United States Patent 7,888,497 (BIOINFORMATICALLY DETECTABLE GROUP OF NOVEL REGULATORY OLIGONUCLEOTIDES AND USES THEREOF) - sequence listing, part 121

SEQ ID NO: 5124984 - DNA, 18 bp, Homo sapiens
acaaagaaacaaaatata

SEQ ID NO: 5124985 - DNA, 18 bp, Homo sapiens
acaaagaaacaaagatgt

SEQ ID NO: 5124986 - DNA, 17 bp, Homo sapiens
acaaagaaacaaagcaa

SEQ ID NO: 5124987 - DNA, 18 bp, Homo sapiens
acaaagaaactttttaat

SEQ ID NO: 5124988 - DNA, 16 bp, Homo sapiens
acaaagaaattatgtg

SEQ ID NO: 5124989 - DNA, 20 bp, Homo sapiens
acaaagaacctaacatttat

SEQ ID NO: 5124990 - DNA, 12 bp, Homo sapiens
acaaagaacctt

SEQ ID NO: 5124991 - DNA, 15 bp, Homo sapiens
acaaagaagaaagct

SEQ ID NO: 5124992 - DNA, 17 bp, Homo sapiens
acaaagaaggaaaagag

SEQ ID NO: 5124993 - DNA, 11 bp, Homo sapiens
acaaagacagg

SEQ ID NO: 5124994 - DNA, 15 bp, Homo sapiens
acaaagacagggaat

SEQ ID NO: 5124995 - DNA, 12 bp, Homo sapiens
acaaagacatgg

SEQ ID NO: 5124996 - DNA, 14 bp, Homo sapiens
acaaagacatggaa

SEQ ID NO: 5124997 - DNA, 11 bp, Homo sapiens
acaaagacatt

SEQ ID NO: 5124998 - DNA, 17 bp, Homo sapiens
acaaagacattcttccc

SEQ ID NO: 5124999 - DNA, 13 bp, Homo sapiens
acaaagacattga

SEQ ID NO: 5125000 - DNA, 20 bp, Homo sapiens
acaaagactccttgtggact

SEQ ID NO: 5125001 - DNA, 18 bp, Homo sapiens
acaaagagaataaagact

SEQ ID NO: 5125002 - DNA, 17 bp, Homo sapiens
acaaagagacaaagctt

SEQ ID NO: 5125003 - DNA, 14 bp, Homo sapiens
acaaagaggacacc

SEQ ID NO: 5125004 - DNA, 20 bp, Homo sapiens
acaaagaggattagacagta

SEQ ID NO: 5125005 - DNA, 14 bp, Homo sapiens
acaaagagtgaaat

SEQ ID NO: 5125006 - DNA, 17 bp, Homo sapiens
acaaagagtgaaatatt

SEQ ID NO: 5125007 - DNA, 16 bp, Homo sapiens
acaaagagttcaagaa

SEQ ID NO: 5125008 - DNA, 22 bp, Homo sapiens
acaaagataacgcaggagagag

SEQ ID NO: 5125009 - DNA, 17 bp, Homo sapiens
acaaagatatcttttct

SEQ ID NO: 5125010 - DNA, 15 bp, Homo sapiens
acaaagatcaaatga

SEQ ID NO: 5125011 - DNA, 24 bp, Homo sapiens
acaaagatgtttgtcagatatgat

SEQ ID NO: 5125012 - DNA, 21 bp, Homo sapiens
acaaagattctccacttggcc

SEQ ID NO: 5125013 - DNA, 14 bp, Homo sapiens
acaaagattgagaa

SEQ ID NO: 5125014 - DNA, 16 bp, Homo sapiens
acaaagattgagaagc

SEQ ID NO: 5125015 - DNA, 17 bp, Homo sapiens
acaaagcaaatttcatt

SEQ ID NO: 5125016 - DNA, 16 bp, Homo sapiens
acaaagcacagtgtta

SEQ ID NO: 5125017 - DNA, 18 bp, Homo sapiens
acaaagcacagtttgaac

SEQ ID NO: 5125018 - DNA, 15 bp, Homo sapiens
acaaagcaccctgta

SEQ ID NO: 5125019 - DNA, 13 bp, Homo sapiens
acaaagcagccac

SEQ ID NO: 5125020 - DNA, 15 bp, Homo sapiens
acaaagcaggagtgg

SEQ ID NO: 5125021 - DNA, 18 bp, Homo sapiens
acaaagcaggagtggaag

SEQ ID NO: 5125022 - DNA, 21 bp, Homo sapiens
acaaagcagtatataataact

SEQ ID NO: 5125023 - DNA, 17 bp, Homo sapiens
acaaagcataatcaata

SEQ ID NO: 5125024 - DNA, 20 bp, Homo sapiens
acaaagcatcattgtaaatt

SEQ ID NO: 5125025 - DNA, 16 bp, Homo sapiens
acaaagcatgctcagt

SEQ ID NO: 5125026 - DNA, 19 bp, Homo sapiens
acaaagcatgggaaaaaga

SEQ ID NO: 5125027 - DNA, 20 bp, Homo sapiens
acaaagccaaacaaaactga

SEQ ID NO: 5125028 - DNA, 13 bp, Homo sapiens
acaaagccctgtc

SEQ ID NO: 5125029 - DNA, 14 bp, Homo sapiens
acaaagccctgtcc

SEQ ID NO: 5125030 - DNA, 23 bp, Homo sapiens
acaaagccttaagcaaattttgt

SEQ ID NO: 5125031 - DNA, 12 bp, Homo sapiens
acaaagccttac

SEQ ID NO: 5125032 - DNA, 23 bp, Homo sapiens
acaaagccttatcaagtgtcttc

SEQ ID NO: 5125033 - DNA, 20 bp, Homo sapiens
acaaagcgagatcccatctc

SEQ ID NO: 5125034 - DNA, 18 bp, Homo sapiens
acaaagcggctttctaat

SEQ ID NO: 5125035 - DNA, 16 bp, Homo sapiens
acaaagctaaatacat

SEQ ID NO: 5125036 - DNA, 20 bp, Homo sapiens
acaaagctaaatacatggaa

SEQ ID NO: 5125037 - DNA, 22 bp, Homo sapiens
acaaagctaggatggttctgtg

SEQ ID NO: 5125038 - DNA, 15 bp, Homo sapiens
acaaagctatttaag

SEQ ID NO: 5125039 - DNA, 16 bp, Homo sapiens
acaaagctatttaagt

SEQ ID NO: 5125040 - DNA, 22 bp, Homo sapiens
acaaagctctgaattcaggtcc

SEQ ID NO: 5125041 - DNA, 23 bp, Homo sapiens
acaaagctctgaattcaggtccc

SEQ ID NO: 5125042 - DNA, 13 bp, Homo sapiens
acaaagctgctaa

SEQ ID NO: 5125043 - DNA, 23 bp, Homo sapiens
acaaagctgctaaatctcctatt

SEQ ID NO: 5125044 - DNA, 17 bp, Homo sapiens
acaaagctgttaaactg

SEQ ID NO: 5125045 - DNA, 19 bp, Homo sapiens
acaaagctgttaaactgtt

SEQ ID NO: 5125046 - DNA, 23 bp, Homo sapiens
acaaagcttctatcccaggaggt

SEQ ID NO: 5125047 - DNA, 19 bp, Homo sapiens
acaaagctttgctacaaat

SEQ ID NO: 5125048 - DNA, 22 bp, Homo sapiens
acaaagctttgctacaaattta

SEQ ID NO: 5125049 - DNA, 13 bp, Homo sapiens
acaaaggaaaaag

SEQ ID NO: 5125050 - DNA, 24 bp, Homo sapiens
acaaaggaaaactcttggcctctg

SEQ ID NO: 5125051 - DNA, 11 bp, Homo sapiens
acaaaggaagt

SEQ ID NO: 5125052 - DNA, 14 bp, Homo sapiens
acaaaggacaaaaa

SEQ ID NO: 5125053 - DNA, 20 bp, Homo sapiens
acaaaggagcattaagccca

SEQ ID NO: 5125054 - DNA, 15 bp, Homo sapiens
acaaaggagcctgtg

SEQ ID NO: 5125055 - DNA, 23 bp, Homo sapiens
acaaaggagcctgtgaacccagg

SEQ ID NO: 5125056 - DNA, 22 bp, Homo sapiens
acaaaggagccttgataatact

SEQ ID NO: 5125057 - DNA, 21 bp, Homo sapiens
acaaaggaggacaagaccctc

SEQ ID NO: 5125058 - DNA, 16 bp, Homo sapiens
acaaaggatgaagaac

SEQ ID NO: 5125059 - DNA, 20 bp, Homo sapiens
acaaaggattaattgctgca

SEQ ID NO: 5125060 - DNA, 16 bp, Homo sapiens
acaaaggcaagactct

SEQ ID NO: 5125061 - DNA, 19 bp, Homo sapiens
acaaaggcaagttaagaga

SEQ ID NO: 5125062 - DNA, 23 bp, Homo sapiens
acaaaggcaagttaagagaaact

SEQ ID NO: 5125063 - DNA, 14 bp, Homo sapiens
acaaaggcagctgt

SEQ ID NO: 5125064 - DNA, 17 bp, Homo sapiens
acaaaggccaaactgct

SEQ ID NO: 5125065 - DNA, 12 bp, Homo sapiens
acaaaggcccag

SEQ ID NO: 5125066 - DNA, 18 bp, Homo sapiens
acaaaggctgacattcac

SEQ ID NO: 5125067 - DNA, 18 bp, Homo sapiens
acaaaggcttattaattt

SEQ ID NO: 5125068 - DNA, 17 bp, Homo sapiens
acaaagggaaagcctct

SEQ ID NO: 5125069 - DNA, 22 bp, Homo sapiens
acaaagggaagcagagcctggg

SEQ ID NO: 5125070 - DNA, 12 bp, Homo sapiens
acaaagggacac

SEQ ID NO: 5125071 - DNA, 19 bp, Homo sapiens
acaaagggacacacagtga

SEQ ID NO: 5125072 - DNA, 18 bp, Homo sapiens
acaaagggagggagcaag

SEQ ID NO: 5125073 - DNA, 18 bp, Homo sapiens
acaaagggattctccagg

SEQ ID NO: 5125074 - DNA, 22 bp, Homo sapiens
acaaagggcacagcatctgtag

SEQ ID NO: 5125075 - DNA, 16 bp, Homo sapiens
acaaagggcaggcctg

SEQ ID NO: 5125076 - DNA, 15 bp, Homo sapiens
acaaagggccatcgt

SEQ ID NO: 5125077 - DNA, 15 bp, Homo sapiens
acaaaggggaaagaa

SEQ ID NO: 5125078 - DNA, 14 bp, Homo sapiens
acaaaggggagaag

SEQ ID NO: 5125079 - DNA, 20 bp, Homo sapiens
acaaaggggagaagggccag

SEQ ID NO: 5125080 - DNA, 19 bp, Homo sapiens
acaaaggggatcataaagt

SEQ ID NO: 5125081 - DNA, 17 bp, Homo sapiens
acaaagggttttaatgt

SEQ ID NO: 5125082 - DNA, 22 bp, Homo sapiens
acaaaggtgaaaattgtttgta

SEQ ID NO: 5125083 - DNA, 19 bp, Homo sapiens
acaaaggtggaataaacat

SEQ ID NO: 5125084 - DNA, 24 bp, Homo sapiens
acaaaggtggaataaacattaatt

SEQ ID NO: 5125085 - DNA, 12 bp, Homo sapiens
acaaaggtggta

SEQ ID NO: 5125086 - DNA, 15 bp, Homo sapiens
acaaaggttccattc

SEQ ID NO: 5125087 - DNA, 18 bp, Homo sapiens
acaaaggttccattcagt

SEQ ID NO: 5125088 - DNA, 21 bp, Homo sapiens
acaaaggttccattcagtgca

SEQ ID NO: 5125089 - DNA, 18 bp, Homo sapiens
acaaaggtttaaatgaac

SEQ ID NO: 5125090 - DNA, 21 bp, Homo sapiens
acaaaggttttcctcttctat

SEQ ID NO: 5125091 - DNA, 14 bp, Homo sapiens
acaaagtaaaatga

SEQ ID NO: 5125092 - DNA, 14 bp, Homo sapiens
acaaagtaaataca

SEQ ID NO: 5125093 - DNA, 20 bp, Homo sapiens
acaaagtaaatacaagactg

SEQ ID NO: 5125094 - DNA, 21 bp, Homo sapiens
acaaagtaaatacaagactgt

SEQ ID NO: 5125095 - DNA, 22 bp, Homo sapiens
acaaagtaaatacaagactgtt

SEQ ID NO: 5125096 - DNA, 15 bp, Homo sapiens
acaaagtaatttctt

SEQ ID NO: 5125097 - DNA, 17 bp, Homo sapiens
acaaagtacagaaaaat

SEQ ID NO: 5125098 - DNA, 23 bp, Homo sapiens
acaaagtactctttaacatacaa

SEQ ID NO: 5125099 - DNA, 17 bp, Homo sapiens
acaaagtagagaagtat

SEQ ID NO: 5125100 - DNA, 22 bp, Homo sapiens
acaaagtatatttaaggattat

SEQ ID NO: 5125101 - DNA, 15 bp, Homo sapiens
acaaagtattaagca

SEQ ID NO: 5125102 - DNA, 22 bp, Homo sapiens
acaaagtcaataaaagagctgt

SEQ ID NO: 5125103 - DNA, 16 bp, Homo sapiens
acaaagtcacagtcgt

SEQ ID NO: 5125104 - DNA, 17 bp, Homo sapiens
acaaagtctaaggaaga

SEQ ID NO: 5125105 - DNA, 15 bp, Homo sapiens
acaaagtctccagcc

SEQ ID NO: 5125106 - DNA, 22 bp, Homo sapiens
acaaagtgaaattagtattttg

SEQ ID NO: 5125107 - DNA, 12 bp, Homo sapiens
acaaagtgcaaa

SEQ ID NO: 5125108 - DNA, 14 bp, Homo sapiens
acaaagtgcaaagc

SEQ ID NO: 5125109 - DNA, 16 bp, Homo sapiens
acaaagtgcaaagctg

SEQ ID NO: 5125110 - DNA, 18 bp, Homo sapiens
acaaagtgcaaagctgct

SEQ ID NO: 5125111 - DNA, 23 bp, Homo sapiens
acaaagtgcaaagctgcttgaat

SEQ ID NO: 5125112 - DNA, 23 bp, Homo sapiens
acaaagtgccaaagaaagtggtc

SEQ ID NO: 5125113 - DNA, 23 bp, Homo sapiens
acaaagtgccgtgataatttttg

SEQ ID NO: 5125114 - DNA, 15 bp, Homo sapiens
acaaagtggaaggaa

SEQ ID NO: 5125115 - DNA, 12 bp, Homo sapiens
aattctttagat

SEQ ID NO: 5125116 - DNA, 21 bp, Homo sapiens
aattctttatcccattttatc

SEQ ID NO: 5125117 - DNA, 16 bp, Homo sapiens
aattctttatttctgt

SEQ ID NO: 5125118 - DNA, 13 bp, Homo sapiens
aattctttcaagt

SEQ ID NO: 5125119 - DNA, 17 bp, Homo sapiens
aattctttcaatacaga

SEQ ID NO: 5125120 - DNA, 18 bp, Homo sapiens
aattctttcaatacagat

SEQ ID NO: 5125121 - DNA, 21 bp, Homo sapiens
aattctttcaatacagatata

SEQ ID NO: 5125122 - DNA, 12 bp, Homo sapiens
aattctttctat

SEQ ID NO: 5125123 - DNA, 19 bp, Homo sapiens
aattctttctattttcaca

SEQ ID NO: 5125124 - DNA, 22 bp, Homo sapiens
aattctttctattttcacaatt

SEQ ID NO: 5125125 - DNA, 12 bp, Homo sapiens
aattctttctca

SEQ ID NO: 5125126 - DNA, 15 bp, Homo sapiens
aattctttctgtctc

SEQ ID NO: 5125127 - DNA, 21 bp, Homo sapiens
aattctttctgttgaaaagca

SEQ ID NO: 5125128 - DNA, 23 bp, Homo sapiens
aattcttttatctttattttagt

SEQ ID NO: 5125129 - DNA, 17 bp, Homo sapiens
aattcttttcctctctt

SEQ ID NO: 5125130 - DNA, 14 bp, Homo sapiens
aattcttttctgag

SEQ ID NO: 5125131 - DNA, 15 bp, Homo sapiens
aattcttttctgagg

SEQ ID NO: 5125132 - DNA, 18 bp, Homo sapiens
aattcttttctgtttctg

SEQ ID NO: 5125133 - DNA, 11 bp, Homo sapiens
aattcttttga

SEQ ID NO: 5125134 - DNA, 17 bp, Homo sapiens
aattcttttgaaagatg

SEQ ID NO: 5125135 - DNA, 23 bp, Homo sapiens
aattcttttgaaagatggtaatc

SEQ ID NO: 5125136 - DNA, 17 bp, Homo sapiens
aattcttttgaattgtt

SEQ ID NO: 5125137 - DNA, 22 bp, Homo sapiens
aattctttttcaaaaattacac

SEQ ID NO: 5125138 - DNA, 14 bp, Homo sapiens
aattcttttttatt

SEQ ID NO: 5125139 - DNA, 22 bp, Homo sapiens
aattgaaaaaagtggaaaacat

SEQ ID NO: 5125140 - DNA, 23 bp, Homo sapiens
aattgaaaaacaattttctgtaa

SEQ ID NO: 5125141 - DNA, 17 bp, Homo sapiens
aattgaaaaactcttta

SEQ ID NO: 5125142 - DNA, 21 bp, Homo sapiens
aattgaaaacactaacaaaat

SEQ ID NO: 5125143 - DNA, 18 bp, Homo sapiens
aattgaaaactttggaga

SEQ ID NO: 5125144 - DNA, 18 bp, Homo sapiens
aattgaaactagttattt

SEQ ID NO: 5125145 - DNA, 21 bp, Homo sapiens
aattgaaagcactatgaattt

SEQ ID NO: 5125146 - DNA, 17 bp, Homo sapiens
aattgaaaggcattctc

SEQ ID NO: 5125147 - DNA, 22 bp, Homo sapiens
aattgaaagggacaagtatcat

SEQ ID NO: 5125148 - DNA, 14 bp, Homo sapiens
aattgaaagtattc

SEQ ID NO: 5125149 - DNA, 13 bp, Homo sapiens
aattgaaatttaa

SEQ ID NO: 5125150 - DNA, 21 bp, Homo sapiens
aattgaaatttttaaatcatt

SEQ ID NO: 5125151 - DNA, 17 bp, Homo sapiens
aattgaacaataaagtt

SEQ ID NO: 5125152 - DNA, 21 bp, Homo sapiens
aattgaacttaaataaatgtc

SEQ ID NO: 5125153 - DNA, 23 bp, Homo sapiens
aattgaagagagatatatctgaa

SEQ ID NO: 5125154 - DNA, 20 bp, Homo sapiens
aattgaagagatttcaacat

SEQ ID NO: 5125155 - DNA, 21 bp, Homo sapiens
aattgaagagatttcaacata

SEQ ID NO: 5125156 - DNA, 13 bp, Homo sapiens
aattgaagcatga

SEQ ID NO: 5125157 - DNA, 18 bp, Homo sapiens
aattgaagccagaccatg

SEQ ID NO: 5125158 - DNA, 18 bp, Homo sapiens
aattgaagctttacttta

SEQ ID NO: 5125159 - DNA, 20 bp, Homo sapiens
aattgaagctttactttaga

SEQ ID NO: 5125160 - DNA, 22 bp, Homo sapiens
aattgaagctttactttagaat

SEQ ID NO: 5125161 - DNA, 21 bp, Homo sapiens
aattgaaggtttttgatagca

SEQ ID NO: 5125162 - DNA, 18 bp, Homo sapiens
aattgaagtaaacttttt

SEQ ID NO: 5125163 - DNA, 21 bp, Homo sapiens
aattgaagtacttaattgaag

SEQ ID NO: 5125164 - DNA, 16 bp, Homo sapiens
aattgaagtcatcata

SEQ ID NO: 5125165 - DNA, 20 bp, Homo sapiens
aattgaagtgtataatataa

SEQ ID NO: 5125166 - DNA, 20 bp, Homo sapiens
aattgaagtttcaagtttta

SEQ ID NO: 5125167 - DNA, 22 bp, Homo sapiens
aattgaataatggtaccagata

SEQ ID NO: 5125168 - DNA, 16 bp, Homo sapiens
aattgaatacacaaat

SEQ ID NO: 5125169 - DNA, 21 bp, Homo sapiens
aattgaatcagtataaacaaa

SEQ ID NO: 5125170 - DNA, 21 bp, Homo sapiens
aattgaattcgtttctgacat

SEQ ID NO: 5125171 - DNA, 20 bp, Homo sapiens
aattgacaagctaggaaaga

SEQ ID NO: 5125172 - DNA, 20 bp, Homo sapiens
aattgacactatatatttct

SEQ ID NO: 5125173 - DNA, 23 bp, Homo sapiens
aattgacactatatatttcttaa

SEQ ID NO: 5125174 - DNA, 23 bp, Homo sapiens
aattgacagatgaaaggagacaa

SEQ ID NO: 5125175 - DNA, 16 bp, Homo sapiens
aattgacatgaccctc

SEQ ID NO: 5125176 - DNA, 20 bp, Homo sapiens
aattgacatgttgtcacatt

SEQ ID NO: 5125177 - DNA, 12 bp, Homo sapiens
aattgacattct

SEQ ID NO: 5125178 - DNA, 16 bp, Homo sapiens
aattgaccaagtgatg

SEQ ID NO: 5125179 - DNA, 18 bp, Homo sapiens
aattgaccatctgctttt

SEQ ID NO: 5125180 - DNA, 21 bp, Homo sapiens
aattgacccacaagaaatgaa

SEQ ID NO: 5125181 - DNA, 17 bp, Homo sapiens
aattgaccctagccaga

SEQ ID NO: 5125182 - DNA, 15 bp, Homo sapiens
aattgactcaaatct

SEQ ID NO: 5125183 - DNA, 13 bp, Homo sapiens
aattgactgaaat

SEQ ID NO: 5125184 - DNA, 18 bp, Homo sapiens
aattgactgaaattactt

SEQ ID NO: 5125185 - DNA, 21 bp, Homo sapiens
aattgactgatgattttcctt

SEQ ID NO: 5125186 - DNA, 14 bp, Homo sapiens
aattgactgtcact

SEQ ID NO: 5125187 - DNA, 14 bp, Homo sapiens
aattgacttagata

SEQ ID NO: 5125188 - DNA, 21 bp, Homo sapiens
aattgacttatttatataaat

SEQ ID NO: 5125189 - DNA, 19 bp, Homo sapiens
aattgacttctattttcct

SEQ ID NO: 5125190 - DNA, 23 bp, Homo sapiens
aattgagaaaaatatatactaaa

SEQ ID NO: 5125191 - DNA, 12 bp, Homo sapiens
aattgagaaaca

SEQ ID NO: 5125192 - DNA, 20 bp, Homo sapiens
aattgagaagcgtatgtttt

SEQ ID NO: 5125193 - DNA, 15 bp, Homo sapiens
aattgagaaggaaaa

SEQ ID NO: 5125194 - DNA, 18 bp, Homo sapiens
aattgagaataagaattt

SEQ ID NO: 5125195 - DNA, 17 bp, Homo sapiens
aattgagaatagaaatt

SEQ ID NO: 5125196 - DNA, 11 bp, Homo sapiens
aattgagaatg

SEQ ID NO: 5125197 - DNA, 18 bp, Homo sapiens
aattgagactgaaagaaa

SEQ ID NO: 5125198 - DNA, 22 bp, Homo sapiens
aattgagagaatggaaaacaga

SEQ ID NO: 5125199 - DNA, 15 bp, Homo sapiens
aattgagagctttat

SEQ ID NO: 5125200 - DNA, 15 bp, Homo sapiens
aattgagattagagg

SEQ ID NO: 5125201 - DNA, 17 bp, Homo sapiens
aattgagcctaaaaata

SEQ ID NO: 5125202 - DNA, 23 bp, Homo sapiens
aattgagcctaaaaataaagcac

SEQ ID NO: 5125203 - DNA, 13 bp, Homo sapiens
aattgagcttaca

SEQ ID NO: 5125204 - DNA, 19 bp, Homo sapiens
aattgaggaaaaactgaca

SEQ ID NO: 5125205 - DNA, 17 bp, Homo sapiens
aattgaggcttacagta

SEQ ID NO: 5125206 - DNA, 17 bp, Homo sapiens
aattgaggggattaata

SEQ ID NO: 5125207 - DNA, 16 bp, Homo sapiens
aattgagtaattctag

SEQ ID NO: 5125208 - DNA, 15 bp, Homo sapiens
aattgagttaaatca

SEQ ID NO: 5125209 - DNA, 22 bp, Homo sapiens
aattgagtttcagaataaaatt

SEQ ID NO: 5125210 - DNA, 16 bp, Homo sapiens
aattgataaaagagtt

SEQ ID NO: 5125211 - DNA, 14 bp, Homo sapiens
aattgataataaac

SEQ ID NO: 5125212 - DNA, 14 bp, Homo sapiens
aattgatacttcag

SEQ ID NO: 5125213 - DNA, 22 bp, Homo sapiens
aattgatagcaggtgtaataag

SEQ ID NO: 5125214 - DNA, 19 bp, Homo sapiens
aattgatccttaaccaata

SEQ ID NO: 5125215 - DNA, 13 bp, Homo sapiens
aattgatctgttt

SEQ ID NO: 5125216 - DNA, 16 bp, Homo sapiens
aattgatctgttttgg

SEQ ID NO: 5125217 - DNA, 13 bp, Homo sapiens
aattgatcttttt

SEQ ID NO: 5125218 - DNA, 21 bp, Homo sapiens
aattgatgatgttgtaaaatg

SEQ ID NO: 5125219 - DNA, 13 bp, Homo sapiens
aattgatggacta

SEQ ID NO: 5125220 - DNA, 21 bp, Homo sapiens
aattgatgtcggtcatagttt

SEQ ID NO: 5125221 - DNA, 14 bp, Homo sapiens
aattgatgtgatta

SEQ ID NO: 5125222 - DNA, 13 bp, Homo sapiens
aattgatgttgat

SEQ ID NO: 5125223 - DNA, 14 bp, Homo sapiens
aattgatgttgatg

SEQ ID NO: 5125224 - DNA, 17 bp, Homo sapiens
aattgatgttgatgcaa

SEQ ID NO: 5125225 - DNA, 13 bp, Homo sapiens
aattgatgtttta

SEQ ID NO: 5125226 - DNA, 20 bp, Homo sapiens
aattgatgttttacgtgcaa

SEQ ID NO: 5125227 - DNA, 14 bp, Homo sapiens
aattgattaaaatc

SEQ ID NO: 5125228 - DNA, 14 bp, Homo sapiens
aattgattattctg

SEQ ID NO: 5125229 - DNA, 18 bp, Homo sapiens
aattgattgaattaaatc

SEQ ID NO: 5125230 - DNA, 23 bp, Homo sapiens
aattgattgggcacatcatttca

SEQ ID NO: 5125231 - DNA, 15 bp, Homo sapiens
aattgattgtcagcc

SEQ ID NO: 5125232 - DNA, 13 bp, Homo sapiens
aattgatttccaa

SEQ ID NO: 5125233 - DNA, 21 bp, Homo sapiens
aattgatttcttttcttcctg

SEQ ID NO: 5125234 - DNA, 16 bp, Homo sapiens
aattgatttgcattga

SEQ ID NO: 5125235 - DNA, 14 bp, Homo sapiens
aattgattttgaac

SEQ ID NO: 5125236 - DNA, 21 bp, Homo sapiens
aattgatttttaaacagcagg

SEQ ID NO: 5125237 - DNA, 19 bp, Homo sapiens
aattgatttttctcttcat

SEQ ID NO: 5125238 - DNA, 20 bp, Homo sapiens
aattgcaaaaacatagaaat

SEQ ID NO: 5125239 - DNA, 17 bp, Homo sapiens
aattgcaaaactagaca

SEQ ID NO: 5125240 - DNA, 19 bp, Homo sapiens
aattgcaaaactagacaaa

SEQ ID NO: 5125241 - DNA, 14 bp, Homo sapiens
aattgcaacaatgc

SEQ ID NO: 5125242 - DNA, 16 bp, Homo sapiens
aattgcaacaatgcaa

SEQ ID NO: 5125243 - DNA, 23 bp, Homo sapiens
aattgcaacaatgcaaaagccaa

SEQ ID NO: 5125244 - DNA, 15 bp, Homo sapiens
aattgcaagggaaga

SEQ ID NO: 5125245 - DNA, 18 bp, Homo sapiens
aattgcaatatataagac

SEQ ID NO: 5125246 - DNA, 13 bp, Homo sapiens
aattgcaatttct

SEQ ID NO: 5125247 - DNA, 15 bp, Homo sapiens
aattgcacaaataca

SEQ ID NO: 5125248 - DNA, 16 bp, Homo sapiens
aattgcacaaatacaa

SEQ ID NO: 5125249 - DNA, 21 bp, Homo sapiens
aattgcacaatttgagcaatt

SEQ ID NO: 5125250 - DNA, 20 bp, Homo sapiens
aattgcacagaagtcctgta

SEQ ID NO: 5125251 - DNA, 14 bp, Homo sapiens
aattgcacatctaa

SEQ ID NO: 5125252 - DNA, 22 bp, Homo sapiens
aattgcacgcggagtgagtttt

SEQ ID NO: 5125253 - DNA, 17 bp, Homo sapiens
aattgcactcatgtgga

SEQ ID NO: 5125254 - DNA, 13 bp, Homo sapiens
aattgcactgaag

SEQ ID NO: 5125255 - DNA, 20 bp, Homo sapiens
aattgcactgaagtttttga

SEQ ID NO: 5125256 - DNA, 21 bp, Homo sapiens
aattgcactgaagtttttgaa

SEQ ID NO: 5125257 - DNA, 23 bp, Homo sapiens
aattgcactgaagtttttgaaat

SEQ ID NO: 5125258 - DNA, 21 bp, Homo sapiens
aattgcagtaaagtcttgtct

SEQ ID NO: 5125259 - DNA, 16 bp, Homo sapiens
aattgcataaagcata

SEQ ID NO: 5125260 - DNA, 16 bp, Homo sapiens
aattgcatactttgta

SEQ ID NO: 5125261 - DNA, 22 bp, Homo sapiens
aattgcatactttgtattttga

SEQ ID NO: 5125262 - DNA, 19 bp, Homo sapiens
aattgcatcagttcattga

SEQ ID NO: 5125263 - DNA, 23 bp, Homo sapiens
aattgcatcagttcattgacctc

SEQ ID NO: 5125264 - DNA, 15 bp, Homo sapiens
aattgcatgaaaata

SEQ ID NO: 5125265 - DNA, 22 bp, Homo sapiens
aattgcatgctgctttaattgt

SEQ ID NO: 5125266 - DNA, 21 bp, Homo sapiens
aattgcattcattgacttcag

SEQ ID NO: 5125267 - DNA, 20 bp, Homo sapiens
aattgcattctgaatgaata

SEQ ID NO: 5125268 - DNA, 21 bp, Homo sapiens
aattgcatttctatgccattt

SEQ ID NO: 5125269 - DNA, 17 bp, Homo sapiens
aattgcatttttacctt

SEQ ID NO: 5125270 - DNA, 23 bp, Homo sapiens
aattgccaacataagttaataga

SEQ ID NO: 5125271 - DNA, 15 bp, Homo sapiens
aattgccaatcttgt

SEQ ID NO: 5125272 - DNA, 16 bp, Homo sapiens
aattgccaatcttgtt

SEQ ID NO: 5125273 - DNA, 23 bp, Homo sapiens
aattgccacctctaacagcacca

SEQ ID NO: 5125274 - DNA, 12 bp, Homo sapiens
aattgccagctg

SEQ ID NO: 5125275 - DNA, 19 bp, Homo sapiens
aattgccatagaaagtata

SEQ ID NO: 5125276 - DNA, 20 bp, Homo sapiens
aattgccatagaaagtataa

SEQ ID NO: 5125277 - DNA, 20 bp, Homo sapiens
aattgccatgtacagtatgt

SEQ ID NO: 5125278 - DNA, 22 bp, Homo sapiens
aattgccattttattaaacatt

SEQ ID NO: 5125279 - DNA, 17 bp, Homo sapiens
aattgccctatgctgtg

SEQ ID NO: 5125280 - DNA, 14 bp, Homo sapiens
aattgccctgccag

SEQ ID NO: 5125281 - DNA, 15 bp, Homo sapiens
aattgccctgttgcc

SEQ ID NO: 5125282 - DNA, 15 bp, Homo sapiens
aattgcctacattta

SEQ ID NO: 5125283 - DNA, 20 bp, Homo sapiens
aattgcctataatacttgca

SEQ ID NO: 5125284 - DNA, 22 bp, Homo sapiens
aattgcctataatacttgcaac

SEQ ID NO: 5125285 - DNA, 13 bp, Homo sapiens
aattgcctccctt

SEQ ID NO: 5125286 - DNA, 23 bp, Homo sapiens
aattgcctgacgaactccttgat

SEQ ID NO: 5125287 - DNA, 14 bp, Homo sapiens
aattgcctgatttg

SEQ ID NO: 5125288 - DNA, 13 bp, Homo sapiens
aattgcctgttaa

SEQ ID NO: 5125289 - DNA, 15 bp, Homo sapiens
aattgcctgttcata

SEQ ID NO: 5125290 - DNA, 15 bp, Homo sapiens
aattgcctttaaaac

SEQ ID NO: 5125291 - DNA, 14 bp, Homo sapiens
aattgcctttctgt

SEQ ID NO: 5125292 - DNA, 20 bp, Homo sapiens
acaaagtgggtactttctga

SEQ ID NO: 5125293 - DNA, 13 bp, Homo sapiens
acaaagtgttgaa

SEQ ID NO: 5125294 - DNA, 16 bp, Homo sapiens
acaaagtgttgaaaat

SEQ ID NO: 5125295 - DNA, 18 bp, Homo sapiens
acaaagttacaaattcaa

SEQ ID NO: 5125296 - DNA, 14 bp, Homo sapiens
acaaagttcactgt

SEQ ID NO: 5125297 - DNA, 18 bp, Homo sapiens
acaaagttcactgtttat

SEQ ID NO: 5125298 - DNA, 22 bp, Homo sapiens
acaaagttgattaagaaaggaa

SEQ ID NO: 5125299 - DNA, 19 bp, Homo sapiens
acaaagtttaccagaaagc

SEQ ID NO: 5125300 - DNA, 18 bp, Homo sapiens
acaaagtttatcttggcc

SEQ ID NO: 5125301 - DNA, 19 bp, Homo sapiens
acaaagtttcagagtatat

SEQ ID NO: 5125302 - DNA, 12 bp, Homo sapiens
acaaataaacag

SEQ ID NO: 5125303 - DNA, 17 bp, Homo sapiens
acaaataaacagttgtt

SEQ ID NO: 5125304 - DNA, 11 bp, Homo sapiens
acaaataaacc

SEQ ID NO: 5125305 - DNA, 15 bp, Homo sapiens
acaaataaacctgag

SEQ ID NO: 5125306 - DNA, 17 bp, Homo sapiens
acaaataaacctgaggc

SEQ ID NO: 5125307 - DNA, 18 bp, Homo sapiens
acaaataaacctgaggca

SEQ ID NO: 5125308 - DNA, 14 bp, Homo sapiens
acaaataaagatgg

SEQ ID NO: 5125309 - DNA, 18 bp, Homo sapiens
acaaataaatagttgctc

SEQ ID NO: 5125310 - DNA, 23 bp, Homo sapiens
acaaataacaacttttttttctt

SEQ ID NO: 5125311 - DNA, 16 bp, Homo sapiens
acaaataagattaata

SEQ ID NO: 5125312 - DNA, 11 bp, Homo sapiens
acaaataattt

SEQ ID NO: 5125313 - DNA, 15 bp, Homo sapiens
acaaatacacataca

SEQ ID NO: 5125314 - DNA, 16 bp, Homo sapiens
acaaatacacatacat

SEQ ID NO: 5125315 - DNA, 14 bp, Homo sapiens
acaaatacatgtgt

SEQ ID NO: 5125316 - DNA, 22 bp, Homo sapiens
acaaatacattcaaattctttt

SEQ ID NO: 5125317 - DNA, 15 bp, Homo sapiens
acaaataccagagca

SEQ ID NO: 5125318 - DNA, 12 bp, Homo sapiens
acaaatacctcc

SEQ ID NO: 5125319 - DNA, 22 bp, Homo sapiens
acaaatacctccattaaatggt

SEQ ID NO: 5125320 - DNA, 16 bp, Homo sapiens
acaaatactaaaaaga

SEQ ID NO: 5125321 - DNA, 14 bp, Homo sapiens
acaaatactcatgt

SEQ ID NO: 5125322 - DNA, 16 bp, Homo sapiens
acaaatactcatgtgt

SEQ ID NO: 5125323 - DNA, 15 bp, Homo sapiens
acaaatactcttagg

SEQ ID NO: 5125324 - DNA, 17 bp, Homo sapiens
acaaatactcttaggaa

SEQ ID NO: 5125325 - DNA, 23 bp, Homo sapiens
acaaatactcttaggaagagaaa

SEQ ID NO: 5125326 - DNA, 16 bp, Homo sapiens
acaaatactgcctagt

SEQ ID NO: 5125327 - DNA, 15 bp, Homo sapiens
acaaatacttattca

SEQ ID NO: 5125328 - DNA, 16 bp, Homo sapiens
acaaatacttattcat

SEQ ID NO: 5125329 - DNA, 15 bp, Homo sapiens
acaaatacttccata

SEQ ID NO: 5125330 - DNA, 13 bp, Homo sapiens
acaaatagaaaat

SEQ ID NO: 5125331 - DNA, 22 bp, Homo sapiens
acaaataggtagagtcattcat

SEQ ID NO: 5125332 - DNA, 21 bp, Homo sapiens
acaaatagtaggcaagatggc

SEQ ID NO: 5125333 - DNA, 20 bp, Homo sapiens
acaaatagtgcaactatgaa

SEQ ID NO: 5125334 - DNA, 19 bp, Homo sapiens
acaaatagtgctaataaag

SEQ ID NO: 5125335 - DNA, 16 bp, Homo sapiens
acaaatataagaataa

SEQ ID NO: 5125336 - DNA, 18 bp, Homo sapiens
acaaatatactcatttgg

SEQ ID NO: 5125337 - DNA, 22 bp, Homo sapiens
acaaatatgaaaaatgtaaata

SEQ ID NO: 5125338 - DNA, 15 bp, Homo sapiens
acaaatatgctttgg

SEQ ID NO: 5125339 - DNA, 19 bp, Homo sapiens
acaaatattcactggcccc

SEQ ID NO: 5125340 - DNA, 13 bp, Homo sapiens
acaaatattcaga

SEQ ID NO: 5125341 - DNA, 19 bp, Homo sapiens
acaaatattgcttggacta

SEQ ID NO: 5125342 - DNA, 22 bp, Homo sapiens
acaaatattgtcatctttttct

SEQ ID NO: 5125343 - DNA, 22 bp, Homo sapiens
acaaatattgttaccatgaaga

SEQ ID NO: 5125344 - DNA, 18 bp, Homo sapiens
acaaatatttattttctt

SEQ ID NO: 5125345 - DNA, 23 bp, Homo sapiens
acaaatatttattttctttctgt

SEQ ID NO: 5125346 - DNA, 13 bp, Homo sapiens
acaaatatttcac

SEQ ID NO: 5125347 - DNA, 20 bp, Homo sapiens
acaaatatttctagacactt

SEQ ID NO: 5125348 - DNA, 13 bp, Homo sapiens
acaaatattttca

SEQ ID NO: 5125349 - DNA, 14 bp, Homo sapiens
acaaatattttcat

SEQ ID NO: 5125350 - DNA, 17 bp, Homo sapiens
acaaatcacacctctgg

SEQ ID NO: 5125351 - DNA, 23 bp, Homo sapiens
acaaatcagaagtcatcttgcta

SEQ ID NO: 5125352 - DNA, 12 bp, Homo sapiens
acaaatcagtaa

SEQ ID NO: 5125353 - DNA, 13 bp, Homo sapiens
acaaatcagtaat

SEQ ID NO: 5125354 - DNA, 16 bp, Homo sapiens
acaaatcagtaatttt

SEQ ID NO: 5125355 - DNA, 15 bp, Homo sapiens
acaaatcataatgta

SEQ ID NO: 5125356 - DNA, 18 bp, Homo sapiens
acaaatcattttgatgta

SEQ ID NO: 5125357 - DNA, 21 bp, Homo sapiens
acaaatccaaaggaaagaata

SEQ ID NO: 5125358 - DNA, 12 bp, Homo sapiens
acaaatccacga

SEQ ID NO: 5125359 - DNA, 17 bp, Homo sapiens
acaaatcgtttctcaga

SEQ ID NO: 5125360 - DNA, 15 bp, Homo sapiens
acaaatctataaata

SEQ ID NO: 5125361 - DNA, 23 bp, Homo sapiens
acaaatctatattaaagtgttat

SEQ ID NO: 5125362 - DNA, 21 bp, Homo sapiens
acaaatctatgccactcagaa

SEQ ID NO: 5125363 - DNA, 14 bp, Homo sapiens
acaaatctatttaa

SEQ ID NO: 5125364 - DNA, 12 bp, Homo sapiens
acaaatctcaga

SEQ ID NO: 5125365 - DNA, 16 bp, Homo sapiens
acaaatctcagaacct

SEQ ID NO: 5125366 - DNA, 15 bp, Homo sapiens
acaaatctgtataaa

SEQ ID NO: 5125367 - DNA, 18 bp, Homo sapiens
acaaatctgtataaatgt

SEQ ID NO: 5125368 - DNA, 17 bp, Homo sapiens
acaaatctgtgtatatt

SEQ ID NO: 5125369 - DNA, 19 bp, Homo sapiens
acaaatcttgggtgggtga

SEQ ID NO: 5125370 - DNA, 15 bp, Homo sapiens
acaaatctttccata

SEQ ID NO: 5125371 - DNA, 11 bp, Homo sapiens
acaaatgaaaa

SEQ ID NO: 5125372 - DNA, 14 bp, Homo sapiens
acaaatgaaaacaa

SEQ ID NO: 5125373 - DNA, 21 bp, Homo sapiens
acaaatgaaagagaaaatata

SEQ ID NO: 5125374 - DNA, 21 bp, Homo sapiens
acaaatgaaatttaattacaa

SEQ ID NO: 5125375 - DNA, 21 bp, Homo sapiens
acaaatgaagaaagtcaaaaa

SEQ ID NO: 5125376 - DNA, 20 bp, Homo sapiens
acaaatgaagtatttcatgt

SEQ ID NO: 5125377 - DNA, 19 bp, Homo sapiens
acaaatgacagattctgac

SEQ ID NO: 5125378 - DNA, 17 bp, Homo sapiens
acaaatgactgtctctt

SEQ ID NO: 5125379 - DNA, 16 bp, Homo sapiens
acaaatgactttatta

SEQ ID NO: 5125380 - DNA, 21 bp, Homo sapiens
acaaatgattgcttttaaaat

SEQ ID NO: 5125381 - DNA, 18 bp, Homo sapiens
acaaatgcagacacacaa

SEQ ID NO: 5125382 - DNA, 16 bp, Homo sapiens
acaaatgcagtgtatt

SEQ ID NO: 5125383 - DNA, 16 bp, Homo sapiens
acaaatgcatctttga

SEQ ID NO: 5125384 - DNA, 15 bp, Homo sapiens
acaaatgcatttagt

SEQ ID NO: 5125385 - DNA, 16 bp, Homo sapiens
acaaatgccacacatc

SEQ ID NO: 5125386 - DNA, 20 bp, Homo sapiens
acaaatgccacacatcaccc

SEQ ID NO: 5125387 - DNA, 19 bp, Homo sapiens
acaaatgccttgaactgtt

SEQ ID NO: 5125388 - DNA, 23 bp, Homo sapiens
acaaatgccttgaactgttgtct

SEQ ID NO: 5125389 - DNA, 21 bp, Homo sapiens
acaaatgctcaaagaaatcta

SEQ ID NO: 5125390 - DNA, 22 bp, Homo sapiens
acaaatgctgcgcccttcccca

SEQ ID NO: 5125391 - DNA, 21 bp, Homo sapiens
acaaatgctggggtcatataa

SEQ ID NO: 5125392 - DNA, 12 bp, Homo sapiens
acaaatgcttta

SEQ ID NO: 5125393 - DNA, 15 bp, Homo sapiens
acaaatggaagagaa

SEQ ID NO: 5125394 - DNA, 15 bp, Homo sapiens
acaaatggacatagg

SEQ ID NO: 5125395 - DNA, 22 bp, Homo sapiens
acaaatggctacatctccaaat

SEQ ID NO: 5125396 - DNA, 19 bp, Homo sapiens
acaaatggctgtaaaacta

SEQ ID NO: 5125397 - DNA, 21 bp, Homo sapiens
acaaatgggactgatgtcatc

SEQ ID NO: 5125398 - DNA, 22 bp, Homo sapiens
acaaatgggactgatgtcatct

SEQ ID NO: 5125399 - DNA, 19 bp, Homo sapiens
acaaatgggttaatcctga

SEQ ID NO: 5125400 - DNA, 18 bp, Homo sapiens
acaaatgtaaacattttc

SEQ ID NO: 5125401 - DNA, 12 bp, Homo sapiens
acaaatgtcatt

SEQ ID NO: 5125402 - DNA, 14 bp, Homo sapiens
acaaatgtcattgt

SEQ ID NO: 5125403 - DNA, 16 bp, Homo sapiens
acaaatgtcattgtct

SEQ ID NO: 5125404 - DNA, 17 bp, Homo sapiens
acaaatgtcctcagagg

SEQ ID NO: 5125405 - DNA, 15 bp, Homo sapiens
acaaatgtgaagatg

SEQ ID NO: 5125406 - DNA, 12 bp, Homo sapiens
acaaatgtgata

SEQ ID NO: 5125407 - DNA, 14 bp, Homo sapiens
acaaatgtgatttt

SEQ ID NO: 5125408 - DNA, 17 bp, Homo sapiens
acaaatgtgctctatgt

SEQ ID NO: 5125409 - DNA, 18 bp, Homo sapiens
acaaatgtgctctatgtc

SEQ ID NO: 5125410 - DNA, 14 bp, Homo sapiens
acaaatgtgtatgt

SEQ ID NO: 5125411 - DNA, 21 bp, Homo sapiens
acaaatgtgtatttttgttgc

SEQ ID NO: 5125412 - DNA, 18 bp, Homo sapiens
acaaatgtgtcccagtga

SEQ ID NO: 5125413 - DNA, 14 bp, Homo sapiens
acaaatgtgtgact

SEQ ID NO: 5125414 - DNA, 22 bp, Homo sapiens
acaaatgtgtgggtttttaaaa

SEQ ID NO: 5125415 - DNA, 18 bp, Homo sapiens
acaaatgtgtttttctat

SEQ ID NO: 5125416 - DNA, 23 bp, Homo sapiens
acaaatgttcatatttattgatt

SEQ ID NO: 5125417 - DNA, 15 bp, Homo sapiens
acaaatgtttataac

SEQ ID NO: 5125418 - DNA, 22 bp, Homo sapiens
acaaatgtttataactctaggg

SEQ ID NO: 5125419 - DNA, 23 bp, Homo sapiens
acaaatgtttataactctaggga

SEQ ID NO: 5125420 - DNA, 13 bp, Homo sapiens
acaaatgttttaa

SEQ ID NO: 5125421 - DNA, 22 bp, Homo sapiens
acaaatgttttagtaaaaaaga

SEQ ID NO: 5125422 - DNA, 17 bp, Homo sapiens
acaaatgttttcattta

SEQ ID NO: 5125423 - DNA, 13 bp, Homo sapiens
acaaatgttttgc

SEQ ID NO: 5125424 - DNA, 14 bp, Homo sapiens
acaaatgttttgct

SEQ ID NO: 5125425 - DNA, 16 bp, Homo sapiens
acaaattaaaaagatt

SEQ ID NO: 5125426 - DNA, 21 bp, Homo sapiens
acaaattaaaaagattctttt

SEQ ID NO: 5125427 - DNA, 15 bp, Homo sapiens
acaaattaatatttg

SEQ ID NO: 5125428 - DNA, 17 bp, Homo sapiens
acaaattaatatttgtg

SEQ ID NO: 5125429 - DNA, 20 bp, Homo sapiens
acaaattaatatttgtgctt

SEQ ID NO: 5125430 - DNA, 18 bp, Homo sapiens
acaaattacaaaaggctc

SEQ ID NO: 5125431 - DNA, 22 bp, Homo sapiens
acaaattagaaaatgttattta

SEQ ID NO: 5125432 - DNA, 15 bp, Homo sapiens
acaaattagaggaga

SEQ ID NO: 5125433 - DNA, 19 bp, Homo sapiens
acaaattagcatgcaagct

SEQ ID NO: 5125434 - DNA, 16 bp, Homo sapiens
acaaattataatgtat

SEQ ID NO: 5125435 - DNA, 17 bp, Homo sapiens
acaaattataatgtatt

SEQ ID NO: 5125436 - DNA, 10 bp, Homo sapiens
acaaattatg

SEQ ID NO: 5125437 - DNA, 22 bp, Homo sapiens
acaaattcaagagctagaaaaa

SEQ ID NO: 5125438 - DNA, 22 bp, Homo sapiens
acaaattcaaggagatataaaa

SEQ ID NO: 5125439 - DNA, 15 bp, Homo sapiens
acaaattcagtctct

SEQ ID NO: 5125440 - DNA, 21 bp, Homo sapiens
acaaattcagtggacatttgt

SEQ ID NO: 5125441 - DNA, 17 bp, Homo sapiens
acaaattcctttcagag

SEQ ID NO: 5125442 - DNA, 18 bp, Homo sapiens
acaaattcctttcagagt

SEQ ID NO: 5125443 - DNA, 21 bp, Homo sapiens
acaaattctgaatattttttg

SEQ ID NO: 5125444 - DNA, 13 bp, Homo sapiens
acaaattctttag

SEQ ID NO: 5125445 - DNA, 23 bp, Homo sapiens
acaaattctttagtactcaatgt

SEQ ID NO: 5125446 - DNA, 15 bp, Homo sapiens
acaaattgagacagt

SEQ ID NO: 5125447 - DNA, 12 bp, Homo sapiens
acaaattgcatt

SEQ ID NO: 5125448 - DNA, 14 bp, Homo sapiens
acaaatttaaaaca

SEQ ID NO: 5125449 - DNA, 20 bp, Homo sapiens
acaaatttagccaataaaga

SEQ ID NO: 5125450 - DNA, 13 bp, Homo sapiens
acaaatttataaa

SEQ ID NO: 5125451 - DNA, 14 bp, Homo sapiens
acaaatttataaag

SEQ ID NO: 5125452 - DNA, 18 bp, Homo sapiens
acaaatttatgcatttca

SEQ ID NO: 5125453 - DNA, 22 bp, Homo sapiens
acaaatttatgcatttcattca

SEQ ID NO: 5125454 - DNA, 16 bp, Homo sapiens
acaaatttcattgcac

SEQ ID NO: 5125455 - DNA, 21 bp, Homo sapiens
acaaatttggccttaagaact

SEQ ID NO: 5125456 - DNA, 22 bp, Homo sapiens
acaaatttggccttaagaactg

SEQ ID NO: 5125457 - DNA, 17 bp, Homo sapiens
acaaattttcaagttta

SEQ ID NO: 5125458 - DNA, 15 bp, Homo sapiens
acaaattttcacaat

SEQ ID NO: 5125459 - DNA, 20 bp, Homo sapiens
acaaattttcccagtgaata

SEQ ID NO: 5125460 - DNA, 15 bp, Homo sapiens
acaaattttgcatat

SEQ ID NO: 5125461 - DNA, 16 bp, Homo sapiens
acaaattttgcatatt

SEQ ID NO: 5125462 - DNA, 16 bp, Homo sapiens
acaaattttgtataac

SEQ ID NO: 5125463 - DNA, 15 bp, Homo sapiens
acaaatttttactca

SEQ ID NO: 5125464 - DNA, 18 bp, Homo sapiens
acaaatttttatttctaa

SEQ ID NO: 5125465 - DNA, 14 bp, Homo sapiens
acaaatttttctgt

SEQ ID NO: 5125466 - DNA, 16 bp, Homo sapiens
acaaatttttctgtgg

SEQ ID NO: 5125467 - DNA, 17 bp, Homo sapiens
acaaattttttaatttc

SEQ ID NO: 5125468 - DNA, 23 bp, Homo sapiens
acaaattttttaatttccaaaat

SEQ ID NO: 5125469 - DNA, 9 bp, Homo sapiens
acaacaaaa

SEQ ID NO: 5125470 - DNA, 14 bp, Homo sapiens
acaacaaaaaataa

SEQ ID NO: 5125471 - DNA, 19 bp, Homo sapiens
aattgcctttctgtgttta

SEQ ID NO: 5125472 - DNA, 13 bp, Homo sapiens
aattgcctttgag

SEQ ID NO: 5125473 - DNA, 23 bp, Homo sapiens
aattgccttttttctgtataaat

SEQ ID NO: 5125474 - DNA, 14 bp, Homo sapiens
aattgcgctcaggg

SEQ ID NO: 5125475 - DNA, 15 bp, Homo sapiens
aattgcgctcagggg

SEQ ID NO: 5125476 - DNA, 16 bp, Homo sapiens
aattgcgctcaggggc

SEQ ID NO: 5125477 - DNA, 20 bp, Homo sapiens
aattgcgctcaggggctcca

SEQ ID NO: 5125478 - DNA, 15 bp, Homo sapiens
aattgctaacaattg

SEQ ID NO: 5125479 - DNA, 14 bp, Homo sapiens
aattgctaattctg

SEQ ID NO: 5125480 - DNA, 15 bp, Homo sapiens
aattgctaattctga

SEQ ID NO: 5125481 - DNA, 16 bp, Homo sapiens
aattgctacatctaaa

SEQ ID NO: 5125482 - DNA, 19 bp, Homo sapiens
aattgctagtcagggtgaa

SEQ ID NO: 5125483 - DNA, 12 bp, Homo sapiens
aattgctataaa

SEQ ID NO: 5125484 - DNA, 13 bp, Homo sapiens
aattgctatgtta

SEQ ID NO: 5125485 - DNA, 21 bp, Homo sapiens
aattgctatgttactattttc

SEQ ID NO: 5125486 - DNA, 15 bp, Homo sapiens
aattgctattttatt

SEQ ID NO: 5125487 - DNA, 17 bp, Homo sapiens
aattgctcacagttatt

SEQ ID NO: 5125488 - DNA, 18 bp, Homo sapiens
aattgctcataagcaata

SEQ ID NO: 5125489 - DNA, 15 bp, Homo sapiens
aattgctccattcct

SEQ ID NO: 5125490 - DNA, 23 bp, Homo sapiens
aattgctcctgcatgcaactaat

SEQ ID NO: 5125491 - DNA, 21 bp, Homo sapiens
aattgctctatgcctcagttt

SEQ ID NO: 5125492 - DNA, 19 bp, Homo sapiens
aattgctctgtgtatatct

SEQ ID NO: 5125493 - DNA, 21 bp, Homo sapiens
aattgctctgtgtatatctct

SEQ ID NO: 5125494 - DNA, 23 bp, Homo sapiens
aattgctcttggctgtgaaaaga

SEQ ID NO: 5125495 - DNA, 23 bp, Homo sapiens
aattgctctttcacaggtagcct

SEQ ID NO: 5125496 - DNA, 21 bp, Homo sapiens
aattgctgaagggcattcttt

SEQ ID NO: 5125497 - DNA, 19 bp, Homo sapiens
aattgctgaggagctcagg

SEQ ID NO: 5125498 - DNA, 21 bp, Homo sapiens
aattgctggaacccaggaggt

SEQ ID NO: 5125499 - DNA, 17 bp, Homo sapiens
aattgctggatgcattt

SEQ ID NO: 5125500 - DNA, 19 bp, Homo sapiens
aattgctggatgcattttt

SEQ ID NO: 5125501 - DNA, 18 bp, Homo sapiens
aattgctgttgaaagcaa

SEQ ID NO: 5125502 - DNA, 20 bp, Homo sapiens
aattgctgttgaaagcaaaa

SEQ ID NO: 5125503 - DNA, 17 bp, Homo sapiens
aattgcttaaaagacat

SEQ ID NO: 5125504 - DNA, 19 bp, Homo sapiens
aattgcttaccaaaggata

SEQ ID NO: 5125505 - DNA, 19 bp, Homo sapiens
aattgcttactcattaaaa

SEQ ID NO: 5125506 - DNA, 23 bp, Homo sapiens
aattgcttactttggaatacatt

SEQ ID NO: 5125507 - DNA, 14 bp, Homo sapiens
aattgcttctaaaa

SEQ ID NO: 5125508 - DNA, 20 bp, Homo sapiens
aattgcttgaacccaggagg

SEQ ID NO: 5125509 - DNA, 16 bp, Homo sapiens
aattgcttgaacctgt

SEQ ID NO: 5125510 - DNA, 21 bp, Homo sapiens
aattgcttgagcatgcccaaa

SEQ ID NO: 5125511 - DNA, 16 bp, Homo sapiens
aattgcttgtttgctt

SEQ ID NO: 5125512 - DNA, 17 bp, Homo sapiens
aattgctttaaatctta

SEQ ID NO: 5125513 - DNA, 13 bp, Homo sapiens
aattgctttgaag

SEQ ID NO: 5125514 - DNA, 15 bp, Homo sapiens
aattgctttgccaaa

SEQ ID NO: 5125515 - DNA, 21 bp, Homo sapiens
aattgctttgccaaaatacca

SEQ ID NO: 5125516 - DNA, 16 bp, Homo sapiens
aattgctttgtgcctt

SEQ ID NO: 5125517 - DNA, 16 bp, Homo sapiens
aattgcttttgttgtg

SEQ ID NO: 5125518 - DNA, 17 bp, Homo sapiens
aattgcttttttaaata

SEQ ID NO: 5125519 - DNA, 13 bp, Homo sapiens
aattggaaagact

SEQ ID NO: 5125520 - DNA, 17 bp, Homo sapiens
aattggaacaaagtgaa

SEQ ID NO: 5125521 - DNA, 14 bp, Homo sapiens
aattggaactgcaa

SEQ ID NO: 5125522 - DNA, 16 bp, Homo sapiens
aattggaaggagaggg

SEQ ID NO: 5125523 - DNA, 19 bp, Homo sapiens
aattggaatcttcacctca

SEQ ID NO: 5125524 - DNA, 22 bp, Homo sapiens
aattggacagttttgatacaaa

SEQ ID NO: 5125525 - DNA, 18 bp, Homo sapiens
aattggaccatcctattt

SEQ ID NO: 5125526 - DNA, 17 bp, Homo sapiens
aattggactctgtcaca

SEQ ID NO: 5125527 - DNA, 19 bp, Homo sapiens
aattggagaaaagcactta

SEQ ID NO: 5125528 - DNA, 23 bp, Homo sapiens
aattggagggtcttgaggggaag

SEQ ID NO: 5125529 - DNA, 20 bp, Homo sapiens
aattggagtatctaaagcca

SEQ ID NO: 5125530 - DNA, 22 bp, Homo sapiens
aattggagtctcaaaatcaact

SEQ ID NO: 5125531 - DNA, 22 bp, Homo sapiens
aattggatattgatgaaatcat

SEQ ID NO: 5125532 - DNA, 14 bp, Homo sapiens
aattggattattac

SEQ ID NO: 5125533 - DNA, 23 bp, Homo sapiens
aattggcagattgttttttccta

SEQ ID NO: 5125534 - DNA, 11 bp, Homo sapiens
aattggcagca

SEQ ID NO: 5125535 - DNA, 19 bp, Homo sapiens
aattggcagcacccactca

SEQ ID NO: 5125536 - DNA, 16 bp, Homo sapiens
aattggcagtgacttt

SEQ ID NO: 5125537 - DNA, 15 bp, Homo sapiens
aattggccagagcct

SEQ ID NO: 5125538 - DNA, 23 bp, Homo sapiens
aattggccagaggaaatctgaat

SEQ ID NO: 5125539 - DNA, 14 bp, Homo sapiens
aattggccatgtcg

SEQ ID NO: 5125540 - DNA, 12 bp, Homo sapiens
aattggcctgaa

SEQ ID NO: 5125541 - DNA, 12 bp, Homo sapiens
aattggctcctt

SEQ ID NO: 5125542 - DNA, 16 bp, Homo sapiens
aattggctcctttccc

SEQ ID NO: 5125543 - DNA, 22 bp, Homo sapiens
aattggcttattttttaaaata

SEQ ID NO: 5125544 - DNA, 15 bp, Homo sapiens
aattggcttccttga

SEQ ID NO: 5125545 - DNA, 16 bp, Homo sapiens
aattgggacaacagtg

SEQ ID NO: 5125546 - DNA, 18 bp, Homo sapiens
aattgggatctgtcttgg

SEQ ID NO: 5125547 - DNA, 23 bp, Homo sapiens
aattgggattttaaaaacatgag

SEQ ID NO: 5125548 - DNA, 16 bp, Homo sapiens
aattgggcactattta

SEQ ID NO: 5125549 - DNA, 16 bp, Homo sapiens
aattgggccagctttt

SEQ ID NO: 5125550 - DNA, 19 bp, Homo sapiens
aattgggcccttagaatgt

SEQ ID NO: 5125551 - DNA, 13 bp, Homo sapiens
aattggggaggga

SEQ ID NO: 5125552 - DNA, 17 bp, Homo sapiens
aattggggattcttaaa

SEQ ID NO: 5125553 - DNA, 20 bp, Homo sapiens
aattggggattcttaaagtt

SEQ ID NO: 5125554 - DNA, 22 bp, Homo sapiens
aattgggggggtgcccggggat

SEQ ID NO: 5125555 - DNA, 21 bp, Homo sapiens
aattgggtggggggcttcata

SEQ ID NO: 5125556 - DNA, 22 bp, Homo sapiens
aattgggtggggggcttcatac

SEQ ID NO: 5125557 - DNA, 15 bp, Homo sapiens
aattgggttcacagc

SEQ ID NO: 5125558 - DNA, 15 bp, Homo sapiens
aattgggttcatgat

SEQ ID NO: 5125559 - DNA, 20 bp, Homo sapiens
aattgggttcatgatgcagt

SEQ ID NO: 5125560 - DNA, 21 bp, Homo sapiens
aattggtaaaactcactgtga

SEQ ID NO: 5125561 - DNA, 20 bp, Homo sapiens
aattggtattatcaaagcat

SEQ ID NO: 5125562 - DNA, 20 bp, Homo sapiens
aattggtcatggtagatttt

SEQ ID NO: 5125563 - DNA, 23 bp, Homo sapiens
aattggtctaccaagtaagacat

SEQ ID NO: 5125564 - DNA, 20 bp, Homo sapiens
aattggtgctatttgaagaa

SEQ ID NO: 5125565 - DNA, 21 bp, Homo sapiens
aattggtgctatttgaagaaa

SEQ ID NO: 5125566 - DNA, 16 bp, Homo sapiens
aattggtgggaagcaa

SEQ ID NO: 5125567 - DNA, 19 bp, Homo sapiens
aattggtgtaatggggcag

SEQ ID NO: 5125568 - DNA, 14 bp, Homo sapiens
aattggtgtatatc

SEQ ID NO: 5125569 - DNA, 15 bp, Homo sapiens
aattggtgtcatttt

SEQ ID NO: 5125570 - DNA, 16 bp, Homo sapiens
aattggttaatgaaaa

SEQ ID NO: 5125571 - DNA, 22 bp, Homo sapiens
aattggttaatgaaaaatctga

SEQ ID NO: 5125572 - DNA, 20 bp, Homo sapiens
aattggttattaaactgaat

SEQ ID NO: 5125573 - DNA, 15 bp, Homo sapiens
aattggttgtatata

SEQ ID NO: 5125574 - DNA, 18 bp, Homo sapiens
aattggtttaaactttta

SEQ ID NO: 5125575 - DNA, 19 bp, Homo sapiens
aattggtttaaacttttat

SEQ ID NO: 5125576 - DNA, 17 bp, Homo sapiens
aattggttttccagagg

SEQ ID NO: 5125577 - DNA, 21 bp, Homo sapiens
aattgtaaaattgtatagaga

SEQ ID NO: 5125578 - DNA, 16 bp, Homo sapiens
aattgtaaacagaaat

SEQ ID NO: 5125579 - DNA, 23 bp, Homo sapiens
aattgtaaacagaaattgcaata

SEQ ID NO: 5125580 - DNA, 14 bp, Homo sapiens
aattgtaaactgta

SEQ ID NO: 5125581 - DNA, 19 bp, Homo sapiens
aattgtaaaggtgatgaat

SEQ ID NO: 5125582 - DNA, 21 bp, Homo sapiens
aattgtaaaggtgatgaattt

SEQ ID NO: 5125583 - DNA, 20 bp, Homo sapiens
aattgtaaagtaaatgaaag

SEQ ID NO: 5125584 - DNA, 13 bp, Homo sapiens
aattgtaaatttt

SEQ ID NO: 5125585 - DNA, 15 bp, Homo sapiens
aattgtaaattttag

SEQ ID NO: 5125586 - DNA, 16 bp, Homo sapiens
aattgtaactgttctt

SEQ ID NO: 5125587 - DNA, 16 bp, Homo sapiens
aattgtaagccagagt

SEQ ID NO: 5125588 - DNA, 12 bp, Homo sapiens
aattgtaaggaa

SEQ ID NO: 5125589 - DNA, 10 bp, Homo sapiens
aattgtaagt

SEQ ID NO: 5125590 - DNA, 14 bp, Homo sapiens
aattgtaattatat

SEQ ID NO: 5125591 - DNA, 13 bp, Homo sapiens
aattgtacaaaaa

SEQ ID NO: 5125592 - DNA, 14 bp, Homo sapiens
aattgtacaaaaaa

SEQ ID NO: 5125593 - DNA, 13 bp, Homo sapiens
aattgtacaaaat

SEQ ID NO: 5125594 - DNA, 19 bp, Homo sapiens
aattgtacaaaattaagca

SEQ ID NO: 5125595 - DNA, 20 bp, Homo sapiens
aattgtacaaaattaagcaa

SEQ ID NO: 5125596 - DNA, 18 bp, Homo sapiens
aattgtacattccctgca

SEQ ID NO: 5125597 - DNA, 15 bp, Homo sapiens
aattgtacattttgt

SEQ ID NO: 5125598 - DNA, 19 bp, Homo sapiens
aattgtaccatcattttat

SEQ ID NO: 5125599 - DNA, 23 bp, Homo sapiens
aattgtacccttcttgtctctct

SEQ ID NO: 5125600 - DNA, 23 bp, Homo sapiens
aattgtacctatttctgatgatg

SEQ ID NO: 5125601 - DNA, 16 bp, Homo sapiens
aattgtactttgaaaa

SEQ ID NO: 5125602 - DNA, 21 bp, Homo sapiens
aattgtagaacatagatgcta

SEQ ID NO: 5125603 - DNA, 17 bp, Homo sapiens
aattgtagactgatgtt

SEQ ID NO: 5125604 - DNA, 19 bp, Homo sapiens
aattgtagatggaaatcag

SEQ ID NO: 5125605 - DNA, 18 bp, Homo sapiens
aattgtagtaattgctct

SEQ ID NO: 5125606 - DNA, 20 bp, Homo sapiens
aattgtagttctgtgtactt

SEQ ID NO: 5125607 - DNA, 21 bp, Homo sapiens
aattgtagttctgtgtacttt

SEQ ID NO: 5125608 - DNA, 10 bp, Homo sapiens
aattgtataa

SEQ ID NO: 5125609 - DNA, 16 bp, Homo sapiens
aattgtataacaggtt

SEQ ID NO: 5125610 - DNA, 18 bp, Homo sapiens
aattgtataacaggttat

SEQ ID NO: 5125611 - DNA, 19 bp, Homo sapiens
aattgtataagtcaagcac

SEQ ID NO: 5125612 - DNA, 14 bp, Homo sapiens
aattgtatacattt

SEQ ID NO: 5125613 - DNA, 22 bp, Homo sapiens
aattgtatacattttgttatag

SEQ ID NO: 5125614 - DNA, 15 bp, Homo sapiens
aattgtatagagata

SEQ ID NO: 5125615 - DNA, 16 bp, Homo sapiens
aattgtatatatatgt

SEQ ID NO: 5125616 - DNA, 14 bp, Homo sapiens
aattgtatattcac

SEQ ID NO: 5125617 - DNA, 14 bp, Homo sapiens
aattgtatattgta

SEQ ID NO: 5125618 - DNA, 21 bp, Homo sapiens
aattgtatcgtatagctgtat

SEQ ID NO: 5125619 - DNA, 11 bp, Homo sapiens
aattgtatcta

SEQ ID NO: 5125620 - DNA, 20 bp, Homo sapiens
aattgtatctacattaaaat

SEQ ID NO: 5125621 - DNA, 18 bp, Homo sapiens
aattgtatgaaaatcctt

SEQ ID NO: 5125622 - DNA, 18 bp, Homo sapiens
aattgtatggtgataaaa

SEQ ID NO: 5125623 - DNA, 22 bp, Homo sapiens
aattgtatgttaagttacttca

SEQ ID NO: 5125624 - DNA, 18 bp, Homo sapiens
aattgtattgaaaacact

SEQ ID NO: 5125625 - DNA, 23 bp, Homo sapiens
aattgtatttatgtatgtaaata

SEQ ID NO: 5125626 - DNA, 11 bp, Homo sapiens
aattgtatttt

SEQ ID NO: 5125627 - DNA, 19 bp, Homo sapiens
aattgtatttttgttgttg

SEQ ID NO: 5125628 - DNA, 18 bp, Homo sapiens
aattgtcagcaatttaac

SEQ ID NO: 5125629 - DNA, 23 bp, Homo sapiens
aattgtcatgactttcagattgt

SEQ ID NO: 5125630 - DNA, 11 bp, Homo sapiens
aattgtcatgg

SEQ ID NO: 5125631 - DNA, 16 bp, Homo sapiens
aattgtccatgtgctt

SEQ ID NO: 5125632 - DNA, 17 bp, Homo sapiens
aattgtccgtgttcata

SEQ ID NO: 5125633 - DNA, 16 bp, Homo sapiens
aattgtccttgaagct

SEQ ID NO: 5125634 - DNA, 17 bp, Homo sapiens
aattgtccttgaagctt

SEQ ID NO: 5125635 - DNA, 12 bp, Homo sapiens
aattgtctattt

SEQ ID NO: 5125636 - DNA, 22 bp, Homo sapiens
aattgtctcaaagcatcaaata

SEQ ID NO: 5125637 - DNA, 16 bp, Homo sapiens
aattgtctctgggctg

SEQ ID NO: 5125638 - DNA, 15 bp, Homo sapiens
aattgtcttaaaacc

SEQ ID NO: 5125639 - DNA, 16 bp, Homo sapiens
aattgtcttcatgtac

SEQ ID NO: 5125640 - DNA, 17 bp, Homo sapiens
aattgtcttcatgtaca

SEQ ID NO: 5125641 - DNA, 23 bp, Homo sapiens
aattgtcttttagacaactagat

SEQ ID NO: 5125642 - DNA, 21 bp, Homo sapiens
aattgtgaacagccaaaagct

SEQ ID NO: 5125643 - DNA, 24 bp, Homo sapiens
aattgtgaacatgatagttaaact

SEQ ID NO: 5125644 - DNA, 16 bp, Homo sapiens
aattgtgaattgataa

SEQ ID NO: 5125645 - DNA, 20 bp, Homo sapiens
aattgtgagaattactgttt

SEQ ID NO: 5125646 - DNA, 11 bp, Homo sapiens
aattgtgatgt

SEQ ID NO: 5125647 - DNA, 13 bp, Homo sapiens
aattgtgcaaaat

SEQ ID NO: 5125648 - DNA, 19 bp, Homo sapiens
aattgtgcaaaggataaat

SEQ ID NO: 5125649 - DNA, 11 bp, Homo sapiens
acaacaaaaat

SEQ ID NO: 5125650 - DNA, 17 bp, Homo sapiens
acaacaaagaggacacc

SEQ ID NO: 5125651 - DNA, 15 bp, Homo sapiens
acaacaaagcatgct

SEQ ID NO: 5125652 - DNA, 19 bp, Homo sapiens
acaacaaagtgcttccttt

SEQ ID NO: 5125653 - DNA, 17 bp, Homo sapiens
acaacaaataatttaag

SEQ ID NO: 5125654 - DNA, 19 bp, Homo sapiens
acaacaaataatttaagtt

SEQ ID NO: 5125655 - DNA, 21 bp, Homo sapiens
acaacaaataatttaagttgg

SEQ ID NO: 5125656 - DNA, 15 bp, Homo sapiens
acaacaacaaaatga

SEQ ID NO: 5125657 - DNA, 15 bp, Homo sapiens
acaacaacaacaata

SEQ ID NO: 5125658 - DNA, 15 bp, Homo sapiens
acaacaacaataaca

SEQ ID NO: 5125659 - DNA, 15 bp, Homo sapiens
acaacaacaataata

SEQ ID NO: 5125660 - DNA, 14 bp, Homo sapiens
acaacaacaataca

SEQ ID NO: 5125661 - DNA, 15 bp, Homo sapiens
acaacaacctggtca

SEQ ID NO: 5125662 - DNA, 15 bp, Homo sapiens
acaacaagaaactgt

SEQ ID NO: 5125663 - DNA, 12 bp, Homo sapiens
acaacaagaaca

SEQ ID NO: 5125664 - DNA, 17 bp, Homo sapiens
acaacaagcaaactgaa

SEQ ID NO: 5125665 - DNA, 21 bp, Homo sapiens
acaacaagcaaactgaaatta

SEQ ID NO: 5125666 - DNA, 12 bp, Homo sapiens
acaacaaggacc

SEQ ID NO: 5125667 - DNA, 15 bp, Homo sapiens
acaacaaggaccctg

SEQ ID NO: 5125668 - DNA, 9 bp, Homo sapiens
acaacaata

SEQ ID NO: 5125669 - DNA, 15 bp, Homo sapiens
acaacaataactttt

SEQ ID NO: 5125670 - DNA, 17 bp, Homo sapiens
acaacaatacaacaaga

SEQ ID NO: 5125671 - DNA, 20 bp, Homo sapiens
acaacaatcccagcatctga

SEQ ID NO: 5125672 - DNA, 16 bp, Homo sapiens
acaacaatctggagat

SEQ ID NO: 5125673 - DNA, 18 bp, Homo sapiens
acaacaattggtaaaact

SEQ ID NO: 5125674 - DNA, 14 bp, Homo sapiens
acaacacaaagaga

SEQ ID NO: 5125675 - DNA, 16 bp, Homo sapiens
acaacacaagaaaact

SEQ ID NO: 5125676 - DNA, 14 bp, Homo sapiens
acaacacacacaca

SEQ ID NO: 5125677 - DNA, 23 bp, Homo sapiens
acaacacacacacacacaaaaca

SEQ ID NO: 5125678 - DNA, 18 bp, Homo sapiens
acaacacattgaaactgt

SEQ ID NO: 5125679 - DNA, 19 bp, Homo sapiens
acaacaccaaaaaatatct

SEQ ID NO: 5125680 - DNA, 21 bp, Homo sapiens
acaacaccagccccacttctg

SEQ ID NO: 5125681 - DNA, 14 bp, Homo sapiens
acaacaccaggact

SEQ ID NO: 5125682 - DNA, 15 bp, Homo sapiens
acaacaccaggactt

SEQ ID NO: 5125683 - DNA, 22 bp, Homo sapiens
acaacaccttcctcctgcagac

SEQ ID NO: 5125684 - DNA, 17 bp, Homo sapiens
acaacactaatacacta

SEQ ID NO: 5125685 - DNA, 20 bp, Homo sapiens
acaacactcatcacacttca

SEQ ID NO: 5125686 - DNA, 21 bp, Homo sapiens
acaacactcattgacctgagg

SEQ ID NO: 5125687 - DNA, 23 bp, Homo sapiens
acaacactcattgacctgaggcc

SEQ ID NO: 5125688 - DNA, 21 bp, Homo sapiens
acaacactgattcctggagag

SEQ ID NO: 5125689 - DNA, 12 bp, Homo sapiens
acaacagaaaga

SEQ ID NO: 5125690 - DNA, 19 bp, Homo sapiens
acaacagaataaagcagcc

SEQ ID NO: 5125691 - DNA, 17 bp, Homo sapiens
acaacagagacagtgaa

SEQ ID NO: 5125692 - DNA, 22 bp, Homo sapiens
acaacagagactgaaatgtgtt

SEQ ID NO: 5125693 - DNA, 16 bp, Homo sapiens
acaacagatttgtgaa

SEQ ID NO: 5125694 - DNA, 14 bp, Homo sapiens
acaacagcaacaac

SEQ ID NO: 5125695 - DNA, 15 bp, Homo sapiens
acaacagcacacagg

SEQ ID NO: 5125696 - DNA, 15 bp, Homo sapiens
acaacagcacgtgca

SEQ ID NO: 5125697 - DNA, 15 bp, Homo sapiens
acaacagcagtctcc

SEQ ID NO: 5125698 - DNA, 16 bp, Homo sapiens
acaacagccaacagct

SEQ ID NO: 5125699 - DNA, 24 bp, Homo sapiens
acaacagccaacagctacaacagc

SEQ ID NO: 5125700 - DNA, 14 bp, Homo sapiens
acaacagcctgggg

SEQ ID NO: 5125701 - DNA, 23 bp, Homo sapiens
acaacagctctcgttctccttcc

SEQ ID NO: 5125702 - DNA, 16 bp, Homo sapiens
acaacagctgaagcac

SEQ ID NO: 5125703 - DNA, 14 bp, Homo sapiens
acaacagctgcctg

SEQ ID NO: 5125704 - DNA, 15 bp, Homo sapiens
acaacaggagagaga

SEQ ID NO: 5125705 - DNA, 18 bp, Homo sapiens
acaacaggattttcaagt

SEQ ID NO: 5125706 - DNA, 12 bp, Homo sapiens
acaacaggcatt

SEQ ID NO: 5125707 - DNA, 17 bp, Homo sapiens
acaacaggttttcacca

SEQ ID NO: 5125708 - DNA, 12 bp, Homo sapiens
acaacagtaaca

SEQ ID NO: 5125709 - DNA, 18 bp, Homo sapiens
acaacagtcagccagctt

SEQ ID NO: 5125710 - DNA, 17 bp, Homo sapiens
acaacagtgctaaaaat

SEQ ID NO: 5125711 - DNA, 22 bp, Homo sapiens
acaacagtgctttgtaaattgt

SEQ ID NO: 5125712 - DNA, 19 bp, Homo sapiens
acaacagttctgagctgta

SEQ ID NO: 5125713 - DNA, 15 bp, Homo sapiens
acaacatatcagact

SEQ ID NO: 5125714 - DNA, 13 bp, Homo sapiens
acaacatatttgg

SEQ ID NO: 5125715 - DNA, 20 bp, Homo sapiens
acaacatcaccagtgccacg

SEQ ID NO: 5125716 - DNA, 12 bp, Homo sapiens
acaacatcagaa

SEQ ID NO: 5125717 - DNA, 23 bp, Homo sapiens
acaacatccaagtggcctccgtc

SEQ ID NO: 5125718 - DNA, 16 bp, Homo sapiens
acaacatccatgtcct

SEQ ID NO: 5125719 - DNA, 17 bp, Homo sapiens
acaacatccatgtccta

SEQ ID NO: 5125720 - DNA, 17 bp, Homo sapiens
acaacatcccacagtgg

SEQ ID NO: 5125721 - DNA, 20 bp, Homo sapiens
acaacatcctcagaaccatt

SEQ ID NO: 5125722 - DNA, 21 bp, Homo sapiens
acaacatcgcaatagtttttt

SEQ ID NO: 5125723 - DNA, 17 bp, Homo sapiens
acaacatcttaaatctt

SEQ ID NO: 5125724 - DNA, 17 bp, Homo sapiens
acaacatctttttctac

SEQ ID NO: 5125725 - DNA, 21 bp, Homo sapiens
acaacatgaggccactggaga

SEQ ID NO: 5125726 - DNA, 12 bp, Homo sapiens
acaacatgcaca

SEQ ID NO: 5125727 - DNA, 22 bp, Homo sapiens
acaacatgcacattcatcctca

SEQ ID NO: 5125728 - DNA, 15 bp, Homo sapiens
acaacatggcttctc

SEQ ID NO: 5125729 - DNA, 22 bp, Homo sapiens
acaacatgtataatatttttaa

SEQ ID NO: 5125730 - DNA, 14 bp, Homo sapiens
acaacattgcattg

SEQ ID NO: 5125731 - DNA, 18 bp, Homo sapiens
acaacatttagtttaaac

SEQ ID NO: 5125732 - DNA, 23 bp, Homo sapiens
acaacatttatttcaaactattg

SEQ ID NO: 5125733 - DNA, 20 bp, Homo sapiens
acaacatttctatagccaaa

SEQ ID NO: 5125734 - DNA, 18 bp, Homo sapiens
acaacattttaatacaga

SEQ ID NO: 5125735 - DNA, 14 bp, Homo sapiens
acaacattttcttg

SEQ ID NO: 5125736 - DNA, 21 bp, Homo sapiens
acaaccaagcgcatccaatct

SEQ ID NO: 5125737 - DNA, 17 bp, Homo sapiens
acaaccacagtgccacc

SEQ ID NO: 5125738 - DNA, 22 bp, Homo sapiens
acaaccacggtcacacctcact

SEQ ID NO: 5125739 - DNA, 21 bp, Homo sapiens
acaaccactgggatcagctgg

SEQ ID NO: 5125740 - DNA, 13 bp, Homo sapiens
acaaccagccaca

SEQ ID NO: 5125741 - DNA, 18 bp, Homo sapiens
acaaccagccacacagag

SEQ ID NO: 5125742 - DNA, 21 bp, Homo sapiens
acaaccatactttatatatgt

SEQ ID NO: 5125743 - DNA, 16 bp, Homo sapiens
acaaccatagaactgt

SEQ ID NO: 5125744 - DNA, 16 bp, Homo sapiens
acaaccatatttagca

SEQ ID NO: 5125745 - DNA, 21 bp, Homo sapiens
acaaccatgcaaattgtgaaa

SEQ ID NO: 5125746 - DNA, 22 bp, Homo sapiens
acaaccatgcaaattgtgaaat

SEQ ID NO: 5125747 - DNA, 22 bp, Homo sapiens
acaaccatgtcatttcagaagt

SEQ ID NO: 5125748 - DNA, 18 bp, Homo sapiens
acaaccattaaagtcaga

SEQ ID NO: 5125749 - DNA, 19 bp, Homo sapiens
acaacccaatctggctggt

SEQ ID NO: 5125750 - DNA, 23 bp, Homo sapiens
acaaccccccatcacaaacttaa

SEQ ID NO: 5125751 - DNA, 16 bp, Homo sapiens
acaaccccctccaccc

SEQ ID NO: 5125752 - DNA, 16 bp, Homo sapiens
acaaccctaccctggc

SEQ ID NO: 5125753 - DNA, 15 bp, Homo sapiens
acaaccctctggaag

SEQ ID NO: 5125754 - DNA, 13 bp, Homo sapiens
acaaccctggcct

SEQ ID NO: 5125755 - DNA, 15 bp, Homo sapiens
acaaccctggcctca

SEQ ID NO: 5125756 - DNA, 19 bp, Homo sapiens
acaaccctgtgtaacaact

SEQ ID NO: 5125757 - DNA, 20 bp, Homo sapiens
acaaccgatgctccagccaa

SEQ ID NO: 5125758 - DNA, 16 bp, Homo sapiens
acaaccggttatcagt

SEQ ID NO: 5125759 - DNA, 22 bp, Homo sapiens
acaaccgtcctgctgtccctgt

SEQ ID NO: 5125760 - DNA, 13 bp, Homo sapiens
acaaccgttggaa

SEQ ID NO: 5125761 - DNA, 13 bp, Homo sapiens
acaacctaaaaaa

SEQ ID NO: 5125762 - DNA, 18 bp, Homo sapiens
acaacctcaccaaactag

SEQ ID NO: 5125763 - DNA, 20 bp, Homo sapiens
acaacctcaccaaactagta

SEQ ID NO: 5125764 - DNA, 14 bp, Homo sapiens
acaacctccacctt

SEQ ID NO: 5125765 - DNA, 15 bp, Homo sapiens
acaacctccctcttg

SEQ ID NO: 5125766 - DNA, 16 bp, Homo sapiens
acaacctctctgatct

SEQ ID NO: 5125767 - DNA, 16 bp, Homo sapiens
acaacctgaaagacaa

SEQ ID NO: 5125768 - DNA, 15 bp, Homo sapiens
acaacctgaaattta

SEQ ID NO: 5125769 - DNA, 14 bp, Homo sapiens
acaacctgaaccta

SEQ ID NO: 5125770 - DNA, 22 bp, Homo sapiens
acaacctgagccttttcttata

SEQ ID NO: 5125771 - DNA, 18 bp, Homo sapiens
acaacctgagttcaagtc

SEQ ID NO: 5125772 - DNA, 18 bp, Homo sapiens
acaacctgcccctcccca

SEQ ID NO: 5125773 - DNA, 18 bp, Homo sapiens
acaacctggccagaggca

SEQ ID NO: 5125774 - DNA, 18 bp, Homo sapiens
acaacctggtgcatcgaa

SEQ ID NO: 5125775 - DNA, 13 bp, Homo sapiens
acaacctgtgcag

SEQ ID NO: 5125776 - DNA, 20 bp, Homo sapiens
acaaccttcagctttatttt

SEQ ID NO: 5125777 - DNA, 23 bp, Homo sapiens
acaaccttcatttaaaaaggttt

SEQ ID NO: 5125778 - DNA, 22 bp, Homo sapiens
acaacctttcccatttcgtgta

SEQ ID NO: 5125779 - DNA, 13 bp, Homo sapiens
acaacctttctgt

SEQ ID NO: 5125780 - DNA, 15 bp, Homo sapiens
acaacctttgtgtaa

SEQ ID NO: 5125781 - DNA, 16 bp, Homo sapiens
acaacgagccttttca

SEQ ID NO: 5125782 - DNA, 14 bp, Homo sapiens
acaacgaggaagcc

SEQ ID NO: 5125783 - DNA, 15 bp, Homo sapiens
acaacgaggaagccc

SEQ ID NO: 5125784 - DNA, 17 bp, Homo sapiens
acaacgatgaatttctt

SEQ ID NO: 5125785 - DNA, 22 bp, Homo sapiens
acaacgatgaatttcttctaat

SEQ ID NO: 5125786 - DNA, 19 bp, Homo sapiens
acaacgcataggaaaagaa

SEQ ID NO: 5125787 - DNA, 20 bp, Homo sapiens
acaacgctctaccctgcagc

SEQ ID NO: 5125788 - DNA, 13 bp, Homo sapiens
acaacggaggcct

SEQ ID NO: 5125789 - DNA, 20 bp, Homo sapiens
acaacggagtcaaaaattaa

SEQ ID NO: 5125790 - DNA, 16 bp, Homo sapiens
acaacgtaaaaataaa

SEQ ID NO: 5125791 - DNA, 18 bp, Homo sapiens
acaacgtaaaaataaaag

SEQ ID NO: 5125792 - DNA, 15 bp, Homo sapiens
acaacgtctttttgt

SEQ ID NO: 5125793 - DNA, 20 bp, Homo sapiens
acaacgtctttttgtttgtt

SEQ ID NO: 5125794 - DNA, 15 bp, Homo sapiens
acaacgtgcattgtg

SEQ ID NO: 5125795 - DNA, 18 bp, Homo sapiens
acaacgtgctctttgttt

SEQ ID NO: 5125796 - DNA, 15 bp, Homo sapiens
acaactaaaaataaa

SEQ ID NO: 5125797 - DNA, 17 bp, Homo sapiens
acaactaaaaataaatt

SEQ ID NO: 5125798 - DNA, 19 bp, Homo sapiens
acaactaaaaataaattaa

SEQ ID NO: 5125799 - DNA, 11 bp, Homo sapiens
acaactaaaat

SEQ ID NO: 5125800 - DNA, 17 bp, Homo sapiens
acaactaaattattatg

SEQ ID NO: 5125801 - DNA, 17 bp, Homo sapiens
acaactaacaatgcctt

SEQ ID NO: 5125802 - DNA, 22 bp, Homo sapiens
acaactaagtgatttgtatgtc

SEQ ID NO: 5125803 - DNA, 14 bp, Homo sapiens
acaactaatcaaga

SEQ ID NO: 5125804 - DNA, 17 bp, Homo sapiens
acaactaatcaagagtg

SEQ ID NO: 5125805 - DNA, 20 bp, Homo sapiens
acaactacagaaaaaccaga

SEQ ID NO: 5125806 - DNA, 12 bp, Homo sapiens
acaactagattt

SEQ ID NO: 5125807 - DNA, 16 bp, Homo sapiens
acaactaggacctcat

SEQ ID NO: 5125808 - DNA, 16 bp, Homo sapiens
acaactaggcttcagc

SEQ ID NO: 5125809 - DNA, 19 bp, Homo sapiens
acaactaggcttcagcata

SEQ ID NO: 5125810 - DNA, 13 bp, Homo sapiens
acaactatattgt

SEQ ID NO: 5125811 - DNA, 16 bp, Homo sapiens
acaactatcaattctt

SEQ ID NO: 5125812 - DNA, 15 bp, Homo sapiens
acaactatgaaatcg

SEQ ID NO: 5125813 - DNA, 17 bp, Homo sapiens
acaactatgtaatttat

SEQ ID NO: 5125814 - DNA, 18 bp, Homo sapiens
acaactatttactttttt

SEQ ID NO: 5125815 - DNA, 17 bp, Homo sapiens
acaactatttcggcctt

SEQ ID NO: 5125816 - DNA, 16 bp, Homo sapiens
acaactattttcagat

SEQ ID NO: 5125817 - DNA, 20 bp, Homo sapiens
acaactattttcagatgtga

SEQ ID NO: 5125818 - DNA, 14 bp, Homo sapiens
acaactatttttgt

SEQ ID NO: 5125819 - DNA, 16 bp, Homo sapiens
acaactcattttcata

SEQ ID NO: 5125820 - DNA, 14 bp, Homo sapiens
acaactccagccac

SEQ ID NO: 5125821 - DNA, 20 bp, Homo sapiens
acaactccagccacccagcc

SEQ ID NO: 5125822 - DNA, 12 bp, Homo sapiens
acaactccccca

SEQ ID NO: 5125823 - DNA, 19 bp, Homo sapiens
acaactcccccaccgccca

SEQ ID NO: 5125824 - DNA, 21 bp, Homo sapiens
acaactccctgaacctcagtt

SEQ ID NO: 5125825 - DNA, 14 bp, Homo sapiens
acaactcccttgca

SEQ ID NO: 5125826 - DNA, 16 bp, Homo sapiens
acaactctagaaatgc

SEQ ID NO: 5125827 - DNA, 19 bp, Homo sapiens
acaactgaaacctaggaag

SEQ ID NO: 5125828 - DNA, 14 bp, Homo sapiens
acaactgaaatgtg

SEQ ID NO: 5125829 - DNA, 16 bp, Homo sapiens
aattgtgcataatgct

SEQ ID NO: 5125830 - DNA, 19 bp, Homo sapiens
aattgtgctccaaatgtct

SEQ ID NO: 5125831 - DNA, 16 bp, Homo sapiens
aattgtgctgccattt

SEQ ID NO: 5125832 - DNA, 19 bp, Homo sapiens
aattgtgctgccatttgat

SEQ ID NO: 5125833 - DNA, 16 bp, Homo sapiens
aattgtgctttcacca

SEQ ID NO: 5125834 - DNA, 18 bp, Homo sapiens
aattgtggagaggagaga

SEQ ID NO: 5125835 - DNA, 23 bp, Homo sapiens
aattgtggatcttgagctctgct

SEQ ID NO: 5125836 - DNA, 13 bp, Homo sapiens
aattgtggattaa

SEQ ID NO: 5125837 - DNA, 20 bp, Homo sapiens
aattgtggattataaaaaat

SEQ ID NO: 5125838 - DNA, 18 bp, Homo sapiens
aattgtgggcataaactg

SEQ ID NO: 5125839 - DNA, 17 bp, Homo sapiens
aattgtgggtctatttc

SEQ ID NO: 5125840 - DNA, 16 bp, Homo sapiens
aattgtggtagaaatt

SEQ ID NO: 5125841 - DNA, 17 bp, Homo sapiens
aattgtggtagaaattt

SEQ ID NO: 5125842 - DNA, 16 bp, Homo sapiens
aattgtggttgtgttc

SEQ ID NO: 5125843 - DNA, 17 bp, Homo sapiens
aattgtggtttatatat

SEQ ID NO: 5125844 - DNA, 13 bp, Homo sapiens
aattgtgtaactg

SEQ ID NO: 5125845 - DNA, 16 bp, Homo sapiens
aattgtgtaactgttc

SEQ ID NO: 5125846 - DNA, 21 bp, Homo sapiens
aattgtgtagcctttttgtat

SEQ ID NO: 5125847 - DNA, 23 bp, Homo sapiens
aattgtgtagtaatgttttttag

SEQ ID NO: 5125848 - DNA, 17 bp, Homo sapiens
aattgtgtatatatctt

SEQ ID NO: 5125849 - DNA, 18 bp, Homo sapiens
aattgtgtatatatctta

SEQ ID NO: 5125850 - DNA, 21 bp, Homo sapiens
aattgtgtatatgttggttta

SEQ ID NO: 5125851 - DNA, 22 bp, Homo sapiens
aattgtgtatttaaaaaaaaga

SEQ ID NO: 5125852 - DNA, 19 bp, Homo sapiens
aattgtgtgatatttcaga

SEQ ID NO: 5125853 - DNA, 21 bp, Homo sapiens
aattgtgtgatatttcagaaa

SEQ ID NO: 5125854 - DNA, 23 bp, Homo sapiens
aattgtgtgatatttcagaaata

SEQ ID NO: 5125855 - DNA, 23 bp, Homo sapiens
aattgtgtggagaactcagtgcc

SEQ ID NO: 5125856 - DNA, 15 bp, Homo sapiens
aattgtgtggagaag

SEQ ID NO: 5125857 - DNA, 21 bp, Homo sapiens
aattgtgttcttaaaatattg

SEQ ID NO: 5125858 - DNA, 20 bp, Homo sapiens
aattgtgtttacattttatg

SEQ ID NO: 5125859 - DNA, 21 bp, Homo sapiens
aattgtgtttacattttatgg

SEQ ID NO: 5125860 - DNA, 22 bp, Homo sapiens
aattgtgtttacattttatggt

SEQ ID NO: 5125861 - DNA, 13 bp, Homo sapiens
aattgtgtttaga

SEQ ID NO: 5125862 - DNA, 21 bp, Homo sapiens
aattgtgtttataattttaaa

SEQ ID NO: 5125863 - DNA, 20 bp, Homo sapiens
aattgtgtttattttttaaa

SEQ ID NO: 5125864 - DNA, 20 bp, Homo sapiens
aattgtgttttaattgtaaa

SEQ ID NO: 5125865 - DNA, 20 bp, Homo sapiens
aattgttaaatttaaaaata

SEQ ID NO: 5125866 - DNA, 17 bp, Homo sapiens
aattgttaatcaaagat

SEQ ID NO: 5125867 - DNA, 15 bp, Homo sapiens
aattgttaatgtgat

SEQ ID NO: 5125868 - DNA, 17 bp, Homo sapiens
aattgttacaagtgttc

SEQ ID NO: 5125869 - DNA, 23 bp, Homo sapiens
aattgttacccatttgaaagaat

SEQ ID NO: 5125870 - DNA, 15 bp, Homo sapiens
aattgttataattag

SEQ ID NO: 5125871 - DNA, 16 bp, Homo sapiens
aattgttatgaaaatc

SEQ ID NO: 5125872 - DNA, 19 bp, Homo sapiens
aattgttatgtaaacatca

SEQ ID NO: 5125873 - DNA, 15 bp, Homo sapiens
aattgttcctctttg

SEQ ID NO: 5125874 - DNA, 15 bp, Homo sapiens
aattgttccttgctt

SEQ ID NO: 5125875 - DNA, 11 bp, Homo sapiens
aattgttcttg

SEQ ID NO: 5125876 - DNA, 20 bp, Homo sapiens
aattgttgaaagctttgaaa

SEQ ID NO: 5125877 - DNA, 18 bp, Homo sapiens
aattgttgaaattttgca

SEQ ID NO: 5125878 - DNA, 20 bp, Homo sapiens
aattgttgaaattttgcaaa

SEQ ID NO: 5125879 - DNA, 23 bp, Homo sapiens
aattgttgaaattttgcaaatat

SEQ ID NO: 5125880 - DNA, 21 bp, Homo sapiens
aattgttgaacaggtgttttt

SEQ ID NO: 5125881 - DNA, 15 bp, Homo sapiens
aattgttgaatgtat

SEQ ID NO: 5125882 - DNA, 18 bp, Homo sapiens
aattgttgacagttctga

SEQ ID NO: 5125883 - DNA, 17 bp, Homo sapiens
aattgttgagatacttt

SEQ ID NO: 5125884 - DNA, 15 bp, Homo sapiens
aattgttgatatttt

SEQ ID NO: 5125885 - DNA, 17 bp, Homo sapiens
aattgttgatattttcc

SEQ ID NO: 5125886 - DNA, 19 bp, Homo sapiens
aattgttgattaatttgag

SEQ ID NO: 5125887 - DNA, 21 bp, Homo sapiens
aattgttgtatatcactaaaa

SEQ ID NO: 5125888 - DNA, 13 bp, Homo sapiens
aattgttgttctg

SEQ ID NO: 5125889 - DNA, 23 bp, Homo sapiens
aattgttgtttctttctagtggt

SEQ ID NO: 5125890 - DNA, 13 bp, Homo sapiens
aattgttgtttgt

SEQ ID NO: 5125891 - DNA, 14 bp, Homo sapiens
aattgttgtttgta

SEQ ID NO: 5125892 - DNA, 22 bp, Homo sapiens
aattgttgtttgtatgtataat

SEQ ID NO: 5125893 - DNA, 23 bp, Homo sapiens
aattgttgtttgtatgtataatt

SEQ ID NO: 5125894 - DNA, 13 bp, Homo sapiens
aattgtttaaaaa

SEQ ID NO: 5125895 - DNA, 14 bp, Homo sapiens
aattgtttagattt

SEQ ID NO: 5125896 - DNA, 14 bp, Homo sapiens
aattgtttataatg

SEQ ID NO: 5125897 - DNA, 17 bp, Homo sapiens
aattgtttatatggata

SEQ ID NO: 5125898 - DNA, 18 bp, Homo sapiens
aattgtttatatggataa

SEQ ID NO: 5125899 - DNA, 21 bp, Homo sapiens
aattgtttatgtgttatgaac

SEQ ID NO: 5125900 - DNA, 21 bp, Homo sapiens
aattgtttcagtttttttaaa

SEQ ID NO: 5125901 - DNA, 16 bp, Homo sapiens
aattgtttcatatctg

SEQ ID NO: 5125902 - DNA, 12 bp, Homo sapiens
aattgtttccaa

SEQ ID NO: 5125903 - DNA, 18 bp, Homo sapiens
aattgtttccaaagtgca

SEQ ID NO: 5125904 - DNA, 23 bp, Homo sapiens
aattgtttcctaaatcagcattt

SEQ ID NO: 5125905 - DNA, 20 bp, Homo sapiens
aattgtttggcttcctcctg

SEQ ID NO: 5125906 - DNA, 21 bp, Homo sapiens
aattgtttggcttcctcctga

SEQ ID NO: 5125907 - DNA, 20 bp, Homo sapiens
aattgtttgtaagtgaagtg

SEQ ID NO: 5125908 - DNA, 13 bp, Homo sapiens
aattgttttacct

SEQ ID NO: 5125909 - DNA, 19 bp, Homo sapiens
aattgttttatctgaattt

SEQ ID NO: 5125910 - DNA, 17 bp, Homo sapiens
aattgttttcacttgta

SEQ ID NO: 5125911 - DNA, 18 bp, Homo sapiens
aattgttttcacttgtat

SEQ ID NO: 5125912 - DNA, 19 bp, Homo sapiens
aattgttttcacttgtatt

SEQ ID NO: 5125913 - DNA, 15 bp, Homo sapiens
aattgttttctttaa

SEQ ID NO: 5125914 - DNA, 19 bp, Homo sapiens
aattgttttctttaaagat

SEQ ID NO: 5125915 - DNA, 20 bp, Homo sapiens
aattgttttgcactttttta

SEQ ID NO: 5125916 - DNA, 12 bp, Homo sapiens
aattgttttgct

SEQ ID NO: 5125917 - DNA, 16 bp, Homo sapiens
aattgttttggaataa

SEQ ID NO: 5125918 - DNA, 22 bp, Homo sapiens
aattgtttttaatttgaatcag

SEQ ID NO: 5125919 - DNA, 22 bp, Homo sapiens
aattgtttttagaaatttattc

SEQ ID NO: 5125920 - DNA, 16 bp, Homo sapiens
aattgtttttataaaa

SEQ ID NO: 5125921 - DNA, 13 bp, Homo sapiens
aattgtttttccc

SEQ ID NO: 5125922 - DNA, 23 bp, Homo sapiens
aattgtttttgaatttaaataaa

SEQ ID NO: 5125923 - DNA, 20 bp, Homo sapiens
aattgttttttaaagcaagt

SEQ ID NO: 5125924 - DNA, 18 bp, Homo sapiens
aattgttttttaatttaa

SEQ ID NO: 5125925 - DNA, 19 bp, Homo sapiens
aattgttttttatcttttc

SEQ ID NO: 5125926 - DNA, 12 bp, Homo sapiens
aatttaaaaaac

SEQ ID NO: 5125927 - DNA, 13 bp, Homo sapiens
aatttaaaaaagt

SEQ ID NO: 5125928 - DNA, 13 bp, Homo sapiens
aatttaaaaaata

SEQ ID NO: 5125929 - DNA, 17 bp, Homo sapiens
aatttaaaaagcaaaaa

SEQ ID NO: 5125930 - DNA, 15 bp, Homo sapiens
aatttaaaaataaag

SEQ ID NO: 5125931 - DNA, 17 bp, Homo sapiens
aatttaaaaatatattt

SEQ ID NO: 5125932 - DNA, 13 bp, Homo sapiens
aatttaaaaatct

SEQ ID NO: 5125933 - DNA, 17 bp, Homo sapiens
aatttaaaaatctttca

SEQ ID NO: 5125934 - DNA, 22 bp, Homo sapiens
aatttaaaaatgagtgtgaagg

SEQ ID NO: 5125935 - DNA, 11 bp, Homo sapiens
aatttaaaaca

SEQ ID NO: 5125936 - DNA, 12 bp, Homo sapiens
aatttaaaacaa

SEQ ID NO: 5125937 - DNA, 16 bp, Homo sapiens
aatttaaaacaaacaa

SEQ ID NO: 5125938 - DNA, 19 bp, Homo sapiens
aatttaaaacacagtattg

SEQ ID NO: 5125939 - DNA, 23 bp, Homo sapiens
aatttaaaacacagtattgtaga

SEQ ID NO: 5125940 - DNA, 23 bp, Homo sapiens
aatttaaaactgttatttttaca

SEQ ID NO: 5125941 - DNA, 13 bp, Homo sapiens
aatttaaaagcag

SEQ ID NO: 5125942 - DNA, 17 bp, Homo sapiens
aatttaaaataaataaa

SEQ ID NO: 5125943 - DNA, 21 bp, Homo sapiens
aatttaaaataaataaacttt

SEQ ID NO: 5125944 - DNA, 19 bp, Homo sapiens
aatttaaaataattatata

SEQ ID NO: 5125945 - DNA, 16 bp, Homo sapiens
aatttaaaatgtagtt

SEQ ID NO: 5125946 - DNA, 18 bp, Homo sapiens
aatttaaaatgtagtttt

SEQ ID NO: 5125947 - DNA, 16 bp, Homo sapiens
aatttaaaattacgtt

SEQ ID NO: 5125948 - DNA, 10 bp, Homo sapiens
aatttaaaca

SEQ ID NO: 5125949 - DNA, 19 bp, Homo sapiens
aatttaaacaggcccagca

SEQ ID NO: 5125950 - DNA, 14 bp, Homo sapiens
aatttaaacattaa

SEQ ID NO: 5125951 - DNA, 22 bp, Homo sapiens
aatttaaacatttgttcctgga

SEQ ID NO: 5125952 - DNA, 12 bp, Homo sapiens
aatttaaactgt

SEQ ID NO: 5125953 - DNA, 16 bp, Homo sapiens
aatttaaagaaacact

SEQ ID NO: 5125954 - DNA, 20 bp, Homo sapiens
aatttaaagaaacactaaat

SEQ ID NO: 5125955 - DNA, 21 bp, Homo sapiens
aatttaaagaaacactaaatt

SEQ ID NO: 5125956 - DNA, 17 bp, Homo sapiens
aatttaaagatattgtt

SEQ ID NO: 5125957 - DNA, 19 bp, Homo sapiens
aatttaaagcaggttcttg

SEQ ID NO: 5125958 - DNA, 18 bp, Homo sapiens
aatttaaagctgtttcta

SEQ ID NO: 5125959 - DNA, 12 bp, Homo sapiens
aatttaaaggct

SEQ ID NO: 5125960 - DNA, 18 bp, Homo sapiens
aatttaaagggtgtactt

SEQ ID NO: 5125961 - DNA, 10 bp, Homo sapiens
aatttaaagt

SEQ ID NO: 5125962 - DNA, 19 bp, Homo sapiens
aatttaaatataattctgt

SEQ ID NO: 5125963 - DNA, 12 bp, Homo sapiens
aatttaaatgaa

SEQ ID NO: 5125964 - DNA, 16 bp, Homo sapiens
aatttaaatgaaagaa

SEQ ID NO: 5125965 - DNA, 15 bp, Homo sapiens
aatttaaatgatatt

SEQ ID NO: 5125966 - DNA, 16 bp, Homo sapiens
aatttaaatgatattt

SEQ ID NO: 5125967 - DNA, 15 bp, Homo sapiens
aatttaaatggcttt

SEQ ID NO: 5125968 - DNA, 22 bp, Homo sapiens
aatttaaatggcttttgccaca

SEQ ID NO: 5125969 - DNA, 13 bp, Homo sapiens
aatttaaatgtta

SEQ ID NO: 5125970 - DNA, 14 bp, Homo sapiens
aatttaaattgtta

SEQ ID NO: 5125971 - DNA, 11 bp, Homo sapiens
aatttaaattt

SEQ ID NO: 5125972 - DNA, 17 bp, Homo sapiens
aatttaaatttaaagat

SEQ ID NO: 5125973 - DNA, 15 bp, Homo sapiens
aatttaacaatgcga

SEQ ID NO: 5125974 - DNA, 17 bp, Homo sapiens
aatttaacaatgcgaat

SEQ ID NO: 5125975 - DNA, 17 bp, Homo sapiens
aatttaacagaagttgt

SEQ ID NO: 5125976 - DNA, 19 bp, Homo sapiens
aatttaacatctgcagtgt

SEQ ID NO: 5125977 - DNA, 17 bp, Homo sapiens
aatttaaccagcaacat

SEQ ID NO: 5125978 - DNA, 13 bp, Homo sapiens
aatttaaccataa

SEQ ID NO: 5125979 - DNA, 17 bp, Homo sapiens
aatttaaccataaatca

SEQ ID NO: 5125980 - DNA, 23 bp, Homo sapiens
aatttaactacccttaattactt

SEQ ID NO: 5125981 - DNA, 20 bp, Homo sapiens
aatttaactactaagaataa

SEQ ID NO: 5125982 - DNA, 12 bp, Homo sapiens
aatttaactgca

SEQ ID NO: 5125983 - DNA, 15 bp, Homo sapiens
aatttaactgcatat

SEQ ID NO: 5125984 - DNA, 18 bp, Homo sapiens
aatttaactgcatataga

SEQ ID NO: 5125985 - DNA, 18 bp, Homo sapiens
aatttaacttaactctta

SEQ ID NO: 5125986 - DNA, 17 bp, Homo sapiens
aatttaagaaataactt

SEQ ID NO: 5125987 - DNA, 20 bp, Homo sapiens
aatttaagcatgagtggcct

SEQ ID NO: 5125988 - DNA, 16 bp, Homo sapiens
aatttaagcattgttt

SEQ ID NO: 5125989 - DNA, 23 bp, Homo sapiens
aatttaagccaataaataatatt

SEQ ID NO: 5125990 - DNA, 20 bp, Homo sapiens
aatttaaggagggacaagaa

SEQ ID NO: 5125991 - DNA, 13 bp, Homo sapiens
aatttaaggcaaa

SEQ ID NO: 5125992 - DNA, 15 bp, Homo sapiens
aatttaaggcttaaa

SEQ ID NO: 5125993 - DNA, 21 bp, Homo sapiens
aatttaaggtctgtttgctgt

SEQ ID NO: 5125994 - DNA, 20 bp, Homo sapiens
aatttaagtgacacagacat

SEQ ID NO: 5125995 - DNA, 12 bp, Homo sapiens
aatttaagtttt

SEQ ID NO: 5125996 - DNA, 17 bp, Homo sapiens
aatttaataaaaaggaa

SEQ ID NO: 5125997 - DNA, 19 bp, Homo sapiens
aatttaataaaaaggaata

SEQ ID NO: 5125998 - DNA, 17 bp, Homo sapiens
aatttaataacttttta

SEQ ID NO: 5125999 - DNA, 15 bp, Homo sapiens
aatttaatatttact

SEQ ID NO: 5126000 - DNA, 12 bp, Homo sapiens
aatttaatgaaa

SEQ ID NO: 5126001 - DNA, 15 bp, Homo sapiens
aatttaatgctgcct

SEQ ID NO: 5126002 - DNA, 17 bp, Homo sapiens
aatttaatgctgccttt

SEQ ID NO: 5126003 - DNA, 11 bp, Homo sapiens
aatttaatggg

SEQ ID NO: 5126004 - DNA, 23 bp, Homo sapiens
aatttaatggggtctgtaaatac

SEQ ID NO: 5126005 - DNA, 20 bp, Homo sapiens
aatttaatgtaaataaaaca

SEQ ID NO: 5126006 - DNA, 20 bp, Homo sapiens
aatttaatgtattaatctgt

SEQ ID NO: 5126007 - DNA, 13 bp, Homo sapiens
aatttaatgtttc

SEQ ID NO: 5126008 - DNA, 15 bp, Homo sapiens
acaactgacacagga

SEQ ID NO: 5126009 - DNA, 17 bp, Homo sapiens
acaactgagatgttaaa

SEQ ID NO: 5126010 - DNA, 19 bp, Homo sapiens
acaactgagtccttaaaca

SEQ ID NO: 5126011 - DNA, 21 bp, Homo sapiens
acaactgatcatttgcagctg

SEQ ID NO: 5126012 - DNA, 21 bp, Homo sapiens
acaactgcaataacttctgac

SEQ ID NO: 5126013 - DNA, 20 bp, Homo sapiens
acaactgccaaataaaatgt

SEQ ID NO: 5126014 - DNA, 20 bp, Homo sapiens
acaactggaatagttttttt

SEQ ID NO: 5126015 - DNA, 17 bp, Homo sapiens
acaactgtaaagcaaat

SEQ ID NO: 5126016 - DNA, 20 bp, Homo sapiens
acaactgtgaatatgagaaa

SEQ ID NO: 5126017 - DNA, 13 bp, Homo sapiens
acaactgtgactg

SEQ ID NO: 5126018 - DNA, 14 bp, Homo sapiens
acaactgtgactgt

SEQ ID NO: 5126019 - DNA, 18 bp, Homo sapiens
acaactgtggataaattt

SEQ ID NO: 5126020 - DNA, 15 bp, Homo sapiens
acaacttagctcagg

SEQ ID NO: 5126021 - DNA, 22 bp, Homo sapiens
acaacttataggtgaatgagta

SEQ ID NO: 5126022 - DNA, 20 bp, Homo sapiens
acaacttatttaaaaatatt

SEQ ID NO: 5126023 - DNA, 16 bp, Homo sapiens
acaacttcagcagggg

SEQ ID NO: 5126024 - DNA, 17 bp, Homo sapiens
acaacttgattttttca

SEQ ID NO: 5126025 - DNA, 15 bp, Homo sapiens
acaacttgctactta

SEQ ID NO: 5126026 - DNA, 13 bp, Homo sapiens
acaacttgctcct

SEQ ID NO: 5126027 - DNA, 15 bp, Homo sapiens
acaacttgctccttt

SEQ ID NO: 5126028 - DNA, 13 bp, Homo sapiens
acaacttggcatt

SEQ ID NO: 5126029 - DNA, 14 bp, Homo sapiens
acaacttgggttct

SEQ ID NO: 5126030 - DNA, 17 bp, Homo sapiens
acaacttgtatttccaa

SEQ ID NO: 5126031 - DNA, 22 bp, Homo sapiens
acaacttgtctattacctgtta

SEQ ID NO: 5126032 - DNA, 17 bp, Homo sapiens
acaacttgtgttctatt

SEQ ID NO: 5126033 - DNA, 17 bp, Homo sapiens
acaactttaagaggaca

SEQ ID NO: 5126034 - DNA, 23 bp, Homo sapiens
acaactttaccataaagccttta

SEQ ID NO: 5126035 - DNA, 22 bp, Homo sapiens
acaactttatgtagagaaaagg

SEQ ID NO: 5126036 - DNA, 14 bp, Homo sapiens
acaactttcagtgg

SEQ ID NO: 5126037 - DNA, 15 bp, Homo sapiens
acaactttcagtggc

SEQ ID NO: 5126038 - DNA, 16 bp, Homo sapiens
acaactttctcttgta

SEQ ID NO: 5126039 - DNA, 15 bp, Homo sapiens
acaactttgcaaatt

SEQ ID NO: 5126040 - DNA, 15 bp, Homo sapiens
acaacttttaaccaa

SEQ ID NO: 5126041 - DNA, 20 bp, Homo sapiens
acaacttttaaccaaacaat

SEQ ID NO: 5126042 - DNA, 19 bp, Homo sapiens
acaacttttccctcactgt

SEQ ID NO: 5126043 - DNA, 11 bp, Homo sapiens
acaacttttct

SEQ ID NO: 5126044 - DNA, 13 bp, Homo sapiens
acaacttttctgc

SEQ ID NO: 5126045 - DNA, 17 bp, Homo sapiens
acaacttttgttttctg

SEQ ID NO: 5126046 - DNA, 18 bp, Homo sapiens
acaacttttgttttctga

SEQ ID NO: 5126047 - DNA, 20 bp, Homo sapiens
acaacttttgttttctgatg

SEQ ID NO: 5126048 - DNA, 14 bp, Homo sapiens
acaactttttaaat

SEQ ID NO: 5126049 - DNA, 20 bp, Homo sapiens
acaacttttttttctttttt

SEQ ID NO: 5126050 - DNA, 20 bp, Homo sapiens
acaagaaaaataaagaaaag

SEQ ID NO: 5126051 - DNA, 23 bp, Homo sapiens
acaagaaaaataaagaaaagatg

SEQ ID NO: 5126052 - DNA, 19 bp, Homo sapiens
acaagaaacgtgtcacact

SEQ ID NO: 5126053 - DNA, 12 bp, Homo sapiens
acaagaaactgt

SEQ ID NO: 5126054 - DNA, 21 bp, Homo sapiens
acaagaaactgtccaaatgct

SEQ ID NO: 5126055 - DNA, 18 bp, Homo sapiens
acaagaaactttggaagc

SEQ ID NO: 5126056 - DNA, 14 bp, Homo sapiens
acaagaaagaaatg

SEQ ID NO: 5126057 - DNA, 21 bp, Homo sapiens
acaagaaaggagagtcttgca

SEQ ID NO: 5126058 - DNA, 17 bp, Homo sapiens
acaagaaagtttcccca

SEQ ID NO: 5126059 - DNA, 13 bp, Homo sapiens
acaagaaataaat

SEQ ID NO: 5126060 - DNA, 16 bp, Homo sapiens
acaagaaatccctgtt

SEQ ID NO: 5126061 - DNA, 21 bp, Homo sapiens
acaagaaatccctgtttaata

SEQ ID NO: 5126062 - DNA, 15 bp, Homo sapiens
acaagaaatgaaagc

SEQ ID NO: 5126063 - DNA, 13 bp, Homo sapiens
acaagaaatgctt

SEQ ID NO: 5126064 - DNA, 11 bp, Homo sapiens
acaagaaatgg

SEQ ID NO: 5126065 - DNA, 20 bp, Homo sapiens
acaagaactcctcccaccca

SEQ ID NO: 5126066 - DNA, 13 bp, Homo sapiens
acaagaagaaata

SEQ ID NO: 5126067 - DNA, 14 bp, Homo sapiens
acaagaagaagggc

SEQ ID NO: 5126068 - DNA, 21 bp, Homo sapiens
acaagaaggccagcccactgg

SEQ ID NO: 5126069 - DNA, 21 bp, Homo sapiens
acaagaaggtggaaggcagtg

SEQ ID NO: 5126070 - DNA, 14 bp, Homo sapiens
acaagaagtttatt

SEQ ID NO: 5126071 - DNA, 17 bp, Homo sapiens
acaagaatcacctcaaa

SEQ ID NO: 5126072 - DNA, 12 bp, Homo sapiens
acaagaatctag

SEQ ID NO: 5126073 - DNA, 23 bp, Homo sapiens
acaagaatgaaggtttttgtaaa

SEQ ID NO: 5126074 - DNA, 12 bp, Homo sapiens
acaagaatgcat

SEQ ID NO: 5126075 - DNA, 15 bp, Homo sapiens
acaagaatgcattga

SEQ ID NO: 5126076 - DNA, 23 bp, Homo sapiens
acaagaatggatcacaagatgga

SEQ ID NO: 5126077 - DNA, 16 bp, Homo sapiens
acaagaattacactaa

SEQ ID NO: 5126078 - DNA, 21 bp, Homo sapiens
acaagacagcagagccatctg

SEQ ID NO: 5126079 - DNA, 19 bp, Homo sapiens
acaagaccaccacttcgaa

SEQ ID NO: 5126080 - DNA, 18 bp, Homo sapiens
acaagaccacgtttctaa

SEQ ID NO: 5126081 - DNA, 15 bp, Homo sapiens
acaagacccccagca

SEQ ID NO: 5126082 - DNA, 15 bp, Homo sapiens
acaagaccctctcag

SEQ ID NO: 5126083 - DNA, 18 bp, Homo sapiens
acaagaccgccccagggc

SEQ ID NO: 5126084 - DNA, 22 bp, Homo sapiens
acaagactgacgccagggtatg

SEQ ID NO: 5126085 - DNA, 13 bp, Homo sapiens
acaagactgcaca

SEQ ID NO: 5126086 - DNA, 23 bp, Homo sapiens
acaagactgcctccctctcttcc

SEQ ID NO: 5126087 - DNA, 18 bp, Homo sapiens
acaagactggcccagtgc

SEQ ID NO: 5126088 - DNA, 15 bp, Homo sapiens
acaagactgtaaatt

SEQ ID NO: 5126089 - DNA, 16 bp, Homo sapiens
acaagactgtcattag

SEQ ID NO: 5126090 - DNA, 20 bp, Homo sapiens
acaagactttccccatactc

SEQ ID NO: 5126091 - DNA, 14 bp, Homo sapiens
acaagagaaaaagc

SEQ ID NO: 5126092 - DNA, 17 bp, Homo sapiens
acaagagaagcattctc

SEQ ID NO: 5126093 - DNA, 21 bp, Homo sapiens
acaagagaccaactttttcat

SEQ ID NO: 5126094 - DNA, 14 bp, Homo sapiens
acaagagactgctt

SEQ ID NO: 5126095 - DNA, 15 bp, Homo sapiens
acaagagatctacac

SEQ ID NO: 5126096 - DNA, 16 bp, Homo sapiens
acaagagatctacaca

SEQ ID NO: 5126097 - DNA, 13 bp, Homo sapiens
acaagagatggga

SEQ ID NO: 5126098 - DNA, 12 bp, Homo sapiens
acaagagcaaaa

SEQ ID NO: 5126099 - DNA, 14 bp, Homo sapiens
acaagagcagcctg

SEQ ID NO: 5126100 - DNA, 15 bp, Homo sapiens
acaagagcagcctgt

SEQ ID NO: 5126101 - DNA, 19 bp, Homo sapiens
acaagagcagcctgtggca

SEQ ID NO: 5126102 - DNA, 20 bp, Homo sapiens
acaagagcagcctgtggcat

SEQ ID NO: 5126103 - DNA, 17 bp, Homo sapiens
acaagagcccaggcctc

SEQ ID NO: 5126104 - DNA, 17 bp, Homo sapiens
acaagagcgaaactccg

SEQ ID NO: 5126105 - DNA, 13 bp, Homo sapiens
acaagagctcctt

SEQ ID NO: 5126106 - DNA, 15 bp, Homo sapiens
acaagagctgttatg

SEQ ID NO: 5126107 - DNA, 20 bp, Homo sapiens
acaagagctgttatgctgtt

SEQ ID NO: 5126108 - DNA, 21 bp, Homo sapiens
acaagagctgttatgctgttt

SEQ ID NO: 5126109 - DNA, 17 bp, Homo sapiens
acaagaggacacaatgg

SEQ ID NO: 5126110 - DNA, 21 bp, Homo sapiens
acaagaggattgtaaaatgca

SEQ ID NO: 5126111 - DNA, 23 bp, Homo sapiens
acaagaggcttccctagtttaca

SEQ ID NO: 5126112 - DNA, 22 bp, Homo sapiens
acaagagggaatagtatagaca

SEQ ID NO: 5126113 - DNA, 18 bp, Homo sapiens
acaagagggcaaagctga

SEQ ID NO: 5126114 - DNA, 21 bp, Homo sapiens
acaagagtatgtggcaaaaca

SEQ ID NO: 5126115 - DNA, 16 bp, Homo sapiens
acaagagtctgtattc

SEQ ID NO: 5126116 - DNA, 12 bp, Homo sapiens
acaagagtgatt

SEQ ID NO: 5126117 - DNA, 18 bp, Homo sapiens
acaagagtttatttccaa

SEQ ID NO: 5126118 - DNA, 17 bp, Homo sapiens
acaagataagcttccag

SEQ ID NO: 5126119 - DNA, 14 bp, Homo sapiens
acaagataccaggc

SEQ ID NO: 5126120 - DNA, 23 bp, Homo sapiens
acaagatattatgtataaaatgt

SEQ ID NO: 5126121 - DNA, 12 bp, Homo sapiens
acaagatattta

SEQ ID NO: 5126122 - DNA, 18 bp, Homo sapiens
acaagatatttatatgtt

SEQ ID NO: 5126123 - DNA, 14 bp, Homo sapiens
acaagatccatttg

SEQ ID NO: 5126124 - DNA, 19 bp, Homo sapiens
acaagatccatttgccttt

SEQ ID NO: 5126125 - DNA, 15 bp, Homo sapiens
acaagatctttcagg

SEQ ID NO: 5126126 - DNA, 20 bp, Homo sapiens
acaagatctttcaggaaaga

SEQ ID NO: 5126127 - DNA, 22 bp, Homo sapiens
acaagatggaaaataaattata

SEQ ID NO: 5126128 - DNA, 18 bp, Homo sapiens
acaagatggaatttatca

SEQ ID NO: 5126129 - DNA, 20 bp, Homo sapiens
acaagatggagaaacaacaa

SEQ ID NO: 5126130 - DNA, 20 bp, Homo sapiens
acaagatggcgaccaccaaa

SEQ ID NO: 5126131 - DNA, 21 bp, Homo sapiens
acaagatggcgaccaccaaag

SEQ ID NO: 5126132 - DNA, 23 bp, Homo sapiens
acaagatggcgaccaccaaagtc

SEQ ID NO: 5126133 - DNA, 24 bp, Homo sapiens
acaagatggcgaccaccaaagtca

SEQ ID NO: 5126134 - DNA, 14 bp, Homo sapiens
acaagatgggacag

SEQ ID NO: 5126135 - DNA, 16 bp, Homo sapiens
acaagatgggacagca

SEQ ID NO: 5126136 - DNA, 15 bp, Homo sapiens
acaagatgtgggcct

SEQ ID NO: 5126137 - DNA, 17 bp, Homo sapiens
acaagattcccagagac

SEQ ID NO: 5126138 - DNA, 23 bp, Homo sapiens
acaagattggtgtttttttctat

SEQ ID NO: 5126139 - DNA, 19 bp, Homo sapiens
acaagatttccctaaaaat

SEQ ID NO: 5126140 - DNA, 19 bp, Homo sapiens
acaagatttcctactttct

SEQ ID NO: 5126141 - DNA, 20 bp, Homo sapiens
acaagattttaaagacatgt

SEQ ID NO: 5126142 - DNA, 20 bp, Homo sapiens
acaagattttttaattgttt

SEQ ID NO: 5126143 - DNA, 16 bp, Homo sapiens
acaagcaaacccagac

SEQ ID NO: 5126144 - DNA, 17 bp, Homo sapiens
acaagcaaaccttctca

SEQ ID NO: 5126145 - DNA, 20 bp, Homo sapiens
acaagcaaatataaacagca

SEQ ID NO: 5126146 - DNA, 17 bp, Homo sapiens
acaagcaacataaaaca

SEQ ID NO: 5126147 - DNA, 14 bp, Homo sapiens
acaagcaacccaaa

SEQ ID NO: 5126148 - DNA, 22 bp, Homo sapiens
acaagcacaattgatctctttt

SEQ ID NO: 5126149 - DNA, 22 bp, Homo sapiens
acaagcacagacattaaacctg

SEQ ID NO: 5126150 - DNA, 18 bp, Homo sapiens
acaagcaccccagacctc

SEQ ID NO: 5126151 - DNA, 17 bp, Homo sapiens
acaagcactattttata

SEQ ID NO: 5126152 - DNA, 15 bp, Homo sapiens
acaagcagacacaca

SEQ ID NO: 5126153 - DNA, 16 bp, Homo sapiens
acaagcagacacacac

SEQ ID NO: 5126154 - DNA, 19 bp, Homo sapiens
acaagcagatactgctgtg

SEQ ID NO: 5126155 - DNA, 14 bp, Homo sapiens
acaagcagtccctt

SEQ ID NO: 5126156 - DNA, 15 bp, Homo sapiens
acaagcatatttgag

SEQ ID NO: 5126157 - DNA, 18 bp, Homo sapiens
acaagcatcatggatcaa

SEQ ID NO: 5126158 - DNA, 19 bp, Homo sapiens
acaagcatgcagctttgca

SEQ ID NO: 5126159 - DNA, 14 bp, Homo sapiens
acaagcatgtctct

SEQ ID NO: 5126160 - DNA, 15 bp, Homo sapiens
acaagcatgtctctc

SEQ ID NO: 5126161 - DNA, 22 bp, Homo sapiens
acaagcatgtctctctgccaag

SEQ ID NO: 5126162 - DNA, 22 bp, Homo sapiens
acaagcattccttagcagctca

SEQ ID NO: 5126163 - DNA, 18 bp, Homo sapiens
acaagccaaaagtccctc

SEQ ID NO: 5126164 - DNA, 22 bp, Homo sapiens
acaagccagaacttgaccctga

SEQ ID NO: 5126165 - DNA, 12 bp, Homo sapiens
acaagccagagc

SEQ ID NO: 5126166 - DNA, 14 bp, Homo sapiens
acaagccaggccct

SEQ ID NO: 5126167 - DNA, 17 bp, Homo sapiens
acaagccaggccctctc

SEQ ID NO: 5126168 - DNA, 11 bp, Homo sapiens
acaagccaggg

SEQ ID NO: 5126169 - DNA, 19 bp, Homo sapiens
acaagcccaaatttaattt

SEQ ID NO: 5126170 - DNA, 13 bp, Homo sapiens
acaagcccacagc

SEQ ID NO: 5126171 - DNA, 11 bp, Homo sapiens
acaagcccagg

SEQ ID NO: 5126172 - DNA, 20 bp, Homo sapiens
acaagcccaggacactgcct

SEQ ID NO: 5126173 - DNA, 14 bp, Homo sapiens
acaagccccaggca

SEQ ID NO: 5126174 - DNA, 17 bp, Homo sapiens
acaagcccccccttcca

SEQ ID NO: 5126175 - DNA, 18 bp, Homo sapiens
acaagcccccccttccac

SEQ ID NO: 5126176 - DNA, 20 bp, Homo sapiens
acaagccctgcttgctggaa

SEQ ID NO: 5126177 - DNA, 20 bp, Homo sapiens
acaagccctgcttttgcata

SEQ ID NO: 5126178 - DNA, 11 bp, Homo sapiens
acaagccctgg

SEQ ID NO: 5126179 - DNA, 14 bp, Homo sapiens
acaagccctggcaa

SEQ ID NO: 5126180 - DNA, 16 bp, Homo sapiens
acaagccgtgttttat

SEQ ID NO: 5126181 - DNA, 21 bp, Homo sapiens
acaagcctcctgtacctcagt

SEQ ID NO: 5126182 - DNA, 18 bp, Homo sapiens
acaagcctctgcccaggc

SEQ ID NO: 5126183 - DNA, 20 bp, Homo sapiens
acaagcctctgcccaggcac

SEQ ID NO: 5126184 - DNA, 23 bp, Homo sapiens
acaagcctctgcccaggcactgc

SEQ ID NO: 5126185 - DNA, 21 bp, Homo sapiens
acaagcctgaaagtaatttca

SEQ ID NO: 5126186 - DNA, 14 bp, Homo sapiens
acaagcctgagaac

SEQ ID NO: 5126187 - DNA, 17 bp, Homo sapiens
aatttaattaatcgaaa

SEQ ID NO: 5126188 - DNA, 13 bp, Homo sapiens
aatttaattcaaa

SEQ ID NO: 5126189 - DNA, 15 bp, Homo sapiens
aatttaattcaaagt

SEQ ID NO: 5126190 - DNA, 19 bp, Homo sapiens
aatttaattcatgtttctt

SEQ ID NO: 5126191 - DNA, 14 bp, Homo sapiens
aatttaattgcttt

SEQ ID NO: 5126192 - DNA, 17 bp, Homo sapiens
aatttaattgctttgaa

SEQ ID NO: 5126193 - DNA, 22 bp, Homo sapiens
aatttaattgtgtaactgttct

SEQ ID NO: 5126194 - DNA, 12 bp, Homo sapiens
aatttaatttat

SEQ ID NO: 5126195 - DNA, 13 bp, Homo sapiens
aatttaatttatg

SEQ ID NO: 5126196 - DNA, 15 bp, Homo sapiens
aatttaatttatgtg

SEQ ID NO: 5126197 - DNA, 18 bp, Homo sapiens
aatttaatttttcctttt

SEQ ID NO: 5126198 - DNA, 21 bp, Homo sapiens
aatttacaaaaatataaaata

SEQ ID NO: 5126199 - DNA, 16 bp, Homo sapiens
aatttacaaaatttat

SEQ ID NO: 5126200 - DNA, 16 bp, Homo sapiens
aatttacaaagtgtgt

SEQ ID NO: 5126201 - DNA, 17 bp, Homo sapiens
aatttacaaagtgtgta

SEQ ID NO: 5126202 - DNA, 22 bp, Homo sapiens
aatttacaagatattattaatt

SEQ ID NO: 5126203 - DNA, 15 bp, Homo sapiens
aatttacacatctta

SEQ ID NO: 5126204 - DNA, 18 bp, Homo sapiens
aatttacacatcttaaaa

SEQ ID NO: 5126205 - DNA, 18 bp, Homo sapiens
aatttacagagacagaaa

SEQ ID NO: 5126206 - DNA, 21 bp, Homo sapiens
aatttacatcagaagtttgca

SEQ ID NO: 5126207 - DNA, 14 bp, Homo sapiens
aatttacatggcaa

SEQ ID NO: 5126208 - DNA, 14 bp, Homo sapiens
aatttacatttatc

SEQ ID NO: 5126209 - DNA, 21 bp, Homo sapiens
aatttaccacaaaagcaaaat

SEQ ID NO: 5126210 - DNA, 23 bp, Homo sapiens
aatttaccatcaaacaaatcatt

SEQ ID NO: 5126211 - DNA, 14 bp, Homo sapiens
aatttacctaagat

SEQ ID NO: 5126212 - DNA, 17 bp, Homo sapiens
aatttacctaagattac

SEQ ID NO: 5126213 - DNA, 23 bp, Homo sapiens
aatttacctctcattagaaaggc

SEQ ID NO: 5126214 - DNA, 23 bp, Homo sapiens
aatttacctcttatgagctccat

SEQ ID NO: 5126215 - DNA, 19 bp, Homo sapiens
aatttacgtcttgagaaat

SEQ ID NO: 5126216 - DNA, 20 bp, Homo sapiens
aatttacgtcttgagaaata

SEQ ID NO: 5126217 - DNA, 16 bp, Homo sapiens
aatttactaatttatt

SEQ ID NO: 5126218 - DNA, 17 bp, Homo sapiens
aatttactacaatatgt

SEQ ID NO: 5126219 - DNA, 15 bp, Homo sapiens
aatttactatatata

SEQ ID NO: 5126220 - DNA, 19 bp, Homo sapiens
aatttactatatatatatg

SEQ ID NO: 5126221 - DNA, 22 bp, Homo sapiens
aatttactcacagcacttgttt

SEQ ID NO: 5126222 - DNA, 12 bp, Homo sapiens
aatttactctgt

SEQ ID NO: 5126223 - DNA, 14 bp, Homo sapiens
aatttactgattcc

SEQ ID NO: 5126224 - DNA, 14 bp, Homo sapiens
aatttactggccac

SEQ ID NO: 5126225 - DNA, 17 bp, Homo sapiens
aatttacttaagtgttc

SEQ ID NO: 5126226 - DNA, 15 bp, Homo sapiens
aatttacttgttttg

SEQ ID NO: 5126227 - DNA, 12 bp, Homo sapiens
aatttactttaa

SEQ ID NO: 5126228 - DNA, 15 bp, Homo sapiens
aatttactttaaact

SEQ ID NO: 5126229 - DNA, 18 bp, Homo sapiens
aatttactttaaactaca

SEQ ID NO: 5126230 - DNA, 14 bp, Homo sapiens
aatttactttcttc

SEQ ID NO: 5126231 - DNA, 18 bp, Homo sapiens
aatttactttcttcacca

SEQ ID NO: 5126232 - DNA, 15 bp, Homo sapiens
aatttactttggaaa

SEQ ID NO: 5126233 - DNA, 14 bp, Homo sapiens
aatttactttgtag

SEQ ID NO: 5126234 - DNA, 12 bp, Homo sapiens
aatttactttta

SEQ ID NO: 5126235 - DNA, 13 bp, Homo sapiens
aatttacttttaa

SEQ ID NO: 5126236 - DNA, 17 bp, Homo sapiens
aatttactttttaaaca

SEQ ID NO: 5126237 - DNA, 22 bp, Homo sapiens
aatttactttttaaacagtgtt

SEQ ID NO: 5126238 - DNA, 21 bp, Homo sapiens
aatttagaaaaagaacatgca

SEQ ID NO: 5126239 - DNA, 15 bp, Homo sapiens
aatttagaaaaagtc

SEQ ID NO: 5126240 - DNA, 12 bp, Homo sapiens
aatttagaaact

SEQ ID NO: 5126241 - DNA, 15 bp, Homo sapiens
aatttagaaactgaa

SEQ ID NO: 5126242 - DNA, 17 bp, Homo sapiens
aatttagaaactgaaaa

SEQ ID NO: 5126243 - DNA, 15 bp, Homo sapiens
aatttagaaatattc

SEQ ID NO: 5126244 - DNA, 16 bp, Homo sapiens
aatttagaaatattca

SEQ ID NO: 5126245 - DNA, 14 bp, Homo sapiens
aatttagaaatcat

SEQ ID NO: 5126246 - DNA, 15 bp, Homo sapiens
aatttagaaatcatt

SEQ ID NO: 5126247 - DNA, 15 bp, Homo sapiens
aatttagaatgaata

SEQ ID NO: 5126248 - DNA, 20 bp, Homo sapiens
aatttagacaacctgaaatt

SEQ ID NO: 5126249 - DNA, 16 bp, Homo sapiens
aatttagaccttttcc

SEQ ID NO: 5126250 - DNA, 15 bp, Homo sapiens
aatttagatattttc

SEQ ID NO: 5126251 - DNA, 19 bp, Homo sapiens
aatttagatattttccata

SEQ ID NO: 5126252 - DNA, 12 bp, Homo sapiens
aatttagatctt

SEQ ID NO: 5126253 - DNA, 14 bp, Homo sapiens
aatttagatcttat

SEQ ID NO: 5126254 - DNA, 17 bp, Homo sapiens
aatttagatcttatatt

SEQ ID NO: 5126255 - DNA, 17 bp, Homo sapiens
aatttagatgaatttag

SEQ ID NO: 5126256 - DNA, 13 bp, Homo sapiens
aatttagcaaact

SEQ ID NO: 5126257 - DNA, 20 bp, Homo sapiens
aatttagcagtccatttttg

SEQ ID NO: 5126258 - DNA, 13 bp, Homo sapiens
aatttagcattgt

SEQ ID NO: 5126259 - DNA, 14 bp, Homo sapiens
aatttagcattgta

SEQ ID NO: 5126260 - DNA, 17 bp, Homo sapiens
aatttaggggtagaaaa

SEQ ID NO: 5126261 - DNA, 16 bp, Homo sapiens
aatttagggtactaaa

SEQ ID NO: 5126262 - DNA, 15 bp, Homo sapiens
aatttaggtaaataa

SEQ ID NO: 5126263 - DNA, 20 bp, Homo sapiens
aatttagtaaaccaatccta

SEQ ID NO: 5126264 - DNA, 16 bp, Homo sapiens
aatttagtaaatgtta

SEQ ID NO: 5126265 - DNA, 16 bp, Homo sapiens
aatttagtaagtgacc

SEQ ID NO: 5126266 - DNA, 12 bp, Homo sapiens
aatttagtatta

SEQ ID NO: 5126267 - DNA, 15 bp, Homo sapiens
aatttagtcattatt

SEQ ID NO: 5126268 - DNA, 23 bp, Homo sapiens
aatttagtgatcttagcatagct

SEQ ID NO: 5126269 - DNA, 18 bp, Homo sapiens
aatttagtggatggaata

SEQ ID NO: 5126270 - DNA, 21 bp, Homo sapiens
aatttagtggatggaatatca

SEQ ID NO: 5126271 - DNA, 17 bp, Homo sapiens
aatttagtgtatatgtg

SEQ ID NO: 5126272 - DNA, 16 bp, Homo sapiens
aatttagtgtatccat

SEQ ID NO: 5126273 - DNA, 22 bp, Homo sapiens
aatttagtgtttttttatttct

SEQ ID NO: 5126274 - DNA, 13 bp, Homo sapiens
aatttagttgttt

SEQ ID NO: 5126275 - DNA, 22 bp, Homo sapiens
aatttagtttcatataaagtat

SEQ ID NO: 5126276 - DNA, 21 bp, Homo sapiens
aatttagtttgtactcagtgg

SEQ ID NO: 5126277 - DNA, 15 bp, Homo sapiens
aatttagtttgttaa

SEQ ID NO: 5126278 - DNA, 23 bp, Homo sapiens
aatttagtttgttaaagcctgtt

SEQ ID NO: 5126279 - DNA, 15 bp, Homo sapiens
aatttataaaattag

SEQ ID NO: 5126280 - DNA, 21 bp, Homo sapiens
aatttataaaattagaaagca

SEQ ID NO: 5126281 - DNA, 11 bp, Homo sapiens
aatttataaca

SEQ ID NO: 5126282 - DNA, 19 bp, Homo sapiens
aatttataagcattgccat

SEQ ID NO: 5126283 - DNA, 20 bp, Homo sapiens
aatttataagcattgccatt

SEQ ID NO: 5126284 - DNA, 21 bp, Homo sapiens
aatttataatataaatatatg

SEQ ID NO: 5126285 - DNA, 19 bp, Homo sapiens
aatttataatgaatacttt

SEQ ID NO: 5126286 - DNA, 23 bp, Homo sapiens
aatttataatgaatactttctta

SEQ ID NO: 5126287 - DNA, 15 bp, Homo sapiens
aatttataatgatta

SEQ ID NO: 5126288 - DNA, 14 bp, Homo sapiens
aatttataattaca

SEQ ID NO: 5126289 - DNA, 18 bp, Homo sapiens
aatttatacaaaataatt

SEQ ID NO: 5126290 - DNA, 19 bp, Homo sapiens
aatttatacaaaataattt

SEQ ID NO: 5126291 - DNA, 20 bp, Homo sapiens
aatttatacaaaataattta

SEQ ID NO: 5126292 - DNA, 17 bp, Homo sapiens
aatttatacttaaaaaa

SEQ ID NO: 5126293 - DNA, 19 bp, Homo sapiens
aatttataggcagatcttt

SEQ ID NO: 5126294 - DNA, 22 bp, Homo sapiens
aatttataggcagatctttaaa

SEQ ID NO: 5126295 - DNA, 23 bp, Homo sapiens
aatttataggcagatctttaaat

SEQ ID NO: 5126296 - DNA, 15 bp, Homo sapiens
aatttatagtaatga

SEQ ID NO: 5126297 - DNA, 17 bp, Homo sapiens
aatttatagtttataca

SEQ ID NO: 5126298 - DNA, 12 bp, Homo sapiens
aatttatataaa

SEQ ID NO: 5126299 - DNA, 22 bp, Homo sapiens
aatttatatagcaagtgctatt

SEQ ID NO: 5126300 - DNA, 14 bp, Homo sapiens
aatttatatcttta

SEQ ID NO: 5126301 - DNA, 19 bp, Homo sapiens
aatttatatctttatgcaa

SEQ ID NO: 5126302 - DNA, 16 bp, Homo sapiens
aatttatatgtatatt

SEQ ID NO: 5126303 - DNA, 16 bp, Homo sapiens
aatttatattccattt

SEQ ID NO: 5126304 - DNA, 16 bp, Homo sapiens
aatttatatttagtaa

SEQ ID NO: 5126305 - DNA, 17 bp, Homo sapiens
aatttatattttagaaa

SEQ ID NO: 5126306 - DNA, 13 bp, Homo sapiens
aatttatcaaaaa

SEQ ID NO: 5126307 - DNA, 17 bp, Homo sapiens
aatttatcaaaaaacaa

SEQ ID NO: 5126308 - DNA, 20 bp, Homo sapiens
aatttatcagattgcttttg

SEQ ID NO: 5126309 - DNA, 22 bp, Homo sapiens
aatttatcagattgcttttgtg

SEQ ID NO: 5126310 - DNA, 21 bp, Homo sapiens
aatttatcatgttttataatt

SEQ ID NO: 5126311 - DNA, 18 bp, Homo sapiens
aatttatccaattttgat

SEQ ID NO: 5126312 - DNA, 23 bp, Homo sapiens
aatttatcctgaaatttcagatt

SEQ ID NO: 5126313 - DNA, 12 bp, Homo sapiens
aatttatctaaa

SEQ ID NO: 5126314 - DNA, 13 bp, Homo sapiens
aatttatctgaat

SEQ ID NO: 5126315 - DNA, 14 bp, Homo sapiens
aatttatctgttgt

SEQ ID NO: 5126316 - DNA, 14 bp, Homo sapiens
aatttatcttaagt

SEQ ID NO: 5126317 - DNA, 18 bp, Homo sapiens
aatttatcttgtctctgg

SEQ ID NO: 5126318 - DNA, 14 bp, Homo sapiens
aatttatctttacc

SEQ ID NO: 5126319 - DNA, 18 bp, Homo sapiens
aatttatctttaccaaaa

SEQ ID NO: 5126320 - DNA, 19 bp, Homo sapiens
aatttatctttaccaaaaa

SEQ ID NO: 5126321 - DNA, 21 bp, Homo sapiens
aatttatgagtgttaataaaa

SEQ ID NO: 5126322 - DNA, 23 bp, Homo sapiens
aatttatgcagagacagctgttt

SEQ ID NO: 5126323 - DNA, 16 bp, Homo sapiens
aatttatgcatttcat

SEQ ID NO: 5126324 - DNA, 14 bp, Homo sapiens
aatttatggtttct

SEQ ID NO: 5126325 - DNA, 19 bp, Homo sapiens
aatttatgtaaggtttttt

SEQ ID NO: 5126326 - DNA, 15 bp, Homo sapiens
aatttatgtcatttt

SEQ ID NO: 5126327 - DNA, 19 bp, Homo sapiens
aatttatgtcattttcaga

SEQ ID NO: 5126328 - DNA, 12 bp, Homo sapiens
aatttattaaat

SEQ ID NO: 5126329 - DNA, 16 bp, Homo sapiens
aatttattaagtctgg

SEQ ID NO: 5126330 - DNA, 16 bp, Homo sapiens
aatttattaatctaaa

SEQ ID NO: 5126331 - DNA, 17 bp, Homo sapiens
aatttattaattgcttt

SEQ ID NO: 5126332 - DNA, 18 bp, Homo sapiens
aatttattaattgctttg

SEQ ID NO: 5126333 - DNA, 16 bp, Homo sapiens
aatttattagtttaaa

SEQ ID NO: 5126334 - DNA, 19 bp, Homo sapiens
aatttattatatatttaca

SEQ ID NO: 5126335 - DNA, 22 bp, Homo sapiens
aatttattatatatttacagaa

SEQ ID NO: 5126336 - DNA, 14 bp, Homo sapiens
aatttattatggca

SEQ ID NO: 5126337 - DNA, 17 bp, Homo sapiens
aatttattatggcacat

SEQ ID NO: 5126338 - DNA, 22 bp, Homo sapiens
aatttattattaaatcagtttt

SEQ ID NO: 5126339 - DNA, 14 bp, Homo sapiens
aatttattcaagaa

SEQ ID NO: 5126340 - DNA, 12 bp, Homo sapiens
aatttattcaat

SEQ ID NO: 5126341 - DNA, 16 bp, Homo sapiens
aatttattcacatata

SEQ ID NO: 5126342 - DNA, 13 bp, Homo sapiens
aatttattcttat

SEQ ID NO: 5126343 - DNA, 23 bp, Homo sapiens
aatttattgaggaaaaatatgtg

SEQ ID NO: 5126344 - DNA, 14 bp, Homo sapiens
aatttattgcacaa

SEQ ID NO: 5126345 - DNA, 15 bp, Homo sapiens
aatttattgcacaaa

SEQ ID NO: 5126346 - DNA, 12 bp, Homo sapiens
aatttattgccg

SEQ ID NO: 5126347 - DNA, 12 bp, Homo sapiens
aatttattggca

SEQ ID NO: 5126348 - DNA, 14 bp, Homo sapiens
aatttattggcagc

SEQ ID NO: 5126349 - DNA, 14 bp, Homo sapiens
aatttattggggtg

SEQ ID NO: 5126350 - DNA, 18 bp, Homo sapiens
aatttattggggtgacct

SEQ ID NO: 5126351 - DNA, 20 bp, Homo sapiens
aatttattgtaccaaagctg

SEQ ID NO: 5126352 - DNA, 21 bp, Homo sapiens
aatttattgtaccaaagctgt

SEQ ID NO: 5126353 - DNA, 22 bp, Homo sapiens
aatttattgtaccaaagctgtt

SEQ ID NO: 5126354 - DNA, 19 bp, Homo sapiens
aatttattgtctgtctaca

SEQ ID NO: 5126355 - DNA, 14 bp, Homo sapiens
aatttattgtcttt

SEQ ID NO: 5126356 - DNA, 15 bp, Homo sapiens
aatttattgtcttta

SEQ ID NO: 5126357 - DNA, 12 bp, Homo sapiens
aatttatttaat

SEQ ID NO: 5126358 - DNA, 17 bp, Homo sapiens
aatttatttatactatt

SEQ ID NO: 5126359 - DNA, 20 bp, Homo sapiens
aatttatttatactatttag

SEQ ID NO: 5126360 - DNA, 13 bp, Homo sapiens
aatttatttatgt

SEQ ID NO: 5126361 - DNA, 12 bp, Homo sapiens
aatttatttcaa

SEQ ID NO: 5126362 - DNA, 14 bp, Homo sapiens
aatttatttcaata

SEQ ID NO: 5126363 - DNA, 16 bp, Homo sapiens
aatttatttcatccag

SEQ ID NO: 5126364 - DNA, 14 bp, Homo sapiens
aatttatttccact

SEQ ID NO: 5126365 - DNA, 21 bp, Homo sapiens
aatttatttccactaaaaata

SEQ ID NO: 5126366 - DNA, 13 bp, Homo sapiens
aatttatttgcaa

SEQ ID NO: 5126367 - DNA, 16 bp, Homo sapiens
aatttattttataaga

SEQ ID NO: 5126368 - DNA, 17 bp, Homo sapiens
acaagcctgagaactga

SEQ ID NO: 5126369 - DNA, 22 bp, Homo sapiens
acaagcctgagggaaaggccag

SEQ ID NO: 5126370 - DNA, 23 bp, Homo sapiens
acaagcctgagggaaaggccagc

SEQ ID NO: 5126371 - DNA, 14 bp, Homo sapiens
acaagcctggagga

SEQ ID NO: 5126372 - DNA, 18 bp, Homo sapiens
acaagcctggcaacacac

SEQ ID NO: 5126373 - DNA, 22 bp, Homo sapiens
acaagcgtcacttctcctgctg

SEQ ID NO: 5126374 - DNA, 18 bp, Homo sapiens
acaagcgtgagccactgc

SEQ ID NO: 5126375 - DNA, 15 bp, Homo sapiens
acaagctacatatgt

SEQ ID NO: 5126376 - DNA, 18 bp, Homo sapiens
acaagctaggaaagagga

SEQ ID NO: 5126377 - DNA, 23 bp, Homo sapiens
acaagctaggaaagaggaggcag

SEQ ID NO: 5126378 - DNA, 14 bp, Homo sapiens
acaagctatgggaa

SEQ ID NO: 5126379 - DNA, 23 bp, Homo sapiens
acaagctattccctcaaatctga

SEQ ID NO: 5126380 - DNA, 16 bp, Homo sapiens
acaagctcatccctgg

SEQ ID NO: 5126381 - DNA, 18 bp, Homo sapiens
acaagctcatccctggac

SEQ ID NO: 5126382 - DNA, 19 bp, Homo sapiens
acaagctcatccctggact

SEQ ID NO: 5126383 - DNA, 15 bp, Homo sapiens
acaagctccaagctc

SEQ ID NO: 5126384 - DNA, 17 bp, Homo sapiens
acaagctccaagctccc

SEQ ID NO: 5126385 - DNA, 19 bp, Homo sapiens
acaagctccaagctcccag

SEQ ID NO: 5126386 - DNA, 18 bp, Homo sapiens
acaagctccatttaaaca

SEQ ID NO: 5126387 - DNA, 15 bp, Homo sapiens
acaagctccctggtg

SEQ ID NO: 5126388 - DNA, 22 bp, Homo sapiens
acaagctctcgggactagctgc

SEQ ID NO: 5126389 - DNA, 14 bp, Homo sapiens
acaagctcttgttt

SEQ ID NO: 5126390 - DNA, 16 bp, Homo sapiens
acaagctcttgtttct

SEQ ID NO: 5126391 - DNA, 14 bp, Homo sapiens
acaagctgacttgg

SEQ ID NO: 5126392 - DNA, 12 bp, Homo sapiens
acaagctgagca

SEQ ID NO: 5126393 - DNA, 17 bp, Homo sapiens
acaagctgatagtgttt

SEQ ID NO: 5126394 - DNA, 22 bp, Homo sapiens
acaagctgcaccctcaggcagg

SEQ ID NO: 5126395 - DNA, 23 bp, Homo sapiens
acaagctgcaccctcaggcaggt

SEQ ID NO: 5126396 - DNA, 16 bp, Homo sapiens
acaagctgcctccctg

SEQ ID NO: 5126397 - DNA, 13 bp, Homo sapiens
acaagctgcctct

SEQ ID NO: 5126398 - DNA, 13 bp, Homo sapiens
acaagctgtatca

SEQ ID NO: 5126399 - DNA, 17 bp, Homo sapiens
acaagctgtatcactgc

SEQ ID NO: 5126400 - DNA, 13 bp, Homo sapiens
acaagctgtccct

SEQ ID NO: 5126401 - DNA, 19 bp, Homo sapiens
acaagctgtccctgcaggg

SEQ ID NO: 5126402 - DNA, 12 bp, Homo sapiens
acaagctgtgca

SEQ ID NO: 5126403 - DNA, 20 bp, Homo sapiens
acaagctgttgaccaggcac

SEQ ID NO: 5126404 - DNA, 17 bp, Homo sapiens
acaagcttcaaagccat

SEQ ID NO: 5126405 - DNA, 16 bp, Homo sapiens
acaagcttctgagacg

SEQ ID NO: 5126406 - DNA, 19 bp, Homo sapiens
acaagcttgtatatacata

SEQ ID NO: 5126407 - DNA, 15 bp, Homo sapiens
acaaggaaaacagta

SEQ ID NO: 5126408 - DNA, 16 bp, Homo sapiens
acaaggaaaacagtaa

SEQ ID NO: 5126409 - DNA, 23 bp, Homo sapiens
acaaggaaaatctatatttgtct

SEQ ID NO: 5126410 - DNA, 14 bp, Homo sapiens
acaaggaagaaatt

SEQ ID NO: 5126411 - DNA, 23 bp, Homo sapiens
acaaggaaggaaaagaaagaaga

SEQ ID NO: 5126412 - DNA, 17 bp, Homo sapiens
acaaggaaggtggtggg

SEQ ID NO: 5126413 - DNA, 23 bp, Homo sapiens
acaaggaataaatgagagggaat

SEQ ID NO: 5126414 - DNA, 23 bp, Homo sapiens
acaaggaatttccctgtgtggat

SEQ ID NO: 5126415 - DNA, 16 bp, Homo sapiens
acaaggacaactttat

SEQ ID NO: 5126416 - DNA, 14 bp, Homo sapiens
acaaggacacgcgc

SEQ ID NO: 5126417 - DNA, 19 bp, Homo sapiens
acaaggaccctgttttcca

SEQ ID NO: 5126418 - DNA, 22 bp, Homo sapiens
acaaggaccctgttttccacac

SEQ ID NO: 5126419 - DNA, 21 bp, Homo sapiens
acaaggagagcggaggaggaa

SEQ ID NO: 5126420 - DNA, 14 bp, Homo sapiens
acaaggagatttct

SEQ ID NO: 5126421 - DNA, 15 bp, Homo sapiens
acaaggagatttctt

SEQ ID NO: 5126422 - DNA, 15 bp, Homo sapiens
acaaggagctcaccc

SEQ ID NO: 5126423 - DNA, 20 bp, Homo sapiens
acaaggagctcaccctgccc

SEQ ID NO: 5126424 - DNA, 18 bp, Homo sapiens
acaaggagctttcttgtt

SEQ ID NO: 5126425 - DNA, 22 bp, Homo sapiens
acaaggagctttcttgtttctt

SEQ ID NO: 5126426 - DNA, 17 bp, Homo sapiens
acaaggagggcctctgg

SEQ ID NO: 5126427 - DNA, 20 bp, Homo sapiens
acaaggagggcctctggtgt

SEQ ID NO: 5126428 - DNA, 13 bp, Homo sapiens
acaaggagtgccc

SEQ ID NO: 5126429 - DNA, 15 bp, Homo sapiens
acaaggagtgcccgc

SEQ ID NO: 5126430 - DNA, 17 bp, Homo sapiens
acaaggatagatgctgg

SEQ ID NO: 5126431 - DNA, 22 bp, Homo sapiens
acaaggatagatgctggcccag

SEQ ID NO: 5126432 - DNA, 17 bp, Homo sapiens
acaaggattgctactgt

SEQ ID NO: 5126433 - DNA, 20 bp, Homo sapiens
acaaggcacttcatgtaaag

SEQ ID NO: 5126434 - DNA, 22 bp, Homo sapiens
acaaggcacttgtcactatgct

SEQ ID NO: 5126435 - DNA, 18 bp, Homo sapiens
acaaggcagcaaggcccg

SEQ ID NO: 5126436 - DNA, 21 bp, Homo sapiens
acaaggcagcaaggcccgagc

SEQ ID NO: 5126437 - DNA, 19 bp, Homo sapiens
acaaggcagcctgaacact

SEQ ID NO: 5126438 - DNA, 22 bp, Homo sapiens
acaaggcaggaggagctgataa

SEQ ID NO: 5126439 - DNA, 13 bp, Homo sapiens
acaaggcaggcct

SEQ ID NO: 5126440 - DNA, 21 bp, Homo sapiens
acaaggcatgtagggggagcc

SEQ ID NO: 5126441 - DNA, 23 bp, Homo sapiens
acaaggcattcagcagtttctga

SEQ ID NO: 5126442 - DNA, 19 bp, Homo sapiens
acaaggccagaaaaagaag

SEQ ID NO: 5126443 - DNA, 20 bp, Homo sapiens
acaaggccagaaaaagaaga

SEQ ID NO: 5126444 - DNA, 19 bp, Homo sapiens
acaaggccagcacccaaag

SEQ ID NO: 5126445 - DNA, 21 bp, Homo sapiens
acaaggccagcacccaaaggg

SEQ ID NO: 5126446 - DNA, 18 bp, Homo sapiens
acaaggccatctgggctc

SEQ ID NO: 5126447 - DNA, 11 bp, Homo sapiens
acaaggcccag

SEQ ID NO: 5126448 - DNA, 18 bp, Homo sapiens
acaaggcccagccctggg

SEQ ID NO: 5126449 - DNA, 13 bp, Homo sapiens
acaaggccccaga

SEQ ID NO: 5126450 - DNA, 17 bp, Homo sapiens
acaaggccccagagact

SEQ ID NO: 5126451 - DNA, 18 bp, Homo sapiens
acaaggccctttaacttg

SEQ ID NO: 5126452 - DNA, 20 bp, Homo sapiens
acaaggccctttaacttgtc

SEQ ID NO: 5126453 - DNA, 12 bp, Homo sapiens
acaaggcctggt

SEQ ID NO: 5126454 - DNA, 14 bp, Homo sapiens
acaaggctggccag

SEQ ID NO: 5126455 - DNA, 13 bp, Homo sapiens
acaaggctgggca

SEQ ID NO: 5126456 - DNA, 23 bp, Homo sapiens
acaaggctgggcacctctagtgc

SEQ ID NO: 5126457 - DNA, 14 bp, Homo sapiens
acaaggctgtgcca

SEQ ID NO: 5126458 - DNA, 20 bp, Homo sapiens
acaaggctgtgccaggctgg

SEQ ID NO: 5126459 - DNA, 17 bp, Homo sapiens
acaaggcttaaaagagt

SEQ ID NO: 5126460 - DNA, 17 bp, Homo sapiens
acaaggcttgctgcaga

SEQ ID NO: 5126461 - DNA, 12 bp, Homo sapiens
acaagggaaggg

SEQ ID NO: 5126462 - DNA, 22 bp, Homo sapiens
acaagggaaggggcctccctcc

SEQ ID NO: 5126463 - DNA, 18 bp, Homo sapiens
acaagggagagacctcat

SEQ ID NO: 5126464 - DNA, 14 bp, Homo sapiens
acaagggaggcagt

SEQ ID NO: 5126465 - DNA, 11 bp, Homo sapiens
acaagggattc

SEQ ID NO: 5126466 - DNA, 16 bp, Homo sapiens
acaagggattctggga

SEQ ID NO: 5126467 - DNA, 18 bp, Homo sapiens
acaagggattctgggaag

SEQ ID NO: 5126468 - DNA, 16 bp, Homo sapiens
acaagggcagtggagg

SEQ ID NO: 5126469 - DNA, 22 bp, Homo sapiens
acaaggggatccagtgtgtaaa

SEQ ID NO: 5126470 - DNA, 14 bp, Homo sapiens
acaaggggcccagt

SEQ ID NO: 5126471 - DNA, 22 bp, Homo sapiens
acaaggggcccttggagcgtgg

SEQ ID NO: 5126472 - DNA, 16 bp, Homo sapiens
acaaggggcttttccc

SEQ ID NO: 5126473 - DNA, 14 bp, Homo sapiens
acaaggggtggaag

SEQ ID NO: 5126474 - DNA, 15 bp, Homo sapiens
acaaggggtggaagg

SEQ ID NO: 5126475 - DNA, 18 bp, Homo sapiens
acaagggtctagggagag

SEQ ID NO: 5126476 - DNA, 14 bp, Homo sapiens
acaaggtaattgtt

SEQ ID NO: 5126477 - DNA, 22 bp, Homo sapiens
acaaggtaattgttttttaaag

SEQ ID NO: 5126478 - DNA, 21 bp, Homo sapiens
acaaggtaggctgcaaaatta

SEQ ID NO: 5126479 - DNA, 14 bp, Homo sapiens
acaaggtagttttt

SEQ ID NO: 5126480 - DNA, 16 bp, Homo sapiens
acaaggtagtttttac

SEQ ID NO: 5126481 - DNA, 19 bp, Homo sapiens
acaaggtcaaagttctggt

SEQ ID NO: 5126482 - DNA, 14 bp, Homo sapiens
acaaggtccactcc

SEQ ID NO: 5126483 - DNA, 20 bp, Homo sapiens
acaaggtccactccctgctc

SEQ ID NO: 5126484 - DNA, 16 bp, Homo sapiens
acaaggtctttaaagt

SEQ ID NO: 5126485 - DNA, 20 bp, Homo sapiens
acaaggtgcacagacctcag

SEQ ID NO: 5126486 - DNA, 22 bp, Homo sapiens
acaaggtgccctttagccagat

SEQ ID NO: 5126487 - DNA, 12 bp, Homo sapiens
acaaggtgctaa

SEQ ID NO: 5126488 - DNA, 15 bp, Homo sapiens
acaaggtgctaacat

SEQ ID NO: 5126489 - DNA, 19 bp, Homo sapiens
acaaggtgctaacatagat

SEQ ID NO: 5126490 - DNA, 17 bp, Homo sapiens
acaaggtgctcagacat

SEQ ID NO: 5126491 - DNA, 14 bp, Homo sapiens
acaaggtgggcagg

SEQ ID NO: 5126492 - DNA, 13 bp, Homo sapiens
acaaggtgttcat

SEQ ID NO: 5126493 - DNA, 14 bp, Homo sapiens
acaaggttgctgtt

SEQ ID NO: 5126494 - DNA, 16 bp, Homo sapiens
acaagtaaaactgtgg

SEQ ID NO: 5126495 - DNA, 22 bp, Homo sapiens
acaagtaaagctagacaaaggc

SEQ ID NO: 5126496 - DNA, 13 bp, Homo sapiens
acaagtaacaaaa

SEQ ID NO: 5126497 - DNA, 13 bp, Homo sapiens
acaagtaactcag

SEQ ID NO: 5126498 - DNA, 23 bp, Homo sapiens
acaagtaagagactcagcctgca

SEQ ID NO: 5126499 - DNA, 13 bp, Homo sapiens
acaagtaatgaat

SEQ ID NO: 5126500 - DNA, 16 bp, Homo sapiens
acaagtaatgaatttt

SEQ ID NO: 5126501 - DNA, 17 bp, Homo sapiens
acaagtaatgaatttta

SEQ ID NO: 5126502 - DNA, 14 bp, Homo sapiens
acaagtaatgtaaa

SEQ ID NO: 5126503 - DNA, 13 bp, Homo sapiens
acaagtaatgtat

SEQ ID NO: 5126504 - DNA, 16 bp, Homo sapiens
acaagtaatttcagtg

SEQ ID NO: 5126505 - DNA, 18 bp, Homo sapiens
acaagtactggtaagatt

SEQ ID NO: 5126506 - DNA, 16 bp, Homo sapiens
acaagtaggagacaca

SEQ ID NO: 5126507 - DNA, 18 bp, Homo sapiens
acaagtagttcatgagta

SEQ ID NO: 5126508 - DNA, 20 bp, Homo sapiens
acaagtagttctgtatttga

SEQ ID NO: 5126509 - DNA, 13 bp, Homo sapiens
acaagtatataat

SEQ ID NO: 5126510 - DNA, 18 bp, Homo sapiens
acaagtatatacttttaa

SEQ ID NO: 5126511 - DNA, 18 bp, Homo sapiens
acaagtatcatctaaata

SEQ ID NO: 5126512 - DNA, 23 bp, Homo sapiens
acaagtatgaataaagacaccta

SEQ ID NO: 5126513 - DNA, 22 bp, Homo sapiens
acaagtatgaatattactctca

SEQ ID NO: 5126514 - DNA, 21 bp, Homo sapiens
acaagtattctacctaaatct

SEQ ID NO: 5126515 - DNA, 11 bp, Homo sapiens
acaagtattta

SEQ ID NO: 5126516 - DNA, 17 bp, Homo sapiens
acaagtatttattccca

SEQ ID NO: 5126517 - DNA, 17 bp, Homo sapiens
acaagtatttgttaatt

SEQ ID NO: 5126518 - DNA, 19 bp, Homo sapiens
acaagtcacggtctaaaca

SEQ ID NO: 5126519 - DNA, 18 bp, Homo sapiens
acaagtcatggtcacagt

SEQ ID NO: 5126520 - DNA, 21 bp, Homo sapiens
acaagtcattttaactttatc

SEQ ID NO: 5126521 - DNA, 21 bp, Homo sapiens
acaagtcctggatgttgtgtg

SEQ ID NO: 5126522 - DNA, 16 bp, Homo sapiens
acaagtcctgtgaatt

SEQ ID NO: 5126523 - DNA, 17 bp, Homo sapiens
acaagtctaaacaatga

SEQ ID NO: 5126524 - DNA, 18 bp, Homo sapiens
acaagtctaaacaatgaa

SEQ ID NO: 5126525 - DNA, 18 bp, Homo sapiens
acaagtctagtcttctgg

SEQ ID NO: 5126526 - DNA, 20 bp, Homo sapiens
acaagtctgcatttcatatt

SEQ ID NO: 5126527 - DNA, 15 bp, Homo sapiens
acaagtctttctcct

SEQ ID NO: 5126528 - DNA, 18 bp, Homo sapiens
acaagtctttctcctctt

SEQ ID NO: 5126529 - DNA, 12 bp, Homo sapiens
acaagtgaaaac

SEQ ID NO: 5126530 - DNA, 23 bp, Homo sapiens
acaagtgaaataacaaaatggac

SEQ ID NO: 5126531 - DNA, 21 bp, Homo sapiens
acaagtgaatctttctcctgg

SEQ ID NO: 5126532 - DNA, 18 bp, Homo sapiens
acaagtgactgtatctgt

SEQ ID NO: 5126533 - DNA, 18 bp, Homo sapiens
acaagtgataatacagat

SEQ ID NO: 5126534 - DNA, 18 bp, Homo sapiens
acaagtgattttcattgt

SEQ ID NO: 5126535 - DNA, 14 bp, Homo sapiens
acaagtgccctcca

SEQ ID NO: 5126536 - DNA, 16 bp, Homo sapiens
acaagtgctcaagcag

SEQ ID NO: 5126537 - DNA, 18 bp, Homo sapiens
acaagtgctcagttccaa

SEQ ID NO: 5126538 - DNA, 18 bp, Homo sapiens
acaagtggactcagggca

SEQ ID NO: 5126539 - DNA, 19 bp, Homo sapiens
acaagtggactcagggcag

SEQ ID NO: 5126540 - DNA, 14 bp, Homo sapiens
acaagtggaggggg

SEQ ID NO: 5126541 - DNA, 22 bp, Homo sapiens
acaagtggagggggtgtctgga

SEQ ID NO: 5126542 - DNA, 13 bp, Homo sapiens
acaagtggcctta

SEQ ID NO: 5126543 - DNA, 19 bp, Homo sapiens
acaagtggctccccacctg

SEQ ID NO: 5126544 - DNA, 18 bp, Homo sapiens
acaagtgtaataaatcaa

SEQ ID NO: 5126545 - DNA, 13 bp, Homo sapiens
acaagtgtaatga

SEQ ID NO: 5126546 - DNA, 18 bp, Homo sapiens
aatttattttataagaaa

SEQ ID NO: 5126547 - DNA, 21 bp, Homo sapiens
aatttattttataagaaaaac

SEQ ID NO: 5126548 - DNA, 17 bp, Homo sapiens
aatttattttgctccct

SEQ ID NO: 5126549 - DNA, 18 bp, Homo sapiens
aatttattttgctccctc

SEQ ID NO: 5126550 - DNA, 13 bp, Homo sapiens
aatttattttgta

SEQ ID NO: 5126551 - DNA, 14 bp, Homo sapiens
aatttattttgtga

SEQ ID NO: 5126552 - DNA, 15 bp, Homo sapiens
aatttattttgtgaa

SEQ ID NO: 5126553 - DNA, 19 bp, Homo sapiens
aatttatttttaagaaaga

SEQ ID NO: 5126554 - DNA, 16 bp, Homo sapiens
aatttcaaaaatataa

SEQ ID NO: 5126555 - DNA, 17 bp, Homo sapiens
aatttcaaaagacatgt

SEQ ID NO: 5126556 - DNA, 15 bp, Homo sapiens
aatttcaaaatacat

SEQ ID NO: 5126557 - DNA, 12 bp, Homo sapiens
aatttcaaaatg

SEQ ID NO: 5126558 - DNA, 18 bp, Homo sapiens
aatttcaaaatgcatgtg

SEQ ID NO: 5126559 - DNA, 22 bp, Homo sapiens
aatttcaaaatgcatgtgattg

SEQ ID NO: 5126560 - DNA, 16 bp, Homo sapiens
aatttcaaacttttga

SEQ ID NO: 5126561 - DNA, 22 bp, Homo sapiens
aatttcaaacttttgaaagatg

SEQ ID NO: 5126562 - DNA, 13 bp, Homo sapiens
aatttcaaataga

SEQ ID NO: 5126563 - DNA, 18 bp, Homo sapiens
aatttcaaatagaatatg

SEQ ID NO: 5126564 - DNA, 11 bp, Homo sapiens
aatttcaaatg

SEQ ID NO: 5126565 - DNA, 19 bp, Homo sapiens
aatttcaaccagcattcat

SEQ ID NO: 5126566 - DNA, 23 bp, Homo sapiens
aatttcaacgcctgcctttggca

SEQ ID NO: 5126567 - DNA, 18 bp, Homo sapiens
aatttcaagaatgtttca

SEQ ID NO: 5126568 - DNA, 21 bp, Homo sapiens
aatttcaagaatgtttcagtt

SEQ ID NO: 5126569 - DNA, 17 bp, Homo sapiens
aatttcaagcttatttt

SEQ ID NO: 5126570 - DNA, 16 bp, Homo sapiens
aatttcaagtcttcct

SEQ ID NO: 5126571 - DNA, 21 bp, Homo sapiens
aatttcaataaaagataaatt

SEQ ID NO: 5126572 - DNA, 13 bp, Homo sapiens
aatttcaatgctt

SEQ ID NO: 5126573 - DNA, 16 bp, Homo sapiens
aatttcaatgcttctt

SEQ ID NO: 5126574 - DNA, 23 bp, Homo sapiens
aatttcaatgcttcttttagtca

SEQ ID NO: 5126575 - DNA, 15 bp, Homo sapiens
aatttcaatttttaa

SEQ ID NO: 5126576 - DNA, 14 bp, Homo sapiens
aatttcacagttct

SEQ ID NO: 5126577 - DNA, 18 bp, Homo sapiens
aatttcacagttctgtaa

SEQ ID NO: 5126578 - DNA, 19 bp, Homo sapiens
aatttcacagttctgtaat

SEQ ID NO: 5126579 - DNA, 17 bp, Homo sapiens
aatttcacatggacttt

SEQ ID NO: 5126580 - DNA, 14 bp, Homo sapiens
aatttcacattaat

SEQ ID NO: 5126581 - DNA, 18 bp, Homo sapiens
aatttcaccccattttct

SEQ ID NO: 5126582 - DNA, 21 bp, Homo sapiens
aatttcaccccattttctgtg

SEQ ID NO: 5126583 - DNA, 16 bp, Homo sapiens
aatttcactgtctttt

SEQ ID NO: 5126584 - DNA, 17 bp, Homo sapiens
aatttcactgtctttta

SEQ ID NO: 5126585 - DNA, 16 bp, Homo sapiens
aatttcactttagaag

SEQ ID NO: 5126586 - DNA, 21 bp, Homo sapiens
aatttcagaaactaagaatca

SEQ ID NO: 5126587 - DNA, 13 bp, Homo sapiens
aatttcagactcc

SEQ ID NO: 5126588 - DNA, 22 bp, Homo sapiens
aatttcagctagttaataattc

SEQ ID NO: 5126589 - DNA, 12 bp, Homo sapiens
aatttcaggaaa

SEQ ID NO: 5126590 - DNA, 14 bp, Homo sapiens
aatttcaggattaa

SEQ ID NO: 5126591 - DNA, 22 bp, Homo sapiens
aatttcaggattaactaaagaa

SEQ ID NO: 5126592 - DNA, 21 bp, Homo sapiens
aatttcaggcattttgttcta

SEQ ID NO: 5126593 - DNA, 19 bp, Homo sapiens
aatttcaggctccccagat

SEQ ID NO: 5126594 - DNA, 17 bp, Homo sapiens
aatttcaggttgttggt

SEQ ID NO: 5126595 - DNA, 16 bp, Homo sapiens
aatttcagtaagatca

SEQ ID NO: 5126596 - DNA, 20 bp, Homo sapiens
aatttcagtcaattctgatg

SEQ ID NO: 5126597 - DNA, 21 bp, Homo sapiens
aatttcagtgggaaatatgcc

SEQ ID NO: 5126598 - DNA, 22 bp, Homo sapiens
aatttcatacctatcatcttaa

SEQ ID NO: 5126599 - DNA, 21 bp, Homo sapiens
aatttcatactatttagattt

SEQ ID NO: 5126600 - DNA, 18 bp, Homo sapiens
aatttcatagctgtactt

SEQ ID NO: 5126601 - DNA, 21 bp, Homo sapiens
aatttcatagctgtacttctt

SEQ ID NO: 5126602 - DNA, 23 bp, Homo sapiens
aatttcatcactaaaagaaaatc

SEQ ID NO: 5126603 - DNA, 18 bp, Homo sapiens
aatttcatgattggctta

SEQ ID NO: 5126604 - DNA, 13 bp, Homo sapiens
aatttcatgcaca

SEQ ID NO: 5126605 - DNA, 13 bp, Homo sapiens
aatttcatgtata

SEQ ID NO: 5126606 - DNA, 16 bp, Homo sapiens
aatttcattcaattta

SEQ ID NO: 5126607 - DNA, 16 bp, Homo sapiens
aatttcattctcttga

SEQ ID NO: 5126608 - DNA, 15 bp, Homo sapiens
aatttcattgcactt

SEQ ID NO: 5126609 - DNA, 17 bp, Homo sapiens
aatttcattgcactttc

SEQ ID NO: 5126610 - DNA, 15 bp, Homo sapiens
aatttcatttccagc

SEQ ID NO: 5126611 - DNA, 22 bp, Homo sapiens
aatttcatttccagcattttta

SEQ ID NO: 5126612 - DNA, 11 bp, Homo sapiens
aatttccaaaa

SEQ ID NO: 5126613 - DNA, 22 bp, Homo sapiens
aatttccagaactgcacaatga

SEQ ID NO: 5126614 - DNA, 11 bp, Homo sapiens
aatttccagag

SEQ ID NO: 5126615 - DNA, 20 bp, Homo sapiens
aatttccagtacctttgtca

SEQ ID NO: 5126616 - DNA, 18 bp, Homo sapiens
aatttccatgatacaaag

SEQ ID NO: 5126617 - DNA, 21 bp, Homo sapiens
aatttccattcttttaaatgg

SEQ ID NO: 5126618 - DNA, 21 bp, Homo sapiens
aatttccatttacttaagact

SEQ ID NO: 5126619 - DNA, 19 bp, Homo sapiens
aatttcccaattaggaagt

SEQ ID NO: 5126620 - DNA, 18 bp, Homo sapiens
aatttcccacccatctcc

SEQ ID NO: 5126621 - DNA, 17 bp, Homo sapiens
aatttcccagttaaaga

SEQ ID NO: 5126622 - DNA, 18 bp, Homo sapiens
aatttcccagttaaagat

SEQ ID NO: 5126623 - DNA, 19 bp, Homo sapiens
aatttcccagttaaagatt

SEQ ID NO: 5126624 - DNA, 22 bp, Homo sapiens
aatttccccaacagtgtgaagt

SEQ ID NO: 5126625 - DNA, 19 bp, Homo sapiens
aatttccccctaaaccaac

SEQ ID NO: 5126626 - DNA, 18 bp, Homo sapiens
aatttccccctgttctta

SEQ ID NO: 5126627 - DNA, 18 bp, Homo sapiens
aatttcccctaatctttt

SEQ ID NO: 5126628 - DNA, 15 bp, Homo sapiens
aatttccctcaggtt

SEQ ID NO: 5126629 - DNA, 12 bp, Homo sapiens
aatttccctggg

SEQ ID NO: 5126630 - DNA, 17 bp, Homo sapiens
aatttcccttcttgcat

SEQ ID NO: 5126631 - DNA, 15 bp, Homo sapiens
aatttcctatctgta

SEQ ID NO: 5126632 - DNA, 16 bp, Homo sapiens
aatttcctcactgcct

SEQ ID NO: 5126633 - DNA, 22 bp, Homo sapiens
aatttcctcactgcctggtaaa

SEQ ID NO: 5126634 - DNA, 20 bp, Homo sapiens
aatttcctgctgaaaataac

SEQ ID NO: 5126635 - DNA, 15 bp, Homo sapiens
aatttcctgtaatat

SEQ ID NO: 5126636 - DNA, 20 bp, Homo sapiens
aatttcctgttggatttgtt

SEQ ID NO: 5126637 - DNA, 19 bp, Homo sapiens
aatttccttctgttaagaa

SEQ ID NO: 5126638 - DNA, 20 bp, Homo sapiens
aatttccttctgttaagaaa

SEQ ID NO: 5126639 - DNA, 22 bp, Homo sapiens
aatttccttctgttaagaaagg

SEQ ID NO: 5126640 - DNA, 16 bp, Homo sapiens
aatttcctttatattt

SEQ ID NO: 5126641 - DNA, 15 bp, Homo sapiens
aatttcctttttgac

SEQ ID NO: 5126642 - DNA, 18 bp, Homo sapiens
aatttcctttttgacact

SEQ ID NO: 5126643 - DNA, 19 bp, Homo sapiens
aatttcctttttgacactg

SEQ ID NO: 5126644 - DNA, 21 bp, Homo sapiens
aatttcctttttgacactgaa

SEQ ID NO: 5126645 - DNA, 23 bp, Homo sapiens
aatttcgccttaaactctggaca

SEQ ID NO: 5126646 - DNA, 19 bp, Homo sapiens
aatttcgcttcttagaaca

SEQ ID NO: 5126647 - DNA, 15 bp, Homo sapiens
aatttctaaagataa

SEQ ID NO: 5126648 - DNA, 16 bp, Homo sapiens
aatttctaaagataat

SEQ ID NO: 5126649 - DNA, 23 bp, Homo sapiens
aatttctaaagataatattactg

SEQ ID NO: 5126650 - DNA, 20 bp, Homo sapiens
aatttctaagaagttacttt

SEQ ID NO: 5126651 - DNA, 17 bp, Homo sapiens
aatttctaatgtttact

SEQ ID NO: 5126652 - DNA, 14 bp, Homo sapiens
aatttctaccagat

SEQ ID NO: 5126653 - DNA, 18 bp, Homo sapiens
aatttctaccatttcaga

SEQ ID NO: 5126654 - DNA, 11 bp, Homo sapiens
aatttctacta

SEQ ID NO: 5126655 - DNA, 14 bp, Homo sapiens
aatttctactgagc

SEQ ID NO: 5126656 - DNA, 18 bp, Homo sapiens
aatttctataaatttaag

SEQ ID NO: 5126657 - DNA, 15 bp, Homo sapiens
aatttctattaatat

SEQ ID NO: 5126658 - DNA, 23 bp, Homo sapiens
aatttctcatgttccttttgaaa

SEQ ID NO: 5126659 - DNA, 19 bp, Homo sapiens
aatttctcccagtcattta

SEQ ID NO: 5126660 - DNA, 19 bp, Homo sapiens
aatttctctcaatttgggt

SEQ ID NO: 5126661 - DNA, 22 bp, Homo sapiens
aatttctgccaataaattctaa

SEQ ID NO: 5126662 - DNA, 13 bp, Homo sapiens
aatttctgccata

SEQ ID NO: 5126663 - DNA, 13 bp, Homo sapiens
aatttctgccctg

SEQ ID NO: 5126664 - DNA, 12 bp, Homo sapiens
aatttctgcctt

SEQ ID NO: 5126665 - DNA, 18 bp, Homo sapiens
aatttctgctgtggtcta

SEQ ID NO: 5126666 - DNA, 21 bp, Homo sapiens
aatttctgcttttgcatcttt

SEQ ID NO: 5126667 - DNA, 15 bp, Homo sapiens
aatttctggaagaaa

SEQ ID NO: 5126668 - DNA, 17 bp, Homo sapiens
aatttctggaagaaagg

SEQ ID NO: 5126669 - DNA, 18 bp, Homo sapiens
aatttctggaagaaaggc

SEQ ID NO: 5126670 - DNA, 23 bp, Homo sapiens
aatttctggaagattcttactgt

SEQ ID NO: 5126671 - DNA, 16 bp, Homo sapiens
aatttctggcaaatat

SEQ ID NO: 5126672 - DNA, 21 bp, Homo sapiens
aatttctggcaaatattttgt

SEQ ID NO: 5126673 - DNA, 22 bp, Homo sapiens
aatttctggcaaatattttgtc

SEQ ID NO: 5126674 - DNA, 19 bp, Homo sapiens
aatttctgggatatttaac

SEQ ID NO: 5126675 - DNA, 20 bp, Homo sapiens
aatttctgggatatttaact

SEQ ID NO: 5126676 - DNA, 17 bp, Homo sapiens
aatttctggtgcacagg

SEQ ID NO: 5126677 - DNA, 18 bp, Homo sapiens
aatttctggtttgcctga

SEQ ID NO: 5126678 - DNA, 16 bp, Homo sapiens
aatttctgtcagaatg

SEQ ID NO: 5126679 - DNA, 13 bp, Homo sapiens
aatttctgtccag

SEQ ID NO: 5126680 - DNA, 20 bp, Homo sapiens
aatttctgtgccctcctgac

SEQ ID NO: 5126681 - DNA, 17 bp, Homo sapiens
aatttctgttgttttaa

SEQ ID NO: 5126682 - DNA, 12 bp, Homo sapiens
aatttcttaact

SEQ ID NO: 5126683 - DNA, 14 bp, Homo sapiens
aatttcttcaaaat

SEQ ID NO: 5126684 - DNA, 19 bp, Homo sapiens
aatttcttcaaaatgtata

SEQ ID NO: 5126685 - DNA, 20 bp, Homo sapiens
aatttcttcactgttgaaaa

SEQ ID NO: 5126686 - DNA, 23 bp, Homo sapiens
aatttcttccacgtaattcaatt

SEQ ID NO: 5126687 - DNA, 13 bp, Homo sapiens
aatttcttcctat

SEQ ID NO: 5126688 - DNA, 14 bp, Homo sapiens
aatttcttccttcc

SEQ ID NO: 5126689 - DNA, 23 bp, Homo sapiens
aatttcttctcctggagttgcat

SEQ ID NO: 5126690 - DNA, 21 bp, Homo sapiens
aatttcttctggtagtgtcag

SEQ ID NO: 5126691 - DNA, 22 bp, Homo sapiens
aatttcttctttagatgccaaa

SEQ ID NO: 5126692 - DNA, 15 bp, Homo sapiens
aatttcttgcaattt

SEQ ID NO: 5126693 - DNA, 24 bp, Homo sapiens
aatttcttgctctatctctcaaaa

SEQ ID NO: 5126694 - DNA, 13 bp, Homo sapiens
aatttcttgctgc

SEQ ID NO: 5126695 - DNA, 22 bp, Homo sapiens
aatttcttggcaaattttaaaa

SEQ ID NO: 5126696 - DNA, 20 bp, Homo sapiens
aatttcttggtaagaagccg

SEQ ID NO: 5126697 - DNA, 15 bp, Homo sapiens
aatttctttaaatgt

SEQ ID NO: 5126698 - DNA, 16 bp, Homo sapiens
aatttcttttattaat

SEQ ID NO: 5126699 - DNA, 17 bp, Homo sapiens
aatttcttttattaata

SEQ ID NO: 5126700 - DNA, 22 bp, Homo sapiens
aatttctttttggtaaatatga

SEQ ID NO: 5126701 - DNA, 19 bp, Homo sapiens
aatttcttttttcctctga

SEQ ID NO: 5126702 - DNA, 22 bp, Homo sapiens
aatttctttttttcctttttaa

SEQ ID NO: 5126703 - DNA, 21 bp, Homo sapiens
aatttgaaaaatgcataataa

SEQ ID NO: 5126704 - DNA, 23 bp, Homo sapiens
aatttgaaaacataatctgcaaa

SEQ ID NO: 5126705 - DNA, 15 bp, Homo sapiens
aatttgaaaatgtcc

SEQ ID NO: 5126706 - DNA, 15 bp, Homo sapiens
aatttgaaacacttt

SEQ ID NO: 5126707 - DNA, 19 bp, Homo sapiens
aatttgaaagtttccttat

SEQ ID NO: 5126708 - DNA, 13 bp, Homo sapiens
aatttgaaatcta

SEQ ID NO: 5126709 - DNA, 22 bp, Homo sapiens
aatttgaacaggtcaaagatgt

SEQ ID NO: 5126710 - DNA, 12 bp, Homo sapiens
aatttgaacttt

SEQ ID NO: 5126711 - DNA, 18 bp, Homo sapiens
aatttgaagaattaatga

SEQ ID NO: 5126712 - DNA, 23 bp, Homo sapiens
aatttgaagaattaatgacaaca

SEQ ID NO: 5126713 - DNA, 17 bp, Homo sapiens
aatttgaagacttcaaa

SEQ ID NO: 5126714 - DNA, 14 bp, Homo sapiens
aatttgaagtaatg

SEQ ID NO: 5126715 - DNA, 19 bp, Homo sapiens
aatttgaataaactctccc

SEQ ID NO: 5126716 - DNA, 17 bp, Homo sapiens
aatttgaataagcagaa

SEQ ID NO: 5126717 - DNA, 17 bp, Homo sapiens
aatttgaataataaatc

SEQ ID NO: 5126718 - DNA, 12 bp, Homo sapiens
aatttgaatcag

SEQ ID NO: 5126719 - DNA, 12 bp, Homo sapiens
aatttgaatgaa

SEQ ID NO: 5126720 - DNA, 14 bp, Homo sapiens
aatttgaatggatt

SEQ ID NO: 5126721 - DNA, 16 bp, Homo sapiens
aatttgaattgggtcc

SEQ ID NO: 5126722 - DNA, 13 bp, Homo sapiens
aatttgaattttg

SEQ ID NO: 5126723 - DNA, 17 bp, Homo sapiens
aatttgactaattttac

SEQ ID NO: 5126724 - DNA, 15 bp, Homo sapiens
aatttgagaagaaat

SEQ ID NO: 5126725 - DNA, 15 bp, Homo sapiens
aatttgagactgaaa

SEQ ID NO: 5126726 - DNA, 18 bp, Homo sapiens
aatttgagagaaatatga

SEQ ID NO: 5126727 - DNA, 20 bp, Homo sapiens
aatttgagagaaatatgaag

SEQ ID NO: 5126728 - DNA, 17 bp, Homo sapiens
aatttgagatacaaaca

SEQ ID NO: 5126729 - DNA, 14 bp, Homo sapiens
aatttgagcaattc

SEQ ID NO: 5126730 - DNA, 19 bp, Homo sapiens
aatttgagcaattcatttc

SEQ ID NO: 5126731 - DNA, 21 bp, Homo sapiens
aatttgagcaattcatttcac

SEQ ID NO: 5126732 - DNA, 22 bp, Homo sapiens
aatttgagcaattcatttcact

SEQ ID NO: 5126733 - DNA, 17 bp, Homo sapiens
aatttgagccatttaaa

SEQ ID NO: 5126734 - DNA, 24 bp, Homo sapiens
aatttgagccatttaaagaccaat

SEQ ID NO: 5126735 - DNA, 14 bp, Homo sapiens
aatttgagcttgtg

SEQ ID NO: 5126736 - DNA, 18 bp, Homo sapiens
aatttgaggagggaatga

SEQ ID NO: 5126737 - DNA, 22 bp, Homo sapiens
aatttgaggtctacattcttgg

SEQ ID NO: 5126738 - DNA, 21 bp, Homo sapiens
aatttgaggtctagagagaac

SEQ ID NO: 5126739 - DNA, 19 bp, Homo sapiens
aatttgagtgtatatatat

SEQ ID NO: 5126740 - DNA, 20 bp, Homo sapiens
aatttgagttggatcatcta

SEQ ID NO: 5126741 - DNA, 17 bp, Homo sapiens
aatttgagtttgctgtt

SEQ ID NO: 5126742 - DNA, 20 bp, Homo sapiens
aatttgagtttgctgtttta

SEQ ID NO: 5126743 - DNA, 15 bp, Homo sapiens
aatttgataatgaca

SEQ ID NO: 5126744 - DNA, 17 bp, Homo sapiens
aatttgatacaaaatgc

SEQ ID NO: 5126745 - DNA, 18 bp, Homo sapiens
aatttgatacataataaa

SEQ ID NO: 5126746 - DNA, 13 bp, Homo sapiens
aatttgatactta

SEQ ID NO: 5126747 - DNA, 18 bp, Homo sapiens
aatttgatacttatattt

SEQ ID NO: 5126748 - DNA, 18 bp, Homo sapiens
aatttgatcgttccagtt

SEQ ID NO: 5126749 - DNA, 17 bp, Homo sapiens
aatttgatgatgttaaa

SEQ ID NO: 5126750 - DNA, 21 bp, Homo sapiens
aatttgatgatgttaaatgta

SEQ ID NO: 5126751 - DNA, 22 bp, Homo sapiens
aatttgatgcccagataatata

SEQ ID NO: 5126752 - DNA, 19 bp, Homo sapiens
aatttgatggtgaatatta

SEQ ID NO: 5126753 - DNA, 17 bp, Homo sapiens
aatttgattattaacat

SEQ ID NO: 5126754 - DNA, 15 bp, Homo sapiens
aatttgattctaaat

SEQ ID NO: 5126755 - DNA, 14 bp, Homo sapiens
aatttgattctatg

SEQ ID NO: 5126756 - DNA, 18 bp, Homo sapiens
aatttgattgctttgctg

SEQ ID NO: 5126757 - DNA, 10 bp, Homo sapiens
aatttgcaaa

SEQ ID NO: 5126758 - DNA, 13 bp, Homo sapiens
aatttgcaaagta

SEQ ID NO: 5126759 - DNA, 14 bp, Homo sapiens
aatttgcaaagtac

SEQ ID NO: 5126760 - DNA, 18 bp, Homo sapiens
aatttgcaaagtactgta

SEQ ID NO: 5126761 - DNA, 17 bp, Homo sapiens
aatttgcacacaaaaca

SEQ ID NO: 5126762 - DNA, 22 bp, Homo sapiens
aatttgcacatcttggctatgt

SEQ ID NO: 5126763 - DNA, 12 bp, Homo sapiens
aatttgcacatt

SEQ ID NO: 5126764 - DNA, 16 bp, Homo sapiens
aatttgcacattaaat

SEQ ID NO: 5126765 - DNA, 14 bp, Homo sapiens
aatttgcactgtta

SEQ ID NO: 5126766 - DNA, 16 bp, Homo sapiens
aatttgcactgtttaa

SEQ ID NO: 5126767 - DNA, 15 bp, Homo sapiens
aatttgcagcttcca

SEQ ID NO: 5126768 - DNA, 16 bp, Homo sapiens
aatttgcatattctat

SEQ ID NO: 5126769 - DNA, 17 bp, Homo sapiens
aatttgcatattctatt

SEQ ID NO: 5126770 - DNA, 21 bp, Homo sapiens
aatttgcatgaaagcacaagg

SEQ ID NO: 5126771 - DNA, 11 bp, Homo sapiens
aatttgcatgt

SEQ ID NO: 5126772 - DNA, 17 bp, Homo sapiens
aatttgcattaaattac

SEQ ID NO: 5126773 - DNA, 18 bp, Homo sapiens
aatttgcattaaattcac

SEQ ID NO: 5126774 - DNA, 21 bp, Homo sapiens
aatttgcattaaattcacaaa

SEQ ID NO: 5126775 - DNA, 13 bp, Homo sapiens
aatttgcattact

SEQ ID NO: 5126776 - DNA, 21 bp, Homo sapiens
aatttgcattactctggtgga

SEQ ID NO: 5126777 - DNA, 20 bp, Homo sapiens
aatttgccaaaataatgtct

SEQ ID NO: 5126778 - DNA, 17 bp, Homo sapiens
aatttgccagaggacca

SEQ ID NO: 5126779 - DNA, 16 bp, Homo sapiens
aatttgccagttttat

SEQ ID NO: 5126780 - DNA, 20 bp, Homo sapiens
aatttgccatgacatttcat

SEQ ID NO: 5126781 - DNA, 14 bp, Homo sapiens
aatttgccattggt

SEQ ID NO: 5126782 - DNA, 17 bp, Homo sapiens
aatttgcccctggcaaa

SEQ ID NO: 5126783 - DNA, 22 bp, Homo sapiens
aatttgcccctggcaaatgcac

SEQ ID NO: 5126784 - DNA, 14 bp, Homo sapiens
aatttgcctctgtc

SEQ ID NO: 5126785 - DNA, 23 bp, Homo sapiens
aatttgctctgtggtaagagata

SEQ ID NO: 5126786 - DNA, 16 bp, Homo sapiens
aatttgctgaaaacat

SEQ ID NO: 5126787 - DNA, 22 bp, Homo sapiens
aatttgctgaaaacattacatg

SEQ ID NO: 5126788 - DNA, 12 bp, Homo sapiens
aatttgctgctg

SEQ ID NO: 5126789 - DNA, 13 bp, Homo sapiens
aatttgctgctga

SEQ ID NO: 5126790 - DNA, 22 bp, Homo sapiens
aatttgctggaacacaaagacc

SEQ ID NO: 5126791 - DNA, 13 bp, Homo sapiens
aatttgctttaat

SEQ ID NO: 5126792 - DNA, 15 bp, Homo sapiens
aatttgctttacata

SEQ ID NO: 5126793 - DNA, 9 bp, Homo sapiens
aatttggaa

SEQ ID NO: 5126794 - DNA, 17 bp, Homo sapiens
aatttggaagaaaacta

SEQ ID NO: 5126795 - DNA, 15 bp, Homo sapiens
aatttggaattctgt

SEQ ID NO: 5126796 - DNA, 19 bp, Homo sapiens
aatttggaccattttcctg

SEQ ID NO: 5126797 - DNA, 18 bp, Homo sapiens
aatttggagcacaaaatt

SEQ ID NO: 5126798 - DNA, 20 bp, Homo sapiens
aatttggagcacaaaattca

SEQ ID NO: 5126799 - DNA, 21 bp, Homo sapiens
aatttggataataaaaattgt

SEQ ID NO: 5126800 - DNA, 23 bp, Homo sapiens
aatttggataataaaaattgtag

SEQ ID NO: 5126801 - DNA, 13 bp, Homo sapiens
aatttggcaattt

SEQ ID NO: 5126802 - DNA, 18 bp, Homo sapiens
aatttggcaattttgtgg

SEQ ID NO: 5126803 - DNA, 15 bp, Homo sapiens
aatttggccatgaaa

SEQ ID NO: 5126804 - DNA, 16 bp, Homo sapiens
aatttggccatgaaag

SEQ ID NO: 5126805 - DNA, 15 bp, Homo sapiens
aatttggctttcaca

SEQ ID NO: 5126806 - DNA, 16 bp, Homo sapiens
aatttgggaacataaa

SEQ ID NO: 5126807 - DNA, 22 bp, Homo sapiens
aatttgggaaggtttgtgtttt

SEQ ID NO: 5126808 - DNA, 21 bp, Homo sapiens
aatttgggagaagcaaatata

SEQ ID NO: 5126809 - DNA, 22 bp, Homo sapiens
aatttgggagaagcaaatatag

SEQ ID NO: 5126810 - DNA, 19 bp, Homo sapiens
aatttgggatactaaagta

SEQ ID NO: 5126811 - DNA, 14 bp, Homo sapiens
aatttgggatgctg

SEQ ID NO: 5126812 - DNA, 15 bp, Homo sapiens
aatttgggcatctct

SEQ ID NO: 5126813 - DNA, 23 bp, Homo sapiens
aatttgggctaaaacttagaaaa

SEQ ID NO: 5126814 - DNA, 22 bp, Homo sapiens
aatttggggacagattcagtct

SEQ ID NO: 5126815 - DNA, 24 bp, Homo sapiens
aatttggggacagattcagtcttg

SEQ ID NO: 5126816 - DNA, 18 bp, Homo sapiens
aatttgggggaaaattta

SEQ ID NO: 5126817 - DNA, 15 bp, Homo sapiens
aatttgggtttttaa

SEQ ID NO: 5126818 - DNA, 15 bp, Homo sapiens
aatttggtacacatg

SEQ ID NO: 5126819 - DNA, 16 bp, Homo sapiens
aatttggtacacatgt

SEQ ID NO: 5126820 - DNA, 23 bp, Homo sapiens
aatttggtacacatgtgttatct

SEQ ID NO: 5126821 - DNA, 19 bp, Homo sapiens
aatttggtgtggctgtatt

SEQ ID NO: 5126822 - DNA, 16 bp, Homo sapiens
aatttggttctaatag

SEQ ID NO: 5126823 - DNA, 22 bp, Homo sapiens
aatttggttctaatagaactca

SEQ ID NO: 5126824 - DNA, 17 bp, Homo sapiens
aatttggttctaggccg

SEQ ID NO: 5126825 - DNA, 19 bp, Homo sapiens
aatttggtttaaaaataca

SEQ ID NO: 5126826 - DNA, 16 bp, Homo sapiens
aatttggtttgttaat

SEQ ID NO: 5126827 - DNA, 17 bp, Homo sapiens
aatttggtttgttaatt

SEQ ID NO: 5126828 - DNA, 21 bp, Homo sapiens
aatttggttttcacattggaa

SEQ ID NO: 5126829 - DNA, 15 bp, Homo sapiens
aatttggtttttact

SEQ ID NO: 5126830 - DNA, 22 bp, Homo sapiens
aatttggtttttactcaaccaa

SEQ ID NO: 5126831 - DNA, 22 bp, Homo sapiens
aatttgtaaaaacagcattgct

SEQ ID NO: 5126832 - DNA, 17 bp, Homo sapiens
aatttgtaaaacttctg

SEQ ID NO: 5126833 - DNA, 19 bp, Homo sapiens
aatttgtaaaacttctgct

SEQ ID NO: 5126834 - DNA, 12 bp, Homo sapiens
aatttgtaaact

SEQ ID NO: 5126835 - DNA, 16 bp, Homo sapiens
aatttgtaaacttctg

SEQ ID NO: 5126836 - DNA, 13 bp, Homo sapiens
aatttgtaaatga

SEQ ID NO: 5126837 - DNA, 15 bp, Homo sapiens
aatttgtaaatgatt

SEQ ID NO: 5126838 - DNA, 13 bp, Homo sapiens
aatttgtaatata

SEQ ID NO: 5126839 - DNA, 23 bp, Homo sapiens
aatttgtaatatatcctgtttgt

SEQ ID NO: 5126840 - DNA, 13 bp, Homo sapiens
aatttgtacaatg

SEQ ID NO: 5126841 - DNA, 19 bp, Homo sapiens
aatttgtacaatggtttat

SEQ ID NO: 5126842 - DNA, 12 bp, Homo sapiens
aatttgtacttc

SEQ ID NO: 5126843 - DNA, 15 bp, Homo sapiens
aatttgtataaaatg

SEQ ID NO: 5126844 - DNA, 21 bp, Homo sapiens
aatttgtatcatgttttacta

SEQ ID NO: 5126845 - DNA, 12 bp, Homo sapiens
aatttgtatctg

SEQ ID NO: 5126846 - DNA, 20 bp, Homo sapiens
aatttgtatctgaaggagat

SEQ ID NO: 5126847 - DNA, 15 bp, Homo sapiens
aatttgtattaaaaa

SEQ ID NO: 5126848 - DNA, 19 bp, Homo sapiens
aatttgtattaaaaagcct

SEQ ID NO: 5126849 - DNA, 12 bp, Homo sapiens
aatttgtatttt

SEQ ID NO: 5126850 - DNA, 14 bp, Homo sapiens
aatttgtcactgga

SEQ ID NO: 5126851 - DNA, 16 bp, Homo sapiens
aatttgtcagcgttct

SEQ ID NO: 5126852 - DNA, 20 bp, Homo sapiens
aatttgtcatgttactaaat

SEQ ID NO: 5126853 - DNA, 16 bp, Homo sapiens
aatttgtcattttgaa

SEQ ID NO: 5126854 - DNA, 19 bp, Homo sapiens
aatttgtcattttgaagct

SEQ ID NO: 5126855 - DNA, 22 bp, Homo sapiens
aatttgtccaatggctgtaaac

SEQ ID NO: 5126856 - DNA, 20 bp, Homo sapiens
aatttgtccatttaaaaatg

SEQ ID NO: 5126857 - DNA, 21 bp, Homo sapiens
aatttgtccatttaaaaatga

SEQ ID NO: 5126858 - DNA, 20 bp, Homo sapiens
aatttgtcgggttctcccat

SEQ ID NO: 5126859 - DNA, 13 bp, Homo sapiens
aatttgtctccta

SEQ ID NO: 5126860 - DNA, 13 bp, Homo sapiens
aatttgtcttaaa

SEQ ID NO: 5126861 - DNA, 20 bp, Homo sapiens
aatttgtcttaaaaatttat

SEQ ID NO: 5126862 - DNA, 12 bp, Homo sapiens
aatttgtctttc

SEQ ID NO: 5126863 - DNA, 18 bp, Homo sapiens
aatttgtctttttgtata

SEQ ID NO: 5126864 - DNA, 19 bp, Homo sapiens
aatttgtgaactgtcatga

SEQ ID NO: 5126865 - DNA, 12 bp, Homo sapiens
aatttgtgaatt

SEQ ID NO: 5126866 - DNA, 20 bp, Homo sapiens
aatttgtgatacaatgctgt

SEQ ID NO: 5126867 - DNA, 19 bp, Homo sapiens
aatttgtggtaaagtagtt

SEQ ID NO: 5126868 - DNA, 14 bp, Homo sapiens
aatttgtggtgatt

SEQ ID NO: 5126869 - DNA, 18 bp, Homo sapiens
aatttgtggttgtagaag

SEQ ID NO: 5126870 - DNA, 14 bp, Homo sapiens
aatttgtgtaaatt

SEQ ID NO: 5126871 - DNA, 19 bp, Homo sapiens
aatttgtgtaataaagtgt

SEQ ID NO: 5126872 - DNA, 15 bp, Homo sapiens
aatttgtgtgcttca

SEQ ID NO: 5126873 - DNA, 14 bp, Homo sapiens
aatttgtgtggata

SEQ ID NO: 5126874 - DNA, 14 bp, Homo sapiens
aatttgtgtgtttt

SEQ ID NO: 5126875 - DNA, 23 bp, Homo sapiens
aatttgtgtgtttttagctgtga

SEQ ID NO: 5126876 - DNA, 14 bp, Homo sapiens
aatttgttaatata

SEQ ID NO: 5126877 - DNA, 14 bp, Homo sapiens
aatttgttaattcc

SEQ ID NO: 5126878 - DNA, 15 bp, Homo sapiens
aatttgttcttgtat

SEQ ID NO: 5126879 - DNA, 18 bp, Homo sapiens
aatttgttgaaattatgt

SEQ ID NO: 5126880 - DNA, 12 bp, Homo sapiens
aatttgttgcat

SEQ ID NO: 5126881 - DNA, 18 bp, Homo sapiens
aatttgtttaaaattctc

SEQ ID NO: 5126882 - DNA, 23 bp, Homo sapiens
aatttgtttaatctacattataa

SEQ ID NO: 5126883 - DNA, 17 bp, Homo sapiens
aatttgtttaattaaat

SEQ ID NO: 5126884 - DNA, 22 bp, Homo sapiens
aatttgtttacttgtaaattga

SEQ ID NO: 5126885 - DNA, 21 bp, Homo sapiens
aatttgtttagaagtacgttt

SEQ ID NO: 5126886 - DNA, 15 bp, Homo sapiens
aatttgtttcatcta

SEQ ID NO: 5126887 - DNA, 17 bp, Homo sapiens
aatttgtttgtattttt

SEQ ID NO: 5126888 - DNA, 16 bp, Homo sapiens
aatttgttttagccat

SEQ ID NO: 5126889 - DNA, 17 bp, Homo sapiens
aatttgttttagccatt

SEQ ID NO: 5126890 - DNA, 14 bp, Homo sapiens
aatttgttttcatt

SEQ ID NO: 5126891 - DNA, 17 bp, Homo sapiens
aatttgtttttcttatc

SEQ ID NO: 5126892 - DNA, 16 bp, Homo sapiens
aatttgtttttgcatt

SEQ ID NO: 5126893 - DNA, 17 bp, Homo sapiens
aatttgtttttgcattt

SEQ ID NO: 5126894 - DNA, 14 bp, Homo sapiens
aattttaaaaaata

SEQ ID NO: 5126895 - DNA, 18 bp, Homo sapiens
aattttaaaaaataacat

SEQ ID NO: 5126896 - DNA, 20 bp, Homo sapiens
aattttaaaaaataacatat

SEQ ID NO: 5126897 - DNA, 17 bp, Homo sapiens
aattttaaaaatgaatc

SEQ ID NO: 5126898 - DNA, 21 bp, Homo sapiens
aattttaaaacatgctgttta

SEQ ID NO: 5126899 - DNA, 14 bp, Homo sapiens
aattttaaaagtca

SEQ ID NO: 5126900 - DNA, 20 bp, Homo sapiens
aattttaaaagttgggaaaa

SEQ ID NO: 5126901 - DNA, 22 bp, Homo sapiens
aattttaaaatctgagggaaat

SEQ ID NO: 5126902 - DNA, 13 bp, Homo sapiens
aattttaaaattg

SEQ ID NO: 5126903 - DNA, 16 bp, Homo sapiens
acaagtgtaatgaata

SEQ ID NO: 5126904 - DNA, 21 bp, Homo sapiens
acaagtgtaggccaccattat

SEQ ID NO: 5126905 - DNA, 12 bp, Homo sapiens
acaagtgtctaa

SEQ ID NO: 5126906 - DNA, 20 bp, Homo sapiens
acaagtgtgtggccccgccc

SEQ ID NO: 5126907 - DNA, 21 bp, Homo sapiens
acaagtgttcttaggtttact

SEQ ID NO: 5126908 - DNA, 19 bp, Homo sapiens
acaagtgttttagatgtta

SEQ ID NO: 5126909 - DNA, 22 bp, Homo sapiens
acaagtgttttagatgttacta

SEQ ID NO: 5126910 - DNA, 19 bp, Homo sapiens
acaagttaagattcttggt

SEQ ID NO: 5126911 - DNA, 20 bp, Homo sapiens
acaagttaaggtatctggta

SEQ ID NO: 5126912 - DNA, 11 bp, Homo sapiens
acaagttatta

SEQ ID NO: 5126913 - DNA, 16 bp, Homo sapiens
acaagttatttaaatc

SEQ ID NO: 5126914 - DNA, 20 bp, Homo sapiens
acaagttccaacatgcaata

SEQ ID NO: 5126915 - DNA, 16 bp, Homo sapiens
acaagttccagctggt

SEQ ID NO: 5126916 - DNA, 20 bp, Homo sapiens
acaagttccattatgaaaat

SEQ ID NO: 5126917 - DNA, 22 bp, Homo sapiens
acaagttccattatgaaaatct

SEQ ID NO: 5126918 - DNA, 17 bp, Homo sapiens
acaagttccctggagaa

SEQ ID NO: 5126919 - DNA, 17 bp, Homo sapiens
acaagttctttttaaaa

SEQ ID NO: 5126920 - DNA, 11 bp, Homo sapiens
acaagttgcct

SEQ ID NO: 5126921 - DNA, 16 bp, Homo sapiens
acaagttgctttgtta

SEQ ID NO: 5126922 - DNA, 18 bp, Homo sapiens
acaagttgcttttacctg

SEQ ID NO: 5126923 - DNA, 17 bp, Homo sapiens
acaagttggagtcactc

SEQ ID NO: 5126924 - DNA, 19 bp, Homo sapiens
acaagttggctagaagaaa

SEQ ID NO: 5126925 - DNA, 23 bp, Homo sapiens
acaagttggctagaagaaagtaa

SEQ ID NO: 5126926 - DNA, 15 bp, Homo sapiens
acaagttgtgtttga

SEQ ID NO: 5126927 - DNA, 16 bp, Homo sapiens
acaagttgttaaaaca

SEQ ID NO: 5126928 - DNA, 17 bp, Homo sapiens
acaagttgttaaaacat

SEQ ID NO: 5126929 - DNA, 13 bp, Homo sapiens
acaagttgttatt

SEQ ID NO: 5126930 - DNA, 14 bp, Homo sapiens
acaagtttaaaaat

SEQ ID NO: 5126931 - DNA, 16 bp, Homo sapiens
acaagtttatatatat

SEQ ID NO: 5126932 - DNA, 13 bp, Homo sapiens
acaagtttcagac

SEQ ID NO: 5126933 - DNA, 16 bp, Homo sapiens
acaagtttcagacagg

SEQ ID NO: 5126934 - DNA, 12 bp, Homo sapiens
acaagtttcagt

SEQ ID NO: 5126935 - DNA, 13 bp, Homo sapiens
acaagtttcagta

SEQ ID NO: 5126936 - DNA, 20 bp, Homo sapiens
acaagtttcagtaatagctg

SEQ ID NO: 5126937 - DNA, 14 bp, Homo sapiens
acaagtttgctaaa

SEQ ID NO: 5126938 - DNA, 21 bp, Homo sapiens
acaagtttgctaaaagaagag

SEQ ID NO: 5126939 - DNA, 14 bp, Homo sapiens
acaagttttagaaa

SEQ ID NO: 5126940 - DNA, 21 bp, Homo sapiens
acaagttttcataagcacact

SEQ ID NO: 5126941 - DNA, 16 bp, Homo sapiens
acaagttttggcagcc

SEQ ID NO: 5126942 - DNA, 16 bp, Homo sapiens
acaagtttttctgtca

SEQ ID NO: 5126943 - DNA, 17 bp, Homo sapiens
acaagtttttttgttca

SEQ ID NO: 5126944 - DNA, 18 bp, Homo sapiens
acaataaaaacaactttc

SEQ ID NO: 5126945 - DNA, 21 bp, Homo sapiens
acaataaaaacaactttcact

SEQ ID NO: 5126946 - DNA, 23 bp, Homo sapiens
acaataaaaaccaaactctgtgt

SEQ ID NO: 5126947 - DNA, 18 bp, Homo sapiens
acaataaaacaaataaat

SEQ ID NO: 5126948 - DNA, 13 bp, Homo sapiens
acaataaaacatt

SEQ ID NO: 5126949 - DNA, 15 bp, Homo sapiens
acaataaaacattat

SEQ ID NO: 5126950 - DNA, 14 bp, Homo sapiens
acaataaaacattc

SEQ ID NO: 5126951 - DNA, 15 bp, Homo sapiens
acaataaaagagctt

SEQ ID NO: 5126952 - DNA, 16 bp, Homo sapiens
acaataaaagagcttt

SEQ ID NO: 5126953 - DNA, 15 bp, Homo sapiens
acaataaaatattat

SEQ ID NO: 5126954 - DNA, 20 bp, Homo sapiens
acaataaaattttttttcat

SEQ ID NO: 5126955 - DNA, 21 bp, Homo sapiens
acaataaaattttttttcatg

SEQ ID NO: 5126956 - DNA, 23 bp, Homo sapiens
acaataaaattttttttcatgtt

SEQ ID NO: 5126957 - DNA, 13 bp, Homo sapiens
acaataaacagct

SEQ ID NO: 5126958 - DNA, 20 bp, Homo sapiens
acaataaaccaaacccagcc

SEQ ID NO: 5126959 - DNA, 12 bp, Homo sapiens
acaataaacctc

SEQ ID NO: 5126960 - DNA, 12 bp, Homo sapiens
acaataaactgg

SEQ ID NO: 5126961 - DNA, 17 bp, Homo sapiens
acaataaagatacatga

SEQ ID NO: 5126962 - DNA, 21 bp, Homo sapiens
acaataaagcagtcctgttca

SEQ ID NO: 5126963 - DNA, 19 bp, Homo sapiens
acaataaagcattttgcaa

SEQ ID NO: 5126964 - DNA, 19 bp, Homo sapiens
acaataaagggagaatggt

SEQ ID NO: 5126965 - DNA, 23 bp, Homo sapiens
acaataaagggagaatggtgctg

SEQ ID NO: 5126966 - DNA, 13 bp, Homo sapiens
acaataaagtgta

SEQ ID NO: 5126967 - DNA, 17 bp, Homo sapiens
acaataaagtttattat

SEQ ID NO: 5126968 - DNA, 18 bp, Homo sapiens
acaataaagtttgctttc

SEQ ID NO: 5126969 - DNA, 13 bp, Homo sapiens
acaataaatagac

SEQ ID NO: 5126970 - DNA, 14 bp, Homo sapiens
acaataaatatact

SEQ ID NO: 5126971 - DNA, 16 bp, Homo sapiens
acaataaatattctgc

SEQ ID NO: 5126972 - DNA, 15 bp, Homo sapiens
acaataaatgaatga

SEQ ID NO: 5126973 - DNA, 11 bp, Homo sapiens
acaataaatgc

SEQ ID NO: 5126974 - DNA, 12 bp, Homo sapiens
acaataaatggc

SEQ ID NO: 5126975 - DNA, 23 bp, Homo sapiens
acaataaatggccagtgctgctt

SEQ ID NO: 5126976 - DNA, 16 bp, Homo sapiens
acaataaatgtattca

SEQ ID NO: 5126977 - DNA, 18 bp, Homo sapiens
acaataaatgtattcaaa

SEQ ID NO: 5126978 - DNA, 15 bp, Homo sapiens
acaataacaacaatg

SEQ ID NO: 5126979 - DNA, 17 bp, Homo sapiens
acaataactactgtgtt

SEQ ID NO: 5126980 - DNA, 15 bp, Homo sapiens
acaataactcctccc

SEQ ID NO: 5126981 - DNA, 14 bp, Homo sapiens
acaataacttctta

SEQ ID NO: 5126982 - DNA, 16 bp, Homo sapiens
acaataagaacaagtt

SEQ ID NO: 5126983 - DNA, 16 bp, Homo sapiens
acaataagaatgaatc

SEQ ID NO: 5126984 - DNA, 18 bp, Homo sapiens
acaataagagtctccttc

SEQ ID NO: 5126985 - DNA, 16 bp, Homo sapiens
acaataagcaaaaaca

SEQ ID NO: 5126986 - DNA, 21 bp, Homo sapiens
acaataagcagaggtggaaaa

SEQ ID NO: 5126987 - DNA, 21 bp, Homo sapiens
acaataagcgttaagggcaga

SEQ ID NO: 5126988 - DNA, 14 bp, Homo sapiens
acaataaggaagga

SEQ ID NO: 5126989 - DNA, 22 bp, Homo sapiens
acaataagtaaatccacaggct

SEQ ID NO: 5126990 - DNA, 12 bp, Homo sapiens
acaataataaaa

SEQ ID NO: 5126991 - DNA, 15 bp, Homo sapiens
acaataataaaaagt

SEQ ID NO: 5126992 - DNA, 14 bp, Homo sapiens
acaataataaagat

SEQ ID NO: 5126993 - DNA, 18 bp, Homo sapiens
acaataataaatcctcag

SEQ ID NO: 5126994 - DNA, 13 bp, Homo sapiens
acaataataaatg

SEQ ID NO: 5126995 - DNA, 18 bp, Homo sapiens
acaataatattgttgtat

SEQ ID NO: 5126996 - DNA, 23 bp, Homo sapiens
acaataatattgttgtataattt

SEQ ID NO: 5126997 - DNA, 13 bp, Homo sapiens
acaataatatttc

SEQ ID NO: 5126998 - DNA, 15 bp, Homo sapiens
acaataatatttcaa

SEQ ID NO: 5126999 - DNA, 19 bp, Homo sapiens
acaataatctctatttgag

SEQ ID NO: 5127000 - DNA, 17 bp, Homo sapiens
acaataatgagttcact

SEQ ID NO: 5127001 - DNA, 12 bp, Homo sapiens
acaataatgcaa

SEQ ID NO: 5127002 - DNA, 22 bp, Homo sapiens
acaataatgtaatttagtctaa

SEQ ID NO: 5127003 - DNA, 17 bp, Homo sapiens
acaataatgtactcaca

SEQ ID NO: 5127004 - DNA, 19 bp, Homo sapiens
acaataatttgttttcatt

SEQ ID NO: 5127005 - DNA, 14 bp, Homo sapiens
acaataattttcta

SEQ ID NO: 5127006 - DNA, 12 bp, Homo sapiens
acaatacaaatg

SEQ ID NO: 5127007 - DNA, 14 bp, Homo sapiens
acaatacaaatgga

SEQ ID NO: 5127008 - DNA, 13 bp, Homo sapiens
acaatacaatgta

SEQ ID NO: 5127009 - DNA, 14 bp, Homo sapiens
acaatacaatgtac

SEQ ID NO: 5127010 - DNA, 22 bp, Homo sapiens
acaatacaatgtacaattatgt

SEQ ID NO: 5127011 - DNA, 18 bp, Homo sapiens
acaatacagtattataga

SEQ ID NO: 5127012 - DNA, 18 bp, Homo sapiens
acaatacatgttttcact

SEQ ID NO: 5127013 - DNA, 20 bp, Homo sapiens
acaataccagaagtgaatta

SEQ ID NO: 5127014 - DNA, 14 bp, Homo sapiens
acaataccttattt

SEQ ID NO: 5127015 - DNA, 18 bp, Homo sapiens
acaatactaaataaacat

SEQ ID NO: 5127016 - DNA, 18 bp, Homo sapiens
acaatactcataatgtga

SEQ ID NO: 5127017 - DNA, 21 bp, Homo sapiens
acaatactcataatgtgaagt

SEQ ID NO: 5127018 - DNA, 19 bp, Homo sapiens
acaatactccctttaaaga

SEQ ID NO: 5127019 - DNA, 14 bp, Homo sapiens
acaatactgttcta

SEQ ID NO: 5127020 - DNA, 21 bp, Homo sapiens
acaatacttgcattccagagt

SEQ ID NO: 5127021 - DNA, 15 bp, Homo sapiens
acaatagacagaaac

SEQ ID NO: 5127022 - DNA, 17 bp, Homo sapiens
acaatagacagaaacag

SEQ ID NO: 5127023 - DNA, 19 bp, Homo sapiens
acaatagccgatatcagaa

SEQ ID NO: 5127024 - DNA, 12 bp, Homo sapiens
acaatagctatt

SEQ ID NO: 5127025 - DNA, 17 bp, Homo sapiens
acaatagctattgcatg

SEQ ID NO: 5127026 - DNA, 20 bp, Homo sapiens
acaatagctattgcatgtaa

SEQ ID NO: 5127027 - DNA, 19 bp, Homo sapiens
acaatagctttaccctcag

SEQ ID NO: 5127028 - DNA, 23 bp, Homo sapiens
acaataggagtggtgatttgaaa

SEQ ID NO: 5127029 - DNA, 19 bp, Homo sapiens
acaatagggctaaatgttt

SEQ ID NO: 5127030 - DNA, 22 bp, Homo sapiens
acaatagggctgataatgtaat

SEQ ID NO: 5127031 - DNA, 13 bp, Homo sapiens
acaataggtcttt

SEQ ID NO: 5127032 - DNA, 18 bp, Homo sapiens
acaataggtctttctctc

SEQ ID NO: 5127033 - DNA, 18 bp, Homo sapiens
acaataggtgcttattct

SEQ ID NO: 5127034 - DNA, 16 bp, Homo sapiens
acaatagtatacattt

SEQ ID NO: 5127035 - DNA, 17 bp, Homo sapiens
acaatagtatacatttt

SEQ ID NO: 5127036 - DNA, 14 bp, Homo sapiens
acaatagtatttct

SEQ ID NO: 5127037 - DNA, 18 bp, Homo sapiens
acaatagtatttctcctt

SEQ ID NO: 5127038 - DNA, 24 bp, Homo sapiens
acaatagtatttctcctttgcaat

SEQ ID NO: 5127039 - DNA, 18 bp, Homo sapiens
acaatagtttttaaaaga

SEQ ID NO: 5127040 - DNA, 21 bp, Homo sapiens
acaatataagagcttccaatt

SEQ ID NO: 5127041 - DNA, 10 bp, Homo sapiens
acaatatata

SEQ ID NO: 5127042 - DNA, 15 bp, Homo sapiens
acaatatataaaaat

SEQ ID NO: 5127043 - DNA, 18 bp, Homo sapiens
acaatatataaaaatata

SEQ ID NO: 5127044 - DNA, 18 bp, Homo sapiens
acaatatatagaattgta

SEQ ID NO: 5127045 - DNA, 21 bp, Homo sapiens
acaatatatattatatatatc

SEQ ID NO: 5127046 - DNA, 19 bp, Homo sapiens
acaatatatgatatataaa

SEQ ID NO: 5127047 - DNA, 15 bp, Homo sapiens
acaatatcatatcat

SEQ ID NO: 5127048 - DNA, 17 bp, Homo sapiens
acaatatcattttcctg

SEQ ID NO: 5127049 - DNA, 20 bp, Homo sapiens
acaatatcattttcctggga

SEQ ID NO: 5127050 - DNA, 19 bp, Homo sapiens
acaatatccaatgaagaag

SEQ ID NO: 5127051 - DNA, 15 bp, Homo sapiens
acaatatgaaaagga

SEQ ID NO: 5127052 - DNA, 15 bp, Homo sapiens
acaatatgaatacag

SEQ ID NO: 5127053 - DNA, 19 bp, Homo sapiens
acaatatgagtaatgttta

SEQ ID NO: 5127054 - DNA, 22 bp, Homo sapiens
acaatatgagtaatgtttaaga

SEQ ID NO: 5127055 - DNA, 20 bp, Homo sapiens
acaatatgattgcactaaat

SEQ ID NO: 5127056 - DNA, 17 bp, Homo sapiens
acaatatgattttaaat

SEQ ID NO: 5127057 - DNA, 17 bp, Homo sapiens
acaatatgtacatttct

SEQ ID NO: 5127058 - DNA, 16 bp, Homo sapiens
acaatatgtatgcttt

SEQ ID NO: 5127059 - DNA, 22 bp, Homo sapiens
acaatatgtatgctttttacct

SEQ ID NO: 5127060 - DNA, 14 bp, Homo sapiens
acaatatgtgagtg

SEQ ID NO: 5127061 - DNA, 21 bp, Homo sapiens
acaatatgtgttttttaatat

SEQ ID NO: 5127062 - DNA, 15 bp, Homo sapiens
acaatatgttagatt

SEQ ID NO: 5127063 - DNA, 20 bp, Homo sapiens
acaatattaattataataaa

SEQ ID NO: 5127064 - DNA, 21 bp, Homo sapiens
acaatattaattataataaag

SEQ ID NO: 5127065 - DNA, 15 bp, Homo sapiens
acaatattatgaaat

SEQ ID NO: 5127066 - DNA, 12 bp, Homo sapiens
acaatattatgt

SEQ ID NO: 5127067 - DNA, 19 bp, Homo sapiens
acaatattcagtggtgaaa

SEQ ID NO: 5127068 - DNA, 23 bp, Homo sapiens
acaatattcagtggtgaaatctt

SEQ ID NO: 5127069 - DNA, 18 bp, Homo sapiens
acaatattgattgggaaa

SEQ ID NO: 5127070 - DNA, 23 bp, Homo sapiens
acaatattgtatactaccatagt

SEQ ID NO: 5127071 - DNA, 16 bp, Homo sapiens
acaatatttaaaattt

SEQ ID NO: 5127072 - DNA, 16 bp, Homo sapiens
acaatatttcttttgt

SEQ ID NO: 5127073 - DNA, 18 bp, Homo sapiens
acaatatttgtgtgctaa

SEQ ID NO: 5127074 - DNA, 18 bp, Homo sapiens
acaatattttaagcatta

SEQ ID NO: 5127075 - DNA, 12 bp, Homo sapiens
acaatattttat

SEQ ID NO: 5127076 - DNA, 16 bp, Homo sapiens
acaatcaaaacacact

SEQ ID NO: 5127077 - DNA, 14 bp, Homo sapiens
acaatcaaaggaaa

SEQ ID NO: 5127078 - DNA, 19 bp, Homo sapiens
acaatcaaaggaaaatagt

SEQ ID NO: 5127079 - DNA, 13 bp, Homo sapiens
acaatcaaatctc

SEQ ID NO: 5127080 - DNA, 21 bp, Homo sapiens
acaatcaaatctcctgctgat

SEQ ID NO: 5127081 - DNA, 12 bp, Homo sapiens
acaatcacactc

SEQ ID NO: 5127082 - DNA, 23 bp, Homo sapiens
acaatcactaaatatctagtgct

SEQ ID NO: 5127083 - DNA, 15 bp, Homo sapiens
aattttaaaattgca

SEQ ID NO: 5127084 - DNA, 21 bp, Homo sapiens
aattttaaaattggtatattt

SEQ ID NO: 5127085 - DNA, 13 bp, Homo sapiens
aattttaaagcaa

SEQ ID NO: 5127086 - DNA, 13 bp, Homo sapiens
aattttaaagcca

SEQ ID NO: 5127087 - DNA, 15 bp, Homo sapiens
aattttaaagccatt

SEQ ID NO: 5127088 - DNA, 19 bp, Homo sapiens
aattttaaagcctgaaaat

SEQ ID NO: 5127089 - DNA, 13 bp, Homo sapiens
aattttaaagtat

SEQ ID NO: 5127090 - DNA, 16 bp, Homo sapiens
aattttaaagtatgca

SEQ ID NO: 5127091 - DNA, 19 bp, Homo sapiens
aattttaaagtcagtgttg

SEQ ID NO: 5127092 - DNA, 13 bp, Homo sapiens
aattttaaagttc

SEQ ID NO: 5127093 - DNA, 15 bp, Homo sapiens
aattttaaagttctt

SEQ ID NO: 5127094 - DNA, 12 bp, Homo sapiens
aattttaaataa

SEQ ID NO: 5127095 - DNA, 17 bp, Homo sapiens
aattttaaataaaagtg

SEQ ID NO: 5127096 - DNA, 19 bp, Homo sapiens
aattttaaataatgtattt

SEQ ID NO: 5127097 - DNA, 23 bp, Homo sapiens
aattttaaataatgtatttactt

SEQ ID NO: 5127098 - DNA, 13 bp, Homo sapiens
aattttaaatgca

SEQ ID NO: 5127099 - DNA, 12 bp, Homo sapiens
aattttaaatta

SEQ ID NO: 5127100 - DNA, 22 bp, Homo sapiens
aattttaacaaacgcattaaga

SEQ ID NO: 5127101 - DNA, 23 bp, Homo sapiens
aattttaacaaacgcattaagag

SEQ ID NO: 5127102 - DNA, 14 bp, Homo sapiens
aattttaacacaca

SEQ ID NO: 5127103 - DNA, 16 bp, Homo sapiens
aattttaacatttgat

SEQ ID NO: 5127104 - DNA, 14 bp, Homo sapiens
aattttaacatttt

SEQ ID NO: 5127105 - DNA, 20 bp, Homo sapiens
aattttaacttttgggattt

SEQ ID NO: 5127106 - DNA, 18 bp, Homo sapiens
aattttaagattcctttt

SEQ ID NO: 5127107 - DNA, 12 bp, Homo sapiens
aattttaagtgc

SEQ ID NO: 5127108 - DNA, 19 bp, Homo sapiens
aattttaagtgctttgtaa

SEQ ID NO: 5127109 - DNA, 15 bp, Homo sapiens
aattttaatcccctg

SEQ ID NO: 5127110 - DNA, 23 bp, Homo sapiens
aattttaatgatggtgttaaagc

SEQ ID NO: 5127111 - DNA, 18 bp, Homo sapiens
aattttaatgctgtttct

SEQ ID NO: 5127112 - DNA, 20 bp, Homo sapiens
aattttaatgctgtttctaa

SEQ ID NO: 5127113 - DNA, 13 bp, Homo sapiens
aattttaatgtga

SEQ ID NO: 5127114 - DNA, 16 bp, Homo sapiens
aattttaatgttaact

SEQ ID NO: 5127115 - DNA, 22 bp, Homo sapiens
aattttaattcaagaaatgaca

SEQ ID NO: 5127116 - DNA, 16 bp, Homo sapiens
aattttaatttctaca

SEQ ID NO: 5127117 - DNA, 20 bp, Homo sapiens
aattttacacgcttttgtga

SEQ ID NO: 5127118 - DNA, 21 bp, Homo sapiens
aattttacactctgtattgaa

SEQ ID NO: 5127119 - DNA, 16 bp, Homo sapiens
aattttacagcccttg

SEQ ID NO: 5127120 - DNA, 16 bp, Homo sapiens
aattttacatgacaga

SEQ ID NO: 5127121 - DNA, 20 bp, Homo sapiens
aattttacatggctggagct

SEQ ID NO: 5127122 - DNA, 21 bp, Homo sapiens
aattttacatgtctcatattt

SEQ ID NO: 5127123 - DNA, 14 bp, Homo sapiens
aattttaccaagtt

SEQ ID NO: 5127124 - DNA, 13 bp, Homo sapiens
aattttactgtga

SEQ ID NO: 5127125 - DNA, 16 bp, Homo sapiens
aattttactgtgaaaa

SEQ ID NO: 5127126 - DNA, 17 bp, Homo sapiens
aattttagaaagaaaat

SEQ ID NO: 5127127 - DNA, 23 bp, Homo sapiens
aattttagaaagaaaattatatt

SEQ ID NO: 5127128 - DNA, 16 bp, Homo sapiens
aattttagagaaactt

SEQ ID NO: 5127129 - DNA, 15 bp, Homo sapiens
aattttagcttttgt

SEQ ID NO: 5127130 - DNA, 23 bp, Homo sapiens
aattttaggcactcttaaatgat

SEQ ID NO: 5127131 - DNA, 18 bp, Homo sapiens
aattttagtaatttccta

SEQ ID NO: 5127132 - DNA, 19 bp, Homo sapiens
aattttagtaatttcctag

SEQ ID NO: 5127133 - DNA, 18 bp, Homo sapiens
aattttagtagttactaa

SEQ ID NO: 5127134 - DNA, 14 bp, Homo sapiens
aattttagtattca

SEQ ID NO: 5127135 - DNA, 21 bp, Homo sapiens
aattttataagcaaatttcaa

SEQ ID NO: 5127136 - DNA, 16 bp, Homo sapiens
aattttataatgtcat

SEQ ID NO: 5127137 - DNA, 21 bp, Homo sapiens
aattttatactttccctaccc

SEQ ID NO: 5127138 - DNA, 19 bp, Homo sapiens
aattttataggactgttct

SEQ ID NO: 5127139 - DNA, 18 bp, Homo sapiens
aattttatataattctga

SEQ ID NO: 5127140 - DNA, 20 bp, Homo sapiens
aattttatatcattggatga

SEQ ID NO: 5127141 - DNA, 12 bp, Homo sapiens
aattttatatgt

SEQ ID NO: 5127142 - DNA, 15 bp, Homo sapiens
aattttatatgtaag

SEQ ID NO: 5127143 - DNA, 18 bp, Homo sapiens
aattttatattcagtgaa

SEQ ID NO: 5127144 - DNA, 13 bp, Homo sapiens
aattttatctgta

SEQ ID NO: 5127145 - DNA, 15 bp, Homo sapiens
aattttatctgtata

SEQ ID NO: 5127146 - DNA, 19 bp, Homo sapiens
aattttatctgtataagct

SEQ ID NO: 5127147 - DNA, 19 bp, Homo sapiens
aattttatctgtttcctga

SEQ ID NO: 5127148 - DNA, 22 bp, Homo sapiens
aattttatgaactgcatgtata

SEQ ID NO: 5127149 - DNA, 13 bp, Homo sapiens
aattttatgtatt

SEQ ID NO: 5127150 - DNA, 22 bp, Homo sapiens
aattttatgtcatatatcaaat

SEQ ID NO: 5127151 - DNA, 22 bp, Homo sapiens
aattttattaaaagagtagaaa

SEQ ID NO: 5127152 - DNA, 20 bp, Homo sapiens
aattttattagacattctct

SEQ ID NO: 5127153 - DNA, 13 bp, Homo sapiens
aattttattatta

SEQ ID NO: 5127154 - DNA, 21 bp, Homo sapiens
aattttatttgttctttttct

SEQ ID NO: 5127155 - DNA, 23 bp, Homo sapiens
aattttatttgttctttttctga

SEQ ID NO: 5127156 - DNA, 14 bp, Homo sapiens
aattttattttaaa

SEQ ID NO: 5127157 - DNA, 19 bp, Homo sapiens
aattttattttaaaatttc

SEQ ID NO: 5127158 - DNA, 23 bp, Homo sapiens
aattttattttgctgagttgttc

SEQ ID NO: 5127159 - DNA, 20 bp, Homo sapiens
aattttattttttttctgta

SEQ ID NO: 5127160 - DNA, 19 bp, Homo sapiens
aattttcaagcaaagtatt

SEQ ID NO: 5127161 - DNA, 14 bp, Homo sapiens
aattttcaaggcct

SEQ ID NO: 5127162 - DNA, 15 bp, Homo sapiens
aattttcaaggcctt

SEQ ID NO: 5127163 - DNA, 21 bp, Homo sapiens
aattttcaaggccttcagttt

SEQ ID NO: 5127164 - DNA, 22 bp, Homo sapiens
aattttcaaggccttcagttta

SEQ ID NO: 5127165 - DNA, 15 bp, Homo sapiens
aattttcaagtaatt

SEQ ID NO: 5127166 - DNA, 14 bp, Homo sapiens
aattttcaagttta

SEQ ID NO: 5127167 - DNA, 22 bp, Homo sapiens
aattttcacaaaatgtctcagt

SEQ ID NO: 5127168 - DNA, 12 bp, Homo sapiens
aattttcacaat

SEQ ID NO: 5127169 - DNA, 15 bp, Homo sapiens
aattttcactgctgc

SEQ ID NO: 5127170 - DNA, 14 bp, Homo sapiens
aattttcactgtgt

SEQ ID NO: 5127171 - DNA, 19 bp, Homo sapiens
aattttcagacacattttt

SEQ ID NO: 5127172 - DNA, 14 bp, Homo sapiens
aattttcagatttg

SEQ ID NO: 5127173 - DNA, 17 bp, Homo sapiens
aattttcagatttgcac

SEQ ID NO: 5127174 - DNA, 12 bp, Homo sapiens
aattttcagcat

SEQ ID NO: 5127175 - DNA, 17 bp, Homo sapiens
aattttcagctgcaagg

SEQ ID NO: 5127176 - DNA, 20 bp, Homo sapiens
aattttcagttctatttaaa

SEQ ID NO: 5127177 - DNA, 10 bp, Homo sapiens
aattttcatt

SEQ ID NO: 5127178 - DNA, 20 bp, Homo sapiens
aattttcattaaacttgaag

SEQ ID NO: 5127179 - DNA, 15 bp, Homo sapiens
aattttcattttaca

SEQ ID NO: 5127180 - DNA, 14 bp, Homo sapiens
aattttcattttca

SEQ ID NO: 5127181 - DNA, 19 bp, Homo sapiens
aattttcattttgcactga

SEQ ID NO: 5127182 - DNA, 14 bp, Homo sapiens
aattttcattttta

SEQ ID NO: 5127183 - DNA, 15 bp, Homo sapiens
aattttccacgcagt

SEQ ID NO: 5127184 - DNA, 23 bp, Homo sapiens
aattttccagagaagcctatttt

SEQ ID NO: 5127185 - DNA, 16 bp, Homo sapiens
aattttccataagcta

SEQ ID NO: 5127186 - DNA, 23 bp, Homo sapiens
aattttcctcaatcacactacac

SEQ ID NO: 5127187 - DNA, 11 bp, Homo sapiens
aattttccttt

SEQ ID NO: 5127188 - DNA, 20 bp, Homo sapiens
aattttcctttaatatgaaa

SEQ ID NO: 5127189 - DNA, 18 bp, Homo sapiens
aattttcctttgtcattt

SEQ ID NO: 5127190 - DNA, 11 bp, Homo sapiens
aattttctaag

SEQ ID NO: 5127191 - DNA, 16 bp, Homo sapiens
aattttctagaatact

SEQ ID NO: 5127192 - DNA, 19 bp, Homo sapiens
aattttctagaatactaat

SEQ ID NO: 5127193 - DNA, 12 bp, Homo sapiens
aattttctagac

SEQ ID NO: 5127194 - DNA, 20 bp, Homo sapiens
aattttctagactttctgtt

SEQ ID NO: 5127195 - DNA, 17 bp, Homo sapiens
aattttctcaaaagcat

SEQ ID NO: 5127196 - DNA, 22 bp, Homo sapiens
aattttctccctttatgtatct

SEQ ID NO: 5127197 - DNA, 23 bp, Homo sapiens
aattttctccttggtttgctagt

SEQ ID NO: 5127198 - DNA, 18 bp, Homo sapiens
aattttctctaaactgtt

SEQ ID NO: 5127199 - DNA, 13 bp, Homo sapiens
aattttctctcca

SEQ ID NO: 5127200 - DNA, 20 bp, Homo sapiens
aattttctctttaggagaaa

SEQ ID NO: 5127201 - DNA, 12 bp, Homo sapiens
aattttctgcag

SEQ ID NO: 5127202 - DNA, 13 bp, Homo sapiens
aattttctgcagc

SEQ ID NO: 5127203 - DNA, 17 bp, Homo sapiens
aattttctgcagctgtt

SEQ ID NO: 5127204 - DNA, 22 bp, Homo sapiens
aattttctggaaaatgcttctt

SEQ ID NO: 5127205 - DNA, 16 bp, Homo sapiens
aattttctgtaatctt

SEQ ID NO: 5127206 - DNA, 13 bp, Homo sapiens
aattttctgtatt

SEQ ID NO: 5127207 - DNA, 14 bp, Homo sapiens
aattttctgtattt

SEQ ID NO: 5127208 - DNA, 13 bp, Homo sapiens
aattttctgttca

SEQ ID NO: 5127209 - DNA, 13 bp, Homo sapiens
aattttcttcatg

SEQ ID NO: 5127210 - DNA, 14 bp, Homo sapiens
aattttcttcatgc

SEQ ID NO: 5127211 - DNA, 21 bp, Homo sapiens
aattttcttgatgactggaat

SEQ ID NO: 5127212 - DNA, 22 bp, Homo sapiens
aattttctttagcttttaccaa

SEQ ID NO: 5127213 - DNA, 12 bp, Homo sapiens
aattttctttca

SEQ ID NO: 5127214 - DNA, 18 bp, Homo sapiens
aattttctttcatacatt

SEQ ID NO: 5127215 - DNA, 21 bp, Homo sapiens
aattttctttcatacattata

SEQ ID NO: 5127216 - DNA, 16 bp, Homo sapiens
aattttctttgtttct

SEQ ID NO: 5127217 - DNA, 23 bp, Homo sapiens
aattttcttttaagcatttgtat

SEQ ID NO: 5127218 - DNA, 14 bp, Homo sapiens
aattttctttttgt

SEQ ID NO: 5127219 - DNA, 20 bp, Homo sapiens
aattttgaaaagtaatattt

SEQ ID NO: 5127220 - DNA, 17 bp, Homo sapiens
aattttgaaatgattca

SEQ ID NO: 5127221 - DNA, 20 bp, Homo sapiens
aattttgaagtgctgtttat

SEQ ID NO: 5127222 - DNA, 13 bp, Homo sapiens
aattttgaccata

SEQ ID NO: 5127223 - DNA, 17 bp, Homo sapiens
aattttgacttaatgtg

SEQ ID NO: 5127224 - DNA, 15 bp, Homo sapiens
aattttgagaaaaat

SEQ ID NO: 5127225 - DNA, 19 bp, Homo sapiens
aattttgagaaaaatagag

SEQ ID NO: 5127226 - DNA, 21 bp, Homo sapiens
aattttgaggtcttttacata

SEQ ID NO: 5127227 - DNA, 20 bp, Homo sapiens
aattttgagttctacataag

SEQ ID NO: 5127228 - DNA, 23 bp, Homo sapiens
aattttgataaaaatttagaaca

SEQ ID NO: 5127229 - DNA, 16 bp, Homo sapiens
aattttgatagtggga

SEQ ID NO: 5127230 - DNA, 22 bp, Homo sapiens
aattttgatatacattgtgtga

SEQ ID NO: 5127231 - DNA, 23 bp, Homo sapiens
aattttgatctttttatattctt

SEQ ID NO: 5127232 - DNA, 20 bp, Homo sapiens
aattttgattaaccttttca

SEQ ID NO: 5127233 - DNA, 18 bp, Homo sapiens
aattttgcaaatataaac

SEQ ID NO: 5127234 - DNA, 19 bp, Homo sapiens
aattttgcaaatataaaca

SEQ ID NO: 5127235 - DNA, 12 bp, Homo sapiens
aattttgcaatg

SEQ ID NO: 5127236 - DNA, 13 bp, Homo sapiens
aattttgcagaag

SEQ ID NO: 5127237 - DNA, 12 bp, Homo sapiens
aattttgctaac

SEQ ID NO: 5127238 - DNA, 16 bp, Homo sapiens
aattttgctaactggg

SEQ ID NO: 5127239 - DNA, 21 bp, Homo sapiens
aattttgctaactgggttaaa

SEQ ID NO: 5127240 - DNA, 15 bp, Homo sapiens
aattttgctttatca

SEQ ID NO: 5127241 - DNA, 22 bp, Homo sapiens
aattttgctttatcagaagcaa

SEQ ID NO: 5127242 - DNA, 17 bp, Homo sapiens
aattttgcttttaatta

SEQ ID NO: 5127243 - DNA, 12 bp, Homo sapiens
aattttggaaaa

SEQ ID NO: 5127244 - DNA, 18 bp, Homo sapiens
aattttggaaaaatgtca

SEQ ID NO: 5127245 - DNA, 22 bp, Homo sapiens
aattttggaaaaatgtcactga

SEQ ID NO: 5127246 - DNA, 18 bp, Homo sapiens
aattttggaagaattcat

SEQ ID NO: 5127247 - DNA, 18 bp, Homo sapiens
aattttggaagattttca

SEQ ID NO: 5127248 - DNA, 22 bp, Homo sapiens
aattttggccaaagtgttaatc

SEQ ID NO: 5127249 - DNA, 18 bp, Homo sapiens
aattttggtgatgtaaaa

SEQ ID NO: 5127250 - DNA, 17 bp, Homo sapiens
aattttggttgtaatta

SEQ ID NO: 5127251 - DNA, 20 bp, Homo sapiens
aattttggttgtaattaaat

SEQ ID NO: 5127252 - DNA, 15 bp, Homo sapiens
aattttggttgtatt

SEQ ID NO: 5127253 - DNA, 16 bp, Homo sapiens
aattttggttgtattc

SEQ ID NO: 5127254 - DNA, 10 bp, Homo sapiens
aattttgtaa

SEQ ID NO: 5127255 - DNA, 12 bp, Homo sapiens
aattttgtaaaa

SEQ ID NO: 5127256 - DNA, 13 bp, Homo sapiens
aattttgtaaaaa

SEQ ID NO: 5127257 - DNA, 21 bp, Homo sapiens
aattttgtaaaacaatgccat

SEQ ID NO: 5127258 - DNA, 13 bp, Homo sapiens
aattttgtaagaa

SEQ ID NO: 5127259 - DNA, 16 bp, Homo sapiens
aattttgtaattttct

SEQ ID NO: 5127260 - DNA, 17 bp, Homo sapiens
aattttgtaattttctt

SEQ ID NO: 5127261 - DNA, 13 bp, Homo sapiens
aattttgtatatt

SEQ ID NO: 5127262 - DNA, 14 bp, Homo sapiens
aattttgtattttc

SEQ ID NO: 5127263 - DNA, 23 bp, Homo sapiens
aattttgtattttccaagtgtgc

SEQ ID NO: 5127264 - DNA, 17 bp, Homo sapiens
aattttgtcacagctct

SEQ ID NO: 5127265 - DNA, 21 bp, Homo sapiens
aattttgtctgccccaagttt

SEQ ID NO: 5127266 - DNA, 22 bp, Homo sapiens
aattttgtcttaagtgtttctc

SEQ ID NO: 5127267 - DNA, 23 bp, Homo sapiens
aattttgtgaaacagacttgtat

SEQ ID NO: 5127268 - DNA, 13 bp, Homo sapiens
aattttgtgaagc

SEQ ID NO: 5127269 - DNA, 17 bp, Homo sapiens
aattttgtgaagcaaaa

SEQ ID NO: 5127270 - DNA, 12 bp, Homo sapiens
aattttgtgatg

SEQ ID NO: 5127271 - DNA, 14 bp, Homo sapiens
aattttgtgcattc

SEQ ID NO: 5127272 - DNA, 12 bp, Homo sapiens
aattttgtgcta

SEQ ID NO: 5127273 - DNA, 15 bp, Homo sapiens
aattttgtgtaagaa

SEQ ID NO: 5127274 - DNA, 17 bp, Homo sapiens
aattttgtgtaagaaat

SEQ ID NO: 5127275 - DNA, 18 bp, Homo sapiens
aattttgtgttccttttt

SEQ ID NO: 5127276 - DNA, 13 bp, Homo sapiens
aattttgttaaca

SEQ ID NO: 5127277 - DNA, 18 bp, Homo sapiens
aattttgttaagaatttc

SEQ ID NO: 5127278 - DNA, 18 bp, Homo sapiens
aattttgttggtctgaat

SEQ ID NO: 5127279 - DNA, 19 bp, Homo sapiens
aattttgtttataagaaat

SEQ ID NO: 5127280 - DNA, 15 bp, Homo sapiens
aattttgtttcagaa

SEQ ID NO: 5127281 - DNA, 21 bp, Homo sapiens
aattttgtttcagaattttgt

SEQ ID NO: 5127282 - DNA, 22 bp, Homo sapiens
aattttgtttcagaattttgta

SEQ ID NO: 5127283 - DNA, 14 bp, Homo sapiens
aattttgtttctgt

SEQ ID NO: 5127284 - DNA, 16 bp, Homo sapiens
aattttgtttctgtac

SEQ ID NO: 5127285 - DNA, 13 bp, Homo sapiens
aattttgtttgta

SEQ ID NO: 5127286 - DNA, 17 bp, Homo sapiens
aattttgttttactttt

SEQ ID NO: 5127287 - DNA, 21 bp, Homo sapiens
aattttgtttttattttcaag

SEQ ID NO: 5127288 - DNA, 19 bp, Homo sapiens
aatttttaaaaatacactt

SEQ ID NO: 5127289 - DNA, 17 bp, Homo sapiens
aatttttaaaactgcat

SEQ ID NO: 5127290 - DNA, 15 bp, Homo sapiens
aatttttaaaagact

SEQ ID NO: 5127291 - DNA, 17 bp, Homo sapiens
aatttttaaaataaact

SEQ ID NO: 5127292 - DNA, 19 bp, Homo sapiens
aatttttaaaataaactgt

SEQ ID NO: 5127293 - DNA, 15 bp, Homo sapiens
aatttttaaacaagt

SEQ ID NO: 5127294 - DNA, 19 bp, Homo sapiens
aatttttaaacaagtattt

SEQ ID NO: 5127295 - DNA, 20 bp, Homo sapiens
aatttttaaatgtaaaacat

SEQ ID NO: 5127296 - DNA, 14 bp, Homo sapiens
aatttttaaatgtt

SEQ ID NO: 5127297 - DNA, 14 bp, Homo sapiens
aatttttaactgta

SEQ ID NO: 5127298 - DNA, 12 bp, Homo sapiens
aatttttaactt

SEQ ID NO: 5127299 - DNA, 22 bp, Homo sapiens
aatttttaacttttggaatcat

SEQ ID NO: 5127300 - DNA, 11 bp, Homo sapiens
aatttttaagc

SEQ ID NO: 5127301 - DNA, 15 bp, Homo sapiens
aatttttaagcaaat

SEQ ID NO: 5127302 - DNA, 17 bp, Homo sapiens
aatttttaagctgcaaa

SEQ ID NO: 5127303 - DNA, 19 bp, Homo sapiens
aatttttaagtgtcagact

SEQ ID NO: 5127304 - DNA, 21 bp, Homo sapiens
aatttttaatgactttttata

SEQ ID NO: 5127305 - DNA, 11 bp, Homo sapiens
aatttttaatt

SEQ ID NO: 5127306 - DNA, 16 bp, Homo sapiens
aatttttacagaattg

SEQ ID NO: 5127307 - DNA, 16 bp, Homo sapiens
aatttttacatgacca

SEQ ID NO: 5127308 - DNA, 14 bp, Homo sapiens
aatttttacattca

SEQ ID NO: 5127309 - DNA, 16 bp, Homo sapiens
aatttttacatttgtt

SEQ ID NO: 5127310 - DNA, 20 bp, Homo sapiens
aatttttaccctaatgtctt

SEQ ID NO: 5127311 - DNA, 22 bp, Homo sapiens
aatttttactcaggctttctat

SEQ ID NO: 5127312 - DNA, 16 bp, Homo sapiens
aatttttaggaagttt

SEQ ID NO: 5127313 - DNA, 13 bp, Homo sapiens
aatttttatgtaa

SEQ ID NO: 5127314 - DNA, 20 bp, Homo sapiens
aatttttatgtaattatata

SEQ ID NO: 5127315 - DNA, 13 bp, Homo sapiens
aatttttatgtgt

SEQ ID NO: 5127316 - DNA, 17 bp, Homo sapiens
aatttttattatgcata

SEQ ID NO: 5127317 - DNA, 16 bp, Homo sapiens
aatttttattatttgt

SEQ ID NO: 5127318 - DNA, 19 bp, Homo sapiens
aatttttatttatttttct

SEQ ID NO: 5127319 - DNA, 21 bp, Homo sapiens
aatttttatttctttttaatt

SEQ ID NO: 5127320 - DNA, 17 bp, Homo sapiens
aatttttatttttgaac

SEQ ID NO: 5127321 - DNA, 18 bp, Homo sapiens
aatttttcaaaatcgttt

SEQ ID NO: 5127322 - DNA, 15 bp, Homo sapiens
aatttttcagatgct

SEQ ID NO: 5127323 - DNA, 21 bp, Homo sapiens
aatttttcagctctctgtata

SEQ ID NO: 5127324 - DNA, 12 bp, Homo sapiens
aatttttcatag

SEQ ID NO: 5127325 - DNA, 13 bp, Homo sapiens
aatttttcataga

SEQ ID NO: 5127326 - DNA, 20 bp, Homo sapiens
aatttttccaactactaata

SEQ ID NO: 5127327 - DNA, 12 bp, Homo sapiens
aatttttccaca

SEQ ID NO: 5127328 - DNA, 13 bp, Homo sapiens
aatttttcctttt

SEQ ID NO: 5127329 - DNA, 16 bp, Homo sapiens
aatttttctctttaaa

SEQ ID NO: 5127330 - DNA, 14 bp, Homo sapiens
aatttttctgtata

SEQ ID NO: 5127331 - DNA, 18 bp, Homo sapiens
aatttttctgtatagaca

SEQ ID NO: 5127332 - DNA, 22 bp, Homo sapiens
aatttttctgttggtcttaact

SEQ ID NO: 5127333 - DNA, 21 bp, Homo sapiens
aatttttcttatttcatttct

SEQ ID NO: 5127334 - DNA, 21 bp, Homo sapiens
aatttttcttttcttgatttt

SEQ ID NO: 5127335 - DNA, 13 bp, Homo sapiens
aatttttgaaaaa

SEQ ID NO: 5127336 - DNA, 20 bp, Homo sapiens
aatttttgaaaaatattgct

SEQ ID NO: 5127337 - DNA, 12 bp, Homo sapiens
aatttttgacac

SEQ ID NO: 5127338 - DNA, 19 bp, Homo sapiens
aatttttgacactttttgt

SEQ ID NO: 5127339 - DNA, 22 bp, Homo sapiens
aatttttgatgcccagacagca

SEQ ID NO: 5127340 - DNA, 11 bp, Homo sapiens
aatttttgcaa

SEQ ID NO: 5127341 - DNA, 12 bp, Homo sapiens
aatttttgcaat

SEQ ID NO: 5127342 - DNA, 21 bp, Homo sapiens
aatttttgcaataatgcagta

SEQ ID NO: 5127343 - DNA, 13 bp, Homo sapiens
aatttttgcaatt

SEQ ID NO: 5127344 - DNA, 19 bp, Homo sapiens
aatttttgcaattattcta

SEQ ID NO: 5127345 - DNA, 17 bp, Homo sapiens
aatttttgcatgtttaa

SEQ ID NO: 5127346 - DNA, 22 bp, Homo sapiens
aatttttgcatgtttaataata

SEQ ID NO: 5127347 - DNA, 21 bp, Homo sapiens
aatttttgcctatctttaaac

SEQ ID NO: 5127348 - DNA, 18 bp, Homo sapiens
aatttttgcttttagaaa

SEQ ID NO: 5127349 - DNA, 19 bp, Homo sapiens
aatttttgcttttagaaaa

SEQ ID NO: 5127350 - DNA, 19 bp, Homo sapiens
aatttttggggaaaaaagc

SEQ ID NO: 5127351 - DNA, 22 bp, Homo sapiens
aatttttggggaaaaaagcaca

SEQ ID NO: 5127352 - DNA, 23 bp, Homo sapiens
aatttttggtttatgactttgtc

SEQ ID NO: 5127353 - DNA, 14 bp, Homo sapiens
aatttttgtaattt

SEQ ID NO: 5127354 - DNA, 13 bp, Homo sapiens
aatttttgtacat

SEQ ID NO: 5127355 - DNA, 13 bp, Homo sapiens
aatttttgtagta

SEQ ID NO: 5127356 - DNA, 14 bp, Homo sapiens
aatttttgtatttt

SEQ ID NO: 5127357 - DNA, 17 bp, Homo sapiens
aatttttgtatttttag

SEQ ID NO: 5127358 - DNA, 23 bp, Homo sapiens
aatttttgtcattttaaaatctg

SEQ ID NO: 5127359 - DNA, 20 bp, Homo sapiens
aatttttgtctttcatggaa

SEQ ID NO: 5127360 - DNA, 14 bp, Homo sapiens
aatttttgtttgga

SEQ ID NO: 5127361 - DNA, 23 bp, Homo sapiens
aattttttaaaaaaaatttgtgt

SEQ ID NO: 5127362 - DNA, 17 bp, Homo sapiens
aattttttaaaagagac

SEQ ID NO: 5127363 - DNA, 14 bp, Homo sapiens
aattttttaaagaa

SEQ ID NO: 5127364 - DNA, 19 bp, Homo sapiens
aattttttaaagaatccaa

SEQ ID NO: 5127365 - DNA, 21 bp, Homo sapiens
aattttttacattttcctgtg

SEQ ID NO: 5127366 - DNA, 17 bp, Homo sapiens
aattttttattcttgtg

SEQ ID NO: 5127367 - DNA, 23 bp, Homo sapiens
aattttttattcttgtgaatatg

SEQ ID NO: 5127368 - DNA, 17 bp, Homo sapiens
aattttttattttaata

SEQ ID NO: 5127369 - DNA, 20 bp, Homo sapiens
aattttttcatgcacactgt

SEQ ID NO: 5127370 - DNA, 12 bp, Homo sapiens
aattttttgaaa

SEQ ID NO: 5127371 - DNA, 23 bp, Homo sapiens
aattttttgaaatgggcatttat

SEQ ID NO: 5127372 - DNA, 14 bp, Homo sapiens
aattttttgaactt

SEQ ID NO: 5127373 - DNA, 15 bp, Homo sapiens
aattttttgaatatg

SEQ ID NO: 5127374 - DNA, 13 bp, Homo sapiens
aattttttgagta

SEQ ID NO: 5127375 - DNA, 12 bp, Homo sapiens
aattttttgcag

SEQ ID NO: 5127376 - DNA, 14 bp, Homo sapiens
aattttttgtatat

SEQ ID NO: 5127377 - DNA, 17 bp, Homo sapiens
aattttttgtgatgaaa

SEQ ID NO: 5127378 - DNA, 19 bp, Homo sapiens
aatttttttaaatttcagt

SEQ ID NO: 5127379 - DNA, 20 bp, Homo sapiens
aatttttttaaatttcagtc

SEQ ID NO: 5127380 - DNA, 20 bp, Homo sapiens
aatttttttaaccaaaggtg

SEQ ID NO: 5127381 - DNA, 17 bp, Homo sapiens
aatttttttaaggaaaa

SEQ ID NO: 5127382 - DNA, 16 bp, Homo sapiens
aatttttttaattttg

SEQ ID NO: 5127383 - DNA, 18 bp, Homo sapiens
aatttttttaattttgta

SEQ ID NO: 5127384 - DNA, 23 bp, Homo sapiens
aatttttttatgttttgtttctg

SEQ ID NO: 5127385 - DNA, 20 bp, Homo sapiens
aatttttttcacctagattt

SEQ ID NO: 5127386 - DNA, 15 bp, Homo sapiens
aatttttttcagtat

SEQ ID NO: 5127387 - DNA, 21 bp, Homo sapiens
aatttttttcatcttctctgg

SEQ ID NO: 5127388 - DNA, 20 bp, Homo sapiens
aatttttttccttacctttt

SEQ ID NO: 5127389 - DNA, 16 bp, Homo sapiens
aatttttttctgcaca

SEQ ID NO: 5127390 - DNA, 19 bp, Homo sapiens
aatttttttctgcacagct

SEQ ID NO: 5127391 - DNA, 17 bp, Homo sapiens
aatttttttgaaaaaag

SEQ ID NO: 5127392 - DNA, 15 bp, Homo sapiens
aatttttttgtaata

SEQ ID NO: 5127393 - DNA, 18 bp, Homo sapiens
aatttttttgtatgaaaa

SEQ ID NO: 5127394 - DNA, 20 bp, Homo sapiens
aattttttttaaaatagaaa

SEQ ID NO: 5127395 - DNA, 19 bp, Homo sapiens
aattttttttaatgcttaa

SEQ ID NO: 5127396 - DNA, 15 bp, Homo sapiens
aattttttttaatgt

SEQ ID NO: 5127397 - DNA, 19 bp, Homo sapiens
aattttttttaatgtacaa

SEQ ID NO: 5127398 - DNA, 20 bp, Homo sapiens
aattttttttaatgtacaag

SEQ ID NO: 5127399 - DNA, 15 bp, Homo sapiens
aattttttttagtat

SEQ ID NO: 5127400 - DNA, 23 bp, Homo sapiens
aattttttttagtatttatttat

SEQ ID NO: 5127401 - DNA, 20 bp, Homo sapiens
aattttttttcaaaaatgct

SEQ ID NO: 5127402 - DNA, 23 bp, Homo sapiens
aattttttttcaaatgtgcaatt

SEQ ID NO: 5127403 - DNA, 14 bp, Homo sapiens
aattttttttcatg

SEQ ID NO: 5127404 - DNA, 15 bp, Homo sapiens
aattttttttcatgt

SEQ ID NO: 5127405 - DNA, 20 bp, Homo sapiens
aattttttttgttgtttcag

SEQ ID NO: 5127406 - DNA, 22 bp, Homo sapiens
aattttttttgttgtttcagtg

SEQ ID NO: 5127407 - DNA, 18 bp, Homo sapiens
aattttttttgttttttg

SEQ ID NO: 5127408 - DNA, 14 bp, Homo sapiens
aattttttttttcc

SEQ ID NO: 5127409 - DNA, 14 bp, Homo sapiens
aattttttttttct

SEQ ID NO: 5127410 - DNA, 23 bp, Homo sapiens
acaaaaaaaaaaaaagaagaccg

SEQ ID NO: 5127411 - DNA, 16 bp, Homo sapiens
acaaaaaaaacaacaa

SEQ ID NO: 5127412 - DNA, 18 bp, Homo sapiens
acaaaaaaaacaacaaaa

SEQ ID NO: 5127413 - DNA, 19 bp, Homo sapiens
acaaaaaaaacaacaaaaa

SEQ ID NO: 5127414 - DNA, 22 bp, Homo sapiens
acaaaaaaaacaacaaaaaaag

SEQ ID NO: 5127415 - DNA, 13 bp, Homo sapiens
acaaaaaaaagaa

SEQ ID NO: 5127416 - DNA, 17 bp, Homo sapiens
acaaaaaaaagaaagaa

SEQ ID NO: 5127417 - DNA, 21 bp, Homo sapiens
acaaaaaaaagaaagaaaaaa

SEQ ID NO: 5127418 - DNA, 13 bp, Homo sapiens
acaaaaaaactat

SEQ ID NO: 5127419 - DNA, 22 bp, Homo sapiens
acaaaaaaagtttgttactttg

SEQ ID NO: 5127420 - DNA, 22 bp, Homo sapiens
acaaaaaaatatcagacaagca

SEQ ID NO: 5127421 - DNA, 19 bp, Homo sapiens
acaaaaaaatctgcagaag

SEQ ID NO: 5127422 - DNA, 18 bp, Homo sapiens
acaaaaaacaatatttat

SEQ ID NO: 5127423 - DNA, 14 bp, Homo sapiens
acaaaaaactgcct

SEQ ID NO: 5127424 - DNA, 24 bp, Homo sapiens
acaaaaaacttttaatgccttcca

SEQ ID NO: 5127425 - DNA, 12 bp, Homo sapiens
acaaaaaagaga

SEQ ID NO: 5127426 - DNA, 13 bp, Homo sapiens
acaaaaaagagaa

SEQ ID NO: 5127427 - DNA, 14 bp, Homo sapiens
acaaaaaagagaaa

SEQ ID NO: 5127428 - DNA, 12 bp, Homo sapiens
acaaaaaaggaa

SEQ ID NO: 5127429 - DNA, 12 bp, Homo sapiens
acaaaaaagtta

SEQ ID NO: 5127430 - DNA, 19 bp, Homo sapiens
acaaaaaataaaatgaaca

SEQ ID NO: 5127431 - DNA, 13 bp, Homo sapiens
acaaaaaatacat

SEQ ID NO: 5127432 - DNA, 12 bp, Homo sapiens
acaaaaaatact

SEQ ID NO: 5127433 - DNA, 14 bp, Homo sapiens
acaaaaaatgtttt

SEQ ID NO: 5127434 - DNA, 13 bp, Homo sapiens
acaaaaacaaaaa

SEQ ID NO: 5127435 - DNA, 18 bp, Homo sapiens
acaaaaacaaaaaaacta

SEQ ID NO: 5127436 - DNA, 14 bp, Homo sapiens
acaaaaacacaaat

SEQ ID NO: 5127437 - DNA, 16 bp, Homo sapiens
acaaaaacacaaatac

SEQ ID NO: 5127438 - DNA, 16 bp, Homo sapiens
acaaaaacacagcaag

SEQ ID NO: 5127439 - DNA, 19 bp, Homo sapiens
acaaaaacagaatttgaga

SEQ ID NO: 5127440 - DNA, 15 bp, Homo sapiens
acaaaaacagcctca

SEQ ID NO: 5127441 - DNA, 21 bp, Homo sapiens
acaaaaacagcctcacagaag

SEQ ID NO: 5127442 - DNA, 11 bp, Homo sapiens
acaaaaaccaa

SEQ ID NO: 5127443 - DNA, 20 bp, Homo sapiens
acaatcactattcttaagca

SEQ ID NO: 5127444 - DNA, 14 bp, Homo sapiens
acaatcactgccaa

SEQ ID NO: 5127445 - DNA, 19 bp, Homo sapiens
acaatcagaccaaggaaca

SEQ ID NO: 5127446 - DNA, 13 bp, Homo sapiens
acaatcagctgct

SEQ ID NO: 5127447 - DNA, 22 bp, Homo sapiens
acaatcaggtaagatcataaca

SEQ ID NO: 5127448 - DNA, 16 bp, Homo sapiens
acaatcagtcatcatg

SEQ ID NO: 5127449 - DNA, 17 bp, Homo sapiens
acaatcagtcccctccc

SEQ ID NO: 5127450 - DNA, 18 bp, Homo sapiens
acaatcagtcccctccca

SEQ ID NO: 5127451 - DNA, 22 bp, Homo sapiens
acaatcagtcccctcccatctg

SEQ ID NO: 5127452 - DNA, 13 bp, Homo sapiens
acaatcagtttat

SEQ ID NO: 5127453 - DNA, 14 bp, Homo sapiens
acaatcagtttatc

SEQ ID NO: 5127454 - DNA, 21 bp, Homo sapiens
acaatcatgaacagctctgag

SEQ ID NO: 5127455 - DNA, 20 bp, Homo sapiens
acaatcatgagtcagacatt

SEQ ID NO: 5127456 - DNA, 14 bp, Homo sapiens
acaatcatgttctg

SEQ ID NO: 5127457 - DNA, 13 bp, Homo sapiens
acaatcattgctg

SEQ ID NO: 5127458 - DNA, 14 bp, Homo sapiens
acaatcattgctga

SEQ ID NO: 5127459 - DNA, 22 bp, Homo sapiens
acaatccatgtgattaatgttt

SEQ ID NO: 5127460 - DNA, 18 bp, Homo sapiens
acaatcccacctagccca

SEQ ID NO: 5127461 - DNA, 20 bp, Homo sapiens
acaatcccacctagcccagg

SEQ ID NO: 5127462 - DNA, 13 bp, Homo sapiens
acaatccctgggg

SEQ ID NO: 5127463 - DNA, 16 bp, Homo sapiens
acaatcctagtgcttt

SEQ ID NO: 5127464 - DNA, 17 bp, Homo sapiens
acaatcctagtgctttc

SEQ ID NO: 5127465 - DNA, 23 bp, Homo sapiens
acaatcctagtgctttccttttt

SEQ ID NO: 5127466 - DNA, 20 bp, Homo sapiens
acaatcctgaagaaaccaca

SEQ ID NO: 5127467 - DNA, 14 bp, Homo sapiens
acaatcctgtccct

SEQ ID NO: 5127468 - DNA, 21 bp, Homo sapiens
acaatcctgtttataatctga

SEQ ID NO: 5127469 - DNA, 16 bp, Homo sapiens
acaatcgatggccttg

SEQ ID NO: 5127470 - DNA, 16 bp, Homo sapiens
acaatcgtcttaagtt

SEQ ID NO: 5127471 - DNA, 19 bp, Homo sapiens
acaatcgttctgtgtttga

SEQ ID NO: 5127472 - DNA, 18 bp, Homo sapiens
acaatctaattaaatggc

SEQ ID NO: 5127473 - DNA, 15 bp, Homo sapiens
acaatctagtaatgt

SEQ ID NO: 5127474 - DNA, 22 bp, Homo sapiens
acaatctatggcttatttctat

SEQ ID NO: 5127475 - DNA, 11 bp, Homo sapiens
acaatctattt

SEQ ID NO: 5127476 - DNA, 14 bp, Homo sapiens
acaatctatttaaa

SEQ ID NO: 5127477 - DNA, 19 bp, Homo sapiens
acaatctatttaaaaaact

SEQ ID NO: 5127478 - DNA, 20 bp, Homo sapiens
acaatctatttattggacat

SEQ ID NO: 5127479 - DNA, 22 bp, Homo sapiens
acaatctcatcccaacaaactt

SEQ ID NO: 5127480 - DNA, 17 bp, Homo sapiens
acaatctcccttcacaa

SEQ ID NO: 5127481 - DNA, 21 bp, Homo sapiens
acaatctcccttcacaagttt

SEQ ID NO: 5127482 - DNA, 20 bp, Homo sapiens
acaatctcgtaggtgtcctg

SEQ ID NO: 5127483 - DNA, 12 bp, Homo sapiens
acaatctcttaa

SEQ ID NO: 5127484 - DNA, 21 bp, Homo sapiens
acaatctggagatactaaatc

SEQ ID NO: 5127485 - DNA, 16 bp, Homo sapiens
acaatctgggactttc

SEQ ID NO: 5127486 - DNA, 14 bp, Homo sapiens
acaatctgttctac

SEQ ID NO: 5127487 - DNA, 16 bp, Homo sapiens
acaatcttagtgaatg

SEQ ID NO: 5127488 - DNA, 15 bp, Homo sapiens
acaatcttatgtttc

SEQ ID NO: 5127489 - DNA, 15 bp, Homo sapiens
acaatcttgggaaca

SEQ ID NO: 5127490 - DNA, 19 bp, Homo sapiens
acaatcttggggctgatga

SEQ ID NO: 5127491 - DNA, 19 bp, Homo sapiens
acaatctttattatgcatt

SEQ ID NO: 5127492 - DNA, 16 bp, Homo sapiens
acaatctttcatgtct

SEQ ID NO: 5127493 - DNA, 19 bp, Homo sapiens
acaatgaaaacaaataaaa

SEQ ID NO: 5127494 - DNA, 18 bp, Homo sapiens
acaatgaaaactctttgc

SEQ ID NO: 5127495 - DNA, 24 bp, Homo sapiens
acaatgaacatccctttttcaatg

SEQ ID NO: 5127496 - DNA, 21 bp, Homo sapiens
acaatgaaggaaaacctcact

SEQ ID NO: 5127497 - DNA, 13 bp, Homo sapiens
acaatgaagggaa

SEQ ID NO: 5127498 - DNA, 18 bp, Homo sapiens
acaatgaagggaaattgt

SEQ ID NO: 5127499 - DNA, 20 bp, Homo sapiens
acaatgaagtgttttacaat

SEQ ID NO: 5127500 - DNA, 21 bp, Homo sapiens
acaatgaagttgaaaatcata

SEQ ID NO: 5127501 - DNA, 13 bp, Homo sapiens
acaatgaatcaga

SEQ ID NO: 5127502 - DNA, 13 bp, Homo sapiens
acaatgaatgtat

SEQ ID NO: 5127503 - DNA, 14 bp, Homo sapiens
acaatgaatgtata

SEQ ID NO: 5127504 - DNA, 15 bp, Homo sapiens
acaatgaatgtcttt

SEQ ID NO: 5127505 - DNA, 22 bp, Homo sapiens
acaatgaattgaatgctctaag

SEQ ID NO: 5127506 - DNA, 20 bp, Homo sapiens
acaatgacaaaaagaagatg

SEQ ID NO: 5127507 - DNA, 17 bp, Homo sapiens
acaatgacaagatgttc

SEQ ID NO: 5127508 - DNA, 16 bp, Homo sapiens
acaatgacatttatat

SEQ ID NO: 5127509 - DNA, 15 bp, Homo sapiens
acaatgactaagcca

SEQ ID NO: 5127510 - DNA, 17 bp, Homo sapiens
acaatgactaagccaag

SEQ ID NO: 5127511 - DNA, 20 bp, Homo sapiens
acaatgactaattcttgcat

SEQ ID NO: 5127512 - DNA, 17 bp, Homo sapiens
acaatgacttactgtac

SEQ ID NO: 5127513 - DNA, 22 bp, Homo sapiens
acaatgacttactgtacatgaa

SEQ ID NO: 5127514 - DNA, 20 bp, Homo sapiens
acaatgagaaaaataaatgg

SEQ ID NO: 5127515 - DNA, 21 bp, Homo sapiens
acaatgatcaccgactgaaaa

SEQ ID NO: 5127516 - DNA, 17 bp, Homo sapiens
acaatgatgatgataat

SEQ ID NO: 5127517 - DNA, 20 bp, Homo sapiens
acaatgatggtaaagccatg

SEQ ID NO: 5127518 - DNA, 16 bp, Homo sapiens
acaatgattaatcagc

SEQ ID NO: 5127519 - DNA, 20 bp, Homo sapiens
acaatgatttggccaggcct

SEQ ID NO: 5127520 - DNA, 13 bp, Homo sapiens
acaatgatttgta

SEQ ID NO: 5127521 - DNA, 14 bp, Homo sapiens
acaatgatttgtaa

SEQ ID NO: 5127522 - DNA, 16 bp, Homo sapiens
acaatgcaacttttaa

SEQ ID NO: 5127523 - DNA, 18 bp, Homo sapiens
acaatgcacttttatgaa

SEQ ID NO: 5127524 - DNA, 16 bp, Homo sapiens
acaatgcatgctttgg

SEQ ID NO: 5127525 - DNA, 16 bp, Homo sapiens
acaatgcatgtgctgt

SEQ ID NO: 5127526 - DNA, 18 bp, Homo sapiens
acaatgccatgaacaaat

SEQ ID NO: 5127527 - DNA, 19 bp, Homo sapiens
acaatgccatgaacaaatt

SEQ ID NO: 5127528 - DNA, 20 bp, Homo sapiens
acaatgccatgaacaaattc

SEQ ID NO: 5127529 - DNA, 21 bp, Homo sapiens
acaatgccatgaacaaattct

SEQ ID NO: 5127530 - DNA, 18 bp, Homo sapiens
acaatgccctgctggcct

SEQ ID NO: 5127531 - DNA, 21 bp, Homo sapiens
acaatgccctgctggcctgtc

SEQ ID NO: 5127532 - DNA, 16 bp, Homo sapiens
acaatgcctattgtaa

SEQ ID NO: 5127533 - DNA, 16 bp, Homo sapiens
acaatgccttgttgta

SEQ ID NO: 5127534 - DNA, 22 bp, Homo sapiens
acaatgccttgttgtattcctg

SEQ ID NO: 5127535 - DNA, 16 bp, Homo sapiens
acaatgcgaatggtag

SEQ ID NO: 5127536 - DNA, 21 bp, Homo sapiens
acaatgcgtggcacatctaaa

SEQ ID NO: 5127537 - DNA, 16 bp, Homo sapiens
acaatgctgccatgcc

SEQ ID NO: 5127538 - DNA, 21 bp, Homo sapiens
acaatgctgccatgcccacca

SEQ ID NO: 5127539 - DNA, 14 bp, Homo sapiens
acaatgctgtattt

SEQ ID NO: 5127540 - DNA, 23 bp, Homo sapiens
acaatgctgtgccctaaagtgta

SEQ ID NO: 5127541 - DNA, 24 bp, Homo sapiens
acaatgctgtgccctaaagtgtat

SEQ ID NO: 5127542 - DNA, 18 bp, Homo sapiens
acaatgctttgataaaat

SEQ ID NO: 5127543 - DNA, 14 bp, Homo sapiens
acaatggaaactga

SEQ ID NO: 5127544 - DNA, 23 bp, Homo sapiens
acaatggagtgggagatcagcca

SEQ ID NO: 5127545 - DNA, 22 bp, Homo sapiens
acaatggatattgcctgtgttt

SEQ ID NO: 5127546 - DNA, 12 bp, Homo sapiens
acaatggcagct

SEQ ID NO: 5127547 - DNA, 16 bp, Homo sapiens
acaatggccagcccag

SEQ ID NO: 5127548 - DNA, 17 bp, Homo sapiens
acaatggccagcccaga

SEQ ID NO: 5127549 - DNA, 17 bp, Homo sapiens
acaatggctatattaat

SEQ ID NO: 5127550 - DNA, 23 bp, Homo sapiens
acaatggctgggagggggccctt

SEQ ID NO: 5127551 - DNA, 16 bp, Homo sapiens
acaatggctgggtttg

SEQ ID NO: 5127552 - DNA, 18 bp, Homo sapiens
acaatggctgggtttggg

SEQ ID NO: 5127553 - DNA, 19 bp, Homo sapiens
acaatgggaaaacttcact

SEQ ID NO: 5127554 - DNA, 13 bp, Homo sapiens
acaatgggaaaag

SEQ ID NO: 5127555 - DNA, 17 bp, Homo sapiens
acaatggggactttgtt

SEQ ID NO: 5127556 - DNA, 19 bp, Homo sapiens
acaatggggctggttttgc

SEQ ID NO: 5127557 - DNA, 14 bp, Homo sapiens
acaatggtaacatt

SEQ ID NO: 5127558 - DNA, 18 bp, Homo sapiens
acaatggtagctctgaag

SEQ ID NO: 5127559 - DNA, 22 bp, Homo sapiens
acaatggtagctctgaagggag

SEQ ID NO: 5127560 - DNA, 18 bp, Homo sapiens
acaatggtcttacattgg

SEQ ID NO: 5127561 - DNA, 19 bp, Homo sapiens
acaatggtcttacattgga

SEQ ID NO: 5127562 - DNA, 15 bp, Homo sapiens
acaatggtgtctctt

SEQ ID NO: 5127563 - DNA, 20 bp, Homo sapiens
acaatggtgtggtgaatgtg

SEQ ID NO: 5127564 - DNA, 21 bp, Homo sapiens
acaatggtttacatgaacaca

SEQ ID NO: 5127565 - DNA, 22 bp, Homo sapiens
acaatggtttacatgaacacag

SEQ ID NO: 5127566 - DNA, 20 bp, Homo sapiens
acaatggtttcaaagaaaga

SEQ ID NO: 5127567 - DNA, 21 bp, Homo sapiens
acaatggttttcttgtgtgtt

SEQ ID NO: 5127568 - DNA, 21 bp, Homo sapiens
acaatgtaattacattaaaat

SEQ ID NO: 5127569 - DNA, 13 bp, Homo sapiens
acaatgtaattat

SEQ ID NO: 5127570 - DNA, 12 bp, Homo sapiens
acaatgtacaat

SEQ ID NO: 5127571 - DNA, 13 bp, Homo sapiens
acaatgtacaatt

SEQ ID NO: 5127572 - DNA, 14 bp, Homo sapiens
acaatgtacaatta

SEQ ID NO: 5127573 - DNA, 18 bp, Homo sapiens
acaatgtacaattatgtc

SEQ ID NO: 5127574 - DNA, 14 bp, Homo sapiens
acaatgtacacact

SEQ ID NO: 5127575 - DNA, 14 bp, Homo sapiens
acaatgtactatat

SEQ ID NO: 5127576 - DNA, 16 bp, Homo sapiens
acaatgtagaaaatga

SEQ ID NO: 5127577 - DNA, 20 bp, Homo sapiens
acaatgtagataagtgttct

SEQ ID NO: 5127578 - DNA, 21 bp, Homo sapiens
acaatgtagataagtgttctg

SEQ ID NO: 5127579 - DNA, 23 bp, Homo sapiens
acaatgtagatggcctcttacta

SEQ ID NO: 5127580 - DNA, 16 bp, Homo sapiens
acaatgtataaagatt

SEQ ID NO: 5127581 - DNA, 18 bp, Homo sapiens
acaatgtataaagattgt

SEQ ID NO: 5127582 - DNA, 15 bp, Homo sapiens
acaatgtatctttat

SEQ ID NO: 5127583 - DNA, 17 bp, Homo sapiens
acaatgtatgtaatttg

SEQ ID NO: 5127584 - DNA, 20 bp, Homo sapiens
acaatgtatgtacaatacaa

SEQ ID NO: 5127585 - DNA, 14 bp, Homo sapiens
acaatgtatttatt

SEQ ID NO: 5127586 - DNA, 17 bp, Homo sapiens
acaatgtatttatttaa

SEQ ID NO: 5127587 - DNA, 19 bp, Homo sapiens
acaatgtatttatttaaaa

SEQ ID NO: 5127588 - DNA, 20 bp, Homo sapiens
acaatgtatttatttaaaag

SEQ ID NO: 5127589 - DNA, 21 bp, Homo sapiens
acaatgtatttatttaaaaga

SEQ ID NO: 5127590 - DNA, 15 bp, Homo sapiens
acaatgtattttgga

SEQ ID NO: 5127591 - DNA, 14 bp, Homo sapiens
acaatgtcacataa

SEQ ID NO: 5127592 - DNA, 22 bp, Homo sapiens
acaatgtcctaactgaaagatg

SEQ ID NO: 5127593 - DNA, 16 bp, Homo sapiens
acaatgtcctctttga

SEQ ID NO: 5127594 - DNA, 21 bp, Homo sapiens
acaatgtcgagtatattatta

SEQ ID NO: 5127595 - DNA, 18 bp, Homo sapiens
acaatgtctggctgaagc

SEQ ID NO: 5127596 - DNA, 19 bp, Homo sapiens
acaatgtgaactttattaa

SEQ ID NO: 5127597 - DNA, 12 bp, Homo sapiens
acaatgtgaata

SEQ ID NO: 5127598 - DNA, 17 bp, Homo sapiens
acaatgtgaataatggc

SEQ ID NO: 5127599 - DNA, 17 bp, Homo sapiens
acaatgtgactttgaaa

SEQ ID NO: 5127600 - DNA, 20 bp, Homo sapiens
acaatgtgactttgaaaata

SEQ ID NO: 5127601 - DNA, 20 bp, Homo sapiens
acaatgtgatatgtgtaata

SEQ ID NO: 5127602 - DNA, 23 bp, Homo sapiens
acaatgtggaattacataacagg

SEQ ID NO: 5127603 - DNA, 21 bp, Homo sapiens
acaatgtggacgtgcactgac

SEQ ID NO: 5127604 - DNA, 21 bp, Homo sapiens
acaatgtggccgaggactttg

SEQ ID NO: 5127605 - DNA, 22 bp, Homo sapiens
acaatgtgggcgtttgtaaatt

SEQ ID NO: 5127606 - DNA, 22 bp, Homo sapiens
acaatgtgtctatttctgaaag

SEQ ID NO: 5127607 - DNA, 22 bp, Homo sapiens
acaatgtgtgttgctgtcagaa

SEQ ID NO: 5127608 - DNA, 13 bp, Homo sapiens
acaatgttaaatg

SEQ ID NO: 5127609 - DNA, 16 bp, Homo sapiens
acaatgttaaatgcaa

SEQ ID NO: 5127610 - DNA, 22 bp, Homo sapiens
acaatgttaaggaaactcttat

SEQ ID NO: 5127611 - DNA, 21 bp, Homo sapiens
acaatgttcatcccatgatgt

SEQ ID NO: 5127612 - DNA, 23 bp, Homo sapiens
acaatgttccttttttgtatatt

SEQ ID NO: 5127613 - DNA, 16 bp, Homo sapiens
acaatgttctgttgta

SEQ ID NO: 5127614 - DNA, 19 bp, Homo sapiens
acaatgttggagcagcagg

SEQ ID NO: 5127615 - DNA, 20 bp, Homo sapiens
acaatgttggagcagcaggc

SEQ ID NO: 5127616 - DNA, 22 bp, Homo sapiens
acaatgttgtagtgtcccccac

SEQ ID NO: 5127617 - DNA, 21 bp, Homo sapiens
acaatgttgtccaacaataaa

SEQ ID NO: 5127618 - DNA, 22 bp, Homo sapiens
acaatgttgtccaacaataaac

SEQ ID NO: 5127619 - DNA, 14 bp, Homo sapiens
acaaaaaccaagtt

SEQ ID NO: 5127620 - DNA, 15 bp, Homo sapiens
acaaaaaccagcagg

SEQ ID NO: 5127621 - DNA, 21 bp, Homo sapiens
acaaaaactttccatgacagt

SEQ ID NO: 5127622 - DNA, 14 bp, Homo sapiens
acaaaaagaaagct

SEQ ID NO: 5127623 - DNA, 14 bp, Homo sapiens
acaaaaagaaatct

SEQ ID NO: 5127624 - DNA, 21 bp, Homo sapiens
acaaaaagaaatcttgtctta

SEQ ID NO: 5127625 - DNA, 16 bp, Homo sapiens
acaaaaagaaatgtca

SEQ ID NO: 5127626 - DNA, 16 bp, Homo sapiens
acaaaaagaacaaaaa

SEQ ID NO: 5127627 - DNA, 20 bp, Homo sapiens
acaaaaagaagagtttgtga

SEQ ID NO: 5127628 - DNA, 15 bp, Homo sapiens
acaaaaagcaaaaat

SEQ ID NO: 5127629 - DNA, 14 bp, Homo sapiens
acaaaaagcaatta

SEQ ID NO: 5127630 - DNA, 21 bp, Homo sapiens
acaaaaagctaacatctttac

SEQ ID NO: 5127631 - DNA, 14 bp, Homo sapiens
acaaaaagcttccc

SEQ ID NO: 5127632 - DNA, 18 bp, Homo sapiens
acaaaaaggaaatgaata

SEQ ID NO: 5127633 - DNA, 12 bp, Homo sapiens
acaaaaaggcaa

SEQ ID NO: 5127634 - DNA, 14 bp, Homo sapiens
acaaaaaggcaaat

SEQ ID NO: 5127635 - DNA, 14 bp, Homo sapiens
acaaaaaggtgcta

SEQ ID NO: 5127636 - DNA, 22 bp, Homo sapiens
acaaaaagtaatgtatatctgt

SEQ ID NO: 5127637 - DNA, 23 bp, Homo sapiens
acaaaaagtgcttcattctttgc

SEQ ID NO: 5127638 - DNA, 15 bp, Homo sapiens
acaaaaagttttttt

SEQ ID NO: 5127639 - DNA, 21 bp, Homo sapiens
acaaaaagttttttttttgtt

SEQ ID NO: 5127640 - DNA, 20 bp, Homo sapiens
acaaaaataaatttatatga

SEQ ID NO: 5127641 - DNA, 14 bp, Homo sapiens
acaaaaataacact

SEQ ID NO: 5127642 - DNA, 16 bp, Homo sapiens
acaaaaataacactgt

SEQ ID NO: 5127643 - DNA, 12 bp, Homo sapiens
acaaaaatactc

SEQ ID NO: 5127644 - DNA, 18 bp, Homo sapiens
acaaaaatactctaattc

SEQ ID NO: 5127645 - DNA, 20 bp, Homo sapiens
acaaaaatactctaattcta

SEQ ID NO: 5127646 - DNA, 14 bp, Homo sapiens
acaaaaatagagaa

SEQ ID NO: 5127647 - DNA, 13 bp, Homo sapiens
acaaaaatataaa

SEQ ID NO: 5127648 - DNA, 13 bp, Homo sapiens
acaaaaatatatt

SEQ ID NO: 5127649 - DNA, 21 bp, Homo sapiens
acaaaaatatattaaaaatat

SEQ ID NO: 5127650 - DNA, 17 bp, Homo sapiens
acaaaaatcaaagaaca

SEQ ID NO: 5127651 - DNA, 19 bp, Homo sapiens
acaaaaatgaactgaagtt

SEQ ID NO: 5127652 - DNA, 13 bp, Homo sapiens
acaaaaatgaata

SEQ ID NO: 5127653 - DNA, 14 bp, Homo sapiens
acaaaaatgactct

SEQ ID NO: 5127654 - DNA, 14 bp, Homo sapiens
acaaaaattaaaat

SEQ ID NO: 5127655 - DNA, 20 bp, Homo sapiens
acaaaaattatctatttgta

SEQ ID NO: 5127656 - DNA, 23 bp, Homo sapiens
acaaaaatttattttcttttttg

SEQ ID NO: 5127657 - DNA, 13 bp, Homo sapiens
acaaaacaaaaca

SEQ ID NO: 5127658 - DNA, 18 bp, Homo sapiens
acaaaacaaaacaaaact

SEQ ID NO: 5127659 - DNA, 14 bp, Homo sapiens
acaaaacaaaacta

SEQ ID NO: 5127660 - DNA, 16 bp, Homo sapiens
acaaaacaaacacaca

SEQ ID NO: 5127661 - DNA, 12 bp, Homo sapiens
acaaaacaaatg

SEQ ID NO: 5127662 - DNA, 12 bp, Homo sapiens
acaaaacaacaa

SEQ ID NO: 5127663 - DNA, 14 bp, Homo sapiens
acaaaacaacaaca

SEQ ID NO: 5127664 - DNA, 17 bp, Homo sapiens
acaaaacaaccctagag

SEQ ID NO: 5127665 - DNA, 15 bp, Homo sapiens
acaaaacaagaaaga

SEQ ID NO: 5127666 - DNA, 23 bp, Homo sapiens
acaaaacatttaaataaaacttt

SEQ ID NO: 5127667 - DNA, 20 bp, Homo sapiens
acaaaacattttgaaggaaa

SEQ ID NO: 5127668 - DNA, 19 bp, Homo sapiens
acaaaaccaaaagttatta

SEQ ID NO: 5127669 - DNA, 22 bp, Homo sapiens
acaaaaccacagtgtaccatta

SEQ ID NO: 5127670 - DNA, 15 bp, Homo sapiens
acaaaaccagctgct

SEQ ID NO: 5127671 - DNA, 21 bp, Homo sapiens
acaaaaccagctgctactcat

SEQ ID NO: 5127672 - DNA, 18 bp, Homo sapiens
acaaaaccgtttagtcat

SEQ ID NO: 5127673 - DNA, 16 bp, Homo sapiens
acaaaacctaacttgc

SEQ ID NO: 5127674 - DNA, 18 bp, Homo sapiens
acaaaacctatttttcct

SEQ ID NO: 5127675 - DNA, 18 bp, Homo sapiens
acaaaaccttgtgtaaga

SEQ ID NO: 5127676 - DNA, 16 bp, Homo sapiens
acaaaacgcgcagatg

SEQ ID NO: 5127677 - DNA, 15 bp, Homo sapiens
acaaaactacatgag

SEQ ID NO: 5127678 - DNA, 17 bp, Homo sapiens
acaaaactacatgagaa

SEQ ID NO: 5127679 - DNA, 14 bp, Homo sapiens
acaaaactatactt

SEQ ID NO: 5127680 - DNA, 16 bp, Homo sapiens
acaaaactatacttga

SEQ ID NO: 5127681 - DNA, 18 bp, Homo sapiens
acaaaactctgtcaggca

SEQ ID NO: 5127682 - DNA, 16 bp, Homo sapiens
acaaaactgcatttca

SEQ ID NO: 5127683 - DNA, 12 bp, Homo sapiens
acaaaactgtaa

SEQ ID NO: 5127684 - DNA, 22 bp, Homo sapiens
acaaaactgtaaataaaatgtg

SEQ ID NO: 5127685 - DNA, 14 bp, Homo sapiens
acaaaactgtaact

SEQ ID NO: 5127686 - DNA, 21 bp, Homo sapiens
acaaaacttaaaagtattcat

SEQ ID NO: 5127687 - DNA, 16 bp, Homo sapiens
acaaaacttataattt

SEQ ID NO: 5127688 - DNA, 11 bp, Homo sapiens
acaaaacttcc

SEQ ID NO: 5127689 - DNA, 11 bp, Homo sapiens
acaaaacttct

SEQ ID NO: 5127690 - DNA, 17 bp, Homo sapiens
acaaaacttcttgtcag

SEQ ID NO: 5127691 - DNA, 12 bp, Homo sapiens
acaaaagaaaaa

SEQ ID NO: 5127692 - DNA, 16 bp, Homo sapiens
acaaaagaaatacctt

SEQ ID NO: 5127693 - DNA, 21 bp, Homo sapiens
acaaaagaactaagaggccca

SEQ ID NO: 5127694 - DNA, 20 bp, Homo sapiens
acaaaagaagcccggctcct

SEQ ID NO: 5127695 - DNA, 20 bp, Homo sapiens
acaaaagaaggtcaaactgt

SEQ ID NO: 5127696 - DNA, 21 bp, Homo sapiens
acaaaagaataacattttcta

SEQ ID NO: 5127697 - DNA, 16 bp, Homo sapiens
acaaaagaataagaca

SEQ ID NO: 5127698 - DNA, 21 bp, Homo sapiens
acaaaagaataagacaagaga

SEQ ID NO: 5127699 - DNA, 16 bp, Homo sapiens
acaaaagaatttttgt

SEQ ID NO: 5127700 - DNA, 21 bp, Homo sapiens
acaaaagagcatggatgcatt

SEQ ID NO: 5127701 - DNA, 17 bp, Homo sapiens
acaaaagatatgaagaa

SEQ ID NO: 5127702 - DNA, 15 bp, Homo sapiens
acaaaagcaaaattt

SEQ ID NO: 5127703 - DNA, 18 bp, Homo sapiens
acaaaagcaaagtgaagt

SEQ ID NO: 5127704 - DNA, 11 bp, Homo sapiens
acaaaagcaat

SEQ ID NO: 5127705 - DNA, 18 bp, Homo sapiens
acaaaagcagccctctgc

SEQ ID NO: 5127706 - DNA, 15 bp, Homo sapiens
acaaaagcagctttt

SEQ ID NO: 5127707 - DNA, 16 bp, Homo sapiens
acaaaagcagctttta

SEQ ID NO: 5127708 - DNA, 21 bp, Homo sapiens
acaaaagcattcggagggagg

SEQ ID NO: 5127709 - DNA, 21 bp, Homo sapiens
acaaaagcccgcttgctcgct

SEQ ID NO: 5127710 - DNA, 18 bp, Homo sapiens
acaaaagcttgtgtatct

SEQ ID NO: 5127711 - DNA, 21 bp, Homo sapiens
acaaaaggaatgtgtaagtct

SEQ ID NO: 5127712 - DNA, 19 bp, Homo sapiens
acaaaaggctccatatata

SEQ ID NO: 5127713 - DNA, 14 bp, Homo sapiens
acaaaagggccagg

SEQ ID NO: 5127714 - DNA, 23 bp, Homo sapiens
acaaaagggctctataatgatta

SEQ ID NO: 5127715 - DNA, 14 bp, Homo sapiens
acaaaagggtcaga

SEQ ID NO: 5127716 - DNA, 22 bp, Homo sapiens
acaaaagtacattgcttaaaat

SEQ ID NO: 5127717 - DNA, 23 bp, Homo sapiens
acaaaagtctcaatgttccattc

SEQ ID NO: 5127718 - DNA, 22 bp, Homo sapiens
acaaaagtgaaccatctcagac

SEQ ID NO: 5127719 - DNA, 15 bp, Homo sapiens
acaaaagtgacagat

SEQ ID NO: 5127720 - DNA, 22 bp, Homo sapiens
acaaaagtgtacctgtaaatgt

SEQ ID NO: 5127721 - DNA, 20 bp, Homo sapiens
acaaaagttctgcgtaatga

SEQ ID NO: 5127722 - DNA, 15 bp, Homo sapiens
acaaaagtttcacaa

SEQ ID NO: 5127723 - DNA, 22 bp, Homo sapiens
acaaaagtttcatccttttcat

SEQ ID NO: 5127724 - DNA, 13 bp, Homo sapiens
acaaaataaattg

SEQ ID NO: 5127725 - DNA, 12 bp, Homo sapiens
acaaaataacat

SEQ ID NO: 5127726 - DNA, 15 bp, Homo sapiens
acaaaatacaaaaaa

SEQ ID NO: 5127727 - DNA, 13 bp, Homo sapiens
acaaaatacacat

SEQ ID NO: 5127728 - DNA, 16 bp, Homo sapiens
acaaaatacacattct

SEQ ID NO: 5127729 - DNA, 14 bp, Homo sapiens
acaaaatacattct

SEQ ID NO: 5127730 - DNA, 14 bp, Homo sapiens
acaaaatagaaagt

SEQ ID NO: 5127731 - DNA, 19 bp, Homo sapiens
acaaaatagcacatccacc

SEQ ID NO: 5127732 - DNA, 14 bp, Homo sapiens
acaaaatagttgta

SEQ ID NO: 5127733 - DNA, 11 bp, Homo sapiens
acaaaatataa

SEQ ID NO: 5127734 - DNA, 22 bp, Homo sapiens
acaaaatataaagcatctaaac

SEQ ID NO: 5127735 - DNA, 14 bp, Homo sapiens
acaaaatatttaag

SEQ ID NO: 5127736 - DNA, 15 bp, Homo sapiens
acaaaatatttaatt

SEQ ID NO: 5127737 - DNA, 13 bp, Homo sapiens
acaaaatatttct

SEQ ID NO: 5127738 - DNA, 23 bp, Homo sapiens
acaaaatcacaagcaataattag

SEQ ID NO: 5127739 - DNA, 14 bp, Homo sapiens
acaaaatccaactc

SEQ ID NO: 5127740 - DNA, 19 bp, Homo sapiens
acaaaatccatgtgaccat

SEQ ID NO: 5127741 - DNA, 22 bp, Homo sapiens
acaaaatccattccaggtagct

SEQ ID NO: 5127742 - DNA, 18 bp, Homo sapiens
acaaaatctaaaacaaaa

SEQ ID NO: 5127743 - DNA, 14 bp, Homo sapiens
acaaaatctcctct

SEQ ID NO: 5127744 - DNA, 14 bp, Homo sapiens
acaaaatctgaact

SEQ ID NO: 5127745 - DNA, 23 bp, Homo sapiens
acaaaatctgaactctcaaaagt

SEQ ID NO: 5127746 - DNA, 23 bp, Homo sapiens
acaaaatcttgtaggtcattgca

SEQ ID NO: 5127747 - DNA, 11 bp, Homo sapiens
acaaaatgaaa

SEQ ID NO: 5127748 - DNA, 22 bp, Homo sapiens
acaaaatgaaacgcaaccacca

SEQ ID NO: 5127749 - DNA, 14 bp, Homo sapiens
acaaaatgaaagaa

SEQ ID NO: 5127750 - DNA, 11 bp, Homo sapiens
acaaaatgaat

SEQ ID NO: 5127751 - DNA, 16 bp, Homo sapiens
acaaaatgaattgcct

SEQ ID NO: 5127752 - DNA, 17 bp, Homo sapiens
acaaaatgaattgcctt

SEQ ID NO: 5127753 - DNA, 19 bp, Homo sapiens
acaaaatgaattgcctttg

SEQ ID NO: 5127754 - DNA, 12 bp, Homo sapiens
acaaaatgactg

SEQ ID NO: 5127755 - DNA, 15 bp, Homo sapiens
acaaaatgattgtct

SEQ ID NO: 5127756 - DNA, 21 bp, Homo sapiens
acaaaatgcctttttgtttac

SEQ ID NO: 5127757 - DNA, 14 bp, Homo sapiens
acaaaatggaatac

SEQ ID NO: 5127758 - DNA, 19 bp, Homo sapiens
acaaaatggaatactctta

SEQ ID NO: 5127759 - DNA, 11 bp, Homo sapiens
acaaaatggac

SEQ ID NO: 5127760 - DNA, 22 bp, Homo sapiens
acaaaatggatacataaagact

SEQ ID NO: 5127761 - DNA, 16 bp, Homo sapiens
acaaaatggcttcagt

SEQ ID NO: 5127762 - DNA, 20 bp, Homo sapiens
acaaaatggggcagaagaga

SEQ ID NO: 5127763 - DNA, 14 bp, Homo sapiens
acaaaatgtaactg

SEQ ID NO: 5127764 - DNA, 16 bp, Homo sapiens
acaaaatgtaactgtt

SEQ ID NO: 5127765 - DNA, 20 bp, Homo sapiens
acaaaatgtcacacttgttt

SEQ ID NO: 5127766 - DNA, 23 bp, Homo sapiens
acaaaatgtcacacttgtttctt

SEQ ID NO: 5127767 - DNA, 21 bp, Homo sapiens
acaaaatgtgtgcttggaaaa

SEQ ID NO: 5127768 - DNA, 11 bp, Homo sapiens
acaaaatgtta

SEQ ID NO: 5127769 - DNA, 19 bp, Homo sapiens
acaaaattaaaaaaaattg

SEQ ID NO: 5127770 - DNA, 14 bp, Homo sapiens
acaaaattataaag

SEQ ID NO: 5127771 - DNA, 18 bp, Homo sapiens
acaaaattcaaagcatgg

SEQ ID NO: 5127772 - DNA, 12 bp, Homo sapiens
acaaaattccag

SEQ ID NO: 5127773 - DNA, 15 bp, Homo sapiens
acaaaatttcacagt

SEQ ID NO: 5127774 - DNA, 12 bp, Homo sapiens
acaaaatttgaa

SEQ ID NO: 5127775 - DNA, 21 bp, Homo sapiens
acaaaatttgaataataaatc

SEQ ID NO: 5127776 - DNA, 16 bp, Homo sapiens
acaaaattttctcatt

SEQ ID NO: 5127777 - DNA, 13 bp, Homo sapiens
acaaaattttgtt

SEQ ID NO: 5127778 - DNA, 23 bp, Homo sapiens
acaaaattttgtttaaaactcag

SEQ ID NO: 5127779 - DNA, 10 bp, Homo sapiens
acaaacaaaa

SEQ ID NO: 5127780 - DNA, 18 bp, Homo sapiens
acaaacaaaaaaaagaac

SEQ ID NO: 5127781 - DNA, 14 bp, Homo sapiens
acaaacaaaaaact

SEQ ID NO: 5127782 - DNA, 15 bp, Homo sapiens
acaaacaaaaaatta

SEQ ID NO: 5127783 - DNA, 14 bp, Homo sapiens
acaaacaaaaattg

SEQ ID NO: 5127784 - DNA, 12 bp, Homo sapiens
acaaacaaaact

SEQ ID NO: 5127785 - DNA, 15 bp, Homo sapiens
acaaacaaaactctt

SEQ ID NO: 5127786 - DNA, 14 bp, Homo sapiens
acaaacaaaactta

SEQ ID NO: 5127787 - DNA, 19 bp, Homo sapiens
acaaacaaaatttctatta

SEQ ID NO: 5127788 - DNA, 16 bp, Homo sapiens
acaaacaaacaaacaa

SEQ ID NO: 5127789 - DNA, 11 bp, Homo sapiens
acaaacaaatc

SEQ ID NO: 5127790 - DNA, 14 bp, Homo sapiens
acaaacaaatggct

SEQ ID NO: 5127791 - DNA, 15 bp, Homo sapiens
acaaacaagggagaa

SEQ ID NO: 5127792 - DNA, 18 bp, Homo sapiens
acaaacacacctctgcca

SEQ ID NO: 5127793 - DNA, 11 bp, Homo sapiens
acaaacacatt

SEQ ID NO: 5127794 - DNA, 18 bp, Homo sapiens
acaaacacattataaagt

SEQ ID NO: 5127795 - DNA, 21 bp, Homo sapiens
acaaacaccttcttattatat

SEQ ID NO: 5127796 - DNA, 11 bp, Homo sapiens
acaaacactgc

SEQ ID NO: 5127797 - DNA, 20 bp, Homo sapiens
acaaacactgccatattgtg

SEQ ID NO: 5127798 - DNA, 14 bp, Homo sapiens
acaaacagatgctc

SEQ ID NO: 5127799 - DNA, 13 bp, Homo sapiens
acaaacagctcag

SEQ ID NO: 5127800 - DNA, 20 bp, Homo sapiens
acaaacagggctgccttctg

SEQ ID NO: 5127801 - DNA, 16 bp, Homo sapiens
acaatgttgtgtttgg

SEQ ID NO: 5127802 - DNA, 23 bp, Homo sapiens
acaatgtttgcttttcactggca

SEQ ID NO: 5127803 - DNA, 15 bp, Homo sapiens
acaatgtttttcata

SEQ ID NO: 5127804 - DNA, 17 bp, Homo sapiens
acaatgttttttatact

SEQ ID NO: 5127805 - DNA, 21 bp, Homo sapiens
acaattaaaaacctgatggaa

SEQ ID NO: 5127806 - DNA, 19 bp, Homo sapiens
acaattaaagctgttattt

SEQ ID NO: 5127807 - DNA, 13 bp, Homo sapiens
acaattaactgcc

SEQ ID NO: 5127808 - DNA, 22 bp, Homo sapiens
acaattaagttacaattacatc

SEQ ID NO: 5127809 - DNA, 20 bp, Homo sapiens
acaattaattatcttttcaa

SEQ ID NO: 5127810 - DNA, 14 bp, Homo sapiens
acaattacatgtaa

SEQ ID NO: 5127811 - DNA, 14 bp, Homo sapiens
acaattactaaatt

SEQ ID NO: 5127812 - DNA, 15 bp, Homo sapiens
acaattactcaggtt

SEQ ID NO: 5127813 - DNA, 15 bp, Homo sapiens
acaattactgtacac

SEQ ID NO: 5127814 - DNA, 14 bp, Homo sapiens
acaattactgtgag

SEQ ID NO: 5127815 - DNA, 20 bp, Homo sapiens
acaattactgtgagaactgt

SEQ ID NO: 5127816 - DNA, 19 bp, Homo sapiens
acaattagaggaatttaaa

SEQ ID NO: 5127817 - DNA, 13 bp, Homo sapiens
acaattagatttc

SEQ ID NO: 5127818 - DNA, 15 bp, Homo sapiens
acaattagcagaatg

SEQ ID NO: 5127819 - DNA, 16 bp, Homo sapiens
acaattaggcttcatt

SEQ ID NO: 5127820 - DNA, 13 bp, Homo sapiens
acaattaggtctg

SEQ ID NO: 5127821 - DNA, 20 bp, Homo sapiens
acaattaggtctgcattttc

SEQ ID NO: 5127822 - DNA, 12 bp, Homo sapiens
acaattataaac

SEQ ID NO: 5127823 - DNA, 16 bp, Homo sapiens
acaattatgaaaaaat

SEQ ID NO: 5127824 - DNA, 17 bp, Homo sapiens
acaattatggaaatata

SEQ ID NO: 5127825 - DNA, 17 bp, Homo sapiens
acaattatgtctcttga

SEQ ID NO: 5127826 - DNA, 20 bp, Homo sapiens
acaattatgtctcttgagca

SEQ ID NO: 5127827 - DNA, 21 bp, Homo sapiens
acaattattccaaaccaaatt

SEQ ID NO: 5127828 - DNA, 19 bp, Homo sapiens
acaattattggcaaagttt

SEQ ID NO: 5127829 - DNA, 18 bp, Homo sapiens
acaattattgtacactaa

SEQ ID NO: 5127830 - DNA, 18 bp, Homo sapiens
acaattattttaatattg

SEQ ID NO: 5127831 - DNA, 19 bp, Homo sapiens
acaattatttttgctctgc

SEQ ID NO: 5127832 - DNA, 20 bp, Homo sapiens
acaattcaagctgagaaaag

SEQ ID NO: 5127833 - DNA, 13 bp, Homo sapiens
acaattcagtggt

SEQ ID NO: 5127834 - DNA, 15 bp, Homo sapiens
acaattcagttttag

SEQ ID NO: 5127835 - DNA, 15 bp, Homo sapiens
acaattcatgaactt

SEQ ID NO: 5127836 - DNA, 22 bp, Homo sapiens
acaattcattgttaaaaaacaa

SEQ ID NO: 5127837 - DNA, 14 bp, Homo sapiens
acaattccatttcc

SEQ ID NO: 5127838 - DNA, 19 bp, Homo sapiens
acaattcccgggcccttca

SEQ ID NO: 5127839 - DNA, 16 bp, Homo sapiens
acaattccctgctgtc

SEQ ID NO: 5127840 - DNA, 21 bp, Homo sapiens
acaattcccttctttttcatc

SEQ ID NO: 5127841 - DNA, 20 bp, Homo sapiens
acaattcctccagagacact

SEQ ID NO: 5127842 - DNA, 23 bp, Homo sapiens
acaattcctccagagacactgag

SEQ ID NO: 5127843 - DNA, 17 bp, Homo sapiens
acaattcctctgataat

SEQ ID NO: 5127844 - DNA, 13 bp, Homo sapiens
acaattcctgtaa

SEQ ID NO: 5127845 - DNA, 12 bp, Homo sapiens
acaattctaaaa

SEQ ID NO: 5127846 - DNA, 17 bp, Homo sapiens
acaattctaatggtaac

SEQ ID NO: 5127847 - DNA, 24 bp, Homo sapiens
acaattctaggatgaacaatgtat

SEQ ID NO: 5127848 - DNA, 21 bp, Homo sapiens
acaattctcccgggactctgc

SEQ ID NO: 5127849 - DNA, 14 bp, Homo sapiens
acaattctgcatgt

SEQ ID NO: 5127850 - DNA, 14 bp, Homo sapiens
acaattctgggtgc

SEQ ID NO: 5127851 - DNA, 13 bp, Homo sapiens
acaattctgtccc

SEQ ID NO: 5127852 - DNA, 22 bp, Homo sapiens
acaattctgttttaggttaaaa

SEQ ID NO: 5127853 - DNA, 15 bp, Homo sapiens
acaattcttgaattc

SEQ ID NO: 5127854 - DNA, 14 bp, Homo sapiens
acaattctttatac

SEQ ID NO: 5127855 - DNA, 15 bp, Homo sapiens
acaattctttataca

SEQ ID NO: 5127856 - DNA, 17 bp, Homo sapiens
acaattctttatacaac

SEQ ID NO: 5127857 - DNA, 12 bp, Homo sapiens
acaattctttgt

SEQ ID NO: 5127858 - DNA, 19 bp, Homo sapiens
acaattcttttgaaagatg

SEQ ID NO: 5127859 - DNA, 22 bp, Homo sapiens
acaattgaaatttttaaatcat

SEQ ID NO: 5127860 - DNA, 15 bp, Homo sapiens
acaattgaacttcca

SEQ ID NO: 5127861 - DNA, 21 bp, Homo sapiens
acaattgaacttccaggaaag

SEQ ID NO: 5127862 - DNA, 19 bp, Homo sapiens
acaattgaagtaaactttt

SEQ ID NO: 5127863 - DNA, 22 bp, Homo sapiens
acaattgaagtaaactttttgt

SEQ ID NO: 5127864 - DNA, 15 bp, Homo sapiens
acaattgatctcttt

SEQ ID NO: 5127865 - DNA, 24 bp, Homo sapiens
acaattgatctgtcatccatattt

SEQ ID NO: 5127866 - DNA, 16 bp, Homo sapiens
acaattgatctttttt

SEQ ID NO: 5127867 - DNA, 21 bp, Homo sapiens
acaattgattttccccctaat

SEQ ID NO: 5127868 - DNA, 13 bp, Homo sapiens
acaattgggagct

SEQ ID NO: 5127869 - DNA, 19 bp, Homo sapiens
acaattggtgtcattttct

SEQ ID NO: 5127870 - DNA, 22 bp, Homo sapiens
acaattggtgtcattttcttga

SEQ ID NO: 5127871 - DNA, 19 bp, Homo sapiens
acaattggttgtatataaa

SEQ ID NO: 5127872 - DNA, 13 bp, Homo sapiens
acaattgtaattg

SEQ ID NO: 5127873 - DNA, 21 bp, Homo sapiens
acaattgtcgaaaagagtctt

SEQ ID NO: 5127874 - DNA, 21 bp, Homo sapiens
acaattgtcttaaaaccagag

SEQ ID NO: 5127875 - DNA, 15 bp, Homo sapiens
acaattgtgaacatg

SEQ ID NO: 5127876 - DNA, 17 bp, Homo sapiens
acaattgtgaacatgat

SEQ ID NO: 5127877 - DNA, 14 bp, Homo sapiens
acaattgtgtagcc

SEQ ID NO: 5127878 - DNA, 16 bp, Homo sapiens
acaattgtgtagcctt

SEQ ID NO: 5127879 - DNA, 24 bp, Homo sapiens
acaattgtgtataactggattgca

SEQ ID NO: 5127880 - DNA, 12 bp, Homo sapiens
acaattgtgttt

SEQ ID NO: 5127881 - DNA, 22 bp, Homo sapiens
acaatttaaaacaatccttact

SEQ ID NO: 5127882 - DNA, 20 bp, Homo sapiens
acaatttaaagcaaaggagt

SEQ ID NO: 5127883 - DNA, 22 bp, Homo sapiens
acaatttacttttaataaagta

SEQ ID NO: 5127884 - DNA, 23 bp, Homo sapiens
acaatttagaaaacattcatcca

SEQ ID NO: 5127885 - DNA, 17 bp, Homo sapiens
acaatttagcaggtaga

SEQ ID NO: 5127886 - DNA, 16 bp, Homo sapiens
acaatttatactgcga

SEQ ID NO: 5127887 - DNA, 12 bp, Homo sapiens
acaatttatatt

SEQ ID NO: 5127888 - DNA, 18 bp, Homo sapiens
acaatttatgaattgaat

SEQ ID NO: 5127889 - DNA, 14 bp, Homo sapiens
acaatttattatgg

SEQ ID NO: 5127890 - DNA, 12 bp, Homo sapiens
acaatttatttt

SEQ ID NO: 5127891 - DNA, 20 bp, Homo sapiens
acaatttcaaaaaaataaaa

SEQ ID NO: 5127892 - DNA, 13 bp, Homo sapiens
acaatttcaaaag

SEQ ID NO: 5127893 - DNA, 18 bp, Homo sapiens
acaatttcaaaatgcatg

SEQ ID NO: 5127894 - DNA, 11 bp, Homo sapiens
acaatttcaac

SEQ ID NO: 5127895 - DNA, 17 bp, Homo sapiens
acaatttcaatgcttct

SEQ ID NO: 5127896 - DNA, 18 bp, Homo sapiens
acaatttcaatgcttctt

SEQ ID NO: 5127897 - DNA, 15 bp, Homo sapiens
acaatttcatcctcc

SEQ ID NO: 5127898 - DNA, 23 bp, Homo sapiens
acaatttccatatagtctattca

SEQ ID NO: 5127899 - DNA, 17 bp, Homo sapiens
acaatttcctttatatt

SEQ ID NO: 5127900 - DNA, 23 bp, Homo sapiens
acaatttcctttatatttagtga

SEQ ID NO: 5127901 - DNA, 21 bp, Homo sapiens
acaatttctattatttttcaa

SEQ ID NO: 5127902 - DNA, 22 bp, Homo sapiens
acaatttctattatttttcaag

SEQ ID NO: 5127903 - DNA, 14 bp, Homo sapiens
acaatttctctggg

SEQ ID NO: 5127904 - DNA, 14 bp, Homo sapiens
acaatttctttaaa

SEQ ID NO: 5127905 - DNA, 21 bp, Homo sapiens
acaatttctttaaaaaagaaa

SEQ ID NO: 5127906 - DNA, 19 bp, Homo sapiens
acaatttgagactgaaatt

SEQ ID NO: 5127907 - DNA, 19 bp, Homo sapiens
acaatttgagcaattcatt

SEQ ID NO: 5127908 - DNA, 14 bp, Homo sapiens
acaatttgatacat

SEQ ID NO: 5127909 - DNA, 15 bp, Homo sapiens
acaatttgcacaata

SEQ ID NO: 5127910 - DNA, 21 bp, Homo sapiens
acaatttgcacaatatttctt

SEQ ID NO: 5127911 - DNA, 17 bp, Homo sapiens
acaatttgcataatact

SEQ ID NO: 5127912 - DNA, 13 bp, Homo sapiens
acaatttgccata

SEQ ID NO: 5127913 - DNA, 23 bp, Homo sapiens
acaatttgggcttcctgtttgta

SEQ ID NO: 5127914 - DNA, 19 bp, Homo sapiens
acaatttgtacttttttct

SEQ ID NO: 5127915 - DNA, 22 bp, Homo sapiens
acaatttgtacttttttcttaa

SEQ ID NO: 5127916 - DNA, 16 bp, Homo sapiens
acaatttgttaattcc

SEQ ID NO: 5127917 - DNA, 18 bp, Homo sapiens
acaatttgtttttgcatt

SEQ ID NO: 5127918 - DNA, 23 bp, Homo sapiens
acaatttgtttttgcatttttgt

SEQ ID NO: 5127919 - DNA, 17 bp, Homo sapiens
acaattttaaagttctt

SEQ ID NO: 5127920 - DNA, 14 bp, Homo sapiens
acaattttaaataa

SEQ ID NO: 5127921 - DNA, 12 bp, Homo sapiens
acaattttaaga

SEQ ID NO: 5127922 - DNA, 23 bp, Homo sapiens
acaattttaatgatggtgttaaa

SEQ ID NO: 5127923 - DNA, 17 bp, Homo sapiens
acaattttacctattct

SEQ ID NO: 5127924 - DNA, 19 bp, Homo sapiens
acaattttacctattctga

SEQ ID NO: 5127925 - DNA, 14 bp, Homo sapiens
acaattttcagatt

SEQ ID NO: 5127926 - DNA, 15 bp, Homo sapiens
acaattttcagattt

SEQ ID NO: 5127927 - DNA, 22 bp, Homo sapiens
acaattttcagatttgcacaaa

SEQ ID NO: 5127928 - DNA, 15 bp, Homo sapiens
acaattttcatccca

SEQ ID NO: 5127929 - DNA, 16 bp, Homo sapiens
acaattttcatcccac

SEQ ID NO: 5127930 - DNA, 18 bp, Homo sapiens
acaattttctaccactgg

SEQ ID NO: 5127931 - DNA, 12 bp, Homo sapiens
acaattttctgt

SEQ ID NO: 5127932 - DNA, 15 bp, Homo sapiens
acaattttctgtaag

SEQ ID NO: 5127933 - DNA, 21 bp, Homo sapiens
acaattttctgtaatctttta

SEQ ID NO: 5127934 - DNA, 12 bp, Homo sapiens
acaattttgtcc

SEQ ID NO: 5127935 - DNA, 20 bp, Homo sapiens
acaattttgtcctaatatat

SEQ ID NO: 5127936 - DNA, 22 bp, Homo sapiens
acaattttgtcttaagtgtttc

SEQ ID NO: 5127937 - DNA, 14 bp, Homo sapiens
acaatttttaatgg

SEQ ID NO: 5127938 - DNA, 15 bp, Homo sapiens
acaatttttaatggc

SEQ ID NO: 5127939 - DNA, 14 bp, Homo sapiens
acaatttttgatca

SEQ ID NO: 5127940 - DNA, 21 bp, Homo sapiens
acaatttttgctgttttcagc

SEQ ID NO: 5127941 - DNA, 18 bp, Homo sapiens
acaattttttgtgatgaa

SEQ ID NO: 5127942 - DNA, 21 bp, Homo sapiens
acaattttttgtgatgaaaag

SEQ ID NO: 5127943 - DNA, 18 bp, Homo sapiens
acaatttttttaattttg

SEQ ID NO: 5127944 - DNA, 17 bp, Homo sapiens
acaattttttttttcct

SEQ ID NO: 5127945 - DNA, 13 bp, Homo sapiens
acacaaaaagaaa

SEQ ID NO: 5127946 - DNA, 16 bp, Homo sapiens
acacaaaaagaaagct

SEQ ID NO: 5127947 - DNA, 22 bp, Homo sapiens
acacaaaaaggagcgggcaggg

SEQ ID NO: 5127948 - DNA, 13 bp, Homo sapiens
acacaaaacaaca

SEQ ID NO: 5127949 - DNA, 17 bp, Homo sapiens
acacaaaacaacagcaa

SEQ ID NO: 5127950 - DNA, 13 bp, Homo sapiens
acacaaaacattt

SEQ ID NO: 5127951 - DNA, 16 bp, Homo sapiens
acacaaaactccgccc

SEQ ID NO: 5127952 - DNA, 21 bp, Homo sapiens
acacaaaactccgcccccagc

SEQ ID NO: 5127953 - DNA, 15 bp, Homo sapiens
acacaaaagaagaaa

SEQ ID NO: 5127954 - DNA, 19 bp, Homo sapiens
acacaaaagtttctctttt

SEQ ID NO: 5127955 - DNA, 18 bp, Homo sapiens
acacaaacctaaaaattt

SEQ ID NO: 5127956 - DNA, 16 bp, Homo sapiens
acacaaacctgcctgg

SEQ ID NO: 5127957 - DNA, 21 bp, Homo sapiens
acacaaactatggtgtgctta

SEQ ID NO: 5127958 - DNA, 19 bp, Homo sapiens
acacaaactgtaaataaaa

SEQ ID NO: 5127959 - DNA, 12 bp, Homo sapiens
acacaaagacca

SEQ ID NO: 5127960 - DNA, 12 bp, Homo sapiens
acacaaagagag

SEQ ID NO: 5127961 - DNA, 17 bp, Homo sapiens
acacaaagagatattta

SEQ ID NO: 5127962 - DNA, 16 bp, Homo sapiens
acacaaaggcatgctg

SEQ ID NO: 5127963 - DNA, 18 bp, Homo sapiens
acacaaaggcatgctgga

SEQ ID NO: 5127964 - DNA, 18 bp, Homo sapiens
acacaaataccagagcac

SEQ ID NO: 5127965 - DNA, 20 bp, Homo sapiens
acacaaatacggaagtaaac

SEQ ID NO: 5127966 - DNA, 19 bp, Homo sapiens
acacaaatattgcttggac

SEQ ID NO: 5127967 - DNA, 17 bp, Homo sapiens
acacaaatgcagacaca

SEQ ID NO: 5127968 - DNA, 21 bp, Homo sapiens
acacaaatggggtccaggtca

SEQ ID NO: 5127969 - DNA, 20 bp, Homo sapiens
acacaaatgtgatttttgta

SEQ ID NO: 5127970 - DNA, 18 bp, Homo sapiens
acacaaatgtgtattttt

SEQ ID NO: 5127971 - DNA, 12 bp, Homo sapiens
acacaaattttc

SEQ ID NO: 5127972 - DNA, 14 bp, Homo sapiens
acacaacaaaaatg

SEQ ID NO: 5127973 - DNA, 15 bp, Homo sapiens
acacaacaagaaact

SEQ ID NO: 5127974 - DNA, 14 bp, Homo sapiens
acacaacaccagga

SEQ ID NO: 5127975 - DNA, 15 bp, Homo sapiens
acacaacaccaggac

SEQ ID NO: 5127976 - DNA, 21 bp, Homo sapiens
acacaacagcagtctccttca

SEQ ID NO: 5127977 - DNA, 13 bp, Homo sapiens
acacaacatttgt

SEQ ID NO: 5127978 - DNA, 19 bp, Homo sapiens
acacaacgattatagtaac

SEQ ID NO: 5127979 - DNA, 13 bp, Homo sapiens
acacaactcactc

SEQ ID NO: 5127980 - DNA, 17 bp, Homo sapiens
acaaacagtgaatttaa

SEQ ID NO: 5127981 - DNA, 17 bp, Homo sapiens
acaaacatacccatctg

SEQ ID NO: 5127982 - DNA, 16 bp, Homo sapiens
acaaacatagacagat

SEQ ID NO: 5127983 - DNA, 19 bp, Homo sapiens
acaaacatatttgttaaat

SEQ ID NO: 5127984 - DNA, 11 bp, Homo sapiens
acaaacatgaa

SEQ ID NO: 5127985 - DNA, 15 bp, Homo sapiens
acaaacattgctgcc

SEQ ID NO: 5127986 - DNA, 13 bp, Homo sapiens
acaaacattgtgt

SEQ ID NO: 5127987 - DNA, 20 bp, Homo sapiens
acaaacattgtgttgacatt

SEQ ID NO: 5127988 - DNA, 11 bp, Homo sapiens
acaaacatttt

SEQ ID NO: 5127989 - DNA, 17 bp, Homo sapiens
acaaacatttttcaaca

SEQ ID NO: 5127990 - DNA, 23 bp, Homo sapiens
acaaaccaagagcttttacagat

SEQ ID NO: 5127991 - DNA, 15 bp, Homo sapiens
acaaaccacaactga

SEQ ID NO: 5127992 - DNA, 14 bp, Homo sapiens
acaaaccacagcag

SEQ ID NO: 5127993 - DNA, 22 bp, Homo sapiens
acaaaccaccctaaaatgacag

SEQ ID NO: 5127994 - DNA, 23 bp, Homo sapiens
acaaaccaccctaaaatgacagc

SEQ ID NO: 5127995 - DNA, 16 bp, Homo sapiens
acaaaccactgtacat

SEQ ID NO: 5127996 - DNA, 18 bp, Homo sapiens
acaaaccactgtacatat

SEQ ID NO: 5127997 - DNA, 20 bp, Homo sapiens
acaaaccagcaacttttctc

SEQ ID NO: 5127998 - DNA, 16 bp, Homo sapiens
acaaaccagcctgggg

SEQ ID NO: 5127999 - DNA, 20 bp, Homo sapiens
acaaaccatctggtgccttt

SEQ ID NO: 5128000 - DNA, 23 bp, Homo sapiens
acaaaccattttattttttgggc

SEQ ID NO: 5128001 - DNA, 21 bp, Homo sapiens
acaaaccgagtgcaatgaatg

SEQ ID NO: 5128002 - DNA, 18 bp, Homo sapiens
acaaacctaccaaaatgg

SEQ ID NO: 5128003 - DNA, 21 bp, Homo sapiens
acaaacctaccaaaatggaat

SEQ ID NO: 5128004 - DNA, 18 bp, Homo sapiens
acaaacctagaattttct

SEQ ID NO: 5128005 - DNA, 19 bp, Homo sapiens
acaaacctagcttttaaaa

SEQ ID NO: 5128006 - DNA, 18 bp, Homo sapiens
acaaacctctatatgttg

SEQ ID NO: 5128007 - DNA, 22 bp, Homo sapiens
acaaacctctatatgttgctga

SEQ ID NO: 5128008 - DNA, 23 bp, Homo sapiens
acaaacctgaaaagatgttgtgt

SEQ ID NO: 5128009 - DNA, 17 bp, Homo sapiens
acaaacctgcatggtgt

SEQ ID NO: 5128010 - DNA, 12 bp, Homo sapiens
acaaacctgcct

SEQ ID NO: 5128011 - DNA, 14 bp, Homo sapiens
acaaacctgcttgt

SEQ ID NO: 5128012 - DNA, 21 bp, Homo sapiens
acaaacctgtttctgcagcca

SEQ ID NO: 5128013 - DNA, 24 bp, Homo sapiens
acaaaccttcttttcaatgcaatg

SEQ ID NO: 5128014 - DNA, 21 bp, Homo sapiens
acaaacggagcccctgaaagc

SEQ ID NO: 5128015 - DNA, 15 bp, Homo sapiens
acaaacgtccccagc

SEQ ID NO: 5128016 - DNA, 13 bp, Homo sapiens
acaaacgtttgac

SEQ ID NO: 5128017 - DNA, 16 bp, Homo sapiens
acaaacgtttgacaaa

SEQ ID NO: 5128018 - DNA, 15 bp, Homo sapiens
acaaactaaaaatat

SEQ ID NO: 5128019 - DNA, 13 bp, Homo sapiens
acaaactaaactt

SEQ ID NO: 5128020 - DNA, 16 bp, Homo sapiens
acaaactacatgtaat

SEQ ID NO: 5128021 - DNA, 17 bp, Homo sapiens
acaaactacctctggac

SEQ ID NO: 5128022 - DNA, 23 bp, Homo sapiens
acaaactacttgattttattgta

SEQ ID NO: 5128023 - DNA, 23 bp, Homo sapiens
acaaactatttcagaatattttg

SEQ ID NO: 5128024 - DNA, 15 bp, Homo sapiens
acaaactcaaaatct

SEQ ID NO: 5128025 - DNA, 19 bp, Homo sapiens
acaaactcaaaatctggga

SEQ ID NO: 5128026 - DNA, 12 bp, Homo sapiens
acaaactccagg

SEQ ID NO: 5128027 - DNA, 16 bp, Homo sapiens
acaaactctcaccatg

SEQ ID NO: 5128028 - DNA, 15 bp, Homo sapiens
acaaactctctgaac

SEQ ID NO: 5128029 - DNA, 22 bp, Homo sapiens
acaaactctctgaacccctccc

SEQ ID NO: 5128030 - DNA, 13 bp, Homo sapiens
acaaactcttgaa

SEQ ID NO: 5128031 - DNA, 22 bp, Homo sapiens
acaaactcttttttaaaaatta

SEQ ID NO: 5128032 - DNA, 16 bp, Homo sapiens
acaaactgatttctca

SEQ ID NO: 5128033 - DNA, 19 bp, Homo sapiens
acaaactgcaatagagact

SEQ ID NO: 5128034 - DNA, 14 bp, Homo sapiens
acaaactgcacatg

SEQ ID NO: 5128035 - DNA, 20 bp, Homo sapiens
acaaactgcacatgatttca

SEQ ID NO: 5128036 - DNA, 22 bp, Homo sapiens
acaaactgcaccagttgctgct

SEQ ID NO: 5128037 - DNA, 21 bp, Homo sapiens
acaaactgcttcctttcttga

SEQ ID NO: 5128038 - DNA, 16 bp, Homo sapiens
acaaactgtaatacaa

SEQ ID NO: 5128039 - DNA, 14 bp, Homo sapiens
acaaactgtcgtct

SEQ ID NO: 5128040 - DNA, 19 bp, Homo sapiens
acaaactgtgaaaatagtg

SEQ ID NO: 5128041 - DNA, 20 bp, Homo sapiens
acaaactgtgaaaatagtgt

SEQ ID NO: 5128042 - DNA, 21 bp, Homo sapiens
acaaactgtgaaaatagtgta

SEQ ID NO: 5128043 - DNA, 12 bp, Homo sapiens
acaaacttccaa

SEQ ID NO: 5128044 - DNA, 13 bp, Homo sapiens
acaaactttgttt

SEQ ID NO: 5128045 - DNA, 14 bp, Homo sapiens
acaaacttttaaga

SEQ ID NO: 5128046 - DNA, 12 bp, Homo sapiens
acaaacttttat

SEQ ID NO: 5128047 - DNA, 13 bp, Homo sapiens
acaaacttttata

SEQ ID NO: 5128048 - DNA, 14 bp, Homo sapiens
acaaacttttataa

SEQ ID NO: 5128049 - DNA, 18 bp, Homo sapiens
acaaacttttcaaggctt

SEQ ID NO: 5128050 - DNA, 15 bp, Homo sapiens
acaaagaaaaaaaat

SEQ ID NO: 5128051 - DNA, 17 bp, Homo sapiens
acaaagaaaaaaatata

SEQ ID NO: 5128052 - DNA, 15 bp, Homo sapiens
acaaagaaaaattaa

SEQ ID NO: 5128053 - DNA, 14 bp, Homo sapiens
acaaagaaaatgtt

SEQ ID NO: 5128054 - DNA, 12 bp, Homo sapiens
acaaagaaacaa

SEQ ID NO: 5128055 - DNA, 20 bp, Homo sapiens
acaaagaaacaaagatgtta

SEQ ID NO: 5128056 - DNA, 19 bp, Homo sapiens
acaaagaaacattttacgc

SEQ ID NO: 5128057 - DNA, 23 bp, Homo sapiens
acaaagaaaggtgccatgtcttt

SEQ ID NO: 5128058 - DNA, 23 bp, Homo sapiens
acaaagaaccatgcaggaaggaa

SEQ ID NO: 5128059 - DNA, 14 bp, Homo sapiens
acaaagaagaaagc

SEQ ID NO: 5128060 - DNA, 13 bp, Homo sapiens
acaaagaagacat

SEQ ID NO: 5128061 - DNA, 21 bp, Homo sapiens
acaaagaagacatgttttaga

SEQ ID NO: 5128062 - DNA, 22 bp, Homo sapiens
acaaagaagacatgttttagac

SEQ ID NO: 5128063 - DNA, 18 bp, Homo sapiens
acaaagaaggaaaagagt

SEQ ID NO: 5128064 - DNA, 14 bp, Homo sapiens
acaaagaaggaaat

SEQ ID NO: 5128065 - DNA, 16 bp, Homo sapiens
acaaagaaggcacagg

SEQ ID NO: 5128066 - DNA, 14 bp, Homo sapiens
acaaagaattccaa

SEQ ID NO: 5128067 - DNA, 19 bp, Homo sapiens
acaaagacaaattctgttt

SEQ ID NO: 5128068 - DNA, 22 bp, Homo sapiens
acaaagacaaattctgtttctt

SEQ ID NO: 5128069 - DNA, 18 bp, Homo sapiens
acaaagacacaggaagaa

SEQ ID NO: 5128070 - DNA, 14 bp, Homo sapiens
acaaagacaggcaa

SEQ ID NO: 5128071 - DNA, 16 bp, Homo sapiens
acaaagacatggaaga

SEQ ID NO: 5128072 - DNA, 15 bp, Homo sapiens
acaaagacattgaca

SEQ ID NO: 5128073 - DNA, 17 bp, Homo sapiens
acaaagacattgacagc

SEQ ID NO: 5128074 - DNA, 19 bp, Homo sapiens
acaaagacattgacagcaa

SEQ ID NO: 5128075 - DNA, 20 bp, Homo sapiens
acaaagacattgacagcaat

SEQ ID NO: 5128076 - DNA, 21 bp, Homo sapiens
acaaagacattgacagcaatt

SEQ ID NO: 5128077 - DNA, 17 bp, Homo sapiens
acaaagaccaaaatgaa

SEQ ID NO: 5128078 - DNA, 20 bp, Homo sapiens
acaaagaccaaaatgaaagt

SEQ ID NO: 5128079 - DNA, 15 bp, Homo sapiens
acaaagaccctggct

SEQ ID NO: 5128080 - DNA, 17 bp, Homo sapiens
acaaagactcctctggg

SEQ ID NO: 5128081 - DNA, 21 bp, Homo sapiens
acaaagactcctctgggcctg

SEQ ID NO: 5128082 - DNA, 17 bp, Homo sapiens
acaaagactccttgtgg

SEQ ID NO: 5128083 - DNA, 14 bp, Homo sapiens
acaaagagaaaaag

SEQ ID NO: 5128084 - DNA, 18 bp, Homo sapiens
acaaagagaccaggggcg

SEQ ID NO: 5128085 - DNA, 15 bp, Homo sapiens
acaaagagatgtcct

SEQ ID NO: 5128086 - DNA, 20 bp, Homo sapiens
acaaagagcgttgaagttga

SEQ ID NO: 5128087 - DNA, 11 bp, Homo sapiens
acaaagagctg

SEQ ID NO: 5128088 - DNA, 19 bp, Homo sapiens
acaaagagtgaaatattgt

SEQ ID NO: 5128089 - DNA, 18 bp, Homo sapiens
acaaagagttcaagaaat

SEQ ID NO: 5128090 - DNA, 22 bp, Homo sapiens
acaaagagttcaagaaataagt

SEQ ID NO: 5128091 - DNA, 23 bp, Homo sapiens
acaaagataacgcaggagagaga

SEQ ID NO: 5128092 - DNA, 22 bp, Homo sapiens
acaaagataagacttgtttctt

SEQ ID NO: 5128093 - DNA, 21 bp, Homo sapiens
acaaagatacttgatgcactt

SEQ ID NO: 5128094 - DNA, 20 bp, Homo sapiens
acaaagatatcttttcttta

SEQ ID NO: 5128095 - DNA, 16 bp, Homo sapiens
acaaagatattattta

SEQ ID NO: 5128096 - DNA, 20 bp, Homo sapiens
acaaagatggctcagagggg

SEQ ID NO: 5128097 - DNA, 12 bp, Homo sapiens
acaaagatttct

SEQ ID NO: 5128098 - DNA, 16 bp, Homo sapiens
acaaagattttctaag

SEQ ID NO: 5128099 - DNA, 21 bp, Homo sapiens
acaaagattttctaaggaatg

SEQ ID NO: 5128100 - DNA, 13 bp, Homo sapiens
acaaagcaaaggc

SEQ ID NO: 5128101 - DNA, 15 bp, Homo sapiens
acaaagcaaaggcag

SEQ ID NO: 5128102 - DNA, 15 bp, Homo sapiens
acaaagcaattcttt

SEQ ID NO: 5128103 - DNA, 16 bp, Homo sapiens
acaaagcacaccatat

SEQ ID NO: 5128104 - DNA, 17 bp, Homo sapiens
acaaagcagctttaaaa

SEQ ID NO: 5128105 - DNA, 22 bp, Homo sapiens
acaaagcagctttaaaaaaata

SEQ ID NO: 5128106 - DNA, 23 bp, Homo sapiens
acaaagcagtatataataacttt

SEQ ID NO: 5128107 - DNA, 17 bp, Homo sapiens
acaaagcagtttttccc

SEQ ID NO: 5128108 - DNA, 19 bp, Homo sapiens
acaaagcagtttttccccc

SEQ ID NO: 5128109 - DNA, 20 bp, Homo sapiens
acaaagcatgggaaaaagag

SEQ ID NO: 5128110 - DNA, 19 bp, Homo sapiens
acaaagccaaactctgcca

SEQ ID NO: 5128111 - DNA, 16 bp, Homo sapiens
acaaagccagaagctg

SEQ ID NO: 5128112 - DNA, 20 bp, Homo sapiens
acaaagccagaagctgagca

SEQ ID NO: 5128113 - DNA, 15 bp, Homo sapiens
acaaagccagaggag

SEQ ID NO: 5128114 - DNA, 18 bp, Homo sapiens
acaaagccagctctgagc

SEQ ID NO: 5128115 - DNA, 15 bp, Homo sapiens
acaaagccattcttt

SEQ ID NO: 5128116 - DNA, 11 bp, Homo sapiens
acaaagcccaa

SEQ ID NO: 5128117 - DNA, 16 bp, Homo sapiens
acaaagccccccagct

SEQ ID NO: 5128118 - DNA, 19 bp, Homo sapiens
acaaagccccccagctccc

SEQ ID NO: 5128119 - DNA, 15 bp, Homo sapiens
acaaagcccttttat

SEQ ID NO: 5128120 - DNA, 17 bp, Homo sapiens
acaaagccttaagcaaa

SEQ ID NO: 5128121 - DNA, 18 bp, Homo sapiens
acaaagccttaagcaaat

SEQ ID NO: 5128122 - DNA, 19 bp, Homo sapiens
acaaagccttaagcaaatt

SEQ ID NO: 5128123 - DNA, 21 bp, Homo sapiens
acaaagcgtggtggacatgca

SEQ ID NO: 5128124 - DNA, 18 bp, Homo sapiens
acaaagcgtttctttact

SEQ ID NO: 5128125 - DNA, 17 bp, Homo sapiens
acaaagctatttaagtg

SEQ ID NO: 5128126 - DNA, 19 bp, Homo sapiens
acaaagctatttaagtgga

SEQ ID NO: 5128127 - DNA, 13 bp, Homo sapiens
acaaagctcaaga

SEQ ID NO: 5128128 - DNA, 19 bp, Homo sapiens
acaaagctgatttcccttt

SEQ ID NO: 5128129 - DNA, 14 bp, Homo sapiens
acaaagctgtcact

SEQ ID NO: 5128130 - DNA, 14 bp, Homo sapiens
acaaagctgttaaa

SEQ ID NO: 5128131 - DNA, 19 bp, Homo sapiens
acaaagcttagcaggagag

SEQ ID NO: 5128132 - DNA, 20 bp, Homo sapiens
acaaagcttctatcccagga

SEQ ID NO: 5128133 - DNA, 23 bp, Homo sapiens
acaaagcttggaagagcctgcag

SEQ ID NO: 5128134 - DNA, 15 bp, Homo sapiens
acaaagctttctttt

SEQ ID NO: 5128135 - DNA, 19 bp, Homo sapiens
acaaagctttcttttctaa

SEQ ID NO: 5128136 - DNA, 14 bp, Homo sapiens
acaaagctttgcta

SEQ ID NO: 5128137 - DNA, 15 bp, Homo sapiens
acaaagctttgctac

SEQ ID NO: 5128138 - DNA, 16 bp, Homo sapiens
acaaagctttgctaca

SEQ ID NO: 5128139 - DNA, 15 bp, Homo sapiens
acaaagcttttgcat

SEQ ID NO: 5128140 - DNA, 22 bp, Homo sapiens
acaaagcttttgcatattgcat

SEQ ID NO: 5128141 - DNA, 23 bp, Homo sapiens
acaaagcttttgcatattgcata

SEQ ID NO: 5128142 - DNA, 11 bp, Homo sapiens
acaaaggaaaa

SEQ ID NO: 5128143 - DNA, 16 bp, Homo sapiens
acaaaggagcctgtga

SEQ ID NO: 5128144 - DNA, 14 bp, Homo sapiens
acaaaggagccttg

SEQ ID NO: 5128145 - DNA, 12 bp, Homo sapiens
acaaaggcagct

SEQ ID NO: 5128146 - DNA, 16 bp, Homo sapiens
acaaaggcagctgtgt

SEQ ID NO: 5128147 - DNA, 23 bp, Homo sapiens
acaaaggcagctgtgtctgagcc

SEQ ID NO: 5128148 - DNA, 20 bp, Homo sapiens
acaaaggcatgttttaaaat

SEQ ID NO: 5128149 - DNA, 15 bp, Homo sapiens
acaaaggccaaactg

SEQ ID NO: 5128150 - DNA, 15 bp, Homo sapiens
acaaaggccttaaca

SEQ ID NO: 5128151 - DNA, 22 bp, Homo sapiens
acaaaggctgacattcactgag

SEQ ID NO: 5128152 - DNA, 16 bp, Homo sapiens
acaaaggctgtattca

SEQ ID NO: 5128153 - DNA, 12 bp, Homo sapiens
acaaagggaaaa

SEQ ID NO: 5128154 - DNA, 15 bp, Homo sapiens
acaaagggaaaaaag

SEQ ID NO: 5128155 - DNA, 16 bp, Homo sapiens
acaaagggaaaaaaga

SEQ ID NO: 5128156 - DNA, 18 bp, Homo sapiens
acaaagggaaagcctctg

SEQ ID NO: 5128157 - DNA, 21 bp, Homo sapiens
acaaaggggatcataaagtta

SEQ ID NO: 5128158 - DNA, 15 bp, Homo sapiens
acaaagggttttaat

SEQ ID NO: 5128159 - DNA, 20 bp, Homo sapiens
acacaactccactgtcttta

SEQ ID NO: 5128160 - DNA, 15 bp, Homo sapiens
acacaactttgcaaa

SEQ ID NO: 5128161 - DNA, 18 bp, Homo sapiens
acacaagaaaaagataag

SEQ ID NO: 5128162 - DNA, 22 bp, Homo sapiens
acacaagaagaagggcacccta

SEQ ID NO: 5128163 - DNA, 17 bp, Homo sapiens
acacaagaattacacta

SEQ ID NO: 5128164 - DNA, 19 bp, Homo sapiens
acacaagaccagtgcttag

SEQ ID NO: 5128165 - DNA, 20 bp, Homo sapiens
acacaagagggactgtattt

SEQ ID NO: 5128166 - DNA, 17 bp, Homo sapiens
acacaagattggtgttt

SEQ ID NO: 5128167 - DNA, 21 bp, Homo sapiens
acacaagattggtgttttttt

SEQ ID NO: 5128168 - DNA, 17 bp, Homo sapiens
acacaagcactttaatg

SEQ ID NO: 5128169 - DNA, 19 bp, Homo sapiens
acacaagccacagaagcca

SEQ ID NO: 5128170 - DNA, 15 bp, Homo sapiens
acacaagccacgcct

SEQ ID NO: 5128171 - DNA, 14 bp, Homo sapiens
acacaagctggaag

SEQ ID NO: 5128172 - DNA, 22 bp, Homo sapiens
acacaagcttttttacacaaat

SEQ ID NO: 5128173 - DNA, 19 bp, Homo sapiens
acacaaggccagaaaaaga

SEQ ID NO: 5128174 - DNA, 15 bp, Homo sapiens
acacaaggtgatttc

SEQ ID NO: 5128175 - DNA, 18 bp, Homo sapiens
acacaaggtgatttcaga

SEQ ID NO: 5128176 - DNA, 13 bp, Homo sapiens
acacaaggtgctc

SEQ ID NO: 5128177 - DNA, 14 bp, Homo sapiens
acacaagtaaacat

SEQ ID NO: 5128178 - DNA, 19 bp, Homo sapiens
acacaagtaagagactcag

SEQ ID NO: 5128179 - DNA, 16 bp, Homo sapiens
acacaagtagattgat

SEQ ID NO: 5128180 - DNA, 22 bp, Homo sapiens
acacaagtgcagtagtgcagtt

SEQ ID NO: 5128181 - DNA, 16 bp, Homo sapiens
acacaagttgtttggt

SEQ ID NO: 5128182 - DNA, 19 bp, Homo sapiens
acacaagtttaaaaatatt

SEQ ID NO: 5128183 - DNA, 20 bp, Homo sapiens
acacaagtttaaaaatatta

SEQ ID NO: 5128184 - DNA, 14 bp, Homo sapiens
acacaataaagcag

SEQ ID NO: 5128185 - DNA, 21 bp, Homo sapiens
acacaataagagtctccttct

SEQ ID NO: 5128186 - DNA, 22 bp, Homo sapiens
acacaataagagtctccttctc

SEQ ID NO: 5128187 - DNA, 18 bp, Homo sapiens
acacaataggtctttctc

SEQ ID NO: 5128188 - DNA, 14 bp, Homo sapiens
acacaatcagacca

SEQ ID NO: 5128189 - DNA, 16 bp, Homo sapiens
acacaatctttccttg

SEQ ID NO: 5128190 - DNA, 22 bp, Homo sapiens
acacaatgacacatttgttgca

SEQ ID NO: 5128191 - DNA, 23 bp, Homo sapiens
acacaatgacacatttgttgcac

SEQ ID NO: 5128192 - DNA, 22 bp, Homo sapiens
acacaatgctattgaaattact

SEQ ID NO: 5128193 - DNA, 21 bp, Homo sapiens
acacaatggcacctctgccct

SEQ ID NO: 5128194 - DNA, 22 bp, Homo sapiens
acacaatggcacctctgccctt

SEQ ID NO: 5128195 - DNA, 17 bp, Homo sapiens
acacaatgtgtctttct

SEQ ID NO: 5128196 - DNA, 21 bp, Homo sapiens
acacaatgttgcactgaaaac

SEQ ID NO: 5128197 - DNA, 20 bp, Homo sapiens
acacaattcattggctcctg

SEQ ID NO: 5128198 - DNA, 21 bp, Homo sapiens
acacaattggaattgtcttta

SEQ ID NO: 5128199 - DNA, 14 bp, Homo sapiens
acacaattgtttta

SEQ ID NO: 5128200 - DNA, 23 bp, Homo sapiens
acacaattttattttttttctgt

SEQ ID NO: 5128201 - DNA, 12 bp, Homo sapiens
acacacaaaaac

SEQ ID NO: 5128202 - DNA, 19 bp, Homo sapiens
acacacaaaaaggagcggg

SEQ ID NO: 5128203 - DNA, 21 bp, Homo sapiens
acacacaaaacaacagcaaca

SEQ ID NO: 5128204 - DNA, 15 bp, Homo sapiens
acacacaaatgcaga

SEQ ID NO: 5128205 - DNA, 21 bp, Homo sapiens
acacacaaatgcagacacaca

SEQ ID NO: 5128206 - DNA, 13 bp, Homo sapiens
acacacaacaaaa

SEQ ID NO: 5128207 - DNA, 14 bp, Homo sapiens
acacacaacagcca

SEQ ID NO: 5128208 - DNA, 15 bp, Homo sapiens
acacacaacagccaa

SEQ ID NO: 5128209 - DNA, 14 bp, Homo sapiens
acacacacaaagag

SEQ ID NO: 5128210 - DNA, 16 bp, Homo sapiens
acacacacaaagagag

SEQ ID NO: 5128211 - DNA, 10 bp, Homo sapiens
acacacacac

SEQ ID NO: 5128212 - DNA, 14 bp, Homo sapiens
acacacacacaaat

SEQ ID NO: 5128213 - DNA, 15 bp, Homo sapiens
acacacacacaaatg

SEQ ID NO: 5128214 - DNA, 14 bp, Homo sapiens
acacacacacacac

SEQ ID NO: 5128215 - DNA, 15 bp, Homo sapiens
acacacacacacaca

SEQ ID NO: 5128216 - DNA, 16 bp, Homo sapiens
acacacacacacacag

SEQ ID NO: 5128217 - DNA, 16 bp, Homo sapiens
acacacacacacatat

SEQ ID NO: 5128218 - DNA, 13 bp, Homo sapiens
acacacacacacg

SEQ ID NO: 5128219 - DNA, 13 bp, Homo sapiens
acacacacacagc

SEQ ID NO: 5128220 - DNA, 14 bp, Homo sapiens
acacacacacagcc

SEQ ID NO: 5128221 - DNA, 14 bp, Homo sapiens
acacacacacagga

SEQ ID NO: 5128222 - DNA, 14 bp, Homo sapiens
acacacacacatat

SEQ ID NO: 5128223 - DNA, 15 bp, Homo sapiens
acacacacacatata

SEQ ID NO: 5128224 - DNA, 13 bp, Homo sapiens
acacacacacatg

SEQ ID NO: 5128225 - DNA, 17 bp, Homo sapiens
acacacacacatgcata

SEQ ID NO: 5128226 - DNA, 14 bp, Homo sapiens
acacacacagatgt

SEQ ID NO: 5128227 - DNA, 11 bp, Homo sapiens
acacacacagc

SEQ ID NO: 5128228 - DNA, 14 bp, Homo sapiens
acacacacagccac

SEQ ID NO: 5128229 - DNA, 15 bp, Homo sapiens
acacacacagccaca

SEQ ID NO: 5128230 - DNA, 12 bp, Homo sapiens
acacacacagct

SEQ ID NO: 5128231 - DNA, 12 bp, Homo sapiens
acacacacaggt

SEQ ID NO: 5128232 - DNA, 12 bp, Homo sapiens
acacacacatac

SEQ ID NO: 5128233 - DNA, 14 bp, Homo sapiens
acacacacatacag

SEQ ID NO: 5128234 - DNA, 15 bp, Homo sapiens
acacacacatatata

SEQ ID NO: 5128235 - DNA, 11 bp, Homo sapiens
acacacacatc

SEQ ID NO: 5128236 - DNA, 16 bp, Homo sapiens
acacacacccaggccc

SEQ ID NO: 5128237 - DNA, 15 bp, Homo sapiens
acacacaccccccca

SEQ ID NO: 5128238 - DNA, 15 bp, Homo sapiens
acacacacccttccc

SEQ ID NO: 5128239 - DNA, 17 bp, Homo sapiens
acacacacctgtctgtg

SEQ ID NO: 5128240 - DNA, 16 bp, Homo sapiens
acacacacgatgcatt

SEQ ID NO: 5128241 - DNA, 22 bp, Homo sapiens
acacacacgatgcatttaataa

SEQ ID NO: 5128242 - DNA, 19 bp, Homo sapiens
acacacacgcacgcacaca

SEQ ID NO: 5128243 - DNA, 21 bp, Homo sapiens
acacacacgcacgcacacaca

SEQ ID NO: 5128244 - DNA, 15 bp, Homo sapiens
acacacacgcagaca

SEQ ID NO: 5128245 - DNA, 20 bp, Homo sapiens
acacacacgcagacacacac

SEQ ID NO: 5128246 - DNA, 16 bp, Homo sapiens
acacacacgctccctg

SEQ ID NO: 5128247 - DNA, 23 bp, Homo sapiens
acacacactcgggttaagaaata

SEQ ID NO: 5128248 - DNA, 15 bp, Homo sapiens
acacacagaaaatat

SEQ ID NO: 5128249 - DNA, 18 bp, Homo sapiens
acacacagaaaatatact

SEQ ID NO: 5128250 - DNA, 19 bp, Homo sapiens
acacacagaaaatatactg

SEQ ID NO: 5128251 - DNA, 13 bp, Homo sapiens
acacacagacaca

SEQ ID NO: 5128252 - DNA, 16 bp, Homo sapiens
acacacagacatatat

SEQ ID NO: 5128253 - DNA, 17 bp, Homo sapiens
acacacagactcatatt

SEQ ID NO: 5128254 - DNA, 16 bp, Homo sapiens
acacacagagatatgc

SEQ ID NO: 5128255 - DNA, 12 bp, Homo sapiens
acacacagcagc

SEQ ID NO: 5128256 - DNA, 10 bp, Homo sapiens
acacacagcc

SEQ ID NO: 5128257 - DNA, 11 bp, Homo sapiens
acacacagcca

SEQ ID NO: 5128258 - DNA, 15 bp, Homo sapiens
acacacagccacaca

SEQ ID NO: 5128259 - DNA, 12 bp, Homo sapiens
acacacagccat

SEQ ID NO: 5128260 - DNA, 19 bp, Homo sapiens
acacacagccattcatctg

SEQ ID NO: 5128261 - DNA, 14 bp, Homo sapiens
acacacagccccta

SEQ ID NO: 5128262 - DNA, 19 bp, Homo sapiens
acacacagcctttctgtat

SEQ ID NO: 5128263 - DNA, 20 bp, Homo sapiens
acacacaggaactctgtgtg

SEQ ID NO: 5128264 - DNA, 24 bp, Homo sapiens
acacacaggagtcctttcttttga

SEQ ID NO: 5128265 - DNA, 16 bp, Homo sapiens
acacacaggccttctg

SEQ ID NO: 5128266 - DNA, 19 bp, Homo sapiens
acacacaggccttctgtgg

SEQ ID NO: 5128267 - DNA, 24 bp, Homo sapiens
acacacaggtggggactgggcaca

SEQ ID NO: 5128268 - DNA, 20 bp, Homo sapiens
acacacagtgaccaagggaa

SEQ ID NO: 5128269 - DNA, 14 bp, Homo sapiens
acacacagttactg

SEQ ID NO: 5128270 - DNA, 12 bp, Homo sapiens
acacacataaag

SEQ ID NO: 5128271 - DNA, 12 bp, Homo sapiens
acacacatagat

SEQ ID NO: 5128272 - DNA, 16 bp, Homo sapiens
acacacatatacacga

SEQ ID NO: 5128273 - DNA, 14 bp, Homo sapiens
acacacatatacat

SEQ ID NO: 5128274 - DNA, 18 bp, Homo sapiens
acacacatatacatatat

SEQ ID NO: 5128275 - DNA, 18 bp, Homo sapiens
acacacatatatgtatac

SEQ ID NO: 5128276 - DNA, 15 bp, Homo sapiens
acacacatcccagga

SEQ ID NO: 5128277 - DNA, 16 bp, Homo sapiens
acacacatctggccct

SEQ ID NO: 5128278 - DNA, 14 bp, Homo sapiens
acacacatgcacac

SEQ ID NO: 5128279 - DNA, 13 bp, Homo sapiens
acacacatgccct

SEQ ID NO: 5128280 - DNA, 17 bp, Homo sapiens
acacacatgccctcctg

SEQ ID NO: 5128281 - DNA, 19 bp, Homo sapiens
acacacatgggcagcccaa

SEQ ID NO: 5128282 - DNA, 17 bp, Homo sapiens
acacacattgctattcc

SEQ ID NO: 5128283 - DNA, 15 bp, Homo sapiens
acacaccagagccca

SEQ ID NO: 5128284 - DNA, 17 bp, Homo sapiens
acacaccaggcgctaat

SEQ ID NO: 5128285 - DNA, 12 bp, Homo sapiens
acacaccaggct

SEQ ID NO: 5128286 - DNA, 17 bp, Homo sapiens
acacaccagtttacagg

SEQ ID NO: 5128287 - DNA, 17 bp, Homo sapiens
acacacccaaggggccc

SEQ ID NO: 5128288 - DNA, 16 bp, Homo sapiens
acacaccccaacatgc

SEQ ID NO: 5128289 - DNA, 20 bp, Homo sapiens
acacaccccacaccccagcc

SEQ ID NO: 5128290 - DNA, 21 bp, Homo sapiens
acacaccccacaccccagccc

SEQ ID NO: 5128291 - DNA, 14 bp, Homo sapiens
acacacccccagag

SEQ ID NO: 5128292 - DNA, 12 bp, Homo sapiens
acacacccccca

SEQ ID NO: 5128293 - DNA, 14 bp, Homo sapiens
acacacccccccac

SEQ ID NO: 5128294 - DNA, 13 bp, Homo sapiens
acacacccctcaa

SEQ ID NO: 5128295 - DNA, 11 bp, Homo sapiens
acacaccctcc

SEQ ID NO: 5128296 - DNA, 18 bp, Homo sapiens
acacaccctccagcacag

SEQ ID NO: 5128297 - DNA, 21 bp, Homo sapiens
acacaccctccagcacagact

SEQ ID NO: 5128298 - DNA, 14 bp, Homo sapiens
acacaccctgaggt

SEQ ID NO: 5128299 - DNA, 12 bp, Homo sapiens
acacaccctgcc

SEQ ID NO: 5128300 - DNA, 17 bp, Homo sapiens
acacaccctgcccctgc

SEQ ID NO: 5128301 - DNA, 13 bp, Homo sapiens
acacacccttccc

SEQ ID NO: 5128302 - DNA, 20 bp, Homo sapiens
acacacccttccccactccc

SEQ ID NO: 5128303 - DNA, 16 bp, Homo sapiens
acacaccgatgtacac

SEQ ID NO: 5128304 - DNA, 16 bp, Homo sapiens
acacaccggtcaccga

SEQ ID NO: 5128305 - DNA, 15 bp, Homo sapiens
acacacctcaccaga

SEQ ID NO: 5128306 - DNA, 13 bp, Homo sapiens
acacacctctgcc

SEQ ID NO: 5128307 - DNA, 13 bp, Homo sapiens
acacacctctgga

SEQ ID NO: 5128308 - DNA, 16 bp, Homo sapiens
acacacctgagaatgt

SEQ ID NO: 5128309 - DNA, 16 bp, Homo sapiens
acacacctgctccaat

SEQ ID NO: 5128310 - DNA, 20 bp, Homo sapiens
acacacctgtagcacttact

SEQ ID NO: 5128311 - DNA, 17 bp, Homo sapiens
acacacctgtctgtgca

SEQ ID NO: 5128312 - DNA, 14 bp, Homo sapiens
acacacgagcaaac

SEQ ID NO: 5128313 - DNA, 20 bp, Homo sapiens
acacacgatgcatttaataa

SEQ ID NO: 5128314 - DNA, 22 bp, Homo sapiens
acacacgatgcatttaataaag

SEQ ID NO: 5128315 - DNA, 18 bp, Homo sapiens
acacacgcacgcacacac

SEQ ID NO: 5128316 - DNA, 15 bp, Homo sapiens
acacacgcagacaca

SEQ ID NO: 5128317 - DNA, 16 bp, Homo sapiens
acacacgcagacacac

SEQ ID NO: 5128318 - DNA, 19 bp, Homo sapiens
acacacgcagacacacaca

SEQ ID NO: 5128319 - DNA, 16 bp, Homo sapiens
acacacgcaggaactc

SEQ ID NO: 5128320 - DNA, 20 bp, Homo sapiens
acacacgcaggaactcccag

SEQ ID NO: 5128321 - DNA, 16 bp, Homo sapiens
acacacgcgcgcacac

SEQ ID NO: 5128322 - DNA, 16 bp, Homo sapiens
acacacgcgtccacat

SEQ ID NO: 5128323 - DNA, 20 bp, Homo sapiens
acacacgcgtccacatacac

SEQ ID NO: 5128324 - DNA, 22 bp, Homo sapiens
acacacgcgtccacatacactg

SEQ ID NO: 5128325 - DNA, 15 bp, Homo sapiens
acacacggaggccag

SEQ ID NO: 5128326 - DNA, 19 bp, Homo sapiens
acacacggaggccagacac

SEQ ID NO: 5128327 - DNA, 17 bp, Homo sapiens
acacacggctgtccctc

SEQ ID NO: 5128328 - DNA, 18 bp, Homo sapiens
acacacggggcacccagc

SEQ ID NO: 5128329 - DNA, 20 bp, Homo sapiens
acacacggggcacccagccc

SEQ ID NO: 5128330 - DNA, 13 bp, Homo sapiens
acacacggggctc

SEQ ID NO: 5128331 - DNA, 17 bp, Homo sapiens
acacacgtatttatatt

SEQ ID NO: 5128332 - DNA, 23 bp, Homo sapiens
acacacgtatttatatttggaaa

SEQ ID NO: 5128333 - DNA, 22 bp, Homo sapiens
acacacgttgacgggccgcagg

SEQ ID NO: 5128334 - DNA, 14 bp, Homo sapiens
acacactaacatca

SEQ ID NO: 5128335 - DNA, 13 bp, Homo sapiens
acacactaatcga

SEQ ID NO: 5128336 - DNA, 17 bp, Homo sapiens
acacactacaccacaca

SEQ ID NO: 5128337 - DNA, 22 bp, Homo sapiens
acacactaccgaatgtgtcttt

SEQ ID NO: 5128338 - DNA, 15 bp, Homo sapiens
acacactcaaatcaa

SEQ ID NO: 5128339 - DNA, 22 bp, Homo sapiens
acacactcaccagtggcctttc

SEQ ID NO: 5128340 - DNA, 12 bp, Homo sapiens
acacactcagcc

SEQ ID NO: 5128341 - DNA, 18 bp, Homo sapiens
acaaagggttttaatgta

SEQ ID NO: 5128342 - DNA, 19 bp, Homo sapiens
acaaaggtgattttcctgt

SEQ ID NO: 5128343 - DNA, 21 bp, Homo sapiens
acaaaggtggaataaacatta

SEQ ID NO: 5128344 - DNA, 18 bp, Homo sapiens
acaaaggtggtaaattca

SEQ ID NO: 5128345 - DNA, 14 bp, Homo sapiens
acaaaggtttaaat

SEQ ID NO: 5128346 - DNA, 17 bp, Homo sapiens
acaaaggtttaaatgaa

SEQ ID NO: 5128347 - DNA, 19 bp, Homo sapiens
acaaaggtttaaatgaaca

SEQ ID NO: 5128348 - DNA, 22 bp, Homo sapiens
acaaaggtttaaatgaacaaga

SEQ ID NO: 5128349 - DNA, 15 bp, Homo sapiens
acaaaggttttgtct

SEQ ID NO: 5128350 - DNA, 14 bp, Homo sapiens
acaaagtaatttct

SEQ ID NO: 5128351 - DNA, 17 bp, Homo sapiens
acaaagtactagctaaa

SEQ ID NO: 5128352 - DNA, 21 bp, Homo sapiens
acaaagtactcctcacttttc

SEQ ID NO: 5128353 - DNA, 16 bp, Homo sapiens
acaaagtactctttaa

SEQ ID NO: 5128354 - DNA, 21 bp, Homo sapiens
acaaagtatatttaaggatta

SEQ ID NO: 5128355 - DNA, 16 bp, Homo sapiens
acaaagtcatgaagct

SEQ ID NO: 5128356 - DNA, 14 bp, Homo sapiens
acaaagtctctggg

SEQ ID NO: 5128357 - DNA, 14 bp, Homo sapiens
acaaagtgaaatta

SEQ ID NO: 5128358 - DNA, 22 bp, Homo sapiens
acaaagtgaactctattttgat

SEQ ID NO: 5128359 - DNA, 21 bp, Homo sapiens
acaaagtgcaaagctgcttga

SEQ ID NO: 5128360 - DNA, 16 bp, Homo sapiens
acaaagtgccaaagaa

SEQ ID NO: 5128361 - DNA, 18 bp, Homo sapiens
acaaagtgccaaagaaag

SEQ ID NO: 5128362 - DNA, 12 bp, Homo sapiens
acaaagtgcttt

SEQ ID NO: 5128363 - DNA, 14 bp, Homo sapiens
acaaagtggaagga

SEQ ID NO: 5128364 - DNA, 16 bp, Homo sapiens
acaaagtggaaggaaa

SEQ ID NO: 5128365 - DNA, 17 bp, Homo sapiens
acaaagtgggtactttc

SEQ ID NO: 5128366 - DNA, 21 bp, Homo sapiens
acaaagtgggtactttctgaa

SEQ ID NO: 5128367 - DNA, 19 bp, Homo sapiens
acaaagtgggtgtgtggcc

SEQ ID NO: 5128368 - DNA, 15 bp, Homo sapiens
acaaagtgtgtatta

SEQ ID NO: 5128369 - DNA, 16 bp, Homo sapiens
acaaagtgtgtattaa

SEQ ID NO: 5128370 - DNA, 20 bp, Homo sapiens
acaaagtgtgtctcaaaaat

SEQ ID NO: 5128371 - DNA, 19 bp, Homo sapiens
acaaagtgttgaaaatgta

SEQ ID NO: 5128372 - DNA, 18 bp, Homo sapiens
acaaagttaaaattgtta

SEQ ID NO: 5128373 - DNA, 23 bp, Homo sapiens
acaaagttactaggtaacttcat

SEQ ID NO: 5128374 - DNA, 18 bp, Homo sapiens
acaaagttactggctctt

SEQ ID NO: 5128375 - DNA, 22 bp, Homo sapiens
acaaagttcactgtttattgaa

SEQ ID NO: 5128376 - DNA, 18 bp, Homo sapiens
acaaagttccacttccag

SEQ ID NO: 5128377 - DNA, 13 bp, Homo sapiens
acaaagttctgta

SEQ ID NO: 5128378 - DNA, 19 bp, Homo sapiens
acaaagttgattaagaaag

SEQ ID NO: 5128379 - DNA, 19 bp, Homo sapiens
acaaagtttacattgtcct

SEQ ID NO: 5128380 - DNA, 22 bp, Homo sapiens
acaaagtttacattgtcctgta

SEQ ID NO: 5128381 - DNA, 18 bp, Homo sapiens
acaaagtttcagagtata

SEQ ID NO: 5128382 - DNA, 20 bp, Homo sapiens
acaaagtttcagagtatatt

SEQ ID NO: 5128383 - DNA, 18 bp, Homo sapiens
acaaagtttggaagtaca

SEQ ID NO: 5128384 - DNA, 14 bp, Homo sapiens
acaaagttttcctt

SEQ ID NO: 5128385 - DNA, 15 bp, Homo sapiens
acaaagttttccttt

SEQ ID NO: 5128386 - DNA, 18 bp, Homo sapiens
acaaataaaattggcacc

SEQ ID NO: 5128387 - DNA, 14 bp, Homo sapiens
acaaataaacctga

SEQ ID NO: 5128388 - DNA, 17 bp, Homo sapiens
acaaataaagatggcta

SEQ ID NO: 5128389 - DNA, 13 bp, Homo sapiens
acaaataaataaa

SEQ ID NO: 5128390 - DNA, 18 bp, Homo sapiens
acaaataaatgattatat

SEQ ID NO: 5128391 - DNA, 19 bp, Homo sapiens
acaaataaatgattatatt

SEQ ID NO: 5128392 - DNA, 22 bp, Homo sapiens
acaaataaatgattatattcac

SEQ ID NO: 5128393 - DNA, 15 bp, Homo sapiens
acaaataacaacttt

SEQ ID NO: 5128394 - DNA, 16 bp, Homo sapiens
acaaataacaagaata

SEQ ID NO: 5128395 - DNA, 19 bp, Homo sapiens
acaaataactactgcaaaa

SEQ ID NO: 5128396 - DNA, 15 bp, Homo sapiens
acaaataatattgcc

SEQ ID NO: 5128397 - DNA, 22 bp, Homo sapiens
acaaataatattgccttgatgt

SEQ ID NO: 5128398 - DNA, 12 bp, Homo sapiens
acaaataatcac

SEQ ID NO: 5128399 - DNA, 13 bp, Homo sapiens
acaaataatcaca

SEQ ID NO: 5128400 - DNA, 20 bp, Homo sapiens
acaaataatgaacagcagaa

SEQ ID NO: 5128401 - DNA, 11 bp, Homo sapiens
acaaataatta

SEQ ID NO: 5128402 - DNA, 19 bp, Homo sapiens
acaaataatttaagttggc

SEQ ID NO: 5128403 - DNA, 14 bp, Homo sapiens
acaaataatttaga

SEQ ID NO: 5128404 - DNA, 15 bp, Homo sapiens
acaaataattttagt

SEQ ID NO: 5128405 - DNA, 14 bp, Homo sapiens
acaaatacacatac

SEQ ID NO: 5128406 - DNA, 14 bp, Homo sapiens
acaaatacagatga

SEQ ID NO: 5128407 - DNA, 17 bp, Homo sapiens
acaaatactcatgtgta

SEQ ID NO: 5128408 - DNA, 18 bp, Homo sapiens
acaaatacttattcattg

SEQ ID NO: 5128409 - DNA, 16 bp, Homo sapiens
acaaatagaaaatggt

SEQ ID NO: 5128410 - DNA, 23 bp, Homo sapiens
acaaatagatttctttgcacaat

SEQ ID NO: 5128411 - DNA, 15 bp, Homo sapiens
acaaataggagtgag

SEQ ID NO: 5128412 - DNA, 17 bp, Homo sapiens
acaaatagttatctttt

SEQ ID NO: 5128413 - DNA, 20 bp, Homo sapiens
acaaatagttatcttttaat

SEQ ID NO: 5128414 - DNA, 14 bp, Homo sapiens
acaaatagttgtaa

SEQ ID NO: 5128415 - DNA, 15 bp, Homo sapiens
acaaatataaatctt

SEQ ID NO: 5128416 - DNA, 19 bp, Homo sapiens
acaaatataagaataaaat

SEQ ID NO: 5128417 - DNA, 14 bp, Homo sapiens
acaaatatatgtat

SEQ ID NO: 5128418 - DNA, 14 bp, Homo sapiens
acaaatatattata

SEQ ID NO: 5128419 - DNA, 18 bp, Homo sapiens
acaaatatatttaattgt

SEQ ID NO: 5128420 - DNA, 20 bp, Homo sapiens
acaaatatgattctcctctc

SEQ ID NO: 5128421 - DNA, 21 bp, Homo sapiens
acaaatatgattctcctctcc

SEQ ID NO: 5128422 - DNA, 12 bp, Homo sapiens
acaaatatgcaa

SEQ ID NO: 5128423 - DNA, 17 bp, Homo sapiens
acaaatatgctaaatgt

SEQ ID NO: 5128424 - DNA, 18 bp, Homo sapiens
acaaatatgctaaatgtt

SEQ ID NO: 5128425 - DNA, 16 bp, Homo sapiens
acaaatatgctaattt

SEQ ID NO: 5128426 - DNA, 20 bp, Homo sapiens
acaaatatggctagttttca

SEQ ID NO: 5128427 - DNA, 21 bp, Homo sapiens
acaaatatggctagttttcaa

SEQ ID NO: 5128428 - DNA, 21 bp, Homo sapiens
acaaatatgtagaatgtaata

SEQ ID NO: 5128429 - DNA, 17 bp, Homo sapiens
acaaatatgttctctga

SEQ ID NO: 5128430 - DNA, 12 bp, Homo sapiens
acaaatattaaa

SEQ ID NO: 5128431 - DNA, 18 bp, Homo sapiens
acaaatattaaaaagtct

SEQ ID NO: 5128432 - DNA, 20 bp, Homo sapiens
acaaatattaaaaagtcttt

SEQ ID NO: 5128433 - DNA, 16 bp, Homo sapiens
acaaatattaagaaaa

SEQ ID NO: 5128434 - DNA, 14 bp, Homo sapiens
acaaatattcagaa

SEQ ID NO: 5128435 - DNA, 15 bp, Homo sapiens
acaaatattctgaat

SEQ ID NO: 5128436 - DNA, 16 bp, Homo sapiens
acaaatattgtcatct

SEQ ID NO: 5128437 - DNA, 13 bp, Homo sapiens
acaaatatttaga

SEQ ID NO: 5128438 - DNA, 15 bp, Homo sapiens
acaaatattttcatg

SEQ ID NO: 5128439 - DNA, 16 bp, Homo sapiens
acaaatattttcatgt

SEQ ID NO: 5128440 - DNA, 15 bp, Homo sapiens
acaaatattttcttt

SEQ ID NO: 5128441 - DNA, 14 bp, Homo sapiens
acaaatcaaacaca

SEQ ID NO: 5128442 - DNA, 16 bp, Homo sapiens
acaaatcaaattgctt

SEQ ID NO: 5128443 - DNA, 19 bp, Homo sapiens
acaaatcaaattgcttaaa

SEQ ID NO: 5128444 - DNA, 17 bp, Homo sapiens
acaaatcaacagaagca

SEQ ID NO: 5128445 - DNA, 19 bp, Homo sapiens
acaaatcaacagaagcatt

SEQ ID NO: 5128446 - DNA, 23 bp, Homo sapiens
acaaatcaacagaagcatttgta

SEQ ID NO: 5128447 - DNA, 12 bp, Homo sapiens
acaaatcaagtt

SEQ ID NO: 5128448 - DNA, 22 bp, Homo sapiens
acaaatcactgtggggaaacaa

SEQ ID NO: 5128449 - DNA, 20 bp, Homo sapiens
acaaatcagaagtcatcttg

SEQ ID NO: 5128450 - DNA, 18 bp, Homo sapiens
acaaatccctatgttgct

SEQ ID NO: 5128451 - DNA, 20 bp, Homo sapiens
acaaatcctctgttttctct

SEQ ID NO: 5128452 - DNA, 20 bp, Homo sapiens
acaaatctataaagaaggat

SEQ ID NO: 5128453 - DNA, 20 bp, Homo sapiens
acaaatctatattaaagtgt

SEQ ID NO: 5128454 - DNA, 15 bp, Homo sapiens
acaaatctatgccac

SEQ ID NO: 5128455 - DNA, 21 bp, Homo sapiens
acaaatctcaagcaaacagct

SEQ ID NO: 5128456 - DNA, 15 bp, Homo sapiens
acaaatctcactgta

SEQ ID NO: 5128457 - DNA, 19 bp, Homo sapiens
acaaatctgcaaagcatgt

SEQ ID NO: 5128458 - DNA, 22 bp, Homo sapiens
acaaatctgcaaagcatgtttt

SEQ ID NO: 5128459 - DNA, 21 bp, Homo sapiens
acaaatctgggcattgagcaa

SEQ ID NO: 5128460 - DNA, 23 bp, Homo sapiens
acaaatctgtataaatgtctatt

SEQ ID NO: 5128461 - DNA, 14 bp, Homo sapiens
acaaatctgtctgc

SEQ ID NO: 5128462 - DNA, 19 bp, Homo sapiens
acaaatctgtgtatattat

SEQ ID NO: 5128463 - DNA, 18 bp, Homo sapiens
acaaatcttcaaggtgta

SEQ ID NO: 5128464 - DNA, 13 bp, Homo sapiens
acaaatcttcagt

SEQ ID NO: 5128465 - DNA, 14 bp, Homo sapiens
acaaatgaaaatga

SEQ ID NO: 5128466 - DNA, 14 bp, Homo sapiens
acaaatgaaagaga

SEQ ID NO: 5128467 - DNA, 18 bp, Homo sapiens
acaaatgaaagagaaaat

SEQ ID NO: 5128468 - DNA, 20 bp, Homo sapiens
acaaatgaaagagaaaatat

SEQ ID NO: 5128469 - DNA, 19 bp, Homo sapiens
acaaatgaagtatttcatg

SEQ ID NO: 5128470 - DNA, 22 bp, Homo sapiens
acaaatgaagtatttcatgtaa

SEQ ID NO: 5128471 - DNA, 17 bp, Homo sapiens
acaaatgacagatcttt

SEQ ID NO: 5128472 - DNA, 16 bp, Homo sapiens
acaaatgactgtatct

SEQ ID NO: 5128473 - DNA, 18 bp, Homo sapiens
acaaatgactttattatt

SEQ ID NO: 5128474 - DNA, 14 bp, Homo sapiens
acaaatgatctagt

SEQ ID NO: 5128475 - DNA, 15 bp, Homo sapiens
acaaatgattgcttt

SEQ ID NO: 5128476 - DNA, 19 bp, Homo sapiens
acaaatgattgcttttaaa

SEQ ID NO: 5128477 - DNA, 18 bp, Homo sapiens
acaaatgcaaatttctat

SEQ ID NO: 5128478 - DNA, 13 bp, Homo sapiens
acaaatgcagaca

SEQ ID NO: 5128479 - DNA, 14 bp, Homo sapiens
acaaatgcagacac

SEQ ID NO: 5128480 - DNA, 20 bp, Homo sapiens
acaaatgcagacacacaaca

SEQ ID NO: 5128481 - DNA, 20 bp, Homo sapiens
acaaatgcagtgtatttaat

SEQ ID NO: 5128482 - DNA, 15 bp, Homo sapiens
acaaatgcatctttg

SEQ ID NO: 5128483 - DNA, 17 bp, Homo sapiens
acaaatgcatgaacaag

SEQ ID NO: 5128484 - DNA, 18 bp, Homo sapiens
acaaatgccaaattaaaa

SEQ ID NO: 5128485 - DNA, 15 bp, Homo sapiens
acaaatgccacacat

SEQ ID NO: 5128486 - DNA, 20 bp, Homo sapiens
acaaatgccttaaaatggaa

SEQ ID NO: 5128487 - DNA, 17 bp, Homo sapiens
acaaatgctcaaagaaa

SEQ ID NO: 5128488 - DNA, 23 bp, Homo sapiens
acaaatgctcccacctgaatttg

SEQ ID NO: 5128489 - DNA, 15 bp, Homo sapiens
acaaatgctctgtct

SEQ ID NO: 5128490 - DNA, 16 bp, Homo sapiens
acaaatggaagagaag

SEQ ID NO: 5128491 - DNA, 20 bp, Homo sapiens
acaaatggagctttctgtat

SEQ ID NO: 5128492 - DNA, 18 bp, Homo sapiens
acaaatggatgacacatt

SEQ ID NO: 5128493 - DNA, 18 bp, Homo sapiens
acaaatggcttacttaca

SEQ ID NO: 5128494 - DNA, 20 bp, Homo sapiens
acaaatggcttacttacaaa

SEQ ID NO: 5128495 - DNA, 21 bp, Homo sapiens
acaaatggcttacttacaaaa

SEQ ID NO: 5128496 - DNA, 19 bp, Homo sapiens
acaaatgggactgatgtca

SEQ ID NO: 5128497 - DNA, 20 bp, Homo sapiens
acaaatgggactgatgtcat

SEQ ID NO: 5128498 - DNA, 20 bp, Homo sapiens
acaaatggtgaatggatttc

SEQ ID NO: 5128499 - DNA, 15 bp, Homo sapiens
acaaatggtggagga

SEQ ID NO: 5128500 - DNA, 17 bp, Homo sapiens
acaaatgtaaacatttt

SEQ ID NO: 5128501 - DNA, 17 bp, Homo sapiens
acaaatgtaagcaaagg

SEQ ID NO: 5128502 - DNA, 19 bp, Homo sapiens
acaaatgtatagaataaac

SEQ ID NO: 5128503 - DNA, 15 bp, Homo sapiens
acaaatgtattttga

SEQ ID NO: 5128504 - DNA, 15 bp, Homo sapiens
acaaatgtcctcaga

SEQ ID NO: 5128505 - DNA, 18 bp, Homo sapiens
acaaatgtctagtttcta

SEQ ID NO: 5128506 - DNA, 14 bp, Homo sapiens
acaaatgtctatca

SEQ ID NO: 5128507 - DNA, 9 bp, Homo sapiens
acaaatgtg

SEQ ID NO: 5128508 - DNA, 15 bp, Homo sapiens
acaaatgtgaaacgg

SEQ ID NO: 5128509 - DNA, 14 bp, Homo sapiens
acaaatgtgaagat

SEQ ID NO: 5128510 - DNA, 16 bp, Homo sapiens
acaaatgtgaagatgc

SEQ ID NO: 5128511 - DNA, 17 bp, Homo sapiens
acaaatgtgaagatgca

SEQ ID NO: 5128512 - DNA, 18 bp, Homo sapiens
acaaatgtgaagatgcat

SEQ ID NO: 5128513 - DNA, 21 bp, Homo sapiens
acaaatgtgaagatgcattgt

SEQ ID NO: 5128514 - DNA, 16 bp, Homo sapiens
acaaatgtggccaagc

SEQ ID NO: 5128515 - DNA, 22 bp, Homo sapiens
acaaatgtgtatcggatgcttt

SEQ ID NO: 5128516 - DNA, 19 bp, Homo sapiens
acaaatgtgtatttttgtt

SEQ ID NO: 5128517 - DNA, 19 bp, Homo sapiens
acaaatgttaaaatgtgtt

SEQ ID NO: 5128518 - DNA, 14 bp, Homo sapiens
acaaatgttaaagt

SEQ ID NO: 5128519 - DNA, 23 bp, Homo sapiens
acaaatgttttcatttacaggaa

SEQ ID NO: 5128520 - DNA, 14 bp, Homo sapiens
acacactcaggcct

SEQ ID NO: 5128521 - DNA, 19 bp, Homo sapiens
acacactcaggcctgtgcc

SEQ ID NO: 5128522 - DNA, 24 bp, Homo sapiens
acacactcaggcctgtgcccactc

SEQ ID NO: 5128523 - DNA, 14 bp, Homo sapiens
acacactcagtgca

SEQ ID NO: 5128524 - DNA, 19 bp, Homo sapiens
acacactccccacttcact

SEQ ID NO: 5128525 - DNA, 16 bp, Homo sapiens
acacactccctgcttg

SEQ ID NO: 5128526 - DNA, 12 bp, Homo sapiens
acacactccttc

SEQ ID NO: 5128527 - DNA, 22 bp, Homo sapiens
acacactctcatgtccccttcc

SEQ ID NO: 5128528 - DNA, 11 bp, Homo sapiens
acacactgacc

SEQ ID NO: 5128529 - DNA, 15 bp, Homo sapiens
acacactgaggcagg

SEQ ID NO: 5128530 - DNA, 15 bp, Homo sapiens
acacactgatgctta

SEQ ID NO: 5128531 - DNA, 15 bp, Homo sapiens
acacactgcacatct

SEQ ID NO: 5128532 - DNA, 15 bp, Homo sapiens
acacactgcctccca

SEQ ID NO: 5128533 - DNA, 14 bp, Homo sapiens
acacactgccttat

SEQ ID NO: 5128534 - DNA, 19 bp, Homo sapiens
acacactgcggtgtctgca

SEQ ID NO: 5128535 - DNA, 11 bp, Homo sapiens
acacactggac

SEQ ID NO: 5128536 - DNA, 12 bp, Homo sapiens
acacactggacc

SEQ ID NO: 5128537 - DNA, 16 bp, Homo sapiens
acacactggctcctgg

SEQ ID NO: 5128538 - DNA, 16 bp, Homo sapiens
acacactggtacttag

SEQ ID NO: 5128539 - DNA, 10 bp, Homo sapiens
acacactgta

SEQ ID NO: 5128540 - DNA, 12 bp, Homo sapiens
acacactgtaaa

SEQ ID NO: 5128541 - DNA, 21 bp, Homo sapiens
acacactgtaaacccctgggt

SEQ ID NO: 5128542 - DNA, 21 bp, Homo sapiens
acacactgtgctttctattgt

SEQ ID NO: 5128543 - DNA, 22 bp, Homo sapiens
acacactgtgctttctattgta

SEQ ID NO: 5128544 - DNA, 15 bp, Homo sapiens
acacacttacagagc

SEQ ID NO: 5128545 - DNA, 14 bp, Homo sapiens
acacacttcttcca

SEQ ID NO: 5128546 - DNA, 13 bp, Homo sapiens
acacactttattt

SEQ ID NO: 5128547 - DNA, 17 bp, Homo sapiens
acacactttccatctct

SEQ ID NO: 5128548 - DNA, 22 bp, Homo sapiens
acacactttccatctctgcctg

SEQ ID NO: 5128549 - DNA, 16 bp, Homo sapiens
acacacttttgcacat

SEQ ID NO: 5128550 - DNA, 20 bp, Homo sapiens
acacacttttgcacatatat

SEQ ID NO: 5128551 - DNA, 23 bp, Homo sapiens
acacacttttggttaagtctgtt

SEQ ID NO: 5128552 - DNA, 14 bp, Homo sapiens
acacactttttaag

SEQ ID NO: 5128553 - DNA, 17 bp, Homo sapiens
acacagaaaaaggatgt

SEQ ID NO: 5128554 - DNA, 12 bp, Homo sapiens
acacagaaaata

SEQ ID NO: 5128555 - DNA, 13 bp, Homo sapiens
acacagaaaatat

SEQ ID NO: 5128556 - DNA, 17 bp, Homo sapiens
acacagaaaatatactg

SEQ ID NO: 5128557 - DNA, 19 bp, Homo sapiens
acacagaaaatatactgta

SEQ ID NO: 5128558 - DNA, 20 bp, Homo sapiens
acacagaaaatatactgtaa

SEQ ID NO: 5128559 - DNA, 18 bp, Homo sapiens
acacagaaacctttttaa

SEQ ID NO: 5128560 - DNA, 21 bp, Homo sapiens
acacagaaatatatatacata

SEQ ID NO: 5128561 - DNA, 16 bp, Homo sapiens
acacagaaatgctgct

SEQ ID NO: 5128562 - DNA, 14 bp, Homo sapiens
acacagaaatgtgt

SEQ ID NO: 5128563 - DNA, 16 bp, Homo sapiens
acacagaactcagcct

SEQ ID NO: 5128564 - DNA, 16 bp, Homo sapiens
acacagaatgcaacca

SEQ ID NO: 5128565 - DNA, 17 bp, Homo sapiens
acacagaatgctcaggg

SEQ ID NO: 5128566 - DNA, 23 bp, Homo sapiens
acacagaattatagatgtctgag

SEQ ID NO: 5128567 - DNA, 17 bp, Homo sapiens
acacagacacacaagca

SEQ ID NO: 5128568 - DNA, 15 bp, Homo sapiens
acacagacatatata

SEQ ID NO: 5128569 - DNA, 19 bp, Homo sapiens
acacagacattttgtgtga

SEQ ID NO: 5128570 - DNA, 21 bp, Homo sapiens
acacagacattttgtgtgaga

SEQ ID NO: 5128571 - DNA, 23 bp, Homo sapiens
acacagacattttgtgtgagact

SEQ ID NO: 5128572 - DNA, 11 bp, Homo sapiens
acacagaccac

SEQ ID NO: 5128573 - DNA, 14 bp, Homo sapiens
acacagacccagga

SEQ ID NO: 5128574 - DNA, 13 bp, Homo sapiens
acacagacctcga

SEQ ID NO: 5128575 - DNA, 18 bp, Homo sapiens
acacagactacagccaga

SEQ ID NO: 5128576 - DNA, 16 bp, Homo sapiens
acacagactattgaca

SEQ ID NO: 5128577 - DNA, 20 bp, Homo sapiens
acacagactattgacatcag

SEQ ID NO: 5128578 - DNA, 23 bp, Homo sapiens
acacagactttctgtgacgcaga

SEQ ID NO: 5128579 - DNA, 16 bp, Homo sapiens
acacagagcctgcctc

SEQ ID NO: 5128580 - DNA, 20 bp, Homo sapiens
acacagagcgcctcacctgc

SEQ ID NO: 5128581 - DNA, 12 bp, Homo sapiens
acacagaggaag

SEQ ID NO: 5128582 - DNA, 20 bp, Homo sapiens
acacagaggaatttatacct

SEQ ID NO: 5128583 - DNA, 20 bp, Homo sapiens
acacagaggacggcttcccc

SEQ ID NO: 5128584 - DNA, 19 bp, Homo sapiens
acacagagtggtctttctg

SEQ ID NO: 5128585 - DNA, 18 bp, Homo sapiens
acacagagtgtgtttttg

SEQ ID NO: 5128586 - DNA, 19 bp, Homo sapiens
acacagatatacacatgga

SEQ ID NO: 5128587 - DNA, 13 bp, Homo sapiens
acacagatattgt

SEQ ID NO: 5128588 - DNA, 21 bp, Homo sapiens
acacagatgaaacacaaacaa

SEQ ID NO: 5128589 - DNA, 13 bp, Homo sapiens
acacagatggcac

SEQ ID NO: 5128590 - DNA, 20 bp, Homo sapiens
acacagatggcacctgtggc

SEQ ID NO: 5128591 - DNA, 21 bp, Homo sapiens
acacagatggcacctgtggcc

SEQ ID NO: 5128592 - DNA, 16 bp, Homo sapiens
acacagatgttcggtt

SEQ ID NO: 5128593 - DNA, 18 bp, Homo sapiens
acacagattatgttcctg

SEQ ID NO: 5128594 - DNA, 21 bp, Homo sapiens
acacagattatgttcctgctg

SEQ ID NO: 5128595 - DNA, 11 bp, Homo sapiens
acacagatttt

SEQ ID NO: 5128596 - DNA, 14 bp, Homo sapiens
acacagatttttac

SEQ ID NO: 5128597 - DNA, 20 bp, Homo sapiens
acacagcacaccagccgctg

SEQ ID NO: 5128598 - DNA, 22 bp, Homo sapiens
acacagcacctcctctctgctg

SEQ ID NO: 5128599 - DNA, 13 bp, Homo sapiens
acacagcagacct

SEQ ID NO: 5128600 - DNA, 13 bp, Homo sapiens
acacagcagcccc

SEQ ID NO: 5128601 - DNA, 11 bp, Homo sapiens
acacagcagct

SEQ ID NO: 5128602 - DNA, 22 bp, Homo sapiens
acacagcagcttcaccagagca

SEQ ID NO: 5128603 - DNA, 21 bp, Homo sapiens
acacagcagtatgaatgatgt

SEQ ID NO: 5128604 - DNA, 14 bp, Homo sapiens
acacagcagtattg

SEQ ID NO: 5128605 - DNA, 15 bp, Homo sapiens
acacagcagtgagta

SEQ ID NO: 5128606 - DNA, 13 bp, Homo sapiens
acacagcagtgtc

SEQ ID NO: 5128607 - DNA, 21 bp, Homo sapiens
acacagcagtgtcccctgccc

SEQ ID NO: 5128608 - DNA, 22 bp, Homo sapiens
acacagcagtgtcccctgcccc

SEQ ID NO: 5128609 - DNA, 23 bp, Homo sapiens
acacagcagtgtcccctgcccca

SEQ ID NO: 5128610 - DNA, 14 bp, Homo sapiens
acacagcagtgtga

SEQ ID NO: 5128611 - DNA, 16 bp, Homo sapiens
acacagcatgcattta

SEQ ID NO: 5128612 - DNA, 22 bp, Homo sapiens
acacagcatgcatttagcatga

SEQ ID NO: 5128613 - DNA, 20 bp, Homo sapiens
acacagcatgggtccagaag

SEQ ID NO: 5128614 - DNA, 13 bp, Homo sapiens
acacagcatgtgc

SEQ ID NO: 5128615 - DNA, 14 bp, Homo sapiens
acacagcatgtgcc

SEQ ID NO: 5128616 - DNA, 18 bp, Homo sapiens
acacagcattgtatatgt

SEQ ID NO: 5128617 - DNA, 12 bp, Homo sapiens
acacagccacac

SEQ ID NO: 5128618 - DNA, 13 bp, Homo sapiens
acacagccacaca

SEQ ID NO: 5128619 - DNA, 13 bp, Homo sapiens
acacagcccaaga

SEQ ID NO: 5128620 - DNA, 12 bp, Homo sapiens
acacagcccaga

SEQ ID NO: 5128621 - DNA, 13 bp, Homo sapiens
acacagcccagaa

SEQ ID NO: 5128622 - DNA, 18 bp, Homo sapiens
acacagcccagaaggcca

SEQ ID NO: 5128623 - DNA, 19 bp, Homo sapiens
acacagcccagacaagatg

SEQ ID NO: 5128624 - DNA, 18 bp, Homo sapiens
acacagcccagagactga

SEQ ID NO: 5128625 - DNA, 23 bp, Homo sapiens
acacagcccgagccccttgggga

SEQ ID NO: 5128626 - DNA, 21 bp, Homo sapiens
acacagcctccctgagcctgc

SEQ ID NO: 5128627 - DNA, 11 bp, Homo sapiens
acacagcctct

SEQ ID NO: 5128628 - DNA, 12 bp, Homo sapiens
acacagcctcta

SEQ ID NO: 5128629 - DNA, 14 bp, Homo sapiens
acacagcctggcct

SEQ ID NO: 5128630 - DNA, 16 bp, Homo sapiens
acacagcctggcctcc

SEQ ID NO: 5128631 - DNA, 21 bp, Homo sapiens
acacagcctgggaccagggca

SEQ ID NO: 5128632 - DNA, 17 bp, Homo sapiens
acacagcctttctgtat

SEQ ID NO: 5128633 - DNA, 15 bp, Homo sapiens
acacagcggctgcct

SEQ ID NO: 5128634 - DNA, 17 bp, Homo sapiens
acacagcggctgcctcc

SEQ ID NO: 5128635 - DNA, 17 bp, Homo sapiens
acacagcggtttgcaga

SEQ ID NO: 5128636 - DNA, 17 bp, Homo sapiens
acacagctactctcccc

SEQ ID NO: 5128637 - DNA, 23 bp, Homo sapiens
acacagctactctccccacgagg

SEQ ID NO: 5128638 - DNA, 22 bp, Homo sapiens
acacagctagtgaagaccagag

SEQ ID NO: 5128639 - DNA, 23 bp, Homo sapiens
acacagctagtgaagaccagagc

SEQ ID NO: 5128640 - DNA, 20 bp, Homo sapiens
acacagctcttctccaggct

SEQ ID NO: 5128641 - DNA, 21 bp, Homo sapiens
acacagctgagctggcctatt

SEQ ID NO: 5128642 - DNA, 11 bp, Homo sapiens
acacagctgcc

SEQ ID NO: 5128643 - DNA, 13 bp, Homo sapiens
acacagctgccct

SEQ ID NO: 5128644 - DNA, 16 bp, Homo sapiens
acacagctgccctagc

SEQ ID NO: 5128645 - DNA, 18 bp, Homo sapiens
acacagctgccctagctg

SEQ ID NO: 5128646 - DNA, 12 bp, Homo sapiens
acacagctgccg

SEQ ID NO: 5128647 - DNA, 16 bp, Homo sapiens
acacagctgggctgtg

SEQ ID NO: 5128648 - DNA, 21 bp, Homo sapiens
acacagctttatcaccagaga

SEQ ID NO: 5128649 - DNA, 12 bp, Homo sapiens
acacaggaactc

SEQ ID NO: 5128650 - DNA, 23 bp, Homo sapiens
acacaggaactctgtgtgagaga

SEQ ID NO: 5128651 - DNA, 18 bp, Homo sapiens
acacaggacaggggttcc

SEQ ID NO: 5128652 - DNA, 18 bp, Homo sapiens
acacaggacccccttccc

SEQ ID NO: 5128653 - DNA, 20 bp, Homo sapiens
acacaggacccccttcccct

SEQ ID NO: 5128654 - DNA, 21 bp, Homo sapiens
acacaggactgaaaagggaat

SEQ ID NO: 5128655 - DNA, 14 bp, Homo sapiens
acacaggagaaaat

SEQ ID NO: 5128656 - DNA, 18 bp, Homo sapiens
acacaggagtcctttctt

SEQ ID NO: 5128657 - DNA, 21 bp, Homo sapiens
acacaggagtcttcagaccca

SEQ ID NO: 5128658 - DNA, 22 bp, Homo sapiens
acacaggagtcttcagacccag

SEQ ID NO: 5128659 - DNA, 21 bp, Homo sapiens
acacaggcaactgaggcagac

SEQ ID NO: 5128660 - DNA, 11 bp, Homo sapiens
acacaggcagc

SEQ ID NO: 5128661 - DNA, 18 bp, Homo sapiens
acacaggcagccagccgt

SEQ ID NO: 5128662 - DNA, 12 bp, Homo sapiens
acacaggcaggg

SEQ ID NO: 5128663 - DNA, 18 bp, Homo sapiens
acacaggcatttcctggg

SEQ ID NO: 5128664 - DNA, 17 bp, Homo sapiens
acacaggccagccccat

SEQ ID NO: 5128665 - DNA, 21 bp, Homo sapiens
acacaggccagccccatcttg

SEQ ID NO: 5128666 - DNA, 16 bp, Homo sapiens
acacaggcccatgccc

SEQ ID NO: 5128667 - DNA, 19 bp, Homo sapiens
acacaggcccggctccagg

SEQ ID NO: 5128668 - DNA, 22 bp, Homo sapiens
acacaggccgtgggacccaggc

SEQ ID NO: 5128669 - DNA, 23 bp, Homo sapiens
acacaggccgtgggacccaggct

SEQ ID NO: 5128670 - DNA, 11 bp, Homo sapiens
acacaggcctg

SEQ ID NO: 5128671 - DNA, 12 bp, Homo sapiens
acacaggcctgg

SEQ ID NO: 5128672 - DNA, 22 bp, Homo sapiens
acacaggcctggcccagccagc

SEQ ID NO: 5128673 - DNA, 16 bp, Homo sapiens
acacaggcctgtgtag

SEQ ID NO: 5128674 - DNA, 22 bp, Homo sapiens
acacaggcctgtgtagctgtga

SEQ ID NO: 5128675 - DNA, 14 bp, Homo sapiens
acacaggccttctg

SEQ ID NO: 5128676 - DNA, 16 bp, Homo sapiens
acacaggccttctgtg

SEQ ID NO: 5128677 - DNA, 23 bp, Homo sapiens
acacaggccttctgtggggctgg

SEQ ID NO: 5128678 - DNA, 12 bp, Homo sapiens
acacaggctggc

SEQ ID NO: 5128679 - DNA, 12 bp, Homo sapiens
acacaggctgtc

SEQ ID NO: 5128680 - DNA, 22 bp, Homo sapiens
acacaggcttatttttaaaata

SEQ ID NO: 5128681 - DNA, 13 bp, Homo sapiens
acacagggaaagc

SEQ ID NO: 5128682 - DNA, 15 bp, Homo sapiens
acacagggaaagcat

SEQ ID NO: 5128683 - DNA, 20 bp, Homo sapiens
acacagggcactgactgata

SEQ ID NO: 5128684 - DNA, 12 bp, Homo sapiens
acacagggctca

SEQ ID NO: 5128685 - DNA, 13 bp, Homo sapiens
acacagggctcac

SEQ ID NO: 5128686 - DNA, 14 bp, Homo sapiens
acacagggctcttt

SEQ ID NO: 5128687 - DNA, 16 bp, Homo sapiens
acacagggctctttga

SEQ ID NO: 5128688 - DNA, 16 bp, Homo sapiens
acacaggggacactga

SEQ ID NO: 5128689 - DNA, 15 bp, Homo sapiens
acacaggggccctgt

SEQ ID NO: 5128690 - DNA, 19 bp, Homo sapiens
acacaggggccctgtacag

SEQ ID NO: 5128691 - DNA, 19 bp, Homo sapiens
acacaggggtggagtttct

SEQ ID NO: 5128692 - DNA, 22 bp, Homo sapiens
acacaggggtggagtttctgac

SEQ ID NO: 5128693 - DNA, 20 bp, Homo sapiens
acacagggtgacggtgacaa

SEQ ID NO: 5128694 - DNA, 15 bp, Homo sapiens
acacaggtcagggct

SEQ ID NO: 5128695 - DNA, 17 bp, Homo sapiens
acacaggtcagggctca

SEQ ID NO: 5128696 - DNA, 22 bp, Homo sapiens
acacagtaaaaacttgtactat

SEQ ID NO: 5128697 - DNA, 13 bp, Homo sapiens
acacagtacacac

SEQ ID NO: 5128698 - DNA, 14 bp, Homo sapiens
acacagtacttcct

SEQ ID NO: 5128699 - DNA, 16 bp, Homo sapiens
acacagtacttcctcc

SEQ ID NO: 5128700 - DNA, 19 bp, Homo sapiens
acacagtagctccaacact

SEQ ID NO: 5128701 - DNA, 14 bp, Homo sapiens
acaaattaaaaaca

SEQ ID NO: 5128702 - DNA, 16 bp, Homo sapiens
acaaattaatatttgt

SEQ ID NO: 5128703 - DNA, 13 bp, Homo sapiens
acaaattaatttt

SEQ ID NO: 5128704 - DNA, 20 bp, Homo sapiens
acaaattaccaaattacatg

SEQ ID NO: 5128705 - DNA, 14 bp, Homo sapiens
acaaattagaggag

SEQ ID NO: 5128706 - DNA, 16 bp, Homo sapiens
acaaattagcatgcaa

SEQ ID NO: 5128707 - DNA, 18 bp, Homo sapiens
acaaattagcatgcaagc

SEQ ID NO: 5128708 - DNA, 15 bp, Homo sapiens
acaaattagttatat

SEQ ID NO: 5128709 - DNA, 11 bp, Homo sapiens
acaaattatgt

SEQ ID NO: 5128710 - DNA, 22 bp, Homo sapiens
acaaattatgttacatctgttt

SEQ ID NO: 5128711 - DNA, 17 bp, Homo sapiens
acaaattattaatgaaa

SEQ ID NO: 5128712 - DNA, 15 bp, Homo sapiens
acaaattcaaataat

SEQ ID NO: 5128713 - DNA, 14 bp, Homo sapiens
acaaattccttccc

SEQ ID NO: 5128714 - DNA, 18 bp, Homo sapiens
acaaattctgtctctgga

SEQ ID NO: 5128715 - DNA, 21 bp, Homo sapiens
acaaattctgtctctggatta

SEQ ID NO: 5128716 - DNA, 16 bp, Homo sapiens
acaaattctttagtac

SEQ ID NO: 5128717 - DNA, 17 bp, Homo sapiens
acaaattgaaaacacac

SEQ ID NO: 5128718 - DNA, 17 bp, Homo sapiens
acaaattgaaataaata

SEQ ID NO: 5128719 - DNA, 20 bp, Homo sapiens
acaaattgactcttatttat

SEQ ID NO: 5128720 - DNA, 20 bp, Homo sapiens
acaaattgcacagaagtcct

SEQ ID NO: 5128721 - DNA, 20 bp, Homo sapiens
acaaattgcttactttggaa

SEQ ID NO: 5128722 - DNA, 18 bp, Homo sapiens
acaaattgcttgaaagaa

SEQ ID NO: 5128723 - DNA, 18 bp, Homo sapiens
acaaattgggatctgtct

SEQ ID NO: 5128724 - DNA, 18 bp, Homo sapiens
acaaattgtaactacact

SEQ ID NO: 5128725 - DNA, 22 bp, Homo sapiens
acaaattgttactccatatata

SEQ ID NO: 5128726 - DNA, 12 bp, Homo sapiens
acaaattgtttt

SEQ ID NO: 5128727 - DNA, 15 bp, Homo sapiens
acaaatttaaaacaa

SEQ ID NO: 5128728 - DNA, 16 bp, Homo sapiens
acaaatttaaaacaaa

SEQ ID NO: 5128729 - DNA, 17 bp, Homo sapiens
acaaatttaattttgca

SEQ ID NO: 5128730 - DNA, 17 bp, Homo sapiens
acaaatttacagagaca

SEQ ID NO: 5128731 - DNA, 18 bp, Homo sapiens
acaaatttacagagacag

SEQ ID NO: 5128732 - DNA, 19 bp, Homo sapiens
acaaatttacagagacaga

SEQ ID NO: 5128733 - DNA, 15 bp, Homo sapiens
acaaatttacatcag

SEQ ID NO: 5128734 - DNA, 16 bp, Homo sapiens
acaaatttagccaata

SEQ ID NO: 5128735 - DNA, 11 bp, Homo sapiens
acaaatttatg

SEQ ID NO: 5128736 - DNA, 13 bp, Homo sapiens
acaaatttatgca

SEQ ID NO: 5128737 - DNA, 19 bp, Homo sapiens
acaaatttatgcatttcat

SEQ ID NO: 5128738 - DNA, 22 bp, Homo sapiens
acaaatttatgggcttcctgat

SEQ ID NO: 5128739 - DNA, 18 bp, Homo sapiens
acaaatttcattgcactt

SEQ ID NO: 5128740 - DNA, 20 bp, Homo sapiens
acaaatttcattgcactttc

SEQ ID NO: 5128741 - DNA, 17 bp, Homo sapiens
acaaatttggccttaag

SEQ ID NO: 5128742 - DNA, 19 bp, Homo sapiens
acaaatttggccttaagaa

SEQ ID NO: 5128743 - DNA, 20 bp, Homo sapiens
acaaatttggccttaagaac

SEQ ID NO: 5128744 - DNA, 23 bp, Homo sapiens
acaaatttggccttaagaactgt

SEQ ID NO: 5128745 - DNA, 12 bp, Homo sapiens
acaaattttcaa

SEQ ID NO: 5128746 - DNA, 20 bp, Homo sapiens
acaaattttgtataactttt

SEQ ID NO: 5128747 - DNA, 14 bp, Homo sapiens
acaaatttttactc

SEQ ID NO: 5128748 - DNA, 18 bp, Homo sapiens
acaaatttttactcaggc

SEQ ID NO: 5128749 - DNA, 15 bp, Homo sapiens
acaaatttttcaaat

SEQ ID NO: 5128750 - DNA, 23 bp, Homo sapiens
acaaatttttctgctttaaaaat

SEQ ID NO: 5128751 - DNA, 13 bp, Homo sapiens
acaacaaaaaaag

SEQ ID NO: 5128752 - DNA, 14 bp, Homo sapiens
acaacaaaaaatac

SEQ ID NO: 5128753 - DNA, 14 bp, Homo sapiens
acaacaaaaatttg

SEQ ID NO: 5128754 - DNA, 11 bp, Homo sapiens
acaacaaacac

SEQ ID NO: 5128755 - DNA, 23 bp, Homo sapiens
acaacaaactgaattaaacatga

SEQ ID NO: 5128756 - DNA, 23 bp, Homo sapiens
acaacaaagacatgctttccatt

SEQ ID NO: 5128757 - DNA, 19 bp, Homo sapiens
acaacaaagcatgctcagt

SEQ ID NO: 5128758 - DNA, 18 bp, Homo sapiens
acaacaaaggcaagttaa

SEQ ID NO: 5128759 - DNA, 21 bp, Homo sapiens
acaacaaatatgttctctgaa

SEQ ID NO: 5128760 - DNA, 14 bp, Homo sapiens
acaacaacaaagca

SEQ ID NO: 5128761 - DNA, 15 bp, Homo sapiens
acaacaacaaagcat

SEQ ID NO: 5128762 - DNA, 14 bp, Homo sapiens
acaacaacaacaat

SEQ ID NO: 5128763 - DNA, 12 bp, Homo sapiens
acaacaacaata

SEQ ID NO: 5128764 - DNA, 14 bp, Homo sapiens
acaacaacaataat

SEQ ID NO: 5128765 - DNA, 12 bp, Homo sapiens
acaacaacagtt

SEQ ID NO: 5128766 - DNA, 24 bp, Homo sapiens
acaacaagaaactgtccaaatgct

SEQ ID NO: 5128767 - DNA, 13 bp, Homo sapiens
acaacaagaacaa

SEQ ID NO: 5128768 - DNA, 16 bp, Homo sapiens
acaacaagaacaacaa

SEQ ID NO: 5128769 - DNA, 21 bp, Homo sapiens
acaacaaggacaactttatgt

SEQ ID NO: 5128770 - DNA, 13 bp, Homo sapiens
acaacaaggaccc

SEQ ID NO: 5128771 - DNA, 12 bp, Homo sapiens
acaacaataaca

SEQ ID NO: 5128772 - DNA, 19 bp, Homo sapiens
acaacaataacaacaatgg

SEQ ID NO: 5128773 - DNA, 17 bp, Homo sapiens
acaacaatactacctca

SEQ ID NO: 5128774 - DNA, 18 bp, Homo sapiens
acaacaatggtttacatg

SEQ ID NO: 5128775 - DNA, 19 bp, Homo sapiens
acaacaattggtaaaactc

SEQ ID NO: 5128776 - DNA, 22 bp, Homo sapiens
acaacaatttaggaatgctcaa

SEQ ID NO: 5128777 - DNA, 23 bp, Homo sapiens
acaacaatttaggaatgctcaat

SEQ ID NO: 5128778 - DNA, 20 bp, Homo sapiens
acaacacagtagtgttctgt

SEQ ID NO: 5128779 - DNA, 17 bp, Homo sapiens
acaacacctaaaaccag

SEQ ID NO: 5128780 - DNA, 19 bp, Homo sapiens
acaacacctaaaaccagtt

SEQ ID NO: 5128781 - DNA, 21 bp, Homo sapiens
acaacacgcctaaaactcaaa

SEQ ID NO: 5128782 - DNA, 12 bp, Homo sapiens
acaacactcaca

SEQ ID NO: 5128783 - DNA, 15 bp, Homo sapiens
acaacacttcatttt

SEQ ID NO: 5128784 - DNA, 18 bp, Homo sapiens
acaacacttcattttcag

SEQ ID NO: 5128785 - DNA, 15 bp, Homo sapiens
acaacactttaatgg

SEQ ID NO: 5128786 - DNA, 21 bp, Homo sapiens
acaacactttccctctctgga

SEQ ID NO: 5128787 - DNA, 14 bp, Homo sapiens
acaacagaaaaaca

SEQ ID NO: 5128788 - DNA, 16 bp, Homo sapiens
acaacagaaaaacaat

SEQ ID NO: 5128789 - DNA, 14 bp, Homo sapiens
acaacagaaacttc

SEQ ID NO: 5128790 - DNA, 13 bp, Homo sapiens
acaacagaaagag

SEQ ID NO: 5128791 - DNA, 11 bp, Homo sapiens
acaacagaagt

SEQ ID NO: 5128792 - DNA, 13 bp, Homo sapiens
acaacagaagtca

SEQ ID NO: 5128793 - DNA, 19 bp, Homo sapiens
acaacagaagttatatttt

SEQ ID NO: 5128794 - DNA, 17 bp, Homo sapiens
acaacagaataaagcag

SEQ ID NO: 5128795 - DNA, 21 bp, Homo sapiens
acaacagaataaagcagcctg

SEQ ID NO: 5128796 - DNA, 22 bp, Homo sapiens
acaacagaataaagcagcctga

SEQ ID NO: 5128797 - DNA, 13 bp, Homo sapiens
acaacagactgaa

SEQ ID NO: 5128798 - DNA, 18 bp, Homo sapiens
acaacagagatgccatga

SEQ ID NO: 5128799 - DNA, 13 bp, Homo sapiens
acaacagattgga

SEQ ID NO: 5128800 - DNA, 18 bp, Homo sapiens
acaacagattggatttta

SEQ ID NO: 5128801 - DNA, 21 bp, Homo sapiens
acaacagatttctaagttaaa

SEQ ID NO: 5128802 - DNA, 14 bp, Homo sapiens
acaacagcacacag

SEQ ID NO: 5128803 - DNA, 14 bp, Homo sapiens
acaacagcagatgg

SEQ ID NO: 5128804 - DNA, 16 bp, Homo sapiens
acaacagccctgcctg

SEQ ID NO: 5128805 - DNA, 17 bp, Homo sapiens
acaacagccctgcctga

SEQ ID NO: 5128806 - DNA, 14 bp, Homo sapiens
acaacagcctgaga

SEQ ID NO: 5128807 - DNA, 15 bp, Homo sapiens
acaacagcctgagaa

SEQ ID NO: 5128808 - DNA, 16 bp, Homo sapiens
acaacagcctgagaaa

SEQ ID NO: 5128809 - DNA, 20 bp, Homo sapiens
acaacagctcgatccaaatt

SEQ ID NO: 5128810 - DNA, 15 bp, Homo sapiens
acaacagctgaagca

SEQ ID NO: 5128811 - DNA, 15 bp, Homo sapiens
acaacagctggtgcc

SEQ ID NO: 5128812 - DNA, 16 bp, Homo sapiens
acaacagcttcttgct

SEQ ID NO: 5128813 - DNA, 17 bp, Homo sapiens
acaacagcttcttgctt

SEQ ID NO: 5128814 - DNA, 16 bp, Homo sapiens
acaacaggaaatgaaa

SEQ ID NO: 5128815 - DNA, 13 bp, Homo sapiens
acaacaggcattc

SEQ ID NO: 5128816 - DNA, 19 bp, Homo sapiens
acaacaggttttcaccata

SEQ ID NO: 5128817 - DNA, 22 bp, Homo sapiens
acaacagtagtttctcagggtc

SEQ ID NO: 5128818 - DNA, 15 bp, Homo sapiens
acaacagtcacctca

SEQ ID NO: 5128819 - DNA, 18 bp, Homo sapiens
acaacagtcttcattttt

SEQ ID NO: 5128820 - DNA, 23 bp, Homo sapiens
acaacagtgctaaaaatgggact

SEQ ID NO: 5128821 - DNA, 18 bp, Homo sapiens
acaacagttctcttctag

SEQ ID NO: 5128822 - DNA, 22 bp, Homo sapiens
acaacagttctgagctgtaatt

SEQ ID NO: 5128823 - DNA, 21 bp, Homo sapiens
acaacagttgggctgtcaaca

SEQ ID NO: 5128824 - DNA, 22 bp, Homo sapiens
acaacataaaattaaaatttaa

SEQ ID NO: 5128825 - DNA, 18 bp, Homo sapiens
acaacataaggagaatgt

SEQ ID NO: 5128826 - DNA, 17 bp, Homo sapiens
acaacatcaagaaaaca

SEQ ID NO: 5128827 - DNA, 12 bp, Homo sapiens
acaacatcattc

SEQ ID NO: 5128828 - DNA, 23 bp, Homo sapiens
acaacatccatgtcctatgtgtg

SEQ ID NO: 5128829 - DNA, 17 bp, Homo sapiens
acaacatgaaactgcct

SEQ ID NO: 5128830 - DNA, 19 bp, Homo sapiens
acaacatgcacattcatcc

SEQ ID NO: 5128831 - DNA, 21 bp, Homo sapiens
acaacatgcatgttctcctct

SEQ ID NO: 5128832 - DNA, 22 bp, Homo sapiens
acaacatgcatgttctcctcta

SEQ ID NO: 5128833 - DNA, 17 bp, Homo sapiens
acaacatggcttctcct

SEQ ID NO: 5128834 - DNA, 14 bp, Homo sapiens
acaacatgtatgtg

SEQ ID NO: 5128835 - DNA, 19 bp, Homo sapiens
acaacatgtttaataaata

SEQ ID NO: 5128836 - DNA, 16 bp, Homo sapiens
acaacatgtttccagc

SEQ ID NO: 5128837 - DNA, 19 bp, Homo sapiens
acaacatgtttccagcatt

SEQ ID NO: 5128838 - DNA, 16 bp, Homo sapiens
acaacattaaaacaat

SEQ ID NO: 5128839 - DNA, 14 bp, Homo sapiens
acaacattaatttt

SEQ ID NO: 5128840 - DNA, 15 bp, Homo sapiens
acaacattatgatct

SEQ ID NO: 5128841 - DNA, 17 bp, Homo sapiens
acaacattatgatctaa

SEQ ID NO: 5128842 - DNA, 19 bp, Homo sapiens
acaacattatgatctaata

SEQ ID NO: 5128843 - DNA, 12 bp, Homo sapiens
acaacatttatg

SEQ ID NO: 5128844 - DNA, 13 bp, Homo sapiens
acaacatttatgt

SEQ ID NO: 5128845 - DNA, 12 bp, Homo sapiens
acaacattttat

SEQ ID NO: 5128846 - DNA, 16 bp, Homo sapiens
acaaccaatggaatgt

SEQ ID NO: 5128847 - DNA, 15 bp, Homo sapiens
acaaccacatttctg

SEQ ID NO: 5128848 - DNA, 21 bp, Homo sapiens
acaaccaccaccttatacatc

SEQ ID NO: 5128849 - DNA, 14 bp, Homo sapiens
acaaccaccattca

SEQ ID NO: 5128850 - DNA, 15 bp, Homo sapiens
acaaccaccgctccc

SEQ ID NO: 5128851 - DNA, 20 bp, Homo sapiens
acaaccaccgctccccagcc

SEQ ID NO: 5128852 - DNA, 17 bp, Homo sapiens
acaaccactcattcaaa

SEQ ID NO: 5128853 - DNA, 16 bp, Homo sapiens
acaaccagaaggccct

SEQ ID NO: 5128854 - DNA, 18 bp, Homo sapiens
acaaccagaaggccctta

SEQ ID NO: 5128855 - DNA, 14 bp, Homo sapiens
acaaccagagcccc

SEQ ID NO: 5128856 - DNA, 15 bp, Homo sapiens
acaaccagccacaca

SEQ ID NO: 5128857 - DNA, 14 bp, Homo sapiens
acaaccaggtcttg

SEQ ID NO: 5128858 - DNA, 19 bp, Homo sapiens
acaaccatccctgccacat

SEQ ID NO: 5128859 - DNA, 20 bp, Homo sapiens
acaaccatgcaaattgtgaa

SEQ ID NO: 5128860 - DNA, 14 bp, Homo sapiens
acaaccattccaga

SEQ ID NO: 5128861 - DNA, 22 bp, Homo sapiens
acaacccaaggcaatgatatgg

SEQ ID NO: 5128862 - DNA, 21 bp, Homo sapiens
acaacccacaccgtcttcctt

SEQ ID NO: 5128863 - DNA, 21 bp, Homo sapiens
acaacccataatcatgtaaat

SEQ ID NO: 5128864 - DNA, 11 bp, Homo sapiens
acaacccatct

SEQ ID NO: 5128865 - DNA, 13 bp, Homo sapiens
acaaccccagcct

SEQ ID NO: 5128866 - DNA, 14 bp, Homo sapiens
acaacccccagctc

SEQ ID NO: 5128867 - DNA, 18 bp, Homo sapiens
acaaccccctccaccccc

SEQ ID NO: 5128868 - DNA, 15 bp, Homo sapiens
acaaccctaccctgg

SEQ ID NO: 5128869 - DNA, 18 bp, Homo sapiens
acaaccctaccctggcag

SEQ ID NO: 5128870 - DNA, 16 bp, Homo sapiens
acaaccctctggaagt

SEQ ID NO: 5128871 - DNA, 12 bp, Homo sapiens
acaaccctgacc

SEQ ID NO: 5128872 - DNA, 14 bp, Homo sapiens
acaaccctgcaaag

SEQ ID NO: 5128873 - DNA, 23 bp, Homo sapiens
acaaccctgttgagtatttgctg

SEQ ID NO: 5128874 - DNA, 20 bp, Homo sapiens
acaaccctgttgctacatca

SEQ ID NO: 5128875 - DNA, 21 bp, Homo sapiens
acaaccctgttgctacatcag

SEQ ID NO: 5128876 - DNA, 19 bp, Homo sapiens
acaaccgatgctccagcca

SEQ ID NO: 5128877 - DNA, 14 bp, Homo sapiens
acaaccggatgcca

SEQ ID NO: 5128878 - DNA, 22 bp, Homo sapiens
acaaccggttatcagttggaca

SEQ ID NO: 5128879 - DNA, 22 bp, Homo sapiens
acaaccgtccccggcccctgcc

SEQ ID NO: 5128880 - DNA, 23 bp, Homo sapiens
acaaccgtccccggcccctgccc

SEQ ID NO: 5128881 - DNA, 20 bp, Homo sapiens
acacagtatagataaatcca

SEQ ID NO: 5128882 - DNA, 14 bp, Homo sapiens
acacagtattcaga

SEQ ID NO: 5128883 - DNA, 17 bp, Homo sapiens
acacagtattgacttct

SEQ ID NO: 5128884 - DNA, 23 bp, Homo sapiens
acacagtatttattgttcccaca

SEQ ID NO: 5128885 - DNA, 12 bp, Homo sapiens
acacagtatttt

SEQ ID NO: 5128886 - DNA, 13 bp, Homo sapiens
acacagtattttc

SEQ ID NO: 5128887 - DNA, 15 bp, Homo sapiens
acacagtcaaaataa

SEQ ID NO: 5128888 - DNA, 19 bp, Homo sapiens
acacagtcaaaataattct

SEQ ID NO: 5128889 - DNA, 20 bp, Homo sapiens
acacagtcagggcggggctg

SEQ ID NO: 5128890 - DNA, 13 bp, Homo sapiens
acacagtcatgtg

SEQ ID NO: 5128891 - DNA, 17 bp, Homo sapiens
acacagtccagactcaa

SEQ ID NO: 5128892 - DNA, 19 bp, Homo sapiens
acacagtctcagtccagat

SEQ ID NO: 5128893 - DNA, 15 bp, Homo sapiens
acacagtctgcaaga

SEQ ID NO: 5128894 - DNA, 14 bp, Homo sapiens
acacagtctggtgc

SEQ ID NO: 5128895 - DNA, 16 bp, Homo sapiens
acacagtctgttttct

SEQ ID NO: 5128896 - DNA, 17 bp, Homo sapiens
acacagtgaaaggcctg

SEQ ID NO: 5128897 - DNA, 14 bp, Homo sapiens
acacagtgacaaaa

SEQ ID NO: 5128898 - DNA, 17 bp, Homo sapiens
acacagtgaccatacta

SEQ ID NO: 5128899 - DNA, 18 bp, Homo sapiens
acacagtgagactgtaca

SEQ ID NO: 5128900 - DNA, 21 bp, Homo sapiens
acacagtgagactgtacataa

SEQ ID NO: 5128901 - DNA, 11 bp, Homo sapiens
acacagtgagt

SEQ ID NO: 5128902 - DNA, 13 bp, Homo sapiens
acacagtgagtcg

SEQ ID NO: 5128903 - DNA, 16 bp, Homo sapiens
acacagtgccttcaat

SEQ ID NO: 5128904 - DNA, 13 bp, Homo sapiens
acacagtggactt

SEQ ID NO: 5128905 - DNA, 20 bp, Homo sapiens
acacagtggagcccacgagc

SEQ ID NO: 5128906 - DNA, 18 bp, Homo sapiens
acacagtggccggggctg

SEQ ID NO: 5128907 - DNA, 20 bp, Homo sapiens
acacagtgggaactctgaca

SEQ ID NO: 5128908 - DNA, 11 bp, Homo sapiens
acacagtgtct

SEQ ID NO: 5128909 - DNA, 16 bp, Homo sapiens
acacagtgtctggcac

SEQ ID NO: 5128910 - DNA, 13 bp, Homo sapiens
acacagtgtctgt

SEQ ID NO: 5128911 - DNA, 14 bp, Homo sapiens
acacagtgtctgtt

SEQ ID NO: 5128912 - DNA, 17 bp, Homo sapiens
acacagtgtctgttcag

SEQ ID NO: 5128913 - DNA, 20 bp, Homo sapiens
acacagtgtctgttcagcaa

SEQ ID NO: 5128914 - DNA, 20 bp, Homo sapiens
acacagtgtgaataaagtgc

SEQ ID NO: 5128915 - DNA, 14 bp, Homo sapiens
acacagtgttagtg

SEQ ID NO: 5128916 - DNA, 13 bp, Homo sapiens
acacagtgtttca

SEQ ID NO: 5128917 - DNA, 20 bp, Homo sapiens
acacagtgtttcaattctgt

SEQ ID NO: 5128918 - DNA, 17 bp, Homo sapiens
acacagtgtttcctgag

SEQ ID NO: 5128919 - DNA, 14 bp, Homo sapiens
acacagttaaataa

SEQ ID NO: 5128920 - DNA, 14 bp, Homo sapiens
acacagttatcaaa

SEQ ID NO: 5128921 - DNA, 19 bp, Homo sapiens
acacagttcacaaacagta

SEQ ID NO: 5128922 - DNA, 18 bp, Homo sapiens
acacagttctgggcaaag

SEQ ID NO: 5128923 - DNA, 22 bp, Homo sapiens
acacagttgctgtcataagaat

SEQ ID NO: 5128924 - DNA, 21 bp, Homo sapiens
acacagttgttgaatgactga

SEQ ID NO: 5128925 - DNA, 13 bp, Homo sapiens
acacagtttaaac

SEQ ID NO: 5128926 - DNA, 13 bp, Homo sapiens
acacagtttggtt

SEQ ID NO: 5128927 - DNA, 23 bp, Homo sapiens
acacagttttgacctaacatacc

SEQ ID NO: 5128928 - DNA, 14 bp, Homo sapiens
acacagttttgtct

SEQ ID NO: 5128929 - DNA, 13 bp, Homo sapiens
acacataaaagta

SEQ ID NO: 5128930 - DNA, 16 bp, Homo sapiens
acacataaaagtaatt

SEQ ID NO: 5128931 - DNA, 20 bp, Homo sapiens
acacataaaagtaattaatt

SEQ ID NO: 5128932 - DNA, 13 bp, Homo sapiens
acacataaaggat

SEQ ID NO: 5128933 - DNA, 14 bp, Homo sapiens
acacataaaggata

SEQ ID NO: 5128934 - DNA, 20 bp, Homo sapiens
acacataaatctgtctgatt

SEQ ID NO: 5128935 - DNA, 13 bp, Homo sapiens
acacataaattat

SEQ ID NO: 5128936 - DNA, 14 bp, Homo sapiens
acacataacttctt

SEQ ID NO: 5128937 - DNA, 14 bp, Homo sapiens
acacataagcataa

SEQ ID NO: 5128938 - DNA, 19 bp, Homo sapiens
acacataattaaagtgtcc

SEQ ID NO: 5128939 - DNA, 13 bp, Homo sapiens
acacatacaaaaa

SEQ ID NO: 5128940 - DNA, 14 bp, Homo sapiens
acacatacaacttc

SEQ ID NO: 5128941 - DNA, 23 bp, Homo sapiens
acacatacacacacacacacaaa

SEQ ID NO: 5128942 - DNA, 22 bp, Homo sapiens
acacatacagagctctctgagg

SEQ ID NO: 5128943 - DNA, 14 bp, Homo sapiens
acacatacataatg

SEQ ID NO: 5128944 - DNA, 23 bp, Homo sapiens
acacatacatacacatacataca

SEQ ID NO: 5128945 - DNA, 18 bp, Homo sapiens
acacatacatacatacat

SEQ ID NO: 5128946 - DNA, 22 bp, Homo sapiens
acacatacatacatacatacaa

SEQ ID NO: 5128947 - DNA, 17 bp, Homo sapiens
acacatacctttggtta

SEQ ID NO: 5128948 - DNA, 17 bp, Homo sapiens
acacatacgtgcacagg

SEQ ID NO: 5128949 - DNA, 15 bp, Homo sapiens
acacatactagaaag

SEQ ID NO: 5128950 - DNA, 22 bp, Homo sapiens
acacatactcatttttcatgat

SEQ ID NO: 5128951 - DNA, 19 bp, Homo sapiens
acacatagattcacctgta

SEQ ID NO: 5128952 - DNA, 18 bp, Homo sapiens
acacatagtggcttctcc

SEQ ID NO: 5128953 - DNA, 17 bp, Homo sapiens
acacatataaaaacaat

SEQ ID NO: 5128954 - DNA, 22 bp, Homo sapiens
acacatataaacatcacacaca

SEQ ID NO: 5128955 - DNA, 13 bp, Homo sapiens
acacatatacata

SEQ ID NO: 5128956 - DNA, 16 bp, Homo sapiens
acacatatacatatga

SEQ ID NO: 5128957 - DNA, 13 bp, Homo sapiens
acacatatacatt

SEQ ID NO: 5128958 - DNA, 14 bp, Homo sapiens
acacatatacatta

SEQ ID NO: 5128959 - DNA, 21 bp, Homo sapiens
acacatatacctataatgtgt

SEQ ID NO: 5128960 - DNA, 16 bp, Homo sapiens
acacatatatacatac

SEQ ID NO: 5128961 - DNA, 20 bp, Homo sapiens
acacatatatgtatacgcac

SEQ ID NO: 5128962 - DNA, 22 bp, Homo sapiens
acacatatatgtatacgcacgc

SEQ ID NO: 5128963 - DNA, 16 bp, Homo sapiens
acacatatatgtatat

SEQ ID NO: 5128964 - DNA, 20 bp, Homo sapiens
acacatatgaacgcacaaca

SEQ ID NO: 5128965 - DNA, 22 bp, Homo sapiens
acacatatgaacgcacaacatg

SEQ ID NO: 5128966 - DNA, 10 bp, Homo sapiens
acacatattc

SEQ ID NO: 5128967 - DNA, 12 bp, Homo sapiens
acacatattcaa

SEQ ID NO: 5128968 - DNA, 16 bp, Homo sapiens
acacatcaaataaact

SEQ ID NO: 5128969 - DNA, 14 bp, Homo sapiens
acacatcaaatgcc

SEQ ID NO: 5128970 - DNA, 18 bp, Homo sapiens
acacatcaagcttttctg

SEQ ID NO: 5128971 - DNA, 21 bp, Homo sapiens
acacatcaagcttttctgtag

SEQ ID NO: 5128972 - DNA, 15 bp, Homo sapiens
acacatcagcttgcc

SEQ ID NO: 5128973 - DNA, 20 bp, Homo sapiens
acacatcataaacaaagagt

SEQ ID NO: 5128974 - DNA, 24 bp, Homo sapiens
acacatcatcatcgaagtcttccc

SEQ ID NO: 5128975 - DNA, 17 bp, Homo sapiens
acacatccatatacata

SEQ ID NO: 5128976 - DNA, 16 bp, Homo sapiens
acacatcccagcccaa

SEQ ID NO: 5128977 - DNA, 14 bp, Homo sapiens
acacatcccaggag

SEQ ID NO: 5128978 - DNA, 20 bp, Homo sapiens
acacatcccggcctcttcca

SEQ ID NO: 5128979 - DNA, 22 bp, Homo sapiens
acacatccgccttttgtataca

SEQ ID NO: 5128980 - DNA, 17 bp, Homo sapiens
acacatcgttcgattta

SEQ ID NO: 5128981 - DNA, 14 bp, Homo sapiens
acacatctcctcca

SEQ ID NO: 5128982 - DNA, 22 bp, Homo sapiens
acacatctggctgcacaggctg

SEQ ID NO: 5128983 - DNA, 19 bp, Homo sapiens
acacatctgggtgccctga

SEQ ID NO: 5128984 - DNA, 20 bp, Homo sapiens
acacatctgtaatcctagct

SEQ ID NO: 5128985 - DNA, 15 bp, Homo sapiens
acacatcttaaaagt

SEQ ID NO: 5128986 - DNA, 15 bp, Homo sapiens
acacatcttacctct

SEQ ID NO: 5128987 - DNA, 21 bp, Homo sapiens
acacatcttacctctcatgcg

SEQ ID NO: 5128988 - DNA, 15 bp, Homo sapiens
acacatcttattgaa

SEQ ID NO: 5128989 - DNA, 13 bp, Homo sapiens
acacatcttccac

SEQ ID NO: 5128990 - DNA, 14 bp, Homo sapiens
acacatcttcccta

SEQ ID NO: 5128991 - DNA, 15 bp, Homo sapiens
acacatctttcttga

SEQ ID NO: 5128992 - DNA, 13 bp, Homo sapiens
acacatgaaaaca

SEQ ID NO: 5128993 - DNA, 15 bp, Homo sapiens
acacatgaagtccaa

SEQ ID NO: 5128994 - DNA, 17 bp, Homo sapiens
acacatgataccagcag

SEQ ID NO: 5128995 - DNA, 18 bp, Homo sapiens
acacatgcaaggtcattt

SEQ ID NO: 5128996 - DNA, 20 bp, Homo sapiens
acacatgcaaggtcattttt

SEQ ID NO: 5128997 - DNA, 14 bp, Homo sapiens
acacatgcactcag

SEQ ID NO: 5128998 - DNA, 21 bp, Homo sapiens
acacatgcacttttgggcctt

SEQ ID NO: 5128999 - DNA, 13 bp, Homo sapiens
acacatgcataca

SEQ ID NO: 5129000 - DNA, 17 bp, Homo sapiens
acacatgcatacacaca

SEQ ID NO: 5129001 - DNA, 18 bp, Homo sapiens
acacatgcatacacacac

SEQ ID NO: 5129002 - DNA, 19 bp, Homo sapiens
acacatgcatacacacaca

SEQ ID NO: 5129003 - DNA, 17 bp, Homo sapiens
acacatgcatacttaca

SEQ ID NO: 5129004 - DNA, 18 bp, Homo sapiens
acacatgcatacttacag

SEQ ID NO: 5129005 - DNA, 18 bp, Homo sapiens
acacatgcatcctcccct

SEQ ID NO: 5129006 - DNA, 21 bp, Homo sapiens
acacatgcatcctcccctctc

SEQ ID NO: 5129007 - DNA, 19 bp, Homo sapiens
acacatgccaacacttaat

SEQ ID NO: 5129008 - DNA, 16 bp, Homo sapiens
acacatgccactatga

SEQ ID NO: 5129009 - DNA, 14 bp, Homo sapiens
acacatgcccctcc

SEQ ID NO: 5129010 - DNA, 16 bp, Homo sapiens
acacatgcccctcccc

SEQ ID NO: 5129011 - DNA, 18 bp, Homo sapiens
acacatgccctcctggac

SEQ ID NO: 5129012 - DNA, 23 bp, Homo sapiens
acacatgccttaaatttgtttaa

SEQ ID NO: 5129013 - DNA, 17 bp, Homo sapiens
acacatgctatgttctg

SEQ ID NO: 5129014 - DNA, 18 bp, Homo sapiens
acacatgctgaacatcac

SEQ ID NO: 5129015 - DNA, 20 bp, Homo sapiens
acacatgctgaggttttgaa

SEQ ID NO: 5129016 - DNA, 23 bp, Homo sapiens
acacatgctgaggttttgaataa

SEQ ID NO: 5129017 - DNA, 19 bp, Homo sapiens
acacatgctgccttcttgg

SEQ ID NO: 5129018 - DNA, 23 bp, Homo sapiens
acacatgctgttggcctcaagca

SEQ ID NO: 5129019 - DNA, 19 bp, Homo sapiens
acacatgcttccctttcct

SEQ ID NO: 5129020 - DNA, 22 bp, Homo sapiens
acacatggctatcctagagagg

SEQ ID NO: 5129021 - DNA, 20 bp, Homo sapiens
acacatggcttcctaaatgg

SEQ ID NO: 5129022 - DNA, 22 bp, Homo sapiens
acacatgtccaagaagcccagg

SEQ ID NO: 5129023 - DNA, 14 bp, Homo sapiens
acacatgtgtatga

SEQ ID NO: 5129024 - DNA, 17 bp, Homo sapiens
acacatgtgttatctac

SEQ ID NO: 5129025 - DNA, 23 bp, Homo sapiens
acacatgtgttatctacctcaag

SEQ ID NO: 5129026 - DNA, 19 bp, Homo sapiens
acacattaaaagacaaata

SEQ ID NO: 5129027 - DNA, 21 bp, Homo sapiens
acacattaaaagacaaatatg

SEQ ID NO: 5129028 - DNA, 16 bp, Homo sapiens
acacattaaacaggat

SEQ ID NO: 5129029 - DNA, 14 bp, Homo sapiens
acacattaaatgtg

SEQ ID NO: 5129030 - DNA, 13 bp, Homo sapiens
acacattaataaa

SEQ ID NO: 5129031 - DNA, 18 bp, Homo sapiens
acacattaataaacaatc

SEQ ID NO: 5129032 - DNA, 14 bp, Homo sapiens
acacattacaaagt

SEQ ID NO: 5129033 - DNA, 18 bp, Homo sapiens
acacattacaaagttaaa

SEQ ID NO: 5129034 - DNA, 16 bp, Homo sapiens
acacattacagccagg

SEQ ID NO: 5129035 - DNA, 18 bp, Homo sapiens
acacattacttgcacaag

SEQ ID NO: 5129036 - DNA, 23 bp, Homo sapiens
acacattagatgttactgtgtga

SEQ ID NO: 5129037 - DNA, 16 bp, Homo sapiens
acacattaggaaaagt

SEQ ID NO: 5129038 - DNA, 23 bp, Homo sapiens
acacattatcactgaaaaaatgt

SEQ ID NO: 5129039 - DNA, 20 bp, Homo sapiens
acacattatcgggagcagtg

SEQ ID NO: 5129040 - DNA, 23 bp, Homo sapiens
acacattatcgggagcagtgtct

SEQ ID NO: 5129041 - DNA, 13 bp, Homo sapiens
acacattatcttc

SEQ ID NO: 5129042 - DNA, 14 bp, Homo sapiens
acacattccagcca

SEQ ID NO: 5129043 - DNA, 17 bp, Homo sapiens
acacattccagccaggc

SEQ ID NO: 5129044 - DNA, 20 bp, Homo sapiens
acacattccagccaggccca

SEQ ID NO: 5129045 - DNA, 18 bp, Homo sapiens
acacattccagggctggg

SEQ ID NO: 5129046 - DNA, 23 bp, Homo sapiens
acacattcccccaccagctgcag

SEQ ID NO: 5129047 - DNA, 23 bp, Homo sapiens
acacattctcacaattgtaaagt

SEQ ID NO: 5129048 - DNA, 22 bp, Homo sapiens
acacattgactcctttccaata

SEQ ID NO: 5129049 - DNA, 14 bp, Homo sapiens
acacattgcacaca

SEQ ID NO: 5129050 - DNA, 15 bp, Homo sapiens
acacattgccttctg

SEQ ID NO: 5129051 - DNA, 14 bp, Homo sapiens
acacattgtgcttg

SEQ ID NO: 5129052 - DNA, 17 bp, Homo sapiens
acacatttaaaacattt

SEQ ID NO: 5129053 - DNA, 18 bp, Homo sapiens
acacatttaaaacatttg

SEQ ID NO: 5129054 - DNA, 14 bp, Homo sapiens
acacatttaattca

SEQ ID NO: 5129055 - DNA, 13 bp, Homo sapiens
acacatttaccaa

SEQ ID NO: 5129056 - DNA, 15 bp, Homo sapiens
acacatttcaaatga

SEQ ID NO: 5129057 - DNA, 13 bp, Homo sapiens
acacatttcacat

SEQ ID NO: 5129058 - DNA, 15 bp, Homo sapiens
acacatttccattca

SEQ ID NO: 5129059 - DNA, 21 bp, Homo sapiens
acacatttcttaaaacacatg

SEQ ID NO: 5129060 - DNA, 14 bp, Homo sapiens
acaacctagaatgt

SEQ ID NO: 5129061 - DNA, 13 bp, Homo sapiens
acaacctatgtaa

SEQ ID NO: 5129062 - DNA, 15 bp, Homo sapiens
acaacctcaactgcc

SEQ ID NO: 5129063 - DNA, 14 bp, Homo sapiens
acaacctcaccaaa

SEQ ID NO: 5129064 - DNA, 17 bp, Homo sapiens
acaacctccacctcctg

SEQ ID NO: 5129065 - DNA, 18 bp, Homo sapiens
acaacctccacctcctgg

SEQ ID NO: 5129066 - DNA, 22 bp, Homo sapiens
acaacctccattctattttaga

SEQ ID NO: 5129067 - DNA, 17 bp, Homo sapiens
acaacctccctcttgtt

SEQ ID NO: 5129068 - DNA, 18 bp, Homo sapiens
acaacctccctcttgttt

SEQ ID NO: 5129069 - DNA, 20 bp, Homo sapiens
acaacctctctgatcttgtg

SEQ ID NO: 5129070 - DNA, 17 bp, Homo sapiens
acaacctgaaagacaaa

SEQ ID NO: 5129071 - DNA, 15 bp, Homo sapiens
acaacctgaatcttt

SEQ ID NO: 5129072 - DNA, 15 bp, Homo sapiens
acaacctgcccctcc

SEQ ID NO: 5129073 - DNA, 16 bp, Homo sapiens
acaacctgcccctccc

SEQ ID NO: 5129074 - DNA, 22 bp, Homo sapiens
acaacctgcttgggtggagaag

SEQ ID NO: 5129075 - DNA, 23 bp, Homo sapiens
acaacctgtgtgagagaatttat

SEQ ID NO: 5129076 - DNA, 12 bp, Homo sapiens
acaaccttcagc

SEQ ID NO: 5129077 - DNA, 12 bp, Homo sapiens
acaaccttgcag

SEQ ID NO: 5129078 - DNA, 22 bp, Homo sapiens
acaacgcaaacctctccttcct

SEQ ID NO: 5129079 - DNA, 23 bp, Homo sapiens
acaacgctctaccctgcagcttg

SEQ ID NO: 5129080 - DNA, 22 bp, Homo sapiens
acaacggaggcctgcgaccctg

SEQ ID NO: 5129081 - DNA, 15 bp, Homo sapiens
acaacgtaaaaataa

SEQ ID NO: 5129082 - DNA, 19 bp, Homo sapiens
acaacgtcccctcaagccc

SEQ ID NO: 5129083 - DNA, 16 bp, Homo sapiens
acaacgtgagagaaag

SEQ ID NO: 5129084 - DNA, 16 bp, Homo sapiens
acaacgtgcattgtgc

SEQ ID NO: 5129085 - DNA, 18 bp, Homo sapiens
acaacgtgcattgtgctt

SEQ ID NO: 5129086 - DNA, 13 bp, Homo sapiens
acaactaaaaaaa

SEQ ID NO: 5129087 - DNA, 13 bp, Homo sapiens
acaactaaataac

SEQ ID NO: 5129088 - DNA, 17 bp, Homo sapiens
acaactaacttgtttga

SEQ ID NO: 5129089 - DNA, 18 bp, Homo sapiens
acaactaacttgtttgag

SEQ ID NO: 5129090 - DNA, 19 bp, Homo sapiens
acaactacagaaaaaccag

SEQ ID NO: 5129091 - DNA, 23 bp, Homo sapiens
acaactagatttgtccttttatt

SEQ ID NO: 5129092 - DNA, 22 bp, Homo sapiens
acaactagcctcatctccagta

SEQ ID NO: 5129093 - DNA, 18 bp, Homo sapiens
acaactatgatttggaaa

SEQ ID NO: 5129094 - DNA, 17 bp, Homo sapiens
acaactcactcctttta

SEQ ID NO: 5129095 - DNA, 19 bp, Homo sapiens
acaactcagaatgggggct

SEQ ID NO: 5129096 - DNA, 13 bp, Homo sapiens
acaactccagcca

SEQ ID NO: 5129097 - DNA, 20 bp, Homo sapiens
acaactccaggaaaactgtt

SEQ ID NO: 5129098 - DNA, 15 bp, Homo sapiens
acaactcccttgcac

SEQ ID NO: 5129099 - DNA, 21 bp, Homo sapiens
acaactctactgttgcaaagc

SEQ ID NO: 5129100 - DNA, 13 bp, Homo sapiens
acaactctccaaa

SEQ ID NO: 5129101 - DNA, 12 bp, Homo sapiens
acaactctgcct

SEQ ID NO: 5129102 - DNA, 19 bp, Homo sapiens
acaactgaaagaaaaagta

SEQ ID NO: 5129103 - DNA, 12 bp, Homo sapiens
acaactgacaca

SEQ ID NO: 5129104 - DNA, 16 bp, Homo sapiens
acaactgacacaggaa

SEQ ID NO: 5129105 - DNA, 17 bp, Homo sapiens
acaactgatcatttgca

SEQ ID NO: 5129106 - DNA, 20 bp, Homo sapiens
acaactgcaataacttctga

SEQ ID NO: 5129107 - DNA, 18 bp, Homo sapiens
acaactgcacatgaaagt

SEQ ID NO: 5129108 - DNA, 12 bp, Homo sapiens
acaactgcggtg

SEQ ID NO: 5129109 - DNA, 17 bp, Homo sapiens
acaactgctgtggcccc

SEQ ID NO: 5129110 - DNA, 19 bp, Homo sapiens
acaactgctgtggccccct

SEQ ID NO: 5129111 - DNA, 15 bp, Homo sapiens
acaactggaaataaa

SEQ ID NO: 5129112 - DNA, 19 bp, Homo sapiens
acaactggaatagtttttt

SEQ ID NO: 5129113 - DNA, 16 bp, Homo sapiens
acaactggcaggcagg

SEQ ID NO: 5129114 - DNA, 17 bp, Homo sapiens
acaactggtctgttaat

SEQ ID NO: 5129115 - DNA, 20 bp, Homo sapiens
acaactgtcagaataaagaa

SEQ ID NO: 5129116 - DNA, 23 bp, Homo sapiens
acaactgtcagaataaagaacat

SEQ ID NO: 5129117 - DNA, 22 bp, Homo sapiens
acaactgtcagttcatcctgca

SEQ ID NO: 5129118 - DNA, 17 bp, Homo sapiens
acaactgtggataaatt

SEQ ID NO: 5129119 - DNA, 22 bp, Homo sapiens
acaactgtggataaattttgga

SEQ ID NO: 5129120 - DNA, 13 bp, Homo sapiens
acaactgttcccg

SEQ ID NO: 5129121 - DNA, 17 bp, Homo sapiens
acaactgtttgtctttt

SEQ ID NO: 5129122 - DNA, 18 bp, Homo sapiens
acaactgtttttgaagaa

SEQ ID NO: 5129123 - DNA, 15 bp, Homo sapiens
acaacttaaataata

SEQ ID NO: 5129124 - DNA, 15 bp, Homo sapiens
acaacttaatggaaa

SEQ ID NO: 5129125 - DNA, 16 bp, Homo sapiens
acaacttaattgctct

SEQ ID NO: 5129126 - DNA, 18 bp, Homo sapiens
acaacttagaaaccaaat

SEQ ID NO: 5129127 - DNA, 16 bp, Homo sapiens
acaacttagctcaggt

SEQ ID NO: 5129128 - DNA, 14 bp, Homo sapiens
acaacttagtgtaa

SEQ ID NO: 5129129 - DNA, 23 bp, Homo sapiens
acaacttataattacaatgcaca

SEQ ID NO: 5129130 - DNA, 20 bp, Homo sapiens
acaacttatgactaaaaata

SEQ ID NO: 5129131 - DNA, 22 bp, Homo sapiens
acaacttatttaaaaatatttc

SEQ ID NO: 5129132 - DNA, 18 bp, Homo sapiens
acaacttcagcaggggat

SEQ ID NO: 5129133 - DNA, 14 bp, Homo sapiens
acaacttcagcagt

SEQ ID NO: 5129134 - DNA, 12 bp, Homo sapiens
acaacttccaga

SEQ ID NO: 5129135 - DNA, 14 bp, Homo sapiens
acaacttccagatt

SEQ ID NO: 5129136 - DNA, 19 bp, Homo sapiens
acaacttcccattaaaaat

SEQ ID NO: 5129137 - DNA, 20 bp, Homo sapiens
acaacttccgttgctgccat

SEQ ID NO: 5129138 - DNA, 16 bp, Homo sapiens
acaacttctgtttctt

SEQ ID NO: 5129139 - DNA, 16 bp, Homo sapiens
acaacttgaagattgt

SEQ ID NO: 5129140 - DNA, 22 bp, Homo sapiens
acaacttgaagattgtagcaat

SEQ ID NO: 5129141 - DNA, 15 bp, Homo sapiens
acaacttgaattaca

SEQ ID NO: 5129142 - DNA, 18 bp, Homo sapiens
acaacttgatacttttat

SEQ ID NO: 5129143 - DNA, 24 bp, Homo sapiens
acaacttgcacgtattttaatagc

SEQ ID NO: 5129144 - DNA, 18 bp, Homo sapiens
acaacttggcatttctat

SEQ ID NO: 5129145 - DNA, 18 bp, Homo sapiens
acaacttgtagcagctat

SEQ ID NO: 5129146 - DNA, 15 bp, Homo sapiens
acaacttgtatttcc

SEQ ID NO: 5129147 - DNA, 16 bp, Homo sapiens
acaacttgtgttctat

SEQ ID NO: 5129148 - DNA, 21 bp, Homo sapiens
acaactttaccataaagcctt

SEQ ID NO: 5129149 - DNA, 13 bp, Homo sapiens
acaactttatacc

SEQ ID NO: 5129150 - DNA, 14 bp, Homo sapiens
acaactttataccc

SEQ ID NO: 5129151 - DNA, 21 bp, Homo sapiens
acaactttattgattgaattt

SEQ ID NO: 5129152 - DNA, 12 bp, Homo sapiens
acaactttcact

SEQ ID NO: 5129153 - DNA, 21 bp, Homo sapiens
acaactttcactttgcaaaga

SEQ ID NO: 5129154 - DNA, 13 bp, Homo sapiens
acaactttcagtg

SEQ ID NO: 5129155 - DNA, 16 bp, Homo sapiens
acaactttcatttaac

SEQ ID NO: 5129156 - DNA, 18 bp, Homo sapiens
acaactttctcttgtaaa

SEQ ID NO: 5129157 - DNA, 23 bp, Homo sapiens
acaactttgcaaattatttatta

SEQ ID NO: 5129158 - DNA, 19 bp, Homo sapiens
acaactttggaatttgaag

SEQ ID NO: 5129159 - DNA, 20 bp, Homo sapiens
acaactttgtcgtggttctt

SEQ ID NO: 5129160 - DNA, 23 bp, Homo sapiens
acaactttgtcgtggttcttaaa

SEQ ID NO: 5129161 - DNA, 17 bp, Homo sapiens
acaactttgtttctcat

SEQ ID NO: 5129162 - DNA, 20 bp, Homo sapiens
acaacttttaaagaaaaata

SEQ ID NO: 5129163 - DNA, 18 bp, Homo sapiens
acaacttttttttctttt

SEQ ID NO: 5129164 - DNA, 16 bp, Homo sapiens
acaagaaaaaatgaat

SEQ ID NO: 5129165 - DNA, 16 bp, Homo sapiens
acaagaaaaagataag

SEQ ID NO: 5129166 - DNA, 19 bp, Homo sapiens
acaagaaaaagtagaaaaa

SEQ ID NO: 5129167 - DNA, 17 bp, Homo sapiens
acaagaaaaataaagaa

SEQ ID NO: 5129168 - DNA, 12 bp, Homo sapiens
acaagaaaacat

SEQ ID NO: 5129169 - DNA, 23 bp, Homo sapiens
acaagaaaataagagctcaggat

SEQ ID NO: 5129170 - DNA, 12 bp, Homo sapiens
acaagaaaatgt

SEQ ID NO: 5129171 - DNA, 22 bp, Homo sapiens
acaagaaaccaagtgggctggt

SEQ ID NO: 5129172 - DNA, 20 bp, Homo sapiens
acaagaaactcaatgcacaa

SEQ ID NO: 5129173 - DNA, 11 bp, Homo sapiens
acaagaaactg

SEQ ID NO: 5129174 - DNA, 13 bp, Homo sapiens
acaagaaactttg

SEQ ID NO: 5129175 - DNA, 13 bp, Homo sapiens
acaagaaagaaac

SEQ ID NO: 5129176 - DNA, 13 bp, Homo sapiens
acaagaaaggaga

SEQ ID NO: 5129177 - DNA, 17 bp, Homo sapiens
acaagaaaggagagtct

SEQ ID NO: 5129178 - DNA, 18 bp, Homo sapiens
acaagaaaggagagtctt

SEQ ID NO: 5129179 - DNA, 18 bp, Homo sapiens
acaagaaaggcagacaca

SEQ ID NO: 5129180 - DNA, 22 bp, Homo sapiens
acaagaaaggctgctgtactga

SEQ ID NO: 5129181 - DNA, 15 bp, Homo sapiens
acaagaaagtggtct

SEQ ID NO: 5129182 - DNA, 18 bp, Homo sapiens
acaagaaatttgatttct

SEQ ID NO: 5129183 - DNA, 11 bp, Homo sapiens
acaagaacaac

SEQ ID NO: 5129184 - DNA, 19 bp, Homo sapiens
acaagaacacacacatata

SEQ ID NO: 5129185 - DNA, 13 bp, Homo sapiens
acaagaacattct

SEQ ID NO: 5129186 - DNA, 14 bp, Homo sapiens
acaagaagaaatat

SEQ ID NO: 5129187 - DNA, 19 bp, Homo sapiens
acaagaagaaatatgaaat

SEQ ID NO: 5129188 - DNA, 14 bp, Homo sapiens
acaagaagaccccg

SEQ ID NO: 5129189 - DNA, 13 bp, Homo sapiens
acaagaagagtaa

SEQ ID NO: 5129190 - DNA, 13 bp, Homo sapiens
acaagaagatgaa

SEQ ID NO: 5129191 - DNA, 20 bp, Homo sapiens
acaagaagccacagacctag

SEQ ID NO: 5129192 - DNA, 13 bp, Homo sapiens
acaagaagcccag

SEQ ID NO: 5129193 - DNA, 20 bp, Homo sapiens
acaagaagcccagtggtgag

SEQ ID NO: 5129194 - DNA, 17 bp, Homo sapiens
acaagaaggccagccca

SEQ ID NO: 5129195 - DNA, 22 bp, Homo sapiens
acaagaaggccagcccactggg

SEQ ID NO: 5129196 - DNA, 23 bp, Homo sapiens
acaagaaggccagcccactgggc

SEQ ID NO: 5129197 - DNA, 17 bp, Homo sapiens
acaagaaggtttctgtc

SEQ ID NO: 5129198 - DNA, 21 bp, Homo sapiens
acaagaagtgggagtgggaga

SEQ ID NO: 5129199 - DNA, 17 bp, Homo sapiens
acaagaataaaggcagc

SEQ ID NO: 5129200 - DNA, 18 bp, Homo sapiens
acaagaataaaggcagct

SEQ ID NO: 5129201 - DNA, 16 bp, Homo sapiens
acaagaatatgttcac

SEQ ID NO: 5129202 - DNA, 17 bp, Homo sapiens
acaagaatcacttgaac

SEQ ID NO: 5129203 - DNA, 15 bp, Homo sapiens
acaagaatgaaggtt

SEQ ID NO: 5129204 - DNA, 23 bp, Homo sapiens
acaagaatgcattccctgaatct

SEQ ID NO: 5129205 - DNA, 13 bp, Homo sapiens
acaagaatggatc

SEQ ID NO: 5129206 - DNA, 14 bp, Homo sapiens
acaagaatggtgtg

SEQ ID NO: 5129207 - DNA, 11 bp, Homo sapiens
acaagaatgtc

SEQ ID NO: 5129208 - DNA, 18 bp, Homo sapiens
acaagacaagctcctccc

SEQ ID NO: 5129209 - DNA, 19 bp, Homo sapiens
acaagacaagctcctccct

SEQ ID NO: 5129210 - DNA, 14 bp, Homo sapiens
acaagacacagtga

SEQ ID NO: 5129211 - DNA, 15 bp, Homo sapiens
acaagacagcagagc

SEQ ID NO: 5129212 - DNA, 21 bp, Homo sapiens
acaagacatttctttctgttt

SEQ ID NO: 5129213 - DNA, 20 bp, Homo sapiens
acaagacccaaaaggcagaa

SEQ ID NO: 5129214 - DNA, 18 bp, Homo sapiens
acaagacccccaggaagg

SEQ ID NO: 5129215 - DNA, 16 bp, Homo sapiens
acaagacccctgctcc

SEQ ID NO: 5129216 - DNA, 19 bp, Homo sapiens
acaagacccttgtggtccc

SEQ ID NO: 5129217 - DNA, 15 bp, Homo sapiens
acaagacctctggct

SEQ ID NO: 5129218 - DNA, 14 bp, Homo sapiens
acaagactgcctcc

SEQ ID NO: 5129219 - DNA, 15 bp, Homo sapiens
acaagactggcccag

SEQ ID NO: 5129220 - DNA, 21 bp, Homo sapiens
acaagactggcccagtgccag

SEQ ID NO: 5129221 - DNA, 14 bp, Homo sapiens
acaagactgtaaat

SEQ ID NO: 5129222 - DNA, 16 bp, Homo sapiens
acaagactgttgtgat

SEQ ID NO: 5129223 - DNA, 14 bp, Homo sapiens
acaagagaagcatt

SEQ ID NO: 5129224 - DNA, 15 bp, Homo sapiens
acaagagaagcattc

SEQ ID NO: 5129225 - DNA, 19 bp, Homo sapiens
acaagagaagcattctcat

SEQ ID NO: 5129226 - DNA, 16 bp, Homo sapiens
acaagagaatgctgtc

SEQ ID NO: 5129227 - DNA, 20 bp, Homo sapiens
acaagagaccacttccttaa

SEQ ID NO: 5129228 - DNA, 22 bp, Homo sapiens
acaagagaccacttccttaaca

SEQ ID NO: 5129229 - DNA, 23 bp, Homo sapiens
acaagagaccacttccttaacag

SEQ ID NO: 5129230 - DNA, 16 bp, Homo sapiens
acaagagatcagcagt

SEQ ID NO: 5129231 - DNA, 19 bp, Homo sapiens
acaagagatctacacatgt

SEQ ID NO: 5129232 - DNA, 15 bp, Homo sapiens
acaagagcactacat

SEQ ID NO: 5129233 - DNA, 16 bp, Homo sapiens
acaagagcagcctgtg

SEQ ID NO: 5129234 - DNA, 18 bp, Homo sapiens
acaagagcttaacagtgt

SEQ ID NO: 5129235 - DNA, 20 bp, Homo sapiens
acaagaggaagagagagacc

SEQ ID NO: 5129236 - DNA, 23 bp, Homo sapiens
acaagaggacacaatggcacctc

SEQ ID NO: 5129237 - DNA, 14 bp, Homo sapiens
acaagaggagcagg

SEQ ID NO: 5129238 - DNA, 23 bp, Homo sapiens
acaagagggaatagtatagacaa

SEQ ID NO: 5129239 - DNA, 15 bp, Homo sapiens
acacatttgcccaat

SEQ ID NO: 5129240 - DNA, 19 bp, Homo sapiens
acacatttgcccaattcca

SEQ ID NO: 5129241 - DNA, 20 bp, Homo sapiens
acacatttgctactgttgta

SEQ ID NO: 5129242 - DNA, 21 bp, Homo sapiens
acacatttggccacaaaacac

SEQ ID NO: 5129243 - DNA, 23 bp, Homo sapiens
acacatttgggatgttccttttt

SEQ ID NO: 5129244 - DNA, 11 bp, Homo sapiens
acacatttgta

SEQ ID NO: 5129245 - DNA, 13 bp, Homo sapiens
acacatttgtaca

SEQ ID NO: 5129246 - DNA, 23 bp, Homo sapiens
acacatttgttgccagatttcag

SEQ ID NO: 5129247 - DNA, 13 bp, Homo sapiens
acacattttatga

SEQ ID NO: 5129248 - DNA, 14 bp, Homo sapiens
acacattttatgag

SEQ ID NO: 5129249 - DNA, 14 bp, Homo sapiens
acacattttatttt

SEQ ID NO: 5129250 - DNA, 14 bp, Homo sapiens
acacattttctcct

SEQ ID NO: 5129251 - DNA, 17 bp, Homo sapiens
acacattttctcctagg

SEQ ID NO: 5129252 - DNA, 12 bp, Homo sapiens
acacattttgta

SEQ ID NO: 5129253 - DNA, 13 bp, Homo sapiens
acacattttgtaa

SEQ ID NO: 5129254 - DNA, 19 bp, Homo sapiens
acacattttgtaaatctgt

SEQ ID NO: 5129255 - DNA, 16 bp, Homo sapiens
acacattttgtataat

SEQ ID NO: 5129256 - DNA, 20 bp, Homo sapiens
acacatttttaaagtctaaa

SEQ ID NO: 5129257 - DNA, 21 bp, Homo sapiens
acacatttttaaagtctaaac

SEQ ID NO: 5129258 - DNA, 11 bp, Homo sapiens
acacatttttg

SEQ ID NO: 5129259 - DNA, 18 bp, Homo sapiens
acacattttttaaatgca

SEQ ID NO: 5129260 - DNA, 19 bp, Homo sapiens
acacattttttaaatgcac

SEQ ID NO: 5129261 - DNA, 20 bp, Homo sapiens
acacattttttaaatgcacc

SEQ ID NO: 5129262 - DNA, 13 bp, Homo sapiens
acacatttttttg

SEQ ID NO: 5129263 - DNA, 14 bp, Homo sapiens
acaccaaaaaatat

SEQ ID NO: 5129264 - DNA, 15 bp, Homo sapiens
acaccaaaaaatatc

SEQ ID NO: 5129265 - DNA, 15 bp, Homo sapiens
acaccaaaatgaacc

SEQ ID NO: 5129266 - DNA, 14 bp, Homo sapiens
acaccaaacatttc

SEQ ID NO: 5129267 - DNA, 13 bp, Homo sapiens
acaccaaacttca

SEQ ID NO: 5129268 - DNA, 18 bp, Homo sapiens
acaccaaacttcattttt

SEQ ID NO: 5129269 - DNA, 15 bp, Homo sapiens
acaccaaagaattgt

SEQ ID NO: 5129270 - DNA, 23 bp, Homo sapiens
acaccaaattctgtggctgccat

SEQ ID NO: 5129271 - DNA, 18 bp, Homo sapiens
acaccaaattgctgagat

SEQ ID NO: 5129272 - DNA, 15 bp, Homo sapiens
acaccaacactgtaa

SEQ ID NO: 5129273 - DNA, 17 bp, Homo sapiens
acaccaacataaaaatg

SEQ ID NO: 5129274 - DNA, 18 bp, Homo sapiens
acaccaaccagacagcac

SEQ ID NO: 5129275 - DNA, 14 bp, Homo sapiens
acaccaacccctga

SEQ ID NO: 5129276 - DNA, 16 bp, Homo sapiens
acaccaagatgtctgt

SEQ ID NO: 5129277 - DNA, 13 bp, Homo sapiens
acaccaagcagca

SEQ ID NO: 5129278 - DNA, 17 bp, Homo sapiens
acaccaagctgtgccac

SEQ ID NO: 5129279 - DNA, 21 bp, Homo sapiens
acaccaagctgtgccaccctg

SEQ ID NO: 5129280 - DNA, 14 bp, Homo sapiens
acaccaaggaagct

SEQ ID NO: 5129281 - DNA, 14 bp, Homo sapiens
acaccaaggccctg

SEQ ID NO: 5129282 - DNA, 13 bp, Homo sapiens
acaccaagtaaat

SEQ ID NO: 5129283 - DNA, 17 bp, Homo sapiens
acaccaagtggctgggt

SEQ ID NO: 5129284 - DNA, 14 bp, Homo sapiens
acaccaataaatgt

SEQ ID NO: 5129285 - DNA, 20 bp, Homo sapiens
acaccaataaatgtttgtta

SEQ ID NO: 5129286 - DNA, 23 bp, Homo sapiens
acaccaatattaacacgctgcct

SEQ ID NO: 5129287 - DNA, 17 bp, Homo sapiens
acaccaatcagcgctct

SEQ ID NO: 5129288 - DNA, 14 bp, Homo sapiens
acaccaatcccagg

SEQ ID NO: 5129289 - DNA, 23 bp, Homo sapiens
acaccaatcccagggctggctct

SEQ ID NO: 5129290 - DNA, 16 bp, Homo sapiens
acaccaatgaaaacat

SEQ ID NO: 5129291 - DNA, 20 bp, Homo sapiens
acaccaatgaaaacatgtac

SEQ ID NO: 5129292 - DNA, 18 bp, Homo sapiens
acaccaatttagaatgaa

SEQ ID NO: 5129293 - DNA, 15 bp, Homo sapiens
acaccacaagtatct

SEQ ID NO: 5129294 - DNA, 18 bp, Homo sapiens
acaccacagacacacaca

SEQ ID NO: 5129295 - DNA, 15 bp, Homo sapiens
acaccacagacgcca

SEQ ID NO: 5129296 - DNA, 17 bp, Homo sapiens
acaccacagcattgtgt

SEQ ID NO: 5129297 - DNA, 14 bp, Homo sapiens
acaccacagcctcc

SEQ ID NO: 5129298 - DNA, 14 bp, Homo sapiens
acaccacatgctat

SEQ ID NO: 5129299 - DNA, 18 bp, Homo sapiens
acaccaccactgtgtccc

SEQ ID NO: 5129300 - DNA, 19 bp, Homo sapiens
acaccaccactgtgtccca

SEQ ID NO: 5129301 - DNA, 21 bp, Homo sapiens
acaccacccagagcaccctct

SEQ ID NO: 5129302 - DNA, 19 bp, Homo sapiens
acaccaccccttgcccaac

SEQ ID NO: 5129303 - DNA, 18 bp, Homo sapiens
acaccacctcactcctgt

SEQ ID NO: 5129304 - DNA, 14 bp, Homo sapiens
acaccactacattc

SEQ ID NO: 5129305 - DNA, 21 bp, Homo sapiens
acaccactacattctgttaat

SEQ ID NO: 5129306 - DNA, 13 bp, Homo sapiens
acaccactcctgc

SEQ ID NO: 5129307 - DNA, 14 bp, Homo sapiens
acaccactcctgcc

SEQ ID NO: 5129308 - DNA, 18 bp, Homo sapiens
acaccactcctgccagcc

SEQ ID NO: 5129309 - DNA, 20 bp, Homo sapiens
acaccactcctgccagcccg

SEQ ID NO: 5129310 - DNA, 13 bp, Homo sapiens
acaccactctggc

SEQ ID NO: 5129311 - DNA, 16 bp, Homo sapiens
acaccactctggcagc

SEQ ID NO: 5129312 - DNA, 18 bp, Homo sapiens
acaccactgccctgcctg

SEQ ID NO: 5129313 - DNA, 11 bp, Homo sapiens
acaccactggg

SEQ ID NO: 5129314 - DNA, 13 bp, Homo sapiens
acaccactgggaa

SEQ ID NO: 5129315 - DNA, 13 bp, Homo sapiens
acaccactgtact

SEQ ID NO: 5129316 - DNA, 14 bp, Homo sapiens
acaccacttaatct

SEQ ID NO: 5129317 - DNA, 15 bp, Homo sapiens
acaccacttaatctt

SEQ ID NO: 5129318 - DNA, 19 bp, Homo sapiens
acaccacttagatttaaag

SEQ ID NO: 5129319 - DNA, 23 bp, Homo sapiens
acaccagactgaagtaaacagct

SEQ ID NO: 5129320 - DNA, 19 bp, Homo sapiens
acaccagagacaagcagag

SEQ ID NO: 5129321 - DNA, 19 bp, Homo sapiens
acaccagagcagatgcaga

SEQ ID NO: 5129322 - DNA, 20 bp, Homo sapiens
acaccagagcagatgcagag

SEQ ID NO: 5129323 - DNA, 13 bp, Homo sapiens
acaccagagccca

SEQ ID NO: 5129324 - DNA, 23 bp, Homo sapiens
acaccagagcccaccttggctca

SEQ ID NO: 5129325 - DNA, 12 bp, Homo sapiens
acaccagagctg

SEQ ID NO: 5129326 - DNA, 21 bp, Homo sapiens
acaccagagtgtagaataata

SEQ ID NO: 5129327 - DNA, 15 bp, Homo sapiens
acaccagatttttag

SEQ ID NO: 5129328 - DNA, 16 bp, Homo sapiens
acaccagcagcactgg

SEQ ID NO: 5129329 - DNA, 16 bp, Homo sapiens
acaccagccaggctct

SEQ ID NO: 5129330 - DNA, 12 bp, Homo sapiens
acaccagccctg

SEQ ID NO: 5129331 - DNA, 13 bp, Homo sapiens
acaccagccctgc

SEQ ID NO: 5129332 - DNA, 23 bp, Homo sapiens
acaccagccctgctgcttcctaa

SEQ ID NO: 5129333 - DNA, 14 bp, Homo sapiens
acaccagccctggt

SEQ ID NO: 5129334 - DNA, 13 bp, Homo sapiens
acaccagccgctg

SEQ ID NO: 5129335 - DNA, 20 bp, Homo sapiens
acaccagcctttctcccagg

SEQ ID NO: 5129336 - DNA, 14 bp, Homo sapiens
acaccagctgctgc

SEQ ID NO: 5129337 - DNA, 23 bp, Homo sapiens
acaccagctgttctgtcccttgg

SEQ ID NO: 5129338 - DNA, 15 bp, Homo sapiens
acaccaggactttaa

SEQ ID NO: 5129339 - DNA, 17 bp, Homo sapiens
acaccaggagtccctgg

SEQ ID NO: 5129340 - DNA, 19 bp, Homo sapiens
acaccaggagtccctggta

SEQ ID NO: 5129341 - DNA, 22 bp, Homo sapiens
acaccaggatagagactggaac

SEQ ID NO: 5129342 - DNA, 18 bp, Homo sapiens
acaccaggctgtgggcct

SEQ ID NO: 5129343 - DNA, 21 bp, Homo sapiens
acaccaggcttgcctgcaggc

SEQ ID NO: 5129344 - DNA, 14 bp, Homo sapiens
acaccagggccagc

SEQ ID NO: 5129345 - DNA, 17 bp, Homo sapiens
acaccagtcacatgacc

SEQ ID NO: 5129346 - DNA, 11 bp, Homo sapiens
acaccagtgtt

SEQ ID NO: 5129347 - DNA, 15 bp, Homo sapiens
acaccagtgttagct

SEQ ID NO: 5129348 - DNA, 17 bp, Homo sapiens
acaccagtttacaggaa

SEQ ID NO: 5129349 - DNA, 19 bp, Homo sapiens
acaccataagctactgcca

SEQ ID NO: 5129350 - DNA, 21 bp, Homo sapiens
acaccataggtagaatgtaaa

SEQ ID NO: 5129351 - DNA, 18 bp, Homo sapiens
acaccatcattaagaata

SEQ ID NO: 5129352 - DNA, 18 bp, Homo sapiens
acaccatcgctggcccct

SEQ ID NO: 5129353 - DNA, 19 bp, Homo sapiens
acaccatcgctggcccctt

SEQ ID NO: 5129354 - DNA, 14 bp, Homo sapiens
acaccatctggccc

SEQ ID NO: 5129355 - DNA, 19 bp, Homo sapiens
acaccatctggcccaggct

SEQ ID NO: 5129356 - DNA, 21 bp, Homo sapiens
acaccatctggcccaggctgg

SEQ ID NO: 5129357 - DNA, 22 bp, Homo sapiens
acaccatctggcccaggctggc

SEQ ID NO: 5129358 - DNA, 19 bp, Homo sapiens
acaccatcttaaatgacag

SEQ ID NO: 5129359 - DNA, 20 bp, Homo sapiens
acaccatgaagatgccattg

SEQ ID NO: 5129360 - DNA, 14 bp, Homo sapiens
acaccatgaatctt

SEQ ID NO: 5129361 - DNA, 16 bp, Homo sapiens
acaccatgattccttt

SEQ ID NO: 5129362 - DNA, 18 bp, Homo sapiens
acaccatggagatgaaat

SEQ ID NO: 5129363 - DNA, 13 bp, Homo sapiens
acaccatgtgcaa

SEQ ID NO: 5129364 - DNA, 15 bp, Homo sapiens
acaccattaccaaaa

SEQ ID NO: 5129365 - DNA, 15 bp, Homo sapiens
acaccattattccag

SEQ ID NO: 5129366 - DNA, 14 bp, Homo sapiens
acaccattcattcc

SEQ ID NO: 5129367 - DNA, 22 bp, Homo sapiens
acaccattgttccttaccttta

SEQ ID NO: 5129368 - DNA, 16 bp, Homo sapiens
acaccattttgtaaat

SEQ ID NO: 5129369 - DNA, 20 bp, Homo sapiens
acaccattttgtaaatgaaa

SEQ ID NO: 5129370 - DNA, 22 bp, Homo sapiens
acaccattttttttttcttttt

SEQ ID NO: 5129371 - DNA, 20 bp, Homo sapiens
acacccaaagcatggactaa

SEQ ID NO: 5129372 - DNA, 22 bp, Homo sapiens
acacccaaagcatggactaacc

SEQ ID NO: 5129373 - DNA, 23 bp, Homo sapiens
acacccaaagcccacttcacaca

SEQ ID NO: 5129374 - DNA, 20 bp, Homo sapiens
acacccaagcacaaactgtc

SEQ ID NO: 5129375 - DNA, 15 bp, Homo sapiens
acacccaagcctgat

SEQ ID NO: 5129376 - DNA, 20 bp, Homo sapiens
acacccacccaaaagtcacc

SEQ ID NO: 5129377 - DNA, 14 bp, Homo sapiens
acacccaccccctg

SEQ ID NO: 5129378 - DNA, 16 bp, Homo sapiens
acacccaccctgtgcc

SEQ ID NO: 5129379 - DNA, 21 bp, Homo sapiens
acacccaccctttttttgggg

SEQ ID NO: 5129380 - DNA, 23 bp, Homo sapiens
acacccaccgtccgccctgctcc

SEQ ID NO: 5129381 - DNA, 16 bp, Homo sapiens
acacccacctctgcca

SEQ ID NO: 5129382 - DNA, 13 bp, Homo sapiens
acacccacctgct

SEQ ID NO: 5129383 - DNA, 14 bp, Homo sapiens
acacccacctgctg

SEQ ID NO: 5129384 - DNA, 16 bp, Homo sapiens
acacccacctgctgct

SEQ ID NO: 5129385 - DNA, 17 bp, Homo sapiens
acacccacctgctgctg

SEQ ID NO: 5129386 - DNA, 16 bp, Homo sapiens
acacccactcccttcc

SEQ ID NO: 5129387 - DNA, 11 bp, Homo sapiens
acacccactgg

SEQ ID NO: 5129388 - DNA, 13 bp, Homo sapiens
acacccactggcc

SEQ ID NO: 5129389 - DNA, 15 bp, Homo sapiens
acacccactggccag

SEQ ID NO: 5129390 - DNA, 13 bp, Homo sapiens
acacccagcaata

SEQ ID NO: 5129391 - DNA, 20 bp, Homo sapiens
acacccagcccacttctgcc

SEQ ID NO: 5129392 - DNA, 14 bp, Homo sapiens
acacccagccccag

SEQ ID NO: 5129393 - DNA, 17 bp, Homo sapiens
acacccagcctcagtcc

SEQ ID NO: 5129394 - DNA, 15 bp, Homo sapiens
acacccagcctgtcc

SEQ ID NO: 5129395 - DNA, 11 bp, Homo sapiens
acacccaggaa

SEQ ID NO: 5129396 - DNA, 16 bp, Homo sapiens
acacccaggcccatgc

SEQ ID NO: 5129397 - DNA, 23 bp, Homo sapiens
acacccaggctggagtgcagtgg

SEQ ID NO: 5129398 - DNA, 22 bp, Homo sapiens
acacccaggggaaggccctgag

SEQ ID NO: 5129399 - DNA, 17 bp, Homo sapiens
acacccagtggaaccaa

SEQ ID NO: 5129400 - DNA, 12 bp, Homo sapiens
acacccatgcac

SEQ ID NO: 5129401 - DNA, 18 bp, Homo sapiens
acacccatgccagagagg

SEQ ID NO: 5129402 - DNA, 14 bp, Homo sapiens
acacccatgtaaat

SEQ ID NO: 5129403 - DNA, 13 bp, Homo sapiens
acacccatgtttc

SEQ ID NO: 5129404 - DNA, 21 bp, Homo sapiens
acaccccacctgcgcttcact

SEQ ID NO: 5129405 - DNA, 17 bp, Homo sapiens
acaccccagactccagg

SEQ ID NO: 5129406 - DNA, 18 bp, Homo sapiens
acaccccagactccaggc

SEQ ID NO: 5129407 - DNA, 20 bp, Homo sapiens
acaccccagactccaggccc

SEQ ID NO: 5129408 - DNA, 21 bp, Homo sapiens
acaccccatgcacctcagggc

SEQ ID NO: 5129409 - DNA, 14 bp, Homo sapiens
acacccccacccct

SEQ ID NO: 5129410 - DNA, 18 bp, Homo sapiens
acacccccacctcctgca

SEQ ID NO: 5129411 - DNA, 17 bp, Homo sapiens
acacccccagctgactg

SEQ ID NO: 5129412 - DNA, 19 bp, Homo sapiens
acacccccatccctcggga

SEQ ID NO: 5129413 - DNA, 21 bp, Homo sapiens
acaccccccgccccccacctt

SEQ ID NO: 5129414 - DNA, 15 bp, Homo sapiens
acaccccccttctga

SEQ ID NO: 5129415 - DNA, 16 bp, Homo sapiens
acaccccccttctgaa

SEQ ID NO: 5129416 - DNA, 22 bp, Homo sapiens
acaccccctccccgcccctgtg

SEQ ID NO: 5129417 - DNA, 13 bp, Homo sapiens
acacccccttggt

SEQ ID NO: 5129418 - DNA, 20 bp, Homo sapiens
acaccccgcctgcctcctgg

SEQ ID NO: 5129419 - DNA, 13 bp, Homo sapiens
acacccctacaca

SEQ ID NO: 5129420 - DNA, 18 bp, Homo sapiens
acaagagggactgtattt

SEQ ID NO: 5129421 - DNA, 15 bp, Homo sapiens
acaagagggcaaagc

SEQ ID NO: 5129422 - DNA, 20 bp, Homo sapiens
acaagagggttcacacagcc

SEQ ID NO: 5129423 - DNA, 20 bp, Homo sapiens
acaagaggtgctagctctta

SEQ ID NO: 5129424 - DNA, 18 bp, Homo sapiens
acaagaggttaaggtggg

SEQ ID NO: 5129425 - DNA, 22 bp, Homo sapiens
acaagagtatgtggcaaaacat

SEQ ID NO: 5129426 - DNA, 16 bp, Homo sapiens
acaagagtccctttga

SEQ ID NO: 5129427 - DNA, 19 bp, Homo sapiens
acaagagtggagagaagct

SEQ ID NO: 5129428 - DNA, 17 bp, Homo sapiens
acaagataaaaaacgaa

SEQ ID NO: 5129429 - DNA, 18 bp, Homo sapiens
acaagataaaggaagtca

SEQ ID NO: 5129430 - DNA, 19 bp, Homo sapiens
acaagatacgtatattttt

SEQ ID NO: 5129431 - DNA, 18 bp, Homo sapiens
acaagatagagagctatt

SEQ ID NO: 5129432 - DNA, 15 bp, Homo sapiens
acaagatattatgta

SEQ ID NO: 5129433 - DNA, 15 bp, Homo sapiens
acaagatattgtaca

SEQ ID NO: 5129434 - DNA, 18 bp, Homo sapiens
acaagatattgtacataa

SEQ ID NO: 5129435 - DNA, 19 bp, Homo sapiens
acaagatattgtacataaa

SEQ ID NO: 5129436 - DNA, 13 bp, Homo sapiens
acaagatatttat

SEQ ID NO: 5129437 - DNA, 16 bp, Homo sapiens
acaagatccaggcaga

SEQ ID NO: 5129438 - DNA, 13 bp, Homo sapiens
acaagatccattt

SEQ ID NO: 5129439 - DNA, 21 bp, Homo sapiens
acaagatccatttgcctttct

SEQ ID NO: 5129440 - DNA, 22 bp, Homo sapiens
acaagatccatttgcctttctg

SEQ ID NO: 5129441 - DNA, 20 bp, Homo sapiens
acaagatgccccagggatgg

SEQ ID NO: 5129442 - DNA, 15 bp, Homo sapiens
acaagatgggacagc

SEQ ID NO: 5129443 - DNA, 14 bp, Homo sapiens
acaagattcccaga

SEQ ID NO: 5129444 - DNA, 16 bp, Homo sapiens
acaagattcccagaga

SEQ ID NO: 5129445 - DNA, 18 bp, Homo sapiens
acaagattcccagagaca

SEQ ID NO: 5129446 - DNA, 24 bp, Homo sapiens
acaagattggtgtttttttctatg

SEQ ID NO: 5129447 - DNA, 19 bp, Homo sapiens
acaagattgtcattagtga

SEQ ID NO: 5129448 - DNA, 14 bp, Homo sapiens
acaagatttagaaa

SEQ ID NO: 5129449 - DNA, 20 bp, Homo sapiens
acaagatttccacaattctt

SEQ ID NO: 5129450 - DNA, 12 bp, Homo sapiens
acaagatttcct

SEQ ID NO: 5129451 - DNA, 18 bp, Homo sapiens
acaagatttccttgtgca

SEQ ID NO: 5129452 - DNA, 18 bp, Homo sapiens
acaagatttgtaattaca

SEQ ID NO: 5129453 - DNA, 21 bp, Homo sapiens
acaagattttttaattgttta

SEQ ID NO: 5129454 - DNA, 20 bp, Homo sapiens
acaagcaaaaccaaagaata

SEQ ID NO: 5129455 - DNA, 15 bp, Homo sapiens
acaagcaaacccaga

SEQ ID NO: 5129456 - DNA, 16 bp, Homo sapiens
acaagcaaaccttctc

SEQ ID NO: 5129457 - DNA, 11 bp, Homo sapiens
acaagcaacaa

SEQ ID NO: 5129458 - DNA, 15 bp, Homo sapiens
acaagcaacccaaac

SEQ ID NO: 5129459 - DNA, 18 bp, Homo sapiens
acaagcaacccaaactga

SEQ ID NO: 5129460 - DNA, 14 bp, Homo sapiens
acaagcaagcaaaa

SEQ ID NO: 5129461 - DNA, 13 bp, Homo sapiens
acaagcaagctcc

SEQ ID NO: 5129462 - DNA, 14 bp, Homo sapiens
acaagcaataatta

SEQ ID NO: 5129463 - DNA, 17 bp, Homo sapiens
acaagcaataattagga

SEQ ID NO: 5129464 - DNA, 19 bp, Homo sapiens
acaagcaatgcaagaaaaa

SEQ ID NO: 5129465 - DNA, 22 bp, Homo sapiens
acaagcaattagacaagaactt

SEQ ID NO: 5129466 - DNA, 19 bp, Homo sapiens
acaagcacaattgatctct

SEQ ID NO: 5129467 - DNA, 20 bp, Homo sapiens
acaagcacaccacaattctc

SEQ ID NO: 5129468 - DNA, 16 bp, Homo sapiens
acaagcacagttttaa

SEQ ID NO: 5129469 - DNA, 19 bp, Homo sapiens
acaagcacagttttaagag

SEQ ID NO: 5129470 - DNA, 14 bp, Homo sapiens
acaagcaccactct

SEQ ID NO: 5129471 - DNA, 14 bp, Homo sapiens
acaagcaccccaga

SEQ ID NO: 5129472 - DNA, 15 bp, Homo sapiens
acaagcactatttta

SEQ ID NO: 5129473 - DNA, 21 bp, Homo sapiens
acaagcactattttatattta

SEQ ID NO: 5129474 - DNA, 13 bp, Homo sapiens
acaagcagacaca

SEQ ID NO: 5129475 - DNA, 21 bp, Homo sapiens
acaagcagagtgcacagctgt

SEQ ID NO: 5129476 - DNA, 14 bp, Homo sapiens
acaagcagcccttg

SEQ ID NO: 5129477 - DNA, 17 bp, Homo sapiens
acaagcagcccttgctt

SEQ ID NO: 5129478 - DNA, 12 bp, Homo sapiens
acaagcaggcac

SEQ ID NO: 5129479 - DNA, 15 bp, Homo sapiens
acaagcaggcaggca

SEQ ID NO: 5129480 - DNA, 16 bp, Homo sapiens
acaagcagggcactct

SEQ ID NO: 5129481 - DNA, 17 bp, Homo sapiens
acaagcatataaaatgg

SEQ ID NO: 5129482 - DNA, 20 bp, Homo sapiens
acaagcatgcataaatcaat

SEQ ID NO: 5129483 - DNA, 20 bp, Homo sapiens
acaagcatgtctctctgcca

SEQ ID NO: 5129484 - DNA, 23 bp, Homo sapiens
acaagcattccttagcagctcag

SEQ ID NO: 5129485 - DNA, 21 bp, Homo sapiens
acaagcattctgtcttgaagg

SEQ ID NO: 5129486 - DNA, 20 bp, Homo sapiens
acaagcatttcccccaggga

SEQ ID NO: 5129487 - DNA, 20 bp, Homo sapiens
acaagccaaaagtccctccc

SEQ ID NO: 5129488 - DNA, 21 bp, Homo sapiens
acaagccaaacattcttattt

SEQ ID NO: 5129489 - DNA, 14 bp, Homo sapiens
acaagccaaagagc

SEQ ID NO: 5129490 - DNA, 21 bp, Homo sapiens
acaagccaagctagaaggaag

SEQ ID NO: 5129491 - DNA, 22 bp, Homo sapiens
acaagccaagctagaaggaagc

SEQ ID NO: 5129492 - DNA, 17 bp, Homo sapiens
acaagccaatgtgaatt

SEQ ID NO: 5129493 - DNA, 20 bp, Homo sapiens
acaagccacaagtcttccag

SEQ ID NO: 5129494 - DNA, 18 bp, Homo sapiens
acaagccacagaagccag

SEQ ID NO: 5129495 - DNA, 18 bp, Homo sapiens
acaagccacgaatgaatg

SEQ ID NO: 5129496 - DNA, 19 bp, Homo sapiens
acaagccacgttgcagaaa

SEQ ID NO: 5129497 - DNA, 13 bp, Homo sapiens
acaagccagagcc

SEQ ID NO: 5129498 - DNA, 15 bp, Homo sapiens
acaagccagctggag

SEQ ID NO: 5129499 - DNA, 14 bp, Homo sapiens
acaagcccaaattt

SEQ ID NO: 5129500 - DNA, 15 bp, Homo sapiens
acaagcccacagcac

SEQ ID NO: 5129501 - DNA, 13 bp, Homo sapiens
acaagcccaggct

SEQ ID NO: 5129502 - DNA, 16 bp, Homo sapiens
acaagccccaggcagg

SEQ ID NO: 5129503 - DNA, 19 bp, Homo sapiens
acaagccctaacttctgta

SEQ ID NO: 5129504 - DNA, 16 bp, Homo sapiens
acaagcctcagcaaac

SEQ ID NO: 5129505 - DNA, 11 bp, Homo sapiens
acaagcctctg

SEQ ID NO: 5129506 - DNA, 13 bp, Homo sapiens
acaagcctctgcc

SEQ ID NO: 5129507 - DNA, 14 bp, Homo sapiens
acaagcctcttctg

SEQ ID NO: 5129508 - DNA, 12 bp, Homo sapiens
acaagcctgagg

SEQ ID NO: 5129509 - DNA, 22 bp, Homo sapiens
acaagcctggaaaaaaacatca

SEQ ID NO: 5129510 - DNA, 12 bp, Homo sapiens
acaagcctggag

SEQ ID NO: 5129511 - DNA, 13 bp, Homo sapiens
acaagcctggagg

SEQ ID NO: 5129512 - DNA, 10 bp, Homo sapiens
acaagcctta

SEQ ID NO: 5129513 - DNA, 13 bp, Homo sapiens
acaagccttaatc

SEQ ID NO: 5129514 - DNA, 18 bp, Homo sapiens
acaagccttactcacctc

SEQ ID NO: 5129515 - DNA, 20 bp, Homo sapiens
acaagccttactcacctctc

SEQ ID NO: 5129516 - DNA, 14 bp, Homo sapiens
acaagcgctcccag

SEQ ID NO: 5129517 - DNA, 20 bp, Homo sapiens
acaagcgctcccagcctgcc

SEQ ID NO: 5129518 - DNA, 13 bp, Homo sapiens
acaagcggccctg

SEQ ID NO: 5129519 - DNA, 20 bp, Homo sapiens
acaagcgtgagccactgcac

SEQ ID NO: 5129520 - DNA, 14 bp, Homo sapiens
acaagctaaaatta

SEQ ID NO: 5129521 - DNA, 22 bp, Homo sapiens
acaagctaattgggagtccagg

SEQ ID NO: 5129522 - DNA, 16 bp, Homo sapiens
acaagctacagttgtc

SEQ ID NO: 5129523 - DNA, 21 bp, Homo sapiens
acaagctacagttgtccagat

SEQ ID NO: 5129524 - DNA, 15 bp, Homo sapiens
acaagctaggaaaga

SEQ ID NO: 5129525 - DNA, 23 bp, Homo sapiens
acaagctcaggaggcgaataaat

SEQ ID NO: 5129526 - DNA, 22 bp, Homo sapiens
acaagctccaagctcccaggca

SEQ ID NO: 5129527 - DNA, 17 bp, Homo sapiens
acaagctccatttaaac

SEQ ID NO: 5129528 - DNA, 18 bp, Homo sapiens
acaagctccctggtgagg

SEQ ID NO: 5129529 - DNA, 17 bp, Homo sapiens
acaagctcctcccttga

SEQ ID NO: 5129530 - DNA, 19 bp, Homo sapiens
acaagctcttgtttctgtt

SEQ ID NO: 5129531 - DNA, 15 bp, Homo sapiens
acaagctgacttggc

SEQ ID NO: 5129532 - DNA, 13 bp, Homo sapiens
acaagctgatagt

SEQ ID NO: 5129533 - DNA, 21 bp, Homo sapiens
acaagctgcaccctcaggcag

SEQ ID NO: 5129534 - DNA, 13 bp, Homo sapiens
acaagctgcactg

SEQ ID NO: 5129535 - DNA, 19 bp, Homo sapiens
acaagctgcactgtgaacc

SEQ ID NO: 5129536 - DNA, 13 bp, Homo sapiens
acaagctggctta

SEQ ID NO: 5129537 - DNA, 19 bp, Homo sapiens
acaagctgtatcactgcct

SEQ ID NO: 5129538 - DNA, 18 bp, Homo sapiens
acaagctgtccctgcagg

SEQ ID NO: 5129539 - DNA, 17 bp, Homo sapiens
acaagcttaaagcttga

SEQ ID NO: 5129540 - DNA, 19 bp, Homo sapiens
acaagcttaaagcttgatt

SEQ ID NO: 5129541 - DNA, 23 bp, Homo sapiens
acaagcttaggtcatgaacatgg

SEQ ID NO: 5129542 - DNA, 16 bp, Homo sapiens
acaagcttcagtaagt

SEQ ID NO: 5129543 - DNA, 13 bp, Homo sapiens
acaagcttctgag

SEQ ID NO: 5129544 - DNA, 15 bp, Homo sapiens
acaagcttgtatata

SEQ ID NO: 5129545 - DNA, 21 bp, Homo sapiens
acaagcttgtatatacatatt

SEQ ID NO: 5129546 - DNA, 22 bp, Homo sapiens
acaagcttgtatatacatatta

SEQ ID NO: 5129547 - DNA, 23 bp, Homo sapiens
acaagctttaaatggcaattttt

SEQ ID NO: 5129548 - DNA, 18 bp, Homo sapiens
acaaggaaaaggaggagg

SEQ ID NO: 5129549 - DNA, 19 bp, Homo sapiens
acaaggaaaaggaggaggt

SEQ ID NO: 5129550 - DNA, 11 bp, Homo sapiens
acaaggaaaat

SEQ ID NO: 5129551 - DNA, 23 bp, Homo sapiens
acaaggaaactttcctttaactc

SEQ ID NO: 5129552 - DNA, 15 bp, Homo sapiens
acaaggaaataaagc

SEQ ID NO: 5129553 - DNA, 19 bp, Homo sapiens
acaaggaagaaattaactt

SEQ ID NO: 5129554 - DNA, 18 bp, Homo sapiens
acaaggaaggaaaagaaa

SEQ ID NO: 5129555 - DNA, 15 bp, Homo sapiens
acaaggaagtggggg

SEQ ID NO: 5129556 - DNA, 14 bp, Homo sapiens
acaaggaataaatg

SEQ ID NO: 5129557 - DNA, 18 bp, Homo sapiens
acaaggaatgcctgtgcc

SEQ ID NO: 5129558 - DNA, 22 bp, Homo sapiens
acaaggaatttccctgtgtgga

SEQ ID NO: 5129559 - DNA, 20 bp, Homo sapiens
acaaggacagaaccctccac

SEQ ID NO: 5129560 - DNA, 20 bp, Homo sapiens
acaaggacagacagcaggca

SEQ ID NO: 5129561 - DNA, 21 bp, Homo sapiens
acaaggacagcccctcctcca

SEQ ID NO: 5129562 - DNA, 22 bp, Homo sapiens
acaaggacagcccctcctccat

SEQ ID NO: 5129563 - DNA, 18 bp, Homo sapiens
acaaggacgctggctact

SEQ ID NO: 5129564 - DNA, 18 bp, Homo sapiens
acaaggactagggtcctg

SEQ ID NO: 5129565 - DNA, 15 bp, Homo sapiens
acaaggacttcctgt

SEQ ID NO: 5129566 - DNA, 17 bp, Homo sapiens
acaaggagagcggagga

SEQ ID NO: 5129567 - DNA, 15 bp, Homo sapiens
acaaggaggtagaga

SEQ ID NO: 5129568 - DNA, 16 bp, Homo sapiens
acaaggatagatgctg

SEQ ID NO: 5129569 - DNA, 18 bp, Homo sapiens
acaaggatagatgctggc

SEQ ID NO: 5129570 - DNA, 17 bp, Homo sapiens
acaaggatcaggctgct

SEQ ID NO: 5129571 - DNA, 15 bp, Homo sapiens
acaaggcaaaaacaa

SEQ ID NO: 5129572 - DNA, 14 bp, Homo sapiens
acaaggcaaggctg

SEQ ID NO: 5129573 - DNA, 17 bp, Homo sapiens
acaaggcaaggctgtca

SEQ ID NO: 5129574 - DNA, 16 bp, Homo sapiens
acaaggcagcaaggcc

SEQ ID NO: 5129575 - DNA, 22 bp, Homo sapiens
acaaggcagcaaggcccgagca

SEQ ID NO: 5129576 - DNA, 14 bp, Homo sapiens
acaaggcaggcctg

SEQ ID NO: 5129577 - DNA, 16 bp, Homo sapiens
acaaggcaggcctttc

SEQ ID NO: 5129578 - DNA, 23 bp, Homo sapiens
acaaggcatccatactgtttaat

SEQ ID NO: 5129579 - DNA, 23 bp, Homo sapiens
acaaggcattcaagtgtacagtg

SEQ ID NO: 5129580 - DNA, 12 bp, Homo sapiens
acaaggcccagc

SEQ ID NO: 5129581 - DNA, 17 bp, Homo sapiens
acaaggcccagccctgg

SEQ ID NO: 5129582 - DNA, 19 bp, Homo sapiens
acaaggcccagccctgggc

SEQ ID NO: 5129583 - DNA, 21 bp, Homo sapiens
acaaggcccagccctgggcaa

SEQ ID NO: 5129584 - DNA, 16 bp, Homo sapiens
acaaggcccaggagac

SEQ ID NO: 5129585 - DNA, 19 bp, Homo sapiens
acaaggcccaggagacctc

SEQ ID NO: 5129586 - DNA, 11 bp, Homo sapiens
acaaggcccca

SEQ ID NO: 5129587 - DNA, 15 bp, Homo sapiens
acaaggccccagaga

SEQ ID NO: 5129588 - DNA, 15 bp, Homo sapiens
acaaggcccctctgc

SEQ ID NO: 5129589 - DNA, 22 bp, Homo sapiens
acaaggcctgcttgactttcca

SEQ ID NO: 5129590 - DNA, 15 bp, Homo sapiens
acaaggcctggtctg

SEQ ID NO: 5129591 - DNA, 17 bp, Homo sapiens
acaaggcctggtctggg

SEQ ID NO: 5129592 - DNA, 19 bp, Homo sapiens
acaaggccttgctcactca

SEQ ID NO: 5129593 - DNA, 22 bp, Homo sapiens
acaaggctgaccaagagagaaa

SEQ ID NO: 5129594 - DNA, 22 bp, Homo sapiens
acaaggcttgctgcagatacta

SEQ ID NO: 5129595 - DNA, 21 bp, Homo sapiens
acaagggaaaaatttttatgt

SEQ ID NO: 5129596 - DNA, 18 bp, Homo sapiens
acaagggaagatttatgt

SEQ ID NO: 5129597 - DNA, 20 bp, Homo sapiens
acaagggaagatttatgttt

SEQ ID NO: 5129598 - DNA, 16 bp, Homo sapiens
acaagggagaaaagct

SEQ ID NO: 5129599 - DNA, 19 bp, Homo sapiens
acacccctacacacaccca

SEQ ID NO: 5129600 - DNA, 16 bp, Homo sapiens
acacccctctgctgca

SEQ ID NO: 5129601 - DNA, 13 bp, Homo sapiens
acacccctctgtc

SEQ ID NO: 5129602 - DNA, 21 bp, Homo sapiens
acacccctctgtctaggactg

SEQ ID NO: 5129603 - DNA, 12 bp, Homo sapiens
acacccctgcac

SEQ ID NO: 5129604 - DNA, 14 bp, Homo sapiens
acacccctgcacac

SEQ ID NO: 5129605 - DNA, 18 bp, Homo sapiens
acacccctggcctgactc

SEQ ID NO: 5129606 - DNA, 13 bp, Homo sapiens
acacccctgtgct

SEQ ID NO: 5129607 - DNA, 14 bp, Homo sapiens
acacccctgtgctc

SEQ ID NO: 5129608 - DNA, 17 bp, Homo sapiens
acaccccttatccagga

SEQ ID NO: 5129609 - DNA, 18 bp, Homo sapiens
acaccccttatccaggac

SEQ ID NO: 5129610 - DNA, 20 bp, Homo sapiens
acaccccttatccaggactc

SEQ ID NO: 5129611 - DNA, 15 bp, Homo sapiens
acacccgaagtcctg

SEQ ID NO: 5129612 - DNA, 18 bp, Homo sapiens
acacccgtgagcgcctgt

SEQ ID NO: 5129613 - DNA, 23 bp, Homo sapiens
acacccgtgtggtaccttcagcc

SEQ ID NO: 5129614 - DNA, 21 bp, Homo sapiens
acaccctaactcttgctcact

SEQ ID NO: 5129615 - DNA, 24 bp, Homo sapiens
acaccctaactcttgctcactccc

SEQ ID NO: 5129616 - DNA, 22 bp, Homo sapiens
acaccctacaagttgatcatgc

SEQ ID NO: 5129617 - DNA, 23 bp, Homo sapiens
acaccctacaagttgatcatgca

SEQ ID NO: 5129618 - DNA, 14 bp, Homo sapiens
acaccctacagcag

SEQ ID NO: 5129619 - DNA, 17 bp, Homo sapiens
acaccctacagcagatc

SEQ ID NO: 5129620 - DNA, 18 bp, Homo sapiens
acaccctaccttccccag

SEQ ID NO: 5129621 - DNA, 17 bp, Homo sapiens
acaccctcaacctcttc

SEQ ID NO: 5129622 - DNA, 14 bp, Homo sapiens
acaccctccactct

SEQ ID NO: 5129623 - DNA, 15 bp, Homo sapiens
acaccctccactctg

SEQ ID NO: 5129624 - DNA, 22 bp, Homo sapiens
acaccctccactctgaggtctc

SEQ ID NO: 5129625 - DNA, 23 bp, Homo sapiens
acaccctccactctgaggtctca

SEQ ID NO: 5129626 - DNA, 14 bp, Homo sapiens
acaccctccagaga

SEQ ID NO: 5129627 - DNA, 15 bp, Homo sapiens
acaccctccagcaca

SEQ ID NO: 5129628 - DNA, 16 bp, Homo sapiens
acaccctcccccgcca

SEQ ID NO: 5129629 - DNA, 12 bp, Homo sapiens
acaccctctccc

SEQ ID NO: 5129630 - DNA, 19 bp, Homo sapiens
acaccctctccttgtcaca

SEQ ID NO: 5129631 - DNA, 16 bp, Homo sapiens
acaccctctctgtcca

SEQ ID NO: 5129632 - DNA, 13 bp, Homo sapiens
acaccctctgggg

SEQ ID NO: 5129633 - DNA, 22 bp, Homo sapiens
acaccctctgggggtcctctct

SEQ ID NO: 5129634 - DNA, 11 bp, Homo sapiens
acaccctgcaa

SEQ ID NO: 5129635 - DNA, 13 bp, Homo sapiens
acaccctgcaagg

SEQ ID NO: 5129636 - DNA, 12 bp, Homo sapiens
acaccctgcccc

SEQ ID NO: 5129637 - DNA, 14 bp, Homo sapiens
acaccctgcccctg

SEQ ID NO: 5129638 - DNA, 16 bp, Homo sapiens
acaccctgcccctgca

SEQ ID NO: 5129639 - DNA, 18 bp, Homo sapiens
acaccctgcctgctgtgg

SEQ ID NO: 5129640 - DNA, 23 bp, Homo sapiens
acaccctgcctgctgtggagccc

SEQ ID NO: 5129641 - DNA, 15 bp, Homo sapiens
acaccctgcttctcc

SEQ ID NO: 5129642 - DNA, 19 bp, Homo sapiens
acaccctgcttctcccggg

SEQ ID NO: 5129643 - DNA, 19 bp, Homo sapiens
acaccctggagtggcatgg

SEQ ID NO: 5129644 - DNA, 11 bp, Homo sapiens
acaccctggat

SEQ ID NO: 5129645 - DNA, 14 bp, Homo sapiens
acaccctggcctga

SEQ ID NO: 5129646 - DNA, 17 bp, Homo sapiens
acaccctggcctgaact

SEQ ID NO: 5129647 - DNA, 17 bp, Homo sapiens
acaccctggtcctgact

SEQ ID NO: 5129648 - DNA, 16 bp, Homo sapiens
acacccttcagcaatg

SEQ ID NO: 5129649 - DNA, 13 bp, Homo sapiens
acacccttcccca

SEQ ID NO: 5129650 - DNA, 17 bp, Homo sapiens
acacccttgaaaatata

SEQ ID NO: 5129651 - DNA, 14 bp, Homo sapiens
acacccttggagct

SEQ ID NO: 5129652 - DNA, 21 bp, Homo sapiens
acaccctttagtgtacattta

SEQ ID NO: 5129653 - DNA, 13 bp, Homo sapiens
acacccttttaac

SEQ ID NO: 5129654 - DNA, 17 bp, Homo sapiens
acaccgcaccgggctgg

SEQ ID NO: 5129655 - DNA, 21 bp, Homo sapiens
acaccgcaccgggctggcctg

SEQ ID NO: 5129656 - DNA, 13 bp, Homo sapiens
acaccgccatcct

SEQ ID NO: 5129657 - DNA, 14 bp, Homo sapiens
acaccgccatcctc

SEQ ID NO: 5129658 - DNA, 17 bp, Homo sapiens
acaccgccatcctctgc

SEQ ID NO: 5129659 - DNA, 21 bp, Homo sapiens
acaccgcgtcccagctcccct

SEQ ID NO: 5129660 - DNA, 15 bp, Homo sapiens
acaccgctcagtatt

SEQ ID NO: 5129661 - DNA, 14 bp, Homo sapiens
acaccgctggctcc

SEQ ID NO: 5129662 - DNA, 22 bp, Homo sapiens
acaccgctggtccctgccctcc

SEQ ID NO: 5129663 - DNA, 15 bp, Homo sapiens
acaccggcactgtgc

SEQ ID NO: 5129664 - DNA, 18 bp, Homo sapiens
acaccggccaagatgctt

SEQ ID NO: 5129665 - DNA, 23 bp, Homo sapiens
acaccgggaagtgcagcgggcca

SEQ ID NO: 5129666 - DNA, 16 bp, Homo sapiens
acaccgggcactcaga

SEQ ID NO: 5129667 - DNA, 16 bp, Homo sapiens
acaccgggcctggaga

SEQ ID NO: 5129668 - DNA, 18 bp, Homo sapiens
acaccggtaccctcctcc

SEQ ID NO: 5129669 - DNA, 23 bp, Homo sapiens
acaccggttccctgaacccctct

SEQ ID NO: 5129670 - DNA, 14 bp, Homo sapiens
acaccgtccctcag

SEQ ID NO: 5129671 - DNA, 14 bp, Homo sapiens
acaccgtcttcctt

SEQ ID NO: 5129672 - DNA, 15 bp, Homo sapiens
acaccgtggcctggg

SEQ ID NO: 5129673 - DNA, 20 bp, Homo sapiens
acaccgtgtaaaccaaagcc

SEQ ID NO: 5129674 - DNA, 22 bp, Homo sapiens
acacctaaaaccagttttgctg

SEQ ID NO: 5129675 - DNA, 19 bp, Homo sapiens
acacctaaataaccaatct

SEQ ID NO: 5129676 - DNA, 19 bp, Homo sapiens
acacctaaccccagggcac

SEQ ID NO: 5129677 - DNA, 23 bp, Homo sapiens
acacctaactcttttctattttg

SEQ ID NO: 5129678 - DNA, 20 bp, Homo sapiens
acacctaagtgactaccact

SEQ ID NO: 5129679 - DNA, 18 bp, Homo sapiens
acacctaccaaaaaataa

SEQ ID NO: 5129680 - DNA, 18 bp, Homo sapiens
acacctaccatgctgctt

SEQ ID NO: 5129681 - DNA, 17 bp, Homo sapiens
acacctaccctcctttt

SEQ ID NO: 5129682 - DNA, 21 bp, Homo sapiens
acacctactagtcaccagaga

SEQ ID NO: 5129683 - DNA, 12 bp, Homo sapiens
acacctagaaag

SEQ ID NO: 5129684 - DNA, 23 bp, Homo sapiens
acacctagccagctgtcaagggc

SEQ ID NO: 5129685 - DNA, 21 bp, Homo sapiens
acacctagctttattcttcag

SEQ ID NO: 5129686 - DNA, 22 bp, Homo sapiens
acacctaggtcgccagtgaaat

SEQ ID NO: 5129687 - DNA, 20 bp, Homo sapiens
acacctattatcccagctgc

SEQ ID NO: 5129688 - DNA, 20 bp, Homo sapiens
acacctcaactaaatccaaa

SEQ ID NO: 5129689 - DNA, 17 bp, Homo sapiens
acacctcactctgctac

SEQ ID NO: 5129690 - DNA, 18 bp, Homo sapiens
acacctcactctttatag

SEQ ID NO: 5129691 - DNA, 14 bp, Homo sapiens
acacctcactgtca

SEQ ID NO: 5129692 - DNA, 17 bp, Homo sapiens
acacctcactgtcatct

SEQ ID NO: 5129693 - DNA, 20 bp, Homo sapiens
acacctcactgtcatctgcc

SEQ ID NO: 5129694 - DNA, 10 bp, Homo sapiens
acacctcaga

SEQ ID NO: 5129695 - DNA, 14 bp, Homo sapiens
acacctcagaaatt

SEQ ID NO: 5129696 - DNA, 20 bp, Homo sapiens
acacctcagaggctgttctt

SEQ ID NO: 5129697 - DNA, 21 bp, Homo sapiens
acacctcagaggctgttcttg

SEQ ID NO: 5129698 - DNA, 13 bp, Homo sapiens
acacctcccaggg

SEQ ID NO: 5129699 - DNA, 18 bp, Homo sapiens
acacctccccctacccat

SEQ ID NO: 5129700 - DNA, 16 bp, Homo sapiens
acacctccccctgcgc

SEQ ID NO: 5129701 - DNA, 18 bp, Homo sapiens
acacctccccctgcgccc

SEQ ID NO: 5129702 - DNA, 14 bp, Homo sapiens
acacctccctactc

SEQ ID NO: 5129703 - DNA, 16 bp, Homo sapiens
acacctccctgtgaag

SEQ ID NO: 5129704 - DNA, 22 bp, Homo sapiens
acacctccgagacagtccagtg

SEQ ID NO: 5129705 - DNA, 15 bp, Homo sapiens
acacctcctcccact

SEQ ID NO: 5129706 - DNA, 20 bp, Homo sapiens
acacctcctcccactgccca

SEQ ID NO: 5129707 - DNA, 22 bp, Homo sapiens
acacctcctcccactgcccact

SEQ ID NO: 5129708 - DNA, 13 bp, Homo sapiens
acacctcctcctg

SEQ ID NO: 5129709 - DNA, 18 bp, Homo sapiens
acacctcctcctgctgct

SEQ ID NO: 5129710 - DNA, 21 bp, Homo sapiens
acacctcctcctgctgctcac

SEQ ID NO: 5129711 - DNA, 11 bp, Homo sapiens
acacctcctgg

SEQ ID NO: 5129712 - DNA, 14 bp, Homo sapiens
acacctcctggggc

SEQ ID NO: 5129713 - DNA, 19 bp, Homo sapiens
acacctccttccctctctg

SEQ ID NO: 5129714 - DNA, 21 bp, Homo sapiens
acacctcgcccttcagcccac

SEQ ID NO: 5129715 - DNA, 22 bp, Homo sapiens
acacctcgcccttcagcccacc

SEQ ID NO: 5129716 - DNA, 21 bp, Homo sapiens
acacctcgtcaagagcatgca

SEQ ID NO: 5129717 - DNA, 21 bp, Homo sapiens
acacctcgttagggaagagaa

SEQ ID NO: 5129718 - DNA, 19 bp, Homo sapiens
acacctctgcacaagctgc

SEQ ID NO: 5129719 - DNA, 14 bp, Homo sapiens
acacctctgcccct

SEQ ID NO: 5129720 - DNA, 21 bp, Homo sapiens
acacctctgctttctgatgtt

SEQ ID NO: 5129721 - DNA, 22 bp, Homo sapiens
acacctctgggccctgcaggag

SEQ ID NO: 5129722 - DNA, 18 bp, Homo sapiens
acacctgacaaatggaag

SEQ ID NO: 5129723 - DNA, 12 bp, Homo sapiens
acacctgacaca

SEQ ID NO: 5129724 - DNA, 16 bp, Homo sapiens
acacctgacagcccct

SEQ ID NO: 5129725 - DNA, 18 bp, Homo sapiens
acacctgactctgaaatc

SEQ ID NO: 5129726 - DNA, 21 bp, Homo sapiens
acacctgactctgaaatctga

SEQ ID NO: 5129727 - DNA, 15 bp, Homo sapiens
acacctgagctggtg

SEQ ID NO: 5129728 - DNA, 23 bp, Homo sapiens
acacctgagttcacagcttcacc

SEQ ID NO: 5129729 - DNA, 21 bp, Homo sapiens
acacctgatctggcccaagct

SEQ ID NO: 5129730 - DNA, 22 bp, Homo sapiens
acacctgatctggcccaagctg

SEQ ID NO: 5129731 - DNA, 18 bp, Homo sapiens
acacctgatgtgtacatc

SEQ ID NO: 5129732 - DNA, 19 bp, Homo sapiens
acacctgcacacccctgca

SEQ ID NO: 5129733 - DNA, 20 bp, Homo sapiens
acacctgcacacccctgcac

SEQ ID NO: 5129734 - DNA, 21 bp, Homo sapiens
acacctgcacaccgtccctct

SEQ ID NO: 5129735 - DNA, 11 bp, Homo sapiens
acacctgcacc

SEQ ID NO: 5129736 - DNA, 20 bp, Homo sapiens
acacctgccccagcgcggct

SEQ ID NO: 5129737 - DNA, 12 bp, Homo sapiens
acacctgccctg

SEQ ID NO: 5129738 - DNA, 13 bp, Homo sapiens
acacctgccctgc

SEQ ID NO: 5129739 - DNA, 20 bp, Homo sapiens
acacctgccctgccctgcca

SEQ ID NO: 5129740 - DNA, 17 bp, Homo sapiens
acacctgccgctgcttg

SEQ ID NO: 5129741 - DNA, 11 bp, Homo sapiens
acacctgcctg

SEQ ID NO: 5129742 - DNA, 12 bp, Homo sapiens
acacctggactg

SEQ ID NO: 5129743 - DNA, 11 bp, Homo sapiens
acacctggccc

SEQ ID NO: 5129744 - DNA, 14 bp, Homo sapiens
acacctggccctgg

SEQ ID NO: 5129745 - DNA, 22 bp, Homo sapiens
acacctggccgcctccaggagc

SEQ ID NO: 5129746 - DNA, 15 bp, Homo sapiens
acacctggccgggtc

SEQ ID NO: 5129747 - DNA, 23 bp, Homo sapiens
acacctggctgaggttcctctgc

SEQ ID NO: 5129748 - DNA, 11 bp, Homo sapiens
acacctggctt

SEQ ID NO: 5129749 - DNA, 20 bp, Homo sapiens
acacctgggcatttggtgag

SEQ ID NO: 5129750 - DNA, 22 bp, Homo sapiens
acacctgggcccgggcaggcca

SEQ ID NO: 5129751 - DNA, 16 bp, Homo sapiens
acacctggtctgtttt

SEQ ID NO: 5129752 - DNA, 19 bp, Homo sapiens
acacctggtgcgggcctgg

SEQ ID NO: 5129753 - DNA, 21 bp, Homo sapiens
acacctgtaatcccagcactt

SEQ ID NO: 5129754 - DNA, 12 bp, Homo sapiens
acacctgtacat

SEQ ID NO: 5129755 - DNA, 15 bp, Homo sapiens
acacctgtactggag

SEQ ID NO: 5129756 - DNA, 19 bp, Homo sapiens
acacctgtcagcccaagca

SEQ ID NO: 5129757 - DNA, 15 bp, Homo sapiens
acacctgtccttctc

SEQ ID NO: 5129758 - DNA, 16 bp, Homo sapiens
acacctgtgcacccca

SEQ ID NO: 5129759 - DNA, 19 bp, Homo sapiens
acacctgtggataaaacat

SEQ ID NO: 5129760 - DNA, 14 bp, Homo sapiens
acaccttaaaacat

SEQ ID NO: 5129761 - DNA, 18 bp, Homo sapiens
acaccttacaaagccagc

SEQ ID NO: 5129762 - DNA, 19 bp, Homo sapiens
acaccttacaaagccagct

SEQ ID NO: 5129763 - DNA, 19 bp, Homo sapiens
acaccttagagaagctacc

SEQ ID NO: 5129764 - DNA, 15 bp, Homo sapiens
acaccttagcagctc

SEQ ID NO: 5129765 - DNA, 16 bp, Homo sapiens
acaccttagcagctct

SEQ ID NO: 5129766 - DNA, 16 bp, Homo sapiens
acaccttcatccagat

SEQ ID NO: 5129767 - DNA, 16 bp, Homo sapiens
acaccttccagggccc

SEQ ID NO: 5129768 - DNA, 17 bp, Homo sapiens
acaccttccagggccct

SEQ ID NO: 5129769 - DNA, 22 bp, Homo sapiens
acaccttcccagctgctcctag

SEQ ID NO: 5129770 - DNA, 20 bp, Homo sapiens
acaccttccccacccttgag

SEQ ID NO: 5129771 - DNA, 14 bp, Homo sapiens
acaccttcctcctg

SEQ ID NO: 5129772 - DNA, 15 bp, Homo sapiens
acaccttcctcctgc

SEQ ID NO: 5129773 - DNA, 16 bp, Homo sapiens
acaccttcctcctgca

SEQ ID NO: 5129774 - DNA, 20 bp, Homo sapiens
acaccttcctcctgcagaca

SEQ ID NO: 5129775 - DNA, 14 bp, Homo sapiens
acaccttctctgga

SEQ ID NO: 5129776 - DNA, 19 bp, Homo sapiens
acaccttcttattatatat

SEQ ID NO: 5129777 - DNA, 20 bp, Homo sapiens
acaccttggacatcctcctc

SEQ ID NO: 5129778 - DNA, 14 bp, Homo sapiens
acaagggagaagac

SEQ ID NO: 5129779 - DNA, 19 bp, Homo sapiens
acaagggagaagacaacag

SEQ ID NO: 5129780 - DNA, 21 bp, Homo sapiens
acaagggatataaaatgaaag

SEQ ID NO: 5129781 - DNA, 20 bp, Homo sapiens
acaagggctgcaatgccctc

SEQ ID NO: 5129782 - DNA, 18 bp, Homo sapiens
acaaggggcaaatgaatt

SEQ ID NO: 5129783 - DNA, 18 bp, Homo sapiens
acaaggggctgttacata

SEQ ID NO: 5129784 - DNA, 21 bp, Homo sapiens
acaaggggctgttacataaca

SEQ ID NO: 5129785 - DNA, 20 bp, Homo sapiens
acaaggggttactttacatc

SEQ ID NO: 5129786 - DNA, 18 bp, Homo sapiens
acaagggtggcatcccag

SEQ ID NO: 5129787 - DNA, 15 bp, Homo sapiens
acaaggtaattgttt

SEQ ID NO: 5129788 - DNA, 18 bp, Homo sapiens
acaaggtataataaaatt

SEQ ID NO: 5129789 - DNA, 20 bp, Homo sapiens
acaaggtcaagagatagaga

SEQ ID NO: 5129790 - DNA, 17 bp, Homo sapiens
acaaggtcatggccaca

SEQ ID NO: 5129791 - DNA, 19 bp, Homo sapiens
acaaggtcatggccacact

SEQ ID NO: 5129792 - DNA, 21 bp, Homo sapiens
acaaggtcatggccacactgt

SEQ ID NO: 5129793 - DNA, 23 bp, Homo sapiens
acaaggtcatggccacactgtga

SEQ ID NO: 5129794 - DNA, 21 bp, Homo sapiens
acaaggtccactccctgctcc

SEQ ID NO: 5129795 - DNA, 22 bp, Homo sapiens
acaaggtccactccctgctcca

SEQ ID NO: 5129796 - DNA, 23 bp, Homo sapiens
acaaggtcctctgtcagtcacag

SEQ ID NO: 5129797 - DNA, 20 bp, Homo sapiens
acaaggtctcttccttaccc

SEQ ID NO: 5129798 - DNA, 14 bp, Homo sapiens
acaaggtgcacaga

SEQ ID NO: 5129799 - DNA, 14 bp, Homo sapiens
acaaggtgctcaga

SEQ ID NO: 5129800 - DNA, 21 bp, Homo sapiens
acaaggtggggattgcccctg

SEQ ID NO: 5129801 - DNA, 20 bp, Homo sapiens
acaaggttccctctgagaat

SEQ ID NO: 5129802 - DNA, 22 bp, Homo sapiens
acaaggttcttcccttttacat

SEQ ID NO: 5129803 - DNA, 17 bp, Homo sapiens
acaaggttggcacccca

SEQ ID NO: 5129804 - DNA, 17 bp, Homo sapiens
acaaggttggttgctaa

SEQ ID NO: 5129805 - DNA, 17 bp, Homo sapiens
acaagtaaaggcattgt

SEQ ID NO: 5129806 - DNA, 15 bp, Homo sapiens
acaagtaacaaaaat

SEQ ID NO: 5129807 - DNA, 15 bp, Homo sapiens
acaagtaagaaaaat

SEQ ID NO: 5129808 - DNA, 15 bp, Homo sapiens
acaagtaagagactc

SEQ ID NO: 5129809 - DNA, 16 bp, Homo sapiens
acaagtaatattatta

SEQ ID NO: 5129810 - DNA, 18 bp, Homo sapiens
acaagtaatcactaaccc

SEQ ID NO: 5129811 - DNA, 18 bp, Homo sapiens
acaagtaatgaattttat

SEQ ID NO: 5129812 - DNA, 22 bp, Homo sapiens
acaagtaccaaagttttatcaa

SEQ ID NO: 5129813 - DNA, 21 bp, Homo sapiens
acaagtactggctctttattc

SEQ ID NO: 5129814 - DNA, 14 bp, Homo sapiens
acaagtagttcatg

SEQ ID NO: 5129815 - DNA, 17 bp, Homo sapiens
acaagtagttcatgagt

SEQ ID NO: 5129816 - DNA, 17 bp, Homo sapiens
acaagtagttctgtatt

SEQ ID NO: 5129817 - DNA, 22 bp, Homo sapiens
acaagtagttctgtatttgaaa

SEQ ID NO: 5129818 - DNA, 14 bp, Homo sapiens
acaagtataattac

SEQ ID NO: 5129819 - DNA, 19 bp, Homo sapiens
acaagtatacttatatttc

SEQ ID NO: 5129820 - DNA, 15 bp, Homo sapiens
acaagtatataattt

SEQ ID NO: 5129821 - DNA, 19 bp, Homo sapiens
acaagtatatacttttaaa

SEQ ID NO: 5129822 - DNA, 19 bp, Homo sapiens
acaagtatatgtgaaaaaa

SEQ ID NO: 5129823 - DNA, 20 bp, Homo sapiens
acaagtatatgtgaaaaaaa

SEQ ID NO: 5129824 - DNA, 15 bp, Homo sapiens
acaagtatcatctaa

SEQ ID NO: 5129825 - DNA, 16 bp, Homo sapiens
acaagtatttattccc

SEQ ID NO: 5129826 - DNA, 15 bp, Homo sapiens
acaagtatttttaat

SEQ ID NO: 5129827 - DNA, 18 bp, Homo sapiens
acaagtcacagctgcagc

SEQ ID NO: 5129828 - DNA, 22 bp, Homo sapiens
acaagtcagctccagctttctg

SEQ ID NO: 5129829 - DNA, 19 bp, Homo sapiens
acaagtcatggacattcat

SEQ ID NO: 5129830 - DNA, 16 bp, Homo sapiens
acaagtcatggtcaca

SEQ ID NO: 5129831 - DNA, 20 bp, Homo sapiens
acaagtcatggtcacagtaa

SEQ ID NO: 5129832 - DNA, 16 bp, Homo sapiens
acaagtcatttcaaaa

SEQ ID NO: 5129833 - DNA, 23 bp, Homo sapiens
acaagtcattttaactttatcac

SEQ ID NO: 5129834 - DNA, 22 bp, Homo sapiens
acaagtccccattgctgtggtc

SEQ ID NO: 5129835 - DNA, 20 bp, Homo sapiens
acaagtcctggatgttgtgt

SEQ ID NO: 5129836 - DNA, 15 bp, Homo sapiens
acaagtcctgtgaat

SEQ ID NO: 5129837 - DNA, 17 bp, Homo sapiens
acaagtcctgtgaattt

SEQ ID NO: 5129838 - DNA, 21 bp, Homo sapiens
acaagtctgcatttcatatta

SEQ ID NO: 5129839 - DNA, 13 bp, Homo sapiens
acaagtcttgctg

SEQ ID NO: 5129840 - DNA, 16 bp, Homo sapiens
acaagtcttgctgtgc

SEQ ID NO: 5129841 - DNA, 14 bp, Homo sapiens
acaagtctttccag

SEQ ID NO: 5129842 - DNA, 14 bp, Homo sapiens
acaagtgaaaactg

SEQ ID NO: 5129843 - DNA, 15 bp, Homo sapiens
acaagtgaaaactga

SEQ ID NO: 5129844 - DNA, 21 bp, Homo sapiens
acaagtgaccccagggcctgt

SEQ ID NO: 5129845 - DNA, 20 bp, Homo sapiens
acaagtgactgtatctgtgt

SEQ ID NO: 5129846 - DNA, 22 bp, Homo sapiens
acaagtgactgtatctgtgtag

SEQ ID NO: 5129847 - DNA, 14 bp, Homo sapiens
acaagtgagggctt

SEQ ID NO: 5129848 - DNA, 23 bp, Homo sapiens
acaagtgatgctaaaacctgaaa

SEQ ID NO: 5129849 - DNA, 19 bp, Homo sapiens
acaagtgccctccaggctt

SEQ ID NO: 5129850 - DNA, 18 bp, Homo sapiens
acaagtgccgcaaattgt

SEQ ID NO: 5129851 - DNA, 20 bp, Homo sapiens
acaagtgccgcaaattgtac

SEQ ID NO: 5129852 - DNA, 23 bp, Homo sapiens
acaagtgccgcaaattgtacctt

SEQ ID NO: 5129853 - DNA, 17 bp, Homo sapiens
acaagtgctctttccac

SEQ ID NO: 5129854 - DNA, 14 bp, Homo sapiens
acaagtgctgaaca

SEQ ID NO: 5129855 - DNA, 13 bp, Homo sapiens
acaagtggagggg

SEQ ID NO: 5129856 - DNA, 11 bp, Homo sapiens
acaagtggctc

SEQ ID NO: 5129857 - DNA, 15 bp, Homo sapiens
acaagtggtaatttt

SEQ ID NO: 5129858 - DNA, 20 bp, Homo sapiens
acaagtggtaatttttgtac

SEQ ID NO: 5129859 - DNA, 21 bp, Homo sapiens
acaagtggtaatttttgtaca

SEQ ID NO: 5129860 - DNA, 23 bp, Homo sapiens
acaagtggtaatttttgtacatt

SEQ ID NO: 5129861 - DNA, 20 bp, Homo sapiens
acaagtggtgaccaaaattt

SEQ ID NO: 5129862 - DNA, 23 bp, Homo sapiens
acaagtggtgaccaaaattttta

SEQ ID NO: 5129863 - DNA, 18 bp, Homo sapiens
acaagtgtatatcagaaa

SEQ ID NO: 5129864 - DNA, 11 bp, Homo sapiens
acaagtgtcta

SEQ ID NO: 5129865 - DNA, 15 bp, Homo sapiens
acaagttaagattct

SEQ ID NO: 5129866 - DNA, 18 bp, Homo sapiens
acaagttaaggtatctgg

SEQ ID NO: 5129867 - DNA, 23 bp, Homo sapiens
acaagttagaaaattcagctcct

SEQ ID NO: 5129868 - DNA, 15 bp, Homo sapiens
acaagttattctctt

SEQ ID NO: 5129869 - DNA, 15 bp, Homo sapiens
acaagttccaacatg

SEQ ID NO: 5129870 - DNA, 17 bp, Homo sapiens
acaagttccaacatgca

SEQ ID NO: 5129871 - DNA, 18 bp, Homo sapiens
acaagttccctggagaaa

SEQ ID NO: 5129872 - DNA, 14 bp, Homo sapiens
acaagttctatttc

SEQ ID NO: 5129873 - DNA, 19 bp, Homo sapiens
acaagttctatttcttgaa

SEQ ID NO: 5129874 - DNA, 16 bp, Homo sapiens
acaagttctggcaaga

SEQ ID NO: 5129875 - DNA, 20 bp, Homo sapiens
acaagttctggcaagagcag

SEQ ID NO: 5129876 - DNA, 14 bp, Homo sapiens
acaagttctttccc

SEQ ID NO: 5129877 - DNA, 21 bp, Homo sapiens
acaagttctttcccagcctct

SEQ ID NO: 5129878 - DNA, 19 bp, Homo sapiens
acaagttgttattgttgaa

SEQ ID NO: 5129879 - DNA, 18 bp, Homo sapiens
acaagttgtttggtactt

SEQ ID NO: 5129880 - DNA, 19 bp, Homo sapiens
acaagttgtttggtacttt

SEQ ID NO: 5129881 - DNA, 22 bp, Homo sapiens
acaagtttcagtaatagctgaa

SEQ ID NO: 5129882 - DNA, 13 bp, Homo sapiens
acaagtttgctaa

SEQ ID NO: 5129883 - DNA, 17 bp, Homo sapiens
acaagtttgctaaaaga

SEQ ID NO: 5129884 - DNA, 19 bp, Homo sapiens
acaagtttgctaaaagaag

SEQ ID NO: 5129885 - DNA, 22 bp, Homo sapiens
acaagtttgctaaaagaagaga

SEQ ID NO: 5129886 - DNA, 15 bp, Homo sapiens
acaagttttaatgta

SEQ ID NO: 5129887 - DNA, 14 bp, Homo sapiens
acaagttttagtta

SEQ ID NO: 5129888 - DNA, 22 bp, Homo sapiens
acaagttttagttaaaactcat

SEQ ID NO: 5129889 - DNA, 22 bp, Homo sapiens
acaagtttttctgtcaagaaga

SEQ ID NO: 5129890 - DNA, 14 bp, Homo sapiens
acaataaaaaccaa

SEQ ID NO: 5129891 - DNA, 19 bp, Homo sapiens
acaataaaaaccaaagcat

SEQ ID NO: 5129892 - DNA, 13 bp, Homo sapiens
acaataaaaagaa

SEQ ID NO: 5129893 - DNA, 16 bp, Homo sapiens
acaataaaaatgttta

SEQ ID NO: 5129894 - DNA, 16 bp, Homo sapiens
acaataaaacattaat

SEQ ID NO: 5129895 - DNA, 22 bp, Homo sapiens
acaataaaagtgtccattgaaa

SEQ ID NO: 5129896 - DNA, 14 bp, Homo sapiens
acaataaaattttt

SEQ ID NO: 5129897 - DNA, 22 bp, Homo sapiens
acaataaaattttttttcatgt

SEQ ID NO: 5129898 - DNA, 18 bp, Homo sapiens
acaataaacatccttgta

SEQ ID NO: 5129899 - DNA, 22 bp, Homo sapiens
acaataaaccaaacccagccac

SEQ ID NO: 5129900 - DNA, 23 bp, Homo sapiens
acaataaaccaaacccagccact

SEQ ID NO: 5129901 - DNA, 20 bp, Homo sapiens
acaataaaccctcagagcct

SEQ ID NO: 5129902 - DNA, 13 bp, Homo sapiens
acaataaacgaaa

SEQ ID NO: 5129903 - DNA, 18 bp, Homo sapiens
acaataaacgaaacacag

SEQ ID NO: 5129904 - DNA, 10 bp, Homo sapiens
acaataaact

SEQ ID NO: 5129905 - DNA, 19 bp, Homo sapiens
acaataaagagaaccatgt

SEQ ID NO: 5129906 - DNA, 14 bp, Homo sapiens
acaataaagagatt

SEQ ID NO: 5129907 - DNA, 16 bp, Homo sapiens
acaataaagagctcaa

SEQ ID NO: 5129908 - DNA, 19 bp, Homo sapiens
acaataaagatatttccaa

SEQ ID NO: 5129909 - DNA, 23 bp, Homo sapiens
acaataaagatcgcccccacctc

SEQ ID NO: 5129910 - DNA, 17 bp, Homo sapiens
acaataaagcagtcctg

SEQ ID NO: 5129911 - DNA, 20 bp, Homo sapiens
acaataaagcagtcctgttc

SEQ ID NO: 5129912 - DNA, 16 bp, Homo sapiens
acaataaagtgacaaa

SEQ ID NO: 5129913 - DNA, 14 bp, Homo sapiens
acaataaagtttat

SEQ ID NO: 5129914 - DNA, 13 bp, Homo sapiens
acaataaatatac

SEQ ID NO: 5129915 - DNA, 13 bp, Homo sapiens
acaataaatattc

SEQ ID NO: 5129916 - DNA, 15 bp, Homo sapiens
acaataaatattctg

SEQ ID NO: 5129917 - DNA, 15 bp, Homo sapiens
acaataaatgaagat

SEQ ID NO: 5129918 - DNA, 11 bp, Homo sapiens
acaataaatgg

SEQ ID NO: 5129919 - DNA, 16 bp, Homo sapiens
acaataaatggccagt

SEQ ID NO: 5129920 - DNA, 13 bp, Homo sapiens
acaataaatgtat

SEQ ID NO: 5129921 - DNA, 15 bp, Homo sapiens
acaataaatgtgctt

SEQ ID NO: 5129922 - DNA, 23 bp, Homo sapiens
acaataaattgctaatgttgctg

SEQ ID NO: 5129923 - DNA, 17 bp, Homo sapiens
acaataaattttttttg

SEQ ID NO: 5129924 - DNA, 21 bp, Homo sapiens
acaataacactaaaattttag

SEQ ID NO: 5129925 - DNA, 13 bp, Homo sapiens
acaataacccagt

SEQ ID NO: 5129926 - DNA, 15 bp, Homo sapiens
acaataacccagtta

SEQ ID NO: 5129927 - DNA, 19 bp, Homo sapiens
acaataacccagttacttt

SEQ ID NO: 5129928 - DNA, 16 bp, Homo sapiens
acaataactactgtgt

SEQ ID NO: 5129929 - DNA, 18 bp, Homo sapiens
acaataactactgtgttc

SEQ ID NO: 5129930 - DNA, 21 bp, Homo sapiens
acaataactactgtgttcctg

SEQ ID NO: 5129931 - DNA, 22 bp, Homo sapiens
acaataactactgtgttcctgg

SEQ ID NO: 5129932 - DNA, 21 bp, Homo sapiens
acaataagagtctccttctct

SEQ ID NO: 5129933 - DNA, 22 bp, Homo sapiens
acaataagagtctccttctctt

SEQ ID NO: 5129934 - DNA, 15 bp, Homo sapiens
acaataagcaaaaac

SEQ ID NO: 5129935 - DNA, 23 bp, Homo sapiens
acaataagcgttaagggcagagt

SEQ ID NO: 5129936 - DNA, 21 bp, Homo sapiens
acaataagttaactattttat

SEQ ID NO: 5129937 - DNA, 12 bp, Homo sapiens
acaataagttac

SEQ ID NO: 5129938 - DNA, 19 bp, Homo sapiens
acaataagttacttgaaat

SEQ ID NO: 5129939 - DNA, 15 bp, Homo sapiens
acaataataaatgtt

SEQ ID NO: 5129940 - DNA, 21 bp, Homo sapiens
acaataatattgttgtataat

SEQ ID NO: 5129941 - DNA, 22 bp, Homo sapiens
acaataatattgttgtataatt

SEQ ID NO: 5129942 - DNA, 20 bp, Homo sapiens
acaataatatttcaagtgcc

SEQ ID NO: 5129943 - DNA, 20 bp, Homo sapiens
acaataatctctatttgaga

SEQ ID NO: 5129944 - DNA, 19 bp, Homo sapiens
acaataatgtaatttagtc

SEQ ID NO: 5129945 - DNA, 15 bp, Homo sapiens
acaataatgtactca

SEQ ID NO: 5129946 - DNA, 11 bp, Homo sapiens
acaataattaa

SEQ ID NO: 5129947 - DNA, 13 bp, Homo sapiens
acaataattcatc

SEQ ID NO: 5129948 - DNA, 18 bp, Homo sapiens
acaataattctacatgtt

SEQ ID NO: 5129949 - DNA, 17 bp, Homo sapiens
acaatacaacaagaaca

SEQ ID NO: 5129950 - DNA, 18 bp, Homo sapiens
acaatacaacaagaacaa

SEQ ID NO: 5129951 - DNA, 16 bp, Homo sapiens
acaatacaatgtacaa

SEQ ID NO: 5129952 - DNA, 12 bp, Homo sapiens
acaatacagata

SEQ ID NO: 5129953 - DNA, 14 bp, Homo sapiens
acaatacagataac

SEQ ID NO: 5129954 - DNA, 17 bp, Homo sapiens
acaatacagatcatctt

SEQ ID NO: 5129955 - DNA, 22 bp, Homo sapiens
acaccttggacatcctcctccc

SEQ ID NO: 5129956 - DNA, 19 bp, Homo sapiens
acaccttggggtccctcca

SEQ ID NO: 5129957 - DNA, 23 bp, Homo sapiens
acaccttggggtccctccacccc

SEQ ID NO: 5129958 - DNA, 16 bp, Homo sapiens
acacctttaggttctt

SEQ ID NO: 5129959 - DNA, 17 bp, Homo sapiens
acacctttattcagaac

SEQ ID NO: 5129960 - DNA, 17 bp, Homo sapiens
acacctttctcctttgt

SEQ ID NO: 5129961 - DNA, 15 bp, Homo sapiens
acaccttttaactca

SEQ ID NO: 5129962 - DNA, 23 bp, Homo sapiens
acaccttttattgacacagaaaa

SEQ ID NO: 5129963 - DNA, 18 bp, Homo sapiens
acaccttttgtatttaaa

SEQ ID NO: 5129964 - DNA, 17 bp, Homo sapiens
acacgaaacttgttatt

SEQ ID NO: 5129965 - DNA, 14 bp, Homo sapiens
acacgaagaaatag

SEQ ID NO: 5129966 - DNA, 16 bp, Homo sapiens
acacgaagaaatagaa

SEQ ID NO: 5129967 - DNA, 12 bp, Homo sapiens
acacgaatattg

SEQ ID NO: 5129968 - DNA, 14 bp, Homo sapiens
acacgacagcacac

SEQ ID NO: 5129969 - DNA, 22 bp, Homo sapiens
acacgacagcacacacagtgga

SEQ ID NO: 5129970 - DNA, 22 bp, Homo sapiens
acacgaccggggccagcaccac

SEQ ID NO: 5129971 - DNA, 16 bp, Homo sapiens
acacgagatttctttt

SEQ ID NO: 5129972 - DNA, 19 bp, Homo sapiens
acacgagccacaagctgca

SEQ ID NO: 5129973 - DNA, 22 bp, Homo sapiens
acacgatccgcaacccatgccc

SEQ ID NO: 5129974 - DNA, 16 bp, Homo sapiens
acacgatcttgtaaga

SEQ ID NO: 5129975 - DNA, 13 bp, Homo sapiens
acacgatgcattt

SEQ ID NO: 5129976 - DNA, 14 bp, Homo sapiens
acacgattagcttt

SEQ ID NO: 5129977 - DNA, 15 bp, Homo sapiens
acacgattagcttta

SEQ ID NO: 5129978 - DNA, 20 bp, Homo sapiens
acacgattttcaagattcta

SEQ ID NO: 5129979 - DNA, 22 bp, Homo sapiens
acacgcaaaagcgactcccagc

SEQ ID NO: 5129980 - DNA, 16 bp, Homo sapiens
acacgcaagggcatca

SEQ ID NO: 5129981 - DNA, 21 bp, Homo sapiens
acacgcaagggcatcaggcac

SEQ ID NO: 5129982 - DNA, 22 bp, Homo sapiens
acacgcaagggcatcaggcact

SEQ ID NO: 5129983 - DNA, 23 bp, Homo sapiens
acacgcaagggcatcaggcactg

SEQ ID NO: 5129984 - DNA, 16 bp, Homo sapiens
acacgcaagtgtgtga

SEQ ID NO: 5129985 - DNA, 17 bp, Homo sapiens
acacgcaagtgtgtgag

SEQ ID NO: 5129986 - DNA, 13 bp, Homo sapiens
acacgcacacaca

SEQ ID NO: 5129987 - DNA, 23 bp, Homo sapiens
acacgcacacacacacacaggag

SEQ ID NO: 5129988 - DNA, 20 bp, Homo sapiens
acacgcacacatcttacctc

SEQ ID NO: 5129989 - DNA, 13 bp, Homo sapiens
acacgcacctgcc

SEQ ID NO: 5129990 - DNA, 16 bp, Homo sapiens
acacgcacctgcctca

SEQ ID NO: 5129991 - DNA, 17 bp, Homo sapiens
acacgcacctgcctcag

SEQ ID NO: 5129992 - DNA, 13 bp, Homo sapiens
acacgcacgcaca

SEQ ID NO: 5129993 - DNA, 15 bp, Homo sapiens
acacgcacgcacaca

SEQ ID NO: 5129994 - DNA, 18 bp, Homo sapiens
acacgcacgcacacacac

SEQ ID NO: 5129995 - DNA, 20 bp, Homo sapiens
acacgcacgcacacacacaa

SEQ ID NO: 5129996 - DNA, 21 bp, Homo sapiens
acacgcacggcagccacagct

SEQ ID NO: 5129997 - DNA, 23 bp, Homo sapiens
acacgcactctccccgctcaggg

SEQ ID NO: 5129998 - DNA, 14 bp, Homo sapiens
acacgcagacacac

SEQ ID NO: 5129999 - DNA, 19 bp, Homo sapiens
acacgcaggaactcccagc

SEQ ID NO: 5130000 - DNA, 16 bp, Homo sapiens
acacgcaggcggccag

SEQ ID NO: 5130001 - DNA, 14 bp, Homo sapiens
acacgcagttgctc

SEQ ID NO: 5130002 - DNA, 20 bp, Homo sapiens
acacgcatgatggagctgat

SEQ ID NO: 5130003 - DNA, 15 bp, Homo sapiens
acacgcatgcctcag

SEQ ID NO: 5130004 - DNA, 17 bp, Homo sapiens
acacgcatgcctcagcc

SEQ ID NO: 5130005 - DNA, 20 bp, Homo sapiens
acacgcatggtcaaccctca

SEQ ID NO: 5130006 - DNA, 17 bp, Homo sapiens
acacgccggggctggcc

SEQ ID NO: 5130007 - DNA, 20 bp, Homo sapiens
acacgccggggctggccctg

SEQ ID NO: 5130008 - DNA, 21 bp, Homo sapiens
acacgccttcatgccagtgca

SEQ ID NO: 5130009 - DNA, 19 bp, Homo sapiens
acacgccttgttcctgctc

SEQ ID NO: 5130010 - DNA, 17 bp, Homo sapiens
acacgcgcgcacacaca

SEQ ID NO: 5130011 - DNA, 18 bp, Homo sapiens
acacgcggtggcatgcat

SEQ ID NO: 5130012 - DNA, 15 bp, Homo sapiens
acacgcgtccacata

SEQ ID NO: 5130013 - DNA, 17 bp, Homo sapiens
acacgcgtccacataca

SEQ ID NO: 5130014 - DNA, 21 bp, Homo sapiens
acacgcgtccacatacactgc

SEQ ID NO: 5130015 - DNA, 23 bp, Homo sapiens
acacgcgtccacatacactgcat

SEQ ID NO: 5130016 - DNA, 15 bp, Homo sapiens
acacgcgtgcacaca

SEQ ID NO: 5130017 - DNA, 17 bp, Homo sapiens
acacgcgtgcacacacc

SEQ ID NO: 5130018 - DNA, 17 bp, Homo sapiens
acacgctccctggaagc

SEQ ID NO: 5130019 - DNA, 17 bp, Homo sapiens
acacgctccttcctctg

SEQ ID NO: 5130020 - DNA, 19 bp, Homo sapiens
acacgctccttcctctgag

SEQ ID NO: 5130021 - DNA, 16 bp, Homo sapiens
acacgctcgcgggcag

SEQ ID NO: 5130022 - DNA, 12 bp, Homo sapiens
acacgctgccca

SEQ ID NO: 5130023 - DNA, 19 bp, Homo sapiens
acacgctgcccaggctctg

SEQ ID NO: 5130024 - DNA, 12 bp, Homo sapiens
acacgctgcctt

SEQ ID NO: 5130025 - DNA, 15 bp, Homo sapiens
acacgctgtctcttg

SEQ ID NO: 5130026 - DNA, 12 bp, Homo sapiens
acacgcttttgt

SEQ ID NO: 5130027 - DNA, 13 bp, Homo sapiens
acacggaagcaag

SEQ ID NO: 5130028 - DNA, 15 bp, Homo sapiens
acacggacactcaaa

SEQ ID NO: 5130029 - DNA, 18 bp, Homo sapiens
acacggactgaggtgcct

SEQ ID NO: 5130030 - DNA, 20 bp, Homo sapiens
acacggagaggccactgtgg

SEQ ID NO: 5130031 - DNA, 22 bp, Homo sapiens
acacggagcccagccctcccca

SEQ ID NO: 5130032 - DNA, 14 bp, Homo sapiens
acacggaggcatct

SEQ ID NO: 5130033 - DNA, 15 bp, Homo sapiens
acacggagtttccat

SEQ ID NO: 5130034 - DNA, 16 bp, Homo sapiens
acacggatctgagaat

SEQ ID NO: 5130035 - DNA, 19 bp, Homo sapiens
acacggatctgctgggctc

SEQ ID NO: 5130036 - DNA, 23 bp, Homo sapiens
acacggcacagagcatccgtctc

SEQ ID NO: 5130037 - DNA, 19 bp, Homo sapiens
acacggcagcccccccctc

SEQ ID NO: 5130038 - DNA, 13 bp, Homo sapiens
acacggcagctgt

SEQ ID NO: 5130039 - DNA, 17 bp, Homo sapiens
acacggcagctgtagct

SEQ ID NO: 5130040 - DNA, 14 bp, Homo sapiens
acacggccacatca

SEQ ID NO: 5130041 - DNA, 15 bp, Homo sapiens
acacggccctcctgg

SEQ ID NO: 5130042 - DNA, 14 bp, Homo sapiens
acacggctccccca

SEQ ID NO: 5130043 - DNA, 20 bp, Homo sapiens
acacggctcccccaggcctg

SEQ ID NO: 5130044 - DNA, 19 bp, Homo sapiens
acacggctgatatctttga

SEQ ID NO: 5130045 - DNA, 22 bp, Homo sapiens
acacggctgcctgacactgagc

SEQ ID NO: 5130046 - DNA, 20 bp, Homo sapiens
acacggctggtcactctgcc

SEQ ID NO: 5130047 - DNA, 13 bp, Homo sapiens
acacggcttcact

SEQ ID NO: 5130048 - DNA, 19 bp, Homo sapiens
acacggcttcactgaccag

SEQ ID NO: 5130049 - DNA, 16 bp, Homo sapiens
acacgggcagcctggc

SEQ ID NO: 5130050 - DNA, 23 bp, Homo sapiens
acacggggatcatctctgtgacc

SEQ ID NO: 5130051 - DNA, 17 bp, Homo sapiens
acacggggctcgggcct

SEQ ID NO: 5130052 - DNA, 23 bp, Homo sapiens
acacgggggcagctgatacaaat

SEQ ID NO: 5130053 - DNA, 15 bp, Homo sapiens
acacggtgaaatcca

SEQ ID NO: 5130054 - DNA, 19 bp, Homo sapiens
acacggtttgaagcctgga

SEQ ID NO: 5130055 - DNA, 19 bp, Homo sapiens
acacggttttggcagctga

SEQ ID NO: 5130056 - DNA, 16 bp, Homo sapiens
acacgtacttaaatga

SEQ ID NO: 5130057 - DNA, 19 bp, Homo sapiens
acacgtatttatatttgga

SEQ ID NO: 5130058 - DNA, 16 bp, Homo sapiens
acacgtcattgtgtaa

SEQ ID NO: 5130059 - DNA, 15 bp, Homo sapiens
acacgtccactccca

SEQ ID NO: 5130060 - DNA, 19 bp, Homo sapiens
acacgtctgaccctctcca

SEQ ID NO: 5130061 - DNA, 15 bp, Homo sapiens
acacgtgaggggggg

SEQ ID NO: 5130062 - DNA, 18 bp, Homo sapiens
acacgtgatggaccaaag

SEQ ID NO: 5130063 - DNA, 14 bp, Homo sapiens
acacgtgctcgcag

SEQ ID NO: 5130064 - DNA, 17 bp, Homo sapiens
acacgtggaggaatgct

SEQ ID NO: 5130065 - DNA, 20 bp, Homo sapiens
acacgtggaggaatgctccc

SEQ ID NO: 5130066 - DNA, 21 bp, Homo sapiens
acacgtggaggaatgctcccc

SEQ ID NO: 5130067 - DNA, 23 bp, Homo sapiens
acacgtggcctcgtgaggggcaa

SEQ ID NO: 5130068 - DNA, 14 bp, Homo sapiens
acacgtgtatatga

SEQ ID NO: 5130069 - DNA, 12 bp, Homo sapiens
acacgtgtcctg

SEQ ID NO: 5130070 - DNA, 22 bp, Homo sapiens
acacgtgtgcacatgcgcactc

SEQ ID NO: 5130071 - DNA, 12 bp, Homo sapiens
acacgtgtgtat

SEQ ID NO: 5130072 - DNA, 22 bp, Homo sapiens
acacgttgccaggggcttgaga

SEQ ID NO: 5130073 - DNA, 22 bp, Homo sapiens
acacgtttaatcccagcacttt

SEQ ID NO: 5130074 - DNA, 16 bp, Homo sapiens
acacgtttagaaatga

SEQ ID NO: 5130075 - DNA, 14 bp, Homo sapiens
acacgttttaagga

SEQ ID NO: 5130076 - DNA, 15 bp, Homo sapiens
acacgttttaaggac

SEQ ID NO: 5130077 - DNA, 22 bp, Homo sapiens
acacgttttaaggactgactga

SEQ ID NO: 5130078 - DNA, 15 bp, Homo sapiens
acactaaaaactgat

SEQ ID NO: 5130079 - DNA, 10 bp, Homo sapiens
acactaaaat

SEQ ID NO: 5130080 - DNA, 12 bp, Homo sapiens
acactaaaattt

SEQ ID NO: 5130081 - DNA, 20 bp, Homo sapiens
acactaaacagactatttaa

SEQ ID NO: 5130082 - DNA, 22 bp, Homo sapiens
acactaaatgctgattatttag

SEQ ID NO: 5130083 - DNA, 13 bp, Homo sapiens
acactaaatgtta

SEQ ID NO: 5130084 - DNA, 15 bp, Homo sapiens
acactaaatgttaaa

SEQ ID NO: 5130085 - DNA, 18 bp, Homo sapiens
acactaaatgttaaagat

SEQ ID NO: 5130086 - DNA, 20 bp, Homo sapiens
acactaaattagtttaaaat

SEQ ID NO: 5130087 - DNA, 23 bp, Homo sapiens
acactaaattagtttaaaatgaa

SEQ ID NO: 5130088 - DNA, 15 bp, Homo sapiens
acactaaattgcagt

SEQ ID NO: 5130089 - DNA, 19 bp, Homo sapiens
acactaacaaaatttgaat

SEQ ID NO: 5130090 - DNA, 13 bp, Homo sapiens
acactaacatttc

SEQ ID NO: 5130091 - DNA, 14 bp, Homo sapiens
acactaacatttcc

SEQ ID NO: 5130092 - DNA, 18 bp, Homo sapiens
acactaaccaaatctctc

SEQ ID NO: 5130093 - DNA, 14 bp, Homo sapiens
acactaaccacgct

SEQ ID NO: 5130094 - DNA, 16 bp, Homo sapiens
acactaaccacgctgg

SEQ ID NO: 5130095 - DNA, 14 bp, Homo sapiens
acactaacctgacc

SEQ ID NO: 5130096 - DNA, 15 bp, Homo sapiens
acactaacctgggtt

SEQ ID NO: 5130097 - DNA, 16 bp, Homo sapiens
acactaacgaaatatc

SEQ ID NO: 5130098 - DNA, 17 bp, Homo sapiens
acactaactcaccagcc

SEQ ID NO: 5130099 - DNA, 19 bp, Homo sapiens
acactaactcaccagcccc

SEQ ID NO: 5130100 - DNA, 20 bp, Homo sapiens
acactaactcaccagcccca

SEQ ID NO: 5130101 - DNA, 12 bp, Homo sapiens
acactaagaaat

SEQ ID NO: 5130102 - DNA, 14 bp, Homo sapiens
acactaagagagaa

SEQ ID NO: 5130103 - DNA, 17 bp, Homo sapiens
acactaagagagaatga

SEQ ID NO: 5130104 - DNA, 18 bp, Homo sapiens
acactaagctctctgggc

SEQ ID NO: 5130105 - DNA, 23 bp, Homo sapiens
acactaagttatagtatatctgg

SEQ ID NO: 5130106 - DNA, 23 bp, Homo sapiens
acactaagtttgcaacatttatt

SEQ ID NO: 5130107 - DNA, 15 bp, Homo sapiens
acactaatgaggaaa

SEQ ID NO: 5130108 - DNA, 12 bp, Homo sapiens
acactaattcat

SEQ ID NO: 5130109 - DNA, 17 bp, Homo sapiens
acactaattccttaaat

SEQ ID NO: 5130110 - DNA, 16 bp, Homo sapiens
acactaattgtccaca

SEQ ID NO: 5130111 - DNA, 21 bp, Homo sapiens
acactacaccacacacaacag

SEQ ID NO: 5130112 - DNA, 13 bp, Homo sapiens
acactacacccag

SEQ ID NO: 5130113 - DNA, 15 bp, Homo sapiens
acactacacccagca

SEQ ID NO: 5130114 - DNA, 14 bp, Homo sapiens
acactacacgcacc

SEQ ID NO: 5130115 - DNA, 20 bp, Homo sapiens
acactacagagcagctcccc

SEQ ID NO: 5130116 - DNA, 16 bp, Homo sapiens
acactaccaaacactc

SEQ ID NO: 5130117 - DNA, 13 bp, Homo sapiens
acactaccactcc

SEQ ID NO: 5130118 - DNA, 16 bp, Homo sapiens
acactaccgaatgtgt

SEQ ID NO: 5130119 - DNA, 23 bp, Homo sapiens
acactaccgaatgtgtctttaga

SEQ ID NO: 5130120 - DNA, 20 bp, Homo sapiens
acactaccttatcaggcaaa

SEQ ID NO: 5130121 - DNA, 18 bp, Homo sapiens
acactactcttacatgta

SEQ ID NO: 5130122 - DNA, 18 bp, Homo sapiens
acactactgtatttcatt

SEQ ID NO: 5130123 - DNA, 19 bp, Homo sapiens
acactactgtatttcatta

SEQ ID NO: 5130124 - DNA, 21 bp, Homo sapiens
acactagatgatattacagga

SEQ ID NO: 5130125 - DNA, 22 bp, Homo sapiens
acactagcatttttggcttact

SEQ ID NO: 5130126 - DNA, 15 bp, Homo sapiens
acactagccaaggaa

SEQ ID NO: 5130127 - DNA, 20 bp, Homo sapiens
acactagcccaatgaaatga

SEQ ID NO: 5130128 - DNA, 15 bp, Homo sapiens
acactagcttgaact

SEQ ID NO: 5130129 - DNA, 16 bp, Homo sapiens
acactaggagactggt

SEQ ID NO: 5130130 - DNA, 22 bp, Homo sapiens
acactagggactatcaggtaat

SEQ ID NO: 5130131 - DNA, 21 bp, Homo sapiens
acactaggggtttcacctgca

SEQ ID NO: 5130132 - DNA, 22 bp, Homo sapiens
acactagtaccttcagatccta

SEQ ID NO: 5130133 - DNA, 23 bp, Homo sapiens
acaatacatcccttacctgggaa

SEQ ID NO: 5130134 - DNA, 16 bp, Homo sapiens
acaatacatgagaaag

SEQ ID NO: 5130135 - DNA, 18 bp, Homo sapiens
acaatacatgagaaagat

SEQ ID NO: 5130136 - DNA, 13 bp, Homo sapiens
acaatacccccag

SEQ ID NO: 5130137 - DNA, 21 bp, Homo sapiens
acaataccgtaacaatgtttg

SEQ ID NO: 5130138 - DNA, 21 bp, Homo sapiens
acaatacctacaataaactgg

SEQ ID NO: 5130139 - DNA, 14 bp, Homo sapiens
acaatacctttttt

SEQ ID NO: 5130140 - DNA, 15 bp, Homo sapiens
acaatactaaataaa

SEQ ID NO: 5130141 - DNA, 20 bp, Homo sapiens
acaatactcataatgtgaag

SEQ ID NO: 5130142 - DNA, 19 bp, Homo sapiens
acaatactttgtgtctttt

SEQ ID NO: 5130143 - DNA, 20 bp, Homo sapiens
acaatacttttcaggcactt

SEQ ID NO: 5130144 - DNA, 13 bp, Homo sapiens
acaatagacagaa

SEQ ID NO: 5130145 - DNA, 16 bp, Homo sapiens
acaatagacagaaaca

SEQ ID NO: 5130146 - DNA, 22 bp, Homo sapiens
acaatagccgatatcagaattt

SEQ ID NO: 5130147 - DNA, 20 bp, Homo sapiens
acaatagctttaccctcagg

SEQ ID NO: 5130148 - DNA, 22 bp, Homo sapiens
acaataggatgggcttctgtgc

SEQ ID NO: 5130149 - DNA, 18 bp, Homo sapiens
acaatagggctaaatgtt

SEQ ID NO: 5130150 - DNA, 18 bp, Homo sapiens
acaatagtaacctgggta

SEQ ID NO: 5130151 - DNA, 15 bp, Homo sapiens
acaatagtatacatt

SEQ ID NO: 5130152 - DNA, 18 bp, Homo sapiens
acaatagtatacatttta

SEQ ID NO: 5130153 - DNA, 16 bp, Homo sapiens
acaatagtcagaaaac

SEQ ID NO: 5130154 - DNA, 20 bp, Homo sapiens
acaatagtgacaccagtaat

SEQ ID NO: 5130155 - DNA, 19 bp, Homo sapiens
acaatataaaactgtactt

SEQ ID NO: 5130156 - DNA, 15 bp, Homo sapiens
acaatatagtttttt

SEQ ID NO: 5130157 - DNA, 17 bp, Homo sapiens
acaatatataaaaatat

SEQ ID NO: 5130158 - DNA, 13 bp, Homo sapiens
acaatatatagaa

SEQ ID NO: 5130159 - DNA, 14 bp, Homo sapiens
acaatatatagaat

SEQ ID NO: 5130160 - DNA, 15 bp, Homo sapiens
acaatatatagaatt

SEQ ID NO: 5130161 - DNA, 20 bp, Homo sapiens
acaatatatattatatatat

SEQ ID NO: 5130162 - DNA, 13 bp, Homo sapiens
acaatatatattt

SEQ ID NO: 5130163 - DNA, 16 bp, Homo sapiens
acaatatatgatatat

SEQ ID NO: 5130164 - DNA, 17 bp, Homo sapiens
acaatatatgatatata

SEQ ID NO: 5130165 - DNA, 23 bp, Homo sapiens
acaatatatgatatataaacctt

SEQ ID NO: 5130166 - DNA, 13 bp, Homo sapiens
acaatatatgtaa

SEQ ID NO: 5130167 - DNA, 13 bp, Homo sapiens
acaatatatttgt

SEQ ID NO: 5130168 - DNA, 11 bp, Homo sapiens
acaatatcaat

SEQ ID NO: 5130169 - DNA, 17 bp, Homo sapiens
acaatatcatatcatca

SEQ ID NO: 5130170 - DNA, 14 bp, Homo sapiens
acaatatgctttac

SEQ ID NO: 5130171 - DNA, 18 bp, Homo sapiens
acaatatgtacatttcta

SEQ ID NO: 5130172 - DNA, 22 bp, Homo sapiens
acaatatgtgccaatcaatagc

SEQ ID NO: 5130173 - DNA, 19 bp, Homo sapiens
acaatattaagtgttgtac

SEQ ID NO: 5130174 - DNA, 15 bp, Homo sapiens
acaatattactttgt

SEQ ID NO: 5130175 - DNA, 20 bp, Homo sapiens
acaatattactttgtctttt

SEQ ID NO: 5130176 - DNA, 22 bp, Homo sapiens
acaatattgctagaggtggcat

SEQ ID NO: 5130177 - DNA, 15 bp, Homo sapiens
acaatattgtttcta

SEQ ID NO: 5130178 - DNA, 13 bp, Homo sapiens
acaatatttaaaa

SEQ ID NO: 5130179 - DNA, 18 bp, Homo sapiens
acaatatttaaaatttat

SEQ ID NO: 5130180 - DNA, 22 bp, Homo sapiens
acaatatttagcattattagtt

SEQ ID NO: 5130181 - DNA, 15 bp, Homo sapiens
acaatatttataaag

SEQ ID NO: 5130182 - DNA, 19 bp, Homo sapiens
acaatatttattgtatttt

SEQ ID NO: 5130183 - DNA, 12 bp, Homo sapiens
acaatatttctt

SEQ ID NO: 5130184 - DNA, 14 bp, Homo sapiens
acaatattttaagc

SEQ ID NO: 5130185 - DNA, 15 bp, Homo sapiens
acaatcaaagaaaag

SEQ ID NO: 5130186 - DNA, 23 bp, Homo sapiens
acaatcaactctaatagtgctta

SEQ ID NO: 5130187 - DNA, 15 bp, Homo sapiens
acaatcaacttttct

SEQ ID NO: 5130188 - DNA, 21 bp, Homo sapiens
acaatcacaaaagctgtgtct

SEQ ID NO: 5130189 - DNA, 16 bp, Homo sapiens
acaatcacagctcctc

SEQ ID NO: 5130190 - DNA, 18 bp, Homo sapiens
acaatcacagggaatggc

SEQ ID NO: 5130191 - DNA, 17 bp, Homo sapiens
acaatcactaaacttta

SEQ ID NO: 5130192 - DNA, 16 bp, Homo sapiens
acaatcagaaactctt

SEQ ID NO: 5130193 - DNA, 16 bp, Homo sapiens
acaatcagacatgagt

SEQ ID NO: 5130194 - DNA, 19 bp, Homo sapiens
acaatcagccacattctag

SEQ ID NO: 5130195 - DNA, 14 bp, Homo sapiens
acaatcagctgctt

SEQ ID NO: 5130196 - DNA, 18 bp, Homo sapiens
acaatcagttaaacacac

SEQ ID NO: 5130197 - DNA, 17 bp, Homo sapiens
acaatcatctattgagt

SEQ ID NO: 5130198 - DNA, 18 bp, Homo sapiens
acaatcatgaaatatgca

SEQ ID NO: 5130199 - DNA, 15 bp, Homo sapiens
acaatcatgtgtgtt

SEQ ID NO: 5130200 - DNA, 21 bp, Homo sapiens
acaatcatgtgtgttaaccca

SEQ ID NO: 5130201 - DNA, 22 bp, Homo sapiens
acaatcattgctgaaaatggta

SEQ ID NO: 5130202 - DNA, 12 bp, Homo sapiens
acaatccaaatg

SEQ ID NO: 5130203 - DNA, 19 bp, Homo sapiens
acaatccactctcaggagg

SEQ ID NO: 5130204 - DNA, 17 bp, Homo sapiens
acaatcccaatctttct

SEQ ID NO: 5130205 - DNA, 20 bp, Homo sapiens
acaatcccaatctttctata

SEQ ID NO: 5130206 - DNA, 19 bp, Homo sapiens
acaatcccacctagcccag

SEQ ID NO: 5130207 - DNA, 20 bp, Homo sapiens
acaatccccatcaggtagct

SEQ ID NO: 5130208 - DNA, 18 bp, Homo sapiens
acaatccctacagggtgt

SEQ ID NO: 5130209 - DNA, 15 bp, Homo sapiens
acaatccctggggct

SEQ ID NO: 5130210 - DNA, 17 bp, Homo sapiens
acaatcctaccttttga

SEQ ID NO: 5130211 - DNA, 13 bp, Homo sapiens
acaatcctgaaga

SEQ ID NO: 5130212 - DNA, 20 bp, Homo sapiens
acaatcctgttactctgtcc

SEQ ID NO: 5130213 - DNA, 20 bp, Homo sapiens
acaatccttttgataaattt

SEQ ID NO: 5130214 - DNA, 22 bp, Homo sapiens
acaatcgtattacataaaacac

SEQ ID NO: 5130215 - DNA, 18 bp, Homo sapiens
acaatctaacaataatat

SEQ ID NO: 5130216 - DNA, 16 bp, Homo sapiens
acaatctacactgcct

SEQ ID NO: 5130217 - DNA, 21 bp, Homo sapiens
acaatctatggcttatttcta

SEQ ID NO: 5130218 - DNA, 16 bp, Homo sapiens
acaatctatttaaaaa

SEQ ID NO: 5130219 - DNA, 14 bp, Homo sapiens
acaatctattttgt

SEQ ID NO: 5130220 - DNA, 20 bp, Homo sapiens
acaatctcggctcactgcat

SEQ ID NO: 5130221 - DNA, 14 bp, Homo sapiens
acaatctcttaaat

SEQ ID NO: 5130222 - DNA, 19 bp, Homo sapiens
acaatctctttttgtttgc

SEQ ID NO: 5130223 - DNA, 18 bp, Homo sapiens
acaatctgacattctcag

SEQ ID NO: 5130224 - DNA, 19 bp, Homo sapiens
acaatctggcttagtgcca

SEQ ID NO: 5130225 - DNA, 16 bp, Homo sapiens
acaatctgttctactc

SEQ ID NO: 5130226 - DNA, 19 bp, Homo sapiens
acaatctgttctactctta

SEQ ID NO: 5130227 - DNA, 20 bp, Homo sapiens
acaatctgttctactcttaa

SEQ ID NO: 5130228 - DNA, 21 bp, Homo sapiens
acaatctgttctactcttaat

SEQ ID NO: 5130229 - DNA, 20 bp, Homo sapiens
acaatcttaaggggcagctt

SEQ ID NO: 5130230 - DNA, 11 bp, Homo sapiens
acaatctttat

SEQ ID NO: 5130231 - DNA, 12 bp, Homo sapiens
acaatctttatt

SEQ ID NO: 5130232 - DNA, 21 bp, Homo sapiens
acaatctttccttgtctctca

SEQ ID NO: 5130233 - DNA, 13 bp, Homo sapiens
acaatctttgctg

SEQ ID NO: 5130234 - DNA, 12 bp, Homo sapiens
acaatgaaattg

SEQ ID NO: 5130235 - DNA, 16 bp, Homo sapiens
acaatgaacacttata

SEQ ID NO: 5130236 - DNA, 18 bp, Homo sapiens
acaatgaagataaaaaga

SEQ ID NO: 5130237 - DNA, 16 bp, Homo sapiens
acaatgaaggaaaacc

SEQ ID NO: 5130238 - DNA, 23 bp, Homo sapiens
acaatgaaggaaaacctcacttg

SEQ ID NO: 5130239 - DNA, 21 bp, Homo sapiens
acaatgaagggaaattgttta

SEQ ID NO: 5130240 - DNA, 17 bp, Homo sapiens
acaatgaagttgaaaat

SEQ ID NO: 5130241 - DNA, 16 bp, Homo sapiens
acaatgacaagatgtt

SEQ ID NO: 5130242 - DNA, 21 bp, Homo sapiens
acaatgacatacgcttttaat

SEQ ID NO: 5130243 - DNA, 16 bp, Homo sapiens
acaatgactaagccaa

SEQ ID NO: 5130244 - DNA, 20 bp, Homo sapiens
acaatgactaagccaagctg

SEQ ID NO: 5130245 - DNA, 22 bp, Homo sapiens
acaatgactaagccaagctgtg

SEQ ID NO: 5130246 - DNA, 23 bp, Homo sapiens
acaatgactaagccaagctgtgt

SEQ ID NO: 5130247 - DNA, 19 bp, Homo sapiens
acaatgactagtcacctgg

SEQ ID NO: 5130248 - DNA, 21 bp, Homo sapiens
acaatgactgctttgtttgga

SEQ ID NO: 5130249 - DNA, 14 bp, Homo sapiens
acaatgacttttaa

SEQ ID NO: 5130250 - DNA, 17 bp, Homo sapiens
acaatgagtaaaatcac

SEQ ID NO: 5130251 - DNA, 15 bp, Homo sapiens
acaatgatatatgga

SEQ ID NO: 5130252 - DNA, 16 bp, Homo sapiens
acaatgatgatgataa

SEQ ID NO: 5130253 - DNA, 19 bp, Homo sapiens
acaatgatgatgataatga

SEQ ID NO: 5130254 - DNA, 21 bp, Homo sapiens
acaatgatgatgataatgatg

SEQ ID NO: 5130255 - DNA, 22 bp, Homo sapiens
acaatgatgattaaacacctga

SEQ ID NO: 5130256 - DNA, 20 bp, Homo sapiens
acaatgatgccctgctccag

SEQ ID NO: 5130257 - DNA, 18 bp, Homo sapiens
acaatgatgccgaacatt

SEQ ID NO: 5130258 - DNA, 18 bp, Homo sapiens
acaatgatgctatttgca

SEQ ID NO: 5130259 - DNA, 22 bp, Homo sapiens
acaatgatgtataattaatgct

SEQ ID NO: 5130260 - DNA, 20 bp, Homo sapiens
acaatgattaatcagctgtt

SEQ ID NO: 5130261 - DNA, 15 bp, Homo sapiens
acaatgatttgtaaa

SEQ ID NO: 5130262 - DNA, 20 bp, Homo sapiens
acaatgatttgtaaaggact

SEQ ID NO: 5130263 - DNA, 19 bp, Homo sapiens
acaatgattttcttgaatg

SEQ ID NO: 5130264 - DNA, 16 bp, Homo sapiens
acaatgcaaaaccttt

SEQ ID NO: 5130265 - DNA, 11 bp, Homo sapiens
acaatgcaaac

SEQ ID NO: 5130266 - DNA, 17 bp, Homo sapiens
acaatgcaaaccatcat

SEQ ID NO: 5130267 - DNA, 18 bp, Homo sapiens
acaatgcaaaccatcatt

SEQ ID NO: 5130268 - DNA, 14 bp, Homo sapiens
acaatgcactttta

SEQ ID NO: 5130269 - DNA, 17 bp, Homo sapiens
acaatgcagatcttagg

SEQ ID NO: 5130270 - DNA, 19 bp, Homo sapiens
acaatgcagatgccagagc

SEQ ID NO: 5130271 - DNA, 17 bp, Homo sapiens
acaatgcatgctttgga

SEQ ID NO: 5130272 - DNA, 18 bp, Homo sapiens
acaatgccaagtcactct

SEQ ID NO: 5130273 - DNA, 15 bp, Homo sapiens
acaatgccatgaaca

SEQ ID NO: 5130274 - DNA, 17 bp, Homo sapiens
acaatgccatgaacaaa

SEQ ID NO: 5130275 - DNA, 22 bp, Homo sapiens
acaatgccatgaacaaattctt

SEQ ID NO: 5130276 - DNA, 17 bp, Homo sapiens
acaatgcctacagctgt

SEQ ID NO: 5130277 - DNA, 19 bp, Homo sapiens
acaatgcctacagctgtct

SEQ ID NO: 5130278 - DNA, 23 bp, Homo sapiens
acaatgcctagactgtgtatgtc

SEQ ID NO: 5130279 - DNA, 14 bp, Homo sapiens
acaatgcctctccc

SEQ ID NO: 5130280 - DNA, 20 bp, Homo sapiens
acaatgcctctcccacgatg

SEQ ID NO: 5130281 - DNA, 21 bp, Homo sapiens
acaatgcgaatggtagtctaa

SEQ ID NO: 5130282 - DNA, 12 bp, Homo sapiens
acaatgctgcca

SEQ ID NO: 5130283 - DNA, 22 bp, Homo sapiens
acaatgctgtgccctaaagtgt

SEQ ID NO: 5130284 - DNA, 20 bp, Homo sapiens
acaatgctttgataaaatat

SEQ ID NO: 5130285 - DNA, 21 bp, Homo sapiens
acaatgctttgataaaatatt

SEQ ID NO: 5130286 - DNA, 12 bp, Homo sapiens
acaatggaaacc

SEQ ID NO: 5130287 - DNA, 14 bp, Homo sapiens
acaatggaaaccat

SEQ ID NO: 5130288 - DNA, 17 bp, Homo sapiens
acaatggaaactttagg

SEQ ID NO: 5130289 - DNA, 16 bp, Homo sapiens
acaatggaccggagag

SEQ ID NO: 5130290 - DNA, 22 bp, Homo sapiens
acaatggcaagcatagtcgcct

SEQ ID NO: 5130291 - DNA, 11 bp, Homo sapiens
acaatggcacc

SEQ ID NO: 5130292 - DNA, 15 bp, Homo sapiens
acaatggcacctctg

SEQ ID NO: 5130293 - DNA, 22 bp, Homo sapiens
acaatggcacctctgcccttcc

SEQ ID NO: 5130294 - DNA, 18 bp, Homo sapiens
acaatggcagaacaggtg

SEQ ID NO: 5130295 - DNA, 15 bp, Homo sapiens
acaatgggaggctgt

SEQ ID NO: 5130296 - DNA, 14 bp, Homo sapiens
acaatggggacttc

SEQ ID NO: 5130297 - DNA, 23 bp, Homo sapiens
acaatggggctggttttgcttcc

SEQ ID NO: 5130298 - DNA, 17 bp, Homo sapiens
acaatggggtgggccca

SEQ ID NO: 5130299 - DNA, 14 bp, Homo sapiens
acaatggtagctct

SEQ ID NO: 5130300 - DNA, 22 bp, Homo sapiens
acaatggtgtctcttttatgtt

SEQ ID NO: 5130301 - DNA, 19 bp, Homo sapiens
acaatggtgtggtgaatgt

SEQ ID NO: 5130302 - DNA, 20 bp, Homo sapiens
acaatggttgaatgaataaa

SEQ ID NO: 5130303 - DNA, 15 bp, Homo sapiens
acaatggtttacatg

SEQ ID NO: 5130304 - DNA, 17 bp, Homo sapiens
acaatggtttattccca

SEQ ID NO: 5130305 - DNA, 19 bp, Homo sapiens
acaatggtttcaaagaaag

SEQ ID NO: 5130306 - DNA, 21 bp, Homo sapiens
acaatgtaataaaaagcctct

SEQ ID NO: 5130307 - DNA, 22 bp, Homo sapiens
acaatgtaattacattaaaatg

SEQ ID NO: 5130308 - DNA, 17 bp, Homo sapiens
acaatgtagataagtgt

SEQ ID NO: 5130309 - DNA, 14 bp, Homo sapiens
acaatgtataaaga

SEQ ID NO: 5130310 - DNA, 22 bp, Homo sapiens
acaatgtataaagattgtactt

SEQ ID NO: 5130311 - DNA, 12 bp, Homo sapiens
acactagtctgt

SEQ ID NO: 5130312 - DNA, 15 bp, Homo sapiens
acactagttcagagg

SEQ ID NO: 5130313 - DNA, 17 bp, Homo sapiens
acactataatataaaac

SEQ ID NO: 5130314 - DNA, 13 bp, Homo sapiens
acactatagtttt

SEQ ID NO: 5130315 - DNA, 15 bp, Homo sapiens
acactatatatttta

SEQ ID NO: 5130316 - DNA, 17 bp, Homo sapiens
acactatatctgtatat

SEQ ID NO: 5130317 - DNA, 18 bp, Homo sapiens
acactatatctgtatata

SEQ ID NO: 5130318 - DNA, 18 bp, Homo sapiens
acactatgcacagagccc

SEQ ID NO: 5130319 - DNA, 16 bp, Homo sapiens
acactatggggtgggg

SEQ ID NO: 5130320 - DNA, 17 bp, Homo sapiens
acactatggtatttgag

SEQ ID NO: 5130321 - DNA, 15 bp, Homo sapiens
acactatgtgtgttg

SEQ ID NO: 5130322 - DNA, 19 bp, Homo sapiens
acactatgtgtgttgtttc

SEQ ID NO: 5130323 - DNA, 21 bp, Homo sapiens
acactatgtgtgttgtttcca

SEQ ID NO: 5130324 - DNA, 12 bp, Homo sapiens
acactattacag

SEQ ID NO: 5130325 - DNA, 17 bp, Homo sapiens
acactattatttcctat

SEQ ID NO: 5130326 - DNA, 16 bp, Homo sapiens
acactattctccagaa

SEQ ID NO: 5130327 - DNA, 15 bp, Homo sapiens
acactattttatgca

SEQ ID NO: 5130328 - DNA, 13 bp, Homo sapiens
acactattttcag

SEQ ID NO: 5130329 - DNA, 14 bp, Homo sapiens
acactattttcaga

SEQ ID NO: 5130330 - DNA, 15 bp, Homo sapiens
acactattttcagaa

SEQ ID NO: 5130331 - DNA, 19 bp, Homo sapiens
acactcaaaagacaaacat

SEQ ID NO: 5130332 - DNA, 21 bp, Homo sapiens
acactcaaaagctgggcaggt

SEQ ID NO: 5130333 - DNA, 19 bp, Homo sapiens
acactcaaatcaagaaact

SEQ ID NO: 5130334 - DNA, 22 bp, Homo sapiens
acactcaaccatgacctcaccc

SEQ ID NO: 5130335 - DNA, 16 bp, Homo sapiens
acactcaagaagcagg

SEQ ID NO: 5130336 - DNA, 17 bp, Homo sapiens
acactcaagaagcaggc

SEQ ID NO: 5130337 - DNA, 18 bp, Homo sapiens
acactcaataaacagtca

SEQ ID NO: 5130338 - DNA, 14 bp, Homo sapiens
acactcaataaatt

SEQ ID NO: 5130339 - DNA, 20 bp, Homo sapiens
acactcacaatcatcttctc

SEQ ID NO: 5130340 - DNA, 22 bp, Homo sapiens
acactcacatttattctgctca

SEQ ID NO: 5130341 - DNA, 17 bp, Homo sapiens
acactcaccagtggcct

SEQ ID NO: 5130342 - DNA, 18 bp, Homo sapiens
acactcaccccagcctca

SEQ ID NO: 5130343 - DNA, 15 bp, Homo sapiens
acactcacttctctt

SEQ ID NO: 5130344 - DNA, 24 bp, Homo sapiens
acactcagaaaattccctggggtc

SEQ ID NO: 5130345 - DNA, 15 bp, Homo sapiens
acactcagaagcctg

SEQ ID NO: 5130346 - DNA, 19 bp, Homo sapiens
acactcagaagcctggggg

SEQ ID NO: 5130347 - DNA, 14 bp, Homo sapiens
acactcagacctga

SEQ ID NO: 5130348 - DNA, 19 bp, Homo sapiens
acactcagacctgaattct

SEQ ID NO: 5130349 - DNA, 22 bp, Homo sapiens
acactcagcagacatttatctt

SEQ ID NO: 5130350 - DNA, 14 bp, Homo sapiens
acactcagcagccc

SEQ ID NO: 5130351 - DNA, 19 bp, Homo sapiens
acactcagccactgtcaca

SEQ ID NO: 5130352 - DNA, 23 bp, Homo sapiens
acactcagccactgtcacaggca

SEQ ID NO: 5130353 - DNA, 13 bp, Homo sapiens
acactcagctgtt

SEQ ID NO: 5130354 - DNA, 17 bp, Homo sapiens
acactcagtccactgtt

SEQ ID NO: 5130355 - DNA, 18 bp, Homo sapiens
acactcagtcccccacca

SEQ ID NO: 5130356 - DNA, 23 bp, Homo sapiens
acactcagtggcccatggcattt

SEQ ID NO: 5130357 - DNA, 21 bp, Homo sapiens
acactcatccacacttaagcc

SEQ ID NO: 5130358 - DNA, 20 bp, Homo sapiens
acactcatcctacttcaaga

SEQ ID NO: 5130359 - DNA, 19 bp, Homo sapiens
acactcatgcacacagata

SEQ ID NO: 5130360 - DNA, 12 bp, Homo sapiens
acactcatgctg

SEQ ID NO: 5130361 - DNA, 15 bp, Homo sapiens
acactcatgctgaaa

SEQ ID NO: 5130362 - DNA, 20 bp, Homo sapiens
acactcatggggaagcttcc

SEQ ID NO: 5130363 - DNA, 16 bp, Homo sapiens
acactcattcattact

SEQ ID NO: 5130364 - DNA, 21 bp, Homo sapiens
acactcattgacctgaggccc

SEQ ID NO: 5130365 - DNA, 15 bp, Homo sapiens
acactccaattaagg

SEQ ID NO: 5130366 - DNA, 16 bp, Homo sapiens
acactccacattcttc

SEQ ID NO: 5130367 - DNA, 22 bp, Homo sapiens
acactccaccctccaccttcca

SEQ ID NO: 5130368 - DNA, 14 bp, Homo sapiens
acactccactctga

SEQ ID NO: 5130369 - DNA, 16 bp, Homo sapiens
acactccactctgatt

SEQ ID NO: 5130370 - DNA, 13 bp, Homo sapiens
acactccactgac

SEQ ID NO: 5130371 - DNA, 22 bp, Homo sapiens
acactccagaattacccttcct

SEQ ID NO: 5130372 - DNA, 11 bp, Homo sapiens
acactccagcc

SEQ ID NO: 5130373 - DNA, 14 bp, Homo sapiens
acactccagcctga

SEQ ID NO: 5130374 - DNA, 14 bp, Homo sapiens
acactccagggaca

SEQ ID NO: 5130375 - DNA, 20 bp, Homo sapiens
acactccagggacacacagc

SEQ ID NO: 5130376 - DNA, 15 bp, Homo sapiens
acactccagtggcag

SEQ ID NO: 5130377 - DNA, 16 bp, Homo sapiens
acactccagtggcaga

SEQ ID NO: 5130378 - DNA, 20 bp, Homo sapiens
acactccattattcctctca

SEQ ID NO: 5130379 - DNA, 20 bp, Homo sapiens
acactcccaaggttggagcc

SEQ ID NO: 5130380 - DNA, 19 bp, Homo sapiens
acactccccacttcacttt

SEQ ID NO: 5130381 - DNA, 17 bp, Homo sapiens
acactcccccagcccca

SEQ ID NO: 5130382 - DNA, 18 bp, Homo sapiens
acactcccccctccattc

SEQ ID NO: 5130383 - DNA, 16 bp, Homo sapiens
acactccccgccttag

SEQ ID NO: 5130384 - DNA, 17 bp, Homo sapiens
acactcccctgcactgg

SEQ ID NO: 5130385 - DNA, 16 bp, Homo sapiens
acactcctacacctaa

SEQ ID NO: 5130386 - DNA, 14 bp, Homo sapiens
acactcctagagaa

SEQ ID NO: 5130387 - DNA, 22 bp, Homo sapiens
acactcctcctgccagctctgt

SEQ ID NO: 5130388 - DNA, 22 bp, Homo sapiens
acactcctctatcatgcaaaaa

SEQ ID NO: 5130389 - DNA, 17 bp, Homo sapiens
acactcctctgcgtcta

SEQ ID NO: 5130390 - DNA, 20 bp, Homo sapiens
acactcctgggctctgaaca

SEQ ID NO: 5130391 - DNA, 13 bp, Homo sapiens
acactccttcccc

SEQ ID NO: 5130392 - DNA, 13 bp, Homo sapiens
acactccttgcat

SEQ ID NO: 5130393 - DNA, 15 bp, Homo sapiens
acactccttgtcaac

SEQ ID NO: 5130394 - DNA, 17 bp, Homo sapiens
acactcgccatctcctg

SEQ ID NO: 5130395 - DNA, 15 bp, Homo sapiens
acactcgtgtgcatg

SEQ ID NO: 5130396 - DNA, 17 bp, Homo sapiens
acactctaagttctatt

SEQ ID NO: 5130397 - DNA, 19 bp, Homo sapiens
acactctagtgacttcctg

SEQ ID NO: 5130398 - DNA, 20 bp, Homo sapiens
acactctcatgtccccttcc

SEQ ID NO: 5130399 - DNA, 21 bp, Homo sapiens
acactctcccattatatttat

SEQ ID NO: 5130400 - DNA, 13 bp, Homo sapiens
acactctcctggg

SEQ ID NO: 5130401 - DNA, 14 bp, Homo sapiens
acactctcctgggc

SEQ ID NO: 5130402 - DNA, 15 bp, Homo sapiens
acactctcctgggcc

SEQ ID NO: 5130403 - DNA, 19 bp, Homo sapiens
acactctcctgggcccctc

SEQ ID NO: 5130404 - DNA, 20 bp, Homo sapiens
acactctcctgggcccctcc

SEQ ID NO: 5130405 - DNA, 17 bp, Homo sapiens
acactctccttgcagtt

SEQ ID NO: 5130406 - DNA, 18 bp, Homo sapiens
acactctccttgcagttc

SEQ ID NO: 5130407 - DNA, 22 bp, Homo sapiens
acactctccttgcagttcttga

SEQ ID NO: 5130408 - DNA, 23 bp, Homo sapiens
acactctccttgcagttcttgag

SEQ ID NO: 5130409 - DNA, 18 bp, Homo sapiens
acactctctgcagcccag

SEQ ID NO: 5130410 - DNA, 20 bp, Homo sapiens
acactctctgcagcccagcc

SEQ ID NO: 5130411 - DNA, 14 bp, Homo sapiens
acactctctggaag

SEQ ID NO: 5130412 - DNA, 14 bp, Homo sapiens
acactctcttctcc

SEQ ID NO: 5130413 - DNA, 11 bp, Homo sapiens
acactctgaga

SEQ ID NO: 5130414 - DNA, 13 bp, Homo sapiens
acactctgatttt

SEQ ID NO: 5130415 - DNA, 21 bp, Homo sapiens
acactctgccttcctgagtcc

SEQ ID NO: 5130416 - DNA, 16 bp, Homo sapiens
acactctgctctgccc

SEQ ID NO: 5130417 - DNA, 14 bp, Homo sapiens
acactctgtgtttt

SEQ ID NO: 5130418 - DNA, 13 bp, Homo sapiens
acactcttagcta

SEQ ID NO: 5130419 - DNA, 21 bp, Homo sapiens
acactcttcttcaagttgagg

SEQ ID NO: 5130420 - DNA, 20 bp, Homo sapiens
acactgaaaaaatactacct

SEQ ID NO: 5130421 - DNA, 14 bp, Homo sapiens
acactgaaaaatta

SEQ ID NO: 5130422 - DNA, 22 bp, Homo sapiens
acactgaaaagaaggaaagatg

SEQ ID NO: 5130423 - DNA, 17 bp, Homo sapiens
acactgaaaccaaaaca

SEQ ID NO: 5130424 - DNA, 21 bp, Homo sapiens
acactgaaagctctgttgcaa

SEQ ID NO: 5130425 - DNA, 13 bp, Homo sapiens
acactgaaaggaa

SEQ ID NO: 5130426 - DNA, 17 bp, Homo sapiens
acactgaaagttttgta

SEQ ID NO: 5130427 - DNA, 21 bp, Homo sapiens
acactgaaccgctacaagagg

SEQ ID NO: 5130428 - DNA, 24 bp, Homo sapiens
acactgaaccttgttgatgccagc

SEQ ID NO: 5130429 - DNA, 18 bp, Homo sapiens
acactgaactcaggatgg

SEQ ID NO: 5130430 - DNA, 21 bp, Homo sapiens
acactgaagctcttgaagaca

SEQ ID NO: 5130431 - DNA, 19 bp, Homo sapiens
acactgaagttaacagaga

SEQ ID NO: 5130432 - DNA, 13 bp, Homo sapiens
acactgaattgaa

SEQ ID NO: 5130433 - DNA, 16 bp, Homo sapiens
acactgaatttttatg

SEQ ID NO: 5130434 - DNA, 20 bp, Homo sapiens
acactgaatttttatgtgtg

SEQ ID NO: 5130435 - DNA, 22 bp, Homo sapiens
acactgaccttggagagacaca

SEQ ID NO: 5130436 - DNA, 23 bp, Homo sapiens
acactgaccttggagagacacag

SEQ ID NO: 5130437 - DNA, 13 bp, Homo sapiens
acactgacttgag

SEQ ID NO: 5130438 - DNA, 19 bp, Homo sapiens
acactgagatccagagagg

SEQ ID NO: 5130439 - DNA, 21 bp, Homo sapiens
acactgagcaagatcttgtct

SEQ ID NO: 5130440 - DNA, 17 bp, Homo sapiens
acactgagctgggcacc

SEQ ID NO: 5130441 - DNA, 22 bp, Homo sapiens
acactgagctgtgacccagagg

SEQ ID NO: 5130442 - DNA, 17 bp, Homo sapiens
acactgagcttctgaga

SEQ ID NO: 5130443 - DNA, 18 bp, Homo sapiens
acactgagcttctgagac

SEQ ID NO: 5130444 - DNA, 14 bp, Homo sapiens
acactgaggactgt

SEQ ID NO: 5130445 - DNA, 17 bp, Homo sapiens
acactgaggcagccttg

SEQ ID NO: 5130446 - DNA, 14 bp, Homo sapiens
acactgaggcaggg

SEQ ID NO: 5130447 - DNA, 16 bp, Homo sapiens
acactgaggcagggaa

SEQ ID NO: 5130448 - DNA, 21 bp, Homo sapiens
acactgaggcttaggcctctc

SEQ ID NO: 5130449 - DNA, 18 bp, Homo sapiens
acactgagtgaggagtgg

SEQ ID NO: 5130450 - DNA, 20 bp, Homo sapiens
acactgagttctatcagtta

SEQ ID NO: 5130451 - DNA, 23 bp, Homo sapiens
acactgagttctatcagttatcc

SEQ ID NO: 5130452 - DNA, 21 bp, Homo sapiens
acactgagttgggcaaaaccc

SEQ ID NO: 5130453 - DNA, 13 bp, Homo sapiens
acactgagtttct

SEQ ID NO: 5130454 - DNA, 15 bp, Homo sapiens
acactgataaaagtt

SEQ ID NO: 5130455 - DNA, 21 bp, Homo sapiens
acactgatacataaaaattaa

SEQ ID NO: 5130456 - DNA, 15 bp, Homo sapiens
acactgatccagccc

SEQ ID NO: 5130457 - DNA, 23 bp, Homo sapiens
acactgatgagtttcactgtact

SEQ ID NO: 5130458 - DNA, 20 bp, Homo sapiens
acactgatgataggttaata

SEQ ID NO: 5130459 - DNA, 14 bp, Homo sapiens
acactgatgcaagg

SEQ ID NO: 5130460 - DNA, 15 bp, Homo sapiens
acactgatggctcaa

SEQ ID NO: 5130461 - DNA, 20 bp, Homo sapiens
acactgatgggctggggcag

SEQ ID NO: 5130462 - DNA, 23 bp, Homo sapiens
acactgatgggtcctgctgctcg

SEQ ID NO: 5130463 - DNA, 16 bp, Homo sapiens
acactgattcctggag

SEQ ID NO: 5130464 - DNA, 13 bp, Homo sapiens
acactgcaaattt

SEQ ID NO: 5130465 - DNA, 20 bp, Homo sapiens
acactgcaatcatatgtgat

SEQ ID NO: 5130466 - DNA, 20 bp, Homo sapiens
acactgcactttgtttagaa

SEQ ID NO: 5130467 - DNA, 21 bp, Homo sapiens
acactgcactttgtttagaaa

SEQ ID NO: 5130468 - DNA, 22 bp, Homo sapiens
acactgcagagactaatgttgg

SEQ ID NO: 5130469 - DNA, 18 bp, Homo sapiens
acactgcagccccaccca

SEQ ID NO: 5130470 - DNA, 20 bp, Homo sapiens
acactgcaggcatcacagct

SEQ ID NO: 5130471 - DNA, 17 bp, Homo sapiens
acactgcagggctgctg

SEQ ID NO: 5130472 - DNA, 15 bp, Homo sapiens
acactgcagtgttat

SEQ ID NO: 5130473 - DNA, 16 bp, Homo sapiens
acactgcagtttcctg

SEQ ID NO: 5130474 - DNA, 17 bp, Homo sapiens
acactgcataggaattt

SEQ ID NO: 5130475 - DNA, 14 bp, Homo sapiens
acactgccaagagc

SEQ ID NO: 5130476 - DNA, 14 bp, Homo sapiens
acactgccaccttg

SEQ ID NO: 5130477 - DNA, 15 bp, Homo sapiens
acactgccagaagag

SEQ ID NO: 5130478 - DNA, 23 bp, Homo sapiens
acactgccagaagagaattcagt

SEQ ID NO: 5130479 - DNA, 19 bp, Homo sapiens
acactgccagaagtgtgtt

SEQ ID NO: 5130480 - DNA, 12 bp, Homo sapiens
acactgccagcc

SEQ ID NO: 5130481 - DNA, 22 bp, Homo sapiens
acactgccatcttagtttggat

SEQ ID NO: 5130482 - DNA, 16 bp, Homo sapiens
acactgccccaggact

SEQ ID NO: 5130483 - DNA, 18 bp, Homo sapiens
acactgccccaggactgt

SEQ ID NO: 5130484 - DNA, 15 bp, Homo sapiens
acactgccctcttgt

SEQ ID NO: 5130485 - DNA, 12 bp, Homo sapiens
acactgcctgcc

SEQ ID NO: 5130486 - DNA, 16 bp, Homo sapiens
acactgcctgccttaa

SEQ ID NO: 5130487 - DNA, 18 bp, Homo sapiens
acactgcctgtatacttt

SEQ ID NO: 5130488 - DNA, 20 bp, Homo sapiens
acactgcctgtatactttag

SEQ ID NO: 5130489 - DNA, 14 bp, Homo sapiens
acaatgtatacaat

SEQ ID NO: 5130490 - DNA, 16 bp, Homo sapiens
acaatgtatgtaattt

SEQ ID NO: 5130491 - DNA, 16 bp, Homo sapiens
acaatgtatgtacaat

SEQ ID NO: 5130492 - DNA, 21 bp, Homo sapiens
acaatgtatgtacaatacaat

SEQ ID NO: 5130493 - DNA, 22 bp, Homo sapiens
acaatgtatgtacaatacaatg

SEQ ID NO: 5130494 - DNA, 20 bp, Homo sapiens
acaatgtattttaataacat

SEQ ID NO: 5130495 - DNA, 13 bp, Homo sapiens
acaatgtattttg

SEQ ID NO: 5130496 - DNA, 22 bp, Homo sapiens
acaatgtattttggaagacata

SEQ ID NO: 5130497 - DNA, 15 bp, Homo sapiens
acaatgtcagtattt

SEQ ID NO: 5130498 - DNA, 22 bp, Homo sapiens
acaatgtcagtatttcagtgta

SEQ ID NO: 5130499 - DNA, 23 bp, Homo sapiens
acaatgtcagtatttcagtgtag

SEQ ID NO: 5130500 - DNA, 11 bp, Homo sapiens
acaatgtctgc

SEQ ID NO: 5130501 - DNA, 19 bp, Homo sapiens
acaatgtctgcagccctga

SEQ ID NO: 5130502 - DNA, 11 bp, Homo sapiens
acaatgtcttg

SEQ ID NO: 5130503 - DNA, 12 bp, Homo sapiens
acaatgtgaaac

SEQ ID NO: 5130504 - DNA, 12 bp, Homo sapiens
acaatgtgaact

SEQ ID NO: 5130505 - DNA, 20 bp, Homo sapiens
acaatgtgaataatggcact

SEQ ID NO: 5130506 - DNA, 13 bp, Homo sapiens
acaatgtgaatag

SEQ ID NO: 5130507 - DNA, 23 bp, Homo sapiens
acaatgtgatatgtgtaatatca

SEQ ID NO: 5130508 - DNA, 18 bp, Homo sapiens
acaatgtggaattacata

SEQ ID NO: 5130509 - DNA, 21 bp, Homo sapiens
acaatgtggaattacataaca

SEQ ID NO: 5130510 - DNA, 23 bp, Homo sapiens
acaatgtggacgtgcactgacag

SEQ ID NO: 5130511 - DNA, 17 bp, Homo sapiens
acaatgtggagtctccc

SEQ ID NO: 5130512 - DNA, 18 bp, Homo sapiens
acaatgtggatttgggga

SEQ ID NO: 5130513 - DNA, 21 bp, Homo sapiens
acaatgtgtctatttctgaaa

SEQ ID NO: 5130514 - DNA, 14 bp, Homo sapiens
acaatgtgtctgag

SEQ ID NO: 5130515 - DNA, 23 bp, Homo sapiens
acaatgtgtctttctttttggac

SEQ ID NO: 5130516 - DNA, 18 bp, Homo sapiens
acaatgtgtttttctcca

SEQ ID NO: 5130517 - DNA, 14 bp, Homo sapiens
acaatgttaaggaa

SEQ ID NO: 5130518 - DNA, 19 bp, Homo sapiens
acaatgttccttttttgta

SEQ ID NO: 5130519 - DNA, 23 bp, Homo sapiens
acaatgttctgttgtaaagagtg

SEQ ID NO: 5130520 - DNA, 12 bp, Homo sapiens
acaatgttcttt

SEQ ID NO: 5130521 - DNA, 16 bp, Homo sapiens
acaatgttctttatat

SEQ ID NO: 5130522 - DNA, 17 bp, Homo sapiens
acaatgttctttatata

SEQ ID NO: 5130523 - DNA, 15 bp, Homo sapiens
acaatgttgagaagt

SEQ ID NO: 5130524 - DNA, 23 bp, Homo sapiens
acaatgttgtccaacaataaaca

SEQ ID NO: 5130525 - DNA, 17 bp, Homo sapiens
acaatgttgtcctcctg

SEQ ID NO: 5130526 - DNA, 17 bp, Homo sapiens
acaatgtttaaaccttt

SEQ ID NO: 5130527 - DNA, 20 bp, Homo sapiens
acaatgtttcagaagcccca

SEQ ID NO: 5130528 - DNA, 13 bp, Homo sapiens
acaatgtttgatg

SEQ ID NO: 5130529 - DNA, 14 bp, Homo sapiens
acaatgtttttcat

SEQ ID NO: 5130530 - DNA, 19 bp, Homo sapiens
acaatgttttttatacttc

SEQ ID NO: 5130531 - DNA, 20 bp, Homo sapiens
acaatgttttttatacttca

SEQ ID NO: 5130532 - DNA, 12 bp, Homo sapiens
acaattaactgc

SEQ ID NO: 5130533 - DNA, 16 bp, Homo sapiens
acaattaataaatgtc

SEQ ID NO: 5130534 - DNA, 17 bp, Homo sapiens
acaattaatagtttgtc

SEQ ID NO: 5130535 - DNA, 15 bp, Homo sapiens
acaattaattcatcc

SEQ ID NO: 5130536 - DNA, 17 bp, Homo sapiens
acaattacatgtaaaca

SEQ ID NO: 5130537 - DNA, 19 bp, Homo sapiens
acaattacatgtaaacaaa

SEQ ID NO: 5130538 - DNA, 16 bp, Homo sapiens
acaattactgtacaca

SEQ ID NO: 5130539 - DNA, 16 bp, Homo sapiens
acaattactttagaaa

SEQ ID NO: 5130540 - DNA, 20 bp, Homo sapiens
acaattactttgaacattaa

SEQ ID NO: 5130541 - DNA, 12 bp, Homo sapiens
acaattagagaa

SEQ ID NO: 5130542 - DNA, 16 bp, Homo sapiens
acaattagcagaatgg

SEQ ID NO: 5130543 - DNA, 17 bp, Homo sapiens
acaattagcagaatgga

SEQ ID NO: 5130544 - DNA, 21 bp, Homo sapiens
acaattaggtctgcattttct

SEQ ID NO: 5130545 - DNA, 22 bp, Homo sapiens
acaattaggtctgcattttctc

SEQ ID NO: 5130546 - DNA, 23 bp, Homo sapiens
acaattataaactcattttgctt

SEQ ID NO: 5130547 - DNA, 21 bp, Homo sapiens
acaattatgaaaaaatgttca

SEQ ID NO: 5130548 - DNA, 15 bp, Homo sapiens
acaattatgtctctt

SEQ ID NO: 5130549 - DNA, 16 bp, Homo sapiens
acaattatgtctcttg

SEQ ID NO: 5130550 - DNA, 14 bp, Homo sapiens
acaattattggcaa

SEQ ID NO: 5130551 - DNA, 15 bp, Homo sapiens
acaattattgtatat

SEQ ID NO: 5130552 - DNA, 19 bp, Homo sapiens
acaattattgtatattgat

SEQ ID NO: 5130553 - DNA, 17 bp, Homo sapiens
acaattatttaaagcaa

SEQ ID NO: 5130554 - DNA, 21 bp, Homo sapiens
acaattatttttacagttctc

SEQ ID NO: 5130555 - DNA, 19 bp, Homo sapiens
acaattcaaagaatcacct

SEQ ID NO: 5130556 - DNA, 13 bp, Homo sapiens
acaattcaaatgc

SEQ ID NO: 5130557 - DNA, 15 bp, Homo sapiens
acaattcaagctgag

SEQ ID NO: 5130558 - DNA, 15 bp, Homo sapiens
acaattcaatcaaag

SEQ ID NO: 5130559 - DNA, 20 bp, Homo sapiens
acaattcacttcattgacca

SEQ ID NO: 5130560 - DNA, 16 bp, Homo sapiens
acaattcagtaacaaa

SEQ ID NO: 5130561 - DNA, 21 bp, Homo sapiens
acaattcagtactgattattc

SEQ ID NO: 5130562 - DNA, 15 bp, Homo sapiens
acaattcattggctc

SEQ ID NO: 5130563 - DNA, 17 bp, Homo sapiens
acaattcattggctcct

SEQ ID NO: 5130564 - DNA, 23 bp, Homo sapiens
acaattcattgttaaaaaacaac

SEQ ID NO: 5130565 - DNA, 20 bp, Homo sapiens
acaattcattgttttgcaaa

SEQ ID NO: 5130566 - DNA, 18 bp, Homo sapiens
acaattccaaaggaatct

SEQ ID NO: 5130567 - DNA, 13 bp, Homo sapiens
acaattccatgac

SEQ ID NO: 5130568 - DNA, 17 bp, Homo sapiens
acaattccatttccagt

SEQ ID NO: 5130569 - DNA, 19 bp, Homo sapiens
acaattcctagataaaaag

SEQ ID NO: 5130570 - DNA, 22 bp, Homo sapiens
acaattcctctactaacaatca

SEQ ID NO: 5130571 - DNA, 15 bp, Homo sapiens
acaattcctgtgctc

SEQ ID NO: 5130572 - DNA, 13 bp, Homo sapiens
acaattctaatgg

SEQ ID NO: 5130573 - DNA, 16 bp, Homo sapiens
acaattctaatggtaa

SEQ ID NO: 5130574 - DNA, 20 bp, Homo sapiens
acaattctaatggtaacttt

SEQ ID NO: 5130575 - DNA, 19 bp, Homo sapiens
acaattctccctatcttgt

SEQ ID NO: 5130576 - DNA, 20 bp, Homo sapiens
acaattctccctatcttgtg

SEQ ID NO: 5130577 - DNA, 14 bp, Homo sapiens
acaattctgcagaa

SEQ ID NO: 5130578 - DNA, 13 bp, Homo sapiens
acaattctttata

SEQ ID NO: 5130579 - DNA, 13 bp, Homo sapiens
acaattctttgtt

SEQ ID NO: 5130580 - DNA, 16 bp, Homo sapiens
acaattgaaattttta

SEQ ID NO: 5130581 - DNA, 19 bp, Homo sapiens
acaattgaacttaaataaa

SEQ ID NO: 5130582 - DNA, 22 bp, Homo sapiens
acaattgaacttccaggaaagt

SEQ ID NO: 5130583 - DNA, 22 bp, Homo sapiens
acaattgaggtaagttttttga

SEQ ID NO: 5130584 - DNA, 17 bp, Homo sapiens
acaattgatacttcagg

SEQ ID NO: 5130585 - DNA, 17 bp, Homo sapiens
acaattgatctttttta

SEQ ID NO: 5130586 - DNA, 13 bp, Homo sapiens
acaattgattttc

SEQ ID NO: 5130587 - DNA, 21 bp, Homo sapiens
acaattgcaaatcagagcata

SEQ ID NO: 5130588 - DNA, 20 bp, Homo sapiens
acaattgggagctgccaaga

SEQ ID NO: 5130589 - DNA, 23 bp, Homo sapiens
acaattggtaaaactcactgtga

SEQ ID NO: 5130590 - DNA, 15 bp, Homo sapiens
acaattggtgtcatt

SEQ ID NO: 5130591 - DNA, 18 bp, Homo sapiens
acaattggtgtcattttc

SEQ ID NO: 5130592 - DNA, 20 bp, Homo sapiens
acaattgtaaaactgaggca

SEQ ID NO: 5130593 - DNA, 13 bp, Homo sapiens
acaattgtaaagt

SEQ ID NO: 5130594 - DNA, 13 bp, Homo sapiens
acaattgtcttaa

SEQ ID NO: 5130595 - DNA, 14 bp, Homo sapiens
acaattgtcttaaa

SEQ ID NO: 5130596 - DNA, 15 bp, Homo sapiens
acaattgtcttaaaa

SEQ ID NO: 5130597 - DNA, 16 bp, Homo sapiens
acaattgtgaacatga

SEQ ID NO: 5130598 - DNA, 20 bp, Homo sapiens
acaattgtgaacatgatagt

SEQ ID NO: 5130599 - DNA, 14 bp, Homo sapiens
acaattgtgacagc

SEQ ID NO: 5130600 - DNA, 19 bp, Homo sapiens
acaattgtgggcataaact

SEQ ID NO: 5130601 - DNA, 17 bp, Homo sapiens
acaattgtgtagccttt

SEQ ID NO: 5130602 - DNA, 17 bp, Homo sapiens
acaattgttacagtact

SEQ ID NO: 5130603 - DNA, 23 bp, Homo sapiens
acaattgttacagtactgttccc

SEQ ID NO: 5130604 - DNA, 22 bp, Homo sapiens
acaattgttttaatctgaaatt

SEQ ID NO: 5130605 - DNA, 17 bp, Homo sapiens
acaatttaaaatatttc

SEQ ID NO: 5130606 - DNA, 14 bp, Homo sapiens
acaatttaaagcaa

SEQ ID NO: 5130607 - DNA, 20 bp, Homo sapiens
acaatttacaaagtgtgtat

SEQ ID NO: 5130608 - DNA, 17 bp, Homo sapiens
acaatttagaaaacatt

SEQ ID NO: 5130609 - DNA, 19 bp, Homo sapiens
acaatttaggaatgctcaa

SEQ ID NO: 5130610 - DNA, 14 bp, Homo sapiens
acaatttatactgc

SEQ ID NO: 5130611 - DNA, 13 bp, Homo sapiens
acaatttattatg

SEQ ID NO: 5130612 - DNA, 14 bp, Homo sapiens
acaatttattttat

SEQ ID NO: 5130613 - DNA, 15 bp, Homo sapiens
acaatttattttatt

SEQ ID NO: 5130614 - DNA, 16 bp, Homo sapiens
acaatttcaaaatgca

SEQ ID NO: 5130615 - DNA, 16 bp, Homo sapiens
acaatttcatcctcct

SEQ ID NO: 5130616 - DNA, 20 bp, Homo sapiens
acaatttcctttatatttag

SEQ ID NO: 5130617 - DNA, 18 bp, Homo sapiens
acaatttctttaaaaaag

SEQ ID NO: 5130618 - DNA, 20 bp, Homo sapiens
acaatttctttaaaaaagaa

SEQ ID NO: 5130619 - DNA, 13 bp, Homo sapiens
acaatttcttttg

SEQ ID NO: 5130620 - DNA, 16 bp, Homo sapiens
acaatttgagcaattc

SEQ ID NO: 5130621 - DNA, 18 bp, Homo sapiens
acaatttgagcaattcat

SEQ ID NO: 5130622 - DNA, 22 bp, Homo sapiens
acaatttgcactgttacttttt

SEQ ID NO: 5130623 - DNA, 23 bp, Homo sapiens
acaatttgcactgttacttttta

SEQ ID NO: 5130624 - DNA, 19 bp, Homo sapiens
acaatttgcataatactaa

SEQ ID NO: 5130625 - DNA, 20 bp, Homo sapiens
acaatttgcataatactaat

SEQ ID NO: 5130626 - DNA, 23 bp, Homo sapiens
acaatttgccatagcagtgctag

SEQ ID NO: 5130627 - DNA, 14 bp, Homo sapiens
acaatttggcaatt

SEQ ID NO: 5130628 - DNA, 20 bp, Homo sapiens
acaatttggcaattttgtgg

SEQ ID NO: 5130629 - DNA, 23 bp, Homo sapiens
acaatttggtcttagctttacat

SEQ ID NO: 5130630 - DNA, 14 bp, Homo sapiens
acaatttgttaatt

SEQ ID NO: 5130631 - DNA, 21 bp, Homo sapiens
acaatttgttcttgtatttta

SEQ ID NO: 5130632 - DNA, 16 bp, Homo sapiens
acaattttaaagttct

SEQ ID NO: 5130633 - DNA, 18 bp, Homo sapiens
acaattttaaagttctta

SEQ ID NO: 5130634 - DNA, 19 bp, Homo sapiens
acaattttaaagttcttat

SEQ ID NO: 5130635 - DNA, 16 bp, Homo sapiens
acaattttaaataaga

SEQ ID NO: 5130636 - DNA, 13 bp, Homo sapiens
acaattttagtca

SEQ ID NO: 5130637 - DNA, 22 bp, Homo sapiens
acaattttagtcactaagactt

SEQ ID NO: 5130638 - DNA, 13 bp, Homo sapiens
acaattttcagat

SEQ ID NO: 5130639 - DNA, 16 bp, Homo sapiens
acaattttcagatttg

SEQ ID NO: 5130640 - DNA, 19 bp, Homo sapiens
acaattttcagatttgcac

SEQ ID NO: 5130641 - DNA, 22 bp, Homo sapiens
acaattttcaggtttcttaaaa

SEQ ID NO: 5130642 - DNA, 23 bp, Homo sapiens
acaattttcctgtggaataaaga

SEQ ID NO: 5130643 - DNA, 16 bp, Homo sapiens
acaattttctgtaaga

SEQ ID NO: 5130644 - DNA, 16 bp, Homo sapiens
acaattttctgtgcca

SEQ ID NO: 5130645 - DNA, 13 bp, Homo sapiens
acaattttcttgt

SEQ ID NO: 5130646 - DNA, 18 bp, Homo sapiens
acaattttcttgtgacag

SEQ ID NO: 5130647 - DNA, 10 bp, Homo sapiens
acaattttgt

SEQ ID NO: 5130648 - DNA, 12 bp, Homo sapiens
acaattttgtac

SEQ ID NO: 5130649 - DNA, 21 bp, Homo sapiens
acaattttgtcttaagtgttt

SEQ ID NO: 5130650 - DNA, 22 bp, Homo sapiens
acaatttttgatcaatgtatat

SEQ ID NO: 5130651 - DNA, 13 bp, Homo sapiens
acaatttttgctg

SEQ ID NO: 5130652 - DNA, 14 bp, Homo sapiens
acaatttttgctgt

SEQ ID NO: 5130653 - DNA, 23 bp, Homo sapiens
acaattttttttaattggccatg

SEQ ID NO: 5130654 - DNA, 17 bp, Homo sapiens
acaattttttttattag

SEQ ID NO: 5130655 - DNA, 18 bp, Homo sapiens
acaattttttttattagt

SEQ ID NO: 5130656 - DNA, 18 bp, Homo sapiens
acaattttttttcaaatg

SEQ ID NO: 5130657 - DNA, 11 bp, Homo sapiens
acacaaaaaaa

SEQ ID NO: 5130658 - DNA, 19 bp, Homo sapiens
acacaaaaaaaattttagc

SEQ ID NO: 5130659 - DNA, 14 bp, Homo sapiens
acacaaaaaaacaa

SEQ ID NO: 5130660 - DNA, 18 bp, Homo sapiens
acacaaaaaaacaagtat

SEQ ID NO: 5130661 - DNA, 20 bp, Homo sapiens
acacaaaaaaacaagtattt

SEQ ID NO: 5130662 - DNA, 10 bp, Homo sapiens
acacaaaaag

SEQ ID NO: 5130663 - DNA, 18 bp, Homo sapiens
acacaaaaataaagacta

SEQ ID NO: 5130664 - DNA, 17 bp, Homo sapiens
acacaaaacaacaaaaa

SEQ ID NO: 5130665 - DNA, 15 bp, Homo sapiens
acacaaaacttgaaa

SEQ ID NO: 5130666 - DNA, 17 bp, Homo sapiens
acacaaaacttgaaaga

SEQ ID NO: 5130667 - DNA, 13 bp, Homo sapiens
acacaaaactttg

SEQ ID NO: 5130668 - DNA, 22 bp, Homo sapiens
acactgcctgtatactttagta

SEQ ID NO: 5130669 - DNA, 17 bp, Homo sapiens
acactgccttagcctct

SEQ ID NO: 5130670 - DNA, 21 bp, Homo sapiens
acactgcctttgctgccttct

SEQ ID NO: 5130671 - DNA, 20 bp, Homo sapiens
acactgcctttttatttata

SEQ ID NO: 5130672 - DNA, 16 bp, Homo sapiens
acactgcgaactctca

SEQ ID NO: 5130673 - DNA, 21 bp, Homo sapiens
acactgcgctttattttctta

SEQ ID NO: 5130674 - DNA, 19 bp, Homo sapiens
acactgcggggcttggctg

SEQ ID NO: 5130675 - DNA, 18 bp, Homo sapiens
acactgctaatgaaagaa

SEQ ID NO: 5130676 - DNA, 14 bp, Homo sapiens
acactgctctaaca

SEQ ID NO: 5130677 - DNA, 19 bp, Homo sapiens
acactgctctaacagccct

SEQ ID NO: 5130678 - DNA, 20 bp, Homo sapiens
acactgctctaacagccctc

SEQ ID NO: 5130679 - DNA, 14 bp, Homo sapiens
acactgctgcacca

SEQ ID NO: 5130680 - DNA, 21 bp, Homo sapiens
acactgctgctccagtgcagg

SEQ ID NO: 5130681 - DNA, 21 bp, Homo sapiens
acactgctgggaagtggctta

SEQ ID NO: 5130682 - DNA, 15 bp, Homo sapiens
acactgctgtccaca

SEQ ID NO: 5130683 - DNA, 17 bp, Homo sapiens
acactgctgtcctctcc

SEQ ID NO: 5130684 - DNA, 19 bp, Homo sapiens
acactgctgtcctctcccc

SEQ ID NO: 5130685 - DNA, 21 bp, Homo sapiens
acactgcttctcggaggccag

SEQ ID NO: 5130686 - DNA, 21 bp, Homo sapiens
acactgcttctcggccagccc

SEQ ID NO: 5130687 - DNA, 22 bp, Homo sapiens
acactgcttctcggccagcccg

SEQ ID NO: 5130688 - DNA, 22 bp, Homo sapiens
acactggaattcagacaccgac

SEQ ID NO: 5130689 - DNA, 22 bp, Homo sapiens
acactggaccaggtcctgctcc

SEQ ID NO: 5130690 - DNA, 18 bp, Homo sapiens
acactggaccccactggc

SEQ ID NO: 5130691 - DNA, 14 bp, Homo sapiens
acactggacctggg

SEQ ID NO: 5130692 - DNA, 16 bp, Homo sapiens
acactggactccggcc

SEQ ID NO: 5130693 - DNA, 20 bp, Homo sapiens
acactggagaagaatatcaa

SEQ ID NO: 5130694 - DNA, 23 bp, Homo sapiens
acactggagaagaatatcaaata

SEQ ID NO: 5130695 - DNA, 18 bp, Homo sapiens
acactggaggagagaaga

SEQ ID NO: 5130696 - DNA, 22 bp, Homo sapiens
acactggaggagagaagaatga

SEQ ID NO: 5130697 - DNA, 11 bp, Homo sapiens
acactggatat

SEQ ID NO: 5130698 - DNA, 16 bp, Homo sapiens
acactggatcaagttc

SEQ ID NO: 5130699 - DNA, 21 bp, Homo sapiens
acactggcaatggtagtttct

SEQ ID NO: 5130700 - DNA, 15 bp, Homo sapiens
acactggcagactgt

SEQ ID NO: 5130701 - DNA, 18 bp, Homo sapiens
acactggcagactgtgta

SEQ ID NO: 5130702 - DNA, 22 bp, Homo sapiens
acactggcatctccctgacctt

SEQ ID NO: 5130703 - DNA, 13 bp, Homo sapiens
acactggccccta

SEQ ID NO: 5130704 - DNA, 16 bp, Homo sapiens
acactggcccctagaa

SEQ ID NO: 5130705 - DNA, 21 bp, Homo sapiens
acactggcgaaccatctcaat

SEQ ID NO: 5130706 - DNA, 22 bp, Homo sapiens
acactggcgtagaagtttttgt

SEQ ID NO: 5130707 - DNA, 14 bp, Homo sapiens
acactggctcctgg

SEQ ID NO: 5130708 - DNA, 18 bp, Homo sapiens
acactggctcctggacct

SEQ ID NO: 5130709 - DNA, 14 bp, Homo sapiens
acactggctctggg

SEQ ID NO: 5130710 - DNA, 21 bp, Homo sapiens
acactggctgccagctatttt

SEQ ID NO: 5130711 - DNA, 14 bp, Homo sapiens
acactgggaaacag

SEQ ID NO: 5130712 - DNA, 19 bp, Homo sapiens
acactgggacttgcaaaaa

SEQ ID NO: 5130713 - DNA, 12 bp, Homo sapiens
acactgggagaa

SEQ ID NO: 5130714 - DNA, 15 bp, Homo sapiens
acactgggagaagag

SEQ ID NO: 5130715 - DNA, 20 bp, Homo sapiens
acactgggaggccagtgagc

SEQ ID NO: 5130716 - DNA, 12 bp, Homo sapiens
acactgggcctg

SEQ ID NO: 5130717 - DNA, 22 bp, Homo sapiens
acactggggacttggcctctct

SEQ ID NO: 5130718 - DNA, 13 bp, Homo sapiens
acactggggtctg

SEQ ID NO: 5130719 - DNA, 15 bp, Homo sapiens
acactgggtgcgtct

SEQ ID NO: 5130720 - DNA, 19 bp, Homo sapiens
acactgggtgcgtctccag

SEQ ID NO: 5130721 - DNA, 23 bp, Homo sapiens
acactgggtggtggcctggtccc

SEQ ID NO: 5130722 - DNA, 16 bp, Homo sapiens
acactggtatttatat

SEQ ID NO: 5130723 - DNA, 17 bp, Homo sapiens
acactggtatttatatt

SEQ ID NO: 5130724 - DNA, 17 bp, Homo sapiens
acactggtctaatgttt

SEQ ID NO: 5130725 - DNA, 16 bp, Homo sapiens
acactggtctcagagg

SEQ ID NO: 5130726 - DNA, 15 bp, Homo sapiens
acactggtctgctgt

SEQ ID NO: 5130727 - DNA, 16 bp, Homo sapiens
acactggtgccaacca

SEQ ID NO: 5130728 - DNA, 21 bp, Homo sapiens
acactggtgggcagctgagga

SEQ ID NO: 5130729 - DNA, 16 bp, Homo sapiens
acactggtgtgacctg

SEQ ID NO: 5130730 - DNA, 21 bp, Homo sapiens
acactggtgtgacctgagggc

SEQ ID NO: 5130731 - DNA, 21 bp, Homo sapiens
acactggttgtagtcagtttt

SEQ ID NO: 5130732 - DNA, 18 bp, Homo sapiens
acactggtttgccaggcc

SEQ ID NO: 5130733 - DNA, 18 bp, Homo sapiens
acactgtaaaatagtttt

SEQ ID NO: 5130734 - DNA, 20 bp, Homo sapiens
acactgtaagctttgttctg

SEQ ID NO: 5130735 - DNA, 21 bp, Homo sapiens
acactgtaagcttttaagaaa

SEQ ID NO: 5130736 - DNA, 14 bp, Homo sapiens
acactgtaatctta

SEQ ID NO: 5130737 - DNA, 17 bp, Homo sapiens
acactgtagctacattt

SEQ ID NO: 5130738 - DNA, 21 bp, Homo sapiens
acactgtagctacattttcag

SEQ ID NO: 5130739 - DNA, 19 bp, Homo sapiens
acactgtagtaaataatgc

SEQ ID NO: 5130740 - DNA, 22 bp, Homo sapiens
acactgtagtaaataatgcttt

SEQ ID NO: 5130741 - DNA, 21 bp, Homo sapiens
acactgtagtttttgaaaatt

SEQ ID NO: 5130742 - DNA, 14 bp, Homo sapiens
acactgtatctaaa

SEQ ID NO: 5130743 - DNA, 18 bp, Homo sapiens
acactgtatgttatagaa

SEQ ID NO: 5130744 - DNA, 21 bp, Homo sapiens
acactgtatgttatagaactt

SEQ ID NO: 5130745 - DNA, 12 bp, Homo sapiens
acactgtatttt

SEQ ID NO: 5130746 - DNA, 14 bp, Homo sapiens
acactgtattttaa

SEQ ID NO: 5130747 - DNA, 18 bp, Homo sapiens
acactgtattttaatgta

SEQ ID NO: 5130748 - DNA, 13 bp, Homo sapiens
acactgtcaagat

SEQ ID NO: 5130749 - DNA, 20 bp, Homo sapiens
acactgtcagtgctagattt

SEQ ID NO: 5130750 - DNA, 14 bp, Homo sapiens
acactgtcatccgt

SEQ ID NO: 5130751 - DNA, 18 bp, Homo sapiens
acactgtcctattatatt

SEQ ID NO: 5130752 - DNA, 19 bp, Homo sapiens
acactgtgaactaatgaca

SEQ ID NO: 5130753 - DNA, 11 bp, Homo sapiens
acactgtgaag

SEQ ID NO: 5130754 - DNA, 22 bp, Homo sapiens
acactgtgaagagctggactcc

SEQ ID NO: 5130755 - DNA, 21 bp, Homo sapiens
acactgtgaagggtacagatt

SEQ ID NO: 5130756 - DNA, 17 bp, Homo sapiens
acactgtgacaatgact

SEQ ID NO: 5130757 - DNA, 20 bp, Homo sapiens
acactgtgacaatgactaag

SEQ ID NO: 5130758 - DNA, 16 bp, Homo sapiens
acactgtgaccctggg

SEQ ID NO: 5130759 - DNA, 23 bp, Homo sapiens
acactgtgattttgccctcctgc

SEQ ID NO: 5130760 - DNA, 18 bp, Homo sapiens
acactgtgcacatctgtg

SEQ ID NO: 5130761 - DNA, 21 bp, Homo sapiens
acactgtgcacatctgtgtct

SEQ ID NO: 5130762 - DNA, 17 bp, Homo sapiens
acactgtgcagacccag

SEQ ID NO: 5130763 - DNA, 16 bp, Homo sapiens
acactgtgcaggccca

SEQ ID NO: 5130764 - DNA, 17 bp, Homo sapiens
acactgtgcaggcccag

SEQ ID NO: 5130765 - DNA, 19 bp, Homo sapiens
acactgtgcaggcccaggc

SEQ ID NO: 5130766 - DNA, 23 bp, Homo sapiens
acactgtgcccagcccggacctt

SEQ ID NO: 5130767 - DNA, 15 bp, Homo sapiens
acactgtgccctggt

SEQ ID NO: 5130768 - DNA, 16 bp, Homo sapiens
acactgtgccctggtg

SEQ ID NO: 5130769 - DNA, 17 bp, Homo sapiens
acactgtgccctggtgg

SEQ ID NO: 5130770 - DNA, 19 bp, Homo sapiens
acactgtgcgttttagagt

SEQ ID NO: 5130771 - DNA, 22 bp, Homo sapiens
acactgtgcgttttagagtatg

SEQ ID NO: 5130772 - DNA, 17 bp, Homo sapiens
acactgtgctgagtctg

SEQ ID NO: 5130773 - DNA, 22 bp, Homo sapiens
acactgtgctttctattgtaca

SEQ ID NO: 5130774 - DNA, 17 bp, Homo sapiens
acactgtggcagcagga

SEQ ID NO: 5130775 - DNA, 13 bp, Homo sapiens
acactgtggccag

SEQ ID NO: 5130776 - DNA, 17 bp, Homo sapiens
acactgtggccaggcct

SEQ ID NO: 5130777 - DNA, 18 bp, Homo sapiens
acactgtggtaggtgttt

SEQ ID NO: 5130778 - DNA, 15 bp, Homo sapiens
acactgtggtgtctc

SEQ ID NO: 5130779 - DNA, 18 bp, Homo sapiens
acactgtgtacacctcaa

SEQ ID NO: 5130780 - DNA, 13 bp, Homo sapiens
acactgtgtcctg

SEQ ID NO: 5130781 - DNA, 22 bp, Homo sapiens
acactgtgtcctggtgctctct

SEQ ID NO: 5130782 - DNA, 13 bp, Homo sapiens
acactgtgtctct

SEQ ID NO: 5130783 - DNA, 21 bp, Homo sapiens
acactgtgtgaggctgtgtct

SEQ ID NO: 5130784 - DNA, 23 bp, Homo sapiens
acactgtgtgaggctgtgtctct

SEQ ID NO: 5130785 - DNA, 22 bp, Homo sapiens
acactgtgtgggggacggcttc

SEQ ID NO: 5130786 - DNA, 16 bp, Homo sapiens
acactgttactccaca

SEQ ID NO: 5130787 - DNA, 18 bp, Homo sapiens
acactgttactccacagc

SEQ ID NO: 5130788 - DNA, 22 bp, Homo sapiens
acactgttactccacagcggag

SEQ ID NO: 5130789 - DNA, 16 bp, Homo sapiens
acactgttagaacact

SEQ ID NO: 5130790 - DNA, 21 bp, Homo sapiens
acactgttcccaatatgtagc

SEQ ID NO: 5130791 - DNA, 14 bp, Homo sapiens
acactgttctctgc

SEQ ID NO: 5130792 - DNA, 20 bp, Homo sapiens
acactgttctctgccctcca

SEQ ID NO: 5130793 - DNA, 22 bp, Homo sapiens
acactgttctctgccctccaag

SEQ ID NO: 5130794 - DNA, 20 bp, Homo sapiens
acactgttctgaaagtgact

SEQ ID NO: 5130795 - DNA, 21 bp, Homo sapiens
acactgttcttagctcaatga

SEQ ID NO: 5130796 - DNA, 23 bp, Homo sapiens
acactgttcttagctcaatgagc

SEQ ID NO: 5130797 - DNA, 17 bp, Homo sapiens
acactgttggcacttat

SEQ ID NO: 5130798 - DNA, 23 bp, Homo sapiens
acactgtttacaagaaaaaatga

SEQ ID NO: 5130799 - DNA, 18 bp, Homo sapiens
acactgtttcaaacttta

SEQ ID NO: 5130800 - DNA, 23 bp, Homo sapiens
acactgtttcaaactttactatg

SEQ ID NO: 5130801 - DNA, 18 bp, Homo sapiens
acactgtttcatctcagc

SEQ ID NO: 5130802 - DNA, 20 bp, Homo sapiens
acactgtttcatctcagctt

SEQ ID NO: 5130803 - DNA, 15 bp, Homo sapiens
acactgttttataga

SEQ ID NO: 5130804 - DNA, 16 bp, Homo sapiens
acactgttttatagaa

SEQ ID NO: 5130805 - DNA, 14 bp, Homo sapiens
acacttaaaagaaa

SEQ ID NO: 5130806 - DNA, 18 bp, Homo sapiens
acacttaaaagaaaacaa

SEQ ID NO: 5130807 - DNA, 14 bp, Homo sapiens
acacttaaatccag

SEQ ID NO: 5130808 - DNA, 20 bp, Homo sapiens
acacttaagggttttagaaa

SEQ ID NO: 5130809 - DNA, 18 bp, Homo sapiens
acacttaatcattttatg

SEQ ID NO: 5130810 - DNA, 14 bp, Homo sapiens
acacttaattctgt

SEQ ID NO: 5130811 - DNA, 19 bp, Homo sapiens
acacttacaagtaatgaat

SEQ ID NO: 5130812 - DNA, 20 bp, Homo sapiens
acacttacaagtaatgaatt

SEQ ID NO: 5130813 - DNA, 21 bp, Homo sapiens
acacttacaagtaatgaattt

SEQ ID NO: 5130814 - DNA, 14 bp, Homo sapiens
acacttacagagca

SEQ ID NO: 5130815 - DNA, 18 bp, Homo sapiens
acacttaccccatggctg

SEQ ID NO: 5130816 - DNA, 18 bp, Homo sapiens
acacttactgtaagacat

SEQ ID NO: 5130817 - DNA, 19 bp, Homo sapiens
acacttactgtaagacatt

SEQ ID NO: 5130818 - DNA, 21 bp, Homo sapiens
acacttactgtaagacattag

SEQ ID NO: 5130819 - DNA, 17 bp, Homo sapiens
acacttactttttctgg

SEQ ID NO: 5130820 - DNA, 15 bp, Homo sapiens
acacttagaatacta

SEQ ID NO: 5130821 - DNA, 18 bp, Homo sapiens
acacttagccattgaaat

SEQ ID NO: 5130822 - DNA, 19 bp, Homo sapiens
acacttagtgatcatttaa

SEQ ID NO: 5130823 - DNA, 21 bp, Homo sapiens
acacttataaaataacttgca

SEQ ID NO: 5130824 - DNA, 15 bp, Homo sapiens
acacttatattttga

SEQ ID NO: 5130825 - DNA, 20 bp, Homo sapiens
acacttatctcactgtttta

SEQ ID NO: 5130826 - DNA, 18 bp, Homo sapiens
acacttatggaattttta

SEQ ID NO: 5130827 - DNA, 20 bp, Homo sapiens
acacttatggggacagcata

SEQ ID NO: 5130828 - DNA, 14 bp, Homo sapiens
acacttattgcttt

SEQ ID NO: 5130829 - DNA, 20 bp, Homo sapiens
acacttattggaactctgct

SEQ ID NO: 5130830 - DNA, 20 bp, Homo sapiens
acacttattgtttgaaagac

SEQ ID NO: 5130831 - DNA, 17 bp, Homo sapiens
acacttattttctgaat

SEQ ID NO: 5130832 - DNA, 20 bp, Homo sapiens
acacttcaaactgcggacac

SEQ ID NO: 5130833 - DNA, 18 bp, Homo sapiens
acacttcaaggtgacaga

SEQ ID NO: 5130834 - DNA, 20 bp, Homo sapiens
acacttcagacacaggaaaa

SEQ ID NO: 5130835 - DNA, 16 bp, Homo sapiens
acacttcagagagctg

SEQ ID NO: 5130836 - DNA, 20 bp, Homo sapiens
acacttcagagagctggtag

SEQ ID NO: 5130837 - DNA, 15 bp, Homo sapiens
acacttcaggctctt

SEQ ID NO: 5130838 - DNA, 19 bp, Homo sapiens
acacttcaggctcttctcc

SEQ ID NO: 5130839 - DNA, 21 bp, Homo sapiens
acacttcatggaccaagaatg

SEQ ID NO: 5130840 - DNA, 16 bp, Homo sapiens
acacttcattttcagg

SEQ ID NO: 5130841 - DNA, 21 bp, Homo sapiens
acacttccacccccagctcct

SEQ ID NO: 5130842 - DNA, 22 bp, Homo sapiens
acacttccattgtttaaaaata

SEQ ID NO: 5130843 - DNA, 14 bp, Homo sapiens
acacaaaagaagaa

SEQ ID NO: 5130844 - DNA, 22 bp, Homo sapiens
acacaaaatccattccaggtag

SEQ ID NO: 5130845 - DNA, 24 bp, Homo sapiens
acacaaaatccattccaggtagct

SEQ ID NO: 5130846 - DNA, 13 bp, Homo sapiens
acacaaaatgtca

SEQ ID NO: 5130847 - DNA, 15 bp, Homo sapiens
acacaaaatgtcaca

SEQ ID NO: 5130848 - DNA, 14 bp, Homo sapiens
acacaaacacacac

SEQ ID NO: 5130849 - DNA, 15 bp, Homo sapiens
acacaaacacctcct

SEQ ID NO: 5130850 - DNA, 20 bp, Homo sapiens
acacaaaccacaactgacac

SEQ ID NO: 5130851 - DNA, 19 bp, Homo sapiens
acacaaactatgggatcca

SEQ ID NO: 5130852 - DNA, 14 bp, Homo sapiens
acacaaactgtaaa

SEQ ID NO: 5130853 - DNA, 15 bp, Homo sapiens
acacaaactgtaaat

SEQ ID NO: 5130854 - DNA, 16 bp, Homo sapiens
acacaaactgtaaata

SEQ ID NO: 5130855 - DNA, 15 bp, Homo sapiens
acacaaagacatgga

SEQ ID NO: 5130856 - DNA, 19 bp, Homo sapiens
acacaaagaccaaaatgaa

SEQ ID NO: 5130857 - DNA, 22 bp, Homo sapiens
acacaaagagaaaaagaaatgc

SEQ ID NO: 5130858 - DNA, 22 bp, Homo sapiens
acacaaagagagttaatcaact

SEQ ID NO: 5130859 - DNA, 13 bp, Homo sapiens
acacaaagctttt

SEQ ID NO: 5130860 - DNA, 18 bp, Homo sapiens
acacaaagcttttgcata

SEQ ID NO: 5130861 - DNA, 19 bp, Homo sapiens
acacaaagcttttgcatat

SEQ ID NO: 5130862 - DNA, 20 bp, Homo sapiens
acacaaaggacaaaaatata

SEQ ID NO: 5130863 - DNA, 20 bp, Homo sapiens
acacaaaggtggaataaaca

SEQ ID NO: 5130864 - DNA, 22 bp, Homo sapiens
acacaaaggtggaataaacatt

SEQ ID NO: 5130865 - DNA, 14 bp, Homo sapiens
acacaaagtgaaat

SEQ ID NO: 5130866 - DNA, 15 bp, Homo sapiens
acacaaagtgaaatt

SEQ ID NO: 5130867 - DNA, 16 bp, Homo sapiens
acacaaagtgaaatta

SEQ ID NO: 5130868 - DNA, 21 bp, Homo sapiens
acacaaatattgcttggacta

SEQ ID NO: 5130869 - DNA, 12 bp, Homo sapiens
acacaaatgaaa

SEQ ID NO: 5130870 - DNA, 16 bp, Homo sapiens
acacaaatgcagacac

SEQ ID NO: 5130871 - DNA, 18 bp, Homo sapiens
acacaaatgcagacacac

SEQ ID NO: 5130872 - DNA, 22 bp, Homo sapiens
acacaaatgcagacacacaaca

SEQ ID NO: 5130873 - DNA, 14 bp, Homo sapiens
acacaaatgcaggg

SEQ ID NO: 5130874 - DNA, 13 bp, Homo sapiens
acacaaatgcatg

SEQ ID NO: 5130875 - DNA, 20 bp, Homo sapiens
acacaaatgctcaaagaaat

SEQ ID NO: 5130876 - DNA, 14 bp, Homo sapiens
acacaaatgtgtac

SEQ ID NO: 5130877 - DNA, 22 bp, Homo sapiens
acacaaattatgctaagaattt

SEQ ID NO: 5130878 - DNA, 13 bp, Homo sapiens
acacaacaaaaat

SEQ ID NO: 5130879 - DNA, 17 bp, Homo sapiens
acacaacacaagaaaac

SEQ ID NO: 5130880 - DNA, 12 bp, Homo sapiens
acacaacactga

SEQ ID NO: 5130881 - DNA, 14 bp, Homo sapiens
acacaacagccaac

SEQ ID NO: 5130882 - DNA, 18 bp, Homo sapiens
acacaacagccaacagct

SEQ ID NO: 5130883 - DNA, 16 bp, Homo sapiens
acacaacatgtatgtg

SEQ ID NO: 5130884 - DNA, 13 bp, Homo sapiens
acacaacatttat

SEQ ID NO: 5130885 - DNA, 18 bp, Homo sapiens
acacaacccaataggagt

SEQ ID NO: 5130886 - DNA, 20 bp, Homo sapiens
acacaacgtaatcaaatatg

SEQ ID NO: 5130887 - DNA, 21 bp, Homo sapiens
acacaacgtaatcaaatatgt

SEQ ID NO: 5130888 - DNA, 14 bp, Homo sapiens
acacaactatattg

SEQ ID NO: 5130889 - DNA, 18 bp, Homo sapiens
acacaactatttttccaa

SEQ ID NO: 5130890 - DNA, 23 bp, Homo sapiens
acacaactcatccagaactgtct

SEQ ID NO: 5130891 - DNA, 14 bp, Homo sapiens
acacaactttattg

SEQ ID NO: 5130892 - DNA, 14 bp, Homo sapiens
acacaactttgcaa

SEQ ID NO: 5130893 - DNA, 23 bp, Homo sapiens
acacaagaaaactcaaagaatgt

SEQ ID NO: 5130894 - DNA, 13 bp, Homo sapiens
acacaagaagtga

SEQ ID NO: 5130895 - DNA, 22 bp, Homo sapiens
acacaagacagcagagccatct

SEQ ID NO: 5130896 - DNA, 16 bp, Homo sapiens
acacaagattggtgtt

SEQ ID NO: 5130897 - DNA, 18 bp, Homo sapiens
acacaagattggtgtttt

SEQ ID NO: 5130898 - DNA, 19 bp, Homo sapiens
acacaagattggtgttttt

SEQ ID NO: 5130899 - DNA, 23 bp, Homo sapiens
acacaagattggtgtttttttct

SEQ ID NO: 5130900 - DNA, 15 bp, Homo sapiens
acacaagcaatgcaa

SEQ ID NO: 5130901 - DNA, 16 bp, Homo sapiens
acacaagcaatgcaag

SEQ ID NO: 5130902 - DNA, 22 bp, Homo sapiens
acacaagcagacacacacatat

SEQ ID NO: 5130903 - DNA, 13 bp, Homo sapiens
acacaagccacag

SEQ ID NO: 5130904 - DNA, 14 bp, Homo sapiens
acacaagccacaga

SEQ ID NO: 5130905 - DNA, 15 bp, Homo sapiens
acacaagccacagaa

SEQ ID NO: 5130906 - DNA, 18 bp, Homo sapiens
acacaagcccacagcaca

SEQ ID NO: 5130907 - DNA, 15 bp, Homo sapiens
acacaagctggaagc

SEQ ID NO: 5130908 - DNA, 20 bp, Homo sapiens
acacaaggccagaaaaagaa

SEQ ID NO: 5130909 - DNA, 19 bp, Homo sapiens
acacaagggatataaaatg

SEQ ID NO: 5130910 - DNA, 21 bp, Homo sapiens
acacaagggatataaaatgaa

SEQ ID NO: 5130911 - DNA, 20 bp, Homo sapiens
acacaaggtcatggccacac

SEQ ID NO: 5130912 - DNA, 16 bp, Homo sapiens
acacaaggtgctcaga

SEQ ID NO: 5130913 - DNA, 13 bp, Homo sapiens
acacaaggtgtaa

SEQ ID NO: 5130914 - DNA, 13 bp, Homo sapiens
acacaagtaaaca

SEQ ID NO: 5130915 - DNA, 15 bp, Homo sapiens
acacaagtaagagac

SEQ ID NO: 5130916 - DNA, 13 bp, Homo sapiens
acacaagtgcagt

SEQ ID NO: 5130917 - DNA, 15 bp, Homo sapiens
acacaataaagcagt

SEQ ID NO: 5130918 - DNA, 13 bp, Homo sapiens
acacaataagcaa

SEQ ID NO: 5130919 - DNA, 14 bp, Homo sapiens
acacaatacagtat

SEQ ID NO: 5130920 - DNA, 21 bp, Homo sapiens
acacaataggtctttctctca

SEQ ID NO: 5130921 - DNA, 23 bp, Homo sapiens
acacaataggtctttctctcagt

SEQ ID NO: 5130922 - DNA, 15 bp, Homo sapiens
acacaatatacgaaa

SEQ ID NO: 5130923 - DNA, 12 bp, Homo sapiens
acacaatatgta

SEQ ID NO: 5130924 - DNA, 15 bp, Homo sapiens
acacaatatgtatgc

SEQ ID NO: 5130925 - DNA, 18 bp, Homo sapiens
acacaatatgtatgcttt

SEQ ID NO: 5130926 - DNA, 12 bp, Homo sapiens
acacaatcaaaa

SEQ ID NO: 5130927 - DNA, 17 bp, Homo sapiens
acacaatcctataaatg

SEQ ID NO: 5130928 - DNA, 17 bp, Homo sapiens
acacaatgccaacagct

SEQ ID NO: 5130929 - DNA, 19 bp, Homo sapiens
acacaatgctattgaaatt

SEQ ID NO: 5130930 - DNA, 18 bp, Homo sapiens
acacaatggagtgtgtaa

SEQ ID NO: 5130931 - DNA, 14 bp, Homo sapiens
acacaatgtgtctg

SEQ ID NO: 5130932 - DNA, 16 bp, Homo sapiens
acacaatgttattcgt

SEQ ID NO: 5130933 - DNA, 18 bp, Homo sapiens
acacaattgatacttcag

SEQ ID NO: 5130934 - DNA, 19 bp, Homo sapiens
acacaattgatacttcagg

SEQ ID NO: 5130935 - DNA, 20 bp, Homo sapiens
acacaattgatacttcaggt

SEQ ID NO: 5130936 - DNA, 23 bp, Homo sapiens
acacaattgatacttcaggtgct

SEQ ID NO: 5130937 - DNA, 17 bp, Homo sapiens
acacaattggaagtcta

SEQ ID NO: 5130938 - DNA, 23 bp, Homo sapiens
acacaatttaattcctcttttta

SEQ ID NO: 5130939 - DNA, 19 bp, Homo sapiens
acacaatttcatttccagc

SEQ ID NO: 5130940 - DNA, 21 bp, Homo sapiens
acacaatttcatttccagcat

SEQ ID NO: 5130941 - DNA, 22 bp, Homo sapiens
acacaattttcactttttctgt

SEQ ID NO: 5130942 - DNA, 9 bp, Homo sapiens
acacacaaa

SEQ ID NO: 5130943 - DNA, 12 bp, Homo sapiens
acacacaaaaca

SEQ ID NO: 5130944 - DNA, 21 bp, Homo sapiens
acacacaaaactttgaggcag

SEQ ID NO: 5130945 - DNA, 22 bp, Homo sapiens
acacacaaaatgtacccagtat

SEQ ID NO: 5130946 - DNA, 20 bp, Homo sapiens
acacacaaacctactgccca

SEQ ID NO: 5130947 - DNA, 13 bp, Homo sapiens
acacacaaagcag

SEQ ID NO: 5130948 - DNA, 22 bp, Homo sapiens
acacacaaatattgcttggact

SEQ ID NO: 5130949 - DNA, 14 bp, Homo sapiens
acacacaaatgcag

SEQ ID NO: 5130950 - DNA, 20 bp, Homo sapiens
acacacaaatgcagacacac

SEQ ID NO: 5130951 - DNA, 14 bp, Homo sapiens
acacacaacaatta

SEQ ID NO: 5130952 - DNA, 15 bp, Homo sapiens
acacacaagcagaca

SEQ ID NO: 5130953 - DNA, 17 bp, Homo sapiens
acacacaaggtgctcag

SEQ ID NO: 5130954 - DNA, 21 bp, Homo sapiens
acacacaattcattggctcct

SEQ ID NO: 5130955 - DNA, 9 bp, Homo sapiens
acacacaca

SEQ ID NO: 5130956 - DNA, 10 bp, Homo sapiens
acacacacaa

SEQ ID NO: 5130957 - DNA, 14 bp, Homo sapiens
acacacacaagtaa

SEQ ID NO: 5130958 - DNA, 11 bp, Homo sapiens
acacacacaca

SEQ ID NO: 5130959 - DNA, 15 bp, Homo sapiens
acacacacacaaacc

SEQ ID NO: 5130960 - DNA, 14 bp, Homo sapiens
acacacacacacaa

SEQ ID NO: 5130961 - DNA, 15 bp, Homo sapiens
acacacacacacaag

SEQ ID NO: 5130962 - DNA, 16 bp, Homo sapiens
acacacacacacacac

SEQ ID NO: 5130963 - DNA, 16 bp, Homo sapiens
acacacacacacacat

SEQ ID NO: 5130964 - DNA, 16 bp, Homo sapiens
acacacacacacacgc

SEQ ID NO: 5130965 - DNA, 16 bp, Homo sapiens
acacacacacacagcc

SEQ ID NO: 5130966 - DNA, 15 bp, Homo sapiens
acacacacacacagg

SEQ ID NO: 5130967 - DNA, 14 bp, Homo sapiens
acacacacacacat

SEQ ID NO: 5130968 - DNA, 16 bp, Homo sapiens
acacacacacacatgc

SEQ ID NO: 5130969 - DNA, 17 bp, Homo sapiens
acacacacacacatgca

SEQ ID NO: 5130970 - DNA, 14 bp, Homo sapiens
acacacacacacct

SEQ ID NO: 5130971 - DNA, 14 bp, Homo sapiens
acacacacacacga

SEQ ID NO: 5130972 - DNA, 16 bp, Homo sapiens
acacacacacacgatg

SEQ ID NO: 5130973 - DNA, 14 bp, Homo sapiens
acacacacacacgc

SEQ ID NO: 5130974 - DNA, 15 bp, Homo sapiens
acacacacacacgca

SEQ ID NO: 5130975 - DNA, 13 bp, Homo sapiens
acacacacacata

SEQ ID NO: 5130976 - DNA, 15 bp, Homo sapiens
acacacacacataca

SEQ ID NO: 5130977 - DNA, 13 bp, Homo sapiens
acacacacacatc

SEQ ID NO: 5130978 - DNA, 14 bp, Homo sapiens
acacacacacatgc

SEQ ID NO: 5130979 - DNA, 15 bp, Homo sapiens
acacacacacatgca

SEQ ID NO: 5130980 - DNA, 14 bp, Homo sapiens
acacacacacgatg

SEQ ID NO: 5130981 - DNA, 13 bp, Homo sapiens
acacacacactcc

SEQ ID NO: 5130982 - DNA, 14 bp, Homo sapiens
acacacacactccc

SEQ ID NO: 5130983 - DNA, 14 bp, Homo sapiens
acacacacagaaaa

SEQ ID NO: 5130984 - DNA, 16 bp, Homo sapiens
acacacacagaaaata

SEQ ID NO: 5130985 - DNA, 13 bp, Homo sapiens
acacacacagcca

SEQ ID NO: 5130986 - DNA, 11 bp, Homo sapiens
acacacacata

SEQ ID NO: 5130987 - DNA, 14 bp, Homo sapiens
acacacacatacac

SEQ ID NO: 5130988 - DNA, 17 bp, Homo sapiens
acacacacatacacgaa

SEQ ID NO: 5130989 - DNA, 21 bp, Homo sapiens
acacacaccagtttacaggaa

SEQ ID NO: 5130990 - DNA, 13 bp, Homo sapiens
acacacacctgtc

SEQ ID NO: 5130991 - DNA, 17 bp, Homo sapiens
acacacaccttgcaaaa

SEQ ID NO: 5130992 - DNA, 12 bp, Homo sapiens
acacacacgcag

SEQ ID NO: 5130993 - DNA, 13 bp, Homo sapiens
acacacacgccag

SEQ ID NO: 5130994 - DNA, 21 bp, Homo sapiens
acacacacgccagctcctctc

SEQ ID NO: 5130995 - DNA, 22 bp, Homo sapiens
acacacacgcgtgcacacacca

SEQ ID NO: 5130996 - DNA, 12 bp, Homo sapiens
acacacactatg

SEQ ID NO: 5130997 - DNA, 13 bp, Homo sapiens
acacacactcctt

SEQ ID NO: 5130998 - DNA, 14 bp, Homo sapiens
acacacactcttca

SEQ ID NO: 5130999 - DNA, 15 bp, Homo sapiens
acacacactggctcc

SEQ ID NO: 5131000 - DNA, 16 bp, Homo sapiens
acacacagaaaagcat

SEQ ID NO: 5131001 - DNA, 13 bp, Homo sapiens
acacacagaaaat

SEQ ID NO: 5131002 - DNA, 14 bp, Homo sapiens
acacacagaaaata

SEQ ID NO: 5131003 - DNA, 16 bp, Homo sapiens
acacacagaaaatata

SEQ ID NO: 5131004 - DNA, 17 bp, Homo sapiens
acacacagaaaatatac

SEQ ID NO: 5131005 - DNA, 20 bp, Homo sapiens
acacacagaaaatatactgt

SEQ ID NO: 5131006 - DNA, 13 bp, Homo sapiens
acacacagaaatg

SEQ ID NO: 5131007 - DNA, 17 bp, Homo sapiens
acacacagactttctgt

SEQ ID NO: 5131008 - DNA, 13 bp, Homo sapiens
acacacagaggaa

SEQ ID NO: 5131009 - DNA, 15 bp, Homo sapiens
acacacagatacaca

SEQ ID NO: 5131010 - DNA, 19 bp, Homo sapiens
acacacagatacacacaca

SEQ ID NO: 5131011 - DNA, 14 bp, Homo sapiens
acacacagatatgc

SEQ ID NO: 5131012 - DNA, 13 bp, Homo sapiens
acacacagcactc

SEQ ID NO: 5131013 - DNA, 13 bp, Homo sapiens
acacacagcagca

SEQ ID NO: 5131014 - DNA, 15 bp, Homo sapiens
acacacagcagctcc

SEQ ID NO: 5131015 - DNA, 13 bp, Homo sapiens
acacacagccatt

SEQ ID NO: 5131016 - DNA, 12 bp, Homo sapiens
acacacagcctg

SEQ ID NO: 5131017 - DNA, 14 bp, Homo sapiens
acacacagcctggc

SEQ ID NO: 5131018 - DNA, 22 bp, Homo sapiens
acacacagcctggcctcccctg

SEQ ID NO: 5131019 - DNA, 13 bp, Homo sapiens
acacacagccttt

SEQ ID NO: 5131020 - DNA, 16 bp, Homo sapiens
acacacagcctttctg

SEQ ID NO: 5131021 - DNA, 17 bp, Homo sapiens
acacacagcctttctgt

SEQ ID NO: 5131022 - DNA, 12 bp, Homo sapiens
acacacagctcc

SEQ ID NO: 5131023 - DNA, 13 bp, Homo sapiens
acacacagctcct

SEQ ID NO: 5131024 - DNA, 17 bp, Homo sapiens
acacacagctctgtcct

SEQ ID NO: 5131025 - DNA, 19 bp, Homo sapiens
acacacagctctgtcctgg

SEQ ID NO: 5131026 - DNA, 15 bp, Homo sapiens
acacacagctgggca

SEQ ID NO: 5131027 - DNA, 18 bp, Homo sapiens
acacttccctctgtttct

SEQ ID NO: 5131028 - DNA, 13 bp, Homo sapiens
acacttccctggc

SEQ ID NO: 5131029 - DNA, 14 bp, Homo sapiens
acacttccctggcg

SEQ ID NO: 5131030 - DNA, 15 bp, Homo sapiens
acacttccctgggcc

SEQ ID NO: 5131031 - DNA, 18 bp, Homo sapiens
acacttccctgggcctca

SEQ ID NO: 5131032 - DNA, 21 bp, Homo sapiens
acacttcctattagtgacttt

SEQ ID NO: 5131033 - DNA, 12 bp, Homo sapiens
acacttctcagg

SEQ ID NO: 5131034 - DNA, 13 bp, Homo sapiens
acacttctcagga

SEQ ID NO: 5131035 - DNA, 14 bp, Homo sapiens
acacttctcatcat

SEQ ID NO: 5131036 - DNA, 20 bp, Homo sapiens
acacttctcatcatattgta

SEQ ID NO: 5131037 - DNA, 15 bp, Homo sapiens
acacttctgaaactt

SEQ ID NO: 5131038 - DNA, 15 bp, Homo sapiens
acacttctgctttca

SEQ ID NO: 5131039 - DNA, 12 bp, Homo sapiens
acacttctgggc

SEQ ID NO: 5131040 - DNA, 14 bp, Homo sapiens
acacttctgtcctg

SEQ ID NO: 5131041 - DNA, 22 bp, Homo sapiens
acacttcttcttggtcttattt

SEQ ID NO: 5131042 - DNA, 23 bp, Homo sapiens
acacttctttatactctcttccc

SEQ ID NO: 5131043 - DNA, 24 bp, Homo sapiens
acacttgaagcctaaatttgtgct

SEQ ID NO: 5131044 - DNA, 18 bp, Homo sapiens
acacttgcaaatgaatgc

SEQ ID NO: 5131045 - DNA, 13 bp, Homo sapiens
acacttgcaacct

SEQ ID NO: 5131046 - DNA, 15 bp, Homo sapiens
acacttgccctgctc

SEQ ID NO: 5131047 - DNA, 17 bp, Homo sapiens
acacttgccctgctccc

SEQ ID NO: 5131048 - DNA, 20 bp, Homo sapiens
acacttgccctgctccctct

SEQ ID NO: 5131049 - DNA, 20 bp, Homo sapiens
acacttgccttcttcaccca

SEQ ID NO: 5131050 - DNA, 18 bp, Homo sapiens
acacttgctcatgccctg

SEQ ID NO: 5131051 - DNA, 14 bp, Homo sapiens
acacttgctcccaa

SEQ ID NO: 5131052 - DNA, 11 bp, Homo sapiens
acacttgctga

SEQ ID NO: 5131053 - DNA, 13 bp, Homo sapiens
acacttgctgagt

SEQ ID NO: 5131054 - DNA, 13 bp, Homo sapiens
acacttgctgggg

SEQ ID NO: 5131055 - DNA, 20 bp, Homo sapiens
acacttgctttatttttcat

SEQ ID NO: 5131056 - DNA, 18 bp, Homo sapiens
acacttggaacagtgttt

SEQ ID NO: 5131057 - DNA, 17 bp, Homo sapiens
acacttggagcccgtgc

SEQ ID NO: 5131058 - DNA, 19 bp, Homo sapiens
acacttggcatacaaaata

SEQ ID NO: 5131059 - DNA, 15 bp, Homo sapiens
acacttgggctggca

SEQ ID NO: 5131060 - DNA, 13 bp, Homo sapiens
acacttgtacaat

SEQ ID NO: 5131061 - DNA, 14 bp, Homo sapiens
acacttgtacaatt

SEQ ID NO: 5131062 - DNA, 20 bp, Homo sapiens
acacttgtataaatgtatat

SEQ ID NO: 5131063 - DNA, 14 bp, Homo sapiens
acacttgtatgcta

SEQ ID NO: 5131064 - DNA, 18 bp, Homo sapiens
acacttgtcagcctcaga

SEQ ID NO: 5131065 - DNA, 17 bp, Homo sapiens
acacttgtccacatagg

SEQ ID NO: 5131066 - DNA, 18 bp, Homo sapiens
acacttgtgaataaagag

SEQ ID NO: 5131067 - DNA, 21 bp, Homo sapiens
acacttgtgacttttgcttta

SEQ ID NO: 5131068 - DNA, 13 bp, Homo sapiens
acacttgtgccag

SEQ ID NO: 5131069 - DNA, 18 bp, Homo sapiens
acacttgtgccagcccgg

SEQ ID NO: 5131070 - DNA, 13 bp, Homo sapiens
acacttgtgtgtg

SEQ ID NO: 5131071 - DNA, 16 bp, Homo sapiens
acacttgtgtgtgggc

SEQ ID NO: 5131072 - DNA, 18 bp, Homo sapiens
acacttgtgtgtgggctg

SEQ ID NO: 5131073 - DNA, 19 bp, Homo sapiens
acacttgttccagctcttt

SEQ ID NO: 5131074 - DNA, 15 bp, Homo sapiens
acacttgtttcttgt

SEQ ID NO: 5131075 - DNA, 13 bp, Homo sapiens
acacttgttttct

SEQ ID NO: 5131076 - DNA, 20 bp, Homo sapiens
acactttacagttctggagg

SEQ ID NO: 5131077 - DNA, 21 bp, Homo sapiens
acactttatgccggatgtgct

SEQ ID NO: 5131078 - DNA, 13 bp, Homo sapiens
acactttatttac

SEQ ID NO: 5131079 - DNA, 17 bp, Homo sapiens
acactttcaaagacaat

SEQ ID NO: 5131080 - DNA, 13 bp, Homo sapiens
acactttcactgg

SEQ ID NO: 5131081 - DNA, 20 bp, Homo sapiens
acactttcattacttttaaa

SEQ ID NO: 5131082 - DNA, 16 bp, Homo sapiens
acactttccatctctg

SEQ ID NO: 5131083 - DNA, 21 bp, Homo sapiens
acactttccatctctgcctgt

SEQ ID NO: 5131084 - DNA, 18 bp, Homo sapiens
acactttcctcttctatg

SEQ ID NO: 5131085 - DNA, 23 bp, Homo sapiens
acactttcctggataaaaaagaa

SEQ ID NO: 5131086 - DNA, 14 bp, Homo sapiens
acactttctcttca

SEQ ID NO: 5131087 - DNA, 18 bp, Homo sapiens
acactttgaaatgtgttt

SEQ ID NO: 5131088 - DNA, 21 bp, Homo sapiens
acactttgaagcaaatacaat

SEQ ID NO: 5131089 - DNA, 17 bp, Homo sapiens
acactttgcactgatat

SEQ ID NO: 5131090 - DNA, 21 bp, Homo sapiens
acactttgccaaggctctccc

SEQ ID NO: 5131091 - DNA, 19 bp, Homo sapiens
acactttgccatattttca

SEQ ID NO: 5131092 - DNA, 16 bp, Homo sapiens
acactttgcctcctgt

SEQ ID NO: 5131093 - DNA, 23 bp, Homo sapiens
acactttgcctcctgtgtactgt

SEQ ID NO: 5131094 - DNA, 15 bp, Homo sapiens
acactttggacctta

SEQ ID NO: 5131095 - DNA, 15 bp, Homo sapiens
acactttggccacag

SEQ ID NO: 5131096 - DNA, 24 bp, Homo sapiens
acactttgggcttagtatttctca

SEQ ID NO: 5131097 - DNA, 23 bp, Homo sapiens
acactttggtttatgcggtgctg

SEQ ID NO: 5131098 - DNA, 12 bp, Homo sapiens
acactttgtatt

SEQ ID NO: 5131099 - DNA, 18 bp, Homo sapiens
acacttttaaaaaacaaa

SEQ ID NO: 5131100 - DNA, 20 bp, Homo sapiens
acacttttaaaaaacaaaaa

SEQ ID NO: 5131101 - DNA, 23 bp, Homo sapiens
acacttttaaaataaattctctc

SEQ ID NO: 5131102 - DNA, 16 bp, Homo sapiens
acacttttaattttgt

SEQ ID NO: 5131103 - DNA, 19 bp, Homo sapiens
acacttttatatttgaaaa

SEQ ID NO: 5131104 - DNA, 15 bp, Homo sapiens
acacttttcacctcc

SEQ ID NO: 5131105 - DNA, 15 bp, Homo sapiens
acacttttcagcaaa

SEQ ID NO: 5131106 - DNA, 16 bp, Homo sapiens
acacttttcatatcat

SEQ ID NO: 5131107 - DNA, 18 bp, Homo sapiens
acacttttgagacttttt

SEQ ID NO: 5131108 - DNA, 20 bp, Homo sapiens
acacttttgaggacaagtta

SEQ ID NO: 5131109 - DNA, 20 bp, Homo sapiens
acacttttgcacatatattt

SEQ ID NO: 5131110 - DNA, 17 bp, Homo sapiens
acacttttgccaatgaa

SEQ ID NO: 5131111 - DNA, 20 bp, Homo sapiens
acacttttgctctgcaggca

SEQ ID NO: 5131112 - DNA, 22 bp, Homo sapiens
acacttttgggaggtccaggca

SEQ ID NO: 5131113 - DNA, 21 bp, Homo sapiens
acactttttctctttccatga

SEQ ID NO: 5131114 - DNA, 15 bp, Homo sapiens
acactttttgtgaat

SEQ ID NO: 5131115 - DNA, 19 bp, Homo sapiens
acactttttgttttttgct

SEQ ID NO: 5131116 - DNA, 20 bp, Homo sapiens
acagaaaaaaaaatgtttta

SEQ ID NO: 5131117 - DNA, 18 bp, Homo sapiens
acagaaaaaaaacacaca

SEQ ID NO: 5131118 - DNA, 18 bp, Homo sapiens
acagaaaaaaataaaaac

SEQ ID NO: 5131119 - DNA, 16 bp, Homo sapiens
acagaaaaacaatctt

SEQ ID NO: 5131120 - DNA, 14 bp, Homo sapiens
acagaaaaaccttg

SEQ ID NO: 5131121 - DNA, 22 bp, Homo sapiens
acagaaaaataagtcaaaagga

SEQ ID NO: 5131122 - DNA, 14 bp, Homo sapiens
acagaaaaatactt

SEQ ID NO: 5131123 - DNA, 13 bp, Homo sapiens
acagaaaaatata

SEQ ID NO: 5131124 - DNA, 19 bp, Homo sapiens
acagaaaaatatgtaccaa

SEQ ID NO: 5131125 - DNA, 22 bp, Homo sapiens
acagaaaaatcttgtgctagaa

SEQ ID NO: 5131126 - DNA, 21 bp, Homo sapiens
acagaaaaatgaaatttaagc

SEQ ID NO: 5131127 - DNA, 9 bp, Homo sapiens
acagaaaac

SEQ ID NO: 5131128 - DNA, 11 bp, Homo sapiens
acagaaaacaa

SEQ ID NO: 5131129 - DNA, 19 bp, Homo sapiens
acagaaaacaaaagagaga

SEQ ID NO: 5131130 - DNA, 21 bp, Homo sapiens
acagaaaacaacaaaaaataa

SEQ ID NO: 5131131 - DNA, 13 bp, Homo sapiens
acagaaaacatgt

SEQ ID NO: 5131132 - DNA, 19 bp, Homo sapiens
acagaaaacctcaagggct

SEQ ID NO: 5131133 - DNA, 20 bp, Homo sapiens
acagaaaacctcaagggctt

SEQ ID NO: 5131134 - DNA, 21 bp, Homo sapiens
acagaaaacctgatgctgggg

SEQ ID NO: 5131135 - DNA, 14 bp, Homo sapiens
acagaaaactagaa

SEQ ID NO: 5131136 - DNA, 19 bp, Homo sapiens
acagaaaagtgcctgagct

SEQ ID NO: 5131137 - DNA, 19 bp, Homo sapiens
acagaaaatagcttttatt

SEQ ID NO: 5131138 - DNA, 13 bp, Homo sapiens
acagaaaatatac

SEQ ID NO: 5131139 - DNA, 14 bp, Homo sapiens
acagaaaatatact

SEQ ID NO: 5131140 - DNA, 15 bp, Homo sapiens
acagaaaatatactg

SEQ ID NO: 5131141 - DNA, 15 bp, Homo sapiens
acagaaaatatgtat

SEQ ID NO: 5131142 - DNA, 20 bp, Homo sapiens
acagaaaattgttgtgctta

SEQ ID NO: 5131143 - DNA, 12 bp, Homo sapiens
acagaaacaaaa

SEQ ID NO: 5131144 - DNA, 17 bp, Homo sapiens
acagaaacaaaaacact

SEQ ID NO: 5131145 - DNA, 12 bp, Homo sapiens
acagaaacactg

SEQ ID NO: 5131146 - DNA, 13 bp, Homo sapiens
acagaaacactgc

SEQ ID NO: 5131147 - DNA, 22 bp, Homo sapiens
acagaaacagagagagacagag

SEQ ID NO: 5131148 - DNA, 14 bp, Homo sapiens
acagaaacattttc

SEQ ID NO: 5131149 - DNA, 16 bp, Homo sapiens
acagaaaccaagccat

SEQ ID NO: 5131150 - DNA, 17 bp, Homo sapiens
acagaaacctatcctca

SEQ ID NO: 5131151 - DNA, 16 bp, Homo sapiens
acagaaaccttttatt

SEQ ID NO: 5131152 - DNA, 20 bp, Homo sapiens
acagaaacctttttaaaaat

SEQ ID NO: 5131153 - DNA, 14 bp, Homo sapiens
acagaaactacatt

SEQ ID NO: 5131154 - DNA, 12 bp, Homo sapiens
acagaaactgat

SEQ ID NO: 5131155 - DNA, 13 bp, Homo sapiens
acagaaactgatg

SEQ ID NO: 5131156 - DNA, 19 bp, Homo sapiens
acagaaactggattaaaac

SEQ ID NO: 5131157 - DNA, 23 bp, Homo sapiens
acagaaactggattaaaacaatt

SEQ ID NO: 5131158 - DNA, 11 bp, Homo sapiens
acagaaagaga

SEQ ID NO: 5131159 - DNA, 19 bp, Homo sapiens
acagaaagcagaacagtga

SEQ ID NO: 5131160 - DNA, 13 bp, Homo sapiens
acagaaagcctcc

SEQ ID NO: 5131161 - DNA, 17 bp, Homo sapiens
acagaaaggccactcag

SEQ ID NO: 5131162 - DNA, 16 bp, Homo sapiens
acagaaaggttttctt

SEQ ID NO: 5131163 - DNA, 22 bp, Homo sapiens
acagaaagtcattccttctttt

SEQ ID NO: 5131164 - DNA, 16 bp, Homo sapiens
acagaaagttggaaag

SEQ ID NO: 5131165 - DNA, 16 bp, Homo sapiens
acagaaagtttgtaaa

SEQ ID NO: 5131166 - DNA, 19 bp, Homo sapiens
acagaaatacatcatatgt

SEQ ID NO: 5131167 - DNA, 15 bp, Homo sapiens
acagaaatatataaa

SEQ ID NO: 5131168 - DNA, 20 bp, Homo sapiens
acagaaatatatatacatat

SEQ ID NO: 5131169 - DNA, 22 bp, Homo sapiens
acagaaatatatatacatatgt

SEQ ID NO: 5131170 - DNA, 17 bp, Homo sapiens
acagaaatatgattgat

SEQ ID NO: 5131171 - DNA, 21 bp, Homo sapiens
acagaaatattggttgaaagt

SEQ ID NO: 5131172 - DNA, 20 bp, Homo sapiens
acagaaatcagaggagagac

SEQ ID NO: 5131173 - DNA, 21 bp, Homo sapiens
acagaaatcagaggagagacg

SEQ ID NO: 5131174 - DNA, 13 bp, Homo sapiens
acagaaatgagga

SEQ ID NO: 5131175 - DNA, 24 bp, Homo sapiens
acagaaatgattactaaggaagat

SEQ ID NO: 5131176 - DNA, 15 bp, Homo sapiens
acagaaatgctctga

SEQ ID NO: 5131177 - DNA, 19 bp, Homo sapiens
acagaaatgctgctggcca

SEQ ID NO: 5131178 - DNA, 15 bp, Homo sapiens
acagaaatggactgg

SEQ ID NO: 5131179 - DNA, 14 bp, Homo sapiens
acagaaatgtacag

SEQ ID NO: 5131180 - DNA, 17 bp, Homo sapiens
acagaaatgtacagcaa

SEQ ID NO: 5131181 - DNA, 13 bp, Homo sapiens
acagaaatgttaa

SEQ ID NO: 5131182 - DNA, 16 bp, Homo sapiens
acagaaatgtttttaa

SEQ ID NO: 5131183 - DNA, 15 bp, Homo sapiens
acagaaattctgcaa

SEQ ID NO: 5131184 - DNA, 21 bp, Homo sapiens
acagaaattctgcaagtttct

SEQ ID NO: 5131185 - DNA, 14 bp, Homo sapiens
acagaaattgtata

SEQ ID NO: 5131186 - DNA, 16 bp, Homo sapiens
acagaaattgtatatt

SEQ ID NO: 5131187 - DNA, 23 bp, Homo sapiens
acagaaattgtatattgtaattt

SEQ ID NO: 5131188 - DNA, 13 bp, Homo sapiens
acagaacaagcca

SEQ ID NO: 5131189 - DNA, 22 bp, Homo sapiens
acagaacacttctaggactggg

SEQ ID NO: 5131190 - DNA, 15 bp, Homo sapiens
acagaacactttgct

SEQ ID NO: 5131191 - DNA, 12 bp, Homo sapiens
acagaacagctt

SEQ ID NO: 5131192 - DNA, 13 bp, Homo sapiens
acagaacagcttc

SEQ ID NO: 5131193 - DNA, 18 bp, Homo sapiens
acagaacagcttcaggtt

SEQ ID NO: 5131194 - DNA, 14 bp, Homo sapiens
acagaacaggaggt

SEQ ID NO: 5131195 - DNA, 21 bp, Homo sapiens
acagaacatatgttgcaagac

SEQ ID NO: 5131196 - DNA, 17 bp, Homo sapiens
acagaacatcattagaa

SEQ ID NO: 5131197 - DNA, 13 bp, Homo sapiens
acagaacatttct

SEQ ID NO: 5131198 - DNA, 21 bp, Homo sapiens
acagaaccaacgggtctgtgg

SEQ ID NO: 5131199 - DNA, 20 bp, Homo sapiens
acagaaccagcactcccagg

SEQ ID NO: 5131200 - DNA, 22 bp, Homo sapiens
acagaaccagcactcccagggc

SEQ ID NO: 5131201 - DNA, 18 bp, Homo sapiens
acagaaccagcagaacag

SEQ ID NO: 5131202 - DNA, 14 bp, Homo sapiens
acagaacccacagt

SEQ ID NO: 5131203 - DNA, 15 bp, Homo sapiens
acagaacccacagta

SEQ ID NO: 5131204 - DNA, 13 bp, Homo sapiens
acagaaccctcca

SEQ ID NO: 5131205 - DNA, 17 bp, Homo sapiens
acagaacctcccaaatt

SEQ ID NO: 5131206 - DNA, 17 bp, Homo sapiens
acagaaccttcaaccca

SEQ ID NO: 5131207 - DNA, 21 bp, Homo sapiens
acacacaggaactctgtgtga

SEQ ID NO: 5131208 - DNA, 14 bp, Homo sapiens
acacacaggccttc

SEQ ID NO: 5131209 - DNA, 23 bp, Homo sapiens
acacacaggtggtgtcactgtcc

SEQ ID NO: 5131210 - DNA, 13 bp, Homo sapiens
acacacagtattc

SEQ ID NO: 5131211 - DNA, 14 bp, Homo sapiens
acacacagtcctca

SEQ ID NO: 5131212 - DNA, 22 bp, Homo sapiens
acacacagtgattccctcctcc

SEQ ID NO: 5131213 - DNA, 16 bp, Homo sapiens
acacacatacacacac

SEQ ID NO: 5131214 - DNA, 21 bp, Homo sapiens
acacacatatacatatatata

SEQ ID NO: 5131215 - DNA, 15 bp, Homo sapiens
acacacatatacatt

SEQ ID NO: 5131216 - DNA, 12 bp, Homo sapiens
acacacatatat

SEQ ID NO: 5131217 - DNA, 17 bp, Homo sapiens
acacacatctggccctg

SEQ ID NO: 5131218 - DNA, 12 bp, Homo sapiens
acacacatgcac

SEQ ID NO: 5131219 - DNA, 13 bp, Homo sapiens
acacacatgcaca

SEQ ID NO: 5131220 - DNA, 17 bp, Homo sapiens
acacacatgcacacaca

SEQ ID NO: 5131221 - DNA, 12 bp, Homo sapiens
acacacatgcat

SEQ ID NO: 5131222 - DNA, 15 bp, Homo sapiens
acacacatgcataca

SEQ ID NO: 5131223 - DNA, 17 bp, Homo sapiens
acacacatgcatacaca

SEQ ID NO: 5131224 - DNA, 18 bp, Homo sapiens
acacacatgcatacacac

SEQ ID NO: 5131225 - DNA, 16 bp, Homo sapiens
acacacattctgcctt

SEQ ID NO: 5131226 - DNA, 23 bp, Homo sapiens
acacacattgctgtgaacaggaa

SEQ ID NO: 5131227 - DNA, 14 bp, Homo sapiens
acacaccacagaag

SEQ ID NO: 5131228 - DNA, 17 bp, Homo sapiens
acacaccaccacgcctg

SEQ ID NO: 5131229 - DNA, 20 bp, Homo sapiens
acacaccaccacgcctggct

SEQ ID NO: 5131230 - DNA, 13 bp, Homo sapiens
acacaccagcact

SEQ ID NO: 5131231 - DNA, 14 bp, Homo sapiens
acacaccagcactt

SEQ ID NO: 5131232 - DNA, 14 bp, Homo sapiens
acacaccaggcgct

SEQ ID NO: 5131233 - DNA, 16 bp, Homo sapiens
acacaccaggctgtgg

SEQ ID NO: 5131234 - DNA, 19 bp, Homo sapiens
acacaccagttttgagtgt

SEQ ID NO: 5131235 - DNA, 17 bp, Homo sapiens
acacacccccagagaga

SEQ ID NO: 5131236 - DNA, 15 bp, Homo sapiens
acacacccccccaca

SEQ ID NO: 5131237 - DNA, 11 bp, Homo sapiens
acacacccctc

SEQ ID NO: 5131238 - DNA, 19 bp, Homo sapiens
acacacccctcaaaaaaag

SEQ ID NO: 5131239 - DNA, 18 bp, Homo sapiens
acacaccctgcccctgca

SEQ ID NO: 5131240 - DNA, 12 bp, Homo sapiens
acacacctcatg

SEQ ID NO: 5131241 - DNA, 12 bp, Homo sapiens
acacacctctgc

SEQ ID NO: 5131242 - DNA, 14 bp, Homo sapiens
acacacctctgcca

SEQ ID NO: 5131243 - DNA, 14 bp, Homo sapiens
acacacctctgccc

SEQ ID NO: 5131244 - DNA, 15 bp, Homo sapiens
acacacctctgcccc

SEQ ID NO: 5131245 - DNA, 23 bp, Homo sapiens
acacacctctggatccctggagg

SEQ ID NO: 5131246 - DNA, 19 bp, Homo sapiens
acacacctgcacacccctg

SEQ ID NO: 5131247 - DNA, 18 bp, Homo sapiens
acacacctgcctgcagag

SEQ ID NO: 5131248 - DNA, 11 bp, Homo sapiens
acacacctgta

SEQ ID NO: 5131249 - DNA, 24 bp, Homo sapiens
acacacctgtagtcccagctactc

SEQ ID NO: 5131250 - DNA, 13 bp, Homo sapiens
acacacctgtctg

SEQ ID NO: 5131251 - DNA, 18 bp, Homo sapiens
acacacctgtctgtgcag

SEQ ID NO: 5131252 - DNA, 13 bp, Homo sapiens
acacaccttggag

SEQ ID NO: 5131253 - DNA, 9 bp, Homo sapiens
acacacgca

SEQ ID NO: 5131254 - DNA, 13 bp, Homo sapiens
acacacgcacgca

SEQ ID NO: 5131255 - DNA, 13 bp, Homo sapiens
acacacgcagaca

SEQ ID NO: 5131256 - DNA, 17 bp, Homo sapiens
acacacgcagacacaca

SEQ ID NO: 5131257 - DNA, 14 bp, Homo sapiens
acacacgccagctc

SEQ ID NO: 5131258 - DNA, 18 bp, Homo sapiens
acacacgccagctcctct

SEQ ID NO: 5131259 - DNA, 15 bp, Homo sapiens
acacacgcgcgcaca

SEQ ID NO: 5131260 - DNA, 21 bp, Homo sapiens
acacacgcgtgcacacaccag

SEQ ID NO: 5131261 - DNA, 14 bp, Homo sapiens
acacacgctgcctt

SEQ ID NO: 5131262 - DNA, 21 bp, Homo sapiens
acacacggttttggcagctga

SEQ ID NO: 5131263 - DNA, 19 bp, Homo sapiens
acacacgtgcaatttgttt

SEQ ID NO: 5131264 - DNA, 22 bp, Homo sapiens
acacacgtgcaatttgtttgtg

SEQ ID NO: 5131265 - DNA, 17 bp, Homo sapiens
acacacgtgtgatgtat

SEQ ID NO: 5131266 - DNA, 17 bp, Homo sapiens
acacacgttgacgggcc

SEQ ID NO: 5131267 - DNA, 22 bp, Homo sapiens
acacactaaactctggggcttg

SEQ ID NO: 5131268 - DNA, 13 bp, Homo sapiens
acacactacacca

SEQ ID NO: 5131269 - DNA, 18 bp, Homo sapiens
acacactacaccacacac

SEQ ID NO: 5131270 - DNA, 18 bp, Homo sapiens
acacactcaccagtggcc

SEQ ID NO: 5131271 - DNA, 13 bp, Homo sapiens
acacactcagcca

SEQ ID NO: 5131272 - DNA, 13 bp, Homo sapiens
acacactcagtgc

SEQ ID NO: 5131273 - DNA, 13 bp, Homo sapiens
acacactccttcc

SEQ ID NO: 5131274 - DNA, 15 bp, Homo sapiens
acacactccttcccc

SEQ ID NO: 5131275 - DNA, 16 bp, Homo sapiens
acacactccttcccct

SEQ ID NO: 5131276 - DNA, 23 bp, Homo sapiens
acacactcgggttaagaaatacc

SEQ ID NO: 5131277 - DNA, 14 bp, Homo sapiens
acacactgaaagct

SEQ ID NO: 5131278 - DNA, 16 bp, Homo sapiens
acacactgaggcaggg

SEQ ID NO: 5131279 - DNA, 19 bp, Homo sapiens
acacactgagttgcacata

SEQ ID NO: 5131280 - DNA, 21 bp, Homo sapiens
acacactgcatgtttgtgatt

SEQ ID NO: 5131281 - DNA, 13 bp, Homo sapiens
acacactgcctta

SEQ ID NO: 5131282 - DNA, 18 bp, Homo sapiens
acacactgccttattaca

SEQ ID NO: 5131283 - DNA, 22 bp, Homo sapiens
acacactggaaattgaaataaa

SEQ ID NO: 5131284 - DNA, 18 bp, Homo sapiens
acacactggaccccactg

SEQ ID NO: 5131285 - DNA, 17 bp, Homo sapiens
acacactggctcctgga

SEQ ID NO: 5131286 - DNA, 17 bp, Homo sapiens
acacactggtacttaga

SEQ ID NO: 5131287 - DNA, 13 bp, Homo sapiens
acacactgtaaat

SEQ ID NO: 5131288 - DNA, 17 bp, Homo sapiens
acacactgtacacataa

SEQ ID NO: 5131289 - DNA, 16 bp, Homo sapiens
acacactgtctggggc

SEQ ID NO: 5131290 - DNA, 20 bp, Homo sapiens
acacactgtctggggcccca

SEQ ID NO: 5131291 - DNA, 12 bp, Homo sapiens
acacactgtgcc

SEQ ID NO: 5131292 - DNA, 19 bp, Homo sapiens
acacactgtgctttctatt

SEQ ID NO: 5131293 - DNA, 23 bp, Homo sapiens
acacactgtgctttctattgtac

SEQ ID NO: 5131294 - DNA, 16 bp, Homo sapiens
acacactgtgtcctgg

SEQ ID NO: 5131295 - DNA, 22 bp, Homo sapiens
acacactgtgtgggggacggct

SEQ ID NO: 5131296 - DNA, 13 bp, Homo sapiens
acacactgttgtt

SEQ ID NO: 5131297 - DNA, 14 bp, Homo sapiens
acacacttactttt

SEQ ID NO: 5131298 - DNA, 13 bp, Homo sapiens
acacacttagaat

SEQ ID NO: 5131299 - DNA, 19 bp, Homo sapiens
acacacttgggagcagtcc

SEQ ID NO: 5131300 - DNA, 16 bp, Homo sapiens
acacactttctcttca

SEQ ID NO: 5131301 - DNA, 22 bp, Homo sapiens
acacacttttctttttaaatgt

SEQ ID NO: 5131302 - DNA, 22 bp, Homo sapiens
acacacttttgcacatatattt

SEQ ID NO: 5131303 - DNA, 11 bp, Homo sapiens
acacagaaaat

SEQ ID NO: 5131304 - DNA, 15 bp, Homo sapiens
acacagaaaatatac

SEQ ID NO: 5131305 - DNA, 22 bp, Homo sapiens
acacagaaaatatactgtaaag

SEQ ID NO: 5131306 - DNA, 20 bp, Homo sapiens
acacagaaaatgttgagaat

SEQ ID NO: 5131307 - DNA, 12 bp, Homo sapiens
acacagaaacac

SEQ ID NO: 5131308 - DNA, 17 bp, Homo sapiens
acacagaaacactgcct

SEQ ID NO: 5131309 - DNA, 21 bp, Homo sapiens
acacagaaacactgccttttt

SEQ ID NO: 5131310 - DNA, 14 bp, Homo sapiens
acacagaaaccaat

SEQ ID NO: 5131311 - DNA, 13 bp, Homo sapiens
acacagaaacctt

SEQ ID NO: 5131312 - DNA, 21 bp, Homo sapiens
acacagaaacctttttaaaaa

SEQ ID NO: 5131313 - DNA, 23 bp, Homo sapiens
acacagaaggggactgccacctc

SEQ ID NO: 5131314 - DNA, 22 bp, Homo sapiens
acacagaatataggataagaaa

SEQ ID NO: 5131315 - DNA, 21 bp, Homo sapiens
acacagacactaacgaaatat

SEQ ID NO: 5131316 - DNA, 23 bp, Homo sapiens
acacagacatgctctttttttaa

SEQ ID NO: 5131317 - DNA, 20 bp, Homo sapiens
acacagacattttgtgtgag

SEQ ID NO: 5131318 - DNA, 16 bp, Homo sapiens
acacagaccctgccca

SEQ ID NO: 5131319 - DNA, 17 bp, Homo sapiens
acacagaccctgcccac

SEQ ID NO: 5131320 - DNA, 19 bp, Homo sapiens
acacagaccctgcccaccc

SEQ ID NO: 5131321 - DNA, 23 bp, Homo sapiens
acacagaccgcgcccctgggact

SEQ ID NO: 5131322 - DNA, 12 bp, Homo sapiens
acacagacggcc

SEQ ID NO: 5131323 - DNA, 23 bp, Homo sapiens
acacagacgttaggcatttcctg

SEQ ID NO: 5131324 - DNA, 12 bp, Homo sapiens
acacagactctg

SEQ ID NO: 5131325 - DNA, 23 bp, Homo sapiens
acacagactgcgatttgtcccag

SEQ ID NO: 5131326 - DNA, 18 bp, Homo sapiens
acacagactggcaataaa

SEQ ID NO: 5131327 - DNA, 14 bp, Homo sapiens
acacagactttctg

SEQ ID NO: 5131328 - DNA, 18 bp, Homo sapiens
acacagactttctgtgac

SEQ ID NO: 5131329 - DNA, 10 bp, Homo sapiens
acacagagaa

SEQ ID NO: 5131330 - DNA, 19 bp, Homo sapiens
acacagagaaatacaaaat

SEQ ID NO: 5131331 - DNA, 22 bp, Homo sapiens
acacagagaagcggatttccag

SEQ ID NO: 5131332 - DNA, 12 bp, Homo sapiens
acacagagaagg

SEQ ID NO: 5131333 - DNA, 19 bp, Homo sapiens
acacagagatttgagaacc

SEQ ID NO: 5131334 - DNA, 20 bp, Homo sapiens
acacagagtggagccctcag

SEQ ID NO: 5131335 - DNA, 23 bp, Homo sapiens
acacagagtggtctttctggaga

SEQ ID NO: 5131336 - DNA, 17 bp, Homo sapiens
acacagatacacacaca

SEQ ID NO: 5131337 - DNA, 15 bp, Homo sapiens
acacagatatgcaca

SEQ ID NO: 5131338 - DNA, 19 bp, Homo sapiens
acacagatcccactggaag

SEQ ID NO: 5131339 - DNA, 20 bp, Homo sapiens
acacagatcccactggaaga

SEQ ID NO: 5131340 - DNA, 14 bp, Homo sapiens
acacagatctcttg

SEQ ID NO: 5131341 - DNA, 16 bp, Homo sapiens
acacagatgaaacaca

SEQ ID NO: 5131342 - DNA, 19 bp, Homo sapiens
acacagatggcacctgtgg

SEQ ID NO: 5131343 - DNA, 21 bp, Homo sapiens
acacagatggtcacacagaga

SEQ ID NO: 5131344 - DNA, 11 bp, Homo sapiens
acacagatgtt

SEQ ID NO: 5131345 - DNA, 23 bp, Homo sapiens
acacagatttcggtcataaagaa

SEQ ID NO: 5131346 - DNA, 19 bp, Homo sapiens
acacagatttttacactaa

SEQ ID NO: 5131347 - DNA, 19 bp, Homo sapiens
acacagatttttgggctcc

SEQ ID NO: 5131348 - DNA, 22 bp, Homo sapiens
acacagcacaccagccgctgca

SEQ ID NO: 5131349 - DNA, 22 bp, Homo sapiens
acacagcacttcaaagaagctg

SEQ ID NO: 5131350 - DNA, 18 bp, Homo sapiens
acacagcagcactgcaga

SEQ ID NO: 5131351 - DNA, 22 bp, Homo sapiens
acacagcagcgcagccgagccc

SEQ ID NO: 5131352 - DNA, 12 bp, Homo sapiens
acacagcagctg

SEQ ID NO: 5131353 - DNA, 13 bp, Homo sapiens
acacagcatgggt

SEQ ID NO: 5131354 - DNA, 15 bp, Homo sapiens
acacagcatgtgtat

SEQ ID NO: 5131355 - DNA, 9 bp, Homo sapiens
acacagcca

SEQ ID NO: 5131356 - DNA, 14 bp, Homo sapiens
acacagccacacac

SEQ ID NO: 5131357 - DNA, 22 bp, Homo sapiens
acacagccacacacacagaaaa

SEQ ID NO: 5131358 - DNA, 23 bp, Homo sapiens
acacagccacacacacagaaaat

SEQ ID NO: 5131359 - DNA, 19 bp, Homo sapiens
acacagccactaaaacaca

SEQ ID NO: 5131360 - DNA, 16 bp, Homo sapiens
acacagccattataaa

SEQ ID NO: 5131361 - DNA, 23 bp, Homo sapiens
acacagccattcatctgggctgg

SEQ ID NO: 5131362 - DNA, 20 bp, Homo sapiens
acacagcccaccctctgtga

SEQ ID NO: 5131363 - DNA, 16 bp, Homo sapiens
acacagcccagagact

SEQ ID NO: 5131364 - DNA, 19 bp, Homo sapiens
acacagccgattcacctga

SEQ ID NO: 5131365 - DNA, 23 bp, Homo sapiens
acacagccgattcacctgagcag

SEQ ID NO: 5131366 - DNA, 23 bp, Homo sapiens
acacagcctatatcaaacatgca

SEQ ID NO: 5131367 - DNA, 24 bp, Homo sapiens
acacagcctggcctcccctgcgga

SEQ ID NO: 5131368 - DNA, 13 bp, Homo sapiens
acacagcctgggc

SEQ ID NO: 5131369 - DNA, 18 bp, Homo sapiens
acacagcctgggccccag

SEQ ID NO: 5131370 - DNA, 15 bp, Homo sapiens
acacagccttccttc

SEQ ID NO: 5131371 - DNA, 21 bp, Homo sapiens
acacagcgtccctagcagtga

SEQ ID NO: 5131372 - DNA, 20 bp, Homo sapiens
acacagctaacacacagctc

SEQ ID NO: 5131373 - DNA, 23 bp, Homo sapiens
acacagctaacacacagctccca

SEQ ID NO: 5131374 - DNA, 20 bp, Homo sapiens
acacagctaataaaagtcag

SEQ ID NO: 5131375 - DNA, 15 bp, Homo sapiens
acacagctacagctt

SEQ ID NO: 5131376 - DNA, 14 bp, Homo sapiens
acacagctctgtcc

SEQ ID NO: 5131377 - DNA, 20 bp, Homo sapiens
acacagctctgtcctgggag

SEQ ID NO: 5131378 - DNA, 12 bp, Homo sapiens
acacagctcttc

SEQ ID NO: 5131379 - DNA, 13 bp, Homo sapiens
acacagctcttca

SEQ ID NO: 5131380 - DNA, 14 bp, Homo sapiens
acacagctcttcat

SEQ ID NO: 5131381 - DNA, 22 bp, Homo sapiens
acacagctcttccagggcagcg

SEQ ID NO: 5131382 - DNA, 21 bp, Homo sapiens
acacagctcttctccaggctg

SEQ ID NO: 5131383 - DNA, 22 bp, Homo sapiens
acacagctcttctccaggctgt

SEQ ID NO: 5131384 - DNA, 22 bp, Homo sapiens
acacagctgagagacttttaat

SEQ ID NO: 5131385 - DNA, 14 bp, Homo sapiens
acacagctgagcac

SEQ ID NO: 5131386 - DNA, 22 bp, Homo sapiens
acagaaccttgttatttctcag

SEQ ID NO: 5131387 - DNA, 23 bp, Homo sapiens
acagaaccttgttatttctcaga

SEQ ID NO: 5131388 - DNA, 13 bp, Homo sapiens
acagaactaaatg

SEQ ID NO: 5131389 - DNA, 21 bp, Homo sapiens
acagaactcgatgcactgacc

SEQ ID NO: 5131390 - DNA, 20 bp, Homo sapiens
acagaactcggtgtccccac

SEQ ID NO: 5131391 - DNA, 23 bp, Homo sapiens
acagaactcgtggcgtggggcag

SEQ ID NO: 5131392 - DNA, 20 bp, Homo sapiens
acagaactctttcaaaacct

SEQ ID NO: 5131393 - DNA, 20 bp, Homo sapiens
acagaactgaacgtcctgca

SEQ ID NO: 5131394 - DNA, 14 bp, Homo sapiens
acagaacttcagaa

SEQ ID NO: 5131395 - DNA, 17 bp, Homo sapiens
acagaacttcagaaaga

SEQ ID NO: 5131396 - DNA, 19 bp, Homo sapiens
acagaacttcagaaagact

SEQ ID NO: 5131397 - DNA, 21 bp, Homo sapiens
acagaacttcagaaagacttg

SEQ ID NO: 5131398 - DNA, 20 bp, Homo sapiens
acagaacttgaatgtgtcag

SEQ ID NO: 5131399 - DNA, 13 bp, Homo sapiens
acagaacttgtgg

SEQ ID NO: 5131400 - DNA, 14 bp, Homo sapiens
acagaagaaaagca

SEQ ID NO: 5131401 - DNA, 15 bp, Homo sapiens
acagaagaaaataat

SEQ ID NO: 5131402 - DNA, 22 bp, Homo sapiens
acagaagaattttttttttaag

SEQ ID NO: 5131403 - DNA, 14 bp, Homo sapiens
acagaagacaaaat

SEQ ID NO: 5131404 - DNA, 20 bp, Homo sapiens
acagaagagtaaactggtga

SEQ ID NO: 5131405 - DNA, 16 bp, Homo sapiens
acagaagattaagaca

SEQ ID NO: 5131406 - DNA, 20 bp, Homo sapiens
acagaagcaaaatggctttt

SEQ ID NO: 5131407 - DNA, 12 bp, Homo sapiens
acagaagcagct

SEQ ID NO: 5131408 - DNA, 13 bp, Homo sapiens
acagaagcagctc

SEQ ID NO: 5131409 - DNA, 15 bp, Homo sapiens
acagaagcagctctt

SEQ ID NO: 5131410 - DNA, 19 bp, Homo sapiens
acagaagcaggctggaggt

SEQ ID NO: 5131411 - DNA, 20 bp, Homo sapiens
acagaagcatttgtattttg

SEQ ID NO: 5131412 - DNA, 21 bp, Homo sapiens
acagaagcatttgtattttgt

SEQ ID NO: 5131413 - DNA, 23 bp, Homo sapiens
acagaagcatttgtattttgtgt

SEQ ID NO: 5131414 - DNA, 18 bp, Homo sapiens
acagaagcccatgtcttc

SEQ ID NO: 5131415 - DNA, 15 bp, Homo sapiens
acagaagctatttca

SEQ ID NO: 5131416 - DNA, 22 bp, Homo sapiens
acagaagctatttcatttgctg

SEQ ID NO: 5131417 - DNA, 14 bp, Homo sapiens
acagaagcttcaga

SEQ ID NO: 5131418 - DNA, 18 bp, Homo sapiens
acagaagcttcagaagtt

SEQ ID NO: 5131419 - DNA, 13 bp, Homo sapiens
acagaagcttcca

SEQ ID NO: 5131420 - DNA, 18 bp, Homo sapiens
acagaaggaatctgtgca

SEQ ID NO: 5131421 - DNA, 22 bp, Homo sapiens
acagaaggaatctgtgcagatg

SEQ ID NO: 5131422 - DNA, 18 bp, Homo sapiens
acagaaggagatgggtga

SEQ ID NO: 5131423 - DNA, 12 bp, Homo sapiens
acagaaggcccg

SEQ ID NO: 5131424 - DNA, 17 bp, Homo sapiens
acagaagggagggcaga

SEQ ID NO: 5131425 - DNA, 19 bp, Homo sapiens
acagaagggagggcagagc

SEQ ID NO: 5131426 - DNA, 21 bp, Homo sapiens
acagaagggagggcagagctg

SEQ ID NO: 5131427 - DNA, 23 bp, Homo sapiens
acagaagggagtgaaaacctctt

SEQ ID NO: 5131428 - DNA, 14 bp, Homo sapiens
acagaagggctctt

SEQ ID NO: 5131429 - DNA, 17 bp, Homo sapiens
acagaaggggactgcca

SEQ ID NO: 5131430 - DNA, 18 bp, Homo sapiens
acagaaggggatgggaaa

SEQ ID NO: 5131431 - DNA, 19 bp, Homo sapiens
acagaaggtaataggaaga

SEQ ID NO: 5131432 - DNA, 16 bp, Homo sapiens
acagaaggtgaacttt

SEQ ID NO: 5131433 - DNA, 22 bp, Homo sapiens
acagaaggtgaactttgtgctt

SEQ ID NO: 5131434 - DNA, 17 bp, Homo sapiens
acagaagtcatgaagcc

SEQ ID NO: 5131435 - DNA, 22 bp, Homo sapiens
acagaagtgaggatgagaccca

SEQ ID NO: 5131436 - DNA, 15 bp, Homo sapiens
acagaagtgcatcct

SEQ ID NO: 5131437 - DNA, 21 bp, Homo sapiens
acagaagtggaaggataatga

SEQ ID NO: 5131438 - DNA, 18 bp, Homo sapiens
acagaagttgtgaaacta

SEQ ID NO: 5131439 - DNA, 20 bp, Homo sapiens
acagaagttgtgaaactaaa

SEQ ID NO: 5131440 - DNA, 22 bp, Homo sapiens
acagaagttgtgaaactaaaat

SEQ ID NO: 5131441 - DNA, 23 bp, Homo sapiens
acagaataaaagttcctctccct

SEQ ID NO: 5131442 - DNA, 13 bp, Homo sapiens
acagaataaagca

SEQ ID NO: 5131443 - DNA, 16 bp, Homo sapiens
acagaataaagcagcc

SEQ ID NO: 5131444 - DNA, 19 bp, Homo sapiens
acagaataaagcagcctga

SEQ ID NO: 5131445 - DNA, 19 bp, Homo sapiens
acagaatacggaagagcag

SEQ ID NO: 5131446 - DNA, 17 bp, Homo sapiens
acagaatagtttacaca

SEQ ID NO: 5131447 - DNA, 21 bp, Homo sapiens
acagaatatgaatgagaatgt

SEQ ID NO: 5131448 - DNA, 21 bp, Homo sapiens
acagaatattgacaagctagg

SEQ ID NO: 5131449 - DNA, 15 bp, Homo sapiens
acagaatatttttat

SEQ ID NO: 5131450 - DNA, 23 bp, Homo sapiens
acagaatatttttatatttcctt

SEQ ID NO: 5131451 - DNA, 16 bp, Homo sapiens
acagaatcagtgttaa

SEQ ID NO: 5131452 - DNA, 14 bp, Homo sapiens
acagaatgaaaaat

SEQ ID NO: 5131453 - DNA, 24 bp, Homo sapiens
acagaatgaaaaatgaaagatgat

SEQ ID NO: 5131454 - DNA, 15 bp, Homo sapiens
acagaatgagagaga

SEQ ID NO: 5131455 - DNA, 20 bp, Homo sapiens
acagaatgagtatttattta

SEQ ID NO: 5131456 - DNA, 22 bp, Homo sapiens
acagaatgatatccagtaagca

SEQ ID NO: 5131457 - DNA, 20 bp, Homo sapiens
acagaatgcaaccaagtcac

SEQ ID NO: 5131458 - DNA, 22 bp, Homo sapiens
acagaatgcaaccaagtcacac

SEQ ID NO: 5131459 - DNA, 13 bp, Homo sapiens
acagaatgcatta

SEQ ID NO: 5131460 - DNA, 14 bp, Homo sapiens
acagaatgctcagg

SEQ ID NO: 5131461 - DNA, 22 bp, Homo sapiens
acagaatgctcagggtcactga

SEQ ID NO: 5131462 - DNA, 19 bp, Homo sapiens
acagaatggctatcaaaag

SEQ ID NO: 5131463 - DNA, 22 bp, Homo sapiens
acagaatggctatcaaaagaaa

SEQ ID NO: 5131464 - DNA, 15 bp, Homo sapiens
acagaatgtatctgt

SEQ ID NO: 5131465 - DNA, 20 bp, Homo sapiens
acagaatgtatctgtgaagt

SEQ ID NO: 5131466 - DNA, 14 bp, Homo sapiens
acagaatgtgttct

SEQ ID NO: 5131467 - DNA, 17 bp, Homo sapiens
acagaattaatggtcat

SEQ ID NO: 5131468 - DNA, 17 bp, Homo sapiens
acagaattctcccagcg

SEQ ID NO: 5131469 - DNA, 15 bp, Homo sapiens
acagaattctgctac

SEQ ID NO: 5131470 - DNA, 18 bp, Homo sapiens
acagaattgactgcagtt

SEQ ID NO: 5131471 - DNA, 14 bp, Homo sapiens
acagaatttataga

SEQ ID NO: 5131472 - DNA, 18 bp, Homo sapiens
acagaatttccactgtaa

SEQ ID NO: 5131473 - DNA, 10 bp, Homo sapiens
acagaatttt

SEQ ID NO: 5131474 - DNA, 15 bp, Homo sapiens
acagaatttttaatg

SEQ ID NO: 5131475 - DNA, 18 bp, Homo sapiens
acagacaaaaacagcctc

SEQ ID NO: 5131476 - DNA, 13 bp, Homo sapiens
acagacaaaacaa

SEQ ID NO: 5131477 - DNA, 14 bp, Homo sapiens
acagacaacagaag

SEQ ID NO: 5131478 - DNA, 13 bp, Homo sapiens
acagacaagcagc

SEQ ID NO: 5131479 - DNA, 18 bp, Homo sapiens
acagacaagcagcccttg

SEQ ID NO: 5131480 - DNA, 21 bp, Homo sapiens
acagacaaggtagccctggcc

SEQ ID NO: 5131481 - DNA, 22 bp, Homo sapiens
acagacaaggtagccctggcca

SEQ ID NO: 5131482 - DNA, 12 bp, Homo sapiens
acagacaaggtt

SEQ ID NO: 5131483 - DNA, 19 bp, Homo sapiens
acagacacaatatgtatgc

SEQ ID NO: 5131484 - DNA, 21 bp, Homo sapiens
acagacacacaaaatgtcaca

SEQ ID NO: 5131485 - DNA, 22 bp, Homo sapiens
acagacacacacacgcacgcac

SEQ ID NO: 5131486 - DNA, 23 bp, Homo sapiens
acagacacacactggctcctgga

SEQ ID NO: 5131487 - DNA, 15 bp, Homo sapiens
acagacacaggcccg

SEQ ID NO: 5131488 - DNA, 22 bp, Homo sapiens
acagacacaggcccggctccag

SEQ ID NO: 5131489 - DNA, 15 bp, Homo sapiens
acagacaccacagcc

SEQ ID NO: 5131490 - DNA, 18 bp, Homo sapiens
acagacaccacagcctcc

SEQ ID NO: 5131491 - DNA, 22 bp, Homo sapiens
acagacaccacagcctcccctt

SEQ ID NO: 5131492 - DNA, 21 bp, Homo sapiens
acagacacctccccctaccca

SEQ ID NO: 5131493 - DNA, 14 bp, Homo sapiens
acagacactaactt

SEQ ID NO: 5131494 - DNA, 12 bp, Homo sapiens
acagacactcct

SEQ ID NO: 5131495 - DNA, 15 bp, Homo sapiens
acagacactcctggg

SEQ ID NO: 5131496 - DNA, 16 bp, Homo sapiens
acagacactcctgggg

SEQ ID NO: 5131497 - DNA, 13 bp, Homo sapiens
acagacactgtaa

SEQ ID NO: 5131498 - DNA, 15 bp, Homo sapiens
acagacactgttgca

SEQ ID NO: 5131499 - DNA, 12 bp, Homo sapiens
acagacagaaga

SEQ ID NO: 5131500 - DNA, 14 bp, Homo sapiens
acagacagaatata

SEQ ID NO: 5131501 - DNA, 15 bp, Homo sapiens
acagacagcagctgg

SEQ ID NO: 5131502 - DNA, 15 bp, Homo sapiens
acagacagccctcca

SEQ ID NO: 5131503 - DNA, 13 bp, Homo sapiens
acagacaggctct

SEQ ID NO: 5131504 - DNA, 19 bp, Homo sapiens
acagacaggtggaaaaact

SEQ ID NO: 5131505 - DNA, 12 bp, Homo sapiens
acagacatacat

SEQ ID NO: 5131506 - DNA, 16 bp, Homo sapiens
acagacatacatagac

SEQ ID NO: 5131507 - DNA, 18 bp, Homo sapiens
acagacatactaaccagc

SEQ ID NO: 5131508 - DNA, 14 bp, Homo sapiens
acagacatatatat

SEQ ID NO: 5131509 - DNA, 22 bp, Homo sapiens
acagacatatatatatatatgc

SEQ ID NO: 5131510 - DNA, 14 bp, Homo sapiens
acagacatatttaa

SEQ ID NO: 5131511 - DNA, 15 bp, Homo sapiens
acagacatcatgctg

SEQ ID NO: 5131512 - DNA, 13 bp, Homo sapiens
acagacatctcct

SEQ ID NO: 5131513 - DNA, 15 bp, Homo sapiens
acagacatctctgca

SEQ ID NO: 5131514 - DNA, 15 bp, Homo sapiens
acagacatgagccac

SEQ ID NO: 5131515 - DNA, 15 bp, Homo sapiens
acagacatgctcttt

SEQ ID NO: 5131516 - DNA, 18 bp, Homo sapiens
acagacatggaacagtgt

SEQ ID NO: 5131517 - DNA, 19 bp, Homo sapiens
acagacatggaacagtgta

SEQ ID NO: 5131518 - DNA, 17 bp, Homo sapiens
acagacattctgccagg

SEQ ID NO: 5131519 - DNA, 21 bp, Homo sapiens
acagacattttgtgtgagact

SEQ ID NO: 5131520 - DNA, 17 bp, Homo sapiens
acagaccaaaaatcaac

SEQ ID NO: 5131521 - DNA, 19 bp, Homo sapiens
acagaccacctttcacaaa

SEQ ID NO: 5131522 - DNA, 15 bp, Homo sapiens
acagaccagcccttc

SEQ ID NO: 5131523 - DNA, 22 bp, Homo sapiens
acagaccatggatatgttgtat

SEQ ID NO: 5131524 - DNA, 17 bp, Homo sapiens
acagacccacccccagc

SEQ ID NO: 5131525 - DNA, 13 bp, Homo sapiens
acagacccaggac

SEQ ID NO: 5131526 - DNA, 12 bp, Homo sapiens
acagacccaggt

SEQ ID NO: 5131527 - DNA, 14 bp, Homo sapiens
acagacccaggtct

SEQ ID NO: 5131528 - DNA, 15 bp, Homo sapiens
acagacccaggtctt

SEQ ID NO: 5131529 - DNA, 16 bp, Homo sapiens
acagacccaggtcttc

SEQ ID NO: 5131530 - DNA, 13 bp, Homo sapiens
acagacccagtga

SEQ ID NO: 5131531 - DNA, 15 bp, Homo sapiens
acagacccccagggc

SEQ ID NO: 5131532 - DNA, 18 bp, Homo sapiens
acagacccctcgcaactg

SEQ ID NO: 5131533 - DNA, 18 bp, Homo sapiens
acagaccccttggctttt

SEQ ID NO: 5131534 - DNA, 16 bp, Homo sapiens
acagaccctgccctgt

SEQ ID NO: 5131535 - DNA, 18 bp, Homo sapiens
acagaccctgccctgtgg

SEQ ID NO: 5131536 - DNA, 18 bp, Homo sapiens
acagaccgaactgttgta

SEQ ID NO: 5131537 - DNA, 19 bp, Homo sapiens
acagaccgaactgttgtat

SEQ ID NO: 5131538 - DNA, 13 bp, Homo sapiens
acagaccggggtg

SEQ ID NO: 5131539 - DNA, 16 bp, Homo sapiens
acagacctaagaaata

SEQ ID NO: 5131540 - DNA, 21 bp, Homo sapiens
acagacctcaagggacaggga

SEQ ID NO: 5131541 - DNA, 21 bp, Homo sapiens
acagacctcactgctttgtag

SEQ ID NO: 5131542 - DNA, 18 bp, Homo sapiens
acagacctccagattatt

SEQ ID NO: 5131543 - DNA, 23 bp, Homo sapiens
acagacctcggctgtgtggggag

SEQ ID NO: 5131544 - DNA, 20 bp, Homo sapiens
acagacctgagatgaagatt

SEQ ID NO: 5131545 - DNA, 16 bp, Homo sapiens
acagacctgctctgga

SEQ ID NO: 5131546 - DNA, 13 bp, Homo sapiens
acagacctggaca

SEQ ID NO: 5131547 - DNA, 22 bp, Homo sapiens
acagacctggagcccctgggtg

SEQ ID NO: 5131548 - DNA, 18 bp, Homo sapiens
acagacgctgctgtcaca

SEQ ID NO: 5131549 - DNA, 20 bp, Homo sapiens
acagacggacgggacagcgg

SEQ ID NO: 5131550 - DNA, 14 bp, Homo sapiens
acagacggcctagg

SEQ ID NO: 5131551 - DNA, 19 bp, Homo sapiens
acagacggcctaggggtgg

SEQ ID NO: 5131552 - DNA, 15 bp, Homo sapiens
acagacgtccctcca

SEQ ID NO: 5131553 - DNA, 16 bp, Homo sapiens
acagacgtccctccac

SEQ ID NO: 5131554 - DNA, 20 bp, Homo sapiens
acagacgttaggcatttcct

SEQ ID NO: 5131555 - DNA, 22 bp, Homo sapiens
acagactaagaaggaaaagaag

SEQ ID NO: 5131556 - DNA, 23 bp, Homo sapiens
acagactagcaggctactgggac

SEQ ID NO: 5131557 - DNA, 19 bp, Homo sapiens
acagactattgacatcagc

SEQ ID NO: 5131558 - DNA, 22 bp, Homo sapiens
acagactatttgctaatgtata

SEQ ID NO: 5131559 - DNA, 17 bp, Homo sapiens
acagactatttttagat

SEQ ID NO: 5131560 - DNA, 19 bp, Homo sapiens
acagactcaatgtgctctg

SEQ ID NO: 5131561 - DNA, 12 bp, Homo sapiens
acagactcactg

SEQ ID NO: 5131562 - DNA, 18 bp, Homo sapiens
acagactcatcctgaaca

SEQ ID NO: 5131563 - DNA, 22 bp, Homo sapiens
acagactcattaaatattctgt

SEQ ID NO: 5131564 - DNA, 17 bp, Homo sapiens
acacagctgagcactta

SEQ ID NO: 5131565 - DNA, 12 bp, Homo sapiens
acacagctgccc

SEQ ID NO: 5131566 - DNA, 19 bp, Homo sapiens
acacagctgccctagctga

SEQ ID NO: 5131567 - DNA, 18 bp, Homo sapiens
acacagctgggcaaagcc

SEQ ID NO: 5131568 - DNA, 18 bp, Homo sapiens
acacagcttaacaatgca

SEQ ID NO: 5131569 - DNA, 17 bp, Homo sapiens
acacagcttgtgaatgt

SEQ ID NO: 5131570 - DNA, 20 bp, Homo sapiens
acacagctttatcaccagag

SEQ ID NO: 5131571 - DNA, 22 bp, Homo sapiens
acacagctttatcaccagagag

SEQ ID NO: 5131572 - DNA, 14 bp, Homo sapiens
acacaggaaaaata

SEQ ID NO: 5131573 - DNA, 15 bp, Homo sapiens
acacaggaaaaataa

SEQ ID NO: 5131574 - DNA, 21 bp, Homo sapiens
acacaggaactctgtgtgaga

SEQ ID NO: 5131575 - DNA, 22 bp, Homo sapiens
acacaggaactctgtgtgagag

SEQ ID NO: 5131576 - DNA, 16 bp, Homo sapiens
acacaggatagataac

SEQ ID NO: 5131577 - DNA, 24 bp, Homo sapiens
acacaggatcctattctcaccagg

SEQ ID NO: 5131578 - DNA, 19 bp, Homo sapiens
acacaggcaactgaggcag

SEQ ID NO: 5131579 - DNA, 20 bp, Homo sapiens
acacaggcaactgaggcaga

SEQ ID NO: 5131580 - DNA, 12 bp, Homo sapiens
acacaggcagcc

SEQ ID NO: 5131581 - DNA, 15 bp, Homo sapiens
acacaggcagccagc

SEQ ID NO: 5131582 - DNA, 12 bp, Homo sapiens
acacaggcagct

SEQ ID NO: 5131583 - DNA, 12 bp, Homo sapiens
acacaggcagga

SEQ ID NO: 5131584 - DNA, 14 bp, Homo sapiens
acacaggcagggcc

SEQ ID NO: 5131585 - DNA, 15 bp, Homo sapiens
acacaggcagggcct

SEQ ID NO: 5131586 - DNA, 22 bp, Homo sapiens
acacaggcagggcctggctcca

SEQ ID NO: 5131587 - DNA, 14 bp, Homo sapiens
acacaggccagccc

SEQ ID NO: 5131588 - DNA, 17 bp, Homo sapiens
acacaggcccggctcca

SEQ ID NO: 5131589 - DNA, 23 bp, Homo sapiens
acacaggcccggctccaggctcc

SEQ ID NO: 5131590 - DNA, 16 bp, Homo sapiens
acacaggccctccctg

SEQ ID NO: 5131591 - DNA, 16 bp, Homo sapiens
acacaggcctgctctc

SEQ ID NO: 5131592 - DNA, 16 bp, Homo sapiens
acacaggcctggccca

SEQ ID NO: 5131593 - DNA, 20 bp, Homo sapiens
acacaggcctggcccagcca

SEQ ID NO: 5131594 - DNA, 24 bp, Homo sapiens
acacaggcctggcccagccagcag

SEQ ID NO: 5131595 - DNA, 11 bp, Homo sapiens
acacaggcctt

SEQ ID NO: 5131596 - DNA, 21 bp, Homo sapiens
acacaggccttctgtggggct

SEQ ID NO: 5131597 - DNA, 14 bp, Homo sapiens
acacaggctgccgc

SEQ ID NO: 5131598 - DNA, 16 bp, Homo sapiens
acacaggctgtcctta

SEQ ID NO: 5131599 - DNA, 18 bp, Homo sapiens
acacaggcttatttttaa

SEQ ID NO: 5131600 - DNA, 15 bp, Homo sapiens
acacagggctcacag

SEQ ID NO: 5131601 - DNA, 16 bp, Homo sapiens
acacagggctcacagg

SEQ ID NO: 5131602 - DNA, 18 bp, Homo sapiens
acacagggctcacagggc

SEQ ID NO: 5131603 - DNA, 20 bp, Homo sapiens
acacagggctcacagggcag

SEQ ID NO: 5131604 - DNA, 19 bp, Homo sapiens
acacagggctctttgatgg

SEQ ID NO: 5131605 - DNA, 21 bp, Homo sapiens
acacaggggacacccagaaac

SEQ ID NO: 5131606 - DNA, 14 bp, Homo sapiens
acacaggggccttt

SEQ ID NO: 5131607 - DNA, 20 bp, Homo sapiens
acacaggtacagcaacagga

SEQ ID NO: 5131608 - DNA, 14 bp, Homo sapiens
acacaggtcagggc

SEQ ID NO: 5131609 - DNA, 18 bp, Homo sapiens
acacaggtcagggctcag

SEQ ID NO: 5131610 - DNA, 23 bp, Homo sapiens
acacaggtcctgaaagtctgtgt

SEQ ID NO: 5131611 - DNA, 20 bp, Homo sapiens
acacaggtctcattgcttct

SEQ ID NO: 5131612 - DNA, 15 bp, Homo sapiens
acacaggtctttcct

SEQ ID NO: 5131613 - DNA, 16 bp, Homo sapiens
acacaggtctttccta

SEQ ID NO: 5131614 - DNA, 18 bp, Homo sapiens
acacaggtggtgtcactg

SEQ ID NO: 5131615 - DNA, 22 bp, Homo sapiens
acacaggtggtgtcactgtccc

SEQ ID NO: 5131616 - DNA, 16 bp, Homo sapiens
acacaggttcacgtgc

SEQ ID NO: 5131617 - DNA, 20 bp, Homo sapiens
acacagtaagataggttctg

SEQ ID NO: 5131618 - DNA, 15 bp, Homo sapiens
acacagtaattgtga

SEQ ID NO: 5131619 - DNA, 16 bp, Homo sapiens
acacagtaattgtgac

SEQ ID NO: 5131620 - DNA, 14 bp, Homo sapiens
acacagtactttat

SEQ ID NO: 5131621 - DNA, 20 bp, Homo sapiens
acacagtactttattgtaca

SEQ ID NO: 5131622 - DNA, 21 bp, Homo sapiens
acacagtagctccaacacttt

SEQ ID NO: 5131623 - DNA, 12 bp, Homo sapiens
acacagtagtgt

SEQ ID NO: 5131624 - DNA, 11 bp, Homo sapiens
acacagtattg

SEQ ID NO: 5131625 - DNA, 22 bp, Homo sapiens
acacagtatttattgttcccac

SEQ ID NO: 5131626 - DNA, 23 bp, Homo sapiens
acacagtcaaaataattctaaat

SEQ ID NO: 5131627 - DNA, 21 bp, Homo sapiens
acacagtcaaatttacattta

SEQ ID NO: 5131628 - DNA, 16 bp, Homo sapiens
acacagtcacattcga

SEQ ID NO: 5131629 - DNA, 21 bp, Homo sapiens
acacagtctggcagttgctaa

SEQ ID NO: 5131630 - DNA, 13 bp, Homo sapiens
acacagtgaaacg

SEQ ID NO: 5131631 - DNA, 22 bp, Homo sapiens
acacagtgaaacgcaattttac

SEQ ID NO: 5131632 - DNA, 18 bp, Homo sapiens
acacagtgaaaggcctgc

SEQ ID NO: 5131633 - DNA, 16 bp, Homo sapiens
acacagtgacacgttt

SEQ ID NO: 5131634 - DNA, 15 bp, Homo sapiens
acacagtgacttcct

SEQ ID NO: 5131635 - DNA, 16 bp, Homo sapiens
acacagtgagactgta

SEQ ID NO: 5131636 - DNA, 22 bp, Homo sapiens
acacagtgagagtactcacttt

SEQ ID NO: 5131637 - DNA, 19 bp, Homo sapiens
acacagtgatgaatgtact

SEQ ID NO: 5131638 - DNA, 19 bp, Homo sapiens
acacagtgccttcaataaa

SEQ ID NO: 5131639 - DNA, 22 bp, Homo sapiens
acacagtgctgaccagacagcc

SEQ ID NO: 5131640 - DNA, 23 bp, Homo sapiens
acacagtggccggggctgaagcc

SEQ ID NO: 5131641 - DNA, 22 bp, Homo sapiens
acacagtgggaactctgacaag

SEQ ID NO: 5131642 - DNA, 20 bp, Homo sapiens
acacagtgggccggccccag

SEQ ID NO: 5131643 - DNA, 21 bp, Homo sapiens
acacagtgggccggccccagg

SEQ ID NO: 5131644 - DNA, 20 bp, Homo sapiens
acacagtgggtggtggatct

SEQ ID NO: 5131645 - DNA, 10 bp, Homo sapiens
acacagtgtt

SEQ ID NO: 5131646 - DNA, 22 bp, Homo sapiens
acacagtgttagtgctggtcag

SEQ ID NO: 5131647 - DNA, 23 bp, Homo sapiens
acacagtgttccagctgcctggg

SEQ ID NO: 5131648 - DNA, 15 bp, Homo sapiens
acacagtgtttcaat

SEQ ID NO: 5131649 - DNA, 23 bp, Homo sapiens
acacagttaaataaatagaaaga

SEQ ID NO: 5131650 - DNA, 22 bp, Homo sapiens
acacagttgaattttttctaaa

SEQ ID NO: 5131651 - DNA, 21 bp, Homo sapiens
acacagttgaccctatttttt

SEQ ID NO: 5131652 - DNA, 22 bp, Homo sapiens
acacagttgttgaatgactgac

SEQ ID NO: 5131653 - DNA, 16 bp, Homo sapiens
acacagtttaaaaaat

SEQ ID NO: 5131654 - DNA, 17 bp, Homo sapiens
acacataaatgaaagaa

SEQ ID NO: 5131655 - DNA, 14 bp, Homo sapiens
acacataaattatg

SEQ ID NO: 5131656 - DNA, 15 bp, Homo sapiens
acacataaattatga

SEQ ID NO: 5131657 - DNA, 16 bp, Homo sapiens
acacataacacacatc

SEQ ID NO: 5131658 - DNA, 16 bp, Homo sapiens
acacataactagaaac

SEQ ID NO: 5131659 - DNA, 13 bp, Homo sapiens
acacataagaaaa

SEQ ID NO: 5131660 - DNA, 19 bp, Homo sapiens
acacataagccaaaactga

SEQ ID NO: 5131661 - DNA, 15 bp, Homo sapiens
acacataattaaagt

SEQ ID NO: 5131662 - DNA, 18 bp, Homo sapiens
acacataattaaagtgtc

SEQ ID NO: 5131663 - DNA, 20 bp, Homo sapiens
acacataattaaagtgtcca

SEQ ID NO: 5131664 - DNA, 21 bp, Homo sapiens
acacataattaaagtgtccat

SEQ ID NO: 5131665 - DNA, 16 bp, Homo sapiens
acacataatttctgtt

SEQ ID NO: 5131666 - DNA, 13 bp, Homo sapiens
acacataatttga

SEQ ID NO: 5131667 - DNA, 14 bp, Homo sapiens
acacatacaaaaaa

SEQ ID NO: 5131668 - DNA, 21 bp, Homo sapiens
acacatacaaaaaaaatcttt

SEQ ID NO: 5131669 - DNA, 13 bp, Homo sapiens
acacatacacaca

SEQ ID NO: 5131670 - DNA, 14 bp, Homo sapiens
acacatacacacac

SEQ ID NO: 5131671 - DNA, 22 bp, Homo sapiens
acacatacacactcatacgtgt

SEQ ID NO: 5131672 - DNA, 20 bp, Homo sapiens
acacatacacggtattccca

SEQ ID NO: 5131673 - DNA, 13 bp, Homo sapiens
acacatacagttt

SEQ ID NO: 5131674 - DNA, 18 bp, Homo sapiens
acacatacatacacatac

SEQ ID NO: 5131675 - DNA, 14 bp, Homo sapiens
acacatacatacat

SEQ ID NO: 5131676 - DNA, 21 bp, Homo sapiens
acacatacatatatacatttt

SEQ ID NO: 5131677 - DNA, 19 bp, Homo sapiens
acacatactcatttttcat

SEQ ID NO: 5131678 - DNA, 18 bp, Homo sapiens
acacatagattaatggca

SEQ ID NO: 5131679 - DNA, 21 bp, Homo sapiens
acacatagattaatggcactg

SEQ ID NO: 5131680 - DNA, 22 bp, Homo sapiens
acacatagattcacctgtaaaa

SEQ ID NO: 5131681 - DNA, 22 bp, Homo sapiens
acacatagcaggggcaccttcc

SEQ ID NO: 5131682 - DNA, 19 bp, Homo sapiens
acacatagttaaaaaagaa

SEQ ID NO: 5131683 - DNA, 14 bp, Homo sapiens
acacatataaaaac

SEQ ID NO: 5131684 - DNA, 16 bp, Homo sapiens
acacatataaaaacaa

SEQ ID NO: 5131685 - DNA, 16 bp, Homo sapiens
acacatatacatatat

SEQ ID NO: 5131686 - DNA, 19 bp, Homo sapiens
acacatatacatatgagaa

SEQ ID NO: 5131687 - DNA, 21 bp, Homo sapiens
acacatatacattatttctgt

SEQ ID NO: 5131688 - DNA, 23 bp, Homo sapiens
acacatatacctataatgtgtgt

SEQ ID NO: 5131689 - DNA, 12 bp, Homo sapiens
acacatatatac

SEQ ID NO: 5131690 - DNA, 23 bp, Homo sapiens
acacatatatataacaaataata

SEQ ID NO: 5131691 - DNA, 16 bp, Homo sapiens
acacatatatctgatg

SEQ ID NO: 5131692 - DNA, 17 bp, Homo sapiens
acacatatgaacgcaca

SEQ ID NO: 5131693 - DNA, 13 bp, Homo sapiens
acacatatgaggg

SEQ ID NO: 5131694 - DNA, 14 bp, Homo sapiens
acacatatgtgctt

SEQ ID NO: 5131695 - DNA, 16 bp, Homo sapiens
acacatattcaaattc

SEQ ID NO: 5131696 - DNA, 15 bp, Homo sapiens
acacatcaaatgccc

SEQ ID NO: 5131697 - DNA, 15 bp, Homo sapiens
acacatcacagatga

SEQ ID NO: 5131698 - DNA, 18 bp, Homo sapiens
acacatcacccttaccat

SEQ ID NO: 5131699 - DNA, 12 bp, Homo sapiens
acacatcagcat

SEQ ID NO: 5131700 - DNA, 22 bp, Homo sapiens
acacatcagcatgttttctgct

SEQ ID NO: 5131701 - DNA, 20 bp, Homo sapiens
acacatcagccatcaactaa

SEQ ID NO: 5131702 - DNA, 22 bp, Homo sapiens
acacatcagcttgccctgttaa

SEQ ID NO: 5131703 - DNA, 12 bp, Homo sapiens
acacatcagtca

SEQ ID NO: 5131704 - DNA, 14 bp, Homo sapiens
acacatcatctgta

SEQ ID NO: 5131705 - DNA, 14 bp, Homo sapiens
acacatccacccca

SEQ ID NO: 5131706 - DNA, 20 bp, Homo sapiens
acacatccagctgcccctcc

SEQ ID NO: 5131707 - DNA, 15 bp, Homo sapiens
acacatcccagccca

SEQ ID NO: 5131708 - DNA, 20 bp, Homo sapiens
acacatccccagccagaagt

SEQ ID NO: 5131709 - DNA, 17 bp, Homo sapiens
acacatcccggcctctt

SEQ ID NO: 5131710 - DNA, 19 bp, Homo sapiens
acacatccctaatgtgtgc

SEQ ID NO: 5131711 - DNA, 20 bp, Homo sapiens
acacatccctaatgtgtgcc

SEQ ID NO: 5131712 - DNA, 16 bp, Homo sapiens
acacatccgccttttg

SEQ ID NO: 5131713 - DNA, 15 bp, Homo sapiens
acacatcctgtcagt

SEQ ID NO: 5131714 - DNA, 19 bp, Homo sapiens
acacatcctgtcagtgtca

SEQ ID NO: 5131715 - DNA, 20 bp, Homo sapiens
acacatctattgcagagact

SEQ ID NO: 5131716 - DNA, 20 bp, Homo sapiens
acacatctgggtgccctgaa

SEQ ID NO: 5131717 - DNA, 17 bp, Homo sapiens
acacatctgtggagatg

SEQ ID NO: 5131718 - DNA, 20 bp, Homo sapiens
acacatcttacctctcatgc

SEQ ID NO: 5131719 - DNA, 15 bp, Homo sapiens
acacatcttccctag

SEQ ID NO: 5131720 - DNA, 22 bp, Homo sapiens
acacatgaaccatccttcccat

SEQ ID NO: 5131721 - DNA, 22 bp, Homo sapiens
acacatgacgccagataaaatg

SEQ ID NO: 5131722 - DNA, 18 bp, Homo sapiens
acacatgatcctgcaatt

SEQ ID NO: 5131723 - DNA, 12 bp, Homo sapiens
acacatgcacac

SEQ ID NO: 5131724 - DNA, 13 bp, Homo sapiens
acacatgcacaca

SEQ ID NO: 5131725 - DNA, 20 bp, Homo sapiens
acacatgcatcatcagccta

SEQ ID NO: 5131726 - DNA, 21 bp, Homo sapiens
acacatgccaacacttaatca

SEQ ID NO: 5131727 - DNA, 15 bp, Homo sapiens
acacatgcccctccc

SEQ ID NO: 5131728 - DNA, 14 bp, Homo sapiens
acacatgccctcct

SEQ ID NO: 5131729 - DNA, 16 bp, Homo sapiens
acacatgccctcctgg

SEQ ID NO: 5131730 - DNA, 19 bp, Homo sapiens
acacatgctctcaatatat

SEQ ID NO: 5131731 - DNA, 16 bp, Homo sapiens
acacatgctgaggttt

SEQ ID NO: 5131732 - DNA, 21 bp, Homo sapiens
acacatgctgttggcctcaag

SEQ ID NO: 5131733 - DNA, 21 bp, Homo sapiens
acacatgcttccctttcctga

SEQ ID NO: 5131734 - DNA, 21 bp, Homo sapiens
acacatggacacagacccaca

SEQ ID NO: 5131735 - DNA, 21 bp, Homo sapiens
acacatggagtgcttctggaa

SEQ ID NO: 5131736 - DNA, 21 bp, Homo sapiens
acacatggattttggcagggc

SEQ ID NO: 5131737 - DNA, 22 bp, Homo sapiens
acacatggattttggcagggcg

SEQ ID NO: 5131738 - DNA, 13 bp, Homo sapiens
acacatgggtgct

SEQ ID NO: 5131739 - DNA, 17 bp, Homo sapiens
acacatggtgagcctag

SEQ ID NO: 5131740 - DNA, 18 bp, Homo sapiens
acacatgtaaaatatgta

SEQ ID NO: 5131741 - DNA, 15 bp, Homo sapiens
acagactccatctct

SEQ ID NO: 5131742 - DNA, 18 bp, Homo sapiens
acagactccatctcttct

SEQ ID NO: 5131743 - DNA, 19 bp, Homo sapiens
acagactccctcccctgcc

SEQ ID NO: 5131744 - DNA, 12 bp, Homo sapiens
acagactctgat

SEQ ID NO: 5131745 - DNA, 20 bp, Homo sapiens
acagactcttacgtggagag

SEQ ID NO: 5131746 - DNA, 20 bp, Homo sapiens
acagactcttccaccagagc

SEQ ID NO: 5131747 - DNA, 23 bp, Homo sapiens
acagactcttccaccagagcagg

SEQ ID NO: 5131748 - DNA, 13 bp, Homo sapiens
acagactgaaagg

SEQ ID NO: 5131749 - DNA, 19 bp, Homo sapiens
acagactgaccttgatgag

SEQ ID NO: 5131750 - DNA, 23 bp, Homo sapiens
acagactgcaagaggctcctgtc

SEQ ID NO: 5131751 - DNA, 13 bp, Homo sapiens
acagactgcagac

SEQ ID NO: 5131752 - DNA, 15 bp, Homo sapiens
acagactgccccagc

SEQ ID NO: 5131753 - DNA, 22 bp, Homo sapiens
acagactggaagcacagcttca

SEQ ID NO: 5131754 - DNA, 22 bp, Homo sapiens
acagactggagaaaacccctcc

SEQ ID NO: 5131755 - DNA, 18 bp, Homo sapiens
acagactggagacaatgc

SEQ ID NO: 5131756 - DNA, 20 bp, Homo sapiens
acagactggatgtaccacca

SEQ ID NO: 5131757 - DNA, 18 bp, Homo sapiens
acagactggcaataaact

SEQ ID NO: 5131758 - DNA, 19 bp, Homo sapiens
acagactggcaataaactc

SEQ ID NO: 5131759 - DNA, 20 bp, Homo sapiens
acagactggcctgaggagca

SEQ ID NO: 5131760 - DNA, 19 bp, Homo sapiens
acagactgttccctccaag

SEQ ID NO: 5131761 - DNA, 20 bp, Homo sapiens
acagactgttccctccaagg

SEQ ID NO: 5131762 - DNA, 21 bp, Homo sapiens
acagactgttttactgtttta

SEQ ID NO: 5131763 - DNA, 17 bp, Homo sapiens
acagacttcacacagca

SEQ ID NO: 5131764 - DNA, 15 bp, Homo sapiens
acagacttctccaga

SEQ ID NO: 5131765 - DNA, 17 bp, Homo sapiens
acagacttctccagacc

SEQ ID NO: 5131766 - DNA, 18 bp, Homo sapiens
acagacttctggaaggct

SEQ ID NO: 5131767 - DNA, 15 bp, Homo sapiens
acagacttgagaact

SEQ ID NO: 5131768 - DNA, 16 bp, Homo sapiens
acagacttgagaactt

SEQ ID NO: 5131769 - DNA, 12 bp, Homo sapiens
acagactttctg

SEQ ID NO: 5131770 - DNA, 22 bp, Homo sapiens
acagactttggacagtggcctc

SEQ ID NO: 5131771 - DNA, 16 bp, Homo sapiens
acagagaaaagtcagg

SEQ ID NO: 5131772 - DNA, 21 bp, Homo sapiens
acagagaaaagtcaggtgcag

SEQ ID NO: 5131773 - DNA, 16 bp, Homo sapiens
acagagaaaatgaatt

SEQ ID NO: 5131774 - DNA, 17 bp, Homo sapiens
acagagaaaatgaattt

SEQ ID NO: 5131775 - DNA, 17 bp, Homo sapiens
acagagaaaccagcttc

SEQ ID NO: 5131776 - DNA, 18 bp, Homo sapiens
acagagaaaccagcttcc

SEQ ID NO: 5131777 - DNA, 19 bp, Homo sapiens
acagagaaagaaaaggcaa

SEQ ID NO: 5131778 - DNA, 11 bp, Homo sapiens
acagagaaagt

SEQ ID NO: 5131779 - DNA, 12 bp, Homo sapiens
acagagaaccaa

SEQ ID NO: 5131780 - DNA, 18 bp, Homo sapiens
acagagaactaacactat

SEQ ID NO: 5131781 - DNA, 10 bp, Homo sapiens
acagagaagc

SEQ ID NO: 5131782 - DNA, 11 bp, Homo sapiens
acagagaagcc

SEQ ID NO: 5131783 - DNA, 14 bp, Homo sapiens
acagagaagccagc

SEQ ID NO: 5131784 - DNA, 18 bp, Homo sapiens
acagagaagccagcttgt

SEQ ID NO: 5131785 - DNA, 13 bp, Homo sapiens
acagagaagccat

SEQ ID NO: 5131786 - DNA, 14 bp, Homo sapiens
acagagaagccatc

SEQ ID NO: 5131787 - DNA, 20 bp, Homo sapiens
acagagaagccttcaagctc

SEQ ID NO: 5131788 - DNA, 13 bp, Homo sapiens
acagagaagctcc

SEQ ID NO: 5131789 - DNA, 14 bp, Homo sapiens
acagagaagctcct

SEQ ID NO: 5131790 - DNA, 14 bp, Homo sapiens
acagagaagctggg

SEQ ID NO: 5131791 - DNA, 12 bp, Homo sapiens
acagagaaggaa

SEQ ID NO: 5131792 - DNA, 13 bp, Homo sapiens
acagagaaggaat

SEQ ID NO: 5131793 - DNA, 15 bp, Homo sapiens
acagagaaggaatgt

SEQ ID NO: 5131794 - DNA, 16 bp, Homo sapiens
acagagaaggcagcag

SEQ ID NO: 5131795 - DNA, 15 bp, Homo sapiens
acagagaaggcagga

SEQ ID NO: 5131796 - DNA, 12 bp, Homo sapiens
acagagaagtca

SEQ ID NO: 5131797 - DNA, 13 bp, Homo sapiens
acagagaagtcac

SEQ ID NO: 5131798 - DNA, 16 bp, Homo sapiens
acagagaagtcacagg

SEQ ID NO: 5131799 - DNA, 18 bp, Homo sapiens
acagagaagtcacagggc

SEQ ID NO: 5131800 - DNA, 19 bp, Homo sapiens
acagagaatctgaagctat

SEQ ID NO: 5131801 - DNA, 19 bp, Homo sapiens
acagagaatttctaaagta

SEQ ID NO: 5131802 - DNA, 17 bp, Homo sapiens
acagagacacctgcacc

SEQ ID NO: 5131803 - DNA, 16 bp, Homo sapiens
acagagacattcctcc

SEQ ID NO: 5131804 - DNA, 22 bp, Homo sapiens
acagagacccagatctcatgga

SEQ ID NO: 5131805 - DNA, 21 bp, Homo sapiens
acagagacccccgtgccaaat

SEQ ID NO: 5131806 - DNA, 19 bp, Homo sapiens
acagagacctccctgttca

SEQ ID NO: 5131807 - DNA, 11 bp, Homo sapiens
acagagactca

SEQ ID NO: 5131808 - DNA, 21 bp, Homo sapiens
acagagactcagatgaggaca

SEQ ID NO: 5131809 - DNA, 20 bp, Homo sapiens
acagagactcagcgctcctc

SEQ ID NO: 5131810 - DNA, 22 bp, Homo sapiens
acagagactcagcgctcctcct

SEQ ID NO: 5131811 - DNA, 15 bp, Homo sapiens
acagagactctccct

SEQ ID NO: 5131812 - DNA, 20 bp, Homo sapiens
acagagactgaatagatatg

SEQ ID NO: 5131813 - DNA, 22 bp, Homo sapiens
acagagactggaggcatttctt

SEQ ID NO: 5131814 - DNA, 14 bp, Homo sapiens
acagagagaaaaag

SEQ ID NO: 5131815 - DNA, 11 bp, Homo sapiens
acagagagaac

SEQ ID NO: 5131816 - DNA, 14 bp, Homo sapiens
acagagagagactg

SEQ ID NO: 5131817 - DNA, 15 bp, Homo sapiens
acagagagagactga

SEQ ID NO: 5131818 - DNA, 20 bp, Homo sapiens
acagagagagattccatctc

SEQ ID NO: 5131819 - DNA, 13 bp, Homo sapiens
acagagaggacca

SEQ ID NO: 5131820 - DNA, 20 bp, Homo sapiens
acagagaggagaaacacatc

SEQ ID NO: 5131821 - DNA, 18 bp, Homo sapiens
acagagaggatacattta

SEQ ID NO: 5131822 - DNA, 20 bp, Homo sapiens
acagagagggacacatgccc

SEQ ID NO: 5131823 - DNA, 21 bp, Homo sapiens
acagagagggacacatgcccc

SEQ ID NO: 5131824 - DNA, 14 bp, Homo sapiens
acagagaggggcag

SEQ ID NO: 5131825 - DNA, 18 bp, Homo sapiens
acagagagttctggtgag

SEQ ID NO: 5131826 - DNA, 16 bp, Homo sapiens
acagagatatgcacac

SEQ ID NO: 5131827 - DNA, 13 bp, Homo sapiens
acagagatgtctc

SEQ ID NO: 5131828 - DNA, 14 bp, Homo sapiens
acagagcacactta

SEQ ID NO: 5131829 - DNA, 21 bp, Homo sapiens
acagagcacacttatttatga

SEQ ID NO: 5131830 - DNA, 22 bp, Homo sapiens
acagagcacacttatttatgaa

SEQ ID NO: 5131831 - DNA, 15 bp, Homo sapiens
acagagcacgcctgc

SEQ ID NO: 5131832 - DNA, 15 bp, Homo sapiens
acagagcagctcccc

SEQ ID NO: 5131833 - DNA, 17 bp, Homo sapiens
acagagcagctccccag

SEQ ID NO: 5131834 - DNA, 24 bp, Homo sapiens
acagagcagctccccaggagctca

SEQ ID NO: 5131835 - DNA, 14 bp, Homo sapiens
acagagcaggactg

SEQ ID NO: 5131836 - DNA, 16 bp, Homo sapiens
acagagcaggctttgt

SEQ ID NO: 5131837 - DNA, 21 bp, Homo sapiens
acagagcaggctttgtgagag

SEQ ID NO: 5131838 - DNA, 19 bp, Homo sapiens
acagagcaggtctgcaggc

SEQ ID NO: 5131839 - DNA, 16 bp, Homo sapiens
acagagcagttgagag

SEQ ID NO: 5131840 - DNA, 17 bp, Homo sapiens
acagagcatacaacaga

SEQ ID NO: 5131841 - DNA, 13 bp, Homo sapiens
acagagcatcaaa

SEQ ID NO: 5131842 - DNA, 12 bp, Homo sapiens
acagagccaccc

SEQ ID NO: 5131843 - DNA, 21 bp, Homo sapiens
acagagccaccccatgagctc

SEQ ID NO: 5131844 - DNA, 15 bp, Homo sapiens
acagagccactcttc

SEQ ID NO: 5131845 - DNA, 13 bp, Homo sapiens
acagagccagagg

SEQ ID NO: 5131846 - DNA, 13 bp, Homo sapiens
acagagccaggag

SEQ ID NO: 5131847 - DNA, 11 bp, Homo sapiens
acagagccagt

SEQ ID NO: 5131848 - DNA, 15 bp, Homo sapiens
acagagcccacgccc

SEQ ID NO: 5131849 - DNA, 16 bp, Homo sapiens
acagagcccccaagcc

SEQ ID NO: 5131850 - DNA, 19 bp, Homo sapiens
acagagcccccaagcctct

SEQ ID NO: 5131851 - DNA, 13 bp, Homo sapiens
acagagcccccct

SEQ ID NO: 5131852 - DNA, 23 bp, Homo sapiens
acagagccctgaggggctgggct

SEQ ID NO: 5131853 - DNA, 18 bp, Homo sapiens
acagagccgagcaatatt

SEQ ID NO: 5131854 - DNA, 13 bp, Homo sapiens
acagagcctgcct

SEQ ID NO: 5131855 - DNA, 14 bp, Homo sapiens
acagagcctgccta

SEQ ID NO: 5131856 - DNA, 15 bp, Homo sapiens
acagagcctgcctca

SEQ ID NO: 5131857 - DNA, 21 bp, Homo sapiens
acagagcctgttttaaaaaat

SEQ ID NO: 5131858 - DNA, 22 bp, Homo sapiens
acagagccttgagagacccagc

SEQ ID NO: 5131859 - DNA, 17 bp, Homo sapiens
acagagcgagactccat

SEQ ID NO: 5131860 - DNA, 20 bp, Homo sapiens
acagagcgagactctgtctc

SEQ ID NO: 5131861 - DNA, 16 bp, Homo sapiens
acagagcgcccctccc

SEQ ID NO: 5131862 - DNA, 19 bp, Homo sapiens
acagagcgcctcacctgca

SEQ ID NO: 5131863 - DNA, 22 bp, Homo sapiens
acagagcgcctcacctgcatcc

SEQ ID NO: 5131864 - DNA, 22 bp, Homo sapiens
acagagcgggcctcttccctca

SEQ ID NO: 5131865 - DNA, 23 bp, Homo sapiens
acagagcgtgagctgagcaggcc

SEQ ID NO: 5131866 - DNA, 22 bp, Homo sapiens
acagagcgtggctgtgctctca

SEQ ID NO: 5131867 - DNA, 14 bp, Homo sapiens
acagagctaaggcc

SEQ ID NO: 5131868 - DNA, 16 bp, Homo sapiens
acagagctacacaggg

SEQ ID NO: 5131869 - DNA, 15 bp, Homo sapiens
acagagctactgaga

SEQ ID NO: 5131870 - DNA, 16 bp, Homo sapiens
acagagctactgagac

SEQ ID NO: 5131871 - DNA, 15 bp, Homo sapiens
acagagctagaggcc

SEQ ID NO: 5131872 - DNA, 16 bp, Homo sapiens
acagagctagaggcca

SEQ ID NO: 5131873 - DNA, 15 bp, Homo sapiens
acagagctctccagc

SEQ ID NO: 5131874 - DNA, 13 bp, Homo sapiens
acagagctctggg

SEQ ID NO: 5131875 - DNA, 20 bp, Homo sapiens
acagagctgacaaaattttg

SEQ ID NO: 5131876 - DNA, 13 bp, Homo sapiens
acagagctgagga

SEQ ID NO: 5131877 - DNA, 15 bp, Homo sapiens
acagagctggatgct

SEQ ID NO: 5131878 - DNA, 14 bp, Homo sapiens
acagagctgggatg

SEQ ID NO: 5131879 - DNA, 12 bp, Homo sapiens
acagagctttcc

SEQ ID NO: 5131880 - DNA, 23 bp, Homo sapiens
acagaggaaacaatatttataaa

SEQ ID NO: 5131881 - DNA, 21 bp, Homo sapiens
acagaggaaagggctggctcc

SEQ ID NO: 5131882 - DNA, 17 bp, Homo sapiens
acagaggaagagcaggc

SEQ ID NO: 5131883 - DNA, 23 bp, Homo sapiens
acagaggacagtatttgtgggga

SEQ ID NO: 5131884 - DNA, 19 bp, Homo sapiens
acagaggagaaagtggaaa

SEQ ID NO: 5131885 - DNA, 14 bp, Homo sapiens
acagaggaggcctc

SEQ ID NO: 5131886 - DNA, 15 bp, Homo sapiens
acagaggaggcctca

SEQ ID NO: 5131887 - DNA, 23 bp, Homo sapiens
acagaggatgctgacatcatttg

SEQ ID NO: 5131888 - DNA, 15 bp, Homo sapiens
acagaggcagtagga

SEQ ID NO: 5131889 - DNA, 23 bp, Homo sapiens
acagaggccatgggcctcctgtg

SEQ ID NO: 5131890 - DNA, 15 bp, Homo sapiens
acagaggccccagcc

SEQ ID NO: 5131891 - DNA, 22 bp, Homo sapiens
acagaggccccagcctccctga

SEQ ID NO: 5131892 - DNA, 14 bp, Homo sapiens
acagaggccggggt

SEQ ID NO: 5131893 - DNA, 12 bp, Homo sapiens
acagaggcctgc

SEQ ID NO: 5131894 - DNA, 23 bp, Homo sapiens
acagaggcgaggggacagcccag

SEQ ID NO: 5131895 - DNA, 15 bp, Homo sapiens
acagaggcggggcta

SEQ ID NO: 5131896 - DNA, 21 bp, Homo sapiens
acagaggctgcacccctgggc

SEQ ID NO: 5131897 - DNA, 24 bp, Homo sapiens
acagaggctggcactgagcctgct

SEQ ID NO: 5131898 - DNA, 12 bp, Homo sapiens
acagaggctgtg

SEQ ID NO: 5131899 - DNA, 13 bp, Homo sapiens
acagaggctgtgg

SEQ ID NO: 5131900 - DNA, 20 bp, Homo sapiens
acagaggctgtggtcagaga

SEQ ID NO: 5131901 - DNA, 22 bp, Homo sapiens
acagagggaaaggctgaacata

SEQ ID NO: 5131902 - DNA, 23 bp, Homo sapiens
acagagggacagtgggctatgcc

SEQ ID NO: 5131903 - DNA, 13 bp, Homo sapiens
acagagggagttt

SEQ ID NO: 5131904 - DNA, 14 bp, Homo sapiens
acagagggagttta

SEQ ID NO: 5131905 - DNA, 15 bp, Homo sapiens
acagagggcgctcct

SEQ ID NO: 5131906 - DNA, 20 bp, Homo sapiens
acagagggctagggaggtgg

SEQ ID NO: 5131907 - DNA, 16 bp, Homo sapiens
acagagggctgcattc

SEQ ID NO: 5131908 - DNA, 17 bp, Homo sapiens
acagaggggctgttagg

SEQ ID NO: 5131909 - DNA, 14 bp, Homo sapiens
acagagggggtggc

SEQ ID NO: 5131910 - DNA, 18 bp, Homo sapiens
acagagggggtggcctcc

SEQ ID NO: 5131911 - DNA, 22 bp, Homo sapiens
acagagggggtggcctcccaac

SEQ ID NO: 5131912 - DNA, 19 bp, Homo sapiens
acagagggtcccattgtgc

SEQ ID NO: 5131913 - DNA, 18 bp, Homo sapiens
acagagggtgataaatct

SEQ ID NO: 5131914 - DNA, 18 bp, Homo sapiens
acagaggtaaaaaaaaga

SEQ ID NO: 5131915 - DNA, 23 bp, Homo sapiens
acagaggtaaaaaaaagaagtgt

SEQ ID NO: 5131916 - DNA, 24 bp, Homo sapiens
acagaggtagtctcactgcttgaa

SEQ ID NO: 5131917 - DNA, 19 bp, Homo sapiens
acagaggtattaaaactaa

SEQ ID NO: 5131918 - DNA, 22 bp, Homo sapiens
acagaggtattaaaactaaatt

SEQ ID NO: 5131919 - DNA, 23 bp, Homo sapiens
acagaggtcgtcgaaaggtgcag

SEQ ID NO: 5131920 - DNA, 19 bp, Homo sapiens
acacatgtccaagaagccc

SEQ ID NO: 5131921 - DNA, 18 bp, Homo sapiens
acacatgtgctgatgttt

SEQ ID NO: 5131922 - DNA, 21 bp, Homo sapiens
acacatgtgctgatgtttaca

SEQ ID NO: 5131923 - DNA, 14 bp, Homo sapiens
acacattaatgaat

SEQ ID NO: 5131924 - DNA, 22 bp, Homo sapiens
acacattaatgataaactcaga

SEQ ID NO: 5131925 - DNA, 23 bp, Homo sapiens
acacattaatgataaactcagat

SEQ ID NO: 5131926 - DNA, 22 bp, Homo sapiens
acacattacaaagttaaaattg

SEQ ID NO: 5131927 - DNA, 17 bp, Homo sapiens
acacattacagccaggt

SEQ ID NO: 5131928 - DNA, 23 bp, Homo sapiens
acacattagattttattttacta

SEQ ID NO: 5131929 - DNA, 16 bp, Homo sapiens
acacattataaagttc

SEQ ID NO: 5131930 - DNA, 23 bp, Homo sapiens
acacattatattctcttatgata

SEQ ID NO: 5131931 - DNA, 17 bp, Homo sapiens
acacattatgtatctta

SEQ ID NO: 5131932 - DNA, 16 bp, Homo sapiens
acacattcaataagca

SEQ ID NO: 5131933 - DNA, 20 bp, Homo sapiens
acacattccagggctggggt

SEQ ID NO: 5131934 - DNA, 15 bp, Homo sapiens
acacattcccccacc

SEQ ID NO: 5131935 - DNA, 18 bp, Homo sapiens
acacattcggctccctgg

SEQ ID NO: 5131936 - DNA, 20 bp, Homo sapiens
acacattctcacaattgtaa

SEQ ID NO: 5131937 - DNA, 17 bp, Homo sapiens
acacattctcctgtgcc

SEQ ID NO: 5131938 - DNA, 15 bp, Homo sapiens
acacattctcgttgc

SEQ ID NO: 5131939 - DNA, 14 bp, Homo sapiens
acacattctgcctt

SEQ ID NO: 5131940 - DNA, 18 bp, Homo sapiens
acacattcttaaggcaat

SEQ ID NO: 5131941 - DNA, 16 bp, Homo sapiens
acacattcttgcttgt

SEQ ID NO: 5131942 - DNA, 20 bp, Homo sapiens
acacattctttataaaatgt

SEQ ID NO: 5131943 - DNA, 16 bp, Homo sapiens
acacattgaaactgta

SEQ ID NO: 5131944 - DNA, 17 bp, Homo sapiens
acacattgaaactgtat

SEQ ID NO: 5131945 - DNA, 18 bp, Homo sapiens
acacattgaaactgtatt

SEQ ID NO: 5131946 - DNA, 22 bp, Homo sapiens
acacattgaatgcgctttattg

SEQ ID NO: 5131947 - DNA, 13 bp, Homo sapiens
acacattgacaat

SEQ ID NO: 5131948 - DNA, 22 bp, Homo sapiens
acacattgagttggaatcactg

SEQ ID NO: 5131949 - DNA, 23 bp, Homo sapiens
acacattgcacacacagtctgtt

SEQ ID NO: 5131950 - DNA, 16 bp, Homo sapiens
acacattgctacctca

SEQ ID NO: 5131951 - DNA, 20 bp, Homo sapiens
acacattggaatgccttgga

SEQ ID NO: 5131952 - DNA, 13 bp, Homo sapiens
acacattgttatt

SEQ ID NO: 5131953 - DNA, 22 bp, Homo sapiens
acacattgttattttcagtgat

SEQ ID NO: 5131954 - DNA, 15 bp, Homo sapiens
acacatttaaaaata

SEQ ID NO: 5131955 - DNA, 16 bp, Homo sapiens
acacatttaccaaatt

SEQ ID NO: 5131956 - DNA, 11 bp, Homo sapiens
acacatttcac

SEQ ID NO: 5131957 - DNA, 13 bp, Homo sapiens
acacatttcatct

SEQ ID NO: 5131958 - DNA, 20 bp, Homo sapiens
acacatttcatctaatttaa

SEQ ID NO: 5131959 - DNA, 18 bp, Homo sapiens
acacatttccctatttta

SEQ ID NO: 5131960 - DNA, 14 bp, Homo sapiens
acacatttctaatt

SEQ ID NO: 5131961 - DNA, 13 bp, Homo sapiens
acacatttcttaa

SEQ ID NO: 5131962 - DNA, 22 bp, Homo sapiens
acacatttcttaaaacacatga

SEQ ID NO: 5131963 - DNA, 14 bp, Homo sapiens
acacatttgctttt

SEQ ID NO: 5131964 - DNA, 22 bp, Homo sapiens
acacatttgggatgttcctttt

SEQ ID NO: 5131965 - DNA, 15 bp, Homo sapiens
acacatttgtacaga

SEQ ID NO: 5131966 - DNA, 21 bp, Homo sapiens
acacattttaattttcctcta

SEQ ID NO: 5131967 - DNA, 13 bp, Homo sapiens
acacattttattt

SEQ ID NO: 5131968 - DNA, 15 bp, Homo sapiens
acacattttgtaaat

SEQ ID NO: 5131969 - DNA, 20 bp, Homo sapiens
acacattttgtaaatctgta

SEQ ID NO: 5131970 - DNA, 14 bp, Homo sapiens
acacattttgtata

SEQ ID NO: 5131971 - DNA, 21 bp, Homo sapiens
acacattttgtataattgtat

SEQ ID NO: 5131972 - DNA, 22 bp, Homo sapiens
acacattttttaaatgcacctg

SEQ ID NO: 5131973 - DNA, 15 bp, Homo sapiens
acacattttttagga

SEQ ID NO: 5131974 - DNA, 19 bp, Homo sapiens
acacattttttaggaaatg

SEQ ID NO: 5131975 - DNA, 15 bp, Homo sapiens
acaccaaaaattgcg

SEQ ID NO: 5131976 - DNA, 13 bp, Homo sapiens
acaccaaacattt

SEQ ID NO: 5131977 - DNA, 15 bp, Homo sapiens
acaccaaagttctaa

SEQ ID NO: 5131978 - DNA, 17 bp, Homo sapiens
acaccaaatattttcaa

SEQ ID NO: 5131979 - DNA, 12 bp, Homo sapiens
acaccaaatgac

SEQ ID NO: 5131980 - DNA, 13 bp, Homo sapiens
acaccaaatgact

SEQ ID NO: 5131981 - DNA, 16 bp, Homo sapiens
acaccaaattgctgag

SEQ ID NO: 5131982 - DNA, 17 bp, Homo sapiens
acaccaacactgtaaca

SEQ ID NO: 5131983 - DNA, 15 bp, Homo sapiens
acaccaaccaggcct

SEQ ID NO: 5131984 - DNA, 18 bp, Homo sapiens
acaccaacccctgaccta

SEQ ID NO: 5131985 - DNA, 15 bp, Homo sapiens
acaccaagagtacag

SEQ ID NO: 5131986 - DNA, 20 bp, Homo sapiens
acaccaagagtagcaccttc

SEQ ID NO: 5131987 - DNA, 14 bp, Homo sapiens
acaccaagcacagc

SEQ ID NO: 5131988 - DNA, 16 bp, Homo sapiens
acaccaagcacagcag

SEQ ID NO: 5131989 - DNA, 19 bp, Homo sapiens
acaccaagcacagcagcct

SEQ ID NO: 5131990 - DNA, 16 bp, Homo sapiens
acaccaagcagcaaca

SEQ ID NO: 5131991 - DNA, 15 bp, Homo sapiens
acaccaagctcaccc

SEQ ID NO: 5131992 - DNA, 16 bp, Homo sapiens
acaccaaggccctgca

SEQ ID NO: 5131993 - DNA, 22 bp, Homo sapiens
acaccaagtaaatctatctcta

SEQ ID NO: 5131994 - DNA, 16 bp, Homo sapiens
acaccaataaatgttt

SEQ ID NO: 5131995 - DNA, 18 bp, Homo sapiens
acaccaataaatgtttgt

SEQ ID NO: 5131996 - DNA, 14 bp, Homo sapiens
acaccaatcagaga

SEQ ID NO: 5131997 - DNA, 15 bp, Homo sapiens
acaccaatcagcgct

SEQ ID NO: 5131998 - DNA, 21 bp, Homo sapiens
acaccaatcccagggctggct

SEQ ID NO: 5131999 - DNA, 20 bp, Homo sapiens
acaccaatcttactttgtaa

SEQ ID NO: 5132000 - DNA, 23 bp, Homo sapiens
acaccaatcttactttgtaaatt

SEQ ID NO: 5132001 - DNA, 23 bp, Homo sapiens
acaccaatgccgccgtgtttcct

SEQ ID NO: 5132002 - DNA, 20 bp, Homo sapiens
acaccaatttagaatgaata

SEQ ID NO: 5132003 - DNA, 16 bp, Homo sapiens
acaccacaagtatcta

SEQ ID NO: 5132004 - DNA, 18 bp, Homo sapiens
acaccacaattctcccta

SEQ ID NO: 5132005 - DNA, 20 bp, Homo sapiens
acaccacacacaacagccaa

SEQ ID NO: 5132006 - DNA, 12 bp, Homo sapiens
acaccacagaca

SEQ ID NO: 5132007 - DNA, 15 bp, Homo sapiens
acaccacagacacac

SEQ ID NO: 5132008 - DNA, 16 bp, Homo sapiens
acaccacagacacaca

SEQ ID NO: 5132009 - DNA, 17 bp, Homo sapiens
acaccacagacacacac

SEQ ID NO: 5132010 - DNA, 21 bp, Homo sapiens
acaccacagacacacacacgc

SEQ ID NO: 5132011 - DNA, 22 bp, Homo sapiens
acaccacagacacacacacgca

SEQ ID NO: 5132012 - DNA, 21 bp, Homo sapiens
acaccacagacgccacctggc

SEQ ID NO: 5132013 - DNA, 18 bp, Homo sapiens
acaccacagcctcccctt

SEQ ID NO: 5132014 - DNA, 14 bp, Homo sapiens
acaccaccaacagg

SEQ ID NO: 5132015 - DNA, 17 bp, Homo sapiens
acaccaccactgtgtcc

SEQ ID NO: 5132016 - DNA, 18 bp, Homo sapiens
acaccaccatgctcaact

SEQ ID NO: 5132017 - DNA, 14 bp, Homo sapiens
acaccacccagagc

SEQ ID NO: 5132018 - DNA, 17 bp, Homo sapiens
acaccaccgagctctgt

SEQ ID NO: 5132019 - DNA, 16 bp, Homo sapiens
acaccaccgccctcct

SEQ ID NO: 5132020 - DNA, 17 bp, Homo sapiens
acaccaccgccctcctc

SEQ ID NO: 5132021 - DNA, 17 bp, Homo sapiens
acaccaccggccccctc

SEQ ID NO: 5132022 - DNA, 15 bp, Homo sapiens
acaccacgcccagct

SEQ ID NO: 5132023 - DNA, 16 bp, Homo sapiens
acaccactcctgccag

SEQ ID NO: 5132024 - DNA, 17 bp, Homo sapiens
acaccactcctgccagc

SEQ ID NO: 5132025 - DNA, 17 bp, Homo sapiens
acaccactgaacagaaa

SEQ ID NO: 5132026 - DNA, 18 bp, Homo sapiens
acaccactgaacagaaat

SEQ ID NO: 5132027 - DNA, 19 bp, Homo sapiens
acaccactgcaaaatgtct

SEQ ID NO: 5132028 - DNA, 11 bp, Homo sapiens
acaccactgcc

SEQ ID NO: 5132029 - DNA, 21 bp, Homo sapiens
acaccactgccattacccagt

SEQ ID NO: 5132030 - DNA, 15 bp, Homo sapiens
acaccactgccctgc

SEQ ID NO: 5132031 - DNA, 19 bp, Homo sapiens
acaccactgccctgcctgc

SEQ ID NO: 5132032 - DNA, 21 bp, Homo sapiens
acaccactgccctgcctgccc

SEQ ID NO: 5132033 - DNA, 22 bp, Homo sapiens
acaccactgccctgcctgccca

SEQ ID NO: 5132034 - DNA, 14 bp, Homo sapiens
acaccactgggaac

SEQ ID NO: 5132035 - DNA, 23 bp, Homo sapiens
acaccacttaatcttctctcttg

SEQ ID NO: 5132036 - DNA, 22 bp, Homo sapiens
acaccacttggagatctttgct

SEQ ID NO: 5132037 - DNA, 19 bp, Homo sapiens
acaccactttctgctttcc

SEQ ID NO: 5132038 - DNA, 18 bp, Homo sapiens
acaccactttgtctctga

SEQ ID NO: 5132039 - DNA, 19 bp, Homo sapiens
acaccactttgtctctgag

SEQ ID NO: 5132040 - DNA, 11 bp, Homo sapiens
acaccagaaga

SEQ ID NO: 5132041 - DNA, 14 bp, Homo sapiens
acaccagaagatgt

SEQ ID NO: 5132042 - DNA, 15 bp, Homo sapiens
acaccagaagtgcca

SEQ ID NO: 5132043 - DNA, 16 bp, Homo sapiens
acaccagaagtgccat

SEQ ID NO: 5132044 - DNA, 14 bp, Homo sapiens
acaccagacagaca

SEQ ID NO: 5132045 - DNA, 17 bp, Homo sapiens
acaccagagcagatgca

SEQ ID NO: 5132046 - DNA, 18 bp, Homo sapiens
acaccagagcagatgcag

SEQ ID NO: 5132047 - DNA, 18 bp, Homo sapiens
acaccagagcccaccttg

SEQ ID NO: 5132048 - DNA, 19 bp, Homo sapiens
acaccagagtgtatgcata

SEQ ID NO: 5132049 - DNA, 21 bp, Homo sapiens
acaccagatgcttttgtgaga

SEQ ID NO: 5132050 - DNA, 16 bp, Homo sapiens
acaccagcaacattat

SEQ ID NO: 5132051 - DNA, 17 bp, Homo sapiens
acaccagcagcactgga

SEQ ID NO: 5132052 - DNA, 14 bp, Homo sapiens
acaccagccaggct

SEQ ID NO: 5132053 - DNA, 20 bp, Homo sapiens
acaccagccccacttctggg

SEQ ID NO: 5132054 - DNA, 13 bp, Homo sapiens
acaccagcccctg

SEQ ID NO: 5132055 - DNA, 15 bp, Homo sapiens
acaccagcccctgcc

SEQ ID NO: 5132056 - DNA, 19 bp, Homo sapiens
acaccagccctgctgcttc

SEQ ID NO: 5132057 - DNA, 19 bp, Homo sapiens
acaccagcctcgtcttcat

SEQ ID NO: 5132058 - DNA, 12 bp, Homo sapiens
acaccagccttg

SEQ ID NO: 5132059 - DNA, 12 bp, Homo sapiens
acaccagctgct

SEQ ID NO: 5132060 - DNA, 12 bp, Homo sapiens
acaccaggccgt

SEQ ID NO: 5132061 - DNA, 14 bp, Homo sapiens
acaccaggctgtgg

SEQ ID NO: 5132062 - DNA, 18 bp, Homo sapiens
acaccagggccagcctct

SEQ ID NO: 5132063 - DNA, 23 bp, Homo sapiens
acaccagggccagtagagagtgc

SEQ ID NO: 5132064 - DNA, 22 bp, Homo sapiens
acaccagtgtcgtgtctgctgt

SEQ ID NO: 5132065 - DNA, 17 bp, Homo sapiens
acaccagttactgttca

SEQ ID NO: 5132066 - DNA, 19 bp, Homo sapiens
acaccagttactgttcatg

SEQ ID NO: 5132067 - DNA, 20 bp, Homo sapiens
acaccagttactgttcatgg

SEQ ID NO: 5132068 - DNA, 22 bp, Homo sapiens
acaccagttttgagtgtactgt

SEQ ID NO: 5132069 - DNA, 21 bp, Homo sapiens
acaccataagctactgccatc

SEQ ID NO: 5132070 - DNA, 22 bp, Homo sapiens
acaccataagctactgccatcc

SEQ ID NO: 5132071 - DNA, 23 bp, Homo sapiens
acaccataagctactgccatcct

SEQ ID NO: 5132072 - DNA, 14 bp, Homo sapiens
acaccatagtttac

SEQ ID NO: 5132073 - DNA, 19 bp, Homo sapiens
acaccatcaccctctgggc

SEQ ID NO: 5132074 - DNA, 14 bp, Homo sapiens
acaccatcctgagc

SEQ ID NO: 5132075 - DNA, 16 bp, Homo sapiens
acaccatcctgagcca

SEQ ID NO: 5132076 - DNA, 18 bp, Homo sapiens
acaccatcctgagccagg

SEQ ID NO: 5132077 - DNA, 15 bp, Homo sapiens
acaccatctggccca

SEQ ID NO: 5132078 - DNA, 15 bp, Homo sapiens
acaccatcttttatt

SEQ ID NO: 5132079 - DNA, 15 bp, Homo sapiens
acaccatgattcctt

SEQ ID NO: 5132080 - DNA, 18 bp, Homo sapiens
acaccatgattcctttaa

SEQ ID NO: 5132081 - DNA, 20 bp, Homo sapiens
acaccatgattcctttaaca

SEQ ID NO: 5132082 - DNA, 20 bp, Homo sapiens
acaccatgttcccagctcag

SEQ ID NO: 5132083 - DNA, 20 bp, Homo sapiens
acaccattaccaaaataata

SEQ ID NO: 5132084 - DNA, 17 bp, Homo sapiens
acaccattgaaggctta

SEQ ID NO: 5132085 - DNA, 16 bp, Homo sapiens
acaccattgttcctta

SEQ ID NO: 5132086 - DNA, 21 bp, Homo sapiens
acaccatttttccagagctgc

SEQ ID NO: 5132087 - DNA, 13 bp, Homo sapiens
acacccaacactt

SEQ ID NO: 5132088 - DNA, 14 bp, Homo sapiens
acacccaagcacaa

SEQ ID NO: 5132089 - DNA, 15 bp, Homo sapiens
acacccaagtccacc

SEQ ID NO: 5132090 - DNA, 16 bp, Homo sapiens
acacccaagtccaggc

SEQ ID NO: 5132091 - DNA, 16 bp, Homo sapiens
acacccaatgctgctc

SEQ ID NO: 5132092 - DNA, 16 bp, Homo sapiens
acacccacacaggtgg

SEQ ID NO: 5132093 - DNA, 15 bp, Homo sapiens
acacccacactcaga

SEQ ID NO: 5132094 - DNA, 13 bp, Homo sapiens
acacccaccccct

SEQ ID NO: 5132095 - DNA, 14 bp, Homo sapiens
acacccaccccctc

SEQ ID NO: 5132096 - DNA, 18 bp, Homo sapiens
acacccaccccctctgga

SEQ ID NO: 5132097 - DNA, 20 bp, Homo sapiens
acacccaccccctgcctggt

SEQ ID NO: 5132098 - DNA, 12 bp, Homo sapiens
acacccaccctt

SEQ ID NO: 5132099 - DNA, 23 bp, Homo sapiens
acagaggttgtagtgagccaaga

SEQ ID NO: 5132100 - DNA, 18 bp, Homo sapiens
acagaggtttgaaggaga

SEQ ID NO: 5132101 - DNA, 20 bp, Homo sapiens
acagaggtttgaaggagaat

SEQ ID NO: 5132102 - DNA, 13 bp, Homo sapiens
acagagtaagaca

SEQ ID NO: 5132103 - DNA, 16 bp, Homo sapiens
acagagtaagacattg

SEQ ID NO: 5132104 - DNA, 23 bp, Homo sapiens
acagagtacttggctgttagccc

SEQ ID NO: 5132105 - DNA, 14 bp, Homo sapiens
acagagtatatatg

SEQ ID NO: 5132106 - DNA, 17 bp, Homo sapiens
acagagtatatatgtac

SEQ ID NO: 5132107 - DNA, 18 bp, Homo sapiens
acagagtatatatgtaca

SEQ ID NO: 5132108 - DNA, 20 bp, Homo sapiens
acagagtatatatgtacagt

SEQ ID NO: 5132109 - DNA, 15 bp, Homo sapiens
acagagtatatttcc

SEQ ID NO: 5132110 - DNA, 17 bp, Homo sapiens
acagagtcgatgctcaa

SEQ ID NO: 5132111 - DNA, 15 bp, Homo sapiens
acagagtcgctggca

SEQ ID NO: 5132112 - DNA, 20 bp, Homo sapiens
acagagtctgacaggaagac

SEQ ID NO: 5132113 - DNA, 14 bp, Homo sapiens
acagagtcttcctc

SEQ ID NO: 5132114 - DNA, 19 bp, Homo sapiens
acagagtcttcctctgtct

SEQ ID NO: 5132115 - DNA, 21 bp, Homo sapiens
acagagtgaaaaatcttaagt

SEQ ID NO: 5132116 - DNA, 20 bp, Homo sapiens
acagagtgagactccatctc

SEQ ID NO: 5132117 - DNA, 19 bp, Homo sapiens
acagagtgagactctgtct

SEQ ID NO: 5132118 - DNA, 22 bp, Homo sapiens
acagagtgccaacttctttcat

SEQ ID NO: 5132119 - DNA, 21 bp, Homo sapiens
acagagtggaataagacagag

SEQ ID NO: 5132120 - DNA, 16 bp, Homo sapiens
acagagtggactcttc

SEQ ID NO: 5132121 - DNA, 18 bp, Homo sapiens
acagagtggatctggagt

SEQ ID NO: 5132122 - DNA, 21 bp, Homo sapiens
acagagtggcctccctgctgt

SEQ ID NO: 5132123 - DNA, 24 bp, Homo sapiens
acagagtggtctttctggagaggt

SEQ ID NO: 5132124 - DNA, 16 bp, Homo sapiens
acagagtggtttccaa

SEQ ID NO: 5132125 - DNA, 20 bp, Homo sapiens
acagagtgtggtccctccac

SEQ ID NO: 5132126 - DNA, 16 bp, Homo sapiens
acagagttcacaggag

SEQ ID NO: 5132127 - DNA, 21 bp, Homo sapiens
acagagttgttacatttttaa

SEQ ID NO: 5132128 - DNA, 13 bp, Homo sapiens
acagagttttctg

SEQ ID NO: 5132129 - DNA, 16 bp, Homo sapiens
acagataaaatgtaaa

SEQ ID NO: 5132130 - DNA, 22 bp, Homo sapiens
acagataaatccttaacatttc

SEQ ID NO: 5132131 - DNA, 17 bp, Homo sapiens
acagataacataaataa

SEQ ID NO: 5132132 - DNA, 21 bp, Homo sapiens
acagataacctaataattgta

SEQ ID NO: 5132133 - DNA, 14 bp, Homo sapiens
acagataactgaaa

SEQ ID NO: 5132134 - DNA, 18 bp, Homo sapiens
acagataactgctttgca

SEQ ID NO: 5132135 - DNA, 15 bp, Homo sapiens
acagataataatggg

SEQ ID NO: 5132136 - DNA, 17 bp, Homo sapiens
acagataattcatttgt

SEQ ID NO: 5132137 - DNA, 17 bp, Homo sapiens
acagataatttattttg

SEQ ID NO: 5132138 - DNA, 22 bp, Homo sapiens
acagataatttattttgtattt

SEQ ID NO: 5132139 - DNA, 17 bp, Homo sapiens
acagatacatacataga

SEQ ID NO: 5132140 - DNA, 22 bp, Homo sapiens
acagatacctccaaccctgccg

SEQ ID NO: 5132141 - DNA, 20 bp, Homo sapiens
acagatactcctccaaggtt

SEQ ID NO: 5132142 - DNA, 13 bp, Homo sapiens
acagatactgaaa

SEQ ID NO: 5132143 - DNA, 21 bp, Homo sapiens
acagatactggaagttttgca

SEQ ID NO: 5132144 - DNA, 22 bp, Homo sapiens
acagatactggaagttttgcat

SEQ ID NO: 5132145 - DNA, 23 bp, Homo sapiens
acagatactgtgagcttacattg

SEQ ID NO: 5132146 - DNA, 17 bp, Homo sapiens
acagatagacagtgctg

SEQ ID NO: 5132147 - DNA, 21 bp, Homo sapiens
acagatagtatctagcaatca

SEQ ID NO: 5132148 - DNA, 14 bp, Homo sapiens
acagatataaaata

SEQ ID NO: 5132149 - DNA, 16 bp, Homo sapiens
acagatataaaatagg

SEQ ID NO: 5132150 - DNA, 15 bp, Homo sapiens
acagatatacacatg

SEQ ID NO: 5132151 - DNA, 19 bp, Homo sapiens
acagatatactttgtggac

SEQ ID NO: 5132152 - DNA, 19 bp, Homo sapiens
acagatattgttataaata

SEQ ID NO: 5132153 - DNA, 12 bp, Homo sapiens
acagatatttaa

SEQ ID NO: 5132154 - DNA, 15 bp, Homo sapiens
acagatatttaaatt

SEQ ID NO: 5132155 - DNA, 14 bp, Homo sapiens
acagatatttcaaa

SEQ ID NO: 5132156 - DNA, 18 bp, Homo sapiens
acagatatttccatttct

SEQ ID NO: 5132157 - DNA, 14 bp, Homo sapiens
acagatattttatc

SEQ ID NO: 5132158 - DNA, 19 bp, Homo sapiens
acagatattttcgcccacc

SEQ ID NO: 5132159 - DNA, 18 bp, Homo sapiens
acagatatttttctccag

SEQ ID NO: 5132160 - DNA, 15 bp, Homo sapiens
acagatcaagctgtg

SEQ ID NO: 5132161 - DNA, 15 bp, Homo sapiens
acagatcactcctgg

SEQ ID NO: 5132162 - DNA, 17 bp, Homo sapiens
acagatcactcctggag

SEQ ID NO: 5132163 - DNA, 14 bp, Homo sapiens
acagatcagaacat

SEQ ID NO: 5132164 - DNA, 22 bp, Homo sapiens
acagatcaggaattctaaataa

SEQ ID NO: 5132165 - DNA, 20 bp, Homo sapiens
acagatcatagatttctgat

SEQ ID NO: 5132166 - DNA, 22 bp, Homo sapiens
acagatcatcttggaactgcat

SEQ ID NO: 5132167 - DNA, 16 bp, Homo sapiens
acagatcatggcagga

SEQ ID NO: 5132168 - DNA, 18 bp, Homo sapiens
acagatcccactggaaga

SEQ ID NO: 5132169 - DNA, 23 bp, Homo sapiens
acagatcccactggaagatcccc

SEQ ID NO: 5132170 - DNA, 22 bp, Homo sapiens
acagatcccatccatcagctcc

SEQ ID NO: 5132171 - DNA, 18 bp, Homo sapiens
acagatccccaagcctgg

SEQ ID NO: 5132172 - DNA, 14 bp, Homo sapiens
acagatccgcatgt

SEQ ID NO: 5132173 - DNA, 18 bp, Homo sapiens
acagatccgcatgtgtct

SEQ ID NO: 5132174 - DNA, 19 bp, Homo sapiens
acagatccgcatgtgtctg

SEQ ID NO: 5132175 - DNA, 20 bp, Homo sapiens
acagatccgcatgtgtctgt

SEQ ID NO: 5132176 - DNA, 21 bp, Homo sapiens
acagatcctccgcggaggccc

SEQ ID NO: 5132177 - DNA, 22 bp, Homo sapiens
acagatcctccgcggaggcccc

SEQ ID NO: 5132178 - DNA, 17 bp, Homo sapiens
acagatcctttttccat

SEQ ID NO: 5132179 - DNA, 19 bp, Homo sapiens
acagatcctttttccatca

SEQ ID NO: 5132180 - DNA, 20 bp, Homo sapiens
acagatcctttttccatcat

SEQ ID NO: 5132181 - DNA, 16 bp, Homo sapiens
acagatctcaatttta

SEQ ID NO: 5132182 - DNA, 17 bp, Homo sapiens
acagatctcctggcaaa

SEQ ID NO: 5132183 - DNA, 13 bp, Homo sapiens
acagatctcttgt

SEQ ID NO: 5132184 - DNA, 12 bp, Homo sapiens
acagatctggaa

SEQ ID NO: 5132185 - DNA, 16 bp, Homo sapiens
acagatctggaacctc

SEQ ID NO: 5132186 - DNA, 20 bp, Homo sapiens
acagatctggaacctcagcc

SEQ ID NO: 5132187 - DNA, 12 bp, Homo sapiens
acagatcttgag

SEQ ID NO: 5132188 - DNA, 20 bp, Homo sapiens
acagatcttgttctttgctg

SEQ ID NO: 5132189 - DNA, 19 bp, Homo sapiens
acagatcttttttttttcc

SEQ ID NO: 5132190 - DNA, 13 bp, Homo sapiens
acagatgaaaatt

SEQ ID NO: 5132191 - DNA, 19 bp, Homo sapiens
acagatgaaacacaaacaa

SEQ ID NO: 5132192 - DNA, 14 bp, Homo sapiens
acagatgaataaac

SEQ ID NO: 5132193 - DNA, 18 bp, Homo sapiens
acagatgaccataatttt

SEQ ID NO: 5132194 - DNA, 18 bp, Homo sapiens
acagatgacccctgccca

SEQ ID NO: 5132195 - DNA, 13 bp, Homo sapiens
acagatgagaaga

SEQ ID NO: 5132196 - DNA, 17 bp, Homo sapiens
acagatgagaagactag

SEQ ID NO: 5132197 - DNA, 16 bp, Homo sapiens
acagatgagcaggagc

SEQ ID NO: 5132198 - DNA, 18 bp, Homo sapiens
acagatgagcgaaaatgt

SEQ ID NO: 5132199 - DNA, 14 bp, Homo sapiens
acagatgaggcccc

SEQ ID NO: 5132200 - DNA, 13 bp, Homo sapiens
acagatgagtcac

SEQ ID NO: 5132201 - DNA, 18 bp, Homo sapiens
acagatgataaatattta

SEQ ID NO: 5132202 - DNA, 19 bp, Homo sapiens
acagatgataaatatttat

SEQ ID NO: 5132203 - DNA, 23 bp, Homo sapiens
acagatgatagtccaatttttac

SEQ ID NO: 5132204 - DNA, 17 bp, Homo sapiens
acagatgatgtaaaaat

SEQ ID NO: 5132205 - DNA, 16 bp, Homo sapiens
acagatgcaatgtgct

SEQ ID NO: 5132206 - DNA, 20 bp, Homo sapiens
acagatgcaatgtgctactg

SEQ ID NO: 5132207 - DNA, 15 bp, Homo sapiens
acagatgcatataga

SEQ ID NO: 5132208 - DNA, 17 bp, Homo sapiens
acagatgcatatagaca

SEQ ID NO: 5132209 - DNA, 20 bp, Homo sapiens
acagatgccaacttcccaca

SEQ ID NO: 5132210 - DNA, 20 bp, Homo sapiens
acagatgccatatagtgtta

SEQ ID NO: 5132211 - DNA, 13 bp, Homo sapiens
acagatgccccag

SEQ ID NO: 5132212 - DNA, 17 bp, Homo sapiens
acagatgccccagagct

SEQ ID NO: 5132213 - DNA, 18 bp, Homo sapiens
acagatgccccagagctg

SEQ ID NO: 5132214 - DNA, 14 bp, Homo sapiens
acagatgcctactt

SEQ ID NO: 5132215 - DNA, 17 bp, Homo sapiens
acagatgcctacttttg

SEQ ID NO: 5132216 - DNA, 12 bp, Homo sapiens
acagatgcctcc

SEQ ID NO: 5132217 - DNA, 18 bp, Homo sapiens
acagatgcctcctgatgg

SEQ ID NO: 5132218 - DNA, 15 bp, Homo sapiens
acagatgcctggtga

SEQ ID NO: 5132219 - DNA, 22 bp, Homo sapiens
acagatgcgttcagcagactgg

SEQ ID NO: 5132220 - DNA, 16 bp, Homo sapiens
acagatgctaataaac

SEQ ID NO: 5132221 - DNA, 19 bp, Homo sapiens
acagatgctaataaactgt

SEQ ID NO: 5132222 - DNA, 18 bp, Homo sapiens
acagatgctgagccatag

SEQ ID NO: 5132223 - DNA, 21 bp, Homo sapiens
acagatgctggtggaggaagg

SEQ ID NO: 5132224 - DNA, 15 bp, Homo sapiens
acagatgctgtgtaa

SEQ ID NO: 5132225 - DNA, 19 bp, Homo sapiens
acagatggaagaagtttta

SEQ ID NO: 5132226 - DNA, 18 bp, Homo sapiens
acagatggacactgccaa

SEQ ID NO: 5132227 - DNA, 11 bp, Homo sapiens
acagatggacc

SEQ ID NO: 5132228 - DNA, 20 bp, Homo sapiens
acagatggacgcaggccctg

SEQ ID NO: 5132229 - DNA, 22 bp, Homo sapiens
acagatggacgcaggccctgtc

SEQ ID NO: 5132230 - DNA, 20 bp, Homo sapiens
acagatggagcaaatgtcct

SEQ ID NO: 5132231 - DNA, 16 bp, Homo sapiens
acagatggatttgcct

SEQ ID NO: 5132232 - DNA, 14 bp, Homo sapiens
acagatggcacctg

SEQ ID NO: 5132233 - DNA, 19 bp, Homo sapiens
acagatggcacctgtggcc

SEQ ID NO: 5132234 - DNA, 21 bp, Homo sapiens
acagatggcacctgtggccag

SEQ ID NO: 5132235 - DNA, 14 bp, Homo sapiens
acagatggccagcc

SEQ ID NO: 5132236 - DNA, 16 bp, Homo sapiens
acagatggctgtgaaa

SEQ ID NO: 5132237 - DNA, 18 bp, Homo sapiens
acagatgggtattaaact

SEQ ID NO: 5132238 - DNA, 23 bp, Homo sapiens
acagatgggtattaaacttgtca

SEQ ID NO: 5132239 - DNA, 14 bp, Homo sapiens
acagatgggtgtcc

SEQ ID NO: 5132240 - DNA, 19 bp, Homo sapiens
acagatgggtgtcccctgg

SEQ ID NO: 5132241 - DNA, 20 bp, Homo sapiens
acagatggtgtcctgcatgt

SEQ ID NO: 5132242 - DNA, 22 bp, Homo sapiens
acagatggtgtcctgcatgtat

SEQ ID NO: 5132243 - DNA, 20 bp, Homo sapiens
acagatgtaaatcgggaagg

SEQ ID NO: 5132244 - DNA, 21 bp, Homo sapiens
acagatgtaaatcgggaagga

SEQ ID NO: 5132245 - DNA, 12 bp, Homo sapiens
acagatgtacat

SEQ ID NO: 5132246 - DNA, 13 bp, Homo sapiens
acagatgtacatt

SEQ ID NO: 5132247 - DNA, 16 bp, Homo sapiens
acagatgtctctgggg

SEQ ID NO: 5132248 - DNA, 17 bp, Homo sapiens
acagatgtctctggggc

SEQ ID NO: 5132249 - DNA, 12 bp, Homo sapiens
acagatgtgaaa

SEQ ID NO: 5132250 - DNA, 15 bp, Homo sapiens
acagatgtgaaggac

SEQ ID NO: 5132251 - DNA, 17 bp, Homo sapiens
acagatgtgaaggacat

SEQ ID NO: 5132252 - DNA, 14 bp, Homo sapiens
acagatgtgcccag

SEQ ID NO: 5132253 - DNA, 16 bp, Homo sapiens
acagatgttatttttg

SEQ ID NO: 5132254 - DNA, 19 bp, Homo sapiens
acagatgttatttttgtat

SEQ ID NO: 5132255 - DNA, 22 bp, Homo sapiens
acagatgttatttttgtatttt

SEQ ID NO: 5132256 - DNA, 23 bp, Homo sapiens
acagatgttatttttgtattttt

SEQ ID NO: 5132257 - DNA, 21 bp, Homo sapiens
acagatgttcggtttttttcc

SEQ ID NO: 5132258 - DNA, 24 bp, Homo sapiens
acagatgtttcttttgtatgtaaa

SEQ ID NO: 5132259 - DNA, 20 bp, Homo sapiens
acagatgtttgttttcaaaa

SEQ ID NO: 5132260 - DNA, 18 bp, Homo sapiens
acagatgttttccactga

SEQ ID NO: 5132261 - DNA, 22 bp, Homo sapiens
acagatgtttttaattctagta

SEQ ID NO: 5132262 - DNA, 18 bp, Homo sapiens
acagattaaacttcacct

SEQ ID NO: 5132263 - DNA, 13 bp, Homo sapiens
acagattaatatt

SEQ ID NO: 5132264 - DNA, 21 bp, Homo sapiens
acagattataataaattgtca

SEQ ID NO: 5132265 - DNA, 18 bp, Homo sapiens
acagattatgttcctgct

SEQ ID NO: 5132266 - DNA, 21 bp, Homo sapiens
acagattatgttcctgctgta

SEQ ID NO: 5132267 - DNA, 15 bp, Homo sapiens
acagattcacactgt

SEQ ID NO: 5132268 - DNA, 17 bp, Homo sapiens
acagattcacactgtct

SEQ ID NO: 5132269 - DNA, 19 bp, Homo sapiens
acagattcacactgtctgg

SEQ ID NO: 5132270 - DNA, 23 bp, Homo sapiens
acagattcactttgtttatgcat

SEQ ID NO: 5132271 - DNA, 18 bp, Homo sapiens
acagattcagaatgagaa

SEQ ID NO: 5132272 - DNA, 15 bp, Homo sapiens
acagattcaggccag

SEQ ID NO: 5132273 - DNA, 22 bp, Homo sapiens
acagattcaggccagcccagcc

SEQ ID NO: 5132274 - DNA, 17 bp, Homo sapiens
acagattcccaggccag

SEQ ID NO: 5132275 - DNA, 22 bp, Homo sapiens
acagattcccaggccagggctg

SEQ ID NO: 5132276 - DNA, 15 bp, Homo sapiens
acacccacccttttt

SEQ ID NO: 5132277 - DNA, 22 bp, Homo sapiens
acacccaccgtccgccctgctc

SEQ ID NO: 5132278 - DNA, 18 bp, Homo sapiens
acacccacctgctgctgt

SEQ ID NO: 5132279 - DNA, 19 bp, Homo sapiens
acacccacctgctgctgta

SEQ ID NO: 5132280 - DNA, 15 bp, Homo sapiens
acacccactcagctc

SEQ ID NO: 5132281 - DNA, 22 bp, Homo sapiens
acacccactccacaccagtaat

SEQ ID NO: 5132282 - DNA, 14 bp, Homo sapiens
acacccactgcccc

SEQ ID NO: 5132283 - DNA, 12 bp, Homo sapiens
acacccagaggt

SEQ ID NO: 5132284 - DNA, 13 bp, Homo sapiens
acacccagaggtc

SEQ ID NO: 5132285 - DNA, 13 bp, Homo sapiens
acacccagccagc

SEQ ID NO: 5132286 - DNA, 14 bp, Homo sapiens
acacccagccagct

SEQ ID NO: 5132287 - DNA, 20 bp, Homo sapiens
acacccagccagctcctttc

SEQ ID NO: 5132288 - DNA, 23 bp, Homo sapiens
acacccagccagctcctttccct

SEQ ID NO: 5132289 - DNA, 12 bp, Homo sapiens
acacccagccca

SEQ ID NO: 5132290 - DNA, 19 bp, Homo sapiens
acacccagcccacttctgc

SEQ ID NO: 5132291 - DNA, 21 bp, Homo sapiens
acacccagcccacttctgcca

SEQ ID NO: 5132292 - DNA, 12 bp, Homo sapiens
acacccagcccc

SEQ ID NO: 5132293 - DNA, 11 bp, Homo sapiens
acacccagcct

SEQ ID NO: 5132294 - DNA, 13 bp, Homo sapiens
acacccagcctca

SEQ ID NO: 5132295 - DNA, 14 bp, Homo sapiens
acacccagcctctg

SEQ ID NO: 5132296 - DNA, 14 bp, Homo sapiens
acacccagcctgtc

SEQ ID NO: 5132297 - DNA, 14 bp, Homo sapiens
acacccaggaaggg

SEQ ID NO: 5132298 - DNA, 15 bp, Homo sapiens
acacccagttctgaa

SEQ ID NO: 5132299 - DNA, 21 bp, Homo sapiens
acacccatcgtataaggaaat

SEQ ID NO: 5132300 - DNA, 14 bp, Homo sapiens
acacccatgaaaga

SEQ ID NO: 5132301 - DNA, 14 bp, Homo sapiens
acacccatgccaga

SEQ ID NO: 5132302 - DNA, 17 bp, Homo sapiens
acacccatggcctcagc

SEQ ID NO: 5132303 - DNA, 21 bp, Homo sapiens
acacccatgtaaatgtccaaa

SEQ ID NO: 5132304 - DNA, 13 bp, Homo sapiens
acacccatttaaa

SEQ ID NO: 5132305 - DNA, 19 bp, Homo sapiens
acaccccaacttggcagct

SEQ ID NO: 5132306 - DNA, 16 bp, Homo sapiens
acaccccaagggacaa

SEQ ID NO: 5132307 - DNA, 12 bp, Homo sapiens
acaccccacctg

SEQ ID NO: 5132308 - DNA, 14 bp, Homo sapiens
acaccccacctgcg

SEQ ID NO: 5132309 - DNA, 21 bp, Homo sapiens
acaccccagacgatgtcttca

SEQ ID NO: 5132310 - DNA, 13 bp, Homo sapiens
acaccccagactc

SEQ ID NO: 5132311 - DNA, 16 bp, Homo sapiens
acaccccagactccag

SEQ ID NO: 5132312 - DNA, 12 bp, Homo sapiens
acaccccagccc

SEQ ID NO: 5132313 - DNA, 19 bp, Homo sapiens
acaccccatctctcttccc

SEQ ID NO: 5132314 - DNA, 14 bp, Homo sapiens
acacccccaagaca

SEQ ID NO: 5132315 - DNA, 11 bp, Homo sapiens
acacccccagc

SEQ ID NO: 5132316 - DNA, 22 bp, Homo sapiens
acaccccccagtcgagccctgc

SEQ ID NO: 5132317 - DNA, 20 bp, Homo sapiens
acaccccccgccccccacct

SEQ ID NO: 5132318 - DNA, 19 bp, Homo sapiens
acaccccctttccatctgt

SEQ ID NO: 5132319 - DNA, 17 bp, Homo sapiens
acaccccgacttttgtt

SEQ ID NO: 5132320 - DNA, 17 bp, Homo sapiens
acaccccgctcacgctg

SEQ ID NO: 5132321 - DNA, 18 bp, Homo sapiens
acaccccgctcacgctga

SEQ ID NO: 5132322 - DNA, 17 bp, Homo sapiens
acaccccgtctgcccct

SEQ ID NO: 5132323 - DNA, 18 bp, Homo sapiens
acaccccgtctgcccctt

SEQ ID NO: 5132324 - DNA, 16 bp, Homo sapiens
acacccctcccctgcc

SEQ ID NO: 5132325 - DNA, 23 bp, Homo sapiens
acacccctcccctgccctagagc

SEQ ID NO: 5132326 - DNA, 17 bp, Homo sapiens
acacccctgcacacacc

SEQ ID NO: 5132327 - DNA, 20 bp, Homo sapiens
acacccctgcacacacctgc

SEQ ID NO: 5132328 - DNA, 23 bp, Homo sapiens
acacccctgctctacccatgagc

SEQ ID NO: 5132329 - DNA, 21 bp, Homo sapiens
acacccctgtgctcccctgcc

SEQ ID NO: 5132330 - DNA, 22 bp, Homo sapiens
acacccctgtgctcccctgcca

SEQ ID NO: 5132331 - DNA, 22 bp, Homo sapiens
acaccccttttccagttgctgt

SEQ ID NO: 5132332 - DNA, 17 bp, Homo sapiens
acacccgaagtcctgtc

SEQ ID NO: 5132333 - DNA, 18 bp, Homo sapiens
acacccgaagtcctgtca

SEQ ID NO: 5132334 - DNA, 20 bp, Homo sapiens
acaccctacagcagatccac

SEQ ID NO: 5132335 - DNA, 12 bp, Homo sapiens
acaccctatatc

SEQ ID NO: 5132336 - DNA, 20 bp, Homo sapiens
acaccctcactctgccaggg

SEQ ID NO: 5132337 - DNA, 17 bp, Homo sapiens
acaccctccactctgag

SEQ ID NO: 5132338 - DNA, 16 bp, Homo sapiens
acaccctccagcacag

SEQ ID NO: 5132339 - DNA, 19 bp, Homo sapiens
acaccctcccccgccactc

SEQ ID NO: 5132340 - DNA, 14 bp, Homo sapiens
acaccctctctgtc

SEQ ID NO: 5132341 - DNA, 12 bp, Homo sapiens
acaccctctgcc

SEQ ID NO: 5132342 - DNA, 20 bp, Homo sapiens
acaccctgagcttttgccac

SEQ ID NO: 5132343 - DNA, 23 bp, Homo sapiens
acaccctgcaaggcccacaggag

SEQ ID NO: 5132344 - DNA, 23 bp, Homo sapiens
acaccctgcccctgcaaagacag

SEQ ID NO: 5132345 - DNA, 17 bp, Homo sapiens
acaccctgccctcatgc

SEQ ID NO: 5132346 - DNA, 13 bp, Homo sapiens
acaccctgcctgc

SEQ ID NO: 5132347 - DNA, 14 bp, Homo sapiens
acaccctgcctgct

SEQ ID NO: 5132348 - DNA, 17 bp, Homo sapiens
acaccctgcctgctgtg

SEQ ID NO: 5132349 - DNA, 21 bp, Homo sapiens
acaccctgcctgctgtggagc

SEQ ID NO: 5132350 - DNA, 13 bp, Homo sapiens
acaccctggcctg

SEQ ID NO: 5132351 - DNA, 13 bp, Homo sapiens
acaccctgtactg

SEQ ID NO: 5132352 - DNA, 18 bp, Homo sapiens
acaccctgtgatggggcc

SEQ ID NO: 5132353 - DNA, 13 bp, Homo sapiens
acacccttagaaa

SEQ ID NO: 5132354 - DNA, 15 bp, Homo sapiens
acacccttagaaaat

SEQ ID NO: 5132355 - DNA, 20 bp, Homo sapiens
acacccttcacataccctcc

SEQ ID NO: 5132356 - DNA, 15 bp, Homo sapiens
acacccttccccact

SEQ ID NO: 5132357 - DNA, 17 bp, Homo sapiens
acacccttccccactcc

SEQ ID NO: 5132358 - DNA, 21 bp, Homo sapiens
acacccttctcccactctcct

SEQ ID NO: 5132359 - DNA, 22 bp, Homo sapiens
acacccttctcccactctccta

SEQ ID NO: 5132360 - DNA, 18 bp, Homo sapiens
acaccctttaatgttcta

SEQ ID NO: 5132361 - DNA, 24 bp, Homo sapiens
acaccgagtctctgtataatctat

SEQ ID NO: 5132362 - DNA, 18 bp, Homo sapiens
acaccgcaccgggctggc

SEQ ID NO: 5132363 - DNA, 20 bp, Homo sapiens
acaccgccatcctctgcctc

SEQ ID NO: 5132364 - DNA, 14 bp, Homo sapiens
acaccgcgtcccag

SEQ ID NO: 5132365 - DNA, 18 bp, Homo sapiens
acaccgcgtcccagctcc

SEQ ID NO: 5132366 - DNA, 20 bp, Homo sapiens
acaccgcgtcccagctcccc

SEQ ID NO: 5132367 - DNA, 14 bp, Homo sapiens
acaccgctggtccc

SEQ ID NO: 5132368 - DNA, 17 bp, Homo sapiens
acaccggcactgtgcac

SEQ ID NO: 5132369 - DNA, 19 bp, Homo sapiens
acaccggtaccctcctccc

SEQ ID NO: 5132370 - DNA, 15 bp, Homo sapiens
acaccgtccctctcc

SEQ ID NO: 5132371 - DNA, 16 bp, Homo sapiens
acaccgtgaggccaag

SEQ ID NO: 5132372 - DNA, 16 bp, Homo sapiens
acaccgtggcctgggc

SEQ ID NO: 5132373 - DNA, 14 bp, Homo sapiens
acaccgtggggaag

SEQ ID NO: 5132374 - DNA, 18 bp, Homo sapiens
acaccgttcattcaggca

SEQ ID NO: 5132375 - DNA, 21 bp, Homo sapiens
acacctaaaaccagttttgct

SEQ ID NO: 5132376 - DNA, 15 bp, Homo sapiens
acacctaaccccagg

SEQ ID NO: 5132377 - DNA, 18 bp, Homo sapiens
acacctaagggacatgtt

SEQ ID NO: 5132378 - DNA, 16 bp, Homo sapiens
acacctaagtgactac

SEQ ID NO: 5132379 - DNA, 21 bp, Homo sapiens
acacctactctatcagagaaa

SEQ ID NO: 5132380 - DNA, 21 bp, Homo sapiens
acacctagacaaacaagggag

SEQ ID NO: 5132381 - DNA, 13 bp, Homo sapiens
acacctagattat

SEQ ID NO: 5132382 - DNA, 16 bp, Homo sapiens
acacctagattatagt

SEQ ID NO: 5132383 - DNA, 13 bp, Homo sapiens
acacctagccagc

SEQ ID NO: 5132384 - DNA, 20 bp, Homo sapiens
acacctaggctagggtgggg

SEQ ID NO: 5132385 - DNA, 23 bp, Homo sapiens
acacctaggtcgccagtgaaata

SEQ ID NO: 5132386 - DNA, 17 bp, Homo sapiens
acacctatgtcatttca

SEQ ID NO: 5132387 - DNA, 18 bp, Homo sapiens
acacctcactctgctacc

SEQ ID NO: 5132388 - DNA, 18 bp, Homo sapiens
acacctcactgtcatctg

SEQ ID NO: 5132389 - DNA, 15 bp, Homo sapiens
acacctcacttttga

SEQ ID NO: 5132390 - DNA, 15 bp, Homo sapiens
acacctcagaaattg

SEQ ID NO: 5132391 - DNA, 16 bp, Homo sapiens
acacctcagccccact

SEQ ID NO: 5132392 - DNA, 18 bp, Homo sapiens
acacctcagttcccttgg

SEQ ID NO: 5132393 - DNA, 21 bp, Homo sapiens
acacctcagttcccttggcct

SEQ ID NO: 5132394 - DNA, 22 bp, Homo sapiens
acacctcagttcccttggcctc

SEQ ID NO: 5132395 - DNA, 23 bp, Homo sapiens
acacctcagttcccttggcctca

SEQ ID NO: 5132396 - DNA, 12 bp, Homo sapiens
acacctccaccc

SEQ ID NO: 5132397 - DNA, 13 bp, Homo sapiens
acacctccaccgt

SEQ ID NO: 5132398 - DNA, 19 bp, Homo sapiens
acacctcccaggagacagt

SEQ ID NO: 5132399 - DNA, 14 bp, Homo sapiens
acacctcccagggg

SEQ ID NO: 5132400 - DNA, 18 bp, Homo sapiens
acacctcccaggggactg

SEQ ID NO: 5132401 - DNA, 15 bp, Homo sapiens
acacctccccctacc

SEQ ID NO: 5132402 - DNA, 19 bp, Homo sapiens
acacctccccctacccata

SEQ ID NO: 5132403 - DNA, 19 bp, Homo sapiens
acacctccccctgcgcccc

SEQ ID NO: 5132404 - DNA, 20 bp, Homo sapiens
acacctccccctgcgccccg

SEQ ID NO: 5132405 - DNA, 23 bp, Homo sapiens
acacctccccctgcgccccgcac

SEQ ID NO: 5132406 - DNA, 22 bp, Homo sapiens
acacctccctactcccctgggc

SEQ ID NO: 5132407 - DNA, 16 bp, Homo sapiens
acacctccctgaacca

SEQ ID NO: 5132408 - DNA, 15 bp, Homo sapiens
acacctcccttcatc

SEQ ID NO: 5132409 - DNA, 23 bp, Homo sapiens
acacctccgagaggcagccagac

SEQ ID NO: 5132410 - DNA, 15 bp, Homo sapiens
acacctcctagcaag

SEQ ID NO: 5132411 - DNA, 22 bp, Homo sapiens
acacctcctagcaagacctgtt

SEQ ID NO: 5132412 - DNA, 14 bp, Homo sapiens
acacctcctcccac

SEQ ID NO: 5132413 - DNA, 21 bp, Homo sapiens
acacctcctcccgaaaaatgt

SEQ ID NO: 5132414 - DNA, 14 bp, Homo sapiens
acacctcctcctgc

SEQ ID NO: 5132415 - DNA, 15 bp, Homo sapiens
acacctcctcctgct

SEQ ID NO: 5132416 - DNA, 19 bp, Homo sapiens
acacctcctcctgctgctc

SEQ ID NO: 5132417 - DNA, 23 bp, Homo sapiens
acacctcctcctgctgctcactc

SEQ ID NO: 5132418 - DNA, 11 bp, Homo sapiens
acacctcctct

SEQ ID NO: 5132419 - DNA, 23 bp, Homo sapiens
acacctccttcctcagtcctgga

SEQ ID NO: 5132420 - DNA, 22 bp, Homo sapiens
acacctcgttagggaagagaaa

SEQ ID NO: 5132421 - DNA, 12 bp, Homo sapiens
acacctctgcca

SEQ ID NO: 5132422 - DNA, 14 bp, Homo sapiens
acacctctgccacc

SEQ ID NO: 5132423 - DNA, 12 bp, Homo sapiens
acacctctgccc

SEQ ID NO: 5132424 - DNA, 19 bp, Homo sapiens
acacctctgccccttgggc

SEQ ID NO: 5132425 - DNA, 17 bp, Homo sapiens
acacctctggatccctg

SEQ ID NO: 5132426 - DNA, 16 bp, Homo sapiens
acacctctgggccctg

SEQ ID NO: 5132427 - DNA, 17 bp, Homo sapiens
acacctctgggccctgc

SEQ ID NO: 5132428 - DNA, 17 bp, Homo sapiens
acacctgaatcagctgg

SEQ ID NO: 5132429 - DNA, 15 bp, Homo sapiens
acacctgacaaatgg

SEQ ID NO: 5132430 - DNA, 16 bp, Homo sapiens
acacctgacaacttct

SEQ ID NO: 5132431 - DNA, 11 bp, Homo sapiens
acacctgacac

SEQ ID NO: 5132432 - DNA, 19 bp, Homo sapiens
acacctgagcgctgtggac

SEQ ID NO: 5132433 - DNA, 17 bp, Homo sapiens
acacctgagctgctgca

SEQ ID NO: 5132434 - DNA, 17 bp, Homo sapiens
acacctgatctggccca

SEQ ID NO: 5132435 - DNA, 19 bp, Homo sapiens
acacctgatcttacagaaa

SEQ ID NO: 5132436 - DNA, 17 bp, Homo sapiens
acacctgcaatcccagc

SEQ ID NO: 5132437 - DNA, 20 bp, Homo sapiens
acacctgcaatcccagcacc

SEQ ID NO: 5132438 - DNA, 21 bp, Homo sapiens
acacctgcaatcccagcacct

SEQ ID NO: 5132439 - DNA, 22 bp, Homo sapiens
acacctgcacacccctgcacac

SEQ ID NO: 5132440 - DNA, 16 bp, Homo sapiens
acacctgcacaccgtc

SEQ ID NO: 5132441 - DNA, 15 bp, Homo sapiens
acacctgcacctccc

SEQ ID NO: 5132442 - DNA, 16 bp, Homo sapiens
acacctgcacctcccc

SEQ ID NO: 5132443 - DNA, 19 bp, Homo sapiens
acacctgcacctcccccca

SEQ ID NO: 5132444 - DNA, 13 bp, Homo sapiens
acacctgcagtgc

SEQ ID NO: 5132445 - DNA, 12 bp, Homo sapiens
acacctgcccca

SEQ ID NO: 5132446 - DNA, 13 bp, Homo sapiens
acacctgccccag

SEQ ID NO: 5132447 - DNA, 14 bp, Homo sapiens
acacctgccccagc

SEQ ID NO: 5132448 - DNA, 15 bp, Homo sapiens
acacctgccccagcg

SEQ ID NO: 5132449 - DNA, 16 bp, Homo sapiens
acacctgccccagcgc

SEQ ID NO: 5132450 - DNA, 17 bp, Homo sapiens
acacctgcctctgaact

SEQ ID NO: 5132451 - DNA, 16 bp, Homo sapiens
acacctgcctctgacc

SEQ ID NO: 5132452 - DNA, 12 bp, Homo sapiens
acacctgcctgc

SEQ ID NO: 5132453 - DNA, 18 bp, Homo sapiens
acacctgccttctaccct

SEQ ID NO: 5132454 - DNA, 13 bp, Homo sapiens
acacctggactga

SEQ ID NO: 5132455 - DNA, 17 bp, Homo sapiens
acacctggactgagcca

SEQ ID NO: 5132456 - DNA, 19 bp, Homo sapiens
acagattcctgttgtgtaa

SEQ ID NO: 5132457 - DNA, 15 bp, Homo sapiens
acagattctgacatt

SEQ ID NO: 5132458 - DNA, 12 bp, Homo sapiens
acagattctgat

SEQ ID NO: 5132459 - DNA, 13 bp, Homo sapiens
acagattctgatt

SEQ ID NO: 5132460 - DNA, 13 bp, Homo sapiens
acagattctttat

SEQ ID NO: 5132461 - DNA, 19 bp, Homo sapiens
acagattctttcagttctt

SEQ ID NO: 5132462 - DNA, 12 bp, Homo sapiens
acagattctttt

SEQ ID NO: 5132463 - DNA, 18 bp, Homo sapiens
acagattgaaaagaccta

SEQ ID NO: 5132464 - DNA, 13 bp, Homo sapiens
acagattgaagaa

SEQ ID NO: 5132465 - DNA, 14 bp, Homo sapiens
acagattgaagaat

SEQ ID NO: 5132466 - DNA, 18 bp, Homo sapiens
acagattgaatttgccta

SEQ ID NO: 5132467 - DNA, 13 bp, Homo sapiens
acagattgcctcc

SEQ ID NO: 5132468 - DNA, 15 bp, Homo sapiens
acagattgcctcctt

SEQ ID NO: 5132469 - DNA, 16 bp, Homo sapiens
acagattgcctcctta

SEQ ID NO: 5132470 - DNA, 19 bp, Homo sapiens
acagattgctacacacaca

SEQ ID NO: 5132471 - DNA, 24 bp, Homo sapiens
acagattggagagggctctgtgct

SEQ ID NO: 5132472 - DNA, 23 bp, Homo sapiens
acagattggcaatgggccgtccc

SEQ ID NO: 5132473 - DNA, 19 bp, Homo sapiens
acagattgggcggggcttc

SEQ ID NO: 5132474 - DNA, 13 bp, Homo sapiens
acagattgtttct

SEQ ID NO: 5132475 - DNA, 23 bp, Homo sapiens
acagattgtttctatacaaatat

SEQ ID NO: 5132476 - DNA, 20 bp, Homo sapiens
acagatttattcctttgtta

SEQ ID NO: 5132477 - DNA, 20 bp, Homo sapiens
acagatttcagtaatgtctt

SEQ ID NO: 5132478 - DNA, 15 bp, Homo sapiens
acagatttcatacct

SEQ ID NO: 5132479 - DNA, 16 bp, Homo sapiens
acagatttcatacctc

SEQ ID NO: 5132480 - DNA, 20 bp, Homo sapiens
acagatttccaaaagtacta

SEQ ID NO: 5132481 - DNA, 15 bp, Homo sapiens
acagatttctaagtt

SEQ ID NO: 5132482 - DNA, 21 bp, Homo sapiens
acagatttgaggactgaagct

SEQ ID NO: 5132483 - DNA, 23 bp, Homo sapiens
acagatttgaggactgaagctgg

SEQ ID NO: 5132484 - DNA, 14 bp, Homo sapiens
acagatttgctttt

SEQ ID NO: 5132485 - DNA, 21 bp, Homo sapiens
acagatttgcttttctttgct

SEQ ID NO: 5132486 - DNA, 20 bp, Homo sapiens
acagatttggtgaatttgaa

SEQ ID NO: 5132487 - DNA, 13 bp, Homo sapiens
acagatttgtgaa

SEQ ID NO: 5132488 - DNA, 14 bp, Homo sapiens
acagatttgtgaac

SEQ ID NO: 5132489 - DNA, 21 bp, Homo sapiens
acagatttgtgaactcagcca

SEQ ID NO: 5132490 - DNA, 17 bp, Homo sapiens
acagatttgttcattcc

SEQ ID NO: 5132491 - DNA, 11 bp, Homo sapiens
acagattttat

SEQ ID NO: 5132492 - DNA, 12 bp, Homo sapiens
acagattttatt

SEQ ID NO: 5132493 - DNA, 18 bp, Homo sapiens
acagattttatttatgcg

SEQ ID NO: 5132494 - DNA, 15 bp, Homo sapiens
acagattttcggaac

SEQ ID NO: 5132495 - DNA, 16 bp, Homo sapiens
acagatttttacaaat

SEQ ID NO: 5132496 - DNA, 17 bp, Homo sapiens
acagatttttacaaatg

SEQ ID NO: 5132497 - DNA, 17 bp, Homo sapiens
acagatttttacactaa

SEQ ID NO: 5132498 - DNA, 16 bp, Homo sapiens
acagatttttatctta

SEQ ID NO: 5132499 - DNA, 22 bp, Homo sapiens
acagattttttctttaaataaa

SEQ ID NO: 5132500 - DNA, 14 bp, Homo sapiens
acagcaaaaaggga

SEQ ID NO: 5132501 - DNA, 20 bp, Homo sapiens
acagcaaaaccattgcttca

SEQ ID NO: 5132502 - DNA, 22 bp, Homo sapiens
acagcaaaaccattgcttcact

SEQ ID NO: 5132503 - DNA, 18 bp, Homo sapiens
acagcaaaactccatctc

SEQ ID NO: 5132504 - DNA, 11 bp, Homo sapiens
acagcaaacag

SEQ ID NO: 5132505 - DNA, 23 bp, Homo sapiens
acagcaaaccaagagattgctaa

SEQ ID NO: 5132506 - DNA, 15 bp, Homo sapiens
acagcaaagcagcag

SEQ ID NO: 5132507 - DNA, 13 bp, Homo sapiens
acagcaaagccat

SEQ ID NO: 5132508 - DNA, 19 bp, Homo sapiens
acagcaaataaaacagtga

SEQ ID NO: 5132509 - DNA, 15 bp, Homo sapiens
acagcaaatgagatg

SEQ ID NO: 5132510 - DNA, 16 bp, Homo sapiens
acagcaaatgcaaaaa

SEQ ID NO: 5132511 - DNA, 18 bp, Homo sapiens
acagcaaatttataattt

SEQ ID NO: 5132512 - DNA, 19 bp, Homo sapiens
acagcaaatttataatttt

SEQ ID NO: 5132513 - DNA, 22 bp, Homo sapiens
acagcaaatttataattttaag

SEQ ID NO: 5132514 - DNA, 13 bp, Homo sapiens
acagcaacaacaa

SEQ ID NO: 5132515 - DNA, 17 bp, Homo sapiens
acagcaacaatttatga

SEQ ID NO: 5132516 - DNA, 13 bp, Homo sapiens
acagcaagaaata

SEQ ID NO: 5132517 - DNA, 21 bp, Homo sapiens
acagcaagagtaagcagtgtt

SEQ ID NO: 5132518 - DNA, 20 bp, Homo sapiens
acagcaagatgaattttatc

SEQ ID NO: 5132519 - DNA, 15 bp, Homo sapiens
acagcaagccatcat

SEQ ID NO: 5132520 - DNA, 21 bp, Homo sapiens
acagcaaggaaatgtcctgca

SEQ ID NO: 5132521 - DNA, 22 bp, Homo sapiens
acagcaaggaaatgtcctgcat

SEQ ID NO: 5132522 - DNA, 19 bp, Homo sapiens
acagcaaggaggctggctg

SEQ ID NO: 5132523 - DNA, 22 bp, Homo sapiens
acagcaaggtgtggaggctcct

SEQ ID NO: 5132524 - DNA, 21 bp, Homo sapiens
acagcaagtagataaatattt

SEQ ID NO: 5132525 - DNA, 16 bp, Homo sapiens
acagcaagtgtgaata

SEQ ID NO: 5132526 - DNA, 17 bp, Homo sapiens
acagcaattcctcaggc

SEQ ID NO: 5132527 - DNA, 14 bp, Homo sapiens
acagcaatttctaa

SEQ ID NO: 5132528 - DNA, 17 bp, Homo sapiens
acagcaattttcataat

SEQ ID NO: 5132529 - DNA, 19 bp, Homo sapiens
acagcacaaggtggcagca

SEQ ID NO: 5132530 - DNA, 23 bp, Homo sapiens
acagcacaaggtggcagcaagca

SEQ ID NO: 5132531 - DNA, 19 bp, Homo sapiens
acagcacaatgttattacc

SEQ ID NO: 5132532 - DNA, 12 bp, Homo sapiens
acagcacacagg

SEQ ID NO: 5132533 - DNA, 19 bp, Homo sapiens
acagcacaccagccgctgc

SEQ ID NO: 5132534 - DNA, 15 bp, Homo sapiens
acagcacacctgtgt

SEQ ID NO: 5132535 - DNA, 13 bp, Homo sapiens
acagcacagaatg

SEQ ID NO: 5132536 - DNA, 13 bp, Homo sapiens
acagcacagagaa

SEQ ID NO: 5132537 - DNA, 15 bp, Homo sapiens
acagcacagagaaga

SEQ ID NO: 5132538 - DNA, 20 bp, Homo sapiens
acagcacagctccctgccaa

SEQ ID NO: 5132539 - DNA, 11 bp, Homo sapiens
acagcacaggc

SEQ ID NO: 5132540 - DNA, 16 bp, Homo sapiens
acagcacagggcaggg

SEQ ID NO: 5132541 - DNA, 21 bp, Homo sapiens
acagcacagggcaggggtggt

SEQ ID NO: 5132542 - DNA, 17 bp, Homo sapiens
acagcacatccacccag

SEQ ID NO: 5132543 - DNA, 17 bp, Homo sapiens
acagcacatgctggcca

SEQ ID NO: 5132544 - DNA, 13 bp, Homo sapiens
acagcacatttgt

SEQ ID NO: 5132545 - DNA, 16 bp, Homo sapiens
acagcacatttgttaa

SEQ ID NO: 5132546 - DNA, 18 bp, Homo sapiens
acagcacatttgttaatg

SEQ ID NO: 5132547 - DNA, 13 bp, Homo sapiens
acagcaccaaatc

SEQ ID NO: 5132548 - DNA, 13 bp, Homo sapiens
acagcacccaggc

SEQ ID NO: 5132549 - DNA, 17 bp, Homo sapiens
acagcacccaggctcca

SEQ ID NO: 5132550 - DNA, 18 bp, Homo sapiens
acagcacccaggctccat

SEQ ID NO: 5132551 - DNA, 21 bp, Homo sapiens
acagcacccaggctccatggg

SEQ ID NO: 5132552 - DNA, 17 bp, Homo sapiens
acagcacctcctctctg

SEQ ID NO: 5132553 - DNA, 17 bp, Homo sapiens
acagcacctgagaagag

SEQ ID NO: 5132554 - DNA, 14 bp, Homo sapiens
acagcactactctg

SEQ ID NO: 5132555 - DNA, 15 bp, Homo sapiens
acagcactactctgt

SEQ ID NO: 5132556 - DNA, 21 bp, Homo sapiens
acagcactactgggtgtcatt

SEQ ID NO: 5132557 - DNA, 17 bp, Homo sapiens
acagcactgcctgccaa

SEQ ID NO: 5132558 - DNA, 22 bp, Homo sapiens
acagcactggctctctccagga

SEQ ID NO: 5132559 - DNA, 17 bp, Homo sapiens
acagcacttacaatttt

SEQ ID NO: 5132560 - DNA, 21 bp, Homo sapiens
acagcacttcaaagaagctgt

SEQ ID NO: 5132561 - DNA, 18 bp, Homo sapiens
acagcacttgttttcagg

SEQ ID NO: 5132562 - DNA, 22 bp, Homo sapiens
acagcactttcctgttgcactg

SEQ ID NO: 5132563 - DNA, 23 bp, Homo sapiens
acagcactttggttttgctgaga

SEQ ID NO: 5132564 - DNA, 22 bp, Homo sapiens
acagcagaaacccatgtgcagg

SEQ ID NO: 5132565 - DNA, 17 bp, Homo sapiens
acagcagacaccattca

SEQ ID NO: 5132566 - DNA, 14 bp, Homo sapiens
acagcagacctaga

SEQ ID NO: 5132567 - DNA, 16 bp, Homo sapiens
acagcagagccatctg

SEQ ID NO: 5132568 - DNA, 23 bp, Homo sapiens
acagcagagtaaaattacagaag

SEQ ID NO: 5132569 - DNA, 19 bp, Homo sapiens
acagcagatccacctgcac

SEQ ID NO: 5132570 - DNA, 20 bp, Homo sapiens
acagcagatccacctgcaca

SEQ ID NO: 5132571 - DNA, 21 bp, Homo sapiens
acagcagatccacctgcacaa

SEQ ID NO: 5132572 - DNA, 15 bp, Homo sapiens
acagcagattccaca

SEQ ID NO: 5132573 - DNA, 14 bp, Homo sapiens
acagcagcaagaaa

SEQ ID NO: 5132574 - DNA, 23 bp, Homo sapiens
acagcagcaagaaaaaaaaatgc

SEQ ID NO: 5132575 - DNA, 16 bp, Homo sapiens
acagcagcaatatttt

SEQ ID NO: 5132576 - DNA, 20 bp, Homo sapiens
acagcagcacgcatgtccct

SEQ ID NO: 5132577 - DNA, 22 bp, Homo sapiens
acagcagcactcccgctgcaca

SEQ ID NO: 5132578 - DNA, 16 bp, Homo sapiens
acagcagcagcctgca

SEQ ID NO: 5132579 - DNA, 19 bp, Homo sapiens
acagcagcagcctgcacct

SEQ ID NO: 5132580 - DNA, 23 bp, Homo sapiens
acagcagcagcctgcacctgccc

SEQ ID NO: 5132581 - DNA, 13 bp, Homo sapiens
acagcagcatctc

SEQ ID NO: 5132582 - DNA, 14 bp, Homo sapiens
acagcagcattttt

SEQ ID NO: 5132583 - DNA, 17 bp, Homo sapiens
acagcagccccaggaga

SEQ ID NO: 5132584 - DNA, 20 bp, Homo sapiens
acagcagccccccagcacta

SEQ ID NO: 5132585 - DNA, 18 bp, Homo sapiens
acagcagcccctgcacaa

SEQ ID NO: 5132586 - DNA, 15 bp, Homo sapiens
acagcagcctccaac

SEQ ID NO: 5132587 - DNA, 16 bp, Homo sapiens
acagcagcctctgaag

SEQ ID NO: 5132588 - DNA, 12 bp, Homo sapiens
acagcagcctgt

SEQ ID NO: 5132589 - DNA, 22 bp, Homo sapiens
acagcagctccaacctggaggc

SEQ ID NO: 5132590 - DNA, 18 bp, Homo sapiens
acagcagctgaagccagc

SEQ ID NO: 5132591 - DNA, 22 bp, Homo sapiens
acagcagctgaagccagctccc

SEQ ID NO: 5132592 - DNA, 22 bp, Homo sapiens
acagcagctgcaggggcctctg

SEQ ID NO: 5132593 - DNA, 23 bp, Homo sapiens
acagcagctgcaggggcctctgt

SEQ ID NO: 5132594 - DNA, 11 bp, Homo sapiens
acagcagctgg

SEQ ID NO: 5132595 - DNA, 12 bp, Homo sapiens
acagcagctgga

SEQ ID NO: 5132596 - DNA, 22 bp, Homo sapiens
acagcagctggtgccccacctg

SEQ ID NO: 5132597 - DNA, 12 bp, Homo sapiens
acagcagcttca

SEQ ID NO: 5132598 - DNA, 13 bp, Homo sapiens
acagcagcttcac

SEQ ID NO: 5132599 - DNA, 22 bp, Homo sapiens
acagcagcttcaccagagcatt

SEQ ID NO: 5132600 - DNA, 17 bp, Homo sapiens
acagcaggagcatggcc

SEQ ID NO: 5132601 - DNA, 14 bp, Homo sapiens
acagcaggaggcac

SEQ ID NO: 5132602 - DNA, 21 bp, Homo sapiens
acagcaggataaacattccag

SEQ ID NO: 5132603 - DNA, 18 bp, Homo sapiens
acagcaggatgccctgtt

SEQ ID NO: 5132604 - DNA, 20 bp, Homo sapiens
acagcaggatgccctgttgg

SEQ ID NO: 5132605 - DNA, 17 bp, Homo sapiens
acagcaggatgtgcctg

SEQ ID NO: 5132606 - DNA, 12 bp, Homo sapiens
acagcaggcagc

SEQ ID NO: 5132607 - DNA, 14 bp, Homo sapiens
acagcaggccacta

SEQ ID NO: 5132608 - DNA, 20 bp, Homo sapiens
acagcaggcccacctacctt

SEQ ID NO: 5132609 - DNA, 15 bp, Homo sapiens
acagcaggctgccag

SEQ ID NO: 5132610 - DNA, 20 bp, Homo sapiens
acagcaggctgccagtgcct

SEQ ID NO: 5132611 - DNA, 11 bp, Homo sapiens
acagcaggtgt

SEQ ID NO: 5132612 - DNA, 19 bp, Homo sapiens
acagcagtatgaatgatgt

SEQ ID NO: 5132613 - DNA, 14 bp, Homo sapiens
acagcagtcacagg

SEQ ID NO: 5132614 - DNA, 18 bp, Homo sapiens
acagcagtcacaggccca

SEQ ID NO: 5132615 - DNA, 22 bp, Homo sapiens
acagcagtcccagtattctcag

SEQ ID NO: 5132616 - DNA, 18 bp, Homo sapiens
acagcagtctccttcagc

SEQ ID NO: 5132617 - DNA, 20 bp, Homo sapiens
acagcagtcttatgcttcca

SEQ ID NO: 5132618 - DNA, 18 bp, Homo sapiens
acagcagtgtcccctgcc

SEQ ID NO: 5132619 - DNA, 19 bp, Homo sapiens
acagcagtgtcccctgccc

SEQ ID NO: 5132620 - DNA, 23 bp, Homo sapiens
acagcagtgtgagggtgcaggga

SEQ ID NO: 5132621 - DNA, 18 bp, Homo sapiens
acagcagttgaaaagact

SEQ ID NO: 5132622 - DNA, 19 bp, Homo sapiens
acagcagttgactcagagt

SEQ ID NO: 5132623 - DNA, 15 bp, Homo sapiens
acagcagtttccaga

SEQ ID NO: 5132624 - DNA, 22 bp, Homo sapiens
acagcagtttgagcttgctgga

SEQ ID NO: 5132625 - DNA, 20 bp, Homo sapiens
acagcagtttgtgatatagc

SEQ ID NO: 5132626 - DNA, 15 bp, Homo sapiens
acagcataacaaggt

SEQ ID NO: 5132627 - DNA, 19 bp, Homo sapiens
acagcatagggtccacttt

SEQ ID NO: 5132628 - DNA, 20 bp, Homo sapiens
acagcatatagaatatatta

SEQ ID NO: 5132629 - DNA, 20 bp, Homo sapiens
acagcatcaatagaaagtca

SEQ ID NO: 5132630 - DNA, 13 bp, Homo sapiens
acagcatcagggt

SEQ ID NO: 5132631 - DNA, 16 bp, Homo sapiens
acagcatcattttgca

SEQ ID NO: 5132632 - DNA, 16 bp, Homo sapiens
acagcatcccttccca

SEQ ID NO: 5132633 - DNA, 13 bp, Homo sapiens
acagcatcctctc

SEQ ID NO: 5132634 - DNA, 21 bp, Homo sapiens
acagcatcgggagcacccaga

SEQ ID NO: 5132635 - DNA, 21 bp, Homo sapiens
acacctggcatggtgcaggga

SEQ ID NO: 5132636 - DNA, 15 bp, Homo sapiens
acacctggccctggg

SEQ ID NO: 5132637 - DNA, 18 bp, Homo sapiens
acacctggccctggggcc

SEQ ID NO: 5132638 - DNA, 19 bp, Homo sapiens
acacctggccctggggcct

SEQ ID NO: 5132639 - DNA, 19 bp, Homo sapiens
acacctggccgcctccagg

SEQ ID NO: 5132640 - DNA, 19 bp, Homo sapiens
acacctggccttaaagagg

SEQ ID NO: 5132641 - DNA, 19 bp, Homo sapiens
acacctggctgaggttcct

SEQ ID NO: 5132642 - DNA, 16 bp, Homo sapiens
acacctgggcccgggc

SEQ ID NO: 5132643 - DNA, 17 bp, Homo sapiens
acacctgggcccgggca

SEQ ID NO: 5132644 - DNA, 21 bp, Homo sapiens
acacctgggcccgggcaggcc

SEQ ID NO: 5132645 - DNA, 23 bp, Homo sapiens
acacctgggcccgggcaggccag

SEQ ID NO: 5132646 - DNA, 21 bp, Homo sapiens
acacctggtctgttttctgtg

SEQ ID NO: 5132647 - DNA, 16 bp, Homo sapiens
acacctgtacattctt

SEQ ID NO: 5132648 - DNA, 17 bp, Homo sapiens
acacctgtagtcccagc

SEQ ID NO: 5132649 - DNA, 19 bp, Homo sapiens
acacctgtagtcccagcta

SEQ ID NO: 5132650 - DNA, 21 bp, Homo sapiens
acacctgtagtcccagctact

SEQ ID NO: 5132651 - DNA, 14 bp, Homo sapiens
acacctgtccttct

SEQ ID NO: 5132652 - DNA, 20 bp, Homo sapiens
acacctgtcttgaataagag

SEQ ID NO: 5132653 - DNA, 15 bp, Homo sapiens
acacctgtgcctcct

SEQ ID NO: 5132654 - DNA, 11 bp, Homo sapiens
acacctgtgtc

SEQ ID NO: 5132655 - DNA, 17 bp, Homo sapiens
acaccttacaaagccag

SEQ ID NO: 5132656 - DNA, 22 bp, Homo sapiens
acaccttacaaagccagctctg

SEQ ID NO: 5132657 - DNA, 17 bp, Homo sapiens
acaccttagagaagcta

SEQ ID NO: 5132658 - DNA, 14 bp, Homo sapiens
acaccttagcagct

SEQ ID NO: 5132659 - DNA, 18 bp, Homo sapiens
acaccttagcagctcttc

SEQ ID NO: 5132660 - DNA, 21 bp, Homo sapiens
acaccttagcctgccctcctt

SEQ ID NO: 5132661 - DNA, 15 bp, Homo sapiens
acaccttcattttga

SEQ ID NO: 5132662 - DNA, 14 bp, Homo sapiens
acaccttccagctc

SEQ ID NO: 5132663 - DNA, 16 bp, Homo sapiens
acaccttccagctcct

SEQ ID NO: 5132664 - DNA, 13 bp, Homo sapiens
acaccttctctgg

SEQ ID NO: 5132665 - DNA, 18 bp, Homo sapiens
acaccttctgagtattct

SEQ ID NO: 5132666 - DNA, 21 bp, Homo sapiens
acaccttctgagtattctcat

SEQ ID NO: 5132667 - DNA, 18 bp, Homo sapiens
acaccttcttattatata

SEQ ID NO: 5132668 - DNA, 15 bp, Homo sapiens
acaccttgacagggc

SEQ ID NO: 5132669 - DNA, 15 bp, Homo sapiens
acacctttattttat

SEQ ID NO: 5132670 - DNA, 18 bp, Homo sapiens
acacctttgcaggcatgc

SEQ ID NO: 5132671 - DNA, 17 bp, Homo sapiens
acacctttgttttgcac

SEQ ID NO: 5132672 - DNA, 15 bp, Homo sapiens
acacctttgttttgt

SEQ ID NO: 5132673 - DNA, 17 bp, Homo sapiens
acaccttttaactcacc

SEQ ID NO: 5132674 - DNA, 22 bp, Homo sapiens
acaccttttccaggagttctga

SEQ ID NO: 5132675 - DNA, 19 bp, Homo sapiens
acaccttttccccaggagc

SEQ ID NO: 5132676 - DNA, 21 bp, Homo sapiens
acaccttttctatttacctcc

SEQ ID NO: 5132677 - DNA, 14 bp, Homo sapiens
acacgaaacttgtt

SEQ ID NO: 5132678 - DNA, 15 bp, Homo sapiens
acacgaaagagagag

SEQ ID NO: 5132679 - DNA, 18 bp, Homo sapiens
acacgaactttagctgca

SEQ ID NO: 5132680 - DNA, 14 bp, Homo sapiens
acacgaatattgct

SEQ ID NO: 5132681 - DNA, 15 bp, Homo sapiens
acacgacagaaacag

SEQ ID NO: 5132682 - DNA, 21 bp, Homo sapiens
acacgactgcaacatacaggt

SEQ ID NO: 5132683 - DNA, 12 bp, Homo sapiens
acacgagatttc

SEQ ID NO: 5132684 - DNA, 13 bp, Homo sapiens
acacgagcaaacc

SEQ ID NO: 5132685 - DNA, 17 bp, Homo sapiens
acacgagcaaacccaga

SEQ ID NO: 5132686 - DNA, 19 bp, Homo sapiens
acacgagcaggctactgtc

SEQ ID NO: 5132687 - DNA, 12 bp, Homo sapiens
acacgagccaca

SEQ ID NO: 5132688 - DNA, 13 bp, Homo sapiens
acacgagccacaa

SEQ ID NO: 5132689 - DNA, 21 bp, Homo sapiens
acacgatccgcaacccatgcc

SEQ ID NO: 5132690 - DNA, 15 bp, Homo sapiens
acacgatgcatttaa

SEQ ID NO: 5132691 - DNA, 20 bp, Homo sapiens
acacgatgcatttaataaag

SEQ ID NO: 5132692 - DNA, 21 bp, Homo sapiens
acacgatgcatttaataaaga

SEQ ID NO: 5132693 - DNA, 13 bp, Homo sapiens
acacgattagctt

SEQ ID NO: 5132694 - DNA, 24 bp, Homo sapiens
acacgcaagggcatcaggcactgg

SEQ ID NO: 5132695 - DNA, 18 bp, Homo sapiens
acacgcacaaacacacac

SEQ ID NO: 5132696 - DNA, 19 bp, Homo sapiens
acacgcacaaacacacaca

SEQ ID NO: 5132697 - DNA, 14 bp, Homo sapiens
acacgcacacacac

SEQ ID NO: 5132698 - DNA, 14 bp, Homo sapiens
acacgcacctgcct

SEQ ID NO: 5132699 - DNA, 17 bp, Homo sapiens
acacgcacgcacacaca

SEQ ID NO: 5132700 - DNA, 20 bp, Homo sapiens
acacgcacgcacacacacat

SEQ ID NO: 5132701 - DNA, 22 bp, Homo sapiens
acacgcacttctggggccagcc

SEQ ID NO: 5132702 - DNA, 12 bp, Homo sapiens
acacgcagacac

SEQ ID NO: 5132703 - DNA, 15 bp, Homo sapiens
acacgcagacacaca

SEQ ID NO: 5132704 - DNA, 14 bp, Homo sapiens
acacgcatgggcat

SEQ ID NO: 5132705 - DNA, 22 bp, Homo sapiens
acacgccagctcctctctgaag

SEQ ID NO: 5132706 - DNA, 21 bp, Homo sapiens
acacgccccggtcccccagag

SEQ ID NO: 5132707 - DNA, 20 bp, Homo sapiens
acacgcccgactctctccat

SEQ ID NO: 5132708 - DNA, 15 bp, Homo sapiens
acacgccggggctgg

SEQ ID NO: 5132709 - DNA, 21 bp, Homo sapiens
acacgccggggctggccctgc

SEQ ID NO: 5132710 - DNA, 17 bp, Homo sapiens
acacgcctgtaatccca

SEQ ID NO: 5132711 - DNA, 24 bp, Homo sapiens
acacgcctgtaatctcagctactc

SEQ ID NO: 5132712 - DNA, 16 bp, Homo sapiens
acacgccttcccctca

SEQ ID NO: 5132713 - DNA, 19 bp, Homo sapiens
acacgccttgttcttggcc

SEQ ID NO: 5132714 - DNA, 23 bp, Homo sapiens
acacgcgcgcgcgcgcacacaca

SEQ ID NO: 5132715 - DNA, 23 bp, Homo sapiens
acacgcgggcgcgatcccacaca

SEQ ID NO: 5132716 - DNA, 22 bp, Homo sapiens
acacgcggtttggtttgcagcg

SEQ ID NO: 5132717 - DNA, 22 bp, Homo sapiens
acacgctcgcgggcagcgggcc

SEQ ID NO: 5132718 - DNA, 18 bp, Homo sapiens
acacgctgcccaggctct

SEQ ID NO: 5132719 - DNA, 21 bp, Homo sapiens
acacgctgcccaggctctgct

SEQ ID NO: 5132720 - DNA, 22 bp, Homo sapiens
acacgctgcccaggctctgctg

SEQ ID NO: 5132721 - DNA, 23 bp, Homo sapiens
acacgctgcccaggctctgctga

SEQ ID NO: 5132722 - DNA, 13 bp, Homo sapiens
acacgctgcctgg

SEQ ID NO: 5132723 - DNA, 14 bp, Homo sapiens
acacgctgcctggt

SEQ ID NO: 5132724 - DNA, 15 bp, Homo sapiens
acacgctgcctggtc

SEQ ID NO: 5132725 - DNA, 17 bp, Homo sapiens
acacgctgctctgcccc

SEQ ID NO: 5132726 - DNA, 22 bp, Homo sapiens
acacgctgctctgccccagctt

SEQ ID NO: 5132727 - DNA, 15 bp, Homo sapiens
acacgctgttctaat

SEQ ID NO: 5132728 - DNA, 15 bp, Homo sapiens
acacggactgaggtg

SEQ ID NO: 5132729 - DNA, 19 bp, Homo sapiens
acacggactgaggtgcctg

SEQ ID NO: 5132730 - DNA, 22 bp, Homo sapiens
acacggactgaggtgcctgctc

SEQ ID NO: 5132731 - DNA, 18 bp, Homo sapiens
acacggagcccagccctc

SEQ ID NO: 5132732 - DNA, 17 bp, Homo sapiens
acacggaggcatctgca

SEQ ID NO: 5132733 - DNA, 15 bp, Homo sapiens
acacggatctgagaa

SEQ ID NO: 5132734 - DNA, 17 bp, Homo sapiens
acacggatctgagaatc

SEQ ID NO: 5132735 - DNA, 19 bp, Homo sapiens
acacggatctgagaatctt

SEQ ID NO: 5132736 - DNA, 18 bp, Homo sapiens
acacggatttagtcccac

SEQ ID NO: 5132737 - DNA, 17 bp, Homo sapiens
acacggcagctgctggc

SEQ ID NO: 5132738 - DNA, 12 bp, Homo sapiens
acacggccacat

SEQ ID NO: 5132739 - DNA, 14 bp, Homo sapiens
acacggccctcctg

SEQ ID NO: 5132740 - DNA, 14 bp, Homo sapiens
acacggccctgccc

SEQ ID NO: 5132741 - DNA, 14 bp, Homo sapiens
acacggcctctggg

SEQ ID NO: 5132742 - DNA, 20 bp, Homo sapiens
acacgggaaagccttaaaaa

SEQ ID NO: 5132743 - DNA, 16 bp, Homo sapiens
acacgggaccagctca

SEQ ID NO: 5132744 - DNA, 23 bp, Homo sapiens
acacgggcctctgcttgccagcc

SEQ ID NO: 5132745 - DNA, 13 bp, Homo sapiens
acacgggcctgtc

SEQ ID NO: 5132746 - DNA, 20 bp, Homo sapiens
acacggggatcatctctgtg

SEQ ID NO: 5132747 - DNA, 23 bp, Homo sapiens
acacggggcaggaccttccttcc

SEQ ID NO: 5132748 - DNA, 17 bp, Homo sapiens
acacggtgaaatccagg

SEQ ID NO: 5132749 - DNA, 18 bp, Homo sapiens
acacggtgaaatccaggt

SEQ ID NO: 5132750 - DNA, 16 bp, Homo sapiens
acacggtgagggtgcg

SEQ ID NO: 5132751 - DNA, 20 bp, Homo sapiens
acacggtttaactgtcccag

SEQ ID NO: 5132752 - DNA, 20 bp, Homo sapiens
acacggttttggcagctgac

SEQ ID NO: 5132753 - DNA, 20 bp, Homo sapiens
acacgtaatgaaacttggat

SEQ ID NO: 5132754 - DNA, 19 bp, Homo sapiens
acacgtatcccacctgaca

SEQ ID NO: 5132755 - DNA, 21 bp, Homo sapiens
acacgtatttatatttggaaa

SEQ ID NO: 5132756 - DNA, 23 bp, Homo sapiens
acacgtatttatatttggaaaga

SEQ ID NO: 5132757 - DNA, 14 bp, Homo sapiens
acacgtccacccca

SEQ ID NO: 5132758 - DNA, 17 bp, Homo sapiens
acacgtgacacaaacac

SEQ ID NO: 5132759 - DNA, 21 bp, Homo sapiens
acacgtgagaatccctggcaa

SEQ ID NO: 5132760 - DNA, 20 bp, Homo sapiens
acacgtgatggaccaaagcc

SEQ ID NO: 5132761 - DNA, 22 bp, Homo sapiens
acacgtgcgtgtgagtgtgtgt

SEQ ID NO: 5132762 - DNA, 22 bp, Homo sapiens
acacgtggaggaatgctccccc

SEQ ID NO: 5132763 - DNA, 23 bp, Homo sapiens
acacgtggaggtgaagtccctgt

SEQ ID NO: 5132764 - DNA, 16 bp, Homo sapiens
acacgtggcctgcacc

SEQ ID NO: 5132765 - DNA, 13 bp, Homo sapiens
acacgtggctggc

SEQ ID NO: 5132766 - DNA, 21 bp, Homo sapiens
acacgtgggctcccctcttcc

SEQ ID NO: 5132767 - DNA, 13 bp, Homo sapiens
acacgtgggtgag

SEQ ID NO: 5132768 - DNA, 14 bp, Homo sapiens
acacgtgtgatgta

SEQ ID NO: 5132769 - DNA, 15 bp, Homo sapiens
acacgtgtgatgtat

SEQ ID NO: 5132770 - DNA, 20 bp, Homo sapiens
acacgttgacgggccgcagg

SEQ ID NO: 5132771 - DNA, 17 bp, Homo sapiens
acacgtttcaacctctc

SEQ ID NO: 5132772 - DNA, 16 bp, Homo sapiens
acacgttttaaggact

SEQ ID NO: 5132773 - DNA, 17 bp, Homo sapiens
acacgttttaaggactg

SEQ ID NO: 5132774 - DNA, 13 bp, Homo sapiens
acactaaaacatt

SEQ ID NO: 5132775 - DNA, 15 bp, Homo sapiens
acactaaaacattgt

SEQ ID NO: 5132776 - DNA, 23 bp, Homo sapiens
acactaaaatttaaatcagacta

SEQ ID NO: 5132777 - DNA, 13 bp, Homo sapiens
acactaaacattc

SEQ ID NO: 5132778 - DNA, 14 bp, Homo sapiens
acactaaactccat

SEQ ID NO: 5132779 - DNA, 15 bp, Homo sapiens
acactaaactctggg

SEQ ID NO: 5132780 - DNA, 14 bp, Homo sapiens
acactaaagagcta

SEQ ID NO: 5132781 - DNA, 21 bp, Homo sapiens
acactaaagagctaggaaaga

SEQ ID NO: 5132782 - DNA, 12 bp, Homo sapiens
acactaaatgtt

SEQ ID NO: 5132783 - DNA, 19 bp, Homo sapiens
acactaaattagtttaaaa

SEQ ID NO: 5132784 - DNA, 18 bp, Homo sapiens
acactaaattattagcat

SEQ ID NO: 5132785 - DNA, 22 bp, Homo sapiens
acactaaattattagcatttgt

SEQ ID NO: 5132786 - DNA, 17 bp, Homo sapiens
acactaaattgcagttt

SEQ ID NO: 5132787 - DNA, 21 bp, Homo sapiens
acactaaattgcagtttacag

SEQ ID NO: 5132788 - DNA, 16 bp, Homo sapiens
acactaaccaagctga

SEQ ID NO: 5132789 - DNA, 22 bp, Homo sapiens
acactaaccaagctgagtttcc

SEQ ID NO: 5132790 - DNA, 23 bp, Homo sapiens
acactaaccaagctgagtttcct

SEQ ID NO: 5132791 - DNA, 15 bp, Homo sapiens
acactaaccacgctg

SEQ ID NO: 5132792 - DNA, 20 bp, Homo sapiens
acactaaccacgctggacct

SEQ ID NO: 5132793 - DNA, 11 bp, Homo sapiens
acactaagaaa

SEQ ID NO: 5132794 - DNA, 13 bp, Homo sapiens
acactaagagaga

SEQ ID NO: 5132795 - DNA, 17 bp, Homo sapiens
acactaagctctctggg

SEQ ID NO: 5132796 - DNA, 14 bp, Homo sapiens
acactaagggtgta

SEQ ID NO: 5132797 - DNA, 19 bp, Homo sapiens
acactaagttatagtatat

SEQ ID NO: 5132798 - DNA, 19 bp, Homo sapiens
acactaatagtaagattaa

SEQ ID NO: 5132799 - DNA, 18 bp, Homo sapiens
acactaatatatggacct

SEQ ID NO: 5132800 - DNA, 13 bp, Homo sapiens
acactaatatatt

SEQ ID NO: 5132801 - DNA, 19 bp, Homo sapiens
acactaatatatttaaaaa

SEQ ID NO: 5132802 - DNA, 15 bp, Homo sapiens
acactaatgaagata

SEQ ID NO: 5132803 - DNA, 22 bp, Homo sapiens
acactaatgaggaaactgcact

SEQ ID NO: 5132804 - DNA, 19 bp, Homo sapiens
acactaatgagtatttggt

SEQ ID NO: 5132805 - DNA, 13 bp, Homo sapiens
acactaattcctt

SEQ ID NO: 5132806 - DNA, 17 bp, Homo sapiens
acactaattcctttcta

SEQ ID NO: 5132807 - DNA, 23 bp, Homo sapiens
acactaattcctttctatcctac

SEQ ID NO: 5132808 - DNA, 23 bp, Homo sapiens
acactaatttgaataaactctcc

SEQ ID NO: 5132809 - DNA, 15 bp, Homo sapiens
acactacaacatatg

SEQ ID NO: 5132810 - DNA, 19 bp, Homo sapiens
acactacaagtttataagc

SEQ ID NO: 5132811 - DNA, 17 bp, Homo sapiens
acactacacactgtgta

SEQ ID NO: 5132812 - DNA, 22 bp, Homo sapiens
acagcatcgggagcacccagag

SEQ ID NO: 5132813 - DNA, 19 bp, Homo sapiens
acagcatcgtgatcactga

SEQ ID NO: 5132814 - DNA, 11 bp, Homo sapiens
acagcatctcc

SEQ ID NO: 5132815 - DNA, 22 bp, Homo sapiens
acagcatctgcctctattcaat

SEQ ID NO: 5132816 - DNA, 14 bp, Homo sapiens
acagcatgaataaa

SEQ ID NO: 5132817 - DNA, 16 bp, Homo sapiens
acagcatgaataaaac

SEQ ID NO: 5132818 - DNA, 24 bp, Homo sapiens
acagcatgaataaaacactcatcc

SEQ ID NO: 5132819 - DNA, 15 bp, Homo sapiens
acagcatgacaaaaa

SEQ ID NO: 5132820 - DNA, 18 bp, Homo sapiens
acagcatgacaaaaatta

SEQ ID NO: 5132821 - DNA, 18 bp, Homo sapiens
acagcatgactggacagc

SEQ ID NO: 5132822 - DNA, 22 bp, Homo sapiens
acagcatgactggacagcggtt

SEQ ID NO: 5132823 - DNA, 17 bp, Homo sapiens
acagcatgagattgtac

SEQ ID NO: 5132824 - DNA, 14 bp, Homo sapiens
acagcatgcattta

SEQ ID NO: 5132825 - DNA, 15 bp, Homo sapiens
acagcatgcatttag

SEQ ID NO: 5132826 - DNA, 18 bp, Homo sapiens
acagcatgcatttagcat

SEQ ID NO: 5132827 - DNA, 20 bp, Homo sapiens
acagcatgcatttagcatga

SEQ ID NO: 5132828 - DNA, 21 bp, Homo sapiens
acagcatgcatttagcatgag

SEQ ID NO: 5132829 - DNA, 23 bp, Homo sapiens
acagcatggcactccctccagca

SEQ ID NO: 5132830 - DNA, 13 bp, Homo sapiens
acagcatggcccg

SEQ ID NO: 5132831 - DNA, 14 bp, Homo sapiens
acagcatgtctact

SEQ ID NO: 5132832 - DNA, 14 bp, Homo sapiens
acagcatgtgccaa

SEQ ID NO: 5132833 - DNA, 20 bp, Homo sapiens
acagcatgtgccctcctgag

SEQ ID NO: 5132834 - DNA, 17 bp, Homo sapiens
acagcatgtgctcagcc

SEQ ID NO: 5132835 - DNA, 22 bp, Homo sapiens
acagcatgtgggtgtcagtgtc

SEQ ID NO: 5132836 - DNA, 21 bp, Homo sapiens
acagcatgtgttaatcttaat

SEQ ID NO: 5132837 - DNA, 13 bp, Homo sapiens
acagcattagata

SEQ ID NO: 5132838 - DNA, 16 bp, Homo sapiens
acagcattagatagtc

SEQ ID NO: 5132839 - DNA, 15 bp, Homo sapiens
acagcattcctccat

SEQ ID NO: 5132840 - DNA, 18 bp, Homo sapiens
acagcattcctccatctt

SEQ ID NO: 5132841 - DNA, 22 bp, Homo sapiens
acagcattgactcagatataga

SEQ ID NO: 5132842 - DNA, 11 bp, Homo sapiens
acagcattgct

SEQ ID NO: 5132843 - DNA, 13 bp, Homo sapiens
acagcattgcttt

SEQ ID NO: 5132844 - DNA, 18 bp, Homo sapiens
acagcattggcctggcca

SEQ ID NO: 5132845 - DNA, 15 bp, Homo sapiens
acagcattgtctttg

SEQ ID NO: 5132846 - DNA, 18 bp, Homo sapiens
acagcattgtctttgctg

SEQ ID NO: 5132847 - DNA, 19 bp, Homo sapiens
acagcattgtctttgctgt

SEQ ID NO: 5132848 - DNA, 11 bp, Homo sapiens
acagcattgtg

SEQ ID NO: 5132849 - DNA, 19 bp, Homo sapiens
acagcatttcagctgtgag

SEQ ID NO: 5132850 - DNA, 13 bp, Homo sapiens
acagcatttgctt

SEQ ID NO: 5132851 - DNA, 17 bp, Homo sapiens
acagcatttgctttcct

SEQ ID NO: 5132852 - DNA, 13 bp, Homo sapiens
acagcattttaag

SEQ ID NO: 5132853 - DNA, 14 bp, Homo sapiens
acagcattttcctc

SEQ ID NO: 5132854 - DNA, 23 bp, Homo sapiens
acagccaaatgcatggtgcagtt

SEQ ID NO: 5132855 - DNA, 15 bp, Homo sapiens
acagccaaattgcag

SEQ ID NO: 5132856 - DNA, 19 bp, Homo sapiens
acagccaaattgcagaaga

SEQ ID NO: 5132857 - DNA, 15 bp, Homo sapiens
acagccaaatttaaa

SEQ ID NO: 5132858 - DNA, 22 bp, Homo sapiens
acagccaacacgcacctgcctc

SEQ ID NO: 5132859 - DNA, 24 bp, Homo sapiens
acagccaacacgcacctgcctcag

SEQ ID NO: 5132860 - DNA, 17 bp, Homo sapiens
acagccaactagcccct

SEQ ID NO: 5132861 - DNA, 19 bp, Homo sapiens
acagccaactatggcctgt

SEQ ID NO: 5132862 - DNA, 17 bp, Homo sapiens
acagccaagacccaaca

SEQ ID NO: 5132863 - DNA, 12 bp, Homo sapiens
acagccaagccc

SEQ ID NO: 5132864 - DNA, 12 bp, Homo sapiens
acagccaagctg

SEQ ID NO: 5132865 - DNA, 18 bp, Homo sapiens
acagccaagctggcacaa

SEQ ID NO: 5132866 - DNA, 15 bp, Homo sapiens
acagccaagtgccaa

SEQ ID NO: 5132867 - DNA, 14 bp, Homo sapiens
acagccaagtgtga

SEQ ID NO: 5132868 - DNA, 16 bp, Homo sapiens
acagccaatctccagg

SEQ ID NO: 5132869 - DNA, 21 bp, Homo sapiens
acagccaatctccaggctccc

SEQ ID NO: 5132870 - DNA, 13 bp, Homo sapiens
acagccacacaca

SEQ ID NO: 5132871 - DNA, 14 bp, Homo sapiens
acagccacacacac

SEQ ID NO: 5132872 - DNA, 20 bp, Homo sapiens
acagccacacacacagaaaa

SEQ ID NO: 5132873 - DNA, 22 bp, Homo sapiens
acagccacacacacagaaaata

SEQ ID NO: 5132874 - DNA, 23 bp, Homo sapiens
acagccacacacacagaaaatat

SEQ ID NO: 5132875 - DNA, 18 bp, Homo sapiens
acagccacaccgtggcag

SEQ ID NO: 5132876 - DNA, 11 bp, Homo sapiens
acagccacccg

SEQ ID NO: 5132877 - DNA, 11 bp, Homo sapiens
acagccacctc

SEQ ID NO: 5132878 - DNA, 16 bp, Homo sapiens
acagccacgaggtggt

SEQ ID NO: 5132879 - DNA, 15 bp, Homo sapiens
acagccacggccagg

SEQ ID NO: 5132880 - DNA, 17 bp, Homo sapiens
acagccacggccaggcc

SEQ ID NO: 5132881 - DNA, 18 bp, Homo sapiens
acagccacggccaggcca

SEQ ID NO: 5132882 - DNA, 16 bp, Homo sapiens
acagccactccccggc

SEQ ID NO: 5132883 - DNA, 21 bp, Homo sapiens
acagccacttttagctactgc

SEQ ID NO: 5132884 - DNA, 10 bp, Homo sapiens
acagccagaa

SEQ ID NO: 5132885 - DNA, 17 bp, Homo sapiens
acagccagagctgggtg

SEQ ID NO: 5132886 - DNA, 19 bp, Homo sapiens
acagccagagctgggtggg

SEQ ID NO: 5132887 - DNA, 14 bp, Homo sapiens
acagccagaggaac

SEQ ID NO: 5132888 - DNA, 18 bp, Homo sapiens
acagccagaggagggcag

SEQ ID NO: 5132889 - DNA, 14 bp, Homo sapiens
acagccagcaagag

SEQ ID NO: 5132890 - DNA, 16 bp, Homo sapiens
acagccagcacctggc

SEQ ID NO: 5132891 - DNA, 12 bp, Homo sapiens
acagccagccca

SEQ ID NO: 5132892 - DNA, 13 bp, Homo sapiens
acagccagggcag

SEQ ID NO: 5132893 - DNA, 14 bp, Homo sapiens
acagccagggggat

SEQ ID NO: 5132894 - DNA, 13 bp, Homo sapiens
acagccaggtagt

SEQ ID NO: 5132895 - DNA, 15 bp, Homo sapiens
acagccaggtgcctt

SEQ ID NO: 5132896 - DNA, 19 bp, Homo sapiens
acagccaggtgccttggag

SEQ ID NO: 5132897 - DNA, 20 bp, Homo sapiens
acagccaggtggcacctgca

SEQ ID NO: 5132898 - DNA, 17 bp, Homo sapiens
acagccagtaaggcagc

SEQ ID NO: 5132899 - DNA, 20 bp, Homo sapiens
acagccagtttagagaaata

SEQ ID NO: 5132900 - DNA, 16 bp, Homo sapiens
acagccatcccagcct

SEQ ID NO: 5132901 - DNA, 18 bp, Homo sapiens
acagccatcccagccttg

SEQ ID NO: 5132902 - DNA, 19 bp, Homo sapiens
acagccatcccagccttgg

SEQ ID NO: 5132903 - DNA, 22 bp, Homo sapiens
acagccatgtccaagttcttca

SEQ ID NO: 5132904 - DNA, 16 bp, Homo sapiens
acagccattcatctgg

SEQ ID NO: 5132905 - DNA, 17 bp, Homo sapiens
acagccattcatctggg

SEQ ID NO: 5132906 - DNA, 23 bp, Homo sapiens
acagccattcatctgggctggca

SEQ ID NO: 5132907 - DNA, 21 bp, Homo sapiens
acagccattgcggccccagga

SEQ ID NO: 5132908 - DNA, 23 bp, Homo sapiens
acagccattgcggccccaggagg

SEQ ID NO: 5132909 - DNA, 14 bp, Homo sapiens
acagccattttgtt

SEQ ID NO: 5132910 - DNA, 16 bp, Homo sapiens
acagcccaaaatttga

SEQ ID NO: 5132911 - DNA, 16 bp, Homo sapiens
acagcccaaccaggag

SEQ ID NO: 5132912 - DNA, 13 bp, Homo sapiens
acagcccaagagg

SEQ ID NO: 5132913 - DNA, 13 bp, Homo sapiens
acagcccaccctc

SEQ ID NO: 5132914 - DNA, 19 bp, Homo sapiens
acagcccacgtcctgtcag

SEQ ID NO: 5132915 - DNA, 15 bp, Homo sapiens
acagcccagaaggcc

SEQ ID NO: 5132916 - DNA, 15 bp, Homo sapiens
acagcccagagcctg

SEQ ID NO: 5132917 - DNA, 15 bp, Homo sapiens
acagcccagcctagc

SEQ ID NO: 5132918 - DNA, 18 bp, Homo sapiens
acagcccagcgccatcct

SEQ ID NO: 5132919 - DNA, 21 bp, Homo sapiens
acagcccaggatactggcaca

SEQ ID NO: 5132920 - DNA, 13 bp, Homo sapiens
acagcccagggcc

SEQ ID NO: 5132921 - DNA, 18 bp, Homo sapiens
acagcccaggtccctccg

SEQ ID NO: 5132922 - DNA, 18 bp, Homo sapiens
acagcccatcacctctaa

SEQ ID NO: 5132923 - DNA, 14 bp, Homo sapiens
acagcccatctgcc

SEQ ID NO: 5132924 - DNA, 14 bp, Homo sapiens
acagcccattttat

SEQ ID NO: 5132925 - DNA, 16 bp, Homo sapiens
acagccccaacctccc

SEQ ID NO: 5132926 - DNA, 12 bp, Homo sapiens
acagccccacag

SEQ ID NO: 5132927 - DNA, 14 bp, Homo sapiens
acagccccacagca

SEQ ID NO: 5132928 - DNA, 17 bp, Homo sapiens
acagccccacagcaccc

SEQ ID NO: 5132929 - DNA, 20 bp, Homo sapiens
acagccccacagcacccagg

SEQ ID NO: 5132930 - DNA, 12 bp, Homo sapiens
acagccccaccc

SEQ ID NO: 5132931 - DNA, 14 bp, Homo sapiens
acagccccaccctg

SEQ ID NO: 5132932 - DNA, 14 bp, Homo sapiens
acagccccatggac

SEQ ID NO: 5132933 - DNA, 15 bp, Homo sapiens
acagcccccacccca

SEQ ID NO: 5132934 - DNA, 17 bp, Homo sapiens
acagcccccaccccagc

SEQ ID NO: 5132935 - DNA, 18 bp, Homo sapiens
acagcccccaccccagca

SEQ ID NO: 5132936 - DNA, 23 bp, Homo sapiens
acagccccggggccccctggtca

SEQ ID NO: 5132937 - DNA, 23 bp, Homo sapiens
acagcccctatagcactgagctc

SEQ ID NO: 5132938 - DNA, 18 bp, Homo sapiens
acagcccctcaaagactt

SEQ ID NO: 5132939 - DNA, 14 bp, Homo sapiens
acagcccctcctcc

SEQ ID NO: 5132940 - DNA, 12 bp, Homo sapiens
acagcccctgga

SEQ ID NO: 5132941 - DNA, 15 bp, Homo sapiens
acagcccctggagcc

SEQ ID NO: 5132942 - DNA, 13 bp, Homo sapiens
acagcccctggca

SEQ ID NO: 5132943 - DNA, 19 bp, Homo sapiens
acagccccttgcttctaag

SEQ ID NO: 5132944 - DNA, 16 bp, Homo sapiens
acagcccgctctctgg

SEQ ID NO: 5132945 - DNA, 17 bp, Homo sapiens
acagcccgctctctggc

SEQ ID NO: 5132946 - DNA, 17 bp, Homo sapiens
acagcccgggctctgcc

SEQ ID NO: 5132947 - DNA, 18 bp, Homo sapiens
acagcccgggctctgcct

SEQ ID NO: 5132948 - DNA, 23 bp, Homo sapiens
acagcccgggctctgcctcccat

SEQ ID NO: 5132949 - DNA, 15 bp, Homo sapiens
acagccctatttctt

SEQ ID NO: 5132950 - DNA, 23 bp, Homo sapiens
acagccctcagcgtcagacagca

SEQ ID NO: 5132951 - DNA, 16 bp, Homo sapiens
acagccctcggcctcc

SEQ ID NO: 5132952 - DNA, 12 bp, Homo sapiens
acagccctgaga

SEQ ID NO: 5132953 - DNA, 13 bp, Homo sapiens
acagccctgcacg

SEQ ID NO: 5132954 - DNA, 17 bp, Homo sapiens
acagccctgcctatcct

SEQ ID NO: 5132955 - DNA, 14 bp, Homo sapiens
acagccctgcctga

SEQ ID NO: 5132956 - DNA, 12 bp, Homo sapiens
acagccctgtca

SEQ ID NO: 5132957 - DNA, 13 bp, Homo sapiens
acagccctgtcag

SEQ ID NO: 5132958 - DNA, 22 bp, Homo sapiens
acagccctgtcagcatgaattt

SEQ ID NO: 5132959 - DNA, 21 bp, Homo sapiens
acagccctgtcagtgcagccc

SEQ ID NO: 5132960 - DNA, 22 bp, Homo sapiens
acagcccttatgcggttaattt

SEQ ID NO: 5132961 - DNA, 12 bp, Homo sapiens
acagcccttcct

SEQ ID NO: 5132962 - DNA, 18 bp, Homo sapiens
acagcccttccttgggga

SEQ ID NO: 5132963 - DNA, 17 bp, Homo sapiens
acagccgcagaagggga

SEQ ID NO: 5132964 - DNA, 13 bp, Homo sapiens
acagccgcagcct

SEQ ID NO: 5132965 - DNA, 20 bp, Homo sapiens
acagccgcagcctccctctg

SEQ ID NO: 5132966 - DNA, 18 bp, Homo sapiens
acagccggatcttggaga

SEQ ID NO: 5132967 - DNA, 16 bp, Homo sapiens
acagccggggcctgcc

SEQ ID NO: 5132968 - DNA, 18 bp, Homo sapiens
acagccggggcctgccta

SEQ ID NO: 5132969 - DNA, 22 bp, Homo sapiens
acagccgtcccgcgttcaagac

SEQ ID NO: 5132970 - DNA, 21 bp, Homo sapiens
acagcctaaagctaaaaatat

SEQ ID NO: 5132971 - DNA, 20 bp, Homo sapiens
acagcctaatcccgtgcccc

SEQ ID NO: 5132972 - DNA, 15 bp, Homo sapiens
acagcctagggcaga

SEQ ID NO: 5132973 - DNA, 12 bp, Homo sapiens
acagcctagggt

SEQ ID NO: 5132974 - DNA, 17 bp, Homo sapiens
acagcctatagatgatg

SEQ ID NO: 5132975 - DNA, 17 bp, Homo sapiens
acagcctattcctgaac

SEQ ID NO: 5132976 - DNA, 18 bp, Homo sapiens
acagcctcacccctgcag

SEQ ID NO: 5132977 - DNA, 17 bp, Homo sapiens
acagcctcacccctgcc

SEQ ID NO: 5132978 - DNA, 18 bp, Homo sapiens
acagcctcacccctgccc

SEQ ID NO: 5132979 - DNA, 20 bp, Homo sapiens
acagcctcacccctgcccct

SEQ ID NO: 5132980 - DNA, 12 bp, Homo sapiens
acagcctcactt

SEQ ID NO: 5132981 - DNA, 18 bp, Homo sapiens
acagcctcacttgaatgt

SEQ ID NO: 5132982 - DNA, 12 bp, Homo sapiens
acagcctcagaa

SEQ ID NO: 5132983 - DNA, 15 bp, Homo sapiens
acagcctccaagtca

SEQ ID NO: 5132984 - DNA, 14 bp, Homo sapiens
acagcctccacctt

SEQ ID NO: 5132985 - DNA, 21 bp, Homo sapiens
acagcctccaccttgagcact

SEQ ID NO: 5132986 - DNA, 23 bp, Homo sapiens
acagcctccaccttgagcactat

SEQ ID NO: 5132987 - DNA, 13 bp, Homo sapiens
acagcctccaggg

SEQ ID NO: 5132988 - DNA, 16 bp, Homo sapiens
acagcctcccaccccc

SEQ ID NO: 5132989 - DNA, 15 bp, Homo sapiens
acagcctccccaccc

SEQ ID NO: 5132990 - DNA, 20 bp, Homo sapiens
acagcctcccccgccagccc

SEQ ID NO: 5132991 - DNA, 15 bp, Homo sapiens
acagcctcccctgcc

SEQ ID NO: 5132992 - DNA, 18 bp, Homo sapiens
acagcctcccctgccagg

SEQ ID NO: 5132993 - DNA, 14 bp, Homo sapiens
acactacacccagc

SEQ ID NO: 5132994 - DNA, 17 bp, Homo sapiens
acactacacccagcaat

SEQ ID NO: 5132995 - DNA, 23 bp, Homo sapiens
acactacacccagcaatagagac

SEQ ID NO: 5132996 - DNA, 14 bp, Homo sapiens
acactacattagaa

SEQ ID NO: 5132997 - DNA, 20 bp, Homo sapiens
acactaccagcgtatatata

SEQ ID NO: 5132998 - DNA, 21 bp, Homo sapiens
acactaccgaatgtgtcttta

SEQ ID NO: 5132999 - DNA, 15 bp, Homo sapiens
acactacctcttttg

SEQ ID NO: 5133000 - DNA, 14 bp, Homo sapiens
acactacgcagaag

SEQ ID NO: 5133001 - DNA, 19 bp, Homo sapiens
acactactcttacatgtat

SEQ ID NO: 5133002 - DNA, 21 bp, Homo sapiens
acactactcttacatgtataa

SEQ ID NO: 5133003 - DNA, 14 bp, Homo sapiens
acactactgagaat

SEQ ID NO: 5133004 - DNA, 13 bp, Homo sapiens
acactacttaaaa

SEQ ID NO: 5133005 - DNA, 16 bp, Homo sapiens
acactagacaagccag

SEQ ID NO: 5133006 - DNA, 22 bp, Homo sapiens
acactagcatagagaatgtgtt

SEQ ID NO: 5133007 - DNA, 17 bp, Homo sapiens
acactagcccaatgaaa

SEQ ID NO: 5133008 - DNA, 12 bp, Homo sapiens
acactagcttat

SEQ ID NO: 5133009 - DNA, 20 bp, Homo sapiens
acactagggactatcaggta

SEQ ID NO: 5133010 - DNA, 22 bp, Homo sapiens
acactagtagctgttttgaata

SEQ ID NO: 5133011 - DNA, 16 bp, Homo sapiens
acactagtctgtgtaa

SEQ ID NO: 5133012 - DNA, 18 bp, Homo sapiens
acactagtctgtgtaact

SEQ ID NO: 5133013 - DNA, 17 bp, Homo sapiens
acactatatattttatg

SEQ ID NO: 5133014 - DNA, 14 bp, Homo sapiens
acactatatctgta

SEQ ID NO: 5133015 - DNA, 15 bp, Homo sapiens
acactatatctgtat

SEQ ID NO: 5133016 - DNA, 22 bp, Homo sapiens
acactatcaacactgcagcatt

SEQ ID NO: 5133017 - DNA, 19 bp, Homo sapiens
acactatcatagttaacat

SEQ ID NO: 5133018 - DNA, 17 bp, Homo sapiens
acactatgataaagttg

SEQ ID NO: 5133019 - DNA, 18 bp, Homo sapiens
acactatgataaagttgt

SEQ ID NO: 5133020 - DNA, 22 bp, Homo sapiens
acactatgataaagttgtaaat

SEQ ID NO: 5133021 - DNA, 21 bp, Homo sapiens
acactatggggtggggtgggt

SEQ ID NO: 5133022 - DNA, 23 bp, Homo sapiens
acactatggggtggggtgggtgt

SEQ ID NO: 5133023 - DNA, 22 bp, Homo sapiens
acactatggtatttgagtgttt

SEQ ID NO: 5133024 - DNA, 13 bp, Homo sapiens
acactatgtgtgt

SEQ ID NO: 5133025 - DNA, 20 bp, Homo sapiens
acactatgtgtgttgtttcc

SEQ ID NO: 5133026 - DNA, 13 bp, Homo sapiens
acactattacagt

SEQ ID NO: 5133027 - DNA, 14 bp, Homo sapiens
acactattacagta

SEQ ID NO: 5133028 - DNA, 20 bp, Homo sapiens
acactattacagtattgcta

SEQ ID NO: 5133029 - DNA, 15 bp, Homo sapiens
acactattatttcct

SEQ ID NO: 5133030 - DNA, 21 bp, Homo sapiens
acactatttgagttggccaag

SEQ ID NO: 5133031 - DNA, 14 bp, Homo sapiens
acactatttgtgac

SEQ ID NO: 5133032 - DNA, 16 bp, Homo sapiens
acactatttgtgactt

SEQ ID NO: 5133033 - DNA, 21 bp, Homo sapiens
acactatttgtgactttttaa

SEQ ID NO: 5133034 - DNA, 20 bp, Homo sapiens
acactatttttttttctttt

SEQ ID NO: 5133035 - DNA, 21 bp, Homo sapiens
acactcaaaagacaaacatgc

SEQ ID NO: 5133036 - DNA, 14 bp, Homo sapiens
acactcaaactttg

SEQ ID NO: 5133037 - DNA, 13 bp, Homo sapiens
acactcaaatcaa

SEQ ID NO: 5133038 - DNA, 17 bp, Homo sapiens
acactcaaatcaagaaa

SEQ ID NO: 5133039 - DNA, 15 bp, Homo sapiens
acactcaaggaaaag

SEQ ID NO: 5133040 - DNA, 23 bp, Homo sapiens
acactcaaggacaggagcctggt

SEQ ID NO: 5133041 - DNA, 16 bp, Homo sapiens
acactcaagtgccatt

SEQ ID NO: 5133042 - DNA, 15 bp, Homo sapiens
acactcaataaacag

SEQ ID NO: 5133043 - DNA, 17 bp, Homo sapiens
acactcaataaacagtc

SEQ ID NO: 5133044 - DNA, 20 bp, Homo sapiens
acactcaataaacagtcact

SEQ ID NO: 5133045 - DNA, 15 bp, Homo sapiens
acactcaccagtggc

SEQ ID NO: 5133046 - DNA, 18 bp, Homo sapiens
acactcaccagtggcctt

SEQ ID NO: 5133047 - DNA, 22 bp, Homo sapiens
acactcaccagtggcctttcag

SEQ ID NO: 5133048 - DNA, 17 bp, Homo sapiens
acactcaccccagcctc

SEQ ID NO: 5133049 - DNA, 13 bp, Homo sapiens
acactcagaaaat

SEQ ID NO: 5133050 - DNA, 21 bp, Homo sapiens
acactcagaaaattccctggg

SEQ ID NO: 5133051 - DNA, 14 bp, Homo sapiens
acactcagaagcct

SEQ ID NO: 5133052 - DNA, 14 bp, Homo sapiens
acactcagaccagc

SEQ ID NO: 5133053 - DNA, 13 bp, Homo sapiens
acactcagcacaa

SEQ ID NO: 5133054 - DNA, 16 bp, Homo sapiens
acactcagcacaaggc

SEQ ID NO: 5133055 - DNA, 22 bp, Homo sapiens
acactcagcacccccttctctg

SEQ ID NO: 5133056 - DNA, 14 bp, Homo sapiens
acactcagccactg

SEQ ID NO: 5133057 - DNA, 20 bp, Homo sapiens
acactcagctgttcagattg

SEQ ID NO: 5133058 - DNA, 12 bp, Homo sapiens
acactcaggcct

SEQ ID NO: 5133059 - DNA, 21 bp, Homo sapiens
acactcaggcctgtgcccact

SEQ ID NO: 5133060 - DNA, 21 bp, Homo sapiens
acactcagggcagctgcctgg

SEQ ID NO: 5133061 - DNA, 20 bp, Homo sapiens
acactcagtccactgttgag

SEQ ID NO: 5133062 - DNA, 22 bp, Homo sapiens
acactcagtggcccatggcatt

SEQ ID NO: 5133063 - DNA, 21 bp, Homo sapiens
acactcagtgggctgtttctg

SEQ ID NO: 5133064 - DNA, 22 bp, Homo sapiens
acactcagtgggctgtttctgc

SEQ ID NO: 5133065 - DNA, 16 bp, Homo sapiens
acactcagttctgctc

SEQ ID NO: 5133066 - DNA, 18 bp, Homo sapiens
acactcatattgccctaa

SEQ ID NO: 5133067 - DNA, 13 bp, Homo sapiens
acactcatccctg

SEQ ID NO: 5133068 - DNA, 19 bp, Homo sapiens
acactcatgcattgtcctc

SEQ ID NO: 5133069 - DNA, 21 bp, Homo sapiens
acactcatggggaagcttcca

SEQ ID NO: 5133070 - DNA, 16 bp, Homo sapiens
acactcattgacctga

SEQ ID NO: 5133071 - DNA, 18 bp, Homo sapiens
acactccaccccctccag

SEQ ID NO: 5133072 - DNA, 20 bp, Homo sapiens
acactccacctccagcacgc

SEQ ID NO: 5133073 - DNA, 12 bp, Homo sapiens
acactccactga

SEQ ID NO: 5133074 - DNA, 13 bp, Homo sapiens
acactccaggccc

SEQ ID NO: 5133075 - DNA, 14 bp, Homo sapiens
acactccaggccct

SEQ ID NO: 5133076 - DNA, 16 bp, Homo sapiens
acactccaggccctgc

SEQ ID NO: 5133077 - DNA, 22 bp, Homo sapiens
acactccaggccctgccccctc

SEQ ID NO: 5133078 - DNA, 14 bp, Homo sapiens
acactccaggcctc

SEQ ID NO: 5133079 - DNA, 16 bp, Homo sapiens
acactccagtgccagc

SEQ ID NO: 5133080 - DNA, 16 bp, Homo sapiens
acactccatctcctgc

SEQ ID NO: 5133081 - DNA, 21 bp, Homo sapiens
acactcccaaggttggagccc

SEQ ID NO: 5133082 - DNA, 15 bp, Homo sapiens
acactcccccctcca

SEQ ID NO: 5133083 - DNA, 23 bp, Homo sapiens
acactccccgcctgtcctgcctc

SEQ ID NO: 5133084 - DNA, 19 bp, Homo sapiens
acactccccgccttagagc

SEQ ID NO: 5133085 - DNA, 15 bp, Homo sapiens
acactcccctgcact

SEQ ID NO: 5133086 - DNA, 16 bp, Homo sapiens
acactccctctccttg

SEQ ID NO: 5133087 - DNA, 14 bp, Homo sapiens
acactcccttgggc

SEQ ID NO: 5133088 - DNA, 20 bp, Homo sapiens
acactcctagagaacgcagc

SEQ ID NO: 5133089 - DNA, 23 bp, Homo sapiens
acactcctagagaacgcagccct

SEQ ID NO: 5133090 - DNA, 14 bp, Homo sapiens
acactcctcctgcc

SEQ ID NO: 5133091 - DNA, 17 bp, Homo sapiens
acactcctcctgccagc

SEQ ID NO: 5133092 - DNA, 19 bp, Homo sapiens
acactcctcctgccagctc

SEQ ID NO: 5133093 - DNA, 18 bp, Homo sapiens
acactcctctatcatgca

SEQ ID NO: 5133094 - DNA, 12 bp, Homo sapiens
acactcctctgc

SEQ ID NO: 5133095 - DNA, 14 bp, Homo sapiens
acactcctctgcgt

SEQ ID NO: 5133096 - DNA, 22 bp, Homo sapiens
acactccttccccttgtccctg

SEQ ID NO: 5133097 - DNA, 13 bp, Homo sapiens
acactccttgaaa

SEQ ID NO: 5133098 - DNA, 24 bp, Homo sapiens
acactcgcccgcccactgtcctgg

SEQ ID NO: 5133099 - DNA, 19 bp, Homo sapiens
acactcgggttaagaaata

SEQ ID NO: 5133100 - DNA, 20 bp, Homo sapiens
acactcgggttaagaaatac

SEQ ID NO: 5133101 - DNA, 17 bp, Homo sapiens
acactcgtatgatactt

SEQ ID NO: 5133102 - DNA, 14 bp, Homo sapiens
acactcgtgtgcat

SEQ ID NO: 5133103 - DNA, 19 bp, Homo sapiens
acactcgtgtgcccaccag

SEQ ID NO: 5133104 - DNA, 15 bp, Homo sapiens
acactctaaataaat

SEQ ID NO: 5133105 - DNA, 16 bp, Homo sapiens
acactctaactgtata

SEQ ID NO: 5133106 - DNA, 17 bp, Homo sapiens
acactctaactgtatat

SEQ ID NO: 5133107 - DNA, 23 bp, Homo sapiens
acactctagtgacttcctggtga

SEQ ID NO: 5133108 - DNA, 18 bp, Homo sapiens
acactctatatgtagtgc

SEQ ID NO: 5133109 - DNA, 22 bp, Homo sapiens
acactctatatgtagtgcattt

SEQ ID NO: 5133110 - DNA, 21 bp, Homo sapiens
acactctcactatgctgctat

SEQ ID NO: 5133111 - DNA, 16 bp, Homo sapiens
acactctcctgggccc

SEQ ID NO: 5133112 - DNA, 17 bp, Homo sapiens
acactctcctgggcccc

SEQ ID NO: 5133113 - DNA, 21 bp, Homo sapiens
acactctcctgggcccctccc

SEQ ID NO: 5133114 - DNA, 13 bp, Homo sapiens
acactctctgcag

SEQ ID NO: 5133115 - DNA, 22 bp, Homo sapiens
acactctctgtacaaaaacaaa

SEQ ID NO: 5133116 - DNA, 17 bp, Homo sapiens
acactctgacaagctgg

SEQ ID NO: 5133117 - DNA, 13 bp, Homo sapiens
acactctgagact

SEQ ID NO: 5133118 - DNA, 16 bp, Homo sapiens
acactctgcagactgc

SEQ ID NO: 5133119 - DNA, 13 bp, Homo sapiens
acactctgctctg

SEQ ID NO: 5133120 - DNA, 14 bp, Homo sapiens
acactctgctctgc

SEQ ID NO: 5133121 - DNA, 12 bp, Homo sapiens
acactctgctgt

SEQ ID NO: 5133122 - DNA, 20 bp, Homo sapiens
acactctgggctccagagtg

SEQ ID NO: 5133123 - DNA, 13 bp, Homo sapiens
acactcttacacc

SEQ ID NO: 5133124 - DNA, 22 bp, Homo sapiens
acactcttagctatgttgacat

SEQ ID NO: 5133125 - DNA, 13 bp, Homo sapiens
acactcttcagtg

SEQ ID NO: 5133126 - DNA, 19 bp, Homo sapiens
acactcttcagtgactcct

SEQ ID NO: 5133127 - DNA, 22 bp, Homo sapiens
acactcttcagtgactcctgct

SEQ ID NO: 5133128 - DNA, 17 bp, Homo sapiens
acactctttctcctgct

SEQ ID NO: 5133129 - DNA, 12 bp, Homo sapiens
acactctttgta

SEQ ID NO: 5133130 - DNA, 16 bp, Homo sapiens
acactgaaaaattata

SEQ ID NO: 5133131 - DNA, 18 bp, Homo sapiens
acactgaaagttttgtaa

SEQ ID NO: 5133132 - DNA, 23 bp, Homo sapiens
acactgaaagttttgtaaaagaa

SEQ ID NO: 5133133 - DNA, 12 bp, Homo sapiens
acactgaaataa

SEQ ID NO: 5133134 - DNA, 18 bp, Homo sapiens
acactgaaatatacacac

SEQ ID NO: 5133135 - DNA, 14 bp, Homo sapiens
acactgaaatccaa

SEQ ID NO: 5133136 - DNA, 14 bp, Homo sapiens
acactgaaatgcct

SEQ ID NO: 5133137 - DNA, 15 bp, Homo sapiens
acactgaaatgcctt

SEQ ID NO: 5133138 - DNA, 14 bp, Homo sapiens
acactgaaattcta

SEQ ID NO: 5133139 - DNA, 17 bp, Homo sapiens
acactgaaattctaaat

SEQ ID NO: 5133140 - DNA, 18 bp, Homo sapiens
acactgaaattgcctgaa

SEQ ID NO: 5133141 - DNA, 12 bp, Homo sapiens
acactgaagaag

SEQ ID NO: 5133142 - DNA, 17 bp, Homo sapiens
acactgaagtcagttct

SEQ ID NO: 5133143 - DNA, 18 bp, Homo sapiens
acactgaagtgcttgcag

SEQ ID NO: 5133144 - DNA, 23 bp, Homo sapiens
acactgaatatttatatttcact

SEQ ID NO: 5133145 - DNA, 21 bp, Homo sapiens
acactgaatctcccctcctca

SEQ ID NO: 5133146 - DNA, 19 bp, Homo sapiens
acactgacaaagtcatccc

SEQ ID NO: 5133147 - DNA, 22 bp, Homo sapiens
acactgacaaagtcatcccctc

SEQ ID NO: 5133148 - DNA, 22 bp, Homo sapiens
acactgacacctttgcaggcat

SEQ ID NO: 5133149 - DNA, 16 bp, Homo sapiens
acactgacttggtgca

SEQ ID NO: 5133150 - DNA, 12 bp, Homo sapiens
acactgagaaag

SEQ ID NO: 5133151 - DNA, 21 bp, Homo sapiens
acactgagaaatagtgcactc

SEQ ID NO: 5133152 - DNA, 19 bp, Homo sapiens
acactgagagcctttttga

SEQ ID NO: 5133153 - DNA, 15 bp, Homo sapiens
acactgagatccaga

SEQ ID NO: 5133154 - DNA, 17 bp, Homo sapiens
acactgagccccacctc

SEQ ID NO: 5133155 - DNA, 21 bp, Homo sapiens
acactgagccccacctctcca

SEQ ID NO: 5133156 - DNA, 19 bp, Homo sapiens
acactgagctgtgacccag

SEQ ID NO: 5133157 - DNA, 17 bp, Homo sapiens
acactgaggcagggaag

SEQ ID NO: 5133158 - DNA, 13 bp, Homo sapiens
acactgagtgaaa

SEQ ID NO: 5133159 - DNA, 18 bp, Homo sapiens
acactgagtgaaatatta

SEQ ID NO: 5133160 - DNA, 22 bp, Homo sapiens
acactgatgcaaggattacaga

SEQ ID NO: 5133161 - DNA, 13 bp, Homo sapiens
acactgatgggct

SEQ ID NO: 5133162 - DNA, 14 bp, Homo sapiens
acactgatgggctg

SEQ ID NO: 5133163 - DNA, 23 bp, Homo sapiens
acactgattacttttgggagggg

SEQ ID NO: 5133164 - DNA, 17 bp, Homo sapiens
acactgattcattctta

SEQ ID NO: 5133165 - DNA, 19 bp, Homo sapiens
acactgcaatcatatgtga

SEQ ID NO: 5133166 - DNA, 16 bp, Homo sapiens
acactgcacaataact

SEQ ID NO: 5133167 - DNA, 23 bp, Homo sapiens
acactgcacaataactcctccca

SEQ ID NO: 5133168 - DNA, 11 bp, Homo sapiens
acactgcacag

SEQ ID NO: 5133169 - DNA, 14 bp, Homo sapiens
acactgcaccctcc

SEQ ID NO: 5133170 - DNA, 15 bp, Homo sapiens
acactgcaccctcca

SEQ ID NO: 5133171 - DNA, 17 bp, Homo sapiens
acactgcactttgttta

SEQ ID NO: 5133172 - DNA, 16 bp, Homo sapiens
acagcctccccttccc

SEQ ID NO: 5133173 - DNA, 17 bp, Homo sapiens
acagcctccccttccca

SEQ ID NO: 5133174 - DNA, 20 bp, Homo sapiens
acagcctccccttcccagac

SEQ ID NO: 5133175 - DNA, 16 bp, Homo sapiens
acagcctccctgagcc

SEQ ID NO: 5133176 - DNA, 19 bp, Homo sapiens
acagcctccctgagcctgc

SEQ ID NO: 5133177 - DNA, 20 bp, Homo sapiens
acagcctccctgagcctgca

SEQ ID NO: 5133178 - DNA, 17 bp, Homo sapiens
acagcctccgcggactg

SEQ ID NO: 5133179 - DNA, 12 bp, Homo sapiens
acagcctcctag

SEQ ID NO: 5133180 - DNA, 15 bp, Homo sapiens
acagcctcctaggct

SEQ ID NO: 5133181 - DNA, 20 bp, Homo sapiens
acagcctcctaggctccctg

SEQ ID NO: 5133182 - DNA, 22 bp, Homo sapiens
acagcctcctctgtctgccctt

SEQ ID NO: 5133183 - DNA, 15 bp, Homo sapiens
acagcctctacagcc

SEQ ID NO: 5133184 - DNA, 13 bp, Homo sapiens
acagcctctccct

SEQ ID NO: 5133185 - DNA, 16 bp, Homo sapiens
acagcctctgacccct

SEQ ID NO: 5133186 - DNA, 19 bp, Homo sapiens
acagcctcttcagcccctt

SEQ ID NO: 5133187 - DNA, 23 bp, Homo sapiens
acagcctcttctgtcccaagtct

SEQ ID NO: 5133188 - DNA, 17 bp, Homo sapiens
acagcctgacaacattt

SEQ ID NO: 5133189 - DNA, 21 bp, Homo sapiens
acagcctgacaacatttctat

SEQ ID NO: 5133190 - DNA, 13 bp, Homo sapiens
acagcctgagaaa

SEQ ID NO: 5133191 - DNA, 12 bp, Homo sapiens
acagcctgagcc

SEQ ID NO: 5133192 - DNA, 23 bp, Homo sapiens
acagcctgcacacacctgcctgc

SEQ ID NO: 5133193 - DNA, 16 bp, Homo sapiens
acagcctgcacagtgg

SEQ ID NO: 5133194 - DNA, 15 bp, Homo sapiens
acagcctgctggcag

SEQ ID NO: 5133195 - DNA, 20 bp, Homo sapiens
acagcctgctggcagggcca

SEQ ID NO: 5133196 - DNA, 12 bp, Homo sapiens
acagcctggact

SEQ ID NO: 5133197 - DNA, 11 bp, Homo sapiens
acagcctggca

SEQ ID NO: 5133198 - DNA, 14 bp, Homo sapiens
acagcctggcacag

SEQ ID NO: 5133199 - DNA, 12 bp, Homo sapiens
acagcctggctg

SEQ ID NO: 5133200 - DNA, 18 bp, Homo sapiens
acagcctgggccccagct

SEQ ID NO: 5133201 - DNA, 13 bp, Homo sapiens
acagcctgtctct

SEQ ID NO: 5133202 - DNA, 20 bp, Homo sapiens
acagcctgtcttcagatcct

SEQ ID NO: 5133203 - DNA, 21 bp, Homo sapiens
acagcctgtcttgtcaggtgg

SEQ ID NO: 5133204 - DNA, 14 bp, Homo sapiens
acagcctgtgtctt

SEQ ID NO: 5133205 - DNA, 20 bp, Homo sapiens
acagcctgtgtgcagtggag

SEQ ID NO: 5133206 - DNA, 18 bp, Homo sapiens
acagcctgtttctatcct

SEQ ID NO: 5133207 - DNA, 19 bp, Homo sapiens
acagccttagagctcttgt

SEQ ID NO: 5133208 - DNA, 19 bp, Homo sapiens
acagccttagctgccagtg

SEQ ID NO: 5133209 - DNA, 15 bp, Homo sapiens
acagccttattttgt

SEQ ID NO: 5133210 - DNA, 23 bp, Homo sapiens
acagccttattttgttggtgctt

SEQ ID NO: 5133211 - DNA, 18 bp, Homo sapiens
acagccttatttttgtat

SEQ ID NO: 5133212 - DNA, 23 bp, Homo sapiens
acagccttatttttgtatgcctt

SEQ ID NO: 5133213 - DNA, 18 bp, Homo sapiens
acagccttccccagctcc

SEQ ID NO: 5133214 - DNA, 15 bp, Homo sapiens
acagccttccctctg

SEQ ID NO: 5133215 - DNA, 16 bp, Homo sapiens
acagccttccttctgc

SEQ ID NO: 5133216 - DNA, 17 bp, Homo sapiens
acagccttccttctgct

SEQ ID NO: 5133217 - DNA, 17 bp, Homo sapiens
acagccttcttgatgta

SEQ ID NO: 5133218 - DNA, 21 bp, Homo sapiens
acagccttgcaacccaaggtg

SEQ ID NO: 5133219 - DNA, 17 bp, Homo sapiens
acagccttgcagcggct

SEQ ID NO: 5133220 - DNA, 12 bp, Homo sapiens
acagccttgggc

SEQ ID NO: 5133221 - DNA, 16 bp, Homo sapiens
acagccttgtccccct

SEQ ID NO: 5133222 - DNA, 14 bp, Homo sapiens
acagcctttctgta

SEQ ID NO: 5133223 - DNA, 15 bp, Homo sapiens
acagcctttctgtat

SEQ ID NO: 5133224 - DNA, 23 bp, Homo sapiens
acagcctttctgtatcaagcccc

SEQ ID NO: 5133225 - DNA, 13 bp, Homo sapiens
acagcctttgaat

SEQ ID NO: 5133226 - DNA, 14 bp, Homo sapiens
acagcctttgaatg

SEQ ID NO: 5133227 - DNA, 17 bp, Homo sapiens
acagcctttttgtaatt

SEQ ID NO: 5133228 - DNA, 17 bp, Homo sapiens
acagcgaactagaagaa

SEQ ID NO: 5133229 - DNA, 19 bp, Homo sapiens
acagcgaagtagcttgctc

SEQ ID NO: 5133230 - DNA, 14 bp, Homo sapiens
acagcgacatagcc

SEQ ID NO: 5133231 - DNA, 14 bp, Homo sapiens
acagcgagaggcag

SEQ ID NO: 5133232 - DNA, 13 bp, Homo sapiens
acagcgagcctgt

SEQ ID NO: 5133233 - DNA, 23 bp, Homo sapiens
acagcgagggcagctgctattta

SEQ ID NO: 5133234 - DNA, 17 bp, Homo sapiens
acagcgataagctttca

SEQ ID NO: 5133235 - DNA, 18 bp, Homo sapiens
acagcgccatgtgtgtca

SEQ ID NO: 5133236 - DNA, 21 bp, Homo sapiens
acagcgcccaaaggacgcact

SEQ ID NO: 5133237 - DNA, 14 bp, Homo sapiens
acagcgcccctgct

SEQ ID NO: 5133238 - DNA, 15 bp, Homo sapiens
acagcgcccctgctg

SEQ ID NO: 5133239 - DNA, 15 bp, Homo sapiens
acagcgcggaggagg

SEQ ID NO: 5133240 - DNA, 22 bp, Homo sapiens
acagcgctcgatggacctcagc

SEQ ID NO: 5133241 - DNA, 22 bp, Homo sapiens
acagcggaggagaccagctcag

SEQ ID NO: 5133242 - DNA, 18 bp, Homo sapiens
acagcggagtctgtcctg

SEQ ID NO: 5133243 - DNA, 17 bp, Homo sapiens
acagcggcagtgggcct

SEQ ID NO: 5133244 - DNA, 13 bp, Homo sapiens
acagcggcccctg

SEQ ID NO: 5133245 - DNA, 13 bp, Homo sapiens
acagcggcccggc

SEQ ID NO: 5133246 - DNA, 14 bp, Homo sapiens
acagcggcccggcc

SEQ ID NO: 5133247 - DNA, 15 bp, Homo sapiens
acagcggcccggccc

SEQ ID NO: 5133248 - DNA, 19 bp, Homo sapiens
acagcggctggacttggag

SEQ ID NO: 5133249 - DNA, 14 bp, Homo sapiens
acagcgggctgtgc

SEQ ID NO: 5133250 - DNA, 15 bp, Homo sapiens
acagcgggctgtgcc

SEQ ID NO: 5133251 - DNA, 14 bp, Homo sapiens
acagcggggaaggt

SEQ ID NO: 5133252 - DNA, 13 bp, Homo sapiens
acagcggttgtaa

SEQ ID NO: 5133253 - DNA, 16 bp, Homo sapiens
acagcggttgtaaata

SEQ ID NO: 5133254 - DNA, 18 bp, Homo sapiens
acagcggttgtaaataca

SEQ ID NO: 5133255 - DNA, 19 bp, Homo sapiens
acagcgtaacggagggtga

SEQ ID NO: 5133256 - DNA, 21 bp, Homo sapiens
acagcgtccctagcagtgaac

SEQ ID NO: 5133257 - DNA, 23 bp, Homo sapiens
acagcgtccggggtggtggacag

SEQ ID NO: 5133258 - DNA, 15 bp, Homo sapiens
acagcgtctgctcat

SEQ ID NO: 5133259 - DNA, 19 bp, Homo sapiens
acagcgtgctggcgacact

SEQ ID NO: 5133260 - DNA, 16 bp, Homo sapiens
acagcgttatgtgtct

SEQ ID NO: 5133261 - DNA, 16 bp, Homo sapiens
acagcgtttaagactg

SEQ ID NO: 5133262 - DNA, 14 bp, Homo sapiens
acagctaaatcatt

SEQ ID NO: 5133263 - DNA, 14 bp, Homo sapiens
acagctaacatgga

SEQ ID NO: 5133264 - DNA, 17 bp, Homo sapiens
acagctaatgggacact

SEQ ID NO: 5133265 - DNA, 21 bp, Homo sapiens
acagctacaacagcctcactt

SEQ ID NO: 5133266 - DNA, 23 bp, Homo sapiens
acagctacaaccctaccctggca

SEQ ID NO: 5133267 - DNA, 20 bp, Homo sapiens
acagctacagctttgggtca

SEQ ID NO: 5133268 - DNA, 15 bp, Homo sapiens
acagctacctgagac

SEQ ID NO: 5133269 - DNA, 18 bp, Homo sapiens
acagctactaacctggag

SEQ ID NO: 5133270 - DNA, 22 bp, Homo sapiens
acagctactcagatctgcactc

SEQ ID NO: 5133271 - DNA, 14 bp, Homo sapiens
acagctactttaac

SEQ ID NO: 5133272 - DNA, 22 bp, Homo sapiens
acagctaggacttaaccttgaa

SEQ ID NO: 5133273 - DNA, 19 bp, Homo sapiens
acagctaggctgagatgca

SEQ ID NO: 5133274 - DNA, 14 bp, Homo sapiens
acagctagtagaca

SEQ ID NO: 5133275 - DNA, 20 bp, Homo sapiens
acagctagtgaagaccagag

SEQ ID NO: 5133276 - DNA, 21 bp, Homo sapiens
acagctagtgaagaccagagc

SEQ ID NO: 5133277 - DNA, 15 bp, Homo sapiens
acagctatatttctg

SEQ ID NO: 5133278 - DNA, 22 bp, Homo sapiens
acagctatatttgattatgtat

SEQ ID NO: 5133279 - DNA, 20 bp, Homo sapiens
acagctattggcaagtttta

SEQ ID NO: 5133280 - DNA, 22 bp, Homo sapiens
acagctattggcaagttttaaa

SEQ ID NO: 5133281 - DNA, 20 bp, Homo sapiens
acagctatttcccttttctg

SEQ ID NO: 5133282 - DNA, 19 bp, Homo sapiens
acagctcacggcagcctca

SEQ ID NO: 5133283 - DNA, 18 bp, Homo sapiens
acagctcagaagtttctt

SEQ ID NO: 5133284 - DNA, 12 bp, Homo sapiens
acagctcagcag

SEQ ID NO: 5133285 - DNA, 13 bp, Homo sapiens
acagctcagccag

SEQ ID NO: 5133286 - DNA, 14 bp, Homo sapiens
acagctcagccagt

SEQ ID NO: 5133287 - DNA, 20 bp, Homo sapiens
acagctcagccagtggggat

SEQ ID NO: 5133288 - DNA, 21 bp, Homo sapiens
acagctcagccagtggggatg

SEQ ID NO: 5133289 - DNA, 12 bp, Homo sapiens
acagctcagctg

SEQ ID NO: 5133290 - DNA, 17 bp, Homo sapiens
acagctcagctgcccat

SEQ ID NO: 5133291 - DNA, 23 bp, Homo sapiens
acagctcagctgcccatcccagt

SEQ ID NO: 5133292 - DNA, 14 bp, Homo sapiens
acagctcaggaggc

SEQ ID NO: 5133293 - DNA, 16 bp, Homo sapiens
acagctcattaaactt

SEQ ID NO: 5133294 - DNA, 17 bp, Homo sapiens
acagctccaccctggcc

SEQ ID NO: 5133295 - DNA, 13 bp, Homo sapiens
acagctcccaccc

SEQ ID NO: 5133296 - DNA, 14 bp, Homo sapiens
acagctcccacccc

SEQ ID NO: 5133297 - DNA, 15 bp, Homo sapiens
acagctcccacccca

SEQ ID NO: 5133298 - DNA, 16 bp, Homo sapiens
acagctcccaccccac

SEQ ID NO: 5133299 - DNA, 16 bp, Homo sapiens
acagctcccccagctc

SEQ ID NO: 5133300 - DNA, 14 bp, Homo sapiens
acagctccctctgc

SEQ ID NO: 5133301 - DNA, 14 bp, Homo sapiens
acagctcctcccac

SEQ ID NO: 5133302 - DNA, 13 bp, Homo sapiens
acagctcctcccc

SEQ ID NO: 5133303 - DNA, 15 bp, Homo sapiens
acagctcctcccctg

SEQ ID NO: 5133304 - DNA, 20 bp, Homo sapiens
acagctcctcccctgccgcc

SEQ ID NO: 5133305 - DNA, 13 bp, Homo sapiens
acagctcctgcca

SEQ ID NO: 5133306 - DNA, 18 bp, Homo sapiens
acagctccttactctgag

SEQ ID NO: 5133307 - DNA, 14 bp, Homo sapiens
acagctccttctgt

SEQ ID NO: 5133308 - DNA, 23 bp, Homo sapiens
acagctccttctgtcctactctg

SEQ ID NO: 5133309 - DNA, 20 bp, Homo sapiens
acagctccttgggaggaagc

SEQ ID NO: 5133310 - DNA, 20 bp, Homo sapiens
acagctccttttccagagca

SEQ ID NO: 5133311 - DNA, 15 bp, Homo sapiens
acagctcgatccaaa

SEQ ID NO: 5133312 - DNA, 18 bp, Homo sapiens
acagctcggagttgtgag

SEQ ID NO: 5133313 - DNA, 13 bp, Homo sapiens
acagctctcccct

SEQ ID NO: 5133314 - DNA, 16 bp, Homo sapiens
acagctctcctccagc

SEQ ID NO: 5133315 - DNA, 19 bp, Homo sapiens
acagctctgagatcctgga

SEQ ID NO: 5133316 - DNA, 20 bp, Homo sapiens
acagctctgcatactcatta

SEQ ID NO: 5133317 - DNA, 17 bp, Homo sapiens
acagctctgggcctctt

SEQ ID NO: 5133318 - DNA, 22 bp, Homo sapiens
acagctctgggcctctttttgc

SEQ ID NO: 5133319 - DNA, 13 bp, Homo sapiens
acagctctgtcct

SEQ ID NO: 5133320 - DNA, 17 bp, Homo sapiens
acagctctgtcctggga

SEQ ID NO: 5133321 - DNA, 19 bp, Homo sapiens
acagctctgtgttgccatg

SEQ ID NO: 5133322 - DNA, 16 bp, Homo sapiens
acagctcttaaatgta

SEQ ID NO: 5133323 - DNA, 21 bp, Homo sapiens
acagctcttcactcagccaca

SEQ ID NO: 5133324 - DNA, 17 bp, Homo sapiens
acagctcttccagggca

SEQ ID NO: 5133325 - DNA, 17 bp, Homo sapiens
acagctcttctaaggaa

SEQ ID NO: 5133326 - DNA, 22 bp, Homo sapiens
acagctcttctcagtgtctgaa

SEQ ID NO: 5133327 - DNA, 19 bp, Homo sapiens
acagctcttctccaggctg

SEQ ID NO: 5133328 - DNA, 13 bp, Homo sapiens
acagctcttcttg

SEQ ID NO: 5133329 - DNA, 16 bp, Homo sapiens
acagctcttggcattt

SEQ ID NO: 5133330 - DNA, 18 bp, Homo sapiens
acagctctttaacatggt

SEQ ID NO: 5133331 - DNA, 19 bp, Homo sapiens
acagctctttttgtgaagt

SEQ ID NO: 5133332 - DNA, 18 bp, Homo sapiens
acagctgaaagaggagga

SEQ ID NO: 5133333 - DNA, 19 bp, Homo sapiens
acagctgaagaaaatgagc

SEQ ID NO: 5133334 - DNA, 12 bp, Homo sapiens
acagctgacaga

SEQ ID NO: 5133335 - DNA, 14 bp, Homo sapiens
acagctgacagata

SEQ ID NO: 5133336 - DNA, 20 bp, Homo sapiens
acagctgacggtttctcccc

SEQ ID NO: 5133337 - DNA, 18 bp, Homo sapiens
acagctgactgaatgcag

SEQ ID NO: 5133338 - DNA, 16 bp, Homo sapiens
acagctgagagacttt

SEQ ID NO: 5133339 - DNA, 20 bp, Homo sapiens
acagctgaggaccctcagcc

SEQ ID NO: 5133340 - DNA, 21 bp, Homo sapiens
acagctgataaatttaatcct

SEQ ID NO: 5133341 - DNA, 21 bp, Homo sapiens
acagctgcagcccatcctccc

SEQ ID NO: 5133342 - DNA, 15 bp, Homo sapiens
acagctgcagctggg

SEQ ID NO: 5133343 - DNA, 18 bp, Homo sapiens
acagctgcagctgggccc

SEQ ID NO: 5133344 - DNA, 15 bp, Homo sapiens
acagctgcaggccac

SEQ ID NO: 5133345 - DNA, 17 bp, Homo sapiens
acagctgccctagctga

SEQ ID NO: 5133346 - DNA, 15 bp, Homo sapiens
acagctgccctgctg

SEQ ID NO: 5133347 - DNA, 15 bp, Homo sapiens
acagctgcctcttcc

SEQ ID NO: 5133348 - DNA, 15 bp, Homo sapiens
acagctgccttagct

SEQ ID NO: 5133349 - DNA, 16 bp, Homo sapiens
acagctgccttagctt

SEQ ID NO: 5133350 - DNA, 21 bp, Homo sapiens
acagctgctcctagagggagg

SEQ ID NO: 5133351 - DNA, 14 bp, Homo sapiens
acagctgctgaaga

SEQ ID NO: 5133352 - DNA, 23 bp, Homo sapiens
acactgcactttgtttagaaaaa

SEQ ID NO: 5133353 - DNA, 17 bp, Homo sapiens
acactgcagccctctcc

SEQ ID NO: 5133354 - DNA, 16 bp, Homo sapiens
acactgcaggcatcac

SEQ ID NO: 5133355 - DNA, 15 bp, Homo sapiens
acactgcagggagga

SEQ ID NO: 5133356 - DNA, 16 bp, Homo sapiens
acactgcagggaggag

SEQ ID NO: 5133357 - DNA, 17 bp, Homo sapiens
acactgcagtttcctgg

SEQ ID NO: 5133358 - DNA, 16 bp, Homo sapiens
acactgcatctcaaga

SEQ ID NO: 5133359 - DNA, 11 bp, Homo sapiens
acactgccaaa

SEQ ID NO: 5133360 - DNA, 17 bp, Homo sapiens
acactgccaaacatcag

SEQ ID NO: 5133361 - DNA, 17 bp, Homo sapiens
acactgccaaataaaca

SEQ ID NO: 5133362 - DNA, 17 bp, Homo sapiens
acactgccagaagagaa

SEQ ID NO: 5133363 - DNA, 11 bp, Homo sapiens
acactgccagc

SEQ ID NO: 5133364 - DNA, 20 bp, Homo sapiens
acactgccagccgccaccgg

SEQ ID NO: 5133365 - DNA, 18 bp, Homo sapiens
acactgccatattgtgta

SEQ ID NO: 5133366 - DNA, 15 bp, Homo sapiens
acactgccctcgcac

SEQ ID NO: 5133367 - DNA, 21 bp, Homo sapiens
acactgcctatatatgtaaat

SEQ ID NO: 5133368 - DNA, 14 bp, Homo sapiens
acactgcctctgag

SEQ ID NO: 5133369 - DNA, 15 bp, Homo sapiens
acactgcctctgagt

SEQ ID NO: 5133370 - DNA, 13 bp, Homo sapiens
acactgcctgggc

SEQ ID NO: 5133371 - DNA, 16 bp, Homo sapiens
acactgcctgggctga

SEQ ID NO: 5133372 - DNA, 18 bp, Homo sapiens
acactgcctttgctgcct

SEQ ID NO: 5133373 - DNA, 19 bp, Homo sapiens
acactgcctttgctgcctt

SEQ ID NO: 5133374 - DNA, 22 bp, Homo sapiens
acactgcctttgctgccttctg

SEQ ID NO: 5133375 - DNA, 23 bp, Homo sapiens
acactgcctttttatttatatgt

SEQ ID NO: 5133376 - DNA, 15 bp, Homo sapiens
acactgcgaactctc

SEQ ID NO: 5133377 - DNA, 16 bp, Homo sapiens
acactgcgcaggtctc

SEQ ID NO: 5133378 - DNA, 20 bp, Homo sapiens
acactgcgcaggtctcttct

SEQ ID NO: 5133379 - DNA, 15 bp, Homo sapiens
acactgcgccccgcc

SEQ ID NO: 5133380 - DNA, 16 bp, Homo sapiens
acactgctaaatttac

SEQ ID NO: 5133381 - DNA, 17 bp, Homo sapiens
acactgctaaatttacg

SEQ ID NO: 5133382 - DNA, 18 bp, Homo sapiens
acactgctaggtgggcca

SEQ ID NO: 5133383 - DNA, 18 bp, Homo sapiens
acactgctcttaagaaac

SEQ ID NO: 5133384 - DNA, 20 bp, Homo sapiens
acactgctgaggcttcataa

SEQ ID NO: 5133385 - DNA, 11 bp, Homo sapiens
acactgctgca

SEQ ID NO: 5133386 - DNA, 19 bp, Homo sapiens
acactgctgcaccagagtg

SEQ ID NO: 5133387 - DNA, 12 bp, Homo sapiens
acactgctggga

SEQ ID NO: 5133388 - DNA, 23 bp, Homo sapiens
acactgctgtcctctcccccttc

SEQ ID NO: 5133389 - DNA, 22 bp, Homo sapiens
acactgcttctcggaggccagg

SEQ ID NO: 5133390 - DNA, 19 bp, Homo sapiens
acactgcttgtgtttttaa

SEQ ID NO: 5133391 - DNA, 20 bp, Homo sapiens
acactggaaaataaattttg

SEQ ID NO: 5133392 - DNA, 19 bp, Homo sapiens
acactggaacatggctagc

SEQ ID NO: 5133393 - DNA, 13 bp, Homo sapiens
acactggaatcca

SEQ ID NO: 5133394 - DNA, 14 bp, Homo sapiens
acactggaatccag

SEQ ID NO: 5133395 - DNA, 11 bp, Homo sapiens
acactggaccc

SEQ ID NO: 5133396 - DNA, 15 bp, Homo sapiens
acactggacctgggg

SEQ ID NO: 5133397 - DNA, 21 bp, Homo sapiens
acactggagaagaatatcaaa

SEQ ID NO: 5133398 - DNA, 21 bp, Homo sapiens
acactggaggagagaagaatg

SEQ ID NO: 5133399 - DNA, 12 bp, Homo sapiens
acactggagtgg

SEQ ID NO: 5133400 - DNA, 14 bp, Homo sapiens
acactggatatgtt

SEQ ID NO: 5133401 - DNA, 23 bp, Homo sapiens
acactggatcaagttcagccacc

SEQ ID NO: 5133402 - DNA, 18 bp, Homo sapiens
acactggcatctccctga

SEQ ID NO: 5133403 - DNA, 19 bp, Homo sapiens
acactggccccacaggagt

SEQ ID NO: 5133404 - DNA, 14 bp, Homo sapiens
acactggcccctca

SEQ ID NO: 5133405 - DNA, 13 bp, Homo sapiens
acactggccttcc

SEQ ID NO: 5133406 - DNA, 16 bp, Homo sapiens
acactggctctgggac

SEQ ID NO: 5133407 - DNA, 17 bp, Homo sapiens
acactggctctgggact

SEQ ID NO: 5133408 - DNA, 14 bp, Homo sapiens
acactggctgccag

SEQ ID NO: 5133409 - DNA, 18 bp, Homo sapiens
acactgggacttgcaaaa

SEQ ID NO: 5133410 - DNA, 20 bp, Homo sapiens
acactgggagaaatgaaaaa

SEQ ID NO: 5133411 - DNA, 17 bp, Homo sapiens
acactgggagaagagaa

SEQ ID NO: 5133412 - DNA, 18 bp, Homo sapiens
acactgggagaagagaac

SEQ ID NO: 5133413 - DNA, 22 bp, Homo sapiens
acactgggagaggtgccagcaa

SEQ ID NO: 5133414 - DNA, 22 bp, Homo sapiens
acactgggaggccgaggcaggg

SEQ ID NO: 5133415 - DNA, 16 bp, Homo sapiens
acactgggggagggga

SEQ ID NO: 5133416 - DNA, 17 bp, Homo sapiens
acactggggtctgtttc

SEQ ID NO: 5133417 - DNA, 13 bp, Homo sapiens
acactgggtggtg

SEQ ID NO: 5133418 - DNA, 19 bp, Homo sapiens
acactggtattcctgcctc

SEQ ID NO: 5133419 - DNA, 15 bp, Homo sapiens
acactggtcacaggc

SEQ ID NO: 5133420 - DNA, 10 bp, Homo sapiens
acactggtct

SEQ ID NO: 5133421 - DNA, 14 bp, Homo sapiens
acactggtgactgc

SEQ ID NO: 5133422 - DNA, 18 bp, Homo sapiens
acactggtgctgagtgac

SEQ ID NO: 5133423 - DNA, 17 bp, Homo sapiens
acactggtggaggagct

SEQ ID NO: 5133424 - DNA, 20 bp, Homo sapiens
acactggtgggcagctgagg

SEQ ID NO: 5133425 - DNA, 11 bp, Homo sapiens
acactggtggt

SEQ ID NO: 5133426 - DNA, 20 bp, Homo sapiens
acactggtgtgacctgaggg

SEQ ID NO: 5133427 - DNA, 16 bp, Homo sapiens
acactggttaaattaa

SEQ ID NO: 5133428 - DNA, 13 bp, Homo sapiens
acactggttctca

SEQ ID NO: 5133429 - DNA, 17 bp, Homo sapiens
acactggttctcaatga

SEQ ID NO: 5133430 - DNA, 22 bp, Homo sapiens
acactggtttggtcagttacaa

SEQ ID NO: 5133431 - DNA, 17 bp, Homo sapiens
acactgtaagctttgtt

SEQ ID NO: 5133432 - DNA, 14 bp, Homo sapiens
acactgtaataggg

SEQ ID NO: 5133433 - DNA, 19 bp, Homo sapiens
acactgtagtttttgaaaa

SEQ ID NO: 5133434 - DNA, 20 bp, Homo sapiens
acactgtagtttttgaaaat

SEQ ID NO: 5133435 - DNA, 20 bp, Homo sapiens
acactgtatctaaaaaataa

SEQ ID NO: 5133436 - DNA, 23 bp, Homo sapiens
acactgtatctaaaaaataactg

SEQ ID NO: 5133437 - DNA, 15 bp, Homo sapiens
acactgtatgactct

SEQ ID NO: 5133438 - DNA, 23 bp, Homo sapiens
acactgtattgtaagtggaaaat

SEQ ID NO: 5133439 - DNA, 15 bp, Homo sapiens
acactgtattttaat

SEQ ID NO: 5133440 - DNA, 16 bp, Homo sapiens
acactgtcaaacaggt

SEQ ID NO: 5133441 - DNA, 20 bp, Homo sapiens
acactgtcaaacatctggaa

SEQ ID NO: 5133442 - DNA, 16 bp, Homo sapiens
acactgtcaagattaa

SEQ ID NO: 5133443 - DNA, 14 bp, Homo sapiens
acactgtcagagct

SEQ ID NO: 5133444 - DNA, 16 bp, Homo sapiens
acactgtcagagctgt

SEQ ID NO: 5133445 - DNA, 23 bp, Homo sapiens
acactgtcagagctgttggcctc

SEQ ID NO: 5133446 - DNA, 16 bp, Homo sapiens
acactgtcatcaatgt

SEQ ID NO: 5133447 - DNA, 17 bp, Homo sapiens
acactgtcatcaatgtt

SEQ ID NO: 5133448 - DNA, 22 bp, Homo sapiens
acactgtcccaaggtgaaatga

SEQ ID NO: 5133449 - DNA, 21 bp, Homo sapiens
acactgtccctctttggcagt

SEQ ID NO: 5133450 - DNA, 20 bp, Homo sapiens
acactgtcctgtccggagcg

SEQ ID NO: 5133451 - DNA, 14 bp, Homo sapiens
acactgtctgcata

SEQ ID NO: 5133452 - DNA, 16 bp, Homo sapiens
acactgtctgctgccc

SEQ ID NO: 5133453 - DNA, 14 bp, Homo sapiens
acactgtctggggc

SEQ ID NO: 5133454 - DNA, 22 bp, Homo sapiens
acactgtctggtttcaccgagg

SEQ ID NO: 5133455 - DNA, 19 bp, Homo sapiens
acactgtcttcccgatgag

SEQ ID NO: 5133456 - DNA, 13 bp, Homo sapiens
acactgtcttgaa

SEQ ID NO: 5133457 - DNA, 22 bp, Homo sapiens
acactgtgaactaatgacaagt

SEQ ID NO: 5133458 - DNA, 16 bp, Homo sapiens
acactgtgacaatgac

SEQ ID NO: 5133459 - DNA, 19 bp, Homo sapiens
acactgtgacaatgactaa

SEQ ID NO: 5133460 - DNA, 18 bp, Homo sapiens
acactgtgacacactaca

SEQ ID NO: 5133461 - DNA, 21 bp, Homo sapiens
acactgtgacatctctattcc

SEQ ID NO: 5133462 - DNA, 17 bp, Homo sapiens
acactgtgagagttgtc

SEQ ID NO: 5133463 - DNA, 19 bp, Homo sapiens
acactgtgagagttgtctc

SEQ ID NO: 5133464 - DNA, 13 bp, Homo sapiens
acactgtgatttt

SEQ ID NO: 5133465 - DNA, 20 bp, Homo sapiens
acactgtgcacatctgtgtc

SEQ ID NO: 5133466 - DNA, 20 bp, Homo sapiens
acactgtgcaggcccaggca

SEQ ID NO: 5133467 - DNA, 15 bp, Homo sapiens
acactgtgctataaa

SEQ ID NO: 5133468 - DNA, 22 bp, Homo sapiens
acactgtgctgagtctgaaggc

SEQ ID NO: 5133469 - DNA, 15 bp, Homo sapiens
acactgtgctttcta

SEQ ID NO: 5133470 - DNA, 15 bp, Homo sapiens
acactgtggaaagct

SEQ ID NO: 5133471 - DNA, 16 bp, Homo sapiens
acactgtggaacacta

SEQ ID NO: 5133472 - DNA, 21 bp, Homo sapiens
acactgtggaacactaaagag

SEQ ID NO: 5133473 - DNA, 23 bp, Homo sapiens
acactgtggaactaataaataca

SEQ ID NO: 5133474 - DNA, 15 bp, Homo sapiens
acactgtggccaggc

SEQ ID NO: 5133475 - DNA, 20 bp, Homo sapiens
acactgtggtaggtgtttga

SEQ ID NO: 5133476 - DNA, 18 bp, Homo sapiens
acactgtgtcctggtgct

SEQ ID NO: 5133477 - DNA, 15 bp, Homo sapiens
acactgtgtctctat

SEQ ID NO: 5133478 - DNA, 17 bp, Homo sapiens
acactgtgtctctatgt

SEQ ID NO: 5133479 - DNA, 22 bp, Homo sapiens
acactgtgtgaggctgtgtctc

SEQ ID NO: 5133480 - DNA, 20 bp, Homo sapiens
acactgtgtgtttgggaagg

SEQ ID NO: 5133481 - DNA, 17 bp, Homo sapiens
acactgttagaacacta

SEQ ID NO: 5133482 - DNA, 18 bp, Homo sapiens
acactgttagaacactat

SEQ ID NO: 5133483 - DNA, 10 bp, Homo sapiens
acactgttat

SEQ ID NO: 5133484 - DNA, 15 bp, Homo sapiens
acactgttattttca

SEQ ID NO: 5133485 - DNA, 23 bp, Homo sapiens
acactgttctctgccctccaaga

SEQ ID NO: 5133486 - DNA, 14 bp, Homo sapiens
acactgttctgaaa

SEQ ID NO: 5133487 - DNA, 12 bp, Homo sapiens
acactgttctta

SEQ ID NO: 5133488 - DNA, 15 bp, Homo sapiens
acactgttcttagct

SEQ ID NO: 5133489 - DNA, 22 bp, Homo sapiens
acactgttcttagctcaatgag

SEQ ID NO: 5133490 - DNA, 15 bp, Homo sapiens
acactgttggaatgt

SEQ ID NO: 5133491 - DNA, 21 bp, Homo sapiens
acactgttgtccttaaaattc

SEQ ID NO: 5133492 - DNA, 17 bp, Homo sapiens
acactgtttcatctcag

SEQ ID NO: 5133493 - DNA, 19 bp, Homo sapiens
acactgtttcatctcagct

SEQ ID NO: 5133494 - DNA, 14 bp, Homo sapiens
acactgtttcctga

SEQ ID NO: 5133495 - DNA, 18 bp, Homo sapiens
acactgttttttggcttg

SEQ ID NO: 5133496 - DNA, 19 bp, Homo sapiens
acactgttttttggcttgc

SEQ ID NO: 5133497 - DNA, 15 bp, Homo sapiens
acacttaaaaatggt

SEQ ID NO: 5133498 - DNA, 13 bp, Homo sapiens
acacttaaaagaa

SEQ ID NO: 5133499 - DNA, 14 bp, Homo sapiens
acacttaaaagatg

SEQ ID NO: 5133500 - DNA, 14 bp, Homo sapiens
acacttaaattatg

SEQ ID NO: 5133501 - DNA, 15 bp, Homo sapiens
acacttaaatttctt

SEQ ID NO: 5133502 - DNA, 23 bp, Homo sapiens
acacttaaggttgggtgctgcta

SEQ ID NO: 5133503 - DNA, 13 bp, Homo sapiens
acacttaatagca

SEQ ID NO: 5133504 - DNA, 13 bp, Homo sapiens
acacttaatcatt

SEQ ID NO: 5133505 - DNA, 17 bp, Homo sapiens
acacttacacccttttg

SEQ ID NO: 5133506 - DNA, 18 bp, Homo sapiens
acacttacactttatgca

SEQ ID NO: 5133507 - DNA, 21 bp, Homo sapiens
acacttacactttatgcacaa

SEQ ID NO: 5133508 - DNA, 13 bp, Homo sapiens
acacttagaatac

SEQ ID NO: 5133509 - DNA, 17 bp, Homo sapiens
acacttagccattgaaa

SEQ ID NO: 5133510 - DNA, 15 bp, Homo sapiens
acacttaggaagaaa

SEQ ID NO: 5133511 - DNA, 22 bp, Homo sapiens
acacttagtgatcatttaaaaa

SEQ ID NO: 5133512 - DNA, 22 bp, Homo sapiens
acacttataaaataacttgcat

SEQ ID NO: 5133513 - DNA, 17 bp, Homo sapiens
acacttataaatatcct

SEQ ID NO: 5133514 - DNA, 14 bp, Homo sapiens
acacttataagtga

SEQ ID NO: 5133515 - DNA, 22 bp, Homo sapiens
acacttatattttatgaacatt

SEQ ID NO: 5133516 - DNA, 19 bp, Homo sapiens
acacttatctcactgtttt

SEQ ID NO: 5133517 - DNA, 15 bp, Homo sapiens
acacttatcttctgg

SEQ ID NO: 5133518 - DNA, 21 bp, Homo sapiens
acacttatggaatttttaagt

SEQ ID NO: 5133519 - DNA, 18 bp, Homo sapiens
acacttatggggacagca

SEQ ID NO: 5133520 - DNA, 19 bp, Homo sapiens
acacttattgtttgaaaga

SEQ ID NO: 5133521 - DNA, 14 bp, Homo sapiens
acacttattttctg

SEQ ID NO: 5133522 - DNA, 20 bp, Homo sapiens
acacttatttttttcccaag

SEQ ID NO: 5133523 - DNA, 16 bp, Homo sapiens
acacttcaaactactt

SEQ ID NO: 5133524 - DNA, 17 bp, Homo sapiens
acacttcacctccttct

SEQ ID NO: 5133525 - DNA, 18 bp, Homo sapiens
acacttcacctccttctg

SEQ ID NO: 5133526 - DNA, 13 bp, Homo sapiens
acacttcaccttc

SEQ ID NO: 5133527 - DNA, 12 bp, Homo sapiens
acacttcagatc

SEQ ID NO: 5133528 - DNA, 19 bp, Homo sapiens
acacttcagcctgtgcagg

SEQ ID NO: 5133529 - DNA, 21 bp, Homo sapiens
acacttcagtatagcattggt

SEQ ID NO: 5133530 - DNA, 21 bp, Homo sapiens
acacttcattgtaaatcactt

SEQ ID NO: 5133531 - DNA, 15 bp, Homo sapiens
acagctgctgaagag

SEQ ID NO: 5133532 - DNA, 13 bp, Homo sapiens
acagctgctggga

SEQ ID NO: 5133533 - DNA, 16 bp, Homo sapiens
acagctgctgtgccag

SEQ ID NO: 5133534 - DNA, 13 bp, Homo sapiens
acagctgctgttc

SEQ ID NO: 5133535 - DNA, 18 bp, Homo sapiens
acagctgctgttctcagg

SEQ ID NO: 5133536 - DNA, 12 bp, Homo sapiens
acagctgcttct

SEQ ID NO: 5133537 - DNA, 11 bp, Homo sapiens
acagctgcttg

SEQ ID NO: 5133538 - DNA, 22 bp, Homo sapiens
acagctgcttgtcctgctctct

SEQ ID NO: 5133539 - DNA, 13 bp, Homo sapiens
acagctgctttct

SEQ ID NO: 5133540 - DNA, 15 bp, Homo sapiens
acagctgctttctgt

SEQ ID NO: 5133541 - DNA, 18 bp, Homo sapiens
acagctggaaagttgggc

SEQ ID NO: 5133542 - DNA, 16 bp, Homo sapiens
acagctggacaccccc

SEQ ID NO: 5133543 - DNA, 14 bp, Homo sapiens
acagctggaccctg

SEQ ID NO: 5133544 - DNA, 21 bp, Homo sapiens
acagctggagaaatggcatca

SEQ ID NO: 5133545 - DNA, 13 bp, Homo sapiens
acagctggagaca

SEQ ID NO: 5133546 - DNA, 18 bp, Homo sapiens
acagctggaggaatacat

SEQ ID NO: 5133547 - DNA, 21 bp, Homo sapiens
acagctggccagtaattagtg

SEQ ID NO: 5133548 - DNA, 24 bp, Homo sapiens
acagctggcggaggctgctcggct

SEQ ID NO: 5133549 - DNA, 10 bp, Homo sapiens
acagctggct

SEQ ID NO: 5133550 - DNA, 20 bp, Homo sapiens
acagctggctatctactacc

SEQ ID NO: 5133551 - DNA, 13 bp, Homo sapiens
acagctggctcta

SEQ ID NO: 5133552 - DNA, 20 bp, Homo sapiens
acagctggctctacttcccc

SEQ ID NO: 5133553 - DNA, 12 bp, Homo sapiens
acagctggctgc

SEQ ID NO: 5133554 - DNA, 13 bp, Homo sapiens
acagctggctgct

SEQ ID NO: 5133555 - DNA, 19 bp, Homo sapiens
acagctggctgctgacagg

SEQ ID NO: 5133556 - DNA, 11 bp, Homo sapiens
acagctgggca

SEQ ID NO: 5133557 - DNA, 18 bp, Homo sapiens
acagctgggcatgccatg

SEQ ID NO: 5133558 - DNA, 16 bp, Homo sapiens
acagctgggctggaac

SEQ ID NO: 5133559 - DNA, 15 bp, Homo sapiens
acagctggggccggt

SEQ ID NO: 5133560 - DNA, 19 bp, Homo sapiens
acagctgggtggcactgcc

SEQ ID NO: 5133561 - DNA, 20 bp, Homo sapiens
acagctgggtggcactgcca

SEQ ID NO: 5133562 - DNA, 16 bp, Homo sapiens
acagctggtcacacaa

SEQ ID NO: 5133563 - DNA, 23 bp, Homo sapiens
acagctggtcctccactttgctg

SEQ ID NO: 5133564 - DNA, 12 bp, Homo sapiens
acagctggtgcc

SEQ ID NO: 5133565 - DNA, 17 bp, Homo sapiens
acagctggtgccctgct

SEQ ID NO: 5133566 - DNA, 15 bp, Homo sapiens
acagctggtgtagct

SEQ ID NO: 5133567 - DNA, 16 bp, Homo sapiens
acagctggtgtagcta

SEQ ID NO: 5133568 - DNA, 20 bp, Homo sapiens
acagctggtgtagctacaga

SEQ ID NO: 5133569 - DNA, 14 bp, Homo sapiens
acagctgtagtcat

SEQ ID NO: 5133570 - DNA, 23 bp, Homo sapiens
acagctgtatgattcccagccag

SEQ ID NO: 5133571 - DNA, 13 bp, Homo sapiens
acagctgtattta

SEQ ID NO: 5133572 - DNA, 17 bp, Homo sapiens
acagctgtatttatata

SEQ ID NO: 5133573 - DNA, 23 bp, Homo sapiens
acagctgtattttggctttctcc

SEQ ID NO: 5133574 - DNA, 14 bp, Homo sapiens
acagctgtccctgt

SEQ ID NO: 5133575 - DNA, 16 bp, Homo sapiens
acagctgtccctgtca

SEQ ID NO: 5133576 - DNA, 13 bp, Homo sapiens
acagctgtctgcc

SEQ ID NO: 5133577 - DNA, 18 bp, Homo sapiens
acagctgtctgccaggca

SEQ ID NO: 5133578 - DNA, 19 bp, Homo sapiens
acagctgtctgccaggcac

SEQ ID NO: 5133579 - DNA, 15 bp, Homo sapiens
acagctgtgagccat

SEQ ID NO: 5133580 - DNA, 16 bp, Homo sapiens
acagctgtgagccatg

SEQ ID NO: 5133581 - DNA, 12 bp, Homo sapiens
acagctgtgccg

SEQ ID NO: 5133582 - DNA, 17 bp, Homo sapiens
acagctgtgccgggagg

SEQ ID NO: 5133583 - DNA, 13 bp, Homo sapiens
acagctgtgcctc

SEQ ID NO: 5133584 - DNA, 15 bp, Homo sapiens
acagctgtgcctcgc

SEQ ID NO: 5133585 - DNA, 15 bp, Homo sapiens
acagctgtgctccac

SEQ ID NO: 5133586 - DNA, 21 bp, Homo sapiens
acagctgtgctccacactcag

SEQ ID NO: 5133587 - DNA, 12 bp, Homo sapiens
acagctgtgtta

SEQ ID NO: 5133588 - DNA, 22 bp, Homo sapiens
acagctgtgttattctttgcgt

SEQ ID NO: 5133589 - DNA, 23 bp, Homo sapiens
acagctgttcagttgcacttcta

SEQ ID NO: 5133590 - DNA, 15 bp, Homo sapiens
acagctgttgactct

SEQ ID NO: 5133591 - DNA, 15 bp, Homo sapiens
acagctgtttaagat

SEQ ID NO: 5133592 - DNA, 14 bp, Homo sapiens
acagctgtttgaaa

SEQ ID NO: 5133593 - DNA, 19 bp, Homo sapiens
acagcttacaggagccagc

SEQ ID NO: 5133594 - DNA, 16 bp, Homo sapiens
acagcttatggcatct

SEQ ID NO: 5133595 - DNA, 19 bp, Homo sapiens
acagcttatttttttctac

SEQ ID NO: 5133596 - DNA, 21 bp, Homo sapiens
acagcttcaccctgtcaagtt

SEQ ID NO: 5133597 - DNA, 15 bp, Homo sapiens
acagcttcagccagg

SEQ ID NO: 5133598 - DNA, 22 bp, Homo sapiens
acagcttcagccaggagctggg

SEQ ID NO: 5133599 - DNA, 15 bp, Homo sapiens
acagcttcaggttat

SEQ ID NO: 5133600 - DNA, 20 bp, Homo sapiens
acagcttcaggttatcgaaa

SEQ ID NO: 5133601 - DNA, 15 bp, Homo sapiens
acagcttcagtccat

SEQ ID NO: 5133602 - DNA, 17 bp, Homo sapiens
acagcttcatgcctttg

SEQ ID NO: 5133603 - DNA, 19 bp, Homo sapiens
acagcttcatgcctttgta

SEQ ID NO: 5133604 - DNA, 21 bp, Homo sapiens
acagcttcattatctgagttg

SEQ ID NO: 5133605 - DNA, 11 bp, Homo sapiens
acagcttcctc

SEQ ID NO: 5133606 - DNA, 13 bp, Homo sapiens
acagcttcctcac

SEQ ID NO: 5133607 - DNA, 12 bp, Homo sapiens
acagcttcctga

SEQ ID NO: 5133608 - DNA, 14 bp, Homo sapiens
acagcttcctgagt

SEQ ID NO: 5133609 - DNA, 20 bp, Homo sapiens
acagcttctcatcctgcagg

SEQ ID NO: 5133610 - DNA, 21 bp, Homo sapiens
acagcttctcatcctgcaggc

SEQ ID NO: 5133611 - DNA, 14 bp, Homo sapiens
acagcttctccaag

SEQ ID NO: 5133612 - DNA, 11 bp, Homo sapiens
acagcttctct

SEQ ID NO: 5133613 - DNA, 16 bp, Homo sapiens
acagcttctctgcagt

SEQ ID NO: 5133614 - DNA, 14 bp, Homo sapiens
acagcttctggagc

SEQ ID NO: 5133615 - DNA, 21 bp, Homo sapiens
acagcttctggagcagaactt

SEQ ID NO: 5133616 - DNA, 16 bp, Homo sapiens
acagcttcttcatctt

SEQ ID NO: 5133617 - DNA, 21 bp, Homo sapiens
acagcttctttactactgcaa

SEQ ID NO: 5133618 - DNA, 21 bp, Homo sapiens
acagcttgaccgtgaggccag

SEQ ID NO: 5133619 - DNA, 19 bp, Homo sapiens
acagcttgacctgaggctg

SEQ ID NO: 5133620 - DNA, 21 bp, Homo sapiens
acagcttgagccgggcccctg

SEQ ID NO: 5133621 - DNA, 22 bp, Homo sapiens
acagcttgccagggatgggcag

SEQ ID NO: 5133622 - DNA, 17 bp, Homo sapiens
acagcttgtaggggagg

SEQ ID NO: 5133623 - DNA, 14 bp, Homo sapiens
acagcttgtctctt

SEQ ID NO: 5133624 - DNA, 13 bp, Homo sapiens
acagcttgtgaat

SEQ ID NO: 5133625 - DNA, 14 bp, Homo sapiens
acagcttgtgaatg

SEQ ID NO: 5133626 - DNA, 19 bp, Homo sapiens
acagcttgttttggacttt

SEQ ID NO: 5133627 - DNA, 23 bp, Homo sapiens
acagcttgttttggactttgtta

SEQ ID NO: 5133628 - DNA, 19 bp, Homo sapiens
acagctttacaacttccat

SEQ ID NO: 5133629 - DNA, 15 bp, Homo sapiens
acagctttacacaca

SEQ ID NO: 5133630 - DNA, 16 bp, Homo sapiens
acagctttacacacac

SEQ ID NO: 5133631 - DNA, 19 bp, Homo sapiens
acagctttattttaaatgt

SEQ ID NO: 5133632 - DNA, 20 bp, Homo sapiens
acagctttattttaaatgtg

SEQ ID NO: 5133633 - DNA, 12 bp, Homo sapiens
acagctttctga

SEQ ID NO: 5133634 - DNA, 13 bp, Homo sapiens
acagctttctggg

SEQ ID NO: 5133635 - DNA, 14 bp, Homo sapiens
acagctttctggga

SEQ ID NO: 5133636 - DNA, 16 bp, Homo sapiens
acagctttctgggatg

SEQ ID NO: 5133637 - DNA, 22 bp, Homo sapiens
acagctttctgggatgtcacag

SEQ ID NO: 5133638 - DNA, 17 bp, Homo sapiens
acagctttcttattcag

SEQ ID NO: 5133639 - DNA, 22 bp, Homo sapiens
acagctttcttattcagtgaaa

SEQ ID NO: 5133640 - DNA, 22 bp, Homo sapiens
acagctttcttgctcccttcag

SEQ ID NO: 5133641 - DNA, 15 bp, Homo sapiens
acagctttgctccgc

SEQ ID NO: 5133642 - DNA, 21 bp, Homo sapiens
acagctttgctccgctcccac

SEQ ID NO: 5133643 - DNA, 20 bp, Homo sapiens
acagctttgggtcattttta

SEQ ID NO: 5133644 - DNA, 20 bp, Homo sapiens
acagctttgtatgtttatga

SEQ ID NO: 5133645 - DNA, 20 bp, Homo sapiens
acagctttgtctccaaagaa

SEQ ID NO: 5133646 - DNA, 22 bp, Homo sapiens
acagctttgtctccaaagaaga

SEQ ID NO: 5133647 - DNA, 15 bp, Homo sapiens
acagctttgtgactg

SEQ ID NO: 5133648 - DNA, 23 bp, Homo sapiens
acagctttgtgactgtatataaa

SEQ ID NO: 5133649 - DNA, 21 bp, Homo sapiens
acagcttttagtacccacctg

SEQ ID NO: 5133650 - DNA, 22 bp, Homo sapiens
acagcttttagtacccacctga

SEQ ID NO: 5133651 - DNA, 14 bp, Homo sapiens
acagcttttatgga

SEQ ID NO: 5133652 - DNA, 15 bp, Homo sapiens
acagcttttcttgat

SEQ ID NO: 5133653 - DNA, 13 bp, Homo sapiens
acagcttttgcaa

SEQ ID NO: 5133654 - DNA, 14 bp, Homo sapiens
acagcttttgcaac

SEQ ID NO: 5133655 - DNA, 15 bp, Homo sapiens
acagcttttgcaact

SEQ ID NO: 5133656 - DNA, 11 bp, Homo sapiens
acaggaaaaaa

SEQ ID NO: 5133657 - DNA, 17 bp, Homo sapiens
acaggaaaaaaactttt

SEQ ID NO: 5133658 - DNA, 22 bp, Homo sapiens
acaggaaaaaaacttttataaa

SEQ ID NO: 5133659 - DNA, 13 bp, Homo sapiens
acaggaaaaataa

SEQ ID NO: 5133660 - DNA, 15 bp, Homo sapiens
acaggaaaaataaac

SEQ ID NO: 5133661 - DNA, 15 bp, Homo sapiens
acaggaaaagctgct

SEQ ID NO: 5133662 - DNA, 16 bp, Homo sapiens
acaggaaaagctgctg

SEQ ID NO: 5133663 - DNA, 17 bp, Homo sapiens
acaggaaaagctgctga

SEQ ID NO: 5133664 - DNA, 20 bp, Homo sapiens
acaggaaaagctgctgacag

SEQ ID NO: 5133665 - DNA, 17 bp, Homo sapiens
acaggaaaagggcattt

SEQ ID NO: 5133666 - DNA, 17 bp, Homo sapiens
acaggaaaatcctctgg

SEQ ID NO: 5133667 - DNA, 18 bp, Homo sapiens
acaggaaaatcctctggc

SEQ ID NO: 5133668 - DNA, 23 bp, Homo sapiens
acaggaaaatcctctggctggct

SEQ ID NO: 5133669 - DNA, 18 bp, Homo sapiens
acaggaaaatgtatccag

SEQ ID NO: 5133670 - DNA, 18 bp, Homo sapiens
acaggaaacaaaccttgc

SEQ ID NO: 5133671 - DNA, 16 bp, Homo sapiens
acaggaaacagcaaac

SEQ ID NO: 5133672 - DNA, 19 bp, Homo sapiens
acaggaaactcctgtgacc

SEQ ID NO: 5133673 - DNA, 15 bp, Homo sapiens
acaggaaagccctcc

SEQ ID NO: 5133674 - DNA, 18 bp, Homo sapiens
acaggaaagccctccccc

SEQ ID NO: 5133675 - DNA, 19 bp, Homo sapiens
acaggaaagccctccccct

SEQ ID NO: 5133676 - DNA, 16 bp, Homo sapiens
acaggaaagtgttatt

SEQ ID NO: 5133677 - DNA, 22 bp, Homo sapiens
acaggaaagttcagagttttct

SEQ ID NO: 5133678 - DNA, 16 bp, Homo sapiens
acaggaacacccagcc

SEQ ID NO: 5133679 - DNA, 21 bp, Homo sapiens
acaggaacacccagccccagc

SEQ ID NO: 5133680 - DNA, 13 bp, Homo sapiens
acaggaacccagc

SEQ ID NO: 5133681 - DNA, 14 bp, Homo sapiens
acaggaacccagcc

SEQ ID NO: 5133682 - DNA, 18 bp, Homo sapiens
acaggaacccagccagag

SEQ ID NO: 5133683 - DNA, 14 bp, Homo sapiens
acaggaacccatca

SEQ ID NO: 5133684 - DNA, 20 bp, Homo sapiens
acaggaacccatcactgtgt

SEQ ID NO: 5133685 - DNA, 15 bp, Homo sapiens
acaggaacggccctg

SEQ ID NO: 5133686 - DNA, 16 bp, Homo sapiens
acaggaacggccctgc

SEQ ID NO: 5133687 - DNA, 22 bp, Homo sapiens
acaggaacggccctgcaggagc

SEQ ID NO: 5133688 - DNA, 19 bp, Homo sapiens
acaggaactctgtgtgaga

SEQ ID NO: 5133689 - DNA, 16 bp, Homo sapiens
acaggaagactggaga

SEQ ID NO: 5133690 - DNA, 17 bp, Homo sapiens
acaggaagatcttaaat

SEQ ID NO: 5133691 - DNA, 18 bp, Homo sapiens
acaggaagatcttaaatt

SEQ ID NO: 5133692 - DNA, 22 bp, Homo sapiens
acaggaagatcttaaattttgt

SEQ ID NO: 5133693 - DNA, 20 bp, Homo sapiens
acaggaagcaccccatgcca

SEQ ID NO: 5133694 - DNA, 22 bp, Homo sapiens
acaggaagccgcctagtgcaga

SEQ ID NO: 5133695 - DNA, 15 bp, Homo sapiens
acaggaagctcagcc

SEQ ID NO: 5133696 - DNA, 22 bp, Homo sapiens
acaggaagctcagccttctcct

SEQ ID NO: 5133697 - DNA, 19 bp, Homo sapiens
acaggaaggtctgatttgc

SEQ ID NO: 5133698 - DNA, 23 bp, Homo sapiens
acaggaaggtctgatttgcagga

SEQ ID NO: 5133699 - DNA, 20 bp, Homo sapiens
acaggaaggtggtgcttaca

SEQ ID NO: 5133700 - DNA, 17 bp, Homo sapiens
acaggaagtagaggagg

SEQ ID NO: 5133701 - DNA, 15 bp, Homo sapiens
acaggaagtgaagaa

SEQ ID NO: 5133702 - DNA, 21 bp, Homo sapiens
acaggaatagatgtggtcctt

SEQ ID NO: 5133703 - DNA, 19 bp, Homo sapiens
acaggaatcaagagctgcc

SEQ ID NO: 5133704 - DNA, 21 bp, Homo sapiens
acaggaatccttactgatatt

SEQ ID NO: 5133705 - DNA, 14 bp, Homo sapiens
acaggaatctcaga

SEQ ID NO: 5133706 - DNA, 19 bp, Homo sapiens
acaggaatctcagagacag

SEQ ID NO: 5133707 - DNA, 18 bp, Homo sapiens
acaggaatgaagaactgt

SEQ ID NO: 5133708 - DNA, 13 bp, Homo sapiens
acaggaatttaga

SEQ ID NO: 5133709 - DNA, 15 bp, Homo sapiens
acaggaatttttaaa

SEQ ID NO: 5133710 - DNA, 20 bp, Homo sapiens
acaggacaaagggagggagc

SEQ ID NO: 5133711 - DNA, 19 bp, Homo sapiens
acacttccaccagcctgca

SEQ ID NO: 5133712 - DNA, 13 bp, Homo sapiens
acacttccagtct

SEQ ID NO: 5133713 - DNA, 14 bp, Homo sapiens
acacttccataatc

SEQ ID NO: 5133714 - DNA, 12 bp, Homo sapiens
acacttccattg

SEQ ID NO: 5133715 - DNA, 14 bp, Homo sapiens
acacttccattgtt

SEQ ID NO: 5133716 - DNA, 16 bp, Homo sapiens
acacttccattgttta

SEQ ID NO: 5133717 - DNA, 20 bp, Homo sapiens
acacttcccatttactcttg

SEQ ID NO: 5133718 - DNA, 11 bp, Homo sapiens
acacttcccca

SEQ ID NO: 5133719 - DNA, 20 bp, Homo sapiens
acacttccccttgtctccct

SEQ ID NO: 5133720 - DNA, 15 bp, Homo sapiens
acacttccctctgtt

SEQ ID NO: 5133721 - DNA, 13 bp, Homo sapiens
acacttcctgtcc

SEQ ID NO: 5133722 - DNA, 14 bp, Homo sapiens
acacttcctgtcct

SEQ ID NO: 5133723 - DNA, 12 bp, Homo sapiens
acacttccttta

SEQ ID NO: 5133724 - DNA, 13 bp, Homo sapiens
acacttctattta

SEQ ID NO: 5133725 - DNA, 20 bp, Homo sapiens
acacttctcaggacacaggc

SEQ ID NO: 5133726 - DNA, 22 bp, Homo sapiens
acacttctcaggacacaggcct

SEQ ID NO: 5133727 - DNA, 16 bp, Homo sapiens
acacttctccttatct

SEQ ID NO: 5133728 - DNA, 13 bp, Homo sapiens
acacttctgcttt

SEQ ID NO: 5133729 - DNA, 14 bp, Homo sapiens
acacttctgctttc

SEQ ID NO: 5133730 - DNA, 17 bp, Homo sapiens
acacttctgtatgcatc

SEQ ID NO: 5133731 - DNA, 20 bp, Homo sapiens
acacttctgtgagaccccca

SEQ ID NO: 5133732 - DNA, 10 bp, Homo sapiens
acacttctta

SEQ ID NO: 5133733 - DNA, 20 bp, Homo sapiens
acacttcttacgcaatgctt

SEQ ID NO: 5133734 - DNA, 16 bp, Homo sapiens
acacttcttgaaacag

SEQ ID NO: 5133735 - DNA, 20 bp, Homo sapiens
acacttcttgaaacagcctg

SEQ ID NO: 5133736 - DNA, 21 bp, Homo sapiens
acacttctttatactctcttc

SEQ ID NO: 5133737 - DNA, 14 bp, Homo sapiens
acacttcttttgaa

SEQ ID NO: 5133738 - DNA, 22 bp, Homo sapiens
acacttgaacctgggaggtgga

SEQ ID NO: 5133739 - DNA, 22 bp, Homo sapiens
acacttgaccttctgtcgtccc

SEQ ID NO: 5133740 - DNA, 18 bp, Homo sapiens
acacttgagaggatgaat

SEQ ID NO: 5133741 - DNA, 23 bp, Homo sapiens
acacttgatggagtgtgagccac

SEQ ID NO: 5133742 - DNA, 21 bp, Homo sapiens
acacttgccctgctccctctc

SEQ ID NO: 5133743 - DNA, 16 bp, Homo sapiens
acacttgctcccaacc

SEQ ID NO: 5133744 - DNA, 18 bp, Homo sapiens
acacttgctttatttttc

SEQ ID NO: 5133745 - DNA, 21 bp, Homo sapiens
acacttgggcgctctgccctc

SEQ ID NO: 5133746 - DNA, 16 bp, Homo sapiens
acacttgggctggcac

SEQ ID NO: 5133747 - DNA, 18 bp, Homo sapiens
acacttggtgctgggaac

SEQ ID NO: 5133748 - DNA, 20 bp, Homo sapiens
acacttggttgggtcctcac

SEQ ID NO: 5133749 - DNA, 21 bp, Homo sapiens
acacttgtaattttgtatctt

SEQ ID NO: 5133750 - DNA, 12 bp, Homo sapiens
acacttgtacaa

SEQ ID NO: 5133751 - DNA, 15 bp, Homo sapiens
acacttgtagagcag

SEQ ID NO: 5133752 - DNA, 15 bp, Homo sapiens
acacttgtcagcctc

SEQ ID NO: 5133753 - DNA, 20 bp, Homo sapiens
acacttgtgacttttgcttt

SEQ ID NO: 5133754 - DNA, 16 bp, Homo sapiens
acacttgtgccagccc

SEQ ID NO: 5133755 - DNA, 23 bp, Homo sapiens
acacttgtgtgtgggctgtgagt

SEQ ID NO: 5133756 - DNA, 20 bp, Homo sapiens
acacttgttgattaatggaa

SEQ ID NO: 5133757 - DNA, 14 bp, Homo sapiens
acacttgtttcttg

SEQ ID NO: 5133758 - DNA, 16 bp, Homo sapiens
acacttgtttcttgtt

SEQ ID NO: 5133759 - DNA, 22 bp, Homo sapiens
acactttaattaccaacctgtt

SEQ ID NO: 5133760 - DNA, 17 bp, Homo sapiens
acactttacagttctgg

SEQ ID NO: 5133761 - DNA, 15 bp, Homo sapiens
acactttacattctt

SEQ ID NO: 5133762 - DNA, 20 bp, Homo sapiens
acactttatggtaagtagca

SEQ ID NO: 5133763 - DNA, 21 bp, Homo sapiens
acactttatggtaagtagcag

SEQ ID NO: 5133764 - DNA, 19 bp, Homo sapiens
acactttcctcttctatga

SEQ ID NO: 5133765 - DNA, 18 bp, Homo sapiens
acactttctgactgcaac

SEQ ID NO: 5133766 - DNA, 14 bp, Homo sapiens
acactttctggaac

SEQ ID NO: 5133767 - DNA, 15 bp, Homo sapiens
acactttctggcaaa

SEQ ID NO: 5133768 - DNA, 13 bp, Homo sapiens
acactttctggga

SEQ ID NO: 5133769 - DNA, 14 bp, Homo sapiens
acactttctttttt

SEQ ID NO: 5133770 - DNA, 17 bp, Homo sapiens
acactttctttttttac

SEQ ID NO: 5133771 - DNA, 17 bp, Homo sapiens
acactttgaaatgtgtt

SEQ ID NO: 5133772 - DNA, 13 bp, Homo sapiens
acactttgaagca

SEQ ID NO: 5133773 - DNA, 17 bp, Homo sapiens
acactttgagcattttt

SEQ ID NO: 5133774 - DNA, 23 bp, Homo sapiens
acactttgagcatttttaaggga

SEQ ID NO: 5133775 - DNA, 17 bp, Homo sapiens
acactttgccaaggctc

SEQ ID NO: 5133776 - DNA, 19 bp, Homo sapiens
acactttgccaaggctctc

SEQ ID NO: 5133777 - DNA, 22 bp, Homo sapiens
acactttgccatttgcttgtac

SEQ ID NO: 5133778 - DNA, 20 bp, Homo sapiens
acactttgcctcctgtgtac

SEQ ID NO: 5133779 - DNA, 20 bp, Homo sapiens
acactttgctttctgaattg

SEQ ID NO: 5133780 - DNA, 18 bp, Homo sapiens
acactttggcccagggtg

SEQ ID NO: 5133781 - DNA, 19 bp, Homo sapiens
acactttggtattcaattt

SEQ ID NO: 5133782 - DNA, 14 bp, Homo sapiens
acactttgtattac

SEQ ID NO: 5133783 - DNA, 18 bp, Homo sapiens
acactttgtctagtgtat

SEQ ID NO: 5133784 - DNA, 17 bp, Homo sapiens
acacttttaaaaaacaa

SEQ ID NO: 5133785 - DNA, 23 bp, Homo sapiens
acacttttaaaaaacaaaaaaag

SEQ ID NO: 5133786 - DNA, 22 bp, Homo sapiens
acacttttaaaataaattctct

SEQ ID NO: 5133787 - DNA, 13 bp, Homo sapiens
acacttttatatt

SEQ ID NO: 5133788 - DNA, 20 bp, Homo sapiens
acacttttctttttaaatgt

SEQ ID NO: 5133789 - DNA, 12 bp, Homo sapiens
acacttttgagg

SEQ ID NO: 5133790 - DNA, 14 bp, Homo sapiens
acacttttgcacat

SEQ ID NO: 5133791 - DNA, 22 bp, Homo sapiens
acacttttggttaagtctgttt

SEQ ID NO: 5133792 - DNA, 17 bp, Homo sapiens
acactttttacagcagc

SEQ ID NO: 5133793 - DNA, 21 bp, Homo sapiens
acactttttacagcagcaata

SEQ ID NO: 5133794 - DNA, 22 bp, Homo sapiens
acactttttccatttcttcaga

SEQ ID NO: 5133795 - DNA, 21 bp, Homo sapiens
acactttttctttacaaacaa

SEQ ID NO: 5133796 - DNA, 22 bp, Homo sapiens
acactttttgtattttttcctt

SEQ ID NO: 5133797 - DNA, 23 bp, Homo sapiens
acacttttttggggatatgctta

SEQ ID NO: 5133798 - DNA, 14 bp, Homo sapiens
acagaaaaaaaaca

SEQ ID NO: 5133799 - DNA, 13 bp, Homo sapiens
acagaaaaacaaa

SEQ ID NO: 5133800 - DNA, 15 bp, Homo sapiens
acagaaaaacaaaaa

SEQ ID NO: 5133801 - DNA, 13 bp, Homo sapiens
acagaaaaagaag

SEQ ID NO: 5133802 - DNA, 13 bp, Homo sapiens
acagaaaaagcat

SEQ ID NO: 5133803 - DNA, 16 bp, Homo sapiens
acagaaaaagcatgat

SEQ ID NO: 5133804 - DNA, 22 bp, Homo sapiens
acagaaaaagcatgatgggaaa

SEQ ID NO: 5133805 - DNA, 20 bp, Homo sapiens
acagaaaaatactttgattt

SEQ ID NO: 5133806 - DNA, 21 bp, Homo sapiens
acagaaaaattgaactacagc

SEQ ID NO: 5133807 - DNA, 17 bp, Homo sapiens
acagaaaacaattgttc

SEQ ID NO: 5133808 - DNA, 22 bp, Homo sapiens
acagaaaacatgtataaatata

SEQ ID NO: 5133809 - DNA, 13 bp, Homo sapiens
acagaaaagagaa

SEQ ID NO: 5133810 - DNA, 15 bp, Homo sapiens
acagaaaagagaaga

SEQ ID NO: 5133811 - DNA, 17 bp, Homo sapiens
acagaaaagagaagaaa

SEQ ID NO: 5133812 - DNA, 20 bp, Homo sapiens
acagaaaagagaagaaagaa

SEQ ID NO: 5133813 - DNA, 22 bp, Homo sapiens
acagaaaagagaagaaagaagc

SEQ ID NO: 5133814 - DNA, 13 bp, Homo sapiens
acagaaaagcata

SEQ ID NO: 5133815 - DNA, 17 bp, Homo sapiens
acagaaaaggttctgaa

SEQ ID NO: 5133816 - DNA, 14 bp, Homo sapiens
acagaaaagtgcct

SEQ ID NO: 5133817 - DNA, 18 bp, Homo sapiens
acagaaaagtgcctgagc

SEQ ID NO: 5133818 - DNA, 17 bp, Homo sapiens
acagaaaatacgagaaa

SEQ ID NO: 5133819 - DNA, 17 bp, Homo sapiens
acagaaaatagctttta

SEQ ID NO: 5133820 - DNA, 16 bp, Homo sapiens
acagaaaatatactgt

SEQ ID NO: 5133821 - DNA, 19 bp, Homo sapiens
acagaaaatatactgtaaa

SEQ ID NO: 5133822 - DNA, 21 bp, Homo sapiens
acagaaaatatactgtaaaga

SEQ ID NO: 5133823 - DNA, 12 bp, Homo sapiens
acagaaaatatg

SEQ ID NO: 5133824 - DNA, 13 bp, Homo sapiens
acagaaaatatgt

SEQ ID NO: 5133825 - DNA, 14 bp, Homo sapiens
acagaaaatatgta

SEQ ID NO: 5133826 - DNA, 22 bp, Homo sapiens
acagaaaattgttgtgcttaga

SEQ ID NO: 5133827 - DNA, 16 bp, Homo sapiens
acagaaaatttgcaac

SEQ ID NO: 5133828 - DNA, 17 bp, Homo sapiens
acagaaacagagagaga

SEQ ID NO: 5133829 - DNA, 12 bp, Homo sapiens
acagaaacattc

SEQ ID NO: 5133830 - DNA, 16 bp, Homo sapiens
acagaaacgagatttg

SEQ ID NO: 5133831 - DNA, 21 bp, Homo sapiens
acagaaacgtgttaaaggttt

SEQ ID NO: 5133832 - DNA, 16 bp, Homo sapiens
acagaaactgatgcca

SEQ ID NO: 5133833 - DNA, 20 bp, Homo sapiens
acagaaagaaaaatgcatta

SEQ ID NO: 5133834 - DNA, 22 bp, Homo sapiens
acagaaagaaaaatgcattatt

SEQ ID NO: 5133835 - DNA, 14 bp, Homo sapiens
acagaaagaccctg

SEQ ID NO: 5133836 - DNA, 22 bp, Homo sapiens
acagaaagagacacacacacag

SEQ ID NO: 5133837 - DNA, 12 bp, Homo sapiens
acagaaagagag

SEQ ID NO: 5133838 - DNA, 16 bp, Homo sapiens
acagaaagagagcact

SEQ ID NO: 5133839 - DNA, 21 bp, Homo sapiens
acagaaagcaaatcagacaca

SEQ ID NO: 5133840 - DNA, 23 bp, Homo sapiens
acagaaagcaaatcagacacaat

SEQ ID NO: 5133841 - DNA, 23 bp, Homo sapiens
acagaaagcacaaagaattgatt

SEQ ID NO: 5133842 - DNA, 20 bp, Homo sapiens
acagaaagcagttctgatgc

SEQ ID NO: 5133843 - DNA, 21 bp, Homo sapiens
acagaaagcctccgctgggct

SEQ ID NO: 5133844 - DNA, 22 bp, Homo sapiens
acagaaagcctccgctgggctt

SEQ ID NO: 5133845 - DNA, 13 bp, Homo sapiens
acagaaagctgcc

SEQ ID NO: 5133846 - DNA, 20 bp, Homo sapiens
acagaaaggcaggtttcatt

SEQ ID NO: 5133847 - DNA, 24 bp, Homo sapiens
acagaaagggcaacaataaaatag

SEQ ID NO: 5133848 - DNA, 19 bp, Homo sapiens
acagaaagtcattccttct

SEQ ID NO: 5133849 - DNA, 17 bp, Homo sapiens
acagaaagtggtgctca

SEQ ID NO: 5133850 - DNA, 14 bp, Homo sapiens
acagaaatacatca

SEQ ID NO: 5133851 - DNA, 15 bp, Homo sapiens
acagaaatacatcat

SEQ ID NO: 5133852 - DNA, 13 bp, Homo sapiens
acagaaatactat

SEQ ID NO: 5133853 - DNA, 14 bp, Homo sapiens
acagaaatagactt

SEQ ID NO: 5133854 - DNA, 17 bp, Homo sapiens
acagaaatagacttaat

SEQ ID NO: 5133855 - DNA, 17 bp, Homo sapiens
acagaaatatatataca

SEQ ID NO: 5133856 - DNA, 18 bp, Homo sapiens
acagaaatatatatacat

SEQ ID NO: 5133857 - DNA, 19 bp, Homo sapiens
acagaaatcaggtgtttta

SEQ ID NO: 5133858 - DNA, 23 bp, Homo sapiens
acagaaatcctttcataaagcac

SEQ ID NO: 5133859 - DNA, 14 bp, Homo sapiens
acagaaatgactgc

SEQ ID NO: 5133860 - DNA, 19 bp, Homo sapiens
acagaaatgccaaaaatgt

SEQ ID NO: 5133861 - DNA, 23 bp, Homo sapiens
acagaaatgccaaaaatgtgcct

SEQ ID NO: 5133862 - DNA, 14 bp, Homo sapiens
acagaaatgctgct

SEQ ID NO: 5133863 - DNA, 20 bp, Homo sapiens
acagaaatgctgctggccaa

SEQ ID NO: 5133864 - DNA, 19 bp, Homo sapiens
acagaaatggggaattctc

SEQ ID NO: 5133865 - DNA, 13 bp, Homo sapiens
acagaaatgtaca

SEQ ID NO: 5133866 - DNA, 16 bp, Homo sapiens
acagaaatgtacagca

SEQ ID NO: 5133867 - DNA, 15 bp, Homo sapiens
acagaaatgtttaaa

SEQ ID NO: 5133868 - DNA, 14 bp, Homo sapiens
acagaaatgtttct

SEQ ID NO: 5133869 - DNA, 20 bp, Homo sapiens
acagaaatgtttctgtgtca

SEQ ID NO: 5133870 - DNA, 14 bp, Homo sapiens
acagaaatgttttt

SEQ ID NO: 5133871 - DNA, 14 bp, Homo sapiens
acagaaattgcaat

SEQ ID NO: 5133872 - DNA, 21 bp, Homo sapiens
acagaaattggtaccttgcac

SEQ ID NO: 5133873 - DNA, 15 bp, Homo sapiens
acagaaattgtatat

SEQ ID NO: 5133874 - DNA, 14 bp, Homo sapiens
acagaaatttctcc

SEQ ID NO: 5133875 - DNA, 19 bp, Homo sapiens
acagaacaaatgtttgttt

SEQ ID NO: 5133876 - DNA, 13 bp, Homo sapiens
acagaacaaccca

SEQ ID NO: 5133877 - DNA, 18 bp, Homo sapiens
acagaacacaaatgtcta

SEQ ID NO: 5133878 - DNA, 13 bp, Homo sapiens
acagaacacttat

SEQ ID NO: 5133879 - DNA, 21 bp, Homo sapiens
acagaacacttctaggactgg

SEQ ID NO: 5133880 - DNA, 19 bp, Homo sapiens
acagaacagcaagtatgaa

SEQ ID NO: 5133881 - DNA, 20 bp, Homo sapiens
acagaacagcaagtatgaac

SEQ ID NO: 5133882 - DNA, 20 bp, Homo sapiens
acagaacagcttcaggttat

SEQ ID NO: 5133883 - DNA, 19 bp, Homo sapiens
acagaacattgccttcctc

SEQ ID NO: 5133884 - DNA, 14 bp, Homo sapiens
acagaacatttctc

SEQ ID NO: 5133885 - DNA, 18 bp, Homo sapiens
acagaacatttctcatgt

SEQ ID NO: 5133886 - DNA, 20 bp, Homo sapiens
acagaacatttctcatgtgc

SEQ ID NO: 5133887 - DNA, 23 bp, Homo sapiens
acagaaccaattcactttagagt

SEQ ID NO: 5133888 - DNA, 20 bp, Homo sapiens
acagaaccagagggttgtac

SEQ ID NO: 5133889 - DNA, 14 bp, Homo sapiens
acaggacacagtca

SEQ ID NO: 5133890 - DNA, 17 bp, Homo sapiens
acaggacacgaaggctg

SEQ ID NO: 5133891 - DNA, 22 bp, Homo sapiens
acaggacagagttcacaggagg

SEQ ID NO: 5133892 - DNA, 19 bp, Homo sapiens
acaggacatgtactgagac

SEQ ID NO: 5133893 - DNA, 13 bp, Homo sapiens
acaggaccacctc

SEQ ID NO: 5133894 - DNA, 14 bp, Homo sapiens
acaggaccaggagc

SEQ ID NO: 5133895 - DNA, 13 bp, Homo sapiens
acaggaccctcag

SEQ ID NO: 5133896 - DNA, 15 bp, Homo sapiens
acaggaccctcagga

SEQ ID NO: 5133897 - DNA, 14 bp, Homo sapiens
acaggacctctgct

SEQ ID NO: 5133898 - DNA, 15 bp, Homo sapiens
acaggacctctgctt

SEQ ID NO: 5133899 - DNA, 14 bp, Homo sapiens
acaggactctgcct

SEQ ID NO: 5133900 - DNA, 21 bp, Homo sapiens
acaggactgaaaagggaatca

SEQ ID NO: 5133901 - DNA, 19 bp, Homo sapiens
acaggactgagccctctca

SEQ ID NO: 5133902 - DNA, 20 bp, Homo sapiens
acaggactgagccctctcac

SEQ ID NO: 5133903 - DNA, 23 bp, Homo sapiens
acaggactgagccctctcactcc

SEQ ID NO: 5133904 - DNA, 16 bp, Homo sapiens
acaggactgattctgg

SEQ ID NO: 5133905 - DNA, 21 bp, Homo sapiens
acaggactgggccgggcccag

SEQ ID NO: 5133906 - DNA, 15 bp, Homo sapiens
acaggactggttcct

SEQ ID NO: 5133907 - DNA, 14 bp, Homo sapiens
acaggacttttaaa

SEQ ID NO: 5133908 - DNA, 13 bp, Homo sapiens
acaggagaaagga

SEQ ID NO: 5133909 - DNA, 17 bp, Homo sapiens
acaggagaagaaagaac

SEQ ID NO: 5133910 - DNA, 20 bp, Homo sapiens
acaggagaatggggttcctg

SEQ ID NO: 5133911 - DNA, 18 bp, Homo sapiens
acaggagacaaaagagca

SEQ ID NO: 5133912 - DNA, 14 bp, Homo sapiens
acaggagaccaccc

SEQ ID NO: 5133913 - DNA, 14 bp, Homo sapiens
acaggagacctggc

SEQ ID NO: 5133914 - DNA, 14 bp, Homo sapiens
acaggagagaagct

SEQ ID NO: 5133915 - DNA, 15 bp, Homo sapiens
acaggagagacagga

SEQ ID NO: 5133916 - DNA, 15 bp, Homo sapiens
acaggagaggcagca

SEQ ID NO: 5133917 - DNA, 14 bp, Homo sapiens
acaggagatgctgt

SEQ ID NO: 5133918 - DNA, 18 bp, Homo sapiens
acaggagatgctgtgccc

SEQ ID NO: 5133919 - DNA, 19 bp, Homo sapiens
acaggagatgctgtgcccc

SEQ ID NO: 5133920 - DNA, 16 bp, Homo sapiens
acaggagcgtgtccta

SEQ ID NO: 5133921 - DNA, 23 bp, Homo sapiens
acaggagctacctgtgtggacag

SEQ ID NO: 5133922 - DNA, 19 bp, Homo sapiens
acaggagctccctttttga

SEQ ID NO: 5133923 - DNA, 21 bp, Homo sapiens
acaggagctccctttttgaat

SEQ ID NO: 5133924 - DNA, 13 bp, Homo sapiens
acaggagctggga

SEQ ID NO: 5133925 - DNA, 14 bp, Homo sapiens
acaggagctgggat

SEQ ID NO: 5133926 - DNA, 18 bp, Homo sapiens
acaggaggaactggtcca

SEQ ID NO: 5133927 - DNA, 19 bp, Homo sapiens
acaggaggaactggtccag

SEQ ID NO: 5133928 - DNA, 15 bp, Homo sapiens
acaggaggacaattc

SEQ ID NO: 5133929 - DNA, 22 bp, Homo sapiens
acaggaggacaattcatgaact

SEQ ID NO: 5133930 - DNA, 17 bp, Homo sapiens
acaggaggagtgggaca

SEQ ID NO: 5133931 - DNA, 19 bp, Homo sapiens
acaggaggcaagcaagctc

SEQ ID NO: 5133932 - DNA, 13 bp, Homo sapiens
acaggaggcaggc

SEQ ID NO: 5133933 - DNA, 16 bp, Homo sapiens
acaggaggcggcccgg

SEQ ID NO: 5133934 - DNA, 17 bp, Homo sapiens
acaggaggcggcccggc

SEQ ID NO: 5133935 - DNA, 23 bp, Homo sapiens
acaggaggcggcccggccagcgg

SEQ ID NO: 5133936 - DNA, 16 bp, Homo sapiens
acaggagggcagcccg

SEQ ID NO: 5133937 - DNA, 14 bp, Homo sapiens
acaggagggccagc

SEQ ID NO: 5133938 - DNA, 19 bp, Homo sapiens
acaggagggcggcctcctt

SEQ ID NO: 5133939 - DNA, 19 bp, Homo sapiens
acaggaggggcccacaatg

SEQ ID NO: 5133940 - DNA, 23 bp, Homo sapiens
acaggagggggtcgtggagagct

SEQ ID NO: 5133941 - DNA, 23 bp, Homo sapiens
acaggagggtatggtgctgctct

SEQ ID NO: 5133942 - DNA, 16 bp, Homo sapiens
acaggaggtgtgaatg

SEQ ID NO: 5133943 - DNA, 17 bp, Homo sapiens
acaggaggtgtgaatgc

SEQ ID NO: 5133944 - DNA, 17 bp, Homo sapiens
acaggaggtgtgataga

SEQ ID NO: 5133945 - DNA, 21 bp, Homo sapiens
acaggaggtgtgatagagcct

SEQ ID NO: 5133946 - DNA, 23 bp, Homo sapiens
acaggagtcagtctctttctgta

SEQ ID NO: 5133947 - DNA, 21 bp, Homo sapiens
acaggagtcttcagacccaga

SEQ ID NO: 5133948 - DNA, 22 bp, Homo sapiens
acaggagtcttcagacccagag

SEQ ID NO: 5133949 - DNA, 23 bp, Homo sapiens
acaggagtcttcagacccagaga

SEQ ID NO: 5133950 - DNA, 23 bp, Homo sapiens
acaggagtgactctggctgccaa

SEQ ID NO: 5133951 - DNA, 16 bp, Homo sapiens
acaggagtgagcacta

SEQ ID NO: 5133952 - DNA, 17 bp, Homo sapiens
acaggagtgtcctcttc

SEQ ID NO: 5133953 - DNA, 14 bp, Homo sapiens
acaggatcagtctg

SEQ ID NO: 5133954 - DNA, 19 bp, Homo sapiens
acaggatcagttaactatt

SEQ ID NO: 5133955 - DNA, 15 bp, Homo sapiens
acaggatcatcattt

SEQ ID NO: 5133956 - DNA, 18 bp, Homo sapiens
acaggatcctggcctgag

SEQ ID NO: 5133957 - DNA, 20 bp, Homo sapiens
acaggatcctggcctgagaa

SEQ ID NO: 5133958 - DNA, 23 bp, Homo sapiens
acaggatctataggcagcttcta

SEQ ID NO: 5133959 - DNA, 23 bp, Homo sapiens
acaggatctgaactttgtttcca

SEQ ID NO: 5133960 - DNA, 21 bp, Homo sapiens
acaggatgaactagccatgac

SEQ ID NO: 5133961 - DNA, 14 bp, Homo sapiens
acaggatgaggaca

SEQ ID NO: 5133962 - DNA, 21 bp, Homo sapiens
acaggatgatgactatggaaa

SEQ ID NO: 5133963 - DNA, 17 bp, Homo sapiens
acaggatgccagcccct

SEQ ID NO: 5133964 - DNA, 20 bp, Homo sapiens
acaggatgccagcccctgcc

SEQ ID NO: 5133965 - DNA, 17 bp, Homo sapiens
acaggatggtctctgcc

SEQ ID NO: 5133966 - DNA, 17 bp, Homo sapiens
acaggatggtgggcagg

SEQ ID NO: 5133967 - DNA, 17 bp, Homo sapiens
acaggatgtggcactgc

SEQ ID NO: 5133968 - DNA, 21 bp, Homo sapiens
acaggattaatatattgaaca

SEQ ID NO: 5133969 - DNA, 14 bp, Homo sapiens
acaggattctgaca

SEQ ID NO: 5133970 - DNA, 18 bp, Homo sapiens
acaggattgatcattctt

SEQ ID NO: 5133971 - DNA, 18 bp, Homo sapiens
acaggattgtctggggcc

SEQ ID NO: 5133972 - DNA, 15 bp, Homo sapiens
acaggatttggccac

SEQ ID NO: 5133973 - DNA, 16 bp, Homo sapiens
acaggattttcaagtt

SEQ ID NO: 5133974 - DNA, 19 bp, Homo sapiens
acaggcaaaacaggaaggg

SEQ ID NO: 5133975 - DNA, 20 bp, Homo sapiens
acaggcaaagaggtgctgct

SEQ ID NO: 5133976 - DNA, 22 bp, Homo sapiens
acaggcaaagaggtgctgcttt

SEQ ID NO: 5133977 - DNA, 16 bp, Homo sapiens
acaggcaacattacaa

SEQ ID NO: 5133978 - DNA, 21 bp, Homo sapiens
acaggcaacattacaaacaaa

SEQ ID NO: 5133979 - DNA, 18 bp, Homo sapiens
acaggcaactgaggcaga

SEQ ID NO: 5133980 - DNA, 22 bp, Homo sapiens
acaggcaactgaggcagacagc

SEQ ID NO: 5133981 - DNA, 18 bp, Homo sapiens
acaggcaagcacctcctg

SEQ ID NO: 5133982 - DNA, 18 bp, Homo sapiens
acaggcaaggaaacaggc

SEQ ID NO: 5133983 - DNA, 19 bp, Homo sapiens
acaggcaatgctggctgtt

SEQ ID NO: 5133984 - DNA, 18 bp, Homo sapiens
acaggcacattaactgtt

SEQ ID NO: 5133985 - DNA, 17 bp, Homo sapiens
acaggcaccagatggga

SEQ ID NO: 5133986 - DNA, 17 bp, Homo sapiens
acaggcaccgagaatgt

SEQ ID NO: 5133987 - DNA, 21 bp, Homo sapiens
acaggcaccgagaatgttgta

SEQ ID NO: 5133988 - DNA, 19 bp, Homo sapiens
acaggcacctctaatcaga

SEQ ID NO: 5133989 - DNA, 12 bp, Homo sapiens
acaggcactcca

SEQ ID NO: 5133990 - DNA, 21 bp, Homo sapiens
acaggcactccaaacctgtct

SEQ ID NO: 5133991 - DNA, 21 bp, Homo sapiens
acaggcactgaacaggctggg

SEQ ID NO: 5133992 - DNA, 22 bp, Homo sapiens
acaggcagaaatataaacacat

SEQ ID NO: 5133993 - DNA, 18 bp, Homo sapiens
acaggcagacacatgctg

SEQ ID NO: 5133994 - DNA, 19 bp, Homo sapiens
acaggcagacacatgctgt

SEQ ID NO: 5133995 - DNA, 19 bp, Homo sapiens
acaggcagccagtgccctg

SEQ ID NO: 5133996 - DNA, 22 bp, Homo sapiens
acaggcagccagtgccctgagc

SEQ ID NO: 5133997 - DNA, 16 bp, Homo sapiens
acaggcagcccagcag

SEQ ID NO: 5133998 - DNA, 20 bp, Homo sapiens
acaggcagcctcctttgtgt

SEQ ID NO: 5133999 - DNA, 17 bp, Homo sapiens
acaggcagctctgagcc

SEQ ID NO: 5134000 - DNA, 18 bp, Homo sapiens
acaggcagctttctagaa

SEQ ID NO: 5134001 - DNA, 16 bp, Homo sapiens
acaggcaggaagagag

SEQ ID NO: 5134002 - DNA, 18 bp, Homo sapiens
acaggcaggaagagagag

SEQ ID NO: 5134003 - DNA, 20 bp, Homo sapiens
acaggcaggccagatggccc

SEQ ID NO: 5134004 - DNA, 12 bp, Homo sapiens
acaggcagggca

SEQ ID NO: 5134005 - DNA, 17 bp, Homo sapiens
acaggcagggcctggct

SEQ ID NO: 5134006 - DNA, 15 bp, Homo sapiens
acaggcaggggccca

SEQ ID NO: 5134007 - DNA, 16 bp, Homo sapiens
acaggcaggggtgaga

SEQ ID NO: 5134008 - DNA, 16 bp, Homo sapiens
acaggcaggtcacaga

SEQ ID NO: 5134009 - DNA, 18 bp, Homo sapiens
acaggcagtctctctctt

SEQ ID NO: 5134010 - DNA, 22 bp, Homo sapiens
acaggcagtctctctcttcctc

SEQ ID NO: 5134011 - DNA, 14 bp, Homo sapiens
acaggcagtgcatg

SEQ ID NO: 5134012 - DNA, 15 bp, Homo sapiens
acaggcagtgcatgt

SEQ ID NO: 5134013 - DNA, 17 bp, Homo sapiens
acaggcagtgcatgtga

SEQ ID NO: 5134014 - DNA, 21 bp, Homo sapiens
acaggcagtgcatgtgaagca

SEQ ID NO: 5134015 - DNA, 22 bp, Homo sapiens
acaggcagtttcagagatggac

SEQ ID NO: 5134016 - DNA, 21 bp, Homo sapiens
acaggcagttttgaaatgaaa

SEQ ID NO: 5134017 - DNA, 18 bp, Homo sapiens
acaggcatattccctgca

SEQ ID NO: 5134018 - DNA, 12 bp, Homo sapiens
acaggcatcagg

SEQ ID NO: 5134019 - DNA, 14 bp, Homo sapiens
acaggcatcaggaa

SEQ ID NO: 5134020 - DNA, 17 bp, Homo sapiens
acaggcatctacacagc

SEQ ID NO: 5134021 - DNA, 15 bp, Homo sapiens
acaggcatgtgccac

SEQ ID NO: 5134022 - DNA, 16 bp, Homo sapiens
acaggcatgtgtcacc

SEQ ID NO: 5134023 - DNA, 19 bp, Homo sapiens
acaggcatgttctctgagg

SEQ ID NO: 5134024 - DNA, 17 bp, Homo sapiens
acaggcatttcctgggt

SEQ ID NO: 5134025 - DNA, 20 bp, Homo sapiens
acaggcatttcctgggtggc

SEQ ID NO: 5134026 - DNA, 18 bp, Homo sapiens
acaggccacacgctgccc

SEQ ID NO: 5134027 - DNA, 16 bp, Homo sapiens
acaggccaccctgtgc

SEQ ID NO: 5134028 - DNA, 21 bp, Homo sapiens
acaggccaccctgtgcagaag

SEQ ID NO: 5134029 - DNA, 24 bp, Homo sapiens
acaggccactgcaaaccctgctgc

SEQ ID NO: 5134030 - DNA, 19 bp, Homo sapiens
acaggccagccttggcacg

SEQ ID NO: 5134031 - DNA, 18 bp, Homo sapiens
acaggccagtagggggag

SEQ ID NO: 5134032 - DNA, 18 bp, Homo sapiens
acaggcccaagagatgaa

SEQ ID NO: 5134033 - DNA, 20 bp, Homo sapiens
acaggcccagcattgctggt

SEQ ID NO: 5134034 - DNA, 22 bp, Homo sapiens
acaggcccagcattgctggttc

SEQ ID NO: 5134035 - DNA, 13 bp, Homo sapiens
acaggcccagcgc

SEQ ID NO: 5134036 - DNA, 19 bp, Homo sapiens
acaggcccagcgcggccag

SEQ ID NO: 5134037 - DNA, 13 bp, Homo sapiens
acaggcccaggga

SEQ ID NO: 5134038 - DNA, 14 bp, Homo sapiens
acaggcccagggag

SEQ ID NO: 5134039 - DNA, 13 bp, Homo sapiens
acaggcccagtgg

SEQ ID NO: 5134040 - DNA, 12 bp, Homo sapiens
acaggccccacg

SEQ ID NO: 5134041 - DNA, 15 bp, Homo sapiens
acaggccccacgccc

SEQ ID NO: 5134042 - DNA, 19 bp, Homo sapiens
acaggccccccgcagcacc

SEQ ID NO: 5134043 - DNA, 20 bp, Homo sapiens
acaggccccccgcagcaccc

SEQ ID NO: 5134044 - DNA, 20 bp, Homo sapiens
acaggcccgccctctgcctc

SEQ ID NO: 5134045 - DNA, 16 bp, Homo sapiens
acaggcccggctccag

SEQ ID NO: 5134046 - DNA, 20 bp, Homo sapiens
acaggcccggctccaggctc

SEQ ID NO: 5134047 - DNA, 21 bp, Homo sapiens
acaggcccggctccaggctcc

SEQ ID NO: 5134048 - DNA, 22 bp, Homo sapiens
acaggcccggctccaggctcct

SEQ ID NO: 5134049 - DNA, 19 bp, Homo sapiens
acaggcccgtgcccagccc

SEQ ID NO: 5134050 - DNA, 22 bp, Homo sapiens
acaggccctcctccctcccagc

SEQ ID NO: 5134051 - DNA, 15 bp, Homo sapiens
acaggccctctgtgg

SEQ ID NO: 5134052 - DNA, 20 bp, Homo sapiens
acaggccctgctcctgcagc

SEQ ID NO: 5134053 - DNA, 22 bp, Homo sapiens
acaggccctggagaagcagcta

SEQ ID NO: 5134054 - DNA, 15 bp, Homo sapiens
acaggcccttcctct

SEQ ID NO: 5134055 - DNA, 20 bp, Homo sapiens
acaggcccttggtagagctg

SEQ ID NO: 5134056 - DNA, 22 bp, Homo sapiens
acaggcccttggtagagctggt

SEQ ID NO: 5134057 - DNA, 18 bp, Homo sapiens
acaggccctttcctcagg

SEQ ID NO: 5134058 - DNA, 20 bp, Homo sapiens
acaggccgtcaccctgggag

SEQ ID NO: 5134059 - DNA, 19 bp, Homo sapiens
acaggcctcacacacaatg

SEQ ID NO: 5134060 - DNA, 13 bp, Homo sapiens
acaggcctcacct

SEQ ID NO: 5134061 - DNA, 14 bp, Homo sapiens
acaggcctcacctc

SEQ ID NO: 5134062 - DNA, 20 bp, Homo sapiens
acaggcctcacctctaccca

SEQ ID NO: 5134063 - DNA, 21 bp, Homo sapiens
acaggcctcacctctacccaa

SEQ ID NO: 5134064 - DNA, 12 bp, Homo sapiens
acaggcctcagg

SEQ ID NO: 5134065 - DNA, 23 bp, Homo sapiens
acaggcctctccatttgctcttc

SEQ ID NO: 5134066 - DNA, 15 bp, Homo sapiens
acagaaccagcagaa

SEQ ID NO: 5134067 - DNA, 19 bp, Homo sapiens
acagaaccagcagaacagc

SEQ ID NO: 5134068 - DNA, 17 bp, Homo sapiens
acagaacccctacatga

SEQ ID NO: 5134069 - DNA, 12 bp, Homo sapiens
acagaacccttt

SEQ ID NO: 5134070 - DNA, 16 bp, Homo sapiens
acagaaccttgttatt

SEQ ID NO: 5134071 - DNA, 17 bp, Homo sapiens
acagaaccttgttattt

SEQ ID NO: 5134072 - DNA, 15 bp, Homo sapiens
acagaacctttgtca

SEQ ID NO: 5134073 - DNA, 17 bp, Homo sapiens
acagaactaaatgttct

SEQ ID NO: 5134074 - DNA, 19 bp, Homo sapiens
acagaactacatatttgtg

SEQ ID NO: 5134075 - DNA, 15 bp, Homo sapiens
acagaactcccttca

SEQ ID NO: 5134076 - DNA, 18 bp, Homo sapiens
acagaactcgatgcactg

SEQ ID NO: 5134077 - DNA, 19 bp, Homo sapiens
acagaactcgatgcactga

SEQ ID NO: 5134078 - DNA, 19 bp, Homo sapiens
acagaactcggtgtcccca

SEQ ID NO: 5134079 - DNA, 18 bp, Homo sapiens
acagaactctttcaaaac

SEQ ID NO: 5134080 - DNA, 21 bp, Homo sapiens
acagaactgaacgtcctgcag

SEQ ID NO: 5134081 - DNA, 20 bp, Homo sapiens
acagaactgctaaatactgt

SEQ ID NO: 5134082 - DNA, 23 bp, Homo sapiens
acagaactgctaaatactgtaca

SEQ ID NO: 5134083 - DNA, 15 bp, Homo sapiens
acagaactggaggca

SEQ ID NO: 5134084 - DNA, 16 bp, Homo sapiens
acagaactggaggcag

SEQ ID NO: 5134085 - DNA, 19 bp, Homo sapiens
acagaactggcaggagcct

SEQ ID NO: 5134086 - DNA, 18 bp, Homo sapiens
acagaacttcagaaagac

SEQ ID NO: 5134087 - DNA, 16 bp, Homo sapiens
acagaactttccccaa

SEQ ID NO: 5134088 - DNA, 18 bp, Homo sapiens
acagaagaaaatagaatt

SEQ ID NO: 5134089 - DNA, 15 bp, Homo sapiens
acagaagacacgtgt

SEQ ID NO: 5134090 - DNA, 16 bp, Homo sapiens
acagaagacacgtgtt

SEQ ID NO: 5134091 - DNA, 12 bp, Homo sapiens
acagaagaggag

SEQ ID NO: 5134092 - DNA, 15 bp, Homo sapiens
acagaagaggaggga

SEQ ID NO: 5134093 - DNA, 17 bp, Homo sapiens
acagaagattaagacag

SEQ ID NO: 5134094 - DNA, 12 bp, Homo sapiens
acagaagcaaat

SEQ ID NO: 5134095 - DNA, 14 bp, Homo sapiens
acagaagcacatgc

SEQ ID NO: 5134096 - DNA, 12 bp, Homo sapiens
acagaagcagga

SEQ ID NO: 5134097 - DNA, 22 bp, Homo sapiens
acagaagcagttgagtcgtcat

SEQ ID NO: 5134098 - DNA, 22 bp, Homo sapiens
acagaagcatttgtattttgtg

SEQ ID NO: 5134099 - DNA, 20 bp, Homo sapiens
acagaagccaagctccctgg

SEQ ID NO: 5134100 - DNA, 15 bp, Homo sapiens
acagaagccaggagc

SEQ ID NO: 5134101 - DNA, 16 bp, Homo sapiens
acagaagccaggagca

SEQ ID NO: 5134102 - DNA, 21 bp, Homo sapiens
acagaagccaggagcaaatgt

SEQ ID NO: 5134103 - DNA, 19 bp, Homo sapiens
acagaagcccatgtcttct

SEQ ID NO: 5134104 - DNA, 20 bp, Homo sapiens
acagaagcccatgtcttctg

SEQ ID NO: 5134105 - DNA, 16 bp, Homo sapiens
acagaagcctgtttca

SEQ ID NO: 5134106 - DNA, 11 bp, Homo sapiens
acagaagctat

SEQ ID NO: 5134107 - DNA, 16 bp, Homo sapiens
acagaagctccaggta

SEQ ID NO: 5134108 - DNA, 22 bp, Homo sapiens
acagaagctcttactctttcct

SEQ ID NO: 5134109 - DNA, 13 bp, Homo sapiens
acagaagcttcag

SEQ ID NO: 5134110 - DNA, 23 bp, Homo sapiens
acagaaggaaggagccagctccc

SEQ ID NO: 5134111 - DNA, 14 bp, Homo sapiens
acagaaggactggt

SEQ ID NO: 5134112 - DNA, 15 bp, Homo sapiens
acagaaggactggtg

SEQ ID NO: 5134113 - DNA, 22 bp, Homo sapiens
acagaaggcaaagtttccatgt

SEQ ID NO: 5134114 - DNA, 20 bp, Homo sapiens
acagaaggccttgaagaatt

SEQ ID NO: 5134115 - DNA, 18 bp, Homo sapiens
acagaaggctcctgcccc

SEQ ID NO: 5134116 - DNA, 20 bp, Homo sapiens
acagaagtagtggtttgctt

SEQ ID NO: 5134117 - DNA, 23 bp, Homo sapiens
acagaagtagtggtttgctttga

SEQ ID NO: 5134118 - DNA, 21 bp, Homo sapiens
acagaagtccctaggagggaa

SEQ ID NO: 5134119 - DNA, 14 bp, Homo sapiens
acagaagtcctgta

SEQ ID NO: 5134120 - DNA, 15 bp, Homo sapiens
acagaagtcctgtat

SEQ ID NO: 5134121 - DNA, 23 bp, Homo sapiens
acagaagtgaggatgagacccag

SEQ ID NO: 5134122 - DNA, 13 bp, Homo sapiens
acagaagtgcatc

SEQ ID NO: 5134123 - DNA, 22 bp, Homo sapiens
acagaagtggaaggataatgag

SEQ ID NO: 5134124 - DNA, 15 bp, Homo sapiens
acagaagtttgcact

SEQ ID NO: 5134125 - DNA, 17 bp, Homo sapiens
acagaagtttgcactat

SEQ ID NO: 5134126 - DNA, 13 bp, Homo sapiens
acagaataaaaga

SEQ ID NO: 5134127 - DNA, 13 bp, Homo sapiens
acagaataaaagt

SEQ ID NO: 5134128 - DNA, 15 bp, Homo sapiens
acagaataaaagttc

SEQ ID NO: 5134129 - DNA, 11 bp, Homo sapiens
acagaataatc

SEQ ID NO: 5134130 - DNA, 21 bp, Homo sapiens
acagaatacaagccactacct

SEQ ID NO: 5134131 - DNA, 22 bp, Homo sapiens
acagaatactgttaaaggaaaa

SEQ ID NO: 5134132 - DNA, 17 bp, Homo sapiens
acagaatagaatacatt

SEQ ID NO: 5134133 - DNA, 19 bp, Homo sapiens
acagaatagaatacattga

SEQ ID NO: 5134134 - DNA, 13 bp, Homo sapiens
acagaatagttta

SEQ ID NO: 5134135 - DNA, 16 bp, Homo sapiens
acagaatagtttacac

SEQ ID NO: 5134136 - DNA, 13 bp, Homo sapiens
acagaatatacac

SEQ ID NO: 5134137 - DNA, 19 bp, Homo sapiens
acagaatatgtttcaaact

SEQ ID NO: 5134138 - DNA, 20 bp, Homo sapiens
acagaatattaaatattata

SEQ ID NO: 5134139 - DNA, 12 bp, Homo sapiens
acagaatatttc

SEQ ID NO: 5134140 - DNA, 23 bp, Homo sapiens
acagaatcatatgattctgcttt

SEQ ID NO: 5134141 - DNA, 19 bp, Homo sapiens
acagaatcttccttttatt

SEQ ID NO: 5134142 - DNA, 16 bp, Homo sapiens
acagaatcttgtattt

SEQ ID NO: 5134143 - DNA, 18 bp, Homo sapiens
acagaatcttgttttgaa

SEQ ID NO: 5134144 - DNA, 17 bp, Homo sapiens
acagaatgaaaaatgaa

SEQ ID NO: 5134145 - DNA, 22 bp, Homo sapiens
acagaatgaaaaatgaaagatg

SEQ ID NO: 5134146 - DNA, 13 bp, Homo sapiens
acagaatgatgga

SEQ ID NO: 5134147 - DNA, 14 bp, Homo sapiens
acagaatgcattaa

SEQ ID NO: 5134148 - DNA, 16 bp, Homo sapiens
acagaatgcattaaaa

SEQ ID NO: 5134149 - DNA, 16 bp, Homo sapiens
acagaatgctgtttta

SEQ ID NO: 5134150 - DNA, 14 bp, Homo sapiens
acagaatggatata

SEQ ID NO: 5134151 - DNA, 23 bp, Homo sapiens
acagaatgggggtatcctgtgca

SEQ ID NO: 5134152 - DNA, 13 bp, Homo sapiens
acagaatgtatct

SEQ ID NO: 5134153 - DNA, 18 bp, Homo sapiens
acagaatgtgataaggaa

SEQ ID NO: 5134154 - DNA, 22 bp, Homo sapiens
acagaatgtgtctcaggaaaac

SEQ ID NO: 5134155 - DNA, 13 bp, Homo sapiens
acagaattcaaca

SEQ ID NO: 5134156 - DNA, 17 bp, Homo sapiens
acagaattctgctacct

SEQ ID NO: 5134157 - DNA, 14 bp, Homo sapiens
acagaattggatac

SEQ ID NO: 5134158 - DNA, 22 bp, Homo sapiens
acagaattgttctttttcctgt

SEQ ID NO: 5134159 - DNA, 23 bp, Homo sapiens
acagaatttgaattatcagcaaa

SEQ ID NO: 5134160 - DNA, 14 bp, Homo sapiens
acagaatttgagaa

SEQ ID NO: 5134161 - DNA, 14 bp, Homo sapiens
acagaattttggaa

SEQ ID NO: 5134162 - DNA, 16 bp, Homo sapiens
acagaatttttaatga

SEQ ID NO: 5134163 - DNA, 18 bp, Homo sapiens
acagaatttttaatgact

SEQ ID NO: 5134164 - DNA, 20 bp, Homo sapiens
acagacaaaaacagcctcac

SEQ ID NO: 5134165 - DNA, 22 bp, Homo sapiens
acagacaaaacaatccccatca

SEQ ID NO: 5134166 - DNA, 14 bp, Homo sapiens
acagacaaagcgtg

SEQ ID NO: 5134167 - DNA, 23 bp, Homo sapiens
acagacaagagtggtatatacaa

SEQ ID NO: 5134168 - DNA, 18 bp, Homo sapiens
acagacaagcaacccaaa

SEQ ID NO: 5134169 - DNA, 19 bp, Homo sapiens
acagacaagcaacccaaac

SEQ ID NO: 5134170 - DNA, 14 bp, Homo sapiens
acagacaagcagcc

SEQ ID NO: 5134171 - DNA, 15 bp, Homo sapiens
acagacaagcagccc

SEQ ID NO: 5134172 - DNA, 21 bp, Homo sapiens
acagacaagttggaaaaacaa

SEQ ID NO: 5134173 - DNA, 15 bp, Homo sapiens
acagacaattctaat

SEQ ID NO: 5134174 - DNA, 19 bp, Homo sapiens
acagacaattctaatggta

SEQ ID NO: 5134175 - DNA, 15 bp, Homo sapiens
acagacacaatatgt

SEQ ID NO: 5134176 - DNA, 13 bp, Homo sapiens
acagacacacaca

SEQ ID NO: 5134177 - DNA, 23 bp, Homo sapiens
acagacacacacacgcacgcaca

SEQ ID NO: 5134178 - DNA, 16 bp, Homo sapiens
acagacacacactggc

SEQ ID NO: 5134179 - DNA, 17 bp, Homo sapiens
acagacacacactggct

SEQ ID NO: 5134180 - DNA, 19 bp, Homo sapiens
acagacacacactggctcc

SEQ ID NO: 5134181 - DNA, 22 bp, Homo sapiens
acagacacacactggctcctgg

SEQ ID NO: 5134182 - DNA, 17 bp, Homo sapiens
acagacacacagcctca

SEQ ID NO: 5134183 - DNA, 14 bp, Homo sapiens
acagacacaggccc

SEQ ID NO: 5134184 - DNA, 17 bp, Homo sapiens
acagacacaggcccggc

SEQ ID NO: 5134185 - DNA, 22 bp, Homo sapiens
acagacaccctccactctgagg

SEQ ID NO: 5134186 - DNA, 22 bp, Homo sapiens
acagacacctccccctacccat

SEQ ID NO: 5134187 - DNA, 20 bp, Homo sapiens
acagacacgagccacctcac

SEQ ID NO: 5134188 - DNA, 20 bp, Homo sapiens
acagacacgctcgcgggcag

SEQ ID NO: 5134189 - DNA, 21 bp, Homo sapiens
acagacacgctcgcgggcagc

SEQ ID NO: 5134190 - DNA, 14 bp, Homo sapiens
acagacactacatt

SEQ ID NO: 5134191 - DNA, 14 bp, Homo sapiens
acagacactggcat

SEQ ID NO: 5134192 - DNA, 21 bp, Homo sapiens
acagacacttggttagtggct

SEQ ID NO: 5134193 - DNA, 17 bp, Homo sapiens
acagacagaaagagaca

SEQ ID NO: 5134194 - DNA, 16 bp, Homo sapiens
acagacagacacacac

SEQ ID NO: 5134195 - DNA, 21 bp, Homo sapiens
acagacagatcccatccatca

SEQ ID NO: 5134196 - DNA, 14 bp, Homo sapiens
acagacagcagctg

SEQ ID NO: 5134197 - DNA, 13 bp, Homo sapiens
acagacagcttac

SEQ ID NO: 5134198 - DNA, 11 bp, Homo sapiens
acagacaggag

SEQ ID NO: 5134199 - DNA, 14 bp, Homo sapiens
acagacaggagaaa

SEQ ID NO: 5134200 - DNA, 15 bp, Homo sapiens
acagacaggctctta

SEQ ID NO: 5134201 - DNA, 17 bp, Homo sapiens
acagacagggagaagtt

SEQ ID NO: 5134202 - DNA, 19 bp, Homo sapiens
acagacagggcctagcttt

SEQ ID NO: 5134203 - DNA, 13 bp, Homo sapiens
acagacatacata

SEQ ID NO: 5134204 - DNA, 15 bp, Homo sapiens
acagacatacataga

SEQ ID NO: 5134205 - DNA, 19 bp, Homo sapiens
acagacatactaaccagca

SEQ ID NO: 5134206 - DNA, 16 bp, Homo sapiens
acagacattgttttgc

SEQ ID NO: 5134207 - DNA, 17 bp, Homo sapiens
acagacattttcaataa

SEQ ID NO: 5134208 - DNA, 19 bp, Homo sapiens
acagacattttgtgtgaga

SEQ ID NO: 5134209 - DNA, 21 bp, Homo sapiens
acagaccaagtccaagcccgt

SEQ ID NO: 5134210 - DNA, 20 bp, Homo sapiens
acagaccacatctttatctg

SEQ ID NO: 5134211 - DNA, 15 bp, Homo sapiens
acagaccacctgctt

SEQ ID NO: 5134212 - DNA, 19 bp, Homo sapiens
acagaccacctgcttctga

SEQ ID NO: 5134213 - DNA, 13 bp, Homo sapiens
acagaccagcagc

SEQ ID NO: 5134214 - DNA, 16 bp, Homo sapiens
acagaccagcccttcc

SEQ ID NO: 5134215 - DNA, 20 bp, Homo sapiens
acagaccagtgaccccagaa

SEQ ID NO: 5134216 - DNA, 20 bp, Homo sapiens
acagaccatattacctggat

SEQ ID NO: 5134217 - DNA, 21 bp, Homo sapiens
acagaccatggatatgttgta

SEQ ID NO: 5134218 - DNA, 21 bp, Homo sapiens
acagacccacccccagccttg

SEQ ID NO: 5134219 - DNA, 12 bp, Homo sapiens
acagacccagga

SEQ ID NO: 5134220 - DNA, 19 bp, Homo sapiens
acagacccaggtcttccag

SEQ ID NO: 5134221 - DNA, 23 bp, Homo sapiens
acagacccaggtcttccagacct

SEQ ID NO: 5134222 - DNA, 21 bp, Homo sapiens
acagacccctcccctcgtgtc

SEQ ID NO: 5134223 - DNA, 19 bp, Homo sapiens
acagacccctgggggaggc

SEQ ID NO: 5134224 - DNA, 19 bp, Homo sapiens
acagaccctgcccacccca

SEQ ID NO: 5134225 - DNA, 20 bp, Homo sapiens
acagaccctgcccaccccat

SEQ ID NO: 5134226 - DNA, 21 bp, Homo sapiens
acagaccgcgcccctgggact

SEQ ID NO: 5134227 - DNA, 15 bp, Homo sapiens
acagacctaatatca

SEQ ID NO: 5134228 - DNA, 18 bp, Homo sapiens
acagacctaatatcattt

SEQ ID NO: 5134229 - DNA, 16 bp, Homo sapiens
acagacctcagtttta

SEQ ID NO: 5134230 - DNA, 19 bp, Homo sapiens
acagacctccagattattt

SEQ ID NO: 5134231 - DNA, 22 bp, Homo sapiens
acagacctccagattattttct

SEQ ID NO: 5134232 - DNA, 15 bp, Homo sapiens
acagacctgcagtga

SEQ ID NO: 5134233 - DNA, 22 bp, Homo sapiens
acagacctgcagtgaggggccc

SEQ ID NO: 5134234 - DNA, 15 bp, Homo sapiens
acagacctgcttttt

SEQ ID NO: 5134235 - DNA, 16 bp, Homo sapiens
acagacctgctttttg

SEQ ID NO: 5134236 - DNA, 17 bp, Homo sapiens
acagacctggagcccct

SEQ ID NO: 5134237 - DNA, 13 bp, Homo sapiens
acagacctggctc

SEQ ID NO: 5134238 - DNA, 19 bp, Homo sapiens
acagacctggctctcagag

SEQ ID NO: 5134239 - DNA, 16 bp, Homo sapiens
acagacctggtgctct

SEQ ID NO: 5134240 - DNA, 18 bp, Homo sapiens
acagacgagacaacagca

SEQ ID NO: 5134241 - DNA, 23 bp, Homo sapiens
acagacgattaacacaccacact

SEQ ID NO: 5134242 - DNA, 16 bp, Homo sapiens
acagacggaaatgaaa

SEQ ID NO: 5134243 - DNA, 17 bp, Homo sapiens
acagacggaagggtaaa

SEQ ID NO: 5134244 - DNA, 23 bp, Homo sapiens
acagacggaagggtaaacaatat

SEQ ID NO: 5134245 - DNA, 14 bp, Homo sapiens
acaggcctctgcct

SEQ ID NO: 5134246 - DNA, 15 bp, Homo sapiens
acaggcctctgcctg

SEQ ID NO: 5134247 - DNA, 20 bp, Homo sapiens
acaggcctgaagatattact

SEQ ID NO: 5134248 - DNA, 17 bp, Homo sapiens
acaggcctgagatttca

SEQ ID NO: 5134249 - DNA, 21 bp, Homo sapiens
acaggcctgagatttcatctg

SEQ ID NO: 5134250 - DNA, 16 bp, Homo sapiens
acaggcctgcagcccc

SEQ ID NO: 5134251 - DNA, 13 bp, Homo sapiens
acaggcctggccc

SEQ ID NO: 5134252 - DNA, 21 bp, Homo sapiens
acaggcctggcccagccagca

SEQ ID NO: 5134253 - DNA, 14 bp, Homo sapiens
acaggccttctgtg

SEQ ID NO: 5134254 - DNA, 16 bp, Homo sapiens
acaggcgaaagaaaac

SEQ ID NO: 5134255 - DNA, 19 bp, Homo sapiens
acaggcgagagaggagcca

SEQ ID NO: 5134256 - DNA, 17 bp, Homo sapiens
acaggcgcctaaagtca

SEQ ID NO: 5134257 - DNA, 18 bp, Homo sapiens
acaggcgcctaaagtcat

SEQ ID NO: 5134258 - DNA, 17 bp, Homo sapiens
acaggcgggaggaggtg

SEQ ID NO: 5134259 - DNA, 23 bp, Homo sapiens
acaggcggggcccagcgctctcc

SEQ ID NO: 5134260 - DNA, 22 bp, Homo sapiens
acaggcgtgagccaccgtgcct

SEQ ID NO: 5134261 - DNA, 20 bp, Homo sapiens
acaggcgtgagccacctcgc

SEQ ID NO: 5134262 - DNA, 17 bp, Homo sapiens
acaggcgtgggatcaga

SEQ ID NO: 5134263 - DNA, 15 bp, Homo sapiens
acaggcgttctcagc

SEQ ID NO: 5134264 - DNA, 20 bp, Homo sapiens
acaggcgttctcagcctccg

SEQ ID NO: 5134265 - DNA, 18 bp, Homo sapiens
acaggctaggaagaactt

SEQ ID NO: 5134266 - DNA, 14 bp, Homo sapiens
acaggctcaatatt

SEQ ID NO: 5134267 - DNA, 14 bp, Homo sapiens
acaggctcaggcag

SEQ ID NO: 5134268 - DNA, 21 bp, Homo sapiens
acaggctcctgccaccacgcc

SEQ ID NO: 5134269 - DNA, 14 bp, Homo sapiens
acaggctctagaga

SEQ ID NO: 5134270 - DNA, 20 bp, Homo sapiens
acaggctctagagagaggga

SEQ ID NO: 5134271 - DNA, 23 bp, Homo sapiens
acaggctctagagagagggagaa

SEQ ID NO: 5134272 - DNA, 15 bp, Homo sapiens
acaggctcttagcag

SEQ ID NO: 5134273 - DNA, 18 bp, Homo sapiens
acaggctcttctttccca

SEQ ID NO: 5134274 - DNA, 20 bp, Homo sapiens
acaggctcttctttcccaaa

SEQ ID NO: 5134275 - DNA, 21 bp, Homo sapiens
acaggctgaaatatccaccca

SEQ ID NO: 5134276 - DNA, 12 bp, Homo sapiens
acaggctgaaga

SEQ ID NO: 5134277 - DNA, 21 bp, Homo sapiens
acaggctgaagagagggacag

SEQ ID NO: 5134278 - DNA, 21 bp, Homo sapiens
acaggctgagctttctagcct

SEQ ID NO: 5134279 - DNA, 20 bp, Homo sapiens
acaggctgagtgcaggccca

SEQ ID NO: 5134280 - DNA, 19 bp, Homo sapiens
acaggctgcaagctgcagg

SEQ ID NO: 5134281 - DNA, 16 bp, Homo sapiens
acaggctgcggcccct

SEQ ID NO: 5134282 - DNA, 19 bp, Homo sapiens
acaggctgcggcccctccc

SEQ ID NO: 5134283 - DNA, 21 bp, Homo sapiens
acaggctgcggcccctccccc

SEQ ID NO: 5134284 - DNA, 20 bp, Homo sapiens
acaggctggagattttcaca

SEQ ID NO: 5134285 - DNA, 12 bp, Homo sapiens
acaggctgggct

SEQ ID NO: 5134286 - DNA, 23 bp, Homo sapiens
acaggctgggcttcagtggcagc

SEQ ID NO: 5134287 - DNA, 14 bp, Homo sapiens
acaggctgggtcct

SEQ ID NO: 5134288 - DNA, 20 bp, Homo sapiens
acaggctgggtcctgccagc

SEQ ID NO: 5134289 - DNA, 21 bp, Homo sapiens
acaggctgggtcctgccagct

SEQ ID NO: 5134290 - DNA, 12 bp, Homo sapiens
acaggctgtaaa

SEQ ID NO: 5134291 - DNA, 20 bp, Homo sapiens
acaggctgtaaattgaactt

SEQ ID NO: 5134292 - DNA, 13 bp, Homo sapiens
acaggctgtaatt

SEQ ID NO: 5134293 - DNA, 14 bp, Homo sapiens
acaggctgtaattc

SEQ ID NO: 5134294 - DNA, 20 bp, Homo sapiens
acaggctgttctgcactgaa

SEQ ID NO: 5134295 - DNA, 22 bp, Homo sapiens
acaggctgttctgcactgaaaa

SEQ ID NO: 5134296 - DNA, 16 bp, Homo sapiens
acaggcttagggacag

SEQ ID NO: 5134297 - DNA, 19 bp, Homo sapiens
acaggcttagtgatgtaat

SEQ ID NO: 5134298 - DNA, 21 bp, Homo sapiens
acaggcttcgtctcagaaggc

SEQ ID NO: 5134299 - DNA, 16 bp, Homo sapiens
acaggcttctgagcag

SEQ ID NO: 5134300 - DNA, 22 bp, Homo sapiens
acaggcttggagggaagggaga

SEQ ID NO: 5134301 - DNA, 20 bp, Homo sapiens
acaggcttttatttccaggt

SEQ ID NO: 5134302 - DNA, 14 bp, Homo sapiens
acagggaaaaaaag

SEQ ID NO: 5134303 - DNA, 16 bp, Homo sapiens
acagggaaaaaaagaa

SEQ ID NO: 5134304 - DNA, 18 bp, Homo sapiens
acagggaaaggtcagccc

SEQ ID NO: 5134305 - DNA, 17 bp, Homo sapiens
acagggaaatgtgtatc

SEQ ID NO: 5134306 - DNA, 21 bp, Homo sapiens
acagggaacgtgattagtgaa

SEQ ID NO: 5134307 - DNA, 16 bp, Homo sapiens
acagggaactgggaag

SEQ ID NO: 5134308 - DNA, 23 bp, Homo sapiens
acagggaactgggaagatgctgg

SEQ ID NO: 5134309 - DNA, 17 bp, Homo sapiens
acagggaagaaatcaag

SEQ ID NO: 5134310 - DNA, 16 bp, Homo sapiens
acagggaagctacagg

SEQ ID NO: 5134311 - DNA, 18 bp, Homo sapiens
acagggaagctacaggtt

SEQ ID NO: 5134312 - DNA, 19 bp, Homo sapiens
acagggaagctacaggtta

SEQ ID NO: 5134313 - DNA, 12 bp, Homo sapiens
acagggaaggca

SEQ ID NO: 5134314 - DNA, 13 bp, Homo sapiens
acagggaaggcag

SEQ ID NO: 5134315 - DNA, 19 bp, Homo sapiens
acagggaaggcaggcaggg

SEQ ID NO: 5134316 - DNA, 20 bp, Homo sapiens
acagggaaggcaggcagggc

SEQ ID NO: 5134317 - DNA, 22 bp, Homo sapiens
acagggaaggcaggcagggctc

SEQ ID NO: 5134318 - DNA, 18 bp, Homo sapiens
acagggaatgctgaggcc

SEQ ID NO: 5134319 - DNA, 22 bp, Homo sapiens
acagggaatgctgaggcctcga

SEQ ID NO: 5134320 - DNA, 17 bp, Homo sapiens
acagggaatggccacaa

SEQ ID NO: 5134321 - DNA, 13 bp, Homo sapiens
acagggacatgcc

SEQ ID NO: 5134322 - DNA, 21 bp, Homo sapiens
acagggaccacatccacccca

SEQ ID NO: 5134323 - DNA, 22 bp, Homo sapiens
acagggaccacatccaccccag

SEQ ID NO: 5134324 - DNA, 15 bp, Homo sapiens
acagggaccagctcc

SEQ ID NO: 5134325 - DNA, 12 bp, Homo sapiens
acagggaccagg

SEQ ID NO: 5134326 - DNA, 16 bp, Homo sapiens
acagggaccagggcca

SEQ ID NO: 5134327 - DNA, 16 bp, Homo sapiens
acagggacttgaagtt

SEQ ID NO: 5134328 - DNA, 23 bp, Homo sapiens
acagggacttgtttagagagcct

SEQ ID NO: 5134329 - DNA, 13 bp, Homo sapiens
acagggagaagtt

SEQ ID NO: 5134330 - DNA, 20 bp, Homo sapiens
acagggagactgcatctcaa

SEQ ID NO: 5134331 - DNA, 13 bp, Homo sapiens
acagggagccaca

SEQ ID NO: 5134332 - DNA, 23 bp, Homo sapiens
acagggagcccctaggaaagcag

SEQ ID NO: 5134333 - DNA, 17 bp, Homo sapiens
acagggagcctcctgcc

SEQ ID NO: 5134334 - DNA, 18 bp, Homo sapiens
acagggagcctcctgccc

SEQ ID NO: 5134335 - DNA, 19 bp, Homo sapiens
acagggagcctcctgccca

SEQ ID NO: 5134336 - DNA, 20 bp, Homo sapiens
acagggaggacgctctctgg

SEQ ID NO: 5134337 - DNA, 16 bp, Homo sapiens
acagggaggccacacg

SEQ ID NO: 5134338 - DNA, 22 bp, Homo sapiens
acagggaggctcccggggcctg

SEQ ID NO: 5134339 - DNA, 23 bp, Homo sapiens
acagggagggccggcggctctga

SEQ ID NO: 5134340 - DNA, 20 bp, Homo sapiens
acagggagggggacctgtcc

SEQ ID NO: 5134341 - DNA, 21 bp, Homo sapiens
acagggatgagcatggagctg

SEQ ID NO: 5134342 - DNA, 20 bp, Homo sapiens
acagggatttagacttacta

SEQ ID NO: 5134343 - DNA, 16 bp, Homo sapiens
acagggcacaggccat

SEQ ID NO: 5134344 - DNA, 15 bp, Homo sapiens
acagggcaccagagg

SEQ ID NO: 5134345 - DNA, 17 bp, Homo sapiens
acagggcaccagaggcc

SEQ ID NO: 5134346 - DNA, 18 bp, Homo sapiens
acagggcactgactgata

SEQ ID NO: 5134347 - DNA, 13 bp, Homo sapiens
acagggcagaaat

SEQ ID NO: 5134348 - DNA, 17 bp, Homo sapiens
acagggcagagcaggaa

SEQ ID NO: 5134349 - DNA, 12 bp, Homo sapiens
acagggcagcag

SEQ ID NO: 5134350 - DNA, 18 bp, Homo sapiens
acagggcagcagtggggt

SEQ ID NO: 5134351 - DNA, 19 bp, Homo sapiens
acagggcagcagtggggtg

SEQ ID NO: 5134352 - DNA, 16 bp, Homo sapiens
acagggcagctgggcc

SEQ ID NO: 5134353 - DNA, 13 bp, Homo sapiens
acagggcaggcct

SEQ ID NO: 5134354 - DNA, 14 bp, Homo sapiens
acagggcaggcctt

SEQ ID NO: 5134355 - DNA, 22 bp, Homo sapiens
acagggcaggccttgctggggt

SEQ ID NO: 5134356 - DNA, 12 bp, Homo sapiens
acagggcaggcg

SEQ ID NO: 5134357 - DNA, 20 bp, Homo sapiens
acagggcagtacctgagggt

SEQ ID NO: 5134358 - DNA, 23 bp, Homo sapiens
acagggcagtgacaagtggaggg

SEQ ID NO: 5134359 - DNA, 16 bp, Homo sapiens
acagggcatctccagg

SEQ ID NO: 5134360 - DNA, 16 bp, Homo sapiens
acagggcatgcctggc

SEQ ID NO: 5134361 - DNA, 19 bp, Homo sapiens
acagggcatgcctggcctg

SEQ ID NO: 5134362 - DNA, 16 bp, Homo sapiens
acagggccagagggag

SEQ ID NO: 5134363 - DNA, 17 bp, Homo sapiens
acagggccagagggagc

SEQ ID NO: 5134364 - DNA, 14 bp, Homo sapiens
acagggccagatgt

SEQ ID NO: 5134365 - DNA, 19 bp, Homo sapiens
acagggccagtggggcctg

SEQ ID NO: 5134366 - DNA, 16 bp, Homo sapiens
acagggccatgtgctg

SEQ ID NO: 5134367 - DNA, 18 bp, Homo sapiens
acagggccatgtgctgcc

SEQ ID NO: 5134368 - DNA, 20 bp, Homo sapiens
acagggccatgtgctgccct

SEQ ID NO: 5134369 - DNA, 21 bp, Homo sapiens
acagggccatgtgctgccctg

SEQ ID NO: 5134370 - DNA, 16 bp, Homo sapiens
acagggcccaggcctg

SEQ ID NO: 5134371 - DNA, 19 bp, Homo sapiens
acagggcccaggcctggag

SEQ ID NO: 5134372 - DNA, 18 bp, Homo sapiens
acagggcccggccacacc

SEQ ID NO: 5134373 - DNA, 13 bp, Homo sapiens
acagggccctctg

SEQ ID NO: 5134374 - DNA, 20 bp, Homo sapiens
acagggccctgttgaatttt

SEQ ID NO: 5134375 - DNA, 17 bp, Homo sapiens
acagggcctctgcggag

SEQ ID NO: 5134376 - DNA, 14 bp, Homo sapiens
acagggcctgactt

SEQ ID NO: 5134377 - DNA, 12 bp, Homo sapiens
acagggcctggc

SEQ ID NO: 5134378 - DNA, 14 bp, Homo sapiens
acagggcctggccc

SEQ ID NO: 5134379 - DNA, 19 bp, Homo sapiens
acagggcctggcccatgta

SEQ ID NO: 5134380 - DNA, 21 bp, Homo sapiens
acagggcctttggcaggtgca

SEQ ID NO: 5134381 - DNA, 16 bp, Homo sapiens
acagggcgggggtggc

SEQ ID NO: 5134382 - DNA, 17 bp, Homo sapiens
acagggcgtcctctcgt

SEQ ID NO: 5134383 - DNA, 22 bp, Homo sapiens
acagggctaagagctagcgctg

SEQ ID NO: 5134384 - DNA, 22 bp, Homo sapiens
acagggctatcccgtaattgga

SEQ ID NO: 5134385 - DNA, 16 bp, Homo sapiens
acagggctcacagggc

SEQ ID NO: 5134386 - DNA, 16 bp, Homo sapiens
acagggctcatttttg

SEQ ID NO: 5134387 - DNA, 13 bp, Homo sapiens
acagggctccagc

SEQ ID NO: 5134388 - DNA, 14 bp, Homo sapiens
acagggctccagcc

SEQ ID NO: 5134389 - DNA, 17 bp, Homo sapiens
acagggctcctgaagga

SEQ ID NO: 5134390 - DNA, 21 bp, Homo sapiens
acagggctgataagctaacac

SEQ ID NO: 5134391 - DNA, 15 bp, Homo sapiens
acagggctgcaacac

SEQ ID NO: 5134392 - DNA, 24 bp, Homo sapiens
acagggctgctccccaacacctgc

SEQ ID NO: 5134393 - DNA, 13 bp, Homo sapiens
acagggctggccc

SEQ ID NO: 5134394 - DNA, 18 bp, Homo sapiens
acagggctggcccagccc

SEQ ID NO: 5134395 - DNA, 20 bp, Homo sapiens
acagggctggcccagccctg

SEQ ID NO: 5134396 - DNA, 21 bp, Homo sapiens
acagggctggcccagccctgc

SEQ ID NO: 5134397 - DNA, 14 bp, Homo sapiens
acagggctggctcc

SEQ ID NO: 5134398 - DNA, 21 bp, Homo sapiens
acagggctggctcctctgccc

SEQ ID NO: 5134399 - DNA, 15 bp, Homo sapiens
acagggcttggggag

SEQ ID NO: 5134400 - DNA, 20 bp, Homo sapiens
acaggggaaggtggcctctg

SEQ ID NO: 5134401 - DNA, 19 bp, Homo sapiens
acaggggaatattttattc

SEQ ID NO: 5134402 - DNA, 16 bp, Homo sapiens
acaggggaggctgaga

SEQ ID NO: 5134403 - DNA, 16 bp, Homo sapiens
acaggggaggtgatag

SEQ ID NO: 5134404 - DNA, 23 bp, Homo sapiens
acaggggaggtgatagcattgct

SEQ ID NO: 5134405 - DNA, 16 bp, Homo sapiens
acaggggatcaaagtt

SEQ ID NO: 5134406 - DNA, 17 bp, Homo sapiens
acaggggcatctctggg

SEQ ID NO: 5134407 - DNA, 22 bp, Homo sapiens
acaggggccccagatctgcctg

SEQ ID NO: 5134408 - DNA, 21 bp, Homo sapiens
acaggggctggagggctgggc

SEQ ID NO: 5134409 - DNA, 23 bp, Homo sapiens
acaggggctggagggctgggcag

SEQ ID NO: 5134410 - DNA, 12 bp, Homo sapiens
acaggggctggt

SEQ ID NO: 5134411 - DNA, 14 bp, Homo sapiens
acaggggcttgact

SEQ ID NO: 5134412 - DNA, 17 bp, Homo sapiens
acagggggaaaatgttt

SEQ ID NO: 5134413 - DNA, 21 bp, Homo sapiens
acaggggggtcggaagcctgt

SEQ ID NO: 5134414 - DNA, 18 bp, Homo sapiens
acagggggtctggctggt

SEQ ID NO: 5134415 - DNA, 23 bp, Homo sapiens
acagggggtggagagaccagcct

SEQ ID NO: 5134416 - DNA, 13 bp, Homo sapiens
acagggggtggga

SEQ ID NO: 5134417 - DNA, 17 bp, Homo sapiens
acaggggtagtttgttt

SEQ ID NO: 5134418 - DNA, 12 bp, Homo sapiens
acaggggttcct

SEQ ID NO: 5134419 - DNA, 22 bp, Homo sapiens
acaggggttgtgggggcagagg

SEQ ID NO: 5134420 - DNA, 17 bp, Homo sapiens
acagggtaaattattca

SEQ ID NO: 5134421 - DNA, 18 bp, Homo sapiens
acagggtaactgtgctga

SEQ ID NO: 5134422 - DNA, 22 bp, Homo sapiens
acagacggacgggacagcggcc

SEQ ID NO: 5134423 - DNA, 23 bp, Homo sapiens
acagacggacgggacagcggccc

SEQ ID NO: 5134424 - DNA, 15 bp, Homo sapiens
acagacgtatgctta

SEQ ID NO: 5134425 - DNA, 21 bp, Homo sapiens
acagactagaagtatttgtgg

SEQ ID NO: 5134426 - DNA, 16 bp, Homo sapiens
acagactattgacatc

SEQ ID NO: 5134427 - DNA, 17 bp, Homo sapiens
acagactatttaacttg

SEQ ID NO: 5134428 - DNA, 23 bp, Homo sapiens
acagactatttttagattttctt

SEQ ID NO: 5134429 - DNA, 24 bp, Homo sapiens
acagactccatctcttctgcaagc

SEQ ID NO: 5134430 - DNA, 16 bp, Homo sapiens
acagactccctcccct

SEQ ID NO: 5134431 - DNA, 17 bp, Homo sapiens
acagactcctgaggaca

SEQ ID NO: 5134432 - DNA, 22 bp, Homo sapiens
acagactcgattcatattgaat

SEQ ID NO: 5134433 - DNA, 19 bp, Homo sapiens
acagactctgtgagattct

SEQ ID NO: 5134434 - DNA, 16 bp, Homo sapiens
acagactcttcacaga

SEQ ID NO: 5134435 - DNA, 17 bp, Homo sapiens
acagactcttcacagat

SEQ ID NO: 5134436 - DNA, 16 bp, Homo sapiens
acagactcttccacca

SEQ ID NO: 5134437 - DNA, 21 bp, Homo sapiens
acagactcttccaccagagca

SEQ ID NO: 5134438 - DNA, 19 bp, Homo sapiens
acagactgccccagccaac

SEQ ID NO: 5134439 - DNA, 13 bp, Homo sapiens
acagactgcctta

SEQ ID NO: 5134440 - DNA, 14 bp, Homo sapiens
acagactgccttat

SEQ ID NO: 5134441 - DNA, 19 bp, Homo sapiens
acagactgccttatattat

SEQ ID NO: 5134442 - DNA, 23 bp, Homo sapiens
acagactgcgatttgtcccaggt

SEQ ID NO: 5134443 - DNA, 14 bp, Homo sapiens
acagactgctgtct

SEQ ID NO: 5134444 - DNA, 17 bp, Homo sapiens
acagactggaagcacag

SEQ ID NO: 5134445 - DNA, 17 bp, Homo sapiens
acagactggcaataaac

SEQ ID NO: 5134446 - DNA, 14 bp, Homo sapiens
acagactgttccct

SEQ ID NO: 5134447 - DNA, 16 bp, Homo sapiens
acagactgttgagtta

SEQ ID NO: 5134448 - DNA, 20 bp, Homo sapiens
acagactgttgtccctgcac

SEQ ID NO: 5134449 - DNA, 19 bp, Homo sapiens
acagacttatacacccctg

SEQ ID NO: 5134450 - DNA, 21 bp, Homo sapiens
acagacttccaccatgtgcat

SEQ ID NO: 5134451 - DNA, 13 bp, Homo sapiens
acagacttctgaa

SEQ ID NO: 5134452 - DNA, 14 bp, Homo sapiens
acagacttctgaaa

SEQ ID NO: 5134453 - DNA, 16 bp, Homo sapiens
acagacttctggaagg

SEQ ID NO: 5134454 - DNA, 23 bp, Homo sapiens
acagacttctggaaggctggctg

SEQ ID NO: 5134455 - DNA, 14 bp, Homo sapiens
acagacttgaagga

SEQ ID NO: 5134456 - DNA, 14 bp, Homo sapiens
acagacttgagaac

SEQ ID NO: 5134457 - DNA, 16 bp, Homo sapiens
acagacttgcactgaa

SEQ ID NO: 5134458 - DNA, 12 bp, Homo sapiens
acagacttgtat

SEQ ID NO: 5134459 - DNA, 14 bp, Homo sapiens
acagacttgtatat

SEQ ID NO: 5134460 - DNA, 16 bp, Homo sapiens
acagactttagctttc

SEQ ID NO: 5134461 - DNA, 17 bp, Homo sapiens
acagactttagctttct

SEQ ID NO: 5134462 - DNA, 20 bp, Homo sapiens
acagactttagctttctgag

SEQ ID NO: 5134463 - DNA, 19 bp, Homo sapiens
acagactttggacagtggc

SEQ ID NO: 5134464 - DNA, 19 bp, Homo sapiens
acagagaaaagtcaggtgc

SEQ ID NO: 5134465 - DNA, 18 bp, Homo sapiens
acagagaaaatgaatttg

SEQ ID NO: 5134466 - DNA, 16 bp, Homo sapiens
acagagaaacagacag

SEQ ID NO: 5134467 - DNA, 13 bp, Homo sapiens
acagagaaaccag

SEQ ID NO: 5134468 - DNA, 16 bp, Homo sapiens
acagagaaaccagctt

SEQ ID NO: 5134469 - DNA, 23 bp, Homo sapiens
acagagaaaccagcttccttcag

SEQ ID NO: 5134470 - DNA, 12 bp, Homo sapiens
acagagaaagaa

SEQ ID NO: 5134471 - DNA, 14 bp, Homo sapiens
acagagaaagaaaa

SEQ ID NO: 5134472 - DNA, 15 bp, Homo sapiens
acagagaaagaaaag

SEQ ID NO: 5134473 - DNA, 16 bp, Homo sapiens
acagagaaagaaaagg

SEQ ID NO: 5134474 - DNA, 19 bp, Homo sapiens
acagagaaagaggaagctt

SEQ ID NO: 5134475 - DNA, 18 bp, Homo sapiens
acagagaaatacaaaata

SEQ ID NO: 5134476 - DNA, 21 bp, Homo sapiens
acagagaaattctgtggtggg

SEQ ID NO: 5134477 - DNA, 23 bp, Homo sapiens
acagagaactagtggtggctctg

SEQ ID NO: 5134478 - DNA, 18 bp, Homo sapiens
acagagaactttattttg

SEQ ID NO: 5134479 - DNA, 13 bp, Homo sapiens
acagagaagccag

SEQ ID NO: 5134480 - DNA, 17 bp, Homo sapiens
acagagaagccagcttg

SEQ ID NO: 5134481 - DNA, 19 bp, Homo sapiens
acagagaagccagcttgtt

SEQ ID NO: 5134482 - DNA, 15 bp, Homo sapiens
acagagaagccttca

SEQ ID NO: 5134483 - DNA, 22 bp, Homo sapiens
acagagaagccttcaagctctg

SEQ ID NO: 5134484 - DNA, 23 bp, Homo sapiens
acagagaagccttcaagctctga

SEQ ID NO: 5134485 - DNA, 20 bp, Homo sapiens
acagagaagcggatttccag

SEQ ID NO: 5134486 - DNA, 17 bp, Homo sapiens
acagagaagctggggag

SEQ ID NO: 5134487 - DNA, 16 bp, Homo sapiens
acagagaaggcaggaa

SEQ ID NO: 5134488 - DNA, 19 bp, Homo sapiens
acagagaaggcgcttccca

SEQ ID NO: 5134489 - DNA, 16 bp, Homo sapiens
acagagaagggaagaa

SEQ ID NO: 5134490 - DNA, 14 bp, Homo sapiens
acagagaagtcaca

SEQ ID NO: 5134491 - DNA, 17 bp, Homo sapiens
acagagaagtcacaggg

SEQ ID NO: 5134492 - DNA, 23 bp, Homo sapiens
acagagaagtttgtagccaggta

SEQ ID NO: 5134493 - DNA, 13 bp, Homo sapiens
acagagaataact

SEQ ID NO: 5134494 - DNA, 17 bp, Homo sapiens
acagagaatatgtctgc

SEQ ID NO: 5134495 - DNA, 14 bp, Homo sapiens
acagagaatttcta

SEQ ID NO: 5134496 - DNA, 18 bp, Homo sapiens
acagagacaagtaatttc

SEQ ID NO: 5134497 - DNA, 16 bp, Homo sapiens
acagagacacctgcac

SEQ ID NO: 5134498 - DNA, 15 bp, Homo sapiens
acagagacaggccca

SEQ ID NO: 5134499 - DNA, 19 bp, Homo sapiens
acagagacattcctccgag

SEQ ID NO: 5134500 - DNA, 12 bp, Homo sapiens
acagagaccaag

SEQ ID NO: 5134501 - DNA, 11 bp, Homo sapiens
acagagaccta

SEQ ID NO: 5134502 - DNA, 18 bp, Homo sapiens
acagagacgcaggaatgg

SEQ ID NO: 5134503 - DNA, 23 bp, Homo sapiens
acagagactcagatgaggacaga

SEQ ID NO: 5134504 - DNA, 13 bp, Homo sapiens
acagagactctcc

SEQ ID NO: 5134505 - DNA, 17 bp, Homo sapiens
acagagactctccctga

SEQ ID NO: 5134506 - DNA, 13 bp, Homo sapiens
acagagactctgg

SEQ ID NO: 5134507 - DNA, 10 bp, Homo sapiens
acagagagaa

SEQ ID NO: 5134508 - DNA, 18 bp, Homo sapiens
acagagagaaccaggagg

SEQ ID NO: 5134509 - DNA, 13 bp, Homo sapiens
acagagagaatga

SEQ ID NO: 5134510 - DNA, 23 bp, Homo sapiens
acagagagacagacttgagaact

SEQ ID NO: 5134511 - DNA, 21 bp, Homo sapiens
acagagagagactgagggaga

SEQ ID NO: 5134512 - DNA, 22 bp, Homo sapiens
acagagagagagaatggatcct

SEQ ID NO: 5134513 - DNA, 16 bp, Homo sapiens
acagagagaggggaga

SEQ ID NO: 5134514 - DNA, 15 bp, Homo sapiens
acagagaggacgtgg

SEQ ID NO: 5134515 - DNA, 18 bp, Homo sapiens
acagagaggagaaacaca

SEQ ID NO: 5134516 - DNA, 20 bp, Homo sapiens
acagagaggagttgccaggg

SEQ ID NO: 5134517 - DNA, 12 bp, Homo sapiens
acagagagggac

SEQ ID NO: 5134518 - DNA, 13 bp, Homo sapiens
acagagagggaca

SEQ ID NO: 5134519 - DNA, 12 bp, Homo sapiens
acagagatataa

SEQ ID NO: 5134520 - DNA, 16 bp, Homo sapiens
acagagatataaatga

SEQ ID NO: 5134521 - DNA, 15 bp, Homo sapiens
acagagatgccatga

SEQ ID NO: 5134522 - DNA, 19 bp, Homo sapiens
acagagatgctaagagaaa

SEQ ID NO: 5134523 - DNA, 16 bp, Homo sapiens
acagagatggcagagc

SEQ ID NO: 5134524 - DNA, 22 bp, Homo sapiens
acagagattactttgctgcctt

SEQ ID NO: 5134525 - DNA, 16 bp, Homo sapiens
acagagattctgaact

SEQ ID NO: 5134526 - DNA, 17 bp, Homo sapiens
acagagcaaagcgccca

SEQ ID NO: 5134527 - DNA, 23 bp, Homo sapiens
acagagcaaagcgcccacccagg

SEQ ID NO: 5134528 - DNA, 12 bp, Homo sapiens
acagagcaagac

SEQ ID NO: 5134529 - DNA, 14 bp, Homo sapiens
acagagcaagcgaa

SEQ ID NO: 5134530 - DNA, 20 bp, Homo sapiens
acagagcacacttatttatg

SEQ ID NO: 5134531 - DNA, 17 bp, Homo sapiens
acagagcacgcctgcca

SEQ ID NO: 5134532 - DNA, 22 bp, Homo sapiens
acagagcactaggttcaattcc

SEQ ID NO: 5134533 - DNA, 13 bp, Homo sapiens
acagagcagctcc

SEQ ID NO: 5134534 - DNA, 14 bp, Homo sapiens
acagagcaggaagc

SEQ ID NO: 5134535 - DNA, 17 bp, Homo sapiens
acagagcaggggctcca

SEQ ID NO: 5134536 - DNA, 18 bp, Homo sapiens
acagagcaggggctccag

SEQ ID NO: 5134537 - DNA, 17 bp, Homo sapiens
acagagccaagcactgc

SEQ ID NO: 5134538 - DNA, 20 bp, Homo sapiens
acagagccaagcactgctca

SEQ ID NO: 5134539 - DNA, 14 bp, Homo sapiens
acagagccacccca

SEQ ID NO: 5134540 - DNA, 11 bp, Homo sapiens
acagagccagg

SEQ ID NO: 5134541 - DNA, 17 bp, Homo sapiens
acagagccaggagaagc

SEQ ID NO: 5134542 - DNA, 22 bp, Homo sapiens
acagagccaggagaagctcagc

SEQ ID NO: 5134543 - DNA, 20 bp, Homo sapiens
acagagccattcccttggaa

SEQ ID NO: 5134544 - DNA, 19 bp, Homo sapiens
acagagcccacgcccccac

SEQ ID NO: 5134545 - DNA, 19 bp, Homo sapiens
acagagcccagggagactc

SEQ ID NO: 5134546 - DNA, 14 bp, Homo sapiens
acagagcccccaag

SEQ ID NO: 5134547 - DNA, 22 bp, Homo sapiens
acagagcccccaagcctctgcc

SEQ ID NO: 5134548 - DNA, 23 bp, Homo sapiens
acagagcccccaagcctctgccc

SEQ ID NO: 5134549 - DNA, 17 bp, Homo sapiens
acagagcccccctagca

SEQ ID NO: 5134550 - DNA, 19 bp, Homo sapiens
acagagcccccctagcaat

SEQ ID NO: 5134551 - DNA, 15 bp, Homo sapiens
acagagcccgggaga

SEQ ID NO: 5134552 - DNA, 20 bp, Homo sapiens
acagagcccgggagagactc

SEQ ID NO: 5134553 - DNA, 20 bp, Homo sapiens
acagagccctatctatgtcc

SEQ ID NO: 5134554 - DNA, 21 bp, Homo sapiens
acagagccctgaggggctggg

SEQ ID NO: 5134555 - DNA, 19 bp, Homo sapiens
acagagcctgccccagcgc

SEQ ID NO: 5134556 - DNA, 17 bp, Homo sapiens
acagagcctgcctcagc

SEQ ID NO: 5134557 - DNA, 11 bp, Homo sapiens
acagagcctgg

SEQ ID NO: 5134558 - DNA, 13 bp, Homo sapiens
acagagcctggcc

SEQ ID NO: 5134559 - DNA, 13 bp, Homo sapiens
acagagcctggct

SEQ ID NO: 5134560 - DNA, 14 bp, Homo sapiens
acagagcctggctt

SEQ ID NO: 5134561 - DNA, 17 bp, Homo sapiens
acagagcctgttttaaa

SEQ ID NO: 5134562 - DNA, 14 bp, Homo sapiens
acagagccttcaca

SEQ ID NO: 5134563 - DNA, 21 bp, Homo sapiens
acagagcgagagtctgtctca

SEQ ID NO: 5134564 - DNA, 21 bp, Homo sapiens
acagagcgcctcacctgcatc

SEQ ID NO: 5134565 - DNA, 20 bp, Homo sapiens
acagagcgtccttccccctg

SEQ ID NO: 5134566 - DNA, 22 bp, Homo sapiens
acagagcgtgagctgagcaggc

SEQ ID NO: 5134567 - DNA, 18 bp, Homo sapiens
acagagctacacagggga

SEQ ID NO: 5134568 - DNA, 10 bp, Homo sapiens
acagagctga

SEQ ID NO: 5134569 - DNA, 18 bp, Homo sapiens
acagagctgacaaaattt

SEQ ID NO: 5134570 - DNA, 14 bp, Homo sapiens
acagagctggatgc

SEQ ID NO: 5134571 - DNA, 21 bp, Homo sapiens
acagagctgggatgtttctgt

SEQ ID NO: 5134572 - DNA, 22 bp, Homo sapiens
acagagctgtcacttttgctcc

SEQ ID NO: 5134573 - DNA, 15 bp, Homo sapiens
acagagcttccctga

SEQ ID NO: 5134574 - DNA, 16 bp, Homo sapiens
acagagcttccctgac

SEQ ID NO: 5134575 - DNA, 14 bp, Homo sapiens
acagagcttgaaaa

SEQ ID NO: 5134576 - DNA, 17 bp, Homo sapiens
acagagctttcttttgt

SEQ ID NO: 5134577 - DNA, 22 bp, Homo sapiens
acagagctttcttttgtattaa

SEQ ID NO: 5134578 - DNA, 19 bp, Homo sapiens
acagaggaaacaatattta

SEQ ID NO: 5134579 - DNA, 17 bp, Homo sapiens
acagaggaaagggctgg

SEQ ID NO: 5134580 - DNA, 12 bp, Homo sapiens
acagaggaagaa

SEQ ID NO: 5134581 - DNA, 21 bp, Homo sapiens
acagaggaatttatacctcaa

SEQ ID NO: 5134582 - DNA, 14 bp, Homo sapiens
acagaggaccagca

SEQ ID NO: 5134583 - DNA, 21 bp, Homo sapiens
acagaggaccagcacactccc

SEQ ID NO: 5134584 - DNA, 17 bp, Homo sapiens
acagaggagagtcccag

SEQ ID NO: 5134585 - DNA, 21 bp, Homo sapiens
acagaggaggatgtaaggcct

SEQ ID NO: 5134586 - DNA, 16 bp, Homo sapiens
acagaggatgagctct

SEQ ID NO: 5134587 - DNA, 19 bp, Homo sapiens
acagaggatgccttttctg

SEQ ID NO: 5134588 - DNA, 20 bp, Homo sapiens
acagaggatgccttttctgt

SEQ ID NO: 5134589 - DNA, 17 bp, Homo sapiens
acagaggatgctgaagt

SEQ ID NO: 5134590 - DNA, 22 bp, Homo sapiens
acagaggatgctgaagtacagt

SEQ ID NO: 5134591 - DNA, 22 bp, Homo sapiens
acagaggatgctgacatcattt

SEQ ID NO: 5134592 - DNA, 15 bp, Homo sapiens
acagaggcagcccca

SEQ ID NO: 5134593 - DNA, 23 bp, Homo sapiens
acagaggcagctgtgtgggctgc

SEQ ID NO: 5134594 - DNA, 16 bp, Homo sapiens
acagaggcagggcagc

SEQ ID NO: 5134595 - DNA, 15 bp, Homo sapiens
acagaggcagtggca

SEQ ID NO: 5134596 - DNA, 17 bp, Homo sapiens
acagaggccaaggactg

SEQ ID NO: 5134597 - DNA, 21 bp, Homo sapiens
acagaggccatgggcctcctg

SEQ ID NO: 5134598 - DNA, 17 bp, Homo sapiens
acagaggccccacctga

SEQ ID NO: 5134599 - DNA, 22 bp, Homo sapiens
acagaggccccacctgaagggt

SEQ ID NO: 5134600 - DNA, 15 bp, Homo sapiens
acagaggccctcaag

SEQ ID NO: 5134601 - DNA, 15 bp, Homo sapiens
acagggtacctcaag

SEQ ID NO: 5134602 - DNA, 15 bp, Homo sapiens
acagggtaggaaagg

SEQ ID NO: 5134603 - DNA, 16 bp, Homo sapiens
acagggtattaagaat

SEQ ID NO: 5134604 - DNA, 16 bp, Homo sapiens
acagggtccaggaatg

SEQ ID NO: 5134605 - DNA, 23 bp, Homo sapiens
acagggtccaggaatggtgcttt

SEQ ID NO: 5134606 - DNA, 21 bp, Homo sapiens
acagggtccccgagtgcctag

SEQ ID NO: 5134607 - DNA, 21 bp, Homo sapiens
acagggtccctggatcagggt

SEQ ID NO: 5134608 - DNA, 12 bp, Homo sapiens
acagggtctcac

SEQ ID NO: 5134609 - DNA, 18 bp, Homo sapiens
acagggtctcactgtgtt

SEQ ID NO: 5134610 - DNA, 21 bp, Homo sapiens
acagggtctctagtgctgtga

SEQ ID NO: 5134611 - DNA, 14 bp, Homo sapiens
acagggtctcttcc

SEQ ID NO: 5134612 - DNA, 14 bp, Homo sapiens
acagggtctgcctc

SEQ ID NO: 5134613 - DNA, 22 bp, Homo sapiens
acagggtctgcctccagccaaa

SEQ ID NO: 5134614 - DNA, 22 bp, Homo sapiens
acagggtctgctctttctctgc

SEQ ID NO: 5134615 - DNA, 15 bp, Homo sapiens
acagggtctgggaca

SEQ ID NO: 5134616 - DNA, 13 bp, Homo sapiens
acagggtcttgca

SEQ ID NO: 5134617 - DNA, 15 bp, Homo sapiens
acagggtcttgctct

SEQ ID NO: 5134618 - DNA, 17 bp, Homo sapiens
acagggtcttgctctgt

SEQ ID NO: 5134619 - DNA, 20 bp, Homo sapiens
acagggtcttttttcatttc

SEQ ID NO: 5134620 - DNA, 21 bp, Homo sapiens
acagggtgaataaagcaggga

SEQ ID NO: 5134621 - DNA, 19 bp, Homo sapiens
acagggtgagggccacctc

SEQ ID NO: 5134622 - DNA, 16 bp, Homo sapiens
acagggtggcccaggt

SEQ ID NO: 5134623 - DNA, 13 bp, Homo sapiens
acagggtgggctt

SEQ ID NO: 5134624 - DNA, 13 bp, Homo sapiens
acagggtggggct

SEQ ID NO: 5134625 - DNA, 17 bp, Homo sapiens
acagggtggtggcacat

SEQ ID NO: 5134626 - DNA, 17 bp, Homo sapiens
acagggtgtctgtcagt

SEQ ID NO: 5134627 - DNA, 16 bp, Homo sapiens
acagggtgttgtcagc

SEQ ID NO: 5134628 - DNA, 21 bp, Homo sapiens
acagggtgttgtcagcatctt

SEQ ID NO: 5134629 - DNA, 23 bp, Homo sapiens
acagggtttggctgtgtctaaac

SEQ ID NO: 5134630 - DNA, 19 bp, Homo sapiens
acagggttttgccatgttg

SEQ ID NO: 5134631 - DNA, 18 bp, Homo sapiens
acagggtttttacctgtc

SEQ ID NO: 5134632 - DNA, 23 bp, Homo sapiens
acagggtttttacctgtcacatt

SEQ ID NO: 5134633 - DNA, 15 bp, Homo sapiens
acaggtaaaacaggg

SEQ ID NO: 5134634 - DNA, 16 bp, Homo sapiens
acaggtaaaacagggc

SEQ ID NO: 5134635 - DNA, 15 bp, Homo sapiens
acaggtaaacacata

SEQ ID NO: 5134636 - DNA, 17 bp, Homo sapiens
acaggtaaacacataaa

SEQ ID NO: 5134637 - DNA, 20 bp, Homo sapiens
acaggtaacattataaatga

SEQ ID NO: 5134638 - DNA, 15 bp, Homo sapiens
acaggtaatataaaa

SEQ ID NO: 5134639 - DNA, 21 bp, Homo sapiens
acaggtacatagctctcatgt

SEQ ID NO: 5134640 - DNA, 14 bp, Homo sapiens
acaggtactttgtc

SEQ ID NO: 5134641 - DNA, 20 bp, Homo sapiens
acaggtagtgggctcacaac

SEQ ID NO: 5134642 - DNA, 19 bp, Homo sapiens
acaggtatatactttgaaa

SEQ ID NO: 5134643 - DNA, 16 bp, Homo sapiens
acaggtatcaggcaca

SEQ ID NO: 5134644 - DNA, 17 bp, Homo sapiens
acaggtatcaggcacag

SEQ ID NO: 5134645 - DNA, 19 bp, Homo sapiens
acaggtatcaggcacaggc

SEQ ID NO: 5134646 - DNA, 21 bp, Homo sapiens
acaggtatcaggcacaggcag

SEQ ID NO: 5134647 - DNA, 22 bp, Homo sapiens
acaggtatcaggcacaggcagg

SEQ ID NO: 5134648 - DNA, 12 bp, Homo sapiens
acaggtattttc

SEQ ID NO: 5134649 - DNA, 17 bp, Homo sapiens
acaggtattttgtttct

SEQ ID NO: 5134650 - DNA, 18 bp, Homo sapiens
acaggtattttgtttctt

SEQ ID NO: 5134651 - DNA, 16 bp, Homo sapiens
acaggtatttttttaa

SEQ ID NO: 5134652 - DNA, 18 bp, Homo sapiens
acaggtcaaagatgtgtt

SEQ ID NO: 5134653 - DNA, 23 bp, Homo sapiens
acaggtcaatacagtacaggcag

SEQ ID NO: 5134654 - DNA, 17 bp, Homo sapiens
acaggtcacccatcagg

SEQ ID NO: 5134655 - DNA, 22 bp, Homo sapiens
acaggtcaggggtgacacagac

SEQ ID NO: 5134656 - DNA, 23 bp, Homo sapiens
acaggtcagtagtcacaaactga

SEQ ID NO: 5134657 - DNA, 15 bp, Homo sapiens
acaggtcatcagatg

SEQ ID NO: 5134658 - DNA, 17 bp, Homo sapiens
acaggtccaaggctggt

SEQ ID NO: 5134659 - DNA, 20 bp, Homo sapiens
acaggtcccacctccagccc

SEQ ID NO: 5134660 - DNA, 15 bp, Homo sapiens
acaggtccctcccct

SEQ ID NO: 5134661 - DNA, 23 bp, Homo sapiens
acaggtcctgaaagtctgtgtcc

SEQ ID NO: 5134662 - DNA, 23 bp, Homo sapiens
acaggtcctgaatgtcctttctc

SEQ ID NO: 5134663 - DNA, 14 bp, Homo sapiens
acaggtcgagctgt

SEQ ID NO: 5134664 - DNA, 18 bp, Homo sapiens
acaggtcgagctgtgctc

SEQ ID NO: 5134665 - DNA, 20 bp, Homo sapiens
acaggtcgagctgtgctcgg

SEQ ID NO: 5134666 - DNA, 17 bp, Homo sapiens
acaggtctagactttct

SEQ ID NO: 5134667 - DNA, 14 bp, Homo sapiens
acaggtctcctctt

SEQ ID NO: 5134668 - DNA, 13 bp, Homo sapiens
acaggtctctgag

SEQ ID NO: 5134669 - DNA, 14 bp, Homo sapiens
acaggtctctgaga

SEQ ID NO: 5134670 - DNA, 17 bp, Homo sapiens
acaggtctctgagacag

SEQ ID NO: 5134671 - DNA, 15 bp, Homo sapiens
acaggtcttctttaa

SEQ ID NO: 5134672 - DNA, 14 bp, Homo sapiens
acaggtcttttctt

SEQ ID NO: 5134673 - DNA, 16 bp, Homo sapiens
acaggtgacagtggct

SEQ ID NO: 5134674 - DNA, 23 bp, Homo sapiens
acaggtgactaccctagttcaaa

SEQ ID NO: 5134675 - DNA, 20 bp, Homo sapiens
acaggtgaggggcaggacct

SEQ ID NO: 5134676 - DNA, 16 bp, Homo sapiens
acaggtgatgctctgg

SEQ ID NO: 5134677 - DNA, 14 bp, Homo sapiens
acaggtgcccacca

SEQ ID NO: 5134678 - DNA, 16 bp, Homo sapiens
acaggtgccccacctc

SEQ ID NO: 5134679 - DNA, 19 bp, Homo sapiens
acaggtgccgccagctgcc

SEQ ID NO: 5134680 - DNA, 19 bp, Homo sapiens
acaggtgcctaacctggga

SEQ ID NO: 5134681 - DNA, 13 bp, Homo sapiens
acaggtgcctggg

SEQ ID NO: 5134682 - DNA, 20 bp, Homo sapiens
acaggtgcctggggctggct

SEQ ID NO: 5134683 - DNA, 21 bp, Homo sapiens
acaggtgcctggggctggctg

SEQ ID NO: 5134684 - DNA, 23 bp, Homo sapiens
acaggtgcgcgccaccgtgcctg

SEQ ID NO: 5134685 - DNA, 18 bp, Homo sapiens
acaggtgctaatttgttt

SEQ ID NO: 5134686 - DNA, 17 bp, Homo sapiens
acaggtgctggcccagc

SEQ ID NO: 5134687 - DNA, 22 bp, Homo sapiens
acaggtggaaaaactgagacag

SEQ ID NO: 5134688 - DNA, 19 bp, Homo sapiens
acaggtggacaaatgttgt

SEQ ID NO: 5134689 - DNA, 20 bp, Homo sapiens
acaggtggcaggaccaggac

SEQ ID NO: 5134690 - DNA, 23 bp, Homo sapiens
acaggtgggatatgctagaaaag

SEQ ID NO: 5134691 - DNA, 22 bp, Homo sapiens
acaggtgggcctggcggcctgt

SEQ ID NO: 5134692 - DNA, 23 bp, Homo sapiens
acaggtgggcctggcggcctgtg

SEQ ID NO: 5134693 - DNA, 16 bp, Homo sapiens
acaggtgggcctggga

SEQ ID NO: 5134694 - DNA, 22 bp, Homo sapiens
acaggtgggcttcccagtggct

SEQ ID NO: 5134695 - DNA, 11 bp, Homo sapiens
acaggtgggga

SEQ ID NO: 5134696 - DNA, 20 bp, Homo sapiens
acaggtggggactgggcaca

SEQ ID NO: 5134697 - DNA, 18 bp, Homo sapiens
acaggtggggcctcagcc

SEQ ID NO: 5134698 - DNA, 21 bp, Homo sapiens
acaggtggggcctcagcctgg

SEQ ID NO: 5134699 - DNA, 22 bp, Homo sapiens
acaggtggggcctcagcctggg

SEQ ID NO: 5134700 - DNA, 12 bp, Homo sapiens
acaggtgtaaat

SEQ ID NO: 5134701 - DNA, 13 bp, Homo sapiens
acaggtgtaaata

SEQ ID NO: 5134702 - DNA, 22 bp, Homo sapiens
acaggtgtcaccatcatttcta

SEQ ID NO: 5134703 - DNA, 14 bp, Homo sapiens
acaggtgtctgcct

SEQ ID NO: 5134704 - DNA, 20 bp, Homo sapiens
acaggtgtgaaccaccacac

SEQ ID NO: 5134705 - DNA, 23 bp, Homo sapiens
acaggtgtgaaccaccacaccca

SEQ ID NO: 5134706 - DNA, 13 bp, Homo sapiens
acaggtgtgcacc

SEQ ID NO: 5134707 - DNA, 19 bp, Homo sapiens
acaggtgtggggacacagc

SEQ ID NO: 5134708 - DNA, 23 bp, Homo sapiens
acaggtgtgtgtgaactgggcac

SEQ ID NO: 5134709 - DNA, 17 bp, Homo sapiens
acaggtgttccgtggga

SEQ ID NO: 5134710 - DNA, 17 bp, Homo sapiens
acaggtgttcctcctcc

SEQ ID NO: 5134711 - DNA, 16 bp, Homo sapiens
acaggtgttggaagcc

SEQ ID NO: 5134712 - DNA, 18 bp, Homo sapiens
acaggtgtttatatctcc

SEQ ID NO: 5134713 - DNA, 18 bp, Homo sapiens
acaggtgtttgactttca

SEQ ID NO: 5134714 - DNA, 21 bp, Homo sapiens
acaggttaaatatataaacaa

SEQ ID NO: 5134715 - DNA, 15 bp, Homo sapiens
acaggttaagtagca

SEQ ID NO: 5134716 - DNA, 18 bp, Homo sapiens
acaggttacaacagattt

SEQ ID NO: 5134717 - DNA, 15 bp, Homo sapiens
acaggttagctgctc

SEQ ID NO: 5134718 - DNA, 21 bp, Homo sapiens
acaggttattttagtttctgt

SEQ ID NO: 5134719 - DNA, 12 bp, Homo sapiens
acaggttcccag

SEQ ID NO: 5134720 - DNA, 14 bp, Homo sapiens
acaggttcccagca

SEQ ID NO: 5134721 - DNA, 14 bp, Homo sapiens
acaggttcctgtgg

SEQ ID NO: 5134722 - DNA, 16 bp, Homo sapiens
acaggttcctgtggag

SEQ ID NO: 5134723 - DNA, 16 bp, Homo sapiens
acaggttccttttaag

SEQ ID NO: 5134724 - DNA, 22 bp, Homo sapiens
acaggttccttttaagtggact

SEQ ID NO: 5134725 - DNA, 19 bp, Homo sapiens
acaggttcttaaaaaggaa

SEQ ID NO: 5134726 - DNA, 20 bp, Homo sapiens
acaggttggaagagaatcac

SEQ ID NO: 5134727 - DNA, 18 bp, Homo sapiens
acaggtttatctgaagga

SEQ ID NO: 5134728 - DNA, 15 bp, Homo sapiens
acaggtttgggaccc

SEQ ID NO: 5134729 - DNA, 15 bp, Homo sapiens
acaggtttgtttctt

SEQ ID NO: 5134730 - DNA, 19 bp, Homo sapiens
acaggtttgttttttcaag

SEQ ID NO: 5134731 - DNA, 21 bp, Homo sapiens
acaggttttagcattgtcttg

SEQ ID NO: 5134732 - DNA, 14 bp, Homo sapiens
acaggttttataat

SEQ ID NO: 5134733 - DNA, 17 bp, Homo sapiens
acaggttttatgagact

SEQ ID NO: 5134734 - DNA, 18 bp, Homo sapiens
acaggttttatgtgttct

SEQ ID NO: 5134735 - DNA, 16 bp, Homo sapiens
acaggttttcacataa

SEQ ID NO: 5134736 - DNA, 13 bp, Homo sapiens
acaggttttcaga

SEQ ID NO: 5134737 - DNA, 14 bp, Homo sapiens
acaggttttcagag

SEQ ID NO: 5134738 - DNA, 18 bp, Homo sapiens
acaggttttcagagaatt

SEQ ID NO: 5134739 - DNA, 13 bp, Homo sapiens
acaggttttcagc

SEQ ID NO: 5134740 - DNA, 22 bp, Homo sapiens
acaggttttcctgaagaattga

SEQ ID NO: 5134741 - DNA, 19 bp, Homo sapiens
acaggtttttgattttgaa

SEQ ID NO: 5134742 - DNA, 13 bp, Homo sapiens
acagtaaaaataa

SEQ ID NO: 5134743 - DNA, 16 bp, Homo sapiens
acagtaaaaataaaat

SEQ ID NO: 5134744 - DNA, 13 bp, Homo sapiens
acagtaaaaattt

SEQ ID NO: 5134745 - DNA, 19 bp, Homo sapiens
acagtaaaacaggctgctt

SEQ ID NO: 5134746 - DNA, 20 bp, Homo sapiens
acagtaaaacaggctgctta

SEQ ID NO: 5134747 - DNA, 20 bp, Homo sapiens
acagtaaaagccttattcta

SEQ ID NO: 5134748 - DNA, 13 bp, Homo sapiens
acagtaaaatatt

SEQ ID NO: 5134749 - DNA, 23 bp, Homo sapiens
acagtaaacactccacattcttc

SEQ ID NO: 5134750 - DNA, 20 bp, Homo sapiens
acagtaaaccactgaaaaaa

SEQ ID NO: 5134751 - DNA, 13 bp, Homo sapiens
acagtaaactcac

SEQ ID NO: 5134752 - DNA, 14 bp, Homo sapiens
acagtaaagaggct

SEQ ID NO: 5134753 - DNA, 19 bp, Homo sapiens
acagtaaagagtacactca

SEQ ID NO: 5134754 - DNA, 12 bp, Homo sapiens
acagtaaataaa

SEQ ID NO: 5134755 - DNA, 15 bp, Homo sapiens
acagtaaataaattg

SEQ ID NO: 5134756 - DNA, 17 bp, Homo sapiens
acagtaaatacactgtg

SEQ ID NO: 5134757 - DNA, 20 bp, Homo sapiens
acagtaaatacactgtgaag

SEQ ID NO: 5134758 - DNA, 19 bp, Homo sapiens
acagtaaatatacacttta

SEQ ID NO: 5134759 - DNA, 22 bp, Homo sapiens
acagtaaatatacactttacat

SEQ ID NO: 5134760 - DNA, 22 bp, Homo sapiens
acagtaacaaataaagtgcagt

SEQ ID NO: 5134761 - DNA, 17 bp, Homo sapiens
acagtaacggtgtttag

SEQ ID NO: 5134762 - DNA, 20 bp, Homo sapiens
acagtaactaagcacattat

SEQ ID NO: 5134763 - DNA, 16 bp, Homo sapiens
acagtaactgccattt

SEQ ID NO: 5134764 - DNA, 10 bp, Homo sapiens
acagtaactt

SEQ ID NO: 5134765 - DNA, 15 bp, Homo sapiens
acagtaacttggtta

SEQ ID NO: 5134766 - DNA, 20 bp, Homo sapiens
acagtaacttggttatacat

SEQ ID NO: 5134767 - DNA, 15 bp, Homo sapiens
acagtaactttatgt

SEQ ID NO: 5134768 - DNA, 13 bp, Homo sapiens
acagtaagagttt

SEQ ID NO: 5134769 - DNA, 18 bp, Homo sapiens
acagtaagagtttacaag

SEQ ID NO: 5134770 - DNA, 22 bp, Homo sapiens
acagtaagagtttacaagaaat

SEQ ID NO: 5134771 - DNA, 15 bp, Homo sapiens
acagtaagatatctc

SEQ ID NO: 5134772 - DNA, 13 bp, Homo sapiens
acagtaagctggt

SEQ ID NO: 5134773 - DNA, 23 bp, Homo sapiens
acagtaagctggtttacagatgt

SEQ ID NO: 5134774 - DNA, 14 bp, Homo sapiens
acagtaagttccta

SEQ ID NO: 5134775 - DNA, 20 bp, Homo sapiens
acagtaagttcctactaggc

SEQ ID NO: 5134776 - DNA, 20 bp, Homo sapiens
acagtaatacattccattgt

SEQ ID NO: 5134777 - DNA, 17 bp, Homo sapiens
acagtaatatgtttaat

SEQ ID NO: 5134778 - DNA, 17 bp, Homo sapiens
acagtaatattggcata

SEQ ID NO: 5134779 - DNA, 20 bp, Homo sapiens
acagaggccggggtccaggc

SEQ ID NO: 5134780 - DNA, 13 bp, Homo sapiens
acagaggcctgcc

SEQ ID NO: 5134781 - DNA, 16 bp, Homo sapiens
acagaggctggcactg

SEQ ID NO: 5134782 - DNA, 18 bp, Homo sapiens
acagaggctgtggtcaga

SEQ ID NO: 5134783 - DNA, 15 bp, Homo sapiens
acagagggaagaaaa

SEQ ID NO: 5134784 - DNA, 16 bp, Homo sapiens
acagagggaagaaaag

SEQ ID NO: 5134785 - DNA, 15 bp, Homo sapiens
acagagggaagccag

SEQ ID NO: 5134786 - DNA, 16 bp, Homo sapiens
acagagggagaaggga

SEQ ID NO: 5134787 - DNA, 18 bp, Homo sapiens
acagagggagacagggct

SEQ ID NO: 5134788 - DNA, 19 bp, Homo sapiens
acagagggagacagggctg

SEQ ID NO: 5134789 - DNA, 20 bp, Homo sapiens
acagagggagacagggctgc

SEQ ID NO: 5134790 - DNA, 15 bp, Homo sapiens
acagagggaggacct

SEQ ID NO: 5134791 - DNA, 23 bp, Homo sapiens
acagagggatggcgaatacctca

SEQ ID NO: 5134792 - DNA, 13 bp, Homo sapiens
acagagggcacat

SEQ ID NO: 5134793 - DNA, 13 bp, Homo sapiens
acagagggccaga

SEQ ID NO: 5134794 - DNA, 17 bp, Homo sapiens
acagagggctcattttc

SEQ ID NO: 5134795 - DNA, 18 bp, Homo sapiens
acagaggggagcagtggc

SEQ ID NO: 5134796 - DNA, 13 bp, Homo sapiens
acagaggggcagg

SEQ ID NO: 5134797 - DNA, 17 bp, Homo sapiens
acagagggggtggcctc

SEQ ID NO: 5134798 - DNA, 21 bp, Homo sapiens
acagagggggtggcctcccaa

SEQ ID NO: 5134799 - DNA, 17 bp, Homo sapiens
acagaggtaaaaaaaag

SEQ ID NO: 5134800 - DNA, 20 bp, Homo sapiens
acagaggtaaaaaaaagaag

SEQ ID NO: 5134801 - DNA, 13 bp, Homo sapiens
acagaggtaacta

SEQ ID NO: 5134802 - DNA, 23 bp, Homo sapiens
acagaggtcaggaagcaggggtg

SEQ ID NO: 5134803 - DNA, 16 bp, Homo sapiens
acagaggttgcagtga

SEQ ID NO: 5134804 - DNA, 22 bp, Homo sapiens
acagaggttgtagtgagccaag

SEQ ID NO: 5134805 - DNA, 14 bp, Homo sapiens
acagaggtttcatt

SEQ ID NO: 5134806 - DNA, 15 bp, Homo sapiens
acagaggtttcattt

SEQ ID NO: 5134807 - DNA, 18 bp, Homo sapiens
acagaggtttcattttca

SEQ ID NO: 5134808 - DNA, 14 bp, Homo sapiens
acagagtaaaagta

SEQ ID NO: 5134809 - DNA, 21 bp, Homo sapiens
acagagtaaatagcattctct

SEQ ID NO: 5134810 - DNA, 14 bp, Homo sapiens
acagagtaagacat

SEQ ID NO: 5134811 - DNA, 17 bp, Homo sapiens
acagagtaagacattgg

SEQ ID NO: 5134812 - DNA, 15 bp, Homo sapiens
acagagtaatcttgt

SEQ ID NO: 5134813 - DNA, 16 bp, Homo sapiens
acagagtaattatagg

SEQ ID NO: 5134814 - DNA, 15 bp, Homo sapiens
acagagtatatatgt

SEQ ID NO: 5134815 - DNA, 22 bp, Homo sapiens
acagagtatatatgtacagtta

SEQ ID NO: 5134816 - DNA, 13 bp, Homo sapiens
acagagtatattt

SEQ ID NO: 5134817 - DNA, 23 bp, Homo sapiens
acagagtatgaacacctgggctt

SEQ ID NO: 5134818 - DNA, 14 bp, Homo sapiens
acagagtatttctg

SEQ ID NO: 5134819 - DNA, 18 bp, Homo sapiens
acagagtcgatgctcaat

SEQ ID NO: 5134820 - DNA, 14 bp, Homo sapiens
acagagtctcactg

SEQ ID NO: 5134821 - DNA, 17 bp, Homo sapiens
acagagtctcactgttg

SEQ ID NO: 5134822 - DNA, 23 bp, Homo sapiens
acagagtctcactgttgcccagg

SEQ ID NO: 5134823 - DNA, 21 bp, Homo sapiens
acagagtgagactctgtctca

SEQ ID NO: 5134824 - DNA, 19 bp, Homo sapiens
acagagtgatagccttccg

SEQ ID NO: 5134825 - DNA, 17 bp, Homo sapiens
acagagtgatttgtaaa

SEQ ID NO: 5134826 - DNA, 20 bp, Homo sapiens
acagagtgccatccctgaga

SEQ ID NO: 5134827 - DNA, 13 bp, Homo sapiens
acagagtgccctg

SEQ ID NO: 5134828 - DNA, 14 bp, Homo sapiens
acagagtgccctgg

SEQ ID NO: 5134829 - DNA, 18 bp, Homo sapiens
acagagtgccctggggca

SEQ ID NO: 5134830 - DNA, 16 bp, Homo sapiens
acagagtgcctgcatt

SEQ ID NO: 5134831 - DNA, 12 bp, Homo sapiens
acagagtggact

SEQ ID NO: 5134832 - DNA, 17 bp, Homo sapiens
acagagtggactcttcc

SEQ ID NO: 5134833 - DNA, 18 bp, Homo sapiens
acagagtggactcttccc

SEQ ID NO: 5134834 - DNA, 19 bp, Homo sapiens
acagagtggcctccctgct

SEQ ID NO: 5134835 - DNA, 18 bp, Homo sapiens
acagagtggtctttctgg

SEQ ID NO: 5134836 - DNA, 19 bp, Homo sapiens
acagagtggtctttctgga

SEQ ID NO: 5134837 - DNA, 19 bp, Homo sapiens
acagagtgtgctggaggac

SEQ ID NO: 5134838 - DNA, 18 bp, Homo sapiens
acagagtgtggactctgg

SEQ ID NO: 5134839 - DNA, 16 bp, Homo sapiens
acagagtgtgtttttg

SEQ ID NO: 5134840 - DNA, 17 bp, Homo sapiens
acagagtgtgtttttgc

SEQ ID NO: 5134841 - DNA, 13 bp, Homo sapiens
acagagttcacag

SEQ ID NO: 5134842 - DNA, 15 bp, Homo sapiens
acagagttcacagga

SEQ ID NO: 5134843 - DNA, 17 bp, Homo sapiens
acagagttcacaggagg

SEQ ID NO: 5134844 - DNA, 21 bp, Homo sapiens
acagagttcacaggaggccag

SEQ ID NO: 5134845 - DNA, 16 bp, Homo sapiens
acagagttgttacatt

SEQ ID NO: 5134846 - DNA, 17 bp, Homo sapiens
acagagttgttacattt

SEQ ID NO: 5134847 - DNA, 18 bp, Homo sapiens
acagagttgttacatttt

SEQ ID NO: 5134848 - DNA, 19 bp, Homo sapiens
acagagttgttacattttt

SEQ ID NO: 5134849 - DNA, 20 bp, Homo sapiens
acagagttgttacattttta

SEQ ID NO: 5134850 - DNA, 22 bp, Homo sapiens
acagagttgttacatttttaag

SEQ ID NO: 5134851 - DNA, 18 bp, Homo sapiens
acagagtttcaccatgtt

SEQ ID NO: 5134852 - DNA, 15 bp, Homo sapiens
acagagtttgtagta

SEQ ID NO: 5134853 - DNA, 12 bp, Homo sapiens
acagagttttct

SEQ ID NO: 5134854 - DNA, 13 bp, Homo sapiens
acagagtttttta

SEQ ID NO: 5134855 - DNA, 13 bp, Homo sapiens
acagataaaaagt

SEQ ID NO: 5134856 - DNA, 22 bp, Homo sapiens
acagataaagaaactgaggccc

SEQ ID NO: 5134857 - DNA, 17 bp, Homo sapiens
acagataaagattgtgt

SEQ ID NO: 5134858 - DNA, 15 bp, Homo sapiens
acagataacataaat

SEQ ID NO: 5134859 - DNA, 14 bp, Homo sapiens
acagataacctaat

SEQ ID NO: 5134860 - DNA, 18 bp, Homo sapiens
acagataactgaaaatta

SEQ ID NO: 5134861 - DNA, 13 bp, Homo sapiens
acagataagcaag

SEQ ID NO: 5134862 - DNA, 13 bp, Homo sapiens
acagataaggaaa

SEQ ID NO: 5134863 - DNA, 14 bp, Homo sapiens
acagataattcatt

SEQ ID NO: 5134864 - DNA, 19 bp, Homo sapiens
acagataattcatttgtat

SEQ ID NO: 5134865 - DNA, 14 bp, Homo sapiens
acagataatttatt

SEQ ID NO: 5134866 - DNA, 15 bp, Homo sapiens
acagatacacacaca

SEQ ID NO: 5134867 - DNA, 16 bp, Homo sapiens
acagatacacatacac

SEQ ID NO: 5134868 - DNA, 18 bp, Homo sapiens
acagatacatagatggac

SEQ ID NO: 5134869 - DNA, 12 bp, Homo sapiens
acagataccata

SEQ ID NO: 5134870 - DNA, 13 bp, Homo sapiens
acagataccataa

SEQ ID NO: 5134871 - DNA, 20 bp, Homo sapiens
acagatacccatccaactcc

SEQ ID NO: 5134872 - DNA, 16 bp, Homo sapiens
acagatacctccaacc

SEQ ID NO: 5134873 - DNA, 16 bp, Homo sapiens
acagatactgaaacat

SEQ ID NO: 5134874 - DNA, 18 bp, Homo sapiens
acagatactgaaacattt

SEQ ID NO: 5134875 - DNA, 22 bp, Homo sapiens
acagatactgaaacatttgaca

SEQ ID NO: 5134876 - DNA, 15 bp, Homo sapiens
acagatactgtgagc

SEQ ID NO: 5134877 - DNA, 14 bp, Homo sapiens
acagatagagagtt

SEQ ID NO: 5134878 - DNA, 19 bp, Homo sapiens
acagataggccttcttgtg

SEQ ID NO: 5134879 - DNA, 14 bp, Homo sapiens
acagatataaatgg

SEQ ID NO: 5134880 - DNA, 17 bp, Homo sapiens
acagatataaatggctg

SEQ ID NO: 5134881 - DNA, 17 bp, Homo sapiens
acagatatacacatgga

SEQ ID NO: 5134882 - DNA, 16 bp, Homo sapiens
acagatatcagtgtct

SEQ ID NO: 5134883 - DNA, 16 bp, Homo sapiens
acagatatcttcagtt

SEQ ID NO: 5134884 - DNA, 19 bp, Homo sapiens
acagatatcttcagtttaa

SEQ ID NO: 5134885 - DNA, 23 bp, Homo sapiens
acagatatcttcagtttaatgca

SEQ ID NO: 5134886 - DNA, 17 bp, Homo sapiens
acagatattccagacca

SEQ ID NO: 5134887 - DNA, 18 bp, Homo sapiens
acagatattgttataaat

SEQ ID NO: 5134888 - DNA, 13 bp, Homo sapiens
acagatatttaaa

SEQ ID NO: 5134889 - DNA, 19 bp, Homo sapiens
acagatatttcaaacatca

SEQ ID NO: 5134890 - DNA, 20 bp, Homo sapiens
acagatatttccatttcttc

SEQ ID NO: 5134891 - DNA, 21 bp, Homo sapiens
acagatcaacaataccttttt

SEQ ID NO: 5134892 - DNA, 17 bp, Homo sapiens
acagatcagaacatgaa

SEQ ID NO: 5134893 - DNA, 23 bp, Homo sapiens
acagatcaggaattctaaataaa

SEQ ID NO: 5134894 - DNA, 19 bp, Homo sapiens
acagatcataggaagtggc

SEQ ID NO: 5134895 - DNA, 20 bp, Homo sapiens
acagatccagaatttattag

SEQ ID NO: 5134896 - DNA, 18 bp, Homo sapiens
acagatccccagcccctc

SEQ ID NO: 5134897 - DNA, 20 bp, Homo sapiens
acagatccccagcccctcct

SEQ ID NO: 5134898 - DNA, 17 bp, Homo sapiens
acagatccgcatgtgtc

SEQ ID NO: 5134899 - DNA, 21 bp, Homo sapiens
acagatccgcatgtgtctgta

SEQ ID NO: 5134900 - DNA, 23 bp, Homo sapiens
acagatccgcatgtgtctgtatt

SEQ ID NO: 5134901 - DNA, 15 bp, Homo sapiens
acagatcctccattt

SEQ ID NO: 5134902 - DNA, 18 bp, Homo sapiens
acagatcctttttccatc

SEQ ID NO: 5134903 - DNA, 22 bp, Homo sapiens
acagatctaccttggtgatttg

SEQ ID NO: 5134904 - DNA, 20 bp, Homo sapiens
acagatctcagggctcggga

SEQ ID NO: 5134905 - DNA, 17 bp, Homo sapiens
acagatctccaaagctt

SEQ ID NO: 5134906 - DNA, 16 bp, Homo sapiens
acagatctttactctt

SEQ ID NO: 5134907 - DNA, 12 bp, Homo sapiens
acagatgaaaat

SEQ ID NO: 5134908 - DNA, 15 bp, Homo sapiens
acagatgaagaagga

SEQ ID NO: 5134909 - DNA, 22 bp, Homo sapiens
acagatgaagaaggagcagaat

SEQ ID NO: 5134910 - DNA, 18 bp, Homo sapiens
acagatgaccgtgtacaa

SEQ ID NO: 5134911 - DNA, 21 bp, Homo sapiens
acagatgagaagactagcagc

SEQ ID NO: 5134912 - DNA, 13 bp, Homo sapiens
acagatgagcagg

SEQ ID NO: 5134913 - DNA, 14 bp, Homo sapiens
acagatgagcagga

SEQ ID NO: 5134914 - DNA, 14 bp, Homo sapiens
acagatgccaactt

SEQ ID NO: 5134915 - DNA, 18 bp, Homo sapiens
acagatgccacacaagga

SEQ ID NO: 5134916 - DNA, 14 bp, Homo sapiens
acagatgccccaga

SEQ ID NO: 5134917 - DNA, 21 bp, Homo sapiens
acagatgccccagagctgttt

SEQ ID NO: 5134918 - DNA, 13 bp, Homo sapiens
acagatgcctcct

SEQ ID NO: 5134919 - DNA, 13 bp, Homo sapiens
acagatgcctggt

SEQ ID NO: 5134920 - DNA, 19 bp, Homo sapiens
acagatgcctggtgagcag

SEQ ID NO: 5134921 - DNA, 18 bp, Homo sapiens
acagatgccttttttgta

SEQ ID NO: 5134922 - DNA, 17 bp, Homo sapiens
acagatgctgagccata

SEQ ID NO: 5134923 - DNA, 13 bp, Homo sapiens
acagatgctggcc

SEQ ID NO: 5134924 - DNA, 16 bp, Homo sapiens
acagatgctggcctct

SEQ ID NO: 5134925 - DNA, 20 bp, Homo sapiens
acagatgctggcctcttggc

SEQ ID NO: 5134926 - DNA, 19 bp, Homo sapiens
acagatggaaaaactgagg

SEQ ID NO: 5134927 - DNA, 21 bp, Homo sapiens
acagatggaagaagttttaac

SEQ ID NO: 5134928 - DNA, 22 bp, Homo sapiens
acagatggacactgccaagagc

SEQ ID NO: 5134929 - DNA, 13 bp, Homo sapiens
acagatggaccaa

SEQ ID NO: 5134930 - DNA, 19 bp, Homo sapiens
acagatggacgcaggccct

SEQ ID NO: 5134931 - DNA, 22 bp, Homo sapiens
acagatggacgtcgaggaccgg

SEQ ID NO: 5134932 - DNA, 18 bp, Homo sapiens
acagatggcacctgtggc

SEQ ID NO: 5134933 - DNA, 17 bp, Homo sapiens
acagatggcccaaggga

SEQ ID NO: 5134934 - DNA, 20 bp, Homo sapiens
acagatggcccaagggatgg

SEQ ID NO: 5134935 - DNA, 14 bp, Homo sapiens
acagatggctgtga

SEQ ID NO: 5134936 - DNA, 19 bp, Homo sapiens
acagatggctgtgaaaatt

SEQ ID NO: 5134937 - DNA, 16 bp, Homo sapiens
acagatggcttagtta

SEQ ID NO: 5134938 - DNA, 18 bp, Homo sapiens
acagatggggtctgtgac

SEQ ID NO: 5134939 - DNA, 23 bp, Homo sapiens
acagatgggtgcttggaggaagg

SEQ ID NO: 5134940 - DNA, 21 bp, Homo sapiens
acagatgggtgtcccctggtg

SEQ ID NO: 5134941 - DNA, 20 bp, Homo sapiens
acagatgtaaaagacttttt

SEQ ID NO: 5134942 - DNA, 14 bp, Homo sapiens
acagatgtccctga

SEQ ID NO: 5134943 - DNA, 14 bp, Homo sapiens
acagatgtctctgg

SEQ ID NO: 5134944 - DNA, 18 bp, Homo sapiens
acagatgtctctggggca

SEQ ID NO: 5134945 - DNA, 14 bp, Homo sapiens
acagatgtgaaaat

SEQ ID NO: 5134946 - DNA, 16 bp, Homo sapiens
acagatgtgaaatgaa

SEQ ID NO: 5134947 - DNA, 17 bp, Homo sapiens
acagatgtgcccagagt

SEQ ID NO: 5134948 - DNA, 23 bp, Homo sapiens
acagatgtgtctgggagagcctg

SEQ ID NO: 5134949 - DNA, 17 bp, Homo sapiens
acagatgtgttgcaaag

SEQ ID NO: 5134950 - DNA, 14 bp, Homo sapiens
acagatgttatttt

SEQ ID NO: 5134951 - DNA, 21 bp, Homo sapiens
acagatgttatttttgtattt

SEQ ID NO: 5134952 - DNA, 22 bp, Homo sapiens
acagatgttccatcctgtacaa

SEQ ID NO: 5134953 - DNA, 21 bp, Homo sapiens
acagattaaacttcacctaca

SEQ ID NO: 5134954 - DNA, 20 bp, Homo sapiens
acagattaggtttgtcccag

SEQ ID NO: 5134955 - DNA, 14 bp, Homo sapiens
acagattatgtatt

SEQ ID NO: 5134956 - DNA, 16 bp, Homo sapiens
acagattatgttcctg

SEQ ID NO: 5134957 - DNA, 13 bp, Homo sapiens
acagattcaaagc

SEQ ID NO: 5134958 - DNA, 22 bp, Homo sapiens
acagtaatcagagttaccatta

SEQ ID NO: 5134959 - DNA, 13 bp, Homo sapiens
acagtaatcagtt

SEQ ID NO: 5134960 - DNA, 12 bp, Homo sapiens
acagtaatgtag

SEQ ID NO: 5134961 - DNA, 16 bp, Homo sapiens
acagtaatgtagaaat

SEQ ID NO: 5134962 - DNA, 22 bp, Homo sapiens
acagtaattattatttaactct

SEQ ID NO: 5134963 - DNA, 15 bp, Homo sapiens
acagtaattgtgaca

SEQ ID NO: 5134964 - DNA, 21 bp, Homo sapiens
acagtaattgtgtttacattt

SEQ ID NO: 5134965 - DNA, 23 bp, Homo sapiens
acagtacaataatgtactcacat

SEQ ID NO: 5134966 - DNA, 11 bp, Homo sapiens
acagtacaatc

SEQ ID NO: 5134967 - DNA, 15 bp, Homo sapiens
acagtacacacaaaa

SEQ ID NO: 5134968 - DNA, 16 bp, Homo sapiens
acagtacagaaggcaa

SEQ ID NO: 5134969 - DNA, 19 bp, Homo sapiens
acagtacagcatgtgcctt

SEQ ID NO: 5134970 - DNA, 13 bp, Homo sapiens
acagtacaggcag

SEQ ID NO: 5134971 - DNA, 14 bp, Homo sapiens
acagtacaggcagc

SEQ ID NO: 5134972 - DNA, 12 bp, Homo sapiens
acagtacatatg

SEQ ID NO: 5134973 - DNA, 17 bp, Homo sapiens
acagtacatatgtaatt

SEQ ID NO: 5134974 - DNA, 23 bp, Homo sapiens
acagtacatgacccggatgaact

SEQ ID NO: 5134975 - DNA, 15 bp, Homo sapiens
acagtacccaaactg

SEQ ID NO: 5134976 - DNA, 18 bp, Homo sapiens
acagtacctgattgtatt

SEQ ID NO: 5134977 - DNA, 18 bp, Homo sapiens
acagtaccttgttgcaga

SEQ ID NO: 5134978 - DNA, 14 bp, Homo sapiens
acagtactatgtaa

SEQ ID NO: 5134979 - DNA, 20 bp, Homo sapiens
acagtactatgtaaatttaa

SEQ ID NO: 5134980 - DNA, 19 bp, Homo sapiens
acagtactccacaaacatg

SEQ ID NO: 5134981 - DNA, 18 bp, Homo sapiens
acagtactgacagaaagc

SEQ ID NO: 5134982 - DNA, 19 bp, Homo sapiens
acagtactgacagaaagca

SEQ ID NO: 5134983 - DNA, 19 bp, Homo sapiens
acagtactggttactttca

SEQ ID NO: 5134984 - DNA, 16 bp, Homo sapiens
acagtactgttcccaa

SEQ ID NO: 5134985 - DNA, 17 bp, Homo sapiens
acagtactttattgtac

SEQ ID NO: 5134986 - DNA, 18 bp, Homo sapiens
acagtactttattgtaca

SEQ ID NO: 5134987 - DNA, 20 bp, Homo sapiens
acagtactttattgtacaga

SEQ ID NO: 5134988 - DNA, 19 bp, Homo sapiens
acagtagaactgtctgtga

SEQ ID NO: 5134989 - DNA, 13 bp, Homo sapiens
acagtagagaggg

SEQ ID NO: 5134990 - DNA, 18 bp, Homo sapiens
acagtagagtagggtaga

SEQ ID NO: 5134991 - DNA, 20 bp, Homo sapiens
acagtagccccatcacattt

SEQ ID NO: 5134992 - DNA, 22 bp, Homo sapiens
acagtagccccatcacatttgt

SEQ ID NO: 5134993 - DNA, 13 bp, Homo sapiens
acagtagctctta

SEQ ID NO: 5134994 - DNA, 12 bp, Homo sapiens
acagtagcttaa

SEQ ID NO: 5134995 - DNA, 18 bp, Homo sapiens
acagtagcttgaaattga

SEQ ID NO: 5134996 - DNA, 14 bp, Homo sapiens
acagtaggattttt

SEQ ID NO: 5134997 - DNA, 21 bp, Homo sapiens
acagtaggtcccggccagctc

SEQ ID NO: 5134998 - DNA, 18 bp, Homo sapiens
acagtaggtgacactata

SEQ ID NO: 5134999 - DNA, 21 bp, Homo sapiens
acagtagtgagaagaatattg

SEQ ID NO: 5135000 - DNA, 15 bp, Homo sapiens
acagtagtgtcatca

SEQ ID NO: 5135001 - DNA, 20 bp, Homo sapiens
acagtagtgttctgttcact

SEQ ID NO: 5135002 - DNA, 19 bp, Homo sapiens
acagtagttgtattcttct

SEQ ID NO: 5135003 - DNA, 20 bp, Homo sapiens
acagtagtttccctactgaa

SEQ ID NO: 5135004 - DNA, 23 bp, Homo sapiens
acagtataattaacatgttaaac

SEQ ID NO: 5135005 - DNA, 13 bp, Homo sapiens
acagtataatttg

SEQ ID NO: 5135006 - DNA, 16 bp, Homo sapiens
acagtatagatttttg

SEQ ID NO: 5135007 - DNA, 22 bp, Homo sapiens
acagtatatcccaagtgcactt

SEQ ID NO: 5135008 - DNA, 21 bp, Homo sapiens
acagtatatgtcatgcctcac

SEQ ID NO: 5135009 - DNA, 14 bp, Homo sapiens
acagtatattcttg

SEQ ID NO: 5135010 - DNA, 15 bp, Homo sapiens
acagtatatttgaaa

SEQ ID NO: 5135011 - DNA, 21 bp, Homo sapiens
acagtatattttatttcaatg

SEQ ID NO: 5135012 - DNA, 19 bp, Homo sapiens
acagtatcgtttgtttatg

SEQ ID NO: 5135013 - DNA, 13 bp, Homo sapiens
acagtatctgctg

SEQ ID NO: 5135014 - DNA, 16 bp, Homo sapiens
acagtatctgctgttc

SEQ ID NO: 5135015 - DNA, 17 bp, Homo sapiens
acagtatctgctgttct

SEQ ID NO: 5135016 - DNA, 22 bp, Homo sapiens
acagtatctgctgttcttcagt

SEQ ID NO: 5135017 - DNA, 17 bp, Homo sapiens
acagtatcttcaaaaat

SEQ ID NO: 5135018 - DNA, 18 bp, Homo sapiens
acagtatcttcaaaaata

SEQ ID NO: 5135019 - DNA, 15 bp, Homo sapiens
acagtatcttttctt

SEQ ID NO: 5135020 - DNA, 20 bp, Homo sapiens
acagtatgatggaacagtga

SEQ ID NO: 5135021 - DNA, 21 bp, Homo sapiens
acagtatggcagctttcctca

SEQ ID NO: 5135022 - DNA, 22 bp, Homo sapiens
acagtatgggggttgtaaattg

SEQ ID NO: 5135023 - DNA, 23 bp, Homo sapiens
acagtatgggggttgtaaattgg

SEQ ID NO: 5135024 - DNA, 22 bp, Homo sapiens
acagtatggtaactttgcaaat

SEQ ID NO: 5135025 - DNA, 12 bp, Homo sapiens
acagtatgtgtc

SEQ ID NO: 5135026 - DNA, 15 bp, Homo sapiens
acagtattacttctg

SEQ ID NO: 5135027 - DNA, 16 bp, Homo sapiens
acagtattacttctgc

SEQ ID NO: 5135028 - DNA, 17 bp, Homo sapiens
acagtattacttctgct

SEQ ID NO: 5135029 - DNA, 19 bp, Homo sapiens
acagtattacttctgctac

SEQ ID NO: 5135030 - DNA, 14 bp, Homo sapiens
acagtattatctgt

SEQ ID NO: 5135031 - DNA, 12 bp, Homo sapiens
acagtattatgc

SEQ ID NO: 5135032 - DNA, 19 bp, Homo sapiens
acagtattatttagtaaaa

SEQ ID NO: 5135033 - DNA, 23 bp, Homo sapiens
acagtattatttagtaaaattat

SEQ ID NO: 5135034 - DNA, 12 bp, Homo sapiens
acagtattctgt

SEQ ID NO: 5135035 - DNA, 14 bp, Homo sapiens
acagtattgctatt

SEQ ID NO: 5135036 - DNA, 16 bp, Homo sapiens
acagtattgctattta

SEQ ID NO: 5135037 - DNA, 14 bp, Homo sapiens
acagtattgtagaa

SEQ ID NO: 5135038 - DNA, 16 bp, Homo sapiens
acagtattgttcttgt

SEQ ID NO: 5135039 - DNA, 13 bp, Homo sapiens
acagtatttaaca

SEQ ID NO: 5135040 - DNA, 14 bp, Homo sapiens
acagtatttaacat

SEQ ID NO: 5135041 - DNA, 15 bp, Homo sapiens
acagtatttaacatt

SEQ ID NO: 5135042 - DNA, 14 bp, Homo sapiens
acagtatttattgg

SEQ ID NO: 5135043 - DNA, 22 bp, Homo sapiens
acagtatttattttttcaaaaa

SEQ ID NO: 5135044 - DNA, 12 bp, Homo sapiens
acagtatttcca

SEQ ID NO: 5135045 - DNA, 16 bp, Homo sapiens
acagtatttccacaat

SEQ ID NO: 5135046 - DNA, 12 bp, Homo sapiens
acagtatttctc

SEQ ID NO: 5135047 - DNA, 23 bp, Homo sapiens
acagtatttctcttttattctgt

SEQ ID NO: 5135048 - DNA, 14 bp, Homo sapiens
acagtatttgtaat

SEQ ID NO: 5135049 - DNA, 18 bp, Homo sapiens
acagtatttgtaattaaa

SEQ ID NO: 5135050 - DNA, 17 bp, Homo sapiens
acagtattttggttctt

SEQ ID NO: 5135051 - DNA, 16 bp, Homo sapiens
acagtatttttcagat

SEQ ID NO: 5135052 - DNA, 21 bp, Homo sapiens
acagtatttttcagatataaa

SEQ ID NO: 5135053 - DNA, 13 bp, Homo sapiens
acagtcaaaataa

SEQ ID NO: 5135054 - DNA, 14 bp, Homo sapiens
acagtcaaaataat

SEQ ID NO: 5135055 - DNA, 19 bp, Homo sapiens
acagtcaaaataattctaa

SEQ ID NO: 5135056 - DNA, 20 bp, Homo sapiens
acagtcaaatttacatttat

SEQ ID NO: 5135057 - DNA, 21 bp, Homo sapiens
acagtcaagacggatccacag

SEQ ID NO: 5135058 - DNA, 22 bp, Homo sapiens
acagtcaagacggatccacagt

SEQ ID NO: 5135059 - DNA, 13 bp, Homo sapiens
acagtcaagatac

SEQ ID NO: 5135060 - DNA, 16 bp, Homo sapiens
acagtcaagatagaaa

SEQ ID NO: 5135061 - DNA, 16 bp, Homo sapiens
acagtcaaggagatga

SEQ ID NO: 5135062 - DNA, 17 bp, Homo sapiens
acagtcaaggagtggct

SEQ ID NO: 5135063 - DNA, 18 bp, Homo sapiens
acagtcaaggagtggctt

SEQ ID NO: 5135064 - DNA, 17 bp, Homo sapiens
acagtcacatgcttgat

SEQ ID NO: 5135065 - DNA, 12 bp, Homo sapiens
acagtcacattc

SEQ ID NO: 5135066 - DNA, 13 bp, Homo sapiens
acagtcacattcg

SEQ ID NO: 5135067 - DNA, 17 bp, Homo sapiens
acagtcacctcatggaa

SEQ ID NO: 5135068 - DNA, 18 bp, Homo sapiens
acagtcacctcatggaat

SEQ ID NO: 5135069 - DNA, 18 bp, Homo sapiens
acagtcacgcctgaaact

SEQ ID NO: 5135070 - DNA, 19 bp, Homo sapiens
acagtcacgcctgaaactt

SEQ ID NO: 5135071 - DNA, 16 bp, Homo sapiens
acagtcactaatatag

SEQ ID NO: 5135072 - DNA, 20 bp, Homo sapiens
acagtcactgccactttgca

SEQ ID NO: 5135073 - DNA, 23 bp, Homo sapiens
acagtcactgccactttgcacat

SEQ ID NO: 5135074 - DNA, 14 bp, Homo sapiens
acagtcactgctct

SEQ ID NO: 5135075 - DNA, 13 bp, Homo sapiens
acagtcactggat

SEQ ID NO: 5135076 - DNA, 15 bp, Homo sapiens
acagtcagatttcca

SEQ ID NO: 5135077 - DNA, 16 bp, Homo sapiens
acagtcagcatgcttc

SEQ ID NO: 5135078 - DNA, 17 bp, Homo sapiens
acagtcagcatgcttcc

SEQ ID NO: 5135079 - DNA, 22 bp, Homo sapiens
acagtcagcatgcttcccagag

SEQ ID NO: 5135080 - DNA, 16 bp, Homo sapiens
acagtcaggggctggg

SEQ ID NO: 5135081 - DNA, 19 bp, Homo sapiens
acagtcaggggctgggcat

SEQ ID NO: 5135082 - DNA, 19 bp, Homo sapiens
acagtcataaatactgtca

SEQ ID NO: 5135083 - DNA, 24 bp, Homo sapiens
acagtcatacaagtcatggtcaca

SEQ ID NO: 5135084 - DNA, 14 bp, Homo sapiens
acagtcatcatcag

SEQ ID NO: 5135085 - DNA, 18 bp, Homo sapiens
acagtcatcatcagggcc

SEQ ID NO: 5135086 - DNA, 19 bp, Homo sapiens
acagtcatcatcagggcct

SEQ ID NO: 5135087 - DNA, 15 bp, Homo sapiens
acagtcatctgtctt

SEQ ID NO: 5135088 - DNA, 16 bp, Homo sapiens
acagtcatggtggcca

SEQ ID NO: 5135089 - DNA, 18 bp, Homo sapiens
acagtcatgtatgcaagt

SEQ ID NO: 5135090 - DNA, 21 bp, Homo sapiens
acagtcattatttaaagcaca

SEQ ID NO: 5135091 - DNA, 22 bp, Homo sapiens
acagtcattatttaaagcacat

SEQ ID NO: 5135092 - DNA, 18 bp, Homo sapiens
acagtcattctaggatgt

SEQ ID NO: 5135093 - DNA, 21 bp, Homo sapiens
acagtcattggaataaggcat

SEQ ID NO: 5135094 - DNA, 13 bp, Homo sapiens
acagtcatttaaa

SEQ ID NO: 5135095 - DNA, 12 bp, Homo sapiens
acagtccacagg

SEQ ID NO: 5135096 - DNA, 16 bp, Homo sapiens
acagtccacaggggcc

SEQ ID NO: 5135097 - DNA, 17 bp, Homo sapiens
acagtccacaggggcca

SEQ ID NO: 5135098 - DNA, 16 bp, Homo sapiens
acagtccagttttgtg

SEQ ID NO: 5135099 - DNA, 21 bp, Homo sapiens
acagtccagttttgtgtgctt

SEQ ID NO: 5135100 - DNA, 19 bp, Homo sapiens
acagtcccactgtgcaggt

SEQ ID NO: 5135101 - DNA, 15 bp, Homo sapiens
acagtcccagcacat

SEQ ID NO: 5135102 - DNA, 15 bp, Homo sapiens
acagtccccagactc

SEQ ID NO: 5135103 - DNA, 19 bp, Homo sapiens
acagtcccccacccacctc

SEQ ID NO: 5135104 - DNA, 17 bp, Homo sapiens
acagtccctaaagaaaa

SEQ ID NO: 5135105 - DNA, 18 bp, Homo sapiens
acagtccctatggaaaga

SEQ ID NO: 5135106 - DNA, 15 bp, Homo sapiens
acagtccctgccaat

SEQ ID NO: 5135107 - DNA, 15 bp, Homo sapiens
acagtccctgctggg

SEQ ID NO: 5135108 - DNA, 20 bp, Homo sapiens
acagtccgcagttgtagcag

SEQ ID NO: 5135109 - DNA, 23 bp, Homo sapiens
acagtccgcagttgtagcagaaa

SEQ ID NO: 5135110 - DNA, 19 bp, Homo sapiens
acagtcctaactggtatag

SEQ ID NO: 5135111 - DNA, 18 bp, Homo sapiens
acagtcctatgtacagag

SEQ ID NO: 5135112 - DNA, 16 bp, Homo sapiens
acagtcctcacagcct

SEQ ID NO: 5135113 - DNA, 19 bp, Homo sapiens
acagtcctcacagcctctc

SEQ ID NO: 5135114 - DNA, 22 bp, Homo sapiens
acagtcctcacagcctctccct

SEQ ID NO: 5135115 - DNA, 13 bp, Homo sapiens
acagtcctcccat

SEQ ID NO: 5135116 - DNA, 23 bp, Homo sapiens
acagtcctctccacctagtggct

SEQ ID NO: 5135117 - DNA, 22 bp, Homo sapiens
acagtcctttcccaccattcct

SEQ ID NO: 5135118 - DNA, 17 bp, Homo sapiens
acagtcgctcagtctgt

SEQ ID NO: 5135119 - DNA, 16 bp, Homo sapiens
acagtcggtgacccca

SEQ ID NO: 5135120 - DNA, 16 bp, Homo sapiens
acagtctaaagaagag

SEQ ID NO: 5135121 - DNA, 14 bp, Homo sapiens
acagtctaaagctg

SEQ ID NO: 5135122 - DNA, 22 bp, Homo sapiens
acagtctaatttttattcataa

SEQ ID NO: 5135123 - DNA, 20 bp, Homo sapiens
acagtctacattgagcattt

SEQ ID NO: 5135124 - DNA, 18 bp, Homo sapiens
acagtctcaagcactaaa

SEQ ID NO: 5135125 - DNA, 16 bp, Homo sapiens
acagtctcaattttgt

SEQ ID NO: 5135126 - DNA, 17 bp, Homo sapiens
acagtctcaattttgta

SEQ ID NO: 5135127 - DNA, 21 bp, Homo sapiens
acagtctcaattttgtattta

SEQ ID NO: 5135128 - DNA, 12 bp, Homo sapiens
acagtctcacca

SEQ ID NO: 5135129 - DNA, 22 bp, Homo sapiens
acagtctcaccatttccccagg

SEQ ID NO: 5135130 - DNA, 17 bp, Homo sapiens
acagtctcagtccagat

SEQ ID NO: 5135131 - DNA, 18 bp, Homo sapiens
acagtctcattacagatt

SEQ ID NO: 5135132 - DNA, 16 bp, Homo sapiens
acagtctcccattctc

SEQ ID NO: 5135133 - DNA, 17 bp, Homo sapiens
acagtctccctgatgga

SEQ ID NO: 5135134 - DNA, 21 bp, Homo sapiens
acagtctccctgatggaccct

SEQ ID NO: 5135135 - DNA, 18 bp, Homo sapiens
acagtctctactgttatt

SEQ ID NO: 5135136 - DNA, 12 bp, Homo sapiens
acagtctctatt

SEQ ID NO: 5135137 - DNA, 16 bp, Homo sapiens
acagattcacactgtc

SEQ ID NO: 5135138 - DNA, 17 bp, Homo sapiens
acagattcagaatgaga

SEQ ID NO: 5135139 - DNA, 20 bp, Homo sapiens
acagattcaggccagcccag

SEQ ID NO: 5135140 - DNA, 14 bp, Homo sapiens
acagattcagtctt

SEQ ID NO: 5135141 - DNA, 19 bp, Homo sapiens
acagattcagtcttgcctt

SEQ ID NO: 5135142 - DNA, 17 bp, Homo sapiens
acagattcataaagtaa

SEQ ID NO: 5135143 - DNA, 16 bp, Homo sapiens
acagattcccaggcca

SEQ ID NO: 5135144 - DNA, 19 bp, Homo sapiens
acagattcccaggccaggg

SEQ ID NO: 5135145 - DNA, 21 bp, Homo sapiens
acagattcccaggccagggct

SEQ ID NO: 5135146 - DNA, 17 bp, Homo sapiens
acagattcctgttgtgt

SEQ ID NO: 5135147 - DNA, 21 bp, Homo sapiens
acagattcctgttgtgtaata

SEQ ID NO: 5135148 - DNA, 21 bp, Homo sapiens
acagattctagccaaactatt

SEQ ID NO: 5135149 - DNA, 22 bp, Homo sapiens
acagattctagccaaactattc

SEQ ID NO: 5135150 - DNA, 20 bp, Homo sapiens
acagattctgacatttatat

SEQ ID NO: 5135151 - DNA, 20 bp, Homo sapiens
acagattctttttttctgtc

SEQ ID NO: 5135152 - DNA, 16 bp, Homo sapiens
acagattgaagaatct

SEQ ID NO: 5135153 - DNA, 19 bp, Homo sapiens
acagattgcctgtttctga

SEQ ID NO: 5135154 - DNA, 18 bp, Homo sapiens
acagattgctacacacac

SEQ ID NO: 5135155 - DNA, 18 bp, Homo sapiens
acagattgctgaaactgt

SEQ ID NO: 5135156 - DNA, 13 bp, Homo sapiens
acagattggattt

SEQ ID NO: 5135157 - DNA, 21 bp, Homo sapiens
acagattgtttctatacaaat

SEQ ID NO: 5135158 - DNA, 14 bp, Homo sapiens
acagatttaaagaa

SEQ ID NO: 5135159 - DNA, 16 bp, Homo sapiens
acagatttaagcaaga

SEQ ID NO: 5135160 - DNA, 23 bp, Homo sapiens
acagatttaagccttgacacact

SEQ ID NO: 5135161 - DNA, 24 bp, Homo sapiens
acagatttaagccttgacacactg

SEQ ID NO: 5135162 - DNA, 13 bp, Homo sapiens
acagatttccaaa

SEQ ID NO: 5135163 - DNA, 16 bp, Homo sapiens
acagatttccaaaagt

SEQ ID NO: 5135164 - DNA, 15 bp, Homo sapiens
acagatttgagctca

SEQ ID NO: 5135165 - DNA, 22 bp, Homo sapiens
acagatttgagctcagccctgg

SEQ ID NO: 5135166 - DNA, 15 bp, Homo sapiens
acagatttgaggact

SEQ ID NO: 5135167 - DNA, 14 bp, Homo sapiens
acagatttggaaag

SEQ ID NO: 5135168 - DNA, 15 bp, Homo sapiens
acagatttggaaaga

SEQ ID NO: 5135169 - DNA, 21 bp, Homo sapiens
acagatttggaaagactggac

SEQ ID NO: 5135170 - DNA, 15 bp, Homo sapiens
acagatttgttcatt

SEQ ID NO: 5135171 - DNA, 14 bp, Homo sapiens
acagattttaattg

SEQ ID NO: 5135172 - DNA, 14 bp, Homo sapiens
acagattttatttg

SEQ ID NO: 5135173 - DNA, 19 bp, Homo sapiens
acagattttatttgtaatt

SEQ ID NO: 5135174 - DNA, 15 bp, Homo sapiens
acagattttctagaa

SEQ ID NO: 5135175 - DNA, 20 bp, Homo sapiens
acagattttgatagcaaagc

SEQ ID NO: 5135176 - DNA, 15 bp, Homo sapiens
acagatttttacaaa

SEQ ID NO: 5135177 - DNA, 15 bp, Homo sapiens
acagatttttttgta

SEQ ID NO: 5135178 - DNA, 23 bp, Homo sapiens
acagcaaaaaaagcaacttttcc

SEQ ID NO: 5135179 - DNA, 21 bp, Homo sapiens
acagcaaaaccattgcttcac

SEQ ID NO: 5135180 - DNA, 21 bp, Homo sapiens
acagcaaaagccctaacttct

SEQ ID NO: 5135181 - DNA, 18 bp, Homo sapiens
acagcaaaatgttgaaga

SEQ ID NO: 5135182 - DNA, 19 bp, Homo sapiens
acagcaaaatgttgaagaa

SEQ ID NO: 5135183 - DNA, 13 bp, Homo sapiens
acagcaaacacag

SEQ ID NO: 5135184 - DNA, 14 bp, Homo sapiens
acagcaaacacagt

SEQ ID NO: 5135185 - DNA, 15 bp, Homo sapiens
acagcaaacacagtc

SEQ ID NO: 5135186 - DNA, 14 bp, Homo sapiens
acagcaaaccaaga

SEQ ID NO: 5135187 - DNA, 17 bp, Homo sapiens
acagcaaaccaagagat

SEQ ID NO: 5135188 - DNA, 18 bp, Homo sapiens
acagcaaaccaagagatt

SEQ ID NO: 5135189 - DNA, 13 bp, Homo sapiens
acagcaaaccctg

SEQ ID NO: 5135190 - DNA, 21 bp, Homo sapiens
acagcaaataaaacagtgaaa

SEQ ID NO: 5135191 - DNA, 20 bp, Homo sapiens
acagcaaattaatgtgtaaa

SEQ ID NO: 5135192 - DNA, 22 bp, Homo sapiens
acagcaaattaatgtgtaaaat

SEQ ID NO: 5135193 - DNA, 21 bp, Homo sapiens
acagcaacaaagcataagaca

SEQ ID NO: 5135194 - DNA, 15 bp, Homo sapiens
acagcaacaacaaca

SEQ ID NO: 5135195 - DNA, 19 bp, Homo sapiens
acagcaacgaaccctagaa

SEQ ID NO: 5135196 - DNA, 14 bp, Homo sapiens
acagcaaggaaaca

SEQ ID NO: 5135197 - DNA, 15 bp, Homo sapiens
acagcaaggaaacat

SEQ ID NO: 5135198 - DNA, 16 bp, Homo sapiens
acagcaaggagattta

SEQ ID NO: 5135199 - DNA, 17 bp, Homo sapiens
acagcaaggagatttac

SEQ ID NO: 5135200 - DNA, 16 bp, Homo sapiens
acagcaaggaggctgg

SEQ ID NO: 5135201 - DNA, 18 bp, Homo sapiens
acagcaaggaggctggct

SEQ ID NO: 5135202 - DNA, 13 bp, Homo sapiens
acagcaaggctgt

SEQ ID NO: 5135203 - DNA, 18 bp, Homo sapiens
acagcaagggtgatggga

SEQ ID NO: 5135204 - DNA, 19 bp, Homo sapiens
acagcaaggtgtggaggct

SEQ ID NO: 5135205 - DNA, 20 bp, Homo sapiens
acagcaaggtgtggaggctc

SEQ ID NO: 5135206 - DNA, 15 bp, Homo sapiens
acagcaagtagataa

SEQ ID NO: 5135207 - DNA, 16 bp, Homo sapiens
acagcaagtcagggtt

SEQ ID NO: 5135208 - DNA, 16 bp, Homo sapiens
acagcaattcatggtt

SEQ ID NO: 5135209 - DNA, 18 bp, Homo sapiens
acagcaattttcataata

SEQ ID NO: 5135210 - DNA, 15 bp, Homo sapiens
acagcaattttgtat

SEQ ID NO: 5135211 - DNA, 14 bp, Homo sapiens
acagcacaagggca

SEQ ID NO: 5135212 - DNA, 16 bp, Homo sapiens
acagcacaagggcaca

SEQ ID NO: 5135213 - DNA, 13 bp, Homo sapiens
acagcacacaggc

SEQ ID NO: 5135214 - DNA, 17 bp, Homo sapiens
acagcacaccagccgct

SEQ ID NO: 5135215 - DNA, 20 bp, Homo sapiens
acagcacaccagccgctgca

SEQ ID NO: 5135216 - DNA, 13 bp, Homo sapiens
acagcacacctgt

SEQ ID NO: 5135217 - DNA, 16 bp, Homo sapiens
acagcacacctgtgtc

SEQ ID NO: 5135218 - DNA, 20 bp, Homo sapiens
acagcacacggtgagggtgc

SEQ ID NO: 5135219 - DNA, 18 bp, Homo sapiens
acagcacagctccctgcc

SEQ ID NO: 5135220 - DNA, 14 bp, Homo sapiens
acagcacaggcagc

SEQ ID NO: 5135221 - DNA, 19 bp, Homo sapiens
acagcacaggcagccccac

SEQ ID NO: 5135222 - DNA, 21 bp, Homo sapiens
acagcacaggcagccccacgg

SEQ ID NO: 5135223 - DNA, 16 bp, Homo sapiens
acagcacagggaagca

SEQ ID NO: 5135224 - DNA, 19 bp, Homo sapiens
acagcacagggaagcaaat

SEQ ID NO: 5135225 - DNA, 17 bp, Homo sapiens
acagcacatcacctctt

SEQ ID NO: 5135226 - DNA, 15 bp, Homo sapiens
acagcacatgctggc

SEQ ID NO: 5135227 - DNA, 19 bp, Homo sapiens
acagcaccaccatttaatt

SEQ ID NO: 5135228 - DNA, 15 bp, Homo sapiens
acagcaccactgctg

SEQ ID NO: 5135229 - DNA, 19 bp, Homo sapiens
acagcaccactgctgagga

SEQ ID NO: 5135230 - DNA, 15 bp, Homo sapiens
acagcacccaggctc

SEQ ID NO: 5135231 - DNA, 16 bp, Homo sapiens
acagcacccaggctcc

SEQ ID NO: 5135232 - DNA, 12 bp, Homo sapiens
acagcaccccat

SEQ ID NO: 5135233 - DNA, 16 bp, Homo sapiens
acagcaccgggggaga

SEQ ID NO: 5135234 - DNA, 20 bp, Homo sapiens
acagcacctcctctctgctg

SEQ ID NO: 5135235 - DNA, 22 bp, Homo sapiens
acagcacctcctctctgctggg

SEQ ID NO: 5135236 - DNA, 15 bp, Homo sapiens
acagcacctgagaag

SEQ ID NO: 5135237 - DNA, 23 bp, Homo sapiens
acagcacgggcacagctgctgtg

SEQ ID NO: 5135238 - DNA, 16 bp, Homo sapiens
acagcacgtgcagcca

SEQ ID NO: 5135239 - DNA, 18 bp, Homo sapiens
acagcactacagatatca

SEQ ID NO: 5135240 - DNA, 13 bp, Homo sapiens
acagcactactct

SEQ ID NO: 5135241 - DNA, 17 bp, Homo sapiens
acagcactactctgtgc

SEQ ID NO: 5135242 - DNA, 17 bp, Homo sapiens
acagcactactgggtgt

SEQ ID NO: 5135243 - DNA, 18 bp, Homo sapiens
acagcactactgggtgtc

SEQ ID NO: 5135244 - DNA, 21 bp, Homo sapiens
acagcactacttacttagaga

SEQ ID NO: 5135245 - DNA, 23 bp, Homo sapiens
acagcactctctaaatcttcctt

SEQ ID NO: 5135246 - DNA, 18 bp, Homo sapiens
acagcactttctgtagta

SEQ ID NO: 5135247 - DNA, 17 bp, Homo sapiens
acagcactttggttttg

SEQ ID NO: 5135248 - DNA, 19 bp, Homo sapiens
acagcactttggttttgct

SEQ ID NO: 5135249 - DNA, 19 bp, Homo sapiens
acagcagaaacccatgtgc

SEQ ID NO: 5135250 - DNA, 23 bp, Homo sapiens
acagcagactcagctctgacatt

SEQ ID NO: 5135251 - DNA, 15 bp, Homo sapiens
acagcagagccatct

SEQ ID NO: 5135252 - DNA, 15 bp, Homo sapiens
acagcagaggttctt

SEQ ID NO: 5135253 - DNA, 12 bp, Homo sapiens
acagcagatcca

SEQ ID NO: 5135254 - DNA, 16 bp, Homo sapiens
acagcagatccacctg

SEQ ID NO: 5135255 - DNA, 16 bp, Homo sapiens
acagcagcaagaaaaa

SEQ ID NO: 5135256 - DNA, 21 bp, Homo sapiens
acagcagcaagaaaaaaaaat

SEQ ID NO: 5135257 - DNA, 22 bp, Homo sapiens
acagcagcaagaaaaaaaaatg

SEQ ID NO: 5135258 - DNA, 12 bp, Homo sapiens
acagcagcaata

SEQ ID NO: 5135259 - DNA, 18 bp, Homo sapiens
acagcagcaatgcaatgt

SEQ ID NO: 5135260 - DNA, 23 bp, Homo sapiens
acagcagcactcccgctgcacac

SEQ ID NO: 5135261 - DNA, 14 bp, Homo sapiens
acagcagcagcctg

SEQ ID NO: 5135262 - DNA, 14 bp, Homo sapiens
acagcagcatctct

SEQ ID NO: 5135263 - DNA, 12 bp, Homo sapiens
acagcagcattt

SEQ ID NO: 5135264 - DNA, 13 bp, Homo sapiens
acagcagcatttt

SEQ ID NO: 5135265 - DNA, 19 bp, Homo sapiens
acagcagcatttttatttc

SEQ ID NO: 5135266 - DNA, 22 bp, Homo sapiens
acagcagcatttttatttcaga

SEQ ID NO: 5135267 - DNA, 19 bp, Homo sapiens
acagcagccccaggagaag

SEQ ID NO: 5135268 - DNA, 18 bp, Homo sapiens
acagcagcctgcttccca

SEQ ID NO: 5135269 - DNA, 19 bp, Homo sapiens
acagcagcctgcttcccac

SEQ ID NO: 5135270 - DNA, 22 bp, Homo sapiens
acagcagcctggggctggcctc

SEQ ID NO: 5135271 - DNA, 13 bp, Homo sapiens
acagcagcctgtg

SEQ ID NO: 5135272 - DNA, 10 bp, Homo sapiens
acagcagctc

SEQ ID NO: 5135273 - DNA, 16 bp, Homo sapiens
acagcagctcaggcac

SEQ ID NO: 5135274 - DNA, 12 bp, Homo sapiens
acagcagctcat

SEQ ID NO: 5135275 - DNA, 16 bp, Homo sapiens
acagcagctcatagaa

SEQ ID NO: 5135276 - DNA, 15 bp, Homo sapiens
acagcagctccaacc

SEQ ID NO: 5135277 - DNA, 19 bp, Homo sapiens
acagcagctccaacctgga

SEQ ID NO: 5135278 - DNA, 20 bp, Homo sapiens
acagcagctccaacctggag

SEQ ID NO: 5135279 - DNA, 23 bp, Homo sapiens
acagcagctccaacctggaggct

SEQ ID NO: 5135280 - DNA, 19 bp, Homo sapiens
acagcagctgaagccagct

SEQ ID NO: 5135281 - DNA, 18 bp, Homo sapiens
acagcagctggtgcccca

SEQ ID NO: 5135282 - DNA, 22 bp, Homo sapiens
acagcagcttataatgggctct

SEQ ID NO: 5135283 - DNA, 18 bp, Homo sapiens
acagcagcttcaccagag

SEQ ID NO: 5135284 - DNA, 21 bp, Homo sapiens
acagcaggaactgagccagaa

SEQ ID NO: 5135285 - DNA, 14 bp, Homo sapiens
acagcaggacctgt

SEQ ID NO: 5135286 - DNA, 12 bp, Homo sapiens
acagcaggaggc

SEQ ID NO: 5135287 - DNA, 13 bp, Homo sapiens
acagcaggaggca

SEQ ID NO: 5135288 - DNA, 22 bp, Homo sapiens
acagcaggataaacattccaga

SEQ ID NO: 5135289 - DNA, 15 bp, Homo sapiens
acagcaggatgccct

SEQ ID NO: 5135290 - DNA, 21 bp, Homo sapiens
acagcaggatgtgcctgtggc

SEQ ID NO: 5135291 - DNA, 16 bp, Homo sapiens
acagcaggcagcgcca

SEQ ID NO: 5135292 - DNA, 15 bp, Homo sapiens
acagcagggaccggg

SEQ ID NO: 5135293 - DNA, 23 bp, Homo sapiens
acagcagggccttctgcctgctg

SEQ ID NO: 5135294 - DNA, 13 bp, Homo sapiens
acagcaggggagc

SEQ ID NO: 5135295 - DNA, 22 bp, Homo sapiens
acagcagggtagtctggtttct

SEQ ID NO: 5135296 - DNA, 18 bp, Homo sapiens
acagcaggtcctccatcc

SEQ ID NO: 5135297 - DNA, 17 bp, Homo sapiens
acagcaggtgtgaccct

SEQ ID NO: 5135298 - DNA, 16 bp, Homo sapiens
acagcagtagacattt

SEQ ID NO: 5135299 - DNA, 24 bp, Homo sapiens
acagcagtagacattttaacaaga

SEQ ID NO: 5135300 - DNA, 12 bp, Homo sapiens
acagcagtattg

SEQ ID NO: 5135301 - DNA, 13 bp, Homo sapiens
acagcagtcacag

SEQ ID NO: 5135302 - DNA, 16 bp, Homo sapiens
acagcagtcacaggcc

SEQ ID NO: 5135303 - DNA, 19 bp, Homo sapiens
acagcagtcacaggcccag

SEQ ID NO: 5135304 - DNA, 21 bp, Homo sapiens
acagcagtcacaggcccagga

SEQ ID NO: 5135305 - DNA, 14 bp, Homo sapiens
acagcagtcttctt

SEQ ID NO: 5135306 - DNA, 14 bp, Homo sapiens
acagcagtgagact

SEQ ID NO: 5135307 - DNA, 18 bp, Homo sapiens
acagcagtgatctcaggg

SEQ ID NO: 5135308 - DNA, 19 bp, Homo sapiens
acagcagtggagagtgttc

SEQ ID NO: 5135309 - DNA, 17 bp, Homo sapiens
acagcagtgtcatcaga

SEQ ID NO: 5135310 - DNA, 22 bp, Homo sapiens
acagcagtgtcccctgccccag

SEQ ID NO: 5135311 - DNA, 22 bp, Homo sapiens
acagcagtgtgaatagcctggc

SEQ ID NO: 5135312 - DNA, 19 bp, Homo sapiens
acagcagtgttccccatct

SEQ ID NO: 5135313 - DNA, 18 bp, Homo sapiens
acagcagtgttctcacag

SEQ ID NO: 5135314 - DNA, 15 bp, Homo sapiens
acagcagttgaaaag

SEQ ID NO: 5135315 - DNA, 17 bp, Homo sapiens
acagcagttgactcaga

SEQ ID NO: 5135316 - DNA, 16 bp, Homo sapiens
acagtctctccctggg

SEQ ID NO: 5135317 - DNA, 18 bp, Homo sapiens
acagtctctccctggggt

SEQ ID NO: 5135318 - DNA, 14 bp, Homo sapiens
acagtctctggaaa

SEQ ID NO: 5135319 - DNA, 15 bp, Homo sapiens
acagtctctggaaaa

SEQ ID NO: 5135320 - DNA, 13 bp, Homo sapiens
acagtctctgttg

SEQ ID NO: 5135321 - DNA, 15 bp, Homo sapiens
acagtctctgttgta

SEQ ID NO: 5135322 - DNA, 20 bp, Homo sapiens
acagtctctttaatcttcag

SEQ ID NO: 5135323 - DNA, 15 bp, Homo sapiens
acagtctctttcttc

SEQ ID NO: 5135324 - DNA, 16 bp, Homo sapiens
acagtctctttcttcc

SEQ ID NO: 5135325 - DNA, 17 bp, Homo sapiens
acagtctctttcttcct

SEQ ID NO: 5135326 - DNA, 19 bp, Homo sapiens
acagtctctttcttccttt

SEQ ID NO: 5135327 - DNA, 19 bp, Homo sapiens
acagtctgatcgtgacgct

SEQ ID NO: 5135328 - DNA, 16 bp, Homo sapiens
acagtctgctcctctt

SEQ ID NO: 5135329 - DNA, 18 bp, Homo sapiens
acagtctgctcctcttgt

SEQ ID NO: 5135330 - DNA, 20 bp, Homo sapiens
acagtctggcagttgctaaa

SEQ ID NO: 5135331 - DNA, 23 bp, Homo sapiens
acagtctggctaggttaaaggcc

SEQ ID NO: 5135332 - DNA, 13 bp, Homo sapiens
acagtctgtcttc

SEQ ID NO: 5135333 - DNA, 16 bp, Homo sapiens
acagtctgtcttctgt

SEQ ID NO: 5135334 - DNA, 15 bp, Homo sapiens
acagtctgttatgca

SEQ ID NO: 5135335 - DNA, 17 bp, Homo sapiens
acagtctgttatgcact

SEQ ID NO: 5135336 - DNA, 17 bp, Homo sapiens
acagtcttactctgtct

SEQ ID NO: 5135337 - DNA, 17 bp, Homo sapiens
acagtcttatttaacca

SEQ ID NO: 5135338 - DNA, 14 bp, Homo sapiens
acagtcttcatttt

SEQ ID NO: 5135339 - DNA, 23 bp, Homo sapiens
acagtcttcattttttttaattg

SEQ ID NO: 5135340 - DNA, 15 bp, Homo sapiens
acagtcttgcagcag

SEQ ID NO: 5135341 - DNA, 15 bp, Homo sapiens
acagtcttgtattaa

SEQ ID NO: 5135342 - DNA, 18 bp, Homo sapiens
acagtcttgtattaagtt

SEQ ID NO: 5135343 - DNA, 23 bp, Homo sapiens
acagtgaaaagagagaagggaga

SEQ ID NO: 5135344 - DNA, 14 bp, Homo sapiens
acagtgaaaatgta

SEQ ID NO: 5135345 - DNA, 21 bp, Homo sapiens
acagtgaaaatgtaagctgtt

SEQ ID NO: 5135346 - DNA, 13 bp, Homo sapiens
acagtgaagacag

SEQ ID NO: 5135347 - DNA, 21 bp, Homo sapiens
acagtgaagacagaagtttgc

SEQ ID NO: 5135348 - DNA, 14 bp, Homo sapiens
acagtgaagcaaat

SEQ ID NO: 5135349 - DNA, 17 bp, Homo sapiens
acagtgaaggctgtcct

SEQ ID NO: 5135350 - DNA, 13 bp, Homo sapiens
acagtgaatgtgt

SEQ ID NO: 5135351 - DNA, 15 bp, Homo sapiens
acagtgaatttctga

SEQ ID NO: 5135352 - DNA, 19 bp, Homo sapiens
acagtgacaaattgtaact

SEQ ID NO: 5135353 - DNA, 22 bp, Homo sapiens
acagtgacaaattgtaactaca

SEQ ID NO: 5135354 - DNA, 18 bp, Homo sapiens
acagtgacaccatttgtc

SEQ ID NO: 5135355 - DNA, 21 bp, Homo sapiens
acagtgacactggaccaggtc

SEQ ID NO: 5135356 - DNA, 13 bp, Homo sapiens
acagtgacagtca

SEQ ID NO: 5135357 - DNA, 16 bp, Homo sapiens
acagtgacccttccca

SEQ ID NO: 5135358 - DNA, 22 bp, Homo sapiens
acagtgaccttttcttcatttt

SEQ ID NO: 5135359 - DNA, 22 bp, Homo sapiens
acagtgacgtgactcagagctt

SEQ ID NO: 5135360 - DNA, 17 bp, Homo sapiens
acagtgactgggccctg

SEQ ID NO: 5135361 - DNA, 15 bp, Homo sapiens
acagtgacttctgag

SEQ ID NO: 5135362 - DNA, 23 bp, Homo sapiens
acagtgacttggccccagacgca

SEQ ID NO: 5135363 - DNA, 23 bp, Homo sapiens
acagtgagaggggagggctcctg

SEQ ID NO: 5135364 - DNA, 16 bp, Homo sapiens
acagtgagcatatctg

SEQ ID NO: 5135365 - DNA, 12 bp, Homo sapiens
acagtgagccaa

SEQ ID NO: 5135366 - DNA, 17 bp, Homo sapiens
acagtgagcctgaattt

SEQ ID NO: 5135367 - DNA, 21 bp, Homo sapiens
acagtgagcctgaattttgtt

SEQ ID NO: 5135368 - DNA, 13 bp, Homo sapiens
acagtgaggaaaa

SEQ ID NO: 5135369 - DNA, 17 bp, Homo sapiens
acagtgaggactcggcc

SEQ ID NO: 5135370 - DNA, 15 bp, Homo sapiens
acagtgaggtcctgg

SEQ ID NO: 5135371 - DNA, 16 bp, Homo sapiens
acagtgaggtcctggg

SEQ ID NO: 5135372 - DNA, 18 bp, Homo sapiens
acagtgaggtcctggggg

SEQ ID NO: 5135373 - DNA, 20 bp, Homo sapiens
acagtgaggtcctgggggcc

SEQ ID NO: 5135374 - DNA, 22 bp, Homo sapiens
acagtgagtcgaggacagggag

SEQ ID NO: 5135375 - DNA, 17 bp, Homo sapiens
acagtgatagagcaaag

SEQ ID NO: 5135376 - DNA, 21 bp, Homo sapiens
acagtgatctccatatgttac

SEQ ID NO: 5135377 - DNA, 12 bp, Homo sapiens
acagtgatgaat

SEQ ID NO: 5135378 - DNA, 21 bp, Homo sapiens
acagtgatgaatgtactatgt

SEQ ID NO: 5135379 - DNA, 23 bp, Homo sapiens
acagtgatgccgggcgccaggac

SEQ ID NO: 5135380 - DNA, 19 bp, Homo sapiens
acagtgattaccagggact

SEQ ID NO: 5135381 - DNA, 17 bp, Homo sapiens
acagtgattagcctcgt

SEQ ID NO: 5135382 - DNA, 23 bp, Homo sapiens
acagtgatttttttttagaacag

SEQ ID NO: 5135383 - DNA, 21 bp, Homo sapiens
acagtgcacctgggacaggga

SEQ ID NO: 5135384 - DNA, 14 bp, Homo sapiens
acagtgcagacagg

SEQ ID NO: 5135385 - DNA, 15 bp, Homo sapiens
acagtgcagacaggc

SEQ ID NO: 5135386 - DNA, 18 bp, Homo sapiens
acagtgcagcaagcctgg

SEQ ID NO: 5135387 - DNA, 14 bp, Homo sapiens
acagtgcagggcaa

SEQ ID NO: 5135388 - DNA, 22 bp, Homo sapiens
acagtgcatccttgaactgtca

SEQ ID NO: 5135389 - DNA, 17 bp, Homo sapiens
acagtgcatctcagccc

SEQ ID NO: 5135390 - DNA, 18 bp, Homo sapiens
acagtgcatctcagccca

SEQ ID NO: 5135391 - DNA, 13 bp, Homo sapiens
acagtgccaaatg

SEQ ID NO: 5135392 - DNA, 12 bp, Homo sapiens
acagtgccaccc

SEQ ID NO: 5135393 - DNA, 16 bp, Homo sapiens
acagtgccattgtctt

SEQ ID NO: 5135394 - DNA, 18 bp, Homo sapiens
acagtgccattgtcttta

SEQ ID NO: 5135395 - DNA, 21 bp, Homo sapiens
acagtgcccatgaatgggaca

SEQ ID NO: 5135396 - DNA, 15 bp, Homo sapiens
acagtgcccttggtg

SEQ ID NO: 5135397 - DNA, 12 bp, Homo sapiens
acagtgcctctt

SEQ ID NO: 5135398 - DNA, 22 bp, Homo sapiens
acagtgcctcttccagtgaaca

SEQ ID NO: 5135399 - DNA, 22 bp, Homo sapiens
acagtgcctgatgggagtaggc

SEQ ID NO: 5135400 - DNA, 13 bp, Homo sapiens
acagtgcctgctg

SEQ ID NO: 5135401 - DNA, 20 bp, Homo sapiens
acagtgcctgggaatgtatt

SEQ ID NO: 5135402 - DNA, 12 bp, Homo sapiens
acagtgccttct

SEQ ID NO: 5135403 - DNA, 14 bp, Homo sapiens
acagtgccttctct

SEQ ID NO: 5135404 - DNA, 15 bp, Homo sapiens
acagtgctactgaaa

SEQ ID NO: 5135405 - DNA, 19 bp, Homo sapiens
acagtgctcagttgtactt

SEQ ID NO: 5135406 - DNA, 15 bp, Homo sapiens
acagtgctcttttct

SEQ ID NO: 5135407 - DNA, 16 bp, Homo sapiens
acagtgctcttttctc

SEQ ID NO: 5135408 - DNA, 23 bp, Homo sapiens
acagtgctgccacttaaaaagac

SEQ ID NO: 5135409 - DNA, 12 bp, Homo sapiens
acagtgctgccc

SEQ ID NO: 5135410 - DNA, 21 bp, Homo sapiens
acagtgctgccccttgcaagc

SEQ ID NO: 5135411 - DNA, 24 bp, Homo sapiens
acagtgctgccctgcgaagtggct

SEQ ID NO: 5135412 - DNA, 14 bp, Homo sapiens
acagtgctgcgaga

SEQ ID NO: 5135413 - DNA, 12 bp, Homo sapiens
acagtgctgctt

SEQ ID NO: 5135414 - DNA, 14 bp, Homo sapiens
acagtgctgggatt

SEQ ID NO: 5135415 - DNA, 23 bp, Homo sapiens
acagtgctgtctgatctgtgctt

SEQ ID NO: 5135416 - DNA, 13 bp, Homo sapiens
acagtgctgtgtg

SEQ ID NO: 5135417 - DNA, 15 bp, Homo sapiens
acagtgctgttctgg

SEQ ID NO: 5135418 - DNA, 14 bp, Homo sapiens
acagtgcttcagcc

SEQ ID NO: 5135419 - DNA, 20 bp, Homo sapiens
acagtgcttgccacagagcg

SEQ ID NO: 5135420 - DNA, 16 bp, Homo sapiens
acagtggaactacatt

SEQ ID NO: 5135421 - DNA, 18 bp, Homo sapiens
acagtggaactacattag

SEQ ID NO: 5135422 - DNA, 18 bp, Homo sapiens
acagtggaatataaggaa

SEQ ID NO: 5135423 - DNA, 18 bp, Homo sapiens
acagtggacggaggtccc

SEQ ID NO: 5135424 - DNA, 20 bp, Homo sapiens
acagtggagctgaattttct

SEQ ID NO: 5135425 - DNA, 15 bp, Homo sapiens
acagtggagggagac

SEQ ID NO: 5135426 - DNA, 16 bp, Homo sapiens
acagtggatcatgaaa

SEQ ID NO: 5135427 - DNA, 17 bp, Homo sapiens
acagtggcaagctacca

SEQ ID NO: 5135428 - DNA, 15 bp, Homo sapiens
acagtggcactaaaa

SEQ ID NO: 5135429 - DNA, 15 bp, Homo sapiens
acagtggcagcaaag

SEQ ID NO: 5135430 - DNA, 17 bp, Homo sapiens
acagtggcagcaaagga

SEQ ID NO: 5135431 - DNA, 19 bp, Homo sapiens
acagtggcagcaaaggaag

SEQ ID NO: 5135432 - DNA, 20 bp, Homo sapiens
acagtggcagcaaaggaaga

SEQ ID NO: 5135433 - DNA, 18 bp, Homo sapiens
acagtggcaggacaggaa

SEQ ID NO: 5135434 - DNA, 22 bp, Homo sapiens
acagtggccggggctgaagcca

SEQ ID NO: 5135435 - DNA, 20 bp, Homo sapiens
acagtggcgagaggagagga

SEQ ID NO: 5135436 - DNA, 16 bp, Homo sapiens
acagtggcgcatgcct

SEQ ID NO: 5135437 - DNA, 16 bp, Homo sapiens
acagtggctcataaaa

SEQ ID NO: 5135438 - DNA, 18 bp, Homo sapiens
acagtggctcataaaaat

SEQ ID NO: 5135439 - DNA, 21 bp, Homo sapiens
acagtggctcataaaaataaa

SEQ ID NO: 5135440 - DNA, 19 bp, Homo sapiens
acagtggctcgtatcccaa

SEQ ID NO: 5135441 - DNA, 18 bp, Homo sapiens
acagtggctgctctggga

SEQ ID NO: 5135442 - DNA, 21 bp, Homo sapiens
acagtgggaactctgacaagg

SEQ ID NO: 5135443 - DNA, 14 bp, Homo sapiens
acagtgggaagaat

SEQ ID NO: 5135444 - DNA, 16 bp, Homo sapiens
acagtgggagccaggg

SEQ ID NO: 5135445 - DNA, 19 bp, Homo sapiens
acagtgggagccctgacct

SEQ ID NO: 5135446 - DNA, 14 bp, Homo sapiens
acagtgggagctga

SEQ ID NO: 5135447 - DNA, 17 bp, Homo sapiens
acagtgggagctgagct

SEQ ID NO: 5135448 - DNA, 18 bp, Homo sapiens
acagtgggagctgagctg

SEQ ID NO: 5135449 - DNA, 20 bp, Homo sapiens
acagtgggagctgagctgga

SEQ ID NO: 5135450 - DNA, 21 bp, Homo sapiens
acagtgggcaggaggccccag

SEQ ID NO: 5135451 - DNA, 19 bp, Homo sapiens
acagtgggccggccccagg

SEQ ID NO: 5135452 - DNA, 22 bp, Homo sapiens
acagtgggcgttgggagcctag

SEQ ID NO: 5135453 - DNA, 14 bp, Homo sapiens
acagtggggcccat

SEQ ID NO: 5135454 - DNA, 22 bp, Homo sapiens
acagtggggcccatggccccag

SEQ ID NO: 5135455 - DNA, 20 bp, Homo sapiens
acagtggggtttttttgtct

SEQ ID NO: 5135456 - DNA, 15 bp, Homo sapiens
acagtgggtggtgga

SEQ ID NO: 5135457 - DNA, 23 bp, Homo sapiens
acagtggtaaatatagaaccatg

SEQ ID NO: 5135458 - DNA, 23 bp, Homo sapiens
acagtggtccagggtccagccct

SEQ ID NO: 5135459 - DNA, 23 bp, Homo sapiens
acagtggtggcaacattcattgc

SEQ ID NO: 5135460 - DNA, 20 bp, Homo sapiens
acagtggttcgtttaccaaa

SEQ ID NO: 5135461 - DNA, 23 bp, Homo sapiens
acagtggttgttttttcattgtg

SEQ ID NO: 5135462 - DNA, 22 bp, Homo sapiens
acagtggttttatactgaagga

SEQ ID NO: 5135463 - DNA, 21 bp, Homo sapiens
acagtgtaaatcccagactga

SEQ ID NO: 5135464 - DNA, 13 bp, Homo sapiens
acagtgtacagtc

SEQ ID NO: 5135465 - DNA, 16 bp, Homo sapiens
acagtgtacatgtaca

SEQ ID NO: 5135466 - DNA, 19 bp, Homo sapiens
acagtgtaccattaaaata

SEQ ID NO: 5135467 - DNA, 12 bp, Homo sapiens
acagtgtatgta

SEQ ID NO: 5135468 - DNA, 17 bp, Homo sapiens
acagtgtatttaagaaa

SEQ ID NO: 5135469 - DNA, 16 bp, Homo sapiens
acagtgtcagagtcat

SEQ ID NO: 5135470 - DNA, 16 bp, Homo sapiens
acagtgtcagatgagg

SEQ ID NO: 5135471 - DNA, 15 bp, Homo sapiens
acagtgtctgggctg

SEQ ID NO: 5135472 - DNA, 15 bp, Homo sapiens
acagtgtctgtaaat

SEQ ID NO: 5135473 - DNA, 16 bp, Homo sapiens
acagtgtctgtgccat

SEQ ID NO: 5135474 - DNA, 23 bp, Homo sapiens
acagtgtctgtgccatggatttc

SEQ ID NO: 5135475 - DNA, 21 bp, Homo sapiens
acagtgtctgttcagcaaact

SEQ ID NO: 5135476 - DNA, 19 bp, Homo sapiens
acagtgtctttttttgtat

SEQ ID NO: 5135477 - DNA, 12 bp, Homo sapiens
acagtgtgaagt

SEQ ID NO: 5135478 - DNA, 15 bp, Homo sapiens
acagtgtgaagttag

SEQ ID NO: 5135479 - DNA, 19 bp, Homo sapiens
acagtgtgaagttagaatt

SEQ ID NO: 5135480 - DNA, 19 bp, Homo sapiens
acagtgtgaataaagtgct

SEQ ID NO: 5135481 - DNA, 19 bp, Homo sapiens
acagtgtggcttaaacatt

SEQ ID NO: 5135482 - DNA, 21 bp, Homo sapiens
acagtgtggcttaaacatttt

SEQ ID NO: 5135483 - DNA, 17 bp, Homo sapiens
acagtgtgggacaggct

SEQ ID NO: 5135484 - DNA, 21 bp, Homo sapiens
acagtgtgggcgctctcccta

SEQ ID NO: 5135485 - DNA, 14 bp, Homo sapiens
acagtgtgtgaact

SEQ ID NO: 5135486 - DNA, 23 bp, Homo sapiens
acagtgtgtgaactgctttcaag

SEQ ID NO: 5135487 - DNA, 11 bp, Homo sapiens
acagtgtgtgt

SEQ ID NO: 5135488 - DNA, 12 bp, Homo sapiens
acagtgtgtgtg

SEQ ID NO: 5135489 - DNA, 16 bp, Homo sapiens
acagtgttattttctt

SEQ ID NO: 5135490 - DNA, 18 bp, Homo sapiens
acagtgttcaaattctga

SEQ ID NO: 5135491 - DNA, 12 bp, Homo sapiens
acagtgttcatt

SEQ ID NO: 5135492 - DNA, 16 bp, Homo sapiens
acagtgttcatttgaa

SEQ ID NO: 5135493 - DNA, 14 bp, Homo sapiens
acagtgttctgagc

SEQ ID NO: 5135494 - DNA, 23 bp, Homo sapiens
acagcagtttgagcttgctggag

SEQ ID NO: 5135495 - DNA, 21 bp, Homo sapiens
acagcataccttggactgact

SEQ ID NO: 5135496 - DNA, 15 bp, Homo sapiens
acagcatatagaata

SEQ ID NO: 5135497 - DNA, 21 bp, Homo sapiens
acagcatcattttgcattcaa

SEQ ID NO: 5135498 - DNA, 15 bp, Homo sapiens
acagcatctccaagc

SEQ ID NO: 5135499 - DNA, 14 bp, Homo sapiens
acagcatctctatg

SEQ ID NO: 5135500 - DNA, 14 bp, Homo sapiens
acagcatctgtagt

SEQ ID NO: 5135501 - DNA, 13 bp, Homo sapiens
acagcatgaataa

SEQ ID NO: 5135502 - DNA, 17 bp, Homo sapiens
acagcatgactggacag

SEQ ID NO: 5135503 - DNA, 21 bp, Homo sapiens
acagcatgagattgtacattt

SEQ ID NO: 5135504 - DNA, 22 bp, Homo sapiens
acagcatgagattgtacatttt

SEQ ID NO: 5135505 - DNA, 20 bp, Homo sapiens
acagcatgaggtgttgtgca

SEQ ID NO: 5135506 - DNA, 14 bp, Homo sapiens
acagcatgcccctt

SEQ ID NO: 5135507 - DNA, 21 bp, Homo sapiens
acagcatgccccttggctgga

SEQ ID NO: 5135508 - DNA, 17 bp, Homo sapiens
acagcatgctgctttgc

SEQ ID NO: 5135509 - DNA, 14 bp, Homo sapiens
acagcatggaaaag

SEQ ID NO: 5135510 - DNA, 18 bp, Homo sapiens
acagcatggactgtgtcc

SEQ ID NO: 5135511 - DNA, 17 bp, Homo sapiens
acagcatggtgcatgcc

SEQ ID NO: 5135512 - DNA, 21 bp, Homo sapiens
acagcatgtacggattttcag

SEQ ID NO: 5135513 - DNA, 14 bp, Homo sapiens
acagcatgtgcaat

SEQ ID NO: 5135514 - DNA, 18 bp, Homo sapiens
acagcatgtgccctcctg

SEQ ID NO: 5135515 - DNA, 14 bp, Homo sapiens
acagcatgtgttaa

SEQ ID NO: 5135516 - DNA, 15 bp, Homo sapiens
acagcattagatagt

SEQ ID NO: 5135517 - DNA, 23 bp, Homo sapiens
acagcattcttgtcacaataaat

SEQ ID NO: 5135518 - DNA, 12 bp, Homo sapiens
acagcattgctt

SEQ ID NO: 5135519 - DNA, 22 bp, Homo sapiens
acagcattggcctggccagacc

SEQ ID NO: 5135520 - DNA, 11 bp, Homo sapiens
acagcattgtc

SEQ ID NO: 5135521 - DNA, 17 bp, Homo sapiens
acagcattgtctttgct

SEQ ID NO: 5135522 - DNA, 23 bp, Homo sapiens
acagcatttgtgtgttacaatgt

SEQ ID NO: 5135523 - DNA, 12 bp, Homo sapiens
acagcattttaa

SEQ ID NO: 5135524 - DNA, 14 bp, Homo sapiens
acagcattttaagg

SEQ ID NO: 5135525 - DNA, 15 bp, Homo sapiens
acagcattttcctct

SEQ ID NO: 5135526 - DNA, 13 bp, Homo sapiens
acagccaaagaaa

SEQ ID NO: 5135527 - DNA, 14 bp, Homo sapiens
acagccaaagaaac

SEQ ID NO: 5135528 - DNA, 15 bp, Homo sapiens
acagccaaagaaact

SEQ ID NO: 5135529 - DNA, 23 bp, Homo sapiens
acagccaaagaaactcagaagag

SEQ ID NO: 5135530 - DNA, 16 bp, Homo sapiens
acagccaaattgcaga

SEQ ID NO: 5135531 - DNA, 15 bp, Homo sapiens
acagccaacaaacat

SEQ ID NO: 5135532 - DNA, 21 bp, Homo sapiens
acagccaacacgcacctgcct

SEQ ID NO: 5135533 - DNA, 21 bp, Homo sapiens
acagccaacagctacaacagc

SEQ ID NO: 5135534 - DNA, 23 bp, Homo sapiens
acagccaacagctacaacagcct

SEQ ID NO: 5135535 - DNA, 13 bp, Homo sapiens
acagccaacaggt

SEQ ID NO: 5135536 - DNA, 21 bp, Homo sapiens
acagccaactagcccctgggg

SEQ ID NO: 5135537 - DNA, 20 bp, Homo sapiens
acagccaagattttcctctt

SEQ ID NO: 5135538 - DNA, 16 bp, Homo sapiens
acagccaagcccaccc

SEQ ID NO: 5135539 - DNA, 13 bp, Homo sapiens
acagccaagctgg

SEQ ID NO: 5135540 - DNA, 17 bp, Homo sapiens
acagccaagctggcaca

SEQ ID NO: 5135541 - DNA, 15 bp, Homo sapiens
acagccaagtgtgac

SEQ ID NO: 5135542 - DNA, 16 bp, Homo sapiens
acagccaagtgtgacc

SEQ ID NO: 5135543 - DNA, 19 bp, Homo sapiens
acagccaagttgtgacagt

SEQ ID NO: 5135544 - DNA, 20 bp, Homo sapiens
acagccaatctccaggctcc

SEQ ID NO: 5135545 - DNA, 10 bp, Homo sapiens
acagccacac

SEQ ID NO: 5135546 - DNA, 18 bp, Homo sapiens
acagccacacacacagaa

SEQ ID NO: 5135547 - DNA, 12 bp, Homo sapiens
acagccacaccg

SEQ ID NO: 5135548 - DNA, 20 bp, Homo sapiens
acagccacatccccaagccc

SEQ ID NO: 5135549 - DNA, 21 bp, Homo sapiens
acagccacccgtggggtgctg

SEQ ID NO: 5135550 - DNA, 16 bp, Homo sapiens
acagccacctccgcca

SEQ ID NO: 5135551 - DNA, 16 bp, Homo sapiens
acagccacggccaggc

SEQ ID NO: 5135552 - DNA, 20 bp, Homo sapiens
acagccagaactctgtgtcc

SEQ ID NO: 5135553 - DNA, 13 bp, Homo sapiens
acagccagactgg

SEQ ID NO: 5135554 - DNA, 23 bp, Homo sapiens
acagccagacttgcttcctgcat

SEQ ID NO: 5135555 - DNA, 12 bp, Homo sapiens
acagccagagcc

SEQ ID NO: 5135556 - DNA, 12 bp, Homo sapiens
acagccagagct

SEQ ID NO: 5135557 - DNA, 14 bp, Homo sapiens
acagccagagctgg

SEQ ID NO: 5135558 - DNA, 19 bp, Homo sapiens
acagccagaggagggcaga

SEQ ID NO: 5135559 - DNA, 13 bp, Homo sapiens
acagccagcacct

SEQ ID NO: 5135560 - DNA, 12 bp, Homo sapiens
acagccagcagc

SEQ ID NO: 5135561 - DNA, 16 bp, Homo sapiens
acagccagcagcagga

SEQ ID NO: 5135562 - DNA, 13 bp, Homo sapiens
acagccagcccag

SEQ ID NO: 5135563 - DNA, 23 bp, Homo sapiens
acagccagcctgtcgtgtccagc

SEQ ID NO: 5135564 - DNA, 16 bp, Homo sapiens
acagccaggtgccttg

SEQ ID NO: 5135565 - DNA, 17 bp, Homo sapiens
acagccaggtggcacct

SEQ ID NO: 5135566 - DNA, 21 bp, Homo sapiens
acagccagtgggagatgttag

SEQ ID NO: 5135567 - DNA, 21 bp, Homo sapiens
acagccagttttactgtgatt

SEQ ID NO: 5135568 - DNA, 19 bp, Homo sapiens
acagccatagacctacaga

SEQ ID NO: 5135569 - DNA, 17 bp, Homo sapiens
acagccatagcagacgg

SEQ ID NO: 5135570 - DNA, 20 bp, Homo sapiens
acagccataggccctttcag

SEQ ID NO: 5135571 - DNA, 16 bp, Homo sapiens
acagccatgtccaagt

SEQ ID NO: 5135572 - DNA, 18 bp, Homo sapiens
acagccatgtccaagttc

SEQ ID NO: 5135573 - DNA, 19 bp, Homo sapiens
acagccattcatctgggct

SEQ ID NO: 5135574 - DNA, 16 bp, Homo sapiens
acagccattgcggccc

SEQ ID NO: 5135575 - DNA, 22 bp, Homo sapiens
acagccattttacatagcacat

SEQ ID NO: 5135576 - DNA, 14 bp, Homo sapiens
acagccattttcca

SEQ ID NO: 5135577 - DNA, 15 bp, Homo sapiens
acagccattttccaa

SEQ ID NO: 5135578 - DNA, 19 bp, Homo sapiens
acagcccaaagaaggaaaa

SEQ ID NO: 5135579 - DNA, 13 bp, Homo sapiens
acagcccacctgg

SEQ ID NO: 5135580 - DNA, 21 bp, Homo sapiens
acagcccacggggatcacagc

SEQ ID NO: 5135581 - DNA, 16 bp, Homo sapiens
acagcccacgtcctgt

SEQ ID NO: 5135582 - DNA, 18 bp, Homo sapiens
acagcccagaaccacaga

SEQ ID NO: 5135583 - DNA, 13 bp, Homo sapiens
acagcccagaagg

SEQ ID NO: 5135584 - DNA, 18 bp, Homo sapiens
acagcccagaaggccaga

SEQ ID NO: 5135585 - DNA, 13 bp, Homo sapiens
acagcccagagcc

SEQ ID NO: 5135586 - DNA, 18 bp, Homo sapiens
acagcccagagcctggct

SEQ ID NO: 5135587 - DNA, 18 bp, Homo sapiens
acagcccagcacaggtat

SEQ ID NO: 5135588 - DNA, 15 bp, Homo sapiens
acagcccaggatact

SEQ ID NO: 5135589 - DNA, 20 bp, Homo sapiens
acagcccaggcatctccttg

SEQ ID NO: 5135590 - DNA, 21 bp, Homo sapiens
acagcccaggcatctccttgg

SEQ ID NO: 5135591 - DNA, 22 bp, Homo sapiens
acagcccaggcggtcactgccc

SEQ ID NO: 5135592 - DNA, 17 bp, Homo sapiens
acagcccaggtcctccc

SEQ ID NO: 5135593 - DNA, 16 bp, Homo sapiens
acagcccatcacctct

SEQ ID NO: 5135594 - DNA, 19 bp, Homo sapiens
acagcccatggtgaatgta

SEQ ID NO: 5135595 - DNA, 20 bp, Homo sapiens
acagccccaaacaagcgcca

SEQ ID NO: 5135596 - DNA, 19 bp, Homo sapiens
acagccccaagcttctgag

SEQ ID NO: 5135597 - DNA, 21 bp, Homo sapiens
acagccccacagcacccaggc

SEQ ID NO: 5135598 - DNA, 13 bp, Homo sapiens
acagccccagagc

SEQ ID NO: 5135599 - DNA, 16 bp, Homo sapiens
acagccccagagcagg

SEQ ID NO: 5135600 - DNA, 11 bp, Homo sapiens
acagccccagg

SEQ ID NO: 5135601 - DNA, 16 bp, Homo sapiens
acagccccagggccct

SEQ ID NO: 5135602 - DNA, 13 bp, Homo sapiens
acagcccccaccc

SEQ ID NO: 5135603 - DNA, 15 bp, Homo sapiens
acagccccctctgcc

SEQ ID NO: 5135604 - DNA, 15 bp, Homo sapiens
acagccccggggccc

SEQ ID NO: 5135605 - DNA, 18 bp, Homo sapiens
acagccccggggccccct

SEQ ID NO: 5135606 - DNA, 19 bp, Homo sapiens
acagccccggggccccctg

SEQ ID NO: 5135607 - DNA, 21 bp, Homo sapiens
acagccccggggccccctggt

SEQ ID NO: 5135608 - DNA, 16 bp, Homo sapiens
acagcccctcctccat

SEQ ID NO: 5135609 - DNA, 15 bp, Homo sapiens
acagcccctggcact

SEQ ID NO: 5135610 - DNA, 20 bp, Homo sapiens
acagcccctggcactgcagg

SEQ ID NO: 5135611 - DNA, 15 bp, Homo sapiens
acagccccttgcttc

SEQ ID NO: 5135612 - DNA, 22 bp, Homo sapiens
acagccccttgcttctaaggga

SEQ ID NO: 5135613 - DNA, 15 bp, Homo sapiens
acagcccgagcccct

SEQ ID NO: 5135614 - DNA, 21 bp, Homo sapiens
acagcccgagccccttgggga

SEQ ID NO: 5135615 - DNA, 23 bp, Homo sapiens
acagcccgatcctcccctggact

SEQ ID NO: 5135616 - DNA, 22 bp, Homo sapiens
acagcccgcatgcagcagcttg

SEQ ID NO: 5135617 - DNA, 15 bp, Homo sapiens
acagcccgctctctg

SEQ ID NO: 5135618 - DNA, 15 bp, Homo sapiens
acagcccgggctctg

SEQ ID NO: 5135619 - DNA, 16 bp, Homo sapiens
acagcccgggctctgc

SEQ ID NO: 5135620 - DNA, 19 bp, Homo sapiens
acagcccgggctctgcctc

SEQ ID NO: 5135621 - DNA, 21 bp, Homo sapiens
acagcccgggctctgcctccc

SEQ ID NO: 5135622 - DNA, 17 bp, Homo sapiens
acagccctatttcttga

SEQ ID NO: 5135623 - DNA, 21 bp, Homo sapiens
acagccctcccgccccttccc

SEQ ID NO: 5135624 - DNA, 18 bp, Homo sapiens
acagccctctctctcact

SEQ ID NO: 5135625 - DNA, 10 bp, Homo sapiens
acagccctga

SEQ ID NO: 5135626 - DNA, 22 bp, Homo sapiens
acagccctgaaacgagaagtgc

SEQ ID NO: 5135627 - DNA, 21 bp, Homo sapiens
acagccctgcctgagaagccc

SEQ ID NO: 5135628 - DNA, 13 bp, Homo sapiens
acagccctggaat

SEQ ID NO: 5135629 - DNA, 20 bp, Homo sapiens
acagccctggcaaatgcctg

SEQ ID NO: 5135630 - DNA, 19 bp, Homo sapiens
acagccctgtcagcatgaa

SEQ ID NO: 5135631 - DNA, 20 bp, Homo sapiens
acagcccttccttggggaaa

SEQ ID NO: 5135632 - DNA, 18 bp, Homo sapiens
acagcccttggcttgtgt

SEQ ID NO: 5135633 - DNA, 16 bp, Homo sapiens
acagcccttttgtctc

SEQ ID NO: 5135634 - DNA, 15 bp, Homo sapiens
acagcccttttgtga

SEQ ID NO: 5135635 - DNA, 20 bp, Homo sapiens
acagcccttttgtgaacctt

SEQ ID NO: 5135636 - DNA, 19 bp, Homo sapiens
acagccgattcacctgagc

SEQ ID NO: 5135637 - DNA, 22 bp, Homo sapiens
acagccgcagcctccctctgac

SEQ ID NO: 5135638 - DNA, 15 bp, Homo sapiens
acagccgccggaagt

SEQ ID NO: 5135639 - DNA, 17 bp, Homo sapiens
acagccgcgggccagga

SEQ ID NO: 5135640 - DNA, 19 bp, Homo sapiens
acagccgctcctgtctgcc

SEQ ID NO: 5135641 - DNA, 20 bp, Homo sapiens
acagccgctcctgtctgcca

SEQ ID NO: 5135642 - DNA, 23 bp, Homo sapiens
acagccggatcttggagacaatt

SEQ ID NO: 5135643 - DNA, 19 bp, Homo sapiens
acagccgtcagccaaatgt

SEQ ID NO: 5135644 - DNA, 21 bp, Homo sapiens
acagcctaggaccagttttgt

SEQ ID NO: 5135645 - DNA, 17 bp, Homo sapiens
acagcctcacagaagaa

SEQ ID NO: 5135646 - DNA, 12 bp, Homo sapiens
acagcctcaccc

SEQ ID NO: 5135647 - DNA, 12 bp, Homo sapiens
acagcctccaag

SEQ ID NO: 5135648 - DNA, 12 bp, Homo sapiens
acagcctccagg

SEQ ID NO: 5135649 - DNA, 14 bp, Homo sapiens
acagcctccagggc

SEQ ID NO: 5135650 - DNA, 15 bp, Homo sapiens
acagcctccagggcc

SEQ ID NO: 5135651 - DNA, 17 bp, Homo sapiens
acagcctccctgagcct

SEQ ID NO: 5135652 - DNA, 21 bp, Homo sapiens
acagcctccctgagcctgcat

SEQ ID NO: 5135653 - DNA, 20 bp, Homo sapiens
acagcctccgccaagatcta

SEQ ID NO: 5135654 - DNA, 21 bp, Homo sapiens
acagcctccgccaagatctac

SEQ ID NO: 5135655 - DNA, 22 bp, Homo sapiens
acagcctcctaggctccctgag

SEQ ID NO: 5135656 - DNA, 12 bp, Homo sapiens
acagcctcctct

SEQ ID NO: 5135657 - DNA, 20 bp, Homo sapiens
acagcctcctctgtctgccc

SEQ ID NO: 5135658 - DNA, 23 bp, Homo sapiens
acagcctcctctgtctgcccttc

SEQ ID NO: 5135659 - DNA, 22 bp, Homo sapiens
acagcctctaagcgtgctgaca

SEQ ID NO: 5135660 - DNA, 16 bp, Homo sapiens
acagcctctctctttt

SEQ ID NO: 5135661 - DNA, 20 bp, Homo sapiens
acagcctctgacccctcctc

SEQ ID NO: 5135662 - DNA, 21 bp, Homo sapiens
acagcctctgacccctcctca

SEQ ID NO: 5135663 - DNA, 23 bp, Homo sapiens
acagcctctgacccctcctcact

SEQ ID NO: 5135664 - DNA, 13 bp, Homo sapiens
acagcctctgact

SEQ ID NO: 5135665 - DNA, 14 bp, Homo sapiens
acagcctctgcagt

SEQ ID NO: 5135666 - DNA, 15 bp, Homo sapiens
acagcctctggctcc

SEQ ID NO: 5135667 - DNA, 14 bp, Homo sapiens
acagcctcttactt

SEQ ID NO: 5135668 - DNA, 16 bp, Homo sapiens
acagcctcttagatgc

SEQ ID NO: 5135669 - DNA, 16 bp, Homo sapiens
acagcctcttcagccc

SEQ ID NO: 5135670 - DNA, 13 bp, Homo sapiens
acagcctcttcct

SEQ ID NO: 5135671 - DNA, 18 bp, Homo sapiens
acagcctcttctgtccca

SEQ ID NO: 5135672 - DNA, 22 bp, Homo sapiens
acagcctcttctgtcccaagtc

SEQ ID NO: 5135673 - DNA, 13 bp, Homo sapiens
acagtgttctgtt

SEQ ID NO: 5135674 - DNA, 15 bp, Homo sapiens
acagtgttctgttta

SEQ ID NO: 5135675 - DNA, 16 bp, Homo sapiens
acagtgttgagaacta

SEQ ID NO: 5135676 - DNA, 21 bp, Homo sapiens
acagtgttgcatatgagcctg

SEQ ID NO: 5135677 - DNA, 16 bp, Homo sapiens
acagtgttgtgcccct

SEQ ID NO: 5135678 - DNA, 21 bp, Homo sapiens
acagtgttgtgccccttcact

SEQ ID NO: 5135679 - DNA, 20 bp, Homo sapiens
acagtgtttacactttggac

SEQ ID NO: 5135680 - DNA, 14 bp, Homo sapiens
acagtgtttatcct

SEQ ID NO: 5135681 - DNA, 20 bp, Homo sapiens
acagtgtttatcctttcata

SEQ ID NO: 5135682 - DNA, 21 bp, Homo sapiens
acagtgtttatcctttcatat

SEQ ID NO: 5135683 - DNA, 15 bp, Homo sapiens
acagtgtttcccata

SEQ ID NO: 5135684 - DNA, 19 bp, Homo sapiens
acagtgtttcgacagctga

SEQ ID NO: 5135685 - DNA, 17 bp, Homo sapiens
acagtgtttcttattcc

SEQ ID NO: 5135686 - DNA, 12 bp, Homo sapiens
acagtgtttgat

SEQ ID NO: 5135687 - DNA, 15 bp, Homo sapiens
acagtgttttatccg

SEQ ID NO: 5135688 - DNA, 11 bp, Homo sapiens
acagtgttttt

SEQ ID NO: 5135689 - DNA, 23 bp, Homo sapiens
acagtgttttttaggaaaagcat

SEQ ID NO: 5135690 - DNA, 21 bp, Homo sapiens
acagttaaactggcttaactt

SEQ ID NO: 5135691 - DNA, 21 bp, Homo sapiens
acagttaaatgagaacatgaa

SEQ ID NO: 5135692 - DNA, 13 bp, Homo sapiens
acagttaactttc

SEQ ID NO: 5135693 - DNA, 14 bp, Homo sapiens
acagttaactttca

SEQ ID NO: 5135694 - DNA, 16 bp, Homo sapiens
acagttaactttcaga

SEQ ID NO: 5135695 - DNA, 18 bp, Homo sapiens
acagttaaggagaatcat

SEQ ID NO: 5135696 - DNA, 17 bp, Homo sapiens
acagttaccctgctttg

SEQ ID NO: 5135697 - DNA, 13 bp, Homo sapiens
acagttactcaga

SEQ ID NO: 5135698 - DNA, 20 bp, Homo sapiens
acagttactcagaattctct

SEQ ID NO: 5135699 - DNA, 17 bp, Homo sapiens
acagttacttccttcct

SEQ ID NO: 5135700 - DNA, 12 bp, Homo sapiens
acagttactttt

SEQ ID NO: 5135701 - DNA, 13 bp, Homo sapiens
acagttacttttc

SEQ ID NO: 5135702 - DNA, 20 bp, Homo sapiens
acagttacttttccttgcat

SEQ ID NO: 5135703 - DNA, 22 bp, Homo sapiens
acagttagggttgagttacttc

SEQ ID NO: 5135704 - DNA, 19 bp, Homo sapiens
acagttagggttttgcaat

SEQ ID NO: 5135705 - DNA, 14 bp, Homo sapiens
acagttataaagaa

SEQ ID NO: 5135706 - DNA, 14 bp, Homo sapiens
acagttatattttt

SEQ ID NO: 5135707 - DNA, 16 bp, Homo sapiens
acagttatcaaaaagt

SEQ ID NO: 5135708 - DNA, 14 bp, Homo sapiens
acagttatcatgaa

SEQ ID NO: 5135709 - DNA, 14 bp, Homo sapiens
acagttatcctgca

SEQ ID NO: 5135710 - DNA, 16 bp, Homo sapiens
acagttatcctgcaag

SEQ ID NO: 5135711 - DNA, 17 bp, Homo sapiens
acagttatctaagttaa

SEQ ID NO: 5135712 - DNA, 23 bp, Homo sapiens
acagttatctaagttaatttaaa

SEQ ID NO: 5135713 - DNA, 15 bp, Homo sapiens
acagttattgtttga

SEQ ID NO: 5135714 - DNA, 18 bp, Homo sapiens
acagttatttatagtcat

SEQ ID NO: 5135715 - DNA, 23 bp, Homo sapiens
acagttatttatagtcatttatt

SEQ ID NO: 5135716 - DNA, 19 bp, Homo sapiens
acagttatttcatctttta

SEQ ID NO: 5135717 - DNA, 21 bp, Homo sapiens
acagttatttcatcttttatt

SEQ ID NO: 5135718 - DNA, 16 bp, Homo sapiens
acagttattttggata

SEQ ID NO: 5135719 - DNA, 14 bp, Homo sapiens
acagttcacaccct

SEQ ID NO: 5135720 - DNA, 18 bp, Homo sapiens
acagttcacaccctgcaa

SEQ ID NO: 5135721 - DNA, 20 bp, Homo sapiens
acagttcacaccctgcaagg

SEQ ID NO: 5135722 - DNA, 13 bp, Homo sapiens
acagttcagagat

SEQ ID NO: 5135723 - DNA, 12 bp, Homo sapiens
acagttcagttc

SEQ ID NO: 5135724 - DNA, 14 bp, Homo sapiens
acagttcatttaat

SEQ ID NO: 5135725 - DNA, 19 bp, Homo sapiens
acagttccaatcagtagct

SEQ ID NO: 5135726 - DNA, 19 bp, Homo sapiens
acagttccattcaactgga

SEQ ID NO: 5135727 - DNA, 22 bp, Homo sapiens
acagttcggtgagctacaaatg

SEQ ID NO: 5135728 - DNA, 15 bp, Homo sapiens
acagttctatttgct

SEQ ID NO: 5135729 - DNA, 17 bp, Homo sapiens
acagttctatttgctat

SEQ ID NO: 5135730 - DNA, 19 bp, Homo sapiens
acagttctcccttcaactg

SEQ ID NO: 5135731 - DNA, 17 bp, Homo sapiens
acagttctctccttctt

SEQ ID NO: 5135732 - DNA, 14 bp, Homo sapiens
acagttctgagctg

SEQ ID NO: 5135733 - DNA, 21 bp, Homo sapiens
acagttctgagctgtaatttc

SEQ ID NO: 5135734 - DNA, 20 bp, Homo sapiens
acagttcttaatacaggaga

SEQ ID NO: 5135735 - DNA, 19 bp, Homo sapiens
acagttcttcgggaagaga

SEQ ID NO: 5135736 - DNA, 24 bp, Homo sapiens
acagttcttcgggaagagaggagt

SEQ ID NO: 5135737 - DNA, 17 bp, Homo sapiens
acagttcttggtgactg

SEQ ID NO: 5135738 - DNA, 22 bp, Homo sapiens
acagttcttggtgactgtccca

SEQ ID NO: 5135739 - DNA, 12 bp, Homo sapiens
acagttctttcc

SEQ ID NO: 5135740 - DNA, 16 bp, Homo sapiens
acagttctttcctctt

SEQ ID NO: 5135741 - DNA, 22 bp, Homo sapiens
acagttctttgggccagacatg

SEQ ID NO: 5135742 - DNA, 15 bp, Homo sapiens
acagttcttttctac

SEQ ID NO: 5135743 - DNA, 20 bp, Homo sapiens
acagttgaaaaacagctgag

SEQ ID NO: 5135744 - DNA, 13 bp, Homo sapiens
acagttgaagaaa

SEQ ID NO: 5135745 - DNA, 13 bp, Homo sapiens
acagttgacccta

SEQ ID NO: 5135746 - DNA, 23 bp, Homo sapiens
acagttgaccctattttttgaca

SEQ ID NO: 5135747 - DNA, 21 bp, Homo sapiens
acagttgactggctttcctct

SEQ ID NO: 5135748 - DNA, 19 bp, Homo sapiens
acagttgatggagccccag

SEQ ID NO: 5135749 - DNA, 13 bp, Homo sapiens
acagttgatgttt

SEQ ID NO: 5135750 - DNA, 15 bp, Homo sapiens
acagttgatgtttgg

SEQ ID NO: 5135751 - DNA, 16 bp, Homo sapiens
acagttgctggcatgt

SEQ ID NO: 5135752 - DNA, 21 bp, Homo sapiens
acagttgctgtcataagaatg

SEQ ID NO: 5135753 - DNA, 20 bp, Homo sapiens
acagttggagggaaagccag

SEQ ID NO: 5135754 - DNA, 22 bp, Homo sapiens
acagttggcagagaaggcctct

SEQ ID NO: 5135755 - DNA, 20 bp, Homo sapiens
acagttgggaaaatatgtcc

SEQ ID NO: 5135756 - DNA, 23 bp, Homo sapiens
acagttgggaagtctcagcctgg

SEQ ID NO: 5135757 - DNA, 18 bp, Homo sapiens
acagttggggctgttcat

SEQ ID NO: 5135758 - DNA, 14 bp, Homo sapiens
acagttgggtgaga

SEQ ID NO: 5135759 - DNA, 17 bp, Homo sapiens
acagttgtaccactgct

SEQ ID NO: 5135760 - DNA, 16 bp, Homo sapiens
acagttgtatgtttgc

SEQ ID NO: 5135761 - DNA, 22 bp, Homo sapiens
acagttgtatttaacagaaatt

SEQ ID NO: 5135762 - DNA, 20 bp, Homo sapiens
acagttgtgataatagcatt

SEQ ID NO: 5135763 - DNA, 15 bp, Homo sapiens
acagttgttggcctc

SEQ ID NO: 5135764 - DNA, 22 bp, Homo sapiens
acagttgtttgatgcattaaaa

SEQ ID NO: 5135765 - DNA, 12 bp, Homo sapiens
acagtttaaaaa

SEQ ID NO: 5135766 - DNA, 21 bp, Homo sapiens
acagtttaaaaaaaaagttgg

SEQ ID NO: 5135767 - DNA, 18 bp, Homo sapiens
acagtttaacagagtttt

SEQ ID NO: 5135768 - DNA, 20 bp, Homo sapiens
acagtttaacagagttttct

SEQ ID NO: 5135769 - DNA, 20 bp, Homo sapiens
acagtttaataccacagctt

SEQ ID NO: 5135770 - DNA, 22 bp, Homo sapiens
acagtttaccagttgcctttta

SEQ ID NO: 5135771 - DNA, 23 bp, Homo sapiens
acagtttacctcaggtgtgcctg

SEQ ID NO: 5135772 - DNA, 18 bp, Homo sapiens
acagtttactttgccaac

SEQ ID NO: 5135773 - DNA, 16 bp, Homo sapiens
acagtttataaagcca

SEQ ID NO: 5135774 - DNA, 20 bp, Homo sapiens
acagtttatcatgaagcctg

SEQ ID NO: 5135775 - DNA, 22 bp, Homo sapiens
acagtttatcatgaagcctgtg

SEQ ID NO: 5135776 - DNA, 15 bp, Homo sapiens
acagtttatcctgtc

SEQ ID NO: 5135777 - DNA, 14 bp, Homo sapiens
acagtttattttct

SEQ ID NO: 5135778 - DNA, 15 bp, Homo sapiens
acagtttatttttat

SEQ ID NO: 5135779 - DNA, 14 bp, Homo sapiens
acagtttccaaatt

SEQ ID NO: 5135780 - DNA, 13 bp, Homo sapiens
acagtttccagat

SEQ ID NO: 5135781 - DNA, 22 bp, Homo sapiens
acagtttcttagctttttaatt

SEQ ID NO: 5135782 - DNA, 14 bp, Homo sapiens
acagtttcttttgt

SEQ ID NO: 5135783 - DNA, 18 bp, Homo sapiens
acagtttcttttgtgttc

SEQ ID NO: 5135784 - DNA, 19 bp, Homo sapiens
acagtttcttttttcttac

SEQ ID NO: 5135785 - DNA, 15 bp, Homo sapiens
acagtttgaacaaaa

SEQ ID NO: 5135786 - DNA, 20 bp, Homo sapiens
acagtttgatgctgagtcat

SEQ ID NO: 5135787 - DNA, 20 bp, Homo sapiens
acagtttgatgtcattaatg

SEQ ID NO: 5135788 - DNA, 13 bp, Homo sapiens
acagtttgctgta

SEQ ID NO: 5135789 - DNA, 13 bp, Homo sapiens
acagtttgtaaat

SEQ ID NO: 5135790 - DNA, 18 bp, Homo sapiens
acagtttgtaaatgttat

SEQ ID NO: 5135791 - DNA, 19 bp, Homo sapiens
acagtttgtaaatgttatt

SEQ ID NO: 5135792 - DNA, 14 bp, Homo sapiens
acagtttgtcacat

SEQ ID NO: 5135793 - DNA, 16 bp, Homo sapiens
acagtttgtgaggacc

SEQ ID NO: 5135794 - DNA, 20 bp, Homo sapiens
acagtttgtgttttaaaaaa

SEQ ID NO: 5135795 - DNA, 21 bp, Homo sapiens
acagtttgtgttttaaaaaaa

SEQ ID NO: 5135796 - DNA, 23 bp, Homo sapiens
acagtttgtgttttaaaaaaact

SEQ ID NO: 5135797 - DNA, 20 bp, Homo sapiens
acagtttgttagtatgaggc

SEQ ID NO: 5135798 - DNA, 15 bp, Homo sapiens
acagtttgttcagtg

SEQ ID NO: 5135799 - DNA, 15 bp, Homo sapiens
acagtttgtttcctg

SEQ ID NO: 5135800 - DNA, 16 bp, Homo sapiens
acagtttgtttcctgt

SEQ ID NO: 5135801 - DNA, 18 bp, Homo sapiens
acagtttgtttcctgtct

SEQ ID NO: 5135802 - DNA, 13 bp, Homo sapiens
acagttttaactg

SEQ ID NO: 5135803 - DNA, 19 bp, Homo sapiens
acagttttaactgtggata

SEQ ID NO: 5135804 - DNA, 21 bp, Homo sapiens
acagttttaactgtggatatt

SEQ ID NO: 5135805 - DNA, 20 bp, Homo sapiens
acagttttagaataaggagg

SEQ ID NO: 5135806 - DNA, 22 bp, Homo sapiens
acagttttcattgattatatgg

SEQ ID NO: 5135807 - DNA, 12 bp, Homo sapiens
acagttttccat

SEQ ID NO: 5135808 - DNA, 23 bp, Homo sapiens
acagttttccatgaaaacgtttt

SEQ ID NO: 5135809 - DNA, 19 bp, Homo sapiens
acagttttcctaaatgtat

SEQ ID NO: 5135810 - DNA, 20 bp, Homo sapiens
acagttttcctaaatgtata

SEQ ID NO: 5135811 - DNA, 14 bp, Homo sapiens
acagttttccttct

SEQ ID NO: 5135812 - DNA, 13 bp, Homo sapiens
acagttttctagc

SEQ ID NO: 5135813 - DNA, 16 bp, Homo sapiens
acagttttctagcaat

SEQ ID NO: 5135814 - DNA, 17 bp, Homo sapiens
acagttttgctttagta

SEQ ID NO: 5135815 - DNA, 23 bp, Homo sapiens
acagttttgtcagtctttcttag

SEQ ID NO: 5135816 - DNA, 19 bp, Homo sapiens
acagttttgtggactgagc

SEQ ID NO: 5135817 - DNA, 17 bp, Homo sapiens
acagtttttttctttgt

SEQ ID NO: 5135818 - DNA, 20 bp, Homo sapiens
acagtttttttctttgtgta

SEQ ID NO: 5135819 - DNA, 11 bp, Homo sapiens
acataaaaact

SEQ ID NO: 5135820 - DNA, 19 bp, Homo sapiens
acataaaaactgatttgct

SEQ ID NO: 5135821 - DNA, 21 bp, Homo sapiens
acataaaaagcagaattttaa

SEQ ID NO: 5135822 - DNA, 20 bp, Homo sapiens
acataaaaaggacatcagca

SEQ ID NO: 5135823 - DNA, 17 bp, Homo sapiens
acataaaaaggatccag

SEQ ID NO: 5135824 - DNA, 14 bp, Homo sapiens
acataaaaattgtt

SEQ ID NO: 5135825 - DNA, 11 bp, Homo sapiens
acataaaacaa

SEQ ID NO: 5135826 - DNA, 23 bp, Homo sapiens
acataaaacaaaaccaagccttg

SEQ ID NO: 5135827 - DNA, 13 bp, Homo sapiens
acataaaacagaa

SEQ ID NO: 5135828 - DNA, 12 bp, Homo sapiens
acataaaacttt

SEQ ID NO: 5135829 - DNA, 13 bp, Homo sapiens
acataaaacttta

SEQ ID NO: 5135830 - DNA, 14 bp, Homo sapiens
acataaaactttaa

SEQ ID NO: 5135831 - DNA, 21 bp, Homo sapiens
acataaaactttaaaaggcaa

SEQ ID NO: 5135832 - DNA, 17 bp, Homo sapiens
acataaaagaaataaac

SEQ ID NO: 5135833 - DNA, 14 bp, Homo sapiens
acataaaagaattt

SEQ ID NO: 5135834 - DNA, 18 bp, Homo sapiens
acataaaagagtggaact

SEQ ID NO: 5135835 - DNA, 14 bp, Homo sapiens
acataaaatctgtg

SEQ ID NO: 5135836 - DNA, 14 bp, Homo sapiens
acataaaatgtcat

SEQ ID NO: 5135837 - DNA, 13 bp, Homo sapiens
acataaaatttaa

SEQ ID NO: 5135838 - DNA, 19 bp, Homo sapiens
acataaaatttaaaaactt

SEQ ID NO: 5135839 - DNA, 16 bp, Homo sapiens
acataaaattttctag

SEQ ID NO: 5135840 - DNA, 23 bp, Homo sapiens
acataaacaagaccacgtttcta

SEQ ID NO: 5135841 - DNA, 12 bp, Homo sapiens
acataaacactt

SEQ ID NO: 5135842 - DNA, 13 bp, Homo sapiens
acataaacacttc

SEQ ID NO: 5135843 - DNA, 20 bp, Homo sapiens
acataaacacttctccttaa

SEQ ID NO: 5135844 - DNA, 13 bp, Homo sapiens
acataaacagttt

SEQ ID NO: 5135845 - DNA, 22 bp, Homo sapiens
acataaaccatttttgttactc

SEQ ID NO: 5135846 - DNA, 18 bp, Homo sapiens
acataaacccatctgtaa

SEQ ID NO: 5135847 - DNA, 13 bp, Homo sapiens
acataaactgact

SEQ ID NO: 5135848 - DNA, 15 bp, Homo sapiens
acataaactgacttt

SEQ ID NO: 5135849 - DNA, 16 bp, Homo sapiens
acataaactgtcactc

SEQ ID NO: 5135850 - DNA, 16 bp, Homo sapiens
acataaacttgtactt

SEQ ID NO: 5135851 - DNA, 23 bp, Homo sapiens
acataaacttgtacttacactga

SEQ ID NO: 5135852 - DNA, 17 bp, Homo sapiens
acagcctgaataaacca

SEQ ID NO: 5135853 - DNA, 20 bp, Homo sapiens
acagcctgaataaaccaaga

SEQ ID NO: 5135854 - DNA, 20 bp, Homo sapiens
acagcctgacaacatttcta

SEQ ID NO: 5135855 - DNA, 12 bp, Homo sapiens
acagcctgcaca

SEQ ID NO: 5135856 - DNA, 19 bp, Homo sapiens
acagcctgcacacacctgc

SEQ ID NO: 5135857 - DNA, 17 bp, Homo sapiens
acagcctgcctctgcca

SEQ ID NO: 5135858 - DNA, 18 bp, Homo sapiens
acagcctgcctctgccac

SEQ ID NO: 5135859 - DNA, 19 bp, Homo sapiens
acagcctgcctctgccaca

SEQ ID NO: 5135860 - DNA, 13 bp, Homo sapiens
acagcctgctggc

SEQ ID NO: 5135861 - DNA, 14 bp, Homo sapiens
acagcctgctggca

SEQ ID NO: 5135862 - DNA, 16 bp, Homo sapiens
acagcctgctggcagg

SEQ ID NO: 5135863 - DNA, 19 bp, Homo sapiens
acagcctgctggcagggcc

SEQ ID NO: 5135864 - DNA, 23 bp, Homo sapiens
acagcctgctggcagggccaggg

SEQ ID NO: 5135865 - DNA, 12 bp, Homo sapiens
acagcctggcac

SEQ ID NO: 5135866 - DNA, 12 bp, Homo sapiens
acagcctgggcc

SEQ ID NO: 5135867 - DNA, 17 bp, Homo sapiens
acagcctggggaggggg

SEQ ID NO: 5135868 - DNA, 12 bp, Homo sapiens
acagcctggggg

SEQ ID NO: 5135869 - DNA, 20 bp, Homo sapiens
acagcctggggttgtccccg

SEQ ID NO: 5135870 - DNA, 21 bp, Homo sapiens
acagcctggtcgccttccacc

SEQ ID NO: 5135871 - DNA, 12 bp, Homo sapiens
acagcctgtctt

SEQ ID NO: 5135872 - DNA, 20 bp, Homo sapiens
acagcctgtggcggtgcctg

SEQ ID NO: 5135873 - DNA, 18 bp, Homo sapiens
acagcctgtgtctttaaa

SEQ ID NO: 5135874 - DNA, 23 bp, Homo sapiens
acagcctgtgtctttaaatgctg

SEQ ID NO: 5135875 - DNA, 19 bp, Homo sapiens
acagcctgtttctatcctg

SEQ ID NO: 5135876 - DNA, 23 bp, Homo sapiens
acagcctgtttctatcctgttta

SEQ ID NO: 5135877 - DNA, 22 bp, Homo sapiens
acagccttagctgccagtgctg

SEQ ID NO: 5135878 - DNA, 12 bp, Homo sapiens
acagccttcact

SEQ ID NO: 5135879 - DNA, 20 bp, Homo sapiens
acagccttcactggagaccg

SEQ ID NO: 5135880 - DNA, 21 bp, Homo sapiens
acagccttcagcagcagctca

SEQ ID NO: 5135881 - DNA, 15 bp, Homo sapiens
acagccttccccagc

SEQ ID NO: 5135882 - DNA, 20 bp, Homo sapiens
acagccttccctctgcattg

SEQ ID NO: 5135883 - DNA, 13 bp, Homo sapiens
acagccttccttc

SEQ ID NO: 5135884 - DNA, 21 bp, Homo sapiens
acagccttccttctgctccca

SEQ ID NO: 5135885 - DNA, 20 bp, Homo sapiens
acagccttctaaattcccaa

SEQ ID NO: 5135886 - DNA, 12 bp, Homo sapiens
acagccttgcaa

SEQ ID NO: 5135887 - DNA, 22 bp, Homo sapiens
acagccttgcagcggctcctgc

SEQ ID NO: 5135888 - DNA, 18 bp, Homo sapiens
acagccttgttcctcagc

SEQ ID NO: 5135889 - DNA, 16 bp, Homo sapiens
acagcctttgaatgta

SEQ ID NO: 5135890 - DNA, 17 bp, Homo sapiens
acagcctttgaatgtaa

SEQ ID NO: 5135891 - DNA, 21 bp, Homo sapiens
acagcctttgaatgtaaccaa

SEQ ID NO: 5135892 - DNA, 22 bp, Homo sapiens
acagcctttgaatgtaaccaat

SEQ ID NO: 5135893 - DNA, 22 bp, Homo sapiens
acagcctttgcccaaaactgtc

SEQ ID NO: 5135894 - DNA, 22 bp, Homo sapiens
acagcctttgcgctctgggttt

SEQ ID NO: 5135895 - DNA, 15 bp, Homo sapiens
acagcgaacagcctt

SEQ ID NO: 5135896 - DNA, 19 bp, Homo sapiens
acagcgaacagccttagag

SEQ ID NO: 5135897 - DNA, 18 bp, Homo sapiens
acagcgaactagaagaaa

SEQ ID NO: 5135898 - DNA, 16 bp, Homo sapiens
acagcgacagaaaacc

SEQ ID NO: 5135899 - DNA, 23 bp, Homo sapiens
acagcgacagaaaacctcaaggg

SEQ ID NO: 5135900 - DNA, 12 bp, Homo sapiens
acagcgagaaaa

SEQ ID NO: 5135901 - DNA, 19 bp, Homo sapiens
acagcgagaggcagagaaa

SEQ ID NO: 5135902 - DNA, 22 bp, Homo sapiens
acagcgagaggcagagaaagaa

SEQ ID NO: 5135903 - DNA, 17 bp, Homo sapiens
acagcgagggcagctgc

SEQ ID NO: 5135904 - DNA, 18 bp, Homo sapiens
acagcgagggcagctgct

SEQ ID NO: 5135905 - DNA, 19 bp, Homo sapiens
acagcgataagctttcaat

SEQ ID NO: 5135906 - DNA, 17 bp, Homo sapiens
acagcgatggcaggcct

SEQ ID NO: 5135907 - DNA, 12 bp, Homo sapiens
acagcgcctcct

SEQ ID NO: 5135908 - DNA, 13 bp, Homo sapiens
acagcgcctcctg

SEQ ID NO: 5135909 - DNA, 21 bp, Homo sapiens
acagcgcgggcggaggcggct

SEQ ID NO: 5135910 - DNA, 23 bp, Homo sapiens
acagcggcagtgggcctgctgag

SEQ ID NO: 5135911 - DNA, 13 bp, Homo sapiens
acagcggccccgc

SEQ ID NO: 5135912 - DNA, 20 bp, Homo sapiens
acagcggccccgcggagccc

SEQ ID NO: 5135913 - DNA, 15 bp, Homo sapiens
acagcggcccctgca

SEQ ID NO: 5135914 - DNA, 16 bp, Homo sapiens
acagcggcccctgcat

SEQ ID NO: 5135915 - DNA, 19 bp, Homo sapiens
acagcggcccctgcatccc

SEQ ID NO: 5135916 - DNA, 16 bp, Homo sapiens
acagcggcccggccca

SEQ ID NO: 5135917 - DNA, 18 bp, Homo sapiens
acagcggcccggcccacg

SEQ ID NO: 5135918 - DNA, 21 bp, Homo sapiens
acagcggcccggcccacgcag

SEQ ID NO: 5135919 - DNA, 23 bp, Homo sapiens
acagcggccttgaagacagagca

SEQ ID NO: 5135920 - DNA, 22 bp, Homo sapiens
acagcgggtacttatttctcag

SEQ ID NO: 5135921 - DNA, 16 bp, Homo sapiens
acagcggtcccagggg

SEQ ID NO: 5135922 - DNA, 14 bp, Homo sapiens
acagcggttgtaaa

SEQ ID NO: 5135923 - DNA, 19 bp, Homo sapiens
acagcggttgtaaatacaa

SEQ ID NO: 5135924 - DNA, 20 bp, Homo sapiens
acagcggttgtaaatacaat

SEQ ID NO: 5135925 - DNA, 18 bp, Homo sapiens
acagcggtttgcagagaa

SEQ ID NO: 5135926 - DNA, 23 bp, Homo sapiens
acagcgtccctagcagtgaacta

SEQ ID NO: 5135927 - DNA, 22 bp, Homo sapiens
acagcgtctgctcataggacct

SEQ ID NO: 5135928 - DNA, 13 bp, Homo sapiens
acagcgtgctggc

SEQ ID NO: 5135929 - DNA, 20 bp, Homo sapiens
acagcgtgtcaactttcatt

SEQ ID NO: 5135930 - DNA, 13 bp, Homo sapiens
acagcgttcctag

SEQ ID NO: 5135931 - DNA, 19 bp, Homo sapiens
acagctaacaattgtgaag

SEQ ID NO: 5135932 - DNA, 18 bp, Homo sapiens
acagctaacacacagctc

SEQ ID NO: 5135933 - DNA, 17 bp, Homo sapiens
acagctaacatggaagt

SEQ ID NO: 5135934 - DNA, 22 bp, Homo sapiens
acagctaataaaagtcagagct

SEQ ID NO: 5135935 - DNA, 19 bp, Homo sapiens
acagctaatgggacactaa

SEQ ID NO: 5135936 - DNA, 14 bp, Homo sapiens
acagctaccaccct

SEQ ID NO: 5135937 - DNA, 16 bp, Homo sapiens
acagctaccaccctta

SEQ ID NO: 5135938 - DNA, 23 bp, Homo sapiens
acagctactcagtggggctggca

SEQ ID NO: 5135939 - DNA, 22 bp, Homo sapiens
acagctactctccccacgaggg

SEQ ID NO: 5135940 - DNA, 20 bp, Homo sapiens
acagctacttctgggaaaaa

SEQ ID NO: 5135941 - DNA, 13 bp, Homo sapiens
acagctagcccca

SEQ ID NO: 5135942 - DNA, 15 bp, Homo sapiens
acagctagcttgaaa

SEQ ID NO: 5135943 - DNA, 17 bp, Homo sapiens
acagctaggctgagatg

SEQ ID NO: 5135944 - DNA, 20 bp, Homo sapiens
acagctaggctgagatgcac

SEQ ID NO: 5135945 - DNA, 15 bp, Homo sapiens
acagctagtgaagac

SEQ ID NO: 5135946 - DNA, 16 bp, Homo sapiens
acagctagtgaagacc

SEQ ID NO: 5135947 - DNA, 15 bp, Homo sapiens
acagctatatttgat

SEQ ID NO: 5135948 - DNA, 21 bp, Homo sapiens
acagctatgcaaaaagctagt

SEQ ID NO: 5135949 - DNA, 16 bp, Homo sapiens
acagctatgggagccc

SEQ ID NO: 5135950 - DNA, 17 bp, Homo sapiens
acagctatgggagcccc

SEQ ID NO: 5135951 - DNA, 21 bp, Homo sapiens
acagctatgggagccccaggg

SEQ ID NO: 5135952 - DNA, 18 bp, Homo sapiens
acagctattatatcagct

SEQ ID NO: 5135953 - DNA, 21 bp, Homo sapiens
acagctattggcaagttttaa

SEQ ID NO: 5135954 - DNA, 14 bp, Homo sapiens
acagctatttaagg

SEQ ID NO: 5135955 - DNA, 17 bp, Homo sapiens
acagctcacctctgaag

SEQ ID NO: 5135956 - DNA, 21 bp, Homo sapiens
acagctcacggcagcctcaac

SEQ ID NO: 5135957 - DNA, 17 bp, Homo sapiens
acagctcactgcagcct

SEQ ID NO: 5135958 - DNA, 22 bp, Homo sapiens
acagctcactgcagcctcaacc

SEQ ID NO: 5135959 - DNA, 13 bp, Homo sapiens
acagctcaggctg

SEQ ID NO: 5135960 - DNA, 21 bp, Homo sapiens
acagctcagttctagtctctc

SEQ ID NO: 5135961 - DNA, 23 bp, Homo sapiens
acagctcagttctagtctctctg

SEQ ID NO: 5135962 - DNA, 20 bp, Homo sapiens
acagctccacacgccccggt

SEQ ID NO: 5135963 - DNA, 21 bp, Homo sapiens
acagctccagatgtttctcat

SEQ ID NO: 5135964 - DNA, 22 bp, Homo sapiens
acagctccagatgtttctcatt

SEQ ID NO: 5135965 - DNA, 16 bp, Homo sapiens
acagctccctctgcct

SEQ ID NO: 5135966 - DNA, 14 bp, Homo sapiens
acagctccctgcca

SEQ ID NO: 5135967 - DNA, 19 bp, Homo sapiens
acagctcccttccctgcag

SEQ ID NO: 5135968 - DNA, 20 bp, Homo sapiens
acagctccgagctgtaggag

SEQ ID NO: 5135969 - DNA, 22 bp, Homo sapiens
acagctccgcgctcggggctgg

SEQ ID NO: 5135970 - DNA, 19 bp, Homo sapiens
acagctcctccatgcctga

SEQ ID NO: 5135971 - DNA, 16 bp, Homo sapiens
acagctcctcccctgc

SEQ ID NO: 5135972 - DNA, 19 bp, Homo sapiens
acagctcctcccctgccgc

SEQ ID NO: 5135973 - DNA, 21 bp, Homo sapiens
acagctcctcctcttggagct

SEQ ID NO: 5135974 - DNA, 23 bp, Homo sapiens
acagctcctcctcttggagctga

SEQ ID NO: 5135975 - DNA, 14 bp, Homo sapiens
acagctcctgccag

SEQ ID NO: 5135976 - DNA, 16 bp, Homo sapiens
acagctcctggaccag

SEQ ID NO: 5135977 - DNA, 16 bp, Homo sapiens
acagctccttctgtcc

SEQ ID NO: 5135978 - DNA, 13 bp, Homo sapiens
acagctccttggg

SEQ ID NO: 5135979 - DNA, 21 bp, Homo sapiens
acagctccttgggaggaagca

SEQ ID NO: 5135980 - DNA, 14 bp, Homo sapiens
acagctccttgtga

SEQ ID NO: 5135981 - DNA, 21 bp, Homo sapiens
acagctccttttccagagcat

SEQ ID NO: 5135982 - DNA, 13 bp, Homo sapiens
acagctctagaca

SEQ ID NO: 5135983 - DNA, 18 bp, Homo sapiens
acagctctcactggccag

SEQ ID NO: 5135984 - DNA, 21 bp, Homo sapiens
acagctctcctccagccctgg

SEQ ID NO: 5135985 - DNA, 22 bp, Homo sapiens
acagctctcctccagccctggg

SEQ ID NO: 5135986 - DNA, 23 bp, Homo sapiens
acagctctcctccagccctgggc

SEQ ID NO: 5135987 - DNA, 16 bp, Homo sapiens
acagctctgagatcct

SEQ ID NO: 5135988 - DNA, 13 bp, Homo sapiens
acagctctgctgg

SEQ ID NO: 5135989 - DNA, 15 bp, Homo sapiens
acagctctggccaca

SEQ ID NO: 5135990 - DNA, 17 bp, Homo sapiens
acagctctgtgttgcca

SEQ ID NO: 5135991 - DNA, 17 bp, Homo sapiens
acagctcttcacaccat

SEQ ID NO: 5135992 - DNA, 19 bp, Homo sapiens
acagctcttcactcagcca

SEQ ID NO: 5135993 - DNA, 12 bp, Homo sapiens
acagctcttcat

SEQ ID NO: 5135994 - DNA, 13 bp, Homo sapiens
acagctcttcatt

SEQ ID NO: 5135995 - DNA, 15 bp, Homo sapiens
acagctcttcattcc

SEQ ID NO: 5135996 - DNA, 16 bp, Homo sapiens
acagctcttcattcca

SEQ ID NO: 5135997 - DNA, 18 bp, Homo sapiens
acagctcttccagggcag

SEQ ID NO: 5135998 - DNA, 14 bp, Homo sapiens
acagctcttctcag

SEQ ID NO: 5135999 - DNA, 20 bp, Homo sapiens
acagctcttggcattttcct

SEQ ID NO: 5136000 - DNA, 16 bp, Homo sapiens
acagctgaacagtgtt

SEQ ID NO: 5136001 - DNA, 16 bp, Homo sapiens
acagctgaagaaaatg

SEQ ID NO: 5136002 - DNA, 16 bp, Homo sapiens
acagctgaagagcaag

SEQ ID NO: 5136003 - DNA, 17 bp, Homo sapiens
acagctgaagagcaagg

SEQ ID NO: 5136004 - DNA, 19 bp, Homo sapiens
acagctgaagtcaaaatat

SEQ ID NO: 5136005 - DNA, 22 bp, Homo sapiens
acagctgaagtcaaaatatgta

SEQ ID NO: 5136006 - DNA, 22 bp, Homo sapiens
acagctgactgaatgcagaacg

SEQ ID NO: 5136007 - DNA, 19 bp, Homo sapiens
acagctgagagacttttaa

SEQ ID NO: 5136008 - DNA, 22 bp, Homo sapiens
acagctgagagacttttaatca

SEQ ID NO: 5136009 - DNA, 18 bp, Homo sapiens
acagctgagcacattctg

SEQ ID NO: 5136010 - DNA, 23 bp, Homo sapiens
acagctgagcacattctggctca

SEQ ID NO: 5136011 - DNA, 16 bp, Homo sapiens
acagctgaggtctctt

SEQ ID NO: 5136012 - DNA, 19 bp, Homo sapiens
acagctgagttatgatgta

SEQ ID NO: 5136013 - DNA, 18 bp, Homo sapiens
acagctgcaattccctgg

SEQ ID NO: 5136014 - DNA, 15 bp, Homo sapiens
acagctgcagagaca

SEQ ID NO: 5136015 - DNA, 17 bp, Homo sapiens
acagctgcagagacaga

SEQ ID NO: 5136016 - DNA, 12 bp, Homo sapiens
acagctgcagct

SEQ ID NO: 5136017 - DNA, 17 bp, Homo sapiens
acagctgcaggtgccca

SEQ ID NO: 5136018 - DNA, 15 bp, Homo sapiens
acagctgcattccag

SEQ ID NO: 5136019 - DNA, 17 bp, Homo sapiens
acagctgcattccagag

SEQ ID NO: 5136020 - DNA, 13 bp, Homo sapiens
acagctgcccaga

SEQ ID NO: 5136021 - DNA, 17 bp, Homo sapiens
acagctgcccagacaca

SEQ ID NO: 5136022 - DNA, 16 bp, Homo sapiens
acagctgccctagctg

SEQ ID NO: 5136023 - DNA, 16 bp, Homo sapiens
acagctgccctgctgc

SEQ ID NO: 5136024 - DNA, 23 bp, Homo sapiens
acagctgccctgctgccacagca

SEQ ID NO: 5136025 - DNA, 15 bp, Homo sapiens
acagctgccctggct

SEQ ID NO: 5136026 - DNA, 17 bp, Homo sapiens
acagctgccctggctgt

SEQ ID NO: 5136027 - DNA, 12 bp, Homo sapiens
acagctgcctcc

SEQ ID NO: 5136028 - DNA, 15 bp, Homo sapiens
acagctgcctccggg

SEQ ID NO: 5136029 - DNA, 18 bp, Homo sapiens
acataaactttataaatt

SEQ ID NO: 5136030 - DNA, 12 bp, Homo sapiens
acataaagaaat

SEQ ID NO: 5136031 - DNA, 20 bp, Homo sapiens
acataaagactaagtagccc

SEQ ID NO: 5136032 - DNA, 13 bp, Homo sapiens
acataaagactgt

SEQ ID NO: 5136033 - DNA, 17 bp, Homo sapiens
acataaagagagcccta

SEQ ID NO: 5136034 - DNA, 16 bp, Homo sapiens
acataaagccatgttt

SEQ ID NO: 5136035 - DNA, 14 bp, Homo sapiens
acataaaggaaaag

SEQ ID NO: 5136036 - DNA, 16 bp, Homo sapiens
acataaaggaaaagac

SEQ ID NO: 5136037 - DNA, 12 bp, Homo sapiens
acataaaggtat

SEQ ID NO: 5136038 - DNA, 21 bp, Homo sapiens
acataaaggtggtatgtgtgt

SEQ ID NO: 5136039 - DNA, 18 bp, Homo sapiens
acataaagtaaatgctac

SEQ ID NO: 5136040 - DNA, 18 bp, Homo sapiens
acataaagtcatcaaagt

SEQ ID NO: 5136041 - DNA, 13 bp, Homo sapiens
acataaataaaaa

SEQ ID NO: 5136042 - DNA, 23 bp, Homo sapiens
acataaataaattaaataaaata

SEQ ID NO: 5136043 - DNA, 16 bp, Homo sapiens
acataaatcacagaaa

SEQ ID NO: 5136044 - DNA, 15 bp, Homo sapiens
acataaatctgtctg

SEQ ID NO: 5136045 - DNA, 17 bp, Homo sapiens
acataaatctgtctgat

SEQ ID NO: 5136046 - DNA, 22 bp, Homo sapiens
acataaatctgtctgattctat

SEQ ID NO: 5136047 - DNA, 15 bp, Homo sapiens
acataaatgaaagaa

SEQ ID NO: 5136048 - DNA, 11 bp, Homo sapiens
acataaatgca

SEQ ID NO: 5136049 - DNA, 12 bp, Homo sapiens
acataaatgctc

SEQ ID NO: 5136050 - DNA, 13 bp, Homo sapiens
acataaattagag

SEQ ID NO: 5136051 - DNA, 12 bp, Homo sapiens
acataaattatg

SEQ ID NO: 5136052 - DNA, 17 bp, Homo sapiens
acataaattatgagatt

SEQ ID NO: 5136053 - DNA, 14 bp, Homo sapiens
acataaattccaga

SEQ ID NO: 5136054 - DNA, 16 bp, Homo sapiens
acataaattgtaattt

SEQ ID NO: 5136055 - DNA, 23 bp, Homo sapiens
acataaattgtaatttgggaaca

SEQ ID NO: 5136056 - DNA, 20 bp, Homo sapiens
acataaatttagtattttgt

SEQ ID NO: 5136057 - DNA, 11 bp, Homo sapiens
acataaatttt

SEQ ID NO: 5136058 - DNA, 20 bp, Homo sapiens
acataaattttaattcaaga

SEQ ID NO: 5136059 - DNA, 17 bp, Homo sapiens
acataacaaaatcactt

SEQ ID NO: 5136060 - DNA, 21 bp, Homo sapiens
acataacaaagggcagccctc

SEQ ID NO: 5136061 - DNA, 14 bp, Homo sapiens
acataacaaataac

SEQ ID NO: 5136062 - DNA, 17 bp, Homo sapiens
acataacaacaacagtt

SEQ ID NO: 5136063 - DNA, 14 bp, Homo sapiens
acataacaagaaaa

SEQ ID NO: 5136064 - DNA, 22 bp, Homo sapiens
acataacaccaaacttcatttt

SEQ ID NO: 5136065 - DNA, 14 bp, Homo sapiens
acataacaggcatt

SEQ ID NO: 5136066 - DNA, 16 bp, Homo sapiens
acataaccccttgaaa

SEQ ID NO: 5136067 - DNA, 18 bp, Homo sapiens
acataacctcagagtatc

SEQ ID NO: 5136068 - DNA, 14 bp, Homo sapiens
acataacgtttttc

SEQ ID NO: 5136069 - DNA, 18 bp, Homo sapiens
acataacgtttttccttt

SEQ ID NO: 5136070 - DNA, 21 bp, Homo sapiens
acataacgtttttcctttaaa

SEQ ID NO: 5136071 - DNA, 23 bp, Homo sapiens
acataacgtttttcctttaaaaa

SEQ ID NO: 5136072 - DNA, 13 bp, Homo sapiens
acataactaaatt

SEQ ID NO: 5136073 - DNA, 22 bp, Homo sapiens
acataactaaatttgatactta

SEQ ID NO: 5136074 - DNA, 23 bp, Homo sapiens
acataactaaatttgatacttat

SEQ ID NO: 5136075 - DNA, 21 bp, Homo sapiens
acataactcacacccctgccc

SEQ ID NO: 5136076 - DNA, 18 bp, Homo sapiens
acataactgacttagttc

SEQ ID NO: 5136077 - DNA, 22 bp, Homo sapiens
acataactgataattttaaaat

SEQ ID NO: 5136078 - DNA, 16 bp, Homo sapiens
acataactgcttcttg

SEQ ID NO: 5136079 - DNA, 21 bp, Homo sapiens
acataactgcttcttggagct

SEQ ID NO: 5136080 - DNA, 18 bp, Homo sapiens
acataactggattttgaa

SEQ ID NO: 5136081 - DNA, 13 bp, Homo sapiens
acataagaaatgt

SEQ ID NO: 5136082 - DNA, 14 bp, Homo sapiens
acataagaaatgta

SEQ ID NO: 5136083 - DNA, 12 bp, Homo sapiens
acataagaaggc

SEQ ID NO: 5136084 - DNA, 16 bp, Homo sapiens
acataagaaggcaatt

SEQ ID NO: 5136085 - DNA, 14 bp, Homo sapiens
acataagaccataa

SEQ ID NO: 5136086 - DNA, 23 bp, Homo sapiens
acataagagagatgagaaagctt

SEQ ID NO: 5136087 - DNA, 15 bp, Homo sapiens
acataagataaatgt

SEQ ID NO: 5136088 - DNA, 16 bp, Homo sapiens
acataagataaatgtg

SEQ ID NO: 5136089 - DNA, 23 bp, Homo sapiens
acataagctaaatcatattagta

SEQ ID NO: 5136090 - DNA, 17 bp, Homo sapiens
acataagctagaaaaat

SEQ ID NO: 5136091 - DNA, 20 bp, Homo sapiens
acataagctagaaaaattag

SEQ ID NO: 5136092 - DNA, 17 bp, Homo sapiens
acataagctatttttct

SEQ ID NO: 5136093 - DNA, 19 bp, Homo sapiens
acataagctatttttctaa

SEQ ID NO: 5136094 - DNA, 14 bp, Homo sapiens
acataagctcagaa

SEQ ID NO: 5136095 - DNA, 22 bp, Homo sapiens
acataagctggtatcagtggtt

SEQ ID NO: 5136096 - DNA, 15 bp, Homo sapiens
acataagcttccatt

SEQ ID NO: 5136097 - DNA, 23 bp, Homo sapiens
acataaggcttttcctgttctgg

SEQ ID NO: 5136098 - DNA, 16 bp, Homo sapiens
acataagtaactttta

SEQ ID NO: 5136099 - DNA, 23 bp, Homo sapiens
acataagtaacttttaaaatttg

SEQ ID NO: 5136100 - DNA, 15 bp, Homo sapiens
acataagtaattcaa

SEQ ID NO: 5136101 - DNA, 20 bp, Homo sapiens
acataagtatttaattcatg

SEQ ID NO: 5136102 - DNA, 18 bp, Homo sapiens
acataagtccattaactg

SEQ ID NO: 5136103 - DNA, 15 bp, Homo sapiens
acataagtcctttca

SEQ ID NO: 5136104 - DNA, 21 bp, Homo sapiens
acataagtcctttcaattcca

SEQ ID NO: 5136105 - DNA, 20 bp, Homo sapiens
acataagttaatagaaagtt

SEQ ID NO: 5136106 - DNA, 16 bp, Homo sapiens
acataagttgcattta

SEQ ID NO: 5136107 - DNA, 14 bp, Homo sapiens
acataagttttctc

SEQ ID NO: 5136108 - DNA, 14 bp, Homo sapiens
acataataaattaa

SEQ ID NO: 5136109 - DNA, 15 bp, Homo sapiens
acataatacattcca

SEQ ID NO: 5136110 - DNA, 20 bp, Homo sapiens
acataataccaccatttaaa

SEQ ID NO: 5136111 - DNA, 14 bp, Homo sapiens
acataatactgaac

SEQ ID NO: 5136112 - DNA, 16 bp, Homo sapiens
acataatactgaacca

SEQ ID NO: 5136113 - DNA, 15 bp, Homo sapiens
acataatagaatttc

SEQ ID NO: 5136114 - DNA, 16 bp, Homo sapiens
acataatagaatttcc

SEQ ID NO: 5136115 - DNA, 18 bp, Homo sapiens
acataatataagaatcat

SEQ ID NO: 5136116 - DNA, 16 bp, Homo sapiens
acataatatatgactt

SEQ ID NO: 5136117 - DNA, 15 bp, Homo sapiens
acataatatcttgaa

SEQ ID NO: 5136118 - DNA, 21 bp, Homo sapiens
acataatcttaaactcttgaa

SEQ ID NO: 5136119 - DNA, 18 bp, Homo sapiens
acataatgcttaatttct

SEQ ID NO: 5136120 - DNA, 22 bp, Homo sapiens
acataatggaaaacatttacat

SEQ ID NO: 5136121 - DNA, 20 bp, Homo sapiens
acataatgggccactgaaat

SEQ ID NO: 5136122 - DNA, 22 bp, Homo sapiens
acataatgggccactgaaatct

SEQ ID NO: 5136123 - DNA, 21 bp, Homo sapiens
acataatggtactcccaaact

SEQ ID NO: 5136124 - DNA, 21 bp, Homo sapiens
acataatgtttttcctttctt

SEQ ID NO: 5136125 - DNA, 21 bp, Homo sapiens
acataattatttctaacacta

SEQ ID NO: 5136126 - DNA, 16 bp, Homo sapiens
acataattcactctga

SEQ ID NO: 5136127 - DNA, 17 bp, Homo sapiens
acataattcactctgag

SEQ ID NO: 5136128 - DNA, 20 bp, Homo sapiens
acataattcactctgagtgt

SEQ ID NO: 5136129 - DNA, 13 bp, Homo sapiens
acataattcttat

SEQ ID NO: 5136130 - DNA, 14 bp, Homo sapiens
acataattcttcct

SEQ ID NO: 5136131 - DNA, 21 bp, Homo sapiens
acataattcttccttccctcc

SEQ ID NO: 5136132 - DNA, 12 bp, Homo sapiens
acataattgatt

SEQ ID NO: 5136133 - DNA, 21 bp, Homo sapiens
acataattgattaaaatctct

SEQ ID NO: 5136134 - DNA, 13 bp, Homo sapiens
acataattgtgac

SEQ ID NO: 5136135 - DNA, 15 bp, Homo sapiens
acataattgtggatt

SEQ ID NO: 5136136 - DNA, 21 bp, Homo sapiens
acataatttaaaataaataaa

SEQ ID NO: 5136137 - DNA, 18 bp, Homo sapiens
acataatttagttgtttc

SEQ ID NO: 5136138 - DNA, 12 bp, Homo sapiens
acataatttcag

SEQ ID NO: 5136139 - DNA, 20 bp, Homo sapiens
acataatttcagtgggaaat

SEQ ID NO: 5136140 - DNA, 22 bp, Homo sapiens
acataatttgcataaagggccc

SEQ ID NO: 5136141 - DNA, 22 bp, Homo sapiens
acataattttttttttctcact

SEQ ID NO: 5136142 - DNA, 21 bp, Homo sapiens
acatacaaaaaaaatctttaa

SEQ ID NO: 5136143 - DNA, 18 bp, Homo sapiens
acatacaaatatatgtat

SEQ ID NO: 5136144 - DNA, 14 bp, Homo sapiens
acatacaagaaaat

SEQ ID NO: 5136145 - DNA, 22 bp, Homo sapiens
acatacaattatttttacagtt

SEQ ID NO: 5136146 - DNA, 16 bp, Homo sapiens
acatacaattccaaac

SEQ ID NO: 5136147 - DNA, 13 bp, Homo sapiens
acatacaatttac

SEQ ID NO: 5136148 - DNA, 12 bp, Homo sapiens
acatacaatttg

SEQ ID NO: 5136149 - DNA, 15 bp, Homo sapiens
acatacacaaatggg

SEQ ID NO: 5136150 - DNA, 13 bp, Homo sapiens
acatacacacacg

SEQ ID NO: 5136151 - DNA, 16 bp, Homo sapiens
acatacacatacatac

SEQ ID NO: 5136152 - DNA, 15 bp, Homo sapiens
acatacaccagcatt

SEQ ID NO: 5136153 - DNA, 12 bp, Homo sapiens
acatacactgca

SEQ ID NO: 5136154 - DNA, 20 bp, Homo sapiens
acatacagaattactgtaac

SEQ ID NO: 5136155 - DNA, 17 bp, Homo sapiens
acatacagagctctctg

SEQ ID NO: 5136156 - DNA, 14 bp, Homo sapiens
acatacagatttta

SEQ ID NO: 5136157 - DNA, 20 bp, Homo sapiens
acatacaggaaggtagaaat

SEQ ID NO: 5136158 - DNA, 16 bp, Homo sapiens
acatacaggagagctg

SEQ ID NO: 5136159 - DNA, 19 bp, Homo sapiens
acatacaggagagctgcag

SEQ ID NO: 5136160 - DNA, 16 bp, Homo sapiens
acatacagtgatatgg

SEQ ID NO: 5136161 - DNA, 15 bp, Homo sapiens
acatacagttttatg

SEQ ID NO: 5136162 - DNA, 20 bp, Homo sapiens
acatacagttttatgctctt

SEQ ID NO: 5136163 - DNA, 14 bp, Homo sapiens
acatacatatatat

SEQ ID NO: 5136164 - DNA, 15 bp, Homo sapiens
acatacatatatatc

SEQ ID NO: 5136165 - DNA, 15 bp, Homo sapiens
acatacatctaagtc

SEQ ID NO: 5136166 - DNA, 17 bp, Homo sapiens
acatacatgatacattt

SEQ ID NO: 5136167 - DNA, 17 bp, Homo sapiens
acatacatgctactttt

SEQ ID NO: 5136168 - DNA, 10 bp, Homo sapiens
acatacatta

SEQ ID NO: 5136169 - DNA, 18 bp, Homo sapiens
acatacattggttttgaa

SEQ ID NO: 5136170 - DNA, 21 bp, Homo sapiens
acataccaagacccccgtctc

SEQ ID NO: 5136171 - DNA, 20 bp, Homo sapiens
acataccacacttaaaagat

SEQ ID NO: 5136172 - DNA, 15 bp, Homo sapiens
acataccagcttaga

SEQ ID NO: 5136173 - DNA, 21 bp, Homo sapiens
acataccaggcaacctcccat

SEQ ID NO: 5136174 - DNA, 22 bp, Homo sapiens
acataccaggcaacctcccatc

SEQ ID NO: 5136175 - DNA, 13 bp, Homo sapiens
acataccatctgt

SEQ ID NO: 5136176 - DNA, 15 bp, Homo sapiens
acataccccactggg

SEQ ID NO: 5136177 - DNA, 23 bp, Homo sapiens
acataccccactgggcacacgca

SEQ ID NO: 5136178 - DNA, 18 bp, Homo sapiens
acataccccttacaaatg

SEQ ID NO: 5136179 - DNA, 22 bp, Homo sapiens
acatacccgcctagctgctgtc

SEQ ID NO: 5136180 - DNA, 16 bp, Homo sapiens
acataccctgacctgg

SEQ ID NO: 5136181 - DNA, 20 bp, Homo sapiens
acataccggggctcctctcc

SEQ ID NO: 5136182 - DNA, 19 bp, Homo sapiens
acatacctaccagtattat

SEQ ID NO: 5136183 - DNA, 20 bp, Homo sapiens
acatacctctctctatatat

SEQ ID NO: 5136184 - DNA, 13 bp, Homo sapiens
acatacctctctg

SEQ ID NO: 5136185 - DNA, 20 bp, Homo sapiens
acatacctgggtatgtgtag

SEQ ID NO: 5136186 - DNA, 18 bp, Homo sapiens
acataccttagactgaaa

SEQ ID NO: 5136187 - DNA, 16 bp, Homo sapiens
acataccttttatttt

SEQ ID NO: 5136188 - DNA, 15 bp, Homo sapiens
acatacgatttaagg

SEQ ID NO: 5136189 - DNA, 13 bp, Homo sapiens
acatacgtgcaca

SEQ ID NO: 5136190 - DNA, 16 bp, Homo sapiens
acatacgtgtctgtgt

SEQ ID NO: 5136191 - DNA, 24 bp, Homo sapiens
acatacgtgttaggaggctgcatg

SEQ ID NO: 5136192 - DNA, 17 bp, Homo sapiens
acatacgtgttctatag

SEQ ID NO: 5136193 - DNA, 21 bp, Homo sapiens
acatactaaccagcagaaatg

SEQ ID NO: 5136194 - DNA, 17 bp, Homo sapiens
acatactatagattctt

SEQ ID NO: 5136195 - DNA, 22 bp, Homo sapiens
acatactcaggataacagagaa

SEQ ID NO: 5136196 - DNA, 13 bp, Homo sapiens
acatactcatttg

SEQ ID NO: 5136197 - DNA, 19 bp, Homo sapiens
acatactctctgcctggtg

SEQ ID NO: 5136198 - DNA, 20 bp, Homo sapiens
acatactctctgcctggtgg

SEQ ID NO: 5136199 - DNA, 19 bp, Homo sapiens
acatactggcctggactgt

SEQ ID NO: 5136200 - DNA, 16 bp, Homo sapiens
acatactggctggtga

SEQ ID NO: 5136201 - DNA, 10 bp, Homo sapiens
acatactgtc

SEQ ID NO: 5136202 - DNA, 17 bp, Homo sapiens
acatactgtgttccaat

SEQ ID NO: 5136203 - DNA, 23 bp, Homo sapiens
acatactgttctcaacatactgt

SEQ ID NO: 5136204 - DNA, 17 bp, Homo sapiens
acatacttacatttcag

SEQ ID NO: 5136205 - DNA, 19 bp, Homo sapiens
acatacttcaaaaataatg

SEQ ID NO: 5136206 - DNA, 22 bp, Homo sapiens
acatacttcatcgcagtggact

SEQ ID NO: 5136207 - DNA, 23 bp, Homo sapiens
acatacttcatcgcagtggactg

SEQ ID NO: 5136208 - DNA, 17 bp, Homo sapiens
acatacttgaagggcca

SEQ ID NO: 5136209 - DNA, 16 bp, Homo sapiens
acatactttacagtaa

SEQ ID NO: 5136210 - DNA, 22 bp, Homo sapiens
acatactttcatcctgactctg

SEQ ID NO: 5136211 - DNA, 12 bp, Homo sapiens
acatacttttgc

SEQ ID NO: 5136212 - DNA, 13 bp, Homo sapiens
acatacttttgca

SEQ ID NO: 5136213 - DNA, 15 bp, Homo sapiens
acatacttttgcaaa

SEQ ID NO: 5136214 - DNA, 20 bp, Homo sapiens
acatacttttgctttcagta

SEQ ID NO: 5136215 - DNA, 16 bp, Homo sapiens
acatagaaacatacac

SEQ ID NO: 5136216 - DNA, 17 bp, Homo sapiens
acatagaaacatacaca

SEQ ID NO: 5136217 - DNA, 18 bp, Homo sapiens
acatagaaacatacacaa

SEQ ID NO: 5136218 - DNA, 12 bp, Homo sapiens
acatagaaagtt

SEQ ID NO: 5136219 - DNA, 14 bp, Homo sapiens
acatagaacacttc

SEQ ID NO: 5136220 - DNA, 12 bp, Homo sapiens
acatagacattt

SEQ ID NO: 5136221 - DNA, 16 bp, Homo sapiens
acatagacatttcaaa

SEQ ID NO: 5136222 - DNA, 18 bp, Homo sapiens
acatagacatttcaaaat

SEQ ID NO: 5136223 - DNA, 14 bp, Homo sapiens
acatagactgaaga

SEQ ID NO: 5136224 - DNA, 20 bp, Homo sapiens
acatagactttatgcaataa

SEQ ID NO: 5136225 - DNA, 22 bp, Homo sapiens
acatagactttatgcaataaat

SEQ ID NO: 5136226 - DNA, 19 bp, Homo sapiens
acatagagaactgtcaccc

SEQ ID NO: 5136227 - DNA, 17 bp, Homo sapiens
acatagagctttttaat

SEQ ID NO: 5136228 - DNA, 18 bp, Homo sapiens
acatagaggtatattgga

SEQ ID NO: 5136229 - DNA, 16 bp, Homo sapiens
acatagatattttcac

SEQ ID NO: 5136230 - DNA, 17 bp, Homo sapiens
acatagatcagccatta

SEQ ID NO: 5136231 - DNA, 22 bp, Homo sapiens
acatagatcagccattaaaata

SEQ ID NO: 5136232 - DNA, 17 bp, Homo sapiens
acatagatgcctgggcc

SEQ ID NO: 5136233 - DNA, 21 bp, Homo sapiens
acatagatgcctgggcctgat

SEQ ID NO: 5136234 - DNA, 15 bp, Homo sapiens
acatagatggaccag

SEQ ID NO: 5136235 - DNA, 19 bp, Homo sapiens
acatagatgtatcattaat

SEQ ID NO: 5136236 - DNA, 21 bp, Homo sapiens
acatagatgtatcattaatgt

SEQ ID NO: 5136237 - DNA, 23 bp, Homo sapiens
acatagatgtatcattaatgtag

SEQ ID NO: 5136238 - DNA, 19 bp, Homo sapiens
acatagattaatggcactg

SEQ ID NO: 5136239 - DNA, 19 bp, Homo sapiens
acatagattcacctgtaaa

SEQ ID NO: 5136240 - DNA, 20 bp, Homo sapiens
acatagattcacctgtaaaa

SEQ ID NO: 5136241 - DNA, 13 bp, Homo sapiens
acatagcacagta

SEQ ID NO: 5136242 - DNA, 16 bp, Homo sapiens
acatagcagctggtta

SEQ ID NO: 5136243 - DNA, 19 bp, Homo sapiens
acatagcatgacatttctt

SEQ ID NO: 5136244 - DNA, 20 bp, Homo sapiens
acatagcatgcttcctttct

SEQ ID NO: 5136245 - DNA, 16 bp, Homo sapiens
acatagcccaagaaca

SEQ ID NO: 5136246 - DNA, 16 bp, Homo sapiens
acatagcccctgcccc

SEQ ID NO: 5136247 - DNA, 17 bp, Homo sapiens
acatagccctaactcct

SEQ ID NO: 5136248 - DNA, 20 bp, Homo sapiens
acatagccctggtgctcctg

SEQ ID NO: 5136249 - DNA, 14 bp, Homo sapiens
acatagccctgttg

SEQ ID NO: 5136250 - DNA, 20 bp, Homo sapiens
acatagccgattctctgccc

SEQ ID NO: 5136251 - DNA, 17 bp, Homo sapiens
acatagcctatatttac

SEQ ID NO: 5136252 - DNA, 13 bp, Homo sapiens
acatagcctttgt

SEQ ID NO: 5136253 - DNA, 19 bp, Homo sapiens
acatagcgaatacaaaatt

SEQ ID NO: 5136254 - DNA, 23 bp, Homo sapiens
acatagcgccgtgctgtaaataa

SEQ ID NO: 5136255 - DNA, 22 bp, Homo sapiens
acatagctacccaaaagagaaa

SEQ ID NO: 5136256 - DNA, 19 bp, Homo sapiens
acatagctatcaagtgtgc

SEQ ID NO: 5136257 - DNA, 15 bp, Homo sapiens
acatagcttgagcta

SEQ ID NO: 5136258 - DNA, 22 bp, Homo sapiens
acatagcttgataaagggccaa

SEQ ID NO: 5136259 - DNA, 21 bp, Homo sapiens
acatagctttagagaagccat

SEQ ID NO: 5136260 - DNA, 13 bp, Homo sapiens
acataggaaggga

SEQ ID NO: 5136261 - DNA, 21 bp, Homo sapiens
acataggaagggatctgagaa

SEQ ID NO: 5136262 - DNA, 20 bp, Homo sapiens
acataggaatatgactcagg

SEQ ID NO: 5136263 - DNA, 20 bp, Homo sapiens
acataggtaggtatctttat

SEQ ID NO: 5136264 - DNA, 21 bp, Homo sapiens
acataggtaggtatctttata

SEQ ID NO: 5136265 - DNA, 17 bp, Homo sapiens
acataggtcataaagca

SEQ ID NO: 5136266 - DNA, 20 bp, Homo sapiens
acataggtgctcttcctcat

SEQ ID NO: 5136267 - DNA, 23 bp, Homo sapiens
acataggttttgatttatatgtg

SEQ ID NO: 5136268 - DNA, 21 bp, Homo sapiens
acataggtttttaaagactag

SEQ ID NO: 5136269 - DNA, 21 bp, Homo sapiens
acatagtaagaccccatctct

SEQ ID NO: 5136270 - DNA, 22 bp, Homo sapiens
acatagtaagttcagcacttgt

SEQ ID NO: 5136271 - DNA, 21 bp, Homo sapiens
acatagtaattcttaagtctt

SEQ ID NO: 5136272 - DNA, 15 bp, Homo sapiens
acatagtattatgtc

SEQ ID NO: 5136273 - DNA, 16 bp, Homo sapiens
acatagtattatgtca

SEQ ID NO: 5136274 - DNA, 14 bp, Homo sapiens
acatagtcctcagg

SEQ ID NO: 5136275 - DNA, 15 bp, Homo sapiens
acatagtctgttcct

SEQ ID NO: 5136276 - DNA, 13 bp, Homo sapiens
acatagtgaaaat

SEQ ID NO: 5136277 - DNA, 15 bp, Homo sapiens
acatagtgaatttta

SEQ ID NO: 5136278 - DNA, 22 bp, Homo sapiens
acatagtgaattttaaaatgta

SEQ ID NO: 5136279 - DNA, 17 bp, Homo sapiens
acatagtggatggacag

SEQ ID NO: 5136280 - DNA, 19 bp, Homo sapiens
acatagtggatggacagat

SEQ ID NO: 5136281 - DNA, 20 bp, Homo sapiens
acatagtggatggacagatg

SEQ ID NO: 5136282 - DNA, 21 bp, Homo sapiens
acatagtggatggacagatgg

SEQ ID NO: 5136283 - DNA, 14 bp, Homo sapiens
acatagtggtattt

SEQ ID NO: 5136284 - DNA, 17 bp, Homo sapiens
acatagtggtattttaa

SEQ ID NO: 5136285 - DNA, 18 bp, Homo sapiens
acatagtggtattttaac

SEQ ID NO: 5136286 - DNA, 22 bp, Homo sapiens
acatagtggtattttaacatag

SEQ ID NO: 5136287 - DNA, 15 bp, Homo sapiens
acatagtggtcattt

SEQ ID NO: 5136288 - DNA, 16 bp, Homo sapiens
acatagtgtcctgccc

SEQ ID NO: 5136289 - DNA, 20 bp, Homo sapiens
acatagtgtcctgcccaccc

SEQ ID NO: 5136290 - DNA, 15 bp, Homo sapiens
acatagttatttatt

SEQ ID NO: 5136291 - DNA, 21 bp, Homo sapiens
acatagttgaaaaaagaagtt

SEQ ID NO: 5136292 - DNA, 19 bp, Homo sapiens
acatagtttcttttttaat

SEQ ID NO: 5136293 - DNA, 20 bp, Homo sapiens
acatagttttaaactcattt

SEQ ID NO: 5136294 - DNA, 13 bp, Homo sapiens
acatataaaaaca

SEQ ID NO: 5136295 - DNA, 21 bp, Homo sapiens
acatataaaaacaatatattt

SEQ ID NO: 5136296 - DNA, 15 bp, Homo sapiens
acatataaaactgtt

SEQ ID NO: 5136297 - DNA, 12 bp, Homo sapiens
acatataaaagt

SEQ ID NO: 5136298 - DNA, 19 bp, Homo sapiens
acatataaacacagtaaga

SEQ ID NO: 5136299 - DNA, 20 bp, Homo sapiens
acatataaacatcacacaca

SEQ ID NO: 5136300 - DNA, 17 bp, Homo sapiens
acatataagttgagaag

SEQ ID NO: 5136301 - DNA, 23 bp, Homo sapiens
acatataatgttgttatttaaag

SEQ ID NO: 5136302 - DNA, 14 bp, Homo sapiens
acatatacacacac

SEQ ID NO: 5136303 - DNA, 15 bp, Homo sapiens
acatatacacacaca

SEQ ID NO: 5136304 - DNA, 14 bp, Homo sapiens
acatatacacattt

SEQ ID NO: 5136305 - DNA, 13 bp, Homo sapiens
acatatacatact

SEQ ID NO: 5136306 - DNA, 13 bp, Homo sapiens
acatatacatata

SEQ ID NO: 5136307 - DNA, 15 bp, Homo sapiens
acatatacatatata

SEQ ID NO: 5136308 - DNA, 16 bp, Homo sapiens
acatatacatatatat

SEQ ID NO: 5136309 - DNA, 13 bp, Homo sapiens
acatatacattat

SEQ ID NO: 5136310 - DNA, 22 bp, Homo sapiens
acatatacattatttctgtata

SEQ ID NO: 5136311 - DNA, 20 bp, Homo sapiens
acatataccacccatagtgc

SEQ ID NO: 5136312 - DNA, 16 bp, Homo sapiens
acatatacctataatg

SEQ ID NO: 5136313 - DNA, 19 bp, Homo sapiens
acatatacctataatgtgt

SEQ ID NO: 5136314 - DNA, 16 bp, Homo sapiens
acatatagctttgcaa

SEQ ID NO: 5136315 - DNA, 15 bp, Homo sapiens
acatatataaaacta

SEQ ID NO: 5136316 - DNA, 13 bp, Homo sapiens
acatatatacata

SEQ ID NO: 5136317 - DNA, 13 bp, Homo sapiens
acatatatacatt

SEQ ID NO: 5136318 - DNA, 22 bp, Homo sapiens
acatatatatatacacatacat

SEQ ID NO: 5136319 - DNA, 16 bp, Homo sapiens
acatatatatatataa

SEQ ID NO: 5136320 - DNA, 23 bp, Homo sapiens
acatatatatatatttttttttg

SEQ ID NO: 5136321 - DNA, 20 bp, Homo sapiens
acatatatatattttttaat

SEQ ID NO: 5136322 - DNA, 13 bp, Homo sapiens
acatatatatctg

SEQ ID NO: 5136323 - DNA, 14 bp, Homo sapiens
acatatatattaca

SEQ ID NO: 5136324 - DNA, 13 bp, Homo sapiens
acatatatctgat

SEQ ID NO: 5136325 - DNA, 17 bp, Homo sapiens
acatatatgtataatat

SEQ ID NO: 5136326 - DNA, 22 bp, Homo sapiens
acatatatgtatacgcacgcac

SEQ ID NO: 5136327 - DNA, 17 bp, Homo sapiens
acatatattatatatag

SEQ ID NO: 5136328 - DNA, 20 bp, Homo sapiens
acatatattatatatagaaa

SEQ ID NO: 5136329 - DNA, 21 bp, Homo sapiens
acatatattatatatagaaaa

SEQ ID NO: 5136330 - DNA, 18 bp, Homo sapiens
acatatattttattttca

SEQ ID NO: 5136331 - DNA, 21 bp, Homo sapiens
acatatatttttaaaaaatga

SEQ ID NO: 5136332 - DNA, 22 bp, Homo sapiens
acatatatttttaaaaaatgaa

SEQ ID NO: 5136333 - DNA, 17 bp, Homo sapiens
acatatattttttacaa

SEQ ID NO: 5136334 - DNA, 14 bp, Homo sapiens
acatatcaaatgaa

SEQ ID NO: 5136335 - DNA, 16 bp, Homo sapiens
acatatcactgctgct

SEQ ID NO: 5136336 - DNA, 15 bp, Homo sapiens
acatatcagaaaagt

SEQ ID NO: 5136337 - DNA, 20 bp, Homo sapiens
acatatcagaaaagtagaat

SEQ ID NO: 5136338 - DNA, 22 bp, Homo sapiens
acatatcagaaaagtagaatta

SEQ ID NO: 5136339 - DNA, 15 bp, Homo sapiens
acatatcagacttca

SEQ ID NO: 5136340 - DNA, 18 bp, Homo sapiens
acatatcagacttcacca

SEQ ID NO: 5136341 - DNA, 21 bp, Homo sapiens
acatatcagtcgtgtcaccag

SEQ ID NO: 5136342 - DNA, 15 bp, Homo sapiens
acatatcatgtgtga

SEQ ID NO: 5136343 - DNA, 17 bp, Homo sapiens
acatatcattcagaatg

SEQ ID NO: 5136344 - DNA, 12 bp, Homo sapiens
acatatcatttg

SEQ ID NO: 5136345 - DNA, 15 bp, Homo sapiens
acatatcccttccag

SEQ ID NO: 5136346 - DNA, 14 bp, Homo sapiens
acatatctaaagtc

SEQ ID NO: 5136347 - DNA, 23 bp, Homo sapiens
acatatctacacttcgcaccgga

SEQ ID NO: 5136348 - DNA, 20 bp, Homo sapiens
acatatctagtatgaaatta

SEQ ID NO: 5136349 - DNA, 19 bp, Homo sapiens
acatatctcttatcttacg

SEQ ID NO: 5136350 - DNA, 17 bp, Homo sapiens
acatatcttacagccag

SEQ ID NO: 5136351 - DNA, 15 bp, Homo sapiens
acatatctttattaa

SEQ ID NO: 5136352 - DNA, 12 bp, Homo sapiens
acatatgaaaaa

SEQ ID NO: 5136353 - DNA, 22 bp, Homo sapiens
acatatgaatgcagcactgctg

SEQ ID NO: 5136354 - DNA, 21 bp, Homo sapiens
acatatgagaatataccttat

SEQ ID NO: 5136355 - DNA, 19 bp, Homo sapiens
acatatgagtgtggaagcc

SEQ ID NO: 5136356 - DNA, 17 bp, Homo sapiens
acatatgatctgtctgt

SEQ ID NO: 5136357 - DNA, 18 bp, Homo sapiens
acatatgatctgtctgtg

SEQ ID NO: 5136358 - DNA, 19 bp, Homo sapiens
acatatgatctgtctgtgg

SEQ ID NO: 5136359 - DNA, 15 bp, Homo sapiens
acatatgattctctt

SEQ ID NO: 5136360 - DNA, 15 bp, Homo sapiens
acatatgcacagggg

SEQ ID NO: 5136361 - DNA, 16 bp, Homo sapiens
acatatgcaccttgtg

SEQ ID NO: 5136362 - DNA, 12 bp, Homo sapiens
acatatgcagtg

SEQ ID NO: 5136363 - DNA, 19 bp, Homo sapiens
acatatgctgatcttttaa

SEQ ID NO: 5136364 - DNA, 23 bp, Homo sapiens
acatatgctgatcttttaaaatc

SEQ ID NO: 5136365 - DNA, 17 bp, Homo sapiens
acatatggaaatgttac

SEQ ID NO: 5136366 - DNA, 22 bp, Homo sapiens
acatatggaaatgttactgtct

SEQ ID NO: 5136367 - DNA, 15 bp, Homo sapiens
acatatgggtgctgg

SEQ ID NO: 5136368 - DNA, 16 bp, Homo sapiens
acatatgggtgctggc

SEQ ID NO: 5136369 - DNA, 13 bp, Homo sapiens
acatatgtaaaat

SEQ ID NO: 5136370 - DNA, 14 bp, Homo sapiens
acatatgtaaaata

SEQ ID NO: 5136371 - DNA, 16 bp, Homo sapiens
acatatgtaaacataa

SEQ ID NO: 5136372 - DNA, 18 bp, Homo sapiens
acatatgtaacagtcaaa

SEQ ID NO: 5136373 - DNA, 16 bp, Homo sapiens
acatatgtacataaat

SEQ ID NO: 5136374 - DNA, 16 bp, Homo sapiens
acatatgtagaaacat

SEQ ID NO: 5136375 - DNA, 19 bp, Homo sapiens
acatatgtagaaacattta

SEQ ID NO: 5136376 - DNA, 17 bp, Homo sapiens
acatatgtagactatat

SEQ ID NO: 5136377 - DNA, 23 bp, Homo sapiens
acatatgtagatattgttttctg

SEQ ID NO: 5136378 - DNA, 14 bp, Homo sapiens
acatatgtatcttt

SEQ ID NO: 5136379 - DNA, 13 bp, Homo sapiens
acatatgtatgtg

SEQ ID NO: 5136380 - DNA, 22 bp, Homo sapiens
acatatgtatgtgtgagtgtat

SEQ ID NO: 5136381 - DNA, 17 bp, Homo sapiens
acatatgtattaagcca

SEQ ID NO: 5136382 - DNA, 23 bp, Homo sapiens
acatatgtattaagccaaacatg

SEQ ID NO: 5136383 - DNA, 20 bp, Homo sapiens
acatatgtcacgaacttgaa

SEQ ID NO: 5136384 - DNA, 18 bp, Homo sapiens
acatatgtccatccatat

SEQ ID NO: 5136385 - DNA, 21 bp, Homo sapiens
acatatgtctgtctttgcaaa

SEQ ID NO: 5136386 - DNA, 14 bp, Homo sapiens
acagctgcctcttc

SEQ ID NO: 5136387 - DNA, 11 bp, Homo sapiens
acagctgcctt

SEQ ID NO: 5136388 - DNA, 20 bp, Homo sapiens
acagctgccttagcttcagg

SEQ ID NO: 5136389 - DNA, 21 bp, Homo sapiens
acagctgctcaataaagtaca

SEQ ID NO: 5136390 - DNA, 15 bp, Homo sapiens
acagctgctcagagc

SEQ ID NO: 5136391 - DNA, 11 bp, Homo sapiens
acagctgcttc

SEQ ID NO: 5136392 - DNA, 16 bp, Homo sapiens
acagctgcttctcccc

SEQ ID NO: 5136393 - DNA, 19 bp, Homo sapiens
acagctgcttctcccccca

SEQ ID NO: 5136394 - DNA, 22 bp, Homo sapiens
acagctgcttctccccccatcc

SEQ ID NO: 5136395 - DNA, 13 bp, Homo sapiens
acagctgcttctg

SEQ ID NO: 5136396 - DNA, 17 bp, Homo sapiens
acagctgcttctgtgca

SEQ ID NO: 5136397 - DNA, 18 bp, Homo sapiens
acagctgcttgtcctgct

SEQ ID NO: 5136398 - DNA, 21 bp, Homo sapiens
acagctgcttgtcctgctctc

SEQ ID NO: 5136399 - DNA, 21 bp, Homo sapiens
acagctggacacccccttggt

SEQ ID NO: 5136400 - DNA, 23 bp, Homo sapiens
acagctggacccatttgccagga

SEQ ID NO: 5136401 - DNA, 16 bp, Homo sapiens
acagctggaccctgct

SEQ ID NO: 5136402 - DNA, 16 bp, Homo sapiens
acagctggagaaatgg

SEQ ID NO: 5136403 - DNA, 20 bp, Homo sapiens
acagctggagacgatcttgc

SEQ ID NO: 5136404 - DNA, 13 bp, Homo sapiens
acagctggatctg

SEQ ID NO: 5136405 - DNA, 13 bp, Homo sapiens
acagctggccacc

SEQ ID NO: 5136406 - DNA, 12 bp, Homo sapiens
acagctggcctg

SEQ ID NO: 5136407 - DNA, 22 bp, Homo sapiens
acagctggctagcattcctcag

SEQ ID NO: 5136408 - DNA, 19 bp, Homo sapiens
acagctggctctgacaaga

SEQ ID NO: 5136409 - DNA, 15 bp, Homo sapiens
acagctggctgctga

SEQ ID NO: 5136410 - DNA, 16 bp, Homo sapiens
acagctggctgctgac

SEQ ID NO: 5136411 - DNA, 17 bp, Homo sapiens
acagctggctgctgaca

SEQ ID NO: 5136412 - DNA, 13 bp, Homo sapiens
acagctggctggg

SEQ ID NO: 5136413 - DNA, 22 bp, Homo sapiens
acagctggctgggccttcacca

SEQ ID NO: 5136414 - DNA, 12 bp, Homo sapiens
acagctggggcc

SEQ ID NO: 5136415 - DNA, 16 bp, Homo sapiens
acagctggggtgcagg

SEQ ID NO: 5136416 - DNA, 13 bp, Homo sapiens
acagctggtgcca

SEQ ID NO: 5136417 - DNA, 18 bp, Homo sapiens
acagctggtgcttagttt

SEQ ID NO: 5136418 - DNA, 11 bp, Homo sapiens
acagctggtgt

SEQ ID NO: 5136419 - DNA, 19 bp, Homo sapiens
acagctggtgtagctacag

SEQ ID NO: 5136420 - DNA, 21 bp, Homo sapiens
acagctggtgtagctacagag

SEQ ID NO: 5136421 - DNA, 23 bp, Homo sapiens
acagctggtgtagctacagagaa

SEQ ID NO: 5136422 - DNA, 19 bp, Homo sapiens
acagctgtatgattcccag

SEQ ID NO: 5136423 - DNA, 15 bp, Homo sapiens
acagctgtccctgtc

SEQ ID NO: 5136424 - DNA, 18 bp, Homo sapiens
acagctgtccctgtcacc

SEQ ID NO: 5136425 - DNA, 12 bp, Homo sapiens
acagctgtctgc

SEQ ID NO: 5136426 - DNA, 20 bp, Homo sapiens
acagctgtgagccatgcctc

SEQ ID NO: 5136427 - DNA, 16 bp, Homo sapiens
acagctgtgcctcgct

SEQ ID NO: 5136428 - DNA, 17 bp, Homo sapiens
acagctgtgctccacac

SEQ ID NO: 5136429 - DNA, 21 bp, Homo sapiens
acagctgtgctgtaacacaag

SEQ ID NO: 5136430 - DNA, 13 bp, Homo sapiens
acagctgtgtctg

SEQ ID NO: 5136431 - DNA, 22 bp, Homo sapiens
acagctgtgtctgccaaacaca

SEQ ID NO: 5136432 - DNA, 23 bp, Homo sapiens
acagctgtgtgacatttggagag

SEQ ID NO: 5136433 - DNA, 19 bp, Homo sapiens
acagctgtttaagatgggc

SEQ ID NO: 5136434 - DNA, 18 bp, Homo sapiens
acagcttacaggagccag

SEQ ID NO: 5136435 - DNA, 16 bp, Homo sapiens
acagcttagatttcat

SEQ ID NO: 5136436 - DNA, 18 bp, Homo sapiens
acagcttagatttcatag

SEQ ID NO: 5136437 - DNA, 13 bp, Homo sapiens
acagcttagtgag

SEQ ID NO: 5136438 - DNA, 20 bp, Homo sapiens
acagcttatggggtatttta

SEQ ID NO: 5136439 - DNA, 17 bp, Homo sapiens
acagcttcacttaaaat

SEQ ID NO: 5136440 - DNA, 13 bp, Homo sapiens
acagcttcagcta

SEQ ID NO: 5136441 - DNA, 13 bp, Homo sapiens
acagcttcaggtt

SEQ ID NO: 5136442 - DNA, 23 bp, Homo sapiens
acagcttcattatctgagttgca

SEQ ID NO: 5136443 - DNA, 19 bp, Homo sapiens
acagcttcatttcctgtgt

SEQ ID NO: 5136444 - DNA, 21 bp, Homo sapiens
acagcttcatttcctgtgtct

SEQ ID NO: 5136445 - DNA, 21 bp, Homo sapiens
acagcttcattttatttttga

SEQ ID NO: 5136446 - DNA, 20 bp, Homo sapiens
acagcttcccctctctcctc

SEQ ID NO: 5136447 - DNA, 15 bp, Homo sapiens
acagcttcctgtccc

SEQ ID NO: 5136448 - DNA, 22 bp, Homo sapiens
acagcttcctgtccccatctgt

SEQ ID NO: 5136449 - DNA, 18 bp, Homo sapiens
acagcttcctttcctgtg

SEQ ID NO: 5136450 - DNA, 13 bp, Homo sapiens
acagcttctccaa

SEQ ID NO: 5136451 - DNA, 13 bp, Homo sapiens
acagcttctctgc

SEQ ID NO: 5136452 - DNA, 15 bp, Homo sapiens
acagcttctctgcag

SEQ ID NO: 5136453 - DNA, 13 bp, Homo sapiens
acagcttctgaga

SEQ ID NO: 5136454 - DNA, 13 bp, Homo sapiens
acagcttcttctg

SEQ ID NO: 5136455 - DNA, 14 bp, Homo sapiens
acagcttcttctgc

SEQ ID NO: 5136456 - DNA, 21 bp, Homo sapiens
acagcttcttgcttgtaaaaa

SEQ ID NO: 5136457 - DNA, 15 bp, Homo sapiens
acagcttgaccagac

SEQ ID NO: 5136458 - DNA, 16 bp, Homo sapiens
acagcttgaccagacc

SEQ ID NO: 5136459 - DNA, 17 bp, Homo sapiens
acagcttgaccagacct

SEQ ID NO: 5136460 - DNA, 23 bp, Homo sapiens
acagcttgaccgtgaggccagag

SEQ ID NO: 5136461 - DNA, 15 bp, Homo sapiens
acagcttgacctgag

SEQ ID NO: 5136462 - DNA, 17 bp, Homo sapiens
acagcttgacctgaggc

SEQ ID NO: 5136463 - DNA, 22 bp, Homo sapiens
acagcttgacctgaggctgtgg

SEQ ID NO: 5136464 - DNA, 16 bp, Homo sapiens
acagcttgactgcttt

SEQ ID NO: 5136465 - DNA, 18 bp, Homo sapiens
acagcttgatgctgtttc

SEQ ID NO: 5136466 - DNA, 23 bp, Homo sapiens
acagcttgggtcaggttcttgcc

SEQ ID NO: 5136467 - DNA, 21 bp, Homo sapiens
acagcttgtctcttgcctgcc

SEQ ID NO: 5136468 - DNA, 23 bp, Homo sapiens
acagcttgtctcttgcctgccac

SEQ ID NO: 5136469 - DNA, 15 bp, Homo sapiens
acagcttgtgaatgt

SEQ ID NO: 5136470 - DNA, 15 bp, Homo sapiens
acagctttcaagtgc

SEQ ID NO: 5136471 - DNA, 15 bp, Homo sapiens
acagctttcctgggt

SEQ ID NO: 5136472 - DNA, 18 bp, Homo sapiens
acagctttcctgggtgag

SEQ ID NO: 5136473 - DNA, 14 bp, Homo sapiens
acagctttctccag

SEQ ID NO: 5136474 - DNA, 15 bp, Homo sapiens
acagctttctccaga

SEQ ID NO: 5136475 - DNA, 16 bp, Homo sapiens
acagctttctccagaa

SEQ ID NO: 5136476 - DNA, 19 bp, Homo sapiens
acagctttctgaccttcag

SEQ ID NO: 5136477 - DNA, 22 bp, Homo sapiens
acagctttctgaccttcagctc

SEQ ID NO: 5136478 - DNA, 19 bp, Homo sapiens
acagctttctgggatgtca

SEQ ID NO: 5136479 - DNA, 20 bp, Homo sapiens
acagctttcttattcagtga

SEQ ID NO: 5136480 - DNA, 17 bp, Homo sapiens
acagctttgataatgtc

SEQ ID NO: 5136481 - DNA, 15 bp, Homo sapiens
acagctttgctgctg

SEQ ID NO: 5136482 - DNA, 21 bp, Homo sapiens
acagctttgctgctgaaggct

SEQ ID NO: 5136483 - DNA, 18 bp, Homo sapiens
acagctttgtatgtttat

SEQ ID NO: 5136484 - DNA, 12 bp, Homo sapiens
acagctttgtct

SEQ ID NO: 5136485 - DNA, 19 bp, Homo sapiens
acagctttgtctccaaaga

SEQ ID NO: 5136486 - DNA, 19 bp, Homo sapiens
acagctttgtttctgcatc

SEQ ID NO: 5136487 - DNA, 23 bp, Homo sapiens
acagcttttagtacccacctgag

SEQ ID NO: 5136488 - DNA, 17 bp, Homo sapiens
acagcttttatggatga

SEQ ID NO: 5136489 - DNA, 18 bp, Homo sapiens
acagcttttatggatgat

SEQ ID NO: 5136490 - DNA, 14 bp, Homo sapiens
acagcttttccaaa

SEQ ID NO: 5136491 - DNA, 17 bp, Homo sapiens
acagcttttcccaggag

SEQ ID NO: 5136492 - DNA, 20 bp, Homo sapiens
acagcttttcccaggagacc

SEQ ID NO: 5136493 - DNA, 21 bp, Homo sapiens
acagcttttgcaacttaatac

SEQ ID NO: 5136494 - DNA, 23 bp, Homo sapiens
acagcttttttagaggtgagttt

SEQ ID NO: 5136495 - DNA, 20 bp, Homo sapiens
acaggaaaaaaaattctgtt

SEQ ID NO: 5136496 - DNA, 14 bp, Homo sapiens
acaggaaaaaaact

SEQ ID NO: 5136497 - DNA, 16 bp, Homo sapiens
acaggaaaaaaacttt

SEQ ID NO: 5136498 - DNA, 12 bp, Homo sapiens
acaggaaaaagt

SEQ ID NO: 5136499 - DNA, 22 bp, Homo sapiens
acaggaaaatgtatccagagga

SEQ ID NO: 5136500 - DNA, 23 bp, Homo sapiens
acaggaaaatgtatccagaggaa

SEQ ID NO: 5136501 - DNA, 20 bp, Homo sapiens
acaggaaaattttaaaaata

SEQ ID NO: 5136502 - DNA, 20 bp, Homo sapiens
acaggaaactcctgtgacca

SEQ ID NO: 5136503 - DNA, 21 bp, Homo sapiens
acaggaaagagctaggaaccc

SEQ ID NO: 5136504 - DNA, 17 bp, Homo sapiens
acaggaaagagtcacac

SEQ ID NO: 5136505 - DNA, 17 bp, Homo sapiens
acaggaaagccctcccc

SEQ ID NO: 5136506 - DNA, 22 bp, Homo sapiens
acaggaaagggaaggccccaca

SEQ ID NO: 5136507 - DNA, 14 bp, Homo sapiens
acaggaacacacag

SEQ ID NO: 5136508 - DNA, 17 bp, Homo sapiens
acaggaacacccagccc

SEQ ID NO: 5136509 - DNA, 20 bp, Homo sapiens
acaggaacacccagccccag

SEQ ID NO: 5136510 - DNA, 13 bp, Homo sapiens
acaggaacccatc

SEQ ID NO: 5136511 - DNA, 18 bp, Homo sapiens
acaggaacccatcactgt

SEQ ID NO: 5136512 - DNA, 21 bp, Homo sapiens
acaggaacggccctgcaggag

SEQ ID NO: 5136513 - DNA, 23 bp, Homo sapiens
acaggaactctgtgtgagagaga

SEQ ID NO: 5136514 - DNA, 13 bp, Homo sapiens
acaggaagaccaa

SEQ ID NO: 5136515 - DNA, 13 bp, Homo sapiens
acaggaagactgg

SEQ ID NO: 5136516 - DNA, 10 bp, Homo sapiens
acaggaagat

SEQ ID NO: 5136517 - DNA, 15 bp, Homo sapiens
acaggaagatattgg

SEQ ID NO: 5136518 - DNA, 22 bp, Homo sapiens
acaggaagatgggaggtggaag

SEQ ID NO: 5136519 - DNA, 15 bp, Homo sapiens
acaggaagcacccca

SEQ ID NO: 5136520 - DNA, 21 bp, Homo sapiens
acaggaagcccaaggcagtgt

SEQ ID NO: 5136521 - DNA, 23 bp, Homo sapiens
acaggaagcccaaggcagtgttc

SEQ ID NO: 5136522 - DNA, 15 bp, Homo sapiens
acaggaagcctcaag

SEQ ID NO: 5136523 - DNA, 16 bp, Homo sapiens
acaggaagcctcaagt

SEQ ID NO: 5136524 - DNA, 16 bp, Homo sapiens
acaggaagctcagcct

SEQ ID NO: 5136525 - DNA, 17 bp, Homo sapiens
acaggaagctcagcctt

SEQ ID NO: 5136526 - DNA, 13 bp, Homo sapiens
acaggaaggaagc

SEQ ID NO: 5136527 - DNA, 23 bp, Homo sapiens
acaggaaggaagcacaaaagaca

SEQ ID NO: 5136528 - DNA, 22 bp, Homo sapiens
acaggaaggaggggagagacag

SEQ ID NO: 5136529 - DNA, 16 bp, Homo sapiens
acaggaaggcaggagg

SEQ ID NO: 5136530 - DNA, 18 bp, Homo sapiens
acaggaaggtgcctggcc

SEQ ID NO: 5136531 - DNA, 13 bp, Homo sapiens
acaggaagtactg

SEQ ID NO: 5136532 - DNA, 17 bp, Homo sapiens
acaggaagtcttcaggg

SEQ ID NO: 5136533 - DNA, 15 bp, Homo sapiens
acaggaatgaagaac

SEQ ID NO: 5136534 - DNA, 22 bp, Homo sapiens
acaggaattattaggagtaatt

SEQ ID NO: 5136535 - DNA, 14 bp, Homo sapiens
acaggaatttctgt

SEQ ID NO: 5136536 - DNA, 22 bp, Homo sapiens
acaggaatttctgttagcaata

SEQ ID NO: 5136537 - DNA, 18 bp, Homo sapiens
acaggaattttattttgc

SEQ ID NO: 5136538 - DNA, 18 bp, Homo sapiens
acaggacaaagggaggga

SEQ ID NO: 5136539 - DNA, 16 bp, Homo sapiens
acaggacacagtcaga

SEQ ID NO: 5136540 - DNA, 17 bp, Homo sapiens
acaggacacctggccgc

SEQ ID NO: 5136541 - DNA, 14 bp, Homo sapiens
acaggacagaatgt

SEQ ID NO: 5136542 - DNA, 18 bp, Homo sapiens
acaggacagagttcacag

SEQ ID NO: 5136543 - DNA, 22 bp, Homo sapiens
acaggacagtgcttcagcctga

SEQ ID NO: 5136544 - DNA, 15 bp, Homo sapiens
acaggacatggatga

SEQ ID NO: 5136545 - DNA, 14 bp, Homo sapiens
acaggaccagattt

SEQ ID NO: 5136546 - DNA, 15 bp, Homo sapiens
acaggaccccagctc

SEQ ID NO: 5136547 - DNA, 17 bp, Homo sapiens
acaggaccccagctctg

SEQ ID NO: 5136548 - DNA, 17 bp, Homo sapiens
acaggacccccttcccc

SEQ ID NO: 5136549 - DNA, 16 bp, Homo sapiens
acaggacccctgcagt

SEQ ID NO: 5136550 - DNA, 20 bp, Homo sapiens
acaggacccctgcagttccc

SEQ ID NO: 5136551 - DNA, 14 bp, Homo sapiens
acaggaccctcagg

SEQ ID NO: 5136552 - DNA, 21 bp, Homo sapiens
acaggacgctgaccgtggagc

SEQ ID NO: 5136553 - DNA, 21 bp, Homo sapiens
acaggactaacactcagaagc

SEQ ID NO: 5136554 - DNA, 22 bp, Homo sapiens
acaggactaacactcagaagcc

SEQ ID NO: 5136555 - DNA, 15 bp, Homo sapiens
acaggactctgcctc

SEQ ID NO: 5136556 - DNA, 24 bp, Homo sapiens
acaggactgagccctctcactcca

SEQ ID NO: 5136557 - DNA, 23 bp, Homo sapiens
acaggactgattctgggatgctc

SEQ ID NO: 5136558 - DNA, 11 bp, Homo sapiens
acaggagaaat

SEQ ID NO: 5136559 - DNA, 21 bp, Homo sapiens
acaggagaatggggttcctgc

SEQ ID NO: 5136560 - DNA, 22 bp, Homo sapiens
acaggagaatggggttcctgct

SEQ ID NO: 5136561 - DNA, 15 bp, Homo sapiens
acaggagacaaaaga

SEQ ID NO: 5136562 - DNA, 14 bp, Homo sapiens
acaggagacactgt

SEQ ID NO: 5136563 - DNA, 13 bp, Homo sapiens
acaggagacatta

SEQ ID NO: 5136564 - DNA, 12 bp, Homo sapiens
acatatgtctta

SEQ ID NO: 5136565 - DNA, 14 bp, Homo sapiens
acatatgtcttact

SEQ ID NO: 5136566 - DNA, 19 bp, Homo sapiens
acatatgtcttactacttt

SEQ ID NO: 5136567 - DNA, 21 bp, Homo sapiens
acatatgtgctggaattctaa

SEQ ID NO: 5136568 - DNA, 21 bp, Homo sapiens
acatattaaaggttctgaaaa

SEQ ID NO: 5136569 - DNA, 22 bp, Homo sapiens
acatattaagaatagtctctgg

SEQ ID NO: 5136570 - DNA, 20 bp, Homo sapiens
acatattagtgcagccaagt

SEQ ID NO: 5136571 - DNA, 15 bp, Homo sapiens
acatattataaataa

SEQ ID NO: 5136572 - DNA, 22 bp, Homo sapiens
acatattataaataaatgccaa

SEQ ID NO: 5136573 - DNA, 12 bp, Homo sapiens
acatattatcat

SEQ ID NO: 5136574 - DNA, 14 bp, Homo sapiens
acatattatgtctt

SEQ ID NO: 5136575 - DNA, 20 bp, Homo sapiens
acatattcaaagcagcagcc

SEQ ID NO: 5136576 - DNA, 18 bp, Homo sapiens
acatattcaaagtatata

SEQ ID NO: 5136577 - DNA, 22 bp, Homo sapiens
acatattcaaagtatatacaga

SEQ ID NO: 5136578 - DNA, 21 bp, Homo sapiens
acatattcaaggagcaagaaa

SEQ ID NO: 5136579 - DNA, 23 bp, Homo sapiens
acatattcaagtgataggataaa

SEQ ID NO: 5136580 - DNA, 14 bp, Homo sapiens
acatattcatcagc

SEQ ID NO: 5136581 - DNA, 22 bp, Homo sapiens
acatattcccatggtagactgt

SEQ ID NO: 5136582 - DNA, 16 bp, Homo sapiens
acatattgatttccgt

SEQ ID NO: 5136583 - DNA, 18 bp, Homo sapiens
acatattgatttccgtta

SEQ ID NO: 5136584 - DNA, 20 bp, Homo sapiens
acatattgcaggagacattt

SEQ ID NO: 5136585 - DNA, 22 bp, Homo sapiens
acatattgcaggagacattttc

SEQ ID NO: 5136586 - DNA, 20 bp, Homo sapiens
acatattggagggaaatctt

SEQ ID NO: 5136587 - DNA, 23 bp, Homo sapiens
acatattgttagggtcagccatt

SEQ ID NO: 5136588 - DNA, 12 bp, Homo sapiens
acatatttaatg

SEQ ID NO: 5136589 - DNA, 14 bp, Homo sapiens
acatatttaatgtt

SEQ ID NO: 5136590 - DNA, 16 bp, Homo sapiens
acatatttaatgtttt

SEQ ID NO: 5136591 - DNA, 17 bp, Homo sapiens
acatatttatagtttaa

SEQ ID NO: 5136592 - DNA, 19 bp, Homo sapiens
acatatttatataacgtga

SEQ ID NO: 5136593 - DNA, 19 bp, Homo sapiens
acatatttatttttacctg

SEQ ID NO: 5136594 - DNA, 19 bp, Homo sapiens
acatatttcataagcacat

SEQ ID NO: 5136595 - DNA, 12 bp, Homo sapiens
acatatttcatt

SEQ ID NO: 5136596 - DNA, 23 bp, Homo sapiens
acatatttgtatgtttttctgta

SEQ ID NO: 5136597 - DNA, 15 bp, Homo sapiens
acatatttgtggaat

SEQ ID NO: 5136598 - DNA, 16 bp, Homo sapiens
acatatttgtggaata

SEQ ID NO: 5136599 - DNA, 19 bp, Homo sapiens
acatatttgtggaataatg

SEQ ID NO: 5136600 - DNA, 20 bp, Homo sapiens
acatatttgttaaatattta

SEQ ID NO: 5136601 - DNA, 13 bp, Homo sapiens
acatattttacat

SEQ ID NO: 5136602 - DNA, 18 bp, Homo sapiens
acatattttcctttagat

SEQ ID NO: 5136603 - DNA, 19 bp, Homo sapiens
acatattttttatatctgg

SEQ ID NO: 5136604 - DNA, 22 bp, Homo sapiens
acatattttttatatctggaat

SEQ ID NO: 5136605 - DNA, 14 bp, Homo sapiens
acatcaaaacttaa

SEQ ID NO: 5136606 - DNA, 16 bp, Homo sapiens
acatcaaaacttaaga

SEQ ID NO: 5136607 - DNA, 17 bp, Homo sapiens
acatcaaacctttgagt

SEQ ID NO: 5136608 - DNA, 19 bp, Homo sapiens
acatcaaactcaatgcttt

SEQ ID NO: 5136609 - DNA, 20 bp, Homo sapiens
acatcaaactcaatgcttta

SEQ ID NO: 5136610 - DNA, 14 bp, Homo sapiens
acatcaaagactcc

SEQ ID NO: 5136611 - DNA, 14 bp, Homo sapiens
acatcaaagcctgg

SEQ ID NO: 5136612 - DNA, 20 bp, Homo sapiens
acatcaaagtggtaaatact

SEQ ID NO: 5136613 - DNA, 13 bp, Homo sapiens
acatcaaataaga

SEQ ID NO: 5136614 - DNA, 14 bp, Homo sapiens
acatcaaataagaa

SEQ ID NO: 5136615 - DNA, 18 bp, Homo sapiens
acatcaaataagaaataa

SEQ ID NO: 5136616 - DNA, 17 bp, Homo sapiens
acatcaaatatttcttg

SEQ ID NO: 5136617 - DNA, 14 bp, Homo sapiens
acatcaaatgcccc

SEQ ID NO: 5136618 - DNA, 17 bp, Homo sapiens
acatcaaatttgccacc

SEQ ID NO: 5136619 - DNA, 16 bp, Homo sapiens
acatcaacatcttggt

SEQ ID NO: 5136620 - DNA, 17 bp, Homo sapiens
acatcaacctggcaaaa

SEQ ID NO: 5136621 - DNA, 19 bp, Homo sapiens
acatcaactttatgtagca

SEQ ID NO: 5136622 - DNA, 16 bp, Homo sapiens
acatcaagaaaacagc

SEQ ID NO: 5136623 - DNA, 17 bp, Homo sapiens
acatcaagaaaacagca

SEQ ID NO: 5136624 - DNA, 18 bp, Homo sapiens
acatcaagactatctaca

SEQ ID NO: 5136625 - DNA, 11 bp, Homo sapiens
acatcaagata

SEQ ID NO: 5136626 - DNA, 14 bp, Homo sapiens
acatcaagcacaga

SEQ ID NO: 5136627 - DNA, 12 bp, Homo sapiens
acatcaagcatc

SEQ ID NO: 5136628 - DNA, 21 bp, Homo sapiens
acatcaagcatgcaataatgt

SEQ ID NO: 5136629 - DNA, 19 bp, Homo sapiens
acatcaagtccatctgaca

SEQ ID NO: 5136630 - DNA, 11 bp, Homo sapiens
acatcaagtgt

SEQ ID NO: 5136631 - DNA, 16 bp, Homo sapiens
acatcaagtgtaatta

SEQ ID NO: 5136632 - DNA, 19 bp, Homo sapiens
acatcaataatattgtata

SEQ ID NO: 5136633 - DNA, 18 bp, Homo sapiens
acatcaatattgtcattc

SEQ ID NO: 5136634 - DNA, 23 bp, Homo sapiens
acatcaatattgtcattcctgta

SEQ ID NO: 5136635 - DNA, 17 bp, Homo sapiens
acatcaatggctttgta

SEQ ID NO: 5136636 - DNA, 14 bp, Homo sapiens
acatcaatgttcat

SEQ ID NO: 5136637 - DNA, 18 bp, Homo sapiens
acatcaatgttcattgta

SEQ ID NO: 5136638 - DNA, 18 bp, Homo sapiens
acatcacacccatttaaa

SEQ ID NO: 5136639 - DNA, 13 bp, Homo sapiens
acatcacagcaga

SEQ ID NO: 5136640 - DNA, 17 bp, Homo sapiens
acatcacagcagaatga

SEQ ID NO: 5136641 - DNA, 13 bp, Homo sapiens
acatcacagcagc

SEQ ID NO: 5136642 - DNA, 14 bp, Homo sapiens
acatcacagcagcc

SEQ ID NO: 5136643 - DNA, 21 bp, Homo sapiens
acatcacagggcctcagtttc

SEQ ID NO: 5136644 - DNA, 18 bp, Homo sapiens
acatcacagggtgggcct

SEQ ID NO: 5136645 - DNA, 16 bp, Homo sapiens
acatcacatcttattt

SEQ ID NO: 5136646 - DNA, 17 bp, Homo sapiens
acatcacatttaaattg

SEQ ID NO: 5136647 - DNA, 16 bp, Homo sapiens
acatcaccaagtgtgg

SEQ ID NO: 5136648 - DNA, 20 bp, Homo sapiens
acatcaccaagtgtggaatt

SEQ ID NO: 5136649 - DNA, 16 bp, Homo sapiens
acatcaccaggtgcat

SEQ ID NO: 5136650 - DNA, 13 bp, Homo sapiens
acatcaccagtcc

SEQ ID NO: 5136651 - DNA, 21 bp, Homo sapiens
acatcaccctatatataattt

SEQ ID NO: 5136652 - DNA, 21 bp, Homo sapiens
acatcaccgacgcgtctcctg

SEQ ID NO: 5136653 - DNA, 23 bp, Homo sapiens
acatcaccgacgcgtctcctgtt

SEQ ID NO: 5136654 - DNA, 17 bp, Homo sapiens
acatcactaatttggct

SEQ ID NO: 5136655 - DNA, 18 bp, Homo sapiens
acatcactacaaaaagaa

SEQ ID NO: 5136656 - DNA, 14 bp, Homo sapiens
acatcactatcaat

SEQ ID NO: 5136657 - DNA, 20 bp, Homo sapiens
acatcactatcaattttaag

SEQ ID NO: 5136658 - DNA, 19 bp, Homo sapiens
acatcactctcaccttcca

SEQ ID NO: 5136659 - DNA, 16 bp, Homo sapiens
acatcactctgctgct

SEQ ID NO: 5136660 - DNA, 19 bp, Homo sapiens
acatcactctgctgcttag

SEQ ID NO: 5136661 - DNA, 12 bp, Homo sapiens
acatcactggca

SEQ ID NO: 5136662 - DNA, 14 bp, Homo sapiens
acatcactgtatac

SEQ ID NO: 5136663 - DNA, 17 bp, Homo sapiens
acatcactgttcatgct

SEQ ID NO: 5136664 - DNA, 12 bp, Homo sapiens
acatcacttcct

SEQ ID NO: 5136665 - DNA, 13 bp, Homo sapiens
acatcacttcctg

SEQ ID NO: 5136666 - DNA, 22 bp, Homo sapiens
acatcacttcctgttttaagca

SEQ ID NO: 5136667 - DNA, 15 bp, Homo sapiens
acatcacttgtacaa

SEQ ID NO: 5136668 - DNA, 16 bp, Homo sapiens
acatcactttgtgaat

SEQ ID NO: 5136669 - DNA, 14 bp, Homo sapiens
acatcagaaaataa

SEQ ID NO: 5136670 - DNA, 15 bp, Homo sapiens
acatcagaaaataaa

SEQ ID NO: 5136671 - DNA, 15 bp, Homo sapiens
acatcagaaaggaat

SEQ ID NO: 5136672 - DNA, 21 bp, Homo sapiens
acatcagaagtaactcccact

SEQ ID NO: 5136673 - DNA, 22 bp, Homo sapiens
acatcagaagtaactcccactc

SEQ ID NO: 5136674 - DNA, 18 bp, Homo sapiens
acatcagaagtttgcatc

SEQ ID NO: 5136675 - DNA, 20 bp, Homo sapiens
acatcagactctagaaaaaa

SEQ ID NO: 5136676 - DNA, 20 bp, Homo sapiens
acatcagagtgtatttttgt

SEQ ID NO: 5136677 - DNA, 12 bp, Homo sapiens
acatcagataag

SEQ ID NO: 5136678 - DNA, 19 bp, Homo sapiens
acatcagatttcttaatgt

SEQ ID NO: 5136679 - DNA, 21 bp, Homo sapiens
acatcagatttcttaatgtct

SEQ ID NO: 5136680 - DNA, 12 bp, Homo sapiens
acatcagcaaac

SEQ ID NO: 5136681 - DNA, 18 bp, Homo sapiens
acatcagcacgatttctg

SEQ ID NO: 5136682 - DNA, 20 bp, Homo sapiens
acatcagcacgatttctgtt

SEQ ID NO: 5136683 - DNA, 22 bp, Homo sapiens
acatcagcacgatttctgttta

SEQ ID NO: 5136684 - DNA, 19 bp, Homo sapiens
acatcagcactttaccaga

SEQ ID NO: 5136685 - DNA, 24 bp, Homo sapiens
acatcagcatgttttctgctttaa

SEQ ID NO: 5136686 - DNA, 16 bp, Homo sapiens
acatcagcattgtctc

SEQ ID NO: 5136687 - DNA, 16 bp, Homo sapiens
acatcagccagctgcc

SEQ ID NO: 5136688 - DNA, 18 bp, Homo sapiens
acatcagccatttttaga

SEQ ID NO: 5136689 - DNA, 15 bp, Homo sapiens
acatcagctgaattc

SEQ ID NO: 5136690 - DNA, 12 bp, Homo sapiens
acatcagcttga

SEQ ID NO: 5136691 - DNA, 18 bp, Homo sapiens
acatcaggagactgggct

SEQ ID NO: 5136692 - DNA, 23 bp, Homo sapiens
acatcaggagactgggctctggc

SEQ ID NO: 5136693 - DNA, 14 bp, Homo sapiens
acatcaggagttca

SEQ ID NO: 5136694 - DNA, 20 bp, Homo sapiens
acatcagggcggcctcccag

SEQ ID NO: 5136695 - DNA, 23 bp, Homo sapiens
acatcagggcggcctcccaggtc

SEQ ID NO: 5136696 - DNA, 18 bp, Homo sapiens
acatcaggtgatccacct

SEQ ID NO: 5136697 - DNA, 20 bp, Homo sapiens
acatcaggtgatccacctgc

SEQ ID NO: 5136698 - DNA, 19 bp, Homo sapiens
acatcagtagcatttttct

SEQ ID NO: 5136699 - DNA, 17 bp, Homo sapiens
acatcagtgaggaggga

SEQ ID NO: 5136700 - DNA, 19 bp, Homo sapiens
acatcagtgaggagggatg

SEQ ID NO: 5136701 - DNA, 20 bp, Homo sapiens
acatcagtgaggagggatgt

SEQ ID NO: 5136702 - DNA, 20 bp, Homo sapiens
acatcagtggcatggctcca

SEQ ID NO: 5136703 - DNA, 20 bp, Homo sapiens
acatcagtgtctgtttcaga

SEQ ID NO: 5136704 - DNA, 19 bp, Homo sapiens
acatcagtgtttgttggat

SEQ ID NO: 5136705 - DNA, 23 bp, Homo sapiens
acatcagtttgatacagtattga

SEQ ID NO: 5136706 - DNA, 13 bp, Homo sapiens
acatcataaatct

SEQ ID NO: 5136707 - DNA, 16 bp, Homo sapiens
acatcataaggtttta

SEQ ID NO: 5136708 - DNA, 20 bp, Homo sapiens
acatcataaggttttattca

SEQ ID NO: 5136709 - DNA, 16 bp, Homo sapiens
acatcataattacatt

SEQ ID NO: 5136710 - DNA, 18 bp, Homo sapiens
acatcataattacattcc

SEQ ID NO: 5136711 - DNA, 16 bp, Homo sapiens
acatcatacttaactt

SEQ ID NO: 5136712 - DNA, 14 bp, Homo sapiens
acatcatagtttct

SEQ ID NO: 5136713 - DNA, 23 bp, Homo sapiens
acatcatatgttagatacacaaa

SEQ ID NO: 5136714 - DNA, 20 bp, Homo sapiens
acatcatattctattgttta

SEQ ID NO: 5136715 - DNA, 19 bp, Homo sapiens
acatcatcactttttttga

SEQ ID NO: 5136716 - DNA, 13 bp, Homo sapiens
acatcatctgtaa

SEQ ID NO: 5136717 - DNA, 19 bp, Homo sapiens
acatcatctgtaagctgtt

SEQ ID NO: 5136718 - DNA, 20 bp, Homo sapiens
acatcatctgtaagctgttt

SEQ ID NO: 5136719 - DNA, 19 bp, Homo sapiens
acatcatctttatctcctg

SEQ ID NO: 5136720 - DNA, 21 bp, Homo sapiens
acatcatctttatctcctggg

SEQ ID NO: 5136721 - DNA, 18 bp, Homo sapiens
acatcatgcattcacaag

SEQ ID NO: 5136722 - DNA, 15 bp, Homo sapiens
acatcatggaccaaa

SEQ ID NO: 5136723 - DNA, 17 bp, Homo sapiens
acatcatggaccaaatg

SEQ ID NO: 5136724 - DNA, 13 bp, Homo sapiens
acatcatgtaaga

SEQ ID NO: 5136725 - DNA, 20 bp, Homo sapiens
acatcatgtaagatggcaac

SEQ ID NO: 5136726 - DNA, 13 bp, Homo sapiens
acatcatgttact

SEQ ID NO: 5136727 - DNA, 15 bp, Homo sapiens
acatcattactataa

SEQ ID NO: 5136728 - DNA, 14 bp, Homo sapiens
acatcattattgta

SEQ ID NO: 5136729 - DNA, 18 bp, Homo sapiens
acatcattattgtagttt

SEQ ID NO: 5136730 - DNA, 15 bp, Homo sapiens
acatcattcatgaca

SEQ ID NO: 5136731 - DNA, 19 bp, Homo sapiens
acatcattcatgacaacat

SEQ ID NO: 5136732 - DNA, 22 bp, Homo sapiens
acatcattcatgacaacatgaa

SEQ ID NO: 5136733 - DNA, 16 bp, Homo sapiens
acatcattcattcact

SEQ ID NO: 5136734 - DNA, 24 bp, Homo sapiens
acatcattcattcactgtatagta

SEQ ID NO: 5136735 - DNA, 15 bp, Homo sapiens
acatcattcattttt

SEQ ID NO: 5136736 - DNA, 14 bp, Homo sapiens
acatcattctgtgt

SEQ ID NO: 5136737 - DNA, 19 bp, Homo sapiens
acatcattggataaatttg

SEQ ID NO: 5136738 - DNA, 19 bp, Homo sapiens
acatcattgtattaacgca

SEQ ID NO: 5136739 - DNA, 17 bp, Homo sapiens
acatcattgtcagcctt

SEQ ID NO: 5136740 - DNA, 14 bp, Homo sapiens
acatcatttcaaga

SEQ ID NO: 5136741 - DNA, 14 bp, Homo sapiens
acatcatttcaatc

SEQ ID NO: 5136742 - DNA, 21 bp, Homo sapiens
acatcatttctttttgggaga

SEQ ID NO: 5136743 - DNA, 13 bp, Homo sapiens
acatcatttggga

SEQ ID NO: 5136744 - DNA, 17 bp, Homo sapiens
acatcattttgttttcc

SEQ ID NO: 5136745 - DNA, 15 bp, Homo sapiens
acatccaaagcagac

SEQ ID NO: 5136746 - DNA, 14 bp, Homo sapiens
acatccaagccaga

SEQ ID NO: 5136747 - DNA, 15 bp, Homo sapiens
acatccaagccagag

SEQ ID NO: 5136748 - DNA, 13 bp, Homo sapiens
acatccaagcttc

SEQ ID NO: 5136749 - DNA, 13 bp, Homo sapiens
acatccaaggaga

SEQ ID NO: 5136750 - DNA, 22 bp, Homo sapiens
acatccaaggagaaacagagac

SEQ ID NO: 5136751 - DNA, 15 bp, Homo sapiens
acatccacatgctct

SEQ ID NO: 5136752 - DNA, 15 bp, Homo sapiens
acatccaccccagcc

SEQ ID NO: 5136753 - DNA, 13 bp, Homo sapiens
acatccactgttt

SEQ ID NO: 5136754 - DNA, 20 bp, Homo sapiens
acatccagcagtccaaggta

SEQ ID NO: 5136755 - DNA, 14 bp, Homo sapiens
acatccagctcctc

SEQ ID NO: 5136756 - DNA, 17 bp, Homo sapiens
acatccagctcctctag

SEQ ID NO: 5136757 - DNA, 16 bp, Homo sapiens
acatccagctgcccct

SEQ ID NO: 5136758 - DNA, 23 bp, Homo sapiens
acatccagctgcccctccctcag

SEQ ID NO: 5136759 - DNA, 17 bp, Homo sapiens
acatccagtggggtctc

SEQ ID NO: 5136760 - DNA, 13 bp, Homo sapiens
acatccataaaga

SEQ ID NO: 5136761 - DNA, 12 bp, Homo sapiens
acatccatccct

SEQ ID NO: 5136762 - DNA, 18 bp, Homo sapiens
acatccatgtttgtaaaa

SEQ ID NO: 5136763 - DNA, 16 bp, Homo sapiens
acatccattccagagc

SEQ ID NO: 5136764 - DNA, 15 bp, Homo sapiens
acatccattctacat

SEQ ID NO: 5136765 - DNA, 13 bp, Homo sapiens
acatcccaaactt

SEQ ID NO: 5136766 - DNA, 14 bp, Homo sapiens
acatcccaaacttt

SEQ ID NO: 5136767 - DNA, 15 bp, Homo sapiens
acatcccaaacttta

SEQ ID NO: 5136768 - DNA, 21 bp, Homo sapiens
acatcccaccccatcctccag

SEQ ID NO: 5136769 - DNA, 14 bp, Homo sapiens
acatcccagcccaa

SEQ ID NO: 5136770 - DNA, 14 bp, Homo sapiens
acatcccagcctgt

SEQ ID NO: 5136771 - DNA, 18 bp, Homo sapiens
acatcccaggaggggcct

SEQ ID NO: 5136772 - DNA, 12 bp, Homo sapiens
acatcccatgtt

SEQ ID NO: 5136773 - DNA, 18 bp, Homo sapiens
acatccccaagcccacca

SEQ ID NO: 5136774 - DNA, 16 bp, Homo sapiens
acatccccacctggcg

SEQ ID NO: 5136775 - DNA, 15 bp, Homo sapiens
acatccccagagccc

SEQ ID NO: 5136776 - DNA, 17 bp, Homo sapiens
acatccccagagcccag

SEQ ID NO: 5136777 - DNA, 19 bp, Homo sapiens
acatccccgctggctgggg

SEQ ID NO: 5136778 - DNA, 15 bp, Homo sapiens
acatcccgggcctca

SEQ ID NO: 5136779 - DNA, 13 bp, Homo sapiens
acatccctgggca

SEQ ID NO: 5136780 - DNA, 15 bp, Homo sapiens
acatccctgggcctg

SEQ ID NO: 5136781 - DNA, 17 bp, Homo sapiens
acatccctgggcctgct

SEQ ID NO: 5136782 - DNA, 20 bp, Homo sapiens
acatccctgggcctgctgct

SEQ ID NO: 5136783 - DNA, 14 bp, Homo sapiens
acatccctgtaaat

SEQ ID NO: 5136784 - DNA, 20 bp, Homo sapiens
acatcccttacctgggaaag

SEQ ID NO: 5136785 - DNA, 13 bp, Homo sapiens
acatcccttcctg

SEQ ID NO: 5136786 - DNA, 17 bp, Homo sapiens
acatcccttcctggaaa

SEQ ID NO: 5136787 - DNA, 19 bp, Homo sapiens
acatcccttcctggaaaca

SEQ ID NO: 5136788 - DNA, 16 bp, Homo sapiens
acatccgccttttgta

SEQ ID NO: 5136789 - DNA, 14 bp, Homo sapiens
acatccgctttatg

SEQ ID NO: 5136790 - DNA, 15 bp, Homo sapiens
acatccggaacagcc

SEQ ID NO: 5136791 - DNA, 16 bp, Homo sapiens
acatccggaggagaag

SEQ ID NO: 5136792 - DNA, 19 bp, Homo sapiens
acatccggggccagctccg

SEQ ID NO: 5136793 - DNA, 23 bp, Homo sapiens
acatcctaaggttcttgctttct

SEQ ID NO: 5136794 - DNA, 15 bp, Homo sapiens
acatcctacaagaca

SEQ ID NO: 5136795 - DNA, 15 bp, Homo sapiens
acatcctactaagaa

SEQ ID NO: 5136796 - DNA, 21 bp, Homo sapiens
acatcctagaggtagagaaac

SEQ ID NO: 5136797 - DNA, 14 bp, Homo sapiens
acatcctagcccca

SEQ ID NO: 5136798 - DNA, 16 bp, Homo sapiens
acatcctagccccacc

SEQ ID NO: 5136799 - DNA, 18 bp, Homo sapiens
acatcctagccccaccca

SEQ ID NO: 5136800 - DNA, 17 bp, Homo sapiens
acatcctatgaaatact

SEQ ID NO: 5136801 - DNA, 23 bp, Homo sapiens
acatcctcattcactaagccatg

SEQ ID NO: 5136802 - DNA, 17 bp, Homo sapiens
acatcctccgtccagcc

SEQ ID NO: 5136803 - DNA, 15 bp, Homo sapiens
acatcctcctcccac

SEQ ID NO: 5136804 - DNA, 22 bp, Homo sapiens
acatcctctgatagctgtttca

SEQ ID NO: 5136805 - DNA, 18 bp, Homo sapiens
acatcctgctgggccccc

SEQ ID NO: 5136806 - DNA, 17 bp, Homo sapiens
acatcctgtataagcac

SEQ ID NO: 5136807 - DNA, 22 bp, Homo sapiens
acatcctgtcatctgagaatga

SEQ ID NO: 5136808 - DNA, 21 bp, Homo sapiens
acatcctgtgggacctgggcc

SEQ ID NO: 5136809 - DNA, 13 bp, Homo sapiens
acatcctgtgtca

SEQ ID NO: 5136810 - DNA, 18 bp, Homo sapiens
acatcctgtgtcagaaac

SEQ ID NO: 5136811 - DNA, 16 bp, Homo sapiens
acatccttaaatgtct

SEQ ID NO: 5136812 - DNA, 18 bp, Homo sapiens
acatccttaaatgtctaa

SEQ ID NO: 5136813 - DNA, 15 bp, Homo sapiens
acatccttctcactg

SEQ ID NO: 5136814 - DNA, 20 bp, Homo sapiens
acatccttctcactgccatg

SEQ ID NO: 5136815 - DNA, 19 bp, Homo sapiens
acatccttcttggcttcct

SEQ ID NO: 5136816 - DNA, 13 bp, Homo sapiens
acatcctttctaa

SEQ ID NO: 5136817 - DNA, 21 bp, Homo sapiens
acatcctttctattgaaaaat

SEQ ID NO: 5136818 - DNA, 21 bp, Homo sapiens
acatcgacaaccacgtaccaa

SEQ ID NO: 5136819 - DNA, 14 bp, Homo sapiens
acatcgcacagttt

SEQ ID NO: 5136820 - DNA, 16 bp, Homo sapiens
acatcgcacagtttac

SEQ ID NO: 5136821 - DNA, 14 bp, Homo sapiens
acatcgccctccac

SEQ ID NO: 5136822 - DNA, 16 bp, Homo sapiens
acatcgcgatgggaac

SEQ ID NO: 5136823 - DNA, 15 bp, Homo sapiens
acatcgggctcacct

SEQ ID NO: 5136824 - DNA, 21 bp, Homo sapiens
acatcggttcaggaggagaca

SEQ ID NO: 5136825 - DNA, 21 bp, Homo sapiens
acatcgtaggcagccacggcc

SEQ ID NO: 5136826 - DNA, 17 bp, Homo sapiens
acatcgtgaaaccctgt

SEQ ID NO: 5136827 - DNA, 20 bp, Homo sapiens
acatcgtgaaaccctgtctc

SEQ ID NO: 5136828 - DNA, 18 bp, Homo sapiens
acatcgtgggtcactaca

SEQ ID NO: 5136829 - DNA, 16 bp, Homo sapiens
acatcgttcgatttaa

SEQ ID NO: 5136830 - DNA, 17 bp, Homo sapiens
acatcgttgagacatca

SEQ ID NO: 5136831 - DNA, 16 bp, Homo sapiens
acatctaaagctttat

SEQ ID NO: 5136832 - DNA, 22 bp, Homo sapiens
acatctaaagctttatctttgt

SEQ ID NO: 5136833 - DNA, 21 bp, Homo sapiens
acatctaaattgatcattcat

SEQ ID NO: 5136834 - DNA, 14 bp, Homo sapiens
acatctaacaaagt

SEQ ID NO: 5136835 - DNA, 15 bp, Homo sapiens
acatctaagcctgaa

SEQ ID NO: 5136836 - DNA, 18 bp, Homo sapiens
acatctaataagtatata

SEQ ID NO: 5136837 - DNA, 23 bp, Homo sapiens
acatctacattttttaaaactga

SEQ ID NO: 5136838 - DNA, 22 bp, Homo sapiens
acatctacgaagccacaggcct

SEQ ID NO: 5136839 - DNA, 16 bp, Homo sapiens
acatctagcagtaaat

SEQ ID NO: 5136840 - DNA, 16 bp, Homo sapiens
acatctagtagttgtt

SEQ ID NO: 5136841 - DNA, 15 bp, Homo sapiens
acatctataaaatgt

SEQ ID NO: 5136842 - DNA, 14 bp, Homo sapiens
acatctatgatata

SEQ ID NO: 5136843 - DNA, 23 bp, Homo sapiens
acatctatgtgtatgttgacttt

SEQ ID NO: 5136844 - DNA, 19 bp, Homo sapiens
acatctattataaaaccat

SEQ ID NO: 5136845 - DNA, 23 bp, Homo sapiens
acatctattttggattgtatatt

SEQ ID NO: 5136846 - DNA, 22 bp, Homo sapiens
acatctcaacaggcctcagggc

SEQ ID NO: 5136847 - DNA, 12 bp, Homo sapiens
acatctcagaga

SEQ ID NO: 5136848 - DNA, 18 bp, Homo sapiens
acatctcatgtgtgctca

SEQ ID NO: 5136849 - DNA, 12 bp, Homo sapiens
acatctccagaa

SEQ ID NO: 5136850 - DNA, 21 bp, Homo sapiens
acatctccagaaaaatgaaaa

SEQ ID NO: 5136851 - DNA, 23 bp, Homo sapiens
acatctccagaaaaatgaaaagc

SEQ ID NO: 5136852 - DNA, 14 bp, Homo sapiens
acatctccagtgtg

SEQ ID NO: 5136853 - DNA, 18 bp, Homo sapiens
acatctcccctttgctaa

SEQ ID NO: 5136854 - DNA, 23 bp, Homo sapiens
acatctcccttttccatgactgt

SEQ ID NO: 5136855 - DNA, 21 bp, Homo sapiens
acatctcctccatactcagga

SEQ ID NO: 5136856 - DNA, 21 bp, Homo sapiens
acatctcctggctaagcctct

SEQ ID NO: 5136857 - DNA, 22 bp, Homo sapiens
acatctcctggctaagcctctg

SEQ ID NO: 5136858 - DNA, 18 bp, Homo sapiens
acatctccttgatcatgt

SEQ ID NO: 5136859 - DNA, 16 bp, Homo sapiens
acatctcgagccccct

SEQ ID NO: 5136860 - DNA, 17 bp, Homo sapiens
acatctctctgccctct

SEQ ID NO: 5136861 - DNA, 22 bp, Homo sapiens
acatctctctgccctctccctg

SEQ ID NO: 5136862 - DNA, 14 bp, Homo sapiens
acatctctctggct

SEQ ID NO: 5136863 - DNA, 12 bp, Homo sapiens
acatctctgaat

SEQ ID NO: 5136864 - DNA, 15 bp, Homo sapiens
acatctctgactttc

SEQ ID NO: 5136865 - DNA, 16 bp, Homo sapiens
acatctctgactttct

SEQ ID NO: 5136866 - DNA, 13 bp, Homo sapiens
acatctctgcagt

SEQ ID NO: 5136867 - DNA, 15 bp, Homo sapiens
acatctctgcttgag

SEQ ID NO: 5136868 - DNA, 14 bp, Homo sapiens
acatctctggagcc

SEQ ID NO: 5136869 - DNA, 22 bp, Homo sapiens
acatctctggcccagaaagcct

SEQ ID NO: 5136870 - DNA, 13 bp, Homo sapiens
acatctctgtaaa

SEQ ID NO: 5136871 - DNA, 23 bp, Homo sapiens
acatctctgtaaaaagcaggtga

SEQ ID NO: 5136872 - DNA, 13 bp, Homo sapiens
acatctcttgaaa

SEQ ID NO: 5136873 - DNA, 15 bp, Homo sapiens
acatctcttgaaacc

SEQ ID NO: 5136874 - DNA, 14 bp, Homo sapiens
acatctctttgaat

SEQ ID NO: 5136875 - DNA, 20 bp, Homo sapiens
acatctctttgatgtcatat

SEQ ID NO: 5136876 - DNA, 13 bp, Homo sapiens
acatctgaaagcc

SEQ ID NO: 5136877 - DNA, 24 bp, Homo sapiens
acatctgaatctccttgttgttct

SEQ ID NO: 5136878 - DNA, 22 bp, Homo sapiens
acatctgagacactaggatgaa

SEQ ID NO: 5136879 - DNA, 21 bp, Homo sapiens
acatctgaggaaaatggaaga

SEQ ID NO: 5136880 - DNA, 15 bp, Homo sapiens
acatctgatctgtat

SEQ ID NO: 5136881 - DNA, 18 bp, Homo sapiens
acatctgatgcatgcttt

SEQ ID NO: 5136882 - DNA, 19 bp, Homo sapiens
acatctgatttctgaacta

SEQ ID NO: 5136883 - DNA, 21 bp, Homo sapiens
acatctgcacactctcttctc

SEQ ID NO: 5136884 - DNA, 22 bp, Homo sapiens
acatctgcacactctcttctcc

SEQ ID NO: 5136885 - DNA, 20 bp, Homo sapiens
acatctgcagtgttctgtga

SEQ ID NO: 5136886 - DNA, 21 bp, Homo sapiens
acatctgcagtgttctgtgaa

SEQ ID NO: 5136887 - DNA, 15 bp, Homo sapiens
acatctgccatttat

SEQ ID NO: 5136888 - DNA, 16 bp, Homo sapiens
acatctgcctcctctc

SEQ ID NO: 5136889 - DNA, 17 bp, Homo sapiens
acatctgcctgtaatta

SEQ ID NO: 5136890 - DNA, 21 bp, Homo sapiens
acatctgcctgtaattaaact

SEQ ID NO: 5136891 - DNA, 23 bp, Homo sapiens
acatctgccttaaaaccaaagag

SEQ ID NO: 5136892 - DNA, 15 bp, Homo sapiens
acatctgccttgctg

SEQ ID NO: 5136893 - DNA, 19 bp, Homo sapiens
acatctgccttgctgcacc

SEQ ID NO: 5136894 - DNA, 14 bp, Homo sapiens
acatctgctctagg

SEQ ID NO: 5136895 - DNA, 23 bp, Homo sapiens
acatctggaaagttttctccact

SEQ ID NO: 5136896 - DNA, 19 bp, Homo sapiens
acatctggaatctgaggca

SEQ ID NO: 5136897 - DNA, 19 bp, Homo sapiens
acatctggatgccttcccc

SEQ ID NO: 5136898 - DNA, 17 bp, Homo sapiens
acatctggcatggctcc

SEQ ID NO: 5136899 - DNA, 12 bp, Homo sapiens
acatctggccct

SEQ ID NO: 5136900 - DNA, 20 bp, Homo sapiens
acatctggctgcacaggctg

SEQ ID NO: 5136901 - DNA, 13 bp, Homo sapiens
acatctggcttat

SEQ ID NO: 5136902 - DNA, 21 bp, Homo sapiens
acatctggcttattttaatgt

SEQ ID NO: 5136903 - DNA, 18 bp, Homo sapiens
acatctgggatcatgata

SEQ ID NO: 5136904 - DNA, 23 bp, Homo sapiens
acatctgggtctactcaaacact

SEQ ID NO: 5136905 - DNA, 16 bp, Homo sapiens
acatctgggtgccctg

SEQ ID NO: 5136906 - DNA, 23 bp, Homo sapiens
acatctgtagggaattcttctgt

SEQ ID NO: 5136907 - DNA, 23 bp, Homo sapiens
acatctgtatttttaaattctgc

SEQ ID NO: 5136908 - DNA, 20 bp, Homo sapiens
acatctgtcagtgagtcaga

SEQ ID NO: 5136909 - DNA, 12 bp, Homo sapiens
acatctgtcctc

SEQ ID NO: 5136910 - DNA, 13 bp, Homo sapiens
acatctgtcctga

SEQ ID NO: 5136911 - DNA, 15 bp, Homo sapiens
acatctgtcctgtga

SEQ ID NO: 5136912 - DNA, 22 bp, Homo sapiens
acatctgtgcagggctggtttg

SEQ ID NO: 5136913 - DNA, 13 bp, Homo sapiens
acatctgtgtatt

SEQ ID NO: 5136914 - DNA, 15 bp, Homo sapiens
acatctgtgtcttgt

SEQ ID NO: 5136915 - DNA, 11 bp, Homo sapiens
acatcttaaat

SEQ ID NO: 5136916 - DNA, 20 bp, Homo sapiens
acatcttaaatctaaacaaa

SEQ ID NO: 5136917 - DNA, 13 bp, Homo sapiens
acatcttacctct

SEQ ID NO: 5136918 - DNA, 14 bp, Homo sapiens
acatcttacctctc

SEQ ID NO: 5136919 - DNA, 18 bp, Homo sapiens
acatcttagtatttgcat

SEQ ID NO: 5136920 - DNA, 19 bp, Homo sapiens
acatcttatagatgcaaag

SEQ ID NO: 5136921 - DNA, 15 bp, Homo sapiens
acaggagacccaaca

SEQ ID NO: 5136922 - DNA, 14 bp, Homo sapiens
acaggagactccaa

SEQ ID NO: 5136923 - DNA, 15 bp, Homo sapiens
acaggagagaaaggg

SEQ ID NO: 5136924 - DNA, 18 bp, Homo sapiens
acaggagaggcagcatgc

SEQ ID NO: 5136925 - DNA, 22 bp, Homo sapiens
acaggagatagctttctttccc

SEQ ID NO: 5136926 - DNA, 22 bp, Homo sapiens
acaggagcagcccacccagcag

SEQ ID NO: 5136927 - DNA, 14 bp, Homo sapiens
acaggagccctgct

SEQ ID NO: 5136928 - DNA, 14 bp, Homo sapiens
acaggagcctagcg

SEQ ID NO: 5136929 - DNA, 22 bp, Homo sapiens
acaggagcctctgcagtcgctt

SEQ ID NO: 5136930 - DNA, 16 bp, Homo sapiens
acaggagcgtgtacta

SEQ ID NO: 5136931 - DNA, 14 bp, Homo sapiens
acaggagctccctt

SEQ ID NO: 5136932 - DNA, 22 bp, Homo sapiens
acaggaggaactggtccaggcc

SEQ ID NO: 5136933 - DNA, 18 bp, Homo sapiens
acaggaggaggagatggc

SEQ ID NO: 5136934 - DNA, 18 bp, Homo sapiens
acaggaggagtgggacag

SEQ ID NO: 5136935 - DNA, 16 bp, Homo sapiens
acaggaggattgcctg

SEQ ID NO: 5136936 - DNA, 17 bp, Homo sapiens
acaggaggattgcctga

SEQ ID NO: 5136937 - DNA, 16 bp, Homo sapiens
acaggaggccagtggg

SEQ ID NO: 5136938 - DNA, 12 bp, Homo sapiens
acaggagggaga

SEQ ID NO: 5136939 - DNA, 14 bp, Homo sapiens
acaggagggagaga

SEQ ID NO: 5136940 - DNA, 15 bp, Homo sapiens
acaggagggcagccc

SEQ ID NO: 5136941 - DNA, 13 bp, Homo sapiens
acaggagggccag

SEQ ID NO: 5136942 - DNA, 12 bp, Homo sapiens
acaggagggccc

SEQ ID NO: 5136943 - DNA, 13 bp, Homo sapiens
acaggagggcccg

SEQ ID NO: 5136944 - DNA, 15 bp, Homo sapiens
acaggagggcccgga

SEQ ID NO: 5136945 - DNA, 17 bp, Homo sapiens
acaggaggggcccacaa

SEQ ID NO: 5136946 - DNA, 18 bp, Homo sapiens
acaggaggtgtgaatgca

SEQ ID NO: 5136947 - DNA, 15 bp, Homo sapiens
acaggaggttggagg

SEQ ID NO: 5136948 - DNA, 17 bp, Homo sapiens
acaggaggttggaggga

SEQ ID NO: 5136949 - DNA, 19 bp, Homo sapiens
acaggagtcagtctctttc

SEQ ID NO: 5136950 - DNA, 22 bp, Homo sapiens
acaggagtcctttcttttgaaa

SEQ ID NO: 5136951 - DNA, 19 bp, Homo sapiens
acaggagtcttcagaccca

SEQ ID NO: 5136952 - DNA, 19 bp, Homo sapiens
acaggagttgtgagccctc

SEQ ID NO: 5136953 - DNA, 19 bp, Homo sapiens
acaggataaagatatcaat

SEQ ID NO: 5136954 - DNA, 14 bp, Homo sapiens
acaggataataaaa

SEQ ID NO: 5136955 - DNA, 16 bp, Homo sapiens
acaggataataaaaca

SEQ ID NO: 5136956 - DNA, 17 bp, Homo sapiens
acaggataataaaacat

SEQ ID NO: 5136957 - DNA, 20 bp, Homo sapiens
acaggatagataactctttg

SEQ ID NO: 5136958 - DNA, 20 bp, Homo sapiens
acaggatattaaacgtgtaa

SEQ ID NO: 5136959 - DNA, 22 bp, Homo sapiens
acaggatattaaacgtgtaaat

SEQ ID NO: 5136960 - DNA, 15 bp, Homo sapiens
acaggatattagaca

SEQ ID NO: 5136961 - DNA, 20 bp, Homo sapiens
acaggatcatcatttaaaaa

SEQ ID NO: 5136962 - DNA, 16 bp, Homo sapiens
acaggatcctggcctg

SEQ ID NO: 5136963 - DNA, 17 bp, Homo sapiens
acaggatcctggcctga

SEQ ID NO: 5136964 - DNA, 14 bp, Homo sapiens
acaggatgaaggca

SEQ ID NO: 5136965 - DNA, 18 bp, Homo sapiens
acaggatgacctggataa

SEQ ID NO: 5136966 - DNA, 15 bp, Homo sapiens
acaggatgaggacag

SEQ ID NO: 5136967 - DNA, 17 bp, Homo sapiens
acaggatgaggacagag

SEQ ID NO: 5136968 - DNA, 13 bp, Homo sapiens
acaggatgaggtc

SEQ ID NO: 5136969 - DNA, 13 bp, Homo sapiens
acaggatgcatat

SEQ ID NO: 5136970 - DNA, 16 bp, Homo sapiens
acaggatgcatattaa

SEQ ID NO: 5136971 - DNA, 14 bp, Homo sapiens
acaggatgccagcc

SEQ ID NO: 5136972 - DNA, 16 bp, Homo sapiens
acaggatgccagcccc

SEQ ID NO: 5136973 - DNA, 21 bp, Homo sapiens
acaggatgccagcccctgcct

SEQ ID NO: 5136974 - DNA, 20 bp, Homo sapiens
acaggatgcccacatactgt

SEQ ID NO: 5136975 - DNA, 15 bp, Homo sapiens
acaggatgctttggt

SEQ ID NO: 5136976 - DNA, 19 bp, Homo sapiens
acaggatggggttctggaa

SEQ ID NO: 5136977 - DNA, 20 bp, Homo sapiens
acaggatggggttctggaaa

SEQ ID NO: 5136978 - DNA, 24 bp, Homo sapiens
acaggatggttcccttgatgaaga

SEQ ID NO: 5136979 - DNA, 18 bp, Homo sapiens
acaggatgtggcactgct

SEQ ID NO: 5136980 - DNA, 18 bp, Homo sapiens
acaggatgtgtttgcttt

SEQ ID NO: 5136981 - DNA, 17 bp, Homo sapiens
acaggattctgacagag

SEQ ID NO: 5136982 - DNA, 23 bp, Homo sapiens
acaggattgatcattcttttata

SEQ ID NO: 5136983 - DNA, 18 bp, Homo sapiens
acaggattgtctgctgcc

SEQ ID NO: 5136984 - DNA, 22 bp, Homo sapiens
acaggattgtctgctgcctcca

SEQ ID NO: 5136985 - DNA, 20 bp, Homo sapiens
acaggatttgaactcagatc

SEQ ID NO: 5136986 - DNA, 21 bp, Homo sapiens
acaggatttggccacactggg

SEQ ID NO: 5136987 - DNA, 13 bp, Homo sapiens
acaggattttcaa

SEQ ID NO: 5136988 - DNA, 14 bp, Homo sapiens
acaggcaaagattt

SEQ ID NO: 5136989 - DNA, 15 bp, Homo sapiens
acaggcaacattaca

SEQ ID NO: 5136990 - DNA, 16 bp, Homo sapiens
acaggcaactgaggca

SEQ ID NO: 5136991 - DNA, 15 bp, Homo sapiens
acaggcaagcacctc

SEQ ID NO: 5136992 - DNA, 20 bp, Homo sapiens
acaggcaagcacctcctgcc

SEQ ID NO: 5136993 - DNA, 19 bp, Homo sapiens
acaggcaaggatgatccag

SEQ ID NO: 5136994 - DNA, 14 bp, Homo sapiens
acaggcaatgctgg

SEQ ID NO: 5136995 - DNA, 19 bp, Homo sapiens
acaggcacaaaatgtgaca

SEQ ID NO: 5136996 - DNA, 20 bp, Homo sapiens
acaggcacattaactgttgc

SEQ ID NO: 5136997 - DNA, 12 bp, Homo sapiens
acaggcaccaga

SEQ ID NO: 5136998 - DNA, 23 bp, Homo sapiens
acaggcacccaccatcatgtctg

SEQ ID NO: 5136999 - DNA, 20 bp, Homo sapiens
acaggcaccgagaatgttgt

SEQ ID NO: 5137000 - DNA, 13 bp, Homo sapiens
acaggcacgtgcc

SEQ ID NO: 5137001 - DNA, 15 bp, Homo sapiens
acaggcactgccctg

SEQ ID NO: 5137002 - DNA, 18 bp, Homo sapiens
acaggcactgccctggtg

SEQ ID NO: 5137003 - DNA, 23 bp, Homo sapiens
acaggcactgccctggtggccct

SEQ ID NO: 5137004 - DNA, 16 bp, Homo sapiens
acaggcacttggcagc

SEQ ID NO: 5137005 - DNA, 13 bp, Homo sapiens
acaggcagaaaga

SEQ ID NO: 5137006 - DNA, 14 bp, Homo sapiens
acaggcagaaagag

SEQ ID NO: 5137007 - DNA, 15 bp, Homo sapiens
acaggcagaaagagt

SEQ ID NO: 5137008 - DNA, 13 bp, Homo sapiens
acaggcagagctg

SEQ ID NO: 5137009 - DNA, 15 bp, Homo sapiens
acaggcagatacagg

SEQ ID NO: 5137010 - DNA, 17 bp, Homo sapiens
acaggcagcaaggtcat

SEQ ID NO: 5137011 - DNA, 17 bp, Homo sapiens
acaggcagcacagagac

SEQ ID NO: 5137012 - DNA, 13 bp, Homo sapiens
acaggcagcagag

SEQ ID NO: 5137013 - DNA, 14 bp, Homo sapiens
acaggcagcattta

SEQ ID NO: 5137014 - DNA, 21 bp, Homo sapiens
acaggcagccagtgccctgag

SEQ ID NO: 5137015 - DNA, 22 bp, Homo sapiens
acaggcagcctcctttgtgtgt

SEQ ID NO: 5137016 - DNA, 16 bp, Homo sapiens
acaggcagcctggaca

SEQ ID NO: 5137017 - DNA, 16 bp, Homo sapiens
acaggcagctctgagc

SEQ ID NO: 5137018 - DNA, 20 bp, Homo sapiens
acaggcagctttaaccatta

SEQ ID NO: 5137019 - DNA, 19 bp, Homo sapiens
acaggcagctttctagaag

SEQ ID NO: 5137020 - DNA, 13 bp, Homo sapiens
acaggcaggaaga

SEQ ID NO: 5137021 - DNA, 15 bp, Homo sapiens
acaggcaggaagaga

SEQ ID NO: 5137022 - DNA, 18 bp, Homo sapiens
acaggcagggcaggacca

SEQ ID NO: 5137023 - DNA, 19 bp, Homo sapiens
acaggcagggcctggctcc

SEQ ID NO: 5137024 - DNA, 20 bp, Homo sapiens
acaggcagggcctggctcca

SEQ ID NO: 5137025 - DNA, 16 bp, Homo sapiens
acaggcagtgcatgtg

SEQ ID NO: 5137026 - DNA, 13 bp, Homo sapiens
acaggcagtttca

SEQ ID NO: 5137027 - DNA, 23 bp, Homo sapiens
acaggcagtttcagagatggaca

SEQ ID NO: 5137028 - DNA, 21 bp, Homo sapiens
acaggcataaaatagagtaaa

SEQ ID NO: 5137029 - DNA, 18 bp, Homo sapiens
acaggcatattattttct

SEQ ID NO: 5137030 - DNA, 19 bp, Homo sapiens
acaggcatattattttctg

SEQ ID NO: 5137031 - DNA, 13 bp, Homo sapiens
acaggcatcagga

SEQ ID NO: 5137032 - DNA, 15 bp, Homo sapiens
acaggcatcaggaat

SEQ ID NO: 5137033 - DNA, 20 bp, Homo sapiens
acaggcatctacacagcctg

SEQ ID NO: 5137034 - DNA, 22 bp, Homo sapiens
acaggcatctacacagcctgga

SEQ ID NO: 5137035 - DNA, 15 bp, Homo sapiens
acaggcatgagccac

SEQ ID NO: 5137036 - DNA, 19 bp, Homo sapiens
acaggcatgagccaccatg

SEQ ID NO: 5137037 - DNA, 17 bp, Homo sapiens
acaggcatgagccactg

SEQ ID NO: 5137038 - DNA, 19 bp, Homo sapiens
acaggcatgagccactgca

SEQ ID NO: 5137039 - DNA, 20 bp, Homo sapiens
acaggcatgagccactgcac

SEQ ID NO: 5137040 - DNA, 22 bp, Homo sapiens
acaggcatgggtgcaaggaaaa

SEQ ID NO: 5137041 - DNA, 14 bp, Homo sapiens
acaggcatgtgcca

SEQ ID NO: 5137042 - DNA, 19 bp, Homo sapiens
acaggcatgtgtcaccatg

SEQ ID NO: 5137043 - DNA, 20 bp, Homo sapiens
acaggcatgttctctgagga

SEQ ID NO: 5137044 - DNA, 22 bp, Homo sapiens
acaggcatgttctctgaggaca

SEQ ID NO: 5137045 - DNA, 19 bp, Homo sapiens
acaggcattgcactaaaag

SEQ ID NO: 5137046 - DNA, 18 bp, Homo sapiens
acaggcatttcctgggtg

SEQ ID NO: 5137047 - DNA, 17 bp, Homo sapiens
acaggcatttgttcact

SEQ ID NO: 5137048 - DNA, 18 bp, Homo sapiens
acaggcatttgttcactg

SEQ ID NO: 5137049 - DNA, 18 bp, Homo sapiens
acaggccactgcaaaccc

SEQ ID NO: 5137050 - DNA, 19 bp, Homo sapiens
acaggccacttgctcagac

SEQ ID NO: 5137051 - DNA, 16 bp, Homo sapiens
acaggccagccttggc

SEQ ID NO: 5137052 - DNA, 17 bp, Homo sapiens
acaggccaggggatctg

SEQ ID NO: 5137053 - DNA, 19 bp, Homo sapiens
acaggccagtagggggagg

SEQ ID NO: 5137054 - DNA, 17 bp, Homo sapiens
acaggccatgtgagcca

SEQ ID NO: 5137055 - DNA, 12 bp, Homo sapiens
acaggcccagaa

SEQ ID NO: 5137056 - DNA, 15 bp, Homo sapiens
acaggcccagcattg

SEQ ID NO: 5137057 - DNA, 12 bp, Homo sapiens
acaggcccagcg

SEQ ID NO: 5137058 - DNA, 23 bp, Homo sapiens
acaggccccacgccctctcctcc

SEQ ID NO: 5137059 - DNA, 21 bp, Homo sapiens
acaggccccccgcagcaccct

SEQ ID NO: 5137060 - DNA, 12 bp, Homo sapiens
acaggccccctt

SEQ ID NO: 5137061 - DNA, 21 bp, Homo sapiens
acaggcccccttgagtggggt

SEQ ID NO: 5137062 - DNA, 23 bp, Homo sapiens
acaggcccggcccagcctaggcc

SEQ ID NO: 5137063 - DNA, 17 bp, Homo sapiens
acaggcccggctccagg

SEQ ID NO: 5137064 - DNA, 18 bp, Homo sapiens
acaggcccggctccaggc

SEQ ID NO: 5137065 - DNA, 12 bp, Homo sapiens
acaggccctccc

SEQ ID NO: 5137066 - DNA, 21 bp, Homo sapiens
acaggccctccctgttcccca

SEQ ID NO: 5137067 - DNA, 22 bp, Homo sapiens
acaggccctccctgttccccag

SEQ ID NO: 5137068 - DNA, 23 bp, Homo sapiens
acaggccctccctgttccccaga

SEQ ID NO: 5137069 - DNA, 18 bp, Homo sapiens
acaggccctctgtggcct

SEQ ID NO: 5137070 - DNA, 19 bp, Homo sapiens
acaggccctctgtggcctg

SEQ ID NO: 5137071 - DNA, 14 bp, Homo sapiens
acaggccctgctcc

SEQ ID NO: 5137072 - DNA, 15 bp, Homo sapiens
acaggccctgctcct

SEQ ID NO: 5137073 - DNA, 17 bp, Homo sapiens
acaggccctgctcctgc

SEQ ID NO: 5137074 - DNA, 19 bp, Homo sapiens
acaggccctgctcctgcag

SEQ ID NO: 5137075 - DNA, 21 bp, Homo sapiens
acaggccctgctcctgcagca

SEQ ID NO: 5137076 - DNA, 19 bp, Homo sapiens
acaggccctttcctcaggc

SEQ ID NO: 5137077 - DNA, 20 bp, Homo sapiens
acaggccctttcctcaggca

SEQ ID NO: 5137078 - DNA, 15 bp, Homo sapiens
acaggccgaggcagg

SEQ ID NO: 5137079 - DNA, 15 bp, Homo sapiens
acaggcctcacctct

SEQ ID NO: 5137080 - DNA, 19 bp, Homo sapiens
acaggcctcacctctaccc

SEQ ID NO: 5137081 - DNA, 13 bp, Homo sapiens
acaggcctcaggg

SEQ ID NO: 5137082 - DNA, 18 bp, Homo sapiens
acaggcctcagggctcct

SEQ ID NO: 5137083 - DNA, 12 bp, Homo sapiens
acaggcctctct

SEQ ID NO: 5137084 - DNA, 13 bp, Homo sapiens
acaggcctctctt

SEQ ID NO: 5137085 - DNA, 13 bp, Homo sapiens
acaggcctctgcc

SEQ ID NO: 5137086 - DNA, 16 bp, Homo sapiens
acaggcctctgcctgc

SEQ ID NO: 5137087 - DNA, 17 bp, Homo sapiens
acaggcctctgcctgct

SEQ ID NO: 5137088 - DNA, 17 bp, Homo sapiens
acaggcctcttcctgtt

SEQ ID NO: 5137089 - DNA, 15 bp, Homo sapiens
acaggcctgagattt

SEQ ID NO: 5137090 - DNA, 13 bp, Homo sapiens
acaggcctgcagc

SEQ ID NO: 5137091 - DNA, 22 bp, Homo sapiens
acaggcctggcccagccagcag

SEQ ID NO: 5137092 - DNA, 23 bp, Homo sapiens
acaggcctggcccagccagcagg

SEQ ID NO: 5137093 - DNA, 20 bp, Homo sapiens
acaggcctgtgtagctgtga

SEQ ID NO: 5137094 - DNA, 13 bp, Homo sapiens
acaggccttctgt

SEQ ID NO: 5137095 - DNA, 22 bp, Homo sapiens
acaggccttctgtggggctggg

SEQ ID NO: 5137096 - DNA, 13 bp, Homo sapiens
acaggcgccgcct

SEQ ID NO: 5137097 - DNA, 13 bp, Homo sapiens
acaggcgcctgcc

SEQ ID NO: 5137098 - DNA, 19 bp, Homo sapiens
acaggcgctccaggccact

SEQ ID NO: 5137099 - DNA, 13 bp, Homo sapiens
acaggcgggctcg

SEQ ID NO: 5137100 - DNA, 14 bp, Homo sapiens
acatcttatttatt

SEQ ID NO: 5137101 - DNA, 16 bp, Homo sapiens
acatcttatttatttt

SEQ ID NO: 5137102 - DNA, 22 bp, Homo sapiens
acatcttatttattttagcaaa

SEQ ID NO: 5137103 - DNA, 13 bp, Homo sapiens
acatcttcaaagc

SEQ ID NO: 5137104 - DNA, 16 bp, Homo sapiens
acatcttcagcaaata

SEQ ID NO: 5137105 - DNA, 16 bp, Homo sapiens
acatcttcagctccca

SEQ ID NO: 5137106 - DNA, 17 bp, Homo sapiens
acatcttcatataaact

SEQ ID NO: 5137107 - DNA, 23 bp, Homo sapiens
acatcttccacaggtctcagaat

SEQ ID NO: 5137108 - DNA, 13 bp, Homo sapiens
acatcttctcagt

SEQ ID NO: 5137109 - DNA, 16 bp, Homo sapiens
acatcttctcagtgtt

SEQ ID NO: 5137110 - DNA, 12 bp, Homo sapiens
acatcttctctc

SEQ ID NO: 5137111 - DNA, 15 bp, Homo sapiens
acatcttcttcccag

SEQ ID NO: 5137112 - DNA, 16 bp, Homo sapiens
acatcttcttcccagt

SEQ ID NO: 5137113 - DNA, 14 bp, Homo sapiens
acatcttctttgga

SEQ ID NO: 5137114 - DNA, 19 bp, Homo sapiens
acatcttgaaaatgccacc

SEQ ID NO: 5137115 - DNA, 21 bp, Homo sapiens
acatcttgaaaatgccaccat

SEQ ID NO: 5137116 - DNA, 14 bp, Homo sapiens
acatcttgatctgc

SEQ ID NO: 5137117 - DNA, 22 bp, Homo sapiens
acatcttgatctgctcagccct

SEQ ID NO: 5137118 - DNA, 23 bp, Homo sapiens
acatcttgatctgctcagccctg

SEQ ID NO: 5137119 - DNA, 23 bp, Homo sapiens
acatcttgcattcaaaatcttca

SEQ ID NO: 5137120 - DNA, 21 bp, Homo sapiens
acatcttgcctacttttcttt

SEQ ID NO: 5137121 - DNA, 13 bp, Homo sapiens
acatcttgctctg

SEQ ID NO: 5137122 - DNA, 21 bp, Homo sapiens
acatcttgctctgctgacaga

SEQ ID NO: 5137123 - DNA, 22 bp, Homo sapiens
acatcttggtatgtggccatat

SEQ ID NO: 5137124 - DNA, 19 bp, Homo sapiens
acatcttggtcagatttga

SEQ ID NO: 5137125 - DNA, 12 bp, Homo sapiens
acatcttgtagg

SEQ ID NO: 5137126 - DNA, 16 bp, Homo sapiens
acatcttgtcttttcc

SEQ ID NO: 5137127 - DNA, 24 bp, Homo sapiens
acatcttgtcttttcccctcattg

SEQ ID NO: 5137128 - DNA, 17 bp, Homo sapiens
acatcttgtgcatgcaa

SEQ ID NO: 5137129 - DNA, 19 bp, Homo sapiens
acatcttgttggtaccttt

SEQ ID NO: 5137130 - DNA, 21 bp, Homo sapiens
acatcttgttggtacctttct

SEQ ID NO: 5137131 - DNA, 14 bp, Homo sapiens
acatcttgtttctg

SEQ ID NO: 5137132 - DNA, 21 bp, Homo sapiens
acatctttaacatagtcctgt

SEQ ID NO: 5137133 - DNA, 20 bp, Homo sapiens
acatctttaaggggaggaac

SEQ ID NO: 5137134 - DNA, 15 bp, Homo sapiens
acatctttaagtatt

SEQ ID NO: 5137135 - DNA, 16 bp, Homo sapiens
acatctttacgtactg

SEQ ID NO: 5137136 - DNA, 22 bp, Homo sapiens
acatctttacgtactgtaactg

SEQ ID NO: 5137137 - DNA, 16 bp, Homo sapiens
acatctttattgaaat

SEQ ID NO: 5137138 - DNA, 18 bp, Homo sapiens
acatctttattgaaattc

SEQ ID NO: 5137139 - DNA, 14 bp, Homo sapiens
acatctttcacact

SEQ ID NO: 5137140 - DNA, 15 bp, Homo sapiens
acatctttcacactt

SEQ ID NO: 5137141 - DNA, 20 bp, Homo sapiens
acatctttcacacttccacc

SEQ ID NO: 5137142 - DNA, 13 bp, Homo sapiens
acatctttcccta

SEQ ID NO: 5137143 - DNA, 18 bp, Homo sapiens
acatctttccctaaagaa

SEQ ID NO: 5137144 - DNA, 13 bp, Homo sapiens
acatctttcttga

SEQ ID NO: 5137145 - DNA, 15 bp, Homo sapiens
acatctttgttttta

SEQ ID NO: 5137146 - DNA, 20 bp, Homo sapiens
acatctttgtttttaaaata

SEQ ID NO: 5137147 - DNA, 16 bp, Homo sapiens
acatcttttaactgcc

SEQ ID NO: 5137148 - DNA, 16 bp, Homo sapiens
acatcttttaagacaa

SEQ ID NO: 5137149 - DNA, 21 bp, Homo sapiens
acatcttttcctgatggctgg

SEQ ID NO: 5137150 - DNA, 14 bp, Homo sapiens
acatcttttctaat

SEQ ID NO: 5137151 - DNA, 14 bp, Homo sapiens
acatcttttgggaa

SEQ ID NO: 5137152 - DNA, 19 bp, Homo sapiens
acatctttttaaagcttat

SEQ ID NO: 5137153 - DNA, 22 bp, Homo sapiens
acatctttttaaagcttatcca

SEQ ID NO: 5137154 - DNA, 15 bp, Homo sapiens
acatctttttcactg

SEQ ID NO: 5137155 - DNA, 22 bp, Homo sapiens
acatctttttcctccctttccc

SEQ ID NO: 5137156 - DNA, 19 bp, Homo sapiens
acatcttttttcacaaatt

SEQ ID NO: 5137157 - DNA, 23 bp, Homo sapiens
acatgaaaaaaggacaatttcaa

SEQ ID NO: 5137158 - DNA, 22 bp, Homo sapiens
acatgaaaaacacggcagctgt

SEQ ID NO: 5137159 - DNA, 15 bp, Homo sapiens
acatgaaaacacatt

SEQ ID NO: 5137160 - DNA, 16 bp, Homo sapiens
acatgaaaacacattt

SEQ ID NO: 5137161 - DNA, 21 bp, Homo sapiens
acatgaaaattacaacagata

SEQ ID NO: 5137162 - DNA, 14 bp, Homo sapiens
acatgaaaatttta

SEQ ID NO: 5137163 - DNA, 16 bp, Homo sapiens
acatgaaaattttaaa

SEQ ID NO: 5137164 - DNA, 18 bp, Homo sapiens
acatgaaaattttaaaaa

SEQ ID NO: 5137165 - DNA, 23 bp, Homo sapiens
acatgaaaattttaaaaatacat

SEQ ID NO: 5137166 - DNA, 12 bp, Homo sapiens
acatgaaacaac

SEQ ID NO: 5137167 - DNA, 14 bp, Homo sapiens
acatgaaacattat

SEQ ID NO: 5137168 - DNA, 18 bp, Homo sapiens
acatgaaacctacacact

SEQ ID NO: 5137169 - DNA, 16 bp, Homo sapiens
acatgaaactgcctat

SEQ ID NO: 5137170 - DNA, 17 bp, Homo sapiens
acatgaaagtcaagtct

SEQ ID NO: 5137171 - DNA, 16 bp, Homo sapiens
acatgaaagttttgca

SEQ ID NO: 5137172 - DNA, 22 bp, Homo sapiens
acatgaaataaagaatttaaag

SEQ ID NO: 5137173 - DNA, 16 bp, Homo sapiens
acatgaaatgtacatg

SEQ ID NO: 5137174 - DNA, 17 bp, Homo sapiens
acatgaaatttttgtaa

SEQ ID NO: 5137175 - DNA, 19 bp, Homo sapiens
acatgaaatttttgtaaat

SEQ ID NO: 5137176 - DNA, 19 bp, Homo sapiens
acatgaacacccttagaaa

SEQ ID NO: 5137177 - DNA, 15 bp, Homo sapiens
acatgaacagcttgc

SEQ ID NO: 5137178 - DNA, 14 bp, Homo sapiens
acatgaacatactg

SEQ ID NO: 5137179 - DNA, 13 bp, Homo sapiens
acatgaagaaata

SEQ ID NO: 5137180 - DNA, 13 bp, Homo sapiens
acatgaagaagct

SEQ ID NO: 5137181 - DNA, 13 bp, Homo sapiens
acatgaagacctt

SEQ ID NO: 5137182 - DNA, 20 bp, Homo sapiens
acatgaagacctttttctgc

SEQ ID NO: 5137183 - DNA, 14 bp, Homo sapiens
acatgaagcagaac

SEQ ID NO: 5137184 - DNA, 11 bp, Homo sapiens
acatgaagcat

SEQ ID NO: 5137185 - DNA, 20 bp, Homo sapiens
acatgaaggagacagcagca

SEQ ID NO: 5137186 - DNA, 12 bp, Homo sapiens
acatgaagtatt

SEQ ID NO: 5137187 - DNA, 13 bp, Homo sapiens
acatgaagtattt

SEQ ID NO: 5137188 - DNA, 19 bp, Homo sapiens
acatgaagtgtgtttcctt

SEQ ID NO: 5137189 - DNA, 15 bp, Homo sapiens
acatgaataatttca

SEQ ID NO: 5137190 - DNA, 13 bp, Homo sapiens
acatgaatactat

SEQ ID NO: 5137191 - DNA, 16 bp, Homo sapiens
acatgaatactatcca

SEQ ID NO: 5137192 - DNA, 22 bp, Homo sapiens
acatgaatatggttggagagcc

SEQ ID NO: 5137193 - DNA, 18 bp, Homo sapiens
acatgaatcaaaagtgcc

SEQ ID NO: 5137194 - DNA, 21 bp, Homo sapiens
acatgaatcaaaagtgcctca

SEQ ID NO: 5137195 - DNA, 17 bp, Homo sapiens
acatgaatgcagtcatg

SEQ ID NO: 5137196 - DNA, 22 bp, Homo sapiens
acatgaatgggcatttctaaaa

SEQ ID NO: 5137197 - DNA, 13 bp, Homo sapiens
acatgaattaagg

SEQ ID NO: 5137198 - DNA, 19 bp, Homo sapiens
acatgaattattacagtgt

SEQ ID NO: 5137199 - DNA, 18 bp, Homo sapiens
acatgaattgcattttac

SEQ ID NO: 5137200 - DNA, 21 bp, Homo sapiens
acatgaattttaaataatgta

SEQ ID NO: 5137201 - DNA, 19 bp, Homo sapiens
acatgaattttagcttttg

SEQ ID NO: 5137202 - DNA, 22 bp, Homo sapiens
acatgaattttagcttttgtgg

SEQ ID NO: 5137203 - DNA, 13 bp, Homo sapiens
acatgacaatgca

SEQ ID NO: 5137204 - DNA, 15 bp, Homo sapiens
acatgacactgaaat

SEQ ID NO: 5137205 - DNA, 19 bp, Homo sapiens
acatgacatcaaaatgagt

SEQ ID NO: 5137206 - DNA, 14 bp, Homo sapiens
acatgacatccaca

SEQ ID NO: 5137207 - DNA, 18 bp, Homo sapiens
acatgacatccacatgca

SEQ ID NO: 5137208 - DNA, 13 bp, Homo sapiens
acatgacatccag

SEQ ID NO: 5137209 - DNA, 21 bp, Homo sapiens
acatgacatccagagatgact

SEQ ID NO: 5137210 - DNA, 17 bp, Homo sapiens
acatgacattcttagct

SEQ ID NO: 5137211 - DNA, 18 bp, Homo sapiens
acatgacatttaccagca

SEQ ID NO: 5137212 - DNA, 13 bp, Homo sapiens
acatgaccaaaaa

SEQ ID NO: 5137213 - DNA, 17 bp, Homo sapiens
acatgacccagcctgaa

SEQ ID NO: 5137214 - DNA, 20 bp, Homo sapiens
acatgacccagcctgaaaga

SEQ ID NO: 5137215 - DNA, 15 bp, Homo sapiens
acatgaccctctgtc

SEQ ID NO: 5137216 - DNA, 17 bp, Homo sapiens
acatgaccctctgtccc

SEQ ID NO: 5137217 - DNA, 14 bp, Homo sapiens
acatgacctccatt

SEQ ID NO: 5137218 - DNA, 22 bp, Homo sapiens
acatgacgcaccagttacaggg

SEQ ID NO: 5137219 - DNA, 14 bp, Homo sapiens
acatgacgtaaaat

SEQ ID NO: 5137220 - DNA, 13 bp, Homo sapiens
acatgactctcat

SEQ ID NO: 5137221 - DNA, 15 bp, Homo sapiens
acatgactgggcctc

SEQ ID NO: 5137222 - DNA, 16 bp, Homo sapiens
acatgactgtttcttt

SEQ ID NO: 5137223 - DNA, 21 bp, Homo sapiens
acatgactgtttcttttgtaa

SEQ ID NO: 5137224 - DNA, 14 bp, Homo sapiens
acatgacttctgcc

SEQ ID NO: 5137225 - DNA, 13 bp, Homo sapiens
acatgactttctt

SEQ ID NO: 5137226 - DNA, 13 bp, Homo sapiens
acatgagaaagat

SEQ ID NO: 5137227 - DNA, 15 bp, Homo sapiens
acatgagaaatgtga

SEQ ID NO: 5137228 - DNA, 15 bp, Homo sapiens
acatgagaacaaaca

SEQ ID NO: 5137229 - DNA, 13 bp, Homo sapiens
acatgagaacaga

SEQ ID NO: 5137230 - DNA, 19 bp, Homo sapiens
acatgagactgtaaaacaa

SEQ ID NO: 5137231 - DNA, 18 bp, Homo sapiens
acatgagagtagggccct

SEQ ID NO: 5137232 - DNA, 17 bp, Homo sapiens
acatgagatcagggcct

SEQ ID NO: 5137233 - DNA, 19 bp, Homo sapiens
acatgagatggagaggctg

SEQ ID NO: 5137234 - DNA, 20 bp, Homo sapiens
acatgagatgtgtggactgt

SEQ ID NO: 5137235 - DNA, 17 bp, Homo sapiens
acatgagcatcaggcca

SEQ ID NO: 5137236 - DNA, 18 bp, Homo sapiens
acatgagcatcaggccag

SEQ ID NO: 5137237 - DNA, 19 bp, Homo sapiens
acatgagcatcaggccagg

SEQ ID NO: 5137238 - DNA, 23 bp, Homo sapiens
acatgagctatttccattccaga

SEQ ID NO: 5137239 - DNA, 19 bp, Homo sapiens
acatgaggactcatatatt

SEQ ID NO: 5137240 - DNA, 13 bp, Homo sapiens
acatgaggactct

SEQ ID NO: 5137241 - DNA, 15 bp, Homo sapiens
acatgaggagggtgc

SEQ ID NO: 5137242 - DNA, 21 bp, Homo sapiens
acatgaggccatctcaggaga

SEQ ID NO: 5137243 - DNA, 16 bp, Homo sapiens
acatgaggggacattt

SEQ ID NO: 5137244 - DNA, 16 bp, Homo sapiens
acatgaggtactgaga

SEQ ID NO: 5137245 - DNA, 16 bp, Homo sapiens
acatgagtcaaaacaa

SEQ ID NO: 5137246 - DNA, 17 bp, Homo sapiens
acatgagtcaaaacaaa

SEQ ID NO: 5137247 - DNA, 16 bp, Homo sapiens
acatgagtctgtagga

SEQ ID NO: 5137248 - DNA, 13 bp, Homo sapiens
acatgagttcaaa

SEQ ID NO: 5137249 - DNA, 14 bp, Homo sapiens
acatgatacatttt

SEQ ID NO: 5137250 - DNA, 15 bp, Homo sapiens
acatgatacccctta

SEQ ID NO: 5137251 - DNA, 23 bp, Homo sapiens
acatgatactgctgcttgtcaaa

SEQ ID NO: 5137252 - DNA, 18 bp, Homo sapiens
acatgatccccgtctctg

SEQ ID NO: 5137253 - DNA, 16 bp, Homo sapiens
acatgatgatttcaga

SEQ ID NO: 5137254 - DNA, 23 bp, Homo sapiens
acatgatgcttttactgaacttt

SEQ ID NO: 5137255 - DNA, 15 bp, Homo sapiens
acatgatgggcctga

SEQ ID NO: 5137256 - DNA, 13 bp, Homo sapiens
acatgattcattt

SEQ ID NO: 5137257 - DNA, 19 bp, Homo sapiens
acatgattgtataagcatg

SEQ ID NO: 5137258 - DNA, 17 bp, Homo sapiens
acatgatttaaagacta

SEQ ID NO: 5137259 - DNA, 23 bp, Homo sapiens
acatgatttaaagactacaataa

SEQ ID NO: 5137260 - DNA, 12 bp, Homo sapiens
acatgatttcac

SEQ ID NO: 5137261 - DNA, 18 bp, Homo sapiens
acatgatttcacaaatat

SEQ ID NO: 5137262 - DNA, 19 bp, Homo sapiens
acatgatttcacaaatatt

SEQ ID NO: 5137263 - DNA, 16 bp, Homo sapiens
acatgatttccttgaa

SEQ ID NO: 5137264 - DNA, 13 bp, Homo sapiens
acatgattttctt

SEQ ID NO: 5137265 - DNA, 18 bp, Homo sapiens
acatgcaaaaagaaatga

SEQ ID NO: 5137266 - DNA, 16 bp, Homo sapiens
acatgcaacaaaaatg

SEQ ID NO: 5137267 - DNA, 17 bp, Homo sapiens
acatgcaaggtcatttt

SEQ ID NO: 5137268 - DNA, 11 bp, Homo sapiens
acatgcaataa

SEQ ID NO: 5137269 - DNA, 13 bp, Homo sapiens
acatgcaataaaa

SEQ ID NO: 5137270 - DNA, 14 bp, Homo sapiens
acatgcaataaaat

SEQ ID NO: 5137271 - DNA, 13 bp, Homo sapiens
acatgcaataaca

SEQ ID NO: 5137272 - DNA, 21 bp, Homo sapiens
acatgcaataacaagcatgca

SEQ ID NO: 5137273 - DNA, 22 bp, Homo sapiens
acatgcaattggggaagaaaaa

SEQ ID NO: 5137274 - DNA, 12 bp, Homo sapiens
acatgcacacac

SEQ ID NO: 5137275 - DNA, 13 bp, Homo sapiens
acatgcacacaca

SEQ ID NO: 5137276 - DNA, 17 bp, Homo sapiens
acatgcacacacacaca

SEQ ID NO: 5137277 - DNA, 18 bp, Homo sapiens
acatgcacacgggcgagc

SEQ ID NO: 5137278 - DNA, 18 bp, Homo sapiens
acatgcacagtcatacaa

SEQ ID NO: 5137279 - DNA, 12 bp, Homo sapiens
acatgcacagtt

SEQ ID NO: 5137280 - DNA, 23 bp, Homo sapiens
acatgcacattcatcctcacatg

SEQ ID NO: 5137281 - DNA, 17 bp, Homo sapiens
acaggcgggctcggagg

SEQ ID NO: 5137282 - DNA, 14 bp, Homo sapiens
acaggcggggccca

SEQ ID NO: 5137283 - DNA, 15 bp, Homo sapiens
acaggcggggcccag

SEQ ID NO: 5137284 - DNA, 19 bp, Homo sapiens
acaggcgtgagccacctcg

SEQ ID NO: 5137285 - DNA, 18 bp, Homo sapiens
acaggctacaaagcagag

SEQ ID NO: 5137286 - DNA, 21 bp, Homo sapiens
acaggctatcaacatgttatt

SEQ ID NO: 5137287 - DNA, 13 bp, Homo sapiens
acaggctcagcat

SEQ ID NO: 5137288 - DNA, 16 bp, Homo sapiens
acaggctcaggcaggg

SEQ ID NO: 5137289 - DNA, 20 bp, Homo sapiens
acaggctcgtcagccacctg

SEQ ID NO: 5137290 - DNA, 23 bp, Homo sapiens
acaggctcgtcagccacctggga

SEQ ID NO: 5137291 - DNA, 17 bp, Homo sapiens
acaggctctagagagag

SEQ ID NO: 5137292 - DNA, 13 bp, Homo sapiens
acaggctctgaga

SEQ ID NO: 5137293 - DNA, 19 bp, Homo sapiens
acaggctcttagcagcttc

SEQ ID NO: 5137294 - DNA, 13 bp, Homo sapiens
acaggctcttctt

SEQ ID NO: 5137295 - DNA, 17 bp, Homo sapiens
acaggctcttctttccc

SEQ ID NO: 5137296 - DNA, 14 bp, Homo sapiens
acaggctgaagaga

SEQ ID NO: 5137297 - DNA, 20 bp, Homo sapiens
acaggctgacgttccgggca

SEQ ID NO: 5137298 - DNA, 13 bp, Homo sapiens
acaggctgagctt

SEQ ID NO: 5137299 - DNA, 22 bp, Homo sapiens
acaggctgagctttctagccta

SEQ ID NO: 5137300 - DNA, 18 bp, Homo sapiens
acaggctgagtgcaggcc

SEQ ID NO: 5137301 - DNA, 22 bp, Homo sapiens
acaggctgagtgcaggcccacc

SEQ ID NO: 5137302 - DNA, 20 bp, Homo sapiens
acaggctgccccacccctcc

SEQ ID NO: 5137303 - DNA, 21 bp, Homo sapiens
acaggctggaagatagctgtg

SEQ ID NO: 5137304 - DNA, 15 bp, Homo sapiens
acaggctggcattct

SEQ ID NO: 5137305 - DNA, 17 bp, Homo sapiens
acaggctgggcttcagt

SEQ ID NO: 5137306 - DNA, 13 bp, Homo sapiens
acaggctgggtcc

SEQ ID NO: 5137307 - DNA, 16 bp, Homo sapiens
acaggctgggtcctgc

SEQ ID NO: 5137308 - DNA, 19 bp, Homo sapiens
acaggctgggtcctgccag

SEQ ID NO: 5137309 - DNA, 18 bp, Homo sapiens
acaggctggtatttaaca

SEQ ID NO: 5137310 - DNA, 18 bp, Homo sapiens
acaggctgtaaattgaac

SEQ ID NO: 5137311 - DNA, 14 bp, Homo sapiens
acaggctgtcctta

SEQ ID NO: 5137312 - DNA, 20 bp, Homo sapiens
acaggctgtgactcttctct

SEQ ID NO: 5137313 - DNA, 22 bp, Homo sapiens
acaggctgtgactcttctctca

SEQ ID NO: 5137314 - DNA, 22 bp, Homo sapiens
acaggctgtgccttggtttcct

SEQ ID NO: 5137315 - DNA, 13 bp, Homo sapiens
acaggctgtgtgt

SEQ ID NO: 5137316 - DNA, 21 bp, Homo sapiens
acaggcttatttttaaaataa

SEQ ID NO: 5137317 - DNA, 17 bp, Homo sapiens
acaggcttctgagcagc

SEQ ID NO: 5137318 - DNA, 18 bp, Homo sapiens
acaggcttctgagcagcg

SEQ ID NO: 5137319 - DNA, 23 bp, Homo sapiens
acaggcttctgagcagcgagcct

SEQ ID NO: 5137320 - DNA, 18 bp, Homo sapiens
acagggaaaaaaagaaaa

SEQ ID NO: 5137321 - DNA, 14 bp, Homo sapiens
acagggaaaatata

SEQ ID NO: 5137322 - DNA, 21 bp, Homo sapiens
acagggaaagcatttaggaga

SEQ ID NO: 5137323 - DNA, 22 bp, Homo sapiens
acagggaaagcatttaggagaa

SEQ ID NO: 5137324 - DNA, 22 bp, Homo sapiens
acagggaaccctgcttgcactt

SEQ ID NO: 5137325 - DNA, 23 bp, Homo sapiens
acagggaagaaactttctggtgc

SEQ ID NO: 5137326 - DNA, 14 bp, Homo sapiens
acagggaagctaca

SEQ ID NO: 5137327 - DNA, 17 bp, Homo sapiens
acagggaaggcaggcag

SEQ ID NO: 5137328 - DNA, 15 bp, Homo sapiens
acagggaagggcttg

SEQ ID NO: 5137329 - DNA, 22 bp, Homo sapiens
acagggaatgcctgagtgcctg

SEQ ID NO: 5137330 - DNA, 16 bp, Homo sapiens
acagggaatggccaca

SEQ ID NO: 5137331 - DNA, 22 bp, Homo sapiens
acagggaattaggcccccatca

SEQ ID NO: 5137332 - DNA, 20 bp, Homo sapiens
acagggacatgccctgtgtg

SEQ ID NO: 5137333 - DNA, 12 bp, Homo sapiens
acagggaccaca

SEQ ID NO: 5137334 - DNA, 22 bp, Homo sapiens
acagggactgaaaacctctcct

SEQ ID NO: 5137335 - DNA, 13 bp, Homo sapiens
acagggacttgaa

SEQ ID NO: 5137336 - DNA, 18 bp, Homo sapiens
acagggacttgtttagag

SEQ ID NO: 5137337 - DNA, 20 bp, Homo sapiens
acagggacttgtttagagag

SEQ ID NO: 5137338 - DNA, 22 bp, Homo sapiens
acagggacttgtttagagagcc

SEQ ID NO: 5137339 - DNA, 23 bp, Homo sapiens
acagggagaaaatccaggtcatg

SEQ ID NO: 5137340 - DNA, 18 bp, Homo sapiens
acagggagaagtagctag

SEQ ID NO: 5137341 - DNA, 12 bp, Homo sapiens
acagggagccac

SEQ ID NO: 5137342 - DNA, 14 bp, Homo sapiens
acagggagcctcct

SEQ ID NO: 5137343 - DNA, 15 bp, Homo sapiens
acagggagcctcctg

SEQ ID NO: 5137344 - DNA, 21 bp, Homo sapiens
acagggaggacgctctctggc

SEQ ID NO: 5137345 - DNA, 16 bp, Homo sapiens
acagggaggattgaaa

SEQ ID NO: 5137346 - DNA, 13 bp, Homo sapiens
acagggaggctcc

SEQ ID NO: 5137347 - DNA, 16 bp, Homo sapiens
acagggaggctcccgg

SEQ ID NO: 5137348 - DNA, 17 bp, Homo sapiens
acagggagggggacctg

SEQ ID NO: 5137349 - DNA, 22 bp, Homo sapiens
acagggagggggacctgtcccc

SEQ ID NO: 5137350 - DNA, 18 bp, Homo sapiens
acagggataaggcctgtg

SEQ ID NO: 5137351 - DNA, 15 bp, Homo sapiens
acagggataccttaa

SEQ ID NO: 5137352 - DNA, 23 bp, Homo sapiens
acagggatgagcatggagctggc

SEQ ID NO: 5137353 - DNA, 15 bp, Homo sapiens
acagggattctcaca

SEQ ID NO: 5137354 - DNA, 16 bp, Homo sapiens
acagggattgatttta

SEQ ID NO: 5137355 - DNA, 22 bp, Homo sapiens
acagggattgattttaaaatgt

SEQ ID NO: 5137356 - DNA, 13 bp, Homo sapiens
acagggcacaggc

SEQ ID NO: 5137357 - DNA, 17 bp, Homo sapiens
acagggcagctgggccc

SEQ ID NO: 5137358 - DNA, 18 bp, Homo sapiens
acagggcaggagctgctg

SEQ ID NO: 5137359 - DNA, 11 bp, Homo sapiens
acagggcaggc

SEQ ID NO: 5137360 - DNA, 16 bp, Homo sapiens
acagggcaggccttgc

SEQ ID NO: 5137361 - DNA, 23 bp, Homo sapiens
acagggcagtccttactccccca

SEQ ID NO: 5137362 - DNA, 20 bp, Homo sapiens
acagggcagtgacaagtgga

SEQ ID NO: 5137363 - DNA, 21 bp, Homo sapiens
acagggcatctccaggaaggc

SEQ ID NO: 5137364 - DNA, 16 bp, Homo sapiens
acagggcatgaaatga

SEQ ID NO: 5137365 - DNA, 22 bp, Homo sapiens
acagggcatgccccggccacct

SEQ ID NO: 5137366 - DNA, 14 bp, Homo sapiens
acagggcatgcctg

SEQ ID NO: 5137367 - DNA, 13 bp, Homo sapiens
acagggccagagg

SEQ ID NO: 5137368 - DNA, 15 bp, Homo sapiens
acagggccagaggga

SEQ ID NO: 5137369 - DNA, 17 bp, Homo sapiens
acagggccagtgcagtt

SEQ ID NO: 5137370 - DNA, 21 bp, Homo sapiens
acagggccagtggggcctgtg

SEQ ID NO: 5137371 - DNA, 19 bp, Homo sapiens
acagggccatgtgctgccc

SEQ ID NO: 5137372 - DNA, 18 bp, Homo sapiens
acagggcccgcagtgctg

SEQ ID NO: 5137373 - DNA, 21 bp, Homo sapiens
acagggcccgcagtgctggga

SEQ ID NO: 5137374 - DNA, 19 bp, Homo sapiens
acagggcccgggcccaggc

SEQ ID NO: 5137375 - DNA, 19 bp, Homo sapiens
acagggccctggagctcag

SEQ ID NO: 5137376 - DNA, 13 bp, Homo sapiens
acagggcctctgc

SEQ ID NO: 5137377 - DNA, 13 bp, Homo sapiens
acagggcctgact

SEQ ID NO: 5137378 - DNA, 23 bp, Homo sapiens
acagggcctgacttttacagctt

SEQ ID NO: 5137379 - DNA, 16 bp, Homo sapiens
acagggcctggcccat

SEQ ID NO: 5137380 - DNA, 17 bp, Homo sapiens
acagggcctggcccatg

SEQ ID NO: 5137381 - DNA, 17 bp, Homo sapiens
acagggctcacagggca

SEQ ID NO: 5137382 - DNA, 20 bp, Homo sapiens
acagggctcacagggcaggc

SEQ ID NO: 5137383 - DNA, 15 bp, Homo sapiens
acagggctccagcct

SEQ ID NO: 5137384 - DNA, 16 bp, Homo sapiens
acagggctccagcctg

SEQ ID NO: 5137385 - DNA, 12 bp, Homo sapiens
acagggctcttt

SEQ ID NO: 5137386 - DNA, 14 bp, Homo sapiens
acagggctggccca

SEQ ID NO: 5137387 - DNA, 17 bp, Homo sapiens
acagggctggcccagcc

SEQ ID NO: 5137388 - DNA, 19 bp, Homo sapiens
acagggctggcccagccct

SEQ ID NO: 5137389 - DNA, 22 bp, Homo sapiens
acagggctggcccagccctgct

SEQ ID NO: 5137390 - DNA, 15 bp, Homo sapiens
acagggctgggagaa

SEQ ID NO: 5137391 - DNA, 19 bp, Homo sapiens
acagggctgggagaagaaa

SEQ ID NO: 5137392 - DNA, 19 bp, Homo sapiens
acagggctgttttgcctcc

SEQ ID NO: 5137393 - DNA, 22 bp, Homo sapiens
acagggctgttttgcctcccca

SEQ ID NO: 5137394 - DNA, 14 bp, Homo sapiens
acagggcttctctt

SEQ ID NO: 5137395 - DNA, 15 bp, Homo sapiens
acagggcttctcttt

SEQ ID NO: 5137396 - DNA, 15 bp, Homo sapiens
acaggggacactgaa

SEQ ID NO: 5137397 - DNA, 19 bp, Homo sapiens
acaggggaggaaaaaagaa

SEQ ID NO: 5137398 - DNA, 20 bp, Homo sapiens
acaggggaggggcgcacccc

SEQ ID NO: 5137399 - DNA, 15 bp, Homo sapiens
acaggggcaggagga

SEQ ID NO: 5137400 - DNA, 14 bp, Homo sapiens
acaggggcaggcct

SEQ ID NO: 5137401 - DNA, 16 bp, Homo sapiens
acaggggcaggcctgg

SEQ ID NO: 5137402 - DNA, 20 bp, Homo sapiens
acaggggcaggcctgggacc

SEQ ID NO: 5137403 - DNA, 17 bp, Homo sapiens
acaggggccagaagatg

SEQ ID NO: 5137404 - DNA, 11 bp, Homo sapiens
acaggggccat

SEQ ID NO: 5137405 - DNA, 17 bp, Homo sapiens
acaggggccctgtacag

SEQ ID NO: 5137406 - DNA, 18 bp, Homo sapiens
acaggggccctgtacagt

SEQ ID NO: 5137407 - DNA, 22 bp, Homo sapiens
acaggggcgtgaggtcccagga

SEQ ID NO: 5137408 - DNA, 20 bp, Homo sapiens
acaggggctatcccttctca

SEQ ID NO: 5137409 - DNA, 21 bp, Homo sapiens
acaggggctatcccttctcag

SEQ ID NO: 5137410 - DNA, 13 bp, Homo sapiens
acaggggctcagg

SEQ ID NO: 5137411 - DNA, 16 bp, Homo sapiens
acaggggctggagggc

SEQ ID NO: 5137412 - DNA, 19 bp, Homo sapiens
acagggggattctgagcag

SEQ ID NO: 5137413 - DNA, 19 bp, Homo sapiens
acaggggggtcggaagcct

SEQ ID NO: 5137414 - DNA, 20 bp, Homo sapiens
acaggggggtcggaagcctg

SEQ ID NO: 5137415 - DNA, 16 bp, Homo sapiens
acagggggtctggctg

SEQ ID NO: 5137416 - DNA, 21 bp, Homo sapiens
acagggggtctggctggtgtt

SEQ ID NO: 5137417 - DNA, 20 bp, Homo sapiens
acaggggtggagtttctgac

SEQ ID NO: 5137418 - DNA, 19 bp, Homo sapiens
acaggggttagcctggact

SEQ ID NO: 5137419 - DNA, 21 bp, Homo sapiens
acaggggttccttctgggcat

SEQ ID NO: 5137420 - DNA, 21 bp, Homo sapiens
acagggtaactaactaaaaca

SEQ ID NO: 5137421 - DNA, 18 bp, Homo sapiens
acagggtactaaaagaaa

SEQ ID NO: 5137422 - DNA, 17 bp, Homo sapiens
acagggtagatttctct

SEQ ID NO: 5137423 - DNA, 23 bp, Homo sapiens
acagggtcaactggcgaagcctg

SEQ ID NO: 5137424 - DNA, 17 bp, Homo sapiens
acagggtccctggatca

SEQ ID NO: 5137425 - DNA, 18 bp, Homo sapiens
acagggtctcactctgtc

SEQ ID NO: 5137426 - DNA, 15 bp, Homo sapiens
acagggtctcactgt

SEQ ID NO: 5137427 - DNA, 14 bp, Homo sapiens
acagggtctcccta

SEQ ID NO: 5137428 - DNA, 19 bp, Homo sapiens
acagggtctctagtgctgt

SEQ ID NO: 5137429 - DNA, 15 bp, Homo sapiens
acagggtctgctctt

SEQ ID NO: 5137430 - DNA, 23 bp, Homo sapiens
acagggtctgctctttctctgcc

SEQ ID NO: 5137431 - DNA, 16 bp, Homo sapiens
acagggtcttgctctg

SEQ ID NO: 5137432 - DNA, 21 bp, Homo sapiens
acagggtggcccaaatagaac

SEQ ID NO: 5137433 - DNA, 13 bp, Homo sapiens
acagggtgggagg

SEQ ID NO: 5137434 - DNA, 15 bp, Homo sapiens
acagggtgggaggga

SEQ ID NO: 5137435 - DNA, 18 bp, Homo sapiens
acagggtgggagggagga

SEQ ID NO: 5137436 - DNA, 21 bp, Homo sapiens
acagggtgggatgagcctctc

SEQ ID NO: 5137437 - DNA, 18 bp, Homo sapiens
acagggtgggcttcctgc

SEQ ID NO: 5137438 - DNA, 21 bp, Homo sapiens
acagggtgggcttcctgccct

SEQ ID NO: 5137439 - DNA, 14 bp, Homo sapiens
acagggttgggccc

SEQ ID NO: 5137440 - DNA, 15 bp, Homo sapiens
acagggtttcaccat

SEQ ID NO: 5137441 - DNA, 14 bp, Homo sapiens
acagggttttgtat

SEQ ID NO: 5137442 - DNA, 20 bp, Homo sapiens
acagggtttttacctgtcac

SEQ ID NO: 5137443 - DNA, 13 bp, Homo sapiens
acaggtaaacaca

SEQ ID NO: 5137444 - DNA, 15 bp, Homo sapiens
acaggtaacattata

SEQ ID NO: 5137445 - DNA, 14 bp, Homo sapiens
acaggtaaccacaa

SEQ ID NO: 5137446 - DNA, 15 bp, Homo sapiens
acaggtaaccacaat

SEQ ID NO: 5137447 - DNA, 15 bp, Homo sapiens
acaggtaactaattg

SEQ ID NO: 5137448 - DNA, 17 bp, Homo sapiens
acaggtaactaattgga

SEQ ID NO: 5137449 - DNA, 16 bp, Homo sapiens
acaggtaagtggcagg

SEQ ID NO: 5137450 - DNA, 15 bp, Homo sapiens
acaggtacagcaaca

SEQ ID NO: 5137451 - DNA, 15 bp, Homo sapiens
acaggtactttgtct

SEQ ID NO: 5137452 - DNA, 13 bp, Homo sapiens
acaggtagcacag

SEQ ID NO: 5137453 - DNA, 14 bp, Homo sapiens
acaggtagcacaga

SEQ ID NO: 5137454 - DNA, 14 bp, Homo sapiens
acaggtcaaatgct

SEQ ID NO: 5137455 - DNA, 12 bp, Homo sapiens
acaggtcaataa

SEQ ID NO: 5137456 - DNA, 13 bp, Homo sapiens
acaggtcagggct

SEQ ID NO: 5137457 - DNA, 19 bp, Homo sapiens
acaggtcaggggtgacaca

SEQ ID NO: 5137458 - DNA, 20 bp, Homo sapiens
acaggtcaggggtgacacag

SEQ ID NO: 5137459 - DNA, 15 bp, Homo sapiens
acatgcacatttata

SEQ ID NO: 5137460 - DNA, 15 bp, Homo sapiens
acatgcacattttgt

SEQ ID NO: 5137461 - DNA, 18 bp, Homo sapiens
acatgcacattttgtaca

SEQ ID NO: 5137462 - DNA, 19 bp, Homo sapiens
acatgcacccgcatgtaca

SEQ ID NO: 5137463 - DNA, 12 bp, Homo sapiens
acatgcaccctg

SEQ ID NO: 5137464 - DNA, 23 bp, Homo sapiens
acatgcactactgaaatttacac

SEQ ID NO: 5137465 - DNA, 13 bp, Homo sapiens
acatgcactgacc

SEQ ID NO: 5137466 - DNA, 18 bp, Homo sapiens
acatgcactgacccttcc

SEQ ID NO: 5137467 - DNA, 18 bp, Homo sapiens
acatgcacttttgggcct

SEQ ID NO: 5137468 - DNA, 15 bp, Homo sapiens
acatgcagaaattga

SEQ ID NO: 5137469 - DNA, 20 bp, Homo sapiens
acatgcagaataatcctgtt

SEQ ID NO: 5137470 - DNA, 17 bp, Homo sapiens
acatgcagcccatgccc

SEQ ID NO: 5137471 - DNA, 20 bp, Homo sapiens
acatgcagcccatgcccacc

SEQ ID NO: 5137472 - DNA, 16 bp, Homo sapiens
acatgcagctctgatg

SEQ ID NO: 5137473 - DNA, 17 bp, Homo sapiens
acatgcagttatatatt

SEQ ID NO: 5137474 - DNA, 11 bp, Homo sapiens
acatgcagttt

SEQ ID NO: 5137475 - DNA, 22 bp, Homo sapiens
acatgcataaaaattaaatgga

SEQ ID NO: 5137476 - DNA, 20 bp, Homo sapiens
acatgcataaactaaaaact

SEQ ID NO: 5137477 - DNA, 12 bp, Homo sapiens
acatgcatacac

SEQ ID NO: 5137478 - DNA, 17 bp, Homo sapiens
acatgcatacacacaca

SEQ ID NO: 5137479 - DNA, 18 bp, Homo sapiens
acatgcatataatgaata

SEQ ID NO: 5137480 - DNA, 23 bp, Homo sapiens
acatgcatccatttactgacact

SEQ ID NO: 5137481 - DNA, 14 bp, Homo sapiens
acatgcatgtctgc

SEQ ID NO: 5137482 - DNA, 18 bp, Homo sapiens
acatgcatgttctcctct

SEQ ID NO: 5137483 - DNA, 12 bp, Homo sapiens
acatgcattcta

SEQ ID NO: 5137484 - DNA, 12 bp, Homo sapiens
acatgcattgtt

SEQ ID NO: 5137485 - DNA, 13 bp, Homo sapiens
acatgcattgttg

SEQ ID NO: 5137486 - DNA, 23 bp, Homo sapiens
acatgcattgttggctatttgaa

SEQ ID NO: 5137487 - DNA, 19 bp, Homo sapiens
acatgcattttatcagaca

SEQ ID NO: 5137488 - DNA, 21 bp, Homo sapiens
acatgccaacacttaatcatt

SEQ ID NO: 5137489 - DNA, 18 bp, Homo sapiens
acatgccaagcactgtgc

SEQ ID NO: 5137490 - DNA, 14 bp, Homo sapiens
acatgccacaagga

SEQ ID NO: 5137491 - DNA, 21 bp, Homo sapiens
acatgccaccctctccatgcc

SEQ ID NO: 5137492 - DNA, 14 bp, Homo sapiens
acatgccactgcct

SEQ ID NO: 5137493 - DNA, 18 bp, Homo sapiens
acatgccactgcctgcac

SEQ ID NO: 5137494 - DNA, 23 bp, Homo sapiens
acatgccactgcctgcacctttc

SEQ ID NO: 5137495 - DNA, 21 bp, Homo sapiens
acatgccagaaggaatcttct

SEQ ID NO: 5137496 - DNA, 15 bp, Homo sapiens
acatgccagcttcct

SEQ ID NO: 5137497 - DNA, 19 bp, Homo sapiens
acatgccatccttccagca

SEQ ID NO: 5137498 - DNA, 18 bp, Homo sapiens
acatgccatttgtactga

SEQ ID NO: 5137499 - DNA, 16 bp, Homo sapiens
acatgcccaaaactta

SEQ ID NO: 5137500 - DNA, 21 bp, Homo sapiens
acatgcccatcccagtgtcct

SEQ ID NO: 5137501 - DNA, 16 bp, Homo sapiens
acatgccccctccctt

SEQ ID NO: 5137502 - DNA, 18 bp, Homo sapiens
acatgcccctcccccagc

SEQ ID NO: 5137503 - DNA, 19 bp, Homo sapiens
acatgcccctcccccagct

SEQ ID NO: 5137504 - DNA, 17 bp, Homo sapiens
acatgccccttggtcct

SEQ ID NO: 5137505 - DNA, 15 bp, Homo sapiens
acatgccctcaggct

SEQ ID NO: 5137506 - DNA, 17 bp, Homo sapiens
acatgccctcaggcttg

SEQ ID NO: 5137507 - DNA, 19 bp, Homo sapiens
acatgccctcaggcttggg

SEQ ID NO: 5137508 - DNA, 21 bp, Homo sapiens
acatgccctcccttctccctg

SEQ ID NO: 5137509 - DNA, 14 bp, Homo sapiens
acatgccctgtgtg

SEQ ID NO: 5137510 - DNA, 20 bp, Homo sapiens
acatgccgcgtccctgcccc

SEQ ID NO: 5137511 - DNA, 14 bp, Homo sapiens
acatgcctaccaat

SEQ ID NO: 5137512 - DNA, 11 bp, Homo sapiens
acatgcctcaa

SEQ ID NO: 5137513 - DNA, 15 bp, Homo sapiens
acatgcctctctcag

SEQ ID NO: 5137514 - DNA, 16 bp, Homo sapiens
acatgcctctctcagg

SEQ ID NO: 5137515 - DNA, 15 bp, Homo sapiens
acatgcctctgtaga

SEQ ID NO: 5137516 - DNA, 18 bp, Homo sapiens
acatgcctgattttaaaa

SEQ ID NO: 5137517 - DNA, 11 bp, Homo sapiens
acatgcctgca

SEQ ID NO: 5137518 - DNA, 22 bp, Homo sapiens
acatgcctgccccaaacaaata

SEQ ID NO: 5137519 - DNA, 14 bp, Homo sapiens
acatgcctgcgcct

SEQ ID NO: 5137520 - DNA, 22 bp, Homo sapiens
acatgcctgcgcctgctgcctg

SEQ ID NO: 5137521 - DNA, 12 bp, Homo sapiens
acatgcctgtcc

SEQ ID NO: 5137522 - DNA, 14 bp, Homo sapiens
acatgcctgtcctg

SEQ ID NO: 5137523 - DNA, 18 bp, Homo sapiens
acatgcctgtcctgaaag

SEQ ID NO: 5137524 - DNA, 19 bp, Homo sapiens
acatgcctgtcctgaaagc

SEQ ID NO: 5137525 - DNA, 17 bp, Homo sapiens
acatgccttatatttgt

SEQ ID NO: 5137526 - DNA, 13 bp, Homo sapiens
acatgccttggtg

SEQ ID NO: 5137527 - DNA, 17 bp, Homo sapiens
acatgcctttccagtgc

SEQ ID NO: 5137528 - DNA, 17 bp, Homo sapiens
acatgcggagaacaaat

SEQ ID NO: 5137529 - DNA, 18 bp, Homo sapiens
acatgcggtagccagcac

SEQ ID NO: 5137530 - DNA, 14 bp, Homo sapiens
acatgcgtgtgtca

SEQ ID NO: 5137531 - DNA, 15 bp, Homo sapiens
acatgctaaataact

SEQ ID NO: 5137532 - DNA, 17 bp, Homo sapiens
acatgctaaatagttct

SEQ ID NO: 5137533 - DNA, 22 bp, Homo sapiens
acatgctacacactgcatgttt

SEQ ID NO: 5137534 - DNA, 16 bp, Homo sapiens
acatgctactaaattt

SEQ ID NO: 5137535 - DNA, 15 bp, Homo sapiens
acatgctatgttctg

SEQ ID NO: 5137536 - DNA, 23 bp, Homo sapiens
acatgctatgttctgtcttccca

SEQ ID NO: 5137537 - DNA, 14 bp, Homo sapiens
acatgctattgtct

SEQ ID NO: 5137538 - DNA, 16 bp, Homo sapiens
acatgctattgtctga

SEQ ID NO: 5137539 - DNA, 13 bp, Homo sapiens
acatgctcacaca

SEQ ID NO: 5137540 - DNA, 15 bp, Homo sapiens
acatgctcacacatt

SEQ ID NO: 5137541 - DNA, 19 bp, Homo sapiens
acatgctcacctctagcct

SEQ ID NO: 5137542 - DNA, 20 bp, Homo sapiens
acatgctcacctctagcctt

SEQ ID NO: 5137543 - DNA, 22 bp, Homo sapiens
acatgctcatcccaaaagctag

SEQ ID NO: 5137544 - DNA, 21 bp, Homo sapiens
acatgctgaacatcacagctt

SEQ ID NO: 5137545 - DNA, 19 bp, Homo sapiens
acatgctgaggttttgaat

SEQ ID NO: 5137546 - DNA, 20 bp, Homo sapiens
acatgctgaggttttgaata

SEQ ID NO: 5137547 - DNA, 13 bp, Homo sapiens
acatgctgcccac

SEQ ID NO: 5137548 - DNA, 16 bp, Homo sapiens
acatgctgcctggcac

SEQ ID NO: 5137549 - DNA, 15 bp, Homo sapiens
acatgctggaaataa

SEQ ID NO: 5137550 - DNA, 20 bp, Homo sapiens
acatgctggaaataaaacag

SEQ ID NO: 5137551 - DNA, 21 bp, Homo sapiens
acatgctggaaataaaacagc

SEQ ID NO: 5137552 - DNA, 23 bp, Homo sapiens
acatgctggttacctgttccatt

SEQ ID NO: 5137553 - DNA, 19 bp, Homo sapiens
acatgctgtacatactttt

SEQ ID NO: 5137554 - DNA, 20 bp, Homo sapiens
acatgctgtacatacttttt

SEQ ID NO: 5137555 - DNA, 21 bp, Homo sapiens
acatgctgtacatactttttg

SEQ ID NO: 5137556 - DNA, 21 bp, Homo sapiens
acatgctgtactaaaatatgc

SEQ ID NO: 5137557 - DNA, 18 bp, Homo sapiens
acatgctgtctggccctg

SEQ ID NO: 5137558 - DNA, 16 bp, Homo sapiens
acatgctgtgctcttt

SEQ ID NO: 5137559 - DNA, 21 bp, Homo sapiens
acatgctgtgtaagctgtgtc

SEQ ID NO: 5137560 - DNA, 16 bp, Homo sapiens
acatgcttacttttta

SEQ ID NO: 5137561 - DNA, 17 bp, Homo sapiens
acatgcttactttttaa

SEQ ID NO: 5137562 - DNA, 20 bp, Homo sapiens
acatgcttactttttaattt

SEQ ID NO: 5137563 - DNA, 19 bp, Homo sapiens
acatgcttagcagtcccct

SEQ ID NO: 5137564 - DNA, 19 bp, Homo sapiens
acatgcttagcttatcttt

SEQ ID NO: 5137565 - DNA, 22 bp, Homo sapiens
acatgcttattccatgactgct

SEQ ID NO: 5137566 - DNA, 23 bp, Homo sapiens
acatgcttattccatgactgctt

SEQ ID NO: 5137567 - DNA, 15 bp, Homo sapiens
acatgcttcaatagt

SEQ ID NO: 5137568 - DNA, 23 bp, Homo sapiens
acatgcttcaatagttcaaggaa

SEQ ID NO: 5137569 - DNA, 22 bp, Homo sapiens
acatgcttgttgacagagagag

SEQ ID NO: 5137570 - DNA, 13 bp, Homo sapiens
acatgcttttcca

SEQ ID NO: 5137571 - DNA, 16 bp, Homo sapiens
acatgcttttcttcct

SEQ ID NO: 5137572 - DNA, 23 bp, Homo sapiens
acatggaaaacagagtatttctg

SEQ ID NO: 5137573 - DNA, 14 bp, Homo sapiens
acatggaaaagaag

SEQ ID NO: 5137574 - DNA, 21 bp, Homo sapiens
acatggaaacccataggccca

SEQ ID NO: 5137575 - DNA, 21 bp, Homo sapiens
acatggaaagggtcttccttc

SEQ ID NO: 5137576 - DNA, 14 bp, Homo sapiens
acatggaacagtgt

SEQ ID NO: 5137577 - DNA, 17 bp, Homo sapiens
acatggaactcattcct

SEQ ID NO: 5137578 - DNA, 17 bp, Homo sapiens
acatggaacttaaaaca

SEQ ID NO: 5137579 - DNA, 18 bp, Homo sapiens
acatggaacttaaaacat

SEQ ID NO: 5137580 - DNA, 18 bp, Homo sapiens
acatggaagaagtatatt

SEQ ID NO: 5137581 - DNA, 14 bp, Homo sapiens
acatggaagagaga

SEQ ID NO: 5137582 - DNA, 15 bp, Homo sapiens
acatggaagatattc

SEQ ID NO: 5137583 - DNA, 18 bp, Homo sapiens
acatggaataacatgtaa

SEQ ID NO: 5137584 - DNA, 20 bp, Homo sapiens
acatggaatctacatgtgtt

SEQ ID NO: 5137585 - DNA, 23 bp, Homo sapiens
acatggaatctacatgtgtttga

SEQ ID NO: 5137586 - DNA, 19 bp, Homo sapiens
acatggaatgagggtttga

SEQ ID NO: 5137587 - DNA, 18 bp, Homo sapiens
acatggaattttttgaat

SEQ ID NO: 5137588 - DNA, 19 bp, Homo sapiens
acatggaattttttgaata

SEQ ID NO: 5137589 - DNA, 13 bp, Homo sapiens
acatggacacaga

SEQ ID NO: 5137590 - DNA, 21 bp, Homo sapiens
acatggacagacttcacagcg

SEQ ID NO: 5137591 - DNA, 16 bp, Homo sapiens
acatggaccagcatct

SEQ ID NO: 5137592 - DNA, 23 bp, Homo sapiens
acatggacccaagataaaagaat

SEQ ID NO: 5137593 - DNA, 16 bp, Homo sapiens
acatggacccactacc

SEQ ID NO: 5137594 - DNA, 12 bp, Homo sapiens
acatggacccgg

SEQ ID NO: 5137595 - DNA, 18 bp, Homo sapiens
acatggaccttctctcca

SEQ ID NO: 5137596 - DNA, 21 bp, Homo sapiens
acatggaccttctctccagag

SEQ ID NO: 5137597 - DNA, 17 bp, Homo sapiens
acatggactttggaaaa

SEQ ID NO: 5137598 - DNA, 21 bp, Homo sapiens
acatggagactcctgccctgt

SEQ ID NO: 5137599 - DNA, 13 bp, Homo sapiens
acatggagagaga

SEQ ID NO: 5137600 - DNA, 13 bp, Homo sapiens
acatggagatgta

SEQ ID NO: 5137601 - DNA, 14 bp, Homo sapiens
acatggagctcagg

SEQ ID NO: 5137602 - DNA, 15 bp, Homo sapiens
acatggagctcaggt

SEQ ID NO: 5137603 - DNA, 18 bp, Homo sapiens
acatggagctcaggtttc

SEQ ID NO: 5137604 - DNA, 19 bp, Homo sapiens
acatggaggcactgaagcc

SEQ ID NO: 5137605 - DNA, 14 bp, Homo sapiens
acatggaggttcta

SEQ ID NO: 5137606 - DNA, 19 bp, Homo sapiens
acatggatacttcctgggt

SEQ ID NO: 5137607 - DNA, 19 bp, Homo sapiens
acatggatgaaattcccgt

SEQ ID NO: 5137608 - DNA, 14 bp, Homo sapiens
acatggatgcacac

SEQ ID NO: 5137609 - DNA, 15 bp, Homo sapiens
acatggcacaggccc

SEQ ID NO: 5137610 - DNA, 14 bp, Homo sapiens
acatggcatgtttt

SEQ ID NO: 5137611 - DNA, 21 bp, Homo sapiens
acatggcatgttttgtcattg

SEQ ID NO: 5137612 - DNA, 11 bp, Homo sapiens
acatggccaca

SEQ ID NO: 5137613 - DNA, 16 bp, Homo sapiens
acatggccagactccc

SEQ ID NO: 5137614 - DNA, 21 bp, Homo sapiens
acatggccagactcccttgct

SEQ ID NO: 5137615 - DNA, 15 bp, Homo sapiens
acatggccagcaaat

SEQ ID NO: 5137616 - DNA, 14 bp, Homo sapiens
acatggccagtgtg

SEQ ID NO: 5137617 - DNA, 19 bp, Homo sapiens
acatggccatcttctttct

SEQ ID NO: 5137618 - DNA, 16 bp, Homo sapiens
acatggcccattggag

SEQ ID NO: 5137619 - DNA, 23 bp, Homo sapiens
acatggcccattggagcacctgg

SEQ ID NO: 5137620 - DNA, 15 bp, Homo sapiens
acatggccccatccc

SEQ ID NO: 5137621 - DNA, 21 bp, Homo sapiens
acatggcccctccccctgcca

SEQ ID NO: 5137622 - DNA, 22 bp, Homo sapiens
acatggcccctccccctgccag

SEQ ID NO: 5137623 - DNA, 16 bp, Homo sapiens
acatggccgctgccca

SEQ ID NO: 5137624 - DNA, 22 bp, Homo sapiens
acatggccgggccctctgtagc

SEQ ID NO: 5137625 - DNA, 17 bp, Homo sapiens
acatggcctatgcacat

SEQ ID NO: 5137626 - DNA, 18 bp, Homo sapiens
acatggcctgtttgggag

SEQ ID NO: 5137627 - DNA, 19 bp, Homo sapiens
acatggcgccctgcctcct

SEQ ID NO: 5137628 - DNA, 20 bp, Homo sapiens
acatggctctaaaaagtttt

SEQ ID NO: 5137629 - DNA, 23 bp, Homo sapiens
acatggctctggactctaaagac

SEQ ID NO: 5137630 - DNA, 22 bp, Homo sapiens
acatggctggagctagaatttg

SEQ ID NO: 5137631 - DNA, 16 bp, Homo sapiens
acatggcttaatctta

SEQ ID NO: 5137632 - DNA, 22 bp, Homo sapiens
acatggcttcctaaatggccct

SEQ ID NO: 5137633 - DNA, 15 bp, Homo sapiens
acatggctttgataa

SEQ ID NO: 5137634 - DNA, 17 bp, Homo sapiens
acatggctttgctttgt

SEQ ID NO: 5137635 - DNA, 22 bp, Homo sapiens
acatgggaaaggaggcatgcct

SEQ ID NO: 5137636 - DNA, 11 bp, Homo sapiens
acatgggacat

SEQ ID NO: 5137637 - DNA, 21 bp, Homo sapiens
acaggtcaggggtgacacaga

SEQ ID NO: 5137638 - DNA, 13 bp, Homo sapiens
acaggtccaagga

SEQ ID NO: 5137639 - DNA, 21 bp, Homo sapiens
acaggtcccacctccagcccg

SEQ ID NO: 5137640 - DNA, 21 bp, Homo sapiens
acaggtcccacgccaggccag

SEQ ID NO: 5137641 - DNA, 19 bp, Homo sapiens
acaggtctcctcttaaaaa

SEQ ID NO: 5137642 - DNA, 13 bp, Homo sapiens
acaggtctctgtt

SEQ ID NO: 5137643 - DNA, 14 bp, Homo sapiens
acaggtctctgttt

SEQ ID NO: 5137644 - DNA, 16 bp, Homo sapiens
acaggtctgggagagg

SEQ ID NO: 5137645 - DNA, 19 bp, Homo sapiens
acaggtctgggagaggcag

SEQ ID NO: 5137646 - DNA, 16 bp, Homo sapiens
acaggtcttcactgcc

SEQ ID NO: 5137647 - DNA, 18 bp, Homo sapiens
acaggtcttcactgccca

SEQ ID NO: 5137648 - DNA, 15 bp, Homo sapiens
acaggtcttgcccaa

SEQ ID NO: 5137649 - DNA, 13 bp, Homo sapiens
acaggtcttgggg

SEQ ID NO: 5137650 - DNA, 15 bp, Homo sapiens
acaggtcttttcaaa

SEQ ID NO: 5137651 - DNA, 19 bp, Homo sapiens
acaggtgaaagtttttctg

SEQ ID NO: 5137652 - DNA, 23 bp, Homo sapiens
acaggtgaaagtttttctgaaag

SEQ ID NO: 5137653 - DNA, 13 bp, Homo sapiens
acaggtgaattgg

SEQ ID NO: 5137654 - DNA, 20 bp, Homo sapiens
acaggtgccgccagctgccg

SEQ ID NO: 5137655 - DNA, 14 bp, Homo sapiens
acaggtgcctgggg

SEQ ID NO: 5137656 - DNA, 12 bp, Homo sapiens
acaggtgccttg

SEQ ID NO: 5137657 - DNA, 22 bp, Homo sapiens
acaggtgccttggggaaatgtg

SEQ ID NO: 5137658 - DNA, 14 bp, Homo sapiens
acaggtgccttttt

SEQ ID NO: 5137659 - DNA, 16 bp, Homo sapiens
acaggtggacacacaa

SEQ ID NO: 5137660 - DNA, 20 bp, Homo sapiens
acaggtggaggcgagccaga

SEQ ID NO: 5137661 - DNA, 12 bp, Homo sapiens
acaggtggaggt

SEQ ID NO: 5137662 - DNA, 16 bp, Homo sapiens
acaggtggcaggacca

SEQ ID NO: 5137663 - DNA, 21 bp, Homo sapiens
acaggtggcaggaccaggact

SEQ ID NO: 5137664 - DNA, 19 bp, Homo sapiens
acaggtggcctagcaggca

SEQ ID NO: 5137665 - DNA, 23 bp, Homo sapiens
acaggtggctgtttcttgtctgt

SEQ ID NO: 5137666 - DNA, 23 bp, Homo sapiens
acaggtgggagatggaggtaggg

SEQ ID NO: 5137667 - DNA, 14 bp, Homo sapiens
acaggtgggcctgg

SEQ ID NO: 5137668 - DNA, 16 bp, Homo sapiens
acaggtgggcctggcg

SEQ ID NO: 5137669 - DNA, 18 bp, Homo sapiens
acaggtgggcctggcggc

SEQ ID NO: 5137670 - DNA, 21 bp, Homo sapiens
acaggtgggcctggcggcctg

SEQ ID NO: 5137671 - DNA, 15 bp, Homo sapiens
acaggtgggcctggg

SEQ ID NO: 5137672 - DNA, 20 bp, Homo sapiens
acaggtgggcttcccagtgg

SEQ ID NO: 5137673 - DNA, 21 bp, Homo sapiens
acaggtggggactgggcacag

SEQ ID NO: 5137674 - DNA, 15 bp, Homo sapiens
acaggtggggcctca

SEQ ID NO: 5137675 - DNA, 15 bp, Homo sapiens
acaggtggtgtcact

SEQ ID NO: 5137676 - DNA, 20 bp, Homo sapiens
acaggtggtgtcactgtccc

SEQ ID NO: 5137677 - DNA, 24 bp, Homo sapiens
acaggtgtactatggctgtatttt

SEQ ID NO: 5137678 - DNA, 22 bp, Homo sapiens
acaggtgtccccagcccactgg

SEQ ID NO: 5137679 - DNA, 19 bp, Homo sapiens
acaggtgtgaaccaccaca

SEQ ID NO: 5137680 - DNA, 13 bp, Homo sapiens
acaggtgtgagcc

SEQ ID NO: 5137681 - DNA, 17 bp, Homo sapiens
acaggtgtgagccactg

SEQ ID NO: 5137682 - DNA, 19 bp, Homo sapiens
acaggtgtgagccactgcg

SEQ ID NO: 5137683 - DNA, 16 bp, Homo sapiens
acaggtgtggtgtaat

SEQ ID NO: 5137684 - DNA, 17 bp, Homo sapiens
acaggtgtggtgtaatt

SEQ ID NO: 5137685 - DNA, 18 bp, Homo sapiens
acaggtgtggtgtaattt

SEQ ID NO: 5137686 - DNA, 13 bp, Homo sapiens
acaggtgtgtgcc

SEQ ID NO: 5137687 - DNA, 16 bp, Homo sapiens
acaggtgtgtgggcca

SEQ ID NO: 5137688 - DNA, 16 bp, Homo sapiens
acaggtgttccgtggg

SEQ ID NO: 5137689 - DNA, 14 bp, Homo sapiens
acaggtgtttatac

SEQ ID NO: 5137690 - DNA, 22 bp, Homo sapiens
acaggttaaatatataaacaaa

SEQ ID NO: 5137691 - DNA, 18 bp, Homo sapiens
acaggttaacctgcagaa

SEQ ID NO: 5137692 - DNA, 15 bp, Homo sapiens
acaggttacaacaga

SEQ ID NO: 5137693 - DNA, 21 bp, Homo sapiens
acaggttacaacagatttgtg

SEQ ID NO: 5137694 - DNA, 18 bp, Homo sapiens
acaggttacgaagacaaa

SEQ ID NO: 5137695 - DNA, 20 bp, Homo sapiens
acaggttactaccctcaccc

SEQ ID NO: 5137696 - DNA, 20 bp, Homo sapiens
acaggttcttaaaaaggaac

SEQ ID NO: 5137697 - DNA, 21 bp, Homo sapiens
acaggttcttaaaaaggaaca

SEQ ID NO: 5137698 - DNA, 13 bp, Homo sapiens
acaggttgtgaaa

SEQ ID NO: 5137699 - DNA, 13 bp, Homo sapiens
acaggtttatctg

SEQ ID NO: 5137700 - DNA, 18 bp, Homo sapiens
acaggtttgggacccctg

SEQ ID NO: 5137701 - DNA, 16 bp, Homo sapiens
acaggttttatgagac

SEQ ID NO: 5137702 - DNA, 22 bp, Homo sapiens
acaggttttattttatcacttg

SEQ ID NO: 5137703 - DNA, 22 bp, Homo sapiens
acaggttttcagagaattatct

SEQ ID NO: 5137704 - DNA, 21 bp, Homo sapiens
acaggttttccaaaagtaaag

SEQ ID NO: 5137705 - DNA, 23 bp, Homo sapiens
acagtaaaacaattgtgacagca

SEQ ID NO: 5137706 - DNA, 20 bp, Homo sapiens
acagtaaaagtaaagactat

SEQ ID NO: 5137707 - DNA, 12 bp, Homo sapiens
acagtaaaatta

SEQ ID NO: 5137708 - DNA, 14 bp, Homo sapiens
acagtaaaattaag

SEQ ID NO: 5137709 - DNA, 15 bp, Homo sapiens
acagtaaaccactga

SEQ ID NO: 5137710 - DNA, 19 bp, Homo sapiens
acagtaaaccactgaaaaa

SEQ ID NO: 5137711 - DNA, 21 bp, Homo sapiens
acagtaaaccactgaaaaaat

SEQ ID NO: 5137712 - DNA, 17 bp, Homo sapiens
acagtaaagaaagcaga

SEQ ID NO: 5137713 - DNA, 19 bp, Homo sapiens
acagtaaagaggcttccaa

SEQ ID NO: 5137714 - DNA, 15 bp, Homo sapiens
acagtaaagagtaca

SEQ ID NO: 5137715 - DNA, 23 bp, Homo sapiens
acagtaaagagtacactcagcca

SEQ ID NO: 5137716 - DNA, 16 bp, Homo sapiens
acagtaaagtttaaaa

SEQ ID NO: 5137717 - DNA, 17 bp, Homo sapiens
acagtaaagtttaaaaa

SEQ ID NO: 5137718 - DNA, 19 bp, Homo sapiens
acagtaaatacactgtgaa

SEQ ID NO: 5137719 - DNA, 22 bp, Homo sapiens
acagtaactgagtgtggcggga

SEQ ID NO: 5137720 - DNA, 21 bp, Homo sapiens
acagtaactttatgtgtaaat

SEQ ID NO: 5137721 - DNA, 17 bp, Homo sapiens
acagtaagaacatcata

SEQ ID NO: 5137722 - DNA, 22 bp, Homo sapiens
acagtaagataggttctgcttt

SEQ ID NO: 5137723 - DNA, 15 bp, Homo sapiens
acagtaagcatgctg

SEQ ID NO: 5137724 - DNA, 17 bp, Homo sapiens
acagtaagtcatttaac

SEQ ID NO: 5137725 - DNA, 17 bp, Homo sapiens
acagtaatatgaaagcc

SEQ ID NO: 5137726 - DNA, 13 bp, Homo sapiens
acagtaatcagag

SEQ ID NO: 5137727 - DNA, 18 bp, Homo sapiens
acagtaatctaggtgtgg

SEQ ID NO: 5137728 - DNA, 22 bp, Homo sapiens
acagtaatctaggtgtggctgt

SEQ ID NO: 5137729 - DNA, 20 bp, Homo sapiens
acagtaatctatgtgtttct

SEQ ID NO: 5137730 - DNA, 22 bp, Homo sapiens
acagtaatctttcggtctcctt

SEQ ID NO: 5137731 - DNA, 12 bp, Homo sapiens
acagtaatgaaa

SEQ ID NO: 5137732 - DNA, 13 bp, Homo sapiens
acagtaatgaaat

SEQ ID NO: 5137733 - DNA, 16 bp, Homo sapiens
acagtaatgtcataaa

SEQ ID NO: 5137734 - DNA, 18 bp, Homo sapiens
acagtaattactttcaga

SEQ ID NO: 5137735 - DNA, 19 bp, Homo sapiens
acagtaattactttcagaa

SEQ ID NO: 5137736 - DNA, 13 bp, Homo sapiens
acagtaattgtga

SEQ ID NO: 5137737 - DNA, 15 bp, Homo sapiens
acagtaattgtgttt

SEQ ID NO: 5137738 - DNA, 18 bp, Homo sapiens
acagtaattgtgtttaca

SEQ ID NO: 5137739 - DNA, 14 bp, Homo sapiens
acagtacaataatg

SEQ ID NO: 5137740 - DNA, 15 bp, Homo sapiens
acagtacaataatgt

SEQ ID NO: 5137741 - DNA, 18 bp, Homo sapiens
acagtacaataatgtact

SEQ ID NO: 5137742 - DNA, 16 bp, Homo sapiens
acagtacacacaaaaa

SEQ ID NO: 5137743 - DNA, 16 bp, Homo sapiens
acagtacacaccagaa

SEQ ID NO: 5137744 - DNA, 14 bp, Homo sapiens
acagtacactgtca

SEQ ID NO: 5137745 - DNA, 15 bp, Homo sapiens
acagtacagcatgtg

SEQ ID NO: 5137746 - DNA, 12 bp, Homo sapiens
acagtacaggca

SEQ ID NO: 5137747 - DNA, 20 bp, Homo sapiens
acagtacaggcagcacagag

SEQ ID NO: 5137748 - DNA, 20 bp, Homo sapiens
acagtacatgtttattatgt

SEQ ID NO: 5137749 - DNA, 22 bp, Homo sapiens
acagtacccttggcctttacag

SEQ ID NO: 5137750 - DNA, 23 bp, Homo sapiens
acagtacctatgacttttttaaa

SEQ ID NO: 5137751 - DNA, 19 bp, Homo sapiens
acagtacctgattgtattt

SEQ ID NO: 5137752 - DNA, 21 bp, Homo sapiens
acagtacctgattgtattttt

SEQ ID NO: 5137753 - DNA, 18 bp, Homo sapiens
acagtaccttaggttctt

SEQ ID NO: 5137754 - DNA, 19 bp, Homo sapiens
acagtaccttgttgcagat

SEQ ID NO: 5137755 - DNA, 22 bp, Homo sapiens
acagtactggttactttcaaaa

SEQ ID NO: 5137756 - DNA, 14 bp, Homo sapiens
acagtacttccaga

SEQ ID NO: 5137757 - DNA, 14 bp, Homo sapiens
acagtactttattg

SEQ ID NO: 5137758 - DNA, 20 bp, Homo sapiens
acagtactttccagcagtca

SEQ ID NO: 5137759 - DNA, 14 bp, Homo sapiens
acagtactttgaat

SEQ ID NO: 5137760 - DNA, 16 bp, Homo sapiens
acagtagagccagctt

SEQ ID NO: 5137761 - DNA, 20 bp, Homo sapiens
acagtagcatactgatgaga

SEQ ID NO: 5137762 - DNA, 22 bp, Homo sapiens
acagtagcatactgatgagaca

SEQ ID NO: 5137763 - DNA, 19 bp, Homo sapiens
acagtagccttattcacct

SEQ ID NO: 5137764 - DNA, 17 bp, Homo sapiens
acagtagcttaaataaa

SEQ ID NO: 5137765 - DNA, 18 bp, Homo sapiens
acagtagcttcctagacc

SEQ ID NO: 5137766 - DNA, 16 bp, Homo sapiens
acagtaggattgctgt

SEQ ID NO: 5137767 - DNA, 19 bp, Homo sapiens
acagtaggtcccggccagc

SEQ ID NO: 5137768 - DNA, 20 bp, Homo sapiens
acagtaggtcccggccagct

SEQ ID NO: 5137769 - DNA, 21 bp, Homo sapiens
acagtagtaccaaatgcttta

SEQ ID NO: 5137770 - DNA, 21 bp, Homo sapiens
acagtagtataatgtatgaat

SEQ ID NO: 5137771 - DNA, 15 bp, Homo sapiens
acagtagtatctgct

SEQ ID NO: 5137772 - DNA, 14 bp, Homo sapiens
acagtagtcttgat

SEQ ID NO: 5137773 - DNA, 14 bp, Homo sapiens
acagtagtgttggg

SEQ ID NO: 5137774 - DNA, 21 bp, Homo sapiens
acagtagttgtattcttctgt

SEQ ID NO: 5137775 - DNA, 13 bp, Homo sapiens
acagtataattaa

SEQ ID NO: 5137776 - DNA, 15 bp, Homo sapiens
acagtataattaaca

SEQ ID NO: 5137777 - DNA, 16 bp, Homo sapiens
acagtatactcagcta

SEQ ID NO: 5137778 - DNA, 15 bp, Homo sapiens
acagtatataagctt

SEQ ID NO: 5137779 - DNA, 15 bp, Homo sapiens
acagtatattttatt

SEQ ID NO: 5137780 - DNA, 23 bp, Homo sapiens
acagtatattttatttcaatgta

SEQ ID NO: 5137781 - DNA, 20 bp, Homo sapiens
acagtatcactctaatataa

SEQ ID NO: 5137782 - DNA, 21 bp, Homo sapiens
acagtatcactctaatataat

SEQ ID NO: 5137783 - DNA, 21 bp, Homo sapiens
acagtatcactgtctttccta

SEQ ID NO: 5137784 - DNA, 20 bp, Homo sapiens
acagtatccaatgtcttttg

SEQ ID NO: 5137785 - DNA, 21 bp, Homo sapiens
acagtatcgaggcttgtgatg

SEQ ID NO: 5137786 - DNA, 10 bp, Homo sapiens
acagtatctc

SEQ ID NO: 5137787 - DNA, 20 bp, Homo sapiens
acagtatctcaaacaattga

SEQ ID NO: 5137788 - DNA, 20 bp, Homo sapiens
acagtatctgctgttcttca

SEQ ID NO: 5137789 - DNA, 16 bp, Homo sapiens
acagtatcttcaaaaa

SEQ ID NO: 5137790 - DNA, 16 bp, Homo sapiens
acagtatgagaagaaa

SEQ ID NO: 5137791 - DNA, 23 bp, Homo sapiens
acagtatgagtcaatgtgcagtg

SEQ ID NO: 5137792 - DNA, 16 bp, Homo sapiens
acagtatgatgaaaat

SEQ ID NO: 5137793 - DNA, 18 bp, Homo sapiens
acagtatgatgaaaataa

SEQ ID NO: 5137794 - DNA, 19 bp, Homo sapiens
acagtatgatgaaaataat

SEQ ID NO: 5137795 - DNA, 15 bp, Homo sapiens
acagtatggcaatat

SEQ ID NO: 5137796 - DNA, 17 bp, Homo sapiens
acagtatgtcccatagg

SEQ ID NO: 5137797 - DNA, 11 bp, Homo sapiens
acagtatgtgt

SEQ ID NO: 5137798 - DNA, 14 bp, Homo sapiens
acagtatgtgtcta

SEQ ID NO: 5137799 - DNA, 22 bp, Homo sapiens
acagtatgtgtctagcaaagcc

SEQ ID NO: 5137800 - DNA, 23 bp, Homo sapiens
acagtatgtgtctagcaaagcca

SEQ ID NO: 5137801 - DNA, 19 bp, Homo sapiens
acagtattaacactaaatt

SEQ ID NO: 5137802 - DNA, 21 bp, Homo sapiens
acagtattaacactaaattgc

SEQ ID NO: 5137803 - DNA, 14 bp, Homo sapiens
acagtattaagggt

SEQ ID NO: 5137804 - DNA, 20 bp, Homo sapiens
acagtattatacgctggcaa

SEQ ID NO: 5137805 - DNA, 20 bp, Homo sapiens
acagtattatagacaaaaga

SEQ ID NO: 5137806 - DNA, 22 bp, Homo sapiens
acagtattatagatataaatat

SEQ ID NO: 5137807 - DNA, 17 bp, Homo sapiens
acagtattatctgtgtt

SEQ ID NO: 5137808 - DNA, 23 bp, Homo sapiens
acagtattatgcctgagttataa

SEQ ID NO: 5137809 - DNA, 21 bp, Homo sapiens
acagtattatttagtaaaatt

SEQ ID NO: 5137810 - DNA, 22 bp, Homo sapiens
acagtattatttagtaaaatta

SEQ ID NO: 5137811 - DNA, 16 bp, Homo sapiens
acagtattcgtgaata

SEQ ID NO: 5137812 - DNA, 18 bp, Homo sapiens
acagtattctcagtgctc

SEQ ID NO: 5137813 - DNA, 23 bp, Homo sapiens
acagtattgctatttatattcat

SEQ ID NO: 5137814 - DNA, 17 bp, Homo sapiens
acatgggactatgcttt

SEQ ID NO: 5137815 - DNA, 20 bp, Homo sapiens
acatgggactatgcttttct

SEQ ID NO: 5137816 - DNA, 12 bp, Homo sapiens
acatgggactgg

SEQ ID NO: 5137817 - DNA, 12 bp, Homo sapiens
acatgggacttg

SEQ ID NO: 5137818 - DNA, 23 bp, Homo sapiens
acatgggagcagtccatgcatga

SEQ ID NO: 5137819 - DNA, 20 bp, Homo sapiens
acatgggagccgggtctgcc

SEQ ID NO: 5137820 - DNA, 23 bp, Homo sapiens
acatgggagccgggtctgcctct

SEQ ID NO: 5137821 - DNA, 14 bp, Homo sapiens
acatgggaggaagg

SEQ ID NO: 5137822 - DNA, 12 bp, Homo sapiens
acatgggaggga

SEQ ID NO: 5137823 - DNA, 19 bp, Homo sapiens
acatgggagggatcagccc

SEQ ID NO: 5137824 - DNA, 13 bp, Homo sapiens
acatgggagttta

SEQ ID NO: 5137825 - DNA, 13 bp, Homo sapiens
acatgggcagccc

SEQ ID NO: 5137826 - DNA, 22 bp, Homo sapiens
acatgggccgcgggtaaactag

SEQ ID NO: 5137827 - DNA, 12 bp, Homo sapiens
acatgggctggg

SEQ ID NO: 5137828 - DNA, 14 bp, Homo sapiens
acatgggcttgtga

SEQ ID NO: 5137829 - DNA, 13 bp, Homo sapiens
acatggggaggag

SEQ ID NO: 5137830 - DNA, 21 bp, Homo sapiens
acatggggcaagccagggccc

SEQ ID NO: 5137831 - DNA, 22 bp, Homo sapiens
acatggggcaagccagggccca

SEQ ID NO: 5137832 - DNA, 20 bp, Homo sapiens
acatggggttggctgggccc

SEQ ID NO: 5137833 - DNA, 21 bp, Homo sapiens
acatggggttggctgggccca

SEQ ID NO: 5137834 - DNA, 16 bp, Homo sapiens
acatggggttttcaat

SEQ ID NO: 5137835 - DNA, 22 bp, Homo sapiens
acatggggttttcaattttgca

SEQ ID NO: 5137836 - DNA, 16 bp, Homo sapiens
acatgggtcgcccatg

SEQ ID NO: 5137837 - DNA, 13 bp, Homo sapiens
acatgggtgacta

SEQ ID NO: 5137838 - DNA, 12 bp, Homo sapiens
acatgggtgggg

SEQ ID NO: 5137839 - DNA, 21 bp, Homo sapiens
acatggtaaacgctgtcccta

SEQ ID NO: 5137840 - DNA, 14 bp, Homo sapiens
acatggtacctaag

SEQ ID NO: 5137841 - DNA, 14 bp, Homo sapiens
acatggtactcttg

SEQ ID NO: 5137842 - DNA, 15 bp, Homo sapiens
acatggtagcagggt

SEQ ID NO: 5137843 - DNA, 18 bp, Homo sapiens
acatggtagcagggtctt

SEQ ID NO: 5137844 - DNA, 13 bp, Homo sapiens
acatggtattgta

SEQ ID NO: 5137845 - DNA, 22 bp, Homo sapiens
acatggtccatttcatgtgatc

SEQ ID NO: 5137846 - DNA, 18 bp, Homo sapiens
acatggtgaaacccccat

SEQ ID NO: 5137847 - DNA, 23 bp, Homo sapiens
acatggtgaaaccccgtctctac

SEQ ID NO: 5137848 - DNA, 23 bp, Homo sapiens
acatggtgagtctatttttaatg

SEQ ID NO: 5137849 - DNA, 23 bp, Homo sapiens
acatggtgcaccgagtgatttcc

SEQ ID NO: 5137850 - DNA, 19 bp, Homo sapiens
acatggtgcccctagcttt

SEQ ID NO: 5137851 - DNA, 23 bp, Homo sapiens
acatggtgcctatatctgagaga

SEQ ID NO: 5137852 - DNA, 13 bp, Homo sapiens
acatggtgcctga

SEQ ID NO: 5137853 - DNA, 23 bp, Homo sapiens
acatggtgcctgagaggcaggca

SEQ ID NO: 5137854 - DNA, 13 bp, Homo sapiens
acatggtgcctta

SEQ ID NO: 5137855 - DNA, 23 bp, Homo sapiens
acatggtgctgggagaggcagcc

SEQ ID NO: 5137856 - DNA, 14 bp, Homo sapiens
acatggtgtctccc

SEQ ID NO: 5137857 - DNA, 23 bp, Homo sapiens
acatggtgtctggattcccagga

SEQ ID NO: 5137858 - DNA, 23 bp, Homo sapiens
acatggtgtggccatcactcagc

SEQ ID NO: 5137859 - DNA, 14 bp, Homo sapiens
acatggtgtggggg

SEQ ID NO: 5137860 - DNA, 14 bp, Homo sapiens
acatggtgttgtat

SEQ ID NO: 5137861 - DNA, 15 bp, Homo sapiens
acatggtgttgtata

SEQ ID NO: 5137862 - DNA, 22 bp, Homo sapiens
acatggttacaatcattgctga

SEQ ID NO: 5137863 - DNA, 23 bp, Homo sapiens
acatggttacaatcattgctgaa

SEQ ID NO: 5137864 - DNA, 18 bp, Homo sapiens
acatggttaccatgtctt

SEQ ID NO: 5137865 - DNA, 20 bp, Homo sapiens
acatggttacctctgcataa

SEQ ID NO: 5137866 - DNA, 20 bp, Homo sapiens
acatggttgtgacctgagga

SEQ ID NO: 5137867 - DNA, 18 bp, Homo sapiens
acatgtaaaatatgtaaa

SEQ ID NO: 5137868 - DNA, 18 bp, Homo sapiens
acatgtaaacaaatattt

SEQ ID NO: 5137869 - DNA, 15 bp, Homo sapiens
acatgtaaagctgtt

SEQ ID NO: 5137870 - DNA, 13 bp, Homo sapiens
acatgtaaataca

SEQ ID NO: 5137871 - DNA, 15 bp, Homo sapiens
acatgtaaattaagt

SEQ ID NO: 5137872 - DNA, 21 bp, Homo sapiens
acatgtaacatagatttatgt

SEQ ID NO: 5137873 - DNA, 19 bp, Homo sapiens
acatgtaagaaaatgttac

SEQ ID NO: 5137874 - DNA, 14 bp, Homo sapiens
acatgtaataaatt

SEQ ID NO: 5137875 - DNA, 18 bp, Homo sapiens
acatgtaatatatttcag

SEQ ID NO: 5137876 - DNA, 21 bp, Homo sapiens
acatgtaattaagtactatgt

SEQ ID NO: 5137877 - DNA, 13 bp, Homo sapiens
acatgtaatttga

SEQ ID NO: 5137878 - DNA, 15 bp, Homo sapiens
acatgtaatttgtgt

SEQ ID NO: 5137879 - DNA, 20 bp, Homo sapiens
acatgtacactacatttttt

SEQ ID NO: 5137880 - DNA, 19 bp, Homo sapiens
acatgtacatagtaaagta

SEQ ID NO: 5137881 - DNA, 18 bp, Homo sapiens
acatgtacatatggaaat

SEQ ID NO: 5137882 - DNA, 22 bp, Homo sapiens
acatgtacatgcatttttctag

SEQ ID NO: 5137883 - DNA, 21 bp, Homo sapiens
acatgtaccccctttcccttc

SEQ ID NO: 5137884 - DNA, 13 bp, Homo sapiens
acatgtactacag

SEQ ID NO: 5137885 - DNA, 19 bp, Homo sapiens
acatgtactacagctatat

SEQ ID NO: 5137886 - DNA, 13 bp, Homo sapiens
acatgtactccag

SEQ ID NO: 5137887 - DNA, 14 bp, Homo sapiens
acatgtagcttctt

SEQ ID NO: 5137888 - DNA, 20 bp, Homo sapiens
acatgtagcttcttctgaaa

SEQ ID NO: 5137889 - DNA, 15 bp, Homo sapiens
acatgtagggcaaga

SEQ ID NO: 5137890 - DNA, 15 bp, Homo sapiens
acatgtaggtgtttg

SEQ ID NO: 5137891 - DNA, 20 bp, Homo sapiens
acatgtagtagtacttgaaa

SEQ ID NO: 5137892 - DNA, 13 bp, Homo sapiens
acatgtataaagt

SEQ ID NO: 5137893 - DNA, 15 bp, Homo sapiens
acatgtataaagtga

SEQ ID NO: 5137894 - DNA, 19 bp, Homo sapiens
acatgtataaagtgattga

SEQ ID NO: 5137895 - DNA, 18 bp, Homo sapiens
acatgtatctatgcattt

SEQ ID NO: 5137896 - DNA, 16 bp, Homo sapiens
acatgtatctgtctac

SEQ ID NO: 5137897 - DNA, 23 bp, Homo sapiens
acatgtatgaaattggttttcca

SEQ ID NO: 5137898 - DNA, 18 bp, Homo sapiens
acatgtatggacgtgtgt

SEQ ID NO: 5137899 - DNA, 11 bp, Homo sapiens
acatgtatggt

SEQ ID NO: 5137900 - DNA, 15 bp, Homo sapiens
acatgtatggttact

SEQ ID NO: 5137901 - DNA, 22 bp, Homo sapiens
acatgtatgttttggtatctgt

SEQ ID NO: 5137902 - DNA, 21 bp, Homo sapiens
acatgtattaaattacatttg

SEQ ID NO: 5137903 - DNA, 22 bp, Homo sapiens
acatgtattaaattacatttgt

SEQ ID NO: 5137904 - DNA, 21 bp, Homo sapiens
acatgtattgcacattgtaaa

SEQ ID NO: 5137905 - DNA, 13 bp, Homo sapiens
acatgtatttatg

SEQ ID NO: 5137906 - DNA, 18 bp, Homo sapiens
acatgtatttatgtaatg

SEQ ID NO: 5137907 - DNA, 12 bp, Homo sapiens
acatgtatttgt

SEQ ID NO: 5137908 - DNA, 16 bp, Homo sapiens
acatgtatttgtttgc

SEQ ID NO: 5137909 - DNA, 22 bp, Homo sapiens
acatgtcaaagctgcatgtgta

SEQ ID NO: 5137910 - DNA, 20 bp, Homo sapiens
acatgtcagccactgtgata

SEQ ID NO: 5137911 - DNA, 22 bp, Homo sapiens
acatgtcagccactgtgataga

SEQ ID NO: 5137912 - DNA, 11 bp, Homo sapiens
acatgtcatgt

SEQ ID NO: 5137913 - DNA, 17 bp, Homo sapiens
acatgtccagcaccttg

SEQ ID NO: 5137914 - DNA, 20 bp, Homo sapiens
acatgtccagcaccttgtgc

SEQ ID NO: 5137915 - DNA, 14 bp, Homo sapiens
acatgtcccagatc

SEQ ID NO: 5137916 - DNA, 19 bp, Homo sapiens
acatgtccttctgagcccg

SEQ ID NO: 5137917 - DNA, 13 bp, Homo sapiens
acatgtctaaagt

SEQ ID NO: 5137918 - DNA, 14 bp, Homo sapiens
acatgtctactttt

SEQ ID NO: 5137919 - DNA, 17 bp, Homo sapiens
acatgtctactttttaa

SEQ ID NO: 5137920 - DNA, 20 bp, Homo sapiens
acatgtctactttttaattt

SEQ ID NO: 5137921 - DNA, 19 bp, Homo sapiens
acatgtctcctactgagga

SEQ ID NO: 5137922 - DNA, 14 bp, Homo sapiens
acatgtctgtcctc

SEQ ID NO: 5137923 - DNA, 16 bp, Homo sapiens
acatgtctgtcctcag

SEQ ID NO: 5137924 - DNA, 17 bp, Homo sapiens
acatgtctgttctacat

SEQ ID NO: 5137925 - DNA, 18 bp, Homo sapiens
acatgtcttaatgaagtt

SEQ ID NO: 5137926 - DNA, 21 bp, Homo sapiens
acatgtcttaatgaagtttga

SEQ ID NO: 5137927 - DNA, 22 bp, Homo sapiens
acatgtcttaatgaagtttgaa

SEQ ID NO: 5137928 - DNA, 21 bp, Homo sapiens
acatgtcttttcttgcatgag

SEQ ID NO: 5137929 - DNA, 23 bp, Homo sapiens
acatgtcttttcttgcatgaggc

SEQ ID NO: 5137930 - DNA, 18 bp, Homo sapiens
acatgtgaaaagaataga

SEQ ID NO: 5137931 - DNA, 13 bp, Homo sapiens
acatgtgaaacct

SEQ ID NO: 5137932 - DNA, 14 bp, Homo sapiens
acatgtgaaacctt

SEQ ID NO: 5137933 - DNA, 13 bp, Homo sapiens
acatgtgaaagat

SEQ ID NO: 5137934 - DNA, 15 bp, Homo sapiens
acatgtgacacatat

SEQ ID NO: 5137935 - DNA, 21 bp, Homo sapiens
acatgtgacacatatgcacct

SEQ ID NO: 5137936 - DNA, 14 bp, Homo sapiens
acatgtgacattta

SEQ ID NO: 5137937 - DNA, 15 bp, Homo sapiens
acatgtgacatttat

SEQ ID NO: 5137938 - DNA, 21 bp, Homo sapiens
acatgtgacatttatatattg

SEQ ID NO: 5137939 - DNA, 19 bp, Homo sapiens
acatgtgaggactgggggc

SEQ ID NO: 5137940 - DNA, 20 bp, Homo sapiens
acatgtgaggaggaaaagga

SEQ ID NO: 5137941 - DNA, 23 bp, Homo sapiens
acatgtgatacattttttaagct

SEQ ID NO: 5137942 - DNA, 19 bp, Homo sapiens
acatgtgcaactcttgtat

SEQ ID NO: 5137943 - DNA, 18 bp, Homo sapiens
acatgtgcacatgcacgt

SEQ ID NO: 5137944 - DNA, 22 bp, Homo sapiens
acatgtgcagatatccaaacaa

SEQ ID NO: 5137945 - DNA, 13 bp, Homo sapiens
acatgtgcagtgc

SEQ ID NO: 5137946 - DNA, 22 bp, Homo sapiens
acatgtgccactgttcagcgga

SEQ ID NO: 5137947 - DNA, 16 bp, Homo sapiens
acatgtgcccctgcca

SEQ ID NO: 5137948 - DNA, 14 bp, Homo sapiens
acatgtgccctgcc

SEQ ID NO: 5137949 - DNA, 15 bp, Homo sapiens
acatgtgccctgcct

SEQ ID NO: 5137950 - DNA, 20 bp, Homo sapiens
acatgtgccgaatgtgcagg

SEQ ID NO: 5137951 - DNA, 16 bp, Homo sapiens
acatgtgctattgaac

SEQ ID NO: 5137952 - DNA, 14 bp, Homo sapiens
acatgtgctcgctc

SEQ ID NO: 5137953 - DNA, 17 bp, Homo sapiens
acatgtgctctggggaa

SEQ ID NO: 5137954 - DNA, 23 bp, Homo sapiens
acatgtgctctggggaattctga

SEQ ID NO: 5137955 - DNA, 17 bp, Homo sapiens
acatgtgcttcatctgt

SEQ ID NO: 5137956 - DNA, 19 bp, Homo sapiens
acatgtggaaaactcacag

SEQ ID NO: 5137957 - DNA, 19 bp, Homo sapiens
acatgtggctcctcccagc

SEQ ID NO: 5137958 - DNA, 20 bp, Homo sapiens
acatgtggggacagggctgg

SEQ ID NO: 5137959 - DNA, 18 bp, Homo sapiens
acatgtggggccaggtca

SEQ ID NO: 5137960 - DNA, 21 bp, Homo sapiens
acatgtgggtggagaagggag

SEQ ID NO: 5137961 - DNA, 23 bp, Homo sapiens
acatgtggtgggacagggaccca

SEQ ID NO: 5137962 - DNA, 13 bp, Homo sapiens
acatgtggtttat

SEQ ID NO: 5137963 - DNA, 15 bp, Homo sapiens
acatgtgtacatata

SEQ ID NO: 5137964 - DNA, 16 bp, Homo sapiens
acatgtgtacatatat

SEQ ID NO: 5137965 - DNA, 17 bp, Homo sapiens
acatgtgtacatatatg

SEQ ID NO: 5137966 - DNA, 20 bp, Homo sapiens
acatgtgtacatatatgtat

SEQ ID NO: 5137967 - DNA, 21 bp, Homo sapiens
acatgtgtagcctatgttgtg

SEQ ID NO: 5137968 - DNA, 20 bp, Homo sapiens
acatgtgtagcctgtgcatg

SEQ ID NO: 5137969 - DNA, 18 bp, Homo sapiens
acatgtgtagggaaagtt

SEQ ID NO: 5137970 - DNA, 16 bp, Homo sapiens
acatgtgtatttatac

SEQ ID NO: 5137971 - DNA, 13 bp, Homo sapiens
acatgtgtcaagc

SEQ ID NO: 5137972 - DNA, 19 bp, Homo sapiens
acatgtgtcaagctgcttg

SEQ ID NO: 5137973 - DNA, 19 bp, Homo sapiens
acatgtgtcccagccacag

SEQ ID NO: 5137974 - DNA, 21 bp, Homo sapiens
acatgtgtctgtgtggtatat

SEQ ID NO: 5137975 - DNA, 17 bp, Homo sapiens
acatgtgtgaaaacaat

SEQ ID NO: 5137976 - DNA, 11 bp, Homo sapiens
acatgtgtgac

SEQ ID NO: 5137977 - DNA, 18 bp, Homo sapiens
acatgtgtgcagagcaga

SEQ ID NO: 5137978 - DNA, 18 bp, Homo sapiens
acatgtgtgggtgctgat

SEQ ID NO: 5137979 - DNA, 13 bp, Homo sapiens
acatgtgtgtata

SEQ ID NO: 5137980 - DNA, 15 bp, Homo sapiens
acatgtgtgtatata

SEQ ID NO: 5137981 - DNA, 18 bp, Homo sapiens
acatgtgtgtatatatgt

SEQ ID NO: 5137982 - DNA, 23 bp, Homo sapiens
acatgtgtgtatatatgtgtata

SEQ ID NO: 5137983 - DNA, 18 bp, Homo sapiens
acatgtgttaaacagaga

SEQ ID NO: 5137984 - DNA, 22 bp, Homo sapiens
acatgtgttagtgtatgtgaat

SEQ ID NO: 5137985 - DNA, 16 bp, Homo sapiens
acatgtgttatctacc

SEQ ID NO: 5137986 - DNA, 19 bp, Homo sapiens
acatgtgttatctacctca

SEQ ID NO: 5137987 - DNA, 15 bp, Homo sapiens
acatgtgtttctgac

SEQ ID NO: 5137988 - DNA, 21 bp, Homo sapiens
acatgttaaaccatgggataa

SEQ ID NO: 5137989 - DNA, 23 bp, Homo sapiens
acatgttaaaccatgggataaat

SEQ ID NO: 5137990 - DNA, 17 bp, Homo sapiens
acatgttaaacttactt

SEQ ID NO: 5137991 - DNA, 16 bp, Homo sapiens
acagtattgggcagga

SEQ ID NO: 5137992 - DNA, 18 bp, Homo sapiens
acagtattgggcaggagg

SEQ ID NO: 5137993 - DNA, 15 bp, Homo sapiens
acagtattgtagaaa

SEQ ID NO: 5137994 - DNA, 17 bp, Homo sapiens
acagtattgtagaaagc

SEQ ID NO: 5137995 - DNA, 19 bp, Homo sapiens
acagtattgttcttgtaaa

SEQ ID NO: 5137996 - DNA, 22 bp, Homo sapiens
acagtattgttcttgtaaaact

SEQ ID NO: 5137997 - DNA, 15 bp, Homo sapiens
acagtatttattggt

SEQ ID NO: 5137998 - DNA, 23 bp, Homo sapiens
acagtatttctttgttatacatt

SEQ ID NO: 5137999 - DNA, 17 bp, Homo sapiens
acagtatttgtaattaa

SEQ ID NO: 5138000 - DNA, 11 bp, Homo sapiens
acagtattttt

SEQ ID NO: 5138001 - DNA, 16 bp, Homo sapiens
acagtcaaatttacat

SEQ ID NO: 5138002 - DNA, 14 bp, Homo sapiens
acagtcaagataca

SEQ ID NO: 5138003 - DNA, 16 bp, Homo sapiens
acagtcacccttctgg

SEQ ID NO: 5138004 - DNA, 14 bp, Homo sapiens
acagtcacgcctga

SEQ ID NO: 5138005 - DNA, 17 bp, Homo sapiens
acagtcacgcctgaaac

SEQ ID NO: 5138006 - DNA, 15 bp, Homo sapiens
acagtcactaatata

SEQ ID NO: 5138007 - DNA, 18 bp, Homo sapiens
acagtcactgatgtacaa

SEQ ID NO: 5138008 - DNA, 12 bp, Homo sapiens
acagtcactgga

SEQ ID NO: 5138009 - DNA, 21 bp, Homo sapiens
acagtcagaaggacggcagga

SEQ ID NO: 5138010 - DNA, 17 bp, Homo sapiens
acagtcagcaacatgat

SEQ ID NO: 5138011 - DNA, 21 bp, Homo sapiens
acagtcagcatgcttcccaga

SEQ ID NO: 5138012 - DNA, 11 bp, Homo sapiens
acagtcagcca

SEQ ID NO: 5138013 - DNA, 15 bp, Homo sapiens
acagtcagctcttca

SEQ ID NO: 5138014 - DNA, 13 bp, Homo sapiens
acagtcaggaagc

SEQ ID NO: 5138015 - DNA, 15 bp, Homo sapiens
acagtcaggacacat

SEQ ID NO: 5138016 - DNA, 21 bp, Homo sapiens
acagtcagtggagcctgggtg

SEQ ID NO: 5138017 - DNA, 15 bp, Homo sapiens
acagtcataaatact

SEQ ID NO: 5138018 - DNA, 20 bp, Homo sapiens
acagtcatcatcagggcctg

SEQ ID NO: 5138019 - DNA, 21 bp, Homo sapiens
acagtcatcatcagggcctgg

SEQ ID NO: 5138020 - DNA, 17 bp, Homo sapiens
acagtcatcgctcgtgt

SEQ ID NO: 5138021 - DNA, 21 bp, Homo sapiens
acagtcatctagaattcactg

SEQ ID NO: 5138022 - DNA, 18 bp, Homo sapiens
acagtccacaggggccac

SEQ ID NO: 5138023 - DNA, 16 bp, Homo sapiens
acagtccccagactca

SEQ ID NO: 5138024 - DNA, 18 bp, Homo sapiens
acagtccccagactcagc

SEQ ID NO: 5138025 - DNA, 13 bp, Homo sapiens
acagtccctgcca

SEQ ID NO: 5138026 - DNA, 13 bp, Homo sapiens
acagtccctgctg

SEQ ID NO: 5138027 - DNA, 19 bp, Homo sapiens
acagtccctgctggggaag

SEQ ID NO: 5138028 - DNA, 22 bp, Homo sapiens
acagtccgcagttgtagcagaa

SEQ ID NO: 5138029 - DNA, 17 bp, Homo sapiens
acagtccgtcaaaacag

SEQ ID NO: 5138030 - DNA, 21 bp, Homo sapiens
acagtccgtcaaaacagattg

SEQ ID NO: 5138031 - DNA, 17 bp, Homo sapiens
acagtcctatgtacaga

SEQ ID NO: 5138032 - DNA, 20 bp, Homo sapiens
acagtcctatgtacagagct

SEQ ID NO: 5138033 - DNA, 23 bp, Homo sapiens
acagtcctcacacacggaggcca

SEQ ID NO: 5138034 - DNA, 20 bp, Homo sapiens
acagtcctcacagcctctcc

SEQ ID NO: 5138035 - DNA, 21 bp, Homo sapiens
acagtcctcacagcctctccc

SEQ ID NO: 5138036 - DNA, 15 bp, Homo sapiens
acagtcctgaagcag

SEQ ID NO: 5138037 - DNA, 23 bp, Homo sapiens
acagtcctgggagaacctcaggc

SEQ ID NO: 5138038 - DNA, 20 bp, Homo sapiens
acagtccttaccagcagagc

SEQ ID NO: 5138039 - DNA, 22 bp, Homo sapiens
acagtccttaccagcagagcac

SEQ ID NO: 5138040 - DNA, 15 bp, Homo sapiens
acagtccttgctttg

SEQ ID NO: 5138041 - DNA, 18 bp, Homo sapiens
acagtcgtaaaagagata

SEQ ID NO: 5138042 - DNA, 20 bp, Homo sapiens
acagtctaaaaattgataga

SEQ ID NO: 5138043 - DNA, 21 bp, Homo sapiens
acagtctaatttttattcata

SEQ ID NO: 5138044 - DNA, 22 bp, Homo sapiens
acagtctagattagaagtgttt

SEQ ID NO: 5138045 - DNA, 23 bp, Homo sapiens
acagtctatttgagactcctcag

SEQ ID NO: 5138046 - DNA, 13 bp, Homo sapiens
acagtctcaattt

SEQ ID NO: 5138047 - DNA, 20 bp, Homo sapiens
acagtctcaattttgtattt

SEQ ID NO: 5138048 - DNA, 16 bp, Homo sapiens
acagtctcaggaaatc

SEQ ID NO: 5138049 - DNA, 19 bp, Homo sapiens
acagtctccggcctctcca

SEQ ID NO: 5138050 - DNA, 15 bp, Homo sapiens
acagtctctactgtt

SEQ ID NO: 5138051 - DNA, 16 bp, Homo sapiens
acagtctctatttgat

SEQ ID NO: 5138052 - DNA, 22 bp, Homo sapiens
acagtctctatttgatttgcaa

SEQ ID NO: 5138053 - DNA, 18 bp, Homo sapiens
acagtctctgagaactgg

SEQ ID NO: 5138054 - DNA, 11 bp, Homo sapiens
acagtctctgg

SEQ ID NO: 5138055 - DNA, 18 bp, Homo sapiens
acagtctctgttgtaaat

SEQ ID NO: 5138056 - DNA, 14 bp, Homo sapiens
acagtctctttaat

SEQ ID NO: 5138057 - DNA, 14 bp, Homo sapiens
acagtctctttctt

SEQ ID NO: 5138058 - DNA, 18 bp, Homo sapiens
acagtctctttcttcctt

SEQ ID NO: 5138059 - DNA, 17 bp, Homo sapiens
acagtctgaagctcgca

SEQ ID NO: 5138060 - DNA, 13 bp, Homo sapiens
acagtctgcatca

SEQ ID NO: 5138061 - DNA, 13 bp, Homo sapiens
acagtctgctcct

SEQ ID NO: 5138062 - DNA, 19 bp, Homo sapiens
acagtctggaggtcccaga

SEQ ID NO: 5138063 - DNA, 20 bp, Homo sapiens
acagtctggagtgatagcta

SEQ ID NO: 5138064 - DNA, 13 bp, Homo sapiens
acagtctggccac

SEQ ID NO: 5138065 - DNA, 15 bp, Homo sapiens
acagtctgtcttctg

SEQ ID NO: 5138066 - DNA, 23 bp, Homo sapiens
acagtctgtcttctgtatataaa

SEQ ID NO: 5138067 - DNA, 12 bp, Homo sapiens
acagtctgttat

SEQ ID NO: 5138068 - DNA, 18 bp, Homo sapiens
acagtctgttatgcactg

SEQ ID NO: 5138069 - DNA, 15 bp, Homo sapiens
acagtctgttttcta

SEQ ID NO: 5138070 - DNA, 19 bp, Homo sapiens
acagtcttccatttgcaag

SEQ ID NO: 5138071 - DNA, 22 bp, Homo sapiens
acagtcttgtattaagttgtta

SEQ ID NO: 5138072 - DNA, 22 bp, Homo sapiens
acagtcttgtgaactttgaatg

SEQ ID NO: 5138073 - DNA, 19 bp, Homo sapiens
acagtctttctttctgaat

SEQ ID NO: 5138074 - DNA, 20 bp, Homo sapiens
acagtcttttgtgtctgtca

SEQ ID NO: 5138075 - DNA, 16 bp, Homo sapiens
acagtgaaacaaattt

SEQ ID NO: 5138076 - DNA, 13 bp, Homo sapiens
acagtgaaagtca

SEQ ID NO: 5138077 - DNA, 15 bp, Homo sapiens
acagtgaaagtcaat

SEQ ID NO: 5138078 - DNA, 23 bp, Homo sapiens
acagtgaaagtcaattcagtgat

SEQ ID NO: 5138079 - DNA, 23 bp, Homo sapiens
acagtgaaattttggtgaatgtg

SEQ ID NO: 5138080 - DNA, 22 bp, Homo sapiens
acagtgaacataactgtaacat

SEQ ID NO: 5138081 - DNA, 19 bp, Homo sapiens
acagtgaagacagaagttt

SEQ ID NO: 5138082 - DNA, 13 bp, Homo sapiens
acagtgaagagta

SEQ ID NO: 5138083 - DNA, 17 bp, Homo sapiens
acagtgaagatgtttac

SEQ ID NO: 5138084 - DNA, 20 bp, Homo sapiens
acagtgaagcagcactgtga

SEQ ID NO: 5138085 - DNA, 23 bp, Homo sapiens
acagtgaagttttactgtctatt

SEQ ID NO: 5138086 - DNA, 10 bp, Homo sapiens
acagtgaatt

SEQ ID NO: 5138087 - DNA, 13 bp, Homo sapiens
acagtgaattgtc

SEQ ID NO: 5138088 - DNA, 15 bp, Homo sapiens
acagtgaattgtctt

SEQ ID NO: 5138089 - DNA, 16 bp, Homo sapiens
acagtgaattgtcttt

SEQ ID NO: 5138090 - DNA, 18 bp, Homo sapiens
acagtgaattgtctttta

SEQ ID NO: 5138091 - DNA, 16 bp, Homo sapiens
acagtgaatttctgat

SEQ ID NO: 5138092 - DNA, 19 bp, Homo sapiens
acagtgacaccatttgtcc

SEQ ID NO: 5138093 - DNA, 18 bp, Homo sapiens
acagtgaccttttcttca

SEQ ID NO: 5138094 - DNA, 21 bp, Homo sapiens
acagtgaccttttcttcattt

SEQ ID NO: 5138095 - DNA, 23 bp, Homo sapiens
acagtgactcgggctcctgtgcc

SEQ ID NO: 5138096 - DNA, 20 bp, Homo sapiens
acagtgactgtcgtgtttac

SEQ ID NO: 5138097 - DNA, 14 bp, Homo sapiens
acagtgacttctga

SEQ ID NO: 5138098 - DNA, 19 bp, Homo sapiens
acagtgacttggccccaga

SEQ ID NO: 5138099 - DNA, 20 bp, Homo sapiens
acagtgactttacaggaggt

SEQ ID NO: 5138100 - DNA, 22 bp, Homo sapiens
acagtgagaaagggcatacatc

SEQ ID NO: 5138101 - DNA, 14 bp, Homo sapiens
acagtgagactgta

SEQ ID NO: 5138102 - DNA, 18 bp, Homo sapiens
acagtgagactgtacata

SEQ ID NO: 5138103 - DNA, 20 bp, Homo sapiens
acagtgagactgtacataat

SEQ ID NO: 5138104 - DNA, 15 bp, Homo sapiens
acagtgagaggggag

SEQ ID NO: 5138105 - DNA, 14 bp, Homo sapiens
acagtgagcatatc

SEQ ID NO: 5138106 - DNA, 13 bp, Homo sapiens
acagtgagctgat

SEQ ID NO: 5138107 - DNA, 14 bp, Homo sapiens
acagtgaggagggt

SEQ ID NO: 5138108 - DNA, 14 bp, Homo sapiens
acagtgaggctggg

SEQ ID NO: 5138109 - DNA, 22 bp, Homo sapiens
acagtgaggtcctgggggcctg

SEQ ID NO: 5138110 - DNA, 17 bp, Homo sapiens
acagtgaggtgcccagc

SEQ ID NO: 5138111 - DNA, 21 bp, Homo sapiens
acagtgagttagactcaaggg

SEQ ID NO: 5138112 - DNA, 18 bp, Homo sapiens
acagtgatattggaactt

SEQ ID NO: 5138113 - DNA, 15 bp, Homo sapiens
acagtgatctccata

SEQ ID NO: 5138114 - DNA, 14 bp, Homo sapiens
acagtgatgaatgt

SEQ ID NO: 5138115 - DNA, 18 bp, Homo sapiens
acagtgatgatgcatgga

SEQ ID NO: 5138116 - DNA, 22 bp, Homo sapiens
acagtgatgccgggcgccagga

SEQ ID NO: 5138117 - DNA, 13 bp, Homo sapiens
acagtgatgttgt

SEQ ID NO: 5138118 - DNA, 19 bp, Homo sapiens
acagtgattaaagcaagag

SEQ ID NO: 5138119 - DNA, 10 bp, Homo sapiens
acagtgattt

SEQ ID NO: 5138120 - DNA, 22 bp, Homo sapiens
acagtgatttttttttagaaca

SEQ ID NO: 5138121 - DNA, 10 bp, Homo sapiens
acagtgcaag

SEQ ID NO: 5138122 - DNA, 13 bp, Homo sapiens
acagtgcacatga

SEQ ID NO: 5138123 - DNA, 22 bp, Homo sapiens
acagtgcactcagagctgctga

SEQ ID NO: 5138124 - DNA, 17 bp, Homo sapiens
acagtgcagacaggcca

SEQ ID NO: 5138125 - DNA, 21 bp, Homo sapiens
acagtgcagcttgcagtccgt

SEQ ID NO: 5138126 - DNA, 14 bp, Homo sapiens
acagtgcagtgcgc

SEQ ID NO: 5138127 - DNA, 11 bp, Homo sapiens
acagtgcagtt

SEQ ID NO: 5138128 - DNA, 21 bp, Homo sapiens
acagtgcatattcctttctat

SEQ ID NO: 5138129 - DNA, 15 bp, Homo sapiens
acagtgcatctcagc

SEQ ID NO: 5138130 - DNA, 13 bp, Homo sapiens
acagtgcatgtgc

SEQ ID NO: 5138131 - DNA, 14 bp, Homo sapiens
acagtgcatgtgca

SEQ ID NO: 5138132 - DNA, 18 bp, Homo sapiens
acagtgcatgtgcatgca

SEQ ID NO: 5138133 - DNA, 15 bp, Homo sapiens
acagtgccaaatgct

SEQ ID NO: 5138134 - DNA, 18 bp, Homo sapiens
acagtgccaaatgctggg

SEQ ID NO: 5138135 - DNA, 18 bp, Homo sapiens
acagtgccaccaagctca

SEQ ID NO: 5138136 - DNA, 13 bp, Homo sapiens
acagtgccagctt

SEQ ID NO: 5138137 - DNA, 14 bp, Homo sapiens
acagtgccatcccc

SEQ ID NO: 5138138 - DNA, 17 bp, Homo sapiens
acagtgccattgtcttt

SEQ ID NO: 5138139 - DNA, 16 bp, Homo sapiens
acagtgcccaccgccc

SEQ ID NO: 5138140 - DNA, 17 bp, Homo sapiens
acagtgcccaccgccct

SEQ ID NO: 5138141 - DNA, 21 bp, Homo sapiens
acagtgcccaccgccctcctc

SEQ ID NO: 5138142 - DNA, 10 bp, Homo sapiens
acagtgcccc

SEQ ID NO: 5138143 - DNA, 19 bp, Homo sapiens
acagtgcctcttccagtga

SEQ ID NO: 5138144 - DNA, 14 bp, Homo sapiens
acagtgcctgctga

SEQ ID NO: 5138145 - DNA, 22 bp, Homo sapiens
acagtgcctggcccattcttga

SEQ ID NO: 5138146 - DNA, 14 bp, Homo sapiens
acagtgcctgggaa

SEQ ID NO: 5138147 - DNA, 23 bp, Homo sapiens
acagtgcgttgagtgtacagatt

SEQ ID NO: 5138148 - DNA, 16 bp, Homo sapiens
acagtgctaaaaatgg

SEQ ID NO: 5138149 - DNA, 20 bp, Homo sapiens
acagtgctgaccagacagcc

SEQ ID NO: 5138150 - DNA, 14 bp, Homo sapiens
acagtgctgcccct

SEQ ID NO: 5138151 - DNA, 17 bp, Homo sapiens
acagtgctgccccttgc

SEQ ID NO: 5138152 - DNA, 18 bp, Homo sapiens
acagtgctgccccttgca

SEQ ID NO: 5138153 - DNA, 20 bp, Homo sapiens
acagtgctgccccttgcaag

SEQ ID NO: 5138154 - DNA, 23 bp, Homo sapiens
acagtgctgccccttgcaagcca

SEQ ID NO: 5138155 - DNA, 14 bp, Homo sapiens
acagtgctgccctg

SEQ ID NO: 5138156 - DNA, 16 bp, Homo sapiens
acagtgctgccctgcg

SEQ ID NO: 5138157 - DNA, 22 bp, Homo sapiens
acagtgctgtctgatctgtgct

SEQ ID NO: 5138158 - DNA, 21 bp, Homo sapiens
acagtgctgttctggagctgc

SEQ ID NO: 5138159 - DNA, 16 bp, Homo sapiens
acagtgctgttgaaga

SEQ ID NO: 5138160 - DNA, 15 bp, Homo sapiens
acagtgcttcagcct

SEQ ID NO: 5138161 - DNA, 23 bp, Homo sapiens
acagtgcttctacacatttcatc

SEQ ID NO: 5138162 - DNA, 13 bp, Homo sapiens
acagtgcttgcat

SEQ ID NO: 5138163 - DNA, 16 bp, Homo sapiens
acagtgcttgcatcct

SEQ ID NO: 5138164 - DNA, 20 bp, Homo sapiens
acagtgcttgcatcctattt

SEQ ID NO: 5138165 - DNA, 23 bp, Homo sapiens
acagtgcttgcatcctatttggt

SEQ ID NO: 5138166 - DNA, 17 bp, Homo sapiens
acagtgctttgtaaatt

SEQ ID NO: 5138167 - DNA, 22 bp, Homo sapiens
acagtggaagtttttttttcct

SEQ ID NO: 5138168 - DNA, 19 bp, Homo sapiens
acagtggactcagcagtga

SEQ ID NO: 5138169 - DNA, 13 bp, Homo sapiens
acagtggagaaat

SEQ ID NO: 5138170 - DNA, 22 bp, Homo sapiens
acatgttaagataacttactgt

SEQ ID NO: 5138171 - DNA, 11 bp, Homo sapiens
acatgttactg

SEQ ID NO: 5138172 - DNA, 17 bp, Homo sapiens
acatgttactgaccagc

SEQ ID NO: 5138173 - DNA, 22 bp, Homo sapiens
acatgttactggataaattgtt

SEQ ID NO: 5138174 - DNA, 19 bp, Homo sapiens
acatgttatccacaagcaa

SEQ ID NO: 5138175 - DNA, 14 bp, Homo sapiens
acatgttatttgta

SEQ ID NO: 5138176 - DNA, 19 bp, Homo sapiens
acatgttcccaaaacaatg

SEQ ID NO: 5138177 - DNA, 22 bp, Homo sapiens
acatgttctaggtttcagcaac

SEQ ID NO: 5138178 - DNA, 14 bp, Homo sapiens
acatgttcttgtca

SEQ ID NO: 5138179 - DNA, 19 bp, Homo sapiens
acatgttggaggagagagc

SEQ ID NO: 5138180 - DNA, 21 bp, Homo sapiens
acatgttggaggagagagcct

SEQ ID NO: 5138181 - DNA, 20 bp, Homo sapiens
acatgttggtatttatctat

SEQ ID NO: 5138182 - DNA, 14 bp, Homo sapiens
acatgttgtacatt

SEQ ID NO: 5138183 - DNA, 20 bp, Homo sapiens
acatgttgtatttatggaag

SEQ ID NO: 5138184 - DNA, 22 bp, Homo sapiens
acatgttgtttgttttatttgg

SEQ ID NO: 5138185 - DNA, 17 bp, Homo sapiens
acatgtttaaattcacc

SEQ ID NO: 5138186 - DNA, 17 bp, Homo sapiens
acatgtttaaattgtaa

SEQ ID NO: 5138187 - DNA, 21 bp, Homo sapiens
acatgtttaataaataaaaat

SEQ ID NO: 5138188 - DNA, 14 bp, Homo sapiens
acatgtttatgtaa

SEQ ID NO: 5138189 - DNA, 21 bp, Homo sapiens
acatgtttatgtaaacaaatc

SEQ ID NO: 5138190 - DNA, 21 bp, Homo sapiens
acatgtttatttattctgcat

SEQ ID NO: 5138191 - DNA, 23 bp, Homo sapiens
acatgtttatttattctgcattt

SEQ ID NO: 5138192 - DNA, 18 bp, Homo sapiens
acatgtttcaagaaccgc

SEQ ID NO: 5138193 - DNA, 15 bp, Homo sapiens
acatgtttcacaaca

SEQ ID NO: 5138194 - DNA, 16 bp, Homo sapiens
acatgtttcacaacag

SEQ ID NO: 5138195 - DNA, 20 bp, Homo sapiens
acatgtttcacaacaggcat

SEQ ID NO: 5138196 - DNA, 12 bp, Homo sapiens
acatgtttcaga

SEQ ID NO: 5138197 - DNA, 13 bp, Homo sapiens
acatgtttccagc

SEQ ID NO: 5138198 - DNA, 14 bp, Homo sapiens
acatgtttccagca

SEQ ID NO: 5138199 - DNA, 21 bp, Homo sapiens
acatgtttccagcattcccag

SEQ ID NO: 5138200 - DNA, 22 bp, Homo sapiens
acatgtttccagcattcccagg

SEQ ID NO: 5138201 - DNA, 23 bp, Homo sapiens
acatgtttccagcattcccaggt

SEQ ID NO: 5138202 - DNA, 16 bp, Homo sapiens
acatgtttcctctagt

SEQ ID NO: 5138203 - DNA, 19 bp, Homo sapiens
acatgtttctttgtaatga

SEQ ID NO: 5138204 - DNA, 22 bp, Homo sapiens
acatgtttctttgtaatgaaaa

SEQ ID NO: 5138205 - DNA, 17 bp, Homo sapiens
acatgttttagacaaat

SEQ ID NO: 5138206 - DNA, 20 bp, Homo sapiens
acatgttttagacaaatact

SEQ ID NO: 5138207 - DNA, 22 bp, Homo sapiens
acatgttttagacaaatactca

SEQ ID NO: 5138208 - DNA, 19 bp, Homo sapiens
acatgttttatactgctct

SEQ ID NO: 5138209 - DNA, 11 bp, Homo sapiens
acatgttttca

SEQ ID NO: 5138210 - DNA, 16 bp, Homo sapiens
acatgttttcaaatgg

SEQ ID NO: 5138211 - DNA, 18 bp, Homo sapiens
acatgtttttatttcctc

SEQ ID NO: 5138212 - DNA, 13 bp, Homo sapiens
acattaaaaagcc

SEQ ID NO: 5138213 - DNA, 14 bp, Homo sapiens
acattaaaaagcct

SEQ ID NO: 5138214 - DNA, 16 bp, Homo sapiens
acattaaaaagcctta

SEQ ID NO: 5138215 - DNA, 23 bp, Homo sapiens
acattaaaaagccttacagttat

SEQ ID NO: 5138216 - DNA, 15 bp, Homo sapiens
acattaaaacaatat

SEQ ID NO: 5138217 - DNA, 12 bp, Homo sapiens
acattaaaagaa

SEQ ID NO: 5138218 - DNA, 22 bp, Homo sapiens
acattaaaagctttagattgaa

SEQ ID NO: 5138219 - DNA, 18 bp, Homo sapiens
acattaaaataaaccaaa

SEQ ID NO: 5138220 - DNA, 16 bp, Homo sapiens
acattaaaatgacaaa

SEQ ID NO: 5138221 - DNA, 19 bp, Homo sapiens
acattaaaatgacaaacat

SEQ ID NO: 5138222 - DNA, 23 bp, Homo sapiens
acattaaaatgacaaacatgata

SEQ ID NO: 5138223 - DNA, 19 bp, Homo sapiens
acattaaacactgtaatct

SEQ ID NO: 5138224 - DNA, 22 bp, Homo sapiens
acattaaagaagggttgagctg

SEQ ID NO: 5138225 - DNA, 15 bp, Homo sapiens
acattaaagttaata

SEQ ID NO: 5138226 - DNA, 12 bp, Homo sapiens
acattaaatgac

SEQ ID NO: 5138227 - DNA, 19 bp, Homo sapiens
acattaaatgactcttccc

SEQ ID NO: 5138228 - DNA, 17 bp, Homo sapiens
acattaaatgcaataat

SEQ ID NO: 5138229 - DNA, 19 bp, Homo sapiens
acattaaatgcaataattt

SEQ ID NO: 5138230 - DNA, 20 bp, Homo sapiens
acattaaatgcaataatttt

SEQ ID NO: 5138231 - DNA, 23 bp, Homo sapiens
acattaaatgcaataattttact

SEQ ID NO: 5138232 - DNA, 14 bp, Homo sapiens
acattaaatgtctt

SEQ ID NO: 5138233 - DNA, 14 bp, Homo sapiens
acattaaattaaat

SEQ ID NO: 5138234 - DNA, 17 bp, Homo sapiens
acattaacagttttcca

SEQ ID NO: 5138235 - DNA, 18 bp, Homo sapiens
acattaacagttttccat

SEQ ID NO: 5138236 - DNA, 12 bp, Homo sapiens
acattaacattt

SEQ ID NO: 5138237 - DNA, 21 bp, Homo sapiens
acattaacattttgagctatt

SEQ ID NO: 5138238 - DNA, 19 bp, Homo sapiens
acattaacccccaaattca

SEQ ID NO: 5138239 - DNA, 16 bp, Homo sapiens
acattaacggtgctaa

SEQ ID NO: 5138240 - DNA, 22 bp, Homo sapiens
acattaactcattagactggaa

SEQ ID NO: 5138241 - DNA, 20 bp, Homo sapiens
acattaactccctccaccag

SEQ ID NO: 5138242 - DNA, 16 bp, Homo sapiens
acattaagaaaatcat

SEQ ID NO: 5138243 - DNA, 22 bp, Homo sapiens
acattaagagaacaaagagtga

SEQ ID NO: 5138244 - DNA, 20 bp, Homo sapiens
acattaagattgaggcctgc

SEQ ID NO: 5138245 - DNA, 16 bp, Homo sapiens
acattaagcatcacaa

SEQ ID NO: 5138246 - DNA, 19 bp, Homo sapiens
acattaagcatcacaaatg

SEQ ID NO: 5138247 - DNA, 17 bp, Homo sapiens
acattaagccttccaca

SEQ ID NO: 5138248 - DNA, 19 bp, Homo sapiens
acattaagtattccttggc

SEQ ID NO: 5138249 - DNA, 22 bp, Homo sapiens
acattaagtattccttggccca

SEQ ID NO: 5138250 - DNA, 14 bp, Homo sapiens
acattaataaacaa

SEQ ID NO: 5138251 - DNA, 16 bp, Homo sapiens
acattaatatttacca

SEQ ID NO: 5138252 - DNA, 17 bp, Homo sapiens
acattaatcaccaaagt

SEQ ID NO: 5138253 - DNA, 19 bp, Homo sapiens
acattaatccacatgtttc

SEQ ID NO: 5138254 - DNA, 22 bp, Homo sapiens
acattaatccacatgtttcaga

SEQ ID NO: 5138255 - DNA, 17 bp, Homo sapiens
acattaatggtctaaaa

SEQ ID NO: 5138256 - DNA, 21 bp, Homo sapiens
acattaatgttaattcagcac

SEQ ID NO: 5138257 - DNA, 13 bp, Homo sapiens
acattaatgttga

SEQ ID NO: 5138258 - DNA, 23 bp, Homo sapiens
acattaatgttgatttctagtta

SEQ ID NO: 5138259 - DNA, 17 bp, Homo sapiens
acattaattaattaaag

SEQ ID NO: 5138260 - DNA, 16 bp, Homo sapiens
acattaattctactaa

SEQ ID NO: 5138261 - DNA, 22 bp, Homo sapiens
acattaattgaggcttacagta

SEQ ID NO: 5138262 - DNA, 15 bp, Homo sapiens
acattaattttatga

SEQ ID NO: 5138263 - DNA, 22 bp, Homo sapiens
acattaattttgtgcattcttt

SEQ ID NO: 5138264 - DNA, 13 bp, Homo sapiens
acattacactaaa

SEQ ID NO: 5138265 - DNA, 14 bp, Homo sapiens
acattacactaaat

SEQ ID NO: 5138266 - DNA, 17 bp, Homo sapiens
acattacagttcataat

SEQ ID NO: 5138267 - DNA, 16 bp, Homo sapiens
acattacatgtaaatt

SEQ ID NO: 5138268 - DNA, 20 bp, Homo sapiens
acattaccttgtctttcaaa

SEQ ID NO: 5138269 - DNA, 13 bp, Homo sapiens
acattactaaata

SEQ ID NO: 5138270 - DNA, 20 bp, Homo sapiens
acattactgaaaacttcatt

SEQ ID NO: 5138271 - DNA, 15 bp, Homo sapiens
acattagaaatattc

SEQ ID NO: 5138272 - DNA, 11 bp, Homo sapiens
acattagaact

SEQ ID NO: 5138273 - DNA, 13 bp, Homo sapiens
acattagaacttc

SEQ ID NO: 5138274 - DNA, 14 bp, Homo sapiens
acattagaacttct

SEQ ID NO: 5138275 - DNA, 22 bp, Homo sapiens
acattagaacttctccgtcctc

SEQ ID NO: 5138276 - DNA, 15 bp, Homo sapiens
acattagaagaaaac

SEQ ID NO: 5138277 - DNA, 21 bp, Homo sapiens
acattagaagaaaacatatat

SEQ ID NO: 5138278 - DNA, 15 bp, Homo sapiens
acattagaagacaat

SEQ ID NO: 5138279 - DNA, 21 bp, Homo sapiens
acattagaagacaattgacaa

SEQ ID NO: 5138280 - DNA, 20 bp, Homo sapiens
acattagaataaaaggtagt

SEQ ID NO: 5138281 - DNA, 19 bp, Homo sapiens
acattagagaaaaccttaa

SEQ ID NO: 5138282 - DNA, 14 bp, Homo sapiens
acattagagaacat

SEQ ID NO: 5138283 - DNA, 22 bp, Homo sapiens
acattagataaattactataaa

SEQ ID NO: 5138284 - DNA, 19 bp, Homo sapiens
acattaggaaaagttgcta

SEQ ID NO: 5138285 - DNA, 21 bp, Homo sapiens
acattaggaagctgaattatt

SEQ ID NO: 5138286 - DNA, 22 bp, Homo sapiens
acattaggaagtggcagttctt

SEQ ID NO: 5138287 - DNA, 17 bp, Homo sapiens
acattaggttgtgaatg

SEQ ID NO: 5138288 - DNA, 18 bp, Homo sapiens
acattagtaaatgtcttt

SEQ ID NO: 5138289 - DNA, 19 bp, Homo sapiens
acattagtaaatgtctttg

SEQ ID NO: 5138290 - DNA, 21 bp, Homo sapiens
acattagtaaatgtctttgta

SEQ ID NO: 5138291 - DNA, 23 bp, Homo sapiens
acattagtaaatgtctttgtaag

SEQ ID NO: 5138292 - DNA, 22 bp, Homo sapiens
acattagtactttatagaagaa

SEQ ID NO: 5138293 - DNA, 23 bp, Homo sapiens
acattagtactttatagaagaat

SEQ ID NO: 5138294 - DNA, 14 bp, Homo sapiens
acattagttgcact

SEQ ID NO: 5138295 - DNA, 12 bp, Homo sapiens
acattagtttgc

SEQ ID NO: 5138296 - DNA, 19 bp, Homo sapiens
acattagttttaatctctt

SEQ ID NO: 5138297 - DNA, 20 bp, Homo sapiens
acattataaaccttcagaag

SEQ ID NO: 5138298 - DNA, 14 bp, Homo sapiens
acattataaatgac

SEQ ID NO: 5138299 - DNA, 14 bp, Homo sapiens
acattataacaact

SEQ ID NO: 5138300 - DNA, 15 bp, Homo sapiens
acattataccgcaga

SEQ ID NO: 5138301 - DNA, 16 bp, Homo sapiens
acattataccgcagag

SEQ ID NO: 5138302 - DNA, 20 bp, Homo sapiens
acattataccgcagagtatt

SEQ ID NO: 5138303 - DNA, 21 bp, Homo sapiens
acattatataacaaaaaaggt

SEQ ID NO: 5138304 - DNA, 14 bp, Homo sapiens
acattatattgcaa

SEQ ID NO: 5138305 - DNA, 15 bp, Homo sapiens
acattatattgcaat

SEQ ID NO: 5138306 - DNA, 12 bp, Homo sapiens
acattatatttg

SEQ ID NO: 5138307 - DNA, 17 bp, Homo sapiens
acattatcactgaaaaa

SEQ ID NO: 5138308 - DNA, 19 bp, Homo sapiens
acattatcactgaaaaaat

SEQ ID NO: 5138309 - DNA, 21 bp, Homo sapiens
acattatcactgaaaaaatgt

SEQ ID NO: 5138310 - DNA, 15 bp, Homo sapiens
acattatcattcaaa

SEQ ID NO: 5138311 - DNA, 23 bp, Homo sapiens
acattatcattcaaaacaaccat

SEQ ID NO: 5138312 - DNA, 13 bp, Homo sapiens
acattatcctgtg

SEQ ID NO: 5138313 - DNA, 21 bp, Homo sapiens
acattatctcacttagtcctt

SEQ ID NO: 5138314 - DNA, 19 bp, Homo sapiens
acattatctcacttgtgcc

SEQ ID NO: 5138315 - DNA, 21 bp, Homo sapiens
acattatcttcatatgtcacc

SEQ ID NO: 5138316 - DNA, 16 bp, Homo sapiens
acattatgatctaata

SEQ ID NO: 5138317 - DNA, 20 bp, Homo sapiens
acattatgatctaataaact

SEQ ID NO: 5138318 - DNA, 20 bp, Homo sapiens
acattatgcccttgagtcta

SEQ ID NO: 5138319 - DNA, 21 bp, Homo sapiens
acattatgtggttttagattt

SEQ ID NO: 5138320 - DNA, 14 bp, Homo sapiens
acattatgtgtgca

SEQ ID NO: 5138321 - DNA, 17 bp, Homo sapiens
acattatgtgtgcatgt

SEQ ID NO: 5138322 - DNA, 16 bp, Homo sapiens
acattatgttattgga

SEQ ID NO: 5138323 - DNA, 20 bp, Homo sapiens
acattatgttattggaattt

SEQ ID NO: 5138324 - DNA, 14 bp, Homo sapiens
acattatgttttat

SEQ ID NO: 5138325 - DNA, 14 bp, Homo sapiens
acattattaaagtt

SEQ ID NO: 5138326 - DNA, 17 bp, Homo sapiens
acattattaaagttttc

SEQ ID NO: 5138327 - DNA, 18 bp, Homo sapiens
acattattaaatcagaat

SEQ ID NO: 5138328 - DNA, 22 bp, Homo sapiens
acattattaagtaacttattta

SEQ ID NO: 5138329 - DNA, 14 bp, Homo sapiens
acattattaatcat

SEQ ID NO: 5138330 - DNA, 17 bp, Homo sapiens
acattattaatcattcc

SEQ ID NO: 5138331 - DNA, 19 bp, Homo sapiens
acattattaatcattccat

SEQ ID NO: 5138332 - DNA, 18 bp, Homo sapiens
acattattatcaacaata

SEQ ID NO: 5138333 - DNA, 12 bp, Homo sapiens
acattattctgg

SEQ ID NO: 5138334 - DNA, 20 bp, Homo sapiens
acattattggacttccattt

SEQ ID NO: 5138335 - DNA, 14 bp, Homo sapiens
acattatttatatg

SEQ ID NO: 5138336 - DNA, 21 bp, Homo sapiens
acattatttattaaaaatgtt

SEQ ID NO: 5138337 - DNA, 23 bp, Homo sapiens
acattatttcgtgttgtgttctt

SEQ ID NO: 5138338 - DNA, 16 bp, Homo sapiens
acattatttctagtcc

SEQ ID NO: 5138339 - DNA, 16 bp, Homo sapiens
acattatttcttccca

SEQ ID NO: 5138340 - DNA, 12 bp, Homo sapiens
acattattttaa

SEQ ID NO: 5138341 - DNA, 19 bp, Homo sapiens
acattattttttatttctg

SEQ ID NO: 5138342 - DNA, 21 bp, Homo sapiens
acattcaaaaacatggccaca

SEQ ID NO: 5138343 - DNA, 16 bp, Homo sapiens
acattcaaaagcacaa

SEQ ID NO: 5138344 - DNA, 24 bp, Homo sapiens
acattcaaaatagggtatattttc

SEQ ID NO: 5138345 - DNA, 19 bp, Homo sapiens
acattcaaatttgtctggt

SEQ ID NO: 5138346 - DNA, 18 bp, Homo sapiens
acattcaacagagactga

SEQ ID NO: 5138347 - DNA, 21 bp, Homo sapiens
acagtggagctgaattttctg

SEQ ID NO: 5138348 - DNA, 22 bp, Homo sapiens
acagtggaggaaaatccatgga

SEQ ID NO: 5138349 - DNA, 17 bp, Homo sapiens
acagtggagtgcaaaag

SEQ ID NO: 5138350 - DNA, 17 bp, Homo sapiens
acagtggattgcatttc

SEQ ID NO: 5138351 - DNA, 20 bp, Homo sapiens
acagtggcaaaacaaaagta

SEQ ID NO: 5138352 - DNA, 20 bp, Homo sapiens
acagtggcaagctaccaact

SEQ ID NO: 5138353 - DNA, 22 bp, Homo sapiens
acagtggcacggagagaaggcc

SEQ ID NO: 5138354 - DNA, 20 bp, Homo sapiens
acagtggcaggacaggaaaa

SEQ ID NO: 5138355 - DNA, 15 bp, Homo sapiens
acagtggccggggct

SEQ ID NO: 5138356 - DNA, 16 bp, Homo sapiens
acagtggccggggctg

SEQ ID NO: 5138357 - DNA, 12 bp, Homo sapiens
acagtggcctct

SEQ ID NO: 5138358 - DNA, 14 bp, Homo sapiens
acagtggcctcttg

SEQ ID NO: 5138359 - DNA, 23 bp, Homo sapiens
acagtggccttgagcttcaaaat

SEQ ID NO: 5138360 - DNA, 16 bp, Homo sapiens
acagtggcgagaggag

SEQ ID NO: 5138361 - DNA, 21 bp, Homo sapiens
acagtggctcacgcctgtaat

SEQ ID NO: 5138362 - DNA, 17 bp, Homo sapiens
acagtggctgctctggg

SEQ ID NO: 5138363 - DNA, 20 bp, Homo sapiens
acagtggctgctctgggaag

SEQ ID NO: 5138364 - DNA, 22 bp, Homo sapiens
acagtggctgctctgggaaggg

SEQ ID NO: 5138365 - DNA, 12 bp, Homo sapiens
acagtggctggg

SEQ ID NO: 5138366 - DNA, 18 bp, Homo sapiens
acagtggctgggtgggcc

SEQ ID NO: 5138367 - DNA, 12 bp, Homo sapiens
acagtgggaaat

SEQ ID NO: 5138368 - DNA, 14 bp, Homo sapiens
acagtgggaaatat

SEQ ID NO: 5138369 - DNA, 16 bp, Homo sapiens
acagtgggaactctga

SEQ ID NO: 5138370 - DNA, 17 bp, Homo sapiens
acagtgggaactggagg

SEQ ID NO: 5138371 - DNA, 13 bp, Homo sapiens
acagtgggagcca

SEQ ID NO: 5138372 - DNA, 15 bp, Homo sapiens
acagtgggagccctg

SEQ ID NO: 5138373 - DNA, 23 bp, Homo sapiens
acagtgggagctgagctggaagg

SEQ ID NO: 5138374 - DNA, 16 bp, Homo sapiens
acagtgggcatcagca

SEQ ID NO: 5138375 - DNA, 23 bp, Homo sapiens
acagtgggccggccccaggctcc

SEQ ID NO: 5138376 - DNA, 19 bp, Homo sapiens
acagtgggcgttgggagcc

SEQ ID NO: 5138377 - DNA, 15 bp, Homo sapiens
acagtggggaagagt

SEQ ID NO: 5138378 - DNA, 15 bp, Homo sapiens
acagtggggaatgaa

SEQ ID NO: 5138379 - DNA, 18 bp, Homo sapiens
acagtggggctgcaggca

SEQ ID NO: 5138380 - DNA, 10 bp, Homo sapiens
acagtggggg

SEQ ID NO: 5138381 - DNA, 18 bp, Homo sapiens
acagtgggggtgcctggt

SEQ ID NO: 5138382 - DNA, 16 bp, Homo sapiens
acagtggggttttttt

SEQ ID NO: 5138383 - DNA, 16 bp, Homo sapiens
acagtgggtggcacct

SEQ ID NO: 5138384 - DNA, 15 bp, Homo sapiens
acagtggtactctgt

SEQ ID NO: 5138385 - DNA, 18 bp, Homo sapiens
acagtggtagagaggttt

SEQ ID NO: 5138386 - DNA, 13 bp, Homo sapiens
acagtggtggcag

SEQ ID NO: 5138387 - DNA, 17 bp, Homo sapiens
acagtggtggcagggcc

SEQ ID NO: 5138388 - DNA, 15 bp, Homo sapiens
acagtggttgcctgg

SEQ ID NO: 5138389 - DNA, 18 bp, Homo sapiens
acagtggttttatactga

SEQ ID NO: 5138390 - DNA, 18 bp, Homo sapiens
acagtgtaaaaattcaga

SEQ ID NO: 5138391 - DNA, 13 bp, Homo sapiens
acagtgtaagctt

SEQ ID NO: 5138392 - DNA, 19 bp, Homo sapiens
acagtgtaatccaggggtg

SEQ ID NO: 5138393 - DNA, 17 bp, Homo sapiens
acagtgtacagtcttgt

SEQ ID NO: 5138394 - DNA, 17 bp, Homo sapiens
acagtgtacatgtacat

SEQ ID NO: 5138395 - DNA, 18 bp, Homo sapiens
acagtgtaccattaaaat

SEQ ID NO: 5138396 - DNA, 15 bp, Homo sapiens
acagtgtatttaaga

SEQ ID NO: 5138397 - DNA, 16 bp, Homo sapiens
acagtgtcccccaggt

SEQ ID NO: 5138398 - DNA, 24 bp, Homo sapiens
acagtgtcccccaggttccgaaga

SEQ ID NO: 5138399 - DNA, 24 bp, Homo sapiens
acagtgtctgtatcggagacagtg

SEQ ID NO: 5138400 - DNA, 11 bp, Homo sapiens
acagtgtcttt

SEQ ID NO: 5138401 - DNA, 12 bp, Homo sapiens
acagtgtctttt

SEQ ID NO: 5138402 - DNA, 13 bp, Homo sapiens
acagtgtgaagtt

SEQ ID NO: 5138403 - DNA, 16 bp, Homo sapiens
acagtgtgaagttaga

SEQ ID NO: 5138404 - DNA, 18 bp, Homo sapiens
acagtgtgaagttagaat

SEQ ID NO: 5138405 - DNA, 22 bp, Homo sapiens
acagtgtgaagttagaattcct

SEQ ID NO: 5138406 - DNA, 13 bp, Homo sapiens
acagtgtgcaagg

SEQ ID NO: 5138407 - DNA, 20 bp, Homo sapiens
acagtgtggcttaaacattt

SEQ ID NO: 5138408 - DNA, 20 bp, Homo sapiens
acagtgtgggacaggctctt

SEQ ID NO: 5138409 - DNA, 21 bp, Homo sapiens
acagtgtgggacaggctcttc

SEQ ID NO: 5138410 - DNA, 15 bp, Homo sapiens
acagtgtggtagtta

SEQ ID NO: 5138411 - DNA, 17 bp, Homo sapiens
acagtgtgtaaacaaaa

SEQ ID NO: 5138412 - DNA, 22 bp, Homo sapiens
acagtgtgtggtcaacatttct

SEQ ID NO: 5138413 - DNA, 20 bp, Homo sapiens
acagtgttattttctttgaa

SEQ ID NO: 5138414 - DNA, 13 bp, Homo sapiens
acagtgttcaaat

SEQ ID NO: 5138415 - DNA, 21 bp, Homo sapiens
acagtgttcatttgaaagagg

SEQ ID NO: 5138416 - DNA, 21 bp, Homo sapiens
acagtgttccagctgcctggg

SEQ ID NO: 5138417 - DNA, 15 bp, Homo sapiens
acagtgttctgagcc

SEQ ID NO: 5138418 - DNA, 16 bp, Homo sapiens
acagtgttctgagccc

SEQ ID NO: 5138419 - DNA, 14 bp, Homo sapiens
acagtgttctgttt

SEQ ID NO: 5138420 - DNA, 17 bp, Homo sapiens
acagtgttctgtttaat

SEQ ID NO: 5138421 - DNA, 19 bp, Homo sapiens
acagtgtttcaattctgta

SEQ ID NO: 5138422 - DNA, 16 bp, Homo sapiens
acagtgtttccagtga

SEQ ID NO: 5138423 - DNA, 22 bp, Homo sapiens
acagtgtttcccataattttct

SEQ ID NO: 5138424 - DNA, 19 bp, Homo sapiens
acagtgtttcctgagtagc

SEQ ID NO: 5138425 - DNA, 21 bp, Homo sapiens
acagtgtttcctgagtagcag

SEQ ID NO: 5138426 - DNA, 17 bp, Homo sapiens
acagtgtttgcaatggt

SEQ ID NO: 5138427 - DNA, 16 bp, Homo sapiens
acagtgttttcagaag

SEQ ID NO: 5138428 - DNA, 22 bp, Homo sapiens
acagtgtttttgtaaagtgtgg

SEQ ID NO: 5138429 - DNA, 15 bp, Homo sapiens
acagttaaacttgca

SEQ ID NO: 5138430 - DNA, 18 bp, Homo sapiens
acagttaaacttgcaatg

SEQ ID NO: 5138431 - DNA, 16 bp, Homo sapiens
acagttaaggaatata

SEQ ID NO: 5138432 - DNA, 14 bp, Homo sapiens
acagttaattatgt

SEQ ID NO: 5138433 - DNA, 18 bp, Homo sapiens
acagttacaagctttaaa

SEQ ID NO: 5138434 - DNA, 14 bp, Homo sapiens
acagttacagttga

SEQ ID NO: 5138435 - DNA, 13 bp, Homo sapiens
acagttacataat

SEQ ID NO: 5138436 - DNA, 18 bp, Homo sapiens
acagttactcttcagttt

SEQ ID NO: 5138437 - DNA, 16 bp, Homo sapiens
acagttacttaagatt

SEQ ID NO: 5138438 - DNA, 22 bp, Homo sapiens
acagttagcagggatgttcctt

SEQ ID NO: 5138439 - DNA, 12 bp, Homo sapiens
acagttagcatt

SEQ ID NO: 5138440 - DNA, 13 bp, Homo sapiens
acagttagcattt

SEQ ID NO: 5138441 - DNA, 14 bp, Homo sapiens
acagttagcattta

SEQ ID NO: 5138442 - DNA, 18 bp, Homo sapiens
acagttagcatttaccaa

SEQ ID NO: 5138443 - DNA, 16 bp, Homo sapiens
acagttagccactgct

SEQ ID NO: 5138444 - DNA, 23 bp, Homo sapiens
acagttagggttttgcaataact

SEQ ID NO: 5138445 - DNA, 14 bp, Homo sapiens
acagttataaaatt

SEQ ID NO: 5138446 - DNA, 23 bp, Homo sapiens
acagttatatttttgtgttttct

SEQ ID NO: 5138447 - DNA, 17 bp, Homo sapiens
acagttatcctgcaagg

SEQ ID NO: 5138448 - DNA, 16 bp, Homo sapiens
acagttatcttagctg

SEQ ID NO: 5138449 - DNA, 21 bp, Homo sapiens
acagttatgtgggtggcttct

SEQ ID NO: 5138450 - DNA, 18 bp, Homo sapiens
acagttattaaaatgtta

SEQ ID NO: 5138451 - DNA, 17 bp, Homo sapiens
acagttattaattaaag

SEQ ID NO: 5138452 - DNA, 14 bp, Homo sapiens
acagttatttatag

SEQ ID NO: 5138453 - DNA, 22 bp, Homo sapiens
acagttatttcatcttttattc

SEQ ID NO: 5138454 - DNA, 18 bp, Homo sapiens
acagttattttggatata

SEQ ID NO: 5138455 - DNA, 22 bp, Homo sapiens
acagttattttggatatattat

SEQ ID NO: 5138456 - DNA, 22 bp, Homo sapiens
acagttcaaaattctaaatgta

SEQ ID NO: 5138457 - DNA, 13 bp, Homo sapiens
acagttcaaagaa

SEQ ID NO: 5138458 - DNA, 12 bp, Homo sapiens
acagttcaagaa

SEQ ID NO: 5138459 - DNA, 16 bp, Homo sapiens
acagttcaagaaagct

SEQ ID NO: 5138460 - DNA, 20 bp, Homo sapiens
acagttcaagaaagcttcaa

SEQ ID NO: 5138461 - DNA, 23 bp, Homo sapiens
acagttcaataaacttaacttta

SEQ ID NO: 5138462 - DNA, 17 bp, Homo sapiens
acagttcacaccctgca

SEQ ID NO: 5138463 - DNA, 21 bp, Homo sapiens
acagttcacagaggtctttca

SEQ ID NO: 5138464 - DNA, 16 bp, Homo sapiens
acagttcagagatcag

SEQ ID NO: 5138465 - DNA, 20 bp, Homo sapiens
acagttcagtggcagggctc

SEQ ID NO: 5138466 - DNA, 16 bp, Homo sapiens
acagttcagttcctct

SEQ ID NO: 5138467 - DNA, 21 bp, Homo sapiens
acagttcagttcctctttgca

SEQ ID NO: 5138468 - DNA, 16 bp, Homo sapiens
acagttcataaatttg

SEQ ID NO: 5138469 - DNA, 22 bp, Homo sapiens
acagttcataaatttgttgtca

SEQ ID NO: 5138470 - DNA, 20 bp, Homo sapiens
acagttcatgtttgcttcat

SEQ ID NO: 5138471 - DNA, 13 bp, Homo sapiens
acagttcatttaa

SEQ ID NO: 5138472 - DNA, 16 bp, Homo sapiens
acagttccacaatttt

SEQ ID NO: 5138473 - DNA, 14 bp, Homo sapiens
acagttccatttat

SEQ ID NO: 5138474 - DNA, 20 bp, Homo sapiens
acagttcccctatgtggaag

SEQ ID NO: 5138475 - DNA, 14 bp, Homo sapiens
acagttcctcgccc

SEQ ID NO: 5138476 - DNA, 19 bp, Homo sapiens
acagttcctcgccctgggt

SEQ ID NO: 5138477 - DNA, 13 bp, Homo sapiens
acagttcctggga

SEQ ID NO: 5138478 - DNA, 21 bp, Homo sapiens
acagttcctgggaacatcaca

SEQ ID NO: 5138479 - DNA, 19 bp, Homo sapiens
acagttcggtgagctacaa

SEQ ID NO: 5138480 - DNA, 18 bp, Homo sapiens
acagttctacagaaaaac

SEQ ID NO: 5138481 - DNA, 23 bp, Homo sapiens
acagttctatttgctatctgaac

SEQ ID NO: 5138482 - DNA, 16 bp, Homo sapiens
acagttctctccttct

SEQ ID NO: 5138483 - DNA, 15 bp, Homo sapiens
acagttctgaagaat

SEQ ID NO: 5138484 - DNA, 19 bp, Homo sapiens
acagttctgagctgtaatt

SEQ ID NO: 5138485 - DNA, 16 bp, Homo sapiens
acagttctgctctggt

SEQ ID NO: 5138486 - DNA, 14 bp, Homo sapiens
acagttctggagga

SEQ ID NO: 5138487 - DNA, 13 bp, Homo sapiens
acagttctgtcat

SEQ ID NO: 5138488 - DNA, 15 bp, Homo sapiens
acagttcttcgggaa

SEQ ID NO: 5138489 - DNA, 17 bp, Homo sapiens
acagttctttcctcttt

SEQ ID NO: 5138490 - DNA, 22 bp, Homo sapiens
acagttctttcctctttctgct

SEQ ID NO: 5138491 - DNA, 17 bp, Homo sapiens
acagttctttgggccag

SEQ ID NO: 5138492 - DNA, 20 bp, Homo sapiens
acagttctttgggccagaca

SEQ ID NO: 5138493 - DNA, 22 bp, Homo sapiens
acagttcttttgttgtaaagag

SEQ ID NO: 5138494 - DNA, 17 bp, Homo sapiens
acagttgaaaacttgta

SEQ ID NO: 5138495 - DNA, 15 bp, Homo sapiens
acagttgactggctt

SEQ ID NO: 5138496 - DNA, 15 bp, Homo sapiens
acagttgagtgaaat

SEQ ID NO: 5138497 - DNA, 18 bp, Homo sapiens
acagttgatatttaaaag

SEQ ID NO: 5138498 - DNA, 16 bp, Homo sapiens
acagttgatggagccc

SEQ ID NO: 5138499 - DNA, 13 bp, Homo sapiens
acagttgcacagc

SEQ ID NO: 5138500 - DNA, 19 bp, Homo sapiens
acagttgcacagcatctca

SEQ ID NO: 5138501 - DNA, 20 bp, Homo sapiens
acagttgcacagcatctcag

SEQ ID NO: 5138502 - DNA, 23 bp, Homo sapiens
acagttgcatgtagtaacactaa

SEQ ID NO: 5138503 - DNA, 19 bp, Homo sapiens
acagttgccaccacctctg

SEQ ID NO: 5138504 - DNA, 22 bp, Homo sapiens
acagttgctgtcataagaatga

SEQ ID NO: 5138505 - DNA, 13 bp, Homo sapiens
acagttgctgtga

SEQ ID NO: 5138506 - DNA, 18 bp, Homo sapiens
acagttgctgttgtgtga

SEQ ID NO: 5138507 - DNA, 23 bp, Homo sapiens
acagttggagggaaagccagcct

SEQ ID NO: 5138508 - DNA, 13 bp, Homo sapiens
acagttggcactg

SEQ ID NO: 5138509 - DNA, 14 bp, Homo sapiens
acagttggccgatt

SEQ ID NO: 5138510 - DNA, 19 bp, Homo sapiens
acagttgggaagtctcagc

SEQ ID NO: 5138511 - DNA, 15 bp, Homo sapiens
acagttgggatccaa

SEQ ID NO: 5138512 - DNA, 15 bp, Homo sapiens
acagttggtaacttt

SEQ ID NO: 5138513 - DNA, 21 bp, Homo sapiens
acagttgtaccactgctaata

SEQ ID NO: 5138514 - DNA, 13 bp, Homo sapiens
acagttgtattta

SEQ ID NO: 5138515 - DNA, 18 bp, Homo sapiens
acagttgtatttaacaga

SEQ ID NO: 5138516 - DNA, 12 bp, Homo sapiens
acagttgtcctg

SEQ ID NO: 5138517 - DNA, 14 bp, Homo sapiens
acagttgtcctgat

SEQ ID NO: 5138518 - DNA, 19 bp, Homo sapiens
acagttgtcctgatttctt

SEQ ID NO: 5138519 - DNA, 21 bp, Homo sapiens
acagttgtcctgatttcttat

SEQ ID NO: 5138520 - DNA, 20 bp, Homo sapiens
acagttgtctagagatatat

SEQ ID NO: 5138521 - DNA, 22 bp, Homo sapiens
acagttgtctattctgagcctt

SEQ ID NO: 5138522 - DNA, 23 bp, Homo sapiens
acagttgtgataatagcattttt

SEQ ID NO: 5138523 - DNA, 20 bp, Homo sapiens
acagttgtgtcataaattac

SEQ ID NO: 5138524 - DNA, 19 bp, Homo sapiens
acagttgtgttagcctctt

SEQ ID NO: 5138525 - DNA, 17 bp, Homo sapiens
acatctgaatctccttg

SEQ ID NO: 5138526 - DNA, 19 bp, Homo sapiens
acatctgaatctccttgtt

SEQ ID NO: 5138527 - DNA, 20 bp, Homo sapiens
acatctgaatctccttgttg

SEQ ID NO: 5138528 - DNA, 16 bp, Homo sapiens
acatctgacccagagg

SEQ ID NO: 5138529 - DNA, 18 bp, Homo sapiens
acatctgacctggcatct

SEQ ID NO: 5138530 - DNA, 13 bp, Homo sapiens
acatctgatttct

SEQ ID NO: 5138531 - DNA, 15 bp, Homo sapiens
acatctgatttctga

SEQ ID NO: 5138532 - DNA, 20 bp, Homo sapiens
acatctgcaatatgaattca

SEQ ID NO: 5138533 - DNA, 16 bp, Homo sapiens
accaactctctctgcc

SEQ ID NO: 5138534 - DNA, 13 bp, Homo sapiens
accaactgagcca

SEQ ID NO: 5138535 - DNA, 16 bp, Homo sapiens
accaactgcacaatca

SEQ ID NO: 5138536 - DNA, 19 bp, Homo sapiens
accaactgcacaatcagtt

SEQ ID NO: 5138537 - DNA, 15 bp, Homo sapiens
accaactgccccagg

SEQ ID NO: 5138538 - DNA, 16 bp, Homo sapiens
accaactgccccaggg

SEQ ID NO: 5138539 - DNA, 13 bp, Homo sapiens
accaactgcctta

SEQ ID NO: 5138540 - DNA, 17 bp, Homo sapiens
accaactgctctcaaaa

SEQ ID NO: 5138541 - DNA, 19 bp, Homo sapiens
accaactgctttgttttgg

SEQ ID NO: 5138542 - DNA, 11 bp, Homo sapiens
accaactggaa

SEQ ID NO: 5138543 - DNA, 17 bp, Homo sapiens
accaactggaagcacag

SEQ ID NO: 5138544 - DNA, 21 bp, Homo sapiens
accaactgtgttgtattaaca

SEQ ID NO: 5138545 - DNA, 23 bp, Homo sapiens
accaactgtgttgtattaacaaa

SEQ ID NO: 5138546 - DNA, 20 bp, Homo sapiens
accaacttggttctgcttca

SEQ ID NO: 5138547 - DNA, 15 bp, Homo sapiens
accaactttcccccc

SEQ ID NO: 5138548 - DNA, 20 bp, Homo sapiens
accaactttccccccaaccc

SEQ ID NO: 5138549 - DNA, 14 bp, Homo sapiens
accaactttctgta

SEQ ID NO: 5138550 - DNA, 21 bp, Homo sapiens
accaacttttctattaaaagt

SEQ ID NO: 5138551 - DNA, 19 bp, Homo sapiens
accaactttttcattccct

SEQ ID NO: 5138552 - DNA, 15 bp, Homo sapiens
accaagaactgcatg

SEQ ID NO: 5138553 - DNA, 11 bp, Homo sapiens
accaagaagat

SEQ ID NO: 5138554 - DNA, 16 bp, Homo sapiens
accaagaagatgtctt

SEQ ID NO: 5138555 - DNA, 16 bp, Homo sapiens
accaagaatgtctcca

SEQ ID NO: 5138556 - DNA, 17 bp, Homo sapiens
accaagaattgattggg

SEQ ID NO: 5138557 - DNA, 21 bp, Homo sapiens
accaagacaggttcaggtagg

SEQ ID NO: 5138558 - DNA, 14 bp, Homo sapiens
accaagactcctgc

SEQ ID NO: 5138559 - DNA, 12 bp, Homo sapiens
accaagagaagg

SEQ ID NO: 5138560 - DNA, 13 bp, Homo sapiens
accaagagagaaa

SEQ ID NO: 5138561 - DNA, 20 bp, Homo sapiens
accaagagagaaagaagtag

SEQ ID NO: 5138562 - DNA, 17 bp, Homo sapiens
accaagagattgctaat

SEQ ID NO: 5138563 - DNA, 21 bp, Homo sapiens
accaagagattgctaattgct

SEQ ID NO: 5138564 - DNA, 12 bp, Homo sapiens
accaagaggctg

SEQ ID NO: 5138565 - DNA, 14 bp, Homo sapiens
accaagaggctggt

SEQ ID NO: 5138566 - DNA, 17 bp, Homo sapiens
accaagagtatgagaaa

SEQ ID NO: 5138567 - DNA, 19 bp, Homo sapiens
accaagagtatgagaaata

SEQ ID NO: 5138568 - DNA, 14 bp, Homo sapiens
accaagagtattcc

SEQ ID NO: 5138569 - DNA, 16 bp, Homo sapiens
accaagatcacaaata

SEQ ID NO: 5138570 - DNA, 17 bp, Homo sapiens
accaagatcacaaatag

SEQ ID NO: 5138571 - DNA, 21 bp, Homo sapiens
accaagatcacaaatagtgtt

SEQ ID NO: 5138572 - DNA, 21 bp, Homo sapiens
accaagatcacataccagagt

SEQ ID NO: 5138573 - DNA, 18 bp, Homo sapiens
accaagatgccaacatcg

SEQ ID NO: 5138574 - DNA, 15 bp, Homo sapiens
accaagatgggcaca

SEQ ID NO: 5138575 - DNA, 16 bp, Homo sapiens
accaagatgggcacat

SEQ ID NO: 5138576 - DNA, 23 bp, Homo sapiens
accaagattatgtgacttgcaat

SEQ ID NO: 5138577 - DNA, 18 bp, Homo sapiens
accaagattttgaaggaa

SEQ ID NO: 5138578 - DNA, 23 bp, Homo sapiens
accaagcaagtcccttcagactg

SEQ ID NO: 5138579 - DNA, 15 bp, Homo sapiens
accaagcaggaagct

SEQ ID NO: 5138580 - DNA, 17 bp, Homo sapiens
accaagcagtggccttt

SEQ ID NO: 5138581 - DNA, 23 bp, Homo sapiens
accaagccaagggaacctgtgtc

SEQ ID NO: 5138582 - DNA, 16 bp, Homo sapiens
accaagccaatgttat

SEQ ID NO: 5138583 - DNA, 20 bp, Homo sapiens
accaagcccgcctccagcac

SEQ ID NO: 5138584 - DNA, 16 bp, Homo sapiens
accaagccggtgccca

SEQ ID NO: 5138585 - DNA, 14 bp, Homo sapiens
accaagccgtggct

SEQ ID NO: 5138586 - DNA, 20 bp, Homo sapiens
accaagcctggtcagcccaa

SEQ ID NO: 5138587 - DNA, 12 bp, Homo sapiens
accaagccttga

SEQ ID NO: 5138588 - DNA, 13 bp, Homo sapiens
accaagccttggc

SEQ ID NO: 5138589 - DNA, 17 bp, Homo sapiens
accaagcgaccaaggat

SEQ ID NO: 5138590 - DNA, 21 bp, Homo sapiens
accaagcggctcaagaataaa

SEQ ID NO: 5138591 - DNA, 22 bp, Homo sapiens
accaagctcacacctgtccttc

SEQ ID NO: 5138592 - DNA, 18 bp, Homo sapiens
accaagctcacagttcct

SEQ ID NO: 5138593 - DNA, 19 bp, Homo sapiens
accaagctcacagttcctc

SEQ ID NO: 5138594 - DNA, 15 bp, Homo sapiens
accaagctcaccctt

SEQ ID NO: 5138595 - DNA, 12 bp, Homo sapiens
accaagctgtgc

SEQ ID NO: 5138596 - DNA, 13 bp, Homo sapiens
accaagcttcaga

SEQ ID NO: 5138597 - DNA, 17 bp, Homo sapiens
accaagcttcagagcct

SEQ ID NO: 5138598 - DNA, 18 bp, Homo sapiens
accaagcttcagagccta

SEQ ID NO: 5138599 - DNA, 22 bp, Homo sapiens
accaagcttgtttccctgctgg

SEQ ID NO: 5138600 - DNA, 17 bp, Homo sapiens
accaaggaaagaacaaa

SEQ ID NO: 5138601 - DNA, 17 bp, Homo sapiens
accaaggaagcagcctc

SEQ ID NO: 5138602 - DNA, 12 bp, Homo sapiens
accaaggaagga

SEQ ID NO: 5138603 - DNA, 13 bp, Homo sapiens
accaaggaaggag

SEQ ID NO: 5138604 - DNA, 17 bp, Homo sapiens
accaaggaaggagcccc

SEQ ID NO: 5138605 - DNA, 21 bp, Homo sapiens
accaaggatcggactctgccc

SEQ ID NO: 5138606 - DNA, 22 bp, Homo sapiens
accaaggatgaattctttcaat

SEQ ID NO: 5138607 - DNA, 24 bp, Homo sapiens
accaaggcagcctccagagccagc

SEQ ID NO: 5138608 - DNA, 15 bp, Homo sapiens
accaaggcagggccc

SEQ ID NO: 5138609 - DNA, 15 bp, Homo sapiens
accaaggcagtgcat

SEQ ID NO: 5138610 - DNA, 18 bp, Homo sapiens
accaaggcagtgcatgca

SEQ ID NO: 5138611 - DNA, 21 bp, Homo sapiens
accaaggcagtgcatgcatgt

SEQ ID NO: 5138612 - DNA, 21 bp, Homo sapiens
accaaggccagccacaccaca

SEQ ID NO: 5138613 - DNA, 22 bp, Homo sapiens
accaaggccctgcatctgtctg

SEQ ID NO: 5138614 - DNA, 13 bp, Homo sapiens
accaaggccctgt

SEQ ID NO: 5138615 - DNA, 14 bp, Homo sapiens
accaaggccctgtc

SEQ ID NO: 5138616 - DNA, 11 bp, Homo sapiens
accaaggctcc

SEQ ID NO: 5138617 - DNA, 15 bp, Homo sapiens
accaaggctgcctgc

SEQ ID NO: 5138618 - DNA, 16 bp, Homo sapiens
accaaggctgcctgcc

SEQ ID NO: 5138619 - DNA, 15 bp, Homo sapiens
accaagggacaggag

SEQ ID NO: 5138620 - DNA, 21 bp, Homo sapiens
accaagggccctcactcagga

SEQ ID NO: 5138621 - DNA, 14 bp, Homo sapiens
accaagggggcggg

SEQ ID NO: 5138622 - DNA, 21 bp, Homo sapiens
accaaggggtggccgggcaca

SEQ ID NO: 5138623 - DNA, 14 bp, Homo sapiens
accaagggtacaga

SEQ ID NO: 5138624 - DNA, 17 bp, Homo sapiens
accaagggtacagatcc

SEQ ID NO: 5138625 - DNA, 17 bp, Homo sapiens
accaagggtatctgctg

SEQ ID NO: 5138626 - DNA, 20 bp, Homo sapiens
accaaggtagaatgaccttg

SEQ ID NO: 5138627 - DNA, 15 bp, Homo sapiens
accaaggtcttcagc

SEQ ID NO: 5138628 - DNA, 19 bp, Homo sapiens
accaaggtgaagatggcct

SEQ ID NO: 5138629 - DNA, 20 bp, Homo sapiens
accaaggtgcggaccggagc

SEQ ID NO: 5138630 - DNA, 19 bp, Homo sapiens
accaagtaaatctatctct

SEQ ID NO: 5138631 - DNA, 13 bp, Homo sapiens
accaagtaaattt

SEQ ID NO: 5138632 - DNA, 20 bp, Homo sapiens
accaagtaagacatctcaaa

SEQ ID NO: 5138633 - DNA, 14 bp, Homo sapiens
accaagtacagcct

SEQ ID NO: 5138634 - DNA, 14 bp, Homo sapiens
accaagtcacacgc

SEQ ID NO: 5138635 - DNA, 20 bp, Homo sapiens
accaagtcaggccaggtggg

SEQ ID NO: 5138636 - DNA, 20 bp, Homo sapiens
accaagtccccttctgtgtt

SEQ ID NO: 5138637 - DNA, 19 bp, Homo sapiens
accaagtcggaacagcaga

SEQ ID NO: 5138638 - DNA, 22 bp, Homo sapiens
accaagtgccttgagctgcctg

SEQ ID NO: 5138639 - DNA, 16 bp, Homo sapiens
accaagtgctggccca

SEQ ID NO: 5138640 - DNA, 14 bp, Homo sapiens
accaagtgcttcct

SEQ ID NO: 5138641 - DNA, 17 bp, Homo sapiens
accaagtgcttcctaca

SEQ ID NO: 5138642 - DNA, 22 bp, Homo sapiens
accaagtgcttcctacaaagac

SEQ ID NO: 5138643 - DNA, 15 bp, Homo sapiens
accaagtgtattgta

SEQ ID NO: 5138644 - DNA, 18 bp, Homo sapiens
accaagtgtattgtaatg

SEQ ID NO: 5138645 - DNA, 16 bp, Homo sapiens
accaagttacttgaaa

SEQ ID NO: 5138646 - DNA, 23 bp, Homo sapiens
accaagttggaacatccttggaa

SEQ ID NO: 5138647 - DNA, 20 bp, Homo sapiens
accaagttgtgcttttctgt

SEQ ID NO: 5138648 - DNA, 18 bp, Homo sapiens
accaagttgtttattcca

SEQ ID NO: 5138649 - DNA, 18 bp, Homo sapiens
accaagtttattcagtaa

SEQ ID NO: 5138650 - DNA, 20 bp, Homo sapiens
accaagtttattcagtaaac

SEQ ID NO: 5138651 - DNA, 22 bp, Homo sapiens
accaagtttattcagtaaacaa

SEQ ID NO: 5138652 - DNA, 23 bp, Homo sapiens
accaagtttcaggtattaagaaa

SEQ ID NO: 5138653 - DNA, 15 bp, Homo sapiens
accaataaaagccag

SEQ ID NO: 5138654 - DNA, 15 bp, Homo sapiens
accaataaaatttct

SEQ ID NO: 5138655 - DNA, 23 bp, Homo sapiens
accaataacaaggagctcaccct

SEQ ID NO: 5138656 - DNA, 14 bp, Homo sapiens
accaatagattccc

SEQ ID NO: 5138657 - DNA, 11 bp, Homo sapiens
accaatatata

SEQ ID NO: 5138658 - DNA, 22 bp, Homo sapiens
accaatattaacacgctgcctg

SEQ ID NO: 5138659 - DNA, 17 bp, Homo sapiens
accaatatttaatcttt

SEQ ID NO: 5138660 - DNA, 23 bp, Homo sapiens
accaatatttaatcttttatgat

SEQ ID NO: 5138661 - DNA, 14 bp, Homo sapiens
accaatcaaatata

SEQ ID NO: 5138662 - DNA, 19 bp, Homo sapiens
accaatcaagataaaggac

SEQ ID NO: 5138663 - DNA, 20 bp, Homo sapiens
accaatcaagataaaggaca

SEQ ID NO: 5138664 - DNA, 13 bp, Homo sapiens
accaatcaataat

SEQ ID NO: 5138665 - DNA, 15 bp, Homo sapiens
accaatcagagagcc

SEQ ID NO: 5138666 - DNA, 21 bp, Homo sapiens
accaatcagcactctgtaaaa

SEQ ID NO: 5138667 - DNA, 13 bp, Homo sapiens
accaatcatttta

SEQ ID NO: 5138668 - DNA, 20 bp, Homo sapiens
accaatcattttaattatta

SEQ ID NO: 5138669 - DNA, 23 bp, Homo sapiens
accaatcccagggctggctctgc

SEQ ID NO: 5138670 - DNA, 22 bp, Homo sapiens
accaatcctactaataaaccag

SEQ ID NO: 5138671 - DNA, 18 bp, Homo sapiens
accaatcgggagtagcaa

SEQ ID NO: 5138672 - DNA, 14 bp, Homo sapiens
accaatctctgtga

SEQ ID NO: 5138673 - DNA, 15 bp, Homo sapiens
accaatctctgtgac

SEQ ID NO: 5138674 - DNA, 12 bp, Homo sapiens
accaatctgccc

SEQ ID NO: 5138675 - DNA, 15 bp, Homo sapiens
accaatctgggaaga

SEQ ID NO: 5138676 - DNA, 15 bp, Homo sapiens
accaatcttactttg

SEQ ID NO: 5138677 - DNA, 17 bp, Homo sapiens
accaatcttactttgta

SEQ ID NO: 5138678 - DNA, 19 bp, Homo sapiens
accaatcttactttgtaaa

SEQ ID NO: 5138679 - DNA, 20 bp, Homo sapiens
accaatcttactttgtaaat

SEQ ID NO: 5138680 - DNA, 16 bp, Homo sapiens
accaatgaaaacatgt

SEQ ID NO: 5138681 - DNA, 17 bp, Homo sapiens
accaatgaaaacatgta

SEQ ID NO: 5138682 - DNA, 12 bp, Homo sapiens
accaatgaagaa

SEQ ID NO: 5138683 - DNA, 14 bp, Homo sapiens
accaatgaagaaga

SEQ ID NO: 5138684 - DNA, 16 bp, Homo sapiens
accaatgaagaagaca

SEQ ID NO: 5138685 - DNA, 21 bp, Homo sapiens
accaatgattcataacaatgt

SEQ ID NO: 5138686 - DNA, 12 bp, Homo sapiens
accaatgcatgc

SEQ ID NO: 5138687 - DNA, 17 bp, Homo sapiens
accaatgcatgcagcca

SEQ ID NO: 5138688 - DNA, 18 bp, Homo sapiens
accaatgcattaccttct

SEQ ID NO: 5138689 - DNA, 21 bp, Homo sapiens
accaatgccaaaaaaagacag

SEQ ID NO: 5138690 - DNA, 23 bp, Homo sapiens
accaatgcctttttagatgtatt

SEQ ID NO: 5138691 - DNA, 18 bp, Homo sapiens
accaatgctgttgtaaac

SEQ ID NO: 5138692 - DNA, 13 bp, Homo sapiens
accaatgggaagc

SEQ ID NO: 5138693 - DNA, 15 bp, Homo sapiens
accaatgttgtacag

SEQ ID NO: 5138694 - DNA, 16 bp, Homo sapiens
accaatgtttaaaaaa

SEQ ID NO: 5138695 - DNA, 16 bp, Homo sapiens
accaattaagtgttga

SEQ ID NO: 5138696 - DNA, 23 bp, Homo sapiens
accaattactgcactcttaaaca

SEQ ID NO: 5138697 - DNA, 20 bp, Homo sapiens
accaattagtcactgctgct

SEQ ID NO: 5138698 - DNA, 17 bp, Homo sapiens
accaattatggaaatag

SEQ ID NO: 5138699 - DNA, 14 bp, Homo sapiens
accaattattgata

SEQ ID NO: 5138700 - DNA, 17 bp, Homo sapiens
accaattcacccactcc

SEQ ID NO: 5138701 - DNA, 20 bp, Homo sapiens
accaattcacccactccctt

SEQ ID NO: 5138702 - DNA, 19 bp, Homo sapiens
accaattcacccagaaaaa

SEQ ID NO: 5138703 - DNA, 11 bp, Homo sapiens
accaattccaa

SEQ ID NO: 5138704 - DNA, 21 bp, Homo sapiens
accaattccaatttcaaaatg

SEQ ID NO: 5138705 - DNA, 22 bp, Homo sapiens
accaattccaatttcaaaatgt

SEQ ID NO: 5138706 - DNA, 16 bp, Homo sapiens
accaattccacttcct

SEQ ID NO: 5138707 - DNA, 20 bp, Homo sapiens
accaattccacttcctgccc

SEQ ID NO: 5138708 - DNA, 22 bp, Homo sapiens
accaattccacttcctgcccca

SEQ ID NO: 5138709 - DNA, 23 bp, Homo sapiens
accaattccacttcctgccccaa

SEQ ID NO: 5138710 - DNA, 18 bp, Homo sapiens
accaattctggacagaca

SEQ ID NO: 5138711 - DNA, 16 bp, Homo sapiens
accaattgaaaagtgt

SEQ ID NO: 5138712 - DNA, 22 bp, Homo sapiens
acatctgcactcctgaacacac

SEQ ID NO: 5138713 - DNA, 21 bp, Homo sapiens
acatctgcagctctttcttct

SEQ ID NO: 5138714 - DNA, 20 bp, Homo sapiens
acatctgccatttatttcct

SEQ ID NO: 5138715 - DNA, 18 bp, Homo sapiens
acatctgcctcctctcct

SEQ ID NO: 5138716 - DNA, 11 bp, Homo sapiens
acatctgcctt

SEQ ID NO: 5138717 - DNA, 16 bp, Homo sapiens
acatctgccttgctgc

SEQ ID NO: 5138718 - DNA, 14 bp, Homo sapiens
acatctgctgtgtg

SEQ ID NO: 5138719 - DNA, 18 bp, Homo sapiens
acatctggaatctgaggc

SEQ ID NO: 5138720 - DNA, 23 bp, Homo sapiens
acatctggaatctgaggcatcct

SEQ ID NO: 5138721 - DNA, 18 bp, Homo sapiens
acatctggatatcaaggt

SEQ ID NO: 5138722 - DNA, 21 bp, Homo sapiens
acatctggccctgacttctgg

SEQ ID NO: 5138723 - DNA, 21 bp, Homo sapiens
acatctggctgcacaggctga

SEQ ID NO: 5138724 - DNA, 22 bp, Homo sapiens
acatctggctggaaagcagagc

SEQ ID NO: 5138725 - DNA, 18 bp, Homo sapiens
acatctggcttattttaa

SEQ ID NO: 5138726 - DNA, 21 bp, Homo sapiens
acatctgggaggctggtctcc

SEQ ID NO: 5138727 - DNA, 15 bp, Homo sapiens
acatctgggtgccct

SEQ ID NO: 5138728 - DNA, 17 bp, Homo sapiens
acatctgggtgccctga

SEQ ID NO: 5138729 - DNA, 15 bp, Homo sapiens
acatctgtaaagaaa

SEQ ID NO: 5138730 - DNA, 17 bp, Homo sapiens
acatctgtaaagaaaac

SEQ ID NO: 5138731 - DNA, 18 bp, Homo sapiens
acatctgtaaagaaaacc

SEQ ID NO: 5138732 - DNA, 19 bp, Homo sapiens
acatctgtaaatctacaca

SEQ ID NO: 5138733 - DNA, 21 bp, Homo sapiens
acatctgtacatgactgtata

SEQ ID NO: 5138734 - DNA, 12 bp, Homo sapiens
acatctgtatat

SEQ ID NO: 5138735 - DNA, 17 bp, Homo sapiens
acatctgtcctcaccct

SEQ ID NO: 5138736 - DNA, 21 bp, Homo sapiens
acatctgtcctcaccctgtgg

SEQ ID NO: 5138737 - DNA, 22 bp, Homo sapiens
acatctgtcctcaccctgtggg

SEQ ID NO: 5138738 - DNA, 21 bp, Homo sapiens
acatctgtctttcatctccca

SEQ ID NO: 5138739 - DNA, 12 bp, Homo sapiens
acatctgtgcag

SEQ ID NO: 5138740 - DNA, 19 bp, Homo sapiens
acatctgtgcagggctggt

SEQ ID NO: 5138741 - DNA, 11 bp, Homo sapiens
acatctgtgtc

SEQ ID NO: 5138742 - DNA, 15 bp, Homo sapiens
acatctgtgtctgtg

SEQ ID NO: 5138743 - DNA, 20 bp, Homo sapiens
acatctgtgtctgtgtctgc

SEQ ID NO: 5138744 - DNA, 16 bp, Homo sapiens
acatctgttatcaaac

SEQ ID NO: 5138745 - DNA, 22 bp, Homo sapiens
acatctgttatcaaactgctgt

SEQ ID NO: 5138746 - DNA, 18 bp, Homo sapiens
acatctgtttcaaactga

SEQ ID NO: 5138747 - DNA, 17 bp, Homo sapiens
acatctgttttaaattt

SEQ ID NO: 5138748 - DNA, 22 bp, Homo sapiens
acatcttaattaagctccttca

SEQ ID NO: 5138749 - DNA, 14 bp, Homo sapiens
acatcttagtattt

SEQ ID NO: 5138750 - DNA, 12 bp, Homo sapiens
acatcttattta

SEQ ID NO: 5138751 - DNA, 18 bp, Homo sapiens
acatcttcaatctaggcg

SEQ ID NO: 5138752 - DNA, 18 bp, Homo sapiens
acatcttcagctcccata

SEQ ID NO: 5138753 - DNA, 19 bp, Homo sapiens
acatcttcattaatactgt

SEQ ID NO: 5138754 - DNA, 15 bp, Homo sapiens
acatcttccacaggt

SEQ ID NO: 5138755 - DNA, 23 bp, Homo sapiens
acatcttccctagagggttcctg

SEQ ID NO: 5138756 - DNA, 13 bp, Homo sapiens
acatcttctcaac

SEQ ID NO: 5138757 - DNA, 21 bp, Homo sapiens
acatcttctcaaccttatcaa

SEQ ID NO: 5138758 - DNA, 18 bp, Homo sapiens
acatcttctgtgaaatat

SEQ ID NO: 5138759 - DNA, 13 bp, Homo sapiens
acatcttctttgg

SEQ ID NO: 5138760 - DNA, 20 bp, Homo sapiens
acatcttgaaaatattgaag

SEQ ID NO: 5138761 - DNA, 14 bp, Homo sapiens
acatcttgaaaatg

SEQ ID NO: 5138762 - DNA, 15 bp, Homo sapiens
acatcttgctctgct

SEQ ID NO: 5138763 - DNA, 17 bp, Homo sapiens
acatcttgctctgctga

SEQ ID NO: 5138764 - DNA, 18 bp, Homo sapiens
acatcttgctctgctgac

SEQ ID NO: 5138765 - DNA, 19 bp, Homo sapiens
acatcttgctctgctgaca

SEQ ID NO: 5138766 - DNA, 22 bp, Homo sapiens
acatcttgctctgctgacagac

SEQ ID NO: 5138767 - DNA, 13 bp, Homo sapiens
acatcttggcaca

SEQ ID NO: 5138768 - DNA, 14 bp, Homo sapiens
acatcttggcaggg

SEQ ID NO: 5138769 - DNA, 15 bp, Homo sapiens
acatcttgtcaacat

SEQ ID NO: 5138770 - DNA, 19 bp, Homo sapiens
acatcttgtcaacatgcat

SEQ ID NO: 5138771 - DNA, 23 bp, Homo sapiens
acatcttgtcattttttttcttt

SEQ ID NO: 5138772 - DNA, 14 bp, Homo sapiens
acatcttgtgcatg

SEQ ID NO: 5138773 - DNA, 16 bp, Homo sapiens
acatcttgtttctgag

SEQ ID NO: 5138774 - DNA, 18 bp, Homo sapiens
acatcttgtttctgagtt

SEQ ID NO: 5138775 - DNA, 20 bp, Homo sapiens
acatctttaacatagtcctg

SEQ ID NO: 5138776 - DNA, 11 bp, Homo sapiens
acatctttaag

SEQ ID NO: 5138777 - DNA, 19 bp, Homo sapiens
acatctttatcattaaaca

SEQ ID NO: 5138778 - DNA, 22 bp, Homo sapiens
acatctttattgaaattctatt

SEQ ID NO: 5138779 - DNA, 12 bp, Homo sapiens
acatctttcaca

SEQ ID NO: 5138780 - DNA, 11 bp, Homo sapiens
acatctttccc

SEQ ID NO: 5138781 - DNA, 18 bp, Homo sapiens
acatctttcctcaagtat

SEQ ID NO: 5138782 - DNA, 18 bp, Homo sapiens
acatctttgaaaagaaaa

SEQ ID NO: 5138783 - DNA, 19 bp, Homo sapiens
acatctttgtttttaaaat

SEQ ID NO: 5138784 - DNA, 15 bp, Homo sapiens
acatcttttaactgc

SEQ ID NO: 5138785 - DNA, 18 bp, Homo sapiens
acatcttttaagacaaat

SEQ ID NO: 5138786 - DNA, 22 bp, Homo sapiens
acatcttttctaatcacagtgt

SEQ ID NO: 5138787 - DNA, 18 bp, Homo sapiens
acatcttttggaagtttt

SEQ ID NO: 5138788 - DNA, 18 bp, Homo sapiens
acatcttttgggaagcca

SEQ ID NO: 5138789 - DNA, 18 bp, Homo sapiens
acatctttttcctccctt

SEQ ID NO: 5138790 - DNA, 20 bp, Homo sapiens
acatctttttcctccctttc

SEQ ID NO: 5138791 - DNA, 20 bp, Homo sapiens
acatgaaaaacacggcagct

SEQ ID NO: 5138792 - DNA, 18 bp, Homo sapiens
acatgaaaacacattttt

SEQ ID NO: 5138793 - DNA, 22 bp, Homo sapiens
acatgaaaacacatttttctta

SEQ ID NO: 5138794 - DNA, 14 bp, Homo sapiens
acatgaaaacattg

SEQ ID NO: 5138795 - DNA, 14 bp, Homo sapiens
acatgaaaactatt

SEQ ID NO: 5138796 - DNA, 18 bp, Homo sapiens
acatgaaaactattttaa

SEQ ID NO: 5138797 - DNA, 14 bp, Homo sapiens
acatgaaaagttat

SEQ ID NO: 5138798 - DNA, 14 bp, Homo sapiens
acatgaaacaactc

SEQ ID NO: 5138799 - DNA, 13 bp, Homo sapiens
acatgaaacagaa

SEQ ID NO: 5138800 - DNA, 20 bp, Homo sapiens
acatgaaacctacacactgt

SEQ ID NO: 5138801 - DNA, 24 bp, Homo sapiens
acatgaaacggaggcagatggaga

SEQ ID NO: 5138802 - DNA, 22 bp, Homo sapiens
acatgaaactgcctattcacgc

SEQ ID NO: 5138803 - DNA, 21 bp, Homo sapiens
acatgaaagtagcagtgtgaa

SEQ ID NO: 5138804 - DNA, 19 bp, Homo sapiens
acatgaaagtcaagtctac

SEQ ID NO: 5138805 - DNA, 18 bp, Homo sapiens
acatgaaataatgcactg

SEQ ID NO: 5138806 - DNA, 17 bp, Homo sapiens
acatgaaatatattttc

SEQ ID NO: 5138807 - DNA, 18 bp, Homo sapiens
acatgaaatatattttct

SEQ ID NO: 5138808 - DNA, 12 bp, Homo sapiens
acatgaaatgat

SEQ ID NO: 5138809 - DNA, 16 bp, Homo sapiens
acatgaacaatgtgtg

SEQ ID NO: 5138810 - DNA, 22 bp, Homo sapiens
acatgaacacaaatgtgtattt

SEQ ID NO: 5138811 - DNA, 17 bp, Homo sapiens
acatgaacacagctgct

SEQ ID NO: 5138812 - DNA, 23 bp, Homo sapiens
acatgaacacagctgctgaagag

SEQ ID NO: 5138813 - DNA, 14 bp, Homo sapiens
acatgaacttagat

SEQ ID NO: 5138814 - DNA, 20 bp, Homo sapiens
acatgaacttagattttaca

SEQ ID NO: 5138815 - DNA, 22 bp, Homo sapiens
acatgaacttagattttacatg

SEQ ID NO: 5138816 - DNA, 19 bp, Homo sapiens
acatgaacttcatatacta

SEQ ID NO: 5138817 - DNA, 16 bp, Homo sapiens
acatgaagaatgcatt

SEQ ID NO: 5138818 - DNA, 23 bp, Homo sapiens
acatgaagcaattagtctgaaac

SEQ ID NO: 5138819 - DNA, 23 bp, Homo sapiens
acatgaagcagaaccttctttgg

SEQ ID NO: 5138820 - DNA, 19 bp, Homo sapiens
acatgaagctgttgtgtga

SEQ ID NO: 5138821 - DNA, 16 bp, Homo sapiens
acatgaagcttcatgc

SEQ ID NO: 5138822 - DNA, 21 bp, Homo sapiens
acatgaaggtaaataaaaaga

SEQ ID NO: 5138823 - DNA, 23 bp, Homo sapiens
acatgaaggtaaataaaaagaaa

SEQ ID NO: 5138824 - DNA, 20 bp, Homo sapiens
acatgaataaaaataaagtt

SEQ ID NO: 5138825 - DNA, 18 bp, Homo sapiens
acatgaataatttcactt

SEQ ID NO: 5138826 - DNA, 21 bp, Homo sapiens
acatgaatactatccatgtaa

SEQ ID NO: 5138827 - DNA, 21 bp, Homo sapiens
acatgaatcccacccacatgt

SEQ ID NO: 5138828 - DNA, 23 bp, Homo sapiens
acatgaatcccacccacatgtga

SEQ ID NO: 5138829 - DNA, 14 bp, Homo sapiens
acatgaatgcagtc

SEQ ID NO: 5138830 - DNA, 21 bp, Homo sapiens
acatgaatgcagtcatgcaaa

SEQ ID NO: 5138831 - DNA, 21 bp, Homo sapiens
acatgaatgggcatttctaaa

SEQ ID NO: 5138832 - DNA, 14 bp, Homo sapiens
acatgaattaaagt

SEQ ID NO: 5138833 - DNA, 17 bp, Homo sapiens
acatgaattattacagt

SEQ ID NO: 5138834 - DNA, 21 bp, Homo sapiens
acatgaattattacagtgttt

SEQ ID NO: 5138835 - DNA, 17 bp, Homo sapiens
acatgaatttagaaata

SEQ ID NO: 5138836 - DNA, 15 bp, Homo sapiens
acatgaattttagct

SEQ ID NO: 5138837 - DNA, 15 bp, Homo sapiens
acatgacaactttgc

SEQ ID NO: 5138838 - DNA, 15 bp, Homo sapiens
acatgacacccgtga

SEQ ID NO: 5138839 - DNA, 14 bp, Homo sapiens
acatgacactgaaa

SEQ ID NO: 5138840 - DNA, 23 bp, Homo sapiens
acatgacactgaaatgccttact

SEQ ID NO: 5138841 - DNA, 15 bp, Homo sapiens
acatgacactgacct

SEQ ID NO: 5138842 - DNA, 13 bp, Homo sapiens
acatgacagatat

SEQ ID NO: 5138843 - DNA, 17 bp, Homo sapiens
acatgacagatatttta

SEQ ID NO: 5138844 - DNA, 18 bp, Homo sapiens
acatgacagatattttat

SEQ ID NO: 5138845 - DNA, 23 bp, Homo sapiens
acatgacagtggttatatttcaa

SEQ ID NO: 5138846 - DNA, 17 bp, Homo sapiens
acatgacatcaaaatga

SEQ ID NO: 5138847 - DNA, 15 bp, Homo sapiens
acatgacatccacat

SEQ ID NO: 5138848 - DNA, 21 bp, Homo sapiens
acatgacatccacatgcacat

SEQ ID NO: 5138849 - DNA, 15 bp, Homo sapiens
acatgacatccagag

SEQ ID NO: 5138850 - DNA, 15 bp, Homo sapiens
acatgacatttgtcc

SEQ ID NO: 5138851 - DNA, 16 bp, Homo sapiens
acatgacatttgtcct

SEQ ID NO: 5138852 - DNA, 22 bp, Homo sapiens
acatgacatttgtcctgcagag

SEQ ID NO: 5138853 - DNA, 20 bp, Homo sapiens
acatgaccaaaaaccaaaag

SEQ ID NO: 5138854 - DNA, 14 bp, Homo sapiens
acatgaccctctgt

SEQ ID NO: 5138855 - DNA, 23 bp, Homo sapiens
acatgaccctctgtccccaggcc

SEQ ID NO: 5138856 - DNA, 16 bp, Homo sapiens
acatgaccttaatgga

SEQ ID NO: 5138857 - DNA, 19 bp, Homo sapiens
acatgacgacaaagctgct

SEQ ID NO: 5138858 - DNA, 16 bp, Homo sapiens
acatgacgtaaaattt

SEQ ID NO: 5138859 - DNA, 18 bp, Homo sapiens
acatgacgtggtaaaatg

SEQ ID NO: 5138860 - DNA, 13 bp, Homo sapiens
acatgactacata

SEQ ID NO: 5138861 - DNA, 18 bp, Homo sapiens
acatgactccatagacct

SEQ ID NO: 5138862 - DNA, 20 bp, Homo sapiens
acatgactccatagaccttt

SEQ ID NO: 5138863 - DNA, 15 bp, Homo sapiens
acatgactctttatt

SEQ ID NO: 5138864 - DNA, 17 bp, Homo sapiens
acatgactctttattgt

SEQ ID NO: 5138865 - DNA, 19 bp, Homo sapiens
acatgactctttattgtct

SEQ ID NO: 5138866 - DNA, 20 bp, Homo sapiens
acatgactctttattgtctg

SEQ ID NO: 5138867 - DNA, 21 bp, Homo sapiens
acatgactctttattgtctgt

SEQ ID NO: 5138868 - DNA, 13 bp, Homo sapiens
acatgactgtttc

SEQ ID NO: 5138869 - DNA, 14 bp, Homo sapiens
acatgactgtttct

SEQ ID NO: 5138870 - DNA, 19 bp, Homo sapiens
acatgacttttctggaaga

SEQ ID NO: 5138871 - DNA, 22 bp, Homo sapiens
acatgagaaaatcagtaattgg

SEQ ID NO: 5138872 - DNA, 15 bp, Homo sapiens
acatgagaaagggag

SEQ ID NO: 5138873 - DNA, 22 bp, Homo sapiens
acatgagaaagggagaggaaga

SEQ ID NO: 5138874 - DNA, 11 bp, Homo sapiens
acatgagaaat

SEQ ID NO: 5138875 - DNA, 12 bp, Homo sapiens
acatgagaaatg

SEQ ID NO: 5138876 - DNA, 13 bp, Homo sapiens
acatgagaaatgt

SEQ ID NO: 5138877 - DNA, 16 bp, Homo sapiens
acatgagaaatgtgaa

SEQ ID NO: 5138878 - DNA, 20 bp, Homo sapiens
acatgagagtagggccctga

SEQ ID NO: 5138879 - DNA, 23 bp, Homo sapiens
acatgagatgtgtggactgtggc

SEQ ID NO: 5138880 - DNA, 20 bp, Homo sapiens
acatgagcatcaggccaggc

SEQ ID NO: 5138881 - DNA, 18 bp, Homo sapiens
acatgagcttacattctt

SEQ ID NO: 5138882 - DNA, 14 bp, Homo sapiens
acatgaggaactgt

SEQ ID NO: 5138883 - DNA, 17 bp, Homo sapiens
acatgaggaactgtaga

SEQ ID NO: 5138884 - DNA, 18 bp, Homo sapiens
acatgaggaactgtagat

SEQ ID NO: 5138885 - DNA, 13 bp, Homo sapiens
acatgaggacaga

SEQ ID NO: 5138886 - DNA, 19 bp, Homo sapiens
acatgaggacagaaggact

SEQ ID NO: 5138887 - DNA, 22 bp, Homo sapiens
acatgaggacagaaggactggt

SEQ ID NO: 5138888 - DNA, 20 bp, Homo sapiens
acatgaggactctattcttt

SEQ ID NO: 5138889 - DNA, 15 bp, Homo sapiens
accaattgaagcatg

SEQ ID NO: 5138890 - DNA, 15 bp, Homo sapiens
accaattgctttgtc

SEQ ID NO: 5138891 - DNA, 16 bp, Homo sapiens
accaattggttaatct

SEQ ID NO: 5138892 - DNA, 13 bp, Homo sapiens
accaattgtgctg

SEQ ID NO: 5138893 - DNA, 15 bp, Homo sapiens
accaattgtgctgcc

SEQ ID NO: 5138894 - DNA, 17 bp, Homo sapiens
accaattgtgctgccat

SEQ ID NO: 5138895 - DNA, 18 bp, Homo sapiens
accaattgtgctgccatt

SEQ ID NO: 5138896 - DNA, 15 bp, Homo sapiens
accaattgtttcttg

SEQ ID NO: 5138897 - DNA, 16 bp, Homo sapiens
accaatttcctttaaa

SEQ ID NO: 5138898 - DNA, 12 bp, Homo sapiens
accaatttcttc

SEQ ID NO: 5138899 - DNA, 14 bp, Homo sapiens
accaatttcttcct

SEQ ID NO: 5138900 - DNA, 20 bp, Homo sapiens
accaatttctttctaaaaca

SEQ ID NO: 5138901 - DNA, 15 bp, Homo sapiens
accaatttgttctgt

SEQ ID NO: 5138902 - DNA, 15 bp, Homo sapiens
accaattttaactta

SEQ ID NO: 5138903 - DNA, 21 bp, Homo sapiens
accaattttttgtgtgtgaag

SEQ ID NO: 5138904 - DNA, 18 bp, Homo sapiens
accacaaaaaaatacctc

SEQ ID NO: 5138905 - DNA, 22 bp, Homo sapiens
accacaaaaagagaagctgtgt

SEQ ID NO: 5138906 - DNA, 13 bp, Homo sapiens
accacaaaagttg

SEQ ID NO: 5138907 - DNA, 16 bp, Homo sapiens
accacaaaccctgctg

SEQ ID NO: 5138908 - DNA, 17 bp, Homo sapiens
accacaaaccctgctga

SEQ ID NO: 5138909 - DNA, 20 bp, Homo sapiens
accacaaagcacagtttgaa

SEQ ID NO: 5138910 - DNA, 10 bp, Homo sapiens
accacaaagg

SEQ ID NO: 5138911 - DNA, 18 bp, Homo sapiens
accacaaatagtgctcgc

SEQ ID NO: 5138912 - DNA, 13 bp, Homo sapiens
accacaacatgag

SEQ ID NO: 5138913 - DNA, 14 bp, Homo sapiens
accacaaccaggaa

SEQ ID NO: 5138914 - DNA, 17 bp, Homo sapiens
accacaaccctgttgct

SEQ ID NO: 5138915 - DNA, 15 bp, Homo sapiens
accacaactgacaca

SEQ ID NO: 5138916 - DNA, 19 bp, Homo sapiens
accacaactgacacaggaa

SEQ ID NO: 5138917 - DNA, 20 bp, Homo sapiens
accacaagacatttctttct

SEQ ID NO: 5138918 - DNA, 13 bp, Homo sapiens
accacaagactct

SEQ ID NO: 5138919 - DNA, 16 bp, Homo sapiens
accacaagactgcaca

SEQ ID NO: 5138920 - DNA, 16 bp, Homo sapiens
accacaagagatcagc

SEQ ID NO: 5138921 - DNA, 21 bp, Homo sapiens
accacaaggctgttgcatggg

SEQ ID NO: 5138922 - DNA, 20 bp, Homo sapiens
accacaagtgaatctttctc

SEQ ID NO: 5138923 - DNA, 21 bp, Homo sapiens
accacaatgtttcttcatttc

SEQ ID NO: 5138924 - DNA, 19 bp, Homo sapiens
accacacacacccttcccc

SEQ ID NO: 5138925 - DNA, 18 bp, Homo sapiens
accacacacacctgtctg

SEQ ID NO: 5138926 - DNA, 17 bp, Homo sapiens
accacacactgtttttt

SEQ ID NO: 5138927 - DNA, 18 bp, Homo sapiens
accacacagtccccagac

SEQ ID NO: 5138928 - DNA, 14 bp, Homo sapiens
accacacatcccag

SEQ ID NO: 5138929 - DNA, 19 bp, Homo sapiens
accacacatcccagcccaa

SEQ ID NO: 5138930 - DNA, 15 bp, Homo sapiens
accacacatctatga

SEQ ID NO: 5138931 - DNA, 12 bp, Homo sapiens
accacacatctg

SEQ ID NO: 5138932 - DNA, 21 bp, Homo sapiens
accacacatttcactgtctgt

SEQ ID NO: 5138933 - DNA, 14 bp, Homo sapiens
accacacattttat

SEQ ID NO: 5138934 - DNA, 16 bp, Homo sapiens
accacaccagcctcct

SEQ ID NO: 5138935 - DNA, 15 bp, Homo sapiens
accacacccagccca

SEQ ID NO: 5138936 - DNA, 16 bp, Homo sapiens
accacacccagcccac

SEQ ID NO: 5138937 - DNA, 21 bp, Homo sapiens
accacacccagcccacttctg

SEQ ID NO: 5138938 - DNA, 14 bp, Homo sapiens
accacacccagcct

SEQ ID NO: 5138939 - DNA, 20 bp, Homo sapiens
accacacccaggtctcttcc

SEQ ID NO: 5138940 - DNA, 15 bp, Homo sapiens
accacaccctgcctg

SEQ ID NO: 5138941 - DNA, 16 bp, Homo sapiens
accacaccctgcctgc

SEQ ID NO: 5138942 - DNA, 22 bp, Homo sapiens
accacaccctgcctgctgtgga

SEQ ID NO: 5138943 - DNA, 13 bp, Homo sapiens
accacaccctgta

SEQ ID NO: 5138944 - DNA, 16 bp, Homo sapiens
accacaccgcagaagc

SEQ ID NO: 5138945 - DNA, 15 bp, Homo sapiens
accacacctccctga

SEQ ID NO: 5138946 - DNA, 22 bp, Homo sapiens
accacacctccctgaaccatcc

SEQ ID NO: 5138947 - DNA, 14 bp, Homo sapiens
accacacctggcta

SEQ ID NO: 5138948 - DNA, 17 bp, Homo sapiens
accacaccttggccttc

SEQ ID NO: 5138949 - DNA, 16 bp, Homo sapiens
accacactacacagca

SEQ ID NO: 5138950 - DNA, 15 bp, Homo sapiens
accacactcagctaa

SEQ ID NO: 5138951 - DNA, 14 bp, Homo sapiens
accacactccagct

SEQ ID NO: 5138952 - DNA, 11 bp, Homo sapiens
accacactgaa

SEQ ID NO: 5138953 - DNA, 13 bp, Homo sapiens
accacactgacca

SEQ ID NO: 5138954 - DNA, 14 bp, Homo sapiens
accacactgaccac

SEQ ID NO: 5138955 - DNA, 14 bp, Homo sapiens
accacactgagttc

SEQ ID NO: 5138956 - DNA, 13 bp, Homo sapiens
accacactggact

SEQ ID NO: 5138957 - DNA, 16 bp, Homo sapiens
accacactggactccg

SEQ ID NO: 5138958 - DNA, 22 bp, Homo sapiens
accacactggactccggccctc

SEQ ID NO: 5138959 - DNA, 18 bp, Homo sapiens
accacactgggtgcgtct

SEQ ID NO: 5138960 - DNA, 22 bp, Homo sapiens
accacactgggtgcgtctccag

SEQ ID NO: 5138961 - DNA, 14 bp, Homo sapiens
accacacttcttga

SEQ ID NO: 5138962 - DNA, 18 bp, Homo sapiens
accacacttcttgaaaca

SEQ ID NO: 5138963 - DNA, 23 bp, Homo sapiens
accacagaatacggaagagcagg

SEQ ID NO: 5138964 - DNA, 15 bp, Homo sapiens
accacagacacacac

SEQ ID NO: 5138965 - DNA, 18 bp, Homo sapiens
accacagacacacacacg

SEQ ID NO: 5138966 - DNA, 22 bp, Homo sapiens
accacagacttgcactgaagcc

SEQ ID NO: 5138967 - DNA, 13 bp, Homo sapiens
accacagaggctg

SEQ ID NO: 5138968 - DNA, 15 bp, Homo sapiens
accacagatactgaa

SEQ ID NO: 5138969 - DNA, 19 bp, Homo sapiens
accacagatactgaaacat

SEQ ID NO: 5138970 - DNA, 21 bp, Homo sapiens
accacagatactgaaacattt

SEQ ID NO: 5138971 - DNA, 16 bp, Homo sapiens
accacagcaactgacc

SEQ ID NO: 5138972 - DNA, 21 bp, Homo sapiens
accacagcaaggcacctgcag

SEQ ID NO: 5138973 - DNA, 15 bp, Homo sapiens
accacagcacagcca

SEQ ID NO: 5138974 - DNA, 11 bp, Homo sapiens
accacagcaga

SEQ ID NO: 5138975 - DNA, 15 bp, Homo sapiens
accacagcagacacc

SEQ ID NO: 5138976 - DNA, 21 bp, Homo sapiens
accacagcagacaccattcat

SEQ ID NO: 5138977 - DNA, 21 bp, Homo sapiens
accacagcagctgaacagcca

SEQ ID NO: 5138978 - DNA, 14 bp, Homo sapiens
accacagcaggatc

SEQ ID NO: 5138979 - DNA, 16 bp, Homo sapiens
accacagcatcatttt

SEQ ID NO: 5138980 - DNA, 16 bp, Homo sapiens
accacagccagcacct

SEQ ID NO: 5138981 - DNA, 19 bp, Homo sapiens
accacagccagcacctggc

SEQ ID NO: 5138982 - DNA, 19 bp, Homo sapiens
accacagcccgctctctgg

SEQ ID NO: 5138983 - DNA, 15 bp, Homo sapiens
accacagccctgtca

SEQ ID NO: 5138984 - DNA, 12 bp, Homo sapiens
accacagcctcc

SEQ ID NO: 5138985 - DNA, 16 bp, Homo sapiens
accacagcctcccctt

SEQ ID NO: 5138986 - DNA, 21 bp, Homo sapiens
accacagccttctaaattccc

SEQ ID NO: 5138987 - DNA, 21 bp, Homo sapiens
accacagcggaggagctccgc

SEQ ID NO: 5138988 - DNA, 15 bp, Homo sapiens
accacagctcctttt

SEQ ID NO: 5138989 - DNA, 17 bp, Homo sapiens
accacagctccttttcc

SEQ ID NO: 5138990 - DNA, 18 bp, Homo sapiens
accacagctgcctccggg

SEQ ID NO: 5138991 - DNA, 19 bp, Homo sapiens
accacagctgcctccgggc

SEQ ID NO: 5138992 - DNA, 14 bp, Homo sapiens
accacagctgctgg

SEQ ID NO: 5138993 - DNA, 16 bp, Homo sapiens
accacagctgctggag

SEQ ID NO: 5138994 - DNA, 16 bp, Homo sapiens
accacaggatctgaac

SEQ ID NO: 5138995 - DNA, 19 bp, Homo sapiens
accacaggatctgaacttt

SEQ ID NO: 5138996 - DNA, 16 bp, Homo sapiens
accacaggatgcatat

SEQ ID NO: 5138997 - DNA, 23 bp, Homo sapiens
accacaggcatctacacagcctg

SEQ ID NO: 5138998 - DNA, 22 bp, Homo sapiens
accacaggccctttcctcaggc

SEQ ID NO: 5138999 - DNA, 16 bp, Homo sapiens
accacaggctcaggca

SEQ ID NO: 5139000 - DNA, 17 bp, Homo sapiens
accacaggctcaggcag

SEQ ID NO: 5139001 - DNA, 23 bp, Homo sapiens
accacaggctgcctcatgaccct

SEQ ID NO: 5139002 - DNA, 17 bp, Homo sapiens
accacagggccagaggg

SEQ ID NO: 5139003 - DNA, 17 bp, Homo sapiens
accacagggttcaaaat

SEQ ID NO: 5139004 - DNA, 23 bp, Homo sapiens
accacagggttcaaaatgtctgt

SEQ ID NO: 5139005 - DNA, 20 bp, Homo sapiens
accacaggttttagcattgt

SEQ ID NO: 5139006 - DNA, 15 bp, Homo sapiens
accacagtcagtgga

SEQ ID NO: 5139007 - DNA, 15 bp, Homo sapiens
accacagtgggtggc

SEQ ID NO: 5139008 - DNA, 19 bp, Homo sapiens
accacagtgggtggcacct

SEQ ID NO: 5139009 - DNA, 21 bp, Homo sapiens
accacagtgggtggcacctcc

SEQ ID NO: 5139010 - DNA, 13 bp, Homo sapiens
accacagtgtctg

SEQ ID NO: 5139011 - DNA, 16 bp, Homo sapiens
accacataatttttgt

SEQ ID NO: 5139012 - DNA, 20 bp, Homo sapiens
accacataatttttgtacat

SEQ ID NO: 5139013 - DNA, 17 bp, Homo sapiens
accacataccatgtgga

SEQ ID NO: 5139014 - DNA, 21 bp, Homo sapiens
accacatagcatgcttccttt

SEQ ID NO: 5139015 - DNA, 20 bp, Homo sapiens
accacatataacacttaact

SEQ ID NO: 5139016 - DNA, 14 bp, Homo sapiens
accacatatacagc

SEQ ID NO: 5139017 - DNA, 21 bp, Homo sapiens
accacatatgaaaaaatccat

SEQ ID NO: 5139018 - DNA, 15 bp, Homo sapiens
accacatccacccca

SEQ ID NO: 5139019 - DNA, 19 bp, Homo sapiens
accacatccaccccagccc

SEQ ID NO: 5139020 - DNA, 14 bp, Homo sapiens
accacatcctccgt

SEQ ID NO: 5139021 - DNA, 20 bp, Homo sapiens
accacatcctccgtccagcc

SEQ ID NO: 5139022 - DNA, 16 bp, Homo sapiens
accacatctacaattt

SEQ ID NO: 5139023 - DNA, 13 bp, Homo sapiens
accacatctgcca

SEQ ID NO: 5139024 - DNA, 15 bp, Homo sapiens
accacatctgctcta

SEQ ID NO: 5139025 - DNA, 13 bp, Homo sapiens
accacatctgtcc

SEQ ID NO: 5139026 - DNA, 19 bp, Homo sapiens
accacatctgtcctcaccc

SEQ ID NO: 5139027 - DNA, 20 bp, Homo sapiens
accacatctgtcctcaccct

SEQ ID NO: 5139028 - DNA, 21 bp, Homo sapiens
accacatctgtcctcaccctg

SEQ ID NO: 5139029 - DNA, 23 bp, Homo sapiens
accacatctgtcctcaccctgtg

SEQ ID NO: 5139030 - DNA, 24 bp, Homo sapiens
accacatcttgctctgctgacaga

SEQ ID NO: 5139031 - DNA, 14 bp, Homo sapiens
accacatcttgtct

SEQ ID NO: 5139032 - DNA, 13 bp, Homo sapiens
accacatgccact

SEQ ID NO: 5139033 - DNA, 16 bp, Homo sapiens
accacatgccactgcc

SEQ ID NO: 5139034 - DNA, 17 bp, Homo sapiens
accacatgccactgcct

SEQ ID NO: 5139035 - DNA, 22 bp, Homo sapiens
accacatgccactgcctgcacc

SEQ ID NO: 5139036 - DNA, 22 bp, Homo sapiens
accacatgccccatcccatgct

SEQ ID NO: 5139037 - DNA, 23 bp, Homo sapiens
accacatgccccatcccatgctg

SEQ ID NO: 5139038 - DNA, 18 bp, Homo sapiens
accacatgcggagaacaa

SEQ ID NO: 5139039 - DNA, 12 bp, Homo sapiens
accacatgggct

SEQ ID NO: 5139040 - DNA, 18 bp, Homo sapiens
accacatgggctgggggc

SEQ ID NO: 5139041 - DNA, 19 bp, Homo sapiens
accacatgggctgggggcc

SEQ ID NO: 5139042 - DNA, 19 bp, Homo sapiens
accacatggggttttggag

SEQ ID NO: 5139043 - DNA, 20 bp, Homo sapiens
accacattctgtctctgctt

SEQ ID NO: 5139044 - DNA, 15 bp, Homo sapiens
accacattgaagaat

SEQ ID NO: 5139045 - DNA, 13 bp, Homo sapiens
accacattgcttt

SEQ ID NO: 5139046 - DNA, 15 bp, Homo sapiens
accacattgcttttc

SEQ ID NO: 5139047 - DNA, 14 bp, Homo sapiens
accacatttaatgg

SEQ ID NO: 5139048 - DNA, 22 bp, Homo sapiens
accacatttcctctgttctttt

SEQ ID NO: 5139049 - DNA, 19 bp, Homo sapiens
accacatttctaagccttt

SEQ ID NO: 5139050 - DNA, 13 bp, Homo sapiens
accacatttctgg

SEQ ID NO: 5139051 - DNA, 19 bp, Homo sapiens
accacattttatatttatt

SEQ ID NO: 5139052 - DNA, 19 bp, Homo sapiens
accaccaagccctgcaaat

SEQ ID NO: 5139053 - DNA, 15 bp, Homo sapiens
accaccaagtattaa

SEQ ID NO: 5139054 - DNA, 17 bp, Homo sapiens
accaccaatcatttcct

SEQ ID NO: 5139055 - DNA, 14 bp, Homo sapiens
accaccacacacag

SEQ ID NO: 5139056 - DNA, 14 bp, Homo sapiens
accaccacacccct

SEQ ID NO: 5139057 - DNA, 15 bp, Homo sapiens
accaccacacccctg

SEQ ID NO: 5139058 - DNA, 16 bp, Homo sapiens
accaccacccctacca

SEQ ID NO: 5139059 - DNA, 14 bp, Homo sapiens
accaccacctgctc

SEQ ID NO: 5139060 - DNA, 18 bp, Homo sapiens
accaccaccttatacatc

SEQ ID NO: 5139061 - DNA, 21 bp, Homo sapiens
accaccaccttatacatcact

SEQ ID NO: 5139062 - DNA, 15 bp, Homo sapiens
accaccacgcagccg

SEQ ID NO: 5139063 - DNA, 22 bp, Homo sapiens
accaccacggccaccactgcag

SEQ ID NO: 5139064 - DNA, 14 bp, Homo sapiens
accaccactggcca

SEQ ID NO: 5139065 - DNA, 20 bp, Homo sapiens
accaccactggccaccaggc

SEQ ID NO: 5139066 - DNA, 15 bp, Homo sapiens
accaccactgtgtcc

SEQ ID NO: 5139067 - DNA, 16 bp, Homo sapiens
accaccagaagcccag

SEQ ID NO: 5139068 - DNA, 16 bp, Homo sapiens
accaccagatgagaag

SEQ ID NO: 5139069 - DNA, 21 bp, Homo sapiens
acatgaggactctattcttta

SEQ ID NO: 5139070 - DNA, 12 bp, Homo sapiens
acatgaggaggg

SEQ ID NO: 5139071 - DNA, 13 bp, Homo sapiens
acatgaggagggt

SEQ ID NO: 5139072 - DNA, 15 bp, Homo sapiens
acatgaggccactgg

SEQ ID NO: 5139073 - DNA, 22 bp, Homo sapiens
acatgaggccatctcaggagat

SEQ ID NO: 5139074 - DNA, 23 bp, Homo sapiens
acatgaggtactgagagtgaaca

SEQ ID NO: 5139075 - DNA, 15 bp, Homo sapiens
acatgagtatcatca

SEQ ID NO: 5139076 - DNA, 18 bp, Homo sapiens
acatgagtcaaaacaaag

SEQ ID NO: 5139077 - DNA, 13 bp, Homo sapiens
acatgagtcccag

SEQ ID NO: 5139078 - DNA, 15 bp, Homo sapiens
acatgagtctccaga

SEQ ID NO: 5139079 - DNA, 15 bp, Homo sapiens
acatgagttcaaata

SEQ ID NO: 5139080 - DNA, 18 bp, Homo sapiens
acatgagttcaaatactt

SEQ ID NO: 5139081 - DNA, 19 bp, Homo sapiens
acatgagttcaaatacttt

SEQ ID NO: 5139082 - DNA, 16 bp, Homo sapiens
acatgagtttaaagcg

SEQ ID NO: 5139083 - DNA, 16 bp, Homo sapiens
acatgataagacattt

SEQ ID NO: 5139084 - DNA, 15 bp, Homo sapiens
acatgatactgctgc

SEQ ID NO: 5139085 - DNA, 17 bp, Homo sapiens
acatgatactgctgctt

SEQ ID NO: 5139086 - DNA, 21 bp, Homo sapiens
acatgatccccgtctctgccc

SEQ ID NO: 5139087 - DNA, 20 bp, Homo sapiens
acatgatctgtttttcacca

SEQ ID NO: 5139088 - DNA, 15 bp, Homo sapiens
acatgatcttcttta

SEQ ID NO: 5139089 - DNA, 17 bp, Homo sapiens
acatgatcttctttata

SEQ ID NO: 5139090 - DNA, 19 bp, Homo sapiens
acatgatcttctttataat

SEQ ID NO: 5139091 - DNA, 12 bp, Homo sapiens
acatgatgcttt

SEQ ID NO: 5139092 - DNA, 18 bp, Homo sapiens
acatgatgcttttactga

SEQ ID NO: 5139093 - DNA, 19 bp, Homo sapiens
acatgatgttaactttgtg

SEQ ID NO: 5139094 - DNA, 13 bp, Homo sapiens
acatgattataga

SEQ ID NO: 5139095 - DNA, 22 bp, Homo sapiens
acatgattatcttgatttccca

SEQ ID NO: 5139096 - DNA, 14 bp, Homo sapiens
acatgattccttcc

SEQ ID NO: 5139097 - DNA, 15 bp, Homo sapiens
acatgattccttcct

SEQ ID NO: 5139098 - DNA, 14 bp, Homo sapiens
acatgattgtataa

SEQ ID NO: 5139099 - DNA, 22 bp, Homo sapiens
acatgatttagggaagcaggga

SEQ ID NO: 5139100 - DNA, 13 bp, Homo sapiens
acatgatttcaaa

SEQ ID NO: 5139101 - DNA, 21 bp, Homo sapiens
acatgatttcacaaatattaa

SEQ ID NO: 5139102 - DNA, 13 bp, Homo sapiens
acatgatttcctt

SEQ ID NO: 5139103 - DNA, 23 bp, Homo sapiens
acatgatttccttgaatgtggct

SEQ ID NO: 5139104 - DNA, 14 bp, Homo sapiens
acatgcaaaaagaa

SEQ ID NO: 5139105 - DNA, 21 bp, Homo sapiens
acatgcaaaaagaaatgacta

SEQ ID NO: 5139106 - DNA, 15 bp, Homo sapiens
acatgcaaacaggtt

SEQ ID NO: 5139107 - DNA, 16 bp, Homo sapiens
acatgcaacagaagtg

SEQ ID NO: 5139108 - DNA, 16 bp, Homo sapiens
acatgcaagaatttct

SEQ ID NO: 5139109 - DNA, 18 bp, Homo sapiens
acatgcaagatacaggaa

SEQ ID NO: 5139110 - DNA, 15 bp, Homo sapiens
acatgcaaggcactg

SEQ ID NO: 5139111 - DNA, 20 bp, Homo sapiens
acatgcaaggcactgtacta

SEQ ID NO: 5139112 - DNA, 18 bp, Homo sapiens
acatgcaaggtcattttt

SEQ ID NO: 5139113 - DNA, 15 bp, Homo sapiens
acatgcaataaaatt

SEQ ID NO: 5139114 - DNA, 16 bp, Homo sapiens
acatgcaataaaattt

SEQ ID NO: 5139115 - DNA, 15 bp, Homo sapiens
acatgcaataacaag

SEQ ID NO: 5139116 - DNA, 16 bp, Homo sapiens
acatgcaataacaagc

SEQ ID NO: 5139117 - DNA, 14 bp, Homo sapiens
acatgcacacacac

SEQ ID NO: 5139118 - DNA, 15 bp, Homo sapiens
acatgcacacacaca

SEQ ID NO: 5139119 - DNA, 21 bp, Homo sapiens
acatgcacacacttgcataca

SEQ ID NO: 5139120 - DNA, 18 bp, Homo sapiens
acatgcacacctccccct

SEQ ID NO: 5139121 - DNA, 15 bp, Homo sapiens
acatgcacactcatg

SEQ ID NO: 5139122 - DNA, 13 bp, Homo sapiens
acatgcacagtca

SEQ ID NO: 5139123 - DNA, 15 bp, Homo sapiens
acatgcacagtcata

SEQ ID NO: 5139124 - DNA, 15 bp, Homo sapiens
acatgcacatgtatt

SEQ ID NO: 5139125 - DNA, 14 bp, Homo sapiens
acatgcacatttat

SEQ ID NO: 5139126 - DNA, 16 bp, Homo sapiens
acatgcacatttatat

SEQ ID NO: 5139127 - DNA, 18 bp, Homo sapiens
acatgcacatttatatat

SEQ ID NO: 5139128 - DNA, 19 bp, Homo sapiens
acatgcaccacgcccggct

SEQ ID NO: 5139129 - DNA, 15 bp, Homo sapiens
acatgcaccttgctc

SEQ ID NO: 5139130 - DNA, 16 bp, Homo sapiens
acatgcaccttgctcc

SEQ ID NO: 5139131 - DNA, 13 bp, Homo sapiens
acatgcacgtgtg

SEQ ID NO: 5139132 - DNA, 16 bp, Homo sapiens
acatgcactactgaaa

SEQ ID NO: 5139133 - DNA, 17 bp, Homo sapiens
acatgcactcagctctt

SEQ ID NO: 5139134 - DNA, 18 bp, Homo sapiens
acatgcactcagctcttg

SEQ ID NO: 5139135 - DNA, 14 bp, Homo sapiens
acatgcactgaccc

SEQ ID NO: 5139136 - DNA, 19 bp, Homo sapiens
acatgcactgacccttcca

SEQ ID NO: 5139137 - DNA, 22 bp, Homo sapiens
acatgcacttggctgcataaat

SEQ ID NO: 5139138 - DNA, 19 bp, Homo sapiens
acatgcacttttgggcctt

SEQ ID NO: 5139139 - DNA, 15 bp, Homo sapiens
acatgcagcccatgc

SEQ ID NO: 5139140 - DNA, 22 bp, Homo sapiens
acatgcagcccatgcccacctg

SEQ ID NO: 5139141 - DNA, 21 bp, Homo sapiens
acatgcagctatttcaaagtg

SEQ ID NO: 5139142 - DNA, 21 bp, Homo sapiens
acatgcagctcttcaacatga

SEQ ID NO: 5139143 - DNA, 23 bp, Homo sapiens
acatgcagtttgaaattctgaat

SEQ ID NO: 5139144 - DNA, 13 bp, Homo sapiens
acatgcatacaca

SEQ ID NO: 5139145 - DNA, 14 bp, Homo sapiens
acatgcatacacac

SEQ ID NO: 5139146 - DNA, 24 bp, Homo sapiens
acatgcatacacacacacacacag

SEQ ID NO: 5139147 - DNA, 13 bp, Homo sapiens
acatgcatataat

SEQ ID NO: 5139148 - DNA, 17 bp, Homo sapiens
acatgcatcatcagcct

SEQ ID NO: 5139149 - DNA, 16 bp, Homo sapiens
acatgcatcctcccct

SEQ ID NO: 5139150 - DNA, 19 bp, Homo sapiens
acatgcatcctcccctctc

SEQ ID NO: 5139151 - DNA, 16 bp, Homo sapiens
acatgcatgtctgcct

SEQ ID NO: 5139152 - DNA, 20 bp, Homo sapiens
acatgcatgttttatgtgca

SEQ ID NO: 5139153 - DNA, 16 bp, Homo sapiens
acatgcattactgcat

SEQ ID NO: 5139154 - DNA, 17 bp, Homo sapiens
acatgcattgttggcta

SEQ ID NO: 5139155 - DNA, 22 bp, Homo sapiens
acatgcattgttggctatttga

SEQ ID NO: 5139156 - DNA, 21 bp, Homo sapiens
acatgcatttgaggtcaagta

SEQ ID NO: 5139157 - DNA, 19 bp, Homo sapiens
acatgccacatcaaacctt

SEQ ID NO: 5139158 - DNA, 17 bp, Homo sapiens
acatgccaccctctcca

SEQ ID NO: 5139159 - DNA, 15 bp, Homo sapiens
acatgccacctggca

SEQ ID NO: 5139160 - DNA, 22 bp, Homo sapiens
acatgccagaaggaatcttctc

SEQ ID NO: 5139161 - DNA, 23 bp, Homo sapiens
acatgccagaaggaatcttctca

SEQ ID NO: 5139162 - DNA, 23 bp, Homo sapiens
acatgccagcttcctgtgggcca

SEQ ID NO: 5139163 - DNA, 21 bp, Homo sapiens
acatgccatttgtactgaccc

SEQ ID NO: 5139164 - DNA, 14 bp, Homo sapiens
acatgccccaggct

SEQ ID NO: 5139165 - DNA, 12 bp, Homo sapiens
acatgccccctg

SEQ ID NO: 5139166 - DNA, 12 bp, Homo sapiens
acatgcccctcc

SEQ ID NO: 5139167 - DNA, 13 bp, Homo sapiens
acatgcccctccc

SEQ ID NO: 5139168 - DNA, 16 bp, Homo sapiens
acatgcccctccccca

SEQ ID NO: 5139169 - DNA, 20 bp, Homo sapiens
acatgcccctcccccagctg

SEQ ID NO: 5139170 - DNA, 15 bp, Homo sapiens
acatgcccctcttag

SEQ ID NO: 5139171 - DNA, 18 bp, Homo sapiens
acatgcccgggaggaaag

SEQ ID NO: 5139172 - DNA, 23 bp, Homo sapiens
acatgccctcaggcttggggatg

SEQ ID NO: 5139173 - DNA, 13 bp, Homo sapiens
acatgccctccct

SEQ ID NO: 5139174 - DNA, 19 bp, Homo sapiens
acatgccctcccttctccc

SEQ ID NO: 5139175 - DNA, 22 bp, Homo sapiens
acatgccctcccttctccctgg

SEQ ID NO: 5139176 - DNA, 13 bp, Homo sapiens
acatgccctcctg

SEQ ID NO: 5139177 - DNA, 18 bp, Homo sapiens
acatgccctcctggacaa

SEQ ID NO: 5139178 - DNA, 23 bp, Homo sapiens
acatgccctcggtcactgagtct

SEQ ID NO: 5139179 - DNA, 15 bp, Homo sapiens
acatgccgaatgcca

SEQ ID NO: 5139180 - DNA, 21 bp, Homo sapiens
acatgccgcgggcggccaggc

SEQ ID NO: 5139181 - DNA, 19 bp, Homo sapiens
acatgccgcgtccctgccc

SEQ ID NO: 5139182 - DNA, 18 bp, Homo sapiens
acatgcctaccaatattt

SEQ ID NO: 5139183 - DNA, 22 bp, Homo sapiens
acatgcctatatgagaagaata

SEQ ID NO: 5139184 - DNA, 17 bp, Homo sapiens
acatgcctcctcctgcc

SEQ ID NO: 5139185 - DNA, 21 bp, Homo sapiens
acatgcctcctcctgccctcc

SEQ ID NO: 5139186 - DNA, 22 bp, Homo sapiens
acatgcctcctcctgccctccg

SEQ ID NO: 5139187 - DNA, 17 bp, Homo sapiens
acatgcctctctcaggc

SEQ ID NO: 5139188 - DNA, 18 bp, Homo sapiens
acatgcctctctcaggcc

SEQ ID NO: 5139189 - DNA, 17 bp, Homo sapiens
acatgcctgcgcctgct

SEQ ID NO: 5139190 - DNA, 20 bp, Homo sapiens
acatgcctgcgcctgctgcc

SEQ ID NO: 5139191 - DNA, 19 bp, Homo sapiens
acatgcctgtaatcccagc

SEQ ID NO: 5139192 - DNA, 20 bp, Homo sapiens
acatgccttggtgccggtca

SEQ ID NO: 5139193 - DNA, 19 bp, Homo sapiens
acatgcgatgttagtttta

SEQ ID NO: 5139194 - DNA, 18 bp, Homo sapiens
acatgcgctcctggcttt

SEQ ID NO: 5139195 - DNA, 16 bp, Homo sapiens
acatgcgggctcgccc

SEQ ID NO: 5139196 - DNA, 16 bp, Homo sapiens
acatgcgggctgggca

SEQ ID NO: 5139197 - DNA, 22 bp, Homo sapiens
acatgcggtagccagcacacag

SEQ ID NO: 5139198 - DNA, 23 bp, Homo sapiens
acatgcggtagccagcacacagg

SEQ ID NO: 5139199 - DNA, 15 bp, Homo sapiens
acatgctaaagccag

SEQ ID NO: 5139200 - DNA, 16 bp, Homo sapiens
acatgctaaagccagg

SEQ ID NO: 5139201 - DNA, 17 bp, Homo sapiens
acatgctaaataactat

SEQ ID NO: 5139202 - DNA, 18 bp, Homo sapiens
acatgctaaataactata

SEQ ID NO: 5139203 - DNA, 20 bp, Homo sapiens
acatgctaaataactatata

SEQ ID NO: 5139204 - DNA, 20 bp, Homo sapiens
acatgctaacctctctgaac

SEQ ID NO: 5139205 - DNA, 17 bp, Homo sapiens
acatgctaagagaagta

SEQ ID NO: 5139206 - DNA, 20 bp, Homo sapiens
acatgctactaaatttttat

SEQ ID NO: 5139207 - DNA, 22 bp, Homo sapiens
acatgctatgctgaagacattc

SEQ ID NO: 5139208 - DNA, 15 bp, Homo sapiens
acatgctcacctcta

SEQ ID NO: 5139209 - DNA, 20 bp, Homo sapiens
acatgctctttttttaagtg

SEQ ID NO: 5139210 - DNA, 14 bp, Homo sapiens
acatgctgagtctc

SEQ ID NO: 5139211 - DNA, 21 bp, Homo sapiens
acatgctgagtctcccaaggc

SEQ ID NO: 5139212 - DNA, 11 bp, Homo sapiens
acatgctgccc

SEQ ID NO: 5139213 - DNA, 12 bp, Homo sapiens
acatgctgccca

SEQ ID NO: 5139214 - DNA, 17 bp, Homo sapiens
acatgctgcccaccccc

SEQ ID NO: 5139215 - DNA, 13 bp, Homo sapiens
acatgctgcctgg

SEQ ID NO: 5139216 - DNA, 14 bp, Homo sapiens
acatgctgcctggc

SEQ ID NO: 5139217 - DNA, 15 bp, Homo sapiens
acatgctgcctggca

SEQ ID NO: 5139218 - DNA, 20 bp, Homo sapiens
acatgctgctctggtgcacg

SEQ ID NO: 5139219 - DNA, 14 bp, Homo sapiens
acatgctggaaata

SEQ ID NO: 5139220 - DNA, 18 bp, Homo sapiens
acatgctggacaggtctg

SEQ ID NO: 5139221 - DNA, 16 bp, Homo sapiens
acatgctggccagcct

SEQ ID NO: 5139222 - DNA, 14 bp, Homo sapiens
acatgctggctcct

SEQ ID NO: 5139223 - DNA, 15 bp, Homo sapiens
acatgctggctcctg

SEQ ID NO: 5139224 - DNA, 21 bp, Homo sapiens
acatgctggtgaatattttca

SEQ ID NO: 5139225 - DNA, 21 bp, Homo sapiens
acatgctggttacctgttcca

SEQ ID NO: 5139226 - DNA, 17 bp, Homo sapiens
acatgctgtacatactt

SEQ ID NO: 5139227 - DNA, 21 bp, Homo sapiens
acatgctgtatatgcaatgtc

SEQ ID NO: 5139228 - DNA, 15 bp, Homo sapiens
acatgctgtctggcc

SEQ ID NO: 5139229 - DNA, 17 bp, Homo sapiens
acatgctgtctggccct

SEQ ID NO: 5139230 - DNA, 19 bp, Homo sapiens
acatgctgtctggccctgg

SEQ ID NO: 5139231 - DNA, 21 bp, Homo sapiens
acatgctgtcttagatcagga

SEQ ID NO: 5139232 - DNA, 17 bp, Homo sapiens
acatgctgtgctctttg

SEQ ID NO: 5139233 - DNA, 18 bp, Homo sapiens
acatgctgtgctctttga

SEQ ID NO: 5139234 - DNA, 20 bp, Homo sapiens
acatgctgtgctctttgaag

SEQ ID NO: 5139235 - DNA, 13 bp, Homo sapiens
acatgcttagctt

SEQ ID NO: 5139236 - DNA, 23 bp, Homo sapiens
acatgcttagcttatctttcttt

SEQ ID NO: 5139237 - DNA, 21 bp, Homo sapiens
acatgcttcatgaaaatccta

SEQ ID NO: 5139238 - DNA, 23 bp, Homo sapiens
acatgcttcatgaaaatcctacc

SEQ ID NO: 5139239 - DNA, 13 bp, Homo sapiens
acatgcttccctt

SEQ ID NO: 5139240 - DNA, 14 bp, Homo sapiens
acatgcttgaataa

SEQ ID NO: 5139241 - DNA, 20 bp, Homo sapiens
acatgcttgtgtttcttagt

SEQ ID NO: 5139242 - DNA, 13 bp, Homo sapiens
acatgctttgtga

SEQ ID NO: 5139243 - DNA, 15 bp, Homo sapiens
acatgcttttacttt

SEQ ID NO: 5139244 - DNA, 14 bp, Homo sapiens
acatggaaaacaga

SEQ ID NO: 5139245 - DNA, 16 bp, Homo sapiens
acatggaaaacagagt

SEQ ID NO: 5139246 - DNA, 13 bp, Homo sapiens
acatggaaaagga

SEQ ID NO: 5139247 - DNA, 13 bp, Homo sapiens
acatggaaaagtt

SEQ ID NO: 5139248 - DNA, 18 bp, Homo sapiens
accaccagatgagaagtt

SEQ ID NO: 5139249 - DNA, 15 bp, Homo sapiens
accaccagccccagc

SEQ ID NO: 5139250 - DNA, 20 bp, Homo sapiens
accaccagcgttcccttctc

SEQ ID NO: 5139251 - DNA, 12 bp, Homo sapiens
accaccagctgt

SEQ ID NO: 5139252 - DNA, 17 bp, Homo sapiens
accaccagctgtgtcca

SEQ ID NO: 5139253 - DNA, 19 bp, Homo sapiens
accaccaggagcagcagcc

SEQ ID NO: 5139254 - DNA, 21 bp, Homo sapiens
accaccaggagcagcagccag

SEQ ID NO: 5139255 - DNA, 23 bp, Homo sapiens
accaccaggagcagcagccagca

SEQ ID NO: 5139256 - DNA, 17 bp, Homo sapiens
accaccagggtcccagg

SEQ ID NO: 5139257 - DNA, 20 bp, Homo sapiens
accaccagggtcccaggaag

SEQ ID NO: 5139258 - DNA, 23 bp, Homo sapiens
accaccagggtggaccaggcctg

SEQ ID NO: 5139259 - DNA, 14 bp, Homo sapiens
accaccaggtctcc

SEQ ID NO: 5139260 - DNA, 17 bp, Homo sapiens
accaccaggtctcccgg

SEQ ID NO: 5139261 - DNA, 17 bp, Homo sapiens
accaccatttaatttca

SEQ ID NO: 5139262 - DNA, 22 bp, Homo sapiens
accaccatttaatttcatgtat

SEQ ID NO: 5139263 - DNA, 20 bp, Homo sapiens
accacccaacctcaccctcc

SEQ ID NO: 5139264 - DNA, 16 bp, Homo sapiens
accacccacctgacca

SEQ ID NO: 5139265 - DNA, 17 bp, Homo sapiens
accacccatatcatgca

SEQ ID NO: 5139266 - DNA, 19 bp, Homo sapiens
accaccccagctgctcccc

SEQ ID NO: 5139267 - DNA, 18 bp, Homo sapiens
accacccccaaacacaaa

SEQ ID NO: 5139268 - DNA, 10 bp, Homo sapiens
accaccccct

SEQ ID NO: 5139269 - DNA, 14 bp, Homo sapiens
accaccccctgttc

SEQ ID NO: 5139270 - DNA, 18 bp, Homo sapiens
accaccccgcctgccctc

SEQ ID NO: 5139271 - DNA, 18 bp, Homo sapiens
accaccccggccccctgc

SEQ ID NO: 5139272 - DNA, 20 bp, Homo sapiens
accaccccggccccctgccc

SEQ ID NO: 5139273 - DNA, 18 bp, Homo sapiens
accacccctccctctgct

SEQ ID NO: 5139274 - DNA, 13 bp, Homo sapiens
accacccctgtgc

SEQ ID NO: 5139275 - DNA, 14 bp, Homo sapiens
accacccctgtgcg

SEQ ID NO: 5139276 - DNA, 21 bp, Homo sapiens
accacccgaaatgccacgtgg

SEQ ID NO: 5139277 - DNA, 20 bp, Homo sapiens
accaccctagtcccttcccc

SEQ ID NO: 5139278 - DNA, 23 bp, Homo sapiens
accaccctatcatcagttaggat

SEQ ID NO: 5139279 - DNA, 14 bp, Homo sapiens
accaccctcaggtg

SEQ ID NO: 5139280 - DNA, 17 bp, Homo sapiens
accaccctcaggtgcct

SEQ ID NO: 5139281 - DNA, 14 bp, Homo sapiens
accaccctcccacc

SEQ ID NO: 5139282 - DNA, 14 bp, Homo sapiens
accaccctcccctc

SEQ ID NO: 5139283 - DNA, 15 bp, Homo sapiens
accaccctcccctct

SEQ ID NO: 5139284 - DNA, 16 bp, Homo sapiens
accaccctcccctctc

SEQ ID NO: 5139285 - DNA, 21 bp, Homo sapiens
accaccctcccctctcttgca

SEQ ID NO: 5139286 - DNA, 14 bp, Homo sapiens
accaccctccttcc

SEQ ID NO: 5139287 - DNA, 18 bp, Homo sapiens
accaccctcgctgccacc

SEQ ID NO: 5139288 - DNA, 12 bp, Homo sapiens
accaccctctgg

SEQ ID NO: 5139289 - DNA, 15 bp, Homo sapiens
accaccctctgggga

SEQ ID NO: 5139290 - DNA, 14 bp, Homo sapiens
accaccctgagccg

SEQ ID NO: 5139291 - DNA, 12 bp, Homo sapiens
accaccctgagg

SEQ ID NO: 5139292 - DNA, 13 bp, Homo sapiens
accaccctgaggg

SEQ ID NO: 5139293 - DNA, 12 bp, Homo sapiens
accaccctgcca

SEQ ID NO: 5139294 - DNA, 15 bp, Homo sapiens
accaccctgccaagg

SEQ ID NO: 5139295 - DNA, 15 bp, Homo sapiens
accaccctgcctgtg

SEQ ID NO: 5139296 - DNA, 16 bp, Homo sapiens
accaccctgtcttcct

SEQ ID NO: 5139297 - DNA, 17 bp, Homo sapiens
accaccctgtcttcctc

SEQ ID NO: 5139298 - DNA, 20 bp, Homo sapiens
accaccctgtcttcctctgc

SEQ ID NO: 5139299 - DNA, 21 bp, Homo sapiens
accaccctgtcttcctctgca

SEQ ID NO: 5139300 - DNA, 19 bp, Homo sapiens
accaccgaatatattactg

SEQ ID NO: 5139301 - DNA, 16 bp, Homo sapiens
accaccgagctctgtg

SEQ ID NO: 5139302 - DNA, 19 bp, Homo sapiens
accaccgcatatgcatgcc

SEQ ID NO: 5139303 - DNA, 16 bp, Homo sapiens
accaccgcccgtctgt

SEQ ID NO: 5139304 - DNA, 18 bp, Homo sapiens
accaccgccctcctcgct

SEQ ID NO: 5139305 - DNA, 17 bp, Homo sapiens
accaccgcgcccctctg

SEQ ID NO: 5139306 - DNA, 13 bp, Homo sapiens
accaccgctcccg

SEQ ID NO: 5139307 - DNA, 18 bp, Homo sapiens
accaccggggcactggct

SEQ ID NO: 5139308 - DNA, 20 bp, Homo sapiens
accaccggggcactggctgc

SEQ ID NO: 5139309 - DNA, 18 bp, Homo sapiens
accacctaatcaggctga

SEQ ID NO: 5139310 - DNA, 18 bp, Homo sapiens
accacctaggccactcct

SEQ ID NO: 5139311 - DNA, 15 bp, Homo sapiens
accacctcactcctg

SEQ ID NO: 5139312 - DNA, 15 bp, Homo sapiens
accacctcagaaagg

SEQ ID NO: 5139313 - DNA, 12 bp, Homo sapiens
accacctcatgt

SEQ ID NO: 5139314 - DNA, 17 bp, Homo sapiens
accacctcctctgccag

SEQ ID NO: 5139315 - DNA, 15 bp, Homo sapiens
accacctgccagcca

SEQ ID NO: 5139316 - DNA, 17 bp, Homo sapiens
accacctgccagccatc

SEQ ID NO: 5139317 - DNA, 18 bp, Homo sapiens
accacctgccagccatca

SEQ ID NO: 5139318 - DNA, 19 bp, Homo sapiens
accacctgccagccatcac

SEQ ID NO: 5139319 - DNA, 13 bp, Homo sapiens
accacctgcttct

SEQ ID NO: 5139320 - DNA, 19 bp, Homo sapiens
accacctggagcggctcat

SEQ ID NO: 5139321 - DNA, 13 bp, Homo sapiens
accacctggagtg

SEQ ID NO: 5139322 - DNA, 20 bp, Homo sapiens
accacctgggttcagcctct

SEQ ID NO: 5139323 - DNA, 21 bp, Homo sapiens
accacctgggttcagcctctc

SEQ ID NO: 5139324 - DNA, 13 bp, Homo sapiens
accacctgtacat

SEQ ID NO: 5139325 - DNA, 16 bp, Homo sapiens
accacctgtacataca

SEQ ID NO: 5139326 - DNA, 17 bp, Homo sapiens
accaccttatacatcac

SEQ ID NO: 5139327 - DNA, 21 bp, Homo sapiens
accaccttatacatcacttcc

SEQ ID NO: 5139328 - DNA, 14 bp, Homo sapiens
accaccttcccagc

SEQ ID NO: 5139329 - DNA, 15 bp, Homo sapiens
accaccttcccagct

SEQ ID NO: 5139330 - DNA, 22 bp, Homo sapiens
accaccttcccagctctccctc

SEQ ID NO: 5139331 - DNA, 12 bp, Homo sapiens
accaccttccct

SEQ ID NO: 5139332 - DNA, 13 bp, Homo sapiens
accaccttccctt

SEQ ID NO: 5139333 - DNA, 16 bp, Homo sapiens
accaccttctgtcccc

SEQ ID NO: 5139334 - DNA, 22 bp, Homo sapiens
accaccttgcactattggactt

SEQ ID NO: 5139335 - DNA, 19 bp, Homo sapiens
accaccttggactcctccc

SEQ ID NO: 5139336 - DNA, 15 bp, Homo sapiens
accacctttactgtg

SEQ ID NO: 5139337 - DNA, 16 bp, Homo sapiens
accacctttactgtgc

SEQ ID NO: 5139338 - DNA, 22 bp, Homo sapiens
accacctttgtttctcccccat

SEQ ID NO: 5139339 - DNA, 15 bp, Homo sapiens
accacgacctcgtcc

SEQ ID NO: 5139340 - DNA, 13 bp, Homo sapiens
accacgactggcc

SEQ ID NO: 5139341 - DNA, 19 bp, Homo sapiens
accacgactggccagggcc

SEQ ID NO: 5139342 - DNA, 13 bp, Homo sapiens
accacgaggaaaa

SEQ ID NO: 5139343 - DNA, 15 bp, Homo sapiens
accacgcacctccac

SEQ ID NO: 5139344 - DNA, 22 bp, Homo sapiens
accacgcagagaggggaggtgg

SEQ ID NO: 5139345 - DNA, 19 bp, Homo sapiens
accacgccagctaattttt

SEQ ID NO: 5139346 - DNA, 19 bp, Homo sapiens
accacgcccagctaatttt

SEQ ID NO: 5139347 - DNA, 14 bp, Homo sapiens
accacgccctgcct

SEQ ID NO: 5139348 - DNA, 18 bp, Homo sapiens
accacgcctcttgaccag

SEQ ID NO: 5139349 - DNA, 15 bp, Homo sapiens
accacgcgtcaccca

SEQ ID NO: 5139350 - DNA, 18 bp, Homo sapiens
accacgcttgacaggaca

SEQ ID NO: 5139351 - DNA, 20 bp, Homo sapiens
accacgcttgacaggacagc

SEQ ID NO: 5139352 - DNA, 14 bp, Homo sapiens
accacggccactgg

SEQ ID NO: 5139353 - DNA, 22 bp, Homo sapiens
accacggccactggccatctcc

SEQ ID NO: 5139354 - DNA, 18 bp, Homo sapiens
accacggcgtttttttac

SEQ ID NO: 5139355 - DNA, 22 bp, Homo sapiens
accacgggacatcacagggtgg

SEQ ID NO: 5139356 - DNA, 19 bp, Homo sapiens
accacgggcccgggttggg

SEQ ID NO: 5139357 - DNA, 14 bp, Homo sapiens
accacgggcctcag

SEQ ID NO: 5139358 - DNA, 20 bp, Homo sapiens
accacgggcctcagtttccc

SEQ ID NO: 5139359 - DNA, 23 bp, Homo sapiens
accacggtccaatccagccttct

SEQ ID NO: 5139360 - DNA, 16 bp, Homo sapiens
accacgtctccctggc

SEQ ID NO: 5139361 - DNA, 16 bp, Homo sapiens
accacgtctgccaggc

SEQ ID NO: 5139362 - DNA, 19 bp, Homo sapiens
accacgtctgccaggccca

SEQ ID NO: 5139363 - DNA, 15 bp, Homo sapiens
accacgtctggctcc

SEQ ID NO: 5139364 - DNA, 16 bp, Homo sapiens
accacgtgaaactgct

SEQ ID NO: 5139365 - DNA, 21 bp, Homo sapiens
accacgtgaaatttgcctctg

SEQ ID NO: 5139366 - DNA, 23 bp, Homo sapiens
accacgtgctacccccatgctgg

SEQ ID NO: 5139367 - DNA, 16 bp, Homo sapiens
accacgtggggccatg

SEQ ID NO: 5139368 - DNA, 13 bp, Homo sapiens
accacgtttctaa

SEQ ID NO: 5139369 - DNA, 12 bp, Homo sapiens
accactaaaaaa

SEQ ID NO: 5139370 - DNA, 23 bp, Homo sapiens
accactaaagtagggaagtttta

SEQ ID NO: 5139371 - DNA, 17 bp, Homo sapiens
accactaaccatcccca

SEQ ID NO: 5139372 - DNA, 18 bp, Homo sapiens
accactaaccatccccaa

SEQ ID NO: 5139373 - DNA, 17 bp, Homo sapiens
accactaactcctgaga

SEQ ID NO: 5139374 - DNA, 17 bp, Homo sapiens
accactaatttgtcact

SEQ ID NO: 5139375 - DNA, 22 bp, Homo sapiens
accactaatttgtcactggaac

SEQ ID NO: 5139376 - DNA, 14 bp, Homo sapiens
accactaattttgt

SEQ ID NO: 5139377 - DNA, 14 bp, Homo sapiens
accactacattctg

SEQ ID NO: 5139378 - DNA, 15 bp, Homo sapiens
accactacattctgt

SEQ ID NO: 5139379 - DNA, 16 bp, Homo sapiens
accactaccagccagc

SEQ ID NO: 5139380 - DNA, 13 bp, Homo sapiens
accactagaactc

SEQ ID NO: 5139381 - DNA, 19 bp, Homo sapiens
accactagactcaaggaag

SEQ ID NO: 5139382 - DNA, 13 bp, Homo sapiens
accactagagctg

SEQ ID NO: 5139383 - DNA, 20 bp, Homo sapiens
accactagctaagcaagcca

SEQ ID NO: 5139384 - DNA, 19 bp, Homo sapiens
accactaggaatcccagag

SEQ ID NO: 5139385 - DNA, 19 bp, Homo sapiens
accactagggtcctggccc

SEQ ID NO: 5139386 - DNA, 21 bp, Homo sapiens
accactagggtcctggccctc

SEQ ID NO: 5139387 - DNA, 15 bp, Homo sapiens
accactataaaatgt

SEQ ID NO: 5139388 - DNA, 13 bp, Homo sapiens
accactatcttaa

SEQ ID NO: 5139389 - DNA, 16 bp, Homo sapiens
accactcaagaccaaa

SEQ ID NO: 5139390 - DNA, 16 bp, Homo sapiens
accactcaagcaacaa

SEQ ID NO: 5139391 - DNA, 13 bp, Homo sapiens
accactcagagac

SEQ ID NO: 5139392 - DNA, 12 bp, Homo sapiens
accactcagccc

SEQ ID NO: 5139393 - DNA, 13 bp, Homo sapiens
accactcagcccc

SEQ ID NO: 5139394 - DNA, 13 bp, Homo sapiens
accactcaggcca

SEQ ID NO: 5139395 - DNA, 14 bp, Homo sapiens
accactcagtgctt

SEQ ID NO: 5139396 - DNA, 13 bp, Homo sapiens
accactccagaga

SEQ ID NO: 5139397 - DNA, 18 bp, Homo sapiens
accactcctcaggaacag

SEQ ID NO: 5139398 - DNA, 18 bp, Homo sapiens
accactcctgtccctgta

SEQ ID NO: 5139399 - DNA, 21 bp, Homo sapiens
accactcctgtccctgtagct

SEQ ID NO: 5139400 - DNA, 19 bp, Homo sapiens
accactcggggcccccatc

SEQ ID NO: 5139401 - DNA, 14 bp, Homo sapiens
accactcgtgcatc

SEQ ID NO: 5139402 - DNA, 21 bp, Homo sapiens
accactcgtgcatccctgaga

SEQ ID NO: 5139403 - DNA, 15 bp, Homo sapiens
accactctcaggacc

SEQ ID NO: 5139404 - DNA, 17 bp, Homo sapiens
accactctcaggaccac

SEQ ID NO: 5139405 - DNA, 14 bp, Homo sapiens
accactctggcagc

SEQ ID NO: 5139406 - DNA, 20 bp, Homo sapiens
accactctggcagccacact

SEQ ID NO: 5139407 - DNA, 15 bp, Homo sapiens
accactctgggcaca

SEQ ID NO: 5139408 - DNA, 12 bp, Homo sapiens
accactctgtaa

SEQ ID NO: 5139409 - DNA, 18 bp, Homo sapiens
accactctgtggccagcc

SEQ ID NO: 5139410 - DNA, 20 bp, Homo sapiens
accactctgtggccagcctg

SEQ ID NO: 5139411 - DNA, 22 bp, Homo sapiens
accactctgtggccagcctggc

SEQ ID NO: 5139412 - DNA, 18 bp, Homo sapiens
accactgaacatttgctt

SEQ ID NO: 5139413 - DNA, 16 bp, Homo sapiens
accactgaattcactc

SEQ ID NO: 5139414 - DNA, 19 bp, Homo sapiens
accactgagctctgcctca

SEQ ID NO: 5139415 - DNA, 14 bp, Homo sapiens
accactgcactcca

SEQ ID NO: 5139416 - DNA, 17 bp, Homo sapiens
accactgcactccagcc

SEQ ID NO: 5139417 - DNA, 17 bp, Homo sapiens
accactgcactttccaa

SEQ ID NO: 5139418 - DNA, 13 bp, Homo sapiens
accactgccctgc

SEQ ID NO: 5139419 - DNA, 17 bp, Homo sapiens
accactgccctgcctgc

SEQ ID NO: 5139420 - DNA, 14 bp, Homo sapiens
accactgctaataa

SEQ ID NO: 5139421 - DNA, 20 bp, Homo sapiens
accactgctaataaatgacc

SEQ ID NO: 5139422 - DNA, 21 bp, Homo sapiens
accactgctaataaatgacca

SEQ ID NO: 5139423 - DNA, 23 bp, Homo sapiens
accactgctaataaatgaccagt

SEQ ID NO: 5139424 - DNA, 17 bp, Homo sapiens
accactgctctgatgaa

SEQ ID NO: 5139425 - DNA, 23 bp, Homo sapiens
accactgctctgatgaagaggag

SEQ ID NO: 5139426 - DNA, 19 bp, Homo sapiens
accactgcttcccactggg

SEQ ID NO: 5139427 - DNA, 12 bp, Homo sapiens
accactggaagc

SEQ ID NO: 5139428 - DNA, 19 bp, Homo sapiens
accactggaagcaggatgg

SEQ ID NO: 5139429 - DNA, 23 bp, Homo sapiens
acatggaaagggagacagccagg

SEQ ID NO: 5139430 - DNA, 16 bp, Homo sapiens
acatggaaagggtctt

SEQ ID NO: 5139431 - DNA, 12 bp, Homo sapiens
acatggaacagt

SEQ ID NO: 5139432 - DNA, 16 bp, Homo sapiens
acatggaacagtgtaa

SEQ ID NO: 5139433 - DNA, 14 bp, Homo sapiens
acatggaagggaag

SEQ ID NO: 5139434 - DNA, 14 bp, Homo sapiens
acatggaagtacta

SEQ ID NO: 5139435 - DNA, 20 bp, Homo sapiens
acatggaatatattttaata

SEQ ID NO: 5139436 - DNA, 13 bp, Homo sapiens
acatggaccagca

SEQ ID NO: 5139437 - DNA, 23 bp, Homo sapiens
acatggaccagcatctggtcttg

SEQ ID NO: 5139438 - DNA, 22 bp, Homo sapiens
acatggacccactacccttctc

SEQ ID NO: 5139439 - DNA, 16 bp, Homo sapiens
acatggacccggagct

SEQ ID NO: 5139440 - DNA, 19 bp, Homo sapiens
acatggacccggagctaac

SEQ ID NO: 5139441 - DNA, 14 bp, Homo sapiens
acatggacctccag

SEQ ID NO: 5139442 - DNA, 19 bp, Homo sapiens
acatggacctccaggctcc

SEQ ID NO: 5139443 - DNA, 21 bp, Homo sapiens
acatggagaaaccctgtctct

SEQ ID NO: 5139444 - DNA, 14 bp, Homo sapiens
acatggagaaatct

SEQ ID NO: 5139445 - DNA, 17 bp, Homo sapiens
acatggagactcctgcc

SEQ ID NO: 5139446 - DNA, 19 bp, Homo sapiens
acatggagccccctctgcc

SEQ ID NO: 5139447 - DNA, 12 bp, Homo sapiens
acatggagctct

SEQ ID NO: 5139448 - DNA, 12 bp, Homo sapiens
acatggaggaat

SEQ ID NO: 5139449 - DNA, 23 bp, Homo sapiens
acatggaggatggtgtcctgagg

SEQ ID NO: 5139450 - DNA, 19 bp, Homo sapiens
acatggagtatatgtcaag

SEQ ID NO: 5139451 - DNA, 13 bp, Homo sapiens
acatggagttccc

SEQ ID NO: 5139452 - DNA, 14 bp, Homo sapiens
acatggagttcccg

SEQ ID NO: 5139453 - DNA, 16 bp, Homo sapiens
acatggatacttcctg

SEQ ID NO: 5139454 - DNA, 21 bp, Homo sapiens
acatggatacttctaaaagct

SEQ ID NO: 5139455 - DNA, 18 bp, Homo sapiens
acatggatgcgaggacca

SEQ ID NO: 5139456 - DNA, 13 bp, Homo sapiens
acatggatgtgtt

SEQ ID NO: 5139457 - DNA, 14 bp, Homo sapiens
acatggattcagtt

SEQ ID NO: 5139458 - DNA, 15 bp, Homo sapiens
acatggattccaaag

SEQ ID NO: 5139459 - DNA, 17 bp, Homo sapiens
acatggattccactgaa

SEQ ID NO: 5139460 - DNA, 15 bp, Homo sapiens
acatggcagccattc

SEQ ID NO: 5139461 - DNA, 23 bp, Homo sapiens
acatggccaatagtcatatgtga

SEQ ID NO: 5139462 - DNA, 19 bp, Homo sapiens
acatggccagactcccttg

SEQ ID NO: 5139463 - DNA, 15 bp, Homo sapiens
acatggccagtgtga

SEQ ID NO: 5139464 - DNA, 21 bp, Homo sapiens
acatggccatagaggcccagg

SEQ ID NO: 5139465 - DNA, 15 bp, Homo sapiens
acatggccgctgccc

SEQ ID NO: 5139466 - DNA, 16 bp, Homo sapiens
acatggcgccctgcct

SEQ ID NO: 5139467 - DNA, 18 bp, Homo sapiens
acatggcgccctgcctcc

SEQ ID NO: 5139468 - DNA, 15 bp, Homo sapiens
acatggctagccttt

SEQ ID NO: 5139469 - DNA, 18 bp, Homo sapiens
acatggctatcctagaga

SEQ ID NO: 5139470 - DNA, 15 bp, Homo sapiens
acatggctgggcctt

SEQ ID NO: 5139471 - DNA, 13 bp, Homo sapiens
acatggctggggg

SEQ ID NO: 5139472 - DNA, 14 bp, Homo sapiens
acatggcttagttt

SEQ ID NO: 5139473 - DNA, 19 bp, Homo sapiens
acatggcttagttttcata

SEQ ID NO: 5139474 - DNA, 19 bp, Homo sapiens
acatggcttcctaaatggc

SEQ ID NO: 5139475 - DNA, 13 bp, Homo sapiens
acatggcttcctc

SEQ ID NO: 5139476 - DNA, 23 bp, Homo sapiens
acatggcttctcctttggcatgt

SEQ ID NO: 5139477 - DNA, 21 bp, Homo sapiens
acatgggacatttgctcatgg

SEQ ID NO: 5139478 - DNA, 12 bp, Homo sapiens
acatgggacctg

SEQ ID NO: 5139479 - DNA, 13 bp, Homo sapiens
acatgggacctgg

SEQ ID NO: 5139480 - DNA, 12 bp, Homo sapiens
acatgggagtgg

SEQ ID NO: 5139481 - DNA, 18 bp, Homo sapiens
acatgggccagtttatat

SEQ ID NO: 5139482 - DNA, 23 bp, Homo sapiens
acatgggctatcagggaggaaga

SEQ ID NO: 5139483 - DNA, 13 bp, Homo sapiens
acatgggctgggg

SEQ ID NO: 5139484 - DNA, 14 bp, Homo sapiens
acatgggctggggg

SEQ ID NO: 5139485 - DNA, 23 bp, Homo sapiens
acatgggctgtgattactgcaat

SEQ ID NO: 5139486 - DNA, 18 bp, Homo sapiens
acatggggaaaaaaatca

SEQ ID NO: 5139487 - DNA, 13 bp, Homo sapiens
acatggggaaggc

SEQ ID NO: 5139488 - DNA, 19 bp, Homo sapiens
acatggggaaggcagaggc

SEQ ID NO: 5139489 - DNA, 21 bp, Homo sapiens
acatggggaggttgtggggcc

SEQ ID NO: 5139490 - DNA, 20 bp, Homo sapiens
acatggggagtgtttcatgg

SEQ ID NO: 5139491 - DNA, 14 bp, Homo sapiens
acatggggcaagcc

SEQ ID NO: 5139492 - DNA, 23 bp, Homo sapiens
acatggggcaagccagggcccag

SEQ ID NO: 5139493 - DNA, 17 bp, Homo sapiens
acatggggcctggccca

SEQ ID NO: 5139494 - DNA, 18 bp, Homo sapiens
acatggggctgggcagct

SEQ ID NO: 5139495 - DNA, 13 bp, Homo sapiens
acatgggggagag

SEQ ID NO: 5139496 - DNA, 16 bp, Homo sapiens
acatggggttcctggt

SEQ ID NO: 5139497 - DNA, 15 bp, Homo sapiens
acatgggttcaattg

SEQ ID NO: 5139498 - DNA, 14 bp, Homo sapiens
acatgggtttagtt

SEQ ID NO: 5139499 - DNA, 20 bp, Homo sapiens
acatggtagatgcttgattg

SEQ ID NO: 5139500 - DNA, 23 bp, Homo sapiens
acatggtagcagggtctttgtgt

SEQ ID NO: 5139501 - DNA, 21 bp, Homo sapiens
acatggtattgtaatgaatat

SEQ ID NO: 5139502 - DNA, 19 bp, Homo sapiens
acatggtccatttcatgtg

SEQ ID NO: 5139503 - DNA, 20 bp, Homo sapiens
acatggtccatttcatgtga

SEQ ID NO: 5139504 - DNA, 16 bp, Homo sapiens
acatggtctagtgaca

SEQ ID NO: 5139505 - DNA, 17 bp, Homo sapiens
acatggtctgtcaatga

SEQ ID NO: 5139506 - DNA, 20 bp, Homo sapiens
acatggtgaaacccccatct

SEQ ID NO: 5139507 - DNA, 20 bp, Homo sapiens
acatggtgaaaccctgtctc

SEQ ID NO: 5139508 - DNA, 21 bp, Homo sapiens
acatggtgaaacctcatctct

SEQ ID NO: 5139509 - DNA, 18 bp, Homo sapiens
acatggtgcccctagctt

SEQ ID NO: 5139510 - DNA, 16 bp, Homo sapiens
acatggtgcctgagag

SEQ ID NO: 5139511 - DNA, 18 bp, Homo sapiens
acatggtgcctgagaggc

SEQ ID NO: 5139512 - DNA, 20 bp, Homo sapiens
acatggtgcctgagaggcag

SEQ ID NO: 5139513 - DNA, 12 bp, Homo sapiens
acatggtgctgt

SEQ ID NO: 5139514 - DNA, 16 bp, Homo sapiens
acatggtgctgtgtgt

SEQ ID NO: 5139515 - DNA, 19 bp, Homo sapiens
acatggtggggtctcctca

SEQ ID NO: 5139516 - DNA, 18 bp, Homo sapiens
acatggtgggtccatggg

SEQ ID NO: 5139517 - DNA, 19 bp, Homo sapiens
acatggtgggtccatgggc

SEQ ID NO: 5139518 - DNA, 16 bp, Homo sapiens
acatggtgtctcacac

SEQ ID NO: 5139519 - DNA, 16 bp, Homo sapiens
acatggtgtctcccaa

SEQ ID NO: 5139520 - DNA, 16 bp, Homo sapiens
acatggtgtgtgtctc

SEQ ID NO: 5139521 - DNA, 19 bp, Homo sapiens
acatggtgtgtgtctctga

SEQ ID NO: 5139522 - DNA, 18 bp, Homo sapiens
acatggttacatatcaaa

SEQ ID NO: 5139523 - DNA, 19 bp, Homo sapiens
acatggttgggggaatgca

SEQ ID NO: 5139524 - DNA, 20 bp, Homo sapiens
acatggttgggggaatgcac

SEQ ID NO: 5139525 - DNA, 14 bp, Homo sapiens
acatggtttaaaag

SEQ ID NO: 5139526 - DNA, 14 bp, Homo sapiens
acatggtttaaata

SEQ ID NO: 5139527 - DNA, 19 bp, Homo sapiens
acatggtttaaatatgaat

SEQ ID NO: 5139528 - DNA, 21 bp, Homo sapiens
acatggtttagataaaggaaa

SEQ ID NO: 5139529 - DNA, 17 bp, Homo sapiens
acatggtttgactcccg

SEQ ID NO: 5139530 - DNA, 15 bp, Homo sapiens
acatggtttgactct

SEQ ID NO: 5139531 - DNA, 20 bp, Homo sapiens
acatgtaaaaagacaaaaac

SEQ ID NO: 5139532 - DNA, 14 bp, Homo sapiens
acatgtaaaaatgt

SEQ ID NO: 5139533 - DNA, 15 bp, Homo sapiens
acatgtaaaaatgtt

SEQ ID NO: 5139534 - DNA, 23 bp, Homo sapiens
acatgtaaaatcttgatagctaa

SEQ ID NO: 5139535 - DNA, 16 bp, Homo sapiens
acatgtaaaatgttta

SEQ ID NO: 5139536 - DNA, 20 bp, Homo sapiens
acatgtaaagctgttaaaat

SEQ ID NO: 5139537 - DNA, 17 bp, Homo sapiens
acatgtaaattaagtgt

SEQ ID NO: 5139538 - DNA, 23 bp, Homo sapiens
acatgtaaattaagtgtgtgtat

SEQ ID NO: 5139539 - DNA, 20 bp, Homo sapiens
acatgtaactatttcttcag

SEQ ID NO: 5139540 - DNA, 21 bp, Homo sapiens
acatgtaactatttcttcaga

SEQ ID NO: 5139541 - DNA, 14 bp, Homo sapiens
acatgtaagaaaat

SEQ ID NO: 5139542 - DNA, 15 bp, Homo sapiens
acatgtaattaagta

SEQ ID NO: 5139543 - DNA, 22 bp, Homo sapiens
acatgtaattaagtactatgta

SEQ ID NO: 5139544 - DNA, 11 bp, Homo sapiens
acatgtacaga

SEQ ID NO: 5139545 - DNA, 21 bp, Homo sapiens
acatgtacataaactgtcact

SEQ ID NO: 5139546 - DNA, 22 bp, Homo sapiens
acatgtacatatggaaatgtta

SEQ ID NO: 5139547 - DNA, 20 bp, Homo sapiens
acatgtaccccctttccctt

SEQ ID NO: 5139548 - DNA, 16 bp, Homo sapiens
acatgtagaaaaatac

SEQ ID NO: 5139549 - DNA, 17 bp, Homo sapiens
acatgtaggaagtagga

SEQ ID NO: 5139550 - DNA, 19 bp, Homo sapiens
acatgtagggcaagaggat

SEQ ID NO: 5139551 - DNA, 16 bp, Homo sapiens
acatgtataaagtgat

SEQ ID NO: 5139552 - DNA, 22 bp, Homo sapiens
acatgtataaagtgattgactt

SEQ ID NO: 5139553 - DNA, 20 bp, Homo sapiens
acatgtataatatttttaat

SEQ ID NO: 5139554 - DNA, 21 bp, Homo sapiens
acatgtatctatgcattttct

SEQ ID NO: 5139555 - DNA, 19 bp, Homo sapiens
acatgtatctctaatgaaa

SEQ ID NO: 5139556 - DNA, 17 bp, Homo sapiens
acatgtatctgtctact

SEQ ID NO: 5139557 - DNA, 18 bp, Homo sapiens
acatgtatctgtctactt

SEQ ID NO: 5139558 - DNA, 17 bp, Homo sapiens
acatgtatgatttctgt

SEQ ID NO: 5139559 - DNA, 15 bp, Homo sapiens
acatgtatgcttcca

SEQ ID NO: 5139560 - DNA, 16 bp, Homo sapiens
acatgtatgcttccag

SEQ ID NO: 5139561 - DNA, 13 bp, Homo sapiens
acatgtatgtaaa

SEQ ID NO: 5139562 - DNA, 19 bp, Homo sapiens
acatgtatgtgtgcttgag

SEQ ID NO: 5139563 - DNA, 19 bp, Homo sapiens
acatgtatgtttgctcctg

SEQ ID NO: 5139564 - DNA, 15 bp, Homo sapiens
acatgtatgttttgg

SEQ ID NO: 5139565 - DNA, 15 bp, Homo sapiens
acatgtattatttca

SEQ ID NO: 5139566 - DNA, 15 bp, Homo sapiens
acatgtattctgttg

SEQ ID NO: 5139567 - DNA, 18 bp, Homo sapiens
acatgtattgcacattgt

SEQ ID NO: 5139568 - DNA, 17 bp, Homo sapiens
acatgtatttgtttgca

SEQ ID NO: 5139569 - DNA, 18 bp, Homo sapiens
acatgtatttgtttgcat

SEQ ID NO: 5139570 - DNA, 19 bp, Homo sapiens
acatgtatttgtttgcata

SEQ ID NO: 5139571 - DNA, 15 bp, Homo sapiens
acatgtcaatctgtc

SEQ ID NO: 5139572 - DNA, 18 bp, Homo sapiens
acatgtcacaatacagta

SEQ ID NO: 5139573 - DNA, 23 bp, Homo sapiens
acatgtcaccgtggaccttcctg

SEQ ID NO: 5139574 - DNA, 18 bp, Homo sapiens
acatgtcagtaccttcaa

SEQ ID NO: 5139575 - DNA, 21 bp, Homo sapiens
acatgtcagtaccttcaaact

SEQ ID NO: 5139576 - DNA, 15 bp, Homo sapiens
acatgtccaagaagc

SEQ ID NO: 5139577 - DNA, 16 bp, Homo sapiens
acatgtcctatccaaa

SEQ ID NO: 5139578 - DNA, 21 bp, Homo sapiens
acatgtcctatccaaaggaat

SEQ ID NO: 5139579 - DNA, 16 bp, Homo sapiens
acatgtccttgtgtgt

SEQ ID NO: 5139580 - DNA, 21 bp, Homo sapiens
acatgtccttgtgtgttttga

SEQ ID NO: 5139581 - DNA, 17 bp, Homo sapiens
acatgtcggagtagaaa

SEQ ID NO: 5139582 - DNA, 18 bp, Homo sapiens
acatgtctcctatcctgg

SEQ ID NO: 5139583 - DNA, 15 bp, Homo sapiens
acatgtcttaatgaa

SEQ ID NO: 5139584 - DNA, 16 bp, Homo sapiens
acatgtcttaatgaag

SEQ ID NO: 5139585 - DNA, 13 bp, Homo sapiens
acatgtcttccat

SEQ ID NO: 5139586 - DNA, 19 bp, Homo sapiens
acatgtcttgtacatgtgt

SEQ ID NO: 5139587 - DNA, 21 bp, Homo sapiens
acatgtctttggcttcagaat

SEQ ID NO: 5139588 - DNA, 14 bp, Homo sapiens
acatgtgaaaagaa

SEQ ID NO: 5139589 - DNA, 20 bp, Homo sapiens
acatgtgaaaccttttttaa

SEQ ID NO: 5139590 - DNA, 21 bp, Homo sapiens
acatgtgaaaccttttttaag

SEQ ID NO: 5139591 - DNA, 16 bp, Homo sapiens
acatgtgaaagatagg

SEQ ID NO: 5139592 - DNA, 12 bp, Homo sapiens
acatgtgacaca

SEQ ID NO: 5139593 - DNA, 14 bp, Homo sapiens
acatgtgacacata

SEQ ID NO: 5139594 - DNA, 23 bp, Homo sapiens
acatgtgagcatggtcacaagca

SEQ ID NO: 5139595 - DNA, 17 bp, Homo sapiens
acatgtgaggaggaaaa

SEQ ID NO: 5139596 - DNA, 15 bp, Homo sapiens
acatgtgatacattt

SEQ ID NO: 5139597 - DNA, 16 bp, Homo sapiens
acatgtgcacatgcac

SEQ ID NO: 5139598 - DNA, 17 bp, Homo sapiens
acatgtgcagatatcca

SEQ ID NO: 5139599 - DNA, 22 bp, Homo sapiens
acatgtgccagggcaatgatga

SEQ ID NO: 5139600 - DNA, 13 bp, Homo sapiens
acatgtgcccctg

SEQ ID NO: 5139601 - DNA, 14 bp, Homo sapiens
acatgtgccctcag

SEQ ID NO: 5139602 - DNA, 23 bp, Homo sapiens
acatgtgctattgaactgagcca

SEQ ID NO: 5139603 - DNA, 23 bp, Homo sapiens
acatgtgctcgctctgcatgatt

SEQ ID NO: 5139604 - DNA, 17 bp, Homo sapiens
acatgtgctgatgttta

SEQ ID NO: 5139605 - DNA, 19 bp, Homo sapiens
acatgtggccatggcctct

SEQ ID NO: 5139606 - DNA, 16 bp, Homo sapiens
acatgtggggccaggt

SEQ ID NO: 5139607 - DNA, 21 bp, Homo sapiens
accactggccaccaggctggc

SEQ ID NO: 5139608 - DNA, 15 bp, Homo sapiens
accactggcctaccc

SEQ ID NO: 5139609 - DNA, 17 bp, Homo sapiens
accactgggatcagctg

SEQ ID NO: 5139610 - DNA, 13 bp, Homo sapiens
accactgggcccc

SEQ ID NO: 5139611 - DNA, 16 bp, Homo sapiens
accactgggcctgcta

SEQ ID NO: 5139612 - DNA, 23 bp, Homo sapiens
accactgggtacaagagatggga

SEQ ID NO: 5139613 - DNA, 16 bp, Homo sapiens
accactggttaaaata

SEQ ID NO: 5139614 - DNA, 22 bp, Homo sapiens
accactggttaaaataaagcct

SEQ ID NO: 5139615 - DNA, 19 bp, Homo sapiens
accactgtaaaatgaaatt

SEQ ID NO: 5139616 - DNA, 20 bp, Homo sapiens
accactgtacacacccgcct

SEQ ID NO: 5139617 - DNA, 17 bp, Homo sapiens
accactgtccctaccac

SEQ ID NO: 5139618 - DNA, 22 bp, Homo sapiens
accactgtccctaccactgagc

SEQ ID NO: 5139619 - DNA, 23 bp, Homo sapiens
accactgtctccacccaccttga

SEQ ID NO: 5139620 - DNA, 14 bp, Homo sapiens
accactgtgaacat

SEQ ID NO: 5139621 - DNA, 15 bp, Homo sapiens
accactgtgaacatt

SEQ ID NO: 5139622 - DNA, 19 bp, Homo sapiens
accactgtgaacatttttt

SEQ ID NO: 5139623 - DNA, 22 bp, Homo sapiens
accactgtgctcaaccagacag

SEQ ID NO: 5139624 - DNA, 23 bp, Homo sapiens
accactgtgctcaaccagacaga

SEQ ID NO: 5139625 - DNA, 21 bp, Homo sapiens
accactgtggaagtccctcag

SEQ ID NO: 5139626 - DNA, 12 bp, Homo sapiens
accactgtggcg

SEQ ID NO: 5139627 - DNA, 15 bp, Homo sapiens
accactgtgtcccag

SEQ ID NO: 5139628 - DNA, 19 bp, Homo sapiens
accactgtgtcccagtgtc

SEQ ID NO: 5139629 - DNA, 14 bp, Homo sapiens
accactgttctgtt

SEQ ID NO: 5139630 - DNA, 22 bp, Homo sapiens
accacttaaaaaaaaatctaaa

SEQ ID NO: 5139631 - DNA, 18 bp, Homo sapiens
accacttaaaaaatgtcc

SEQ ID NO: 5139632 - DNA, 14 bp, Homo sapiens
accacttaatcttc

SEQ ID NO: 5139633 - DNA, 15 bp, Homo sapiens
accacttaatcttct

SEQ ID NO: 5139634 - DNA, 12 bp, Homo sapiens
accacttacagt

SEQ ID NO: 5139635 - DNA, 14 bp, Homo sapiens
accacttacttcgt

SEQ ID NO: 5139636 - DNA, 16 bp, Homo sapiens
accacttagatttaaa

SEQ ID NO: 5139637 - DNA, 18 bp, Homo sapiens
accacttagcctctttct

SEQ ID NO: 5139638 - DNA, 14 bp, Homo sapiens
accacttatttcta

SEQ ID NO: 5139639 - DNA, 16 bp, Homo sapiens
accacttatttctaaa

SEQ ID NO: 5139640 - DNA, 13 bp, Homo sapiens
accacttcactga

SEQ ID NO: 5139641 - DNA, 13 bp, Homo sapiens
accacttcattct

SEQ ID NO: 5139642 - DNA, 14 bp, Homo sapiens
accacttcattctg

SEQ ID NO: 5139643 - DNA, 17 bp, Homo sapiens
accacttccagagccag

SEQ ID NO: 5139644 - DNA, 20 bp, Homo sapiens
accacttccaggggaacctg

SEQ ID NO: 5139645 - DNA, 13 bp, Homo sapiens
accacttccctgc

SEQ ID NO: 5139646 - DNA, 14 bp, Homo sapiens
accacttcctgcta

SEQ ID NO: 5139647 - DNA, 19 bp, Homo sapiens
accacttcctgctacagga

SEQ ID NO: 5139648 - DNA, 16 bp, Homo sapiens
accacttcgcacacac

SEQ ID NO: 5139649 - DNA, 17 bp, Homo sapiens
accacttctccatgctg

SEQ ID NO: 5139650 - DNA, 12 bp, Homo sapiens
accacttctctg

SEQ ID NO: 5139651 - DNA, 22 bp, Homo sapiens
accacttctctgctgcctctgt

SEQ ID NO: 5139652 - DNA, 14 bp, Homo sapiens
accacttctgtggg

SEQ ID NO: 5139653 - DNA, 16 bp, Homo sapiens
accacttctgtgggca

SEQ ID NO: 5139654 - DNA, 17 bp, Homo sapiens
accacttcttttataac

SEQ ID NO: 5139655 - DNA, 13 bp, Homo sapiens
accacttgagcct

SEQ ID NO: 5139656 - DNA, 14 bp, Homo sapiens
accacttgagccta

SEQ ID NO: 5139657 - DNA, 13 bp, Homo sapiens
accacttgctgca

SEQ ID NO: 5139658 - DNA, 20 bp, Homo sapiens
accacttggaaataaaccat

SEQ ID NO: 5139659 - DNA, 22 bp, Homo sapiens
accacttggagatctttgcttc

SEQ ID NO: 5139660 - DNA, 13 bp, Homo sapiens
accacttggctgc

SEQ ID NO: 5139661 - DNA, 14 bp, Homo sapiens
accacttggctgct

SEQ ID NO: 5139662 - DNA, 19 bp, Homo sapiens
accacttgtgttttgcaag

SEQ ID NO: 5139663 - DNA, 17 bp, Homo sapiens
accactttattgcaatg

SEQ ID NO: 5139664 - DNA, 21 bp, Homo sapiens
accactttattgcaatgcaga

SEQ ID NO: 5139665 - DNA, 22 bp, Homo sapiens
accactttccttttctattcct

SEQ ID NO: 5139666 - DNA, 20 bp, Homo sapiens
accactttgatattgagaca

SEQ ID NO: 5139667 - DNA, 22 bp, Homo sapiens
accactttggagactggggtgg

SEQ ID NO: 5139668 - DNA, 16 bp, Homo sapiens
accacttttgttcttg

SEQ ID NO: 5139669 - DNA, 22 bp, Homo sapiens
accacttttgttcttggtttgt

SEQ ID NO: 5139670 - DNA, 12 bp, Homo sapiens
accactttttag

SEQ ID NO: 5139671 - DNA, 17 bp, Homo sapiens
accactttttgcagctt

SEQ ID NO: 5139672 - DNA, 20 bp, Homo sapiens
accactttttgcagctttct

SEQ ID NO: 5139673 - DNA, 13 bp, Homo sapiens
accagaaaagcaa

SEQ ID NO: 5139674 - DNA, 19 bp, Homo sapiens
accagaaaatatgatatat

SEQ ID NO: 5139675 - DNA, 16 bp, Homo sapiens
accagaaaatgagggc

SEQ ID NO: 5139676 - DNA, 15 bp, Homo sapiens
accagaaacacccct

SEQ ID NO: 5139677 - DNA, 21 bp, Homo sapiens
accagaaacacccctctgtct

SEQ ID NO: 5139678 - DNA, 22 bp, Homo sapiens
accagaaacctgggagagactt

SEQ ID NO: 5139679 - DNA, 15 bp, Homo sapiens
accagaaagaggaat

SEQ ID NO: 5139680 - DNA, 21 bp, Homo sapiens
accagaaagaggaataaaatg

SEQ ID NO: 5139681 - DNA, 23 bp, Homo sapiens
accagaaagcagttgagacaaga

SEQ ID NO: 5139682 - DNA, 15 bp, Homo sapiens
accagaaagtcctgg

SEQ ID NO: 5139683 - DNA, 15 bp, Homo sapiens
accagaaattccagt

SEQ ID NO: 5139684 - DNA, 14 bp, Homo sapiens
accagaaccaaacc

SEQ ID NO: 5139685 - DNA, 11 bp, Homo sapiens
accagaagaaa

SEQ ID NO: 5139686 - DNA, 12 bp, Homo sapiens
accagaagaaaa

SEQ ID NO: 5139687 - DNA, 13 bp, Homo sapiens
accagaagaaaag

SEQ ID NO: 5139688 - DNA, 13 bp, Homo sapiens
accagaagaacta

SEQ ID NO: 5139689 - DNA, 20 bp, Homo sapiens
accagaagacaaaggcccaa

SEQ ID NO: 5139690 - DNA, 18 bp, Homo sapiens
accagaagatgtgaaatt

SEQ ID NO: 5139691 - DNA, 17 bp, Homo sapiens
accagaagctcccccag

SEQ ID NO: 5139692 - DNA, 21 bp, Homo sapiens
accagaagctgttgggagaaa

SEQ ID NO: 5139693 - DNA, 13 bp, Homo sapiens
accagaaggaagc

SEQ ID NO: 5139694 - DNA, 14 bp, Homo sapiens
accagaaggaagcc

SEQ ID NO: 5139695 - DNA, 22 bp, Homo sapiens
accagaaggaagccctctcaga

SEQ ID NO: 5139696 - DNA, 14 bp, Homo sapiens
accagaagggcttc

SEQ ID NO: 5139697 - DNA, 15 bp, Homo sapiens
accagaagggcttca

SEQ ID NO: 5139698 - DNA, 20 bp, Homo sapiens
accagaagtgaatgggaaag

SEQ ID NO: 5139699 - DNA, 16 bp, Homo sapiens
accagaagtgtttcag

SEQ ID NO: 5139700 - DNA, 18 bp, Homo sapiens
accagaagtgtttcagat

SEQ ID NO: 5139701 - DNA, 13 bp, Homo sapiens
accagaagtttct

SEQ ID NO: 5139702 - DNA, 16 bp, Homo sapiens
accagaatcataattt

SEQ ID NO: 5139703 - DNA, 19 bp, Homo sapiens
accagaatcataattttca

SEQ ID NO: 5139704 - DNA, 16 bp, Homo sapiens
accagaattcccttga

SEQ ID NO: 5139705 - DNA, 14 bp, Homo sapiens
accagaattgtcct

SEQ ID NO: 5139706 - DNA, 21 bp, Homo sapiens
accagaattgtgcaaatggaa

SEQ ID NO: 5139707 - DNA, 23 bp, Homo sapiens
accagacaaggaaatacccttct

SEQ ID NO: 5139708 - DNA, 14 bp, Homo sapiens
accagacaatgttg

SEQ ID NO: 5139709 - DNA, 14 bp, Homo sapiens
accagacaccttga

SEQ ID NO: 5139710 - DNA, 15 bp, Homo sapiens
accagacagaggcag

SEQ ID NO: 5139711 - DNA, 13 bp, Homo sapiens
accagacagaggg

SEQ ID NO: 5139712 - DNA, 16 bp, Homo sapiens
accagacagagggtca

SEQ ID NO: 5139713 - DNA, 22 bp, Homo sapiens
accagacagagggtcacagtgt

SEQ ID NO: 5139714 - DNA, 18 bp, Homo sapiens
accagacccacctggagc

SEQ ID NO: 5139715 - DNA, 21 bp, Homo sapiens
accagacccacctggagcccg

SEQ ID NO: 5139716 - DNA, 18 bp, Homo sapiens
accagacctagacctggg

SEQ ID NO: 5139717 - DNA, 19 bp, Homo sapiens
accagacctagacctgggc

SEQ ID NO: 5139718 - DNA, 21 bp, Homo sapiens
accagacctagacctgggcca

SEQ ID NO: 5139719 - DNA, 14 bp, Homo sapiens
accagacctcttct

SEQ ID NO: 5139720 - DNA, 20 bp, Homo sapiens
accagacggttcaccagcct

SEQ ID NO: 5139721 - DNA, 23 bp, Homo sapiens
accagacgtcaggccctgactcc

SEQ ID NO: 5139722 - DNA, 21 bp, Homo sapiens
accagactacttgggagcacc

SEQ ID NO: 5139723 - DNA, 15 bp, Homo sapiens
accagactcttgcct

SEQ ID NO: 5139724 - DNA, 21 bp, Homo sapiens
accagactgtggagaaataaa

SEQ ID NO: 5139725 - DNA, 18 bp, Homo sapiens
accagactgtgggtccct

SEQ ID NO: 5139726 - DNA, 16 bp, Homo sapiens
accagacttggcctcc

SEQ ID NO: 5139727 - DNA, 16 bp, Homo sapiens
accagactttgagcct

SEQ ID NO: 5139728 - DNA, 20 bp, Homo sapiens
accagagaaaaagggagggg

SEQ ID NO: 5139729 - DNA, 18 bp, Homo sapiens
accagagaccgtcctcac

SEQ ID NO: 5139730 - DNA, 15 bp, Homo sapiens
accagagacgcccag

SEQ ID NO: 5139731 - DNA, 23 bp, Homo sapiens
accagagacgcccagccccatcc

SEQ ID NO: 5139732 - DNA, 20 bp, Homo sapiens
accagagataatatgagaat

SEQ ID NO: 5139733 - DNA, 23 bp, Homo sapiens
accagagcaaaaatgtaaaaaac

SEQ ID NO: 5139734 - DNA, 14 bp, Homo sapiens
accagagcactgta

SEQ ID NO: 5139735 - DNA, 21 bp, Homo sapiens
accagagcagagaagggcagg

SEQ ID NO: 5139736 - DNA, 16 bp, Homo sapiens
accagagcaggggctg

SEQ ID NO: 5139737 - DNA, 23 bp, Homo sapiens
accagagcaggggctgctggggg

SEQ ID NO: 5139738 - DNA, 14 bp, Homo sapiens
accagagccatgga

SEQ ID NO: 5139739 - DNA, 17 bp, Homo sapiens
accagagccatggactc

SEQ ID NO: 5139740 - DNA, 11 bp, Homo sapiens
accagagcccc

SEQ ID NO: 5139741 - DNA, 15 bp, Homo sapiens
accagagccccccac

SEQ ID NO: 5139742 - DNA, 16 bp, Homo sapiens
accagagccccccaca

SEQ ID NO: 5139743 - DNA, 17 bp, Homo sapiens
accagagcctccctcag

SEQ ID NO: 5139744 - DNA, 17 bp, Homo sapiens
accagagccttcaagtg

SEQ ID NO: 5139745 - DNA, 18 bp, Homo sapiens
accagagccttcaagtgc

SEQ ID NO: 5139746 - DNA, 21 bp, Homo sapiens
accagagcggtatctctggca

SEQ ID NO: 5139747 - DNA, 13 bp, Homo sapiens
accagagctagtt

SEQ ID NO: 5139748 - DNA, 19 bp, Homo sapiens
accagagctctatccccat

SEQ ID NO: 5139749 - DNA, 15 bp, Homo sapiens
accagagctgcctcc

SEQ ID NO: 5139750 - DNA, 16 bp, Homo sapiens
accagagctgcctccc

SEQ ID NO: 5139751 - DNA, 18 bp, Homo sapiens
accagagctggaacacaa

SEQ ID NO: 5139752 - DNA, 22 bp, Homo sapiens
accagagcttctctgggctgaa

SEQ ID NO: 5139753 - DNA, 23 bp, Homo sapiens
accagagcttctctgggctgaat

SEQ ID NO: 5139754 - DNA, 15 bp, Homo sapiens
accagaggaagttat

SEQ ID NO: 5139755 - DNA, 18 bp, Homo sapiens
accagaggaatcactctt

SEQ ID NO: 5139756 - DNA, 23 bp, Homo sapiens
accagaggccgaaggtgcctcag

SEQ ID NO: 5139757 - DNA, 15 bp, Homo sapiens
accagaggtggcagg

SEQ ID NO: 5139758 - DNA, 16 bp, Homo sapiens
accagagtcagcacag

SEQ ID NO: 5139759 - DNA, 13 bp, Homo sapiens
accagagtctgga

SEQ ID NO: 5139760 - DNA, 16 bp, Homo sapiens
accagagtctggagct

SEQ ID NO: 5139761 - DNA, 17 bp, Homo sapiens
accagataaatagaact

SEQ ID NO: 5139762 - DNA, 19 bp, Homo sapiens
accagataaatagaactat

SEQ ID NO: 5139763 - DNA, 14 bp, Homo sapiens
accagataactttt

SEQ ID NO: 5139764 - DNA, 20 bp, Homo sapiens
accagataagaatgctggtt

SEQ ID NO: 5139765 - DNA, 20 bp, Homo sapiens
accagatagttatattaaat

SEQ ID NO: 5139766 - DNA, 21 bp, Homo sapiens
accagatagttatattaaatt

SEQ ID NO: 5139767 - DNA, 14 bp, Homo sapiens
accagatattttgt

SEQ ID NO: 5139768 - DNA, 20 bp, Homo sapiens
accagatcaggagagcaagg

SEQ ID NO: 5139769 - DNA, 20 bp, Homo sapiens
accagatccttttccatccc

SEQ ID NO: 5139770 - DNA, 20 bp, Homo sapiens
accagatgaaataatgttct

SEQ ID NO: 5139771 - DNA, 21 bp, Homo sapiens
accagatgacacataaatctg

SEQ ID NO: 5139772 - DNA, 13 bp, Homo sapiens
accagatgagaat

SEQ ID NO: 5139773 - DNA, 18 bp, Homo sapiens
accagatgatgggggagg

SEQ ID NO: 5139774 - DNA, 14 bp, Homo sapiens
accagatgcagctc

SEQ ID NO: 5139775 - DNA, 14 bp, Homo sapiens
accagatgctactg

SEQ ID NO: 5139776 - DNA, 11 bp, Homo sapiens
accagatgctg

SEQ ID NO: 5139777 - DNA, 12 bp, Homo sapiens
accagatgctga

SEQ ID NO: 5139778 - DNA, 21 bp, Homo sapiens
accagatgcttttgtgagaaa

SEQ ID NO: 5139779 - DNA, 23 bp, Homo sapiens
accagatggttgtgtatgggtag

SEQ ID NO: 5139780 - DNA, 15 bp, Homo sapiens
accagatgtccgtct

SEQ ID NO: 5139781 - DNA, 22 bp, Homo sapiens
accagatgtccgtctctcttgc

SEQ ID NO: 5139782 - DNA, 21 bp, Homo sapiens
accagatgtgcttttatttag

SEQ ID NO: 5139783 - DNA, 19 bp, Homo sapiens
accagattcacttctgaat

SEQ ID NO: 5139784 - DNA, 15 bp, Homo sapiens
accagatttatttta

SEQ ID NO: 5139785 - DNA, 16 bp, Homo sapiens
accagcaacttgaact

SEQ ID NO: 5139786 - DNA, 15 bp, Homo sapiens
acatgtggtgggaca

SEQ ID NO: 5139787 - DNA, 21 bp, Homo sapiens
acatgtggttactagtacagg

SEQ ID NO: 5139788 - DNA, 24 bp, Homo sapiens
acatgtgtaagacactgtgcaaat

SEQ ID NO: 5139789 - DNA, 11 bp, Homo sapiens
acatgtgtaca

SEQ ID NO: 5139790 - DNA, 14 bp, Homo sapiens
acatgtgtacatat

SEQ ID NO: 5139791 - DNA, 20 bp, Homo sapiens
acatgtgtagcctatgttgt

SEQ ID NO: 5139792 - DNA, 18 bp, Homo sapiens
acatgtgtagcctgtgca

SEQ ID NO: 5139793 - DNA, 20 bp, Homo sapiens
acatgtgtatattcctttta

SEQ ID NO: 5139794 - DNA, 20 bp, Homo sapiens
acatgtgtatgatactaaag

SEQ ID NO: 5139795 - DNA, 22 bp, Homo sapiens
acatgtgtatttatacccccag

SEQ ID NO: 5139796 - DNA, 16 bp, Homo sapiens
acatgtgtctgtgtgg

SEQ ID NO: 5139797 - DNA, 18 bp, Homo sapiens
acatgtgtgaaaacaata

SEQ ID NO: 5139798 - DNA, 15 bp, Homo sapiens
acatgtgtgcagagc

SEQ ID NO: 5139799 - DNA, 17 bp, Homo sapiens
acatgtgtgcagagcag

SEQ ID NO: 5139800 - DNA, 21 bp, Homo sapiens
acatgtgtgcagagcagacag

SEQ ID NO: 5139801 - DNA, 17 bp, Homo sapiens
acatgtgtgggtgctga

SEQ ID NO: 5139802 - DNA, 22 bp, Homo sapiens
acatgtgtgtatatatgtgtat

SEQ ID NO: 5139803 - DNA, 22 bp, Homo sapiens
acatgtgtgtatatgtagatgt

SEQ ID NO: 5139804 - DNA, 18 bp, Homo sapiens
acatgtgtttattcatcc

SEQ ID NO: 5139805 - DNA, 20 bp, Homo sapiens
acatgtgtttattcatccag

SEQ ID NO: 5139806 - DNA, 23 bp, Homo sapiens
acatgtgttttcatcatttcagc

SEQ ID NO: 5139807 - DNA, 17 bp, Homo sapiens
acatgttacgtgtgcaa

SEQ ID NO: 5139808 - DNA, 16 bp, Homo sapiens
acatgttactgaccag

SEQ ID NO: 5139809 - DNA, 19 bp, Homo sapiens
acatgttactggataaatt

SEQ ID NO: 5139810 - DNA, 15 bp, Homo sapiens
acatgttattcaatg

SEQ ID NO: 5139811 - DNA, 16 bp, Homo sapiens
acatgttattcaatgt

SEQ ID NO: 5139812 - DNA, 22 bp, Homo sapiens
acatgttctaatactttgttta

SEQ ID NO: 5139813 - DNA, 12 bp, Homo sapiens
acatgttctcca

SEQ ID NO: 5139814 - DNA, 15 bp, Homo sapiens
acatgttcttgtcat

SEQ ID NO: 5139815 - DNA, 13 bp, Homo sapiens
acatgttctttgt

SEQ ID NO: 5139816 - DNA, 15 bp, Homo sapiens
acatgttctttgtac

SEQ ID NO: 5139817 - DNA, 16 bp, Homo sapiens
acatgttctttgtacc

SEQ ID NO: 5139818 - DNA, 13 bp, Homo sapiens
acatgttgccttg

SEQ ID NO: 5139819 - DNA, 19 bp, Homo sapiens
acatgttggaaatgtgttt

SEQ ID NO: 5139820 - DNA, 22 bp, Homo sapiens
acatgttggaggagagagcctt

SEQ ID NO: 5139821 - DNA, 20 bp, Homo sapiens
acatgttgggaaacttggct

SEQ ID NO: 5139822 - DNA, 20 bp, Homo sapiens
acatgttgggcatgattcta

SEQ ID NO: 5139823 - DNA, 15 bp, Homo sapiens
acatgttggtattta

SEQ ID NO: 5139824 - DNA, 14 bp, Homo sapiens
acatgttgtaaatt

SEQ ID NO: 5139825 - DNA, 20 bp, Homo sapiens
acatgttgtaagcactgact

SEQ ID NO: 5139826 - DNA, 16 bp, Homo sapiens
acatgtttaactttaa

SEQ ID NO: 5139827 - DNA, 15 bp, Homo sapiens
acatgtttacaggtt

SEQ ID NO: 5139828 - DNA, 18 bp, Homo sapiens
acatgtttagagttgcaa

SEQ ID NO: 5139829 - DNA, 23 bp, Homo sapiens
acatgtttatgtaaacaaatctt

SEQ ID NO: 5139830 - DNA, 22 bp, Homo sapiens
acatgtttcacaacaggcattc

SEQ ID NO: 5139831 - DNA, 22 bp, Homo sapiens
acatgtttctgttttgttgttt

SEQ ID NO: 5139832 - DNA, 21 bp, Homo sapiens
acatgtttgcacctttctagt

SEQ ID NO: 5139833 - DNA, 16 bp, Homo sapiens
acatgttttaaagaaa

SEQ ID NO: 5139834 - DNA, 14 bp, Homo sapiens
acatgttttacaaa

SEQ ID NO: 5139835 - DNA, 20 bp, Homo sapiens
acatgttttacaaagaaaca

SEQ ID NO: 5139836 - DNA, 23 bp, Homo sapiens
acatgttttagacaaatactcat

SEQ ID NO: 5139837 - DNA, 12 bp, Homo sapiens
acatgttttcaa

SEQ ID NO: 5139838 - DNA, 15 bp, Homo sapiens
acatgttttcaaatg

SEQ ID NO: 5139839 - DNA, 15 bp, Homo sapiens
acatgttttgataaa

SEQ ID NO: 5139840 - DNA, 18 bp, Homo sapiens
acatgttttgataaagta

SEQ ID NO: 5139841 - DNA, 20 bp, Homo sapiens
acatgttttgataaagtagt

SEQ ID NO: 5139842 - DNA, 21 bp, Homo sapiens
acatgttttgataaagtagta

SEQ ID NO: 5139843 - DNA, 22 bp, Homo sapiens
acatgttttgataaagtagtaa

SEQ ID NO: 5139844 - DNA, 23 bp, Homo sapiens
acatgttttgataaagtagtaaa

SEQ ID NO: 5139845 - DNA, 21 bp, Homo sapiens
acatgtttttcttctccctca

SEQ ID NO: 5139846 - DNA, 23 bp, Homo sapiens
acatgtttttgttttctttgaat

SEQ ID NO: 5139847 - DNA, 14 bp, Homo sapiens
acatgttttttcat

SEQ ID NO: 5139848 - DNA, 17 bp, Homo sapiens
acatgttttttcatttg

SEQ ID NO: 5139849 - DNA, 15 bp, Homo sapiens
acattaaaaaatgaa

SEQ ID NO: 5139850 - DNA, 22 bp, Homo sapiens
acattaaaaatgaccactcttt

SEQ ID NO: 5139851 - DNA, 14 bp, Homo sapiens
acattaaaaatgga

SEQ ID NO: 5139852 - DNA, 18 bp, Homo sapiens
acattaaaactcataatt

SEQ ID NO: 5139853 - DNA, 19 bp, Homo sapiens
acattaaaagaagactgga

SEQ ID NO: 5139854 - DNA, 20 bp, Homo sapiens
acattaaaagaagactggaa

SEQ ID NO: 5139855 - DNA, 21 bp, Homo sapiens
acattaaaagaagactggaag

SEQ ID NO: 5139856 - DNA, 18 bp, Homo sapiens
acattaaaagacaaatat

SEQ ID NO: 5139857 - DNA, 17 bp, Homo sapiens
acattaaaataaaccaa

SEQ ID NO: 5139858 - DNA, 11 bp, Homo sapiens
acattaaaatg

SEQ ID NO: 5139859 - DNA, 15 bp, Homo sapiens
acattaaaatgacaa

SEQ ID NO: 5139860 - DNA, 20 bp, Homo sapiens
acattaaaatgacaaacatg

SEQ ID NO: 5139861 - DNA, 18 bp, Homo sapiens
acattaaacactgtaatc

SEQ ID NO: 5139862 - DNA, 21 bp, Homo sapiens
acattaaagcaatctgttgaa

SEQ ID NO: 5139863 - DNA, 13 bp, Homo sapiens
acattaaagcagt

SEQ ID NO: 5139864 - DNA, 14 bp, Homo sapiens
acattaaagcagtc

SEQ ID NO: 5139865 - DNA, 19 bp, Homo sapiens
acattaaagccctgtgtta

SEQ ID NO: 5139866 - DNA, 19 bp, Homo sapiens
acattaaagtaaagtacaa

SEQ ID NO: 5139867 - DNA, 11 bp, Homo sapiens
acattaaatga

SEQ ID NO: 5139868 - DNA, 12 bp, Homo sapiens
acattaaatgtc

SEQ ID NO: 5139869 - DNA, 13 bp, Homo sapiens
acattaaatgtct

SEQ ID NO: 5139870 - DNA, 21 bp, Homo sapiens
acattaaattgataacatgga

SEQ ID NO: 5139871 - DNA, 15 bp, Homo sapiens
acattaacaaataaa

SEQ ID NO: 5139872 - DNA, 12 bp, Homo sapiens
acattaacagtt

SEQ ID NO: 5139873 - DNA, 16 bp, Homo sapiens
acattaacagttttcc

SEQ ID NO: 5139874 - DNA, 13 bp, Homo sapiens
acattaacatcta

SEQ ID NO: 5139875 - DNA, 17 bp, Homo sapiens
acattaacattttgagc

SEQ ID NO: 5139876 - DNA, 20 bp, Homo sapiens
acattaacccccaaattcaa

SEQ ID NO: 5139877 - DNA, 21 bp, Homo sapiens
acattaacccccaaattcaaa

SEQ ID NO: 5139878 - DNA, 14 bp, Homo sapiens
acattaacggtgct

SEQ ID NO: 5139879 - DNA, 17 bp, Homo sapiens
acattaacggtgctaaa

SEQ ID NO: 5139880 - DNA, 18 bp, Homo sapiens
acattaacggtgctaaaa

SEQ ID NO: 5139881 - DNA, 14 bp, Homo sapiens
acattaactcatta

SEQ ID NO: 5139882 - DNA, 15 bp, Homo sapiens
acattaactctaact

SEQ ID NO: 5139883 - DNA, 11 bp, Homo sapiens
acattaactgt

SEQ ID NO: 5139884 - DNA, 12 bp, Homo sapiens
acattaactgtt

SEQ ID NO: 5139885 - DNA, 13 bp, Homo sapiens
acattaactgttg

SEQ ID NO: 5139886 - DNA, 19 bp, Homo sapiens
acattaactgttgcacttt

SEQ ID NO: 5139887 - DNA, 17 bp, Homo sapiens
acattaagaaaatcata

SEQ ID NO: 5139888 - DNA, 13 bp, Homo sapiens
acattaagaatgt

SEQ ID NO: 5139889 - DNA, 19 bp, Homo sapiens
acattaagaatgttggttt

SEQ ID NO: 5139890 - DNA, 16 bp, Homo sapiens
acattaagtaaatgct

SEQ ID NO: 5139891 - DNA, 23 bp, Homo sapiens
acattaagtattccttggcccag

SEQ ID NO: 5139892 - DNA, 15 bp, Homo sapiens
acattaagtggcttt

SEQ ID NO: 5139893 - DNA, 19 bp, Homo sapiens
acattaatagcagcctttc

SEQ ID NO: 5139894 - DNA, 18 bp, Homo sapiens
acattaatatacttgaat

SEQ ID NO: 5139895 - DNA, 20 bp, Homo sapiens
acattaatatttaccaaagt

SEQ ID NO: 5139896 - DNA, 13 bp, Homo sapiens
acattaatgagaa

SEQ ID NO: 5139897 - DNA, 21 bp, Homo sapiens
acattaatgagaagagttttc

SEQ ID NO: 5139898 - DNA, 17 bp, Homo sapiens
acattaatgataaactc

SEQ ID NO: 5139899 - DNA, 18 bp, Homo sapiens
acattaatgcccagccag

SEQ ID NO: 5139900 - DNA, 20 bp, Homo sapiens
acattaatggtctaaaaata

SEQ ID NO: 5139901 - DNA, 22 bp, Homo sapiens
acattaatgttgaaaaagaaaa

SEQ ID NO: 5139902 - DNA, 14 bp, Homo sapiens
acattaatgttgat

SEQ ID NO: 5139903 - DNA, 21 bp, Homo sapiens
acattaatgttgatttctagt

SEQ ID NO: 5139904 - DNA, 22 bp, Homo sapiens
acattaatgttgatttctagtt

SEQ ID NO: 5139905 - DNA, 14 bp, Homo sapiens
acattaattaatta

SEQ ID NO: 5139906 - DNA, 20 bp, Homo sapiens
acattaattaattaaagccc

SEQ ID NO: 5139907 - DNA, 17 bp, Homo sapiens
acattaatttaattact

SEQ ID NO: 5139908 - DNA, 19 bp, Homo sapiens
acattaatttatgcagaga

SEQ ID NO: 5139909 - DNA, 16 bp, Homo sapiens
acattaattttgtgca

SEQ ID NO: 5139910 - DNA, 22 bp, Homo sapiens
acattacaaagttaaaattgtt

SEQ ID NO: 5139911 - DNA, 17 bp, Homo sapiens
acattacactaaattat

SEQ ID NO: 5139912 - DNA, 15 bp, Homo sapiens
acattacagaccatg

SEQ ID NO: 5139913 - DNA, 18 bp, Homo sapiens
acattacagattaaagaa

SEQ ID NO: 5139914 - DNA, 13 bp, Homo sapiens
acattacagttca

SEQ ID NO: 5139915 - DNA, 13 bp, Homo sapiens
acattacatgtaa

SEQ ID NO: 5139916 - DNA, 15 bp, Homo sapiens
acattacattaacat

SEQ ID NO: 5139917 - DNA, 16 bp, Homo sapiens
acattaccatataatg

SEQ ID NO: 5139918 - DNA, 22 bp, Homo sapiens
acattaccattcatagtaagaa

SEQ ID NO: 5139919 - DNA, 15 bp, Homo sapiens
acattaccttactgt

SEQ ID NO: 5139920 - DNA, 16 bp, Homo sapiens
acattaccttactgtg

SEQ ID NO: 5139921 - DNA, 17 bp, Homo sapiens
acattacggtacagaca

SEQ ID NO: 5139922 - DNA, 15 bp, Homo sapiens
acattactgaaaact

SEQ ID NO: 5139923 - DNA, 17 bp, Homo sapiens
acattactgaaaacttc

SEQ ID NO: 5139924 - DNA, 16 bp, Homo sapiens
acattactgccttcag

SEQ ID NO: 5139925 - DNA, 15 bp, Homo sapiens
acattactgtatgta

SEQ ID NO: 5139926 - DNA, 22 bp, Homo sapiens
acattactgtatgtataaatta

SEQ ID NO: 5139927 - DNA, 16 bp, Homo sapiens
acattacttatttaac

SEQ ID NO: 5139928 - DNA, 15 bp, Homo sapiens
acattacttgcacaa

SEQ ID NO: 5139929 - DNA, 19 bp, Homo sapiens
acattacttgcacaagctt

SEQ ID NO: 5139930 - DNA, 18 bp, Homo sapiens
acattagaacactgcatt

SEQ ID NO: 5139931 - DNA, 12 bp, Homo sapiens
acattagaactt

SEQ ID NO: 5139932 - DNA, 20 bp, Homo sapiens
acattagaagaaaacatata

SEQ ID NO: 5139933 - DNA, 13 bp, Homo sapiens
acattagaatatt

SEQ ID NO: 5139934 - DNA, 17 bp, Homo sapiens
acattagacacacatat

SEQ ID NO: 5139935 - DNA, 21 bp, Homo sapiens
acattagagaaaaccttaaaa

SEQ ID NO: 5139936 - DNA, 22 bp, Homo sapiens
acattagatgttactgtgtgaa

SEQ ID NO: 5139937 - DNA, 19 bp, Homo sapiens
acattagattttattttac

SEQ ID NO: 5139938 - DNA, 18 bp, Homo sapiens
acattagcagtttgcttt

SEQ ID NO: 5139939 - DNA, 18 bp, Homo sapiens
acattaggaacagagtat

SEQ ID NO: 5139940 - DNA, 19 bp, Homo sapiens
acattaggaacagagtata

SEQ ID NO: 5139941 - DNA, 20 bp, Homo sapiens
acattaggaagctgaattat

SEQ ID NO: 5139942 - DNA, 20 bp, Homo sapiens
acattaggaattgtttatac

SEQ ID NO: 5139943 - DNA, 14 bp, Homo sapiens
acattaggccccag

SEQ ID NO: 5139944 - DNA, 19 bp, Homo sapiens
acattaggccccagcaaca

SEQ ID NO: 5139945 - DNA, 19 bp, Homo sapiens
acattaggctgtgtcacca

SEQ ID NO: 5139946 - DNA, 13 bp, Homo sapiens
acattaggctgtt

SEQ ID NO: 5139947 - DNA, 20 bp, Homo sapiens
acattaggggaaccattgtt

SEQ ID NO: 5139948 - DNA, 16 bp, Homo sapiens
acattaggttgtgaat

SEQ ID NO: 5139949 - DNA, 14 bp, Homo sapiens
acattagtaaatgt

SEQ ID NO: 5139950 - DNA, 15 bp, Homo sapiens
acattagtaaatgtc

SEQ ID NO: 5139951 - DNA, 20 bp, Homo sapiens
acattagtaaatgtctttgt

SEQ ID NO: 5139952 - DNA, 18 bp, Homo sapiens
acattagtactttataga

SEQ ID NO: 5139953 - DNA, 22 bp, Homo sapiens
acattagtcgttatatttgact

SEQ ID NO: 5139954 - DNA, 14 bp, Homo sapiens
acattagtctcagt

SEQ ID NO: 5139955 - DNA, 15 bp, Homo sapiens
acattagttttaatc

SEQ ID NO: 5139956 - DNA, 22 bp, Homo sapiens
acattataaaccttcagaagct

SEQ ID NO: 5139957 - DNA, 15 bp, Homo sapiens
acattataaacgctt

SEQ ID NO: 5139958 - DNA, 15 bp, Homo sapiens
acattataaatgaca

SEQ ID NO: 5139959 - DNA, 18 bp, Homo sapiens
acattataacaactattt

SEQ ID NO: 5139960 - DNA, 14 bp, Homo sapiens
acattataagtact

SEQ ID NO: 5139961 - DNA, 14 bp, Homo sapiens
acattatagaaatt

SEQ ID NO: 5139962 - DNA, 15 bp, Homo sapiens
acattatagaaatta

SEQ ID NO: 5139963 - DNA, 17 bp, Homo sapiens
acattatataacaaaaa

SEQ ID NO: 5139964 - DNA, 22 bp, Homo sapiens
acattatataacaaaaaaggtt

SEQ ID NO: 5139965 - DNA, 23 bp, Homo sapiens
accagcaacttgtctttttctgg

SEQ ID NO: 5139966 - DNA, 18 bp, Homo sapiens
accagcaacttttctcat

SEQ ID NO: 5139967 - DNA, 17 bp, Homo sapiens
accagcaagtcccagac

SEQ ID NO: 5139968 - DNA, 13 bp, Homo sapiens
accagcaatgccc

SEQ ID NO: 5139969 - DNA, 18 bp, Homo sapiens
accagcaatgccctgcct

SEQ ID NO: 5139970 - DNA, 17 bp, Homo sapiens
accagcaattctctttc

SEQ ID NO: 5139971 - DNA, 18 bp, Homo sapiens
accagcacactcccgaga

SEQ ID NO: 5139972 - DNA, 13 bp, Homo sapiens
accagcacatcca

SEQ ID NO: 5139973 - DNA, 16 bp, Homo sapiens
accagcacatttctcc

SEQ ID NO: 5139974 - DNA, 13 bp, Homo sapiens
accagcactcagc

SEQ ID NO: 5139975 - DNA, 16 bp, Homo sapiens
accagcactcccaggg

SEQ ID NO: 5139976 - DNA, 18 bp, Homo sapiens
accagcactcccagggcc

SEQ ID NO: 5139977 - DNA, 13 bp, Homo sapiens
accagcagaaaag

SEQ ID NO: 5139978 - DNA, 22 bp, Homo sapiens
accagcagaaaagtgcttagaa

SEQ ID NO: 5139979 - DNA, 23 bp, Homo sapiens
accagcagaaaagtgcttagaaa

SEQ ID NO: 5139980 - DNA, 20 bp, Homo sapiens
accagcagacagagccagga

SEQ ID NO: 5139981 - DNA, 21 bp, Homo sapiens
accagcagatcccagctcacg

SEQ ID NO: 5139982 - DNA, 13 bp, Homo sapiens
accagcagcactg

SEQ ID NO: 5139983 - DNA, 17 bp, Homo sapiens
accagcagcgcctttcc

SEQ ID NO: 5139984 - DNA, 22 bp, Homo sapiens
accagcaggaggttctgggcct

SEQ ID NO: 5139985 - DNA, 10 bp, Homo sapiens
accagcaggc

SEQ ID NO: 5139986 - DNA, 11 bp, Homo sapiens
accagcaggca

SEQ ID NO: 5139987 - DNA, 12 bp, Homo sapiens
accagcaggcac

SEQ ID NO: 5139988 - DNA, 12 bp, Homo sapiens
accagcagggag

SEQ ID NO: 5139989 - DNA, 13 bp, Homo sapiens
accagcaggtgtg

SEQ ID NO: 5139990 - DNA, 16 bp, Homo sapiens
accagcagtcacaggt

SEQ ID NO: 5139991 - DNA, 15 bp, Homo sapiens
accagcagtgtttaa

SEQ ID NO: 5139992 - DNA, 16 bp, Homo sapiens
accagcatagttctgc

SEQ ID NO: 5139993 - DNA, 17 bp, Homo sapiens
accagcatctggtcttg

SEQ ID NO: 5139994 - DNA, 20 bp, Homo sapiens
accagcatgtcactcccaga

SEQ ID NO: 5139995 - DNA, 13 bp, Homo sapiens
accagcattcatg

SEQ ID NO: 5139996 - DNA, 17 bp, Homo sapiens
accagcatttgtccttt

SEQ ID NO: 5139997 - DNA, 18 bp, Homo sapiens
accagccacacagagcct

SEQ ID NO: 5139998 - DNA, 10 bp, Homo sapiens
accagccact

SEQ ID NO: 5139999 - DNA, 18 bp, Homo sapiens
accagccagccctggccc

SEQ ID NO: 5140000 - DNA, 11 bp, Homo sapiens
accagccagcg

SEQ ID NO: 5140001 - DNA, 17 bp, Homo sapiens
accagccaggctctgtg

SEQ ID NO: 5140002 - DNA, 20 bp, Homo sapiens
accagccaggctctgtgctg

SEQ ID NO: 5140003 - DNA, 17 bp, Homo sapiens
accagccatcctccctc

SEQ ID NO: 5140004 - DNA, 14 bp, Homo sapiens
accagcccagatgt

SEQ ID NO: 5140005 - DNA, 16 bp, Homo sapiens
accagcccagcctgcc

SEQ ID NO: 5140006 - DNA, 17 bp, Homo sapiens
accagcccagcctgccc

SEQ ID NO: 5140007 - DNA, 19 bp, Homo sapiens
accagcccatcgccacaaa

SEQ ID NO: 5140008 - DNA, 18 bp, Homo sapiens
accagcccattggccgag

SEQ ID NO: 5140009 - DNA, 17 bp, Homo sapiens
accagccccactgccag

SEQ ID NO: 5140010 - DNA, 16 bp, Homo sapiens
accagccccacttctg

SEQ ID NO: 5140011 - DNA, 20 bp, Homo sapiens
accagccccacttctgggtc

SEQ ID NO: 5140012 - DNA, 20 bp, Homo sapiens
accagccccagtgcccacag

SEQ ID NO: 5140013 - DNA, 14 bp, Homo sapiens
accagcccccagga

SEQ ID NO: 5140014 - DNA, 22 bp, Homo sapiens
accagccccccaccccacagat

SEQ ID NO: 5140015 - DNA, 19 bp, Homo sapiens
accagcccccgccccagag

SEQ ID NO: 5140016 - DNA, 16 bp, Homo sapiens
accagcccctccccag

SEQ ID NO: 5140017 - DNA, 21 bp, Homo sapiens
accagcccctccccagactct

SEQ ID NO: 5140018 - DNA, 23 bp, Homo sapiens
accagcccctccccagactctca

SEQ ID NO: 5140019 - DNA, 11 bp, Homo sapiens
accagcccctg

SEQ ID NO: 5140020 - DNA, 17 bp, Homo sapiens
accagccccttcctggg

SEQ ID NO: 5140021 - DNA, 17 bp, Homo sapiens
accagcccgaacaccat

SEQ ID NO: 5140022 - DNA, 21 bp, Homo sapiens
accagcccgacagtgccatcc

SEQ ID NO: 5140023 - DNA, 20 bp, Homo sapiens
accagcccgaccaacatgga

SEQ ID NO: 5140024 - DNA, 21 bp, Homo sapiens
accagcccgcaactctccagc

SEQ ID NO: 5140025 - DNA, 13 bp, Homo sapiens
accagccctactc

SEQ ID NO: 5140026 - DNA, 17 bp, Homo sapiens
accagccctactcctgc

SEQ ID NO: 5140027 - DNA, 17 bp, Homo sapiens
accagccctccagagca

SEQ ID NO: 5140028 - DNA, 14 bp, Homo sapiens
accagccctgagcc

SEQ ID NO: 5140029 - DNA, 15 bp, Homo sapiens
accagccctgctgct

SEQ ID NO: 5140030 - DNA, 20 bp, Homo sapiens
accagccctgctgcttccta

SEQ ID NO: 5140031 - DNA, 22 bp, Homo sapiens
accagccctgctgcttcctaac

SEQ ID NO: 5140032 - DNA, 12 bp, Homo sapiens
accagccctggg

SEQ ID NO: 5140033 - DNA, 17 bp, Homo sapiens
accagccctggggctgg

SEQ ID NO: 5140034 - DNA, 14 bp, Homo sapiens
accagccctggtgg

SEQ ID NO: 5140035 - DNA, 17 bp, Homo sapiens
accagcccttccctgct

SEQ ID NO: 5140036 - DNA, 18 bp, Homo sapiens
accagcccttgagggaga

SEQ ID NO: 5140037 - DNA, 14 bp, Homo sapiens
accagccgtgagca

SEQ ID NO: 5140038 - DNA, 14 bp, Homo sapiens
accagcctagcctg

SEQ ID NO: 5140039 - DNA, 14 bp, Homo sapiens
accagcctcaccag

SEQ ID NO: 5140040 - DNA, 19 bp, Homo sapiens
accagcctcagtgcagccc

SEQ ID NO: 5140041 - DNA, 14 bp, Homo sapiens
accagcctccatgc

SEQ ID NO: 5140042 - DNA, 21 bp, Homo sapiens
accagcctcctgtttgcaggc

SEQ ID NO: 5140043 - DNA, 19 bp, Homo sapiens
accagcctcgtcttcatta

SEQ ID NO: 5140044 - DNA, 14 bp, Homo sapiens
accagcctgaccaa

SEQ ID NO: 5140045 - DNA, 15 bp, Homo sapiens
accagcctgaccaaa

SEQ ID NO: 5140046 - DNA, 20 bp, Homo sapiens
accagcctgaccaacatggt

SEQ ID NO: 5140047 - DNA, 15 bp, Homo sapiens
accagcctgagccac

SEQ ID NO: 5140048 - DNA, 13 bp, Homo sapiens
accagcctgccag

SEQ ID NO: 5140049 - DNA, 16 bp, Homo sapiens
accagcctgccaggcc

SEQ ID NO: 5140050 - DNA, 18 bp, Homo sapiens
accagcctgccaggccct

SEQ ID NO: 5140051 - DNA, 22 bp, Homo sapiens
accagcctgccaggccctccag

SEQ ID NO: 5140052 - DNA, 22 bp, Homo sapiens
accagcctgctgacagacacta

SEQ ID NO: 5140053 - DNA, 11 bp, Homo sapiens
accagcctggc

SEQ ID NO: 5140054 - DNA, 14 bp, Homo sapiens
accagcctggccaa

SEQ ID NO: 5140055 - DNA, 20 bp, Homo sapiens
accagcctggccaacatggt

SEQ ID NO: 5140056 - DNA, 14 bp, Homo sapiens
accagcctggccca

SEQ ID NO: 5140057 - DNA, 12 bp, Homo sapiens
accagcctgggg

SEQ ID NO: 5140058 - DNA, 21 bp, Homo sapiens
accagcctggggccttcctgg

SEQ ID NO: 5140059 - DNA, 13 bp, Homo sapiens
accagcctgtacc

SEQ ID NO: 5140060 - DNA, 13 bp, Homo sapiens
accagcctgtcca

SEQ ID NO: 5140061 - DNA, 14 bp, Homo sapiens
accagcctgttgga

SEQ ID NO: 5140062 - DNA, 16 bp, Homo sapiens
accagccttgctctct

SEQ ID NO: 5140063 - DNA, 17 bp, Homo sapiens
accagccttgctctctt

SEQ ID NO: 5140064 - DNA, 11 bp, Homo sapiens
accagcctttc

SEQ ID NO: 5140065 - DNA, 17 bp, Homo sapiens
accagcctttctcccag

SEQ ID NO: 5140066 - DNA, 19 bp, Homo sapiens
accagcctttctcccaggc

SEQ ID NO: 5140067 - DNA, 13 bp, Homo sapiens
accagcctttctt

SEQ ID NO: 5140068 - DNA, 22 bp, Homo sapiens
accagcctttgggtcctgggca

SEQ ID NO: 5140069 - DNA, 24 bp, Homo sapiens
accagcctttgggtcctgggcagg

SEQ ID NO: 5140070 - DNA, 14 bp, Homo sapiens
accagcgaagggag

SEQ ID NO: 5140071 - DNA, 19 bp, Homo sapiens
accagcgccaaatgttcat

SEQ ID NO: 5140072 - DNA, 14 bp, Homo sapiens
accagcgcccccac

SEQ ID NO: 5140073 - DNA, 16 bp, Homo sapiens
accagcgcccccactc

SEQ ID NO: 5140074 - DNA, 23 bp, Homo sapiens
accagcgcccccactcctcctcc

SEQ ID NO: 5140075 - DNA, 23 bp, Homo sapiens
accagcgcccgctgggctgagcc

SEQ ID NO: 5140076 - DNA, 19 bp, Homo sapiens
accagcgctctaaaagcac

SEQ ID NO: 5140077 - DNA, 17 bp, Homo sapiens
accagcggaaacaggtg

SEQ ID NO: 5140078 - DNA, 18 bp, Homo sapiens
accagcggctgctcaagc

SEQ ID NO: 5140079 - DNA, 20 bp, Homo sapiens
accagcgttcccttctcccc

SEQ ID NO: 5140080 - DNA, 15 bp, Homo sapiens
accagctaactccag

SEQ ID NO: 5140081 - DNA, 22 bp, Homo sapiens
accagctaagaaaagattttaa

SEQ ID NO: 5140082 - DNA, 20 bp, Homo sapiens
accagctaaggagtccctgg

SEQ ID NO: 5140083 - DNA, 19 bp, Homo sapiens
accagctacttgatgtaac

SEQ ID NO: 5140084 - DNA, 17 bp, Homo sapiens
accagctatctgtcatc

SEQ ID NO: 5140085 - DNA, 13 bp, Homo sapiens
accagctcagagg

SEQ ID NO: 5140086 - DNA, 16 bp, Homo sapiens
accagctcagcactgc

SEQ ID NO: 5140087 - DNA, 15 bp, Homo sapiens
accagctcagccccg

SEQ ID NO: 5140088 - DNA, 16 bp, Homo sapiens
accagctcaggacaga

SEQ ID NO: 5140089 - DNA, 12 bp, Homo sapiens
accagctcaggg

SEQ ID NO: 5140090 - DNA, 14 bp, Homo sapiens
accagctccacaca

SEQ ID NO: 5140091 - DNA, 17 bp, Homo sapiens
accagctccactggcct

SEQ ID NO: 5140092 - DNA, 17 bp, Homo sapiens
accagctcccagggtgg

SEQ ID NO: 5140093 - DNA, 12 bp, Homo sapiens
accagctcctcc

SEQ ID NO: 5140094 - DNA, 14 bp, Homo sapiens
accagctcctccag

SEQ ID NO: 5140095 - DNA, 16 bp, Homo sapiens
accagctcctccagcc

SEQ ID NO: 5140096 - DNA, 20 bp, Homo sapiens
accagctcgtgggctgggaa

SEQ ID NO: 5140097 - DNA, 23 bp, Homo sapiens
accagctctgtggcctgtgtcca

SEQ ID NO: 5140098 - DNA, 14 bp, Homo sapiens
accagctgcaaagt

SEQ ID NO: 5140099 - DNA, 19 bp, Homo sapiens
accagctgcaaagtgtttt

SEQ ID NO: 5140100 - DNA, 14 bp, Homo sapiens
accagctgcctctt

SEQ ID NO: 5140101 - DNA, 15 bp, Homo sapiens
accagctgcctcttc

SEQ ID NO: 5140102 - DNA, 19 bp, Homo sapiens
accagctgcctctttgctg

SEQ ID NO: 5140103 - DNA, 16 bp, Homo sapiens
accagctgcgcttgct

SEQ ID NO: 5140104 - DNA, 20 bp, Homo sapiens
accagctgcgcttgcttttc

SEQ ID NO: 5140105 - DNA, 13 bp, Homo sapiens
accagctgctctg

SEQ ID NO: 5140106 - DNA, 21 bp, Homo sapiens
accagctgctgtgccccacca

SEQ ID NO: 5140107 - DNA, 21 bp, Homo sapiens
accagctggcctggggtccct

SEQ ID NO: 5140108 - DNA, 12 bp, Homo sapiens
accagctggctc

SEQ ID NO: 5140109 - DNA, 14 bp, Homo sapiens
accagctggctctg

SEQ ID NO: 5140110 - DNA, 11 bp, Homo sapiens
accagctgggg

SEQ ID NO: 5140111 - DNA, 21 bp, Homo sapiens
accagctggggcgtggggagg

SEQ ID NO: 5140112 - DNA, 20 bp, Homo sapiens
accagctggtatattgtgta

SEQ ID NO: 5140113 - DNA, 17 bp, Homo sapiens
accagcttaaaggcagt

SEQ ID NO: 5140114 - DNA, 17 bp, Homo sapiens
accagcttccttcagag

SEQ ID NO: 5140115 - DNA, 15 bp, Homo sapiens
accagcttctccagg

SEQ ID NO: 5140116 - DNA, 20 bp, Homo sapiens
accagcttctccaggctctt

SEQ ID NO: 5140117 - DNA, 13 bp, Homo sapiens
accagcttctttc

SEQ ID NO: 5140118 - DNA, 18 bp, Homo sapiens
accagcttgcgaataaca

SEQ ID NO: 5140119 - DNA, 17 bp, Homo sapiens
accagcttgcttctctg

SEQ ID NO: 5140120 - DNA, 23 bp, Homo sapiens
accagcttgcttctctgccggtg

SEQ ID NO: 5140121 - DNA, 15 bp, Homo sapiens
accagctttattttt

SEQ ID NO: 5140122 - DNA, 15 bp, Homo sapiens
accagctttgacccg

SEQ ID NO: 5140123 - DNA, 17 bp, Homo sapiens
accagctttgtttttgg

SEQ ID NO: 5140124 - DNA, 13 bp, Homo sapiens
accagcttttaac

SEQ ID NO: 5140125 - DNA, 19 bp, Homo sapiens
accaggaaaggattttata

SEQ ID NO: 5140126 - DNA, 14 bp, Homo sapiens
accaggaaaggctt

SEQ ID NO: 5140127 - DNA, 13 bp, Homo sapiens
accaggaacagca

SEQ ID NO: 5140128 - DNA, 20 bp, Homo sapiens
accaggaactctggagttca

SEQ ID NO: 5140129 - DNA, 15 bp, Homo sapiens
accaggaagaaggcc

SEQ ID NO: 5140130 - DNA, 17 bp, Homo sapiens
accaggaagaaggcccg

SEQ ID NO: 5140131 - DNA, 14 bp, Homo sapiens
accaggaagcacag

SEQ ID NO: 5140132 - DNA, 17 bp, Homo sapiens
accaggaagcacaggtc

SEQ ID NO: 5140133 - DNA, 12 bp, Homo sapiens
accaggaagccg

SEQ ID NO: 5140134 - DNA, 15 bp, Homo sapiens
accaggaaggaagag

SEQ ID NO: 5140135 - DNA, 19 bp, Homo sapiens
accaggaatatttcctcca

SEQ ID NO: 5140136 - DNA, 14 bp, Homo sapiens
accaggacaggacc

SEQ ID NO: 5140137 - DNA, 14 bp, Homo sapiens
accaggacccaggg

SEQ ID NO: 5140138 - DNA, 17 bp, Homo sapiens
accaggacccagggaga

SEQ ID NO: 5140139 - DNA, 20 bp, Homo sapiens
accaggacccagggagaggc

SEQ ID NO: 5140140 - DNA, 15 bp, Homo sapiens
accaggacccagggt

SEQ ID NO: 5140141 - DNA, 16 bp, Homo sapiens
accaggacccagggtc

SEQ ID NO: 5140142 - DNA, 12 bp, Homo sapiens
accaggaccctg

SEQ ID NO: 5140143 - DNA, 20 bp, Homo sapiens
accaggactatagcccaggt

SEQ ID NO: 5140144 - DNA, 14 bp, Homo sapiens
accaggactccctc

SEQ ID NO: 5140145 - DNA, 16 bp, Homo sapiens
accaggactccctcct

SEQ ID NO: 5140146 - DNA, 18 bp, Homo sapiens
accaggactccctcctca

SEQ ID NO: 5140147 - DNA, 14 bp, Homo sapiens
acattatattctct

SEQ ID NO: 5140148 - DNA, 19 bp, Homo sapiens
acattatattgcaatgaag

SEQ ID NO: 5140149 - DNA, 21 bp, Homo sapiens
acattatcgggagcagtgtct

SEQ ID NO: 5140150 - DNA, 13 bp, Homo sapiens
acattatcttagt

SEQ ID NO: 5140151 - DNA, 21 bp, Homo sapiens
acattatgatctaataaactt

SEQ ID NO: 5140152 - DNA, 22 bp, Homo sapiens
acattatgatctaataaacttt

SEQ ID NO: 5140153 - DNA, 13 bp, Homo sapiens
acattatgcaaat

SEQ ID NO: 5140154 - DNA, 17 bp, Homo sapiens
acattatgctccagaaa

SEQ ID NO: 5140155 - DNA, 15 bp, Homo sapiens
acattatgtatctta

SEQ ID NO: 5140156 - DNA, 14 bp, Homo sapiens
acattatgtgagtt

SEQ ID NO: 5140157 - DNA, 20 bp, Homo sapiens
acattatgtggaatcctaaa

SEQ ID NO: 5140158 - DNA, 19 bp, Homo sapiens
acattatgtggttttagat

SEQ ID NO: 5140159 - DNA, 22 bp, Homo sapiens
acattatgtggttttagatttt

SEQ ID NO: 5140160 - DNA, 13 bp, Homo sapiens
acattatgtgtgc

SEQ ID NO: 5140161 - DNA, 20 bp, Homo sapiens
acattatgtgtgcatgtgtg

SEQ ID NO: 5140162 - DNA, 22 bp, Homo sapiens
acattatgtgtgcatgtgtgta

SEQ ID NO: 5140163 - DNA, 12 bp, Homo sapiens
acattatgtttt

SEQ ID NO: 5140164 - DNA, 21 bp, Homo sapiens
acattatgttttatttaaatg

SEQ ID NO: 5140165 - DNA, 13 bp, Homo sapiens
acattattaaacg

SEQ ID NO: 5140166 - DNA, 12 bp, Homo sapiens
acattattactt

SEQ ID NO: 5140167 - DNA, 19 bp, Homo sapiens
acattattgaggaaaatta

SEQ ID NO: 5140168 - DNA, 23 bp, Homo sapiens
acattattgtcccacaatattac

SEQ ID NO: 5140169 - DNA, 12 bp, Homo sapiens
acattatttcta

SEQ ID NO: 5140170 - DNA, 13 bp, Homo sapiens
acattatttctgt

SEQ ID NO: 5140171 - DNA, 15 bp, Homo sapiens
acattatttctgtat

SEQ ID NO: 5140172 - DNA, 16 bp, Homo sapiens
acattatttctgtata

SEQ ID NO: 5140173 - DNA, 18 bp, Homo sapiens
acattatttctgtatata

SEQ ID NO: 5140174 - DNA, 18 bp, Homo sapiens
acattatttcttcccaga

SEQ ID NO: 5140175 - DNA, 13 bp, Homo sapiens
acattatttgcat

SEQ ID NO: 5140176 - DNA, 23 bp, Homo sapiens
acattcaaaaaactctctcccag

SEQ ID NO: 5140177 - DNA, 21 bp, Homo sapiens
acattcaaggcttatctctgc

SEQ ID NO: 5140178 - DNA, 20 bp, Homo sapiens
acattcacacagggctcttt

SEQ ID NO: 5140179 - DNA, 13 bp, Homo sapiens
acattcaccaaca

SEQ ID NO: 5140180 - DNA, 16 bp, Homo sapiens
acattcaccaacaaca

SEQ ID NO: 5140181 - DNA, 13 bp, Homo sapiens
acattcacctgcc

SEQ ID NO: 5140182 - DNA, 22 bp, Homo sapiens
acattcacctgtatatttcttt

SEQ ID NO: 5140183 - DNA, 13 bp, Homo sapiens
acattcacttttg

SEQ ID NO: 5140184 - DNA, 15 bp, Homo sapiens
acattcacttttgtt

SEQ ID NO: 5140185 - DNA, 20 bp, Homo sapiens
acattcagactaaaaataca

SEQ ID NO: 5140186 - DNA, 15 bp, Homo sapiens
acattcagattatat

SEQ ID NO: 5140187 - DNA, 20 bp, Homo sapiens
acattcagctgaggttcatt

SEQ ID NO: 5140188 - DNA, 21 bp, Homo sapiens
acattcagctgaggttcatta

SEQ ID NO: 5140189 - DNA, 22 bp, Homo sapiens
acattcagctgaggttcattac

SEQ ID NO: 5140190 - DNA, 13 bp, Homo sapiens
acattcagttctt

SEQ ID NO: 5140191 - DNA, 16 bp, Homo sapiens
acattcataaggaaat

SEQ ID NO: 5140192 - DNA, 13 bp, Homo sapiens
acattcatatctt

SEQ ID NO: 5140193 - DNA, 20 bp, Homo sapiens
acattcatcaatatccctct

SEQ ID NO: 5140194 - DNA, 14 bp, Homo sapiens
acattcatcctcac

SEQ ID NO: 5140195 - DNA, 16 bp, Homo sapiens
acattcatcctcacat

SEQ ID NO: 5140196 - DNA, 16 bp, Homo sapiens
acattcatgcctggct

SEQ ID NO: 5140197 - DNA, 20 bp, Homo sapiens
acattcatgtaactctccag

SEQ ID NO: 5140198 - DNA, 21 bp, Homo sapiens
acattcatgtaactctccagc

SEQ ID NO: 5140199 - DNA, 17 bp, Homo sapiens
acattccaaagaacagc

SEQ ID NO: 5140200 - DNA, 17 bp, Homo sapiens
acattccaagacagtat

SEQ ID NO: 5140201 - DNA, 16 bp, Homo sapiens
acattccaagactcta

SEQ ID NO: 5140202 - DNA, 23 bp, Homo sapiens
acattccacagctgccctggctg

SEQ ID NO: 5140203 - DNA, 21 bp, Homo sapiens
acattccacatctgtttcaaa

SEQ ID NO: 5140204 - DNA, 12 bp, Homo sapiens
acattccagcca

SEQ ID NO: 5140205 - DNA, 15 bp, Homo sapiens
acattccagggctgg

SEQ ID NO: 5140206 - DNA, 16 bp, Homo sapiens
acattccagggctggg

SEQ ID NO: 5140207 - DNA, 21 bp, Homo sapiens
acattccatcacagccagccc

SEQ ID NO: 5140208 - DNA, 13 bp, Homo sapiens
acattccatgacg

SEQ ID NO: 5140209 - DNA, 18 bp, Homo sapiens
acattcccaaggttactt

SEQ ID NO: 5140210 - DNA, 13 bp, Homo sapiens
acattccccagag

SEQ ID NO: 5140211 - DNA, 14 bp, Homo sapiens
acattcccccacca

SEQ ID NO: 5140212 - DNA, 17 bp, Homo sapiens
acattcccctggggacc

SEQ ID NO: 5140213 - DNA, 22 bp, Homo sapiens
acattcccctggggacccacgt

SEQ ID NO: 5140214 - DNA, 18 bp, Homo sapiens
acattccctatcaaaaca

SEQ ID NO: 5140215 - DNA, 19 bp, Homo sapiens
acattccctctaatttgaa

SEQ ID NO: 5140216 - DNA, 17 bp, Homo sapiens
acattccctctcatcca

SEQ ID NO: 5140217 - DNA, 14 bp, Homo sapiens
acattccctctcct

SEQ ID NO: 5140218 - DNA, 11 bp, Homo sapiens
acattccctgc

SEQ ID NO: 5140219 - DNA, 15 bp, Homo sapiens
acattccctggcctg

SEQ ID NO: 5140220 - DNA, 15 bp, Homo sapiens
acattccgaagaggg

SEQ ID NO: 5140221 - DNA, 23 bp, Homo sapiens
acattccgaggggctcagttctg

SEQ ID NO: 5140222 - DNA, 16 bp, Homo sapiens
acattccgtcctgatg

SEQ ID NO: 5140223 - DNA, 19 bp, Homo sapiens
acattcctaaactatcttt

SEQ ID NO: 5140224 - DNA, 18 bp, Homo sapiens
acattcctaactagaatt

SEQ ID NO: 5140225 - DNA, 19 bp, Homo sapiens
acattcctaactagaatta

SEQ ID NO: 5140226 - DNA, 21 bp, Homo sapiens
acattcctaactagaattagt

SEQ ID NO: 5140227 - DNA, 12 bp, Homo sapiens
acattcctcagc

SEQ ID NO: 5140228 - DNA, 17 bp, Homo sapiens
acattcctcagctgcca

SEQ ID NO: 5140229 - DNA, 22 bp, Homo sapiens
acattcctcatgaatgtaaatt

SEQ ID NO: 5140230 - DNA, 20 bp, Homo sapiens
acattcctccagcctcccct

SEQ ID NO: 5140231 - DNA, 15 bp, Homo sapiens
acattcctctgcagc

SEQ ID NO: 5140232 - DNA, 20 bp, Homo sapiens
acattcctgagattctggga

SEQ ID NO: 5140233 - DNA, 13 bp, Homo sapiens
acattcctggccc

SEQ ID NO: 5140234 - DNA, 18 bp, Homo sapiens
acattccttgcctgcaca

SEQ ID NO: 5140235 - DNA, 20 bp, Homo sapiens
acattcgaaggaacctgtgt

SEQ ID NO: 5140236 - DNA, 16 bp, Homo sapiens
acattcgaatctctgc

SEQ ID NO: 5140237 - DNA, 19 bp, Homo sapiens
acattcgaatctctgcccc

SEQ ID NO: 5140238 - DNA, 23 bp, Homo sapiens
acattcgaggtgtcaccctgcag

SEQ ID NO: 5140239 - DNA, 19 bp, Homo sapiens
acattcgatctcattcagt

SEQ ID NO: 5140240 - DNA, 17 bp, Homo sapiens
acattcggctccctgga

SEQ ID NO: 5140241 - DNA, 13 bp, Homo sapiens
acattctaatgca

SEQ ID NO: 5140242 - DNA, 15 bp, Homo sapiens
acattctaatgcata

SEQ ID NO: 5140243 - DNA, 15 bp, Homo sapiens
acattctacagttgt

SEQ ID NO: 5140244 - DNA, 18 bp, Homo sapiens
acattctacagttgtgat

SEQ ID NO: 5140245 - DNA, 16 bp, Homo sapiens
acattctacttgctta

SEQ ID NO: 5140246 - DNA, 23 bp, Homo sapiens
acattctacttgcttattacatt

SEQ ID NO: 5140247 - DNA, 22 bp, Homo sapiens
acattctagggtattctgtaat

SEQ ID NO: 5140248 - DNA, 18 bp, Homo sapiens
acattctagttcagagcc

SEQ ID NO: 5140249 - DNA, 18 bp, Homo sapiens
acattctatctactgatt

SEQ ID NO: 5140250 - DNA, 18 bp, Homo sapiens
acattctatgacattttt

SEQ ID NO: 5140251 - DNA, 20 bp, Homo sapiens
acattctattgactttctta

SEQ ID NO: 5140252 - DNA, 18 bp, Homo sapiens
acattctatttcaacttc

SEQ ID NO: 5140253 - DNA, 19 bp, Homo sapiens
acattctcagtttttctta

SEQ ID NO: 5140254 - DNA, 19 bp, Homo sapiens
acattctcgttgcctctga

SEQ ID NO: 5140255 - DNA, 18 bp, Homo sapiens
acattctctaataagaaa

SEQ ID NO: 5140256 - DNA, 22 bp, Homo sapiens
acattctctaggagaaacttag

SEQ ID NO: 5140257 - DNA, 22 bp, Homo sapiens
acattctctattgtaattttgt

SEQ ID NO: 5140258 - DNA, 19 bp, Homo sapiens
acattctctcatagaacat

SEQ ID NO: 5140259 - DNA, 16 bp, Homo sapiens
acattctctttgataa

SEQ ID NO: 5140260 - DNA, 17 bp, Homo sapiens
acattctctttgataac

SEQ ID NO: 5140261 - DNA, 18 bp, Homo sapiens
acattctctttgataaca

SEQ ID NO: 5140262 - DNA, 14 bp, Homo sapiens
acattctgaatcaa

SEQ ID NO: 5140263 - DNA, 14 bp, Homo sapiens
acattctgaatgct

SEQ ID NO: 5140264 - DNA, 20 bp, Homo sapiens
acattctgaatgcttctaag

SEQ ID NO: 5140265 - DNA, 16 bp, Homo sapiens
acattctgatttggaa

SEQ ID NO: 5140266 - DNA, 19 bp, Homo sapiens
acattctgcctagagtgta

SEQ ID NO: 5140267 - DNA, 13 bp, Homo sapiens
acattctgccttg

SEQ ID NO: 5140268 - DNA, 17 bp, Homo sapiens
acattctgctctgccca

SEQ ID NO: 5140269 - DNA, 19 bp, Homo sapiens
acattctgctctgcccatg

SEQ ID NO: 5140270 - DNA, 22 bp, Homo sapiens
acattctgctctgcccatgcct

SEQ ID NO: 5140271 - DNA, 12 bp, Homo sapiens
acattctgctgc

SEQ ID NO: 5140272 - DNA, 18 bp, Homo sapiens
acattctgctttcatctt

SEQ ID NO: 5140273 - DNA, 18 bp, Homo sapiens
acattctggatctgaccc

SEQ ID NO: 5140274 - DNA, 14 bp, Homo sapiens
acattctggctcca

SEQ ID NO: 5140275 - DNA, 15 bp, Homo sapiens
acattctggctccac

SEQ ID NO: 5140276 - DNA, 23 bp, Homo sapiens
acattctgtcgccttagcatgtt

SEQ ID NO: 5140277 - DNA, 17 bp, Homo sapiens
acattctgtctctgctt

SEQ ID NO: 5140278 - DNA, 15 bp, Homo sapiens
acattctgttaatca

SEQ ID NO: 5140279 - DNA, 22 bp, Homo sapiens
acattcttaaaggaaaagtcaa

SEQ ID NO: 5140280 - DNA, 23 bp, Homo sapiens
acattcttaaaggaaaagtcaac

SEQ ID NO: 5140281 - DNA, 17 bp, Homo sapiens
acattcttataaatatg

SEQ ID NO: 5140282 - DNA, 18 bp, Homo sapiens
acattcttataaatatga

SEQ ID NO: 5140283 - DNA, 22 bp, Homo sapiens
acattcttataaatatgaagct

SEQ ID NO: 5140284 - DNA, 23 bp, Homo sapiens
acattcttataaatatgaagctc

SEQ ID NO: 5140285 - DNA, 18 bp, Homo sapiens
acattcttattaattctt

SEQ ID NO: 5140286 - DNA, 21 bp, Homo sapiens
acattcttcaagatcccattt

SEQ ID NO: 5140287 - DNA, 20 bp, Homo sapiens
acattcttcagtttttcact

SEQ ID NO: 5140288 - DNA, 21 bp, Homo sapiens
acattcttcagtttttcactt

SEQ ID NO: 5140289 - DNA, 19 bp, Homo sapiens
acattcttccaaaaagatt

SEQ ID NO: 5140290 - DNA, 14 bp, Homo sapiens
acattcttccatca

SEQ ID NO: 5140291 - DNA, 19 bp, Homo sapiens
acattcttgcttgtgtgtc

SEQ ID NO: 5140292 - DNA, 21 bp, Homo sapiens
acattcttgcttgtgtgtctg

SEQ ID NO: 5140293 - DNA, 20 bp, Homo sapiens
acattcttggcttaatcatt

SEQ ID NO: 5140294 - DNA, 23 bp, Homo sapiens
acattcttggcttaatcattttc

SEQ ID NO: 5140295 - DNA, 18 bp, Homo sapiens
acattcttggtcacaaag

SEQ ID NO: 5140296 - DNA, 19 bp, Homo sapiens
acattcttgtgtctgtttt

SEQ ID NO: 5140297 - DNA, 19 bp, Homo sapiens
acattctttataaaatgta

SEQ ID NO: 5140298 - DNA, 16 bp, Homo sapiens
acattctttattctgc

SEQ ID NO: 5140299 - DNA, 15 bp, Homo sapiens
acattctttcctaaa

SEQ ID NO: 5140300 - DNA, 20 bp, Homo sapiens
acattcttttaacttctttc

SEQ ID NO: 5140301 - DNA, 23 bp, Homo sapiens
acattctttttgctctaaaatat

SEQ ID NO: 5140302 - DNA, 16 bp, Homo sapiens
acattgaaaacagata

SEQ ID NO: 5140303 - DNA, 19 bp, Homo sapiens
acattgaaaccctccaaat

SEQ ID NO: 5140304 - DNA, 15 bp, Homo sapiens
acattgaaactgtat

SEQ ID NO: 5140305 - DNA, 14 bp, Homo sapiens
acattgaaagctct

SEQ ID NO: 5140306 - DNA, 18 bp, Homo sapiens
acattgaaatacttgaaa

SEQ ID NO: 5140307 - DNA, 16 bp, Homo sapiens
acattgaaatattagt

SEQ ID NO: 5140308 - DNA, 17 bp, Homo sapiens
acattgaaatctaggaa

SEQ ID NO: 5140309 - DNA, 20 bp, Homo sapiens
acattgaaatctaggaaaat

SEQ ID NO: 5140310 - DNA, 21 bp, Homo sapiens
acattgacaatgacaaaaaga

SEQ ID NO: 5140311 - DNA, 14 bp, Homo sapiens
acattgacagcaat

SEQ ID NO: 5140312 - DNA, 16 bp, Homo sapiens
acattgacagcaattc

SEQ ID NO: 5140313 - DNA, 17 bp, Homo sapiens
acattgacagcaattca

SEQ ID NO: 5140314 - DNA, 18 bp, Homo sapiens
acattgacagcaattcat

SEQ ID NO: 5140315 - DNA, 17 bp, Homo sapiens
acattgaccaagaactg

SEQ ID NO: 5140316 - DNA, 20 bp, Homo sapiens
acattgaccaagaactgcat

SEQ ID NO: 5140317 - DNA, 19 bp, Homo sapiens
acattgacgattccttctc

SEQ ID NO: 5140318 - DNA, 22 bp, Homo sapiens
acattgacgattccttctctga

SEQ ID NO: 5140319 - DNA, 17 bp, Homo sapiens
acattgactatttttgt

SEQ ID NO: 5140320 - DNA, 17 bp, Homo sapiens
acattgagactgctaga

SEQ ID NO: 5140321 - DNA, 17 bp, Homo sapiens
acattgagactttcttc

SEQ ID NO: 5140322 - DNA, 16 bp, Homo sapiens
acattgagctgatata

SEQ ID NO: 5140323 - DNA, 14 bp, Homo sapiens
acattgagtagaca

SEQ ID NO: 5140324 - DNA, 18 bp, Homo sapiens
acattgattgctgcattt

SEQ ID NO: 5140325 - DNA, 21 bp, Homo sapiens
accaggactccctcctcacct

SEQ ID NO: 5140326 - DNA, 16 bp, Homo sapiens
accaggactctgcctt

SEQ ID NO: 5140327 - DNA, 20 bp, Homo sapiens
accaggactctgccttccag

SEQ ID NO: 5140328 - DNA, 11 bp, Homo sapiens
accaggactta

SEQ ID NO: 5140329 - DNA, 16 bp, Homo sapiens
accaggacttgtgcag

SEQ ID NO: 5140330 - DNA, 23 bp, Homo sapiens
accaggagaagggctggggccgg

SEQ ID NO: 5140331 - DNA, 19 bp, Homo sapiens
accaggagcaaccgtgcag

SEQ ID NO: 5140332 - DNA, 21 bp, Homo sapiens
accaggagcaaccgtgcagcc

SEQ ID NO: 5140333 - DNA, 22 bp, Homo sapiens
accaggagcaaccgtgcagcca

SEQ ID NO: 5140334 - DNA, 14 bp, Homo sapiens
accaggagcacctg

SEQ ID NO: 5140335 - DNA, 15 bp, Homo sapiens
accaggagcacctgg

SEQ ID NO: 5140336 - DNA, 16 bp, Homo sapiens
accaggagcagcagcc

SEQ ID NO: 5140337 - DNA, 17 bp, Homo sapiens
accaggagcagcagcca

SEQ ID NO: 5140338 - DNA, 21 bp, Homo sapiens
accaggagcattttgtgtctt

SEQ ID NO: 5140339 - DNA, 11 bp, Homo sapiens
accaggagcca

SEQ ID NO: 5140340 - DNA, 13 bp, Homo sapiens
accaggagccagg

SEQ ID NO: 5140341 - DNA, 14 bp, Homo sapiens
accaggagccaggt

SEQ ID NO: 5140342 - DNA, 16 bp, Homo sapiens
accaggaggcctggga

SEQ ID NO: 5140343 - DNA, 20 bp, Homo sapiens
accaggagggagagcctctg

SEQ ID NO: 5140344 - DNA, 23 bp, Homo sapiens
accaggagggtaacagaagagga

SEQ ID NO: 5140345 - DNA, 20 bp, Homo sapiens
accaggagtgggtggggagt

SEQ ID NO: 5140346 - DNA, 18 bp, Homo sapiens
accaggatcgctttgtac

SEQ ID NO: 5140347 - DNA, 18 bp, Homo sapiens
accaggatggagcaagct

SEQ ID NO: 5140348 - DNA, 19 bp, Homo sapiens
accaggatggagcaagctc

SEQ ID NO: 5140349 - DNA, 15 bp, Homo sapiens
accaggatttctaat

SEQ ID NO: 5140350 - DNA, 13 bp, Homo sapiens
accaggatttttt

SEQ ID NO: 5140351 - DNA, 18 bp, Homo sapiens
accaggcaacctcccatc

SEQ ID NO: 5140352 - DNA, 19 bp, Homo sapiens
accaggcaacttgggaact

SEQ ID NO: 5140353 - DNA, 22 bp, Homo sapiens
accaggcaagaaaagcgcagag

SEQ ID NO: 5140354 - DNA, 16 bp, Homo sapiens
accaggcacatggctg

SEQ ID NO: 5140355 - DNA, 17 bp, Homo sapiens
accaggcaccaaaagaa

SEQ ID NO: 5140356 - DNA, 15 bp, Homo sapiens
accaggcaccaggca

SEQ ID NO: 5140357 - DNA, 19 bp, Homo sapiens
accaggcacctcccctccc

SEQ ID NO: 5140358 - DNA, 22 bp, Homo sapiens
accaggcacgaacccacctgct

SEQ ID NO: 5140359 - DNA, 23 bp, Homo sapiens
accaggcacgaacccacctgctg

SEQ ID NO: 5140360 - DNA, 17 bp, Homo sapiens
accaggcagcctctggg

SEQ ID NO: 5140361 - DNA, 16 bp, Homo sapiens
accaggcagctccagc

SEQ ID NO: 5140362 - DNA, 16 bp, Homo sapiens
accaggcagctgagac

SEQ ID NO: 5140363 - DNA, 14 bp, Homo sapiens
accaggcagtgtgc

SEQ ID NO: 5140364 - DNA, 16 bp, Homo sapiens
accaggcatggaaaga

SEQ ID NO: 5140365 - DNA, 15 bp, Homo sapiens
accaggccacccact

SEQ ID NO: 5140366 - DNA, 20 bp, Homo sapiens
accaggccacccactgtggg

SEQ ID NO: 5140367 - DNA, 14 bp, Homo sapiens
accaggccacctcc

SEQ ID NO: 5140368 - DNA, 17 bp, Homo sapiens
accaggccacctcccca

SEQ ID NO: 5140369 - DNA, 19 bp, Homo sapiens
accaggccagagcaaacag

SEQ ID NO: 5140370 - DNA, 15 bp, Homo sapiens
accaggccagctcag

SEQ ID NO: 5140371 - DNA, 18 bp, Homo sapiens
accaggccagctcaggaa

SEQ ID NO: 5140372 - DNA, 17 bp, Homo sapiens
accaggcccaaggaggg

SEQ ID NO: 5140373 - DNA, 20 bp, Homo sapiens
accaggcccacgaggagcag

SEQ ID NO: 5140374 - DNA, 16 bp, Homo sapiens
accaggcccgcactgg

SEQ ID NO: 5140375 - DNA, 21 bp, Homo sapiens
accaggccgggcttgggccct

SEQ ID NO: 5140376 - DNA, 18 bp, Homo sapiens
accaggccgtcctcccgg

SEQ ID NO: 5140377 - DNA, 20 bp, Homo sapiens
accaggccgtcctcccgggc

SEQ ID NO: 5140378 - DNA, 22 bp, Homo sapiens
accaggcctcactggctcatgc

SEQ ID NO: 5140379 - DNA, 12 bp, Homo sapiens
accaggcctctg

SEQ ID NO: 5140380 - DNA, 13 bp, Homo sapiens
accaggcctctgc

SEQ ID NO: 5140381 - DNA, 20 bp, Homo sapiens
accaggcctctgctgccgcc

SEQ ID NO: 5140382 - DNA, 19 bp, Homo sapiens
accaggcctggagggcact

SEQ ID NO: 5140383 - DNA, 19 bp, Homo sapiens
accaggccttcatcctcct

SEQ ID NO: 5140384 - DNA, 17 bp, Homo sapiens
accaggctgatgccgtg

SEQ ID NO: 5140385 - DNA, 20 bp, Homo sapiens
accaggctgcagcctccact

SEQ ID NO: 5140386 - DNA, 21 bp, Homo sapiens
accaggctgcagcctccactt

SEQ ID NO: 5140387 - DNA, 20 bp, Homo sapiens
accaggctgcaggtggggtt

SEQ ID NO: 5140388 - DNA, 12 bp, Homo sapiens
accaggctgctg

SEQ ID NO: 5140389 - DNA, 14 bp, Homo sapiens
accaggctgctgca

SEQ ID NO: 5140390 - DNA, 20 bp, Homo sapiens
accaggctggacaccctctg

SEQ ID NO: 5140391 - DNA, 15 bp, Homo sapiens
accaggctggagtga

SEQ ID NO: 5140392 - DNA, 17 bp, Homo sapiens
accaggctggcgcagcc

SEQ ID NO: 5140393 - DNA, 13 bp, Homo sapiens
accaggctgggca

SEQ ID NO: 5140394 - DNA, 14 bp, Homo sapiens
accaggcttcccaa

SEQ ID NO: 5140395 - DNA, 20 bp, Homo sapiens
accaggcttgcctgggacgg

SEQ ID NO: 5140396 - DNA, 17 bp, Homo sapiens
accagggaccagcccag

SEQ ID NO: 5140397 - DNA, 12 bp, Homo sapiens
accagggaccct

SEQ ID NO: 5140398 - DNA, 22 bp, Homo sapiens
accagggactcggcccagggcc

SEQ ID NO: 5140399 - DNA, 14 bp, Homo sapiens
accagggactgcag

SEQ ID NO: 5140400 - DNA, 20 bp, Homo sapiens
accagggagaggcctcggct

SEQ ID NO: 5140401 - DNA, 21 bp, Homo sapiens
accagggagatttgctcaata

SEQ ID NO: 5140402 - DNA, 20 bp, Homo sapiens
accagggagcccctttgatg

SEQ ID NO: 5140403 - DNA, 19 bp, Homo sapiens
accagggagctgcaggggc

SEQ ID NO: 5140404 - DNA, 17 bp, Homo sapiens
accagggatcacagacc

SEQ ID NO: 5140405 - DNA, 15 bp, Homo sapiens
accagggatgctggg

SEQ ID NO: 5140406 - DNA, 19 bp, Homo sapiens
accagggatgctgggctgg

SEQ ID NO: 5140407 - DNA, 23 bp, Homo sapiens
accagggatgctgggctgggccc

SEQ ID NO: 5140408 - DNA, 21 bp, Homo sapiens
accagggcactgtctgcgtga

SEQ ID NO: 5140409 - DNA, 15 bp, Homo sapiens
accagggcagggcca

SEQ ID NO: 5140410 - DNA, 19 bp, Homo sapiens
accagggcagtgaaaatga

SEQ ID NO: 5140411 - DNA, 17 bp, Homo sapiens
accagggcatctctggg

SEQ ID NO: 5140412 - DNA, 18 bp, Homo sapiens
accagggcatctctgggc

SEQ ID NO: 5140413 - DNA, 14 bp, Homo sapiens
accagggccaccgc

SEQ ID NO: 5140414 - DNA, 22 bp, Homo sapiens
accagggccagaagtagctttg

SEQ ID NO: 5140415 - DNA, 19 bp, Homo sapiens
accagggccagagcagctc

SEQ ID NO: 5140416 - DNA, 16 bp, Homo sapiens
accagggccagcctct

SEQ ID NO: 5140417 - DNA, 17 bp, Homo sapiens
accagggccagcctcta

SEQ ID NO: 5140418 - DNA, 13 bp, Homo sapiens
accagggccagct

SEQ ID NO: 5140419 - DNA, 17 bp, Homo sapiens
accagggccccggggcc

SEQ ID NO: 5140420 - DNA, 14 bp, Homo sapiens
accagggccctggg

SEQ ID NO: 5140421 - DNA, 16 bp, Homo sapiens
accagggccctgggca

SEQ ID NO: 5140422 - DNA, 19 bp, Homo sapiens
accagggcctgagccaagc

SEQ ID NO: 5140423 - DNA, 16 bp, Homo sapiens
accagggccttttctg

SEQ ID NO: 5140424 - DNA, 23 bp, Homo sapiens
accagggccttttctggcaccgc

SEQ ID NO: 5140425 - DNA, 15 bp, Homo sapiens
accagggctcagctc

SEQ ID NO: 5140426 - DNA, 15 bp, Homo sapiens
accagggctccagcc

SEQ ID NO: 5140427 - DNA, 16 bp, Homo sapiens
accagggctccagccc

SEQ ID NO: 5140428 - DNA, 14 bp, Homo sapiens
accagggctccagg

SEQ ID NO: 5140429 - DNA, 17 bp, Homo sapiens
accagggctccaggagc

SEQ ID NO: 5140430 - DNA, 18 bp, Homo sapiens
accagggctgctctttcc

SEQ ID NO: 5140431 - DNA, 16 bp, Homo sapiens
accaggggaaggaagg

SEQ ID NO: 5140432 - DNA, 22 bp, Homo sapiens
accaggggaaggaaggagggca

SEQ ID NO: 5140433 - DNA, 18 bp, Homo sapiens
accaggggacactttgtt

SEQ ID NO: 5140434 - DNA, 17 bp, Homo sapiens
accaggggaccagaggg

SEQ ID NO: 5140435 - DNA, 19 bp, Homo sapiens
accaggggaggagcctgtg

SEQ ID NO: 5140436 - DNA, 20 bp, Homo sapiens
accaggggcaggcacagcac

SEQ ID NO: 5140437 - DNA, 12 bp, Homo sapiens
accaggggccaa

SEQ ID NO: 5140438 - DNA, 13 bp, Homo sapiens
accaggggccaac

SEQ ID NO: 5140439 - DNA, 13 bp, Homo sapiens
accaggggcccta

SEQ ID NO: 5140440 - DNA, 17 bp, Homo sapiens
accaggggccctacctg

SEQ ID NO: 5140441 - DNA, 21 bp, Homo sapiens
accaggggctgggctccctga

SEQ ID NO: 5140442 - DNA, 13 bp, Homo sapiens
accagggggaagc

SEQ ID NO: 5140443 - DNA, 22 bp, Homo sapiens
accagggggaagcaccagcctc

SEQ ID NO: 5140444 - DNA, 23 bp, Homo sapiens
accagggggaagcaccagcctca

SEQ ID NO: 5140445 - DNA, 22 bp, Homo sapiens
accaggggtgctatgacatgca

SEQ ID NO: 5140446 - DNA, 18 bp, Homo sapiens
accaggggttccccagga

SEQ ID NO: 5140447 - DNA, 16 bp, Homo sapiens
accaggggtttctcgc

SEQ ID NO: 5140448 - DNA, 14 bp, Homo sapiens
accagggtcccagg

SEQ ID NO: 5140449 - DNA, 15 bp, Homo sapiens
accagggtcccagga

SEQ ID NO: 5140450 - DNA, 19 bp, Homo sapiens
accagggtccgcaccagct

SEQ ID NO: 5140451 - DNA, 21 bp, Homo sapiens
accagggtccttttgacactg

SEQ ID NO: 5140452 - DNA, 16 bp, Homo sapiens
accagggtgcatggct

SEQ ID NO: 5140453 - DNA, 13 bp, Homo sapiens
accagggtggcca

SEQ ID NO: 5140454 - DNA, 15 bp, Homo sapiens
accagggtggccaca

SEQ ID NO: 5140455 - DNA, 16 bp, Homo sapiens
accagggtggccacac

SEQ ID NO: 5140456 - DNA, 22 bp, Homo sapiens
accagggtggccacacaggcag

SEQ ID NO: 5140457 - DNA, 20 bp, Homo sapiens
accagggttgaccccagagg

SEQ ID NO: 5140458 - DNA, 21 bp, Homo sapiens
accagggttgaccccagagga

SEQ ID NO: 5140459 - DNA, 19 bp, Homo sapiens
accagggttggcaccttcc

SEQ ID NO: 5140460 - DNA, 15 bp, Homo sapiens
accaggtcaccatcc

SEQ ID NO: 5140461 - DNA, 20 bp, Homo sapiens
accaggtcaccatcctcaga

SEQ ID NO: 5140462 - DNA, 21 bp, Homo sapiens
accaggtcaccatcctcagag

SEQ ID NO: 5140463 - DNA, 18 bp, Homo sapiens
accaggtcactctgacct

SEQ ID NO: 5140464 - DNA, 21 bp, Homo sapiens
accaggtccaatgagctttct

SEQ ID NO: 5140465 - DNA, 19 bp, Homo sapiens
accaggtccattttgcctg

SEQ ID NO: 5140466 - DNA, 14 bp, Homo sapiens
accaggtcctgctc

SEQ ID NO: 5140467 - DNA, 14 bp, Homo sapiens
accaggtcctgtga

SEQ ID NO: 5140468 - DNA, 20 bp, Homo sapiens
accaggtcctttctcctgat

SEQ ID NO: 5140469 - DNA, 19 bp, Homo sapiens
accaggtctcctccaccgc

SEQ ID NO: 5140470 - DNA, 16 bp, Homo sapiens
accaggtcttggagct

SEQ ID NO: 5140471 - DNA, 16 bp, Homo sapiens
accaggtgagaagtga

SEQ ID NO: 5140472 - DNA, 20 bp, Homo sapiens
accaggtgatctattcattg

SEQ ID NO: 5140473 - DNA, 13 bp, Homo sapiens
accaggtgccttt

SEQ ID NO: 5140474 - DNA, 15 bp, Homo sapiens
accaggtgctcagcc

SEQ ID NO: 5140475 - DNA, 14 bp, Homo sapiens
accaggtgggagcg

SEQ ID NO: 5140476 - DNA, 23 bp, Homo sapiens
accaggtgttctacactcatctt

SEQ ID NO: 5140477 - DNA, 20 bp, Homo sapiens
accaggttacctcactttta

SEQ ID NO: 5140478 - DNA, 18 bp, Homo sapiens
accaggttcacttaaaag

SEQ ID NO: 5140479 - DNA, 15 bp, Homo sapiens
accaggtttgcacct

SEQ ID NO: 5140480 - DNA, 15 bp, Homo sapiens
accagtaaagtgtaa

SEQ ID NO: 5140481 - DNA, 18 bp, Homo sapiens
accagtaattgtgaaaat

SEQ ID NO: 5140482 - DNA, 23 bp, Homo sapiens
accagtacctctgtatagaaatc

SEQ ID NO: 5140483 - DNA, 20 bp, Homo sapiens
accagtaggggcttataata

SEQ ID NO: 5140484 - DNA, 23 bp, Homo sapiens
accagtaggttgaggacaggaga

SEQ ID NO: 5140485 - DNA, 11 bp, Homo sapiens
accagtagtga

SEQ ID NO: 5140486 - DNA, 16 bp, Homo sapiens
accagtagtgaccaat

SEQ ID NO: 5140487 - DNA, 15 bp, Homo sapiens
accagtatctccatc

SEQ ID NO: 5140488 - DNA, 23 bp, Homo sapiens
accagtattctaaagttttgcaa

SEQ ID NO: 5140489 - DNA, 15 bp, Homo sapiens
accagtattgtacaa

SEQ ID NO: 5140490 - DNA, 22 bp, Homo sapiens
accagtattgtacaaagtatta

SEQ ID NO: 5140491 - DNA, 11 bp, Homo sapiens
accagtattta

SEQ ID NO: 5140492 - DNA, 14 bp, Homo sapiens
accagtatttagaa

SEQ ID NO: 5140493 - DNA, 19 bp, Homo sapiens
accagtatttagaagccaa

SEQ ID NO: 5140494 - DNA, 15 bp, Homo sapiens
accagtcaagagcaa

SEQ ID NO: 5140495 - DNA, 18 bp, Homo sapiens
accagtcacctcctgctc

SEQ ID NO: 5140496 - DNA, 15 bp, Homo sapiens
accagtcagggacag

SEQ ID NO: 5140497 - DNA, 16 bp, Homo sapiens
accagtcagggacagc

SEQ ID NO: 5140498 - DNA, 21 bp, Homo sapiens
accagtccacgccgggtcgcc

SEQ ID NO: 5140499 - DNA, 20 bp, Homo sapiens
accagtcccgtcgtgcagtc

SEQ ID NO: 5140500 - DNA, 15 bp, Homo sapiens
accagtccctctgag

SEQ ID NO: 5140501 - DNA, 19 bp, Homo sapiens
accagtcctgctgcctgga

SEQ ID NO: 5140502 - DNA, 22 bp, Homo sapiens
accagtctagtccgtcctggca

SEQ ID NO: 5140503 - DNA, 22 bp, Homo sapiens
acattgattgctgcattttacc

SEQ ID NO: 5140504 - DNA, 16 bp, Homo sapiens
acattgatttattttt

SEQ ID NO: 5140505 - DNA, 21 bp, Homo sapiens
acattgatttattttttaatc

SEQ ID NO: 5140506 - DNA, 14 bp, Homo sapiens
acattgatttttct

SEQ ID NO: 5140507 - DNA, 16 bp, Homo sapiens
acattgcaatagaaat

SEQ ID NO: 5140508 - DNA, 23 bp, Homo sapiens
acattgcaggaagagatgctcta

SEQ ID NO: 5140509 - DNA, 20 bp, Homo sapiens
acattgcataagtggaccca

SEQ ID NO: 5140510 - DNA, 18 bp, Homo sapiens
acattgcatcaaagcatc

SEQ ID NO: 5140511 - DNA, 14 bp, Homo sapiens
acattgcattctat

SEQ ID NO: 5140512 - DNA, 15 bp, Homo sapiens
acattgcattctatt

SEQ ID NO: 5140513 - DNA, 16 bp, Homo sapiens
acattgcattctattg

SEQ ID NO: 5140514 - DNA, 18 bp, Homo sapiens
acattgcattgtgactat

SEQ ID NO: 5140515 - DNA, 14 bp, Homo sapiens
acattgccaaaaag

SEQ ID NO: 5140516 - DNA, 17 bp, Homo sapiens
acattgccaaaaaggat

SEQ ID NO: 5140517 - DNA, 23 bp, Homo sapiens
acattgccaaaaaggatacataa

SEQ ID NO: 5140518 - DNA, 17 bp, Homo sapiens
acattgcccacacctgc

SEQ ID NO: 5140519 - DNA, 19 bp, Homo sapiens
acattgcccacacctgcct

SEQ ID NO: 5140520 - DNA, 12 bp, Homo sapiens
acattgcccctc

SEQ ID NO: 5140521 - DNA, 16 bp, Homo sapiens
acattgcccctctgcc

SEQ ID NO: 5140522 - DNA, 16 bp, Homo sapiens
acattgcctgttctgc

SEQ ID NO: 5140523 - DNA, 18 bp, Homo sapiens
acattgccttctggagct

SEQ ID NO: 5140524 - DNA, 15 bp, Homo sapiens
acattgccttgcatt

SEQ ID NO: 5140525 - DNA, 17 bp, Homo sapiens
acattgccttgcatttg

SEQ ID NO: 5140526 - DNA, 22 bp, Homo sapiens
acattgccttgcatttgtacct

SEQ ID NO: 5140527 - DNA, 18 bp, Homo sapiens
acattgcctttgaatgtt

SEQ ID NO: 5140528 - DNA, 22 bp, Homo sapiens
acattgccttttctagcccgaa

SEQ ID NO: 5140529 - DNA, 20 bp, Homo sapiens
acattgctccaagatgttct

SEQ ID NO: 5140530 - DNA, 15 bp, Homo sapiens
acattgctctctggg

SEQ ID NO: 5140531 - DNA, 12 bp, Homo sapiens
acattgctgcct

SEQ ID NO: 5140532 - DNA, 18 bp, Homo sapiens
acattgctggtcatcctt

SEQ ID NO: 5140533 - DNA, 19 bp, Homo sapiens
acattgctggtcttgtaag

SEQ ID NO: 5140534 - DNA, 13 bp, Homo sapiens
acattgcttaaaa

SEQ ID NO: 5140535 - DNA, 15 bp, Homo sapiens
acattgcttcattaa

SEQ ID NO: 5140536 - DNA, 21 bp, Homo sapiens
acattgcttcattaaaacaag

SEQ ID NO: 5140537 - DNA, 22 bp, Homo sapiens
acattgcttcattaaaacaaga

SEQ ID NO: 5140538 - DNA, 20 bp, Homo sapiens
acattgcttgtgccacaccc

SEQ ID NO: 5140539 - DNA, 18 bp, Homo sapiens
acattgctttactgtcaa

SEQ ID NO: 5140540 - DNA, 18 bp, Homo sapiens
acattgctttagacaaat

SEQ ID NO: 5140541 - DNA, 23 bp, Homo sapiens
acattgctttgaccactcttcct

SEQ ID NO: 5140542 - DNA, 15 bp, Homo sapiens
acattgcttttaaaa

SEQ ID NO: 5140543 - DNA, 15 bp, Homo sapiens
acattgcttttgaaa

SEQ ID NO: 5140544 - DNA, 16 bp, Homo sapiens
acattggaaacaagtc

SEQ ID NO: 5140545 - DNA, 12 bp, Homo sapiens
acattggaagca

SEQ ID NO: 5140546 - DNA, 15 bp, Homo sapiens
acattggaagcaggt

SEQ ID NO: 5140547 - DNA, 16 bp, Homo sapiens
acattggaagctccca

SEQ ID NO: 5140548 - DNA, 16 bp, Homo sapiens
acattggaatgccttg

SEQ ID NO: 5140549 - DNA, 17 bp, Homo sapiens
acattggaatgccttgg

SEQ ID NO: 5140550 - DNA, 15 bp, Homo sapiens
acattggacagaaaa

SEQ ID NO: 5140551 - DNA, 16 bp, Homo sapiens
acattggacagaaaat

SEQ ID NO: 5140552 - DNA, 18 bp, Homo sapiens
acattggattatcctgag

SEQ ID NO: 5140553 - DNA, 19 bp, Homo sapiens
acattggcacaatgtatac

SEQ ID NO: 5140554 - DNA, 14 bp, Homo sapiens
acattggcagtgtg

SEQ ID NO: 5140555 - DNA, 23 bp, Homo sapiens
acattggcataatttttctttat

SEQ ID NO: 5140556 - DNA, 18 bp, Homo sapiens
acattgggaaggaagccc

SEQ ID NO: 5140557 - DNA, 19 bp, Homo sapiens
acattgggccacttcctaa

SEQ ID NO: 5140558 - DNA, 21 bp, Homo sapiens
acattggggattgaaaatcat

SEQ ID NO: 5140559 - DNA, 20 bp, Homo sapiens
acattgggtctattccagct

SEQ ID NO: 5140560 - DNA, 23 bp, Homo sapiens
acattgggtctattccagctcat

SEQ ID NO: 5140561 - DNA, 15 bp, Homo sapiens
acattgggtggggct

SEQ ID NO: 5140562 - DNA, 15 bp, Homo sapiens
acattggtaaacatt

SEQ ID NO: 5140563 - DNA, 16 bp, Homo sapiens
acattggtaagaatga

SEQ ID NO: 5140564 - DNA, 21 bp, Homo sapiens
acattggtgaaggatccagga

SEQ ID NO: 5140565 - DNA, 16 bp, Homo sapiens
acattggtgttgtact

SEQ ID NO: 5140566 - DNA, 22 bp, Homo sapiens
acattggttcttgtattaagaa

SEQ ID NO: 5140567 - DNA, 23 bp, Homo sapiens
acattggttcttgtattaagaat

SEQ ID NO: 5140568 - DNA, 22 bp, Homo sapiens
acattggttctttcatttgctt

SEQ ID NO: 5140569 - DNA, 14 bp, Homo sapiens
acattgtaaaataa

SEQ ID NO: 5140570 - DNA, 17 bp, Homo sapiens
acattgtaaaataaagt

SEQ ID NO: 5140571 - DNA, 15 bp, Homo sapiens
acattgtaaagtatg

SEQ ID NO: 5140572 - DNA, 12 bp, Homo sapiens
acattgtaaata

SEQ ID NO: 5140573 - DNA, 14 bp, Homo sapiens
acattgtaaataaa

SEQ ID NO: 5140574 - DNA, 17 bp, Homo sapiens
acattgtaaataaattt

SEQ ID NO: 5140575 - DNA, 21 bp, Homo sapiens
acattgtaaataaattttgtg

SEQ ID NO: 5140576 - DNA, 16 bp, Homo sapiens
acattgtaaatattta

SEQ ID NO: 5140577 - DNA, 19 bp, Homo sapiens
acattgtacgaagagtatt

SEQ ID NO: 5140578 - DNA, 12 bp, Homo sapiens
acattgtactgt

SEQ ID NO: 5140579 - DNA, 22 bp, Homo sapiens
acattgtagcctaatattcatg

SEQ ID NO: 5140580 - DNA, 21 bp, Homo sapiens
acattgtataggccatctgta

SEQ ID NO: 5140581 - DNA, 23 bp, Homo sapiens
acattgtataggccatctgtaaa

SEQ ID NO: 5140582 - DNA, 22 bp, Homo sapiens
acattgtattttactttgtgca

SEQ ID NO: 5140583 - DNA, 13 bp, Homo sapiens
acattgtcaataa

SEQ ID NO: 5140584 - DNA, 14 bp, Homo sapiens
acattgtcaataaa

SEQ ID NO: 5140585 - DNA, 17 bp, Homo sapiens
acattgtcagaatgttg

SEQ ID NO: 5140586 - DNA, 14 bp, Homo sapiens
acattgtcagcaaa

SEQ ID NO: 5140587 - DNA, 18 bp, Homo sapiens
acattgtcagcaaattaa

SEQ ID NO: 5140588 - DNA, 15 bp, Homo sapiens
acattgtcctgtagc

SEQ ID NO: 5140589 - DNA, 19 bp, Homo sapiens
acattgtctcccgcccccc

SEQ ID NO: 5140590 - DNA, 22 bp, Homo sapiens
acattgtctcctatatatttct

SEQ ID NO: 5140591 - DNA, 18 bp, Homo sapiens
acattgtgattattgaag

SEQ ID NO: 5140592 - DNA, 21 bp, Homo sapiens
acattgtgccctgtagctcct

SEQ ID NO: 5140593 - DNA, 14 bp, Homo sapiens
acattgtgctttct

SEQ ID NO: 5140594 - DNA, 19 bp, Homo sapiens
acattgtgtgaaaaaagaa

SEQ ID NO: 5140595 - DNA, 16 bp, Homo sapiens
acattgtgttgacatt

SEQ ID NO: 5140596 - DNA, 18 bp, Homo sapiens
acattgttaatataattt

SEQ ID NO: 5140597 - DNA, 15 bp, Homo sapiens
acattgttattttca

SEQ ID NO: 5140598 - DNA, 17 bp, Homo sapiens
acattgttcaactccct

SEQ ID NO: 5140599 - DNA, 20 bp, Homo sapiens
acattgttcaattagaatag

SEQ ID NO: 5140600 - DNA, 20 bp, Homo sapiens
acattgttctttccggccaa

SEQ ID NO: 5140601 - DNA, 15 bp, Homo sapiens
acattgttgctccct

SEQ ID NO: 5140602 - DNA, 18 bp, Homo sapiens
acattgtttgctgctatt

SEQ ID NO: 5140603 - DNA, 16 bp, Homo sapiens
acattgttttaaaaag

SEQ ID NO: 5140604 - DNA, 18 bp, Homo sapiens
acattgttttaaaaagaa

SEQ ID NO: 5140605 - DNA, 15 bp, Homo sapiens
acattgtttttgtat

SEQ ID NO: 5140606 - DNA, 10 bp, Homo sapiens
acatttaaaa

SEQ ID NO: 5140607 - DNA, 18 bp, Homo sapiens
acatttaaaaaacatttt

SEQ ID NO: 5140608 - DNA, 14 bp, Homo sapiens
acatttaaaaataa

SEQ ID NO: 5140609 - DNA, 14 bp, Homo sapiens
acatttaaaatagt

SEQ ID NO: 5140610 - DNA, 17 bp, Homo sapiens
acatttaaacttgtcag

SEQ ID NO: 5140611 - DNA, 16 bp, Homo sapiens
acatttaaacttttta

SEQ ID NO: 5140612 - DNA, 17 bp, Homo sapiens
acatttaaagagatttc

SEQ ID NO: 5140613 - DNA, 21 bp, Homo sapiens
acatttaaataaaactttcca

SEQ ID NO: 5140614 - DNA, 14 bp, Homo sapiens
acatttaaatacaa

SEQ ID NO: 5140615 - DNA, 15 bp, Homo sapiens
acatttaaattccac

SEQ ID NO: 5140616 - DNA, 12 bp, Homo sapiens
acatttaacata

SEQ ID NO: 5140617 - DNA, 13 bp, Homo sapiens
acatttaacataa

SEQ ID NO: 5140618 - DNA, 20 bp, Homo sapiens
acatttaagagacagtcacc

SEQ ID NO: 5140619 - DNA, 21 bp, Homo sapiens
acatttaagcaggaatgcaat

SEQ ID NO: 5140620 - DNA, 13 bp, Homo sapiens
acatttaagtggt

SEQ ID NO: 5140621 - DNA, 15 bp, Homo sapiens
acatttaataaaact

SEQ ID NO: 5140622 - DNA, 20 bp, Homo sapiens
acatttaataactttgctgg

SEQ ID NO: 5140623 - DNA, 16 bp, Homo sapiens
acatttaataatcaga

SEQ ID NO: 5140624 - DNA, 18 bp, Homo sapiens
acatttaataatgtatgt

SEQ ID NO: 5140625 - DNA, 20 bp, Homo sapiens
acatttaataatgtatgtac

SEQ ID NO: 5140626 - DNA, 17 bp, Homo sapiens
acatttaatacagcagt

SEQ ID NO: 5140627 - DNA, 18 bp, Homo sapiens
acatttaatatcctgcct

SEQ ID NO: 5140628 - DNA, 15 bp, Homo sapiens
acatttacaaactga

SEQ ID NO: 5140629 - DNA, 16 bp, Homo sapiens
acatttacaataaata

SEQ ID NO: 5140630 - DNA, 13 bp, Homo sapiens
acatttacacatt

SEQ ID NO: 5140631 - DNA, 13 bp, Homo sapiens
acatttacatcaa

SEQ ID NO: 5140632 - DNA, 16 bp, Homo sapiens
acatttacatgtatta

SEQ ID NO: 5140633 - DNA, 11 bp, Homo sapiens
acatttaccaa

SEQ ID NO: 5140634 - DNA, 12 bp, Homo sapiens
acatttaccaaa

SEQ ID NO: 5140635 - DNA, 14 bp, Homo sapiens
acatttaccaaatt

SEQ ID NO: 5140636 - DNA, 18 bp, Homo sapiens
acatttaccaatcatatt

SEQ ID NO: 5140637 - DNA, 21 bp, Homo sapiens
acatttactacagtttttaac

SEQ ID NO: 5140638 - DNA, 16 bp, Homo sapiens
acatttagaaaagtga

SEQ ID NO: 5140639 - DNA, 17 bp, Homo sapiens
acatttagaaaagtgaa

SEQ ID NO: 5140640 - DNA, 17 bp, Homo sapiens
acatttagaaatgttta

SEQ ID NO: 5140641 - DNA, 21 bp, Homo sapiens
acatttagaaatgtttattga

SEQ ID NO: 5140642 - DNA, 19 bp, Homo sapiens
acatttagaacctgcattt

SEQ ID NO: 5140643 - DNA, 20 bp, Homo sapiens
acatttagctgtgctcagaa

SEQ ID NO: 5140644 - DNA, 22 bp, Homo sapiens
acatttagtaaatgctgaaata

SEQ ID NO: 5140645 - DNA, 18 bp, Homo sapiens
acatttataatgtttgct

SEQ ID NO: 5140646 - DNA, 14 bp, Homo sapiens
acatttataattgc

SEQ ID NO: 5140647 - DNA, 17 bp, Homo sapiens
acatttatagaagaaat

SEQ ID NO: 5140648 - DNA, 14 bp, Homo sapiens
acatttatatagac

SEQ ID NO: 5140649 - DNA, 16 bp, Homo sapiens
acatttatatatatat

SEQ ID NO: 5140650 - DNA, 17 bp, Homo sapiens
acatttatatatatatg

SEQ ID NO: 5140651 - DNA, 16 bp, Homo sapiens
acatttatatttgtgt

SEQ ID NO: 5140652 - DNA, 15 bp, Homo sapiens
acatttatcttctgt

SEQ ID NO: 5140653 - DNA, 17 bp, Homo sapiens
acatttatcttctgttt

SEQ ID NO: 5140654 - DNA, 19 bp, Homo sapiens
acatttatcttctgttttt

SEQ ID NO: 5140655 - DNA, 20 bp, Homo sapiens
acatttatcttctgtttttc

SEQ ID NO: 5140656 - DNA, 22 bp, Homo sapiens
acatttatcttctgtttttctc

SEQ ID NO: 5140657 - DNA, 12 bp, Homo sapiens
acatttatgacc

SEQ ID NO: 5140658 - DNA, 14 bp, Homo sapiens
acatttatgtacaa

SEQ ID NO: 5140659 - DNA, 11 bp, Homo sapiens
acatttatgtg

SEQ ID NO: 5140660 - DNA, 15 bp, Homo sapiens
acatttatgtgttga

SEQ ID NO: 5140661 - DNA, 22 bp, Homo sapiens
acatttatgtgttgataatttt

SEQ ID NO: 5140662 - DNA, 22 bp, Homo sapiens
acatttatgttcctttatttag

SEQ ID NO: 5140663 - DNA, 22 bp, Homo sapiens
acatttatgttccttttaaaga

SEQ ID NO: 5140664 - DNA, 15 bp, Homo sapiens
acatttattctgctc

SEQ ID NO: 5140665 - DNA, 20 bp, Homo sapiens
acatttattttatgagaaat

SEQ ID NO: 5140666 - DNA, 22 bp, Homo sapiens
acatttattttatgagaaatgt

SEQ ID NO: 5140667 - DNA, 21 bp, Homo sapiens
acatttattttgagaagctct

SEQ ID NO: 5140668 - DNA, 11 bp, Homo sapiens
acatttcaaaa

SEQ ID NO: 5140669 - DNA, 13 bp, Homo sapiens
acatttcaaaact

SEQ ID NO: 5140670 - DNA, 14 bp, Homo sapiens
acatttcaaagttt

SEQ ID NO: 5140671 - DNA, 17 bp, Homo sapiens
acatttcaaattgaatt

SEQ ID NO: 5140672 - DNA, 20 bp, Homo sapiens
acatttcaccatggccccct

SEQ ID NO: 5140673 - DNA, 20 bp, Homo sapiens
acatttcacctactttgtaa

SEQ ID NO: 5140674 - DNA, 24 bp, Homo sapiens
acatttcacctactttgtaagtga

SEQ ID NO: 5140675 - DNA, 14 bp, Homo sapiens
acatttcacctcct

SEQ ID NO: 5140676 - DNA, 15 bp, Homo sapiens
acatttcactgtctg

SEQ ID NO: 5140677 - DNA, 16 bp, Homo sapiens
acatttcacttttctg

SEQ ID NO: 5140678 - DNA, 17 bp, Homo sapiens
acatttcacttttctgt

SEQ ID NO: 5140679 - DNA, 14 bp, Homo sapiens
acatttcagggaga

SEQ ID NO: 5140680 - DNA, 15 bp, Homo sapiens
acatttcagggagaa

SEQ ID NO: 5140681 - DNA, 23 bp, Homo sapiens
acatttcagggagaaactccaaa

SEQ ID NO: 5140682 - DNA, 21 bp, Homo sapiens
acatttcataaggcctgccct

SEQ ID NO: 5140683 - DNA, 21 bp, Homo sapiens
accagtctatttccactgaac

SEQ ID NO: 5140684 - DNA, 23 bp, Homo sapiens
accagtctgaagtttcatttatg

SEQ ID NO: 5140685 - DNA, 13 bp, Homo sapiens
accagtcttctcc

SEQ ID NO: 5140686 - DNA, 19 bp, Homo sapiens
accagtctttaaaggccca

SEQ ID NO: 5140687 - DNA, 15 bp, Homo sapiens
accagtgaaaattga

SEQ ID NO: 5140688 - DNA, 14 bp, Homo sapiens
accagtgaaccaaa

SEQ ID NO: 5140689 - DNA, 13 bp, Homo sapiens
accagtgaatttt

SEQ ID NO: 5140690 - DNA, 18 bp, Homo sapiens
accagtgaatttttgcaa

SEQ ID NO: 5140691 - DNA, 22 bp, Homo sapiens
accagtgaatttttgcaataat

SEQ ID NO: 5140692 - DNA, 16 bp, Homo sapiens
accagtgaccccagaa

SEQ ID NO: 5140693 - DNA, 22 bp, Homo sapiens
accagtgaccccagaaaagcat

SEQ ID NO: 5140694 - DNA, 12 bp, Homo sapiens
accagtgacttt

SEQ ID NO: 5140695 - DNA, 20 bp, Homo sapiens
accagtgagaactctctccc

SEQ ID NO: 5140696 - DNA, 17 bp, Homo sapiens
accagtgcaacagcact

SEQ ID NO: 5140697 - DNA, 13 bp, Homo sapiens
accagtgcaggct

SEQ ID NO: 5140698 - DNA, 16 bp, Homo sapiens
accagtgcaggctggc

SEQ ID NO: 5140699 - DNA, 20 bp, Homo sapiens
accagtgcatcacatctgca

SEQ ID NO: 5140700 - DNA, 20 bp, Homo sapiens
accagtgccacgtcatgagc

SEQ ID NO: 5140701 - DNA, 22 bp, Homo sapiens
accagtgccacgtcatgagcgt

SEQ ID NO: 5140702 - DNA, 19 bp, Homo sapiens
accagtgccgcctgtgccc

SEQ ID NO: 5140703 - DNA, 17 bp, Homo sapiens
accagtgcctcagtgct

SEQ ID NO: 5140704 - DNA, 18 bp, Homo sapiens
accagtgcctcagtgctg

SEQ ID NO: 5140705 - DNA, 21 bp, Homo sapiens
accagtgcctctccctgctgc

SEQ ID NO: 5140706 - DNA, 12 bp, Homo sapiens
accagtggacct

SEQ ID NO: 5140707 - DNA, 17 bp, Homo sapiens
accagtgggatgggctc

SEQ ID NO: 5140708 - DNA, 16 bp, Homo sapiens
accagtgggtctggtg

SEQ ID NO: 5140709 - DNA, 19 bp, Homo sapiens
accagtggtctggaaacag

SEQ ID NO: 5140710 - DNA, 23 bp, Homo sapiens
accagtggtgctcaatgcaaata

SEQ ID NO: 5140711 - DNA, 20 bp, Homo sapiens
accagtgtaaattcagtctt

SEQ ID NO: 5140712 - DNA, 19 bp, Homo sapiens
accagtgtaactggctgct

SEQ ID NO: 5140713 - DNA, 20 bp, Homo sapiens
accagtgtaactggctgctc

SEQ ID NO: 5140714 - DNA, 21 bp, Homo sapiens
accagtgtaactggctgctcc

SEQ ID NO: 5140715 - DNA, 23 bp, Homo sapiens
accagtgtaactggctgctccct

SEQ ID NO: 5140716 - DNA, 20 bp, Homo sapiens
accagtgtagcatcttcctc

SEQ ID NO: 5140717 - DNA, 21 bp, Homo sapiens
accagtgtagcatcttcctct

SEQ ID NO: 5140718 - DNA, 13 bp, Homo sapiens
accagtgtagcct

SEQ ID NO: 5140719 - DNA, 16 bp, Homo sapiens
accagtgtagccttgc

SEQ ID NO: 5140720 - DNA, 13 bp, Homo sapiens
accagtgtcccct

SEQ ID NO: 5140721 - DNA, 18 bp, Homo sapiens
accagtgtcccctccact

SEQ ID NO: 5140722 - DNA, 20 bp, Homo sapiens
accagtgtcctccaagtgcc

SEQ ID NO: 5140723 - DNA, 13 bp, Homo sapiens
accagtgtgaacc

SEQ ID NO: 5140724 - DNA, 12 bp, Homo sapiens
accagtgtgtgg

SEQ ID NO: 5140725 - DNA, 13 bp, Homo sapiens
accagtgttagct

SEQ ID NO: 5140726 - DNA, 22 bp, Homo sapiens
accagtgttagggaagggcctg

SEQ ID NO: 5140727 - DNA, 17 bp, Homo sapiens
accagtgttagtgggaa

SEQ ID NO: 5140728 - DNA, 19 bp, Homo sapiens
accagtgttagtgggaaga

SEQ ID NO: 5140729 - DNA, 23 bp, Homo sapiens
accagtgttagtgggaagagctg

SEQ ID NO: 5140730 - DNA, 20 bp, Homo sapiens
accagtgttcctgaagctgc

SEQ ID NO: 5140731 - DNA, 15 bp, Homo sapiens
accagttaaagccac

SEQ ID NO: 5140732 - DNA, 18 bp, Homo sapiens
accagttaaagccacaga

SEQ ID NO: 5140733 - DNA, 18 bp, Homo sapiens
accagttaacgtattagt

SEQ ID NO: 5140734 - DNA, 23 bp, Homo sapiens
accagttaacgtattagttgcca

SEQ ID NO: 5140735 - DNA, 14 bp, Homo sapiens
accagttaattact

SEQ ID NO: 5140736 - DNA, 12 bp, Homo sapiens
accagttaattt

SEQ ID NO: 5140737 - DNA, 14 bp, Homo sapiens
accagttaattttt

SEQ ID NO: 5140738 - DNA, 14 bp, Homo sapiens
accagttataaata

SEQ ID NO: 5140739 - DNA, 20 bp, Homo sapiens
accagttatgtttgaatgaa

SEQ ID NO: 5140740 - DNA, 17 bp, Homo sapiens
accagttcagacactac

SEQ ID NO: 5140741 - DNA, 20 bp, Homo sapiens
accagttccctcagccctca

SEQ ID NO: 5140742 - DNA, 22 bp, Homo sapiens
accagttctggccaggagctgg

SEQ ID NO: 5140743 - DNA, 15 bp, Homo sapiens
accagttctgggcaa

SEQ ID NO: 5140744 - DNA, 13 bp, Homo sapiens
accagttcttgca

SEQ ID NO: 5140745 - DNA, 17 bp, Homo sapiens
accagttcttgcaataa

SEQ ID NO: 5140746 - DNA, 18 bp, Homo sapiens
accagttcttgcaataag

SEQ ID NO: 5140747 - DNA, 23 bp, Homo sapiens
accagttgcactacataatctct

SEQ ID NO: 5140748 - DNA, 15 bp, Homo sapiens
accagttgctgctgc

SEQ ID NO: 5140749 - DNA, 14 bp, Homo sapiens
accagttgctgctt

SEQ ID NO: 5140750 - DNA, 15 bp, Homo sapiens
accagttgggagcac

SEQ ID NO: 5140751 - DNA, 15 bp, Homo sapiens
accagttgtatttaa

SEQ ID NO: 5140752 - DNA, 20 bp, Homo sapiens
accagtttaacctgatgcag

SEQ ID NO: 5140753 - DNA, 21 bp, Homo sapiens
accagtttaacctgatgcagt

SEQ ID NO: 5140754 - DNA, 23 bp, Homo sapiens
accagtttaagccgcagacctgg

SEQ ID NO: 5140755 - DNA, 11 bp, Homo sapiens
accagtttacc

SEQ ID NO: 5140756 - DNA, 15 bp, Homo sapiens
accagtttatacaga

SEQ ID NO: 5140757 - DNA, 16 bp, Homo sapiens
accagtttatacagaa

SEQ ID NO: 5140758 - DNA, 12 bp, Homo sapiens
accagtttatgt

SEQ ID NO: 5140759 - DNA, 20 bp, Homo sapiens
accagtttcacataagttat

SEQ ID NO: 5140760 - DNA, 17 bp, Homo sapiens
accagtttcttaaactg

SEQ ID NO: 5140761 - DNA, 12 bp, Homo sapiens
accagtttcttt

SEQ ID NO: 5140762 - DNA, 16 bp, Homo sapiens
accagtttgcagagtg

SEQ ID NO: 5140763 - DNA, 12 bp, Homo sapiens
accagtttgcat

SEQ ID NO: 5140764 - DNA, 14 bp, Homo sapiens
accagtttgcatga

SEQ ID NO: 5140765 - DNA, 18 bp, Homo sapiens
accagtttgtccatcttg

SEQ ID NO: 5140766 - DNA, 20 bp, Homo sapiens
accagttttgagtgtactgt

SEQ ID NO: 5140767 - DNA, 20 bp, Homo sapiens
accataaaaccctatacaag

SEQ ID NO: 5140768 - DNA, 16 bp, Homo sapiens
accataaaataaataa

SEQ ID NO: 5140769 - DNA, 18 bp, Homo sapiens
accataaaataaataatc

SEQ ID NO: 5140770 - DNA, 18 bp, Homo sapiens
accataaacatttgccaa

SEQ ID NO: 5140771 - DNA, 19 bp, Homo sapiens
accataaagcctttaaaac

SEQ ID NO: 5140772 - DNA, 13 bp, Homo sapiens
accataaatcaat

SEQ ID NO: 5140773 - DNA, 13 bp, Homo sapiens
accataacccagg

SEQ ID NO: 5140774 - DNA, 13 bp, Homo sapiens
accataagagaaa

SEQ ID NO: 5140775 - DNA, 15 bp, Homo sapiens
accataagagaaacc

SEQ ID NO: 5140776 - DNA, 18 bp, Homo sapiens
accataagctactgccat

SEQ ID NO: 5140777 - DNA, 22 bp, Homo sapiens
accataagctactgccatcctg

SEQ ID NO: 5140778 - DNA, 21 bp, Homo sapiens
accataagggactgtgccaga

SEQ ID NO: 5140779 - DNA, 19 bp, Homo sapiens
accataatccctgtcttct

SEQ ID NO: 5140780 - DNA, 13 bp, Homo sapiens
accataatgagat

SEQ ID NO: 5140781 - DNA, 19 bp, Homo sapiens
accataatgagatgtgagc

SEQ ID NO: 5140782 - DNA, 18 bp, Homo sapiens
accataattttttttaaa

SEQ ID NO: 5140783 - DNA, 16 bp, Homo sapiens
accatacattatttct

SEQ ID NO: 5140784 - DNA, 21 bp, Homo sapiens
accatactaataaatataatt

SEQ ID NO: 5140785 - DNA, 21 bp, Homo sapiens
accatactaattataccccct

SEQ ID NO: 5140786 - DNA, 17 bp, Homo sapiens
accatactcatttctaa

SEQ ID NO: 5140787 - DNA, 15 bp, Homo sapiens
accatactgagggac

SEQ ID NO: 5140788 - DNA, 17 bp, Homo sapiens
accatactgtctctgga

SEQ ID NO: 5140789 - DNA, 12 bp, Homo sapiens
accatagaaaaa

SEQ ID NO: 5140790 - DNA, 15 bp, Homo sapiens
accatagaaaaatgt

SEQ ID NO: 5140791 - DNA, 16 bp, Homo sapiens
accatagaaaaatgta

SEQ ID NO: 5140792 - DNA, 20 bp, Homo sapiens
accatagaaaaatgtataaa

SEQ ID NO: 5140793 - DNA, 15 bp, Homo sapiens
accatagctacatca

SEQ ID NO: 5140794 - DNA, 15 bp, Homo sapiens
accatagcttaagaa

SEQ ID NO: 5140795 - DNA, 16 bp, Homo sapiens
accataggaagacata

SEQ ID NO: 5140796 - DNA, 19 bp, Homo sapiens
accatagtgttcattgata

SEQ ID NO: 5140797 - DNA, 15 bp, Homo sapiens
accatagttactgta

SEQ ID NO: 5140798 - DNA, 22 bp, Homo sapiens
accatagttatttacttgaaag

SEQ ID NO: 5140799 - DNA, 18 bp, Homo sapiens
accatataactgtgatga

SEQ ID NO: 5140800 - DNA, 17 bp, Homo sapiens
accatatagcaaaactt

SEQ ID NO: 5140801 - DNA, 14 bp, Homo sapiens
accatatgaatgaa

SEQ ID NO: 5140802 - DNA, 15 bp, Homo sapiens
accatatgaatgaaa

SEQ ID NO: 5140803 - DNA, 15 bp, Homo sapiens
accatatgattgaaa

SEQ ID NO: 5140804 - DNA, 19 bp, Homo sapiens
accatatgattgaaaagaa

SEQ ID NO: 5140805 - DNA, 23 bp, Homo sapiens
accatatgattgaaaagaagaaa

SEQ ID NO: 5140806 - DNA, 19 bp, Homo sapiens
accatatgcccacatttag

SEQ ID NO: 5140807 - DNA, 20 bp, Homo sapiens
accatatggatattagtcat

SEQ ID NO: 5140808 - DNA, 14 bp, Homo sapiens
accatatgtagcat

SEQ ID NO: 5140809 - DNA, 16 bp, Homo sapiens
accatatgtagcatta

SEQ ID NO: 5140810 - DNA, 13 bp, Homo sapiens
accatattctaag

SEQ ID NO: 5140811 - DNA, 23 bp, Homo sapiens
accatattctaagttagactctt

SEQ ID NO: 5140812 - DNA, 23 bp, Homo sapiens
accatattgctcttaaaaatctt

SEQ ID NO: 5140813 - DNA, 15 bp, Homo sapiens
accatatttagcagt

SEQ ID NO: 5140814 - DNA, 14 bp, Homo sapiens
accatcaagccacc

SEQ ID NO: 5140815 - DNA, 15 bp, Homo sapiens
accatcaagccacca

SEQ ID NO: 5140816 - DNA, 12 bp, Homo sapiens
accatcaataaa

SEQ ID NO: 5140817 - DNA, 18 bp, Homo sapiens
accatcacaatacagata

SEQ ID NO: 5140818 - DNA, 14 bp, Homo sapiens
accatcacacatgc

SEQ ID NO: 5140819 - DNA, 16 bp, Homo sapiens
accatcacagcttgtt

SEQ ID NO: 5140820 - DNA, 13 bp, Homo sapiens
accatcaccaccg

SEQ ID NO: 5140821 - DNA, 21 bp, Homo sapiens
accatcaccaccgcctctggc

SEQ ID NO: 5140822 - DNA, 14 bp, Homo sapiens
accatcaccctctg

SEQ ID NO: 5140823 - DNA, 15 bp, Homo sapiens
accatcactcactca

SEQ ID NO: 5140824 - DNA, 22 bp, Homo sapiens
accatcactgagagtcaggagt

SEQ ID NO: 5140825 - DNA, 20 bp, Homo sapiens
accatcagaaacaccctcac

SEQ ID NO: 5140826 - DNA, 13 bp, Homo sapiens
accatcagctctg

SEQ ID NO: 5140827 - DNA, 13 bp, Homo sapiens
accatcagttact

SEQ ID NO: 5140828 - DNA, 16 bp, Homo sapiens
accatcagttactggt

SEQ ID NO: 5140829 - DNA, 12 bp, Homo sapiens
accatcatccta

SEQ ID NO: 5140830 - DNA, 13 bp, Homo sapiens
accatcatgccct

SEQ ID NO: 5140831 - DNA, 20 bp, Homo sapiens
accatcatgtttcagtgaag

SEQ ID NO: 5140832 - DNA, 15 bp, Homo sapiens
accatcattgaaatc

SEQ ID NO: 5140833 - DNA, 19 bp, Homo sapiens
accatcatttaatttctaa

SEQ ID NO: 5140834 - DNA, 13 bp, Homo sapiens
accatcattttat

SEQ ID NO: 5140835 - DNA, 16 bp, Homo sapiens
accatcattttattat

SEQ ID NO: 5140836 - DNA, 18 bp, Homo sapiens
accatccaccctgcaggc

SEQ ID NO: 5140837 - DNA, 14 bp, Homo sapiens
accatccaccttcc

SEQ ID NO: 5140838 - DNA, 18 bp, Homo sapiens
accatccaccttcccttc

SEQ ID NO: 5140839 - DNA, 23 bp, Homo sapiens
accatccactctaccctcccacc

SEQ ID NO: 5140840 - DNA, 19 bp, Homo sapiens
accatccagagaccaaata

SEQ ID NO: 5140841 - DNA, 12 bp, Homo sapiens
accatccagctc

SEQ ID NO: 5140842 - DNA, 17 bp, Homo sapiens
accatccagctccccag

SEQ ID NO: 5140843 - DNA, 15 bp, Homo sapiens
accatccatccctgg

SEQ ID NO: 5140844 - DNA, 13 bp, Homo sapiens
accatcccactga

SEQ ID NO: 5140845 - DNA, 14 bp, Homo sapiens
accatccccaactc

SEQ ID NO: 5140846 - DNA, 17 bp, Homo sapiens
accatccccgcacaaag

SEQ ID NO: 5140847 - DNA, 16 bp, Homo sapiens
accatccctgatggca

SEQ ID NO: 5140848 - DNA, 20 bp, Homo sapiens
accatccctttttgaagtgt

SEQ ID NO: 5140849 - DNA, 17 bp, Homo sapiens
accatccgccagggccc

SEQ ID NO: 5140850 - DNA, 18 bp, Homo sapiens
accatcctaggctgacac

SEQ ID NO: 5140851 - DNA, 16 bp, Homo sapiens
accatcctatttaact

SEQ ID NO: 5140852 - DNA, 24 bp, Homo sapiens
accatcctcagaggctgagccctg

SEQ ID NO: 5140853 - DNA, 13 bp, Homo sapiens
accatcctgagcc

SEQ ID NO: 5140854 - DNA, 17 bp, Homo sapiens
accatcctgcagcctcc

SEQ ID NO: 5140855 - DNA, 14 bp, Homo sapiens
accatcctggcccc

SEQ ID NO: 5140856 - DNA, 22 bp, Homo sapiens
accatcctggctaacatggtga

SEQ ID NO: 5140857 - DNA, 13 bp, Homo sapiens
accatcctggctg

SEQ ID NO: 5140858 - DNA, 14 bp, Homo sapiens
accatccttccatc

SEQ ID NO: 5140859 - DNA, 16 bp, Homo sapiens
accatccttccatcct

SEQ ID NO: 5140860 - DNA, 13 bp, Homo sapiens
accatcgcctctg

SEQ ID NO: 5140861 - DNA, 20 bp, Homo sapiens
accatcgctggcccctttgg

SEQ ID NO: 5140862 - DNA, 15 bp, Homo sapiens
accatcgtccagccc

SEQ ID NO: 5140863 - DNA, 21 bp, Homo sapiens
acatttcatccaccaatatca

SEQ ID NO: 5140864 - DNA, 12 bp, Homo sapiens
acatttcatccg

SEQ ID NO: 5140865 - DNA, 20 bp, Homo sapiens
acatttcatgtagtaagatt

SEQ ID NO: 5140866 - DNA, 14 bp, Homo sapiens
acatttcatgtatt

SEQ ID NO: 5140867 - DNA, 15 bp, Homo sapiens
acatttcattagcca

SEQ ID NO: 5140868 - DNA, 18 bp, Homo sapiens
acatttcattgtacaagt

SEQ ID NO: 5140869 - DNA, 14 bp, Homo sapiens
acatttccaagctg

SEQ ID NO: 5140870 - DNA, 22 bp, Homo sapiens
acatttccattcatggatattt

SEQ ID NO: 5140871 - DNA, 13 bp, Homo sapiens
acatttcccaggg

SEQ ID NO: 5140872 - DNA, 12 bp, Homo sapiens
acatttccttta

SEQ ID NO: 5140873 - DNA, 15 bp, Homo sapiens
acatttcctttgaac

SEQ ID NO: 5140874 - DNA, 15 bp, Homo sapiens
acatttcgtacaaaa

SEQ ID NO: 5140875 - DNA, 17 bp, Homo sapiens
acatttcgttttttaca

SEQ ID NO: 5140876 - DNA, 12 bp, Homo sapiens
acatttctaact

SEQ ID NO: 5140877 - DNA, 14 bp, Homo sapiens
acatttctaactct

SEQ ID NO: 5140878 - DNA, 15 bp, Homo sapiens
acatttctaagacta

SEQ ID NO: 5140879 - DNA, 12 bp, Homo sapiens
acatttctataa

SEQ ID NO: 5140880 - DNA, 16 bp, Homo sapiens
acatttctataaaaat

SEQ ID NO: 5140881 - DNA, 21 bp, Homo sapiens
acatttctataaaaatactac

SEQ ID NO: 5140882 - DNA, 20 bp, Homo sapiens
acatttctatagccaaaaat

SEQ ID NO: 5140883 - DNA, 12 bp, Homo sapiens
acatttctcaat

SEQ ID NO: 5140884 - DNA, 16 bp, Homo sapiens
acatttctcactgaaa

SEQ ID NO: 5140885 - DNA, 14 bp, Homo sapiens
acatttctcatgtg

SEQ ID NO: 5140886 - DNA, 16 bp, Homo sapiens
acatttctcatgttga

SEQ ID NO: 5140887 - DNA, 22 bp, Homo sapiens
acatttctcctttgataaaata

SEQ ID NO: 5140888 - DNA, 22 bp, Homo sapiens
acatttctctaactcctgccat

SEQ ID NO: 5140889 - DNA, 14 bp, Homo sapiens
acatttctctccac

SEQ ID NO: 5140890 - DNA, 16 bp, Homo sapiens
acatttctctccacct

SEQ ID NO: 5140891 - DNA, 21 bp, Homo sapiens
acatttctcttccccttagaa

SEQ ID NO: 5140892 - DNA, 23 bp, Homo sapiens
acatttctgaattgttggggttt

SEQ ID NO: 5140893 - DNA, 13 bp, Homo sapiens
acatttctgacac

SEQ ID NO: 5140894 - DNA, 13 bp, Homo sapiens
acatttctgattc

SEQ ID NO: 5140895 - DNA, 14 bp, Homo sapiens
acatttctgattct

SEQ ID NO: 5140896 - DNA, 20 bp, Homo sapiens
acatttctggccatttaact

SEQ ID NO: 5140897 - DNA, 18 bp, Homo sapiens
acatttctgtaaatacca

SEQ ID NO: 5140898 - DNA, 17 bp, Homo sapiens
acatttcttaaaacaca

SEQ ID NO: 5140899 - DNA, 15 bp, Homo sapiens
acatttcttaaatta

SEQ ID NO: 5140900 - DNA, 19 bp, Homo sapiens
acatttcttctagtgatga

SEQ ID NO: 5140901 - DNA, 14 bp, Homo sapiens
acatttcttttaaa

SEQ ID NO: 5140902 - DNA, 22 bp, Homo sapiens
acatttcttttctttttacata

SEQ ID NO: 5140903 - DNA, 13 bp, Homo sapiens
acatttgaaaata

SEQ ID NO: 5140904 - DNA, 13 bp, Homo sapiens
acatttgaattct

SEQ ID NO: 5140905 - DNA, 18 bp, Homo sapiens
acatttgagtatccgatt

SEQ ID NO: 5140906 - DNA, 19 bp, Homo sapiens
acatttgagtcccttccag

SEQ ID NO: 5140907 - DNA, 13 bp, Homo sapiens
acatttgataatt

SEQ ID NO: 5140908 - DNA, 19 bp, Homo sapiens
acatttgatatttttccat

SEQ ID NO: 5140909 - DNA, 18 bp, Homo sapiens
acatttgatgtacatgtg

SEQ ID NO: 5140910 - DNA, 20 bp, Homo sapiens
acatttgattaataaaatat

SEQ ID NO: 5140911 - DNA, 22 bp, Homo sapiens
acatttgcaaaatggaaatgta

SEQ ID NO: 5140912 - DNA, 12 bp, Homo sapiens
acatttgcaatt

SEQ ID NO: 5140913 - DNA, 13 bp, Homo sapiens
acatttgcatgcc

SEQ ID NO: 5140914 - DNA, 15 bp, Homo sapiens
acatttgccaagtga

SEQ ID NO: 5140915 - DNA, 19 bp, Homo sapiens
acatttgcccaattccagg

SEQ ID NO: 5140916 - DNA, 13 bp, Homo sapiens
acatttgccttgc

SEQ ID NO: 5140917 - DNA, 14 bp, Homo sapiens
acatttgccttgca

SEQ ID NO: 5140918 - DNA, 21 bp, Homo sapiens
acatttgccttgcagaactgc

SEQ ID NO: 5140919 - DNA, 21 bp, Homo sapiens
acatttggaaaagacagaaaa

SEQ ID NO: 5140920 - DNA, 20 bp, Homo sapiens
acatttggaactaacacgtg

SEQ ID NO: 5140921 - DNA, 16 bp, Homo sapiens
acatttggaatacttt

SEQ ID NO: 5140922 - DNA, 18 bp, Homo sapiens
acatttggaatacttttt

SEQ ID NO: 5140923 - DNA, 22 bp, Homo sapiens
acatttggaggcaatcctacct

SEQ ID NO: 5140924 - DNA, 15 bp, Homo sapiens
acatttggagtgttc

SEQ ID NO: 5140925 - DNA, 19 bp, Homo sapiens
acatttggataaacaacat

SEQ ID NO: 5140926 - DNA, 17 bp, Homo sapiens
acatttggccacaaaac

SEQ ID NO: 5140927 - DNA, 14 bp, Homo sapiens
acatttggctccac

SEQ ID NO: 5140928 - DNA, 20 bp, Homo sapiens
acatttggcttacagtaaat

SEQ ID NO: 5140929 - DNA, 17 bp, Homo sapiens
acatttgggagacatgt

SEQ ID NO: 5140930 - DNA, 22 bp, Homo sapiens
acatttgggagactgagcttga

SEQ ID NO: 5140931 - DNA, 13 bp, Homo sapiens
acatttgggctca

SEQ ID NO: 5140932 - DNA, 17 bp, Homo sapiens
acatttgggctcagggt

SEQ ID NO: 5140933 - DNA, 21 bp, Homo sapiens
acatttgggttggttccaagt

SEQ ID NO: 5140934 - DNA, 14 bp, Homo sapiens
acatttggtaatgt

SEQ ID NO: 5140935 - DNA, 19 bp, Homo sapiens
acatttggtaatgttttta

SEQ ID NO: 5140936 - DNA, 20 bp, Homo sapiens
acatttgtaaaaatactgtt

SEQ ID NO: 5140937 - DNA, 21 bp, Homo sapiens
acatttgtaaaaatactgttt

SEQ ID NO: 5140938 - DNA, 16 bp, Homo sapiens
acatttgtatattgtg

SEQ ID NO: 5140939 - DNA, 14 bp, Homo sapiens
acatttgtatttat

SEQ ID NO: 5140940 - DNA, 20 bp, Homo sapiens
acatttgtattttgtgatga

SEQ ID NO: 5140941 - DNA, 15 bp, Homo sapiens
acatttgtcacagaa

SEQ ID NO: 5140942 - DNA, 18 bp, Homo sapiens
acatttgtcactgaataa

SEQ ID NO: 5140943 - DNA, 16 bp, Homo sapiens
acatttgtcagtattt

SEQ ID NO: 5140944 - DNA, 14 bp, Homo sapiens
acatttgtcatttt

SEQ ID NO: 5140945 - DNA, 19 bp, Homo sapiens
acatttgtcattttcatta

SEQ ID NO: 5140946 - DNA, 22 bp, Homo sapiens
acatttgtcattttcattagca

SEQ ID NO: 5140947 - DNA, 12 bp, Homo sapiens
acatttgtgaga

SEQ ID NO: 5140948 - DNA, 19 bp, Homo sapiens
acatttgtgatatatgtat

SEQ ID NO: 5140949 - DNA, 22 bp, Homo sapiens
acatttgtgcataaatttccac

SEQ ID NO: 5140950 - DNA, 21 bp, Homo sapiens
acatttgtgtaaacagtgttt

SEQ ID NO: 5140951 - DNA, 20 bp, Homo sapiens
acatttgtgtaatatgaaat

SEQ ID NO: 5140952 - DNA, 21 bp, Homo sapiens
acatttgtgtcactgtacagt

SEQ ID NO: 5140953 - DNA, 22 bp, Homo sapiens
acatttgttctgggttaacagt

SEQ ID NO: 5140954 - DNA, 14 bp, Homo sapiens
acatttgtttcccc

SEQ ID NO: 5140955 - DNA, 16 bp, Homo sapiens
acatttgtttgctgta

SEQ ID NO: 5140956 - DNA, 23 bp, Homo sapiens
acatttgtttggttatagtgcaa

SEQ ID NO: 5140957 - DNA, 17 bp, Homo sapiens
acatttgtttgtattca

SEQ ID NO: 5140958 - DNA, 17 bp, Homo sapiens
acattttaaaaaacaaa

SEQ ID NO: 5140959 - DNA, 23 bp, Homo sapiens
acattttaaaaacatagaaaaat

SEQ ID NO: 5140960 - DNA, 19 bp, Homo sapiens
acattttaaaagtgccatt

SEQ ID NO: 5140961 - DNA, 23 bp, Homo sapiens
acattttaaaatgtttaaattct

SEQ ID NO: 5140962 - DNA, 15 bp, Homo sapiens
acattttaaaggata

SEQ ID NO: 5140963 - DNA, 17 bp, Homo sapiens
acattttaaaggataat

SEQ ID NO: 5140964 - DNA, 11 bp, Homo sapiens
acattttaaca

SEQ ID NO: 5140965 - DNA, 12 bp, Homo sapiens
acattttaacaa

SEQ ID NO: 5140966 - DNA, 18 bp, Homo sapiens
acattttaacaagaagat

SEQ ID NO: 5140967 - DNA, 19 bp, Homo sapiens
acattttaatgcacctgaa

SEQ ID NO: 5140968 - DNA, 14 bp, Homo sapiens
acattttaatgggt

SEQ ID NO: 5140969 - DNA, 13 bp, Homo sapiens
acattttaattca

SEQ ID NO: 5140970 - DNA, 14 bp, Homo sapiens
acattttacagtaa

SEQ ID NO: 5140971 - DNA, 19 bp, Homo sapiens
acattttacagtaaatgtt

SEQ ID NO: 5140972 - DNA, 15 bp, Homo sapiens
acattttactgttgt

SEQ ID NO: 5140973 - DNA, 21 bp, Homo sapiens
acattttactgttgtacaatc

SEQ ID NO: 5140974 - DNA, 18 bp, Homo sapiens
acattttactttttcctg

SEQ ID NO: 5140975 - DNA, 18 bp, Homo sapiens
acattttagaatgtcaat

SEQ ID NO: 5140976 - DNA, 19 bp, Homo sapiens
acattttagaatgtcaata

SEQ ID NO: 5140977 - DNA, 18 bp, Homo sapiens
acattttagctctattga

SEQ ID NO: 5140978 - DNA, 22 bp, Homo sapiens
acattttaggatctcgcctgga

SEQ ID NO: 5140979 - DNA, 15 bp, Homo sapiens
acattttataaaaca

SEQ ID NO: 5140980 - DNA, 16 bp, Homo sapiens
acattttataaagtta

SEQ ID NO: 5140981 - DNA, 18 bp, Homo sapiens
acattttataaagttatg

SEQ ID NO: 5140982 - DNA, 14 bp, Homo sapiens
acattttataattt

SEQ ID NO: 5140983 - DNA, 17 bp, Homo sapiens
acattttatactgtaca

SEQ ID NO: 5140984 - DNA, 19 bp, Homo sapiens
acattttatcattaaaaat

SEQ ID NO: 5140985 - DNA, 13 bp, Homo sapiens
acattttatgtct

SEQ ID NO: 5140986 - DNA, 10 bp, Homo sapiens
acattttatt

SEQ ID NO: 5140987 - DNA, 13 bp, Homo sapiens
acattttattaag

SEQ ID NO: 5140988 - DNA, 14 bp, Homo sapiens
acattttcaagaca

SEQ ID NO: 5140989 - DNA, 20 bp, Homo sapiens
acattttcaaggactatttt

SEQ ID NO: 5140990 - DNA, 21 bp, Homo sapiens
acattttcagaagttaacatc

SEQ ID NO: 5140991 - DNA, 17 bp, Homo sapiens
acattttcatgcttcca

SEQ ID NO: 5140992 - DNA, 17 bp, Homo sapiens
acattttccatatttgg

SEQ ID NO: 5140993 - DNA, 20 bp, Homo sapiens
acattttccatatttggatg

SEQ ID NO: 5140994 - DNA, 21 bp, Homo sapiens
acattttccgcccactcctgg

SEQ ID NO: 5140995 - DNA, 22 bp, Homo sapiens
acattttcctcacacccacctg

SEQ ID NO: 5140996 - DNA, 19 bp, Homo sapiens
acattttccttttcaaata

SEQ ID NO: 5140997 - DNA, 15 bp, Homo sapiens
acattttcgtcctgt

SEQ ID NO: 5140998 - DNA, 12 bp, Homo sapiens
acattttctaaa

SEQ ID NO: 5140999 - DNA, 16 bp, Homo sapiens
acattttctaaataaa

SEQ ID NO: 5141000 - DNA, 11 bp, Homo sapiens
acattttctcc

SEQ ID NO: 5141001 - DNA, 22 bp, Homo sapiens
acattttctctcgttaattttc

SEQ ID NO: 5141002 - DNA, 12 bp, Homo sapiens
acattttctctt

SEQ ID NO: 5141003 - DNA, 16 bp, Homo sapiens
acattttctcttagaa

SEQ ID NO: 5141004 - DNA, 17 bp, Homo sapiens
acattttctcttagaaa

SEQ ID NO: 5141005 - DNA, 18 bp, Homo sapiens
acattttctcttagaaaa

SEQ ID NO: 5141006 - DNA, 22 bp, Homo sapiens
acattttcttttattatcagtt

SEQ ID NO: 5141007 - DNA, 20 bp, Homo sapiens
acattttcttttgttcttga

SEQ ID NO: 5141008 - DNA, 12 bp, Homo sapiens
acattttgaagt

SEQ ID NO: 5141009 - DNA, 19 bp, Homo sapiens
acattttgagaacaaagat

SEQ ID NO: 5141010 - DNA, 14 bp, Homo sapiens
acattttgatttcc

SEQ ID NO: 5141011 - DNA, 20 bp, Homo sapiens
acattttgcagctatggaca

SEQ ID NO: 5141012 - DNA, 14 bp, Homo sapiens
acattttgccaaaa

SEQ ID NO: 5141013 - DNA, 13 bp, Homo sapiens
acattttgccttt

SEQ ID NO: 5141014 - DNA, 13 bp, Homo sapiens
acattttggaaat

SEQ ID NO: 5141015 - DNA, 15 bp, Homo sapiens
acattttggaaattg

SEQ ID NO: 5141016 - DNA, 16 bp, Homo sapiens
acattttggaaattgt

SEQ ID NO: 5141017 - DNA, 20 bp, Homo sapiens
acattttggatttctttata

SEQ ID NO: 5141018 - DNA, 17 bp, Homo sapiens
acattttggtgagaaat

SEQ ID NO: 5141019 - DNA, 13 bp, Homo sapiens
acattttgtaaaa

SEQ ID NO: 5141020 - DNA, 14 bp, Homo sapiens
acattttgtaaaat

SEQ ID NO: 5141021 - DNA, 21 bp, Homo sapiens
acattttgtaaatctgtactt

SEQ ID NO: 5141022 - DNA, 20 bp, Homo sapiens
acattttgtacaaagatatg

SEQ ID NO: 5141023 - DNA, 12 bp, Homo sapiens
acattttgtagc

SEQ ID NO: 5141024 - DNA, 18 bp, Homo sapiens
acattttgtatattaact

SEQ ID NO: 5141025 - DNA, 12 bp, Homo sapiens
acattttgtatg

SEQ ID NO: 5141026 - DNA, 18 bp, Homo sapiens
acattttgtatgctgcat

SEQ ID NO: 5141027 - DNA, 17 bp, Homo sapiens
acattttgtatggagtt

SEQ ID NO: 5141028 - DNA, 15 bp, Homo sapiens
acattttgttacata

SEQ ID NO: 5141029 - DNA, 16 bp, Homo sapiens
acattttgttgtaaaa

SEQ ID NO: 5141030 - DNA, 17 bp, Homo sapiens
acattttgttgtaaaaa

SEQ ID NO: 5141031 - DNA, 19 bp, Homo sapiens
acattttgttgtaaaaaga

SEQ ID NO: 5141032 - DNA, 14 bp, Homo sapiens
acattttgtttcca

SEQ ID NO: 5141033 - DNA, 16 bp, Homo sapiens
acattttgtttttact

SEQ ID NO: 5141034 - DNA, 20 bp, Homo sapiens
acattttgtttttactgtat

SEQ ID NO: 5141035 - DNA, 23 bp, Homo sapiens
acattttgtttttactgtatgtt

SEQ ID NO: 5141036 - DNA, 14 bp, Homo sapiens
acatttttaaatgt

SEQ ID NO: 5141037 - DNA, 17 bp, Homo sapiens
acatttttaagatgcat

SEQ ID NO: 5141038 - DNA, 15 bp, Homo sapiens
acatttttaagtgct

SEQ ID NO: 5141039 - DNA, 18 bp, Homo sapiens
acatttttaagtgctgca

SEQ ID NO: 5141040 - DNA, 18 bp, Homo sapiens
acatttttagcctgtgtc

SEQ ID NO: 5141041 - DNA, 20 bp, Homo sapiens
acatttttatacctgtttaa

SEQ ID NO: 5141042 - DNA, 17 bp, Homo sapiens
acatttttatttatgaa

SEQ ID NO: 5141043 - DNA, 18 bp, Homo sapiens
acatttttatttatgaag

SEQ ID NO: 5141044 - DNA, 19 bp, Homo sapiens
accatcgtcttcttggcca

SEQ ID NO: 5141045 - DNA, 23 bp, Homo sapiens
accatctacctgcttggtctttc

SEQ ID NO: 5141046 - DNA, 18 bp, Homo sapiens
accatctcacaccagtcc

SEQ ID NO: 5141047 - DNA, 13 bp, Homo sapiens
accatctcaggcc

SEQ ID NO: 5141048 - DNA, 17 bp, Homo sapiens
accatctcaggccacct

SEQ ID NO: 5141049 - DNA, 12 bp, Homo sapiens
accatctccctg

SEQ ID NO: 5141050 - DNA, 16 bp, Homo sapiens
accatctccctggtgc

SEQ ID NO: 5141051 - DNA, 18 bp, Homo sapiens
accatctccctggtgctt

SEQ ID NO: 5141052 - DNA, 20 bp, Homo sapiens
accatctccctggtgcttat

SEQ ID NO: 5141053 - DNA, 23 bp, Homo sapiens
accatctcctatcttttatttca

SEQ ID NO: 5141054 - DNA, 22 bp, Homo sapiens
accatctctagttggccagcgt

SEQ ID NO: 5141055 - DNA, 15 bp, Homo sapiens
accatctctccaact

SEQ ID NO: 5141056 - DNA, 21 bp, Homo sapiens
accatctctccctcctggtga

SEQ ID NO: 5141057 - DNA, 12 bp, Homo sapiens
accatctctctt

SEQ ID NO: 5141058 - DNA, 13 bp, Homo sapiens
accatctctgtga

SEQ ID NO: 5141059 - DNA, 14 bp, Homo sapiens
accatctctttacc

SEQ ID NO: 5141060 - DNA, 17 bp, Homo sapiens
accatctgctgcagtta

SEQ ID NO: 5141061 - DNA, 14 bp, Homo sapiens
accatctgctgccc

SEQ ID NO: 5141062 - DNA, 13 bp, Homo sapiens
accatctgctgtc

SEQ ID NO: 5141063 - DNA, 19 bp, Homo sapiens
accatctggcccaggctgg

SEQ ID NO: 5141064 - DNA, 18 bp, Homo sapiens
accatctggggcacctgc

SEQ ID NO: 5141065 - DNA, 13 bp, Homo sapiens
accatctggtgcc

SEQ ID NO: 5141066 - DNA, 14 bp, Homo sapiens
accatctggtgcct

SEQ ID NO: 5141067 - DNA, 18 bp, Homo sapiens
accatctgtaccctgctt

SEQ ID NO: 5141068 - DNA, 14 bp, Homo sapiens
accatctgtgacta

SEQ ID NO: 5141069 - DNA, 13 bp, Homo sapiens
accatctgtttga

SEQ ID NO: 5141070 - DNA, 18 bp, Homo sapiens
accatcttaaatgacagt

SEQ ID NO: 5141071 - DNA, 18 bp, Homo sapiens
accatcttaatctttatt

SEQ ID NO: 5141072 - DNA, 23 bp, Homo sapiens
accatcttaatctttattttatt

SEQ ID NO: 5141073 - DNA, 18 bp, Homo sapiens
accatcttcataatttgc

SEQ ID NO: 5141074 - DNA, 19 bp, Homo sapiens
accatcttctatcttcttt

SEQ ID NO: 5141075 - DNA, 18 bp, Homo sapiens
accatcttctgtgtttat

SEQ ID NO: 5141076 - DNA, 23 bp, Homo sapiens
accatcttgggattcctcccctg

SEQ ID NO: 5141077 - DNA, 17 bp, Homo sapiens
accatctttctgattcc

SEQ ID NO: 5141078 - DNA, 10 bp, Homo sapiens
accatctttg

SEQ ID NO: 5141079 - DNA, 21 bp, Homo sapiens
accatcttttcctcattttca

SEQ ID NO: 5141080 - DNA, 18 bp, Homo sapiens
accatgaaaagttttcaa

SEQ ID NO: 5141081 - DNA, 14 bp, Homo sapiens
accatgaaacaaag

SEQ ID NO: 5141082 - DNA, 14 bp, Homo sapiens
accatgaacttgat

SEQ ID NO: 5141083 - DNA, 24 bp, Homo sapiens
accatgaagagatttttcatgatt

SEQ ID NO: 5141084 - DNA, 18 bp, Homo sapiens
accatgaagtaaattatg

SEQ ID NO: 5141085 - DNA, 20 bp, Homo sapiens
accatgaatatttatttaaa

SEQ ID NO: 5141086 - DNA, 23 bp, Homo sapiens
accatgaattctggtcacattcc

SEQ ID NO: 5141087 - DNA, 16 bp, Homo sapiens
accatgaccccttctc

SEQ ID NO: 5141088 - DNA, 23 bp, Homo sapiens
accatgaccccttctctctccag

SEQ ID NO: 5141089 - DNA, 16 bp, Homo sapiens
accatgactgtgacca

SEQ ID NO: 5141090 - DNA, 10 bp, Homo sapiens
accatgagaa

SEQ ID NO: 5141091 - DNA, 18 bp, Homo sapiens
accatgagaagagggcct

SEQ ID NO: 5141092 - DNA, 23 bp, Homo sapiens
accatgagaataagagaaagaaa

SEQ ID NO: 5141093 - DNA, 19 bp, Homo sapiens
accatgagaatttgcaaca

SEQ ID NO: 5141094 - DNA, 18 bp, Homo sapiens
accatgagcaattctcct

SEQ ID NO: 5141095 - DNA, 20 bp, Homo sapiens
accatgagcacctccagctg

SEQ ID NO: 5141096 - DNA, 19 bp, Homo sapiens
accatgagtggcatggcca

SEQ ID NO: 5141097 - DNA, 20 bp, Homo sapiens
accatgatcacttatcagtt

SEQ ID NO: 5141098 - DNA, 15 bp, Homo sapiens
accatgatgctgagc

SEQ ID NO: 5141099 - DNA, 20 bp, Homo sapiens
accatgatgctgagcccgga

SEQ ID NO: 5141100 - DNA, 19 bp, Homo sapiens
accatgatggccaggctga

SEQ ID NO: 5141101 - DNA, 21 bp, Homo sapiens
accatgcaaatgtcttccagg

SEQ ID NO: 5141102 - DNA, 17 bp, Homo sapiens
accatgcaaattgtgaa

SEQ ID NO: 5141103 - DNA, 18 bp, Homo sapiens
accatgcaaattgtgaaa

SEQ ID NO: 5141104 - DNA, 15 bp, Homo sapiens
accatgcacccctga

SEQ ID NO: 5141105 - DNA, 21 bp, Homo sapiens
accatgcactatatttgtata

SEQ ID NO: 5141106 - DNA, 12 bp, Homo sapiens
accatgcactca

SEQ ID NO: 5141107 - DNA, 17 bp, Homo sapiens
accatgcactgtaaata

SEQ ID NO: 5141108 - DNA, 19 bp, Homo sapiens
accatgcactgtaaatatc

SEQ ID NO: 5141109 - DNA, 12 bp, Homo sapiens
accatgcagccc

SEQ ID NO: 5141110 - DNA, 21 bp, Homo sapiens
accatgcagcccctgggccct

SEQ ID NO: 5141111 - DNA, 19 bp, Homo sapiens
accatgcagcttcatcaat

SEQ ID NO: 5141112 - DNA, 21 bp, Homo sapiens
accatgcagcttcatcaattt

SEQ ID NO: 5141113 - DNA, 15 bp, Homo sapiens
accatgcaggaagga

SEQ ID NO: 5141114 - DNA, 21 bp, Homo sapiens
accatgcaggaaggaaaacta

SEQ ID NO: 5141115 - DNA, 22 bp, Homo sapiens
accatgcattcagatctgaagt

SEQ ID NO: 5141116 - DNA, 14 bp, Homo sapiens
accatgcatttctc

SEQ ID NO: 5141117 - DNA, 20 bp, Homo sapiens
accatgccagattctgcctc

SEQ ID NO: 5141118 - DNA, 21 bp, Homo sapiens
accatgccagattctgcctct

SEQ ID NO: 5141119 - DNA, 14 bp, Homo sapiens
accatgccaggcta

SEQ ID NO: 5141120 - DNA, 19 bp, Homo sapiens
accatgccaggctaatttt

SEQ ID NO: 5141121 - DNA, 19 bp, Homo sapiens
accatgcccggctaatttt

SEQ ID NO: 5141122 - DNA, 17 bp, Homo sapiens
accatgcctcactaatt

SEQ ID NO: 5141123 - DNA, 20 bp, Homo sapiens
accatgcctcactaattttt

SEQ ID NO: 5141124 - DNA, 17 bp, Homo sapiens
accatgcctcccagagc

SEQ ID NO: 5141125 - DNA, 22 bp, Homo sapiens
accatgcgacactgggaggcca

SEQ ID NO: 5141126 - DNA, 14 bp, Homo sapiens
accatgcgctgctc

SEQ ID NO: 5141127 - DNA, 20 bp, Homo sapiens
accatgcgtcaggggcctag

SEQ ID NO: 5141128 - DNA, 22 bp, Homo sapiens
accatgctcaatgaaaaggtga

SEQ ID NO: 5141129 - DNA, 13 bp, Homo sapiens
accatgctctctc

SEQ ID NO: 5141130 - DNA, 15 bp, Homo sapiens
accatgctctctcac

SEQ ID NO: 5141131 - DNA, 19 bp, Homo sapiens
accatgctctctcacctgc

SEQ ID NO: 5141132 - DNA, 23 bp, Homo sapiens
accatgctctctcacctgctccc

SEQ ID NO: 5141133 - DNA, 14 bp, Homo sapiens
accatgctgctggg

SEQ ID NO: 5141134 - DNA, 18 bp, Homo sapiens
accatgctgctggggaag

SEQ ID NO: 5141135 - DNA, 12 bp, Homo sapiens
accatgctgctt

SEQ ID NO: 5141136 - DNA, 21 bp, Homo sapiens
accatgctgctttttggcaca

SEQ ID NO: 5141137 - DNA, 22 bp, Homo sapiens
accatgctgctttttggcacag

SEQ ID NO: 5141138 - DNA, 20 bp, Homo sapiens
accatgctgtctggcacagc

SEQ ID NO: 5141139 - DNA, 16 bp, Homo sapiens
accatggaaagaaata

SEQ ID NO: 5141140 - DNA, 13 bp, Homo sapiens
accatggacacat

SEQ ID NO: 5141141 - DNA, 14 bp, Homo sapiens
accatggacacatt

SEQ ID NO: 5141142 - DNA, 22 bp, Homo sapiens
accatggacactacacccagca

SEQ ID NO: 5141143 - DNA, 24 bp, Homo sapiens
accatggacactacacccagcaat

SEQ ID NO: 5141144 - DNA, 17 bp, Homo sapiens
accatggacggccccgt

SEQ ID NO: 5141145 - DNA, 15 bp, Homo sapiens
accatggactttata

SEQ ID NO: 5141146 - DNA, 15 bp, Homo sapiens
accatggaggcaggc

SEQ ID NO: 5141147 - DNA, 22 bp, Homo sapiens
accatggaggcaggctccccct

SEQ ID NO: 5141148 - DNA, 16 bp, Homo sapiens
accatggagtggcagc

SEQ ID NO: 5141149 - DNA, 22 bp, Homo sapiens
accatggcacctttgagagagg

SEQ ID NO: 5141150 - DNA, 14 bp, Homo sapiens
accatggcacttga

SEQ ID NO: 5141151 - DNA, 20 bp, Homo sapiens
accatggccattcagcacag

SEQ ID NO: 5141152 - DNA, 19 bp, Homo sapiens
accatgggaggtggggcct

SEQ ID NO: 5141153 - DNA, 16 bp, Homo sapiens
accatgggctcagggc

SEQ ID NO: 5141154 - DNA, 12 bp, Homo sapiens
accatggggagg

SEQ ID NO: 5141155 - DNA, 19 bp, Homo sapiens
accatggggatcagagtct

SEQ ID NO: 5141156 - DNA, 21 bp, Homo sapiens
accatgggtgtggatggcagt

SEQ ID NO: 5141157 - DNA, 16 bp, Homo sapiens
accatggttctgcctc

SEQ ID NO: 5141158 - DNA, 18 bp, Homo sapiens
accatggttctgcctcct

SEQ ID NO: 5141159 - DNA, 21 bp, Homo sapiens
accatggttttggctctccca

SEQ ID NO: 5141160 - DNA, 22 bp, Homo sapiens
accatggttttggctctcccac

SEQ ID NO: 5141161 - DNA, 13 bp, Homo sapiens
accatgtaaaaca

SEQ ID NO: 5141162 - DNA, 17 bp, Homo sapiens
accatgtaaaacaaaaa

SEQ ID NO: 5141163 - DNA, 21 bp, Homo sapiens
accatgtaaaacaaaaaacaa

SEQ ID NO: 5141164 - DNA, 21 bp, Homo sapiens
accatgtaaagaacataaata

SEQ ID NO: 5141165 - DNA, 11 bp, Homo sapiens
accatgtaaat

SEQ ID NO: 5141166 - DNA, 14 bp, Homo sapiens
accatgtaaataat

SEQ ID NO: 5141167 - DNA, 19 bp, Homo sapiens
accatgtaaataatctgtg

SEQ ID NO: 5141168 - DNA, 18 bp, Homo sapiens
accatgtaagcactctgg

SEQ ID NO: 5141169 - DNA, 17 bp, Homo sapiens
accatgtagaaaatttg

SEQ ID NO: 5141170 - DNA, 20 bp, Homo sapiens
accatgtatgtggtatgtat

SEQ ID NO: 5141171 - DNA, 15 bp, Homo sapiens
accatgtcagcaaaa

SEQ ID NO: 5141172 - DNA, 16 bp, Homo sapiens
accatgtcatcttttt

SEQ ID NO: 5141173 - DNA, 19 bp, Homo sapiens
accatgtctctaagccaac

SEQ ID NO: 5141174 - DNA, 16 bp, Homo sapiens
accatgtgagctcttc

SEQ ID NO: 5141175 - DNA, 23 bp, Homo sapiens
accatgtgcaataagattggtgt

SEQ ID NO: 5141176 - DNA, 22 bp, Homo sapiens
accatgtgctacaggggccaga

SEQ ID NO: 5141177 - DNA, 12 bp, Homo sapiens
accatgtggcca

SEQ ID NO: 5141178 - DNA, 14 bp, Homo sapiens
accatgttaataca

SEQ ID NO: 5141179 - DNA, 17 bp, Homo sapiens
accatgttatattgctt

SEQ ID NO: 5141180 - DNA, 13 bp, Homo sapiens
accatgttcatta

SEQ ID NO: 5141181 - DNA, 18 bp, Homo sapiens
accatgttcattataatc

SEQ ID NO: 5141182 - DNA, 13 bp, Homo sapiens
accatgttctata

SEQ ID NO: 5141183 - DNA, 14 bp, Homo sapiens
accatgttgcccag

SEQ ID NO: 5141184 - DNA, 14 bp, Homo sapiens
accatgttggcctc

SEQ ID NO: 5141185 - DNA, 15 bp, Homo sapiens
accatgtttaaagaa

SEQ ID NO: 5141186 - DNA, 20 bp, Homo sapiens
accatgtttgagctcagacc

SEQ ID NO: 5141187 - DNA, 13 bp, Homo sapiens
accattaaaactg

SEQ ID NO: 5141188 - DNA, 22 bp, Homo sapiens
accattaaaactgaagtctgaa

SEQ ID NO: 5141189 - DNA, 16 bp, Homo sapiens
accattaaaactgctt

SEQ ID NO: 5141190 - DNA, 12 bp, Homo sapiens
accattaaaatc

SEQ ID NO: 5141191 - DNA, 20 bp, Homo sapiens
accattaagaacaaggaatt

SEQ ID NO: 5141192 - DNA, 15 bp, Homo sapiens
accattaatgaaaac

SEQ ID NO: 5141193 - DNA, 22 bp, Homo sapiens
accattaatgaaaactttttca

SEQ ID NO: 5141194 - DNA, 14 bp, Homo sapiens
accattaattacat

SEQ ID NO: 5141195 - DNA, 17 bp, Homo sapiens
accattaattacataca

SEQ ID NO: 5141196 - DNA, 14 bp, Homo sapiens
accattacatgttt

SEQ ID NO: 5141197 - DNA, 17 bp, Homo sapiens
accattacatgtttaaa

SEQ ID NO: 5141198 - DNA, 22 bp, Homo sapiens
accattactgaggggattctct

SEQ ID NO: 5141199 - DNA, 11 bp, Homo sapiens
accattagcat

SEQ ID NO: 5141200 - DNA, 18 bp, Homo sapiens
accattatactttatatc

SEQ ID NO: 5141201 - DNA, 16 bp, Homo sapiens
accattatgctggtgt

SEQ ID NO: 5141202 - DNA, 17 bp, Homo sapiens
accattattatcaagta

SEQ ID NO: 5141203 - DNA, 16 bp, Homo sapiens
accattattcacaggt

SEQ ID NO: 5141204 - DNA, 18 bp, Homo sapiens
accattatttaataagag

SEQ ID NO: 5141205 - DNA, 17 bp, Homo sapiens
accattattttacagtc

SEQ ID NO: 5141206 - DNA, 23 bp, Homo sapiens
accattcaaacaggtcgagctgt

SEQ ID NO: 5141207 - DNA, 14 bp, Homo sapiens
accattcaaatgac

SEQ ID NO: 5141208 - DNA, 19 bp, Homo sapiens
accattcacaataaaagct

SEQ ID NO: 5141209 - DNA, 19 bp, Homo sapiens
accattcacatttgatgta

SEQ ID NO: 5141210 - DNA, 21 bp, Homo sapiens
accattcagtgattactgtca

SEQ ID NO: 5141211 - DNA, 21 bp, Homo sapiens
accattccaagtctccacccc

SEQ ID NO: 5141212 - DNA, 14 bp, Homo sapiens
accattcctgcctt

SEQ ID NO: 5141213 - DNA, 17 bp, Homo sapiens
accattccttcaaataa

SEQ ID NO: 5141214 - DNA, 17 bp, Homo sapiens
accattctattctccag

SEQ ID NO: 5141215 - DNA, 18 bp, Homo sapiens
accattctattctccaga

SEQ ID NO: 5141216 - DNA, 19 bp, Homo sapiens
accattctattctccagac

SEQ ID NO: 5141217 - DNA, 13 bp, Homo sapiens
accattctccacc

SEQ ID NO: 5141218 - DNA, 15 bp, Homo sapiens
accattctcctgcct

SEQ ID NO: 5141219 - DNA, 16 bp, Homo sapiens
accattctcctgcctc

SEQ ID NO: 5141220 - DNA, 13 bp, Homo sapiens
accattctgactc

SEQ ID NO: 5141221 - DNA, 12 bp, Homo sapiens
accattctgcat

SEQ ID NO: 5141222 - DNA, 13 bp, Homo sapiens
accattctgcatt

SEQ ID NO: 5141223 - DNA, 22 bp, Homo sapiens
acatttttcaactttgaataaa

SEQ ID NO: 5141224 - DNA, 14 bp, Homo sapiens
acatttttcattca

SEQ ID NO: 5141225 - DNA, 16 bp, Homo sapiens
acatttttcattcatg

SEQ ID NO: 5141226 - DNA, 18 bp, Homo sapiens
acatttttcattcatgaa

SEQ ID NO: 5141227 - DNA, 19 bp, Homo sapiens
acatttttcattcatgaat

SEQ ID NO: 5141228 - DNA, 20 bp, Homo sapiens
acatttttcattcatgaata

SEQ ID NO: 5141229 - DNA, 13 bp, Homo sapiens
acatttttcctct

SEQ ID NO: 5141230 - DNA, 14 bp, Homo sapiens
acatttttctgatg

SEQ ID NO: 5141231 - DNA, 15 bp, Homo sapiens
acatttttctgatgg

SEQ ID NO: 5141232 - DNA, 13 bp, Homo sapiens
acatttttcttag

SEQ ID NO: 5141233 - DNA, 22 bp, Homo sapiens
acatttttgagatattaaagat

SEQ ID NO: 5141234 - DNA, 16 bp, Homo sapiens
acatttttgatcaaat

SEQ ID NO: 5141235 - DNA, 22 bp, Homo sapiens
acatttttgatcaaatgtacat

SEQ ID NO: 5141236 - DNA, 15 bp, Homo sapiens
acatttttgatttca

SEQ ID NO: 5141237 - DNA, 21 bp, Homo sapiens
acatttttgcagctaaattac

SEQ ID NO: 5141238 - DNA, 15 bp, Homo sapiens
acatttttggaaatt

SEQ ID NO: 5141239 - DNA, 18 bp, Homo sapiens
acatttttggatttctgt

SEQ ID NO: 5141240 - DNA, 18 bp, Homo sapiens
acatttttggggggagag

SEQ ID NO: 5141241 - DNA, 17 bp, Homo sapiens
acatttttgtacattat

SEQ ID NO: 5141242 - DNA, 21 bp, Homo sapiens
acatttttgtggttttgagaa

SEQ ID NO: 5141243 - DNA, 22 bp, Homo sapiens
acatttttgtggttttgagaaa

SEQ ID NO: 5141244 - DNA, 23 bp, Homo sapiens
acatttttgtggttttgagaaag

SEQ ID NO: 5141245 - DNA, 14 bp, Homo sapiens
acattttttaaatg

SEQ ID NO: 5141246 - DNA, 21 bp, Homo sapiens
acattttttaaatgcacctgg

SEQ ID NO: 5141247 - DNA, 17 bp, Homo sapiens
acattttttaagaaaac

SEQ ID NO: 5141248 - DNA, 14 bp, Homo sapiens
acattttttaagct

SEQ ID NO: 5141249 - DNA, 17 bp, Homo sapiens
acattttttaagcttca

SEQ ID NO: 5141250 - DNA, 14 bp, Homo sapiens
acattttttcatca

SEQ ID NO: 5141251 - DNA, 13 bp, Homo sapiens
acattttttgaaa

SEQ ID NO: 5141252 - DNA, 15 bp, Homo sapiens
acattttttgaaatg

SEQ ID NO: 5141253 - DNA, 21 bp, Homo sapiens
acattttttgctataatcatt

SEQ ID NO: 5141254 - DNA, 18 bp, Homo sapiens
acatttttttatgctctt

SEQ ID NO: 5141255 - DNA, 13 bp, Homo sapiens
acatttttttcta

SEQ ID NO: 5141256 - DNA, 23 bp, Homo sapiens
acatttttttctgatttgtcctg

SEQ ID NO: 5141257 - DNA, 23 bp, Homo sapiens
acatttttttgcatgcatgcaaa

SEQ ID NO: 5141258 - DNA, 18 bp, Homo sapiens
acatttttttttttaatt

SEQ ID NO: 5141259 - DNA, 21 bp, Homo sapiens
accaaaaaaaagcatgaatat

SEQ ID NO: 5141260 - DNA, 23 bp, Homo sapiens
accaaaaaaaagcatgaatattt

SEQ ID NO: 5141261 - DNA, 16 bp, Homo sapiens
accaaaaaaaggaagg

SEQ ID NO: 5141262 - DNA, 18 bp, Homo sapiens
accaaaaaacctcactgg

SEQ ID NO: 5141263 - DNA, 15 bp, Homo sapiens
accaaaaaagttaca

SEQ ID NO: 5141264 - DNA, 12 bp, Homo sapiens
accaaaaaatat

SEQ ID NO: 5141265 - DNA, 14 bp, Homo sapiens
accaaaaaatgtga

SEQ ID NO: 5141266 - DNA, 17 bp, Homo sapiens
accaaaaacaatacttt

SEQ ID NO: 5141267 - DNA, 20 bp, Homo sapiens
accaaaaactagacattatt

SEQ ID NO: 5141268 - DNA, 23 bp, Homo sapiens
accaaaaagagactgatcatcca

SEQ ID NO: 5141269 - DNA, 16 bp, Homo sapiens
accaaaaatagaaatt

SEQ ID NO: 5141270 - DNA, 13 bp, Homo sapiens
accaaaaatcaac

SEQ ID NO: 5141271 - DNA, 17 bp, Homo sapiens
accaaaaattgccaagt

SEQ ID NO: 5141272 - DNA, 17 bp, Homo sapiens
accaaaacataagacga

SEQ ID NO: 5141273 - DNA, 12 bp, Homo sapiens
accaaaactgtg

SEQ ID NO: 5141274 - DNA, 15 bp, Homo sapiens
accaaaagaacaaga

SEQ ID NO: 5141275 - DNA, 13 bp, Homo sapiens
accaaaagaagta

SEQ ID NO: 5141276 - DNA, 23 bp, Homo sapiens
accaaaagaatttgtgtttgtct

SEQ ID NO: 5141277 - DNA, 14 bp, Homo sapiens
accaaaagacactg

SEQ ID NO: 5141278 - DNA, 21 bp, Homo sapiens
accaaaagggaaaaaataaaa

SEQ ID NO: 5141279 - DNA, 20 bp, Homo sapiens
accaaaagggaggctctctg

SEQ ID NO: 5141280 - DNA, 22 bp, Homo sapiens
accaaaataaaaattgaaaaat

SEQ ID NO: 5141281 - DNA, 15 bp, Homo sapiens
accaaaataataaaa

SEQ ID NO: 5141282 - DNA, 18 bp, Homo sapiens
accaaaatactccaaaga

SEQ ID NO: 5141283 - DNA, 14 bp, Homo sapiens
accaaaatcccctt

SEQ ID NO: 5141284 - DNA, 16 bp, Homo sapiens
accaaaatccccttct

SEQ ID NO: 5141285 - DNA, 12 bp, Homo sapiens
accaaaatgaaa

SEQ ID NO: 5141286 - DNA, 22 bp, Homo sapiens
accaaaatgacatctttttaaa

SEQ ID NO: 5141287 - DNA, 19 bp, Homo sapiens
accaaaattactaataaat

SEQ ID NO: 5141288 - DNA, 16 bp, Homo sapiens
accaaaattatagctt

SEQ ID NO: 5141289 - DNA, 13 bp, Homo sapiens
accaaaattcatc

SEQ ID NO: 5141290 - DNA, 21 bp, Homo sapiens
accaaacaatattgctccatg

SEQ ID NO: 5141291 - DNA, 13 bp, Homo sapiens
accaaacaattat

SEQ ID NO: 5141292 - DNA, 16 bp, Homo sapiens
accaaacaattattta

SEQ ID NO: 5141293 - DNA, 16 bp, Homo sapiens
accaaacacccagagg

SEQ ID NO: 5141294 - DNA, 21 bp, Homo sapiens
accaaacagcaaaccaagaga

SEQ ID NO: 5141295 - DNA, 14 bp, Homo sapiens
accaaacatttctg

SEQ ID NO: 5141296 - DNA, 21 bp, Homo sapiens
accaaacccaggttcatgaat

SEQ ID NO: 5141297 - DNA, 18 bp, Homo sapiens
accaaaccctataaacct

SEQ ID NO: 5141298 - DNA, 21 bp, Homo sapiens
accaaacccttagcagcccag

SEQ ID NO: 5141299 - DNA, 23 bp, Homo sapiens
accaaacccttagcagcccagca

SEQ ID NO: 5141300 - DNA, 18 bp, Homo sapiens
accaaacggaactcttca

SEQ ID NO: 5141301 - DNA, 15 bp, Homo sapiens
accaaactcagttca

SEQ ID NO: 5141302 - DNA, 20 bp, Homo sapiens
accaaactgggtcttcagct

SEQ ID NO: 5141303 - DNA, 18 bp, Homo sapiens
accaaactgttaaatgtg

SEQ ID NO: 5141304 - DNA, 15 bp, Homo sapiens
accaaagaaacacca

SEQ ID NO: 5141305 - DNA, 15 bp, Homo sapiens
accaaagaagaaagt

SEQ ID NO: 5141306 - DNA, 13 bp, Homo sapiens
accaaagaatgca

SEQ ID NO: 5141307 - DNA, 13 bp, Homo sapiens
accaaagactgca

SEQ ID NO: 5141308 - DNA, 18 bp, Homo sapiens
accaaagactgcagaacc

SEQ ID NO: 5141309 - DNA, 21 bp, Homo sapiens
accaaagagactggagcatct

SEQ ID NO: 5141310 - DNA, 19 bp, Homo sapiens
accaaagagtattcagtga

SEQ ID NO: 5141311 - DNA, 18 bp, Homo sapiens
accaaagagtctctggct

SEQ ID NO: 5141312 - DNA, 22 bp, Homo sapiens
accaaagagtctctggctcagc

SEQ ID NO: 5141313 - DNA, 19 bp, Homo sapiens
accaaagcaaagaaaataa

SEQ ID NO: 5141314 - DNA, 14 bp, Homo sapiens
accaaagcaaggta

SEQ ID NO: 5141315 - DNA, 15 bp, Homo sapiens
accaaagcaattaaa

SEQ ID NO: 5141316 - DNA, 11 bp, Homo sapiens
accaaagcaca

SEQ ID NO: 5141317 - DNA, 20 bp, Homo sapiens
accaaagcaccttagctggc

SEQ ID NO: 5141318 - DNA, 24 bp, Homo sapiens
accaaagcatcaatacaaccagcc

SEQ ID NO: 5141319 - DNA, 14 bp, Homo sapiens
accaaagccaccag

SEQ ID NO: 5141320 - DNA, 16 bp, Homo sapiens
accaaagccacctgct

SEQ ID NO: 5141321 - DNA, 13 bp, Homo sapiens
accaaagctgccc

SEQ ID NO: 5141322 - DNA, 11 bp, Homo sapiens
accaaagctgt

SEQ ID NO: 5141323 - DNA, 16 bp, Homo sapiens
accaaagctgttttta

SEQ ID NO: 5141324 - DNA, 19 bp, Homo sapiens
accaaaggaaaatgtctgt

SEQ ID NO: 5141325 - DNA, 16 bp, Homo sapiens
accaaaggaaggaagc

SEQ ID NO: 5141326 - DNA, 19 bp, Homo sapiens
accaaaggacattatgtgt

SEQ ID NO: 5141327 - DNA, 21 bp, Homo sapiens
accaaaggacattatgtgtgc

SEQ ID NO: 5141328 - DNA, 20 bp, Homo sapiens
accaaagggagtctgccagg

SEQ ID NO: 5141329 - DNA, 13 bp, Homo sapiens
accaaaggtcaat

SEQ ID NO: 5141330 - DNA, 15 bp, Homo sapiens
accaaaggtcaatgt

SEQ ID NO: 5141331 - DNA, 17 bp, Homo sapiens
accaaaggtgaaggaat

SEQ ID NO: 5141332 - DNA, 19 bp, Homo sapiens
accaaaggtgaaggaatat

SEQ ID NO: 5141333 - DNA, 20 bp, Homo sapiens
accaaaggtgaaggaatata

SEQ ID NO: 5141334 - DNA, 15 bp, Homo sapiens
accaaaggtttttaa

SEQ ID NO: 5141335 - DNA, 15 bp, Homo sapiens
accaaagtatttttt

SEQ ID NO: 5141336 - DNA, 12 bp, Homo sapiens
accaaagtcaaa

SEQ ID NO: 5141337 - DNA, 16 bp, Homo sapiens
accaaagtcccttcct

SEQ ID NO: 5141338 - DNA, 15 bp, Homo sapiens
accaaagtctaaact

SEQ ID NO: 5141339 - DNA, 19 bp, Homo sapiens
accaaagtctgccgcccac

SEQ ID NO: 5141340 - DNA, 23 bp, Homo sapiens
accaaagtgtcttttgacatttt

SEQ ID NO: 5141341 - DNA, 23 bp, Homo sapiens
accaaagttctaataatttctaa

SEQ ID NO: 5141342 - DNA, 23 bp, Homo sapiens
accaaagttgttttacagctgtg

SEQ ID NO: 5141343 - DNA, 14 bp, Homo sapiens
accaaatacctcaa

SEQ ID NO: 5141344 - DNA, 22 bp, Homo sapiens
accaaatacctcaatttttgtt

SEQ ID NO: 5141345 - DNA, 21 bp, Homo sapiens
accaaataggatcatatgaat

SEQ ID NO: 5141346 - DNA, 15 bp, Homo sapiens
accaaatagtgattg

SEQ ID NO: 5141347 - DNA, 18 bp, Homo sapiens
accaaatagtgtgaaata

SEQ ID NO: 5141348 - DNA, 16 bp, Homo sapiens
accaaatatgttaaag

SEQ ID NO: 5141349 - DNA, 15 bp, Homo sapiens
accaaatattaaaga

SEQ ID NO: 5141350 - DNA, 17 bp, Homo sapiens
accaaatattaaagatt

SEQ ID NO: 5141351 - DNA, 14 bp, Homo sapiens
accaaatcaaaatc

SEQ ID NO: 5141352 - DNA, 19 bp, Homo sapiens
accaaatcagctgctacta

SEQ ID NO: 5141353 - DNA, 15 bp, Homo sapiens
accaaatcatcctga

SEQ ID NO: 5141354 - DNA, 17 bp, Homo sapiens
accaaatcattgtatca

SEQ ID NO: 5141355 - DNA, 17 bp, Homo sapiens
accaaatctcagttgtt

SEQ ID NO: 5141356 - DNA, 22 bp, Homo sapiens
accaaatctcagttgtttgctt

SEQ ID NO: 5141357 - DNA, 19 bp, Homo sapiens
accaaatgaaatgccaaag

SEQ ID NO: 5141358 - DNA, 19 bp, Homo sapiens
accaaatgatagaaacaga

SEQ ID NO: 5141359 - DNA, 20 bp, Homo sapiens
accaaatgatagaaacagac

SEQ ID NO: 5141360 - DNA, 12 bp, Homo sapiens
accaaatgcatc

SEQ ID NO: 5141361 - DNA, 17 bp, Homo sapiens
accaaatgcctctgcct

SEQ ID NO: 5141362 - DNA, 18 bp, Homo sapiens
accaaatgcctctgcctt

SEQ ID NO: 5141363 - DNA, 17 bp, Homo sapiens
accaaatgcctgttgta

SEQ ID NO: 5141364 - DNA, 19 bp, Homo sapiens
accaaatgctttaaaaact

SEQ ID NO: 5141365 - DNA, 19 bp, Homo sapiens
accaaatggccagttttct

SEQ ID NO: 5141366 - DNA, 15 bp, Homo sapiens
accaaatggtacaaa

SEQ ID NO: 5141367 - DNA, 15 bp, Homo sapiens
accaaatgtaaaata

SEQ ID NO: 5141368 - DNA, 16 bp, Homo sapiens
accaaatgtaaaatat

SEQ ID NO: 5141369 - DNA, 21 bp, Homo sapiens
accaaatgtaaaatatttata

SEQ ID NO: 5141370 - DNA, 18 bp, Homo sapiens
accaaatgtaactatgtt

SEQ ID NO: 5141371 - DNA, 13 bp, Homo sapiens
accaaatgtagtt

SEQ ID NO: 5141372 - DNA, 15 bp, Homo sapiens
accaaattaaaaaaa

SEQ ID NO: 5141373 - DNA, 17 bp, Homo sapiens
accaaattaacctttca

SEQ ID NO: 5141374 - DNA, 14 bp, Homo sapiens
accaaattacaagt

SEQ ID NO: 5141375 - DNA, 16 bp, Homo sapiens
accaaattacaagtat

SEQ ID NO: 5141376 - DNA, 16 bp, Homo sapiens
accaaattagcaggtg

SEQ ID NO: 5141377 - DNA, 22 bp, Homo sapiens
accaaattagtgaaccaaaaat

SEQ ID NO: 5141378 - DNA, 15 bp, Homo sapiens
accaaattctccctg

SEQ ID NO: 5141379 - DNA, 21 bp, Homo sapiens
accaaattctgtggctgccat

SEQ ID NO: 5141380 - DNA, 17 bp, Homo sapiens
accaaattgcactgaag

SEQ ID NO: 5141381 - DNA, 16 bp, Homo sapiens
accaaattgctgagat

SEQ ID NO: 5141382 - DNA, 14 bp, Homo sapiens
accaaattgcttct

SEQ ID NO: 5141383 - DNA, 13 bp, Homo sapiens
accaaatttgtac

SEQ ID NO: 5141384 - DNA, 14 bp, Homo sapiens
accaaattttaatt

SEQ ID NO: 5141385 - DNA, 22 bp, Homo sapiens
accaaattttgaggtcttttac

SEQ ID NO: 5141386 - DNA, 16 bp, Homo sapiens
accaacaacagtcagc

SEQ ID NO: 5141387 - DNA, 22 bp, Homo sapiens
accaacaagaataaaggcagct

SEQ ID NO: 5141388 - DNA, 21 bp, Homo sapiens
accaacaataaatatgtatta

SEQ ID NO: 5141389 - DNA, 20 bp, Homo sapiens
accaacaatcttcctgttta

SEQ ID NO: 5141390 - DNA, 22 bp, Homo sapiens
accaacaattaggtctgcattt

SEQ ID NO: 5141391 - DNA, 23 bp, Homo sapiens
accaacaattaggtctgcatttt

SEQ ID NO: 5141392 - DNA, 21 bp, Homo sapiens
accaacaccatcacagcttgt

SEQ ID NO: 5141393 - DNA, 22 bp, Homo sapiens
accaacaccatcacagcttgtt

SEQ ID NO: 5141394 - DNA, 15 bp, Homo sapiens
accaacacccctccc

SEQ ID NO: 5141395 - DNA, 20 bp, Homo sapiens
accaacacgtggccaagaga

SEQ ID NO: 5141396 - DNA, 21 bp, Homo sapiens
accaacagaaaccttttattt

SEQ ID NO: 5141397 - DNA, 15 bp, Homo sapiens
accaacagaagcaga

SEQ ID NO: 5141398 - DNA, 22 bp, Homo sapiens
accaacaggctgttctgcactg

SEQ ID NO: 5141399 - DNA, 23 bp, Homo sapiens
accaacaggctgttctgcactga

SEQ ID NO: 5141400 - DNA, 16 bp, Homo sapiens
accaacatactcccat

SEQ ID NO: 5141401 - DNA, 15 bp, Homo sapiens
accattctgcattta

SEQ ID NO: 5141402 - DNA, 20 bp, Homo sapiens
accattctgcctctcctcag

SEQ ID NO: 5141403 - DNA, 16 bp, Homo sapiens
accattctgtattgat

SEQ ID NO: 5141404 - DNA, 11 bp, Homo sapiens
accattctgtg

SEQ ID NO: 5141405 - DNA, 13 bp, Homo sapiens
accattctttctt

SEQ ID NO: 5141406 - DNA, 15 bp, Homo sapiens
accattgaaaaagga

SEQ ID NO: 5141407 - DNA, 15 bp, Homo sapiens
accattgaactgtac

SEQ ID NO: 5141408 - DNA, 19 bp, Homo sapiens
accattgaaggaaagctat

SEQ ID NO: 5141409 - DNA, 16 bp, Homo sapiens
accattgaaggcttaa

SEQ ID NO: 5141410 - DNA, 22 bp, Homo sapiens
accattgacacatccgcctttt

SEQ ID NO: 5141411 - DNA, 14 bp, Homo sapiens
accattgacaggca

SEQ ID NO: 5141412 - DNA, 13 bp, Homo sapiens
accattgacctca

SEQ ID NO: 5141413 - DNA, 19 bp, Homo sapiens
accattgacctcagctgca

SEQ ID NO: 5141414 - DNA, 23 bp, Homo sapiens
accattgagaccgtgaagatact

SEQ ID NO: 5141415 - DNA, 23 bp, Homo sapiens
accattgagctagcgatttcaga

SEQ ID NO: 5141416 - DNA, 16 bp, Homo sapiens
accattgagtccctgc

SEQ ID NO: 5141417 - DNA, 23 bp, Homo sapiens
accattgatgagcactcctgatt

SEQ ID NO: 5141418 - DNA, 18 bp, Homo sapiens
accattgcaacaaaatac

SEQ ID NO: 5141419 - DNA, 21 bp, Homo sapiens
accattgcactctagcctggc

SEQ ID NO: 5141420 - DNA, 15 bp, Homo sapiens
accattgcatgaatt

SEQ ID NO: 5141421 - DNA, 17 bp, Homo sapiens
accattgctaatttaaa

SEQ ID NO: 5141422 - DNA, 12 bp, Homo sapiens
accattgctgct

SEQ ID NO: 5141423 - DNA, 11 bp, Homo sapiens
accattgcttc

SEQ ID NO: 5141424 - DNA, 16 bp, Homo sapiens
accattgcttcactac

SEQ ID NO: 5141425 - DNA, 20 bp, Homo sapiens
accattgcttcactacccat

SEQ ID NO: 5141426 - DNA, 20 bp, Homo sapiens
accattggaaatttcacgtc

SEQ ID NO: 5141427 - DNA, 15 bp, Homo sapiens
accattggacagatt

SEQ ID NO: 5141428 - DNA, 22 bp, Homo sapiens
accattggacagatttcagtaa

SEQ ID NO: 5141429 - DNA, 18 bp, Homo sapiens
accattggtctctgggta

SEQ ID NO: 5141430 - DNA, 21 bp, Homo sapiens
accattggttaatctggactt

SEQ ID NO: 5141431 - DNA, 23 bp, Homo sapiens
accattgtaatattaactaaata

SEQ ID NO: 5141432 - DNA, 20 bp, Homo sapiens
accattgtattttgtttgtg

SEQ ID NO: 5141433 - DNA, 22 bp, Homo sapiens
accattgtcctaagaacaatgc

SEQ ID NO: 5141434 - DNA, 12 bp, Homo sapiens
accattgtcttc

SEQ ID NO: 5141435 - DNA, 14 bp, Homo sapiens
accattgtcttcca

SEQ ID NO: 5141436 - DNA, 14 bp, Homo sapiens
accattgtcttgtt

SEQ ID NO: 5141437 - DNA, 17 bp, Homo sapiens
accattgtcttgttctg

SEQ ID NO: 5141438 - DNA, 21 bp, Homo sapiens
accattgtcttgttctgtgat

SEQ ID NO: 5141439 - DNA, 18 bp, Homo sapiens
accattgtgaagcaccta

SEQ ID NO: 5141440 - DNA, 20 bp, Homo sapiens
accattgttctgaatgctgc

SEQ ID NO: 5141441 - DNA, 21 bp, Homo sapiens
accattgttctgaatgctgct

SEQ ID NO: 5141442 - DNA, 14 bp, Homo sapiens
accatttaaaaaca

SEQ ID NO: 5141443 - DNA, 21 bp, Homo sapiens
accatttaaaaacaggcagct

SEQ ID NO: 5141444 - DNA, 23 bp, Homo sapiens
accatttaaaaacaggcagctca

SEQ ID NO: 5141445 - DNA, 13 bp, Homo sapiens
accatttaaaaat

SEQ ID NO: 5141446 - DNA, 15 bp, Homo sapiens
accatttaataaaga

SEQ ID NO: 5141447 - DNA, 18 bp, Homo sapiens
accatttaatcatttcca

SEQ ID NO: 5141448 - DNA, 12 bp, Homo sapiens
accatttataat

SEQ ID NO: 5141449 - DNA, 16 bp, Homo sapiens
accatttatacaaatt

SEQ ID NO: 5141450 - DNA, 22 bp, Homo sapiens
accatttatacaaattagaaaa

SEQ ID NO: 5141451 - DNA, 19 bp, Homo sapiens
accatttatcaagcattta

SEQ ID NO: 5141452 - DNA, 13 bp, Homo sapiens
accatttatcttg

SEQ ID NO: 5141453 - DNA, 14 bp, Homo sapiens
accatttcagagag

SEQ ID NO: 5141454 - DNA, 16 bp, Homo sapiens
accatttccccagggc

SEQ ID NO: 5141455 - DNA, 16 bp, Homo sapiens
accatttcccctgtgg

SEQ ID NO: 5141456 - DNA, 13 bp, Homo sapiens
accatttctgggg

SEQ ID NO: 5141457 - DNA, 20 bp, Homo sapiens
accatttcttggcattggaa

SEQ ID NO: 5141458 - DNA, 22 bp, Homo sapiens
accatttggcatccctgggcct

SEQ ID NO: 5141459 - DNA, 16 bp, Homo sapiens
accatttgtaataaag

SEQ ID NO: 5141460 - DNA, 21 bp, Homo sapiens
accattttattttttgggcca

SEQ ID NO: 5141461 - DNA, 22 bp, Homo sapiens
accattttattttttgggccat

SEQ ID NO: 5141462 - DNA, 19 bp, Homo sapiens
accattttcccatcatcct

SEQ ID NO: 5141463 - DNA, 14 bp, Homo sapiens
accattttcctttg

SEQ ID NO: 5141464 - DNA, 15 bp, Homo sapiens
accattttcctttgg

SEQ ID NO: 5141465 - DNA, 22 bp, Homo sapiens
accattttgctgtcccttttcc

SEQ ID NO: 5141466 - DNA, 19 bp, Homo sapiens
accattttggatgtcattg

SEQ ID NO: 5141467 - DNA, 17 bp, Homo sapiens
accatttttcattcact

SEQ ID NO: 5141468 - DNA, 20 bp, Homo sapiens
accattttttaaggaaacaa

SEQ ID NO: 5141469 - DNA, 20 bp, Homo sapiens
accattttttttttcttttt

SEQ ID NO: 5141470 - DNA, 19 bp, Homo sapiens
acccaaaaatatctcctcc

SEQ ID NO: 5141471 - DNA, 11 bp, Homo sapiens
acccaaaacag

SEQ ID NO: 5141472 - DNA, 12 bp, Homo sapiens
acccaaaagatt

SEQ ID NO: 5141473 - DNA, 21 bp, Homo sapiens
acccaaaagctcagccagccc

SEQ ID NO: 5141474 - DNA, 14 bp, Homo sapiens
acccaaaatatata

SEQ ID NO: 5141475 - DNA, 13 bp, Homo sapiens
acccaaacacttc

SEQ ID NO: 5141476 - DNA, 16 bp, Homo sapiens
acccaaacacttctgc

SEQ ID NO: 5141477 - DNA, 17 bp, Homo sapiens
acccaaacacttctgct

SEQ ID NO: 5141478 - DNA, 19 bp, Homo sapiens
acccaaacacttctgcttt

SEQ ID NO: 5141479 - DNA, 20 bp, Homo sapiens
acccaaacacttctgctttc

SEQ ID NO: 5141480 - DNA, 14 bp, Homo sapiens
acccaaaccccctg

SEQ ID NO: 5141481 - DNA, 19 bp, Homo sapiens
acccaaaccccctgcagcc

SEQ ID NO: 5141482 - DNA, 23 bp, Homo sapiens
acccaaaccccctgcagcccagg

SEQ ID NO: 5141483 - DNA, 15 bp, Homo sapiens
acccaaaccccttcc

SEQ ID NO: 5141484 - DNA, 17 bp, Homo sapiens
acccaaaccccttccca

SEQ ID NO: 5141485 - DNA, 15 bp, Homo sapiens
acccaaaccctaggt

SEQ ID NO: 5141486 - DNA, 14 bp, Homo sapiens
acccaaagcacatg

SEQ ID NO: 5141487 - DNA, 22 bp, Homo sapiens
acccaaagcacatgcttagctt

SEQ ID NO: 5141488 - DNA, 13 bp, Homo sapiens
acccaaagcagga

SEQ ID NO: 5141489 - DNA, 14 bp, Homo sapiens
acccaaagcaggat

SEQ ID NO: 5141490 - DNA, 13 bp, Homo sapiens
acccaaagccctg

SEQ ID NO: 5141491 - DNA, 15 bp, Homo sapiens
acccaaagcctgtcc

SEQ ID NO: 5141492 - DNA, 17 bp, Homo sapiens
acccaaaggtggcagct

SEQ ID NO: 5141493 - DNA, 13 bp, Homo sapiens
acccaaataaatg

SEQ ID NO: 5141494 - DNA, 15 bp, Homo sapiens
acccaaataaatgtg

SEQ ID NO: 5141495 - DNA, 21 bp, Homo sapiens
acccaaataaatgtgtaaatg

SEQ ID NO: 5141496 - DNA, 14 bp, Homo sapiens
acccaaatattgtg

SEQ ID NO: 5141497 - DNA, 15 bp, Homo sapiens
acccaaatcctctcc

SEQ ID NO: 5141498 - DNA, 15 bp, Homo sapiens
acccaaatgtccctg

SEQ ID NO: 5141499 - DNA, 21 bp, Homo sapiens
acccaaatgttcatcaatgaa

SEQ ID NO: 5141500 - DNA, 21 bp, Homo sapiens
acccaaattataagggccctg

SEQ ID NO: 5141501 - DNA, 20 bp, Homo sapiens
acccaaattgagtttaacaa

SEQ ID NO: 5141502 - DNA, 22 bp, Homo sapiens
acccaacaggtgctgaactgtg

SEQ ID NO: 5141503 - DNA, 12 bp, Homo sapiens
acccaacagttt

SEQ ID NO: 5141504 - DNA, 19 bp, Homo sapiens
acccaaccaactttccccc

SEQ ID NO: 5141505 - DNA, 15 bp, Homo sapiens
acccaacccatgccc

SEQ ID NO: 5141506 - DNA, 19 bp, Homo sapiens
acccaacccatgcccctga

SEQ ID NO: 5141507 - DNA, 19 bp, Homo sapiens
acccaaccccaagccagcc

SEQ ID NO: 5141508 - DNA, 17 bp, Homo sapiens
acccaaccctatctcct

SEQ ID NO: 5141509 - DNA, 20 bp, Homo sapiens
acccaaccctatctcctgac

SEQ ID NO: 5141510 - DNA, 15 bp, Homo sapiens
acccaaccctgccct

SEQ ID NO: 5141511 - DNA, 14 bp, Homo sapiens
acccaacctcaccc

SEQ ID NO: 5141512 - DNA, 15 bp, Homo sapiens
acccaacggccctgc

SEQ ID NO: 5141513 - DNA, 20 bp, Homo sapiens
acccaacgtgatgctatgca

SEQ ID NO: 5141514 - DNA, 19 bp, Homo sapiens
acccaactccacagggctg

SEQ ID NO: 5141515 - DNA, 15 bp, Homo sapiens
acccaactctcctgg

SEQ ID NO: 5141516 - DNA, 17 bp, Homo sapiens
acccaactgacttctgc

SEQ ID NO: 5141517 - DNA, 14 bp, Homo sapiens
acccaacttcccct

SEQ ID NO: 5141518 - DNA, 21 bp, Homo sapiens
acccaactttctcactgctgt

SEQ ID NO: 5141519 - DNA, 20 bp, Homo sapiens
acccaagaaaacctgttttt

SEQ ID NO: 5141520 - DNA, 22 bp, Homo sapiens
acccaagaaaacctgtttttaa

SEQ ID NO: 5141521 - DNA, 17 bp, Homo sapiens
acccaagaactcctgaa

SEQ ID NO: 5141522 - DNA, 13 bp, Homo sapiens
acccaagagaact

SEQ ID NO: 5141523 - DNA, 18 bp, Homo sapiens
acccaagagaactttctt

SEQ ID NO: 5141524 - DNA, 14 bp, Homo sapiens
acccaagaggtggg

SEQ ID NO: 5141525 - DNA, 17 bp, Homo sapiens
acccaagataaaagaat

SEQ ID NO: 5141526 - DNA, 15 bp, Homo sapiens
acccaagatgaatta

SEQ ID NO: 5141527 - DNA, 15 bp, Homo sapiens
acccaagcaaggcca

SEQ ID NO: 5141528 - DNA, 15 bp, Homo sapiens
acccaagcaggaggc

SEQ ID NO: 5141529 - DNA, 19 bp, Homo sapiens
acccaagccctgaggcctg

SEQ ID NO: 5141530 - DNA, 21 bp, Homo sapiens
acccaagcctgatccagcctt

SEQ ID NO: 5141531 - DNA, 15 bp, Homo sapiens
acccaagctcctcct

SEQ ID NO: 5141532 - DNA, 20 bp, Homo sapiens
acccaagctgtggcagccgt

SEQ ID NO: 5141533 - DNA, 15 bp, Homo sapiens
acccaagcttagaac

SEQ ID NO: 5141534 - DNA, 22 bp, Homo sapiens
acccaagcttggcagccgagct

SEQ ID NO: 5141535 - DNA, 17 bp, Homo sapiens
acccaaggactgaggga

SEQ ID NO: 5141536 - DNA, 13 bp, Homo sapiens
acccaagggcctg

SEQ ID NO: 5141537 - DNA, 16 bp, Homo sapiens
acccaagggcctggcc

SEQ ID NO: 5141538 - DNA, 18 bp, Homo sapiens
acccaagggcctggcctg

SEQ ID NO: 5141539 - DNA, 22 bp, Homo sapiens
acccaagggcctggcctgagct

SEQ ID NO: 5141540 - DNA, 23 bp, Homo sapiens
acccaagggcctggcctgagctg

SEQ ID NO: 5141541 - DNA, 17 bp, Homo sapiens
acccaagggtcgcctat

SEQ ID NO: 5141542 - DNA, 21 bp, Homo sapiens
acccaagggtcgcctattttt

SEQ ID NO: 5141543 - DNA, 16 bp, Homo sapiens
acccaagtccaagcat

SEQ ID NO: 5141544 - DNA, 13 bp, Homo sapiens
acccaagtccacc

SEQ ID NO: 5141545 - DNA, 23 bp, Homo sapiens
acccaagtgaaggttcccaagga

SEQ ID NO: 5141546 - DNA, 22 bp, Homo sapiens
acccaagtggacgttaggccag

SEQ ID NO: 5141547 - DNA, 18 bp, Homo sapiens
acccaagtggggcctcct

SEQ ID NO: 5141548 - DNA, 16 bp, Homo sapiens
acccaagtgggggcag

SEQ ID NO: 5141549 - DNA, 17 bp, Homo sapiens
acccaagtttatttctc

SEQ ID NO: 5141550 - DNA, 18 bp, Homo sapiens
acccaagtttatttctct

SEQ ID NO: 5141551 - DNA, 15 bp, Homo sapiens
acccaatcagatgcc

SEQ ID NO: 5141552 - DNA, 14 bp, Homo sapiens
acccaatccaaatg

SEQ ID NO: 5141553 - DNA, 14 bp, Homo sapiens
acccaatccctctc

SEQ ID NO: 5141554 - DNA, 13 bp, Homo sapiens
acccaatctgcac

SEQ ID NO: 5141555 - DNA, 19 bp, Homo sapiens
acccaatctgcacactcca

SEQ ID NO: 5141556 - DNA, 21 bp, Homo sapiens
acccaatctgcacactccagg

SEQ ID NO: 5141557 - DNA, 13 bp, Homo sapiens
acccaatctggct

SEQ ID NO: 5141558 - DNA, 15 bp, Homo sapiens
acccaatctggctgg

SEQ ID NO: 5141559 - DNA, 13 bp, Homo sapiens
acccaatggagac

SEQ ID NO: 5141560 - DNA, 14 bp, Homo sapiens
acccaatgggaccg

SEQ ID NO: 5141561 - DNA, 22 bp, Homo sapiens
acccaatgggaccgtgccccac

SEQ ID NO: 5141562 - DNA, 16 bp, Homo sapiens
acccaatgtctcccac

SEQ ID NO: 5141563 - DNA, 22 bp, Homo sapiens
acccaatgtctcccacacccac

SEQ ID NO: 5141564 - DNA, 17 bp, Homo sapiens
acccaattcaggactgg

SEQ ID NO: 5141565 - DNA, 14 bp, Homo sapiens
acccaattgtttca

SEQ ID NO: 5141566 - DNA, 14 bp, Homo sapiens
acccaatttaattc

SEQ ID NO: 5141567 - DNA, 21 bp, Homo sapiens
acccaattttaaaaaataaca

SEQ ID NO: 5141568 - DNA, 20 bp, Homo sapiens
acccacaaaagtacaattta

SEQ ID NO: 5141569 - DNA, 16 bp, Homo sapiens
acccacaaagaaacaa

SEQ ID NO: 5141570 - DNA, 20 bp, Homo sapiens
acccacaaccctctggaagt

SEQ ID NO: 5141571 - DNA, 16 bp, Homo sapiens
acccacaaccctggga

SEQ ID NO: 5141572 - DNA, 21 bp, Homo sapiens
acccacaagaaatgaaagcag

SEQ ID NO: 5141573 - DNA, 17 bp, Homo sapiens
acccacaagagcatcag

SEQ ID NO: 5141574 - DNA, 13 bp, Homo sapiens
acccacaagtgcc

SEQ ID NO: 5141575 - DNA, 17 bp, Homo sapiens
acccacaatcccaccta

SEQ ID NO: 5141576 - DNA, 19 bp, Homo sapiens
acccacaatcccacctagc

SEQ ID NO: 5141577 - DNA, 17 bp, Homo sapiens
acccacaatctgagcac

SEQ ID NO: 5141578 - DNA, 17 bp, Homo sapiens
acccacacagaggacct

SEQ ID NO: 5141579 - DNA, 16 bp, Homo sapiens
acccacacagctgccc

SEQ ID NO: 5141580 - DNA, 19 bp, Homo sapiens
accaacatactcccatctg

SEQ ID NO: 5141581 - DNA, 21 bp, Homo sapiens
accaacatactcccatctgtg

SEQ ID NO: 5141582 - DNA, 21 bp, Homo sapiens
accaacatcccattgccctgg

SEQ ID NO: 5141583 - DNA, 21 bp, Homo sapiens
accaacatctacaaaacatta

SEQ ID NO: 5141584 - DNA, 16 bp, Homo sapiens
accaacatggagaaac

SEQ ID NO: 5141585 - DNA, 18 bp, Homo sapiens
accaacattaaaactcat

SEQ ID NO: 5141586 - DNA, 15 bp, Homo sapiens
accaacccagccgct

SEQ ID NO: 5141587 - DNA, 22 bp, Homo sapiens
accaacccatcagaaggagaag

SEQ ID NO: 5141588 - DNA, 19 bp, Homo sapiens
accaaccccgcggcccaga

SEQ ID NO: 5141589 - DNA, 13 bp, Homo sapiens
accaaccctggga

SEQ ID NO: 5141590 - DNA, 15 bp, Homo sapiens
accaaccctgggacc

SEQ ID NO: 5141591 - DNA, 16 bp, Homo sapiens
accaaccctgggacct

SEQ ID NO: 5141592 - DNA, 19 bp, Homo sapiens
accaaccctggggaaggag

SEQ ID NO: 5141593 - DNA, 14 bp, Homo sapiens
accaaccctgtttc

SEQ ID NO: 5141594 - DNA, 16 bp, Homo sapiens
accaaccctgtttcct

SEQ ID NO: 5141595 - DNA, 21 bp, Homo sapiens
accaaccgaacatgaccaaaa

SEQ ID NO: 5141596 - DNA, 23 bp, Homo sapiens
accaacctccagtgtcagggtcc

SEQ ID NO: 5141597 - DNA, 14 bp, Homo sapiens
accaacctccccgc

SEQ ID NO: 5141598 - DNA, 13 bp, Homo sapiens
accaacctgacca

SEQ ID NO: 5141599 - DNA, 13 bp, Homo sapiens
accaacctgacct

SEQ ID NO: 5141600 - DNA, 15 bp, Homo sapiens
accaacctttaaaat

SEQ ID NO: 5141601 - DNA, 23 bp, Homo sapiens
accaacgaagaaaataaaatgag

SEQ ID NO: 5141602 - DNA, 17 bp, Homo sapiens
accaacgtctgtgccat

SEQ ID NO: 5141603 - DNA, 20 bp, Homo sapiens
accaacgttactcagggctc

SEQ ID NO: 5141604 - DNA, 17 bp, Homo sapiens
accaactagacattctg

SEQ ID NO: 5141605 - DNA, 22 bp, Homo sapiens
accaactatattgcgagaaaca

SEQ ID NO: 5141606 - DNA, 15 bp, Homo sapiens
accaactatttcaat

SEQ ID NO: 5141607 - DNA, 19 bp, Homo sapiens
accaactatttttgaggaa

SEQ ID NO: 5141608 - DNA, 14 bp, Homo sapiens
accaactccagact

SEQ ID NO: 5141609 - DNA, 17 bp, Homo sapiens
accaactcctagttcta

SEQ ID NO: 5141610 - DNA, 18 bp, Homo sapiens
accaactctctctgcccc

SEQ ID NO: 5141611 - DNA, 19 bp, Homo sapiens
accaactctctctgccccc

SEQ ID NO: 5141612 - DNA, 22 bp, Homo sapiens
accaactctgcactccatggcc

SEQ ID NO: 5141613 - DNA, 23 bp, Homo sapiens
accaactctgcactccatggcca

SEQ ID NO: 5141614 - DNA, 14 bp, Homo sapiens
accaactcttgcag

SEQ ID NO: 5141615 - DNA, 14 bp, Homo sapiens
accaactgagccaa

SEQ ID NO: 5141616 - DNA, 15 bp, Homo sapiens
accaactgcacaatc

SEQ ID NO: 5141617 - DNA, 17 bp, Homo sapiens
accaactgccccagggg

SEQ ID NO: 5141618 - DNA, 13 bp, Homo sapiens
accaactgcccta

SEQ ID NO: 5141619 - DNA, 20 bp, Homo sapiens
accaactgccctaagccccc

SEQ ID NO: 5141620 - DNA, 18 bp, Homo sapiens
accaactggaagcacaga

SEQ ID NO: 5141621 - DNA, 19 bp, Homo sapiens
accaactggccctcttctt

SEQ ID NO: 5141622 - DNA, 10 bp, Homo sapiens
accaactgtg

SEQ ID NO: 5141623 - DNA, 11 bp, Homo sapiens
accaactgtgt

SEQ ID NO: 5141624 - DNA, 15 bp, Homo sapiens
accaacttcctctgc

SEQ ID NO: 5141625 - DNA, 17 bp, Homo sapiens
accaacttcctctgcca

SEQ ID NO: 5141626 - DNA, 22 bp, Homo sapiens
accaacttggttctgcttcaat

SEQ ID NO: 5141627 - DNA, 12 bp, Homo sapiens
accaactttcaa

SEQ ID NO: 5141628 - DNA, 15 bp, Homo sapiens
accaactttcaagaa

SEQ ID NO: 5141629 - DNA, 20 bp, Homo sapiens
accaactttcaagaacttgt

SEQ ID NO: 5141630 - DNA, 19 bp, Homo sapiens
accaactttctgtaaactc

SEQ ID NO: 5141631 - DNA, 22 bp, Homo sapiens
accaacttttctattaaaagtg

SEQ ID NO: 5141632 - DNA, 15 bp, Homo sapiens
accaactttttcatt

SEQ ID NO: 5141633 - DNA, 20 bp, Homo sapiens
accaagaaaccactgggcat

SEQ ID NO: 5141634 - DNA, 14 bp, Homo sapiens
accaagaaagcagg

SEQ ID NO: 5141635 - DNA, 13 bp, Homo sapiens
accaagaaagcct

SEQ ID NO: 5141636 - DNA, 18 bp, Homo sapiens
accaagaaaggaacctgt

SEQ ID NO: 5141637 - DNA, 15 bp, Homo sapiens
accaagaacataaac

SEQ ID NO: 5141638 - DNA, 14 bp, Homo sapiens
accaagaagcaaag

SEQ ID NO: 5141639 - DNA, 19 bp, Homo sapiens
accaagaagcctttcctgt

SEQ ID NO: 5141640 - DNA, 21 bp, Homo sapiens
accaagaattctccaaaacaa

SEQ ID NO: 5141641 - DNA, 13 bp, Homo sapiens
accaagactcctg

SEQ ID NO: 5141642 - DNA, 23 bp, Homo sapiens
accaagacttttgtctgatcaag

SEQ ID NO: 5141643 - DNA, 14 bp, Homo sapiens
accaagagacacaa

SEQ ID NO: 5141644 - DNA, 15 bp, Homo sapiens
accaagagagaaaga

SEQ ID NO: 5141645 - DNA, 15 bp, Homo sapiens
accaagagattgcta

SEQ ID NO: 5141646 - DNA, 18 bp, Homo sapiens
accaagaggatttcttca

SEQ ID NO: 5141647 - DNA, 16 bp, Homo sapiens
accaagaggctggttt

SEQ ID NO: 5141648 - DNA, 15 bp, Homo sapiens
accaagagtaacttt

SEQ ID NO: 5141649 - DNA, 14 bp, Homo sapiens
accaagatctataa

SEQ ID NO: 5141650 - DNA, 20 bp, Homo sapiens
accaagatctataaagcgat

SEQ ID NO: 5141651 - DNA, 14 bp, Homo sapiens
accaagatgatcac

SEQ ID NO: 5141652 - DNA, 22 bp, Homo sapiens
accaagatgccatctgtgtcct

SEQ ID NO: 5141653 - DNA, 19 bp, Homo sapiens
accaagatggcccatcctg

SEQ ID NO: 5141654 - DNA, 16 bp, Homo sapiens
accaagatgggtggca

SEQ ID NO: 5141655 - DNA, 20 bp, Homo sapiens
accaagattttgaaggaaat

SEQ ID NO: 5141656 - DNA, 14 bp, Homo sapiens
accaagcacagcag

SEQ ID NO: 5141657 - DNA, 15 bp, Homo sapiens
accaagcactaccag

SEQ ID NO: 5141658 - DNA, 13 bp, Homo sapiens
accaagcaggaag

SEQ ID NO: 5141659 - DNA, 16 bp, Homo sapiens
accaagcaggaagctc

SEQ ID NO: 5141660 - DNA, 15 bp, Homo sapiens
accaagcaggagacg

SEQ ID NO: 5141661 - DNA, 16 bp, Homo sapiens
accaagcatcaggggg

SEQ ID NO: 5141662 - DNA, 15 bp, Homo sapiens
accaagcatctttgt

SEQ ID NO: 5141663 - DNA, 21 bp, Homo sapiens
accaagccaccgcagctgctg

SEQ ID NO: 5141664 - DNA, 21 bp, Homo sapiens
accaagccccttggccctctc

SEQ ID NO: 5141665 - DNA, 16 bp, Homo sapiens
accaagccctgcaaat

SEQ ID NO: 5141666 - DNA, 15 bp, Homo sapiens
accaagccgtggctt

SEQ ID NO: 5141667 - DNA, 17 bp, Homo sapiens
accaagccgtggcttcc

SEQ ID NO: 5141668 - DNA, 12 bp, Homo sapiens
accaagcctctg

SEQ ID NO: 5141669 - DNA, 15 bp, Homo sapiens
accaagcctctggaa

SEQ ID NO: 5141670 - DNA, 18 bp, Homo sapiens
accaagcctggtcagccc

SEQ ID NO: 5141671 - DNA, 11 bp, Homo sapiens
accaagccttg

SEQ ID NO: 5141672 - DNA, 12 bp, Homo sapiens
accaagccttgg

SEQ ID NO: 5141673 - DNA, 15 bp, Homo sapiens
accaagcgaccaagg

SEQ ID NO: 5141674 - DNA, 19 bp, Homo sapiens
accaagctataaaagccca

SEQ ID NO: 5141675 - DNA, 15 bp, Homo sapiens
accaagctatcctgg

SEQ ID NO: 5141676 - DNA, 21 bp, Homo sapiens
accaagctattcctttccctt

SEQ ID NO: 5141677 - DNA, 14 bp, Homo sapiens
accaagctgagttt

SEQ ID NO: 5141678 - DNA, 17 bp, Homo sapiens
accaagctgagtttcct

SEQ ID NO: 5141679 - DNA, 19 bp, Homo sapiens
accaagctgtcacaggttt

SEQ ID NO: 5141680 - DNA, 18 bp, Homo sapiens
accaagcttaaggagagg

SEQ ID NO: 5141681 - DNA, 20 bp, Homo sapiens
accaagcttaaggagaggag

SEQ ID NO: 5141682 - DNA, 17 bp, Homo sapiens
accaagcttagaagcca

SEQ ID NO: 5141683 - DNA, 18 bp, Homo sapiens
accaagcttagtcctggg

SEQ ID NO: 5141684 - DNA, 20 bp, Homo sapiens
accaagcttcagagcctagc

SEQ ID NO: 5141685 - DNA, 22 bp, Homo sapiens
accaagcttcagagcctagcca

SEQ ID NO: 5141686 - DNA, 21 bp, Homo sapiens
accaagctttcaaacatgttg

SEQ ID NO: 5141687 - DNA, 11 bp, Homo sapiens
accaaggaaac

SEQ ID NO: 5141688 - DNA, 20 bp, Homo sapiens
accaaggaaacgctacctct

SEQ ID NO: 5141689 - DNA, 16 bp, Homo sapiens
accaaggaaggagccc

SEQ ID NO: 5141690 - DNA, 18 bp, Homo sapiens
accaaggaaggagcccct

SEQ ID NO: 5141691 - DNA, 20 bp, Homo sapiens
accaaggaaggagcccctga

SEQ ID NO: 5141692 - DNA, 13 bp, Homo sapiens
accaaggaggggc

SEQ ID NO: 5141693 - DNA, 18 bp, Homo sapiens
accaaggcaaggcaggtg

SEQ ID NO: 5141694 - DNA, 19 bp, Homo sapiens
accaaggcaaggcaggtgc

SEQ ID NO: 5141695 - DNA, 12 bp, Homo sapiens
accaaggcagcc

SEQ ID NO: 5141696 - DNA, 13 bp, Homo sapiens
accaaggcagcct

SEQ ID NO: 5141697 - DNA, 17 bp, Homo sapiens
accaaggcagcctccag

SEQ ID NO: 5141698 - DNA, 18 bp, Homo sapiens
accaaggcagcctccaga

SEQ ID NO: 5141699 - DNA, 20 bp, Homo sapiens
accaaggcagcctccagagc

SEQ ID NO: 5141700 - DNA, 22 bp, Homo sapiens
accaaggcagcctccagagcca

SEQ ID NO: 5141701 - DNA, 23 bp, Homo sapiens
accaaggcagcctccagagccag

SEQ ID NO: 5141702 - DNA, 22 bp, Homo sapiens
accaaggcagtgcatgcatgtt

SEQ ID NO: 5141703 - DNA, 15 bp, Homo sapiens
accaaggcccagcta

SEQ ID NO: 5141704 - DNA, 13 bp, Homo sapiens
accaaggccctgc

SEQ ID NO: 5141705 - DNA, 14 bp, Homo sapiens
accaaggccctgca

SEQ ID NO: 5141706 - DNA, 23 bp, Homo sapiens
accaaggccctgcatctgtctgc

SEQ ID NO: 5141707 - DNA, 19 bp, Homo sapiens
accaagggatgggacctga

SEQ ID NO: 5141708 - DNA, 15 bp, Homo sapiens
accaagggcagaggg

SEQ ID NO: 5141709 - DNA, 23 bp, Homo sapiens
accaagggcagaggggtgctcat

SEQ ID NO: 5141710 - DNA, 13 bp, Homo sapiens
accaagggccctc

SEQ ID NO: 5141711 - DNA, 19 bp, Homo sapiens
accaagggccctcactcag

SEQ ID NO: 5141712 - DNA, 23 bp, Homo sapiens
accaagggctgacttctccagga

SEQ ID NO: 5141713 - DNA, 20 bp, Homo sapiens
accaaggggctcttgaaccc

SEQ ID NO: 5141714 - DNA, 20 bp, Homo sapiens
accaagggggcggggactgc

SEQ ID NO: 5141715 - DNA, 19 bp, Homo sapiens
accaaggggtggccgggca

SEQ ID NO: 5141716 - DNA, 21 bp, Homo sapiens
accaaggtacaactgtattta

SEQ ID NO: 5141717 - DNA, 20 bp, Homo sapiens
accaaggtaccgatttctgc

SEQ ID NO: 5141718 - DNA, 23 bp, Homo sapiens
accaaggtaccgatttctgctaa

SEQ ID NO: 5141719 - DNA, 23 bp, Homo sapiens
accaaggtagaatgaccttgtaa

SEQ ID NO: 5141720 - DNA, 22 bp, Homo sapiens
accaaggtcagatttgaaaaga

SEQ ID NO: 5141721 - DNA, 19 bp, Homo sapiens
accaaggtctcacactcct

SEQ ID NO: 5141722 - DNA, 21 bp, Homo sapiens
accaaggtctcacactcctcc

SEQ ID NO: 5141723 - DNA, 19 bp, Homo sapiens
accaaggtcttcagccatc

SEQ ID NO: 5141724 - DNA, 19 bp, Homo sapiens
accaaggtgcactgagaag

SEQ ID NO: 5141725 - DNA, 22 bp, Homo sapiens
accaaggtttatgccaccaggt

SEQ ID NO: 5141726 - DNA, 23 bp, Homo sapiens
accaagtaaccaggccccagcct

SEQ ID NO: 5141727 - DNA, 17 bp, Homo sapiens
accaagtaagacatctc

SEQ ID NO: 5141728 - DNA, 15 bp, Homo sapiens
accaagtacaaggac

SEQ ID NO: 5141729 - DNA, 15 bp, Homo sapiens
accaagtatttatta

SEQ ID NO: 5141730 - DNA, 12 bp, Homo sapiens
accaagtcacac

SEQ ID NO: 5141731 - DNA, 15 bp, Homo sapiens
accaagtcaggccag

SEQ ID NO: 5141732 - DNA, 16 bp, Homo sapiens
accaagtcaggccagg

SEQ ID NO: 5141733 - DNA, 21 bp, Homo sapiens
accaagtcaggccaggtgggc

SEQ ID NO: 5141734 - DNA, 15 bp, Homo sapiens
accaagtcctggcta

SEQ ID NO: 5141735 - DNA, 20 bp, Homo sapiens
accaagtcctggctacatcc

SEQ ID NO: 5141736 - DNA, 12 bp, Homo sapiens
accaagtggctg

SEQ ID NO: 5141737 - DNA, 13 bp, Homo sapiens
accaagtgtgctc

SEQ ID NO: 5141738 - DNA, 14 bp, Homo sapiens
accaagtgtgctct

SEQ ID NO: 5141739 - DNA, 23 bp, Homo sapiens
accaagtgtgctctttttttaaa

SEQ ID NO: 5141740 - DNA, 14 bp, Homo sapiens
accaagtgtggaat

SEQ ID NO: 5141741 - DNA, 12 bp, Homo sapiens
accaagttacac

SEQ ID NO: 5141742 - DNA, 15 bp, Homo sapiens
accaagttatataaa

SEQ ID NO: 5141743 - DNA, 14 bp, Homo sapiens
accaagttcattac

SEQ ID NO: 5141744 - DNA, 15 bp, Homo sapiens
accaagttgtttatt

SEQ ID NO: 5141745 - DNA, 20 bp, Homo sapiens
accaagttgtttattccaaa

SEQ ID NO: 5141746 - DNA, 16 bp, Homo sapiens
accaagtttattcagt

SEQ ID NO: 5141747 - DNA, 24 bp, Homo sapiens
accaagtttattcagtaaacaact

SEQ ID NO: 5141748 - DNA, 12 bp, Homo sapiens
accaataaaaat

SEQ ID NO: 5141749 - DNA, 16 bp, Homo sapiens
accaataaaacaagaa

SEQ ID NO: 5141750 - DNA, 12 bp, Homo sapiens
accaataaaagc

SEQ ID NO: 5141751 - DNA, 21 bp, Homo sapiens
accaataaaagccagatgcta

SEQ ID NO: 5141752 - DNA, 12 bp, Homo sapiens
accaataaaagt

SEQ ID NO: 5141753 - DNA, 15 bp, Homo sapiens
accaataaaagtggt

SEQ ID NO: 5141754 - DNA, 17 bp, Homo sapiens
accaataaaataatttt

SEQ ID NO: 5141755 - DNA, 14 bp, Homo sapiens
accaataaactgag

SEQ ID NO: 5141756 - DNA, 17 bp, Homo sapiens
accaataaagtgaccct

SEQ ID NO: 5141757 - DNA, 19 bp, Homo sapiens
accaataaatgtttgttat

SEQ ID NO: 5141758 - DNA, 24 bp, Homo sapiens
accaataacaaggagctcaccctg

SEQ ID NO: 5141759 - DNA, 19 bp, Homo sapiens
acccacacagctgccctag

SEQ ID NO: 5141760 - DNA, 13 bp, Homo sapiens
acccacacatgtt

SEQ ID NO: 5141761 - DNA, 20 bp, Homo sapiens
acccacacattccagggctg

SEQ ID NO: 5141762 - DNA, 22 bp, Homo sapiens
acccacaccccgtctgcccctt

SEQ ID NO: 5141763 - DNA, 23 bp, Homo sapiens
acccacaccctacagcagatcca

SEQ ID NO: 5141764 - DNA, 17 bp, Homo sapiens
acccacaccgtcttcct

SEQ ID NO: 5141765 - DNA, 19 bp, Homo sapiens
acccacaccgtcttccttc

SEQ ID NO: 5141766 - DNA, 15 bp, Homo sapiens
acccacacctctgcc

SEQ ID NO: 5141767 - DNA, 16 bp, Homo sapiens
acccacacctctgcca

SEQ ID NO: 5141768 - DNA, 17 bp, Homo sapiens
acccacacctctgccag

SEQ ID NO: 5141769 - DNA, 14 bp, Homo sapiens
acccacacgactgc

SEQ ID NO: 5141770 - DNA, 20 bp, Homo sapiens
acccacactacgcagaagag

SEQ ID NO: 5141771 - DNA, 22 bp, Homo sapiens
acccacactcagatcctcctca

SEQ ID NO: 5141772 - DNA, 11 bp, Homo sapiens
acccacactgc

SEQ ID NO: 5141773 - DNA, 13 bp, Homo sapiens
acccacagaaaga

SEQ ID NO: 5141774 - DNA, 16 bp, Homo sapiens
acccacagaaagagag

SEQ ID NO: 5141775 - DNA, 12 bp, Homo sapiens
acccacagaccg

SEQ ID NO: 5141776 - DNA, 22 bp, Homo sapiens
acccacagatgtctctggggca

SEQ ID NO: 5141777 - DNA, 12 bp, Homo sapiens
acccacagccct

SEQ ID NO: 5141778 - DNA, 13 bp, Homo sapiens
acccacagccctg

SEQ ID NO: 5141779 - DNA, 14 bp, Homo sapiens
acccacagccctga

SEQ ID NO: 5141780 - DNA, 16 bp, Homo sapiens
acccacagccctgaaa

SEQ ID NO: 5141781 - DNA, 13 bp, Homo sapiens
acccacagcctcc

SEQ ID NO: 5141782 - DNA, 14 bp, Homo sapiens
acccacagctcagc

SEQ ID NO: 5141783 - DNA, 15 bp, Homo sapiens
acccacagctcagct

SEQ ID NO: 5141784 - DNA, 18 bp, Homo sapiens
acccacagctctgggcct

SEQ ID NO: 5141785 - DNA, 19 bp, Homo sapiens
acccacagctctgggcctc

SEQ ID NO: 5141786 - DNA, 20 bp, Homo sapiens
acccacagctctgggcctct

SEQ ID NO: 5141787 - DNA, 18 bp, Homo sapiens
acccacaggcccacagta

SEQ ID NO: 5141788 - DNA, 16 bp, Homo sapiens
acccacagtggagagg

SEQ ID NO: 5141789 - DNA, 14 bp, Homo sapiens
acccacataaacac

SEQ ID NO: 5141790 - DNA, 13 bp, Homo sapiens
acccacatatctt

SEQ ID NO: 5141791 - DNA, 15 bp, Homo sapiens
acccacatattgaaa

SEQ ID NO: 5141792 - DNA, 23 bp, Homo sapiens
acccacatgccatttgtactgac

SEQ ID NO: 5141793 - DNA, 17 bp, Homo sapiens
acccaccaaccctcagg

SEQ ID NO: 5141794 - DNA, 18 bp, Homo sapiens
acccaccaaccctcaggg

SEQ ID NO: 5141795 - DNA, 20 bp, Homo sapiens
acccaccacccccatcatca

SEQ ID NO: 5141796 - DNA, 17 bp, Homo sapiens
acccaccacccccttta

SEQ ID NO: 5141797 - DNA, 15 bp, Homo sapiens
acccaccactctcag

SEQ ID NO: 5141798 - DNA, 12 bp, Homo sapiens
acccaccactgg

SEQ ID NO: 5141799 - DNA, 22 bp, Homo sapiens
acccaccactggaagcaggatg

SEQ ID NO: 5141800 - DNA, 13 bp, Homo sapiens
acccaccagctcc

SEQ ID NO: 5141801 - DNA, 14 bp, Homo sapiens
acccaccagctcca

SEQ ID NO: 5141802 - DNA, 17 bp, Homo sapiens
acccaccagctccacac

SEQ ID NO: 5141803 - DNA, 20 bp, Homo sapiens
acccaccagctccacacatt

SEQ ID NO: 5141804 - DNA, 16 bp, Homo sapiens
acccaccaggccagct

SEQ ID NO: 5141805 - DNA, 14 bp, Homo sapiens
acccaccagggctc

SEQ ID NO: 5141806 - DNA, 18 bp, Homo sapiens
acccaccagggctcagct

SEQ ID NO: 5141807 - DNA, 21 bp, Homo sapiens
acccaccagggctcagctcct

SEQ ID NO: 5141808 - DNA, 11 bp, Homo sapiens
acccaccagtg

SEQ ID NO: 5141809 - DNA, 14 bp, Homo sapiens
acccaccagtgcct

SEQ ID NO: 5141810 - DNA, 21 bp, Homo sapiens
acccaccatccttccatcctg

SEQ ID NO: 5141811 - DNA, 22 bp, Homo sapiens
acccacccaaaagtcacccagg

SEQ ID NO: 5141812 - DNA, 16 bp, Homo sapiens
acccacccagcaccca

SEQ ID NO: 5141813 - DNA, 13 bp, Homo sapiens
acccacccagccc

SEQ ID NO: 5141814 - DNA, 15 bp, Homo sapiens
acccaccccaactct

SEQ ID NO: 5141815 - DNA, 19 bp, Homo sapiens
acccaccccaactctcccc

SEQ ID NO: 5141816 - DNA, 21 bp, Homo sapiens
acccaccccacagactccggc

SEQ ID NO: 5141817 - DNA, 15 bp, Homo sapiens
acccaccccacgccc

SEQ ID NO: 5141818 - DNA, 12 bp, Homo sapiens
acccaccccagc

SEQ ID NO: 5141819 - DNA, 16 bp, Homo sapiens
acccaccccagcacag

SEQ ID NO: 5141820 - DNA, 21 bp, Homo sapiens
acccaccccagcacagccacc

SEQ ID NO: 5141821 - DNA, 15 bp, Homo sapiens
acccaccccatggag

SEQ ID NO: 5141822 - DNA, 14 bp, Homo sapiens
acccacccccagcc

SEQ ID NO: 5141823 - DNA, 15 bp, Homo sapiens
acccacccccaggcc

SEQ ID NO: 5141824 - DNA, 16 bp, Homo sapiens
acccacccccaggcct

SEQ ID NO: 5141825 - DNA, 19 bp, Homo sapiens
acccacccccaggcctcct

SEQ ID NO: 5141826 - DNA, 16 bp, Homo sapiens
acccaccccctgcctg

SEQ ID NO: 5141827 - DNA, 19 bp, Homo sapiens
acccacccctcctgggccc

SEQ ID NO: 5141828 - DNA, 13 bp, Homo sapiens
acccacccctgcc

SEQ ID NO: 5141829 - DNA, 12 bp, Homo sapiens
acccacccctgt

SEQ ID NO: 5141830 - DNA, 15 bp, Homo sapiens
acccacccctgtgct

SEQ ID NO: 5141831 - DNA, 16 bp, Homo sapiens
acccacccctgtgctc

SEQ ID NO: 5141832 - DNA, 17 bp, Homo sapiens
acccacccctgtgctcc

SEQ ID NO: 5141833 - DNA, 15 bp, Homo sapiens
acccaccctctccac

SEQ ID NO: 5141834 - DNA, 21 bp, Homo sapiens
acccaccctctccacacccag

SEQ ID NO: 5141835 - DNA, 16 bp, Homo sapiens
acccaccctctggtcc

SEQ ID NO: 5141836 - DNA, 15 bp, Homo sapiens
acccaccctgtgcca

SEQ ID NO: 5141837 - DNA, 23 bp, Homo sapiens
acccacccttacttcctggcctc

SEQ ID NO: 5141838 - DNA, 20 bp, Homo sapiens
acccaccgccacaataaaga

SEQ ID NO: 5141839 - DNA, 15 bp, Homo sapiens
acccaccgcccttgc

SEQ ID NO: 5141840 - DNA, 23 bp, Homo sapiens
acccaccgggccactccttcctg

SEQ ID NO: 5141841 - DNA, 14 bp, Homo sapiens
acccacctcagcct

SEQ ID NO: 5141842 - DNA, 12 bp, Homo sapiens
acccacctccac

SEQ ID NO: 5141843 - DNA, 16 bp, Homo sapiens
acccacctccacccag

SEQ ID NO: 5141844 - DNA, 17 bp, Homo sapiens
acccacctccacccagc

SEQ ID NO: 5141845 - DNA, 21 bp, Homo sapiens
acccacctccacccagcccct

SEQ ID NO: 5141846 - DNA, 11 bp, Homo sapiens
acccacctccc

SEQ ID NO: 5141847 - DNA, 13 bp, Homo sapiens
acccacctccctg

SEQ ID NO: 5141848 - DNA, 15 bp, Homo sapiens
acccacctccctgcc

SEQ ID NO: 5141849 - DNA, 16 bp, Homo sapiens
acccacctccctgcct

SEQ ID NO: 5141850 - DNA, 18 bp, Homo sapiens
acccacctccctgcctcc

SEQ ID NO: 5141851 - DNA, 19 bp, Homo sapiens
acccacctcctgcggctca

SEQ ID NO: 5141852 - DNA, 14 bp, Homo sapiens
acccacctcggcct

SEQ ID NO: 5141853 - DNA, 15 bp, Homo sapiens
acccacctcggcctc

SEQ ID NO: 5141854 - DNA, 18 bp, Homo sapiens
acccacctctcctgccct

SEQ ID NO: 5141855 - DNA, 14 bp, Homo sapiens
acccacctctgcca

SEQ ID NO: 5141856 - DNA, 13 bp, Homo sapiens
acccacctctggc

SEQ ID NO: 5141857 - DNA, 18 bp, Homo sapiens
acccacctctggccctgt

SEQ ID NO: 5141858 - DNA, 20 bp, Homo sapiens
acccacctctggccctgtgt

SEQ ID NO: 5141859 - DNA, 14 bp, Homo sapiens
acccacctgaaatg

SEQ ID NO: 5141860 - DNA, 13 bp, Homo sapiens
acccacctgagct

SEQ ID NO: 5141861 - DNA, 16 bp, Homo sapiens
acccacctgagctttg

SEQ ID NO: 5141862 - DNA, 11 bp, Homo sapiens
acccacctgct

SEQ ID NO: 5141863 - DNA, 22 bp, Homo sapiens
acccacctgctgagagacccaa

SEQ ID NO: 5141864 - DNA, 14 bp, Homo sapiens
acccacctgctgct

SEQ ID NO: 5141865 - DNA, 15 bp, Homo sapiens
acccacctgctgctg

SEQ ID NO: 5141866 - DNA, 22 bp, Homo sapiens
acccacctggccccctcagctc

SEQ ID NO: 5141867 - DNA, 20 bp, Homo sapiens
acccacctggtactgaccca

SEQ ID NO: 5141868 - DNA, 23 bp, Homo sapiens
acccacctggtactgacccagga

SEQ ID NO: 5141869 - DNA, 15 bp, Homo sapiens
acccaccttgacgtt

SEQ ID NO: 5141870 - DNA, 20 bp, Homo sapiens
acccaccttgttggagcctg

SEQ ID NO: 5141871 - DNA, 21 bp, Homo sapiens
acccacctttgccacaaagct

SEQ ID NO: 5141872 - DNA, 21 bp, Homo sapiens
acccacgctgggtattaccat

SEQ ID NO: 5141873 - DNA, 15 bp, Homo sapiens
acccacggagccctc

SEQ ID NO: 5141874 - DNA, 16 bp, Homo sapiens
acccacggagccctcc

SEQ ID NO: 5141875 - DNA, 17 bp, Homo sapiens
acccacggagccctccc

SEQ ID NO: 5141876 - DNA, 22 bp, Homo sapiens
acccacgtgagagaatctgcct

SEQ ID NO: 5141877 - DNA, 14 bp, Homo sapiens
acccacgtggctgc

SEQ ID NO: 5141878 - DNA, 21 bp, Homo sapiens
acccactacccttctcctttc

SEQ ID NO: 5141879 - DNA, 23 bp, Homo sapiens
acccactacccttctcctttcct

SEQ ID NO: 5141880 - DNA, 24 bp, Homo sapiens
acccactagccctctttctctctg

SEQ ID NO: 5141881 - DNA, 18 bp, Homo sapiens
acccactatccttcgtga

SEQ ID NO: 5141882 - DNA, 13 bp, Homo sapiens
acccactcacact

SEQ ID NO: 5141883 - DNA, 18 bp, Homo sapiens
acccactcaccagggtcc

SEQ ID NO: 5141884 - DNA, 12 bp, Homo sapiens
acccactcagga

SEQ ID NO: 5141885 - DNA, 13 bp, Homo sapiens
acccactcaggat

SEQ ID NO: 5141886 - DNA, 15 bp, Homo sapiens
acccactcatcagaa

SEQ ID NO: 5141887 - DNA, 15 bp, Homo sapiens
acccactcatgactg

SEQ ID NO: 5141888 - DNA, 16 bp, Homo sapiens
acccactcccttcccc

SEQ ID NO: 5141889 - DNA, 18 bp, Homo sapiens
acccactccgactccccc

SEQ ID NO: 5141890 - DNA, 19 bp, Homo sapiens
acccactcctcactgcccc

SEQ ID NO: 5141891 - DNA, 20 bp, Homo sapiens
acccactctcctctgcctca

SEQ ID NO: 5141892 - DNA, 21 bp, Homo sapiens
acccactctgcggcccgggcc

SEQ ID NO: 5141893 - DNA, 20 bp, Homo sapiens
acccactctggtggccactt

SEQ ID NO: 5141894 - DNA, 23 bp, Homo sapiens
acccactctggtggccacttcat

SEQ ID NO: 5141895 - DNA, 23 bp, Homo sapiens
acccactctttgctacaataaat

SEQ ID NO: 5141896 - DNA, 22 bp, Homo sapiens
acccactgaattgacatgaccc

SEQ ID NO: 5141897 - DNA, 23 bp, Homo sapiens
acccactgacccaactgatcctg

SEQ ID NO: 5141898 - DNA, 18 bp, Homo sapiens
acccactgcatgcagaaa

SEQ ID NO: 5141899 - DNA, 15 bp, Homo sapiens
acccactgctctggt

SEQ ID NO: 5141900 - DNA, 17 bp, Homo sapiens
acccactggactcacct

SEQ ID NO: 5141901 - DNA, 17 bp, Homo sapiens
acccactgtcaggcctc

SEQ ID NO: 5141902 - DNA, 22 bp, Homo sapiens
acccactgtcaggcctctgagc

SEQ ID NO: 5141903 - DNA, 16 bp, Homo sapiens
acccactgtcttgcag

SEQ ID NO: 5141904 - DNA, 19 bp, Homo sapiens
acccactgtggggcaagcc

SEQ ID NO: 5141905 - DNA, 16 bp, Homo sapiens
acccacttagtccact

SEQ ID NO: 5141906 - DNA, 21 bp, Homo sapiens
acccacttagtccactctgag

SEQ ID NO: 5141907 - DNA, 15 bp, Homo sapiens
acccacttccctgca

SEQ ID NO: 5141908 - DNA, 18 bp, Homo sapiens
acccacttccctgcaagg

SEQ ID NO: 5141909 - DNA, 18 bp, Homo sapiens
acccacttctcatcacac

SEQ ID NO: 5141910 - DNA, 15 bp, Homo sapiens
acccacttctgcact

SEQ ID NO: 5141911 - DNA, 12 bp, Homo sapiens
acccacttctgg

SEQ ID NO: 5141912 - DNA, 16 bp, Homo sapiens
acccacttctggcctc

SEQ ID NO: 5141913 - DNA, 19 bp, Homo sapiens
acccacttgcttttaaaat

SEQ ID NO: 5141914 - DNA, 19 bp, Homo sapiens
acccacttgtcactgacac

SEQ ID NO: 5141915 - DNA, 22 bp, Homo sapiens
acccacttgtcactgacacaaa

SEQ ID NO: 5141916 - DNA, 20 bp, Homo sapiens
acccactttgtaatttttgc

SEQ ID NO: 5141917 - DNA, 14 bp, Homo sapiens
acccagaaaggcta

SEQ ID NO: 5141918 - DNA, 19 bp, Homo sapiens
acccagaacctttttatag

SEQ ID NO: 5141919 - DNA, 19 bp, Homo sapiens
acccagaactggacgccca

SEQ ID NO: 5141920 - DNA, 23 bp, Homo sapiens
acccagaagatgtattcagagcc

SEQ ID NO: 5141921 - DNA, 13 bp, Homo sapiens
acccagaaggacc

SEQ ID NO: 5141922 - DNA, 19 bp, Homo sapiens
acccagaatgagacatcca

SEQ ID NO: 5141923 - DNA, 21 bp, Homo sapiens
acccagaatggagcctgctct

SEQ ID NO: 5141924 - DNA, 23 bp, Homo sapiens
acccagaatggagcctgctctcc

SEQ ID NO: 5141925 - DNA, 16 bp, Homo sapiens
acccagacaaccaaaa

SEQ ID NO: 5141926 - DNA, 20 bp, Homo sapiens
acccagacaaccaaaacata

SEQ ID NO: 5141927 - DNA, 17 bp, Homo sapiens
acccagacataaaggaa

SEQ ID NO: 5141928 - DNA, 18 bp, Homo sapiens
acccagacataaaggaaa

SEQ ID NO: 5141929 - DNA, 14 bp, Homo sapiens
acccagacccagtg

SEQ ID NO: 5141930 - DNA, 14 bp, Homo sapiens
acccagaccctcct

SEQ ID NO: 5141931 - DNA, 15 bp, Homo sapiens
acccagacctgcctg

SEQ ID NO: 5141932 - DNA, 18 bp, Homo sapiens
acccagacctgcctgtct

SEQ ID NO: 5141933 - DNA, 21 bp, Homo sapiens
acccagacggctccactagga

SEQ ID NO: 5141934 - DNA, 21 bp, Homo sapiens
acccagacgtggtgcttctca

SEQ ID NO: 5141935 - DNA, 20 bp, Homo sapiens
acccagactggagtgcagtg

SEQ ID NO: 5141936 - DNA, 11 bp, Homo sapiens
acccagactgt

SEQ ID NO: 5141937 - DNA, 15 bp, Homo sapiens
acccagactgtctcc

SEQ ID NO: 5141938 - DNA, 18 bp, Homo sapiens
acccagagaatatataca

SEQ ID NO: 5141939 - DNA, 12 bp, Homo sapiens
acccagagagaa

SEQ ID NO: 5141940 - DNA, 17 bp, Homo sapiens
acccagagaggaatcag

SEQ ID NO: 5141941 - DNA, 17 bp, Homo sapiens
acccagagatgcctgat

SEQ ID NO: 5141942 - DNA, 23 bp, Homo sapiens
acccagagatgcctgatttcatt

SEQ ID NO: 5141943 - DNA, 22 bp, Homo sapiens
acccagagattagcctcccact

SEQ ID NO: 5141944 - DNA, 19 bp, Homo sapiens
acccagagccctctgagcc

SEQ ID NO: 5141945 - DNA, 23 bp, Homo sapiens
acccagaggaggcagaataagaa

SEQ ID NO: 5141946 - DNA, 17 bp, Homo sapiens
acccagaggccctgaag

SEQ ID NO: 5141947 - DNA, 18 bp, Homo sapiens
acccagaggccctgaagc

SEQ ID NO: 5141948 - DNA, 21 bp, Homo sapiens
acccagaggccctgaagcctc

SEQ ID NO: 5141949 - DNA, 23 bp, Homo sapiens
acccagaggctactcttgactta

SEQ ID NO: 5141950 - DNA, 23 bp, Homo sapiens
acccagaggggacgctgaggaag

SEQ ID NO: 5141951 - DNA, 14 bp, Homo sapiens
acccagaggtccag

SEQ ID NO: 5141952 - DNA, 17 bp, Homo sapiens
acccagaggtccaggtc

SEQ ID NO: 5141953 - DNA, 22 bp, Homo sapiens
acccagaggtccaggtcccagc

SEQ ID NO: 5141954 - DNA, 14 bp, Homo sapiens
acccagaggtctcc

SEQ ID NO: 5141955 - DNA, 19 bp, Homo sapiens
acccagaggtctccctata

SEQ ID NO: 5141956 - DNA, 13 bp, Homo sapiens
acccagaggtgga

SEQ ID NO: 5141957 - DNA, 23 bp, Homo sapiens
acccagaggtggccctcccaggc

SEQ ID NO: 5141958 - DNA, 16 bp, Homo sapiens
acccagagtcccaggc

SEQ ID NO: 5141959 - DNA, 20 bp, Homo sapiens
acccagagtggagtctgagt

SEQ ID NO: 5141960 - DNA, 18 bp, Homo sapiens
acccagatatggaaacag

SEQ ID NO: 5141961 - DNA, 19 bp, Homo sapiens
acccagatatggaaacaga

SEQ ID NO: 5141962 - DNA, 21 bp, Homo sapiens
acccagatcaggaaccagggc

SEQ ID NO: 5141963 - DNA, 14 bp, Homo sapiens
acccagatcctcac

SEQ ID NO: 5141964 - DNA, 15 bp, Homo sapiens
acccagatctcatgg

SEQ ID NO: 5141965 - DNA, 15 bp, Homo sapiens
acccagatgatctct

SEQ ID NO: 5141966 - DNA, 18 bp, Homo sapiens
acccagatggcctgaagc

SEQ ID NO: 5141967 - DNA, 22 bp, Homo sapiens
acccagatgggggaaagcacag

SEQ ID NO: 5141968 - DNA, 22 bp, Homo sapiens
acccagatgttttatttatgaa

SEQ ID NO: 5141969 - DNA, 14 bp, Homo sapiens
acccagattttatt

SEQ ID NO: 5141970 - DNA, 20 bp, Homo sapiens
acccagattttgctgtatat

SEQ ID NO: 5141971 - DNA, 18 bp, Homo sapiens
acccagcaaatgggcatt

SEQ ID NO: 5141972 - DNA, 11 bp, Homo sapiens
acccagcagcg

SEQ ID NO: 5141973 - DNA, 13 bp, Homo sapiens
acccagcaggggc

SEQ ID NO: 5141974 - DNA, 19 bp, Homo sapiens
acccagcagttctctgcca

SEQ ID NO: 5141975 - DNA, 14 bp, Homo sapiens
acccagcagttctg

SEQ ID NO: 5141976 - DNA, 15 bp, Homo sapiens
acccagcagttctgt

SEQ ID NO: 5141977 - DNA, 16 bp, Homo sapiens
acccagcatctcccag

SEQ ID NO: 5141978 - DNA, 22 bp, Homo sapiens
acccagcatctcccagcaagac

SEQ ID NO: 5141979 - DNA, 13 bp, Homo sapiens
acccagcatgtac

SEQ ID NO: 5141980 - DNA, 15 bp, Homo sapiens
acccagcatgtacaa

SEQ ID NO: 5141981 - DNA, 16 bp, Homo sapiens
acccagcatgtacaaa

SEQ ID NO: 5141982 - DNA, 13 bp, Homo sapiens
acccagccacctt

SEQ ID NO: 5141983 - DNA, 14 bp, Homo sapiens
acccagccaccttc

SEQ ID NO: 5141984 - DNA, 18 bp, Homo sapiens
acccagccaccttcctga

SEQ ID NO: 5141985 - DNA, 11 bp, Homo sapiens
acccagccact

SEQ ID NO: 5141986 - DNA, 23 bp, Homo sapiens
acccagccactgccaagcttcct

SEQ ID NO: 5141987 - DNA, 22 bp, Homo sapiens
acccagccagagtttgcctccc

SEQ ID NO: 5141988 - DNA, 13 bp, Homo sapiens
acccagccagctg

SEQ ID NO: 5141989 - DNA, 14 bp, Homo sapiens
acccagccaggccc

SEQ ID NO: 5141990 - DNA, 17 bp, Homo sapiens
acccagccaggcccagc

SEQ ID NO: 5141991 - DNA, 15 bp, Homo sapiens
acccagccatctgcc

SEQ ID NO: 5141992 - DNA, 20 bp, Homo sapiens
acccagccatctgcccaggg

SEQ ID NO: 5141993 - DNA, 20 bp, Homo sapiens
acccagcccaacccggccca

SEQ ID NO: 5141994 - DNA, 14 bp, Homo sapiens
acccagcccacccc

SEQ ID NO: 5141995 - DNA, 16 bp, Homo sapiens
acccagcccacttctg

SEQ ID NO: 5141996 - DNA, 17 bp, Homo sapiens
acccagcccacttctgc

SEQ ID NO: 5141997 - DNA, 15 bp, Homo sapiens
acccagcccagccca

SEQ ID NO: 5141998 - DNA, 16 bp, Homo sapiens
acccagcccagcccag

SEQ ID NO: 5141999 - DNA, 19 bp, Homo sapiens
acccagcccattctctctc

SEQ ID NO: 5142000 - DNA, 22 bp, Homo sapiens
acccagcccattctctctcctg

SEQ ID NO: 5142001 - DNA, 10 bp, Homo sapiens
acccagcccc

SEQ ID NO: 5142002 - DNA, 17 bp, Homo sapiens
acccagccccagccagg

SEQ ID NO: 5142003 - DNA, 22 bp, Homo sapiens
acccagccccagcgagtctgga

SEQ ID NO: 5142004 - DNA, 14 bp, Homo sapiens
acccagcccctggc

SEQ ID NO: 5142005 - DNA, 20 bp, Homo sapiens
acccagccccttcccctggg

SEQ ID NO: 5142006 - DNA, 19 bp, Homo sapiens
acccagccctgcccctcac

SEQ ID NO: 5142007 - DNA, 12 bp, Homo sapiens
acccagccctgg

SEQ ID NO: 5142008 - DNA, 13 bp, Homo sapiens
acccagccctggg

SEQ ID NO: 5142009 - DNA, 16 bp, Homo sapiens
acccagccgctgcccg

SEQ ID NO: 5142010 - DNA, 18 bp, Homo sapiens
acccagccgctgcccggc

SEQ ID NO: 5142011 - DNA, 12 bp, Homo sapiens
acccagcctgaa

SEQ ID NO: 5142012 - DNA, 16 bp, Homo sapiens
acccagcgagccctgg

SEQ ID NO: 5142013 - DNA, 17 bp, Homo sapiens
acccagcgagccctggt

SEQ ID NO: 5142014 - DNA, 19 bp, Homo sapiens
acccagcgagccctggtgg

SEQ ID NO: 5142015 - DNA, 24 bp, Homo sapiens
acccagcgagccctggtggcagtg

SEQ ID NO: 5142016 - DNA, 17 bp, Homo sapiens
acccagcggccccccgc

SEQ ID NO: 5142017 - DNA, 20 bp, Homo sapiens
acccagcggcttagccaagc

SEQ ID NO: 5142018 - DNA, 21 bp, Homo sapiens
acccagcggcttagccaagcc

SEQ ID NO: 5142019 - DNA, 23 bp, Homo sapiens
acccagcgggcaggttctgcctg

SEQ ID NO: 5142020 - DNA, 19 bp, Homo sapiens
acccagctactctgtccag

SEQ ID NO: 5142021 - DNA, 20 bp, Homo sapiens
acccagctactctgtccagg

SEQ ID NO: 5142022 - DNA, 21 bp, Homo sapiens
acccagctactctgtccaggc

SEQ ID NO: 5142023 - DNA, 22 bp, Homo sapiens
acccagctatggttctctcgca

SEQ ID NO: 5142024 - DNA, 17 bp, Homo sapiens
acccagctccaggggcc

SEQ ID NO: 5142025 - DNA, 15 bp, Homo sapiens
acccagctcctctga

SEQ ID NO: 5142026 - DNA, 17 bp, Homo sapiens
acccagctcctctgagc

SEQ ID NO: 5142027 - DNA, 21 bp, Homo sapiens
acccagctccttttgtcccca

SEQ ID NO: 5142028 - DNA, 12 bp, Homo sapiens
acccagctctgt

SEQ ID NO: 5142029 - DNA, 16 bp, Homo sapiens
acccagctctgttcca

SEQ ID NO: 5142030 - DNA, 14 bp, Homo sapiens
acccagctgcaccc

SEQ ID NO: 5142031 - DNA, 20 bp, Homo sapiens
acccagctgcaccccttcct

SEQ ID NO: 5142032 - DNA, 15 bp, Homo sapiens
acccagctggtcctg

SEQ ID NO: 5142033 - DNA, 18 bp, Homo sapiens
acccagctggtcctgtgg

SEQ ID NO: 5142034 - DNA, 19 bp, Homo sapiens
acccagcttagagttcttc

SEQ ID NO: 5142035 - DNA, 16 bp, Homo sapiens
acccagcttcaaacta

SEQ ID NO: 5142036 - DNA, 16 bp, Homo sapiens
acccaggaaaggagga

SEQ ID NO: 5142037 - DNA, 21 bp, Homo sapiens
acccaggaagggagggagctg

SEQ ID NO: 5142038 - DNA, 22 bp, Homo sapiens
acccaggaagggagggagctga

SEQ ID NO: 5142039 - DNA, 21 bp, Homo sapiens
acccaggaatgacccttttgt

SEQ ID NO: 5142040 - DNA, 23 bp, Homo sapiens
acccaggacttatttaaactctg

SEQ ID NO: 5142041 - DNA, 12 bp, Homo sapiens
acccaggaggct

SEQ ID NO: 5142042 - DNA, 17 bp, Homo sapiens
acccaggaggctgaggc

SEQ ID NO: 5142043 - DNA, 22 bp, Homo sapiens
acccaggaggctgaggcaggag

SEQ ID NO: 5142044 - DNA, 18 bp, Homo sapiens
acccaggaggggaacact

SEQ ID NO: 5142045 - DNA, 20 bp, Homo sapiens
acccaggaggggaacactgc

SEQ ID NO: 5142046 - DNA, 21 bp, Homo sapiens
acccaggaggggaacactgcc

SEQ ID NO: 5142047 - DNA, 14 bp, Homo sapiens
acccaggaggtgga

SEQ ID NO: 5142048 - DNA, 21 bp, Homo sapiens
acccaggaggtggaggttgca

SEQ ID NO: 5142049 - DNA, 17 bp, Homo sapiens
acccaggagtccagacc

SEQ ID NO: 5142050 - DNA, 17 bp, Homo sapiens
acccaggagtccagccc

SEQ ID NO: 5142051 - DNA, 16 bp, Homo sapiens
acccaggagtttgtgt

SEQ ID NO: 5142052 - DNA, 19 bp, Homo sapiens
acccaggatatctgaaaat

SEQ ID NO: 5142053 - DNA, 21 bp, Homo sapiens
acccaggatatctgaaaatat

SEQ ID NO: 5142054 - DNA, 19 bp, Homo sapiens
acccaggatgacccctggg

SEQ ID NO: 5142055 - DNA, 20 bp, Homo sapiens
acccaggcaatcttgccttc

SEQ ID NO: 5142056 - DNA, 11 bp, Homo sapiens
acccaggcagc

SEQ ID NO: 5142057 - DNA, 15 bp, Homo sapiens
acccaggcagctggc

SEQ ID NO: 5142058 - DNA, 16 bp, Homo sapiens
acccaggcagctggca

SEQ ID NO: 5142059 - DNA, 19 bp, Homo sapiens
acccaggcaggccctgcct

SEQ ID NO: 5142060 - DNA, 19 bp, Homo sapiens
acccaggccaggcatgtgg

SEQ ID NO: 5142061 - DNA, 20 bp, Homo sapiens
acccaggcccatgccaaggc

SEQ ID NO: 5142062 - DNA, 17 bp, Homo sapiens
acccaggccctccatgg

SEQ ID NO: 5142063 - DNA, 20 bp, Homo sapiens
acccaggccctccatgggct

SEQ ID NO: 5142064 - DNA, 17 bp, Homo sapiens
acccaggccgcctgcca

SEQ ID NO: 5142065 - DNA, 18 bp, Homo sapiens
acccaggctccatgggga

SEQ ID NO: 5142066 - DNA, 14 bp, Homo sapiens
acccaggctcccag

SEQ ID NO: 5142067 - DNA, 21 bp, Homo sapiens
acccaggctcccagcctaagg

SEQ ID NO: 5142068 - DNA, 15 bp, Homo sapiens
acccaggctccgccc

SEQ ID NO: 5142069 - DNA, 19 bp, Homo sapiens
acccaggctccgcccttag

SEQ ID NO: 5142070 - DNA, 20 bp, Homo sapiens
acccaggctccgcccttagt

SEQ ID NO: 5142071 - DNA, 21 bp, Homo sapiens
acccaggctccgcccttagtc

SEQ ID NO: 5142072 - DNA, 23 bp, Homo sapiens
acccaggctccgcccttagtccc

SEQ ID NO: 5142073 - DNA, 21 bp, Homo sapiens
acccaggctctggagccagag

SEQ ID NO: 5142074 - DNA, 11 bp, Homo sapiens
acccaggctgc

SEQ ID NO: 5142075 - DNA, 13 bp, Homo sapiens
acccaggctgcac

SEQ ID NO: 5142076 - DNA, 17 bp, Homo sapiens
acccaggctgcactgca

SEQ ID NO: 5142077 - DNA, 15 bp, Homo sapiens
acccaggctgcagtg

SEQ ID NO: 5142078 - DNA, 19 bp, Homo sapiens
acccaggctgcagtgcaat

SEQ ID NO: 5142079 - DNA, 20 bp, Homo sapiens
acccaggctggagtacagtg

SEQ ID NO: 5142080 - DNA, 16 bp, Homo sapiens
acccaggctggagtgc

SEQ ID NO: 5142081 - DNA, 12 bp, Homo sapiens
acccaggctggg

SEQ ID NO: 5142082 - DNA, 18 bp, Homo sapiens
acccagggactctccaaa

SEQ ID NO: 5142083 - DNA, 19 bp, Homo sapiens
acccagggactctccaaac

SEQ ID NO: 5142084 - DNA, 12 bp, Homo sapiens
acccagggagct

SEQ ID NO: 5142085 - DNA, 14 bp, Homo sapiens
acccagggaggaag

SEQ ID NO: 5142086 - DNA, 21 bp, Homo sapiens
acccagggcagtgtggtggga

SEQ ID NO: 5142087 - DNA, 21 bp, Homo sapiens
acccagggcccaggcaaatca

SEQ ID NO: 5142088 - DNA, 14 bp, Homo sapiens
acccagggccccca

SEQ ID NO: 5142089 - DNA, 12 bp, Homo sapiens
acccagggcctg

SEQ ID NO: 5142090 - DNA, 23 bp, Homo sapiens
acccagggcctgacttgagccac

SEQ ID NO: 5142091 - DNA, 21 bp, Homo sapiens
acccagggtggtcttcaagcc

SEQ ID NO: 5142092 - DNA, 23 bp, Homo sapiens
acccagggtggtcttcaagcctg

SEQ ID NO: 5142093 - DNA, 23 bp, Homo sapiens
acccaggtccccaattgagaatg

SEQ ID NO: 5142094 - DNA, 21 bp, Homo sapiens
acccaggtcccccgactgcct

SEQ ID NO: 5142095 - DNA, 16 bp, Homo sapiens
acccaggtctcttcct

SEQ ID NO: 5142096 - DNA, 14 bp, Homo sapiens
acccaggtctgatg

SEQ ID NO: 5142097 - DNA, 22 bp, Homo sapiens
acccaggtctgatgccaaagct

SEQ ID NO: 5142098 - DNA, 19 bp, Homo sapiens
acccaggtcttccagacct

SEQ ID NO: 5142099 - DNA, 20 bp, Homo sapiens
acccaggtcttccagacctg

SEQ ID NO: 5142100 - DNA, 21 bp, Homo sapiens
acccaggtgatgttagtgttt

SEQ ID NO: 5142101 - DNA, 11 bp, Homo sapiens
acccaggtgct

SEQ ID NO: 5142102 - DNA, 19 bp, Homo sapiens
acccaggtggagggcacag

SEQ ID NO: 5142103 - DNA, 23 bp, Homo sapiens
acccaggtggagggcacagccct

SEQ ID NO: 5142104 - DNA, 18 bp, Homo sapiens
  misc_feature (7)..(7): n is a, c, g or t
acccagnagggcgtcgct

SEQ ID NO: 5142105 - DNA, 18 bp, Homo sapiens
acccagtaactcatctgt

SEQ ID NO: 5142106 - DNA, 20 bp, Homo sapiens
acccagtattactgctgctg

SEQ ID NO: 5142107 - DNA, 18 bp, Homo sapiens
acccagtccatgctccag

SEQ ID NO: 5142108 - DNA, 17 bp, Homo sapiens
acccagtccccacccgc

SEQ ID NO: 5142109 - DNA, 21 bp, Homo sapiens
acccagtccccgtgccccgcc

SEQ ID NO: 5142110 - DNA, 13 bp, Homo sapiens
acccagtccctgg

SEQ ID NO: 5142111 - DNA, 15 bp, Homo sapiens
acccagtccctgggg

SEQ ID NO: 5142112 - DNA, 16 bp, Homo sapiens
acccagtcctctgcct

SEQ ID NO: 5142113 - DNA, 14 bp, Homo sapiens
acccagtcctggcc

SEQ ID NO: 5142114 - DNA, 20 bp, Homo sapiens
acccagtctaggagctcctt

SEQ ID NO: 5142115 - DNA, 15 bp, Homo sapiens
acccagtctcagaca

SEQ ID NO: 5142116 - DNA, 16 bp, Homo sapiens
accaataacttcagag

SEQ ID NO: 5142117 - DNA, 18 bp, Homo sapiens
accaataacttcagagaa

SEQ ID NO: 5142118 - DNA, 19 bp, Homo sapiens
accaataacttcagagaag

SEQ ID NO: 5142119 - DNA, 11 bp, Homo sapiens
accaatacaaa

SEQ ID NO: 5142120 - DNA, 13 bp, Homo sapiens
accaatacatttg

SEQ ID NO: 5142121 - DNA, 17 bp, Homo sapiens
accaatacatttgtatt

SEQ ID NO: 5142122 - DNA, 17 bp, Homo sapiens
accaatactactgtaaa

SEQ ID NO: 5142123 - DNA, 21 bp, Homo sapiens
accaatactactgtaaatgta

SEQ ID NO: 5142124 - DNA, 13 bp, Homo sapiens
accaatagattcc

SEQ ID NO: 5142125 - DNA, 16 bp, Homo sapiens
accaatagcccacagc

SEQ ID NO: 5142126 - DNA, 17 bp, Homo sapiens
accaatagcctgaattt

SEQ ID NO: 5142127 - DNA, 18 bp, Homo sapiens
accaatattaccatctta

SEQ ID NO: 5142128 - DNA, 16 bp, Homo sapiens
accaatattgtacagt

SEQ ID NO: 5142129 - DNA, 18 bp, Homo sapiens
accaatattgtacagttt

SEQ ID NO: 5142130 - DNA, 16 bp, Homo sapiens
accaatatttaatctt

SEQ ID NO: 5142131 - DNA, 20 bp, Homo sapiens
accaatatttaatcttttat

SEQ ID NO: 5142132 - DNA, 19 bp, Homo sapiens
accaatatttcttcacaaa

SEQ ID NO: 5142133 - DNA, 13 bp, Homo sapiens
accaatcaaatat

SEQ ID NO: 5142134 - DNA, 18 bp, Homo sapiens
accaatcaaatgtctggg

SEQ ID NO: 5142135 - DNA, 15 bp, Homo sapiens
accaatcaataatag

SEQ ID NO: 5142136 - DNA, 16 bp, Homo sapiens
accaatcagagagcct

SEQ ID NO: 5142137 - DNA, 12 bp, Homo sapiens
accaatcatctt

SEQ ID NO: 5142138 - DNA, 13 bp, Homo sapiens
accaatcccaact

SEQ ID NO: 5142139 - DNA, 16 bp, Homo sapiens
accaatcccagggctg

SEQ ID NO: 5142140 - DNA, 18 bp, Homo sapiens
accaatcccagggctggc

SEQ ID NO: 5142141 - DNA, 19 bp, Homo sapiens
accaatcccagggctggct

SEQ ID NO: 5142142 - DNA, 22 bp, Homo sapiens
accaatcccagggctggctctg

SEQ ID NO: 5142143 - DNA, 22 bp, Homo sapiens
accaatcccgtgaaagaattat

SEQ ID NO: 5142144 - DNA, 19 bp, Homo sapiens
accaatcctactaataaac

SEQ ID NO: 5142145 - DNA, 17 bp, Homo sapiens
accaatcctatgcatgg

SEQ ID NO: 5142146 - DNA, 21 bp, Homo sapiens
accaatcctatgtcatttcta

SEQ ID NO: 5142147 - DNA, 13 bp, Homo sapiens
accaatcctggac

SEQ ID NO: 5142148 - DNA, 17 bp, Homo sapiens
accaatcgggagtagca

SEQ ID NO: 5142149 - DNA, 15 bp, Homo sapiens
accaatctctaagcc

SEQ ID NO: 5142150 - DNA, 13 bp, Homo sapiens
accaatctctgct

SEQ ID NO: 5142151 - DNA, 13 bp, Homo sapiens
accaatctctgtg

SEQ ID NO: 5142152 - DNA, 22 bp, Homo sapiens
accaatctgtgagaagtttttg

SEQ ID NO: 5142153 - DNA, 20 bp, Homo sapiens
accaatcttaaacataataa

SEQ ID NO: 5142154 - DNA, 16 bp, Homo sapiens
accaatcttactttgt

SEQ ID NO: 5142155 - DNA, 18 bp, Homo sapiens
accaatcttactttgtaa

SEQ ID NO: 5142156 - DNA, 21 bp, Homo sapiens
accaatcttactttgtaaatt

SEQ ID NO: 5142157 - DNA, 17 bp, Homo sapiens
accaatcttgtttatag

SEQ ID NO: 5142158 - DNA, 20 bp, Homo sapiens
accaatcttgtttatagcaa

SEQ ID NO: 5142159 - DNA, 22 bp, Homo sapiens
accaatgaagaagacaaagtct

SEQ ID NO: 5142160 - DNA, 14 bp, Homo sapiens
accaatgacttttt

SEQ ID NO: 5142161 - DNA, 12 bp, Homo sapiens
accaatgattca

SEQ ID NO: 5142162 - DNA, 22 bp, Homo sapiens
accaatgccaagataattcact

SEQ ID NO: 5142163 - DNA, 16 bp, Homo sapiens
accaatgcccagcagg

SEQ ID NO: 5142164 - DNA, 18 bp, Homo sapiens
accaatgccttaattaaa

SEQ ID NO: 5142165 - DNA, 16 bp, Homo sapiens
accaatgcctttttag

SEQ ID NO: 5142166 - DNA, 22 bp, Homo sapiens
accaatgcctttttagatgtat

SEQ ID NO: 5142167 - DNA, 18 bp, Homo sapiens
accaatgcttttatcaaa

SEQ ID NO: 5142168 - DNA, 14 bp, Homo sapiens
accaatgggaagca

SEQ ID NO: 5142169 - DNA, 15 bp, Homo sapiens
accaatgggaagcag

SEQ ID NO: 5142170 - DNA, 23 bp, Homo sapiens
accaatgggtttgccaagccctt

SEQ ID NO: 5142171 - DNA, 22 bp, Homo sapiens
accaatggtgatcctctatttt

SEQ ID NO: 5142172 - DNA, 21 bp, Homo sapiens
accaatgtacccaccgggcca

SEQ ID NO: 5142173 - DNA, 13 bp, Homo sapiens
accaatgtcttga

SEQ ID NO: 5142174 - DNA, 16 bp, Homo sapiens
accaatgtgttttctg

SEQ ID NO: 5142175 - DNA, 17 bp, Homo sapiens
accaatgtgttttctgt

SEQ ID NO: 5142176 - DNA, 19 bp, Homo sapiens
accaatgtgttttctgtag

SEQ ID NO: 5142177 - DNA, 15 bp, Homo sapiens
accaatgttctctct

SEQ ID NO: 5142178 - DNA, 17 bp, Homo sapiens
accaattaagtgttgaa

SEQ ID NO: 5142179 - DNA, 20 bp, Homo sapiens
accaattacccataaacagc

SEQ ID NO: 5142180 - DNA, 22 bp, Homo sapiens
accaattactgcactcttaaac

SEQ ID NO: 5142181 - DNA, 22 bp, Homo sapiens
accaattataacttattagcag

SEQ ID NO: 5142182 - DNA, 14 bp, Homo sapiens
accaattattttca

SEQ ID NO: 5142183 - DNA, 18 bp, Homo sapiens
accaattcactttagagt

SEQ ID NO: 5142184 - DNA, 12 bp, Homo sapiens
accaattccaat

SEQ ID NO: 5142185 - DNA, 18 bp, Homo sapiens
accaattccacttcctgc

SEQ ID NO: 5142186 - DNA, 17 bp, Homo sapiens
accaattcctcatttgt

SEQ ID NO: 5142187 - DNA, 15 bp, Homo sapiens
accaattgatgtttt

SEQ ID NO: 5142188 - DNA, 17 bp, Homo sapiens
accaattgattttaaac

SEQ ID NO: 5142189 - DNA, 14 bp, Homo sapiens
accaattgccctgc

SEQ ID NO: 5142190 - DNA, 16 bp, Homo sapiens
accaattgccctgcca

SEQ ID NO: 5142191 - DNA, 22 bp, Homo sapiens
accaattgctgctacttatata

SEQ ID NO: 5142192 - DNA, 14 bp, Homo sapiens
accaattgtgctgc

SEQ ID NO: 5142193 - DNA, 13 bp, Homo sapiens
accaatttcttcc

SEQ ID NO: 5142194 - DNA, 16 bp, Homo sapiens
accaatttcttccttc

SEQ ID NO: 5142195 - DNA, 16 bp, Homo sapiens
accaatttctttctaa

SEQ ID NO: 5142196 - DNA, 17 bp, Homo sapiens
accaatttgcaccagtt

SEQ ID NO: 5142197 - DNA, 21 bp, Homo sapiens
accaatttggtaaaaatgctg

SEQ ID NO: 5142198 - DNA, 22 bp, Homo sapiens
accaattttttgtgtgtgaagc

SEQ ID NO: 5142199 - DNA, 23 bp, Homo sapiens
accaattttttgttcttcagaga

SEQ ID NO: 5142200 - DNA, 20 bp, Homo sapiens
accacaaaaagagaagctgt

SEQ ID NO: 5142201 - DNA, 18 bp, Homo sapiens
accacaaacggagcccct

SEQ ID NO: 5142202 - DNA, 14 bp, Homo sapiens
accacaaaggccaa

SEQ ID NO: 5142203 - DNA, 18 bp, Homo sapiens
accacaaaggccaaactg

SEQ ID NO: 5142204 - DNA, 17 bp, Homo sapiens
accacaacatgaggcca

SEQ ID NO: 5142205 - DNA, 21 bp, Homo sapiens
accacaacatgaggccactgg

SEQ ID NO: 5142206 - DNA, 20 bp, Homo sapiens
accacaacctccacctcctg

SEQ ID NO: 5142207 - DNA, 15 bp, Homo sapiens
accacaaccttgcag

SEQ ID NO: 5142208 - DNA, 13 bp, Homo sapiens
accacaactgaca

SEQ ID NO: 5142209 - DNA, 23 bp, Homo sapiens
accacaagacatttctttctgtt

SEQ ID NO: 5142210 - DNA, 18 bp, Homo sapiens
accacaagagatcagcag

SEQ ID NO: 5142211 - DNA, 14 bp, Homo sapiens
accacaagctgagc

SEQ ID NO: 5142212 - DNA, 21 bp, Homo sapiens
accacaagctgagcaggacag

SEQ ID NO: 5142213 - DNA, 12 bp, Homo sapiens
accacaaggaaa

SEQ ID NO: 5142214 - DNA, 21 bp, Homo sapiens
accacaagtatctaaatttgg

SEQ ID NO: 5142215 - DNA, 17 bp, Homo sapiens
accacaatgcagtgcct

SEQ ID NO: 5142216 - DNA, 14 bp, Homo sapiens
accacacaaagaca

SEQ ID NO: 5142217 - DNA, 14 bp, Homo sapiens
accacacacacaca

SEQ ID NO: 5142218 - DNA, 20 bp, Homo sapiens
accacacacacccttcccca

SEQ ID NO: 5142219 - DNA, 21 bp, Homo sapiens
accacacacacccttccccac

SEQ ID NO: 5142220 - DNA, 12 bp, Homo sapiens
accacacagtcc

SEQ ID NO: 5142221 - DNA, 13 bp, Homo sapiens
accacacagtccc

SEQ ID NO: 5142222 - DNA, 16 bp, Homo sapiens
accacacagtccccag

SEQ ID NO: 5142223 - DNA, 17 bp, Homo sapiens
accacacagtccccaga

SEQ ID NO: 5142224 - DNA, 15 bp, Homo sapiens
accacaccaaacctc

SEQ ID NO: 5142225 - DNA, 18 bp, Homo sapiens
accacaccaaccaggcct

SEQ ID NO: 5142226 - DNA, 17 bp, Homo sapiens
accacacccacactcag

SEQ ID NO: 5142227 - DNA, 13 bp, Homo sapiens
accacacccagcc

SEQ ID NO: 5142228 - DNA, 15 bp, Homo sapiens
accacacccagcctc

SEQ ID NO: 5142229 - DNA, 22 bp, Homo sapiens
accacacccagcctcagtcctc

SEQ ID NO: 5142230 - DNA, 17 bp, Homo sapiens
accacacccagcctctg

SEQ ID NO: 5142231 - DNA, 17 bp, Homo sapiens
accacacccaggtctct

SEQ ID NO: 5142232 - DNA, 22 bp, Homo sapiens
accacacccctgccggccttgg

SEQ ID NO: 5142233 - DNA, 21 bp, Homo sapiens
accacacccgaagtcctgtca

SEQ ID NO: 5142234 - DNA, 18 bp, Homo sapiens
accacacccggctaattt

SEQ ID NO: 5142235 - DNA, 13 bp, Homo sapiens
accacaccctgcc

SEQ ID NO: 5142236 - DNA, 14 bp, Homo sapiens
accacaccctgcct

SEQ ID NO: 5142237 - DNA, 17 bp, Homo sapiens
accacaccctgcctgct

SEQ ID NO: 5142238 - DNA, 17 bp, Homo sapiens
accacaccctgtactgt

SEQ ID NO: 5142239 - DNA, 22 bp, Homo sapiens
accacacgtaatgaaacttgga

SEQ ID NO: 5142240 - DNA, 21 bp, Homo sapiens
accacactcaccccagcctca

SEQ ID NO: 5142241 - DNA, 18 bp, Homo sapiens
accacactgaccacactg

SEQ ID NO: 5142242 - DNA, 13 bp, Homo sapiens
accacactgagtt

SEQ ID NO: 5142243 - DNA, 15 bp, Homo sapiens
accacactgagttct

SEQ ID NO: 5142244 - DNA, 17 bp, Homo sapiens
accacacttcctgtcca

SEQ ID NO: 5142245 - DNA, 13 bp, Homo sapiens
accacacttgaaa

SEQ ID NO: 5142246 - DNA, 17 bp, Homo sapiens
accacacttgaaacctt

SEQ ID NO: 5142247 - DNA, 20 bp, Homo sapiens
accacacttgtcggctccag

SEQ ID NO: 5142248 - DNA, 21 bp, Homo sapiens
accacacttgttttctttgtt

SEQ ID NO: 5142249 - DNA, 15 bp, Homo sapiens
accacagaaatcaca

SEQ ID NO: 5142250 - DNA, 23 bp, Homo sapiens
accacagacacaatatgtatgct

SEQ ID NO: 5142251 - DNA, 13 bp, Homo sapiens
accacagacacac

SEQ ID NO: 5142252 - DNA, 12 bp, Homo sapiens
accacagacact

SEQ ID NO: 5142253 - DNA, 13 bp, Homo sapiens
accacagacactc

SEQ ID NO: 5142254 - DNA, 17 bp, Homo sapiens
accacagacgccacctg

SEQ ID NO: 5142255 - DNA, 12 bp, Homo sapiens
accacagacttt

SEQ ID NO: 5142256 - DNA, 23 bp, Homo sapiens
accacagactttagctttctgag

SEQ ID NO: 5142257 - DNA, 21 bp, Homo sapiens
accacagataagcctgaaaca

SEQ ID NO: 5142258 - DNA, 16 bp, Homo sapiens
accacagatactgaaa

SEQ ID NO: 5142259 - DNA, 10 bp, Homo sapiens
accacagcaa

SEQ ID NO: 5142260 - DNA, 12 bp, Homo sapiens
accacagcagga

SEQ ID NO: 5142261 - DNA, 18 bp, Homo sapiens
accacagcccgctctctg

SEQ ID NO: 5142262 - DNA, 20 bp, Homo sapiens
accacagcccgctctctggc

SEQ ID NO: 5142263 - DNA, 17 bp, Homo sapiens
accacagccggtcagag

SEQ ID NO: 5142264 - DNA, 19 bp, Homo sapiens
accacagccggtcagagga

SEQ ID NO: 5142265 - DNA, 14 bp, Homo sapiens
accacagcctcccc

SEQ ID NO: 5142266 - DNA, 15 bp, Homo sapiens
accacagcctcccct

SEQ ID NO: 5142267 - DNA, 17 bp, Homo sapiens
accacagcctccccttc

SEQ ID NO: 5142268 - DNA, 23 bp, Homo sapiens
accacagcctccccttcccagac

SEQ ID NO: 5142269 - DNA, 23 bp, Homo sapiens
accacagccttctaaattcccaa

SEQ ID NO: 5142270 - DNA, 12 bp, Homo sapiens
accacagctgct

SEQ ID NO: 5142271 - DNA, 18 bp, Homo sapiens
accacagctgctggccag

SEQ ID NO: 5142272 - DNA, 14 bp, Homo sapiens
accacagctgggca

SEQ ID NO: 5142273 - DNA, 22 bp, Homo sapiens
accacaggaattttaaaaacaa

SEQ ID NO: 5142274 - DNA, 15 bp, Homo sapiens
accacaggctcaggc

SEQ ID NO: 5142275 - DNA, 16 bp, Homo sapiens
accacaggcttgttac

SEQ ID NO: 5142276 - DNA, 16 bp, Homo sapiens
accacaggtgtgagcc

SEQ ID NO: 5142277 - DNA, 14 bp, Homo sapiens
accacagtcagtgg

SEQ ID NO: 5142278 - DNA, 22 bp, Homo sapiens
accacagtcagtggagcctggg

SEQ ID NO: 5142279 - DNA, 16 bp, Homo sapiens
accacagtccctcacc

SEQ ID NO: 5142280 - DNA, 14 bp, Homo sapiens
accacagtgccacc

SEQ ID NO: 5142281 - DNA, 16 bp, Homo sapiens
accacagtgggtggca

SEQ ID NO: 5142282 - DNA, 21 bp, Homo sapiens
accacagtgtaccattaaaat

SEQ ID NO: 5142283 - DNA, 12 bp, Homo sapiens
accacagtgtct

SEQ ID NO: 5142284 - DNA, 18 bp, Homo sapiens
accacataatttttgtac

SEQ ID NO: 5142285 - DNA, 18 bp, Homo sapiens
accacatacgtaaaaatc

SEQ ID NO: 5142286 - DNA, 14 bp, Homo sapiens
accacatagaacat

SEQ ID NO: 5142287 - DNA, 19 bp, Homo sapiens
accacatagcatgaggcca

SEQ ID NO: 5142288 - DNA, 23 bp, Homo sapiens
accacatccacacacgcaggaac

SEQ ID NO: 5142289 - DNA, 14 bp, Homo sapiens
accacatctgctct

SEQ ID NO: 5142290 - DNA, 15 bp, Homo sapiens
accacatctgtcctc

SEQ ID NO: 5142291 - DNA, 14 bp, Homo sapiens
accacatcttgctc

SEQ ID NO: 5142292 - DNA, 18 bp, Homo sapiens
accacatcttgctctgct

SEQ ID NO: 5142293 - DNA, 21 bp, Homo sapiens
accacatcttgctctgctgac

SEQ ID NO: 5142294 - DNA, 17 bp, Homo sapiens
accacatctttatctgt

SEQ ID NO: 5142295 - DNA, 21 bp, Homo sapiens
accacatgaactacgtgacct

SEQ ID NO: 5142296 - DNA, 19 bp, Homo sapiens
acccagtctcctctccatt

SEQ ID NO: 5142297 - DNA, 18 bp, Homo sapiens
acccagtctctgctccac

SEQ ID NO: 5142298 - DNA, 13 bp, Homo sapiens
acccagtctttct

SEQ ID NO: 5142299 - DNA, 14 bp, Homo sapiens
acccagtctttctt

SEQ ID NO: 5142300 - DNA, 21 bp, Homo sapiens
acccagtctttcttcactctg

SEQ ID NO: 5142301 - DNA, 22 bp, Homo sapiens
acccagtgaggatgctgcagtg

SEQ ID NO: 5142302 - DNA, 9 bp, Homo sapiens
acccagtgc

SEQ ID NO: 5142303 - DNA, 15 bp, Homo sapiens
acccagtgcccccac

SEQ ID NO: 5142304 - DNA, 22 bp, Homo sapiens
acccagtgcccccactgaccag

SEQ ID NO: 5142305 - DNA, 14 bp, Homo sapiens
acccagtgctgcca

SEQ ID NO: 5142306 - DNA, 15 bp, Homo sapiens
acccagtgctgccat

SEQ ID NO: 5142307 - DNA, 11 bp, Homo sapiens
acccagtggca

SEQ ID NO: 5142308 - DNA, 13 bp, Homo sapiens
acccagtggcagg

SEQ ID NO: 5142309 - DNA, 16 bp, Homo sapiens
acccagtggcagggca

SEQ ID NO: 5142310 - DNA, 18 bp, Homo sapiens
acccagtggcagggcaca

SEQ ID NO: 5142311 - DNA, 20 bp, Homo sapiens
acccagtggcagggcacagg

SEQ ID NO: 5142312 - DNA, 22 bp, Homo sapiens
acccagtggcataccgtttggt

SEQ ID NO: 5142313 - DNA, 23 bp, Homo sapiens
acccagtgtaaagaataaatgaa

SEQ ID NO: 5142314 - DNA, 17 bp, Homo sapiens
acccagtgtgtgctcag

SEQ ID NO: 5142315 - DNA, 19 bp, Homo sapiens
acccagtgtgtgctcagca

SEQ ID NO: 5142316 - DNA, 23 bp, Homo sapiens
acccagtgtgtgctcagcagccc

SEQ ID NO: 5142317 - DNA, 17 bp, Homo sapiens
acccagttgccatctgc

SEQ ID NO: 5142318 - DNA, 19 bp, Homo sapiens
acccagttgcctccagggc

SEQ ID NO: 5142319 - DNA, 19 bp, Homo sapiens
acccagttggtgactggga

SEQ ID NO: 5142320 - DNA, 20 bp, Homo sapiens
acccagttggtgactgggaa

SEQ ID NO: 5142321 - DNA, 22 bp, Homo sapiens
acccagttgtgctatattttta

SEQ ID NO: 5142322 - DNA, 17 bp, Homo sapiens
acccagtttccttggga

SEQ ID NO: 5142323 - DNA, 20 bp, Homo sapiens
acccagtttctaaactggag

SEQ ID NO: 5142324 - DNA, 22 bp, Homo sapiens
acccagtttctaaactggagac

SEQ ID NO: 5142325 - DNA, 23 bp, Homo sapiens
acccagtttctaaactggagact

SEQ ID NO: 5142326 - DNA, 16 bp, Homo sapiens
acccataaacagcaca

SEQ ID NO: 5142327 - DNA, 18 bp, Homo sapiens
acccataaacagcacacc

SEQ ID NO: 5142328 - DNA, 15 bp, Homo sapiens
acccataaacagtaa

SEQ ID NO: 5142329 - DNA, 23 bp, Homo sapiens
acccataagtaatatttaaagat

SEQ ID NO: 5142330 - DNA, 24 bp, Homo sapiens
acccataataagagaatgttccta

SEQ ID NO: 5142331 - DNA, 14 bp, Homo sapiens
acccatacaatgta

SEQ ID NO: 5142332 - DNA, 15 bp, Homo sapiens
acccatacaatgtat

SEQ ID NO: 5142333 - DNA, 18 bp, Homo sapiens
acccatagatcttctgaa

SEQ ID NO: 5142334 - DNA, 22 bp, Homo sapiens
acccatagatcttctgaaatga

SEQ ID NO: 5142335 - DNA, 15 bp, Homo sapiens
acccatagcagcttt

SEQ ID NO: 5142336 - DNA, 14 bp, Homo sapiens
acccataggaaatc

SEQ ID NO: 5142337 - DNA, 22 bp, Homo sapiens
acccataggcccacacacaggt

SEQ ID NO: 5142338 - DNA, 14 bp, Homo sapiens
acccatagggagct

SEQ ID NO: 5142339 - DNA, 17 bp, Homo sapiens
acccatagtgcttcaca

SEQ ID NO: 5142340 - DNA, 23 bp, Homo sapiens
acccatatccttaccctccttgg

SEQ ID NO: 5142341 - DNA, 13 bp, Homo sapiens
acccatcactgtg

SEQ ID NO: 5142342 - DNA, 23 bp, Homo sapiens
acccatcagaaaaagcatactgc

SEQ ID NO: 5142343 - DNA, 14 bp, Homo sapiens
acccatcagaagga

SEQ ID NO: 5142344 - DNA, 19 bp, Homo sapiens
acccatcagaaggagaagg

SEQ ID NO: 5142345 - DNA, 19 bp, Homo sapiens
acccatcaggaccactcag

SEQ ID NO: 5142346 - DNA, 15 bp, Homo sapiens
acccatccctgcctg

SEQ ID NO: 5142347 - DNA, 14 bp, Homo sapiens
acccatcccttttc

SEQ ID NO: 5142348 - DNA, 14 bp, Homo sapiens
acccatcctaggaa

SEQ ID NO: 5142349 - DNA, 15 bp, Homo sapiens
acccatcgctgtgtg

SEQ ID NO: 5142350 - DNA, 17 bp, Homo sapiens
acccatcgctgtgtgtt

SEQ ID NO: 5142351 - DNA, 20 bp, Homo sapiens
acccatcgtggtatgtgaat

SEQ ID NO: 5142352 - DNA, 20 bp, Homo sapiens
acccatctaaaccagaagga

SEQ ID NO: 5142353 - DNA, 16 bp, Homo sapiens
acccatctacccctgg

SEQ ID NO: 5142354 - DNA, 17 bp, Homo sapiens
acccatctacccctgga

SEQ ID NO: 5142355 - DNA, 19 bp, Homo sapiens
acccatctagtacttgaaa

SEQ ID NO: 5142356 - DNA, 20 bp, Homo sapiens
acccatctgcacccccctgg

SEQ ID NO: 5142357 - DNA, 21 bp, Homo sapiens
acccatctgcacccccctggg

SEQ ID NO: 5142358 - DNA, 22 bp, Homo sapiens
acccatctgcacccccctgggc

SEQ ID NO: 5142359 - DNA, 14 bp, Homo sapiens
acccatctggaggc

SEQ ID NO: 5142360 - DNA, 10 bp, Homo sapiens
acccatctgt

SEQ ID NO: 5142361 - DNA, 14 bp, Homo sapiens
acccatctgtaata

SEQ ID NO: 5142362 - DNA, 17 bp, Homo sapiens
acccatctgttttttgt

SEQ ID NO: 5142363 - DNA, 18 bp, Homo sapiens
acccatctgttttttgta

SEQ ID NO: 5142364 - DNA, 21 bp, Homo sapiens
acccatcttcacgcctgggtg

SEQ ID NO: 5142365 - DNA, 22 bp, Homo sapiens
acccatcttccacctcacctct

SEQ ID NO: 5142366 - DNA, 16 bp, Homo sapiens
acccatcttccccgga

SEQ ID NO: 5142367 - DNA, 19 bp, Homo sapiens
acccatcttcctgctgctg

SEQ ID NO: 5142368 - DNA, 17 bp, Homo sapiens
acccatcttgcttccaa

SEQ ID NO: 5142369 - DNA, 20 bp, Homo sapiens
acccatctttaatttatatc

SEQ ID NO: 5142370 - DNA, 11 bp, Homo sapiens
acccatgaaaa

SEQ ID NO: 5142371 - DNA, 16 bp, Homo sapiens
acccatgaaagaaaac

SEQ ID NO: 5142372 - DNA, 20 bp, Homo sapiens
acccatgaagacaggacagt

SEQ ID NO: 5142373 - DNA, 15 bp, Homo sapiens
acccatgaagctggc

SEQ ID NO: 5142374 - DNA, 23 bp, Homo sapiens
acccatgaagctggccctcagct

SEQ ID NO: 5142375 - DNA, 23 bp, Homo sapiens
acccatgaaggctggaaggcagc

SEQ ID NO: 5142376 - DNA, 18 bp, Homo sapiens
acccatgagcctgcccgc

SEQ ID NO: 5142377 - DNA, 19 bp, Homo sapiens
acccatgagcctgcccgct

SEQ ID NO: 5142378 - DNA, 20 bp, Homo sapiens
acccatgagcctgcccgctg

SEQ ID NO: 5142379 - DNA, 14 bp, Homo sapiens
acccatgagcgtcc

SEQ ID NO: 5142380 - DNA, 20 bp, Homo sapiens
acccatgaggcaatgtcagg

SEQ ID NO: 5142381 - DNA, 20 bp, Homo sapiens
acccatgagttggggtctgg

SEQ ID NO: 5142382 - DNA, 21 bp, Homo sapiens
acccatgagttggggtctggc

SEQ ID NO: 5142383 - DNA, 16 bp, Homo sapiens
acccatgatactccac

SEQ ID NO: 5142384 - DNA, 16 bp, Homo sapiens
acccatgcacagtaca

SEQ ID NO: 5142385 - DNA, 18 bp, Homo sapiens
acccatgcacgcaccccg

SEQ ID NO: 5142386 - DNA, 20 bp, Homo sapiens
acccatgcacgcaccccgcc

SEQ ID NO: 5142387 - DNA, 19 bp, Homo sapiens
acccatgccccactctgct

SEQ ID NO: 5142388 - DNA, 21 bp, Homo sapiens
acccatgccccactctgctga

SEQ ID NO: 5142389 - DNA, 17 bp, Homo sapiens
acccatgcccctgacag

SEQ ID NO: 5142390 - DNA, 13 bp, Homo sapiens
acccatgccctgg

SEQ ID NO: 5142391 - DNA, 22 bp, Homo sapiens
acccatgccctggaccagccgc

SEQ ID NO: 5142392 - DNA, 23 bp, Homo sapiens
acccatgcctccccctagccatt

SEQ ID NO: 5142393 - DNA, 15 bp, Homo sapiens
acccatgctgccctg

SEQ ID NO: 5142394 - DNA, 18 bp, Homo sapiens
acccatgctgccctgtga

SEQ ID NO: 5142395 - DNA, 19 bp, Homo sapiens
acccatgctgccctgtgag

SEQ ID NO: 5142396 - DNA, 14 bp, Homo sapiens
acccatgctggtca

SEQ ID NO: 5142397 - DNA, 15 bp, Homo sapiens
acccatggcctcagc

SEQ ID NO: 5142398 - DNA, 22 bp, Homo sapiens
acccatggcctcagccctgctc

SEQ ID NO: 5142399 - DNA, 23 bp, Homo sapiens
acccatggcctcagccctgctcc

SEQ ID NO: 5142400 - DNA, 13 bp, Homo sapiens
acccatgggcagg

SEQ ID NO: 5142401 - DNA, 14 bp, Homo sapiens
acccatggggagga

SEQ ID NO: 5142402 - DNA, 17 bp, Homo sapiens
acccatggggaggagac

SEQ ID NO: 5142403 - DNA, 20 bp, Homo sapiens
acccatgtcaccggtcagtg

SEQ ID NO: 5142404 - DNA, 22 bp, Homo sapiens
acccatgtgggcgcccaccctg

SEQ ID NO: 5142405 - DNA, 22 bp, Homo sapiens
acccattagcagtccctccaca

SEQ ID NO: 5142406 - DNA, 15 bp, Homo sapiens
acccattatctggaa

SEQ ID NO: 5142407 - DNA, 15 bp, Homo sapiens
acccattcacatttt

SEQ ID NO: 5142408 - DNA, 17 bp, Homo sapiens
acccattcatactaaat

SEQ ID NO: 5142409 - DNA, 19 bp, Homo sapiens
acccattccagtacagtat

SEQ ID NO: 5142410 - DNA, 17 bp, Homo sapiens
acccattccatttatct

SEQ ID NO: 5142411 - DNA, 19 bp, Homo sapiens
acccattccatttatcttt

SEQ ID NO: 5142412 - DNA, 22 bp, Homo sapiens
acccattcccccatgtggctga

SEQ ID NO: 5142413 - DNA, 13 bp, Homo sapiens
acccattcctatt

SEQ ID NO: 5142414 - DNA, 23 bp, Homo sapiens
acccattccttcccagaggggcc

SEQ ID NO: 5142415 - DNA, 22 bp, Homo sapiens
acccattcgtggtgatcaatta

SEQ ID NO: 5142416 - DNA, 15 bp, Homo sapiens
acccattctgttttc

SEQ ID NO: 5142417 - DNA, 14 bp, Homo sapiens
acccattcttcccg

SEQ ID NO: 5142418 - DNA, 14 bp, Homo sapiens
acccattgcagacc

SEQ ID NO: 5142419 - DNA, 17 bp, Homo sapiens
acccattgctgttgtcc

SEQ ID NO: 5142420 - DNA, 14 bp, Homo sapiens
acccattgtctcat

SEQ ID NO: 5142421 - DNA, 15 bp, Homo sapiens
acccattgtctcatt

SEQ ID NO: 5142422 - DNA, 16 bp, Homo sapiens
acccattgtctcattg

SEQ ID NO: 5142423 - DNA, 22 bp, Homo sapiens
acccattgttgtcaaggaagaa

SEQ ID NO: 5142424 - DNA, 23 bp, Homo sapiens
acccatttaaatttttttcctta

SEQ ID NO: 5142425 - DNA, 23 bp, Homo sapiens
acccatttccttgtgctcctgcc

SEQ ID NO: 5142426 - DNA, 16 bp, Homo sapiens
acccatttgccatgct

SEQ ID NO: 5142427 - DNA, 20 bp, Homo sapiens
acccatttgccatgctgcta

SEQ ID NO: 5142428 - DNA, 22 bp, Homo sapiens
acccatttgccatgctgctatg

SEQ ID NO: 5142429 - DNA, 15 bp, Homo sapiens
acccatttgttcata

SEQ ID NO: 5142430 - DNA, 15 bp, Homo sapiens
acccatttgttttcg

SEQ ID NO: 5142431 - DNA, 14 bp, Homo sapiens
acccattttcacat

SEQ ID NO: 5142432 - DNA, 23 bp, Homo sapiens
accccaaacaccttccagctcct

SEQ ID NO: 5142433 - DNA, 16 bp, Homo sapiens
accccaaaccccagcc

SEQ ID NO: 5142434 - DNA, 17 bp, Homo sapiens
accccaaaccccagccc

SEQ ID NO: 5142435 - DNA, 20 bp, Homo sapiens
accccaaaccccagccccaa

SEQ ID NO: 5142436 - DNA, 14 bp, Homo sapiens
accccaaacctcca

SEQ ID NO: 5142437 - DNA, 16 bp, Homo sapiens
accccaaacttccagg

SEQ ID NO: 5142438 - DNA, 15 bp, Homo sapiens
accccaaagagaaag

SEQ ID NO: 5142439 - DNA, 16 bp, Homo sapiens
accccaaagagaaaga

SEQ ID NO: 5142440 - DNA, 15 bp, Homo sapiens
accccaaagctttcc

SEQ ID NO: 5142441 - DNA, 18 bp, Homo sapiens
accccaaaggggcctctc

SEQ ID NO: 5142442 - DNA, 15 bp, Homo sapiens
accccaacaaaccat

SEQ ID NO: 5142443 - DNA, 23 bp, Homo sapiens
accccaacctctcctttctgtgc

SEQ ID NO: 5142444 - DNA, 18 bp, Homo sapiens
accccaacctgctctcct

SEQ ID NO: 5142445 - DNA, 14 bp, Homo sapiens
accccaactcccag

SEQ ID NO: 5142446 - DNA, 17 bp, Homo sapiens
accccaactctccccag

SEQ ID NO: 5142447 - DNA, 17 bp, Homo sapiens
accccaagaccaagctt

SEQ ID NO: 5142448 - DNA, 18 bp, Homo sapiens
accccaagactcccatga

SEQ ID NO: 5142449 - DNA, 16 bp, Homo sapiens
accccaagagaactcg

SEQ ID NO: 5142450 - DNA, 18 bp, Homo sapiens
accccaagagaactcgcg

SEQ ID NO: 5142451 - DNA, 13 bp, Homo sapiens
accccaagcagca

SEQ ID NO: 5142452 - DNA, 16 bp, Homo sapiens
accccaagcgccctgg

SEQ ID NO: 5142453 - DNA, 23 bp, Homo sapiens
accccaagcggccttttccaaat

SEQ ID NO: 5142454 - DNA, 11 bp, Homo sapiens
accccaagctt

SEQ ID NO: 5142455 - DNA, 21 bp, Homo sapiens
accccaaggactgagggcagt

SEQ ID NO: 5142456 - DNA, 20 bp, Homo sapiens
accccaagggggctgctgct

SEQ ID NO: 5142457 - DNA, 15 bp, Homo sapiens
accccaagtccacct

SEQ ID NO: 5142458 - DNA, 22 bp, Homo sapiens
accccaagtccacctgcctatc

SEQ ID NO: 5142459 - DNA, 20 bp, Homo sapiens
accccaattaactgaagcaa

SEQ ID NO: 5142460 - DNA, 20 bp, Homo sapiens
accccaatttcggatttttt

SEQ ID NO: 5142461 - DNA, 21 bp, Homo sapiens
accccaatttcggattttttc

SEQ ID NO: 5142462 - DNA, 20 bp, Homo sapiens
accccacaatttctttaaaa

SEQ ID NO: 5142463 - DNA, 16 bp, Homo sapiens
accccacacacgccag

SEQ ID NO: 5142464 - DNA, 16 bp, Homo sapiens
accccacaccaggccg

SEQ ID NO: 5142465 - DNA, 15 bp, Homo sapiens
accccacaccccagc

SEQ ID NO: 5142466 - DNA, 19 bp, Homo sapiens
accccacaccccagcccac

SEQ ID NO: 5142467 - DNA, 19 bp, Homo sapiens
accccacacgccggggctg

SEQ ID NO: 5142468 - DNA, 22 bp, Homo sapiens
accccacacgccggggctggcc

SEQ ID NO: 5142469 - DNA, 23 bp, Homo sapiens
accccacacgccggggctggccc

SEQ ID NO: 5142470 - DNA, 20 bp, Homo sapiens
accccacagaaccttcaacc

SEQ ID NO: 5142471 - DNA, 22 bp, Homo sapiens
accccacaggatgaactagcca

SEQ ID NO: 5142472 - DNA, 20 bp, Homo sapiens
accacatgccaagcactgtg

SEQ ID NO: 5142473 - DNA, 22 bp, Homo sapiens
accacatgccaagcactgtgct

SEQ ID NO: 5142474 - DNA, 16 bp, Homo sapiens
accacatggaacttaa

SEQ ID NO: 5142475 - DNA, 18 bp, Homo sapiens
accacatgtgcacatgca

SEQ ID NO: 5142476 - DNA, 14 bp, Homo sapiens
accacattaattaa

SEQ ID NO: 5142477 - DNA, 20 bp, Homo sapiens
accacattaattaattaaag

SEQ ID NO: 5142478 - DNA, 22 bp, Homo sapiens
accacattccatgacgcaggag

SEQ ID NO: 5142479 - DNA, 18 bp, Homo sapiens
accacattctgtctctgc

SEQ ID NO: 5142480 - DNA, 21 bp, Homo sapiens
accacatttaatgggaaaaac

SEQ ID NO: 5142481 - DNA, 20 bp, Homo sapiens
accacatttagaaatgttta

SEQ ID NO: 5142482 - DNA, 21 bp, Homo sapiens
accacatttagaaatgtttat

SEQ ID NO: 5142483 - DNA, 14 bp, Homo sapiens
accaccaaaattat

SEQ ID NO: 5142484 - DNA, 12 bp, Homo sapiens
accaccaacagg

SEQ ID NO: 5142485 - DNA, 19 bp, Homo sapiens
accaccaagccttgattgg

SEQ ID NO: 5142486 - DNA, 17 bp, Homo sapiens
accaccacacacagcta

SEQ ID NO: 5142487 - DNA, 16 bp, Homo sapiens
accaccacacccggct

SEQ ID NO: 5142488 - DNA, 17 bp, Homo sapiens
accaccaccttatacat

SEQ ID NO: 5142489 - DNA, 14 bp, Homo sapiens
accaccacgcctgg

SEQ ID NO: 5142490 - DNA, 15 bp, Homo sapiens
accaccactggccac

SEQ ID NO: 5142491 - DNA, 21 bp, Homo sapiens
accaccactggccaccaggct

SEQ ID NO: 5142492 - DNA, 22 bp, Homo sapiens
accaccactggccaccaggctg

SEQ ID NO: 5142493 - DNA, 20 bp, Homo sapiens
accaccactgtgtcccagtg

SEQ ID NO: 5142494 - DNA, 13 bp, Homo sapiens
accaccagcaggc

SEQ ID NO: 5142495 - DNA, 16 bp, Homo sapiens
accaccagccccagca

SEQ ID NO: 5142496 - DNA, 17 bp, Homo sapiens
accaccagccccagcaa

SEQ ID NO: 5142497 - DNA, 19 bp, Homo sapiens
accaccagcgttcccttct

SEQ ID NO: 5142498 - DNA, 18 bp, Homo sapiens
accaccaggagcagcagc

SEQ ID NO: 5142499 - DNA, 20 bp, Homo sapiens
accaccaggagcagcagcca

SEQ ID NO: 5142500 - DNA, 22 bp, Homo sapiens
accaccaggagcagcagccagc

SEQ ID NO: 5142501 - DNA, 17 bp, Homo sapiens
accaccagggcatctct

SEQ ID NO: 5142502 - DNA, 18 bp, Homo sapiens
accaccagggctccagga

SEQ ID NO: 5142503 - DNA, 22 bp, Homo sapiens
accaccagggtcccaggaagcc

SEQ ID NO: 5142504 - DNA, 12 bp, Homo sapiens
accaccagggtg

SEQ ID NO: 5142505 - DNA, 15 bp, Homo sapiens
accaccagttaacgt

SEQ ID NO: 5142506 - DNA, 17 bp, Homo sapiens
accaccagttaacgtat

SEQ ID NO: 5142507 - DNA, 20 bp, Homo sapiens
accaccatccaccgctgctc

SEQ ID NO: 5142508 - DNA, 13 bp, Homo sapiens
accaccatttccc

SEQ ID NO: 5142509 - DNA, 11 bp, Homo sapiens
accacccacct

SEQ ID NO: 5142510 - DNA, 23 bp, Homo sapiens
accacccactctcctctgcctca

SEQ ID NO: 5142511 - DNA, 18 bp, Homo sapiens
accacccagagcaccctc

SEQ ID NO: 5142512 - DNA, 13 bp, Homo sapiens
accacccagccct

SEQ ID NO: 5142513 - DNA, 14 bp, Homo sapiens
accacccagccctt

SEQ ID NO: 5142514 - DNA, 17 bp, Homo sapiens
accacccagcccttcct

SEQ ID NO: 5142515 - DNA, 20 bp, Homo sapiens
accacccatagtgcttcaca

SEQ ID NO: 5142516 - DNA, 21 bp, Homo sapiens
accaccccacccacctttgca

SEQ ID NO: 5142517 - DNA, 17 bp, Homo sapiens
accacccccaaacacaa

SEQ ID NO: 5142518 - DNA, 19 bp, Homo sapiens
accacccccactggtgaga

SEQ ID NO: 5142519 - DNA, 13 bp, Homo sapiens
accacccccagtc

SEQ ID NO: 5142520 - DNA, 14 bp, Homo sapiens
accacccccagtcc

SEQ ID NO: 5142521 - DNA, 14 bp, Homo sapiens
accaccccccactc

SEQ ID NO: 5142522 - DNA, 24 bp, Homo sapiens
accacccccgagcttgcctcaggg

SEQ ID NO: 5142523 - DNA, 20 bp, Homo sapiens
accacccccgatgggatggc

SEQ ID NO: 5142524 - DNA, 20 bp, Homo sapiens
accacccctaaagtgccagg

SEQ ID NO: 5142525 - DNA, 13 bp, Homo sapiens
accacccctacca

SEQ ID NO: 5142526 - DNA, 14 bp, Homo sapiens
accacccctaccac

SEQ ID NO: 5142527 - DNA, 21 bp, Homo sapiens
accacccctccctctgctctc

SEQ ID NO: 5142528 - DNA, 19 bp, Homo sapiens
accacccctgcctccaccc

SEQ ID NO: 5142529 - DNA, 20 bp, Homo sapiens
accacccctgcctccaccct

SEQ ID NO: 5142530 - DNA, 14 bp, Homo sapiens
accaccccttcctg

SEQ ID NO: 5142531 - DNA, 13 bp, Homo sapiens
accaccctcactg

SEQ ID NO: 5142532 - DNA, 19 bp, Homo sapiens
accaccctcactggctctc

SEQ ID NO: 5142533 - DNA, 15 bp, Homo sapiens
accaccctcaggtgc

SEQ ID NO: 5142534 - DNA, 17 bp, Homo sapiens
accaccctcccaccatg

SEQ ID NO: 5142535 - DNA, 13 bp, Homo sapiens
accaccctcccct

SEQ ID NO: 5142536 - DNA, 17 bp, Homo sapiens
accaccctcccctctct

SEQ ID NO: 5142537 - DNA, 12 bp, Homo sapiens
accaccctgagc

SEQ ID NO: 5142538 - DNA, 21 bp, Homo sapiens
accaccctgagccggccccag

SEQ ID NO: 5142539 - DNA, 14 bp, Homo sapiens
accaccctgccaag

SEQ ID NO: 5142540 - DNA, 13 bp, Homo sapiens
accaccctgcctg

SEQ ID NO: 5142541 - DNA, 16 bp, Homo sapiens
accaccctgcctgtgg

SEQ ID NO: 5142542 - DNA, 19 bp, Homo sapiens
accaccctgcctgtggagg

SEQ ID NO: 5142543 - DNA, 18 bp, Homo sapiens
accaccctgtcttcctct

SEQ ID NO: 5142544 - DNA, 21 bp, Homo sapiens
accaccgaatatattactgat

SEQ ID NO: 5142545 - DNA, 18 bp, Homo sapiens
accaccgagctctgtggg

SEQ ID NO: 5142546 - DNA, 20 bp, Homo sapiens
accaccgcatatgcatgcca

SEQ ID NO: 5142547 - DNA, 22 bp, Homo sapiens
accaccgcatatgcatgccagg

SEQ ID NO: 5142548 - DNA, 23 bp, Homo sapiens
accaccgcatatgcatgccaggc

SEQ ID NO: 5142549 - DNA, 14 bp, Homo sapiens
accaccgcatcctc

SEQ ID NO: 5142550 - DNA, 22 bp, Homo sapiens
accaccgcctctggccgccacc

SEQ ID NO: 5142551 - DNA, 23 bp, Homo sapiens
accaccgcctctggccgccaccc

SEQ ID NO: 5142552 - DNA, 14 bp, Homo sapiens
accaccgcgcccct

SEQ ID NO: 5142553 - DNA, 16 bp, Homo sapiens
accaccgcgcccctct

SEQ ID NO: 5142554 - DNA, 18 bp, Homo sapiens
accaccgcgcccctctgc

SEQ ID NO: 5142555 - DNA, 19 bp, Homo sapiens
accaccgcgcccctctgcg

SEQ ID NO: 5142556 - DNA, 15 bp, Homo sapiens
accaccgctccccag

SEQ ID NO: 5142557 - DNA, 18 bp, Homo sapiens
accaccgctccccagccc

SEQ ID NO: 5142558 - DNA, 19 bp, Homo sapiens
accaccgctccccagccca

SEQ ID NO: 5142559 - DNA, 21 bp, Homo sapiens
accaccgctccccagcccagg

SEQ ID NO: 5142560 - DNA, 14 bp, Homo sapiens
accaccggccccct

SEQ ID NO: 5142561 - DNA, 23 bp, Homo sapiens
accaccggccccctccccccaga

SEQ ID NO: 5142562 - DNA, 21 bp, Homo sapiens
accaccggggcactggctgct

SEQ ID NO: 5142563 - DNA, 22 bp, Homo sapiens
accaccggggcactggctgctc

SEQ ID NO: 5142564 - DNA, 15 bp, Homo sapiens
accaccgttcagtca

SEQ ID NO: 5142565 - DNA, 19 bp, Homo sapiens
accaccgttcagtcatttt

SEQ ID NO: 5142566 - DNA, 17 bp, Homo sapiens
accacctacaaggagat

SEQ ID NO: 5142567 - DNA, 15 bp, Homo sapiens
accacctacacagga

SEQ ID NO: 5142568 - DNA, 20 bp, Homo sapiens
accacctaggccactcctcc

SEQ ID NO: 5142569 - DNA, 22 bp, Homo sapiens
accacctatatccagaagggga

SEQ ID NO: 5142570 - DNA, 16 bp, Homo sapiens
accacctcactcctgt

SEQ ID NO: 5142571 - DNA, 16 bp, Homo sapiens
accacctcatgtcatt

SEQ ID NO: 5142572 - DNA, 22 bp, Homo sapiens
accacctcctctgccagcagga

SEQ ID NO: 5142573 - DNA, 15 bp, Homo sapiens
accacctctcaatat

SEQ ID NO: 5142574 - DNA, 17 bp, Homo sapiens
accacctctccagaggc

SEQ ID NO: 5142575 - DNA, 12 bp, Homo sapiens
accacctctgtg

SEQ ID NO: 5142576 - DNA, 22 bp, Homo sapiens
accacctctttctacagcctaa

SEQ ID NO: 5142577 - DNA, 10 bp, Homo sapiens
accacctgcc

SEQ ID NO: 5142578 - DNA, 16 bp, Homo sapiens
accacctgccagccat

SEQ ID NO: 5142579 - DNA, 20 bp, Homo sapiens
accacctgcccggcccagga

SEQ ID NO: 5142580 - DNA, 23 bp, Homo sapiens
accacctgcccggcccaggagcg

SEQ ID NO: 5142581 - DNA, 12 bp, Homo sapiens
accacctgcctc

SEQ ID NO: 5142582 - DNA, 20 bp, Homo sapiens
accacctgcttctgaactca

SEQ ID NO: 5142583 - DNA, 14 bp, Homo sapiens
accacctgtacata

SEQ ID NO: 5142584 - DNA, 15 bp, Homo sapiens
accaccttaaaacat

SEQ ID NO: 5142585 - DNA, 16 bp, Homo sapiens
accaccttatacatca

SEQ ID NO: 5142586 - DNA, 17 bp, Homo sapiens
accaccttcccagctct

SEQ ID NO: 5142587 - DNA, 19 bp, Homo sapiens
accaccttctgtccccagc

SEQ ID NO: 5142588 - DNA, 20 bp, Homo sapiens
accaccttggactcctccca

SEQ ID NO: 5142589 - DNA, 21 bp, Homo sapiens
accaccttggactcctcccac

SEQ ID NO: 5142590 - DNA, 18 bp, Homo sapiens
accacctttggctggtag

SEQ ID NO: 5142591 - DNA, 17 bp, Homo sapiens
accaccttttattacat

SEQ ID NO: 5142592 - DNA, 15 bp, Homo sapiens
accacgaatgaggta

SEQ ID NO: 5142593 - DNA, 16 bp, Homo sapiens
accacgactggccagg

SEQ ID NO: 5142594 - DNA, 20 bp, Homo sapiens
accacgaggctgattcctct

SEQ ID NO: 5142595 - DNA, 16 bp, Homo sapiens
accacgaggctgcccc

SEQ ID NO: 5142596 - DNA, 20 bp, Homo sapiens
accacgaggctgcccccatc

SEQ ID NO: 5142597 - DNA, 18 bp, Homo sapiens
accacgatgtggccctgg

SEQ ID NO: 5142598 - DNA, 19 bp, Homo sapiens
accacgatgtggccctggc

SEQ ID NO: 5142599 - DNA, 20 bp, Homo sapiens
accacgatgtggccctggcc

SEQ ID NO: 5142600 - DNA, 21 bp, Homo sapiens
accacgatgtggccctggcct

SEQ ID NO: 5142601 - DNA, 23 bp, Homo sapiens
accacgcacctccacgccactgc

SEQ ID NO: 5142602 - DNA, 17 bp, Homo sapiens
accacgccccaggacct

SEQ ID NO: 5142603 - DNA, 13 bp, Homo sapiens
accacgcccctgc

SEQ ID NO: 5142604 - DNA, 14 bp, Homo sapiens
accacgcccggcta

SEQ ID NO: 5142605 - DNA, 19 bp, Homo sapiens
accacgcccgtcctgcctg

SEQ ID NO: 5142606 - DNA, 20 bp, Homo sapiens
accacgcccgtcctgcctgt

SEQ ID NO: 5142607 - DNA, 21 bp, Homo sapiens
accacgcccgtcctgcctgtg

SEQ ID NO: 5142608 - DNA, 23 bp, Homo sapiens
accacgcccgtcctgcctgtggc

SEQ ID NO: 5142609 - DNA, 18 bp, Homo sapiens
accacgccgccctccatc

SEQ ID NO: 5142610 - DNA, 13 bp, Homo sapiens
accacgcctggct

SEQ ID NO: 5142611 - DNA, 20 bp, Homo sapiens
accacgcctggctaattttt

SEQ ID NO: 5142612 - DNA, 16 bp, Homo sapiens
accacgctggggtctg

SEQ ID NO: 5142613 - DNA, 18 bp, Homo sapiens
accacggccaccactgca

SEQ ID NO: 5142614 - DNA, 20 bp, Homo sapiens
accacggccggctaattttt

SEQ ID NO: 5142615 - DNA, 19 bp, Homo sapiens
accacggcgtttttttaca

SEQ ID NO: 5142616 - DNA, 15 bp, Homo sapiens
accacggctggatac

SEQ ID NO: 5142617 - DNA, 15 bp, Homo sapiens
accacgggcctcagt

SEQ ID NO: 5142618 - DNA, 16 bp, Homo sapiens
accacgggcctcagtt

SEQ ID NO: 5142619 - DNA, 22 bp, Homo sapiens
accacgggttgaggaagtcagg

SEQ ID NO: 5142620 - DNA, 21 bp, Homo sapiens
accacggtcacacctcactgt

SEQ ID NO: 5142621 - DNA, 17 bp, Homo sapiens
accacgtaccaagccac

SEQ ID NO: 5142622 - DNA, 14 bp, Homo sapiens
accacgtctccctg

SEQ ID NO: 5142623 - DNA, 23 bp, Homo sapiens
accacgtctgccaggcccatctc

SEQ ID NO: 5142624 - DNA, 19 bp, Homo sapiens
accacgtctggctccctgc

SEQ ID NO: 5142625 - DNA, 20 bp, Homo sapiens
accacgtctggctccctgcc

SEQ ID NO: 5142626 - DNA, 22 bp, Homo sapiens
accacgtgaaatttgcctctgt

SEQ ID NO: 5142627 - DNA, 23 bp, Homo sapiens
accacgtgaaatttgcctctgtc

SEQ ID NO: 5142628 - DNA, 13 bp, Homo sapiens
accacgtggggct

SEQ ID NO: 5142629 - DNA, 22 bp, Homo sapiens
accacgttaactgcattttaca

SEQ ID NO: 5142630 - DNA, 20 bp, Homo sapiens
accactaattttgttttaaa

SEQ ID NO: 5142631 - DNA, 11 bp, Homo sapiens
accactacagt

SEQ ID NO: 5142632 - DNA, 18 bp, Homo sapiens
accactacagtaagctgg

SEQ ID NO: 5142633 - DNA, 16 bp, Homo sapiens
accactacattctgtt

SEQ ID NO: 5142634 - DNA, 22 bp, Homo sapiens
accactaccagccagcctcaga

SEQ ID NO: 5142635 - DNA, 20 bp, Homo sapiens
accactagaactctccatct

SEQ ID NO: 5142636 - DNA, 16 bp, Homo sapiens
accactagcctcaggg

SEQ ID NO: 5142637 - DNA, 22 bp, Homo sapiens
accactatagtgtaataatgtt

SEQ ID NO: 5142638 - DNA, 21 bp, Homo sapiens
accactatctccgttccatct

SEQ ID NO: 5142639 - DNA, 22 bp, Homo sapiens
accactatctccgttccatctg

SEQ ID NO: 5142640 - DNA, 20 bp, Homo sapiens
accactcaaattaatctttc

SEQ ID NO: 5142641 - DNA, 15 bp, Homo sapiens
accactcagccccta

SEQ ID NO: 5142642 - DNA, 16 bp, Homo sapiens
accactcagcccctag

SEQ ID NO: 5142643 - DNA, 17 bp, Homo sapiens
accactcagcccctagg

SEQ ID NO: 5142644 - DNA, 18 bp, Homo sapiens
accactcagcccctagga

SEQ ID NO: 5142645 - DNA, 12 bp, Homo sapiens
accactcaggcc

SEQ ID NO: 5142646 - DNA, 18 bp, Homo sapiens
accactcagtaaaagcaa

SEQ ID NO: 5142647 - DNA, 18 bp, Homo sapiens
accactcagttaaggaag

SEQ ID NO: 5142648 - DNA, 12 bp, Homo sapiens
accactccattc

SEQ ID NO: 5142649 - DNA, 23 bp, Homo sapiens
accccacatccttctcactgcca

SEQ ID NO: 5142650 - DNA, 13 bp, Homo sapiens
accccaccacaca

SEQ ID NO: 5142651 - DNA, 22 bp, Homo sapiens
accccaccacgatgtggccctg

SEQ ID NO: 5142652 - DNA, 11 bp, Homo sapiens
accccacccaa

SEQ ID NO: 5142653 - DNA, 14 bp, Homo sapiens
accccacccacctt

SEQ ID NO: 5142654 - DNA, 16 bp, Homo sapiens
accccacccacctttg

SEQ ID NO: 5142655 - DNA, 14 bp, Homo sapiens
accccacccagctc

SEQ ID NO: 5142656 - DNA, 22 bp, Homo sapiens
accccacccccttcagtgccca

SEQ ID NO: 5142657 - DNA, 20 bp, Homo sapiens
accccacccctcatcaggag

SEQ ID NO: 5142658 - DNA, 21 bp, Homo sapiens
accccaccctagtttccctga

SEQ ID NO: 5142659 - DNA, 21 bp, Homo sapiens
accccaccctcagcacccctt

SEQ ID NO: 5142660 - DNA, 15 bp, Homo sapiens
accccaccctccctg

SEQ ID NO: 5142661 - DNA, 16 bp, Homo sapiens
accccaccctccctgg

SEQ ID NO: 5142662 - DNA, 20 bp, Homo sapiens
accccaccctccctggagtg

SEQ ID NO: 5142663 - DNA, 13 bp, Homo sapiens
accccaccctgcc

SEQ ID NO: 5142664 - DNA, 19 bp, Homo sapiens
accccaccctgtctgcagg

SEQ ID NO: 5142665 - DNA, 16 bp, Homo sapiens
accccaccctgtttgg

SEQ ID NO: 5142666 - DNA, 19 bp, Homo sapiens
accccaccctgtttggatt

SEQ ID NO: 5142667 - DNA, 19 bp, Homo sapiens
accccacccttcccctcct

SEQ ID NO: 5142668 - DNA, 20 bp, Homo sapiens
accccacccttgcccacccc

SEQ ID NO: 5142669 - DNA, 15 bp, Homo sapiens
accccacctcacagc

SEQ ID NO: 5142670 - DNA, 11 bp, Homo sapiens
accccacctcc

SEQ ID NO: 5142671 - DNA, 18 bp, Homo sapiens
accccacctccactccca

SEQ ID NO: 5142672 - DNA, 23 bp, Homo sapiens
accccacctccactcccacctca

SEQ ID NO: 5142673 - DNA, 14 bp, Homo sapiens
accccacctgaggc

SEQ ID NO: 5142674 - DNA, 13 bp, Homo sapiens
accccacctgcag

SEQ ID NO: 5142675 - DNA, 17 bp, Homo sapiens
accccacgccctgttca

SEQ ID NO: 5142676 - DNA, 21 bp, Homo sapiens
accccacgcgtgcataaaaac

SEQ ID NO: 5142677 - DNA, 17 bp, Homo sapiens
accccacgttctatata

SEQ ID NO: 5142678 - DNA, 14 bp, Homo sapiens
accccactacacag

SEQ ID NO: 5142679 - DNA, 18 bp, Homo sapiens
accccactcacagagaca

SEQ ID NO: 5142680 - DNA, 12 bp, Homo sapiens
accccactccag

SEQ ID NO: 5142681 - DNA, 16 bp, Homo sapiens
accccactccagccct

SEQ ID NO: 5142682 - DNA, 13 bp, Homo sapiens
accccactcccac

SEQ ID NO: 5142683 - DNA, 15 bp, Homo sapiens
accccactcccctca

SEQ ID NO: 5142684 - DNA, 11 bp, Homo sapiens
accccactcct

SEQ ID NO: 5142685 - DNA, 22 bp, Homo sapiens
accccactctacctccttagct

SEQ ID NO: 5142686 - DNA, 19 bp, Homo sapiens
accccacttatgctgctgt

SEQ ID NO: 5142687 - DNA, 22 bp, Homo sapiens
accccacttatgctgctgtgaa

SEQ ID NO: 5142688 - DNA, 12 bp, Homo sapiens
accccacttcca

SEQ ID NO: 5142689 - DNA, 21 bp, Homo sapiens
accccacttcctactgtaata

SEQ ID NO: 5142690 - DNA, 16 bp, Homo sapiens
accccagaaatcactg

SEQ ID NO: 5142691 - DNA, 18 bp, Homo sapiens
accccagaaatcactgtg

SEQ ID NO: 5142692 - DNA, 19 bp, Homo sapiens
accccagactagatgtagt

SEQ ID NO: 5142693 - DNA, 15 bp, Homo sapiens
accccagactgtaga

SEQ ID NO: 5142694 - DNA, 10 bp, Homo sapiens
accccagagc

SEQ ID NO: 5142695 - DNA, 16 bp, Homo sapiens
accccagaggcagagg

SEQ ID NO: 5142696 - DNA, 16 bp, Homo sapiens
accccagaggccttgt

SEQ ID NO: 5142697 - DNA, 19 bp, Homo sapiens
accccagagggaccagctg

SEQ ID NO: 5142698 - DNA, 16 bp, Homo sapiens
accccagagtgactga

SEQ ID NO: 5142699 - DNA, 19 bp, Homo sapiens
accccagagtgggagaggc

SEQ ID NO: 5142700 - DNA, 19 bp, Homo sapiens
accccagatacctgtgagg

SEQ ID NO: 5142701 - DNA, 23 bp, Homo sapiens
accccagatacctgtgaggactg

SEQ ID NO: 5142702 - DNA, 15 bp, Homo sapiens
accccagcacagcca

SEQ ID NO: 5142703 - DNA, 17 bp, Homo sapiens
accccagcacagccacc

SEQ ID NO: 5142704 - DNA, 15 bp, Homo sapiens
accccagcacagctc

SEQ ID NO: 5142705 - DNA, 17 bp, Homo sapiens
accccagcacagctcct

SEQ ID NO: 5142706 - DNA, 18 bp, Homo sapiens
accccagcacagctcctc

SEQ ID NO: 5142707 - DNA, 16 bp, Homo sapiens
accccagcattccagc

SEQ ID NO: 5142708 - DNA, 19 bp, Homo sapiens
accccagcattccagctct

SEQ ID NO: 5142709 - DNA, 20 bp, Homo sapiens
accccagcattccagctctg

SEQ ID NO: 5142710 - DNA, 23 bp, Homo sapiens
accccagcattctcaggcaccag

SEQ ID NO: 5142711 - DNA, 14 bp, Homo sapiens
accccagccaggct

SEQ ID NO: 5142712 - DNA, 14 bp, Homo sapiens
accccagcccagac

SEQ ID NO: 5142713 - DNA, 13 bp, Homo sapiens
accccagccccaa

SEQ ID NO: 5142714 - DNA, 19 bp, Homo sapiens
accccagcccccacagccc

SEQ ID NO: 5142715 - DNA, 21 bp, Homo sapiens
accccagcccccacagccctg

SEQ ID NO: 5142716 - DNA, 10 bp, Homo sapiens
accccagcct

SEQ ID NO: 5142717 - DNA, 12 bp, Homo sapiens
accccagcctaa

SEQ ID NO: 5142718 - DNA, 12 bp, Homo sapiens
accccagcctca

SEQ ID NO: 5142719 - DNA, 21 bp, Homo sapiens
accccagcctcaaatccagga

SEQ ID NO: 5142720 - DNA, 12 bp, Homo sapiens
accccagcctcc

SEQ ID NO: 5142721 - DNA, 19 bp, Homo sapiens
accccagcctgacctgaga

SEQ ID NO: 5142722 - DNA, 21 bp, Homo sapiens
accccagcctgacctgagact

SEQ ID NO: 5142723 - DNA, 21 bp, Homo sapiens
accccagcctggccacgcagc

SEQ ID NO: 5142724 - DNA, 22 bp, Homo sapiens
accccagcctggccacgcagcc

SEQ ID NO: 5142725 - DNA, 17 bp, Homo sapiens
accccagcgtcaggcct

SEQ ID NO: 5142726 - DNA, 18 bp, Homo sapiens
accccagctagggctgga

SEQ ID NO: 5142727 - DNA, 22 bp, Homo sapiens
accccagctattttctgaccaa

SEQ ID NO: 5142728 - DNA, 15 bp, Homo sapiens
accccagctccaggc

SEQ ID NO: 5142729 - DNA, 14 bp, Homo sapiens
accccagctcccta

SEQ ID NO: 5142730 - DNA, 10 bp, Homo sapiens
accccagctg

SEQ ID NO: 5142731 - DNA, 14 bp, Homo sapiens
accccagctgccgg

SEQ ID NO: 5142732 - DNA, 12 bp, Homo sapiens
accccagctgct

SEQ ID NO: 5142733 - DNA, 16 bp, Homo sapiens
accccagctggcctct

SEQ ID NO: 5142734 - DNA, 15 bp, Homo sapiens
accccagctgggagg

SEQ ID NO: 5142735 - DNA, 21 bp, Homo sapiens
accccagctgtgagccttggc

SEQ ID NO: 5142736 - DNA, 14 bp, Homo sapiens
accccagcttttct

SEQ ID NO: 5142737 - DNA, 21 bp, Homo sapiens
accccagcttttcttgccagc

SEQ ID NO: 5142738 - DNA, 22 bp, Homo sapiens
accccagcttttcttgccagct

SEQ ID NO: 5142739 - DNA, 23 bp, Homo sapiens
accccagcttttcttgccagctc

SEQ ID NO: 5142740 - DNA, 21 bp, Homo sapiens
accccaggaagtcatcctgca

SEQ ID NO: 5142741 - DNA, 22 bp, Homo sapiens
accccaggacagtttatcctgt

SEQ ID NO: 5142742 - DNA, 21 bp, Homo sapiens
accccaggacctcttctggag

SEQ ID NO: 5142743 - DNA, 22 bp, Homo sapiens
accccaggacctcttctggaga

SEQ ID NO: 5142744 - DNA, 23 bp, Homo sapiens
accccaggacctcttctggagat

SEQ ID NO: 5142745 - DNA, 11 bp, Homo sapiens
accccaggacg

SEQ ID NO: 5142746 - DNA, 21 bp, Homo sapiens
accccaggacgccactcattt

SEQ ID NO: 5142747 - DNA, 16 bp, Homo sapiens
accccaggatcccaga

SEQ ID NO: 5142748 - DNA, 19 bp, Homo sapiens
accccaggcagctcctgtt

SEQ ID NO: 5142749 - DNA, 15 bp, Homo sapiens
accccaggcatccca

SEQ ID NO: 5142750 - DNA, 17 bp, Homo sapiens
accccaggcatcccatc

SEQ ID NO: 5142751 - DNA, 21 bp, Homo sapiens
accccaggcatcccatccctt

SEQ ID NO: 5142752 - DNA, 15 bp, Homo sapiens
accccaggcccactc

SEQ ID NO: 5142753 - DNA, 18 bp, Homo sapiens
accccaggcccactcagg

SEQ ID NO: 5142754 - DNA, 19 bp, Homo sapiens
accccaggcccactcaggg

SEQ ID NO: 5142755 - DNA, 13 bp, Homo sapiens
accccaggccctg

SEQ ID NO: 5142756 - DNA, 14 bp, Homo sapiens
accccaggccctgc

SEQ ID NO: 5142757 - DNA, 22 bp, Homo sapiens
accccaggccctgccagagcag

SEQ ID NO: 5142758 - DNA, 14 bp, Homo sapiens
accccaggctctta

SEQ ID NO: 5142759 - DNA, 23 bp, Homo sapiens
accccaggctggacatgctgact

SEQ ID NO: 5142760 - DNA, 21 bp, Homo sapiens
accccaggctggagtgcagtg

SEQ ID NO: 5142761 - DNA, 13 bp, Homo sapiens
accccaggctggg

SEQ ID NO: 5142762 - DNA, 10 bp, Homo sapiens
accccagggc

SEQ ID NO: 5142763 - DNA, 11 bp, Homo sapiens
accccagggca

SEQ ID NO: 5142764 - DNA, 16 bp, Homo sapiens
accccagggcactgcc

SEQ ID NO: 5142765 - DNA, 17 bp, Homo sapiens
accccagggcactgcca

SEQ ID NO: 5142766 - DNA, 22 bp, Homo sapiens
accccagggcactgccagccca

SEQ ID NO: 5142767 - DNA, 15 bp, Homo sapiens
accccagggcagcca

SEQ ID NO: 5142768 - DNA, 11 bp, Homo sapiens
accccagggcc

SEQ ID NO: 5142769 - DNA, 12 bp, Homo sapiens
accccagggccc

SEQ ID NO: 5142770 - DNA, 19 bp, Homo sapiens
accccagggcccccacagg

SEQ ID NO: 5142771 - DNA, 16 bp, Homo sapiens
accccagggccctggc

SEQ ID NO: 5142772 - DNA, 20 bp, Homo sapiens
accccagggccctggccagc

SEQ ID NO: 5142773 - DNA, 16 bp, Homo sapiens
accccagggcctgtct

SEQ ID NO: 5142774 - DNA, 21 bp, Homo sapiens
accccagggcctgtctccctt

SEQ ID NO: 5142775 - DNA, 22 bp, Homo sapiens
accccagggctgtaactgccag

SEQ ID NO: 5142776 - DNA, 23 bp, Homo sapiens
accccagggctgtaactgccagg

SEQ ID NO: 5142777 - DNA, 20 bp, Homo sapiens
accccaggtcagccctgtgt

SEQ ID NO: 5142778 - DNA, 22 bp, Homo sapiens
accccaggtcagccctgtgtct

SEQ ID NO: 5142779 - DNA, 16 bp, Homo sapiens
accccaggttttctgc

SEQ ID NO: 5142780 - DNA, 10 bp, Homo sapiens
accccagtca

SEQ ID NO: 5142781 - DNA, 18 bp, Homo sapiens
accccagtccccgggaaa

SEQ ID NO: 5142782 - DNA, 15 bp, Homo sapiens
accccagtgcctgca

SEQ ID NO: 5142783 - DNA, 18 bp, Homo sapiens
accccagtgcctgtctgg

SEQ ID NO: 5142784 - DNA, 21 bp, Homo sapiens
accccagtgcctgtctggagc

SEQ ID NO: 5142785 - DNA, 17 bp, Homo sapiens
accccagtggccactca

SEQ ID NO: 5142786 - DNA, 16 bp, Homo sapiens
accccagtgggaactg

SEQ ID NO: 5142787 - DNA, 18 bp, Homo sapiens
accccagttcatctctgc

SEQ ID NO: 5142788 - DNA, 20 bp, Homo sapiens
accccagttcatctctgctg

SEQ ID NO: 5142789 - DNA, 21 bp, Homo sapiens
accccagttcatctctgctga

SEQ ID NO: 5142790 - DNA, 23 bp, Homo sapiens
accccagttcctagcactgcccc

SEQ ID NO: 5142791 - DNA, 17 bp, Homo sapiens
accccagttctgctcct

SEQ ID NO: 5142792 - DNA, 21 bp, Homo sapiens
accccagttctgctcctctcc

SEQ ID NO: 5142793 - DNA, 22 bp, Homo sapiens
accccataagccctgagactcc

SEQ ID NO: 5142794 - DNA, 20 bp, Homo sapiens
accccataataaccctgcca

SEQ ID NO: 5142795 - DNA, 22 bp, Homo sapiens
accccataataaccctgccagt

SEQ ID NO: 5142796 - DNA, 17 bp, Homo sapiens
accccataccccttatt

SEQ ID NO: 5142797 - DNA, 23 bp, Homo sapiens
accccataccccttattgctgcc

SEQ ID NO: 5142798 - DNA, 19 bp, Homo sapiens
accccatagtgaccggctg

SEQ ID NO: 5142799 - DNA, 21 bp, Homo sapiens
accccatagtgaccggctgct

SEQ ID NO: 5142800 - DNA, 21 bp, Homo sapiens
accccatatacacctggaaca

SEQ ID NO: 5142801 - DNA, 12 bp, Homo sapiens
accccatatatt

SEQ ID NO: 5142802 - DNA, 23 bp, Homo sapiens
accccatatattaccccttcatg

SEQ ID NO: 5142803 - DNA, 21 bp, Homo sapiens
accccatcactcgcaggacca

SEQ ID NO: 5142804 - DNA, 15 bp, Homo sapiens
accccatcatccctt

SEQ ID NO: 5142805 - DNA, 20 bp, Homo sapiens
accccatccagccaggggtg

SEQ ID NO: 5142806 - DNA, 17 bp, Homo sapiens
accccatccagttcatg

SEQ ID NO: 5142807 - DNA, 11 bp, Homo sapiens
accccatccct

SEQ ID NO: 5142808 - DNA, 13 bp, Homo sapiens
accccatccctgg

SEQ ID NO: 5142809 - DNA, 14 bp, Homo sapiens
accccatccctggc

SEQ ID NO: 5142810 - DNA, 15 bp, Homo sapiens
accccatccctggct

SEQ ID NO: 5142811 - DNA, 15 bp, Homo sapiens
accccatcccttcct

SEQ ID NO: 5142812 - DNA, 14 bp, Homo sapiens
accccatcctcaca

SEQ ID NO: 5142813 - DNA, 17 bp, Homo sapiens
accccatcctcacacag

SEQ ID NO: 5142814 - DNA, 15 bp, Homo sapiens
accccatctctcttc

SEQ ID NO: 5142815 - DNA, 16 bp, Homo sapiens
accccatctgtgaata

SEQ ID NO: 5142816 - DNA, 18 bp, Homo sapiens
accccatctgtgaataag

SEQ ID NO: 5142817 - DNA, 20 bp, Homo sapiens
accccatgcacctcagggcc

SEQ ID NO: 5142818 - DNA, 22 bp, Homo sapiens
accccatggagacaataaacag

SEQ ID NO: 5142819 - DNA, 18 bp, Homo sapiens
accccatggtccatcccc

SEQ ID NO: 5142820 - DNA, 13 bp, Homo sapiens
accccattcccgc

SEQ ID NO: 5142821 - DNA, 23 bp, Homo sapiens
accccattctttgcttgaacaca

SEQ ID NO: 5142822 - DNA, 19 bp, Homo sapiens
accccatttctctcctcac

SEQ ID NO: 5142823 - DNA, 20 bp, Homo sapiens
acccccaaagacctgcctgt

SEQ ID NO: 5142824 - DNA, 14 bp, Homo sapiens
acccccaaatttaa

SEQ ID NO: 5142825 - DNA, 18 bp, Homo sapiens
acccccaaatttaattaa

SEQ ID NO: 5142826 - DNA, 16 bp, Homo sapiens
acccccaacccccaga

SEQ ID NO: 5142827 - DNA, 17 bp, Homo sapiens
acccccaacccccagag

SEQ ID NO: 5142828 - DNA, 14 bp, Homo sapiens
accactcctctccc

SEQ ID NO: 5142829 - DNA, 15 bp, Homo sapiens
accactcctgccagc

SEQ ID NO: 5142830 - DNA, 16 bp, Homo sapiens
accactcctgccagcc

SEQ ID NO: 5142831 - DNA, 21 bp, Homo sapiens
accactcctgccagcccggct

SEQ ID NO: 5142832 - DNA, 13 bp, Homo sapiens
accactcctgcct

SEQ ID NO: 5142833 - DNA, 17 bp, Homo sapiens
accactcgtgcatccct

SEQ ID NO: 5142834 - DNA, 11 bp, Homo sapiens
accactctaat

SEQ ID NO: 5142835 - DNA, 16 bp, Homo sapiens
accactctggcagcca

SEQ ID NO: 5142836 - DNA, 17 bp, Homo sapiens
accactctggcagccac

SEQ ID NO: 5142837 - DNA, 14 bp, Homo sapiens
accactctgtaatt

SEQ ID NO: 5142838 - DNA, 19 bp, Homo sapiens
accactctgtggccagcct

SEQ ID NO: 5142839 - DNA, 21 bp, Homo sapiens
accactctgtggccagcctgg

SEQ ID NO: 5142840 - DNA, 23 bp, Homo sapiens
accactctgtggccagcctggca

SEQ ID NO: 5142841 - DNA, 22 bp, Homo sapiens
accactcttctctccaaggaaa

SEQ ID NO: 5142842 - DNA, 13 bp, Homo sapiens
accactcttgact

SEQ ID NO: 5142843 - DNA, 18 bp, Homo sapiens
accactcttttgctgtgc

SEQ ID NO: 5142844 - DNA, 16 bp, Homo sapiens
accactgaaaaaatat

SEQ ID NO: 5142845 - DNA, 17 bp, Homo sapiens
accactgaaaaaatata

SEQ ID NO: 5142846 - DNA, 10 bp, Homo sapiens
accactgaat

SEQ ID NO: 5142847 - DNA, 14 bp, Homo sapiens
accactgaatctgt

SEQ ID NO: 5142848 - DNA, 18 bp, Homo sapiens
accactgaattcactcca

SEQ ID NO: 5142849 - DNA, 19 bp, Homo sapiens
accactgaattcactccag

SEQ ID NO: 5142850 - DNA, 21 bp, Homo sapiens
accactgacagcctccacctt

SEQ ID NO: 5142851 - DNA, 19 bp, Homo sapiens
accactgacgtttctgggc

SEQ ID NO: 5142852 - DNA, 21 bp, Homo sapiens
accactgagagcgagatggga

SEQ ID NO: 5142853 - DNA, 17 bp, Homo sapiens
accactgagcccttgca

SEQ ID NO: 5142854 - DNA, 21 bp, Homo sapiens
accactgagtaccaggggctg

SEQ ID NO: 5142855 - DNA, 13 bp, Homo sapiens
accactgatatca

SEQ ID NO: 5142856 - DNA, 17 bp, Homo sapiens
accactgcaagtccttt

SEQ ID NO: 5142857 - DNA, 22 bp, Homo sapiens
accactgcaagtccttttgtaa

SEQ ID NO: 5142858 - DNA, 18 bp, Homo sapiens
accactgcactccagcct

SEQ ID NO: 5142859 - DNA, 20 bp, Homo sapiens
accactgcactccagcctgg

SEQ ID NO: 5142860 - DNA, 13 bp, Homo sapiens
accactgcagaag

SEQ ID NO: 5142861 - DNA, 18 bp, Homo sapiens
accactgccaatgctgta

SEQ ID NO: 5142862 - DNA, 19 bp, Homo sapiens
accactgccaatgctgtac

SEQ ID NO: 5142863 - DNA, 21 bp, Homo sapiens
accactgccccctgctgccat

SEQ ID NO: 5142864 - DNA, 15 bp, Homo sapiens
accactgccctgcct

SEQ ID NO: 5142865 - DNA, 16 bp, Homo sapiens
accactgccctgcctg

SEQ ID NO: 5142866 - DNA, 19 bp, Homo sapiens
accactgccctgcctgccc

SEQ ID NO: 5142867 - DNA, 20 bp, Homo sapiens
accactgccctgcctgccca

SEQ ID NO: 5142868 - DNA, 18 bp, Homo sapiens
accactgctaataaatga

SEQ ID NO: 5142869 - DNA, 22 bp, Homo sapiens
accactgctaataaatgaccag

SEQ ID NO: 5142870 - DNA, 23 bp, Homo sapiens
accactgctgaggagtctgagga

SEQ ID NO: 5142871 - DNA, 15 bp, Homo sapiens
accactgcttctctt

SEQ ID NO: 5142872 - DNA, 16 bp, Homo sapiens
accactgcttctcttt

SEQ ID NO: 5142873 - DNA, 15 bp, Homo sapiens
accactggccaccag

SEQ ID NO: 5142874 - DNA, 16 bp, Homo sapiens
accactggccaccagg

SEQ ID NO: 5142875 - DNA, 17 bp, Homo sapiens
accactggccaccaggc

SEQ ID NO: 5142876 - DNA, 20 bp, Homo sapiens
accactggccaccaggctgg

SEQ ID NO: 5142877 - DNA, 16 bp, Homo sapiens
accactgggcccctca

SEQ ID NO: 5142878 - DNA, 15 bp, Homo sapiens
accactgggcctgct

SEQ ID NO: 5142879 - DNA, 17 bp, Homo sapiens
accactggtacttcctt

SEQ ID NO: 5142880 - DNA, 19 bp, Homo sapiens
accactggtgtatgaaatg

SEQ ID NO: 5142881 - DNA, 20 bp, Homo sapiens
accactgtaaaatgaaatta

SEQ ID NO: 5142882 - DNA, 16 bp, Homo sapiens
accactgtaattgaca

SEQ ID NO: 5142883 - DNA, 16 bp, Homo sapiens
accactgtccctacca

SEQ ID NO: 5142884 - DNA, 13 bp, Homo sapiens
accactgtcttct

SEQ ID NO: 5142885 - DNA, 17 bp, Homo sapiens
accactgtgccactgac

SEQ ID NO: 5142886 - DNA, 19 bp, Homo sapiens
accactgtggaagtccctc

SEQ ID NO: 5142887 - DNA, 22 bp, Homo sapiens
accactgtggccttctcagcct

SEQ ID NO: 5142888 - DNA, 20 bp, Homo sapiens
accactgtggcgttctgctg

SEQ ID NO: 5142889 - DNA, 21 bp, Homo sapiens
accactgtggcgttctgctgc

SEQ ID NO: 5142890 - DNA, 12 bp, Homo sapiens
accactgtgtcc

SEQ ID NO: 5142891 - DNA, 19 bp, Homo sapiens
accactgtttcttgcttgt

SEQ ID NO: 5142892 - DNA, 12 bp, Homo sapiens
accacttaatct

SEQ ID NO: 5142893 - DNA, 13 bp, Homo sapiens
accacttacctca

SEQ ID NO: 5142894 - DNA, 16 bp, Homo sapiens
accacttcactgaaag

SEQ ID NO: 5142895 - DNA, 17 bp, Homo sapiens
accacttcactgaaaga

SEQ ID NO: 5142896 - DNA, 14 bp, Homo sapiens
accacttcagctga

SEQ ID NO: 5142897 - DNA, 15 bp, Homo sapiens
accacttcagggctt

SEQ ID NO: 5142898 - DNA, 17 bp, Homo sapiens
accacttcattcttgaa

SEQ ID NO: 5142899 - DNA, 14 bp, Homo sapiens
accacttccagagc

SEQ ID NO: 5142900 - DNA, 16 bp, Homo sapiens
accacttccagagcca

SEQ ID NO: 5142901 - DNA, 22 bp, Homo sapiens
accacttccctgcttttctccc

SEQ ID NO: 5142902 - DNA, 14 bp, Homo sapiens
accacttcctgagg

SEQ ID NO: 5142903 - DNA, 15 bp, Homo sapiens
accacttcctgaggc

SEQ ID NO: 5142904 - DNA, 20 bp, Homo sapiens
accacttcctgctacaggag

SEQ ID NO: 5142905 - DNA, 22 bp, Homo sapiens
accacttcctgctacaggaggg

SEQ ID NO: 5142906 - DNA, 13 bp, Homo sapiens
accacttccttaa

SEQ ID NO: 5142907 - DNA, 14 bp, Homo sapiens
accacttccttaac

SEQ ID NO: 5142908 - DNA, 15 bp, Homo sapiens
accacttccttaaca

SEQ ID NO: 5142909 - DNA, 15 bp, Homo sapiens
accacttcctttaaa

SEQ ID NO: 5142910 - DNA, 13 bp, Homo sapiens
accacttcgaaac

SEQ ID NO: 5142911 - DNA, 20 bp, Homo sapiens
accacttctccatgctgcaa

SEQ ID NO: 5142912 - DNA, 15 bp, Homo sapiens
accacttctctgctg

SEQ ID NO: 5142913 - DNA, 23 bp, Homo sapiens
accacttctctgctgcctctgtg

SEQ ID NO: 5142914 - DNA, 16 bp, Homo sapiens
accacttcttttataa

SEQ ID NO: 5142915 - DNA, 16 bp, Homo sapiens
accacttgaatttatt

SEQ ID NO: 5142916 - DNA, 13 bp, Homo sapiens
accacttgcctgg

SEQ ID NO: 5142917 - DNA, 14 bp, Homo sapiens
accacttgcctggg

SEQ ID NO: 5142918 - DNA, 19 bp, Homo sapiens
accacttgtagatttgatt

SEQ ID NO: 5142919 - DNA, 20 bp, Homo sapiens
accacttgtcactacaaaaa

SEQ ID NO: 5142920 - DNA, 18 bp, Homo sapiens
accactttattgcaatgc

SEQ ID NO: 5142921 - DNA, 15 bp, Homo sapiens
accactttcccacac

SEQ ID NO: 5142922 - DNA, 12 bp, Homo sapiens
accacttttaaa

SEQ ID NO: 5142923 - DNA, 15 bp, Homo sapiens
accacttttctatat

SEQ ID NO: 5142924 - DNA, 11 bp, Homo sapiens
accacttttgg

SEQ ID NO: 5142925 - DNA, 12 bp, Homo sapiens
accacttttgtt

SEQ ID NO: 5142926 - DNA, 15 bp, Homo sapiens
accacttttgttctt

SEQ ID NO: 5142927 - DNA, 21 bp, Homo sapiens
accacttttgttcttggtttg

SEQ ID NO: 5142928 - DNA, 15 bp, Homo sapiens
accactttttgcagc

SEQ ID NO: 5142929 - DNA, 18 bp, Homo sapiens
accactttttgcagcttt

SEQ ID NO: 5142930 - DNA, 19 bp, Homo sapiens
accagaaaaaataaatgtt

SEQ ID NO: 5142931 - DNA, 14 bp, Homo sapiens
accagaaaagcaat

SEQ ID NO: 5142932 - DNA, 24 bp, Homo sapiens
accagaaagcagttgagacaagaa

SEQ ID NO: 5142933 - DNA, 23 bp, Homo sapiens
accagaaagcctcctctggagaa

SEQ ID NO: 5142934 - DNA, 17 bp, Homo sapiens
accagaaagcttcatcc

SEQ ID NO: 5142935 - DNA, 22 bp, Homo sapiens
accagaaagggaacagtccata

SEQ ID NO: 5142936 - DNA, 11 bp, Homo sapiens
accagaaatat

SEQ ID NO: 5142937 - DNA, 22 bp, Homo sapiens
accagaaatatcgctgatgcag

SEQ ID NO: 5142938 - DNA, 16 bp, Homo sapiens
accagaaatcaaaaag

SEQ ID NO: 5142939 - DNA, 16 bp, Homo sapiens
accagaacagcatggc

SEQ ID NO: 5142940 - DNA, 17 bp, Homo sapiens
accagaacagcatggcc

SEQ ID NO: 5142941 - DNA, 21 bp, Homo sapiens
accagaaccaattattttcat

SEQ ID NO: 5142942 - DNA, 18 bp, Homo sapiens
accagaacgcaccccact

SEQ ID NO: 5142943 - DNA, 21 bp, Homo sapiens
accagaacgtggtttgcctga

SEQ ID NO: 5142944 - DNA, 16 bp, Homo sapiens
accagaactttttcct

SEQ ID NO: 5142945 - DNA, 17 bp, Homo sapiens
accagaagacaaaggcc

SEQ ID NO: 5142946 - DNA, 15 bp, Homo sapiens
accagaagactggat

SEQ ID NO: 5142947 - DNA, 12 bp, Homo sapiens
accagaagcaag

SEQ ID NO: 5142948 - DNA, 20 bp, Homo sapiens
accagaagctcccccagcaa

SEQ ID NO: 5142949 - DNA, 14 bp, Homo sapiens
accagaaggaaagc

SEQ ID NO: 5142950 - DNA, 13 bp, Homo sapiens
accagaaggccct

SEQ ID NO: 5142951 - DNA, 14 bp, Homo sapiens
accagaagggaaac

SEQ ID NO: 5142952 - DNA, 20 bp, Homo sapiens
accagaagtgcagcccctct

SEQ ID NO: 5142953 - DNA, 18 bp, Homo sapiens
accagaagtttctacatt

SEQ ID NO: 5142954 - DNA, 14 bp, Homo sapiens
accagaataaaata

SEQ ID NO: 5142955 - DNA, 14 bp, Homo sapiens
accagaatcataat

SEQ ID NO: 5142956 - DNA, 22 bp, Homo sapiens
accagaatgaaaactgtaaata

SEQ ID NO: 5142957 - DNA, 17 bp, Homo sapiens
accagaatgaggcacat

SEQ ID NO: 5142958 - DNA, 18 bp, Homo sapiens
accagaattcccttgaat

SEQ ID NO: 5142959 - DNA, 23 bp, Homo sapiens
accagaattgcttgaacccagga

SEQ ID NO: 5142960 - DNA, 19 bp, Homo sapiens
accagacaaaaaaatttaa

SEQ ID NO: 5142961 - DNA, 16 bp, Homo sapiens
accagacaagctgttg

SEQ ID NO: 5142962 - DNA, 16 bp, Homo sapiens
accagacaaggaaata

SEQ ID NO: 5142963 - DNA, 12 bp, Homo sapiens
accagacaatgt

SEQ ID NO: 5142964 - DNA, 16 bp, Homo sapiens
accagacacccaggac

SEQ ID NO: 5142965 - DNA, 17 bp, Homo sapiens
accagacacccaggact

SEQ ID NO: 5142966 - DNA, 23 bp, Homo sapiens
accagacaccttgacagggcaca

SEQ ID NO: 5142967 - DNA, 12 bp, Homo sapiens
accagacagagg

SEQ ID NO: 5142968 - DNA, 15 bp, Homo sapiens
accagacagcacagg

SEQ ID NO: 5142969 - DNA, 18 bp, Homo sapiens
accagacagcacagggca

SEQ ID NO: 5142970 - DNA, 11 bp, Homo sapiens
accagacaggt

SEQ ID NO: 5142971 - DNA, 19 bp, Homo sapiens
accagacatcaccctttgc

SEQ ID NO: 5142972 - DNA, 23 bp, Homo sapiens
accagacccacctggagcccgct

SEQ ID NO: 5142973 - DNA, 13 bp, Homo sapiens
accagacccttct

SEQ ID NO: 5142974 - DNA, 22 bp, Homo sapiens
accagacctggaagaacaggcc

SEQ ID NO: 5142975 - DNA, 16 bp, Homo sapiens
accagacggggctgga

SEQ ID NO: 5142976 - DNA, 23 bp, Homo sapiens
accagactacttgggagcaccgc

SEQ ID NO: 5142977 - DNA, 16 bp, Homo sapiens
accagactcgccaaca

SEQ ID NO: 5142978 - DNA, 17 bp, Homo sapiens
accagactcgccaacat

SEQ ID NO: 5142979 - DNA, 20 bp, Homo sapiens
accagactgtggagaaataa

SEQ ID NO: 5142980 - DNA, 12 bp, Homo sapiens
accagacttcaa

SEQ ID NO: 5142981 - DNA, 15 bp, Homo sapiens
accagacttcaagat

SEQ ID NO: 5142982 - DNA, 21 bp, Homo sapiens
accagacttggcctccagctg

SEQ ID NO: 5142983 - DNA, 12 bp, Homo sapiens
accagactttga

SEQ ID NO: 5142984 - DNA, 18 bp, Homo sapiens
accagacttttttaaaca

SEQ ID NO: 5142985 - DNA, 23 bp, Homo sapiens
accagagacccaacagcagtgat

SEQ ID NO: 5142986 - DNA, 17 bp, Homo sapiens
accagagacgcccagcc

SEQ ID NO: 5142987 - DNA, 19 bp, Homo sapiens
accagagacgcccagcccc

SEQ ID NO: 5142988 - DNA, 20 bp, Homo sapiens
accagagacgcccagcccca

SEQ ID NO: 5142989 - DNA, 13 bp, Homo sapiens
accagagagaaag

SEQ ID NO: 5142990 - DNA, 20 bp, Homo sapiens
accagagagagcaaggaagc

SEQ ID NO: 5142991 - DNA, 14 bp, Homo sapiens
accagagcaaaaat

SEQ ID NO: 5142992 - DNA, 22 bp, Homo sapiens
accagagcaaaaatgtaaaaaa

SEQ ID NO: 5142993 - DNA, 19 bp, Homo sapiens
accagagcaacctctcact

SEQ ID NO: 5142994 - DNA, 13 bp, Homo sapiens
accagagcacaga

SEQ ID NO: 5142995 - DNA, 17 bp, Homo sapiens
accagagcactgtatac

SEQ ID NO: 5142996 - DNA, 12 bp, Homo sapiens
accagagcagat

SEQ ID NO: 5142997 - DNA, 17 bp, Homo sapiens
accagagcagatgcaga

SEQ ID NO: 5142998 - DNA, 15 bp, Homo sapiens
accagagcaggggct

SEQ ID NO: 5142999 - DNA, 19 bp, Homo sapiens
accagagcaggggctgctg

SEQ ID NO: 5143000 - DNA, 22 bp, Homo sapiens
accagagcaggggctgctgggg

SEQ ID NO: 5143001 - DNA, 20 bp, Homo sapiens
accagagcatttccaacacc

SEQ ID NO: 5143002 - DNA, 14 bp, Homo sapiens
accagagcccacct

SEQ ID NO: 5143003 - DNA, 19 bp, Homo sapiens
accagagcccaccttggct

SEQ ID NO: 5143004 - DNA, 22 bp, Homo sapiens
accagagcccaccttggctcaa

SEQ ID NO: 5143005 - DNA, 17 bp, Homo sapiens
accagagccccacacgg

SEQ ID NO: 5143006 - DNA, 14 bp, Homo sapiens
accagagccgggag

SEQ ID NO: 5143007 - DNA, 18 bp, Homo sapiens
accagagcgatgtgttct

SEQ ID NO: 5143008 - DNA, 20 bp, Homo sapiens
acccccaagaaacctccatc

SEQ ID NO: 5143009 - DNA, 21 bp, Homo sapiens
acccccaagacagcagtcttc

SEQ ID NO: 5143010 - DNA, 18 bp, Homo sapiens
acccccaagcctgggctt

SEQ ID NO: 5143011 - DNA, 23 bp, Homo sapiens
acccccaataaaccttgaacagt

SEQ ID NO: 5143012 - DNA, 18 bp, Homo sapiens
acccccacaagctgtccc

SEQ ID NO: 5143013 - DNA, 15 bp, Homo sapiens
acccccacacacaca

SEQ ID NO: 5143014 - DNA, 21 bp, Homo sapiens
acccccacacacacacacatg

SEQ ID NO: 5143015 - DNA, 23 bp, Homo sapiens
acccccacagacctgctctggac

SEQ ID NO: 5143016 - DNA, 13 bp, Homo sapiens
acccccaccaagg

SEQ ID NO: 5143017 - DNA, 15 bp, Homo sapiens
acccccaccaagggc

SEQ ID NO: 5143018 - DNA, 11 bp, Homo sapiens
acccccaccag

SEQ ID NO: 5143019 - DNA, 22 bp, Homo sapiens
acccccaccatgcagcccctgg

SEQ ID NO: 5143020 - DNA, 17 bp, Homo sapiens
acccccacccacctcca

SEQ ID NO: 5143021 - DNA, 12 bp, Homo sapiens
acccccacccca

SEQ ID NO: 5143022 - DNA, 15 bp, Homo sapiens
acccccaccccacac

SEQ ID NO: 5143023 - DNA, 17 bp, Homo sapiens
acccccaccccacactt

SEQ ID NO: 5143024 - DNA, 15 bp, Homo sapiens
acccccacccccagc

SEQ ID NO: 5143025 - DNA, 13 bp, Homo sapiens
acccccacccctg

SEQ ID NO: 5143026 - DNA, 14 bp, Homo sapiens
acccccacccctgt

SEQ ID NO: 5143027 - DNA, 23 bp, Homo sapiens
acccccacccctgtacccagcca

SEQ ID NO: 5143028 - DNA, 14 bp, Homo sapiens
acccccaccccttc

SEQ ID NO: 5143029 - DNA, 20 bp, Homo sapiens
acccccaccccttccccact

SEQ ID NO: 5143030 - DNA, 22 bp, Homo sapiens
acccccaccctagcctccacca

SEQ ID NO: 5143031 - DNA, 12 bp, Homo sapiens
acccccaccctc

SEQ ID NO: 5143032 - DNA, 19 bp, Homo sapiens
acccccacctccctgcagc

SEQ ID NO: 5143033 - DNA, 15 bp, Homo sapiens
acccccactccagct

SEQ ID NO: 5143034 - DNA, 19 bp, Homo sapiens
acccccactgccgcctcct

SEQ ID NO: 5143035 - DNA, 20 bp, Homo sapiens
acccccacttcatgcccact

SEQ ID NO: 5143036 - DNA, 16 bp, Homo sapiens
acccccactttcgcct

SEQ ID NO: 5143037 - DNA, 18 bp, Homo sapiens
acccccagaatgacctgg

SEQ ID NO: 5143038 - DNA, 12 bp, Homo sapiens
acccccagagac

SEQ ID NO: 5143039 - DNA, 16 bp, Homo sapiens
acccccagaggtggcc

SEQ ID NO: 5143040 - DNA, 18 bp, Homo sapiens
acccccagaggtggccct

SEQ ID NO: 5143041 - DNA, 19 bp, Homo sapiens
acccccagaggtggccctt

SEQ ID NO: 5143042 - DNA, 11 bp, Homo sapiens
acccccagcaa

SEQ ID NO: 5143043 - DNA, 13 bp, Homo sapiens
acccccagcacag

SEQ ID NO: 5143044 - DNA, 13 bp, Homo sapiens
acccccagcaccc

SEQ ID NO: 5143045 - DNA, 21 bp, Homo sapiens
acccccagcacccgggctcag

SEQ ID NO: 5143046 - DNA, 13 bp, Homo sapiens
acccccagccagg

SEQ ID NO: 5143047 - DNA, 16 bp, Homo sapiens
acccccagcccacaga

SEQ ID NO: 5143048 - DNA, 17 bp, Homo sapiens
acccccagcccacagag

SEQ ID NO: 5143049 - DNA, 14 bp, Homo sapiens
acccccagccccga

SEQ ID NO: 5143050 - DNA, 14 bp, Homo sapiens
acccccagccctgg

SEQ ID NO: 5143051 - DNA, 13 bp, Homo sapiens
acccccagcctcc

SEQ ID NO: 5143052 - DNA, 18 bp, Homo sapiens
acccccagcctcccccag

SEQ ID NO: 5143053 - DNA, 20 bp, Homo sapiens
acccccagcctcccccaggc

SEQ ID NO: 5143054 - DNA, 13 bp, Homo sapiens
acccccagcctgc

SEQ ID NO: 5143055 - DNA, 14 bp, Homo sapiens
acccccagcctggg

SEQ ID NO: 5143056 - DNA, 14 bp, Homo sapiens
acccccagccttgc

SEQ ID NO: 5143057 - DNA, 18 bp, Homo sapiens
acccccagctccggcctg

SEQ ID NO: 5143058 - DNA, 22 bp, Homo sapiens
acccccagctcctttccctgga

SEQ ID NO: 5143059 - DNA, 14 bp, Homo sapiens
acccccagctgact

SEQ ID NO: 5143060 - DNA, 16 bp, Homo sapiens
acccccagctttgcta

SEQ ID NO: 5143061 - DNA, 17 bp, Homo sapiens
acccccaggaggagaga

SEQ ID NO: 5143062 - DNA, 23 bp, Homo sapiens
acccccaggaggagagagatgct

SEQ ID NO: 5143063 - DNA, 19 bp, Homo sapiens
acccccaggattcccagag

SEQ ID NO: 5143064 - DNA, 18 bp, Homo sapiens
acccccaggcctcctagg

SEQ ID NO: 5143065 - DNA, 18 bp, Homo sapiens
acccccaggtcttcctgc

SEQ ID NO: 5143066 - DNA, 19 bp, Homo sapiens
acccccaggtcttcctgct

SEQ ID NO: 5143067 - DNA, 17 bp, Homo sapiens
acccccaggtggcctgc

SEQ ID NO: 5143068 - DNA, 21 bp, Homo sapiens
acccccaggtttttgcccatc

SEQ ID NO: 5143069 - DNA, 13 bp, Homo sapiens
acccccagtcccc

SEQ ID NO: 5143070 - DNA, 13 bp, Homo sapiens
acccccagtcctc

SEQ ID NO: 5143071 - DNA, 17 bp, Homo sapiens
acccccagtcctcccta

SEQ ID NO: 5143072 - DNA, 17 bp, Homo sapiens
acccccagtctccaggg

SEQ ID NO: 5143073 - DNA, 18 bp, Homo sapiens
acccccagtgccacagag

SEQ ID NO: 5143074 - DNA, 11 bp, Homo sapiens
acccccagtgt

SEQ ID NO: 5143075 - DNA, 22 bp, Homo sapiens
acccccagtgtattttgtccaa

SEQ ID NO: 5143076 - DNA, 16 bp, Homo sapiens
acccccatccagcctc

SEQ ID NO: 5143077 - DNA, 17 bp, Homo sapiens
acccccatccagcctcc

SEQ ID NO: 5143078 - DNA, 19 bp, Homo sapiens
acccccatccagcctccag

SEQ ID NO: 5143079 - DNA, 20 bp, Homo sapiens
acccccatccagcctccagg

SEQ ID NO: 5143080 - DNA, 21 bp, Homo sapiens
acccccatccagcctccaggg

SEQ ID NO: 5143081 - DNA, 20 bp, Homo sapiens
acccccatcgctctgagcat

SEQ ID NO: 5143082 - DNA, 15 bp, Homo sapiens
acccccatctgagct

SEQ ID NO: 5143083 - DNA, 18 bp, Homo sapiens
acccccatcttccacctg

SEQ ID NO: 5143084 - DNA, 21 bp, Homo sapiens
acccccatcttccacctgtgc

SEQ ID NO: 5143085 - DNA, 19 bp, Homo sapiens
acccccatgctgccttcag

SEQ ID NO: 5143086 - DNA, 21 bp, Homo sapiens
acccccatgctgccttcaggg

SEQ ID NO: 5143087 - DNA, 14 bp, Homo sapiens
acccccatgtaaat

SEQ ID NO: 5143088 - DNA, 16 bp, Homo sapiens
acccccatgtaaatat

SEQ ID NO: 5143089 - DNA, 22 bp, Homo sapiens
acccccatgtaaatattgttct

SEQ ID NO: 5143090 - DNA, 16 bp, Homo sapiens
acccccatgtggcagc

SEQ ID NO: 5143091 - DNA, 19 bp, Homo sapiens
acccccatgtggcagccca

SEQ ID NO: 5143092 - DNA, 15 bp, Homo sapiens
acccccattctcatc

SEQ ID NO: 5143093 - DNA, 16 bp, Homo sapiens
acccccattctcatct

SEQ ID NO: 5143094 - DNA, 20 bp, Homo sapiens
accccccaacccctgaggaa

SEQ ID NO: 5143095 - DNA, 14 bp, Homo sapiens
accccccacccccg

SEQ ID NO: 5143096 - DNA, 12 bp, Homo sapiens
accccccacctg

SEQ ID NO: 5143097 - DNA, 19 bp, Homo sapiens
accccccactctgtgcctg

SEQ ID NO: 5143098 - DNA, 18 bp, Homo sapiens
accccccagaacctgtcc

SEQ ID NO: 5143099 - DNA, 14 bp, Homo sapiens
accccccagcactg

SEQ ID NO: 5143100 - DNA, 15 bp, Homo sapiens
accccccagcactga

SEQ ID NO: 5143101 - DNA, 14 bp, Homo sapiens
accccccaggccct

SEQ ID NO: 5143102 - DNA, 20 bp, Homo sapiens
accccccagtcgagccctgc

SEQ ID NO: 5143103 - DNA, 22 bp, Homo sapiens
acccccccagcttcacttctga

SEQ ID NO: 5143104 - DNA, 15 bp, Homo sapiens
acccccccaggcctc

SEQ ID NO: 5143105 - DNA, 19 bp, Homo sapiens
acccccccaggcctccaga

SEQ ID NO: 5143106 - DNA, 13 bp, Homo sapiens
accccccccccac

SEQ ID NO: 5143107 - DNA, 19 bp, Homo sapiens
acccccctaccccatgctg

SEQ ID NO: 5143108 - DNA, 12 bp, Homo sapiens
acccccctcatt

SEQ ID NO: 5143109 - DNA, 14 bp, Homo sapiens
acccccctcccaga

SEQ ID NO: 5143110 - DNA, 13 bp, Homo sapiens
acccccctcctcc

SEQ ID NO: 5143111 - DNA, 16 bp, Homo sapiens
acccccctcctccccc

SEQ ID NO: 5143112 - DNA, 16 bp, Homo sapiens
acccccctcctgctcc

SEQ ID NO: 5143113 - DNA, 23 bp, Homo sapiens
acccccctcctgctcctccctgc

SEQ ID NO: 5143114 - DNA, 20 bp, Homo sapiens
acccccctctctttctctgg

SEQ ID NO: 5143115 - DNA, 21 bp, Homo sapiens
acccccctctctttctctggt

SEQ ID NO: 5143116 - DNA, 14 bp, Homo sapiens
acccccctgtacac

SEQ ID NO: 5143117 - DNA, 15 bp, Homo sapiens
acccccctgtgcctg

SEQ ID NO: 5143118 - DNA, 15 bp, Homo sapiens
acccccctgttctaa

SEQ ID NO: 5143119 - DNA, 19 bp, Homo sapiens
acccccctgttctaagggg

SEQ ID NO: 5143120 - DNA, 20 bp, Homo sapiens
acccccgacggcctccagga

SEQ ID NO: 5143121 - DNA, 21 bp, Homo sapiens
acccccgacgtgctcccctgc

SEQ ID NO: 5143122 - DNA, 22 bp, Homo sapiens
acccccgacgtgctcccctgct

SEQ ID NO: 5143123 - DNA, 15 bp, Homo sapiens
acccccgagcttgcc

SEQ ID NO: 5143124 - DNA, 14 bp, Homo sapiens
acccccgaggcccc

SEQ ID NO: 5143125 - DNA, 15 bp, Homo sapiens
acccccgaggccccc

SEQ ID NO: 5143126 - DNA, 20 bp, Homo sapiens
acccccgaggcccccctctg

SEQ ID NO: 5143127 - DNA, 21 bp, Homo sapiens
acccccgaggcccccctctgc

SEQ ID NO: 5143128 - DNA, 22 bp, Homo sapiens
acccccgagtttggtccctggg

SEQ ID NO: 5143129 - DNA, 13 bp, Homo sapiens
acccccgcagagg

SEQ ID NO: 5143130 - DNA, 19 bp, Homo sapiens
acccccgccacctcagggc

SEQ ID NO: 5143131 - DNA, 15 bp, Homo sapiens
acccccgccacggcc

SEQ ID NO: 5143132 - DNA, 21 bp, Homo sapiens
acccccgccacggccaccctc

SEQ ID NO: 5143133 - DNA, 14 bp, Homo sapiens
acccccgccaggcg

SEQ ID NO: 5143134 - DNA, 13 bp, Homo sapiens
acccccgcccagg

SEQ ID NO: 5143135 - DNA, 19 bp, Homo sapiens
acccccgcccaggctggcc

SEQ ID NO: 5143136 - DNA, 21 bp, Homo sapiens
acccccgcccaggctggccag

SEQ ID NO: 5143137 - DNA, 22 bp, Homo sapiens
acccccgctccagatctgcact

SEQ ID NO: 5143138 - DNA, 19 bp, Homo sapiens
acccccgggatcctgcccc

SEQ ID NO: 5143139 - DNA, 21 bp, Homo sapiens
acccccgggatcctgccccca

SEQ ID NO: 5143140 - DNA, 14 bp, Homo sapiens
acccccgggtgcct

SEQ ID NO: 5143141 - DNA, 20 bp, Homo sapiens
acccccgtcggaatggtaac

SEQ ID NO: 5143142 - DNA, 23 bp, Homo sapiens
acccccgtgccaaatcctgggca

SEQ ID NO: 5143143 - DNA, 16 bp, Homo sapiens
acccccgtggtctttg

SEQ ID NO: 5143144 - DNA, 21 bp, Homo sapiens
acccccgtggtctttgaataa

SEQ ID NO: 5143145 - DNA, 22 bp, Homo sapiens
acccccgtggtctttgaataaa

SEQ ID NO: 5143146 - DNA, 20 bp, Homo sapiens
accccctaacctctaaccct

SEQ ID NO: 5143147 - DNA, 17 bp, Homo sapiens
accccctcaagccccag

SEQ ID NO: 5143148 - DNA, 19 bp, Homo sapiens
accccctcaagccccagca

SEQ ID NO: 5143149 - DNA, 12 bp, Homo sapiens
accccctcacca

SEQ ID NO: 5143150 - DNA, 17 bp, Homo sapiens
accccctcacccctcca

SEQ ID NO: 5143151 - DNA, 13 bp, Homo sapiens
accccctcagcct

SEQ ID NO: 5143152 - DNA, 17 bp, Homo sapiens
accccctcattcccctc

SEQ ID NO: 5143153 - DNA, 16 bp, Homo sapiens
accccctcattgttta

SEQ ID NO: 5143154 - DNA, 13 bp, Homo sapiens
accccctccagct

SEQ ID NO: 5143155 - DNA, 14 bp, Homo sapiens
accccctccagctc

SEQ ID NO: 5143156 - DNA, 17 bp, Homo sapiens
accccctcccaccccca

SEQ ID NO: 5143157 - DNA, 22 bp, Homo sapiens
accccctccccaaagccactgg

SEQ ID NO: 5143158 - DNA, 15 bp, Homo sapiens
accccctccccccaa

SEQ ID NO: 5143159 - DNA, 12 bp, Homo sapiens
accccctccccg

SEQ ID NO: 5143160 - DNA, 21 bp, Homo sapiens
accccctccccgcccttcttt

SEQ ID NO: 5143161 - DNA, 20 bp, Homo sapiens
accccctccccgggcagcag

SEQ ID NO: 5143162 - DNA, 22 bp, Homo sapiens
accccctccccgggcagcagag

SEQ ID NO: 5143163 - DNA, 16 bp, Homo sapiens
accccctccctacaca

SEQ ID NO: 5143164 - DNA, 20 bp, Homo sapiens
accccctccctggcctgttc

SEQ ID NO: 5143165 - DNA, 22 bp, Homo sapiens
accccctccctggcctgttctg

SEQ ID NO: 5143166 - DNA, 16 bp, Homo sapiens
accccctcctccccca

SEQ ID NO: 5143167 - DNA, 13 bp, Homo sapiens
accccctcctgct

SEQ ID NO: 5143168 - DNA, 14 bp, Homo sapiens
accccctcctgctg

SEQ ID NO: 5143169 - DNA, 15 bp, Homo sapiens
accccctcctgctgc

SEQ ID NO: 5143170 - DNA, 16 bp, Homo sapiens
accccctcctgctgca

SEQ ID NO: 5143171 - DNA, 16 bp, Homo sapiens
accccctcctggcaat

SEQ ID NO: 5143172 - DNA, 15 bp, Homo sapiens
accccctccttcaga

SEQ ID NO: 5143173 - DNA, 23 bp, Homo sapiens
accccctccttccctgtgtcttt

SEQ ID NO: 5143174 - DNA, 14 bp, Homo sapiens
accccctcgccagc

SEQ ID NO: 5143175 - DNA, 16 bp, Homo sapiens
accccctcgcctccta

SEQ ID NO: 5143176 - DNA, 14 bp, Homo sapiens
accccctcggagcc

SEQ ID NO: 5143177 - DNA, 20 bp, Homo sapiens
accccctcggagcctgtgtt

SEQ ID NO: 5143178 - DNA, 14 bp, Homo sapiens
accccctctagaaa

SEQ ID NO: 5143179 - DNA, 13 bp, Homo sapiens
accccctctggag

SEQ ID NO: 5143180 - DNA, 21 bp, Homo sapiens
accccctctggagaaggcctg

SEQ ID NO: 5143181 - DNA, 22 bp, Homo sapiens
accccctctggagaaggcctgg

SEQ ID NO: 5143182 - DNA, 21 bp, Homo sapiens
accccctcttctgagcacaga

SEQ ID NO: 5143183 - DNA, 22 bp, Homo sapiens
accccctcttctgagcacagat

SEQ ID NO: 5143184 - DNA, 22 bp, Homo sapiens
accccctgcaaagcccagcttg

SEQ ID NO: 5143185 - DNA, 14 bp, Homo sapiens
accccctgcaagaa

SEQ ID NO: 5143186 - DNA, 17 bp, Homo sapiens
accccctgcagcccagg

SEQ ID NO: 5143187 - DNA, 14 bp, Homo sapiens
accagagctctgga

SEQ ID NO: 5143188 - DNA, 15 bp, Homo sapiens
accagagctctggag

SEQ ID NO: 5143189 - DNA, 18 bp, Homo sapiens
accagagctctggagcca

SEQ ID NO: 5143190 - DNA, 23 bp, Homo sapiens
accagagctctggagccacctgt

SEQ ID NO: 5143191 - DNA, 19 bp, Homo sapiens
accagagctgccacctgcc

SEQ ID NO: 5143192 - DNA, 17 bp, Homo sapiens
accagagctgcctcccc

SEQ ID NO: 5143193 - DNA, 18 bp, Homo sapiens
accagagctgcctcccca

SEQ ID NO: 5143194 - DNA, 17 bp, Homo sapiens
accagagctgtggagag

SEQ ID NO: 5143195 - DNA, 20 bp, Homo sapiens
accagagcttctctgggctg

SEQ ID NO: 5143196 - DNA, 16 bp, Homo sapiens
accagaggaagcccct

SEQ ID NO: 5143197 - DNA, 16 bp, Homo sapiens
accagaggagcctttt

SEQ ID NO: 5143198 - DNA, 13 bp, Homo sapiens
accagaggcagct

SEQ ID NO: 5143199 - DNA, 11 bp, Homo sapiens
accagaggccg

SEQ ID NO: 5143200 - DNA, 22 bp, Homo sapiens
accagaggctgcagaaggccaa

SEQ ID NO: 5143201 - DNA, 14 bp, Homo sapiens
accagagggcatgc

SEQ ID NO: 5143202 - DNA, 16 bp, Homo sapiens
accagagggcatgctg

SEQ ID NO: 5143203 - DNA, 15 bp, Homo sapiens
accagagtcacccag

SEQ ID NO: 5143204 - DNA, 19 bp, Homo sapiens
accagagtcttaagggtca

SEQ ID NO: 5143205 - DNA, 22 bp, Homo sapiens
accagagtcttaagggtcactg

SEQ ID NO: 5143206 - DNA, 18 bp, Homo sapiens
accagataaatagaacta

SEQ ID NO: 5143207 - DNA, 23 bp, Homo sapiens
accagataaatagaactatctgc

SEQ ID NO: 5143208 - DNA, 19 bp, Homo sapiens
accagataactgaggaggg

SEQ ID NO: 5143209 - DNA, 22 bp, Homo sapiens
accagataccttatcttacaat

SEQ ID NO: 5143210 - DNA, 22 bp, Homo sapiens
accagatagctcaatactctct

SEQ ID NO: 5143211 - DNA, 14 bp, Homo sapiens
accagatcaggaga

SEQ ID NO: 5143212 - DNA, 15 bp, Homo sapiens
accagatctttctct

SEQ ID NO: 5143213 - DNA, 20 bp, Homo sapiens
accagatctttctcttccct

SEQ ID NO: 5143214 - DNA, 16 bp, Homo sapiens
accagatgaacatttc

SEQ ID NO: 5143215 - DNA, 17 bp, Homo sapiens
accagatgaacatttca

SEQ ID NO: 5143216 - DNA, 20 bp, Homo sapiens
accagatgacacataaatct

SEQ ID NO: 5143217 - DNA, 21 bp, Homo sapiens
accagatgagaagttaagcag

SEQ ID NO: 5143218 - DNA, 16 bp, Homo sapiens
accagatgagaattag

SEQ ID NO: 5143219 - DNA, 21 bp, Homo sapiens
accagatgcgtcccaagatgt

SEQ ID NO: 5143220 - DNA, 10 bp, Homo sapiens
accagatgct

SEQ ID NO: 5143221 - DNA, 14 bp, Homo sapiens
accagatgctgaaa

SEQ ID NO: 5143222 - DNA, 13 bp, Homo sapiens
accagatgtccgt

SEQ ID NO: 5143223 - DNA, 14 bp, Homo sapiens
accagatgtgacag

SEQ ID NO: 5143224 - DNA, 18 bp, Homo sapiens
accagatgtgcttttatt

SEQ ID NO: 5143225 - DNA, 21 bp, Homo sapiens
accagattctgcctatgtaaa

SEQ ID NO: 5143226 - DNA, 19 bp, Homo sapiens
accagattctttgtggata

SEQ ID NO: 5143227 - DNA, 22 bp, Homo sapiens
accagcaaagagaatgtatttc

SEQ ID NO: 5143228 - DNA, 14 bp, Homo sapiens
accagcaacatctc

SEQ ID NO: 5143229 - DNA, 19 bp, Homo sapiens
accagcaacatctcgagcc

SEQ ID NO: 5143230 - DNA, 16 bp, Homo sapiens
accagcaactctgact

SEQ ID NO: 5143231 - DNA, 16 bp, Homo sapiens
accagcaagtcccaga

SEQ ID NO: 5143232 - DNA, 17 bp, Homo sapiens
accagcaatatgtaaat

SEQ ID NO: 5143233 - DNA, 19 bp, Homo sapiens
accagcaatgccctgcctt

SEQ ID NO: 5143234 - DNA, 13 bp, Homo sapiens
accagcacactcc

SEQ ID NO: 5143235 - DNA, 22 bp, Homo sapiens
accagcaccttcaagcgctcca

SEQ ID NO: 5143236 - DNA, 17 bp, Homo sapiens
accagcactcagcctca

SEQ ID NO: 5143237 - DNA, 17 bp, Homo sapiens
accagcactccatcact

SEQ ID NO: 5143238 - DNA, 15 bp, Homo sapiens
accagcactcccagg

SEQ ID NO: 5143239 - DNA, 23 bp, Homo sapiens
accagcactcccagggcccgagc

SEQ ID NO: 5143240 - DNA, 16 bp, Homo sapiens
accagcactgtctcag

SEQ ID NO: 5143241 - DNA, 14 bp, Homo sapiens
accagcagaaatgc

SEQ ID NO: 5143242 - DNA, 19 bp, Homo sapiens
accagcagaaatgccccca

SEQ ID NO: 5143243 - DNA, 14 bp, Homo sapiens
accagcagaacagc

SEQ ID NO: 5143244 - DNA, 19 bp, Homo sapiens
accagcagaacagccattt

SEQ ID NO: 5143245 - DNA, 22 bp, Homo sapiens
accagcagacagagccaggaga

SEQ ID NO: 5143246 - DNA, 15 bp, Homo sapiens
accagcagatcccag

SEQ ID NO: 5143247 - DNA, 19 bp, Homo sapiens
accagcagatcccagctca

SEQ ID NO: 5143248 - DNA, 20 bp, Homo sapiens
accagcagcaactgaaaatg

SEQ ID NO: 5143249 - DNA, 19 bp, Homo sapiens
accagcagcaatctgtctt

SEQ ID NO: 5143250 - DNA, 12 bp, Homo sapiens
accagcagcaca

SEQ ID NO: 5143251 - DNA, 22 bp, Homo sapiens
accagcagcacaattctgtccc

SEQ ID NO: 5143252 - DNA, 15 bp, Homo sapiens
accagcagcactgga

SEQ ID NO: 5143253 - DNA, 18 bp, Homo sapiens
accagcagcactggaacc

SEQ ID NO: 5143254 - DNA, 23 bp, Homo sapiens
accagcagcatagaacaggacct

SEQ ID NO: 5143255 - DNA, 13 bp, Homo sapiens
accagcagcctgg

SEQ ID NO: 5143256 - DNA, 18 bp, Homo sapiens
accagcagcgcctttccc

SEQ ID NO: 5143257 - DNA, 14 bp, Homo sapiens
accagcaggaggga

SEQ ID NO: 5143258 - DNA, 23 bp, Homo sapiens
accagcaggaggttctgggcctc

SEQ ID NO: 5143259 - DNA, 13 bp, Homo sapiens
accagcaggcagg

SEQ ID NO: 5143260 - DNA, 21 bp, Homo sapiens
accagcaggcaggtggactga

SEQ ID NO: 5143261 - DNA, 16 bp, Homo sapiens
accagcaggctcctca

SEQ ID NO: 5143262 - DNA, 12 bp, Homo sapiens
accagcaggtgt

SEQ ID NO: 5143263 - DNA, 21 bp, Homo sapiens
accagcaggtgtggtggctca

SEQ ID NO: 5143264 - DNA, 22 bp, Homo sapiens
accagcaggtgtggtggctcat

SEQ ID NO: 5143265 - DNA, 17 bp, Homo sapiens
accagcagtcacaggtc

SEQ ID NO: 5143266 - DNA, 18 bp, Homo sapiens
accagcagtctgcctgga

SEQ ID NO: 5143267 - DNA, 13 bp, Homo sapiens
accagcagtgttt

SEQ ID NO: 5143268 - DNA, 17 bp, Homo sapiens
accagcataccagttct

SEQ ID NO: 5143269 - DNA, 18 bp, Homo sapiens
accagcatagttctgcaa

SEQ ID NO: 5143270 - DNA, 16 bp, Homo sapiens
accagcatcacctgcc

SEQ ID NO: 5143271 - DNA, 18 bp, Homo sapiens
accagcatcacctgcctg

SEQ ID NO: 5143272 - DNA, 22 bp, Homo sapiens
accagcatcccttgaccaggcc

SEQ ID NO: 5143273 - DNA, 22 bp, Homo sapiens
accagcatggtagtggcaaaga

SEQ ID NO: 5143274 - DNA, 18 bp, Homo sapiens
accagcatgtcactccca

SEQ ID NO: 5143275 - DNA, 23 bp, Homo sapiens
accagcattccctacagcctagg

SEQ ID NO: 5143276 - DNA, 15 bp, Homo sapiens
accagcattcctttt

SEQ ID NO: 5143277 - DNA, 11 bp, Homo sapiens
accagcatttg

SEQ ID NO: 5143278 - DNA, 14 bp, Homo sapiens
accagcatttgtcc

SEQ ID NO: 5143279 - DNA, 16 bp, Homo sapiens
accagcatttgtcctt

SEQ ID NO: 5143280 - DNA, 20 bp, Homo sapiens
accagcatttgtccttttgt

SEQ ID NO: 5143281 - DNA, 13 bp, Homo sapiens
accagcattttac

SEQ ID NO: 5143282 - DNA, 14 bp, Homo sapiens
accagcattttact

SEQ ID NO: 5143283 - DNA, 14 bp, Homo sapiens
accagccacacaga

SEQ ID NO: 5143284 - DNA, 15 bp, Homo sapiens
accagccacacagag

SEQ ID NO: 5143285 - DNA, 17 bp, Homo sapiens
accagccacacagagcc

SEQ ID NO: 5143286 - DNA, 20 bp, Homo sapiens
accagccacacagagcctgc

SEQ ID NO: 5143287 - DNA, 21 bp, Homo sapiens
accagccacacagagcctgcc

SEQ ID NO: 5143288 - DNA, 19 bp, Homo sapiens
accagccacagtacatatg

SEQ ID NO: 5143289 - DNA, 16 bp, Homo sapiens
accagccacctcatcc

SEQ ID NO: 5143290 - DNA, 15 bp, Homo sapiens
accagccagatcctc

SEQ ID NO: 5143291 - DNA, 16 bp, Homo sapiens
accagccagcctcaga

SEQ ID NO: 5143292 - DNA, 14 bp, Homo sapiens
accagccagcgcag

SEQ ID NO: 5143293 - DNA, 19 bp, Homo sapiens
accagccaggctctgtgct

SEQ ID NO: 5143294 - DNA, 23 bp, Homo sapiens
accagccaggctctgtgctgacc

SEQ ID NO: 5143295 - DNA, 19 bp, Homo sapiens
accagccagggaaagactg

SEQ ID NO: 5143296 - DNA, 22 bp, Homo sapiens
accagccatacttatctctctg

SEQ ID NO: 5143297 - DNA, 21 bp, Homo sapiens
accagccattggctatttaaa

SEQ ID NO: 5143298 - DNA, 11 bp, Homo sapiens
accagcccacg

SEQ ID NO: 5143299 - DNA, 17 bp, Homo sapiens
accagcccacgctgact

SEQ ID NO: 5143300 - DNA, 15 bp, Homo sapiens
accagcccagatgtt

SEQ ID NO: 5143301 - DNA, 12 bp, Homo sapiens
accagcccagcc

SEQ ID NO: 5143302 - DNA, 16 bp, Homo sapiens
accagcccagcctgca

SEQ ID NO: 5143303 - DNA, 20 bp, Homo sapiens
accagcccagcctgccccct

SEQ ID NO: 5143304 - DNA, 12 bp, Homo sapiens
accagcccaggc

SEQ ID NO: 5143305 - DNA, 18 bp, Homo sapiens
accagcccatggccctgt

SEQ ID NO: 5143306 - DNA, 19 bp, Homo sapiens
accagcccatggccctgtg

SEQ ID NO: 5143307 - DNA, 20 bp, Homo sapiens
accagcccatggccctgtgc

SEQ ID NO: 5143308 - DNA, 20 bp, Homo sapiens
accagcccattggccgagct

SEQ ID NO: 5143309 - DNA, 19 bp, Homo sapiens
accagccccaatccaaaac

SEQ ID NO: 5143310 - DNA, 18 bp, Homo sapiens
accagccccactgccagc

SEQ ID NO: 5143311 - DNA, 20 bp, Homo sapiens
accagccccactgccagcag

SEQ ID NO: 5143312 - DNA, 21 bp, Homo sapiens
accagccccactgccagcagc

SEQ ID NO: 5143313 - DNA, 22 bp, Homo sapiens
accagccccactgccagcagca

SEQ ID NO: 5143314 - DNA, 23 bp, Homo sapiens
accagccccactgccagcagcag

SEQ ID NO: 5143315 - DNA, 16 bp, Homo sapiens
accagccccagtgccc

SEQ ID NO: 5143316 - DNA, 17 bp, Homo sapiens
accagccccagtgccca

SEQ ID NO: 5143317 - DNA, 22 bp, Homo sapiens
accagcccccaggaagacatta

SEQ ID NO: 5143318 - DNA, 21 bp, Homo sapiens
accagcccccgccccagagtg

SEQ ID NO: 5143319 - DNA, 13 bp, Homo sapiens
accagccccctgg

SEQ ID NO: 5143320 - DNA, 19 bp, Homo sapiens
accagccccctggatgggc

SEQ ID NO: 5143321 - DNA, 15 bp, Homo sapiens
accagcccctgcccc

SEQ ID NO: 5143322 - DNA, 16 bp, Homo sapiens
accagcccctgcccca

SEQ ID NO: 5143323 - DNA, 18 bp, Homo sapiens
accagcccctgccccagc

SEQ ID NO: 5143324 - DNA, 18 bp, Homo sapiens
accagccccttcctgggt

SEQ ID NO: 5143325 - DNA, 19 bp, Homo sapiens
accagcccgacagtgccat

SEQ ID NO: 5143326 - DNA, 15 bp, Homo sapiens
accagcccggcctgc

SEQ ID NO: 5143327 - DNA, 16 bp, Homo sapiens
accagcccggcctgct

SEQ ID NO: 5143328 - DNA, 18 bp, Homo sapiens
accagccctactcctgcg

SEQ ID NO: 5143329 - DNA, 22 bp, Homo sapiens
accagccctagctgtcccatgg

SEQ ID NO: 5143330 - DNA, 12 bp, Homo sapiens
accagccctcca

SEQ ID NO: 5143331 - DNA, 17 bp, Homo sapiens
accagccctgagccatg

SEQ ID NO: 5143332 - DNA, 13 bp, Homo sapiens
accagccctgcag

SEQ ID NO: 5143333 - DNA, 21 bp, Homo sapiens
accagccctgctgcttcctaa

SEQ ID NO: 5143334 - DNA, 23 bp, Homo sapiens
accagccctgctgcttcctaact

SEQ ID NO: 5143335 - DNA, 15 bp, Homo sapiens
accagccctggggct

SEQ ID NO: 5143336 - DNA, 16 bp, Homo sapiens
accagccctggggctg

SEQ ID NO: 5143337 - DNA, 18 bp, Homo sapiens
accagccctggggctggg

SEQ ID NO: 5143338 - DNA, 20 bp, Homo sapiens
accagccctggggctgggcc

SEQ ID NO: 5143339 - DNA, 12 bp, Homo sapiens
accagccctggt

SEQ ID NO: 5143340 - DNA, 15 bp, Homo sapiens
accagcccttccctg

SEQ ID NO: 5143341 - DNA, 18 bp, Homo sapiens
accagcccttccctgctt

SEQ ID NO: 5143342 - DNA, 21 bp, Homo sapiens
accagccgcccagatcatgcc

SEQ ID NO: 5143343 - DNA, 17 bp, Homo sapiens
accagccgccccagccc

SEQ ID NO: 5143344 - DNA, 13 bp, Homo sapiens
accagccgctgca

SEQ ID NO: 5143345 - DNA, 19 bp, Homo sapiens
accagccgtgagcatgttt

SEQ ID NO: 5143346 - DNA, 22 bp, Homo sapiens
accagccgtgagcatgtttgga

SEQ ID NO: 5143347 - DNA, 18 bp, Homo sapiens
accagcctacaagctggc

SEQ ID NO: 5143348 - DNA, 13 bp, Homo sapiens
accagcctcagtg

SEQ ID NO: 5143349 - DNA, 19 bp, Homo sapiens
accagcctccatgctgcct

SEQ ID NO: 5143350 - DNA, 13 bp, Homo sapiens
accagcctcctgg

SEQ ID NO: 5143351 - DNA, 23 bp, Homo sapiens
accagcctctcttggtttccttc

SEQ ID NO: 5143352 - DNA, 13 bp, Homo sapiens
accagcctgacta

SEQ ID NO: 5143353 - DNA, 23 bp, Homo sapiens
accagcctgagccacagtggggc

SEQ ID NO: 5143354 - DNA, 12 bp, Homo sapiens
accagcctgcca

SEQ ID NO: 5143355 - DNA, 13 bp, Homo sapiens
accagcctgctga

SEQ ID NO: 5143356 - DNA, 15 bp, Homo sapiens
accagcctgctgaca

SEQ ID NO: 5143357 - DNA, 17 bp, Homo sapiens
accagcctgctgacaga

SEQ ID NO: 5143358 - DNA, 15 bp, Homo sapiens
accagcctggccaac

SEQ ID NO: 5143359 - DNA, 13 bp, Homo sapiens
accagcctggccc

SEQ ID NO: 5143360 - DNA, 14 bp, Homo sapiens
accagcctggggcc

SEQ ID NO: 5143361 - DNA, 14 bp, Homo sapiens
accagcctggtcaa

SEQ ID NO: 5143362 - DNA, 20 bp, Homo sapiens
accagcctggtgcccatcct

SEQ ID NO: 5143363 - DNA, 18 bp, Homo sapiens
accagcctgtcacccagc

SEQ ID NO: 5143364 - DNA, 20 bp, Homo sapiens
accagcctgtccaacatggt

SEQ ID NO: 5143365 - DNA, 22 bp, Homo sapiens
accagcctgtccaacatggtga

SEQ ID NO: 5143366 - DNA, 13 bp, Homo sapiens
accccctgcctgg

SEQ ID NO: 5143367 - DNA, 19 bp, Homo sapiens
accccctgctccaccagca

SEQ ID NO: 5143368 - DNA, 21 bp, Homo sapiens
accccctgctccaccagcagc

SEQ ID NO: 5143369 - DNA, 17 bp, Homo sapiens
accccctgctggtgccc

SEQ ID NO: 5143370 - DNA, 16 bp, Homo sapiens
accccctggccctgcc

SEQ ID NO: 5143371 - DNA, 13 bp, Homo sapiens
accccctggcttg

SEQ ID NO: 5143372 - DNA, 24 bp, Homo sapiens
accccctgtaaggttccatccacc

SEQ ID NO: 5143373 - DNA, 22 bp, Homo sapiens
accccctgtcccattctagatc

SEQ ID NO: 5143374 - DNA, 18 bp, Homo sapiens
accccctgttccctgttc

SEQ ID NO: 5143375 - DNA, 17 bp, Homo sapiens
acccccttaaatttaat

SEQ ID NO: 5143376 - DNA, 20 bp, Homo sapiens
acccccttcagtgcccacca

SEQ ID NO: 5143377 - DNA, 11 bp, Homo sapiens
acccccttccc

SEQ ID NO: 5143378 - DNA, 12 bp, Homo sapiens
acccccttcccc

SEQ ID NO: 5143379 - DNA, 23 bp, Homo sapiens
acccccttccccgctcttgccct

SEQ ID NO: 5143380 - DNA, 16 bp, Homo sapiens
acccccttccctggga

SEQ ID NO: 5143381 - DNA, 19 bp, Homo sapiens
acccccttctccatccaca

SEQ ID NO: 5143382 - DNA, 14 bp, Homo sapiens
acccccttctctgc

SEQ ID NO: 5143383 - DNA, 17 bp, Homo sapiens
acccccttctctgctcc

SEQ ID NO: 5143384 - DNA, 23 bp, Homo sapiens
acccccttctctgctccaccaca

SEQ ID NO: 5143385 - DNA, 14 bp, Homo sapiens
acccccttctgggc

SEQ ID NO: 5143386 - DNA, 17 bp, Homo sapiens
acccccttgcccaggcc

SEQ ID NO: 5143387 - DNA, 12 bp, Homo sapiens
accccctttcta

SEQ ID NO: 5143388 - DNA, 18 bp, Homo sapiens
accccgaaatcagccccc

SEQ ID NO: 5143389 - DNA, 16 bp, Homo sapiens
accccgacgccacagc

SEQ ID NO: 5143390 - DNA, 18 bp, Homo sapiens
accccgagaaccctgagc

SEQ ID NO: 5143391 - DNA, 16 bp, Homo sapiens
accccgaggccctgca

SEQ ID NO: 5143392 - DNA, 17 bp, Homo sapiens
accccgagggctgagga

SEQ ID NO: 5143393 - DNA, 20 bp, Homo sapiens
accccgagggctgaggagca

SEQ ID NO: 5143394 - DNA, 14 bp, Homo sapiens
accccgaggtaggg

SEQ ID NO: 5143395 - DNA, 22 bp, Homo sapiens
accccgaggtaggggtggggag

SEQ ID NO: 5143396 - DNA, 22 bp, Homo sapiens
accccgcaagcaccatcccctc

SEQ ID NO: 5143397 - DNA, 13 bp, Homo sapiens
accccgcactgca

SEQ ID NO: 5143398 - DNA, 17 bp, Homo sapiens
accccgcagacaccttg

SEQ ID NO: 5143399 - DNA, 13 bp, Homo sapiens
accccgcagcccg

SEQ ID NO: 5143400 - DNA, 21 bp, Homo sapiens
accccgcaggatccctcctga

SEQ ID NO: 5143401 - DNA, 22 bp, Homo sapiens
accccgcaggatccctcctgag

SEQ ID NO: 5143402 - DNA, 22 bp, Homo sapiens
accccgccagcctacactgcca

SEQ ID NO: 5143403 - DNA, 23 bp, Homo sapiens
accccgccccagtatcatgcgat

SEQ ID NO: 5143404 - DNA, 13 bp, Homo sapiens
accccgcccctgc

SEQ ID NO: 5143405 - DNA, 19 bp, Homo sapiens
accccgcccctgcatgcct

SEQ ID NO: 5143406 - DNA, 23 bp, Homo sapiens
accccgcctcccagccccagggg

SEQ ID NO: 5143407 - DNA, 14 bp, Homo sapiens
accccgcctgccct

SEQ ID NO: 5143408 - DNA, 15 bp, Homo sapiens
accccgcctgcctcc

SEQ ID NO: 5143409 - DNA, 16 bp, Homo sapiens
accccgcggcccagac

SEQ ID NO: 5143410 - DNA, 17 bp, Homo sapiens
accccgcggcccagacc

SEQ ID NO: 5143411 - DNA, 15 bp, Homo sapiens
accccgcggtgctct

SEQ ID NO: 5143412 - DNA, 21 bp, Homo sapiens
accccgcggtgctctggcggc

SEQ ID NO: 5143413 - DNA, 16 bp, Homo sapiens
accccgctcacgctga

SEQ ID NO: 5143414 - DNA, 14 bp, Homo sapiens
accccgctctgcat

SEQ ID NO: 5143415 - DNA, 16 bp, Homo sapiens
accccgctctgcatgc

SEQ ID NO: 5143416 - DNA, 18 bp, Homo sapiens
accccgctgatggagccc

SEQ ID NO: 5143417 - DNA, 23 bp, Homo sapiens
accccgctgatggagccccacct

SEQ ID NO: 5143418 - DNA, 20 bp, Homo sapiens
accccgcttttgcagcagag

SEQ ID NO: 5143419 - DNA, 14 bp, Homo sapiens
accccggatcgagg

SEQ ID NO: 5143420 - DNA, 19 bp, Homo sapiens
accccggatcgaggacaag

SEQ ID NO: 5143421 - DNA, 16 bp, Homo sapiens
accccggcaggccctg

SEQ ID NO: 5143422 - DNA, 17 bp, Homo sapiens
accccggcaggccctgc

SEQ ID NO: 5143423 - DNA, 15 bp, Homo sapiens
accccggccacctgc

SEQ ID NO: 5143424 - DNA, 16 bp, Homo sapiens
accccggcctcagggc

SEQ ID NO: 5143425 - DNA, 16 bp, Homo sapiens
accccgggatgcaagg

SEQ ID NO: 5143426 - DNA, 21 bp, Homo sapiens
accccgggcccgggcccccgc

SEQ ID NO: 5143427 - DNA, 23 bp, Homo sapiens
accccgggcccgggcccccgccc

SEQ ID NO: 5143428 - DNA, 13 bp, Homo sapiens
accccgggcgggt

SEQ ID NO: 5143429 - DNA, 13 bp, Homo sapiens
accccgggctctc

SEQ ID NO: 5143430 - DNA, 15 bp, Homo sapiens
accccgggctctctg

SEQ ID NO: 5143431 - DNA, 16 bp, Homo sapiens
accccgggctctctgc

SEQ ID NO: 5143432 - DNA, 15 bp, Homo sapiens
accccggggaccctg

SEQ ID NO: 5143433 - DNA, 22 bp, Homo sapiens
accccggggcatggacagggcc

SEQ ID NO: 5143434 - DNA, 23 bp, Homo sapiens
accccggggcatggacagggcca

SEQ ID NO: 5143435 - DNA, 24 bp, Homo sapiens
accccggggcatggacagggccag

SEQ ID NO: 5143436 - DNA, 14 bp, Homo sapiens
accccggtggcagt

SEQ ID NO: 5143437 - DNA, 19 bp, Homo sapiens
accccggtggcggccccag

SEQ ID NO: 5143438 - DNA, 14 bp, Homo sapiens
accccgtcaacaaa

SEQ ID NO: 5143439 - DNA, 13 bp, Homo sapiens
accccgtcccggc

SEQ ID NO: 5143440 - DNA, 15 bp, Homo sapiens
accccgtcccggccc

SEQ ID NO: 5143441 - DNA, 14 bp, Homo sapiens
accccgtccctcct

SEQ ID NO: 5143442 - DNA, 23 bp, Homo sapiens
accccgtctgccccttgacccca

SEQ ID NO: 5143443 - DNA, 22 bp, Homo sapiens
accccgtctggggttcagcccc

SEQ ID NO: 5143444 - DNA, 23 bp, Homo sapiens
accccgtctggggttcagcccct

SEQ ID NO: 5143445 - DNA, 17 bp, Homo sapiens
accccgtgaagcatcca

SEQ ID NO: 5143446 - DNA, 13 bp, Homo sapiens
accccgtggctct

SEQ ID NO: 5143447 - DNA, 14 bp, Homo sapiens
accccgtggctctg

SEQ ID NO: 5143448 - DNA, 17 bp, Homo sapiens
accccgtggctctggga

SEQ ID NO: 5143449 - DNA, 21 bp, Homo sapiens
accccgtgtccccggcctcag

SEQ ID NO: 5143450 - DNA, 17 bp, Homo sapiens
accccgttcccagcgca

SEQ ID NO: 5143451 - DNA, 15 bp, Homo sapiens
accccgttgttgtcc

SEQ ID NO: 5143452 - DNA, 22 bp, Homo sapiens
acccctaaaagaaaccctgcac

SEQ ID NO: 5143453 - DNA, 14 bp, Homo sapiens
acccctaaactcca

SEQ ID NO: 5143454 - DNA, 17 bp, Homo sapiens
acccctaacctggctta

SEQ ID NO: 5143455 - DNA, 15 bp, Homo sapiens
acccctaagactgcc

SEQ ID NO: 5143456 - DNA, 17 bp, Homo sapiens
acccctaagactgcctt

SEQ ID NO: 5143457 - DNA, 14 bp, Homo sapiens
acccctaagtgccc

SEQ ID NO: 5143458 - DNA, 20 bp, Homo sapiens
acccctaatcgccctgagct

SEQ ID NO: 5143459 - DNA, 18 bp, Homo sapiens
acccctacacacacactc

SEQ ID NO: 5143460 - DNA, 23 bp, Homo sapiens
acccctacacacacactccctgc

SEQ ID NO: 5143461 - DNA, 17 bp, Homo sapiens
acccctacacacaccca

SEQ ID NO: 5143462 - DNA, 17 bp, Homo sapiens
acccctacagcctgcac

SEQ ID NO: 5143463 - DNA, 24 bp, Homo sapiens
acccctacccccaaccctcagaca

SEQ ID NO: 5143464 - DNA, 21 bp, Homo sapiens
acccctaccccctcatccccc

SEQ ID NO: 5143465 - DNA, 20 bp, Homo sapiens
acccctaccgatggtcccag

SEQ ID NO: 5143466 - DNA, 23 bp, Homo sapiens
acccctaccgatggtcccaggaa

SEQ ID NO: 5143467 - DNA, 19 bp, Homo sapiens
acccctagaaaggagagaa

SEQ ID NO: 5143468 - DNA, 17 bp, Homo sapiens
acccctagagacagtga

SEQ ID NO: 5143469 - DNA, 13 bp, Homo sapiens
acccctagccctg

SEQ ID NO: 5143470 - DNA, 19 bp, Homo sapiens
acccctaggtcatttgtag

SEQ ID NO: 5143471 - DNA, 21 bp, Homo sapiens
acccctagttccctctgctca

SEQ ID NO: 5143472 - DNA, 17 bp, Homo sapiens
acccctatacctgagcc

SEQ ID NO: 5143473 - DNA, 20 bp, Homo sapiens
acccctcaacacctctgcac

SEQ ID NO: 5143474 - DNA, 16 bp, Homo sapiens
acccctcaagccagga

SEQ ID NO: 5143475 - DNA, 20 bp, Homo sapiens
acccctcaagccaggagacc

SEQ ID NO: 5143476 - DNA, 23 bp, Homo sapiens
acccctcaagccaggagaccctg

SEQ ID NO: 5143477 - DNA, 11 bp, Homo sapiens
acccctcacca

SEQ ID NO: 5143478 - DNA, 15 bp, Homo sapiens
acccctcaccacccc

SEQ ID NO: 5143479 - DNA, 15 bp, Homo sapiens
acccctcaccttgca

SEQ ID NO: 5143480 - DNA, 23 bp, Homo sapiens
acccctcaccttgcaacacacag

SEQ ID NO: 5143481 - DNA, 18 bp, Homo sapiens
acccctcactccccaggg

SEQ ID NO: 5143482 - DNA, 12 bp, Homo sapiens
acccctcagcgc

SEQ ID NO: 5143483 - DNA, 12 bp, Homo sapiens
acccctcagtgc

SEQ ID NO: 5143484 - DNA, 14 bp, Homo sapiens
acccctcagtgctc

SEQ ID NO: 5143485 - DNA, 20 bp, Homo sapiens
acccctcagtgctcggcagt

SEQ ID NO: 5143486 - DNA, 11 bp, Homo sapiens
acccctccacg

SEQ ID NO: 5143487 - DNA, 21 bp, Homo sapiens
acccctccacgtgtccgtcca

SEQ ID NO: 5143488 - DNA, 17 bp, Homo sapiens
acccctccactctttct

SEQ ID NO: 5143489 - DNA, 13 bp, Homo sapiens
acccctccactgc

SEQ ID NO: 5143490 - DNA, 22 bp, Homo sapiens
acccctccagttttgcctgaga

SEQ ID NO: 5143491 - DNA, 16 bp, Homo sapiens
acccctccatgtgggc

SEQ ID NO: 5143492 - DNA, 12 bp, Homo sapiens
acccctccccac

SEQ ID NO: 5143493 - DNA, 17 bp, Homo sapiens
acccctccccacccacc

SEQ ID NO: 5143494 - DNA, 13 bp, Homo sapiens
acccctccccact

SEQ ID NO: 5143495 - DNA, 12 bp, Homo sapiens
acccctcccctc

SEQ ID NO: 5143496 - DNA, 19 bp, Homo sapiens
acccctcccctccatccct

SEQ ID NO: 5143497 - DNA, 15 bp, Homo sapiens
acccctcccctggga

SEQ ID NO: 5143498 - DNA, 18 bp, Homo sapiens
acccctcccctgggactt

SEQ ID NO: 5143499 - DNA, 18 bp, Homo sapiens
acccctcccggccctgcc

SEQ ID NO: 5143500 - DNA, 19 bp, Homo sapiens
acccctcccggccctgcct

SEQ ID NO: 5143501 - DNA, 17 bp, Homo sapiens
acccctccctccctctt

SEQ ID NO: 5143502 - DNA, 18 bp, Homo sapiens
acccctccctccctcttt

SEQ ID NO: 5143503 - DNA, 16 bp, Homo sapiens
acccctccctctgctc

SEQ ID NO: 5143504 - DNA, 19 bp, Homo sapiens
acccctccctctgctctca

SEQ ID NO: 5143505 - DNA, 11 bp, Homo sapiens
acccctccctg

SEQ ID NO: 5143506 - DNA, 22 bp, Homo sapiens
acccctcccttgctcagtgcct

SEQ ID NO: 5143507 - DNA, 16 bp, Homo sapiens
acccctccctttctcc

SEQ ID NO: 5143508 - DNA, 19 bp, Homo sapiens
acccctccctttctcccct

SEQ ID NO: 5143509 - DNA, 23 bp, Homo sapiens
acccctccctttctcccctgccc

SEQ ID NO: 5143510 - DNA, 21 bp, Homo sapiens
acccctccgtgtggagcacgt

SEQ ID NO: 5143511 - DNA, 14 bp, Homo sapiens
acccctcctcactg

SEQ ID NO: 5143512 - DNA, 16 bp, Homo sapiens
acccctcctcactggc

SEQ ID NO: 5143513 - DNA, 18 bp, Homo sapiens
acccctcctcactggcca

SEQ ID NO: 5143514 - DNA, 13 bp, Homo sapiens
acccctcctccct

SEQ ID NO: 5143515 - DNA, 16 bp, Homo sapiens
acccctcctccctcag

SEQ ID NO: 5143516 - DNA, 15 bp, Homo sapiens
acccctcctcccttt

SEQ ID NO: 5143517 - DNA, 23 bp, Homo sapiens
acccctcctccctttttccttgt

SEQ ID NO: 5143518 - DNA, 17 bp, Homo sapiens
acccctcctccttgctg

SEQ ID NO: 5143519 - DNA, 18 bp, Homo sapiens
acccctcctctagctctg

SEQ ID NO: 5143520 - DNA, 12 bp, Homo sapiens
acccctcctggg

SEQ ID NO: 5143521 - DNA, 15 bp, Homo sapiens
acccctccttcccca

SEQ ID NO: 5143522 - DNA, 18 bp, Homo sapiens
acccctccttccccagac

SEQ ID NO: 5143523 - DNA, 16 bp, Homo sapiens
acccctccttccctgg

SEQ ID NO: 5143524 - DNA, 21 bp, Homo sapiens
acccctccttccttgaccagc

SEQ ID NO: 5143525 - DNA, 22 bp, Homo sapiens
acccctccttccttgaccagca

SEQ ID NO: 5143526 - DNA, 15 bp, Homo sapiens
acccctcgactcagc

SEQ ID NO: 5143527 - DNA, 18 bp, Homo sapiens
acccctcgactcagcacc

SEQ ID NO: 5143528 - DNA, 21 bp, Homo sapiens
acccctcgcaaccctgcctgt

SEQ ID NO: 5143529 - DNA, 14 bp, Homo sapiens
acccctcgcccagt

SEQ ID NO: 5143530 - DNA, 22 bp, Homo sapiens
acccctcgcccagtcccagcag

SEQ ID NO: 5143531 - DNA, 16 bp, Homo sapiens
acccctcgccccagcc

SEQ ID NO: 5143532 - DNA, 22 bp, Homo sapiens
acccctcgtccaccccccacac

SEQ ID NO: 5143533 - DNA, 14 bp, Homo sapiens
acccctctccaggc

SEQ ID NO: 5143534 - DNA, 20 bp, Homo sapiens
acccctctccaggcctgtca

SEQ ID NO: 5143535 - DNA, 18 bp, Homo sapiens
acccctctcgcctcatta

SEQ ID NO: 5143536 - DNA, 17 bp, Homo sapiens
acccctctgcccctgca

SEQ ID NO: 5143537 - DNA, 12 bp, Homo sapiens
acccctctggtg

SEQ ID NO: 5143538 - DNA, 23 bp, Homo sapiens
acccctcttagcttacaggaagc

SEQ ID NO: 5143539 - DNA, 12 bp, Homo sapiens
acccctcttcca

SEQ ID NO: 5143540 - DNA, 13 bp, Homo sapiens
acccctcttccag

SEQ ID NO: 5143541 - DNA, 13 bp, Homo sapiens
acccctcttcccc

SEQ ID NO: 5143542 - DNA, 19 bp, Homo sapiens
acccctcttcccccttccc

SEQ ID NO: 5143543 - DNA, 19 bp, Homo sapiens
acccctgaactggccccag

SEQ ID NO: 5143544 - DNA, 22 bp, Homo sapiens
acccctgacctaccccagccag

SEQ ID NO: 5143545 - DNA, 22 bp, Homo sapiens
accagccttcctgtgggcccct

SEQ ID NO: 5143546 - DNA, 18 bp, Homo sapiens
accagccttgctctcttc

SEQ ID NO: 5143547 - DNA, 19 bp, Homo sapiens
accagccttggtgccacca

SEQ ID NO: 5143548 - DNA, 16 bp, Homo sapiens
accagcctttctccca

SEQ ID NO: 5143549 - DNA, 22 bp, Homo sapiens
accagcctttctcccaggccag

SEQ ID NO: 5143550 - DNA, 13 bp, Homo sapiens
accagcctttggg

SEQ ID NO: 5143551 - DNA, 19 bp, Homo sapiens
accagcctttgggtcctgg

SEQ ID NO: 5143552 - DNA, 19 bp, Homo sapiens
accagcgaactctcagaaa

SEQ ID NO: 5143553 - DNA, 23 bp, Homo sapiens
accagcgaactctcagaaataaa

SEQ ID NO: 5143554 - DNA, 23 bp, Homo sapiens
accagcgcactgatggtcactgg

SEQ ID NO: 5143555 - DNA, 19 bp, Homo sapiens
accagcgcccccactcctc

SEQ ID NO: 5143556 - DNA, 14 bp, Homo sapiens
accagcgcccccag

SEQ ID NO: 5143557 - DNA, 14 bp, Homo sapiens
accagcgcccgctg

SEQ ID NO: 5143558 - DNA, 15 bp, Homo sapiens
accagcgcccgctgg

SEQ ID NO: 5143559 - DNA, 17 bp, Homo sapiens
accagcgcccgctgggc

SEQ ID NO: 5143560 - DNA, 18 bp, Homo sapiens
accagcgcccgctgggct

SEQ ID NO: 5143561 - DNA, 19 bp, Homo sapiens
accagcgcttgaagcctga

SEQ ID NO: 5143562 - DNA, 14 bp, Homo sapiens
accagcggaaacag

SEQ ID NO: 5143563 - DNA, 15 bp, Homo sapiens
accagcggctgctca

SEQ ID NO: 5143564 - DNA, 22 bp, Homo sapiens
accagcgtcctcgttcaaaaca

SEQ ID NO: 5143565 - DNA, 22 bp, Homo sapiens
accagcgtgtgactactccccc

SEQ ID NO: 5143566 - DNA, 23 bp, Homo sapiens
accagcgttcccttctccccctt

SEQ ID NO: 5143567 - DNA, 23 bp, Homo sapiens
accagctaagaaaagattttaat

SEQ ID NO: 5143568 - DNA, 17 bp, Homo sapiens
accagctagccagtcac

SEQ ID NO: 5143569 - DNA, 20 bp, Homo sapiens
accagctcagccccggccac

SEQ ID NO: 5143570 - DNA, 13 bp, Homo sapiens
accagctcaggac

SEQ ID NO: 5143571 - DNA, 15 bp, Homo sapiens
accagctcaggacag

SEQ ID NO: 5143572 - DNA, 15 bp, Homo sapiens
accagctccacacat

SEQ ID NO: 5143573 - DNA, 23 bp, Homo sapiens
accagctccacacattccagcca

SEQ ID NO: 5143574 - DNA, 14 bp, Homo sapiens
accagctccactgg

SEQ ID NO: 5143575 - DNA, 11 bp, Homo sapiens
accagctccca

SEQ ID NO: 5143576 - DNA, 12 bp, Homo sapiens
accagctcccag

SEQ ID NO: 5143577 - DNA, 13 bp, Homo sapiens
accagctcccagg

SEQ ID NO: 5143578 - DNA, 14 bp, Homo sapiens
accagctccccggg

SEQ ID NO: 5143579 - DNA, 15 bp, Homo sapiens
accagctcctccagc

SEQ ID NO: 5143580 - DNA, 18 bp, Homo sapiens
accagctcctccagccct

SEQ ID NO: 5143581 - DNA, 14 bp, Homo sapiens
accagctcctccct

SEQ ID NO: 5143582 - DNA, 12 bp, Homo sapiens
accagctctctt

SEQ ID NO: 5143583 - DNA, 15 bp, Homo sapiens
accagctctcttcct

SEQ ID NO: 5143584 - DNA, 20 bp, Homo sapiens
accagctctcttcctgtctt

SEQ ID NO: 5143585 - DNA, 22 bp, Homo sapiens
accagctctgccgtctctggag

SEQ ID NO: 5143586 - DNA, 12 bp, Homo sapiens
accagctctgtg

SEQ ID NO: 5143587 - DNA, 16 bp, Homo sapiens
accagctctgtggcct

SEQ ID NO: 5143588 - DNA, 18 bp, Homo sapiens
accagctctgtggcctgt

SEQ ID NO: 5143589 - DNA, 19 bp, Homo sapiens
accagctctgtggcctgtg

SEQ ID NO: 5143590 - DNA, 20 bp, Homo sapiens
accagctctgtggcctgtgt

SEQ ID NO: 5143591 - DNA, 23 bp, Homo sapiens
accagctgaagttgcagatgtta

SEQ ID NO: 5143592 - DNA, 11 bp, Homo sapiens
accagctgcaa

SEQ ID NO: 5143593 - DNA, 18 bp, Homo sapiens
accagctgcaaagtgttt

SEQ ID NO: 5143594 - DNA, 20 bp, Homo sapiens
accagctgcaaagtgttttg

SEQ ID NO: 5143595 - DNA, 13 bp, Homo sapiens
accagctgcagcc

SEQ ID NO: 5143596 - DNA, 11 bp, Homo sapiens
accagctgcta

SEQ ID NO: 5143597 - DNA, 16 bp, Homo sapiens
accagctgctctgccc

SEQ ID NO: 5143598 - DNA, 18 bp, Homo sapiens
accagctgctctgcccct

SEQ ID NO: 5143599 - DNA, 19 bp, Homo sapiens
accagctgctctgcccctt

SEQ ID NO: 5143600 - DNA, 13 bp, Homo sapiens
accagctgctgct

SEQ ID NO: 5143601 - DNA, 17 bp, Homo sapiens
accagctgctgctctga

SEQ ID NO: 5143602 - DNA, 18 bp, Homo sapiens
accagctggctctgcagc

SEQ ID NO: 5143603 - DNA, 10 bp, Homo sapiens
accagctggg

SEQ ID NO: 5143604 - DNA, 23 bp, Homo sapiens
accagctggggcgtggggagggc

SEQ ID NO: 5143605 - DNA, 17 bp, Homo sapiens
accagctgtaacacagc

SEQ ID NO: 5143606 - DNA, 13 bp, Homo sapiens
accagctgtgtcc

SEQ ID NO: 5143607 - DNA, 18 bp, Homo sapiens
accagctgtgtccggccc

SEQ ID NO: 5143608 - DNA, 16 bp, Homo sapiens
accagcttaaaacact

SEQ ID NO: 5143609 - DNA, 20 bp, Homo sapiens
accagcttagccaacatagt

SEQ ID NO: 5143610 - DNA, 18 bp, Homo sapiens
accagcttctccaggctc

SEQ ID NO: 5143611 - DNA, 22 bp, Homo sapiens
accagcttgtatgcaatggatt

SEQ ID NO: 5143612 - DNA, 19 bp, Homo sapiens
accagcttgttctgggctc

SEQ ID NO: 5143613 - DNA, 23 bp, Homo sapiens
accagcttgttctgggctcaggg

SEQ ID NO: 5143614 - DNA, 15 bp, Homo sapiens
accagcttttaacca

SEQ ID NO: 5143615 - DNA, 21 bp, Homo sapiens
accaggaaaggattttataat

SEQ ID NO: 5143616 - DNA, 22 bp, Homo sapiens
accaggaaattctgtttatgtt

SEQ ID NO: 5143617 - DNA, 23 bp, Homo sapiens
accaggaagaaggcccgggagga

SEQ ID NO: 5143618 - DNA, 16 bp, Homo sapiens
accaggaagcacaggt

SEQ ID NO: 5143619 - DNA, 14 bp, Homo sapiens
accaggaaggaaga

SEQ ID NO: 5143620 - DNA, 20 bp, Homo sapiens
accaggaaggaagagcaagc

SEQ ID NO: 5143621 - DNA, 16 bp, Homo sapiens
accaggaagtgtttat

SEQ ID NO: 5143622 - DNA, 15 bp, Homo sapiens
accaggacaggacca

SEQ ID NO: 5143623 - DNA, 16 bp, Homo sapiens
accaggacccagggag

SEQ ID NO: 5143624 - DNA, 16 bp, Homo sapiens
accaggaccctttctc

SEQ ID NO: 5143625 - DNA, 21 bp, Homo sapiens
accaggactccttgttctgct

SEQ ID NO: 5143626 - DNA, 15 bp, Homo sapiens
accaggactctgcct

SEQ ID NO: 5143627 - DNA, 21 bp, Homo sapiens
accaggactctgccttccagg

SEQ ID NO: 5143628 - DNA, 19 bp, Homo sapiens
accaggacttggggtcagg

SEQ ID NO: 5143629 - DNA, 18 bp, Homo sapiens
accaggagaaccactaca

SEQ ID NO: 5143630 - DNA, 19 bp, Homo sapiens
accaggagaaccactacat

SEQ ID NO: 5143631 - DNA, 21 bp, Homo sapiens
accaggagaagggctggggcc

SEQ ID NO: 5143632 - DNA, 18 bp, Homo sapiens
accaggagcacctggacc

SEQ ID NO: 5143633 - DNA, 20 bp, Homo sapiens
accaggagcacctggacccc

SEQ ID NO: 5143634 - DNA, 14 bp, Homo sapiens
accaggagcagcag

SEQ ID NO: 5143635 - DNA, 18 bp, Homo sapiens
accaggagcagcagccag

SEQ ID NO: 5143636 - DNA, 22 bp, Homo sapiens
accaggagcagcagccagcacc

SEQ ID NO: 5143637 - DNA, 12 bp, Homo sapiens
accaggagccag

SEQ ID NO: 5143638 - DNA, 15 bp, Homo sapiens
accaggagctagccc

SEQ ID NO: 5143639 - DNA, 20 bp, Homo sapiens
accaggagctgatggcagct

SEQ ID NO: 5143640 - DNA, 17 bp, Homo sapiens
accaggaggattgcctt

SEQ ID NO: 5143641 - DNA, 21 bp, Homo sapiens
accaggagggagagcctctgt

SEQ ID NO: 5143642 - DNA, 14 bp, Homo sapiens
accaggaggggtct

SEQ ID NO: 5143643 - DNA, 18 bp, Homo sapiens
accaggaggggtctgcct

SEQ ID NO: 5143644 - DNA, 20 bp, Homo sapiens
accaggaggggtctgcctcc

SEQ ID NO: 5143645 - DNA, 21 bp, Homo sapiens
accaggaggggtctgcctccc

SEQ ID NO: 5143646 - DNA, 22 bp, Homo sapiens
accaggagtccctggtaataag

SEQ ID NO: 5143647 - DNA, 16 bp, Homo sapiens
accaggagtgggtggg

SEQ ID NO: 5143648 - DNA, 18 bp, Homo sapiens
accaggatactggacgct

SEQ ID NO: 5143649 - DNA, 17 bp, Homo sapiens
accaggatagagactgg

SEQ ID NO: 5143650 - DNA, 19 bp, Homo sapiens
accaggcaacctcccatcc

SEQ ID NO: 5143651 - DNA, 18 bp, Homo sapiens
accaggcacatggctggg

SEQ ID NO: 5143652 - DNA, 19 bp, Homo sapiens
accaggcaccaaaagaagt

SEQ ID NO: 5143653 - DNA, 20 bp, Homo sapiens
accaggcaccaaaagaagta

SEQ ID NO: 5143654 - DNA, 17 bp, Homo sapiens
accaggcacctcttcct

SEQ ID NO: 5143655 - DNA, 20 bp, Homo sapiens
accaggcacgaacccacctg

SEQ ID NO: 5143656 - DNA, 21 bp, Homo sapiens
accaggcacgaacccacctgc

SEQ ID NO: 5143657 - DNA, 21 bp, Homo sapiens
accaggcagctgagaccaggg

SEQ ID NO: 5143658 - DNA, 12 bp, Homo sapiens
accaggccacct

SEQ ID NO: 5143659 - DNA, 16 bp, Homo sapiens
accaggccagctcagg

SEQ ID NO: 5143660 - DNA, 23 bp, Homo sapiens
accaggcccaaggagggtccagg

SEQ ID NO: 5143661 - DNA, 12 bp, Homo sapiens
accaggcccagc

SEQ ID NO: 5143662 - DNA, 13 bp, Homo sapiens
accaggcccagcc

SEQ ID NO: 5143663 - DNA, 14 bp, Homo sapiens
accaggcccagcca

SEQ ID NO: 5143664 - DNA, 18 bp, Homo sapiens
accaggcccagccagttg

SEQ ID NO: 5143665 - DNA, 13 bp, Homo sapiens
accaggccccagc

SEQ ID NO: 5143666 - DNA, 20 bp, Homo sapiens
accaggcccgcactgggggc

SEQ ID NO: 5143667 - DNA, 14 bp, Homo sapiens
accaggccctgctc

SEQ ID NO: 5143668 - DNA, 16 bp, Homo sapiens
accaggccgccccagc

SEQ ID NO: 5143669 - DNA, 16 bp, Homo sapiens
accaggcctcactggc

SEQ ID NO: 5143670 - DNA, 18 bp, Homo sapiens
accaggcctctgctgccg

SEQ ID NO: 5143671 - DNA, 14 bp, Homo sapiens
accaggcctggcct

SEQ ID NO: 5143672 - DNA, 20 bp, Homo sapiens
accaggcctggcctctgggc

SEQ ID NO: 5143673 - DNA, 22 bp, Homo sapiens
accaggcctggcctctgggcag

SEQ ID NO: 5143674 - DNA, 12 bp, Homo sapiens
accaggcctggg

SEQ ID NO: 5143675 - DNA, 21 bp, Homo sapiens
accaggccttcatcctcctcc

SEQ ID NO: 5143676 - DNA, 19 bp, Homo sapiens
accaggctacagttgatat

SEQ ID NO: 5143677 - DNA, 19 bp, Homo sapiens
accaggctcacaactgttt

SEQ ID NO: 5143678 - DNA, 14 bp, Homo sapiens
accaggctgcagcc

SEQ ID NO: 5143679 - DNA, 14 bp, Homo sapiens
accaggctgcaggt

SEQ ID NO: 5143680 - DNA, 17 bp, Homo sapiens
accaggctgcctccctt

SEQ ID NO: 5143681 - DNA, 22 bp, Homo sapiens
accaggctggacaccctctgcc

SEQ ID NO: 5143682 - DNA, 18 bp, Homo sapiens
accaggctggagtgcagt

SEQ ID NO: 5143683 - DNA, 19 bp, Homo sapiens
accaggctggcgcagccaa

SEQ ID NO: 5143684 - DNA, 20 bp, Homo sapiens
accaggctggcgcagccaag

SEQ ID NO: 5143685 - DNA, 23 bp, Homo sapiens
accaggctggcgcagccaaggcc

SEQ ID NO: 5143686 - DNA, 12 bp, Homo sapiens
accaggctgtgg

SEQ ID NO: 5143687 - DNA, 13 bp, Homo sapiens
accaggctgtgtc

SEQ ID NO: 5143688 - DNA, 18 bp, Homo sapiens
accaggcttgcctgcagg

SEQ ID NO: 5143689 - DNA, 12 bp, Homo sapiens
accagggaagtg

SEQ ID NO: 5143690 - DNA, 10 bp, Homo sapiens
accagggaca

SEQ ID NO: 5143691 - DNA, 15 bp, Homo sapiens
accagggagaggcct

SEQ ID NO: 5143692 - DNA, 19 bp, Homo sapiens
accagggagcttcctggct

SEQ ID NO: 5143693 - DNA, 16 bp, Homo sapiens
accagggaggagagga

SEQ ID NO: 5143694 - DNA, 18 bp, Homo sapiens
accagggatgctgggctg

SEQ ID NO: 5143695 - DNA, 20 bp, Homo sapiens
accagggatgctgggctggg

SEQ ID NO: 5143696 - DNA, 20 bp, Homo sapiens
accagggatgtctgttgaaa

SEQ ID NO: 5143697 - DNA, 16 bp, Homo sapiens
accagggattgtttct

SEQ ID NO: 5143698 - DNA, 18 bp, Homo sapiens
accagggattgtttctgt

SEQ ID NO: 5143699 - DNA, 10 bp, Homo sapiens
accagggcaa

SEQ ID NO: 5143700 - DNA, 16 bp, Homo sapiens
accagggcaaggcccc

SEQ ID NO: 5143701 - DNA, 22 bp, Homo sapiens
accagggcatctctgggctgga

SEQ ID NO: 5143702 - DNA, 23 bp, Homo sapiens
accagggcattcgggccacaggg

SEQ ID NO: 5143703 - DNA, 15 bp, Homo sapiens
accagggccagagca

SEQ ID NO: 5143704 - DNA, 17 bp, Homo sapiens
accagggccctgggcag

SEQ ID NO: 5143705 - DNA, 13 bp, Homo sapiens
accagggcctccc

SEQ ID NO: 5143706 - DNA, 15 bp, Homo sapiens
accagggcctccctg

SEQ ID NO: 5143707 - DNA, 22 bp, Homo sapiens
accagggcctccctgttcacgg

SEQ ID NO: 5143708 - DNA, 17 bp, Homo sapiens
accagggcctggctggg

SEQ ID NO: 5143709 - DNA, 23 bp, Homo sapiens
accagggcgaacgacaatagctt

SEQ ID NO: 5143710 - DNA, 13 bp, Homo sapiens
accagggctctgt

SEQ ID NO: 5143711 - DNA, 17 bp, Homo sapiens
accaggggaaggaagga

SEQ ID NO: 5143712 - DNA, 20 bp, Homo sapiens
accaggggaaggaaggaggg

SEQ ID NO: 5143713 - DNA, 15 bp, Homo sapiens
accaggggaggagcc

SEQ ID NO: 5143714 - DNA, 16 bp, Homo sapiens
accaggggcaggcaca

SEQ ID NO: 5143715 - DNA, 16 bp, Homo sapiens
accaggggccctacct

SEQ ID NO: 5143716 - DNA, 19 bp, Homo sapiens
accaggggctgggctccct

SEQ ID NO: 5143717 - DNA, 21 bp, Homo sapiens
accagggggaagcaccagcct

SEQ ID NO: 5143718 - DNA, 17 bp, Homo sapiens
accaggggtaccaggca

SEQ ID NO: 5143719 - DNA, 19 bp, Homo sapiens
accaggggtcctaaccact

SEQ ID NO: 5143720 - DNA, 22 bp, Homo sapiens
accaggggtgctcacctctgcc

SEQ ID NO: 5143721 - DNA, 16 bp, Homo sapiens
accagggtcccaggaa

SEQ ID NO: 5143722 - DNA, 17 bp, Homo sapiens
accagggtcccaggaag

SEQ ID NO: 5143723 - DNA, 17 bp, Homo sapiens
acccctgagccagcagg

SEQ ID NO: 5143724 - DNA, 13 bp, Homo sapiens
acccctgcacaca

SEQ ID NO: 5143725 - DNA, 14 bp, Homo sapiens
acccctgcacacac

SEQ ID NO: 5143726 - DNA, 22 bp, Homo sapiens
acccctgcacacacctgcacac

SEQ ID NO: 5143727 - DNA, 12 bp, Homo sapiens
acccctgcacca

SEQ ID NO: 5143728 - DNA, 18 bp, Homo sapiens
acccctgcagctcctctg

SEQ ID NO: 5143729 - DNA, 22 bp, Homo sapiens
acccctgcagttcccctggaag

SEQ ID NO: 5143730 - DNA, 14 bp, Homo sapiens
acccctgccactca

SEQ ID NO: 5143731 - DNA, 22 bp, Homo sapiens
acccctgccactcacccttcct

SEQ ID NO: 5143732 - DNA, 17 bp, Homo sapiens
acccctgcccaagtggc

SEQ ID NO: 5143733 - DNA, 20 bp, Homo sapiens
acccctgcccccagccccgg

SEQ ID NO: 5143734 - DNA, 15 bp, Homo sapiens
acccctgcccccagg

SEQ ID NO: 5143735 - DNA, 12 bp, Homo sapiens
acccctgccccg

SEQ ID NO: 5143736 - DNA, 21 bp, Homo sapiens
acccctgccccgttgcttccc

SEQ ID NO: 5143737 - DNA, 12 bp, Homo sapiens
acccctgcccct

SEQ ID NO: 5143738 - DNA, 14 bp, Homo sapiens
acccctgcccctgt

SEQ ID NO: 5143739 - DNA, 13 bp, Homo sapiens
acccctgccctcg

SEQ ID NO: 5143740 - DNA, 15 bp, Homo sapiens
acccctgccctcggc

SEQ ID NO: 5143741 - DNA, 12 bp, Homo sapiens
acccctgccctg

SEQ ID NO: 5143742 - DNA, 14 bp, Homo sapiens
acccctgccctgct

SEQ ID NO: 5143743 - DNA, 13 bp, Homo sapiens
acccctgccctgg

SEQ ID NO: 5143744 - DNA, 13 bp, Homo sapiens
acccctgccggcc

SEQ ID NO: 5143745 - DNA, 19 bp, Homo sapiens
acccctgccggccttggcc

SEQ ID NO: 5143746 - DNA, 12 bp, Homo sapiens
acccctgcctcc

SEQ ID NO: 5143747 - DNA, 14 bp, Homo sapiens
acccctgcctccac

SEQ ID NO: 5143748 - DNA, 19 bp, Homo sapiens
acccctgcctccaccctct

SEQ ID NO: 5143749 - DNA, 21 bp, Homo sapiens
acccctgcctccaccctctga

SEQ ID NO: 5143750 - DNA, 20 bp, Homo sapiens
acccctgcctcctgcctccc

SEQ ID NO: 5143751 - DNA, 15 bp, Homo sapiens
acccctgcctcgagg

SEQ ID NO: 5143752 - DNA, 16 bp, Homo sapiens
acccctgcctcgaggg

SEQ ID NO: 5143753 - DNA, 22 bp, Homo sapiens
acccctgcctcgagggccgcct

SEQ ID NO: 5143754 - DNA, 12 bp, Homo sapiens
acccctgcctgg

SEQ ID NO: 5143755 - DNA, 22 bp, Homo sapiens
acccctgcctggatttcttcct

SEQ ID NO: 5143756 - DNA, 17 bp, Homo sapiens
acccctgcgtcgagctg

SEQ ID NO: 5143757 - DNA, 19 bp, Homo sapiens
acccctgcgtcgagctggg

SEQ ID NO: 5143758 - DNA, 20 bp, Homo sapiens
acccctgcgtcgagctggga

SEQ ID NO: 5143759 - DNA, 9 bp, Homo sapiens
acccctgct

SEQ ID NO: 5143760 - DNA, 23 bp, Homo sapiens
acccctgctcccagcctgctgag

SEQ ID NO: 5143761 - DNA, 23 bp, Homo sapiens
acccctgctcccattcctccctc

SEQ ID NO: 5143762 - DNA, 12 bp, Homo sapiens
acccctggaaga

SEQ ID NO: 5143763 - DNA, 18 bp, Homo sapiens
acccctggaagagcccag

SEQ ID NO: 5143764 - DNA, 19 bp, Homo sapiens
acccctggaagagcccagt

SEQ ID NO: 5143765 - DNA, 15 bp, Homo sapiens
acccctggaccccag

SEQ ID NO: 5143766 - DNA, 11 bp, Homo sapiens
acccctggcca

SEQ ID NO: 5143767 - DNA, 12 bp, Homo sapiens
acccctggccac

SEQ ID NO: 5143768 - DNA, 21 bp, Homo sapiens
acccctggccagctctgaggg

SEQ ID NO: 5143769 - DNA, 13 bp, Homo sapiens
acccctggccggc

SEQ ID NO: 5143770 - DNA, 22 bp, Homo sapiens
acccctggctaccttgtgggaa

SEQ ID NO: 5143771 - DNA, 19 bp, Homo sapiens
acccctggctccaggccag

SEQ ID NO: 5143772 - DNA, 20 bp, Homo sapiens
acccctggctccaggccagg

SEQ ID NO: 5143773 - DNA, 22 bp, Homo sapiens
acccctggctccaggccagggg

SEQ ID NO: 5143774 - DNA, 13 bp, Homo sapiens
acccctggctcct

SEQ ID NO: 5143775 - DNA, 11 bp, Homo sapiens
acccctggctg

SEQ ID NO: 5143776 - DNA, 23 bp, Homo sapiens
acccctggctgaacagtgctctg

SEQ ID NO: 5143777 - DNA, 13 bp, Homo sapiens
acccctggctggt

SEQ ID NO: 5143778 - DNA, 21 bp, Homo sapiens
acccctggctgtactgctcag

SEQ ID NO: 5143779 - DNA, 12 bp, Homo sapiens
acccctgggcag

SEQ ID NO: 5143780 - DNA, 13 bp, Homo sapiens
acccctgggcagg

SEQ ID NO: 5143781 - DNA, 14 bp, Homo sapiens
acccctgggcctca

SEQ ID NO: 5143782 - DNA, 20 bp, Homo sapiens
acccctgggcctcatcacag

SEQ ID NO: 5143783 - DNA, 13 bp, Homo sapiens
acccctgggggag

SEQ ID NO: 5143784 - DNA, 20 bp, Homo sapiens
acccctgggggaggcttcca

SEQ ID NO: 5143785 - DNA, 17 bp, Homo sapiens
acccctgggggctctca

SEQ ID NO: 5143786 - DNA, 19 bp, Homo sapiens
acccctggggtggccaggg

SEQ ID NO: 5143787 - DNA, 23 bp, Homo sapiens
acccctggggtggccagggcttc

SEQ ID NO: 5143788 - DNA, 19 bp, Homo sapiens
acccctggtggctgcaggc

SEQ ID NO: 5143789 - DNA, 16 bp, Homo sapiens
acccctggtggttcac

SEQ ID NO: 5143790 - DNA, 14 bp, Homo sapiens
acccctggttctca

SEQ ID NO: 5143791 - DNA, 24 bp, Homo sapiens
acccctgtaaggggccagagcctt

SEQ ID NO: 5143792 - DNA, 17 bp, Homo sapiens
acccctgtacccagcca

SEQ ID NO: 5143793 - DNA, 21 bp, Homo sapiens
acccctgtagggaaaccttgg

SEQ ID NO: 5143794 - DNA, 22 bp, Homo sapiens
acccctgtccagcgcggctccc

SEQ ID NO: 5143795 - DNA, 11 bp, Homo sapiens
acccctgtccc

SEQ ID NO: 5143796 - DNA, 22 bp, Homo sapiens
acccctgtcccatgcaggccct

SEQ ID NO: 5143797 - DNA, 17 bp, Homo sapiens
acccctgtcctcactgc

SEQ ID NO: 5143798 - DNA, 21 bp, Homo sapiens
acccctgtcctcactgctccc

SEQ ID NO: 5143799 - DNA, 18 bp, Homo sapiens
acccctgtcctggggctg

SEQ ID NO: 5143800 - DNA, 22 bp, Homo sapiens
acccctgtgctccgtgcctcca

SEQ ID NO: 5143801 - DNA, 20 bp, Homo sapiens
accccttaagccctggcccc

SEQ ID NO: 5143802 - DNA, 17 bp, Homo sapiens
accccttaatcttgctt

SEQ ID NO: 5143803 - DNA, 18 bp, Homo sapiens
accccttaatcttgcttt

SEQ ID NO: 5143804 - DNA, 23 bp, Homo sapiens
accccttaccccaaagagaaaga

SEQ ID NO: 5143805 - DNA, 16 bp, Homo sapiens
accccttacttagcat

SEQ ID NO: 5143806 - DNA, 15 bp, Homo sapiens
accccttagcctccc

SEQ ID NO: 5143807 - DNA, 17 bp, Homo sapiens
accccttatcctgagca

SEQ ID NO: 5143808 - DNA, 20 bp, Homo sapiens
accccttattgctgccaaaa

SEQ ID NO: 5143809 - DNA, 22 bp, Homo sapiens
accccttcataccgcctcgtgc

SEQ ID NO: 5143810 - DNA, 13 bp, Homo sapiens
accccttcatgtc

SEQ ID NO: 5143811 - DNA, 16 bp, Homo sapiens
accccttccagaagca

SEQ ID NO: 5143812 - DNA, 15 bp, Homo sapiens
accccttccagatca

SEQ ID NO: 5143813 - DNA, 20 bp, Homo sapiens
accccttccagatcactgcc

SEQ ID NO: 5143814 - DNA, 11 bp, Homo sapiens
accccttccca

SEQ ID NO: 5143815 - DNA, 13 bp, Homo sapiens
accccttcccacg

SEQ ID NO: 5143816 - DNA, 17 bp, Homo sapiens
accccttcccattccat

SEQ ID NO: 5143817 - DNA, 15 bp, Homo sapiens
accccttccccactg

SEQ ID NO: 5143818 - DNA, 13 bp, Homo sapiens
accccttccccag

SEQ ID NO: 5143819 - DNA, 15 bp, Homo sapiens
accccttccccaggc

SEQ ID NO: 5143820 - DNA, 20 bp, Homo sapiens
accccttccccatttcctct

SEQ ID NO: 5143821 - DNA, 19 bp, Homo sapiens
accccttcctccccacact

SEQ ID NO: 5143822 - DNA, 15 bp, Homo sapiens
accccttcctgggca

SEQ ID NO: 5143823 - DNA, 13 bp, Homo sapiens
accccttcctgtc

SEQ ID NO: 5143824 - DNA, 17 bp, Homo sapiens
accccttcctgtcctgc

SEQ ID NO: 5143825 - DNA, 19 bp, Homo sapiens
accccttcctgtcctgcct

SEQ ID NO: 5143826 - DNA, 20 bp, Homo sapiens
accccttcctgtcctgcctc

SEQ ID NO: 5143827 - DNA, 21 bp, Homo sapiens
accccttcctgtcctgcctcc

SEQ ID NO: 5143828 - DNA, 15 bp, Homo sapiens
accccttcctgtctg

SEQ ID NO: 5143829 - DNA, 19 bp, Homo sapiens
accccttcctgtctggccc

SEQ ID NO: 5143830 - DNA, 24 bp, Homo sapiens
accccttcctttcctctgcagcac

SEQ ID NO: 5143831 - DNA, 20 bp, Homo sapiens
accccttcgacatgctgcca

SEQ ID NO: 5143832 - DNA, 15 bp, Homo sapiens
accccttcgctcctg

SEQ ID NO: 5143833 - DNA, 20 bp, Homo sapiens
accccttcgctcctgtgtct

SEQ ID NO: 5143834 - DNA, 12 bp, Homo sapiens
accccttcgtgg

SEQ ID NO: 5143835 - DNA, 17 bp, Homo sapiens
accccttctctcctccc

SEQ ID NO: 5143836 - DNA, 17 bp, Homo sapiens
accccttctctctccag

SEQ ID NO: 5143837 - DNA, 18 bp, Homo sapiens
accccttctctgtgaccc

SEQ ID NO: 5143838 - DNA, 16 bp, Homo sapiens
accccttgaagccttt

SEQ ID NO: 5143839 - DNA, 18 bp, Homo sapiens
accccttgctctctgttc

SEQ ID NO: 5143840 - DNA, 21 bp, Homo sapiens
accccttggaaatgtctgctg

SEQ ID NO: 5143841 - DNA, 16 bp, Homo sapiens
accccttggcccctca

SEQ ID NO: 5143842 - DNA, 23 bp, Homo sapiens
accccttggcttttgcttggcag

SEQ ID NO: 5143843 - DNA, 21 bp, Homo sapiens
accccttgtcgcccctccctc

SEQ ID NO: 5143844 - DNA, 21 bp, Homo sapiens
accccttgttgcactgccccc

SEQ ID NO: 5143845 - DNA, 23 bp, Homo sapiens
accccttgttgcactgccccctg

SEQ ID NO: 5143846 - DNA, 14 bp, Homo sapiens
accccttgtttctg

SEQ ID NO: 5143847 - DNA, 18 bp, Homo sapiens
accccttgtttctgttgt

SEQ ID NO: 5143848 - DNA, 12 bp, Homo sapiens
acccctttcccc

SEQ ID NO: 5143849 - DNA, 13 bp, Homo sapiens
acccctttccccc

SEQ ID NO: 5143850 - DNA, 16 bp, Homo sapiens
acccctttcccccacc

SEQ ID NO: 5143851 - DNA, 22 bp, Homo sapiens
acccctttcccccaccccagag

SEQ ID NO: 5143852 - DNA, 12 bp, Homo sapiens
acccctttcctc

SEQ ID NO: 5143853 - DNA, 12 bp, Homo sapiens
acccctttcctg

SEQ ID NO: 5143854 - DNA, 14 bp, Homo sapiens
acccctttctccag

SEQ ID NO: 5143855 - DNA, 18 bp, Homo sapiens
acccctttctccagccct

SEQ ID NO: 5143856 - DNA, 19 bp, Homo sapiens
acccctttctccagccctg

SEQ ID NO: 5143857 - DNA, 17 bp, Homo sapiens
acccctttctggctctc

SEQ ID NO: 5143858 - DNA, 21 bp, Homo sapiens
acccctttcttctcgggccac

SEQ ID NO: 5143859 - DNA, 17 bp, Homo sapiens
acccctttggcacaccc

SEQ ID NO: 5143860 - DNA, 23 bp, Homo sapiens
accccttttcagcttctgctggg

SEQ ID NO: 5143861 - DNA, 18 bp, Homo sapiens
acccgaaagcatcactgc

SEQ ID NO: 5143862 - DNA, 16 bp, Homo sapiens
acccgaagtcctgtca

SEQ ID NO: 5143863 - DNA, 20 bp, Homo sapiens
acccgaagtcctgtcactga

SEQ ID NO: 5143864 - DNA, 21 bp, Homo sapiens
acccgacagagggaagaaaag

SEQ ID NO: 5143865 - DNA, 21 bp, Homo sapiens
acccgaccccccgtgggctcc

SEQ ID NO: 5143866 - DNA, 12 bp, Homo sapiens
acccgacctggc

SEQ ID NO: 5143867 - DNA, 19 bp, Homo sapiens
acccgacctggctgcccct

SEQ ID NO: 5143868 - DNA, 14 bp, Homo sapiens
acccgacttctttt

SEQ ID NO: 5143869 - DNA, 23 bp, Homo sapiens
acccgagcccagctacattcctc

SEQ ID NO: 5143870 - DNA, 19 bp, Homo sapiens
acccgaggatttctgggac

SEQ ID NO: 5143871 - DNA, 14 bp, Homo sapiens
acccgaggcccgca

SEQ ID NO: 5143872 - DNA, 14 bp, Homo sapiens
acccgaggctgccc

SEQ ID NO: 5143873 - DNA, 15 bp, Homo sapiens
acccgaggctgccca

SEQ ID NO: 5143874 - DNA, 24 bp, Homo sapiens
acccgaggctgcccactatggtca

SEQ ID NO: 5143875 - DNA, 21 bp, Homo sapiens
acccgagtcattcgttctgtg

SEQ ID NO: 5143876 - DNA, 19 bp, Homo sapiens
acccgagttcctctgggtt

SEQ ID NO: 5143877 - DNA, 12 bp, Homo sapiens
acccgatgctgc

SEQ ID NO: 5143878 - DNA, 23 bp, Homo sapiens
acccgatgctgctttcccctgtg

SEQ ID NO: 5143879 - DNA, 23 bp, Homo sapiens
acccgcagcgcccccatctgtct

SEQ ID NO: 5143880 - DNA, 13 bp, Homo sapiens
acccgccccagag

SEQ ID NO: 5143881 - DNA, 15 bp, Homo sapiens
acccgccccagagac

SEQ ID NO: 5143882 - DNA, 23 bp, Homo sapiens
acccgccccagagactgcccacc

SEQ ID NO: 5143883 - DNA, 23 bp, Homo sapiens
acccgccccgccccctccctgct

SEQ ID NO: 5143884 - DNA, 17 bp, Homo sapiens
acccgcccgcccccgcc

SEQ ID NO: 5143885 - DNA, 20 bp, Homo sapiens
acccgcccgcgtccaacccc

SEQ ID NO: 5143886 - DNA, 15 bp, Homo sapiens
acccgccctcagggg

SEQ ID NO: 5143887 - DNA, 22 bp, Homo sapiens
acccgccgccactaggtgtccc

SEQ ID NO: 5143888 - DNA, 16 bp, Homo sapiens
acccgccgcctcccac

SEQ ID NO: 5143889 - DNA, 15 bp, Homo sapiens
acccgccggatgaca

SEQ ID NO: 5143890 - DNA, 21 bp, Homo sapiens
acccgcctcgacctccccacc

SEQ ID NO: 5143891 - DNA, 21 bp, Homo sapiens
acccgcctctcccgtcagggc

SEQ ID NO: 5143892 - DNA, 15 bp, Homo sapiens
acccgccttcagcct

SEQ ID NO: 5143893 - DNA, 16 bp, Homo sapiens
acccgccttggcctcc

SEQ ID NO: 5143894 - DNA, 17 bp, Homo sapiens
acccgccttggcctccc

SEQ ID NO: 5143895 - DNA, 20 bp, Homo sapiens
acccgccttggcctcccaaa

SEQ ID NO: 5143896 - DNA, 16 bp, Homo sapiens
acccgccttttataaa

SEQ ID NO: 5143897 - DNA, 13 bp, Homo sapiens
acccgctctggac

SEQ ID NO: 5143898 - DNA, 13 bp, Homo sapiens
acccgctgcccag

SEQ ID NO: 5143899 - DNA, 14 bp, Homo sapiens
acccgctgcccagc

SEQ ID NO: 5143900 - DNA, 15 bp, Homo sapiens
acccgctgcccagcc

SEQ ID NO: 5143901 - DNA, 13 bp, Homo sapiens
acccgctgcccct

SEQ ID NO: 5143902 - DNA, 23 bp, Homo sapiens
accagggtccgcaccagctgctc

SEQ ID NO: 5143903 - DNA, 15 bp, Homo sapiens
accagggtctctcag

SEQ ID NO: 5143904 - DNA, 18 bp, Homo sapiens
accagggtctctcaggga

SEQ ID NO: 5143905 - DNA, 22 bp, Homo sapiens
accagggtggaccaggcctgga

SEQ ID NO: 5143906 - DNA, 19 bp, Homo sapiens
accagggtggccacacagg

SEQ ID NO: 5143907 - DNA, 15 bp, Homo sapiens
accagggtttatctt

SEQ ID NO: 5143908 - DNA, 22 bp, Homo sapiens
accaggtcaccatcctcagagg

SEQ ID NO: 5143909 - DNA, 20 bp, Homo sapiens
accaggtccattttgcctga

SEQ ID NO: 5143910 - DNA, 18 bp, Homo sapiens
accaggtcctgctccgct

SEQ ID NO: 5143911 - DNA, 23 bp, Homo sapiens
accaggtcctgctccgctgcctg

SEQ ID NO: 5143912 - DNA, 19 bp, Homo sapiens
accaggtcctgtgagcaaa

SEQ ID NO: 5143913 - DNA, 23 bp, Homo sapiens
accaggtcctgtgagcaaagtgc

SEQ ID NO: 5143914 - DNA, 12 bp, Homo sapiens
accaggtcttgt

SEQ ID NO: 5143915 - DNA, 15 bp, Homo sapiens
accaggtgcatgcat

SEQ ID NO: 5143916 - DNA, 17 bp, Homo sapiens
accaggtgcctttcaaa

SEQ ID NO: 5143917 - DNA, 22 bp, Homo sapiens
accaggtgcctttcaaatttag

SEQ ID NO: 5143918 - DNA, 22 bp, Homo sapiens
accaggtgggagcgttttgttg

SEQ ID NO: 5143919 - DNA, 18 bp, Homo sapiens
accaggtgtctagaggca

SEQ ID NO: 5143920 - DNA, 14 bp, Homo sapiens
accaggttaaaatt

SEQ ID NO: 5143921 - DNA, 16 bp, Homo sapiens
accaggtttcattttg

SEQ ID NO: 5143922 - DNA, 16 bp, Homo sapiens
accaggtttgggatgg

SEQ ID NO: 5143923 - DNA, 17 bp, Homo sapiens
accagtaaagtgtaaca

SEQ ID NO: 5143924 - DNA, 19 bp, Homo sapiens
accagtaaagtgtaacata

SEQ ID NO: 5143925 - DNA, 18 bp, Homo sapiens
accagtacctctgtatag

SEQ ID NO: 5143926 - DNA, 14 bp, Homo sapiens
accagtacttctaa

SEQ ID NO: 5143927 - DNA, 16 bp, Homo sapiens
accagtacttctaaga

SEQ ID NO: 5143928 - DNA, 18 bp, Homo sapiens
accagtagtcacctctgg

SEQ ID NO: 5143929 - DNA, 12 bp, Homo sapiens
accagtagtgac

SEQ ID NO: 5143930 - DNA, 15 bp, Homo sapiens
accagtagtgaccaa

SEQ ID NO: 5143931 - DNA, 16 bp, Homo sapiens
accagtataaaattac

SEQ ID NO: 5143932 - DNA, 18 bp, Homo sapiens
accagtatacaagataag

SEQ ID NO: 5143933 - DNA, 20 bp, Homo sapiens
accagtatcgctcatagatc

SEQ ID NO: 5143934 - DNA, 15 bp, Homo sapiens
accagtatggaaggg

SEQ ID NO: 5143935 - DNA, 17 bp, Homo sapiens
accagtatggaagggag

SEQ ID NO: 5143936 - DNA, 18 bp, Homo sapiens
accagtatggaagggagg

SEQ ID NO: 5143937 - DNA, 17 bp, Homo sapiens
accagtatttaagcttt

SEQ ID NO: 5143938 - DNA, 18 bp, Homo sapiens
accagtatttttgctgct

SEQ ID NO: 5143939 - DNA, 23 bp, Homo sapiens
accagtatttttgctgcttctga

SEQ ID NO: 5143940 - DNA, 21 bp, Homo sapiens
accagtcacacattatagaaa

SEQ ID NO: 5143941 - DNA, 20 bp, Homo sapiens
accagtcacctcctgctcct

SEQ ID NO: 5143942 - DNA, 14 bp, Homo sapiens
accagtcatttttc

SEQ ID NO: 5143943 - DNA, 15 bp, Homo sapiens
accagtcatttttca

SEQ ID NO: 5143944 - DNA, 9 bp, Homo sapiens
accagtccc

SEQ ID NO: 5143945 - DNA, 17 bp, Homo sapiens
accagtcccatgctggc

SEQ ID NO: 5143946 - DNA, 12 bp, Homo sapiens
accagtccctgt

SEQ ID NO: 5143947 - DNA, 18 bp, Homo sapiens
accagtcctatttttcaa

SEQ ID NO: 5143948 - DNA, 14 bp, Homo sapiens
accagtcctgctgc

SEQ ID NO: 5143949 - DNA, 16 bp, Homo sapiens
accagtcctgctgcct

SEQ ID NO: 5143950 - DNA, 20 bp, Homo sapiens
accagtcgccctctgtgcct

SEQ ID NO: 5143951 - DNA, 23 bp, Homo sapiens
accagtcgccctctgtgcctaat

SEQ ID NO: 5143952 - DNA, 14 bp, Homo sapiens
accagtctcctcac

SEQ ID NO: 5143953 - DNA, 19 bp, Homo sapiens
accagtctcctcactctgt

SEQ ID NO: 5143954 - DNA, 14 bp, Homo sapiens
accagtctcctccc

SEQ ID NO: 5143955 - DNA, 14 bp, Homo sapiens
accagtctctcaag

SEQ ID NO: 5143956 - DNA, 14 bp, Homo sapiens
accagtctgaagtt

SEQ ID NO: 5143957 - DNA, 19 bp, Homo sapiens
accagtctgaagtttcatt

SEQ ID NO: 5143958 - DNA, 14 bp, Homo sapiens
accagtctgaccct

SEQ ID NO: 5143959 - DNA, 16 bp, Homo sapiens
accagtcttctccctg

SEQ ID NO: 5143960 - DNA, 13 bp, Homo sapiens
accagtgaaagaa

SEQ ID NO: 5143961 - DNA, 16 bp, Homo sapiens
accagtgaaccaaaga

SEQ ID NO: 5143962 - DNA, 23 bp, Homo sapiens
accagtgaacttttttttttaat

SEQ ID NO: 5143963 - DNA, 17 bp, Homo sapiens
accagtgaatttttgca

SEQ ID NO: 5143964 - DNA, 16 bp, Homo sapiens
accagtgacgctgctg

SEQ ID NO: 5143965 - DNA, 22 bp, Homo sapiens
accagtgagaactctctccctg

SEQ ID NO: 5143966 - DNA, 15 bp, Homo sapiens
accagtgagacagcc

SEQ ID NO: 5143967 - DNA, 13 bp, Homo sapiens
accagtgcaagca

SEQ ID NO: 5143968 - DNA, 14 bp, Homo sapiens
accagtgcaggctg

SEQ ID NO: 5143969 - DNA, 15 bp, Homo sapiens
accagtgcaggctgg

SEQ ID NO: 5143970 - DNA, 20 bp, Homo sapiens
accagtgcaggctggccagc

SEQ ID NO: 5143971 - DNA, 15 bp, Homo sapiens
accagtgccaaggac

SEQ ID NO: 5143972 - DNA, 23 bp, Homo sapiens
accagtgcccaaagtctgtgtga

SEQ ID NO: 5143973 - DNA, 14 bp, Homo sapiens
accagtgccgcctg

SEQ ID NO: 5143974 - DNA, 10 bp, Homo sapiens
accagtgcct

SEQ ID NO: 5143975 - DNA, 23 bp, Homo sapiens
accagtgcctctccctgctgctc

SEQ ID NO: 5143976 - DNA, 20 bp, Homo sapiens
accagtggacctagcctgga

SEQ ID NO: 5143977 - DNA, 13 bp, Homo sapiens
accagtggccttt

SEQ ID NO: 5143978 - DNA, 23 bp, Homo sapiens
accagtgggatgggctctacctc

SEQ ID NO: 5143979 - DNA, 16 bp, Homo sapiens
accagtgggcatgtat

SEQ ID NO: 5143980 - DNA, 17 bp, Homo sapiens
accagtggtctcacatg

SEQ ID NO: 5143981 - DNA, 14 bp, Homo sapiens
accagtggtgctca

SEQ ID NO: 5143982 - DNA, 17 bp, Homo sapiens
accagtgtaaattcagt

SEQ ID NO: 5143983 - DNA, 23 bp, Homo sapiens
accagtgtaaattcagtcttttc

SEQ ID NO: 5143984 - DNA, 18 bp, Homo sapiens
accagtgtaactggctgc

SEQ ID NO: 5143985 - DNA, 12 bp, Homo sapiens
accagtgtacag

SEQ ID NO: 5143986 - DNA, 14 bp, Homo sapiens
accagtgtacaggt

SEQ ID NO: 5143987 - DNA, 16 bp, Homo sapiens
accagtgtactgcttt

SEQ ID NO: 5143988 - DNA, 23 bp, Homo sapiens
accagtgtagcatcttcctctgc

SEQ ID NO: 5143989 - DNA, 22 bp, Homo sapiens
accagtgtatcaggtcagggac

SEQ ID NO: 5143990 - DNA, 18 bp, Homo sapiens
accagtgtcctccaagtg

SEQ ID NO: 5143991 - DNA, 19 bp, Homo sapiens
accagtgtcctccaagtgc

SEQ ID NO: 5143992 - DNA, 21 bp, Homo sapiens
accagtgtggtttgtgtttga

SEQ ID NO: 5143993 - DNA, 23 bp, Homo sapiens
accagtgtgtggctttcagagcc

SEQ ID NO: 5143994 - DNA, 15 bp, Homo sapiens
accagtgtgtggggg

SEQ ID NO: 5143995 - DNA, 15 bp, Homo sapiens
accagtgttcctgaa

SEQ ID NO: 5143996 - DNA, 17 bp, Homo sapiens
accagtgttcctgaagc

SEQ ID NO: 5143997 - DNA, 15 bp, Homo sapiens
accagtgttgtggat

SEQ ID NO: 5143998 - DNA, 17 bp, Homo sapiens
accagtgttgtggattt

SEQ ID NO: 5143999 - DNA, 14 bp, Homo sapiens
accagttaaaagca

SEQ ID NO: 5144000 - DNA, 16 bp, Homo sapiens
accagttaagaatgga

SEQ ID NO: 5144001 - DNA, 13 bp, Homo sapiens
accagttactgtt

SEQ ID NO: 5144002 - DNA, 16 bp, Homo sapiens
accagttactgttcat

SEQ ID NO: 5144003 - DNA, 16 bp, Homo sapiens
accagttatgataacc

SEQ ID NO: 5144004 - DNA, 17 bp, Homo sapiens
accagttatgtgaatga

SEQ ID NO: 5144005 - DNA, 16 bp, Homo sapiens
accagttctcatgggt

SEQ ID NO: 5144006 - DNA, 21 bp, Homo sapiens
accagttctcatgggtggcac

SEQ ID NO: 5144007 - DNA, 15 bp, Homo sapiens
accagttctggccag

SEQ ID NO: 5144008 - DNA, 21 bp, Homo sapiens
accagttgcacttggcctctg

SEQ ID NO: 5144009 - DNA, 15 bp, Homo sapiens
accagttgcagtcac

SEQ ID NO: 5144010 - DNA, 20 bp, Homo sapiens
accagttgcagtcactctag

SEQ ID NO: 5144011 - DNA, 20 bp, Homo sapiens
accagttgccctagcccaga

SEQ ID NO: 5144012 - DNA, 12 bp, Homo sapiens
accagttgcctt

SEQ ID NO: 5144013 - DNA, 13 bp, Homo sapiens
accagttgccttt

SEQ ID NO: 5144014 - DNA, 16 bp, Homo sapiens
accagttgccttttat

SEQ ID NO: 5144015 - DNA, 15 bp, Homo sapiens
accagtttacaggaa

SEQ ID NO: 5144016 - DNA, 17 bp, Homo sapiens
accagtttatacagaac

SEQ ID NO: 5144017 - DNA, 14 bp, Homo sapiens
accagtttcttaaa

SEQ ID NO: 5144018 - DNA, 17 bp, Homo sapiens
accagtttcttttcttt

SEQ ID NO: 5144019 - DNA, 21 bp, Homo sapiens
accagtttcttttcttttgtt

SEQ ID NO: 5144020 - DNA, 13 bp, Homo sapiens
accagtttgcatg

SEQ ID NO: 5144021 - DNA, 23 bp, Homo sapiens
accagttttatccataatgatgg

SEQ ID NO: 5144022 - DNA, 11 bp, Homo sapiens
accagttttga

SEQ ID NO: 5144023 - DNA, 18 bp, Homo sapiens
accagttttgagtgtact

SEQ ID NO: 5144024 - DNA, 12 bp, Homo sapiens
accagttttgat

SEQ ID NO: 5144025 - DNA, 14 bp, Homo sapiens
accagttttgctgc

SEQ ID NO: 5144026 - DNA, 13 bp, Homo sapiens
accagttttgtat

SEQ ID NO: 5144027 - DNA, 15 bp, Homo sapiens
accataaaaagctga

SEQ ID NO: 5144028 - DNA, 13 bp, Homo sapiens
accataaactggg

SEQ ID NO: 5144029 - DNA, 11 bp, Homo sapiens
accataaagat

SEQ ID NO: 5144030 - DNA, 14 bp, Homo sapiens
accataaagccttt

SEQ ID NO: 5144031 - DNA, 22 bp, Homo sapiens
accataaatcaattcatgttta

SEQ ID NO: 5144032 - DNA, 14 bp, Homo sapiens
accataaattcaac

SEQ ID NO: 5144033 - DNA, 23 bp, Homo sapiens
accataacccaggaatgaagata

SEQ ID NO: 5144034 - DNA, 17 bp, Homo sapiens
accataagctactgcca

SEQ ID NO: 5144035 - DNA, 15 bp, Homo sapiens
accataatccctgtc

SEQ ID NO: 5144036 - DNA, 16 bp, Homo sapiens
accataatcctagccc

SEQ ID NO: 5144037 - DNA, 13 bp, Homo sapiens
accataatcttat

SEQ ID NO: 5144038 - DNA, 15 bp, Homo sapiens
accataatgttcctt

SEQ ID NO: 5144039 - DNA, 22 bp, Homo sapiens
accatacattatttcttcccag

SEQ ID NO: 5144040 - DNA, 13 bp, Homo sapiens
accatacccagct

SEQ ID NO: 5144041 - DNA, 12 bp, Homo sapiens
accatactcaga

SEQ ID NO: 5144042 - DNA, 19 bp, Homo sapiens
accatactcatttctaaaa

SEQ ID NO: 5144043 - DNA, 13 bp, Homo sapiens
accatactgtctc

SEQ ID NO: 5144044 - DNA, 14 bp, Homo sapiens
accatactgtctct

SEQ ID NO: 5144045 - DNA, 15 bp, Homo sapiens
accatactgtctctg

SEQ ID NO: 5144046 - DNA, 14 bp, Homo sapiens
accatagaacagaa

SEQ ID NO: 5144047 - DNA, 21 bp, Homo sapiens
accataggaagacataaaact

SEQ ID NO: 5144048 - DNA, 17 bp, Homo sapiens
accatagggcatgatta

SEQ ID NO: 5144049 - DNA, 17 bp, Homo sapiens
accatagggctggggac

SEQ ID NO: 5144050 - DNA, 21 bp, Homo sapiens
accatagtgtcacagagagct

SEQ ID NO: 5144051 - DNA, 21 bp, Homo sapiens
accatagttatttacttgaaa

SEQ ID NO: 5144052 - DNA, 14 bp, Homo sapiens
accatagttgacag

SEQ ID NO: 5144053 - DNA, 17 bp, Homo sapiens
accatagttttgtttaa

SEQ ID NO: 5144054 - DNA, 18 bp, Homo sapiens
accatagttttgtttaat

SEQ ID NO: 5144055 - DNA, 13 bp, Homo sapiens
accatatgaattg

SEQ ID NO: 5144056 - DNA, 13 bp, Homo sapiens
accatatgatact

SEQ ID NO: 5144057 - DNA, 17 bp, Homo sapiens
accatatgtccactgtt

SEQ ID NO: 5144058 - DNA, 19 bp, Homo sapiens
accatatgtctgcttctgt

SEQ ID NO: 5144059 - DNA, 16 bp, Homo sapiens
accatattaccacaga

SEQ ID NO: 5144060 - DNA, 14 bp, Homo sapiens
accatattacctgg

SEQ ID NO: 5144061 - DNA, 17 bp, Homo sapiens
accatattacctggatt

SEQ ID NO: 5144062 - DNA, 16 bp, Homo sapiens
accatattgctcttaa

SEQ ID NO: 5144063 - DNA, 16 bp, Homo sapiens
accatattggtcacgt

SEQ ID NO: 5144064 - DNA, 22 bp, Homo sapiens
accatatttgaattggcctgaa

SEQ ID NO: 5144065 - DNA, 12 bp, Homo sapiens
accatattttat

SEQ ID NO: 5144066 - DNA, 14 bp, Homo sapiens
accatatttttaaa

SEQ ID NO: 5144067 - DNA, 13 bp, Homo sapiens
accatcaaatgct

SEQ ID NO: 5144068 - DNA, 18 bp, Homo sapiens
accatcaagggtcatggc

SEQ ID NO: 5144069 - DNA, 14 bp, Homo sapiens
accatcaccaccgc

SEQ ID NO: 5144070 - DNA, 15 bp, Homo sapiens
accatcaccaccgcc

SEQ ID NO: 5144071 - DNA, 20 bp, Homo sapiens
accatcaccaccgcctctgg

SEQ ID NO: 5144072 - DNA, 18 bp, Homo sapiens
accatcaccacgcagaga

SEQ ID NO: 5144073 - DNA, 20 bp, Homo sapiens
accatcactcactcactccc

SEQ ID NO: 5144074 - DNA, 13 bp, Homo sapiens
accatcactgagt

SEQ ID NO: 5144075 - DNA, 18 bp, Homo sapiens
accatcagaattcagaat

SEQ ID NO: 5144076 - DNA, 13 bp, Homo sapiens
accatcagcctgt

SEQ ID NO: 5144077 - DNA, 15 bp, Homo sapiens
accatcagctctgcc

SEQ ID NO: 5144078 - DNA, 16 bp, Homo sapiens
accatcagctctgcct

SEQ ID NO: 5144079 - DNA, 18 bp, Homo sapiens
accatcagctctgccttg

SEQ ID NO: 5144080 - DNA, 23 bp, Homo sapiens
accatcagtgcacaaatcattcc

SEQ ID NO: 5144081 - DNA, 15 bp, Homo sapiens
accatcatgccctct

SEQ ID NO: 5144082 - DNA, 16 bp, Homo sapiens
accatcatgtctggct

SEQ ID NO: 5144083 - DNA, 17 bp, Homo sapiens
accatcatgtctggcta

SEQ ID NO: 5144084 - DNA, 14 bp, Homo sapiens
acccgctgcccctc

SEQ ID NO: 5144085 - DNA, 13 bp, Homo sapiens
acccgctggagcc

SEQ ID NO: 5144086 - DNA, 17 bp, Homo sapiens
acccgctggagcccaca

SEQ ID NO: 5144087 - DNA, 23 bp, Homo sapiens
acccgctggagcccacagcgagc

SEQ ID NO: 5144088 - DNA, 12 bp, Homo sapiens
acccggaaacag

SEQ ID NO: 5144089 - DNA, 12 bp, Homo sapiens
acccggaaagac

SEQ ID NO: 5144090 - DNA, 15 bp, Homo sapiens
acccggaggccacat

SEQ ID NO: 5144091 - DNA, 14 bp, Homo sapiens
acccggaggccgag

SEQ ID NO: 5144092 - DNA, 14 bp, Homo sapiens
acccggatgaactc

SEQ ID NO: 5144093 - DNA, 17 bp, Homo sapiens
acccggattggccctgc

SEQ ID NO: 5144094 - DNA, 20 bp, Homo sapiens
acccggattggccctgcccc

SEQ ID NO: 5144095 - DNA, 20 bp, Homo sapiens
acccggcatgccgagtgccc

SEQ ID NO: 5144096 - DNA, 17 bp, Homo sapiens
acccggccacagctgct

SEQ ID NO: 5144097 - DNA, 22 bp, Homo sapiens
acccggccaggaccttggtgag

SEQ ID NO: 5144098 - DNA, 22 bp, Homo sapiens
acccggcccagagaccccttcc

SEQ ID NO: 5144099 - DNA, 20 bp, Homo sapiens
acccggcccatatccctggt

SEQ ID NO: 5144100 - DNA, 19 bp, Homo sapiens
acccggcccccgccctctg

SEQ ID NO: 5144101 - DNA, 17 bp, Homo sapiens
acccggcccctaccagc

SEQ ID NO: 5144102 - DNA, 18 bp, Homo sapiens
acccggcccggctgagcc

SEQ ID NO: 5144103 - DNA, 21 bp, Homo sapiens
acccggcccggctgagccctg

SEQ ID NO: 5144104 - DNA, 16 bp, Homo sapiens
acccggccggagccgc

SEQ ID NO: 5144105 - DNA, 21 bp, Homo sapiens
acccggcctctctgccccacc

SEQ ID NO: 5144106 - DNA, 23 bp, Homo sapiens
acccggcctggatgccagctgtg

SEQ ID NO: 5144107 - DNA, 14 bp, Homo sapiens
acccggctgcagag

SEQ ID NO: 5144108 - DNA, 14 bp, Homo sapiens
acccggcttcctgt

SEQ ID NO: 5144109 - DNA, 22 bp, Homo sapiens
acccgggaagggggctgggaca

SEQ ID NO: 5144110 - DNA, 24 bp, Homo sapiens
acccgggaccaaactcacggacca

SEQ ID NO: 5144111 - DNA, 17 bp, Homo sapiens
acccgggaccacagctg

SEQ ID NO: 5144112 - DNA, 18 bp, Homo sapiens
acccgggaccacagctgc

SEQ ID NO: 5144113 - DNA, 21 bp, Homo sapiens
acccgggaccacagctgctgg

SEQ ID NO: 5144114 - DNA, 17 bp, Homo sapiens
acccgggaggcagaggt

SEQ ID NO: 5144115 - DNA, 19 bp, Homo sapiens
acccgggaggtggagcttg

SEQ ID NO: 5144116 - DNA, 12 bp, Homo sapiens
acccgggctcag

SEQ ID NO: 5144117 - DNA, 19 bp, Homo sapiens
acccgggctgcctgcccct

SEQ ID NO: 5144118 - DNA, 18 bp, Homo sapiens
acccggggaactggtttt

SEQ ID NO: 5144119 - DNA, 21 bp, Homo sapiens
acccggggcagctggcaggag

SEQ ID NO: 5144120 - DNA, 18 bp, Homo sapiens
acccggggccagagacat

SEQ ID NO: 5144121 - DNA, 13 bp, Homo sapiens
acccgggggacag

SEQ ID NO: 5144122 - DNA, 19 bp, Homo sapiens
acccgggggagcccagtga

SEQ ID NO: 5144123 - DNA, 15 bp, Homo sapiens
acccggggtctcctg

SEQ ID NO: 5144124 - DNA, 15 bp, Homo sapiens
acccggtcccaggcc

SEQ ID NO: 5144125 - DNA, 18 bp, Homo sapiens
acccggtcccaggccgca

SEQ ID NO: 5144126 - DNA, 15 bp, Homo sapiens
acccggtgcatctgg

SEQ ID NO: 5144127 - DNA, 16 bp, Homo sapiens
acccggtgcatctggc

SEQ ID NO: 5144128 - DNA, 17 bp, Homo sapiens
acccggtgctccctctg

SEQ ID NO: 5144129 - DNA, 14 bp, Homo sapiens
acccggtggcttct

SEQ ID NO: 5144130 - DNA, 22 bp, Homo sapiens
acccggtggcttctggcacctg

SEQ ID NO: 5144131 - DNA, 22 bp, Homo sapiens
acccggttattcgcccacccga

SEQ ID NO: 5144132 - DNA, 22 bp, Homo sapiens
acccggttcagtgtttctgggg

SEQ ID NO: 5144133 - DNA, 16 bp, Homo sapiens
acccggtttcttttta

SEQ ID NO: 5144134 - DNA, 22 bp, Homo sapiens
acccgtacccccgtggtctttg

SEQ ID NO: 5144135 - DNA, 21 bp, Homo sapiens
acccgtaggcagcctctctgc

SEQ ID NO: 5144136 - DNA, 14 bp, Homo sapiens
acccgtccagacct

SEQ ID NO: 5144137 - DNA, 14 bp, Homo sapiens
acccgtccattcag

SEQ ID NO: 5144138 - DNA, 13 bp, Homo sapiens
acccgtccccaca

SEQ ID NO: 5144139 - DNA, 18 bp, Homo sapiens
acccgtccccacacgagg

SEQ ID NO: 5144140 - DNA, 14 bp, Homo sapiens
acccgtcctccctc

SEQ ID NO: 5144141 - DNA, 15 bp, Homo sapiens
acccgtcctccctca

SEQ ID NO: 5144142 - DNA, 23 bp, Homo sapiens
acccgtcctctcggctgccaggg

SEQ ID NO: 5144143 - DNA, 16 bp, Homo sapiens
acccgtctccagctgc

SEQ ID NO: 5144144 - DNA, 19 bp, Homo sapiens
acccgtgagcgcctgtgca

SEQ ID NO: 5144145 - DNA, 23 bp, Homo sapiens
acccgtgccaagtccaggtcctg

SEQ ID NO: 5144146 - DNA, 13 bp, Homo sapiens
acccgtgccacgc

SEQ ID NO: 5144147 - DNA, 16 bp, Homo sapiens
acccgtgcccctggga

SEQ ID NO: 5144148 - DNA, 13 bp, Homo sapiens
acccgtgcctggg

SEQ ID NO: 5144149 - DNA, 17 bp, Homo sapiens
acccgtggggtgctgcc

SEQ ID NO: 5144150 - DNA, 18 bp, Homo sapiens
acccgtggggtgctgccc

SEQ ID NO: 5144151 - DNA, 13 bp, Homo sapiens
acccgtgttctcc

SEQ ID NO: 5144152 - DNA, 14 bp, Homo sapiens
acccgttaatttaa

SEQ ID NO: 5144153 - DNA, 13 bp, Homo sapiens
acccgttcaactt

SEQ ID NO: 5144154 - DNA, 17 bp, Homo sapiens
acccgttcatgggggag

SEQ ID NO: 5144155 - DNA, 23 bp, Homo sapiens
acccgttcatgggggagggggca

SEQ ID NO: 5144156 - DNA, 18 bp, Homo sapiens
acccgttgggtcccttgc

SEQ ID NO: 5144157 - DNA, 23 bp, Homo sapiens
acccgtttccaagcctgggccac

SEQ ID NO: 5144158 - DNA, 21 bp, Homo sapiens
acccgttttatgatttactca

SEQ ID NO: 5144159 - DNA, 18 bp, Homo sapiens
accctaaaaagagaagaa

SEQ ID NO: 5144160 - DNA, 14 bp, Homo sapiens
accctaaaatttta

SEQ ID NO: 5144161 - DNA, 21 bp, Homo sapiens
accctaaagcaaatctgccac

SEQ ID NO: 5144162 - DNA, 15 bp, Homo sapiens
accctaaagcgacat

SEQ ID NO: 5144163 - DNA, 16 bp, Homo sapiens
accctaaataataaaa

SEQ ID NO: 5144164 - DNA, 14 bp, Homo sapiens
accctaaccaagtt

SEQ ID NO: 5144165 - DNA, 15 bp, Homo sapiens
accctaaccaagttc

SEQ ID NO: 5144166 - DNA, 22 bp, Homo sapiens
accctaactcttgctcactccc

SEQ ID NO: 5144167 - DNA, 23 bp, Homo sapiens
accctaactcttgctcactccct

SEQ ID NO: 5144168 - DNA, 17 bp, Homo sapiens
accctaagggcagccct

SEQ ID NO: 5144169 - DNA, 18 bp, Homo sapiens
accctaagggcagccctc

SEQ ID NO: 5144170 - DNA, 19 bp, Homo sapiens
accctaagggcagccctcc

SEQ ID NO: 5144171 - DNA, 22 bp, Homo sapiens
accctaaggtcattaccacagg

SEQ ID NO: 5144172 - DNA, 11 bp, Homo sapiens
accctaataag

SEQ ID NO: 5144173 - DNA, 21 bp, Homo sapiens
accctaatctttcacttgaaa

SEQ ID NO: 5144174 - DNA, 18 bp, Homo sapiens
accctaattttgtacata

SEQ ID NO: 5144175 - DNA, 14 bp, Homo sapiens
accctacaagatgc

SEQ ID NO: 5144176 - DNA, 23 bp, Homo sapiens
accctacaagttgatcatgcagg

SEQ ID NO: 5144177 - DNA, 18 bp, Homo sapiens
accctacacctctgggcc

SEQ ID NO: 5144178 - DNA, 19 bp, Homo sapiens
accctacacctctgggccc

SEQ ID NO: 5144179 - DNA, 22 bp, Homo sapiens
accctacacctctgggccctgc

SEQ ID NO: 5144180 - DNA, 22 bp, Homo sapiens
accctacagacagcttacagga

SEQ ID NO: 5144181 - DNA, 13 bp, Homo sapiens
accctacagcaga

SEQ ID NO: 5144182 - DNA, 21 bp, Homo sapiens
accctacagtatataagcttt

SEQ ID NO: 5144183 - DNA, 22 bp, Homo sapiens
accctacagtatataagctttt

SEQ ID NO: 5144184 - DNA, 22 bp, Homo sapiens
accctacatgcatgttttatgt

SEQ ID NO: 5144185 - DNA, 18 bp, Homo sapiens
accctaccagctcctcca

SEQ ID NO: 5144186 - DNA, 14 bp, Homo sapiens
accctaccccacca

SEQ ID NO: 5144187 - DNA, 15 bp, Homo sapiens
accctaccccaccac

SEQ ID NO: 5144188 - DNA, 17 bp, Homo sapiens
accctaccctggcaggg

SEQ ID NO: 5144189 - DNA, 13 bp, Homo sapiens
accctaccttccc

SEQ ID NO: 5144190 - DNA, 22 bp, Homo sapiens
accctacgctcatctctggaag

SEQ ID NO: 5144191 - DNA, 14 bp, Homo sapiens
accctactcctcca

SEQ ID NO: 5144192 - DNA, 15 bp, Homo sapiens
accctactgtgggga

SEQ ID NO: 5144193 - DNA, 21 bp, Homo sapiens
accctacttcattttcagagt

SEQ ID NO: 5144194 - DNA, 23 bp, Homo sapiens
accctacttcattttcagagtga

SEQ ID NO: 5144195 - DNA, 21 bp, Homo sapiens
accctactttgcttccgccac

SEQ ID NO: 5144196 - DNA, 15 bp, Homo sapiens
accctagaagaaaac

SEQ ID NO: 5144197 - DNA, 16 bp, Homo sapiens
accctagaagaaaacc

SEQ ID NO: 5144198 - DNA, 17 bp, Homo sapiens
accctagaaggtgggga

SEQ ID NO: 5144199 - DNA, 16 bp, Homo sapiens
accctagccaatgtct

SEQ ID NO: 5144200 - DNA, 16 bp, Homo sapiens
accctagccagagaat

SEQ ID NO: 5144201 - DNA, 23 bp, Homo sapiens
accctagccattcctggtaccca

SEQ ID NO: 5144202 - DNA, 21 bp, Homo sapiens
accctagcctccaccatcccc

SEQ ID NO: 5144203 - DNA, 12 bp, Homo sapiens
accctagccttg

SEQ ID NO: 5144204 - DNA, 15 bp, Homo sapiens
accctagccttgctt

SEQ ID NO: 5144205 - DNA, 15 bp, Homo sapiens
accctagctgtgtca

SEQ ID NO: 5144206 - DNA, 18 bp, Homo sapiens
accctagctttatatttt

SEQ ID NO: 5144207 - DNA, 21 bp, Homo sapiens
accctaggcctctcacctctg

SEQ ID NO: 5144208 - DNA, 19 bp, Homo sapiens
accctaggtctccacccct

SEQ ID NO: 5144209 - DNA, 21 bp, Homo sapiens
accctaggtctccacccctca

SEQ ID NO: 5144210 - DNA, 12 bp, Homo sapiens
accctaggtgct

SEQ ID NO: 5144211 - DNA, 15 bp, Homo sapiens
accctaggtgctcat

SEQ ID NO: 5144212 - DNA, 19 bp, Homo sapiens
accctaggttccctgttct

SEQ ID NO: 5144213 - DNA, 23 bp, Homo sapiens
accctagtcaaaactatttttgt

SEQ ID NO: 5144214 - DNA, 21 bp, Homo sapiens
accctagttagtgttttgcct

SEQ ID NO: 5144215 - DNA, 13 bp, Homo sapiens
accctagttcaaa

SEQ ID NO: 5144216 - DNA, 16 bp, Homo sapiens
accctagtttccctga

SEQ ID NO: 5144217 - DNA, 14 bp, Homo sapiens
accctatacatttt

SEQ ID NO: 5144218 - DNA, 17 bp, Homo sapiens
accctatatctccgtgt

SEQ ID NO: 5144219 - DNA, 12 bp, Homo sapiens
accctatctccc

SEQ ID NO: 5144220 - DNA, 18 bp, Homo sapiens
accctatctcctgacaga

SEQ ID NO: 5144221 - DNA, 14 bp, Homo sapiens
accctatggccact

SEQ ID NO: 5144222 - DNA, 19 bp, Homo sapiens
accctatgggtctaggaca

SEQ ID NO: 5144223 - DNA, 23 bp, Homo sapiens
accctatgggtctaggacacagt

SEQ ID NO: 5144224 - DNA, 21 bp, Homo sapiens
accctattctatccatctcct

SEQ ID NO: 5144225 - DNA, 19 bp, Homo sapiens
accctattgctgcttgagg

SEQ ID NO: 5144226 - DNA, 16 bp, Homo sapiens
accctatttgtttcat

SEQ ID NO: 5144227 - DNA, 17 bp, Homo sapiens
accctatttgtttcatt

SEQ ID NO: 5144228 - DNA, 18 bp, Homo sapiens
accctattttttgacact

SEQ ID NO: 5144229 - DNA, 17 bp, Homo sapiens
accctcaaaccctgtgg

SEQ ID NO: 5144230 - DNA, 18 bp, Homo sapiens
accctcaaaccctgtggg

SEQ ID NO: 5144231 - DNA, 20 bp, Homo sapiens
accctcaaatgtcagagcta

SEQ ID NO: 5144232 - DNA, 12 bp, Homo sapiens
accctcaacctc

SEQ ID NO: 5144233 - DNA, 18 bp, Homo sapiens
accctcaataaatgttgc

SEQ ID NO: 5144234 - DNA, 22 bp, Homo sapiens
accctcacccactctggtggcc

SEQ ID NO: 5144235 - DNA, 18 bp, Homo sapiens
accctcaccgcggctgga

SEQ ID NO: 5144236 - DNA, 21 bp, Homo sapiens
accctcacctctcccccaagg

SEQ ID NO: 5144237 - DNA, 14 bp, Homo sapiens
accctcactctgcc

SEQ ID NO: 5144238 - DNA, 16 bp, Homo sapiens
accctcactctgccag

SEQ ID NO: 5144239 - DNA, 19 bp, Homo sapiens
accctcactggctctcctg

SEQ ID NO: 5144240 - DNA, 22 bp, Homo sapiens
accctcactggctctcctggcc

SEQ ID NO: 5144241 - DNA, 19 bp, Homo sapiens
accctcagcaccccttcca

SEQ ID NO: 5144242 - DNA, 17 bp, Homo sapiens
accctcagcagctctgg

SEQ ID NO: 5144243 - DNA, 13 bp, Homo sapiens
accctcagccctg

SEQ ID NO: 5144244 - DNA, 14 bp, Homo sapiens
accctcagccttga

SEQ ID NO: 5144245 - DNA, 11 bp, Homo sapiens
accctcagctg

SEQ ID NO: 5144246 - DNA, 16 bp, Homo sapiens
accctcagctgcctca

SEQ ID NO: 5144247 - DNA, 15 bp, Homo sapiens
accctcagctgtcac

SEQ ID NO: 5144248 - DNA, 15 bp, Homo sapiens
accctcaggacaatg

SEQ ID NO: 5144249 - DNA, 14 bp, Homo sapiens
accctcaggcaggt

SEQ ID NO: 5144250 - DNA, 19 bp, Homo sapiens
accctcaggcataggcctg

SEQ ID NO: 5144251 - DNA, 14 bp, Homo sapiens
accctcaggccacc

SEQ ID NO: 5144252 - DNA, 13 bp, Homo sapiens
accctcagggagc

SEQ ID NO: 5144253 - DNA, 20 bp, Homo sapiens
accctcagggagcctcccca

SEQ ID NO: 5144254 - DNA, 19 bp, Homo sapiens
accctcagggcaaagccag

SEQ ID NO: 5144255 - DNA, 21 bp, Homo sapiens
accctcaggggaaaactgtta

SEQ ID NO: 5144256 - DNA, 14 bp, Homo sapiens
accctcaggtgcct

SEQ ID NO: 5144257 - DNA, 15 bp, Homo sapiens
accctcaggtgcctc

SEQ ID NO: 5144258 - DNA, 13 bp, Homo sapiens
accctcagttatt

SEQ ID NO: 5144259 - DNA, 17 bp, Homo sapiens
accctcagttattttgt

SEQ ID NO: 5144260 - DNA, 18 bp, Homo sapiens
accctcatacacagaaac

SEQ ID NO: 5144261 - DNA, 23 bp, Homo sapiens
accctcataccatctgctgcccc

SEQ ID NO: 5144262 - DNA, 13 bp, Homo sapiens
accatcatgtgta

SEQ ID NO: 5144263 - DNA, 19 bp, Homo sapiens
accatcattggaaatgaaa

SEQ ID NO: 5144264 - DNA, 20 bp, Homo sapiens
accatccaacagacctggtg

SEQ ID NO: 5144265 - DNA, 15 bp, Homo sapiens
accatccaccaggcc

SEQ ID NO: 5144266 - DNA, 18 bp, Homo sapiens
accatccagagaccaaat

SEQ ID NO: 5144267 - DNA, 13 bp, Homo sapiens
accatccagctcc

SEQ ID NO: 5144268 - DNA, 12 bp, Homo sapiens
accatccagtgg

SEQ ID NO: 5144269 - DNA, 17 bp, Homo sapiens
accatccatccctagaa

SEQ ID NO: 5144270 - DNA, 19 bp, Homo sapiens
accatccatccctggtgaa

SEQ ID NO: 5144271 - DNA, 21 bp, Homo sapiens
accatccattctcctcagtgg

SEQ ID NO: 5144272 - DNA, 14 bp, Homo sapiens
accatcccactgat

SEQ ID NO: 5144273 - DNA, 17 bp, Homo sapiens
accatccccaccccacc

SEQ ID NO: 5144274 - DNA, 18 bp, Homo sapiens
accatccctgaaggcccc

SEQ ID NO: 5144275 - DNA, 21 bp, Homo sapiens
accatccctgaaggccccgcc

SEQ ID NO: 5144276 - DNA, 22 bp, Homo sapiens
accatccctgaaggccccgccc

SEQ ID NO: 5144277 - DNA, 21 bp, Homo sapiens
accatccctgccacatacagg

SEQ ID NO: 5144278 - DNA, 18 bp, Homo sapiens
accatccctttttgaagt

SEQ ID NO: 5144279 - DNA, 14 bp, Homo sapiens
accatcctctccct

SEQ ID NO: 5144280 - DNA, 14 bp, Homo sapiens
accatcctctgtta

SEQ ID NO: 5144281 - DNA, 12 bp, Homo sapiens
accatcctgagc

SEQ ID NO: 5144282 - DNA, 14 bp, Homo sapiens
accatcctgagcca

SEQ ID NO: 5144283 - DNA, 16 bp, Homo sapiens
accatcctgcagcctc

SEQ ID NO: 5144284 - DNA, 21 bp, Homo sapiens
accatcctggagggctttctg

SEQ ID NO: 5144285 - DNA, 17 bp, Homo sapiens
accatcctggcccctcc

SEQ ID NO: 5144286 - DNA, 12 bp, Homo sapiens
accatcctggct

SEQ ID NO: 5144287 - DNA, 13 bp, Homo sapiens
accatcctggcta

SEQ ID NO: 5144288 - DNA, 19 bp, Homo sapiens
accatccttacaatgtaaa

SEQ ID NO: 5144289 - DNA, 19 bp, Homo sapiens
accatcgcctctgtctcct

SEQ ID NO: 5144290 - DNA, 17 bp, Homo sapiens
accatcgcgtgcaatga

SEQ ID NO: 5144291 - DNA, 15 bp, Homo sapiens
accatcgctggcccc

SEQ ID NO: 5144292 - DNA, 16 bp, Homo sapiens
accatcgctggcccct

SEQ ID NO: 5144293 - DNA, 20 bp, Homo sapiens
accatcgtgtttgcaaaggt

SEQ ID NO: 5144294 - DNA, 18 bp, Homo sapiens
accatctaggatgatttt

SEQ ID NO: 5144295 - DNA, 22 bp, Homo sapiens
accatctagtgactcaggatat

SEQ ID NO: 5144296 - DNA, 16 bp, Homo sapiens
accatctatgtgaata

SEQ ID NO: 5144297 - DNA, 21 bp, Homo sapiens
accatctcagacctttactga

SEQ ID NO: 5144298 - DNA, 16 bp, Homo sapiens
accatctcaggccacc

SEQ ID NO: 5144299 - DNA, 20 bp, Homo sapiens
accatctctccctcctggtg

SEQ ID NO: 5144300 - DNA, 14 bp, Homo sapiens
accatctctcttcc

SEQ ID NO: 5144301 - DNA, 13 bp, Homo sapiens
accatctcttcat

SEQ ID NO: 5144302 - DNA, 16 bp, Homo sapiens
accatctgatgtttca

SEQ ID NO: 5144303 - DNA, 12 bp, Homo sapiens
accatctgcatg

SEQ ID NO: 5144304 - DNA, 23 bp, Homo sapiens
accatctgccaatgccatgactg

SEQ ID NO: 5144305 - DNA, 12 bp, Homo sapiens
accatctgctgc

SEQ ID NO: 5144306 - DNA, 19 bp, Homo sapiens
accatctgctgcagttacc

SEQ ID NO: 5144307 - DNA, 17 bp, Homo sapiens
accatctggcccaggct

SEQ ID NO: 5144308 - DNA, 13 bp, Homo sapiens
accatctggcctg

SEQ ID NO: 5144309 - DNA, 16 bp, Homo sapiens
accatctggcctggcc

SEQ ID NO: 5144310 - DNA, 23 bp, Homo sapiens
accatctggcctggcctggccct

SEQ ID NO: 5144311 - DNA, 16 bp, Homo sapiens
accatctggggcacct

SEQ ID NO: 5144312 - DNA, 17 bp, Homo sapiens
accatctggtgcctttc

SEQ ID NO: 5144313 - DNA, 19 bp, Homo sapiens
accatctgtcttgccagcc

SEQ ID NO: 5144314 - DNA, 23 bp, Homo sapiens
accatctgtgactataaagctgt

SEQ ID NO: 5144315 - DNA, 16 bp, Homo sapiens
accatctgtttgaaga

SEQ ID NO: 5144316 - DNA, 23 bp, Homo sapiens
accatctgtttgaagattatatg

SEQ ID NO: 5144317 - DNA, 13 bp, Homo sapiens
accatcttaatct

SEQ ID NO: 5144318 - DNA, 21 bp, Homo sapiens
accatcttcactggcttccat

SEQ ID NO: 5144319 - DNA, 22 bp, Homo sapiens
accatcttctatcttctttcca

SEQ ID NO: 5144320 - DNA, 20 bp, Homo sapiens
accatcttgaagtcattgtc

SEQ ID NO: 5144321 - DNA, 18 bp, Homo sapiens
accatcttggccaggctg

SEQ ID NO: 5144322 - DNA, 22 bp, Homo sapiens
accatctttagcagtttcctca

SEQ ID NO: 5144323 - DNA, 13 bp, Homo sapiens
accatctttgagg

SEQ ID NO: 5144324 - DNA, 20 bp, Homo sapiens
accatctttgccaacatggt

SEQ ID NO: 5144325 - DNA, 15 bp, Homo sapiens
accatgaaacaaagc

SEQ ID NO: 5144326 - DNA, 13 bp, Homo sapiens
accatgaagctgg

SEQ ID NO: 5144327 - DNA, 20 bp, Homo sapiens
accatgaagtaaattatgta

SEQ ID NO: 5144328 - DNA, 19 bp, Homo sapiens
accatgaagtgaaaatgcc

SEQ ID NO: 5144329 - DNA, 15 bp, Homo sapiens
accatgaatatctgg

SEQ ID NO: 5144330 - DNA, 22 bp, Homo sapiens
accatgaatgaacccctggctc

SEQ ID NO: 5144331 - DNA, 19 bp, Homo sapiens
accatgaattctggtcaca

SEQ ID NO: 5144332 - DNA, 15 bp, Homo sapiens
accatgaattcttga

SEQ ID NO: 5144333 - DNA, 18 bp, Homo sapiens
accatgaccccttctctc

SEQ ID NO: 5144334 - DNA, 17 bp, Homo sapiens
accatgaccctacataa

SEQ ID NO: 5144335 - DNA, 15 bp, Homo sapiens
accatgactgtgacc

SEQ ID NO: 5144336 - DNA, 21 bp, Homo sapiens
accatgagaattttacttcca

SEQ ID NO: 5144337 - DNA, 21 bp, Homo sapiens
accatgagcactactctacca

SEQ ID NO: 5144338 - DNA, 20 bp, Homo sapiens
accatgagtgaatttatatc

SEQ ID NO: 5144339 - DNA, 22 bp, Homo sapiens
accatgagtggcatggccacca

SEQ ID NO: 5144340 - DNA, 18 bp, Homo sapiens
accatgatggccaggctg

SEQ ID NO: 5144341 - DNA, 22 bp, Homo sapiens
accatgattaaccacttcagct

SEQ ID NO: 5144342 - DNA, 23 bp, Homo sapiens
accatgattaaccacttcagctg

SEQ ID NO: 5144343 - DNA, 14 bp, Homo sapiens
accatgattccttt

SEQ ID NO: 5144344 - DNA, 17 bp, Homo sapiens
accatgcaaagcaacga

SEQ ID NO: 5144345 - DNA, 16 bp, Homo sapiens
accatgcaaatgctat

SEQ ID NO: 5144346 - DNA, 15 bp, Homo sapiens
accatgcaaattgtg

SEQ ID NO: 5144347 - DNA, 20 bp, Homo sapiens
accatgcactatatttgtat

SEQ ID NO: 5144348 - DNA, 23 bp, Homo sapiens
accatgcactcacccctagccct

SEQ ID NO: 5144349 - DNA, 14 bp, Homo sapiens
accatgcagagcgc

SEQ ID NO: 5144350 - DNA, 17 bp, Homo sapiens
accatgcaggaaggaaa

SEQ ID NO: 5144351 - DNA, 18 bp, Homo sapiens
accatgcattcagatctg

SEQ ID NO: 5144352 - DNA, 16 bp, Homo sapiens
accatgcatttaaagt

SEQ ID NO: 5144353 - DNA, 22 bp, Homo sapiens
accatgcccagctaattttgta

SEQ ID NO: 5144354 - DNA, 20 bp, Homo sapiens
accatgcccagctagttttt

SEQ ID NO: 5144355 - DNA, 22 bp, Homo sapiens
accatgcccggctaatttttgt

SEQ ID NO: 5144356 - DNA, 19 bp, Homo sapiens
accatgccttttttttaag

SEQ ID NO: 5144357 - DNA, 23 bp, Homo sapiens
accatgcgacactgggaggccag

SEQ ID NO: 5144358 - DNA, 19 bp, Homo sapiens
accatgcgctgctcaacct

SEQ ID NO: 5144359 - DNA, 22 bp, Homo sapiens
accatgcgtcaggggcctagag

SEQ ID NO: 5144360 - DNA, 22 bp, Homo sapiens
accatgctctctcacctgctcc

SEQ ID NO: 5144361 - DNA, 19 bp, Homo sapiens
accatgctgctggggaaga

SEQ ID NO: 5144362 - DNA, 21 bp, Homo sapiens
accatgctgctggggaagaca

SEQ ID NO: 5144363 - DNA, 21 bp, Homo sapiens
accatgctggcggcgcagagg

SEQ ID NO: 5144364 - DNA, 17 bp, Homo sapiens
accatgctggtatatgg

SEQ ID NO: 5144365 - DNA, 17 bp, Homo sapiens
accatgctgtctggcac

SEQ ID NO: 5144366 - DNA, 18 bp, Homo sapiens
accatgcttgcctgaagc

SEQ ID NO: 5144367 - DNA, 14 bp, Homo sapiens
accatgctttgttt

SEQ ID NO: 5144368 - DNA, 23 bp, Homo sapiens
accatggacactacacccagcaa

SEQ ID NO: 5144369 - DNA, 16 bp, Homo sapiens
accatggagacaagaa

SEQ ID NO: 5144370 - DNA, 17 bp, Homo sapiens
accatggagatgaaatg

SEQ ID NO: 5144371 - DNA, 23 bp, Homo sapiens
accatggagtggcagcccagcca

SEQ ID NO: 5144372 - DNA, 17 bp, Homo sapiens
accatggatatgttgta

SEQ ID NO: 5144373 - DNA, 22 bp, Homo sapiens
accatggattgtacatattttt

SEQ ID NO: 5144374 - DNA, 23 bp, Homo sapiens
accatggccgaagccccttggag

SEQ ID NO: 5144375 - DNA, 23 bp, Homo sapiens
accatggctgaaggaaaccagtg

SEQ ID NO: 5144376 - DNA, 21 bp, Homo sapiens
accatgggaggtggggcctca

SEQ ID NO: 5144377 - DNA, 18 bp, Homo sapiens
accatgggataaatgcca

SEQ ID NO: 5144378 - DNA, 20 bp, Homo sapiens
accatgggctcagggccagg

SEQ ID NO: 5144379 - DNA, 21 bp, Homo sapiens
accatgggctcagggccaggt

SEQ ID NO: 5144380 - DNA, 23 bp, Homo sapiens
accatgggctcagggccaggtcc

SEQ ID NO: 5144381 - DNA, 16 bp, Homo sapiens
accatggggaggtggc

SEQ ID NO: 5144382 - DNA, 18 bp, Homo sapiens
accatgggtgtggatggc

SEQ ID NO: 5144383 - DNA, 20 bp, Homo sapiens
accatggtcatcaccaccct

SEQ ID NO: 5144384 - DNA, 22 bp, Homo sapiens
accatggtcggaaaacatgcta

SEQ ID NO: 5144385 - DNA, 17 bp, Homo sapiens
accatggttaagagtcc

SEQ ID NO: 5144386 - DNA, 23 bp, Homo sapiens
accatggttttggctctcccacc

SEQ ID NO: 5144387 - DNA, 14 bp, Homo sapiens
accatgtaaaacaa

SEQ ID NO: 5144388 - DNA, 15 bp, Homo sapiens
accatgtaaaacaaa

SEQ ID NO: 5144389 - DNA, 20 bp, Homo sapiens
accatgtaaaacaaaaaaca

SEQ ID NO: 5144390 - DNA, 19 bp, Homo sapiens
accatgtaacaaccagaga

SEQ ID NO: 5144391 - DNA, 17 bp, Homo sapiens
accatgtacatgaagaa

SEQ ID NO: 5144392 - DNA, 15 bp, Homo sapiens
accatgtagttttaa

SEQ ID NO: 5144393 - DNA, 16 bp, Homo sapiens
accatgtagttttaac

SEQ ID NO: 5144394 - DNA, 15 bp, Homo sapiens
accatgtatgtggta

SEQ ID NO: 5144395 - DNA, 20 bp, Homo sapiens
accatgtattcatccagagt

SEQ ID NO: 5144396 - DNA, 13 bp, Homo sapiens
accatgtcactgt

SEQ ID NO: 5144397 - DNA, 15 bp, Homo sapiens
accatgtcactgtgg

SEQ ID NO: 5144398 - DNA, 18 bp, Homo sapiens
accatgtcagcaaaaagc

SEQ ID NO: 5144399 - DNA, 12 bp, Homo sapiens
accatgtcattt

SEQ ID NO: 5144400 - DNA, 18 bp, Homo sapiens
accatgtcatttcagaag

SEQ ID NO: 5144401 - DNA, 22 bp, Homo sapiens
accatgtctatgattcgtgtaa

SEQ ID NO: 5144402 - DNA, 14 bp, Homo sapiens
accatgtctttctc

SEQ ID NO: 5144403 - DNA, 16 bp, Homo sapiens
accatgtctttctctc

SEQ ID NO: 5144404 - DNA, 12 bp, Homo sapiens
accatgtgccat

SEQ ID NO: 5144405 - DNA, 13 bp, Homo sapiens
accatgtgcctga

SEQ ID NO: 5144406 - DNA, 16 bp, Homo sapiens
accatgtgcggagcag

SEQ ID NO: 5144407 - DNA, 21 bp, Homo sapiens
accatgtgcggagcagccttt

SEQ ID NO: 5144408 - DNA, 18 bp, Homo sapiens
accatgtggtttgctgtt

SEQ ID NO: 5144409 - DNA, 15 bp, Homo sapiens
accatgtgtcacttg

SEQ ID NO: 5144410 - DNA, 15 bp, Homo sapiens
accatgttaatacat

SEQ ID NO: 5144411 - DNA, 20 bp, Homo sapiens
accatgttaatacatcattt

SEQ ID NO: 5144412 - DNA, 16 bp, Homo sapiens
accatgttagccagga

SEQ ID NO: 5144413 - DNA, 14 bp, Homo sapiens
accatgttagcctt

SEQ ID NO: 5144414 - DNA, 15 bp, Homo sapiens
accatgttagcctta

SEQ ID NO: 5144415 - DNA, 16 bp, Homo sapiens
accatgttagccttag

SEQ ID NO: 5144416 - DNA, 16 bp, Homo sapiens
accatgttatattgct

SEQ ID NO: 5144417 - DNA, 12 bp, Homo sapiens
accatgttcatt

SEQ ID NO: 5144418 - DNA, 16 bp, Homo sapiens
accatgttcattataa

SEQ ID NO: 5144419 - DNA, 16 bp, Homo sapiens
accatgttcccagctc

SEQ ID NO: 5144420 - DNA, 23 bp, Homo sapiens
accatgttcttgagcagctgaat

SEQ ID NO: 5144421 - DNA, 14 bp, Homo sapiens
accatgttgcactg

SEQ ID NO: 5144422 - DNA, 15 bp, Homo sapiens
accatgttgcccagg

SEQ ID NO: 5144423 - DNA, 20 bp, Homo sapiens
accatgttggccaggctgct

SEQ ID NO: 5144424 - DNA, 22 bp, Homo sapiens
accatgttggccaggctggtct

SEQ ID NO: 5144425 - DNA, 19 bp, Homo sapiens
accatgtttgagctcagac

SEQ ID NO: 5144426 - DNA, 21 bp, Homo sapiens
accattaaaactgaagtctga

SEQ ID NO: 5144427 - DNA, 23 bp, Homo sapiens
accattaaaactgaagtctgaaa

SEQ ID NO: 5144428 - DNA, 17 bp, Homo sapiens
accattaaaactgcttt

SEQ ID NO: 5144429 - DNA, 14 bp, Homo sapiens
accattaaaatatg

SEQ ID NO: 5144430 - DNA, 19 bp, Homo sapiens
accattaaaatatgcacta

SEQ ID NO: 5144431 - DNA, 20 bp, Homo sapiens
accattaaaatatgcactaa

SEQ ID NO: 5144432 - DNA, 18 bp, Homo sapiens
accattaaaatcttgaaa

SEQ ID NO: 5144433 - DNA, 19 bp, Homo sapiens
accattaaaccatctccct

SEQ ID NO: 5144434 - DNA, 21 bp, Homo sapiens
accattaacaggtctttgaaa

SEQ ID NO: 5144435 - DNA, 18 bp, Homo sapiens
accattaatcagaaacat

SEQ ID NO: 5144436 - DNA, 12 bp, Homo sapiens
accattaatgaa

SEQ ID NO: 5144437 - DNA, 13 bp, Homo sapiens
accattaattaca

SEQ ID NO: 5144438 - DNA, 19 bp, Homo sapiens
accattacaactagatcaa

SEQ ID NO: 5144439 - DNA, 13 bp, Homo sapiens
aaaccaagttatt

SEQ ID NO: 5144440 - DNA, 19 bp, Homo sapiens
aaaccaagttatttttctt

SEQ ID NO: 5144441 - DNA, 15 bp, Homo sapiens
aaaccaatcatctta

SEQ ID NO: 5144442 - DNA, 21 bp, Homo sapiens
aaaccaatggtgatcctctat

SEQ ID NO: 5144443 - DNA, 14 bp, Homo sapiens
aaaccaatttcttc

SEQ ID NO: 5144444 - DNA, 16 bp, Homo sapiens
aaaccaatttcttcct

SEQ ID NO: 5144445 - DNA, 17 bp, Homo sapiens
aaaccaatttcttcctt

SEQ ID NO: 5144446 - DNA, 16 bp, Homo sapiens
aaaccaatttgttctg

SEQ ID NO: 5144447 - DNA, 16 bp, Homo sapiens
aaaccacaaaagttgt

SEQ ID NO: 5144448 - DNA, 19 bp, Homo sapiens
aaaccacaaacggagcccc

SEQ ID NO: 5144449 - DNA, 13 bp, Homo sapiens
aaaccacagaaca

SEQ ID NO: 5144450 - DNA, 17 bp, Homo sapiens
aaaccacagccctgtca

SEQ ID NO: 5144451 - DNA, 12 bp, Homo sapiens
aaaccacagctg

SEQ ID NO: 5144452 - DNA, 12 bp, Homo sapiens
aaaccacagtct

SEQ ID NO: 5144453 - DNA, 19 bp, Homo sapiens
aaaccacataatttttgta

SEQ ID NO: 5144454 - DNA, 23 bp, Homo sapiens
aaaccacataatttttgtacatc

SEQ ID NO: 5144455 - DNA, 15 bp, Homo sapiens
aaaccacatatgaaa

SEQ ID NO: 5144456 - DNA, 12 bp, Homo sapiens
aaaccacatggg

SEQ ID NO: 5144457 - DNA, 22 bp, Homo sapiens
aaaccacatgggctgggggcca

SEQ ID NO: 5144458 - DNA, 21 bp, Homo sapiens
aaaccacattggagatgttta

SEQ ID NO: 5144459 - DNA, 20 bp, Homo sapiens
aaaccacctcagaaaggatt

SEQ ID NO: 5144460 - DNA, 15 bp, Homo sapiens
aaaccactagaaagt

SEQ ID NO: 5144461 - DNA, 16 bp, Homo sapiens
aaaccactagaactct

SEQ ID NO: 5144462 - DNA, 13 bp, Homo sapiens
aaaccactgtaca

SEQ ID NO: 5144463 - DNA, 15 bp, Homo sapiens
aaaccactgtgaaca

SEQ ID NO: 5144464 - DNA, 18 bp, Homo sapiens
aaaccacttctccatgct

SEQ ID NO: 5144465 - DNA, 16 bp, Homo sapiens
aaaccacttctctgct

SEQ ID NO: 5144466 - DNA, 17 bp, Homo sapiens
aaaccacttctctgctg

SEQ ID NO: 5144467 - DNA, 21 bp, Homo sapiens
aaaccacttctctgctgcctc

SEQ ID NO: 5144468 - DNA, 14 bp, Homo sapiens
aaaccacttgagcc

SEQ ID NO: 5144469 - DNA, 14 bp, Homo sapiens
aaaccacttgcctg

SEQ ID NO: 5144470 - DNA, 17 bp, Homo sapiens
aaaccacttgcctgggg

SEQ ID NO: 5144471 - DNA, 20 bp, Homo sapiens
aaaccagaaaaaataaatgt

SEQ ID NO: 5144472 - DNA, 16 bp, Homo sapiens
aaaccagaaaagcaat

SEQ ID NO: 5144473 - DNA, 11 bp, Homo sapiens
aaaccagaacc

SEQ ID NO: 5144474 - DNA, 16 bp, Homo sapiens
aaaccagaacccagtg

SEQ ID NO: 5144475 - DNA, 14 bp, Homo sapiens
aaaccagaaggaag

SEQ ID NO: 5144476 - DNA, 15 bp, Homo sapiens
aaaccagcagaaaag

SEQ ID NO: 5144477 - DNA, 13 bp, Homo sapiens
aaaccagcaggtg

SEQ ID NO: 5144478 - DNA, 16 bp, Homo sapiens
aaaccagccttcggag

SEQ ID NO: 5144479 - DNA, 20 bp, Homo sapiens
aaaccagctacttgatgtaa

SEQ ID NO: 5144480 - DNA, 22 bp, Homo sapiens
aaaccagctctgaacttccaag

SEQ ID NO: 5144481 - DNA, 16 bp, Homo sapiens
aaaccagcttccttca

SEQ ID NO: 5144482 - DNA, 19 bp, Homo sapiens
aaaccagcttccttcagag

SEQ ID NO: 5144483 - DNA, 15 bp, Homo sapiens
aaaccaggacattaa

SEQ ID NO: 5144484 - DNA, 16 bp, Homo sapiens
aaaccaggaccctgtc

SEQ ID NO: 5144485 - DNA, 21 bp, Homo sapiens
aaaccaggagcattttgtgtc

SEQ ID NO: 5144486 - DNA, 23 bp, Homo sapiens
aaaccaggagcattttgtgtctt

SEQ ID NO: 5144487 - DNA, 12 bp, Homo sapiens
aaaccaggcctc

SEQ ID NO: 5144488 - DNA, 15 bp, Homo sapiens
aaaccaggctgcagg

SEQ ID NO: 5144489 - DNA, 16 bp, Homo sapiens
aaaccagggtgcatgg

SEQ ID NO: 5144490 - DNA, 19 bp, Homo sapiens
aaaccagtgtagccttgcc

SEQ ID NO: 5144491 - DNA, 13 bp, Homo sapiens
aaaccagtgtgaa

SEQ ID NO: 5144492 - DNA, 16 bp, Homo sapiens
aaaccagtgtgaaccc

SEQ ID NO: 5144493 - DNA, 18 bp, Homo sapiens
aaaccagttaagaatgga

SEQ ID NO: 5144494 - DNA, 23 bp, Homo sapiens
aaaccagtttagatttcaagaaa

SEQ ID NO: 5144495 - DNA, 16 bp, Homo sapiens
aaaccagtttattctg

SEQ ID NO: 5144496 - DNA, 17 bp, Homo sapiens
aaaccagtttattctgt

SEQ ID NO: 5144497 - DNA, 17 bp, Homo sapiens
aaaccataaaataaatt

SEQ ID NO: 5144498 - DNA, 20 bp, Homo sapiens
aaaccataaacatttgcacc

SEQ ID NO: 5144499 - DNA, 20 bp, Homo sapiens
aaaccataaactgtacaaat

SEQ ID NO: 5144500 - DNA, 15 bp, Homo sapiens
aaaccataaacttca

SEQ ID NO: 5144501 - DNA, 17 bp, Homo sapiens
aaaccatcagatatttc

SEQ ID NO: 5144502 - DNA, 19 bp, Homo sapiens
aaaccatccatctgtggaa

SEQ ID NO: 5144503 - DNA, 13 bp, Homo sapiens
aaaccatctccct

SEQ ID NO: 5144504 - DNA, 19 bp, Homo sapiens
aaaccatctccctggtgct

SEQ ID NO: 5144505 - DNA, 14 bp, Homo sapiens
aaaccatctggcct

SEQ ID NO: 5144506 - DNA, 18 bp, Homo sapiens
aaaccatctggcctggcc

SEQ ID NO: 5144507 - DNA, 17 bp, Homo sapiens
aaaccatgaaaagtttt

SEQ ID NO: 5144508 - DNA, 20 bp, Homo sapiens
aaaccatgaaaagttttcaa

SEQ ID NO: 5144509 - DNA, 23 bp, Homo sapiens
aaaccatgaagagatttttcatg

SEQ ID NO: 5144510 - DNA, 15 bp, Homo sapiens
aaaccatgagaattt

SEQ ID NO: 5144511 - DNA, 17 bp, Homo sapiens
aaaccatgagaatttgc

SEQ ID NO: 5144512 - DNA, 13 bp, Homo sapiens
aaaccatgcacta

SEQ ID NO: 5144513 - DNA, 14 bp, Homo sapiens
aaaccatgcagctt

SEQ ID NO: 5144514 - DNA, 21 bp, Homo sapiens
aaaccatgcctggtattttca

SEQ ID NO: 5144515 - DNA, 22 bp, Homo sapiens
aaaccatgctctggcatgttga

SEQ ID NO: 5144516 - DNA, 20 bp, Homo sapiens
aaaccatgggataaatgcca

SEQ ID NO: 5144517 - DNA, 14 bp, Homo sapiens
aaaccatgtagttt

SEQ ID NO: 5144518 - DNA, 20 bp, Homo sapiens
aaaccattatgaagaagaga

SEQ ID NO: 5144519 - DNA, 18 bp, Homo sapiens
aaaccattatttaataag

SEQ ID NO: 5144520 - DNA, 16 bp, Homo sapiens
aaaccattgcttcact

SEQ ID NO: 5144521 - DNA, 14 bp, Homo sapiens
aaaccattgtaact

SEQ ID NO: 5144522 - DNA, 16 bp, Homo sapiens
aaaccatttaattcat

SEQ ID NO: 5144523 - DNA, 20 bp, Homo sapiens
aaaccatttaattcataatt

SEQ ID NO: 5144524 - DNA, 15 bp, Homo sapiens
aaaccatttcaaatg

SEQ ID NO: 5144525 - DNA, 19 bp, Homo sapiens
aaaccatttcagccaaact

SEQ ID NO: 5144526 - DNA, 19 bp, Homo sapiens
aaaccattttattttttgg

SEQ ID NO: 5144527 - DNA, 15 bp, Homo sapiens
aaaccatttttgaac

SEQ ID NO: 5144528 - DNA, 17 bp, Homo sapiens
aaaccatttttgctgaa

SEQ ID NO: 5144529 - DNA, 15 bp, Homo sapiens
aaacccaaacttcca

SEQ ID NO: 5144530 - DNA, 12 bp, Homo sapiens
aaacccaaagat

SEQ ID NO: 5144531 - DNA, 16 bp, Homo sapiens
aaacccaaagccctgg

SEQ ID NO: 5144532 - DNA, 14 bp, Homo sapiens
aaacccaagtgctg

SEQ ID NO: 5144533 - DNA, 23 bp, Homo sapiens
aaacccaagtttatttctctctt

SEQ ID NO: 5144534 - DNA, 22 bp, Homo sapiens
aaacccaatacttttgtccaat

SEQ ID NO: 5144535 - DNA, 14 bp, Homo sapiens
aaacccacaagctg

SEQ ID NO: 5144536 - DNA, 14 bp, Homo sapiens
aaacccacataaac

SEQ ID NO: 5144537 - DNA, 15 bp, Homo sapiens
aaacccacataaaca

SEQ ID NO: 5144538 - DNA, 20 bp, Homo sapiens
aaacccacataaacacttct

SEQ ID NO: 5144539 - DNA, 23 bp, Homo sapiens
aaacccaccttgttggagcctgc

SEQ ID NO: 5144540 - DNA, 20 bp, Homo sapiens
aaacccacgcgtgttctgaa

SEQ ID NO: 5144541 - DNA, 18 bp, Homo sapiens
aaacccagacaaccaaaa

SEQ ID NO: 5144542 - DNA, 14 bp, Homo sapiens
aaacccagactgtc

SEQ ID NO: 5144543 - DNA, 11 bp, Homo sapiens
aaacccagaga

SEQ ID NO: 5144544 - DNA, 22 bp, Homo sapiens
aaacccagagggttgctggtcc

SEQ ID NO: 5144545 - DNA, 16 bp, Homo sapiens
aaacccagcatgtaca

SEQ ID NO: 5144546 - DNA, 18 bp, Homo sapiens
aaacccagcatgtacaaa

SEQ ID NO: 5144547 - DNA, 18 bp, Homo sapiens
aaacccagcgttcttcag

SEQ ID NO: 5144548 - DNA, 18 bp, Homo sapiens
aaacccagctctggtcca

SEQ ID NO: 5144549 - DNA, 13 bp, Homo sapiens
aaacccaggctgt

SEQ ID NO: 5144550 - DNA, 16 bp, Homo sapiens
aaacccatacaatgta

SEQ ID NO: 5144551 - DNA, 21 bp, Homo sapiens
aaacccataggcccacacaca

SEQ ID NO: 5144552 - DNA, 22 bp, Homo sapiens
aaacccatcgtggtatgtgaat

SEQ ID NO: 5144553 - DNA, 16 bp, Homo sapiens
aaacccatctgtaata

SEQ ID NO: 5144554 - DNA, 15 bp, Homo sapiens
aaacccatgaagctg

SEQ ID NO: 5144555 - DNA, 20 bp, Homo sapiens
aaaccccacctttattcctt

SEQ ID NO: 5144556 - DNA, 12 bp, Homo sapiens
aaaccccagccc

SEQ ID NO: 5144557 - DNA, 13 bp, Homo sapiens
aaaccccagctat

SEQ ID NO: 5144558 - DNA, 18 bp, Homo sapiens
aaaccccagctattttct

SEQ ID NO: 5144559 - DNA, 17 bp, Homo sapiens
aaaccccatctctacaa

SEQ ID NO: 5144560 - DNA, 23 bp, Homo sapiens
aaaccccatttgctttcttttct

SEQ ID NO: 5144561 - DNA, 16 bp, Homo sapiens
aaacccccacacacac

SEQ ID NO: 5144562 - DNA, 13 bp, Homo sapiens
aaacccccatctc

SEQ ID NO: 5144563 - DNA, 15 bp, Homo sapiens
aaaccccccagatat

SEQ ID NO: 5144564 - DNA, 16 bp, Homo sapiens
aaacccccttttccct

SEQ ID NO: 5144565 - DNA, 17 bp, Homo sapiens
aaacccccttttccctt

SEQ ID NO: 5144566 - DNA, 13 bp, Homo sapiens
aaaccccgtctct

SEQ ID NO: 5144567 - DNA, 13 bp, Homo sapiens
aaacccctaaaaa

SEQ ID NO: 5144568 - DNA, 17 bp, Homo sapiens
aaacccctaaaaacaaa

SEQ ID NO: 5144569 - DNA, 19 bp, Homo sapiens
aaacccctaccctcacaat

SEQ ID NO: 5144570 - DNA, 12 bp, Homo sapiens
aaacccctgaca

SEQ ID NO: 5144571 - DNA, 18 bp, Homo sapiens
aaacccctgtaggcctca

SEQ ID NO: 5144572 - DNA, 13 bp, Homo sapiens
aaacccctgtccc

SEQ ID NO: 5144573 - DNA, 21 bp, Homo sapiens
aaacccgacaacatttctgcc

SEQ ID NO: 5144574 - DNA, 19 bp, Homo sapiens
aaacccgacagagggaaga

SEQ ID NO: 5144575 - DNA, 18 bp, Homo sapiens
aaacccgaggaagatgct

SEQ ID NO: 5144576 - DNA, 15 bp, Homo sapiens
aaacccgagggacag

SEQ ID NO: 5144577 - DNA, 21 bp, Homo sapiens
aaacccgggaacctccccagc

SEQ ID NO: 5144578 - DNA, 21 bp, Homo sapiens
aaacccgttttatgatttact

SEQ ID NO: 5144579 - DNA, 22 bp, Homo sapiens
aaaccctatgccttttgtagct

SEQ ID NO: 5144580 - DNA, 22 bp, Homo sapiens
aaaccctgctaaatgacttatt

SEQ ID NO: 5144581 - DNA, 12 bp, Homo sapiens
aaaccctgcttc

SEQ ID NO: 5144582 - DNA, 20 bp, Homo sapiens
aaaccctgcttctgctgccc

SEQ ID NO: 5144583 - DNA, 20 bp, Homo sapiens
aaaccctggtgctttccttc

SEQ ID NO: 5144584 - DNA, 14 bp, Homo sapiens
aaaccctgtcaaac

SEQ ID NO: 5144585 - DNA, 15 bp, Homo sapiens
aaaccctgtcaaaca

SEQ ID NO: 5144586 - DNA, 17 bp, Homo sapiens
aaaccctgtcaaacatt

SEQ ID NO: 5144587 - DNA, 21 bp, Homo sapiens
aaaccctgtggggcctgatgg

SEQ ID NO: 5144588 - DNA, 15 bp, Homo sapiens
aaacccttcaactcc

SEQ ID NO: 5144589 - DNA, 16 bp, Homo sapiens
aaacccttgaaaagac

SEQ ID NO: 5144590 - DNA, 14 bp, Homo sapiens
aaacccttgactgt

SEQ ID NO: 5144591 - DNA, 16 bp, Homo sapiens
aaaccctttagtgctt

SEQ ID NO: 5144592 - DNA, 12 bp, Homo sapiens
aaaccctttgta

SEQ ID NO: 5144593 - DNA, 22 bp, Homo sapiens
aaaccgaactgatgtaagtaaa

SEQ ID NO: 5144594 - DNA, 20 bp, Homo sapiens
aaaccgagtagaaaatgtga

SEQ ID NO: 5144595 - DNA, 15 bp, Homo sapiens
aaaccgataatgcat

SEQ ID NO: 5144596 - DNA, 22 bp, Homo sapiens
aaaccgataatgcatgaagcaa

SEQ ID NO: 5144597 - DNA, 17 bp, Homo sapiens
aaaccgcaaacgtgaaa

SEQ ID NO: 5144598 - DNA, 23 bp, Homo sapiens
aaaccgccagcgaacttgacaat

SEQ ID NO: 5144599 - DNA, 15 bp, Homo sapiens
aaaccgccagctctg

SEQ ID NO: 5144600 - DNA, 18 bp, Homo sapiens
aaaccgccagctctgttc

SEQ ID NO: 5144601 - DNA, 16 bp, Homo sapiens
aaaccgcctagtttac

SEQ ID NO: 5144602 - DNA, 20 bp, Homo sapiens
aaaccgcctagtttactgtt

SEQ ID NO: 5144603 - DNA, 23 bp, Homo sapiens
aaaccgctaaaagaaactttctt

SEQ ID NO: 5144604 - DNA, 14 bp, Homo sapiens
aaaccgtaatttta

SEQ ID NO: 5144605 - DNA, 15 bp, Homo sapiens
aaaccgtaattttat

SEQ ID NO: 5144606 - DNA, 13 bp, Homo sapiens
aaaccgtccctga

SEQ ID NO: 5144607 - DNA, 18 bp, Homo sapiens
aaaccgtgattcttgaaa

SEQ ID NO: 5144608 - DNA, 21 bp, Homo sapiens
aaaccgtggtctcatgtaaca

SEQ ID NO: 5144609 - DNA, 13 bp, Homo sapiens
aaaccgtgtttgt

SEQ ID NO: 5144610 - DNA, 12 bp, Homo sapiens
aaacctaaaaat

SEQ ID NO: 5144611 - DNA, 17 bp, Homo sapiens
aaacctaaaaattttgt

SEQ ID NO: 5144612 - DNA, 20 bp, Homo sapiens
aaacctaaaattaagaagta

SEQ ID NO: 5144613 - DNA, 16 bp, Homo sapiens
aaacctaagtccttcc

SEQ ID NO: 5144614 - DNA, 18 bp, Homo sapiens
aaacctacacactgtcat

SEQ ID NO: 5144615 - DNA, 13 bp, Homo sapiens
aaacctacagcat

SEQ ID NO: 5144616 - DNA, 18 bp, Homo sapiens
aaacctaccctcagtgag

SEQ ID NO: 5144617 - DNA, 23 bp, Homo sapiens
aaacctaccttatagagcacaat

SEQ ID NO: 5144618 - DNA, 17 bp, Homo sapiens
aaacctactgcccacat

SEQ ID NO: 5144619 - DNA, 18 bp, Homo sapiens
accattacatgtttaaat

SEQ ID NO: 5144620 - DNA, 14 bp, Homo sapiens
accattacctgtac

SEQ ID NO: 5144621 - DNA, 20 bp, Homo sapiens
accattagataaacacaggc

SEQ ID NO: 5144622 - DNA, 21 bp, Homo sapiens
accattagataaacacaggca

SEQ ID NO: 5144623 - DNA, 14 bp, Homo sapiens
accattagcataat

SEQ ID NO: 5144624 - DNA, 21 bp, Homo sapiens
accattataaccttaatttat

SEQ ID NO: 5144625 - DNA, 17 bp, Homo sapiens
accattataatgaattt

SEQ ID NO: 5144626 - DNA, 15 bp, Homo sapiens
accattataatttat

SEQ ID NO: 5144627 - DNA, 20 bp, Homo sapiens
accattatgatcaaaaactg

SEQ ID NO: 5144628 - DNA, 23 bp, Homo sapiens
accattatgatcaaaaactgcct

SEQ ID NO: 5144629 - DNA, 18 bp, Homo sapiens
accattattatgcaaaat

SEQ ID NO: 5144630 - DNA, 16 bp, Homo sapiens
accattatttaataag

SEQ ID NO: 5144631 - DNA, 18 bp, Homo sapiens
accattattttacagtct

SEQ ID NO: 5144632 - DNA, 22 bp, Homo sapiens
accattattttacagtctctgt

SEQ ID NO: 5144633 - DNA, 20 bp, Homo sapiens
accattcacaataaaagctt

SEQ ID NO: 5144634 - DNA, 22 bp, Homo sapiens
accattcacatttgatgtacat

SEQ ID NO: 5144635 - DNA, 23 bp, Homo sapiens
accattcagatcactgaatttat

SEQ ID NO: 5144636 - DNA, 20 bp, Homo sapiens
accattcaggaacctggacc

SEQ ID NO: 5144637 - DNA, 22 bp, Homo sapiens
accattcatctttcctttgctc

SEQ ID NO: 5144638 - DNA, 18 bp, Homo sapiens
accattccataatcatgt

SEQ ID NO: 5144639 - DNA, 13 bp, Homo sapiens
accattcctgcct

SEQ ID NO: 5144640 - DNA, 21 bp, Homo sapiens
accattcctgcctttaagcca

SEQ ID NO: 5144641 - DNA, 13 bp, Homo sapiens
accattcctgtcc

SEQ ID NO: 5144642 - DNA, 18 bp, Homo sapiens
accattccttcaaataaa

SEQ ID NO: 5144643 - DNA, 22 bp, Homo sapiens
accattccttcaaataaagaaa

SEQ ID NO: 5144644 - DNA, 14 bp, Homo sapiens
accattcctttaaa

SEQ ID NO: 5144645 - DNA, 22 bp, Homo sapiens
accattcctttaaattctccaa

SEQ ID NO: 5144646 - DNA, 20 bp, Homo sapiens
accattctattctccagaca

SEQ ID NO: 5144647 - DNA, 13 bp, Homo sapiens
accattctcaccc

SEQ ID NO: 5144648 - DNA, 21 bp, Homo sapiens
accattctcctgcctcagcct

SEQ ID NO: 5144649 - DNA, 21 bp, Homo sapiens
accattctgactcggtttctc

SEQ ID NO: 5144650 - DNA, 24 bp, Homo sapiens
accattctgactcggtttctccaa

SEQ ID NO: 5144651 - DNA, 16 bp, Homo sapiens
accattctgcatttag

SEQ ID NO: 5144652 - DNA, 13 bp, Homo sapiens
accattgaaaaag

SEQ ID NO: 5144653 - DNA, 17 bp, Homo sapiens
accattgaaaaaggaaa

SEQ ID NO: 5144654 - DNA, 16 bp, Homo sapiens
accattgaaatcagca

SEQ ID NO: 5144655 - DNA, 22 bp, Homo sapiens
accattgaaatcagcatgacaa

SEQ ID NO: 5144656 - DNA, 18 bp, Homo sapiens
accattgaaggaaagcta

SEQ ID NO: 5144657 - DNA, 23 bp, Homo sapiens
accattgaaggaaagctatatct

SEQ ID NO: 5144658 - DNA, 13 bp, Homo sapiens
accattgaaggct

SEQ ID NO: 5144659 - DNA, 16 bp, Homo sapiens
accattgacaggcact

SEQ ID NO: 5144660 - DNA, 15 bp, Homo sapiens
accattgacctcagc

SEQ ID NO: 5144661 - DNA, 16 bp, Homo sapiens
accattgacctcagct

SEQ ID NO: 5144662 - DNA, 20 bp, Homo sapiens
accattgacctcagctgcac

SEQ ID NO: 5144663 - DNA, 22 bp, Homo sapiens
accattgagaccgtgaagatac

SEQ ID NO: 5144664 - DNA, 17 bp, Homo sapiens
accattgagtccctgct

SEQ ID NO: 5144665 - DNA, 18 bp, Homo sapiens
accattgctaatttaaag

SEQ ID NO: 5144666 - DNA, 20 bp, Homo sapiens
accattgctaatttaaagga

SEQ ID NO: 5144667 - DNA, 21 bp, Homo sapiens
accattgctcttagtcccaag

SEQ ID NO: 5144668 - DNA, 16 bp, Homo sapiens
accattgctgctcctt

SEQ ID NO: 5144669 - DNA, 13 bp, Homo sapiens
accattgcttcac

SEQ ID NO: 5144670 - DNA, 21 bp, Homo sapiens
accattgcttcactacccatc

SEQ ID NO: 5144671 - DNA, 14 bp, Homo sapiens
accattggaaattt

SEQ ID NO: 5144672 - DNA, 18 bp, Homo sapiens
accattggaaatttcacg

SEQ ID NO: 5144673 - DNA, 21 bp, Homo sapiens
accattggacagatttcagta

SEQ ID NO: 5144674 - DNA, 17 bp, Homo sapiens
accattggctgcgctaa

SEQ ID NO: 5144675 - DNA, 16 bp, Homo sapiens
accattggggctccca

SEQ ID NO: 5144676 - DNA, 18 bp, Homo sapiens
accattggggctcccagc

SEQ ID NO: 5144677 - DNA, 22 bp, Homo sapiens
accattgtaactattaaccttt

SEQ ID NO: 5144678 - DNA, 13 bp, Homo sapiens
accattgtatttt

SEQ ID NO: 5144679 - DNA, 13 bp, Homo sapiens
accattgtcttcc

SEQ ID NO: 5144680 - DNA, 22 bp, Homo sapiens
accattgtcttccaaccccagc

SEQ ID NO: 5144681 - DNA, 16 bp, Homo sapiens
accatttaaaaacagg

SEQ ID NO: 5144682 - DNA, 20 bp, Homo sapiens
accatttaaagaaagaatgc

SEQ ID NO: 5144683 - DNA, 18 bp, Homo sapiens
accatttaataaagaaat

SEQ ID NO: 5144684 - DNA, 14 bp, Homo sapiens
accatttaatcatt

SEQ ID NO: 5144685 - DNA, 16 bp, Homo sapiens
accatttaattcataa

SEQ ID NO: 5144686 - DNA, 19 bp, Homo sapiens
accatttaattcataatta

SEQ ID NO: 5144687 - DNA, 12 bp, Homo sapiens
accatttaattt

SEQ ID NO: 5144688 - DNA, 13 bp, Homo sapiens
accatttaatttc

SEQ ID NO: 5144689 - DNA, 19 bp, Homo sapiens
accatttagtcctcacctt

SEQ ID NO: 5144690 - DNA, 13 bp, Homo sapiens
accatttatacaa

SEQ ID NO: 5144691 - DNA, 21 bp, Homo sapiens
accatttatacaaattagaaa

SEQ ID NO: 5144692 - DNA, 23 bp, Homo sapiens
accatttatacaaattagaaaat

SEQ ID NO: 5144693 - DNA, 18 bp, Homo sapiens
accatttatctactattt

SEQ ID NO: 5144694 - DNA, 15 bp, Homo sapiens
accatttatcttgaa

SEQ ID NO: 5144695 - DNA, 18 bp, Homo sapiens
accatttatgaaggtttg

SEQ ID NO: 5144696 - DNA, 14 bp, Homo sapiens
accatttcaaatgg

SEQ ID NO: 5144697 - DNA, 13 bp, Homo sapiens
accatttcacaga

SEQ ID NO: 5144698 - DNA, 18 bp, Homo sapiens
accatttccccagggcac

SEQ ID NO: 5144699 - DNA, 19 bp, Homo sapiens
accatttccgtaattctta

SEQ ID NO: 5144700 - DNA, 23 bp, Homo sapiens
accatttcttgaggtaaaagcat

SEQ ID NO: 5144701 - DNA, 18 bp, Homo sapiens
accatttgctactgtaca

SEQ ID NO: 5144702 - DNA, 17 bp, Homo sapiens
accatttgggatggaga

SEQ ID NO: 5144703 - DNA, 14 bp, Homo sapiens
accatttgtaataa

SEQ ID NO: 5144704 - DNA, 15 bp, Homo sapiens
accatttgtaataaa

SEQ ID NO: 5144705 - DNA, 18 bp, Homo sapiens
accatttgtaataaagta

SEQ ID NO: 5144706 - DNA, 13 bp, Homo sapiens
accatttgtagtg

SEQ ID NO: 5144707 - DNA, 23 bp, Homo sapiens
accatttgtccttttctgcaaca

SEQ ID NO: 5144708 - DNA, 15 bp, Homo sapiens
accatttgtgtctct

SEQ ID NO: 5144709 - DNA, 15 bp, Homo sapiens
accatttgttaactg

SEQ ID NO: 5144710 - DNA, 20 bp, Homo sapiens
accattttagttcctttatt

SEQ ID NO: 5144711 - DNA, 22 bp, Homo sapiens
accattttagttcctttattta

SEQ ID NO: 5144712 - DNA, 20 bp, Homo sapiens
accattttatagactaccaa

SEQ ID NO: 5144713 - DNA, 11 bp, Homo sapiens
accattttatc

SEQ ID NO: 5144714 - DNA, 23 bp, Homo sapiens
accattttcccatcatcctttgt

SEQ ID NO: 5144715 - DNA, 12 bp, Homo sapiens
accattttcctg

SEQ ID NO: 5144716 - DNA, 14 bp, Homo sapiens
accattttcctgca

SEQ ID NO: 5144717 - DNA, 11 bp, Homo sapiens
accattttcta

SEQ ID NO: 5144718 - DNA, 13 bp, Homo sapiens
accattttctggt

SEQ ID NO: 5144719 - DNA, 22 bp, Homo sapiens
accattttgaaatattcacaag

SEQ ID NO: 5144720 - DNA, 23 bp, Homo sapiens
accattttgctgtcccttttcct

SEQ ID NO: 5144721 - DNA, 23 bp, Homo sapiens
accattttggggtacccactgct

SEQ ID NO: 5144722 - DNA, 22 bp, Homo sapiens
accattttgtaaatgaaactta

SEQ ID NO: 5144723 - DNA, 23 bp, Homo sapiens
accattttgttattgactaacag

SEQ ID NO: 5144724 - DNA, 18 bp, Homo sapiens
accatttttgctgaattc

SEQ ID NO: 5144725 - DNA, 16 bp, Homo sapiens
accatttttgttactc

SEQ ID NO: 5144726 - DNA, 13 bp, Homo sapiens
acccaaaaagaga

SEQ ID NO: 5144727 - DNA, 20 bp, Homo sapiens
acccaaaaatatctcctcca

SEQ ID NO: 5144728 - DNA, 13 bp, Homo sapiens
acccaaaacacat

SEQ ID NO: 5144729 - DNA, 15 bp, Homo sapiens
acccaaaacacattt

SEQ ID NO: 5144730 - DNA, 20 bp, Homo sapiens
acccaaaaccctgaagccat

SEQ ID NO: 5144731 - DNA, 15 bp, Homo sapiens
acccaaaagaaactg

SEQ ID NO: 5144732 - DNA, 15 bp, Homo sapiens
acccaaaagagaaaa

SEQ ID NO: 5144733 - DNA, 15 bp, Homo sapiens
acccaaaagcacaaa

SEQ ID NO: 5144734 - DNA, 16 bp, Homo sapiens
acccaaaaggaagagc

SEQ ID NO: 5144735 - DNA, 15 bp, Homo sapiens
acccaaaaggcagaa

SEQ ID NO: 5144736 - DNA, 18 bp, Homo sapiens
acccaaaaggcagaagca

SEQ ID NO: 5144737 - DNA, 12 bp, Homo sapiens
acccaaaatata

SEQ ID NO: 5144738 - DNA, 15 bp, Homo sapiens
acccaaaatatatac

SEQ ID NO: 5144739 - DNA, 14 bp, Homo sapiens
acccaaacacttct

SEQ ID NO: 5144740 - DNA, 13 bp, Homo sapiens
acccaaaccccca

SEQ ID NO: 5144741 - DNA, 16 bp, Homo sapiens
acccaaaccccctgca

SEQ ID NO: 5144742 - DNA, 18 bp, Homo sapiens
acccaaaccccctgcagc

SEQ ID NO: 5144743 - DNA, 20 bp, Homo sapiens
acccaaaccccctgcagccc

SEQ ID NO: 5144744 - DNA, 14 bp, Homo sapiens
acccaaacctggag

SEQ ID NO: 5144745 - DNA, 16 bp, Homo sapiens
acccaaacctggagat

SEQ ID NO: 5144746 - DNA, 21 bp, Homo sapiens
acccaaagagacagctcttct

SEQ ID NO: 5144747 - DNA, 13 bp, Homo sapiens
acccaaagcagtg

SEQ ID NO: 5144748 - DNA, 14 bp, Homo sapiens
acccaaagcatgga

SEQ ID NO: 5144749 - DNA, 16 bp, Homo sapiens
acccaaagcatggact

SEQ ID NO: 5144750 - DNA, 17 bp, Homo sapiens
acccaaagcatggacta

SEQ ID NO: 5144751 - DNA, 20 bp, Homo sapiens
acccaaagcctgtcccagga

SEQ ID NO: 5144752 - DNA, 22 bp, Homo sapiens
acccaaagctgagcctgcaggg

SEQ ID NO: 5144753 - DNA, 17 bp, Homo sapiens
acccaaagtattcttct

SEQ ID NO: 5144754 - DNA, 16 bp, Homo sapiens
acccaaataaatgtgt

SEQ ID NO: 5144755 - DNA, 20 bp, Homo sapiens
acccaaatcacatctcacct

SEQ ID NO: 5144756 - DNA, 14 bp, Homo sapiens
acccaaatcctctc

SEQ ID NO: 5144757 - DNA, 17 bp, Homo sapiens
acccaaatcctctccag

SEQ ID NO: 5144758 - DNA, 16 bp, Homo sapiens
acccaaatgtccctgc

SEQ ID NO: 5144759 - DNA, 19 bp, Homo sapiens
acccaaatgtgtacacctg

SEQ ID NO: 5144760 - DNA, 16 bp, Homo sapiens
acccaaatgttcatca

SEQ ID NO: 5144761 - DNA, 22 bp, Homo sapiens
acccaaattataagggccctgc

SEQ ID NO: 5144762 - DNA, 16 bp, Homo sapiens
acccaaatttccctgg

SEQ ID NO: 5144763 - DNA, 14 bp, Homo sapiens
acccaacaaccctg

SEQ ID NO: 5144764 - DNA, 15 bp, Homo sapiens
acccaacagctcaga

SEQ ID NO: 5144765 - DNA, 13 bp, Homo sapiens
acccaacagttta

SEQ ID NO: 5144766 - DNA, 23 bp, Homo sapiens
acccaacagtttatttttattat

SEQ ID NO: 5144767 - DNA, 16 bp, Homo sapiens
acccaacccaaaccat

SEQ ID NO: 5144768 - DNA, 17 bp, Homo sapiens
acccaacctcaccctcc

SEQ ID NO: 5144769 - DNA, 14 bp, Homo sapiens
acccaacctgtcct

SEQ ID NO: 5144770 - DNA, 22 bp, Homo sapiens
acccaacctgtccttactcaga

SEQ ID NO: 5144771 - DNA, 13 bp, Homo sapiens
acccaactctcct

SEQ ID NO: 5144772 - DNA, 16 bp, Homo sapiens
acccaactgacctgcc

SEQ ID NO: 5144773 - DNA, 19 bp, Homo sapiens
acccaactgatcctgctcc

SEQ ID NO: 5144774 - DNA, 20 bp, Homo sapiens
acccaactgatcctgctcca

SEQ ID NO: 5144775 - DNA, 23 bp, Homo sapiens
acccaactgatcctgctccagca

SEQ ID NO: 5144776 - DNA, 18 bp, Homo sapiens
acccaagaaaccaaagtc

SEQ ID NO: 5144777 - DNA, 16 bp, Homo sapiens
acccaagacatgacat

SEQ ID NO: 5144778 - DNA, 22 bp, Homo sapiens
acccaagagaggaaggacccct

SEQ ID NO: 5144779 - DNA, 13 bp, Homo sapiens
acccaagatgact

SEQ ID NO: 5144780 - DNA, 20 bp, Homo sapiens
acccaagatgcaagaaggag

SEQ ID NO: 5144781 - DNA, 22 bp, Homo sapiens
acccaagatgggcatcttttgt

SEQ ID NO: 5144782 - DNA, 14 bp, Homo sapiens
acccaagcacaaac

SEQ ID NO: 5144783 - DNA, 17 bp, Homo sapiens
acccaagcacaaactgt

SEQ ID NO: 5144784 - DNA, 16 bp, Homo sapiens
acccaagcccaaactt

SEQ ID NO: 5144785 - DNA, 15 bp, Homo sapiens
acccaagccctcctt

SEQ ID NO: 5144786 - DNA, 20 bp, Homo sapiens
acccaagccctgaggcctga

SEQ ID NO: 5144787 - DNA, 21 bp, Homo sapiens
acccaagccctgaggcctgag

SEQ ID NO: 5144788 - DNA, 23 bp, Homo sapiens
acccaagccctgaggcctgaggc

SEQ ID NO: 5144789 - DNA, 17 bp, Homo sapiens
acccaagcctgctggct

SEQ ID NO: 5144790 - DNA, 13 bp, Homo sapiens
acccaagctcctc

SEQ ID NO: 5144791 - DNA, 21 bp, Homo sapiens
acccaagctctggggatgggt

SEQ ID NO: 5144792 - DNA, 15 bp, Homo sapiens
acccaagctgtggca

SEQ ID NO: 5144793 - DNA, 13 bp, Homo sapiens
acccaagcttggc

SEQ ID NO: 5144794 - DNA, 14 bp, Homo sapiens
acccaagcttggca

SEQ ID NO: 5144795 - DNA, 17 bp, Homo sapiens
acccaaggaaaactgca

SEQ ID NO: 5144796 - DNA, 21 bp, Homo sapiens
acccaaggaaaactgcatgga

SEQ ID NO: 5144797 - DNA, 13 bp, Homo sapiens
acccaaggactga

SEQ ID NO: 5144798 - DNA, 21 bp, Homo sapiens
acccaaggagcacaggtccca

SEQ ID NO: 5144799 - DNA, 18 bp, Homo sapiens
acccaaggattctgttct

SEQ ID NO: 5144800 - DNA, 18 bp, Homo sapiens
acccaaggatttttaaaa

SEQ ID NO: 5144801 - DNA, 23 bp, Homo sapiens
acccaaggggatttttatgtctg

SEQ ID NO: 5144802 - DNA, 18 bp, Homo sapiens
acccaaggggcccgaggg

SEQ ID NO: 5144803 - DNA, 18 bp, Homo sapiens
acccaaggtaccatccta

SEQ ID NO: 5144804 - DNA, 18 bp, Homo sapiens
acccaaggtcacatagct

SEQ ID NO: 5144805 - DNA, 23 bp, Homo sapiens
acccaaggtgaggtgaactccag

SEQ ID NO: 5144806 - DNA, 23 bp, Homo sapiens
acccaaggtggtcttggagagga

SEQ ID NO: 5144807 - DNA, 19 bp, Homo sapiens
acccaagtagctgctacct

SEQ ID NO: 5144808 - DNA, 15 bp, Homo sapiens
acccaagtccacccc

SEQ ID NO: 5144809 - DNA, 14 bp, Homo sapiens
acccaagtgcctca

SEQ ID NO: 5144810 - DNA, 19 bp, Homo sapiens
acccaagttatgcatcccc

SEQ ID NO: 5144811 - DNA, 19 bp, Homo sapiens
acccaagttggagtgcagt

SEQ ID NO: 5144812 - DNA, 11 bp, Homo sapiens
acccaataaag

SEQ ID NO: 5144813 - DNA, 21 bp, Homo sapiens
acccaatacagtctagtttcc

SEQ ID NO: 5144814 - DNA, 17 bp, Homo sapiens
acccaatagctgcccat

SEQ ID NO: 5144815 - DNA, 13 bp, Homo sapiens
acccaatcccagt

SEQ ID NO: 5144816 - DNA, 14 bp, Homo sapiens
acccaatcccagtt

SEQ ID NO: 5144817 - DNA, 20 bp, Homo sapiens
acccaatccctctccactct

SEQ ID NO: 5144818 - DNA, 24 bp, Homo sapiens
acccaatctgcacactccaggcct

SEQ ID NO: 5144819 - DNA, 15 bp, Homo sapiens
acccaatgcctgtga

SEQ ID NO: 5144820 - DNA, 15 bp, Homo sapiens
acccaatgctcctgg

SEQ ID NO: 5144821 - DNA, 16 bp, Homo sapiens
acccaatgctcctgga

SEQ ID NO: 5144822 - DNA, 14 bp, Homo sapiens
acccaatgctgctc

SEQ ID NO: 5144823 - DNA, 15 bp, Homo sapiens
acccaatgtctccca

SEQ ID NO: 5144824 - DNA, 17 bp, Homo sapiens
acccaatgtctcccaca

SEQ ID NO: 5144825 - DNA, 23 bp, Homo sapiens
acccaattggcccaacactgtct

SEQ ID NO: 5144826 - DNA, 21 bp, Homo sapiens
acccaatttaattccataatc

SEQ ID NO: 5144827 - DNA, 13 bp, Homo sapiens
acccaatttccaa

SEQ ID NO: 5144828 - DNA, 18 bp, Homo sapiens
acccaattttaaaaaata

SEQ ID NO: 5144829 - DNA, 21 bp, Homo sapiens
acccacaaactccaggctgga

SEQ ID NO: 5144830 - DNA, 17 bp, Homo sapiens
acccacaaagaaacaaa

SEQ ID NO: 5144831 - DNA, 12 bp, Homo sapiens
acccacaagccc

SEQ ID NO: 5144832 - DNA, 17 bp, Homo sapiens
acccacaagctgcctct

SEQ ID NO: 5144833 - DNA, 18 bp, Homo sapiens
acccacaagtggcagaca

SEQ ID NO: 5144834 - DNA, 13 bp, Homo sapiens
acccacacagctg

SEQ ID NO: 5144835 - DNA, 18 bp, Homo sapiens
acccacacagctgcccta

SEQ ID NO: 5144836 - DNA, 18 bp, Homo sapiens
acccacacaggtggccat

SEQ ID NO: 5144837 - DNA, 19 bp, Homo sapiens
acccacacaggtggccatc

SEQ ID NO: 5144838 - DNA, 12 bp, Homo sapiens
acccacacatgt

SEQ ID NO: 5144839 - DNA, 23 bp, Homo sapiens
acccacacatgtttacagaactg

SEQ ID NO: 5144840 - DNA, 21 bp, Homo sapiens
acccacacattccagggctgg

SEQ ID NO: 5144841 - DNA, 20 bp, Homo sapiens
acccacaccccgtctgcccc

SEQ ID NO: 5144842 - DNA, 23 bp, Homo sapiens
acccacaccccgtctgccccttg

SEQ ID NO: 5144843 - DNA, 22 bp, Homo sapiens
acccacaccctacagcagatcc

SEQ ID NO: 5144844 - DNA, 18 bp, Homo sapiens
acccacaccgtcttcctt

SEQ ID NO: 5144845 - DNA, 13 bp, Homo sapiens
acccacacctggg

SEQ ID NO: 5144846 - DNA, 18 bp, Homo sapiens
acccacactacgcagaag

SEQ ID NO: 5144847 - DNA, 19 bp, Homo sapiens
acccacactacgcagaaga

SEQ ID NO: 5144848 - DNA, 15 bp, Homo sapiens
acccacactgcaaca

SEQ ID NO: 5144849 - DNA, 20 bp, Homo sapiens
acccacactgccagaagaga

SEQ ID NO: 5144850 - DNA, 14 bp, Homo sapiens
acccacagaaagag

SEQ ID NO: 5144851 - DNA, 13 bp, Homo sapiens
acccacagaactt

SEQ ID NO: 5144852 - DNA, 21 bp, Homo sapiens
acccacagagtgccatccctg

SEQ ID NO: 5144853 - DNA, 15 bp, Homo sapiens
acccacagccataga

SEQ ID NO: 5144854 - DNA, 15 bp, Homo sapiens
acccacagccctgaa

SEQ ID NO: 5144855 - DNA, 19 bp, Homo sapiens
acccacagcctctgcctgt

SEQ ID NO: 5144856 - DNA, 14 bp, Homo sapiens
acccacagggcctg

SEQ ID NO: 5144857 - DNA, 13 bp, Homo sapiens
acccacagggcta

SEQ ID NO: 5144858 - DNA, 13 bp, Homo sapiens
acccacaggtgag

SEQ ID NO: 5144859 - DNA, 19 bp, Homo sapiens
acccacaggttctatgatt

SEQ ID NO: 5144860 - DNA, 20 bp, Homo sapiens
acccacagtgagaggggagg

SEQ ID NO: 5144861 - DNA, 17 bp, Homo sapiens
acccacagtttgagacc

SEQ ID NO: 5144862 - DNA, 23 bp, Homo sapiens
acccacataaaagccccagcttg

SEQ ID NO: 5144863 - DNA, 15 bp, Homo sapiens
acccacataaacact

SEQ ID NO: 5144864 - DNA, 14 bp, Homo sapiens
acccacatgctcca

SEQ ID NO: 5144865 - DNA, 15 bp, Homo sapiens
acccacattactttt

SEQ ID NO: 5144866 - DNA, 19 bp, Homo sapiens
acccaccaaccctcagggc

SEQ ID NO: 5144867 - DNA, 15 bp, Homo sapiens
acccaccaccatgcc

SEQ ID NO: 5144868 - DNA, 14 bp, Homo sapiens
acccaccaccccca

SEQ ID NO: 5144869 - DNA, 18 bp, Homo sapiens
acccaccactctcaggac

SEQ ID NO: 5144870 - DNA, 20 bp, Homo sapiens
acccaccactctcaggacca

SEQ ID NO: 5144871 - DNA, 16 bp, Homo sapiens
acccaccactggaagc

SEQ ID NO: 5144872 - DNA, 20 bp, Homo sapiens
acccaccagaaattccagta

SEQ ID NO: 5144873 - DNA, 18 bp, Homo sapiens
acccaccagctccacaca

SEQ ID NO: 5144874 - DNA, 12 bp, Homo sapiens
acccaccaggcc

SEQ ID NO: 5144875 - DNA, 15 bp, Homo sapiens
acccaccaggccagc

SEQ ID NO: 5144876 - DNA, 20 bp, Homo sapiens
acccaccaggccagctcagg

SEQ ID NO: 5144877 - DNA, 19 bp, Homo sapiens
acccaccagggctcagctc

SEQ ID NO: 5144878 - DNA, 14 bp, Homo sapiens
acccaccagtcagg

SEQ ID NO: 5144879 - DNA, 13 bp, Homo sapiens
acccaccagtgcc

SEQ ID NO: 5144880 - DNA, 18 bp, Homo sapiens
acccaccagttgctgctg

SEQ ID NO: 5144881 - DNA, 15 bp, Homo sapiens
acccaccatacagat

SEQ ID NO: 5144882 - DNA, 16 bp, Homo sapiens
acccaccatccttcca

SEQ ID NO: 5144883 - DNA, 12 bp, Homo sapiens
acccacccagaa

SEQ ID NO: 5144884 - DNA, 14 bp, Homo sapiens
acccacccagcccc

SEQ ID NO: 5144885 - DNA, 17 bp, Homo sapiens
acccacccatcttcctg

SEQ ID NO: 5144886 - DNA, 12 bp, Homo sapiens
acccaccccaac

SEQ ID NO: 5144887 - DNA, 13 bp, Homo sapiens
acccaccccaact

SEQ ID NO: 5144888 - DNA, 15 bp, Homo sapiens
acccaccccacacct

SEQ ID NO: 5144889 - DNA, 13 bp, Homo sapiens
acccaccccagca

SEQ ID NO: 5144890 - DNA, 14 bp, Homo sapiens
acccaccccagcac

SEQ ID NO: 5144891 - DNA, 13 bp, Homo sapiens
acccacccccagg

SEQ ID NO: 5144892 - DNA, 14 bp, Homo sapiens
acccacccccaggc

SEQ ID NO: 5144893 - DNA, 17 bp, Homo sapiens
acccacccccaggcctc

SEQ ID NO: 5144894 - DNA, 18 bp, Homo sapiens
acccacccccaggcctcc

SEQ ID NO: 5144895 - DNA, 12 bp, Homo sapiens
acccaccccctg

SEQ ID NO: 5144896 - DNA, 16 bp, Homo sapiens
acccaccccctttggt

SEQ ID NO: 5144897 - DNA, 12 bp, Homo sapiens
acccacccctcc

SEQ ID NO: 5144898 - DNA, 23 bp, Homo sapiens
acccacccctcctgggcccaggc

SEQ ID NO: 5144899 - DNA, 15 bp, Homo sapiens
acccacccctgcaca

SEQ ID NO: 5144900 - DNA, 16 bp, Homo sapiens
acccacccctgcccag

SEQ ID NO: 5144901 - DNA, 19 bp, Homo sapiens
acccacccgacctggctgc

SEQ ID NO: 5144902 - DNA, 20 bp, Homo sapiens
acccacccggctggccggga

SEQ ID NO: 5144903 - DNA, 21 bp, Homo sapiens
acccaccctaatttgcccttc

SEQ ID NO: 5144904 - DNA, 15 bp, Homo sapiens
acccaccctcctttc

SEQ ID NO: 5144905 - DNA, 13 bp, Homo sapiens
acccaccctctcc

SEQ ID NO: 5144906 - DNA, 14 bp, Homo sapiens
acccaccctctggt

SEQ ID NO: 5144907 - DNA, 22 bp, Homo sapiens
acccaccctgtgccatcaccat

SEQ ID NO: 5144908 - DNA, 19 bp, Homo sapiens
acccacccttctcccctgc

SEQ ID NO: 5144909 - DNA, 22 bp, Homo sapiens
acccaccctttttttggggtgc

SEQ ID NO: 5144910 - DNA, 19 bp, Homo sapiens
acccaccgtccgccctgct

SEQ ID NO: 5144911 - DNA, 14 bp, Homo sapiens
acccacctcacccc

SEQ ID NO: 5144912 - DNA, 13 bp, Homo sapiens
acccacctcagcc

SEQ ID NO: 5144913 - DNA, 15 bp, Homo sapiens
acccacctcagcctc

SEQ ID NO: 5144914 - DNA, 14 bp, Homo sapiens
acccacctccaccc

SEQ ID NO: 5144915 - DNA, 18 bp, Homo sapiens
acccacctccacccagcc

SEQ ID NO: 5144916 - DNA, 19 bp, Homo sapiens
acccacctccacccagccc

SEQ ID NO: 5144917 - DNA, 16 bp, Homo sapiens
acccacctccaccccc

SEQ ID NO: 5144918 - DNA, 16 bp, Homo sapiens
acccacctccccctcc

SEQ ID NO: 5144919 - DNA, 21 bp, Homo sapiens
acccacctccccctccccggc

SEQ ID NO: 5144920 - DNA, 14 bp, Homo sapiens
acccacctcctgcg

SEQ ID NO: 5144921 - DNA, 16 bp, Homo sapiens
acccacctctcctgcc

SEQ ID NO: 5144922 - DNA, 14 bp, Homo sapiens
acccacctgagctt

SEQ ID NO: 5144923 - DNA, 13 bp, Homo sapiens
acccacctgctga

SEQ ID NO: 5144924 - DNA, 13 bp, Homo sapiens
acccacctgctgc

SEQ ID NO: 5144925 - DNA, 23 bp, Homo sapiens
acccacctggccccctcagctct

SEQ ID NO: 5144926 - DNA, 22 bp, Homo sapiens
acccacctgggccaaggactcc

SEQ ID NO: 5144927 - DNA, 16 bp, Homo sapiens
acccacctggtactga

SEQ ID NO: 5144928 - DNA, 18 bp, Homo sapiens
acccacctgttttctgaa

SEQ ID NO: 5144929 - DNA, 17 bp, Homo sapiens
acccaccttccttgcga

SEQ ID NO: 5144930 - DNA, 15 bp, Homo sapiens
acccaccttggcctc

SEQ ID NO: 5144931 - DNA, 22 bp, Homo sapiens
acccaccttgttggagcctgca

SEQ ID NO: 5144932 - DNA, 23 bp, Homo sapiens
acccaccttgttggagcctgcag

SEQ ID NO: 5144933 - DNA, 18 bp, Homo sapiens
acccacgaacgctcttag

SEQ ID NO: 5144934 - DNA, 17 bp, Homo sapiens
acccacgattttctcca

SEQ ID NO: 5144935 - DNA, 17 bp, Homo sapiens
acccacgcgtgttctga

SEQ ID NO: 5144936 - DNA, 18 bp, Homo sapiens
acccacggagccctccct

SEQ ID NO: 5144937 - DNA, 19 bp, Homo sapiens
acccacgtgacaccaccga

SEQ ID NO: 5144938 - DNA, 21 bp, Homo sapiens
acccacgtgagagaatctgcc

SEQ ID NO: 5144939 - DNA, 20 bp, Homo sapiens
acccacgtgtaactgtcagc

SEQ ID NO: 5144940 - DNA, 15 bp, Homo sapiens
acccactacccttct

SEQ ID NO: 5144941 - DNA, 16 bp, Homo sapiens
acccactacccttctc

SEQ ID NO: 5144942 - DNA, 16 bp, Homo sapiens
acccactagccctctt

SEQ ID NO: 5144943 - DNA, 20 bp, Homo sapiens
acccactagccctctttctc

SEQ ID NO: 5144944 - DNA, 21 bp, Homo sapiens
acccactagccctctttctct

SEQ ID NO: 5144945 - DNA, 18 bp, Homo sapiens
acccactaggtgaacagc

SEQ ID NO: 5144946 - DNA, 19 bp, Homo sapiens
acccactcagccattctct

SEQ ID NO: 5144947 - DNA, 15 bp, Homo sapiens
acccactcaggattg

SEQ ID NO: 5144948 - DNA, 13 bp, Homo sapiens
acccactcccttg

SEQ ID NO: 5144949 - DNA, 18 bp, Homo sapiens
acccactcctcactgccc

SEQ ID NO: 5144950 - DNA, 15 bp, Homo sapiens
acccactcggtccca

SEQ ID NO: 5144951 - DNA, 18 bp, Homo sapiens
acccactctcctctgcct

SEQ ID NO: 5144952 - DNA, 13 bp, Homo sapiens
acccactctgcac

SEQ ID NO: 5144953 - DNA, 23 bp, Homo sapiens
acccactctgcggcccgggccga

SEQ ID NO: 5144954 - DNA, 14 bp, Homo sapiens
acccactctgcttc

SEQ ID NO: 5144955 - DNA, 13 bp, Homo sapiens
acccactctttgc

SEQ ID NO: 5144956 - DNA, 22 bp, Homo sapiens
acccactgaaatgaccaagaca

SEQ ID NO: 5144957 - DNA, 16 bp, Homo sapiens
acccactgccagatgc

SEQ ID NO: 5144958 - DNA, 14 bp, Homo sapiens
acccactgctctgg

SEQ ID NO: 5144959 - DNA, 11 bp, Homo sapiens
acccactgctt

SEQ ID NO: 5144960 - DNA, 12 bp, Homo sapiens
acccactggcca

SEQ ID NO: 5144961 - DNA, 13 bp, Homo sapiens
acccactggccag

SEQ ID NO: 5144962 - DNA, 22 bp, Homo sapiens
acccactggttccttcttcctg

SEQ ID NO: 5144963 - DNA, 19 bp, Homo sapiens
acccactgtccgcctctgc

SEQ ID NO: 5144964 - DNA, 18 bp, Homo sapiens
acccactgtgcttacagt

SEQ ID NO: 5144965 - DNA, 17 bp, Homo sapiens
acccacttatttttcaa

SEQ ID NO: 5144966 - DNA, 21 bp, Homo sapiens
acccacttctcatcacacaca

SEQ ID NO: 5144967 - DNA, 23 bp, Homo sapiens
acccacttctcatcacacacatg

SEQ ID NO: 5144968 - DNA, 14 bp, Homo sapiens
acccacttctgcac

SEQ ID NO: 5144969 - DNA, 21 bp, Homo sapiens
acccacttctggcctccagcc

SEQ ID NO: 5144970 - DNA, 17 bp, Homo sapiens
acccacttgcctgtcac

SEQ ID NO: 5144971 - DNA, 18 bp, Homo sapiens
acccacttgcctgtcacc

SEQ ID NO: 5144972 - DNA, 19 bp, Homo sapiens
acccactttgtaatttttg

SEQ ID NO: 5144973 - DNA, 21 bp, Homo sapiens
acccactttgtaatttttgct

SEQ ID NO: 5144974 - DNA, 21 bp, Homo sapiens
acccagaaaatctgaattgga

SEQ ID NO: 5144975 - DNA, 19 bp, Homo sapiens
acccagaaacaacacaatc

SEQ ID NO: 5144976 - DNA, 21 bp, Homo sapiens
acccagaaacgccacatcccc

SEQ ID NO: 5144977 - DNA, 18 bp, Homo sapiens
aaacctactgcccacatt

SEQ ID NO: 5144978 - DNA, 17 bp, Homo sapiens
aaacctactttttatgt

SEQ ID NO: 5144979 - DNA, 19 bp, Homo sapiens
aaacctagaacttcaaaat

SEQ ID NO: 5144980 - DNA, 21 bp, Homo sapiens
aaacctagaacttcaaaatgt

SEQ ID NO: 5144981 - DNA, 14 bp, Homo sapiens
aaacctagccggaa

SEQ ID NO: 5144982 - DNA, 20 bp, Homo sapiens
aaacctagcttttaaaaaat

SEQ ID NO: 5144983 - DNA, 21 bp, Homo sapiens
aaacctagcttttaaaaaata

SEQ ID NO: 5144984 - DNA, 19 bp, Homo sapiens
aaacctatctcagggaggg

SEQ ID NO: 5144985 - DNA, 22 bp, Homo sapiens
aaacctattaagtcatcatctc

SEQ ID NO: 5144986 - DNA, 17 bp, Homo sapiens
aaacctattttgaaagg

SEQ ID NO: 5144987 - DNA, 22 bp, Homo sapiens
aaacctcaaaatgtctaagata

SEQ ID NO: 5144988 - DNA, 14 bp, Homo sapiens
aaacctcaccaact

SEQ ID NO: 5144989 - DNA, 12 bp, Homo sapiens
aaacctcaccct

SEQ ID NO: 5144990 - DNA, 16 bp, Homo sapiens
aaacctcactgggcct

SEQ ID NO: 5144991 - DNA, 14 bp, Homo sapiens
aaacctcacttgaa

SEQ ID NO: 5144992 - DNA, 21 bp, Homo sapiens
aaacctcagtcatattcttat

SEQ ID NO: 5144993 - DNA, 21 bp, Homo sapiens
aaacctcatgacagccagagc

SEQ ID NO: 5144994 - DNA, 18 bp, Homo sapiens
aaacctccagcctccctg

SEQ ID NO: 5144995 - DNA, 19 bp, Homo sapiens
aaacctccatcctgccagg

SEQ ID NO: 5144996 - DNA, 22 bp, Homo sapiens
aaacctccatcctgccaggagc

SEQ ID NO: 5144997 - DNA, 17 bp, Homo sapiens
aaacctctcctgacccc

SEQ ID NO: 5144998 - DNA, 18 bp, Homo sapiens
aaacctctcctgacccct

SEQ ID NO: 5144999 - DNA, 16 bp, Homo sapiens
aaacctctccttcctc

SEQ ID NO: 5145000 - DNA, 15 bp, Homo sapiens
aaacctctgtgagca

SEQ ID NO: 5145001 - DNA, 20 bp, Homo sapiens
aaacctctttcggaaatgat

SEQ ID NO: 5145002 - DNA, 13 bp, Homo sapiens
aaacctgaacaaa

SEQ ID NO: 5145003 - DNA, 23 bp, Homo sapiens
aaacctgaactttcattggattt

SEQ ID NO: 5145004 - DNA, 12 bp, Homo sapiens
aaacctgaagac

SEQ ID NO: 5145005 - DNA, 18 bp, Homo sapiens
aaacctgaagactgagga

SEQ ID NO: 5145006 - DNA, 23 bp, Homo sapiens
aaacctgaggatgcaacaaatat

SEQ ID NO: 5145007 - DNA, 13 bp, Homo sapiens
aaacctgaggcag

SEQ ID NO: 5145008 - DNA, 19 bp, Homo sapiens
aaacctgatgttaaaattc

SEQ ID NO: 5145009 - DNA, 16 bp, Homo sapiens
aaacctgcaaggcaaa

SEQ ID NO: 5145010 - DNA, 13 bp, Homo sapiens
aaacctgcactga

SEQ ID NO: 5145011 - DNA, 22 bp, Homo sapiens
aaacctgcagttaacaggatat

SEQ ID NO: 5145012 - DNA, 16 bp, Homo sapiens
aaacctgcatattgtg

SEQ ID NO: 5145013 - DNA, 11 bp, Homo sapiens
aaacctgccaa

SEQ ID NO: 5145014 - DNA, 21 bp, Homo sapiens
aaacctgccaaggagcatcct

SEQ ID NO: 5145015 - DNA, 14 bp, Homo sapiens
aaacctgccctgcc

SEQ ID NO: 5145016 - DNA, 12 bp, Homo sapiens
aaacctgcctgg

SEQ ID NO: 5145017 - DNA, 15 bp, Homo sapiens
aaacctgcctttgta

SEQ ID NO: 5145018 - DNA, 19 bp, Homo sapiens
aaacctgcctttgtatgtg

SEQ ID NO: 5145019 - DNA, 21 bp, Homo sapiens
aaacctgcctttgtatgtgga

SEQ ID NO: 5145020 - DNA, 14 bp, Homo sapiens
aaacctgcttttca

SEQ ID NO: 5145021 - DNA, 15 bp, Homo sapiens
aaacctgcttttcaa

SEQ ID NO: 5145022 - DNA, 12 bp, Homo sapiens
aaacctggagat

SEQ ID NO: 5145023 - DNA, 15 bp, Homo sapiens
aaacctggagatgat

SEQ ID NO: 5145024 - DNA, 17 bp, Homo sapiens
aaacctggagatgatga

SEQ ID NO: 5145025 - DNA, 18 bp, Homo sapiens
aaacctgggaaggccagc

SEQ ID NO: 5145026 - DNA, 12 bp, Homo sapiens
aaacctgggacc

SEQ ID NO: 5145027 - DNA, 18 bp, Homo sapiens
aaacctggggtgaatact

SEQ ID NO: 5145028 - DNA, 22 bp, Homo sapiens
aaacctggggtgaatacttatt

SEQ ID NO: 5145029 - DNA, 21 bp, Homo sapiens
aaacctggttcatatttatac

SEQ ID NO: 5145030 - DNA, 12 bp, Homo sapiens
aaacctgtatct

SEQ ID NO: 5145031 - DNA, 13 bp, Homo sapiens
aaacctgtatctt

SEQ ID NO: 5145032 - DNA, 16 bp, Homo sapiens
aaacctgtatctttct

SEQ ID NO: 5145033 - DNA, 17 bp, Homo sapiens
aaacctgtatctttcta

SEQ ID NO: 5145034 - DNA, 22 bp, Homo sapiens
aaacctgtattactgaataata

SEQ ID NO: 5145035 - DNA, 18 bp, Homo sapiens
aaacctgtccataaagta

SEQ ID NO: 5145036 - DNA, 18 bp, Homo sapiens
aaacctgtctccactgtg

SEQ ID NO: 5145037 - DNA, 20 bp, Homo sapiens
aaacctgtgatttctgtgcc

SEQ ID NO: 5145038 - DNA, 21 bp, Homo sapiens
aaacctgtgatttctgtgcca

SEQ ID NO: 5145039 - DNA, 14 bp, Homo sapiens
aaacctgtgcctcc

SEQ ID NO: 5145040 - DNA, 15 bp, Homo sapiens
aaacctgtgcctccc

SEQ ID NO: 5145041 - DNA, 15 bp, Homo sapiens
aaacctgtgctttca

SEQ ID NO: 5145042 - DNA, 22 bp, Homo sapiens
aaacctgtgtctctgagagtag

SEQ ID NO: 5145043 - DNA, 22 bp, Homo sapiens
aaacctgttcaggcaggctttc

SEQ ID NO: 5145044 - DNA, 22 bp, Homo sapiens
aaacctgttcctgactgttctc

SEQ ID NO: 5145045 - DNA, 12 bp, Homo sapiens
aaacctgttcta

SEQ ID NO: 5145046 - DNA, 19 bp, Homo sapiens
aaacctgtttaaatatttc

SEQ ID NO: 5145047 - DNA, 21 bp, Homo sapiens
aaacctgtttaaatatttcaa

SEQ ID NO: 5145048 - DNA, 16 bp, Homo sapiens
aaacctgtttttaaca

SEQ ID NO: 5145049 - DNA, 19 bp, Homo sapiens
aaaccttaaaagtaataaa

SEQ ID NO: 5145050 - DNA, 14 bp, Homo sapiens
aaaccttactctga

SEQ ID NO: 5145051 - DNA, 23 bp, Homo sapiens
aaaccttagtgtccttttctcat

SEQ ID NO: 5145052 - DNA, 22 bp, Homo sapiens
aaaccttatctccacaacctct

SEQ ID NO: 5145053 - DNA, 16 bp, Homo sapiens
aaaccttattgtacct

SEQ ID NO: 5145054 - DNA, 23 bp, Homo sapiens
aaaccttccacccagtgctgaat

SEQ ID NO: 5145055 - DNA, 15 bp, Homo sapiens
aaaccttccttccct

SEQ ID NO: 5145056 - DNA, 16 bp, Homo sapiens
aaaccttccttccctg

SEQ ID NO: 5145057 - DNA, 17 bp, Homo sapiens
aaaccttctatgttcat

SEQ ID NO: 5145058 - DNA, 16 bp, Homo sapiens
aaaccttcttttcaat

SEQ ID NO: 5145059 - DNA, 13 bp, Homo sapiens
aaaccttgaagtt

SEQ ID NO: 5145060 - DNA, 14 bp, Homo sapiens
aaaccttgaggaga

SEQ ID NO: 5145061 - DNA, 14 bp, Homo sapiens
aaaccttgcagcat

SEQ ID NO: 5145062 - DNA, 21 bp, Homo sapiens
aaaccttgcagcatttttatt

SEQ ID NO: 5145063 - DNA, 16 bp, Homo sapiens
aaaccttgccttgaaa

SEQ ID NO: 5145064 - DNA, 22 bp, Homo sapiens
aaaccttgctctcctcatctcc

SEQ ID NO: 5145065 - DNA, 17 bp, Homo sapiens
aaaccttgtaaaaaaag

SEQ ID NO: 5145066 - DNA, 20 bp, Homo sapiens
aaaccttgtaaaaaaagcaa

SEQ ID NO: 5145067 - DNA, 22 bp, Homo sapiens
aaaccttgttctatttttcaat

SEQ ID NO: 5145068 - DNA, 16 bp, Homo sapiens
aaacctttctggcctg

SEQ ID NO: 5145069 - DNA, 18 bp, Homo sapiens
aaacctttctggcctgtt

SEQ ID NO: 5145070 - DNA, 21 bp, Homo sapiens
aaacctttgcttaccttgttt

SEQ ID NO: 5145071 - DNA, 22 bp, Homo sapiens
aaacctttgcttaccttgtttt

SEQ ID NO: 5145072 - DNA, 15 bp, Homo sapiens
aaacctttgtttcaa

SEQ ID NO: 5145073 - DNA, 18 bp, Homo sapiens
aaacctttgtttgcatct

SEQ ID NO: 5145074 - DNA, 14 bp, Homo sapiens
aaaccttttaaaaa

SEQ ID NO: 5145075 - DNA, 22 bp, Homo sapiens
aaaccttttactggttgcatgg

SEQ ID NO: 5145076 - DNA, 15 bp, Homo sapiens
aaaccttttattata

SEQ ID NO: 5145077 - DNA, 23 bp, Homo sapiens
aaaccttttatttttatttctga

SEQ ID NO: 5145078 - DNA, 16 bp, Homo sapiens
aaaccttttcttgtat

SEQ ID NO: 5145079 - DNA, 22 bp, Homo sapiens
aaaccttttttatgatgctatt

SEQ ID NO: 5145080 - DNA, 15 bp, Homo sapiens
aaaccttttttcttg

SEQ ID NO: 5145081 - DNA, 20 bp, Homo sapiens
aaaccttttttcttgctact

SEQ ID NO: 5145082 - DNA, 18 bp, Homo sapiens
aaacgaagccatctttct

SEQ ID NO: 5145083 - DNA, 13 bp, Homo sapiens
aaacgaatataag

SEQ ID NO: 5145084 - DNA, 14 bp, Homo sapiens
aaacgaatataagc

SEQ ID NO: 5145085 - DNA, 17 bp, Homo sapiens
aaacgactcaaaatgac

SEQ ID NO: 5145086 - DNA, 16 bp, Homo sapiens
aaacgagaagtgccct

SEQ ID NO: 5145087 - DNA, 17 bp, Homo sapiens
aaacgagactttccatt

SEQ ID NO: 5145088 - DNA, 23 bp, Homo sapiens
aaacgagatgtttgccaaataaa

SEQ ID NO: 5145089 - DNA, 23 bp, Homo sapiens
aaacgagttaatgatggcagagg

SEQ ID NO: 5145090 - DNA, 17 bp, Homo sapiens
aaacgatatatgtaaat

SEQ ID NO: 5145091 - DNA, 15 bp, Homo sapiens
aaacgatcgctgtga

SEQ ID NO: 5145092 - DNA, 16 bp, Homo sapiens
aaacgatcgctgtgaa

SEQ ID NO: 5145093 - DNA, 21 bp, Homo sapiens
aaacgatgtgcaatacatttt

SEQ ID NO: 5145094 - DNA, 15 bp, Homo sapiens
aaacgatttaattct

SEQ ID NO: 5145095 - DNA, 17 bp, Homo sapiens
aaacgatttaattctct

SEQ ID NO: 5145096 - DNA, 13 bp, Homo sapiens
aaacgatttacca

SEQ ID NO: 5145097 - DNA, 19 bp, Homo sapiens
aaacgcaaagggctgaaag

SEQ ID NO: 5145098 - DNA, 14 bp, Homo sapiens
aaacgcaattttac

SEQ ID NO: 5145099 - DNA, 16 bp, Homo sapiens
aaacgcacctccatcc

SEQ ID NO: 5145100 - DNA, 21 bp, Homo sapiens
aaacgcagattgggctggctc

SEQ ID NO: 5145101 - DNA, 20 bp, Homo sapiens
aaacgcatggagtgtgtatt

SEQ ID NO: 5145102 - DNA, 23 bp, Homo sapiens
aaacgccacaaaaatagagaaaa

SEQ ID NO: 5145103 - DNA, 12 bp, Homo sapiens
aaacgccatgtc

SEQ ID NO: 5145104 - DNA, 14 bp, Homo sapiens
aaacgcgcagatgt

SEQ ID NO: 5145105 - DNA, 15 bp, Homo sapiens
aaacgcgcagatgtg

SEQ ID NO: 5145106 - DNA, 12 bp, Homo sapiens
aaacgctacctc

SEQ ID NO: 5145107 - DNA, 18 bp, Homo sapiens
aaacgctacctctctgtc

SEQ ID NO: 5145108 - DNA, 21 bp, Homo sapiens
aaacgctacctctctgtccct

SEQ ID NO: 5145109 - DNA, 14 bp, Homo sapiens
aaacgctcctttgt

SEQ ID NO: 5145110 - DNA, 16 bp, Homo sapiens
aaacgcttcagttgtt

SEQ ID NO: 5145111 - DNA, 17 bp, Homo sapiens
aaacggaatgaccttgg

SEQ ID NO: 5145112 - DNA, 23 bp, Homo sapiens
aaacggaggaagcccacatattc

SEQ ID NO: 5145113 - DNA, 16 bp, Homo sapiens
aaacggattatttttt

SEQ ID NO: 5145114 - DNA, 13 bp, Homo sapiens
aaacggcccaggc

SEQ ID NO: 5145115 - DNA, 19 bp, Homo sapiens
aaacgggaacatgccccct

SEQ ID NO: 5145116 - DNA, 20 bp, Homo sapiens
aaacgggaacatgccccctg

SEQ ID NO: 5145117 - DNA, 22 bp, Homo sapiens
aaacgggcagtctgctctgctg

SEQ ID NO: 5145118 - DNA, 15 bp, Homo sapiens
aaacgggctcagcaa

SEQ ID NO: 5145119 - DNA, 21 bp, Homo sapiens
aaacggggcagtactcctccc

SEQ ID NO: 5145120 - DNA, 18 bp, Homo sapiens
aaacggtgcaacagaagg

SEQ ID NO: 5145121 - DNA, 16 bp, Homo sapiens
aaacggtgcccatcct

SEQ ID NO: 5145122 - DNA, 15 bp, Homo sapiens
aaacggttaaaactg

SEQ ID NO: 5145123 - DNA, 17 bp, Homo sapiens
aaacggttcagtttctt

SEQ ID NO: 5145124 - DNA, 17 bp, Homo sapiens
aaacgtaatttgttata

SEQ ID NO: 5145125 - DNA, 23 bp, Homo sapiens
aaacgtacttaactgtgtgaaga

SEQ ID NO: 5145126 - DNA, 18 bp, Homo sapiens
aaacgtatagtcaatatg

SEQ ID NO: 5145127 - DNA, 18 bp, Homo sapiens
aaacgtatggaatgcttc

SEQ ID NO: 5145128 - DNA, 21 bp, Homo sapiens
aaacgtcccacactttgaagc

SEQ ID NO: 5145129 - DNA, 15 bp, Homo sapiens
aaacgtctattttgt

SEQ ID NO: 5145130 - DNA, 14 bp, Homo sapiens
aaacgtcttaaata

SEQ ID NO: 5145131 - DNA, 16 bp, Homo sapiens
aaacgtctttttaagc

SEQ ID NO: 5145132 - DNA, 13 bp, Homo sapiens
aaacgtgaacaaa

SEQ ID NO: 5145133 - DNA, 23 bp, Homo sapiens
aaacgtgatgttttgaatgtgga

SEQ ID NO: 5145134 - DNA, 17 bp, Homo sapiens
aaacgtggattttaaaa

SEQ ID NO: 5145135 - DNA, 22 bp, Homo sapiens
aaacgtggattttaaaaaatca

SEQ ID NO: 5145136 - DNA, 21 bp, Homo sapiens
aaacgtggcacacactgacca

SEQ ID NO: 5145137 - DNA, 22 bp, Homo sapiens
aaacgtggcacacactgaccac

SEQ ID NO: 5145138 - DNA, 20 bp, Homo sapiens
aaacgtggctgcttcaagga

SEQ ID NO: 5145139 - DNA, 21 bp, Homo sapiens
aaacgtggctgcttcaaggat

SEQ ID NO: 5145140 - DNA, 19 bp, Homo sapiens
aaacgtggtcaccttcgag

SEQ ID NO: 5145141 - DNA, 21 bp, Homo sapiens
aaacgtggtcaccttcgagta

SEQ ID NO: 5145142 - DNA, 16 bp, Homo sapiens
aaacgtggttacatta

SEQ ID NO: 5145143 - DNA, 13 bp, Homo sapiens
aaacgtgtaaatt

SEQ ID NO: 5145144 - DNA, 17 bp, Homo sapiens
aaacgtgtcacacttgt

SEQ ID NO: 5145145 - DNA, 18 bp, Homo sapiens
aaacgtgttcgaaagtct

SEQ ID NO: 5145146 - DNA, 22 bp, Homo sapiens
aaacgtgttgtatctacagtaa

SEQ ID NO: 5145147 - DNA, 18 bp, Homo sapiens
aaacgttgacccctttcc

SEQ ID NO: 5145148 - DNA, 21 bp, Homo sapiens
aaacgttgacccctttccccc

SEQ ID NO: 5145149 - DNA, 22 bp, Homo sapiens
aaacgtttcagtaataaaacat

SEQ ID NO: 5145150 - DNA, 12 bp, Homo sapiens
aaacgtttgaaa

SEQ ID NO: 5145151 - DNA, 19 bp, Homo sapiens
aaactaaaaaaaaaaaggc

SEQ ID NO: 5145152 - DNA, 12 bp, Homo sapiens
aaactaaaaata

SEQ ID NO: 5145153 - DNA, 15 bp, Homo sapiens
aaactaaaaatattc

SEQ ID NO: 5145154 - DNA, 16 bp, Homo sapiens
aaactaaaaatttaca

SEQ ID NO: 5145155 - DNA, 18 bp, Homo sapiens
acccagaaattccttccc

SEQ ID NO: 5145156 - DNA, 22 bp, Homo sapiens
acccagaaattccttcccactc

SEQ ID NO: 5145157 - DNA, 12 bp, Homo sapiens
acccagaaggaa

SEQ ID NO: 5145158 - DNA, 23 bp, Homo sapiens
acccagaaggaacccggtcccag

SEQ ID NO: 5145159 - DNA, 19 bp, Homo sapiens
acccagaatgtagcatctg

SEQ ID NO: 5145160 - DNA, 18 bp, Homo sapiens
acccagacaaccaaaaca

SEQ ID NO: 5145161 - DNA, 18 bp, Homo sapiens
acccagacagcctgtttc

SEQ ID NO: 5145162 - DNA, 21 bp, Homo sapiens
acccagacagctccctctgcc

SEQ ID NO: 5145163 - DNA, 22 bp, Homo sapiens
acccagacagctccctctgcct

SEQ ID NO: 5145164 - DNA, 20 bp, Homo sapiens
acccagacataaaggaaaag

SEQ ID NO: 5145165 - DNA, 13 bp, Homo sapiens
acccagacccagt

SEQ ID NO: 5145166 - DNA, 15 bp, Homo sapiens
acccagacccagtgg

SEQ ID NO: 5145167 - DNA, 20 bp, Homo sapiens
acccagaccctccttcccca

SEQ ID NO: 5145168 - DNA, 17 bp, Homo sapiens
acccagacggctccact

SEQ ID NO: 5145169 - DNA, 22 bp, Homo sapiens
acccagacggctccactaggac

SEQ ID NO: 5145170 - DNA, 22 bp, Homo sapiens
acccagacgtggtgcttctcac

SEQ ID NO: 5145171 - DNA, 20 bp, Homo sapiens
acccagactggaatgcagtg

SEQ ID NO: 5145172 - DNA, 12 bp, Homo sapiens
acccagactgtc

SEQ ID NO: 5145173 - DNA, 20 bp, Homo sapiens
acccagactgtctccacggc

SEQ ID NO: 5145174 - DNA, 22 bp, Homo sapiens
acccagagaaaattaattatat

SEQ ID NO: 5145175 - DNA, 17 bp, Homo sapiens
acccagagaagcccctt

SEQ ID NO: 5145176 - DNA, 18 bp, Homo sapiens
acccagagaagccccttc

SEQ ID NO: 5145177 - DNA, 19 bp, Homo sapiens
acccagagaagccccttcc

SEQ ID NO: 5145178 - DNA, 22 bp, Homo sapiens
acccagagaagccccttcccca

SEQ ID NO: 5145179 - DNA, 23 bp, Homo sapiens
acccagagaaggacggtgccaag

SEQ ID NO: 5145180 - DNA, 21 bp, Homo sapiens
acccagagagaaaaagagaga

SEQ ID NO: 5145181 - DNA, 24 bp, Homo sapiens
acccagagagaaaaagagagagca

SEQ ID NO: 5145182 - DNA, 20 bp, Homo sapiens
acccagagagaggggcctgc

SEQ ID NO: 5145183 - DNA, 23 bp, Homo sapiens
acccagagagaggggcctgcagg

SEQ ID NO: 5145184 - DNA, 15 bp, Homo sapiens
acccagagatgcctg

SEQ ID NO: 5145185 - DNA, 18 bp, Homo sapiens
acccagagcacaggagct

SEQ ID NO: 5145186 - DNA, 24 bp, Homo sapiens
acccagagcaccccctgctccacc

SEQ ID NO: 5145187 - DNA, 15 bp, Homo sapiens
acccagagccttctc

SEQ ID NO: 5145188 - DNA, 20 bp, Homo sapiens
acccagagccttctcctgcc

SEQ ID NO: 5145189 - DNA, 23 bp, Homo sapiens
acccagagccttctcctgcctac

SEQ ID NO: 5145190 - DNA, 12 bp, Homo sapiens
acccagagctgc

SEQ ID NO: 5145191 - DNA, 22 bp, Homo sapiens
acccagaggaaggggccagagg

SEQ ID NO: 5145192 - DNA, 14 bp, Homo sapiens
acccagaggccctg

SEQ ID NO: 5145193 - DNA, 21 bp, Homo sapiens
acccagagggttgctggtcct

SEQ ID NO: 5145194 - DNA, 15 bp, Homo sapiens
acccagaggtccagg

SEQ ID NO: 5145195 - DNA, 23 bp, Homo sapiens
acccagaggtctcatctcccagg

SEQ ID NO: 5145196 - DNA, 14 bp, Homo sapiens
acccagaggtggcc

SEQ ID NO: 5145197 - DNA, 18 bp, Homo sapiens
acccagaggtggccctcc

SEQ ID NO: 5145198 - DNA, 22 bp, Homo sapiens
acccagaggtggccctcccagg

SEQ ID NO: 5145199 - DNA, 19 bp, Homo sapiens
acccagagtttttatgtag

SEQ ID NO: 5145200 - DNA, 21 bp, Homo sapiens
acccagataaaggttcatgca

SEQ ID NO: 5145201 - DNA, 16 bp, Homo sapiens
acccagatatggaaac

SEQ ID NO: 5145202 - DNA, 21 bp, Homo sapiens
acccagatggaaaaataacaa

SEQ ID NO: 5145203 - DNA, 20 bp, Homo sapiens
acccagatgttttatttatg

SEQ ID NO: 5145204 - DNA, 15 bp, Homo sapiens
acccagattcccttc

SEQ ID NO: 5145205 - DNA, 19 bp, Homo sapiens
acccagattgtgtacatag

SEQ ID NO: 5145206 - DNA, 17 bp, Homo sapiens
acccagcaaatgggcat

SEQ ID NO: 5145207 - DNA, 15 bp, Homo sapiens
acccagcaacacaga

SEQ ID NO: 5145208 - DNA, 17 bp, Homo sapiens
acccagcaacagaaaaa

SEQ ID NO: 5145209 - DNA, 18 bp, Homo sapiens
acccagcaccttgcagat

SEQ ID NO: 5145210 - DNA, 15 bp, Homo sapiens
acccagcagagggat

SEQ ID NO: 5145211 - DNA, 17 bp, Homo sapiens
acccagcagatgtttaa

SEQ ID NO: 5145212 - DNA, 21 bp, Homo sapiens
acccagcaggaagccaggctg

SEQ ID NO: 5145213 - DNA, 12 bp, Homo sapiens
acccagcaggca

SEQ ID NO: 5145214 - DNA, 15 bp, Homo sapiens
acccagcaggcagag

SEQ ID NO: 5145215 - DNA, 17 bp, Homo sapiens
acccagcagttctctgc

SEQ ID NO: 5145216 - DNA, 14 bp, Homo sapiens
acccagcatctccc

SEQ ID NO: 5145217 - DNA, 11 bp, Homo sapiens
acccagccaaa

SEQ ID NO: 5145218 - DNA, 13 bp, Homo sapiens
acccagccactgc

SEQ ID NO: 5145219 - DNA, 13 bp, Homo sapiens
acccagccagctc

SEQ ID NO: 5145220 - DNA, 20 bp, Homo sapiens
acccagccagctgcagggca

SEQ ID NO: 5145221 - DNA, 15 bp, Homo sapiens
acccagccatgtgtt

SEQ ID NO: 5145222 - DNA, 14 bp, Homo sapiens
acccagcccagcct

SEQ ID NO: 5145223 - DNA, 14 bp, Homo sapiens
acccagcccattct

SEQ ID NO: 5145224 - DNA, 17 bp, Homo sapiens
acccagccccaaggggt

SEQ ID NO: 5145225 - DNA, 19 bp, Homo sapiens
acccagccccaaggggtgg

SEQ ID NO: 5145226 - DNA, 14 bp, Homo sapiens
acccagccccaggg

SEQ ID NO: 5145227 - DNA, 20 bp, Homo sapiens
acccagcccctctcccctct

SEQ ID NO: 5145228 - DNA, 12 bp, Homo sapiens
acccagcccctg

SEQ ID NO: 5145229 - DNA, 12 bp, Homo sapiens
acccagcccctt

SEQ ID NO: 5145230 - DNA, 13 bp, Homo sapiens
acccagccccttc

SEQ ID NO: 5145231 - DNA, 14 bp, Homo sapiens
acccagccccttcc

SEQ ID NO: 5145232 - DNA, 16 bp, Homo sapiens
acccagccccttcccc

SEQ ID NO: 5145233 - DNA, 22 bp, Homo sapiens
acccagccccttcccctgggaa

SEQ ID NO: 5145234 - DNA, 14 bp, Homo sapiens
acccagcccgcggc

SEQ ID NO: 5145235 - DNA, 19 bp, Homo sapiens
acccagcccgcggcctgga

SEQ ID NO: 5145236 - DNA, 14 bp, Homo sapiens
acccagccctgggg

SEQ ID NO: 5145237 - DNA, 16 bp, Homo sapiens
acccagccctggggta

SEQ ID NO: 5145238 - DNA, 15 bp, Homo sapiens
acccagccctggtct

SEQ ID NO: 5145239 - DNA, 13 bp, Homo sapiens
acccagccgctgc

SEQ ID NO: 5145240 - DNA, 14 bp, Homo sapiens
acccagccgctgcc

SEQ ID NO: 5145241 - DNA, 9 bp, Homo sapiens
acccagcct

SEQ ID NO: 5145242 - DNA, 11 bp, Homo sapiens
acccagcctga

SEQ ID NO: 5145243 - DNA, 11 bp, Homo sapiens
acccagcctgt

SEQ ID NO: 5145244 - DNA, 16 bp, Homo sapiens
acccagcctgtcccac

SEQ ID NO: 5145245 - DNA, 19 bp, Homo sapiens
acccagcctgtcccactgg

SEQ ID NO: 5145246 - DNA, 22 bp, Homo sapiens
acccagcctgtcccactggctc

SEQ ID NO: 5145247 - DNA, 15 bp, Homo sapiens
acccagcggacacac

SEQ ID NO: 5145248 - DNA, 17 bp, Homo sapiens
acccagcgtggcccagg

SEQ ID NO: 5145249 - DNA, 20 bp, Homo sapiens
acccagcgtggcccaggccg

SEQ ID NO: 5145250 - DNA, 15 bp, Homo sapiens
acccagcgtggcctc

SEQ ID NO: 5145251 - DNA, 16 bp, Homo sapiens
acccagcgttcttcag

SEQ ID NO: 5145252 - DNA, 17 bp, Homo sapiens
acccagcgttcttcagg

SEQ ID NO: 5145253 - DNA, 18 bp, Homo sapiens
acccagcgttcttcagga

SEQ ID NO: 5145254 - DNA, 23 bp, Homo sapiens
acccagcgttcttcaggagatga

SEQ ID NO: 5145255 - DNA, 14 bp, Homo sapiens
acccagctaaataa

SEQ ID NO: 5145256 - DNA, 18 bp, Homo sapiens
acccagctactctgtcca

SEQ ID NO: 5145257 - DNA, 21 bp, Homo sapiens
acccagctccaggggcccttg

SEQ ID NO: 5145258 - DNA, 11 bp, Homo sapiens
acccagctcct

SEQ ID NO: 5145259 - DNA, 23 bp, Homo sapiens
acccagctcctctgagccatacc

SEQ ID NO: 5145260 - DNA, 11 bp, Homo sapiens
acccagctctc

SEQ ID NO: 5145261 - DNA, 13 bp, Homo sapiens
acccagctctggt

SEQ ID NO: 5145262 - DNA, 15 bp, Homo sapiens
acccagctgatgggg

SEQ ID NO: 5145263 - DNA, 16 bp, Homo sapiens
acccagctgcagacca

SEQ ID NO: 5145264 - DNA, 15 bp, Homo sapiens
acccaggaaaggagg

SEQ ID NO: 5145265 - DNA, 20 bp, Homo sapiens
acccaggaaaggaggaccag

SEQ ID NO: 5145266 - DNA, 11 bp, Homo sapiens
acccaggaagg

SEQ ID NO: 5145267 - DNA, 13 bp, Homo sapiens
acccaggaaggga

SEQ ID NO: 5145268 - DNA, 23 bp, Homo sapiens
acccaggaagggaaagcgggcag

SEQ ID NO: 5145269 - DNA, 18 bp, Homo sapiens
acccaggaagggagggag

SEQ ID NO: 5145270 - DNA, 14 bp, Homo sapiens
acccaggacaggat

SEQ ID NO: 5145271 - DNA, 17 bp, Homo sapiens
acccaggacaggatcca

SEQ ID NO: 5145272 - DNA, 20 bp, Homo sapiens
acccaggacaggatccaggc

SEQ ID NO: 5145273 - DNA, 21 bp, Homo sapiens
acccaggacatctcctggcta

SEQ ID NO: 5145274 - DNA, 14 bp, Homo sapiens
acccaggaccaagc

SEQ ID NO: 5145275 - DNA, 19 bp, Homo sapiens
acccaggaccatcctggag

SEQ ID NO: 5145276 - DNA, 23 bp, Homo sapiens
acccaggaccatcctggagggct

SEQ ID NO: 5145277 - DNA, 16 bp, Homo sapiens
acccaggacctctggg

SEQ ID NO: 5145278 - DNA, 22 bp, Homo sapiens
acccaggaggcagggaggcagc

SEQ ID NO: 5145279 - DNA, 23 bp, Homo sapiens
acccaggaggcagggaggcagcc

SEQ ID NO: 5145280 - DNA, 12 bp, Homo sapiens
acccaggaggcg

SEQ ID NO: 5145281 - DNA, 21 bp, Homo sapiens
acccaggaggctgaggcagga

SEQ ID NO: 5145282 - DNA, 20 bp, Homo sapiens
acccaggaggtggaggttgc

SEQ ID NO: 5145283 - DNA, 15 bp, Homo sapiens
acccaggagtccaga

SEQ ID NO: 5145284 - DNA, 16 bp, Homo sapiens
acccaggatgacccct

SEQ ID NO: 5145285 - DNA, 18 bp, Homo sapiens
acccaggatgacccctgg

SEQ ID NO: 5145286 - DNA, 15 bp, Homo sapiens
acccaggattcaaca

SEQ ID NO: 5145287 - DNA, 18 bp, Homo sapiens
acccaggcagctggcagg

SEQ ID NO: 5145288 - DNA, 17 bp, Homo sapiens
acccaggccactgacct

SEQ ID NO: 5145289 - DNA, 14 bp, Homo sapiens
acccaggccctcca

SEQ ID NO: 5145290 - DNA, 16 bp, Homo sapiens
acccaggccctccatg

SEQ ID NO: 5145291 - DNA, 19 bp, Homo sapiens
acccaggccctccatgggc

SEQ ID NO: 5145292 - DNA, 21 bp, Homo sapiens
acccaggccctccatgggcta

SEQ ID NO: 5145293 - DNA, 15 bp, Homo sapiens
acccaggccgcagct

SEQ ID NO: 5145294 - DNA, 22 bp, Homo sapiens
acccaggccgcagctcttgccc

SEQ ID NO: 5145295 - DNA, 23 bp, Homo sapiens
acccaggccgcagctcttgccct

SEQ ID NO: 5145296 - DNA, 16 bp, Homo sapiens
acccaggcctccctgc

SEQ ID NO: 5145297 - DNA, 18 bp, Homo sapiens
acccaggcctccctgcag

SEQ ID NO: 5145298 - DNA, 23 bp, Homo sapiens
acccaggcctccctgcagactcc

SEQ ID NO: 5145299 - DNA, 21 bp, Homo sapiens
acccaggcctgtggccccacc

SEQ ID NO: 5145300 - DNA, 11 bp, Homo sapiens
acccaggctcc

SEQ ID NO: 5145301 - DNA, 15 bp, Homo sapiens
acccaggctccatgg

SEQ ID NO: 5145302 - DNA, 19 bp, Homo sapiens
acccaggctccatggggaa

SEQ ID NO: 5145303 - DNA, 13 bp, Homo sapiens
acccaggctccca

SEQ ID NO: 5145304 - DNA, 15 bp, Homo sapiens
acccaggctcccagc

SEQ ID NO: 5145305 - DNA, 16 bp, Homo sapiens
acccaggctcccagcc

SEQ ID NO: 5145306 - DNA, 17 bp, Homo sapiens
acccaggctcccagcct

SEQ ID NO: 5145307 - DNA, 20 bp, Homo sapiens
acccaggctctggagccaga

SEQ ID NO: 5145308 - DNA, 12 bp, Homo sapiens
acccaggctgca

SEQ ID NO: 5145309 - DNA, 15 bp, Homo sapiens
acccaggctgcactg

SEQ ID NO: 5145310 - DNA, 16 bp, Homo sapiens
acccaggctgcactgc

SEQ ID NO: 5145311 - DNA, 18 bp, Homo sapiens
acccaggctgcactgcag

SEQ ID NO: 5145312 - DNA, 20 bp, Homo sapiens
acccaggctgcactgcagtg

SEQ ID NO: 5145313 - DNA, 11 bp, Homo sapiens
acccaggctgg

SEQ ID NO: 5145314 - DNA, 22 bp, Homo sapiens
acccaggctgggcaaggaggcc

SEQ ID NO: 5145315 - DNA, 23 bp, Homo sapiens
acccaggctggtctcaaactcct

SEQ ID NO: 5145316 - DNA, 16 bp, Homo sapiens
acccagggactctcca

SEQ ID NO: 5145317 - DNA, 21 bp, Homo sapiens
acccagggagctgatgcccct

SEQ ID NO: 5145318 - DNA, 15 bp, Homo sapiens
acccagggcccggca

SEQ ID NO: 5145319 - DNA, 14 bp, Homo sapiens
acccagggcctagg

SEQ ID NO: 5145320 - DNA, 15 bp, Homo sapiens
acccagggcctgact

SEQ ID NO: 5145321 - DNA, 16 bp, Homo sapiens
acccagggcctgactt

SEQ ID NO: 5145322 - DNA, 17 bp, Homo sapiens
acccagggcctgacttg

SEQ ID NO: 5145323 - DNA, 22 bp, Homo sapiens
acccagggcctgacttgagcca

SEQ ID NO: 5145324 - DNA, 20 bp, Homo sapiens
acccagggctccctcctgga

SEQ ID NO: 5145325 - DNA, 18 bp, Homo sapiens
acccagggctctgcagca

SEQ ID NO: 5145326 - DNA, 21 bp, Homo sapiens
acccagggctctgcagcacct

SEQ ID NO: 5145327 - DNA, 15 bp, Homo sapiens
acccagggctctgcc

SEQ ID NO: 5145328 - DNA, 19 bp, Homo sapiens
acccagggctctgccccag

SEQ ID NO: 5145329 - DNA, 21 bp, Homo sapiens
acccagggctctgccccagtc

SEQ ID NO: 5145330 - DNA, 16 bp, Homo sapiens
acccaggggacagctg

SEQ ID NO: 5145331 - DNA, 15 bp, Homo sapiens
acccaggggcagccc

SEQ ID NO: 5145332 - DNA, 20 bp, Homo sapiens
acccagggggctgaaacttg

SEQ ID NO: 5145333 - DNA, 21 bp, Homo sapiens
acccagggggctgaaacttga

SEQ ID NO: 5145334 - DNA, 16 bp, Homo sapiens
aaactaaaatagttta

SEQ ID NO: 5145335 - DNA, 16 bp, Homo sapiens
aaactaaaattcaaca

SEQ ID NO: 5145336 - DNA, 14 bp, Homo sapiens
aaactaaacagaaa

SEQ ID NO: 5145337 - DNA, 16 bp, Homo sapiens
aaactaaactacagaa

SEQ ID NO: 5145338 - DNA, 16 bp, Homo sapiens
aaactaaagcaataga

SEQ ID NO: 5145339 - DNA, 16 bp, Homo sapiens
aaactaaatagcatgt

SEQ ID NO: 5145340 - DNA, 15 bp, Homo sapiens
aaactaaatatatgt

SEQ ID NO: 5145341 - DNA, 17 bp, Homo sapiens
aaactaaatctctaata

SEQ ID NO: 5145342 - DNA, 17 bp, Homo sapiens
aaactaaatgtgtacac

SEQ ID NO: 5145343 - DNA, 22 bp, Homo sapiens
aaactaaattactgttttatgt

SEQ ID NO: 5145344 - DNA, 15 bp, Homo sapiens
aaactaaattgtaaa

SEQ ID NO: 5145345 - DNA, 15 bp, Homo sapiens
aaactaacaatatga

SEQ ID NO: 5145346 - DNA, 17 bp, Homo sapiens
aaactaacacattttta

SEQ ID NO: 5145347 - DNA, 20 bp, Homo sapiens
aaactaaccttgaataaggc

SEQ ID NO: 5145348 - DNA, 15 bp, Homo sapiens
aaactaagatttatc

SEQ ID NO: 5145349 - DNA, 19 bp, Homo sapiens
aaactaaggcttttatttc

SEQ ID NO: 5145350 - DNA, 13 bp, Homo sapiens
aaactaataaaat

SEQ ID NO: 5145351 - DNA, 19 bp, Homo sapiens
aaactaataaaatattttc

SEQ ID NO: 5145352 - DNA, 20 bp, Homo sapiens
aaactaatggtccacaccca

SEQ ID NO: 5145353 - DNA, 22 bp, Homo sapiens
aaactaatgtactgtacataaa

SEQ ID NO: 5145354 - DNA, 12 bp, Homo sapiens
aaactaatgtga

SEQ ID NO: 5145355 - DNA, 13 bp, Homo sapiens
aaactaattaaac

SEQ ID NO: 5145356 - DNA, 17 bp, Homo sapiens
aaactacaaaaattaac

SEQ ID NO: 5145357 - DNA, 21 bp, Homo sapiens
aaactacaaacgtttgacaaa

SEQ ID NO: 5145358 - DNA, 17 bp, Homo sapiens
aaactacaaagctgaag

SEQ ID NO: 5145359 - DNA, 22 bp, Homo sapiens
aaactacacatccctaatgtgt

SEQ ID NO: 5145360 - DNA, 16 bp, Homo sapiens
aaactacaccacacta

SEQ ID NO: 5145361 - DNA, 23 bp, Homo sapiens
aaactacagaatattaaatatta

SEQ ID NO: 5145362 - DNA, 18 bp, Homo sapiens
aaactacattgacagatt

SEQ ID NO: 5145363 - DNA, 15 bp, Homo sapiens
aaactacattttaac

SEQ ID NO: 5145364 - DNA, 18 bp, Homo sapiens
aaactacattttaacatg

SEQ ID NO: 5145365 - DNA, 16 bp, Homo sapiens
aaactacattttgcaa

SEQ ID NO: 5145366 - DNA, 14 bp, Homo sapiens
aaactaccacctca

SEQ ID NO: 5145367 - DNA, 22 bp, Homo sapiens
aaactaccaggtgtgcctggaa

SEQ ID NO: 5145368 - DNA, 19 bp, Homo sapiens
aaactaccagtgggcatgt

SEQ ID NO: 5145369 - DNA, 16 bp, Homo sapiens
aaactacctaaaataa

SEQ ID NO: 5145370 - DNA, 20 bp, Homo sapiens
aaactacctaacattattta

SEQ ID NO: 5145371 - DNA, 17 bp, Homo sapiens
aaactacctatattcct

SEQ ID NO: 5145372 - DNA, 20 bp, Homo sapiens
aaactacctcaaaacacttt

SEQ ID NO: 5145373 - DNA, 19 bp, Homo sapiens
aaactactaatctcaattt

SEQ ID NO: 5145374 - DNA, 22 bp, Homo sapiens
aaactactatttttctttccaa

SEQ ID NO: 5145375 - DNA, 18 bp, Homo sapiens
aaactactgaataaatca

SEQ ID NO: 5145376 - DNA, 21 bp, Homo sapiens
aaactactgaatgaagcagta

SEQ ID NO: 5145377 - DNA, 20 bp, Homo sapiens
aaactactgattacttgtaa

SEQ ID NO: 5145378 - DNA, 19 bp, Homo sapiens
aaactactgcctttagaaa

SEQ ID NO: 5145379 - DNA, 18 bp, Homo sapiens
aaactactgcctttcaaa

SEQ ID NO: 5145380 - DNA, 12 bp, Homo sapiens
aaactactgtaa

SEQ ID NO: 5145381 - DNA, 14 bp, Homo sapiens
aaactactgtacat

SEQ ID NO: 5145382 - DNA, 19 bp, Homo sapiens
aaactactgtacatttttt

SEQ ID NO: 5145383 - DNA, 20 bp, Homo sapiens
aaactactgtatctgatgtt

SEQ ID NO: 5145384 - DNA, 14 bp, Homo sapiens
aaactactgtgtca

SEQ ID NO: 5145385 - DNA, 16 bp, Homo sapiens
aaactactttgctgct

SEQ ID NO: 5145386 - DNA, 20 bp, Homo sapiens
aaactactttgctgctaata

SEQ ID NO: 5145387 - DNA, 18 bp, Homo sapiens
aaactacttttctaaaat

SEQ ID NO: 5145388 - DNA, 15 bp, Homo sapiens
aaactagaaaaggaa

SEQ ID NO: 5145389 - DNA, 23 bp, Homo sapiens
aaactagaaagcagagattttca

SEQ ID NO: 5145390 - DNA, 22 bp, Homo sapiens
aaactagaaatctgtcctgtgg

SEQ ID NO: 5145391 - DNA, 16 bp, Homo sapiens
aaactagaagtcaaaa

SEQ ID NO: 5145392 - DNA, 15 bp, Homo sapiens
aaactagaatttcat

SEQ ID NO: 5145393 - DNA, 21 bp, Homo sapiens
aaactagacttgaggaaacca

SEQ ID NO: 5145394 - DNA, 20 bp, Homo sapiens
aaactagataacttaaataa

SEQ ID NO: 5145395 - DNA, 15 bp, Homo sapiens
aaactagatgacctc

SEQ ID NO: 5145396 - DNA, 16 bp, Homo sapiens
aaactagatgacctca

SEQ ID NO: 5145397 - DNA, 20 bp, Homo sapiens
aaactagatgacctcattaa

SEQ ID NO: 5145398 - DNA, 16 bp, Homo sapiens
aaactagattgactat

SEQ ID NO: 5145399 - DNA, 18 bp, Homo sapiens
aaactagatttataaatg

SEQ ID NO: 5145400 - DNA, 15 bp, Homo sapiens
aaactagcaactctt

SEQ ID NO: 5145401 - DNA, 15 bp, Homo sapiens
aaactagctgtcact

SEQ ID NO: 5145402 - DNA, 13 bp, Homo sapiens
aaactaggaaaat

SEQ ID NO: 5145403 - DNA, 15 bp, Homo sapiens
aaactaggaaaattg

SEQ ID NO: 5145404 - DNA, 19 bp, Homo sapiens
aaactaggcatttgtaaat

SEQ ID NO: 5145405 - DNA, 18 bp, Homo sapiens
aaactagggccaagccca

SEQ ID NO: 5145406 - DNA, 20 bp, Homo sapiens
aaactaggggacaaagcaaa

SEQ ID NO: 5145407 - DNA, 18 bp, Homo sapiens
aaactagggttttggcct

SEQ ID NO: 5145408 - DNA, 19 bp, Homo sapiens
aaactagggttttggcctg

SEQ ID NO: 5145409 - DNA, 14 bp, Homo sapiens
aaactaggtaatgt

SEQ ID NO: 5145410 - DNA, 20 bp, Homo sapiens
aaactaggtaatgttttgta

SEQ ID NO: 5145411 - DNA, 21 bp, Homo sapiens
aaactaggtaatgttttgtat

SEQ ID NO: 5145412 - DNA, 22 bp, Homo sapiens
aaactaggtaatgttttgtata

SEQ ID NO: 5145413 - DNA, 22 bp, Homo sapiens
aaactagtaatgggccaattaa

SEQ ID NO: 5145414 - DNA, 17 bp, Homo sapiens
aaactagtatcatttta

SEQ ID NO: 5145415 - DNA, 12 bp, Homo sapiens
aaactagtgttt

SEQ ID NO: 5145416 - DNA, 22 bp, Homo sapiens
aaactagttactaaacatgtat

SEQ ID NO: 5145417 - DNA, 17 bp, Homo sapiens
aaactagttataaaaat

SEQ ID NO: 5145418 - DNA, 19 bp, Homo sapiens
aaactagttattttataat

SEQ ID NO: 5145419 - DNA, 15 bp, Homo sapiens
aaactagtttttcct

SEQ ID NO: 5145420 - DNA, 16 bp, Homo sapiens
aaactagtttttccta

SEQ ID NO: 5145421 - DNA, 17 bp, Homo sapiens
aaactataaaaaagaaa

SEQ ID NO: 5145422 - DNA, 22 bp, Homo sapiens
aaactataaaaaagaaagaatt

SEQ ID NO: 5145423 - DNA, 17 bp, Homo sapiens
aaactataaaacaaaaa

SEQ ID NO: 5145424 - DNA, 23 bp, Homo sapiens
aaactataacattatataacaaa

SEQ ID NO: 5145425 - DNA, 22 bp, Homo sapiens
aaactataagcaagaaggcaaa

SEQ ID NO: 5145426 - DNA, 18 bp, Homo sapiens
aaactatatttatttatg

SEQ ID NO: 5145427 - DNA, 23 bp, Homo sapiens
aaactatatttatttatgtagga

SEQ ID NO: 5145428 - DNA, 18 bp, Homo sapiens
aaactatattttgtcata

SEQ ID NO: 5145429 - DNA, 19 bp, Homo sapiens
aaactatcaagagagtaaa

SEQ ID NO: 5145430 - DNA, 17 bp, Homo sapiens
aaactatccaattaaaa

SEQ ID NO: 5145431 - DNA, 22 bp, Homo sapiens
aaactatcctatgccttcaaat

SEQ ID NO: 5145432 - DNA, 17 bp, Homo sapiens
aaactatcctgattcca

SEQ ID NO: 5145433 - DNA, 19 bp, Homo sapiens
aaactatccttctctttca

SEQ ID NO: 5145434 - DNA, 15 bp, Homo sapiens
aaactatctggccat

SEQ ID NO: 5145435 - DNA, 16 bp, Homo sapiens
aaactatcttggtgaa

SEQ ID NO: 5145436 - DNA, 18 bp, Homo sapiens
aaactatgacaatttttg

SEQ ID NO: 5145437 - DNA, 16 bp, Homo sapiens
aaactatgcaagagaa

SEQ ID NO: 5145438 - DNA, 19 bp, Homo sapiens
aaactatgcatctgagaaa

SEQ ID NO: 5145439 - DNA, 13 bp, Homo sapiens
aaactatggaaat

SEQ ID NO: 5145440 - DNA, 16 bp, Homo sapiens
aaactatggttcccaa

SEQ ID NO: 5145441 - DNA, 17 bp, Homo sapiens
aaactatggttcccaat

SEQ ID NO: 5145442 - DNA, 19 bp, Homo sapiens
aaactatgtattaatttag

SEQ ID NO: 5145443 - DNA, 15 bp, Homo sapiens
aaactatgttcctaa

SEQ ID NO: 5145444 - DNA, 22 bp, Homo sapiens
aaactattagagtatttccctt

SEQ ID NO: 5145445 - DNA, 14 bp, Homo sapiens
aaactattcttaat

SEQ ID NO: 5145446 - DNA, 18 bp, Homo sapiens
aaactattgagccttgca

SEQ ID NO: 5145447 - DNA, 20 bp, Homo sapiens
aaactattgagccttgcatg

SEQ ID NO: 5145448 - DNA, 17 bp, Homo sapiens
aaactatttaaaattgg

SEQ ID NO: 5145449 - DNA, 19 bp, Homo sapiens
aaactatttagtgttagtt

SEQ ID NO: 5145450 - DNA, 18 bp, Homo sapiens
aaactatttatatcacac

SEQ ID NO: 5145451 - DNA, 13 bp, Homo sapiens
aaactatttgtat

SEQ ID NO: 5145452 - DNA, 15 bp, Homo sapiens
aaactatttttgtaa

SEQ ID NO: 5145453 - DNA, 20 bp, Homo sapiens
aaactatttttgtaaaagac

SEQ ID NO: 5145454 - DNA, 17 bp, Homo sapiens
aaactattttttaaaaa

SEQ ID NO: 5145455 - DNA, 18 bp, Homo sapiens
aaactattttttaaaaat

SEQ ID NO: 5145456 - DNA, 18 bp, Homo sapiens
aaactcaaagaatgtgta

SEQ ID NO: 5145457 - DNA, 11 bp, Homo sapiens
aaactcaaatg

SEQ ID NO: 5145458 - DNA, 14 bp, Homo sapiens
aaactcaaggaaaa

SEQ ID NO: 5145459 - DNA, 23 bp, Homo sapiens
aaactcaaggaggtggtgaattt

SEQ ID NO: 5145460 - DNA, 14 bp, Homo sapiens
aaactcaatgcttt

SEQ ID NO: 5145461 - DNA, 18 bp, Homo sapiens
aaactcaatgctttattt

SEQ ID NO: 5145462 - DNA, 23 bp, Homo sapiens
aaactcaatgctttatttgtaaa

SEQ ID NO: 5145463 - DNA, 15 bp, Homo sapiens
aaactcacaaatgat

SEQ ID NO: 5145464 - DNA, 13 bp, Homo sapiens
aaactcaccattt

SEQ ID NO: 5145465 - DNA, 20 bp, Homo sapiens
aaactcaccatttcatccat

SEQ ID NO: 5145466 - DNA, 16 bp, Homo sapiens
aaactcacctgctggc

SEQ ID NO: 5145467 - DNA, 23 bp, Homo sapiens
aaactcactcactgtttataaat

SEQ ID NO: 5145468 - DNA, 15 bp, Homo sapiens
aaactcactgctcaa

SEQ ID NO: 5145469 - DNA, 17 bp, Homo sapiens
aaactcagatccttggt

SEQ ID NO: 5145470 - DNA, 14 bp, Homo sapiens
aaactcagatctga

SEQ ID NO: 5145471 - DNA, 13 bp, Homo sapiens
aaactcagatgtc

SEQ ID NO: 5145472 - DNA, 17 bp, Homo sapiens
aaactcagatgtccaaa

SEQ ID NO: 5145473 - DNA, 17 bp, Homo sapiens
aaactcagatttaaaac

SEQ ID NO: 5145474 - DNA, 21 bp, Homo sapiens
aaactcagcctgggacagttt

SEQ ID NO: 5145475 - DNA, 23 bp, Homo sapiens
aaactcaggatggtcatcttgga

SEQ ID NO: 5145476 - DNA, 13 bp, Homo sapiens
aaactcaggccca

SEQ ID NO: 5145477 - DNA, 14 bp, Homo sapiens
aaactcaggcccag

SEQ ID NO: 5145478 - DNA, 18 bp, Homo sapiens
aaactcagggacagagcc

SEQ ID NO: 5145479 - DNA, 22 bp, Homo sapiens
aaactcagtctcaaataataat

SEQ ID NO: 5145480 - DNA, 15 bp, Homo sapiens
aaactcatattttga

SEQ ID NO: 5145481 - DNA, 16 bp, Homo sapiens
aaactcatcacataaa

SEQ ID NO: 5145482 - DNA, 14 bp, Homo sapiens
aaactcatctcatt

SEQ ID NO: 5145483 - DNA, 17 bp, Homo sapiens
aaactcattgcagcaga

SEQ ID NO: 5145484 - DNA, 19 bp, Homo sapiens
aaactcattgcagcagata

SEQ ID NO: 5145485 - DNA, 15 bp, Homo sapiens
aaactcatttataaa

SEQ ID NO: 5145486 - DNA, 24 bp, Homo sapiens
aaactcatttataaagctaaaata

SEQ ID NO: 5145487 - DNA, 15 bp, Homo sapiens
aaactcattttgctt

SEQ ID NO: 5145488 - DNA, 17 bp, Homo sapiens
aaactccacagggactg

SEQ ID NO: 5145489 - DNA, 17 bp, Homo sapiens
aaactccacatctgcct

SEQ ID NO: 5145490 - DNA, 10 bp, Homo sapiens
aaactccagg

SEQ ID NO: 5145491 - DNA, 23 bp, Homo sapiens
aaactccaggatttataaagcaa

SEQ ID NO: 5145492 - DNA, 11 bp, Homo sapiens
aaactccaggc

SEQ ID NO: 5145493 - DNA, 14 bp, Homo sapiens
aaactccattcata

SEQ ID NO: 5145494 - DNA, 10 bp, Homo sapiens
aaactcccac

SEQ ID NO: 5145495 - DNA, 15 bp, Homo sapiens
aaactcccttgtgtt

SEQ ID NO: 5145496 - DNA, 14 bp, Homo sapiens
aaactccgaagaaa

SEQ ID NO: 5145497 - DNA, 18 bp, Homo sapiens
aaactccggcactgggtt

SEQ ID NO: 5145498 - DNA, 15 bp, Homo sapiens
aaactcctactgctt

SEQ ID NO: 5145499 - DNA, 23 bp, Homo sapiens
aaactcctactgcttcctctgaa

SEQ ID NO: 5145500 - DNA, 12 bp, Homo sapiens
aaactcctattt

SEQ ID NO: 5145501 - DNA, 12 bp, Homo sapiens
aaactcctgcct

SEQ ID NO: 5145502 - DNA, 14 bp, Homo sapiens
aaactcctgcctgt

SEQ ID NO: 5145503 - DNA, 20 bp, Homo sapiens
aaactccttcctggcctgag

SEQ ID NO: 5145504 - DNA, 13 bp, Homo sapiens
aaactcctttctt

SEQ ID NO: 5145505 - DNA, 20 bp, Homo sapiens
aaactccttttgctgtcttt

SEQ ID NO: 5145506 - DNA, 17 bp, Homo sapiens
aaactcgaggactgtat

SEQ ID NO: 5145507 - DNA, 20 bp, Homo sapiens
aaactcgaggactgtatttg

SEQ ID NO: 5145508 - DNA, 23 bp, Homo sapiens
aaactcgcttttattttaatatt

SEQ ID NO: 5145509 - DNA, 18 bp, Homo sapiens
aaactcgggggtgctggg

SEQ ID NO: 5145510 - DNA, 16 bp, Homo sapiens
aaactcgttttttaca

SEQ ID NO: 5145511 - DNA, 20 bp, Homo sapiens
aaactctaaacattaatcaa

SEQ ID NO: 5145512 - DNA, 19 bp, Homo sapiens
aaactctacaccctctgcc

SEQ ID NO: 5145513 - DNA, 16 bp, Homo sapiens
acccaggggtccaggc

SEQ ID NO: 5145514 - DNA, 17 bp, Homo sapiens
acccaggggtccaggcc

SEQ ID NO: 5145515 - DNA, 18 bp, Homo sapiens
acccaggggtccaggccc

SEQ ID NO: 5145516 - DNA, 13 bp, Homo sapiens
acccaggggtggg

SEQ ID NO: 5145517 - DNA, 19 bp, Homo sapiens
acccagggtggagtgcagt

SEQ ID NO: 5145518 - DNA, 21 bp, Homo sapiens
acccagggtggagtgcagtgg

SEQ ID NO: 5145519 - DNA, 21 bp, Homo sapiens
acccagggttcccgcggggct

SEQ ID NO: 5145520 - DNA, 22 bp, Homo sapiens
acccagggttcccgcggggctg

SEQ ID NO: 5145521 - DNA, 23 bp, Homo sapiens
acccaggtcccccgactgcctgt

SEQ ID NO: 5145522 - DNA, 14 bp, Homo sapiens
acccaggtcccctc

SEQ ID NO: 5145523 - DNA, 14 bp, Homo sapiens
acccaggtctccct

SEQ ID NO: 5145524 - DNA, 16 bp, Homo sapiens
acccaggtctgatgcc

SEQ ID NO: 5145525 - DNA, 17 bp, Homo sapiens
acccaggtctgatgcca

SEQ ID NO: 5145526 - DNA, 17 bp, Homo sapiens
acccaggtcttccagac

SEQ ID NO: 5145527 - DNA, 21 bp, Homo sapiens
acccaggtggagggcacagcc

SEQ ID NO: 5145528 - DNA, 22 bp, Homo sapiens
acccaggtggagggcacagccc

SEQ ID NO: 5145529 - DNA, 14 bp, Homo sapiens
acccaggtgggtcc

SEQ ID NO: 5145530 - DNA, 18 bp, Homo sapiens
acccaggtgggtcccggc

SEQ ID NO: 5145531 - DNA, 16 bp, Homo sapiens
acccaggtgtggccta

SEQ ID NO: 5145532 - DNA, 19 bp, Homo sapiens
acccaggttggagtgcagt

SEQ ID NO: 5145533 - DNA, 20 bp, Homo sapiens
acccaggttttgcactcttg

SEQ ID NO: 5145534 - DNA, 21 bp, Homo sapiens
acccagtaacttgcaaaaagt

SEQ ID NO: 5145535 - DNA, 18 bp, Homo sapiens
acccagtagggtttgaca

SEQ ID NO: 5145536 - DNA, 15 bp, Homo sapiens
acccagtattactgc

SEQ ID NO: 5145537 - DNA, 19 bp, Homo sapiens
acccagtattactgctgct

SEQ ID NO: 5145538 - DNA, 16 bp, Homo sapiens
acccagtcacctcccc

SEQ ID NO: 5145539 - DNA, 19 bp, Homo sapiens
acccagtcacctccccaca

SEQ ID NO: 5145540 - DNA, 16 bp, Homo sapiens
acccagtccacaaaat

SEQ ID NO: 5145541 - DNA, 16 bp, Homo sapiens
acccagtccatgctcc

SEQ ID NO: 5145542 - DNA, 17 bp, Homo sapiens
acccagtccatgctcca

SEQ ID NO: 5145543 - DNA, 15 bp, Homo sapiens
acccagtcccacact

SEQ ID NO: 5145544 - DNA, 22 bp, Homo sapiens
acccagtcccagaaccacactg

SEQ ID NO: 5145545 - DNA, 14 bp, Homo sapiens
acccagtccccacc

SEQ ID NO: 5145546 - DNA, 16 bp, Homo sapiens
acccagtccccacccg

SEQ ID NO: 5145547 - DNA, 23 bp, Homo sapiens
acccagtccccacccgcctgcag

SEQ ID NO: 5145548 - DNA, 22 bp, Homo sapiens
acccagtccgccaaacactcca

SEQ ID NO: 5145549 - DNA, 16 bp, Homo sapiens
acccagtcctgcccgc

SEQ ID NO: 5145550 - DNA, 16 bp, Homo sapiens
acccagtcctggccat

SEQ ID NO: 5145551 - DNA, 13 bp, Homo sapiens
acccagtcgccct

SEQ ID NO: 5145552 - DNA, 19 bp, Homo sapiens
acccagtcgcccttacttc

SEQ ID NO: 5145553 - DNA, 13 bp, Homo sapiens
acccagtctcctc

SEQ ID NO: 5145554 - DNA, 16 bp, Homo sapiens
acccagtctgttcccc

SEQ ID NO: 5145555 - DNA, 21 bp, Homo sapiens
acccagtctgttgctgctcca

SEQ ID NO: 5145556 - DNA, 21 bp, Homo sapiens
acccagtcttatttttctagt

SEQ ID NO: 5145557 - DNA, 18 bp, Homo sapiens
acccagtctttcttcact

SEQ ID NO: 5145558 - DNA, 20 bp, Homo sapiens
acccagtgagacagaccgcc

SEQ ID NO: 5145559 - DNA, 17 bp, Homo sapiens
acccagtgcagaatgta

SEQ ID NO: 5145560 - DNA, 18 bp, Homo sapiens
acccagtgcagaatgtaa

SEQ ID NO: 5145561 - DNA, 18 bp, Homo sapiens
acccagtgcccccactga

SEQ ID NO: 5145562 - DNA, 14 bp, Homo sapiens
acccagtgctgaat

SEQ ID NO: 5145563 - DNA, 13 bp, Homo sapiens
acccagtgctgcc

SEQ ID NO: 5145564 - DNA, 18 bp, Homo sapiens
acccagtgctgccatgcc

SEQ ID NO: 5145565 - DNA, 21 bp, Homo sapiens
acccagtgctgccatgccact

SEQ ID NO: 5145566 - DNA, 23 bp, Homo sapiens
acccagtgctgccatgccactgc

SEQ ID NO: 5145567 - DNA, 22 bp, Homo sapiens
acccagtggcagggcacagggc

SEQ ID NO: 5145568 - DNA, 14 bp, Homo sapiens
acccagtgggaaga

SEQ ID NO: 5145569 - DNA, 18 bp, Homo sapiens
acccagtgggtctgggat

SEQ ID NO: 5145570 - DNA, 15 bp, Homo sapiens
acccagtggtcagca

SEQ ID NO: 5145571 - DNA, 22 bp, Homo sapiens
acccagtgtaaagaataaatga

SEQ ID NO: 5145572 - DNA, 15 bp, Homo sapiens
acccagtgtctacct

SEQ ID NO: 5145573 - DNA, 12 bp, Homo sapiens
acccagtgttca

SEQ ID NO: 5145574 - DNA, 21 bp, Homo sapiens
acccagttacttttttacact

SEQ ID NO: 5145575 - DNA, 17 bp, Homo sapiens
acccagttgcctccagg

SEQ ID NO: 5145576 - DNA, 18 bp, Homo sapiens
acccagttgcctccaggg

SEQ ID NO: 5145577 - DNA, 21 bp, Homo sapiens
acccagttgctgatccctgct

SEQ ID NO: 5145578 - DNA, 22 bp, Homo sapiens
acccagttgctgatccctgctc

SEQ ID NO: 5145579 - DNA, 20 bp, Homo sapiens
acccagtttcctttcttagc

SEQ ID NO: 5145580 - DNA, 23 bp, Homo sapiens
acccataaacagcacacctgtgt

SEQ ID NO: 5145581 - DNA, 17 bp, Homo sapiens
acccataaacagtaatg

SEQ ID NO: 5145582 - DNA, 15 bp, Homo sapiens
acccataatcatgta

SEQ ID NO: 5145583 - DNA, 16 bp, Homo sapiens
acccatacaatgtatg

SEQ ID NO: 5145584 - DNA, 17 bp, Homo sapiens
acccatacaatgtatgt

SEQ ID NO: 5145585 - DNA, 21 bp, Homo sapiens
acccatacaatgtatgtacaa

SEQ ID NO: 5145586 - DNA, 14 bp, Homo sapiens
acccatacaccccc

SEQ ID NO: 5145587 - DNA, 14 bp, Homo sapiens
acccatagacagcc

SEQ ID NO: 5145588 - DNA, 21 bp, Homo sapiens
acccatagatcttctgaaatg

SEQ ID NO: 5145589 - DNA, 14 bp, Homo sapiens
acccataggcccac

SEQ ID NO: 5145590 - DNA, 17 bp, Homo sapiens
acccataggcccacaca

SEQ ID NO: 5145591 - DNA, 19 bp, Homo sapiens
acccataggcccacacaca

SEQ ID NO: 5145592 - DNA, 14 bp, Homo sapiens
acccatatcccctc

SEQ ID NO: 5145593 - DNA, 19 bp, Homo sapiens
acccatatcccctctcccc

SEQ ID NO: 5145594 - DNA, 20 bp, Homo sapiens
acccatatcccctctccccc

SEQ ID NO: 5145595 - DNA, 21 bp, Homo sapiens
acccatatcccctctcccccc

SEQ ID NO: 5145596 - DNA, 18 bp, Homo sapiens
acccatatctgtgcaatg

SEQ ID NO: 5145597 - DNA, 15 bp, Homo sapiens
acccatatctgtgtg

SEQ ID NO: 5145598 - DNA, 20 bp, Homo sapiens
acccatattgtaaaacaggt

SEQ ID NO: 5145599 - DNA, 14 bp, Homo sapiens
acccatcactgtgt

SEQ ID NO: 5145600 - DNA, 18 bp, Homo sapiens
acccatcagaaggagaag

SEQ ID NO: 5145601 - DNA, 17 bp, Homo sapiens
acccatcagacaggtaa

SEQ ID NO: 5145602 - DNA, 15 bp, Homo sapiens
acccatcagcactct

SEQ ID NO: 5145603 - DNA, 18 bp, Homo sapiens
acccatcagttccagcct

SEQ ID NO: 5145604 - DNA, 18 bp, Homo sapiens
acccatccctgcctggag

SEQ ID NO: 5145605 - DNA, 21 bp, Homo sapiens
acccatcccttttcctttctg

SEQ ID NO: 5145606 - DNA, 19 bp, Homo sapiens
acccatcctaggaaccagc

SEQ ID NO: 5145607 - DNA, 19 bp, Homo sapiens
acccatcggtgtccattta

SEQ ID NO: 5145608 - DNA, 19 bp, Homo sapiens
acccatcgtataaggaaat

SEQ ID NO: 5145609 - DNA, 13 bp, Homo sapiens
acccatctccccc

SEQ ID NO: 5145610 - DNA, 13 bp, Homo sapiens
acccatctgcacc

SEQ ID NO: 5145611 - DNA, 20 bp, Homo sapiens
acccatctgtagtaatttat

SEQ ID NO: 5145612 - DNA, 18 bp, Homo sapiens
acccatcttcctgctgct

SEQ ID NO: 5145613 - DNA, 20 bp, Homo sapiens
acccatcttcctgctgctgt

SEQ ID NO: 5145614 - DNA, 15 bp, Homo sapiens
acccatcttgaaaaa

SEQ ID NO: 5145615 - DNA, 22 bp, Homo sapiens
acccatcttgaaaaacactatt

SEQ ID NO: 5145616 - DNA, 16 bp, Homo sapiens
acccatcttgcttcca

SEQ ID NO: 5145617 - DNA, 17 bp, Homo sapiens
acccatctttctcacac

SEQ ID NO: 5145618 - DNA, 16 bp, Homo sapiens
acccatgaaacagcag

SEQ ID NO: 5145619 - DNA, 18 bp, Homo sapiens
acccatgaaacagcagct

SEQ ID NO: 5145620 - DNA, 11 bp, Homo sapiens
acccatgaagc

SEQ ID NO: 5145621 - DNA, 14 bp, Homo sapiens
acccatgaagctgg

SEQ ID NO: 5145622 - DNA, 19 bp, Homo sapiens
acccatgaagctggccctc

SEQ ID NO: 5145623 - DNA, 17 bp, Homo sapiens
acccatgaatcaaagac

SEQ ID NO: 5145624 - DNA, 23 bp, Homo sapiens
acccatgactttatatggatgat

SEQ ID NO: 5145625 - DNA, 13 bp, Homo sapiens
acccatgagcctg

SEQ ID NO: 5145626 - DNA, 14 bp, Homo sapiens
acccatgagcctgc

SEQ ID NO: 5145627 - DNA, 20 bp, Homo sapiens
acccatgagcgtccaggtga

SEQ ID NO: 5145628 - DNA, 21 bp, Homo sapiens
acccatgagcgtccaggtgat

SEQ ID NO: 5145629 - DNA, 16 bp, Homo sapiens
acccatgcagctgctc

SEQ ID NO: 5145630 - DNA, 17 bp, Homo sapiens
acccatgcagctgctcc

SEQ ID NO: 5145631 - DNA, 15 bp, Homo sapiens
acccatgcatggcct

SEQ ID NO: 5145632 - DNA, 20 bp, Homo sapiens
acccatgcatggcctcccag

SEQ ID NO: 5145633 - DNA, 23 bp, Homo sapiens
acccatgcatggcctcccagcca

SEQ ID NO: 5145634 - DNA, 14 bp, Homo sapiens
acccatgccagcgc

SEQ ID NO: 5145635 - DNA, 16 bp, Homo sapiens
acccatgccagcgcag

SEQ ID NO: 5145636 - DNA, 16 bp, Homo sapiens
acccatgccccactct

SEQ ID NO: 5145637 - DNA, 14 bp, Homo sapiens
acccatgcccctga

SEQ ID NO: 5145638 - DNA, 15 bp, Homo sapiens
acccatgccctggac

SEQ ID NO: 5145639 - DNA, 21 bp, Homo sapiens
acccatgccctggaccagccg

SEQ ID NO: 5145640 - DNA, 13 bp, Homo sapiens
acccatgctgccc

SEQ ID NO: 5145641 - DNA, 14 bp, Homo sapiens
acccatgctgccct

SEQ ID NO: 5145642 - DNA, 16 bp, Homo sapiens
acccatgctgccctgt

SEQ ID NO: 5145643 - DNA, 17 bp, Homo sapiens
acccatgctgccctgtg

SEQ ID NO: 5145644 - DNA, 18 bp, Homo sapiens
acccatggaaaaatgcca

SEQ ID NO: 5145645 - DNA, 15 bp, Homo sapiens
acccatggcctcaga

SEQ ID NO: 5145646 - DNA, 17 bp, Homo sapiens
acccatgggcaggagac

SEQ ID NO: 5145647 - DNA, 16 bp, Homo sapiens
acccatgggctctgac

SEQ ID NO: 5145648 - DNA, 17 bp, Homo sapiens
acccatgggctctgaca

SEQ ID NO: 5145649 - DNA, 12 bp, Homo sapiens
acccatggggag

SEQ ID NO: 5145650 - DNA, 20 bp, Homo sapiens
acccatggggaggagacctt

SEQ ID NO: 5145651 - DNA, 16 bp, Homo sapiens
acccatgtaaccactg

SEQ ID NO: 5145652 - DNA, 17 bp, Homo sapiens
acccatgtaaccactgc

SEQ ID NO: 5145653 - DNA, 22 bp, Homo sapiens
acccatgtaatccttttgttta

SEQ ID NO: 5145654 - DNA, 12 bp, Homo sapiens
acccatgtcacc

SEQ ID NO: 5145655 - DNA, 23 bp, Homo sapiens
acccatgtcaccggtcagtgcct

SEQ ID NO: 5145656 - DNA, 22 bp, Homo sapiens
acccatgtgctgggaaatgcag

SEQ ID NO: 5145657 - DNA, 20 bp, Homo sapiens
acccatgtgttaaaatactc

SEQ ID NO: 5145658 - DNA, 19 bp, Homo sapiens
acccatgttacttctctga

SEQ ID NO: 5145659 - DNA, 16 bp, Homo sapiens
acccatgtttctctgg

SEQ ID NO: 5145660 - DNA, 21 bp, Homo sapiens
acccattaaggggaagaatga

SEQ ID NO: 5145661 - DNA, 16 bp, Homo sapiens
acccattaggcatgcc

SEQ ID NO: 5145662 - DNA, 18 bp, Homo sapiens
acccattcactacaggtg

SEQ ID NO: 5145663 - DNA, 17 bp, Homo sapiens
acccattccagtacagt

SEQ ID NO: 5145664 - DNA, 19 bp, Homo sapiens
acccattcccccatgtggc

SEQ ID NO: 5145665 - DNA, 18 bp, Homo sapiens
acccattccttagctatt

SEQ ID NO: 5145666 - DNA, 13 bp, Homo sapiens
acccattccttcc

SEQ ID NO: 5145667 - DNA, 15 bp, Homo sapiens
acccattccttccca

SEQ ID NO: 5145668 - DNA, 19 bp, Homo sapiens
acccattctacacagagca

SEQ ID NO: 5145669 - DNA, 23 bp, Homo sapiens
acccattctgttttcccccagca

SEQ ID NO: 5145670 - DNA, 13 bp, Homo sapiens
acccattgtctca

SEQ ID NO: 5145671 - DNA, 18 bp, Homo sapiens
acccattgttcccttcct

SEQ ID NO: 5145672 - DNA, 19 bp, Homo sapiens
acccattgttcccttcctc

SEQ ID NO: 5145673 - DNA, 18 bp, Homo sapiens
acccattgttgtcaagga

SEQ ID NO: 5145674 - DNA, 20 bp, Homo sapiens
acccatttaaatttttttcc

SEQ ID NO: 5145675 - DNA, 18 bp, Homo sapiens
acccatttaatcaccatg

SEQ ID NO: 5145676 - DNA, 22 bp, Homo sapiens
acccatttaatttctattgtgt

SEQ ID NO: 5145677 - DNA, 14 bp, Homo sapiens
acccatttacaaat

SEQ ID NO: 5145678 - DNA, 17 bp, Homo sapiens
acccatttgccatgctg

SEQ ID NO: 5145679 - DNA, 19 bp, Homo sapiens
acccatttgccatgctgct

SEQ ID NO: 5145680 - DNA, 17 bp, Homo sapiens
acccatttttccttttg

SEQ ID NO: 5145681 - DNA, 17 bp, Homo sapiens
acccatttttgagccaa

SEQ ID NO: 5145682 - DNA, 22 bp, Homo sapiens
accccaaaattagccagtaatc

SEQ ID NO: 5145683 - DNA, 20 bp, Homo sapiens
accccaaacaccttccagct

SEQ ID NO: 5145684 - DNA, 19 bp, Homo sapiens
accccaaacagtgactgta

SEQ ID NO: 5145685 - DNA, 20 bp, Homo sapiens
accccaaagactctggaggt

SEQ ID NO: 5145686 - DNA, 14 bp, Homo sapiens
accccaaagagcct

SEQ ID NO: 5145687 - DNA, 15 bp, Homo sapiens
accccaaagagcctg

SEQ ID NO: 5145688 - DNA, 22 bp, Homo sapiens
accccaaagagcctggagaagc

SEQ ID NO: 5145689 - DNA, 17 bp, Homo sapiens
accccaaagctttcctg

SEQ ID NO: 5145690 - DNA, 20 bp, Homo sapiens
accccaaagtccaggctaat

SEQ ID NO: 5145691 - DNA, 23 bp, Homo sapiens
accctcatcaccaacgtctgtgc

SEQ ID NO: 5145692 - DNA, 19 bp, Homo sapiens
accctcatctttcttccaa

SEQ ID NO: 5145693 - DNA, 22 bp, Homo sapiens
accctcatgctgccaatatcct

SEQ ID NO: 5145694 - DNA, 19 bp, Homo sapiens
accctcatggcccccaggg

SEQ ID NO: 5145695 - DNA, 14 bp, Homo sapiens
accctcatgttctt

SEQ ID NO: 5145696 - DNA, 17 bp, Homo sapiens
accctcatgttcttaat

SEQ ID NO: 5145697 - DNA, 20 bp, Homo sapiens
accctcattgctgtcttgcc

SEQ ID NO: 5145698 - DNA, 16 bp, Homo sapiens
accctcattgtgtttc

SEQ ID NO: 5145699 - DNA, 17 bp, Homo sapiens
accctcattgtgtttct

SEQ ID NO: 5145700 - DNA, 18 bp, Homo sapiens
accctccaaacactgggc

SEQ ID NO: 5145701 - DNA, 11 bp, Homo sapiens
accctccaaat

SEQ ID NO: 5145702 - DNA, 11 bp, Homo sapiens
accctccaagg

SEQ ID NO: 5145703 - DNA, 21 bp, Homo sapiens
accctccaagtctgtacctca

SEQ ID NO: 5145704 - DNA, 23 bp, Homo sapiens
accctccaagtctgtacctcaaa

SEQ ID NO: 5145705 - DNA, 14 bp, Homo sapiens
accctccaccctgt

SEQ ID NO: 5145706 - DNA, 20 bp, Homo sapiens
accctccaccgcagaaggaa

SEQ ID NO: 5145707 - DNA, 21 bp, Homo sapiens
accctccaccgcagaaggaag

SEQ ID NO: 5145708 - DNA, 17 bp, Homo sapiens
accctccacctcctctc

SEQ ID NO: 5145709 - DNA, 14 bp, Homo sapiens
accctccacctctc

SEQ ID NO: 5145710 - DNA, 12 bp, Homo sapiens
accctccacctt

SEQ ID NO: 5145711 - DNA, 15 bp, Homo sapiens
accctccaccttcca

SEQ ID NO: 5145712 - DNA, 13 bp, Homo sapiens
accctccactcac

SEQ ID NO: 5145713 - DNA, 15 bp, Homo sapiens
accctccacttctcc

SEQ ID NO: 5145714 - DNA, 15 bp, Homo sapiens
accctccagagacaa

SEQ ID NO: 5145715 - DNA, 13 bp, Homo sapiens
accctccagagtg

SEQ ID NO: 5145716 - DNA, 12 bp, Homo sapiens
accctccagcac

SEQ ID NO: 5145717 - DNA, 14 bp, Homo sapiens
accctccagcacag

SEQ ID NO: 5145718 - DNA, 17 bp, Homo sapiens
accctccagcacagact

SEQ ID NO: 5145719 - DNA, 19 bp, Homo sapiens
accctccagtgctggattt

SEQ ID NO: 5145720 - DNA, 20 bp, Homo sapiens
accctccagtgctggatttg

SEQ ID NO: 5145721 - DNA, 16 bp, Homo sapiens
accctccatgctcctc

SEQ ID NO: 5145722 - DNA, 13 bp, Homo sapiens
accctcccacccc

SEQ ID NO: 5145723 - DNA, 14 bp, Homo sapiens
accctcccaccccc

SEQ ID NO: 5145724 - DNA, 20 bp, Homo sapiens
accctcccacccccttctct

SEQ ID NO: 5145725 - DNA, 13 bp, Homo sapiens
accctcccagacc

SEQ ID NO: 5145726 - DNA, 15 bp, Homo sapiens
accctcccagacctg

SEQ ID NO: 5145727 - DNA, 11 bp, Homo sapiens
accctcccagg

SEQ ID NO: 5145728 - DNA, 22 bp, Homo sapiens
accctcccatgagactgccctg

SEQ ID NO: 5145729 - DNA, 14 bp, Homo sapiens
accctcccccgcag

SEQ ID NO: 5145730 - DNA, 12 bp, Homo sapiens
accctcccctct

SEQ ID NO: 5145731 - DNA, 14 bp, Homo sapiens
accctcccctctct

SEQ ID NO: 5145732 - DNA, 18 bp, Homo sapiens
accctcccctctcttgca

SEQ ID NO: 5145733 - DNA, 13 bp, Homo sapiens
accctcccctctt

SEQ ID NO: 5145734 - DNA, 19 bp, Homo sapiens
accctccccttcccagggc

SEQ ID NO: 5145735 - DNA, 21 bp, Homo sapiens
accctccccttcccagggcaa

SEQ ID NO: 5145736 - DNA, 15 bp, Homo sapiens
accctccccttttat

SEQ ID NO: 5145737 - DNA, 18 bp, Homo sapiens
accctccctcagcccctc

SEQ ID NO: 5145738 - DNA, 20 bp, Homo sapiens
accctccctcagcccctctt

SEQ ID NO: 5145739 - DNA, 11 bp, Homo sapiens
accctccctcc

SEQ ID NO: 5145740 - DNA, 22 bp, Homo sapiens
accctccctccgatccttcctc

SEQ ID NO: 5145741 - DNA, 23 bp, Homo sapiens
accctccctccgatccttcctcc

SEQ ID NO: 5145742 - DNA, 13 bp, Homo sapiens
accctccctggag

SEQ ID NO: 5145743 - DNA, 13 bp, Homo sapiens
accctccctgtcc

SEQ ID NO: 5145744 - DNA, 15 bp, Homo sapiens
accctccctgtcccc

SEQ ID NO: 5145745 - DNA, 18 bp, Homo sapiens
accctccctgtcccctga

SEQ ID NO: 5145746 - DNA, 15 bp, Homo sapiens
accctccgttgacag

SEQ ID NO: 5145747 - DNA, 16 bp, Homo sapiens
accctcctccctccaa

SEQ ID NO: 5145748 - DNA, 23 bp, Homo sapiens
accctcctccctccaagcctggc

SEQ ID NO: 5145749 - DNA, 12 bp, Homo sapiens
accctcctcctc

SEQ ID NO: 5145750 - DNA, 13 bp, Homo sapiens
accctcctcctct

SEQ ID NO: 5145751 - DNA, 21 bp, Homo sapiens
accctcctctagccatccctt

SEQ ID NO: 5145752 - DNA, 20 bp, Homo sapiens
accctcctctatttctttaa

SEQ ID NO: 5145753 - DNA, 15 bp, Homo sapiens
accctcctctgctgg

SEQ ID NO: 5145754 - DNA, 18 bp, Homo sapiens
accctcctctgctgggaa

SEQ ID NO: 5145755 - DNA, 11 bp, Homo sapiens
accctcctctt

SEQ ID NO: 5145756 - DNA, 15 bp, Homo sapiens
accctcctcttggaa

SEQ ID NO: 5145757 - DNA, 13 bp, Homo sapiens
accctcctgagcc

SEQ ID NO: 5145758 - DNA, 17 bp, Homo sapiens
accctcctgagcctcac

SEQ ID NO: 5145759 - DNA, 18 bp, Homo sapiens
accctcctgccccacact

SEQ ID NO: 5145760 - DNA, 20 bp, Homo sapiens
accctcctgccccacactcc

SEQ ID NO: 5145761 - DNA, 22 bp, Homo sapiens
accctcctgccccacactcccc

SEQ ID NO: 5145762 - DNA, 12 bp, Homo sapiens
accctcctgctg

SEQ ID NO: 5145763 - DNA, 17 bp, Homo sapiens
accctcctgctgagctg

SEQ ID NO: 5145764 - DNA, 18 bp, Homo sapiens
accctcctgctgagctgc

SEQ ID NO: 5145765 - DNA, 20 bp, Homo sapiens
accctcctgctgagctgccc

SEQ ID NO: 5145766 - DNA, 14 bp, Homo sapiens
accctcctggcaca

SEQ ID NO: 5145767 - DNA, 12 bp, Homo sapiens
accctcctggcc

SEQ ID NO: 5145768 - DNA, 22 bp, Homo sapiens
accctcctggcctcagactgca

SEQ ID NO: 5145769 - DNA, 15 bp, Homo sapiens
accctcctggccttc

SEQ ID NO: 5145770 - DNA, 21 bp, Homo sapiens
accctcctggccttcctcgtt

SEQ ID NO: 5145771 - DNA, 21 bp, Homo sapiens
accctcctgggaaggccacct

SEQ ID NO: 5145772 - DNA, 17 bp, Homo sapiens
accctcctgtaaatggt

SEQ ID NO: 5145773 - DNA, 16 bp, Homo sapiens
accctcctgtcttccc

SEQ ID NO: 5145774 - DNA, 20 bp, Homo sapiens
accctcctgttgcacccagc

SEQ ID NO: 5145775 - DNA, 22 bp, Homo sapiens
accctcctgttgcacccagccc

SEQ ID NO: 5145776 - DNA, 21 bp, Homo sapiens
accctccttccccaccccata

SEQ ID NO: 5145777 - DNA, 16 bp, Homo sapiens
accctccttctatttt

SEQ ID NO: 5145778 - DNA, 21 bp, Homo sapiens
accctcgaagcgcgccactcg

SEQ ID NO: 5145779 - DNA, 21 bp, Homo sapiens
accctcgagattaacggtgct

SEQ ID NO: 5145780 - DNA, 14 bp, Homo sapiens
accctcgaggcgga

SEQ ID NO: 5145781 - DNA, 14 bp, Homo sapiens
accctcgcagcagg

SEQ ID NO: 5145782 - DNA, 15 bp, Homo sapiens
accctcgcagcaggt

SEQ ID NO: 5145783 - DNA, 14 bp, Homo sapiens
accctcgccctgtc

SEQ ID NO: 5145784 - DNA, 16 bp, Homo sapiens
accctcgccctgtccc

SEQ ID NO: 5145785 - DNA, 18 bp, Homo sapiens
accctcgccggaccctct

SEQ ID NO: 5145786 - DNA, 16 bp, Homo sapiens
accctcgctctctgtc

SEQ ID NO: 5145787 - DNA, 16 bp, Homo sapiens
accctcgctgccaccc

SEQ ID NO: 5145788 - DNA, 15 bp, Homo sapiens
accctcgctggcccc

SEQ ID NO: 5145789 - DNA, 14 bp, Homo sapiens
accctcggagcccc

SEQ ID NO: 5145790 - DNA, 17 bp, Homo sapiens
accctcggctcccgggt

SEQ ID NO: 5145791 - DNA, 15 bp, Homo sapiens
accctcgggcccacc

SEQ ID NO: 5145792 - DNA, 22 bp, Homo sapiens
accctcgggcccacctggccac

SEQ ID NO: 5145793 - DNA, 16 bp, Homo sapiens
accctcggtcattcct

SEQ ID NO: 5145794 - DNA, 21 bp, Homo sapiens
accctcggtgtacacagaggc

SEQ ID NO: 5145795 - DNA, 20 bp, Homo sapiens
accctcgtggccttccccag

SEQ ID NO: 5145796 - DNA, 22 bp, Homo sapiens
accctctaacctcgccctctcc

SEQ ID NO: 5145797 - DNA, 14 bp, Homo sapiens
accctctacctgga

SEQ ID NO: 5145798 - DNA, 20 bp, Homo sapiens
accctctagtttacttgctc

SEQ ID NO: 5145799 - DNA, 13 bp, Homo sapiens
accctctatttac

SEQ ID NO: 5145800 - DNA, 15 bp, Homo sapiens
accctctcactagtg

SEQ ID NO: 5145801 - DNA, 15 bp, Homo sapiens
accctctccacccca

SEQ ID NO: 5145802 - DNA, 18 bp, Homo sapiens
accctctccatctcccaa

SEQ ID NO: 5145803 - DNA, 20 bp, Homo sapiens
accctctccatctcccaagg

SEQ ID NO: 5145804 - DNA, 16 bp, Homo sapiens
accctctccatgccca

SEQ ID NO: 5145805 - DNA, 21 bp, Homo sapiens
accctctccatgcccaaccta

SEQ ID NO: 5145806 - DNA, 14 bp, Homo sapiens
accctctcctgggg

SEQ ID NO: 5145807 - DNA, 21 bp, Homo sapiens
accctctcctgggggtggcag

SEQ ID NO: 5145808 - DNA, 19 bp, Homo sapiens
accctctctaatggcccct

SEQ ID NO: 5145809 - DNA, 14 bp, Homo sapiens
accctctctgtcca

SEQ ID NO: 5145810 - DNA, 23 bp, Homo sapiens
accctctctgtccaatctgcaag

SEQ ID NO: 5145811 - DNA, 12 bp, Homo sapiens
accctctcttcc

SEQ ID NO: 5145812 - DNA, 14 bp, Homo sapiens
accctctcttccct

SEQ ID NO: 5145813 - DNA, 22 bp, Homo sapiens
accctctcttgattaagggcta

SEQ ID NO: 5145814 - DNA, 13 bp, Homo sapiens
accctctgagctt

SEQ ID NO: 5145815 - DNA, 21 bp, Homo sapiens
accctctgagctttgcatgtt

SEQ ID NO: 5145816 - DNA, 19 bp, Homo sapiens
accctctgccaccagagac

SEQ ID NO: 5145817 - DNA, 22 bp, Homo sapiens
accctctgcggccactgcgcca

SEQ ID NO: 5145818 - DNA, 19 bp, Homo sapiens
accctctgctatgtctgtg

SEQ ID NO: 5145819 - DNA, 20 bp, Homo sapiens
accctctgctatgtctgtga

SEQ ID NO: 5145820 - DNA, 17 bp, Homo sapiens
accctctgctgaagact

SEQ ID NO: 5145821 - DNA, 11 bp, Homo sapiens
accctctggaa

SEQ ID NO: 5145822 - DNA, 17 bp, Homo sapiens
accctctggaaatatgt

SEQ ID NO: 5145823 - DNA, 19 bp, Homo sapiens
accctctggaaatatgtaa

SEQ ID NO: 5145824 - DNA, 20 bp, Homo sapiens
accctctggattctgaatct

SEQ ID NO: 5145825 - DNA, 11 bp, Homo sapiens
accctctggga

SEQ ID NO: 5145826 - DNA, 13 bp, Homo sapiens
accctctgggaac

SEQ ID NO: 5145827 - DNA, 22 bp, Homo sapiens
accctctgggaacctcccagag

SEQ ID NO: 5145828 - DNA, 23 bp, Homo sapiens
accctctgggaacctcccagagg

SEQ ID NO: 5145829 - DNA, 12 bp, Homo sapiens
accctctgggag

SEQ ID NO: 5145830 - DNA, 20 bp, Homo sapiens
accctctgggagtccccatc

SEQ ID NO: 5145831 - DNA, 17 bp, Homo sapiens
accctctggggacagga

SEQ ID NO: 5145832 - DNA, 16 bp, Homo sapiens
accctctggggccctt

SEQ ID NO: 5145833 - DNA, 12 bp, Homo sapiens
accctctggggg

SEQ ID NO: 5145834 - DNA, 19 bp, Homo sapiens
accctctgggggtcctctc

SEQ ID NO: 5145835 - DNA, 20 bp, Homo sapiens
accctctgggggtcctctct

SEQ ID NO: 5145836 - DNA, 21 bp, Homo sapiens
accctctgggggtcctctctg

SEQ ID NO: 5145837 - DNA, 15 bp, Homo sapiens
accctctggtccttc

SEQ ID NO: 5145838 - DNA, 12 bp, Homo sapiens
accctctgtacc

SEQ ID NO: 5145839 - DNA, 11 bp, Homo sapiens
accctctgtcc

SEQ ID NO: 5145840 - DNA, 18 bp, Homo sapiens
accctctgtcccacccct

SEQ ID NO: 5145841 - DNA, 19 bp, Homo sapiens
accctctgtcccaccccta

SEQ ID NO: 5145842 - DNA, 20 bp, Homo sapiens
accctctgtcccacccctag

SEQ ID NO: 5145843 - DNA, 17 bp, Homo sapiens
accctctgtccccacga

SEQ ID NO: 5145844 - DNA, 17 bp, Homo sapiens
accctctgtccccaggc

SEQ ID NO: 5145845 - DNA, 19 bp, Homo sapiens
accctctgtccccaggcct

SEQ ID NO: 5145846 - DNA, 20 bp, Homo sapiens
accctctgtccccaggcctg

SEQ ID NO: 5145847 - DNA, 16 bp, Homo sapiens
accctctgtccttccc

SEQ ID NO: 5145848 - DNA, 13 bp, Homo sapiens
accctctgtgaaa

SEQ ID NO: 5145849 - DNA, 20 bp, Homo sapiens
accctctgttccttccctgt

SEQ ID NO: 5145850 - DNA, 21 bp, Homo sapiens
accctctgttccttccctgtg

SEQ ID NO: 5145851 - DNA, 17 bp, Homo sapiens
accctcttcctgtgatc

SEQ ID NO: 5145852 - DNA, 20 bp, Homo sapiens
accctcttcctgtgatccac

SEQ ID NO: 5145853 - DNA, 18 bp, Homo sapiens
accctcttctctgggccc

SEQ ID NO: 5145854 - DNA, 12 bp, Homo sapiens
accctcttgcca

SEQ ID NO: 5145855 - DNA, 20 bp, Homo sapiens
accctcttgccatcctgatg

SEQ ID NO: 5145856 - DNA, 23 bp, Homo sapiens
accctcttgcccatcctgactga

SEQ ID NO: 5145857 - DNA, 20 bp, Homo sapiens
accctctttcttgtttgtca

SEQ ID NO: 5145858 - DNA, 22 bp, Homo sapiens
accctctttcttgtttgtcagc

SEQ ID NO: 5145859 - DNA, 15 bp, Homo sapiens
accctctttgctgca

SEQ ID NO: 5145860 - DNA, 21 bp, Homo sapiens
accctcttttaccaacttcct

SEQ ID NO: 5145861 - DNA, 18 bp, Homo sapiens
accctgaaagccctgagc

SEQ ID NO: 5145862 - DNA, 19 bp, Homo sapiens
accctgaaaggaacactgg

SEQ ID NO: 5145863 - DNA, 14 bp, Homo sapiens
accctgaaatgtgt

SEQ ID NO: 5145864 - DNA, 23 bp, Homo sapiens
accctgaacatttagtaccctgc

SEQ ID NO: 5145865 - DNA, 17 bp, Homo sapiens
accctgaacccacacct

SEQ ID NO: 5145866 - DNA, 21 bp, Homo sapiens
accctgaacccacacctgggc

SEQ ID NO: 5145867 - DNA, 20 bp, Homo sapiens
accctgaagcagaggccttt

SEQ ID NO: 5145868 - DNA, 22 bp, Homo sapiens
accctgaagcagaggcctttat

SEQ ID NO: 5145869 - DNA, 19 bp, Homo sapiens
accctgaagccattggaga

SEQ ID NO: 5145870 - DNA, 18 bp, Homo sapiens
accctgaatcagaggcag

SEQ ID NO: 5145871 - DNA, 17 bp, Homo sapiens
accccaaatgctctctc

SEQ ID NO: 5145872 - DNA, 12 bp, Homo sapiens
accccaacccaa

SEQ ID NO: 5145873 - DNA, 19 bp, Homo sapiens
accccaacccaataaaact

SEQ ID NO: 5145874 - DNA, 14 bp, Homo sapiens
accccaacctcaga

SEQ ID NO: 5145875 - DNA, 13 bp, Homo sapiens
accccaacctgct

SEQ ID NO: 5145876 - DNA, 14 bp, Homo sapiens
accccaacctgctc

SEQ ID NO: 5145877 - DNA, 20 bp, Homo sapiens
accccaacctgctctcctct

SEQ ID NO: 5145878 - DNA, 16 bp, Homo sapiens
accccaacgcacagga

SEQ ID NO: 5145879 - DNA, 15 bp, Homo sapiens
accccaactcccagc

SEQ ID NO: 5145880 - DNA, 14 bp, Homo sapiens
accccaactctccc

SEQ ID NO: 5145881 - DNA, 16 bp, Homo sapiens
accccaactctcccca

SEQ ID NO: 5145882 - DNA, 19 bp, Homo sapiens
accccaacttggcagcttt

SEQ ID NO: 5145883 - DNA, 16 bp, Homo sapiens
accccaagactcccat

SEQ ID NO: 5145884 - DNA, 17 bp, Homo sapiens
accccaagactcccatg

SEQ ID NO: 5145885 - DNA, 18 bp, Homo sapiens
accccaagcagcattcag

SEQ ID NO: 5145886 - DNA, 18 bp, Homo sapiens
accccaagccagcccggc

SEQ ID NO: 5145887 - DNA, 15 bp, Homo sapiens
accccaagcgccctg

SEQ ID NO: 5145888 - DNA, 19 bp, Homo sapiens
accccaagcgccctggccc

SEQ ID NO: 5145889 - DNA, 23 bp, Homo sapiens
accccaagcgccctggcccccac

SEQ ID NO: 5145890 - DNA, 15 bp, Homo sapiens
accccaagcttccca

SEQ ID NO: 5145891 - DNA, 13 bp, Homo sapiens
accccaaggccag

SEQ ID NO: 5145892 - DNA, 21 bp, Homo sapiens
accccaagggggctgctgctc

SEQ ID NO: 5145893 - DNA, 16 bp, Homo sapiens
accccaatatatgtat

SEQ ID NO: 5145894 - DNA, 14 bp, Homo sapiens
accccaatcccagc

SEQ ID NO: 5145895 - DNA, 14 bp, Homo sapiens
accccaatccctgc

SEQ ID NO: 5145896 - DNA, 21 bp, Homo sapiens
accccaatccctgccactggg

SEQ ID NO: 5145897 - DNA, 22 bp, Homo sapiens
accccaatccctgccactgggc

SEQ ID NO: 5145898 - DNA, 15 bp, Homo sapiens
accccacaatttctt

SEQ ID NO: 5145899 - DNA, 16 bp, Homo sapiens
accccacaccagcctt

SEQ ID NO: 5145900 - DNA, 17 bp, Homo sapiens
accccacaccaggccgt

SEQ ID NO: 5145901 - DNA, 20 bp, Homo sapiens
accccacaccaggccgtcct

SEQ ID NO: 5145902 - DNA, 16 bp, Homo sapiens
accccacaccccagcc

SEQ ID NO: 5145903 - DNA, 20 bp, Homo sapiens
accccacaccccagcccacc

SEQ ID NO: 5145904 - DNA, 12 bp, Homo sapiens
accccacagctg

SEQ ID NO: 5145905 - DNA, 14 bp, Homo sapiens
accccacagctggg

SEQ ID NO: 5145906 - DNA, 15 bp, Homo sapiens
accccacagctgggg

SEQ ID NO: 5145907 - DNA, 16 bp, Homo sapiens
accccacagctggggc

SEQ ID NO: 5145908 - DNA, 20 bp, Homo sapiens
accccaccacacacaccctt

SEQ ID NO: 5145909 - DNA, 22 bp, Homo sapiens
accccacccacctttgcaggga

SEQ ID NO: 5145910 - DNA, 15 bp, Homo sapiens
accccacccccaccc

SEQ ID NO: 5145911 - DNA, 18 bp, Homo sapiens
accccacccccgccatgc

SEQ ID NO: 5145912 - DNA, 14 bp, Homo sapiens
accccacccctcat

SEQ ID NO: 5145913 - DNA, 18 bp, Homo sapiens
accccacccctcatcagg

SEQ ID NO: 5145914 - DNA, 12 bp, Homo sapiens
accccaccctca

SEQ ID NO: 5145915 - DNA, 13 bp, Homo sapiens
accccaccctcag

SEQ ID NO: 5145916 - DNA, 15 bp, Homo sapiens
accccaccctcagca

SEQ ID NO: 5145917 - DNA, 13 bp, Homo sapiens
accccaccctccc

SEQ ID NO: 5145918 - DNA, 17 bp, Homo sapiens
accccaccctccctgga

SEQ ID NO: 5145919 - DNA, 15 bp, Homo sapiens
accccaccctgtttg

SEQ ID NO: 5145920 - DNA, 15 bp, Homo sapiens
accccacccttgccc

SEQ ID NO: 5145921 - DNA, 17 bp, Homo sapiens
accccacccttgcccac

SEQ ID NO: 5145922 - DNA, 14 bp, Homo sapiens
accccaccgccacc

SEQ ID NO: 5145923 - DNA, 14 bp, Homo sapiens
accccacctcttcc

SEQ ID NO: 5145924 - DNA, 19 bp, Homo sapiens
accccacctgacctctgca

SEQ ID NO: 5145925 - DNA, 14 bp, Homo sapiens
accccacctgcagg

SEQ ID NO: 5145926 - DNA, 12 bp, Homo sapiens
accccacctgcg

SEQ ID NO: 5145927 - DNA, 22 bp, Homo sapiens
accccaccttgccaagctttct

SEQ ID NO: 5145928 - DNA, 21 bp, Homo sapiens
accccacctttattccttcat

SEQ ID NO: 5145929 - DNA, 18 bp, Homo sapiens
accccacgccctgttcac

SEQ ID NO: 5145930 - DNA, 18 bp, Homo sapiens
accccactcaggggaccc

SEQ ID NO: 5145931 - DNA, 13 bp, Homo sapiens
accccactccagc

SEQ ID NO: 5145932 - DNA, 20 bp, Homo sapiens
accccactccagccctgtcc

SEQ ID NO: 5145933 - DNA, 18 bp, Homo sapiens
accccactcccctcacac

SEQ ID NO: 5145934 - DNA, 12 bp, Homo sapiens
accccactcctg

SEQ ID NO: 5145935 - DNA, 14 bp, Homo sapiens
accccactcctgtc

SEQ ID NO: 5145936 - DNA, 19 bp, Homo sapiens
accccactgagagctgctc

SEQ ID NO: 5145937 - DNA, 14 bp, Homo sapiens
accccactgccaag

SEQ ID NO: 5145938 - DNA, 11 bp, Homo sapiens
accccactgga

SEQ ID NO: 5145939 - DNA, 16 bp, Homo sapiens
accccactggctgaga

SEQ ID NO: 5145940 - DNA, 20 bp, Homo sapiens
accccactgggccagccctg

SEQ ID NO: 5145941 - DNA, 22 bp, Homo sapiens
accccactgggccagccctgca

SEQ ID NO: 5145942 - DNA, 18 bp, Homo sapiens
accccacttatgctgctg

SEQ ID NO: 5145943 - DNA, 12 bp, Homo sapiens
accccacttcag

SEQ ID NO: 5145944 - DNA, 15 bp, Homo sapiens
accccagaaatcact

SEQ ID NO: 5145945 - DNA, 17 bp, Homo sapiens
accccagaaatcactgt

SEQ ID NO: 5145946 - DNA, 22 bp, Homo sapiens
accccagaacgcatgcagggcc

SEQ ID NO: 5145947 - DNA, 17 bp, Homo sapiens
accccagaatcccctgg

SEQ ID NO: 5145948 - DNA, 20 bp, Homo sapiens
accccagaatcccctgggga

SEQ ID NO: 5145949 - DNA, 15 bp, Homo sapiens
accccagacctctga

SEQ ID NO: 5145950 - DNA, 21 bp, Homo sapiens
accccagactcaaactcaagg

SEQ ID NO: 5145951 - DNA, 15 bp, Homo sapiens
accccagactccagg

SEQ ID NO: 5145952 - DNA, 17 bp, Homo sapiens
accccagagattcccaa

SEQ ID NO: 5145953 - DNA, 17 bp, Homo sapiens
accccagagccacacat

SEQ ID NO: 5145954 - DNA, 18 bp, Homo sapiens
accccagagccacacatg

SEQ ID NO: 5145955 - DNA, 18 bp, Homo sapiens
accccagaggacacaggc

SEQ ID NO: 5145956 - DNA, 13 bp, Homo sapiens
accccagaggcag

SEQ ID NO: 5145957 - DNA, 14 bp, Homo sapiens
accccagaggcaga

SEQ ID NO: 5145958 - DNA, 17 bp, Homo sapiens
accccagaggcagaggt

SEQ ID NO: 5145959 - DNA, 18 bp, Homo sapiens
accccagagggaccagct

SEQ ID NO: 5145960 - DNA, 22 bp, Homo sapiens
accccagagggaccagctgggg

SEQ ID NO: 5145961 - DNA, 13 bp, Homo sapiens
accccagagtgtg

SEQ ID NO: 5145962 - DNA, 18 bp, Homo sapiens
accccagatacctgtgag

SEQ ID NO: 5145963 - DNA, 12 bp, Homo sapiens
accccagcacag

SEQ ID NO: 5145964 - DNA, 19 bp, Homo sapiens
accccagcacagccacctc

SEQ ID NO: 5145965 - DNA, 20 bp, Homo sapiens
accccagcacagccacctcc

SEQ ID NO: 5145966 - DNA, 15 bp, Homo sapiens
accccagcagtcctg

SEQ ID NO: 5145967 - DNA, 16 bp, Homo sapiens
accccagcccaccctg

SEQ ID NO: 5145968 - DNA, 20 bp, Homo sapiens
accccagcccaccctgctcc

SEQ ID NO: 5145969 - DNA, 17 bp, Homo sapiens
accccagccccactgcc

SEQ ID NO: 5145970 - DNA, 14 bp, Homo sapiens
accccagcccccac

SEQ ID NO: 5145971 - DNA, 23 bp, Homo sapiens
accccagccgctcggaggcccca

SEQ ID NO: 5145972 - DNA, 19 bp, Homo sapiens
accccagcctacccttcct

SEQ ID NO: 5145973 - DNA, 13 bp, Homo sapiens
accccagcctcat

SEQ ID NO: 5145974 - DNA, 22 bp, Homo sapiens
accccagcctcgcctgtcaccc

SEQ ID NO: 5145975 - DNA, 18 bp, Homo sapiens
accccagcctggccacgc

SEQ ID NO: 5145976 - DNA, 21 bp, Homo sapiens
accccagcggcagatgggcct

SEQ ID NO: 5145977 - DNA, 22 bp, Homo sapiens
accccagcggcagatgggcctg

SEQ ID NO: 5145978 - DNA, 21 bp, Homo sapiens
accccagcgtcaggcctacct

SEQ ID NO: 5145979 - DNA, 22 bp, Homo sapiens
accccagctactctgatccctc

SEQ ID NO: 5145980 - DNA, 21 bp, Homo sapiens
accccagctagggctggactc

SEQ ID NO: 5145981 - DNA, 21 bp, Homo sapiens
accccagctattttctgacca

SEQ ID NO: 5145982 - DNA, 23 bp, Homo sapiens
accccagctattttctgaccaaa

SEQ ID NO: 5145983 - DNA, 13 bp, Homo sapiens
accccagctccag

SEQ ID NO: 5145984 - DNA, 21 bp, Homo sapiens
accccagctccgacctctctc

SEQ ID NO: 5145985 - DNA, 11 bp, Homo sapiens
accccagctct

SEQ ID NO: 5145986 - DNA, 14 bp, Homo sapiens
accccagctctgct

SEQ ID NO: 5145987 - DNA, 22 bp, Homo sapiens
accccagctgccggcagtgctg

SEQ ID NO: 5145988 - DNA, 16 bp, Homo sapiens
accccagctgctctaa

SEQ ID NO: 5145989 - DNA, 15 bp, Homo sapiens
accccagctggcctc

SEQ ID NO: 5145990 - DNA, 23 bp, Homo sapiens
accccagctggcctctagaacac

SEQ ID NO: 5145991 - DNA, 20 bp, Homo sapiens
accccagctgggaggcaaga

SEQ ID NO: 5145992 - DNA, 23 bp, Homo sapiens
accccagctggggccaggctggg

SEQ ID NO: 5145993 - DNA, 17 bp, Homo sapiens
accccagctgtgagcct

SEQ ID NO: 5145994 - DNA, 22 bp, Homo sapiens
accccagctgtgagccttggct

SEQ ID NO: 5145995 - DNA, 22 bp, Homo sapiens
accccaggacgcatgcagggcc

SEQ ID NO: 5145996 - DNA, 17 bp, Homo sapiens
accccaggacgccactc

SEQ ID NO: 5145997 - DNA, 20 bp, Homo sapiens
accccaggacgccactcatt

SEQ ID NO: 5145998 - DNA, 23 bp, Homo sapiens
accccaggacgccactcatttca

SEQ ID NO: 5145999 - DNA, 15 bp, Homo sapiens
accccaggcactgtt

SEQ ID NO: 5146000 - DNA, 19 bp, Homo sapiens
accccaggcagctcgagca

SEQ ID NO: 5146001 - DNA, 13 bp, Homo sapiens
accccaggcccac

SEQ ID NO: 5146002 - DNA, 15 bp, Homo sapiens
accccaggccccgag

SEQ ID NO: 5146003 - DNA, 12 bp, Homo sapiens
accccaggccct

SEQ ID NO: 5146004 - DNA, 16 bp, Homo sapiens
accccaggcccttcag

SEQ ID NO: 5146005 - DNA, 16 bp, Homo sapiens
accccagggcacagga

SEQ ID NO: 5146006 - DNA, 18 bp, Homo sapiens
accccagggcacaggagc

SEQ ID NO: 5146007 - DNA, 19 bp, Homo sapiens
accccagggcacaggagct

SEQ ID NO: 5146008 - DNA, 13 bp, Homo sapiens
accccagggcact

SEQ ID NO: 5146009 - DNA, 24 bp, Homo sapiens
accccagggcactgccagcccacc

SEQ ID NO: 5146010 - DNA, 17 bp, Homo sapiens
accccagggcagccagg

SEQ ID NO: 5146011 - DNA, 21 bp, Homo sapiens
accccagggccctggccagcc

SEQ ID NO: 5146012 - DNA, 24 bp, Homo sapiens
accccagggcctgagcctggccag

SEQ ID NO: 5146013 - DNA, 14 bp, Homo sapiens
accccagggcctgt

SEQ ID NO: 5146014 - DNA, 17 bp, Homo sapiens
accccagggcctgtctc

SEQ ID NO: 5146015 - DNA, 18 bp, Homo sapiens
accccagggcctgtctcc

SEQ ID NO: 5146016 - DNA, 15 bp, Homo sapiens
accccagggtcataa

SEQ ID NO: 5146017 - DNA, 21 bp, Homo sapiens
accccagggtcataagtgggg

SEQ ID NO: 5146018 - DNA, 12 bp, Homo sapiens
accccagggtgg

SEQ ID NO: 5146019 - DNA, 13 bp, Homo sapiens
accccaggtcagc

SEQ ID NO: 5146020 - DNA, 18 bp, Homo sapiens
accccaggtcagccctgt

SEQ ID NO: 5146021 - DNA, 19 bp, Homo sapiens
accccaggtcagccctgtg

SEQ ID NO: 5146022 - DNA, 19 bp, Homo sapiens
accccaggtcaggggctcc

SEQ ID NO: 5146023 - DNA, 23 bp, Homo sapiens
accccaggtcaggggctccctac

SEQ ID NO: 5146024 - DNA, 13 bp, Homo sapiens
accccaggtttct

SEQ ID NO: 5146025 - DNA, 14 bp, Homo sapiens
accccagtcaagct

SEQ ID NO: 5146026 - DNA, 18 bp, Homo sapiens
accccagtcaagctccta

SEQ ID NO: 5146027 - DNA, 15 bp, Homo sapiens
accccagtccccggg

SEQ ID NO: 5146028 - DNA, 19 bp, Homo sapiens
accccagtggccactcagc

SEQ ID NO: 5146029 - DNA, 19 bp, Homo sapiens
accccagttcatctctgct

SEQ ID NO: 5146030 - DNA, 21 bp, Homo sapiens
accccagttcccttggtggca

SEQ ID NO: 5146031 - DNA, 15 bp, Homo sapiens
accccagttctgctc

SEQ ID NO: 5146032 - DNA, 20 bp, Homo sapiens
accccagttctgctcctctc

SEQ ID NO: 5146033 - DNA, 15 bp, Homo sapiens
accccagtttcttct

SEQ ID NO: 5146034 - DNA, 21 bp, Homo sapiens
accccagtttgggaactcatc

SEQ ID NO: 5146035 - DNA, 20 bp, Homo sapiens
accccataagccctgagact

SEQ ID NO: 5146036 - DNA, 19 bp, Homo sapiens
accccataataaccctgcc

SEQ ID NO: 5146037 - DNA, 15 bp, Homo sapiens
accccatagtgcctt

SEQ ID NO: 5146038 - DNA, 22 bp, Homo sapiens
accccatagtgccttgatttta

SEQ ID NO: 5146039 - DNA, 16 bp, Homo sapiens
accccatatacacctg

SEQ ID NO: 5146040 - DNA, 18 bp, Homo sapiens
accccatatacacctgga

SEQ ID NO: 5146041 - DNA, 16 bp, Homo sapiens
accccatcactcgcag

SEQ ID NO: 5146042 - DNA, 16 bp, Homo sapiens
accccatccagccagg

SEQ ID NO: 5146043 - DNA, 16 bp, Homo sapiens
accccatccctggctg

SEQ ID NO: 5146044 - DNA, 17 bp, Homo sapiens
accccatccctggctga

SEQ ID NO: 5146045 - DNA, 18 bp, Homo sapiens
accccatcctccagggct

SEQ ID NO: 5146046 - DNA, 22 bp, Homo sapiens
accccatcctccctcccccagc

SEQ ID NO: 5146047 - DNA, 18 bp, Homo sapiens
accccatctctacaaaaa

SEQ ID NO: 5146048 - DNA, 22 bp, Homo sapiens
accccatctctgctgcttctgg

SEQ ID NO: 5146049 - DNA, 15 bp, Homo sapiens
accccatctgtgaat

SEQ ID NO: 5146050 - DNA, 19 bp, Homo sapiens
accctgaattcattgtctc

SEQ ID NO: 5146051 - DNA, 21 bp, Homo sapiens
accctgacaaattttaattat

SEQ ID NO: 5146052 - DNA, 20 bp, Homo sapiens
accctgacctccgcccctgc

SEQ ID NO: 5146053 - DNA, 21 bp, Homo sapiens
accctgagatacttcccaaag

SEQ ID NO: 5146054 - DNA, 24 bp, Homo sapiens
accctgagcagatcgtgccgtgga

SEQ ID NO: 5146055 - DNA, 22 bp, Homo sapiens
accctgagcagggtccacagct

SEQ ID NO: 5146056 - DNA, 16 bp, Homo sapiens
accctgagcctgacct

SEQ ID NO: 5146057 - DNA, 23 bp, Homo sapiens
accctgagctcggggacaggtga

SEQ ID NO: 5146058 - DNA, 23 bp, Homo sapiens
accctgagctgaggcagcagtgt

SEQ ID NO: 5146059 - DNA, 19 bp, Homo sapiens
accctgagcttaaataaca

SEQ ID NO: 5146060 - DNA, 23 bp, Homo sapiens
accctgaggaggccgcttagtgc

SEQ ID NO: 5146061 - DNA, 18 bp, Homo sapiens
accctgaggagtgatggg

SEQ ID NO: 5146062 - DNA, 23 bp, Homo sapiens
accctgaggcccagagggcctgc

SEQ ID NO: 5146063 - DNA, 20 bp, Homo sapiens
accctgaggccctgggctgg

SEQ ID NO: 5146064 - DNA, 18 bp, Homo sapiens
accctgagggctcctcca

SEQ ID NO: 5146065 - DNA, 16 bp, Homo sapiens
accctgaggtatctgt

SEQ ID NO: 5146066 - DNA, 17 bp, Homo sapiens
accctgaggtcactgct

SEQ ID NO: 5146067 - DNA, 19 bp, Homo sapiens
accctgaggtcactgctag

SEQ ID NO: 5146068 - DNA, 14 bp, Homo sapiens
accctgaggtcagg

SEQ ID NO: 5146069 - DNA, 23 bp, Homo sapiens
accctgaggtcagggagtgctgg

SEQ ID NO: 5146070 - DNA, 19 bp, Homo sapiens
accctgagtccccacctgc

SEQ ID NO: 5146071 - DNA, 20 bp, Homo sapiens
accctgatcacctcagggca

SEQ ID NO: 5146072 - DNA, 17 bp, Homo sapiens
accctgatccttttcaa

SEQ ID NO: 5146073 - DNA, 20 bp, Homo sapiens
accctgatctctcagcccca

SEQ ID NO: 5146074 - DNA, 20 bp, Homo sapiens
accctgatgtgacattccat

SEQ ID NO: 5146075 - DNA, 22 bp, Homo sapiens
accctgattcatactccttttg

SEQ ID NO: 5146076 - DNA, 23 bp, Homo sapiens
accctgattcatactccttttgg

SEQ ID NO: 5146077 - DNA, 14 bp, Homo sapiens
accctgattcttga

SEQ ID NO: 5146078 - DNA, 22 bp, Homo sapiens
accctgatttaggagaagccag

SEQ ID NO: 5146079 - DNA, 23 bp, Homo sapiens
accctgcaaacagaacagggtca

SEQ ID NO: 5146080 - DNA, 13 bp, Homo sapiens
accctgcaagacc

SEQ ID NO: 5146081 - DNA, 18 bp, Homo sapiens
accctgcaaggcccacag

SEQ ID NO: 5146082 - DNA, 17 bp, Homo sapiens
accctgcaatgtaattg

SEQ ID NO: 5146083 - DNA, 14 bp, Homo sapiens
accctgcaccctcc

SEQ ID NO: 5146084 - DNA, 16 bp, Homo sapiens
accctgcaccctccta

SEQ ID NO: 5146085 - DNA, 13 bp, Homo sapiens
accctgcacctgc

SEQ ID NO: 5146086 - DNA, 12 bp, Homo sapiens
accctgcagcca

SEQ ID NO: 5146087 - DNA, 11 bp, Homo sapiens
accctgcagct

SEQ ID NO: 5146088 - DNA, 14 bp, Homo sapiens
accctgcaggactt

SEQ ID NO: 5146089 - DNA, 21 bp, Homo sapiens
accctgcaggcaggcagacca

SEQ ID NO: 5146090 - DNA, 15 bp, Homo sapiens
accctgcaggccagg

SEQ ID NO: 5146091 - DNA, 17 bp, Homo sapiens
accctgcaggccaggcc

SEQ ID NO: 5146092 - DNA, 21 bp, Homo sapiens
accctgcaggccaggccagct

SEQ ID NO: 5146093 - DNA, 16 bp, Homo sapiens
accctgcattttcctc

SEQ ID NO: 5146094 - DNA, 19 bp, Homo sapiens
accctgccaactttccaga

SEQ ID NO: 5146095 - DNA, 15 bp, Homo sapiens
accctgccacagcca

SEQ ID NO: 5146096 - DNA, 15 bp, Homo sapiens
accctgccaccctct

SEQ ID NO: 5146097 - DNA, 20 bp, Homo sapiens
accctgccaccctctgctgc

SEQ ID NO: 5146098 - DNA, 23 bp, Homo sapiens
accctgccaccctctgctgcaca

SEQ ID NO: 5146099 - DNA, 16 bp, Homo sapiens
accctgccaggcacag

SEQ ID NO: 5146100 - DNA, 17 bp, Homo sapiens
accctgccaggcacagg

SEQ ID NO: 5146101 - DNA, 22 bp, Homo sapiens
accctgccaggcacaggcaggg

SEQ ID NO: 5146102 - DNA, 13 bp, Homo sapiens
accctgccagggg

SEQ ID NO: 5146103 - DNA, 13 bp, Homo sapiens
accctgccagtgc

SEQ ID NO: 5146104 - DNA, 15 bp, Homo sapiens
accctgccagtgcca

SEQ ID NO: 5146105 - DNA, 16 bp, Homo sapiens
accctgccagtgccag

SEQ ID NO: 5146106 - DNA, 23 bp, Homo sapiens
accctgccatggaactgtttcct

SEQ ID NO: 5146107 - DNA, 22 bp, Homo sapiens
accctgcccaccccatccctgg

SEQ ID NO: 5146108 - DNA, 14 bp, Homo sapiens
accctgcccactcc

SEQ ID NO: 5146109 - DNA, 16 bp, Homo sapiens
accctgcccactccca

SEQ ID NO: 5146110 - DNA, 15 bp, Homo sapiens
accctgcccagagct

SEQ ID NO: 5146111 - DNA, 19 bp, Homo sapiens
accctgcccagagctgagt

SEQ ID NO: 5146112 - DNA, 21 bp, Homo sapiens
accctgccccaccccacctcc

SEQ ID NO: 5146113 - DNA, 22 bp, Homo sapiens
accctgccccccctaagagaca

SEQ ID NO: 5146114 - DNA, 13 bp, Homo sapiens
accctgccccctg

SEQ ID NO: 5146115 - DNA, 22 bp, Homo sapiens
accctgcccctaagttattacc

SEQ ID NO: 5146116 - DNA, 14 bp, Homo sapiens
accctgcccctgcc

SEQ ID NO: 5146117 - DNA, 18 bp, Homo sapiens
accctgcccctgccccgt

SEQ ID NO: 5146118 - DNA, 17 bp, Homo sapiens
accctgccccttgccat

SEQ ID NO: 5146119 - DNA, 22 bp, Homo sapiens
accctgccccttgtcctctcag

SEQ ID NO: 5146120 - DNA, 17 bp, Homo sapiens
accctgcccgctcccaa

SEQ ID NO: 5146121 - DNA, 21 bp, Homo sapiens
accctgccctcatgggacctg

SEQ ID NO: 5146122 - DNA, 11 bp, Homo sapiens
accctgccctg

SEQ ID NO: 5146123 - DNA, 15 bp, Homo sapiens
accctgccctgcacc

SEQ ID NO: 5146124 - DNA, 14 bp, Homo sapiens
accctgccctgctg

SEQ ID NO: 5146125 - DNA, 12 bp, Homo sapiens
accctgccctgg

SEQ ID NO: 5146126 - DNA, 17 bp, Homo sapiens
accctgccctggcctac

SEQ ID NO: 5146127 - DNA, 13 bp, Homo sapiens
accctgccctgtg

SEQ ID NO: 5146128 - DNA, 20 bp, Homo sapiens
accctgcccttgacatctgg

SEQ ID NO: 5146129 - DNA, 22 bp, Homo sapiens
accctgccgagggggctgtcat

SEQ ID NO: 5146130 - DNA, 19 bp, Homo sapiens
accctgccgtcaccaccac

SEQ ID NO: 5146131 - DNA, 10 bp, Homo sapiens
accctgcctc

SEQ ID NO: 5146132 - DNA, 23 bp, Homo sapiens
accctgcctcccttgactttgct

SEQ ID NO: 5146133 - DNA, 22 bp, Homo sapiens
accctgcctcgcccccactttt

SEQ ID NO: 5146134 - DNA, 13 bp, Homo sapiens
accctgcctctcc

SEQ ID NO: 5146135 - DNA, 16 bp, Homo sapiens
accctgcctgagccca

SEQ ID NO: 5146136 - DNA, 17 bp, Homo sapiens
accctgcctgagcccag

SEQ ID NO: 5146137 - DNA, 13 bp, Homo sapiens
accctgcctgctg

SEQ ID NO: 5146138 - DNA, 21 bp, Homo sapiens
accctgcctgtcacctgggag

SEQ ID NO: 5146139 - DNA, 23 bp, Homo sapiens
accctgcctgtggaggtgacctg

SEQ ID NO: 5146140 - DNA, 18 bp, Homo sapiens
accctgccttatcttgca

SEQ ID NO: 5146141 - DNA, 18 bp, Homo sapiens
accctgcgaaggggccct

SEQ ID NO: 5146142 - DNA, 20 bp, Homo sapiens
accctgcgaaggggccctgg

SEQ ID NO: 5146143 - DNA, 13 bp, Homo sapiens
accctgcgcccct

SEQ ID NO: 5146144 - DNA, 15 bp, Homo sapiens
accctgcgcccctgc

SEQ ID NO: 5146145 - DNA, 15 bp, Homo sapiens
accctgcgcctccag

SEQ ID NO: 5146146 - DNA, 17 bp, Homo sapiens
accctgcgcctccagag

SEQ ID NO: 5146147 - DNA, 13 bp, Homo sapiens
accctgcgggcca

SEQ ID NO: 5146148 - DNA, 17 bp, Homo sapiens
accctgcgtggggacag

SEQ ID NO: 5146149 - DNA, 16 bp, Homo sapiens
accctgctcctaccta

SEQ ID NO: 5146150 - DNA, 13 bp, Homo sapiens
accctgctcctag

SEQ ID NO: 5146151 - DNA, 19 bp, Homo sapiens
accctgctcctcctgccct

SEQ ID NO: 5146152 - DNA, 11 bp, Homo sapiens
accctgctgac

SEQ ID NO: 5146153 - DNA, 11 bp, Homo sapiens
accctgctgca

SEQ ID NO: 5146154 - DNA, 17 bp, Homo sapiens
accctgctgcactagga

SEQ ID NO: 5146155 - DNA, 23 bp, Homo sapiens
accctgctgggaccccagctagg

SEQ ID NO: 5146156 - DNA, 17 bp, Homo sapiens
accctgcttcccaaact

SEQ ID NO: 5146157 - DNA, 16 bp, Homo sapiens
accctgcttctcccgg

SEQ ID NO: 5146158 - DNA, 14 bp, Homo sapiens
accctgcttctgct

SEQ ID NO: 5146159 - DNA, 19 bp, Homo sapiens
accctgcttggggcctggc

SEQ ID NO: 5146160 - DNA, 21 bp, Homo sapiens
accctgctttggcggcccggc

SEQ ID NO: 5146161 - DNA, 16 bp, Homo sapiens
accctggaaaggggag

SEQ ID NO: 5146162 - DNA, 10 bp, Homo sapiens
accctggaat

SEQ ID NO: 5146163 - DNA, 17 bp, Homo sapiens
accctggacagtgccta

SEQ ID NO: 5146164 - DNA, 21 bp, Homo sapiens
accctggagagtgcacatgcc

SEQ ID NO: 5146165 - DNA, 13 bp, Homo sapiens
accctggagccca

SEQ ID NO: 5146166 - DNA, 19 bp, Homo sapiens
accctggagcggctctcct

SEQ ID NO: 5146167 - DNA, 20 bp, Homo sapiens
accctggagcggctctcctg

SEQ ID NO: 5146168 - DNA, 12 bp, Homo sapiens
accctggaggca

SEQ ID NO: 5146169 - DNA, 17 bp, Homo sapiens
accctggagtggcatgg

SEQ ID NO: 5146170 - DNA, 16 bp, Homo sapiens
accctggatcagtcct

SEQ ID NO: 5146171 - DNA, 12 bp, Homo sapiens
accctggatgct

SEQ ID NO: 5146172 - DNA, 18 bp, Homo sapiens
accctggcacccagggtg

SEQ ID NO: 5146173 - DNA, 16 bp, Homo sapiens
accctggcagagaaga

SEQ ID NO: 5146174 - DNA, 22 bp, Homo sapiens
accctggcagggacctgagagc

SEQ ID NO: 5146175 - DNA, 14 bp, Homo sapiens
accctggccccaac

SEQ ID NO: 5146176 - DNA, 15 bp, Homo sapiens
accctggcccctctc

SEQ ID NO: 5146177 - DNA, 17 bp, Homo sapiens
accctggcccctctccc

SEQ ID NO: 5146178 - DNA, 19 bp, Homo sapiens
accctggcccctctccctt

SEQ ID NO: 5146179 - DNA, 11 bp, Homo sapiens
accctggcccg

SEQ ID NO: 5146180 - DNA, 18 bp, Homo sapiens
accctggcccgcccctcg

SEQ ID NO: 5146181 - DNA, 21 bp, Homo sapiens
accctggcccgcccctcgctg

SEQ ID NO: 5146182 - DNA, 22 bp, Homo sapiens
accctggccgagtccaagctgg

SEQ ID NO: 5146183 - DNA, 19 bp, Homo sapiens
accctggccgccccctgcc

SEQ ID NO: 5146184 - DNA, 12 bp, Homo sapiens
accctggcctca

SEQ ID NO: 5146185 - DNA, 22 bp, Homo sapiens
accctggcctcacttgattcat

SEQ ID NO: 5146186 - DNA, 16 bp, Homo sapiens
accctggcctgaactg

SEQ ID NO: 5146187 - DNA, 20 bp, Homo sapiens
accctggcctgaactgagga

SEQ ID NO: 5146188 - DNA, 22 bp, Homo sapiens
accctggcctgccagtctgcct

SEQ ID NO: 5146189 - DNA, 14 bp, Homo sapiens
accctggctggaat

SEQ ID NO: 5146190 - DNA, 23 bp, Homo sapiens
accctgggaagttggagcaagag

SEQ ID NO: 5146191 - DNA, 22 bp, Homo sapiens
accctgggagccagtcctccac

SEQ ID NO: 5146192 - DNA, 20 bp, Homo sapiens
accctgggcaaacagagcta

SEQ ID NO: 5146193 - DNA, 21 bp, Homo sapiens
accctgggcaaacagagctac

SEQ ID NO: 5146194 - DNA, 15 bp, Homo sapiens
accctgggccctggg

SEQ ID NO: 5146195 - DNA, 12 bp, Homo sapiens
accctgggctcc

SEQ ID NO: 5146196 - DNA, 23 bp, Homo sapiens
accctgggctccacacagcagtg

SEQ ID NO: 5146197 - DNA, 16 bp, Homo sapiens
accctgggctccctgg

SEQ ID NO: 5146198 - DNA, 17 bp, Homo sapiens
accctgggctggagagt

SEQ ID NO: 5146199 - DNA, 18 bp, Homo sapiens
accctgggctggggagga

SEQ ID NO: 5146200 - DNA, 16 bp, Homo sapiens
accctgggctgtccag

SEQ ID NO: 5146201 - DNA, 23 bp, Homo sapiens
accctgggctgtccagccttaat

SEQ ID NO: 5146202 - DNA, 20 bp, Homo sapiens
accctggggacccccacgat

SEQ ID NO: 5146203 - DNA, 17 bp, Homo sapiens
accctggggcaggggtg

SEQ ID NO: 5146204 - DNA, 22 bp, Homo sapiens
accctggggcctgactgctcag

SEQ ID NO: 5146205 - DNA, 11 bp, Homo sapiens
accctggggcg

SEQ ID NO: 5146206 - DNA, 23 bp, Homo sapiens
accctggggcgtgcagcagggaa

SEQ ID NO: 5146207 - DNA, 21 bp, Homo sapiens
accctggggctggcttttctg

SEQ ID NO: 5146208 - DNA, 16 bp, Homo sapiens
accctgggggcacagg

SEQ ID NO: 5146209 - DNA, 22 bp, Homo sapiens
accctgggggcacaggaggcag

SEQ ID NO: 5146210 - DNA, 22 bp, Homo sapiens
accctggggtaagtggagttgg

SEQ ID NO: 5146211 - DNA, 19 bp, Homo sapiens
accctgggtcctcgggccc

SEQ ID NO: 5146212 - DNA, 16 bp, Homo sapiens
accctgggtcgggaca

SEQ ID NO: 5146213 - DNA, 20 bp, Homo sapiens
accctgggtgccattcccag

SEQ ID NO: 5146214 - DNA, 21 bp, Homo sapiens
accctgggtgccattcccagc

SEQ ID NO: 5146215 - DNA, 20 bp, Homo sapiens
accctgggtgtccccgctgc

SEQ ID NO: 5146216 - DNA, 23 bp, Homo sapiens
accctgggtgtccccgctgctgt

SEQ ID NO: 5146217 - DNA, 21 bp, Homo sapiens
accctgggtttggcccctgga

SEQ ID NO: 5146218 - DNA, 13 bp, Homo sapiens
accctggtgacct

SEQ ID NO: 5146219 - DNA, 21 bp, Homo sapiens
accctggtgacctcctgtcac

SEQ ID NO: 5146220 - DNA, 12 bp, Homo sapiens
accctggtgctt

SEQ ID NO: 5146221 - DNA, 16 bp, Homo sapiens
accctggtgctttcct

SEQ ID NO: 5146222 - DNA, 19 bp, Homo sapiens
accctggtggttgctgttt

SEQ ID NO: 5146223 - DNA, 14 bp, Homo sapiens
accctgtaatggtt

SEQ ID NO: 5146224 - DNA, 23 bp, Homo sapiens
accctgtacatatctttgagttc

SEQ ID NO: 5146225 - DNA, 23 bp, Homo sapiens
accctgtacccttccttcttccc

SEQ ID NO: 5146226 - DNA, 15 bp, Homo sapiens
accctgtatatagcc

SEQ ID NO: 5146227 - DNA, 18 bp, Homo sapiens
accccatgcacctcaggg

SEQ ID NO: 5146228 - DNA, 17 bp, Homo sapiens
accccatgctgttgatt

SEQ ID NO: 5146229 - DNA, 22 bp, Homo sapiens
accccatgctgttgattgctaa

SEQ ID NO: 5146230 - DNA, 23 bp, Homo sapiens
accccatgctgttgattgctaaa

SEQ ID NO: 5146231 - DNA, 21 bp, Homo sapiens
accccatggagacaataaaca

SEQ ID NO: 5146232 - DNA, 19 bp, Homo sapiens
accccatggagctgggcta

SEQ ID NO: 5146233 - DNA, 13 bp, Homo sapiens
accccatgggctt

SEQ ID NO: 5146234 - DNA, 17 bp, Homo sapiens
accccatgggcttggac

SEQ ID NO: 5146235 - DNA, 17 bp, Homo sapiens
accccatggtccatccc

SEQ ID NO: 5146236 - DNA, 14 bp, Homo sapiens
accccatgtgcctt

SEQ ID NO: 5146237 - DNA, 15 bp, Homo sapiens
accccatgtgccttt

SEQ ID NO: 5146238 - DNA, 16 bp, Homo sapiens
accccatgtgccttta

SEQ ID NO: 5146239 - DNA, 17 bp, Homo sapiens
accccattctgggactg

SEQ ID NO: 5146240 - DNA, 18 bp, Homo sapiens
accccattctgggactgc

SEQ ID NO: 5146241 - DNA, 13 bp, Homo sapiens
accccattctttg

SEQ ID NO: 5146242 - DNA, 18 bp, Homo sapiens
accccatttgctttcttt

SEQ ID NO: 5146243 - DNA, 19 bp, Homo sapiens
acccccaaagacctgcctg

SEQ ID NO: 5146244 - DNA, 22 bp, Homo sapiens
acccccaaatacatcctgcgga

SEQ ID NO: 5146245 - DNA, 15 bp, Homo sapiens
acccccaacccccag

SEQ ID NO: 5146246 - DNA, 23 bp, Homo sapiens
acccccaagaaacctccatcctg

SEQ ID NO: 5146247 - DNA, 14 bp, Homo sapiens
acccccaagcctgg

SEQ ID NO: 5146248 - DNA, 21 bp, Homo sapiens
acccccaatatttttggactg

SEQ ID NO: 5146249 - DNA, 22 bp, Homo sapiens
acccccacaagctgtccctgca

SEQ ID NO: 5146250 - DNA, 12 bp, Homo sapiens
acccccacacac

SEQ ID NO: 5146251 - DNA, 13 bp, Homo sapiens
acccccacagacc

SEQ ID NO: 5146252 - DNA, 10 bp, Homo sapiens
acccccacca

SEQ ID NO: 5146253 - DNA, 13 bp, Homo sapiens
acccccaccacta

SEQ ID NO: 5146254 - DNA, 15 bp, Homo sapiens
acccccaccatgcag

SEQ ID NO: 5146255 - DNA, 14 bp, Homo sapiens
acccccacccacct

SEQ ID NO: 5146256 - DNA, 15 bp, Homo sapiens
acccccacccacctc

SEQ ID NO: 5146257 - DNA, 23 bp, Homo sapiens
acccccacccacctccacccagc

SEQ ID NO: 5146258 - DNA, 16 bp, Homo sapiens
acccccaccccacact

SEQ ID NO: 5146259 - DNA, 18 bp, Homo sapiens
acccccacccccagctca

SEQ ID NO: 5146260 - DNA, 19 bp, Homo sapiens
acccccacccccagctcaa

SEQ ID NO: 5146261 - DNA, 13 bp, Homo sapiens
acccccaccctgc

SEQ ID NO: 5146262 - DNA, 20 bp, Homo sapiens
acccccaccctgcactttcc

SEQ ID NO: 5146263 - DNA, 15 bp, Homo sapiens
acccccaccgaagag

SEQ ID NO: 5146264 - DNA, 21 bp, Homo sapiens
acccccaccgaagagccctga

SEQ ID NO: 5146265 - DNA, 22 bp, Homo sapiens
acccccaccgaagagccctgag

SEQ ID NO: 5146266 - DNA, 20 bp, Homo sapiens
acccccacctcaaggtcagg

SEQ ID NO: 5146267 - DNA, 14 bp, Homo sapiens
acccccacctcccg

SEQ ID NO: 5146268 - DNA, 16 bp, Homo sapiens
acccccacctcccggt

SEQ ID NO: 5146269 - DNA, 17 bp, Homo sapiens
acccccacctccctgca

SEQ ID NO: 5146270 - DNA, 23 bp, Homo sapiens
acccccacgattggccacctgta

SEQ ID NO: 5146271 - DNA, 18 bp, Homo sapiens
acccccactctcattccc

SEQ ID NO: 5146272 - DNA, 21 bp, Homo sapiens
acccccactctcattccccag

SEQ ID NO: 5146273 - DNA, 18 bp, Homo sapiens
acccccactttcgcctcc

SEQ ID NO: 5146274 - DNA, 20 bp, Homo sapiens
acccccactttcgcctcctc

SEQ ID NO: 5146275 - DNA, 16 bp, Homo sapiens
acccccagcaaccctc

SEQ ID NO: 5146276 - DNA, 22 bp, Homo sapiens
acccccagcacccgggctcagg

SEQ ID NO: 5146277 - DNA, 11 bp, Homo sapiens
acccccagcca

SEQ ID NO: 5146278 - DNA, 13 bp, Homo sapiens
acccccagcccac

SEQ ID NO: 5146279 - DNA, 14 bp, Homo sapiens
acccccagcccaca

SEQ ID NO: 5146280 - DNA, 14 bp, Homo sapiens
acccccagcctccc

SEQ ID NO: 5146281 - DNA, 15 bp, Homo sapiens
acccccagcctgcta

SEQ ID NO: 5146282 - DNA, 13 bp, Homo sapiens
acccccagcctgg

SEQ ID NO: 5146283 - DNA, 15 bp, Homo sapiens
acccccagcctgggc

SEQ ID NO: 5146284 - DNA, 17 bp, Homo sapiens
acccccagcctgggcct

SEQ ID NO: 5146285 - DNA, 21 bp, Homo sapiens
acccccagccttgcccagctt

SEQ ID NO: 5146286 - DNA, 19 bp, Homo sapiens
acccccagctaataaacca

SEQ ID NO: 5146287 - DNA, 20 bp, Homo sapiens
acccccagctcaatggactg

SEQ ID NO: 5146288 - DNA, 13 bp, Homo sapiens
acccccagctccc

SEQ ID NO: 5146289 - DNA, 16 bp, Homo sapiens
acccccagctgactgt

SEQ ID NO: 5146290 - DNA, 19 bp, Homo sapiens
acccccagctgactgttgg

SEQ ID NO: 5146291 - DNA, 22 bp, Homo sapiens
acccccagctttgcccaacacc

SEQ ID NO: 5146292 - DNA, 13 bp, Homo sapiens
acccccaggacct

SEQ ID NO: 5146293 - DNA, 13 bp, Homo sapiens
acccccaggcaga

SEQ ID NO: 5146294 - DNA, 11 bp, Homo sapiens
acccccaggcc

SEQ ID NO: 5146295 - DNA, 17 bp, Homo sapiens
acccccaggcctgtcca

SEQ ID NO: 5146296 - DNA, 14 bp, Homo sapiens
acccccaggtggcc

SEQ ID NO: 5146297 - DNA, 17 bp, Homo sapiens
acccccagtcctcactg

SEQ ID NO: 5146298 - DNA, 18 bp, Homo sapiens
acccccagtcctccctag

SEQ ID NO: 5146299 - DNA, 14 bp, Homo sapiens
acccccagtgcagc

SEQ ID NO: 5146300 - DNA, 15 bp, Homo sapiens
acccccagtgccaca

SEQ ID NO: 5146301 - DNA, 16 bp, Homo sapiens
acccccagtgccacag

SEQ ID NO: 5146302 - DNA, 19 bp, Homo sapiens
acccccagtgccacagaga

SEQ ID NO: 5146303 - DNA, 14 bp, Homo sapiens
acccccagttccta

SEQ ID NO: 5146304 - DNA, 12 bp, Homo sapiens
acccccatccag

SEQ ID NO: 5146305 - DNA, 17 bp, Homo sapiens
acccccatccctcggga

SEQ ID NO: 5146306 - DNA, 15 bp, Homo sapiens
acccccatcgctctg

SEQ ID NO: 5146307 - DNA, 17 bp, Homo sapiens
acccccatctctccctc

SEQ ID NO: 5146308 - DNA, 15 bp, Homo sapiens
acccccatgccaatg

SEQ ID NO: 5146309 - DNA, 19 bp, Homo sapiens
acccccatgccaatgtcca

SEQ ID NO: 5146310 - DNA, 20 bp, Homo sapiens
acccccatggccccaggccc

SEQ ID NO: 5146311 - DNA, 15 bp, Homo sapiens
acccccattctgtcc

SEQ ID NO: 5146312 - DNA, 19 bp, Homo sapiens
accccccaacccctgagga

SEQ ID NO: 5146313 - DNA, 14 bp, Homo sapiens
accccccaagctgt

SEQ ID NO: 5146314 - DNA, 14 bp, Homo sapiens
accccccactcagt

SEQ ID NO: 5146315 - DNA, 20 bp, Homo sapiens
accccccactcagtgcctcc

SEQ ID NO: 5146316 - DNA, 12 bp, Homo sapiens
accccccactcc

SEQ ID NO: 5146317 - DNA, 20 bp, Homo sapiens
accccccagaacctgtcctt

SEQ ID NO: 5146318 - DNA, 12 bp, Homo sapiens
accccccagcac

SEQ ID NO: 5146319 - DNA, 17 bp, Homo sapiens
accccccagcactgagg

SEQ ID NO: 5146320 - DNA, 19 bp, Homo sapiens
accccccagcactgaggaa

SEQ ID NO: 5146321 - DNA, 21 bp, Homo sapiens
accccccagcccctcctccct

SEQ ID NO: 5146322 - DNA, 12 bp, Homo sapiens
acccccccagct

SEQ ID NO: 5146323 - DNA, 12 bp, Homo sapiens
acccccccaggc

SEQ ID NO: 5146324 - DNA, 21 bp, Homo sapiens
acccccccagtccgccccgtg

SEQ ID NO: 5146325 - DNA, 21 bp, Homo sapiens
accccccccattagaatgtga

SEQ ID NO: 5146326 - DNA, 18 bp, Homo sapiens
accccccgtctcctgccg

SEQ ID NO: 5146327 - DNA, 19 bp, Homo sapiens
acccccctccccaactccc

SEQ ID NO: 5146328 - DNA, 11 bp, Homo sapiens
acccccctcct

SEQ ID NO: 5146329 - DNA, 12 bp, Homo sapiens
acccccctcctc

SEQ ID NO: 5146330 - DNA, 14 bp, Homo sapiens
acccccctcctccc

SEQ ID NO: 5146331 - DNA, 14 bp, Homo sapiens
acccccctcctgct

SEQ ID NO: 5146332 - DNA, 15 bp, Homo sapiens
acccccctcctgctc

SEQ ID NO: 5146333 - DNA, 17 bp, Homo sapiens
acccccctcctgctcct

SEQ ID NO: 5146334 - DNA, 18 bp, Homo sapiens
acccccctctctttctct

SEQ ID NO: 5146335 - DNA, 11 bp, Homo sapiens
acccccctctg

SEQ ID NO: 5146336 - DNA, 12 bp, Homo sapiens
acccccctgggc

SEQ ID NO: 5146337 - DNA, 17 bp, Homo sapiens
acccccctgttctaagg

SEQ ID NO: 5146338 - DNA, 20 bp, Homo sapiens
acccccctttcacaggcagc

SEQ ID NO: 5146339 - DNA, 21 bp, Homo sapiens
acccccctttcacaggcagcc

SEQ ID NO: 5146340 - DNA, 17 bp, Homo sapiens
acccccgacggcctcca

SEQ ID NO: 5146341 - DNA, 17 bp, Homo sapiens
acccccgacgtgctccc

SEQ ID NO: 5146342 - DNA, 23 bp, Homo sapiens
acccccgacgtgctcccctgctc

SEQ ID NO: 5146343 - DNA, 18 bp, Homo sapiens
acccccgagcttgcctca

SEQ ID NO: 5146344 - DNA, 16 bp, Homo sapiens
acccccgaggggaggg

SEQ ID NO: 5146345 - DNA, 23 bp, Homo sapiens
acccccgcaccaagcagacaaag

SEQ ID NO: 5146346 - DNA, 21 bp, Homo sapiens
acccccgccacctcagggcac

SEQ ID NO: 5146347 - DNA, 14 bp, Homo sapiens
acccccgccacggc

SEQ ID NO: 5146348 - DNA, 20 bp, Homo sapiens
acccccgccacggccaccct

SEQ ID NO: 5146349 - DNA, 13 bp, Homo sapiens
acccccgccaggc

SEQ ID NO: 5146350 - DNA, 15 bp, Homo sapiens
acccccgccaggcgc

SEQ ID NO: 5146351 - DNA, 13 bp, Homo sapiens
acccccgccatgc

SEQ ID NO: 5146352 - DNA, 23 bp, Homo sapiens
acccccgcccaggctggccagcc

SEQ ID NO: 5146353 - DNA, 14 bp, Homo sapiens
acccccgcccccac

SEQ ID NO: 5146354 - DNA, 16 bp, Homo sapiens
acccccgcccccaccg

SEQ ID NO: 5146355 - DNA, 13 bp, Homo sapiens
acccccgccccct

SEQ ID NO: 5146356 - DNA, 14 bp, Homo sapiens
acccccgctccaga

SEQ ID NO: 5146357 - DNA, 16 bp, Homo sapiens
acccccggcccagtgc

SEQ ID NO: 5146358 - DNA, 17 bp, Homo sapiens
acccccggcctccaggc

SEQ ID NO: 5146359 - DNA, 15 bp, Homo sapiens
acccccgggtgcctg

SEQ ID NO: 5146360 - DNA, 19 bp, Homo sapiens
acccccgtcctcttcgaga

SEQ ID NO: 5146361 - DNA, 15 bp, Homo sapiens
acccccgtgccaaat

SEQ ID NO: 5146362 - DNA, 22 bp, Homo sapiens
acccccgtgccaaatcctgggc

SEQ ID NO: 5146363 - DNA, 17 bp, Homo sapiens
acccccgtggtctttga

SEQ ID NO: 5146364 - DNA, 21 bp, Homo sapiens
accccctcaaaagccaaaaaa

SEQ ID NO: 5146365 - DNA, 19 bp, Homo sapiens
accccctcaagccaatccc

SEQ ID NO: 5146366 - DNA, 14 bp, Homo sapiens
accccctcaagccc

SEQ ID NO: 5146367 - DNA, 21 bp, Homo sapiens
accccctcaagccccagcagc

SEQ ID NO: 5146368 - DNA, 17 bp, Homo sapiens
accccctcaccatccag

SEQ ID NO: 5146369 - DNA, 13 bp, Homo sapiens
accccctcacccc

SEQ ID NO: 5146370 - DNA, 14 bp, Homo sapiens
accccctcatcccc

SEQ ID NO: 5146371 - DNA, 18 bp, Homo sapiens
accccctcatcccccagt

SEQ ID NO: 5146372 - DNA, 15 bp, Homo sapiens
accccctcattcccc

SEQ ID NO: 5146373 - DNA, 15 bp, Homo sapiens
accccctccagctcc

SEQ ID NO: 5146374 - DNA, 13 bp, Homo sapiens
accccctcccacc

SEQ ID NO: 5146375 - DNA, 14 bp, Homo sapiens
accccctcccaccc

SEQ ID NO: 5146376 - DNA, 19 bp, Homo sapiens
accccctcccacccccagc

SEQ ID NO: 5146377 - DNA, 14 bp, Homo sapiens
accccctccccagg

SEQ ID NO: 5146378 - DNA, 20 bp, Homo sapiens
accccctccccgcccctgtg

SEQ ID NO: 5146379 - DNA, 21 bp, Homo sapiens
accccctccccgggcagcaga

SEQ ID NO: 5146380 - DNA, 15 bp, Homo sapiens
accccctccctggcc

SEQ ID NO: 5146381 - DNA, 16 bp, Homo sapiens
accccctccctggcct

SEQ ID NO: 5146382 - DNA, 17 bp, Homo sapiens
accccctccctggcctg

SEQ ID NO: 5146383 - DNA, 15 bp, Homo sapiens
accccctcctggcaa

SEQ ID NO: 5146384 - DNA, 11 bp, Homo sapiens
accccctcctt

SEQ ID NO: 5146385 - DNA, 12 bp, Homo sapiens
accccctccttc

SEQ ID NO: 5146386 - DNA, 15 bp, Homo sapiens
accccctcggagcct

SEQ ID NO: 5146387 - DNA, 18 bp, Homo sapiens
accccctcgggtctcctc

SEQ ID NO: 5146388 - DNA, 21 bp, Homo sapiens
accccctcgggtctcctcact

SEQ ID NO: 5146389 - DNA, 15 bp, Homo sapiens
accccctctccctgc

SEQ ID NO: 5146390 - DNA, 16 bp, Homo sapiens
accccctctgctctgt

SEQ ID NO: 5146391 - DNA, 18 bp, Homo sapiens
accccctcttcaaagcag

SEQ ID NO: 5146392 - DNA, 19 bp, Homo sapiens
accccctcttcaaagcaga

SEQ ID NO: 5146393 - DNA, 20 bp, Homo sapiens
accccctcttcaaagcagag

SEQ ID NO: 5146394 - DNA, 19 bp, Homo sapiens
accccctctttgtgtactt

SEQ ID NO: 5146395 - DNA, 11 bp, Homo sapiens
accccctgaat

SEQ ID NO: 5146396 - DNA, 20 bp, Homo sapiens
accccctgagatcccctgag

SEQ ID NO: 5146397 - DNA, 14 bp, Homo sapiens
accccctgcaaagc

SEQ ID NO: 5146398 - DNA, 13 bp, Homo sapiens
accccctgcagcc

SEQ ID NO: 5146399 - DNA, 16 bp, Homo sapiens
accccctgcagcccag

SEQ ID NO: 5146400 - DNA, 15 bp, Homo sapiens
accccctgcccacaa

SEQ ID NO: 5146401 - DNA, 19 bp, Homo sapiens
accccctgccccagagaag

SEQ ID NO: 5146402 - DNA, 13 bp, Homo sapiens
accccctgcccgc

SEQ ID NO: 5146403 - DNA, 14 bp, Homo sapiens
accccctgcccgcc

SEQ ID NO: 5146404 - DNA, 15 bp, Homo sapiens
accccctgcccgcca

SEQ ID NO: 5146405 - DNA, 14 bp, Homo sapiens
accccctgccctgc

SEQ ID NO: 5146406 - DNA, 15 bp, Homo sapiens
accccctgccctgca

SEQ ID NO: 5146407 - DNA, 14 bp, Homo sapiens
accccctgcctggt

SEQ ID NO: 5146408 - DNA, 22 bp, Homo sapiens
accccctgctccaccagcagca

SEQ ID NO: 5146409 - DNA, 18 bp, Homo sapiens
accctgtatatagcccag

SEQ ID NO: 5146410 - DNA, 18 bp, Homo sapiens
accctgtatatcagggta

SEQ ID NO: 5146411 - DNA, 18 bp, Homo sapiens
accctgtatggagctaga

SEQ ID NO: 5146412 - DNA, 21 bp, Homo sapiens
accctgtatggagctagagag

SEQ ID NO: 5146413 - DNA, 15 bp, Homo sapiens
accctgtcacccaca

SEQ ID NO: 5146414 - DNA, 17 bp, Homo sapiens
accctgtcacttgctgg

SEQ ID NO: 5146415 - DNA, 22 bp, Homo sapiens
accctgtcagacgttggtccca

SEQ ID NO: 5146416 - DNA, 12 bp, Homo sapiens
accctgtcagga

SEQ ID NO: 5146417 - DNA, 14 bp, Homo sapiens
accctgtcccaggc

SEQ ID NO: 5146418 - DNA, 11 bp, Homo sapiens
accctgtcccc

SEQ ID NO: 5146419 - DNA, 16 bp, Homo sapiens
accctgtcccccagct

SEQ ID NO: 5146420 - DNA, 19 bp, Homo sapiens
accctgtcccccagctctg

SEQ ID NO: 5146421 - DNA, 16 bp, Homo sapiens
accctgtccggcccag

SEQ ID NO: 5146422 - DNA, 23 bp, Homo sapiens
accctgtccggcccagtgccact

SEQ ID NO: 5146423 - DNA, 12 bp, Homo sapiens
accctgtcctcc

SEQ ID NO: 5146424 - DNA, 16 bp, Homo sapiens
accctgtcctcccacc

SEQ ID NO: 5146425 - DNA, 21 bp, Homo sapiens
accctgtcctcccacccctcc

SEQ ID NO: 5146426 - DNA, 16 bp, Homo sapiens
accctgtcctgcacac

SEQ ID NO: 5146427 - DNA, 19 bp, Homo sapiens
accctgtcctgcacaccct

SEQ ID NO: 5146428 - DNA, 21 bp, Homo sapiens
accctgtctctactaaaaata

SEQ ID NO: 5146429 - DNA, 15 bp, Homo sapiens
accctgtctgcaggc

SEQ ID NO: 5146430 - DNA, 15 bp, Homo sapiens
accctgtcttcctct

SEQ ID NO: 5146431 - DNA, 17 bp, Homo sapiens
accctgtcttcctctgc

SEQ ID NO: 5146432 - DNA, 23 bp, Homo sapiens
accctgtcttctgggcacagtgg

SEQ ID NO: 5146433 - DNA, 21 bp, Homo sapiens
accctgtgaccctctcacttt

SEQ ID NO: 5146434 - DNA, 15 bp, Homo sapiens
accctgtgaccgcag

SEQ ID NO: 5146435 - DNA, 20 bp, Homo sapiens
accctgtgatggggccctgc

SEQ ID NO: 5146436 - DNA, 22 bp, Homo sapiens
accctgtgatggggccctgcct

SEQ ID NO: 5146437 - DNA, 15 bp, Homo sapiens
accctgtgccccagt

SEQ ID NO: 5146438 - DNA, 15 bp, Homo sapiens
accctgtgccccgcc

SEQ ID NO: 5146439 - DNA, 16 bp, Homo sapiens
accctgtgccccgcct

SEQ ID NO: 5146440 - DNA, 14 bp, Homo sapiens
accctgtgcccctt

SEQ ID NO: 5146441 - DNA, 17 bp, Homo sapiens
accctgtgccctccttc

SEQ ID NO: 5146442 - DNA, 21 bp, Homo sapiens
accctgtgccctccttcccaa

SEQ ID NO: 5146443 - DNA, 13 bp, Homo sapiens
accctgtgcctgt

SEQ ID NO: 5146444 - DNA, 18 bp, Homo sapiens
accctgtgcctgtgtttc

SEQ ID NO: 5146445 - DNA, 19 bp, Homo sapiens
accctgtgctggtgtcctg

SEQ ID NO: 5146446 - DNA, 17 bp, Homo sapiens
accctgtggaagcatgg

SEQ ID NO: 5146447 - DNA, 23 bp, Homo sapiens
accctgtggaagcatggctgtct

SEQ ID NO: 5146448 - DNA, 18 bp, Homo sapiens
accctgtggcaaatgcca

SEQ ID NO: 5146449 - DNA, 15 bp, Homo sapiens
accctgtggccaggt

SEQ ID NO: 5146450 - DNA, 23 bp, Homo sapiens
accctgtgggcttatgtctctgc

SEQ ID NO: 5146451 - DNA, 19 bp, Homo sapiens
accctgtgggtgtctccct

SEQ ID NO: 5146452 - DNA, 20 bp, Homo sapiens
accctgtgggtgtctccctc

SEQ ID NO: 5146453 - DNA, 24 bp, Homo sapiens
accctgtggttgcctgccctcctg

SEQ ID NO: 5146454 - DNA, 16 bp, Homo sapiens
accctgtgtcagagcc

SEQ ID NO: 5146455 - DNA, 20 bp, Homo sapiens
accctgtgtcagagcctacc

SEQ ID NO: 5146456 - DNA, 18 bp, Homo sapiens
accctgtgtcctccacca

SEQ ID NO: 5146457 - DNA, 14 bp, Homo sapiens
accctgttacttat

SEQ ID NO: 5146458 - DNA, 19 bp, Homo sapiens
accctgttcccaagcaaag

SEQ ID NO: 5146459 - DNA, 18 bp, Homo sapiens
accctgttccctctttct

SEQ ID NO: 5146460 - DNA, 20 bp, Homo sapiens
accctgttgagtatttgctg

SEQ ID NO: 5146461 - DNA, 22 bp, Homo sapiens
accctgttgagtatttgctgtt

SEQ ID NO: 5146462 - DNA, 19 bp, Homo sapiens
accctgttgcaaaggaaat

SEQ ID NO: 5146463 - DNA, 12 bp, Homo sapiens
accctgttgcta

SEQ ID NO: 5146464 - DNA, 14 bp, Homo sapiens
accctgttgctaag

SEQ ID NO: 5146465 - DNA, 13 bp, Homo sapiens
accctgtttctgt

SEQ ID NO: 5146466 - DNA, 22 bp, Homo sapiens
accctgttttattgagttctga

SEQ ID NO: 5146467 - DNA, 16 bp, Homo sapiens
accctgttttccacac

SEQ ID NO: 5146468 - DNA, 19 bp, Homo sapiens
accctgttttccacaccat

SEQ ID NO: 5146469 - DNA, 20 bp, Homo sapiens
accctgttttccacaccatc

SEQ ID NO: 5146470 - DNA, 17 bp, Homo sapiens
accctgttttgagccct

SEQ ID NO: 5146471 - DNA, 15 bp, Homo sapiens
acccttaaaagaagg

SEQ ID NO: 5146472 - DNA, 23 bp, Homo sapiens
acccttaacccaaggagcacagg

SEQ ID NO: 5146473 - DNA, 17 bp, Homo sapiens
acccttaagccaatcat

SEQ ID NO: 5146474 - DNA, 18 bp, Homo sapiens
acccttaagctgtagaga

SEQ ID NO: 5146475 - DNA, 16 bp, Homo sapiens
acccttaagtcaccct

SEQ ID NO: 5146476 - DNA, 18 bp, Homo sapiens
acccttaccccttagcct

SEQ ID NO: 5146477 - DNA, 18 bp, Homo sapiens
acccttacttcctggcct

SEQ ID NO: 5146478 - DNA, 16 bp, Homo sapiens
acccttagaatccacg

SEQ ID NO: 5146479 - DNA, 23 bp, Homo sapiens
acccttagcttttagcctggctg

SEQ ID NO: 5146480 - DNA, 14 bp, Homo sapiens
acccttataaaatc

SEQ ID NO: 5146481 - DNA, 21 bp, Homo sapiens
acccttcaacgtttcttcact

SEQ ID NO: 5146482 - DNA, 19 bp, Homo sapiens
acccttcaactcctggctc

SEQ ID NO: 5146483 - DNA, 12 bp, Homo sapiens
acccttcaatgt

SEQ ID NO: 5146484 - DNA, 16 bp, Homo sapiens
acccttcaatgttaaa

SEQ ID NO: 5146485 - DNA, 17 bp, Homo sapiens
acccttcaatgttaaat

SEQ ID NO: 5146486 - DNA, 19 bp, Homo sapiens
acccttcaatgttaaatct

SEQ ID NO: 5146487 - DNA, 17 bp, Homo sapiens
acccttcacactgttat

SEQ ID NO: 5146488 - DNA, 15 bp, Homo sapiens
acccttcacgctggc

SEQ ID NO: 5146489 - DNA, 18 bp, Homo sapiens
acccttcacgctggcttc

SEQ ID NO: 5146490 - DNA, 20 bp, Homo sapiens
acccttcacgctggcttcca

SEQ ID NO: 5146491 - DNA, 12 bp, Homo sapiens
acccttcagacc

SEQ ID NO: 5146492 - DNA, 14 bp, Homo sapiens
acccttcagacccc

SEQ ID NO: 5146493 - DNA, 15 bp, Homo sapiens
acccttcatcttcct

SEQ ID NO: 5146494 - DNA, 19 bp, Homo sapiens
acccttcatcttcctgtgt

SEQ ID NO: 5146495 - DNA, 17 bp, Homo sapiens
acccttccacagctggc

SEQ ID NO: 5146496 - DNA, 18 bp, Homo sapiens
acccttccacagctggcc

SEQ ID NO: 5146497 - DNA, 13 bp, Homo sapiens
acccttccacctc

SEQ ID NO: 5146498 - DNA, 12 bp, Homo sapiens
acccttccatca

SEQ ID NO: 5146499 - DNA, 21 bp, Homo sapiens
acccttcccaatcagcactga

SEQ ID NO: 5146500 - DNA, 22 bp, Homo sapiens
acccttcccaatcagcactgaa

SEQ ID NO: 5146501 - DNA, 23 bp, Homo sapiens
acccttcccaatcagcactgaaa

SEQ ID NO: 5146502 - DNA, 15 bp, Homo sapiens
acccttcccagccct

SEQ ID NO: 5146503 - DNA, 16 bp, Homo sapiens
acccttcccagccctc

SEQ ID NO: 5146504 - DNA, 17 bp, Homo sapiens
acccttcccagccctca

SEQ ID NO: 5146505 - DNA, 18 bp, Homo sapiens
acccttcccagccctcat

SEQ ID NO: 5146506 - DNA, 22 bp, Homo sapiens
acccttcccctccttctccctt

SEQ ID NO: 5146507 - DNA, 19 bp, Homo sapiens
acccttcccgccctcggga

SEQ ID NO: 5146508 - DNA, 15 bp, Homo sapiens
acccttccctcttcc

SEQ ID NO: 5146509 - DNA, 23 bp, Homo sapiens
acccttccctcttccctctccct

SEQ ID NO: 5146510 - DNA, 16 bp, Homo sapiens
acccttccctgcacta

SEQ ID NO: 5146511 - DNA, 14 bp, Homo sapiens
acccttccctgcct

SEQ ID NO: 5146512 - DNA, 13 bp, Homo sapiens
acccttccctgct

SEQ ID NO: 5146513 - DNA, 19 bp, Homo sapiens
acccttcccttgagccctc

SEQ ID NO: 5146514 - DNA, 19 bp, Homo sapiens
acccttcctcaccacttcc

SEQ ID NO: 5146515 - DNA, 14 bp, Homo sapiens
acccttcctcatct

SEQ ID NO: 5146516 - DNA, 19 bp, Homo sapiens
acccttcctcatctgtgcc

SEQ ID NO: 5146517 - DNA, 13 bp, Homo sapiens
acccttcctcctc

SEQ ID NO: 5146518 - DNA, 22 bp, Homo sapiens
acccttcctgcatttctcttct

SEQ ID NO: 5146519 - DNA, 14 bp, Homo sapiens
acccttcctggccc

SEQ ID NO: 5146520 - DNA, 15 bp, Homo sapiens
acccttcctggccca

SEQ ID NO: 5146521 - DNA, 20 bp, Homo sapiens
acccttcctggcccaggcct

SEQ ID NO: 5146522 - DNA, 19 bp, Homo sapiens
acccttctactttttcctt

SEQ ID NO: 5146523 - DNA, 23 bp, Homo sapiens
acccttctactttttccttcctg

SEQ ID NO: 5146524 - DNA, 20 bp, Homo sapiens
acccttctccaaaggctctg

SEQ ID NO: 5146525 - DNA, 21 bp, Homo sapiens
acccttctccaaaggctctgt

SEQ ID NO: 5146526 - DNA, 14 bp, Homo sapiens
acccttctcccact

SEQ ID NO: 5146527 - DNA, 17 bp, Homo sapiens
acccttctcccactctc

SEQ ID NO: 5146528 - DNA, 18 bp, Homo sapiens
acccttctcccactctcc

SEQ ID NO: 5146529 - DNA, 18 bp, Homo sapiens
acccttctcccctgcccc

SEQ ID NO: 5146530 - DNA, 19 bp, Homo sapiens
acccttctcctcttgtaaa

SEQ ID NO: 5146531 - DNA, 21 bp, Homo sapiens
acccttctcctcttgtaaata

SEQ ID NO: 5146532 - DNA, 23 bp, Homo sapiens
acccttctcctcttgtaaataaa

SEQ ID NO: 5146533 - DNA, 13 bp, Homo sapiens
acccttctccttt

SEQ ID NO: 5146534 - DNA, 23 bp, Homo sapiens
acccttctcctttccttcccagg

SEQ ID NO: 5146535 - DNA, 12 bp, Homo sapiens
acccttctcgga

SEQ ID NO: 5146536 - DNA, 19 bp, Homo sapiens
acccttctctgttggtctg

SEQ ID NO: 5146537 - DNA, 20 bp, Homo sapiens
acccttctctgttggtctgc

SEQ ID NO: 5146538 - DNA, 14 bp, Homo sapiens
acccttctcttctc

SEQ ID NO: 5146539 - DNA, 15 bp, Homo sapiens
acccttctcttctcc

SEQ ID NO: 5146540 - DNA, 16 bp, Homo sapiens
acccttctgctttcta

SEQ ID NO: 5146541 - DNA, 18 bp, Homo sapiens
acccttctggaaactgtg

SEQ ID NO: 5146542 - DNA, 12 bp, Homo sapiens
acccttctgggc

SEQ ID NO: 5146543 - DNA, 19 bp, Homo sapiens
acccttctgggtccaggga

SEQ ID NO: 5146544 - DNA, 13 bp, Homo sapiens
acccttctgtgcc

SEQ ID NO: 5146545 - DNA, 16 bp, Homo sapiens
acccttctgtgcccag

SEQ ID NO: 5146546 - DNA, 22 bp, Homo sapiens
acccttcttcatgttcaattat

SEQ ID NO: 5146547 - DNA, 16 bp, Homo sapiens
acccttcttgcctgct

SEQ ID NO: 5146548 - DNA, 19 bp, Homo sapiens
acccttcttgcctgctggg

SEQ ID NO: 5146549 - DNA, 14 bp, Homo sapiens
acccttcttgtctc

SEQ ID NO: 5146550 - DNA, 22 bp, Homo sapiens
acccttcttgtctctctggcaa

SEQ ID NO: 5146551 - DNA, 13 bp, Homo sapiens
acccttctttcca

SEQ ID NO: 5146552 - DNA, 15 bp, Homo sapiens
acccttctttcctct

SEQ ID NO: 5146553 - DNA, 18 bp, Homo sapiens
acccttctttcctcttcc

SEQ ID NO: 5146554 - DNA, 19 bp, Homo sapiens
acccttgaagatgtagctt

SEQ ID NO: 5146555 - DNA, 23 bp, Homo sapiens
acccttgaatgtagcagccccgg

SEQ ID NO: 5146556 - DNA, 20 bp, Homo sapiens
acccttgaatttctagacag

SEQ ID NO: 5146557 - DNA, 23 bp, Homo sapiens
acccttgaatttctagacagtat

SEQ ID NO: 5146558 - DNA, 15 bp, Homo sapiens
acccttgactgttat

SEQ ID NO: 5146559 - DNA, 20 bp, Homo sapiens
acccttgagacctggaacca

SEQ ID NO: 5146560 - DNA, 22 bp, Homo sapiens
acccttgattcattctgaaccc

SEQ ID NO: 5146561 - DNA, 17 bp, Homo sapiens
acccttgccgtctacct

SEQ ID NO: 5146562 - DNA, 15 bp, Homo sapiens
acccttgcctgcctc

SEQ ID NO: 5146563 - DNA, 19 bp, Homo sapiens
acccttgcctgcctcctag

SEQ ID NO: 5146564 - DNA, 18 bp, Homo sapiens
acccttgctgctgcccgc

SEQ ID NO: 5146565 - DNA, 13 bp, Homo sapiens
acccttggacttg

SEQ ID NO: 5146566 - DNA, 15 bp, Homo sapiens
acccttggacttgag

SEQ ID NO: 5146567 - DNA, 18 bp, Homo sapiens
acccttggcactgatggg

SEQ ID NO: 5146568 - DNA, 19 bp, Homo sapiens
acccttggcctccatttct

SEQ ID NO: 5146569 - DNA, 20 bp, Homo sapiens
acccttggcctccatttctg

SEQ ID NO: 5146570 - DNA, 23 bp, Homo sapiens
acccttggctatgaaaatgagcc

SEQ ID NO: 5146571 - DNA, 18 bp, Homo sapiens
acccttgggccagaagta

SEQ ID NO: 5146572 - DNA, 15 bp, Homo sapiens
acccttggtagagtt

SEQ ID NO: 5146573 - DNA, 16 bp, Homo sapiens
acccttggtagagttt

SEQ ID NO: 5146574 - DNA, 18 bp, Homo sapiens
acccttggtagagtttat

SEQ ID NO: 5146575 - DNA, 19 bp, Homo sapiens
acccttggtagagtttatt

SEQ ID NO: 5146576 - DNA, 21 bp, Homo sapiens
acccttggtagagtttatttt

SEQ ID NO: 5146577 - DNA, 23 bp, Homo sapiens
acccttggtctgtgttctcaaca

SEQ ID NO: 5146578 - DNA, 17 bp, Homo sapiens
acccttggtgtttccct

SEQ ID NO: 5146579 - DNA, 20 bp, Homo sapiens
acccttggtgtttcccttcc

SEQ ID NO: 5146580 - DNA, 23 bp, Homo sapiens
acccttggtgtttcccttcctcg

SEQ ID NO: 5146581 - DNA, 17 bp, Homo sapiens
acccttgtaccccatcc

SEQ ID NO: 5146582 - DNA, 19 bp, Homo sapiens
acccttgtaccccatccct

SEQ ID NO: 5146583 - DNA, 19 bp, Homo sapiens
acccttgtcatctctctgc

SEQ ID NO: 5146584 - DNA, 18 bp, Homo sapiens
acccttgtgagagcccat

SEQ ID NO: 5146585 - DNA, 21 bp, Homo sapiens
acccttgtgcctctcatcttt

SEQ ID NO: 5146586 - DNA, 16 bp, Homo sapiens
acccttgtggtcccac

SEQ ID NO: 5146587 - DNA, 17 bp, Homo sapiens
acccttgtggtcccacc

SEQ ID NO: 5146588 - DNA, 19 bp, Homo sapiens
acccttgtggtcccacccc

SEQ ID NO: 5146589 - DNA, 20 bp, Homo sapiens
acccttgttttttatagttg

SEQ ID NO: 5146590 - DNA, 15 bp, Homo sapiens
accctttaaatgtaa

SEQ ID NO: 5146591 - DNA, 14 bp, Homo sapiens
accctttaatgttc

SEQ ID NO: 5146592 - DNA, 21 bp, Homo sapiens
accctttacattttgtgcagt

SEQ ID NO: 5146593 - DNA, 15 bp, Homo sapiens
accctttatctctgt

SEQ ID NO: 5146594 - DNA, 15 bp, Homo sapiens
accctttcaccccca

SEQ ID NO: 5146595 - DNA, 22 bp, Homo sapiens
accctttcagaatcttttcaat

SEQ ID NO: 5146596 - DNA, 19 bp, Homo sapiens
accctttccggcacactgc

SEQ ID NO: 5146597 - DNA, 23 bp, Homo sapiens
accctttccggcacactgccaaa

SEQ ID NO: 5146598 - DNA, 15 bp, Homo sapiens
accctttcctccccc

SEQ ID NO: 5146599 - DNA, 20 bp, Homo sapiens
accctttcctcctttatcac

SEQ ID NO: 5146600 - DNA, 15 bp, Homo sapiens
accctttctgccagg

SEQ ID NO: 5146601 - DNA, 16 bp, Homo sapiens
accctttctgccaggg

SEQ ID NO: 5146602 - DNA, 17 bp, Homo sapiens
accctttctggcacgaa

SEQ ID NO: 5146603 - DNA, 22 bp, Homo sapiens
accctttctgtttggacccatg

SEQ ID NO: 5146604 - DNA, 22 bp, Homo sapiens
accctttgcctttcttctgccc

SEQ ID NO: 5146605 - DNA, 23 bp, Homo sapiens
accctttgtgtgctctccattct

SEQ ID NO: 5146606 - DNA, 13 bp, Homo sapiens
acccttttaacat

SEQ ID NO: 5146607 - DNA, 15 bp, Homo sapiens
acccttttccatttt

SEQ ID NO: 5146608 - DNA, 17 bp, Homo sapiens
acccttttcccccttcc

SEQ ID NO: 5146609 - DNA, 22 bp, Homo sapiens
acccttttcccccttcccattt

SEQ ID NO: 5146610 - DNA, 15 bp, Homo sapiens
acccttttcctccag

SEQ ID NO: 5146611 - DNA, 20 bp, Homo sapiens
acccttttcctccagacaga

SEQ ID NO: 5146612 - DNA, 19 bp, Homo sapiens
acccttttcctttgtggtt

SEQ ID NO: 5146613 - DNA, 15 bp, Homo sapiens
acccttttccttttt

SEQ ID NO: 5146614 - DNA, 18 bp, Homo sapiens
acccttttccttttttgg

SEQ ID NO: 5146615 - DNA, 19 bp, Homo sapiens
acccttttccttttttggg

SEQ ID NO: 5146616 - DNA, 16 bp, Homo sapiens
acccttttctcaggac

SEQ ID NO: 5146617 - DNA, 23 bp, Homo sapiens
acccttttggcccccgagctggg

SEQ ID NO: 5146618 - DNA, 21 bp, Homo sapiens
acccttttgggtttctgccct

SEQ ID NO: 5146619 - DNA, 14 bp, Homo sapiens
acccttttgtctgc

SEQ ID NO: 5146620 - DNA, 11 bp, Homo sapiens
accctttttgg

SEQ ID NO: 5146621 - DNA, 18 bp, Homo sapiens
accctttttttggggtgc

SEQ ID NO: 5146622 - DNA, 19 bp, Homo sapiens
accgaaaacgtggctgctt

SEQ ID NO: 5146623 - DNA, 22 bp, Homo sapiens
accgaaaacgtggctgcttcaa

SEQ ID NO: 5146624 - DNA, 17 bp, Homo sapiens
accgaaacagcgctggg

SEQ ID NO: 5146625 - DNA, 15 bp, Homo sapiens
accgaaatctgtatt

SEQ ID NO: 5146626 - DNA, 18 bp, Homo sapiens
accgaacatgaccaaaaa

SEQ ID NO: 5146627 - DNA, 23 bp, Homo sapiens
accgaacatgaccaaaaaccaaa

SEQ ID NO: 5146628 - DNA, 21 bp, Homo sapiens
accgaactcgggattacagaa

SEQ ID NO: 5146629 - DNA, 22 bp, Homo sapiens
accgaactcgggattacagaaa

SEQ ID NO: 5146630 - DNA, 18 bp, Homo sapiens
accgaagagccctgagct

SEQ ID NO: 5146631 - DNA, 13 bp, Homo sapiens
accgaagcccaga

SEQ ID NO: 5146632 - DNA, 18 bp, Homo sapiens
accgaagcccagagggtc

SEQ ID NO: 5146633 - DNA, 23 bp, Homo sapiens
accgaagtggactggcccctggg

SEQ ID NO: 5146634 - DNA, 16 bp, Homo sapiens
accgaatatattactg

SEQ ID NO: 5146635 - DNA, 23 bp, Homo sapiens
accgaatattcatggatggctca

SEQ ID NO: 5146636 - DNA, 12 bp, Homo sapiens
accgaatattga

SEQ ID NO: 5146637 - DNA, 19 bp, Homo sapiens
accgaatgtgtctttagat

SEQ ID NO: 5146638 - DNA, 22 bp, Homo sapiens
accgaatgtgtctttagatagc

SEQ ID NO: 5146639 - DNA, 18 bp, Homo sapiens
accgaattttattttaca

SEQ ID NO: 5146640 - DNA, 15 bp, Homo sapiens
accgacatttttcaa

SEQ ID NO: 5146641 - DNA, 14 bp, Homo sapiens
accgaccccgggcc

SEQ ID NO: 5146642 - DNA, 16 bp, Homo sapiens
accgaccccgggccgg

SEQ ID NO: 5146643 - DNA, 18 bp, Homo sapiens
accgacccgaggcccaga

SEQ ID NO: 5146644 - DNA, 21 bp, Homo sapiens
accgacgaaaaagtcactctt

SEQ ID NO: 5146645 - DNA, 16 bp, Homo sapiens
accgacgcgtctcctg

SEQ ID NO: 5146646 - DNA, 15 bp, Homo sapiens
accgactgcccagcc

SEQ ID NO: 5146647 - DNA, 14 bp, Homo sapiens
accgactttcccca

SEQ ID NO: 5146648 - DNA, 14 bp, Homo sapiens
accgagacatgaat

SEQ ID NO: 5146649 - DNA, 15 bp, Homo sapiens
accgagaccaaactc

SEQ ID NO: 5146650 - DNA, 16 bp, Homo sapiens
accgagactcagcctc

SEQ ID NO: 5146651 - DNA, 18 bp, Homo sapiens
accgagactcagcctctg

SEQ ID NO: 5146652 - DNA, 13 bp, Homo sapiens
accgagagccaaa

SEQ ID NO: 5146653 - DNA, 17 bp, Homo sapiens
accgagagtagccgaga

SEQ ID NO: 5146654 - DNA, 16 bp, Homo sapiens
accgagataggggagg

SEQ ID NO: 5146655 - DNA, 21 bp, Homo sapiens
accgagataggggagggggga

SEQ ID NO: 5146656 - DNA, 12 bp, Homo sapiens
accgagccagca

SEQ ID NO: 5146657 - DNA, 14 bp, Homo sapiens
accgagccctggag

SEQ ID NO: 5146658 - DNA, 18 bp, Homo sapiens
accgagcgctttctggaa

SEQ ID NO: 5146659 - DNA, 19 bp, Homo sapiens
accgagctctgtgggaaaa

SEQ ID NO: 5146660 - DNA, 12 bp, Homo sapiens
accgaggaccca

SEQ ID NO: 5146661 - DNA, 18 bp, Homo sapiens
accgaggacccatgaaac

SEQ ID NO: 5146662 - DNA, 14 bp, Homo sapiens
accgaggagcccca

SEQ ID NO: 5146663 - DNA, 15 bp, Homo sapiens
accgaggagccccag

SEQ ID NO: 5146664 - DNA, 21 bp, Homo sapiens
accgaggggcctttgttctgg

SEQ ID NO: 5146665 - DNA, 15 bp, Homo sapiens
accgagtatctgtaa

SEQ ID NO: 5146666 - DNA, 21 bp, Homo sapiens
accgagtctcttctccactgg

SEQ ID NO: 5146667 - DNA, 24 bp, Homo sapiens
accgagtctcttctccactggatg

SEQ ID NO: 5146668 - DNA, 15 bp, Homo sapiens
accgagtgatttcca

SEQ ID NO: 5146669 - DNA, 22 bp, Homo sapiens
accgagtgtggagctgcttcca

SEQ ID NO: 5146670 - DNA, 16 bp, Homo sapiens
accgataatgcatgaa

SEQ ID NO: 5146671 - DNA, 19 bp, Homo sapiens
accgataatgcatgaagca

SEQ ID NO: 5146672 - DNA, 20 bp, Homo sapiens
accgatgcaaacattggaag

SEQ ID NO: 5146673 - DNA, 13 bp, Homo sapiens
accgatgctccag

SEQ ID NO: 5146674 - DNA, 13 bp, Homo sapiens
accgatgctttac

SEQ ID NO: 5146675 - DNA, 15 bp, Homo sapiens
accgatgctttacca

SEQ ID NO: 5146676 - DNA, 13 bp, Homo sapiens
accgatggagccc

SEQ ID NO: 5146677 - DNA, 14 bp, Homo sapiens
accgatggtcccag

SEQ ID NO: 5146678 - DNA, 15 bp, Homo sapiens
accgattcttccttg

SEQ ID NO: 5146679 - DNA, 20 bp, Homo sapiens
accgattcttccttgccaca

SEQ ID NO: 5146680 - DNA, 12 bp, Homo sapiens
accgatttctgc

SEQ ID NO: 5146681 - DNA, 18 bp, Homo sapiens
accgatttctgctaagtt

SEQ ID NO: 5146682 - DNA, 22 bp, Homo sapiens
accgattttttttttttcctct

SEQ ID NO: 5146683 - DNA, 23 bp, Homo sapiens
accgattttttttttttcctctt

SEQ ID NO: 5146684 - DNA, 18 bp, Homo sapiens
accgcaaacgtgaaattc

SEQ ID NO: 5146685 - DNA, 14 bp, Homo sapiens
accgcaactcacac

SEQ ID NO: 5146686 - DNA, 17 bp, Homo sapiens
accgcaactcacacatt

SEQ ID NO: 5146687 - DNA, 14 bp, Homo sapiens
accgcacagctcag

SEQ ID NO: 5146688 - DNA, 11 bp, Homo sapiens
accgcacttat

SEQ ID NO: 5146689 - DNA, 13 bp, Homo sapiens
accgcagaaggaa

SEQ ID NO: 5146690 - DNA, 16 bp, Homo sapiens
accgcagacaggacca

SEQ ID NO: 5146691 - DNA, 16 bp, Homo sapiens
accgcagcctgtcagc

SEQ ID NO: 5146692 - DNA, 14 bp, Homo sapiens
accgcagctgctgc

SEQ ID NO: 5146693 - DNA, 21 bp, Homo sapiens
accgcagctgctgccactctg

SEQ ID NO: 5146694 - DNA, 19 bp, Homo sapiens
accgcaggggactgtctca

SEQ ID NO: 5146695 - DNA, 15 bp, Homo sapiens
accgcaggtgctcat

SEQ ID NO: 5146696 - DNA, 13 bp, Homo sapiens
accgcatcctcac

SEQ ID NO: 5146697 - DNA, 16 bp, Homo sapiens
accgcatcctcactgg

SEQ ID NO: 5146698 - DNA, 21 bp, Homo sapiens
accgcatcctcactgggctca

SEQ ID NO: 5146699 - DNA, 13 bp, Homo sapiens
accgcatctgctc

SEQ ID NO: 5146700 - DNA, 18 bp, Homo sapiens
accgcatctgctcatctg

SEQ ID NO: 5146701 - DNA, 20 bp, Homo sapiens
accgcatctgctcatctgat

SEQ ID NO: 5146702 - DNA, 13 bp, Homo sapiens
accgcatggcagc

SEQ ID NO: 5146703 - DNA, 21 bp, Homo sapiens
accgcatggcagctgggccca

SEQ ID NO: 5146704 - DNA, 13 bp, Homo sapiens
accgcattccagg

SEQ ID NO: 5146705 - DNA, 14 bp, Homo sapiens
accgcattccaggg

SEQ ID NO: 5146706 - DNA, 17 bp, Homo sapiens
accgccaaggctggggg

SEQ ID NO: 5146707 - DNA, 20 bp, Homo sapiens
accgccacgtcccagcatcc

SEQ ID NO: 5146708 - DNA, 16 bp, Homo sapiens
accgccagagtgtcct

SEQ ID NO: 5146709 - DNA, 21 bp, Homo sapiens
accgccagctctgttcttcct

SEQ ID NO: 5146710 - DNA, 23 bp, Homo sapiens
accgccatgcaactccatgccta

SEQ ID NO: 5146711 - DNA, 19 bp, Homo sapiens
accgccatgcatgatgggt

SEQ ID NO: 5146712 - DNA, 16 bp, Homo sapiens
accgcccaacccccac

SEQ ID NO: 5146713 - DNA, 17 bp, Homo sapiens
accgcccaacccccacc

SEQ ID NO: 5146714 - DNA, 18 bp, Homo sapiens
accgcccaacccccacct

SEQ ID NO: 5146715 - DNA, 21 bp, Homo sapiens
accgcccaacccccacctccc

SEQ ID NO: 5146716 - DNA, 11 bp, Homo sapiens
accgcccaccc

SEQ ID NO: 5146717 - DNA, 14 bp, Homo sapiens
accgcccacccaca

SEQ ID NO: 5146718 - DNA, 16 bp, Homo sapiens
accgcccacccacacc

SEQ ID NO: 5146719 - DNA, 18 bp, Homo sapiens
accgcccacccacacccc

SEQ ID NO: 5146720 - DNA, 14 bp, Homo sapiens
accgcccacccagc

SEQ ID NO: 5146721 - DNA, 21 bp, Homo sapiens
accgcccacccagcagcgccc

SEQ ID NO: 5146722 - DNA, 23 bp, Homo sapiens
accgcccagcggcttgcctgcct

SEQ ID NO: 5146723 - DNA, 15 bp, Homo sapiens
accgcccagctctcc

SEQ ID NO: 5146724 - DNA, 16 bp, Homo sapiens
accgcccagctctccc

SEQ ID NO: 5146725 - DNA, 11 bp, Homo sapiens
accgcccatca

SEQ ID NO: 5146726 - DNA, 14 bp, Homo sapiens
accgccccaggcac

SEQ ID NO: 5146727 - DNA, 15 bp, Homo sapiens
accgcccccacccct

SEQ ID NO: 5146728 - DNA, 22 bp, Homo sapiens
accgcccccaccccttccccag

SEQ ID NO: 5146729 - DNA, 11 bp, Homo sapiens
accgccccctc

SEQ ID NO: 5146730 - DNA, 13 bp, Homo sapiens
accgcccggcagc

SEQ ID NO: 5146731 - DNA, 20 bp, Homo sapiens
accgcccggcagccccttct

SEQ ID NO: 5146732 - DNA, 13 bp, Homo sapiens
accgccctcctcg

SEQ ID NO: 5146733 - DNA, 21 bp, Homo sapiens
accgccctcctcgctgtgcca

SEQ ID NO: 5146734 - DNA, 22 bp, Homo sapiens
accgccctcctcgctgtgccac

SEQ ID NO: 5146735 - DNA, 19 bp, Homo sapiens
accgccgcagaagcagccc

SEQ ID NO: 5146736 - DNA, 17 bp, Homo sapiens
accgccggggtcctggg

SEQ ID NO: 5146737 - DNA, 18 bp, Homo sapiens
accgccggggtcctggga

SEQ ID NO: 5146738 - DNA, 20 bp, Homo sapiens
accgccggttcattttgcac

SEQ ID NO: 5146739 - DNA, 20 bp, Homo sapiens
accgcctccccacctccagg

SEQ ID NO: 5146740 - DNA, 16 bp, Homo sapiens
accgcctcctacagcc

SEQ ID NO: 5146741 - DNA, 15 bp, Homo sapiens
accgcctcgtgccag

SEQ ID NO: 5146742 - DNA, 16 bp, Homo sapiens
accgcctcgtgccagc

SEQ ID NO: 5146743 - DNA, 17 bp, Homo sapiens
accgcctcgtgccagca

SEQ ID NO: 5146744 - DNA, 19 bp, Homo sapiens
accgcctcgtgccagcagc

SEQ ID NO: 5146745 - DNA, 21 bp, Homo sapiens
accgcctcgtgccagcagcct

SEQ ID NO: 5146746 - DNA, 13 bp, Homo sapiens
accgcctcttccc

SEQ ID NO: 5146747 - DNA, 14 bp, Homo sapiens
accgcctcttcccg

SEQ ID NO: 5146748 - DNA, 12 bp, Homo sapiens
accgcctgccct

SEQ ID NO: 5146749 - DNA, 13 bp, Homo sapiens
accgcctgccctc

SEQ ID NO: 5146750 - DNA, 15 bp, Homo sapiens
accgcctgccctccc

SEQ ID NO: 5146751 - DNA, 22 bp, Homo sapiens
accgcctgccctcccgcacctt

SEQ ID NO: 5146752 - DNA, 17 bp, Homo sapiens
accgcctgccctgcctg

SEQ ID NO: 5146753 - DNA, 18 bp, Homo sapiens
accgcctgccctgcctgg

SEQ ID NO: 5146754 - DNA, 14 bp, Homo sapiens
accgcctgcttcac

SEQ ID NO: 5146755 - DNA, 16 bp, Homo sapiens
accgcctgcttcacac

SEQ ID NO: 5146756 - DNA, 20 bp, Homo sapiens
accgcctgcttcacacccct

SEQ ID NO: 5146757 - DNA, 21 bp, Homo sapiens
accgcctgcttcacacccctc

SEQ ID NO: 5146758 - DNA, 13 bp, Homo sapiens
accgcctggccct

SEQ ID NO: 5146759 - DNA, 14 bp, Homo sapiens
accgcctggccctc

SEQ ID NO: 5146760 - DNA, 18 bp, Homo sapiens
accgcctggccctccctc

SEQ ID NO: 5146761 - DNA, 20 bp, Homo sapiens
accgcctggccctccctccc

SEQ ID NO: 5146762 - DNA, 16 bp, Homo sapiens
accgccttgcccagcc

SEQ ID NO: 5146763 - DNA, 17 bp, Homo sapiens
accgccttgcccagcct

SEQ ID NO: 5146764 - DNA, 16 bp, Homo sapiens
accgcgagggcctgcg

SEQ ID NO: 5146765 - DNA, 14 bp, Homo sapiens
accgcgcatctctt

SEQ ID NO: 5146766 - DNA, 19 bp, Homo sapiens
accccctgctggtgcccac

SEQ ID NO: 5146767 - DNA, 12 bp, Homo sapiens
accccctggaga

SEQ ID NO: 5146768 - DNA, 17 bp, Homo sapiens
accccctggccctgcct

SEQ ID NO: 5146769 - DNA, 13 bp, Homo sapiens
accccctgggcag

SEQ ID NO: 5146770 - DNA, 19 bp, Homo sapiens
accccctgggcagatgtcc

SEQ ID NO: 5146771 - DNA, 21 bp, Homo sapiens
accccctgtcccattctagat

SEQ ID NO: 5146772 - DNA, 16 bp, Homo sapiens
accccctgttccctgt

SEQ ID NO: 5146773 - DNA, 16 bp, Homo sapiens
acccccttcagtgccc

SEQ ID NO: 5146774 - DNA, 18 bp, Homo sapiens
acccccttcagtgcccac

SEQ ID NO: 5146775 - DNA, 21 bp, Homo sapiens
acccccttccccgctcttgcc

SEQ ID NO: 5146776 - DNA, 19 bp, Homo sapiens
acccccttcctactcccag

SEQ ID NO: 5146777 - DNA, 21 bp, Homo sapiens
acccccttctctgcccattcc

SEQ ID NO: 5146778 - DNA, 19 bp, Homo sapiens
acccccttgattcccaccg

SEQ ID NO: 5146779 - DNA, 11 bp, Homo sapiens
acccccttggt

SEQ ID NO: 5146780 - DNA, 16 bp, Homo sapiens
accccctttcccttct

SEQ ID NO: 5146781 - DNA, 18 bp, Homo sapiens
accccctttgactctggg

SEQ ID NO: 5146782 - DNA, 21 bp, Homo sapiens
acccccttttcagctgagccc

SEQ ID NO: 5146783 - DNA, 23 bp, Homo sapiens
accccgaaatcagcccccagcct

SEQ ID NO: 5146784 - DNA, 18 bp, Homo sapiens
accccgaccacctgccca

SEQ ID NO: 5146785 - DNA, 20 bp, Homo sapiens
accccgactatccctgcaca

SEQ ID NO: 5146786 - DNA, 23 bp, Homo sapiens
accccgactatccctgcacataa

SEQ ID NO: 5146787 - DNA, 14 bp, Homo sapiens
accccgaggccctg

SEQ ID NO: 5146788 - DNA, 15 bp, Homo sapiens
accccgaggccctgc

SEQ ID NO: 5146789 - DNA, 20 bp, Homo sapiens
accccgaggccctgcatggg

SEQ ID NO: 5146790 - DNA, 18 bp, Homo sapiens
accccgagggctgaggag

SEQ ID NO: 5146791 - DNA, 12 bp, Homo sapiens
accccgcactgc

SEQ ID NO: 5146792 - DNA, 20 bp, Homo sapiens
accccgcagacaccttggac

SEQ ID NO: 5146793 - DNA, 17 bp, Homo sapiens
accccgcagcacgcctc

SEQ ID NO: 5146794 - DNA, 19 bp, Homo sapiens
accccgcaggatccctcct

SEQ ID NO: 5146795 - DNA, 13 bp, Homo sapiens
accccgccagcct

SEQ ID NO: 5146796 - DNA, 15 bp, Homo sapiens
accccgccagcctac

SEQ ID NO: 5146797 - DNA, 18 bp, Homo sapiens
accccgccagcctacact

SEQ ID NO: 5146798 - DNA, 17 bp, Homo sapiens
accccgccgttccctgc

SEQ ID NO: 5146799 - DNA, 22 bp, Homo sapiens
accccgcctcccagccccaggg

SEQ ID NO: 5146800 - DNA, 14 bp, Homo sapiens
accccgcctctggg

SEQ ID NO: 5146801 - DNA, 13 bp, Homo sapiens
accccgcctgccc

SEQ ID NO: 5146802 - DNA, 13 bp, Homo sapiens
accccgcctgcct

SEQ ID NO: 5146803 - DNA, 20 bp, Homo sapiens
accccgcctgcctcctggct

SEQ ID NO: 5146804 - DNA, 13 bp, Homo sapiens
accccgcggccca

SEQ ID NO: 5146805 - DNA, 15 bp, Homo sapiens
accccgcggcccaga

SEQ ID NO: 5146806 - DNA, 20 bp, Homo sapiens
accccgcggcccagacccag

SEQ ID NO: 5146807 - DNA, 22 bp, Homo sapiens
accccgcggtgctctggcggct

SEQ ID NO: 5146808 - DNA, 21 bp, Homo sapiens
accccgctctgcatgcggccc

SEQ ID NO: 5146809 - DNA, 22 bp, Homo sapiens
accccgctctgcatgcggccca

SEQ ID NO: 5146810 - DNA, 14 bp, Homo sapiens
accccgctctggca

SEQ ID NO: 5146811 - DNA, 22 bp, Homo sapiens
accccgctcttcccaagtcctc

SEQ ID NO: 5146812 - DNA, 13 bp, Homo sapiens
accccgctgcctg

SEQ ID NO: 5146813 - DNA, 21 bp, Homo sapiens
accccgctgcctggcgggcag

SEQ ID NO: 5146814 - DNA, 18 bp, Homo sapiens
accccgcttttgcagcag

SEQ ID NO: 5146815 - DNA, 21 bp, Homo sapiens
accccgcttttgcagcagagg

SEQ ID NO: 5146816 - DNA, 22 bp, Homo sapiens
accccgcttttgcagcagagga

SEQ ID NO: 5146817 - DNA, 23 bp, Homo sapiens
accccggaggcgtggaggagagg

SEQ ID NO: 5146818 - DNA, 22 bp, Homo sapiens
accccggccggccacccaggag

SEQ ID NO: 5146819 - DNA, 13 bp, Homo sapiens
accccggcctcag

SEQ ID NO: 5146820 - DNA, 14 bp, Homo sapiens
accccggcctcagg

SEQ ID NO: 5146821 - DNA, 17 bp, Homo sapiens
accccggcctcagggcg

SEQ ID NO: 5146822 - DNA, 15 bp, Homo sapiens
accccggcctccact

SEQ ID NO: 5146823 - DNA, 21 bp, Homo sapiens
accccggcctccactccccca

SEQ ID NO: 5146824 - DNA, 21 bp, Homo sapiens
accccggctccccctgccagc

SEQ ID NO: 5146825 - DNA, 19 bp, Homo sapiens
accccgggcccgggccccc

SEQ ID NO: 5146826 - DNA, 13 bp, Homo sapiens
accccgggccgga

SEQ ID NO: 5146827 - DNA, 18 bp, Homo sapiens
accccgggctctctgctg

SEQ ID NO: 5146828 - DNA, 16 bp, Homo sapiens
accccggggaccctgt

SEQ ID NO: 5146829 - DNA, 21 bp, Homo sapiens
accccggtggcggccccagca

SEQ ID NO: 5146830 - DNA, 19 bp, Homo sapiens
accccgtcccggccccgcg

SEQ ID NO: 5146831 - DNA, 15 bp, Homo sapiens
accccgtccctttcc

SEQ ID NO: 5146832 - DNA, 18 bp, Homo sapiens
accccgtccctttccctg

SEQ ID NO: 5146833 - DNA, 21 bp, Homo sapiens
accccgtccctttccctgcat

SEQ ID NO: 5146834 - DNA, 20 bp, Homo sapiens
accccgtcgaggggctctca

SEQ ID NO: 5146835 - DNA, 16 bp, Homo sapiens
accccgtctctactaa

SEQ ID NO: 5146836 - DNA, 18 bp, Homo sapiens
accccgtgaagcaatcat

SEQ ID NO: 5146837 - DNA, 13 bp, Homo sapiens
accccgtgcccct

SEQ ID NO: 5146838 - DNA, 15 bp, Homo sapiens
accccgtggctctgg

SEQ ID NO: 5146839 - DNA, 14 bp, Homo sapiens
accccgttcccagc

SEQ ID NO: 5146840 - DNA, 16 bp, Homo sapiens
accccgttcccagcgc

SEQ ID NO: 5146841 - DNA, 22 bp, Homo sapiens
accccgttgttgtccctgcagg

SEQ ID NO: 5146842 - DNA, 17 bp, Homo sapiens
acccctaaaaacaaaac

SEQ ID NO: 5146843 - DNA, 17 bp, Homo sapiens
acccctaaaaagattgc

SEQ ID NO: 5146844 - DNA, 21 bp, Homo sapiens
acccctaaaagaaaccctgca

SEQ ID NO: 5146845 - DNA, 16 bp, Homo sapiens
acccctaaactccagg

SEQ ID NO: 5146846 - DNA, 22 bp, Homo sapiens
acccctaaagagatactttgat

SEQ ID NO: 5146847 - DNA, 19 bp, Homo sapiens
acccctaaagtgccaggtg

SEQ ID NO: 5146848 - DNA, 11 bp, Homo sapiens
acccctaacct

SEQ ID NO: 5146849 - DNA, 18 bp, Homo sapiens
acccctaacctggcttat

SEQ ID NO: 5146850 - DNA, 15 bp, Homo sapiens
acccctaatgtcagc

SEQ ID NO: 5146851 - DNA, 17 bp, Homo sapiens
acccctacacacacact

SEQ ID NO: 5146852 - DNA, 20 bp, Homo sapiens
acccctacacacacccaggc

SEQ ID NO: 5146853 - DNA, 14 bp, Homo sapiens
acccctacagcctg

SEQ ID NO: 5146854 - DNA, 16 bp, Homo sapiens
acccctacagcctgca

SEQ ID NO: 5146855 - DNA, 16 bp, Homo sapiens
acccctacatgaaaca

SEQ ID NO: 5146856 - DNA, 12 bp, Homo sapiens
acccctaccccc

SEQ ID NO: 5146857 - DNA, 22 bp, Homo sapiens
acccctacccccaaccctcaga

SEQ ID NO: 5146858 - DNA, 17 bp, Homo sapiens
acccctagaaaggagag

SEQ ID NO: 5146859 - DNA, 14 bp, Homo sapiens
acccctagcatgaa

SEQ ID NO: 5146860 - DNA, 16 bp, Homo sapiens
acccctagccaccagt

SEQ ID NO: 5146861 - DNA, 17 bp, Homo sapiens
acccctagccaccagtg

SEQ ID NO: 5146862 - DNA, 22 bp, Homo sapiens
acccctaggtcatttgtagata

SEQ ID NO: 5146863 - DNA, 14 bp, Homo sapiens
acccctagttccct

SEQ ID NO: 5146864 - DNA, 15 bp, Homo sapiens
acccctagttccctc

SEQ ID NO: 5146865 - DNA, 17 bp, Homo sapiens
acccctagttccctctg

SEQ ID NO: 5146866 - DNA, 20 bp, Homo sapiens
acccctagttccctctgctc

SEQ ID NO: 5146867 - DNA, 18 bp, Homo sapiens
acccctatacctgagcct

SEQ ID NO: 5146868 - DNA, 19 bp, Homo sapiens
acccctatacctgagcctc

SEQ ID NO: 5146869 - DNA, 13 bp, Homo sapiens
acccctatgaact

SEQ ID NO: 5146870 - DNA, 14 bp, Homo sapiens
acccctcaaactgc

SEQ ID NO: 5146871 - DNA, 20 bp, Homo sapiens
acccctcaaactgcacatct

SEQ ID NO: 5146872 - DNA, 21 bp, Homo sapiens
acccctcaaactgcacatcta

SEQ ID NO: 5146873 - DNA, 10 bp, Homo sapiens
acccctcacc

SEQ ID NO: 5146874 - DNA, 16 bp, Homo sapiens
acccctcaccaccccc

SEQ ID NO: 5146875 - DNA, 20 bp, Homo sapiens
acccctcaccacccccactg

SEQ ID NO: 5146876 - DNA, 16 bp, Homo sapiens
acccctcaccttgcaa

SEQ ID NO: 5146877 - DNA, 19 bp, Homo sapiens
acccctcaccttgcaacac

SEQ ID NO: 5146878 - DNA, 22 bp, Homo sapiens
acccctcaccttgcaacacaca

SEQ ID NO: 5146879 - DNA, 17 bp, Homo sapiens
acccctcactctggcct

SEQ ID NO: 5146880 - DNA, 18 bp, Homo sapiens
acccctcactttccctga

SEQ ID NO: 5146881 - DNA, 17 bp, Homo sapiens
acccctcagccccagcc

SEQ ID NO: 5146882 - DNA, 14 bp, Homo sapiens
acccctcagctccc

SEQ ID NO: 5146883 - DNA, 15 bp, Homo sapiens
acccctcagtgctcg

SEQ ID NO: 5146884 - DNA, 22 bp, Homo sapiens
acccctcagtgctcggcagtca

SEQ ID NO: 5146885 - DNA, 20 bp, Homo sapiens
acccctcagttgtgcagctt

SEQ ID NO: 5146886 - DNA, 21 bp, Homo sapiens
acccctcatacctacacccaa

SEQ ID NO: 5146887 - DNA, 13 bp, Homo sapiens
acccctcatctga

SEQ ID NO: 5146888 - DNA, 18 bp, Homo sapiens
acccctcccacctctttc

SEQ ID NO: 5146889 - DNA, 20 bp, Homo sapiens
acccctcccacctctttctt

SEQ ID NO: 5146890 - DNA, 21 bp, Homo sapiens
acccctcccacctctttcttc

SEQ ID NO: 5146891 - DNA, 13 bp, Homo sapiens
acccctcccagct

SEQ ID NO: 5146892 - DNA, 14 bp, Homo sapiens
acccctcccagctg

SEQ ID NO: 5146893 - DNA, 15 bp, Homo sapiens
acccctcccagctga

SEQ ID NO: 5146894 - DNA, 16 bp, Homo sapiens
acccctcccagctgac

SEQ ID NO: 5146895 - DNA, 15 bp, Homo sapiens
acccctccccaccca

SEQ ID NO: 5146896 - DNA, 12 bp, Homo sapiens
acccctccccag

SEQ ID NO: 5146897 - DNA, 20 bp, Homo sapiens
acccctccccattcacagag

SEQ ID NO: 5146898 - DNA, 11 bp, Homo sapiens
acccctccccc

SEQ ID NO: 5146899 - DNA, 13 bp, Homo sapiens
acccctcccccac

SEQ ID NO: 5146900 - DNA, 15 bp, Homo sapiens
acccctcccccacgt

SEQ ID NO: 5146901 - DNA, 13 bp, Homo sapiens
acccctcccctcc

SEQ ID NO: 5146902 - DNA, 14 bp, Homo sapiens
acccctcccctcca

SEQ ID NO: 5146903 - DNA, 17 bp, Homo sapiens
acccctcccctcccacc

SEQ ID NO: 5146904 - DNA, 22 bp, Homo sapiens
acccctcccctcccacccacag

SEQ ID NO: 5146905 - DNA, 22 bp, Homo sapiens
acccctcccctgggactttccc

SEQ ID NO: 5146906 - DNA, 21 bp, Homo sapiens
acccctcccggccctgcctgc

SEQ ID NO: 5146907 - DNA, 13 bp, Homo sapiens
acccctccctccc

SEQ ID NO: 5146908 - DNA, 18 bp, Homo sapiens
acccctccctctgctctc

SEQ ID NO: 5146909 - DNA, 18 bp, Homo sapiens
acccctccctctgtccac

SEQ ID NO: 5146910 - DNA, 19 bp, Homo sapiens
acccctccctgcaggggct

SEQ ID NO: 5146911 - DNA, 23 bp, Homo sapiens
acccctcctcactggccatccct

SEQ ID NO: 5146912 - DNA, 19 bp, Homo sapiens
acccctcctccctcagact

SEQ ID NO: 5146913 - DNA, 21 bp, Homo sapiens
acccctcctccctcagactca

SEQ ID NO: 5146914 - DNA, 18 bp, Homo sapiens
acccctcctccctttttc

SEQ ID NO: 5146915 - DNA, 16 bp, Homo sapiens
acccctcctccttgct

SEQ ID NO: 5146916 - DNA, 19 bp, Homo sapiens
acccctcctccttgctgat

SEQ ID NO: 5146917 - DNA, 11 bp, Homo sapiens
acccctcctga

SEQ ID NO: 5146918 - DNA, 15 bp, Homo sapiens
acccctcctgggccc

SEQ ID NO: 5146919 - DNA, 20 bp, Homo sapiens
acccctcctgggcccaggca

SEQ ID NO: 5146920 - DNA, 16 bp, Homo sapiens
acccctccttccccag

SEQ ID NO: 5146921 - DNA, 20 bp, Homo sapiens
acccctccttccccagaccc

SEQ ID NO: 5146922 - DNA, 20 bp, Homo sapiens
acccctccttccttgaccag

SEQ ID NO: 5146923 - DNA, 22 bp, Homo sapiens
acccctccttggtttctccctc

SEQ ID NO: 5146924 - DNA, 19 bp, Homo sapiens
acccctcgcaaccctgcct

SEQ ID NO: 5146925 - DNA, 18 bp, Homo sapiens
acccctcgcccagtccca

SEQ ID NO: 5146926 - DNA, 23 bp, Homo sapiens
acccctcgcccagtcccagcagc

SEQ ID NO: 5146927 - DNA, 17 bp, Homo sapiens
acccctcgccccagcct

SEQ ID NO: 5146928 - DNA, 17 bp, Homo sapiens
acccctcgtccaccccc

SEQ ID NO: 5146929 - DNA, 13 bp, Homo sapiens
acccctctccagg

SEQ ID NO: 5146930 - DNA, 15 bp, Homo sapiens
acccctctccaggcc

SEQ ID NO: 5146931 - DNA, 16 bp, Homo sapiens
acccctctccaggcct

SEQ ID NO: 5146932 - DNA, 19 bp, Homo sapiens
acccctctcccttttcaga

SEQ ID NO: 5146933 - DNA, 14 bp, Homo sapiens
acccctctcgcctc

SEQ ID NO: 5146934 - DNA, 13 bp, Homo sapiens
acccctctcttag

SEQ ID NO: 5146935 - DNA, 13 bp, Homo sapiens
acccctctgcccc

SEQ ID NO: 5146936 - DNA, 14 bp, Homo sapiens
acccctctgcccct

SEQ ID NO: 5146937 - DNA, 18 bp, Homo sapiens
acccctctgcccctgcag

SEQ ID NO: 5146938 - DNA, 19 bp, Homo sapiens
acccctctgcccctgcagc

SEQ ID NO: 5146939 - DNA, 20 bp, Homo sapiens
acccctctgcccctgcagct

SEQ ID NO: 5146940 - DNA, 22 bp, Homo sapiens
acccctctgcccctgcagctgg

SEQ ID NO: 5146941 - DNA, 23 bp, Homo sapiens
acccctctgcccctgcagctgga

SEQ ID NO: 5146942 - DNA, 13 bp, Homo sapiens
acccctctggcca

SEQ ID NO: 5146943 - DNA, 18 bp, Homo sapiens
acccctctggccaggatg

SEQ ID NO: 5146944 - DNA, 19 bp, Homo sapiens
acccctcttctgctcctta

SEQ ID NO: 5146945 - DNA, 18 bp, Homo sapiens
accgcgcccctctgcgcc

SEQ ID NO: 5146946 - DNA, 14 bp, Homo sapiens
accgcgcctacctt

SEQ ID NO: 5146947 - DNA, 16 bp, Homo sapiens
accgcgctagggctcc

SEQ ID NO: 5146948 - DNA, 14 bp, Homo sapiens
accgcggccaggca

SEQ ID NO: 5146949 - DNA, 15 bp, Homo sapiens
accgcggccaggcac

SEQ ID NO: 5146950 - DNA, 21 bp, Homo sapiens
accgcggccgaagcccaccac

SEQ ID NO: 5146951 - DNA, 18 bp, Homo sapiens
accgcgggtgtgggaaag

SEQ ID NO: 5146952 - DNA, 19 bp, Homo sapiens
accgcgggtgtgggaaagc

SEQ ID NO: 5146953 - DNA, 16 bp, Homo sapiens
accgcgtcccagctcc

SEQ ID NO: 5146954 - DNA, 18 bp, Homo sapiens
accgcgtctaccctggga

SEQ ID NO: 5146955 - DNA, 13 bp, Homo sapiens
accgcgttgtaaa

SEQ ID NO: 5146956 - DNA, 16 bp, Homo sapiens
accgctacaagagggc

SEQ ID NO: 5146957 - DNA, 20 bp, Homo sapiens
accgctacaagagggcaaag

SEQ ID NO: 5146958 - DNA, 22 bp, Homo sapiens
accgctacaagagggcaaagct

SEQ ID NO: 5146959 - DNA, 19 bp, Homo sapiens
accgctatttctccttgga

SEQ ID NO: 5146960 - DNA, 14 bp, Homo sapiens
accgctcaccctcc

SEQ ID NO: 5146961 - DNA, 16 bp, Homo sapiens
accgctcagtattact

SEQ ID NO: 5146962 - DNA, 17 bp, Homo sapiens
accgctcagtattactt

SEQ ID NO: 5146963 - DNA, 22 bp, Homo sapiens
accgctcagtattactttctgc

SEQ ID NO: 5146964 - DNA, 14 bp, Homo sapiens
accgctcagtattt

SEQ ID NO: 5146965 - DNA, 14 bp, Homo sapiens
accgctcagtgtca

SEQ ID NO: 5146966 - DNA, 15 bp, Homo sapiens
accgctctccctttg

SEQ ID NO: 5146967 - DNA, 17 bp, Homo sapiens
accgctgattctcaggg

SEQ ID NO: 5146968 - DNA, 14 bp, Homo sapiens
accgctgccagcac

SEQ ID NO: 5146969 - DNA, 16 bp, Homo sapiens
accgctgccagcacag

SEQ ID NO: 5146970 - DNA, 14 bp, Homo sapiens
accgctgcccaggt

SEQ ID NO: 5146971 - DNA, 19 bp, Homo sapiens
accgctgcctaagtggctg

SEQ ID NO: 5146972 - DNA, 12 bp, Homo sapiens
accgctgcctcg

SEQ ID NO: 5146973 - DNA, 15 bp, Homo sapiens
accgctggccctgcc

SEQ ID NO: 5146974 - DNA, 13 bp, Homo sapiens
accgctggccctt

SEQ ID NO: 5146975 - DNA, 15 bp, Homo sapiens
accgctggcccttag

SEQ ID NO: 5146976 - DNA, 17 bp, Homo sapiens
accgctggggaacagag

SEQ ID NO: 5146977 - DNA, 18 bp, Homo sapiens
accgctggggaacagagc

SEQ ID NO: 5146978 - DNA, 17 bp, Homo sapiens
accgctggtccctgccc

SEQ ID NO: 5146979 - DNA, 14 bp, Homo sapiens
accgcttcacccct

SEQ ID NO: 5146980 - DNA, 18 bp, Homo sapiens
accgcttcacccctgcac

SEQ ID NO: 5146981 - DNA, 15 bp, Homo sapiens
accgcttcccagagg

SEQ ID NO: 5146982 - DNA, 16 bp, Homo sapiens
accgcttcccagaggc

SEQ ID NO: 5146983 - DNA, 22 bp, Homo sapiens
accgcttccggctcctgtgctt

SEQ ID NO: 5146984 - DNA, 22 bp, Homo sapiens
accgcttgtggggacccaggct

SEQ ID NO: 5146985 - DNA, 13 bp, Homo sapiens
accgctttggcct

SEQ ID NO: 5146986 - DNA, 15 bp, Homo sapiens
accggaactgggctg

SEQ ID NO: 5146987 - DNA, 15 bp, Homo sapiens
accggaagctcctgg

SEQ ID NO: 5146988 - DNA, 16 bp, Homo sapiens
accggaagctcctggt

SEQ ID NO: 5146989 - DNA, 17 bp, Homo sapiens
accggacaagagcctgc

SEQ ID NO: 5146990 - DNA, 19 bp, Homo sapiens
accggacacacctctgctc

SEQ ID NO: 5146991 - DNA, 19 bp, Homo sapiens
accggacagtcggaaaagc

SEQ ID NO: 5146992 - DNA, 16 bp, Homo sapiens
accggaccagcctggc

SEQ ID NO: 5146993 - DNA, 12 bp, Homo sapiens
accggaccatct

SEQ ID NO: 5146994 - DNA, 13 bp, Homo sapiens
accggagagagaa

SEQ ID NO: 5146995 - DNA, 19 bp, Homo sapiens
accggagagttatcctgat

SEQ ID NO: 5146996 - DNA, 23 bp, Homo sapiens
accggagctttcaaagaaggaat

SEQ ID NO: 5146997 - DNA, 18 bp, Homo sapiens
accggagtactagccagc

SEQ ID NO: 5146998 - DNA, 12 bp, Homo sapiens
accggcagaaaa

SEQ ID NO: 5146999 - DNA, 12 bp, Homo sapiens
accggcagagct

SEQ ID NO: 5147000 - DNA, 15 bp, Homo sapiens
accggcatgctggcc

SEQ ID NO: 5147001 - DNA, 14 bp, Homo sapiens
accggccaggccgc

SEQ ID NO: 5147002 - DNA, 16 bp, Homo sapiens
accggcccgccacctt

SEQ ID NO: 5147003 - DNA, 22 bp, Homo sapiens
accggccgcagcccccactgac

SEQ ID NO: 5147004 - DNA, 23 bp, Homo sapiens
accggccgcagcccccactgacc

SEQ ID NO: 5147005 - DNA, 22 bp, Homo sapiens
accggccgcatgtctgcatggc

SEQ ID NO: 5147006 - DNA, 17 bp, Homo sapiens
accggcctcggcctccc

SEQ ID NO: 5147007 - DNA, 16 bp, Homo sapiens
accggcctgccaggag

SEQ ID NO: 5147008 - DNA, 17 bp, Homo sapiens
accggcctggctgcagc

SEQ ID NO: 5147009 - DNA, 11 bp, Homo sapiens
accggcgcgct

SEQ ID NO: 5147010 - DNA, 14 bp, Homo sapiens
accggcgctgcagg

SEQ ID NO: 5147011 - DNA, 20 bp, Homo sapiens
accggctcaggagagggcct

SEQ ID NO: 5147012 - DNA, 16 bp, Homo sapiens
accggctctcacctgg

SEQ ID NO: 5147013 - DNA, 22 bp, Homo sapiens
accggctggcagggctggcccc

SEQ ID NO: 5147014 - DNA, 19 bp, Homo sapiens
accggctggcctggcccct

SEQ ID NO: 5147015 - DNA, 18 bp, Homo sapiens
accgggaataaccttcca

SEQ ID NO: 5147016 - DNA, 11 bp, Homo sapiens
accgggacccc

SEQ ID NO: 5147017 - DNA, 18 bp, Homo sapiens
accgggagaaggcatgag

SEQ ID NO: 5147018 - DNA, 20 bp, Homo sapiens
accgggagcctccccctcag

SEQ ID NO: 5147019 - DNA, 19 bp, Homo sapiens
accgggagcctgcgtggcc

SEQ ID NO: 5147020 - DNA, 22 bp, Homo sapiens
accgggagcctgcgtggcctgg

SEQ ID NO: 5147021 - DNA, 23 bp, Homo sapiens
accgggagcctgcgtggcctggg

SEQ ID NO: 5147022 - DNA, 12 bp, Homo sapiens
accgggcactca

SEQ ID NO: 5147023 - DNA, 14 bp, Homo sapiens
accgggcactcaga

SEQ ID NO: 5147024 - DNA, 17 bp, Homo sapiens
accgggcactggcactg

SEQ ID NO: 5147025 - DNA, 15 bp, Homo sapiens
accgggcagggccgc

SEQ ID NO: 5147026 - DNA, 19 bp, Homo sapiens
accgggccacagagaaagt

SEQ ID NO: 5147027 - DNA, 20 bp, Homo sapiens
accgggccacagagaaagta

SEQ ID NO: 5147028 - DNA, 20 bp, Homo sapiens
accgggccactccttcctgc

SEQ ID NO: 5147029 - DNA, 11 bp, Homo sapiens
accgggcctga

SEQ ID NO: 5147030 - DNA, 21 bp, Homo sapiens
accgggctccatgcctctgga

SEQ ID NO: 5147031 - DNA, 11 bp, Homo sapiens
accgggctgca

SEQ ID NO: 5147032 - DNA, 21 bp, Homo sapiens
accgggctgcaggtgctgctg

SEQ ID NO: 5147033 - DNA, 15 bp, Homo sapiens
accgggctggctgct

SEQ ID NO: 5147034 - DNA, 22 bp, Homo sapiens
accgggctggctgcttgcagcc

SEQ ID NO: 5147035 - DNA, 23 bp, Homo sapiens
accgggctggctgcttgcagcca

SEQ ID NO: 5147036 - DNA, 23 bp, Homo sapiens
accgggctgggagctctgcagag

SEQ ID NO: 5147037 - DNA, 22 bp, Homo sapiens
accggggaacccagccctgggg

SEQ ID NO: 5147038 - DNA, 15 bp, Homo sapiens
accggggcaagaggg

SEQ ID NO: 5147039 - DNA, 21 bp, Homo sapiens
accggggcactggctgctctg

SEQ ID NO: 5147040 - DNA, 17 bp, Homo sapiens
accgggggccagacaca

SEQ ID NO: 5147041 - DNA, 18 bp, Homo sapiens
accgggggccagacacag

SEQ ID NO: 5147042 - DNA, 16 bp, Homo sapiens
accgggggctctgagc

SEQ ID NO: 5147043 - DNA, 18 bp, Homo sapiens
accgggggctgctgggcg

SEQ ID NO: 5147044 - DNA, 17 bp, Homo sapiens
accgggggtggctctgt

SEQ ID NO: 5147045 - DNA, 22 bp, Homo sapiens
accggggttcccgtgtgcctga

SEQ ID NO: 5147046 - DNA, 23 bp, Homo sapiens
accgggtcacacaaaggcatgct

SEQ ID NO: 5147047 - DNA, 23 bp, Homo sapiens
accgggtcttgattcagtcacat

SEQ ID NO: 5147048 - DNA, 18 bp, Homo sapiens
accgggtggcagcgccca

SEQ ID NO: 5147049 - DNA, 19 bp, Homo sapiens
accgggtggcagcgcccag

SEQ ID NO: 5147050 - DNA, 17 bp, Homo sapiens
accgggtgggcctggcc

SEQ ID NO: 5147051 - DNA, 18 bp, Homo sapiens
accgggtgggcctggcct

SEQ ID NO: 5147052 - DNA, 19 bp, Homo sapiens
accgggtgggcctggcctg

SEQ ID NO: 5147053 - DNA, 21 bp, Homo sapiens
accgggtgggcctggcctgag

SEQ ID NO: 5147054 - DNA, 23 bp, Homo sapiens
accgggttctgcagcggcagagc

SEQ ID NO: 5147055 - DNA, 13 bp, Homo sapiens
accggtacagaaa

SEQ ID NO: 5147056 - DNA, 14 bp, Homo sapiens
accggtcagtgcct

SEQ ID NO: 5147057 - DNA, 22 bp, Homo sapiens
accggtcagtgccttttggaac

SEQ ID NO: 5147058 - DNA, 14 bp, Homo sapiens
accggtccagctgg

SEQ ID NO: 5147059 - DNA, 18 bp, Homo sapiens
accggtccagctggcctg

SEQ ID NO: 5147060 - DNA, 23 bp, Homo sapiens
accggtccagctggcctggacag

SEQ ID NO: 5147061 - DNA, 16 bp, Homo sapiens
accggtcccagcctgg

SEQ ID NO: 5147062 - DNA, 19 bp, Homo sapiens
accggtcccagcctgggct

SEQ ID NO: 5147063 - DNA, 23 bp, Homo sapiens
accggtgccaaacccagcccctg

SEQ ID NO: 5147064 - DNA, 18 bp, Homo sapiens
accggtgcttctggaaac

SEQ ID NO: 5147065 - DNA, 16 bp, Homo sapiens
accggtgggcagtggg

SEQ ID NO: 5147066 - DNA, 22 bp, Homo sapiens
accggttagcatggttttagca

SEQ ID NO: 5147067 - DNA, 18 bp, Homo sapiens
accggttcccacaagcct

SEQ ID NO: 5147068 - DNA, 16 bp, Homo sapiens
accgtaaaggtttatt

SEQ ID NO: 5147069 - DNA, 23 bp, Homo sapiens
accgtaaaggtttatttttctgt

SEQ ID NO: 5147070 - DNA, 17 bp, Homo sapiens
accgtaataattattat

SEQ ID NO: 5147071 - DNA, 15 bp, Homo sapiens
accgtaattgctttg

SEQ ID NO: 5147072 - DNA, 18 bp, Homo sapiens
accgtaattgctttgtgc

SEQ ID NO: 5147073 - DNA, 13 bp, Homo sapiens
accgtaattttat

SEQ ID NO: 5147074 - DNA, 16 bp, Homo sapiens
accgtaattttattat

SEQ ID NO: 5147075 - DNA, 14 bp, Homo sapiens
accgtactctcaca

SEQ ID NO: 5147076 - DNA, 18 bp, Homo sapiens
accgtactctcacatgtg

SEQ ID NO: 5147077 - DNA, 19 bp, Homo sapiens
accgtactgcttggaagaa

SEQ ID NO: 5147078 - DNA, 17 bp, Homo sapiens
accgtcacactcttcag

SEQ ID NO: 5147079 - DNA, 20 bp, Homo sapiens
accgtcattgatggagcctg

SEQ ID NO: 5147080 - DNA, 14 bp, Homo sapiens
accgtccaggcccc

SEQ ID NO: 5147081 - DNA, 15 bp, Homo sapiens
accgtcccctcccag

SEQ ID NO: 5147082 - DNA, 14 bp, Homo sapiens
accgtccctctgca

SEQ ID NO: 5147083 - DNA, 16 bp, Homo sapiens
accgtccctctgcaga

SEQ ID NO: 5147084 - DNA, 16 bp, Homo sapiens
accgtccgccctgctc

SEQ ID NO: 5147085 - DNA, 12 bp, Homo sapiens
accgtcctcacc

SEQ ID NO: 5147086 - DNA, 13 bp, Homo sapiens
accgtcctgccca

SEQ ID NO: 5147087 - DNA, 18 bp, Homo sapiens
accgtcctgctgtccctg

SEQ ID NO: 5147088 - DNA, 19 bp, Homo sapiens
accgtcctgctgtccctgt

SEQ ID NO: 5147089 - DNA, 23 bp, Homo sapiens
accgtcctgctgtccctgtcagg

SEQ ID NO: 5147090 - DNA, 17 bp, Homo sapiens
accgtcgacaagaatgt

SEQ ID NO: 5147091 - DNA, 18 bp, Homo sapiens
accgtcgaccaggaaagc

SEQ ID NO: 5147092 - DNA, 16 bp, Homo sapiens
accgtcgggggctgag

SEQ ID NO: 5147093 - DNA, 16 bp, Homo sapiens
accgtctacagatggc

SEQ ID NO: 5147094 - DNA, 15 bp, Homo sapiens
accgtctcggccctg

SEQ ID NO: 5147095 - DNA, 16 bp, Homo sapiens
accgtctgtttttaaa

SEQ ID NO: 5147096 - DNA, 14 bp, Homo sapiens
accgtcttccttca

SEQ ID NO: 5147097 - DNA, 20 bp, Homo sapiens
accgtcttgggtcgccctac

SEQ ID NO: 5147098 - DNA, 22 bp, Homo sapiens
accgtgacagcccgcaggatca

SEQ ID NO: 5147099 - DNA, 18 bp, Homo sapiens
accgtgaccgtttgctat

SEQ ID NO: 5147100 - DNA, 17 bp, Homo sapiens
accgtgaggccaagatc

SEQ ID NO: 5147101 - DNA, 16 bp, Homo sapiens
accgtgaggccagaga

SEQ ID NO: 5147102 - DNA, 17 bp, Homo sapiens
accgtgaggccagagac

SEQ ID NO: 5147103 - DNA, 14 bp, Homo sapiens
accgtgatggagag

SEQ ID NO: 5147104 - DNA, 20 bp, Homo sapiens
accgtgatttggaagagagg

SEQ ID NO: 5147105 - DNA, 12 bp, Homo sapiens
accgtgcagcca

SEQ ID NO: 5147106 - DNA, 24 bp, Homo sapiens
accgtgcagccacgaacacgcatg

SEQ ID NO: 5147107 - DNA, 18 bp, Homo sapiens
accgtgccactttccacc

SEQ ID NO: 5147108 - DNA, 13 bp, Homo sapiens
accgtgccagcag

SEQ ID NO: 5147109 - DNA, 20 bp, Homo sapiens
accgtgccccacctccccac

SEQ ID NO: 5147110 - DNA, 20 bp, Homo sapiens
accgtgcccggctaattttt

SEQ ID NO: 5147111 - DNA, 16 bp, Homo sapiens
accgtgcctggccaga

SEQ ID NO: 5147112 - DNA, 14 bp, Homo sapiens
accgtgcctggctg

SEQ ID NO: 5147113 - DNA, 21 bp, Homo sapiens
accgtgctgtcttctggtctg

SEQ ID NO: 5147114 - DNA, 14 bp, Homo sapiens
accgtggacaggcc

SEQ ID NO: 5147115 - DNA, 15 bp, Homo sapiens
accgtggacaggccc

SEQ ID NO: 5147116 - DNA, 15 bp, Homo sapiens
accgtggaggaggaa

SEQ ID NO: 5147117 - DNA, 15 bp, Homo sapiens
accgtggatctcctt

SEQ ID NO: 5147118 - DNA, 20 bp, Homo sapiens
accgtggatctccttccctt

SEQ ID NO: 5147119 - DNA, 19 bp, Homo sapiens
accgtggccctgccctctc

SEQ ID NO: 5147120 - DNA, 21 bp, Homo sapiens
accgtggccctgccctctcct

SEQ ID NO: 5147121 - DNA, 16 bp, Homo sapiens
accgtgggcagggagc

SEQ ID NO: 5147122 - DNA, 15 bp, Homo sapiens
accgtgggcggggcc

SEQ ID NO: 5147123 - DNA, 17 bp, Homo sapiens
accgtgggcggggcctt

SEQ ID NO: 5147124 - DNA, 19 bp, Homo sapiens
acccctgacctaccccagc

SEQ ID NO: 5147125 - DNA, 20 bp, Homo sapiens
acccctgacctaccccagcc

SEQ ID NO: 5147126 - DNA, 19 bp, Homo sapiens
acccctgaggaagatgggg

SEQ ID NO: 5147127 - DNA, 22 bp, Homo sapiens
acccctgagttgggcagccagg

SEQ ID NO: 5147128 - DNA, 16 bp, Homo sapiens
acccctgcacacacct

SEQ ID NO: 5147129 - DNA, 19 bp, Homo sapiens
acccctgcacacacctgca

SEQ ID NO: 5147130 - DNA, 12 bp, Homo sapiens
acccctgcaggc

SEQ ID NO: 5147131 - DNA, 10 bp, Homo sapiens
acccctgcat

SEQ ID NO: 5147132 - DNA, 13 bp, Homo sapiens
acccctgccactc

SEQ ID NO: 5147133 - DNA, 16 bp, Homo sapiens
acccctgccactcacc

SEQ ID NO: 5147134 - DNA, 19 bp, Homo sapiens
acccctgccagttctctgt

SEQ ID NO: 5147135 - DNA, 10 bp, Homo sapiens
acccctgccc

SEQ ID NO: 5147136 - DNA, 12 bp, Homo sapiens
acccctgcccaa

SEQ ID NO: 5147137 - DNA, 13 bp, Homo sapiens
acccctgccccca

SEQ ID NO: 5147138 - DNA, 19 bp, Homo sapiens
acccctgcccccacttcct

SEQ ID NO: 5147139 - DNA, 18 bp, Homo sapiens
acccctgcccctgtggga

SEQ ID NO: 5147140 - DNA, 20 bp, Homo sapiens
acccctgcccctgtgggact

SEQ ID NO: 5147141 - DNA, 21 bp, Homo sapiens
acccctgcccctgtgggactc

SEQ ID NO: 5147142 - DNA, 13 bp, Homo sapiens
acccctgccctgc

SEQ ID NO: 5147143 - DNA, 17 bp, Homo sapiens
acccctgccctgctcct

SEQ ID NO: 5147144 - DNA, 16 bp, Homo sapiens
acccctgcccttgtcc

SEQ ID NO: 5147145 - DNA, 15 bp, Homo sapiens
acccctgcctccacc

SEQ ID NO: 5147146 - DNA, 23 bp, Homo sapiens
acccctgcctccaccctctgagc

SEQ ID NO: 5147147 - DNA, 17 bp, Homo sapiens
acccctgcctcctgcct

SEQ ID NO: 5147148 - DNA, 18 bp, Homo sapiens
acccctgcctcctgcctc

SEQ ID NO: 5147149 - DNA, 23 bp, Homo sapiens
acccctgcctcgagggccgcctg

SEQ ID NO: 5147150 - DNA, 13 bp, Homo sapiens
acccctgcctgga

SEQ ID NO: 5147151 - DNA, 14 bp, Homo sapiens
acccctgcctgggt

SEQ ID NO: 5147152 - DNA, 20 bp, Homo sapiens
acccctgcctgggttttcta

SEQ ID NO: 5147153 - DNA, 11 bp, Homo sapiens
acccctgcctt

SEQ ID NO: 5147154 - DNA, 12 bp, Homo sapiens
acccctgccttc

SEQ ID NO: 5147155 - DNA, 14 bp, Homo sapiens
acccctgccttcct

SEQ ID NO: 5147156 - DNA, 18 bp, Homo sapiens
acccctgccttcctctga

SEQ ID NO: 5147157 - DNA, 20 bp, Homo sapiens
acccctgccttcctctgagg

SEQ ID NO: 5147158 - DNA, 20 bp, Homo sapiens
acccctgcctttgggagcag

SEQ ID NO: 5147159 - DNA, 11 bp, Homo sapiens
acccctgctcc

SEQ ID NO: 5147160 - DNA, 15 bp, Homo sapiens
acccctgctcccagc

SEQ ID NO: 5147161 - DNA, 18 bp, Homo sapiens
acccctgctcccagcctg

SEQ ID NO: 5147162 - DNA, 20 bp, Homo sapiens
acccctgctcccagcctgct

SEQ ID NO: 5147163 - DNA, 21 bp, Homo sapiens
acccctgctgccgccactggc

SEQ ID NO: 5147164 - DNA, 18 bp, Homo sapiens
acccctgctttgccccac

SEQ ID NO: 5147165 - DNA, 14 bp, Homo sapiens
acccctggacccca

SEQ ID NO: 5147166 - DNA, 18 bp, Homo sapiens
acccctggaccccagcct

SEQ ID NO: 5147167 - DNA, 20 bp, Homo sapiens
acccctggaccccagcctca

SEQ ID NO: 5147168 - DNA, 23 bp, Homo sapiens
acccctggaccccagcctcaaat

SEQ ID NO: 5147169 - DNA, 12 bp, Homo sapiens
acccctggccag

SEQ ID NO: 5147170 - DNA, 15 bp, Homo sapiens
acccctggccagctc

SEQ ID NO: 5147171 - DNA, 17 bp, Homo sapiens
acccctggccagctctg

SEQ ID NO: 5147172 - DNA, 18 bp, Homo sapiens
acccctggccagctctga

SEQ ID NO: 5147173 - DNA, 19 bp, Homo sapiens
acccctggccagctctgag

SEQ ID NO: 5147174 - DNA, 12 bp, Homo sapiens
acccctggcctc

SEQ ID NO: 5147175 - DNA, 19 bp, Homo sapiens
acccctggctaccttgtgg

SEQ ID NO: 5147176 - DNA, 12 bp, Homo sapiens
acccctggctct

SEQ ID NO: 5147177 - DNA, 15 bp, Homo sapiens
acccctggctctggg

SEQ ID NO: 5147178 - DNA, 17 bp, Homo sapiens
acccctggctgaacagt

SEQ ID NO: 5147179 - DNA, 21 bp, Homo sapiens
acccctggctgaacagtgctc

SEQ ID NO: 5147180 - DNA, 22 bp, Homo sapiens
acccctggctgaacagtgctct

SEQ ID NO: 5147181 - DNA, 24 bp, Homo sapiens
acccctggctgaacagtgctctgc

SEQ ID NO: 5147182 - DNA, 15 bp, Homo sapiens
acccctggcttttca

SEQ ID NO: 5147183 - DNA, 20 bp, Homo sapiens
acccctggcttttcactgct

SEQ ID NO: 5147184 - DNA, 21 bp, Homo sapiens
acccctggcttttcactgctg

SEQ ID NO: 5147185 - DNA, 21 bp, Homo sapiens
acccctgggggaggcttccag

SEQ ID NO: 5147186 - DNA, 22 bp, Homo sapiens
acccctgggggaggcttccagc

SEQ ID NO: 5147187 - DNA, 16 bp, Homo sapiens
acccctgggggctctc

SEQ ID NO: 5147188 - DNA, 20 bp, Homo sapiens
acccctggggtggccagggc

SEQ ID NO: 5147189 - DNA, 14 bp, Homo sapiens
acccctggtggctg

SEQ ID NO: 5147190 - DNA, 15 bp, Homo sapiens
acccctggtggctgc

SEQ ID NO: 5147191 - DNA, 16 bp, Homo sapiens
acccctggtggctgca

SEQ ID NO: 5147192 - DNA, 16 bp, Homo sapiens
acccctggtgtccctg

SEQ ID NO: 5147193 - DNA, 21 bp, Homo sapiens
acccctggtgtccctgcctgg

SEQ ID NO: 5147194 - DNA, 16 bp, Homo sapiens
acccctggttctcatc

SEQ ID NO: 5147195 - DNA, 20 bp, Homo sapiens
acccctggttctcatctttc

SEQ ID NO: 5147196 - DNA, 21 bp, Homo sapiens
acccctgtaaggggccagagc

SEQ ID NO: 5147197 - DNA, 16 bp, Homo sapiens
acccctgtacccagct

SEQ ID NO: 5147198 - DNA, 18 bp, Homo sapiens
acccctgtacccagctcc

SEQ ID NO: 5147199 - DNA, 16 bp, Homo sapiens
acccctgtcccaccca

SEQ ID NO: 5147200 - DNA, 22 bp, Homo sapiens
acccctgtgctcccctgccaca

SEQ ID NO: 5147201 - DNA, 14 bp, Homo sapiens
acccctgtggcaga

SEQ ID NO: 5147202 - DNA, 18 bp, Homo sapiens
acccctgtggcagaccgg

SEQ ID NO: 5147203 - DNA, 21 bp, Homo sapiens
acccctgttaagcaattcctt

SEQ ID NO: 5147204 - DNA, 22 bp, Homo sapiens
accccttaccccaaagagaaag

SEQ ID NO: 5147205 - DNA, 17 bp, Homo sapiens
accccttagcctccctg

SEQ ID NO: 5147206 - DNA, 18 bp, Homo sapiens
accccttagcctccctga

SEQ ID NO: 5147207 - DNA, 14 bp, Homo sapiens
accccttattgctg

SEQ ID NO: 5147208 - DNA, 13 bp, Homo sapiens
accccttccagat

SEQ ID NO: 5147209 - DNA, 18 bp, Homo sapiens
accccttccatgtggaga

SEQ ID NO: 5147210 - DNA, 11 bp, Homo sapiens
accccttcccc

SEQ ID NO: 5147211 - DNA, 14 bp, Homo sapiens
accccttccccact

SEQ ID NO: 5147212 - DNA, 20 bp, Homo sapiens
accccttccccactgcctgc

SEQ ID NO: 5147213 - DNA, 21 bp, Homo sapiens
accccttccccactgcctgcc

SEQ ID NO: 5147214 - DNA, 23 bp, Homo sapiens
accccttccccactgcctgccca

SEQ ID NO: 5147215 - DNA, 14 bp, Homo sapiens
accccttccccagg

SEQ ID NO: 5147216 - DNA, 19 bp, Homo sapiens
accccttccccaggcccac

SEQ ID NO: 5147217 - DNA, 20 bp, Homo sapiens
accccttccccaggcccacc

SEQ ID NO: 5147218 - DNA, 21 bp, Homo sapiens
accccttccccaggcccacca

SEQ ID NO: 5147219 - DNA, 14 bp, Homo sapiens
accccttcctcagc

SEQ ID NO: 5147220 - DNA, 17 bp, Homo sapiens
accccttcctcagcctg

SEQ ID NO: 5147221 - DNA, 19 bp, Homo sapiens
accccttcctcagcctggg

SEQ ID NO: 5147222 - DNA, 20 bp, Homo sapiens
accccttcctcagcctgggg

SEQ ID NO: 5147223 - DNA, 12 bp, Homo sapiens
accccttcctcc

SEQ ID NO: 5147224 - DNA, 11 bp, Homo sapiens
accccttcctg

SEQ ID NO: 5147225 - DNA, 16 bp, Homo sapiens
accccttcctgtcctg

SEQ ID NO: 5147226 - DNA, 22 bp, Homo sapiens
accccttcctgtcctgcctcct

SEQ ID NO: 5147227 - DNA, 12 bp, Homo sapiens
accccttccttt

SEQ ID NO: 5147228 - DNA, 17 bp, Homo sapiens
accccttcctttcctct

SEQ ID NO: 5147229 - DNA, 18 bp, Homo sapiens
accccttcgacatgctgc

SEQ ID NO: 5147230 - DNA, 12 bp, Homo sapiens
accccttctctc

SEQ ID NO: 5147231 - DNA, 14 bp, Homo sapiens
accccttctctctc

SEQ ID NO: 5147232 - DNA, 18 bp, Homo sapiens
accccttctctctccaga

SEQ ID NO: 5147233 - DNA, 11 bp, Homo sapiens
accccttgctc

SEQ ID NO: 5147234 - DNA, 16 bp, Homo sapiens
accccttgctcccttc

SEQ ID NO: 5147235 - DNA, 15 bp, Homo sapiens
accccttgctctctg

SEQ ID NO: 5147236 - DNA, 24 bp, Homo sapiens
accccttgctctctgttctcttgc

SEQ ID NO: 5147237 - DNA, 23 bp, Homo sapiens
accccttggaaatgtctgctggt

SEQ ID NO: 5147238 - DNA, 19 bp, Homo sapiens
accccttggaggagagaga

SEQ ID NO: 5147239 - DNA, 20 bp, Homo sapiens
accccttggaggagagagac

SEQ ID NO: 5147240 - DNA, 14 bp, Homo sapiens
accccttggcccct

SEQ ID NO: 5147241 - DNA, 17 bp, Homo sapiens
accccttggcccctcac

SEQ ID NO: 5147242 - DNA, 13 bp, Homo sapiens
acccctttaaact

SEQ ID NO: 5147243 - DNA, 15 bp, Homo sapiens
acccctttaaactgt

SEQ ID NO: 5147244 - DNA, 21 bp, Homo sapiens
acccctttaaggttcagactt

SEQ ID NO: 5147245 - DNA, 11 bp, Homo sapiens
acccctttccc

SEQ ID NO: 5147246 - DNA, 13 bp, Homo sapiens
acccctttcccac

SEQ ID NO: 5147247 - DNA, 14 bp, Homo sapiens
acccctttcccacc

SEQ ID NO: 5147248 - DNA, 17 bp, Homo sapiens
acccctttcccacccca

SEQ ID NO: 5147249 - DNA, 15 bp, Homo sapiens
acccctttccccagc

SEQ ID NO: 5147250 - DNA, 21 bp, Homo sapiens
acccctttccccagcctctcc

SEQ ID NO: 5147251 - DNA, 15 bp, Homo sapiens
acccctttcccccac

SEQ ID NO: 5147252 - DNA, 17 bp, Homo sapiens
acccctttcccccaccc

SEQ ID NO: 5147253 - DNA, 23 bp, Homo sapiens
acccctttcccccaccccagagt

SEQ ID NO: 5147254 - DNA, 16 bp, Homo sapiens
acccctttcctcccca

SEQ ID NO: 5147255 - DNA, 21 bp, Homo sapiens
acccctttcctccccatacac

SEQ ID NO: 5147256 - DNA, 16 bp, Homo sapiens
acccctttctccagcc

SEQ ID NO: 5147257 - DNA, 17 bp, Homo sapiens
acccctttctgtcccac

SEQ ID NO: 5147258 - DNA, 16 bp, Homo sapiens
acccctttctgttcga

SEQ ID NO: 5147259 - DNA, 20 bp, Homo sapiens
acccctttcttctcgggcca

SEQ ID NO: 5147260 - DNA, 16 bp, Homo sapiens
acccctttgccttccc

SEQ ID NO: 5147261 - DNA, 16 bp, Homo sapiens
accccttttcagcttc

SEQ ID NO: 5147262 - DNA, 17 bp, Homo sapiens
accccttttcagcttct

SEQ ID NO: 5147263 - DNA, 20 bp, Homo sapiens
acccgaaagcatcactgcct

SEQ ID NO: 5147264 - DNA, 15 bp, Homo sapiens
acccgaagtcctgtc

SEQ ID NO: 5147265 - DNA, 23 bp, Homo sapiens
acccgaccccccgtgggctcccg

SEQ ID NO: 5147266 - DNA, 14 bp, Homo sapiens
acccgacctggctg

SEQ ID NO: 5147267 - DNA, 15 bp, Homo sapiens
acccgacctggctgc

SEQ ID NO: 5147268 - DNA, 18 bp, Homo sapiens
acccgacctggctgcccc

SEQ ID NO: 5147269 - DNA, 14 bp, Homo sapiens
acccgactgtgaaa

SEQ ID NO: 5147270 - DNA, 13 bp, Homo sapiens
acccgagcacata

SEQ ID NO: 5147271 - DNA, 21 bp, Homo sapiens
acccgagcccagctacattcc

SEQ ID NO: 5147272 - DNA, 22 bp, Homo sapiens
acccgagcccagctacattcct

SEQ ID NO: 5147273 - DNA, 13 bp, Homo sapiens
acccgaggaaact

SEQ ID NO: 5147274 - DNA, 16 bp, Homo sapiens
acccgaggatttctgg

SEQ ID NO: 5147275 - DNA, 13 bp, Homo sapiens
acccgaggcccag

SEQ ID NO: 5147276 - DNA, 14 bp, Homo sapiens
acccgaggcccaga

SEQ ID NO: 5147277 - DNA, 23 bp, Homo sapiens
acccgaggcccagatccaaggcc

SEQ ID NO: 5147278 - DNA, 16 bp, Homo sapiens
acccgaggctgagaat

SEQ ID NO: 5147279 - DNA, 19 bp, Homo sapiens
acccgagggacagcagatt

SEQ ID NO: 5147280 - DNA, 15 bp, Homo sapiens
acccgagtacctcca

SEQ ID NO: 5147281 - DNA, 14 bp, Homo sapiens
acccgcatgtacaa

SEQ ID NO: 5147282 - DNA, 18 bp, Homo sapiens
acccgccccgcgcacccc

SEQ ID NO: 5147283 - DNA, 13 bp, Homo sapiens
acccgccctcagg

SEQ ID NO: 5147284 - DNA, 21 bp, Homo sapiens
acccgccctttccttgccttc

SEQ ID NO: 5147285 - DNA, 21 bp, Homo sapiens
acccgccgcctcccacggcac

SEQ ID NO: 5147286 - DNA, 18 bp, Homo sapiens
acccgcctctcccgtcag

SEQ ID NO: 5147287 - DNA, 23 bp, Homo sapiens
acccgcctctcccgtcagggccc

SEQ ID NO: 5147288 - DNA, 24 bp, Homo sapiens
acccgcctctcccgtcagggccca

SEQ ID NO: 5147289 - DNA, 14 bp, Homo sapiens
acccgcctgcagag

SEQ ID NO: 5147290 - DNA, 15 bp, Homo sapiens
acccgccttgtgaga

SEQ ID NO: 5147291 - DNA, 19 bp, Homo sapiens
acccgccttttataaacct

SEQ ID NO: 5147292 - DNA, 22 bp, Homo sapiens
acccgctcggacttactgcctg

SEQ ID NO: 5147293 - DNA, 23 bp, Homo sapiens
acccgctcggacttactgcctga

SEQ ID NO: 5147294 - DNA, 16 bp, Homo sapiens
acccgctgcccagccc

SEQ ID NO: 5147295 - DNA, 19 bp, Homo sapiens
acccgctgcccagccctcc

SEQ ID NO: 5147296 - DNA, 16 bp, Homo sapiens
acccgctgcccctccc

SEQ ID NO: 5147297 - DNA, 17 bp, Homo sapiens
acccgctgcttccaggt

SEQ ID NO: 5147298 - DNA, 14 bp, Homo sapiens
acccgctgtggccg

SEQ ID NO: 5147299 - DNA, 16 bp, Homo sapiens
acccgctttcttgctg

SEQ ID NO: 5147300 - DNA, 13 bp, Homo sapiens
acccggaaagact

SEQ ID NO: 5147301 - DNA, 23 bp, Homo sapiens
acccggacaggtggggcctcagc

SEQ ID NO: 5147302 - DNA, 19 bp, Homo sapiens
acccggaggccacatgagt

SEQ ID NO: 5147303 - DNA, 16 bp, Homo sapiens
acccggatctccaggc

SEQ ID NO: 5147304 - DNA, 19 bp, Homo sapiens
accgtgggcggggccttgc

SEQ ID NO: 5147305 - DNA, 16 bp, Homo sapiens
accgtgggctccctga

SEQ ID NO: 5147306 - DNA, 14 bp, Homo sapiens
accgtggggaaggg

SEQ ID NO: 5147307 - DNA, 13 bp, Homo sapiens
accgtggggaggc

SEQ ID NO: 5147308 - DNA, 16 bp, Homo sapiens
accgtggggaggccat

SEQ ID NO: 5147309 - DNA, 16 bp, Homo sapiens
accgtggtatgtctgc

SEQ ID NO: 5147310 - DNA, 16 bp, Homo sapiens
accgtggtgtcctctg

SEQ ID NO: 5147311 - DNA, 22 bp, Homo sapiens
accgtggtgtgaggcccccgga

SEQ ID NO: 5147312 - DNA, 14 bp, Homo sapiens
accgtgtaaaccaa

SEQ ID NO: 5147313 - DNA, 14 bp, Homo sapiens
accgtgtcaagctg

SEQ ID NO: 5147314 - DNA, 17 bp, Homo sapiens
accgtgtcaagctgctc

SEQ ID NO: 5147315 - DNA, 15 bp, Homo sapiens
accgtgtccagcaca

SEQ ID NO: 5147316 - DNA, 15 bp, Homo sapiens
accgtgtcctcctct

SEQ ID NO: 5147317 - DNA, 18 bp, Homo sapiens
accgtgtcctcctctgag

SEQ ID NO: 5147318 - DNA, 16 bp, Homo sapiens
accgtgtgcctttccc

SEQ ID NO: 5147319 - DNA, 11 bp, Homo sapiens
accgtgtgctc

SEQ ID NO: 5147320 - DNA, 23 bp, Homo sapiens
accgtgtgctccagtgttttctt

SEQ ID NO: 5147321 - DNA, 15 bp, Homo sapiens
accgtgtttgtctct

SEQ ID NO: 5147322 - DNA, 18 bp, Homo sapiens
accgtgtttgtctcttct

SEQ ID NO: 5147323 - DNA, 17 bp, Homo sapiens
accgttaggattcaggc

SEQ ID NO: 5147324 - DNA, 23 bp, Homo sapiens
accgttaggattcaggcagcagt

SEQ ID NO: 5147325 - DNA, 18 bp, Homo sapiens
accgttcaaattctcttc

SEQ ID NO: 5147326 - DNA, 14 bp, Homo sapiens
accgttcacttccc

SEQ ID NO: 5147327 - DNA, 16 bp, Homo sapiens
accgttcacttcccct

SEQ ID NO: 5147328 - DNA, 22 bp, Homo sapiens
accgttcagtgtcccaggcagc

SEQ ID NO: 5147329 - DNA, 21 bp, Homo sapiens
accgttcgtacgcccaggaca

SEQ ID NO: 5147330 - DNA, 16 bp, Homo sapiens
accgttgcttgaaatt

SEQ ID NO: 5147331 - DNA, 13 bp, Homo sapiens
accgttgtctcat

SEQ ID NO: 5147332 - DNA, 14 bp, Homo sapiens
accgtttacagtgt

SEQ ID NO: 5147333 - DNA, 17 bp, Homo sapiens
accgtttagtcatatct

SEQ ID NO: 5147334 - DNA, 22 bp, Homo sapiens
accgtttagtcatatctatcta

SEQ ID NO: 5147335 - DNA, 15 bp, Homo sapiens
accgtttcaggacca

SEQ ID NO: 5147336 - DNA, 12 bp, Homo sapiens
accgtttcttcc

SEQ ID NO: 5147337 - DNA, 13 bp, Homo sapiens
accgtttcttccc

SEQ ID NO: 5147338 - DNA, 22 bp, Homo sapiens
accgtttcttcctgccagcagg

SEQ ID NO: 5147339 - DNA, 18 bp, Homo sapiens
accgtttggtgtctgatg

SEQ ID NO: 5147340 - DNA, 19 bp, Homo sapiens
accgtttggtgtctgatgt

SEQ ID NO: 5147341 - DNA, 18 bp, Homo sapiens
accgtttgtccacttcat

SEQ ID NO: 5147342 - DNA, 13 bp, Homo sapiens
accgttttacact

SEQ ID NO: 5147343 - DNA, 14 bp, Homo sapiens
accgttttgtattg

SEQ ID NO: 5147344 - DNA, 18 bp, Homo sapiens
accgtttttatattactt

SEQ ID NO: 5147345 - DNA, 13 bp, Homo sapiens
accgtttttcaag

SEQ ID NO: 5147346 - DNA, 16 bp, Homo sapiens
acctaaaaaagatata

SEQ ID NO: 5147347 - DNA, 19 bp, Homo sapiens
acctaaaaaagatatatta

SEQ ID NO: 5147348 - DNA, 13 bp, Homo sapiens
acctaaaaatttt

SEQ ID NO: 5147349 - DNA, 19 bp, Homo sapiens
acctaaaaccagttttgct

SEQ ID NO: 5147350 - DNA, 21 bp, Homo sapiens
acctaaaagagatttcaagag

SEQ ID NO: 5147351 - DNA, 21 bp, Homo sapiens
acctaaaaggaaatctcaccc

SEQ ID NO: 5147352 - DNA, 23 bp, Homo sapiens
acctaaaagttgaaaagccaaag

SEQ ID NO: 5147353 - DNA, 20 bp, Homo sapiens
acctaaaataaataccaaag

SEQ ID NO: 5147354 - DNA, 19 bp, Homo sapiens
acctaaaatttgccctccc

SEQ ID NO: 5147355 - DNA, 21 bp, Homo sapiens
acctaaaatttgccctcccat

SEQ ID NO: 5147356 - DNA, 15 bp, Homo sapiens
acctaaacagctgct

SEQ ID NO: 5147357 - DNA, 18 bp, Homo sapiens
acctaaacagctgcttta

SEQ ID NO: 5147358 - DNA, 23 bp, Homo sapiens
acctaaacatagaaattgcctga

SEQ ID NO: 5147359 - DNA, 17 bp, Homo sapiens
acctaaagcaagcctga

SEQ ID NO: 5147360 - DNA, 21 bp, Homo sapiens
acctaaagggactacctctgt

SEQ ID NO: 5147361 - DNA, 22 bp, Homo sapiens
acctaaagggtatgagctggag

SEQ ID NO: 5147362 - DNA, 16 bp, Homo sapiens
acctaaaggtgtattt

SEQ ID NO: 5147363 - DNA, 20 bp, Homo sapiens
acctaaaggtgtatttaaac

SEQ ID NO: 5147364 - DNA, 20 bp, Homo sapiens
acctaaataaacacatagat

SEQ ID NO: 5147365 - DNA, 17 bp, Homo sapiens
acctaaatccattttct

SEQ ID NO: 5147366 - DNA, 20 bp, Homo sapiens
acctaaatccattttctaaa

SEQ ID NO: 5147367 - DNA, 14 bp, Homo sapiens
acctaaatgacctc

SEQ ID NO: 5147368 - DNA, 15 bp, Homo sapiens
acctaaatgacctca

SEQ ID NO: 5147369 - DNA, 22 bp, Homo sapiens
acctaaatgacctcagcaaatc

SEQ ID NO: 5147370 - DNA, 16 bp, Homo sapiens
acctaaattaacaaat

SEQ ID NO: 5147371 - DNA, 17 bp, Homo sapiens
acctaaattaacaaatt

SEQ ID NO: 5147372 - DNA, 14 bp, Homo sapiens
acctaacaatgttt

SEQ ID NO: 5147373 - DNA, 20 bp, Homo sapiens
acctaacacattaaatgtgg

SEQ ID NO: 5147374 - DNA, 18 bp, Homo sapiens
acctaacaggagaaagga

SEQ ID NO: 5147375 - DNA, 18 bp, Homo sapiens
acctaacattatttattc

SEQ ID NO: 5147376 - DNA, 12 bp, Homo sapiens
acctaacattcg

SEQ ID NO: 5147377 - DNA, 19 bp, Homo sapiens
acctaacattcgatctcat

SEQ ID NO: 5147378 - DNA, 13 bp, Homo sapiens
acctaacccagaa

SEQ ID NO: 5147379 - DNA, 13 bp, Homo sapiens
acctaacctgtgt

SEQ ID NO: 5147380 - DNA, 17 bp, Homo sapiens
acctaactcttttctat

SEQ ID NO: 5147381 - DNA, 15 bp, Homo sapiens
acctaactgcaatgt

SEQ ID NO: 5147382 - DNA, 22 bp, Homo sapiens
acctaagaacaaaactgtaact

SEQ ID NO: 5147383 - DNA, 20 bp, Homo sapiens
acctaagaatttcactgtct

SEQ ID NO: 5147384 - DNA, 21 bp, Homo sapiens
acctaagcaatcactgggccc

SEQ ID NO: 5147385 - DNA, 18 bp, Homo sapiens
acctaagccctgccccgg

SEQ ID NO: 5147386 - DNA, 12 bp, Homo sapiens
acctaaggcaga

SEQ ID NO: 5147387 - DNA, 16 bp, Homo sapiens
acctaaggcagacagg

SEQ ID NO: 5147388 - DNA, 23 bp, Homo sapiens
acctaagggacatgttttgataa

SEQ ID NO: 5147389 - DNA, 23 bp, Homo sapiens
acctaagtactgtaataatacct

SEQ ID NO: 5147390 - DNA, 19 bp, Homo sapiens
acctaagtcaggtaatata

SEQ ID NO: 5147391 - DNA, 17 bp, Homo sapiens
acctaataattgtatct

SEQ ID NO: 5147392 - DNA, 16 bp, Homo sapiens
acctaatatcacttaa

SEQ ID NO: 5147393 - DNA, 19 bp, Homo sapiens
acctaatatcacttaaatc

SEQ ID NO: 5147394 - DNA, 16 bp, Homo sapiens
acctaatatcatttta

SEQ ID NO: 5147395 - DNA, 17 bp, Homo sapiens
acctaatcaggctgagg

SEQ ID NO: 5147396 - DNA, 11 bp, Homo sapiens
acctaatccaa

SEQ ID NO: 5147397 - DNA, 21 bp, Homo sapiens
acctaatctctgtaaagctaa

SEQ ID NO: 5147398 - DNA, 21 bp, Homo sapiens
acctaatgaaagtgatgacat

SEQ ID NO: 5147399 - DNA, 17 bp, Homo sapiens
acctaatgggaatcatt

SEQ ID NO: 5147400 - DNA, 22 bp, Homo sapiens
acctaatgtctcactgttctgc

SEQ ID NO: 5147401 - DNA, 16 bp, Homo sapiens
acctaattagagcaga

SEQ ID NO: 5147402 - DNA, 17 bp, Homo sapiens
acctaatttttttcctg

SEQ ID NO: 5147403 - DNA, 19 bp, Homo sapiens
acctacaaaagcttgtgta

SEQ ID NO: 5147404 - DNA, 17 bp, Homo sapiens
acctacaagattcctgg

SEQ ID NO: 5147405 - DNA, 14 bp, Homo sapiens
acctacaataaact

SEQ ID NO: 5147406 - DNA, 20 bp, Homo sapiens
acctacacacataccttcat

SEQ ID NO: 5147407 - DNA, 20 bp, Homo sapiens
acctacacacgtaccttcat

SEQ ID NO: 5147408 - DNA, 22 bp, Homo sapiens
acctacaccattatcttggaaa

SEQ ID NO: 5147409 - DNA, 22 bp, Homo sapiens
acctacagaatactagccagag

SEQ ID NO: 5147410 - DNA, 15 bp, Homo sapiens
acctacagacctggc

SEQ ID NO: 5147411 - DNA, 16 bp, Homo sapiens
acctacagacctggct

SEQ ID NO: 5147412 - DNA, 17 bp, Homo sapiens
acctacagacctggctc

SEQ ID NO: 5147413 - DNA, 23 bp, Homo sapiens
acctacagacctggctctcagag

SEQ ID NO: 5147414 - DNA, 19 bp, Homo sapiens
acctacagactccatctct

SEQ ID NO: 5147415 - DNA, 22 bp, Homo sapiens
acctacagactccatctcttct

SEQ ID NO: 5147416 - DNA, 20 bp, Homo sapiens
acctacagagatgctaagag

SEQ ID NO: 5147417 - DNA, 14 bp, Homo sapiens
acctacagcagcac

SEQ ID NO: 5147418 - DNA, 12 bp, Homo sapiens
acctacagcctc

SEQ ID NO: 5147419 - DNA, 16 bp, Homo sapiens
acctacaggactgggc

SEQ ID NO: 5147420 - DNA, 22 bp, Homo sapiens
acctacagggaactgggaagat

SEQ ID NO: 5147421 - DNA, 23 bp, Homo sapiens
acctacagggggtctggctggtg

SEQ ID NO: 5147422 - DNA, 18 bp, Homo sapiens
acctacagtggagggaga

SEQ ID NO: 5147423 - DNA, 17 bp, Homo sapiens
acctacagtgtacagtc

SEQ ID NO: 5147424 - DNA, 21 bp, Homo sapiens
acctacataggcaaattggaa

SEQ ID NO: 5147425 - DNA, 20 bp, Homo sapiens
acctacatatgctgatcttt

SEQ ID NO: 5147426 - DNA, 17 bp, Homo sapiens
acctacatccccaggtc

SEQ ID NO: 5147427 - DNA, 14 bp, Homo sapiens
acctacatctgaaa

SEQ ID NO: 5147428 - DNA, 18 bp, Homo sapiens
acctacatgctgaaaaat

SEQ ID NO: 5147429 - DNA, 15 bp, Homo sapiens
acctacatgtatttg

SEQ ID NO: 5147430 - DNA, 19 bp, Homo sapiens
acctacatgttattctagt

SEQ ID NO: 5147431 - DNA, 17 bp, Homo sapiens
acctacattccaccctg

SEQ ID NO: 5147432 - DNA, 15 bp, Homo sapiens
acctaccacatgcca

SEQ ID NO: 5147433 - DNA, 16 bp, Homo sapiens
acctaccaccccactg

SEQ ID NO: 5147434 - DNA, 19 bp, Homo sapiens
acctaccaccccactggct

SEQ ID NO: 5147435 - DNA, 18 bp, Homo sapiens
acctaccaccccttcctg

SEQ ID NO: 5147436 - DNA, 21 bp, Homo sapiens
acctaccaccccttcctgtcc

SEQ ID NO: 5147437 - DNA, 15 bp, Homo sapiens
acctacccagctgat

SEQ ID NO: 5147438 - DNA, 15 bp, Homo sapiens
acctacccatacacc

SEQ ID NO: 5147439 - DNA, 13 bp, Homo sapiens
acctaccccagcc

SEQ ID NO: 5147440 - DNA, 17 bp, Homo sapiens
acctaccctcaaagtag

SEQ ID NO: 5147441 - DNA, 18 bp, Homo sapiens
acctaccctcaaagtagg

SEQ ID NO: 5147442 - DNA, 17 bp, Homo sapiens
acctaccctcagtgagc

SEQ ID NO: 5147443 - DNA, 20 bp, Homo sapiens
acctacctcaggttgctggt

SEQ ID NO: 5147444 - DNA, 18 bp, Homo sapiens
acctacctccctccctct

SEQ ID NO: 5147445 - DNA, 20 bp, Homo sapiens
acctacctcgccgagctgtc

SEQ ID NO: 5147446 - DNA, 11 bp, Homo sapiens
acctacctgtg

SEQ ID NO: 5147447 - DNA, 17 bp, Homo sapiens
acctacctgttgagcat

SEQ ID NO: 5147448 - DNA, 24 bp, Homo sapiens
acctacctgttgagcatcacagaa

SEQ ID NO: 5147449 - DNA, 18 bp, Homo sapiens
acctaccttactatttaa

SEQ ID NO: 5147450 - DNA, 20 bp, Homo sapiens
acctaccttactatttaaag

SEQ ID NO: 5147451 - DNA, 18 bp, Homo sapiens
acctaccttcatttcagg

SEQ ID NO: 5147452 - DNA, 23 bp, Homo sapiens
acctacgagggaggaacacctga

SEQ ID NO: 5147453 - DNA, 21 bp, Homo sapiens
acctacgttcctggccccctc

SEQ ID NO: 5147454 - DNA, 21 bp, Homo sapiens
acctacgtttgcaccgcctgc

SEQ ID NO: 5147455 - DNA, 17 bp, Homo sapiens
acctactaatagtttgt

SEQ ID NO: 5147456 - DNA, 14 bp, Homo sapiens
acctactcacacag

SEQ ID NO: 5147457 - DNA, 16 bp, Homo sapiens
acctactcctccccct

SEQ ID NO: 5147458 - DNA, 19 bp, Homo sapiens
acctactcctccccctcct

SEQ ID NO: 5147459 - DNA, 16 bp, Homo sapiens
acctactcctgggtca

SEQ ID NO: 5147460 - DNA, 22 bp, Homo sapiens
acctactctgtaatttgcttgt

SEQ ID NO: 5147461 - DNA, 20 bp, Homo sapiens
acctactgaacccagagtca

SEQ ID NO: 5147462 - DNA, 20 bp, Homo sapiens
acctactgaggagcaaagca

SEQ ID NO: 5147463 - DNA, 14 bp, Homo sapiens
acctactgcccaca

SEQ ID NO: 5147464 - DNA, 14 bp, Homo sapiens
acctactgttcctt

SEQ ID NO: 5147465 - DNA, 16 bp, Homo sapiens
acctactgttcctttc

SEQ ID NO: 5147466 - DNA, 18 bp, Homo sapiens
acctactgttcctttcag

SEQ ID NO: 5147467 - DNA, 16 bp, Homo sapiens
acctactgttctaaag

SEQ ID NO: 5147468 - DNA, 17 bp, Homo sapiens
acctactgttctaaagc

SEQ ID NO: 5147469 - DNA, 16 bp, Homo sapiens
acctacttagatattt

SEQ ID NO: 5147470 - DNA, 20 bp, Homo sapiens
acctacttagatatttcatg

SEQ ID NO: 5147471 - DNA, 23 bp, Homo sapiens
acctacttagatatttcatgtgc

SEQ ID NO: 5147472 - DNA, 19 bp, Homo sapiens
acctacttgtaaacttgaa

SEQ ID NO: 5147473 - DNA, 20 bp, Homo sapiens
acctactttgactttttgca

SEQ ID NO: 5147474 - DNA, 13 bp, Homo sapiens
acctactttttat

SEQ ID NO: 5147475 - DNA, 22 bp, Homo sapiens
acctactttttatgtgctatgc

SEQ ID NO: 5147476 - DNA, 22 bp, Homo sapiens
acctactttttctttgattttc

SEQ ID NO: 5147477 - DNA, 19 bp, Homo sapiens
acctagaacttcaaaatgt

SEQ ID NO: 5147478 - DNA, 15 bp, Homo sapiens
acctagaagtaagaa

SEQ ID NO: 5147479 - DNA, 18 bp, Homo sapiens
acctagactctccctgta

SEQ ID NO: 5147480 - DNA, 13 bp, Homo sapiens
acctagatcagaa

SEQ ID NO: 5147481 - DNA, 22 bp, Homo sapiens
acctagatgtttaacaaatcta

SEQ ID NO: 5147482 - DNA, 19 bp, Homo sapiens
acccggatctccaggccca

SEQ ID NO: 5147483 - DNA, 16 bp, Homo sapiens
acccggattggccctg

SEQ ID NO: 5147484 - DNA, 21 bp, Homo sapiens
acccggattggccctgcccct

SEQ ID NO: 5147485 - DNA, 22 bp, Homo sapiens
acccggattggccctgcccctc

SEQ ID NO: 5147486 - DNA, 22 bp, Homo sapiens
acccggcatgccgagtgcccca

SEQ ID NO: 5147487 - DNA, 16 bp, Homo sapiens
acccggccacagctgc

SEQ ID NO: 5147488 - DNA, 20 bp, Homo sapiens
acccggcccccgccctctgc

SEQ ID NO: 5147489 - DNA, 15 bp, Homo sapiens
acccggcccctgctg

SEQ ID NO: 5147490 - DNA, 17 bp, Homo sapiens
acccggcccctgctggt

SEQ ID NO: 5147491 - DNA, 22 bp, Homo sapiens
acccggcccctgctggttcagg

SEQ ID NO: 5147492 - DNA, 22 bp, Homo sapiens
acccggccgccgccaggactgt

SEQ ID NO: 5147493 - DNA, 18 bp, Homo sapiens
acccggcctctctgcccc

SEQ ID NO: 5147494 - DNA, 21 bp, Homo sapiens
acccggcctggatgccagctg

SEQ ID NO: 5147495 - DNA, 21 bp, Homo sapiens
acccggcggtcccctccgcca

SEQ ID NO: 5147496 - DNA, 17 bp, Homo sapiens
acccggctccccctgct

SEQ ID NO: 5147497 - DNA, 17 bp, Homo sapiens
acccggctcgtgtattt

SEQ ID NO: 5147498 - DNA, 22 bp, Homo sapiens
acccggctcgtgtatttattac

SEQ ID NO: 5147499 - DNA, 21 bp, Homo sapiens
acccggctcgttcccccaggg

SEQ ID NO: 5147500 - DNA, 21 bp, Homo sapiens
acccggctgactcagtgcagg

SEQ ID NO: 5147501 - DNA, 13 bp, Homo sapiens
acccgggaagggg

SEQ ID NO: 5147502 - DNA, 19 bp, Homo sapiens
acccgggaagggggctggg

SEQ ID NO: 5147503 - DNA, 21 bp, Homo sapiens
acccgggaggcggagcttgca

SEQ ID NO: 5147504 - DNA, 21 bp, Homo sapiens
acccgggaggtggagcttgca

SEQ ID NO: 5147505 - DNA, 20 bp, Homo sapiens
acccgggcagggctcccaca

SEQ ID NO: 5147506 - DNA, 14 bp, Homo sapiens
acccgggctgcctg

SEQ ID NO: 5147507 - DNA, 13 bp, Homo sapiens
acccggggcagct

SEQ ID NO: 5147508 - DNA, 19 bp, Homo sapiens
acccggggccagagacata

SEQ ID NO: 5147509 - DNA, 14 bp, Homo sapiens
acccggggcccagg

SEQ ID NO: 5147510 - DNA, 20 bp, Homo sapiens
acccgggggagcccagtgaa

SEQ ID NO: 5147511 - DNA, 19 bp, Homo sapiens
acccggggtctcctggacc

SEQ ID NO: 5147512 - DNA, 14 bp, Homo sapiens
acccggtccccact

SEQ ID NO: 5147513 - DNA, 19 bp, Homo sapiens
acccggtggcttctggcac

SEQ ID NO: 5147514 - DNA, 21 bp, Homo sapiens
acccggtggcttctggcacct

SEQ ID NO: 5147515 - DNA, 14 bp, Homo sapiens
acccggttcagtgt

SEQ ID NO: 5147516 - DNA, 21 bp, Homo sapiens
acccggttgcagtcactgtga

SEQ ID NO: 5147517 - DNA, 18 bp, Homo sapiens
acccggtttctttttaag

SEQ ID NO: 5147518 - DNA, 15 bp, Homo sapiens
acccgtacaacgtgt

SEQ ID NO: 5147519 - DNA, 19 bp, Homo sapiens
acccgtacccccgtggtct

SEQ ID NO: 5147520 - DNA, 19 bp, Homo sapiens
acccgtaggcagcctctct

SEQ ID NO: 5147521 - DNA, 20 bp, Homo sapiens
acccgtaggcagcctctctg

SEQ ID NO: 5147522 - DNA, 23 bp, Homo sapiens
acccgtaggcagcctctctgcta

SEQ ID NO: 5147523 - DNA, 15 bp, Homo sapiens
acccgtatctgccct

SEQ ID NO: 5147524 - DNA, 15 bp, Homo sapiens
acccgtccattcttc

SEQ ID NO: 5147525 - DNA, 22 bp, Homo sapiens
acccgtccattcttcagtgtct

SEQ ID NO: 5147526 - DNA, 13 bp, Homo sapiens
acccgtcctccct

SEQ ID NO: 5147527 - DNA, 21 bp, Homo sapiens
acccgtcctccctcagcctcc

SEQ ID NO: 5147528 - DNA, 14 bp, Homo sapiens
acccgtcctctcgg

SEQ ID NO: 5147529 - DNA, 21 bp, Homo sapiens
acccgtcctctcggctgccag

SEQ ID NO: 5147530 - DNA, 12 bp, Homo sapiens
acccgtcctggg

SEQ ID NO: 5147531 - DNA, 17 bp, Homo sapiens
acccgtctccagctgct

SEQ ID NO: 5147532 - DNA, 16 bp, Homo sapiens
acccgtgacagtggct

SEQ ID NO: 5147533 - DNA, 17 bp, Homo sapiens
acccgtgagcgcctgtg

SEQ ID NO: 5147534 - DNA, 22 bp, Homo sapiens
acccgtgccaagtccaggtcct

SEQ ID NO: 5147535 - DNA, 21 bp, Homo sapiens
acccgtgccacgcgctctgca

SEQ ID NO: 5147536 - DNA, 22 bp, Homo sapiens
acccgtgcctgggcccctcccc

SEQ ID NO: 5147537 - DNA, 23 bp, Homo sapiens
acccgtgcctgggcccctcccct

SEQ ID NO: 5147538 - DNA, 12 bp, Homo sapiens
acccgttccaaa

SEQ ID NO: 5147539 - DNA, 18 bp, Homo sapiens
acccgttctgctggcctg

SEQ ID NO: 5147540 - DNA, 23 bp, Homo sapiens
acccgttctgctggcctggatct

SEQ ID NO: 5147541 - DNA, 15 bp, Homo sapiens
acccgtttccaagcc

SEQ ID NO: 5147542 - DNA, 16 bp, Homo sapiens
acccgtttccaagcct

SEQ ID NO: 5147543 - DNA, 12 bp, Homo sapiens
accctaaaaaga

SEQ ID NO: 5147544 - DNA, 20 bp, Homo sapiens
accctaaagcaaatctgcca

SEQ ID NO: 5147545 - DNA, 20 bp, Homo sapiens
accctaaataataaaaataa

SEQ ID NO: 5147546 - DNA, 16 bp, Homo sapiens
accctaaatcttgact

SEQ ID NO: 5147547 - DNA, 13 bp, Homo sapiens
accctaaccaagt

SEQ ID NO: 5147548 - DNA, 14 bp, Homo sapiens
accctaactgagct

SEQ ID NO: 5147549 - DNA, 21 bp, Homo sapiens
accctaagggcagccctccat

SEQ ID NO: 5147550 - DNA, 21 bp, Homo sapiens
accctaagtgtggatgttcag

SEQ ID NO: 5147551 - DNA, 13 bp, Homo sapiens
accctaatgtctt

SEQ ID NO: 5147552 - DNA, 17 bp, Homo sapiens
accctaattaatagaat

SEQ ID NO: 5147553 - DNA, 19 bp, Homo sapiens
accctaatttgcccttcag

SEQ ID NO: 5147554 - DNA, 16 bp, Homo sapiens
accctacaagatgcca

SEQ ID NO: 5147555 - DNA, 22 bp, Homo sapiens
accctacaagttgatcatgcag

SEQ ID NO: 5147556 - DNA, 21 bp, Homo sapiens
accctacacctctgggccctg

SEQ ID NO: 5147557 - DNA, 20 bp, Homo sapiens
accctacagacagtatgtct

SEQ ID NO: 5147558 - DNA, 15 bp, Homo sapiens
accctacagtatata

SEQ ID NO: 5147559 - DNA, 20 bp, Homo sapiens
accctacatgcatgttttat

SEQ ID NO: 5147560 - DNA, 15 bp, Homo sapiens
accctaccagctcct

SEQ ID NO: 5147561 - DNA, 22 bp, Homo sapiens
accctaccagctcctccagccc

SEQ ID NO: 5147562 - DNA, 14 bp, Homo sapiens
accctaccctggca

SEQ ID NO: 5147563 - DNA, 17 bp, Homo sapiens
accctacctgtgcctga

SEQ ID NO: 5147564 - DNA, 18 bp, Homo sapiens
accctaccttccccagac

SEQ ID NO: 5147565 - DNA, 19 bp, Homo sapiens
accctactgaagtggctgg

SEQ ID NO: 5147566 - DNA, 14 bp, Homo sapiens
accctactggctgt

SEQ ID NO: 5147567 - DNA, 15 bp, Homo sapiens
accctactggctgta

SEQ ID NO: 5147568 - DNA, 13 bp, Homo sapiens
accctactgtggg

SEQ ID NO: 5147569 - DNA, 14 bp, Homo sapiens
accctacttctttt

SEQ ID NO: 5147570 - DNA, 19 bp, Homo sapiens
accctactttgcttccgcc

SEQ ID NO: 5147571 - DNA, 17 bp, Homo sapiens
accctagccctctccct

SEQ ID NO: 5147572 - DNA, 18 bp, Homo sapiens
accctagcctccaccatc

SEQ ID NO: 5147573 - DNA, 17 bp, Homo sapiens
accctagccttgcttgt

SEQ ID NO: 5147574 - DNA, 18 bp, Homo sapiens
accctaggtctccacccc

SEQ ID NO: 5147575 - DNA, 22 bp, Homo sapiens
accctaggtctccacccctcaa

SEQ ID NO: 5147576 - DNA, 22 bp, Homo sapiens
accctagtcccttcccctccct

SEQ ID NO: 5147577 - DNA, 18 bp, Homo sapiens
accctagttattttctga

SEQ ID NO: 5147578 - DNA, 15 bp, Homo sapiens
accctagttctacct

SEQ ID NO: 5147579 - DNA, 21 bp, Homo sapiens
accctagttctacctcaggca

SEQ ID NO: 5147580 - DNA, 22 bp, Homo sapiens
accctagttctcttatctttga

SEQ ID NO: 5147581 - DNA, 19 bp, Homo sapiens
accctatatgcttactgtg

SEQ ID NO: 5147582 - DNA, 23 bp, Homo sapiens
accctatattttgcatagtacca

SEQ ID NO: 5147583 - DNA, 20 bp, Homo sapiens
accctatcatagatttacaa

SEQ ID NO: 5147584 - DNA, 13 bp, Homo sapiens
accctatccctgt

SEQ ID NO: 5147585 - DNA, 16 bp, Homo sapiens
accctatctcccacaa

SEQ ID NO: 5147586 - DNA, 19 bp, Homo sapiens
accctatgccttttgtagc

SEQ ID NO: 5147587 - DNA, 19 bp, Homo sapiens
accctatggggaggccctg

SEQ ID NO: 5147588 - DNA, 20 bp, Homo sapiens
accctatggggaggccctgc

SEQ ID NO: 5147589 - DNA, 22 bp, Homo sapiens
accctatggggaggccctgcct

SEQ ID NO: 5147590 - DNA, 14 bp, Homo sapiens
accctattgctgct

SEQ ID NO: 5147591 - DNA, 15 bp, Homo sapiens
accctatttaaaact

SEQ ID NO: 5147592 - DNA, 15 bp, Homo sapiens
accctatttgtttca

SEQ ID NO: 5147593 - DNA, 21 bp, Homo sapiens
accctatttgtttcattaaag

SEQ ID NO: 5147594 - DNA, 13 bp, Homo sapiens
accctcaaagtag

SEQ ID NO: 5147595 - DNA, 16 bp, Homo sapiens
accctcaaatgtcaga

SEQ ID NO: 5147596 - DNA, 21 bp, Homo sapiens
accctcaaatgtcagagctat

SEQ ID NO: 5147597 - DNA, 19 bp, Homo sapiens
accctcaccacccaacagt

SEQ ID NO: 5147598 - DNA, 14 bp, Homo sapiens
accctcacccactc

SEQ ID NO: 5147599 - DNA, 21 bp, Homo sapiens
accctcacccactctggtggc

SEQ ID NO: 5147600 - DNA, 22 bp, Homo sapiens
accctcaccccctcctggcaat

SEQ ID NO: 5147601 - DNA, 16 bp, Homo sapiens
accctcaccgcggctg

SEQ ID NO: 5147602 - DNA, 21 bp, Homo sapiens
accctcaccgcggctggatgg

SEQ ID NO: 5147603 - DNA, 11 bp, Homo sapiens
accctcactgg

SEQ ID NO: 5147604 - DNA, 21 bp, Homo sapiens
accctcactggctctcctggc

SEQ ID NO: 5147605 - DNA, 18 bp, Homo sapiens
accctcagaaacactggg

SEQ ID NO: 5147606 - DNA, 11 bp, Homo sapiens
accctcagagc

SEQ ID NO: 5147607 - DNA, 13 bp, Homo sapiens
accctcagagcct

SEQ ID NO: 5147608 - DNA, 14 bp, Homo sapiens
accctcagagcctc

SEQ ID NO: 5147609 - DNA, 20 bp, Homo sapiens
accctcagatgcacatgagc

SEQ ID NO: 5147610 - DNA, 14 bp, Homo sapiens
accctcagcacccc

SEQ ID NO: 5147611 - DNA, 16 bp, Homo sapiens
accctcagcacccctt

SEQ ID NO: 5147612 - DNA, 12 bp, Homo sapiens
accctcagcagc

SEQ ID NO: 5147613 - DNA, 16 bp, Homo sapiens
accctcagcagctctg

SEQ ID NO: 5147614 - DNA, 23 bp, Homo sapiens
accctcagcagctctggctctgc

SEQ ID NO: 5147615 - DNA, 13 bp, Homo sapiens
accctcagcccca

SEQ ID NO: 5147616 - DNA, 14 bp, Homo sapiens
accctcagccccag

SEQ ID NO: 5147617 - DNA, 22 bp, Homo sapiens
accctcagccctggcctttttc

SEQ ID NO: 5147618 - DNA, 20 bp, Homo sapiens
accctcagctgcctcatcgt

SEQ ID NO: 5147619 - DNA, 16 bp, Homo sapiens
accctcagctggcgga

SEQ ID NO: 5147620 - DNA, 16 bp, Homo sapiens
accctcagctgtcacc

SEQ ID NO: 5147621 - DNA, 21 bp, Homo sapiens
accctcagctgtcacctgctc

SEQ ID NO: 5147622 - DNA, 11 bp, Homo sapiens
accctcaggaa

SEQ ID NO: 5147623 - DNA, 18 bp, Homo sapiens
accctcaggaacccaccc

SEQ ID NO: 5147624 - DNA, 20 bp, Homo sapiens
accctcaggcacaccttgca

SEQ ID NO: 5147625 - DNA, 21 bp, Homo sapiens
accctcaggcacaccttgcag

SEQ ID NO: 5147626 - DNA, 13 bp, Homo sapiens
accctcaggcagg

SEQ ID NO: 5147627 - DNA, 20 bp, Homo sapiens
accctcaggcataggcctgg

SEQ ID NO: 5147628 - DNA, 22 bp, Homo sapiens
accctcaggtgtagctgagctg

SEQ ID NO: 5147629 - DNA, 19 bp, Homo sapiens
accctcagtgagcatggta

SEQ ID NO: 5147630 - DNA, 16 bp, Homo sapiens
accctcataccatctg

SEQ ID NO: 5147631 - DNA, 13 bp, Homo sapiens
accctcatcacca

SEQ ID NO: 5147632 - DNA, 13 bp, Homo sapiens
accctcatctttc

SEQ ID NO: 5147633 - DNA, 12 bp, Homo sapiens
accctcatgctg

SEQ ID NO: 5147634 - DNA, 20 bp, Homo sapiens
accctcatgctgtgtgactc

SEQ ID NO: 5147635 - DNA, 15 bp, Homo sapiens
accctcatgttctta

SEQ ID NO: 5147636 - DNA, 21 bp, Homo sapiens
accctcattgctgtcttgccc

SEQ ID NO: 5147637 - DNA, 21 bp, Homo sapiens
accctccaaaggaactctaga

SEQ ID NO: 5147638 - DNA, 16 bp, Homo sapiens
accctccaaaggaagg

SEQ ID NO: 5147639 - DNA, 23 bp, Homo sapiens
accctccaaatggagaagctgca

SEQ ID NO: 5147640 - DNA, 14 bp, Homo sapiens
accctccaaggcca

SEQ ID NO: 5147641 - DNA, 18 bp, Homo sapiens
accctccaagggatctgc

SEQ ID NO: 5147642 - DNA, 20 bp, Homo sapiens
accctccacaaagcaaaggc

SEQ ID NO: 5147643 - DNA, 15 bp, Homo sapiens
accctccaccctgtc

SEQ ID NO: 5147644 - DNA, 23 bp, Homo sapiens
accctccaccctgtcccccagct

SEQ ID NO: 5147645 - DNA, 16 bp, Homo sapiens
accctccactcactgc

SEQ ID NO: 5147646 - DNA, 17 bp, Homo sapiens
accctccactcactgct

SEQ ID NO: 5147647 - DNA, 17 bp, Homo sapiens
accctccactctgaggt

SEQ ID NO: 5147648 - DNA, 15 bp, Homo sapiens
accctccacttcccg

SEQ ID NO: 5147649 - DNA, 16 bp, Homo sapiens
accctccacttcccgt

SEQ ID NO: 5147650 - DNA, 22 bp, Homo sapiens
accctccagcttttcctcaggg

SEQ ID NO: 5147651 - DNA, 20 bp, Homo sapiens
accctccatgctcctcacct

SEQ ID NO: 5147652 - DNA, 18 bp, Homo sapiens
accctcccaccactcccc

SEQ ID NO: 5147653 - DNA, 20 bp, Homo sapiens
accctcccaccatgcgctgc

SEQ ID NO: 5147654 - DNA, 12 bp, Homo sapiens
accctcccaccc

SEQ ID NO: 5147655 - DNA, 23 bp, Homo sapiens
accctcccacccccttctctgct

SEQ ID NO: 5147656 - DNA, 12 bp, Homo sapiens
accctcccactc

SEQ ID NO: 5147657 - DNA, 13 bp, Homo sapiens
accctcccactcc

SEQ ID NO: 5147658 - DNA, 14 bp, Homo sapiens
accctcccactccc

SEQ ID NO: 5147659 - DNA, 23 bp, Homo sapiens
acctagattattgaattcttcac

SEQ ID NO: 5147660 - DNA, 12 bp, Homo sapiens
acctagattttt

SEQ ID NO: 5147661 - DNA, 18 bp, Homo sapiens
acctagcaattccatcac

SEQ ID NO: 5147662 - DNA, 14 bp, Homo sapiens
acctagcagggaag

SEQ ID NO: 5147663 - DNA, 19 bp, Homo sapiens
acctagcatcttacaaaaa

SEQ ID NO: 5147664 - DNA, 17 bp, Homo sapiens
acctagccaacatggtg

SEQ ID NO: 5147665 - DNA, 13 bp, Homo sapiens
acctagccagctg

SEQ ID NO: 5147666 - DNA, 12 bp, Homo sapiens
acctagccggaa

SEQ ID NO: 5147667 - DNA, 13 bp, Homo sapiens
acctagcctggat

SEQ ID NO: 5147668 - DNA, 15 bp, Homo sapiens
acctagctacactga

SEQ ID NO: 5147669 - DNA, 19 bp, Homo sapiens
acctagctgaatgtttttc

SEQ ID NO: 5147670 - DNA, 21 bp, Homo sapiens
acctagctgaatgtttttcta

SEQ ID NO: 5147671 - DNA, 23 bp, Homo sapiens
acctagctgaatgtttttctaaa

SEQ ID NO: 5147672 - DNA, 19 bp, Homo sapiens
acctagctggtagcataaa

SEQ ID NO: 5147673 - DNA, 14 bp, Homo sapiens
acctagctgtgcaa

SEQ ID NO: 5147674 - DNA, 18 bp, Homo sapiens
acctagctgtgccccctc

SEQ ID NO: 5147675 - DNA, 23 bp, Homo sapiens
acctagctgtgccccctctggtt

SEQ ID NO: 5147676 - DNA, 20 bp, Homo sapiens
acctagcttgaggcaatttt

SEQ ID NO: 5147677 - DNA, 14 bp, Homo sapiens
acctagcttttaaa

SEQ ID NO: 5147678 - DNA, 18 bp, Homo sapiens
acctagcttttaaaaaat

SEQ ID NO: 5147679 - DNA, 19 bp, Homo sapiens
acctagcttttaaaaaata

SEQ ID NO: 5147680 - DNA, 17 bp, Homo sapiens
acctaggatatcttctc

SEQ ID NO: 5147681 - DNA, 13 bp, Homo sapiens
acctaggctcctc

SEQ ID NO: 5147682 - DNA, 22 bp, Homo sapiens
acctaggctgaggttagagaga

SEQ ID NO: 5147683 - DNA, 23 bp, Homo sapiens
acctaggctgaggttagagagat

SEQ ID NO: 5147684 - DNA, 17 bp, Homo sapiens
acctagggaggacctta

SEQ ID NO: 5147685 - DNA, 15 bp, Homo sapiens
acctagggatcctga

SEQ ID NO: 5147686 - DNA, 19 bp, Homo sapiens
acctagggggacggggctg

SEQ ID NO: 5147687 - DNA, 21 bp, Homo sapiens
acctagggttttctatttctt

SEQ ID NO: 5147688 - DNA, 16 bp, Homo sapiens
acctaggtggggcctg

SEQ ID NO: 5147689 - DNA, 21 bp, Homo sapiens
acctagtactctctgctctag

SEQ ID NO: 5147690 - DNA, 13 bp, Homo sapiens
acctagtctaagg

SEQ ID NO: 5147691 - DNA, 13 bp, Homo sapiens
acctagtgaaact

SEQ ID NO: 5147692 - DNA, 17 bp, Homo sapiens
acctagtggctgtccag

SEQ ID NO: 5147693 - DNA, 13 bp, Homo sapiens
acctataaaacaa

SEQ ID NO: 5147694 - DNA, 19 bp, Homo sapiens
acctataaagtaaagctaa

SEQ ID NO: 5147695 - DNA, 15 bp, Homo sapiens
acctataaatggact

SEQ ID NO: 5147696 - DNA, 19 bp, Homo sapiens
acctataacctgtaggaaa

SEQ ID NO: 5147697 - DNA, 17 bp, Homo sapiens
acctatacctatgtgaa

SEQ ID NO: 5147698 - DNA, 17 bp, Homo sapiens
acctatagcatcttctc

SEQ ID NO: 5147699 - DNA, 15 bp, Homo sapiens
acctatagtcccagc

SEQ ID NO: 5147700 - DNA, 21 bp, Homo sapiens
acctatatgcagtctctttat

SEQ ID NO: 5147701 - DNA, 13 bp, Homo sapiens
acctatattgatt

SEQ ID NO: 5147702 - DNA, 23 bp, Homo sapiens
acctatcaaagcttcaaaaactt

SEQ ID NO: 5147703 - DNA, 20 bp, Homo sapiens
acctatcaatcctgccccca

SEQ ID NO: 5147704 - DNA, 17 bp, Homo sapiens
acctatccaccacccca

SEQ ID NO: 5147705 - DNA, 14 bp, Homo sapiens
acctatcccacctc

SEQ ID NO: 5147706 - DNA, 17 bp, Homo sapiens
acctatcccacctccat

SEQ ID NO: 5147707 - DNA, 15 bp, Homo sapiens
acctatcctcactgc

SEQ ID NO: 5147708 - DNA, 19 bp, Homo sapiens
acctatccttacatttcac

SEQ ID NO: 5147709 - DNA, 16 bp, Homo sapiens
acctatctcagggagg

SEQ ID NO: 5147710 - DNA, 17 bp, Homo sapiens
acctatctcagggaggg

SEQ ID NO: 5147711 - DNA, 15 bp, Homo sapiens
acctatctcgtggga

SEQ ID NO: 5147712 - DNA, 17 bp, Homo sapiens
acctatctcgtgggaga

SEQ ID NO: 5147713 - DNA, 21 bp, Homo sapiens
acctatctgtattggcagcac

SEQ ID NO: 5147714 - DNA, 22 bp, Homo sapiens
acctatctgtattggcagcaca

SEQ ID NO: 5147715 - DNA, 14 bp, Homo sapiens
acctatctgtggaa

SEQ ID NO: 5147716 - DNA, 17 bp, Homo sapiens
acctatctgtggaaagc

SEQ ID NO: 5147717 - DNA, 17 bp, Homo sapiens
acctatgagtgagaata

SEQ ID NO: 5147718 - DNA, 19 bp, Homo sapiens
acctatgagtgagaatatg

SEQ ID NO: 5147719 - DNA, 22 bp, Homo sapiens
acctatgcctgtggtgaagtgt

SEQ ID NO: 5147720 - DNA, 21 bp, Homo sapiens
acctatggcccagccactgca

SEQ ID NO: 5147721 - DNA, 22 bp, Homo sapiens
acctatggtataatggttgact

SEQ ID NO: 5147722 - DNA, 18 bp, Homo sapiens
acctatgtcatttcattt

SEQ ID NO: 5147723 - DNA, 17 bp, Homo sapiens
acctatgtcctaaggac

SEQ ID NO: 5147724 - DNA, 18 bp, Homo sapiens
acctatgtgaaactctat

SEQ ID NO: 5147725 - DNA, 15 bp, Homo sapiens
acctatgtgacagac

SEQ ID NO: 5147726 - DNA, 15 bp, Homo sapiens
acctattaaaagttg

SEQ ID NO: 5147727 - DNA, 18 bp, Homo sapiens
acctattaggtggaaatt

SEQ ID NO: 5147728 - DNA, 16 bp, Homo sapiens
acctattatcccagct

SEQ ID NO: 5147729 - DNA, 23 bp, Homo sapiens
acctattcaagaagatagttgta

SEQ ID NO: 5147730 - DNA, 14 bp, Homo sapiens
acctattcaccctc

SEQ ID NO: 5147731 - DNA, 16 bp, Homo sapiens
acctattcaccctcca

SEQ ID NO: 5147732 - DNA, 21 bp, Homo sapiens
acctattctgaaaaagacata

SEQ ID NO: 5147733 - DNA, 23 bp, Homo sapiens
acctattgccaggaatgtttcag

SEQ ID NO: 5147734 - DNA, 22 bp, Homo sapiens
acctatttatcgcaacatgaat

SEQ ID NO: 5147735 - DNA, 17 bp, Homo sapiens
acctatttcaaaaattt

SEQ ID NO: 5147736 - DNA, 20 bp, Homo sapiens
acctatttcaaaaatttgga

SEQ ID NO: 5147737 - DNA, 12 bp, Homo sapiens
acctatttccac

SEQ ID NO: 5147738 - DNA, 19 bp, Homo sapiens
acctatttccagaaataca

SEQ ID NO: 5147739 - DNA, 11 bp, Homo sapiens
acctatttctg

SEQ ID NO: 5147740 - DNA, 17 bp, Homo sapiens
acctatttctgatgatg

SEQ ID NO: 5147741 - DNA, 11 bp, Homo sapiens
acctattttag

SEQ ID NO: 5147742 - DNA, 14 bp, Homo sapiens
acctattttagggt

SEQ ID NO: 5147743 - DNA, 21 bp, Homo sapiens
acctattttagggttctaaat

SEQ ID NO: 5147744 - DNA, 16 bp, Homo sapiens
acctattttcatttgt

SEQ ID NO: 5147745 - DNA, 17 bp, Homo sapiens
acctattttcatttgta

SEQ ID NO: 5147746 - DNA, 21 bp, Homo sapiens
acctattttgaaaaattccta

SEQ ID NO: 5147747 - DNA, 19 bp, Homo sapiens
acctattttgaaaggtcag

SEQ ID NO: 5147748 - DNA, 20 bp, Homo sapiens
acctatttttgacatggaaa

SEQ ID NO: 5147749 - DNA, 17 bp, Homo sapiens
acctcaaaagaaaatgt

SEQ ID NO: 5147750 - DNA, 16 bp, Homo sapiens
acctcaaaatgtctaa

SEQ ID NO: 5147751 - DNA, 20 bp, Homo sapiens
acctcaaactatctggccat

SEQ ID NO: 5147752 - DNA, 23 bp, Homo sapiens
acctcaaacttccagtcaggtag

SEQ ID NO: 5147753 - DNA, 20 bp, Homo sapiens
acctcaaagggcagttttga

SEQ ID NO: 5147754 - DNA, 14 bp, Homo sapiens
acctcaaatatagt

SEQ ID NO: 5147755 - DNA, 17 bp, Homo sapiens
acctcaaccatcctggc

SEQ ID NO: 5147756 - DNA, 21 bp, Homo sapiens
acctcaaccatcctggctgcg

SEQ ID NO: 5147757 - DNA, 19 bp, Homo sapiens
acctcaacccccatttcta

SEQ ID NO: 5147758 - DNA, 18 bp, Homo sapiens
acctcaacctgtaaatta

SEQ ID NO: 5147759 - DNA, 21 bp, Homo sapiens
acctcaacctgtaaattattt

SEQ ID NO: 5147760 - DNA, 15 bp, Homo sapiens
acctcaactaaccct

SEQ ID NO: 5147761 - DNA, 19 bp, Homo sapiens
acctcaagccccatttcct

SEQ ID NO: 5147762 - DNA, 15 bp, Homo sapiens
acctcaagccctgag

SEQ ID NO: 5147763 - DNA, 17 bp, Homo sapiens
acctcaagccctgaggg

SEQ ID NO: 5147764 - DNA, 15 bp, Homo sapiens
acctcaagggggact

SEQ ID NO: 5147765 - DNA, 19 bp, Homo sapiens
acctcaagtgatctgccca

SEQ ID NO: 5147766 - DNA, 20 bp, Homo sapiens
acctcaagttcttggaccag

SEQ ID NO: 5147767 - DNA, 19 bp, Homo sapiens
acctcaatcagtctcagaa

SEQ ID NO: 5147768 - DNA, 15 bp, Homo sapiens
acctcaatgccctgc

SEQ ID NO: 5147769 - DNA, 16 bp, Homo sapiens
acctcaatgccctgcc

SEQ ID NO: 5147770 - DNA, 17 bp, Homo sapiens
acctcaatgccctgcca

SEQ ID NO: 5147771 - DNA, 20 bp, Homo sapiens
acctcaattttcactgtgtc

SEQ ID NO: 5147772 - DNA, 14 bp, Homo sapiens
acctcacacacctc

SEQ ID NO: 5147773 - DNA, 18 bp, Homo sapiens
acctcacacacctctgcc

SEQ ID NO: 5147774 - DNA, 20 bp, Homo sapiens
acctcacacacctctgcccc

SEQ ID NO: 5147775 - DNA, 16 bp, Homo sapiens
acctcacacacggctg

SEQ ID NO: 5147776 - DNA, 17 bp, Homo sapiens
acctcacacctcactct

SEQ ID NO: 5147777 - DNA, 20 bp, Homo sapiens
acctcacagtgacccttccc

SEQ ID NO: 5147778 - DNA, 22 bp, Homo sapiens
acctcacatgcatacatacaca

SEQ ID NO: 5147779 - DNA, 13 bp, Homo sapiens
acctcaccaaact

SEQ ID NO: 5147780 - DNA, 16 bp, Homo sapiens
acctcaccaactccta

SEQ ID NO: 5147781 - DNA, 17 bp, Homo sapiens
acctcaccaactcctag

SEQ ID NO: 5147782 - DNA, 23 bp, Homo sapiens
acctcaccccgaggccctgcatg

SEQ ID NO: 5147783 - DNA, 18 bp, Homo sapiens
acctcacccttgcaccgt

SEQ ID NO: 5147784 - DNA, 15 bp, Homo sapiens
acctcacctagaaat

SEQ ID NO: 5147785 - DNA, 16 bp, Homo sapiens
acctcacctggtcctc

SEQ ID NO: 5147786 - DNA, 15 bp, Homo sapiens
acctcacgctctgga

SEQ ID NO: 5147787 - DNA, 16 bp, Homo sapiens
acctcactagctcccc

SEQ ID NO: 5147788 - DNA, 22 bp, Homo sapiens
acctcactagctccccaatccc

SEQ ID NO: 5147789 - DNA, 16 bp, Homo sapiens
acctcactatctgaaa

SEQ ID NO: 5147790 - DNA, 23 bp, Homo sapiens
acctcactatggtatgctggcca

SEQ ID NO: 5147791 - DNA, 19 bp, Homo sapiens
acctcactcagcaccactc

SEQ ID NO: 5147792 - DNA, 22 bp, Homo sapiens
acctcactcagcaccactcaag

SEQ ID NO: 5147793 - DNA, 18 bp, Homo sapiens
acctcactcttgccaacc

SEQ ID NO: 5147794 - DNA, 17 bp, Homo sapiens
acctcactctttatagt

SEQ ID NO: 5147795 - DNA, 21 bp, Homo sapiens
acctcactgagaggcctggag

SEQ ID NO: 5147796 - DNA, 14 bp, Homo sapiens
acctcactgccctc

SEQ ID NO: 5147797 - DNA, 15 bp, Homo sapiens
acctcactgcctcat

SEQ ID NO: 5147798 - DNA, 15 bp, Homo sapiens
acctcactggcctgc

SEQ ID NO: 5147799 - DNA, 17 bp, Homo sapiens
acctcactggcctgcca

SEQ ID NO: 5147800 - DNA, 20 bp, Homo sapiens
acctcactggcctgccatgc

SEQ ID NO: 5147801 - DNA, 22 bp, Homo sapiens
acctcactggcctgccatgcca

SEQ ID NO: 5147802 - DNA, 17 bp, Homo sapiens
acctcactggtgcattt

SEQ ID NO: 5147803 - DNA, 22 bp, Homo sapiens
acctcactggtgcatttaaaat

SEQ ID NO: 5147804 - DNA, 14 bp, Homo sapiens
acctcactgtcagg

SEQ ID NO: 5147805 - DNA, 18 bp, Homo sapiens
acctcactgtcatctgcc

SEQ ID NO: 5147806 - DNA, 14 bp, Homo sapiens
acctcactgtcctg

SEQ ID NO: 5147807 - DNA, 12 bp, Homo sapiens
acctcacttgtg

SEQ ID NO: 5147808 - DNA, 19 bp, Homo sapiens
acctcagaaagtcaccagg

SEQ ID NO: 5147809 - DNA, 18 bp, Homo sapiens
acctcagaaattgaaagc

SEQ ID NO: 5147810 - DNA, 14 bp, Homo sapiens
acctcagaacataa

SEQ ID NO: 5147811 - DNA, 21 bp, Homo sapiens
acctcagacaatccactctca

SEQ ID NO: 5147812 - DNA, 22 bp, Homo sapiens
acctcagacaatccactctcag

SEQ ID NO: 5147813 - DNA, 22 bp, Homo sapiens
acctcagacttaccaggaagca

SEQ ID NO: 5147814 - DNA, 11 bp, Homo sapiens
acctcagagca

SEQ ID NO: 5147815 - DNA, 18 bp, Homo sapiens
acctcagaggcagcttca

SEQ ID NO: 5147816 - DNA, 18 bp, Homo sapiens
acctcagagtatggagct

SEQ ID NO: 5147817 - DNA, 19 bp, Homo sapiens
acctcagagtccaggcccc

SEQ ID NO: 5147818 - DNA, 22 bp, Homo sapiens
acctcagatggcagcttttaaa

SEQ ID NO: 5147819 - DNA, 17 bp, Homo sapiens
acctcagattcttcatt

SEQ ID NO: 5147820 - DNA, 13 bp, Homo sapiens
acctcagcaagct

SEQ ID NO: 5147821 - DNA, 15 bp, Homo sapiens
acctcagcaagctgc

SEQ ID NO: 5147822 - DNA, 24 bp, Homo sapiens
acctcagcaagctgcccagccctg

SEQ ID NO: 5147823 - DNA, 12 bp, Homo sapiens
acctcagcattt

SEQ ID NO: 5147824 - DNA, 16 bp, Homo sapiens
acctcagccaaacaca

SEQ ID NO: 5147825 - DNA, 17 bp, Homo sapiens
acctcagccaaacacag

SEQ ID NO: 5147826 - DNA, 21 bp, Homo sapiens
acctcagccctgaaaataaca

SEQ ID NO: 5147827 - DNA, 17 bp, Homo sapiens
acctcagccctggccct

SEQ ID NO: 5147828 - DNA, 13 bp, Homo sapiens
acctcagcctccc

SEQ ID NO: 5147829 - DNA, 23 bp, Homo sapiens
acctcagcctcccaaagtgcagg

SEQ ID NO: 5147830 - DNA, 20 bp, Homo sapiens
acctcagcctgcacagtgtc

SEQ ID NO: 5147831 - DNA, 13 bp, Homo sapiens
acctcagcctgga

SEQ ID NO: 5147832 - DNA, 20 bp, Homo sapiens
acctcagcctggagaggcct

SEQ ID NO: 5147833 - DNA, 13 bp, Homo sapiens
acctcagcctggc

SEQ ID NO: 5147834 - DNA, 19 bp, Homo sapiens
acctcagcctggccagaca

SEQ ID NO: 5147835 - DNA, 20 bp, Homo sapiens
acctcagcctggccagacac

SEQ ID NO: 5147836 - DNA, 12 bp, Homo sapiens
acctcagcctgt

SEQ ID NO: 5147837 - DNA, 20 bp, Homo sapiens
acctcagccttccccttgcc

SEQ ID NO: 5147838 - DNA, 22 bp, Homo sapiens
acctcagctctgggagaggatt

SEQ ID NO: 5147839 - DNA, 17 bp, Homo sapiens
acctcagctgcacattc

SEQ ID NO: 5147840 - DNA, 15 bp, Homo sapiens
acctcagctgcttct

SEQ ID NO: 5147841 - DNA, 17 bp, Homo sapiens
acctcaggaaagaatag

SEQ ID NO: 5147842 - DNA, 23 bp, Homo sapiens
acctcaggaaagaatagaaagaa

SEQ ID NO: 5147843 - DNA, 14 bp, Homo sapiens
acctcaggacccca

SEQ ID NO: 5147844 - DNA, 16 bp, Homo sapiens
acctcaggagggcagg

SEQ ID NO: 5147845 - DNA, 19 bp, Homo sapiens
acctcaggagggcaggctg

SEQ ID NO: 5147846 - DNA, 19 bp, Homo sapiens
acctcaggcactagccttt

SEQ ID NO: 5147847 - DNA, 12 bp, Homo sapiens
acctcaggcagc

SEQ ID NO: 5147848 - DNA, 15 bp, Homo sapiens
acctcaggcaggaag

SEQ ID NO: 5147849 - DNA, 20 bp, Homo sapiens
acctcaggccaggtgcagtg

SEQ ID NO: 5147850 - DNA, 12 bp, Homo sapiens
acctcaggcctg

SEQ ID NO: 5147851 - DNA, 12 bp, Homo sapiens
acctcaggctcc

SEQ ID NO: 5147852 - DNA, 13 bp, Homo sapiens
acctcaggctcct

SEQ ID NO: 5147853 - DNA, 14 bp, Homo sapiens
acctcaggctccta

SEQ ID NO: 5147854 - DNA, 19 bp, Homo sapiens
acctcaggcttccttggca

SEQ ID NO: 5147855 - DNA, 17 bp, Homo sapiens
acctcagggctgtccca

SEQ ID NO: 5147856 - DNA, 20 bp, Homo sapiens
acctcagggctgtcccagcc

SEQ ID NO: 5147857 - DNA, 15 bp, Homo sapiens
acctcaggggcacct

SEQ ID NO: 5147858 - DNA, 16 bp, Homo sapiens
acctcaggggcacctc

SEQ ID NO: 5147859 - DNA, 17 bp, Homo sapiens
acctcaggggcacctcc

SEQ ID NO: 5147860 - DNA, 21 bp, Homo sapiens
acctcaggggcacctccggct

SEQ ID NO: 5147861 - DNA, 23 bp, Homo sapiens
acctcaggtaatcgacctgcctc

SEQ ID NO: 5147862 - DNA, 18 bp, Homo sapiens
acctcaggtgagaagcag

SEQ ID NO: 5147863 - DNA, 14 bp, Homo sapiens
acctcaggttgctg

SEQ ID NO: 5147864 - DNA, 17 bp, Homo sapiens
acctcagtaatttagaa

SEQ ID NO: 5147865 - DNA, 15 bp, Homo sapiens
acctcagtatttatg

SEQ ID NO: 5147866 - DNA, 18 bp, Homo sapiens
acctcagtcagtattgtt

SEQ ID NO: 5147867 - DNA, 22 bp, Homo sapiens
acctcagtcagtattgttttgg

SEQ ID NO: 5147868 - DNA, 19 bp, Homo sapiens
acctcagtggatcttcaga

SEQ ID NO: 5147869 - DNA, 14 bp, Homo sapiens
acctcagtgggaag

SEQ ID NO: 5147870 - DNA, 16 bp, Homo sapiens
acctcagttaaactgt

SEQ ID NO: 5147871 - DNA, 18 bp, Homo sapiens
acctcagttattacatgt

SEQ ID NO: 5147872 - DNA, 20 bp, Homo sapiens
acctcagttcccttggcctc

SEQ ID NO: 5147873 - DNA, 19 bp, Homo sapiens
acctcagttggcctctgcc

SEQ ID NO: 5147874 - DNA, 20 bp, Homo sapiens
acctcagttggcctctgccc

SEQ ID NO: 5147875 - DNA, 22 bp, Homo sapiens
acctcagttggcctctgcccct

SEQ ID NO: 5147876 - DNA, 17 bp, Homo sapiens
acctcagtttccctctg

SEQ ID NO: 5147877 - DNA, 22 bp, Homo sapiens
acctcagtttctgttgtttctt

SEQ ID NO: 5147878 - DNA, 14 bp, Homo sapiens
acctcatatgctat

SEQ ID NO: 5147879 - DNA, 14 bp, Homo sapiens
acctcatcaggatg

SEQ ID NO: 5147880 - DNA, 16 bp, Homo sapiens
acctcatcattaataa

SEQ ID NO: 5147881 - DNA, 18 bp, Homo sapiens
acctcatccatgcacttt

SEQ ID NO: 5147882 - DNA, 20 bp, Homo sapiens
acctcatctacaagcatttg

SEQ ID NO: 5147883 - DNA, 14 bp, Homo sapiens
acctcatctccaag

SEQ ID NO: 5147884 - DNA, 14 bp, Homo sapiens
acctcatctcccga

SEQ ID NO: 5147885 - DNA, 23 bp, Homo sapiens
acctcatctctgaaaattctgga

SEQ ID NO: 5147886 - DNA, 15 bp, Homo sapiens
acctcatctgcctgc

SEQ ID NO: 5147887 - DNA, 22 bp, Homo sapiens
acctcatctgcctgcagtgtca

SEQ ID NO: 5147888 - DNA, 18 bp, Homo sapiens
acctcatctgtggagctg

SEQ ID NO: 5147889 - DNA, 19 bp, Homo sapiens
acctcatctgtggagctgc

SEQ ID NO: 5147890 - DNA, 21 bp, Homo sapiens
acctcatctgtggagctgcca

SEQ ID NO: 5147891 - DNA, 17 bp, Homo sapiens
acctcatgacagccaga

SEQ ID NO: 5147892 - DNA, 22 bp, Homo sapiens
acctcatgacagccagagcctg

SEQ ID NO: 5147893 - DNA, 17 bp, Homo sapiens
acctcatgaggaccagg

SEQ ID NO: 5147894 - DNA, 16 bp, Homo sapiens
acctcatgcatctcca

SEQ ID NO: 5147895 - DNA, 21 bp, Homo sapiens
acctcatgcatctccacctgc

SEQ ID NO: 5147896 - DNA, 13 bp, Homo sapiens
acctcatgcccac

SEQ ID NO: 5147897 - DNA, 16 bp, Homo sapiens
acctcatgcccacccc

SEQ ID NO: 5147898 - DNA, 20 bp, Homo sapiens
acctcatgcccaccccctgc

SEQ ID NO: 5147899 - DNA, 22 bp, Homo sapiens
acctcatgcccaccccctgccc

SEQ ID NO: 5147900 - DNA, 20 bp, Homo sapiens
acctcatgccgctgtgtcta

SEQ ID NO: 5147901 - DNA, 23 bp, Homo sapiens
acctcatgccgctgtgtctatga

SEQ ID NO: 5147902 - DNA, 18 bp, Homo sapiens
acctcatgcctggccccc

SEQ ID NO: 5147903 - DNA, 18 bp, Homo sapiens
acctcatgctagcctcac

SEQ ID NO: 5147904 - DNA, 21 bp, Homo sapiens
acctcatggagtcatcttgca

SEQ ID NO: 5147905 - DNA, 23 bp, Homo sapiens
acctcatggattgccacagctca

SEQ ID NO: 5147906 - DNA, 23 bp, Homo sapiens
acctcatggtcatggacagatag

SEQ ID NO: 5147907 - DNA, 19 bp, Homo sapiens
acctcatgtttatgaaaat

SEQ ID NO: 5147908 - DNA, 22 bp, Homo sapiens
acctcattaaatggtgatttct

SEQ ID NO: 5147909 - DNA, 21 bp, Homo sapiens
acctcattaaccgatgcttta

SEQ ID NO: 5147910 - DNA, 20 bp, Homo sapiens
acctcattccggccacatca

SEQ ID NO: 5147911 - DNA, 13 bp, Homo sapiens
acctcattctgaa

SEQ ID NO: 5147912 - DNA, 23 bp, Homo sapiens
acctcattctggttccctgctgc

SEQ ID NO: 5147913 - DNA, 17 bp, Homo sapiens
acctcattgacaagaac

SEQ ID NO: 5147914 - DNA, 18 bp, Homo sapiens
acctcattggccagctca

SEQ ID NO: 5147915 - DNA, 13 bp, Homo sapiens
acctcatttgcat

SEQ ID NO: 5147916 - DNA, 15 bp, Homo sapiens
acctcatttttcata

SEQ ID NO: 5147917 - DNA, 19 bp, Homo sapiens
acctccaaaactcctgccc

SEQ ID NO: 5147918 - DNA, 19 bp, Homo sapiens
acctccaaagcttcccacg

SEQ ID NO: 5147919 - DNA, 21 bp, Homo sapiens
acctccaaagcttcccacggc

SEQ ID NO: 5147920 - DNA, 23 bp, Homo sapiens
acctccaacagaactaaatgttc

SEQ ID NO: 5147921 - DNA, 23 bp, Homo sapiens
acctccaaccctgccgtcaccac

SEQ ID NO: 5147922 - DNA, 21 bp, Homo sapiens
acctccaagcaagtagctttc

SEQ ID NO: 5147923 - DNA, 19 bp, Homo sapiens
acctccaataaagtgcctt

SEQ ID NO: 5147924 - DNA, 13 bp, Homo sapiens
acctccacagctt

SEQ ID NO: 5147925 - DNA, 15 bp, Homo sapiens
acctccacagcttcc

SEQ ID NO: 5147926 - DNA, 18 bp, Homo sapiens
acctccacagtagcattt

SEQ ID NO: 5147927 - DNA, 18 bp, Homo sapiens
acctccacagttcagtgg

SEQ ID NO: 5147928 - DNA, 22 bp, Homo sapiens
acctccaccacatctgccagac

SEQ ID NO: 5147929 - DNA, 10 bp, Homo sapiens
acctccaccc

SEQ ID NO: 5147930 - DNA, 13 bp, Homo sapiens
acctccacccagc

SEQ ID NO: 5147931 - DNA, 17 bp, Homo sapiens
acctccacccccaagaa

SEQ ID NO: 5147932 - DNA, 20 bp, Homo sapiens
acctccacccccaagaaacc

SEQ ID NO: 5147933 - DNA, 17 bp, Homo sapiens
acctccacccccgccac

SEQ ID NO: 5147934 - DNA, 16 bp, Homo sapiens
acctccacctccgggt

SEQ ID NO: 5147935 - DNA, 18 bp, Homo sapiens
acctccacctcctgagtt

SEQ ID NO: 5147936 - DNA, 17 bp, Homo sapiens
acctccacctcctgggt

SEQ ID NO: 5147937 - DNA, 13 bp, Homo sapiens
acctccacctgtg

SEQ ID NO: 5147938 - DNA, 15 bp, Homo sapiens
acctccacctgtgag

SEQ ID NO: 5147939 - DNA, 19 bp, Homo sapiens
acctccacgccactgcctc

SEQ ID NO: 5147940 - DNA, 16 bp, Homo sapiens
acctccactcagcact

SEQ ID NO: 5147941 - DNA, 19 bp, Homo sapiens
acctccactctctgcccct

SEQ ID NO: 5147942 - DNA, 16 bp, Homo sapiens
acctccagaagtccct

SEQ ID NO: 5147943 - DNA, 14 bp, Homo sapiens
acctccagactcag

SEQ ID NO: 5147944 - DNA, 14 bp, Homo sapiens
acctccagattatt

SEQ ID NO: 5147945 - DNA, 20 bp, Homo sapiens
acctccagattattttctat

SEQ ID NO: 5147946 - DNA, 23 bp, Homo sapiens
acctccagcacgcgacttctcag

SEQ ID NO: 5147947 - DNA, 14 bp, Homo sapiens
acctccagcctccc

SEQ ID NO: 5147948 - DNA, 13 bp, Homo sapiens
acctccagcctga

SEQ ID NO: 5147949 - DNA, 17 bp, Homo sapiens
acctccagctttcctgt

SEQ ID NO: 5147950 - DNA, 22 bp, Homo sapiens
acctccaggcaggccaggctgc

SEQ ID NO: 5147951 - DNA, 17 bp, Homo sapiens
acctccaggccgtttct

SEQ ID NO: 5147952 - DNA, 20 bp, Homo sapiens
acctccaggctccagcacat

SEQ ID NO: 5147953 - DNA, 14 bp, Homo sapiens
acctccaggctttc

SEQ ID NO: 5147954 - DNA, 16 bp, Homo sapiens
acctccaggggctcct

SEQ ID NO: 5147955 - DNA, 18 bp, Homo sapiens
acctccagtccccctatc

SEQ ID NO: 5147956 - DNA, 12 bp, Homo sapiens
acctccagtcct

SEQ ID NO: 5147957 - DNA, 17 bp, Homo sapiens
acctccagtcctgctgg

SEQ ID NO: 5147958 - DNA, 18 bp, Homo sapiens
acctccagtcctgctggc

SEQ ID NO: 5147959 - DNA, 21 bp, Homo sapiens
acctccagtcctgctggcctg

SEQ ID NO: 5147960 - DNA, 22 bp, Homo sapiens
acctccagtcctgctggcctgc

SEQ ID NO: 5147961 - DNA, 23 bp, Homo sapiens
acctccatactcaagctgtctct

SEQ ID NO: 5147962 - DNA, 19 bp, Homo sapiens
acctccatccccctctgtc

SEQ ID NO: 5147963 - DNA, 13 bp, Homo sapiens
acctccatccctg

SEQ ID NO: 5147964 - DNA, 15 bp, Homo sapiens
acctccatccctgct

SEQ ID NO: 5147965 - DNA, 10 bp, Homo sapiens
acctccatct

SEQ ID NO: 5147966 - DNA, 15 bp, Homo sapiens
acctccatgtcatcc

SEQ ID NO: 5147967 - DNA, 18 bp, Homo sapiens
acctccattaaagtctga

SEQ ID NO: 5147968 - DNA, 15 bp, Homo sapiens
acctcccaccaacat

SEQ ID NO: 5147969 - DNA, 16 bp, Homo sapiens
acctcccaccccactc

SEQ ID NO: 5147970 - DNA, 17 bp, Homo sapiens
acctcccaccccactcc

SEQ ID NO: 5147971 - DNA, 18 bp, Homo sapiens
acctcccaccccactcca

SEQ ID NO: 5147972 - DNA, 21 bp, Homo sapiens
acctcccaccccactccagcc

SEQ ID NO: 5147973 - DNA, 23 bp, Homo sapiens
acctcccaccccactccagccct

SEQ ID NO: 5147974 - DNA, 17 bp, Homo sapiens
acctcccaccctgaccc

SEQ ID NO: 5147975 - DNA, 15 bp, Homo sapiens
acctcccacctttgg

SEQ ID NO: 5147976 - DNA, 17 bp, Homo sapiens
acctcccactcctgctg

SEQ ID NO: 5147977 - DNA, 21 bp, Homo sapiens
acctcccactttgtctgtaca

SEQ ID NO: 5147978 - DNA, 23 bp, Homo sapiens
acctcccagaggtccagcccatc

SEQ ID NO: 5147979 - DNA, 21 bp, Homo sapiens
acctcccagcccctgcccctc

SEQ ID NO: 5147980 - DNA, 14 bp, Homo sapiens
acctcccagcccta

SEQ ID NO: 5147981 - DNA, 13 bp, Homo sapiens
acctcccaggaca

SEQ ID NO: 5147982 - DNA, 12 bp, Homo sapiens
acctcccagggc

SEQ ID NO: 5147983 - DNA, 14 bp, Homo sapiens
acctcccagggcta

SEQ ID NO: 5147984 - DNA, 16 bp, Homo sapiens
acctcccaggggactg

SEQ ID NO: 5147985 - DNA, 19 bp, Homo sapiens
acctcccatttctgttgct

SEQ ID NO: 5147986 - DNA, 12 bp, Homo sapiens
acctccccaaag

SEQ ID NO: 5147987 - DNA, 14 bp, Homo sapiens
acctccccacatcg

SEQ ID NO: 5147988 - DNA, 20 bp, Homo sapiens
acctccccacatcgcacact

SEQ ID NO: 5147989 - DNA, 22 bp, Homo sapiens
acctccccacccccgctggggg

SEQ ID NO: 5147990 - DNA, 14 bp, Homo sapiens
acctccccacgccc

SEQ ID NO: 5147991 - DNA, 18 bp, Homo sapiens
acctccccagacagggct

SEQ ID NO: 5147992 - DNA, 21 bp, Homo sapiens
acctccccagacagggctcca

SEQ ID NO: 5147993 - DNA, 22 bp, Homo sapiens
acctccccagacagggctccag

SEQ ID NO: 5147994 - DNA, 15 bp, Homo sapiens
acctccccagagccc

SEQ ID NO: 5147995 - DNA, 19 bp, Homo sapiens
acctccccagagccctgca

SEQ ID NO: 5147996 - DNA, 15 bp, Homo sapiens
acctccccagcattc

SEQ ID NO: 5147997 - DNA, 23 bp, Homo sapiens
acctccccagcattccagcccct

SEQ ID NO: 5147998 - DNA, 13 bp, Homo sapiens
acctccccagccc

SEQ ID NO: 5147999 - DNA, 14 bp, Homo sapiens
acctccccagccca

SEQ ID NO: 5148000 - DNA, 15 bp, Homo sapiens
acctccccagcccct

SEQ ID NO: 5148001 - DNA, 19 bp, Homo sapiens
acctccccagcccctagcc

SEQ ID NO: 5148002 - DNA, 15 bp, Homo sapiens
acctccccagcctgc

SEQ ID NO: 5148003 - DNA, 19 bp, Homo sapiens
acctccccaggccgtggct

SEQ ID NO: 5148004 - DNA, 13 bp, Homo sapiens
acctccccccact

SEQ ID NO: 5148005 - DNA, 13 bp, Homo sapiens
acctccccctcac

SEQ ID NO: 5148006 - DNA, 19 bp, Homo sapiens
acctccccctcccccttct

SEQ ID NO: 5148007 - DNA, 14 bp, Homo sapiens
acctccccctcctt

SEQ ID NO: 5148008 - DNA, 21 bp, Homo sapiens
acctccccctccttcccagct

SEQ ID NO: 5148009 - DNA, 20 bp, Homo sapiens
acctccccctgcgccccgca

SEQ ID NO: 5148010 - DNA, 11 bp, Homo sapiens
acctccccctt

SEQ ID NO: 5148011 - DNA, 20 bp, Homo sapiens
acctccccgctctccctgtc

SEQ ID NO: 5148012 - DNA, 20 bp, Homo sapiens
acctccccggcctctctctt

SEQ ID NO: 5148013 - DNA, 14 bp, Homo sapiens
acctcccctatcca

SEQ ID NO: 5148014 - DNA, 17 bp, Homo sapiens
acctcccctatccaccc

SEQ ID NO: 5148015 - DNA, 15 bp, Homo sapiens
accctcccactccca

SEQ ID NO: 5148016 - DNA, 21 bp, Homo sapiens
accctcccactcccatctcct

SEQ ID NO: 5148017 - DNA, 16 bp, Homo sapiens
accctcccagacctgc

SEQ ID NO: 5148018 - DNA, 12 bp, Homo sapiens
accctcccaggt

SEQ ID NO: 5148019 - DNA, 15 bp, Homo sapiens
accctcccagtctca

SEQ ID NO: 5148020 - DNA, 22 bp, Homo sapiens
accctcccagtctcatctcctg

SEQ ID NO: 5148021 - DNA, 14 bp, Homo sapiens
accctcccagtgag

SEQ ID NO: 5148022 - DNA, 11 bp, Homo sapiens
accctcccatg

SEQ ID NO: 5148023 - DNA, 17 bp, Homo sapiens
accctcccatgagactg

SEQ ID NO: 5148024 - DNA, 20 bp, Homo sapiens
accctcccatgagactgccc

SEQ ID NO: 5148025 - DNA, 17 bp, Homo sapiens
accctcccatggcacct

SEQ ID NO: 5148026 - DNA, 22 bp, Homo sapiens
accctccccaaaggctttgccc

SEQ ID NO: 5148027 - DNA, 11 bp, Homo sapiens
accctccccac

SEQ ID NO: 5148028 - DNA, 14 bp, Homo sapiens
accctccccattca

SEQ ID NO: 5148029 - DNA, 10 bp, Homo sapiens
accctccccc

SEQ ID NO: 5148030 - DNA, 18 bp, Homo sapiens
accctcccccaccattcc

SEQ ID NO: 5148031 - DNA, 21 bp, Homo sapiens
accctcccccaccattccaca

SEQ ID NO: 5148032 - DNA, 13 bp, Homo sapiens
accctcccccgca

SEQ ID NO: 5148033 - DNA, 15 bp, Homo sapiens
accctcccccgcagc

SEQ ID NO: 5148034 - DNA, 12 bp, Homo sapiens
accctcccctcc

SEQ ID NO: 5148035 - DNA, 15 bp, Homo sapiens
accctcccctctcct

SEQ ID NO: 5148036 - DNA, 15 bp, Homo sapiens
accctcccctgcctc

SEQ ID NO: 5148037 - DNA, 20 bp, Homo sapiens
accctcccctgtcttctctc

SEQ ID NO: 5148038 - DNA, 20 bp, Homo sapiens
accctccccttcccagggca

SEQ ID NO: 5148039 - DNA, 19 bp, Homo sapiens
accctccccttttatgcac

SEQ ID NO: 5148040 - DNA, 19 bp, Homo sapiens
accctccccttttttcttc

SEQ ID NO: 5148041 - DNA, 15 bp, Homo sapiens
accctcccggcctgg

SEQ ID NO: 5148042 - DNA, 12 bp, Homo sapiens
accctccctcag

SEQ ID NO: 5148043 - DNA, 17 bp, Homo sapiens
accctccctcagcccct

SEQ ID NO: 5148044 - DNA, 21 bp, Homo sapiens
accctccctccactcctctca

SEQ ID NO: 5148045 - DNA, 13 bp, Homo sapiens
accctccctgctg

SEQ ID NO: 5148046 - DNA, 20 bp, Homo sapiens
accctccctgctgtcccctc

SEQ ID NO: 5148047 - DNA, 17 bp, Homo sapiens
accctccctgtcccctg

SEQ ID NO: 5148048 - DNA, 19 bp, Homo sapiens
accctccctgtcccctgag

SEQ ID NO: 5148049 - DNA, 15 bp, Homo sapiens
accctccctgttcat

SEQ ID NO: 5148050 - DNA, 14 bp, Homo sapiens
accctccggcgggt

SEQ ID NO: 5148051 - DNA, 17 bp, Homo sapiens
accctccgttcctcctc

SEQ ID NO: 5148052 - DNA, 20 bp, Homo sapiens
accctcctagcctgctctgc

SEQ ID NO: 5148053 - DNA, 22 bp, Homo sapiens
accctcctagcctgctctgcca

SEQ ID NO: 5148054 - DNA, 14 bp, Homo sapiens
accctcctcacaga

SEQ ID NO: 5148055 - DNA, 22 bp, Homo sapiens
accctcctcccgactgaccact

SEQ ID NO: 5148056 - DNA, 17 bp, Homo sapiens
accctcctccctccaag

SEQ ID NO: 5148057 - DNA, 20 bp, Homo sapiens
accctcctcctcttcaccag

SEQ ID NO: 5148058 - DNA, 13 bp, Homo sapiens
accctcctccttt

SEQ ID NO: 5148059 - DNA, 14 bp, Homo sapiens
accctcctcctttt

SEQ ID NO: 5148060 - DNA, 21 bp, Homo sapiens
accctcctgacccccatgtaa

SEQ ID NO: 5148061 - DNA, 16 bp, Homo sapiens
accctcctgagcctca

SEQ ID NO: 5148062 - DNA, 14 bp, Homo sapiens
accctcctgcccca

SEQ ID NO: 5148063 - DNA, 21 bp, Homo sapiens
accctcctgccccacactccc

SEQ ID NO: 5148064 - DNA, 14 bp, Homo sapiens
accctcctgccccc

SEQ ID NO: 5148065 - DNA, 16 bp, Homo sapiens
accctcctgctgagct

SEQ ID NO: 5148066 - DNA, 15 bp, Homo sapiens
accctcctggcctca

SEQ ID NO: 5148067 - DNA, 19 bp, Homo sapiens
accctcctggcctcagact

SEQ ID NO: 5148068 - DNA, 15 bp, Homo sapiens
accctcctgggaagg

SEQ ID NO: 5148069 - DNA, 23 bp, Homo sapiens
accctcctgtcttcccagggtag

SEQ ID NO: 5148070 - DNA, 11 bp, Homo sapiens
accctcctgtt

SEQ ID NO: 5148071 - DNA, 19 bp, Homo sapiens
accctcctgttgcacccag

SEQ ID NO: 5148072 - DNA, 23 bp, Homo sapiens
accctcctgttgcacccagccct

SEQ ID NO: 5148073 - DNA, 24 bp, Homo sapiens
accctcctgttgcacccagccctg

SEQ ID NO: 5148074 - DNA, 19 bp, Homo sapiens
accctccttccccacccca

SEQ ID NO: 5148075 - DNA, 17 bp, Homo sapiens
accctccttgagactgg

SEQ ID NO: 5148076 - DNA, 21 bp, Homo sapiens
accctcctttcaccacatgtg

SEQ ID NO: 5148077 - DNA, 14 bp, Homo sapiens
accctccttttctc

SEQ ID NO: 5148078 - DNA, 16 bp, Homo sapiens
accctcgaagcgcgcc

SEQ ID NO: 5148079 - DNA, 18 bp, Homo sapiens
accctcgaggcggatctt

SEQ ID NO: 5148080 - DNA, 17 bp, Homo sapiens
accctcgccctgtccct

SEQ ID NO: 5148081 - DNA, 18 bp, Homo sapiens
accctcgccctgtccctc

SEQ ID NO: 5148082 - DNA, 21 bp, Homo sapiens
accctcgccctgtccctccca

SEQ ID NO: 5148083 - DNA, 23 bp, Homo sapiens
accctcgctctctgtctccaggc

SEQ ID NO: 5148084 - DNA, 20 bp, Homo sapiens
accctcgctgccacccaccc

SEQ ID NO: 5148085 - DNA, 16 bp, Homo sapiens
accctcgctggccccc

SEQ ID NO: 5148086 - DNA, 20 bp, Homo sapiens
accctcggaaatcagtgcga

SEQ ID NO: 5148087 - DNA, 13 bp, Homo sapiens
accctcgggccca

SEQ ID NO: 5148088 - DNA, 14 bp, Homo sapiens
accctcgggcccac

SEQ ID NO: 5148089 - DNA, 16 bp, Homo sapiens
accctcgggcccacct

SEQ ID NO: 5148090 - DNA, 19 bp, Homo sapiens
accctcgggccccatcctc

SEQ ID NO: 5148091 - DNA, 19 bp, Homo sapiens
accctcggggatgtgtcct

SEQ ID NO: 5148092 - DNA, 22 bp, Homo sapiens
accctcggggggtcacaggccc

SEQ ID NO: 5148093 - DNA, 23 bp, Homo sapiens
accctcggggggtcacaggccca

SEQ ID NO: 5148094 - DNA, 15 bp, Homo sapiens
accctcgtggacacc

SEQ ID NO: 5148095 - DNA, 17 bp, Homo sapiens
accctcgtggacacctg

SEQ ID NO: 5148096 - DNA, 18 bp, Homo sapiens
accctcgtggacacctgc

SEQ ID NO: 5148097 - DNA, 19 bp, Homo sapiens
accctcgtggacacctgcc

SEQ ID NO: 5148098 - DNA, 20 bp, Homo sapiens
accctcgtggacacctgccc

SEQ ID NO: 5148099 - DNA, 13 bp, Homo sapiens
accctctcacttt

SEQ ID NO: 5148100 - DNA, 22 bp, Homo sapiens
accctctccacacccagcctgt

SEQ ID NO: 5148101 - DNA, 13 bp, Homo sapiens
accctctccaggc

SEQ ID NO: 5148102 - DNA, 15 bp, Homo sapiens
accctctccatctcc

SEQ ID NO: 5148103 - DNA, 17 bp, Homo sapiens
accctctccatctccca

SEQ ID NO: 5148104 - DNA, 19 bp, Homo sapiens
accctctccgcacacctct

SEQ ID NO: 5148105 - DNA, 21 bp, Homo sapiens
accctctccgcacacctctgg

SEQ ID NO: 5148106 - DNA, 16 bp, Homo sapiens
accctctcctggactc

SEQ ID NO: 5148107 - DNA, 15 bp, Homo sapiens
accctctcctggggg

SEQ ID NO: 5148108 - DNA, 22 bp, Homo sapiens
accctctcctgggggtggcagg

SEQ ID NO: 5148109 - DNA, 23 bp, Homo sapiens
accctctcctgggggtggcaggc

SEQ ID NO: 5148110 - DNA, 22 bp, Homo sapiens
accctctcctgtctgccctctg

SEQ ID NO: 5148111 - DNA, 19 bp, Homo sapiens
accctctctgtccaatctg

SEQ ID NO: 5148112 - DNA, 13 bp, Homo sapiens
accctctgaagaa

SEQ ID NO: 5148113 - DNA, 21 bp, Homo sapiens
accctctgaatggtccagggt

SEQ ID NO: 5148114 - DNA, 22 bp, Homo sapiens
accctctgaatggtccagggtt

SEQ ID NO: 5148115 - DNA, 18 bp, Homo sapiens
accctctgagacagagag

SEQ ID NO: 5148116 - DNA, 16 bp, Homo sapiens
accctctgcagggcag

SEQ ID NO: 5148117 - DNA, 17 bp, Homo sapiens
accctctgcagggcagc

SEQ ID NO: 5148118 - DNA, 15 bp, Homo sapiens
accctctgctgaaga

SEQ ID NO: 5148119 - DNA, 16 bp, Homo sapiens
accctctgctgaagac

SEQ ID NO: 5148120 - DNA, 15 bp, Homo sapiens
accctctgctgcaca

SEQ ID NO: 5148121 - DNA, 20 bp, Homo sapiens
accctctgctgcacagtagt

SEQ ID NO: 5148122 - DNA, 20 bp, Homo sapiens
accctctgggaacctcccag

SEQ ID NO: 5148123 - DNA, 16 bp, Homo sapiens
accctctgggcagctg

SEQ ID NO: 5148124 - DNA, 21 bp, Homo sapiens
accctctgggcagctgtcatg

SEQ ID NO: 5148125 - DNA, 13 bp, Homo sapiens
accctctggggac

SEQ ID NO: 5148126 - DNA, 13 bp, Homo sapiens
accctctgggggt

SEQ ID NO: 5148127 - DNA, 15 bp, Homo sapiens
accctctgggggtcc

SEQ ID NO: 5148128 - DNA, 17 bp, Homo sapiens
accctctggtccttctg

SEQ ID NO: 5148129 - DNA, 23 bp, Homo sapiens
accctctggttgtgggcttggac

SEQ ID NO: 5148130 - DNA, 22 bp, Homo sapiens
accctctgtaccccatgacctt

SEQ ID NO: 5148131 - DNA, 14 bp, Homo sapiens
accctctgtcccac

SEQ ID NO: 5148132 - DNA, 17 bp, Homo sapiens
accctctgtcccacccc

SEQ ID NO: 5148133 - DNA, 24 bp, Homo sapiens
accctctgtccccaggcctggctc

SEQ ID NO: 5148134 - DNA, 15 bp, Homo sapiens
accctctgtccttcc

SEQ ID NO: 5148135 - DNA, 14 bp, Homo sapiens
accctctgttcctt

SEQ ID NO: 5148136 - DNA, 13 bp, Homo sapiens
accctcttcatgg

SEQ ID NO: 5148137 - DNA, 16 bp, Homo sapiens
accctcttcctactgg

SEQ ID NO: 5148138 - DNA, 19 bp, Homo sapiens
accctcttctctgggccca

SEQ ID NO: 5148139 - DNA, 20 bp, Homo sapiens
accctcttctctgggcccag

SEQ ID NO: 5148140 - DNA, 14 bp, Homo sapiens
accctcttcttccc

SEQ ID NO: 5148141 - DNA, 22 bp, Homo sapiens
accctcttgcccatcctgactg

SEQ ID NO: 5148142 - DNA, 16 bp, Homo sapiens
accctctttcttgttt

SEQ ID NO: 5148143 - DNA, 21 bp, Homo sapiens
accctctttcttgtttgtcag

SEQ ID NO: 5148144 - DNA, 23 bp, Homo sapiens
accctctttcttgtttgtcagca

SEQ ID NO: 5148145 - DNA, 20 bp, Homo sapiens
accctctttgctgcagagaa

SEQ ID NO: 5148146 - DNA, 20 bp, Homo sapiens
accctcttttaccaacttcc

SEQ ID NO: 5148147 - DNA, 20 bp, Homo sapiens
accctgaaaggaacactggc

SEQ ID NO: 5148148 - DNA, 15 bp, Homo sapiens
accctgaaatgtgtg

SEQ ID NO: 5148149 - DNA, 18 bp, Homo sapiens
accctgaacccacacctg

SEQ ID NO: 5148150 - DNA, 19 bp, Homo sapiens
accctgaacccacacctgg

SEQ ID NO: 5148151 - DNA, 18 bp, Homo sapiens
accctgaactcagaaggc

SEQ ID NO: 5148152 - DNA, 17 bp, Homo sapiens
accctgaagatttcaga

SEQ ID NO: 5148153 - DNA, 21 bp, Homo sapiens
accctgaagatttcagaggct

SEQ ID NO: 5148154 - DNA, 21 bp, Homo sapiens
accctgaagcagaggccttta

SEQ ID NO: 5148155 - DNA, 14 bp, Homo sapiens
accctgaatcagag

SEQ ID NO: 5148156 - DNA, 15 bp, Homo sapiens
accctgaatcagagg

SEQ ID NO: 5148157 - DNA, 20 bp, Homo sapiens
accctgaatcagaggcagag

SEQ ID NO: 5148158 - DNA, 21 bp, Homo sapiens
accctgaatggttccatgcct

SEQ ID NO: 5148159 - DNA, 17 bp, Homo sapiens
accctgaatgtgtgccc

SEQ ID NO: 5148160 - DNA, 21 bp, Homo sapiens
accctgaatttggcctgcact

SEQ ID NO: 5148161 - DNA, 17 bp, Homo sapiens
accctgaccagctcccc

SEQ ID NO: 5148162 - DNA, 21 bp, Homo sapiens
accctgacctccgcccctgcc

SEQ ID NO: 5148163 - DNA, 20 bp, Homo sapiens
accctgacctggccccctca

SEQ ID NO: 5148164 - DNA, 15 bp, Homo sapiens
accctgagactccag

SEQ ID NO: 5148165 - DNA, 20 bp, Homo sapiens
accctgagatacttcccaaa

SEQ ID NO: 5148166 - DNA, 22 bp, Homo sapiens
accctgagatctgcacagtcag

SEQ ID NO: 5148167 - DNA, 22 bp, Homo sapiens
accctgagcagatcgtgccgtg

SEQ ID NO: 5148168 - DNA, 16 bp, Homo sapiens
accctgagcagggtcc

SEQ ID NO: 5148169 - DNA, 17 bp, Homo sapiens
accctgagcagggtcca

SEQ ID NO: 5148170 - DNA, 13 bp, Homo sapiens
accctgagcccac

SEQ ID NO: 5148171 - DNA, 12 bp, Homo sapiens
accctgagccgg

SEQ ID NO: 5148172 - DNA, 12 bp, Homo sapiens
accctgagcctg

SEQ ID NO: 5148173 - DNA, 22 bp, Homo sapiens
accctgagctgaggcagcagtg

SEQ ID NO: 5148174 - DNA, 16 bp, Homo sapiens
accctgaggaggccgc

SEQ ID NO: 5148175 - DNA, 14 bp, Homo sapiens
accctgaggagtct

SEQ ID NO: 5148176 - DNA, 17 bp, Homo sapiens
accctgaggagtctgag

SEQ ID NO: 5148177 - DNA, 22 bp, Homo sapiens
accctgaggagtctgaggtcct

SEQ ID NO: 5148178 - DNA, 11 bp, Homo sapiens
accctgaggcc

SEQ ID NO: 5148179 - DNA, 14 bp, Homo sapiens
accctgaggcccag

SEQ ID NO: 5148180 - DNA, 18 bp, Homo sapiens
accctgaggccctgggct

SEQ ID NO: 5148181 - DNA, 18 bp, Homo sapiens
accctgaggcctctggaa

SEQ ID NO: 5148182 - DNA, 11 bp, Homo sapiens
accctgagggc

SEQ ID NO: 5148183 - DNA, 22 bp, Homo sapiens
accctgaggtcagggagtgctg

SEQ ID NO: 5148184 - DNA, 16 bp, Homo sapiens
accctgagttcatcca

SEQ ID NO: 5148185 - DNA, 16 bp, Homo sapiens
accctgagttgctttt

SEQ ID NO: 5148186 - DNA, 14 bp, Homo sapiens
accctgatctggac

SEQ ID NO: 5148187 - DNA, 15 bp, Homo sapiens
accctgatctggacc

SEQ ID NO: 5148188 - DNA, 22 bp, Homo sapiens
accctgattatatccagtaaca

SEQ ID NO: 5148189 - DNA, 20 bp, Homo sapiens
accctgatttaggagaagcc

SEQ ID NO: 5148190 - DNA, 17 bp, Homo sapiens
accctgatttcttgctt

SEQ ID NO: 5148191 - DNA, 15 bp, Homo sapiens
accctgcaaggccca

SEQ ID NO: 5148192 - DNA, 16 bp, Homo sapiens
accctgcaaggcccac

SEQ ID NO: 5148193 - DNA, 20 bp, Homo sapiens
acctcccctccttgcctcct

SEQ ID NO: 5148194 - DNA, 14 bp, Homo sapiens
acctcccctcttcc

SEQ ID NO: 5148195 - DNA, 13 bp, Homo sapiens
acctcccctgcca

SEQ ID NO: 5148196 - DNA, 15 bp, Homo sapiens
acctccccttgccag

SEQ ID NO: 5148197 - DNA, 19 bp, Homo sapiens
acctccccttgccagctgc

SEQ ID NO: 5148198 - DNA, 13 bp, Homo sapiens
acctccccttggg

SEQ ID NO: 5148199 - DNA, 19 bp, Homo sapiens
acctccctcaacctcatcc

SEQ ID NO: 5148200 - DNA, 19 bp, Homo sapiens
acctccctccccagctccg

SEQ ID NO: 5148201 - DNA, 15 bp, Homo sapiens
acctccctcctttcc

SEQ ID NO: 5148202 - DNA, 18 bp, Homo sapiens
acctccctcctttccttt

SEQ ID NO: 5148203 - DNA, 14 bp, Homo sapiens
acctccctcttgtt

SEQ ID NO: 5148204 - DNA, 23 bp, Homo sapiens
acctccctcttgttttgtttgtc

SEQ ID NO: 5148205 - DNA, 13 bp, Homo sapiens
acctccctgcagc

SEQ ID NO: 5148206 - DNA, 13 bp, Homo sapiens
acctccctgcctc

SEQ ID NO: 5148207 - DNA, 13 bp, Homo sapiens
acctccctgcgcc

SEQ ID NO: 5148208 - DNA, 14 bp, Homo sapiens
acctccctggcttg

SEQ ID NO: 5148209 - DNA, 17 bp, Homo sapiens
acctccctgggcctgtc

SEQ ID NO: 5148210 - DNA, 22 bp, Homo sapiens
acctccctgggcctgtctcaga

SEQ ID NO: 5148211 - DNA, 22 bp, Homo sapiens
acctccctgttcaaggcccctg

SEQ ID NO: 5148212 - DNA, 12 bp, Homo sapiens
acctcccttccc

SEQ ID NO: 5148213 - DNA, 13 bp, Homo sapiens
acctcccttccca

SEQ ID NO: 5148214 - DNA, 21 bp, Homo sapiens
acctcccttcccacctactgc

SEQ ID NO: 5148215 - DNA, 18 bp, Homo sapiens
acctcccttccctccctg

SEQ ID NO: 5148216 - DNA, 13 bp, Homo sapiens
acctcccttccga

SEQ ID NO: 5148217 - DNA, 22 bp, Homo sapiens
acctccgaactgttcaagtgtc

SEQ ID NO: 5148218 - DNA, 14 bp, Homo sapiens
acctccgagacagt

SEQ ID NO: 5148219 - DNA, 18 bp, Homo sapiens
acctccgagacagtccag

SEQ ID NO: 5148220 - DNA, 19 bp, Homo sapiens
acctccgagacagtccagt

SEQ ID NO: 5148221 - DNA, 14 bp, Homo sapiens
acctccgcatcccg

SEQ ID NO: 5148222 - DNA, 17 bp, Homo sapiens
acctccgccccagacac

SEQ ID NO: 5148223 - DNA, 18 bp, Homo sapiens
acctccgccccagacaca

SEQ ID NO: 5148224 - DNA, 20 bp, Homo sapiens
acctccgcctcttgggttca

SEQ ID NO: 5148225 - DNA, 14 bp, Homo sapiens
acctccgcgggctg

SEQ ID NO: 5148226 - DNA, 16 bp, Homo sapiens
acctccggagcgccct

SEQ ID NO: 5148227 - DNA, 21 bp, Homo sapiens
acctccggagcgccctgcagg

SEQ ID NO: 5148228 - DNA, 19 bp, Homo sapiens
acctccggcctccacatga

SEQ ID NO: 5148229 - DNA, 13 bp, Homo sapiens
acctccggctgcc

SEQ ID NO: 5148230 - DNA, 19 bp, Homo sapiens
acctccggctgcctagccc

SEQ ID NO: 5148231 - DNA, 16 bp, Homo sapiens
acctccgtgctgggct

SEQ ID NO: 5148232 - DNA, 21 bp, Homo sapiens
acctcctaaaaggcccagaga

SEQ ID NO: 5148233 - DNA, 17 bp, Homo sapiens
acctcctaaatgcccca

SEQ ID NO: 5148234 - DNA, 19 bp, Homo sapiens
acctcctaatggcatggag

SEQ ID NO: 5148235 - DNA, 15 bp, Homo sapiens
acctcctaccccttc

SEQ ID NO: 5148236 - DNA, 17 bp, Homo sapiens
acctcctaccctcccac

SEQ ID NO: 5148237 - DNA, 19 bp, Homo sapiens
acctcctagaggtgggcag

SEQ ID NO: 5148238 - DNA, 23 bp, Homo sapiens
acctcctagaggtgggcagctgg

SEQ ID NO: 5148239 - DNA, 13 bp, Homo sapiens
acctcctcagcct

SEQ ID NO: 5148240 - DNA, 23 bp, Homo sapiens
acctcctcagggatggccgttgg

SEQ ID NO: 5148241 - DNA, 21 bp, Homo sapiens
acctcctccaagaagccctcc

SEQ ID NO: 5148242 - DNA, 22 bp, Homo sapiens
acctcctccaagaagccctcct

SEQ ID NO: 5148243 - DNA, 19 bp, Homo sapiens
acctcctccactcactcca

SEQ ID NO: 5148244 - DNA, 23 bp, Homo sapiens
acctcctcccccctcctctgaaa

SEQ ID NO: 5148245 - DNA, 13 bp, Homo sapiens
acctcctccccct

SEQ ID NO: 5148246 - DNA, 18 bp, Homo sapiens
acctcctccccctgttct

SEQ ID NO: 5148247 - DNA, 21 bp, Homo sapiens
acctcctccctaatgctcacc

SEQ ID NO: 5148248 - DNA, 22 bp, Homo sapiens
acctcctccctcattcatcttg

SEQ ID NO: 5148249 - DNA, 13 bp, Homo sapiens
acctcctcctgct

SEQ ID NO: 5148250 - DNA, 18 bp, Homo sapiens
acctcctcctgctgctca

SEQ ID NO: 5148251 - DNA, 21 bp, Homo sapiens
acctcctcctgctgctcactc

SEQ ID NO: 5148252 - DNA, 23 bp, Homo sapiens
acctcctcctttgtttaataaag

SEQ ID NO: 5148253 - DNA, 14 bp, Homo sapiens
acctcctctcctga

SEQ ID NO: 5148254 - DNA, 14 bp, Homo sapiens
acctcctctctgct

SEQ ID NO: 5148255 - DNA, 19 bp, Homo sapiens
acctcctctgccagcagga

SEQ ID NO: 5148256 - DNA, 23 bp, Homo sapiens
acctcctctgccagcaggaataa

SEQ ID NO: 5148257 - DNA, 12 bp, Homo sapiens
acctcctctggg

SEQ ID NO: 5148258 - DNA, 15 bp, Homo sapiens
acctcctctgggccc

SEQ ID NO: 5148259 - DNA, 12 bp, Homo sapiens
acctcctctgtg

SEQ ID NO: 5148260 - DNA, 21 bp, Homo sapiens
acctcctgacaacgtctcttc

SEQ ID NO: 5148261 - DNA, 19 bp, Homo sapiens
acctcctgacacccttctc

SEQ ID NO: 5148262 - DNA, 21 bp, Homo sapiens
acctcctgacacccttctccc

SEQ ID NO: 5148263 - DNA, 21 bp, Homo sapiens
acctcctgagaaggcgaggag

SEQ ID NO: 5148264 - DNA, 17 bp, Homo sapiens
acctcctgcccaggaga

SEQ ID NO: 5148265 - DNA, 14 bp, Homo sapiens
acctcctgcctccc

SEQ ID NO: 5148266 - DNA, 15 bp, Homo sapiens
acctcctgcggctca

SEQ ID NO: 5148267 - DNA, 14 bp, Homo sapiens
acctcctgctcctt

SEQ ID NO: 5148268 - DNA, 16 bp, Homo sapiens
acctcctgctctggga

SEQ ID NO: 5148269 - DNA, 12 bp, Homo sapiens
acctcctgctgg

SEQ ID NO: 5148270 - DNA, 13 bp, Homo sapiens
acctcctgggcta

SEQ ID NO: 5148271 - DNA, 13 bp, Homo sapiens
acctcctggtggt

SEQ ID NO: 5148272 - DNA, 12 bp, Homo sapiens
acctcctgtcac

SEQ ID NO: 5148273 - DNA, 15 bp, Homo sapiens
acctcctgtggaacc

SEQ ID NO: 5148274 - DNA, 21 bp, Homo sapiens
acctcctgtggaacccagcag

SEQ ID NO: 5148275 - DNA, 18 bp, Homo sapiens
acctccttagctttccct

SEQ ID NO: 5148276 - DNA, 22 bp, Homo sapiens
acctccttagctttccctgtgc

SEQ ID NO: 5148277 - DNA, 15 bp, Homo sapiens
acctccttccctctc

SEQ ID NO: 5148278 - DNA, 21 bp, Homo sapiens
acctccttccctctctggaga

SEQ ID NO: 5148279 - DNA, 22 bp, Homo sapiens
acctccttccctctctggagaa

SEQ ID NO: 5148280 - DNA, 21 bp, Homo sapiens
acctccttcctcagtcctgga

SEQ ID NO: 5148281 - DNA, 23 bp, Homo sapiens
acctccttcctcagtcctggaag

SEQ ID NO: 5148282 - DNA, 12 bp, Homo sapiens
acctccttctct

SEQ ID NO: 5148283 - DNA, 23 bp, Homo sapiens
acctccttctctgtctcatgtgt

SEQ ID NO: 5148284 - DNA, 21 bp, Homo sapiens
acctccttctgcagtcagact

SEQ ID NO: 5148285 - DNA, 22 bp, Homo sapiens
acctccttctgcagtcagactg

SEQ ID NO: 5148286 - DNA, 18 bp, Homo sapiens
acctccttgctttgctgt

SEQ ID NO: 5148287 - DNA, 18 bp, Homo sapiens
acctccttgtcactttat

SEQ ID NO: 5148288 - DNA, 19 bp, Homo sapiens
acctccttgtcactttatt

SEQ ID NO: 5148289 - DNA, 22 bp, Homo sapiens
acctcctttcaaggtaactgta

SEQ ID NO: 5148290 - DNA, 22 bp, Homo sapiens
acctcctttcatcacactgggt

SEQ ID NO: 5148291 - DNA, 19 bp, Homo sapiens
acctcgaggaactccagga

SEQ ID NO: 5148292 - DNA, 19 bp, Homo sapiens
acctcgagtactgtgggca

SEQ ID NO: 5148293 - DNA, 22 bp, Homo sapiens
acctcgagtactgtgggcaatt

SEQ ID NO: 5148294 - DNA, 23 bp, Homo sapiens
acctcgagtggcgagtccagaca

SEQ ID NO: 5148295 - DNA, 12 bp, Homo sapiens
acctcgccctct

SEQ ID NO: 5148296 - DNA, 14 bp, Homo sapiens
acctcgccctctcc

SEQ ID NO: 5148297 - DNA, 15 bp, Homo sapiens
acctcgccctctcct

SEQ ID NO: 5148298 - DNA, 22 bp, Homo sapiens
acctcgccctctcctttgttcc

SEQ ID NO: 5148299 - DNA, 19 bp, Homo sapiens
acctcgcggcgcagcccct

SEQ ID NO: 5148300 - DNA, 13 bp, Homo sapiens
acctcgctcccct

SEQ ID NO: 5148301 - DNA, 14 bp, Homo sapiens
acctcgctcccctc

SEQ ID NO: 5148302 - DNA, 14 bp, Homo sapiens
acctcgctgagggc

SEQ ID NO: 5148303 - DNA, 20 bp, Homo sapiens
acctcgctgttgtcacatct

SEQ ID NO: 5148304 - DNA, 19 bp, Homo sapiens
acctcggacagagcccccc

SEQ ID NO: 5148305 - DNA, 22 bp, Homo sapiens
acctcggagcatggtgttttca

SEQ ID NO: 5148306 - DNA, 23 bp, Homo sapiens
acctcggagggatggagaaagaa

SEQ ID NO: 5148307 - DNA, 17 bp, Homo sapiens
acctcggcacacactgt

SEQ ID NO: 5148308 - DNA, 18 bp, Homo sapiens
acctcggccgaggcctgc

SEQ ID NO: 5148309 - DNA, 23 bp, Homo sapiens
acctcggggacaccagagctgcc

SEQ ID NO: 5148310 - DNA, 18 bp, Homo sapiens
acctcggtcactccaact

SEQ ID NO: 5148311 - DNA, 15 bp, Homo sapiens
acctcggtgaccact

SEQ ID NO: 5148312 - DNA, 18 bp, Homo sapiens
acctcggtgaccactctt

SEQ ID NO: 5148313 - DNA, 15 bp, Homo sapiens
acctcgtactcagga

SEQ ID NO: 5148314 - DNA, 16 bp, Homo sapiens
acctcgtactcaggag

SEQ ID NO: 5148315 - DNA, 19 bp, Homo sapiens
acctcgtactcaggagccc

SEQ ID NO: 5148316 - DNA, 20 bp, Homo sapiens
acctcgtctttgcttgtcct

SEQ ID NO: 5148317 - DNA, 13 bp, Homo sapiens
acctcgtgatcta

SEQ ID NO: 5148318 - DNA, 22 bp, Homo sapiens
acctcgtgatttgcctgcctgg

SEQ ID NO: 5148319 - DNA, 20 bp, Homo sapiens
acctctaaatttccatatcc

SEQ ID NO: 5148320 - DNA, 16 bp, Homo sapiens
acctctaacagcacca

SEQ ID NO: 5148321 - DNA, 17 bp, Homo sapiens
acctctaactgtgcaaa

SEQ ID NO: 5148322 - DNA, 16 bp, Homo sapiens
acctctaagtgctgct

SEQ ID NO: 5148323 - DNA, 17 bp, Homo sapiens
acctctaagtgctgctg

SEQ ID NO: 5148324 - DNA, 20 bp, Homo sapiens
acctctaatagtataaaccc

SEQ ID NO: 5148325 - DNA, 17 bp, Homo sapiens
acctctacaggcattta

SEQ ID NO: 5148326 - DNA, 21 bp, Homo sapiens
acctctacccaaaccctaggt

SEQ ID NO: 5148327 - DNA, 22 bp, Homo sapiens
acctctactaaaaagaaggaaa

SEQ ID NO: 5148328 - DNA, 16 bp, Homo sapiens
acctctacttgctgaa

SEQ ID NO: 5148329 - DNA, 15 bp, Homo sapiens
acctctactttccag

SEQ ID NO: 5148330 - DNA, 20 bp, Homo sapiens
acctctagaatcccagcagc

SEQ ID NO: 5148331 - DNA, 21 bp, Homo sapiens
acctctagaatcccagcagca

SEQ ID NO: 5148332 - DNA, 16 bp, Homo sapiens
acctctagagaaaaga

SEQ ID NO: 5148333 - DNA, 18 bp, Homo sapiens
acctctagccctgcccgg

SEQ ID NO: 5148334 - DNA, 19 bp, Homo sapiens
acctctagccttaaggggg

SEQ ID NO: 5148335 - DNA, 16 bp, Homo sapiens
acctctagctgttctt

SEQ ID NO: 5148336 - DNA, 19 bp, Homo sapiens
acctctaggtccccatact

SEQ ID NO: 5148337 - DNA, 12 bp, Homo sapiens
acctctatacag

SEQ ID NO: 5148338 - DNA, 22 bp, Homo sapiens
acctctatatctttaaataaat

SEQ ID NO: 5148339 - DNA, 23 bp, Homo sapiens
acctctatatctttaaataaatg

SEQ ID NO: 5148340 - DNA, 16 bp, Homo sapiens
acctctcaagctagtg

SEQ ID NO: 5148341 - DNA, 19 bp, Homo sapiens
acctctcaatattcaataa

SEQ ID NO: 5148342 - DNA, 20 bp, Homo sapiens
acctctcaatattcaataaa

SEQ ID NO: 5148343 - DNA, 17 bp, Homo sapiens
acctctcacgggccctg

SEQ ID NO: 5148344 - DNA, 22 bp, Homo sapiens
acctctcacgggccctgcccca

SEQ ID NO: 5148345 - DNA, 12 bp, Homo sapiens
acctctcactcc

SEQ ID NO: 5148346 - DNA, 16 bp, Homo sapiens
acctctcactccccat

SEQ ID NO: 5148347 - DNA, 13 bp, Homo sapiens
acctctcagcaga

SEQ ID NO: 5148348 - DNA, 18 bp, Homo sapiens
acctctcagcagaaacac

SEQ ID NO: 5148349 - DNA, 19 bp, Homo sapiens
acctctcagcatagcctgc

SEQ ID NO: 5148350 - DNA, 16 bp, Homo sapiens
acctctcagctgctgg

SEQ ID NO: 5148351 - DNA, 20 bp, Homo sapiens
acctctcagctgctggatga

SEQ ID NO: 5148352 - DNA, 15 bp, Homo sapiens
acctctcagggcctg

SEQ ID NO: 5148353 - DNA, 18 bp, Homo sapiens
acctctcatcagtgtcct

SEQ ID NO: 5148354 - DNA, 16 bp, Homo sapiens
acctctccaagtctct

SEQ ID NO: 5148355 - DNA, 18 bp, Homo sapiens
acctctccagcatcccag

SEQ ID NO: 5148356 - DNA, 23 bp, Homo sapiens
acctctccagcatcccagcctca

SEQ ID NO: 5148357 - DNA, 16 bp, Homo sapiens
acctctccagcctcag

SEQ ID NO: 5148358 - DNA, 13 bp, Homo sapiens
acctctccagctc

SEQ ID NO: 5148359 - DNA, 16 bp, Homo sapiens
acctctccagctcctc

SEQ ID NO: 5148360 - DNA, 14 bp, Homo sapiens
acctctccaggtgc

SEQ ID NO: 5148361 - DNA, 17 bp, Homo sapiens
acctctccaggtgctca

SEQ ID NO: 5148362 - DNA, 18 bp, Homo sapiens
acctctccaggtgctcat

SEQ ID NO: 5148363 - DNA, 16 bp, Homo sapiens
acctctccatcctgct

SEQ ID NO: 5148364 - DNA, 12 bp, Homo sapiens
acctctcccacc

SEQ ID NO: 5148365 - DNA, 13 bp, Homo sapiens
acctctcccaggg

SEQ ID NO: 5148366 - DNA, 19 bp, Homo sapiens
acctctccctcctcagctc

SEQ ID NO: 5148367 - DNA, 12 bp, Homo sapiens
acctctccctcg

SEQ ID NO: 5148368 - DNA, 15 bp, Homo sapiens
acctctccctgcatc

SEQ ID NO: 5148369 - DNA, 22 bp, Homo sapiens
acctctccctgcatcctgaggc

SEQ ID NO: 5148370 - DNA, 15 bp, Homo sapiens
acctctcccttggat

SEQ ID NO: 5148371 - DNA, 17 bp, Homo sapiens
accctgcaaggcccaca

SEQ ID NO: 5148372 - DNA, 23 bp, Homo sapiens
accctgcaaggcccacaggaggc

SEQ ID NO: 5148373 - DNA, 12 bp, Homo sapiens
accctgcaccct

SEQ ID NO: 5148374 - DNA, 18 bp, Homo sapiens
accctgcacctcattcca

SEQ ID NO: 5148375 - DNA, 14 bp, Homo sapiens
accctgcacctgct

SEQ ID NO: 5148376 - DNA, 17 bp, Homo sapiens
accctgcacctgctgcg

SEQ ID NO: 5148377 - DNA, 22 bp, Homo sapiens
accctgcacctgctgcgtcccc

SEQ ID NO: 5148378 - DNA, 19 bp, Homo sapiens
accctgcactttcctccac

SEQ ID NO: 5148379 - DNA, 13 bp, Homo sapiens
accctgcagagca

SEQ ID NO: 5148380 - DNA, 14 bp, Homo sapiens
accctgcagagcac

SEQ ID NO: 5148381 - DNA, 19 bp, Homo sapiens
accctgcagagcacacagg

SEQ ID NO: 5148382 - DNA, 14 bp, Homo sapiens
accctgcagccagg

SEQ ID NO: 5148383 - DNA, 16 bp, Homo sapiens
accctgcaggcaggca

SEQ ID NO: 5148384 - DNA, 17 bp, Homo sapiens
accctgcaggcaggcag

SEQ ID NO: 5148385 - DNA, 16 bp, Homo sapiens
accctgcaggccaggc

SEQ ID NO: 5148386 - DNA, 22 bp, Homo sapiens
accctgcatggctgagctgccc

SEQ ID NO: 5148387 - DNA, 15 bp, Homo sapiens
accctgcattttcct

SEQ ID NO: 5148388 - DNA, 17 bp, Homo sapiens
accctgcattttcctct

SEQ ID NO: 5148389 - DNA, 18 bp, Homo sapiens
accctgccaactttccag

SEQ ID NO: 5148390 - DNA, 12 bp, Homo sapiens
accctgccaagg

SEQ ID NO: 5148391 - DNA, 13 bp, Homo sapiens
accctgccacagc

SEQ ID NO: 5148392 - DNA, 20 bp, Homo sapiens
accctgccacagccagagga

SEQ ID NO: 5148393 - DNA, 14 bp, Homo sapiens
accctgccaccctc

SEQ ID NO: 5148394 - DNA, 21 bp, Homo sapiens
accctgccaccctctgctgca

SEQ ID NO: 5148395 - DNA, 14 bp, Homo sapiens
accctgccaggcac

SEQ ID NO: 5148396 - DNA, 18 bp, Homo sapiens
accctgccaggcacaggc

SEQ ID NO: 5148397 - DNA, 16 bp, Homo sapiens
accctgccagggggtt

SEQ ID NO: 5148398 - DNA, 11 bp, Homo sapiens
accctgccagt

SEQ ID NO: 5148399 - DNA, 17 bp, Homo sapiens
accctgccagtgccagg

SEQ ID NO: 5148400 - DNA, 18 bp, Homo sapiens
accctgccagtgccaggg

SEQ ID NO: 5148401 - DNA, 19 bp, Homo sapiens
accctgccagtgccagggt

SEQ ID NO: 5148402 - DNA, 14 bp, Homo sapiens
accctgccatggaa

SEQ ID NO: 5148403 - DNA, 16 bp, Homo sapiens
accctgcccacccccg

SEQ ID NO: 5148404 - DNA, 13 bp, Homo sapiens
accctgcccagag

SEQ ID NO: 5148405 - DNA, 16 bp, Homo sapiens
accctgcccagagctg

SEQ ID NO: 5148406 - DNA, 17 bp, Homo sapiens
accctgcccagagctga

SEQ ID NO: 5148407 - DNA, 18 bp, Homo sapiens
accctgcccagagctgag

SEQ ID NO: 5148408 - DNA, 13 bp, Homo sapiens
accctgcccagcc

SEQ ID NO: 5148409 - DNA, 16 bp, Homo sapiens
accctgcccagtctgg

SEQ ID NO: 5148410 - DNA, 22 bp, Homo sapiens
accctgcccatacccctgcctg

SEQ ID NO: 5148411 - DNA, 19 bp, Homo sapiens
accctgccccaccccacct

SEQ ID NO: 5148412 - DNA, 20 bp, Homo sapiens
accctgccccccctaagaga

SEQ ID NO: 5148413 - DNA, 12 bp, Homo sapiens
accctgcccctg

SEQ ID NO: 5148414 - DNA, 17 bp, Homo sapiens
accctgcccctgcaaag

SEQ ID NO: 5148415 - DNA, 23 bp, Homo sapiens
accctgcccctgcaaagacagta

SEQ ID NO: 5148416 - DNA, 21 bp, Homo sapiens
accctgcccctttcttcccca

SEQ ID NO: 5148417 - DNA, 12 bp, Homo sapiens
accctgcccgct

SEQ ID NO: 5148418 - DNA, 16 bp, Homo sapiens
accctgcccgctccca

SEQ ID NO: 5148419 - DNA, 19 bp, Homo sapiens
accctgcccgctcccaacc

SEQ ID NO: 5148420 - DNA, 13 bp, Homo sapiens
accctgccctcct

SEQ ID NO: 5148421 - DNA, 12 bp, Homo sapiens
accctgccctgc

SEQ ID NO: 5148422 - DNA, 13 bp, Homo sapiens
accctgccctgca

SEQ ID NO: 5148423 - DNA, 14 bp, Homo sapiens
accctgccctgcac

SEQ ID NO: 5148424 - DNA, 19 bp, Homo sapiens
accctgccctgcaccttgg

SEQ ID NO: 5148425 - DNA, 23 bp, Homo sapiens
accctgccctgctctgcccaggc

SEQ ID NO: 5148426 - DNA, 15 bp, Homo sapiens
accctgccctgctga

SEQ ID NO: 5148427 - DNA, 21 bp, Homo sapiens
accctgccctggcctaccaca

SEQ ID NO: 5148428 - DNA, 12 bp, Homo sapiens
accctgccctgt

SEQ ID NO: 5148429 - DNA, 17 bp, Homo sapiens
accctgccctgtgggcc

SEQ ID NO: 5148430 - DNA, 22 bp, Homo sapiens
accctgccgtcaccaccacccc

SEQ ID NO: 5148431 - DNA, 20 bp, Homo sapiens
accctgcctctcccaggcag

SEQ ID NO: 5148432 - DNA, 20 bp, Homo sapiens
accctgcctgagcccaggag

SEQ ID NO: 5148433 - DNA, 14 bp, Homo sapiens
accctgcctgctgt

SEQ ID NO: 5148434 - DNA, 17 bp, Homo sapiens
accctgcctgctgtgga

SEQ ID NO: 5148435 - DNA, 20 bp, Homo sapiens
accctgcctgtcacctggga

SEQ ID NO: 5148436 - DNA, 14 bp, Homo sapiens
accctgcctgtgga

SEQ ID NO: 5148437 - DNA, 14 bp, Homo sapiens
accctgccttatct

SEQ ID NO: 5148438 - DNA, 22 bp, Homo sapiens
accctgcgaaggggccctggtc

SEQ ID NO: 5148439 - DNA, 22 bp, Homo sapiens
accctgcgcccagtccttccac

SEQ ID NO: 5148440 - DNA, 19 bp, Homo sapiens
accctgcgcccctgcccag

SEQ ID NO: 5148441 - DNA, 20 bp, Homo sapiens
accctgcgcccctgcccagc

SEQ ID NO: 5148442 - DNA, 16 bp, Homo sapiens
accctgcgcctccaga

SEQ ID NO: 5148443 - DNA, 18 bp, Homo sapiens
accctgcgcctccagagg

SEQ ID NO: 5148444 - DNA, 18 bp, Homo sapiens
accctgcgggccagggtc

SEQ ID NO: 5148445 - DNA, 14 bp, Homo sapiens
accctgctaaatga

SEQ ID NO: 5148446 - DNA, 14 bp, Homo sapiens
accctgctcctcct

SEQ ID NO: 5148447 - DNA, 19 bp, Homo sapiens
accctgctgaacacagtgt

SEQ ID NO: 5148448 - DNA, 14 bp, Homo sapiens
accctgctgagtct

SEQ ID NO: 5148449 - DNA, 14 bp, Homo sapiens
accctgctgccttc

SEQ ID NO: 5148450 - DNA, 22 bp, Homo sapiens
accctgcttcccaaactcccag

SEQ ID NO: 5148451 - DNA, 14 bp, Homo sapiens
accctgcttctccc

SEQ ID NO: 5148452 - DNA, 15 bp, Homo sapiens
accctgcttctcccg

SEQ ID NO: 5148453 - DNA, 18 bp, Homo sapiens
accctgcttctgctgcct

SEQ ID NO: 5148454 - DNA, 19 bp, Homo sapiens
accctgcttctgctgcctg

SEQ ID NO: 5148455 - DNA, 17 bp, Homo sapiens
accctgcttggcccagg

SEQ ID NO: 5148456 - DNA, 17 bp, Homo sapiens
accctgcttggggcctg

SEQ ID NO: 5148457 - DNA, 17 bp, Homo sapiens
accctggaaaatgaatc

SEQ ID NO: 5148458 - DNA, 17 bp, Homo sapiens
accctggaagcagggac

SEQ ID NO: 5148459 - DNA, 22 bp, Homo sapiens
accctggaattcagcaccctgg

SEQ ID NO: 5148460 - DNA, 14 bp, Homo sapiens
accctggacccagc

SEQ ID NO: 5148461 - DNA, 14 bp, Homo sapiens
accctggagccatc

SEQ ID NO: 5148462 - DNA, 22 bp, Homo sapiens
accctggagcccggcagtgcac

SEQ ID NO: 5148463 - DNA, 21 bp, Homo sapiens
accctggagcggctctcctga

SEQ ID NO: 5148464 - DNA, 15 bp, Homo sapiens
accctggaggctctc

SEQ ID NO: 5148465 - DNA, 22 bp, Homo sapiens
accctggagtggcatggtcctg

SEQ ID NO: 5148466 - DNA, 22 bp, Homo sapiens
accctggcaaagcagcaacaca

SEQ ID NO: 5148467 - DNA, 12 bp, Homo sapiens
accctggcagag

SEQ ID NO: 5148468 - DNA, 15 bp, Homo sapiens
accctggcattatgt

SEQ ID NO: 5148469 - DNA, 19 bp, Homo sapiens
accctggcatttggcctct

SEQ ID NO: 5148470 - DNA, 15 bp, Homo sapiens
accctggccaccacc

SEQ ID NO: 5148471 - DNA, 12 bp, Homo sapiens
accctggcccca

SEQ ID NO: 5148472 - DNA, 18 bp, Homo sapiens
accctggcccctctccct

SEQ ID NO: 5148473 - DNA, 21 bp, Homo sapiens
accctggccgagtccaagctg

SEQ ID NO: 5148474 - DNA, 17 bp, Homo sapiens
accctggccgccccctg

SEQ ID NO: 5148475 - DNA, 23 bp, Homo sapiens
accctggcctagaccagcagaca

SEQ ID NO: 5148476 - DNA, 11 bp, Homo sapiens
accctggcctc

SEQ ID NO: 5148477 - DNA, 14 bp, Homo sapiens
accctggcctcact

SEQ ID NO: 5148478 - DNA, 15 bp, Homo sapiens
accctggctccttgt

SEQ ID NO: 5148479 - DNA, 15 bp, Homo sapiens
accctggctctgcca

SEQ ID NO: 5148480 - DNA, 11 bp, Homo sapiens
accctggctgg

SEQ ID NO: 5148481 - DNA, 14 bp, Homo sapiens
accctgggaagctg

SEQ ID NO: 5148482 - DNA, 12 bp, Homo sapiens
accctgggaagg

SEQ ID NO: 5148483 - DNA, 16 bp, Homo sapiens
accctgggaagttgga

SEQ ID NO: 5148484 - DNA, 23 bp, Homo sapiens
accctgggacctaggggcgccgc

SEQ ID NO: 5148485 - DNA, 17 bp, Homo sapiens
accctgggagacagacc

SEQ ID NO: 5148486 - DNA, 22 bp, Homo sapiens
accctgggccctgggctggaat

SEQ ID NO: 5148487 - DNA, 14 bp, Homo sapiens
accctgggcctccc

SEQ ID NO: 5148488 - DNA, 15 bp, Homo sapiens
accctgggcctcccg

SEQ ID NO: 5148489 - DNA, 15 bp, Homo sapiens
accctgggcctggag

SEQ ID NO: 5148490 - DNA, 22 bp, Homo sapiens
accctgggcctggcagctcagc

SEQ ID NO: 5148491 - DNA, 21 bp, Homo sapiens
accctgggctattgctgctgc

SEQ ID NO: 5148492 - DNA, 15 bp, Homo sapiens
accctgggctccaca

SEQ ID NO: 5148493 - DNA, 20 bp, Homo sapiens
accctgggctccacacagca

SEQ ID NO: 5148494 - DNA, 21 bp, Homo sapiens
accctgggctccctggaggac

SEQ ID NO: 5148495 - DNA, 20 bp, Homo sapiens
accctgggctctgggagcag

SEQ ID NO: 5148496 - DNA, 17 bp, Homo sapiens
accctgggctctgtggg

SEQ ID NO: 5148497 - DNA, 15 bp, Homo sapiens
accctgggctggaga

SEQ ID NO: 5148498 - DNA, 16 bp, Homo sapiens
accctgggctggagag

SEQ ID NO: 5148499 - DNA, 15 bp, Homo sapiens
accctgggctgggga

SEQ ID NO: 5148500 - DNA, 19 bp, Homo sapiens
accctgggctggggaggag

SEQ ID NO: 5148501 - DNA, 21 bp, Homo sapiens
accctgggctgtccagcctta

SEQ ID NO: 5148502 - DNA, 15 bp, Homo sapiens
accctggggaaggag

SEQ ID NO: 5148503 - DNA, 16 bp, Homo sapiens
accctggggagaaagt

SEQ ID NO: 5148504 - DNA, 18 bp, Homo sapiens
accctggggcctgactgc

SEQ ID NO: 5148505 - DNA, 18 bp, Homo sapiens
accctggggcctggacct

SEQ ID NO: 5148506 - DNA, 22 bp, Homo sapiens
accctggggctggcttttctgt

SEQ ID NO: 5148507 - DNA, 18 bp, Homo sapiens
accctgggggcacaggag

SEQ ID NO: 5148508 - DNA, 21 bp, Homo sapiens
accctgggtcaccttcctggg

SEQ ID NO: 5148509 - DNA, 18 bp, Homo sapiens
accctgggtgggctctgt

SEQ ID NO: 5148510 - DNA, 20 bp, Homo sapiens
accctgggtttggcccctgg

SEQ ID NO: 5148511 - DNA, 16 bp, Homo sapiens
accctggtcctgactt

SEQ ID NO: 5148512 - DNA, 19 bp, Homo sapiens
accctggtcctgacttccc

SEQ ID NO: 5148513 - DNA, 14 bp, Homo sapiens
accctggtctccgt

SEQ ID NO: 5148514 - DNA, 15 bp, Homo sapiens
accctggtgacctcc

SEQ ID NO: 5148515 - DNA, 20 bp, Homo sapiens
accctggtgaggaagctcca

SEQ ID NO: 5148516 - DNA, 15 bp, Homo sapiens
accctggtggaggct

SEQ ID NO: 5148517 - DNA, 15 bp, Homo sapiens
accctggtgggccaa

SEQ ID NO: 5148518 - DNA, 17 bp, Homo sapiens
accctggtggttgctgt

SEQ ID NO: 5148519 - DNA, 18 bp, Homo sapiens
accctggtggttgctgtt

SEQ ID NO: 5148520 - DNA, 17 bp, Homo sapiens
accctggttactctggt

SEQ ID NO: 5148521 - DNA, 14 bp, Homo sapiens
accctggttgtgtg

SEQ ID NO: 5148522 - DNA, 23 bp, Homo sapiens
accctgtaaaatggaggtggaaa

SEQ ID NO: 5148523 - DNA, 16 bp, Homo sapiens
accctgtacctcatcc

SEQ ID NO: 5148524 - DNA, 20 bp, Homo sapiens
accctgtatatagcccagcc

SEQ ID NO: 5148525 - DNA, 19 bp, Homo sapiens
accctgtatccaattttaa

SEQ ID NO: 5148526 - DNA, 18 bp, Homo sapiens
accctgtcaaacattagt

SEQ ID NO: 5148527 - DNA, 20 bp, Homo sapiens
accctgtcaagttaacaagg

SEQ ID NO: 5148528 - DNA, 22 bp, Homo sapiens
accctgtcaagttaacaaggaa

SEQ ID NO: 5148529 - DNA, 13 bp, Homo sapiens
accctgtcaccca

SEQ ID NO: 5148530 - DNA, 20 bp, Homo sapiens
accctgtcagaatcatgctg

SEQ ID NO: 5148531 - DNA, 19 bp, Homo sapiens
accctgtccaaactgccta

SEQ ID NO: 5148532 - DNA, 15 bp, Homo sapiens
accctgtcccaggca

SEQ ID NO: 5148533 - DNA, 21 bp, Homo sapiens
accctgtcccaggcagcgcca

SEQ ID NO: 5148534 - DNA, 22 bp, Homo sapiens
accctgtcccaggcagcgccac

SEQ ID NO: 5148535 - DNA, 21 bp, Homo sapiens
accctgtcccccagctctggt

SEQ ID NO: 5148536 - DNA, 22 bp, Homo sapiens
accctgtcccccagctctggtg

SEQ ID NO: 5148537 - DNA, 15 bp, Homo sapiens
accctgtccggccca

SEQ ID NO: 5148538 - DNA, 14 bp, Homo sapiens
accctgtcctccca

SEQ ID NO: 5148539 - DNA, 22 bp, Homo sapiens
accctgtcctgcacaccctggg

SEQ ID NO: 5148540 - DNA, 14 bp, Homo sapiens
accctgtcctgcag

SEQ ID NO: 5148541 - DNA, 15 bp, Homo sapiens
accctgtcctgcagt

SEQ ID NO: 5148542 - DNA, 11 bp, Homo sapiens
accctgtctca

SEQ ID NO: 5148543 - DNA, 20 bp, Homo sapiens
accctgtctcagtacctccc

SEQ ID NO: 5148544 - DNA, 13 bp, Homo sapiens
accctgtctctac

SEQ ID NO: 5148545 - DNA, 21 bp, Homo sapiens
accctgtctcttaaagaaaaa

SEQ ID NO: 5148546 - DNA, 23 bp, Homo sapiens
accctgtctgcaggccaccccca

SEQ ID NO: 5148547 - DNA, 22 bp, Homo sapiens
accctgtctgtcccttttcttt

SEQ ID NO: 5148548 - DNA, 14 bp, Homo sapiens
accctgtcttcctc

SEQ ID NO: 5148549 - DNA, 19 bp, Homo sapiens
accctgtgacatggtgcct

SEQ ID NO: 5148550 - DNA, 17 bp, Homo sapiens
acctctccggcctggcc

SEQ ID NO: 5148551 - DNA, 14 bp, Homo sapiens
acctctcctgccct

SEQ ID NO: 5148552 - DNA, 15 bp, Homo sapiens
acctctcctgccctg

SEQ ID NO: 5148553 - DNA, 12 bp, Homo sapiens
acctctccttcc

SEQ ID NO: 5148554 - DNA, 14 bp, Homo sapiens
acctctccttcctc

SEQ ID NO: 5148555 - DNA, 15 bp, Homo sapiens
acctctctactagca

SEQ ID NO: 5148556 - DNA, 18 bp, Homo sapiens
acctctctcagagcatct

SEQ ID NO: 5148557 - DNA, 21 bp, Homo sapiens
acctctctcagagcatctggc

SEQ ID NO: 5148558 - DNA, 22 bp, Homo sapiens
acctctctcagccccatcgccc

SEQ ID NO: 5148559 - DNA, 18 bp, Homo sapiens
acctctctcggccccctc

SEQ ID NO: 5148560 - DNA, 15 bp, Homo sapiens
acctctctctgctcc

SEQ ID NO: 5148561 - DNA, 23 bp, Homo sapiens
acctctctgcctctcttcttccc

SEQ ID NO: 5148562 - DNA, 15 bp, Homo sapiens
acctctctgggacct

SEQ ID NO: 5148563 - DNA, 20 bp, Homo sapiens
acctctctgtagtttatggc

SEQ ID NO: 5148564 - DNA, 15 bp, Homo sapiens
acctctctgtccctt

SEQ ID NO: 5148565 - DNA, 20 bp, Homo sapiens
acctctctgtctttttcctt

SEQ ID NO: 5148566 - DNA, 23 bp, Homo sapiens
acctctcttatagaatatttatt

SEQ ID NO: 5148567 - DNA, 13 bp, Homo sapiens
acctctcttcagc

SEQ ID NO: 5148568 - DNA, 12 bp, Homo sapiens
acctctcttgtg

SEQ ID NO: 5148569 - DNA, 21 bp, Homo sapiens
acctctcttttcctctctgtc

SEQ ID NO: 5148570 - DNA, 22 bp, Homo sapiens
acctctcttttcctctctgtct

SEQ ID NO: 5148571 - DNA, 19 bp, Homo sapiens
acctctgaaggcaaatata

SEQ ID NO: 5148572 - DNA, 17 bp, Homo sapiens
acctctgaatgtcccag

SEQ ID NO: 5148573 - DNA, 23 bp, Homo sapiens
acctctgacatcaagtgtaatta

SEQ ID NO: 5148574 - DNA, 20 bp, Homo sapiens
acctctgacgcaccactgcc

SEQ ID NO: 5148575 - DNA, 12 bp, Homo sapiens
acctctgaggac

SEQ ID NO: 5148576 - DNA, 17 bp, Homo sapiens
acctctgaggactctgg

SEQ ID NO: 5148577 - DNA, 16 bp, Homo sapiens
acctctgatcaaagca

SEQ ID NO: 5148578 - DNA, 16 bp, Homo sapiens
acctctgcacaagctg

SEQ ID NO: 5148579 - DNA, 13 bp, Homo sapiens
acctctgcctccc

SEQ ID NO: 5148580 - DNA, 12 bp, Homo sapiens
acctctgcctga

SEQ ID NO: 5148581 - DNA, 19 bp, Homo sapiens
acctctgccttacaaaata

SEQ ID NO: 5148582 - DNA, 22 bp, Homo sapiens
acctctgctctgaggcttccag

SEQ ID NO: 5148583 - DNA, 23 bp, Homo sapiens
acctctgctctgaggcttccaga

SEQ ID NO: 5148584 - DNA, 20 bp, Homo sapiens
acctctgctgagtgctgggc

SEQ ID NO: 5148585 - DNA, 21 bp, Homo sapiens
acctctgctgagtgctgggca

SEQ ID NO: 5148586 - DNA, 23 bp, Homo sapiens
acctctgctgagtgctgggcact

SEQ ID NO: 5148587 - DNA, 15 bp, Homo sapiens
acctctgctgcccac

SEQ ID NO: 5148588 - DNA, 16 bp, Homo sapiens
acctctgctgcccacg

SEQ ID NO: 5148589 - DNA, 19 bp, Homo sapiens
acctctgcttcccaggttc

SEQ ID NO: 5148590 - DNA, 14 bp, Homo sapiens
acctctgcttctga

SEQ ID NO: 5148591 - DNA, 24 bp, Homo sapiens
acctctgcttttatctcagatgtt

SEQ ID NO: 5148592 - DNA, 10 bp, Homo sapiens
acctctggaa

SEQ ID NO: 5148593 - DNA, 11 bp, Homo sapiens
acctctggaac

SEQ ID NO: 5148594 - DNA, 19 bp, Homo sapiens
acctctggaaccccccagg

SEQ ID NO: 5148595 - DNA, 19 bp, Homo sapiens
acctctggactggctagag

SEQ ID NO: 5148596 - DNA, 23 bp, Homo sapiens
acctctggactggctagagtcct

SEQ ID NO: 5148597 - DNA, 21 bp, Homo sapiens
acctctggattaggtctctgt

SEQ ID NO: 5148598 - DNA, 18 bp, Homo sapiens
acctctggattcattgtc

SEQ ID NO: 5148599 - DNA, 21 bp, Homo sapiens
acctctggccaaatatgcact

SEQ ID NO: 5148600 - DNA, 13 bp, Homo sapiens
acctctggccctg

SEQ ID NO: 5148601 - DNA, 15 bp, Homo sapiens
acctctggccctgtt

SEQ ID NO: 5148602 - DNA, 16 bp, Homo sapiens
acctctggcccttgga

SEQ ID NO: 5148603 - DNA, 20 bp, Homo sapiens
acctctggcccttggaataa

SEQ ID NO: 5148604 - DNA, 15 bp, Homo sapiens
acctctgggacccca

SEQ ID NO: 5148605 - DNA, 16 bp, Homo sapiens
acctctgggaccccag

SEQ ID NO: 5148606 - DNA, 19 bp, Homo sapiens
acctctgggaccccagctg

SEQ ID NO: 5148607 - DNA, 21 bp, Homo sapiens
acctctgggaccccagctgct

SEQ ID NO: 5148608 - DNA, 10 bp, Homo sapiens
acctctgggc

SEQ ID NO: 5148609 - DNA, 15 bp, Homo sapiens
acctctgggccctgc

SEQ ID NO: 5148610 - DNA, 18 bp, Homo sapiens
acctctgggccctgcagg

SEQ ID NO: 5148611 - DNA, 11 bp, Homo sapiens
acctctgggct

SEQ ID NO: 5148612 - DNA, 13 bp, Homo sapiens
acctctgggcttc

SEQ ID NO: 5148613 - DNA, 16 bp, Homo sapiens
acctctggggacccca

SEQ ID NO: 5148614 - DNA, 20 bp, Homo sapiens
acctctggggaccccaacct

SEQ ID NO: 5148615 - DNA, 18 bp, Homo sapiens
acctctgggttgggatca

SEQ ID NO: 5148616 - DNA, 12 bp, Homo sapiens
acctctggtcca

SEQ ID NO: 5148617 - DNA, 23 bp, Homo sapiens
acctctggtggctcctcctagga

SEQ ID NO: 5148618 - DNA, 14 bp, Homo sapiens
acctctgtatagaa

SEQ ID NO: 5148619 - DNA, 12 bp, Homo sapiens
acctctgtctca

SEQ ID NO: 5148620 - DNA, 21 bp, Homo sapiens
acctctgtctcatcctcctgg

SEQ ID NO: 5148621 - DNA, 17 bp, Homo sapiens
acctctgtctgagacag

SEQ ID NO: 5148622 - DNA, 19 bp, Homo sapiens
acctctgtctgagacaggt

SEQ ID NO: 5148623 - DNA, 22 bp, Homo sapiens
acctctgtctgagacaggtgcc

SEQ ID NO: 5148624 - DNA, 19 bp, Homo sapiens
acctctgtcttggctttca

SEQ ID NO: 5148625 - DNA, 16 bp, Homo sapiens
acctctgtgacctcag

SEQ ID NO: 5148626 - DNA, 21 bp, Homo sapiens
acctctgtgaggaaagcacac

SEQ ID NO: 5148627 - DNA, 16 bp, Homo sapiens
acctctgtgccagggc

SEQ ID NO: 5148628 - DNA, 20 bp, Homo sapiens
acctctgtggtcacccatgc

SEQ ID NO: 5148629 - DNA, 22 bp, Homo sapiens
acctctgtggtcacccatgcat

SEQ ID NO: 5148630 - DNA, 15 bp, Homo sapiens
acctctgtgtgctcc

SEQ ID NO: 5148631 - DNA, 22 bp, Homo sapiens
acctctgttaaggttgaacttt

SEQ ID NO: 5148632 - DNA, 18 bp, Homo sapiens
acctctgttccccaccca

SEQ ID NO: 5148633 - DNA, 16 bp, Homo sapiens
acctctgttgtcctcc

SEQ ID NO: 5148634 - DNA, 20 bp, Homo sapiens
acctctgttgtcctcccctt

SEQ ID NO: 5148635 - DNA, 22 bp, Homo sapiens
acctcttaaagaaaacccaccc

SEQ ID NO: 5148636 - DNA, 15 bp, Homo sapiens
acctcttactttgct

SEQ ID NO: 5148637 - DNA, 21 bp, Homo sapiens
acctcttatgagctccatgtt

SEQ ID NO: 5148638 - DNA, 22 bp, Homo sapiens
acctcttatgagctccatgttg

SEQ ID NO: 5148639 - DNA, 14 bp, Homo sapiens
acctcttcagctgg

SEQ ID NO: 5148640 - DNA, 21 bp, Homo sapiens
acctcttccaggaagcacagg

SEQ ID NO: 5148641 - DNA, 23 bp, Homo sapiens
acctcttccaggaagcacaggcc

SEQ ID NO: 5148642 - DNA, 14 bp, Homo sapiens
acctcttccccaga

SEQ ID NO: 5148643 - DNA, 23 bp, Homo sapiens
acctcttccccagaaaggagact

SEQ ID NO: 5148644 - DNA, 20 bp, Homo sapiens
acctcttccctctgggcctg

SEQ ID NO: 5148645 - DNA, 20 bp, Homo sapiens
acctcttccgttggaaagaa

SEQ ID NO: 5148646 - DNA, 21 bp, Homo sapiens
acctcttccgttggaaagaac

SEQ ID NO: 5148647 - DNA, 14 bp, Homo sapiens
acctcttcctaggc

SEQ ID NO: 5148648 - DNA, 13 bp, Homo sapiens
acctcttcctctg

SEQ ID NO: 5148649 - DNA, 14 bp, Homo sapiens
acctcttcctctgg

SEQ ID NO: 5148650 - DNA, 19 bp, Homo sapiens
acctcttcctctggttcct

SEQ ID NO: 5148651 - DNA, 17 bp, Homo sapiens
acctcttcctggaataa

SEQ ID NO: 5148652 - DNA, 21 bp, Homo sapiens
acctcttctcttcctgtaaca

SEQ ID NO: 5148653 - DNA, 16 bp, Homo sapiens
acctcttctggctcaa

SEQ ID NO: 5148654 - DNA, 17 bp, Homo sapiens
acctcttgagccttgaa

SEQ ID NO: 5148655 - DNA, 14 bp, Homo sapiens
acctcttgctgtct

SEQ ID NO: 5148656 - DNA, 18 bp, Homo sapiens
acctcttgctgtctctgc

SEQ ID NO: 5148657 - DNA, 20 bp, Homo sapiens
acctcttgctgtctctgctc

SEQ ID NO: 5148658 - DNA, 23 bp, Homo sapiens
acctcttgggcatgctcagccct

SEQ ID NO: 5148659 - DNA, 16 bp, Homo sapiens
acctcttgtttctggg

SEQ ID NO: 5148660 - DNA, 19 bp, Homo sapiens
acctctttactctctccga

SEQ ID NO: 5148661 - DNA, 17 bp, Homo sapiens
acctctttcctctctgg

SEQ ID NO: 5148662 - DNA, 16 bp, Homo sapiens
acctctttctacagcc

SEQ ID NO: 5148663 - DNA, 13 bp, Homo sapiens
acctctttcttca

SEQ ID NO: 5148664 - DNA, 22 bp, Homo sapiens
acctctttgaaagaaggaagac

SEQ ID NO: 5148665 - DNA, 13 bp, Homo sapiens
acctctttgctca

SEQ ID NO: 5148666 - DNA, 17 bp, Homo sapiens
acctctttgctccctga

SEQ ID NO: 5148667 - DNA, 16 bp, Homo sapiens
acctcttttcctagtt

SEQ ID NO: 5148668 - DNA, 16 bp, Homo sapiens
acctcttttgttgtcc

SEQ ID NO: 5148669 - DNA, 13 bp, Homo sapiens
acctctttttcct

SEQ ID NO: 5148670 - DNA, 15 bp, Homo sapiens
acctctttttcctcc

SEQ ID NO: 5148671 - DNA, 23 bp, Homo sapiens
acctcttttttctatctgccaaa

SEQ ID NO: 5148672 - DNA, 19 bp, Homo sapiens
acctgaaaacactgtgcac

SEQ ID NO: 5148673 - DNA, 12 bp, Homo sapiens
acctgaaaagta

SEQ ID NO: 5148674 - DNA, 14 bp, Homo sapiens
acctgaaaatgtgg

SEQ ID NO: 5148675 - DNA, 18 bp, Homo sapiens
acctgaaacactggacct

SEQ ID NO: 5148676 - DNA, 19 bp, Homo sapiens
acctgaaacactggacctg

SEQ ID NO: 5148677 - DNA, 15 bp, Homo sapiens
acctgaaagagagga

SEQ ID NO: 5148678 - DNA, 14 bp, Homo sapiens
acctgaaagccctt

SEQ ID NO: 5148679 - DNA, 13 bp, Homo sapiens
acctgaaagcctg

SEQ ID NO: 5148680 - DNA, 17 bp, Homo sapiens
acctgaaagcctgtctc

SEQ ID NO: 5148681 - DNA, 22 bp, Homo sapiens
acctgaaataatatatttcttc

SEQ ID NO: 5148682 - DNA, 18 bp, Homo sapiens
acctgaaatatattttaa

SEQ ID NO: 5148683 - DNA, 18 bp, Homo sapiens
acctgaaattaatttgtg

SEQ ID NO: 5148684 - DNA, 15 bp, Homo sapiens
acctgaaattccaaa

SEQ ID NO: 5148685 - DNA, 22 bp, Homo sapiens
acctgaaattccaaagtctcta

SEQ ID NO: 5148686 - DNA, 20 bp, Homo sapiens
acctgaacaaaccctttaaa

SEQ ID NO: 5148687 - DNA, 14 bp, Homo sapiens
acctgaacattgta

SEQ ID NO: 5148688 - DNA, 14 bp, Homo sapiens
acctgaaccactgt

SEQ ID NO: 5148689 - DNA, 15 bp, Homo sapiens
acctgaaccactgtg

SEQ ID NO: 5148690 - DNA, 16 bp, Homo sapiens
acctgaaccactgtgg

SEQ ID NO: 5148691 - DNA, 18 bp, Homo sapiens
acctgaaccccatgggct

SEQ ID NO: 5148692 - DNA, 21 bp, Homo sapiens
acctgaaccccatgggcttgg

SEQ ID NO: 5148693 - DNA, 15 bp, Homo sapiens
acctgaactctgcaa

SEQ ID NO: 5148694 - DNA, 16 bp, Homo sapiens
acctgaactgaacacc

SEQ ID NO: 5148695 - DNA, 18 bp, Homo sapiens
acctgaagactcattctt

SEQ ID NO: 5148696 - DNA, 21 bp, Homo sapiens
acctgaagagcgctcctctgc

SEQ ID NO: 5148697 - DNA, 23 bp, Homo sapiens
acctgaagagtggtcagaacaga

SEQ ID NO: 5148698 - DNA, 18 bp, Homo sapiens
acctgaagatgtctcctc

SEQ ID NO: 5148699 - DNA, 22 bp, Homo sapiens
acctgaagatgtctcctcaagc

SEQ ID NO: 5148700 - DNA, 22 bp, Homo sapiens
acctgaagctatcgtaaaatta

SEQ ID NO: 5148701 - DNA, 19 bp, Homo sapiens
acctgaaggattattaagc

SEQ ID NO: 5148702 - DNA, 19 bp, Homo sapiens
acctgaaggcagggctcct

SEQ ID NO: 5148703 - DNA, 23 bp, Homo sapiens
acctgaaggcagggctcctccct

SEQ ID NO: 5148704 - DNA, 21 bp, Homo sapiens
acctgaaggggttttcttgat

SEQ ID NO: 5148705 - DNA, 23 bp, Homo sapiens
acctgaaggggttttcttgataa

SEQ ID NO: 5148706 - DNA, 22 bp, Homo sapiens
acctgaagggtggatgtgctgg

SEQ ID NO: 5148707 - DNA, 23 bp, Homo sapiens
acctgaagggtggatgtgctgga

SEQ ID NO: 5148708 - DNA, 15 bp, Homo sapiens
acctgaagggttgac

SEQ ID NO: 5148709 - DNA, 23 bp, Homo sapiens
acctgaaggtattggcctgttca

SEQ ID NO: 5148710 - DNA, 15 bp, Homo sapiens
acctgaagtcaaacc

SEQ ID NO: 5148711 - DNA, 22 bp, Homo sapiens
acctgaagtctttgtacagaca

SEQ ID NO: 5148712 - DNA, 13 bp, Homo sapiens
acctgaagttcac

SEQ ID NO: 5148713 - DNA, 18 bp, Homo sapiens
acctgaataaagaatgaa

SEQ ID NO: 5148714 - DNA, 20 bp, Homo sapiens
acctgaataagggactttgg

SEQ ID NO: 5148715 - DNA, 22 bp, Homo sapiens
acctgaataccacttacctcaa

SEQ ID NO: 5148716 - DNA, 15 bp, Homo sapiens
acctgaatcagctgg

SEQ ID NO: 5148717 - DNA, 19 bp, Homo sapiens
acctgaatcagctggacat

SEQ ID NO: 5148718 - DNA, 21 bp, Homo sapiens
acctgaatcttttttttatat

SEQ ID NO: 5148719 - DNA, 22 bp, Homo sapiens
acctgaatcttttttttatata

SEQ ID NO: 5148720 - DNA, 16 bp, Homo sapiens
acctgaatgctctgta

SEQ ID NO: 5148721 - DNA, 19 bp, Homo sapiens
acctgaatgcttctgagag

SEQ ID NO: 5148722 - DNA, 20 bp, Homo sapiens
acctgaatgcttctgagagc

SEQ ID NO: 5148723 - DNA, 18 bp, Homo sapiens
acctgaattaaagtctac

SEQ ID NO: 5148724 - DNA, 23 bp, Homo sapiens
acctgaattaaagtctacactgc

SEQ ID NO: 5148725 - DNA, 19 bp, Homo sapiens
acctgaattattaatgaat

SEQ ID NO: 5148726 - DNA, 18 bp, Homo sapiens
acctgaattcgagacagg

SEQ ID NO: 5148727 - DNA, 20 bp, Homo sapiens
accctgtgcagaagggagct

SEQ ID NO: 5148728 - DNA, 11 bp, Homo sapiens
accctgtgccc

SEQ ID NO: 5148729 - DNA, 21 bp, Homo sapiens
accctgtgccccgcctcccgg

SEQ ID NO: 5148730 - DNA, 18 bp, Homo sapiens
accctgtgccctccttcc

SEQ ID NO: 5148731 - DNA, 14 bp, Homo sapiens
accctgtgcctgtg

SEQ ID NO: 5148732 - DNA, 15 bp, Homo sapiens
accctgtgcctgtgt

SEQ ID NO: 5148733 - DNA, 16 bp, Homo sapiens
accctgtgcctgtgtt

SEQ ID NO: 5148734 - DNA, 19 bp, Homo sapiens
accctgtgcctgtgtttca

SEQ ID NO: 5148735 - DNA, 22 bp, Homo sapiens
accctgtggaagcatggctgtc

SEQ ID NO: 5148736 - DNA, 14 bp, Homo sapiens
accctgtggccctg

SEQ ID NO: 5148737 - DNA, 17 bp, Homo sapiens
accctgtggccctggct

SEQ ID NO: 5148738 - DNA, 14 bp, Homo sapiens
accctgtgggaccg

SEQ ID NO: 5148739 - DNA, 21 bp, Homo sapiens
accctgtgggaccgcctggcc

SEQ ID NO: 5148740 - DNA, 22 bp, Homo sapiens
accctgtgggaccgcctggccc

SEQ ID NO: 5148741 - DNA, 23 bp, Homo sapiens
accctgtgggaccgcctggccct

SEQ ID NO: 5148742 - DNA, 22 bp, Homo sapiens
accctgtgggcttatgtctctg

SEQ ID NO: 5148743 - DNA, 21 bp, Homo sapiens
accctgtgtcagagcctacct

SEQ ID NO: 5148744 - DNA, 22 bp, Homo sapiens
accctgtgtcagagcctacctt

SEQ ID NO: 5148745 - DNA, 17 bp, Homo sapiens
accctgttaccattttg

SEQ ID NO: 5148746 - DNA, 18 bp, Homo sapiens
accctgttagttttgtaa

SEQ ID NO: 5148747 - DNA, 15 bp, Homo sapiens
accctgttcaggctg

SEQ ID NO: 5148748 - DNA, 15 bp, Homo sapiens
accctgttcctgctg

SEQ ID NO: 5148749 - DNA, 21 bp, Homo sapiens
accctgttcctgctgctgtct

SEQ ID NO: 5148750 - DNA, 18 bp, Homo sapiens
accctgttcctggaggtc

SEQ ID NO: 5148751 - DNA, 20 bp, Homo sapiens
accctgttctgtagttattc

SEQ ID NO: 5148752 - DNA, 21 bp, Homo sapiens
accctgttgagtatttgctgt

SEQ ID NO: 5148753 - DNA, 10 bp, Homo sapiens
accctgttgc

SEQ ID NO: 5148754 - DNA, 16 bp, Homo sapiens
accctgttgcaaagga

SEQ ID NO: 5148755 - DNA, 15 bp, Homo sapiens
accctgttgctaagc

SEQ ID NO: 5148756 - DNA, 23 bp, Homo sapiens
accctgttgctacatcagagtgt

SEQ ID NO: 5148757 - DNA, 15 bp, Homo sapiens
accctgtttcctgag

SEQ ID NO: 5148758 - DNA, 19 bp, Homo sapiens
accctgtttcctttcagga

SEQ ID NO: 5148759 - DNA, 19 bp, Homo sapiens
accctgtttggatttttaa

SEQ ID NO: 5148760 - DNA, 21 bp, Homo sapiens
accctgttttccacaccatca

SEQ ID NO: 5148761 - DNA, 21 bp, Homo sapiens
acccttaaacagttgcacagc

SEQ ID NO: 5148762 - DNA, 16 bp, Homo sapiens
acccttaacccaagga

SEQ ID NO: 5148763 - DNA, 18 bp, Homo sapiens
acccttaacccaaggagc

SEQ ID NO: 5148764 - DNA, 15 bp, Homo sapiens
acccttaactgacat

SEQ ID NO: 5148765 - DNA, 22 bp, Homo sapiens
acccttaataacatacaatgac

SEQ ID NO: 5148766 - DNA, 19 bp, Homo sapiens
acccttacagcctctgact

SEQ ID NO: 5148767 - DNA, 18 bp, Homo sapiens
acccttacagtgaagatg

SEQ ID NO: 5148768 - DNA, 18 bp, Homo sapiens
acccttaccatgtgcctg

SEQ ID NO: 5148769 - DNA, 22 bp, Homo sapiens
acccttaccatgtgcctgatcc

SEQ ID NO: 5148770 - DNA, 22 bp, Homo sapiens
acccttaccccttagcctccct

SEQ ID NO: 5148771 - DNA, 13 bp, Homo sapiens
acccttacttcct

SEQ ID NO: 5148772 - DNA, 14 bp, Homo sapiens
acccttacttcctg

SEQ ID NO: 5148773 - DNA, 13 bp, Homo sapiens
acccttagcagcc

SEQ ID NO: 5148774 - DNA, 21 bp, Homo sapiens
acccttagcttttagcctggc

SEQ ID NO: 5148775 - DNA, 22 bp, Homo sapiens
acccttaggatggggctcccag

SEQ ID NO: 5148776 - DNA, 23 bp, Homo sapiens
acccttatcaccagctgcctctt

SEQ ID NO: 5148777 - DNA, 17 bp, Homo sapiens
acccttattgctgtcct

SEQ ID NO: 5148778 - DNA, 14 bp, Homo sapiens
acccttatttaaaa

SEQ ID NO: 5148779 - DNA, 13 bp, Homo sapiens
acccttcaactcc

SEQ ID NO: 5148780 - DNA, 17 bp, Homo sapiens
acccttcaactcctggc

SEQ ID NO: 5148781 - DNA, 18 bp, Homo sapiens
acccttcaactcctggct

SEQ ID NO: 5148782 - DNA, 20 bp, Homo sapiens
acccttcaactcctggctcc

SEQ ID NO: 5148783 - DNA, 13 bp, Homo sapiens
acccttcaatgtt

SEQ ID NO: 5148784 - DNA, 21 bp, Homo sapiens
acccttcacaccccaggccct

SEQ ID NO: 5148785 - DNA, 21 bp, Homo sapiens
acccttcacataccctccccc

SEQ ID NO: 5148786 - DNA, 16 bp, Homo sapiens
acccttcagggccaga

SEQ ID NO: 5148787 - DNA, 21 bp, Homo sapiens
acccttcagtgctacattttg

SEQ ID NO: 5148788 - DNA, 17 bp, Homo sapiens
acccttcatcttcctgt

SEQ ID NO: 5148789 - DNA, 23 bp, Homo sapiens
acccttccatctgattccagcac

SEQ ID NO: 5148790 - DNA, 13 bp, Homo sapiens
acccttcccaatc

SEQ ID NO: 5148791 - DNA, 19 bp, Homo sapiens
acccttcccagccctcatc

SEQ ID NO: 5148792 - DNA, 21 bp, Homo sapiens
acccttcccagccctcatccc

SEQ ID NO: 5148793 - DNA, 10 bp, Homo sapiens
acccttcccc

SEQ ID NO: 5148794 - DNA, 15 bp, Homo sapiens
acccttccccactcc

SEQ ID NO: 5148795 - DNA, 22 bp, Homo sapiens
acccttcccgcctccctctcag

SEQ ID NO: 5148796 - DNA, 12 bp, Homo sapiens
acccttcccggc

SEQ ID NO: 5148797 - DNA, 17 bp, Homo sapiens
acccttcccggcccccg

SEQ ID NO: 5148798 - DNA, 23 bp, Homo sapiens
acccttcccggcccccggccaag

SEQ ID NO: 5148799 - DNA, 12 bp, Homo sapiens
acccttccctct

SEQ ID NO: 5148800 - DNA, 13 bp, Homo sapiens
acccttccctctt

SEQ ID NO: 5148801 - DNA, 18 bp, Homo sapiens
acccttccctcttccctc

SEQ ID NO: 5148802 - DNA, 11 bp, Homo sapiens
acccttccctg

SEQ ID NO: 5148803 - DNA, 13 bp, Homo sapiens
acccttccctgca

SEQ ID NO: 5148804 - DNA, 15 bp, Homo sapiens
acccttccctgcact

SEQ ID NO: 5148805 - DNA, 22 bp, Homo sapiens
acccttccctgcactaaagcca

SEQ ID NO: 5148806 - DNA, 22 bp, Homo sapiens
acccttccctgtggccttatga

SEQ ID NO: 5148807 - DNA, 20 bp, Homo sapiens
acccttcccttgagccctct

SEQ ID NO: 5148808 - DNA, 20 bp, Homo sapiens
acccttccgacaggagcact

SEQ ID NO: 5148809 - DNA, 13 bp, Homo sapiens
acccttcctaagt

SEQ ID NO: 5148810 - DNA, 13 bp, Homo sapiens
acccttcctcatc

SEQ ID NO: 5148811 - DNA, 18 bp, Homo sapiens
acccttcctcatctgtgc

SEQ ID NO: 5148812 - DNA, 24 bp, Homo sapiens
acccttcctcatctgtgcctgtct

SEQ ID NO: 5148813 - DNA, 22 bp, Homo sapiens
acccttcctcctcctttgccta

SEQ ID NO: 5148814 - DNA, 18 bp, Homo sapiens
acccttcctgagctttat

SEQ ID NO: 5148815 - DNA, 13 bp, Homo sapiens
acccttcctgcgc

SEQ ID NO: 5148816 - DNA, 16 bp, Homo sapiens
acccttcctggcccag

SEQ ID NO: 5148817 - DNA, 19 bp, Homo sapiens
acccttcctggcccaggcc

SEQ ID NO: 5148818 - DNA, 18 bp, Homo sapiens
acccttcgggagggcact

SEQ ID NO: 5148819 - DNA, 18 bp, Homo sapiens
acccttctacaaaagaag

SEQ ID NO: 5148820 - DNA, 16 bp, Homo sapiens
acccttctcccctgcc

SEQ ID NO: 5148821 - DNA, 17 bp, Homo sapiens
acccttctcccctgccc

SEQ ID NO: 5148822 - DNA, 21 bp, Homo sapiens
acccttctcccctgccccgtc

SEQ ID NO: 5148823 - DNA, 15 bp, Homo sapiens
acccttctcctcttg

SEQ ID NO: 5148824 - DNA, 14 bp, Homo sapiens
acccttctcctttc

SEQ ID NO: 5148825 - DNA, 15 bp, Homo sapiens
acccttctcctttcc

SEQ ID NO: 5148826 - DNA, 17 bp, Homo sapiens
acccttctcctttcctt

SEQ ID NO: 5148827 - DNA, 22 bp, Homo sapiens
acccttctcctttccttcccag

SEQ ID NO: 5148828 - DNA, 15 bp, Homo sapiens
acccttctgctttct

SEQ ID NO: 5148829 - DNA, 20 bp, Homo sapiens
acccttctgggtccagggag

SEQ ID NO: 5148830 - DNA, 14 bp, Homo sapiens
acccttctgtctgt

SEQ ID NO: 5148831 - DNA, 17 bp, Homo sapiens
acccttcttgcctgctg

SEQ ID NO: 5148832 - DNA, 16 bp, Homo sapiens
acccttctttcctctt

SEQ ID NO: 5148833 - DNA, 20 bp, Homo sapiens
acccttctttcctcttcccc

SEQ ID NO: 5148834 - DNA, 12 bp, Homo sapiens
acccttcttttc

SEQ ID NO: 5148835 - DNA, 14 bp, Homo sapiens
acccttcttttctc

SEQ ID NO: 5148836 - DNA, 18 bp, Homo sapiens
acccttgaagatgtagct

SEQ ID NO: 5148837 - DNA, 19 bp, Homo sapiens
acccttgaatttctagaca

SEQ ID NO: 5148838 - DNA, 16 bp, Homo sapiens
acccttgactgttatc

SEQ ID NO: 5148839 - DNA, 22 bp, Homo sapiens
acccttgactgttatctcggac

SEQ ID NO: 5148840 - DNA, 16 bp, Homo sapiens
acccttgacttaactt

SEQ ID NO: 5148841 - DNA, 16 bp, Homo sapiens
acccttgattcattct

SEQ ID NO: 5148842 - DNA, 22 bp, Homo sapiens
acccttgattttgccccctgag

SEQ ID NO: 5148843 - DNA, 14 bp, Homo sapiens
acccttgcattaga

SEQ ID NO: 5148844 - DNA, 16 bp, Homo sapiens
acccttgcccacccca

SEQ ID NO: 5148845 - DNA, 23 bp, Homo sapiens
acccttgcccggctgtgattgct

SEQ ID NO: 5148846 - DNA, 20 bp, Homo sapiens
acccttgccgtctacctgag

SEQ ID NO: 5148847 - DNA, 18 bp, Homo sapiens
acccttgcctgcctccta

SEQ ID NO: 5148848 - DNA, 14 bp, Homo sapiens
acccttgctgctgc

SEQ ID NO: 5148849 - DNA, 14 bp, Homo sapiens
acccttgctttcct

SEQ ID NO: 5148850 - DNA, 15 bp, Homo sapiens
acccttgctttcctg

SEQ ID NO: 5148851 - DNA, 19 bp, Homo sapiens
acccttgctttcctgggcc

SEQ ID NO: 5148852 - DNA, 20 bp, Homo sapiens
acccttgctttcctgggcct

SEQ ID NO: 5148853 - DNA, 18 bp, Homo sapiens
acccttggagctctgagt

SEQ ID NO: 5148854 - DNA, 21 bp, Homo sapiens
acccttggaggctgtcttctc

SEQ ID NO: 5148855 - DNA, 17 bp, Homo sapiens
acccttggcccatcccg

SEQ ID NO: 5148856 - DNA, 22 bp, Homo sapiens
acccttggcccatcccgccttc

SEQ ID NO: 5148857 - DNA, 21 bp, Homo sapiens
acccttggcctccatttctgt

SEQ ID NO: 5148858 - DNA, 12 bp, Homo sapiens
acccttggcctg

SEQ ID NO: 5148859 - DNA, 16 bp, Homo sapiens
acccttggcctgtcca

SEQ ID NO: 5148860 - DNA, 17 bp, Homo sapiens
acccttggctcaatcct

SEQ ID NO: 5148861 - DNA, 21 bp, Homo sapiens
acccttgggcagagtcctgcc

SEQ ID NO: 5148862 - DNA, 23 bp, Homo sapiens
acccttgggcagagtcctgcctt

SEQ ID NO: 5148863 - DNA, 16 bp, Homo sapiens
acccttgggccagaag

SEQ ID NO: 5148864 - DNA, 19 bp, Homo sapiens
acccttgggcctgggcctc

SEQ ID NO: 5148865 - DNA, 19 bp, Homo sapiens
acccttggggtggtgctgg

SEQ ID NO: 5148866 - DNA, 17 bp, Homo sapiens
acccttggtctcatgcc

SEQ ID NO: 5148867 - DNA, 21 bp, Homo sapiens
acccttggtttgcacataaaa

SEQ ID NO: 5148868 - DNA, 18 bp, Homo sapiens
acccttgtcatctctctg

SEQ ID NO: 5148869 - DNA, 20 bp, Homo sapiens
accctttagccaaacccttg

SEQ ID NO: 5148870 - DNA, 15 bp, Homo sapiens
accctttagtgcttt

SEQ ID NO: 5148871 - DNA, 16 bp, Homo sapiens
accctttatctctgta

SEQ ID NO: 5148872 - DNA, 16 bp, Homo sapiens
accctttattctcact

SEQ ID NO: 5148873 - DNA, 14 bp, Homo sapiens
accctttcaccccc

SEQ ID NO: 5148874 - DNA, 22 bp, Homo sapiens
accctttccaacccctttgctg

SEQ ID NO: 5148875 - DNA, 21 bp, Homo sapiens
accctttccaggttctgaaag

SEQ ID NO: 5148876 - DNA, 20 bp, Homo sapiens
accctttcccccttctctta

SEQ ID NO: 5148877 - DNA, 14 bp, Homo sapiens
accctttccttcct

SEQ ID NO: 5148878 - DNA, 21 bp, Homo sapiens
accctttccttccttccctgg

SEQ ID NO: 5148879 - DNA, 22 bp, Homo sapiens
accctttccttccttccctggc

SEQ ID NO: 5148880 - DNA, 23 bp, Homo sapiens
accctttccttccttccctggct

SEQ ID NO: 5148881 - DNA, 19 bp, Homo sapiens
accctttcgctggctttcc

SEQ ID NO: 5148882 - DNA, 19 bp, Homo sapiens
accctttctacttccaaga

SEQ ID NO: 5148883 - DNA, 14 bp, Homo sapiens
accctttctggcac

SEQ ID NO: 5148884 - DNA, 15 bp, Homo sapiens
accctttctggcacg

SEQ ID NO: 5148885 - DNA, 14 bp, Homo sapiens
accctttcttcaat

SEQ ID NO: 5148886 - DNA, 17 bp, Homo sapiens
accctttcttcagctct

SEQ ID NO: 5148887 - DNA, 17 bp, Homo sapiens
accctttcttgacaaaa

SEQ ID NO: 5148888 - DNA, 12 bp, Homo sapiens
accctttgcccc

SEQ ID NO: 5148889 - DNA, 22 bp, Homo sapiens
accctttgctgtgaggctgtcc

SEQ ID NO: 5148890 - DNA, 12 bp, Homo sapiens
accctttggggg

SEQ ID NO: 5148891 - DNA, 13 bp, Homo sapiens
accctttgggggt

SEQ ID NO: 5148892 - DNA, 20 bp, Homo sapiens
accctttgtattataattgt

SEQ ID NO: 5148893 - DNA, 17 bp, Homo sapiens
acccttttaaagttgat

SEQ ID NO: 5148894 - DNA, 23 bp, Homo sapiens
acccttttaagtttaaaatgtgt

SEQ ID NO: 5148895 - DNA, 11 bp, Homo sapiens
acccttttcat

SEQ ID NO: 5148896 - DNA, 18 bp, Homo sapiens
acccttttcccccttccc

SEQ ID NO: 5148897 - DNA, 13 bp, Homo sapiens
acccttttccttt

SEQ ID NO: 5148898 - DNA, 10 bp, Homo sapiens
acccttttct

SEQ ID NO: 5148899 - DNA, 13 bp, Homo sapiens
acccttttctcag

SEQ ID NO: 5148900 - DNA, 15 bp, Homo sapiens
acccttttctgatcg

SEQ ID NO: 5148901 - DNA, 21 bp, Homo sapiens
acccttttctgatcgtctcgg

SEQ ID NO: 5148902 - DNA, 23 bp, Homo sapiens
acccttttctgatcgtctcggcc

SEQ ID NO: 5148903 - DNA, 20 bp, Homo sapiens
accgaaaacgtggctgcttc

SEQ ID NO: 5148904 - DNA, 17 bp, Homo sapiens
accgaaactgacttgct

SEQ ID NO: 5148905 - DNA, 21 bp, Homo sapiens
acctgaattcgagacaggcag

SEQ ID NO: 5148906 - DNA, 15 bp, Homo sapiens
acctgaattgaaaga

SEQ ID NO: 5148907 - DNA, 19 bp, Homo sapiens
acctgaattttggctgtgt

SEQ ID NO: 5148908 - DNA, 16 bp, Homo sapiens
acctgacaacttctga

SEQ ID NO: 5148909 - DNA, 16 bp, Homo sapiens
acctgacaagcactgc

SEQ ID NO: 5148910 - DNA, 19 bp, Homo sapiens
acctgacaatggcagctag

SEQ ID NO: 5148911 - DNA, 21 bp, Homo sapiens
acctgacacaccaggcgctaa

SEQ ID NO: 5148912 - DNA, 20 bp, Homo sapiens
acctgacaccgtccctcagt

SEQ ID NO: 5148913 - DNA, 17 bp, Homo sapiens
acctgacactcccttgg

SEQ ID NO: 5148914 - DNA, 19 bp, Homo sapiens
acctgaccaacatggagaa

SEQ ID NO: 5148915 - DNA, 15 bp, Homo sapiens
acctgaccagaatgc

SEQ ID NO: 5148916 - DNA, 14 bp, Homo sapiens
acctgaccgtgggc

SEQ ID NO: 5148917 - DNA, 14 bp, Homo sapiens
acctgacctaacct

SEQ ID NO: 5148918 - DNA, 16 bp, Homo sapiens
acctgacctctgaaga

SEQ ID NO: 5148919 - DNA, 20 bp, Homo sapiens
acctgacctctgaagagctg

SEQ ID NO: 5148920 - DNA, 14 bp, Homo sapiens
acctgacctcttgc

SEQ ID NO: 5148921 - DNA, 15 bp, Homo sapiens
acctgacctcttgct

SEQ ID NO: 5148922 - DNA, 18 bp, Homo sapiens
acctgacctcttgctgtc

SEQ ID NO: 5148923 - DNA, 13 bp, Homo sapiens
acctgacgatctt

SEQ ID NO: 5148924 - DNA, 17 bp, Homo sapiens
acctgacgatcttcccc

SEQ ID NO: 5148925 - DNA, 18 bp, Homo sapiens
acctgacgatcttccccc

SEQ ID NO: 5148926 - DNA, 21 bp, Homo sapiens
acctgacgatcttcccccttc

SEQ ID NO: 5148927 - DNA, 19 bp, Homo sapiens
acctgacggacgtcctgct

SEQ ID NO: 5148928 - DNA, 17 bp, Homo sapiens
acctgacggctggggac

SEQ ID NO: 5148929 - DNA, 16 bp, Homo sapiens
acctgactaagaaatt

SEQ ID NO: 5148930 - DNA, 22 bp, Homo sapiens
acctgactcgtctgactgtgtg

SEQ ID NO: 5148931 - DNA, 13 bp, Homo sapiens
acctgactctgaa

SEQ ID NO: 5148932 - DNA, 22 bp, Homo sapiens
acctgactctgaaatctgaaga

SEQ ID NO: 5148933 - DNA, 16 bp, Homo sapiens
acctgacttggctggg

SEQ ID NO: 5148934 - DNA, 13 bp, Homo sapiens
acctgagaatgtg

SEQ ID NO: 5148935 - DNA, 23 bp, Homo sapiens
acctgagaccagttgggagcact

SEQ ID NO: 5148936 - DNA, 19 bp, Homo sapiens
acctgagaccctgggagag

SEQ ID NO: 5148937 - DNA, 21 bp, Homo sapiens
acctgagactgtcggagaggc

SEQ ID NO: 5148938 - DNA, 16 bp, Homo sapiens
acctgagactttcagt

SEQ ID NO: 5148939 - DNA, 22 bp, Homo sapiens
acctgagagcatctcaggaggg

SEQ ID NO: 5148940 - DNA, 14 bp, Homo sapiens
acctgagatggagc

SEQ ID NO: 5148941 - DNA, 21 bp, Homo sapiens
acctgagcccggatgcttctc

SEQ ID NO: 5148942 - DNA, 10 bp, Homo sapiens
acctgagcct

SEQ ID NO: 5148943 - DNA, 19 bp, Homo sapiens
acctgagccttttcttata

SEQ ID NO: 5148944 - DNA, 20 bp, Homo sapiens
acctgagccttttcttatat

SEQ ID NO: 5148945 - DNA, 19 bp, Homo sapiens
acctgagcgggagtcaggg

SEQ ID NO: 5148946 - DNA, 12 bp, Homo sapiens
acctgagctaaa

SEQ ID NO: 5148947 - DNA, 22 bp, Homo sapiens
acctgagctaaataaagatatt

SEQ ID NO: 5148948 - DNA, 20 bp, Homo sapiens
acctgagctagaagctggag

SEQ ID NO: 5148949 - DNA, 21 bp, Homo sapiens
acctgagctattttcctctgg

SEQ ID NO: 5148950 - DNA, 12 bp, Homo sapiens
acctgagctgcc

SEQ ID NO: 5148951 - DNA, 12 bp, Homo sapiens
acctgagctggc

SEQ ID NO: 5148952 - DNA, 18 bp, Homo sapiens
acctgagctggccaggcc

SEQ ID NO: 5148953 - DNA, 20 bp, Homo sapiens
acctgagctggccaggccct

SEQ ID NO: 5148954 - DNA, 21 bp, Homo sapiens
acctgagctttccgcgtcagc

SEQ ID NO: 5148955 - DNA, 23 bp, Homo sapiens
acctgagctttggacgcacacag

SEQ ID NO: 5148956 - DNA, 21 bp, Homo sapiens
acctgaggacatggcttctga

SEQ ID NO: 5148957 - DNA, 15 bp, Homo sapiens
acctgaggagacatc

SEQ ID NO: 5148958 - DNA, 23 bp, Homo sapiens
acctgaggcaggagggcatgtgc

SEQ ID NO: 5148959 - DNA, 13 bp, Homo sapiens
acctgaggcccag

SEQ ID NO: 5148960 - DNA, 14 bp, Homo sapiens
acctgaggctgtgg

SEQ ID NO: 5148961 - DNA, 22 bp, Homo sapiens
acctgaggtcgggagttggaga

SEQ ID NO: 5148962 - DNA, 13 bp, Homo sapiens
acctgaggtgggc

SEQ ID NO: 5148963 - DNA, 16 bp, Homo sapiens
acctgaggtgggccca

SEQ ID NO: 5148964 - DNA, 20 bp, Homo sapiens
acctgaggtgggctggggct

SEQ ID NO: 5148965 - DNA, 22 bp, Homo sapiens
acctgagtcaccctacctgtgc

SEQ ID NO: 5148966 - DNA, 21 bp, Homo sapiens
acctgagtcggccccacatgg

SEQ ID NO: 5148967 - DNA, 22 bp, Homo sapiens
acctgagtcggccccacatggg

SEQ ID NO: 5148968 - DNA, 16 bp, Homo sapiens
acctgagttcccggga

SEQ ID NO: 5148969 - DNA, 23 bp, Homo sapiens
acctgagttcccgggagctgggc

SEQ ID NO: 5148970 - DNA, 16 bp, Homo sapiens
acctgataagggagag

SEQ ID NO: 5148971 - DNA, 19 bp, Homo sapiens
acctgataagggagaggga

SEQ ID NO: 5148972 - DNA, 22 bp, Homo sapiens
acctgataagggagagggaaat

SEQ ID NO: 5148973 - DNA, 16 bp, Homo sapiens
acctgatacatttaca

SEQ ID NO: 5148974 - DNA, 16 bp, Homo sapiens
acctgatacggctccc

SEQ ID NO: 5148975 - DNA, 15 bp, Homo sapiens
acctgatcacctctg

SEQ ID NO: 5148976 - DNA, 19 bp, Homo sapiens
acctgatcactagcctgtc

SEQ ID NO: 5148977 - DNA, 22 bp, Homo sapiens
acctgatcctggaggcccagtt

SEQ ID NO: 5148978 - DNA, 19 bp, Homo sapiens
acctgatctggcccaagct

SEQ ID NO: 5148979 - DNA, 15 bp, Homo sapiens
acctgatgaaaataa

SEQ ID NO: 5148980 - DNA, 21 bp, Homo sapiens
acctgatgccccttccccaag

SEQ ID NO: 5148981 - DNA, 22 bp, Homo sapiens
acctgatggaagtaaagcctca

SEQ ID NO: 5148982 - DNA, 21 bp, Homo sapiens
acctgatggcacttagctatc

SEQ ID NO: 5148983 - DNA, 20 bp, Homo sapiens
acctgatgtcagctgctgtt

SEQ ID NO: 5148984 - DNA, 21 bp, Homo sapiens
acctgatgtcagctgctgttg

SEQ ID NO: 5148985 - DNA, 15 bp, Homo sapiens
acctgatgtgtacat

SEQ ID NO: 5148986 - DNA, 22 bp, Homo sapiens
acctgatgtgtacatcccatgt

SEQ ID NO: 5148987 - DNA, 22 bp, Homo sapiens
acctgattaactgaggcatcca

SEQ ID NO: 5148988 - DNA, 11 bp, Homo sapiens
acctgattcaa

SEQ ID NO: 5148989 - DNA, 19 bp, Homo sapiens
acctgattcaactaaaaaa

SEQ ID NO: 5148990 - DNA, 16 bp, Homo sapiens
acctgattgatcacac

SEQ ID NO: 5148991 - DNA, 15 bp, Homo sapiens
acctgattggccact

SEQ ID NO: 5148992 - DNA, 16 bp, Homo sapiens
acctgattggccactg

SEQ ID NO: 5148993 - DNA, 16 bp, Homo sapiens
acctgattgtaaactt

SEQ ID NO: 5148994 - DNA, 21 bp, Homo sapiens
acctgatttacagtttcaaaa

SEQ ID NO: 5148995 - DNA, 21 bp, Homo sapiens
acctgatttattgaaattttt

SEQ ID NO: 5148996 - DNA, 20 bp, Homo sapiens
acctgatttcagaagagact

SEQ ID NO: 5148997 - DNA, 20 bp, Homo sapiens
acctgattttttttcctttt

SEQ ID NO: 5148998 - DNA, 15 bp, Homo sapiens
acctgcaaaaaatac

SEQ ID NO: 5148999 - DNA, 15 bp, Homo sapiens
acctgcaaaaaatag

SEQ ID NO: 5149000 - DNA, 16 bp, Homo sapiens
acctgcaaaaatgagt

SEQ ID NO: 5149001 - DNA, 19 bp, Homo sapiens
acctgcaaaaatgagttgt

SEQ ID NO: 5149002 - DNA, 22 bp, Homo sapiens
acctgcaaacgcttcagttgtt

SEQ ID NO: 5149003 - DNA, 16 bp, Homo sapiens
acctgcaaagatctgt

SEQ ID NO: 5149004 - DNA, 10 bp, Homo sapiens
acctgcaaga

SEQ ID NO: 5149005 - DNA, 21 bp, Homo sapiens
acctgcaagccccagggcctg

SEQ ID NO: 5149006 - DNA, 23 bp, Homo sapiens
acctgcaagccccagggcctggg

SEQ ID NO: 5149007 - DNA, 20 bp, Homo sapiens
acctgcaaggcaaagtaaaa

SEQ ID NO: 5149008 - DNA, 18 bp, Homo sapiens
acctgcaagtatccagac

SEQ ID NO: 5149009 - DNA, 14 bp, Homo sapiens
acctgcaagtgccc

SEQ ID NO: 5149010 - DNA, 20 bp, Homo sapiens
acctgcaagtgcccgccctg

SEQ ID NO: 5149011 - DNA, 21 bp, Homo sapiens
acctgcaagttgctctgacct

SEQ ID NO: 5149012 - DNA, 18 bp, Homo sapiens
acctgcaatcccagctac

SEQ ID NO: 5149013 - DNA, 19 bp, Homo sapiens
acctgcacaaacatagaca

SEQ ID NO: 5149014 - DNA, 15 bp, Homo sapiens
acctgcacacaggac

SEQ ID NO: 5149015 - DNA, 16 bp, Homo sapiens
acctgcacacaggaca

SEQ ID NO: 5149016 - DNA, 15 bp, Homo sapiens
acctgcacacccctg

SEQ ID NO: 5149017 - DNA, 21 bp, Homo sapiens
acctgcacaccgtccctctcc

SEQ ID NO: 5149018 - DNA, 11 bp, Homo sapiens
acctgcacact

SEQ ID NO: 5149019 - DNA, 18 bp, Homo sapiens
acctgcacactccatctc

SEQ ID NO: 5149020 - DNA, 20 bp, Homo sapiens
acctgcacactccatctcct

SEQ ID NO: 5149021 - DNA, 12 bp, Homo sapiens
acctgcacaggc

SEQ ID NO: 5149022 - DNA, 14 bp, Homo sapiens
acctgcacaggctt

SEQ ID NO: 5149023 - DNA, 17 bp, Homo sapiens
acctgcacaggcttgct

SEQ ID NO: 5149024 - DNA, 14 bp, Homo sapiens
acctgcacctcccc

SEQ ID NO: 5149025 - DNA, 15 bp, Homo sapiens
acctgcacctccccc

SEQ ID NO: 5149026 - DNA, 16 bp, Homo sapiens
acctgcacctcccccc

SEQ ID NO: 5149027 - DNA, 17 bp, Homo sapiens
acctgcacctcccccca

SEQ ID NO: 5149028 - DNA, 19 bp, Homo sapiens
acctgcacctccccccact

SEQ ID NO: 5149029 - DNA, 22 bp, Homo sapiens
acctgcacctccccccactgca

SEQ ID NO: 5149030 - DNA, 18 bp, Homo sapiens
acctgcactaacagagtg

SEQ ID NO: 5149031 - DNA, 12 bp, Homo sapiens
acctgcactcca

SEQ ID NO: 5149032 - DNA, 10 bp, Homo sapiens
acctgcactg

SEQ ID NO: 5149033 - DNA, 11 bp, Homo sapiens
acctgcactga

SEQ ID NO: 5149034 - DNA, 15 bp, Homo sapiens
acctgcacttggcct

SEQ ID NO: 5149035 - DNA, 17 bp, Homo sapiens
acctgcacttggcctct

SEQ ID NO: 5149036 - DNA, 14 bp, Homo sapiens
acctgcagaaacag

SEQ ID NO: 5149037 - DNA, 13 bp, Homo sapiens
acctgcagcccca

SEQ ID NO: 5149038 - DNA, 19 bp, Homo sapiens
acctgcagccccaggcctc

SEQ ID NO: 5149039 - DNA, 14 bp, Homo sapiens
acctgcagcctccc

SEQ ID NO: 5149040 - DNA, 15 bp, Homo sapiens
acctgcaggccaaga

SEQ ID NO: 5149041 - DNA, 19 bp, Homo sapiens
acctgcaggccaagagcag

SEQ ID NO: 5149042 - DNA, 13 bp, Homo sapiens
acctgcaggcggg

SEQ ID NO: 5149043 - DNA, 16 bp, Homo sapiens
acctgcaggcggggct

SEQ ID NO: 5149044 - DNA, 18 bp, Homo sapiens
acctgcaggcggggctcc

SEQ ID NO: 5149045 - DNA, 21 bp, Homo sapiens
acctgcaggcggggctcctcc

SEQ ID NO: 5149046 - DNA, 13 bp, Homo sapiens
acctgcaggctcc

SEQ ID NO: 5149047 - DNA, 17 bp, Homo sapiens
acctgcaggctccatgc

SEQ ID NO: 5149048 - DNA, 19 bp, Homo sapiens
acctgcaggctccatgcac

SEQ ID NO: 5149049 - DNA, 17 bp, Homo sapiens
acctgcaggctcccgag

SEQ ID NO: 5149050 - DNA, 21 bp, Homo sapiens
acctgcaggcttaggtcctca

SEQ ID NO: 5149051 - DNA, 17 bp, Homo sapiens
acctgcaggttgggcca

SEQ ID NO: 5149052 - DNA, 17 bp, Homo sapiens
acctgcagttcctgagt

SEQ ID NO: 5149053 - DNA, 15 bp, Homo sapiens
acctgcagttggcct

SEQ ID NO: 5149054 - DNA, 21 bp, Homo sapiens
acctgcagttggcctcagcag

SEQ ID NO: 5149055 - DNA, 14 bp, Homo sapiens
acctgcataaaaag

SEQ ID NO: 5149056 - DNA, 17 bp, Homo sapiens
acctgcatatctctagt

SEQ ID NO: 5149057 - DNA, 13 bp, Homo sapiens
acctgcatattgt

SEQ ID NO: 5149058 - DNA, 18 bp, Homo sapiens
acctgcatcagcctctgg

SEQ ID NO: 5149059 - DNA, 23 bp, Homo sapiens
acctgcatcagcctctggccaga

SEQ ID NO: 5149060 - DNA, 15 bp, Homo sapiens
acctgcatcattccc

SEQ ID NO: 5149061 - DNA, 19 bp, Homo sapiens
acctgcatccgtagttccc

SEQ ID NO: 5149062 - DNA, 22 bp, Homo sapiens
acctgcatccgtagttccctga

SEQ ID NO: 5149063 - DNA, 18 bp, Homo sapiens
acctgcatccttcctggg

SEQ ID NO: 5149064 - DNA, 21 bp, Homo sapiens
acctgcatctaagcatctggg

SEQ ID NO: 5149065 - DNA, 17 bp, Homo sapiens
acctgcatctggggccc

SEQ ID NO: 5149066 - DNA, 15 bp, Homo sapiens
acctgcatgcagcaa

SEQ ID NO: 5149067 - DNA, 22 bp, Homo sapiens
acctgcatgcagcaacacccaa

SEQ ID NO: 5149068 - DNA, 19 bp, Homo sapiens
acctgcatggtcaagcctc

SEQ ID NO: 5149069 - DNA, 14 bp, Homo sapiens
acctgcatggtgtt

SEQ ID NO: 5149070 - DNA, 15 bp, Homo sapiens
acctgcattgtaaat

SEQ ID NO: 5149071 - DNA, 15 bp, Homo sapiens
acctgcatttttaaa

SEQ ID NO: 5149072 - DNA, 14 bp, Homo sapiens
acctgccaagaaga

SEQ ID NO: 5149073 - DNA, 16 bp, Homo sapiens
acctgccaaggagcat

SEQ ID NO: 5149074 - DNA, 20 bp, Homo sapiens
acctgccacaaaccaccagg

SEQ ID NO: 5149075 - DNA, 13 bp, Homo sapiens
acctgccaccaca

SEQ ID NO: 5149076 - DNA, 17 bp, Homo sapiens
acctgccaccacacaca

SEQ ID NO: 5149077 - DNA, 14 bp, Homo sapiens
acctgccaccccca

SEQ ID NO: 5149078 - DNA, 15 bp, Homo sapiens
acctgccacccccag

SEQ ID NO: 5149079 - DNA, 11 bp, Homo sapiens
acctgccaccg

SEQ ID NO: 5149080 - DNA, 21 bp, Homo sapiens
acctgccactaggctgggtgc

SEQ ID NO: 5149081 - DNA, 22 bp, Homo sapiens
acctgccactaggctgggtgcc

SEQ ID NO: 5149082 - DNA, 13 bp, Homo sapiens
acctgccactcac

SEQ ID NO: 5149083 - DNA, 16 bp, Homo sapiens
acctgccactcacaca

SEQ ID NO: 5149084 - DNA, 20 bp, Homo sapiens
accgaacatatcatttgtga

SEQ ID NO: 5149085 - DNA, 21 bp, Homo sapiens
accgaactgggcatatttcta

SEQ ID NO: 5149086 - DNA, 14 bp, Homo sapiens
accgaagagccctg

SEQ ID NO: 5149087 - DNA, 14 bp, Homo sapiens
accgaaggtgacag

SEQ ID NO: 5149088 - DNA, 15 bp, Homo sapiens
accgaataaatgttt

SEQ ID NO: 5149089 - DNA, 19 bp, Homo sapiens
accgaatatattactgatt

SEQ ID NO: 5149090 - DNA, 16 bp, Homo sapiens
accgaatgtgtcttta

SEQ ID NO: 5149091 - DNA, 12 bp, Homo sapiens
accgaattttat

SEQ ID NO: 5149092 - DNA, 11 bp, Homo sapiens
accgacaagca

SEQ ID NO: 5149093 - DNA, 18 bp, Homo sapiens
accgacatttttcaataa

SEQ ID NO: 5149094 - DNA, 20 bp, Homo sapiens
accgacatttttcaataaag

SEQ ID NO: 5149095 - DNA, 15 bp, Homo sapiens
accgaccaactgccc

SEQ ID NO: 5149096 - DNA, 17 bp, Homo sapiens
accgaccatcgtccagc

SEQ ID NO: 5149097 - DNA, 21 bp, Homo sapiens
accgaccatcgtccagccctc

SEQ ID NO: 5149098 - DNA, 16 bp, Homo sapiens
accgacccgaggccca

SEQ ID NO: 5149099 - DNA, 17 bp, Homo sapiens
accgacccgaggcccag

SEQ ID NO: 5149100 - DNA, 20 bp, Homo sapiens
accgacccgaggcccagatc

SEQ ID NO: 5149101 - DNA, 14 bp, Homo sapiens
accgacccttcctg

SEQ ID NO: 5149102 - DNA, 13 bp, Homo sapiens
accgacgcccctc

SEQ ID NO: 5149103 - DNA, 18 bp, Homo sapiens
accgacgcgtctcctgtt

SEQ ID NO: 5149104 - DNA, 15 bp, Homo sapiens
accgactaccccagt

SEQ ID NO: 5149105 - DNA, 23 bp, Homo sapiens
accgactcatttacaactgaaac

SEQ ID NO: 5149106 - DNA, 13 bp, Homo sapiens
accgagacccacc

SEQ ID NO: 5149107 - DNA, 18 bp, Homo sapiens
accgagacggctggacct

SEQ ID NO: 5149108 - DNA, 19 bp, Homo sapiens
accgagactcagcctctgc

SEQ ID NO: 5149109 - DNA, 23 bp, Homo sapiens
accgagagccaaacagagcccag

SEQ ID NO: 5149110 - DNA, 21 bp, Homo sapiens
accgagaggaaaaaggcttct

SEQ ID NO: 5149111 - DNA, 19 bp, Homo sapiens
accgagataggggaggggg

SEQ ID NO: 5149112 - DNA, 17 bp, Homo sapiens
accgagatgtgagtcct

SEQ ID NO: 5149113 - DNA, 19 bp, Homo sapiens
accgagatgtgagtcctgt

SEQ ID NO: 5149114 - DNA, 24 bp, Homo sapiens
accgagatgtgagtcctgttgaag

SEQ ID NO: 5149115 - DNA, 15 bp, Homo sapiens
accgagcaaagatca

SEQ ID NO: 5149116 - DNA, 15 bp, Homo sapiens
accgagcagggctgt

SEQ ID NO: 5149117 - DNA, 16 bp, Homo sapiens
accgagccagcagctg

SEQ ID NO: 5149118 - DNA, 13 bp, Homo sapiens
accgagcccagca

SEQ ID NO: 5149119 - DNA, 12 bp, Homo sapiens
accgagccctgg

SEQ ID NO: 5149120 - DNA, 15 bp, Homo sapiens
accgagccctggaga

SEQ ID NO: 5149121 - DNA, 17 bp, Homo sapiens
accgagccctggagagc

SEQ ID NO: 5149122 - DNA, 14 bp, Homo sapiens
accgagctggagcg

SEQ ID NO: 5149123 - DNA, 19 bp, Homo sapiens
accgaggaacaacttggaa

SEQ ID NO: 5149124 - DNA, 16 bp, Homo sapiens
accgaggactccaggg

SEQ ID NO: 5149125 - DNA, 15 bp, Homo sapiens
accgaggagggagag

SEQ ID NO: 5149126 - DNA, 23 bp, Homo sapiens
accgaggagggagagtctcccag

SEQ ID NO: 5149127 - DNA, 16 bp, Homo sapiens
accgaggcgcgggggc

SEQ ID NO: 5149128 - DNA, 18 bp, Homo sapiens
accgaggctacagctcca

SEQ ID NO: 5149129 - DNA, 18 bp, Homo sapiens
accgaggctggagctggc

SEQ ID NO: 5149130 - DNA, 14 bp, Homo sapiens
accgaggggccttt

SEQ ID NO: 5149131 - DNA, 15 bp, Homo sapiens
accgaggggcctttg

SEQ ID NO: 5149132 - DNA, 16 bp, Homo sapiens
accgaggtgttgccag

SEQ ID NO: 5149133 - DNA, 23 bp, Homo sapiens
accgagtatctgtaacccttgaa

SEQ ID NO: 5149134 - DNA, 16 bp, Homo sapiens
accgagtctcttctcc

SEQ ID NO: 5149135 - DNA, 17 bp, Homo sapiens
accgagtgtggagctgc

SEQ ID NO: 5149136 - DNA, 18 bp, Homo sapiens
accgagtgtggagctgct

SEQ ID NO: 5149137 - DNA, 14 bp, Homo sapiens
accgataatgcatg

SEQ ID NO: 5149138 - DNA, 15 bp, Homo sapiens
accgatattagtcct

SEQ ID NO: 5149139 - DNA, 19 bp, Homo sapiens
accgatgatactgtttctt

SEQ ID NO: 5149140 - DNA, 23 bp, Homo sapiens
accgatgctccagccaacccctg

SEQ ID NO: 5149141 - DNA, 15 bp, Homo sapiens
accgatggtcccagg

SEQ ID NO: 5149142 - DNA, 19 bp, Homo sapiens
accgatttcagcacatgca

SEQ ID NO: 5149143 - DNA, 15 bp, Homo sapiens
accgatttctgctaa

SEQ ID NO: 5149144 - DNA, 15 bp, Homo sapiens
accgcaactcacaca

SEQ ID NO: 5149145 - DNA, 16 bp, Homo sapiens
accgcaactcacacat

SEQ ID NO: 5149146 - DNA, 12 bp, Homo sapiens
accgcacagctc

SEQ ID NO: 5149147 - DNA, 15 bp, Homo sapiens
accgcaccccatccc

SEQ ID NO: 5149148 - DNA, 15 bp, Homo sapiens
accgcaccgggctgg

SEQ ID NO: 5149149 - DNA, 21 bp, Homo sapiens
accgcaccgggctggcctgac

SEQ ID NO: 5149150 - DNA, 12 bp, Homo sapiens
accgcagaagga

SEQ ID NO: 5149151 - DNA, 14 bp, Homo sapiens
accgcagaaggaag

SEQ ID NO: 5149152 - DNA, 23 bp, Homo sapiens
accgcagccagccggtgcctggc

SEQ ID NO: 5149153 - DNA, 16 bp, Homo sapiens
accgcagcctctgccc

SEQ ID NO: 5149154 - DNA, 14 bp, Homo sapiens
accgcagcgtcccc

SEQ ID NO: 5149155 - DNA, 19 bp, Homo sapiens
accgcagcgtcccccgccg

SEQ ID NO: 5149156 - DNA, 16 bp, Homo sapiens
accgcagctgctgcca

SEQ ID NO: 5149157 - DNA, 20 bp, Homo sapiens
accgcagctgctgccactct

SEQ ID NO: 5149158 - DNA, 14 bp, Homo sapiens
accgcaggaagctg

SEQ ID NO: 5149159 - DNA, 19 bp, Homo sapiens
accgcaggaagctgctccg

SEQ ID NO: 5149160 - DNA, 14 bp, Homo sapiens
accgcaggagggca

SEQ ID NO: 5149161 - DNA, 21 bp, Homo sapiens
accgcaggggactgtctcaga

SEQ ID NO: 5149162 - DNA, 19 bp, Homo sapiens
accgcaggtgctcatgctg

SEQ ID NO: 5149163 - DNA, 13 bp, Homo sapiens
accgcagtcacca

SEQ ID NO: 5149164 - DNA, 22 bp, Homo sapiens
accgcagtcgtcgcacagtctc

SEQ ID NO: 5149165 - DNA, 15 bp, Homo sapiens
accgcatatgcatgc

SEQ ID NO: 5149166 - DNA, 18 bp, Homo sapiens
accgcatatgcatgccag

SEQ ID NO: 5149167 - DNA, 20 bp, Homo sapiens
accgcatatgcatgccaggc

SEQ ID NO: 5149168 - DNA, 15 bp, Homo sapiens
accgcatcctcactg

SEQ ID NO: 5149169 - DNA, 19 bp, Homo sapiens
accgcatcctcactgggct

SEQ ID NO: 5149170 - DNA, 13 bp, Homo sapiens
accgcatcctcca

SEQ ID NO: 5149171 - DNA, 14 bp, Homo sapiens
accgcatcctccag

SEQ ID NO: 5149172 - DNA, 15 bp, Homo sapiens
accgcatctgctcat

SEQ ID NO: 5149173 - DNA, 22 bp, Homo sapiens
accgcatgccccctcgtgccag

SEQ ID NO: 5149174 - DNA, 17 bp, Homo sapiens
accgcatggcagctggg

SEQ ID NO: 5149175 - DNA, 18 bp, Homo sapiens
accgcatggcagctgggc

SEQ ID NO: 5149176 - DNA, 20 bp, Homo sapiens
accgcatggcagctgggccc

SEQ ID NO: 5149177 - DNA, 17 bp, Homo sapiens
accgccacatggcttcc

SEQ ID NO: 5149178 - DNA, 20 bp, Homo sapiens
accgccaccccactgagagc

SEQ ID NO: 5149179 - DNA, 17 bp, Homo sapiens
accgccagatggggcct

SEQ ID NO: 5149180 - DNA, 12 bp, Homo sapiens
accgccagcagc

SEQ ID NO: 5149181 - DNA, 13 bp, Homo sapiens
accgccagctctg

SEQ ID NO: 5149182 - DNA, 19 bp, Homo sapiens
accgccatcctctgcctca

SEQ ID NO: 5149183 - DNA, 12 bp, Homo sapiens
accgccatgcaa

SEQ ID NO: 5149184 - DNA, 15 bp, Homo sapiens
accgcccacccagca

SEQ ID NO: 5149185 - DNA, 16 bp, Homo sapiens
accgcccacccagcag

SEQ ID NO: 5149186 - DNA, 17 bp, Homo sapiens
accgcccacccagcagc

SEQ ID NO: 5149187 - DNA, 22 bp, Homo sapiens
accgcccacccagcagcgcccg

SEQ ID NO: 5149188 - DNA, 12 bp, Homo sapiens
accgcccactct

SEQ ID NO: 5149189 - DNA, 20 bp, Homo sapiens
accgcccagcggcttgcctg

SEQ ID NO: 5149190 - DNA, 20 bp, Homo sapiens
accgccccaaagtaaaagaa

SEQ ID NO: 5149191 - DNA, 14 bp, Homo sapiens
accgcccccacccc

SEQ ID NO: 5149192 - DNA, 12 bp, Homo sapiens
accgccccctcc

SEQ ID NO: 5149193 - DNA, 15 bp, Homo sapiens
accgcccctggccgc

SEQ ID NO: 5149194 - DNA, 16 bp, Homo sapiens
accgcccctggccgcg

SEQ ID NO: 5149195 - DNA, 15 bp, Homo sapiens
accgcccgtctgtgt

SEQ ID NO: 5149196 - DNA, 14 bp, Homo sapiens
accgccctcctcca

SEQ ID NO: 5149197 - DNA, 19 bp, Homo sapiens
accgccctgcgggccacag

SEQ ID NO: 5149198 - DNA, 13 bp, Homo sapiens
accgccctgggct

SEQ ID NO: 5149199 - DNA, 16 bp, Homo sapiens
accgcccttttcccct

SEQ ID NO: 5149200 - DNA, 18 bp, Homo sapiens
accgcccttttcccctac

SEQ ID NO: 5149201 - DNA, 18 bp, Homo sapiens
accgccgactttgtaccc

SEQ ID NO: 5149202 - DNA, 16 bp, Homo sapiens
accgccgcagaagcag

SEQ ID NO: 5149203 - DNA, 20 bp, Homo sapiens
accgccggggtcctgggagg

SEQ ID NO: 5149204 - DNA, 15 bp, Homo sapiens
accgcctagtttact

SEQ ID NO: 5149205 - DNA, 15 bp, Homo sapiens
accgcctcctgctct

SEQ ID NO: 5149206 - DNA, 11 bp, Homo sapiens
accgcctgccc

SEQ ID NO: 5149207 - DNA, 17 bp, Homo sapiens
accgcctgcccccagcg

SEQ ID NO: 5149208 - DNA, 23 bp, Homo sapiens
accgcctgccctgcctgggcctt

SEQ ID NO: 5149209 - DNA, 13 bp, Homo sapiens
accgcctgcttca

SEQ ID NO: 5149210 - DNA, 22 bp, Homo sapiens
accgcctgcttcacacccctca

SEQ ID NO: 5149211 - DNA, 12 bp, Homo sapiens
accgcctggccc

SEQ ID NO: 5149212 - DNA, 16 bp, Homo sapiens
accgcctggccctccc

SEQ ID NO: 5149213 - DNA, 12 bp, Homo sapiens
accgccttctct

SEQ ID NO: 5149214 - DNA, 13 bp, Homo sapiens
accgcgcccagcc

SEQ ID NO: 5149215 - DNA, 23 bp, Homo sapiens
accgcgcccctctgcgccccagc

SEQ ID NO: 5149216 - DNA, 19 bp, Homo sapiens
accgcgccctcctgcccac

SEQ ID NO: 5149217 - DNA, 19 bp, Homo sapiens
accgcggacgtgctggcct

SEQ ID NO: 5149218 - DNA, 17 bp, Homo sapiens
accgcgtctaccctggg

SEQ ID NO: 5149219 - DNA, 13 bp, Homo sapiens
accgctaaaagaa

SEQ ID NO: 5149220 - DNA, 15 bp, Homo sapiens
accgctaaaagaaac

SEQ ID NO: 5149221 - DNA, 16 bp, Homo sapiens
accgctaaaagaaact

SEQ ID NO: 5149222 - DNA, 17 bp, Homo sapiens
accgctacaccactctg

SEQ ID NO: 5149223 - DNA, 13 bp, Homo sapiens
accgctcagtatt

SEQ ID NO: 5149224 - DNA, 12 bp, Homo sapiens
accgctcagtgt

SEQ ID NO: 5149225 - DNA, 14 bp, Homo sapiens
accgctccccacag

SEQ ID NO: 5149226 - DNA, 23 bp, Homo sapiens
accgctccccacagctttgcacc

SEQ ID NO: 5149227 - DNA, 15 bp, Homo sapiens
accgctccccagccc

SEQ ID NO: 5149228 - DNA, 17 bp, Homo sapiens
accgctccccagcccag

SEQ ID NO: 5149229 - DNA, 19 bp, Homo sapiens
accgctccccagcccaggg

SEQ ID NO: 5149230 - DNA, 21 bp, Homo sapiens
accgctcccctctcctccgcc

SEQ ID NO: 5149231 - DNA, 20 bp, Homo sapiens
accgctctcttttctgtact

SEQ ID NO: 5149232 - DNA, 22 bp, Homo sapiens
accgctctcttttctgtacttc

SEQ ID NO: 5149233 - DNA, 13 bp, Homo sapiens
accgctgaatatg

SEQ ID NO: 5149234 - DNA, 20 bp, Homo sapiens
accgctgagaggctgcctcc

SEQ ID NO: 5149235 - DNA, 20 bp, Homo sapiens
accgctgccttttgctgctg

SEQ ID NO: 5149236 - DNA, 19 bp, Homo sapiens
accgctggccctgccgttt

SEQ ID NO: 5149237 - DNA, 18 bp, Homo sapiens
accgctggcccttagaga

SEQ ID NO: 5149238 - DNA, 17 bp, Homo sapiens
accgctgggtggttttt

SEQ ID NO: 5149239 - DNA, 19 bp, Homo sapiens
accgctgggttctgactct

SEQ ID NO: 5149240 - DNA, 15 bp, Homo sapiens
accgcttcacccctg

SEQ ID NO: 5149241 - DNA, 17 bp, Homo sapiens
accgcttcacccctgca

SEQ ID NO: 5149242 - DNA, 14 bp, Homo sapiens
accgcttcccagag

SEQ ID NO: 5149243 - DNA, 18 bp, Homo sapiens
accgcttgtggggaccca

SEQ ID NO: 5149244 - DNA, 14 bp, Homo sapiens
accgctttggcctg

SEQ ID NO: 5149245 - DNA, 16 bp, Homo sapiens
accgctttggcctgag

SEQ ID NO: 5149246 - DNA, 11 bp, Homo sapiens
accgcttttgg

SEQ ID NO: 5149247 - DNA, 17 bp, Homo sapiens
accggaagctcctggta

SEQ ID NO: 5149248 - DNA, 23 bp, Homo sapiens
accggaaggaggccaaccagccc

SEQ ID NO: 5149249 - DNA, 16 bp, Homo sapiens
accggaattgagaggt

SEQ ID NO: 5149250 - DNA, 15 bp, Homo sapiens
accggaccagcctgg

SEQ ID NO: 5149251 - DNA, 18 bp, Homo sapiens
accggacgcatgcagggc

SEQ ID NO: 5149252 - DNA, 19 bp, Homo sapiens
accggacgcatgcagggcc

SEQ ID NO: 5149253 - DNA, 20 bp, Homo sapiens
accggacgcatgcagggccc

SEQ ID NO: 5149254 - DNA, 19 bp, Homo sapiens
accggagagtgggggtggg

SEQ ID NO: 5149255 - DNA, 13 bp, Homo sapiens
accggagctccag

SEQ ID NO: 5149256 - DNA, 18 bp, Homo sapiens
accggatgctgtgcctgg

SEQ ID NO: 5149257 - DNA, 14 bp, Homo sapiens
accggattctctct

SEQ ID NO: 5149258 - DNA, 17 bp, Homo sapiens
accggcaacctgtaact

SEQ ID NO: 5149259 - DNA, 15 bp, Homo sapiens
accggcactcatgac

SEQ ID NO: 5149260 - DNA, 23 bp, Homo sapiens
accggcactcatgacggcctgcc

SEQ ID NO: 5149261 - DNA, 13 bp, Homo sapiens
accggcagagctc

SEQ ID NO: 5149262 - DNA, 16 bp, Homo sapiens
accggcatgctggcct

SEQ ID NO: 5149263 - DNA, 18 bp, Homo sapiens
accggcatgctggcctgt

SEQ ID NO: 5149264 - DNA, 20 bp, Homo sapiens
accggcatgctggcctgtgg

SEQ ID NO: 5149265 - DNA, 22 bp, Homo sapiens
acctgccactcacacagccagg

SEQ ID NO: 5149266 - DNA, 12 bp, Homo sapiens
acctgccagcca

SEQ ID NO: 5149267 - DNA, 14 bp, Homo sapiens
acctgccagccatc

SEQ ID NO: 5149268 - DNA, 17 bp, Homo sapiens
acctgccagccatcaca

SEQ ID NO: 5149269 - DNA, 21 bp, Homo sapiens
acctgccagcctggcttctgg

SEQ ID NO: 5149270 - DNA, 14 bp, Homo sapiens
acctgccaggaagc

SEQ ID NO: 5149271 - DNA, 15 bp, Homo sapiens
acctgccaggaagcc

SEQ ID NO: 5149272 - DNA, 17 bp, Homo sapiens
acctgccaggaagccag

SEQ ID NO: 5149273 - DNA, 18 bp, Homo sapiens
acctgccaggaagccagc

SEQ ID NO: 5149274 - DNA, 23 bp, Homo sapiens
acctgccaggaagccagcaggct

SEQ ID NO: 5149275 - DNA, 15 bp, Homo sapiens
acctgccaggcaggg

SEQ ID NO: 5149276 - DNA, 16 bp, Homo sapiens
acctgccaggctgcag

SEQ ID NO: 5149277 - DNA, 18 bp, Homo sapiens
acctgccaggctgcaggg

SEQ ID NO: 5149278 - DNA, 12 bp, Homo sapiens
acctgccaggga

SEQ ID NO: 5149279 - DNA, 16 bp, Homo sapiens
acctgccagggacaga

SEQ ID NO: 5149280 - DNA, 13 bp, Homo sapiens
acctgccagggag

SEQ ID NO: 5149281 - DNA, 21 bp, Homo sapiens
acctgccagggagacagagct

SEQ ID NO: 5149282 - DNA, 15 bp, Homo sapiens
acctgccatttgcac

SEQ ID NO: 5149283 - DNA, 13 bp, Homo sapiens
acctgcccaacct

SEQ ID NO: 5149284 - DNA, 21 bp, Homo sapiens
acctgcccaacctgctctcct

SEQ ID NO: 5149285 - DNA, 22 bp, Homo sapiens
acctgcccagatcccagaagga

SEQ ID NO: 5149286 - DNA, 14 bp, Homo sapiens
acctgcccatgtcc

SEQ ID NO: 5149287 - DNA, 20 bp, Homo sapiens
acctgcccatgtccagaggg

SEQ ID NO: 5149288 - DNA, 11 bp, Homo sapiens
acctgccccag

SEQ ID NO: 5149289 - DNA, 14 bp, Homo sapiens
acctgccccagcac

SEQ ID NO: 5149290 - DNA, 13 bp, Homo sapiens
acctgccccagcg

SEQ ID NO: 5149291 - DNA, 19 bp, Homo sapiens
acctgccccagcgcggctt

SEQ ID NO: 5149292 - DNA, 15 bp, Homo sapiens
acctgcccccacagc

SEQ ID NO: 5149293 - DNA, 18 bp, Homo sapiens
acctgcccccactcagca

SEQ ID NO: 5149294 - DNA, 19 bp, Homo sapiens
acctgcccccactcagcat

SEQ ID NO: 5149295 - DNA, 13 bp, Homo sapiens
acctgccccctgg

SEQ ID NO: 5149296 - DNA, 15 bp, Homo sapiens
acctgcccccttctc

SEQ ID NO: 5149297 - DNA, 19 bp, Homo sapiens
acctgcccccttctcccac

SEQ ID NO: 5149298 - DNA, 20 bp, Homo sapiens
acctgcccccttctcccaca

SEQ ID NO: 5149299 - DNA, 22 bp, Homo sapiens
acctgcccccttctcccacact

SEQ ID NO: 5149300 - DNA, 23 bp, Homo sapiens
acctgccccgcccagctgcacct

SEQ ID NO: 5149301 - DNA, 20 bp, Homo sapiens
acctgccccggacctacctc

SEQ ID NO: 5149302 - DNA, 23 bp, Homo sapiens
acctgccccggacctacctccct

SEQ ID NO: 5149303 - DNA, 19 bp, Homo sapiens
acctgccccgtagagaatg

SEQ ID NO: 5149304 - DNA, 22 bp, Homo sapiens
acctgccccgtgtgtgtggccg

SEQ ID NO: 5149305 - DNA, 14 bp, Homo sapiens
acctgcccctcccc

SEQ ID NO: 5149306 - DNA, 18 bp, Homo sapiens
acctgcccctcctctctg

SEQ ID NO: 5149307 - DNA, 20 bp, Homo sapiens
acctgcccctcctctctgcc

SEQ ID NO: 5149308 - DNA, 14 bp, Homo sapiens
acctgcccctctgt

SEQ ID NO: 5149309 - DNA, 15 bp, Homo sapiens
acctgcccctctgtt

SEQ ID NO: 5149310 - DNA, 16 bp, Homo sapiens
acctgcccctctgttc

SEQ ID NO: 5149311 - DNA, 18 bp, Homo sapiens
acctgcccctctgttctc

SEQ ID NO: 5149312 - DNA, 11 bp, Homo sapiens
acctgcccctg

SEQ ID NO: 5149313 - DNA, 17 bp, Homo sapiens
acctgcccctgccgcct

SEQ ID NO: 5149314 - DNA, 15 bp, Homo sapiens
acctgcccctgcctg

SEQ ID NO: 5149315 - DNA, 16 bp, Homo sapiens
acctgcccctgcctga

SEQ ID NO: 5149316 - DNA, 20 bp, Homo sapiens
acctgcccggcccaggagcg

SEQ ID NO: 5149317 - DNA, 15 bp, Homo sapiens
acctgccctcaaggg

SEQ ID NO: 5149318 - DNA, 23 bp, Homo sapiens
acctgccctctatttattagcca

SEQ ID NO: 5149319 - DNA, 17 bp, Homo sapiens
acctgccctctctcagt

SEQ ID NO: 5149320 - DNA, 12 bp, Homo sapiens
acctgccctgcc

SEQ ID NO: 5149321 - DNA, 17 bp, Homo sapiens
acctgccctgccctgcc

SEQ ID NO: 5149322 - DNA, 18 bp, Homo sapiens
acctgccctgccctgcca

SEQ ID NO: 5149323 - DNA, 22 bp, Homo sapiens
acctgccctgccctgccacctg

SEQ ID NO: 5149324 - DNA, 23 bp, Homo sapiens
acctgccctgccctgccacctgt

SEQ ID NO: 5149325 - DNA, 16 bp, Homo sapiens
acctgccctgcctgag

SEQ ID NO: 5149326 - DNA, 14 bp, Homo sapiens
acctgccctggaac

SEQ ID NO: 5149327 - DNA, 15 bp, Homo sapiens
acctgccctggaaca

SEQ ID NO: 5149328 - DNA, 23 bp, Homo sapiens
acctgccctggccccagccctac

SEQ ID NO: 5149329 - DNA, 22 bp, Homo sapiens
acctgcccttttttctgcctcc

SEQ ID NO: 5149330 - DNA, 16 bp, Homo sapiens
acctgccgccctgtgg

SEQ ID NO: 5149331 - DNA, 14 bp, Homo sapiens
acctgccggctctg

SEQ ID NO: 5149332 - DNA, 15 bp, Homo sapiens
acctgccggctctgg

SEQ ID NO: 5149333 - DNA, 17 bp, Homo sapiens
acctgccggctctgggc

SEQ ID NO: 5149334 - DNA, 17 bp, Homo sapiens
acctgcctaaattaaat

SEQ ID NO: 5149335 - DNA, 12 bp, Homo sapiens
acctgcctagct

SEQ ID NO: 5149336 - DNA, 18 bp, Homo sapiens
acctgcctagctcttggg

SEQ ID NO: 5149337 - DNA, 22 bp, Homo sapiens
acctgcctagctcttgggcctg

SEQ ID NO: 5149338 - DNA, 18 bp, Homo sapiens
acctgcctatccatcctg

SEQ ID NO: 5149339 - DNA, 21 bp, Homo sapiens
acctgcctatccatcctgcga

SEQ ID NO: 5149340 - DNA, 15 bp, Homo sapiens
acctgcctccaccag

SEQ ID NO: 5149341 - DNA, 19 bp, Homo sapiens
acctgcctccaccagcaag

SEQ ID NO: 5149342 - DNA, 19 bp, Homo sapiens
acctgcctccggcctgcac

SEQ ID NO: 5149343 - DNA, 18 bp, Homo sapiens
acctgcctcctcgttcct

SEQ ID NO: 5149344 - DNA, 20 bp, Homo sapiens
acctgcctcctcgttccttt

SEQ ID NO: 5149345 - DNA, 21 bp, Homo sapiens
acctgcctcggcctcccaaag

SEQ ID NO: 5149346 - DNA, 15 bp, Homo sapiens
acctgcctctaatct

SEQ ID NO: 5149347 - DNA, 11 bp, Homo sapiens
acctgcctctc

SEQ ID NO: 5149348 - DNA, 22 bp, Homo sapiens
acctgcctctgaactgctgctg

SEQ ID NO: 5149349 - DNA, 10 bp, Homo sapiens
acctgcctgc

SEQ ID NO: 5149350 - DNA, 22 bp, Homo sapiens
acctgcctgccccacacggact

SEQ ID NO: 5149351 - DNA, 14 bp, Homo sapiens
acctgcctgccctc

SEQ ID NO: 5149352 - DNA, 18 bp, Homo sapiens
acctgcctgccgctgcag

SEQ ID NO: 5149353 - DNA, 18 bp, Homo sapiens
acctgcctgcgtcttccg

SEQ ID NO: 5149354 - DNA, 22 bp, Homo sapiens
acctgcctgcgtcttccgcccc

SEQ ID NO: 5149355 - DNA, 15 bp, Homo sapiens
acctgcctggccggc

SEQ ID NO: 5149356 - DNA, 20 bp, Homo sapiens
acctgcctgggacagccact

SEQ ID NO: 5149357 - DNA, 22 bp, Homo sapiens
acctgcctgggacagccactgg

SEQ ID NO: 5149358 - DNA, 13 bp, Homo sapiens
acctgcctgggtt

SEQ ID NO: 5149359 - DNA, 12 bp, Homo sapiens
acctgcctggtg

SEQ ID NO: 5149360 - DNA, 22 bp, Homo sapiens
acctgcctggtgcattgctgtg

SEQ ID NO: 5149361 - DNA, 23 bp, Homo sapiens
acctgcctggtgcattgctgtgt

SEQ ID NO: 5149362 - DNA, 17 bp, Homo sapiens
acctgcctgttctccag

SEQ ID NO: 5149363 - DNA, 16 bp, Homo sapiens
acctgccttgcctgtt

SEQ ID NO: 5149364 - DNA, 13 bp, Homo sapiens
acctgccttggcc

SEQ ID NO: 5149365 - DNA, 23 bp, Homo sapiens
acctgccttgggcctcatctgct

SEQ ID NO: 5149366 - DNA, 13 bp, Homo sapiens
acctgcctttgta

SEQ ID NO: 5149367 - DNA, 16 bp, Homo sapiens
acctgccttttaagtt

SEQ ID NO: 5149368 - DNA, 20 bp, Homo sapiens
acctgcgagaggtccctgct

SEQ ID NO: 5149369 - DNA, 23 bp, Homo sapiens
acctgcgagggccgcccgctccc

SEQ ID NO: 5149370 - DNA, 17 bp, Homo sapiens
acctgcgagtgttatga

SEQ ID NO: 5149371 - DNA, 21 bp, Homo sapiens
acctgcgcaaagggcgggcct

SEQ ID NO: 5149372 - DNA, 17 bp, Homo sapiens
acctgcgcaagtgcctg

SEQ ID NO: 5149373 - DNA, 19 bp, Homo sapiens
acctgcgcaagtgcctggg

SEQ ID NO: 5149374 - DNA, 14 bp, Homo sapiens
acctgcgcaccccg

SEQ ID NO: 5149375 - DNA, 15 bp, Homo sapiens
acctgcgcagggccc

SEQ ID NO: 5149376 - DNA, 20 bp, Homo sapiens
acctgcgcagggccctctgg

SEQ ID NO: 5149377 - DNA, 16 bp, Homo sapiens
acctgcgcctggctct

SEQ ID NO: 5149378 - DNA, 22 bp, Homo sapiens
acctgcgcctggctctgtcacc

SEQ ID NO: 5149379 - DNA, 14 bp, Homo sapiens
acctgcgcttcact

SEQ ID NO: 5149380 - DNA, 14 bp, Homo sapiens
acctgcgcttctgc

SEQ ID NO: 5149381 - DNA, 21 bp, Homo sapiens
acctgcgcttctgctggagga

SEQ ID NO: 5149382 - DNA, 21 bp, Homo sapiens
acctgcggccgccccccgccc

SEQ ID NO: 5149383 - DNA, 22 bp, Homo sapiens
acctgcggctgctgtgtgcctt

SEQ ID NO: 5149384 - DNA, 21 bp, Homo sapiens
acctgcgggtcctcagctgct

SEQ ID NO: 5149385 - DNA, 18 bp, Homo sapiens
acctgcggtgctatctcc

SEQ ID NO: 5149386 - DNA, 21 bp, Homo sapiens
acctgctagacacatttttaa

SEQ ID NO: 5149387 - DNA, 18 bp, Homo sapiens
acctgctaggccagagcc

SEQ ID NO: 5149388 - DNA, 22 bp, Homo sapiens
acctgctagtcgcccctcagag

SEQ ID NO: 5149389 - DNA, 23 bp, Homo sapiens
acctgctagtcgcccctcagagc

SEQ ID NO: 5149390 - DNA, 16 bp, Homo sapiens
acctgctcacagggat

SEQ ID NO: 5149391 - DNA, 16 bp, Homo sapiens
acctgctcacgtcaaa

SEQ ID NO: 5149392 - DNA, 16 bp, Homo sapiens
acctgctcagccctgc

SEQ ID NO: 5149393 - DNA, 17 bp, Homo sapiens
acctgctcagccctgca

SEQ ID NO: 5149394 - DNA, 19 bp, Homo sapiens
acctgctcatcatattcca

SEQ ID NO: 5149395 - DNA, 12 bp, Homo sapiens
acctgctccaag

SEQ ID NO: 5149396 - DNA, 13 bp, Homo sapiens
acctgctccagga

SEQ ID NO: 5149397 - DNA, 17 bp, Homo sapiens
acctgctcccaggccag

SEQ ID NO: 5149398 - DNA, 19 bp, Homo sapiens
acctgctcccagtcctgcc

SEQ ID NO: 5149399 - DNA, 20 bp, Homo sapiens
acctgctcccagtcctgcct

SEQ ID NO: 5149400 - DNA, 16 bp, Homo sapiens
acctgctccgccagga

SEQ ID NO: 5149401 - DNA, 18 bp, Homo sapiens
acctgctccgctgctcct

SEQ ID NO: 5149402 - DNA, 22 bp, Homo sapiens
acctgctccgctgctccttggc

SEQ ID NO: 5149403 - DNA, 15 bp, Homo sapiens
acctgctcctgccca

SEQ ID NO: 5149404 - DNA, 13 bp, Homo sapiens
acctgctctccgg

SEQ ID NO: 5149405 - DNA, 23 bp, Homo sapiens
acctgctctcctcttctactcac

SEQ ID NO: 5149406 - DNA, 13 bp, Homo sapiens
acctgctctcttg

SEQ ID NO: 5149407 - DNA, 16 bp, Homo sapiens
acctgctcttcccagc

SEQ ID NO: 5149408 - DNA, 21 bp, Homo sapiens
acctgctgaattgtttataat

SEQ ID NO: 5149409 - DNA, 17 bp, Homo sapiens
acctgctgacctgtgca

SEQ ID NO: 5149410 - DNA, 18 bp, Homo sapiens
acctgctgacctgtgcac

SEQ ID NO: 5149411 - DNA, 18 bp, Homo sapiens
acctgctgagctctgaga

SEQ ID NO: 5149412 - DNA, 19 bp, Homo sapiens
acctgctgagctctgagag

SEQ ID NO: 5149413 - DNA, 18 bp, Homo sapiens
acctgctgagggaccagc

SEQ ID NO: 5149414 - DNA, 20 bp, Homo sapiens
acctgctgagggaccagcca

SEQ ID NO: 5149415 - DNA, 22 bp, Homo sapiens
acctgctgagggggctctttcc

SEQ ID NO: 5149416 - DNA, 17 bp, Homo sapiens
acctgctgccccagctg

SEQ ID NO: 5149417 - DNA, 17 bp, Homo sapiens
acctgctgcccgtgagg

SEQ ID NO: 5149418 - DNA, 20 bp, Homo sapiens
acctgctgcgggggagccag

SEQ ID NO: 5149419 - DNA, 20 bp, Homo sapiens
acctgctgcgtccccactcc

SEQ ID NO: 5149420 - DNA, 13 bp, Homo sapiens
acctgctgctcag

SEQ ID NO: 5149421 - DNA, 14 bp, Homo sapiens
acctgctgctcagt

SEQ ID NO: 5149422 - DNA, 17 bp, Homo sapiens
acctgctgctccatgga

SEQ ID NO: 5149423 - DNA, 13 bp, Homo sapiens
acctgctgctgta

SEQ ID NO: 5149424 - DNA, 15 bp, Homo sapiens
acctgctgcttctcc

SEQ ID NO: 5149425 - DNA, 17 bp, Homo sapiens
acctgctgcttctccaa

SEQ ID NO: 5149426 - DNA, 19 bp, Homo sapiens
acctgctggaaaccacact

SEQ ID NO: 5149427 - DNA, 13 bp, Homo sapiens
acctgctggcccc

SEQ ID NO: 5149428 - DNA, 16 bp, Homo sapiens
acctgctggcccctca

SEQ ID NO: 5149429 - DNA, 19 bp, Homo sapiens
acctgctggcccctcacct

SEQ ID NO: 5149430 - DNA, 21 bp, Homo sapiens
acctgctgtaataaatgtatt

SEQ ID NO: 5149431 - DNA, 20 bp, Homo sapiens
acctgctgtgatacgatgct

SEQ ID NO: 5149432 - DNA, 18 bp, Homo sapiens
acctgcttcacagtactt

SEQ ID NO: 5149433 - DNA, 18 bp, Homo sapiens
acctgcttcacgttggcc

SEQ ID NO: 5149434 - DNA, 21 bp, Homo sapiens
acctgcttcattcaagcttca

SEQ ID NO: 5149435 - DNA, 19 bp, Homo sapiens
acctgcttccacccgtctc

SEQ ID NO: 5149436 - DNA, 16 bp, Homo sapiens
acctgcttccccaaag

SEQ ID NO: 5149437 - DNA, 16 bp, Homo sapiens
acctgcttcccccact

SEQ ID NO: 5149438 - DNA, 17 bp, Homo sapiens
acctgcttcctgaaata

SEQ ID NO: 5149439 - DNA, 18 bp, Homo sapiens
acctgcttcctgaaataa

SEQ ID NO: 5149440 - DNA, 22 bp, Homo sapiens
acctgcttcctgaaataaacac

SEQ ID NO: 5149441 - DNA, 14 bp, Homo sapiens
acctgcttccttca

SEQ ID NO: 5149442 - DNA, 16 bp, Homo sapiens
acctgcttccttcagt

SEQ ID NO: 5149443 - DNA, 22 bp, Homo sapiens
accggccaggccgcgcccagca

SEQ ID NO: 5149444 - DNA, 21 bp, Homo sapiens
accggcccctggcagcacagc

SEQ ID NO: 5149445 - DNA, 18 bp, Homo sapiens
accggccgatggagacac

SEQ ID NO: 5149446 - DNA, 16 bp, Homo sapiens
accggccgcagccccc

SEQ ID NO: 5149447 - DNA, 17 bp, Homo sapiens
accggccgcagccccca

SEQ ID NO: 5149448 - DNA, 11 bp, Homo sapiens
accggcctgga

SEQ ID NO: 5149449 - DNA, 14 bp, Homo sapiens
accggcctggacct

SEQ ID NO: 5149450 - DNA, 18 bp, Homo sapiens
accggcctggctgcagct

SEQ ID NO: 5149451 - DNA, 21 bp, Homo sapiens
accggcctgtgggtctctgaa

SEQ ID NO: 5149452 - DNA, 14 bp, Homo sapiens
accggcgcgctctt

SEQ ID NO: 5149453 - DNA, 15 bp, Homo sapiens
accggctcaggagag

SEQ ID NO: 5149454 - DNA, 14 bp, Homo sapiens
accggctcccaccc

SEQ ID NO: 5149455 - DNA, 14 bp, Homo sapiens
accggctgcttttc

SEQ ID NO: 5149456 - DNA, 14 bp, Homo sapiens
accggctggcctgg

SEQ ID NO: 5149457 - DNA, 14 bp, Homo sapiens
accgggaagggtgg

SEQ ID NO: 5149458 - DNA, 13 bp, Homo sapiens
accgggacccgag

SEQ ID NO: 5149459 - DNA, 14 bp, Homo sapiens
accgggactacaga

SEQ ID NO: 5149460 - DNA, 16 bp, Homo sapiens
accgggactacagaag

SEQ ID NO: 5149461 - DNA, 18 bp, Homo sapiens
accgggactacagaagtg

SEQ ID NO: 5149462 - DNA, 15 bp, Homo sapiens
accgggagcctcccc

SEQ ID NO: 5149463 - DNA, 16 bp, Homo sapiens
accgggatccagttcc

SEQ ID NO: 5149464 - DNA, 21 bp, Homo sapiens
accgggcactcccgggatggg

SEQ ID NO: 5149465 - DNA, 21 bp, Homo sapiens
accgggcatgtctgcctggag

SEQ ID NO: 5149466 - DNA, 21 bp, Homo sapiens
accgggccactccttcctgcc

SEQ ID NO: 5149467 - DNA, 12 bp, Homo sapiens
accgggcccccc

SEQ ID NO: 5149468 - DNA, 12 bp, Homo sapiens
accgggcccctc

SEQ ID NO: 5149469 - DNA, 15 bp, Homo sapiens
accgggccctccttg

SEQ ID NO: 5149470 - DNA, 19 bp, Homo sapiens
accgggccctgggttcctc

SEQ ID NO: 5149471 - DNA, 16 bp, Homo sapiens
accgggccgctagatg

SEQ ID NO: 5149472 - DNA, 22 bp, Homo sapiens
accgggcgcatgcctcccaggc

SEQ ID NO: 5149473 - DNA, 23 bp, Homo sapiens
accgggcgcatgcctcccaggcc

SEQ ID NO: 5149474 - DNA, 12 bp, Homo sapiens
accgggctgcag

SEQ ID NO: 5149475 - DNA, 21 bp, Homo sapiens
accgggctgggagctctgcag

SEQ ID NO: 5149476 - DNA, 22 bp, Homo sapiens
accggggagcccccgccccgcc

SEQ ID NO: 5149477 - DNA, 14 bp, Homo sapiens
accggggcacacgg

SEQ ID NO: 5149478 - DNA, 19 bp, Homo sapiens
accgggggccagacacaga

SEQ ID NO: 5149479 - DNA, 20 bp, Homo sapiens
accggggtggagtcagggct

SEQ ID NO: 5149480 - DNA, 21 bp, Homo sapiens
accggggtggagtcagggctg

SEQ ID NO: 5149481 - DNA, 22 bp, Homo sapiens
accggggtggagtcagggctgt

SEQ ID NO: 5149482 - DNA, 21 bp, Homo sapiens
accgggtcttgattcagtcac

SEQ ID NO: 5149483 - DNA, 11 bp, Homo sapiens
accgggtgaaa

SEQ ID NO: 5149484 - DNA, 20 bp, Homo sapiens
accgggtggcagcgcccagc

SEQ ID NO: 5149485 - DNA, 17 bp, Homo sapiens
accgggttctcctgatt

SEQ ID NO: 5149486 - DNA, 15 bp, Homo sapiens
accggtaccctcctc

SEQ ID NO: 5149487 - DNA, 16 bp, Homo sapiens
accggtaccctcctcc

SEQ ID NO: 5149488 - DNA, 14 bp, Homo sapiens
accggtcccagcct

SEQ ID NO: 5149489 - DNA, 17 bp, Homo sapiens
accggtcccagcctggg

SEQ ID NO: 5149490 - DNA, 18 bp, Homo sapiens
accggtcccagcctgggc

SEQ ID NO: 5149491 - DNA, 19 bp, Homo sapiens
accggtgccaaacccagcc

SEQ ID NO: 5149492 - DNA, 15 bp, Homo sapiens
accggtgctgcagga

SEQ ID NO: 5149493 - DNA, 17 bp, Homo sapiens
accggtgctgcaggagt

SEQ ID NO: 5149494 - DNA, 13 bp, Homo sapiens
accggtgctttta

SEQ ID NO: 5149495 - DNA, 21 bp, Homo sapiens
accggtgcttttattgtaaag

SEQ ID NO: 5149496 - DNA, 22 bp, Homo sapiens
accgtaaaggtttatttttctg

SEQ ID NO: 5149497 - DNA, 15 bp, Homo sapiens
accgtaaagtgcctt

SEQ ID NO: 5149498 - DNA, 22 bp, Homo sapiens
accgtacagtttctgcttggga

SEQ ID NO: 5149499 - DNA, 17 bp, Homo sapiens
accgtagggcctgactc

SEQ ID NO: 5149500 - DNA, 15 bp, Homo sapiens
accgtcaatgtgaaa

SEQ ID NO: 5149501 - DNA, 21 bp, Homo sapiens
accgtcaggtactcctgccag

SEQ ID NO: 5149502 - DNA, 22 bp, Homo sapiens
accgtcatggcttaatgtttat

SEQ ID NO: 5149503 - DNA, 15 bp, Homo sapiens
accgtccaggcccca

SEQ ID NO: 5149504 - DNA, 17 bp, Homo sapiens
accgtccccggcccctg

SEQ ID NO: 5149505 - DNA, 20 bp, Homo sapiens
accgtccccggcccctgccc

SEQ ID NO: 5149506 - DNA, 16 bp, Homo sapiens
accgtcccctcccagg

SEQ ID NO: 5149507 - DNA, 16 bp, Homo sapiens
accgtcccctgcccac

SEQ ID NO: 5149508 - DNA, 12 bp, Homo sapiens
accgtccctcag

SEQ ID NO: 5149509 - DNA, 14 bp, Homo sapiens
accgtccctctccc

SEQ ID NO: 5149510 - DNA, 15 bp, Homo sapiens
accgtccgccctgct

SEQ ID NO: 5149511 - DNA, 15 bp, Homo sapiens
accgtcctcacccct

SEQ ID NO: 5149512 - DNA, 21 bp, Homo sapiens
accgtcctcacccctgtcctc

SEQ ID NO: 5149513 - DNA, 15 bp, Homo sapiens
accgtcctctttttc

SEQ ID NO: 5149514 - DNA, 17 bp, Homo sapiens
accgtcctgctgtccct

SEQ ID NO: 5149515 - DNA, 15 bp, Homo sapiens
accgtcgacaagaat

SEQ ID NO: 5149516 - DNA, 14 bp, Homo sapiens
accgtcgaccagga

SEQ ID NO: 5149517 - DNA, 15 bp, Homo sapiens
accgtctacatttca

SEQ ID NO: 5149518 - DNA, 16 bp, Homo sapiens
accgtctacatttcac

SEQ ID NO: 5149519 - DNA, 19 bp, Homo sapiens
accgtctcactgtgtgtct

SEQ ID NO: 5149520 - DNA, 20 bp, Homo sapiens
accgtctcggccctgaacca

SEQ ID NO: 5149521 - DNA, 12 bp, Homo sapiens
accgtcttcctt

SEQ ID NO: 5149522 - DNA, 14 bp, Homo sapiens
accgtctttacccc

SEQ ID NO: 5149523 - DNA, 20 bp, Homo sapiens
accgtctttacccctgctga

SEQ ID NO: 5149524 - DNA, 22 bp, Homo sapiens
accgtgacatcagcgtagtgtt

SEQ ID NO: 5149525 - DNA, 15 bp, Homo sapiens
accgtgaggaggggt

SEQ ID NO: 5149526 - DNA, 14 bp, Homo sapiens
accgtgaggccaag

SEQ ID NO: 5149527 - DNA, 22 bp, Homo sapiens
accgtgcagagctgcacttggc

SEQ ID NO: 5149528 - DNA, 21 bp, Homo sapiens
accgtgccaaccccacccagc

SEQ ID NO: 5149529 - DNA, 22 bp, Homo sapiens
accgtgccaaccccacccagct

SEQ ID NO: 5149530 - DNA, 12 bp, Homo sapiens
accgtgccagca

SEQ ID NO: 5149531 - DNA, 22 bp, Homo sapiens
accgtgccattgtactccagcc

SEQ ID NO: 5149532 - DNA, 16 bp, Homo sapiens
accgtgccccacctcc

SEQ ID NO: 5149533 - DNA, 18 bp, Homo sapiens
accgtgccccacctcccc

SEQ ID NO: 5149534 - DNA, 20 bp, Homo sapiens
accgtgcccggcccattcta

SEQ ID NO: 5149535 - DNA, 19 bp, Homo sapiens
accgtgcctggccacgccc

SEQ ID NO: 5149536 - DNA, 15 bp, Homo sapiens
accgtgcctggctga

SEQ ID NO: 5149537 - DNA, 23 bp, Homo sapiens
accgtgcctggctgattcagcat

SEQ ID NO: 5149538 - DNA, 17 bp, Homo sapiens
accgtggaccttcctgc

SEQ ID NO: 5149539 - DNA, 17 bp, Homo sapiens
accgtggatctccttcc

SEQ ID NO: 5149540 - DNA, 21 bp, Homo sapiens
accgtggcagcttgctgggct

SEQ ID NO: 5149541 - DNA, 15 bp, Homo sapiens
accgtggccctgccc

SEQ ID NO: 5149542 - DNA, 14 bp, Homo sapiens
accgtggcctgggc

SEQ ID NO: 5149543 - DNA, 18 bp, Homo sapiens
accgtgggcagggagcgg

SEQ ID NO: 5149544 - DNA, 20 bp, Homo sapiens
accgtgggcggggccttgcg

SEQ ID NO: 5149545 - DNA, 14 bp, Homo sapiens
accgtgggctccct

SEQ ID NO: 5149546 - DNA, 16 bp, Homo sapiens
accgtggggaaggggt

SEQ ID NO: 5149547 - DNA, 12 bp, Homo sapiens
accgtggggagg

SEQ ID NO: 5149548 - DNA, 14 bp, Homo sapiens
accgtggggaggcc

SEQ ID NO: 5149549 - DNA, 17 bp, Homo sapiens
accgtgggggaactgac

SEQ ID NO: 5149550 - DNA, 23 bp, Homo sapiens
accgtgggggaactgacgctgga

SEQ ID NO: 5149551 - DNA, 17 bp, Homo sapiens
accgtggtatgtctgcc

SEQ ID NO: 5149552 - DNA, 14 bp, Homo sapiens
accgtggtgtcctc

SEQ ID NO: 5149553 - DNA, 17 bp, Homo sapiens
accgtggtgtcctctgt

SEQ ID NO: 5149554 - DNA, 18 bp, Homo sapiens
accgtggtgtcctctgtc

SEQ ID NO: 5149555 - DNA, 18 bp, Homo sapiens
accgtggtgtgaggcccc

SEQ ID NO: 5149556 - DNA, 21 bp, Homo sapiens
accgtggtgtgaggcccccgg

SEQ ID NO: 5149557 - DNA, 11 bp, Homo sapiens
accgtgtacaa

SEQ ID NO: 5149558 - DNA, 13 bp, Homo sapiens
accgtgtcaagct

SEQ ID NO: 5149559 - DNA, 16 bp, Homo sapiens
accgtgtccagcacag

SEQ ID NO: 5149560 - DNA, 17 bp, Homo sapiens
accgtgtccagcacaga

SEQ ID NO: 5149561 - DNA, 20 bp, Homo sapiens
accgtgtcccaaggagctga

SEQ ID NO: 5149562 - DNA, 21 bp, Homo sapiens
accgtgtcccaaggagctgat

SEQ ID NO: 5149563 - DNA, 16 bp, Homo sapiens
accgtgtcctcctctg

SEQ ID NO: 5149564 - DNA, 20 bp, Homo sapiens
accgtgtcctcctctgagga

SEQ ID NO: 5149565 - DNA, 17 bp, Homo sapiens
accgtgtctgtctggca

SEQ ID NO: 5149566 - DNA, 19 bp, Homo sapiens
accgtgtttgtctcttctg

SEQ ID NO: 5149567 - DNA, 14 bp, Homo sapiens
accgttcaagaggc

SEQ ID NO: 5149568 - DNA, 17 bp, Homo sapiens
accgttccttaaaaaca

SEQ ID NO: 5149569 - DNA, 23 bp, Homo sapiens
accgttctctgtccccaggtcct

SEQ ID NO: 5149570 - DNA, 14 bp, Homo sapiens
accgttctgtgcac

SEQ ID NO: 5149571 - DNA, 18 bp, Homo sapiens
accgtttccaagctgcgg

SEQ ID NO: 5149572 - DNA, 14 bp, Homo sapiens
accgtttcttccct

SEQ ID NO: 5149573 - DNA, 21 bp, Homo sapiens
accgtttggtgtctgatgtgt

SEQ ID NO: 5149574 - DNA, 20 bp, Homo sapiens
accgttttcacttgtctcct

SEQ ID NO: 5149575 - DNA, 12 bp, Homo sapiens
accgtttttcaa

SEQ ID NO: 5149576 - DNA, 13 bp, Homo sapiens
acctaaaaaagat

SEQ ID NO: 5149577 - DNA, 15 bp, Homo sapiens
acctaaaaaagatat

SEQ ID NO: 5149578 - DNA, 16 bp, Homo sapiens
acctaaaaatcaatca

SEQ ID NO: 5149579 - DNA, 17 bp, Homo sapiens
acctaaaaatcaatcac

SEQ ID NO: 5149580 - DNA, 16 bp, Homo sapiens
acctaaaacaatctgt

SEQ ID NO: 5149581 - DNA, 13 bp, Homo sapiens
acctaaaagagat

SEQ ID NO: 5149582 - DNA, 17 bp, Homo sapiens
acctaaacagctgcttt

SEQ ID NO: 5149583 - DNA, 16 bp, Homo sapiens
acctaaaccctctgtg

SEQ ID NO: 5149584 - DNA, 20 bp, Homo sapiens
acctaaaccctctgtgaaat

SEQ ID NO: 5149585 - DNA, 16 bp, Homo sapiens
acctaaacttacattt

SEQ ID NO: 5149586 - DNA, 12 bp, Homo sapiens
acctaaagaaaa

SEQ ID NO: 5149587 - DNA, 13 bp, Homo sapiens
acctaaagaaaaa

SEQ ID NO: 5149588 - DNA, 19 bp, Homo sapiens
acctaaaggactattatgt

SEQ ID NO: 5149589 - DNA, 20 bp, Homo sapiens
acctaaagggtatgagctgg

SEQ ID NO: 5149590 - DNA, 16 bp, Homo sapiens
acctaaataaccaatc

SEQ ID NO: 5149591 - DNA, 19 bp, Homo sapiens
acctaaatccattttctaa

SEQ ID NO: 5149592 - DNA, 21 bp, Homo sapiens
acctaaatccattttctaaac

SEQ ID NO: 5149593 - DNA, 11 bp, Homo sapiens
acctaaatgac

SEQ ID NO: 5149594 - DNA, 18 bp, Homo sapiens
acctaaatgacctcagca

SEQ ID NO: 5149595 - DNA, 18 bp, Homo sapiens
acctaaattaacaaattc

SEQ ID NO: 5149596 - DNA, 21 bp, Homo sapiens
acctaaatttttgtaagaaaa

SEQ ID NO: 5149597 - DNA, 16 bp, Homo sapiens
acctaaccccagggca

SEQ ID NO: 5149598 - DNA, 22 bp, Homo sapiens
acctaaccccagggcactgcca

SEQ ID NO: 5149599 - DNA, 18 bp, Homo sapiens
acctaacccctttcctgc

SEQ ID NO: 5149600 - DNA, 14 bp, Homo sapiens
acctaacctgtgtc

SEQ ID NO: 5149601 - DNA, 15 bp, Homo sapiens
acctaacctgtgtct

SEQ ID NO: 5149602 - DNA, 19 bp, Homo sapiens
acctaacgccctatttttg

SEQ ID NO: 5149603 - DNA, 12 bp, Homo sapiens
acctaactgtat

SEQ ID NO: 5149604 - DNA, 13 bp, Homo sapiens
acctaagaacaaa

SEQ ID NO: 5149605 - DNA, 19 bp, Homo sapiens
acctaagagccacaataag

SEQ ID NO: 5149606 - DNA, 21 bp, Homo sapiens
acctaagattacaaatcagaa

SEQ ID NO: 5149607 - DNA, 17 bp, Homo sapiens
acctaagcaatcactgg

SEQ ID NO: 5149608 - DNA, 22 bp, Homo sapiens
acctaagcaatcactgggccca

SEQ ID NO: 5149609 - DNA, 14 bp, Homo sapiens
acctaagcacttct

SEQ ID NO: 5149610 - DNA, 19 bp, Homo sapiens
acctaagcacttctagaat

SEQ ID NO: 5149611 - DNA, 13 bp, Homo sapiens
acctaaggcagac

SEQ ID NO: 5149612 - DNA, 15 bp, Homo sapiens
acctaagggacatgt

SEQ ID NO: 5149613 - DNA, 16 bp, Homo sapiens
acctaagtaattctct

SEQ ID NO: 5149614 - DNA, 13 bp, Homo sapiens
acctaagtactgt

SEQ ID NO: 5149615 - DNA, 14 bp, Homo sapiens
acctaagtactgta

SEQ ID NO: 5149616 - DNA, 16 bp, Homo sapiens
acctaagtacttaaaa

SEQ ID NO: 5149617 - DNA, 19 bp, Homo sapiens
acctaagtccttccacctg

SEQ ID NO: 5149618 - DNA, 18 bp, Homo sapiens
acctaagtcctttatgtg

SEQ ID NO: 5149619 - DNA, 18 bp, Homo sapiens
acctaagtctctgtgaat

SEQ ID NO: 5149620 - DNA, 18 bp, Homo sapiens
acctaagtgacatttgta

SEQ ID NO: 5149621 - DNA, 20 bp, Homo sapiens
acctaagtttcagttgattt

SEQ ID NO: 5149622 - DNA, 13 bp, Homo sapiens
acctaagtttccg

SEQ ID NO: 5149623 - DNA, 15 bp, Homo sapiens
acctgcttctctgcc

SEQ ID NO: 5149624 - DNA, 18 bp, Homo sapiens
acctgcttctgaactcaa

SEQ ID NO: 5149625 - DNA, 19 bp, Homo sapiens
acctgcttgtgttgggccc

SEQ ID NO: 5149626 - DNA, 15 bp, Homo sapiens
acctgctttttgaaa

SEQ ID NO: 5149627 - DNA, 16 bp, Homo sapiens
acctgctttttgaaat

SEQ ID NO: 5149628 - DNA, 17 bp, Homo sapiens
acctggaaactgctcag

SEQ ID NO: 5149629 - DNA, 15 bp, Homo sapiens
acctggaaagccagg

SEQ ID NO: 5149630 - DNA, 14 bp, Homo sapiens
acctggaaccagag

SEQ ID NO: 5149631 - DNA, 15 bp, Homo sapiens
acctggaaccagagc

SEQ ID NO: 5149632 - DNA, 16 bp, Homo sapiens
acctggaagagctggg

SEQ ID NO: 5149633 - DNA, 19 bp, Homo sapiens
acctggaatctacaagcca

SEQ ID NO: 5149634 - DNA, 21 bp, Homo sapiens
acctggaatctacaagccaaa

SEQ ID NO: 5149635 - DNA, 22 bp, Homo sapiens
acctggaatcttccatctgcat

SEQ ID NO: 5149636 - DNA, 19 bp, Homo sapiens
acctggaattgtggggcaa

SEQ ID NO: 5149637 - DNA, 18 bp, Homo sapiens
acctggacacacactcac

SEQ ID NO: 5149638 - DNA, 16 bp, Homo sapiens
acctggaccaaagctg

SEQ ID NO: 5149639 - DNA, 16 bp, Homo sapiens
acctggaccccagcct

SEQ ID NO: 5149640 - DNA, 19 bp, Homo sapiens
acctggaccccagccttgg

SEQ ID NO: 5149641 - DNA, 17 bp, Homo sapiens
acctggaccccctgccc

SEQ ID NO: 5149642 - DNA, 19 bp, Homo sapiens
acctggactgaccctgcag

SEQ ID NO: 5149643 - DNA, 14 bp, Homo sapiens
acctggagaagtag

SEQ ID NO: 5149644 - DNA, 14 bp, Homo sapiens
acctggagacagta

SEQ ID NO: 5149645 - DNA, 15 bp, Homo sapiens
acctggagactgtcc

SEQ ID NO: 5149646 - DNA, 22 bp, Homo sapiens
acctggagagccagaacctgga

SEQ ID NO: 5149647 - DNA, 13 bp, Homo sapiens
acctggagagcta

SEQ ID NO: 5149648 - DNA, 14 bp, Homo sapiens
acctggagatgatg

SEQ ID NO: 5149649 - DNA, 15 bp, Homo sapiens
acctggagatgatga

SEQ ID NO: 5149650 - DNA, 16 bp, Homo sapiens
acctggagatgcagct

SEQ ID NO: 5149651 - DNA, 16 bp, Homo sapiens
acctggagcccctggg

SEQ ID NO: 5149652 - DNA, 17 bp, Homo sapiens
acctggagcccgcttca

SEQ ID NO: 5149653 - DNA, 19 bp, Homo sapiens
acctggagcgccacacact

SEQ ID NO: 5149654 - DNA, 14 bp, Homo sapiens
acctggagctgcca

SEQ ID NO: 5149655 - DNA, 17 bp, Homo sapiens
acctggagctgccagca

SEQ ID NO: 5149656 - DNA, 23 bp, Homo sapiens
acctggagcttcagccaggtctg

SEQ ID NO: 5149657 - DNA, 13 bp, Homo sapiens
acctggagggcta

SEQ ID NO: 5149658 - DNA, 20 bp, Homo sapiens
acctggagggctagaacctg

SEQ ID NO: 5149659 - DNA, 23 bp, Homo sapiens
acctggagggctagaacctggag

SEQ ID NO: 5149660 - DNA, 19 bp, Homo sapiens
acctggaggggagaggtca

SEQ ID NO: 5149661 - DNA, 14 bp, Homo sapiens
acctggaggggcta

SEQ ID NO: 5149662 - DNA, 18 bp, Homo sapiens
acctggatccagcactgg

SEQ ID NO: 5149663 - DNA, 15 bp, Homo sapiens
acctggatggatctg

SEQ ID NO: 5149664 - DNA, 22 bp, Homo sapiens
acctggatggatctgctccatg

SEQ ID NO: 5149665 - DNA, 19 bp, Homo sapiens
acctggatggggcaggcca

SEQ ID NO: 5149666 - DNA, 21 bp, Homo sapiens
acctggattgcgcctaatgtg

SEQ ID NO: 5149667 - DNA, 22 bp, Homo sapiens
acctggcaagctagaacctgga

SEQ ID NO: 5149668 - DNA, 23 bp, Homo sapiens
acctggcaagctagaacctggag

SEQ ID NO: 5149669 - DNA, 14 bp, Homo sapiens
acctggcactgctg

SEQ ID NO: 5149670 - DNA, 14 bp, Homo sapiens
acctggcagctctg

SEQ ID NO: 5149671 - DNA, 22 bp, Homo sapiens
acctggcaggccctgcccagcc

SEQ ID NO: 5149672 - DNA, 23 bp, Homo sapiens
acctggcaggccctgcccagcca

SEQ ID NO: 5149673 - DNA, 22 bp, Homo sapiens
acctggcagtggctctcagagc

SEQ ID NO: 5149674 - DNA, 21 bp, Homo sapiens
acctggcatcgcaccattctg

SEQ ID NO: 5149675 - DNA, 21 bp, Homo sapiens
acctggcatctaattctgatt

SEQ ID NO: 5149676 - DNA, 13 bp, Homo sapiens
acctggccacctg

SEQ ID NO: 5149677 - DNA, 23 bp, Homo sapiens
acctggccactgtccctgtcctt

SEQ ID NO: 5149678 - DNA, 14 bp, Homo sapiens
acctggccagaggc

SEQ ID NO: 5149679 - DNA, 21 bp, Homo sapiens
acctggcccagtgcaatctgt

SEQ ID NO: 5149680 - DNA, 21 bp, Homo sapiens
acctggccccatgtctctcag

SEQ ID NO: 5149681 - DNA, 20 bp, Homo sapiens
acctggccccttctccagca

SEQ ID NO: 5149682 - DNA, 15 bp, Homo sapiens
acctggccctctctg

SEQ ID NO: 5149683 - DNA, 19 bp, Homo sapiens
acctggccctctctgaagg

SEQ ID NO: 5149684 - DNA, 23 bp, Homo sapiens
acctggccctctctgaaggaggc

SEQ ID NO: 5149685 - DNA, 17 bp, Homo sapiens
acctggccctgcttcct

SEQ ID NO: 5149686 - DNA, 18 bp, Homo sapiens
acctggccctgcttcctg

SEQ ID NO: 5149687 - DNA, 19 bp, Homo sapiens
acctggccctgcttcctgc

SEQ ID NO: 5149688 - DNA, 16 bp, Homo sapiens
acctggccctggggcc

SEQ ID NO: 5149689 - DNA, 18 bp, Homo sapiens
acctggccctggggcctg

SEQ ID NO: 5149690 - DNA, 19 bp, Homo sapiens
acctggccctggggcctgt

SEQ ID NO: 5149691 - DNA, 21 bp, Homo sapiens
acctggccctggggcctgtac

SEQ ID NO: 5149692 - DNA, 22 bp, Homo sapiens
acctggccgcaagtccccagcc

SEQ ID NO: 5149693 - DNA, 18 bp, Homo sapiens
acctggccgcctccagga

SEQ ID NO: 5149694 - DNA, 19 bp, Homo sapiens
acctggccgcctccaggag

SEQ ID NO: 5149695 - DNA, 22 bp, Homo sapiens
acctggccggtaggctgctggc

SEQ ID NO: 5149696 - DNA, 12 bp, Homo sapiens
acctggcctctg

SEQ ID NO: 5149697 - DNA, 13 bp, Homo sapiens
acctggcctctgc

SEQ ID NO: 5149698 - DNA, 16 bp, Homo sapiens
acctggcctctgcact

SEQ ID NO: 5149699 - DNA, 23 bp, Homo sapiens
acctggcctctgcactcccctgc

SEQ ID NO: 5149700 - DNA, 17 bp, Homo sapiens
acctggcctgctgggaa

SEQ ID NO: 5149701 - DNA, 13 bp, Homo sapiens
acctggcctgtgg

SEQ ID NO: 5149702 - DNA, 11 bp, Homo sapiens
acctggccttc

SEQ ID NO: 5149703 - DNA, 18 bp, Homo sapiens
acctggcctttcactttt

SEQ ID NO: 5149704 - DNA, 12 bp, Homo sapiens
acctggcggagc

SEQ ID NO: 5149705 - DNA, 21 bp, Homo sapiens
acctggcggagctctcctccg

SEQ ID NO: 5149706 - DNA, 23 bp, Homo sapiens
acctggcggtgtataccaggcag

SEQ ID NO: 5149707 - DNA, 19 bp, Homo sapiens
acctggctaattttttgta

SEQ ID NO: 5149708 - DNA, 21 bp, Homo sapiens
acctggctacgtaattatact

SEQ ID NO: 5149709 - DNA, 11 bp, Homo sapiens
acctggctccc

SEQ ID NO: 5149710 - DNA, 14 bp, Homo sapiens
acctggctccctcc

SEQ ID NO: 5149711 - DNA, 18 bp, Homo sapiens
acctggctccctcccacc

SEQ ID NO: 5149712 - DNA, 15 bp, Homo sapiens
acctggctctcacct

SEQ ID NO: 5149713 - DNA, 16 bp, Homo sapiens
acctggctctcacctc

SEQ ID NO: 5149714 - DNA, 20 bp, Homo sapiens
acctggctctcacctctagg

SEQ ID NO: 5149715 - DNA, 17 bp, Homo sapiens
acctggctctcagagga

SEQ ID NO: 5149716 - DNA, 14 bp, Homo sapiens
acctggctgagcag

SEQ ID NO: 5149717 - DNA, 23 bp, Homo sapiens
acctggctgagcagttcccctgg

SEQ ID NO: 5149718 - DNA, 19 bp, Homo sapiens
acctggctgagcctggctg

SEQ ID NO: 5149719 - DNA, 13 bp, Homo sapiens
acctggctgagtg

SEQ ID NO: 5149720 - DNA, 15 bp, Homo sapiens
acctggctgccaaca

SEQ ID NO: 5149721 - DNA, 17 bp, Homo sapiens
acctggctgcccctcac

SEQ ID NO: 5149722 - DNA, 20 bp, Homo sapiens
acctggctgcccctcacctt

SEQ ID NO: 5149723 - DNA, 18 bp, Homo sapiens
acctggctgctaggccag

SEQ ID NO: 5149724 - DNA, 17 bp, Homo sapiens
acctggctgggcctggg

SEQ ID NO: 5149725 - DNA, 15 bp, Homo sapiens
acctggcttcccagg

SEQ ID NO: 5149726 - DNA, 22 bp, Homo sapiens
acctggcttgtttattttgtgg

SEQ ID NO: 5149727 - DNA, 21 bp, Homo sapiens
acctggcttttactttattaa

SEQ ID NO: 5149728 - DNA, 15 bp, Homo sapiens
acctggctttttaaa

SEQ ID NO: 5149729 - DNA, 18 bp, Homo sapiens
acctgggaaaacagagga

SEQ ID NO: 5149730 - DNA, 19 bp, Homo sapiens
acctgggaaaacagaggaa

SEQ ID NO: 5149731 - DNA, 20 bp, Homo sapiens
acctgggaaaacagaggaat

SEQ ID NO: 5149732 - DNA, 15 bp, Homo sapiens
acctgggaaaggacc

SEQ ID NO: 5149733 - DNA, 16 bp, Homo sapiens
acctgggaaccatgaa

SEQ ID NO: 5149734 - DNA, 15 bp, Homo sapiens
acctgggaaggccag

SEQ ID NO: 5149735 - DNA, 19 bp, Homo sapiens
acctgggacaagcaggccg

SEQ ID NO: 5149736 - DNA, 20 bp, Homo sapiens
acctgggacaagcaggccgc

SEQ ID NO: 5149737 - DNA, 23 bp, Homo sapiens
acctgggacaagcaggccgccct

SEQ ID NO: 5149738 - DNA, 12 bp, Homo sapiens
acctgggaccaa

SEQ ID NO: 5149739 - DNA, 19 bp, Homo sapiens
acctgggaccaacctgacc

SEQ ID NO: 5149740 - DNA, 22 bp, Homo sapiens
acctgggagaaatctggcttct

SEQ ID NO: 5149741 - DNA, 18 bp, Homo sapiens
acctgggagatgctggga

SEQ ID NO: 5149742 - DNA, 19 bp, Homo sapiens
acctgggatatgacaagca

SEQ ID NO: 5149743 - DNA, 20 bp, Homo sapiens
acctgggatgaggggtgctg

SEQ ID NO: 5149744 - DNA, 17 bp, Homo sapiens
acctgggattatatatc

SEQ ID NO: 5149745 - DNA, 13 bp, Homo sapiens
acctgggcacaaa

SEQ ID NO: 5149746 - DNA, 14 bp, Homo sapiens
acctgggcacaaac

SEQ ID NO: 5149747 - DNA, 19 bp, Homo sapiens
acctgggcacctggggagt

SEQ ID NO: 5149748 - DNA, 14 bp, Homo sapiens
acctgggcagctcc

SEQ ID NO: 5149749 - DNA, 15 bp, Homo sapiens
acctgggcatatcca

SEQ ID NO: 5149750 - DNA, 16 bp, Homo sapiens
acctgggccaaggact

SEQ ID NO: 5149751 - DNA, 17 bp, Homo sapiens
acctgggccaaggactc

SEQ ID NO: 5149752 - DNA, 18 bp, Homo sapiens
acctgggcccacagagcc

SEQ ID NO: 5149753 - DNA, 23 bp, Homo sapiens
acctgggcccacagagcctggct

SEQ ID NO: 5149754 - DNA, 14 bp, Homo sapiens
acctgggccccact

SEQ ID NO: 5149755 - DNA, 15 bp, Homo sapiens
acctgggccccactg

SEQ ID NO: 5149756 - DNA, 16 bp, Homo sapiens
acctgggccccactgg

SEQ ID NO: 5149757 - DNA, 19 bp, Homo sapiens
acctgggccccactggaca

SEQ ID NO: 5149758 - DNA, 19 bp, Homo sapiens
acctgggcccgggcaggcc

SEQ ID NO: 5149759 - DNA, 20 bp, Homo sapiens
acctgggcccgggcaggcca

SEQ ID NO: 5149760 - DNA, 15 bp, Homo sapiens
acctgggccctaggc

SEQ ID NO: 5149761 - DNA, 17 bp, Homo sapiens
acctgggccctaggcat

SEQ ID NO: 5149762 - DNA, 14 bp, Homo sapiens
acctgggccctgga

SEQ ID NO: 5149763 - DNA, 23 bp, Homo sapiens
acctgggccctggggcctgtact

SEQ ID NO: 5149764 - DNA, 14 bp, Homo sapiens
acctgggccctggt

SEQ ID NO: 5149765 - DNA, 20 bp, Homo sapiens
acctgggccgggctgtagat

SEQ ID NO: 5149766 - DNA, 23 bp, Homo sapiens
acctgggcgccaactgctgatca

SEQ ID NO: 5149767 - DNA, 15 bp, Homo sapiens
acctgggctgaggag

SEQ ID NO: 5149768 - DNA, 16 bp, Homo sapiens
acctgggctgggagaa

SEQ ID NO: 5149769 - DNA, 17 bp, Homo sapiens
acctgggctgggagaag

SEQ ID NO: 5149770 - DNA, 18 bp, Homo sapiens
acctgggctgggagaagg

SEQ ID NO: 5149771 - DNA, 13 bp, Homo sapiens
acctgggctgtga

SEQ ID NO: 5149772 - DNA, 16 bp, Homo sapiens
acctggggactcctca

SEQ ID NO: 5149773 - DNA, 15 bp, Homo sapiens
acctggggagtggga

SEQ ID NO: 5149774 - DNA, 22 bp, Homo sapiens
acctggggagtggttaggcagc

SEQ ID NO: 5149775 - DNA, 23 bp, Homo sapiens
acctggggagtggttaggcagca

SEQ ID NO: 5149776 - DNA, 18 bp, Homo sapiens
acctggggcacagtccag

SEQ ID NO: 5149777 - DNA, 19 bp, Homo sapiens
acctggggcacagtccagg

SEQ ID NO: 5149778 - DNA, 20 bp, Homo sapiens
acctggggcacagtccagga

SEQ ID NO: 5149779 - DNA, 22 bp, Homo sapiens
acctggggcacagtccaggaac

SEQ ID NO: 5149780 - DNA, 19 bp, Homo sapiens
acctggggcagtcacctgc

SEQ ID NO: 5149781 - DNA, 14 bp, Homo sapiens
acctggggctgctg

SEQ ID NO: 5149782 - DNA, 19 bp, Homo sapiens
acctggggctgctgtgaag

SEQ ID NO: 5149783 - DNA, 23 bp, Homo sapiens
acctggggggagggacagggcag

SEQ ID NO: 5149784 - DNA, 22 bp, Homo sapiens
acctgggggtagccccgcccca

SEQ ID NO: 5149785 - DNA, 17 bp, Homo sapiens
acctggggtctctctcc

SEQ ID NO: 5149786 - DNA, 18 bp, Homo sapiens
acctggggtctctctccc

SEQ ID NO: 5149787 - DNA, 20 bp, Homo sapiens
acctggggtctctctcccta

SEQ ID NO: 5149788 - DNA, 17 bp, Homo sapiens
acctggggtgaatactt

SEQ ID NO: 5149789 - DNA, 18 bp, Homo sapiens
acctggggtgaatactta

SEQ ID NO: 5149790 - DNA, 16 bp, Homo sapiens
acctggggtgctgcct

SEQ ID NO: 5149791 - DNA, 22 bp, Homo sapiens
acctggggtgggggccaagtca

SEQ ID NO: 5149792 - DNA, 19 bp, Homo sapiens
acctgggtaaatgcagcgt

SEQ ID NO: 5149793 - DNA, 17 bp, Homo sapiens
acctgggtatcccctgc

SEQ ID NO: 5149794 - DNA, 19 bp, Homo sapiens
acctgggtatcccctgcct

SEQ ID NO: 5149795 - DNA, 20 bp, Homo sapiens
acctgggtatcccctgcctc

SEQ ID NO: 5149796 - DNA, 19 bp, Homo sapiens
acctgggtatgttcctaag

SEQ ID NO: 5149797 - DNA, 16 bp, Homo sapiens
acctgggtccaaataa

SEQ ID NO: 5149798 - DNA, 18 bp, Homo sapiens
acctgggtccaaataaaa

SEQ ID NO: 5149799 - DNA, 20 bp, Homo sapiens
acctgggtccaaataaaaac

SEQ ID NO: 5149800 - DNA, 21 bp, Homo sapiens
acctaataagtgctactttgc

SEQ ID NO: 5149801 - DNA, 14 bp, Homo sapiens
acctaataattgta

SEQ ID NO: 5149802 - DNA, 18 bp, Homo sapiens
acctaatatcattttatt

SEQ ID NO: 5149803 - DNA, 21 bp, Homo sapiens
acctaatatcattttattcac

SEQ ID NO: 5149804 - DNA, 21 bp, Homo sapiens
acctaatccaggcagatccag

SEQ ID NO: 5149805 - DNA, 22 bp, Homo sapiens
acctaatccaggcagatccagg

SEQ ID NO: 5149806 - DNA, 17 bp, Homo sapiens
acctaatctctgtaaag

SEQ ID NO: 5149807 - DNA, 20 bp, Homo sapiens
acctaatgctccttgttcct

SEQ ID NO: 5149808 - DNA, 12 bp, Homo sapiens
acctaatgctgg

SEQ ID NO: 5149809 - DNA, 15 bp, Homo sapiens
acctaatgctggcct

SEQ ID NO: 5149810 - DNA, 16 bp, Homo sapiens
acctaatgggaatcat

SEQ ID NO: 5149811 - DNA, 18 bp, Homo sapiens
acctaatgggaatcattc

SEQ ID NO: 5149812 - DNA, 20 bp, Homo sapiens
acctaatgggaatcattcca

SEQ ID NO: 5149813 - DNA, 22 bp, Homo sapiens
acctaatgggaatcattccact

SEQ ID NO: 5149814 - DNA, 18 bp, Homo sapiens
acctaatgtctcactgtt

SEQ ID NO: 5149815 - DNA, 20 bp, Homo sapiens
acctaatgtttatgagccag

SEQ ID NO: 5149816 - DNA, 15 bp, Homo sapiens
acctaattaatttca

SEQ ID NO: 5149817 - DNA, 22 bp, Homo sapiens
acctaattcgatgaaggctgcc

SEQ ID NO: 5149818 - DNA, 15 bp, Homo sapiens
acctaattgcacaac

SEQ ID NO: 5149819 - DNA, 14 bp, Homo sapiens
acctaattgtggat

SEQ ID NO: 5149820 - DNA, 20 bp, Homo sapiens
acctaattgtggtagaaatt

SEQ ID NO: 5149821 - DNA, 23 bp, Homo sapiens
acctaattgttaaatttaaaaat

SEQ ID NO: 5149822 - DNA, 14 bp, Homo sapiens
acctaatttcattt

SEQ ID NO: 5149823 - DNA, 18 bp, Homo sapiens
acctaatttcattttagt

SEQ ID NO: 5149824 - DNA, 15 bp, Homo sapiens
acctacaagatttcc

SEQ ID NO: 5149825 - DNA, 15 bp, Homo sapiens
acctacaataaactg

SEQ ID NO: 5149826 - DNA, 16 bp, Homo sapiens
acctacaataaactgg

SEQ ID NO: 5149827 - DNA, 17 bp, Homo sapiens
acctacaataaactggt

SEQ ID NO: 5149828 - DNA, 18 bp, Homo sapiens
acctacaataaactggta

SEQ ID NO: 5149829 - DNA, 16 bp, Homo sapiens
acctacacccctgtgc

SEQ ID NO: 5149830 - DNA, 16 bp, Homo sapiens
acctacagactaagaa

SEQ ID NO: 5149831 - DNA, 16 bp, Homo sapiens
acctacagactccatc

SEQ ID NO: 5149832 - DNA, 13 bp, Homo sapiens
acctacagcagca

SEQ ID NO: 5149833 - DNA, 13 bp, Homo sapiens
acctacaggactg

SEQ ID NO: 5149834 - DNA, 19 bp, Homo sapiens
acctacagggggtctggct

SEQ ID NO: 5149835 - DNA, 15 bp, Homo sapiens
acctacagtgtacag

SEQ ID NO: 5149836 - DNA, 16 bp, Homo sapiens
acctacagtgtacagt

SEQ ID NO: 5149837 - DNA, 18 bp, Homo sapiens
acctacagtgtacagtct

SEQ ID NO: 5149838 - DNA, 22 bp, Homo sapiens
acctacatatgctgatctttta

SEQ ID NO: 5149839 - DNA, 13 bp, Homo sapiens
acctacatgtatt

SEQ ID NO: 5149840 - DNA, 16 bp, Homo sapiens
acctaccacagtgtct

SEQ ID NO: 5149841 - DNA, 16 bp, Homo sapiens
acctaccaggacagaa

SEQ ID NO: 5149842 - DNA, 15 bp, Homo sapiens
acctaccccagccag

SEQ ID NO: 5149843 - DNA, 18 bp, Homo sapiens
acctaccccagccaggct

SEQ ID NO: 5149844 - DNA, 20 bp, Homo sapiens
acctaccccatgaagatatt

SEQ ID NO: 5149845 - DNA, 20 bp, Homo sapiens
acctacccctgacttctgtt

SEQ ID NO: 5149846 - DNA, 12 bp, Homo sapiens
acctacctcagg

SEQ ID NO: 5149847 - DNA, 16 bp, Homo sapiens
acctacctcaggttgc

SEQ ID NO: 5149848 - DNA, 13 bp, Homo sapiens
acctacctccctc

SEQ ID NO: 5149849 - DNA, 16 bp, Homo sapiens
acctacctccctccct

SEQ ID NO: 5149850 - DNA, 16 bp, Homo sapiens
acctacctgccttgga

SEQ ID NO: 5149851 - DNA, 22 bp, Homo sapiens
acctacctggcccctgagctct

SEQ ID NO: 5149852 - DNA, 18 bp, Homo sapiens
acctacctgtaacttttt

SEQ ID NO: 5149853 - DNA, 15 bp, Homo sapiens
acctacctgtgaatc

SEQ ID NO: 5149854 - DNA, 17 bp, Homo sapiens
acctacctgtgaatcat

SEQ ID NO: 5149855 - DNA, 18 bp, Homo sapiens
acctaccttcaaagctga

SEQ ID NO: 5149856 - DNA, 16 bp, Homo sapiens
acctacgaccccagag

SEQ ID NO: 5149857 - DNA, 20 bp, Homo sapiens
acctacgttcctggccccct

SEQ ID NO: 5149858 - DNA, 20 bp, Homo sapiens
acctacgtttgcaccgcctg

SEQ ID NO: 5149859 - DNA, 17 bp, Homo sapiens
acctactactcaattgt

SEQ ID NO: 5149860 - DNA, 17 bp, Homo sapiens
acctactatgtgctggg

SEQ ID NO: 5149861 - DNA, 18 bp, Homo sapiens
acctactctggctagaag

SEQ ID NO: 5149862 - DNA, 16 bp, Homo sapiens
acctactgcactttcc

SEQ ID NO: 5149863 - DNA, 13 bp, Homo sapiens
acctactgcccac

SEQ ID NO: 5149864 - DNA, 17 bp, Homo sapiens
acctactgcccacattt

SEQ ID NO: 5149865 - DNA, 23 bp, Homo sapiens
acctactgcccaggcactgcaaa

SEQ ID NO: 5149866 - DNA, 22 bp, Homo sapiens
acctactggtgtaatctcaatg

SEQ ID NO: 5149867 - DNA, 20 bp, Homo sapiens
acctactgttctaaagctct

SEQ ID NO: 5149868 - DNA, 21 bp, Homo sapiens
acctactgttctaaagctctg

SEQ ID NO: 5149869 - DNA, 23 bp, Homo sapiens
acctactgttctaaagctctgac

SEQ ID NO: 5149870 - DNA, 23 bp, Homo sapiens
acctacttatttcagattcacct

SEQ ID NO: 5149871 - DNA, 15 bp, Homo sapiens
acctagaaacaagga

SEQ ID NO: 5149872 - DNA, 22 bp, Homo sapiens
acctagaaattgacacaagtgg

SEQ ID NO: 5149873 - DNA, 18 bp, Homo sapiens
acctagaacctccctcct

SEQ ID NO: 5149874 - DNA, 17 bp, Homo sapiens
acctagaacttcaaaat

SEQ ID NO: 5149875 - DNA, 20 bp, Homo sapiens
acctagaagaagctatgtca

SEQ ID NO: 5149876 - DNA, 18 bp, Homo sapiens
acctagaagtaagaagag

SEQ ID NO: 5149877 - DNA, 19 bp, Homo sapiens
acctagaagtaagaagagg

SEQ ID NO: 5149878 - DNA, 16 bp, Homo sapiens
acctagaagtctccct

SEQ ID NO: 5149879 - DNA, 21 bp, Homo sapiens
acctagaatgtcagatttctg

SEQ ID NO: 5149880 - DNA, 20 bp, Homo sapiens
acctagaccagtttgcatga

SEQ ID NO: 5149881 - DNA, 20 bp, Homo sapiens
acctagaccttgcctcccct

SEQ ID NO: 5149882 - DNA, 21 bp, Homo sapiens
acctagaccttgcctcccctc

SEQ ID NO: 5149883 - DNA, 23 bp, Homo sapiens
acctagaccttgcctcccctcct

SEQ ID NO: 5149884 - DNA, 17 bp, Homo sapiens
acctagactctccctgt

SEQ ID NO: 5149885 - DNA, 15 bp, Homo sapiens
acctagagccagacc

SEQ ID NO: 5149886 - DNA, 16 bp, Homo sapiens
acctagagccagacca

SEQ ID NO: 5149887 - DNA, 15 bp, Homo sapiens
acctagagccgggca

SEQ ID NO: 5149888 - DNA, 21 bp, Homo sapiens
acctagcaacatatctctgcc

SEQ ID NO: 5149889 - DNA, 14 bp, Homo sapiens
acctagcagcaccg

SEQ ID NO: 5149890 - DNA, 22 bp, Homo sapiens
acctagcagcaccgttctgtgc

SEQ ID NO: 5149891 - DNA, 23 bp, Homo sapiens
acctagcagcaccgttctgtgca

SEQ ID NO: 5149892 - DNA, 21 bp, Homo sapiens
acctagcaggctgttccatgt

SEQ ID NO: 5149893 - DNA, 21 bp, Homo sapiens
acctagcgggatggggctccc

SEQ ID NO: 5149894 - DNA, 16 bp, Homo sapiens
acctagctaattattt

SEQ ID NO: 5149895 - DNA, 17 bp, Homo sapiens
acctagctgcatctata

SEQ ID NO: 5149896 - DNA, 22 bp, Homo sapiens
acctagctggttaatggcagca

SEQ ID NO: 5149897 - DNA, 20 bp, Homo sapiens
acctagctgtgccccctctg

SEQ ID NO: 5149898 - DNA, 16 bp, Homo sapiens
acctagctgttgtaaa

SEQ ID NO: 5149899 - DNA, 17 bp, Homo sapiens
acctagctgttgtaaag

SEQ ID NO: 5149900 - DNA, 21 bp, Homo sapiens
acctagctgttgtaaagaatt

SEQ ID NO: 5149901 - DNA, 17 bp, Homo sapiens
acctaggaagcctcaga

SEQ ID NO: 5149902 - DNA, 22 bp, Homo sapiens
acctaggaagcctcagattcct

SEQ ID NO: 5149903 - DNA, 22 bp, Homo sapiens
acctaggactgactcggcagtg

SEQ ID NO: 5149904 - DNA, 17 bp, Homo sapiens
acctaggcaatgaagaa

SEQ ID NO: 5149905 - DNA, 23 bp, Homo sapiens
acctaggcccattgctgacgatt

SEQ ID NO: 5149906 - DNA, 20 bp, Homo sapiens
acctaggctcatggacgaga

SEQ ID NO: 5149907 - DNA, 12 bp, Homo sapiens
acctaggctcct

SEQ ID NO: 5149908 - DNA, 15 bp, Homo sapiens
acctaggctcctctt

SEQ ID NO: 5149909 - DNA, 13 bp, Homo sapiens
acctaggctgagg

SEQ ID NO: 5149910 - DNA, 24 bp, Homo sapiens
acctagggaggaccttatctgtgc

SEQ ID NO: 5149911 - DNA, 22 bp, Homo sapiens
acctagggcgacgtcttcagag

SEQ ID NO: 5149912 - DNA, 15 bp, Homo sapiens
acctaggggcgccgc

SEQ ID NO: 5149913 - DNA, 23 bp, Homo sapiens
acctaggggtttctgttggataa

SEQ ID NO: 5149914 - DNA, 16 bp, Homo sapiens
acctagggtgatatta

SEQ ID NO: 5149915 - DNA, 19 bp, Homo sapiens
acctaggtcgccagtgaaa

SEQ ID NO: 5149916 - DNA, 21 bp, Homo sapiens
acctaggtcgccagtgaaata

SEQ ID NO: 5149917 - DNA, 22 bp, Homo sapiens
acctagtaagtgcctgctgtat

SEQ ID NO: 5149918 - DNA, 18 bp, Homo sapiens
acctagtacattactaaa

SEQ ID NO: 5149919 - DNA, 19 bp, Homo sapiens
acctagtacattactaaat

SEQ ID NO: 5149920 - DNA, 14 bp, Homo sapiens
acctagtactgccc

SEQ ID NO: 5149921 - DNA, 15 bp, Homo sapiens
acctagtagtcattt

SEQ ID NO: 5149922 - DNA, 18 bp, Homo sapiens
acctagtcccctttcctc

SEQ ID NO: 5149923 - DNA, 16 bp, Homo sapiens
acctagtccgctgaag

SEQ ID NO: 5149924 - DNA, 14 bp, Homo sapiens
acctagtgaaactt

SEQ ID NO: 5149925 - DNA, 20 bp, Homo sapiens
acctagtgaaacttttctag

SEQ ID NO: 5149926 - DNA, 19 bp, Homo sapiens
acctagtgcatttggcact

SEQ ID NO: 5149927 - DNA, 22 bp, Homo sapiens
acctagttaaagaaaggaaaag

SEQ ID NO: 5149928 - DNA, 18 bp, Homo sapiens
acctataaagtaaagcta

SEQ ID NO: 5149929 - DNA, 20 bp, Homo sapiens
acctataaagtgtttatgac

SEQ ID NO: 5149930 - DNA, 22 bp, Homo sapiens
acctataaatactaaatatgaa

SEQ ID NO: 5149931 - DNA, 20 bp, Homo sapiens
acctataaatggacttgctt

SEQ ID NO: 5149932 - DNA, 17 bp, Homo sapiens
acctataagaagcctta

SEQ ID NO: 5149933 - DNA, 16 bp, Homo sapiens
acctataatgtgtgta

SEQ ID NO: 5149934 - DNA, 22 bp, Homo sapiens
acctataatgtgtgtatgtgta

SEQ ID NO: 5149935 - DNA, 16 bp, Homo sapiens
acctataattttgcaa

SEQ ID NO: 5149936 - DNA, 19 bp, Homo sapiens
acctatacaacctaactta

SEQ ID NO: 5149937 - DNA, 18 bp, Homo sapiens
acctatacctatgtgaaa

SEQ ID NO: 5149938 - DNA, 15 bp, Homo sapiens
acctatacctgtgtt

SEQ ID NO: 5149939 - DNA, 15 bp, Homo sapiens
acctatactgaaaga

SEQ ID NO: 5149940 - DNA, 14 bp, Homo sapiens
acctataggaaagt

SEQ ID NO: 5149941 - DNA, 22 bp, Homo sapiens
acctataggaaagtctgtcagg

SEQ ID NO: 5149942 - DNA, 19 bp, Homo sapiens
acctatagtagtctgtgtt

SEQ ID NO: 5149943 - DNA, 22 bp, Homo sapiens
acctatataataaagctactga

SEQ ID NO: 5149944 - DNA, 21 bp, Homo sapiens
acctatatccagaaggggagc

SEQ ID NO: 5149945 - DNA, 17 bp, Homo sapiens
acctatatgatttatag

SEQ ID NO: 5149946 - DNA, 13 bp, Homo sapiens
acctatattcctt

SEQ ID NO: 5149947 - DNA, 15 bp, Homo sapiens
acctatattccttgt

SEQ ID NO: 5149948 - DNA, 18 bp, Homo sapiens
acctatattgatttaaaa

SEQ ID NO: 5149949 - DNA, 13 bp, Homo sapiens
acctatcaaaaac

SEQ ID NO: 5149950 - DNA, 14 bp, Homo sapiens
acctatcaaaaact

SEQ ID NO: 5149951 - DNA, 17 bp, Homo sapiens
acctatcaaaaactgac

SEQ ID NO: 5149952 - DNA, 20 bp, Homo sapiens
acctatctgtattggcagca

SEQ ID NO: 5149953 - DNA, 14 bp, Homo sapiens
acctatgaagcaat

SEQ ID NO: 5149954 - DNA, 14 bp, Homo sapiens
acctatgataaata

SEQ ID NO: 5149955 - DNA, 19 bp, Homo sapiens
acctatgatattttctgtg

SEQ ID NO: 5149956 - DNA, 15 bp, Homo sapiens
acctatgcagggagg

SEQ ID NO: 5149957 - DNA, 16 bp, Homo sapiens
acctatgcagggaggc

SEQ ID NO: 5149958 - DNA, 15 bp, Homo sapiens
acctatgcctgtggt

SEQ ID NO: 5149959 - DNA, 21 bp, Homo sapiens
acctatgcttctagaaagccc

SEQ ID NO: 5149960 - DNA, 18 bp, Homo sapiens
acctatggaagtggttct

SEQ ID NO: 5149961 - DNA, 19 bp, Homo sapiens
acctatgtcctaaggacac

SEQ ID NO: 5149962 - DNA, 23 bp, Homo sapiens
acctatgtcctaaggacacacta

SEQ ID NO: 5149963 - DNA, 17 bp, Homo sapiens
acctattacattttact

SEQ ID NO: 5149964 - DNA, 17 bp, Homo sapiens
acctattaggtggaaat

SEQ ID NO: 5149965 - DNA, 23 bp, Homo sapiens
acctattatccttctacttgtcc

SEQ ID NO: 5149966 - DNA, 17 bp, Homo sapiens
acctattcaccctccac

SEQ ID NO: 5149967 - DNA, 15 bp, Homo sapiens
acctattccttcaga

SEQ ID NO: 5149968 - DNA, 22 bp, Homo sapiens
acctattctgaaaaagacataa

SEQ ID NO: 5149969 - DNA, 22 bp, Homo sapiens
acctattgccaggaatgtttca

SEQ ID NO: 5149970 - DNA, 22 bp, Homo sapiens
acctattgctgtaaataaaaat

SEQ ID NO: 5149971 - DNA, 18 bp, Homo sapiens
acctatttcaaaaatttg

SEQ ID NO: 5149972 - DNA, 16 bp, Homo sapiens
acctatttccagaaat

SEQ ID NO: 5149973 - DNA, 11 bp, Homo sapiens
acctatttctc

SEQ ID NO: 5149974 - DNA, 13 bp, Homo sapiens
acctatttctgat

SEQ ID NO: 5149975 - DNA, 18 bp, Homo sapiens
acctatttctgatgatgt

SEQ ID NO: 5149976 - DNA, 23 bp, Homo sapiens
acctgggtccaaataaaaactaa

SEQ ID NO: 5149977 - DNA, 21 bp, Homo sapiens
acctgggtgctctggctggag

SEQ ID NO: 5149978 - DNA, 14 bp, Homo sapiens
acctgggtgtgctc

SEQ ID NO: 5149979 - DNA, 23 bp, Homo sapiens
acctgggtgtgctccaggcttcc

SEQ ID NO: 5149980 - DNA, 23 bp, Homo sapiens
acctgggttagggtgtgtgttca

SEQ ID NO: 5149981 - DNA, 22 bp, Homo sapiens
acctgggttccccaccccgggc

SEQ ID NO: 5149982 - DNA, 22 bp, Homo sapiens
acctgggttccctttccttcca

SEQ ID NO: 5149983 - DNA, 19 bp, Homo sapiens
acctgggtttccagggcac

SEQ ID NO: 5149984 - DNA, 16 bp, Homo sapiens
acctgggtttgcaaga

SEQ ID NO: 5149985 - DNA, 21 bp, Homo sapiens
acctggtactccctctcagga

SEQ ID NO: 5149986 - DNA, 19 bp, Homo sapiens
acctggtactgcacatttt

SEQ ID NO: 5149987 - DNA, 20 bp, Homo sapiens
acctggtattatttttctta

SEQ ID NO: 5149988 - DNA, 18 bp, Homo sapiens
acctggtccacagggcac

SEQ ID NO: 5149989 - DNA, 22 bp, Homo sapiens
acctggtccccactgctgagct

SEQ ID NO: 5149990 - DNA, 20 bp, Homo sapiens
acctggtcctccgcctactg

SEQ ID NO: 5149991 - DNA, 16 bp, Homo sapiens
acctggtctggtcagg

SEQ ID NO: 5149992 - DNA, 21 bp, Homo sapiens
acctggtgagtaacttagaaa

SEQ ID NO: 5149993 - DNA, 20 bp, Homo sapiens
acctggtgcatcgaaatgta

SEQ ID NO: 5149994 - DNA, 14 bp, Homo sapiens
acctggtgcccctg

SEQ ID NO: 5149995 - DNA, 15 bp, Homo sapiens
acctggtgcgggcct

SEQ ID NO: 5149996 - DNA, 17 bp, Homo sapiens
acctggtgcgggcctgg

SEQ ID NO: 5149997 - DNA, 20 bp, Homo sapiens
acctggtgcgggcctggccc

SEQ ID NO: 5149998 - DNA, 21 bp, Homo sapiens
acctggtgcgggcctggccct

SEQ ID NO: 5149999 - DNA, 21 bp, Homo sapiens
acctggtgctcgggaagggag

SEQ ID NO: 5150000 - DNA, 13 bp, Homo sapiens
acctggtgctgga

SEQ ID NO: 5150001 - DNA, 14 bp, Homo sapiens
acctggtgctggat

SEQ ID NO: 5150002 - DNA, 15 bp, Homo sapiens
acctggtggccctgc

SEQ ID NO: 5150003 - DNA, 16 bp, Homo sapiens
acctggtggccctgcg

SEQ ID NO: 5150004 - DNA, 17 bp, Homo sapiens
acctggtggccctgcgg

SEQ ID NO: 5150005 - DNA, 14 bp, Homo sapiens
acctggtggctgga

SEQ ID NO: 5150006 - DNA, 13 bp, Homo sapiens
acctggttgagtg

SEQ ID NO: 5150007 - DNA, 16 bp, Homo sapiens
acctggttggccgtgg

SEQ ID NO: 5150008 - DNA, 16 bp, Homo sapiens
acctggttgtccaggt

SEQ ID NO: 5150009 - DNA, 17 bp, Homo sapiens
acctggttgtccaggtc

SEQ ID NO: 5150010 - DNA, 12 bp, Homo sapiens
acctgtaaatta

SEQ ID NO: 5150011 - DNA, 13 bp, Homo sapiens
acctgtaactgcc

SEQ ID NO: 5150012 - DNA, 14 bp, Homo sapiens
acctgtaacttttt

SEQ ID NO: 5150013 - DNA, 13 bp, Homo sapiens
acctgtaataaat

SEQ ID NO: 5150014 - DNA, 15 bp, Homo sapiens
acctgtaataaatat

SEQ ID NO: 5150015 - DNA, 18 bp, Homo sapiens
acctgtaataaatatgag

SEQ ID NO: 5150016 - DNA, 21 bp, Homo sapiens
acctgtaataaatatgagtgc

SEQ ID NO: 5150017 - DNA, 20 bp, Homo sapiens
acctgtaatagcctcacctt

SEQ ID NO: 5150018 - DNA, 11 bp, Homo sapiens
acctgtaatca

SEQ ID NO: 5150019 - DNA, 17 bp, Homo sapiens
acctgtaatcccagcac

SEQ ID NO: 5150020 - DNA, 20 bp, Homo sapiens
acctgtaatcccagctactt

SEQ ID NO: 5150021 - DNA, 17 bp, Homo sapiens
acctgtaatctcagcac

SEQ ID NO: 5150022 - DNA, 20 bp, Homo sapiens
acctgtacacacacagacac

SEQ ID NO: 5150023 - DNA, 22 bp, Homo sapiens
acctgtactatgatgggcttct

SEQ ID NO: 5150024 - DNA, 13 bp, Homo sapiens
acctgtagaagat

SEQ ID NO: 5150025 - DNA, 17 bp, Homo sapiens
acctgtagccatctgca

SEQ ID NO: 5150026 - DNA, 15 bp, Homo sapiens
acctgtagtcccagc

SEQ ID NO: 5150027 - DNA, 20 bp, Homo sapiens
acctgtagtcccagctactt

SEQ ID NO: 5150028 - DNA, 20 bp, Homo sapiens
acctgtataaccctgttaca

SEQ ID NO: 5150029 - DNA, 23 bp, Homo sapiens
acctgtataagtggaggcacttt

SEQ ID NO: 5150030 - DNA, 16 bp, Homo sapiens
acctgtatacagtgca

SEQ ID NO: 5150031 - DNA, 18 bp, Homo sapiens
acctgtatactcttgaat

SEQ ID NO: 5150032 - DNA, 17 bp, Homo sapiens
acctgtatatttctttt

SEQ ID NO: 5150033 - DNA, 20 bp, Homo sapiens
acctgtatatttgtaaagct

SEQ ID NO: 5150034 - DNA, 12 bp, Homo sapiens
acctgtatcttt

SEQ ID NO: 5150035 - DNA, 18 bp, Homo sapiens
acctgtatctttctatgc

SEQ ID NO: 5150036 - DNA, 20 bp, Homo sapiens
acctgtatttaaaaatagaa

SEQ ID NO: 5150037 - DNA, 14 bp, Homo sapiens
acctgtatttttgt

SEQ ID NO: 5150038 - DNA, 21 bp, Homo sapiens
acctgtatttttgttagttta

SEQ ID NO: 5150039 - DNA, 23 bp, Homo sapiens
acctgtatttttgttagtttaca

SEQ ID NO: 5150040 - DNA, 18 bp, Homo sapiens
acctgtcaaaaattttga

SEQ ID NO: 5150041 - DNA, 19 bp, Homo sapiens
acctgtcaaaaattttgaa

SEQ ID NO: 5150042 - DNA, 19 bp, Homo sapiens
acctgtcaaacaaagccag

SEQ ID NO: 5150043 - DNA, 22 bp, Homo sapiens
acctgtcaatgatacagtccct

SEQ ID NO: 5150044 - DNA, 15 bp, Homo sapiens
acctgtcacattgca

SEQ ID NO: 5150045 - DNA, 18 bp, Homo sapiens
acctgtcaccctgcagga

SEQ ID NO: 5150046 - DNA, 15 bp, Homo sapiens
acctgtcacctggcc

SEQ ID NO: 5150047 - DNA, 23 bp, Homo sapiens
acctgtcacgattgtcatcagga

SEQ ID NO: 5150048 - DNA, 15 bp, Homo sapiens
acctgtcagaataaa

SEQ ID NO: 5150049 - DNA, 17 bp, Homo sapiens
acctgtcatctgggcca

SEQ ID NO: 5150050 - DNA, 18 bp, Homo sapiens
acctgtcatctgggccac

SEQ ID NO: 5150051 - DNA, 18 bp, Homo sapiens
acctgtcatgcccccctc

SEQ ID NO: 5150052 - DNA, 11 bp, Homo sapiens
acctgtccaat

SEQ ID NO: 5150053 - DNA, 16 bp, Homo sapiens
acctgtccataaagta

SEQ ID NO: 5150054 - DNA, 14 bp, Homo sapiens
acctgtcccacctc

SEQ ID NO: 5150055 - DNA, 18 bp, Homo sapiens
acctgtcccccactctct

SEQ ID NO: 5150056 - DNA, 20 bp, Homo sapiens
acctgtcccccactctctca

SEQ ID NO: 5150057 - DNA, 15 bp, Homo sapiens
acctgtccccctgac

SEQ ID NO: 5150058 - DNA, 13 bp, Homo sapiens
acctgtccctcca

SEQ ID NO: 5150059 - DNA, 15 bp, Homo sapiens
acctgtccggcccag

SEQ ID NO: 5150060 - DNA, 14 bp, Homo sapiens
acctgtcctgtctt

SEQ ID NO: 5150061 - DNA, 19 bp, Homo sapiens
acctgtcctgtctttgatc

SEQ ID NO: 5150062 - DNA, 19 bp, Homo sapiens
acctgtccttactcagagc

SEQ ID NO: 5150063 - DNA, 22 bp, Homo sapiens
acctgtccttactcagagctgc

SEQ ID NO: 5150064 - DNA, 16 bp, Homo sapiens
acctgtcgtctctccc

SEQ ID NO: 5150065 - DNA, 22 bp, Homo sapiens
acctgtctaggaaggtgtgatg

SEQ ID NO: 5150066 - DNA, 23 bp, Homo sapiens
acctgtctataagagaattatat

SEQ ID NO: 5150067 - DNA, 12 bp, Homo sapiens
acctgtctcctt

SEQ ID NO: 5150068 - DNA, 14 bp, Homo sapiens
acctgtctctctct

SEQ ID NO: 5150069 - DNA, 18 bp, Homo sapiens
acctgtctgaactgttaa

SEQ ID NO: 5150070 - DNA, 14 bp, Homo sapiens
acctgtctgctcca

SEQ ID NO: 5150071 - DNA, 19 bp, Homo sapiens
acctgtctgctccagctct

SEQ ID NO: 5150072 - DNA, 15 bp, Homo sapiens
acctgtctgctgcca

SEQ ID NO: 5150073 - DNA, 12 bp, Homo sapiens
acctgtctgtct

SEQ ID NO: 5150074 - DNA, 18 bp, Homo sapiens
acctgtctgtctgtctgt

SEQ ID NO: 5150075 - DNA, 20 bp, Homo sapiens
acctgtctgtctgtctgtcc

SEQ ID NO: 5150076 - DNA, 13 bp, Homo sapiens
acctgtctgtgca

SEQ ID NO: 5150077 - DNA, 21 bp, Homo sapiens
acctgtcttattaagactggc

SEQ ID NO: 5150078 - DNA, 16 bp, Homo sapiens
acctgtcttgaataag

SEQ ID NO: 5150079 - DNA, 22 bp, Homo sapiens
acctgtcttgcctttttcatta

SEQ ID NO: 5150080 - DNA, 16 bp, Homo sapiens
acctgtcttgctcctg

SEQ ID NO: 5150081 - DNA, 17 bp, Homo sapiens
acctgtcttgctcctgg

SEQ ID NO: 5150082 - DNA, 22 bp, Homo sapiens
acctgtcttgctcctggggaga

SEQ ID NO: 5150083 - DNA, 15 bp, Homo sapiens
acctgtcttggcctc

SEQ ID NO: 5150084 - DNA, 20 bp, Homo sapiens
acctgtgacaaaggatgaag

SEQ ID NO: 5150085 - DNA, 17 bp, Homo sapiens
acctgtgacagcagctc

SEQ ID NO: 5150086 - DNA, 18 bp, Homo sapiens
acctgtgactcttagccc

SEQ ID NO: 5150087 - DNA, 17 bp, Homo sapiens
acctgtgagcccagctg

SEQ ID NO: 5150088 - DNA, 15 bp, Homo sapiens
acctgtgaggaagag

SEQ ID NO: 5150089 - DNA, 15 bp, Homo sapiens
acctgtgaggactgg

SEQ ID NO: 5150090 - DNA, 19 bp, Homo sapiens
acctgtgagtttaaagcaa

SEQ ID NO: 5150091 - DNA, 18 bp, Homo sapiens
acctgtgatctagtcctt

SEQ ID NO: 5150092 - DNA, 18 bp, Homo sapiens
acctgtgcaaaataaaat

SEQ ID NO: 5150093 - DNA, 13 bp, Homo sapiens
acctgtgcacccc

SEQ ID NO: 5150094 - DNA, 14 bp, Homo sapiens
acctgtgcacccca

SEQ ID NO: 5150095 - DNA, 15 bp, Homo sapiens
acctgtgcagggccc

SEQ ID NO: 5150096 - DNA, 23 bp, Homo sapiens
acctgtgcagggccctctggggc

SEQ ID NO: 5150097 - DNA, 18 bp, Homo sapiens
acctgtgcagtcccgtgg

SEQ ID NO: 5150098 - DNA, 13 bp, Homo sapiens
acctgtgccaggc

SEQ ID NO: 5150099 - DNA, 13 bp, Homo sapiens
acctgtgcctccc

SEQ ID NO: 5150100 - DNA, 14 bp, Homo sapiens
acctgtgcctcggc

SEQ ID NO: 5150101 - DNA, 15 bp, Homo sapiens
acctgtgcctcggct

SEQ ID NO: 5150102 - DNA, 14 bp, Homo sapiens
acctgtgctgctgc

SEQ ID NO: 5150103 - DNA, 23 bp, Homo sapiens
acctgtgctggagccctgttcct

SEQ ID NO: 5150104 - DNA, 14 bp, Homo sapiens
acctgtgctttgag

SEQ ID NO: 5150105 - DNA, 15 bp, Homo sapiens
acctgtggagaagcc

SEQ ID NO: 5150106 - DNA, 10 bp, Homo sapiens
acctgtggat

SEQ ID NO: 5150107 - DNA, 17 bp, Homo sapiens
acctgtggccaagttct

SEQ ID NO: 5150108 - DNA, 18 bp, Homo sapiens
acctgtggccaagttctt

SEQ ID NO: 5150109 - DNA, 16 bp, Homo sapiens
acctgtggccagagca

SEQ ID NO: 5150110 - DNA, 18 bp, Homo sapiens
acctgtggccagagcacc

SEQ ID NO: 5150111 - DNA, 22 bp, Homo sapiens
acctgtggccagagcacctcag

SEQ ID NO: 5150112 - DNA, 20 bp, Homo sapiens
acctgtggggatttctccca

SEQ ID NO: 5150113 - DNA, 23 bp, Homo sapiens
acctgtggggatttctcccagct

SEQ ID NO: 5150114 - DNA, 14 bp, Homo sapiens
acctgtggggcctg

SEQ ID NO: 5150115 - DNA, 16 bp, Homo sapiens
acctgtggggcctggg

SEQ ID NO: 5150116 - DNA, 13 bp, Homo sapiens
acctgtgtacata

SEQ ID NO: 5150117 - DNA, 23 bp, Homo sapiens
acctgtgtatggtgacctctccg

SEQ ID NO: 5150118 - DNA, 23 bp, Homo sapiens
acctgtgtccccgatgctgacct

SEQ ID NO: 5150119 - DNA, 19 bp, Homo sapiens
acctgtgtccgatgctgga

SEQ ID NO: 5150120 - DNA, 18 bp, Homo sapiens
acctgtgtgcccagcacc

SEQ ID NO: 5150121 - DNA, 22 bp, Homo sapiens
acctgtgtgcccagcacctgga

SEQ ID NO: 5150122 - DNA, 20 bp, Homo sapiens
acctgtgtggtactctgaaa

SEQ ID NO: 5150123 - DNA, 22 bp, Homo sapiens
acctgtgtggtactctgaaaca

SEQ ID NO: 5150124 - DNA, 22 bp, Homo sapiens
acctgtgtgtatgtgtgtgttt

SEQ ID NO: 5150125 - DNA, 16 bp, Homo sapiens
acctgtgtgtctccat

SEQ ID NO: 5150126 - DNA, 19 bp, Homo sapiens
acctgtgtgtctccataaa

SEQ ID NO: 5150127 - DNA, 19 bp, Homo sapiens
acctgtgtgttcttttgat

SEQ ID NO: 5150128 - DNA, 17 bp, Homo sapiens
acctgtgtttcttgcct

SEQ ID NO: 5150129 - DNA, 19 bp, Homo sapiens
acctgtgtttcttgcctca

SEQ ID NO: 5150130 - DNA, 18 bp, Homo sapiens
acctgttaaaatgtacac

SEQ ID NO: 5150131 - DNA, 20 bp, Homo sapiens
acctgttaaaatgtacactg

SEQ ID NO: 5150132 - DNA, 23 bp, Homo sapiens
acctgttaaggtggaaaatggac

SEQ ID NO: 5150133 - DNA, 18 bp, Homo sapiens
acctgttacctactttga

SEQ ID NO: 5150134 - DNA, 17 bp, Homo sapiens
acctgttagcagacagg

SEQ ID NO: 5150135 - DNA, 14 bp, Homo sapiens
acctgttatgccaa

SEQ ID NO: 5150136 - DNA, 16 bp, Homo sapiens
acctgttatttatcaa

SEQ ID NO: 5150137 - DNA, 15 bp, Homo sapiens
acctgttattttatg

SEQ ID NO: 5150138 - DNA, 20 bp, Homo sapiens
acctgttcaaaatgttaata

SEQ ID NO: 5150139 - DNA, 22 bp, Homo sapiens
acctgttcacagaaaaagcatg

SEQ ID NO: 5150140 - DNA, 14 bp, Homo sapiens
acctgttcaggagc

SEQ ID NO: 5150141 - DNA, 15 bp, Homo sapiens
acctgttcaggagct

SEQ ID NO: 5150142 - DNA, 18 bp, Homo sapiens
acctgttcagtgtcccgg

SEQ ID NO: 5150143 - DNA, 19 bp, Homo sapiens
acctgttcagtgtcccggg

SEQ ID NO: 5150144 - DNA, 20 bp, Homo sapiens
acctgttcagtgtcccgggc

SEQ ID NO: 5150145 - DNA, 13 bp, Homo sapiens
acctgttccattg

SEQ ID NO: 5150146 - DNA, 13 bp, Homo sapiens
acctgttcctccc

SEQ ID NO: 5150147 - DNA, 22 bp, Homo sapiens
acctgttctggtagctccacaa

SEQ ID NO: 5150148 - DNA, 17 bp, Homo sapiens
acctgttcttagagtgt

SEQ ID NO: 5150149 - DNA, 18 bp, Homo sapiens
acctgttcttagagtgta

SEQ ID NO: 5150150 - DNA, 20 bp, Homo sapiens
acctgttcttagagtgtagc

SEQ ID NO: 5150151 - DNA, 21 bp, Homo sapiens
acctgttcttagagtgtagct

SEQ ID NO: 5150152 - DNA, 21 bp, Homo sapiens
acctgttcttccttttttaaa

SEQ ID NO: 5150153 - DNA, 21 bp, Homo sapiens
acctgttcttgggcctcaggc

SEQ ID NO: 5150154 - DNA, 23 bp, Homo sapiens
acctatttcttaaacacttgcaa

SEQ ID NO: 5150155 - DNA, 14 bp, Homo sapiens
acctatttgacata

SEQ ID NO: 5150156 - DNA, 22 bp, Homo sapiens
acctatttggtgctagtaaatt

SEQ ID NO: 5150157 - DNA, 16 bp, Homo sapiens
acctattttagacaaa

SEQ ID NO: 5150158 - DNA, 14 bp, Homo sapiens
acctatttttcctt

SEQ ID NO: 5150159 - DNA, 15 bp, Homo sapiens
acctatttttccttt

SEQ ID NO: 5150160 - DNA, 17 bp, Homo sapiens
acctcaaactaggagga

SEQ ID NO: 5150161 - DNA, 14 bp, Homo sapiens
acctcaaactgggt

SEQ ID NO: 5150162 - DNA, 20 bp, Homo sapiens
acctcaaatgatgtgcctgc

SEQ ID NO: 5150163 - DNA, 22 bp, Homo sapiens
acctcaaatgatgtgcctgctt

SEQ ID NO: 5150164 - DNA, 16 bp, Homo sapiens
acctcaaccaatgcca

SEQ ID NO: 5150165 - DNA, 15 bp, Homo sapiens
acctcaacccagagg

SEQ ID NO: 5150166 - DNA, 22 bp, Homo sapiens
acctcaacccccatttctattt

SEQ ID NO: 5150167 - DNA, 17 bp, Homo sapiens
acctcaacctgtaaatt

SEQ ID NO: 5150168 - DNA, 16 bp, Homo sapiens
acctcaacctgtgatg

SEQ ID NO: 5150169 - DNA, 17 bp, Homo sapiens
acctcaactaaccctta

SEQ ID NO: 5150170 - DNA, 13 bp, Homo sapiens
acctcaagccatc

SEQ ID NO: 5150171 - DNA, 14 bp, Homo sapiens
acctcaagctgcat

SEQ ID NO: 5150172 - DNA, 16 bp, Homo sapiens
acctcaagctgcatct

SEQ ID NO: 5150173 - DNA, 12 bp, Homo sapiens
acctcaagggct

SEQ ID NO: 5150174 - DNA, 22 bp, Homo sapiens
acctcaagtaataggcatttta

SEQ ID NO: 5150175 - DNA, 23 bp, Homo sapiens
acctcaagtgatctgtccacctc

SEQ ID NO: 5150176 - DNA, 17 bp, Homo sapiens
acctcaagtgtcctgaa

SEQ ID NO: 5150177 - DNA, 19 bp, Homo sapiens
acctcaatgccctgccatt

SEQ ID NO: 5150178 - DNA, 13 bp, Homo sapiens
acctcaatgtccc

SEQ ID NO: 5150179 - DNA, 12 bp, Homo sapiens
acctcaatttat

SEQ ID NO: 5150180 - DNA, 20 bp, Homo sapiens
acctcaatttatgttaacag

SEQ ID NO: 5150181 - DNA, 14 bp, Homo sapiens
acctcaatttttgt

SEQ ID NO: 5150182 - DNA, 20 bp, Homo sapiens
acctcaatttttgtttttga

SEQ ID NO: 5150183 - DNA, 21 bp, Homo sapiens
acctcacaaggttatcagaaa

SEQ ID NO: 5150184 - DNA, 15 bp, Homo sapiens
acctcacacacctct

SEQ ID NO: 5150185 - DNA, 18 bp, Homo sapiens
acctcacactactgtatt

SEQ ID NO: 5150186 - DNA, 16 bp, Homo sapiens
acctcacactccttta

SEQ ID NO: 5150187 - DNA, 18 bp, Homo sapiens
acctcacagaaatgagat

SEQ ID NO: 5150188 - DNA, 21 bp, Homo sapiens
acctcacagtgacccttccca

SEQ ID NO: 5150189 - DNA, 16 bp, Homo sapiens
acctcaccaaactagt

SEQ ID NO: 5150190 - DNA, 11 bp, Homo sapiens
acctcaccatt

SEQ ID NO: 5150191 - DNA, 11 bp, Homo sapiens
acctcacccca

SEQ ID NO: 5150192 - DNA, 22 bp, Homo sapiens
acctcaccccgaggccctgcat

SEQ ID NO: 5150193 - DNA, 18 bp, Homo sapiens
acctcacccctccttggt

SEQ ID NO: 5150194 - DNA, 13 bp, Homo sapiens
acctcacccggcc

SEQ ID NO: 5150195 - DNA, 15 bp, Homo sapiens
acctcacccggcctc

SEQ ID NO: 5150196 - DNA, 17 bp, Homo sapiens
acctcacccggcctctt

SEQ ID NO: 5150197 - DNA, 13 bp, Homo sapiens
acctcaccctctc

SEQ ID NO: 5150198 - DNA, 12 bp, Homo sapiens
acctcaccctgc

SEQ ID NO: 5150199 - DNA, 17 bp, Homo sapiens
acctcaccggcatgctg

SEQ ID NO: 5150200 - DNA, 19 bp, Homo sapiens
acctcaccggcatgctggc

SEQ ID NO: 5150201 - DNA, 21 bp, Homo sapiens
acctcaccggcatgctggcct

SEQ ID NO: 5150202 - DNA, 13 bp, Homo sapiens
acctcacctccat

SEQ ID NO: 5150203 - DNA, 23 bp, Homo sapiens
acctcacctgagacctccactcc

SEQ ID NO: 5150204 - DNA, 14 bp, Homo sapiens
acctcaccttcctg

SEQ ID NO: 5150205 - DNA, 15 bp, Homo sapiens
acctcaccttcctgt

SEQ ID NO: 5150206 - DNA, 17 bp, Homo sapiens
acctcaccttcctgtgg

SEQ ID NO: 5150207 - DNA, 16 bp, Homo sapiens
acctcacctttgcaaa

SEQ ID NO: 5150208 - DNA, 19 bp, Homo sapiens
acctcacctttgcaaagtt

SEQ ID NO: 5150209 - DNA, 15 bp, Homo sapiens
acctcacgcacctcc

SEQ ID NO: 5150210 - DNA, 18 bp, Homo sapiens
acctcacgcacctcccat

SEQ ID NO: 5150211 - DNA, 22 bp, Homo sapiens
acctcacgcacctcccatccta

SEQ ID NO: 5150212 - DNA, 22 bp, Homo sapiens
acctcacgcaggctgagtccag

SEQ ID NO: 5150213 - DNA, 14 bp, Homo sapiens
acctcacgctctgg

SEQ ID NO: 5150214 - DNA, 22 bp, Homo sapiens
acctcactagccatgctttatg

SEQ ID NO: 5150215 - DNA, 24 bp, Homo sapiens
acctcactatggtatgctggccag

SEQ ID NO: 5150216 - DNA, 21 bp, Homo sapiens
acctcactcagaagtccagag

SEQ ID NO: 5150217 - DNA, 14 bp, Homo sapiens
acctcactcagcac

SEQ ID NO: 5150218 - DNA, 15 bp, Homo sapiens
acctcactcagcacc

SEQ ID NO: 5150219 - DNA, 15 bp, Homo sapiens
acctcactctgctac

SEQ ID NO: 5150220 - DNA, 14 bp, Homo sapiens
acctcactctttat

SEQ ID NO: 5150221 - DNA, 14 bp, Homo sapiens
acctcactgcctca

SEQ ID NO: 5150222 - DNA, 20 bp, Homo sapiens
acctcactgggcctttccag

SEQ ID NO: 5150223 - DNA, 15 bp, Homo sapiens
acctcactgtcatct

SEQ ID NO: 5150224 - DNA, 17 bp, Homo sapiens
acctcactgtcatctgc

SEQ ID NO: 5150225 - DNA, 14 bp, Homo sapiens
acctcactgtccaa

SEQ ID NO: 5150226 - DNA, 15 bp, Homo sapiens
acctcactgtccaat

SEQ ID NO: 5150227 - DNA, 15 bp, Homo sapiens
acctcacttgcttct

SEQ ID NO: 5150228 - DNA, 21 bp, Homo sapiens
acctcacttgcttcttatcct

SEQ ID NO: 5150229 - DNA, 23 bp, Homo sapiens
acctcacttttgaatctataaaa

SEQ ID NO: 5150230 - DNA, 17 bp, Homo sapiens
acctcagaaaacttatt

SEQ ID NO: 5150231 - DNA, 20 bp, Homo sapiens
acctcagaaagtcaccagga

SEQ ID NO: 5150232 - DNA, 15 bp, Homo sapiens
acctcagagccccgc

SEQ ID NO: 5150233 - DNA, 16 bp, Homo sapiens
acctcagagccccgca

SEQ ID NO: 5150234 - DNA, 17 bp, Homo sapiens
acctcagagtccaggcc

SEQ ID NO: 5150235 - DNA, 14 bp, Homo sapiens
acctcagatggcag

SEQ ID NO: 5150236 - DNA, 19 bp, Homo sapiens
acctcagatggcagctttt

SEQ ID NO: 5150237 - DNA, 20 bp, Homo sapiens
acctcagatggcagctttta

SEQ ID NO: 5150238 - DNA, 21 bp, Homo sapiens
acctcagatggcagcttttaa

SEQ ID NO: 5150239 - DNA, 19 bp, Homo sapiens
acctcagattcttcattga

SEQ ID NO: 5150240 - DNA, 17 bp, Homo sapiens
acctcagcaaatcctct

SEQ ID NO: 5150241 - DNA, 15 bp, Homo sapiens
acctcagcaacctgt

SEQ ID NO: 5150242 - DNA, 15 bp, Homo sapiens
acctcagcactgtgg

SEQ ID NO: 5150243 - DNA, 23 bp, Homo sapiens
acctcagcatttactttgtttct

SEQ ID NO: 5150244 - DNA, 23 bp, Homo sapiens
acctcagcatttccttccagccc

SEQ ID NO: 5150245 - DNA, 14 bp, Homo sapiens
acctcagccaaaca

SEQ ID NO: 5150246 - DNA, 14 bp, Homo sapiens
acctcagccatgag

SEQ ID NO: 5150247 - DNA, 14 bp, Homo sapiens
acctcagccccact

SEQ ID NO: 5150248 - DNA, 20 bp, Homo sapiens
acctcagccctggccctgcc

SEQ ID NO: 5150249 - DNA, 22 bp, Homo sapiens
acctcagccctggccctgccca

SEQ ID NO: 5150250 - DNA, 13 bp, Homo sapiens
acctcagcctaga

SEQ ID NO: 5150251 - DNA, 15 bp, Homo sapiens
acctcagcctagacc

SEQ ID NO: 5150252 - DNA, 11 bp, Homo sapiens
acctcagcctg

SEQ ID NO: 5150253 - DNA, 15 bp, Homo sapiens
acctcagcctggcca

SEQ ID NO: 5150254 - DNA, 21 bp, Homo sapiens
acctcagcctggccagacaca

SEQ ID NO: 5150255 - DNA, 17 bp, Homo sapiens
acctcagcctgggcgct

SEQ ID NO: 5150256 - DNA, 16 bp, Homo sapiens
acctcagcctgtgctg

SEQ ID NO: 5150257 - DNA, 17 bp, Homo sapiens
acctcagcctgtgctgc

SEQ ID NO: 5150258 - DNA, 18 bp, Homo sapiens
acctcagctagctctgcc

SEQ ID NO: 5150259 - DNA, 12 bp, Homo sapiens
acctcagctctg

SEQ ID NO: 5150260 - DNA, 14 bp, Homo sapiens
acctcagctctggg

SEQ ID NO: 5150261 - DNA, 12 bp, Homo sapiens
acctcagctgca

SEQ ID NO: 5150262 - DNA, 18 bp, Homo sapiens
acctcagctgcacattcc

SEQ ID NO: 5150263 - DNA, 20 bp, Homo sapiens
acctcagctgcacattcctg

SEQ ID NO: 5150264 - DNA, 23 bp, Homo sapiens
acctcagctgcacattcctggcc

SEQ ID NO: 5150265 - DNA, 12 bp, Homo sapiens
acctcaggaaag

SEQ ID NO: 5150266 - DNA, 15 bp, Homo sapiens
acctcaggaccccag

SEQ ID NO: 5150267 - DNA, 14 bp, Homo sapiens
acctcaggagggca

SEQ ID NO: 5150268 - DNA, 18 bp, Homo sapiens
acctcaggatgggccaaa

SEQ ID NO: 5150269 - DNA, 23 bp, Homo sapiens
acctcaggcactagcctttggct

SEQ ID NO: 5150270 - DNA, 15 bp, Homo sapiens
acctcaggcagctca

SEQ ID NO: 5150271 - DNA, 16 bp, Homo sapiens
acctcaggcagctcaa

SEQ ID NO: 5150272 - DNA, 17 bp, Homo sapiens
acctcaggcagctcaag

SEQ ID NO: 5150273 - DNA, 21 bp, Homo sapiens
acctcaggccaggtgcagtgg

SEQ ID NO: 5150274 - DNA, 13 bp, Homo sapiens
acctcaggcctgg

SEQ ID NO: 5150275 - DNA, 14 bp, Homo sapiens
acctcaggcctggg

SEQ ID NO: 5150276 - DNA, 18 bp, Homo sapiens
acctcaggcttccttggc

SEQ ID NO: 5150277 - DNA, 15 bp, Homo sapiens
acctcagggctatgt

SEQ ID NO: 5150278 - DNA, 18 bp, Homo sapiens
acctcagggctatgtgga

SEQ ID NO: 5150279 - DNA, 13 bp, Homo sapiens
acctcaggggaga

SEQ ID NO: 5150280 - DNA, 13 bp, Homo sapiens
acctcaggggcac

SEQ ID NO: 5150281 - DNA, 22 bp, Homo sapiens
acctcaggtaatcgacctgcct

SEQ ID NO: 5150282 - DNA, 18 bp, Homo sapiens
acctcaggtacggagaag

SEQ ID NO: 5150283 - DNA, 21 bp, Homo sapiens
acctcaggtacggagaagaat

SEQ ID NO: 5150284 - DNA, 20 bp, Homo sapiens
acctcaggtgatccacccac

SEQ ID NO: 5150285 - DNA, 16 bp, Homo sapiens
acctcaggtgccaacc

SEQ ID NO: 5150286 - DNA, 18 bp, Homo sapiens
acctcaggtgccaaccca

SEQ ID NO: 5150287 - DNA, 16 bp, Homo sapiens
acctcaggttccaaat

SEQ ID NO: 5150288 - DNA, 14 bp, Homo sapiens
acctcagtagaaaa

SEQ ID NO: 5150289 - DNA, 16 bp, Homo sapiens
acctcagtcaggcact

SEQ ID NO: 5150290 - DNA, 15 bp, Homo sapiens
acctcagtcatattt

SEQ ID NO: 5150291 - DNA, 22 bp, Homo sapiens
acctcagtctacccctctcctt

SEQ ID NO: 5150292 - DNA, 16 bp, Homo sapiens
acctcagtgtcattta

SEQ ID NO: 5150293 - DNA, 17 bp, Homo sapiens
acctcagttaaactgtg

SEQ ID NO: 5150294 - DNA, 17 bp, Homo sapiens
acctcagttcccttggc

SEQ ID NO: 5150295 - DNA, 21 bp, Homo sapiens
acctcagttcccttggcctca

SEQ ID NO: 5150296 - DNA, 22 bp, Homo sapiens
acctcagttcccttggcctcag

SEQ ID NO: 5150297 - DNA, 17 bp, Homo sapiens
acctcagttggcctctg

SEQ ID NO: 5150298 - DNA, 18 bp, Homo sapiens
acctcagttggcctctgc

SEQ ID NO: 5150299 - DNA, 21 bp, Homo sapiens
acctcagttggcctctgcccc

SEQ ID NO: 5150300 - DNA, 23 bp, Homo sapiens
acctcagttggcctctgcccctc

SEQ ID NO: 5150301 - DNA, 13 bp, Homo sapiens
acctcagttttat

SEQ ID NO: 5150302 - DNA, 19 bp, Homo sapiens
acctcataaaaatctagca

SEQ ID NO: 5150303 - DNA, 22 bp, Homo sapiens
acctcatcactggactgcatgg

SEQ ID NO: 5150304 - DNA, 14 bp, Homo sapiens
acctcatcagcctt

SEQ ID NO: 5150305 - DNA, 15 bp, Homo sapiens
acctcatcaggatga

SEQ ID NO: 5150306 - DNA, 15 bp, Homo sapiens
acctcatcatccacc

SEQ ID NO: 5150307 - DNA, 17 bp, Homo sapiens
acctcatcatccacccg

SEQ ID NO: 5150308 - DNA, 18 bp, Homo sapiens
acctcatcatccacccgc

SEQ ID NO: 5150309 - DNA, 22 bp, Homo sapiens
acctcatcattaataagtgaag

SEQ ID NO: 5150310 - DNA, 14 bp, Homo sapiens
acctcatccaaaca

SEQ ID NO: 5150311 - DNA, 16 bp, Homo sapiens
acctcatctgcctgca

SEQ ID NO: 5150312 - DNA, 14 bp, Homo sapiens
acctcatgacagcc

SEQ ID NO: 5150313 - DNA, 15 bp, Homo sapiens
acctcatgacagcca

SEQ ID NO: 5150314 - DNA, 19 bp, Homo sapiens
acctcatgacagccagagc

SEQ ID NO: 5150315 - DNA, 15 bp, Homo sapiens
acctcatgcccagct

SEQ ID NO: 5150316 - DNA, 20 bp, Homo sapiens
acctcatgcccagctctctg

SEQ ID NO: 5150317 - DNA, 22 bp, Homo sapiens
acctcatgcccagctctctgac

SEQ ID NO: 5150318 - DNA, 19 bp, Homo sapiens
acctcatgccgctgtgtct

SEQ ID NO: 5150319 - DNA, 23 bp, Homo sapiens
acctcatgcctggcccccctcca

SEQ ID NO: 5150320 - DNA, 17 bp, Homo sapiens
acctcatgctagcctca

SEQ ID NO: 5150321 - DNA, 18 bp, Homo sapiens
acctcatggagtcatctt

SEQ ID NO: 5150322 - DNA, 19 bp, Homo sapiens
acctcatggtcatggacag

SEQ ID NO: 5150323 - DNA, 15 bp, Homo sapiens
acctcatgtcatttc

SEQ ID NO: 5150324 - DNA, 16 bp, Homo sapiens
acctcatgtcatttct

SEQ ID NO: 5150325 - DNA, 15 bp, Homo sapiens
acctcatgtttatga

SEQ ID NO: 5150326 - DNA, 20 bp, Homo sapiens
acctcatgtttatgaaaata

SEQ ID NO: 5150327 - DNA, 23 bp, Homo sapiens
acctcattaaatggtgatttctt

SEQ ID NO: 5150328 - DNA, 15 bp, Homo sapiens
acctcattgctacca

SEQ ID NO: 5150329 - DNA, 20 bp, Homo sapiens
acctcattgctaccacagac

SEQ ID NO: 5150330 - DNA, 21 bp, Homo sapiens
acctccaaaaaagaaacattg

SEQ ID NO: 5150331 - DNA, 19 bp, Homo sapiens
acctccaaaagccctgagt

SEQ ID NO: 5150332 - DNA, 22 bp, Homo sapiens
acctccaaccaaataagacttc

SEQ ID NO: 5150333 - DNA, 14 bp, Homo sapiens
acctgttgagcatc

SEQ ID NO: 5150334 - DNA, 19 bp, Homo sapiens
acctgttgagcatcacaga

SEQ ID NO: 5150335 - DNA, 18 bp, Homo sapiens
acctgttgctgtgtttaa

SEQ ID NO: 5150336 - DNA, 22 bp, Homo sapiens
acctgttgctgtgtttaatttg

SEQ ID NO: 5150337 - DNA, 19 bp, Homo sapiens
acctgttgcttacaatttt

SEQ ID NO: 5150338 - DNA, 22 bp, Homo sapiens
acctgttggcctgtgggcctca

SEQ ID NO: 5150339 - DNA, 16 bp, Homo sapiens
acctgttggttccaag

SEQ ID NO: 5150340 - DNA, 16 bp, Homo sapiens
acctgttgtctgaaac

SEQ ID NO: 5150341 - DNA, 21 bp, Homo sapiens
acctgtttatataattttgca

SEQ ID NO: 5150342 - DNA, 20 bp, Homo sapiens
acctgtttcataagctttgt

SEQ ID NO: 5150343 - DNA, 22 bp, Homo sapiens
acctgtttctacctatatgcag

SEQ ID NO: 5150344 - DNA, 15 bp, Homo sapiens
acctgtttctctgcc

SEQ ID NO: 5150345 - DNA, 19 bp, Homo sapiens
acctgtttctgcagccact

SEQ ID NO: 5150346 - DNA, 18 bp, Homo sapiens
acctgtttctggaagact

SEQ ID NO: 5150347 - DNA, 13 bp, Homo sapiens
acctgtttgaagg

SEQ ID NO: 5150348 - DNA, 15 bp, Homo sapiens
acctgttttctgaaa

SEQ ID NO: 5150349 - DNA, 13 bp, Homo sapiens
acctgttttgcag

SEQ ID NO: 5150350 - DNA, 13 bp, Homo sapiens
acctgtttttaac

SEQ ID NO: 5150351 - DNA, 16 bp, Homo sapiens
acctgtttttaacatg

SEQ ID NO: 5150352 - DNA, 16 bp, Homo sapiens
accttaaaaaatgttt

SEQ ID NO: 5150353 - DNA, 14 bp, Homo sapiens
accttaaaacagct

SEQ ID NO: 5150354 - DNA, 16 bp, Homo sapiens
accttaaaacagctgt

SEQ ID NO: 5150355 - DNA, 17 bp, Homo sapiens
accttaaaagtaataaa

SEQ ID NO: 5150356 - DNA, 19 bp, Homo sapiens
accttaaaagtaataaaga

SEQ ID NO: 5150357 - DNA, 15 bp, Homo sapiens
accttaaaatgtgta

SEQ ID NO: 5150358 - DNA, 21 bp, Homo sapiens
accttaaaatgtgtacagtga

SEQ ID NO: 5150359 - DNA, 20 bp, Homo sapiens
accttaaaattaagatttcc

SEQ ID NO: 5150360 - DNA, 16 bp, Homo sapiens
accttaaaattgatat

SEQ ID NO: 5150361 - DNA, 15 bp, Homo sapiens
accttaaaatttgaa

SEQ ID NO: 5150362 - DNA, 19 bp, Homo sapiens
accttaaagcaataagttc

SEQ ID NO: 5150363 - DNA, 18 bp, Homo sapiens
accttaaagctgaattta

SEQ ID NO: 5150364 - DNA, 19 bp, Homo sapiens
accttaaagctgaatttat

SEQ ID NO: 5150365 - DNA, 20 bp, Homo sapiens
accttaaagctgaatttata

SEQ ID NO: 5150366 - DNA, 13 bp, Homo sapiens
accttaaatacac

SEQ ID NO: 5150367 - DNA, 23 bp, Homo sapiens
accttaaatctgcctttgtttct

SEQ ID NO: 5150368 - DNA, 13 bp, Homo sapiens
accttaaatgcta

SEQ ID NO: 5150369 - DNA, 13 bp, Homo sapiens
accttaaattaaa

SEQ ID NO: 5150370 - DNA, 14 bp, Homo sapiens
accttaaattaaac

SEQ ID NO: 5150371 - DNA, 16 bp, Homo sapiens
accttaaattaaacaa

SEQ ID NO: 5150372 - DNA, 22 bp, Homo sapiens
accttaaattaaacaatttatt

SEQ ID NO: 5150373 - DNA, 15 bp, Homo sapiens
accttaactcagcca

SEQ ID NO: 5150374 - DNA, 17 bp, Homo sapiens
accttaagacactgtga

SEQ ID NO: 5150375 - DNA, 18 bp, Homo sapiens
accttaagacactgtgag

SEQ ID NO: 5150376 - DNA, 19 bp, Homo sapiens
accttaagacactgtgaga

SEQ ID NO: 5150377 - DNA, 12 bp, Homo sapiens
accttaagacct

SEQ ID NO: 5150378 - DNA, 19 bp, Homo sapiens
accttaagatttttctttt

SEQ ID NO: 5150379 - DNA, 21 bp, Homo sapiens
accttaagtaagcaacagcat

SEQ ID NO: 5150380 - DNA, 19 bp, Homo sapiens
accttaatattattggggt

SEQ ID NO: 5150381 - DNA, 19 bp, Homo sapiens
accttaatgacaacactta

SEQ ID NO: 5150382 - DNA, 14 bp, Homo sapiens
accttaatttatat

SEQ ID NO: 5150383 - DNA, 15 bp, Homo sapiens
accttaatttattat

SEQ ID NO: 5150384 - DNA, 23 bp, Homo sapiens
accttacattcctagagagcaga

SEQ ID NO: 5150385 - DNA, 13 bp, Homo sapiens
accttaccaaaaa

SEQ ID NO: 5150386 - DNA, 16 bp, Homo sapiens
accttaccaagttggt

SEQ ID NO: 5150387 - DNA, 20 bp, Homo sapiens
accttacgatcaggcacagg

SEQ ID NO: 5150388 - DNA, 19 bp, Homo sapiens
accttactcaggggatgtt

SEQ ID NO: 5150389 - DNA, 14 bp, Homo sapiens
accttactggcact

SEQ ID NO: 5150390 - DNA, 19 bp, Homo sapiens
accttacttaaagcttgtt

SEQ ID NO: 5150391 - DNA, 14 bp, Homo sapiens
accttagaaaaaaa

SEQ ID NO: 5150392 - DNA, 22 bp, Homo sapiens
accttagaccaccaagccttga

SEQ ID NO: 5150393 - DNA, 21 bp, Homo sapiens
accttagatttagtagtgtaa

SEQ ID NO: 5150394 - DNA, 17 bp, Homo sapiens
accttagcagctcttcc

SEQ ID NO: 5150395 - DNA, 18 bp, Homo sapiens
accttagcagctcttccc

SEQ ID NO: 5150396 - DNA, 19 bp, Homo sapiens
accttagcagctcttcccc

SEQ ID NO: 5150397 - DNA, 14 bp, Homo sapiens
accttagccatcag

SEQ ID NO: 5150398 - DNA, 23 bp, Homo sapiens
accttagccccattgctccattc

SEQ ID NO: 5150399 - DNA, 14 bp, Homo sapiens
accttagcctgccc

SEQ ID NO: 5150400 - DNA, 16 bp, Homo sapiens
accttagcgttctgga

SEQ ID NO: 5150401 - DNA, 19 bp, Homo sapiens
accttagctccctcccgca

SEQ ID NO: 5150402 - DNA, 23 bp, Homo sapiens
accttagctccctcccgcacccc

SEQ ID NO: 5150403 - DNA, 23 bp, Homo sapiens
accttaggaataatctcctgtta

SEQ ID NO: 5150404 - DNA, 13 bp, Homo sapiens
accttaggccttc

SEQ ID NO: 5150405 - DNA, 16 bp, Homo sapiens
accttaggccttcctc

SEQ ID NO: 5150406 - DNA, 20 bp, Homo sapiens
accttaggccttcctctctc

SEQ ID NO: 5150407 - DNA, 15 bp, Homo sapiens
accttaggctttgta

SEQ ID NO: 5150408 - DNA, 16 bp, Homo sapiens
accttaggctttgtat

SEQ ID NO: 5150409 - DNA, 23 bp, Homo sapiens
accttaggctttgtatgacagtg

SEQ ID NO: 5150410 - DNA, 19 bp, Homo sapiens
accttaggttctttctgaa

SEQ ID NO: 5150411 - DNA, 20 bp, Homo sapiens
accttagttgaaatgatagc

SEQ ID NO: 5150412 - DNA, 19 bp, Homo sapiens
accttagtttcaagagtct

SEQ ID NO: 5150413 - DNA, 15 bp, Homo sapiens
accttatagagcaca

SEQ ID NO: 5150414 - DNA, 16 bp, Homo sapiens
accttatagagcacaa

SEQ ID NO: 5150415 - DNA, 18 bp, Homo sapiens
accttatagttactgtgt

SEQ ID NO: 5150416 - DNA, 23 bp, Homo sapiens
accttatagttactgtgtaatta

SEQ ID NO: 5150417 - DNA, 23 bp, Homo sapiens
accttatatttacaataaatgaa

SEQ ID NO: 5150418 - DNA, 17 bp, Homo sapiens
accttatatttctgtgt

SEQ ID NO: 5150419 - DNA, 18 bp, Homo sapiens
accttatatttctgtgta

SEQ ID NO: 5150420 - DNA, 16 bp, Homo sapiens
accttatcaggatggt

SEQ ID NO: 5150421 - DNA, 22 bp, Homo sapiens
accttatctgtgcgtgaaacac

SEQ ID NO: 5150422 - DNA, 23 bp, Homo sapiens
accttatctgtgcgtgaaacaca

SEQ ID NO: 5150423 - DNA, 13 bp, Homo sapiens
accttatgtatta

SEQ ID NO: 5150424 - DNA, 17 bp, Homo sapiens
accttatgtattatttt

SEQ ID NO: 5150425 - DNA, 20 bp, Homo sapiens
accttattagctaaaaatat

SEQ ID NO: 5150426 - DNA, 18 bp, Homo sapiens
accttattgtacctctct

SEQ ID NO: 5150427 - DNA, 13 bp, Homo sapiens
accttatttattt

SEQ ID NO: 5150428 - DNA, 19 bp, Homo sapiens
accttcaaaatgttctatt

SEQ ID NO: 5150429 - DNA, 19 bp, Homo sapiens
accttcaaactagggccaa

SEQ ID NO: 5150430 - DNA, 15 bp, Homo sapiens
accttcaaagaaact

SEQ ID NO: 5150431 - DNA, 13 bp, Homo sapiens
accttcaaagctg

SEQ ID NO: 5150432 - DNA, 14 bp, Homo sapiens
accttcaaatacat

SEQ ID NO: 5150433 - DNA, 14 bp, Homo sapiens
accttcaatgaatt

SEQ ID NO: 5150434 - DNA, 18 bp, Homo sapiens
accttcaattcctgggcc

SEQ ID NO: 5150435 - DNA, 18 bp, Homo sapiens
accttcaccaagcttaga

SEQ ID NO: 5150436 - DNA, 21 bp, Homo sapiens
accttcacccagagctgccta

SEQ ID NO: 5150437 - DNA, 23 bp, Homo sapiens
accttcacccagcacccatgccc

SEQ ID NO: 5150438 - DNA, 22 bp, Homo sapiens
accttcacctccaggttcaagt

SEQ ID NO: 5150439 - DNA, 20 bp, Homo sapiens
accttcacgattaactgtga

SEQ ID NO: 5150440 - DNA, 16 bp, Homo sapiens
accttcactccagaca

SEQ ID NO: 5150441 - DNA, 21 bp, Homo sapiens
accttcactctaagatgttat

SEQ ID NO: 5150442 - DNA, 22 bp, Homo sapiens
accttcactgtgaccttgagaa

SEQ ID NO: 5150443 - DNA, 17 bp, Homo sapiens
accttcagactttgctt

SEQ ID NO: 5150444 - DNA, 15 bp, Homo sapiens
accttcagatcctac

SEQ ID NO: 5150445 - DNA, 16 bp, Homo sapiens
accttcagatcctacc

SEQ ID NO: 5150446 - DNA, 17 bp, Homo sapiens
accttcagatcctaccc

SEQ ID NO: 5150447 - DNA, 18 bp, Homo sapiens
accttcagatcctacccc

SEQ ID NO: 5150448 - DNA, 13 bp, Homo sapiens
accttcagccctg

SEQ ID NO: 5150449 - DNA, 21 bp, Homo sapiens
accttcagccctttggcttca

SEQ ID NO: 5150450 - DNA, 17 bp, Homo sapiens
accttcagctcacgctt

SEQ ID NO: 5150451 - DNA, 12 bp, Homo sapiens
accttcagcttt

SEQ ID NO: 5150452 - DNA, 20 bp, Homo sapiens
accttcaggccccgccccat

SEQ ID NO: 5150453 - DNA, 18 bp, Homo sapiens
accttcagggagagctgg

SEQ ID NO: 5150454 - DNA, 19 bp, Homo sapiens
accttcagttatgattttt

SEQ ID NO: 5150455 - DNA, 19 bp, Homo sapiens
accttcagtttttgtgttt

SEQ ID NO: 5150456 - DNA, 14 bp, Homo sapiens
accttcatattggc

SEQ ID NO: 5150457 - DNA, 18 bp, Homo sapiens
accttcatgaccttacat

SEQ ID NO: 5150458 - DNA, 22 bp, Homo sapiens
accttcatgattatagcaacta

SEQ ID NO: 5150459 - DNA, 16 bp, Homo sapiens
accttcatgcccttct

SEQ ID NO: 5150460 - DNA, 15 bp, Homo sapiens
accttcatttaaaaa

SEQ ID NO: 5150461 - DNA, 21 bp, Homo sapiens
accttcatttaactctttgaa

SEQ ID NO: 5150462 - DNA, 17 bp, Homo sapiens
accttcatttcatcctg

SEQ ID NO: 5150463 - DNA, 22 bp, Homo sapiens
accttcatttcatgtatagttt

SEQ ID NO: 5150464 - DNA, 23 bp, Homo sapiens
accttcattttctaattctcttt

SEQ ID NO: 5150465 - DNA, 15 bp, Homo sapiens
accttcattttgagg

SEQ ID NO: 5150466 - DNA, 17 bp, Homo sapiens
accttcattttgagggg

SEQ ID NO: 5150467 - DNA, 11 bp, Homo sapiens
accttccaaac

SEQ ID NO: 5150468 - DNA, 16 bp, Homo sapiens
accttccaaacaaaag

SEQ ID NO: 5150469 - DNA, 15 bp, Homo sapiens
accttccaagactga

SEQ ID NO: 5150470 - DNA, 17 bp, Homo sapiens
accttccaagagcctga

SEQ ID NO: 5150471 - DNA, 19 bp, Homo sapiens
accttccaatgcttctgtt

SEQ ID NO: 5150472 - DNA, 14 bp, Homo sapiens
accttccacccagt

SEQ ID NO: 5150473 - DNA, 17 bp, Homo sapiens
accttccagctcctgta

SEQ ID NO: 5150474 - DNA, 14 bp, Homo sapiens
accttccagggccc

SEQ ID NO: 5150475 - DNA, 17 bp, Homo sapiens
accttccagggccctag

SEQ ID NO: 5150476 - DNA, 22 bp, Homo sapiens
accttccatacacagaggagtg

SEQ ID NO: 5150477 - DNA, 18 bp, Homo sapiens
accttcccaccccttcat

SEQ ID NO: 5150478 - DNA, 12 bp, Homo sapiens
accttcccagct

SEQ ID NO: 5150479 - DNA, 17 bp, Homo sapiens
accttcccagctctccc

SEQ ID NO: 5150480 - DNA, 12 bp, Homo sapiens
accttccccaga

SEQ ID NO: 5150481 - DNA, 16 bp, Homo sapiens
accttccccagacttg

SEQ ID NO: 5150482 - DNA, 18 bp, Homo sapiens
accttccccagacttgca

SEQ ID NO: 5150483 - DNA, 14 bp, Homo sapiens
accttcccccaact

SEQ ID NO: 5150484 - DNA, 20 bp, Homo sapiens
accttccccctcccccagcc

SEQ ID NO: 5150485 - DNA, 13 bp, Homo sapiens
accttcccgcctc

SEQ ID NO: 5150486 - DNA, 16 bp, Homo sapiens
accttcccgtctgatt

SEQ ID NO: 5150487 - DNA, 17 bp, Homo sapiens
accttccctccacctgc

SEQ ID NO: 5150488 - DNA, 21 bp, Homo sapiens
accttcccttcctcagcaggc

SEQ ID NO: 5150489 - DNA, 14 bp, Homo sapiens
accttcccttgcca

SEQ ID NO: 5150490 - DNA, 14 bp, Homo sapiens
accttcctcctgca

SEQ ID NO: 5150491 - DNA, 15 bp, Homo sapiens
accttcctcctgcag

SEQ ID NO: 5150492 - DNA, 15 bp, Homo sapiens
accttcctcgcagag

SEQ ID NO: 5150493 - DNA, 16 bp, Homo sapiens
accttcctctggggct

SEQ ID NO: 5150494 - DNA, 11 bp, Homo sapiens
accttcctgcc

SEQ ID NO: 5150495 - DNA, 18 bp, Homo sapiens
accttcctgccaccagtc

SEQ ID NO: 5150496 - DNA, 13 bp, Homo sapiens
accttcctgccca

SEQ ID NO: 5150497 - DNA, 11 bp, Homo sapiens
accttcctggg

SEQ ID NO: 5150498 - DNA, 22 bp, Homo sapiens
accttcctgggcagcccagaga

SEQ ID NO: 5150499 - DNA, 18 bp, Homo sapiens
accttcctgtccctgagg

SEQ ID NO: 5150500 - DNA, 13 bp, Homo sapiens
accttcctgtctc

SEQ ID NO: 5150501 - DNA, 15 bp, Homo sapiens
accttcctgtctccc

SEQ ID NO: 5150502 - DNA, 17 bp, Homo sapiens
accttcctgtctcccag

SEQ ID NO: 5150503 - DNA, 23 bp, Homo sapiens
accttccttccctggctacttcc

SEQ ID NO: 5150504 - DNA, 22 bp, Homo sapiens
accttccttccctgggctgtgc

SEQ ID NO: 5150505 - DNA, 14 bp, Homo sapiens
accttccttcctgt

SEQ ID NO: 5150506 - DNA, 15 bp, Homo sapiens
accttccttcctgtt

SEQ ID NO: 5150507 - DNA, 18 bp, Homo sapiens
accttccttctaaacatt

SEQ ID NO: 5150508 - DNA, 20 bp, Homo sapiens
accttccttttacttttctt

SEQ ID NO: 5150509 - DNA, 19 bp, Homo sapiens
accttcctttttttaaatt

SEQ ID NO: 5150510 - DNA, 14 bp, Homo sapiens
accttcgcctttgc

SEQ ID NO: 5150511 - DNA, 17 bp, Homo sapiens
accttcgcctttgctga

SEQ ID NO: 5150512 - DNA, 16 bp, Homo sapiens
acctccaaccctgccg

SEQ ID NO: 5150513 - DNA, 16 bp, Homo sapiens
acctccaactggatgt

SEQ ID NO: 5150514 - DNA, 20 bp, Homo sapiens
acctccaactggatgttgac

SEQ ID NO: 5150515 - DNA, 17 bp, Homo sapiens
acctccaagcatttcat

SEQ ID NO: 5150516 - DNA, 22 bp, Homo sapiens
acctccaataaagtgccttctg

SEQ ID NO: 5150517 - DNA, 23 bp, Homo sapiens
acctccaataaagtgccttctgg

SEQ ID NO: 5150518 - DNA, 20 bp, Homo sapiens
acctccaatcccccagcgct

SEQ ID NO: 5150519 - DNA, 12 bp, Homo sapiens
acctccacaccc

SEQ ID NO: 5150520 - DNA, 15 bp, Homo sapiens
acctccacacccacc

SEQ ID NO: 5150521 - DNA, 18 bp, Homo sapiens
acctccaccacatctgcc

SEQ ID NO: 5150522 - DNA, 20 bp, Homo sapiens
acctccaccacatctgccag

SEQ ID NO: 5150523 - DNA, 22 bp, Homo sapiens
acctccacccactgtccgcctc

SEQ ID NO: 5150524 - DNA, 15 bp, Homo sapiens
acctccacccagccc

SEQ ID NO: 5150525 - DNA, 18 bp, Homo sapiens
acctccacccccaagaaa

SEQ ID NO: 5150526 - DNA, 22 bp, Homo sapiens
acctccacccccgccacggcca

SEQ ID NO: 5150527 - DNA, 12 bp, Homo sapiens
acctccaccctg

SEQ ID NO: 5150528 - DNA, 12 bp, Homo sapiens
acctccacctcc

SEQ ID NO: 5150529 - DNA, 15 bp, Homo sapiens
acctccacctcctga

SEQ ID NO: 5150530 - DNA, 17 bp, Homo sapiens
acctccacctcctgagt

SEQ ID NO: 5150531 - DNA, 16 bp, Homo sapiens
acctccacctgtgaga

SEQ ID NO: 5150532 - DNA, 16 bp, Homo sapiens
acctccacgccactgc

SEQ ID NO: 5150533 - DNA, 20 bp, Homo sapiens
acctccacgccactgcctcc

SEQ ID NO: 5150534 - DNA, 23 bp, Homo sapiens
acctccactccacatctgcatca

SEQ ID NO: 5150535 - DNA, 12 bp, Homo sapiens
acctccactccc

SEQ ID NO: 5150536 - DNA, 23 bp, Homo sapiens
acctccactcccacctcacccgg

SEQ ID NO: 5150537 - DNA, 10 bp, Homo sapiens
acctccagaa

SEQ ID NO: 5150538 - DNA, 21 bp, Homo sapiens
acctccagaaacggccattca

SEQ ID NO: 5150539 - DNA, 17 bp, Homo sapiens
acctccagaagtccctt

SEQ ID NO: 5150540 - DNA, 11 bp, Homo sapiens
acctccagact

SEQ ID NO: 5150541 - DNA, 16 bp, Homo sapiens
acctccagactcagca

SEQ ID NO: 5150542 - DNA, 21 bp, Homo sapiens
acctccagactcagcagagtg

SEQ ID NO: 5150543 - DNA, 18 bp, Homo sapiens
acctccagcacgcgactt

SEQ ID NO: 5150544 - DNA, 21 bp, Homo sapiens
acctccagcagactcctgctc

SEQ ID NO: 5150545 - DNA, 12 bp, Homo sapiens
acctccagccca

SEQ ID NO: 5150546 - DNA, 16 bp, Homo sapiens
acctccagcccacagt

SEQ ID NO: 5150547 - DNA, 17 bp, Homo sapiens
acctccagcccgggagc

SEQ ID NO: 5150548 - DNA, 21 bp, Homo sapiens
acctccagcccgggagcctag

SEQ ID NO: 5150549 - DNA, 20 bp, Homo sapiens
acctccagcctccctgtctc

SEQ ID NO: 5150550 - DNA, 13 bp, Homo sapiens
acctccagcctct

SEQ ID NO: 5150551 - DNA, 15 bp, Homo sapiens
acctccagcctctgg

SEQ ID NO: 5150552 - DNA, 13 bp, Homo sapiens
acctccagctgtt

SEQ ID NO: 5150553 - DNA, 17 bp, Homo sapiens
acctccagcttccacaa

SEQ ID NO: 5150554 - DNA, 18 bp, Homo sapiens
acctccagctttcctgta

SEQ ID NO: 5150555 - DNA, 21 bp, Homo sapiens
acctccaggcaggccaggctg

SEQ ID NO: 5150556 - DNA, 14 bp, Homo sapiens
acctccaggcctgt

SEQ ID NO: 5150557 - DNA, 23 bp, Homo sapiens
acctccaggctccagcacatccc

SEQ ID NO: 5150558 - DNA, 13 bp, Homo sapiens
acctccaggggct

SEQ ID NO: 5150559 - DNA, 18 bp, Homo sapiens
acctccaggttcaagtga

SEQ ID NO: 5150560 - DNA, 19 bp, Homo sapiens
acctccagtcacactcccc

SEQ ID NO: 5150561 - DNA, 11 bp, Homo sapiens
acctccagtcc

SEQ ID NO: 5150562 - DNA, 14 bp, Homo sapiens
acctccagtcctgc

SEQ ID NO: 5150563 - DNA, 15 bp, Homo sapiens
acctccagtcctgct

SEQ ID NO: 5150564 - DNA, 20 bp, Homo sapiens
acctccagtcctgctggcct

SEQ ID NO: 5150565 - DNA, 16 bp, Homo sapiens
acctccatatgctgta

SEQ ID NO: 5150566 - DNA, 21 bp, Homo sapiens
acctccatccccctctgtctg

SEQ ID NO: 5150567 - DNA, 17 bp, Homo sapiens
acctccatccctgctct

SEQ ID NO: 5150568 - DNA, 12 bp, Homo sapiens
acctccatcctg

SEQ ID NO: 5150569 - DNA, 13 bp, Homo sapiens
acctccatgacag

SEQ ID NO: 5150570 - DNA, 22 bp, Homo sapiens
acctccatgcccccgccacctc

SEQ ID NO: 5150571 - DNA, 22 bp, Homo sapiens
acctccatgtggacttaggaag

SEQ ID NO: 5150572 - DNA, 19 bp, Homo sapiens
acctccattaaagtctgaa

SEQ ID NO: 5150573 - DNA, 13 bp, Homo sapiens
acctcccaactct

SEQ ID NO: 5150574 - DNA, 20 bp, Homo sapiens
acctcccaaggactttccag

SEQ ID NO: 5150575 - DNA, 20 bp, Homo sapiens
acctcccacaaaggagagct

SEQ ID NO: 5150576 - DNA, 22 bp, Homo sapiens
acctcccacctatccgccctgc

SEQ ID NO: 5150577 - DNA, 14 bp, Homo sapiens
acctcccacctttg

SEQ ID NO: 5150578 - DNA, 15 bp, Homo sapiens
acctcccactcctgc

SEQ ID NO: 5150579 - DNA, 16 bp, Homo sapiens
acctcccactcctgct

SEQ ID NO: 5150580 - DNA, 14 bp, Homo sapiens
acctcccagaggtc

SEQ ID NO: 5150581 - DNA, 19 bp, Homo sapiens
acctcccagaggtccagcc

SEQ ID NO: 5150582 - DNA, 21 bp, Homo sapiens
acctcccagaggtccagccca

SEQ ID NO: 5150583 - DNA, 12 bp, Homo sapiens
acctcccagccc

SEQ ID NO: 5150584 - DNA, 13 bp, Homo sapiens
acctcccagccct

SEQ ID NO: 5150585 - DNA, 22 bp, Homo sapiens
acctcccagccctatggatgtg

SEQ ID NO: 5150586 - DNA, 19 bp, Homo sapiens
acctcccagggctacacag

SEQ ID NO: 5150587 - DNA, 15 bp, Homo sapiens
acctcccatcctaat

SEQ ID NO: 5150588 - DNA, 20 bp, Homo sapiens
acctccccacacacaggcct

SEQ ID NO: 5150589 - DNA, 22 bp, Homo sapiens
acctccccacacacaggccttc

SEQ ID NO: 5150590 - DNA, 13 bp, Homo sapiens
acctccccacatc

SEQ ID NO: 5150591 - DNA, 21 bp, Homo sapiens
acctccccacgccctcccctc

SEQ ID NO: 5150592 - DNA, 15 bp, Homo sapiens
acctccccactccag

SEQ ID NO: 5150593 - DNA, 16 bp, Homo sapiens
acctccccactccagc

SEQ ID NO: 5150594 - DNA, 15 bp, Homo sapiens
acctccccagacagg

SEQ ID NO: 5150595 - DNA, 19 bp, Homo sapiens
acctccccagacagggctc

SEQ ID NO: 5150596 - DNA, 21 bp, Homo sapiens
acctccccagagccctgcagt

SEQ ID NO: 5150597 - DNA, 21 bp, Homo sapiens
acctccccagcattccagccc

SEQ ID NO: 5150598 - DNA, 12 bp, Homo sapiens
acctccccagcc

SEQ ID NO: 5150599 - DNA, 16 bp, Homo sapiens
acctccccagccccta

SEQ ID NO: 5150600 - DNA, 23 bp, Homo sapiens
acctccccagcccctagcccagg

SEQ ID NO: 5150601 - DNA, 16 bp, Homo sapiens
acctccccagcctgcg

SEQ ID NO: 5150602 - DNA, 13 bp, Homo sapiens
acctccccaggcc

SEQ ID NO: 5150603 - DNA, 18 bp, Homo sapiens
acctcccccaaaccctgc

SEQ ID NO: 5150604 - DNA, 22 bp, Homo sapiens
acctcccccaaaccctgcttct

SEQ ID NO: 5150605 - DNA, 13 bp, Homo sapiens
acctcccccaggg

SEQ ID NO: 5150606 - DNA, 15 bp, Homo sapiens
acctccccccactgc

SEQ ID NO: 5150607 - DNA, 18 bp, Homo sapiens
acctccccccactgcagg

SEQ ID NO: 5150608 - DNA, 20 bp, Homo sapiens
acctccccctcccccttctc

SEQ ID NO: 5150609 - DNA, 15 bp, Homo sapiens
acctccccctccccg

SEQ ID NO: 5150610 - DNA, 21 bp, Homo sapiens
acctccccctccccggccaca

SEQ ID NO: 5150611 - DNA, 22 bp, Homo sapiens
acctccccctccccggccacat

SEQ ID NO: 5150612 - DNA, 16 bp, Homo sapiens
acctccccctcttggt

SEQ ID NO: 5150613 - DNA, 22 bp, Homo sapiens
acctccccctttcacactggat

SEQ ID NO: 5150614 - DNA, 17 bp, Homo sapiens
acctccccgctctccct

SEQ ID NO: 5150615 - DNA, 15 bp, Homo sapiens
acctccccgctggga

SEQ ID NO: 5150616 - DNA, 18 bp, Homo sapiens
acctcccctatccaccca

SEQ ID NO: 5150617 - DNA, 19 bp, Homo sapiens
acctcccctatccacccag

SEQ ID NO: 5150618 - DNA, 15 bp, Homo sapiens
acctcccctccccag

SEQ ID NO: 5150619 - DNA, 19 bp, Homo sapiens
acctcccctccttgcctcc

SEQ ID NO: 5150620 - DNA, 21 bp, Homo sapiens
acctcccctccttgcctcctg

SEQ ID NO: 5150621 - DNA, 22 bp, Homo sapiens
acctcccctccttgcctcctgt

SEQ ID NO: 5150622 - DNA, 15 bp, Homo sapiens
acctcccctctcccc

SEQ ID NO: 5150623 - DNA, 16 bp, Homo sapiens
acctcccctctccccg

SEQ ID NO: 5150624 - DNA, 15 bp, Homo sapiens
acctcccctgaggct

SEQ ID NO: 5150625 - DNA, 14 bp, Homo sapiens
acctcccctgccag

SEQ ID NO: 5150626 - DNA, 15 bp, Homo sapiens
acctcccctgccagg

SEQ ID NO: 5150627 - DNA, 19 bp, Homo sapiens
acctcccctgccagggctc

SEQ ID NO: 5150628 - DNA, 20 bp, Homo sapiens
acctcccctgccagggctcg

SEQ ID NO: 5150629 - DNA, 23 bp, Homo sapiens
acctcccctgccagggctcgggc

SEQ ID NO: 5150630 - DNA, 14 bp, Homo sapiens
acctcccctgcctt

SEQ ID NO: 5150631 - DNA, 16 bp, Homo sapiens
acctcccctgccttgc

SEQ ID NO: 5150632 - DNA, 17 bp, Homo sapiens
acctcccctgccttgct

SEQ ID NO: 5150633 - DNA, 16 bp, Homo sapiens
acctcccctggtcctg

SEQ ID NO: 5150634 - DNA, 20 bp, Homo sapiens
acctcccgccctcacctgca

SEQ ID NO: 5150635 - DNA, 11 bp, Homo sapiens
acctccctact

SEQ ID NO: 5150636 - DNA, 10 bp, Homo sapiens
acctccctcc

SEQ ID NO: 5150637 - DNA, 12 bp, Homo sapiens
acctccctcctc

SEQ ID NO: 5150638 - DNA, 13 bp, Homo sapiens
acctccctcctca

SEQ ID NO: 5150639 - DNA, 16 bp, Homo sapiens
acctccctcctcaggg

SEQ ID NO: 5150640 - DNA, 22 bp, Homo sapiens
acctccctcttgttttgtttgt

SEQ ID NO: 5150641 - DNA, 15 bp, Homo sapiens
acctccctgaaccat

SEQ ID NO: 5150642 - DNA, 13 bp, Homo sapiens
acctccctgcaat

SEQ ID NO: 5150643 - DNA, 14 bp, Homo sapiens
acctccctgcagct

SEQ ID NO: 5150644 - DNA, 14 bp, Homo sapiens
acctccctgcccag

SEQ ID NO: 5150645 - DNA, 21 bp, Homo sapiens
acctccctgcccaggccggcc

SEQ ID NO: 5150646 - DNA, 18 bp, Homo sapiens
acctccctgccctgtcct

SEQ ID NO: 5150647 - DNA, 14 bp, Homo sapiens
acctccctgcctcc

SEQ ID NO: 5150648 - DNA, 14 bp, Homo sapiens
acctccctgcgccc

SEQ ID NO: 5150649 - DNA, 14 bp, Homo sapiens
acctccctgctcag

SEQ ID NO: 5150650 - DNA, 12 bp, Homo sapiens
acctccctggct

SEQ ID NO: 5150651 - DNA, 18 bp, Homo sapiens
acctccctgggcctgtct

SEQ ID NO: 5150652 - DNA, 19 bp, Homo sapiens
acctccctgggcctgtctc

SEQ ID NO: 5150653 - DNA, 17 bp, Homo sapiens
acctccctgtctcccgg

SEQ ID NO: 5150654 - DNA, 13 bp, Homo sapiens
acctccctgtgag

SEQ ID NO: 5150655 - DNA, 20 bp, Homo sapiens
acctcccttaagcagcaaca

SEQ ID NO: 5150656 - DNA, 16 bp, Homo sapiens
acctcccttcatccca

SEQ ID NO: 5150657 - DNA, 22 bp, Homo sapiens
acctcccttccgaccctctggg

SEQ ID NO: 5150658 - DNA, 17 bp, Homo sapiens
acctcccttgggcacgt

SEQ ID NO: 5150659 - DNA, 21 bp, Homo sapiens
acctccgaactgttcaagtgt

SEQ ID NO: 5150660 - DNA, 23 bp, Homo sapiens
acctccgaactgttcaagtgtcc

SEQ ID NO: 5150661 - DNA, 20 bp, Homo sapiens
acctccgagaggcagccaga

SEQ ID NO: 5150662 - DNA, 21 bp, Homo sapiens
acctccgccccagacacaccc

SEQ ID NO: 5150663 - DNA, 22 bp, Homo sapiens
acctccgcccctgcccccgctc

SEQ ID NO: 5150664 - DNA, 13 bp, Homo sapiens
acctccgcctctc

SEQ ID NO: 5150665 - DNA, 17 bp, Homo sapiens
acctccgcgggctgact

SEQ ID NO: 5150666 - DNA, 18 bp, Homo sapiens
acctccggagcgccctgc

SEQ ID NO: 5150667 - DNA, 20 bp, Homo sapiens
acctccggccaggtgcctcc

SEQ ID NO: 5150668 - DNA, 21 bp, Homo sapiens
acctccggccaggtgcctcct

SEQ ID NO: 5150669 - DNA, 23 bp, Homo sapiens
acctccggccaggtgcctcctga

SEQ ID NO: 5150670 - DNA, 16 bp, Homo sapiens
acctccgtcctctccc

SEQ ID NO: 5150671 - DNA, 14 bp, Homo sapiens
acctcctaaaacaa

SEQ ID NO: 5150672 - DNA, 18 bp, Homo sapiens
acctcctaaaaggcccag

SEQ ID NO: 5150673 - DNA, 22 bp, Homo sapiens
acctcctaaaaggcccagagag

SEQ ID NO: 5150674 - DNA, 14 bp, Homo sapiens
acctcctaaataaa

SEQ ID NO: 5150675 - DNA, 17 bp, Homo sapiens
acctcctaatggcatgg

SEQ ID NO: 5150676 - DNA, 18 bp, Homo sapiens
acctcctaatggcatgga

SEQ ID NO: 5150677 - DNA, 17 bp, Homo sapiens
acctcctaccccttcct

SEQ ID NO: 5150678 - DNA, 12 bp, Homo sapiens
acctcctaccct

SEQ ID NO: 5150679 - DNA, 23 bp, Homo sapiens
acctcctacgtcaaacatgaagt

SEQ ID NO: 5150680 - DNA, 15 bp, Homo sapiens
acctcctatatcatt

SEQ ID NO: 5150681 - DNA, 16 bp, Homo sapiens
acctcctatatcatta

SEQ ID NO: 5150682 - DNA, 18 bp, Homo sapiens
acctcctatatcattatt

SEQ ID NO: 5150683 - DNA, 21 bp, Homo sapiens
acctcctatccttggagagca

SEQ ID NO: 5150684 - DNA, 21 bp, Homo sapiens
acctcctcacttggctgtctg

SEQ ID NO: 5150685 - DNA, 23 bp, Homo sapiens
acctcctcagcctgaaccccagg

SEQ ID NO: 5150686 - DNA, 14 bp, Homo sapiens
acctcctcagggat

SEQ ID NO: 5150687 - DNA, 13 bp, Homo sapiens
acctcctccaaga

SEQ ID NO: 5150688 - DNA, 20 bp, Homo sapiens
acctcctccaagaagccctc

SEQ ID NO: 5150689 - DNA, 12 bp, Homo sapiens
acctcctccact

SEQ ID NO: 5150690 - DNA, 18 bp, Homo sapiens
acctcctccactcactcc

SEQ ID NO: 5150691 - DNA, 22 bp, Homo sapiens
accttcgggcagtcctgtgtga

SEQ ID NO: 5150692 - DNA, 11 bp, Homo sapiens
accttctaaaa

SEQ ID NO: 5150693 - DNA, 18 bp, Homo sapiens
accttctaaaagccatta

SEQ ID NO: 5150694 - DNA, 22 bp, Homo sapiens
accttctaaaagtactgcattt

SEQ ID NO: 5150695 - DNA, 23 bp, Homo sapiens
accttctaatccatgtgctgctg

SEQ ID NO: 5150696 - DNA, 21 bp, Homo sapiens
accttctaattggtttttact

SEQ ID NO: 5150697 - DNA, 17 bp, Homo sapiens
accttctagaattataa

SEQ ID NO: 5150698 - DNA, 19 bp, Homo sapiens
accttctagtgagcctggg

SEQ ID NO: 5150699 - DNA, 23 bp, Homo sapiens
accttctagtgagcctgggccag

SEQ ID NO: 5150700 - DNA, 17 bp, Homo sapiens
accttctatagcatcac

SEQ ID NO: 5150701 - DNA, 20 bp, Homo sapiens
accttctatagcatcactta

SEQ ID NO: 5150702 - DNA, 12 bp, Homo sapiens
accttctatcct

SEQ ID NO: 5150703 - DNA, 15 bp, Homo sapiens
accttctatcctctg

SEQ ID NO: 5150704 - DNA, 21 bp, Homo sapiens
accttctcaaaagattgtttt

SEQ ID NO: 5150705 - DNA, 14 bp, Homo sapiens
accttctccaaatg

SEQ ID NO: 5150706 - DNA, 20 bp, Homo sapiens
accttctcccaggcctctgc

SEQ ID NO: 5150707 - DNA, 14 bp, Homo sapiens
accttctccccagc

SEQ ID NO: 5150708 - DNA, 18 bp, Homo sapiens
accttctccccagctccc

SEQ ID NO: 5150709 - DNA, 23 bp, Homo sapiens
accttctccccagctcccaggac

SEQ ID NO: 5150710 - DNA, 11 bp, Homo sapiens
accttctccct

SEQ ID NO: 5150711 - DNA, 17 bp, Homo sapiens
accttctcccttcttgg

SEQ ID NO: 5150712 - DNA, 20 bp, Homo sapiens
accttctcccttcttgggtc

SEQ ID NO: 5150713 - DNA, 22 bp, Homo sapiens
accttctcccttcttgggtctg

SEQ ID NO: 5150714 - DNA, 16 bp, Homo sapiens
accttctctatatcat

SEQ ID NO: 5150715 - DNA, 22 bp, Homo sapiens
accttctctccagagctcctga

SEQ ID NO: 5150716 - DNA, 23 bp, Homo sapiens
accttctctggagccaagtccag

SEQ ID NO: 5150717 - DNA, 12 bp, Homo sapiens
accttctgaaga

SEQ ID NO: 5150718 - DNA, 22 bp, Homo sapiens
accttctgacgcagcctgagaa

SEQ ID NO: 5150719 - DNA, 17 bp, Homo sapiens
accttctgagtattctc

SEQ ID NO: 5150720 - DNA, 16 bp, Homo sapiens
accttctgccaaggcc

SEQ ID NO: 5150721 - DNA, 11 bp, Homo sapiens
accttctgccc

SEQ ID NO: 5150722 - DNA, 19 bp, Homo sapiens
accttctgccctcctgcca

SEQ ID NO: 5150723 - DNA, 12 bp, Homo sapiens
accttctgcctt

SEQ ID NO: 5150724 - DNA, 19 bp, Homo sapiens
accttctggcttccttctc

SEQ ID NO: 5150725 - DNA, 20 bp, Homo sapiens
accttctgggggaaagggaa

SEQ ID NO: 5150726 - DNA, 19 bp, Homo sapiens
accttctggttgcttcaga

SEQ ID NO: 5150727 - DNA, 13 bp, Homo sapiens
accttctgtagtt

SEQ ID NO: 5150728 - DNA, 16 bp, Homo sapiens
accttctgtcgtcccc

SEQ ID NO: 5150729 - DNA, 22 bp, Homo sapiens
accttctgtcgtccccagacca

SEQ ID NO: 5150730 - DNA, 22 bp, Homo sapiens
accttctgtgcatctggcctgg

SEQ ID NO: 5150731 - DNA, 19 bp, Homo sapiens
accttcttcaggctgccta

SEQ ID NO: 5150732 - DNA, 13 bp, Homo sapiens
accttcttccaca

SEQ ID NO: 5150733 - DNA, 18 bp, Homo sapiens
accttcttggcttctggg

SEQ ID NO: 5150734 - DNA, 14 bp, Homo sapiens
accttcttgggact

SEQ ID NO: 5150735 - DNA, 17 bp, Homo sapiens
accttctttcactctgt

SEQ ID NO: 5150736 - DNA, 12 bp, Homo sapiens
accttctttcta

SEQ ID NO: 5150737 - DNA, 14 bp, Homo sapiens
accttctttctgga

SEQ ID NO: 5150738 - DNA, 22 bp, Homo sapiens
accttctttgtaatcccttcac

SEQ ID NO: 5150739 - DNA, 19 bp, Homo sapiens
accttcttttcaatgcaat

SEQ ID NO: 5150740 - DNA, 21 bp, Homo sapiens
accttcttttcaatgcaatgc

SEQ ID NO: 5150741 - DNA, 16 bp, Homo sapiens
accttgaaaaaaaaca

SEQ ID NO: 5150742 - DNA, 23 bp, Homo sapiens
accttgaaaaaaaacagtggatc

SEQ ID NO: 5150743 - DNA, 19 bp, Homo sapiens
accttgaaaactttatgct

SEQ ID NO: 5150744 - DNA, 17 bp, Homo sapiens
accttgaaaggcaggaa

SEQ ID NO: 5150745 - DNA, 14 bp, Homo sapiens
accttgaaatggaa

SEQ ID NO: 5150746 - DNA, 20 bp, Homo sapiens
accttgaagttctgaaattt

SEQ ID NO: 5150747 - DNA, 15 bp, Homo sapiens
accttgaatgatgcc

SEQ ID NO: 5150748 - DNA, 17 bp, Homo sapiens
accttgaatgctgccag

SEQ ID NO: 5150749 - DNA, 18 bp, Homo sapiens
accttgaatgctgccagt

SEQ ID NO: 5150750 - DNA, 15 bp, Homo sapiens
accttgacagggcac

SEQ ID NO: 5150751 - DNA, 16 bp, Homo sapiens
accttgacagggcaca

SEQ ID NO: 5150752 - DNA, 15 bp, Homo sapiens
accttgaccattaat

SEQ ID NO: 5150753 - DNA, 19 bp, Homo sapiens
accttgactgttgatgtac

SEQ ID NO: 5150754 - DNA, 17 bp, Homo sapiens
accttgacttgattagt

SEQ ID NO: 5150755 - DNA, 17 bp, Homo sapiens
accttgacttgccatga

SEQ ID NO: 5150756 - DNA, 13 bp, Homo sapiens
accttgactttgt

SEQ ID NO: 5150757 - DNA, 20 bp, Homo sapiens
accttgagaccctcttctct

SEQ ID NO: 5150758 - DNA, 23 bp, Homo sapiens
accttgagaccctcttctctggg

SEQ ID NO: 5150759 - DNA, 12 bp, Homo sapiens
accttgagcaga

SEQ ID NO: 5150760 - DNA, 18 bp, Homo sapiens
accttgagcagaatacaa

SEQ ID NO: 5150761 - DNA, 19 bp, Homo sapiens
accttgagcagaatacaat

SEQ ID NO: 5150762 - DNA, 17 bp, Homo sapiens
accttgagggtgggcca

SEQ ID NO: 5150763 - DNA, 22 bp, Homo sapiens
accttgagggtgggccagcata

SEQ ID NO: 5150764 - DNA, 17 bp, Homo sapiens
accttgagttaacagga

SEQ ID NO: 5150765 - DNA, 20 bp, Homo sapiens
accttgagttaacaggacag

SEQ ID NO: 5150766 - DNA, 15 bp, Homo sapiens
accttgattgcacca

SEQ ID NO: 5150767 - DNA, 23 bp, Homo sapiens
accttgattggggaattaaaagt

SEQ ID NO: 5150768 - DNA, 15 bp, Homo sapiens
accttgattttcttc

SEQ ID NO: 5150769 - DNA, 16 bp, Homo sapiens
accttgcaacacacag

SEQ ID NO: 5150770 - DNA, 19 bp, Homo sapiens
accttgcaacacacagaca

SEQ ID NO: 5150771 - DNA, 17 bp, Homo sapiens
accttgcaacctcacct

SEQ ID NO: 5150772 - DNA, 16 bp, Homo sapiens
accttgcacacatcat

SEQ ID NO: 5150773 - DNA, 20 bp, Homo sapiens
accttgcactattggacttt

SEQ ID NO: 5150774 - DNA, 23 bp, Homo sapiens
accttgcagaaggcaaggccctg

SEQ ID NO: 5150775 - DNA, 19 bp, Homo sapiens
accttgcatctcattgctc

SEQ ID NO: 5150776 - DNA, 13 bp, Homo sapiens
accttgcatttca

SEQ ID NO: 5150777 - DNA, 17 bp, Homo sapiens
accttgccaattagtaa

SEQ ID NO: 5150778 - DNA, 21 bp, Homo sapiens
accttgccagggcagggtctg

SEQ ID NO: 5150779 - DNA, 13 bp, Homo sapiens
accttgcctcctt

SEQ ID NO: 5150780 - DNA, 22 bp, Homo sapiens
accttgcctccttttttcttaa

SEQ ID NO: 5150781 - DNA, 18 bp, Homo sapiens
accttgcctgaacatcct

SEQ ID NO: 5150782 - DNA, 21 bp, Homo sapiens
accttgcctgaacatccttcc

SEQ ID NO: 5150783 - DNA, 18 bp, Homo sapiens
accttgcctggtacagta

SEQ ID NO: 5150784 - DNA, 20 bp, Homo sapiens
accttgctaattttctcaaa

SEQ ID NO: 5150785 - DNA, 20 bp, Homo sapiens
accttgctagctagccagcc

SEQ ID NO: 5150786 - DNA, 21 bp, Homo sapiens
accttgctcccaatggtgctt

SEQ ID NO: 5150787 - DNA, 14 bp, Homo sapiens
accttgctctcctc

SEQ ID NO: 5150788 - DNA, 16 bp, Homo sapiens
accttgctctcctcat

SEQ ID NO: 5150789 - DNA, 19 bp, Homo sapiens
accttgctctcctcatctc

SEQ ID NO: 5150790 - DNA, 20 bp, Homo sapiens
accttgctctcctcatctcc

SEQ ID NO: 5150791 - DNA, 18 bp, Homo sapiens
accttgctcttctttctg

SEQ ID NO: 5150792 - DNA, 23 bp, Homo sapiens
accttgctgcaagcacagccctt

SEQ ID NO: 5150793 - DNA, 17 bp, Homo sapiens
accttgctgtcctgatc

SEQ ID NO: 5150794 - DNA, 15 bp, Homo sapiens
accttgctgtgtgac

SEQ ID NO: 5150795 - DNA, 22 bp, Homo sapiens
accttgcttcttactgataatt

SEQ ID NO: 5150796 - DNA, 15 bp, Homo sapiens
accttgcttttgctt

SEQ ID NO: 5150797 - DNA, 18 bp, Homo sapiens
accttggaatcgtcccta

SEQ ID NO: 5150798 - DNA, 13 bp, Homo sapiens
accttggactcct

SEQ ID NO: 5150799 - DNA, 17 bp, Homo sapiens
accttggactcctccca

SEQ ID NO: 5150800 - DNA, 18 bp, Homo sapiens
accttggactcctcccac

SEQ ID NO: 5150801 - DNA, 14 bp, Homo sapiens
accttggagagctc

SEQ ID NO: 5150802 - DNA, 18 bp, Homo sapiens
accttggagagctcagga

SEQ ID NO: 5150803 - DNA, 14 bp, Homo sapiens
accttggagaggag

SEQ ID NO: 5150804 - DNA, 19 bp, Homo sapiens
accttggagcatttatgta

SEQ ID NO: 5150805 - DNA, 21 bp, Homo sapiens
accttggaggccttccctggc

SEQ ID NO: 5150806 - DNA, 16 bp, Homo sapiens
accttggcaccagaca

SEQ ID NO: 5150807 - DNA, 17 bp, Homo sapiens
accttggcaccagacac

SEQ ID NO: 5150808 - DNA, 14 bp, Homo sapiens
accttggcataaga

SEQ ID NO: 5150809 - DNA, 21 bp, Homo sapiens
accttggcccaggagctctgc

SEQ ID NO: 5150810 - DNA, 19 bp, Homo sapiens
accttggcctctccttgga

SEQ ID NO: 5150811 - DNA, 13 bp, Homo sapiens
accttggcctggg

SEQ ID NO: 5150812 - DNA, 13 bp, Homo sapiens
accttggccttct

SEQ ID NO: 5150813 - DNA, 14 bp, Homo sapiens
accttggccttctc

SEQ ID NO: 5150814 - DNA, 22 bp, Homo sapiens
accttggccttctcccctcttc

SEQ ID NO: 5150815 - DNA, 21 bp, Homo sapiens
accttggcgtgtgtccctgtg

SEQ ID NO: 5150816 - DNA, 23 bp, Homo sapiens
accttggcgtgtgtccctgtggt

SEQ ID NO: 5150817 - DNA, 16 bp, Homo sapiens
accttggctctgccag

SEQ ID NO: 5150818 - DNA, 17 bp, Homo sapiens
accttggctctgccagt

SEQ ID NO: 5150819 - DNA, 12 bp, Homo sapiens
accttggctgca

SEQ ID NO: 5150820 - DNA, 15 bp, Homo sapiens
accttgggaccaaag

SEQ ID NO: 5150821 - DNA, 18 bp, Homo sapiens
accttgggcaagtccctt

SEQ ID NO: 5150822 - DNA, 17 bp, Homo sapiens
accttgggcacatctgc

SEQ ID NO: 5150823 - DNA, 19 bp, Homo sapiens
accttgggcacgggagagc

SEQ ID NO: 5150824 - DNA, 22 bp, Homo sapiens
accttggggccttgatgactgc

SEQ ID NO: 5150825 - DNA, 18 bp, Homo sapiens
accttgggtcctgaagtg

SEQ ID NO: 5150826 - DNA, 16 bp, Homo sapiens
accttgggtctgtgtc

SEQ ID NO: 5150827 - DNA, 23 bp, Homo sapiens
accttgggttagacctacagggg

SEQ ID NO: 5150828 - DNA, 21 bp, Homo sapiens
accttgggtttgtattttaaa

SEQ ID NO: 5150829 - DNA, 23 bp, Homo sapiens
accttgtaaaaaaagcaaaaatg

SEQ ID NO: 5150830 - DNA, 20 bp, Homo sapiens
accttgtaaattccccttcc

SEQ ID NO: 5150831 - DNA, 21 bp, Homo sapiens
accttgtaaattccccttccc

SEQ ID NO: 5150832 - DNA, 17 bp, Homo sapiens
accttgtaaccagtgca

SEQ ID NO: 5150833 - DNA, 15 bp, Homo sapiens
accttgtaatgtaac

SEQ ID NO: 5150834 - DNA, 17 bp, Homo sapiens
accttgtaatgtaactg

SEQ ID NO: 5150835 - DNA, 19 bp, Homo sapiens
accttgtataaattattca

SEQ ID NO: 5150836 - DNA, 17 bp, Homo sapiens
accttgtcatatgtgtt

SEQ ID NO: 5150837 - DNA, 20 bp, Homo sapiens
accttgtcatgtaccatcaa

SEQ ID NO: 5150838 - DNA, 22 bp, Homo sapiens
accttgtcatgtaccatcaata

SEQ ID NO: 5150839 - DNA, 17 bp, Homo sapiens
accttgtgaaggaaaaa

SEQ ID NO: 5150840 - DNA, 14 bp, Homo sapiens
accttgtgatgact

SEQ ID NO: 5150841 - DNA, 20 bp, Homo sapiens
accttgtgcccgattctttc

SEQ ID NO: 5150842 - DNA, 12 bp, Homo sapiens
accttgtgcctg

SEQ ID NO: 5150843 - DNA, 16 bp, Homo sapiens
accttgtgcctggggt

SEQ ID NO: 5150844 - DNA, 18 bp, Homo sapiens
accttgtggataagtggc

SEQ ID NO: 5150845 - DNA, 15 bp, Homo sapiens
accttgtgggaccag

SEQ ID NO: 5150846 - DNA, 14 bp, Homo sapiens
accttgtggtctcg

SEQ ID NO: 5150847 - DNA, 23 bp, Homo sapiens
accttgtgtggcgcacttcagaa

SEQ ID NO: 5150848 - DNA, 18 bp, Homo sapiens
accttgtgtgtatgtgta

SEQ ID NO: 5150849 - DNA, 17 bp, Homo sapiens
accttgttatttctcag

SEQ ID NO: 5150850 - DNA, 21 bp, Homo sapiens
accttgttcacactctcacat

SEQ ID NO: 5150851 - DNA, 14 bp, Homo sapiens
accttgttctattt

SEQ ID NO: 5150852 - DNA, 17 bp, Homo sapiens
accttgttgatgccagc

SEQ ID NO: 5150853 - DNA, 16 bp, Homo sapiens
accttgttggagcctg

SEQ ID NO: 5150854 - DNA, 14 bp, Homo sapiens
accttgttgtgttt

SEQ ID NO: 5150855 - DNA, 15 bp, Homo sapiens
accttgttgtgtttc

SEQ ID NO: 5150856 - DNA, 17 bp, Homo sapiens
accttgtttattagcat

SEQ ID NO: 5150857 - DNA, 16 bp, Homo sapiens
accttgtttctttctg

SEQ ID NO: 5150858 - DNA, 14 bp, Homo sapiens
accttgttttctct

SEQ ID NO: 5150859 - DNA, 17 bp, Homo sapiens
accttgttttctctata

SEQ ID NO: 5150860 - DNA, 13 bp, Homo sapiens
accttgttttgcc

SEQ ID NO: 5150861 - DNA, 14 bp, Homo sapiens
accttgttttgcca

SEQ ID NO: 5150862 - DNA, 22 bp, Homo sapiens
acctttaaaaagcagtttttga

SEQ ID NO: 5150863 - DNA, 16 bp, Homo sapiens
acctttaaaaatgtat

SEQ ID NO: 5150864 - DNA, 16 bp, Homo sapiens
acctttaaaattgtca

SEQ ID NO: 5150865 - DNA, 20 bp, Homo sapiens
acctttaaagtaaaggcctc

SEQ ID NO: 5150866 - DNA, 11 bp, Homo sapiens
acctttaaata

SEQ ID NO: 5150867 - DNA, 15 bp, Homo sapiens
acctttaaatatcat

SEQ ID NO: 5150868 - DNA, 18 bp, Homo sapiens
acctttaaatgcaacagt

SEQ ID NO: 5150869 - DNA, 20 bp, Homo sapiens
acctcctccactcactccag

SEQ ID NO: 5150870 - DNA, 15 bp, Homo sapiens
acctcctcccactgc

SEQ ID NO: 5150871 - DNA, 23 bp, Homo sapiens
acctcctcccgaaaaatgtgtgg

SEQ ID NO: 5150872 - DNA, 18 bp, Homo sapiens
acctcctcgaacccactc

SEQ ID NO: 5150873 - DNA, 12 bp, Homo sapiens
acctcctctcag

SEQ ID NO: 5150874 - DNA, 16 bp, Homo sapiens
acctcctctcagtgtt

SEQ ID NO: 5150875 - DNA, 12 bp, Homo sapiens
acctcctctctg

SEQ ID NO: 5150876 - DNA, 13 bp, Homo sapiens
acctcctctcttg

SEQ ID NO: 5150877 - DNA, 22 bp, Homo sapiens
acctcctctgccagcaggaata

SEQ ID NO: 5150878 - DNA, 11 bp, Homo sapiens
acctcctctgt

SEQ ID NO: 5150879 - DNA, 13 bp, Homo sapiens
acctcctctgtga

SEQ ID NO: 5150880 - DNA, 14 bp, Homo sapiens
acctcctctgtgaa

SEQ ID NO: 5150881 - DNA, 15 bp, Homo sapiens
acctcctcttccccc

SEQ ID NO: 5150882 - DNA, 23 bp, Homo sapiens
acctcctgatagtagtaaaatta

SEQ ID NO: 5150883 - DNA, 16 bp, Homo sapiens
acctcctgcccaggag

SEQ ID NO: 5150884 - DNA, 18 bp, Homo sapiens
acctcctgcccaggagag

SEQ ID NO: 5150885 - DNA, 19 bp, Homo sapiens
acctcctgcccaggagagc

SEQ ID NO: 5150886 - DNA, 20 bp, Homo sapiens
acctcctgcccaggagagcc

SEQ ID NO: 5150887 - DNA, 21 bp, Homo sapiens
acctcctgcccaggagagcca

SEQ ID NO: 5150888 - DNA, 11 bp, Homo sapiens
acctcctgcct

SEQ ID NO: 5150889 - DNA, 12 bp, Homo sapiens
acctcctgcctc

SEQ ID NO: 5150890 - DNA, 21 bp, Homo sapiens
acctcctgcggctcagccttg

SEQ ID NO: 5150891 - DNA, 13 bp, Homo sapiens
acctcctgctctg

SEQ ID NO: 5150892 - DNA, 14 bp, Homo sapiens
acctcctgctctgg

SEQ ID NO: 5150893 - DNA, 11 bp, Homo sapiens
acctcctgctg

SEQ ID NO: 5150894 - DNA, 13 bp, Homo sapiens
acctcctgctggg

SEQ ID NO: 5150895 - DNA, 16 bp, Homo sapiens
acctcctgctgggcag

SEQ ID NO: 5150896 - DNA, 15 bp, Homo sapiens
acctcctggactgta

SEQ ID NO: 5150897 - DNA, 16 bp, Homo sapiens
acctcctggactgtag

SEQ ID NO: 5150898 - DNA, 12 bp, Homo sapiens
acctcctgggtt

SEQ ID NO: 5150899 - DNA, 18 bp, Homo sapiens
acctcctgtcactcactg

SEQ ID NO: 5150900 - DNA, 22 bp, Homo sapiens
acctcctgtcactcactgaggc

SEQ ID NO: 5150901 - DNA, 16 bp, Homo sapiens
acctcctgtcagtgag

SEQ ID NO: 5150902 - DNA, 14 bp, Homo sapiens
acctcctgtggaac

SEQ ID NO: 5150903 - DNA, 17 bp, Homo sapiens
acctccttagccctgtc

SEQ ID NO: 5150904 - DNA, 19 bp, Homo sapiens
acctccttagccctgtctg

SEQ ID NO: 5150905 - DNA, 23 bp, Homo sapiens
acctccttagctttccctgtgcc

SEQ ID NO: 5150906 - DNA, 17 bp, Homo sapiens
acctccttccctctctg

SEQ ID NO: 5150907 - DNA, 18 bp, Homo sapiens
acctccttccctctctgg

SEQ ID NO: 5150908 - DNA, 23 bp, Homo sapiens
acctccttctgcaaagtggcagg

SEQ ID NO: 5150909 - DNA, 20 bp, Homo sapiens
acctccttctgcagtcagac

SEQ ID NO: 5150910 - DNA, 21 bp, Homo sapiens
acctccttgtaacatcaggga

SEQ ID NO: 5150911 - DNA, 18 bp, Homo sapiens
acctcctttaccctcatc

SEQ ID NO: 5150912 - DNA, 23 bp, Homo sapiens
acctcctttcctatctttacatc

SEQ ID NO: 5150913 - DNA, 16 bp, Homo sapiens
acctcctttctcttct

SEQ ID NO: 5150914 - DNA, 17 bp, Homo sapiens
acctcctttctcttctc

SEQ ID NO: 5150915 - DNA, 22 bp, Homo sapiens
acctcgaagctgttctctgctt

SEQ ID NO: 5150916 - DNA, 22 bp, Homo sapiens
acctcgagaagtaattatcagt

SEQ ID NO: 5150917 - DNA, 16 bp, Homo sapiens
acctcgagtactgtgg

SEQ ID NO: 5150918 - DNA, 13 bp, Homo sapiens
acctcgccctctc

SEQ ID NO: 5150919 - DNA, 20 bp, Homo sapiens
acctcgcggcgcagcccctg

SEQ ID NO: 5150920 - DNA, 18 bp, Homo sapiens
acctcgctccaactccaa

SEQ ID NO: 5150921 - DNA, 17 bp, Homo sapiens
acctcgctcccctctgg

SEQ ID NO: 5150922 - DNA, 18 bp, Homo sapiens
acctcgctcccctctgga

SEQ ID NO: 5150923 - DNA, 19 bp, Homo sapiens
acctcgctcccctctggaa

SEQ ID NO: 5150924 - DNA, 14 bp, Homo sapiens
acctcgctggactc

SEQ ID NO: 5150925 - DNA, 16 bp, Homo sapiens
acctcgctgggctcta

SEQ ID NO: 5150926 - DNA, 21 bp, Homo sapiens
acctcgctgttgtcacatctc

SEQ ID NO: 5150927 - DNA, 19 bp, Homo sapiens
acctcggaatttctatgag

SEQ ID NO: 5150928 - DNA, 16 bp, Homo sapiens
acctcggacaccatct

SEQ ID NO: 5150929 - DNA, 15 bp, Homo sapiens
acctcggacagagcc

SEQ ID NO: 5150930 - DNA, 23 bp, Homo sapiens
acctcggagcatggtgttttcat

SEQ ID NO: 5150931 - DNA, 22 bp, Homo sapiens
acctcggagggatggagaaaga

SEQ ID NO: 5150932 - DNA, 18 bp, Homo sapiens
acctcggccctccctgcg

SEQ ID NO: 5150933 - DNA, 21 bp, Homo sapiens
acctcggccctccctgcgctt

SEQ ID NO: 5150934 - DNA, 13 bp, Homo sapiens
acctcggcctccc

SEQ ID NO: 5150935 - DNA, 13 bp, Homo sapiens
acctcggctgtgt

SEQ ID NO: 5150936 - DNA, 17 bp, Homo sapiens
acctcggcttgtgggct

SEQ ID NO: 5150937 - DNA, 18 bp, Homo sapiens
acctcggggacaccagag

SEQ ID NO: 5150938 - DNA, 20 bp, Homo sapiens
acctcggggacaccagagct

SEQ ID NO: 5150939 - DNA, 15 bp, Homo sapiens
acctcggtgatgcct

SEQ ID NO: 5150940 - DNA, 14 bp, Homo sapiens
acctcgtcaagagc

SEQ ID NO: 5150941 - DNA, 20 bp, Homo sapiens
acctcgtcctccccctgcca

SEQ ID NO: 5150942 - DNA, 22 bp, Homo sapiens
acctcgtcctccccctgccagt

SEQ ID NO: 5150943 - DNA, 23 bp, Homo sapiens
acctcgtgatatccacaaatgct

SEQ ID NO: 5150944 - DNA, 17 bp, Homo sapiens
acctcgtgatccacccg

SEQ ID NO: 5150945 - DNA, 17 bp, Homo sapiens
acctcgtgatgggcccg

SEQ ID NO: 5150946 - DNA, 19 bp, Homo sapiens
acctcgtgccaccccgagg

SEQ ID NO: 5150947 - DNA, 21 bp, Homo sapiens
acctcgtggggttcagtagag

SEQ ID NO: 5150948 - DNA, 19 bp, Homo sapiens
acctcgttactctcacctc

SEQ ID NO: 5150949 - DNA, 20 bp, Homo sapiens
acctcgttagagaatggcct

SEQ ID NO: 5150950 - DNA, 16 bp, Homo sapiens
acctctaacaccacac

SEQ ID NO: 5150951 - DNA, 19 bp, Homo sapiens
acctctaacaccacactga

SEQ ID NO: 5150952 - DNA, 20 bp, Homo sapiens
acctctaacaccacactgac

SEQ ID NO: 5150953 - DNA, 22 bp, Homo sapiens
acctctaacaccacactgacca

SEQ ID NO: 5150954 - DNA, 24 bp, Homo sapiens
acctctaacaccacactgaccaca

SEQ ID NO: 5150955 - DNA, 19 bp, Homo sapiens
acctctaacagcaccaaat

SEQ ID NO: 5150956 - DNA, 14 bp, Homo sapiens
acctctaagtgctg

SEQ ID NO: 5150957 - DNA, 17 bp, Homo sapiens
acctctaataaacactg

SEQ ID NO: 5150958 - DNA, 18 bp, Homo sapiens
acctctaataaacactgt

SEQ ID NO: 5150959 - DNA, 19 bp, Homo sapiens
acctctacccaaaccctag

SEQ ID NO: 5150960 - DNA, 16 bp, Homo sapiens
acctctactgtctcct

SEQ ID NO: 5150961 - DNA, 14 bp, Homo sapiens
acctctagaatccc

SEQ ID NO: 5150962 - DNA, 12 bp, Homo sapiens
acctctagaatt

SEQ ID NO: 5150963 - DNA, 15 bp, Homo sapiens
acctctagccctgcc

SEQ ID NO: 5150964 - DNA, 15 bp, Homo sapiens
acctctagtcagagt

SEQ ID NO: 5150965 - DNA, 18 bp, Homo sapiens
acctctataattgccact

SEQ ID NO: 5150966 - DNA, 17 bp, Homo sapiens
acctctattagtttcaa

SEQ ID NO: 5150967 - DNA, 22 bp, Homo sapiens
acctctcaagctagtgtttcta

SEQ ID NO: 5150968 - DNA, 20 bp, Homo sapiens
acctctcacgggccctgccc

SEQ ID NO: 5150969 - DNA, 21 bp, Homo sapiens
acctctcacgggccctgcccc

SEQ ID NO: 5150970 - DNA, 13 bp, Homo sapiens
acctctcactgcc

SEQ ID NO: 5150971 - DNA, 14 bp, Homo sapiens
acctctcagctgct

SEQ ID NO: 5150972 - DNA, 17 bp, Homo sapiens
acctctcatcagcccag

SEQ ID NO: 5150973 - DNA, 20 bp, Homo sapiens
acctctcattagaaaggcta

SEQ ID NO: 5150974 - DNA, 22 bp, Homo sapiens
acctctccaagggcttctgcac

SEQ ID NO: 5150975 - DNA, 19 bp, Homo sapiens
acctctccagcatcccagc

SEQ ID NO: 5150976 - DNA, 21 bp, Homo sapiens
acctctccagcatcccagcct

SEQ ID NO: 5150977 - DNA, 16 bp, Homo sapiens
acctctccaggtgctc

SEQ ID NO: 5150978 - DNA, 19 bp, Homo sapiens
acctctccatcttcagctt

SEQ ID NO: 5150979 - DNA, 21 bp, Homo sapiens
acctctcccaactataaaact

SEQ ID NO: 5150980 - DNA, 11 bp, Homo sapiens
acctctcccac

SEQ ID NO: 5150981 - DNA, 12 bp, Homo sapiens
acctctcccagc

SEQ ID NO: 5150982 - DNA, 12 bp, Homo sapiens
acctctccctca

SEQ ID NO: 5150983 - DNA, 23 bp, Homo sapiens
acctctccctgcatcctgaggcc

SEQ ID NO: 5150984 - DNA, 14 bp, Homo sapiens
acctctcccttgga

SEQ ID NO: 5150985 - DNA, 13 bp, Homo sapiens
acctctccggcct

SEQ ID NO: 5150986 - DNA, 22 bp, Homo sapiens
acctctccggcctggccttttc

SEQ ID NO: 5150987 - DNA, 14 bp, Homo sapiens
acctctcctcatgt

SEQ ID NO: 5150988 - DNA, 13 bp, Homo sapiens
acctctcctgccc

SEQ ID NO: 5150989 - DNA, 16 bp, Homo sapiens
acctctcctgccctgt

SEQ ID NO: 5150990 - DNA, 20 bp, Homo sapiens
acctctcctttggccattcc

SEQ ID NO: 5150991 - DNA, 22 bp, Homo sapiens
acctctcggccccatcgcccca

SEQ ID NO: 5150992 - DNA, 19 bp, Homo sapiens
acctctctaagccacagct

SEQ ID NO: 5150993 - DNA, 21 bp, Homo sapiens
acctctctaagttatgtacgt

SEQ ID NO: 5150994 - DNA, 14 bp, Homo sapiens
acctctctcactcc

SEQ ID NO: 5150995 - DNA, 14 bp, Homo sapiens
acctctctcagagc

SEQ ID NO: 5150996 - DNA, 16 bp, Homo sapiens
acctctctcagagcat

SEQ ID NO: 5150997 - DNA, 17 bp, Homo sapiens
acctctctcagagcatc

SEQ ID NO: 5150998 - DNA, 14 bp, Homo sapiens
acctctctcagccc

SEQ ID NO: 5150999 - DNA, 15 bp, Homo sapiens
acctctctccttctg

SEQ ID NO: 5151000 - DNA, 14 bp, Homo sapiens
acctctctcggccc

SEQ ID NO: 5151001 - DNA, 20 bp, Homo sapiens
acctctctctaagtttagaa

SEQ ID NO: 5151002 - DNA, 17 bp, Homo sapiens
acctctctctgaggaca

SEQ ID NO: 5151003 - DNA, 14 bp, Homo sapiens
acctctctctgctc

SEQ ID NO: 5151004 - DNA, 16 bp, Homo sapiens
acctctctctgctcct

SEQ ID NO: 5151005 - DNA, 19 bp, Homo sapiens
acctctctctgctcctcac

SEQ ID NO: 5151006 - DNA, 19 bp, Homo sapiens
acctctctgaactgcaaca

SEQ ID NO: 5151007 - DNA, 13 bp, Homo sapiens
acctctctgcctc

SEQ ID NO: 5151008 - DNA, 14 bp, Homo sapiens
acctctctgcctct

SEQ ID NO: 5151009 - DNA, 14 bp, Homo sapiens
acctctctgcctgt

SEQ ID NO: 5151010 - DNA, 22 bp, Homo sapiens
acctctctggaaggccccttcc

SEQ ID NO: 5151011 - DNA, 18 bp, Homo sapiens
acctctctggcttccatg

SEQ ID NO: 5151012 - DNA, 17 bp, Homo sapiens
acctctctgggacctag

SEQ ID NO: 5151013 - DNA, 20 bp, Homo sapiens
acctctctgggacctagggg

SEQ ID NO: 5151014 - DNA, 14 bp, Homo sapiens
acctctctgtagtt

SEQ ID NO: 5151015 - DNA, 14 bp, Homo sapiens
acctctctgtccct

SEQ ID NO: 5151016 - DNA, 22 bp, Homo sapiens
acctctctgtcccttgctgtat

SEQ ID NO: 5151017 - DNA, 18 bp, Homo sapiens
acctctctgtctttttcc

SEQ ID NO: 5151018 - DNA, 21 bp, Homo sapiens
acctctctgtctttttccttc

SEQ ID NO: 5151019 - DNA, 19 bp, Homo sapiens
acctctcttgaaccccaaa

SEQ ID NO: 5151020 - DNA, 15 bp, Homo sapiens
acctctgaagagctg

SEQ ID NO: 5151021 - DNA, 13 bp, Homo sapiens
acctctgaaggca

SEQ ID NO: 5151022 - DNA, 19 bp, Homo sapiens
acctctgaatgtcccagag

SEQ ID NO: 5151023 - DNA, 20 bp, Homo sapiens
acctctgaatgtcccagagg

SEQ ID NO: 5151024 - DNA, 15 bp, Homo sapiens
acctctgacaactgt

SEQ ID NO: 5151025 - DNA, 19 bp, Homo sapiens
acctctgacaactgtgaag

SEQ ID NO: 5151026 - DNA, 15 bp, Homo sapiens
acctctgacagcagc

SEQ ID NO: 5151027 - DNA, 20 bp, Homo sapiens
acctctgacagcagcatctc

SEQ ID NO: 5151028 - DNA, 21 bp, Homo sapiens
acctctgacagcagcatctct

SEQ ID NO: 5151029 - DNA, 13 bp, Homo sapiens
acctctgagaaga

SEQ ID NO: 5151030 - DNA, 21 bp, Homo sapiens
acctctgaggacagaggccgg

SEQ ID NO: 5151031 - DNA, 13 bp, Homo sapiens
acctctgatacct

SEQ ID NO: 5151032 - DNA, 15 bp, Homo sapiens
acctctgatacctca

SEQ ID NO: 5151033 - DNA, 20 bp, Homo sapiens
acctctgatagactttgtga

SEQ ID NO: 5151034 - DNA, 23 bp, Homo sapiens
acctctgatttattttgtatgaa

SEQ ID NO: 5151035 - DNA, 22 bp, Homo sapiens
acctctgcaagagggggcattg

SEQ ID NO: 5151036 - DNA, 18 bp, Homo sapiens
acctctgcacaagctgca

SEQ ID NO: 5151037 - DNA, 21 bp, Homo sapiens
acctctgcagcaataaagcag

SEQ ID NO: 5151038 - DNA, 13 bp, Homo sapiens
acctctgccactc

SEQ ID NO: 5151039 - DNA, 13 bp, Homo sapiens
acctctgcccttc

SEQ ID NO: 5151040 - DNA, 20 bp, Homo sapiens
acctctgcccttcccctccc

SEQ ID NO: 5151041 - DNA, 13 bp, Homo sapiens
acctctgcctcaa

SEQ ID NO: 5151042 - DNA, 15 bp, Homo sapiens
acctctgcctcaatg

SEQ ID NO: 5151043 - DNA, 20 bp, Homo sapiens
acctctgcctcagaaaacaa

SEQ ID NO: 5151044 - DNA, 16 bp, Homo sapiens
acctctgcctcctggg

SEQ ID NO: 5151045 - DNA, 20 bp, Homo sapiens
acctctgcctgaagtcacac

SEQ ID NO: 5151046 - DNA, 14 bp, Homo sapiens
acctctgcggaccc

SEQ ID NO: 5151047 - DNA, 18 bp, Homo sapiens
acctctgcggaccccagc

SEQ ID NO: 5151048 - DNA, 21 bp, Homo sapiens
acctttaaatttaggtaaata

SEQ ID NO: 5151049 - DNA, 19 bp, Homo sapiens
acctttaactgagggctga

SEQ ID NO: 5151050 - DNA, 15 bp, Homo sapiens
acctttaagagaaat

SEQ ID NO: 5151051 - DNA, 13 bp, Homo sapiens
acctttacataat

SEQ ID NO: 5151052 - DNA, 18 bp, Homo sapiens
acctttaccccatccctg

SEQ ID NO: 5151053 - DNA, 12 bp, Homo sapiens
acctttactgtg

SEQ ID NO: 5151054 - DNA, 13 bp, Homo sapiens
acctttactttag

SEQ ID NO: 5151055 - DNA, 17 bp, Homo sapiens
acctttagaatatcttt

SEQ ID NO: 5151056 - DNA, 17 bp, Homo sapiens
acctttagaatattaaa

SEQ ID NO: 5151057 - DNA, 14 bp, Homo sapiens
acctttaggttctt

SEQ ID NO: 5151058 - DNA, 18 bp, Homo sapiens
acctttatatctgtcttt

SEQ ID NO: 5151059 - DNA, 21 bp, Homo sapiens
acctttatatctgtcttttat

SEQ ID NO: 5151060 - DNA, 20 bp, Homo sapiens
acctttatcacctcattctg

SEQ ID NO: 5151061 - DNA, 15 bp, Homo sapiens
acctttatccctgct

SEQ ID NO: 5151062 - DNA, 18 bp, Homo sapiens
acctttatccctgcttat

SEQ ID NO: 5151063 - DNA, 15 bp, Homo sapiens
acctttatggtttct

SEQ ID NO: 5151064 - DNA, 14 bp, Homo sapiens
acctttatgtttta

SEQ ID NO: 5151065 - DNA, 18 bp, Homo sapiens
acctttattaaaatctta

SEQ ID NO: 5151066 - DNA, 20 bp, Homo sapiens
acctttattaaaatcttaaa

SEQ ID NO: 5151067 - DNA, 22 bp, Homo sapiens
acctttattaatgaactgtgac

SEQ ID NO: 5151068 - DNA, 19 bp, Homo sapiens
acctttattcacccctgcc

SEQ ID NO: 5151069 - DNA, 17 bp, Homo sapiens
acctttattcttttcca

SEQ ID NO: 5151070 - DNA, 22 bp, Homo sapiens
acctttattgggtatcaagaca

SEQ ID NO: 5151071 - DNA, 14 bp, Homo sapiens
acctttattgtgat

SEQ ID NO: 5151072 - DNA, 16 bp, Homo sapiens
acctttattgtgatct

SEQ ID NO: 5151073 - DNA, 23 bp, Homo sapiens
acctttatttattaaacttcagc

SEQ ID NO: 5151074 - DNA, 17 bp, Homo sapiens
acctttattttagaatt

SEQ ID NO: 5151075 - DNA, 14 bp, Homo sapiens
acctttattttatt

SEQ ID NO: 5151076 - DNA, 20 bp, Homo sapiens
acctttcaaaatggaaaatt

SEQ ID NO: 5151077 - DNA, 18 bp, Homo sapiens
acctttcaaagccatttt

SEQ ID NO: 5151078 - DNA, 14 bp, Homo sapiens
acctttcaaagctt

SEQ ID NO: 5151079 - DNA, 16 bp, Homo sapiens
acctttcaataggaaa

SEQ ID NO: 5151080 - DNA, 17 bp, Homo sapiens
acctttcaataggaaaa

SEQ ID NO: 5151081 - DNA, 23 bp, Homo sapiens
acctttcaataggaaaaactgat

SEQ ID NO: 5151082 - DNA, 21 bp, Homo sapiens
acctttcacctttgtgtattt

SEQ ID NO: 5151083 - DNA, 23 bp, Homo sapiens
acctttcagataactgttattta

SEQ ID NO: 5151084 - DNA, 19 bp, Homo sapiens
acctttcagtactcttatt

SEQ ID NO: 5151085 - DNA, 18 bp, Homo sapiens
acctttcataatctttgc

SEQ ID NO: 5151086 - DNA, 13 bp, Homo sapiens
acctttcataatt

SEQ ID NO: 5151087 - DNA, 18 bp, Homo sapiens
acctttcatgtgcctgaa

SEQ ID NO: 5151088 - DNA, 18 bp, Homo sapiens
acctttccaccacagcca

SEQ ID NO: 5151089 - DNA, 18 bp, Homo sapiens
acctttcccacctctctc

SEQ ID NO: 5151090 - DNA, 18 bp, Homo sapiens
acctttcccatcttccaa

SEQ ID NO: 5151091 - DNA, 15 bp, Homo sapiens
acctttcccatgctg

SEQ ID NO: 5151092 - DNA, 17 bp, Homo sapiens
acctttcccatgctgaa

SEQ ID NO: 5151093 - DNA, 23 bp, Homo sapiens
acctttcccatgctgaattattt

SEQ ID NO: 5151094 - DNA, 14 bp, Homo sapiens
acctttcccatttc

SEQ ID NO: 5151095 - DNA, 14 bp, Homo sapiens
acctttccctcacc

SEQ ID NO: 5151096 - DNA, 18 bp, Homo sapiens
acctttccctcaccccct

SEQ ID NO: 5151097 - DNA, 21 bp, Homo sapiens
acctttccgctgtcgccccag

SEQ ID NO: 5151098 - DNA, 15 bp, Homo sapiens
acctttcctacattt

SEQ ID NO: 5151099 - DNA, 17 bp, Homo sapiens
acctttcctacattttc

SEQ ID NO: 5151100 - DNA, 13 bp, Homo sapiens
acctttcctctcc

SEQ ID NO: 5151101 - DNA, 18 bp, Homo sapiens
acctttcctctccctcag

SEQ ID NO: 5151102 - DNA, 19 bp, Homo sapiens
acctttcctctccctcagg

SEQ ID NO: 5151103 - DNA, 20 bp, Homo sapiens
acctttcctctccctcaggg

SEQ ID NO: 5151104 - DNA, 21 bp, Homo sapiens
acctttcctgatgcccctgac

SEQ ID NO: 5151105 - DNA, 19 bp, Homo sapiens
acctttcggcagaggaacc

SEQ ID NO: 5151106 - DNA, 17 bp, Homo sapiens
acctttctaaccttcac

SEQ ID NO: 5151107 - DNA, 18 bp, Homo sapiens
acctttctaggttcaaaa

SEQ ID NO: 5151108 - DNA, 20 bp, Homo sapiens
acctttctataattttacaa

SEQ ID NO: 5151109 - DNA, 16 bp, Homo sapiens
acctttctcctttgta

SEQ ID NO: 5151110 - DNA, 13 bp, Homo sapiens
acctttctctgag

SEQ ID NO: 5151111 - DNA, 15 bp, Homo sapiens
acctttctgaatgga

SEQ ID NO: 5151112 - DNA, 21 bp, Homo sapiens
acctttctgacatcagcactt

SEQ ID NO: 5151113 - DNA, 13 bp, Homo sapiens
acctttctggcct

SEQ ID NO: 5151114 - DNA, 14 bp, Homo sapiens
acctttctggcctg

SEQ ID NO: 5151115 - DNA, 22 bp, Homo sapiens
acctttctgggctttctcctgg

SEQ ID NO: 5151116 - DNA, 17 bp, Homo sapiens
acctttcttcttgtgtc

SEQ ID NO: 5151117 - DNA, 23 bp, Homo sapiens
acctttgagagagggggcactgt

SEQ ID NO: 5151118 - DNA, 20 bp, Homo sapiens
acctttgagtagatccattt

SEQ ID NO: 5151119 - DNA, 21 bp, Homo sapiens
acctttgatgaattcttcctc

SEQ ID NO: 5151120 - DNA, 23 bp, Homo sapiens
acctttgcacaggatgctggcct

SEQ ID NO: 5151121 - DNA, 22 bp, Homo sapiens
acctttgcccacacacactcct

SEQ ID NO: 5151122 - DNA, 14 bp, Homo sapiens
acctttggaaaaat

SEQ ID NO: 5151123 - DNA, 17 bp, Homo sapiens
acctttggaaacaacat

SEQ ID NO: 5151124 - DNA, 18 bp, Homo sapiens
acctttggagcaaagctg

SEQ ID NO: 5151125 - DNA, 17 bp, Homo sapiens
acctttgggttctttct

SEQ ID NO: 5151126 - DNA, 18 bp, Homo sapiens
acctttgtacagcccaga

SEQ ID NO: 5151127 - DNA, 22 bp, Homo sapiens
acctttgtacagcccagaggcc

SEQ ID NO: 5151128 - DNA, 24 bp, Homo sapiens
acctttgtagttactcaagcagtt

SEQ ID NO: 5151129 - DNA, 15 bp, Homo sapiens
acctttgtattctct

SEQ ID NO: 5151130 - DNA, 15 bp, Homo sapiens
acctttgtccccacc

SEQ ID NO: 5151131 - DNA, 16 bp, Homo sapiens
acctttgtccccaccg

SEQ ID NO: 5151132 - DNA, 18 bp, Homo sapiens
acctttgtgccctatcac

SEQ ID NO: 5151133 - DNA, 15 bp, Homo sapiens
acctttgtgtaaaga

SEQ ID NO: 5151134 - DNA, 19 bp, Homo sapiens
acctttgtgtggctcctgg

SEQ ID NO: 5151135 - DNA, 13 bp, Homo sapiens
acctttgtttcct

SEQ ID NO: 5151136 - DNA, 18 bp, Homo sapiens
acctttgttttgcactga

SEQ ID NO: 5151137 - DNA, 16 bp, Homo sapiens
accttttaaaattgaa

SEQ ID NO: 5151138 - DNA, 22 bp, Homo sapiens
accttttaaagtgtttcagcta

SEQ ID NO: 5151139 - DNA, 21 bp, Homo sapiens
accttttaaatcctgttgaaa

SEQ ID NO: 5151140 - DNA, 14 bp, Homo sapiens
accttttaagttaa

SEQ ID NO: 5151141 - DNA, 21 bp, Homo sapiens
accttttaattaatgaaatat

SEQ ID NO: 5151142 - DNA, 13 bp, Homo sapiens
accttttacattg

SEQ ID NO: 5151143 - DNA, 24 bp, Homo sapiens
accttttactggttgcatggaaat

SEQ ID NO: 5151144 - DNA, 13 bp, Homo sapiens
accttttactgtg

SEQ ID NO: 5151145 - DNA, 17 bp, Homo sapiens
accttttataagacaaa

SEQ ID NO: 5151146 - DNA, 15 bp, Homo sapiens
accttttatcaataa

SEQ ID NO: 5151147 - DNA, 12 bp, Homo sapiens
accttttcaaat

SEQ ID NO: 5151148 - DNA, 18 bp, Homo sapiens
accttttcacaatggaaa

SEQ ID NO: 5151149 - DNA, 18 bp, Homo sapiens
accttttcatgtacagca

SEQ ID NO: 5151150 - DNA, 20 bp, Homo sapiens
accttttcccttgctgtacc

SEQ ID NO: 5151151 - DNA, 11 bp, Homo sapiens
accttttccta

SEQ ID NO: 5151152 - DNA, 12 bp, Homo sapiens
accttttctaaa

SEQ ID NO: 5151153 - DNA, 13 bp, Homo sapiens
accttttctaaaa

SEQ ID NO: 5151154 - DNA, 22 bp, Homo sapiens
accttttctagtctgtcttcct

SEQ ID NO: 5151155 - DNA, 13 bp, Homo sapiens
accttttctataa

SEQ ID NO: 5151156 - DNA, 18 bp, Homo sapiens
accttttctataagttgt

SEQ ID NO: 5151157 - DNA, 17 bp, Homo sapiens
accttttctcacaaaaa

SEQ ID NO: 5151158 - DNA, 14 bp, Homo sapiens
accttttctctccc

SEQ ID NO: 5151159 - DNA, 17 bp, Homo sapiens
accttttctctcccata

SEQ ID NO: 5151160 - DNA, 20 bp, Homo sapiens
accttttctgtggctggctc

SEQ ID NO: 5151161 - DNA, 12 bp, Homo sapiens
accttttcttca

SEQ ID NO: 5151162 - DNA, 15 bp, Homo sapiens
accttttcttcaaaa

SEQ ID NO: 5151163 - DNA, 12 bp, Homo sapiens
accttttcttgc

SEQ ID NO: 5151164 - DNA, 19 bp, Homo sapiens
accttttgaagtagtttgt

SEQ ID NO: 5151165 - DNA, 17 bp, Homo sapiens
accttttgagtgcctta

SEQ ID NO: 5151166 - DNA, 21 bp, Homo sapiens
accttttgataaaatgttcct

SEQ ID NO: 5151167 - DNA, 21 bp, Homo sapiens
accttttgcacctgctctctt

SEQ ID NO: 5151168 - DNA, 17 bp, Homo sapiens
accttttgcatttcttt

SEQ ID NO: 5151169 - DNA, 22 bp, Homo sapiens
accttttgggaatgttttaaat

SEQ ID NO: 5151170 - DNA, 17 bp, Homo sapiens
accttttgtatttaaaa

SEQ ID NO: 5151171 - DNA, 13 bp, Homo sapiens
accttttgtctct

SEQ ID NO: 5151172 - DNA, 10 bp, Homo sapiens
acctttttaa

SEQ ID NO: 5151173 - DNA, 22 bp, Homo sapiens
acctttttataaagatcattta

SEQ ID NO: 5151174 - DNA, 23 bp, Homo sapiens
acctttttatatttaaaaaatta

SEQ ID NO: 5151175 - DNA, 14 bp, Homo sapiens
acctttttccttcc

SEQ ID NO: 5151176 - DNA, 13 bp, Homo sapiens
acctttttctctc

SEQ ID NO: 5151177 - DNA, 18 bp, Homo sapiens
acctttttgaacatgtat

SEQ ID NO: 5151178 - DNA, 22 bp, Homo sapiens
acctttttgcatgatatcttca

SEQ ID NO: 5151179 - DNA, 18 bp, Homo sapiens
acctttttgcttatttta

SEQ ID NO: 5151180 - DNA, 20 bp, Homo sapiens
acctttttgcttattttaca

SEQ ID NO: 5151181 - DNA, 15 bp, Homo sapiens
acctttttgtatgtg

SEQ ID NO: 5151182 - DNA, 22 bp, Homo sapiens
accttttttatacataaacaag

SEQ ID NO: 5151183 - DNA, 23 bp, Homo sapiens
accttttttcaacagtgaagaca

SEQ ID NO: 5151184 - DNA, 13 bp, Homo sapiens
accttttttcttg

SEQ ID NO: 5151185 - DNA, 16 bp, Homo sapiens
accttttttcttgcta

SEQ ID NO: 5151186 - DNA, 13 bp, Homo sapiens
accttttttgtct

SEQ ID NO: 5151187 - DNA, 20 bp, Homo sapiens
acctttttttagttatatat

SEQ ID NO: 5151188 - DNA, 18 bp, Homo sapiens
accttttttttacggaat

SEQ ID NO: 5151189 - DNA, 20 bp, Homo sapiens
accttttttttttgagttta

SEQ ID NO: 5151190 - DNA, 20 bp, Homo sapiens
acgaaaaagtgattgtgaag

SEQ ID NO: 5151191 - DNA, 21 bp, Homo sapiens
acgaaacacagaactcagcct

SEQ ID NO: 5151192 - DNA, 17 bp, Homo sapiens
acgaaaccaaaaagttg

SEQ ID NO: 5151193 - DNA, 13 bp, Homo sapiens
acgaaacccactc

SEQ ID NO: 5151194 - DNA, 14 bp, Homo sapiens
acgaaactgctcta

SEQ ID NO: 5151195 - DNA, 21 bp, Homo sapiens
acgaaacttgttattgtgaat

SEQ ID NO: 5151196 - DNA, 14 bp, Homo sapiens
acgaaagaaatgta

SEQ ID NO: 5151197 - DNA, 12 bp, Homo sapiens
acgaaagagaga

SEQ ID NO: 5151198 - DNA, 20 bp, Homo sapiens
acgaaaggatgagcagagcc

SEQ ID NO: 5151199 - DNA, 18 bp, Homo sapiens
acgaaagtatttactttt

SEQ ID NO: 5151200 - DNA, 22 bp, Homo sapiens
acgaaagtatttactttttaaa

SEQ ID NO: 5151201 - DNA, 17 bp, Homo sapiens
acgaaataattgttgtt

SEQ ID NO: 5151202 - DNA, 21 bp, Homo sapiens
acgaaatacgttaggaggaca

SEQ ID NO: 5151203 - DNA, 12 bp, Homo sapiens
acgaaatgttat

SEQ ID NO: 5151204 - DNA, 21 bp, Homo sapiens
acgaaattgttacaatagaat

SEQ ID NO: 5151205 - DNA, 12 bp, Homo sapiens
acgaacaaaaca

SEQ ID NO: 5151206 - DNA, 14 bp, Homo sapiens
acgaacatggcatg

SEQ ID NO: 5151207 - DNA, 18 bp, Homo sapiens
acgaacatggcatgtgaa

SEQ ID NO: 5151208 - DNA, 15 bp, Homo sapiens
acgaacccacctgct

SEQ ID NO: 5151209 - DNA, 20 bp, Homo sapiens
acgaacccctagaaaggaga

SEQ ID NO: 5151210 - DNA, 19 bp, Homo sapiens
acgaaccctagaaatatat

SEQ ID NO: 5151211 - DNA, 19 bp, Homo sapiens
acgaacctacagttttaac

SEQ ID NO: 5151212 - DNA, 14 bp, Homo sapiens
acgaacttgaaagt

SEQ ID NO: 5151213 - DNA, 19 bp, Homo sapiens
acgaagaaatagaataggc

SEQ ID NO: 5151214 - DNA, 19 bp, Homo sapiens
acgaagacaaagtcccaga

SEQ ID NO: 5151215 - DNA, 20 bp, Homo sapiens
acgaagagtatttttgacag

SEQ ID NO: 5151216 - DNA, 22 bp, Homo sapiens
acgaagagtatttttgacagaa

SEQ ID NO: 5151217 - DNA, 20 bp, Homo sapiens
acgaagagtttaaagagaaa

SEQ ID NO: 5151218 - DNA, 19 bp, Homo sapiens
acgaagcaatttgttgctg

SEQ ID NO: 5151219 - DNA, 17 bp, Homo sapiens
acgaagccatctttctt

SEQ ID NO: 5151220 - DNA, 20 bp, Homo sapiens
acgaagcggagagagccaag

SEQ ID NO: 5151221 - DNA, 21 bp, Homo sapiens
acgaagcggagagagccaaga

SEQ ID NO: 5151222 - DNA, 14 bp, Homo sapiens
acgaagtgttgcat

SEQ ID NO: 5151223 - DNA, 21 bp, Homo sapiens
acgaataaacgcagaagaggg

SEQ ID NO: 5151224 - DNA, 11 bp, Homo sapiens
acgaataaagg

SEQ ID NO: 5151225 - DNA, 12 bp, Homo sapiens
acgaataaaggt

SEQ ID NO: 5151226 - DNA, 12 bp, Homo sapiens
acctctgctctg

SEQ ID NO: 5151227 - DNA, 14 bp, Homo sapiens
acctctgctctgag

SEQ ID NO: 5151228 - DNA, 12 bp, Homo sapiens
acctctgctgat

SEQ ID NO: 5151229 - DNA, 12 bp, Homo sapiens
acctctgctggg

SEQ ID NO: 5151230 - DNA, 16 bp, Homo sapiens
acctctgctgggatgt

SEQ ID NO: 5151231 - DNA, 14 bp, Homo sapiens
acctctgcttccca

SEQ ID NO: 5151232 - DNA, 20 bp, Homo sapiens
acctctgctttctgatgttg

SEQ ID NO: 5151233 - DNA, 19 bp, Homo sapiens
acctctgcttttgcacacc

SEQ ID NO: 5151234 - DNA, 20 bp, Homo sapiens
acctctgcttttgcacacct

SEQ ID NO: 5151235 - DNA, 20 bp, Homo sapiens
acctctggaaccccccaggc

SEQ ID NO: 5151236 - DNA, 23 bp, Homo sapiens
acctctggaaccccccaggccct

SEQ ID NO: 5151237 - DNA, 16 bp, Homo sapiens
acctctggactggcta

SEQ ID NO: 5151238 - DNA, 17 bp, Homo sapiens
acctctggagtgccccc

SEQ ID NO: 5151239 - DNA, 19 bp, Homo sapiens
acctctggccaaatatgca

SEQ ID NO: 5151240 - DNA, 22 bp, Homo sapiens
acctctggccaaatatgcactt

SEQ ID NO: 5151241 - DNA, 23 bp, Homo sapiens
acctctggccaaatatgcacttt

SEQ ID NO: 5151242 - DNA, 12 bp, Homo sapiens
acctctggccct

SEQ ID NO: 5151243 - DNA, 15 bp, Homo sapiens
acctctggccctgtg

SEQ ID NO: 5151244 - DNA, 17 bp, Homo sapiens
acctctggccctgtgta

SEQ ID NO: 5151245 - DNA, 17 bp, Homo sapiens
acctctggccctgttgt

SEQ ID NO: 5151246 - DNA, 13 bp, Homo sapiens
acctctggccctt

SEQ ID NO: 5151247 - DNA, 17 bp, Homo sapiens
acctctggcccttggaa

SEQ ID NO: 5151248 - DNA, 13 bp, Homo sapiens
acctctggctgac

SEQ ID NO: 5151249 - DNA, 16 bp, Homo sapiens
acctctggctgactaa

SEQ ID NO: 5151250 - DNA, 17 bp, Homo sapiens
acctctgggaccccagc

SEQ ID NO: 5151251 - DNA, 14 bp, Homo sapiens
acctctgggccctg

SEQ ID NO: 5151252 - DNA, 22 bp, Homo sapiens
acctctgggccctgcaggaggc

SEQ ID NO: 5151253 - DNA, 23 bp, Homo sapiens
acctctgggccctgcaggaggcc

SEQ ID NO: 5151254 - DNA, 23 bp, Homo sapiens
acctctggggaccccaacctcag

SEQ ID NO: 5151255 - DNA, 18 bp, Homo sapiens
acctctggtggctcctcc

SEQ ID NO: 5151256 - DNA, 19 bp, Homo sapiens
acctctggtggctcctcct

SEQ ID NO: 5151257 - DNA, 17 bp, Homo sapiens
acctctggttaatttat

SEQ ID NO: 5151258 - DNA, 18 bp, Homo sapiens
acctctggttatcctgta

SEQ ID NO: 5151259 - DNA, 15 bp, Homo sapiens
acctctgtaggcagc

SEQ ID NO: 5151260 - DNA, 21 bp, Homo sapiens
acctctgtatttgaatcagcc

SEQ ID NO: 5151261 - DNA, 16 bp, Homo sapiens
acctctgtctcatcct

SEQ ID NO: 5151262 - DNA, 23 bp, Homo sapiens
acctctgtctcatcctcctggaa

SEQ ID NO: 5151263 - DNA, 18 bp, Homo sapiens
acctctgtctgagacagg

SEQ ID NO: 5151264 - DNA, 17 bp, Homo sapiens
acctctgtgaccaactg

SEQ ID NO: 5151265 - DNA, 18 bp, Homo sapiens
acctctgtgacctcaggc

SEQ ID NO: 5151266 - DNA, 16 bp, Homo sapiens
acctctgtgcagggca

SEQ ID NO: 5151267 - DNA, 20 bp, Homo sapiens
acctctgtgggcactggtgg

SEQ ID NO: 5151268 - DNA, 21 bp, Homo sapiens
acctctgtgggcactggtggg

SEQ ID NO: 5151269 - DNA, 15 bp, Homo sapiens
acctctgttcagtgt

SEQ ID NO: 5151270 - DNA, 17 bp, Homo sapiens
acctctgttcagtgtaa

SEQ ID NO: 5151271 - DNA, 22 bp, Homo sapiens
acctctgttcagtgtaaatagt

SEQ ID NO: 5151272 - DNA, 15 bp, Homo sapiens
acctctgttcatttc

SEQ ID NO: 5151273 - DNA, 14 bp, Homo sapiens
acctctgttgtcct

SEQ ID NO: 5151274 - DNA, 22 bp, Homo sapiens
acctctgttgtcctccccttgg

SEQ ID NO: 5151275 - DNA, 21 bp, Homo sapiens
acctcttaaagaaaacccacc

SEQ ID NO: 5151276 - DNA, 16 bp, Homo sapiens
acctcttactttgctt

SEQ ID NO: 5151277 - DNA, 12 bp, Homo sapiens
acctcttagaaa

SEQ ID NO: 5151278 - DNA, 16 bp, Homo sapiens
acctcttagagtcctt

SEQ ID NO: 5151279 - DNA, 15 bp, Homo sapiens
acctcttagctgagt

SEQ ID NO: 5151280 - DNA, 17 bp, Homo sapiens
acctcttatcactaaga

SEQ ID NO: 5151281 - DNA, 21 bp, Homo sapiens
acctcttatcactaagaaaga

SEQ ID NO: 5151282 - DNA, 23 bp, Homo sapiens
acctcttatcactaagaaagaaa

SEQ ID NO: 5151283 - DNA, 15 bp, Homo sapiens
acctcttcacctgac

SEQ ID NO: 5151284 - DNA, 15 bp, Homo sapiens
acctcttcagaggcc

SEQ ID NO: 5151285 - DNA, 18 bp, Homo sapiens
acctcttcagaggccctc

SEQ ID NO: 5151286 - DNA, 19 bp, Homo sapiens
acctcttcagctgctgaca

SEQ ID NO: 5151287 - DNA, 11 bp, Homo sapiens
acctcttccac

SEQ ID NO: 5151288 - DNA, 14 bp, Homo sapiens
acctcttccaggaa

SEQ ID NO: 5151289 - DNA, 20 bp, Homo sapiens
acctcttccaggaagcacag

SEQ ID NO: 5151290 - DNA, 18 bp, Homo sapiens
acctcttccctctgggcc

SEQ ID NO: 5151291 - DNA, 22 bp, Homo sapiens
acctcttccgactctttctgag

SEQ ID NO: 5151292 - DNA, 17 bp, Homo sapiens
acctcttcctaggccac

SEQ ID NO: 5151293 - DNA, 12 bp, Homo sapiens
acctcttcctct

SEQ ID NO: 5151294 - DNA, 16 bp, Homo sapiens
acctcttcctggaata

SEQ ID NO: 5151295 - DNA, 14 bp, Homo sapiens
acctcttctatgca

SEQ ID NO: 5151296 - DNA, 23 bp, Homo sapiens
acctcttctatgcaagccttgct

SEQ ID NO: 5151297 - DNA, 15 bp, Homo sapiens
acctcttctattgct

SEQ ID NO: 5151298 - DNA, 16 bp, Homo sapiens
acctcttctcttcctg

SEQ ID NO: 5151299 - DNA, 13 bp, Homo sapiens
acctcttctgcca

SEQ ID NO: 5151300 - DNA, 19 bp, Homo sapiens
acctcttgagccttgaact

SEQ ID NO: 5151301 - DNA, 20 bp, Homo sapiens
acctcttgagccttgaactt

SEQ ID NO: 5151302 - DNA, 21 bp, Homo sapiens
acctcttgagccttgaacttt

SEQ ID NO: 5151303 - DNA, 12 bp, Homo sapiens
acctcttgcctc

SEQ ID NO: 5151304 - DNA, 13 bp, Homo sapiens
acctcttgctgtc

SEQ ID NO: 5151305 - DNA, 15 bp, Homo sapiens
acctcttgctgtctc

SEQ ID NO: 5151306 - DNA, 17 bp, Homo sapiens
acctcttgctgtctctg

SEQ ID NO: 5151307 - DNA, 13 bp, Homo sapiens
acctcttggcttt

SEQ ID NO: 5151308 - DNA, 20 bp, Homo sapiens
acctcttgtgcaaggtggcc

SEQ ID NO: 5151309 - DNA, 15 bp, Homo sapiens
acctcttgtgctgag

SEQ ID NO: 5151310 - DNA, 12 bp, Homo sapiens
acctcttgtttt

SEQ ID NO: 5151311 - DNA, 19 bp, Homo sapiens
acctctttattttttgatt

SEQ ID NO: 5151312 - DNA, 22 bp, Homo sapiens
acctctttattttttgattgaa

SEQ ID NO: 5151313 - DNA, 23 bp, Homo sapiens
acctctttcttcaattaatggaa

SEQ ID NO: 5151314 - DNA, 18 bp, Homo sapiens
acctctttgcgtttcctt

SEQ ID NO: 5151315 - DNA, 15 bp, Homo sapiens
acctctttgctccct

SEQ ID NO: 5151316 - DNA, 13 bp, Homo sapiens
acctctttggaaa

SEQ ID NO: 5151317 - DNA, 17 bp, Homo sapiens
acctcttttagtcattt

SEQ ID NO: 5151318 - DNA, 20 bp, Homo sapiens
acctcttttgagactttgcc

SEQ ID NO: 5151319 - DNA, 23 bp, Homo sapiens
acctcttttgagactttgcccag

SEQ ID NO: 5151320 - DNA, 17 bp, Homo sapiens
acctcttttgttgtcct

SEQ ID NO: 5151321 - DNA, 12 bp, Homo sapiens
acctctttttaa

SEQ ID NO: 5151322 - DNA, 18 bp, Homo sapiens
acctctttttaaggacac

SEQ ID NO: 5151323 - DNA, 16 bp, Homo sapiens
acctctttttcctcct

SEQ ID NO: 5151324 - DNA, 18 bp, Homo sapiens
acctctttttcctcctgg

SEQ ID NO: 5151325 - DNA, 20 bp, Homo sapiens
acctgaaaacactgtgcaca

SEQ ID NO: 5151326 - DNA, 16 bp, Homo sapiens
acctgaaaattcaaca

SEQ ID NO: 5151327 - DNA, 14 bp, Homo sapiens
acctgaaacactgg

SEQ ID NO: 5151328 - DNA, 15 bp, Homo sapiens
acctgaaacactgga

SEQ ID NO: 5151329 - DNA, 14 bp, Homo sapiens
acctgaaacacttt

SEQ ID NO: 5151330 - DNA, 18 bp, Homo sapiens
acctgaaagaacatacat

SEQ ID NO: 5151331 - DNA, 22 bp, Homo sapiens
acctgaaagcccttctcaagac

SEQ ID NO: 5151332 - DNA, 16 bp, Homo sapiens
acctgaaagcctgtct

SEQ ID NO: 5151333 - DNA, 18 bp, Homo sapiens
acctgaaagcctgtctct

SEQ ID NO: 5151334 - DNA, 16 bp, Homo sapiens
acctgaaaggaaggtt

SEQ ID NO: 5151335 - DNA, 20 bp, Homo sapiens
acctgaaagttccttctgta

SEQ ID NO: 5151336 - DNA, 14 bp, Homo sapiens
acctgaaataatat

SEQ ID NO: 5151337 - DNA, 17 bp, Homo sapiens
acctgaaataatatatt

SEQ ID NO: 5151338 - DNA, 19 bp, Homo sapiens
acctgaaattaatttgtga

SEQ ID NO: 5151339 - DNA, 14 bp, Homo sapiens
acctgaaattccaa

SEQ ID NO: 5151340 - DNA, 15 bp, Homo sapiens
acctgaacaaaccct

SEQ ID NO: 5151341 - DNA, 23 bp, Homo sapiens
acctgaacaggaatccttactga

SEQ ID NO: 5151342 - DNA, 23 bp, Homo sapiens
acctgaacccagaaacaacacaa

SEQ ID NO: 5151343 - DNA, 19 bp, Homo sapiens
acctgaaccccagaggcag

SEQ ID NO: 5151344 - DNA, 21 bp, Homo sapiens
acctgaaccccagaggcagag

SEQ ID NO: 5151345 - DNA, 14 bp, Homo sapiens
acctgaacctagga

SEQ ID NO: 5151346 - DNA, 14 bp, Homo sapiens
acctgaagaatcac

SEQ ID NO: 5151347 - DNA, 16 bp, Homo sapiens
acctgaagaatcacaa

SEQ ID NO: 5151348 - DNA, 23 bp, Homo sapiens
acctgaagagcgctcctctgcct

SEQ ID NO: 5151349 - DNA, 19 bp, Homo sapiens
acctgaagatgggagcctt

SEQ ID NO: 5151350 - DNA, 16 bp, Homo sapiens
acctgaagatgtctcc

SEQ ID NO: 5151351 - DNA, 20 bp, Homo sapiens
acctgaagatgtctcctcaa

SEQ ID NO: 5151352 - DNA, 21 bp, Homo sapiens
acctgaagatgtctcctcaag

SEQ ID NO: 5151353 - DNA, 17 bp, Homo sapiens
acctgaaggcagggctc

SEQ ID NO: 5151354 - DNA, 20 bp, Homo sapiens
acctgaaggcagggctcctc

SEQ ID NO: 5151355 - DNA, 23 bp, Homo sapiens
acctgaagggtgacatcccagga

SEQ ID NO: 5151356 - DNA, 16 bp, Homo sapiens
acctgaagttttatga

SEQ ID NO: 5151357 - DNA, 19 bp, Homo sapiens
acctgaataattactacat

SEQ ID NO: 5151358 - DNA, 23 bp, Homo sapiens
acctgaatcacaacgggccagct

SEQ ID NO: 5151359 - DNA, 15 bp, Homo sapiens
acctgaatctttttt

SEQ ID NO: 5151360 - DNA, 14 bp, Homo sapiens
acctgaatggagaa

SEQ ID NO: 5151361 - DNA, 12 bp, Homo sapiens
acctgaattaaa

SEQ ID NO: 5151362 - DNA, 14 bp, Homo sapiens
acctgaattaaagt

SEQ ID NO: 5151363 - DNA, 15 bp, Homo sapiens
acctgaattaaagtc

SEQ ID NO: 5151364 - DNA, 13 bp, Homo sapiens
acctgaattgaaa

SEQ ID NO: 5151365 - DNA, 19 bp, Homo sapiens
acctgaattgaaagagaat

SEQ ID NO: 5151366 - DNA, 14 bp, Homo sapiens
acctgaatttgtat

SEQ ID NO: 5151367 - DNA, 15 bp, Homo sapiens
acctgacaaatggaa

SEQ ID NO: 5151368 - DNA, 15 bp, Homo sapiens
acctgacaacttctg

SEQ ID NO: 5151369 - DNA, 22 bp, Homo sapiens
acctgacaatggcagctagact

SEQ ID NO: 5151370 - DNA, 11 bp, Homo sapiens
acctgacaatt

SEQ ID NO: 5151371 - DNA, 12 bp, Homo sapiens
acctgacacaag

SEQ ID NO: 5151372 - DNA, 16 bp, Homo sapiens
acctgacacaagagga

SEQ ID NO: 5151373 - DNA, 19 bp, Homo sapiens
acctgacacaccaggcgct

SEQ ID NO: 5151374 - DNA, 14 bp, Homo sapiens
acctgacacatctt

SEQ ID NO: 5151375 - DNA, 13 bp, Homo sapiens
acctgacacctgc

SEQ ID NO: 5151376 - DNA, 20 bp, Homo sapiens
acctgacactaaccagagtc

SEQ ID NO: 5151377 - DNA, 22 bp, Homo sapiens
acctgacactaaccagagtcag

SEQ ID NO: 5151378 - DNA, 14 bp, Homo sapiens
acctgaccagactg

SEQ ID NO: 5151379 - DNA, 18 bp, Homo sapiens
acctgaccaggggcccta

SEQ ID NO: 5151380 - DNA, 18 bp, Homo sapiens
acctgaccccattcctga

SEQ ID NO: 5151381 - DNA, 17 bp, Homo sapiens
acctgacccctgctcag

SEQ ID NO: 5151382 - DNA, 19 bp, Homo sapiens
acctgacccttctctcact

SEQ ID NO: 5151383 - DNA, 15 bp, Homo sapiens
acctgaccggcacct

SEQ ID NO: 5151384 - DNA, 18 bp, Homo sapiens
acctgaccgtgggcgggg

SEQ ID NO: 5151385 - DNA, 17 bp, Homo sapiens
acctgacctcttgctgt

SEQ ID NO: 5151386 - DNA, 22 bp, Homo sapiens
acctgacctcttgctgtctctg

SEQ ID NO: 5151387 - DNA, 17 bp, Homo sapiens
acctgacctgctgaatt

SEQ ID NO: 5151388 - DNA, 16 bp, Homo sapiens
acctgacgatcttccc

SEQ ID NO: 5151389 - DNA, 23 bp, Homo sapiens
acctgacgatcttcccccttccc

SEQ ID NO: 5151390 - DNA, 17 bp, Homo sapiens
acctgacggacgtcctg

SEQ ID NO: 5151391 - DNA, 19 bp, Homo sapiens
acctgacgtagctgcaaag

SEQ ID NO: 5151392 - DNA, 22 bp, Homo sapiens
acctgactcaattatttgcata

SEQ ID NO: 5151393 - DNA, 23 bp, Homo sapiens
acctgactctgaaatctgaagac

SEQ ID NO: 5151394 - DNA, 21 bp, Homo sapiens
acctgagaccctgggagagaa

SEQ ID NO: 5151395 - DNA, 23 bp, Homo sapiens
acctgagaccctgggagagaagt

SEQ ID NO: 5151396 - DNA, 23 bp, Homo sapiens
acctgagacctccactccacatc

SEQ ID NO: 5151397 - DNA, 15 bp, Homo sapiens
acctgagacgggcat

SEQ ID NO: 5151398 - DNA, 22 bp, Homo sapiens
acctgagactcacactctctgc

SEQ ID NO: 5151399 - DNA, 22 bp, Homo sapiens
acctgagactgtcggagaggct

SEQ ID NO: 5151400 - DNA, 19 bp, Homo sapiens
acctgagagcatctcagga

SEQ ID NO: 5151401 - DNA, 22 bp, Homo sapiens
acctgagatactgaagtgcagc

SEQ ID NO: 5151402 - DNA, 12 bp, Homo sapiens
acctgagatctg

SEQ ID NO: 5151403 - DNA, 21 bp, Homo sapiens
acctgagatgctgggagggct

SEQ ID NO: 5151404 - DNA, 23 bp, Homo sapiens
acgaataaaggtcccatgctcca

SEQ ID NO: 5151405 - DNA, 16 bp, Homo sapiens
acgaatagacatcaaa

SEQ ID NO: 5151406 - DNA, 15 bp, Homo sapiens
acgaatatgaatgtc

SEQ ID NO: 5151407 - DNA, 18 bp, Homo sapiens
acgaatatgaatgtcaca

SEQ ID NO: 5151408 - DNA, 13 bp, Homo sapiens
acgaatcctgctc

SEQ ID NO: 5151409 - DNA, 18 bp, Homo sapiens
acgaattatttttttaaa

SEQ ID NO: 5151410 - DNA, 16 bp, Homo sapiens
acgaattccatcttgt

SEQ ID NO: 5151411 - DNA, 23 bp, Homo sapiens
acgaatttaaaatgtagttttaa

SEQ ID NO: 5151412 - DNA, 19 bp, Homo sapiens
acgaatttctgtgccctcc

SEQ ID NO: 5151413 - DNA, 19 bp, Homo sapiens
acgaatttggtgtggctgt

SEQ ID NO: 5151414 - DNA, 22 bp, Homo sapiens
acgaatttggtgtggctgtatt

SEQ ID NO: 5151415 - DNA, 13 bp, Homo sapiens
acgacaaaatgaa

SEQ ID NO: 5151416 - DNA, 15 bp, Homo sapiens
acgacaaagaaacat

SEQ ID NO: 5151417 - DNA, 22 bp, Homo sapiens
acgacaaagccaaactctgcca

SEQ ID NO: 5151418 - DNA, 12 bp, Homo sapiens
acgacaaagctg

SEQ ID NO: 5151419 - DNA, 21 bp, Homo sapiens
acgacaaagctgctaaatctc

SEQ ID NO: 5151420 - DNA, 20 bp, Homo sapiens
acgacaacgatgatgcttgt

SEQ ID NO: 5151421 - DNA, 14 bp, Homo sapiens
acgacaaggaaagg

SEQ ID NO: 5151422 - DNA, 21 bp, Homo sapiens
acgacacggtcggggcatctg

SEQ ID NO: 5151423 - DNA, 13 bp, Homo sapiens
acgacactgcagc

SEQ ID NO: 5151424 - DNA, 16 bp, Homo sapiens
acgaccagccccttcc

SEQ ID NO: 5151425 - DNA, 18 bp, Homo sapiens
acgaccagccccttcctg

SEQ ID NO: 5151426 - DNA, 14 bp, Homo sapiens
acgacccctgcctc

SEQ ID NO: 5151427 - DNA, 15 bp, Homo sapiens
acgaccgacgcccct

SEQ ID NO: 5151428 - DNA, 16 bp, Homo sapiens
acgaccggggccagca

SEQ ID NO: 5151429 - DNA, 18 bp, Homo sapiens
acgacctttactgtcgta

SEQ ID NO: 5151430 - DNA, 16 bp, Homo sapiens
acgacgccctctcccc

SEQ ID NO: 5151431 - DNA, 21 bp, Homo sapiens
acgactcttttccaaacacag

SEQ ID NO: 5151432 - DNA, 18 bp, Homo sapiens
acgactgcgggagccaga

SEQ ID NO: 5151433 - DNA, 14 bp, Homo sapiens
acgactgtatattg

SEQ ID NO: 5151434 - DNA, 19 bp, Homo sapiens
acgactgtatattgctaag

SEQ ID NO: 5151435 - DNA, 19 bp, Homo sapiens
acgactgttgtacaagctc

SEQ ID NO: 5151436 - DNA, 14 bp, Homo sapiens
acgacttttgtttg

SEQ ID NO: 5151437 - DNA, 14 bp, Homo sapiens
acgagaagtgcttt

SEQ ID NO: 5151438 - DNA, 22 bp, Homo sapiens
acgagacaacagcacacaggca

SEQ ID NO: 5151439 - DNA, 18 bp, Homo sapiens
acgagacacattgccttc

SEQ ID NO: 5151440 - DNA, 22 bp, Homo sapiens
acgagacaccctaactcttgct

SEQ ID NO: 5151441 - DNA, 23 bp, Homo sapiens
acgagacccatttccttgtgctc

SEQ ID NO: 5151442 - DNA, 17 bp, Homo sapiens
acgagacccccatccag

SEQ ID NO: 5151443 - DNA, 24 bp, Homo sapiens
acgagacccccatccagcctccag

SEQ ID NO: 5151444 - DNA, 20 bp, Homo sapiens
acgagaccctacaggagagg

SEQ ID NO: 5151445 - DNA, 14 bp, Homo sapiens
acgagactttccat

SEQ ID NO: 5151446 - DNA, 20 bp, Homo sapiens
acgagaggggaagagtgtac

SEQ ID NO: 5151447 - DNA, 22 bp, Homo sapiens
acgagagtgcctccccttcttg

SEQ ID NO: 5151448 - DNA, 17 bp, Homo sapiens
acgagataatgtgaact

SEQ ID NO: 5151449 - DNA, 16 bp, Homo sapiens
acgagatcttccttcc

SEQ ID NO: 5151450 - DNA, 20 bp, Homo sapiens
acgagatgggaaggcacagg

SEQ ID NO: 5151451 - DNA, 15 bp, Homo sapiens
acgagatttcttttt

SEQ ID NO: 5151452 - DNA, 23 bp, Homo sapiens
acgagatttcttttttatgtgat

SEQ ID NO: 5151453 - DNA, 13 bp, Homo sapiens
acgagatttgcca

SEQ ID NO: 5151454 - DNA, 19 bp, Homo sapiens
acgagcacctccagcctga

SEQ ID NO: 5151455 - DNA, 16 bp, Homo sapiens
acgagcactggccaga

SEQ ID NO: 5151456 - DNA, 19 bp, Homo sapiens
acgagcactggccagagag

SEQ ID NO: 5151457 - DNA, 22 bp, Homo sapiens
acgagcagagcgcagcccccac

SEQ ID NO: 5151458 - DNA, 14 bp, Homo sapiens
acgagcagcccagg

SEQ ID NO: 5151459 - DNA, 15 bp, Homo sapiens
acgagcagcccaggg

SEQ ID NO: 5151460 - DNA, 18 bp, Homo sapiens
acgagcagcccagggcct

SEQ ID NO: 5151461 - DNA, 12 bp, Homo sapiens
acgagccacaag

SEQ ID NO: 5151462 - DNA, 14 bp, Homo sapiens
acgagccacaagct

SEQ ID NO: 5151463 - DNA, 19 bp, Homo sapiens
acgagccccacagagcagg

SEQ ID NO: 5151464 - DNA, 17 bp, Homo sapiens
acgagcctcctcagggg

SEQ ID NO: 5151465 - DNA, 14 bp, Homo sapiens
acgagcctggaagc

SEQ ID NO: 5151466 - DNA, 20 bp, Homo sapiens
acgagctggaacccacgagg

SEQ ID NO: 5151467 - DNA, 19 bp, Homo sapiens
acgagctgtttactaggga

SEQ ID NO: 5151468 - DNA, 20 bp, Homo sapiens
acgagcttaatcaacagaag

SEQ ID NO: 5151469 - DNA, 12 bp, Homo sapiens
acgaggaagccc

SEQ ID NO: 5151470 - DNA, 15 bp, Homo sapiens
acgaggagcagcagc

SEQ ID NO: 5151471 - DNA, 19 bp, Homo sapiens
acgaggatttccctgaagc

SEQ ID NO: 5151472 - DNA, 18 bp, Homo sapiens
acgaggcaatgactgtga

SEQ ID NO: 5151473 - DNA, 17 bp, Homo sapiens
acgaggcaggggctctg

SEQ ID NO: 5151474 - DNA, 21 bp, Homo sapiens
acgaggccactcagaggcccc

SEQ ID NO: 5151475 - DNA, 21 bp, Homo sapiens
acgaggccctcgggcccagcc

SEQ ID NO: 5151476 - DNA, 16 bp, Homo sapiens
acgaggccttcagaaa

SEQ ID NO: 5151477 - DNA, 17 bp, Homo sapiens
acgaggccttcagaaaa

SEQ ID NO: 5151478 - DNA, 15 bp, Homo sapiens
acgaggcggcaaaga

SEQ ID NO: 5151479 - DNA, 22 bp, Homo sapiens
acgaggctgattcctctcattt

SEQ ID NO: 5151480 - DNA, 17 bp, Homo sapiens
acgaggctgcccccatc

SEQ ID NO: 5151481 - DNA, 20 bp, Homo sapiens
acgaggctgcccccatccag

SEQ ID NO: 5151482 - DNA, 18 bp, Homo sapiens
acgagggaggaacacctg

SEQ ID NO: 5151483 - DNA, 20 bp, Homo sapiens
acgagggatgggatttcatg

SEQ ID NO: 5151484 - DNA, 16 bp, Homo sapiens
acgagggccaggcacc

SEQ ID NO: 5151485 - DNA, 21 bp, Homo sapiens
acgaggggacccatgggggct

SEQ ID NO: 5151486 - DNA, 16 bp, Homo sapiens
acgaggggggccaggg

SEQ ID NO: 5151487 - DNA, 18 bp, Homo sapiens
acgaggggtgtcttgggc

SEQ ID NO: 5151488 - DNA, 21 bp, Homo sapiens
acgaggggtgtcttgggcaga

SEQ ID NO: 5151489 - DNA, 21 bp, Homo sapiens
acgagggtctcccctcctgca

SEQ ID NO: 5151490 - DNA, 14 bp, Homo sapiens
acgaggtatgaggt

SEQ ID NO: 5151491 - DNA, 22 bp, Homo sapiens
acgaggtggtagctctgagccc

SEQ ID NO: 5151492 - DNA, 21 bp, Homo sapiens
acgaggttaaagaagctgcat

SEQ ID NO: 5151493 - DNA, 19 bp, Homo sapiens
acgagtagaggtttaaaga

SEQ ID NO: 5151494 - DNA, 17 bp, Homo sapiens
acgagtcaatcccctca

SEQ ID NO: 5151495 - DNA, 12 bp, Homo sapiens
acgagtcacctg

SEQ ID NO: 5151496 - DNA, 13 bp, Homo sapiens
acgagtcacctgc

SEQ ID NO: 5151497 - DNA, 17 bp, Homo sapiens
acgagtcacctgcaagc

SEQ ID NO: 5151498 - DNA, 16 bp, Homo sapiens
acgagtgttcctgtgc

SEQ ID NO: 5151499 - DNA, 16 bp, Homo sapiens
acgagttcatggggat

SEQ ID NO: 5151500 - DNA, 23 bp, Homo sapiens
acgagttcatggggatctggggg

SEQ ID NO: 5151501 - DNA, 20 bp, Homo sapiens
acgatagcctagctttctaa

SEQ ID NO: 5151502 - DNA, 23 bp, Homo sapiens
acgatatttaattcacctcagcc

SEQ ID NO: 5151503 - DNA, 19 bp, Homo sapiens
acgatatttcgtttggtct

SEQ ID NO: 5151504 - DNA, 14 bp, Homo sapiens
acgatcacaaatga

SEQ ID NO: 5151505 - DNA, 15 bp, Homo sapiens
acgatcacaaatgac

SEQ ID NO: 5151506 - DNA, 16 bp, Homo sapiens
acgatcacaaatgact

SEQ ID NO: 5151507 - DNA, 19 bp, Homo sapiens
acgatcacaaatgacttta

SEQ ID NO: 5151508 - DNA, 22 bp, Homo sapiens
acgatcacctgcatcacagccc

SEQ ID NO: 5151509 - DNA, 16 bp, Homo sapiens
acgatcaggaggaagt

SEQ ID NO: 5151510 - DNA, 17 bp, Homo sapiens
acgatcccctcccccaa

SEQ ID NO: 5151511 - DNA, 22 bp, Homo sapiens
acgatcggtttcatattttaaa

SEQ ID NO: 5151512 - DNA, 12 bp, Homo sapiens
acgatcttcccc

SEQ ID NO: 5151513 - DNA, 13 bp, Homo sapiens
acgatcttccccc

SEQ ID NO: 5151514 - DNA, 21 bp, Homo sapiens
acgatcttgctggcagggcct

SEQ ID NO: 5151515 - DNA, 19 bp, Homo sapiens
acgatgcatttaataaaga

SEQ ID NO: 5151516 - DNA, 15 bp, Homo sapiens
acgatgcctgcaggc

SEQ ID NO: 5151517 - DNA, 22 bp, Homo sapiens
acgatgggatcattatttcatg

SEQ ID NO: 5151518 - DNA, 15 bp, Homo sapiens
acgatgggtgttgct

SEQ ID NO: 5151519 - DNA, 15 bp, Homo sapiens
acgatgtcaaggact

SEQ ID NO: 5151520 - DNA, 20 bp, Homo sapiens
acgatgtgcaatacattttt

SEQ ID NO: 5151521 - DNA, 18 bp, Homo sapiens
acgatgtggccctggcct

SEQ ID NO: 5151522 - DNA, 22 bp, Homo sapiens
acgatgtggccctggcctgctg

SEQ ID NO: 5151523 - DNA, 15 bp, Homo sapiens
acgatgtgtctgtat

SEQ ID NO: 5151524 - DNA, 21 bp, Homo sapiens
acgatgtgttgaccggctgcc

SEQ ID NO: 5151525 - DNA, 17 bp, Homo sapiens
acgatgtttatgttctt

SEQ ID NO: 5151526 - DNA, 17 bp, Homo sapiens
acgattatttatttctg

SEQ ID NO: 5151527 - DNA, 12 bp, Homo sapiens
acgattcacagc

SEQ ID NO: 5151528 - DNA, 19 bp, Homo sapiens
acgattcatttttgaaact

SEQ ID NO: 5151529 - DNA, 13 bp, Homo sapiens
acgattccactga

SEQ ID NO: 5151530 - DNA, 11 bp, Homo sapiens
acgattccagt

SEQ ID NO: 5151531 - DNA, 22 bp, Homo sapiens
acgattcttaccctttcttttg

SEQ ID NO: 5151532 - DNA, 20 bp, Homo sapiens
acgattggtatgatgctgcc

SEQ ID NO: 5151533 - DNA, 18 bp, Homo sapiens
acgatttagaaagaagcc

SEQ ID NO: 5151534 - DNA, 18 bp, Homo sapiens
acgatttagatttaatga

SEQ ID NO: 5151535 - DNA, 23 bp, Homo sapiens
acgatttctccattaaacttcta

SEQ ID NO: 5151536 - DNA, 12 bp, Homo sapiens
acgatttctgtt

SEQ ID NO: 5151537 - DNA, 13 bp, Homo sapiens
acgatttctgttt

SEQ ID NO: 5151538 - DNA, 19 bp, Homo sapiens
acgatttctgtttagataa

SEQ ID NO: 5151539 - DNA, 22 bp, Homo sapiens
acgatttgcaggattcccttct

SEQ ID NO: 5151540 - DNA, 18 bp, Homo sapiens
acgattttaaaatgactt

SEQ ID NO: 5151541 - DNA, 13 bp, Homo sapiens
acgcaaaaatagc

SEQ ID NO: 5151542 - DNA, 21 bp, Homo sapiens
acgcaaaccaacctttctgac

SEQ ID NO: 5151543 - DNA, 15 bp, Homo sapiens
acgcaaacctctcct

SEQ ID NO: 5151544 - DNA, 16 bp, Homo sapiens
acgcaaagagagattt

SEQ ID NO: 5151545 - DNA, 17 bp, Homo sapiens
acgcaaagagagatttt

SEQ ID NO: 5151546 - DNA, 17 bp, Homo sapiens
acgcaaagggctgaaag

SEQ ID NO: 5151547 - DNA, 21 bp, Homo sapiens
acgcaaagggctgaaagccat

SEQ ID NO: 5151548 - DNA, 17 bp, Homo sapiens
acgcaacccttgctgct

SEQ ID NO: 5151549 - DNA, 15 bp, Homo sapiens
acgcaagcctcagcc

SEQ ID NO: 5151550 - DNA, 24 bp, Homo sapiens
acgcaagcctcagccactcccagg

SEQ ID NO: 5151551 - DNA, 14 bp, Homo sapiens
acgcaaggaaggac

SEQ ID NO: 5151552 - DNA, 20 bp, Homo sapiens
acgcaaggctgtgctcttcc

SEQ ID NO: 5151553 - DNA, 22 bp, Homo sapiens
acgcaagggagaagaaatccat

SEQ ID NO: 5151554 - DNA, 18 bp, Homo sapiens
acgcaagggcatcaggca

SEQ ID NO: 5151555 - DNA, 19 bp, Homo sapiens
acgcaattctcgattcttt

SEQ ID NO: 5151556 - DNA, 15 bp, Homo sapiens
acgcaattgtatata

SEQ ID NO: 5151557 - DNA, 21 bp, Homo sapiens
acgcaattgtatatatatgtg

SEQ ID NO: 5151558 - DNA, 22 bp, Homo sapiens
acgcaattgtatatatatgtga

SEQ ID NO: 5151559 - DNA, 23 bp, Homo sapiens
acgcaattgtatatatatgtgaa

SEQ ID NO: 5151560 - DNA, 21 bp, Homo sapiens
acgcaattgtgggatgtcctc

SEQ ID NO: 5151561 - DNA, 14 bp, Homo sapiens
acgcacacacacaa

SEQ ID NO: 5151562 - DNA, 18 bp, Homo sapiens
acgcacacacacacacag

SEQ ID NO: 5151563 - DNA, 19 bp, Homo sapiens
acgcacacacacacacagg

SEQ ID NO: 5151564 - DNA, 20 bp, Homo sapiens
acgcacacacacacacagga

SEQ ID NO: 5151565 - DNA, 17 bp, Homo sapiens
acgcacacatcttacct

SEQ ID NO: 5151566 - DNA, 14 bp, Homo sapiens
acgcacacatggac

SEQ ID NO: 5151567 - DNA, 14 bp, Homo sapiens
acgcacactgtctg

SEQ ID NO: 5151568 - DNA, 11 bp, Homo sapiens
acgcacagcac

SEQ ID NO: 5151569 - DNA, 13 bp, Homo sapiens
acgcacagcactg

SEQ ID NO: 5151570 - DNA, 17 bp, Homo sapiens
acgcacagccaaggact

SEQ ID NO: 5151571 - DNA, 13 bp, Homo sapiens
acgcacaggtgct

SEQ ID NO: 5151572 - DNA, 13 bp, Homo sapiens
acgcacagtgcag

SEQ ID NO: 5151573 - DNA, 15 bp, Homo sapiens
acgcacagtgcagtt

SEQ ID NO: 5151574 - DNA, 18 bp, Homo sapiens
acgcacatagagatatgc

SEQ ID NO: 5151575 - DNA, 21 bp, Homo sapiens
acgcacatagagatatgcaca

SEQ ID NO: 5151576 - DNA, 19 bp, Homo sapiens
acgcacatatacacacaca

SEQ ID NO: 5151577 - DNA, 14 bp, Homo sapiens
acgcaccaatcagc

SEQ ID NO: 5151578 - DNA, 17 bp, Homo sapiens
acgcaccaatcagcact

SEQ ID NO: 5151579 - DNA, 13 bp, Homo sapiens
acgcaccactgct

SEQ ID NO: 5151580 - DNA, 14 bp, Homo sapiens
acgcacccacaccc

SEQ ID NO: 5151581 - DNA, 16 bp, Homo sapiens
acgcaccccgcccctg

SEQ ID NO: 5151582 - DNA, 23 bp, Homo sapiens
acctgagatgctgggagggctga

SEQ ID NO: 5151583 - DNA, 15 bp, Homo sapiens
acctgagatggagct

SEQ ID NO: 5151584 - DNA, 17 bp, Homo sapiens
acctgagatggagctgc

SEQ ID NO: 5151585 - DNA, 16 bp, Homo sapiens
acctgagatgtgtgat

SEQ ID NO: 5151586 - DNA, 17 bp, Homo sapiens
acctgagatttattaaa

SEQ ID NO: 5151587 - DNA, 16 bp, Homo sapiens
acctgagccagcctgc

SEQ ID NO: 5151588 - DNA, 17 bp, Homo sapiens
acctgagccccaaaagg

SEQ ID NO: 5151589 - DNA, 19 bp, Homo sapiens
acctgagcccgcagcccag

SEQ ID NO: 5151590 - DNA, 11 bp, Homo sapiens
acctgagcctg

SEQ ID NO: 5151591 - DNA, 14 bp, Homo sapiens
acctgagcctgccg

SEQ ID NO: 5151592 - DNA, 16 bp, Homo sapiens
acctgagcctgccgag

SEQ ID NO: 5151593 - DNA, 21 bp, Homo sapiens
acctgagcctgccgagcaacc

SEQ ID NO: 5151594 - DNA, 12 bp, Homo sapiens
acctgagcctgg

SEQ ID NO: 5151595 - DNA, 20 bp, Homo sapiens
acctgagcggcaccctggtc

SEQ ID NO: 5151596 - DNA, 19 bp, Homo sapiens
acctgagctagaagctgga

SEQ ID NO: 5151597 - DNA, 17 bp, Homo sapiens
acctgagctattttcct

SEQ ID NO: 5151598 - DNA, 18 bp, Homo sapiens
acctgagctattttcctc

SEQ ID NO: 5151599 - DNA, 14 bp, Homo sapiens
acctgagctggcca

SEQ ID NO: 5151600 - DNA, 14 bp, Homo sapiens
acctgagctttgga

SEQ ID NO: 5151601 - DNA, 17 bp, Homo sapiens
acctgaggaactgtctc

SEQ ID NO: 5151602 - DNA, 14 bp, Homo sapiens
acctgaggataact

SEQ ID NO: 5151603 - DNA, 15 bp, Homo sapiens
acctgaggcagatga

SEQ ID NO: 5151604 - DNA, 16 bp, Homo sapiens
acctgaggcaggaggg

SEQ ID NO: 5151605 - DNA, 19 bp, Homo sapiens
acctgaggcaggagggcat

SEQ ID NO: 5151606 - DNA, 20 bp, Homo sapiens
acctgaggcaggagggcatg

SEQ ID NO: 5151607 - DNA, 13 bp, Homo sapiens
acctgaggccaaa

SEQ ID NO: 5151608 - DNA, 14 bp, Homo sapiens
acctgaggccaaat

SEQ ID NO: 5151609 - DNA, 22 bp, Homo sapiens
acctgaggccctcactgagcct

SEQ ID NO: 5151610 - DNA, 15 bp, Homo sapiens
acctgaggcccttct

SEQ ID NO: 5151611 - DNA, 16 bp, Homo sapiens
acctgaggcccttctc

SEQ ID NO: 5151612 - DNA, 16 bp, Homo sapiens
acctgaggctcctgtg

SEQ ID NO: 5151613 - DNA, 23 bp, Homo sapiens
acctgagggcagaaaggttctgc

SEQ ID NO: 5151614 - DNA, 14 bp, Homo sapiens
acctgaggggcctc

SEQ ID NO: 5151615 - DNA, 16 bp, Homo sapiens
acctgaggggcctctt

SEQ ID NO: 5151616 - DNA, 14 bp, Homo sapiens
acctgagggtctgt

SEQ ID NO: 5151617 - DNA, 18 bp, Homo sapiens
acctgagggtctgtaggt

SEQ ID NO: 5151618 - DNA, 12 bp, Homo sapiens
acctgaggtggg

SEQ ID NO: 5151619 - DNA, 18 bp, Homo sapiens
acctgaggtgggcccagg

SEQ ID NO: 5151620 - DNA, 22 bp, Homo sapiens
acctgaggtgggcccaggacca

SEQ ID NO: 5151621 - DNA, 15 bp, Homo sapiens
acctgaggtgggctg

SEQ ID NO: 5151622 - DNA, 17 bp, Homo sapiens
acctgaggtgggctggg

SEQ ID NO: 5151623 - DNA, 21 bp, Homo sapiens
acctgaggtgggctggggctg

SEQ ID NO: 5151624 - DNA, 20 bp, Homo sapiens
acctgagttcccgggagctg

SEQ ID NO: 5151625 - DNA, 14 bp, Homo sapiens
acctgagttcctga

SEQ ID NO: 5151626 - DNA, 17 bp, Homo sapiens
acctgagttgaagaggg

SEQ ID NO: 5151627 - DNA, 21 bp, Homo sapiens
acctgatacctgcctgggaca

SEQ ID NO: 5151628 - DNA, 16 bp, Homo sapiens
acctgatcaatgacag

SEQ ID NO: 5151629 - DNA, 17 bp, Homo sapiens
acctgatcaatgacaga

SEQ ID NO: 5151630 - DNA, 16 bp, Homo sapiens
acctgatcatggtcag

SEQ ID NO: 5151631 - DNA, 13 bp, Homo sapiens
acctgatcctgga

SEQ ID NO: 5151632 - DNA, 15 bp, Homo sapiens
acctgatctggccca

SEQ ID NO: 5151633 - DNA, 21 bp, Homo sapiens
acctgatctggcccaagctgg

SEQ ID NO: 5151634 - DNA, 13 bp, Homo sapiens
acctgatgaaaat

SEQ ID NO: 5151635 - DNA, 19 bp, Homo sapiens
acctgatgaaaataaagaa

SEQ ID NO: 5151636 - DNA, 15 bp, Homo sapiens
acctgatgacctggg

SEQ ID NO: 5151637 - DNA, 19 bp, Homo sapiens
acctgatgctaattttcag

SEQ ID NO: 5151638 - DNA, 13 bp, Homo sapiens
acctgatgctggg

SEQ ID NO: 5151639 - DNA, 17 bp, Homo sapiens
acctgatggtgaaacca

SEQ ID NO: 5151640 - DNA, 13 bp, Homo sapiens
acctgatgtgtac

SEQ ID NO: 5151641 - DNA, 17 bp, Homo sapiens
acctgattaactgaggc

SEQ ID NO: 5151642 - DNA, 17 bp, Homo sapiens
acctgattgatcacaca

SEQ ID NO: 5151643 - DNA, 20 bp, Homo sapiens
acctgattgatcacacagtg

SEQ ID NO: 5151644 - DNA, 22 bp, Homo sapiens
acctgattgatcacacagtgtt

SEQ ID NO: 5151645 - DNA, 14 bp, Homo sapiens
acctgattggccac

SEQ ID NO: 5151646 - DNA, 21 bp, Homo sapiens
acctgattggccactggatcc

SEQ ID NO: 5151647 - DNA, 16 bp, Homo sapiens
acctgattgtattttt

SEQ ID NO: 5151648 - DNA, 14 bp, Homo sapiens
acctgattgtgtct

SEQ ID NO: 5151649 - DNA, 18 bp, Homo sapiens
acctgatttcagaagaga

SEQ ID NO: 5151650 - DNA, 21 bp, Homo sapiens
acctgatttcagcacaataaa

SEQ ID NO: 5151651 - DNA, 16 bp, Homo sapiens
acctgattttttttcc

SEQ ID NO: 5151652 - DNA, 13 bp, Homo sapiens
acctgcaaaaaat

SEQ ID NO: 5151653 - DNA, 15 bp, Homo sapiens
acctgcaaaaatgag

SEQ ID NO: 5151654 - DNA, 19 bp, Homo sapiens
acctgcaagccccagggcc

SEQ ID NO: 5151655 - DNA, 20 bp, Homo sapiens
acctgcaagccccagggcct

SEQ ID NO: 5151656 - DNA, 22 bp, Homo sapiens
acctgcaagccccagggcctgg

SEQ ID NO: 5151657 - DNA, 13 bp, Homo sapiens
acctgcaagcctt

SEQ ID NO: 5151658 - DNA, 14 bp, Homo sapiens
acctgcaaggcaaa

SEQ ID NO: 5151659 - DNA, 17 bp, Homo sapiens
acctgcaaggcaaagta

SEQ ID NO: 5151660 - DNA, 18 bp, Homo sapiens
acctgcaaggcaaagtaa

SEQ ID NO: 5151661 - DNA, 18 bp, Homo sapiens
acctgcaagggctcccca

SEQ ID NO: 5151662 - DNA, 15 bp, Homo sapiens
acctgcaagtgcccg

SEQ ID NO: 5151663 - DNA, 17 bp, Homo sapiens
acctgcaagttgctctg

SEQ ID NO: 5151664 - DNA, 19 bp, Homo sapiens
acctgcaagttgctctgac

SEQ ID NO: 5151665 - DNA, 20 bp, Homo sapiens
acctgcaagttgctctgacc

SEQ ID NO: 5151666 - DNA, 17 bp, Homo sapiens
acctgcaatcccagcta

SEQ ID NO: 5151667 - DNA, 14 bp, Homo sapiens
acctgcacaaacat

SEQ ID NO: 5151668 - DNA, 15 bp, Homo sapiens
acctgcacaaacata

SEQ ID NO: 5151669 - DNA, 14 bp, Homo sapiens
acctgcacacagga

SEQ ID NO: 5151670 - DNA, 17 bp, Homo sapiens
acctgcacacaggacag

SEQ ID NO: 5151671 - DNA, 18 bp, Homo sapiens
acctgcacacaggacagc

SEQ ID NO: 5151672 - DNA, 20 bp, Homo sapiens
acctgcacacaggacagcgg

SEQ ID NO: 5151673 - DNA, 16 bp, Homo sapiens
acctgcacacccctgc

SEQ ID NO: 5151674 - DNA, 18 bp, Homo sapiens
acctgcacacccctgcac

SEQ ID NO: 5151675 - DNA, 20 bp, Homo sapiens
acctgcacaccgtccctctc

SEQ ID NO: 5151676 - DNA, 22 bp, Homo sapiens
acctgcacactccatctcctgc

SEQ ID NO: 5151677 - DNA, 19 bp, Homo sapiens
acctgcacagggccctctg

SEQ ID NO: 5151678 - DNA, 20 bp, Homo sapiens
acctgcaccgccccttctcc

SEQ ID NO: 5151679 - DNA, 14 bp, Homo sapiens
acctgcacctctgg

SEQ ID NO: 5151680 - DNA, 15 bp, Homo sapiens
acctgcacgttcata

SEQ ID NO: 5151681 - DNA, 20 bp, Homo sapiens
acctgcacgttcataaccaa

SEQ ID NO: 5151682 - DNA, 15 bp, Homo sapiens
acctgcactccatcc

SEQ ID NO: 5151683 - DNA, 20 bp, Homo sapiens
acctgcactgaaacctgaga

SEQ ID NO: 5151684 - DNA, 23 bp, Homo sapiens
acctgcactggggagcccgtctc

SEQ ID NO: 5151685 - DNA, 18 bp, Homo sapiens
acctgcacttcatatcta

SEQ ID NO: 5151686 - DNA, 13 bp, Homo sapiens
acctgcagagaaa

SEQ ID NO: 5151687 - DNA, 17 bp, Homo sapiens
acctgcagattctagga

SEQ ID NO: 5151688 - DNA, 16 bp, Homo sapiens
acctgcagccccaggc

SEQ ID NO: 5151689 - DNA, 17 bp, Homo sapiens
acctgcagcctccctcc

SEQ ID NO: 5151690 - DNA, 15 bp, Homo sapiens
acctgcagcctttgg

SEQ ID NO: 5151691 - DNA, 21 bp, Homo sapiens
acctgcagcgcgcacacgcac

SEQ ID NO: 5151692 - DNA, 22 bp, Homo sapiens
acctgcagcggctgccctctgg

SEQ ID NO: 5151693 - DNA, 22 bp, Homo sapiens
acctgcagcgggcaaagagctc

SEQ ID NO: 5151694 - DNA, 13 bp, Homo sapiens
acctgcagctccc

SEQ ID NO: 5151695 - DNA, 15 bp, Homo sapiens
acctgcagctccctc

SEQ ID NO: 5151696 - DNA, 14 bp, Homo sapiens
acctgcaggaccct

SEQ ID NO: 5151697 - DNA, 18 bp, Homo sapiens
acctgcaggactcgggct

SEQ ID NO: 5151698 - DNA, 12 bp, Homo sapiens
acctgcaggcgt

SEQ ID NO: 5151699 - DNA, 12 bp, Homo sapiens
acctgcaggctc

SEQ ID NO: 5151700 - DNA, 18 bp, Homo sapiens
acctgcaggctccatgca

SEQ ID NO: 5151701 - DNA, 17 bp, Homo sapiens
acctgcaggctgagcca

SEQ ID NO: 5151702 - DNA, 12 bp, Homo sapiens
acctgcaggctt

SEQ ID NO: 5151703 - DNA, 23 bp, Homo sapiens
acctgcaggcttaggtcctcact

SEQ ID NO: 5151704 - DNA, 13 bp, Homo sapiens
acctgcaggttgg

SEQ ID NO: 5151705 - DNA, 21 bp, Homo sapiens
acctgcaggtttgacacgcag

SEQ ID NO: 5151706 - DNA, 14 bp, Homo sapiens
acctgcagtgaggg

SEQ ID NO: 5151707 - DNA, 16 bp, Homo sapiens
acctgcagtgaggggc

SEQ ID NO: 5151708 - DNA, 11 bp, Homo sapiens
acctgcagtgc

SEQ ID NO: 5151709 - DNA, 16 bp, Homo sapiens
acctgcagtgccagct

SEQ ID NO: 5151710 - DNA, 15 bp, Homo sapiens
acctgcagttcctga

SEQ ID NO: 5151711 - DNA, 16 bp, Homo sapiens
acctgcagttcctgag

SEQ ID NO: 5151712 - DNA, 19 bp, Homo sapiens
acctgcagttggcctcagc

SEQ ID NO: 5151713 - DNA, 23 bp, Homo sapiens
acctgcatatctctagtccctgt

SEQ ID NO: 5151714 - DNA, 15 bp, Homo sapiens
acctgcatcacagcc

SEQ ID NO: 5151715 - DNA, 19 bp, Homo sapiens
acctgcatcagcctctggc

SEQ ID NO: 5151716 - DNA, 21 bp, Homo sapiens
acctgcatcagcctctggcca

SEQ ID NO: 5151717 - DNA, 21 bp, Homo sapiens
acctgcatccgtagttccctg

SEQ ID NO: 5151718 - DNA, 17 bp, Homo sapiens
acctgcatcctctcccc

SEQ ID NO: 5151719 - DNA, 23 bp, Homo sapiens
acctgcatcctctcccccacaag

SEQ ID NO: 5151720 - DNA, 16 bp, Homo sapiens
acctgcatccttcctg

SEQ ID NO: 5151721 - DNA, 19 bp, Homo sapiens
acctgcatccttcctgggg

SEQ ID NO: 5151722 - DNA, 18 bp, Homo sapiens
acctgcatctaagcccat

SEQ ID NO: 5151723 - DNA, 15 bp, Homo sapiens
acctgcatgaaagca

SEQ ID NO: 5151724 - DNA, 17 bp, Homo sapiens
acctgcatgaaagcatt

SEQ ID NO: 5151725 - DNA, 14 bp, Homo sapiens
acctgcatgcagca

SEQ ID NO: 5151726 - DNA, 18 bp, Homo sapiens
acctgcatggtcaagcct

SEQ ID NO: 5151727 - DNA, 20 bp, Homo sapiens
acctgcatgtgttgtacaat

SEQ ID NO: 5151728 - DNA, 21 bp, Homo sapiens
acctgcatgtgttgtacaata

SEQ ID NO: 5151729 - DNA, 17 bp, Homo sapiens
acctgcatttaagaaca

SEQ ID NO: 5151730 - DNA, 22 bp, Homo sapiens
acctgcatttaagaacagaaca

SEQ ID NO: 5151731 - DNA, 12 bp, Homo sapiens
acctgccaagga

SEQ ID NO: 5151732 - DNA, 14 bp, Homo sapiens
acctgccaaggagc

SEQ ID NO: 5151733 - DNA, 19 bp, Homo sapiens
acctgccaaggagcatcct

SEQ ID NO: 5151734 - DNA, 23 bp, Homo sapiens
acctgccacaaaccaccaggact

SEQ ID NO: 5151735 - DNA, 15 bp, Homo sapiens
acctgccaccacaca

SEQ ID NO: 5151736 - DNA, 14 bp, Homo sapiens
acctgccaccaggg

SEQ ID NO: 5151737 - DNA, 15 bp, Homo sapiens
acctgccaccaggga

SEQ ID NO: 5151738 - DNA, 16 bp, Homo sapiens
acctgccaccagggag

SEQ ID NO: 5151739 - DNA, 23 bp, Homo sapiens
acctgccacccccttccctggga

SEQ ID NO: 5151740 - DNA, 18 bp, Homo sapiens
acctgccaccgccagagg

SEQ ID NO: 5151741 - DNA, 18 bp, Homo sapiens
acctgccactaggctggg

SEQ ID NO: 5151742 - DNA, 17 bp, Homo sapiens
acctgccactcacacag

SEQ ID NO: 5151743 - DNA, 19 bp, Homo sapiens
acctgccactcacacagcc

SEQ ID NO: 5151744 - DNA, 21 bp, Homo sapiens
acctgccactcacacagccag

SEQ ID NO: 5151745 - DNA, 18 bp, Homo sapiens
acctgccagccactgtca

SEQ ID NO: 5151746 - DNA, 16 bp, Homo sapiens
acctgccagcctggct

SEQ ID NO: 5151747 - DNA, 18 bp, Homo sapiens
acctgccagcctggcttc

SEQ ID NO: 5151748 - DNA, 24 bp, Homo sapiens
acctgccaggcctccctcgggctg

SEQ ID NO: 5151749 - DNA, 15 bp, Homo sapiens
acctgccaggctgca

SEQ ID NO: 5151750 - DNA, 17 bp, Homo sapiens
acctgccaggctgcagg

SEQ ID NO: 5151751 - DNA, 11 bp, Homo sapiens
acctgccaggg

SEQ ID NO: 5151752 - DNA, 13 bp, Homo sapiens
acctgccagggac

SEQ ID NO: 5151753 - DNA, 15 bp, Homo sapiens
acctgccagggacag

SEQ ID NO: 5151754 - DNA, 18 bp, Homo sapiens
acctgccagggacagagg

SEQ ID NO: 5151755 - DNA, 13 bp, Homo sapiens
acctgccagggcc

SEQ ID NO: 5151756 - DNA, 18 bp, Homo sapiens
acctgccatttgcaccct

SEQ ID NO: 5151757 - DNA, 19 bp, Homo sapiens
acctgccatttgcaccctc

SEQ ID NO: 5151758 - DNA, 23 bp, Homo sapiens
acctgcccacaactcccttgcac

SEQ ID NO: 5151759 - DNA, 20 bp, Homo sapiens
acctgcccagatcccagaag

SEQ ID NO: 5151760 - DNA, 19 bp, Homo sapiens
acctgcccagttagcccgg

SEQ ID NO: 5151761 - DNA, 22 bp, Homo sapiens
acctgcccagttagcccggcca

SEQ ID NO: 5151762 - DNA, 16 bp, Homo sapiens
acgcaccgcctgaagg

SEQ ID NO: 5151763 - DNA, 17 bp, Homo sapiens
acgcacctgcctcagga

SEQ ID NO: 5151764 - DNA, 17 bp, Homo sapiens
acgcacctgtagtccca

SEQ ID NO: 5151765 - DNA, 17 bp, Homo sapiens
acgcacgacgtcagcct

SEQ ID NO: 5151766 - DNA, 15 bp, Homo sapiens
acgcacgcacccaca

SEQ ID NO: 5151767 - DNA, 17 bp, Homo sapiens
acgcacgcacccacacc

SEQ ID NO: 5151768 - DNA, 16 bp, Homo sapiens
acgcacgctcgctgcc

SEQ ID NO: 5151769 - DNA, 15 bp, Homo sapiens
acgcacggcagccac

SEQ ID NO: 5151770 - DNA, 17 bp, Homo sapiens
acgcactccatgagcac

SEQ ID NO: 5151771 - DNA, 21 bp, Homo sapiens
acgcactccatgagcacccca

SEQ ID NO: 5151772 - DNA, 13 bp, Homo sapiens
acgcactggacag

SEQ ID NO: 5151773 - DNA, 17 bp, Homo sapiens
acgcactggacagcatc

SEQ ID NO: 5151774 - DNA, 22 bp, Homo sapiens
acgcactggacagcatcagaaa

SEQ ID NO: 5151775 - DNA, 17 bp, Homo sapiens
acgcactgggccacgga

SEQ ID NO: 5151776 - DNA, 14 bp, Homo sapiens
acgcacttctgggg

SEQ ID NO: 5151777 - DNA, 21 bp, Homo sapiens
acgcacttctggggccagccc

SEQ ID NO: 5151778 - DNA, 15 bp, Homo sapiens
acgcacttgcctgtt

SEQ ID NO: 5151779 - DNA, 16 bp, Homo sapiens
acgcacttgcctgttg

SEQ ID NO: 5151780 - DNA, 19 bp, Homo sapiens
acgcactttgcaggatgac

SEQ ID NO: 5151781 - DNA, 15 bp, Homo sapiens
acgcagaactaccag

SEQ ID NO: 5151782 - DNA, 20 bp, Homo sapiens
acgcagaagagaaagtacaa

SEQ ID NO: 5151783 - DNA, 11 bp, Homo sapiens
acgcagacctg

SEQ ID NO: 5151784 - DNA, 16 bp, Homo sapiens
acgcagagattttcat

SEQ ID NO: 5151785 - DNA, 15 bp, Homo sapiens
acgcagagccccgga

SEQ ID NO: 5151786 - DNA, 18 bp, Homo sapiens
acgcagagccccggagca

SEQ ID NO: 5151787 - DNA, 21 bp, Homo sapiens
acgcagagccccggagcacca

SEQ ID NO: 5151788 - DNA, 15 bp, Homo sapiens
acgcagaggaatttt

SEQ ID NO: 5151789 - DNA, 16 bp, Homo sapiens
acgcagaggacgcacg

SEQ ID NO: 5151790 - DNA, 22 bp, Homo sapiens
acgcagaggcggaaaccttgca

SEQ ID NO: 5151791 - DNA, 12 bp, Homo sapiens
acgcagatgagt

SEQ ID NO: 5151792 - DNA, 19 bp, Homo sapiens
acgcagatgatccatgagt

SEQ ID NO: 5151793 - DNA, 13 bp, Homo sapiens
acgcagattgggc

SEQ ID NO: 5151794 - DNA, 23 bp, Homo sapiens
acgcagcagctgggacccctccc

SEQ ID NO: 5151795 - DNA, 13 bp, Homo sapiens
acgcagccaggac

SEQ ID NO: 5151796 - DNA, 21 bp, Homo sapiens
acgcagcccagagcagaccct

SEQ ID NO: 5151797 - DNA, 12 bp, Homo sapiens
acgcagccctgc

SEQ ID NO: 5151798 - DNA, 23 bp, Homo sapiens
acgcagccctgctttgggctgcc

SEQ ID NO: 5151799 - DNA, 20 bp, Homo sapiens
acgcagccctgggggccagc

SEQ ID NO: 5151800 - DNA, 23 bp, Homo sapiens
acgcagccctgggggccagctgg

SEQ ID NO: 5151801 - DNA, 19 bp, Homo sapiens
acgcagccgccgccgccca

SEQ ID NO: 5151802 - DNA, 23 bp, Homo sapiens
acgcagccggagggaggcactag

SEQ ID NO: 5151803 - DNA, 11 bp, Homo sapiens
acgcagcctcc

SEQ ID NO: 5151804 - DNA, 11 bp, Homo sapiens
acgcagcctga

SEQ ID NO: 5151805 - DNA, 14 bp, Homo sapiens
acgcagcctgctct

SEQ ID NO: 5151806 - DNA, 17 bp, Homo sapiens
acgcaggaactcccagc

SEQ ID NO: 5151807 - DNA, 15 bp, Homo sapiens
acgcaggaagcctac

SEQ ID NO: 5151808 - DNA, 22 bp, Homo sapiens
acgcaggagaatcactgcagcc

SEQ ID NO: 5151809 - DNA, 23 bp, Homo sapiens
acgcaggagaatcactgcagccc

SEQ ID NO: 5151810 - DNA, 11 bp, Homo sapiens
acgcaggagag

SEQ ID NO: 5151811 - DNA, 14 bp, Homo sapiens
acgcaggagagaga

SEQ ID NO: 5151812 - DNA, 21 bp, Homo sapiens
acgcaggagagagagagagaa

SEQ ID NO: 5151813 - DNA, 14 bp, Homo sapiens
acgcaggaggagaa

SEQ ID NO: 5151814 - DNA, 23 bp, Homo sapiens
acgcaggccacccgggctgcctg

SEQ ID NO: 5151815 - DNA, 11 bp, Homo sapiens
acgcaggcccc

SEQ ID NO: 5151816 - DNA, 22 bp, Homo sapiens
acgcaggcccccaggtgccagt

SEQ ID NO: 5151817 - DNA, 14 bp, Homo sapiens
acgcaggcggccag

SEQ ID NO: 5151818 - DNA, 15 bp, Homo sapiens
acgcaggctgagtgc

SEQ ID NO: 5151819 - DNA, 18 bp, Homo sapiens
acgcaggggctctgagcc

SEQ ID NO: 5151820 - DNA, 19 bp, Homo sapiens
acgcaggggctctgagccc

SEQ ID NO: 5151821 - DNA, 17 bp, Homo sapiens
acgcaggggttgcagtg

SEQ ID NO: 5151822 - DNA, 14 bp, Homo sapiens
acgcaggtgctgcg

SEQ ID NO: 5151823 - DNA, 14 bp, Homo sapiens
acgcagtggccttc

SEQ ID NO: 5151824 - DNA, 20 bp, Homo sapiens
acgcagttgctcgcttttcc

SEQ ID NO: 5151825 - DNA, 20 bp, Homo sapiens
acgcagttgtgtggcccagc

SEQ ID NO: 5151826 - DNA, 22 bp, Homo sapiens
acgcatagactgaggtataaag

SEQ ID NO: 5151827 - DNA, 16 bp, Homo sapiens
acgcataggaaaagaa

SEQ ID NO: 5151828 - DNA, 14 bp, Homo sapiens
acgcatccagcaag

SEQ ID NO: 5151829 - DNA, 22 bp, Homo sapiens
acgcatctagttcccctgttta

SEQ ID NO: 5151830 - DNA, 18 bp, Homo sapiens
acgcatgaagaacagtgc

SEQ ID NO: 5151831 - DNA, 18 bp, Homo sapiens
acgcatgatggagctgat

SEQ ID NO: 5151832 - DNA, 14 bp, Homo sapiens
acgcatgcctcagc

SEQ ID NO: 5151833 - DNA, 15 bp, Homo sapiens
acgcatgcctcagcc

SEQ ID NO: 5151834 - DNA, 22 bp, Homo sapiens
acgcatgcctcagccagccctg

SEQ ID NO: 5151835 - DNA, 21 bp, Homo sapiens
acgcatgggcattgcagcctt

SEQ ID NO: 5151836 - DNA, 15 bp, Homo sapiens
acgcatgtccctcca

SEQ ID NO: 5151837 - DNA, 16 bp, Homo sapiens
acgcattaagaggttt

SEQ ID NO: 5151838 - DNA, 16 bp, Homo sapiens
acgcattaagggcctg

SEQ ID NO: 5151839 - DNA, 18 bp, Homo sapiens
acgcattaagggcctgct

SEQ ID NO: 5151840 - DNA, 22 bp, Homo sapiens
acgcattaagggcctgctggag

SEQ ID NO: 5151841 - DNA, 13 bp, Homo sapiens
acgcattttgggt

SEQ ID NO: 5151842 - DNA, 21 bp, Homo sapiens
acgcattttgggttgtttaaa

SEQ ID NO: 5151843 - DNA, 22 bp, Homo sapiens
acgcattttggtttttcctcat

SEQ ID NO: 5151844 - DNA, 17 bp, Homo sapiens
acgccaaagtgcagccc

SEQ ID NO: 5151845 - DNA, 19 bp, Homo sapiens
acgccaaagtgcagccctt

SEQ ID NO: 5151846 - DNA, 13 bp, Homo sapiens
acgccaaccccag

SEQ ID NO: 5151847 - DNA, 16 bp, Homo sapiens
acgccaacttctccca

SEQ ID NO: 5151848 - DNA, 18 bp, Homo sapiens
acgccaacttctcccacc

SEQ ID NO: 5151849 - DNA, 12 bp, Homo sapiens
acgccacagccc

SEQ ID NO: 5151850 - DNA, 14 bp, Homo sapiens
acgccacagcccag

SEQ ID NO: 5151851 - DNA, 20 bp, Homo sapiens
acgccacagcccagccacgg

SEQ ID NO: 5151852 - DNA, 18 bp, Homo sapiens
acgccaccacacctggct

SEQ ID NO: 5151853 - DNA, 18 bp, Homo sapiens
acgccacccccgccccca

SEQ ID NO: 5151854 - DNA, 16 bp, Homo sapiens
acgccactcatttcat

SEQ ID NO: 5151855 - DNA, 17 bp, Homo sapiens
acgccactccacaaatg

SEQ ID NO: 5151856 - DNA, 23 bp, Homo sapiens
acgccactgcactccagcctggg

SEQ ID NO: 5151857 - DNA, 22 bp, Homo sapiens
acgccagacttcccacggctcc

SEQ ID NO: 5151858 - DNA, 15 bp, Homo sapiens
acgccagataaaatg

SEQ ID NO: 5151859 - DNA, 17 bp, Homo sapiens
acgccagattctttcct

SEQ ID NO: 5151860 - DNA, 15 bp, Homo sapiens
acgccagctcctctc

SEQ ID NO: 5151861 - DNA, 15 bp, Homo sapiens
acgccagctggccca

SEQ ID NO: 5151862 - DNA, 13 bp, Homo sapiens
acgccaggccagc

SEQ ID NO: 5151863 - DNA, 11 bp, Homo sapiens
acgccagggac

SEQ ID NO: 5151864 - DNA, 15 bp, Homo sapiens
acgccagtctcccag

SEQ ID NO: 5151865 - DNA, 22 bp, Homo sapiens
acgccagtctcccaggccccct

SEQ ID NO: 5151866 - DNA, 18 bp, Homo sapiens
acgccagtttcaccattt

SEQ ID NO: 5151867 - DNA, 16 bp, Homo sapiens
acgccatcccagcccc

SEQ ID NO: 5151868 - DNA, 16 bp, Homo sapiens
acgccattctcctgcc

SEQ ID NO: 5151869 - DNA, 17 bp, Homo sapiens
acgccattctcctgcct

SEQ ID NO: 5151870 - DNA, 22 bp, Homo sapiens
acgccattctcctgcctcagcc

SEQ ID NO: 5151871 - DNA, 18 bp, Homo sapiens
acgccattgtactccagc

SEQ ID NO: 5151872 - DNA, 23 bp, Homo sapiens
acgccattgtactccagcctggg

SEQ ID NO: 5151873 - DNA, 16 bp, Homo sapiens
acgcccaacccttccc

SEQ ID NO: 5151874 - DNA, 17 bp, Homo sapiens
acgcccaccagccttgc

SEQ ID NO: 5151875 - DNA, 16 bp, Homo sapiens
acgcccacccccagtc

SEQ ID NO: 5151876 - DNA, 18 bp, Homo sapiens
acgcccacttccctgggt

SEQ ID NO: 5151877 - DNA, 14 bp, Homo sapiens
acgcccaggacagc

SEQ ID NO: 5151878 - DNA, 17 bp, Homo sapiens
acgcccaggacagctgg

SEQ ID NO: 5151879 - DNA, 22 bp, Homo sapiens
acgcccaggatgaaggggccag

SEQ ID NO: 5151880 - DNA, 21 bp, Homo sapiens
acgccccagataccagcccct

SEQ ID NO: 5151881 - DNA, 13 bp, Homo sapiens
acgccccagcccg

SEQ ID NO: 5151882 - DNA, 14 bp, Homo sapiens
acgcccccactggt

SEQ ID NO: 5151883 - DNA, 22 bp, Homo sapiens
acgccccgaacctcacctgacc

SEQ ID NO: 5151884 - DNA, 16 bp, Homo sapiens
acgccccgctgtgtcc

SEQ ID NO: 5151885 - DNA, 19 bp, Homo sapiens
acgccccgggcaaagggtc

SEQ ID NO: 5151886 - DNA, 20 bp, Homo sapiens
acgccccgggcaaagggtct

SEQ ID NO: 5151887 - DNA, 21 bp, Homo sapiens
acgccccggggcgcctagagc

SEQ ID NO: 5151888 - DNA, 18 bp, Homo sapiens
acgccccggtcccccaga

SEQ ID NO: 5151889 - DNA, 21 bp, Homo sapiens
acgcccctccaaacctccagc

SEQ ID NO: 5151890 - DNA, 22 bp, Homo sapiens
acgcccctccaaacctccagcc

SEQ ID NO: 5151891 - DNA, 16 bp, Homo sapiens
acgcccctcccaagcg

SEQ ID NO: 5151892 - DNA, 21 bp, Homo sapiens
acgcccctccccagcccccac

SEQ ID NO: 5151893 - DNA, 17 bp, Homo sapiens
acgcccctgtggccaac

SEQ ID NO: 5151894 - DNA, 17 bp, Homo sapiens
acgcccctttctcttgc

SEQ ID NO: 5151895 - DNA, 16 bp, Homo sapiens
acgcccgtcctgcctg

SEQ ID NO: 5151896 - DNA, 19 bp, Homo sapiens
acgcccgtcctgcctgtgg

SEQ ID NO: 5151897 - DNA, 20 bp, Homo sapiens
acgcccgtcctgcctgtggc

SEQ ID NO: 5151898 - DNA, 17 bp, Homo sapiens
acgccctactccactgc

SEQ ID NO: 5151899 - DNA, 13 bp, Homo sapiens
acgccctatttct

SEQ ID NO: 5151900 - DNA, 12 bp, Homo sapiens
acgccctcccct

SEQ ID NO: 5151901 - DNA, 13 bp, Homo sapiens
acgccctcccctc

SEQ ID NO: 5151902 - DNA, 14 bp, Homo sapiens
acgccctcccctcc

SEQ ID NO: 5151903 - DNA, 15 bp, Homo sapiens
acgccctcccctccc

SEQ ID NO: 5151904 - DNA, 22 bp, Homo sapiens
acgccctcccctcccctgctgc

SEQ ID NO: 5151905 - DNA, 15 bp, Homo sapiens
acgccctctcctccc

SEQ ID NO: 5151906 - DNA, 23 bp, Homo sapiens
acgccctgggcctgcacctctcc

SEQ ID NO: 5151907 - DNA, 16 bp, Homo sapiens
acgcccttggagcctt

SEQ ID NO: 5151908 - DNA, 20 bp, Homo sapiens
acgcccttggagccttccac

SEQ ID NO: 5151909 - DNA, 17 bp, Homo sapiens
acgccgatataagccat

SEQ ID NO: 5151910 - DNA, 22 bp, Homo sapiens
acgccgatataagccatagccc

SEQ ID NO: 5151911 - DNA, 23 bp, Homo sapiens
acgccgatataagccatagcccc

SEQ ID NO: 5151912 - DNA, 23 bp, Homo sapiens
acgccgccctccatccgtgctgc

SEQ ID NO: 5151913 - DNA, 16 bp, Homo sapiens
acgccgccttggcctt

SEQ ID NO: 5151914 - DNA, 16 bp, Homo sapiens
acgccggcctctgctg

SEQ ID NO: 5151915 - DNA, 20 bp, Homo sapiens
acgccgggagaagccacctt

SEQ ID NO: 5151916 - DNA, 21 bp, Homo sapiens
acgccggggacagaggcctgc

SEQ ID NO: 5151917 - DNA, 15 bp, Homo sapiens
acgccggggctggcc

SEQ ID NO: 5151918 - DNA, 17 bp, Homo sapiens
acgccggggctggccct

SEQ ID NO: 5151919 - DNA, 18 bp, Homo sapiens
acgccggggctggccctg

SEQ ID NO: 5151920 - DNA, 20 bp, Homo sapiens
acgccggggctggccctgcc

SEQ ID NO: 5151921 - DNA, 21 bp, Homo sapiens
acgccggggctggccctgccc

SEQ ID NO: 5151922 - DNA, 23 bp, Homo sapiens
acgccgtaattctttctgtctcc

SEQ ID NO: 5151923 - DNA, 15 bp, Homo sapiens
acgccgtctgtcctc

SEQ ID NO: 5151924 - DNA, 15 bp, Homo sapiens
acgcctactggggca

SEQ ID NO: 5151925 - DNA, 18 bp, Homo sapiens
acgcctataatcccagca

SEQ ID NO: 5151926 - DNA, 16 bp, Homo sapiens
acgcctatgatcccag

SEQ ID NO: 5151927 - DNA, 14 bp, Homo sapiens
acgcctatgccctg

SEQ ID NO: 5151928 - DNA, 22 bp, Homo sapiens
acgcctcactgaaacatggctg

SEQ ID NO: 5151929 - DNA, 12 bp, Homo sapiens
acgcctcctggc

SEQ ID NO: 5151930 - DNA, 13 bp, Homo sapiens
acgcctcctggcc

SEQ ID NO: 5151931 - DNA, 16 bp, Homo sapiens
acgcctctccccacct

SEQ ID NO: 5151932 - DNA, 19 bp, Homo sapiens
acgcctctccccaccttct

SEQ ID NO: 5151933 - DNA, 23 bp, Homo sapiens
acgcctcttctgtccctgttaga

SEQ ID NO: 5151934 - DNA, 21 bp, Homo sapiens
acgcctcttttccctctctag

SEQ ID NO: 5151935 - DNA, 14 bp, Homo sapiens
acgcctgagacagc

SEQ ID NO: 5151936 - DNA, 17 bp, Homo sapiens
acgcctgagcccaggga

SEQ ID NO: 5151937 - DNA, 18 bp, Homo sapiens
acgcctgagcccagggag

SEQ ID NO: 5151938 - DNA, 23 bp, Homo sapiens
acgcctgcaaacgctgcctgccc

SEQ ID NO: 5151939 - DNA, 22 bp, Homo sapiens
acgcctgcaggctggagactgg

SEQ ID NO: 5151940 - DNA, 14 bp, Homo sapiens
acctgccccaagtg

SEQ ID NO: 5151941 - DNA, 17 bp, Homo sapiens
acctgccccacttgtcc

SEQ ID NO: 5151942 - DNA, 22 bp, Homo sapiens
acctgccccacttgtccttagc

SEQ ID NO: 5151943 - DNA, 15 bp, Homo sapiens
acctgccccagcgcg

SEQ ID NO: 5151944 - DNA, 20 bp, Homo sapiens
acctgccccagcgcggcttg

SEQ ID NO: 5151945 - DNA, 13 bp, Homo sapiens
acctgccccaggc

SEQ ID NO: 5151946 - DNA, 16 bp, Homo sapiens
acctgccccaggctca

SEQ ID NO: 5151947 - DNA, 13 bp, Homo sapiens
acctgcccccaca

SEQ ID NO: 5151948 - DNA, 19 bp, Homo sapiens
acctgcccccacagctcct

SEQ ID NO: 5151949 - DNA, 17 bp, Homo sapiens
acctgcccccactcagc

SEQ ID NO: 5151950 - DNA, 15 bp, Homo sapiens
acctgcccccgctct

SEQ ID NO: 5151951 - DNA, 17 bp, Homo sapiens
acctgcccccttctccc

SEQ ID NO: 5151952 - DNA, 23 bp, Homo sapiens
acctgcccccttctcccacactg

SEQ ID NO: 5151953 - DNA, 16 bp, Homo sapiens
acctgccccgcccagc

SEQ ID NO: 5151954 - DNA, 18 bp, Homo sapiens
acctgccccgtagagaat

SEQ ID NO: 5151955 - DNA, 21 bp, Homo sapiens
acctgccccgtagagaatgtg

SEQ ID NO: 5151956 - DNA, 20 bp, Homo sapiens
acctgcccctcaactctcct

SEQ ID NO: 5151957 - DNA, 15 bp, Homo sapiens
acctgcccctccctc

SEQ ID NO: 5151958 - DNA, 14 bp, Homo sapiens
acctgcccctcctc

SEQ ID NO: 5151959 - DNA, 20 bp, Homo sapiens
acctgcccctctgttctctc

SEQ ID NO: 5151960 - DNA, 16 bp, Homo sapiens
acctgcccggcccagg

SEQ ID NO: 5151961 - DNA, 19 bp, Homo sapiens
acctgcccggcccaggagc

SEQ ID NO: 5151962 - DNA, 16 bp, Homo sapiens
acctgccctacatatc

SEQ ID NO: 5151963 - DNA, 14 bp, Homo sapiens
acctgccctcaagg

SEQ ID NO: 5151964 - DNA, 12 bp, Homo sapiens
acctgccctctc

SEQ ID NO: 5151965 - DNA, 13 bp, Homo sapiens
acctgccctgccc

SEQ ID NO: 5151966 - DNA, 17 bp, Homo sapiens
acctgccctgcccccac

SEQ ID NO: 5151967 - DNA, 16 bp, Homo sapiens
acctgccctgccctgc

SEQ ID NO: 5151968 - DNA, 20 bp, Homo sapiens
acctgccctgccctgccacc

SEQ ID NO: 5151969 - DNA, 13 bp, Homo sapiens
acctgccctgcct

SEQ ID NO: 5151970 - DNA, 14 bp, Homo sapiens
acctgccctgcctg

SEQ ID NO: 5151971 - DNA, 15 bp, Homo sapiens
acctgccctgcctga

SEQ ID NO: 5151972 - DNA, 19 bp, Homo sapiens
acctgccctgcctgagggc

SEQ ID NO: 5151973 - DNA, 20 bp, Homo sapiens
acctgccctgcctgagggcc

SEQ ID NO: 5151974 - DNA, 20 bp, Homo sapiens
acctgccctgctgagtccca

SEQ ID NO: 5151975 - DNA, 12 bp, Homo sapiens
acctgccctgga

SEQ ID NO: 5151976 - DNA, 13 bp, Homo sapiens
acctgccctggaa

SEQ ID NO: 5151977 - DNA, 23 bp, Homo sapiens
acctgccctgggcatgcccagcc

SEQ ID NO: 5151978 - DNA, 21 bp, Homo sapiens
acctgcccttttttctgcctc

SEQ ID NO: 5151979 - DNA, 17 bp, Homo sapiens
acctgccgacctcgtcc

SEQ ID NO: 5151980 - DNA, 17 bp, Homo sapiens
acctgccgcatgctccc

SEQ ID NO: 5151981 - DNA, 19 bp, Homo sapiens
acctgccgcatgctccctc

SEQ ID NO: 5151982 - DNA, 12 bp, Homo sapiens
acctgccgctgc

SEQ ID NO: 5151983 - DNA, 19 bp, Homo sapiens
acctgccggctctgggctg

SEQ ID NO: 5151984 - DNA, 19 bp, Homo sapiens
acctgcctagctcttgggc

SEQ ID NO: 5151985 - DNA, 17 bp, Homo sapiens
acctgcctatccatcct

SEQ ID NO: 5151986 - DNA, 17 bp, Homo sapiens
acctgcctcacagctgg

SEQ ID NO: 5151987 - DNA, 21 bp, Homo sapiens
acctgcctcccttcatgcatg

SEQ ID NO: 5151988 - DNA, 22 bp, Homo sapiens
acctgcctcccttcatgcatgg

SEQ ID NO: 5151989 - DNA, 23 bp, Homo sapiens
acctgcctcccttcatgcatgga

SEQ ID NO: 5151990 - DNA, 20 bp, Homo sapiens
acctgcctccggcctgcact

SEQ ID NO: 5151991 - DNA, 22 bp, Homo sapiens
acctgcctccggcctgcactcc

SEQ ID NO: 5151992 - DNA, 13 bp, Homo sapiens
acctgcctcctcg

SEQ ID NO: 5151993 - DNA, 14 bp, Homo sapiens
acctgcctctgacc

SEQ ID NO: 5151994 - DNA, 22 bp, Homo sapiens
acctgcctgaccatcccatgag

SEQ ID NO: 5151995 - DNA, 20 bp, Homo sapiens
acctgcctgccccacacgga

SEQ ID NO: 5151996 - DNA, 17 bp, Homo sapiens
acctgcctgcgtcttcc

SEQ ID NO: 5151997 - DNA, 20 bp, Homo sapiens
acctgcctgcgtcttccgcc

SEQ ID NO: 5151998 - DNA, 10 bp, Homo sapiens
acctgcctgg

SEQ ID NO: 5151999 - DNA, 13 bp, Homo sapiens
acctgcctggccg

SEQ ID NO: 5152000 - DNA, 15 bp, Homo sapiens
acctgcctgtgtgct

SEQ ID NO: 5152001 - DNA, 20 bp, Homo sapiens
acctgcctgtgtgctccgga

SEQ ID NO: 5152002 - DNA, 18 bp, Homo sapiens
acctgcctgttctccaga

SEQ ID NO: 5152003 - DNA, 19 bp, Homo sapiens
acctgcctgttctccagat

SEQ ID NO: 5152004 - DNA, 22 bp, Homo sapiens
acctgccttggcctcccaaagt

SEQ ID NO: 5152005 - DNA, 16 bp, Homo sapiens
acctgcctttgtatgt

SEQ ID NO: 5152006 - DNA, 17 bp, Homo sapiens
acctgcctttgtatgtg

SEQ ID NO: 5152007 - DNA, 23 bp, Homo sapiens
acctgcgacagcttgtgattcct

SEQ ID NO: 5152008 - DNA, 16 bp, Homo sapiens
acctgcgcacaggtgg

SEQ ID NO: 5152009 - DNA, 13 bp, Homo sapiens
acctgcgcttcac

SEQ ID NO: 5152010 - DNA, 20 bp, Homo sapiens
acctgcgcttctgctggagg

SEQ ID NO: 5152011 - DNA, 22 bp, Homo sapiens
acctgcgcttctgctggaggag

SEQ ID NO: 5152012 - DNA, 16 bp, Homo sapiens
acctgcggaaggaggt

SEQ ID NO: 5152013 - DNA, 16 bp, Homo sapiens
acctgcggctgctgtg

SEQ ID NO: 5152014 - DNA, 15 bp, Homo sapiens
acctgcgggtcctca

SEQ ID NO: 5152015 - DNA, 19 bp, Homo sapiens
acctgcgggtcctcagctg

SEQ ID NO: 5152016 - DNA, 16 bp, Homo sapiens
acctgcggtgctatct

SEQ ID NO: 5152017 - DNA, 19 bp, Homo sapiens
acctgcggtgctatctccc

SEQ ID NO: 5152018 - DNA, 22 bp, Homo sapiens
acctgcggtgctatctccccca

SEQ ID NO: 5152019 - DNA, 18 bp, Homo sapiens
acctgcgtggtccattcc

SEQ ID NO: 5152020 - DNA, 22 bp, Homo sapiens
acctgctaggccagagcccact

SEQ ID NO: 5152021 - DNA, 19 bp, Homo sapiens
acctgctagtcgcccctca

SEQ ID NO: 5152022 - DNA, 21 bp, Homo sapiens
acctgctagtcgcccctcaga

SEQ ID NO: 5152023 - DNA, 21 bp, Homo sapiens
acctgctcacagggatgctgg

SEQ ID NO: 5152024 - DNA, 12 bp, Homo sapiens
acctgctcaggc

SEQ ID NO: 5152025 - DNA, 13 bp, Homo sapiens
acctgctccagaa

SEQ ID NO: 5152026 - DNA, 14 bp, Homo sapiens
acctgctccagatc

SEQ ID NO: 5152027 - DNA, 16 bp, Homo sapiens
acctgctccagatcct

SEQ ID NO: 5152028 - DNA, 15 bp, Homo sapiens
acctgctcccaggcc

SEQ ID NO: 5152029 - DNA, 18 bp, Homo sapiens
acctgctcccagtcctgc

SEQ ID NO: 5152030 - DNA, 21 bp, Homo sapiens
acctgctcccagtcctgcctg

SEQ ID NO: 5152031 - DNA, 17 bp, Homo sapiens
acctgctcccttcgctc

SEQ ID NO: 5152032 - DNA, 22 bp, Homo sapiens
acctgctcccttcgctctgctg

SEQ ID NO: 5152033 - DNA, 19 bp, Homo sapiens
acctgctccgccaggaaag

SEQ ID NO: 5152034 - DNA, 20 bp, Homo sapiens
acctgctcctgcccacgtgc

SEQ ID NO: 5152035 - DNA, 15 bp, Homo sapiens
acctgctctcctctt

SEQ ID NO: 5152036 - DNA, 16 bp, Homo sapiens
acctgctctcctcttc

SEQ ID NO: 5152037 - DNA, 18 bp, Homo sapiens
acctgctctcctcttgcc

SEQ ID NO: 5152038 - DNA, 19 bp, Homo sapiens
acctgctctcctcttgcca

SEQ ID NO: 5152039 - DNA, 14 bp, Homo sapiens
acctgctctgctga

SEQ ID NO: 5152040 - DNA, 14 bp, Homo sapiens
acctgctctggaca

SEQ ID NO: 5152041 - DNA, 16 bp, Homo sapiens
acctgctgacctgtgc

SEQ ID NO: 5152042 - DNA, 16 bp, Homo sapiens
acctgctgagagaccc

SEQ ID NO: 5152043 - DNA, 12 bp, Homo sapiens
acctgctgagct

SEQ ID NO: 5152044 - DNA, 16 bp, Homo sapiens
acctgctgagctctga

SEQ ID NO: 5152045 - DNA, 23 bp, Homo sapiens
acctgctgagctctgagaggccc

SEQ ID NO: 5152046 - DNA, 19 bp, Homo sapiens
acctgctgagggaccagcc

SEQ ID NO: 5152047 - DNA, 13 bp, Homo sapiens
acctgctgatgtg

SEQ ID NO: 5152048 - DNA, 16 bp, Homo sapiens
acctgctgccccagct

SEQ ID NO: 5152049 - DNA, 15 bp, Homo sapiens
acctgctgcggggga

SEQ ID NO: 5152050 - DNA, 23 bp, Homo sapiens
acctgctgcgggggagccagttc

SEQ ID NO: 5152051 - DNA, 16 bp, Homo sapiens
acctgctgcgtcccca

SEQ ID NO: 5152052 - DNA, 17 bp, Homo sapiens
acctgctgcgtccccac

SEQ ID NO: 5152053 - DNA, 21 bp, Homo sapiens
acctgctgcgtccccactccc

SEQ ID NO: 5152054 - DNA, 11 bp, Homo sapiens
acctgctgctt

SEQ ID NO: 5152055 - DNA, 17 bp, Homo sapiens
acctgctggaagaattc

SEQ ID NO: 5152056 - DNA, 19 bp, Homo sapiens
acctgctggacagcctccg

SEQ ID NO: 5152057 - DNA, 20 bp, Homo sapiens
acctgctggacagcctccgc

SEQ ID NO: 5152058 - DNA, 15 bp, Homo sapiens
acctgctggcccctc

SEQ ID NO: 5152059 - DNA, 17 bp, Homo sapiens
acctgctgggtaaactg

SEQ ID NO: 5152060 - DNA, 20 bp, Homo sapiens
acctgctggttgttgccagg

SEQ ID NO: 5152061 - DNA, 18 bp, Homo sapiens
acctgctgtcagcctggc

SEQ ID NO: 5152062 - DNA, 21 bp, Homo sapiens
acctgctgtgatacgatgctt

SEQ ID NO: 5152063 - DNA, 14 bp, Homo sapiens
acctgcttatgcat

SEQ ID NO: 5152064 - DNA, 21 bp, Homo sapiens
acctgcttcatgctcagccct

SEQ ID NO: 5152065 - DNA, 17 bp, Homo sapiens
acctgcttcccccactt

SEQ ID NO: 5152066 - DNA, 19 bp, Homo sapiens
acctgcttcccccacttca

SEQ ID NO: 5152067 - DNA, 22 bp, Homo sapiens
acctgcttcccccacttcacct

SEQ ID NO: 5152068 - DNA, 19 bp, Homo sapiens
acctgcttcctgaaataaa

SEQ ID NO: 5152069 - DNA, 13 bp, Homo sapiens
acctgcttcctgg

SEQ ID NO: 5152070 - DNA, 13 bp, Homo sapiens
acctgcttccttc

SEQ ID NO: 5152071 - DNA, 17 bp, Homo sapiens
acctgcttccttcagtt

SEQ ID NO: 5152072 - DNA, 21 bp, Homo sapiens
acctgcttctctgcccagctt

SEQ ID NO: 5152073 - DNA, 21 bp, Homo sapiens
acctgcttctgaactcaagct

SEQ ID NO: 5152074 - DNA, 21 bp, Homo sapiens
acctgcttgagctttctgtgc

SEQ ID NO: 5152075 - DNA, 22 bp, Homo sapiens
acctgcttgggtggagaagcca

SEQ ID NO: 5152076 - DNA, 23 bp, Homo sapiens
acctgcttgtgttgggccccagg

SEQ ID NO: 5152077 - DNA, 16 bp, Homo sapiens
acctgctttctcctgg

SEQ ID NO: 5152078 - DNA, 15 bp, Homo sapiens
acctgcttttcaatg

SEQ ID NO: 5152079 - DNA, 16 bp, Homo sapiens
acctgcttttcaatgt

SEQ ID NO: 5152080 - DNA, 17 bp, Homo sapiens
acctgctttttgaaatg

SEQ ID NO: 5152081 - DNA, 21 bp, Homo sapiens
acctgctttttgaaatgaaat

SEQ ID NO: 5152082 - DNA, 23 bp, Homo sapiens
acctggaaacagaccaatagaca

SEQ ID NO: 5152083 - DNA, 14 bp, Homo sapiens
acctggaaagccag

SEQ ID NO: 5152084 - DNA, 20 bp, Homo sapiens
acctggaactgtagggccag

SEQ ID NO: 5152085 - DNA, 18 bp, Homo sapiens
acctggaacttggggagt

SEQ ID NO: 5152086 - DNA, 21 bp, Homo sapiens
acctggaagatcatggacctg

SEQ ID NO: 5152087 - DNA, 18 bp, Homo sapiens
acctggaagccctctctg

SEQ ID NO: 5152088 - DNA, 21 bp, Homo sapiens
acctggaagggctagaacctg

SEQ ID NO: 5152089 - DNA, 19 bp, Homo sapiens
acctggaatgtattttaac

SEQ ID NO: 5152090 - DNA, 23 bp, Homo sapiens
acctggaattttcagtcatctca

SEQ ID NO: 5152091 - DNA, 22 bp, Homo sapiens
acctggacaaagtccaagtctg

SEQ ID NO: 5152092 - DNA, 19 bp, Homo sapiens
acctggacacacactcacc

SEQ ID NO: 5152093 - DNA, 20 bp, Homo sapiens
acctggacacacactcacca

SEQ ID NO: 5152094 - DNA, 17 bp, Homo sapiens
acctggacacaggcctg

SEQ ID NO: 5152095 - DNA, 17 bp, Homo sapiens
acctggaccccagcctt

SEQ ID NO: 5152096 - DNA, 18 bp, Homo sapiens
acctggaccccctgcccg

SEQ ID NO: 5152097 - DNA, 20 bp, Homo sapiens
acctggaccccctgcccgcc

SEQ ID NO: 5152098 - DNA, 17 bp, Homo sapiens
acctggactagggcctc

SEQ ID NO: 5152099 - DNA, 22 bp, Homo sapiens
acctggacttaagcatctggct

SEQ ID NO: 5152100 - DNA, 21 bp, Homo sapiens
acctggagaaggaagctgcct

SEQ ID NO: 5152101 - DNA, 12 bp, Homo sapiens
acctggagacag

SEQ ID NO: 5152102 - DNA, 13 bp, Homo sapiens
acctggagacagg

SEQ ID NO: 5152103 - DNA, 14 bp, Homo sapiens
acctggagacagga

SEQ ID NO: 5152104 - DNA, 13 bp, Homo sapiens
acctggagacagt

SEQ ID NO: 5152105 - DNA, 13 bp, Homo sapiens
acctggagaccag

SEQ ID NO: 5152106 - DNA, 21 bp, Homo sapiens
acctggagagctagaacctag

SEQ ID NO: 5152107 - DNA, 16 bp, Homo sapiens
acctggagatgatgat

SEQ ID NO: 5152108 - DNA, 16 bp, Homo sapiens
acctggagatggtgga

SEQ ID NO: 5152109 - DNA, 17 bp, Homo sapiens
acctggagcccctgggt

SEQ ID NO: 5152110 - DNA, 15 bp, Homo sapiens
acctggaggctggac

SEQ ID NO: 5152111 - DNA, 13 bp, Homo sapiens
acctggaggggca

SEQ ID NO: 5152112 - DNA, 19 bp, Homo sapiens
acctggaggggcaccaggt

SEQ ID NO: 5152113 - DNA, 22 bp, Homo sapiens
acctggaggggctagaacctag

SEQ ID NO: 5152114 - DNA, 18 bp, Homo sapiens
acctggagggttgatata

SEQ ID NO: 5152115 - DNA, 22 bp, Homo sapiens
acctggagtggatctatttaca

SEQ ID NO: 5152116 - DNA, 16 bp, Homo sapiens
acctggagttcctgaa

SEQ ID NO: 5152117 - DNA, 19 bp, Homo sapiens
acctggagttcctgaacct

SEQ ID NO: 5152118 - DNA, 12 bp, Homo sapiens
acgcctgcccag

SEQ ID NO: 5152119 - DNA, 15 bp, Homo sapiens
acgcctgcccccgtc

SEQ ID NO: 5152120 - DNA, 22 bp, Homo sapiens
acgcctgccctccccagagcac

SEQ ID NO: 5152121 - DNA, 16 bp, Homo sapiens
acgcctgccctgccca

SEQ ID NO: 5152122 - DNA, 18 bp, Homo sapiens
acgcctgcgatggtgctg

SEQ ID NO: 5152123 - DNA, 14 bp, Homo sapiens
acgcctgctggccg

SEQ ID NO: 5152124 - DNA, 11 bp, Homo sapiens
acgcctggctc

SEQ ID NO: 5152125 - DNA, 16 bp, Homo sapiens
acgcctggctccaggc

SEQ ID NO: 5152126 - DNA, 19 bp, Homo sapiens
acgcctggctccaggctcc

SEQ ID NO: 5152127 - DNA, 13 bp, Homo sapiens
acgcctgtaaatg

SEQ ID NO: 5152128 - DNA, 16 bp, Homo sapiens
acgcctgtaaatgtat

SEQ ID NO: 5152129 - DNA, 16 bp, Homo sapiens
acgcctgtaatcccag

SEQ ID NO: 5152130 - DNA, 20 bp, Homo sapiens
acgcctgtaatcccagcact

SEQ ID NO: 5152131 - DNA, 21 bp, Homo sapiens
acgcctgtaatcccagcactt

SEQ ID NO: 5152132 - DNA, 13 bp, Homo sapiens
acgcctgtgccac

SEQ ID NO: 5152133 - DNA, 22 bp, Homo sapiens
acgcctgtgccaccccttcctc

SEQ ID NO: 5152134 - DNA, 19 bp, Homo sapiens
acgccttcaggcaccacag

SEQ ID NO: 5152135 - DNA, 16 bp, Homo sapiens
acgccttccaggtcag

SEQ ID NO: 5152136 - DNA, 17 bp, Homo sapiens
acgccttcccctcagcc

SEQ ID NO: 5152137 - DNA, 15 bp, Homo sapiens
acgccttccctaagt

SEQ ID NO: 5152138 - DNA, 13 bp, Homo sapiens
acgccttcctctc

SEQ ID NO: 5152139 - DNA, 17 bp, Homo sapiens
acgccttcctctctgga

SEQ ID NO: 5152140 - DNA, 18 bp, Homo sapiens
acgccttgttcttggcca

SEQ ID NO: 5152141 - DNA, 22 bp, Homo sapiens
acgccttttcttggttcttttt

SEQ ID NO: 5152142 - DNA, 23 bp, Homo sapiens
acgcgaaagtatcaccagggtgc

SEQ ID NO: 5152143 - DNA, 14 bp, Homo sapiens
acgcgacttctcag

SEQ ID NO: 5152144 - DNA, 16 bp, Homo sapiens
acgcgacttctcagga

SEQ ID NO: 5152145 - DNA, 14 bp, Homo sapiens
acgcgagaggctct

SEQ ID NO: 5152146 - DNA, 14 bp, Homo sapiens
acgcgcacacacac

SEQ ID NO: 5152147 - DNA, 15 bp, Homo sapiens
acgcgcacacacacc

SEQ ID NO: 5152148 - DNA, 13 bp, Homo sapiens
acgcgcagatgtg

SEQ ID NO: 5152149 - DNA, 20 bp, Homo sapiens
acgcgcagatgtgcagcaga

SEQ ID NO: 5152150 - DNA, 21 bp, Homo sapiens
acgcgcagatgtgcagcagat

SEQ ID NO: 5152151 - DNA, 15 bp, Homo sapiens
acgcgcccccctccc

SEQ ID NO: 5152152 - DNA, 18 bp, Homo sapiens
acgcgcccccctcccaga

SEQ ID NO: 5152153 - DNA, 22 bp, Homo sapiens
acgcgcgcgcgcgcacacacac

SEQ ID NO: 5152154 - DNA, 16 bp, Homo sapiens
acgcgctctgcatgct

SEQ ID NO: 5152155 - DNA, 19 bp, Homo sapiens
acgcgctctgcatgctcct

SEQ ID NO: 5152156 - DNA, 21 bp, Homo sapiens
acgcgctctgcatgctcctct

SEQ ID NO: 5152157 - DNA, 18 bp, Homo sapiens
acgcggaggaggaagagg

SEQ ID NO: 5152158 - DNA, 16 bp, Homo sapiens
acgcggccgctctccg

SEQ ID NO: 5152159 - DNA, 18 bp, Homo sapiens
acgcggcgggaggcccac

SEQ ID NO: 5152160 - DNA, 17 bp, Homo sapiens
acgcggcggggactcgg

SEQ ID NO: 5152161 - DNA, 18 bp, Homo sapiens
acgcgggctgtgccttac

SEQ ID NO: 5152162 - DNA, 18 bp, Homo sapiens
acgcggtacaaaggaaaa

SEQ ID NO: 5152163 - DNA, 20 bp, Homo sapiens
acgcggtttggtttgcagcg

SEQ ID NO: 5152164 - DNA, 12 bp, Homo sapiens
acgcgtatttac

SEQ ID NO: 5152165 - DNA, 13 bp, Homo sapiens
acgcgtccacata

SEQ ID NO: 5152166 - DNA, 12 bp, Homo sapiens
acgcgtctcctg

SEQ ID NO: 5152167 - DNA, 20 bp, Homo sapiens
acgcgtgcacacaccagagc

SEQ ID NO: 5152168 - DNA, 23 bp, Homo sapiens
acgcgtgcacacaccagagccca

SEQ ID NO: 5152169 - DNA, 12 bp, Homo sapiens
acgcgtgttctg

SEQ ID NO: 5152170 - DNA, 14 bp, Homo sapiens
acgcgttgaaattg

SEQ ID NO: 5152171 - DNA, 16 bp, Homo sapiens
acgctaaagagccctt

SEQ ID NO: 5152172 - DNA, 21 bp, Homo sapiens
acgctaaagagcccttgcctc

SEQ ID NO: 5152173 - DNA, 18 bp, Homo sapiens
acgctaacaatttctcat

SEQ ID NO: 5152174 - DNA, 19 bp, Homo sapiens
acgctaacaatttctcata

SEQ ID NO: 5152175 - DNA, 21 bp, Homo sapiens
acgctaataagtgacaaataa

SEQ ID NO: 5152176 - DNA, 17 bp, Homo sapiens
acgctacccgggaaggg

SEQ ID NO: 5152177 - DNA, 20 bp, Homo sapiens
acgctacctctctgtccctt

SEQ ID NO: 5152178 - DNA, 19 bp, Homo sapiens
acgctactataaagagaag

SEQ ID NO: 5152179 - DNA, 14 bp, Homo sapiens
acgctagagcatgc

SEQ ID NO: 5152180 - DNA, 17 bp, Homo sapiens
acgctagagcatgctgc

SEQ ID NO: 5152181 - DNA, 20 bp, Homo sapiens
acgctcaatgcccagtaaaa

SEQ ID NO: 5152182 - DNA, 12 bp, Homo sapiens
acgctcacccag

SEQ ID NO: 5152183 - DNA, 14 bp, Homo sapiens
acgctcagccccag

SEQ ID NO: 5152184 - DNA, 18 bp, Homo sapiens
acgctcagccccaggcca

SEQ ID NO: 5152185 - DNA, 12 bp, Homo sapiens
acgctcagtgcc

SEQ ID NO: 5152186 - DNA, 14 bp, Homo sapiens
acgctcagtgcccg

SEQ ID NO: 5152187 - DNA, 15 bp, Homo sapiens
acgctcagtgcccgt

SEQ ID NO: 5152188 - DNA, 21 bp, Homo sapiens
acgctccaaagtcataattgc

SEQ ID NO: 5152189 - DNA, 14 bp, Homo sapiens
acgctccagctgcc

SEQ ID NO: 5152190 - DNA, 17 bp, Homo sapiens
acgctccagctgccccg

SEQ ID NO: 5152191 - DNA, 19 bp, Homo sapiens
acgctccagctgccccggc

SEQ ID NO: 5152192 - DNA, 17 bp, Homo sapiens
acgctccccgcctgttc

SEQ ID NO: 5152193 - DNA, 20 bp, Homo sapiens
acgctccccgcctgttcccc

SEQ ID NO: 5152194 - DNA, 17 bp, Homo sapiens
acgctcccctgagaggt

SEQ ID NO: 5152195 - DNA, 16 bp, Homo sapiens
acgctccctccccctg

SEQ ID NO: 5152196 - DNA, 17 bp, Homo sapiens
acgctccctgacttctc

SEQ ID NO: 5152197 - DNA, 20 bp, Homo sapiens
acgctccctgacttctcccc

SEQ ID NO: 5152198 - DNA, 14 bp, Homo sapiens
acgctccctggaag

SEQ ID NO: 5152199 - DNA, 13 bp, Homo sapiens
acgctccgctgcc

SEQ ID NO: 5152200 - DNA, 20 bp, Homo sapiens
acgctccgctgccgtgccgc

SEQ ID NO: 5152201 - DNA, 22 bp, Homo sapiens
acgctcctccctctgaggctgt

SEQ ID NO: 5152202 - DNA, 23 bp, Homo sapiens
acgctcctccctctgaggctgta

SEQ ID NO: 5152203 - DNA, 14 bp, Homo sapiens
acgctcctctgccc

SEQ ID NO: 5152204 - DNA, 23 bp, Homo sapiens
acgctcctctgcccttcctttcc

SEQ ID NO: 5152205 - DNA, 15 bp, Homo sapiens
acgctccttcctctg

SEQ ID NO: 5152206 - DNA, 21 bp, Homo sapiens
acgctcctttgtgtgtgtgtc

SEQ ID NO: 5152207 - DNA, 23 bp, Homo sapiens
acgctcgctgccatcaccgctgg

SEQ ID NO: 5152208 - DNA, 19 bp, Homo sapiens
acgctctaggcagaagaag

SEQ ID NO: 5152209 - DNA, 17 bp, Homo sapiens
acgctctctggccttcg

SEQ ID NO: 5152210 - DNA, 12 bp, Homo sapiens
acgctctctgtc

SEQ ID NO: 5152211 - DNA, 21 bp, Homo sapiens
acgctgaagcggtcagactgg

SEQ ID NO: 5152212 - DNA, 12 bp, Homo sapiens
acgctgaataaa

SEQ ID NO: 5152213 - DNA, 15 bp, Homo sapiens
acgctgaataaatgt

SEQ ID NO: 5152214 - DNA, 23 bp, Homo sapiens
acgctgaatgagaagtaaattat

SEQ ID NO: 5152215 - DNA, 14 bp, Homo sapiens
acgctgacagcctc

SEQ ID NO: 5152216 - DNA, 15 bp, Homo sapiens
acgctgaccgtggag

SEQ ID NO: 5152217 - DNA, 17 bp, Homo sapiens
acgctgactacagggcc

SEQ ID NO: 5152218 - DNA, 16 bp, Homo sapiens
acgctgatgtttatgt

SEQ ID NO: 5152219 - DNA, 20 bp, Homo sapiens
acgctgattcctaaggccca

SEQ ID NO: 5152220 - DNA, 14 bp, Homo sapiens
acgctgcagagcac

SEQ ID NO: 5152221 - DNA, 15 bp, Homo sapiens
acgctgcatgagaca

SEQ ID NO: 5152222 - DNA, 18 bp, Homo sapiens
acgctgcccaggctctgc

SEQ ID NO: 5152223 - DNA, 14 bp, Homo sapiens
acgctgcccagggg

SEQ ID NO: 5152224 - DNA, 22 bp, Homo sapiens
acgctgccgctgccgctgcacc

SEQ ID NO: 5152225 - DNA, 17 bp, Homo sapiens
acgctgccgggagactg

SEQ ID NO: 5152226 - DNA, 11 bp, Homo sapiens
acgctgcctct

SEQ ID NO: 5152227 - DNA, 13 bp, Homo sapiens
acgctgcctgccc

SEQ ID NO: 5152228 - DNA, 15 bp, Homo sapiens
acgctgcctgcccac

SEQ ID NO: 5152229 - DNA, 22 bp, Homo sapiens
acgctgcgtgccatgagtccat

SEQ ID NO: 5152230 - DNA, 11 bp, Homo sapiens
acgctgctcca

SEQ ID NO: 5152231 - DNA, 12 bp, Homo sapiens
acgctgctctca

SEQ ID NO: 5152232 - DNA, 15 bp, Homo sapiens
acgctgctctgcccc

SEQ ID NO: 5152233 - DNA, 20 bp, Homo sapiens
acgctgctctgccccagctt

SEQ ID NO: 5152234 - DNA, 20 bp, Homo sapiens
acgctggagatgcaaggtgc

SEQ ID NO: 5152235 - DNA, 12 bp, Homo sapiens
acgctggagctg

SEQ ID NO: 5152236 - DNA, 17 bp, Homo sapiens
acgctggagtgcagtga

SEQ ID NO: 5152237 - DNA, 18 bp, Homo sapiens
acgctggcaacacagagg

SEQ ID NO: 5152238 - DNA, 11 bp, Homo sapiens
acgctggcctt

SEQ ID NO: 5152239 - DNA, 22 bp, Homo sapiens
acgctggcgacacactccgtcc

SEQ ID NO: 5152240 - DNA, 14 bp, Homo sapiens
acgctggctactgt

SEQ ID NO: 5152241 - DNA, 18 bp, Homo sapiens
acgctggctccccaaagg

SEQ ID NO: 5152242 - DNA, 11 bp, Homo sapiens
acgctggctcg

SEQ ID NO: 5152243 - DNA, 15 bp, Homo sapiens
acgctggcttccagc

SEQ ID NO: 5152244 - DNA, 16 bp, Homo sapiens
acgctgggcctaggat

SEQ ID NO: 5152245 - DNA, 16 bp, Homo sapiens
acgctggggctctctg

SEQ ID NO: 5152246 - DNA, 18 bp, Homo sapiens
acgctgggtattaccatg

SEQ ID NO: 5152247 - DNA, 23 bp, Homo sapiens
acgctgggtattaccatgtaaat

SEQ ID NO: 5152248 - DNA, 19 bp, Homo sapiens
acgctggtagagatggagg

SEQ ID NO: 5152249 - DNA, 23 bp, Homo sapiens
acgctggtagagatggaggagga

SEQ ID NO: 5152250 - DNA, 20 bp, Homo sapiens
acgctgtcctctcgagccca

SEQ ID NO: 5152251 - DNA, 21 bp, Homo sapiens
acgctgtctccagacccccac

SEQ ID NO: 5152252 - DNA, 22 bp, Homo sapiens
acgctgtctccagacccccacc

SEQ ID NO: 5152253 - DNA, 11 bp, Homo sapiens
acgctgtgctg

SEQ ID NO: 5152254 - DNA, 13 bp, Homo sapiens
acgctgtgctggt

SEQ ID NO: 5152255 - DNA, 20 bp, Homo sapiens
acgctgtgctggttctgttt

SEQ ID NO: 5152256 - DNA, 15 bp, Homo sapiens
acgctgtgggcaggt

SEQ ID NO: 5152257 - DNA, 16 bp, Homo sapiens
acgcttactagatgtg

SEQ ID NO: 5152258 - DNA, 18 bp, Homo sapiens
acgcttactagatgtgag

SEQ ID NO: 5152259 - DNA, 16 bp, Homo sapiens
acgcttattgcccagg

SEQ ID NO: 5152260 - DNA, 13 bp, Homo sapiens
acgcttcacagtg

SEQ ID NO: 5152261 - DNA, 16 bp, Homo sapiens
acgcttcacagtgatc

SEQ ID NO: 5152262 - DNA, 12 bp, Homo sapiens
acgcttccagac

SEQ ID NO: 5152263 - DNA, 14 bp, Homo sapiens
acgcttccagacca

SEQ ID NO: 5152264 - DNA, 15 bp, Homo sapiens
acgcttccagaccac

SEQ ID NO: 5152265 - DNA, 16 bp, Homo sapiens
acgcttccagaccacc

SEQ ID NO: 5152266 - DNA, 19 bp, Homo sapiens
acgcttccagaccacctgc

SEQ ID NO: 5152267 - DNA, 12 bp, Homo sapiens
acgcttctgaat

SEQ ID NO: 5152268 - DNA, 13 bp, Homo sapiens
acgcttctgaatg

SEQ ID NO: 5152269 - DNA, 22 bp, Homo sapiens
acgcttctggaggtggggaggg

SEQ ID NO: 5152270 - DNA, 18 bp, Homo sapiens
acgcttgcgtatgtctgt

SEQ ID NO: 5152271 - DNA, 22 bp, Homo sapiens
acgcttgctctgtttgtggggt

SEQ ID NO: 5152272 - DNA, 17 bp, Homo sapiens
acgcttgtgacagtgcc

SEQ ID NO: 5152273 - DNA, 18 bp, Homo sapiens
acgcttgtgacagtgcct

SEQ ID NO: 5152274 - DNA, 19 bp, Homo sapiens
acgctttcagcgaatgaca

SEQ ID NO: 5152275 - DNA, 12 bp, Homo sapiens
acgctttgattc

SEQ ID NO: 5152276 - DNA, 20 bp, Homo sapiens
acgcttttaatgaaaaggaa

SEQ ID NO: 5152277 - DNA, 22 bp, Homo sapiens
acgcttttaatgaaaaggaatc

SEQ ID NO: 5152278 - DNA, 20 bp, Homo sapiens
acgcttttgagtgggccctg

SEQ ID NO: 5152279 - DNA, 12 bp, Homo sapiens
acggaaaacaat

SEQ ID NO: 5152280 - DNA, 18 bp, Homo sapiens
acggaaaatgccaatctc

SEQ ID NO: 5152281 - DNA, 23 bp, Homo sapiens
acggaaacatagaaacatacaca

SEQ ID NO: 5152282 - DNA, 18 bp, Homo sapiens
acggaagccccctcttcc

SEQ ID NO: 5152283 - DNA, 20 bp, Homo sapiens
acggaagccccctcttcctc

SEQ ID NO: 5152284 - DNA, 19 bp, Homo sapiens
acggaaggacctatgtttg

SEQ ID NO: 5152285 - DNA, 16 bp, Homo sapiens
acggaagggtaaacaa

SEQ ID NO: 5152286 - DNA, 22 bp, Homo sapiens
acggaagggtaaacaatatagt

SEQ ID NO: 5152287 - DNA, 14 bp, Homo sapiens
acggaagtggaagg

SEQ ID NO: 5152288 - DNA, 17 bp, Homo sapiens
acggaagtggcctgaga

SEQ ID NO: 5152289 - DNA, 21 bp, Homo sapiens
acggaagtggcctgagaagag

SEQ ID NO: 5152290 - DNA, 21 bp, Homo sapiens
acggaagtggtggctgtggaa

SEQ ID NO: 5152291 - DNA, 20 bp, Homo sapiens
acggaagttttcaatgatgg

SEQ ID NO: 5152292 - DNA, 11 bp, Homo sapiens
acggaattcca

SEQ ID NO: 5152293 - DNA, 13 bp, Homo sapiens
acggaattccaat

SEQ ID NO: 5152294 - DNA, 23 bp, Homo sapiens
acggacaaaaccccccagatatc

SEQ ID NO: 5152295 - DNA, 19 bp, Homo sapiens
acggacactcaaaagctgg

SEQ ID NO: 5152296 - DNA, 16 bp, Homo sapiens
acggacactgtggaga

SEQ ID NO: 5152297 - DNA, 17 bp, Homo sapiens
acggacagagaccaaga

SEQ ID NO: 5152298 - DNA, 17 bp, Homo sapiens
acctggatagttaaggg

SEQ ID NO: 5152299 - DNA, 20 bp, Homo sapiens
acctggatagttaagggctt

SEQ ID NO: 5152300 - DNA, 21 bp, Homo sapiens
acctggatataaattaattgt

SEQ ID NO: 5152301 - DNA, 17 bp, Homo sapiens
acctggatccagcactg

SEQ ID NO: 5152302 - DNA, 18 bp, Homo sapiens
acctggatggatctgctc

SEQ ID NO: 5152303 - DNA, 19 bp, Homo sapiens
acctggatggatctgctcc

SEQ ID NO: 5152304 - DNA, 23 bp, Homo sapiens
acctggatggatctgctccatgc

SEQ ID NO: 5152305 - DNA, 24 bp, Homo sapiens
acctggatggatctgctccatgca

SEQ ID NO: 5152306 - DNA, 13 bp, Homo sapiens
acctggatgtact

SEQ ID NO: 5152307 - DNA, 22 bp, Homo sapiens
acctggattttttatgtacaac

SEQ ID NO: 5152308 - DNA, 15 bp, Homo sapiens
acctggcaaaggacc

SEQ ID NO: 5152309 - DNA, 20 bp, Homo sapiens
acctggcaagctagaacctg

SEQ ID NO: 5152310 - DNA, 22 bp, Homo sapiens
acctggcacaccagaagtgcca

SEQ ID NO: 5152311 - DNA, 21 bp, Homo sapiens
acctggcacagaaagggcagc

SEQ ID NO: 5152312 - DNA, 15 bp, Homo sapiens
acctggcactgctgt

SEQ ID NO: 5152313 - DNA, 17 bp, Homo sapiens
acctggcagatgggggc

SEQ ID NO: 5152314 - DNA, 18 bp, Homo sapiens
acctggcagatgggggcc

SEQ ID NO: 5152315 - DNA, 20 bp, Homo sapiens
acctggcagatgggggcctc

SEQ ID NO: 5152316 - DNA, 14 bp, Homo sapiens
acctggcaggccct

SEQ ID NO: 5152317 - DNA, 16 bp, Homo sapiens
acctggcaggccctgc

SEQ ID NO: 5152318 - DNA, 10 bp, Homo sapiens
acctggcagt

SEQ ID NO: 5152319 - DNA, 14 bp, Homo sapiens
acctggcatggtgc

SEQ ID NO: 5152320 - DNA, 14 bp, Homo sapiens
acctggccactgtc

SEQ ID NO: 5152321 - DNA, 13 bp, Homo sapiens
acctggccagagg

SEQ ID NO: 5152322 - DNA, 13 bp, Homo sapiens
acctggcccagtg

SEQ ID NO: 5152323 - DNA, 21 bp, Homo sapiens
acctggccccaggctgtcacc

SEQ ID NO: 5152324 - DNA, 23 bp, Homo sapiens
acctggccccatgtctctcagaa

SEQ ID NO: 5152325 - DNA, 19 bp, Homo sapiens
acctggccccttctccagc

SEQ ID NO: 5152326 - DNA, 15 bp, Homo sapiens
acctggccctgcttc

SEQ ID NO: 5152327 - DNA, 12 bp, Homo sapiens
acctggccctgg

SEQ ID NO: 5152328 - DNA, 13 bp, Homo sapiens
acctggccctggg

SEQ ID NO: 5152329 - DNA, 17 bp, Homo sapiens
acctggccctggggcct

SEQ ID NO: 5152330 - DNA, 21 bp, Homo sapiens
acctggccgcctccaggagcc

SEQ ID NO: 5152331 - DNA, 22 bp, Homo sapiens
acctggccgcgtttagaccaag

SEQ ID NO: 5152332 - DNA, 23 bp, Homo sapiens
acctggccgggtcaccctgtgac

SEQ ID NO: 5152333 - DNA, 20 bp, Homo sapiens
acctggccggtaggctgctg

SEQ ID NO: 5152334 - DNA, 16 bp, Homo sapiens
acctggcctagaaagg

SEQ ID NO: 5152335 - DNA, 14 bp, Homo sapiens
acctggcctcattt

SEQ ID NO: 5152336 - DNA, 17 bp, Homo sapiens
acctggcctctgcactc

SEQ ID NO: 5152337 - DNA, 20 bp, Homo sapiens
acctggcctctgcactcccc

SEQ ID NO: 5152338 - DNA, 22 bp, Homo sapiens
acctggcctgagcctcctgaag

SEQ ID NO: 5152339 - DNA, 13 bp, Homo sapiens
acctggcctgctg

SEQ ID NO: 5152340 - DNA, 15 bp, Homo sapiens
acctggcctgtctgt

SEQ ID NO: 5152341 - DNA, 17 bp, Homo sapiens
acctggccttaaagagg

SEQ ID NO: 5152342 - DNA, 23 bp, Homo sapiens
acctggccttaaagagggacagg

SEQ ID NO: 5152343 - DNA, 13 bp, Homo sapiens
acctggcctttca

SEQ ID NO: 5152344 - DNA, 22 bp, Homo sapiens
acctggcggcaggaagccaaag

SEQ ID NO: 5152345 - DNA, 18 bp, Homo sapiens
acctggcgggctggtgac

SEQ ID NO: 5152346 - DNA, 15 bp, Homo sapiens
acctggcgtgctcag

SEQ ID NO: 5152347 - DNA, 23 bp, Homo sapiens
acctggctaattttttgtacttt

SEQ ID NO: 5152348 - DNA, 11 bp, Homo sapiens
acctggctacg

SEQ ID NO: 5152349 - DNA, 15 bp, Homo sapiens
acctggctctcagag

SEQ ID NO: 5152350 - DNA, 23 bp, Homo sapiens
acctggctctgtggcgagccatt

SEQ ID NO: 5152351 - DNA, 22 bp, Homo sapiens
acctggctgaggttcctctgcc

SEQ ID NO: 5152352 - DNA, 11 bp, Homo sapiens
acctggctgcc

SEQ ID NO: 5152353 - DNA, 21 bp, Homo sapiens
acctggctgcgaactgtgcag

SEQ ID NO: 5152354 - DNA, 20 bp, Homo sapiens
acctggctgctaggccagag

SEQ ID NO: 5152355 - DNA, 14 bp, Homo sapiens
acctggcttattta

SEQ ID NO: 5152356 - DNA, 20 bp, Homo sapiens
acctggcttcatacagaagg

SEQ ID NO: 5152357 - DNA, 16 bp, Homo sapiens
acctggcttcccagga

SEQ ID NO: 5152358 - DNA, 21 bp, Homo sapiens
acctggcttcccaggaccctg

SEQ ID NO: 5152359 - DNA, 16 bp, Homo sapiens
acctggcttttacttt

SEQ ID NO: 5152360 - DNA, 17 bp, Homo sapiens
acctggcttttacttta

SEQ ID NO: 5152361 - DNA, 20 bp, Homo sapiens
acctggcttttctttctacc

SEQ ID NO: 5152362 - DNA, 23 bp, Homo sapiens
acctggctttttaaaatatatgt

SEQ ID NO: 5152363 - DNA, 21 bp, Homo sapiens
acctggctttttattgtattt

SEQ ID NO: 5152364 - DNA, 14 bp, Homo sapiens
acctgggaaaacag

SEQ ID NO: 5152365 - DNA, 22 bp, Homo sapiens
acctgggaaagagatttaaact

SEQ ID NO: 5152366 - DNA, 20 bp, Homo sapiens
acctgggaacgactggactg

SEQ ID NO: 5152367 - DNA, 16 bp, Homo sapiens
acctgggaagatacca

SEQ ID NO: 5152368 - DNA, 16 bp, Homo sapiens
acctgggaaggccagc

SEQ ID NO: 5152369 - DNA, 13 bp, Homo sapiens
acctgggaagggg

SEQ ID NO: 5152370 - DNA, 18 bp, Homo sapiens
acctgggacaagcaggcc

SEQ ID NO: 5152371 - DNA, 15 bp, Homo sapiens
acctgggacagggag

SEQ ID NO: 5152372 - DNA, 10 bp, Homo sapiens
acctgggacc

SEQ ID NO: 5152373 - DNA, 20 bp, Homo sapiens
acctgggaccaacctgacct

SEQ ID NO: 5152374 - DNA, 14 bp, Homo sapiens
acctgggaccccga

SEQ ID NO: 5152375 - DNA, 22 bp, Homo sapiens
acctgggagaaggtctccaagg

SEQ ID NO: 5152376 - DNA, 15 bp, Homo sapiens
acctgggagatgctg

SEQ ID NO: 5152377 - DNA, 17 bp, Homo sapiens
acctgggagatgctggg

SEQ ID NO: 5152378 - DNA, 15 bp, Homo sapiens
acctgggatatgaca

SEQ ID NO: 5152379 - DNA, 15 bp, Homo sapiens
acctgggatttgaga

SEQ ID NO: 5152380 - DNA, 22 bp, Homo sapiens
acctgggcaagtgaggcaagag

SEQ ID NO: 5152381 - DNA, 13 bp, Homo sapiens
acctgggcacctg

SEQ ID NO: 5152382 - DNA, 14 bp, Homo sapiens
acctgggcacctgg

SEQ ID NO: 5152383 - DNA, 18 bp, Homo sapiens
acctgggcacctggggag

SEQ ID NO: 5152384 - DNA, 23 bp, Homo sapiens
acctgggcactccgcgccgatgc

SEQ ID NO: 5152385 - DNA, 19 bp, Homo sapiens
acctgggcatttggtgaga

SEQ ID NO: 5152386 - DNA, 18 bp, Homo sapiens
acctgggccccactggac

SEQ ID NO: 5152387 - DNA, 23 bp, Homo sapiens
acctgggcccgggcaggccagct

SEQ ID NO: 5152388 - DNA, 13 bp, Homo sapiens
acctgggccctag

SEQ ID NO: 5152389 - DNA, 13 bp, Homo sapiens
acctgggccctgg

SEQ ID NO: 5152390 - DNA, 19 bp, Homo sapiens
acctgggccctggggcctg

SEQ ID NO: 5152391 - DNA, 21 bp, Homo sapiens
acctgggccctggggcctgta

SEQ ID NO: 5152392 - DNA, 22 bp, Homo sapiens
acctgggcctcccatagtgctg

SEQ ID NO: 5152393 - DNA, 12 bp, Homo sapiens
acctgggcggcc

SEQ ID NO: 5152394 - DNA, 18 bp, Homo sapiens
acctgggcggccagaggc

SEQ ID NO: 5152395 - DNA, 12 bp, Homo sapiens
acctgggctggg

SEQ ID NO: 5152396 - DNA, 18 bp, Homo sapiens
acctgggctgtgatgtga

SEQ ID NO: 5152397 - DNA, 14 bp, Homo sapiens
acctgggctgtgct

SEQ ID NO: 5152398 - DNA, 15 bp, Homo sapiens
acctgggctgtgctg

SEQ ID NO: 5152399 - DNA, 23 bp, Homo sapiens
acctgggcttaagttttacttga

SEQ ID NO: 5152400 - DNA, 17 bp, Homo sapiens
acctggggaaagcctga

SEQ ID NO: 5152401 - DNA, 14 bp, Homo sapiens
acctggggcacagt

SEQ ID NO: 5152402 - DNA, 11 bp, Homo sapiens
acctgggggca

SEQ ID NO: 5152403 - DNA, 22 bp, Homo sapiens
acctgggggcagaactcctacc

SEQ ID NO: 5152404 - DNA, 22 bp, Homo sapiens
acctggggggagggacagggca

SEQ ID NO: 5152405 - DNA, 22 bp, Homo sapiens
acctggggggcagtggtgtgga

SEQ ID NO: 5152406 - DNA, 21 bp, Homo sapiens
acctggggtcccccctccctg

SEQ ID NO: 5152407 - DNA, 23 bp, Homo sapiens
acctgggtatcccctgcctcctg

SEQ ID NO: 5152408 - DNA, 18 bp, Homo sapiens
acctgggtatgttcctaa

SEQ ID NO: 5152409 - DNA, 15 bp, Homo sapiens
acctgggtccaaata

SEQ ID NO: 5152410 - DNA, 21 bp, Homo sapiens
acctgggtccaaataaaaact

SEQ ID NO: 5152411 - DNA, 15 bp, Homo sapiens
acctgggtccttttc

SEQ ID NO: 5152412 - DNA, 14 bp, Homo sapiens
acctgggtgctctg

SEQ ID NO: 5152413 - DNA, 13 bp, Homo sapiens
acctgggtgtgct

SEQ ID NO: 5152414 - DNA, 17 bp, Homo sapiens
acctgggtgtgctccag

SEQ ID NO: 5152415 - DNA, 19 bp, Homo sapiens
acctgggtgtgctccaggc

SEQ ID NO: 5152416 - DNA, 18 bp, Homo sapiens
acctgggttagggtgtgt

SEQ ID NO: 5152417 - DNA, 21 bp, Homo sapiens
acctgggttatttattgacac

SEQ ID NO: 5152418 - DNA, 16 bp, Homo sapiens
acctgggttgcagaca

SEQ ID NO: 5152419 - DNA, 18 bp, Homo sapiens
acctgggttgcagacagg

SEQ ID NO: 5152420 - DNA, 20 bp, Homo sapiens
acctgggttgcagacaggaa

SEQ ID NO: 5152421 - DNA, 19 bp, Homo sapiens
acctggtaccctcctggct

SEQ ID NO: 5152422 - DNA, 15 bp, Homo sapiens
acctggtccacaggg

SEQ ID NO: 5152423 - DNA, 16 bp, Homo sapiens
acctggtccacagggc

SEQ ID NO: 5152424 - DNA, 23 bp, Homo sapiens
acctggtccccactgctgagctg

SEQ ID NO: 5152425 - DNA, 17 bp, Homo sapiens
acctggtcgccaatcca

SEQ ID NO: 5152426 - DNA, 17 bp, Homo sapiens
acctggtctggtcaggc

SEQ ID NO: 5152427 - DNA, 18 bp, Homo sapiens
acctggtctggtcaggca

SEQ ID NO: 5152428 - DNA, 19 bp, Homo sapiens
acctggtgcatcgaaatgt

SEQ ID NO: 5152429 - DNA, 21 bp, Homo sapiens
acctggtgcatcgaaatgtat

SEQ ID NO: 5152430 - DNA, 23 bp, Homo sapiens
acctggtgcatcgaaatgtattc

SEQ ID NO: 5152431 - DNA, 16 bp, Homo sapiens
acctggtgcccctgct

SEQ ID NO: 5152432 - DNA, 16 bp, Homo sapiens
acctggtgcgggcctg

SEQ ID NO: 5152433 - DNA, 18 bp, Homo sapiens
acctggtgcgggcctggc

SEQ ID NO: 5152434 - DNA, 10 bp, Homo sapiens
acctggtgct

SEQ ID NO: 5152435 - DNA, 16 bp, Homo sapiens
acctggtggctggagg

SEQ ID NO: 5152436 - DNA, 19 bp, Homo sapiens
acctggtgtgcggaggcag

SEQ ID NO: 5152437 - DNA, 15 bp, Homo sapiens
acctggttcatattt

SEQ ID NO: 5152438 - DNA, 22 bp, Homo sapiens
acctggttccggaatcctgtcc

SEQ ID NO: 5152439 - DNA, 14 bp, Homo sapiens
acctggttgtccag

SEQ ID NO: 5152440 - DNA, 15 bp, Homo sapiens
acctggttgtccagg

SEQ ID NO: 5152441 - DNA, 18 bp, Homo sapiens
acctggttgtccaggtct

SEQ ID NO: 5152442 - DNA, 15 bp, Homo sapiens
acctgtaaaacttta

SEQ ID NO: 5152443 - DNA, 17 bp, Homo sapiens
acctgtaaaactttatt

SEQ ID NO: 5152444 - DNA, 22 bp, Homo sapiens
acctgtaaaactttattttata

SEQ ID NO: 5152445 - DNA, 18 bp, Homo sapiens
acctgtaaatgtcctgaa

SEQ ID NO: 5152446 - DNA, 16 bp, Homo sapiens
acctgtaactgccctt

SEQ ID NO: 5152447 - DNA, 15 bp, Homo sapiens
acctgtaacttttgt

SEQ ID NO: 5152448 - DNA, 17 bp, Homo sapiens
acctgtaacttttgtaa

SEQ ID NO: 5152449 - DNA, 20 bp, Homo sapiens
acctgtaacttttgtaaata

SEQ ID NO: 5152450 - DNA, 15 bp, Homo sapiens
acctgtaagtgtctt

SEQ ID NO: 5152451 - DNA, 19 bp, Homo sapiens
acctgtaatcccaacactt

SEQ ID NO: 5152452 - DNA, 16 bp, Homo sapiens
acctgtaatcccagca

SEQ ID NO: 5152453 - DNA, 19 bp, Homo sapiens
acctgtaatcccagcactt

SEQ ID NO: 5152454 - DNA, 11 bp, Homo sapiens
acctgtacagt

SEQ ID NO: 5152455 - DNA, 14 bp, Homo sapiens
acctgtacattctt

SEQ ID NO: 5152456 - DNA, 17 bp, Homo sapiens
acctgtagaagatgacc

SEQ ID NO: 5152457 - DNA, 17 bp, Homo sapiens
acctgtagatgcagaaa

SEQ ID NO: 5152458 - DNA, 19 bp, Homo sapiens
acctgtagatgcagaaaaa

SEQ ID NO: 5152459 - DNA, 14 bp, Homo sapiens
acctgtagccatct

SEQ ID NO: 5152460 - DNA, 11 bp, Homo sapiens
acctgtagctg

SEQ ID NO: 5152461 - DNA, 20 bp, Homo sapiens
acctgtaggaaacagaaaag

SEQ ID NO: 5152462 - DNA, 18 bp, Homo sapiens
acctgtagtcccagctac

SEQ ID NO: 5152463 - DNA, 19 bp, Homo sapiens
acctgtagtcccagctact

SEQ ID NO: 5152464 - DNA, 15 bp, Homo sapiens
acctgtagtgagaaa

SEQ ID NO: 5152465 - DNA, 20 bp, Homo sapiens
acctgtagtgagaaactgat

SEQ ID NO: 5152466 - DNA, 18 bp, Homo sapiens
acctgtatatttctttta

SEQ ID NO: 5152467 - DNA, 23 bp, Homo sapiens
acctgtatttaaaaagaaacaga

SEQ ID NO: 5152468 - DNA, 21 bp, Homo sapiens
acctgtatttaaaaatagaaa

SEQ ID NO: 5152469 - DNA, 23 bp, Homo sapiens
acctgtatttaaaaatagaaaca

SEQ ID NO: 5152470 - DNA, 12 bp, Homo sapiens
acctgtattttt

SEQ ID NO: 5152471 - DNA, 22 bp, Homo sapiens
acctgtcaacctgaattaaagt

SEQ ID NO: 5152472 - DNA, 14 bp, Homo sapiens
acctgtcaatacta

SEQ ID NO: 5152473 - DNA, 20 bp, Homo sapiens
acctgtcacattgcattcta

SEQ ID NO: 5152474 - DNA, 19 bp, Homo sapiens
acctgtcaccgtgagcagc

SEQ ID NO: 5152475 - DNA, 13 bp, Homo sapiens
acctgtcagaata

SEQ ID NO: 5152476 - DNA, 21 bp, Homo sapiens
acggacagttccagaagtgtg

SEQ ID NO: 5152477 - DNA, 22 bp, Homo sapiens
acggacccccagagcaccccca

SEQ ID NO: 5152478 - DNA, 15 bp, Homo sapiens
acggacgctggctcc

SEQ ID NO: 5152479 - DNA, 18 bp, Homo sapiens
acggacgggacagcggcc

SEQ ID NO: 5152480 - DNA, 15 bp, Homo sapiens
acggactcagactcc

SEQ ID NO: 5152481 - DNA, 21 bp, Homo sapiens
acggactcagactcctggctt

SEQ ID NO: 5152482 - DNA, 21 bp, Homo sapiens
acggactcccgggccacgccc

SEQ ID NO: 5152483 - DNA, 17 bp, Homo sapiens
acggactgaggtgcctg

SEQ ID NO: 5152484 - DNA, 20 bp, Homo sapiens
acggactgaggtgcctgctc

SEQ ID NO: 5152485 - DNA, 21 bp, Homo sapiens
acggactgtccaccttttctg

SEQ ID NO: 5152486 - DNA, 12 bp, Homo sapiens
acggagagaaaa

SEQ ID NO: 5152487 - DNA, 13 bp, Homo sapiens
acggagagaaaaa

SEQ ID NO: 5152488 - DNA, 14 bp, Homo sapiens
acggagagccttgg

SEQ ID NO: 5152489 - DNA, 14 bp, Homo sapiens
acggagaggccact

SEQ ID NO: 5152490 - DNA, 16 bp, Homo sapiens
acggagagtgcttggg

SEQ ID NO: 5152491 - DNA, 22 bp, Homo sapiens
acggagagtgcttgggtggtgg

SEQ ID NO: 5152492 - DNA, 20 bp, Homo sapiens
acggagcactgcacctgcct

SEQ ID NO: 5152493 - DNA, 20 bp, Homo sapiens
acggagcccagccctcccca

SEQ ID NO: 5152494 - DNA, 18 bp, Homo sapiens
acggagccccaggcctct

SEQ ID NO: 5152495 - DNA, 12 bp, Homo sapiens
acggagccctcc

SEQ ID NO: 5152496 - DNA, 21 bp, Homo sapiens
acggagccctccctatgtctg

SEQ ID NO: 5152497 - DNA, 23 bp, Homo sapiens
acggagccctccctatgtctgca

SEQ ID NO: 5152498 - DNA, 19 bp, Homo sapiens
acggagcggattgcaaagc

SEQ ID NO: 5152499 - DNA, 21 bp, Homo sapiens
acggagcggattgcaaagcaa

SEQ ID NO: 5152500 - DNA, 13 bp, Homo sapiens
acggagctcctgg

SEQ ID NO: 5152501 - DNA, 17 bp, Homo sapiens
acggaggagaattaagt

SEQ ID NO: 5152502 - DNA, 18 bp, Homo sapiens
acggaggagggatgctgc

SEQ ID NO: 5152503 - DNA, 23 bp, Homo sapiens
acggaggcaaagctggctcacct

SEQ ID NO: 5152504 - DNA, 16 bp, Homo sapiens
acggaggccagacaca

SEQ ID NO: 5152505 - DNA, 19 bp, Homo sapiens
acggaggccagacacaggc

SEQ ID NO: 5152506 - DNA, 10 bp, Homo sapiens
acggaggctc

SEQ ID NO: 5152507 - DNA, 13 bp, Homo sapiens
acggagggaggca

SEQ ID NO: 5152508 - DNA, 15 bp, Homo sapiens
acggagggaggcacc

SEQ ID NO: 5152509 - DNA, 12 bp, Homo sapiens
acggagggctgg

SEQ ID NO: 5152510 - DNA, 23 bp, Homo sapiens
acggagtcccaccttggctgcag

SEQ ID NO: 5152511 - DNA, 15 bp, Homo sapiens
acggagtggccgggc

SEQ ID NO: 5152512 - DNA, 17 bp, Homo sapiens
acggagtggggggacag

SEQ ID NO: 5152513 - DNA, 23 bp, Homo sapiens
acggagtggggggacagagactc

SEQ ID NO: 5152514 - DNA, 14 bp, Homo sapiens
acggagttcagagg

SEQ ID NO: 5152515 - DNA, 22 bp, Homo sapiens
acggatcctgcactgactctgg

SEQ ID NO: 5152516 - DNA, 15 bp, Homo sapiens
acggatctgagaatc

SEQ ID NO: 5152517 - DNA, 17 bp, Homo sapiens
acggatctgagaatctt

SEQ ID NO: 5152518 - DNA, 16 bp, Homo sapiens
acggatggaaggagag

SEQ ID NO: 5152519 - DNA, 23 bp, Homo sapiens
acggattagggcatttgagaaat

SEQ ID NO: 5152520 - DNA, 16 bp, Homo sapiens
acggattattttttca

SEQ ID NO: 5152521 - DNA, 20 bp, Homo sapiens
acggattattttttcagacc

SEQ ID NO: 5152522 - DNA, 21 bp, Homo sapiens
acggattattttttcagaccg

SEQ ID NO: 5152523 - DNA, 22 bp, Homo sapiens
acggatttagctaacaaaagat

SEQ ID NO: 5152524 - DNA, 22 bp, Homo sapiens
acggatttattatataaatata

SEQ ID NO: 5152525 - DNA, 16 bp, Homo sapiens
acggcaacattcctca

SEQ ID NO: 5152526 - DNA, 15 bp, Homo sapiens
acggcaaccacatgt

SEQ ID NO: 5152527 - DNA, 20 bp, Homo sapiens
acggcaaccacatgtcccag

SEQ ID NO: 5152528 - DNA, 22 bp, Homo sapiens
acggcaaccacatgtcccagat

SEQ ID NO: 5152529 - DNA, 20 bp, Homo sapiens
acggcaacgtagcctgggct

SEQ ID NO: 5152530 - DNA, 21 bp, Homo sapiens
acggcacctgggccctggggc

SEQ ID NO: 5152531 - DNA, 17 bp, Homo sapiens
acggcacgcacttgcct

SEQ ID NO: 5152532 - DNA, 19 bp, Homo sapiens
acggcacgcacttgcctgt

SEQ ID NO: 5152533 - DNA, 18 bp, Homo sapiens
acggcacggtcttccctc

SEQ ID NO: 5152534 - DNA, 20 bp, Homo sapiens
acggcactccagcctgggcg

SEQ ID NO: 5152535 - DNA, 16 bp, Homo sapiens
acggcactgtggcctt

SEQ ID NO: 5152536 - DNA, 19 bp, Homo sapiens
acggcagaaaacagagcct

SEQ ID NO: 5152537 - DNA, 20 bp, Homo sapiens
acggcagagaccccaggatc

SEQ ID NO: 5152538 - DNA, 15 bp, Homo sapiens
acggcagcctcaacc

SEQ ID NO: 5152539 - DNA, 23 bp, Homo sapiens
acggcagctgctggctgtgacaa

SEQ ID NO: 5152540 - DNA, 11 bp, Homo sapiens
acggcagctgt

SEQ ID NO: 5152541 - DNA, 22 bp, Homo sapiens
acggcaggacaacgaggaagcc

SEQ ID NO: 5152542 - DNA, 20 bp, Homo sapiens
acggcaggcgtgtggcagcc

SEQ ID NO: 5152543 - DNA, 23 bp, Homo sapiens
acggcaggcgtgtggcagccaca

SEQ ID NO: 5152544 - DNA, 18 bp, Homo sapiens
acggcaggctcactgcca

SEQ ID NO: 5152545 - DNA, 20 bp, Homo sapiens
acggcaggtggcctaaggct

SEQ ID NO: 5152546 - DNA, 19 bp, Homo sapiens
acggcatcgcatccgtcct

SEQ ID NO: 5152547 - DNA, 22 bp, Homo sapiens
acggcattatgatcccttcccc

SEQ ID NO: 5152548 - DNA, 20 bp, Homo sapiens
acggccaatggtgcttcccc

SEQ ID NO: 5152549 - DNA, 16 bp, Homo sapiens
acggccaccactgcag

SEQ ID NO: 5152550 - DNA, 23 bp, Homo sapiens
acggccacccgccccgcgcaccc

SEQ ID NO: 5152551 - DNA, 11 bp, Homo sapiens
acggccaccct

SEQ ID NO: 5152552 - DNA, 12 bp, Homo sapiens
acggccaccctc

SEQ ID NO: 5152553 - DNA, 20 bp, Homo sapiens
acggccaccctccttcccgc

SEQ ID NO: 5152554 - DNA, 15 bp, Homo sapiens
acggccactggccat

SEQ ID NO: 5152555 - DNA, 22 bp, Homo sapiens
acggccaggaaaagccctcatc

SEQ ID NO: 5152556 - DNA, 13 bp, Homo sapiens
acggccaggcaga

SEQ ID NO: 5152557 - DNA, 22 bp, Homo sapiens
acggccaggctccctgaccacc

SEQ ID NO: 5152558 - DNA, 12 bp, Homo sapiens
acggccagggtt

SEQ ID NO: 5152559 - DNA, 18 bp, Homo sapiens
acggccagggttgtgctt

SEQ ID NO: 5152560 - DNA, 12 bp, Homo sapiens
acggcccaggcc

SEQ ID NO: 5152561 - DNA, 13 bp, Homo sapiens
acggcccagggag

SEQ ID NO: 5152562 - DNA, 14 bp, Homo sapiens
acggcccagggagg

SEQ ID NO: 5152563 - DNA, 18 bp, Homo sapiens
acggccccagcttctcag

SEQ ID NO: 5152564 - DNA, 21 bp, Homo sapiens
acggccccgaagggcccccac

SEQ ID NO: 5152565 - DNA, 16 bp, Homo sapiens
acggccctcctgggaa

SEQ ID NO: 5152566 - DNA, 11 bp, Homo sapiens
acggccctgca

SEQ ID NO: 5152567 - DNA, 17 bp, Homo sapiens
acggccctgcaggagca

SEQ ID NO: 5152568 - DNA, 13 bp, Homo sapiens
acggccctgctgg

SEQ ID NO: 5152569 - DNA, 15 bp, Homo sapiens
acggccgctccaggg

SEQ ID NO: 5152570 - DNA, 14 bp, Homo sapiens
acggccgtccctga

SEQ ID NO: 5152571 - DNA, 21 bp, Homo sapiens
acggccgtccctgacttccca

SEQ ID NO: 5152572 - DNA, 23 bp, Homo sapiens
acggccgtccctgacttcccagc

SEQ ID NO: 5152573 - DNA, 21 bp, Homo sapiens
acggcctaggggtggcgctca

SEQ ID NO: 5152574 - DNA, 13 bp, Homo sapiens
acggcctctgggg

SEQ ID NO: 5152575 - DNA, 18 bp, Homo sapiens
acggcctgatgctccctc

SEQ ID NO: 5152576 - DNA, 19 bp, Homo sapiens
acggcctgatgctccctcc

SEQ ID NO: 5152577 - DNA, 20 bp, Homo sapiens
acggcctgatgctccctccc

SEQ ID NO: 5152578 - DNA, 22 bp, Homo sapiens
acggcctggctggtgggaaggc

SEQ ID NO: 5152579 - DNA, 21 bp, Homo sapiens
acggccttcaactgaaaagac

SEQ ID NO: 5152580 - DNA, 18 bp, Homo sapiens
acggccttcgacctggac

SEQ ID NO: 5152581 - DNA, 17 bp, Homo sapiens
acggccttgatcccctt

SEQ ID NO: 5152582 - DNA, 23 bp, Homo sapiens
acggccttgctgggggccgccct

SEQ ID NO: 5152583 - DNA, 21 bp, Homo sapiens
acggcctttctagcctggcta

SEQ ID NO: 5152584 - DNA, 22 bp, Homo sapiens
acggcgaccaataaacagctcc

SEQ ID NO: 5152585 - DNA, 16 bp, Homo sapiens
acggcgctgcctcagg

SEQ ID NO: 5152586 - DNA, 12 bp, Homo sapiens
acggcggccagg

SEQ ID NO: 5152587 - DNA, 17 bp, Homo sapiens
acggcggcggccctcaa

SEQ ID NO: 5152588 - DNA, 23 bp, Homo sapiens
acggcgggatcctccacagagag

SEQ ID NO: 5152589 - DNA, 16 bp, Homo sapiens
acggctaagaggctgc

SEQ ID NO: 5152590 - DNA, 17 bp, Homo sapiens
acggctaagaggctgct

SEQ ID NO: 5152591 - DNA, 20 bp, Homo sapiens
acggctccgagggcggccag

SEQ ID NO: 5152592 - DNA, 23 bp, Homo sapiens
acggctccgagggcggccaggga

SEQ ID NO: 5152593 - DNA, 15 bp, Homo sapiens
acggctcctcagagc

SEQ ID NO: 5152594 - DNA, 18 bp, Homo sapiens
acggctcctcagagcgcc

SEQ ID NO: 5152595 - DNA, 13 bp, Homo sapiens
acggctctccaga

SEQ ID NO: 5152596 - DNA, 22 bp, Homo sapiens
acggctctcgtccctctgctcc

SEQ ID NO: 5152597 - DNA, 20 bp, Homo sapiens
acggctctgtccccagcctg

SEQ ID NO: 5152598 - DNA, 16 bp, Homo sapiens
acggctgagccttcag

SEQ ID NO: 5152599 - DNA, 16 bp, Homo sapiens
acggctgatgtggact

SEQ ID NO: 5152600 - DNA, 16 bp, Homo sapiens
acggctgcgcactgtg

SEQ ID NO: 5152601 - DNA, 12 bp, Homo sapiens
acggctgctgca

SEQ ID NO: 5152602 - DNA, 15 bp, Homo sapiens
acggctggacctgca

SEQ ID NO: 5152603 - DNA, 21 bp, Homo sapiens
acggctggcatggtggctccc

SEQ ID NO: 5152604 - DNA, 16 bp, Homo sapiens
acggctggggacccac

SEQ ID NO: 5152605 - DNA, 16 bp, Homo sapiens
acggctggtcactctg

SEQ ID NO: 5152606 - DNA, 21 bp, Homo sapiens
acggctggtcactctgccctc

SEQ ID NO: 5152607 - DNA, 19 bp, Homo sapiens
acggctgtgacgcagccgg

SEQ ID NO: 5152608 - DNA, 17 bp, Homo sapiens
acggctgtgggaccagg

SEQ ID NO: 5152609 - DNA, 14 bp, Homo sapiens
acggctgtgtattt

SEQ ID NO: 5152610 - DNA, 17 bp, Homo sapiens
acggctgtgtatttctg

SEQ ID NO: 5152611 - DNA, 19 bp, Homo sapiens
acggctgtgtatttctgta

SEQ ID NO: 5152612 - DNA, 21 bp, Homo sapiens
acggctgttcccctcacccaa

SEQ ID NO: 5152613 - DNA, 23 bp, Homo sapiens
acggctgttcccctcacccaaaa

SEQ ID NO: 5152614 - DNA, 22 bp, Homo sapiens
acggcttccccatcgccttctg

SEQ ID NO: 5152615 - DNA, 16 bp, Homo sapiens
acggcttctcatgcta

SEQ ID NO: 5152616 - DNA, 20 bp, Homo sapiens
acggcttgtgggcactgtgc

SEQ ID NO: 5152617 - DNA, 22 bp, Homo sapiens
acggcttgtgggcactgtgcca

SEQ ID NO: 5152618 - DNA, 13 bp, Homo sapiens
acgggaaaggaaa

SEQ ID NO: 5152619 - DNA, 15 bp, Homo sapiens
acgggaagcaacctc

SEQ ID NO: 5152620 - DNA, 22 bp, Homo sapiens
acgggaagcctccgtcaggaga

SEQ ID NO: 5152621 - DNA, 17 bp, Homo sapiens
acgggaagtttagagag

SEQ ID NO: 5152622 - DNA, 15 bp, Homo sapiens
acgggaatgcctagg

SEQ ID NO: 5152623 - DNA, 16 bp, Homo sapiens
acgggaatgcctaggt

SEQ ID NO: 5152624 - DNA, 14 bp, Homo sapiens
acgggacagcggcc

SEQ ID NO: 5152625 - DNA, 17 bp, Homo sapiens
acgggacagcggcccgg

SEQ ID NO: 5152626 - DNA, 15 bp, Homo sapiens
acgggaccagctcac

SEQ ID NO: 5152627 - DNA, 21 bp, Homo sapiens
acgggacccacatgctccaga

SEQ ID NO: 5152628 - DNA, 21 bp, Homo sapiens
acgggaccctgcccagagctg

SEQ ID NO: 5152629 - DNA, 23 bp, Homo sapiens
acgggaccctgcccagagctgag

SEQ ID NO: 5152630 - DNA, 13 bp, Homo sapiens
acgggaccgggcc

SEQ ID NO: 5152631 - DNA, 17 bp, Homo sapiens
acgggacgcggcaggct

SEQ ID NO: 5152632 - DNA, 19 bp, Homo sapiens
acgggagagcgccacccgc

SEQ ID NO: 5152633 - DNA, 21 bp, Homo sapiens
acgggagagcgccacccgccc

SEQ ID NO: 5152634 - DNA, 18 bp, Homo sapiens
acgggagcattggcccct

SEQ ID NO: 5152635 - DNA, 14 bp, Homo sapiens
acgggagcctcctc

SEQ ID NO: 5152636 - DNA, 22 bp, Homo sapiens
acgggaggaatcttttactgtg

SEQ ID NO: 5152637 - DNA, 21 bp, Homo sapiens
acgggaggccccagctctgag

SEQ ID NO: 5152638 - DNA, 22 bp, Homo sapiens
acgggaggccccagctctgagg

SEQ ID NO: 5152639 - DNA, 13 bp, Homo sapiens
acgggaggggagg

SEQ ID NO: 5152640 - DNA, 18 bp, Homo sapiens
acgggagtggccatctgg

SEQ ID NO: 5152641 - DNA, 22 bp, Homo sapiens
acgggagtggccatctggaaat

SEQ ID NO: 5152642 - DNA, 17 bp, Homo sapiens
acgggatgacctccaga

SEQ ID NO: 5152643 - DNA, 22 bp, Homo sapiens
acgggatggttctggctgtttg

SEQ ID NO: 5152644 - DNA, 16 bp, Homo sapiens
acgggcaagaagctgc

SEQ ID NO: 5152645 - DNA, 23 bp, Homo sapiens
acgggcaagtgagaggggaggga

SEQ ID NO: 5152646 - DNA, 16 bp, Homo sapiens
acgggcacacagactg

SEQ ID NO: 5152647 - DNA, 10 bp, Homo sapiens
acgggcacag

SEQ ID NO: 5152648 - DNA, 12 bp, Homo sapiens
acgggcagccac

SEQ ID NO: 5152649 - DNA, 14 bp, Homo sapiens
acgggcagccacag

SEQ ID NO: 5152650 - DNA, 15 bp, Homo sapiens
acgggcagccacagg

SEQ ID NO: 5152651 - DNA, 17 bp, Homo sapiens
acgggcagcctggctcc

SEQ ID NO: 5152652 - DNA, 15 bp, Homo sapiens
acgggcagcctgggc

SEQ ID NO: 5152653 - DNA, 14 bp, Homo sapiens
acctgtcagaataa

SEQ ID NO: 5152654 - DNA, 23 bp, Homo sapiens
acctgtcagaataaaaatgtggt

SEQ ID NO: 5152655 - DNA, 15 bp, Homo sapiens
acctgtcatctgggc

SEQ ID NO: 5152656 - DNA, 17 bp, Homo sapiens
acctgtcatgcccccct

SEQ ID NO: 5152657 - DNA, 14 bp, Homo sapiens
acctgtcatgtgcg

SEQ ID NO: 5152658 - DNA, 14 bp, Homo sapiens
acctgtcattgtat

SEQ ID NO: 5152659 - DNA, 16 bp, Homo sapiens
acctgtccaagacagg

SEQ ID NO: 5152660 - DNA, 15 bp, Homo sapiens
acctgtccataaagt

SEQ ID NO: 5152661 - DNA, 13 bp, Homo sapiens
acctgtcccacct

SEQ ID NO: 5152662 - DNA, 15 bp, Homo sapiens
acctgtcccacctca

SEQ ID NO: 5152663 - DNA, 22 bp, Homo sapiens
acctgtccccaccctccactca

SEQ ID NO: 5152664 - DNA, 15 bp, Homo sapiens
acctgtcccccactc

SEQ ID NO: 5152665 - DNA, 12 bp, Homo sapiens
acctgtccccct

SEQ ID NO: 5152666 - DNA, 16 bp, Homo sapiens
acctgtccccctgaca

SEQ ID NO: 5152667 - DNA, 23 bp, Homo sapiens
acctgtcccctatgccactaagc

SEQ ID NO: 5152668 - DNA, 20 bp, Homo sapiens
acctgtccggcccagtgcca

SEQ ID NO: 5152669 - DNA, 15 bp, Homo sapiens
acctgtcctgtcttt

SEQ ID NO: 5152670 - DNA, 16 bp, Homo sapiens
acctgtcctgtctttg

SEQ ID NO: 5152671 - DNA, 13 bp, Homo sapiens
acctgtccttctc

SEQ ID NO: 5152672 - DNA, 20 bp, Homo sapiens
acctgtcgtctctcccaccc

SEQ ID NO: 5152673 - DNA, 17 bp, Homo sapiens
acctgtctatactacag

SEQ ID NO: 5152674 - DNA, 14 bp, Homo sapiens
acctgtctcagcct

SEQ ID NO: 5152675 - DNA, 15 bp, Homo sapiens
acctgtctccctggg

SEQ ID NO: 5152676 - DNA, 14 bp, Homo sapiens
acctgtctcctccc

SEQ ID NO: 5152677 - DNA, 17 bp, Homo sapiens
acctgtctcctttctca

SEQ ID NO: 5152678 - DNA, 12 bp, Homo sapiens
acctgtctctct

SEQ ID NO: 5152679 - DNA, 15 bp, Homo sapiens
acctgtctctctctt

SEQ ID NO: 5152680 - DNA, 18 bp, Homo sapiens
acctgtctctctcttctc

SEQ ID NO: 5152681 - DNA, 13 bp, Homo sapiens
acctgtctgctcc

SEQ ID NO: 5152682 - DNA, 11 bp, Homo sapiens
acctgtctgtc

SEQ ID NO: 5152683 - DNA, 20 bp, Homo sapiens
acctgtcttattaagactgg

SEQ ID NO: 5152684 - DNA, 17 bp, Homo sapiens
acctgtcttccaaggag

SEQ ID NO: 5152685 - DNA, 19 bp, Homo sapiens
acctgtcttccaaggagac

SEQ ID NO: 5152686 - DNA, 14 bp, Homo sapiens
acctgtcttggcct

SEQ ID NO: 5152687 - DNA, 17 bp, Homo sapiens
acctgtcttttgggagt

SEQ ID NO: 5152688 - DNA, 15 bp, Homo sapiens
acctgtgaagctgaa

SEQ ID NO: 5152689 - DNA, 17 bp, Homo sapiens
acctgtgaagctgaaaa

SEQ ID NO: 5152690 - DNA, 13 bp, Homo sapiens
acctgtgacaaag

SEQ ID NO: 5152691 - DNA, 18 bp, Homo sapiens
acctgtgacaaaggatga

SEQ ID NO: 5152692 - DNA, 23 bp, Homo sapiens
acctgtgaccagcactgtctcag

SEQ ID NO: 5152693 - DNA, 13 bp, Homo sapiens
acctgtgacctgg

SEQ ID NO: 5152694 - DNA, 16 bp, Homo sapiens
acctgtgacctggtct

SEQ ID NO: 5152695 - DNA, 17 bp, Homo sapiens
acctgtgacctggtctg

SEQ ID NO: 5152696 - DNA, 16 bp, Homo sapiens
acctgtgactcctgtt

SEQ ID NO: 5152697 - DNA, 19 bp, Homo sapiens
acctgtgagaaaggaaaaa

SEQ ID NO: 5152698 - DNA, 20 bp, Homo sapiens
acctgtgagaaaggaaaaat

SEQ ID NO: 5152699 - DNA, 23 bp, Homo sapiens
acctgtgagctgcaccaggtaga

SEQ ID NO: 5152700 - DNA, 14 bp, Homo sapiens
acctgtgaggggaa

SEQ ID NO: 5152701 - DNA, 16 bp, Homo sapiens
acctgtgagtaaatat

SEQ ID NO: 5152702 - DNA, 18 bp, Homo sapiens
acctgtgagtttaaagca

SEQ ID NO: 5152703 - DNA, 19 bp, Homo sapiens
acctgtgatgaggggagga

SEQ ID NO: 5152704 - DNA, 13 bp, Homo sapiens
acctgtgatttct

SEQ ID NO: 5152705 - DNA, 12 bp, Homo sapiens
acctgtgcacct

SEQ ID NO: 5152706 - DNA, 14 bp, Homo sapiens
acctgtgccaggct

SEQ ID NO: 5152707 - DNA, 15 bp, Homo sapiens
acctgtgccctcacc

SEQ ID NO: 5152708 - DNA, 10 bp, Homo sapiens
acctgtgcct

SEQ ID NO: 5152709 - DNA, 23 bp, Homo sapiens
acctgtgcctccctctcctcgga

SEQ ID NO: 5152710 - DNA, 19 bp, Homo sapiens
acctgtgcctgagaattta

SEQ ID NO: 5152711 - DNA, 13 bp, Homo sapiens
acctgtgctacct

SEQ ID NO: 5152712 - DNA, 21 bp, Homo sapiens
acctgtgctagttttacagat

SEQ ID NO: 5152713 - DNA, 22 bp, Homo sapiens
acctgtgcttcgggcccttccc

SEQ ID NO: 5152714 - DNA, 13 bp, Homo sapiens
acctgtgctttca

SEQ ID NO: 5152715 - DNA, 13 bp, Homo sapiens
acctgtgctttga

SEQ ID NO: 5152716 - DNA, 23 bp, Homo sapiens
acctgtggaacataaaaaggaca

SEQ ID NO: 5152717 - DNA, 19 bp, Homo sapiens
acctgtggataaaacatta

SEQ ID NO: 5152718 - DNA, 19 bp, Homo sapiens
acctgtggccaagttctta

SEQ ID NO: 5152719 - DNA, 17 bp, Homo sapiens
acctgtggctcagggga

SEQ ID NO: 5152720 - DNA, 12 bp, Homo sapiens
acctgtgggctg

SEQ ID NO: 5152721 - DNA, 19 bp, Homo sapiens
acctgtggggatttctccc

SEQ ID NO: 5152722 - DNA, 21 bp, Homo sapiens
acctgtggggatttctcccag

SEQ ID NO: 5152723 - DNA, 22 bp, Homo sapiens
acctgtggggatttctcccagc

SEQ ID NO: 5152724 - DNA, 12 bp, Homo sapiens
acctgtgggtgt

SEQ ID NO: 5152725 - DNA, 13 bp, Homo sapiens
acctgtgggtgta

SEQ ID NO: 5152726 - DNA, 16 bp, Homo sapiens
acctgtgtacataact

SEQ ID NO: 5152727 - DNA, 13 bp, Homo sapiens
acctgtgtagtct

SEQ ID NO: 5152728 - DNA, 20 bp, Homo sapiens
acctgtgtatggtgacctct

SEQ ID NO: 5152729 - DNA, 18 bp, Homo sapiens
acctgtgtattttttaaa

SEQ ID NO: 5152730 - DNA, 20 bp, Homo sapiens
acctgtgtccaagaactcta

SEQ ID NO: 5152731 - DNA, 11 bp, Homo sapiens
acctgtgtctc

SEQ ID NO: 5152732 - DNA, 20 bp, Homo sapiens
acctgtgtctgcgaagtcct

SEQ ID NO: 5152733 - DNA, 16 bp, Homo sapiens
acctgtgtgagagaat

SEQ ID NO: 5152734 - DNA, 17 bp, Homo sapiens
acctgtgtgcccagcac

SEQ ID NO: 5152735 - DNA, 19 bp, Homo sapiens
acctgtgtgcccagcacct

SEQ ID NO: 5152736 - DNA, 11 bp, Homo sapiens
acctgtgtgct

SEQ ID NO: 5152737 - DNA, 20 bp, Homo sapiens
acctgtgtttcttgcctcat

SEQ ID NO: 5152738 - DNA, 22 bp, Homo sapiens
acctgttaaaacaaccagttaa

SEQ ID NO: 5152739 - DNA, 19 bp, Homo sapiens
acctgttaaaatgtacact

SEQ ID NO: 5152740 - DNA, 18 bp, Homo sapiens
acctgttacactgggctg

SEQ ID NO: 5152741 - DNA, 17 bp, Homo sapiens
acctgttacctactttg

SEQ ID NO: 5152742 - DNA, 19 bp, Homo sapiens
acctgttagctccctgtgg

SEQ ID NO: 5152743 - DNA, 19 bp, Homo sapiens
acctgttatatatctcttt

SEQ ID NO: 5152744 - DNA, 21 bp, Homo sapiens
acctgttatgccaaacagttg

SEQ ID NO: 5152745 - DNA, 19 bp, Homo sapiens
acctgttatggaaaatgtc

SEQ ID NO: 5152746 - DNA, 15 bp, Homo sapiens
acctgttatttatca

SEQ ID NO: 5152747 - DNA, 18 bp, Homo sapiens
acctgttcaaaatgttaa

SEQ ID NO: 5152748 - DNA, 15 bp, Homo sapiens
acctgttcacagaaa

SEQ ID NO: 5152749 - DNA, 19 bp, Homo sapiens
acctgttctctagttttcc

SEQ ID NO: 5152750 - DNA, 15 bp, Homo sapiens
acctgttctgtagct

SEQ ID NO: 5152751 - DNA, 16 bp, Homo sapiens
acctgttctgtagctt

SEQ ID NO: 5152752 - DNA, 16 bp, Homo sapiens
acctgttcttgggcct

SEQ ID NO: 5152753 - DNA, 14 bp, Homo sapiens
acctgttgaagatt

SEQ ID NO: 5152754 - DNA, 15 bp, Homo sapiens
acctgttgcacctca

SEQ ID NO: 5152755 - DNA, 17 bp, Homo sapiens
acctgttgccagcagat

SEQ ID NO: 5152756 - DNA, 19 bp, Homo sapiens
acctgttgctgtgtttaat

SEQ ID NO: 5152757 - DNA, 21 bp, Homo sapiens
acctgttgcttacaatttttt

SEQ ID NO: 5152758 - DNA, 14 bp, Homo sapiens
acctgttggcctgt

SEQ ID NO: 5152759 - DNA, 22 bp, Homo sapiens
acctgttgtcctgaactgtgag

SEQ ID NO: 5152760 - DNA, 16 bp, Homo sapiens
acctgtttaaattgct

SEQ ID NO: 5152761 - DNA, 13 bp, Homo sapiens
acctgtttatata

SEQ ID NO: 5152762 - DNA, 19 bp, Homo sapiens
acctgtttcaccagtgttt

SEQ ID NO: 5152763 - DNA, 21 bp, Homo sapiens
acctgtttcataagctttgta

SEQ ID NO: 5152764 - DNA, 18 bp, Homo sapiens
acctgtttcttgtaactg

SEQ ID NO: 5152765 - DNA, 13 bp, Homo sapiens
acctgttttctga

SEQ ID NO: 5152766 - DNA, 19 bp, Homo sapiens
acctgttttctgaaacaca

SEQ ID NO: 5152767 - DNA, 21 bp, Homo sapiens
acctgttttctgactagttta

SEQ ID NO: 5152768 - DNA, 19 bp, Homo sapiens
acctgttttgcttttgtaa

SEQ ID NO: 5152769 - DNA, 18 bp, Homo sapiens
acctgttttgttaatgct

SEQ ID NO: 5152770 - DNA, 15 bp, Homo sapiens
acctgtttttaacat

SEQ ID NO: 5152771 - DNA, 16 bp, Homo sapiens
acctgtttttaagctg

SEQ ID NO: 5152772 - DNA, 19 bp, Homo sapiens
acctgtttttaagctgttt

SEQ ID NO: 5152773 - DNA, 20 bp, Homo sapiens
acctgtttttaagctgtttc

SEQ ID NO: 5152774 - DNA, 17 bp, Homo sapiens
acctgtttttttttcat

SEQ ID NO: 5152775 - DNA, 18 bp, Homo sapiens
acctgtttttttttcatt

SEQ ID NO: 5152776 - DNA, 13 bp, Homo sapiens
accttaaaaagta

SEQ ID NO: 5152777 - DNA, 22 bp, Homo sapiens
accttaaaagtaataaagagaa

SEQ ID NO: 5152778 - DNA, 13 bp, Homo sapiens
accttaaaatttg

SEQ ID NO: 5152779 - DNA, 20 bp, Homo sapiens
accttaaaatttgaaacatt

SEQ ID NO: 5152780 - DNA, 21 bp, Homo sapiens
accttaaaatttgaaacattg

SEQ ID NO: 5152781 - DNA, 22 bp, Homo sapiens
accttaaatacactgaattgaa

SEQ ID NO: 5152782 - DNA, 19 bp, Homo sapiens
accttaaattaaacaattt

SEQ ID NO: 5152783 - DNA, 15 bp, Homo sapiens
accttaactggagac

SEQ ID NO: 5152784 - DNA, 16 bp, Homo sapiens
accttaaggaaaagta

SEQ ID NO: 5152785 - DNA, 22 bp, Homo sapiens
accttaagtaagcaacagcata

SEQ ID NO: 5152786 - DNA, 18 bp, Homo sapiens
accttaatattattgggg

SEQ ID NO: 5152787 - DNA, 13 bp, Homo sapiens
accttaatgacaa

SEQ ID NO: 5152788 - DNA, 22 bp, Homo sapiens
accttaattattgcactagaga

SEQ ID NO: 5152789 - DNA, 14 bp, Homo sapiens
accttaatttaact

SEQ ID NO: 5152790 - DNA, 22 bp, Homo sapiens
accttaatttaactttccagtc

SEQ ID NO: 5152791 - DNA, 20 bp, Homo sapiens
accttacaaagccagctctg

SEQ ID NO: 5152792 - DNA, 20 bp, Homo sapiens
accttacaaccacatttctg

SEQ ID NO: 5152793 - DNA, 12 bp, Homo sapiens
accttacattcc

SEQ ID NO: 5152794 - DNA, 13 bp, Homo sapiens
accttacattcct

SEQ ID NO: 5152795 - DNA, 15 bp, Homo sapiens
accttaccaactttc

SEQ ID NO: 5152796 - DNA, 16 bp, Homo sapiens
accttaccaactttct

SEQ ID NO: 5152797 - DNA, 19 bp, Homo sapiens
accttaccaactttctgta

SEQ ID NO: 5152798 - DNA, 14 bp, Homo sapiens
accttacccctggc

SEQ ID NO: 5152799 - DNA, 16 bp, Homo sapiens
accttaccctactggc

SEQ ID NO: 5152800 - DNA, 17 bp, Homo sapiens
accttacgatcaggcac

SEQ ID NO: 5152801 - DNA, 13 bp, Homo sapiens
accttactaatta

SEQ ID NO: 5152802 - DNA, 14 bp, Homo sapiens
accttactctgagc

SEQ ID NO: 5152803 - DNA, 16 bp, Homo sapiens
accttactggcactgt

SEQ ID NO: 5152804 - DNA, 19 bp, Homo sapiens
accttactggcactgtggc

SEQ ID NO: 5152805 - DNA, 15 bp, Homo sapiens
accttactgtggagg

SEQ ID NO: 5152806 - DNA, 16 bp, Homo sapiens
accttacttacagcat

SEQ ID NO: 5152807 - DNA, 21 bp, Homo sapiens
accttagaaggtattaagatt

SEQ ID NO: 5152808 - DNA, 14 bp, Homo sapiens
accttagaatacag

SEQ ID NO: 5152809 - DNA, 18 bp, Homo sapiens
accttagacagtccctgc

SEQ ID NO: 5152810 - DNA, 19 bp, Homo sapiens
accttagacagtccctgcc

SEQ ID NO: 5152811 - DNA, 18 bp, Homo sapiens
accttagaccaccaagcc

SEQ ID NO: 5152812 - DNA, 19 bp, Homo sapiens
accttagaccaccaagcct

SEQ ID NO: 5152813 - DNA, 21 bp, Homo sapiens
accttagaccaccaagccttg

SEQ ID NO: 5152814 - DNA, 19 bp, Homo sapiens
accttagacggaggtgcct

SEQ ID NO: 5152815 - DNA, 18 bp, Homo sapiens
accttagataatatttct

SEQ ID NO: 5152816 - DNA, 18 bp, Homo sapiens
accttagcgttctggact

SEQ ID NO: 5152817 - DNA, 13 bp, Homo sapiens
accttagctccct

SEQ ID NO: 5152818 - DNA, 21 bp, Homo sapiens
accttagctggcattacagct

SEQ ID NO: 5152819 - DNA, 22 bp, Homo sapiens
accttagctggcattacagctg

SEQ ID NO: 5152820 - DNA, 13 bp, Homo sapiens
accttaggcaggg

SEQ ID NO: 5152821 - DNA, 16 bp, Homo sapiens
accttaggcagggaag

SEQ ID NO: 5152822 - DNA, 18 bp, Homo sapiens
accttaggccttcctctc

SEQ ID NO: 5152823 - DNA, 13 bp, Homo sapiens
accttagggaaga

SEQ ID NO: 5152824 - DNA, 21 bp, Homo sapiens
accttagggtggctttaattg

SEQ ID NO: 5152825 - DNA, 16 bp, Homo sapiens
accttaggttctttct

SEQ ID NO: 5152826 - DNA, 23 bp, Homo sapiens
accttagtccgcaagttcaggga

SEQ ID NO: 5152827 - DNA, 13 bp, Homo sapiens
accttagtgagtt

SEQ ID NO: 5152828 - DNA, 17 bp, Homo sapiens
accttagtgcagttatt

SEQ ID NO: 5152829 - DNA, 19 bp, Homo sapiens
accttagtgtttctgtgca

SEQ ID NO: 5152830 - DNA, 22 bp, Homo sapiens
accttagtgtttctgtgcatgg

SEQ ID NO: 5152831 - DNA, 19 bp, Homo sapiens
accttatacatcacttcct

SEQ ID NO: 5152832 - DNA, 22 bp, Homo sapiens
accttatacatcacttcctgtt

SEQ ID NO: 5152833 - DNA, 14 bp, Homo sapiens
acgggcatgggcct

SEQ ID NO: 5152834 - DNA, 19 bp, Homo sapiens
acgggcatgggcctctctg

SEQ ID NO: 5152835 - DNA, 23 bp, Homo sapiens
acgggcatgggcctctctggggg

SEQ ID NO: 5152836 - DNA, 17 bp, Homo sapiens
acgggcattcacaaccc

SEQ ID NO: 5152837 - DNA, 11 bp, Homo sapiens
acgggccaggc

SEQ ID NO: 5152838 - DNA, 16 bp, Homo sapiens
acgggcccgggttggg

SEQ ID NO: 5152839 - DNA, 17 bp, Homo sapiens
acgggcccgggttgggt

SEQ ID NO: 5152840 - DNA, 18 bp, Homo sapiens
acgggccctccctcccag

SEQ ID NO: 5152841 - DNA, 19 bp, Homo sapiens
acgggccctccctcccagc

SEQ ID NO: 5152842 - DNA, 11 bp, Homo sapiens
acgggccctgc

SEQ ID NO: 5152843 - DNA, 13 bp, Homo sapiens
acgggccgcagga

SEQ ID NO: 5152844 - DNA, 15 bp, Homo sapiens
acgggccggccagct

SEQ ID NO: 5152845 - DNA, 20 bp, Homo sapiens
acgggcctctgcttgccagc

SEQ ID NO: 5152846 - DNA, 16 bp, Homo sapiens
acgggcgctgcagcct

SEQ ID NO: 5152847 - DNA, 20 bp, Homo sapiens
acgggcgctgcagcctccct

SEQ ID NO: 5152848 - DNA, 16 bp, Homo sapiens
acgggcggtcctgcac

SEQ ID NO: 5152849 - DNA, 19 bp, Homo sapiens
acgggcggtcctgcacaga

SEQ ID NO: 5152850 - DNA, 20 bp, Homo sapiens
acgggctcagcagccagagg

SEQ ID NO: 5152851 - DNA, 18 bp, Homo sapiens
acgggctccttcccctgc

SEQ ID NO: 5152852 - DNA, 21 bp, Homo sapiens
acgggctgtccgtgtgcctcc

SEQ ID NO: 5152853 - DNA, 14 bp, Homo sapiens
acggggacacggcc

SEQ ID NO: 5152854 - DNA, 22 bp, Homo sapiens
acggggaccactgggcccctca

SEQ ID NO: 5152855 - DNA, 15 bp, Homo sapiens
acggggactcagccc

SEQ ID NO: 5152856 - DNA, 13 bp, Homo sapiens
acggggaggggga

SEQ ID NO: 5152857 - DNA, 18 bp, Homo sapiens
acggggagtgagactcct

SEQ ID NO: 5152858 - DNA, 19 bp, Homo sapiens
acggggatcatctctgtga

SEQ ID NO: 5152859 - DNA, 22 bp, Homo sapiens
acggggatggttccccaggagg

SEQ ID NO: 5152860 - DNA, 19 bp, Homo sapiens
acggggcagtactcctccc

SEQ ID NO: 5152861 - DNA, 23 bp, Homo sapiens
acggggcagttagagcagcctcg

SEQ ID NO: 5152862 - DNA, 18 bp, Homo sapiens
acggggcccgccccaggc

SEQ ID NO: 5152863 - DNA, 21 bp, Homo sapiens
acggggcccttacctgtgacc

SEQ ID NO: 5152864 - DNA, 19 bp, Homo sapiens
acggggcgggccctgcctg

SEQ ID NO: 5152865 - DNA, 22 bp, Homo sapiens
acggggcgggccctgcctgagg

SEQ ID NO: 5152866 - DNA, 17 bp, Homo sapiens
acggggctcactctggc

SEQ ID NO: 5152867 - DNA, 19 bp, Homo sapiens
acggggctcactctggccc

SEQ ID NO: 5152868 - DNA, 22 bp, Homo sapiens
acggggctcccctggacagagg

SEQ ID NO: 5152869 - DNA, 21 bp, Homo sapiens
acgggggagtgagacaggctg

SEQ ID NO: 5152870 - DNA, 12 bp, Homo sapiens
acgggggcagtg

SEQ ID NO: 5152871 - DNA, 14 bp, Homo sapiens
acgggggctgcttc

SEQ ID NO: 5152872 - DNA, 16 bp, Homo sapiens
acgggggctgcttctc

SEQ ID NO: 5152873 - DNA, 17 bp, Homo sapiens
acgggggctgcttctcc

SEQ ID NO: 5152874 - DNA, 18 bp, Homo sapiens
acgggggctgtggctctg

SEQ ID NO: 5152875 - DNA, 16 bp, Homo sapiens
acggggggccccagtc

SEQ ID NO: 5152876 - DNA, 15 bp, Homo sapiens
acggggggctcctgc

SEQ ID NO: 5152877 - DNA, 12 bp, Homo sapiens
acgggggtggga

SEQ ID NO: 5152878 - DNA, 21 bp, Homo sapiens
acggggtcgggggaggagcac

SEQ ID NO: 5152879 - DNA, 16 bp, Homo sapiens
acggggtggggagggt

SEQ ID NO: 5152880 - DNA, 15 bp, Homo sapiens
acggggttccctcct

SEQ ID NO: 5152881 - DNA, 13 bp, Homo sapiens
acggggtttcacc

SEQ ID NO: 5152882 - DNA, 18 bp, Homo sapiens
acgggtctgagactgaaa

SEQ ID NO: 5152883 - DNA, 12 bp, Homo sapiens
acgggtctgtgg

SEQ ID NO: 5152884 - DNA, 18 bp, Homo sapiens
acgggtgggcggctggag

SEQ ID NO: 5152885 - DNA, 21 bp, Homo sapiens
acgggtgtcacggccaggcag

SEQ ID NO: 5152886 - DNA, 12 bp, Homo sapiens
acgggtgtggct

SEQ ID NO: 5152887 - DNA, 23 bp, Homo sapiens
acgggttcaccatgttgcccagg

SEQ ID NO: 5152888 - DNA, 16 bp, Homo sapiens
acgggttgaaagacat

SEQ ID NO: 5152889 - DNA, 22 bp, Homo sapiens
acgggttgaaagacatcaatga

SEQ ID NO: 5152890 - DNA, 17 bp, Homo sapiens
acggtattatgcttctt

SEQ ID NO: 5152891 - DNA, 20 bp, Homo sapiens
acggtattatgcttcttgga

SEQ ID NO: 5152892 - DNA, 20 bp, Homo sapiens
acggtcacacctcactgtca

SEQ ID NO: 5152893 - DNA, 19 bp, Homo sapiens
acggtcacacggccacccg

SEQ ID NO: 5152894 - DNA, 20 bp, Homo sapiens
acggtcacacggccacccgc

SEQ ID NO: 5152895 - DNA, 21 bp, Homo sapiens
acggtcatgatgtctgcaaag

SEQ ID NO: 5152896 - DNA, 17 bp, Homo sapiens
acggtccaatccagcct

SEQ ID NO: 5152897 - DNA, 15 bp, Homo sapiens
acggtccccacccct

SEQ ID NO: 5152898 - DNA, 15 bp, Homo sapiens
acggtccgcggcctg

SEQ ID NO: 5152899 - DNA, 16 bp, Homo sapiens
acggtcgccacctggc

SEQ ID NO: 5152900 - DNA, 19 bp, Homo sapiens
acggtctggcagggcagca

SEQ ID NO: 5152901 - DNA, 15 bp, Homo sapiens
acggtgaaatccagg

SEQ ID NO: 5152902 - DNA, 16 bp, Homo sapiens
acggtgaaatccaggt

SEQ ID NO: 5152903 - DNA, 16 bp, Homo sapiens
acggtgaaggtgacag

SEQ ID NO: 5152904 - DNA, 16 bp, Homo sapiens
acggtgaatggctttg

SEQ ID NO: 5152905 - DNA, 19 bp, Homo sapiens
acggtgaatggctttgtat

SEQ ID NO: 5152906 - DNA, 20 bp, Homo sapiens
acggtgaatggctttgtata

SEQ ID NO: 5152907 - DNA, 18 bp, Homo sapiens
acggtgacacaggtcagg

SEQ ID NO: 5152908 - DNA, 23 bp, Homo sapiens
acggtgacacaggtcagggctca

SEQ ID NO: 5152909 - DNA, 23 bp, Homo sapiens
acggtgacagtgacgtgactcag

SEQ ID NO: 5152910 - DNA, 16 bp, Homo sapiens
acggtgagactctgag

SEQ ID NO: 5152911 - DNA, 14 bp, Homo sapiens
acggtgagggtgcg

SEQ ID NO: 5152912 - DNA, 17 bp, Homo sapiens
acggtgccaagggcccc

SEQ ID NO: 5152913 - DNA, 18 bp, Homo sapiens
acggtgcgtggctgtggc

SEQ ID NO: 5152914 - DNA, 20 bp, Homo sapiens
acggtgcgtggctgtggcac

SEQ ID NO: 5152915 - DNA, 15 bp, Homo sapiens
acggtgctccaggca

SEQ ID NO: 5152916 - DNA, 18 bp, Homo sapiens
acggtgctccaggcaggc

SEQ ID NO: 5152917 - DNA, 22 bp, Homo sapiens
acggtgctccaggcaggctaag

SEQ ID NO: 5152918 - DNA, 20 bp, Homo sapiens
acggtgctcgcttctcctcc

SEQ ID NO: 5152919 - DNA, 19 bp, Homo sapiens
acggtgctgtgagggaggg

SEQ ID NO: 5152920 - DNA, 23 bp, Homo sapiens
acggtggagaagatcgcatggca

SEQ ID NO: 5152921 - DNA, 18 bp, Homo sapiens
acggtggctcacgcctgt

SEQ ID NO: 5152922 - DNA, 21 bp, Homo sapiens
acggtggggcgtagacttgac

SEQ ID NO: 5152923 - DNA, 21 bp, Homo sapiens
acggtgggggtagggggctgg

SEQ ID NO: 5152924 - DNA, 21 bp, Homo sapiens
acggtggtcggtgggaccctg

SEQ ID NO: 5152925 - DNA, 20 bp, Homo sapiens
acggtgttaattttgctaac

SEQ ID NO: 5152926 - DNA, 14 bp, Homo sapiens
acggtgttgcagag

SEQ ID NO: 5152927 - DNA, 15 bp, Homo sapiens
acggttaacttgtat

SEQ ID NO: 5152928 - DNA, 17 bp, Homo sapiens
acggttaacttgtatat

SEQ ID NO: 5152929 - DNA, 20 bp, Homo sapiens
acggttaacttgtatattcc

SEQ ID NO: 5152930 - DNA, 15 bp, Homo sapiens
acggttatttcctgc

SEQ ID NO: 5152931 - DNA, 17 bp, Homo sapiens
acggttcctacacagga

SEQ ID NO: 5152932 - DNA, 18 bp, Homo sapiens
acggttcctacacaggac

SEQ ID NO: 5152933 - DNA, 12 bp, Homo sapiens
acggttcctggt

SEQ ID NO: 5152934 - DNA, 21 bp, Homo sapiens
acggttgctaaattataaaat

SEQ ID NO: 5152935 - DNA, 22 bp, Homo sapiens
acggttgctaaattataaaatt

SEQ ID NO: 5152936 - DNA, 20 bp, Homo sapiens
acggtttaactgtcccagcg

SEQ ID NO: 5152937 - DNA, 18 bp, Homo sapiens
acggtttcgaagtcatta

SEQ ID NO: 5152938 - DNA, 14 bp, Homo sapiens
acggtttctccccg

SEQ ID NO: 5152939 - DNA, 18 bp, Homo sapiens
acggttttaaatgtgttg

SEQ ID NO: 5152940 - DNA, 15 bp, Homo sapiens
acggttttactgcag

SEQ ID NO: 5152941 - DNA, 17 bp, Homo sapiens
acggttttggcagctga

SEQ ID NO: 5152942 - DNA, 13 bp, Homo sapiens
acgtaaaacattt

SEQ ID NO: 5152943 - DNA, 21 bp, Homo sapiens
acgtaaaatttacagtcaatc

SEQ ID NO: 5152944 - DNA, 20 bp, Homo sapiens
acgtaaacttcagtgtccca

SEQ ID NO: 5152945 - DNA, 19 bp, Homo sapiens
acgtaaagaaaatcataaa

SEQ ID NO: 5152946 - DNA, 15 bp, Homo sapiens
acgtaaagaactttt

SEQ ID NO: 5152947 - DNA, 13 bp, Homo sapiens
acgtaaatgtttt

SEQ ID NO: 5152948 - DNA, 18 bp, Homo sapiens
acgtaaccacggaaaaga

SEQ ID NO: 5152949 - DNA, 17 bp, Homo sapiens
acgtaagcactgttttt

SEQ ID NO: 5152950 - DNA, 12 bp, Homo sapiens
acgtaatcaaat

SEQ ID NO: 5152951 - DNA, 16 bp, Homo sapiens
acgtaatcaaatatgt

SEQ ID NO: 5152952 - DNA, 18 bp, Homo sapiens
acgtaatgaaacttggat

SEQ ID NO: 5152953 - DNA, 19 bp, Homo sapiens
acgtaatgcattgcctgta

SEQ ID NO: 5152954 - DNA, 16 bp, Homo sapiens
acgtaattcaatttct

SEQ ID NO: 5152955 - DNA, 17 bp, Homo sapiens
acgtacaagtagttctg

SEQ ID NO: 5152956 - DNA, 19 bp, Homo sapiens
acgtacaagtagttctgta

SEQ ID NO: 5152957 - DNA, 20 bp, Homo sapiens
acgtacaagtagttctgtat

SEQ ID NO: 5152958 - DNA, 20 bp, Homo sapiens
acgtacacaccacgtcctgg

SEQ ID NO: 5152959 - DNA, 12 bp, Homo sapiens
acgtacacattt

SEQ ID NO: 5152960 - DNA, 15 bp, Homo sapiens
acgtacatacacaca

SEQ ID NO: 5152961 - DNA, 21 bp, Homo sapiens
acgtacatacacacatacata

SEQ ID NO: 5152962 - DNA, 19 bp, Homo sapiens
acgtacatttgtgctgttt

SEQ ID NO: 5152963 - DNA, 18 bp, Homo sapiens
acgtaccaagccaccgca

SEQ ID NO: 5152964 - DNA, 17 bp, Homo sapiens
acgtactagagggcatt

SEQ ID NO: 5152965 - DNA, 16 bp, Homo sapiens
acgtacttaactgtgt

SEQ ID NO: 5152966 - DNA, 18 bp, Homo sapiens
acgtacttagcagctatc

SEQ ID NO: 5152967 - DNA, 22 bp, Homo sapiens
acgtagatttttgctcttctgt

SEQ ID NO: 5152968 - DNA, 15 bp, Homo sapiens
acgtagcatgtggca

SEQ ID NO: 5152969 - DNA, 17 bp, Homo sapiens
acgtagccacaggagcc

SEQ ID NO: 5152970 - DNA, 20 bp, Homo sapiens
acgtagctgcaaaggacaga

SEQ ID NO: 5152971 - DNA, 15 bp, Homo sapiens
acgtagggggctctg

SEQ ID NO: 5152972 - DNA, 20 bp, Homo sapiens
acgtagggggctctgggcgg

SEQ ID NO: 5152973 - DNA, 15 bp, Homo sapiens
acgtagtaaaagtca

SEQ ID NO: 5152974 - DNA, 14 bp, Homo sapiens
acgtagtgactcag

SEQ ID NO: 5152975 - DNA, 16 bp, Homo sapiens
acgtagttgtgctttt

SEQ ID NO: 5152976 - DNA, 14 bp, Homo sapiens
acgtataaatatga

SEQ ID NO: 5152977 - DNA, 18 bp, Homo sapiens
acgtataaatatgaaatg

SEQ ID NO: 5152978 - DNA, 19 bp, Homo sapiens
acgtatattgtatcatttg

SEQ ID NO: 5152979 - DNA, 20 bp, Homo sapiens
acgtatcaatacagtttata

SEQ ID NO: 5152980 - DNA, 13 bp, Homo sapiens
acgtatgcaagtc

SEQ ID NO: 5152981 - DNA, 20 bp, Homo sapiens
acgtatgcaagtctgtgagt

SEQ ID NO: 5152982 - DNA, 21 bp, Homo sapiens
acgtatgtatttcattgctgt

SEQ ID NO: 5152983 - DNA, 17 bp, Homo sapiens
acgtatgtgtgcaggag

SEQ ID NO: 5152984 - DNA, 15 bp, Homo sapiens
acgtattacaaacaa

SEQ ID NO: 5152985 - DNA, 16 bp, Homo sapiens
acgtattagttgccaa

SEQ ID NO: 5152986 - DNA, 22 bp, Homo sapiens
acgtattagttgccaatatgcc

SEQ ID NO: 5152987 - DNA, 13 bp, Homo sapiens
acgtattattgtc

SEQ ID NO: 5152988 - DNA, 16 bp, Homo sapiens
acgtattgctgtgtct

SEQ ID NO: 5152989 - DNA, 16 bp, Homo sapiens
acgtattggtccagct

SEQ ID NO: 5152990 - DNA, 17 bp, Homo sapiens
acgtattgtgaaatttg

SEQ ID NO: 5152991 - DNA, 21 bp, Homo sapiens
acgtatttaatagcaaagaat

SEQ ID NO: 5152992 - DNA, 17 bp, Homo sapiens
acgtatttcacagagca

SEQ ID NO: 5152993 - DNA, 14 bp, Homo sapiens
acgtattttaaaag

SEQ ID NO: 5152994 - DNA, 14 bp, Homo sapiens
acgtcaaacatgaa

SEQ ID NO: 5152995 - DNA, 20 bp, Homo sapiens
acgtcaacccaagctctggg

SEQ ID NO: 5152996 - DNA, 21 bp, Homo sapiens
acgtcaacccaagctctgggg

SEQ ID NO: 5152997 - DNA, 15 bp, Homo sapiens
acgtcaccctcctga

SEQ ID NO: 5152998 - DNA, 15 bp, Homo sapiens
acgtcacgctccctg

SEQ ID NO: 5152999 - DNA, 18 bp, Homo sapiens
acgtcagatgtttaaaac

SEQ ID NO: 5153000 - DNA, 22 bp, Homo sapiens
acgtcagcctcttaccttcccg

SEQ ID NO: 5153001 - DNA, 17 bp, Homo sapiens
acgtcagcgcaccaaaa

SEQ ID NO: 5153002 - DNA, 18 bp, Homo sapiens
acgtcaggccctgactcc

SEQ ID NO: 5153003 - DNA, 18 bp, Homo sapiens
acgtcaggcctggcctca

SEQ ID NO: 5153004 - DNA, 17 bp, Homo sapiens
acgtcatctagttttaa

SEQ ID NO: 5153005 - DNA, 13 bp, Homo sapiens
acgtcatctcagg

SEQ ID NO: 5153006 - DNA, 12 bp, Homo sapiens
acgtcatgtatt

SEQ ID NO: 5153007 - DNA, 18 bp, Homo sapiens
acgtcatgtatttgagca

SEQ ID NO: 5153008 - DNA, 23 bp, Homo sapiens
acgtcattaaggttatgcactgc

SEQ ID NO: 5153009 - DNA, 20 bp, Homo sapiens
acgtcattgtgtaaggaaaa

SEQ ID NO: 5153010 - DNA, 20 bp, Homo sapiens
acgtccacagagtataaata

SEQ ID NO: 5153011 - DNA, 14 bp, Homo sapiens
accttatagagcac

SEQ ID NO: 5153012 - DNA, 17 bp, Homo sapiens
accttatagagcacaat

SEQ ID NO: 5153013 - DNA, 14 bp, Homo sapiens
accttatagttact

SEQ ID NO: 5153014 - DNA, 17 bp, Homo sapiens
accttatatttacaata

SEQ ID NO: 5153015 - DNA, 18 bp, Homo sapiens
accttatatttacaataa

SEQ ID NO: 5153016 - DNA, 23 bp, Homo sapiens
accttatcactgcattattctct

SEQ ID NO: 5153017 - DNA, 15 bp, Homo sapiens
accttatcctgcatt

SEQ ID NO: 5153018 - DNA, 23 bp, Homo sapiens
accttatctggaagatctgcaaa

SEQ ID NO: 5153019 - DNA, 16 bp, Homo sapiens
accttatgctacacag

SEQ ID NO: 5153020 - DNA, 17 bp, Homo sapiens
accttattaacaaaata

SEQ ID NO: 5153021 - DNA, 16 bp, Homo sapiens
accttattctatactt

SEQ ID NO: 5153022 - DNA, 22 bp, Homo sapiens
accttattgagcgtgattctgt

SEQ ID NO: 5153023 - DNA, 14 bp, Homo sapiens
accttattgtacct

SEQ ID NO: 5153024 - DNA, 17 bp, Homo sapiens
accttattgtacctctc

SEQ ID NO: 5153025 - DNA, 22 bp, Homo sapiens
accttattgtacctctcttata

SEQ ID NO: 5153026 - DNA, 18 bp, Homo sapiens
accttattgtacgtttaa

SEQ ID NO: 5153027 - DNA, 17 bp, Homo sapiens
accttatttaaaagatt

SEQ ID NO: 5153028 - DNA, 19 bp, Homo sapiens
accttatttatttttgtgt

SEQ ID NO: 5153029 - DNA, 22 bp, Homo sapiens
accttatttgctaatcaaagcc

SEQ ID NO: 5153030 - DNA, 18 bp, Homo sapiens
accttattttttcccaaa

SEQ ID NO: 5153031 - DNA, 15 bp, Homo sapiens
accttcaaaatgttc

SEQ ID NO: 5153032 - DNA, 20 bp, Homo sapiens
accttcaaaatgttctattt

SEQ ID NO: 5153033 - DNA, 21 bp, Homo sapiens
accttcaacatgtgctcgctc

SEQ ID NO: 5153034 - DNA, 16 bp, Homo sapiens
accttcaacccagtgg

SEQ ID NO: 5153035 - DNA, 18 bp, Homo sapiens
accttcaactgtctgtct

SEQ ID NO: 5153036 - DNA, 18 bp, Homo sapiens
accttcaagcgctccagg

SEQ ID NO: 5153037 - DNA, 22 bp, Homo sapiens
accttcaaggctcttcttcctc

SEQ ID NO: 5153038 - DNA, 15 bp, Homo sapiens
accttcaataaagta

SEQ ID NO: 5153039 - DNA, 17 bp, Homo sapiens
accttcaataaagtatc

SEQ ID NO: 5153040 - DNA, 19 bp, Homo sapiens
accttcaataaagtatcta

SEQ ID NO: 5153041 - DNA, 20 bp, Homo sapiens
accttcaatgacttctaatt

SEQ ID NO: 5153042 - DNA, 17 bp, Homo sapiens
accttcacacacagact

SEQ ID NO: 5153043 - DNA, 13 bp, Homo sapiens
accttcacagatg

SEQ ID NO: 5153044 - DNA, 15 bp, Homo sapiens
accttcactccagac

SEQ ID NO: 5153045 - DNA, 14 bp, Homo sapiens
accttcactctaag

SEQ ID NO: 5153046 - DNA, 20 bp, Homo sapiens
accttcactctaagatgtta

SEQ ID NO: 5153047 - DNA, 17 bp, Homo sapiens
accttcagagccagccg

SEQ ID NO: 5153048 - DNA, 19 bp, Homo sapiens
accttcagatccttttatt

SEQ ID NO: 5153049 - DNA, 16 bp, Homo sapiens
accttcagctcacgct

SEQ ID NO: 5153050 - DNA, 15 bp, Homo sapiens
accttcagctttatt

SEQ ID NO: 5153051 - DNA, 19 bp, Homo sapiens
accttcagctttatttttc

SEQ ID NO: 5153052 - DNA, 15 bp, Homo sapiens
accttcataagatct

SEQ ID NO: 5153053 - DNA, 14 bp, Homo sapiens
accttcatccagat

SEQ ID NO: 5153054 - DNA, 15 bp, Homo sapiens
accttcatccagatt

SEQ ID NO: 5153055 - DNA, 19 bp, Homo sapiens
accttcatgaccttacata

SEQ ID NO: 5153056 - DNA, 20 bp, Homo sapiens
accttcattctgagaccaaa

SEQ ID NO: 5153057 - DNA, 20 bp, Homo sapiens
accttcatttaactctttga

SEQ ID NO: 5153058 - DNA, 16 bp, Homo sapiens
accttcatttcatcct

SEQ ID NO: 5153059 - DNA, 14 bp, Homo sapiens
accttcatttcatg

SEQ ID NO: 5153060 - DNA, 20 bp, Homo sapiens
accttcattttacattctgt

SEQ ID NO: 5153061 - DNA, 22 bp, Homo sapiens
accttcatttttaagactgtaa

SEQ ID NO: 5153062 - DNA, 17 bp, Homo sapiens
accttccaacttcctgt

SEQ ID NO: 5153063 - DNA, 23 bp, Homo sapiens
accttccagaaatactactgtgt

SEQ ID NO: 5153064 - DNA, 13 bp, Homo sapiens
accttccagctcc

SEQ ID NO: 5153065 - DNA, 17 bp, Homo sapiens
accttccagtcaggatg

SEQ ID NO: 5153066 - DNA, 19 bp, Homo sapiens
accttccatggctcttttt

SEQ ID NO: 5153067 - DNA, 16 bp, Homo sapiens
accttccattcacacc

SEQ ID NO: 5153068 - DNA, 21 bp, Homo sapiens
accttcccaaacgcctcccct

SEQ ID NO: 5153069 - DNA, 22 bp, Homo sapiens
accttcccaaacgcctcccctg

SEQ ID NO: 5153070 - DNA, 14 bp, Homo sapiens
accttcccagctgc

SEQ ID NO: 5153071 - DNA, 9 bp, Homo sapiens
accttcccc

SEQ ID NO: 5153072 - DNA, 15 bp, Homo sapiens
accttccccaaagga

SEQ ID NO: 5153073 - DNA, 13 bp, Homo sapiens
accttccccagac

SEQ ID NO: 5153074 - DNA, 15 bp, Homo sapiens
accttccccagactc

SEQ ID NO: 5153075 - DNA, 16 bp, Homo sapiens
accttccccagactca

SEQ ID NO: 5153076 - DNA, 20 bp, Homo sapiens
accttccccagactcagctc

SEQ ID NO: 5153077 - DNA, 22 bp, Homo sapiens
accttccccagacttgcactgg

SEQ ID NO: 5153078 - DNA, 17 bp, Homo sapiens
accttccctagttcttt

SEQ ID NO: 5153079 - DNA, 18 bp, Homo sapiens
accttcccttcctcagca

SEQ ID NO: 5153080 - DNA, 17 bp, Homo sapiens
accttcccttctacaag

SEQ ID NO: 5153081 - DNA, 12 bp, Homo sapiens
accttcctcact

SEQ ID NO: 5153082 - DNA, 16 bp, Homo sapiens
accttcctcacttcca

SEQ ID NO: 5153083 - DNA, 14 bp, Homo sapiens
accttcctcatcta

SEQ ID NO: 5153084 - DNA, 17 bp, Homo sapiens
accttcctgactgggaa

SEQ ID NO: 5153085 - DNA, 12 bp, Homo sapiens
accttcctgccc

SEQ ID NO: 5153086 - DNA, 14 bp, Homo sapiens
accttcctgcccag

SEQ ID NO: 5153087 - DNA, 15 bp, Homo sapiens
accttcctgcccagg

SEQ ID NO: 5153088 - DNA, 23 bp, Homo sapiens
accttcctgggaggacaggcagg

SEQ ID NO: 5153089 - DNA, 18 bp, Homo sapiens
accttcctgggcagccca

SEQ ID NO: 5153090 - DNA, 19 bp, Homo sapiens
accttcctgtccctgaggt

SEQ ID NO: 5153091 - DNA, 13 bp, Homo sapiens
accttccttccct

SEQ ID NO: 5153092 - DNA, 19 bp, Homo sapiens
accttccttccctgggctg

SEQ ID NO: 5153093 - DNA, 21 bp, Homo sapiens
accttccttttacttttcttc

SEQ ID NO: 5153094 - DNA, 15 bp, Homo sapiens
accttcgagtagaga

SEQ ID NO: 5153095 - DNA, 15 bp, Homo sapiens
accttcgccacctgg

SEQ ID NO: 5153096 - DNA, 19 bp, Homo sapiens
accttcggcagtggctggg

SEQ ID NO: 5153097 - DNA, 14 bp, Homo sapiens
accttcgggctgtg

SEQ ID NO: 5153098 - DNA, 20 bp, Homo sapiens
accttcggggcctgtctgaa

SEQ ID NO: 5153099 - DNA, 21 bp, Homo sapiens
accttcgtttactatgcctgt

SEQ ID NO: 5153100 - DNA, 22 bp, Homo sapiens
accttcgtttactatgcctgtg

SEQ ID NO: 5153101 - DNA, 15 bp, Homo sapiens
accttctaaaagcca

SEQ ID NO: 5153102 - DNA, 15 bp, Homo sapiens
accttctagaattat

SEQ ID NO: 5153103 - DNA, 16 bp, Homo sapiens
accttctagaattata

SEQ ID NO: 5153104 - DNA, 18 bp, Homo sapiens
accttctagtcttggcca

SEQ ID NO: 5153105 - DNA, 18 bp, Homo sapiens
accttctagtgagcctgg

SEQ ID NO: 5153106 - DNA, 17 bp, Homo sapiens
accttctagttgccccc

SEQ ID NO: 5153107 - DNA, 15 bp, Homo sapiens
accttctatgtatta

SEQ ID NO: 5153108 - DNA, 20 bp, Homo sapiens
accttctatgtattagtgtc

SEQ ID NO: 5153109 - DNA, 16 bp, Homo sapiens
accttctatgttcata

SEQ ID NO: 5153110 - DNA, 22 bp, Homo sapiens
accttctcaaaagattgtttta

SEQ ID NO: 5153111 - DNA, 21 bp, Homo sapiens
accttctcacctgtgagacca

SEQ ID NO: 5153112 - DNA, 12 bp, Homo sapiens
accttctcccag

SEQ ID NO: 5153113 - DNA, 16 bp, Homo sapiens
accttctcccaggcct

SEQ ID NO: 5153114 - DNA, 22 bp, Homo sapiens
accttctcccaggcctctgccc

SEQ ID NO: 5153115 - DNA, 15 bp, Homo sapiens
accttctccccagct

SEQ ID NO: 5153116 - DNA, 17 bp, Homo sapiens
accttctccccattctg

SEQ ID NO: 5153117 - DNA, 23 bp, Homo sapiens
accttctccctcatttcaggagc

SEQ ID NO: 5153118 - DNA, 22 bp, Homo sapiens
accttctccttcacctttgtcc

SEQ ID NO: 5153119 - DNA, 22 bp, Homo sapiens
accttctctatggggcatcctc

SEQ ID NO: 5153120 - DNA, 23 bp, Homo sapiens
accttctctatggggcatcctct

SEQ ID NO: 5153121 - DNA, 12 bp, Homo sapiens
accttctctgga

SEQ ID NO: 5153122 - DNA, 15 bp, Homo sapiens
accttctctggagcc

SEQ ID NO: 5153123 - DNA, 17 bp, Homo sapiens
accttctctggagccaa

SEQ ID NO: 5153124 - DNA, 11 bp, Homo sapiens
accttctctta

SEQ ID NO: 5153125 - DNA, 17 bp, Homo sapiens
accttctgacagcccaa

SEQ ID NO: 5153126 - DNA, 18 bp, Homo sapiens
accttctgacgcagcctg

SEQ ID NO: 5153127 - DNA, 15 bp, Homo sapiens
accttctgagtattc

SEQ ID NO: 5153128 - DNA, 19 bp, Homo sapiens
accttctgatgaagttgta

SEQ ID NO: 5153129 - DNA, 13 bp, Homo sapiens
accttctgccctc

SEQ ID NO: 5153130 - DNA, 22 bp, Homo sapiens
accttctggtggttctgctgtt

SEQ ID NO: 5153131 - DNA, 18 bp, Homo sapiens
accttctggttgcttcag

SEQ ID NO: 5153132 - DNA, 11 bp, Homo sapiens
accttctgtag

SEQ ID NO: 5153133 - DNA, 15 bp, Homo sapiens
accttctgtccccag

SEQ ID NO: 5153134 - DNA, 20 bp, Homo sapiens
accttctgtccccagccctg

SEQ ID NO: 5153135 - DNA, 18 bp, Homo sapiens
accttctgtcgtccccag

SEQ ID NO: 5153136 - DNA, 20 bp, Homo sapiens
accttctgtcgtccccagac

SEQ ID NO: 5153137 - DNA, 12 bp, Homo sapiens
accttctgtggc

SEQ ID NO: 5153138 - DNA, 15 bp, Homo sapiens
accttctgtggctca

SEQ ID NO: 5153139 - DNA, 16 bp, Homo sapiens
accttctgtggctcac

SEQ ID NO: 5153140 - DNA, 15 bp, Homo sapiens
accttctgtggctgt

SEQ ID NO: 5153141 - DNA, 15 bp, Homo sapiens
accttcttattatat

SEQ ID NO: 5153142 - DNA, 21 bp, Homo sapiens
accttcttcgctgctagagaa

SEQ ID NO: 5153143 - DNA, 19 bp, Homo sapiens
accttcttggcttctggga

SEQ ID NO: 5153144 - DNA, 17 bp, Homo sapiens
accttctttattctgtg

SEQ ID NO: 5153145 - DNA, 19 bp, Homo sapiens
accttctttattctgtgtt

SEQ ID NO: 5153146 - DNA, 18 bp, Homo sapiens
accttctttctggactgg

SEQ ID NO: 5153147 - DNA, 13 bp, Homo sapiens
accttctttgtaa

SEQ ID NO: 5153148 - DNA, 20 bp, Homo sapiens
accttcttttcaatgcaatg

SEQ ID NO: 5153149 - DNA, 22 bp, Homo sapiens
accttcttttcaatgcaatgca

SEQ ID NO: 5153150 - DNA, 18 bp, Homo sapiens
accttgaaaaaaaacagt

SEQ ID NO: 5153151 - DNA, 11 bp, Homo sapiens
accttgaaatc

SEQ ID NO: 5153152 - DNA, 21 bp, Homo sapiens
accttgaacactgggggaggg

SEQ ID NO: 5153153 - DNA, 12 bp, Homo sapiens
accttgaacagt

SEQ ID NO: 5153154 - DNA, 17 bp, Homo sapiens
accttgaacctgtcacc

SEQ ID NO: 5153155 - DNA, 20 bp, Homo sapiens
accttgaactgggtacttgt

SEQ ID NO: 5153156 - DNA, 17 bp, Homo sapiens
accttgaaggtctgtca

SEQ ID NO: 5153157 - DNA, 20 bp, Homo sapiens
accttgaagtgactgttgta

SEQ ID NO: 5153158 - DNA, 23 bp, Homo sapiens
accttgaataaggcccactgtaa

SEQ ID NO: 5153159 - DNA, 13 bp, Homo sapiens
accttgaatgctg

SEQ ID NO: 5153160 - DNA, 16 bp, Homo sapiens
accttgaatgctgcca

SEQ ID NO: 5153161 - DNA, 20 bp, Homo sapiens
accttgaccatcgtccttcc

SEQ ID NO: 5153162 - DNA, 17 bp, Homo sapiens
accttgaccctagaatt

SEQ ID NO: 5153163 - DNA, 17 bp, Homo sapiens
accttgacctttgtaca

SEQ ID NO: 5153164 - DNA, 20 bp, Homo sapiens
accttgacgtttcttctttc

SEQ ID NO: 5153165 - DNA, 16 bp, Homo sapiens
accttgactgttgatg

SEQ ID NO: 5153166 - DNA, 16 bp, Homo sapiens
accttgacttgccatg

SEQ ID NO: 5153167 - DNA, 20 bp, Homo sapiens
accttgagaccaagccggtg

SEQ ID NO: 5153168 - DNA, 22 bp, Homo sapiens
accttgagaccaagccggtgcc

SEQ ID NO: 5153169 - DNA, 17 bp, Homo sapiens
accttgagaccctcttc

SEQ ID NO: 5153170 - DNA, 22 bp, Homo sapiens
accttgagaccctcttctctgg

SEQ ID NO: 5153171 - DNA, 10 bp, Homo sapiens
accttgagca

SEQ ID NO: 5153172 - DNA, 15 bp, Homo sapiens
accttgaggagaagt

SEQ ID NO: 5153173 - DNA, 19 bp, Homo sapiens
accttgaggagtcttgtgt

SEQ ID NO: 5153174 - DNA, 19 bp, Homo sapiens
accttgagggtgggccagc

SEQ ID NO: 5153175 - DNA, 22 bp, Homo sapiens
accttgaggtcttttgacatgt

SEQ ID NO: 5153176 - DNA, 14 bp, Homo sapiens
accttgatggggtg

SEQ ID NO: 5153177 - DNA, 20 bp, Homo sapiens
accttgatgtcttgagagcg

SEQ ID NO: 5153178 - DNA, 13 bp, Homo sapiens
accttgattgcac

SEQ ID NO: 5153179 - DNA, 14 bp, Homo sapiens
accttgattggaaa

SEQ ID NO: 5153180 - DNA, 12 bp, Homo sapiens
accttgattttc

SEQ ID NO: 5153181 - DNA, 16 bp, Homo sapiens
accttgattttcttct

SEQ ID NO: 5153182 - DNA, 21 bp, Homo sapiens
accttgattttcttctttgtg

SEQ ID NO: 5153183 - DNA, 15 bp, Homo sapiens
accttgcaaagcaac

SEQ ID NO: 5153184 - DNA, 17 bp, Homo sapiens
accttgcaacacacaga

SEQ ID NO: 5153185 - DNA, 10 bp, Homo sapiens
accttgcagc

SEQ ID NO: 5153186 - DNA, 11 bp, Homo sapiens
accttgcagca

SEQ ID NO: 5153187 - DNA, 21 bp, Homo sapiens
accttgccacccattcttccc

SEQ ID NO: 5153188 - DNA, 13 bp, Homo sapiens
accttgccagggc

SEQ ID NO: 5153189 - DNA, 16 bp, Homo sapiens
accttgccagggcagg

SEQ ID NO: 5153190 - DNA, 22 bp, Homo sapiens
acgtccaggtccgtagctcccc

SEQ ID NO: 5153191 - DNA, 21 bp, Homo sapiens
acgtccaggttcaacccacag

SEQ ID NO: 5153192 - DNA, 20 bp, Homo sapiens
acgtccatcacgttagctgt

SEQ ID NO: 5153193 - DNA, 17 bp, Homo sapiens
acgtccatctctctccc

SEQ ID NO: 5153194 - DNA, 21 bp, Homo sapiens
acgtcccagcggcctcagggt

SEQ ID NO: 5153195 - DNA, 13 bp, Homo sapiens
acgtccccctggg

SEQ ID NO: 5153196 - DNA, 14 bp, Homo sapiens
acgtcccctccgcc

SEQ ID NO: 5153197 - DNA, 15 bp, Homo sapiens
acgtcccgctgcctc

SEQ ID NO: 5153198 - DNA, 22 bp, Homo sapiens
acgtcccgctgcctcctgctct

SEQ ID NO: 5153199 - DNA, 22 bp, Homo sapiens
acgtccctccacgttcacccct

SEQ ID NO: 5153200 - DNA, 16 bp, Homo sapiens
acgtcctgagaaagct

SEQ ID NO: 5153201 - DNA, 20 bp, Homo sapiens
acgtcctgccacctggggca

SEQ ID NO: 5153202 - DNA, 23 bp, Homo sapiens
acgtcctgctggcacctcagaca

SEQ ID NO: 5153203 - DNA, 13 bp, Homo sapiens
acgtcctggaatg

SEQ ID NO: 5153204 - DNA, 22 bp, Homo sapiens
acgtcctggaatgaagcatgta

SEQ ID NO: 5153205 - DNA, 19 bp, Homo sapiens
acgtcctgggtgctgtcat

SEQ ID NO: 5153206 - DNA, 12 bp, Homo sapiens
acgtcctggtct

SEQ ID NO: 5153207 - DNA, 18 bp, Homo sapiens
acgtcctgtcagtgccgc

SEQ ID NO: 5153208 - DNA, 18 bp, Homo sapiens
acgtcgaggaccgggcac

SEQ ID NO: 5153209 - DNA, 13 bp, Homo sapiens
acgtctaaactgt

SEQ ID NO: 5153210 - DNA, 21 bp, Homo sapiens
acgtctaaactgtttactcac

SEQ ID NO: 5153211 - DNA, 15 bp, Homo sapiens
acgtctaactggaaa

SEQ ID NO: 5153212 - DNA, 21 bp, Homo sapiens
acgtctagatgggttcttagc

SEQ ID NO: 5153213 - DNA, 23 bp, Homo sapiens
acgtctagctatgctgtatctgt

SEQ ID NO: 5153214 - DNA, 18 bp, Homo sapiens
acgtctatttcatcagaa

SEQ ID NO: 5153215 - DNA, 17 bp, Homo sapiens
acgtctcaagactgaaa

SEQ ID NO: 5153216 - DNA, 15 bp, Homo sapiens
acgtctcatctccca

SEQ ID NO: 5153217 - DNA, 16 bp, Homo sapiens
acgtctcatctcccat

SEQ ID NO: 5153218 - DNA, 12 bp, Homo sapiens
acgtctcccaga

SEQ ID NO: 5153219 - DNA, 14 bp, Homo sapiens
acgtctccccttct

SEQ ID NO: 5153220 - DNA, 20 bp, Homo sapiens
acgtctcctcctcgaagcca

SEQ ID NO: 5153221 - DNA, 16 bp, Homo sapiens
acgtctctctgcctgc

SEQ ID NO: 5153222 - DNA, 18 bp, Homo sapiens
acgtctctctgcctgctg

SEQ ID NO: 5153223 - DNA, 22 bp, Homo sapiens
acgtctctctgcctgctgggct

SEQ ID NO: 5153224 - DNA, 12 bp, Homo sapiens
acgtctctgccg

SEQ ID NO: 5153225 - DNA, 22 bp, Homo sapiens
acgtctgaagcttgactcccaa

SEQ ID NO: 5153226 - DNA, 15 bp, Homo sapiens
acgtctgacaggcaa

SEQ ID NO: 5153227 - DNA, 15 bp, Homo sapiens
acgtctgccaccagc

SEQ ID NO: 5153228 - DNA, 15 bp, Homo sapiens
acgtctgccaggccc

SEQ ID NO: 5153229 - DNA, 17 bp, Homo sapiens
acgtctgccaggcccat

SEQ ID NO: 5153230 - DNA, 16 bp, Homo sapiens
acgtctgccaggggta

SEQ ID NO: 5153231 - DNA, 18 bp, Homo sapiens
acgtctggctccctgccc

SEQ ID NO: 5153232 - DNA, 21 bp, Homo sapiens
acgtctggctccctgcccctt

SEQ ID NO: 5153233 - DNA, 17 bp, Homo sapiens
acgtctgggagaaattg

SEQ ID NO: 5153234 - DNA, 17 bp, Homo sapiens
acgtctgggcccccact

SEQ ID NO: 5153235 - DNA, 14 bp, Homo sapiens
acgtctggggtgtg

SEQ ID NO: 5153236 - DNA, 14 bp, Homo sapiens
acgtctgtcttcac

SEQ ID NO: 5153237 - DNA, 21 bp, Homo sapiens
acgtctgtgctctgtccttgt

SEQ ID NO: 5153238 - DNA, 16 bp, Homo sapiens
acgtcttccttcttta

SEQ ID NO: 5153239 - DNA, 12 bp, Homo sapiens
acgtcttctaaa

SEQ ID NO: 5153240 - DNA, 19 bp, Homo sapiens
acgtcttcttgctgcagcc

SEQ ID NO: 5153241 - DNA, 20 bp, Homo sapiens
acgtcttcttgctgcagcct

SEQ ID NO: 5153242 - DNA, 13 bp, Homo sapiens
acgtcttgctatt

SEQ ID NO: 5153243 - DNA, 23 bp, Homo sapiens
acgtcttgctatttgagcatgca

SEQ ID NO: 5153244 - DNA, 21 bp, Homo sapiens
acgtcttggtgccttttgtgt

SEQ ID NO: 5153245 - DNA, 15 bp, Homo sapiens
acgtctttcctgcta

SEQ ID NO: 5153246 - DNA, 19 bp, Homo sapiens
acgtctttttaagcctttg

SEQ ID NO: 5153247 - DNA, 16 bp, Homo sapiens
acgtgaaactgctgtt

SEQ ID NO: 5153248 - DNA, 17 bp, Homo sapiens
acgtgaagataccataa

SEQ ID NO: 5153249 - DNA, 14 bp, Homo sapiens
acgtgaagcctccc

SEQ ID NO: 5153250 - DNA, 15 bp, Homo sapiens
acgtgaatattttgc

SEQ ID NO: 5153251 - DNA, 19 bp, Homo sapiens
acgtgacacaaacacacac

SEQ ID NO: 5153252 - DNA, 17 bp, Homo sapiens
acgtgacagtgcctggg

SEQ ID NO: 5153253 - DNA, 20 bp, Homo sapiens
acgtgaccaattgccctgcc

SEQ ID NO: 5153254 - DNA, 22 bp, Homo sapiens
acgtgaccaattgccctgccag

SEQ ID NO: 5153255 - DNA, 11 bp, Homo sapiens
acgtgaccctg

SEQ ID NO: 5153256 - DNA, 23 bp, Homo sapiens
acgtgaccctgtgccccgcctcc

SEQ ID NO: 5153257 - DNA, 14 bp, Homo sapiens
acgtgactgcccca

SEQ ID NO: 5153258 - DNA, 18 bp, Homo sapiens
acgtgactgccccaactc

SEQ ID NO: 5153259 - DNA, 20 bp, Homo sapiens
acgtgagagaaagagagaag

SEQ ID NO: 5153260 - DNA, 23 bp, Homo sapiens
acgtgagagaaagagagaagcca

SEQ ID NO: 5153261 - DNA, 23 bp, Homo sapiens
acgtgagagtgtcttcacggcag

SEQ ID NO: 5153262 - DNA, 16 bp, Homo sapiens
acgtgagatcattcac

SEQ ID NO: 5153263 - DNA, 14 bp, Homo sapiens
acgtgagccaggta

SEQ ID NO: 5153264 - DNA, 15 bp, Homo sapiens
acgtgagccaggtaa

SEQ ID NO: 5153265 - DNA, 22 bp, Homo sapiens
acgtgagctccggaatagatgt

SEQ ID NO: 5153266 - DNA, 22 bp, Homo sapiens
acgtgaggggggggtgggtgag

SEQ ID NO: 5153267 - DNA, 19 bp, Homo sapiens
acgtgaggtttcagtagct

SEQ ID NO: 5153268 - DNA, 11 bp, Homo sapiens
acgtgagtcct

SEQ ID NO: 5153269 - DNA, 19 bp, Homo sapiens
acgtgatggaccaaagcca

SEQ ID NO: 5153270 - DNA, 18 bp, Homo sapiens
acgtgatggtctgagact

SEQ ID NO: 5153271 - DNA, 14 bp, Homo sapiens
acgtgatgtgccac

SEQ ID NO: 5153272 - DNA, 22 bp, Homo sapiens
acgtgattcaattcaacactcc

SEQ ID NO: 5153273 - DNA, 18 bp, Homo sapiens
acgtgattgattcagtat

SEQ ID NO: 5153274 - DNA, 20 bp, Homo sapiens
acgtgattgattcagtatct

SEQ ID NO: 5153275 - DNA, 18 bp, Homo sapiens
acgtgcaaacaacctgaa

SEQ ID NO: 5153276 - DNA, 22 bp, Homo sapiens
acgtgcaaacaacctgaatctt

SEQ ID NO: 5153277 - DNA, 14 bp, Homo sapiens
acgtgcaaagccaa

SEQ ID NO: 5153278 - DNA, 22 bp, Homo sapiens
acgtgcaaggactcccggagcc

SEQ ID NO: 5153279 - DNA, 14 bp, Homo sapiens
acgtgcaatttgtt

SEQ ID NO: 5153280 - DNA, 19 bp, Homo sapiens
acgtgcacaaattcatgtg

SEQ ID NO: 5153281 - DNA, 16 bp, Homo sapiens
acgtgcacacacctgc

SEQ ID NO: 5153282 - DNA, 17 bp, Homo sapiens
acgtgcacacacctgca

SEQ ID NO: 5153283 - DNA, 19 bp, Homo sapiens
acgtgcacacacctgcaca

SEQ ID NO: 5153284 - DNA, 23 bp, Homo sapiens
acgtgcacctgtactcaggaggc

SEQ ID NO: 5153285 - DNA, 16 bp, Homo sapiens
acgtgcacgcacactg

SEQ ID NO: 5153286 - DNA, 15 bp, Homo sapiens
acgtgcactgtgaat

SEQ ID NO: 5153287 - DNA, 13 bp, Homo sapiens
acgtgcagcacct

SEQ ID NO: 5153288 - DNA, 15 bp, Homo sapiens
acgtgcaggacagct

SEQ ID NO: 5153289 - DNA, 17 bp, Homo sapiens
acgtgcaggacagctct

SEQ ID NO: 5153290 - DNA, 19 bp, Homo sapiens
acgtgcaggacagctcttg

SEQ ID NO: 5153291 - DNA, 18 bp, Homo sapiens
acgtgcagtatctcaaga

SEQ ID NO: 5153292 - DNA, 22 bp, Homo sapiens
acgtgcattgtgcttctttctt

SEQ ID NO: 5153293 - DNA, 11 bp, Homo sapiens
acgtgcattta

SEQ ID NO: 5153294 - DNA, 19 bp, Homo sapiens
acgtgcatttaaactctgc

SEQ ID NO: 5153295 - DNA, 20 bp, Homo sapiens
acgtgcatttaaactctgcc

SEQ ID NO: 5153296 - DNA, 14 bp, Homo sapiens
acgtgccaccatga

SEQ ID NO: 5153297 - DNA, 17 bp, Homo sapiens
acgtgccagatataact

SEQ ID NO: 5153298 - DNA, 23 bp, Homo sapiens
acgtgccagatataactgtcttg

SEQ ID NO: 5153299 - DNA, 20 bp, Homo sapiens
acgtgccagcagcccttgtt

SEQ ID NO: 5153300 - DNA, 21 bp, Homo sapiens
acgtgccaggcccggggctgg

SEQ ID NO: 5153301 - DNA, 21 bp, Homo sapiens
acgtgccattgtctttcctcc

SEQ ID NO: 5153302 - DNA, 15 bp, Homo sapiens
acgtgcccatttcac

SEQ ID NO: 5153303 - DNA, 16 bp, Homo sapiens
acgtgccccccagttc

SEQ ID NO: 5153304 - DNA, 17 bp, Homo sapiens
acgtgccccccagttcc

SEQ ID NO: 5153305 - DNA, 17 bp, Homo sapiens
acgtgcctgtagtccca

SEQ ID NO: 5153306 - DNA, 23 bp, Homo sapiens
acgtgcctgtagtcccagctact

SEQ ID NO: 5153307 - DNA, 23 bp, Homo sapiens
acgtgcctgtgatcccagctact

SEQ ID NO: 5153308 - DNA, 18 bp, Homo sapiens
acgtgcctgtgggcctgg

SEQ ID NO: 5153309 - DNA, 14 bp, Homo sapiens
acgtgccttaggaa

SEQ ID NO: 5153310 - DNA, 22 bp, Homo sapiens
acgtgccttaggaatactgttt

SEQ ID NO: 5153311 - DNA, 23 bp, Homo sapiens
acgtgcgctgggcacttccctgc

SEQ ID NO: 5153312 - DNA, 20 bp, Homo sapiens
acgtgcgtgtctctgccatg

SEQ ID NO: 5153313 - DNA, 20 bp, Homo sapiens
acgtgctccgtagctctgct

SEQ ID NO: 5153314 - DNA, 17 bp, Homo sapiens
acgtgctcgcagcctgg

SEQ ID NO: 5153315 - DNA, 22 bp, Homo sapiens
acgtgctcttctgttctcaaat

SEQ ID NO: 5153316 - DNA, 19 bp, Homo sapiens
acgtgctctttgttttgtg

SEQ ID NO: 5153317 - DNA, 14 bp, Homo sapiens
acgtgctggccttg

SEQ ID NO: 5153318 - DNA, 23 bp, Homo sapiens
acgtgctggccttggtatgtgcc

SEQ ID NO: 5153319 - DNA, 15 bp, Homo sapiens
acgtgctttgagaaa

SEQ ID NO: 5153320 - DNA, 17 bp, Homo sapiens
acgtggaacctctgtct

SEQ ID NO: 5153321 - DNA, 18 bp, Homo sapiens
acgtggaacctctgtctc

SEQ ID NO: 5153322 - DNA, 20 bp, Homo sapiens
acgtggaacctctgtctcat

SEQ ID NO: 5153323 - DNA, 17 bp, Homo sapiens
acgtggactctgtgctc

SEQ ID NO: 5153324 - DNA, 22 bp, Homo sapiens
acgtggagaatcacaggctggg

SEQ ID NO: 5153325 - DNA, 13 bp, Homo sapiens
acgtggagacagc

SEQ ID NO: 5153326 - DNA, 14 bp, Homo sapiens
acgtggagagctgg

SEQ ID NO: 5153327 - DNA, 13 bp, Homo sapiens
acgtggagaggga

SEQ ID NO: 5153328 - DNA, 23 bp, Homo sapiens
acgtggattgtatttaagacata

SEQ ID NO: 5153329 - DNA, 19 bp, Homo sapiens
acgtggattttaaaaaatc

SEQ ID NO: 5153330 - DNA, 20 bp, Homo sapiens
acgtggattttaaaaaatca

SEQ ID NO: 5153331 - DNA, 16 bp, Homo sapiens
acgtggcacctcctca

SEQ ID NO: 5153332 - DNA, 15 bp, Homo sapiens
acgtggcatgtggcc

SEQ ID NO: 5153333 - DNA, 20 bp, Homo sapiens
acgtggccatgtatgaagcc

SEQ ID NO: 5153334 - DNA, 15 bp, Homo sapiens
acgtggcccagagaa

SEQ ID NO: 5153335 - DNA, 15 bp, Homo sapiens
acgtggccgctgccc

SEQ ID NO: 5153336 - DNA, 20 bp, Homo sapiens
acgtggcctccgcagtgtct

SEQ ID NO: 5153337 - DNA, 22 bp, Homo sapiens
acgtggcctctctctctctcct

SEQ ID NO: 5153338 - DNA, 22 bp, Homo sapiens
acgtggctgcgtgcccctgctg

SEQ ID NO: 5153339 - DNA, 17 bp, Homo sapiens
acgtggctgcttcaagg

SEQ ID NO: 5153340 - DNA, 18 bp, Homo sapiens
acgtggctgcttcaagga

SEQ ID NO: 5153341 - DNA, 19 bp, Homo sapiens
acgtggctgcttcaaggat

SEQ ID NO: 5153342 - DNA, 20 bp, Homo sapiens
acgtggcttctgatgaatct

SEQ ID NO: 5153343 - DNA, 23 bp, Homo sapiens
acgtggcttctgatgaatcttgc

SEQ ID NO: 5153344 - DNA, 22 bp, Homo sapiens
acgtggcttgtagaatttttaa

SEQ ID NO: 5153345 - DNA, 18 bp, Homo sapiens
acgtggcttttagacaga

SEQ ID NO: 5153346 - DNA, 19 bp, Homo sapiens
acgtgggcaaacaggcagt

SEQ ID NO: 5153347 - DNA, 18 bp, Homo sapiens
acgtgggcatcattttaa

SEQ ID NO: 5153348 - DNA, 17 bp, Homo sapiens
acgtgggcattcaaatg

SEQ ID NO: 5153349 - DNA, 17 bp, Homo sapiens
acgtgggccctgcaggc

SEQ ID NO: 5153350 - DNA, 17 bp, Homo sapiens
acgtgggctcccctctt

SEQ ID NO: 5153351 - DNA, 15 bp, Homo sapiens
acgtggggagggtgg

SEQ ID NO: 5153352 - DNA, 19 bp, Homo sapiens
acgtggggcagcacagaga

SEQ ID NO: 5153353 - DNA, 15 bp, Homo sapiens
acgtggggtggaatt

SEQ ID NO: 5153354 - DNA, 19 bp, Homo sapiens
acgtgggtatttcctgcta

SEQ ID NO: 5153355 - DNA, 17 bp, Homo sapiens
acgtgggtgccctctcc

SEQ ID NO: 5153356 - DNA, 15 bp, Homo sapiens
acgtgggttcaattt

SEQ ID NO: 5153357 - DNA, 15 bp, Homo sapiens
acgtggtcactgtgc

SEQ ID NO: 5153358 - DNA, 21 bp, Homo sapiens
acgtggtctagaccagggctg

SEQ ID NO: 5153359 - DNA, 15 bp, Homo sapiens
acgtggtggcccagc

SEQ ID NO: 5153360 - DNA, 19 bp, Homo sapiens
acgtggtggcccagctcct

SEQ ID NO: 5153361 - DNA, 12 bp, Homo sapiens
acgtggtgggac

SEQ ID NO: 5153362 - DNA, 14 bp, Homo sapiens
acgtggttcagaga

SEQ ID NO: 5153363 - DNA, 22 bp, Homo sapiens
acgtgtaaatgaagatctttat

SEQ ID NO: 5153364 - DNA, 22 bp, Homo sapiens
acgtgtaaccagttataaatac

SEQ ID NO: 5153365 - DNA, 14 bp, Homo sapiens
acgtgtacagcaca

SEQ ID NO: 5153366 - DNA, 15 bp, Homo sapiens
acgtgtacagcacag

SEQ ID NO: 5153367 - DNA, 16 bp, Homo sapiens
acgtgtacagcacaga

SEQ ID NO: 5153368 - DNA, 14 bp, Homo sapiens
acgtgtagctatat

SEQ ID NO: 5153369 - DNA, 20 bp, Homo sapiens
acgtgtagtgtccattttgt

SEQ ID NO: 5153370 - DNA, 22 bp, Homo sapiens
acgtgtatatgaggatgtatgt

SEQ ID NO: 5153371 - DNA, 18 bp, Homo sapiens
acgtgtatgtttcttctt

SEQ ID NO: 5153372 - DNA, 17 bp, Homo sapiens
acgtgtattttcattac

SEQ ID NO: 5153373 - DNA, 22 bp, Homo sapiens
acgtgtccgtccacccttccat

SEQ ID NO: 5153374 - DNA, 22 bp, Homo sapiens
acgtgtctggaatcccagctcc

SEQ ID NO: 5153375 - DNA, 13 bp, Homo sapiens
acgtgtctgttat

SEQ ID NO: 5153376 - DNA, 23 bp, Homo sapiens
acgtgtcttaggctgatgccact

SEQ ID NO: 5153377 - DNA, 21 bp, Homo sapiens
acgtgtgaaatctgtctttgc

SEQ ID NO: 5153378 - DNA, 12 bp, Homo sapiens
acgtgtgaggat

SEQ ID NO: 5153379 - DNA, 13 bp, Homo sapiens
acgtgtgatgtat

SEQ ID NO: 5153380 - DNA, 16 bp, Homo sapiens
acgtgtgatgtatgtt

SEQ ID NO: 5153381 - DNA, 20 bp, Homo sapiens
acgtgtggcttggtcacttc

SEQ ID NO: 5153382 - DNA, 23 bp, Homo sapiens
acgtgtggttcatccatcatctg

SEQ ID NO: 5153383 - DNA, 21 bp, Homo sapiens
acgtgtgtaaatatgtacatt

SEQ ID NO: 5153384 - DNA, 15 bp, Homo sapiens
acgtgtgtattatgg

SEQ ID NO: 5153385 - DNA, 13 bp, Homo sapiens
acgtgtgtgaagt

SEQ ID NO: 5153386 - DNA, 18 bp, Homo sapiens
acgtgtgtggctgggacc

SEQ ID NO: 5153387 - DNA, 19 bp, Homo sapiens
acgtgtgtggctgggacct

SEQ ID NO: 5153388 - DNA, 21 bp, Homo sapiens
acgtgtgttcttttgagtcct

SEQ ID NO: 5153389 - DNA, 16 bp, Homo sapiens
acgtgtgtttttctat

SEQ ID NO: 5153390 - DNA, 19 bp, Homo sapiens
acgtgttaattataaacag

SEQ ID NO: 5153391 - DNA, 21 bp, Homo sapiens
acgtgttatattccatactta

SEQ ID NO: 5153392 - DNA, 16 bp, Homo sapiens
acgtgttcaaaaattt

SEQ ID NO: 5153393 - DNA, 22 bp, Homo sapiens
acgtgttcctataaaatcaaag

SEQ ID NO: 5153394 - DNA, 13 bp, Homo sapiens
acgtgttctatag

SEQ ID NO: 5153395 - DNA, 11 bp, Homo sapiens
acgtgtttaaa

SEQ ID NO: 5153396 - DNA, 18 bp, Homo sapiens
acgtgtttaattaaattt

SEQ ID NO: 5153397 - DNA, 16 bp, Homo sapiens
acgtgttttccatccc

SEQ ID NO: 5153398 - DNA, 14 bp, Homo sapiens
acgttaaaagacag

SEQ ID NO: 5153399 - DNA, 21 bp, Homo sapiens
acgttaaaagcaaaaagatgt

SEQ ID NO: 5153400 - DNA, 17 bp, Homo sapiens
acgttaaaagtgtacaa

SEQ ID NO: 5153401 - DNA, 13 bp, Homo sapiens
acgttaaagtagg

SEQ ID NO: 5153402 - DNA, 21 bp, Homo sapiens
acgttaagggaaggaactctg

SEQ ID NO: 5153403 - DNA, 13 bp, Homo sapiens
acgttaattaaac

SEQ ID NO: 5153404 - DNA, 12 bp, Homo sapiens
acgttacatttt

SEQ ID NO: 5153405 - DNA, 15 bp, Homo sapiens
acgttactcagggct

SEQ ID NO: 5153406 - DNA, 17 bp, Homo sapiens
acgttagaccacaaata

SEQ ID NO: 5153407 - DNA, 22 bp, Homo sapiens
acgttaggaggacaaaaggaat

SEQ ID NO: 5153408 - DNA, 16 bp, Homo sapiens
acgttaggcatttcct

SEQ ID NO: 5153409 - DNA, 20 bp, Homo sapiens
acgttaggcatttcctgctg

SEQ ID NO: 5153410 - DNA, 23 bp, Homo sapiens
acgttaggcccgggcccctggca

SEQ ID NO: 5153411 - DNA, 15 bp, Homo sapiens
acgttcataaccaac

SEQ ID NO: 5153412 - DNA, 16 bp, Homo sapiens
acgttcatcacctgct

SEQ ID NO: 5153413 - DNA, 14 bp, Homo sapiens
acgttcatgttcat

SEQ ID NO: 5153414 - DNA, 11 bp, Homo sapiens
acgttcccttt

SEQ ID NO: 5153415 - DNA, 19 bp, Homo sapiens
acgttcctctccacctgca

SEQ ID NO: 5153416 - DNA, 14 bp, Homo sapiens
acgttcctggcccc

SEQ ID NO: 5153417 - DNA, 24 bp, Homo sapiens
acgttcctggccccctcattcaga

SEQ ID NO: 5153418 - DNA, 16 bp, Homo sapiens
acgttccttactgcag

SEQ ID NO: 5153419 - DNA, 19 bp, Homo sapiens
acgttccttactgcagaat

SEQ ID NO: 5153420 - DNA, 23 bp, Homo sapiens
acgttcgaggcggtttccaggaa

SEQ ID NO: 5153421 - DNA, 19 bp, Homo sapiens
acgttctataaatgaatgt

SEQ ID NO: 5153422 - DNA, 15 bp, Homo sapiens
acgttctccagccca

SEQ ID NO: 5153423 - DNA, 22 bp, Homo sapiens
acgttctccagcccacacccct

SEQ ID NO: 5153424 - DNA, 21 bp, Homo sapiens
acgttctggaacattctgtca

SEQ ID NO: 5153425 - DNA, 20 bp, Homo sapiens
acgttctgttaatttagtaa

SEQ ID NO: 5153426 - DNA, 16 bp, Homo sapiens
acgttgacccctttcc

SEQ ID NO: 5153427 - DNA, 21 bp, Homo sapiens
acgttgacccctttcccccac

SEQ ID NO: 5153428 - DNA, 22 bp, Homo sapiens
acgttgacccctttcccccacc

SEQ ID NO: 5153429 - DNA, 22 bp, Homo sapiens
acgttgacgggccgcaggaggg

SEQ ID NO: 5153430 - DNA, 21 bp, Homo sapiens
acgttgagaatcactgctcca

SEQ ID NO: 5153431 - DNA, 15 bp, Homo sapiens
acgttgccaggggct

SEQ ID NO: 5153432 - DNA, 21 bp, Homo sapiens
acgttgccaggggcttgagaa

SEQ ID NO: 5153433 - DNA, 13 bp, Homo sapiens
acgttgctcccca

SEQ ID NO: 5153434 - DNA, 13 bp, Homo sapiens
acgttgctgagcc

SEQ ID NO: 5153435 - DNA, 16 bp, Homo sapiens
acgttgctgagccagc

SEQ ID NO: 5153436 - DNA, 19 bp, Homo sapiens
acgttgctgagccagctgc

SEQ ID NO: 5153437 - DNA, 14 bp, Homo sapiens
acgttgctgccagt

SEQ ID NO: 5153438 - DNA, 12 bp, Homo sapiens
acgttgctgtgg

SEQ ID NO: 5153439 - DNA, 19 bp, Homo sapiens
acgttggagaagcccgtgt

SEQ ID NO: 5153440 - DNA, 19 bp, Homo sapiens
acgttggcctcagggccag

SEQ ID NO: 5153441 - DNA, 21 bp, Homo sapiens
acgttggcctcagggccagga

SEQ ID NO: 5153442 - DNA, 22 bp, Homo sapiens
acgttggcctcagggccaggaa

SEQ ID NO: 5153443 - DNA, 18 bp, Homo sapiens
acgttggcgaggaaaaac

SEQ ID NO: 5153444 - DNA, 22 bp, Homo sapiens
acgttggcgaggaaaaacaaaa

SEQ ID NO: 5153445 - DNA, 16 bp, Homo sapiens
acgttgggacagggag

SEQ ID NO: 5153446 - DNA, 16 bp, Homo sapiens
acgttggttaaataaa

SEQ ID NO: 5153447 - DNA, 21 bp, Homo sapiens
acgttgtgatgaagctgaggc

SEQ ID NO: 5153448 - DNA, 14 bp, Homo sapiens
acgttgtgcatttg

SEQ ID NO: 5153449 - DNA, 14 bp, Homo sapiens
acgttgttaaatgg

SEQ ID NO: 5153450 - DNA, 16 bp, Homo sapiens
acgttgtttcttatag

SEQ ID NO: 5153451 - DNA, 17 bp, Homo sapiens
acgttgtttcttataga

SEQ ID NO: 5153452 - DNA, 13 bp, Homo sapiens
acgtttaaagttc

SEQ ID NO: 5153453 - DNA, 15 bp, Homo sapiens
acgtttaacattgat

SEQ ID NO: 5153454 - DNA, 18 bp, Homo sapiens
acgtttaacattgattgg

SEQ ID NO: 5153455 - DNA, 17 bp, Homo sapiens
acgtttaagccaaaaca

SEQ ID NO: 5153456 - DNA, 23 bp, Homo sapiens
acgtttaagccaaaacaatgttt

SEQ ID NO: 5153457 - DNA, 14 bp, Homo sapiens
acgtttagaaatga

SEQ ID NO: 5153458 - DNA, 19 bp, Homo sapiens
acgtttagaaatgatttca

SEQ ID NO: 5153459 - DNA, 14 bp, Homo sapiens
acgtttatttaaaa

SEQ ID NO: 5153460 - DNA, 19 bp, Homo sapiens
acgtttcagtaataaaaca

SEQ ID NO: 5153461 - DNA, 14 bp, Homo sapiens
acgtttctaaaggc

SEQ ID NO: 5153462 - DNA, 15 bp, Homo sapiens
acgtttctaaaggct

SEQ ID NO: 5153463 - DNA, 12 bp, Homo sapiens
acgtttcttcac

SEQ ID NO: 5153464 - DNA, 17 bp, Homo sapiens
acgtttcttctttctag

SEQ ID NO: 5153465 - DNA, 12 bp, Homo sapiens
acgtttctttaa

SEQ ID NO: 5153466 - DNA, 22 bp, Homo sapiens
acgtttgaagacattgcaccag

SEQ ID NO: 5153467 - DNA, 11 bp, Homo sapiens
acgtttgaagt

SEQ ID NO: 5153468 - DNA, 15 bp, Homo sapiens
acgtttgatacaaca

SEQ ID NO: 5153469 - DNA, 21 bp, Homo sapiens
acgtttgcagttgatgtgtct

SEQ ID NO: 5153470 - DNA, 20 bp, Homo sapiens
acgtttggactgatttgtgg

SEQ ID NO: 5153471 - DNA, 19 bp, Homo sapiens
acgtttggttcaaatgtgt

SEQ ID NO: 5153472 - DNA, 13 bp, Homo sapiens
acgtttgtatgtg

SEQ ID NO: 5153473 - DNA, 15 bp, Homo sapiens
acgtttgtgcagaat

SEQ ID NO: 5153474 - DNA, 18 bp, Homo sapiens
acgttttaaggactgact

SEQ ID NO: 5153475 - DNA, 19 bp, Homo sapiens
acgttttaaggactgactg

SEQ ID NO: 5153476 - DNA, 17 bp, Homo sapiens
acgttttagaaaatttt

SEQ ID NO: 5153477 - DNA, 19 bp, Homo sapiens
acgttttagaaaattttat

SEQ ID NO: 5153478 - DNA, 20 bp, Homo sapiens
acgttttataagcatcatta

SEQ ID NO: 5153479 - DNA, 21 bp, Homo sapiens
acgttttataagcatcattat

SEQ ID NO: 5153480 - DNA, 14 bp, Homo sapiens
acgttttattgtgt

SEQ ID NO: 5153481 - DNA, 12 bp, Homo sapiens
acgttttctaat

SEQ ID NO: 5153482 - DNA, 19 bp, Homo sapiens
acgttttctaattgcttat

SEQ ID NO: 5153483 - DNA, 19 bp, Homo sapiens
acgttttctactttgaaat

SEQ ID NO: 5153484 - DNA, 17 bp, Homo sapiens
acgttttcttaaatgtt

SEQ ID NO: 5153485 - DNA, 19 bp, Homo sapiens
acgttttcttaaatgtttt

SEQ ID NO: 5153486 - DNA, 13 bp, Homo sapiens
acgttttcttctt

SEQ ID NO: 5153487 - DNA, 14 bp, Homo sapiens
acgttttcttcttt

SEQ ID NO: 5153488 - DNA, 15 bp, Homo sapiens
acgttttcttctttc

SEQ ID NO: 5153489 - DNA, 21 bp, Homo sapiens
acgttttgcctcatgaacact

SEQ ID NO: 5153490 - DNA, 14 bp, Homo sapiens
acgtttttccttta

SEQ ID NO: 5153491 - DNA, 14 bp, Homo sapiens
acgtttttggaaaa

SEQ ID NO: 5153492 - DNA, 19 bp, Homo sapiens
acgtttttgtgctgtgggc

SEQ ID NO: 5153493 - DNA, 17 bp, Homo sapiens
acgttttttcctcagtg

SEQ ID NO: 5153494 - DNA, 13 bp, Homo sapiens
acgttttttcttc

SEQ ID NO: 5153495 - DNA, 17 bp, Homo sapiens
actaaaaaaaaaaaggc

SEQ ID NO: 5153496 - DNA, 13 bp, Homo sapiens
actaaaaaaattt

SEQ ID NO: 5153497 - DNA, 15 bp, Homo sapiens
actaaaaaaccaaca

SEQ ID NO: 5153498 - DNA, 19 bp, Homo sapiens
actaaaaaaccaacaatgt

SEQ ID NO: 5153499 - DNA, 22 bp, Homo sapiens
actaaaaacactggattcattt

SEQ ID NO: 5153500 - DNA, 16 bp, Homo sapiens
actaaaaagaaggaaa

SEQ ID NO: 5153501 - DNA, 20 bp, Homo sapiens
actaaaaagagactgtgcca

SEQ ID NO: 5153502 - DNA, 17 bp, Homo sapiens
actaaaaaggaaacttc

SEQ ID NO: 5153503 - DNA, 20 bp, Homo sapiens
actaaaaagtataaaatagt

SEQ ID NO: 5153504 - DNA, 17 bp, Homo sapiens
actaaaaagttgaacca

SEQ ID NO: 5153505 - DNA, 18 bp, Homo sapiens
actaaaaagttgaaccat

SEQ ID NO: 5153506 - DNA, 15 bp, Homo sapiens
actaaaaataagaaa

SEQ ID NO: 5153507 - DNA, 13 bp, Homo sapiens
actaaaaatattg

SEQ ID NO: 5153508 - DNA, 12 bp, Homo sapiens
actaaaaatgca

SEQ ID NO: 5153509 - DNA, 18 bp, Homo sapiens
actaaaacattatatgta

SEQ ID NO: 5153510 - DNA, 16 bp, Homo sapiens
actaaaacattgtcta

SEQ ID NO: 5153511 - DNA, 18 bp, Homo sapiens
actaaaacattgtctaca

SEQ ID NO: 5153512 - DNA, 14 bp, Homo sapiens
actaaaactagata

SEQ ID NO: 5153513 - DNA, 14 bp, Homo sapiens
actaaaagaatttg

SEQ ID NO: 5153514 - DNA, 13 bp, Homo sapiens
actaaaagacatt

SEQ ID NO: 5153515 - DNA, 11 bp, Homo sapiens
actaaaagata

SEQ ID NO: 5153516 - DNA, 20 bp, Homo sapiens
actaaaagatataagtgctg

SEQ ID NO: 5153517 - DNA, 23 bp, Homo sapiens
actaaaagatataagtgctgtat

SEQ ID NO: 5153518 - DNA, 12 bp, Homo sapiens
actaaaagatcg

SEQ ID NO: 5153519 - DNA, 15 bp, Homo sapiens
actaaaagcatgaat

SEQ ID NO: 5153520 - DNA, 20 bp, Homo sapiens
actaaaagcatgaattggaa

SEQ ID NO: 5153521 - DNA, 13 bp, Homo sapiens
actaaaagtacaa

SEQ ID NO: 5153522 - DNA, 20 bp, Homo sapiens
actaaaagtggcatagagaa

SEQ ID NO: 5153523 - DNA, 17 bp, Homo sapiens
actaaaataattttgta

SEQ ID NO: 5153524 - DNA, 21 bp, Homo sapiens
actaaaatacaagtaaagcta

SEQ ID NO: 5153525 - DNA, 14 bp, Homo sapiens
actaaaatagttta

SEQ ID NO: 5153526 - DNA, 12 bp, Homo sapiens
actaaaatatat

SEQ ID NO: 5153527 - DNA, 14 bp, Homo sapiens
actaaaatatgtct

SEQ ID NO: 5153528 - DNA, 14 bp, Homo sapiens
actaaaatatttat

SEQ ID NO: 5153529 - DNA, 18 bp, Homo sapiens
actaaaatgaggatccag

SEQ ID NO: 5153530 - DNA, 17 bp, Homo sapiens
actaaaatgtttaattc

SEQ ID NO: 5153531 - DNA, 15 bp, Homo sapiens
actaaaattaatgca

SEQ ID NO: 5153532 - DNA, 12 bp, Homo sapiens
actaaaattatg

SEQ ID NO: 5153533 - DNA, 12 bp, Homo sapiens
actaaaattcaa

SEQ ID NO: 5153534 - DNA, 15 bp, Homo sapiens
actaaaattccactc

SEQ ID NO: 5153535 - DNA, 13 bp, Homo sapiens
actaaacaaataa

SEQ ID NO: 5153536 - DNA, 16 bp, Homo sapiens
actaaacatgtatgta

SEQ ID NO: 5153537 - DNA, 17 bp, Homo sapiens
actaaacatgtatgtaa

SEQ ID NO: 5153538 - DNA, 16 bp, Homo sapiens
actaaaccaactctaa

SEQ ID NO: 5153539 - DNA, 17 bp, Homo sapiens
actaaaccacttaaaat

SEQ ID NO: 5153540 - DNA, 19 bp, Homo sapiens
actaaaccacttctctgct

SEQ ID NO: 5153541 - DNA, 20 bp, Homo sapiens
actaaaccacttctctgctg

SEQ ID NO: 5153542 - DNA, 13 bp, Homo sapiens
actaaaccctcac

SEQ ID NO: 5153543 - DNA, 18 bp, Homo sapiens
actaaactaaaatagttt

SEQ ID NO: 5153544 - DNA, 19 bp, Homo sapiens
actaaactaaaatagttta

SEQ ID NO: 5153545 - DNA, 19 bp, Homo sapiens
actaaactatctgtattta

SEQ ID NO: 5153546 - DNA, 14 bp, Homo sapiens
actaaactcattta

SEQ ID NO: 5153547 - DNA, 19 bp, Homo sapiens
actaaactccatgatattt

SEQ ID NO: 5153548 - DNA, 20 bp, Homo sapiens
accttgccccaacccttctt

SEQ ID NO: 5153549 - DNA, 21 bp, Homo sapiens
accttgccccaacccttcttc

SEQ ID NO: 5153550 - DNA, 13 bp, Homo sapiens
accttgccttgaa

SEQ ID NO: 5153551 - DNA, 18 bp, Homo sapiens
accttgcgaccatgtgta

SEQ ID NO: 5153552 - DNA, 13 bp, Homo sapiens
accttgctaattt

SEQ ID NO: 5153553 - DNA, 19 bp, Homo sapiens
accttgctagctagccagc

SEQ ID NO: 5153554 - DNA, 16 bp, Homo sapiens
accttgctatcaagaa

SEQ ID NO: 5153555 - DNA, 15 bp, Homo sapiens
accttgctcttgggg

SEQ ID NO: 5153556 - DNA, 22 bp, Homo sapiens
accttgctgcaagcacagccct

SEQ ID NO: 5153557 - DNA, 18 bp, Homo sapiens
accttgctgcagtgtcca

SEQ ID NO: 5153558 - DNA, 12 bp, Homo sapiens
accttgctgcca

SEQ ID NO: 5153559 - DNA, 14 bp, Homo sapiens
accttgctgtcctg

SEQ ID NO: 5153560 - DNA, 19 bp, Homo sapiens
accttgctgtcctgatctg

SEQ ID NO: 5153561 - DNA, 23 bp, Homo sapiens
accttgctgtcctgatctgtgat

SEQ ID NO: 5153562 - DNA, 14 bp, Homo sapiens
accttgctgtgtga

SEQ ID NO: 5153563 - DNA, 12 bp, Homo sapiens
accttgcttcct

SEQ ID NO: 5153564 - DNA, 14 bp, Homo sapiens
accttgcttccttc

SEQ ID NO: 5153565 - DNA, 17 bp, Homo sapiens
accttgcttccttctca

SEQ ID NO: 5153566 - DNA, 22 bp, Homo sapiens
accttggaaacagttggcactg

SEQ ID NO: 5153567 - DNA, 18 bp, Homo sapiens
accttggacatcctcctc

SEQ ID NO: 5153568 - DNA, 18 bp, Homo sapiens
accttggaccactcctgt

SEQ ID NO: 5153569 - DNA, 23 bp, Homo sapiens
accttggaccactcctgtccctg

SEQ ID NO: 5153570 - DNA, 17 bp, Homo sapiens
accttggaccctggtga

SEQ ID NO: 5153571 - DNA, 15 bp, Homo sapiens
accttggactcctcc

SEQ ID NO: 5153572 - DNA, 18 bp, Homo sapiens
accttggagcatttatgt

SEQ ID NO: 5153573 - DNA, 22 bp, Homo sapiens
accttggagcatttatgtagac

SEQ ID NO: 5153574 - DNA, 21 bp, Homo sapiens
accttggaggaatgacaataa

SEQ ID NO: 5153575 - DNA, 13 bp, Homo sapiens
accttggaggagg

SEQ ID NO: 5153576 - DNA, 18 bp, Homo sapiens
accttggcaccagacacc

SEQ ID NO: 5153577 - DNA, 16 bp, Homo sapiens
accttggcataagaca

SEQ ID NO: 5153578 - DNA, 19 bp, Homo sapiens
accttggcatcctgtgctt

SEQ ID NO: 5153579 - DNA, 18 bp, Homo sapiens
accttggcccaggagctc

SEQ ID NO: 5153580 - DNA, 11 bp, Homo sapiens
accttggcctc

SEQ ID NO: 5153581 - DNA, 13 bp, Homo sapiens
accttggcctccc

SEQ ID NO: 5153582 - DNA, 15 bp, Homo sapiens
accttggcctcccaa

SEQ ID NO: 5153583 - DNA, 14 bp, Homo sapiens
accttggcctgggc

SEQ ID NO: 5153584 - DNA, 16 bp, Homo sapiens
accttggcctgggccg

SEQ ID NO: 5153585 - DNA, 12 bp, Homo sapiens
accttggccttc

SEQ ID NO: 5153586 - DNA, 16 bp, Homo sapiens
accttggccttctccc

SEQ ID NO: 5153587 - DNA, 23 bp, Homo sapiens
accttggcgcgcagcccgggaga

SEQ ID NO: 5153588 - DNA, 14 bp, Homo sapiens
accttggctcaagt

SEQ ID NO: 5153589 - DNA, 14 bp, Homo sapiens
accttggctgcagg

SEQ ID NO: 5153590 - DNA, 18 bp, Homo sapiens
accttggctgcagggagt

SEQ ID NO: 5153591 - DNA, 12 bp, Homo sapiens
accttggcttgg

SEQ ID NO: 5153592 - DNA, 17 bp, Homo sapiens
accttggcttggccctg

SEQ ID NO: 5153593 - DNA, 12 bp, Homo sapiens
accttgggacca

SEQ ID NO: 5153594 - DNA, 13 bp, Homo sapiens
accttgggccctg

SEQ ID NO: 5153595 - DNA, 14 bp, Homo sapiens
accttgggctgggg

SEQ ID NO: 5153596 - DNA, 17 bp, Homo sapiens
accttggggcttgactt

SEQ ID NO: 5153597 - DNA, 19 bp, Homo sapiens
accttgggtctgtgtcact

SEQ ID NO: 5153598 - DNA, 16 bp, Homo sapiens
accttggtaaattgta

SEQ ID NO: 5153599 - DNA, 18 bp, Homo sapiens
accttggtaaattgtaaa

SEQ ID NO: 5153600 - DNA, 20 bp, Homo sapiens
accttggttatcaaatacat

SEQ ID NO: 5153601 - DNA, 14 bp, Homo sapiens
accttgtaaaaaaa

SEQ ID NO: 5153602 - DNA, 19 bp, Homo sapiens
accttgtaaaaaaagcaaa

SEQ ID NO: 5153603 - DNA, 21 bp, Homo sapiens
accttgtaaccagtgcagaaa

SEQ ID NO: 5153604 - DNA, 16 bp, Homo sapiens
accttgtaatgtaact

SEQ ID NO: 5153605 - DNA, 21 bp, Homo sapiens
accttgtattgaagttaactg

SEQ ID NO: 5153606 - DNA, 18 bp, Homo sapiens
accttgtcattttggtct

SEQ ID NO: 5153607 - DNA, 21 bp, Homo sapiens
accttgtctgctaaataaaca

SEQ ID NO: 5153608 - DNA, 22 bp, Homo sapiens
accttgtctgctaaataaacat

SEQ ID NO: 5153609 - DNA, 15 bp, Homo sapiens
accttgtctttcaaa

SEQ ID NO: 5153610 - DNA, 20 bp, Homo sapiens
accttgtgaaggaaaaacat

SEQ ID NO: 5153611 - DNA, 21 bp, Homo sapiens
accttgtgactcagtgtattt

SEQ ID NO: 5153612 - DNA, 13 bp, Homo sapiens
accttgtgaggga

SEQ ID NO: 5153613 - DNA, 18 bp, Homo sapiens
accttgtgagggagagaa

SEQ ID NO: 5153614 - DNA, 14 bp, Homo sapiens
accttgtgatcatg

SEQ ID NO: 5153615 - DNA, 18 bp, Homo sapiens
accttgtgcccagggttt

SEQ ID NO: 5153616 - DNA, 23 bp, Homo sapiens
accttgtgcccagggttttgccc

SEQ ID NO: 5153617 - DNA, 13 bp, Homo sapiens
accttgtgctact

SEQ ID NO: 5153618 - DNA, 12 bp, Homo sapiens
accttgtgggaa

SEQ ID NO: 5153619 - DNA, 16 bp, Homo sapiens
accttgtgggaccagt

SEQ ID NO: 5153620 - DNA, 22 bp, Homo sapiens
accttgtgggaccagtcccaca

SEQ ID NO: 5153621 - DNA, 20 bp, Homo sapiens
accttgtgtactttcttccc

SEQ ID NO: 5153622 - DNA, 12 bp, Homo sapiens
accttgtgttta

SEQ ID NO: 5153623 - DNA, 16 bp, Homo sapiens
accttgttacttctga

SEQ ID NO: 5153624 - DNA, 22 bp, Homo sapiens
accttgttatttctcagacttt

SEQ ID NO: 5153625 - DNA, 16 bp, Homo sapiens
accttgttcctgccct

SEQ ID NO: 5153626 - DNA, 23 bp, Homo sapiens
accttgttcctgtaaaatccatt

SEQ ID NO: 5153627 - DNA, 20 bp, Homo sapiens
accttgttctatttttcaat

SEQ ID NO: 5153628 - DNA, 20 bp, Homo sapiens
accttgttgatgccagctgt

SEQ ID NO: 5153629 - DNA, 18 bp, Homo sapiens
accttgttgcagatgggt

SEQ ID NO: 5153630 - DNA, 22 bp, Homo sapiens
accttgttgcatgatgtatttt

SEQ ID NO: 5153631 - DNA, 15 bp, Homo sapiens
accttgttggagcct

SEQ ID NO: 5153632 - DNA, 18 bp, Homo sapiens
accttgttggagcctgca

SEQ ID NO: 5153633 - DNA, 18 bp, Homo sapiens
accttgttgttgttaaat

SEQ ID NO: 5153634 - DNA, 17 bp, Homo sapiens
accttgtttgttttatt

SEQ ID NO: 5153635 - DNA, 19 bp, Homo sapiens
accttgtttgttttattca

SEQ ID NO: 5153636 - DNA, 22 bp, Homo sapiens
accttgtttttaatctcctgtt

SEQ ID NO: 5153637 - DNA, 19 bp, Homo sapiens
acctttaaaaatgtataat

SEQ ID NO: 5153638 - DNA, 15 bp, Homo sapiens
acctttaaaataata

SEQ ID NO: 5153639 - DNA, 12 bp, Homo sapiens
acctttaaatat

SEQ ID NO: 5153640 - DNA, 22 bp, Homo sapiens
acctttaaatatcattctttgt

SEQ ID NO: 5153641 - DNA, 22 bp, Homo sapiens
acctttaaatttaggtaaataa

SEQ ID NO: 5153642 - DNA, 19 bp, Homo sapiens
acctttaacacagacccct

SEQ ID NO: 5153643 - DNA, 24 bp, Homo sapiens
acctttaacacagacccctaggga

SEQ ID NO: 5153644 - DNA, 19 bp, Homo sapiens
acctttaacttttttttct

SEQ ID NO: 5153645 - DNA, 22 bp, Homo sapiens
acctttaagaaaaatgaaaact

SEQ ID NO: 5153646 - DNA, 16 bp, Homo sapiens
acctttaagtcctctc

SEQ ID NO: 5153647 - DNA, 17 bp, Homo sapiens
acctttaagtcctctct

SEQ ID NO: 5153648 - DNA, 18 bp, Homo sapiens
acctttaagtcctctctt

SEQ ID NO: 5153649 - DNA, 22 bp, Homo sapiens
acctttaatcaggtcctgctca

SEQ ID NO: 5153650 - DNA, 16 bp, Homo sapiens
acctttaatctgtttt

SEQ ID NO: 5153651 - DNA, 20 bp, Homo sapiens
acctttaatgcaatgcatat

SEQ ID NO: 5153652 - DNA, 15 bp, Homo sapiens
acctttacataattg

SEQ ID NO: 5153653 - DNA, 16 bp, Homo sapiens
acctttacataattgc

SEQ ID NO: 5153654 - DNA, 15 bp, Homo sapiens
acctttactgtgctt

SEQ ID NO: 5153655 - DNA, 14 bp, Homo sapiens
acctttactttaga

SEQ ID NO: 5153656 - DNA, 17 bp, Homo sapiens
acctttagaacaggaga

SEQ ID NO: 5153657 - DNA, 16 bp, Homo sapiens
acctttagaatatctt

SEQ ID NO: 5153658 - DNA, 17 bp, Homo sapiens
acctttatagctctcat

SEQ ID NO: 5153659 - DNA, 16 bp, Homo sapiens
acctttatgttttaat

SEQ ID NO: 5153660 - DNA, 14 bp, Homo sapiens
acctttattaaaat

SEQ ID NO: 5153661 - DNA, 14 bp, Homo sapiens
acctttattcagaa

SEQ ID NO: 5153662 - DNA, 22 bp, Homo sapiens
acctttattcagaactttagta

SEQ ID NO: 5153663 - DNA, 14 bp, Homo sapiens
acctttattcttta

SEQ ID NO: 5153664 - DNA, 14 bp, Homo sapiens
acctttattctttt

SEQ ID NO: 5153665 - DNA, 15 bp, Homo sapiens
acctttcaaacccag

SEQ ID NO: 5153666 - DNA, 21 bp, Homo sapiens
acctttcaataggaaaaactg

SEQ ID NO: 5153667 - DNA, 12 bp, Homo sapiens
acctttcacaaa

SEQ ID NO: 5153668 - DNA, 15 bp, Homo sapiens
acctttcacatagag

SEQ ID NO: 5153669 - DNA, 15 bp, Homo sapiens
acctttcagaactca

SEQ ID NO: 5153670 - DNA, 17 bp, Homo sapiens
acctttcagctgtgaac

SEQ ID NO: 5153671 - DNA, 18 bp, Homo sapiens
acctttcataatttttaa

SEQ ID NO: 5153672 - DNA, 11 bp, Homo sapiens
acctttcatac

SEQ ID NO: 5153673 - DNA, 23 bp, Homo sapiens
acctttccaaagttaacagattt

SEQ ID NO: 5153674 - DNA, 22 bp, Homo sapiens
acctttccactcccactgccag

SEQ ID NO: 5153675 - DNA, 23 bp, Homo sapiens
acctttccattttacgttttaga

SEQ ID NO: 5153676 - DNA, 17 bp, Homo sapiens
acctttcccacagtctc

SEQ ID NO: 5153677 - DNA, 20 bp, Homo sapiens
acctttcccacctctctccc

SEQ ID NO: 5153678 - DNA, 21 bp, Homo sapiens
acctttcccacctctctcccc

SEQ ID NO: 5153679 - DNA, 15 bp, Homo sapiens
acctttccccagaca

SEQ ID NO: 5153680 - DNA, 19 bp, Homo sapiens
acctttccctcaccccctc

SEQ ID NO: 5153681 - DNA, 22 bp, Homo sapiens
acctttccctcaccccctccca

SEQ ID NO: 5153682 - DNA, 19 bp, Homo sapiens
acctttccgctgtcgcccc

SEQ ID NO: 5153683 - DNA, 14 bp, Homo sapiens
acctttcctgaaat

SEQ ID NO: 5153684 - DNA, 19 bp, Homo sapiens
acctttcctgatgcccctg

SEQ ID NO: 5153685 - DNA, 22 bp, Homo sapiens
acctttcctgatgcccctgaca

SEQ ID NO: 5153686 - DNA, 21 bp, Homo sapiens
acctttctaagggaaaaagtt

SEQ ID NO: 5153687 - DNA, 22 bp, Homo sapiens
acctttctaagggaaaaagttg

SEQ ID NO: 5153688 - DNA, 14 bp, Homo sapiens
acctttctagcctt

SEQ ID NO: 5153689 - DNA, 15 bp, Homo sapiens
acctttctagcctta

SEQ ID NO: 5153690 - DNA, 15 bp, Homo sapiens
acctttctccactgg

SEQ ID NO: 5153691 - DNA, 17 bp, Homo sapiens
acctttctccactgggt

SEQ ID NO: 5153692 - DNA, 20 bp, Homo sapiens
acctttctccctccttcctt

SEQ ID NO: 5153693 - DNA, 20 bp, Homo sapiens
acctttctcctttgtacttt

SEQ ID NO: 5153694 - DNA, 13 bp, Homo sapiens
acctttctctctc

SEQ ID NO: 5153695 - DNA, 14 bp, Homo sapiens
acctttctgaatgg

SEQ ID NO: 5153696 - DNA, 16 bp, Homo sapiens
acctttctgacatcag

SEQ ID NO: 5153697 - DNA, 14 bp, Homo sapiens
acctttctgaggag

SEQ ID NO: 5153698 - DNA, 18 bp, Homo sapiens
acctttctggcttttaag

SEQ ID NO: 5153699 - DNA, 20 bp, Homo sapiens
acctttctgggctttctcct

SEQ ID NO: 5153700 - DNA, 16 bp, Homo sapiens
acctttctgtagccta

SEQ ID NO: 5153701 - DNA, 19 bp, Homo sapiens
acctttcttcactgcagat

SEQ ID NO: 5153702 - DNA, 22 bp, Homo sapiens
acctttgaaatattaaaatcac

SEQ ID NO: 5153703 - DNA, 19 bp, Homo sapiens
acctttgagagatataata

SEQ ID NO: 5153704 - DNA, 22 bp, Homo sapiens
acctttgatgaattcttcctct

SEQ ID NO: 5153705 - DNA, 10 bp, Homo sapiens
acctttgcag

SEQ ID NO: 5153706 - DNA, 12 bp, Homo sapiens
acctttgcaggg

SEQ ID NO: 5153707 - DNA, 11 bp, Homo sapiens
acctttgctat

SEQ ID NO: 5153708 - DNA, 14 bp, Homo sapiens
acctttgctatgta

SEQ ID NO: 5153709 - DNA, 16 bp, Homo sapiens
acctttgctatgtaag

SEQ ID NO: 5153710 - DNA, 18 bp, Homo sapiens
acctttgctatgtaaggg

SEQ ID NO: 5153711 - DNA, 12 bp, Homo sapiens
acctttgctgtc

SEQ ID NO: 5153712 - DNA, 14 bp, Homo sapiens
acctttgctgtcac

SEQ ID NO: 5153713 - DNA, 15 bp, Homo sapiens
acctttggcttaatt

SEQ ID NO: 5153714 - DNA, 18 bp, Homo sapiens
acctttgggatcagcctc

SEQ ID NO: 5153715 - DNA, 14 bp, Homo sapiens
acctttggtgcaga

SEQ ID NO: 5153716 - DNA, 15 bp, Homo sapiens
acctttggtgcagag

SEQ ID NO: 5153717 - DNA, 17 bp, Homo sapiens
acctttggtgcagaggt

SEQ ID NO: 5153718 - DNA, 19 bp, Homo sapiens
acctttgtaaaacagccta

SEQ ID NO: 5153719 - DNA, 18 bp, Homo sapiens
acctttgtaagaaaacca

SEQ ID NO: 5153720 - DNA, 20 bp, Homo sapiens
acctttgtaagacatttgta

SEQ ID NO: 5153721 - DNA, 13 bp, Homo sapiens
acctttgtagtta

SEQ ID NO: 5153722 - DNA, 15 bp, Homo sapiens
acctttgtagttact

SEQ ID NO: 5153723 - DNA, 19 bp, Homo sapiens
acctttgtagttactcaag

SEQ ID NO: 5153724 - DNA, 19 bp, Homo sapiens
acctttgtattctctcctg

SEQ ID NO: 5153725 - DNA, 23 bp, Homo sapiens
acctttgtattctctcctgtacc

SEQ ID NO: 5153726 - DNA, 19 bp, Homo sapiens
acctttgtctcacgattcc

SEQ ID NO: 5153727 - DNA, 22 bp, Homo sapiens
actaaactccatgatatttaag

SEQ ID NO: 5153728 - DNA, 16 bp, Homo sapiens
actaaactctctttgg

SEQ ID NO: 5153729 - DNA, 13 bp, Homo sapiens
actaaactttacc

SEQ ID NO: 5153730 - DNA, 21 bp, Homo sapiens
actaaagaaaatatctgaaat

SEQ ID NO: 5153731 - DNA, 15 bp, Homo sapiens
actaaagaaagatta

SEQ ID NO: 5153732 - DNA, 11 bp, Homo sapiens
actaaagaaga

SEQ ID NO: 5153733 - DNA, 20 bp, Homo sapiens
actaaagaagaggagaaaaa

SEQ ID NO: 5153734 - DNA, 16 bp, Homo sapiens
actaaagagagaatgt

SEQ ID NO: 5153735 - DNA, 13 bp, Homo sapiens
actaaagcaatag

SEQ ID NO: 5153736 - DNA, 15 bp, Homo sapiens
actaaagcaatagaa

SEQ ID NO: 5153737 - DNA, 19 bp, Homo sapiens
actaaagcaatagaaacaa

SEQ ID NO: 5153738 - DNA, 17 bp, Homo sapiens
actaaagcagtagaaat

SEQ ID NO: 5153739 - DNA, 12 bp, Homo sapiens
actaaagcagtg

SEQ ID NO: 5153740 - DNA, 20 bp, Homo sapiens
actaaagcagtggacaccag

SEQ ID NO: 5153741 - DNA, 20 bp, Homo sapiens
actaaagcatcacacagtgg

SEQ ID NO: 5153742 - DNA, 20 bp, Homo sapiens
actaaagcatgaaatgtgaa

SEQ ID NO: 5153743 - DNA, 15 bp, Homo sapiens
actaaagccagcctg

SEQ ID NO: 5153744 - DNA, 20 bp, Homo sapiens
actaaagccatttgtctgtg

SEQ ID NO: 5153745 - DNA, 21 bp, Homo sapiens
actaaaggaaacaaagcaata

SEQ ID NO: 5153746 - DNA, 12 bp, Homo sapiens
actaaaggaatc

SEQ ID NO: 5153747 - DNA, 22 bp, Homo sapiens
actaaagggcaggtggttctaa

SEQ ID NO: 5153748 - DNA, 18 bp, Homo sapiens
actaaaggtggttttatt

SEQ ID NO: 5153749 - DNA, 15 bp, Homo sapiens
actaaagtatagaga

SEQ ID NO: 5153750 - DNA, 21 bp, Homo sapiens
actaaagtatagagaaaagtg

SEQ ID NO: 5153751 - DNA, 20 bp, Homo sapiens
actaaagtatggtacatcta

SEQ ID NO: 5153752 - DNA, 14 bp, Homo sapiens
actaaagtatgtaa

SEQ ID NO: 5153753 - DNA, 22 bp, Homo sapiens
actaaagtatgtaaagtatgta

SEQ ID NO: 5153754 - DNA, 18 bp, Homo sapiens
actaaagtgcattatttt

SEQ ID NO: 5153755 - DNA, 21 bp, Homo sapiens
actaaagtgcattattttatt

SEQ ID NO: 5153756 - DNA, 18 bp, Homo sapiens
actaaagttgaaaataca

SEQ ID NO: 5153757 - DNA, 15 bp, Homo sapiens
actaaagttgtactt

SEQ ID NO: 5153758 - DNA, 15 bp, Homo sapiens
actaaataaaacaat

SEQ ID NO: 5153759 - DNA, 18 bp, Homo sapiens
actaaataaacatctgat

SEQ ID NO: 5153760 - DNA, 21 bp, Homo sapiens
actaaataatgatcttccaaa

SEQ ID NO: 5153761 - DNA, 22 bp, Homo sapiens
actaaataatgatcttccaaat

SEQ ID NO: 5153762 - DNA, 14 bp, Homo sapiens
actaaatacatgtt

SEQ ID NO: 5153763 - DNA, 14 bp, Homo sapiens
actaaatagatttt

SEQ ID NO: 5153764 - DNA, 20 bp, Homo sapiens
actaaatagcatgtattgtg

SEQ ID NO: 5153765 - DNA, 19 bp, Homo sapiens
actaaatatatattatgca

SEQ ID NO: 5153766 - DNA, 13 bp, Homo sapiens
actaaatatatgt

SEQ ID NO: 5153767 - DNA, 21 bp, Homo sapiens
actaaatatatgtctgtgtgt

SEQ ID NO: 5153768 - DNA, 13 bp, Homo sapiens
actaaatatgaaa

SEQ ID NO: 5153769 - DNA, 16 bp, Homo sapiens
actaaatatgaaattt

SEQ ID NO: 5153770 - DNA, 18 bp, Homo sapiens
actaaatcagagacaaaa

SEQ ID NO: 5153771 - DNA, 19 bp, Homo sapiens
actaaatcagagacaaaat

SEQ ID NO: 5153772 - DNA, 13 bp, Homo sapiens
actaaatctttta

SEQ ID NO: 5153773 - DNA, 22 bp, Homo sapiens
actaaatgagattatatgtgga

SEQ ID NO: 5153774 - DNA, 15 bp, Homo sapiens
actaaatgcctagtt

SEQ ID NO: 5153775 - DNA, 14 bp, Homo sapiens
actaaatgtgtaca

SEQ ID NO: 5153776 - DNA, 19 bp, Homo sapiens
actaaatgttaaagatgta

SEQ ID NO: 5153777 - DNA, 13 bp, Homo sapiens
actaaatgttcta

SEQ ID NO: 5153778 - DNA, 23 bp, Homo sapiens
actaaattagtttaaaatgaagc

SEQ ID NO: 5153779 - DNA, 12 bp, Homo sapiens
actaaattatta

SEQ ID NO: 5153780 - DNA, 19 bp, Homo sapiens
actaaatttaaatttaaag

SEQ ID NO: 5153781 - DNA, 22 bp, Homo sapiens
actaaatttaaatttaaagata

SEQ ID NO: 5153782 - DNA, 13 bp, Homo sapiens
actaaatttgata

SEQ ID NO: 5153783 - DNA, 18 bp, Homo sapiens
actaaatttgatacttat

SEQ ID NO: 5153784 - DNA, 20 bp, Homo sapiens
actaaatttgatacttatat

SEQ ID NO: 5153785 - DNA, 20 bp, Homo sapiens
actaaatttggggacagatt

SEQ ID NO: 5153786 - DNA, 22 bp, Homo sapiens
actaaatttgtctttcaagtga

SEQ ID NO: 5153787 - DNA, 13 bp, Homo sapiens
actaaattttaaa

SEQ ID NO: 5153788 - DNA, 12 bp, Homo sapiens
actaaattttct

SEQ ID NO: 5153789 - DNA, 13 bp, Homo sapiens
actaaattttctt

SEQ ID NO: 5153790 - DNA, 17 bp, Homo sapiens
actaaattttcttttaa

SEQ ID NO: 5153791 - DNA, 16 bp, Homo sapiens
actaaatttttcatag

SEQ ID NO: 5153792 - DNA, 18 bp, Homo sapiens
actaacaaaatttgaata

SEQ ID NO: 5153793 - DNA, 19 bp, Homo sapiens
actaacaaaatttgaataa

SEQ ID NO: 5153794 - DNA, 15 bp, Homo sapiens
actaacaaaggcagc

SEQ ID NO: 5153795 - DNA, 18 bp, Homo sapiens
actaacaaaggcagctgt

SEQ ID NO: 5153796 - DNA, 21 bp, Homo sapiens
actaacaaatgtaaaattatg

SEQ ID NO: 5153797 - DNA, 20 bp, Homo sapiens
actaacaactgggaaataag

SEQ ID NO: 5153798 - DNA, 21 bp, Homo sapiens
actaacaagatttgtaattac

SEQ ID NO: 5153799 - DNA, 22 bp, Homo sapiens
actaacaagatttgtaattaca

SEQ ID NO: 5153800 - DNA, 15 bp, Homo sapiens
actaacaatgccttg

SEQ ID NO: 5153801 - DNA, 22 bp, Homo sapiens
actaacaatttccccctgttct

SEQ ID NO: 5153802 - DNA, 16 bp, Homo sapiens
actaacacatttttaa

SEQ ID NO: 5153803 - DNA, 12 bp, Homo sapiens
actaacactatt

SEQ ID NO: 5153804 - DNA, 17 bp, Homo sapiens
actaacactcagaagcc

SEQ ID NO: 5153805 - DNA, 19 bp, Homo sapiens
actaacagattataataaa

SEQ ID NO: 5153806 - DNA, 22 bp, Homo sapiens
actaacagattataataaattg

SEQ ID NO: 5153807 - DNA, 18 bp, Homo sapiens
actaacaggccaaagagt

SEQ ID NO: 5153808 - DNA, 14 bp, Homo sapiens
actaacagtaactg

SEQ ID NO: 5153809 - DNA, 20 bp, Homo sapiens
actaacataaaatctgtgaa

SEQ ID NO: 5153810 - DNA, 12 bp, Homo sapiens
actaacatccca

SEQ ID NO: 5153811 - DNA, 15 bp, Homo sapiens
actaaccaagctgag

SEQ ID NO: 5153812 - DNA, 18 bp, Homo sapiens
actaaccacattttagga

SEQ ID NO: 5153813 - DNA, 19 bp, Homo sapiens
actaaccacattttaggat

SEQ ID NO: 5153814 - DNA, 23 bp, Homo sapiens
actaaccagggaagctgtccctc

SEQ ID NO: 5153815 - DNA, 19 bp, Homo sapiens
actaaccagtacctctgta

SEQ ID NO: 5153816 - DNA, 21 bp, Homo sapiens
actaaccatgtgttatgtttt

SEQ ID NO: 5153817 - DNA, 13 bp, Homo sapiens
actaaccatttct

SEQ ID NO: 5153818 - DNA, 17 bp, Homo sapiens
actaaccccagctgccg

SEQ ID NO: 5153819 - DNA, 14 bp, Homo sapiens
actaacctggagac

SEQ ID NO: 5153820 - DNA, 21 bp, Homo sapiens
actaacctggtattttaagag

SEQ ID NO: 5153821 - DNA, 22 bp, Homo sapiens
actaaccttccaaaaattactt

SEQ ID NO: 5153822 - DNA, 21 bp, Homo sapiens
actaaccttgcctggtacagt

SEQ ID NO: 5153823 - DNA, 17 bp, Homo sapiens
actaacgaacgttttaa

SEQ ID NO: 5153824 - DNA, 22 bp, Homo sapiens
actaactaaactctctttggga

SEQ ID NO: 5153825 - DNA, 22 bp, Homo sapiens
actaactcaaatacacatttgc

SEQ ID NO: 5153826 - DNA, 20 bp, Homo sapiens
actaactcatagattgcaaa

SEQ ID NO: 5153827 - DNA, 14 bp, Homo sapiens
actaactgccatgt

SEQ ID NO: 5153828 - DNA, 20 bp, Homo sapiens
actaactgcttcatctcctt

SEQ ID NO: 5153829 - DNA, 23 bp, Homo sapiens
actaacttatttatgttaaaaga

SEQ ID NO: 5153830 - DNA, 13 bp, Homo sapiens
actaacttatttt

SEQ ID NO: 5153831 - DNA, 15 bp, Homo sapiens
actaacttattttga

SEQ ID NO: 5153832 - DNA, 17 bp, Homo sapiens
actaacttattttgatt

SEQ ID NO: 5153833 - DNA, 23 bp, Homo sapiens
actaacttcagtaggatttatgt

SEQ ID NO: 5153834 - DNA, 16 bp, Homo sapiens
actaacttctaaaact

SEQ ID NO: 5153835 - DNA, 17 bp, Homo sapiens
actaacttgacttttaa

SEQ ID NO: 5153836 - DNA, 15 bp, Homo sapiens
actaagaaacacatc

SEQ ID NO: 5153837 - DNA, 12 bp, Homo sapiens
actaagaaactt

SEQ ID NO: 5153838 - DNA, 14 bp, Homo sapiens
actaagaaactttt

SEQ ID NO: 5153839 - DNA, 12 bp, Homo sapiens
actaagaaagaa

SEQ ID NO: 5153840 - DNA, 23 bp, Homo sapiens
actaagaaatattccaaatgtct

SEQ ID NO: 5153841 - DNA, 12 bp, Homo sapiens
actaagaagtgg

SEQ ID NO: 5153842 - DNA, 21 bp, Homo sapiens
actaagaataacaagaagccc

SEQ ID NO: 5153843 - DNA, 17 bp, Homo sapiens
actaagaatcatcctca

SEQ ID NO: 5153844 - DNA, 22 bp, Homo sapiens
actaagaatgtccttattcttg

SEQ ID NO: 5153845 - DNA, 19 bp, Homo sapiens
actaagagaaaattgcact

SEQ ID NO: 5153846 - DNA, 22 bp, Homo sapiens
actaagagaaaccttgcaaact

SEQ ID NO: 5153847 - DNA, 17 bp, Homo sapiens
actaagagaagttgtaa

SEQ ID NO: 5153848 - DNA, 16 bp, Homo sapiens
actaagagagaatgag

SEQ ID NO: 5153849 - DNA, 20 bp, Homo sapiens
actaagaggaaagtacattt

SEQ ID NO: 5153850 - DNA, 19 bp, Homo sapiens
actaagatgaaattgccaa

SEQ ID NO: 5153851 - DNA, 18 bp, Homo sapiens
actaagatgacattgcta

SEQ ID NO: 5153852 - DNA, 23 bp, Homo sapiens
actaagatgtgcagcatttcact

SEQ ID NO: 5153853 - DNA, 21 bp, Homo sapiens
actaagattcttttaaattag

SEQ ID NO: 5153854 - DNA, 18 bp, Homo sapiens
actaagatttatctgcaa

SEQ ID NO: 5153855 - DNA, 17 bp, Homo sapiens
actaagcacattatgtt

SEQ ID NO: 5153856 - DNA, 21 bp, Homo sapiens
actaagcaccataaccaagaa

SEQ ID NO: 5153857 - DNA, 13 bp, Homo sapiens
actaagcagagga

SEQ ID NO: 5153858 - DNA, 14 bp, Homo sapiens
actaagcagaggag

SEQ ID NO: 5153859 - DNA, 15 bp, Homo sapiens
actaagcagaggagg

SEQ ID NO: 5153860 - DNA, 19 bp, Homo sapiens
actaagcagaggaggggcc

SEQ ID NO: 5153861 - DNA, 15 bp, Homo sapiens
actaagccacaagaa

SEQ ID NO: 5153862 - DNA, 11 bp, Homo sapiens
actaagccagg

SEQ ID NO: 5153863 - DNA, 14 bp, Homo sapiens
actaagccaggagg

SEQ ID NO: 5153864 - DNA, 15 bp, Homo sapiens
actaagccaggaggc

SEQ ID NO: 5153865 - DNA, 15 bp, Homo sapiens
actaagccaggcctg

SEQ ID NO: 5153866 - DNA, 16 bp, Homo sapiens
actaagccaggcctgg

SEQ ID NO: 5153867 - DNA, 17 bp, Homo sapiens
actaagccaggcctggc

SEQ ID NO: 5153868 - DNA, 22 bp, Homo sapiens
actaagccatgccatgcccagg

SEQ ID NO: 5153869 - DNA, 16 bp, Homo sapiens
actaagccctgtcgag

SEQ ID NO: 5153870 - DNA, 18 bp, Homo sapiens
actaagccctgtcgagac

SEQ ID NO: 5153871 - DNA, 19 bp, Homo sapiens
actaagcctacctgctctc

SEQ ID NO: 5153872 - DNA, 20 bp, Homo sapiens
actaagctctctgggcctgg

SEQ ID NO: 5153873 - DNA, 16 bp, Homo sapiens
actaagctctttgaga

SEQ ID NO: 5153874 - DNA, 15 bp, Homo sapiens
actaagcttaatttt

SEQ ID NO: 5153875 - DNA, 18 bp, Homo sapiens
actaagctttctcctttg

SEQ ID NO: 5153876 - DNA, 17 bp, Homo sapiens
actaaggaatatatatg

SEQ ID NO: 5153877 - DNA, 20 bp, Homo sapiens
actaaggaatatatatggaa

SEQ ID NO: 5153878 - DNA, 18 bp, Homo sapiens
actaaggacaaattagca

SEQ ID NO: 5153879 - DNA, 17 bp, Homo sapiens
actaaggacaggatggc

SEQ ID NO: 5153880 - DNA, 12 bp, Homo sapiens
actaaggagaat

SEQ ID NO: 5153881 - DNA, 21 bp, Homo sapiens
actaaggccttttatgtaatt

SEQ ID NO: 5153882 - DNA, 21 bp, Homo sapiens
actaaggggcccggccagcca

SEQ ID NO: 5153883 - DNA, 23 bp, Homo sapiens
actaagggggtgaccatgcaatt

SEQ ID NO: 5153884 - DNA, 19 bp, Homo sapiens
actaagggtggagagttgg

SEQ ID NO: 5153885 - DNA, 18 bp, Homo sapiens
actaaggtgactttctga

SEQ ID NO: 5153886 - DNA, 16 bp, Homo sapiens
actaagtaagaaacac

SEQ ID NO: 5153887 - DNA, 22 bp, Homo sapiens
actaagtccctataataaaggc

SEQ ID NO: 5153888 - DNA, 19 bp, Homo sapiens
actaagtctctagcctctt

SEQ ID NO: 5153889 - DNA, 21 bp, Homo sapiens
actaagtctcttttttacaaa

SEQ ID NO: 5153890 - DNA, 20 bp, Homo sapiens
actaagttattgctgcataa

SEQ ID NO: 5153891 - DNA, 15 bp, Homo sapiens
actaagttattgtta

SEQ ID NO: 5153892 - DNA, 16 bp, Homo sapiens
actaagttattttatg

SEQ ID NO: 5153893 - DNA, 17 bp, Homo sapiens
actaagttattttatga

SEQ ID NO: 5153894 - DNA, 12 bp, Homo sapiens
actaataaaata

SEQ ID NO: 5153895 - DNA, 13 bp, Homo sapiens
actaataaaataa

SEQ ID NO: 5153896 - DNA, 21 bp, Homo sapiens
actaataaaatacatactata

SEQ ID NO: 5153897 - DNA, 15 bp, Homo sapiens
actaataaaatattt

SEQ ID NO: 5153898 - DNA, 22 bp, Homo sapiens
actaataaaatattttctgtgt

SEQ ID NO: 5153899 - DNA, 23 bp, Homo sapiens
actaataaaatattttctgtgtg

SEQ ID NO: 5153900 - DNA, 15 bp, Homo sapiens
actaataaaccagtt

SEQ ID NO: 5153901 - DNA, 16 bp, Homo sapiens
actaataaatataatt

SEQ ID NO: 5153902 - DNA, 23 bp, Homo sapiens
actaataatcttgtttctgaaaa

SEQ ID NO: 5153903 - DNA, 17 bp, Homo sapiens
actaatacagctgagct

SEQ ID NO: 5153904 - DNA, 14 bp, Homo sapiens
actaatagaaaagt

SEQ ID NO: 5153905 - DNA, 16 bp, Homo sapiens
acctttgtctgaagga

SEQ ID NO: 5153906 - DNA, 22 bp, Homo sapiens
acctttgtcttctataatattt

SEQ ID NO: 5153907 - DNA, 13 bp, Homo sapiens
acctttgtgccct

SEQ ID NO: 5153908 - DNA, 13 bp, Homo sapiens
acctttgtgtaat

SEQ ID NO: 5153909 - DNA, 16 bp, Homo sapiens
acctttgtgtaataaa

SEQ ID NO: 5153910 - DNA, 15 bp, Homo sapiens
acctttgtgtatttt

SEQ ID NO: 5153911 - DNA, 16 bp, Homo sapiens
acctttgtgtattttt

SEQ ID NO: 5153912 - DNA, 22 bp, Homo sapiens
acctttgttttgcactgacaag

SEQ ID NO: 5153913 - DNA, 14 bp, Homo sapiens
acctttgttttgtt

SEQ ID NO: 5153914 - DNA, 16 bp, Homo sapiens
accttttaaaaaaata

SEQ ID NO: 5153915 - DNA, 22 bp, Homo sapiens
accttttaaaaaaataatataa

SEQ ID NO: 5153916 - DNA, 19 bp, Homo sapiens
accttttaaatcctgttga

SEQ ID NO: 5153917 - DNA, 22 bp, Homo sapiens
accttttaaatcctgttgaaaa

SEQ ID NO: 5153918 - DNA, 23 bp, Homo sapiens
accttttaaatcctgttgaaaag

SEQ ID NO: 5153919 - DNA, 20 bp, Homo sapiens
accttttaacacctgatgtg

SEQ ID NO: 5153920 - DNA, 21 bp, Homo sapiens
accttttaacacctgatgtgt

SEQ ID NO: 5153921 - DNA, 14 bp, Homo sapiens
accttttaactcac

SEQ ID NO: 5153922 - DNA, 19 bp, Homo sapiens
accttttaagttaatgaaa

SEQ ID NO: 5153923 - DNA, 14 bp, Homo sapiens
accttttacagaat

SEQ ID NO: 5153924 - DNA, 15 bp, Homo sapiens
accttttacagaata

SEQ ID NO: 5153925 - DNA, 13 bp, Homo sapiens
accttttatacca

SEQ ID NO: 5153926 - DNA, 14 bp, Homo sapiens
accttttataccag

SEQ ID NO: 5153927 - DNA, 18 bp, Homo sapiens
accttttatgaaaatgtt

SEQ ID NO: 5153928 - DNA, 18 bp, Homo sapiens
accttttatgaatcaaat

SEQ ID NO: 5153929 - DNA, 23 bp, Homo sapiens
accttttatttttatttctgact

SEQ ID NO: 5153930 - DNA, 13 bp, Homo sapiens
accttttcaaatt

SEQ ID NO: 5153931 - DNA, 16 bp, Homo sapiens
accttttcaggaaaat

SEQ ID NO: 5153932 - DNA, 22 bp, Homo sapiens
accttttccaggagttctgaag

SEQ ID NO: 5153933 - DNA, 22 bp, Homo sapiens
accttttccttatactgtatat

SEQ ID NO: 5153934 - DNA, 14 bp, Homo sapiens
accttttctataag

SEQ ID NO: 5153935 - DNA, 14 bp, Homo sapiens
accttttctctttt

SEQ ID NO: 5153936 - DNA, 15 bp, Homo sapiens
accttttctgtggct

SEQ ID NO: 5153937 - DNA, 16 bp, Homo sapiens
accttttctgtggctg

SEQ ID NO: 5153938 - DNA, 21 bp, Homo sapiens
accttttctgtggctggctct

SEQ ID NO: 5153939 - DNA, 16 bp, Homo sapiens
accttttctgttgtac

SEQ ID NO: 5153940 - DNA, 15 bp, Homo sapiens
accttttcttcattt

SEQ ID NO: 5153941 - DNA, 16 bp, Homo sapiens
accttttcttcatttt

SEQ ID NO: 5153942 - DNA, 14 bp, Homo sapiens
accttttcttgcct

SEQ ID NO: 5153943 - DNA, 17 bp, Homo sapiens
accttttcttgtatctg

SEQ ID NO: 5153944 - DNA, 17 bp, Homo sapiens
accttttgaggagcccc

SEQ ID NO: 5153945 - DNA, 21 bp, Homo sapiens
accttttgaggagccccagct

SEQ ID NO: 5153946 - DNA, 14 bp, Homo sapiens
accttttgagtgcc

SEQ ID NO: 5153947 - DNA, 20 bp, Homo sapiens
accttttgagtgccttacac

SEQ ID NO: 5153948 - DNA, 18 bp, Homo sapiens
accttttgataaaatgtt

SEQ ID NO: 5153949 - DNA, 14 bp, Homo sapiens
accttttggccttt

SEQ ID NO: 5153950 - DNA, 16 bp, Homo sapiens
accttttggcctttgt

SEQ ID NO: 5153951 - DNA, 17 bp, Homo sapiens
accttttggcctttgta

SEQ ID NO: 5153952 - DNA, 18 bp, Homo sapiens
accttttggcctttgtaa

SEQ ID NO: 5153953 - DNA, 16 bp, Homo sapiens
accttttgggaatgtt

SEQ ID NO: 5153954 - DNA, 19 bp, Homo sapiens
accttttgggaatgtttta

SEQ ID NO: 5153955 - DNA, 11 bp, Homo sapiens
accttttgtag

SEQ ID NO: 5153956 - DNA, 22 bp, Homo sapiens
accttttgtagttttatttgta

SEQ ID NO: 5153957 - DNA, 21 bp, Homo sapiens
accttttgtttttccagttcc

SEQ ID NO: 5153958 - DNA, 12 bp, Homo sapiens
acctttttaaca

SEQ ID NO: 5153959 - DNA, 13 bp, Homo sapiens
acctttttaacag

SEQ ID NO: 5153960 - DNA, 19 bp, Homo sapiens
acctttttaataaaaatac

SEQ ID NO: 5153961 - DNA, 19 bp, Homo sapiens
acctttttaatagagtatg

SEQ ID NO: 5153962 - DNA, 12 bp, Homo sapiens
acctttttaatc

SEQ ID NO: 5153963 - DNA, 16 bp, Homo sapiens
acctttttaatccagg

SEQ ID NO: 5153964 - DNA, 21 bp, Homo sapiens
acctttttaatttccagaact

SEQ ID NO: 5153965 - DNA, 19 bp, Homo sapiens
acctttttatattttatac

SEQ ID NO: 5153966 - DNA, 17 bp, Homo sapiens
acctttttcttgatctt

SEQ ID NO: 5153967 - DNA, 22 bp, Homo sapiens
acctttttgcttattttacaaa

SEQ ID NO: 5153968 - DNA, 18 bp, Homo sapiens
acctttttgtatgtgaac

SEQ ID NO: 5153969 - DNA, 14 bp, Homo sapiens
accttttttataca

SEQ ID NO: 5153970 - DNA, 16 bp, Homo sapiens
accttttttatacata

SEQ ID NO: 5153971 - DNA, 17 bp, Homo sapiens
accttttttatacataa

SEQ ID NO: 5153972 - DNA, 18 bp, Homo sapiens
accttttttatacataaa

SEQ ID NO: 5153973 - DNA, 18 bp, Homo sapiens
accttttttcaacagtga

SEQ ID NO: 5153974 - DNA, 17 bp, Homo sapiens
acctttttttctctcct

SEQ ID NO: 5153975 - DNA, 18 bp, Homo sapiens
acctttttttctctccta

SEQ ID NO: 5153976 - DNA, 19 bp, Homo sapiens
acctttttttctctcctaa

SEQ ID NO: 5153977 - DNA, 16 bp, Homo sapiens
accttttttttacgga

SEQ ID NO: 5153978 - DNA, 21 bp, Homo sapiens
accttttttttacggaattcc

SEQ ID NO: 5153979 - DNA, 17 bp, Homo sapiens
acctttttttttgaaac

SEQ ID NO: 5153980 - DNA, 18 bp, Homo sapiens
accttttttttttttcca

SEQ ID NO: 5153981 - DNA, 19 bp, Homo sapiens
acgaaaaagagcatatact

SEQ ID NO: 5153982 - DNA, 19 bp, Homo sapiens
acgaaacacaaaccacaac

SEQ ID NO: 5153983 - DNA, 23 bp, Homo sapiens
acgaaactccatctcaaaacaaa

SEQ ID NO: 5153984 - DNA, 16 bp, Homo sapiens
acgaaactggaataag

SEQ ID NO: 5153985 - DNA, 21 bp, Homo sapiens
acgaaactggaataagccttc

SEQ ID NO: 5153986 - DNA, 15 bp, Homo sapiens
acgaaagtaaagtaa

SEQ ID NO: 5153987 - DNA, 23 bp, Homo sapiens
acgaaataattgttgttctgtta

SEQ ID NO: 5153988 - DNA, 18 bp, Homo sapiens
acgaaatatgaagagcaa

SEQ ID NO: 5153989 - DNA, 23 bp, Homo sapiens
acgaaatgttattttttaattat

SEQ ID NO: 5153990 - DNA, 17 bp, Homo sapiens
acgaacccctcccctcc

SEQ ID NO: 5153991 - DNA, 18 bp, Homo sapiens
acgaaccttggcctgggc

SEQ ID NO: 5153992 - DNA, 11 bp, Homo sapiens
acgaagaaaaa

SEQ ID NO: 5153993 - DNA, 16 bp, Homo sapiens
acgaagaaatagaata

SEQ ID NO: 5153994 - DNA, 15 bp, Homo sapiens
acgaagccacaggcc

SEQ ID NO: 5153995 - DNA, 14 bp, Homo sapiens
acgaaggagcccat

SEQ ID NO: 5153996 - DNA, 15 bp, Homo sapiens
acgaaggctgcccct

SEQ ID NO: 5153997 - DNA, 17 bp, Homo sapiens
acgaagggaaatgtctt

SEQ ID NO: 5153998 - DNA, 22 bp, Homo sapiens
acgaaggggccccggggctggc

SEQ ID NO: 5153999 - DNA, 16 bp, Homo sapiens
acgaagggggcatctg

SEQ ID NO: 5154000 - DNA, 15 bp, Homo sapiens
acgaataaacgcaga

SEQ ID NO: 5154001 - DNA, 14 bp, Homo sapiens
acgaatacttttgc

SEQ ID NO: 5154002 - DNA, 13 bp, Homo sapiens
acgaatatgaatg

SEQ ID NO: 5154003 - DNA, 14 bp, Homo sapiens
acgaatattgctga

SEQ ID NO: 5154004 - DNA, 18 bp, Homo sapiens
acgaatattgctgatggt

SEQ ID NO: 5154005 - DNA, 21 bp, Homo sapiens
acgaatattgctgatggtgca

SEQ ID NO: 5154006 - DNA, 21 bp, Homo sapiens
acgaatcccctaaacaaaaag

SEQ ID NO: 5154007 - DNA, 15 bp, Homo sapiens
acgaatctcatccct

SEQ ID NO: 5154008 - DNA, 21 bp, Homo sapiens
acgaatcttatttttcctgtc

SEQ ID NO: 5154009 - DNA, 18 bp, Homo sapiens
acgaatgccattggaacc

SEQ ID NO: 5154010 - DNA, 17 bp, Homo sapiens
acgaatttaaaatgtag

SEQ ID NO: 5154011 - DNA, 14 bp, Homo sapiens
acgaatttctatag

SEQ ID NO: 5154012 - DNA, 20 bp, Homo sapiens
acgacaaaaacaagactgcc

SEQ ID NO: 5154013 - DNA, 23 bp, Homo sapiens
acgacaaagctgctaaatctcct

SEQ ID NO: 5154014 - DNA, 16 bp, Homo sapiens
acgacaatgttgagaa

SEQ ID NO: 5154015 - DNA, 14 bp, Homo sapiens
acgacataagctgg

SEQ ID NO: 5154016 - DNA, 15 bp, Homo sapiens
acgacataagctggt

SEQ ID NO: 5154017 - DNA, 12 bp, Homo sapiens
acgaccagcccc

SEQ ID NO: 5154018 - DNA, 11 bp, Homo sapiens
acgaccccaga

SEQ ID NO: 5154019 - DNA, 12 bp, Homo sapiens
acgacccctgaa

SEQ ID NO: 5154020 - DNA, 17 bp, Homo sapiens
acgaccgacgcccctcc

SEQ ID NO: 5154021 - DNA, 15 bp, Homo sapiens
acgacctacattaat

SEQ ID NO: 5154022 - DNA, 13 bp, Homo sapiens
acgacctttacct

SEQ ID NO: 5154023 - DNA, 14 bp, Homo sapiens
acgacgccctctcc

SEQ ID NO: 5154024 - DNA, 21 bp, Homo sapiens
acgactaacctatctatgaac

SEQ ID NO: 5154025 - DNA, 14 bp, Homo sapiens
acgactaatcacct

SEQ ID NO: 5154026 - DNA, 23 bp, Homo sapiens
acgactcttttccaaacacaggc

SEQ ID NO: 5154027 - DNA, 15 bp, Homo sapiens
acgactgcccggcag

SEQ ID NO: 5154028 - DNA, 19 bp, Homo sapiens
acgacttatatatttgaaa

SEQ ID NO: 5154029 - DNA, 22 bp, Homo sapiens
acgacttcagggcagggctctg

SEQ ID NO: 5154030 - DNA, 16 bp, Homo sapiens
acgactttctttaaca

SEQ ID NO: 5154031 - DNA, 17 bp, Homo sapiens
acgactttctttaacat

SEQ ID NO: 5154032 - DNA, 20 bp, Homo sapiens
acgagacaacagcacacagg

SEQ ID NO: 5154033 - DNA, 11 bp, Homo sapiens
acgagaccccc

SEQ ID NO: 5154034 - DNA, 12 bp, Homo sapiens
acgagaccccca

SEQ ID NO: 5154035 - DNA, 14 bp, Homo sapiens
acgagaccccggct

SEQ ID NO: 5154036 - DNA, 16 bp, Homo sapiens
acgagacgtttcctac

SEQ ID NO: 5154037 - DNA, 18 bp, Homo sapiens
acgagaggtatgcctgta

SEQ ID NO: 5154038 - DNA, 19 bp, Homo sapiens
acgagatcaagagatcaag

SEQ ID NO: 5154039 - DNA, 20 bp, Homo sapiens
acgagatttcttttttatgt

SEQ ID NO: 5154040 - DNA, 17 bp, Homo sapiens
acgagcagagcgcagcc

SEQ ID NO: 5154041 - DNA, 20 bp, Homo sapiens
acgagcagagcgcagccccc

SEQ ID NO: 5154042 - DNA, 23 bp, Homo sapiens
acgagcagcccagggcctagagg

SEQ ID NO: 5154043 - DNA, 20 bp, Homo sapiens
acgagcaggctactgtcagc

SEQ ID NO: 5154044 - DNA, 16 bp, Homo sapiens
acgagcaggcttcttc

SEQ ID NO: 5154045 - DNA, 21 bp, Homo sapiens
acgagcatccccctcctctcc

SEQ ID NO: 5154046 - DNA, 22 bp, Homo sapiens
acgagcatccccctcctctccc

SEQ ID NO: 5154047 - DNA, 17 bp, Homo sapiens
acgagccacaagctgca

SEQ ID NO: 5154048 - DNA, 21 bp, Homo sapiens
acgagccacaagctgcactgt

SEQ ID NO: 5154049 - DNA, 15 bp, Homo sapiens
acgagcccttttaga

SEQ ID NO: 5154050 - DNA, 12 bp, Homo sapiens
acgagcctcctc

SEQ ID NO: 5154051 - DNA, 15 bp, Homo sapiens
acgaggaaccgaaaa

SEQ ID NO: 5154052 - DNA, 22 bp, Homo sapiens
acgaggacatttgtgggcaagc

SEQ ID NO: 5154053 - DNA, 22 bp, Homo sapiens
acgaggatttccctgaagctat

SEQ ID NO: 5154054 - DNA, 20 bp, Homo sapiens
acgaggcaatgactgtgagc

SEQ ID NO: 5154055 - DNA, 19 bp, Homo sapiens
acgaggcaggggctctgct

SEQ ID NO: 5154056 - DNA, 20 bp, Homo sapiens
acgaggccactcagaggccc

SEQ ID NO: 5154057 - DNA, 13 bp, Homo sapiens
acgaggccctcgg

SEQ ID NO: 5154058 - DNA, 18 bp, Homo sapiens
acgaggccttcagaaaag

SEQ ID NO: 5154059 - DNA, 22 bp, Homo sapiens
acgaggccttcagaaaagacac

SEQ ID NO: 5154060 - DNA, 16 bp, Homo sapiens
acgaggcttctctaac

SEQ ID NO: 5154061 - DNA, 19 bp, Homo sapiens
acgagggaggaacacctga

SEQ ID NO: 5154062 - DNA, 19 bp, Homo sapiens
acgagggatgtggagcaca

SEQ ID NO: 5154063 - DNA, 14 bp, Homo sapiens
acgagggcaacagg

SEQ ID NO: 5154064 - DNA, 18 bp, Homo sapiens
acgagggcaacagggagc

SEQ ID NO: 5154065 - DNA, 12 bp, Homo sapiens
acgagggctggc

SEQ ID NO: 5154066 - DNA, 16 bp, Homo sapiens
acgagggctggctggc

SEQ ID NO: 5154067 - DNA, 20 bp, Homo sapiens
acgaggggtgtcttgggcag

SEQ ID NO: 5154068 - DNA, 17 bp, Homo sapiens
acgagggtctcccctcc

SEQ ID NO: 5154069 - DNA, 22 bp, Homo sapiens
acgagggtctcccctcctgcac

SEQ ID NO: 5154070 - DNA, 17 bp, Homo sapiens
acgaggtggtagctctg

SEQ ID NO: 5154071 - DNA, 18 bp, Homo sapiens
acgagtaagatattattt

SEQ ID NO: 5154072 - DNA, 17 bp, Homo sapiens
acgagtaagtgaatcct

SEQ ID NO: 5154073 - DNA, 17 bp, Homo sapiens
acgagtgggaaggactt

SEQ ID NO: 5154074 - DNA, 16 bp, Homo sapiens
acgataaaattacaaa

SEQ ID NO: 5154075 - DNA, 14 bp, Homo sapiens
acgataaggaagaa

SEQ ID NO: 5154076 - DNA, 17 bp, Homo sapiens
acgataaggaagaaaca

SEQ ID NO: 5154077 - DNA, 17 bp, Homo sapiens
acgatagttacataatc

SEQ ID NO: 5154078 - DNA, 13 bp, Homo sapiens
acgatatatgtaa

SEQ ID NO: 5154079 - DNA, 19 bp, Homo sapiens
acgatatatgtaaatatac

SEQ ID NO: 5154080 - DNA, 14 bp, Homo sapiens
acgatatttcgttt

SEQ ID NO: 5154081 - DNA, 19 bp, Homo sapiens
acgatcaagttgttgactg

SEQ ID NO: 5154082 - DNA, 13 bp, Homo sapiens
acgatcaggagga

SEQ ID NO: 5154083 - DNA, 17 bp, Homo sapiens
acgatcaggcacaggtc

SEQ ID NO: 5154084 - DNA, 14 bp, Homo sapiens
actaatagaacttg

SEQ ID NO: 5154085 - DNA, 16 bp, Homo sapiens
actaatagaataaagg

SEQ ID NO: 5154086 - DNA, 17 bp, Homo sapiens
actaatagagtacttaa

SEQ ID NO: 5154087 - DNA, 21 bp, Homo sapiens
actaatagatttttttttcca

SEQ ID NO: 5154088 - DNA, 18 bp, Homo sapiens
actaatagcctaaaagat

SEQ ID NO: 5154089 - DNA, 18 bp, Homo sapiens
actaatataaaatgagta

SEQ ID NO: 5154090 - DNA, 16 bp, Homo sapiens
actaatataacttgaa

SEQ ID NO: 5154091 - DNA, 14 bp, Homo sapiens
actaatatatattt

SEQ ID NO: 5154092 - DNA, 13 bp, Homo sapiens
actaatatatctg

SEQ ID NO: 5154093 - DNA, 15 bp, Homo sapiens
actaatatatctgta

SEQ ID NO: 5154094 - DNA, 17 bp, Homo sapiens
actaatatatgaaataa

SEQ ID NO: 5154095 - DNA, 21 bp, Homo sapiens
actaatatatgaaataagtaa

SEQ ID NO: 5154096 - DNA, 16 bp, Homo sapiens
actaatatatggacct

SEQ ID NO: 5154097 - DNA, 17 bp, Homo sapiens
actaatatatttaaaaa

SEQ ID NO: 5154098 - DNA, 18 bp, Homo sapiens
actaatatatttaaaaat

SEQ ID NO: 5154099 - DNA, 18 bp, Homo sapiens
actaatatttgtctgtgt

SEQ ID NO: 5154100 - DNA, 19 bp, Homo sapiens
actaatatttgtctgtgtg

SEQ ID NO: 5154101 - DNA, 18 bp, Homo sapiens
actaatccaatacctctt

SEQ ID NO: 5154102 - DNA, 16 bp, Homo sapiens
actaatctaaactgta

SEQ ID NO: 5154103 - DNA, 18 bp, Homo sapiens
actaatctcaatttaaga

SEQ ID NO: 5154104 - DNA, 18 bp, Homo sapiens
actaatcttgaatgtttg

SEQ ID NO: 5154105 - DNA, 14 bp, Homo sapiens
actaatctttctgc

SEQ ID NO: 5154106 - DNA, 18 bp, Homo sapiens
actaatgaaatttacagt

SEQ ID NO: 5154107 - DNA, 23 bp, Homo sapiens
actaatgagctttgggcaataaa

SEQ ID NO: 5154108 - DNA, 15 bp, Homo sapiens
actaatgcaaactgg

SEQ ID NO: 5154109 - DNA, 19 bp, Homo sapiens
actaatgccttactcttct

SEQ ID NO: 5154110 - DNA, 14 bp, Homo sapiens
actaatgctttctg

SEQ ID NO: 5154111 - DNA, 13 bp, Homo sapiens
actaatgcttttt

SEQ ID NO: 5154112 - DNA, 12 bp, Homo sapiens
actaatggcatg

SEQ ID NO: 5154113 - DNA, 18 bp, Homo sapiens
actaatggggcggtgaga

SEQ ID NO: 5154114 - DNA, 16 bp, Homo sapiens
actaatgtaaaatgat

SEQ ID NO: 5154115 - DNA, 13 bp, Homo sapiens
actaatgtaaata

SEQ ID NO: 5154116 - DNA, 23 bp, Homo sapiens
actaatgtaaatattgctgtctg

SEQ ID NO: 5154117 - DNA, 19 bp, Homo sapiens
actaatgtactgtacataa

SEQ ID NO: 5154118 - DNA, 23 bp, Homo sapiens
actaatgtctcttctaacatctt

SEQ ID NO: 5154119 - DNA, 12 bp, Homo sapiens
actaatgtgatg

SEQ ID NO: 5154120 - DNA, 19 bp, Homo sapiens
actaatgttagaattgatt

SEQ ID NO: 5154121 - DNA, 22 bp, Homo sapiens
actaatgttagaattgatttcc

SEQ ID NO: 5154122 - DNA, 19 bp, Homo sapiens
actaatgtttgaacaaagc

SEQ ID NO: 5154123 - DNA, 14 bp, Homo sapiens
actaattaaaaaat

SEQ ID NO: 5154124 - DNA, 16 bp, Homo sapiens
actaattaaaaaatag

SEQ ID NO: 5154125 - DNA, 16 bp, Homo sapiens
actaattaaaatctgg

SEQ ID NO: 5154126 - DNA, 20 bp, Homo sapiens
actaattaaaatctggaaat

SEQ ID NO: 5154127 - DNA, 15 bp, Homo sapiens
actaattaaactgat

SEQ ID NO: 5154128 - DNA, 16 bp, Homo sapiens
actaattaacatataa

SEQ ID NO: 5154129 - DNA, 23 bp, Homo sapiens
actaattagggtacatttataat

SEQ ID NO: 5154130 - DNA, 18 bp, Homo sapiens
actaattagtgtccaact

SEQ ID NO: 5154131 - DNA, 16 bp, Homo sapiens
actaattataatgcaa

SEQ ID NO: 5154132 - DNA, 22 bp, Homo sapiens
actaattatcacgtctgacaaa

SEQ ID NO: 5154133 - DNA, 21 bp, Homo sapiens
actaattcaattcatgtaaca

SEQ ID NO: 5154134 - DNA, 23 bp, Homo sapiens
actaattcagggaatatatattt

SEQ ID NO: 5154135 - DNA, 18 bp, Homo sapiens
actaattcataatcactc

SEQ ID NO: 5154136 - DNA, 12 bp, Homo sapiens
actaattcattt

SEQ ID NO: 5154137 - DNA, 18 bp, Homo sapiens
actaattccttaaatgaa

SEQ ID NO: 5154138 - DNA, 19 bp, Homo sapiens
actaattccttaaatgaac

SEQ ID NO: 5154139 - DNA, 20 bp, Homo sapiens
actaattccttaaatgaact

SEQ ID NO: 5154140 - DNA, 21 bp, Homo sapiens
actaattccttaaatgaacta

SEQ ID NO: 5154141 - DNA, 16 bp, Homo sapiens
actaattctatttctc

SEQ ID NO: 5154142 - DNA, 14 bp, Homo sapiens
actaattctcacat

SEQ ID NO: 5154143 - DNA, 20 bp, Homo sapiens
actaattctcacatccctct

SEQ ID NO: 5154144 - DNA, 22 bp, Homo sapiens
actaattcttgcatattttgta

SEQ ID NO: 5154145 - DNA, 19 bp, Homo sapiens
actaattggaaggagaggg

SEQ ID NO: 5154146 - DNA, 21 bp, Homo sapiens
actaattgtaaggtattgcaa

SEQ ID NO: 5154147 - DNA, 22 bp, Homo sapiens
actaattgtaaggtattgcaag

SEQ ID NO: 5154148 - DNA, 15 bp, Homo sapiens
actaattgtataaca

SEQ ID NO: 5154149 - DNA, 16 bp, Homo sapiens
actaattgtataacag

SEQ ID NO: 5154150 - DNA, 15 bp, Homo sapiens
actaatttaaaaaat

SEQ ID NO: 5154151 - DNA, 12 bp, Homo sapiens
actaatttaaac

SEQ ID NO: 5154152 - DNA, 14 bp, Homo sapiens
actaatttaaacca

SEQ ID NO: 5154153 - DNA, 15 bp, Homo sapiens
actaatttaaaccag

SEQ ID NO: 5154154 - DNA, 21 bp, Homo sapiens
actaatttaaaccagcagaaa

SEQ ID NO: 5154155 - DNA, 18 bp, Homo sapiens
actaatttcttagagaat

SEQ ID NO: 5154156 - DNA, 15 bp, Homo sapiens
actaatttgaataaa

SEQ ID NO: 5154157 - DNA, 14 bp, Homo sapiens
actaatttggtttt

SEQ ID NO: 5154158 - DNA, 12 bp, Homo sapiens
actaatttgtat

SEQ ID NO: 5154159 - DNA, 15 bp, Homo sapiens
actaatttgtcactg

SEQ ID NO: 5154160 - DNA, 23 bp, Homo sapiens
actaattttacacattagatttt

SEQ ID NO: 5154161 - DNA, 15 bp, Homo sapiens
actaattttacatgt

SEQ ID NO: 5154162 - DNA, 21 bp, Homo sapiens
actaattttacatgtttataa

SEQ ID NO: 5154163 - DNA, 15 bp, Homo sapiens
actaattttacttct

SEQ ID NO: 5154164 - DNA, 16 bp, Homo sapiens
actaattttatttcta

SEQ ID NO: 5154165 - DNA, 22 bp, Homo sapiens
actaattttccataagctattt

SEQ ID NO: 5154166 - DNA, 17 bp, Homo sapiens
actaattttgttttaaa

SEQ ID NO: 5154167 - DNA, 20 bp, Homo sapiens
actaattttgttttaaactg

SEQ ID NO: 5154168 - DNA, 14 bp, Homo sapiens
actaattttttaag

SEQ ID NO: 5154169 - DNA, 21 bp, Homo sapiens
actacaaaaaagttgttaact

SEQ ID NO: 5154170 - DNA, 11 bp, Homo sapiens
actacaaaaac

SEQ ID NO: 5154171 - DNA, 15 bp, Homo sapiens
actacaaaaagaaga

SEQ ID NO: 5154172 - DNA, 14 bp, Homo sapiens
actacaaaatttga

SEQ ID NO: 5154173 - DNA, 16 bp, Homo sapiens
actacaaaatttgaaa

SEQ ID NO: 5154174 - DNA, 17 bp, Homo sapiens
actacaaagctttgcta

SEQ ID NO: 5154175 - DNA, 11 bp, Homo sapiens
actacaaagta

SEQ ID NO: 5154176 - DNA, 17 bp, Homo sapiens
actacaacattagaata

SEQ ID NO: 5154177 - DNA, 16 bp, Homo sapiens
actacaaccaatggaa

SEQ ID NO: 5154178 - DNA, 16 bp, Homo sapiens
actacaacctccacct

SEQ ID NO: 5154179 - DNA, 13 bp, Homo sapiens
actacaagtcagc

SEQ ID NO: 5154180 - DNA, 16 bp, Homo sapiens
actacaatatgtacat

SEQ ID NO: 5154181 - DNA, 13 bp, Homo sapiens
actacaatgatgg

SEQ ID NO: 5154182 - DNA, 11 bp, Homo sapiens
actacacaata

SEQ ID NO: 5154183 - DNA, 16 bp, Homo sapiens
actacacaatacagta

SEQ ID NO: 5154184 - DNA, 19 bp, Homo sapiens
actacacaatacagtatta

SEQ ID NO: 5154185 - DNA, 13 bp, Homo sapiens
actacacacagta

SEQ ID NO: 5154186 - DNA, 20 bp, Homo sapiens
actacacagcacaccagccg

SEQ ID NO: 5154187 - DNA, 20 bp, Homo sapiens
actacacatccctaatgtgt

SEQ ID NO: 5154188 - DNA, 23 bp, Homo sapiens
actacacatccctaatgtgtgcc

SEQ ID NO: 5154189 - DNA, 19 bp, Homo sapiens
actacacattcaataagca

SEQ ID NO: 5154190 - DNA, 12 bp, Homo sapiens
actacacatttg

SEQ ID NO: 5154191 - DNA, 14 bp, Homo sapiens
actacacatttgaa

SEQ ID NO: 5154192 - DNA, 18 bp, Homo sapiens
actacacatttttaaatt

SEQ ID NO: 5154193 - DNA, 21 bp, Homo sapiens
actacacatttttaaattgtt

SEQ ID NO: 5154194 - DNA, 14 bp, Homo sapiens
actacaccacacac

SEQ ID NO: 5154195 - DNA, 15 bp, Homo sapiens
actacaccacacaca

SEQ ID NO: 5154196 - DNA, 17 bp, Homo sapiens
actacacccaagcctga

SEQ ID NO: 5154197 - DNA, 14 bp, Homo sapiens
actacacccagcaa

SEQ ID NO: 5154198 - DNA, 19 bp, Homo sapiens
actacactccagcctgagc

SEQ ID NO: 5154199 - DNA, 20 bp, Homo sapiens
actacactccagcctgagca

SEQ ID NO: 5154200 - DNA, 13 bp, Homo sapiens
actacagaagtgg

SEQ ID NO: 5154201 - DNA, 20 bp, Homo sapiens
actacagaataatgtgttaa

SEQ ID NO: 5154202 - DNA, 23 bp, Homo sapiens
actacagacctgctttttgaaat

SEQ ID NO: 5154203 - DNA, 20 bp, Homo sapiens
actacagagcagctccccag

SEQ ID NO: 5154204 - DNA, 22 bp, Homo sapiens
actacagagcagctccccagga

SEQ ID NO: 5154205 - DNA, 18 bp, Homo sapiens
actacagctatgaagaaa

SEQ ID NO: 5154206 - DNA, 22 bp, Homo sapiens
actacagggtgaggtgcttgcc

SEQ ID NO: 5154207 - DNA, 19 bp, Homo sapiens
actacaggtattttcatca

SEQ ID NO: 5154208 - DNA, 23 bp, Homo sapiens
actacaggtgtgagtcaccaagc

SEQ ID NO: 5154209 - DNA, 21 bp, Homo sapiens
actacaggtgtttgactttca

SEQ ID NO: 5154210 - DNA, 17 bp, Homo sapiens
actacaggttttatgag

SEQ ID NO: 5154211 - DNA, 22 bp, Homo sapiens
actacagtgacaaattgtaact

SEQ ID NO: 5154212 - DNA, 18 bp, Homo sapiens
actacagtgattcatgta

SEQ ID NO: 5154213 - DNA, 21 bp, Homo sapiens
actacataatctctggaaatt

SEQ ID NO: 5154214 - DNA, 15 bp, Homo sapiens
actacatagtaagta

SEQ ID NO: 5154215 - DNA, 14 bp, Homo sapiens
actacatgcacttg

SEQ ID NO: 5154216 - DNA, 19 bp, Homo sapiens
actacatgggccagccctt

SEQ ID NO: 5154217 - DNA, 21 bp, Homo sapiens
actacatgggccagcccttgc

SEQ ID NO: 5154218 - DNA, 18 bp, Homo sapiens
actacattaaaagcttta

SEQ ID NO: 5154219 - DNA, 18 bp, Homo sapiens
actacattaggttgtgaa

SEQ ID NO: 5154220 - DNA, 11 bp, Homo sapiens
actacattctg

SEQ ID NO: 5154221 - DNA, 19 bp, Homo sapiens
actacattgagcccctgag

SEQ ID NO: 5154222 - DNA, 22 bp, Homo sapiens
actacattggaagcctgagcag

SEQ ID NO: 5154223 - DNA, 23 bp, Homo sapiens
actacatttccaacttgatgtca

SEQ ID NO: 5154224 - DNA, 23 bp, Homo sapiens
actacatttctactatgatcaga

SEQ ID NO: 5154225 - DNA, 16 bp, Homo sapiens
actacattttaaaaac

SEQ ID NO: 5154226 - DNA, 18 bp, Homo sapiens
actacattttgctctgtg

SEQ ID NO: 5154227 - DNA, 13 bp, Homo sapiens
actacattttttc

SEQ ID NO: 5154228 - DNA, 15 bp, Homo sapiens
actacattttttcta

SEQ ID NO: 5154229 - DNA, 20 bp, Homo sapiens
actacattttttctaataaa

SEQ ID NO: 5154230 - DNA, 21 bp, Homo sapiens
actacattttttctaataaag

SEQ ID NO: 5154231 - DNA, 16 bp, Homo sapiens
actaccaaaagacatt

SEQ ID NO: 5154232 - DNA, 21 bp, Homo sapiens
actaccaaaatgaagacacgc

SEQ ID NO: 5154233 - DNA, 16 bp, Homo sapiens
actaccaaacactcag

SEQ ID NO: 5154234 - DNA, 23 bp, Homo sapiens
actaccaaacactcagtccactg

SEQ ID NO: 5154235 - DNA, 15 bp, Homo sapiens
actaccaaaggacac

SEQ ID NO: 5154236 - DNA, 12 bp, Homo sapiens
actaccaccctc

SEQ ID NO: 5154237 - DNA, 15 bp, Homo sapiens
actaccaccctcgct

SEQ ID NO: 5154238 - DNA, 21 bp, Homo sapiens
actaccaccctcgctgccacc

SEQ ID NO: 5154239 - DNA, 21 bp, Homo sapiens
actaccacctcaggtgacttt

SEQ ID NO: 5154240 - DNA, 14 bp, Homo sapiens
actaccactttttt

SEQ ID NO: 5154241 - DNA, 22 bp, Homo sapiens
actaccactttttttaaccatt

SEQ ID NO: 5154242 - DNA, 19 bp, Homo sapiens
actaccagaagggcttcaa

SEQ ID NO: 5154243 - DNA, 19 bp, Homo sapiens
actaccaggaataatgata

SEQ ID NO: 5154244 - DNA, 20 bp, Homo sapiens
actaccagggtctctcaggg

SEQ ID NO: 5154245 - DNA, 19 bp, Homo sapiens
actaccagtgggcatgtat

SEQ ID NO: 5154246 - DNA, 18 bp, Homo sapiens
actaccatgctttgttta

SEQ ID NO: 5154247 - DNA, 14 bp, Homo sapiens
actacccaaatcta

SEQ ID NO: 5154248 - DNA, 22 bp, Homo sapiens
actacccattgttcccttcctc

SEQ ID NO: 5154249 - DNA, 12 bp, Homo sapiens
actaccccacac

SEQ ID NO: 5154250 - DNA, 20 bp, Homo sapiens
actaccccacaccagccttg

SEQ ID NO: 5154251 - DNA, 21 bp, Homo sapiens
actaccccaggacgcatgcag

SEQ ID NO: 5154252 - DNA, 16 bp, Homo sapiens
actacccccttttcag

SEQ ID NO: 5154253 - DNA, 14 bp, Homo sapiens
actaccccttgatt

SEQ ID NO: 5154254 - DNA, 16 bp, Homo sapiens
actacccgagcccagc

SEQ ID NO: 5154255 - DNA, 14 bp, Homo sapiens
actaccctccagag

SEQ ID NO: 5154256 - DNA, 20 bp, Homo sapiens
actaccctcctgtaaaatac

SEQ ID NO: 5154257 - DNA, 16 bp, Homo sapiens
actaccctgattcttg

SEQ ID NO: 5154258 - DNA, 13 bp, Homo sapiens
actacccttctcc

SEQ ID NO: 5154259 - DNA, 20 bp, Homo sapiens
actacccttctcctttcctt

SEQ ID NO: 5154260 - DNA, 21 bp, Homo sapiens
actacccttctcctttccttc

SEQ ID NO: 5154261 - DNA, 19 bp, Homo sapiens
actaccgaatgtgtcttta

SEQ ID NO: 5154262 - DNA, 15 bp, Homo sapiens
actaccgtgccagca

SEQ ID NO: 5154263 - DNA, 17 bp, Homo sapiens
actaccgtgccagcagc

SEQ ID NO: 5154264 - DNA, 23 bp, Homo sapiens
actacctaaaataaataccaaag

SEQ ID NO: 5154265 - DNA, 17 bp, Homo sapiens
actacctaagtaattct

SEQ ID NO: 5154266 - DNA, 17 bp, Homo sapiens
actacctactggtgtaa

SEQ ID NO: 5154267 - DNA, 12 bp, Homo sapiens
actacctagaag

SEQ ID NO: 5154268 - DNA, 16 bp, Homo sapiens
actacctagaagtaag

SEQ ID NO: 5154269 - DNA, 14 bp, Homo sapiens
actacctataggaa

SEQ ID NO: 5154270 - DNA, 22 bp, Homo sapiens
actacctatccttacatttcac

SEQ ID NO: 5154271 - DNA, 15 bp, Homo sapiens
actacctcaaaacac

SEQ ID NO: 5154272 - DNA, 14 bp, Homo sapiens
actacctcagaaca

SEQ ID NO: 5154273 - DNA, 14 bp, Homo sapiens
actacctcctcagg

SEQ ID NO: 5154274 - DNA, 15 bp, Homo sapiens
actacctcctcaggg

SEQ ID NO: 5154275 - DNA, 14 bp, Homo sapiens
actacctcttttga

SEQ ID NO: 5154276 - DNA, 22 bp, Homo sapiens
actacctgccatgcatacatgc

SEQ ID NO: 5154277 - DNA, 22 bp, Homo sapiens
actacctgtatttaaaaataga

SEQ ID NO: 5154278 - DNA, 13 bp, Homo sapiens
actacctgtcaag

SEQ ID NO: 5154279 - DNA, 22 bp, Homo sapiens
actacctgtcccctatgccact

SEQ ID NO: 5154280 - DNA, 12 bp, Homo sapiens
actacctgtgta

SEQ ID NO: 5154281 - DNA, 21 bp, Homo sapiens
actaccttccactctggaacc

SEQ ID NO: 5154282 - DNA, 19 bp, Homo sapiens
actacctttgtccaggcct

SEQ ID NO: 5154283 - DNA, 20 bp, Homo sapiens
actacctttgtccaggcctg

SEQ ID NO: 5154284 - DNA, 21 bp, Homo sapiens
actacgaaaaataaaaaggaa

SEQ ID NO: 5154285 - DNA, 17 bp, Homo sapiens
actacgcactggacagc

SEQ ID NO: 5154286 - DNA, 13 bp, Homo sapiens
actacgcagaaga

SEQ ID NO: 5154287 - DNA, 18 bp, Homo sapiens
actacggaactgcacact

SEQ ID NO: 5154288 - DNA, 21 bp, Homo sapiens
actacggaactgcacactcag

SEQ ID NO: 5154289 - DNA, 15 bp, Homo sapiens
actacggagaaactc

SEQ ID NO: 5154290 - DNA, 14 bp, Homo sapiens
actacggttgggag

SEQ ID NO: 5154291 - DNA, 16 bp, Homo sapiens
actacgtgttcacagg

SEQ ID NO: 5154292 - DNA, 17 bp, Homo sapiens
actactaaaagtttaga

SEQ ID NO: 5154293 - DNA, 14 bp, Homo sapiens
actactaaactggg

SEQ ID NO: 5154294 - DNA, 16 bp, Homo sapiens
actactaacaaatgta

SEQ ID NO: 5154295 - DNA, 14 bp, Homo sapiens
actactaaggaaaa

SEQ ID NO: 5154296 - DNA, 12 bp, Homo sapiens
actactacctct

SEQ ID NO: 5154297 - DNA, 13 bp, Homo sapiens
actactacctctt

SEQ ID NO: 5154298 - DNA, 16 bp, Homo sapiens
actactactctgccaa

SEQ ID NO: 5154299 - DNA, 21 bp, Homo sapiens
actactagggaaatgcctttg

SEQ ID NO: 5154300 - DNA, 19 bp, Homo sapiens
actactagtttttactttt

SEQ ID NO: 5154301 - DNA, 20 bp, Homo sapiens
actactcaatactacctctg

SEQ ID NO: 5154302 - DNA, 15 bp, Homo sapiens
actactcagggaatg

SEQ ID NO: 5154303 - DNA, 19 bp, Homo sapiens
actactcctctgcagtgcc

SEQ ID NO: 5154304 - DNA, 21 bp, Homo sapiens
actactcctctgcagtgcctt

SEQ ID NO: 5154305 - DNA, 14 bp, Homo sapiens
actactctctgttt

SEQ ID NO: 5154306 - DNA, 17 bp, Homo sapiens
actactgaaacagattt

SEQ ID NO: 5154307 - DNA, 19 bp, Homo sapiens
actactgaataaatcatgt

SEQ ID NO: 5154308 - DNA, 18 bp, Homo sapiens
actactgacatgtggggc

SEQ ID NO: 5154309 - DNA, 23 bp, Homo sapiens
actactgacatgtggggccaggt

SEQ ID NO: 5154310 - DNA, 19 bp, Homo sapiens
actactgaccagacaagct

SEQ ID NO: 5154311 - DNA, 18 bp, Homo sapiens
actactgagggaaatagc

SEQ ID NO: 5154312 - DNA, 19 bp, Homo sapiens
actactgagggaaatagcc

SEQ ID NO: 5154313 - DNA, 22 bp, Homo sapiens
actactgataacgtattttgat

SEQ ID NO: 5154314 - DNA, 21 bp, Homo sapiens
actactgattttaaaatgaat

SEQ ID NO: 5154315 - DNA, 22 bp, Homo sapiens
actactgattttaaaatgaata

SEQ ID NO: 5154316 - DNA, 17 bp, Homo sapiens
actactgcaaaaagtac

SEQ ID NO: 5154317 - DNA, 16 bp, Homo sapiens
actactgcagtcttta

SEQ ID NO: 5154318 - DNA, 15 bp, Homo sapiens
actactgcatttata

SEQ ID NO: 5154319 - DNA, 20 bp, Homo sapiens
actactgctaccacaactat

SEQ ID NO: 5154320 - DNA, 14 bp, Homo sapiens
actactgctgcaaa

SEQ ID NO: 5154321 - DNA, 18 bp, Homo sapiens
actactgggactcttcag

SEQ ID NO: 5154322 - DNA, 18 bp, Homo sapiens
actactgggtgtcatttc

SEQ ID NO: 5154323 - DNA, 21 bp, Homo sapiens
actactgggtgtcatttcatt

SEQ ID NO: 5154324 - DNA, 15 bp, Homo sapiens
actactggtctgtac

SEQ ID NO: 5154325 - DNA, 16 bp, Homo sapiens
actactggtctgtact

SEQ ID NO: 5154326 - DNA, 17 bp, Homo sapiens
actactggtctgtactc

SEQ ID NO: 5154327 - DNA, 12 bp, Homo sapiens
actactgtacat

SEQ ID NO: 5154328 - DNA, 15 bp, Homo sapiens
actactgtatctgat

SEQ ID NO: 5154329 - DNA, 23 bp, Homo sapiens
actactgtatttcattatctgta

SEQ ID NO: 5154330 - DNA, 22 bp, Homo sapiens
actactgtggaaaaatatttaa

SEQ ID NO: 5154331 - DNA, 15 bp, Homo sapiens
actactgtgttcctg

SEQ ID NO: 5154332 - DNA, 16 bp, Homo sapiens
actactgtgttcctgg

SEQ ID NO: 5154333 - DNA, 22 bp, Homo sapiens
actactgttaggaacagcagtg

SEQ ID NO: 5154334 - DNA, 19 bp, Homo sapiens
actactgttataattattc

SEQ ID NO: 5154335 - DNA, 23 bp, Homo sapiens
actactgttatcagtaatgctaa

SEQ ID NO: 5154336 - DNA, 20 bp, Homo sapiens
actactgttcagcttttatt

SEQ ID NO: 5154337 - DNA, 15 bp, Homo sapiens
actacttgagaaaat

SEQ ID NO: 5154338 - DNA, 19 bp, Homo sapiens
actacttgatggtcagaca

SEQ ID NO: 5154339 - DNA, 21 bp, Homo sapiens
actacttgatggtcagacaca

SEQ ID NO: 5154340 - DNA, 23 bp, Homo sapiens
actactttaaatcctaccaaagt

SEQ ID NO: 5154341 - DNA, 20 bp, Homo sapiens
actactttgaaaacaattca

SEQ ID NO: 5154342 - DNA, 13 bp, Homo sapiens
actactttgaata

SEQ ID NO: 5154343 - DNA, 15 bp, Homo sapiens
actacttttctaaaa

SEQ ID NO: 5154344 - DNA, 22 bp, Homo sapiens
actactttttatactccataca

SEQ ID NO: 5154345 - DNA, 23 bp, Homo sapiens
actagaaaattgtgctggaaatg

SEQ ID NO: 5154346 - DNA, 11 bp, Homo sapiens
actagaaaccc

SEQ ID NO: 5154347 - DNA, 18 bp, Homo sapiens
actagaaagtgaataaaa

SEQ ID NO: 5154348 - DNA, 22 bp, Homo sapiens
actagaaagtgaataaaaatta

SEQ ID NO: 5154349 - DNA, 13 bp, Homo sapiens
actagaaatatat

SEQ ID NO: 5154350 - DNA, 15 bp, Homo sapiens
actagaaatctgtcc

SEQ ID NO: 5154351 - DNA, 18 bp, Homo sapiens
actagaaatgggaatcat

SEQ ID NO: 5154352 - DNA, 15 bp, Homo sapiens
actagaacaacttga

SEQ ID NO: 5154353 - DNA, 18 bp, Homo sapiens
actagaacctatctttaa

SEQ ID NO: 5154354 - DNA, 14 bp, Homo sapiens
actagaacctggag

SEQ ID NO: 5154355 - DNA, 15 bp, Homo sapiens
actagaacctggagg

SEQ ID NO: 5154356 - DNA, 23 bp, Homo sapiens
actagaacctggagggctagaac

SEQ ID NO: 5154357 - DNA, 15 bp, Homo sapiens
actagaactctccat

SEQ ID NO: 5154358 - DNA, 17 bp, Homo sapiens
actagaactgaattttg

SEQ ID NO: 5154359 - DNA, 13 bp, Homo sapiens
actagaagaaaag

SEQ ID NO: 5154360 - DNA, 14 bp, Homo sapiens
actagaagaaaagc

SEQ ID NO: 5154361 - DNA, 19 bp, Homo sapiens
actagaagattagaaacta

SEQ ID NO: 5154362 - DNA, 22 bp, Homo sapiens
actagaatcaccgcatttcagt

SEQ ID NO: 5154363 - DNA, 15 bp, Homo sapiens
actagaatgagaaat

SEQ ID NO: 5154364 - DNA, 18 bp, Homo sapiens
actagaattagtatgtct

SEQ ID NO: 5154365 - DNA, 20 bp, Homo sapiens
actagaattagtatgtctgt

SEQ ID NO: 5154366 - DNA, 18 bp, Homo sapiens
actagaattctagtgctg

SEQ ID NO: 5154367 - DNA, 21 bp, Homo sapiens
actagaattctagtgctgctg

SEQ ID NO: 5154368 - DNA, 15 bp, Homo sapiens
actagacaaaagttt

SEQ ID NO: 5154369 - DNA, 16 bp, Homo sapiens
actagacaccttctgt

SEQ ID NO: 5154370 - DNA, 21 bp, Homo sapiens
actagacaccttctgtgctca

SEQ ID NO: 5154371 - DNA, 20 bp, Homo sapiens
actagacattctgtcgcctt

SEQ ID NO: 5154372 - DNA, 19 bp, Homo sapiens
actagaccatttttaaatg

SEQ ID NO: 5154373 - DNA, 19 bp, Homo sapiens
actagactcttcactgtta

SEQ ID NO: 5154374 - DNA, 22 bp, Homo sapiens
actagactggtggcaggggctt

SEQ ID NO: 5154375 - DNA, 14 bp, Homo sapiens
actagagaaagaca

SEQ ID NO: 5154376 - DNA, 19 bp, Homo sapiens
actagagaataatttttgt

SEQ ID NO: 5154377 - DNA, 16 bp, Homo sapiens
actagagaatgcacag

SEQ ID NO: 5154378 - DNA, 22 bp, Homo sapiens
actagagaatgttcccaatttg

SEQ ID NO: 5154379 - DNA, 13 bp, Homo sapiens
actagagacaaat

SEQ ID NO: 5154380 - DNA, 17 bp, Homo sapiens
actagagacaaatcttt

SEQ ID NO: 5154381 - DNA, 15 bp, Homo sapiens
actagagactctgtg

SEQ ID NO: 5154382 - DNA, 19 bp, Homo sapiens
actagagactctgtgatct

SEQ ID NO: 5154383 - DNA, 16 bp, Homo sapiens
actagagcagccctgg

SEQ ID NO: 5154384 - DNA, 22 bp, Homo sapiens
actagagctgggaaacagggag

SEQ ID NO: 5154385 - DNA, 23 bp, Homo sapiens
actagagctgggaaacagggagc

SEQ ID NO: 5154386 - DNA, 15 bp, Homo sapiens
actagaggccaggga

SEQ ID NO: 5154387 - DNA, 18 bp, Homo sapiens
actagaggccagggcagc

SEQ ID NO: 5154388 - DNA, 21 bp, Homo sapiens
actagagggacctctcccagg

SEQ ID NO: 5154389 - DNA, 22 bp, Homo sapiens
actagagggacctctcccaggg

SEQ ID NO: 5154390 - DNA, 12 bp, Homo sapiens
actagagggccc

SEQ ID NO: 5154391 - DNA, 14 bp, Homo sapiens
actagagggcccat

SEQ ID NO: 5154392 - DNA, 16 bp, Homo sapiens
actagagggcccatca

SEQ ID NO: 5154393 - DNA, 23 bp, Homo sapiens
actagagtaaaggccatcaaact

SEQ ID NO: 5154394 - DNA, 15 bp, Homo sapiens
actagagtatgtgta

SEQ ID NO: 5154395 - DNA, 19 bp, Homo sapiens
actagagtcacccccccag

SEQ ID NO: 5154396 - DNA, 15 bp, Homo sapiens
actagagtctgaaca

SEQ ID NO: 5154397 - DNA, 21 bp, Homo sapiens
actagagtctgaacagctgta

SEQ ID NO: 5154398 - DNA, 16 bp, Homo sapiens
actagataacttaaat

SEQ ID NO: 5154399 - DNA, 15 bp, Homo sapiens
actagatacagaata

SEQ ID NO: 5154400 - DNA, 13 bp, Homo sapiens
actagatcacttg

SEQ ID NO: 5154401 - DNA, 22 bp, Homo sapiens
actagatctcctatttttcaga

SEQ ID NO: 5154402 - DNA, 23 bp, Homo sapiens
actagatctcctatttttcagaa

SEQ ID NO: 5154403 - DNA, 14 bp, Homo sapiens
actagatctcctgt

SEQ ID NO: 5154404 - DNA, 18 bp, Homo sapiens
actagatctcctgtaatt

SEQ ID NO: 5154405 - DNA, 14 bp, Homo sapiens
actagatgacctca

SEQ ID NO: 5154406 - DNA, 17 bp, Homo sapiens
actagatgacctcatta

SEQ ID NO: 5154407 - DNA, 16 bp, Homo sapiens
actagatggtgctgag

SEQ ID NO: 5154408 - DNA, 18 bp, Homo sapiens
actagattacattcagtt

SEQ ID NO: 5154409 - DNA, 16 bp, Homo sapiens
actagattctcacctg

SEQ ID NO: 5154410 - DNA, 15 bp, Homo sapiens
actagattgtgatcc

SEQ ID NO: 5154411 - DNA, 23 bp, Homo sapiens
actagatttataaatgcactgta

SEQ ID NO: 5154412 - DNA, 16 bp, Homo sapiens
actagatttgtccttt

SEQ ID NO: 5154413 - DNA, 19 bp, Homo sapiens
actagcaaaataaaacata

SEQ ID NO: 5154414 - DNA, 20 bp, Homo sapiens
actagcaaacaaaaatagaa

SEQ ID NO: 5154415 - DNA, 13 bp, Homo sapiens
actagcaataagt

SEQ ID NO: 5154416 - DNA, 20 bp, Homo sapiens
actagcaataagttgaatga

SEQ ID NO: 5154417 - DNA, 17 bp, Homo sapiens
actagcatacttaaaat

SEQ ID NO: 5154418 - DNA, 19 bp, Homo sapiens
actagcatacttaaaatat

SEQ ID NO: 5154419 - DNA, 10 bp, Homo sapiens
actagcatta

SEQ ID NO: 5154420 - DNA, 20 bp, Homo sapiens
actagcattacattattaaa

SEQ ID NO: 5154421 - DNA, 15 bp, Homo sapiens
actagccactcctgc

SEQ ID NO: 5154422 - DNA, 11 bp, Homo sapiens
actagccagaa

SEQ ID NO: 5154423 - DNA, 20 bp, Homo sapiens
actagccagcacaaaaggca

SEQ ID NO: 5154424 - DNA, 13 bp, Homo sapiens
actagccagccag

SEQ ID NO: 5154425 - DNA, 17 bp, Homo sapiens
actagcccaatgaaatg

SEQ ID NO: 5154426 - DNA, 14 bp, Homo sapiens
actagcccaggacc

SEQ ID NO: 5154427 - DNA, 21 bp, Homo sapiens
actagcctccctctcctctgt

SEQ ID NO: 5154428 - DNA, 16 bp, Homo sapiens
actagcctgtcatcct

SEQ ID NO: 5154429 - DNA, 19 bp, Homo sapiens
actagccttcccagcttcc

SEQ ID NO: 5154430 - DNA, 17 bp, Homo sapiens
actagcctttggctctg

SEQ ID NO: 5154431 - DNA, 17 bp, Homo sapiens
actagcctttttggtat

SEQ ID NO: 5154432 - DNA, 15 bp, Homo sapiens
actagcgcctggcct

SEQ ID NO: 5154433 - DNA, 17 bp, Homo sapiens
actagctaagcaagcca

SEQ ID NO: 5154434 - DNA, 14 bp, Homo sapiens
actagctatggtgt

SEQ ID NO: 5154435 - DNA, 12 bp, Homo sapiens
actagctcccca

SEQ ID NO: 5154436 - DNA, 11 bp, Homo sapiens
actagctcttg

SEQ ID NO: 5154437 - DNA, 16 bp, Homo sapiens
actagctctttgagat

SEQ ID NO: 5154438 - DNA, 22 bp, Homo sapiens
actagctggaattttttattct

SEQ ID NO: 5154439 - DNA, 23 bp, Homo sapiens
actagctggaattttttattctt

SEQ ID NO: 5154440 - DNA, 21 bp, Homo sapiens
actagctgggactacaggtgc

SEQ ID NO: 5154441 - DNA, 18 bp, Homo sapiens
acgatcattgtgcccact

SEQ ID NO: 5154442 - DNA, 19 bp, Homo sapiens
acgatccgcaacccatgcc

SEQ ID NO: 5154443 - DNA, 19 bp, Homo sapiens
acgatcctgccaccctgta

SEQ ID NO: 5154444 - DNA, 21 bp, Homo sapiens
acgatcctgccaccctgtagc

SEQ ID NO: 5154445 - DNA, 15 bp, Homo sapiens
acgatctcagctcac

SEQ ID NO: 5154446 - DNA, 22 bp, Homo sapiens
acgatctcggctcactgcaacc

SEQ ID NO: 5154447 - DNA, 11 bp, Homo sapiens
acgatcttggc

SEQ ID NO: 5154448 - DNA, 14 bp, Homo sapiens
acgatgaaaaactt

SEQ ID NO: 5154449 - DNA, 16 bp, Homo sapiens
acgatgaatttcttct

SEQ ID NO: 5154450 - DNA, 19 bp, Homo sapiens
acgatgaatttcttctaat

SEQ ID NO: 5154451 - DNA, 22 bp, Homo sapiens
acgatgaccacagactcaatgt

SEQ ID NO: 5154452 - DNA, 16 bp, Homo sapiens
acgatgacgcctctgg

SEQ ID NO: 5154453 - DNA, 23 bp, Homo sapiens
acgatgcatttaataaagatgag

SEQ ID NO: 5154454 - DNA, 17 bp, Homo sapiens
acgatgggctttcccaa

SEQ ID NO: 5154455 - DNA, 19 bp, Homo sapiens
acgatggggggctgatggc

SEQ ID NO: 5154456 - DNA, 23 bp, Homo sapiens
acgatggggggctgatggctgcc

SEQ ID NO: 5154457 - DNA, 14 bp, Homo sapiens
acgatgtggccctg

SEQ ID NO: 5154458 - DNA, 15 bp, Homo sapiens
acgattatgactaaa

SEQ ID NO: 5154459 - DNA, 18 bp, Homo sapiens
acgattatttatttctgt

SEQ ID NO: 5154460 - DNA, 20 bp, Homo sapiens
acgattcatttttgaaactg

SEQ ID NO: 5154461 - DNA, 16 bp, Homo sapiens
acgattccttctctga

SEQ ID NO: 5154462 - DNA, 21 bp, Homo sapiens
acgattggtatgatgctgccg

SEQ ID NO: 5154463 - DNA, 14 bp, Homo sapiens
acgatttaattctc

SEQ ID NO: 5154464 - DNA, 17 bp, Homo sapiens
acgatttaattctcttg

SEQ ID NO: 5154465 - DNA, 13 bp, Homo sapiens
acgatttaattta

SEQ ID NO: 5154466 - DNA, 22 bp, Homo sapiens
acgatttctccattaaacttct

SEQ ID NO: 5154467 - DNA, 12 bp, Homo sapiens
acgatttgtctt

SEQ ID NO: 5154468 - DNA, 16 bp, Homo sapiens
acgattttaaaatgac

SEQ ID NO: 5154469 - DNA, 18 bp, Homo sapiens
acgattttctccagctca

SEQ ID NO: 5154470 - DNA, 18 bp, Homo sapiens
acgcaaaaatagctcttg

SEQ ID NO: 5154471 - DNA, 20 bp, Homo sapiens
acgcaaaccaacctttctga

SEQ ID NO: 5154472 - DNA, 19 bp, Homo sapiens
acgcaaacctctccttcct

SEQ ID NO: 5154473 - DNA, 20 bp, Homo sapiens
acgcaaacctctccttcctc

SEQ ID NO: 5154474 - DNA, 22 bp, Homo sapiens
acgcaactcacacctccttttc

SEQ ID NO: 5154475 - DNA, 13 bp, Homo sapiens
acgcaaggaagga

SEQ ID NO: 5154476 - DNA, 18 bp, Homo sapiens
acgcaaggctgtgctctt

SEQ ID NO: 5154477 - DNA, 21 bp, Homo sapiens
acgcaagggagaagaaatcca

SEQ ID NO: 5154478 - DNA, 16 bp, Homo sapiens
acgcaagtgtgtgagt

SEQ ID NO: 5154479 - DNA, 16 bp, Homo sapiens
acgcaattaaaaataa

SEQ ID NO: 5154480 - DNA, 11 bp, Homo sapiens
acgcaattctc

SEQ ID NO: 5154481 - DNA, 18 bp, Homo sapiens
acgcaattttacctagtt

SEQ ID NO: 5154482 - DNA, 15 bp, Homo sapiens
acgcacacatggaca

SEQ ID NO: 5154483 - DNA, 18 bp, Homo sapiens
acgcacaccctgcccctg

SEQ ID NO: 5154484 - DNA, 17 bp, Homo sapiens
acgcacacgcacacatc

SEQ ID NO: 5154485 - DNA, 14 bp, Homo sapiens
acgcacagacaggt

SEQ ID NO: 5154486 - DNA, 21 bp, Homo sapiens
acgcacagacaggttttcaca

SEQ ID NO: 5154487 - DNA, 19 bp, Homo sapiens
acgcacataccttcatgtg

SEQ ID NO: 5154488 - DNA, 21 bp, Homo sapiens
acgcaccaatcagcactctgt

SEQ ID NO: 5154489 - DNA, 14 bp, Homo sapiens
acgcaccacatctc

SEQ ID NO: 5154490 - DNA, 22 bp, Homo sapiens
acgcaccaccatgccaggctaa

SEQ ID NO: 5154491 - DNA, 23 bp, Homo sapiens
acgcaccactgcttcccactggg

SEQ ID NO: 5154492 - DNA, 17 bp, Homo sapiens
acgcaccattttgtcag

SEQ ID NO: 5154493 - DNA, 15 bp, Homo sapiens
acgcacccacaccct

SEQ ID NO: 5154494 - DNA, 18 bp, Homo sapiens
acgcaccccactgggaga

SEQ ID NO: 5154495 - DNA, 18 bp, Homo sapiens
acgcaccccgcccctgca

SEQ ID NO: 5154496 - DNA, 16 bp, Homo sapiens
acgcacccgtatctgc

SEQ ID NO: 5154497 - DNA, 23 bp, Homo sapiens
acgcaccgcctgaaggcacagct

SEQ ID NO: 5154498 - DNA, 20 bp, Homo sapiens
acgcaccggcctggctgcag

SEQ ID NO: 5154499 - DNA, 22 bp, Homo sapiens
acgcaccggcctggctgcagct

SEQ ID NO: 5154500 - DNA, 13 bp, Homo sapiens
acgcacctccacg

SEQ ID NO: 5154501 - DNA, 16 bp, Homo sapiens
acgcacctccacgcca

SEQ ID NO: 5154502 - DNA, 22 bp, Homo sapiens
acgcacctccacgccactgcct

SEQ ID NO: 5154503 - DNA, 13 bp, Homo sapiens
acgcacctccatc

SEQ ID NO: 5154504 - DNA, 13 bp, Homo sapiens
acgcacctcccat

SEQ ID NO: 5154505 - DNA, 14 bp, Homo sapiens
acgcacctgcctca

SEQ ID NO: 5154506 - DNA, 14 bp, Homo sapiens
acgcacctgtagtc

SEQ ID NO: 5154507 - DNA, 11 bp, Homo sapiens
acgcacgcaca

SEQ ID NO: 5154508 - DNA, 13 bp, Homo sapiens
acgcacgcacaca

SEQ ID NO: 5154509 - DNA, 13 bp, Homo sapiens
acgcacgcaccca

SEQ ID NO: 5154510 - DNA, 21 bp, Homo sapiens
acgcacgctcgctgccatcac

SEQ ID NO: 5154511 - DNA, 21 bp, Homo sapiens
acgcactctccccgctcaggg

SEQ ID NO: 5154512 - DNA, 23 bp, Homo sapiens
acgcactgagcaacgctattcca

SEQ ID NO: 5154513 - DNA, 14 bp, Homo sapiens
acgcacttcctctc

SEQ ID NO: 5154514 - DNA, 22 bp, Homo sapiens
acgcacttctggggccagcccc

SEQ ID NO: 5154515 - DNA, 21 bp, Homo sapiens
acgcacttgcctgttggctgc

SEQ ID NO: 5154516 - DNA, 23 bp, Homo sapiens
acgcacttgcctgttggctgctg

SEQ ID NO: 5154517 - DNA, 19 bp, Homo sapiens
acgcagaagaaagggtgga

SEQ ID NO: 5154518 - DNA, 14 bp, Homo sapiens
acgcagaagagaaa

SEQ ID NO: 5154519 - DNA, 14 bp, Homo sapiens
acgcagaagagggg

SEQ ID NO: 5154520 - DNA, 14 bp, Homo sapiens
acgcagagccccgg

SEQ ID NO: 5154521 - DNA, 15 bp, Homo sapiens
acgcagaggcggaaa

SEQ ID NO: 5154522 - DNA, 21 bp, Homo sapiens
acgcagaggcggaaaccttgc

SEQ ID NO: 5154523 - DNA, 15 bp, Homo sapiens
acgcagatgatccat

SEQ ID NO: 5154524 - DNA, 22 bp, Homo sapiens
acgcagatgctgtcactggcag

SEQ ID NO: 5154525 - DNA, 21 bp, Homo sapiens
acgcagcagctgggacccctc

SEQ ID NO: 5154526 - DNA, 21 bp, Homo sapiens
acgcagcaggaggccaggccg

SEQ ID NO: 5154527 - DNA, 13 bp, Homo sapiens
acgcagccacaca

SEQ ID NO: 5154528 - DNA, 14 bp, Homo sapiens
acgcagccacacag

SEQ ID NO: 5154529 - DNA, 23 bp, Homo sapiens
acgcagccccccacgcttctgga

SEQ ID NO: 5154530 - DNA, 19 bp, Homo sapiens
acgcagccctagagcctgc

SEQ ID NO: 5154531 - DNA, 20 bp, Homo sapiens
acgcagccctagagcctgcc

SEQ ID NO: 5154532 - DNA, 19 bp, Homo sapiens
acgcagccctgggggccag

SEQ ID NO: 5154533 - DNA, 21 bp, Homo sapiens
acgcagccctgggggccagct

SEQ ID NO: 5154534 - DNA, 18 bp, Homo sapiens
acgcagccgccgccgccc

SEQ ID NO: 5154535 - DNA, 18 bp, Homo sapiens
acgcagcctgctctggag

SEQ ID NO: 5154536 - DNA, 16 bp, Homo sapiens
acgcaggaactcccag

SEQ ID NO: 5154537 - DNA, 12 bp, Homo sapiens
acgcaggaatgg

SEQ ID NO: 5154538 - DNA, 14 bp, Homo sapiens
acgcaggagctgtg

SEQ ID NO: 5154539 - DNA, 12 bp, Homo sapiens
acgcaggcacag

SEQ ID NO: 5154540 - DNA, 18 bp, Homo sapiens
acgcaggccacccgggct

SEQ ID NO: 5154541 - DNA, 22 bp, Homo sapiens
acgcaggccacccgggctgcct

SEQ ID NO: 5154542 - DNA, 16 bp, Homo sapiens
acgcaggcccctctcc

SEQ ID NO: 5154543 - DNA, 18 bp, Homo sapiens
acgcaggcccctctcctc

SEQ ID NO: 5154544 - DNA, 17 bp, Homo sapiens
acgcaggccctgtccag

SEQ ID NO: 5154545 - DNA, 20 bp, Homo sapiens
acgcaggcctccctgcctca

SEQ ID NO: 5154546 - DNA, 18 bp, Homo sapiens
acgcaggcggccagggcg

SEQ ID NO: 5154547 - DNA, 22 bp, Homo sapiens
acgcaggctgagtgcactggca

SEQ ID NO: 5154548 - DNA, 23 bp, Homo sapiens
acgcaggctgagtgcactggcag

SEQ ID NO: 5154549 - DNA, 12 bp, Homo sapiens
acgcagggccat

SEQ ID NO: 5154550 - DNA, 18 bp, Homo sapiens
acgcagggccatccactg

SEQ ID NO: 5154551 - DNA, 19 bp, Homo sapiens
acgcaggggccctgagcca

SEQ ID NO: 5154552 - DNA, 21 bp, Homo sapiens
acgcaggtatttagaagcaga

SEQ ID NO: 5154553 - DNA, 21 bp, Homo sapiens
acgcagtccgcccaggtcccc

SEQ ID NO: 5154554 - DNA, 15 bp, Homo sapiens
acgcagtgcctggag

SEQ ID NO: 5154555 - DNA, 17 bp, Homo sapiens
acgcagtgcctggagtt

SEQ ID NO: 5154556 - DNA, 15 bp, Homo sapiens
acgcagttctttcca

SEQ ID NO: 5154557 - DNA, 18 bp, Homo sapiens
acgcagttgattccttga

SEQ ID NO: 5154558 - DNA, 18 bp, Homo sapiens
acgcagttgtgtggccca

SEQ ID NO: 5154559 - DNA, 18 bp, Homo sapiens
acgcatacacacatgccc

SEQ ID NO: 5154560 - DNA, 22 bp, Homo sapiens
acgcatacacacatgccctcct

SEQ ID NO: 5154561 - DNA, 15 bp, Homo sapiens
acgcatccagcaaga

SEQ ID NO: 5154562 - DNA, 19 bp, Homo sapiens
acgcatcccatctctccca

SEQ ID NO: 5154563 - DNA, 14 bp, Homo sapiens
acgcatcctgcagt

SEQ ID NO: 5154564 - DNA, 21 bp, Homo sapiens
acgcatctcaaaacagagggc

SEQ ID NO: 5154565 - DNA, 23 bp, Homo sapiens
acgcatctcaaaacagagggctg

SEQ ID NO: 5154566 - DNA, 16 bp, Homo sapiens
acgcatgatggagctg

SEQ ID NO: 5154567 - DNA, 15 bp, Homo sapiens
acgcatgcagggccc

SEQ ID NO: 5154568 - DNA, 23 bp, Homo sapiens
acgcatgcctcagccagccctgg

SEQ ID NO: 5154569 - DNA, 22 bp, Homo sapiens
acgcatggagtgtgtattgttc

SEQ ID NO: 5154570 - DNA, 23 bp, Homo sapiens
acgcatgggcattgcagccttgc

SEQ ID NO: 5154571 - DNA, 19 bp, Homo sapiens
acgcatggtcaaccctcag

SEQ ID NO: 5154572 - DNA, 16 bp, Homo sapiens
acgcatgtccctccaa

SEQ ID NO: 5154573 - DNA, 22 bp, Homo sapiens
acgcattttgggttgtttaaaa

SEQ ID NO: 5154574 - DNA, 18 bp, Homo sapiens
acgcattttggtttttcc

SEQ ID NO: 5154575 - DNA, 20 bp, Homo sapiens
acgcattttggtttttcctc

SEQ ID NO: 5154576 - DNA, 18 bp, Homo sapiens
acgccaaagtgcagccct

SEQ ID NO: 5154577 - DNA, 14 bp, Homo sapiens
acgccaacagcccc

SEQ ID NO: 5154578 - DNA, 14 bp, Homo sapiens
acgccaaccccagc

SEQ ID NO: 5154579 - DNA, 17 bp, Homo sapiens
acgccaaccccagcagt

SEQ ID NO: 5154580 - DNA, 12 bp, Homo sapiens
acgccacatccc

SEQ ID NO: 5154581 - DNA, 19 bp, Homo sapiens
acgccaccacacctggctt

SEQ ID NO: 5154582 - DNA, 20 bp, Homo sapiens
acgccaccctgcccaccccc

SEQ ID NO: 5154583 - DNA, 13 bp, Homo sapiens
acgccacctcgcc

SEQ ID NO: 5154584 - DNA, 17 bp, Homo sapiens
acgccactcatttcatc

SEQ ID NO: 5154585 - DNA, 21 bp, Homo sapiens
acgccactcatttcatctcat

SEQ ID NO: 5154586 - DNA, 18 bp, Homo sapiens
acgccactccctgggaca

SEQ ID NO: 5154587 - DNA, 21 bp, Homo sapiens
acgccactgcactccagcctg

SEQ ID NO: 5154588 - DNA, 16 bp, Homo sapiens
acgccagacttcccac

SEQ ID NO: 5154589 - DNA, 18 bp, Homo sapiens
acgccagataaaatgttc

SEQ ID NO: 5154590 - DNA, 11 bp, Homo sapiens
acgccagctgg

SEQ ID NO: 5154591 - DNA, 16 bp, Homo sapiens
acgccagctggcccag

SEQ ID NO: 5154592 - DNA, 11 bp, Homo sapiens
acgccaggaga

SEQ ID NO: 5154593 - DNA, 14 bp, Homo sapiens
acgccagtgtgttt

SEQ ID NO: 5154594 - DNA, 11 bp, Homo sapiens
acgccatccca

SEQ ID NO: 5154595 - DNA, 17 bp, Homo sapiens
acgccatcccagcccca

SEQ ID NO: 5154596 - DNA, 18 bp, Homo sapiens
acgccatcccagccccaa

SEQ ID NO: 5154597 - DNA, 19 bp, Homo sapiens
acgccatgtgatggacact

SEQ ID NO: 5154598 - DNA, 15 bp, Homo sapiens
acgccattggttgga

SEQ ID NO: 5154599 - DNA, 20 bp, Homo sapiens
acgcccacccaaccccaagc

SEQ ID NO: 5154600 - DNA, 15 bp, Homo sapiens
acgcccagcccccac

SEQ ID NO: 5154601 - DNA, 18 bp, Homo sapiens
acgcccagcccccacccc

SEQ ID NO: 5154602 - DNA, 19 bp, Homo sapiens
acgcccagcccccaccccc

SEQ ID NO: 5154603 - DNA, 12 bp, Homo sapiens
acgcccagcctc

SEQ ID NO: 5154604 - DNA, 15 bp, Homo sapiens
acgcccagcctcctc

SEQ ID NO: 5154605 - DNA, 21 bp, Homo sapiens
acgcccagctccgcctgctgg

SEQ ID NO: 5154606 - DNA, 19 bp, Homo sapiens
acgcccagctgaggctggg

SEQ ID NO: 5154607 - DNA, 15 bp, Homo sapiens
acgcccatctcagga

SEQ ID NO: 5154608 - DNA, 23 bp, Homo sapiens
acgcccccccccacccctggggg

SEQ ID NO: 5154609 - DNA, 23 bp, Homo sapiens
acgccccgggcaaagggtctttt

SEQ ID NO: 5154610 - DNA, 20 bp, Homo sapiens
acgccccggtcccccagagc

SEQ ID NO: 5154611 - DNA, 12 bp, Homo sapiens
acgcccctccaa

SEQ ID NO: 5154612 - DNA, 19 bp, Homo sapiens
acgcccctccaaacctcca

SEQ ID NO: 5154613 - DNA, 20 bp, Homo sapiens
acgcccctccaaacctccag

SEQ ID NO: 5154614 - DNA, 23 bp, Homo sapiens
acgcccctcccaagcgttcctgg

SEQ ID NO: 5154615 - DNA, 14 bp, Homo sapiens
acgcccctccccag

SEQ ID NO: 5154616 - DNA, 18 bp, Homo sapiens
acgcccctccccagcccc

SEQ ID NO: 5154617 - DNA, 21 bp, Homo sapiens
acgcccctccgggcagagacc

SEQ ID NO: 5154618 - DNA, 11 bp, Homo sapiens
actagctgtgc

SEQ ID NO: 5154619 - DNA, 15 bp, Homo sapiens
actaggaaaattgga

SEQ ID NO: 5154620 - DNA, 15 bp, Homo sapiens
actaggaaggcactt

SEQ ID NO: 5154621 - DNA, 16 bp, Homo sapiens
actaggactctgaggc

SEQ ID NO: 5154622 - DNA, 18 bp, Homo sapiens
actaggagaaccaaatct

SEQ ID NO: 5154623 - DNA, 13 bp, Homo sapiens
actaggagactgg

SEQ ID NO: 5154624 - DNA, 14 bp, Homo sapiens
actaggagactggt

SEQ ID NO: 5154625 - DNA, 21 bp, Homo sapiens
actaggagctttgactcagga

SEQ ID NO: 5154626 - DNA, 15 bp, Homo sapiens
actaggaggaaaaga

SEQ ID NO: 5154627 - DNA, 15 bp, Homo sapiens
actaggatactgctg

SEQ ID NO: 5154628 - DNA, 17 bp, Homo sapiens
actaggatagcttcatc

SEQ ID NO: 5154629 - DNA, 15 bp, Homo sapiens
actaggatatgtata

SEQ ID NO: 5154630 - DNA, 17 bp, Homo sapiens
actaggattagaaaatt

SEQ ID NO: 5154631 - DNA, 18 bp, Homo sapiens
actaggattataatgctg

SEQ ID NO: 5154632 - DNA, 23 bp, Homo sapiens
actaggattgacattctacagtt

SEQ ID NO: 5154633 - DNA, 18 bp, Homo sapiens
actaggcatgttaggaat

SEQ ID NO: 5154634 - DNA, 17 bp, Homo sapiens
actaggcattgtgatgt

SEQ ID NO: 5154635 - DNA, 20 bp, Homo sapiens
actaggcccccacttgcctc

SEQ ID NO: 5154636 - DNA, 22 bp, Homo sapiens
actaggcccccacttgcctctt

SEQ ID NO: 5154637 - DNA, 23 bp, Homo sapiens
actaggcccccacttgcctcttc

SEQ ID NO: 5154638 - DNA, 15 bp, Homo sapiens
actaggccctggtct

SEQ ID NO: 5154639 - DNA, 22 bp, Homo sapiens
actaggccttgcggctcctcag

SEQ ID NO: 5154640 - DNA, 14 bp, Homo sapiens
actaggctcagaga

SEQ ID NO: 5154641 - DNA, 15 bp, Homo sapiens
actaggctcatactc

SEQ ID NO: 5154642 - DNA, 15 bp, Homo sapiens
actaggcttctgtaa

SEQ ID NO: 5154643 - DNA, 20 bp, Homo sapiens
actagggaaaggtaaataca

SEQ ID NO: 5154644 - DNA, 21 bp, Homo sapiens
actagggactatcaggtaata

SEQ ID NO: 5154645 - DNA, 18 bp, Homo sapiens
actagggagccatgtttc

SEQ ID NO: 5154646 - DNA, 20 bp, Homo sapiens
actagggatccctcatctgt

SEQ ID NO: 5154647 - DNA, 17 bp, Homo sapiens
actagggattcaggctg

SEQ ID NO: 5154648 - DNA, 16 bp, Homo sapiens
actagggccaagccca

SEQ ID NO: 5154649 - DNA, 21 bp, Homo sapiens
actagggcctcggaggctcct

SEQ ID NO: 5154650 - DNA, 12 bp, Homo sapiens
actagggctgag

SEQ ID NO: 5154651 - DNA, 13 bp, Homo sapiens
actaggggaggag

SEQ ID NO: 5154652 - DNA, 15 bp, Homo sapiens
actagggggtgtata

SEQ ID NO: 5154653 - DNA, 22 bp, Homo sapiens
actagggtcctggccctcttct

SEQ ID NO: 5154654 - DNA, 15 bp, Homo sapiens
actagggtcctgggg

SEQ ID NO: 5154655 - DNA, 16 bp, Homo sapiens
actagggttttggcct

SEQ ID NO: 5154656 - DNA, 17 bp, Homo sapiens
actagggttttggcctg

SEQ ID NO: 5154657 - DNA, 23 bp, Homo sapiens
actagggttttggcctgcctgcg

SEQ ID NO: 5154658 - DNA, 14 bp, Homo sapiens
actaggtaacttca

SEQ ID NO: 5154659 - DNA, 22 bp, Homo sapiens
actaggtaataataatgggaga

SEQ ID NO: 5154660 - DNA, 14 bp, Homo sapiens
actaggtaatgttt

SEQ ID NO: 5154661 - DNA, 15 bp, Homo sapiens
actaggtaatgtttt

SEQ ID NO: 5154662 - DNA, 23 bp, Homo sapiens
actaggtattgtctactctgaag

SEQ ID NO: 5154663 - DNA, 18 bp, Homo sapiens
actaggtcaaaaatctgt

SEQ ID NO: 5154664 - DNA, 19 bp, Homo sapiens
actaggtgacatgtctact

SEQ ID NO: 5154665 - DNA, 22 bp, Homo sapiens
actaggtgcccagaatgaggct

SEQ ID NO: 5154666 - DNA, 15 bp, Homo sapiens
actaggtgcccagtc

SEQ ID NO: 5154667 - DNA, 20 bp, Homo sapiens
actaggtgcccagtcttgag

SEQ ID NO: 5154668 - DNA, 13 bp, Homo sapiens
actaggtgtcccc

SEQ ID NO: 5154669 - DNA, 21 bp, Homo sapiens
actaggttctaggtcctggct

SEQ ID NO: 5154670 - DNA, 19 bp, Homo sapiens
actaggttggacagccccc

SEQ ID NO: 5154671 - DNA, 21 bp, Homo sapiens
actaggtttaaaacagcctgg

SEQ ID NO: 5154672 - DNA, 22 bp, Homo sapiens
actaggtttatttatctgagca

SEQ ID NO: 5154673 - DNA, 19 bp, Homo sapiens
actagtaataccaaagact

SEQ ID NO: 5154674 - DNA, 13 bp, Homo sapiens
actagtaatcttg

SEQ ID NO: 5154675 - DNA, 20 bp, Homo sapiens
actagtacaaattataaaaa

SEQ ID NO: 5154676 - DNA, 14 bp, Homo sapiens
actagtagttctct

SEQ ID NO: 5154677 - DNA, 17 bp, Homo sapiens
actagtagttctcttgg

SEQ ID NO: 5154678 - DNA, 13 bp, Homo sapiens
actagtatcactg

SEQ ID NO: 5154679 - DNA, 18 bp, Homo sapiens
actagtatctctggcctc

SEQ ID NO: 5154680 - DNA, 19 bp, Homo sapiens
actagtatctctggcctcc

SEQ ID NO: 5154681 - DNA, 14 bp, Homo sapiens
actagtatgaaata

SEQ ID NO: 5154682 - DNA, 15 bp, Homo sapiens
actagtatgaaataa

SEQ ID NO: 5154683 - DNA, 17 bp, Homo sapiens
actagtcaagaaaaata

SEQ ID NO: 5154684 - DNA, 20 bp, Homo sapiens
actagtcatagaaatacctc

SEQ ID NO: 5154685 - DNA, 16 bp, Homo sapiens
actagtcccttggata

SEQ ID NO: 5154686 - DNA, 17 bp, Homo sapiens
actagtctgtgtaactt

SEQ ID NO: 5154687 - DNA, 15 bp, Homo sapiens
actagtgacagcttg

SEQ ID NO: 5154688 - DNA, 18 bp, Homo sapiens
actagtgacagtttcttt

SEQ ID NO: 5154689 - DNA, 19 bp, Homo sapiens
actagtgagtcagcacctt

SEQ ID NO: 5154690 - DNA, 13 bp, Homo sapiens
actagtgcaaatc

SEQ ID NO: 5154691 - DNA, 16 bp, Homo sapiens
actagtgcaaatcata

SEQ ID NO: 5154692 - DNA, 17 bp, Homo sapiens
actagtgccaatgatgt

SEQ ID NO: 5154693 - DNA, 16 bp, Homo sapiens
actagtgcctagaaag

SEQ ID NO: 5154694 - DNA, 14 bp, Homo sapiens
actagtgctgaagc

SEQ ID NO: 5154695 - DNA, 16 bp, Homo sapiens
actagtgctgaagctt

SEQ ID NO: 5154696 - DNA, 19 bp, Homo sapiens
actagtgctgaagcttatt

SEQ ID NO: 5154697 - DNA, 20 bp, Homo sapiens
actagtggggtttcctggca

SEQ ID NO: 5154698 - DNA, 14 bp, Homo sapiens
actagtgtcaggcc

SEQ ID NO: 5154699 - DNA, 17 bp, Homo sapiens
actagtgtcaggccccc

SEQ ID NO: 5154700 - DNA, 23 bp, Homo sapiens
actagtgtcaggcccccagtggg

SEQ ID NO: 5154701 - DNA, 15 bp, Homo sapiens
actagtgtgactcct

SEQ ID NO: 5154702 - DNA, 13 bp, Homo sapiens
actagtgttctgt

SEQ ID NO: 5154703 - DNA, 20 bp, Homo sapiens
actagtgtttaagtcatttt

SEQ ID NO: 5154704 - DNA, 16 bp, Homo sapiens
actagtgtttctgcag

SEQ ID NO: 5154705 - DNA, 17 bp, Homo sapiens
actagtgtttctgcaga

SEQ ID NO: 5154706 - DNA, 13 bp, Homo sapiens
actagttacacat

SEQ ID NO: 5154707 - DNA, 17 bp, Homo sapiens
actagttattttataat

SEQ ID NO: 5154708 - DNA, 18 bp, Homo sapiens
actagttcagaggaagca

SEQ ID NO: 5154709 - DNA, 11 bp, Homo sapiens
actagttctta

SEQ ID NO: 5154710 - DNA, 21 bp, Homo sapiens
actagttgaacatctcacttt

SEQ ID NO: 5154711 - DNA, 19 bp, Homo sapiens
actagtttagttaaatgag

SEQ ID NO: 5154712 - DNA, 14 bp, Homo sapiens
actagtttatgcta

SEQ ID NO: 5154713 - DNA, 13 bp, Homo sapiens
actagtttccagt

SEQ ID NO: 5154714 - DNA, 20 bp, Homo sapiens
actagtttgattattatgtt

SEQ ID NO: 5154715 - DNA, 17 bp, Homo sapiens
actagttttagttttct

SEQ ID NO: 5154716 - DNA, 23 bp, Homo sapiens
actagtttttagaaaagaaagca

SEQ ID NO: 5154717 - DNA, 14 bp, Homo sapiens
actagtttttatag

SEQ ID NO: 5154718 - DNA, 13 bp, Homo sapiens
actataaaaaaga

SEQ ID NO: 5154719 - DNA, 18 bp, Homo sapiens
actataaaatgtcttcaa

SEQ ID NO: 5154720 - DNA, 16 bp, Homo sapiens
actataaactactgta

SEQ ID NO: 5154721 - DNA, 19 bp, Homo sapiens
actataaactactgtaatt

SEQ ID NO: 5154722 - DNA, 20 bp, Homo sapiens
actataaagaagtaacaaaa

SEQ ID NO: 5154723 - DNA, 12 bp, Homo sapiens
actataaagaga

SEQ ID NO: 5154724 - DNA, 18 bp, Homo sapiens
actataaagctgttattc

SEQ ID NO: 5154725 - DNA, 16 bp, Homo sapiens
actataaatacaaatc

SEQ ID NO: 5154726 - DNA, 18 bp, Homo sapiens
actataaatacaaatctg

SEQ ID NO: 5154727 - DNA, 19 bp, Homo sapiens
actataaatacaaatctgt

SEQ ID NO: 5154728 - DNA, 22 bp, Homo sapiens
actataaatacaaatctgtata

SEQ ID NO: 5154729 - DNA, 15 bp, Homo sapiens
actataaatatacat

SEQ ID NO: 5154730 - DNA, 19 bp, Homo sapiens
actataaatatacatataa

SEQ ID NO: 5154731 - DNA, 13 bp, Homo sapiens
actataaatgata

SEQ ID NO: 5154732 - DNA, 14 bp, Homo sapiens
actataacaaaaaa

SEQ ID NO: 5154733 - DNA, 15 bp, Homo sapiens
actataacaatcact

SEQ ID NO: 5154734 - DNA, 22 bp, Homo sapiens
actataacatatgtacataaat

SEQ ID NO: 5154735 - DNA, 14 bp, Homo sapiens
actataacattcaa

SEQ ID NO: 5154736 - DNA, 17 bp, Homo sapiens
actataacattcaattt

SEQ ID NO: 5154737 - DNA, 23 bp, Homo sapiens
actataaccatcagttactggtt

SEQ ID NO: 5154738 - DNA, 22 bp, Homo sapiens
actataactgtcatctagcccc

SEQ ID NO: 5154739 - DNA, 18 bp, Homo sapiens
actataagaactttgagc

SEQ ID NO: 5154740 - DNA, 14 bp, Homo sapiens
actataagatacaa

SEQ ID NO: 5154741 - DNA, 17 bp, Homo sapiens
actataaggctgagggc

SEQ ID NO: 5154742 - DNA, 19 bp, Homo sapiens
actataatcaaatgatttc

SEQ ID NO: 5154743 - DNA, 20 bp, Homo sapiens
actataatcaaatgatttca

SEQ ID NO: 5154744 - DNA, 22 bp, Homo sapiens
actataatcaaatgatttcata

SEQ ID NO: 5154745 - DNA, 14 bp, Homo sapiens
actataatggttgg

SEQ ID NO: 5154746 - DNA, 12 bp, Homo sapiens
actataatgtaa

SEQ ID NO: 5154747 - DNA, 14 bp, Homo sapiens
actataatgtaagc

SEQ ID NO: 5154748 - DNA, 21 bp, Homo sapiens
actataatgtaagctctactg

SEQ ID NO: 5154749 - DNA, 19 bp, Homo sapiens
actataatgtgaaatgtaa

SEQ ID NO: 5154750 - DNA, 14 bp, Homo sapiens
actataattgagaa

SEQ ID NO: 5154751 - DNA, 15 bp, Homo sapiens
actataattgtaaat

SEQ ID NO: 5154752 - DNA, 19 bp, Homo sapiens
actataattgtaaatattt

SEQ ID NO: 5154753 - DNA, 15 bp, Homo sapiens
actatacaacaaagg

SEQ ID NO: 5154754 - DNA, 15 bp, Homo sapiens
actatacaacaatgt

SEQ ID NO: 5154755 - DNA, 21 bp, Homo sapiens
actatacaattcagtactgat

SEQ ID NO: 5154756 - DNA, 13 bp, Homo sapiens
actatacagccat

SEQ ID NO: 5154757 - DNA, 12 bp, Homo sapiens
actatacatact

SEQ ID NO: 5154758 - DNA, 15 bp, Homo sapiens
actatacccgggacc

SEQ ID NO: 5154759 - DNA, 15 bp, Homo sapiens
actatacctgcttca

SEQ ID NO: 5154760 - DNA, 16 bp, Homo sapiens
actatacttgaacaaa

SEQ ID NO: 5154761 - DNA, 13 bp, Homo sapiens
actatagccattt

SEQ ID NO: 5154762 - DNA, 15 bp, Homo sapiens
actatagcccctggt

SEQ ID NO: 5154763 - DNA, 22 bp, Homo sapiens
actatagcccctggtgtgtaaa

SEQ ID NO: 5154764 - DNA, 17 bp, Homo sapiens
actatagcctaggtgac

SEQ ID NO: 5154765 - DNA, 20 bp, Homo sapiens
actatagcctaggtgacaga

SEQ ID NO: 5154766 - DNA, 20 bp, Homo sapiens
actataggcatgcgccacca

SEQ ID NO: 5154767 - DNA, 20 bp, Homo sapiens
actataggtaattaaggcag

SEQ ID NO: 5154768 - DNA, 20 bp, Homo sapiens
actatagtttaatactcaga

SEQ ID NO: 5154769 - DNA, 11 bp, Homo sapiens
actatataaag

SEQ ID NO: 5154770 - DNA, 18 bp, Homo sapiens
actatataaatgacatta

SEQ ID NO: 5154771 - DNA, 21 bp, Homo sapiens
actatataagacattaagaga

SEQ ID NO: 5154772 - DNA, 19 bp, Homo sapiens
actatataatttatttcca

SEQ ID NO: 5154773 - DNA, 21 bp, Homo sapiens
actatataatttatttccact

SEQ ID NO: 5154774 - DNA, 15 bp, Homo sapiens
actatatacatgtgt

SEQ ID NO: 5154775 - DNA, 21 bp, Homo sapiens
actatatagaatttcctgtaa

SEQ ID NO: 5154776 - DNA, 23 bp, Homo sapiens
actatatagaatttcctgtaata

SEQ ID NO: 5154777 - DNA, 17 bp, Homo sapiens
actatatagagatgttt

SEQ ID NO: 5154778 - DNA, 18 bp, Homo sapiens
actatatagagatgtttt

SEQ ID NO: 5154779 - DNA, 24 bp, Homo sapiens
actatatataaatgacctgttttc

SEQ ID NO: 5154780 - DNA, 14 bp, Homo sapiens
actatatatatatg

SEQ ID NO: 5154781 - DNA, 19 bp, Homo sapiens
actatatatatatgccttt

SEQ ID NO: 5154782 - DNA, 16 bp, Homo sapiens
actatatatatttcta

SEQ ID NO: 5154783 - DNA, 14 bp, Homo sapiens
actatatatttctt

SEQ ID NO: 5154784 - DNA, 14 bp, Homo sapiens
actatatgcataaa

SEQ ID NO: 5154785 - DNA, 22 bp, Homo sapiens
actatatgtatatctttgcact

SEQ ID NO: 5154786 - DNA, 13 bp, Homo sapiens
actatatgtatgg

SEQ ID NO: 5154787 - DNA, 15 bp, Homo sapiens
actatattaactttt

SEQ ID NO: 5154788 - DNA, 17 bp, Homo sapiens
actatattgtttgctaa

SEQ ID NO: 5154789 - DNA, 22 bp, Homo sapiens
actatattgtttgctaagcatt

SEQ ID NO: 5154790 - DNA, 16 bp, Homo sapiens
actatatttatttatg

SEQ ID NO: 5154791 - DNA, 18 bp, Homo sapiens
actatatttatttatgta

SEQ ID NO: 5154792 - DNA, 16 bp, Homo sapiens
actatatttatttttg

SEQ ID NO: 5154793 - DNA, 21 bp, Homo sapiens
actatattttcccttattact

SEQ ID NO: 5154794 - DNA, 16 bp, Homo sapiens
actatattttgtcata

SEQ ID NO: 5154795 - DNA, 20 bp, Homo sapiens
actatatttttctcaatgtt

SEQ ID NO: 5154796 - DNA, 15 bp, Homo sapiens
actatcaaaattgcc

SEQ ID NO: 5154797 - DNA, 13 bp, Homo sapiens
acgcccctgcctg

SEQ ID NO: 5154798 - DNA, 16 bp, Homo sapiens
acgcccgagagcctcg

SEQ ID NO: 5154799 - DNA, 22 bp, Homo sapiens
acgcccgagagcctcgcttttt

SEQ ID NO: 5154800 - DNA, 24 bp, Homo sapiens
acgccctactccactgccctggca

SEQ ID NO: 5154801 - DNA, 14 bp, Homo sapiens
acgccctatttcta

SEQ ID NO: 5154802 - DNA, 22 bp, Homo sapiens
acgccctatttctatgtcattt

SEQ ID NO: 5154803 - DNA, 23 bp, Homo sapiens
acgccctcccctcccctgctgca

SEQ ID NO: 5154804 - DNA, 14 bp, Homo sapiens
acgccctccctctc

SEQ ID NO: 5154805 - DNA, 17 bp, Homo sapiens
acgccctccctctccca

SEQ ID NO: 5154806 - DNA, 22 bp, Homo sapiens
acgccctccctctcccaggccc

SEQ ID NO: 5154807 - DNA, 15 bp, Homo sapiens
acgccctccctgcta

SEQ ID NO: 5154808 - DNA, 17 bp, Homo sapiens
acgccctccctgctagc

SEQ ID NO: 5154809 - DNA, 24 bp, Homo sapiens
acgccctccctgctagcacagagg

SEQ ID NO: 5154810 - DNA, 15 bp, Homo sapiens
acgccctctccccac

SEQ ID NO: 5154811 - DNA, 12 bp, Homo sapiens
acgccctgggga

SEQ ID NO: 5154812 - DNA, 22 bp, Homo sapiens
acgccctggggagtgagcttgg

SEQ ID NO: 5154813 - DNA, 21 bp, Homo sapiens
acgccctgttcacgctcaccc

SEQ ID NO: 5154814 - DNA, 19 bp, Homo sapiens
acgccctgttcccttcctg

SEQ ID NO: 5154815 - DNA, 20 bp, Homo sapiens
acgcccttcaatgctgcagg

SEQ ID NO: 5154816 - DNA, 18 bp, Homo sapiens
acgcccttggagccttcc

SEQ ID NO: 5154817 - DNA, 22 bp, Homo sapiens
acgcccttggagccttccaccg

SEQ ID NO: 5154818 - DNA, 17 bp, Homo sapiens
acgcccttggccatggg

SEQ ID NO: 5154819 - DNA, 17 bp, Homo sapiens
acgccctttcctcctca

SEQ ID NO: 5154820 - DNA, 12 bp, Homo sapiens
acgccgagtgca

SEQ ID NO: 5154821 - DNA, 19 bp, Homo sapiens
acgccgatataagccatag

SEQ ID NO: 5154822 - DNA, 22 bp, Homo sapiens
acgccgcaggtgtttggcaccc

SEQ ID NO: 5154823 - DNA, 20 bp, Homo sapiens
acgccgccctaaaagcacac

SEQ ID NO: 5154824 - DNA, 13 bp, Homo sapiens
acgccgccctcca

SEQ ID NO: 5154825 - DNA, 15 bp, Homo sapiens
acgccgccctccatc

SEQ ID NO: 5154826 - DNA, 17 bp, Homo sapiens
acgccgccctccatccg

SEQ ID NO: 5154827 - DNA, 14 bp, Homo sapiens
acgccgccttggcc

SEQ ID NO: 5154828 - DNA, 20 bp, Homo sapiens
acgccgccttggccttgcag

SEQ ID NO: 5154829 - DNA, 16 bp, Homo sapiens
acgccgcgcactcagc

SEQ ID NO: 5154830 - DNA, 12 bp, Homo sapiens
acgccggcctct

SEQ ID NO: 5154831 - DNA, 20 bp, Homo sapiens
acgccggcctctgctgcccc

SEQ ID NO: 5154832 - DNA, 17 bp, Homo sapiens
acgccggcttcctcctt

SEQ ID NO: 5154833 - DNA, 21 bp, Homo sapiens
acgccggcttcctccttccag

SEQ ID NO: 5154834 - DNA, 19 bp, Homo sapiens
acgccgggagaagccacct

SEQ ID NO: 5154835 - DNA, 21 bp, Homo sapiens
acgccgggagaagccaccttc

SEQ ID NO: 5154836 - DNA, 18 bp, Homo sapiens
acgccgggtcgcctgccc

SEQ ID NO: 5154837 - DNA, 14 bp, Homo sapiens
acgccgtaattctt

SEQ ID NO: 5154838 - DNA, 17 bp, Homo sapiens
acgccgtaattctttct

SEQ ID NO: 5154839 - DNA, 15 bp, Homo sapiens
acgcctcccactggg

SEQ ID NO: 5154840 - DNA, 22 bp, Homo sapiens
acgcctccggtgagcagggtca

SEQ ID NO: 5154841 - DNA, 17 bp, Homo sapiens
acgcctctccccacctt

SEQ ID NO: 5154842 - DNA, 18 bp, Homo sapiens
acgcctctccccaccttc

SEQ ID NO: 5154843 - DNA, 19 bp, Homo sapiens
acgcctctcctcaatgctg

SEQ ID NO: 5154844 - DNA, 19 bp, Homo sapiens
acgcctctctcagcccagg

SEQ ID NO: 5154845 - DNA, 19 bp, Homo sapiens
acgcctctggacctcggtg

SEQ ID NO: 5154846 - DNA, 18 bp, Homo sapiens
acgcctcttctgtccctg

SEQ ID NO: 5154847 - DNA, 16 bp, Homo sapiens
acgcctcttgaccagg

SEQ ID NO: 5154848 - DNA, 19 bp, Homo sapiens
acgcctcttttccctctct

SEQ ID NO: 5154849 - DNA, 20 bp, Homo sapiens
acgcctcttttccctctcta

SEQ ID NO: 5154850 - DNA, 18 bp, Homo sapiens
acgcctgagacagcacca

SEQ ID NO: 5154851 - DNA, 19 bp, Homo sapiens
acgcctgagacagcaccac

SEQ ID NO: 5154852 - DNA, 20 bp, Homo sapiens
acgcctgagacagcaccact

SEQ ID NO: 5154853 - DNA, 21 bp, Homo sapiens
acgcctgagacagcaccactg

SEQ ID NO: 5154854 - DNA, 17 bp, Homo sapiens
acgcctgagagtggcac

SEQ ID NO: 5154855 - DNA, 15 bp, Homo sapiens
acgcctgagcccagg

SEQ ID NO: 5154856 - DNA, 13 bp, Homo sapiens
acgcctgaggaac

SEQ ID NO: 5154857 - DNA, 15 bp, Homo sapiens
acgcctgaggcaatt

SEQ ID NO: 5154858 - DNA, 17 bp, Homo sapiens
acgcctgcaaacgctgc

SEQ ID NO: 5154859 - DNA, 18 bp, Homo sapiens
acgcctgcaaacgctgcc

SEQ ID NO: 5154860 - DNA, 21 bp, Homo sapiens
acgcctgcaaacgctgcctgc

SEQ ID NO: 5154861 - DNA, 22 bp, Homo sapiens
acgcctgcaaacgctgcctgcc

SEQ ID NO: 5154862 - DNA, 15 bp, Homo sapiens
acgcctgcccagcct

SEQ ID NO: 5154863 - DNA, 14 bp, Homo sapiens
acgcctgccctgcc

SEQ ID NO: 5154864 - DNA, 15 bp, Homo sapiens
acgcctgcctcccct

SEQ ID NO: 5154865 - DNA, 16 bp, Homo sapiens
acgcctgccttctggg

SEQ ID NO: 5154866 - DNA, 17 bp, Homo sapiens
acgcctgccttctgggc

SEQ ID NO: 5154867 - DNA, 21 bp, Homo sapiens
acgcctgcgatggtgctgcac

SEQ ID NO: 5154868 - DNA, 21 bp, Homo sapiens
acgcctgcttgtccctgccca

SEQ ID NO: 5154869 - DNA, 22 bp, Homo sapiens
acgcctgcttttgcaaataact

SEQ ID NO: 5154870 - DNA, 12 bp, Homo sapiens
acgcctggctcc

SEQ ID NO: 5154871 - DNA, 14 bp, Homo sapiens
acgcctggctccag

SEQ ID NO: 5154872 - DNA, 18 bp, Homo sapiens
acgcctggctccaggctc

SEQ ID NO: 5154873 - DNA, 20 bp, Homo sapiens
acgcctggctccaggctcca

SEQ ID NO: 5154874 - DNA, 18 bp, Homo sapiens
acgcctgggggtgccagg

SEQ ID NO: 5154875 - DNA, 18 bp, Homo sapiens
acgcctgtaaatgtattc

SEQ ID NO: 5154876 - DNA, 19 bp, Homo sapiens
acgcctgtaaatgtattca

SEQ ID NO: 5154877 - DNA, 18 bp, Homo sapiens
acgcctgtaatcccagca

SEQ ID NO: 5154878 - DNA, 19 bp, Homo sapiens
acgcctgtaatcccagcag

SEQ ID NO: 5154879 - DNA, 20 bp, Homo sapiens
acgcctgtcctcctggaagg

SEQ ID NO: 5154880 - DNA, 15 bp, Homo sapiens
acgccttcatgccag

SEQ ID NO: 5154881 - DNA, 14 bp, Homo sapiens
acgccttcccctca

SEQ ID NO: 5154882 - DNA, 13 bp, Homo sapiens
acgcgaaaccaat

SEQ ID NO: 5154883 - DNA, 22 bp, Homo sapiens
acgcgaaagtatcaccagggtg

SEQ ID NO: 5154884 - DNA, 20 bp, Homo sapiens
acgcgaccctcggtgcagag

SEQ ID NO: 5154885 - DNA, 16 bp, Homo sapiens
acgcgacttccacaaa

SEQ ID NO: 5154886 - DNA, 17 bp, Homo sapiens
acgcgacttctcaggac

SEQ ID NO: 5154887 - DNA, 13 bp, Homo sapiens
acgcgcacacaca

SEQ ID NO: 5154888 - DNA, 14 bp, Homo sapiens
acgcgccaccgagt

SEQ ID NO: 5154889 - DNA, 20 bp, Homo sapiens
acgcgcccccctcccagagg

SEQ ID NO: 5154890 - DNA, 16 bp, Homo sapiens
acgcgcgcacacacac

SEQ ID NO: 5154891 - DNA, 16 bp, Homo sapiens
acgcgcgcgcacacac

SEQ ID NO: 5154892 - DNA, 14 bp, Homo sapiens
acgcgctctgcatg

SEQ ID NO: 5154893 - DNA, 13 bp, Homo sapiens
acgcggaggagga

SEQ ID NO: 5154894 - DNA, 20 bp, Homo sapiens
acgcggcgggaggcccacgg

SEQ ID NO: 5154895 - DNA, 24 bp, Homo sapiens
acgcggctcccggggcagggcagc

SEQ ID NO: 5154896 - DNA, 12 bp, Homo sapiens
acgcgggagcca

SEQ ID NO: 5154897 - DNA, 19 bp, Homo sapiens
acgcggttttttcacttcc

SEQ ID NO: 5154898 - DNA, 16 bp, Homo sapiens
acgcgtccacatacac

SEQ ID NO: 5154899 - DNA, 13 bp, Homo sapiens
acgcgtctgcctg

SEQ ID NO: 5154900 - DNA, 14 bp, Homo sapiens
acgcgtctgcctgg

SEQ ID NO: 5154901 - DNA, 16 bp, Homo sapiens
acgcgtctgcctgggc

SEQ ID NO: 5154902 - DNA, 15 bp, Homo sapiens
acgcgtgattgaccc

SEQ ID NO: 5154903 - DNA, 13 bp, Homo sapiens
acgcgtgtgtgcc

SEQ ID NO: 5154904 - DNA, 18 bp, Homo sapiens
acgcgttgaaattgtaat

SEQ ID NO: 5154905 - DNA, 19 bp, Homo sapiens
acgctaataaaaatttatt

SEQ ID NO: 5154906 - DNA, 18 bp, Homo sapiens
acgctacccgggaagggg

SEQ ID NO: 5154907 - DNA, 15 bp, Homo sapiens
acgctacctctctgt

SEQ ID NO: 5154908 - DNA, 16 bp, Homo sapiens
acgctagattaaaata

SEQ ID NO: 5154909 - DNA, 16 bp, Homo sapiens
acgctatccagttgca

SEQ ID NO: 5154910 - DNA, 19 bp, Homo sapiens
acgctatgtagaatgtctt

SEQ ID NO: 5154911 - DNA, 15 bp, Homo sapiens
acgctcaaggaagga

SEQ ID NO: 5154912 - DNA, 15 bp, Homo sapiens
acgctcaatgcccag

SEQ ID NO: 5154913 - DNA, 15 bp, Homo sapiens
acgctcacccagtca

SEQ ID NO: 5154914 - DNA, 21 bp, Homo sapiens
acgctcacccagtcacctccc

SEQ ID NO: 5154915 - DNA, 21 bp, Homo sapiens
acgctcagccccaggccagct

SEQ ID NO: 5154916 - DNA, 23 bp, Homo sapiens
acgctcagccccaggccagctgc

SEQ ID NO: 5154917 - DNA, 17 bp, Homo sapiens
acgctcagtgcccgttt

SEQ ID NO: 5154918 - DNA, 13 bp, Homo sapiens
acgctcagtgggg

SEQ ID NO: 5154919 - DNA, 15 bp, Homo sapiens
acgctcatctctgga

SEQ ID NO: 5154920 - DNA, 16 bp, Homo sapiens
acgctcatctctggaa

SEQ ID NO: 5154921 - DNA, 23 bp, Homo sapiens
acgctcatctctggaaggggcag

SEQ ID NO: 5154922 - DNA, 14 bp, Homo sapiens
acgctcatcttgca

SEQ ID NO: 5154923 - DNA, 19 bp, Homo sapiens
acgctcatgtcctgtcctg

SEQ ID NO: 5154924 - DNA, 21 bp, Homo sapiens
acgctcatgtcctgtcctggt

SEQ ID NO: 5154925 - DNA, 11 bp, Homo sapiens
acgctccagct

SEQ ID NO: 5154926 - DNA, 18 bp, Homo sapiens
acgctccccgcctgttcc

SEQ ID NO: 5154927 - DNA, 19 bp, Homo sapiens
acgctcccctgagaggttt

SEQ ID NO: 5154928 - DNA, 20 bp, Homo sapiens
acgctcccctgagaggtttc

SEQ ID NO: 5154929 - DNA, 17 bp, Homo sapiens
acgctccctccccctgc

SEQ ID NO: 5154930 - DNA, 22 bp, Homo sapiens
acgctccctgacttctcccccg

SEQ ID NO: 5154931 - DNA, 16 bp, Homo sapiens
acgctcctctgtttgt

SEQ ID NO: 5154932 - DNA, 13 bp, Homo sapiens
acgctcctgccct

SEQ ID NO: 5154933 - DNA, 12 bp, Homo sapiens
acgctcctgtct

SEQ ID NO: 5154934 - DNA, 22 bp, Homo sapiens
acgctcctgtctccaagaatgt

SEQ ID NO: 5154935 - DNA, 13 bp, Homo sapiens
acgctcctttgtg

SEQ ID NO: 5154936 - DNA, 22 bp, Homo sapiens
acgctcctttgtgtgtgtgtca

SEQ ID NO: 5154937 - DNA, 15 bp, Homo sapiens
acgctcgcgggcagc

SEQ ID NO: 5154938 - DNA, 15 bp, Homo sapiens
acgctcgctgccatc

SEQ ID NO: 5154939 - DNA, 22 bp, Homo sapiens
acgctctaaggcaggatgtggc

SEQ ID NO: 5154940 - DNA, 15 bp, Homo sapiens
acgctctaccctgca

SEQ ID NO: 5154941 - DNA, 11 bp, Homo sapiens
acgctctcctc

SEQ ID NO: 5154942 - DNA, 21 bp, Homo sapiens
acgctctcctcgagccctccc

SEQ ID NO: 5154943 - DNA, 15 bp, Homo sapiens
acgctctctactctg

SEQ ID NO: 5154944 - DNA, 18 bp, Homo sapiens
acgctctctactctgctt

SEQ ID NO: 5154945 - DNA, 16 bp, Homo sapiens
acgctctctggccttc

SEQ ID NO: 5154946 - DNA, 13 bp, Homo sapiens
acgctctgcacct

SEQ ID NO: 5154947 - DNA, 19 bp, Homo sapiens
acgctctgcaccttctgac

SEQ ID NO: 5154948 - DNA, 11 bp, Homo sapiens
acgctctgctg

SEQ ID NO: 5154949 - DNA, 12 bp, Homo sapiens
acgctctggaca

SEQ ID NO: 5154950 - DNA, 12 bp, Homo sapiens
acgctcttagct

SEQ ID NO: 5154951 - DNA, 22 bp, Homo sapiens
acgctcttgaggaagcccaggc

SEQ ID NO: 5154952 - DNA, 23 bp, Homo sapiens
acgctgaactgacaatgaaggga

SEQ ID NO: 5154953 - DNA, 14 bp, Homo sapiens
acgctgaatgagaa

SEQ ID NO: 5154954 - DNA, 16 bp, Homo sapiens
acgctgacagcctcct

SEQ ID NO: 5154955 - DNA, 23 bp, Homo sapiens
acgctgaccatgcgtcaggggcc

SEQ ID NO: 5154956 - DNA, 23 bp, Homo sapiens
acgctgagatacaagtcatccat

SEQ ID NO: 5154957 - DNA, 14 bp, Homo sapiens
acgctgagccacct

SEQ ID NO: 5154958 - DNA, 17 bp, Homo sapiens
acgctgagccacctgcc

SEQ ID NO: 5154959 - DNA, 16 bp, Homo sapiens
acgctgatacataact

SEQ ID NO: 5154960 - DNA, 14 bp, Homo sapiens
acgctgatcattgg

SEQ ID NO: 5154961 - DNA, 21 bp, Homo sapiens
acgctgattcctaaggcccag

SEQ ID NO: 5154962 - DNA, 22 bp, Homo sapiens
acgctgattcctaaggcccagc

SEQ ID NO: 5154963 - DNA, 13 bp, Homo sapiens
acgctgcacttga

SEQ ID NO: 5154964 - DNA, 18 bp, Homo sapiens
acgctgccatttccctga

SEQ ID NO: 5154965 - DNA, 14 bp, Homo sapiens
acgctgcccaggct

SEQ ID NO: 5154966 - DNA, 15 bp, Homo sapiens
acgctgcccaggctc

SEQ ID NO: 5154967 - DNA, 21 bp, Homo sapiens
acgctgcccaggggcttcaga

SEQ ID NO: 5154968 - DNA, 23 bp, Homo sapiens
acgctgccgctgccgctgcacca

SEQ ID NO: 5154969 - DNA, 23 bp, Homo sapiens
acgctgccgggagactgccagtg

SEQ ID NO: 5154970 - DNA, 19 bp, Homo sapiens
acgctgcctcctcagcagc

SEQ ID NO: 5154971 - DNA, 20 bp, Homo sapiens
acgctgcctctcattggcac

SEQ ID NO: 5154972 - DNA, 13 bp, Homo sapiens
acgctgcctggtc

SEQ ID NO: 5154973 - DNA, 14 bp, Homo sapiens
acgctgcctggtct

SEQ ID NO: 5154974 - DNA, 19 bp, Homo sapiens
acgctgcctggtctgtctg

SEQ ID NO: 5154975 - DNA, 20 bp, Homo sapiens
acgctgcctggtctgtctgg

SEQ ID NO: 5154976 - DNA, 15 bp, Homo sapiens
actatcaactacaaa

SEQ ID NO: 5154977 - DNA, 17 bp, Homo sapiens
actatcaatatttaagt

SEQ ID NO: 5154978 - DNA, 15 bp, Homo sapiens
actatcacacatgaa

SEQ ID NO: 5154979 - DNA, 11 bp, Homo sapiens
actatcacata

SEQ ID NO: 5154980 - DNA, 13 bp, Homo sapiens
actatcacataca

SEQ ID NO: 5154981 - DNA, 15 bp, Homo sapiens
actatcacatacaat

SEQ ID NO: 5154982 - DNA, 17 bp, Homo sapiens
actatcacatacaattt

SEQ ID NO: 5154983 - DNA, 19 bp, Homo sapiens
actatcaggagtccactgc

SEQ ID NO: 5154984 - DNA, 19 bp, Homo sapiens
actatcaggtaataaaagc

SEQ ID NO: 5154985 - DNA, 14 bp, Homo sapiens
actatcataaaatc

SEQ ID NO: 5154986 - DNA, 18 bp, Homo sapiens
actatcatagttaacata

SEQ ID NO: 5154987 - DNA, 22 bp, Homo sapiens
actatcatgtcaaacgtgaaaa

SEQ ID NO: 5154988 - DNA, 15 bp, Homo sapiens
actatcattaacatt

SEQ ID NO: 5154989 - DNA, 17 bp, Homo sapiens
actatcatttaataata

SEQ ID NO: 5154990 - DNA, 21 bp, Homo sapiens
actatccaacttatatttctg

SEQ ID NO: 5154991 - DNA, 23 bp, Homo sapiens
actatccaatgaatgatcattga

SEQ ID NO: 5154992 - DNA, 18 bp, Homo sapiens
actatccatgcaccaaac

SEQ ID NO: 5154993 - DNA, 20 bp, Homo sapiens
actatcccaacagtcatgtt

SEQ ID NO: 5154994 - DNA, 17 bp, Homo sapiens
actatcccaatcaaaga

SEQ ID NO: 5154995 - DNA, 22 bp, Homo sapiens
actatcccaatcaaagaattac

SEQ ID NO: 5154996 - DNA, 23 bp, Homo sapiens
actatccccaaactcctttactg

SEQ ID NO: 5154997 - DNA, 16 bp, Homo sapiens
actatcccggctgccc

SEQ ID NO: 5154998 - DNA, 19 bp, Homo sapiens
actatccctgcacataaac

SEQ ID NO: 5154999 - DNA, 15 bp, Homo sapiens
actatcctgtaaata

SEQ ID NO: 5155000 - DNA, 14 bp, Homo sapiens
actatctacaaaaa

SEQ ID NO: 5155001 - DNA, 20 bp, Homo sapiens
actatctacaaaatttctga

SEQ ID NO: 5155002 - DNA, 15 bp, Homo sapiens
actatctactctcct

SEQ ID NO: 5155003 - DNA, 16 bp, Homo sapiens
actatctcacttccag

SEQ ID NO: 5155004 - DNA, 20 bp, Homo sapiens
actatctgaaccattaaagt

SEQ ID NO: 5155005 - DNA, 21 bp, Homo sapiens
actatctgaagatttccattt

SEQ ID NO: 5155006 - DNA, 17 bp, Homo sapiens
actatctgcattatcta

SEQ ID NO: 5155007 - DNA, 13 bp, Homo sapiens
actatctgctttt

SEQ ID NO: 5155008 - DNA, 14 bp, Homo sapiens
actatctgtctggt

SEQ ID NO: 5155009 - DNA, 15 bp, Homo sapiens
actatctgttgaaaa

SEQ ID NO: 5155010 - DNA, 16 bp, Homo sapiens
actatctgttgaaaag

SEQ ID NO: 5155011 - DNA, 13 bp, Homo sapiens
actatcttctcta

SEQ ID NO: 5155012 - DNA, 21 bp, Homo sapiens
actatcttctctatattttta

SEQ ID NO: 5155013 - DNA, 19 bp, Homo sapiens
actatcttcttcaaataca

SEQ ID NO: 5155014 - DNA, 13 bp, Homo sapiens
actatcttctttg

SEQ ID NO: 5155015 - DNA, 18 bp, Homo sapiens
actatcttctttggactt

SEQ ID NO: 5155016 - DNA, 14 bp, Homo sapiens
actatctttctgat

SEQ ID NO: 5155017 - DNA, 22 bp, Homo sapiens
actatctttttgcttacagttt

SEQ ID NO: 5155018 - DNA, 20 bp, Homo sapiens
actatgaaaagctagaattg

SEQ ID NO: 5155019 - DNA, 16 bp, Homo sapiens
actatgaaaatgctgg

SEQ ID NO: 5155020 - DNA, 18 bp, Homo sapiens
actatgaaaatgctggct

SEQ ID NO: 5155021 - DNA, 18 bp, Homo sapiens
actatgaactacaaagct

SEQ ID NO: 5155022 - DNA, 18 bp, Homo sapiens
actatgaacttctctcag

SEQ ID NO: 5155023 - DNA, 19 bp, Homo sapiens
actatgaacttctctcaga

SEQ ID NO: 5155024 - DNA, 21 bp, Homo sapiens
actatgaacttctctcagact

SEQ ID NO: 5155025 - DNA, 15 bp, Homo sapiens
actatgaacttggat

SEQ ID NO: 5155026 - DNA, 17 bp, Homo sapiens
actatgaagacttaaaa

SEQ ID NO: 5155027 - DNA, 23 bp, Homo sapiens
actatgaatgggcaaaactgaat

SEQ ID NO: 5155028 - DNA, 18 bp, Homo sapiens
actatgacagatatattt

SEQ ID NO: 5155029 - DNA, 15 bp, Homo sapiens
actatgactggagta

SEQ ID NO: 5155030 - DNA, 19 bp, Homo sapiens
actatgagaatgtagaagt

SEQ ID NO: 5155031 - DNA, 20 bp, Homo sapiens
actatgagttcacatgtgcc

SEQ ID NO: 5155032 - DNA, 22 bp, Homo sapiens
actatgagttcacatgtgccct

SEQ ID NO: 5155033 - DNA, 21 bp, Homo sapiens
actatgataaagttgtaaata

SEQ ID NO: 5155034 - DNA, 14 bp, Homo sapiens
actatgatctcagg

SEQ ID NO: 5155035 - DNA, 15 bp, Homo sapiens
actatgatctcagga

SEQ ID NO: 5155036 - DNA, 17 bp, Homo sapiens
actatgatgtggagaaa

SEQ ID NO: 5155037 - DNA, 14 bp, Homo sapiens
actatgatttattt

SEQ ID NO: 5155038 - DNA, 12 bp, Homo sapiens
actatgatttct

SEQ ID NO: 5155039 - DNA, 15 bp, Homo sapiens
actatgatttggaaa

SEQ ID NO: 5155040 - DNA, 19 bp, Homo sapiens
actatgcacagattaaact

SEQ ID NO: 5155041 - DNA, 19 bp, Homo sapiens
actatgcacctataaatac

SEQ ID NO: 5155042 - DNA, 17 bp, Homo sapiens
actatgcagaggcctgg

SEQ ID NO: 5155043 - DNA, 16 bp, Homo sapiens
actatgcagtatctct

SEQ ID NO: 5155044 - DNA, 21 bp, Homo sapiens
actatgcatggtgccccagga

SEQ ID NO: 5155045 - DNA, 24 bp, Homo sapiens
actatgcatggtgccccaggacca

SEQ ID NO: 5155046 - DNA, 22 bp, Homo sapiens
actatgccgtgtagtttctggt

SEQ ID NO: 5155047 - DNA, 19 bp, Homo sapiens
actatgcctgtgtcttctc

SEQ ID NO: 5155048 - DNA, 21 bp, Homo sapiens
actatgcctgttgatctatgg

SEQ ID NO: 5155049 - DNA, 21 bp, Homo sapiens
actatgctattaaaaaaaaag

SEQ ID NO: 5155050 - DNA, 13 bp, Homo sapiens
actatgctgaaga

SEQ ID NO: 5155051 - DNA, 14 bp, Homo sapiens
actatggaaaatca

SEQ ID NO: 5155052 - DNA, 17 bp, Homo sapiens
actatggaaaatcagct

SEQ ID NO: 5155053 - DNA, 17 bp, Homo sapiens
actatggaatagattat

SEQ ID NO: 5155054 - DNA, 19 bp, Homo sapiens
actatggagtcttgtgaaa

SEQ ID NO: 5155055 - DNA, 20 bp, Homo sapiens
actatggagtcttgtgaaag

SEQ ID NO: 5155056 - DNA, 24 bp, Homo sapiens
actatggataaactaaacacgtga

SEQ ID NO: 5155057 - DNA, 21 bp, Homo sapiens
actatggctgatttatttcta

SEQ ID NO: 5155058 - DNA, 17 bp, Homo sapiens
actatggctgtattttt

SEQ ID NO: 5155059 - DNA, 14 bp, Homo sapiens
actatggctgttta

SEQ ID NO: 5155060 - DNA, 15 bp, Homo sapiens
actatgggatgagaa

SEQ ID NO: 5155061 - DNA, 13 bp, Homo sapiens
actatggggtggg

SEQ ID NO: 5155062 - DNA, 21 bp, Homo sapiens
actatggtatgctggccagca

SEQ ID NO: 5155063 - DNA, 15 bp, Homo sapiens
actatggtatttgag

SEQ ID NO: 5155064 - DNA, 16 bp, Homo sapiens
actatggtatttgagt

SEQ ID NO: 5155065 - DNA, 20 bp, Homo sapiens
actatggtgccaatggaacc

SEQ ID NO: 5155066 - DNA, 21 bp, Homo sapiens
actatggtgccaatggaacct

SEQ ID NO: 5155067 - DNA, 11 bp, Homo sapiens
actatgtaaac

SEQ ID NO: 5155068 - DNA, 12 bp, Homo sapiens
actatgtaaact

SEQ ID NO: 5155069 - DNA, 14 bp, Homo sapiens
actatgtaaactac

SEQ ID NO: 5155070 - DNA, 14 bp, Homo sapiens
actatgtaacatgt

SEQ ID NO: 5155071 - DNA, 16 bp, Homo sapiens
actatgtaagggcttt

SEQ ID NO: 5155072 - DNA, 18 bp, Homo sapiens
actatgtacaatatttta

SEQ ID NO: 5155073 - DNA, 21 bp, Homo sapiens
actatgtacaatattttaagc

SEQ ID NO: 5155074 - DNA, 15 bp, Homo sapiens
actatgtatatacat

SEQ ID NO: 5155075 - DNA, 23 bp, Homo sapiens
actatgtatgtatgtattattat

SEQ ID NO: 5155076 - DNA, 14 bp, Homo sapiens
actatgtattaatt

SEQ ID NO: 5155077 - DNA, 18 bp, Homo sapiens
actatgtcgatgcacagt

SEQ ID NO: 5155078 - DNA, 18 bp, Homo sapiens
actatgtctagagcctct

SEQ ID NO: 5155079 - DNA, 19 bp, Homo sapiens
actatgtctgaacatagaa

SEQ ID NO: 5155080 - DNA, 14 bp, Homo sapiens
actatgtgatgtta

SEQ ID NO: 5155081 - DNA, 20 bp, Homo sapiens
actatgtggctgaaaatgca

SEQ ID NO: 5155082 - DNA, 17 bp, Homo sapiens
actatgtgtgttgtttc

SEQ ID NO: 5155083 - DNA, 14 bp, Homo sapiens
actatgtgtttttc

SEQ ID NO: 5155084 - DNA, 13 bp, Homo sapiens
actatgttcctaa

SEQ ID NO: 5155085 - DNA, 13 bp, Homo sapiens
actatgttgataa

SEQ ID NO: 5155086 - DNA, 14 bp, Homo sapiens
actatgttgcccag

SEQ ID NO: 5155087 - DNA, 20 bp, Homo sapiens
actatgttgcccaggcaggt

SEQ ID NO: 5155088 - DNA, 23 bp, Homo sapiens
actatgttgcccaggcaggtctt

SEQ ID NO: 5155089 - DNA, 20 bp, Homo sapiens
actatgtttttgttcagttt

SEQ ID NO: 5155090 - DNA, 17 bp, Homo sapiens
actattaaaatattttg

SEQ ID NO: 5155091 - DNA, 13 bp, Homo sapiens
actattaaagtaa

SEQ ID NO: 5155092 - DNA, 13 bp, Homo sapiens
actattaaccttt

SEQ ID NO: 5155093 - DNA, 15 bp, Homo sapiens
actattaagatatct

SEQ ID NO: 5155094 - DNA, 20 bp, Homo sapiens
actattaagcagtaaaaact

SEQ ID NO: 5155095 - DNA, 20 bp, Homo sapiens
actattaaggatgtagcttt

SEQ ID NO: 5155096 - DNA, 13 bp, Homo sapiens
actattaatcttt

SEQ ID NO: 5155097 - DNA, 14 bp, Homo sapiens
actattaattccaa

SEQ ID NO: 5155098 - DNA, 15 bp, Homo sapiens
actattaattccaag

SEQ ID NO: 5155099 - DNA, 13 bp, Homo sapiens
actattacagtat

SEQ ID NO: 5155100 - DNA, 15 bp, Homo sapiens
actattacagtattg

SEQ ID NO: 5155101 - DNA, 13 bp, Homo sapiens
actattacagtgt

SEQ ID NO: 5155102 - DNA, 21 bp, Homo sapiens
actattaccaccacctgctca

SEQ ID NO: 5155103 - DNA, 16 bp, Homo sapiens
actattataaggccat

SEQ ID NO: 5155104 - DNA, 16 bp, Homo sapiens
actattataagtgctt

SEQ ID NO: 5155105 - DNA, 21 bp, Homo sapiens
actattcaaacagtctcagga

SEQ ID NO: 5155106 - DNA, 17 bp, Homo sapiens
actattcaatgcaatgc

SEQ ID NO: 5155107 - DNA, 20 bp, Homo sapiens
actattcagaacttgtaact

SEQ ID NO: 5155108 - DNA, 19 bp, Homo sapiens
actattcagaagacacaga

SEQ ID NO: 5155109 - DNA, 15 bp, Homo sapiens
actattcagaggaaa

SEQ ID NO: 5155110 - DNA, 20 bp, Homo sapiens
actattcatagaagggctag

SEQ ID NO: 5155111 - DNA, 18 bp, Homo sapiens
actattcatcaatgaaga

SEQ ID NO: 5155112 - DNA, 13 bp, Homo sapiens
actattcatgttt

SEQ ID NO: 5155113 - DNA, 20 bp, Homo sapiens
actattcattaaatgtttga

SEQ ID NO: 5155114 - DNA, 17 bp, Homo sapiens
actattccatgttttaa

SEQ ID NO: 5155115 - DNA, 21 bp, Homo sapiens
actattccccagcagggtctt

SEQ ID NO: 5155116 - DNA, 20 bp, Homo sapiens
actattccctaggacaagga

SEQ ID NO: 5155117 - DNA, 18 bp, Homo sapiens
actattccttttctgtat

SEQ ID NO: 5155118 - DNA, 18 bp, Homo sapiens
actattcgaatgaaaaga

SEQ ID NO: 5155119 - DNA, 23 bp, Homo sapiens
actattctttgtattaccaaagc

SEQ ID NO: 5155120 - DNA, 14 bp, Homo sapiens
actattgaaaaata

SEQ ID NO: 5155121 - DNA, 22 bp, Homo sapiens
actattgagccttgcatgtact

SEQ ID NO: 5155122 - DNA, 21 bp, Homo sapiens
actattgctatcttttctgga

SEQ ID NO: 5155123 - DNA, 19 bp, Homo sapiens
actattgctcataatgact

SEQ ID NO: 5155124 - DNA, 19 bp, Homo sapiens
actattgcttaaacaaaac

SEQ ID NO: 5155125 - DNA, 21 bp, Homo sapiens
actattggaatctgatatact

SEQ ID NO: 5155126 - DNA, 17 bp, Homo sapiens
actattggacagacaca

SEQ ID NO: 5155127 - DNA, 15 bp, Homo sapiens
actattgtgccaact

SEQ ID NO: 5155128 - DNA, 21 bp, Homo sapiens
actattgtgccaactgccagg

SEQ ID NO: 5155129 - DNA, 23 bp, Homo sapiens
actattgtgttttttttttttgg

SEQ ID NO: 5155130 - DNA, 14 bp, Homo sapiens
actattgttacatt

SEQ ID NO: 5155131 - DNA, 20 bp, Homo sapiens
actattgtttaaaaacagga

SEQ ID NO: 5155132 - DNA, 17 bp, Homo sapiens
actatttaaaataaaga

SEQ ID NO: 5155133 - DNA, 18 bp, Homo sapiens
actatttaaaataaagag

SEQ ID NO: 5155134 - DNA, 14 bp, Homo sapiens
actatttaaactta

SEQ ID NO: 5155135 - DNA, 10 bp, Homo sapiens
actatttaac

SEQ ID NO: 5155136 - DNA, 18 bp, Homo sapiens
actatttaacttgagggt

SEQ ID NO: 5155137 - DNA, 22 bp, Homo sapiens
actatttaagagaacaagcaaa

SEQ ID NO: 5155138 - DNA, 18 bp, Homo sapiens
actatttaagatgtgaaa

SEQ ID NO: 5155139 - DNA, 20 bp, Homo sapiens
actatttaagatgtgaaaat

SEQ ID NO: 5155140 - DNA, 21 bp, Homo sapiens
actatttaagatgtgaaaatt

SEQ ID NO: 5155141 - DNA, 15 bp, Homo sapiens
actatttagataaca

SEQ ID NO: 5155142 - DNA, 12 bp, Homo sapiens
actatttatctg

SEQ ID NO: 5155143 - DNA, 21 bp, Homo sapiens
actatttattaaaaacatgac

SEQ ID NO: 5155144 - DNA, 18 bp, Homo sapiens
actatttattaaaaccat

SEQ ID NO: 5155145 - DNA, 20 bp, Homo sapiens
actatttattgactctgggt

SEQ ID NO: 5155146 - DNA, 17 bp, Homo sapiens
actatttatttacaaat

SEQ ID NO: 5155147 - DNA, 15 bp, Homo sapiens
actatttcaataagt

SEQ ID NO: 5155148 - DNA, 12 bp, Homo sapiens
actatttcacat

SEQ ID NO: 5155149 - DNA, 22 bp, Homo sapiens
actatttctgggtcttttgcta

SEQ ID NO: 5155150 - DNA, 20 bp, Homo sapiens
actatttcttaatgtaacat

SEQ ID NO: 5155151 - DNA, 12 bp, Homo sapiens
actatttcttca

SEQ ID NO: 5155152 - DNA, 14 bp, Homo sapiens
actatttcttcaga

SEQ ID NO: 5155153 - DNA, 17 bp, Homo sapiens
actatttctttcatcag

SEQ ID NO: 5155154 - DNA, 18 bp, Homo sapiens
actatttgaaaaaagaag

SEQ ID NO: 5155155 - DNA, 19 bp, Homo sapiens
actatttgcttatttaata

SEQ ID NO: 5155156 - DNA, 23 bp, Homo sapiens
actatttgcttatttaataaaga

SEQ ID NO: 5155157 - DNA, 21 bp, Homo sapiens
actatttgggctctgaaataa

SEQ ID NO: 5155158 - DNA, 18 bp, Homo sapiens
actatttgtctttcagga

SEQ ID NO: 5155159 - DNA, 11 bp, Homo sapiens
actatttgtga

SEQ ID NO: 5155160 - DNA, 21 bp, Homo sapiens
actattttaatttgtattgaa

SEQ ID NO: 5155161 - DNA, 13 bp, Homo sapiens
actattttatgca

SEQ ID NO: 5155162 - DNA, 18 bp, Homo sapiens
actattttattaaaaata

SEQ ID NO: 5155163 - DNA, 16 bp, Homo sapiens
actattttcagaatct

SEQ ID NO: 5155164 - DNA, 19 bp, Homo sapiens
actattttcagaatctgaa

SEQ ID NO: 5155165 - DNA, 15 bp, Homo sapiens
actattttcattttt

SEQ ID NO: 5155166 - DNA, 14 bp, Homo sapiens
actattttctacaa

SEQ ID NO: 5155167 - DNA, 13 bp, Homo sapiens
actattttgaaga

SEQ ID NO: 5155168 - DNA, 19 bp, Homo sapiens
actattttgaagaaaacac

SEQ ID NO: 5155169 - DNA, 23 bp, Homo sapiens
actattttgttttaatctacttt

SEQ ID NO: 5155170 - DNA, 22 bp, Homo sapiens
actatttttattttcttatgta

SEQ ID NO: 5155171 - DNA, 18 bp, Homo sapiens
actatttttcagaatctc

SEQ ID NO: 5155172 - DNA, 14 bp, Homo sapiens
actatttttctatg

SEQ ID NO: 5155173 - DNA, 14 bp, Homo sapiens
actatttttgtaaa

SEQ ID NO: 5155174 - DNA, 19 bp, Homo sapiens
actatttttgtaaaagaca

SEQ ID NO: 5155175 - DNA, 22 bp, Homo sapiens
actatttttgtttttattaaaa

SEQ ID NO: 5155176 - DNA, 16 bp, Homo sapiens
actattttttaaaaat

SEQ ID NO: 5155177 - DNA, 19 bp, Homo sapiens
actatttttttgttgctgt

SEQ ID NO: 5155178 - DNA, 14 bp, Homo sapiens
actcaaaaataagt

SEQ ID NO: 5155179 - DNA, 20 bp, Homo sapiens
actcaaaaccatctctcttc

SEQ ID NO: 5155180 - DNA, 20 bp, Homo sapiens
actcaaaacccatctgggct

SEQ ID NO: 5155181 - DNA, 13 bp, Homo sapiens
actcaaaacctgg

SEQ ID NO: 5155182 - DNA, 20 bp, Homo sapiens
actcaaaactcttgaaatta

SEQ ID NO: 5155183 - DNA, 17 bp, Homo sapiens
actcaaaagacaaacat

SEQ ID NO: 5155184 - DNA, 23 bp, Homo sapiens
actcaaaaggagaactgtgctct

SEQ ID NO: 5155185 - DNA, 15 bp, Homo sapiens
actcaaaatatttgt

SEQ ID NO: 5155186 - DNA, 19 bp, Homo sapiens
actcaaaatatttgtacat

SEQ ID NO: 5155187 - DNA, 16 bp, Homo sapiens
actcaaaatctgtcat

SEQ ID NO: 5155188 - DNA, 12 bp, Homo sapiens
actcaaaatgac

SEQ ID NO: 5155189 - DNA, 14 bp, Homo sapiens
actcaaaatgacag

SEQ ID NO: 5155190 - DNA, 13 bp, Homo sapiens
actcaaacacaga

SEQ ID NO: 5155191 - DNA, 15 bp, Homo sapiens
actcaaacggaggaa

SEQ ID NO: 5155192 - DNA, 16 bp, Homo sapiens
actcaaacttctggct

SEQ ID NO: 5155193 - DNA, 22 bp, Homo sapiens
actcaaacttctggctccctct

SEQ ID NO: 5155194 - DNA, 21 bp, Homo sapiens
actcaaagacttcctctggct

SEQ ID NO: 5155195 - DNA, 22 bp, Homo sapiens
actcaaagacttcctctggctc

SEQ ID NO: 5155196 - DNA, 20 bp, Homo sapiens
actcaaagaggtaactgagg

SEQ ID NO: 5155197 - DNA, 16 bp, Homo sapiens
actcaaagatgaaagc

SEQ ID NO: 5155198 - DNA, 21 bp, Homo sapiens
actcaaagatgaaagctgttt

SEQ ID NO: 5155199 - DNA, 19 bp, Homo sapiens
actcaaagcaaaagtgctg

SEQ ID NO: 5155200 - DNA, 20 bp, Homo sapiens
actcaaagcaagctcttctc

SEQ ID NO: 5155201 - DNA, 14 bp, Homo sapiens
actcaaagcccaga

SEQ ID NO: 5155202 - DNA, 20 bp, Homo sapiens
actcaaagttaacctacctg

SEQ ID NO: 5155203 - DNA, 14 bp, Homo sapiens
actcaaatgagtaa

SEQ ID NO: 5155204 - DNA, 21 bp, Homo sapiens
actcaaatgctcagaccagct

SEQ ID NO: 5155205 - DNA, 22 bp, Homo sapiens
actcaaatgcttggcttctcat

SEQ ID NO: 5155206 - DNA, 22 bp, Homo sapiens
actcaaatggggccagatccag

SEQ ID NO: 5155207 - DNA, 12 bp, Homo sapiens
actcaaatggtg

SEQ ID NO: 5155208 - DNA, 19 bp, Homo sapiens
actcaacaataaagactga

SEQ ID NO: 5155209 - DNA, 23 bp, Homo sapiens
actcaacagagaggaccaacatc

SEQ ID NO: 5155210 - DNA, 17 bp, Homo sapiens
actcaacattactgtta

SEQ ID NO: 5155211 - DNA, 15 bp, Homo sapiens
actcaaccaaatggt

SEQ ID NO: 5155212 - DNA, 21 bp, Homo sapiens
actcaaccaaatggtacaaaa

SEQ ID NO: 5155213 - DNA, 14 bp, Homo sapiens
actcaaccagagtc

SEQ ID NO: 5155214 - DNA, 19 bp, Homo sapiens
actcaacccattgttgtca

SEQ ID NO: 5155215 - DNA, 13 bp, Homo sapiens
actcaactaattt

SEQ ID NO: 5155216 - DNA, 15 bp, Homo sapiens
actcaagaagcaggc

SEQ ID NO: 5155217 - DNA, 16 bp, Homo sapiens
actcaagaagcaggct

SEQ ID NO: 5155218 - DNA, 19 bp, Homo sapiens
actcaagaagcaggctaca

SEQ ID NO: 5155219 - DNA, 23 bp, Homo sapiens
actcaagaagtgaagaatgcaca

SEQ ID NO: 5155220 - DNA, 19 bp, Homo sapiens
actcaagaatttctaaact

SEQ ID NO: 5155221 - DNA, 17 bp, Homo sapiens
actcaagacttccagag

SEQ ID NO: 5155222 - DNA, 18 bp, Homo sapiens
actcaagattcccaggag

SEQ ID NO: 5155223 - DNA, 15 bp, Homo sapiens
actcaagcactgata

SEQ ID NO: 5155224 - DNA, 17 bp, Homo sapiens
actcaagccaagcagcc

SEQ ID NO: 5155225 - DNA, 19 bp, Homo sapiens
actcaagccaagcagccaa

SEQ ID NO: 5155226 - DNA, 18 bp, Homo sapiens
actcaagcgggtggctct

SEQ ID NO: 5155227 - DNA, 13 bp, Homo sapiens
actcaagctgcgt

SEQ ID NO: 5155228 - DNA, 17 bp, Homo sapiens
actcaaggacaggagcc

SEQ ID NO: 5155229 - DNA, 23 bp, Homo sapiens
actcaaggccaataataaagaca

SEQ ID NO: 5155230 - DNA, 19 bp, Homo sapiens
actcaaggttcccagagat

SEQ ID NO: 5155231 - DNA, 20 bp, Homo sapiens
actcaaggttcccagagatg

SEQ ID NO: 5155232 - DNA, 14 bp, Homo sapiens
actcaagtgtagaa

SEQ ID NO: 5155233 - DNA, 17 bp, Homo sapiens
actcaagtgtcacctcc

SEQ ID NO: 5155234 - DNA, 23 bp, Homo sapiens
actcaagtgtcacctccttcccc

SEQ ID NO: 5155235 - DNA, 18 bp, Homo sapiens
actcaagttgtttaactg

SEQ ID NO: 5155236 - DNA, 20 bp, Homo sapiens
actcaagttgtttaactgtg

SEQ ID NO: 5155237 - DNA, 21 bp, Homo sapiens
actcaataaacagtcactgga

SEQ ID NO: 5155238 - DNA, 12 bp, Homo sapiens
actcaataaatt

SEQ ID NO: 5155239 - DNA, 19 bp, Homo sapiens
actcaataaattgcaacat

SEQ ID NO: 5155240 - DNA, 22 bp, Homo sapiens
actcaataaattgcaacatatt

SEQ ID NO: 5155241 - DNA, 12 bp, Homo sapiens
actcaatatttt

SEQ ID NO: 5155242 - DNA, 19 bp, Homo sapiens
actcaatctaaattaaaaa

SEQ ID NO: 5155243 - DNA, 22 bp, Homo sapiens
actcaatctaaattaaaaaaga

SEQ ID NO: 5155244 - DNA, 23 bp, Homo sapiens
actcaatctccccttgcactaaa

SEQ ID NO: 5155245 - DNA, 22 bp, Homo sapiens
actcaatgaaatatgtgaagcc

SEQ ID NO: 5155246 - DNA, 16 bp, Homo sapiens
actcaatgcactgaca

SEQ ID NO: 5155247 - DNA, 18 bp, Homo sapiens
actcaatgctttatttgt

SEQ ID NO: 5155248 - DNA, 22 bp, Homo sapiens
actcaatgctttatttgtaaat

SEQ ID NO: 5155249 - DNA, 24 bp, Homo sapiens
actcaatggagtatgtctgatgga

SEQ ID NO: 5155250 - DNA, 16 bp, Homo sapiens
actcaatggatttgat

SEQ ID NO: 5155251 - DNA, 23 bp, Homo sapiens
actcaatgggagaatcagcagaa

SEQ ID NO: 5155252 - DNA, 19 bp, Homo sapiens
actcaatgtgtgccgagcc

SEQ ID NO: 5155253 - DNA, 16 bp, Homo sapiens
actcaatgtttctgga

SEQ ID NO: 5155254 - DNA, 18 bp, Homo sapiens
actcacaagaagaccaga

SEQ ID NO: 5155255 - DNA, 21 bp, Homo sapiens
actcacaagaagaccagactg

SEQ ID NO: 5155256 - DNA, 22 bp, Homo sapiens
actcacaagcaatccatgatct

SEQ ID NO: 5155257 - DNA, 23 bp, Homo sapiens
actcacaattgttgactaaaatg

SEQ ID NO: 5155258 - DNA, 16 bp, Homo sapiens
actcacaatttaaaat

SEQ ID NO: 5155259 - DNA, 17 bp, Homo sapiens
actcacaatttaaaata

SEQ ID NO: 5155260 - DNA, 20 bp, Homo sapiens
actcacaatttaaaatattt

SEQ ID NO: 5155261 - DNA, 14 bp, Homo sapiens
actcacacagccag

SEQ ID NO: 5155262 - DNA, 22 bp, Homo sapiens
actcacacaggacccccttccc

SEQ ID NO: 5155263 - DNA, 19 bp, Homo sapiens
actcacacaggcatttcct

SEQ ID NO: 5155264 - DNA, 23 bp, Homo sapiens
actcacacaggcatttcctgggt

SEQ ID NO: 5155265 - DNA, 22 bp, Homo sapiens
actcacacattcccccaccagc

SEQ ID NO: 5155266 - DNA, 15 bp, Homo sapiens
actcacacccctgcc

SEQ ID NO: 5155267 - DNA, 21 bp, Homo sapiens
actcacacctgaactgaacac

SEQ ID NO: 5155268 - DNA, 17 bp, Homo sapiens
actcacactctctgcag

SEQ ID NO: 5155269 - DNA, 15 bp, Homo sapiens
actcacactggccac

SEQ ID NO: 5155270 - DNA, 17 bp, Homo sapiens
actcacagactgctgtc

SEQ ID NO: 5155271 - DNA, 17 bp, Homo sapiens
actcacagagacacagg

SEQ ID NO: 5155272 - DNA, 13 bp, Homo sapiens
actcacagccagc

SEQ ID NO: 5155273 - DNA, 18 bp, Homo sapiens
actcacagccagcgaact

SEQ ID NO: 5155274 - DNA, 22 bp, Homo sapiens
actcacagccagcgaactgaca

SEQ ID NO: 5155275 - DNA, 23 bp, Homo sapiens
actcacaggttggaagagaatca

SEQ ID NO: 5155276 - DNA, 14 bp, Homo sapiens
actcacatcttttt

SEQ ID NO: 5155277 - DNA, 13 bp, Homo sapiens
actcacatgacac

SEQ ID NO: 5155278 - DNA, 12 bp, Homo sapiens
actcacatgccg

SEQ ID NO: 5155279 - DNA, 21 bp, Homo sapiens
actcacatgccttctaaacgt

SEQ ID NO: 5155280 - DNA, 18 bp, Homo sapiens
actcacatgctggacagg

SEQ ID NO: 5155281 - DNA, 16 bp, Homo sapiens
actcacatggctatgt

SEQ ID NO: 5155282 - DNA, 19 bp, Homo sapiens
actcacatttattctgctc

SEQ ID NO: 5155283 - DNA, 15 bp, Homo sapiens
actcacattttgtta

SEQ ID NO: 5155284 - DNA, 14 bp, Homo sapiens
actcaccaaaatat

SEQ ID NO: 5155285 - DNA, 15 bp, Homo sapiens
actcaccaaaatata

SEQ ID NO: 5155286 - DNA, 17 bp, Homo sapiens
actcaccaaaatatagt

SEQ ID NO: 5155287 - DNA, 18 bp, Homo sapiens
actcaccaacttgccaca

SEQ ID NO: 5155288 - DNA, 19 bp, Homo sapiens
actcaccaacttttaatgg

SEQ ID NO: 5155289 - DNA, 18 bp, Homo sapiens
actcaccacaagctgagc

SEQ ID NO: 5155290 - DNA, 14 bp, Homo sapiens
actcaccagcccca

SEQ ID NO: 5155291 - DNA, 21 bp, Homo sapiens
actcaccagccccactgccag

SEQ ID NO: 5155292 - DNA, 23 bp, Homo sapiens
actcaccagccccactgccagca

SEQ ID NO: 5155293 - DNA, 17 bp, Homo sapiens
actcaccagccctagct

SEQ ID NO: 5155294 - DNA, 23 bp, Homo sapiens
actcaccagggtccgcaccagct

SEQ ID NO: 5155295 - DNA, 19 bp, Homo sapiens
actcaccagtgtcccctcc

SEQ ID NO: 5155296 - DNA, 17 bp, Homo sapiens
actcaccatatttgaat

SEQ ID NO: 5155297 - DNA, 13 bp, Homo sapiens
actcaccatctgt

SEQ ID NO: 5155298 - DNA, 18 bp, Homo sapiens
actcaccatttaatcatt

SEQ ID NO: 5155299 - DNA, 22 bp, Homo sapiens
actcaccatttaatcatttcca

SEQ ID NO: 5155300 - DNA, 13 bp, Homo sapiens
actcaccatttca

SEQ ID NO: 5155301 - DNA, 12 bp, Homo sapiens
actcacccaagc

SEQ ID NO: 5155302 - DNA, 21 bp, Homo sapiens
actcacccatgtgccaaggtg

SEQ ID NO: 5155303 - DNA, 17 bp, Homo sapiens
actcaccccagcctcat

SEQ ID NO: 5155304 - DNA, 20 bp, Homo sapiens
actcaccccagcctcattgt

SEQ ID NO: 5155305 - DNA, 18 bp, Homo sapiens
actcacccccaaggggca

SEQ ID NO: 5155306 - DNA, 20 bp, Homo sapiens
actcacccctagccctggtt

SEQ ID NO: 5155307 - DNA, 15 bp, Homo sapiens
actcaccctgggagc

SEQ ID NO: 5155308 - DNA, 18 bp, Homo sapiens
actcaccctgggagccag

SEQ ID NO: 5155309 - DNA, 22 bp, Homo sapiens
actcaccctgggagccagtcct

SEQ ID NO: 5155310 - DNA, 21 bp, Homo sapiens
actcacccttcctggcccagg

SEQ ID NO: 5155311 - DNA, 13 bp, Homo sapiens
actcacccttggc

SEQ ID NO: 5155312 - DNA, 20 bp, Homo sapiens
actcaccgacccgacactct

SEQ ID NO: 5155313 - DNA, 22 bp, Homo sapiens
actcaccgacccgacactctca

SEQ ID NO: 5155314 - DNA, 16 bp, Homo sapiens
actcacctaatgttta

SEQ ID NO: 5155315 - DNA, 23 bp, Homo sapiens
actcacctaatgtttatgagcca

SEQ ID NO: 5155316 - DNA, 11 bp, Homo sapiens
actcacctcct

SEQ ID NO: 5155317 - DNA, 21 bp, Homo sapiens
actcacctgcccctcaactct

SEQ ID NO: 5155318 - DNA, 23 bp, Homo sapiens
actcacctgcgcaagtgcctggg

SEQ ID NO: 5155319 - DNA, 20 bp, Homo sapiens
actcacctgctggcccctca

SEQ ID NO: 5155320 - DNA, 14 bp, Homo sapiens
actcacctggggct

SEQ ID NO: 5155321 - DNA, 18 bp, Homo sapiens
actcacctggggctgctg

SEQ ID NO: 5155322 - DNA, 23 bp, Homo sapiens
actcacctttctccactgggtgc

SEQ ID NO: 5155323 - DNA, 20 bp, Homo sapiens
actcacggaccactcgaggc

SEQ ID NO: 5155324 - DNA, 22 bp, Homo sapiens
actcacgggaggaatcttttac

SEQ ID NO: 5155325 - DNA, 13 bp, Homo sapiens
actcactaagttt

SEQ ID NO: 5155326 - DNA, 19 bp, Homo sapiens
actcactaagtttacttct

SEQ ID NO: 5155327 - DNA, 18 bp, Homo sapiens
actcactaattcattaat

SEQ ID NO: 5155328 - DNA, 14 bp, Homo sapiens
actcactaggcccc

SEQ ID NO: 5155329 - DNA, 17 bp, Homo sapiens
actcactaggcccccac

SEQ ID NO: 5155330 - DNA, 21 bp, Homo sapiens
actcactaggcccccacttgc

SEQ ID NO: 5155331 - DNA, 14 bp, Homo sapiens
aaactctacagatg

SEQ ID NO: 5155332 - DNA, 15 bp, Homo sapiens
aaactctacatttaa

SEQ ID NO: 5155333 - DNA, 14 bp, Homo sapiens
aaactctaccctga

SEQ ID NO: 5155334 - DNA, 19 bp, Homo sapiens
aaactctaggggaattaac

SEQ ID NO: 5155335 - DNA, 20 bp, Homo sapiens
aaactctataaagaaacttt

SEQ ID NO: 5155336 - DNA, 18 bp, Homo sapiens
aaactctatttagatgca

SEQ ID NO: 5155337 - DNA, 16 bp, Homo sapiens
aaactctccatgatta

SEQ ID NO: 5155338 - DNA, 17 bp, Homo sapiens
aaactctcccctttctt

SEQ ID NO: 5155339 - DNA, 20 bp, Homo sapiens
aaactctccttttccttacc

SEQ ID NO: 5155340 - DNA, 21 bp, Homo sapiens
aaactctccttttccttacca

SEQ ID NO: 5155341 - DNA, 15 bp, Homo sapiens
aaactctctagctta

SEQ ID NO: 5155342 - DNA, 21 bp, Homo sapiens
aaactctcttctctttctctc

SEQ ID NO: 5155343 - DNA, 16 bp, Homo sapiens
aaactctcttcttcca

SEQ ID NO: 5155344 - DNA, 15 bp, Homo sapiens
aaactctgaatttat

SEQ ID NO: 5155345 - DNA, 17 bp, Homo sapiens
aaactctgaatttatct

SEQ ID NO: 5155346 - DNA, 17 bp, Homo sapiens
aaactctgcatccagag

SEQ ID NO: 5155347 - DNA, 15 bp, Homo sapiens
aaactctgccagaaa

SEQ ID NO: 5155348 - DNA, 22 bp, Homo sapiens
aaactctggacactctatatgt

SEQ ID NO: 5155349 - DNA, 14 bp, Homo sapiens
aaactctgggaaat

SEQ ID NO: 5155350 - DNA, 13 bp, Homo sapiens
aaactctgggtct

SEQ ID NO: 5155351 - DNA, 14 bp, Homo sapiens
aaactctgggtctt

SEQ ID NO: 5155352 - DNA, 19 bp, Homo sapiens
aaactctggtgataaaaat

SEQ ID NO: 5155353 - DNA, 20 bp, Homo sapiens
aaactctgttgcaagtgcaa

SEQ ID NO: 5155354 - DNA, 23 bp, Homo sapiens
aaactcttaaaacccaagtgcct

SEQ ID NO: 5155355 - DNA, 15 bp, Homo sapiens
aaactcttaatctgt

SEQ ID NO: 5155356 - DNA, 16 bp, Homo sapiens
aaactcttatctcagt

SEQ ID NO: 5155357 - DNA, 14 bp, Homo sapiens
aaactcttcaaggc

SEQ ID NO: 5155358 - DNA, 16 bp, Homo sapiens
aaactcttcagttaat

SEQ ID NO: 5155359 - DNA, 19 bp, Homo sapiens
aaactcttcagttaattct

SEQ ID NO: 5155360 - DNA, 22 bp, Homo sapiens
aaactcttcagttaattcttag

SEQ ID NO: 5155361 - DNA, 17 bp, Homo sapiens
aaactcttgacctcagg

SEQ ID NO: 5155362 - DNA, 12 bp, Homo sapiens
aaactcttgcta

SEQ ID NO: 5155363 - DNA, 14 bp, Homo sapiens
aaactcttggcctc

SEQ ID NO: 5155364 - DNA, 19 bp, Homo sapiens
aaactcttggcctctgctt

SEQ ID NO: 5155365 - DNA, 14 bp, Homo sapiens
aaactctttaactt

SEQ ID NO: 5155366 - DNA, 15 bp, Homo sapiens
aaactctttcattct

SEQ ID NO: 5155367 - DNA, 11 bp, Homo sapiens
aaactctttgg

SEQ ID NO: 5155368 - DNA, 14 bp, Homo sapiens
aaactgaaaaatat

SEQ ID NO: 5155369 - DNA, 16 bp, Homo sapiens
aaactgaaaaatatct

SEQ ID NO: 5155370 - DNA, 15 bp, Homo sapiens
aaactgaaaaatcta

SEQ ID NO: 5155371 - DNA, 16 bp, Homo sapiens
aaactgaaaaatgtca

SEQ ID NO: 5155372 - DNA, 18 bp, Homo sapiens
aaactgaaaatctaatat

SEQ ID NO: 5155373 - DNA, 20 bp, Homo sapiens
aaactgaaagcacatgaata

SEQ ID NO: 5155374 - DNA, 14 bp, Homo sapiens
aaactgaaagtgtt

SEQ ID NO: 5155375 - DNA, 23 bp, Homo sapiens
aaactgaaagtgttttactcttt

SEQ ID NO: 5155376 - DNA, 19 bp, Homo sapiens
aaactgaacttgaagctaa

SEQ ID NO: 5155377 - DNA, 11 bp, Homo sapiens
aaactgaagaa

SEQ ID NO: 5155378 - DNA, 12 bp, Homo sapiens
aaactgaagaag

SEQ ID NO: 5155379 - DNA, 17 bp, Homo sapiens
aaactgaagaattttga

SEQ ID NO: 5155380 - DNA, 12 bp, Homo sapiens
aaactgaagatg

SEQ ID NO: 5155381 - DNA, 17 bp, Homo sapiens
aaactgaagcaacttga

SEQ ID NO: 5155382 - DNA, 16 bp, Homo sapiens
aaactgaaggtcaata

SEQ ID NO: 5155383 - DNA, 13 bp, Homo sapiens
aaactgaatattt

SEQ ID NO: 5155384 - DNA, 14 bp, Homo sapiens
aaactgaatatttt

SEQ ID NO: 5155385 - DNA, 17 bp, Homo sapiens
aaactgaatattttgga

SEQ ID NO: 5155386 - DNA, 14 bp, Homo sapiens
aaactgaatgaatc

SEQ ID NO: 5155387 - DNA, 11 bp, Homo sapiens
aaactgaattt

SEQ ID NO: 5155388 - DNA, 14 bp, Homo sapiens
aaactgaatttgtt

SEQ ID NO: 5155389 - DNA, 19 bp, Homo sapiens
aaactgaatttttcttgcg

SEQ ID NO: 5155390 - DNA, 14 bp, Homo sapiens
aaactgacaatttt

SEQ ID NO: 5155391 - DNA, 19 bp, Homo sapiens
aaactgacagggcccagtt

SEQ ID NO: 5155392 - DNA, 17 bp, Homo sapiens
aaactgacagtattaag

SEQ ID NO: 5155393 - DNA, 16 bp, Homo sapiens
aaactgacatcagatt

SEQ ID NO: 5155394 - DNA, 17 bp, Homo sapiens
aaactgacatcagattt

SEQ ID NO: 5155395 - DNA, 18 bp, Homo sapiens
aaactgacatcagatttc

SEQ ID NO: 5155396 - DNA, 21 bp, Homo sapiens
aaactgacatcagatttctta

SEQ ID NO: 5155397 - DNA, 22 bp, Homo sapiens
aaactgacatgccctcccttct

SEQ ID NO: 5155398 - DNA, 20 bp, Homo sapiens
aaactgagaaatgaatgctg

SEQ ID NO: 5155399 - DNA, 13 bp, Homo sapiens
aaactgagacagg

SEQ ID NO: 5155400 - DNA, 21 bp, Homo sapiens
aaactgagagtaattcatctg

SEQ ID NO: 5155401 - DNA, 23 bp, Homo sapiens
aaactgagatgtgaacacatcag

SEQ ID NO: 5155402 - DNA, 19 bp, Homo sapiens
aaactgagcctcttttcaa

SEQ ID NO: 5155403 - DNA, 13 bp, Homo sapiens
aaactgaggagta

SEQ ID NO: 5155404 - DNA, 21 bp, Homo sapiens
aaactgaggagtagctgagag

SEQ ID NO: 5155405 - DNA, 15 bp, Homo sapiens
aaactgaggcccaga

SEQ ID NO: 5155406 - DNA, 16 bp, Homo sapiens
aaactgaggcccagag

SEQ ID NO: 5155407 - DNA, 22 bp, Homo sapiens
aaactgaggcccagagagctga

SEQ ID NO: 5155408 - DNA, 22 bp, Homo sapiens
aaactgaggcccagagagggaa

SEQ ID NO: 5155409 - DNA, 20 bp, Homo sapiens
aaactgaggtgttattttca

SEQ ID NO: 5155410 - DNA, 16 bp, Homo sapiens
aaactgagtataatca

SEQ ID NO: 5155411 - DNA, 15 bp, Homo sapiens
aaactgagtcactca

SEQ ID NO: 5155412 - DNA, 19 bp, Homo sapiens
aaactgagtccatgaaaat

SEQ ID NO: 5155413 - DNA, 14 bp, Homo sapiens
aaactgagtcctgt

SEQ ID NO: 5155414 - DNA, 13 bp, Homo sapiens
aaactgagtgact

SEQ ID NO: 5155415 - DNA, 16 bp, Homo sapiens
aaactgatctaaaatg

SEQ ID NO: 5155416 - DNA, 20 bp, Homo sapiens
aaactgatgcgaaaacttga

SEQ ID NO: 5155417 - DNA, 13 bp, Homo sapiens
aaactgatgcttt

SEQ ID NO: 5155418 - DNA, 17 bp, Homo sapiens
aaactgatgctttcaga

SEQ ID NO: 5155419 - DNA, 13 bp, Homo sapiens
aaactgatgtata

SEQ ID NO: 5155420 - DNA, 12 bp, Homo sapiens
aaactgatgtga

SEQ ID NO: 5155421 - DNA, 17 bp, Homo sapiens
aaactgatttctcacgg

SEQ ID NO: 5155422 - DNA, 16 bp, Homo sapiens
aaactgcaagttcatt

SEQ ID NO: 5155423 - DNA, 17 bp, Homo sapiens
aaactgcaatagagact

SEQ ID NO: 5155424 - DNA, 21 bp, Homo sapiens
aaactgcaatagagactgtag

SEQ ID NO: 5155425 - DNA, 22 bp, Homo sapiens
aaactgcacagtgctgttggtg

SEQ ID NO: 5155426 - DNA, 15 bp, Homo sapiens
aaactgcagcctctc

SEQ ID NO: 5155427 - DNA, 21 bp, Homo sapiens
aaactgcagttttaacttttt

SEQ ID NO: 5155428 - DNA, 17 bp, Homo sapiens
aaactgcattagaaatt

SEQ ID NO: 5155429 - DNA, 11 bp, Homo sapiens
aaactgcattt

SEQ ID NO: 5155430 - DNA, 12 bp, Homo sapiens
aaactgcatttg

SEQ ID NO: 5155431 - DNA, 17 bp, Homo sapiens
aaactgccaaacctcct

SEQ ID NO: 5155432 - DNA, 21 bp, Homo sapiens
aaactgccaaactattttctg

SEQ ID NO: 5155433 - DNA, 14 bp, Homo sapiens
aaactgccacaagc

SEQ ID NO: 5155434 - DNA, 19 bp, Homo sapiens
aaactgccacaagcacaat

SEQ ID NO: 5155435 - DNA, 17 bp, Homo sapiens
aaactgccattggctat

SEQ ID NO: 5155436 - DNA, 11 bp, Homo sapiens
aaactgccccc

SEQ ID NO: 5155437 - DNA, 22 bp, Homo sapiens
aaactgcctgacaattatgaaa

SEQ ID NO: 5155438 - DNA, 16 bp, Homo sapiens
aaactgcctgttcctt

SEQ ID NO: 5155439 - DNA, 15 bp, Homo sapiens
aaactgcgtcttgga

SEQ ID NO: 5155440 - DNA, 15 bp, Homo sapiens
aaactgctaaattct

SEQ ID NO: 5155441 - DNA, 11 bp, Homo sapiens
aaactgctgtc

SEQ ID NO: 5155442 - DNA, 14 bp, Homo sapiens
aaactgctgttaat

SEQ ID NO: 5155443 - DNA, 12 bp, Homo sapiens
aaactgcttata

SEQ ID NO: 5155444 - DNA, 12 bp, Homo sapiens
aaactgctttat

SEQ ID NO: 5155445 - DNA, 19 bp, Homo sapiens
aaactgctttgtgcatatg

SEQ ID NO: 5155446 - DNA, 22 bp, Homo sapiens
aaactgcttttttttttccagc

SEQ ID NO: 5155447 - DNA, 23 bp, Homo sapiens
aaactgcttttttttttccagca

SEQ ID NO: 5155448 - DNA, 22 bp, Homo sapiens
aaactggaaacatctgatttct

SEQ ID NO: 5155449 - DNA, 11 bp, Homo sapiens
aaactggaaat

SEQ ID NO: 5155450 - DNA, 19 bp, Homo sapiens
aaactggaacggtgaaggt

SEQ ID NO: 5155451 - DNA, 20 bp, Homo sapiens
aaactggaacggtgaaggtg

SEQ ID NO: 5155452 - DNA, 11 bp, Homo sapiens
aaactggaagc

SEQ ID NO: 5155453 - DNA, 15 bp, Homo sapiens
aaactggaataagaa

SEQ ID NO: 5155454 - DNA, 17 bp, Homo sapiens
aaactggaataagcctt

SEQ ID NO: 5155455 - DNA, 21 bp, Homo sapiens
aaactggaataagccttcgaa

SEQ ID NO: 5155456 - DNA, 17 bp, Homo sapiens
aaactggagaaatgatt

SEQ ID NO: 5155457 - DNA, 20 bp, Homo sapiens
aaactggagaggctaacctc

SEQ ID NO: 5155458 - DNA, 17 bp, Homo sapiens
aaactggatatttcaat

SEQ ID NO: 5155459 - DNA, 15 bp, Homo sapiens
aaactggatggaaat

SEQ ID NO: 5155460 - DNA, 19 bp, Homo sapiens
aaactggattaaaacaatt

SEQ ID NO: 5155461 - DNA, 12 bp, Homo sapiens
aaactggccagg

SEQ ID NO: 5155462 - DNA, 20 bp, Homo sapiens
aaactggcgatctcccaggg

SEQ ID NO: 5155463 - DNA, 19 bp, Homo sapiens
aaactggcttaacttagta

SEQ ID NO: 5155464 - DNA, 12 bp, Homo sapiens
aaactgggaaac

SEQ ID NO: 5155465 - DNA, 13 bp, Homo sapiens
aaactgggaaatg

SEQ ID NO: 5155466 - DNA, 13 bp, Homo sapiens
aaactgggaaggc

SEQ ID NO: 5155467 - DNA, 15 bp, Homo sapiens
aaactgggataactg

SEQ ID NO: 5155468 - DNA, 18 bp, Homo sapiens
aaactgggataactgatt

SEQ ID NO: 5155469 - DNA, 23 bp, Homo sapiens
aaactgggatgaaactaaagcaa

SEQ ID NO: 5155470 - DNA, 22 bp, Homo sapiens
aaactggggagttataaaaata

SEQ ID NO: 5155471 - DNA, 18 bp, Homo sapiens
aaactggggcctccagaa

SEQ ID NO: 5155472 - DNA, 14 bp, Homo sapiens
aaactggggcttgc

SEQ ID NO: 5155473 - DNA, 17 bp, Homo sapiens
aaactggggggaaaaag

SEQ ID NO: 5155474 - DNA, 19 bp, Homo sapiens
aaactgggtcatcatttgt

SEQ ID NO: 5155475 - DNA, 18 bp, Homo sapiens
aaactgggtcttcagctt

SEQ ID NO: 5155476 - DNA, 18 bp, Homo sapiens
aaactggtatgaataatt

SEQ ID NO: 5155477 - DNA, 16 bp, Homo sapiens
aaactggtattttatc

SEQ ID NO: 5155478 - DNA, 22 bp, Homo sapiens
aaactggtattttatctttgat

SEQ ID NO: 5155479 - DNA, 16 bp, Homo sapiens
aaactggttcctacat

SEQ ID NO: 5155480 - DNA, 23 bp, Homo sapiens
aaactggttctacaaatttttac

SEQ ID NO: 5155481 - DNA, 20 bp, Homo sapiens
aaactggttctgtgttgaaa

SEQ ID NO: 5155482 - DNA, 23 bp, Homo sapiens
aaactggtttagcacaatttata

SEQ ID NO: 5155483 - DNA, 21 bp, Homo sapiens
aaactgtaaaaaatgtgtgta

SEQ ID NO: 5155484 - DNA, 18 bp, Homo sapiens
aaactgtaaatcataatg

SEQ ID NO: 5155485 - DNA, 17 bp, Homo sapiens
aaactgtaatacaatga

SEQ ID NO: 5155486 - DNA, 19 bp, Homo sapiens
aaactgtacagaatttcca

SEQ ID NO: 5155487 - DNA, 12 bp, Homo sapiens
aaactgtacagt

SEQ ID NO: 5155488 - DNA, 18 bp, Homo sapiens
aaactgtacagtgtcttt

SEQ ID NO: 5155489 - DNA, 13 bp, Homo sapiens
aaactgtactgtg

SEQ ID NO: 5155490 - DNA, 21 bp, Homo sapiens
aaactgtactttgattcacat

SEQ ID NO: 5155491 - DNA, 16 bp, Homo sapiens
aaactgtagaaatgat

SEQ ID NO: 5155492 - DNA, 14 bp, Homo sapiens
aaactgtagatgaa

SEQ ID NO: 5155493 - DNA, 14 bp, Homo sapiens
aaactgtagctgta

SEQ ID NO: 5155494 - DNA, 12 bp, Homo sapiens
aaactgtagtaa

SEQ ID NO: 5155495 - DNA, 21 bp, Homo sapiens
aaactgtatcaaatctgtata

SEQ ID NO: 5155496 - DNA, 16 bp, Homo sapiens
aaactgtatcttcctt

SEQ ID NO: 5155497 - DNA, 13 bp, Homo sapiens
aaactgtatgctc

SEQ ID NO: 5155498 - DNA, 22 bp, Homo sapiens
aaactgtattgatgacagtagt

SEQ ID NO: 5155499 - DNA, 12 bp, Homo sapiens
aaactgtattta

SEQ ID NO: 5155500 - DNA, 18 bp, Homo sapiens
aaactgtatttacttgtt

SEQ ID NO: 5155501 - DNA, 14 bp, Homo sapiens
aaactgtcactgtt

SEQ ID NO: 5155502 - DNA, 12 bp, Homo sapiens
aaactgtccctt

SEQ ID NO: 5155503 - DNA, 18 bp, Homo sapiens
aaactgtcctctttcaga

SEQ ID NO: 5155504 - DNA, 20 bp, Homo sapiens
aaactgtcctctttcagaaa

SEQ ID NO: 5155505 - DNA, 21 bp, Homo sapiens
aaactgtcctctttcagaaaa

SEQ ID NO: 5155506 - DNA, 20 bp, Homo sapiens
aaactgtctttaaaagagag

SEQ ID NO: 5155507 - DNA, 11 bp, Homo sapiens
aaactgtgaaa

SEQ ID NO: 5155508 - DNA, 12 bp, Homo sapiens
aaactgtgaaaa

SEQ ID NO: 5155509 - DNA, 18 bp, Homo sapiens
aaactgtgaaaatagtgt

SEQ ID NO: 5155510 - DNA, 16 bp, Homo sapiens
aaactgtgaatgcttc

SEQ ID NO: 5155511 - DNA, 21 bp, Homo sapiens
aaactgtgaatgcttctgatt

SEQ ID NO: 5155512 - DNA, 15 bp, Homo sapiens
acgctgcgtgccatg

SEQ ID NO: 5155513 - DNA, 17 bp, Homo sapiens
acgctgctccatgcaca

SEQ ID NO: 5155514 - DNA, 18 bp, Homo sapiens
acgctgctccatgcacag

SEQ ID NO: 5155515 - DNA, 23 bp, Homo sapiens
acgctgctctcctgacagccaca

SEQ ID NO: 5155516 - DNA, 13 bp, Homo sapiens
acgctgctctgcc

SEQ ID NO: 5155517 - DNA, 14 bp, Homo sapiens
acgctgctctgccc

SEQ ID NO: 5155518 - DNA, 16 bp, Homo sapiens
acgctgctctgcccca

SEQ ID NO: 5155519 - DNA, 17 bp, Homo sapiens
acgctgctctgccccag

SEQ ID NO: 5155520 - DNA, 12 bp, Homo sapiens
acgctgctgtca

SEQ ID NO: 5155521 - DNA, 20 bp, Homo sapiens
acgctggaccttgaactggg

SEQ ID NO: 5155522 - DNA, 20 bp, Homo sapiens
acgctggaccttttctttac

SEQ ID NO: 5155523 - DNA, 14 bp, Homo sapiens
acgctggagaccct

SEQ ID NO: 5155524 - DNA, 15 bp, Homo sapiens
acgctggagaccctg

SEQ ID NO: 5155525 - DNA, 17 bp, Homo sapiens
acgctggagaccctgcg

SEQ ID NO: 5155526 - DNA, 18 bp, Homo sapiens
acgctggagaccctgcgc

SEQ ID NO: 5155527 - DNA, 16 bp, Homo sapiens
acgctggagtgcagtg

SEQ ID NO: 5155528 - DNA, 18 bp, Homo sapiens
acgctggagtgcagtgag

SEQ ID NO: 5155529 - DNA, 20 bp, Homo sapiens
acgctggccaatttttgtac

SEQ ID NO: 5155530 - DNA, 21 bp, Homo sapiens
acgctggccaatttttgtact

SEQ ID NO: 5155531 - DNA, 12 bp, Homo sapiens
acgctggctact

SEQ ID NO: 5155532 - DNA, 11 bp, Homo sapiens
acgctggctcc

SEQ ID NO: 5155533 - DNA, 13 bp, Homo sapiens
acgctggcttcca

SEQ ID NO: 5155534 - DNA, 14 bp, Homo sapiens
acgctggcttccag

SEQ ID NO: 5155535 - DNA, 22 bp, Homo sapiens
acgctggcttccagcgggccct

SEQ ID NO: 5155536 - DNA, 15 bp, Homo sapiens
acgctggggctctct

SEQ ID NO: 5155537 - DNA, 19 bp, Homo sapiens
acgctggggctctctgaga

SEQ ID NO: 5155538 - DNA, 19 bp, Homo sapiens
acgctgggtattaccatgt

SEQ ID NO: 5155539 - DNA, 20 bp, Homo sapiens
acgctggtagagatggagga

SEQ ID NO: 5155540 - DNA, 18 bp, Homo sapiens
acgctggtctggatggta

SEQ ID NO: 5155541 - DNA, 21 bp, Homo sapiens
acgctgtcctctcgagcccag

SEQ ID NO: 5155542 - DNA, 12 bp, Homo sapiens
acgctgtctcca

SEQ ID NO: 5155543 - DNA, 23 bp, Homo sapiens
acgctgtctccagacccccaccc

SEQ ID NO: 5155544 - DNA, 19 bp, Homo sapiens
acgctgtgatgctgtgtgc

SEQ ID NO: 5155545 - DNA, 14 bp, Homo sapiens
acgctgtgctgccc

SEQ ID NO: 5155546 - DNA, 15 bp, Homo sapiens
acgctgtgctgccct

SEQ ID NO: 5155547 - DNA, 19 bp, Homo sapiens
acgctgtgctgccctgccc

SEQ ID NO: 5155548 - DNA, 22 bp, Homo sapiens
acgctgtgctgccctgcccacc

SEQ ID NO: 5155549 - DNA, 14 bp, Homo sapiens
acgctgtgggcagg

SEQ ID NO: 5155550 - DNA, 20 bp, Homo sapiens
acgcttaacctttccgctgt

SEQ ID NO: 5155551 - DNA, 13 bp, Homo sapiens
acgcttaaggtgg

SEQ ID NO: 5155552 - DNA, 22 bp, Homo sapiens
acgcttaagtcatcattacttg

SEQ ID NO: 5155553 - DNA, 11 bp, Homo sapiens
acgcttccaga

SEQ ID NO: 5155554 - DNA, 18 bp, Homo sapiens
acgcttccagaccacctg

SEQ ID NO: 5155555 - DNA, 23 bp, Homo sapiens
acgcttccagaccacctgccagc

SEQ ID NO: 5155556 - DNA, 13 bp, Homo sapiens
acgcttctccgga

SEQ ID NO: 5155557 - DNA, 14 bp, Homo sapiens
acgcttctgagcag

SEQ ID NO: 5155558 - DNA, 19 bp, Homo sapiens
acgcttctggaggtgggga

SEQ ID NO: 5155559 - DNA, 18 bp, Homo sapiens
acgcttgacaggacagca

SEQ ID NO: 5155560 - DNA, 23 bp, Homo sapiens
acgcttgtagaactcactctggg

SEQ ID NO: 5155561 - DNA, 16 bp, Homo sapiens
acgcttgtgacagtgc

SEQ ID NO: 5155562 - DNA, 23 bp, Homo sapiens
acgcttgtgtctttagtgctcca

SEQ ID NO: 5155563 - DNA, 12 bp, Homo sapiens
acgctttcatga

SEQ ID NO: 5155564 - DNA, 13 bp, Homo sapiens
acgctttcatgac

SEQ ID NO: 5155565 - DNA, 17 bp, Homo sapiens
acgctttctagctgttg

SEQ ID NO: 5155566 - DNA, 11 bp, Homo sapiens
acgctttgatt

SEQ ID NO: 5155567 - DNA, 13 bp, Homo sapiens
acgctttgattca

SEQ ID NO: 5155568 - DNA, 14 bp, Homo sapiens
acgctttgattcat

SEQ ID NO: 5155569 - DNA, 16 bp, Homo sapiens
acgctttgattcatag

SEQ ID NO: 5155570 - DNA, 15 bp, Homo sapiens
acgctttgtttactc

SEQ ID NO: 5155571 - DNA, 14 bp, Homo sapiens
acgcttttctttgt

SEQ ID NO: 5155572 - DNA, 19 bp, Homo sapiens
acgcttttgagtgggccct

SEQ ID NO: 5155573 - DNA, 14 bp, Homo sapiens
acgcttttgtgatg

SEQ ID NO: 5155574 - DNA, 15 bp, Homo sapiens
acggaaaatgccaat

SEQ ID NO: 5155575 - DNA, 13 bp, Homo sapiens
acggaaaatgctt

SEQ ID NO: 5155576 - DNA, 11 bp, Homo sapiens
acggaaacaga

SEQ ID NO: 5155577 - DNA, 12 bp, Homo sapiens
acggaaacagaa

SEQ ID NO: 5155578 - DNA, 14 bp, Homo sapiens
acggaaacagaact

SEQ ID NO: 5155579 - DNA, 16 bp, Homo sapiens
acggaaacatacagag

SEQ ID NO: 5155580 - DNA, 21 bp, Homo sapiens
acggaaagtttttagaatgtt

SEQ ID NO: 5155581 - DNA, 11 bp, Homo sapiens
acggaactctt

SEQ ID NO: 5155582 - DNA, 22 bp, Homo sapiens
acggaagaagagatcaggaaga

SEQ ID NO: 5155583 - DNA, 15 bp, Homo sapiens
acggaagagccttgc

SEQ ID NO: 5155584 - DNA, 14 bp, Homo sapiens
acggaagtggcctg

SEQ ID NO: 5155585 - DNA, 13 bp, Homo sapiens
acggaagttttca

SEQ ID NO: 5155586 - DNA, 14 bp, Homo sapiens
acggaagttttcaa

SEQ ID NO: 5155587 - DNA, 15 bp, Homo sapiens
acggacaataaacct

SEQ ID NO: 5155588 - DNA, 19 bp, Homo sapiens
acggacaataaacctccgc

SEQ ID NO: 5155589 - DNA, 15 bp, Homo sapiens
acggacaccccctcg

SEQ ID NO: 5155590 - DNA, 17 bp, Homo sapiens
acggacactcaaaagct

SEQ ID NO: 5155591 - DNA, 19 bp, Homo sapiens
acggaccactcgaggcctg

SEQ ID NO: 5155592 - DNA, 14 bp, Homo sapiens
acggaccctgtgtg

SEQ ID NO: 5155593 - DNA, 19 bp, Homo sapiens
acggaccgcatcctccagg

SEQ ID NO: 5155594 - DNA, 14 bp, Homo sapiens
acggacgggacagc

SEQ ID NO: 5155595 - DNA, 21 bp, Homo sapiens
acggacgggacagcggcccgg

SEQ ID NO: 5155596 - DNA, 17 bp, Homo sapiens
acggactcccgggccac

SEQ ID NO: 5155597 - DNA, 16 bp, Homo sapiens
acggactctttgctgt

SEQ ID NO: 5155598 - DNA, 15 bp, Homo sapiens
acggactgaggtgcc

SEQ ID NO: 5155599 - DNA, 12 bp, Homo sapiens
acggagaagaat

SEQ ID NO: 5155600 - DNA, 14 bp, Homo sapiens
acggagagaaaaaa

SEQ ID NO: 5155601 - DNA, 19 bp, Homo sapiens
acggagagcgcctgcccct

SEQ ID NO: 5155602 - DNA, 18 bp, Homo sapiens
acggagcactgtgcagcc

SEQ ID NO: 5155603 - DNA, 19 bp, Homo sapiens
acggagcagttcagagtgg

SEQ ID NO: 5155604 - DNA, 21 bp, Homo sapiens
acggagccactcctctgactc

SEQ ID NO: 5155605 - DNA, 11 bp, Homo sapiens
acggagccctc

SEQ ID NO: 5155606 - DNA, 13 bp, Homo sapiens
acggagccctccc

SEQ ID NO: 5155607 - DNA, 14 bp, Homo sapiens
acggagccctccct

SEQ ID NO: 5155608 - DNA, 20 bp, Homo sapiens
acggagcggattgcaaagca

SEQ ID NO: 5155609 - DNA, 15 bp, Homo sapiens
acggaggaagcccac

SEQ ID NO: 5155610 - DNA, 15 bp, Homo sapiens
acggaggaggggaag

SEQ ID NO: 5155611 - DNA, 22 bp, Homo sapiens
acggaggaggggaaggggctga

SEQ ID NO: 5155612 - DNA, 18 bp, Homo sapiens
acggagggtccagactgt

SEQ ID NO: 5155613 - DNA, 19 bp, Homo sapiens
acggagtcccaccttggct

SEQ ID NO: 5155614 - DNA, 21 bp, Homo sapiens
acggagtcccaccttggctgc

SEQ ID NO: 5155615 - DNA, 21 bp, Homo sapiens
acggagtctcactctgtcacc

SEQ ID NO: 5155616 - DNA, 12 bp, Homo sapiens
acggagtcttgc

SEQ ID NO: 5155617 - DNA, 22 bp, Homo sapiens
acggagtggggggacagagact

SEQ ID NO: 5155618 - DNA, 18 bp, Homo sapiens
acggagtgttggggctgg

SEQ ID NO: 5155619 - DNA, 21 bp, Homo sapiens
acggagtgttggggctggggg

SEQ ID NO: 5155620 - DNA, 15 bp, Homo sapiens
acggagttcagaggg

SEQ ID NO: 5155621 - DNA, 22 bp, Homo sapiens
acggataggcaggaacatacag

SEQ ID NO: 5155622 - DNA, 16 bp, Homo sapiens
acggatcagaaataca

SEQ ID NO: 5155623 - DNA, 14 bp, Homo sapiens
acggatgatttcta

SEQ ID NO: 5155624 - DNA, 15 bp, Homo sapiens
acggatgcacagaga

SEQ ID NO: 5155625 - DNA, 19 bp, Homo sapiens
acggatgcccattcctgcc

SEQ ID NO: 5155626 - DNA, 21 bp, Homo sapiens
acggatgcccattcctgcctg

SEQ ID NO: 5155627 - DNA, 23 bp, Homo sapiens
acggatgggccctatgtctcagg

SEQ ID NO: 5155628 - DNA, 22 bp, Homo sapiens
acggattagggcatttgagaaa

SEQ ID NO: 5155629 - DNA, 17 bp, Homo sapiens
acggattattatttgta

SEQ ID NO: 5155630 - DNA, 13 bp, Homo sapiens
acggattattttt

SEQ ID NO: 5155631 - DNA, 19 bp, Homo sapiens
acggattattttttcagac

SEQ ID NO: 5155632 - DNA, 13 bp, Homo sapiens
acggatttattat

SEQ ID NO: 5155633 - DNA, 14 bp, Homo sapiens
acggcaaccacatg

SEQ ID NO: 5155634 - DNA, 18 bp, Homo sapiens
acggcaacgtagcctggg

SEQ ID NO: 5155635 - DNA, 14 bp, Homo sapiens
acggcaagaaggca

SEQ ID NO: 5155636 - DNA, 13 bp, Homo sapiens
acggcacccaccc

SEQ ID NO: 5155637 - DNA, 19 bp, Homo sapiens
acggcacctgggccctggg

SEQ ID NO: 5155638 - DNA, 20 bp, Homo sapiens
acggcacctgggccctgggg

SEQ ID NO: 5155639 - DNA, 12 bp, Homo sapiens
acggcacgcact

SEQ ID NO: 5155640 - DNA, 22 bp, Homo sapiens
acggcacggtcttccctcttcc

SEQ ID NO: 5155641 - DNA, 22 bp, Homo sapiens
acggcagaaaacagagcctgcc

SEQ ID NO: 5155642 - DNA, 15 bp, Homo sapiens
acggcagccacagct

SEQ ID NO: 5155643 - DNA, 12 bp, Homo sapiens
acggcagcccca

SEQ ID NO: 5155644 - DNA, 15 bp, Homo sapiens
acggcagccccatcc

SEQ ID NO: 5155645 - DNA, 18 bp, Homo sapiens
acggcagcccccccctca

SEQ ID NO: 5155646 - DNA, 17 bp, Homo sapiens
acggcagcttgagcctg

SEQ ID NO: 5155647 - DNA, 21 bp, Homo sapiens
acggcagcttgagcctgtcac

SEQ ID NO: 5155648 - DNA, 21 bp, Homo sapiens
acggcaggacaacgaggaagc

SEQ ID NO: 5155649 - DNA, 22 bp, Homo sapiens
acggcaggctcactgccaggcc

SEQ ID NO: 5155650 - DNA, 20 bp, Homo sapiens
acggcatcgcatccgtcctg

SEQ ID NO: 5155651 - DNA, 23 bp, Homo sapiens
acggcatcgcatccgtcctgggc

SEQ ID NO: 5155652 - DNA, 21 bp, Homo sapiens
acggcattagcttcctgcccc

SEQ ID NO: 5155653 - DNA, 16 bp, Homo sapiens
acggccaacaaagctg

SEQ ID NO: 5155654 - DNA, 15 bp, Homo sapiens
acggccaagaatgta

SEQ ID NO: 5155655 - DNA, 23 bp, Homo sapiens
acggccaagaatgtacgtccagc

SEQ ID NO: 5155656 - DNA, 20 bp, Homo sapiens
acggccacacagctgccggt

SEQ ID NO: 5155657 - DNA, 14 bp, Homo sapiens
acggccacccaccc

SEQ ID NO: 5155658 - DNA, 15 bp, Homo sapiens
acggccaccctcctt

SEQ ID NO: 5155659 - DNA, 12 bp, Homo sapiens
acggccactgca

SEQ ID NO: 5155660 - DNA, 21 bp, Homo sapiens
acggccactgcagtcacccct

SEQ ID NO: 5155661 - DNA, 20 bp, Homo sapiens
acggccaggaaaagccctca

SEQ ID NO: 5155662 - DNA, 13 bp, Homo sapiens
acggccaggccag

SEQ ID NO: 5155663 - DNA, 14 bp, Homo sapiens
acggccaggctccc

SEQ ID NO: 5155664 - DNA, 15 bp, Homo sapiens
acggccaggctccct

SEQ ID NO: 5155665 - DNA, 23 bp, Homo sapiens
acggccagggagaagctcctctc

SEQ ID NO: 5155666 - DNA, 15 bp, Homo sapiens
acggccatctctttg

SEQ ID NO: 5155667 - DNA, 10 bp, Homo sapiens
acggcccagg

SEQ ID NO: 5155668 - DNA, 14 bp, Homo sapiens
acggcccaggccag

SEQ ID NO: 5155669 - DNA, 22 bp, Homo sapiens
acggcccaggccaggtgcccag

SEQ ID NO: 5155670 - DNA, 23 bp, Homo sapiens
acggcccagggagggtgagctgg

SEQ ID NO: 5155671 - DNA, 15 bp, Homo sapiens
acggcccatcttggc

SEQ ID NO: 5155672 - DNA, 12 bp, Homo sapiens
acggccccagcg

SEQ ID NO: 5155673 - DNA, 14 bp, Homo sapiens
acggcccgcagcct

SEQ ID NO: 5155674 - DNA, 19 bp, Homo sapiens
acggcccgccgtgcctgca

SEQ ID NO: 5155675 - DNA, 17 bp, Homo sapiens
acggcccggcccctcac

SEQ ID NO: 5155676 - DNA, 22 bp, Homo sapiens
acggcccggcccctcaccctct

SEQ ID NO: 5155677 - DNA, 15 bp, Homo sapiens
acggccctcctggga

SEQ ID NO: 5155678 - DNA, 20 bp, Homo sapiens
acggccctccttcttttcct

SEQ ID NO: 5155679 - DNA, 18 bp, Homo sapiens
acggccctgcaggagcag

SEQ ID NO: 5155680 - DNA, 12 bp, Homo sapiens
acggccctgccc

SEQ ID NO: 5155681 - DNA, 13 bp, Homo sapiens
acggccctgcctg

SEQ ID NO: 5155682 - DNA, 15 bp, Homo sapiens
acggccctgcctgcc

SEQ ID NO: 5155683 - DNA, 14 bp, Homo sapiens
acggccctggcctt

SEQ ID NO: 5155684 - DNA, 18 bp, Homo sapiens
acggccgctccaggggtg

SEQ ID NO: 5155685 - DNA, 23 bp, Homo sapiens
acggcctaggggtggcgctcaga

SEQ ID NO: 5155686 - DNA, 18 bp, Homo sapiens
acggcctatgagatgaaa

SEQ ID NO: 5155687 - DNA, 14 bp, Homo sapiens
acggcctccaggag

SEQ ID NO: 5155688 - DNA, 18 bp, Homo sapiens
acggcctccaggaggggc

SEQ ID NO: 5155689 - DNA, 13 bp, Homo sapiens
acggcctcctttc

SEQ ID NO: 5155690 - DNA, 12 bp, Homo sapiens
acggcctggcat

SEQ ID NO: 5155691 - DNA, 16 bp, Homo sapiens
acggcctggcatgcag

SEQ ID NO: 5155692 - DNA, 18 bp, Homo sapiens
acggcctggcatgcagct

SEQ ID NO: 5155693 - DNA, 13 bp, Homo sapiens
actcactcactcc

SEQ ID NO: 5155694 - DNA, 16 bp, Homo sapiens
actcactcactccaag

SEQ ID NO: 5155695 - DNA, 17 bp, Homo sapiens
actcactcactccaaga

SEQ ID NO: 5155696 - DNA, 14 bp, Homo sapiens
actcactcactctg

SEQ ID NO: 5155697 - DNA, 15 bp, Homo sapiens
actcactcactctga

SEQ ID NO: 5155698 - DNA, 22 bp, Homo sapiens
actcactccaagaccaccaggg

SEQ ID NO: 5155699 - DNA, 16 bp, Homo sapiens
actcactccattccta

SEQ ID NO: 5155700 - DNA, 15 bp, Homo sapiens
actcactccccactc

SEQ ID NO: 5155701 - DNA, 16 bp, Homo sapiens
actcactccccactcc

SEQ ID NO: 5155702 - DNA, 19 bp, Homo sapiens
actcactccccactccccc

SEQ ID NO: 5155703 - DNA, 20 bp, Homo sapiens
actcactccccactccccca

SEQ ID NO: 5155704 - DNA, 14 bp, Homo sapiens
actcactcctgaga

SEQ ID NO: 5155705 - DNA, 21 bp, Homo sapiens
actcactcctgagacccctgg

SEQ ID NO: 5155706 - DNA, 16 bp, Homo sapiens
actcactccttttaaa

SEQ ID NO: 5155707 - DNA, 15 bp, Homo sapiens
actcactctgggctg

SEQ ID NO: 5155708 - DNA, 21 bp, Homo sapiens
actcactctttagatatttac

SEQ ID NO: 5155709 - DNA, 14 bp, Homo sapiens
actcactgaagcct

SEQ ID NO: 5155710 - DNA, 15 bp, Homo sapiens
actcactgaagcctg

SEQ ID NO: 5155711 - DNA, 13 bp, Homo sapiens
actcactgaggcc

SEQ ID NO: 5155712 - DNA, 18 bp, Homo sapiens
actcactgaggccatcag

SEQ ID NO: 5155713 - DNA, 12 bp, Homo sapiens
actcactgccta

SEQ ID NO: 5155714 - DNA, 15 bp, Homo sapiens
actcactgcctagga

SEQ ID NO: 5155715 - DNA, 20 bp, Homo sapiens
actcactgcctaggaggctg

SEQ ID NO: 5155716 - DNA, 21 bp, Homo sapiens
actcactgcctaggaggctgg

SEQ ID NO: 5155717 - DNA, 13 bp, Homo sapiens
actcactgcctgc

SEQ ID NO: 5155718 - DNA, 14 bp, Homo sapiens
actcactgcctgca

SEQ ID NO: 5155719 - DNA, 13 bp, Homo sapiens
actcactgtgctc

SEQ ID NO: 5155720 - DNA, 14 bp, Homo sapiens
actcactgtgctcc

SEQ ID NO: 5155721 - DNA, 16 bp, Homo sapiens
actcacttacatcttc

SEQ ID NO: 5155722 - DNA, 23 bp, Homo sapiens
actcacttgatgtttcctggaag

SEQ ID NO: 5155723 - DNA, 21 bp, Homo sapiens
actcacttgccattgccagga

SEQ ID NO: 5155724 - DNA, 15 bp, Homo sapiens
actcactttcccttg

SEQ ID NO: 5155725 - DNA, 15 bp, Homo sapiens
actcactttctagat

SEQ ID NO: 5155726 - DNA, 14 bp, Homo sapiens
actcacttttccca

SEQ ID NO: 5155727 - DNA, 15 bp, Homo sapiens
actcacttttcccac

SEQ ID NO: 5155728 - DNA, 16 bp, Homo sapiens
actcacttttcccact

SEQ ID NO: 5155729 - DNA, 19 bp, Homo sapiens
actcagaaaagaaaaccat

SEQ ID NO: 5155730 - DNA, 20 bp, Homo sapiens
actcagaaaagaaaaccatt

SEQ ID NO: 5155731 - DNA, 22 bp, Homo sapiens
actcagaaaatggggcttgccc

SEQ ID NO: 5155732 - DNA, 15 bp, Homo sapiens
actcagaactgtccc

SEQ ID NO: 5155733 - DNA, 22 bp, Homo sapiens
actcagaactgtcggaggaaag

SEQ ID NO: 5155734 - DNA, 17 bp, Homo sapiens
actcagaagacactgat

SEQ ID NO: 5155735 - DNA, 18 bp, Homo sapiens
actcagaagacactgatg

SEQ ID NO: 5155736 - DNA, 12 bp, Homo sapiens
actcagaagaga

SEQ ID NO: 5155737 - DNA, 15 bp, Homo sapiens
actcagaagcctctg

SEQ ID NO: 5155738 - DNA, 16 bp, Homo sapiens
actcagaagcctctgg

SEQ ID NO: 5155739 - DNA, 20 bp, Homo sapiens
actcagaagcctctgggtca

SEQ ID NO: 5155740 - DNA, 17 bp, Homo sapiens
actcagaagcctgaggc

SEQ ID NO: 5155741 - DNA, 18 bp, Homo sapiens
actcagaagcctgaggct

SEQ ID NO: 5155742 - DNA, 14 bp, Homo sapiens
actcagaagcctgg

SEQ ID NO: 5155743 - DNA, 16 bp, Homo sapiens
actcagaagcctgggg

SEQ ID NO: 5155744 - DNA, 17 bp, Homo sapiens
actcagaagcctggggg

SEQ ID NO: 5155745 - DNA, 16 bp, Homo sapiens
actcagaagtccagag

SEQ ID NO: 5155746 - DNA, 23 bp, Homo sapiens
actcagaatataacatgtaaaat

SEQ ID NO: 5155747 - DNA, 15 bp, Homo sapiens
actcagaatgctcta

SEQ ID NO: 5155748 - DNA, 17 bp, Homo sapiens
actcagaattattcata

SEQ ID NO: 5155749 - DNA, 15 bp, Homo sapiens
actcagaccagagaa

SEQ ID NO: 5155750 - DNA, 23 bp, Homo sapiens
actcagaccagctcccagatggc

SEQ ID NO: 5155751 - DNA, 20 bp, Homo sapiens
actcagacgtgtgacctcca

SEQ ID NO: 5155752 - DNA, 24 bp, Homo sapiens
actcagacgtgtgacctccatact

SEQ ID NO: 5155753 - DNA, 15 bp, Homo sapiens
actcagagcagagca

SEQ ID NO: 5155754 - DNA, 18 bp, Homo sapiens
actcagagcccctccctg

SEQ ID NO: 5155755 - DNA, 20 bp, Homo sapiens
actcagagctctctctacag

SEQ ID NO: 5155756 - DNA, 11 bp, Homo sapiens
actcagagctg

SEQ ID NO: 5155757 - DNA, 12 bp, Homo sapiens
actcagagctgc

SEQ ID NO: 5155758 - DNA, 20 bp, Homo sapiens
actcagagctgcgggctgag

SEQ ID NO: 5155759 - DNA, 21 bp, Homo sapiens
actcagagctgcgggctgagg

SEQ ID NO: 5155760 - DNA, 14 bp, Homo sapiens
actcagaggccccc

SEQ ID NO: 5155761 - DNA, 17 bp, Homo sapiens
actcagaggcccccagt

SEQ ID NO: 5155762 - DNA, 13 bp, Homo sapiens
actcagaggctga

SEQ ID NO: 5155763 - DNA, 14 bp, Homo sapiens
actcagaggctggg

SEQ ID NO: 5155764 - DNA, 18 bp, Homo sapiens
actcagaggctgggagca

SEQ ID NO: 5155765 - DNA, 19 bp, Homo sapiens
actcagaggtccaggcccc

SEQ ID NO: 5155766 - DNA, 16 bp, Homo sapiens
actcagatcactactg

SEQ ID NO: 5155767 - DNA, 21 bp, Homo sapiens
actcagatcactactgcagtc

SEQ ID NO: 5155768 - DNA, 13 bp, Homo sapiens
actcagatctgat

SEQ ID NO: 5155769 - DNA, 19 bp, Homo sapiens
actcagatctgatcaagag

SEQ ID NO: 5155770 - DNA, 23 bp, Homo sapiens
actcagatgaccccagaaactga

SEQ ID NO: 5155771 - DNA, 17 bp, Homo sapiens
actcagatgaggacaga

SEQ ID NO: 5155772 - DNA, 17 bp, Homo sapiens
actcagatgatgccagc

SEQ ID NO: 5155773 - DNA, 21 bp, Homo sapiens
actcagatggaaccgcaggaa

SEQ ID NO: 5155774 - DNA, 19 bp, Homo sapiens
actcagattgactaaataa

SEQ ID NO: 5155775 - DNA, 16 bp, Homo sapiens
actcagatttaagcct

SEQ ID NO: 5155776 - DNA, 19 bp, Homo sapiens
actcagcaactgttagctg

SEQ ID NO: 5155777 - DNA, 14 bp, Homo sapiens
actcagcaccactc

SEQ ID NO: 5155778 - DNA, 22 bp, Homo sapiens
actcagcaccactcaagaccaa

SEQ ID NO: 5155779 - DNA, 18 bp, Homo sapiens
actcagcactctggactc

SEQ ID NO: 5155780 - DNA, 18 bp, Homo sapiens
actcagcagaggcagtgg

SEQ ID NO: 5155781 - DNA, 14 bp, Homo sapiens
actcagcagagtga

SEQ ID NO: 5155782 - DNA, 16 bp, Homo sapiens
actcagcagcagagag

SEQ ID NO: 5155783 - DNA, 17 bp, Homo sapiens
actcagcagcagagagc

SEQ ID NO: 5155784 - DNA, 19 bp, Homo sapiens
actcagcagcagagagccc

SEQ ID NO: 5155785 - DNA, 21 bp, Homo sapiens
actcagcagcagagagccctg

SEQ ID NO: 5155786 - DNA, 15 bp, Homo sapiens
actcagcagccctcc

SEQ ID NO: 5155787 - DNA, 17 bp, Homo sapiens
actcagcagccctcctc

SEQ ID NO: 5155788 - DNA, 19 bp, Homo sapiens
actcagcagccctcctcac

SEQ ID NO: 5155789 - DNA, 23 bp, Homo sapiens
actcagcatttgattaacatttg

SEQ ID NO: 5155790 - DNA, 14 bp, Homo sapiens
actcagccaagcac

SEQ ID NO: 5155791 - DNA, 17 bp, Homo sapiens
actcagccaagcacagt

SEQ ID NO: 5155792 - DNA, 18 bp, Homo sapiens
actcagccaagcacagtg

SEQ ID NO: 5155793 - DNA, 22 bp, Homo sapiens
actcagccaagcacagtggtgg

SEQ ID NO: 5155794 - DNA, 14 bp, Homo sapiens
actcagccacaccc

SEQ ID NO: 5155795 - DNA, 17 bp, Homo sapiens
actcagccaccctgagt

SEQ ID NO: 5155796 - DNA, 18 bp, Homo sapiens
actcagccaccctgagtt

SEQ ID NO: 5155797 - DNA, 19 bp, Homo sapiens
actcagccacgaccagccc

SEQ ID NO: 5155798 - DNA, 20 bp, Homo sapiens
actcagccactgtcacaggc

SEQ ID NO: 5155799 - DNA, 21 bp, Homo sapiens
actcagccactgtcacaggca

SEQ ID NO: 5155800 - DNA, 23 bp, Homo sapiens
actcagccatttccccctcctca

SEQ ID NO: 5155801 - DNA, 22 bp, Homo sapiens
actcagccatttctaagcagat

SEQ ID NO: 5155802 - DNA, 14 bp, Homo sapiens
actcagcccagctg

SEQ ID NO: 5155803 - DNA, 16 bp, Homo sapiens
actcagcccagctggc

SEQ ID NO: 5155804 - DNA, 17 bp, Homo sapiens
actcagcccagctggcc

SEQ ID NO: 5155805 - DNA, 13 bp, Homo sapiens
actcagcccctac

SEQ ID NO: 5155806 - DNA, 16 bp, Homo sapiens
actcagcccctacccc

SEQ ID NO: 5155807 - DNA, 21 bp, Homo sapiens
actcagccctgggccccacca

SEQ ID NO: 5155808 - DNA, 19 bp, Homo sapiens
actcagcctctgctggaga

SEQ ID NO: 5155809 - DNA, 16 bp, Homo sapiens
actcagcctgcagtta

SEQ ID NO: 5155810 - DNA, 17 bp, Homo sapiens
actcagcctgcagttaa

SEQ ID NO: 5155811 - DNA, 12 bp, Homo sapiens
actcagcctgct

SEQ ID NO: 5155812 - DNA, 18 bp, Homo sapiens
actcagcctgctgcccag

SEQ ID NO: 5155813 - DNA, 12 bp, Homo sapiens
actcagcctgtt

SEQ ID NO: 5155814 - DNA, 11 bp, Homo sapiens
actcagccttc

SEQ ID NO: 5155815 - DNA, 23 bp, Homo sapiens
actcagccttcagacagagagga

SEQ ID NO: 5155816 - DNA, 15 bp, Homo sapiens
actcagccttgcaaa

SEQ ID NO: 5155817 - DNA, 18 bp, Homo sapiens
actcagcgctcctcctgt

SEQ ID NO: 5155818 - DNA, 20 bp, Homo sapiens
actcagcgctcctcctgtgt

SEQ ID NO: 5155819 - DNA, 20 bp, Homo sapiens
actcagctattaagaaaatc

SEQ ID NO: 5155820 - DNA, 15 bp, Homo sapiens
actcagctccccaga

SEQ ID NO: 5155821 - DNA, 15 bp, Homo sapiens
actcagctctgtctg

SEQ ID NO: 5155822 - DNA, 14 bp, Homo sapiens
actcagctgtcctg

SEQ ID NO: 5155823 - DNA, 18 bp, Homo sapiens
actcagctgtctgtggct

SEQ ID NO: 5155824 - DNA, 22 bp, Homo sapiens
actcagcttaattctccttccc

SEQ ID NO: 5155825 - DNA, 21 bp, Homo sapiens
actcagcttcggggccggtga

SEQ ID NO: 5155826 - DNA, 20 bp, Homo sapiens
actcagcttggttcctgccc

SEQ ID NO: 5155827 - DNA, 17 bp, Homo sapiens
actcagctttagttttt

SEQ ID NO: 5155828 - DNA, 16 bp, Homo sapiens
actcaggaaccctgga

SEQ ID NO: 5155829 - DNA, 18 bp, Homo sapiens
actcaggaaccctggaga

SEQ ID NO: 5155830 - DNA, 19 bp, Homo sapiens
actcaggaaccctggagac

SEQ ID NO: 5155831 - DNA, 20 bp, Homo sapiens
actcaggaaccctggagaca

SEQ ID NO: 5155832 - DNA, 21 bp, Homo sapiens
actcaggaaccctggagacag

SEQ ID NO: 5155833 - DNA, 22 bp, Homo sapiens
actcaggaaccctggagacaga

SEQ ID NO: 5155834 - DNA, 13 bp, Homo sapiens
actcaggaacttt

SEQ ID NO: 5155835 - DNA, 18 bp, Homo sapiens
actcaggaacttttgtta

SEQ ID NO: 5155836 - DNA, 13 bp, Homo sapiens
actcaggaagaac

SEQ ID NO: 5155837 - DNA, 12 bp, Homo sapiens
actcaggactcc

SEQ ID NO: 5155838 - DNA, 15 bp, Homo sapiens
actcaggactccagc

SEQ ID NO: 5155839 - DNA, 19 bp, Homo sapiens
actcaggagcacagccata

SEQ ID NO: 5155840 - DNA, 20 bp, Homo sapiens
actcaggagcacagccatag

SEQ ID NO: 5155841 - DNA, 12 bp, Homo sapiens
actcaggagccc

SEQ ID NO: 5155842 - DNA, 16 bp, Homo sapiens
actcaggagcctgtga

SEQ ID NO: 5155843 - DNA, 12 bp, Homo sapiens
actcaggaggct

SEQ ID NO: 5155844 - DNA, 17 bp, Homo sapiens
actcaggaggctgaggc

SEQ ID NO: 5155845 - DNA, 20 bp, Homo sapiens
actcaggaggctgaggcaga

SEQ ID NO: 5155846 - DNA, 22 bp, Homo sapiens
actcaggaggctgaggcaggag

SEQ ID NO: 5155847 - DNA, 18 bp, Homo sapiens
actcaggaggctgagggg

SEQ ID NO: 5155848 - DNA, 18 bp, Homo sapiens
actcaggagtctgccact

SEQ ID NO: 5155849 - DNA, 22 bp, Homo sapiens
actcaggatgccaagtggccct

SEQ ID NO: 5155850 - DNA, 17 bp, Homo sapiens
actcaggatgcccaggg

SEQ ID NO: 5155851 - DNA, 13 bp, Homo sapiens
actcaggattctc

SEQ ID NO: 5155852 - DNA, 16 bp, Homo sapiens
actcaggcagtgcagt

SEQ ID NO: 5155853 - DNA, 19 bp, Homo sapiens
actcaggccacagtggggc

SEQ ID NO: 5155854 - DNA, 17 bp, Homo sapiens
actcaggcccaaagcct

SEQ ID NO: 5155855 - DNA, 23 bp, Homo sapiens
actcaggcctccatcttctcatg

SEQ ID NO: 5155856 - DNA, 16 bp, Homo sapiens
actcaggcctctgcag

SEQ ID NO: 5155857 - DNA, 18 bp, Homo sapiens
actcaggcctctgcagaa

SEQ ID NO: 5155858 - DNA, 14 bp, Homo sapiens
actcaggcctgcca

SEQ ID NO: 5155859 - DNA, 17 bp, Homo sapiens
actcaggcctgtgccca

SEQ ID NO: 5155860 - DNA, 21 bp, Homo sapiens
actcaggcctgtgtgactcca

SEQ ID NO: 5155861 - DNA, 14 bp, Homo sapiens
actcaggcgcctgg

SEQ ID NO: 5155862 - DNA, 16 bp, Homo sapiens
actcaggcgcctggca

SEQ ID NO: 5155863 - DNA, 23 bp, Homo sapiens
actcaggcgcctggcacatttca

SEQ ID NO: 5155864 - DNA, 20 bp, Homo sapiens
actcaggcgggacagtgctg

SEQ ID NO: 5155865 - DNA, 18 bp, Homo sapiens
actcaggctgctccttct

SEQ ID NO: 5155866 - DNA, 16 bp, Homo sapiens
actcaggctttctatt

SEQ ID NO: 5155867 - DNA, 16 bp, Homo sapiens
actcagggattccttc

SEQ ID NO: 5155868 - DNA, 20 bp, Homo sapiens
actcagggcagcgccaggct

SEQ ID NO: 5155869 - DNA, 14 bp, Homo sapiens
actcagggccccag

SEQ ID NO: 5155870 - DNA, 16 bp, Homo sapiens
actcagggctcctccc

SEQ ID NO: 5155871 - DNA, 15 bp, Homo sapiens
actcagggctggccc

SEQ ID NO: 5155872 - DNA, 17 bp, Homo sapiens
acggcctggctggtggg

SEQ ID NO: 5155873 - DNA, 23 bp, Homo sapiens
acggcctggctggtgggaaggcc

SEQ ID NO: 5155874 - DNA, 12 bp, Homo sapiens
acggcctgggag

SEQ ID NO: 5155875 - DNA, 14 bp, Homo sapiens
acggcctgggaggg

SEQ ID NO: 5155876 - DNA, 19 bp, Homo sapiens
acggccttcgacctggacg

SEQ ID NO: 5155877 - DNA, 22 bp, Homo sapiens
acggccttcttggtttcagcca

SEQ ID NO: 5155878 - DNA, 14 bp, Homo sapiens
acggcctttctagc

SEQ ID NO: 5155879 - DNA, 23 bp, Homo sapiens
acggcgcacctatcacccaggct

SEQ ID NO: 5155880 - DNA, 13 bp, Homo sapiens
acggcggccaggc

SEQ ID NO: 5155881 - DNA, 15 bp, Homo sapiens
acggcggccaggcac

SEQ ID NO: 5155882 - DNA, 18 bp, Homo sapiens
acggcggccaggcacagg

SEQ ID NO: 5155883 - DNA, 19 bp, Homo sapiens
acggcggccaggcacaggg

SEQ ID NO: 5155884 - DNA, 18 bp, Homo sapiens
acggcgggatcctccaca

SEQ ID NO: 5155885 - DNA, 13 bp, Homo sapiens
acggcgttttttt

SEQ ID NO: 5155886 - DNA, 21 bp, Homo sapiens
acggctaacctggacctggaa

SEQ ID NO: 5155887 - DNA, 14 bp, Homo sapiens
acggctactctata

SEQ ID NO: 5155888 - DNA, 14 bp, Homo sapiens
acggctcactgcag

SEQ ID NO: 5155889 - DNA, 15 bp, Homo sapiens
acggctcactgcagc

SEQ ID NO: 5155890 - DNA, 17 bp, Homo sapiens
acggctcactgcagcct

SEQ ID NO: 5155891 - DNA, 18 bp, Homo sapiens
acggctcactgcagcctc

SEQ ID NO: 5155892 - DNA, 16 bp, Homo sapiens
acggctcccccaggcc

SEQ ID NO: 5155893 - DNA, 19 bp, Homo sapiens
acggctcccccaggcctga

SEQ ID NO: 5155894 - DNA, 21 bp, Homo sapiens
acggctccgagggcggccagg

SEQ ID NO: 5155895 - DNA, 13 bp, Homo sapiens
acggctcctcccc

SEQ ID NO: 5155896 - DNA, 17 bp, Homo sapiens
acggctcctccccgatc

SEQ ID NO: 5155897 - DNA, 19 bp, Homo sapiens
acggctcgatttctccagg

SEQ ID NO: 5155898 - DNA, 18 bp, Homo sapiens
acggctctaggtggggcg

SEQ ID NO: 5155899 - DNA, 16 bp, Homo sapiens
acggctctccagacct

SEQ ID NO: 5155900 - DNA, 22 bp, Homo sapiens
acggctctgggggtgggaagtg

SEQ ID NO: 5155901 - DNA, 15 bp, Homo sapiens
acggctctgtgcccg

SEQ ID NO: 5155902 - DNA, 20 bp, Homo sapiens
acggctctgtgcccggtgcc

SEQ ID NO: 5155903 - DNA, 18 bp, Homo sapiens
acggctgcgcactgtgtc

SEQ ID NO: 5155904 - DNA, 14 bp, Homo sapiens
acggctggacctgc

SEQ ID NO: 5155905 - DNA, 22 bp, Homo sapiens
acggctgggcacacgcctccca

SEQ ID NO: 5155906 - DNA, 12 bp, Homo sapiens
acggctggggac

SEQ ID NO: 5155907 - DNA, 22 bp, Homo sapiens
acggctgggtgtttcagtttga

SEQ ID NO: 5155908 - DNA, 17 bp, Homo sapiens
acggctggtcactctgc

SEQ ID NO: 5155909 - DNA, 18 bp, Homo sapiens
acggctggtcactctgcc

SEQ ID NO: 5155910 - DNA, 22 bp, Homo sapiens
acggctggtcactctgccctct

SEQ ID NO: 5155911 - DNA, 21 bp, Homo sapiens
acggctgtgacgcagccggag

SEQ ID NO: 5155912 - DNA, 22 bp, Homo sapiens
acggctgtggaccgtggacagg

SEQ ID NO: 5155913 - DNA, 23 bp, Homo sapiens
acggctgtggaccgtggacaggc

SEQ ID NO: 5155914 - DNA, 18 bp, Homo sapiens
acggctgtgtatttctgt

SEQ ID NO: 5155915 - DNA, 22 bp, Homo sapiens
acggctgtgtatttctgtagaa

SEQ ID NO: 5155916 - DNA, 13 bp, Homo sapiens
acggcttcaggcc

SEQ ID NO: 5155917 - DNA, 17 bp, Homo sapiens
acggcttcctcattcct

SEQ ID NO: 5155918 - DNA, 18 bp, Homo sapiens
acgggaacatgccccctg

SEQ ID NO: 5155919 - DNA, 21 bp, Homo sapiens
acgggaagcgctcagaacagt

SEQ ID NO: 5155920 - DNA, 15 bp, Homo sapiens
acgggactctggtgg

SEQ ID NO: 5155921 - DNA, 18 bp, Homo sapiens
acgggactgcggaggaag

SEQ ID NO: 5155922 - DNA, 12 bp, Homo sapiens
acgggagagcgc

SEQ ID NO: 5155923 - DNA, 15 bp, Homo sapiens
acgggaggccccagc

SEQ ID NO: 5155924 - DNA, 14 bp, Homo sapiens
acgggaggcctcag

SEQ ID NO: 5155925 - DNA, 15 bp, Homo sapiens
acgggaggcctcagt

SEQ ID NO: 5155926 - DNA, 13 bp, Homo sapiens
acgggaggctggg

SEQ ID NO: 5155927 - DNA, 15 bp, Homo sapiens
acgggaggctgggca

SEQ ID NO: 5155928 - DNA, 18 bp, Homo sapiens
acgggatgacctccagaa

SEQ ID NO: 5155929 - DNA, 24 bp, Homo sapiens
acgggatgattgcttgagctcagg

SEQ ID NO: 5155930 - DNA, 16 bp, Homo sapiens
acgggatgctctttaa

SEQ ID NO: 5155931 - DNA, 20 bp, Homo sapiens
acgggcaacactcactgcct

SEQ ID NO: 5155932 - DNA, 21 bp, Homo sapiens
acgggcacaagacccctgctc

SEQ ID NO: 5155933 - DNA, 15 bp, Homo sapiens
acgggcacagctgct

SEQ ID NO: 5155934 - DNA, 13 bp, Homo sapiens
acgggcagccaca

SEQ ID NO: 5155935 - DNA, 23 bp, Homo sapiens
acgggcagccacaggactgagcc

SEQ ID NO: 5155936 - DNA, 16 bp, Homo sapiens
acgggcagtagctgtg

SEQ ID NO: 5155937 - DNA, 17 bp, Homo sapiens
acgggcagtctgctctg

SEQ ID NO: 5155938 - DNA, 19 bp, Homo sapiens
acgggcagtctgctctgct

SEQ ID NO: 5155939 - DNA, 23 bp, Homo sapiens
acgggcatgcacacggctggtca

SEQ ID NO: 5155940 - DNA, 16 bp, Homo sapiens
acgggcatgggcctct

SEQ ID NO: 5155941 - DNA, 22 bp, Homo sapiens
acgggcatgggcctctctgggg

SEQ ID NO: 5155942 - DNA, 13 bp, Homo sapiens
acgggccaggccc

SEQ ID NO: 5155943 - DNA, 16 bp, Homo sapiens
acgggccctccttccc

SEQ ID NO: 5155944 - DNA, 14 bp, Homo sapiens
acgggcctcagttt

SEQ ID NO: 5155945 - DNA, 17 bp, Homo sapiens
acgggcctcagtttccc

SEQ ID NO: 5155946 - DNA, 17 bp, Homo sapiens
acgggcctgtccacagg

SEQ ID NO: 5155947 - DNA, 18 bp, Homo sapiens
acgggcgctgcagcctcc

SEQ ID NO: 5155948 - DNA, 23 bp, Homo sapiens
acgggcggggctgtgcgggcgcc

SEQ ID NO: 5155949 - DNA, 22 bp, Homo sapiens
acgggctcatgcacccctgagc

SEQ ID NO: 5155950 - DNA, 13 bp, Homo sapiens
acgggctccttcc

SEQ ID NO: 5155951 - DNA, 20 bp, Homo sapiens
acgggctgtccgtgtgcctc

SEQ ID NO: 5155952 - DNA, 22 bp, Homo sapiens
acgggctgtccgtgtgcctcct

SEQ ID NO: 5155953 - DNA, 23 bp, Homo sapiens
acgggctgtccgtgtgcctcctg

SEQ ID NO: 5155954 - DNA, 23 bp, Homo sapiens
acgggcttgttgctgttgatgtt

SEQ ID NO: 5155955 - DNA, 15 bp, Homo sapiens
acggggaaaatgcat

SEQ ID NO: 5155956 - DNA, 19 bp, Homo sapiens
acggggacacggcctctgg

SEQ ID NO: 5155957 - DNA, 17 bp, Homo sapiens
acggggaccactgggcc

SEQ ID NO: 5155958 - DNA, 14 bp, Homo sapiens
acggggactgggga

SEQ ID NO: 5155959 - DNA, 18 bp, Homo sapiens
acggggagcggcggaaag

SEQ ID NO: 5155960 - DNA, 23 bp, Homo sapiens
acggggaggccaagtgcaggctg

SEQ ID NO: 5155961 - DNA, 21 bp, Homo sapiens
acggggatggttccccaggag

SEQ ID NO: 5155962 - DNA, 17 bp, Homo sapiens
acggggcaaagctgctg

SEQ ID NO: 5155963 - DNA, 13 bp, Homo sapiens
acggggcagagct

SEQ ID NO: 5155964 - DNA, 15 bp, Homo sapiens
acggggcagagctga

SEQ ID NO: 5155965 - DNA, 15 bp, Homo sapiens
acggggcaggcgctg

SEQ ID NO: 5155966 - DNA, 21 bp, Homo sapiens
acggggcagtactcctccctg

SEQ ID NO: 5155967 - DNA, 22 bp, Homo sapiens
acggggccacgtgtgctgtggc

SEQ ID NO: 5155968 - DNA, 20 bp, Homo sapiens
acggggccgacattgtctcc

SEQ ID NO: 5155969 - DNA, 14 bp, Homo sapiens
acggggctcccctg

SEQ ID NO: 5155970 - DNA, 15 bp, Homo sapiens
acggggctcccctgg

SEQ ID NO: 5155971 - DNA, 14 bp, Homo sapiens
acgggggcagtgtg

SEQ ID NO: 5155972 - DNA, 15 bp, Homo sapiens
acgggggcagtgtga

SEQ ID NO: 5155973 - DNA, 15 bp, Homo sapiens
acgggggctgcttct

SEQ ID NO: 5155974 - DNA, 14 bp, Homo sapiens
acggggggccccag

SEQ ID NO: 5155975 - DNA, 15 bp, Homo sapiens
acggggggccccagt

SEQ ID NO: 5155976 - DNA, 19 bp, Homo sapiens
acggggggctcctgcccag

SEQ ID NO: 5155977 - DNA, 20 bp, Homo sapiens
acgggggtgcggcaggagca

SEQ ID NO: 5155978 - DNA, 18 bp, Homo sapiens
acgggggttggggtgggg

SEQ ID NO: 5155979 - DNA, 14 bp, Homo sapiens
acggggtccttcaa

SEQ ID NO: 5155980 - DNA, 13 bp, Homo sapiens
acggggtcttgct

SEQ ID NO: 5155981 - DNA, 16 bp, Homo sapiens
acggggtggctgaaag

SEQ ID NO: 5155982 - DNA, 12 bp, Homo sapiens
acggggtgggga

SEQ ID NO: 5155983 - DNA, 13 bp, Homo sapiens
acggggtggggag

SEQ ID NO: 5155984 - DNA, 16 bp, Homo sapiens
acggggttacactgtt

SEQ ID NO: 5155985 - DNA, 21 bp, Homo sapiens
acggggttggctgttccagac

SEQ ID NO: 5155986 - DNA, 15 bp, Homo sapiens
acggggtttcaccat

SEQ ID NO: 5155987 - DNA, 20 bp, Homo sapiens
acgggtaacagtgaggctgg

SEQ ID NO: 5155988 - DNA, 23 bp, Homo sapiens
acgggtctcacttataccaaagg

SEQ ID NO: 5155989 - DNA, 22 bp, Homo sapiens
acgggtctgtgggactggccca

SEQ ID NO: 5155990 - DNA, 21 bp, Homo sapiens
acgggtgcccgtaatcccagc

SEQ ID NO: 5155991 - DNA, 15 bp, Homo sapiens
acgggtggaggggaa

SEQ ID NO: 5155992 - DNA, 14 bp, Homo sapiens
acgggtggggaaag

SEQ ID NO: 5155993 - DNA, 13 bp, Homo sapiens
acgggtggtcccc

SEQ ID NO: 5155994 - DNA, 16 bp, Homo sapiens
acgggtgtcacggcca

SEQ ID NO: 5155995 - DNA, 23 bp, Homo sapiens
acgggtgtcacggccaggcagat

SEQ ID NO: 5155996 - DNA, 18 bp, Homo sapiens
acgggttaagatctgaaa

SEQ ID NO: 5155997 - DNA, 19 bp, Homo sapiens
acgggttaagatctgaaag

SEQ ID NO: 5155998 - DNA, 23 bp, Homo sapiens
acgggttagacagccaaaggctg

SEQ ID NO: 5155999 - DNA, 14 bp, Homo sapiens
acgggttgaaagac

SEQ ID NO: 5156000 - DNA, 21 bp, Homo sapiens
acgggttgaaagacatcaatg

SEQ ID NO: 5156001 - DNA, 20 bp, Homo sapiens
acgggttgttttgggtgaat

SEQ ID NO: 5156002 - DNA, 14 bp, Homo sapiens
acggtaagtgttct

SEQ ID NO: 5156003 - DNA, 15 bp, Homo sapiens
acggtaagtgttctc

SEQ ID NO: 5156004 - DNA, 20 bp, Homo sapiens
acggtacgcagcccagagca

SEQ ID NO: 5156005 - DNA, 15 bp, Homo sapiens
acggtcacacctcac

SEQ ID NO: 5156006 - DNA, 21 bp, Homo sapiens
acggtcacacctcactgtcat

SEQ ID NO: 5156007 - DNA, 20 bp, Homo sapiens
acggtcaggtttaacatttg

SEQ ID NO: 5156008 - DNA, 23 bp, Homo sapiens
acggtcaggtttaacatttgcct

SEQ ID NO: 5156009 - DNA, 18 bp, Homo sapiens
acggtcatgatgtctgca

SEQ ID NO: 5156010 - DNA, 21 bp, Homo sapiens
acggtcctttaggcagcctgc

SEQ ID NO: 5156011 - DNA, 21 bp, Homo sapiens
acggtcggggcatctggcctg

SEQ ID NO: 5156012 - DNA, 19 bp, Homo sapiens
acggtctaaacacacttag

SEQ ID NO: 5156013 - DNA, 12 bp, Homo sapiens
acggtctgagct

SEQ ID NO: 5156014 - DNA, 13 bp, Homo sapiens
acggtctggcagg

SEQ ID NO: 5156015 - DNA, 15 bp, Homo sapiens
acggtctggcagggc

SEQ ID NO: 5156016 - DNA, 13 bp, Homo sapiens
acggtctgtgccc

SEQ ID NO: 5156017 - DNA, 16 bp, Homo sapiens
acggtctgtgtgctgt

SEQ ID NO: 5156018 - DNA, 18 bp, Homo sapiens
acggtctgttcttgaagc

SEQ ID NO: 5156019 - DNA, 15 bp, Homo sapiens
acggtgaaagtgctg

SEQ ID NO: 5156020 - DNA, 13 bp, Homo sapiens
acggtgaaatcca

SEQ ID NO: 5156021 - DNA, 14 bp, Homo sapiens
acggtgaaatccag

SEQ ID NO: 5156022 - DNA, 19 bp, Homo sapiens
acggtgaaggtgacagcag

SEQ ID NO: 5156023 - DNA, 17 bp, Homo sapiens
acggtgacaaagatggc

SEQ ID NO: 5156024 - DNA, 21 bp, Homo sapiens
acggtgacacaggtcagggct

SEQ ID NO: 5156025 - DNA, 23 bp, Homo sapiens
acggtgaccgcctcctgctctgc

SEQ ID NO: 5156026 - DNA, 18 bp, Homo sapiens
acggtgagggtgcggggc

SEQ ID NO: 5156027 - DNA, 23 bp, Homo sapiens
acggtgagggtgcggggcctgca

SEQ ID NO: 5156028 - DNA, 18 bp, Homo sapiens
acggtgatattgtgcatg

SEQ ID NO: 5156029 - DNA, 20 bp, Homo sapiens
acggtgatattgtgcatgca

SEQ ID NO: 5156030 - DNA, 14 bp, Homo sapiens
acggtgcccaagcc

SEQ ID NO: 5156031 - DNA, 23 bp, Homo sapiens
acggtgcgcacaccgccagcagc

SEQ ID NO: 5156032 - DNA, 19 bp, Homo sapiens
acggtgcgtggctgtggca

SEQ ID NO: 5156033 - DNA, 23 bp, Homo sapiens
acggtgctatatccagttcctgc

SEQ ID NO: 5156034 - DNA, 23 bp, Homo sapiens
acggtgctatttctattccttat

SEQ ID NO: 5156035 - DNA, 20 bp, Homo sapiens
acggtgctgtgagggagggg

SEQ ID NO: 5156036 - DNA, 21 bp, Homo sapiens
acggtggcggctgcacaacag

SEQ ID NO: 5156037 - DNA, 18 bp, Homo sapiens
acggtgggcatttgtgag

SEQ ID NO: 5156038 - DNA, 19 bp, Homo sapiens
acggtgggcatttgtgagg

SEQ ID NO: 5156039 - DNA, 18 bp, Homo sapiens
acggtggtgcatgcctgt

SEQ ID NO: 5156040 - DNA, 17 bp, Homo sapiens
acggtgttaattttgct

SEQ ID NO: 5156041 - DNA, 21 bp, Homo sapiens
acggtgttaattttgctaact

SEQ ID NO: 5156042 - DNA, 22 bp, Homo sapiens
acggtgttaattttgctaactg

SEQ ID NO: 5156043 - DNA, 13 bp, Homo sapiens
acggtgttgcaga

SEQ ID NO: 5156044 - DNA, 15 bp, Homo sapiens
acggtgttttgccat

SEQ ID NO: 5156045 - DNA, 17 bp, Homo sapiens
acggtgttttgccatgt

SEQ ID NO: 5156046 - DNA, 14 bp, Homo sapiens
acggttaactgtaa

SEQ ID NO: 5156047 - DNA, 18 bp, Homo sapiens
acggttaacttgtatatt

SEQ ID NO: 5156048 - DNA, 19 bp, Homo sapiens
acggttcaaacctgtgaag

SEQ ID NO: 5156049 - DNA, 16 bp, Homo sapiens
actcaggggatgttta

SEQ ID NO: 5156050 - DNA, 15 bp, Homo sapiens
actcaggggtcactg

SEQ ID NO: 5156051 - DNA, 16 bp, Homo sapiens
actcagggttcatctg

SEQ ID NO: 5156052 - DNA, 17 bp, Homo sapiens
actcagggttcatctgt

SEQ ID NO: 5156053 - DNA, 21 bp, Homo sapiens
actcaggttcacagcagcttt

SEQ ID NO: 5156054 - DNA, 22 bp, Homo sapiens
actcaggttcacagcagctttg

SEQ ID NO: 5156055 - DNA, 22 bp, Homo sapiens
actcaggttccagaacagccct

SEQ ID NO: 5156056 - DNA, 24 bp, Homo sapiens
actcaggttgtctgtagagaatga

SEQ ID NO: 5156057 - DNA, 17 bp, Homo sapiens
actcagtaaaacataat

SEQ ID NO: 5156058 - DNA, 20 bp, Homo sapiens
actcagtaacacagtgcagt

SEQ ID NO: 5156059 - DNA, 18 bp, Homo sapiens
actcagtaacagtgcagt

SEQ ID NO: 5156060 - DNA, 20 bp, Homo sapiens
actcagtaaggcagtgcagt

SEQ ID NO: 5156061 - DNA, 14 bp, Homo sapiens
actcagtaggtctg

SEQ ID NO: 5156062 - DNA, 21 bp, Homo sapiens
actcagtaggtctgaaggcct

SEQ ID NO: 5156063 - DNA, 23 bp, Homo sapiens
actcagtaggtctgaaggcctcc

SEQ ID NO: 5156064 - DNA, 23 bp, Homo sapiens
actcagtatagcattgaacattt

SEQ ID NO: 5156065 - DNA, 20 bp, Homo sapiens
actcagtatgctttccctga

SEQ ID NO: 5156066 - DNA, 23 bp, Homo sapiens
actcagtatgctttccctgagga

SEQ ID NO: 5156067 - DNA, 14 bp, Homo sapiens
actcagtcaaatgt

SEQ ID NO: 5156068 - DNA, 19 bp, Homo sapiens
actcagtccactgttgagc

SEQ ID NO: 5156069 - DNA, 22 bp, Homo sapiens
actcagtcccccaccacactga

SEQ ID NO: 5156070 - DNA, 17 bp, Homo sapiens
actcagtctctcttctc

SEQ ID NO: 5156071 - DNA, 23 bp, Homo sapiens
actcagtctctcttctctccagc

SEQ ID NO: 5156072 - DNA, 16 bp, Homo sapiens
actcagtgaaatcata

SEQ ID NO: 5156073 - DNA, 11 bp, Homo sapiens
actcagtgagc

SEQ ID NO: 5156074 - DNA, 15 bp, Homo sapiens
actcagtgaggccgc

SEQ ID NO: 5156075 - DNA, 21 bp, Homo sapiens
actcagtgcagggacagcctg

SEQ ID NO: 5156076 - DNA, 18 bp, Homo sapiens
actcagtgcctccacatg

SEQ ID NO: 5156077 - DNA, 22 bp, Homo sapiens
actcagtggacactcagaccag

SEQ ID NO: 5156078 - DNA, 14 bp, Homo sapiens
actcagtggacagt

SEQ ID NO: 5156079 - DNA, 22 bp, Homo sapiens
actcagtgggccaattgttctt

SEQ ID NO: 5156080 - DNA, 13 bp, Homo sapiens
actcagtgtattt

SEQ ID NO: 5156081 - DNA, 17 bp, Homo sapiens
actcagtgtattttaaa

SEQ ID NO: 5156082 - DNA, 20 bp, Homo sapiens
actcagtgtctgcctttaaa

SEQ ID NO: 5156083 - DNA, 21 bp, Homo sapiens
actcagtgtctgcctttaaat

SEQ ID NO: 5156084 - DNA, 21 bp, Homo sapiens
actcagtgtggactgggaagc

SEQ ID NO: 5156085 - DNA, 22 bp, Homo sapiens
actcagtgtgtgatccggtttc

SEQ ID NO: 5156086 - DNA, 17 bp, Homo sapiens
actcagtgttagagaaa

SEQ ID NO: 5156087 - DNA, 22 bp, Homo sapiens
actcagttaaaatgtctgtttc

SEQ ID NO: 5156088 - DNA, 14 bp, Homo sapiens
actcagttcttggc

SEQ ID NO: 5156089 - DNA, 14 bp, Homo sapiens
actcagttgttctg

SEQ ID NO: 5156090 - DNA, 19 bp, Homo sapiens
actcagttgttctgagcac

SEQ ID NO: 5156091 - DNA, 16 bp, Homo sapiens
actcagtttatgctgt

SEQ ID NO: 5156092 - DNA, 23 bp, Homo sapiens
actcagtttatgttgtacaatgt

SEQ ID NO: 5156093 - DNA, 14 bp, Homo sapiens
actcagtttcatat

SEQ ID NO: 5156094 - DNA, 23 bp, Homo sapiens
actcagtttcatatattattccg

SEQ ID NO: 5156095 - DNA, 13 bp, Homo sapiens
actcagtttgtca

SEQ ID NO: 5156096 - DNA, 15 bp, Homo sapiens
actcagtttgtcaga

SEQ ID NO: 5156097 - DNA, 13 bp, Homo sapiens
actcagttttttg

SEQ ID NO: 5156098 - DNA, 16 bp, Homo sapiens
actcagttttttgtaa

SEQ ID NO: 5156099 - DNA, 20 bp, Homo sapiens
actcataaaggacactggat

SEQ ID NO: 5156100 - DNA, 20 bp, Homo sapiens
actcataagttggaccagag

SEQ ID NO: 5156101 - DNA, 14 bp, Homo sapiens
actcataatgtgaa

SEQ ID NO: 5156102 - DNA, 15 bp, Homo sapiens
actcataatgtgaag

SEQ ID NO: 5156103 - DNA, 16 bp, Homo sapiens
actcataatgtgaagt

SEQ ID NO: 5156104 - DNA, 23 bp, Homo sapiens
actcatacactcgtatgatactt

SEQ ID NO: 5156105 - DNA, 21 bp, Homo sapiens
actcatacagtggtattgcta

SEQ ID NO: 5156106 - DNA, 23 bp, Homo sapiens
actcatactgtcatataatgcaa

SEQ ID NO: 5156107 - DNA, 20 bp, Homo sapiens
actcatactgtgctggagcc

SEQ ID NO: 5156108 - DNA, 23 bp, Homo sapiens
actcatataaaaggtgagctcag

SEQ ID NO: 5156109 - DNA, 22 bp, Homo sapiens
actcatattactggtaggaact

SEQ ID NO: 5156110 - DNA, 15 bp, Homo sapiens
actcatattttcatg

SEQ ID NO: 5156111 - DNA, 20 bp, Homo sapiens
actcatcaatcaaataagta

SEQ ID NO: 5156112 - DNA, 14 bp, Homo sapiens
actcatcacataaa

SEQ ID NO: 5156113 - DNA, 16 bp, Homo sapiens
actcatcacataaaga

SEQ ID NO: 5156114 - DNA, 13 bp, Homo sapiens
actcatcactgtg

SEQ ID NO: 5156115 - DNA, 9 bp, Homo sapiens
actcatcat

SEQ ID NO: 5156116 - DNA, 12 bp, Homo sapiens
actcatcataaa

SEQ ID NO: 5156117 - DNA, 18 bp, Homo sapiens
actcatccattaatgtag

SEQ ID NO: 5156118 - DNA, 22 bp, Homo sapiens
actcatccccacagctggctct

SEQ ID NO: 5156119 - DNA, 17 bp, Homo sapiens
actcatccgcctggccc

SEQ ID NO: 5156120 - DNA, 16 bp, Homo sapiens
actcatcctcttttaa

SEQ ID NO: 5156121 - DNA, 18 bp, Homo sapiens
actcatcctgaacagcat

SEQ ID NO: 5156122 - DNA, 20 bp, Homo sapiens
actcatcctgtgtggggagg

SEQ ID NO: 5156123 - DNA, 19 bp, Homo sapiens
actcatcgggcccagggac

SEQ ID NO: 5156124 - DNA, 15 bp, Homo sapiens
actcatctgaaatgt

SEQ ID NO: 5156125 - DNA, 19 bp, Homo sapiens
actcatctggagttctcaa

SEQ ID NO: 5156126 - DNA, 12 bp, Homo sapiens
actcatcttagg

SEQ ID NO: 5156127 - DNA, 22 bp, Homo sapiens
actcatcttagtgcctgagagt

SEQ ID NO: 5156128 - DNA, 12 bp, Homo sapiens
actcatcttata

SEQ ID NO: 5156129 - DNA, 22 bp, Homo sapiens
actcatcttggccctcctcagc

SEQ ID NO: 5156130 - DNA, 20 bp, Homo sapiens
actcatctttagagcaacag

SEQ ID NO: 5156131 - DNA, 13 bp, Homo sapiens
actcatctttccc

SEQ ID NO: 5156132 - DNA, 20 bp, Homo sapiens
actcatctttccctccttgg

SEQ ID NO: 5156133 - DNA, 15 bp, Homo sapiens
actcatgaatgaaaa

SEQ ID NO: 5156134 - DNA, 23 bp, Homo sapiens
actcatgaatgaaaatacatctt

SEQ ID NO: 5156135 - DNA, 19 bp, Homo sapiens
actcatgacggcctgcctg

SEQ ID NO: 5156136 - DNA, 21 bp, Homo sapiens
actcatgacggcctgcctgca

SEQ ID NO: 5156137 - DNA, 17 bp, Homo sapiens
actcatgactgcatgac

SEQ ID NO: 5156138 - DNA, 14 bp, Homo sapiens
actcatgaggaggg

SEQ ID NO: 5156139 - DNA, 17 bp, Homo sapiens
actcatgcaaactgctt

SEQ ID NO: 5156140 - DNA, 18 bp, Homo sapiens
actcatgcaaactgcttt

SEQ ID NO: 5156141 - DNA, 19 bp, Homo sapiens
actcatgcaaactgcttta

SEQ ID NO: 5156142 - DNA, 18 bp, Homo sapiens
actcatgcggcccagcca

SEQ ID NO: 5156143 - DNA, 23 bp, Homo sapiens
actcatgcggcccagccatgggc

SEQ ID NO: 5156144 - DNA, 12 bp, Homo sapiens
actcatgctgaa

SEQ ID NO: 5156145 - DNA, 13 bp, Homo sapiens
actcatggcagct

SEQ ID NO: 5156146 - DNA, 16 bp, Homo sapiens
actcatgtacattggt

SEQ ID NO: 5156147 - DNA, 17 bp, Homo sapiens
actcatgtgactctttc

SEQ ID NO: 5156148 - DNA, 11 bp, Homo sapiens
actcatgtgta

SEQ ID NO: 5156149 - DNA, 13 bp, Homo sapiens
actcatgtgtatg

SEQ ID NO: 5156150 - DNA, 21 bp, Homo sapiens
actcatgtgtatgggcaaaaa

SEQ ID NO: 5156151 - DNA, 15 bp, Homo sapiens
actcatgttattttt

SEQ ID NO: 5156152 - DNA, 19 bp, Homo sapiens
actcattaaatattctgta

SEQ ID NO: 5156153 - DNA, 23 bp, Homo sapiens
actcattaaatattctgtacatt

SEQ ID NO: 5156154 - DNA, 12 bp, Homo sapiens
actcattaatta

SEQ ID NO: 5156155 - DNA, 20 bp, Homo sapiens
actcattaattcaatgaaat

SEQ ID NO: 5156156 - DNA, 22 bp, Homo sapiens
actcattaattcaatgaaatgg

SEQ ID NO: 5156157 - DNA, 17 bp, Homo sapiens
actcattagaattacca

SEQ ID NO: 5156158 - DNA, 17 bp, Homo sapiens
actcattcacatttcaa

SEQ ID NO: 5156159 - DNA, 13 bp, Homo sapiens
actcattcattag

SEQ ID NO: 5156160 - DNA, 19 bp, Homo sapiens
actcattccagatcccagg

SEQ ID NO: 5156161 - DNA, 13 bp, Homo sapiens
actcattcccagt

SEQ ID NO: 5156162 - DNA, 13 bp, Homo sapiens
actcattccttct

SEQ ID NO: 5156163 - DNA, 13 bp, Homo sapiens
actcattctatcc

SEQ ID NO: 5156164 - DNA, 15 bp, Homo sapiens
actcattgacctgag

SEQ ID NO: 5156165 - DNA, 22 bp, Homo sapiens
actcattgcagcagataacttt

SEQ ID NO: 5156166 - DNA, 20 bp, Homo sapiens
actcattgcatcatttacaa

SEQ ID NO: 5156167 - DNA, 16 bp, Homo sapiens
actcattgcccccacc

SEQ ID NO: 5156168 - DNA, 18 bp, Homo sapiens
actcatttacaactgaaa

SEQ ID NO: 5156169 - DNA, 15 bp, Homo sapiens
actcatttcatctca

SEQ ID NO: 5156170 - DNA, 14 bp, Homo sapiens
actcatttctaaaa

SEQ ID NO: 5156171 - DNA, 17 bp, Homo sapiens
actcatttctaaaagaa

SEQ ID NO: 5156172 - DNA, 19 bp, Homo sapiens
actcatttctaaaagaata

SEQ ID NO: 5156173 - DNA, 19 bp, Homo sapiens
actcatttggatataaatc

SEQ ID NO: 5156174 - DNA, 20 bp, Homo sapiens
actcatttgggtattttgtc

SEQ ID NO: 5156175 - DNA, 22 bp, Homo sapiens
actcatttgggtattttgtcag

SEQ ID NO: 5156176 - DNA, 16 bp, Homo sapiens
actcattttctataac

SEQ ID NO: 5156177 - DNA, 15 bp, Homo sapiens
actcatttttgccat

SEQ ID NO: 5156178 - DNA, 21 bp, Homo sapiens
actcatttttgccatacatca

SEQ ID NO: 5156179 - DNA, 13 bp, Homo sapiens
actccaaaaacag

SEQ ID NO: 5156180 - DNA, 20 bp, Homo sapiens
actccaaaaagaaaagtgtt

SEQ ID NO: 5156181 - DNA, 16 bp, Homo sapiens
actccaaaaagaaata

SEQ ID NO: 5156182 - DNA, 18 bp, Homo sapiens
actccaaaacccatgtgg

SEQ ID NO: 5156183 - DNA, 18 bp, Homo sapiens
actccaaaataggtgctg

SEQ ID NO: 5156184 - DNA, 22 bp, Homo sapiens
actccaaaatgttggtcatttt

SEQ ID NO: 5156185 - DNA, 15 bp, Homo sapiens
actccaaagaaatgt

SEQ ID NO: 5156186 - DNA, 13 bp, Homo sapiens
actccaaagagaa

SEQ ID NO: 5156187 - DNA, 23 bp, Homo sapiens
actccaacctaacctgtgtctgc

SEQ ID NO: 5156188 - DNA, 14 bp, Homo sapiens
actccaactcttcc

SEQ ID NO: 5156189 - DNA, 20 bp, Homo sapiens
actccaagaccaccagggtc

SEQ ID NO: 5156190 - DNA, 21 bp, Homo sapiens
actccaagagggaatggtcaa

SEQ ID NO: 5156191 - DNA, 16 bp, Homo sapiens
actccaagatgccctc

SEQ ID NO: 5156192 - DNA, 15 bp, Homo sapiens
actccaagcagactc

SEQ ID NO: 5156193 - DNA, 17 bp, Homo sapiens
actccaagcagactcca

SEQ ID NO: 5156194 - DNA, 18 bp, Homo sapiens
actccaagcagactccag

SEQ ID NO: 5156195 - DNA, 19 bp, Homo sapiens
actccaagcagactccagc

SEQ ID NO: 5156196 - DNA, 21 bp, Homo sapiens
actccaagcagactccagccc

SEQ ID NO: 5156197 - DNA, 23 bp, Homo sapiens
actccaagcagactccagcccct

SEQ ID NO: 5156198 - DNA, 14 bp, Homo sapiens
actccaagccccct

SEQ ID NO: 5156199 - DNA, 21 bp, Homo sapiens
actccaagccccctggcagct

SEQ ID NO: 5156200 - DNA, 22 bp, Homo sapiens
actccaagccccctggcagctg

SEQ ID NO: 5156201 - DNA, 18 bp, Homo sapiens
actccaaggagctactga

SEQ ID NO: 5156202 - DNA, 19 bp, Homo sapiens
actccaaggtttataaagc

SEQ ID NO: 5156203 - DNA, 16 bp, Homo sapiens
actccaagtgccccac

SEQ ID NO: 5156204 - DNA, 18 bp, Homo sapiens
actccaatggggccagca

SEQ ID NO: 5156205 - DNA, 19 bp, Homo sapiens
actccaatggggccagcac

SEQ ID NO: 5156206 - DNA, 17 bp, Homo sapiens
actccaattaaggattt

SEQ ID NO: 5156207 - DNA, 19 bp, Homo sapiens
actccacaaatgatgtttt

SEQ ID NO: 5156208 - DNA, 17 bp, Homo sapiens
actccacaccagtaata

SEQ ID NO: 5156209 - DNA, 13 bp, Homo sapiens
actccacactgca

SEQ ID NO: 5156210 - DNA, 16 bp, Homo sapiens
actccacactgcacaa

SEQ ID NO: 5156211 - DNA, 14 bp, Homo sapiens
actccacataagtc

SEQ ID NO: 5156212 - DNA, 17 bp, Homo sapiens
actccacatcaacattc

SEQ ID NO: 5156213 - DNA, 16 bp, Homo sapiens
actccacatcctgtgg

SEQ ID NO: 5156214 - DNA, 16 bp, Homo sapiens
actccacatctgcatc

SEQ ID NO: 5156215 - DNA, 15 bp, Homo sapiens
actccacatctgcct

SEQ ID NO: 5156216 - DNA, 20 bp, Homo sapiens
actccacattcttcagtttt

SEQ ID NO: 5156217 - DNA, 14 bp, Homo sapiens
actccaccaagcct

SEQ ID NO: 5156218 - DNA, 13 bp, Homo sapiens
actccaccaccca

SEQ ID NO: 5156219 - DNA, 14 bp, Homo sapiens
actccaccacccaa

SEQ ID NO: 5156220 - DNA, 19 bp, Homo sapiens
actccaccagatagcagag

SEQ ID NO: 5156221 - DNA, 11 bp, Homo sapiens
actccacccag

SEQ ID NO: 5156222 - DNA, 15 bp, Homo sapiens
actccacccagagta

SEQ ID NO: 5156223 - DNA, 16 bp, Homo sapiens
actccaccctccacct

SEQ ID NO: 5156224 - DNA, 15 bp, Homo sapiens
actccaccctgttag

SEQ ID NO: 5156225 - DNA, 17 bp, Homo sapiens
actccaccgaccaactg

SEQ ID NO: 5156226 - DNA, 19 bp, Homo sapiens
actccaccgaccaactgcc

SEQ ID NO: 5156227 - DNA, 12 bp, Homo sapiens
acggttcaatgg

SEQ ID NO: 5156228 - DNA, 16 bp, Homo sapiens
acggttcaccagcctc

SEQ ID NO: 5156229 - DNA, 19 bp, Homo sapiens
acggttcaccagcctctct

SEQ ID NO: 5156230 - DNA, 23 bp, Homo sapiens
acggttccctgcctaggagctgg

SEQ ID NO: 5156231 - DNA, 12 bp, Homo sapiens
acggttgcctga

SEQ ID NO: 5156232 - DNA, 19 bp, Homo sapiens
acggttgctaaattataaa

SEQ ID NO: 5156233 - DNA, 21 bp, Homo sapiens
acggttgcttcaccttggagc

SEQ ID NO: 5156234 - DNA, 15 bp, Homo sapiens
acggtttccagggag

SEQ ID NO: 5156235 - DNA, 20 bp, Homo sapiens
acggtttctagcctctgaga

SEQ ID NO: 5156236 - DNA, 15 bp, Homo sapiens
acggtttctgttctg

SEQ ID NO: 5156237 - DNA, 18 bp, Homo sapiens
acggtttctgttctgccc

SEQ ID NO: 5156238 - DNA, 17 bp, Homo sapiens
acggtttgaagcctgga

SEQ ID NO: 5156239 - DNA, 21 bp, Homo sapiens
acggttttttattattgtggt

SEQ ID NO: 5156240 - DNA, 16 bp, Homo sapiens
acgtaaaaataaaagc

SEQ ID NO: 5156241 - DNA, 22 bp, Homo sapiens
acgtaaaacatttgtttccccc

SEQ ID NO: 5156242 - DNA, 14 bp, Homo sapiens
acgtaaaatttaca

SEQ ID NO: 5156243 - DNA, 12 bp, Homo sapiens
acgtaaagaact

SEQ ID NO: 5156244 - DNA, 13 bp, Homo sapiens
acgtaaagaattt

SEQ ID NO: 5156245 - DNA, 18 bp, Homo sapiens
acgtaaagctagaaatga

SEQ ID NO: 5156246 - DNA, 14 bp, Homo sapiens
acgtaaatattcat

SEQ ID NO: 5156247 - DNA, 15 bp, Homo sapiens
acgtaaatattcata

SEQ ID NO: 5156248 - DNA, 12 bp, Homo sapiens
acgtaaatccac

SEQ ID NO: 5156249 - DNA, 16 bp, Homo sapiens
acgtaagactttttgg

SEQ ID NO: 5156250 - DNA, 13 bp, Homo sapiens
acgtaagcactgt

SEQ ID NO: 5156251 - DNA, 15 bp, Homo sapiens
acgtaataaggtttt

SEQ ID NO: 5156252 - DNA, 14 bp, Homo sapiens
acgtaatcctcctg

SEQ ID NO: 5156253 - DNA, 18 bp, Homo sapiens
acgtaatgcattgcctgt

SEQ ID NO: 5156254 - DNA, 23 bp, Homo sapiens
acgtaatgtatttatatgttaat

SEQ ID NO: 5156255 - DNA, 13 bp, Homo sapiens
acgtaattaaatc

SEQ ID NO: 5156256 - DNA, 17 bp, Homo sapiens
acgtaattaaatccaac

SEQ ID NO: 5156257 - DNA, 19 bp, Homo sapiens
acgtaattcttcctgtttg

SEQ ID NO: 5156258 - DNA, 21 bp, Homo sapiens
acgtacaaaactctgtataag

SEQ ID NO: 5156259 - DNA, 22 bp, Homo sapiens
acgtacaaaactctgtataagt

SEQ ID NO: 5156260 - DNA, 15 bp, Homo sapiens
acgtacaagtagttc

SEQ ID NO: 5156261 - DNA, 22 bp, Homo sapiens
acgtacaagtagttctgtattt

SEQ ID NO: 5156262 - DNA, 13 bp, Homo sapiens
acgtacacacaca

SEQ ID NO: 5156263 - DNA, 16 bp, Homo sapiens
acgtacaccatatgca

SEQ ID NO: 5156264 - DNA, 21 bp, Homo sapiens
acgtacgggaatgtgctttca

SEQ ID NO: 5156265 - DNA, 18 bp, Homo sapiens
acgtactacggagaaact

SEQ ID NO: 5156266 - DNA, 18 bp, Homo sapiens
acgtactatggaagccac

SEQ ID NO: 5156267 - DNA, 22 bp, Homo sapiens
acgtactatggaagccacatca

SEQ ID NO: 5156268 - DNA, 14 bp, Homo sapiens
acgtactctggtta

SEQ ID NO: 5156269 - DNA, 13 bp, Homo sapiens
acgtactgtaact

SEQ ID NO: 5156270 - DNA, 14 bp, Homo sapiens
acgtactgtaactg

SEQ ID NO: 5156271 - DNA, 23 bp, Homo sapiens
acgtacttaactgtgtgaagaaa

SEQ ID NO: 5156272 - DNA, 16 bp, Homo sapiens
acgtagcaggccatgg

SEQ ID NO: 5156273 - DNA, 15 bp, Homo sapiens
acgtagccacaggag

SEQ ID NO: 5156274 - DNA, 22 bp, Homo sapiens
acgtagccacaggagccctgct

SEQ ID NO: 5156275 - DNA, 12 bp, Homo sapiens
acgtagcctggg

SEQ ID NO: 5156276 - DNA, 14 bp, Homo sapiens
acgtagctctctta

SEQ ID NO: 5156277 - DNA, 16 bp, Homo sapiens
acgtagctgcaaagga

SEQ ID NO: 5156278 - DNA, 24 bp, Homo sapiens
acgtagcttctaccatgaacagaa

SEQ ID NO: 5156279 - DNA, 16 bp, Homo sapiens
acgtagtaaaagtcat

SEQ ID NO: 5156280 - DNA, 15 bp, Homo sapiens
acgtagtgagccttg

SEQ ID NO: 5156281 - DNA, 18 bp, Homo sapiens
acgtagttctagcagtcc

SEQ ID NO: 5156282 - DNA, 13 bp, Homo sapiens
acgtatacaataa

SEQ ID NO: 5156283 - DNA, 17 bp, Homo sapiens
acgtatcacctttccca

SEQ ID NO: 5156284 - DNA, 15 bp, Homo sapiens
acgtatcatttctaa

SEQ ID NO: 5156285 - DNA, 19 bp, Homo sapiens
acgtatgcatgctaaatta

SEQ ID NO: 5156286 - DNA, 21 bp, Homo sapiens
acgtatgcatttttttagttt

SEQ ID NO: 5156287 - DNA, 13 bp, Homo sapiens
acgtatgtatttc

SEQ ID NO: 5156288 - DNA, 23 bp, Homo sapiens
acgtatgtcggcacgtcccatgt

SEQ ID NO: 5156289 - DNA, 22 bp, Homo sapiens
acgtatgtgtgcaggagcctcc

SEQ ID NO: 5156290 - DNA, 20 bp, Homo sapiens
acgtatgtttttgtgtattt

SEQ ID NO: 5156291 - DNA, 17 bp, Homo sapiens
acgtattagttgccaat

SEQ ID NO: 5156292 - DNA, 21 bp, Homo sapiens
acgtattagttgccaatatgc

SEQ ID NO: 5156293 - DNA, 17 bp, Homo sapiens
acgtattgctgtgtctc

SEQ ID NO: 5156294 - DNA, 15 bp, Homo sapiens
acgtatttaatagca

SEQ ID NO: 5156295 - DNA, 18 bp, Homo sapiens
acgtatttagccattacc

SEQ ID NO: 5156296 - DNA, 13 bp, Homo sapiens
acgtatttctcca

SEQ ID NO: 5156297 - DNA, 15 bp, Homo sapiens
acgtatttctccaga

SEQ ID NO: 5156298 - DNA, 18 bp, Homo sapiens
acgtatttctccagaccc

SEQ ID NO: 5156299 - DNA, 22 bp, Homo sapiens
acgtattttgatcagtgttaca

SEQ ID NO: 5156300 - DNA, 19 bp, Homo sapiens
acgtattttgatgttttgt

SEQ ID NO: 5156301 - DNA, 17 bp, Homo sapiens
acgtcacccaaaagcac

SEQ ID NO: 5156302 - DNA, 23 bp, Homo sapiens
acgtcacccaaaagcacaaaatg

SEQ ID NO: 5156303 - DNA, 17 bp, Homo sapiens
acgtcaccctcctgagc

SEQ ID NO: 5156304 - DNA, 19 bp, Homo sapiens
acgtcaccctcctgagcct

SEQ ID NO: 5156305 - DNA, 21 bp, Homo sapiens
acgtcacgtgtagtgtccatt

SEQ ID NO: 5156306 - DNA, 17 bp, Homo sapiens
acgtcactgccagagct

SEQ ID NO: 5156307 - DNA, 17 bp, Homo sapiens
acgtcagatgtttaaaa

SEQ ID NO: 5156308 - DNA, 20 bp, Homo sapiens
acgtcagatgtttaaaacac

SEQ ID NO: 5156309 - DNA, 15 bp, Homo sapiens
acgtcaggccctgac

SEQ ID NO: 5156310 - DNA, 23 bp, Homo sapiens
acgtcaggccctgactcctctgg

SEQ ID NO: 5156311 - DNA, 20 bp, Homo sapiens
acgtcatgagcgtcaaagaa

SEQ ID NO: 5156312 - DNA, 14 bp, Homo sapiens
acgtcattgtgtaa

SEQ ID NO: 5156313 - DNA, 16 bp, Homo sapiens
acgtccaaggtggcag

SEQ ID NO: 5156314 - DNA, 16 bp, Homo sapiens
acgtccaatcatgggc

SEQ ID NO: 5156315 - DNA, 23 bp, Homo sapiens
acgtccaccatggggtcctacca

SEQ ID NO: 5156316 - DNA, 18 bp, Homo sapiens
acgtccacccgtttccaa

SEQ ID NO: 5156317 - DNA, 17 bp, Homo sapiens
acgtccactcccaagcc

SEQ ID NO: 5156318 - DNA, 18 bp, Homo sapiens
acgtccagaatttttcat

SEQ ID NO: 5156319 - DNA, 16 bp, Homo sapiens
acgtccatagctcctc

SEQ ID NO: 5156320 - DNA, 15 bp, Homo sapiens
acgtccatctctctc

SEQ ID NO: 5156321 - DNA, 19 bp, Homo sapiens
acgtccatctctctccctt

SEQ ID NO: 5156322 - DNA, 18 bp, Homo sapiens
acgtcccaccccacctct

SEQ ID NO: 5156323 - DNA, 21 bp, Homo sapiens
acgtcccagcatccctggagc

SEQ ID NO: 5156324 - DNA, 18 bp, Homo sapiens
acgtcccagcggcctcag

SEQ ID NO: 5156325 - DNA, 23 bp, Homo sapiens
acgtcccctccgccgtgccggcg

SEQ ID NO: 5156326 - DNA, 14 bp, Homo sapiens
acgtcccgctgcct

SEQ ID NO: 5156327 - DNA, 19 bp, Homo sapiens
acgtcccgctgctgtgctc

SEQ ID NO: 5156328 - DNA, 12 bp, Homo sapiens
acgtccctccac

SEQ ID NO: 5156329 - DNA, 23 bp, Homo sapiens
acgtccctgcggaagccacaggg

SEQ ID NO: 5156330 - DNA, 23 bp, Homo sapiens
acgtccgtgtgtcccagatgctg

SEQ ID NO: 5156331 - DNA, 16 bp, Homo sapiens
acgtcctatctccccc

SEQ ID NO: 5156332 - DNA, 20 bp, Homo sapiens
acgtcctcgaattctcagac

SEQ ID NO: 5156333 - DNA, 16 bp, Homo sapiens
acgtcctgccacctgg

SEQ ID NO: 5156334 - DNA, 12 bp, Homo sapiens
acgtcctgcctg

SEQ ID NO: 5156335 - DNA, 15 bp, Homo sapiens
acgtcctgcctggca

SEQ ID NO: 5156336 - DNA, 15 bp, Homo sapiens
acgtcctgctggcac

SEQ ID NO: 5156337 - DNA, 20 bp, Homo sapiens
acgtcctgctggcacctcag

SEQ ID NO: 5156338 - DNA, 12 bp, Homo sapiens
acgtcctgggtg

SEQ ID NO: 5156339 - DNA, 20 bp, Homo sapiens
acgtcctggtctttgtttga

SEQ ID NO: 5156340 - DNA, 15 bp, Homo sapiens
acgtcctgtcagtgc

SEQ ID NO: 5156341 - DNA, 21 bp, Homo sapiens
acgtccttgggcgtctctaat

SEQ ID NO: 5156342 - DNA, 17 bp, Homo sapiens
acgtcgaggaccgggca

SEQ ID NO: 5156343 - DNA, 19 bp, Homo sapiens
acgtcgccataaaggcccc

SEQ ID NO: 5156344 - DNA, 23 bp, Homo sapiens
acgtcgcccgctgagctgagtgg

SEQ ID NO: 5156345 - DNA, 13 bp, Homo sapiens
acgtcgctgtccg

SEQ ID NO: 5156346 - DNA, 19 bp, Homo sapiens
acgtcgtcttctgtatact

SEQ ID NO: 5156347 - DNA, 17 bp, Homo sapiens
acgtctagctatgctgt

SEQ ID NO: 5156348 - DNA, 21 bp, Homo sapiens
acgtctatgcaattgtacaaa

SEQ ID NO: 5156349 - DNA, 22 bp, Homo sapiens
acgtctatgcaattgtacaaaa

SEQ ID NO: 5156350 - DNA, 22 bp, Homo sapiens
acgtctatttcatcagaacagc

SEQ ID NO: 5156351 - DNA, 12 bp, Homo sapiens
acgtctcagaga

SEQ ID NO: 5156352 - DNA, 13 bp, Homo sapiens
acgtctcccagat

SEQ ID NO: 5156353 - DNA, 18 bp, Homo sapiens
acgtctcctcctcgaagc

SEQ ID NO: 5156354 - DNA, 14 bp, Homo sapiens
acgtctcctgctgc

SEQ ID NO: 5156355 - DNA, 18 bp, Homo sapiens
acgtctcctgctgcgtga

SEQ ID NO: 5156356 - DNA, 13 bp, Homo sapiens
acgtctctctgcc

SEQ ID NO: 5156357 - DNA, 19 bp, Homo sapiens
acgtctctctgcctgctgg

SEQ ID NO: 5156358 - DNA, 20 bp, Homo sapiens
acgtctctctgcctgctggg

SEQ ID NO: 5156359 - DNA, 23 bp, Homo sapiens
acgtctctctgcctgctgggctc

SEQ ID NO: 5156360 - DNA, 14 bp, Homo sapiens
acgtctctgccgcc

SEQ ID NO: 5156361 - DNA, 17 bp, Homo sapiens
acgtctctgccgcctgc

SEQ ID NO: 5156362 - DNA, 19 bp, Homo sapiens
acgtctctgccgcctgcgt

SEQ ID NO: 5156363 - DNA, 23 bp, Homo sapiens
acgtctgacaggcaatgctggct

SEQ ID NO: 5156364 - DNA, 12 bp, Homo sapiens
acgtctgccagg

SEQ ID NO: 5156365 - DNA, 16 bp, Homo sapiens
acgtctgccaggccca

SEQ ID NO: 5156366 - DNA, 23 bp, Homo sapiens
acgtctggccctggcgggtggct

SEQ ID NO: 5156367 - DNA, 12 bp, Homo sapiens
acgtctggctcc

SEQ ID NO: 5156368 - DNA, 20 bp, Homo sapiens
acgtctggctccctgcccct

SEQ ID NO: 5156369 - DNA, 22 bp, Homo sapiens
acgtctgggagaaattgacaga

SEQ ID NO: 5156370 - DNA, 17 bp, Homo sapiens
acgtctgggtggccctt

SEQ ID NO: 5156371 - DNA, 18 bp, Homo sapiens
acgtctgtcaggggcttg

SEQ ID NO: 5156372 - DNA, 19 bp, Homo sapiens
acgtctgtcaggggcttgg

SEQ ID NO: 5156373 - DNA, 13 bp, Homo sapiens
acgtctgtcttca

SEQ ID NO: 5156374 - DNA, 21 bp, Homo sapiens
acgtcttagagccttttatct

SEQ ID NO: 5156375 - DNA, 13 bp, Homo sapiens
acgtcttcagagt

SEQ ID NO: 5156376 - DNA, 12 bp, Homo sapiens
acgtcttccttc

SEQ ID NO: 5156377 - DNA, 23 bp, Homo sapiens
acgtcttccttctgcctgagctt

SEQ ID NO: 5156378 - DNA, 13 bp, Homo sapiens
acgtctttttaag

SEQ ID NO: 5156379 - DNA, 22 bp, Homo sapiens
acgtctttttaagcctttgaag

SEQ ID NO: 5156380 - DNA, 17 bp, Homo sapiens
acgtctttttgtttgtt

SEQ ID NO: 5156381 - DNA, 18 bp, Homo sapiens
acgtctttttgtttgttt

SEQ ID NO: 5156382 - DNA, 13 bp, Homo sapiens
acgtgaaatactt

SEQ ID NO: 5156383 - DNA, 15 bp, Homo sapiens
acgtgaaatatttaa

SEQ ID NO: 5156384 - DNA, 11 bp, Homo sapiens
acgtgaaattc

SEQ ID NO: 5156385 - DNA, 18 bp, Homo sapiens
acgtgaaatttgcctctg

SEQ ID NO: 5156386 - DNA, 20 bp, Homo sapiens
acgtgaaatttgcctctgtc

SEQ ID NO: 5156387 - DNA, 16 bp, Homo sapiens
acgtgaactaagattt

SEQ ID NO: 5156388 - DNA, 14 bp, Homo sapiens
acgtgaagaaataa

SEQ ID NO: 5156389 - DNA, 17 bp, Homo sapiens
acgtgaataggctgctt

SEQ ID NO: 5156390 - DNA, 14 bp, Homo sapiens
acgtgacaacacaa

SEQ ID NO: 5156391 - DNA, 13 bp, Homo sapiens
acgtgacacaaac

SEQ ID NO: 5156392 - DNA, 19 bp, Homo sapiens
acgtgacagtgcctgggaa

SEQ ID NO: 5156393 - DNA, 18 bp, Homo sapiens
acgtgaccaattgccctg

SEQ ID NO: 5156394 - DNA, 23 bp, Homo sapiens
acgtgaccaattgccctgccagg

SEQ ID NO: 5156395 - DNA, 14 bp, Homo sapiens
acgtgaccagcccc

SEQ ID NO: 5156396 - DNA, 17 bp, Homo sapiens
acgtgaccctgtgcccc

SEQ ID NO: 5156397 - DNA, 21 bp, Homo sapiens
acgtgaccggacttttctgca

SEQ ID NO: 5156398 - DNA, 14 bp, Homo sapiens
acgtgactcagagc

SEQ ID NO: 5156399 - DNA, 15 bp, Homo sapiens
acgtgactcagagct

SEQ ID NO: 5156400 - DNA, 18 bp, Homo sapiens
acgtgactggcctgctgg

SEQ ID NO: 5156401 - DNA, 19 bp, Homo sapiens
acgtgagagaaagagagaa

SEQ ID NO: 5156402 - DNA, 14 bp, Homo sapiens
acgtgagagaaggg

SEQ ID NO: 5156403 - DNA, 16 bp, Homo sapiens
acgtgagagaatctgc

SEQ ID NO: 5156404 - DNA, 14 bp, Homo sapiens
acgtgagagtgtct

SEQ ID NO: 5156405 - DNA, 15 bp, Homo sapiens
acgtgagagtgtctt

SEQ ID NO: 5156406 - DNA, 20 bp, Homo sapiens
actccaccgaccaactgccc

SEQ ID NO: 5156407 - DNA, 22 bp, Homo sapiens
actccaccgaccaactgcccta

SEQ ID NO: 5156408 - DNA, 13 bp, Homo sapiens
actccaccttccc

SEQ ID NO: 5156409 - DNA, 19 bp, Homo sapiens
actccacgatcctgccacc

SEQ ID NO: 5156410 - DNA, 20 bp, Homo sapiens
actccacgatgcctttgagt

SEQ ID NO: 5156411 - DNA, 22 bp, Homo sapiens
actccacggatgcgtgggcaga

SEQ ID NO: 5156412 - DNA, 12 bp, Homo sapiens
actccactcagc

SEQ ID NO: 5156413 - DNA, 14 bp, Homo sapiens
actccactcagcac

SEQ ID NO: 5156414 - DNA, 18 bp, Homo sapiens
actccactcagcacaatt

SEQ ID NO: 5156415 - DNA, 12 bp, Homo sapiens
actccactccaa

SEQ ID NO: 5156416 - DNA, 15 bp, Homo sapiens
actccactcccagca

SEQ ID NO: 5156417 - DNA, 23 bp, Homo sapiens
actccactctccttcgtgtctct

SEQ ID NO: 5156418 - DNA, 22 bp, Homo sapiens
actccactctgattcacctctt

SEQ ID NO: 5156419 - DNA, 15 bp, Homo sapiens
actccactgacctgg

SEQ ID NO: 5156420 - DNA, 17 bp, Homo sapiens
actccactgccctggca

SEQ ID NO: 5156421 - DNA, 23 bp, Homo sapiens
actccactgccctggcagcagca

SEQ ID NO: 5156422 - DNA, 15 bp, Homo sapiens
actccactgcgcctg

SEQ ID NO: 5156423 - DNA, 12 bp, Homo sapiens
actccactggac

SEQ ID NO: 5156424 - DNA, 13 bp, Homo sapiens
actccactggaca

SEQ ID NO: 5156425 - DNA, 15 bp, Homo sapiens
actccactggacaga

SEQ ID NO: 5156426 - DNA, 14 bp, Homo sapiens
actccactgtcttt

SEQ ID NO: 5156427 - DNA, 13 bp, Homo sapiens
actccactgtttt

SEQ ID NO: 5156428 - DNA, 19 bp, Homo sapiens
actccacttggacatgggc

SEQ ID NO: 5156429 - DNA, 23 bp, Homo sapiens
actccagaaatgtccctttcttc

SEQ ID NO: 5156430 - DNA, 22 bp, Homo sapiens
actccagaatctgctgttgcca

SEQ ID NO: 5156431 - DNA, 20 bp, Homo sapiens
actccagaattacccttcct

SEQ ID NO: 5156432 - DNA, 13 bp, Homo sapiens
actccagacccct

SEQ ID NO: 5156433 - DNA, 18 bp, Homo sapiens
actccagacccctggctt

SEQ ID NO: 5156434 - DNA, 15 bp, Homo sapiens
actccagagcccctt

SEQ ID NO: 5156435 - DNA, 16 bp, Homo sapiens
actccagagggacagg

SEQ ID NO: 5156436 - DNA, 16 bp, Homo sapiens
actccagagtctgagc

SEQ ID NO: 5156437 - DNA, 15 bp, Homo sapiens
actccagatctgcac

SEQ ID NO: 5156438 - DNA, 20 bp, Homo sapiens
actccagcaacttcttctcc

SEQ ID NO: 5156439 - DNA, 13 bp, Homo sapiens
actccagcacctg

SEQ ID NO: 5156440 - DNA, 16 bp, Homo sapiens
actccagcacctgtgg

SEQ ID NO: 5156441 - DNA, 12 bp, Homo sapiens
actccagcagat

SEQ ID NO: 5156442 - DNA, 19 bp, Homo sapiens
actccagcagataaggccg

SEQ ID NO: 5156443 - DNA, 16 bp, Homo sapiens
actccagccagcgcct

SEQ ID NO: 5156444 - DNA, 17 bp, Homo sapiens
actccagccagcgcctc

SEQ ID NO: 5156445 - DNA, 18 bp, Homo sapiens
actccagccagggcaaga

SEQ ID NO: 5156446 - DNA, 14 bp, Homo sapiens
actccagcccaaca

SEQ ID NO: 5156447 - DNA, 15 bp, Homo sapiens
actccagcccctgga

SEQ ID NO: 5156448 - DNA, 13 bp, Homo sapiens
actccagcccgca

SEQ ID NO: 5156449 - DNA, 12 bp, Homo sapiens
actccagccctg

SEQ ID NO: 5156450 - DNA, 13 bp, Homo sapiens
actccagcctgag

SEQ ID NO: 5156451 - DNA, 20 bp, Homo sapiens
actccagcctgagcaacaga

SEQ ID NO: 5156452 - DNA, 18 bp, Homo sapiens
actccagcctgggcaaca

SEQ ID NO: 5156453 - DNA, 21 bp, Homo sapiens
actccagcctgggcaacacag

SEQ ID NO: 5156454 - DNA, 15 bp, Homo sapiens
actccagcctgggga

SEQ ID NO: 5156455 - DNA, 14 bp, Homo sapiens
actccagcctgggt

SEQ ID NO: 5156456 - DNA, 17 bp, Homo sapiens
actccagcgcctgccct

SEQ ID NO: 5156457 - DNA, 22 bp, Homo sapiens
actccagcgcctgccctccctg

SEQ ID NO: 5156458 - DNA, 23 bp, Homo sapiens
actccagcggttgccttttttat

SEQ ID NO: 5156459 - DNA, 16 bp, Homo sapiens
actccagcgtcctcag

SEQ ID NO: 5156460 - DNA, 19 bp, Homo sapiens
actccagcgtcctcagcac

SEQ ID NO: 5156461 - DNA, 20 bp, Homo sapiens
actccagctctacgtcccac

SEQ ID NO: 5156462 - DNA, 18 bp, Homo sapiens
actccagctgagtcctgg

SEQ ID NO: 5156463 - DNA, 21 bp, Homo sapiens
actccagctgagtcctggggt

SEQ ID NO: 5156464 - DNA, 16 bp, Homo sapiens
actccagctggtgccc

SEQ ID NO: 5156465 - DNA, 22 bp, Homo sapiens
actccagctggtgcccccagac

SEQ ID NO: 5156466 - DNA, 17 bp, Homo sapiens
actccaggaaaactgtt

SEQ ID NO: 5156467 - DNA, 14 bp, Homo sapiens
actccaggaaagag

SEQ ID NO: 5156468 - DNA, 20 bp, Homo sapiens
actccaggaaggggctggac

SEQ ID NO: 5156469 - DNA, 18 bp, Homo sapiens
actccaggacttagaata

SEQ ID NO: 5156470 - DNA, 17 bp, Homo sapiens
actccaggatcctcctg

SEQ ID NO: 5156471 - DNA, 23 bp, Homo sapiens
actccaggatttaggccttaaca

SEQ ID NO: 5156472 - DNA, 17 bp, Homo sapiens
actccaggatttataaa

SEQ ID NO: 5156473 - DNA, 20 bp, Homo sapiens
actccaggcatgtgtctggc

SEQ ID NO: 5156474 - DNA, 16 bp, Homo sapiens
actccaggcccaaggc

SEQ ID NO: 5156475 - DNA, 21 bp, Homo sapiens
actccaggcccaaggctcccg

SEQ ID NO: 5156476 - DNA, 13 bp, Homo sapiens
actccaggccctg

SEQ ID NO: 5156477 - DNA, 16 bp, Homo sapiens
actccaggccctgccc

SEQ ID NO: 5156478 - DNA, 22 bp, Homo sapiens
actccaggcctctagttccaga

SEQ ID NO: 5156479 - DNA, 19 bp, Homo sapiens
actccaggcctgaccaggg

SEQ ID NO: 5156480 - DNA, 20 bp, Homo sapiens
actccaggcctgaccagggg

SEQ ID NO: 5156481 - DNA, 12 bp, Homo sapiens
actccaggctgg

SEQ ID NO: 5156482 - DNA, 15 bp, Homo sapiens
actccaggctggaag

SEQ ID NO: 5156483 - DNA, 15 bp, Homo sapiens
actccaggctgggct

SEQ ID NO: 5156484 - DNA, 16 bp, Homo sapiens
actccaggctgggctg

SEQ ID NO: 5156485 - DNA, 18 bp, Homo sapiens
actccaggctgggctgag

SEQ ID NO: 5156486 - DNA, 22 bp, Homo sapiens
actccaggcttccacacttctg

SEQ ID NO: 5156487 - DNA, 20 bp, Homo sapiens
actccagggacacacagcct

SEQ ID NO: 5156488 - DNA, 24 bp, Homo sapiens
actccagggacacacagcctagca

SEQ ID NO: 5156489 - DNA, 18 bp, Homo sapiens
actccagggtcccctgcc

SEQ ID NO: 5156490 - DNA, 19 bp, Homo sapiens
actccagggttaaagaaag

SEQ ID NO: 5156491 - DNA, 23 bp, Homo sapiens
actccaggttcgtatagaaaaag

SEQ ID NO: 5156492 - DNA, 18 bp, Homo sapiens
actccagtaaaagttgtg

SEQ ID NO: 5156493 - DNA, 15 bp, Homo sapiens
actccagtactggag

SEQ ID NO: 5156494 - DNA, 17 bp, Homo sapiens
actccagtactggagct

SEQ ID NO: 5156495 - DNA, 16 bp, Homo sapiens
actccagtcaacagat

SEQ ID NO: 5156496 - DNA, 15 bp, Homo sapiens
actccagtcctgcca

SEQ ID NO: 5156497 - DNA, 16 bp, Homo sapiens
actccagtcctgccac

SEQ ID NO: 5156498 - DNA, 20 bp, Homo sapiens
actccagtctcctgacatta

SEQ ID NO: 5156499 - DNA, 21 bp, Homo sapiens
actccagtgccaacaatccta

SEQ ID NO: 5156500 - DNA, 19 bp, Homo sapiens
actccagtgccagcaatga

SEQ ID NO: 5156501 - DNA, 16 bp, Homo sapiens
actccagtgctcagct

SEQ ID NO: 5156502 - DNA, 19 bp, Homo sapiens
actccagtgctcagctgtg

SEQ ID NO: 5156503 - DNA, 22 bp, Homo sapiens
actccagtgctcagctgtggct

SEQ ID NO: 5156504 - DNA, 16 bp, Homo sapiens
actccagtggtgaaga

SEQ ID NO: 5156505 - DNA, 14 bp, Homo sapiens
actccagtgtacat

SEQ ID NO: 5156506 - DNA, 18 bp, Homo sapiens
actccagttaaaaaaaat

SEQ ID NO: 5156507 - DNA, 20 bp, Homo sapiens
actccagttaaaaaaaattt

SEQ ID NO: 5156508 - DNA, 14 bp, Homo sapiens
actccagttgcaga

SEQ ID NO: 5156509 - DNA, 14 bp, Homo sapiens
actccataaaaaga

SEQ ID NO: 5156510 - DNA, 18 bp, Homo sapiens
actccataaaaagaaagc

SEQ ID NO: 5156511 - DNA, 20 bp, Homo sapiens
actccataaaaagaaagcta

SEQ ID NO: 5156512 - DNA, 21 bp, Homo sapiens
actccatacagcctctacagc

SEQ ID NO: 5156513 - DNA, 18 bp, Homo sapiens
actccatactccactcca

SEQ ID NO: 5156514 - DNA, 15 bp, Homo sapiens
actccatatggaggc

SEQ ID NO: 5156515 - DNA, 18 bp, Homo sapiens
actccatatttatttaaa

SEQ ID NO: 5156516 - DNA, 15 bp, Homo sapiens
actccatcactgaga

SEQ ID NO: 5156517 - DNA, 19 bp, Homo sapiens
actccatcagttagagctg

SEQ ID NO: 5156518 - DNA, 15 bp, Homo sapiens
actccatccagctac

SEQ ID NO: 5156519 - DNA, 16 bp, Homo sapiens
actccatcgccatctt

SEQ ID NO: 5156520 - DNA, 19 bp, Homo sapiens
actccatctcaaaaaataa

SEQ ID NO: 5156521 - DNA, 16 bp, Homo sapiens
actccatctcaaaaca

SEQ ID NO: 5156522 - DNA, 11 bp, Homo sapiens
actccatctct

SEQ ID NO: 5156523 - DNA, 21 bp, Homo sapiens
actccatctctcatcctccag

SEQ ID NO: 5156524 - DNA, 13 bp, Homo sapiens
actccatctcttc

SEQ ID NO: 5156525 - DNA, 15 bp, Homo sapiens
actccatctcttctg

SEQ ID NO: 5156526 - DNA, 16 bp, Homo sapiens
actccatcttcaataa

SEQ ID NO: 5156527 - DNA, 19 bp, Homo sapiens
actccatgaccaggccacc

SEQ ID NO: 5156528 - DNA, 23 bp, Homo sapiens
actccatgaccaggccaccatct

SEQ ID NO: 5156529 - DNA, 20 bp, Homo sapiens
actccatgcctatttactgg

SEQ ID NO: 5156530 - DNA, 23 bp, Homo sapiens
actccatgcctatttactggaaa

SEQ ID NO: 5156531 - DNA, 21 bp, Homo sapiens
actccatgcttagtcactgcc

SEQ ID NO: 5156532 - DNA, 14 bp, Homo sapiens
actccatggccacc

SEQ ID NO: 5156533 - DNA, 16 bp, Homo sapiens
actccatggccacccc

SEQ ID NO: 5156534 - DNA, 14 bp, Homo sapiens
actccatggccctt

SEQ ID NO: 5156535 - DNA, 17 bp, Homo sapiens
actccatggttctcaat

SEQ ID NO: 5156536 - DNA, 14 bp, Homo sapiens
actccatgttggct

SEQ ID NO: 5156537 - DNA, 15 bp, Homo sapiens
actccattattttat

SEQ ID NO: 5156538 - DNA, 12 bp, Homo sapiens
actccattccca

SEQ ID NO: 5156539 - DNA, 23 bp, Homo sapiens
actccattgtgccttactaaata

SEQ ID NO: 5156540 - DNA, 19 bp, Homo sapiens
actccatttcccacttcca

SEQ ID NO: 5156541 - DNA, 15 bp, Homo sapiens
actccatttctttct

SEQ ID NO: 5156542 - DNA, 17 bp, Homo sapiens
actcccaaactgacaat

SEQ ID NO: 5156543 - DNA, 15 bp, Homo sapiens
actcccaaagagctg

SEQ ID NO: 5156544 - DNA, 16 bp, Homo sapiens
actcccaaagagctgc

SEQ ID NO: 5156545 - DNA, 19 bp, Homo sapiens
actcccaaagagctgccta

SEQ ID NO: 5156546 - DNA, 19 bp, Homo sapiens
actcccaaagctcagactt

SEQ ID NO: 5156547 - DNA, 15 bp, Homo sapiens
actcccaacttcttc

SEQ ID NO: 5156548 - DNA, 13 bp, Homo sapiens
actcccaagaaca

SEQ ID NO: 5156549 - DNA, 14 bp, Homo sapiens
actcccaagaacag

SEQ ID NO: 5156550 - DNA, 19 bp, Homo sapiens
actcccaagaacagcaggc

SEQ ID NO: 5156551 - DNA, 21 bp, Homo sapiens
actcccaagacccgagctggg

SEQ ID NO: 5156552 - DNA, 19 bp, Homo sapiens
actcccaaggttggagccc

SEQ ID NO: 5156553 - DNA, 19 bp, Homo sapiens
actcccaatggataaatca

SEQ ID NO: 5156554 - DNA, 21 bp, Homo sapiens
actcccacaattggccagggc

SEQ ID NO: 5156555 - DNA, 14 bp, Homo sapiens
actcccaccacagg

SEQ ID NO: 5156556 - DNA, 20 bp, Homo sapiens
actcccacccagtctctgct

SEQ ID NO: 5156557 - DNA, 12 bp, Homo sapiens
actcccacccta

SEQ ID NO: 5156558 - DNA, 20 bp, Homo sapiens
actcccaccctacccccttt

SEQ ID NO: 5156559 - DNA, 15 bp, Homo sapiens
actcccacctcaccc

SEQ ID NO: 5156560 - DNA, 17 bp, Homo sapiens
actcccacttccctgac

SEQ ID NO: 5156561 - DNA, 13 bp, Homo sapiens
actcccagaacct

SEQ ID NO: 5156562 - DNA, 22 bp, Homo sapiens
actcccagaacctctaagtgct

SEQ ID NO: 5156563 - DNA, 13 bp, Homo sapiens
actcccagcagag

SEQ ID NO: 5156564 - DNA, 15 bp, Homo sapiens
actcccagcagagcc

SEQ ID NO: 5156565 - DNA, 23 bp, Homo sapiens
actcccagcagagcccaccagcc

SEQ ID NO: 5156566 - DNA, 13 bp, Homo sapiens
actcccaggctgg

SEQ ID NO: 5156567 - DNA, 22 bp, Homo sapiens
actcccaggctggagagcactg

SEQ ID NO: 5156568 - DNA, 14 bp, Homo sapiens
actcccagggcccg

SEQ ID NO: 5156569 - DNA, 16 bp, Homo sapiens
actcccagggcccgag

SEQ ID NO: 5156570 - DNA, 16 bp, Homo sapiens
actcccatcacctcta

SEQ ID NO: 5156571 - DNA, 18 bp, Homo sapiens
actcccatcccttcaacc

SEQ ID NO: 5156572 - DNA, 15 bp, Homo sapiens
actcccatctgattt

SEQ ID NO: 5156573 - DNA, 22 bp, Homo sapiens
actcccatgaagccttttgaaa

SEQ ID NO: 5156574 - DNA, 16 bp, Homo sapiens
actcccattcctgaag

SEQ ID NO: 5156575 - DNA, 22 bp, Homo sapiens
actcccattcctgaagaaccag

SEQ ID NO: 5156576 - DNA, 14 bp, Homo sapiens
actccccaacccct

SEQ ID NO: 5156577 - DNA, 14 bp, Homo sapiens
actccccaaggaag

SEQ ID NO: 5156578 - DNA, 13 bp, Homo sapiens
actccccactccc

SEQ ID NO: 5156579 - DNA, 14 bp, Homo sapiens
actccccagagctg

SEQ ID NO: 5156580 - DNA, 17 bp, Homo sapiens
actccccagccagcctg

SEQ ID NO: 5156581 - DNA, 13 bp, Homo sapiens
actccccagccca

SEQ ID NO: 5156582 - DNA, 17 bp, Homo sapiens
actccccagccccagcc

SEQ ID NO: 5156583 - DNA, 19 bp, Homo sapiens
actccccagcctgggccca

SEQ ID NO: 5156584 - DNA, 19 bp, Homo sapiens
actccccaggccaggccac

SEQ ID NO: 5156585 - DNA, 22 bp, Homo sapiens
acgtgagccaggtaatgaggga

SEQ ID NO: 5156586 - DNA, 23 bp, Homo sapiens
acgtgagccaggtaatgagggac

SEQ ID NO: 5156587 - DNA, 20 bp, Homo sapiens
acgtgagctacatgtgtaag

SEQ ID NO: 5156588 - DNA, 17 bp, Homo sapiens
acgtgagggggagctga

SEQ ID NO: 5156589 - DNA, 16 bp, Homo sapiens
acgtgataatgcagat

SEQ ID NO: 5156590 - DNA, 21 bp, Homo sapiens
acgtgataatgcagataaata

SEQ ID NO: 5156591 - DNA, 20 bp, Homo sapiens
acgtgatcctctcacctcag

SEQ ID NO: 5156592 - DNA, 16 bp, Homo sapiens
acgtgatggaccaaag

SEQ ID NO: 5156593 - DNA, 20 bp, Homo sapiens
acgtgatggaccaaagccac

SEQ ID NO: 5156594 - DNA, 15 bp, Homo sapiens
acgtgatgtgccact

SEQ ID NO: 5156595 - DNA, 16 bp, Homo sapiens
acgtgatgtgccacta

SEQ ID NO: 5156596 - DNA, 21 bp, Homo sapiens
acgtgatgtgctcatcagaaa

SEQ ID NO: 5156597 - DNA, 13 bp, Homo sapiens
acgtgattctaag

SEQ ID NO: 5156598 - DNA, 19 bp, Homo sapiens
acgtgattttgctgtagaa

SEQ ID NO: 5156599 - DNA, 13 bp, Homo sapiens
acgtgcaaacaac

SEQ ID NO: 5156600 - DNA, 21 bp, Homo sapiens
acgtgcaaacaacctgaatct

SEQ ID NO: 5156601 - DNA, 13 bp, Homo sapiens
acgtgcaaagcca

SEQ ID NO: 5156602 - DNA, 15 bp, Homo sapiens
acgtgcaacagactg

SEQ ID NO: 5156603 - DNA, 19 bp, Homo sapiens
acgtgcaactgacactccc

SEQ ID NO: 5156604 - DNA, 20 bp, Homo sapiens
acgtgcaaggactcccggag

SEQ ID NO: 5156605 - DNA, 22 bp, Homo sapiens
acgtgcaatttgtttgtgcttc

SEQ ID NO: 5156606 - DNA, 20 bp, Homo sapiens
acgtgcacagcttcctgagt

SEQ ID NO: 5156607 - DNA, 23 bp, Homo sapiens
acgtgcacagcttcctgagtcac

SEQ ID NO: 5156608 - DNA, 16 bp, Homo sapiens
acgtgcagcacctgtc

SEQ ID NO: 5156609 - DNA, 18 bp, Homo sapiens
acgtgccagatataactg

SEQ ID NO: 5156610 - DNA, 16 bp, Homo sapiens
acgtgccagctctagt

SEQ ID NO: 5156611 - DNA, 13 bp, Homo sapiens
acgtgccaggccc

SEQ ID NO: 5156612 - DNA, 18 bp, Homo sapiens
acgtgccaggcccggggc

SEQ ID NO: 5156613 - DNA, 15 bp, Homo sapiens
acgtgccattgtctt

SEQ ID NO: 5156614 - DNA, 12 bp, Homo sapiens
acgtgcccagcc

SEQ ID NO: 5156615 - DNA, 17 bp, Homo sapiens
acgtgcctgtgggcctg

SEQ ID NO: 5156616 - DNA, 21 bp, Homo sapiens
acgtgccttaggaatactgtt

SEQ ID NO: 5156617 - DNA, 16 bp, Homo sapiens
acgtgcgacagagaga

SEQ ID NO: 5156618 - DNA, 23 bp, Homo sapiens
acgtgcgcgcccaggccagtgct

SEQ ID NO: 5156619 - DNA, 22 bp, Homo sapiens
acgtgcgctgggcacttccctg

SEQ ID NO: 5156620 - DNA, 19 bp, Homo sapiens
acgtgctccgtagctctgc

SEQ ID NO: 5156621 - DNA, 21 bp, Homo sapiens
acgtgctccgtagctctgctg

SEQ ID NO: 5156622 - DNA, 22 bp, Homo sapiens
acgtgctccgtagctctgctgc

SEQ ID NO: 5156623 - DNA, 13 bp, Homo sapiens
acgtgctcgcagc

SEQ ID NO: 5156624 - DNA, 18 bp, Homo sapiens
acgtgctcgcagcctggc

SEQ ID NO: 5156625 - DNA, 19 bp, Homo sapiens
acgtgctcgcagcctggcg

SEQ ID NO: 5156626 - DNA, 21 bp, Homo sapiens
acgtgctcgcctctgcccagc

SEQ ID NO: 5156627 - DNA, 23 bp, Homo sapiens
acgtgctctttgttttgtgtctc

SEQ ID NO: 5156628 - DNA, 15 bp, Homo sapiens
acgtgctggccttgg

SEQ ID NO: 5156629 - DNA, 17 bp, Homo sapiens
acgtgctgtgggcctca

SEQ ID NO: 5156630 - DNA, 11 bp, Homo sapiens
acgtgcttctt

SEQ ID NO: 5156631 - DNA, 20 bp, Homo sapiens
acgtggaaccctaaagcagt

SEQ ID NO: 5156632 - DNA, 14 bp, Homo sapiens
acgtggaacctctg

SEQ ID NO: 5156633 - DNA, 15 bp, Homo sapiens
acgtggacatgcctc

SEQ ID NO: 5156634 - DNA, 17 bp, Homo sapiens
acgtggacgtttttaat

SEQ ID NO: 5156635 - DNA, 15 bp, Homo sapiens
acgtggactcctctt

SEQ ID NO: 5156636 - DNA, 18 bp, Homo sapiens
acgtggactcctcttggt

SEQ ID NO: 5156637 - DNA, 22 bp, Homo sapiens
acgtggagagaagttgccctcc

SEQ ID NO: 5156638 - DNA, 16 bp, Homo sapiens
acgtggagagctggtg

SEQ ID NO: 5156639 - DNA, 18 bp, Homo sapiens
acgtggagagctggtgcc

SEQ ID NO: 5156640 - DNA, 13 bp, Homo sapiens
acgtggaggagca

SEQ ID NO: 5156641 - DNA, 18 bp, Homo sapiens
acgtggatacagagccac

SEQ ID NO: 5156642 - DNA, 22 bp, Homo sapiens
acgtggatgggcaaagcttgtc

SEQ ID NO: 5156643 - DNA, 14 bp, Homo sapiens
acgtggattgtatt

SEQ ID NO: 5156644 - DNA, 18 bp, Homo sapiens
acgtggattttaaaaaat

SEQ ID NO: 5156645 - DNA, 21 bp, Homo sapiens
acgtggattttaaaaaatcaa

SEQ ID NO: 5156646 - DNA, 20 bp, Homo sapiens
acgtggccaagagaaacttc

SEQ ID NO: 5156647 - DNA, 13 bp, Homo sapiens
acgtggccaggag

SEQ ID NO: 5156648 - DNA, 16 bp, Homo sapiens
acgtggcctcttgagc

SEQ ID NO: 5156649 - DNA, 16 bp, Homo sapiens
acgtggcgctgtcggt

SEQ ID NO: 5156650 - DNA, 17 bp, Homo sapiens
acgtggctcagccagca

SEQ ID NO: 5156651 - DNA, 15 bp, Homo sapiens
acgtggctctgctgg

SEQ ID NO: 5156652 - DNA, 21 bp, Homo sapiens
acgtggctgcgtgcccctgct

SEQ ID NO: 5156653 - DNA, 11 bp, Homo sapiens
acgtggctgct

SEQ ID NO: 5156654 - DNA, 13 bp, Homo sapiens
acgtggctgcttc

SEQ ID NO: 5156655 - DNA, 14 bp, Homo sapiens
acgtggctgcttca

SEQ ID NO: 5156656 - DNA, 11 bp, Homo sapiens
acgtgggagac

SEQ ID NO: 5156657 - DNA, 14 bp, Homo sapiens
acgtgggagaggca

SEQ ID NO: 5156658 - DNA, 18 bp, Homo sapiens
acgtgggagaggcagaaa

SEQ ID NO: 5156659 - DNA, 21 bp, Homo sapiens
acgtgggcttaaagcagaagc

SEQ ID NO: 5156660 - DNA, 15 bp, Homo sapiens
acgtggggcagcaca

SEQ ID NO: 5156661 - DNA, 20 bp, Homo sapiens
acgtggggcagcacagagag

SEQ ID NO: 5156662 - DNA, 15 bp, Homo sapiens
acgtggtcaccttcg

SEQ ID NO: 5156663 - DNA, 16 bp, Homo sapiens
acgtggtggcccagct

SEQ ID NO: 5156664 - DNA, 18 bp, Homo sapiens
acgtggttcagagactgg

SEQ ID NO: 5156665 - DNA, 14 bp, Homo sapiens
acgtgtaacttgtg

SEQ ID NO: 5156666 - DNA, 16 bp, Homo sapiens
acgtgtagtgtccatt

SEQ ID NO: 5156667 - DNA, 16 bp, Homo sapiens
acgtgtatagtatctg

SEQ ID NO: 5156668 - DNA, 23 bp, Homo sapiens
acgtgtatatgaggatgtatgtg

SEQ ID NO: 5156669 - DNA, 14 bp, Homo sapiens
acgtgtatgtttct

SEQ ID NO: 5156670 - DNA, 16 bp, Homo sapiens
acgtgtatgtttcttc

SEQ ID NO: 5156671 - DNA, 22 bp, Homo sapiens
acgtgtcagaagcctccaagcc

SEQ ID NO: 5156672 - DNA, 18 bp, Homo sapiens
acgtgtcagggctgagtg

SEQ ID NO: 5156673 - DNA, 17 bp, Homo sapiens
acgtgtctttagaactc

SEQ ID NO: 5156674 - DNA, 12 bp, Homo sapiens
acgtgtgatttt

SEQ ID NO: 5156675 - DNA, 15 bp, Homo sapiens
acgtgtgcatgtgtc

SEQ ID NO: 5156676 - DNA, 19 bp, Homo sapiens
acgtgtgctgtggccaggc

SEQ ID NO: 5156677 - DNA, 18 bp, Homo sapiens
acgtgtgtaaatatgtac

SEQ ID NO: 5156678 - DNA, 17 bp, Homo sapiens
acgtgtgtccaggctct

SEQ ID NO: 5156679 - DNA, 11 bp, Homo sapiens
acgtgtgtgac

SEQ ID NO: 5156680 - DNA, 23 bp, Homo sapiens
acgtgtgtgactcagatgtctct

SEQ ID NO: 5156681 - DNA, 12 bp, Homo sapiens
acgtgtgtggtc

SEQ ID NO: 5156682 - DNA, 18 bp, Homo sapiens
acgtgtgtgtcagctggt

SEQ ID NO: 5156683 - DNA, 18 bp, Homo sapiens
acgtgtgtgtgtgattgc

SEQ ID NO: 5156684 - DNA, 18 bp, Homo sapiens
acgtgtgtttttctatta

SEQ ID NO: 5156685 - DNA, 22 bp, Homo sapiens
acgtgtgtttttctattaaaag

SEQ ID NO: 5156686 - DNA, 23 bp, Homo sapiens
acgtgtgtttttctattaaaaga

SEQ ID NO: 5156687 - DNA, 20 bp, Homo sapiens
acgtgttaattataaacagc

SEQ ID NO: 5156688 - DNA, 23 bp, Homo sapiens
acgtgttaggaggctgcatgctc

SEQ ID NO: 5156689 - DNA, 19 bp, Homo sapiens
acgtgttcaaaaatttctg

SEQ ID NO: 5156690 - DNA, 23 bp, Homo sapiens
acgtgttccagtgtctgtctgag

SEQ ID NO: 5156691 - DNA, 18 bp, Homo sapiens
acgtgttcctataaaatc

SEQ ID NO: 5156692 - DNA, 11 bp, Homo sapiens
acgtgttgcct

SEQ ID NO: 5156693 - DNA, 18 bp, Homo sapiens
acgtgtttacttggtgag

SEQ ID NO: 5156694 - DNA, 15 bp, Homo sapiens
acgtgtttcgggcca

SEQ ID NO: 5156695 - DNA, 16 bp, Homo sapiens
acgtgtttgtgctgtg

SEQ ID NO: 5156696 - DNA, 22 bp, Homo sapiens
acgtgttttattcctgtatgtt

SEQ ID NO: 5156697 - DNA, 15 bp, Homo sapiens
acgtgtttttgtatc

SEQ ID NO: 5156698 - DNA, 15 bp, Homo sapiens
acgtgtttttttcct

SEQ ID NO: 5156699 - DNA, 19 bp, Homo sapiens
acgttaaaagcaaaaagat

SEQ ID NO: 5156700 - DNA, 22 bp, Homo sapiens
acgttaaaagtgtacaagttgc

SEQ ID NO: 5156701 - DNA, 23 bp, Homo sapiens
acgttaacccatttttgagccaa

SEQ ID NO: 5156702 - DNA, 23 bp, Homo sapiens
acgttaagtccaaggagaagaag

SEQ ID NO: 5156703 - DNA, 14 bp, Homo sapiens
acgttaattaaaca

SEQ ID NO: 5156704 - DNA, 15 bp, Homo sapiens
acgttaccaggcagg

SEQ ID NO: 5156705 - DNA, 19 bp, Homo sapiens
acgttactcagggctcctc

SEQ ID NO: 5156706 - DNA, 20 bp, Homo sapiens
acgttagaggaaaaatattt

SEQ ID NO: 5156707 - DNA, 15 bp, Homo sapiens
acgttaggccaggcc

SEQ ID NO: 5156708 - DNA, 21 bp, Homo sapiens
acgttagtcgtgagctcttgt

SEQ ID NO: 5156709 - DNA, 15 bp, Homo sapiens
acgttatatattgta

SEQ ID NO: 5156710 - DNA, 16 bp, Homo sapiens
acgttatatattgtat

SEQ ID NO: 5156711 - DNA, 17 bp, Homo sapiens
acgttatatattgtatt

SEQ ID NO: 5156712 - DNA, 23 bp, Homo sapiens
acgttatctcattgcaaaaatat

SEQ ID NO: 5156713 - DNA, 18 bp, Homo sapiens
acgttcacccatcttatc

SEQ ID NO: 5156714 - DNA, 13 bp, Homo sapiens
acgttcagggagg

SEQ ID NO: 5156715 - DNA, 16 bp, Homo sapiens
acgttcagggaggggc

SEQ ID NO: 5156716 - DNA, 13 bp, Homo sapiens
acgttcataacca

SEQ ID NO: 5156717 - DNA, 19 bp, Homo sapiens
acgttcataaccaacaata

SEQ ID NO: 5156718 - DNA, 17 bp, Homo sapiens
acgttcatcacctgcta

SEQ ID NO: 5156719 - DNA, 11 bp, Homo sapiens
acgttccagcc

SEQ ID NO: 5156720 - DNA, 20 bp, Homo sapiens
acgttccgggcaaatgccag

SEQ ID NO: 5156721 - DNA, 20 bp, Homo sapiens
acgttcctattgtcattaaa

SEQ ID NO: 5156722 - DNA, 21 bp, Homo sapiens
acgttcctattgtcattaaag

SEQ ID NO: 5156723 - DNA, 13 bp, Homo sapiens
acgttcctggccc

SEQ ID NO: 5156724 - DNA, 21 bp, Homo sapiens
acgttccttactgcagaatag

SEQ ID NO: 5156725 - DNA, 14 bp, Homo sapiens
acgttcgatttcta

SEQ ID NO: 5156726 - DNA, 18 bp, Homo sapiens
acgttcgatttctacctc

SEQ ID NO: 5156727 - DNA, 20 bp, Homo sapiens
acgttcgatttctacctcag

SEQ ID NO: 5156728 - DNA, 21 bp, Homo sapiens
acgttcgatttctacctcagc

SEQ ID NO: 5156729 - DNA, 14 bp, Homo sapiens
acgttcggggcatg

SEQ ID NO: 5156730 - DNA, 21 bp, Homo sapiens
acgttctatataaggaggaaa

SEQ ID NO: 5156731 - DNA, 17 bp, Homo sapiens
acgttgatagtttacaa

SEQ ID NO: 5156732 - DNA, 18 bp, Homo sapiens
acgttgatagtttacaaa

SEQ ID NO: 5156733 - DNA, 15 bp, Homo sapiens
acgttgatctcctgg

SEQ ID NO: 5156734 - DNA, 14 bp, Homo sapiens
acgttgctgtggga

SEQ ID NO: 5156735 - DNA, 12 bp, Homo sapiens
acgttggacttt

SEQ ID NO: 5156736 - DNA, 18 bp, Homo sapiens
acgttggagaagcccgtg

SEQ ID NO: 5156737 - DNA, 15 bp, Homo sapiens
acgttggttaaataa

SEQ ID NO: 5156738 - DNA, 15 bp, Homo sapiens
acgttgtgcatttgg

SEQ ID NO: 5156739 - DNA, 13 bp, Homo sapiens
acgttgttgtcat

SEQ ID NO: 5156740 - DNA, 13 bp, Homo sapiens
acgtttaaagtgt

SEQ ID NO: 5156741 - DNA, 18 bp, Homo sapiens
acgtttaaagttctgtgt

SEQ ID NO: 5156742 - DNA, 22 bp, Homo sapiens
acgtttaaagttctgtgtattt

SEQ ID NO: 5156743 - DNA, 18 bp, Homo sapiens
acgtttacaagccccccc

SEQ ID NO: 5156744 - DNA, 16 bp, Homo sapiens
acgtttacttatctta

SEQ ID NO: 5156745 - DNA, 22 bp, Homo sapiens
acgtttagaaatgatttcaaaa

SEQ ID NO: 5156746 - DNA, 17 bp, Homo sapiens
acgtttagctgacaaaa

SEQ ID NO: 5156747 - DNA, 22 bp, Homo sapiens
acgtttagctgacaaaatactt

SEQ ID NO: 5156748 - DNA, 21 bp, Homo sapiens
acgtttataaacagaaatgga

SEQ ID NO: 5156749 - DNA, 19 bp, Homo sapiens
acgtttccccaataaagcc

SEQ ID NO: 5156750 - DNA, 20 bp, Homo sapiens
acgtttccccaataaagcct

SEQ ID NO: 5156751 - DNA, 16 bp, Homo sapiens
acgtttctaaaggcta

SEQ ID NO: 5156752 - DNA, 10 bp, Homo sapiens
acgtttctca

SEQ ID NO: 5156753 - DNA, 17 bp, Homo sapiens
acgtttctcaaatctgc

SEQ ID NO: 5156754 - DNA, 22 bp, Homo sapiens
acgtttctcaaatctgcttcat

SEQ ID NO: 5156755 - DNA, 17 bp, Homo sapiens
acgtttctcattaaaat

SEQ ID NO: 5156756 - DNA, 22 bp, Homo sapiens
acgtttctcattaaaatccagt

SEQ ID NO: 5156757 - DNA, 10 bp, Homo sapiens
acgtttcttt

SEQ ID NO: 5156758 - DNA, 20 bp, Homo sapiens
acgtttctttaaccttgtat

SEQ ID NO: 5156759 - DNA, 18 bp, Homo sapiens
acgtttgactagccatct

SEQ ID NO: 5156760 - DNA, 17 bp, Homo sapiens
acgtttgccccatggga

SEQ ID NO: 5156761 - DNA, 20 bp, Homo sapiens
acgtttggaagatcctgtga

SEQ ID NO: 5156762 - DNA, 18 bp, Homo sapiens
acgtttggcatttctctt

SEQ ID NO: 5156763 - DNA, 11 bp, Homo sapiens
actccccaggg

SEQ ID NO: 5156764 - DNA, 22 bp, Homo sapiens
actcccccaaccaaggaaggag

SEQ ID NO: 5156765 - DNA, 21 bp, Homo sapiens
actcccccaccactcaggcca

SEQ ID NO: 5156766 - DNA, 13 bp, Homo sapiens
actcccccacctg

SEQ ID NO: 5156767 - DNA, 17 bp, Homo sapiens
actcccccagaggtgga

SEQ ID NO: 5156768 - DNA, 21 bp, Homo sapiens
actcccccagccccagagaaa

SEQ ID NO: 5156769 - DNA, 12 bp, Homo sapiens
actcccccagga

SEQ ID NO: 5156770 - DNA, 20 bp, Homo sapiens
actcccccctggccacagac

SEQ ID NO: 5156771 - DNA, 17 bp, Homo sapiens
actcccccgtttctcct

SEQ ID NO: 5156772 - DNA, 19 bp, Homo sapiens
actcccccgtttctccttt

SEQ ID NO: 5156773 - DNA, 21 bp, Homo sapiens
actccccctaaacccctgtcc

SEQ ID NO: 5156774 - DNA, 21 bp, Homo sapiens
actccccgcccgccctcctct

SEQ ID NO: 5156775 - DNA, 23 bp, Homo sapiens
actccccgcccgccctcctctgc

SEQ ID NO: 5156776 - DNA, 19 bp, Homo sapiens
actccccgccgtacagttc

SEQ ID NO: 5156777 - DNA, 20 bp, Homo sapiens
actccccgcctccccaagtc

SEQ ID NO: 5156778 - DNA, 15 bp, Homo sapiens
actccccgcctgtcc

SEQ ID NO: 5156779 - DNA, 16 bp, Homo sapiens
actccccgcctgtcct

SEQ ID NO: 5156780 - DNA, 13 bp, Homo sapiens
actcccctctcct

SEQ ID NO: 5156781 - DNA, 12 bp, Homo sapiens
actcccctgcac

SEQ ID NO: 5156782 - DNA, 22 bp, Homo sapiens
actcccctgcactggagtccag

SEQ ID NO: 5156783 - DNA, 13 bp, Homo sapiens
actcccctgctgg

SEQ ID NO: 5156784 - DNA, 14 bp, Homo sapiens
actcccctgtttca

SEQ ID NO: 5156785 - DNA, 23 bp, Homo sapiens
actcccctgtttcaatcactgtc

SEQ ID NO: 5156786 - DNA, 16 bp, Homo sapiens
actccccttccctggg

SEQ ID NO: 5156787 - DNA, 20 bp, Homo sapiens
actccccttccctggggagc

SEQ ID NO: 5156788 - DNA, 23 bp, Homo sapiens
actccccttgccttcccctgtct

SEQ ID NO: 5156789 - DNA, 21 bp, Homo sapiens
actcccgagacggcactgaga

SEQ ID NO: 5156790 - DNA, 16 bp, Homo sapiens
actcccgccacacgct

SEQ ID NO: 5156791 - DNA, 21 bp, Homo sapiens
actcccgccccgggctggccc

SEQ ID NO: 5156792 - DNA, 22 bp, Homo sapiens
actcccgccccgggctggccct

SEQ ID NO: 5156793 - DNA, 19 bp, Homo sapiens
actcccgcctcagggccag

SEQ ID NO: 5156794 - DNA, 14 bp, Homo sapiens
actcccgctgagcc

SEQ ID NO: 5156795 - DNA, 20 bp, Homo sapiens
actcccgctgagcccactct

SEQ ID NO: 5156796 - DNA, 21 bp, Homo sapiens
actcccgctgagcccactcta

SEQ ID NO: 5156797 - DNA, 13 bp, Homo sapiens
actcccgctgcac

SEQ ID NO: 5156798 - DNA, 14 bp, Homo sapiens
actcccgctgcaca

SEQ ID NO: 5156799 - DNA, 20 bp, Homo sapiens
actcccgctgcacacagacg

SEQ ID NO: 5156800 - DNA, 22 bp, Homo sapiens
actcccggcctaggcacctccc

SEQ ID NO: 5156801 - DNA, 16 bp, Homo sapiens
actcccgggccacgcc

SEQ ID NO: 5156802 - DNA, 17 bp, Homo sapiens
actcccgggccacgccc

SEQ ID NO: 5156803 - DNA, 16 bp, Homo sapiens
actccctaaagccctc

SEQ ID NO: 5156804 - DNA, 17 bp, Homo sapiens
actccctaaagccctct

SEQ ID NO: 5156805 - DNA, 18 bp, Homo sapiens
actccctacactgatgca

SEQ ID NO: 5156806 - DNA, 14 bp, Homo sapiens
actccctaggccca

SEQ ID NO: 5156807 - DNA, 15 bp, Homo sapiens
actccctaggcccaa

SEQ ID NO: 5156808 - DNA, 12 bp, Homo sapiens
actccctagtta

SEQ ID NO: 5156809 - DNA, 12 bp, Homo sapiens
actccctccacc

SEQ ID NO: 5156810 - DNA, 18 bp, Homo sapiens
actccctccaccagcctg

SEQ ID NO: 5156811 - DNA, 14 bp, Homo sapiens
actccctccatgtg

SEQ ID NO: 5156812 - DNA, 10 bp, Homo sapiens
actccctccc

SEQ ID NO: 5156813 - DNA, 12 bp, Homo sapiens
actccctcccag

SEQ ID NO: 5156814 - DNA, 23 bp, Homo sapiens
actccctccccacccaagagagg

SEQ ID NO: 5156815 - DNA, 19 bp, Homo sapiens
actccctccctttctcttt

SEQ ID NO: 5156816 - DNA, 13 bp, Homo sapiens
actccctcctcac

SEQ ID NO: 5156817 - DNA, 21 bp, Homo sapiens
actccctcctcacactccaga

SEQ ID NO: 5156818 - DNA, 15 bp, Homo sapiens
actccctcctcacct

SEQ ID NO: 5156819 - DNA, 16 bp, Homo sapiens
actccctgagtctgga

SEQ ID NO: 5156820 - DNA, 17 bp, Homo sapiens
actccctgatcccagac

SEQ ID NO: 5156821 - DNA, 15 bp, Homo sapiens
actccctgccaccgt

SEQ ID NO: 5156822 - DNA, 18 bp, Homo sapiens
actccctgcttgcaggag

SEQ ID NO: 5156823 - DNA, 13 bp, Homo sapiens
actccctggcctt

SEQ ID NO: 5156824 - DNA, 18 bp, Homo sapiens
actccctggctgttctga

SEQ ID NO: 5156825 - DNA, 21 bp, Homo sapiens
actccctgggacacagaccca

SEQ ID NO: 5156826 - DNA, 22 bp, Homo sapiens
actccctgtagtgaatcctctg

SEQ ID NO: 5156827 - DNA, 19 bp, Homo sapiens
actccctgtccatccccag

SEQ ID NO: 5156828 - DNA, 23 bp, Homo sapiens
actccctgttatttttctgccct

SEQ ID NO: 5156829 - DNA, 17 bp, Homo sapiens
actccctgttttagttt

SEQ ID NO: 5156830 - DNA, 22 bp, Homo sapiens
actcccttaaggtctccaaacc

SEQ ID NO: 5156831 - DNA, 23 bp, Homo sapiens
actcccttaggcattatttaatg

SEQ ID NO: 5156832 - DNA, 15 bp, Homo sapiens
actcccttcccataa

SEQ ID NO: 5156833 - DNA, 23 bp, Homo sapiens
actcccttcccatgacccaggct

SEQ ID NO: 5156834 - DNA, 11 bp, Homo sapiens
actcccttcct

SEQ ID NO: 5156835 - DNA, 17 bp, Homo sapiens
actcccttcctggcctc

SEQ ID NO: 5156836 - DNA, 18 bp, Homo sapiens
actcccttcctggcctca

SEQ ID NO: 5156837 - DNA, 17 bp, Homo sapiens
actcccttctacctgcc

SEQ ID NO: 5156838 - DNA, 19 bp, Homo sapiens
actcccttctacctgccac

SEQ ID NO: 5156839 - DNA, 13 bp, Homo sapiens
actcccttctcct

SEQ ID NO: 5156840 - DNA, 14 bp, Homo sapiens
actcccttctgtag

SEQ ID NO: 5156841 - DNA, 22 bp, Homo sapiens
actcccttgaagttgtggagga

SEQ ID NO: 5156842 - DNA, 17 bp, Homo sapiens
actcccttgctggcccc

SEQ ID NO: 5156843 - DNA, 12 bp, Homo sapiens
actccctttcaa

SEQ ID NO: 5156844 - DNA, 14 bp, Homo sapiens
actccctttcccct

SEQ ID NO: 5156845 - DNA, 18 bp, Homo sapiens
actccctttgcgtcagga

SEQ ID NO: 5156846 - DNA, 20 bp, Homo sapiens
actccctttgcgtcaggagc

SEQ ID NO: 5156847 - DNA, 18 bp, Homo sapiens
actccctttgtggacttt

SEQ ID NO: 5156848 - DNA, 20 bp, Homo sapiens
actccctttgtggactttat

SEQ ID NO: 5156849 - DNA, 20 bp, Homo sapiens
actccctttttacactttat

SEQ ID NO: 5156850 - DNA, 22 bp, Homo sapiens
actccgaaagtctgaatctccc

SEQ ID NO: 5156851 - DNA, 15 bp, Homo sapiens
actccgactccccct

SEQ ID NO: 5156852 - DNA, 16 bp, Homo sapiens
actccgaggtggttca

SEQ ID NO: 5156853 - DNA, 21 bp, Homo sapiens
actccgaggtggttcagacaa

SEQ ID NO: 5156854 - DNA, 22 bp, Homo sapiens
actccgatttggagagtagtaa

SEQ ID NO: 5156855 - DNA, 16 bp, Homo sapiens
actccgccagccacag

SEQ ID NO: 5156856 - DNA, 22 bp, Homo sapiens
actccgccctcctcgggccgag

SEQ ID NO: 5156857 - DNA, 23 bp, Homo sapiens
actccgccctcctcgggccgagg

SEQ ID NO: 5156858 - DNA, 21 bp, Homo sapiens
actccgcgccgatgccaccgg

SEQ ID NO: 5156859 - DNA, 16 bp, Homo sapiens
actccgctggatgggg

SEQ ID NO: 5156860 - DNA, 15 bp, Homo sapiens
actccggagacaggg

SEQ ID NO: 5156861 - DNA, 16 bp, Homo sapiens
actccggagacagggt

SEQ ID NO: 5156862 - DNA, 14 bp, Homo sapiens
actccggaggactg

SEQ ID NO: 5156863 - DNA, 16 bp, Homo sapiens
actccggaggactgag

SEQ ID NO: 5156864 - DNA, 18 bp, Homo sapiens
actccggaggactgagcc

SEQ ID NO: 5156865 - DNA, 20 bp, Homo sapiens
actccggattgcgttcctcc

SEQ ID NO: 5156866 - DNA, 19 bp, Homo sapiens
actccggccctccagagcc

SEQ ID NO: 5156867 - DNA, 16 bp, Homo sapiens
actccggcctgggcga

SEQ ID NO: 5156868 - DNA, 15 bp, Homo sapiens
actccggtgtgcctg

SEQ ID NO: 5156869 - DNA, 16 bp, Homo sapiens
actccggtgtgcctgc

SEQ ID NO: 5156870 - DNA, 19 bp, Homo sapiens
actccggtgtgcctgcagc

SEQ ID NO: 5156871 - DNA, 16 bp, Homo sapiens
actccgtctcaaggaa

SEQ ID NO: 5156872 - DNA, 15 bp, Homo sapiens
actccgtgaggctgc

SEQ ID NO: 5156873 - DNA, 18 bp, Homo sapiens
actccgtgtgcctggggt

SEQ ID NO: 5156874 - DNA, 14 bp, Homo sapiens
actccgtttccaaa

SEQ ID NO: 5156875 - DNA, 18 bp, Homo sapiens
actcctaacctcaagtga

SEQ ID NO: 5156876 - DNA, 23 bp, Homo sapiens
actcctaatcaagagtctctcca

SEQ ID NO: 5156877 - DNA, 19 bp, Homo sapiens
actcctaattttaaataat

SEQ ID NO: 5156878 - DNA, 11 bp, Homo sapiens
actcctacctg

SEQ ID NO: 5156879 - DNA, 16 bp, Homo sapiens
actcctacctgccctg

SEQ ID NO: 5156880 - DNA, 15 bp, Homo sapiens
actcctacctggtca

SEQ ID NO: 5156881 - DNA, 13 bp, Homo sapiens
actcctagaagaa

SEQ ID NO: 5156882 - DNA, 16 bp, Homo sapiens
actcctagctgtcctt

SEQ ID NO: 5156883 - DNA, 16 bp, Homo sapiens
actcctaggaaaatac

SEQ ID NO: 5156884 - DNA, 14 bp, Homo sapiens
actcctaggagagc

SEQ ID NO: 5156885 - DNA, 15 bp, Homo sapiens
actcctaggagagcc

SEQ ID NO: 5156886 - DNA, 20 bp, Homo sapiens
actcctaggcaggacatgct

SEQ ID NO: 5156887 - DNA, 21 bp, Homo sapiens
actcctaggcaggacatgctg

SEQ ID NO: 5156888 - DNA, 14 bp, Homo sapiens
actcctaggccctt

SEQ ID NO: 5156889 - DNA, 22 bp, Homo sapiens
actcctagtaggggtaccactg

SEQ ID NO: 5156890 - DNA, 22 bp, Homo sapiens
actcctatccccaggccaggtc

SEQ ID NO: 5156891 - DNA, 18 bp, Homo sapiens
actcctatgatctcaggt

SEQ ID NO: 5156892 - DNA, 13 bp, Homo sapiens
actcctatttcaa

SEQ ID NO: 5156893 - DNA, 14 bp, Homo sapiens
actcctatttttgt

SEQ ID NO: 5156894 - DNA, 16 bp, Homo sapiens
actcctatttttgtaa

SEQ ID NO: 5156895 - DNA, 20 bp, Homo sapiens
actcctatttttgtaaactg

SEQ ID NO: 5156896 - DNA, 20 bp, Homo sapiens
actcctcaaaagcaaatgag

SEQ ID NO: 5156897 - DNA, 21 bp, Homo sapiens
actcctcaaaagcaaatgaga

SEQ ID NO: 5156898 - DNA, 14 bp, Homo sapiens
actcctcaaaccac

SEQ ID NO: 5156899 - DNA, 14 bp, Homo sapiens
actcctcaaccttg

SEQ ID NO: 5156900 - DNA, 20 bp, Homo sapiens
actcctcaactgatgataga

SEQ ID NO: 5156901 - DNA, 17 bp, Homo sapiens
actcctcaagactttga

SEQ ID NO: 5156902 - DNA, 15 bp, Homo sapiens
actcctcaagggcag

SEQ ID NO: 5156903 - DNA, 16 bp, Homo sapiens
actcctcaagggcaga

SEQ ID NO: 5156904 - DNA, 19 bp, Homo sapiens
actcctcaattccagggaa

SEQ ID NO: 5156905 - DNA, 13 bp, Homo sapiens
actcctcacacag

SEQ ID NO: 5156906 - DNA, 14 bp, Homo sapiens
actcctcacagcat

SEQ ID NO: 5156907 - DNA, 18 bp, Homo sapiens
actcctcacagcatctct

SEQ ID NO: 5156908 - DNA, 19 bp, Homo sapiens
actcctcagatctgaacac

SEQ ID NO: 5156909 - DNA, 16 bp, Homo sapiens
actcctcagcacccct

SEQ ID NO: 5156910 - DNA, 18 bp, Homo sapiens
actcctcagcacccctcc

SEQ ID NO: 5156911 - DNA, 20 bp, Homo sapiens
actcctcaggaacagaacac

SEQ ID NO: 5156912 - DNA, 14 bp, Homo sapiens
actcctcagtccct

SEQ ID NO: 5156913 - DNA, 13 bp, Homo sapiens
actcctcagttcc

SEQ ID NO: 5156914 - DNA, 19 bp, Homo sapiens
actcctcattgtaaacaaa

SEQ ID NO: 5156915 - DNA, 22 bp, Homo sapiens
actcctccatccatgtgttcca

SEQ ID NO: 5156916 - DNA, 15 bp, Homo sapiens
actcctcccagggtt

SEQ ID NO: 5156917 - DNA, 19 bp, Homo sapiens
actcctcccagggttttaa

SEQ ID NO: 5156918 - DNA, 11 bp, Homo sapiens
actcctcccat

SEQ ID NO: 5156919 - DNA, 21 bp, Homo sapiens
actcctccccaccctcctggc

SEQ ID NO: 5156920 - DNA, 16 bp, Homo sapiens
actcctccccctcctc

SEQ ID NO: 5156921 - DNA, 16 bp, Homo sapiens
actcctccctgatgta

SEQ ID NO: 5156922 - DNA, 20 bp, Homo sapiens
actcctccctgatgtacagt

SEQ ID NO: 5156923 - DNA, 14 bp, Homo sapiens
actcctccctgggg

SEQ ID NO: 5156924 - DNA, 16 bp, Homo sapiens
actcctccctgggggt

SEQ ID NO: 5156925 - DNA, 21 bp, Homo sapiens
actcctccctttccttcctaa

SEQ ID NO: 5156926 - DNA, 13 bp, Homo sapiens
actcctcctagcc

SEQ ID NO: 5156927 - DNA, 11 bp, Homo sapiens
actcctcctcc

SEQ ID NO: 5156928 - DNA, 12 bp, Homo sapiens
actcctcctctt

SEQ ID NO: 5156929 - DNA, 13 bp, Homo sapiens
actcctcctcttt

SEQ ID NO: 5156930 - DNA, 16 bp, Homo sapiens
actcctcctctttctc

SEQ ID NO: 5156931 - DNA, 19 bp, Homo sapiens
actcctcctctttctctcc

SEQ ID NO: 5156932 - DNA, 13 bp, Homo sapiens
actcctcctgcca

SEQ ID NO: 5156933 - DNA, 14 bp, Homo sapiens
actcctcctgccag

SEQ ID NO: 5156934 - DNA, 19 bp, Homo sapiens
actcctcctgccagctctg

SEQ ID NO: 5156935 - DNA, 21 bp, Homo sapiens
actcctcctgccagctctgtc

SEQ ID NO: 5156936 - DNA, 20 bp, Homo sapiens
actcctcctgctcctcaccc

SEQ ID NO: 5156937 - DNA, 16 bp, Homo sapiens
actcctcctgggggct

SEQ ID NO: 5156938 - DNA, 21 bp, Homo sapiens
actcctcctgggggctggctc

SEQ ID NO: 5156939 - DNA, 20 bp, Homo sapiens
actcctccttgcctgctttt

SEQ ID NO: 5156940 - DNA, 15 bp, Homo sapiens
actcctcctttctcc

SEQ ID NO: 5156941 - DNA, 16 bp, Homo sapiens
actcctcctttttcca

SEQ ID NO: 5156942 - DNA, 21 bp, Homo sapiens
acgtttgttccccttttctgt

SEQ ID NO: 5156943 - DNA, 14 bp, Homo sapiens
acgttttaataatt

SEQ ID NO: 5156944 - DNA, 12 bp, Homo sapiens
acgttttagaaa

SEQ ID NO: 5156945 - DNA, 18 bp, Homo sapiens
acgttttagaaaatttta

SEQ ID NO: 5156946 - DNA, 19 bp, Homo sapiens
acgttttatattatataag

SEQ ID NO: 5156947 - DNA, 13 bp, Homo sapiens
acgttttctaatt

SEQ ID NO: 5156948 - DNA, 17 bp, Homo sapiens
acgttttctaattgctt

SEQ ID NO: 5156949 - DNA, 23 bp, Homo sapiens
acgttttctcttccttgtgattg

SEQ ID NO: 5156950 - DNA, 12 bp, Homo sapiens
acgttttcttct

SEQ ID NO: 5156951 - DNA, 17 bp, Homo sapiens
acgttttcttctttccc

SEQ ID NO: 5156952 - DNA, 22 bp, Homo sapiens
acgttttcttctttccctggac

SEQ ID NO: 5156953 - DNA, 17 bp, Homo sapiens
acgttttggttctatgc

SEQ ID NO: 5156954 - DNA, 15 bp, Homo sapiens
acgttttgtgtatat

SEQ ID NO: 5156955 - DNA, 20 bp, Homo sapiens
acgttttgtttgaaaaagca

SEQ ID NO: 5156956 - DNA, 13 bp, Homo sapiens
acgtttttccttt

SEQ ID NO: 5156957 - DNA, 22 bp, Homo sapiens
acgtttttctggaccaaggtga

SEQ ID NO: 5156958 - DNA, 18 bp, Homo sapiens
acgttttttcctcagtgc

SEQ ID NO: 5156959 - DNA, 16 bp, Homo sapiens
acgttttttcttcttt

SEQ ID NO: 5156960 - DNA, 16 bp, Homo sapiens
actaaaaaaaaaaagg

SEQ ID NO: 5156961 - DNA, 17 bp, Homo sapiens
actaaaaaaaagatgaa

SEQ ID NO: 5156962 - DNA, 18 bp, Homo sapiens
actaaaaaatgtctatag

SEQ ID NO: 5156963 - DNA, 17 bp, Homo sapiens
actaaaaagagactgtg

SEQ ID NO: 5156964 - DNA, 21 bp, Homo sapiens
actaaaaagagactgtgccat

SEQ ID NO: 5156965 - DNA, 21 bp, Homo sapiens
actaaaaataaattaataaat

SEQ ID NO: 5156966 - DNA, 12 bp, Homo sapiens
actaaaaataca

SEQ ID NO: 5156967 - DNA, 14 bp, Homo sapiens
actaaaaatacaaa

SEQ ID NO: 5156968 - DNA, 17 bp, Homo sapiens
actaaaaatacaaacaa

SEQ ID NO: 5156969 - DNA, 13 bp, Homo sapiens
actaaaaatatag

SEQ ID NO: 5156970 - DNA, 18 bp, Homo sapiens
actaaaaatatcacactg

SEQ ID NO: 5156971 - DNA, 21 bp, Homo sapiens
actaaaaatattgtttctgca

SEQ ID NO: 5156972 - DNA, 15 bp, Homo sapiens
actaaaaatgcaaaa

SEQ ID NO: 5156973 - DNA, 19 bp, Homo sapiens
actaaaacaaagccacttt

SEQ ID NO: 5156974 - DNA, 14 bp, Homo sapiens
actaaaacattgtc

SEQ ID NO: 5156975 - DNA, 16 bp, Homo sapiens
actaaaactacaaaaa

SEQ ID NO: 5156976 - DNA, 12 bp, Homo sapiens
actaaaactcag

SEQ ID NO: 5156977 - DNA, 17 bp, Homo sapiens
actaaaagacatttgtt

SEQ ID NO: 5156978 - DNA, 21 bp, Homo sapiens
actaaaagatataagtgctgt

SEQ ID NO: 5156979 - DNA, 21 bp, Homo sapiens
actaaaagcagcgtcactcta

SEQ ID NO: 5156980 - DNA, 13 bp, Homo sapiens
actaaaagcatga

SEQ ID NO: 5156981 - DNA, 13 bp, Homo sapiens
actaaaaggaaac

SEQ ID NO: 5156982 - DNA, 21 bp, Homo sapiens
actaaaagtgatgtgatttat

SEQ ID NO: 5156983 - DNA, 19 bp, Homo sapiens
actaaaataattttgtaat

SEQ ID NO: 5156984 - DNA, 20 bp, Homo sapiens
actaaaataattttgtaatg

SEQ ID NO: 5156985 - DNA, 21 bp, Homo sapiens
actaaaatagtttaaaaatat

SEQ ID NO: 5156986 - DNA, 18 bp, Homo sapiens
actaaaatcattgtcaaa

SEQ ID NO: 5156987 - DNA, 16 bp, Homo sapiens
actaaaatgtatctaa

SEQ ID NO: 5156988 - DNA, 19 bp, Homo sapiens
actaaaatgtttaattcat

SEQ ID NO: 5156989 - DNA, 14 bp, Homo sapiens
actaaaattatgtt

SEQ ID NO: 5156990 - DNA, 17 bp, Homo sapiens
actaaaattcaacaaat

SEQ ID NO: 5156991 - DNA, 22 bp, Homo sapiens
actaaaattcaacaaatgatgt

SEQ ID NO: 5156992 - DNA, 14 bp, Homo sapiens
actaaaatttacac

SEQ ID NO: 5156993 - DNA, 14 bp, Homo sapiens
actaaaattttcta

SEQ ID NO: 5156994 - DNA, 18 bp, Homo sapiens
actaaacatatgatttca

SEQ ID NO: 5156995 - DNA, 11 bp, Homo sapiens
actaaacattt

SEQ ID NO: 5156996 - DNA, 16 bp, Homo sapiens
actaaaccaagttatt

SEQ ID NO: 5156997 - DNA, 19 bp, Homo sapiens
actaaaccgataatgcatg

SEQ ID NO: 5156998 - DNA, 14 bp, Homo sapiens
actaaactaaaata

SEQ ID NO: 5156999 - DNA, 17 bp, Homo sapiens
actaaactaaaatagtt

SEQ ID NO: 5157000 - DNA, 17 bp, Homo sapiens
actaaactacattataa

SEQ ID NO: 5157001 - DNA, 17 bp, Homo sapiens
actaaactaccacctca

SEQ ID NO: 5157002 - DNA, 16 bp, Homo sapiens
actaaactagctcttg

SEQ ID NO: 5157003 - DNA, 17 bp, Homo sapiens
actaaactatctgtatt

SEQ ID NO: 5157004 - DNA, 15 bp, Homo sapiens
actaaactctctttg

SEQ ID NO: 5157005 - DNA, 19 bp, Homo sapiens
actaaacttggtgcttatt

SEQ ID NO: 5157006 - DNA, 22 bp, Homo sapiens
actaaacttggtgcttattgat

SEQ ID NO: 5157007 - DNA, 13 bp, Homo sapiens
actaaactttatt

SEQ ID NO: 5157008 - DNA, 18 bp, Homo sapiens
actaaactttatttgtaa

SEQ ID NO: 5157009 - DNA, 19 bp, Homo sapiens
actaaactttatttgtaaa

SEQ ID NO: 5157010 - DNA, 15 bp, Homo sapiens
actaaactttcacac

SEQ ID NO: 5157011 - DNA, 16 bp, Homo sapiens
actaaactttcacacc

SEQ ID NO: 5157012 - DNA, 14 bp, Homo sapiens
actaaagaagagga

SEQ ID NO: 5157013 - DNA, 23 bp, Homo sapiens
actaaagaagaggagaaaaagaa

SEQ ID NO: 5157014 - DNA, 20 bp, Homo sapiens
actaaagaagatctgtaatt

SEQ ID NO: 5157015 - DNA, 12 bp, Homo sapiens
actaaagagaca

SEQ ID NO: 5157016 - DNA, 19 bp, Homo sapiens
actaaagagacatatttat

SEQ ID NO: 5157017 - DNA, 21 bp, Homo sapiens
actaaagagagaatgtagata

SEQ ID NO: 5157018 - DNA, 17 bp, Homo sapiens
actaaagagtgaatgcc

SEQ ID NO: 5157019 - DNA, 19 bp, Homo sapiens
actaaagagtgaatgccat

SEQ ID NO: 5157020 - DNA, 11 bp, Homo sapiens
actaaagcaaa

SEQ ID NO: 5157021 - DNA, 15 bp, Homo sapiens
actaaagcaaattgt

SEQ ID NO: 5157022 - DNA, 11 bp, Homo sapiens
actaaagcaat

SEQ ID NO: 5157023 - DNA, 16 bp, Homo sapiens
actaaagcaatagaaa

SEQ ID NO: 5157024 - DNA, 21 bp, Homo sapiens
actaaagcacttcttttccaa

SEQ ID NO: 5157025 - DNA, 11 bp, Homo sapiens
actaaagcagt

SEQ ID NO: 5157026 - DNA, 15 bp, Homo sapiens
actaaagcagtgttt

SEQ ID NO: 5157027 - DNA, 12 bp, Homo sapiens
actaaagcatga

SEQ ID NO: 5157028 - DNA, 16 bp, Homo sapiens
actaaagccaaacata

SEQ ID NO: 5157029 - DNA, 23 bp, Homo sapiens
actaaagccaaacatatatatac

SEQ ID NO: 5157030 - DNA, 16 bp, Homo sapiens
actaaagccagcctga

SEQ ID NO: 5157031 - DNA, 14 bp, Homo sapiens
actaaagccaggaa

SEQ ID NO: 5157032 - DNA, 16 bp, Homo sapiens
actaaagccaggaaca

SEQ ID NO: 5157033 - DNA, 23 bp, Homo sapiens
actaaagccaggaacagggacca

SEQ ID NO: 5157034 - DNA, 12 bp, Homo sapiens
actaaagccttt

SEQ ID NO: 5157035 - DNA, 16 bp, Homo sapiens
actaaagctatgttac

SEQ ID NO: 5157036 - DNA, 21 bp, Homo sapiens
actaaagctatgttacatgga

SEQ ID NO: 5157037 - DNA, 14 bp, Homo sapiens
actaaagcttcaga

SEQ ID NO: 5157038 - DNA, 17 bp, Homo sapiens
actaaaggtggccacaa

SEQ ID NO: 5157039 - DNA, 22 bp, Homo sapiens
actaaaggtggccacaaattct

SEQ ID NO: 5157040 - DNA, 23 bp, Homo sapiens
actaaaggtggttttattttccc

SEQ ID NO: 5157041 - DNA, 21 bp, Homo sapiens
actaaagtatggtacatctac

SEQ ID NO: 5157042 - DNA, 16 bp, Homo sapiens
actaaagtatttaaag

SEQ ID NO: 5157043 - DNA, 20 bp, Homo sapiens
actaaagtgtgctttataaa

SEQ ID NO: 5157044 - DNA, 22 bp, Homo sapiens
actaaagttagaaagttgattt

SEQ ID NO: 5157045 - DNA, 20 bp, Homo sapiens
actaaagttgtactttaaaa

SEQ ID NO: 5157046 - DNA, 22 bp, Homo sapiens
actaaataatactttaggaaat

SEQ ID NO: 5157047 - DNA, 12 bp, Homo sapiens
actaaataatga

SEQ ID NO: 5157048 - DNA, 15 bp, Homo sapiens
actaaataatgaata

SEQ ID NO: 5157049 - DNA, 22 bp, Homo sapiens
actaaataatgaataaactgaa

SEQ ID NO: 5157050 - DNA, 16 bp, Homo sapiens
actaaataatgatctt

SEQ ID NO: 5157051 - DNA, 15 bp, Homo sapiens
actaaatagcatgta

SEQ ID NO: 5157052 - DNA, 16 bp, Homo sapiens
actaaatagcatgtat

SEQ ID NO: 5157053 - DNA, 23 bp, Homo sapiens
actaaatagcatgtattgtgtct

SEQ ID NO: 5157054 - DNA, 13 bp, Homo sapiens
actaaatatctgt

SEQ ID NO: 5157055 - DNA, 12 bp, Homo sapiens
actaaatatgca

SEQ ID NO: 5157056 - DNA, 19 bp, Homo sapiens
actaaatatgctctgagta

SEQ ID NO: 5157057 - DNA, 16 bp, Homo sapiens
actaaatctctaatat

SEQ ID NO: 5157058 - DNA, 17 bp, Homo sapiens
actaaatctctaatatg

SEQ ID NO: 5157059 - DNA, 23 bp, Homo sapiens
actaaatctgtaagctctttgaa

SEQ ID NO: 5157060 - DNA, 15 bp, Homo sapiens
actaaatcttttata

SEQ ID NO: 5157061 - DNA, 18 bp, Homo sapiens
actaaatgagctcctgcg

SEQ ID NO: 5157062 - DNA, 17 bp, Homo sapiens
actaaatgataaatgta

SEQ ID NO: 5157063 - DNA, 18 bp, Homo sapiens
actaaatgatattcatat

SEQ ID NO: 5157064 - DNA, 19 bp, Homo sapiens
actaaatgatctctgaaag

SEQ ID NO: 5157065 - DNA, 17 bp, Homo sapiens
actaaatgcctagtttt

SEQ ID NO: 5157066 - DNA, 19 bp, Homo sapiens
actaaatgcctagttttta

SEQ ID NO: 5157067 - DNA, 20 bp, Homo sapiens
actaaatgcctagtttttag

SEQ ID NO: 5157068 - DNA, 15 bp, Homo sapiens
actaaatggcagtga

SEQ ID NO: 5157069 - DNA, 17 bp, Homo sapiens
actaaatgtacagatat

SEQ ID NO: 5157070 - DNA, 17 bp, Homo sapiens
actaaatgtagttgtca

SEQ ID NO: 5157071 - DNA, 11 bp, Homo sapiens
actaaatgtta

SEQ ID NO: 5157072 - DNA, 15 bp, Homo sapiens
actaaatgttaaaga

SEQ ID NO: 5157073 - DNA, 14 bp, Homo sapiens
actaaatgttctat

SEQ ID NO: 5157074 - DNA, 20 bp, Homo sapiens
actaaattacgtatgcaagt

SEQ ID NO: 5157075 - DNA, 14 bp, Homo sapiens
actaaattagttta

SEQ ID NO: 5157076 - DNA, 16 bp, Homo sapiens
actaaattagtttaaa

SEQ ID NO: 5157077 - DNA, 18 bp, Homo sapiens
actaaattagtttaaaat

SEQ ID NO: 5157078 - DNA, 19 bp, Homo sapiens
actaaattattagcatttg

SEQ ID NO: 5157079 - DNA, 21 bp, Homo sapiens
actaaattattagcatttgtt

SEQ ID NO: 5157080 - DNA, 18 bp, Homo sapiens
actaaattcaaagaagta

SEQ ID NO: 5157081 - DNA, 21 bp, Homo sapiens
actaaattgcagtttacagta

SEQ ID NO: 5157082 - DNA, 23 bp, Homo sapiens
actaaattgcagtttacagtatt

SEQ ID NO: 5157083 - DNA, 20 bp, Homo sapiens
actaaattgtatacattttg

SEQ ID NO: 5157084 - DNA, 15 bp, Homo sapiens
actaaatttctcagt

SEQ ID NO: 5157085 - DNA, 21 bp, Homo sapiens
actaaatttgatacttatatt

SEQ ID NO: 5157086 - DNA, 22 bp, Homo sapiens
actaaatttgatacttatattt

SEQ ID NO: 5157087 - DNA, 19 bp, Homo sapiens
actaaatttggggacagat

SEQ ID NO: 5157088 - DNA, 24 bp, Homo sapiens
actaaatttggggacagattcagt

SEQ ID NO: 5157089 - DNA, 14 bp, Homo sapiens
actaaatttgtaaa

SEQ ID NO: 5157090 - DNA, 16 bp, Homo sapiens
actaaatttgtctttc

SEQ ID NO: 5157091 - DNA, 15 bp, Homo sapiens
actaaattttaaagc

SEQ ID NO: 5157092 - DNA, 14 bp, Homo sapiens
actaacaaaatttg

SEQ ID NO: 5157093 - DNA, 16 bp, Homo sapiens
actaacaaaatttgaa

SEQ ID NO: 5157094 - DNA, 19 bp, Homo sapiens
actaacaaaggcagctgtg

SEQ ID NO: 5157095 - DNA, 20 bp, Homo sapiens
actaacaaaggcagctgtgt

SEQ ID NO: 5157096 - DNA, 24 bp, Homo sapiens
actaacaaaggcagctgtgtctga

SEQ ID NO: 5157097 - DNA, 18 bp, Homo sapiens
actaacaagattaaatat

SEQ ID NO: 5157098 - DNA, 19 bp, Homo sapiens
actaacaagatttgtaatt

SEQ ID NO: 5157099 - DNA, 19 bp, Homo sapiens
actaacactcagaagcctg

SEQ ID NO: 5157100 - DNA, 14 bp, Homo sapiens
actaacagattata

SEQ ID NO: 5157101 - DNA, 22 bp, Homo sapiens
actaacagctacaaacttttaa

SEQ ID NO: 5157102 - DNA, 17 bp, Homo sapiens
actaacaggatatttaa

SEQ ID NO: 5157103 - DNA, 17 bp, Homo sapiens
actaacaggcttagtga

SEQ ID NO: 5157104 - DNA, 15 bp, Homo sapiens
actaacagggagaag

SEQ ID NO: 5157105 - DNA, 16 bp, Homo sapiens
actaacagtcaagaaa

SEQ ID NO: 5157106 - DNA, 15 bp, Homo sapiens
actaacatataatgt

SEQ ID NO: 5157107 - DNA, 22 bp, Homo sapiens
actaacatcccaataaagtcct

SEQ ID NO: 5157108 - DNA, 12 bp, Homo sapiens
actaacattata

SEQ ID NO: 5157109 - DNA, 15 bp, Homo sapiens
actaacattgtgact

SEQ ID NO: 5157110 - DNA, 22 bp, Homo sapiens
actaacattgtgactttgcttt

SEQ ID NO: 5157111 - DNA, 18 bp, Homo sapiens
actaacatttatttgagt

SEQ ID NO: 5157112 - DNA, 14 bp, Homo sapiens
actaaccaaatctc

SEQ ID NO: 5157113 - DNA, 21 bp, Homo sapiens
actaaccaagctgagtttcct

SEQ ID NO: 5157114 - DNA, 14 bp, Homo sapiens
actaaccaccattt

SEQ ID NO: 5157115 - DNA, 12 bp, Homo sapiens
actaaccacgct

SEQ ID NO: 5157116 - DNA, 14 bp, Homo sapiens
actaaccatcccca

SEQ ID NO: 5157117 - DNA, 16 bp, Homo sapiens
actaaccatccccaac

SEQ ID NO: 5157118 - DNA, 17 bp, Homo sapiens
actaaccatccccaact

SEQ ID NO: 5157119 - DNA, 14 bp, Homo sapiens
actaaccatttctt

SEQ ID NO: 5157120 - DNA, 17 bp, Homo sapiens
actaacccagtctttct

SEQ ID NO: 5157121 - DNA, 18 bp, Homo sapiens
actaacccagtctttctt

SEQ ID NO: 5157122 - DNA, 19 bp, Homo sapiens
actcctcggcctggctcct

SEQ ID NO: 5157123 - DNA, 18 bp, Homo sapiens
actcctcggtactcccat

SEQ ID NO: 5157124 - DNA, 17 bp, Homo sapiens
actcctctagtcagcac

SEQ ID NO: 5157125 - DNA, 22 bp, Homo sapiens
actcctctcaactgcctcagcg

SEQ ID NO: 5157126 - DNA, 22 bp, Homo sapiens
actcctctcccacagagtgctg

SEQ ID NO: 5157127 - DNA, 22 bp, Homo sapiens
actcctctccttcaaagaatga

SEQ ID NO: 5157128 - DNA, 20 bp, Homo sapiens
actcctctgcagtgccttgg

SEQ ID NO: 5157129 - DNA, 15 bp, Homo sapiens
actcctctgcgtcta

SEQ ID NO: 5157130 - DNA, 13 bp, Homo sapiens
actcctctgctga

SEQ ID NO: 5157131 - DNA, 22 bp, Homo sapiens
actcctctggctttcccaggag

SEQ ID NO: 5157132 - DNA, 13 bp, Homo sapiens
actcctctgggcc

SEQ ID NO: 5157133 - DNA, 21 bp, Homo sapiens
actcctctgggcctggggtgc

SEQ ID NO: 5157134 - DNA, 16 bp, Homo sapiens
actcctctgtctctgc

SEQ ID NO: 5157135 - DNA, 16 bp, Homo sapiens
actcctgaaaaaaaac

SEQ ID NO: 5157136 - DNA, 18 bp, Homo sapiens
actcctgaaacctcttcc

SEQ ID NO: 5157137 - DNA, 12 bp, Homo sapiens
actcctgaaatc

SEQ ID NO: 5157138 - DNA, 14 bp, Homo sapiens
actcctgaaattca

SEQ ID NO: 5157139 - DNA, 23 bp, Homo sapiens
actcctgaagggaaggcaaaggc

SEQ ID NO: 5157140 - DNA, 23 bp, Homo sapiens
actcctgaagtgagttttacacg

SEQ ID NO: 5157141 - DNA, 16 bp, Homo sapiens
actcctgacctcaggt

SEQ ID NO: 5157142 - DNA, 18 bp, Homo sapiens
actcctgacctcaggtga

SEQ ID NO: 5157143 - DNA, 19 bp, Homo sapiens
actcctgacgtctgaagct

SEQ ID NO: 5157144 - DNA, 21 bp, Homo sapiens
actcctgacgtctgaagcttg

SEQ ID NO: 5157145 - DNA, 18 bp, Homo sapiens
actcctgactcctacctg

SEQ ID NO: 5157146 - DNA, 20 bp, Homo sapiens
actcctgagacccctggcct

SEQ ID NO: 5157147 - DNA, 15 bp, Homo sapiens
actcctgatgccctc

SEQ ID NO: 5157148 - DNA, 21 bp, Homo sapiens
actcctgatgccctcttctcc

SEQ ID NO: 5157149 - DNA, 16 bp, Homo sapiens
actcctgattgctctg

SEQ ID NO: 5157150 - DNA, 20 bp, Homo sapiens
actcctgattttgtagttaa

SEQ ID NO: 5157151 - DNA, 15 bp, Homo sapiens
actcctgcaggcagc

SEQ ID NO: 5157152 - DNA, 9 bp, Homo sapiens
actcctgcc

SEQ ID NO: 5157153 - DNA, 17 bp, Homo sapiens
actcctgccaaggagga

SEQ ID NO: 5157154 - DNA, 15 bp, Homo sapiens
actcctgccagcccg

SEQ ID NO: 5157155 - DNA, 18 bp, Homo sapiens
actcctgccagcccggct

SEQ ID NO: 5157156 - DNA, 16 bp, Homo sapiens
actcctgccaggcaca

SEQ ID NO: 5157157 - DNA, 19 bp, Homo sapiens
actcctgccattcttctgg

SEQ ID NO: 5157158 - DNA, 12 bp, Homo sapiens
actcctgccccg

SEQ ID NO: 5157159 - DNA, 14 bp, Homo sapiens
actcctgcctcatg

SEQ ID NO: 5157160 - DNA, 19 bp, Homo sapiens
actcctgcctccgctggct

SEQ ID NO: 5157161 - DNA, 20 bp, Homo sapiens
actcctgcctccgctggctt

SEQ ID NO: 5157162 - DNA, 15 bp, Homo sapiens
actcctgcctgtgtt

SEQ ID NO: 5157163 - DNA, 21 bp, Homo sapiens
actcctgcggctgcctgcccc

SEQ ID NO: 5157164 - DNA, 13 bp, Homo sapiens
actcctgctggta

SEQ ID NO: 5157165 - DNA, 22 bp, Homo sapiens
actcctgctggtacctgccctc

SEQ ID NO: 5157166 - DNA, 12 bp, Homo sapiens
actcctgcttct

SEQ ID NO: 5157167 - DNA, 19 bp, Homo sapiens
actcctgcttctctcagcc

SEQ ID NO: 5157168 - DNA, 20 bp, Homo sapiens
actcctgcttctctcagcca

SEQ ID NO: 5157169 - DNA, 17 bp, Homo sapiens
actcctggactccggag

SEQ ID NO: 5157170 - DNA, 22 bp, Homo sapiens
actcctggactccggaggactg

SEQ ID NO: 5157171 - DNA, 23 bp, Homo sapiens
actcctggactccggaggactga

SEQ ID NO: 5157172 - DNA, 13 bp, Homo sapiens
actcctggcaggg

SEQ ID NO: 5157173 - DNA, 23 bp, Homo sapiens
actcctggcagggccacctgcag

SEQ ID NO: 5157174 - DNA, 11 bp, Homo sapiens
actcctggcct

SEQ ID NO: 5157175 - DNA, 14 bp, Homo sapiens
actcctggcctcaa

SEQ ID NO: 5157176 - DNA, 13 bp, Homo sapiens
actcctggcctcg

SEQ ID NO: 5157177 - DNA, 19 bp, Homo sapiens
actcctggctcaagccctg

SEQ ID NO: 5157178 - DNA, 23 bp, Homo sapiens
actcctgggcacccttaatcttc

SEQ ID NO: 5157179 - DNA, 16 bp, Homo sapiens
actcctgggccccaga

SEQ ID NO: 5157180 - DNA, 18 bp, Homo sapiens
actcctgggctcaagcaa

SEQ ID NO: 5157181 - DNA, 16 bp, Homo sapiens
actcctggggcctctt

SEQ ID NO: 5157182 - DNA, 21 bp, Homo sapiens
actcctggggcctcttgggtc

SEQ ID NO: 5157183 - DNA, 16 bp, Homo sapiens
actcctgggttgagct

SEQ ID NO: 5157184 - DNA, 16 bp, Homo sapiens
actcctggtcctaggc

SEQ ID NO: 5157185 - DNA, 22 bp, Homo sapiens
actcctggtcctaggctggaag

SEQ ID NO: 5157186 - DNA, 21 bp, Homo sapiens
actcctggtctgaaaatgttg

SEQ ID NO: 5157187 - DNA, 12 bp, Homo sapiens
actcctggtgcc

SEQ ID NO: 5157188 - DNA, 16 bp, Homo sapiens
actcctggtgcccctc

SEQ ID NO: 5157189 - DNA, 15 bp, Homo sapiens
actcctgtcagcccc

SEQ ID NO: 5157190 - DNA, 20 bp, Homo sapiens
actcctgtcccgccttcctc

SEQ ID NO: 5157191 - DNA, 16 bp, Homo sapiens
actcctgtccctgtag

SEQ ID NO: 5157192 - DNA, 22 bp, Homo sapiens
actcctgtccctgtagctcagt

SEQ ID NO: 5157193 - DNA, 21 bp, Homo sapiens
actcctgtctgtcctggaggt

SEQ ID NO: 5157194 - DNA, 17 bp, Homo sapiens
actcctgtcttctttct

SEQ ID NO: 5157195 - DNA, 14 bp, Homo sapiens
actcctgtgctctg

SEQ ID NO: 5157196 - DNA, 22 bp, Homo sapiens
actcctgtgctctggaggctgc

SEQ ID NO: 5157197 - DNA, 17 bp, Homo sapiens
actcctgtgggagcctc

SEQ ID NO: 5157198 - DNA, 18 bp, Homo sapiens
actcctgtgggagcctcg

SEQ ID NO: 5157199 - DNA, 12 bp, Homo sapiens
actcctgtgtgt

SEQ ID NO: 5157200 - DNA, 19 bp, Homo sapiens
actcctgtgtgtggaaggc

SEQ ID NO: 5157201 - DNA, 22 bp, Homo sapiens
actcctgttccttgctagccct

SEQ ID NO: 5157202 - DNA, 20 bp, Homo sapiens
actcctgttctttgggctca

SEQ ID NO: 5157203 - DNA, 18 bp, Homo sapiens
actcctgttgccatggat

SEQ ID NO: 5157204 - DNA, 22 bp, Homo sapiens
actccttaccaatagcctgaat

SEQ ID NO: 5157205 - DNA, 12 bp, Homo sapiens
actccttagaga

SEQ ID NO: 5157206 - DNA, 21 bp, Homo sapiens
actccttatctctttccacca

SEQ ID NO: 5157207 - DNA, 15 bp, Homo sapiens
actccttatttggcg

SEQ ID NO: 5157208 - DNA, 12 bp, Homo sapiens
actccttccagc

SEQ ID NO: 5157209 - DNA, 23 bp, Homo sapiens
actccttccagtgtccttagaac

SEQ ID NO: 5157210 - DNA, 15 bp, Homo sapiens
actccttccatctct

SEQ ID NO: 5157211 - DNA, 20 bp, Homo sapiens
actccttccatctcttcctt

SEQ ID NO: 5157212 - DNA, 19 bp, Homo sapiens
actccttccccacttctgt

SEQ ID NO: 5157213 - DNA, 17 bp, Homo sapiens
actccttccctaatagc

SEQ ID NO: 5157214 - DNA, 19 bp, Homo sapiens
actccttccctaatagctt

SEQ ID NO: 5157215 - DNA, 15 bp, Homo sapiens
actccttcctgcccc

SEQ ID NO: 5157216 - DNA, 14 bp, Homo sapiens
actccttcctggcc

SEQ ID NO: 5157217 - DNA, 15 bp, Homo sapiens
actccttcctggcct

SEQ ID NO: 5157218 - DNA, 17 bp, Homo sapiens
actccttcctggcctga

SEQ ID NO: 5157219 - DNA, 19 bp, Homo sapiens
actccttcctggcctgaga

SEQ ID NO: 5157220 - DNA, 21 bp, Homo sapiens
actccttccttcaggactctg

SEQ ID NO: 5157221 - DNA, 23 bp, Homo sapiens
actccttccttcaggactctgcg

SEQ ID NO: 5157222 - DNA, 14 bp, Homo sapiens
actccttctcccca

SEQ ID NO: 5157223 - DNA, 14 bp, Homo sapiens
actccttctctcac

SEQ ID NO: 5157224 - DNA, 16 bp, Homo sapiens
actccttctctcactg

SEQ ID NO: 5157225 - DNA, 22 bp, Homo sapiens
actccttctgccagttccctcc

SEQ ID NO: 5157226 - DNA, 23 bp, Homo sapiens
actccttctgccagttccctccc

SEQ ID NO: 5157227 - DNA, 21 bp, Homo sapiens
actccttctgttttgagtttt

SEQ ID NO: 5157228 - DNA, 21 bp, Homo sapiens
actccttgaaaccagctcagg

SEQ ID NO: 5157229 - DNA, 12 bp, Homo sapiens
actccttgcatc

SEQ ID NO: 5157230 - DNA, 17 bp, Homo sapiens
actccttggatttgcat

SEQ ID NO: 5157231 - DNA, 19 bp, Homo sapiens
actccttggatttgcattt

SEQ ID NO: 5157232 - DNA, 18 bp, Homo sapiens
actccttgtggtttatgt

SEQ ID NO: 5157233 - DNA, 19 bp, Homo sapiens
actccttgtggtttatgtc

SEQ ID NO: 5157234 - DNA, 21 bp, Homo sapiens
actccttgtggtttatgtcat

SEQ ID NO: 5157235 - DNA, 16 bp, Homo sapiens
actccttgttctgctc

SEQ ID NO: 5157236 - DNA, 14 bp, Homo sapiens
actcctttatctgt

SEQ ID NO: 5157237 - DNA, 17 bp, Homo sapiens
actcctttatctgtaat

SEQ ID NO: 5157238 - DNA, 20 bp, Homo sapiens
actcctttccaatagaaaga

SEQ ID NO: 5157239 - DNA, 14 bp, Homo sapiens
actcctttcctctg

SEQ ID NO: 5157240 - DNA, 20 bp, Homo sapiens
actcctttcctgcatctttc

SEQ ID NO: 5157241 - DNA, 24 bp, Homo sapiens
actcctttctaaggagcactagaa

SEQ ID NO: 5157242 - DNA, 19 bp, Homo sapiens
actcctttgcattccatga

SEQ ID NO: 5157243 - DNA, 20 bp, Homo sapiens
actcctttgcattccatgat

SEQ ID NO: 5157244 - DNA, 22 bp, Homo sapiens
actcctttgcattccatgattt

SEQ ID NO: 5157245 - DNA, 19 bp, Homo sapiens
actcctttggtatttcact

SEQ ID NO: 5157246 - DNA, 14 bp, Homo sapiens
actcgaaactgaca

SEQ ID NO: 5157247 - DNA, 22 bp, Homo sapiens
actcgacaaaggccacaggcag

SEQ ID NO: 5157248 - DNA, 13 bp, Homo sapiens
actcgacccagaa

SEQ ID NO: 5157249 - DNA, 16 bp, Homo sapiens
actcgagaccttttca

SEQ ID NO: 5157250 - DNA, 17 bp, Homo sapiens
actcgagaccttttcaa

SEQ ID NO: 5157251 - DNA, 18 bp, Homo sapiens
actcgagagggctgagcc

SEQ ID NO: 5157252 - DNA, 13 bp, Homo sapiens
actcgaggcctgc

SEQ ID NO: 5157253 - DNA, 16 bp, Homo sapiens
actcgaggcctgcaaa

SEQ ID NO: 5157254 - DNA, 14 bp, Homo sapiens
actcgagtctgagg

SEQ ID NO: 5157255 - DNA, 18 bp, Homo sapiens
actcgagtgtttaaatgc

SEQ ID NO: 5157256 - DNA, 19 bp, Homo sapiens
actcgatcaaaaccttcct

SEQ ID NO: 5157257 - DNA, 14 bp, Homo sapiens
actcgatgcactga

SEQ ID NO: 5157258 - DNA, 16 bp, Homo sapiens
actcgatgcactgacc

SEQ ID NO: 5157259 - DNA, 17 bp, Homo sapiens
actcgattttaccatat

SEQ ID NO: 5157260 - DNA, 20 bp, Homo sapiens
actcgcacctgtgctggagc

SEQ ID NO: 5157261 - DNA, 14 bp, Homo sapiens
actcgccacctgcc

SEQ ID NO: 5157262 - DNA, 18 bp, Homo sapiens
actcgccatctcctgggc

SEQ ID NO: 5157263 - DNA, 12 bp, Homo sapiens
actcgcccccag

SEQ ID NO: 5157264 - DNA, 14 bp, Homo sapiens
actcgcccgcccac

SEQ ID NO: 5157265 - DNA, 15 bp, Homo sapiens
actcgcccgcccact

SEQ ID NO: 5157266 - DNA, 17 bp, Homo sapiens
actcgcctcagcctgat

SEQ ID NO: 5157267 - DNA, 16 bp, Homo sapiens
actcgcgacaatgcaa

SEQ ID NO: 5157268 - DNA, 15 bp, Homo sapiens
actcgcgctcagtaa

SEQ ID NO: 5157269 - DNA, 14 bp, Homo sapiens
actcgctagcagtg

SEQ ID NO: 5157270 - DNA, 23 bp, Homo sapiens
actcgctcctagtgtttctttgt

SEQ ID NO: 5157271 - DNA, 12 bp, Homo sapiens
actcgcttcccc

SEQ ID NO: 5157272 - DNA, 20 bp, Homo sapiens
actcgcttcccccatagcca

SEQ ID NO: 5157273 - DNA, 16 bp, Homo sapiens
actcgcttctctgtga

SEQ ID NO: 5157274 - DNA, 17 bp, Homo sapiens
actcgcttgctagaagt

SEQ ID NO: 5157275 - DNA, 18 bp, Homo sapiens
actcgcttgtaaatacca

SEQ ID NO: 5157276 - DNA, 23 bp, Homo sapiens
actcgcttgtgcagaaaacattg

SEQ ID NO: 5157277 - DNA, 21 bp, Homo sapiens
actcggacttgaatgctgccc

SEQ ID NO: 5157278 - DNA, 16 bp, Homo sapiens
actcggagagggctgc

SEQ ID NO: 5157279 - DNA, 18 bp, Homo sapiens
actcggatggggcacgga

SEQ ID NO: 5157280 - DNA, 22 bp, Homo sapiens
actcggatgtgtcctttctgaa

SEQ ID NO: 5157281 - DNA, 22 bp, Homo sapiens
actcggcagcccttccaaactc

SEQ ID NO: 5157282 - DNA, 16 bp, Homo sapiens
actcggcccagggccg

SEQ ID NO: 5157283 - DNA, 21 bp, Homo sapiens
actcggcctcccaaagtgctg

SEQ ID NO: 5157284 - DNA, 22 bp, Homo sapiens
actcggcctcccaaagtgctgg

SEQ ID NO: 5157285 - DNA, 13 bp, Homo sapiens
actcgggagctgc

SEQ ID NO: 5157286 - DNA, 14 bp, Homo sapiens
actcgggagctgca

SEQ ID NO: 5157287 - DNA, 15 bp, Homo sapiens
actcgggagctgcac

SEQ ID NO: 5157288 - DNA, 20 bp, Homo sapiens
actcgggaggctgagacagg

SEQ ID NO: 5157289 - DNA, 15 bp, Homo sapiens
actcgggctcctgtg

SEQ ID NO: 5157290 - DNA, 18 bp, Homo sapiens
actcgggctcctgtgccc

SEQ ID NO: 5157291 - DNA, 16 bp, Homo sapiens
actcggggcccccatc

SEQ ID NO: 5157292 - DNA, 18 bp, Homo sapiens
actcgggggcgcctggag

SEQ ID NO: 5157293 - DNA, 14 bp, Homo sapiens
actcgggggctggt

SEQ ID NO: 5157294 - DNA, 19 bp, Homo sapiens
actcgggggtggagtgaga

SEQ ID NO: 5157295 - DNA, 18 bp, Homo sapiens
actcggtgtccccaccat

SEQ ID NO: 5157296 - DNA, 21 bp, Homo sapiens
actcgtccaagggacagccca

SEQ ID NO: 5157297 - DNA, 19 bp, Homo sapiens
actcgtccccctcctgcct

SEQ ID NO: 5157298 - DNA, 20 bp, Homo sapiens
actcgtgacagcctctgact

SEQ ID NO: 5157299 - DNA, 15 bp, Homo sapiens
actcgtgagcgccag

SEQ ID NO: 5157300 - DNA, 18 bp, Homo sapiens
actcgtgtgcatgagaat

SEQ ID NO: 5157301 - DNA, 21 bp, Homo sapiens
actcgtgtgcatgagaatgtc

SEQ ID NO: 5157302 - DNA, 23 bp, Homo sapiens
actcgtgtgtttctattttttga

SEQ ID NO: 5157303 - DNA, 15 bp, Homo sapiens
actcgttaaagcaaa

SEQ ID NO: 5157304 - DNA, 16 bp, Homo sapiens
actcgttacctgccgc

SEQ ID NO: 5157305 - DNA, 18 bp, Homo sapiens
actcgttattcatacaaa

SEQ ID NO: 5157306 - DNA, 20 bp, Homo sapiens
actcgttctcgtgacccagt

SEQ ID NO: 5157307 - DNA, 22 bp, Homo sapiens
actcgttctcgtgacccagtgg

SEQ ID NO: 5157308 - DNA, 23 bp, Homo sapiens
actcgttctgttacccagggctc

SEQ ID NO: 5157309 - DNA, 16 bp, Homo sapiens
actcgttggatgtctg

SEQ ID NO: 5157310 - DNA, 13 bp, Homo sapiens
actcgtttttata

SEQ ID NO: 5157311 - DNA, 15 bp, Homo sapiens
actctaaaaatagaa

SEQ ID NO: 5157312 - DNA, 15 bp, Homo sapiens
actctaaaagatcct

SEQ ID NO: 5157313 - DNA, 13 bp, Homo sapiens
actctaaaatatg

SEQ ID NO: 5157314 - DNA, 14 bp, Homo sapiens
actctaaaatatgg

SEQ ID NO: 5157315 - DNA, 21 bp, Homo sapiens
actctaaacaatagttcactc

SEQ ID NO: 5157316 - DNA, 20 bp, Homo sapiens
actctaaacacacaagtaga

SEQ ID NO: 5157317 - DNA, 23 bp, Homo sapiens
actctaaagaaacagaagattac

SEQ ID NO: 5157318 - DNA, 16 bp, Homo sapiens
actctaaagaccaaac

SEQ ID NO: 5157319 - DNA, 12 bp, Homo sapiens
actctaaagatt

SEQ ID NO: 5157320 - DNA, 12 bp, Homo sapiens
actctaaatagc

SEQ ID NO: 5157321 - DNA, 17 bp, Homo sapiens
actctaaattctttatt

SEQ ID NO: 5157322 - DNA, 17 bp, Homo sapiens
actctaacactcgactc

SEQ ID NO: 5157323 - DNA, 14 bp, Homo sapiens
actctaacaggcac

SEQ ID NO: 5157324 - DNA, 20 bp, Homo sapiens
actctaaccaaggctgtgtt

SEQ ID NO: 5157325 - DNA, 13 bp, Homo sapiens
actctaaccagtg

SEQ ID NO: 5157326 - DNA, 14 bp, Homo sapiens
actctaaccctgtg

SEQ ID NO: 5157327 - DNA, 16 bp, Homo sapiens
actctaaccctgtgga

SEQ ID NO: 5157328 - DNA, 17 bp, Homo sapiens
actctaaccctgtggaa

SEQ ID NO: 5157329 - DNA, 16 bp, Homo sapiens
actctaactctgagag

SEQ ID NO: 5157330 - DNA, 15 bp, Homo sapiens
actctaagaaagaac

SEQ ID NO: 5157331 - DNA, 22 bp, Homo sapiens
actctaagatacactgcacttt

SEQ ID NO: 5157332 - DNA, 17 bp, Homo sapiens
actctaagatcttagat

SEQ ID NO: 5157333 - DNA, 21 bp, Homo sapiens
actctaagatcttagattctc

SEQ ID NO: 5157334 - DNA, 13 bp, Homo sapiens
actctaagatgtt

SEQ ID NO: 5157335 - DNA, 13 bp, Homo sapiens
actctaagcagaa

SEQ ID NO: 5157336 - DNA, 16 bp, Homo sapiens
actctaagctgtgtgc

SEQ ID NO: 5157337 - DNA, 20 bp, Homo sapiens
actctaagtcatgtatgttt

SEQ ID NO: 5157338 - DNA, 14 bp, Homo sapiens
actctaatagtgct

SEQ ID NO: 5157339 - DNA, 19 bp, Homo sapiens
actctaatatgattataca

SEQ ID NO: 5157340 - DNA, 21 bp, Homo sapiens
actctaattagagaactggag

SEQ ID NO: 5157341 - DNA, 19 bp, Homo sapiens
actctaattggtcattcct

SEQ ID NO: 5157342 - DNA, 18 bp, Homo sapiens
actctacaccctctgccc

SEQ ID NO: 5157343 - DNA, 14 bp, Homo sapiens
actctacactgaaa

SEQ ID NO: 5157344 - DNA, 16 bp, Homo sapiens
actctacactgtgaac

SEQ ID NO: 5157345 - DNA, 14 bp, Homo sapiens
actctacagactcc

SEQ ID NO: 5157346 - DNA, 19 bp, Homo sapiens
actctacataatttagagt

SEQ ID NO: 5157347 - DNA, 13 bp, Homo sapiens
actctacatttaa

SEQ ID NO: 5157348 - DNA, 16 bp, Homo sapiens
actctacatttaaaca

SEQ ID NO: 5157349 - DNA, 18 bp, Homo sapiens
actctaccagtgcaggct

SEQ ID NO: 5157350 - DNA, 22 bp, Homo sapiens
actctaccagtgcaggctggcc

SEQ ID NO: 5157351 - DNA, 22 bp, Homo sapiens
actctaccatggttctgcctcc

SEQ ID NO: 5157352 - DNA, 24 bp, Homo sapiens
actctaccatggttctgcctcctg

SEQ ID NO: 5157353 - DNA, 17 bp, Homo sapiens
actctacccatattaca

SEQ ID NO: 5157354 - DNA, 18 bp, Homo sapiens
actctacccccaacacca

SEQ ID NO: 5157355 - DNA, 21 bp, Homo sapiens
actctaccctcttagaaaaac

SEQ ID NO: 5157356 - DNA, 16 bp, Homo sapiens
actctacctaatgtct

SEQ ID NO: 5157357 - DNA, 13 bp, Homo sapiens
actctacctcata

SEQ ID NO: 5157358 - DNA, 21 bp, Homo sapiens
actctactattaagtttgaaa

SEQ ID NO: 5157359 - DNA, 17 bp, Homo sapiens
actctactcccagcgct

SEQ ID NO: 5157360 - DNA, 20 bp, Homo sapiens
actctactgcaagacttaaa

SEQ ID NO: 5157361 - DNA, 20 bp, Homo sapiens
actctagaacatgcacattt

SEQ ID NO: 5157362 - DNA, 19 bp, Homo sapiens
actctagacaagatattgt

SEQ ID NO: 5157363 - DNA, 21 bp, Homo sapiens
actctagacaagatattgtac

SEQ ID NO: 5157364 - DNA, 15 bp, Homo sapiens
actctagagagcctt

SEQ ID NO: 5157365 - DNA, 21 bp, Homo sapiens
actctagagagccttaacttc

SEQ ID NO: 5157366 - DNA, 12 bp, Homo sapiens
actctagagggc

SEQ ID NO: 5157367 - DNA, 14 bp, Homo sapiens
actctagagtccaa

SEQ ID NO: 5157368 - DNA, 21 bp, Homo sapiens
actctagatacctaaaacata

SEQ ID NO: 5157369 - DNA, 22 bp, Homo sapiens
actctagatgaagttttacatt

SEQ ID NO: 5157370 - DNA, 12 bp, Homo sapiens
actctagatgtt

SEQ ID NO: 5157371 - DNA, 14 bp, Homo sapiens
actctagattccat

SEQ ID NO: 5157372 - DNA, 14 bp, Homo sapiens
actctagattttgt

SEQ ID NO: 5157373 - DNA, 19 bp, Homo sapiens
actctagattttgttttgc

SEQ ID NO: 5157374 - DNA, 21 bp, Homo sapiens
actctagattttgttttgctt

SEQ ID NO: 5157375 - DNA, 23 bp, Homo sapiens
actctagcctggcaacagagcga

SEQ ID NO: 5157376 - DNA, 17 bp, Homo sapiens
actctagcctgggccag

SEQ ID NO: 5157377 - DNA, 20 bp, Homo sapiens
actctagctgggggtgggcc

SEQ ID NO: 5157378 - DNA, 13 bp, Homo sapiens
actctaggaagaa

SEQ ID NO: 5157379 - DNA, 13 bp, Homo sapiens
actctaggactgg

SEQ ID NO: 5157380 - DNA, 17 bp, Homo sapiens
actctaggactgggccc

SEQ ID NO: 5157381 - DNA, 21 bp, Homo sapiens
actctaggatgtatattttat

SEQ ID NO: 5157382 - DNA, 23 bp, Homo sapiens
actctagggatataaaaacagat

SEQ ID NO: 5157383 - DNA, 12 bp, Homo sapiens
actctaggttat

SEQ ID NO: 5157384 - DNA, 15 bp, Homo sapiens
actctaggttataca

SEQ ID NO: 5157385 - DNA, 20 bp, Homo sapiens
actctaggttatacaataac

SEQ ID NO: 5157386 - DNA, 19 bp, Homo sapiens
actctagtcaatgacatga

SEQ ID NO: 5157387 - DNA, 18 bp, Homo sapiens
actctagtgacttcctgg

SEQ ID NO: 5157388 - DNA, 16 bp, Homo sapiens
actctagttctagatg

SEQ ID NO: 5157389 - DNA, 17 bp, Homo sapiens
actctagttctagatga

SEQ ID NO: 5157390 - DNA, 13 bp, Homo sapiens
actctataaagaa

SEQ ID NO: 5157391 - DNA, 18 bp, Homo sapiens
actctataaagaaacttt

SEQ ID NO: 5157392 - DNA, 16 bp, Homo sapiens
actctatactcaatca

SEQ ID NO: 5157393 - DNA, 13 bp, Homo sapiens
actctatatactt

SEQ ID NO: 5157394 - DNA, 15 bp, Homo sapiens
actctatatgtagtg

SEQ ID NO: 5157395 - DNA, 16 bp, Homo sapiens
actctatattgttcag

SEQ ID NO: 5157396 - DNA, 15 bp, Homo sapiens
actctatcaaatgtg

SEQ ID NO: 5157397 - DNA, 14 bp, Homo sapiens
actctatcaagtat

SEQ ID NO: 5157398 - DNA, 13 bp, Homo sapiens
actctatcagcat

SEQ ID NO: 5157399 - DNA, 17 bp, Homo sapiens
actctatccctggcttc

SEQ ID NO: 5157400 - DNA, 20 bp, Homo sapiens
actctatcggagaacatgaa

SEQ ID NO: 5157401 - DNA, 23 bp, Homo sapiens
actctatcggagaacatgaatca

SEQ ID NO: 5157402 - DNA, 15 bp, Homo sapiens
actctatctgggcct

SEQ ID NO: 5157403 - DNA, 17 bp, Homo sapiens
actctatgccccaaata

SEQ ID NO: 5157404 - DNA, 19 bp, Homo sapiens
actctatgccccaaatata

SEQ ID NO: 5157405 - DNA, 20 bp, Homo sapiens
actctatgccccaaatatag

SEQ ID NO: 5157406 - DNA, 13 bp, Homo sapiens
actctatggtctt

SEQ ID NO: 5157407 - DNA, 17 bp, Homo sapiens
actctatgttctaagaa

SEQ ID NO: 5157408 - DNA, 14 bp, Homo sapiens
actctattctcaaa

SEQ ID NO: 5157409 - DNA, 14 bp, Homo sapiens
actctattctttaa

SEQ ID NO: 5157410 - DNA, 13 bp, Homo sapiens
actctattttaat

SEQ ID NO: 5157411 - DNA, 16 bp, Homo sapiens
actctatttttacatt

SEQ ID NO: 5157412 - DNA, 16 bp, Homo sapiens
actctcaaaagtctat

SEQ ID NO: 5157413 - DNA, 22 bp, Homo sapiens
actctcaatgcattttcaagat

SEQ ID NO: 5157414 - DNA, 15 bp, Homo sapiens
actctcacccataaa

SEQ ID NO: 5157415 - DNA, 19 bp, Homo sapiens
actctcacccataaacagt

SEQ ID NO: 5157416 - DNA, 22 bp, Homo sapiens
actctcaccccccgacctggct

SEQ ID NO: 5157417 - DNA, 23 bp, Homo sapiens
actctcaccccccgacctggctg

SEQ ID NO: 5157418 - DNA, 17 bp, Homo sapiens
actctcactatgctgct

SEQ ID NO: 5157419 - DNA, 19 bp, Homo sapiens
actctcactatgctgctat

SEQ ID NO: 5157420 - DNA, 18 bp, Homo sapiens
actctcagagactcccag

SEQ ID NO: 5157421 - DNA, 22 bp, Homo sapiens
actctcaggaaatgctgaccca

SEQ ID NO: 5157422 - DNA, 17 bp, Homo sapiens
actctcaggaccaccct

SEQ ID NO: 5157423 - DNA, 20 bp, Homo sapiens
actctcaggaccaccctgcc

SEQ ID NO: 5157424 - DNA, 22 bp, Homo sapiens
actctcaggaggcgcagcccga

SEQ ID NO: 5157425 - DNA, 24 bp, Homo sapiens
actctcaggaggcgcagcccgaag

SEQ ID NO: 5157426 - DNA, 22 bp, Homo sapiens
actctcaggatcaagaaagtgt

SEQ ID NO: 5157427 - DNA, 21 bp, Homo sapiens
actctcagtcagtgtcatgaa

SEQ ID NO: 5157428 - DNA, 13 bp, Homo sapiens
actctcagtctct

SEQ ID NO: 5157429 - DNA, 19 bp, Homo sapiens
actctcatgtccccttcct

SEQ ID NO: 5157430 - DNA, 21 bp, Homo sapiens
actctcatgtccccttcctgt

SEQ ID NO: 5157431 - DNA, 22 bp, Homo sapiens
actctcattttatttacagctg

SEQ ID NO: 5157432 - DNA, 24 bp, Homo sapiens
actctcattttatttacagctgtg

SEQ ID NO: 5157433 - DNA, 16 bp, Homo sapiens
actctccaatgttcta

SEQ ID NO: 5157434 - DNA, 19 bp, Homo sapiens
actctccaatgttctatta

SEQ ID NO: 5157435 - DNA, 15 bp, Homo sapiens
actctccacctcact

SEQ ID NO: 5157436 - DNA, 22 bp, Homo sapiens
actctccacctcactagctccc

SEQ ID NO: 5157437 - DNA, 15 bp, Homo sapiens
actctccactgacct

SEQ ID NO: 5157438 - DNA, 19 bp, Homo sapiens
actctccagccattgtaat

SEQ ID NO: 5157439 - DNA, 20 bp, Homo sapiens
actctccaggattgtccaca

SEQ ID NO: 5157440 - DNA, 23 bp, Homo sapiens
actctccaggcaccgcctgcccc

SEQ ID NO: 5157441 - DNA, 21 bp, Homo sapiens
actctccagttatcagtactc

SEQ ID NO: 5157442 - DNA, 13 bp, Homo sapiens
actctccatatcc

SEQ ID NO: 5157443 - DNA, 13 bp, Homo sapiens
actctccatctta

SEQ ID NO: 5157444 - DNA, 21 bp, Homo sapiens
actctcccaaagggcacaccc

SEQ ID NO: 5157445 - DNA, 21 bp, Homo sapiens
actctcccaggcctgcctgca

SEQ ID NO: 5157446 - DNA, 19 bp, Homo sapiens
actctcccattatatttat

SEQ ID NO: 5157447 - DNA, 14 bp, Homo sapiens
actctccccacact

SEQ ID NO: 5157448 - DNA, 21 bp, Homo sapiens
actctccccacgagggctggc

SEQ ID NO: 5157449 - DNA, 11 bp, Homo sapiens
actctccccag

SEQ ID NO: 5157450 - DNA, 12 bp, Homo sapiens
actctccccagt

SEQ ID NO: 5157451 - DNA, 13 bp, Homo sapiens
actctccccagtc

SEQ ID NO: 5157452 - DNA, 10 bp, Homo sapiens
actctccccc

SEQ ID NO: 5157453 - DNA, 14 bp, Homo sapiens
actctccccctttc

SEQ ID NO: 5157454 - DNA, 15 bp, Homo sapiens
actctccccctttca

SEQ ID NO: 5157455 - DNA, 23 bp, Homo sapiens
actctccccgctcaggggcctgg

SEQ ID NO: 5157456 - DNA, 12 bp, Homo sapiens
actctcccctcc

SEQ ID NO: 5157457 - DNA, 16 bp, Homo sapiens
actctcccctccccat

SEQ ID NO: 5157458 - DNA, 19 bp, Homo sapiens
actctcccctccccatctg

SEQ ID NO: 5157459 - DNA, 22 bp, Homo sapiens
actctcccctccccatctgtgt

SEQ ID NO: 5157460 - DNA, 19 bp, Homo sapiens
actctcccctgaatcctca

SEQ ID NO: 5157461 - DNA, 20 bp, Homo sapiens
actctcccctgaatcctcag

SEQ ID NO: 5157462 - DNA, 14 bp, Homo sapiens
actctcccctttct

SEQ ID NO: 5157463 - DNA, 15 bp, Homo sapiens
actctcccctttctt

SEQ ID NO: 5157464 - DNA, 16 bp, Homo sapiens
actctccctctggtct

SEQ ID NO: 5157465 - DNA, 21 bp, Homo sapiens
actctccgaagtctgatccct

SEQ ID NO: 5157466 - DNA, 12 bp, Homo sapiens
actctcctagag

SEQ ID NO: 5157467 - DNA, 12 bp, Homo sapiens
actctcctagtg

SEQ ID NO: 5157468 - DNA, 16 bp, Homo sapiens
actctcctctgcctca

SEQ ID NO: 5157469 - DNA, 17 bp, Homo sapiens
actctcctctgctgctg

SEQ ID NO: 5157470 - DNA, 13 bp, Homo sapiens
actctcctctttt

SEQ ID NO: 5157471 - DNA, 13 bp, Homo sapiens
actctcctgagga

SEQ ID NO: 5157472 - DNA, 16 bp, Homo sapiens
actctcctgaggagca

SEQ ID NO: 5157473 - DNA, 19 bp, Homo sapiens
actctcctgctcctcagga

SEQ ID NO: 5157474 - DNA, 15 bp, Homo sapiens
actctcctggactgc

SEQ ID NO: 5157475 - DNA, 11 bp, Homo sapiens
actctcctggg

SEQ ID NO: 5157476 - DNA, 15 bp, Homo sapiens
actctcctgggcccc

SEQ ID NO: 5157477 - DNA, 17 bp, Homo sapiens
actctcctgggcccctc

SEQ ID NO: 5157478 - DNA, 16 bp, Homo sapiens
actctcctgtttggaa

SEQ ID NO: 5157479 - DNA, 17 bp, Homo sapiens
actaaccccaacgcaca

SEQ ID NO: 5157480 - DNA, 21 bp, Homo sapiens
actaaccccaacgcacaggaa

SEQ ID NO: 5157481 - DNA, 17 bp, Homo sapiens
actaacgataaaaggta

SEQ ID NO: 5157482 - DNA, 18 bp, Homo sapiens
actaacgttgagcccctg

SEQ ID NO: 5157483 - DNA, 14 bp, Homo sapiens
actaactaaaacaa

SEQ ID NO: 5157484 - DNA, 15 bp, Homo sapiens
actaactaaaacaaa

SEQ ID NO: 5157485 - DNA, 13 bp, Homo sapiens
actaactaaactc

SEQ ID NO: 5157486 - DNA, 23 bp, Homo sapiens
actaactaaccacattttaggat

SEQ ID NO: 5157487 - DNA, 20 bp, Homo sapiens
actaactagacaccaaagtt

SEQ ID NO: 5157488 - DNA, 12 bp, Homo sapiens
actaactagagc

SEQ ID NO: 5157489 - DNA, 16 bp, Homo sapiens
actaactatgcaataa

SEQ ID NO: 5157490 - DNA, 15 bp, Homo sapiens
actaactatgcatgg

SEQ ID NO: 5157491 - DNA, 22 bp, Homo sapiens
actaactcaccagccccactgc

SEQ ID NO: 5157492 - DNA, 15 bp, Homo sapiens
actaactcaggtgta

SEQ ID NO: 5157493 - DNA, 21 bp, Homo sapiens
actaactcctgagaaatgtta

SEQ ID NO: 5157494 - DNA, 15 bp, Homo sapiens
actaactgccatgta

SEQ ID NO: 5157495 - DNA, 15 bp, Homo sapiens
actaactgcttcatc

SEQ ID NO: 5157496 - DNA, 23 bp, Homo sapiens
actaactgcttcatctccttttg

SEQ ID NO: 5157497 - DNA, 20 bp, Homo sapiens
actaactgtttacatatctg

SEQ ID NO: 5157498 - DNA, 13 bp, Homo sapiens
actaacttctaaa

SEQ ID NO: 5157499 - DNA, 17 bp, Homo sapiens
actaacttctaaaactg

SEQ ID NO: 5157500 - DNA, 19 bp, Homo sapiens
actaacttctaaaactgta

SEQ ID NO: 5157501 - DNA, 11 bp, Homo sapiens
actaacttgtt

SEQ ID NO: 5157502 - DNA, 21 bp, Homo sapiens
actaacttttttttttttaac

SEQ ID NO: 5157503 - DNA, 13 bp, Homo sapiens
actaagaaacttt

SEQ ID NO: 5157504 - DNA, 15 bp, Homo sapiens
actaagaaacttttg

SEQ ID NO: 5157505 - DNA, 16 bp, Homo sapiens
actaagaaagaaagga

SEQ ID NO: 5157506 - DNA, 18 bp, Homo sapiens
actaagaaagaaaggaaa

SEQ ID NO: 5157507 - DNA, 21 bp, Homo sapiens
actaagaaatgggactctgaa

SEQ ID NO: 5157508 - DNA, 22 bp, Homo sapiens
actaagaagtggtgttccatga

SEQ ID NO: 5157509 - DNA, 14 bp, Homo sapiens
actaagaagtttaa

SEQ ID NO: 5157510 - DNA, 21 bp, Homo sapiens
actaagaatgtccttattctt

SEQ ID NO: 5157511 - DNA, 18 bp, Homo sapiens
actaagaattcaaactgg

SEQ ID NO: 5157512 - DNA, 18 bp, Homo sapiens
actaagaattttgtttta

SEQ ID NO: 5157513 - DNA, 14 bp, Homo sapiens
actaagacaagaac

SEQ ID NO: 5157514 - DNA, 16 bp, Homo sapiens
actaagactgcttcta

SEQ ID NO: 5157515 - DNA, 18 bp, Homo sapiens
actaagagaaaattgcac

SEQ ID NO: 5157516 - DNA, 16 bp, Homo sapiens
actaagagaaaccttg

SEQ ID NO: 5157517 - DNA, 17 bp, Homo sapiens
actaagagaaactgtgt

SEQ ID NO: 5157518 - DNA, 19 bp, Homo sapiens
actaagagacagttctctg

SEQ ID NO: 5157519 - DNA, 20 bp, Homo sapiens
actaagagacagttctctgt

SEQ ID NO: 5157520 - DNA, 13 bp, Homo sapiens
actaagagagaat

SEQ ID NO: 5157521 - DNA, 17 bp, Homo sapiens
actaagaggtgggagga

SEQ ID NO: 5157522 - DNA, 19 bp, Homo sapiens
actaagatcggttaacaaa

SEQ ID NO: 5157523 - DNA, 21 bp, Homo sapiens
actaagatcggttaacaaata

SEQ ID NO: 5157524 - DNA, 22 bp, Homo sapiens
actaagatcggttaacaaataa

SEQ ID NO: 5157525 - DNA, 17 bp, Homo sapiens
actaagatgacattgct

SEQ ID NO: 5157526 - DNA, 17 bp, Homo sapiens
actaagattcttttaaa

SEQ ID NO: 5157527 - DNA, 12 bp, Homo sapiens
actaagatttcc

SEQ ID NO: 5157528 - DNA, 21 bp, Homo sapiens
actaagatttcctttggcaat

SEQ ID NO: 5157529 - DNA, 15 bp, Homo sapiens
actaagcaatttccc

SEQ ID NO: 5157530 - DNA, 20 bp, Homo sapiens
actaagcaccataaccaaga

SEQ ID NO: 5157531 - DNA, 22 bp, Homo sapiens
actaagcaccataaccaagaaa

SEQ ID NO: 5157532 - DNA, 22 bp, Homo sapiens
actaagcagaggaggggccgct

SEQ ID NO: 5157533 - DNA, 12 bp, Homo sapiens
actaagcatttc

SEQ ID NO: 5157534 - DNA, 15 bp, Homo sapiens
actaagccaagctgt

SEQ ID NO: 5157535 - DNA, 16 bp, Homo sapiens
actaagccacaagaaa

SEQ ID NO: 5157536 - DNA, 18 bp, Homo sapiens
actaagccagcaccggac

SEQ ID NO: 5157537 - DNA, 16 bp, Homo sapiens
actaagccaggaggct

SEQ ID NO: 5157538 - DNA, 18 bp, Homo sapiens
actaagccaggcctggct

SEQ ID NO: 5157539 - DNA, 21 bp, Homo sapiens
actaagccctcgaaccaaggc

SEQ ID NO: 5157540 - DNA, 12 bp, Homo sapiens
actaagcctttg

SEQ ID NO: 5157541 - DNA, 20 bp, Homo sapiens
actaagctttgccagctgct

SEQ ID NO: 5157542 - DNA, 11 bp, Homo sapiens
actaaggaaat

SEQ ID NO: 5157543 - DNA, 15 bp, Homo sapiens
actaaggaaatattt

SEQ ID NO: 5157544 - DNA, 19 bp, Homo sapiens
actaaggaactaaaacttg

SEQ ID NO: 5157545 - DNA, 12 bp, Homo sapiens
actaaggacaaa

SEQ ID NO: 5157546 - DNA, 14 bp, Homo sapiens
actaaggacaaatt

SEQ ID NO: 5157547 - DNA, 15 bp, Homo sapiens
actaaggacaaatta

SEQ ID NO: 5157548 - DNA, 16 bp, Homo sapiens
actaaggacaaattag

SEQ ID NO: 5157549 - DNA, 15 bp, Homo sapiens
actaaggagaaatga

SEQ ID NO: 5157550 - DNA, 21 bp, Homo sapiens
actaaggatttttcaagagat

SEQ ID NO: 5157551 - DNA, 18 bp, Homo sapiens
actaaggcatttgattaa

SEQ ID NO: 5157552 - DNA, 23 bp, Homo sapiens
actaaggctgcttcaaagattat

SEQ ID NO: 5157553 - DNA, 22 bp, Homo sapiens
actaaggggcccggccagccat

SEQ ID NO: 5157554 - DNA, 20 bp, Homo sapiens
actaagggtggagagttggg

SEQ ID NO: 5157555 - DNA, 20 bp, Homo sapiens
actaaggtgactttctgaaa

SEQ ID NO: 5157556 - DNA, 14 bp, Homo sapiens
actaagtaagaaac

SEQ ID NO: 5157557 - DNA, 15 bp, Homo sapiens
actaagtaagaaaca

SEQ ID NO: 5157558 - DNA, 22 bp, Homo sapiens
actaagtaatctcacagcattt

SEQ ID NO: 5157559 - DNA, 19 bp, Homo sapiens
actaagtacccttggggtg

SEQ ID NO: 5157560 - DNA, 18 bp, Homo sapiens
actaagtagaataaagaa

SEQ ID NO: 5157561 - DNA, 20 bp, Homo sapiens
actaagtctcttttttacaa

SEQ ID NO: 5157562 - DNA, 14 bp, Homo sapiens
actaagtgatgctg

SEQ ID NO: 5157563 - DNA, 19 bp, Homo sapiens
actaagttaataataatga

SEQ ID NO: 5157564 - DNA, 18 bp, Homo sapiens
actaagttatagtatatc

SEQ ID NO: 5157565 - DNA, 14 bp, Homo sapiens
actaagttattgct

SEQ ID NO: 5157566 - DNA, 15 bp, Homo sapiens
actaagttattgctg

SEQ ID NO: 5157567 - DNA, 23 bp, Homo sapiens
actaagttattgctgcataaatt

SEQ ID NO: 5157568 - DNA, 22 bp, Homo sapiens
actaagttattgttaattatgt

SEQ ID NO: 5157569 - DNA, 13 bp, Homo sapiens
actaagttcacat

SEQ ID NO: 5157570 - DNA, 15 bp, Homo sapiens
actaagttgcaagat

SEQ ID NO: 5157571 - DNA, 15 bp, Homo sapiens
actaagtttttatgg

SEQ ID NO: 5157572 - DNA, 21 bp, Homo sapiens
actaataaaaaactgtgaacc

SEQ ID NO: 5157573 - DNA, 13 bp, Homo sapiens
actaataaaatac

SEQ ID NO: 5157574 - DNA, 16 bp, Homo sapiens
actaataaaatacata

SEQ ID NO: 5157575 - DNA, 13 bp, Homo sapiens
actaataaaatat

SEQ ID NO: 5157576 - DNA, 14 bp, Homo sapiens
actaataaaatata

SEQ ID NO: 5157577 - DNA, 14 bp, Homo sapiens
actaataaaatatt

SEQ ID NO: 5157578 - DNA, 18 bp, Homo sapiens
actaataaaatattttct

SEQ ID NO: 5157579 - DNA, 21 bp, Homo sapiens
actaataaaatattttctgtg

SEQ ID NO: 5157580 - DNA, 13 bp, Homo sapiens
actaataaaatgt

SEQ ID NO: 5157581 - DNA, 17 bp, Homo sapiens
actaataaagtctgtct

SEQ ID NO: 5157582 - DNA, 18 bp, Homo sapiens
actaataaagtctgtctg

SEQ ID NO: 5157583 - DNA, 14 bp, Homo sapiens
actaataaatataa

SEQ ID NO: 5157584 - DNA, 13 bp, Homo sapiens
actaataaatgga

SEQ ID NO: 5157585 - DNA, 16 bp, Homo sapiens
actaataaatggacta

SEQ ID NO: 5157586 - DNA, 12 bp, Homo sapiens
actaataaattg

SEQ ID NO: 5157587 - DNA, 15 bp, Homo sapiens
actaatacaattcat

SEQ ID NO: 5157588 - DNA, 15 bp, Homo sapiens
actaataccttgtgt

SEQ ID NO: 5157589 - DNA, 15 bp, Homo sapiens
actaatacttactgt

SEQ ID NO: 5157590 - DNA, 17 bp, Homo sapiens
actaatacttactgtta

SEQ ID NO: 5157591 - DNA, 16 bp, Homo sapiens
actaatagaaaagtat

SEQ ID NO: 5157592 - DNA, 17 bp, Homo sapiens
actaatagaataaaggc

SEQ ID NO: 5157593 - DNA, 20 bp, Homo sapiens
actaatagaataaaggcagt

SEQ ID NO: 5157594 - DNA, 21 bp, Homo sapiens
actaatagagacacagagatg

SEQ ID NO: 5157595 - DNA, 20 bp, Homo sapiens
actaatagagtacttaatat

SEQ ID NO: 5157596 - DNA, 22 bp, Homo sapiens
actaatagagtacttaatatac

SEQ ID NO: 5157597 - DNA, 13 bp, Homo sapiens
actaataggtctg

SEQ ID NO: 5157598 - DNA, 17 bp, Homo sapiens
actaatatagtagattt

SEQ ID NO: 5157599 - DNA, 12 bp, Homo sapiens
actaatatatat

SEQ ID NO: 5157600 - DNA, 19 bp, Homo sapiens
actaatatatattttaagg

SEQ ID NO: 5157601 - DNA, 23 bp, Homo sapiens
actaatatatattttaaggttgc

SEQ ID NO: 5157602 - DNA, 17 bp, Homo sapiens
actaatatatctgtaac

SEQ ID NO: 5157603 - DNA, 19 bp, Homo sapiens
actaatatatggacctagc

SEQ ID NO: 5157604 - DNA, 15 bp, Homo sapiens
actaatatgggcatt

SEQ ID NO: 5157605 - DNA, 22 bp, Homo sapiens
actaatatgggcattgtagtta

SEQ ID NO: 5157606 - DNA, 23 bp, Homo sapiens
actaatatggttttgttttcaat

SEQ ID NO: 5157607 - DNA, 13 bp, Homo sapiens
actaatatttctg

SEQ ID NO: 5157608 - DNA, 20 bp, Homo sapiens
actaatatttgtctgtgtgc

SEQ ID NO: 5157609 - DNA, 21 bp, Homo sapiens
actaatatttgtctgtgtgct

SEQ ID NO: 5157610 - DNA, 19 bp, Homo sapiens
actaatattttatgtgaga

SEQ ID NO: 5157611 - DNA, 21 bp, Homo sapiens
actaatcaatacgtgatctct

SEQ ID NO: 5157612 - DNA, 16 bp, Homo sapiens
actaatcaatactttg

SEQ ID NO: 5157613 - DNA, 18 bp, Homo sapiens
actaatcacaaactgaat

SEQ ID NO: 5157614 - DNA, 20 bp, Homo sapiens
actaatccattatcctttat

SEQ ID NO: 5157615 - DNA, 22 bp, Homo sapiens
actaatccattatcctttattt

SEQ ID NO: 5157616 - DNA, 19 bp, Homo sapiens
actaatcgaactatgaact

SEQ ID NO: 5157617 - DNA, 13 bp, Homo sapiens
actaatcgagcac

SEQ ID NO: 5157618 - DNA, 21 bp, Homo sapiens
actaatcttaaccctgtgctg

SEQ ID NO: 5157619 - DNA, 13 bp, Homo sapiens
actaatgaaattt

SEQ ID NO: 5157620 - DNA, 22 bp, Homo sapiens
actaatgaacaaatatgctttg

SEQ ID NO: 5157621 - DNA, 23 bp, Homo sapiens
actaatgaagatacggttgcttc

SEQ ID NO: 5157622 - DNA, 21 bp, Homo sapiens
actaatgaagtattacatgat

SEQ ID NO: 5157623 - DNA, 17 bp, Homo sapiens
actaatgaattgaaatt

SEQ ID NO: 5157624 - DNA, 17 bp, Homo sapiens
actaatgacaagtgact

SEQ ID NO: 5157625 - DNA, 18 bp, Homo sapiens
actaatgatgagcattta

SEQ ID NO: 5157626 - DNA, 15 bp, Homo sapiens
actaatgatgctttt

SEQ ID NO: 5157627 - DNA, 13 bp, Homo sapiens
actaatgcagcca

SEQ ID NO: 5157628 - DNA, 19 bp, Homo sapiens
actaatgccctatcttagt

SEQ ID NO: 5157629 - DNA, 23 bp, Homo sapiens
actaatgccttactcttcttgaa

SEQ ID NO: 5157630 - DNA, 23 bp, Homo sapiens
actaatgctaagaaatgctgaaa

SEQ ID NO: 5157631 - DNA, 22 bp, Homo sapiens
actaatgcttacaactttctaa

SEQ ID NO: 5157632 - DNA, 21 bp, Homo sapiens
actaatgcttgccaagaaatc

SEQ ID NO: 5157633 - DNA, 17 bp, Homo sapiens
actaatgctttttagaa

SEQ ID NO: 5157634 - DNA, 21 bp, Homo sapiens
actaatgctttttagaaagca

SEQ ID NO: 5157635 - DNA, 23 bp, Homo sapiens
actaatgctttttagaaagcatt

SEQ ID NO: 5157636 - DNA, 16 bp, Homo sapiens
actaatggcatgagaa

SEQ ID NO: 5157637 - DNA, 15 bp, Homo sapiens
actaatgtaaatatt

SEQ ID NO: 5157638 - DNA, 13 bp, Homo sapiens
actaatgtactgt

SEQ ID NO: 5157639 - DNA, 14 bp, Homo sapiens
actaatgtactgta

SEQ ID NO: 5157640 - DNA, 19 bp, Homo sapiens
actaatgtctcttctaaca

SEQ ID NO: 5157641 - DNA, 20 bp, Homo sapiens
actaatgtctcttctaacat

SEQ ID NO: 5157642 - DNA, 11 bp, Homo sapiens
actaatgtgtc

SEQ ID NO: 5157643 - DNA, 21 bp, Homo sapiens
actaatgttagaattgatttc

SEQ ID NO: 5157644 - DNA, 19 bp, Homo sapiens
actaatgttatttcttaaa

SEQ ID NO: 5157645 - DNA, 21 bp, Homo sapiens
actaatgttatttcttaaaat

SEQ ID NO: 5157646 - DNA, 17 bp, Homo sapiens
actaatgttatttttta

SEQ ID NO: 5157647 - DNA, 20 bp, Homo sapiens
actaattagggtacatttat

SEQ ID NO: 5157648 - DNA, 18 bp, Homo sapiens
actaattataatgcaaat

SEQ ID NO: 5157649 - DNA, 17 bp, Homo sapiens
actaattatactacttt

SEQ ID NO: 5157650 - DNA, 22 bp, Homo sapiens
actaattattattttaaaatat

SEQ ID NO: 5157651 - DNA, 13 bp, Homo sapiens
actaattccttaa

SEQ ID NO: 5157652 - DNA, 17 bp, Homo sapiens
actaattctatttctct

SEQ ID NO: 5157653 - DNA, 18 bp, Homo sapiens
actaattctatttctcta

SEQ ID NO: 5157654 - DNA, 19 bp, Homo sapiens
actaattctatttctctat

SEQ ID NO: 5157655 - DNA, 11 bp, Homo sapiens
actaattctgt

SEQ ID NO: 5157656 - DNA, 14 bp, Homo sapiens
actaattcttgcat

SEQ ID NO: 5157657 - DNA, 18 bp, Homo sapiens
actctccttcgtgtctct

SEQ ID NO: 5157658 - DNA, 13 bp, Homo sapiens
actctccttgcag

SEQ ID NO: 5157659 - DNA, 13 bp, Homo sapiens
actctcctttgat

SEQ ID NO: 5157660 - DNA, 22 bp, Homo sapiens
actctcctttgatattatgtgg

SEQ ID NO: 5157661 - DNA, 18 bp, Homo sapiens
actctcctttgtgtggct

SEQ ID NO: 5157662 - DNA, 15 bp, Homo sapiens
actctcgagacttct

SEQ ID NO: 5157663 - DNA, 21 bp, Homo sapiens
actctcgagacttctctgtga

SEQ ID NO: 5157664 - DNA, 23 bp, Homo sapiens
actctcggggcccttggggcctg

SEQ ID NO: 5157665 - DNA, 23 bp, Homo sapiens
actctcgtgatatgctgcttgtg

SEQ ID NO: 5157666 - DNA, 15 bp, Homo sapiens
actctctaaactggt

SEQ ID NO: 5157667 - DNA, 22 bp, Homo sapiens
actctctagtgcaggaaaaggc

SEQ ID NO: 5157668 - DNA, 12 bp, Homo sapiens
actctctagttc

SEQ ID NO: 5157669 - DNA, 20 bp, Homo sapiens
actctctagttccctcagtg

SEQ ID NO: 5157670 - DNA, 17 bp, Homo sapiens
actctctagttttatct

SEQ ID NO: 5157671 - DNA, 13 bp, Homo sapiens
actctctcaccca

SEQ ID NO: 5157672 - DNA, 15 bp, Homo sapiens
actctctcacccacc

SEQ ID NO: 5157673 - DNA, 18 bp, Homo sapiens
actctctcacccaccagc

SEQ ID NO: 5157674 - DNA, 13 bp, Homo sapiens
actctctccaccc

SEQ ID NO: 5157675 - DNA, 13 bp, Homo sapiens
actctctccagga

SEQ ID NO: 5157676 - DNA, 14 bp, Homo sapiens
actctctccatcag

SEQ ID NO: 5157677 - DNA, 17 bp, Homo sapiens
actctctccatcagaag

SEQ ID NO: 5157678 - DNA, 14 bp, Homo sapiens
actctctcccagga

SEQ ID NO: 5157679 - DNA, 14 bp, Homo sapiens
actctctcctctct

SEQ ID NO: 5157680 - DNA, 18 bp, Homo sapiens
actctctcctctctctcc

SEQ ID NO: 5157681 - DNA, 20 bp, Homo sapiens
actctctcctctctctccct

SEQ ID NO: 5157682 - DNA, 16 bp, Homo sapiens
actctctctgccccca

SEQ ID NO: 5157683 - DNA, 15 bp, Homo sapiens
actctctgaaatata

SEQ ID NO: 5157684 - DNA, 19 bp, Homo sapiens
actctctgaacccctccct

SEQ ID NO: 5157685 - DNA, 20 bp, Homo sapiens
actctctgagtacattgtgc

SEQ ID NO: 5157686 - DNA, 15 bp, Homo sapiens
actctctgcagccca

SEQ ID NO: 5157687 - DNA, 16 bp, Homo sapiens
actctctgccagctcc

SEQ ID NO: 5157688 - DNA, 18 bp, Homo sapiens
actctctgccagctccac

SEQ ID NO: 5157689 - DNA, 14 bp, Homo sapiens
actctctgcctgct

SEQ ID NO: 5157690 - DNA, 16 bp, Homo sapiens
actctctgcctgcttc

SEQ ID NO: 5157691 - DNA, 21 bp, Homo sapiens
actctctgcctgcttcctgga

SEQ ID NO: 5157692 - DNA, 22 bp, Homo sapiens
actctctgcctgcttcctggac

SEQ ID NO: 5157693 - DNA, 17 bp, Homo sapiens
actctctgcctggtggt

SEQ ID NO: 5157694 - DNA, 13 bp, Homo sapiens
actctctgctcta

SEQ ID NO: 5157695 - DNA, 15 bp, Homo sapiens
actctctgctctagc

SEQ ID NO: 5157696 - DNA, 24 bp, Homo sapiens
actctctgctctagccaggagtct

SEQ ID NO: 5157697 - DNA, 13 bp, Homo sapiens
actctctgctggc

SEQ ID NO: 5157698 - DNA, 12 bp, Homo sapiens
actctctgggac

SEQ ID NO: 5157699 - DNA, 15 bp, Homo sapiens
actctctgtacaaaa

SEQ ID NO: 5157700 - DNA, 17 bp, Homo sapiens
actctctgtggtccctt

SEQ ID NO: 5157701 - DNA, 19 bp, Homo sapiens
actctcttagttcttacct

SEQ ID NO: 5157702 - DNA, 23 bp, Homo sapiens
actctcttagttcttaccttttg

SEQ ID NO: 5157703 - DNA, 21 bp, Homo sapiens
actctcttattgcctcacttc

SEQ ID NO: 5157704 - DNA, 12 bp, Homo sapiens
actctcttccct

SEQ ID NO: 5157705 - DNA, 15 bp, Homo sapiens
actctcttcctccac

SEQ ID NO: 5157706 - DNA, 12 bp, Homo sapiens
actctcttcctt

SEQ ID NO: 5157707 - DNA, 15 bp, Homo sapiens
actctcttcctttca

SEQ ID NO: 5157708 - DNA, 15 bp, Homo sapiens
actctcttctccatt

SEQ ID NO: 5157709 - DNA, 20 bp, Homo sapiens
actctcttctccattcccta

SEQ ID NO: 5157710 - DNA, 21 bp, Homo sapiens
actctcttctccattccctag

SEQ ID NO: 5157711 - DNA, 23 bp, Homo sapiens
actctcttctccattccctagca

SEQ ID NO: 5157712 - DNA, 18 bp, Homo sapiens
actctcttctctttctct

SEQ ID NO: 5157713 - DNA, 17 bp, Homo sapiens
actctcttcttctcata

SEQ ID NO: 5157714 - DNA, 21 bp, Homo sapiens
actctctttccttgagctgtt

SEQ ID NO: 5157715 - DNA, 15 bp, Homo sapiens
actctctttcttcca

SEQ ID NO: 5157716 - DNA, 16 bp, Homo sapiens
actctctttcttccac

SEQ ID NO: 5157717 - DNA, 9 bp, Homo sapiens
actctgaac

SEQ ID NO: 5157718 - DNA, 23 bp, Homo sapiens
actctgaactggagctgctaagc

SEQ ID NO: 5157719 - DNA, 13 bp, Homo sapiens
actctgaactttg

SEQ ID NO: 5157720 - DNA, 16 bp, Homo sapiens
actctgaagcctctgg

SEQ ID NO: 5157721 - DNA, 21 bp, Homo sapiens
actctgaagtcccttcctgtc

SEQ ID NO: 5157722 - DNA, 23 bp, Homo sapiens
actctgaagtcccttcctgtcct

SEQ ID NO: 5157723 - DNA, 18 bp, Homo sapiens
actctgacaacagacttc

SEQ ID NO: 5157724 - DNA, 22 bp, Homo sapiens
actctgacaagctggccaaagt

SEQ ID NO: 5157725 - DNA, 18 bp, Homo sapiens
actctgacaagggctgac

SEQ ID NO: 5157726 - DNA, 20 bp, Homo sapiens
actctgacaagggctgacct

SEQ ID NO: 5157727 - DNA, 13 bp, Homo sapiens
actctgactcatc

SEQ ID NO: 5157728 - DNA, 12 bp, Homo sapiens
actctgactctt

SEQ ID NO: 5157729 - DNA, 14 bp, Homo sapiens
actctgagacaaaa

SEQ ID NO: 5157730 - DNA, 11 bp, Homo sapiens
actctgagact

SEQ ID NO: 5157731 - DNA, 15 bp, Homo sapiens
actctgagagctgtt

SEQ ID NO: 5157732 - DNA, 15 bp, Homo sapiens
actctgagccaaggg

SEQ ID NO: 5157733 - DNA, 16 bp, Homo sapiens
actctgagccaaggga

SEQ ID NO: 5157734 - DNA, 21 bp, Homo sapiens
actctgagccaagggagggaa

SEQ ID NO: 5157735 - DNA, 11 bp, Homo sapiens
actctgagccc

SEQ ID NO: 5157736 - DNA, 13 bp, Homo sapiens
actctgagcccag

SEQ ID NO: 5157737 - DNA, 15 bp, Homo sapiens
actctgagcccaggc

SEQ ID NO: 5157738 - DNA, 16 bp, Homo sapiens
actctgagcccaggcc

SEQ ID NO: 5157739 - DNA, 18 bp, Homo sapiens
actctgagcccaggccgt

SEQ ID NO: 5157740 - DNA, 14 bp, Homo sapiens
actctgagcccatg

SEQ ID NO: 5157741 - DNA, 21 bp, Homo sapiens
actctgagcgggaggcagagt

SEQ ID NO: 5157742 - DNA, 13 bp, Homo sapiens
actctgagctgct

SEQ ID NO: 5157743 - DNA, 21 bp, Homo sapiens
actctgagctgctaggaacct

SEQ ID NO: 5157744 - DNA, 13 bp, Homo sapiens
actctgaggtctc

SEQ ID NO: 5157745 - DNA, 14 bp, Homo sapiens
actctgaggtctca

SEQ ID NO: 5157746 - DNA, 19 bp, Homo sapiens
actctgaggtctcaccttc

SEQ ID NO: 5157747 - DNA, 16 bp, Homo sapiens
actctgagtccactgc

SEQ ID NO: 5157748 - DNA, 21 bp, Homo sapiens
actctgagtgttttatgagaa

SEQ ID NO: 5157749 - DNA, 16 bp, Homo sapiens
actctgagtttaccat

SEQ ID NO: 5157750 - DNA, 22 bp, Homo sapiens
actctgatagaattatttcaca

SEQ ID NO: 5157751 - DNA, 16 bp, Homo sapiens
actctgcaaaggcctg

SEQ ID NO: 5157752 - DNA, 23 bp, Homo sapiens
actctgcaagtgtctggagcggc

SEQ ID NO: 5157753 - DNA, 14 bp, Homo sapiens
actctgcacagcaa

SEQ ID NO: 5157754 - DNA, 17 bp, Homo sapiens
actctgcacatgtcttg

SEQ ID NO: 5157755 - DNA, 21 bp, Homo sapiens
actctgcacatgtcttgtaca

SEQ ID NO: 5157756 - DNA, 23 bp, Homo sapiens
actctgcactactcctctgcagt

SEQ ID NO: 5157757 - DNA, 11 bp, Homo sapiens
actctgcactc

SEQ ID NO: 5157758 - DNA, 17 bp, Homo sapiens
actctgcactccatggc

SEQ ID NO: 5157759 - DNA, 18 bp, Homo sapiens
actctgcactccatggcc

SEQ ID NO: 5157760 - DNA, 19 bp, Homo sapiens
actctgcactccatggcca

SEQ ID NO: 5157761 - DNA, 17 bp, Homo sapiens
actctgcagactgctag

SEQ ID NO: 5157762 - DNA, 22 bp, Homo sapiens
actctgcagatagtgcctctgc

SEQ ID NO: 5157763 - DNA, 12 bp, Homo sapiens
actctgcagcct

SEQ ID NO: 5157764 - DNA, 13 bp, Homo sapiens
actctgcagcctc

SEQ ID NO: 5157765 - DNA, 22 bp, Homo sapiens
actctgcaggaaatcagagctg

SEQ ID NO: 5157766 - DNA, 16 bp, Homo sapiens
actctgcataccctca

SEQ ID NO: 5157767 - DNA, 15 bp, Homo sapiens
actctgcatccagag

SEQ ID NO: 5157768 - DNA, 20 bp, Homo sapiens
actctgcatccagagattca

SEQ ID NO: 5157769 - DNA, 20 bp, Homo sapiens
actctgcatgtagaggcttg

SEQ ID NO: 5157770 - DNA, 16 bp, Homo sapiens
actctgccactttatt

SEQ ID NO: 5157771 - DNA, 12 bp, Homo sapiens
actctgccagaa

SEQ ID NO: 5157772 - DNA, 15 bp, Homo sapiens
actctgccagaaaaa

SEQ ID NO: 5157773 - DNA, 11 bp, Homo sapiens
actctgccagg

SEQ ID NO: 5157774 - DNA, 14 bp, Homo sapiens
actctgccccaatc

SEQ ID NO: 5157775 - DNA, 20 bp, Homo sapiens
actctgccccccccccccat

SEQ ID NO: 5157776 - DNA, 12 bp, Homo sapiens
actctgccccct

SEQ ID NO: 5157777 - DNA, 13 bp, Homo sapiens
actctgccccctg

SEQ ID NO: 5157778 - DNA, 15 bp, Homo sapiens
actctgccccctgct

SEQ ID NO: 5157779 - DNA, 17 bp, Homo sapiens
actctgccccctgctgg

SEQ ID NO: 5157780 - DNA, 18 bp, Homo sapiens
actctgccccctgctggc

SEQ ID NO: 5157781 - DNA, 20 bp, Homo sapiens
actctgcccctggacctggg

SEQ ID NO: 5157782 - DNA, 15 bp, Homo sapiens
actctgccccttctg

SEQ ID NO: 5157783 - DNA, 18 bp, Homo sapiens
actctgccctactcactc

SEQ ID NO: 5157784 - DNA, 13 bp, Homo sapiens
actctgccctcta

SEQ ID NO: 5157785 - DNA, 20 bp, Homo sapiens
actctgccgctgtgtaggga

SEQ ID NO: 5157786 - DNA, 16 bp, Homo sapiens
actctgcctcctcttc

SEQ ID NO: 5157787 - DNA, 22 bp, Homo sapiens
actctgcctcctggtttccttt

SEQ ID NO: 5157788 - DNA, 22 bp, Homo sapiens
actctgcctgaacactgcttct

SEQ ID NO: 5157789 - DNA, 16 bp, Homo sapiens
actctgcctgcccttt

SEQ ID NO: 5157790 - DNA, 23 bp, Homo sapiens
actctgccttaatttttgaaaag

SEQ ID NO: 5157791 - DNA, 15 bp, Homo sapiens
actctgccttccagg

SEQ ID NO: 5157792 - DNA, 19 bp, Homo sapiens
actctgccttccaggcgta

SEQ ID NO: 5157793 - DNA, 19 bp, Homo sapiens
actctgcctttatgatgct

SEQ ID NO: 5157794 - DNA, 15 bp, Homo sapiens
actctgcctttctaa

SEQ ID NO: 5157795 - DNA, 16 bp, Homo sapiens
actctgcggcccgggc

SEQ ID NO: 5157796 - DNA, 19 bp, Homo sapiens
actctgcggcccgggccga

SEQ ID NO: 5157797 - DNA, 19 bp, Homo sapiens
actctgcgggaggctgggg

SEQ ID NO: 5157798 - DNA, 20 bp, Homo sapiens
actctgcgggaggctggggc

SEQ ID NO: 5157799 - DNA, 17 bp, Homo sapiens
actctgctaatcatgtg

SEQ ID NO: 5157800 - DNA, 16 bp, Homo sapiens
actctgctaccttgcc

SEQ ID NO: 5157801 - DNA, 17 bp, Homo sapiens
actctgctagtgaaaag

SEQ ID NO: 5157802 - DNA, 15 bp, Homo sapiens
actctgctatttctc

SEQ ID NO: 5157803 - DNA, 9 bp, Homo sapiens
actctgctc

SEQ ID NO: 5157804 - DNA, 16 bp, Homo sapiens
actctgctcagggccg

SEQ ID NO: 5157805 - DNA, 18 bp, Homo sapiens
actctgctccaaagtaga

SEQ ID NO: 5157806 - DNA, 18 bp, Homo sapiens
actctgctcccagcccct

SEQ ID NO: 5157807 - DNA, 19 bp, Homo sapiens
actctgctctatgccaggc

SEQ ID NO: 5157808 - DNA, 20 bp, Homo sapiens
actctgctctatgccaggct

SEQ ID NO: 5157809 - DNA, 21 bp, Homo sapiens
actctgctctatgccaggctg

SEQ ID NO: 5157810 - DNA, 22 bp, Homo sapiens
actctgctctatgccaggctgt

SEQ ID NO: 5157811 - DNA, 23 bp, Homo sapiens
actctgctctatgccaggctgtg

SEQ ID NO: 5157812 - DNA, 12 bp, Homo sapiens
actctgctctcc

SEQ ID NO: 5157813 - DNA, 22 bp, Homo sapiens
actctgctctcctcgggccctg

SEQ ID NO: 5157814 - DNA, 13 bp, Homo sapiens
actctgctctgat

SEQ ID NO: 5157815 - DNA, 14 bp, Homo sapiens
actctgctctgccc

SEQ ID NO: 5157816 - DNA, 14 bp, Homo sapiens
actctgctcttgca

SEQ ID NO: 5157817 - DNA, 18 bp, Homo sapiens
actctgctgaatgtaaaa

SEQ ID NO: 5157818 - DNA, 15 bp, Homo sapiens
actctgctgaggcca

SEQ ID NO: 5157819 - DNA, 17 bp, Homo sapiens
actctgctgaggccaga

SEQ ID NO: 5157820 - DNA, 19 bp, Homo sapiens
actctgctgaggccagagg

SEQ ID NO: 5157821 - DNA, 20 bp, Homo sapiens
actctgctgagggtccagaa

SEQ ID NO: 5157822 - DNA, 12 bp, Homo sapiens
actctgctgctc

SEQ ID NO: 5157823 - DNA, 14 bp, Homo sapiens
actctgctgcttag

SEQ ID NO: 5157824 - DNA, 14 bp, Homo sapiens
actctgctgtttga

SEQ ID NO: 5157825 - DNA, 16 bp, Homo sapiens
actctgcttaaacaaa

SEQ ID NO: 5157826 - DNA, 14 bp, Homo sapiens
actctgcttctctg

SEQ ID NO: 5157827 - DNA, 15 bp, Homo sapiens
actctgcttctctga

SEQ ID NO: 5157828 - DNA, 22 bp, Homo sapiens
actctgcttctctgacttctgc

SEQ ID NO: 5157829 - DNA, 16 bp, Homo sapiens
actctgcttgattttt

SEQ ID NO: 5157830 - DNA, 19 bp, Homo sapiens
actctgcttggctgtcccc

SEQ ID NO: 5157831 - DNA, 13 bp, Homo sapiens
actctgcttgtta

SEQ ID NO: 5157832 - DNA, 22 bp, Homo sapiens
actctgctttgactgagcagac

SEQ ID NO: 5157833 - DNA, 23 bp, Homo sapiens
actctgctttgactgagcagact

SEQ ID NO: 5157834 - DNA, 17 bp, Homo sapiens
actctggaaaaggcata

SEQ ID NO: 5157835 - DNA, 17 bp, Homo sapiens
actctggaagcccccca

SEQ ID NO: 5157836 - DNA, 18 bp, Homo sapiens
actctggaccaaggagca

SEQ ID NO: 5157837 - DNA, 20 bp, Homo sapiens
actctggaccaaggagcatc

SEQ ID NO: 5157838 - DNA, 17 bp, Homo sapiens
actctggaccatgctga

SEQ ID NO: 5157839 - DNA, 15 bp, Homo sapiens
actctggacctctct

SEQ ID NO: 5157840 - DNA, 19 bp, Homo sapiens
actctggacctctcttgtg

SEQ ID NO: 5157841 - DNA, 21 bp, Homo sapiens
actctggactccacgatgcct

SEQ ID NO: 5157842 - DNA, 16 bp, Homo sapiens
actctggactttctct

SEQ ID NO: 5157843 - DNA, 21 bp, Homo sapiens
actctggactttctctaataa

SEQ ID NO: 5157844 - DNA, 22 bp, Homo sapiens
actctggactttctctaataat

SEQ ID NO: 5157845 - DNA, 12 bp, Homo sapiens
actctggagagc

SEQ ID NO: 5157846 - DNA, 17 bp, Homo sapiens
actctggagccaaggca

SEQ ID NO: 5157847 - DNA, 22 bp, Homo sapiens
actctggaggtcatctggcgga

SEQ ID NO: 5157848 - DNA, 23 bp, Homo sapiens
actctggcaaagcttttagaaat

SEQ ID NO: 5157849 - DNA, 17 bp, Homo sapiens
actctggcaaatgatga

SEQ ID NO: 5157850 - DNA, 13 bp, Homo sapiens
actctggcacagt

SEQ ID NO: 5157851 - DNA, 15 bp, Homo sapiens
actctggcacagtga

SEQ ID NO: 5157852 - DNA, 23 bp, Homo sapiens
actctggcaccccggatcgagga

SEQ ID NO: 5157853 - DNA, 15 bp, Homo sapiens
actctggcacttcca

SEQ ID NO: 5157854 - DNA, 13 bp, Homo sapiens
actctggcagcct

SEQ ID NO: 5157855 - DNA, 16 bp, Homo sapiens
actctggcagctcaga

SEQ ID NO: 5157856 - DNA, 19 bp, Homo sapiens
actctggcagctcagagag

SEQ ID NO: 5157857 - DNA, 11 bp, Homo sapiens
actctggcccc

SEQ ID NO: 5157858 - DNA, 13 bp, Homo sapiens
actctggccctgg

SEQ ID NO: 5157859 - DNA, 17 bp, Homo sapiens
actctggcctctcgagt

SEQ ID NO: 5157860 - DNA, 23 bp, Homo sapiens
actctggccttggttcctccagc

SEQ ID NO: 5157861 - DNA, 17 bp, Homo sapiens
actctggctcagcctgt

SEQ ID NO: 5157862 - DNA, 16 bp, Homo sapiens
actctggctgccaaga

SEQ ID NO: 5157863 - DNA, 22 bp, Homo sapiens
actctggcttggcctatctcct

SEQ ID NO: 5157864 - DNA, 22 bp, Homo sapiens
actctgggaacttctttgcagt

SEQ ID NO: 5157865 - DNA, 14 bp, Homo sapiens
actctgggaagaat

SEQ ID NO: 5157866 - DNA, 16 bp, Homo sapiens
actctgggaagaatgt

SEQ ID NO: 5157867 - DNA, 23 bp, Homo sapiens
actctgggatgtgtagccttctc

SEQ ID NO: 5157868 - DNA, 14 bp, Homo sapiens
actctgggcaggga

SEQ ID NO: 5157869 - DNA, 19 bp, Homo sapiens
actctgggctatggacaca

SEQ ID NO: 5157870 - DNA, 16 bp, Homo sapiens
actctgggctgtgcct

SEQ ID NO: 5157871 - DNA, 18 bp, Homo sapiens
actctgggctgtgcctga

SEQ ID NO: 5157872 - DNA, 23 bp, Homo sapiens
actctggggcttgtcctgtgctt

SEQ ID NO: 5157873 - DNA, 19 bp, Homo sapiens
actctggggtgcagcttca

SEQ ID NO: 5157874 - DNA, 17 bp, Homo sapiens
actctggggtgctgcct

SEQ ID NO: 5157875 - DNA, 18 bp, Homo sapiens
actctgggtccctcggag

SEQ ID NO: 5157876 - DNA, 16 bp, Homo sapiens
actctgggtgcctcct

SEQ ID NO: 5157877 - DNA, 17 bp, Homo sapiens
actctgggtgcctcctc

SEQ ID NO: 5157878 - DNA, 23 bp, Homo sapiens
actctgggtggaagtgcccagcc

SEQ ID NO: 5157879 - DNA, 18 bp, Homo sapiens
actctgggttcgttgggg

SEQ ID NO: 5157880 - DNA, 18 bp, Homo sapiens
actctggtcttctttggg

SEQ ID NO: 5157881 - DNA, 19 bp, Homo sapiens
actctggtggccacttcat

SEQ ID NO: 5157882 - DNA, 15 bp, Homo sapiens
actctggtggctgcc

SEQ ID NO: 5157883 - DNA, 15 bp, Homo sapiens
actctggtttctcat

SEQ ID NO: 5157884 - DNA, 17 bp, Homo sapiens
actctggtttctcattc

SEQ ID NO: 5157885 - DNA, 16 bp, Homo sapiens
actctgtaacatcact

SEQ ID NO: 5157886 - DNA, 14 bp, Homo sapiens
actctgtataagtt

SEQ ID NO: 5157887 - DNA, 21 bp, Homo sapiens
actctgtataatagagataag

SEQ ID NO: 5157888 - DNA, 17 bp, Homo sapiens
actctgtatctatgcaa

SEQ ID NO: 5157889 - DNA, 23 bp, Homo sapiens
actctgtatttaggccatttgtt

SEQ ID NO: 5157890 - DNA, 16 bp, Homo sapiens
actctgtcagccagcc

SEQ ID NO: 5157891 - DNA, 21 bp, Homo sapiens
actctgtcagccagccgccct

SEQ ID NO: 5157892 - DNA, 18 bp, Homo sapiens
actctgtccaactctgta

SEQ ID NO: 5157893 - DNA, 15 bp, Homo sapiens
actctgtccaggcca

SEQ ID NO: 5157894 - DNA, 16 bp, Homo sapiens
actctgtccaggccac

SEQ ID NO: 5157895 - DNA, 18 bp, Homo sapiens
actctgtccaggccactg

SEQ ID NO: 5157896 - DNA, 20 bp, Homo sapiens
actctgtcctgaaggcctga

SEQ ID NO: 5157897 - DNA, 21 bp, Homo sapiens
actctgtcgagcctgggggct

SEQ ID NO: 5157898 - DNA, 21 bp, Homo sapiens
actctgtctaaaaaacaaaac

SEQ ID NO: 5157899 - DNA, 13 bp, Homo sapiens
actctgtctcaaa

SEQ ID NO: 5157900 - DNA, 17 bp, Homo sapiens
actctgtctcccaggct

SEQ ID NO: 5157901 - DNA, 14 bp, Homo sapiens
actctgtctggcca

SEQ ID NO: 5157902 - DNA, 17 bp, Homo sapiens
actctgtgaaagaagag

SEQ ID NO: 5157903 - DNA, 12 bp, Homo sapiens
actctgtgatct

SEQ ID NO: 5157904 - DNA, 17 bp, Homo sapiens
actctgtgatctaagca

SEQ ID NO: 5157905 - DNA, 20 bp, Homo sapiens
actctgtgatctaagcagtt

SEQ ID NO: 5157906 - DNA, 16 bp, Homo sapiens
actctgtgcaggtgct

SEQ ID NO: 5157907 - DNA, 16 bp, Homo sapiens
actctgtgccagagcc

SEQ ID NO: 5157908 - DNA, 17 bp, Homo sapiens
actctgtgccagagcct

SEQ ID NO: 5157909 - DNA, 18 bp, Homo sapiens
actctgtgccagagcctg

SEQ ID NO: 5157910 - DNA, 20 bp, Homo sapiens
actctgtgccagagcctggg

SEQ ID NO: 5157911 - DNA, 22 bp, Homo sapiens
actctgtgccagagcctggggc

SEQ ID NO: 5157912 - DNA, 12 bp, Homo sapiens
actctgtgccca

SEQ ID NO: 5157913 - DNA, 23 bp, Homo sapiens
actctgtgcccatgggcactgct

SEQ ID NO: 5157914 - DNA, 15 bp, Homo sapiens
actctgtgctggcca

SEQ ID NO: 5157915 - DNA, 15 bp, Homo sapiens
actctgtggccaaag

SEQ ID NO: 5157916 - DNA, 14 bp, Homo sapiens
actctgtggccagc

SEQ ID NO: 5157917 - DNA, 18 bp, Homo sapiens
actctgtggccagcctgg

SEQ ID NO: 5157918 - DNA, 17 bp, Homo sapiens
actctgtggggccttgg

SEQ ID NO: 5157919 - DNA, 23 bp, Homo sapiens
actctgtgtaatagaataaaggc

SEQ ID NO: 5157920 - DNA, 20 bp, Homo sapiens
actctgtgtaatctctgatt

SEQ ID NO: 5157921 - DNA, 11 bp, Homo sapiens
actctgtgtca

SEQ ID NO: 5157922 - DNA, 14 bp, Homo sapiens
actctgtgtcccag

SEQ ID NO: 5157923 - DNA, 21 bp, Homo sapiens
actctgtgtgagagagagggc

SEQ ID NO: 5157924 - DNA, 22 bp, Homo sapiens
actctgtgtgagcgtgtccaca

SEQ ID NO: 5157925 - DNA, 22 bp, Homo sapiens
actctgtgtgggaaaatggcag

SEQ ID NO: 5157926 - DNA, 15 bp, Homo sapiens
actctgtgtgtgtat

SEQ ID NO: 5157927 - DNA, 18 bp, Homo sapiens
actctgtgtgtgtatgag

SEQ ID NO: 5157928 - DNA, 21 bp, Homo sapiens
actctgttattgatcccttct

SEQ ID NO: 5157929 - DNA, 19 bp, Homo sapiens
actctgttcattcctccag

SEQ ID NO: 5157930 - DNA, 20 bp, Homo sapiens
actctgttcattcctccagg

SEQ ID NO: 5157931 - DNA, 15 bp, Homo sapiens
actctgttcccccac

SEQ ID NO: 5157932 - DNA, 18 bp, Homo sapiens
actctgttcccccaccct

SEQ ID NO: 5157933 - DNA, 12 bp, Homo sapiens
actctgttcctg

SEQ ID NO: 5157934 - DNA, 17 bp, Homo sapiens
actctgttccttcacat

SEQ ID NO: 5157935 - DNA, 15 bp, Homo sapiens
actctgttgaatatt

SEQ ID NO: 5157936 - DNA, 17 bp, Homo sapiens
actctgttgaccaggct

SEQ ID NO: 5157937 - DNA, 22 bp, Homo sapiens
actctgttgatctacccgtgcc

SEQ ID NO: 5157938 - DNA, 22 bp, Homo sapiens
actctgttgcccaggctggagt

SEQ ID NO: 5157939 - DNA, 12 bp, Homo sapiens
actctgttgcct

SEQ ID NO: 5157940 - DNA, 15 bp, Homo sapiens
actctgttgcctcct

SEQ ID NO: 5157941 - DNA, 16 bp, Homo sapiens
actctgttgcctcctc

SEQ ID NO: 5157942 - DNA, 22 bp, Homo sapiens
actctgttgtaagtaataattt

SEQ ID NO: 5157943 - DNA, 22 bp, Homo sapiens
actctgtttgctcacccaggac

SEQ ID NO: 5157944 - DNA, 12 bp, Homo sapiens
actcttaaagca

SEQ ID NO: 5157945 - DNA, 15 bp, Homo sapiens
actcttaaatacttt

SEQ ID NO: 5157946 - DNA, 17 bp, Homo sapiens
actcttaaatacttttt

SEQ ID NO: 5157947 - DNA, 18 bp, Homo sapiens
actcttaaatatacaact

SEQ ID NO: 5157948 - DNA, 16 bp, Homo sapiens
actcttaaatcatttg

SEQ ID NO: 5157949 - DNA, 17 bp, Homo sapiens
actcttaaatcatttgg

SEQ ID NO: 5157950 - DNA, 17 bp, Homo sapiens
actcttaaatgatctgc

SEQ ID NO: 5157951 - DNA, 20 bp, Homo sapiens
actcttaaatgatctgcctc

SEQ ID NO: 5157952 - DNA, 14 bp, Homo sapiens
actcttaagaagac

SEQ ID NO: 5157953 - DNA, 13 bp, Homo sapiens
actcttaagagaa

SEQ ID NO: 5157954 - DNA, 13 bp, Homo sapiens
actcttaagccat

SEQ ID NO: 5157955 - DNA, 14 bp, Homo sapiens
actcttaagccatc

SEQ ID NO: 5157956 - DNA, 14 bp, Homo sapiens
actcttaagtgtaa

SEQ ID NO: 5157957 - DNA, 16 bp, Homo sapiens
actcttaagtttctca

SEQ ID NO: 5157958 - DNA, 19 bp, Homo sapiens
actcttaagtttctcagct

SEQ ID NO: 5157959 - DNA, 21 bp, Homo sapiens
actcttaagtttctcagctcc

SEQ ID NO: 5157960 - DNA, 22 bp, Homo sapiens
actcttaagtttctcagctccc

SEQ ID NO: 5157961 - DNA, 14 bp, Homo sapiens
actcttaatcaaat

SEQ ID NO: 5157962 - DNA, 15 bp, Homo sapiens
actcttaatgatgtt

SEQ ID NO: 5157963 - DNA, 13 bp, Homo sapiens
actcttaatttta

SEQ ID NO: 5157964 - DNA, 15 bp, Homo sapiens
actcttacagagcct

SEQ ID NO: 5157965 - DNA, 17 bp, Homo sapiens
actcttacagagccttg

SEQ ID NO: 5157966 - DNA, 18 bp, Homo sapiens
actcttacagagccttga

SEQ ID NO: 5157967 - DNA, 22 bp, Homo sapiens
actcttaccatatgtttggtaa

SEQ ID NO: 5157968 - DNA, 16 bp, Homo sapiens
actcttacctaaactg

SEQ ID NO: 5157969 - DNA, 17 bp, Homo sapiens
actcttacctaaactga

SEQ ID NO: 5157970 - DNA, 22 bp, Homo sapiens
actcttacgaatattttcagta

SEQ ID NO: 5157971 - DNA, 17 bp, Homo sapiens
actcttagaagtgacat

SEQ ID NO: 5157972 - DNA, 18 bp, Homo sapiens
actcttagagatgattca

SEQ ID NO: 5157973 - DNA, 20 bp, Homo sapiens
actcttaggaagagaaacca

SEQ ID NO: 5157974 - DNA, 16 bp, Homo sapiens
actcttaggatatttg

SEQ ID NO: 5157975 - DNA, 18 bp, Homo sapiens
actcttaggatatttgag

SEQ ID NO: 5157976 - DNA, 15 bp, Homo sapiens
actcttagttttttt

SEQ ID NO: 5157977 - DNA, 16 bp, Homo sapiens
actcttataaatttct

SEQ ID NO: 5157978 - DNA, 17 bp, Homo sapiens
actcttatatctatatt

SEQ ID NO: 5157979 - DNA, 18 bp, Homo sapiens
actcttatatctatattt

SEQ ID NO: 5157980 - DNA, 16 bp, Homo sapiens
actcttatatttttct

SEQ ID NO: 5157981 - DNA, 12 bp, Homo sapiens
actcttatctca

SEQ ID NO: 5157982 - DNA, 16 bp, Homo sapiens
actcttatgaaatggg

SEQ ID NO: 5157983 - DNA, 21 bp, Homo sapiens
actcttatgctgtacccagtt

SEQ ID NO: 5157984 - DNA, 22 bp, Homo sapiens
actcttattaggatacaagctg

SEQ ID NO: 5157985 - DNA, 18 bp, Homo sapiens
actcttattgtccttcta

SEQ ID NO: 5157986 - DNA, 18 bp, Homo sapiens
actcttcaaaaactgttt

SEQ ID NO: 5157987 - DNA, 15 bp, Homo sapiens
actcttcaaatggga

SEQ ID NO: 5157988 - DNA, 15 bp, Homo sapiens
actcttcaaggccaa

SEQ ID NO: 5157989 - DNA, 19 bp, Homo sapiens
actcttcaaggtctgcttt

SEQ ID NO: 5157990 - DNA, 16 bp, Homo sapiens
actcttcaagtagatt

SEQ ID NO: 5157991 - DNA, 20 bp, Homo sapiens
actcttcaagtagattggct

SEQ ID NO: 5157992 - DNA, 17 bp, Homo sapiens
actcttcaccttggttt

SEQ ID NO: 5157993 - DNA, 22 bp, Homo sapiens
actcttcacttgagttggctgt

SEQ ID NO: 5157994 - DNA, 11 bp, Homo sapiens
actcttcagaa

SEQ ID NO: 5157995 - DNA, 16 bp, Homo sapiens
actcttcagagaaatc

SEQ ID NO: 5157996 - DNA, 15 bp, Homo sapiens
actcttcagggtcta

SEQ ID NO: 5157997 - DNA, 17 bp, Homo sapiens
actcttcagttaattct

SEQ ID NO: 5157998 - DNA, 18 bp, Homo sapiens
actcttcagttaattctt

SEQ ID NO: 5157999 - DNA, 21 bp, Homo sapiens
actcttcagttaattcttaga

SEQ ID NO: 5158000 - DNA, 17 bp, Homo sapiens
actcttccaccagagca

SEQ ID NO: 5158001 - DNA, 18 bp, Homo sapiens
actcttccaccagagcag

SEQ ID NO: 5158002 - DNA, 21 bp, Homo sapiens
actcttccaccagagcagggg

SEQ ID NO: 5158003 - DNA, 23 bp, Homo sapiens
actcttccaccagagcaggggct

SEQ ID NO: 5158004 - DNA, 22 bp, Homo sapiens
actcttccaggactctctgctt

SEQ ID NO: 5158005 - DNA, 19 bp, Homo sapiens
actcttcccctccctccca

SEQ ID NO: 5158006 - DNA, 15 bp, Homo sapiens
actcttccctcaaat

SEQ ID NO: 5158007 - DNA, 13 bp, Homo sapiens
actcttccctggg

SEQ ID NO: 5158008 - DNA, 15 bp, Homo sapiens
actcttccctgggaa

SEQ ID NO: 5158009 - DNA, 16 bp, Homo sapiens
actcttcccttcccct

SEQ ID NO: 5158010 - DNA, 16 bp, Homo sapiens
actcttccgatgtttg

SEQ ID NO: 5158011 - DNA, 16 bp, Homo sapiens
actcttccgtgcatcc

SEQ ID NO: 5158012 - DNA, 20 bp, Homo sapiens
actcttccgtgcatcccaga

SEQ ID NO: 5158013 - DNA, 15 bp, Homo sapiens
actcttcctcatcct

SEQ ID NO: 5158014 - DNA, 20 bp, Homo sapiens
actcttcctccaaggacaga

SEQ ID NO: 5158015 - DNA, 14 bp, Homo sapiens
actcttcctcccct

SEQ ID NO: 5158016 - DNA, 13 bp, Homo sapiens
actcttcctcctc

SEQ ID NO: 5158017 - DNA, 15 bp, Homo sapiens
actaattgagccatt

SEQ ID NO: 5158018 - DNA, 12 bp, Homo sapiens
actaattggaag

SEQ ID NO: 5158019 - DNA, 20 bp, Homo sapiens
actaattggcctctttaaga

SEQ ID NO: 5158020 - DNA, 19 bp, Homo sapiens
actaattgtataacaggtt

SEQ ID NO: 5158021 - DNA, 22 bp, Homo sapiens
actaattgtataacaggttatt

SEQ ID NO: 5158022 - DNA, 16 bp, Homo sapiens
actaatttaaaccagc

SEQ ID NO: 5158023 - DNA, 17 bp, Homo sapiens
actaatttaaaccagca

SEQ ID NO: 5158024 - DNA, 15 bp, Homo sapiens
actaatttatacttt

SEQ ID NO: 5158025 - DNA, 12 bp, Homo sapiens
actaatttcttc

SEQ ID NO: 5158026 - DNA, 14 bp, Homo sapiens
actaatttcttctt

SEQ ID NO: 5158027 - DNA, 16 bp, Homo sapiens
actaatttgtggtaaa

SEQ ID NO: 5158028 - DNA, 15 bp, Homo sapiens
actaattttaaaatg

SEQ ID NO: 5158029 - DNA, 21 bp, Homo sapiens
actaattttaaagtaaaaggc

SEQ ID NO: 5158030 - DNA, 20 bp, Homo sapiens
actaattttccataagctat

SEQ ID NO: 5158031 - DNA, 23 bp, Homo sapiens
actaattttgcatgcgtatttat

SEQ ID NO: 5158032 - DNA, 14 bp, Homo sapiens
actaattttgttga

SEQ ID NO: 5158033 - DNA, 16 bp, Homo sapiens
actaattttgttgaaa

SEQ ID NO: 5158034 - DNA, 20 bp, Homo sapiens
actaatttttagatattcat

SEQ ID NO: 5158035 - DNA, 23 bp, Homo sapiens
actaatttttagatattcattaa

SEQ ID NO: 5158036 - DNA, 15 bp, Homo sapiens
actaatttttatttt

SEQ ID NO: 5158037 - DNA, 11 bp, Homo sapiens
actacaaaaag

SEQ ID NO: 5158038 - DNA, 16 bp, Homo sapiens
actacaaaaagaagag

SEQ ID NO: 5158039 - DNA, 14 bp, Homo sapiens
actacaaaaataca

SEQ ID NO: 5158040 - DNA, 15 bp, Homo sapiens
actacaaaatacaat

SEQ ID NO: 5158041 - DNA, 18 bp, Homo sapiens
actacaaacaaaatttct

SEQ ID NO: 5158042 - DNA, 21 bp, Homo sapiens
actacaaacatggggagccat

SEQ ID NO: 5158043 - DNA, 18 bp, Homo sapiens
actacaaagctttgctac

SEQ ID NO: 5158044 - DNA, 19 bp, Homo sapiens
actacaaaggtttaaatga

SEQ ID NO: 5158045 - DNA, 21 bp, Homo sapiens
actacaaaggtttaaatgaac

SEQ ID NO: 5158046 - DNA, 22 bp, Homo sapiens
actacaaaggtttaaatgaaca

SEQ ID NO: 5158047 - DNA, 19 bp, Homo sapiens
actacaaatcaagtatttg

SEQ ID NO: 5158048 - DNA, 13 bp, Homo sapiens
actacaacattag

SEQ ID NO: 5158049 - DNA, 15 bp, Homo sapiens
actacaacattagaa

SEQ ID NO: 5158050 - DNA, 19 bp, Homo sapiens
actacaacattagaatatt

SEQ ID NO: 5158051 - DNA, 13 bp, Homo sapiens
actacaacctcca

SEQ ID NO: 5158052 - DNA, 15 bp, Homo sapiens
actacaacctccacc

SEQ ID NO: 5158053 - DNA, 19 bp, Homo sapiens
actacaacttttgttttct

SEQ ID NO: 5158054 - DNA, 20 bp, Homo sapiens
actacaacttttgttttctg

SEQ ID NO: 5158055 - DNA, 23 bp, Homo sapiens
actacaacttttgttttctgatg

SEQ ID NO: 5158056 - DNA, 22 bp, Homo sapiens
actacaagtttataagcccaaa

SEQ ID NO: 5158057 - DNA, 22 bp, Homo sapiens
actacaataccctaccctatgg

SEQ ID NO: 5158058 - DNA, 23 bp, Homo sapiens
actacaatgatggtaaagccatg

SEQ ID NO: 5158059 - DNA, 22 bp, Homo sapiens
actacaatttaaagcaaaggag

SEQ ID NO: 5158060 - DNA, 19 bp, Homo sapiens
actacacacccccaagcca

SEQ ID NO: 5158061 - DNA, 17 bp, Homo sapiens
actacacatttgaaaca

SEQ ID NO: 5158062 - DNA, 20 bp, Homo sapiens
actacacatttttaaattgt

SEQ ID NO: 5158063 - DNA, 22 bp, Homo sapiens
actacacatttttaaattgtta

SEQ ID NO: 5158064 - DNA, 14 bp, Homo sapiens
actacaccacacta

SEQ ID NO: 5158065 - DNA, 23 bp, Homo sapiens
actacaccatgtttgagctcaga

SEQ ID NO: 5158066 - DNA, 15 bp, Homo sapiens
actacacccagcaat

SEQ ID NO: 5158067 - DNA, 18 bp, Homo sapiens
actacactcaactaattt

SEQ ID NO: 5158068 - DNA, 17 bp, Homo sapiens
actacactccagcctga

SEQ ID NO: 5158069 - DNA, 20 bp, Homo sapiens
actacactccagcctgggca

SEQ ID NO: 5158070 - DNA, 14 bp, Homo sapiens
actacactgaggag

SEQ ID NO: 5158071 - DNA, 16 bp, Homo sapiens
actacactgaggagag

SEQ ID NO: 5158072 - DNA, 17 bp, Homo sapiens
actacacttctgaaact

SEQ ID NO: 5158073 - DNA, 18 bp, Homo sapiens
actacactttgctagtga

SEQ ID NO: 5158074 - DNA, 23 bp, Homo sapiens
actacagaaagcaaatcagacac

SEQ ID NO: 5158075 - DNA, 23 bp, Homo sapiens
actacagaaatgaggaggatgct

SEQ ID NO: 5158076 - DNA, 16 bp, Homo sapiens
actacagaagtggaag

SEQ ID NO: 5158077 - DNA, 21 bp, Homo sapiens
actacagaagtggaaggataa

SEQ ID NO: 5158078 - DNA, 15 bp, Homo sapiens
actacagaataatgt

SEQ ID NO: 5158079 - DNA, 20 bp, Homo sapiens
actacagaatattaaatatt

SEQ ID NO: 5158080 - DNA, 22 bp, Homo sapiens
actacagaatattaaatattat

SEQ ID NO: 5158081 - DNA, 19 bp, Homo sapiens
actacagacctgctttttg

SEQ ID NO: 5158082 - DNA, 14 bp, Homo sapiens
actacagagcagct

SEQ ID NO: 5158083 - DNA, 18 bp, Homo sapiens
actacagctggggtgcag

SEQ ID NO: 5158084 - DNA, 19 bp, Homo sapiens
actacagctggggtgcagg

SEQ ID NO: 5158085 - DNA, 20 bp, Homo sapiens
actacaggcacacaccacca

SEQ ID NO: 5158086 - DNA, 19 bp, Homo sapiens
actacaggcgcctgccagc

SEQ ID NO: 5158087 - DNA, 21 bp, Homo sapiens
actacaggctcatgccatcat

SEQ ID NO: 5158088 - DNA, 18 bp, Homo sapiens
actacagggccgccggca

SEQ ID NO: 5158089 - DNA, 17 bp, Homo sapiens
actacaggtgagtgcca

SEQ ID NO: 5158090 - DNA, 16 bp, Homo sapiens
actacaggttttatga

SEQ ID NO: 5158091 - DNA, 17 bp, Homo sapiens
actacagtattactctt

SEQ ID NO: 5158092 - DNA, 15 bp, Homo sapiens
actacagttagggct

SEQ ID NO: 5158093 - DNA, 14 bp, Homo sapiens
actacataaaaata

SEQ ID NO: 5158094 - DNA, 16 bp, Homo sapiens
actacataaactgact

SEQ ID NO: 5158095 - DNA, 17 bp, Homo sapiens
actacataaactgactt

SEQ ID NO: 5158096 - DNA, 14 bp, Homo sapiens
actacataatctct

SEQ ID NO: 5158097 - DNA, 20 bp, Homo sapiens
actacataatctctggaaat

SEQ ID NO: 5158098 - DNA, 23 bp, Homo sapiens
actacataattaaattttaatgt

SEQ ID NO: 5158099 - DNA, 14 bp, Homo sapiens
actacatctgatat

SEQ ID NO: 5158100 - DNA, 18 bp, Homo sapiens
actacatctttaaacagt

SEQ ID NO: 5158101 - DNA, 20 bp, Homo sapiens
actacatgcagcccatgccc

SEQ ID NO: 5158102 - DNA, 15 bp, Homo sapiens
actacatgtggttta

SEQ ID NO: 5158103 - DNA, 19 bp, Homo sapiens
actacatgtggtttataga

SEQ ID NO: 5158104 - DNA, 17 bp, Homo sapiens
actacattaaaagcttt

SEQ ID NO: 5158105 - DNA, 16 bp, Homo sapiens
actacattagggaagc

SEQ ID NO: 5158106 - DNA, 18 bp, Homo sapiens
actacattagggaagcta

SEQ ID NO: 5158107 - DNA, 16 bp, Homo sapiens
actacattatggaatc

SEQ ID NO: 5158108 - DNA, 12 bp, Homo sapiens
actacattctgt

SEQ ID NO: 5158109 - DNA, 13 bp, Homo sapiens
actacattctgtt

SEQ ID NO: 5158110 - DNA, 17 bp, Homo sapiens
actacattgagcccctg

SEQ ID NO: 5158111 - DNA, 22 bp, Homo sapiens
actacattgagtagacacattt

SEQ ID NO: 5158112 - DNA, 15 bp, Homo sapiens
actacatttgcatgc

SEQ ID NO: 5158113 - DNA, 15 bp, Homo sapiens
actacattttaaaaa

SEQ ID NO: 5158114 - DNA, 15 bp, Homo sapiens
actacattttaacat

SEQ ID NO: 5158115 - DNA, 16 bp, Homo sapiens
actacattttaacatg

SEQ ID NO: 5158116 - DNA, 15 bp, Homo sapiens
actacattttgctct

SEQ ID NO: 5158117 - DNA, 14 bp, Homo sapiens
actaccaaaagaca

SEQ ID NO: 5158118 - DNA, 21 bp, Homo sapiens
actaccaaaagacattagaga

SEQ ID NO: 5158119 - DNA, 14 bp, Homo sapiens
actaccaaaatgaa

SEQ ID NO: 5158120 - DNA, 16 bp, Homo sapiens
actaccaatcccaact

SEQ ID NO: 5158121 - DNA, 22 bp, Homo sapiens
actaccaccctcgctgccaccc

SEQ ID NO: 5158122 - DNA, 13 bp, Homo sapiens
actaccacctcag

SEQ ID NO: 5158123 - DNA, 14 bp, Homo sapiens
actaccagatgacc

SEQ ID NO: 5158124 - DNA, 21 bp, Homo sapiens
actaccagctaactccagtct

SEQ ID NO: 5158125 - DNA, 19 bp, Homo sapiens
actaccagggtctctcagg

SEQ ID NO: 5158126 - DNA, 23 bp, Homo sapiens
actaccatctgatgtttcatatt

SEQ ID NO: 5158127 - DNA, 21 bp, Homo sapiens
actacccacgttctcacaccc

SEQ ID NO: 5158128 - DNA, 13 bp, Homo sapiens
actacccagctct

SEQ ID NO: 5158129 - DNA, 15 bp, Homo sapiens
actacccatagacat

SEQ ID NO: 5158130 - DNA, 19 bp, Homo sapiens
actacccatagacatgaaa

SEQ ID NO: 5158131 - DNA, 19 bp, Homo sapiens
actacccatgtctttctgg

SEQ ID NO: 5158132 - DNA, 19 bp, Homo sapiens
actaccccacaacacgcct

SEQ ID NO: 5158133 - DNA, 20 bp, Homo sapiens
actaccccatatacacctgg

SEQ ID NO: 5158134 - DNA, 21 bp, Homo sapiens
actacccgagcccagctacat

SEQ ID NO: 5158135 - DNA, 23 bp, Homo sapiens
actaccctacacctctgggccct

SEQ ID NO: 5158136 - DNA, 13 bp, Homo sapiens
actaccctcaccc

SEQ ID NO: 5158137 - DNA, 22 bp, Homo sapiens
actaccctctcactagtgccaa

SEQ ID NO: 5158138 - DNA, 13 bp, Homo sapiens
actaccctgggct

SEQ ID NO: 5158139 - DNA, 18 bp, Homo sapiens
actaccctgggctctggt

SEQ ID NO: 5158140 - DNA, 16 bp, Homo sapiens
actacccttaattact

SEQ ID NO: 5158141 - DNA, 14 bp, Homo sapiens
actacccttctcct

SEQ ID NO: 5158142 - DNA, 13 bp, Homo sapiens
actaccgcaggcc

SEQ ID NO: 5158143 - DNA, 18 bp, Homo sapiens
actaccgtgccagcagcg

SEQ ID NO: 5158144 - DNA, 14 bp, Homo sapiens
actaccgtggacca

SEQ ID NO: 5158145 - DNA, 13 bp, Homo sapiens
actacctataaat

SEQ ID NO: 5158146 - DNA, 16 bp, Homo sapiens
actacctataggaaag

SEQ ID NO: 5158147 - DNA, 17 bp, Homo sapiens
actacctatccttacat

SEQ ID NO: 5158148 - DNA, 12 bp, Homo sapiens
actacctcctca

SEQ ID NO: 5158149 - DNA, 17 bp, Homo sapiens
actacctcctcagggat

SEQ ID NO: 5158150 - DNA, 12 bp, Homo sapiens
actacctctgga

SEQ ID NO: 5158151 - DNA, 23 bp, Homo sapiens
actacctctggacagttgtgttg

SEQ ID NO: 5158152 - DNA, 21 bp, Homo sapiens
actacctgccatgcatacatg

SEQ ID NO: 5158153 - DNA, 18 bp, Homo sapiens
actaccttggttccccca

SEQ ID NO: 5158154 - DNA, 23 bp, Homo sapiens
actacctttatagctctcatcac

SEQ ID NO: 5158155 - DNA, 19 bp, Homo sapiens
actacctttggcttaattc

SEQ ID NO: 5158156 - DNA, 13 bp, Homo sapiens
actacgcctggct

SEQ ID NO: 5158157 - DNA, 18 bp, Homo sapiens
actacggaatagttggct

SEQ ID NO: 5158158 - DNA, 16 bp, Homo sapiens
actacgtcttaagtca

SEQ ID NO: 5158159 - DNA, 14 bp, Homo sapiens
actacgtgccagct

SEQ ID NO: 5158160 - DNA, 21 bp, Homo sapiens
actacgtgttcacaggctgct

SEQ ID NO: 5158161 - DNA, 15 bp, Homo sapiens
actacgttaagggaa

SEQ ID NO: 5158162 - DNA, 16 bp, Homo sapiens
actactaaaagtttag

SEQ ID NO: 5158163 - DNA, 18 bp, Homo sapiens
actactaaaagtttagaa

SEQ ID NO: 5158164 - DNA, 21 bp, Homo sapiens
actactaaaagtttagaactt

SEQ ID NO: 5158165 - DNA, 13 bp, Homo sapiens
actactaaagtgc

SEQ ID NO: 5158166 - DNA, 20 bp, Homo sapiens
actactaacaaatgtaaaat

SEQ ID NO: 5158167 - DNA, 14 bp, Homo sapiens
actactaagaataa

SEQ ID NO: 5158168 - DNA, 17 bp, Homo sapiens
actactaaggaaaataa

SEQ ID NO: 5158169 - DNA, 14 bp, Homo sapiens
actactaaggcctt

SEQ ID NO: 5158170 - DNA, 22 bp, Homo sapiens
actactaaggccttttatgtaa

SEQ ID NO: 5158171 - DNA, 19 bp, Homo sapiens
actactaatagaataaagg

SEQ ID NO: 5158172 - DNA, 17 bp, Homo sapiens
actactaatctcaattt

SEQ ID NO: 5158173 - DNA, 18 bp, Homo sapiens
actactacatctgtgatg

SEQ ID NO: 5158174 - DNA, 15 bp, Homo sapiens
actactactctgcca

SEQ ID NO: 5158175 - DNA, 15 bp, Homo sapiens
actactactggtgat

SEQ ID NO: 5158176 - DNA, 13 bp, Homo sapiens
actactactgtta

SEQ ID NO: 5158177 - DNA, 19 bp, Homo sapiens
actactagatgtctttagg

SEQ ID NO: 5158178 - DNA, 21 bp, Homo sapiens
actactagtttttacttttat

SEQ ID NO: 5158179 - DNA, 15 bp, Homo sapiens
actactattctgtta

SEQ ID NO: 5158180 - DNA, 19 bp, Homo sapiens
actactatttttctttcca

SEQ ID NO: 5158181 - DNA, 16 bp, Homo sapiens
actactcaaagcaaaa

SEQ ID NO: 5158182 - DNA, 18 bp, Homo sapiens
actactcaaagcaaaagt

SEQ ID NO: 5158183 - DNA, 17 bp, Homo sapiens
actactcagcatggaaa

SEQ ID NO: 5158184 - DNA, 21 bp, Homo sapiens
actactcagttattactgttt

SEQ ID NO: 5158185 - DNA, 21 bp, Homo sapiens
actactcatacttaagcaaaa

SEQ ID NO: 5158186 - DNA, 14 bp, Homo sapiens
actactcgagccca

SEQ ID NO: 5158187 - DNA, 15 bp, Homo sapiens
actactcgagcccac

SEQ ID NO: 5158188 - DNA, 13 bp, Homo sapiens
actactctgccaa

SEQ ID NO: 5158189 - DNA, 14 bp, Homo sapiens
actactctgccaat

SEQ ID NO: 5158190 - DNA, 12 bp, Homo sapiens
actactctgcct

SEQ ID NO: 5158191 - DNA, 18 bp, Homo sapiens
actactgaactgttacct

SEQ ID NO: 5158192 - DNA, 10 bp, Homo sapiens
actactgaat

SEQ ID NO: 5158193 - DNA, 14 bp, Homo sapiens
actactgaataaat

SEQ ID NO: 5158194 - DNA, 20 bp, Homo sapiens
actactgacagggagcagcc

SEQ ID NO: 5158195 - DNA, 22 bp, Homo sapiens
actactgacggagtcctgtgtt

SEQ ID NO: 5158196 - DNA, 21 bp, Homo sapiens
actcttcctctaacatttttg

SEQ ID NO: 5158197 - DNA, 15 bp, Homo sapiens
actcttcctgcaagg

SEQ ID NO: 5158198 - DNA, 15 bp, Homo sapiens
actcttcctgtccta

SEQ ID NO: 5158199 - DNA, 12 bp, Homo sapiens
actcttcctttc

SEQ ID NO: 5158200 - DNA, 16 bp, Homo sapiens
actcttctaaaacttg

SEQ ID NO: 5158201 - DNA, 24 bp, Homo sapiens
actcttctcattacttgttgccta

SEQ ID NO: 5158202 - DNA, 21 bp, Homo sapiens
actcttctccattccctccac

SEQ ID NO: 5158203 - DNA, 20 bp, Homo sapiens
actcttctcggctcaggctc

SEQ ID NO: 5158204 - DNA, 22 bp, Homo sapiens
actcttctctcaaccttggcct

SEQ ID NO: 5158205 - DNA, 19 bp, Homo sapiens
actcttctctccaaggaaa

SEQ ID NO: 5158206 - DNA, 17 bp, Homo sapiens
actcttctctcctttct

SEQ ID NO: 5158207 - DNA, 23 bp, Homo sapiens
actcttctctcctttctccctgc

SEQ ID NO: 5158208 - DNA, 15 bp, Homo sapiens
actcttctctctgct

SEQ ID NO: 5158209 - DNA, 16 bp, Homo sapiens
actcttctctctgctc

SEQ ID NO: 5158210 - DNA, 19 bp, Homo sapiens
actcttctctctgctctga

SEQ ID NO: 5158211 - DNA, 23 bp, Homo sapiens
actcttctgagcacctacttaca

SEQ ID NO: 5158212 - DNA, 13 bp, Homo sapiens
actcttctgtctt

SEQ ID NO: 5158213 - DNA, 14 bp, Homo sapiens
actcttctgtcttg

SEQ ID NO: 5158214 - DNA, 21 bp, Homo sapiens
actcttctttaagccatagac

SEQ ID NO: 5158215 - DNA, 17 bp, Homo sapiens
actcttgaagtacttaa

SEQ ID NO: 5158216 - DNA, 19 bp, Homo sapiens
actcttgaagtccaggact

SEQ ID NO: 5158217 - DNA, 20 bp, Homo sapiens
actcttgaattcctctcaaa

SEQ ID NO: 5158218 - DNA, 12 bp, Homo sapiens
actcttgagaat

SEQ ID NO: 5158219 - DNA, 18 bp, Homo sapiens
actcttgagagctcaggc

SEQ ID NO: 5158220 - DNA, 19 bp, Homo sapiens
actcttgagagctcaggca

SEQ ID NO: 5158221 - DNA, 21 bp, Homo sapiens
actcttgagttgtttttgtat

SEQ ID NO: 5158222 - DNA, 13 bp, Homo sapiens
actcttgatctct

SEQ ID NO: 5158223 - DNA, 19 bp, Homo sapiens
actcttgatctctcttgtc

SEQ ID NO: 5158224 - DNA, 10 bp, Homo sapiens
actcttgatg

SEQ ID NO: 5158225 - DNA, 16 bp, Homo sapiens
actcttgattatccat

SEQ ID NO: 5158226 - DNA, 20 bp, Homo sapiens
actcttgatttcacatttct

SEQ ID NO: 5158227 - DNA, 14 bp, Homo sapiens
actcttgcctgttt

SEQ ID NO: 5158228 - DNA, 16 bp, Homo sapiens
actcttgcctttccac

SEQ ID NO: 5158229 - DNA, 22 bp, Homo sapiens
actcttgcgtgtcaatttccct

SEQ ID NO: 5158230 - DNA, 19 bp, Homo sapiens
actcttgctattgaattga

SEQ ID NO: 5158231 - DNA, 17 bp, Homo sapiens
actcttgctcactccct

SEQ ID NO: 5158232 - DNA, 18 bp, Homo sapiens
actcttgctcactcccta

SEQ ID NO: 5158233 - DNA, 15 bp, Homo sapiens
actcttgctcctgct

SEQ ID NO: 5158234 - DNA, 19 bp, Homo sapiens
actcttgctcctgcttctc

SEQ ID NO: 5158235 - DNA, 14 bp, Homo sapiens
actcttgctctttc

SEQ ID NO: 5158236 - DNA, 15 bp, Homo sapiens
actcttggagcctct

SEQ ID NO: 5158237 - DNA, 17 bp, Homo sapiens
actcttggagcctcttt

SEQ ID NO: 5158238 - DNA, 20 bp, Homo sapiens
actcttggatgggacatttt

SEQ ID NO: 5158239 - DNA, 22 bp, Homo sapiens
actcttggatgggacatttttg

SEQ ID NO: 5158240 - DNA, 13 bp, Homo sapiens
actcttggcctca

SEQ ID NO: 5158241 - DNA, 15 bp, Homo sapiens
actcttggcctctgc

SEQ ID NO: 5158242 - DNA, 17 bp, Homo sapiens
actcttggtcacctcaa

SEQ ID NO: 5158243 - DNA, 20 bp, Homo sapiens
actcttggtcagcttttgtt

SEQ ID NO: 5158244 - DNA, 21 bp, Homo sapiens
actcttggttcgatacctgga

SEQ ID NO: 5158245 - DNA, 16 bp, Homo sapiens
actcttggtttcttca

SEQ ID NO: 5158246 - DNA, 23 bp, Homo sapiens
actcttgtaagattttgaaaact

SEQ ID NO: 5158247 - DNA, 16 bp, Homo sapiens
actcttgtactgcctg

SEQ ID NO: 5158248 - DNA, 21 bp, Homo sapiens
actcttgttgaagtgctgttt

SEQ ID NO: 5158249 - DNA, 16 bp, Homo sapiens
actcttgttgcccagg

SEQ ID NO: 5158250 - DNA, 23 bp, Homo sapiens
actcttgttgcccaggctggagt

SEQ ID NO: 5158251 - DNA, 17 bp, Homo sapiens
actctttacccttgagc

SEQ ID NO: 5158252 - DNA, 19 bp, Homo sapiens
actctttacccttgagccc

SEQ ID NO: 5158253 - DNA, 14 bp, Homo sapiens
actctttagagcag

SEQ ID NO: 5158254 - DNA, 18 bp, Homo sapiens
actctttatagtgcacaa

SEQ ID NO: 5158255 - DNA, 20 bp, Homo sapiens
actctttatcaagcaacatt

SEQ ID NO: 5158256 - DNA, 18 bp, Homo sapiens
actctttatgatctggcc

SEQ ID NO: 5158257 - DNA, 22 bp, Homo sapiens
actctttatttctagcagagtg

SEQ ID NO: 5158258 - DNA, 18 bp, Homo sapiens
actctttatttttctctt

SEQ ID NO: 5158259 - DNA, 11 bp, Homo sapiens
actctttcaaa

SEQ ID NO: 5158260 - DNA, 15 bp, Homo sapiens
actctttcaaagaaa

SEQ ID NO: 5158261 - DNA, 16 bp, Homo sapiens
actctttcaaagaaat

SEQ ID NO: 5158262 - DNA, 13 bp, Homo sapiens
actctttcattct

SEQ ID NO: 5158263 - DNA, 17 bp, Homo sapiens
actctttcattcttctc

SEQ ID NO: 5158264 - DNA, 12 bp, Homo sapiens
actctttcccca

SEQ ID NO: 5158265 - DNA, 17 bp, Homo sapiens
actctttcctaaagcca

SEQ ID NO: 5158266 - DNA, 23 bp, Homo sapiens
actctttcggtaggtggaagcta

SEQ ID NO: 5158267 - DNA, 17 bp, Homo sapiens
actctttctaatgctga

SEQ ID NO: 5158268 - DNA, 21 bp, Homo sapiens
actctttctattgttaaacaa

SEQ ID NO: 5158269 - DNA, 23 bp, Homo sapiens
actctttctattgttaaacaaat

SEQ ID NO: 5158270 - DNA, 14 bp, Homo sapiens
actctttctcccta

SEQ ID NO: 5158271 - DNA, 15 bp, Homo sapiens
actctttctgagtgc

SEQ ID NO: 5158272 - DNA, 14 bp, Homo sapiens
actctttcttcact

SEQ ID NO: 5158273 - DNA, 19 bp, Homo sapiens
actctttctttcaataaaa

SEQ ID NO: 5158274 - DNA, 23 bp, Homo sapiens
actctttctttgcaacagcagtg

SEQ ID NO: 5158275 - DNA, 19 bp, Homo sapiens
actctttgaagaaaagaaa

SEQ ID NO: 5158276 - DNA, 23 bp, Homo sapiens
actctttgaagaaaagaaaaaac

SEQ ID NO: 5158277 - DNA, 22 bp, Homo sapiens
actctttgagatagaagaactg

SEQ ID NO: 5158278 - DNA, 21 bp, Homo sapiens
actctttgcccagttcatccc

SEQ ID NO: 5158279 - DNA, 16 bp, Homo sapiens
actctttgctacaata

SEQ ID NO: 5158280 - DNA, 18 bp, Homo sapiens
actctttgctacaataaa

SEQ ID NO: 5158281 - DNA, 24 bp, Homo sapiens
actctttgctacaataaatgctga

SEQ ID NO: 5158282 - DNA, 11 bp, Homo sapiens
actctttgctg

SEQ ID NO: 5158283 - DNA, 17 bp, Homo sapiens
actctttgctttgtagt

SEQ ID NO: 5158284 - DNA, 18 bp, Homo sapiens
actctttgctttgtagtt

SEQ ID NO: 5158285 - DNA, 15 bp, Homo sapiens
actctttggctattg

SEQ ID NO: 5158286 - DNA, 22 bp, Homo sapiens
actctttggctattgtccttgt

SEQ ID NO: 5158287 - DNA, 21 bp, Homo sapiens
actctttgggatcttgaagaa

SEQ ID NO: 5158288 - DNA, 20 bp, Homo sapiens
actctttgggtccattcaga

SEQ ID NO: 5158289 - DNA, 14 bp, Homo sapiens
actctttggtggct

SEQ ID NO: 5158290 - DNA, 21 bp, Homo sapiens
actctttgtggggaagagggg

SEQ ID NO: 5158291 - DNA, 18 bp, Homo sapiens
actctttgttatttgaaa

SEQ ID NO: 5158292 - DNA, 18 bp, Homo sapiens
actctttgttttctttcc

SEQ ID NO: 5158293 - DNA, 22 bp, Homo sapiens
actcttttaagatcttgttaaa

SEQ ID NO: 5158294 - DNA, 17 bp, Homo sapiens
actcttttctattttgt

SEQ ID NO: 5158295 - DNA, 23 bp, Homo sapiens
actcttttgagcagtaaatgtat

SEQ ID NO: 5158296 - DNA, 15 bp, Homo sapiens
actcttttgctgtgc

SEQ ID NO: 5158297 - DNA, 14 bp, Homo sapiens
actctttttagggc

SEQ ID NO: 5158298 - DNA, 20 bp, Homo sapiens
actctttttagggccaggca

SEQ ID NO: 5158299 - DNA, 22 bp, Homo sapiens
actctttttcccaactttggaa

SEQ ID NO: 5158300 - DNA, 20 bp, Homo sapiens
actctttttggactcagccc

SEQ ID NO: 5158301 - DNA, 21 bp, Homo sapiens
actctttttggactcagccca

SEQ ID NO: 5158302 - DNA, 18 bp, Homo sapiens
actctttttgggtccagt

SEQ ID NO: 5158303 - DNA, 19 bp, Homo sapiens
actcttttttaaaaattac

SEQ ID NO: 5158304 - DNA, 22 bp, Homo sapiens
actctttttttgagtgacagct

SEQ ID NO: 5158305 - DNA, 21 bp, Homo sapiens
actgaaaaaaaaaaagaagaa

SEQ ID NO: 5158306 - DNA, 23 bp, Homo sapiens
actgaaaaaaaaaaagaagaaga

SEQ ID NO: 5158307 - DNA, 13 bp, Homo sapiens
actgaaaaaatat

SEQ ID NO: 5158308 - DNA, 15 bp, Homo sapiens
actgaaaaaatatat

SEQ ID NO: 5158309 - DNA, 16 bp, Homo sapiens
actgaaaaaatatatg

SEQ ID NO: 5158310 - DNA, 13 bp, Homo sapiens
actgaaaaaatgt

SEQ ID NO: 5158311 - DNA, 20 bp, Homo sapiens
actgaaaaagaatgaaaaca

SEQ ID NO: 5158312 - DNA, 12 bp, Homo sapiens
actgaaaacata

SEQ ID NO: 5158313 - DNA, 14 bp, Homo sapiens
actgaaaacatctg

SEQ ID NO: 5158314 - DNA, 15 bp, Homo sapiens
actgaaaacatctgg

SEQ ID NO: 5158315 - DNA, 18 bp, Homo sapiens
actgaaaacatctggaag

SEQ ID NO: 5158316 - DNA, 14 bp, Homo sapiens
actgaaaagaagga

SEQ ID NO: 5158317 - DNA, 17 bp, Homo sapiens
actgaaaagaaggaaag

SEQ ID NO: 5158318 - DNA, 19 bp, Homo sapiens
actgaaaagaaggaaagat

SEQ ID NO: 5158319 - DNA, 19 bp, Homo sapiens
actgaaaagactcagtgtt

SEQ ID NO: 5158320 - DNA, 13 bp, Homo sapiens
actgaaaagagag

SEQ ID NO: 5158321 - DNA, 20 bp, Homo sapiens
actgaaaaggaggggtctgg

SEQ ID NO: 5158322 - DNA, 16 bp, Homo sapiens
actgaaaatctaatat

SEQ ID NO: 5158323 - DNA, 14 bp, Homo sapiens
actgaaaatgaatg

SEQ ID NO: 5158324 - DNA, 23 bp, Homo sapiens
actgaaacatgcacattttgtac

SEQ ID NO: 5158325 - DNA, 13 bp, Homo sapiens
actgaaacattat

SEQ ID NO: 5158326 - DNA, 16 bp, Homo sapiens
actgaaacatttgaca

SEQ ID NO: 5158327 - DNA, 15 bp, Homo sapiens
actgaaaccaaaaca

SEQ ID NO: 5158328 - DNA, 17 bp, Homo sapiens
actgaaacctcttcggt

SEQ ID NO: 5158329 - DNA, 10 bp, Homo sapiens
actgaaagaa

SEQ ID NO: 5158330 - DNA, 12 bp, Homo sapiens
actgaaagaaac

SEQ ID NO: 5158331 - DNA, 19 bp, Homo sapiens
actgaaagaaactaagatt

SEQ ID NO: 5158332 - DNA, 16 bp, Homo sapiens
actgaaagcaaatgct

SEQ ID NO: 5158333 - DNA, 14 bp, Homo sapiens
actgaaagcagcag

SEQ ID NO: 5158334 - DNA, 19 bp, Homo sapiens
actgaaagcagcagctagg

SEQ ID NO: 5158335 - DNA, 20 bp, Homo sapiens
actgaaagccttagggaagc

SEQ ID NO: 5158336 - DNA, 16 bp, Homo sapiens
actgaaaggcttttca

SEQ ID NO: 5158337 - DNA, 15 bp, Homo sapiens
actgaaagtctgtgg

SEQ ID NO: 5158338 - DNA, 17 bp, Homo sapiens
actgaaagtgtttcctt

SEQ ID NO: 5158339 - DNA, 17 bp, Homo sapiens
actgaaagttttgtaaa

SEQ ID NO: 5158340 - DNA, 13 bp, Homo sapiens
actgaaataaaaa

SEQ ID NO: 5158341 - DNA, 20 bp, Homo sapiens
actgaaataaacctgcactg

SEQ ID NO: 5158342 - DNA, 18 bp, Homo sapiens
actgaaatgccttacttt

SEQ ID NO: 5158343 - DNA, 23 bp, Homo sapiens
actgaaatgccttactttgtatg

SEQ ID NO: 5158344 - DNA, 15 bp, Homo sapiens
actgaaatggcttct

SEQ ID NO: 5158345 - DNA, 13 bp, Homo sapiens
actgaaattactt

SEQ ID NO: 5158346 - DNA, 18 bp, Homo sapiens
actgaaattactttaaca

SEQ ID NO: 5158347 - DNA, 20 bp, Homo sapiens
actgaaattactttaacatt

SEQ ID NO: 5158348 - DNA, 19 bp, Homo sapiens
actgaaattagtgttttca

SEQ ID NO: 5158349 - DNA, 20 bp, Homo sapiens
actgaaattattttctccaa

SEQ ID NO: 5158350 - DNA, 13 bp, Homo sapiens
actgaaattgttt

SEQ ID NO: 5158351 - DNA, 19 bp, Homo sapiens
actgaaattgtttaaaagc

SEQ ID NO: 5158352 - DNA, 22 bp, Homo sapiens
actgaaattgttttaccagctc

SEQ ID NO: 5158353 - DNA, 23 bp, Homo sapiens
actgaaattgttttaccagctcc

SEQ ID NO: 5158354 - DNA, 21 bp, Homo sapiens
actgaacagtaacatagctgt

SEQ ID NO: 5158355 - DNA, 20 bp, Homo sapiens
actgaacatctgagtcctgg

SEQ ID NO: 5158356 - DNA, 13 bp, Homo sapiens
actgaacatgcct

SEQ ID NO: 5158357 - DNA, 13 bp, Homo sapiens
actgaacattcca

SEQ ID NO: 5158358 - DNA, 16 bp, Homo sapiens
actgaacatttgcttt

SEQ ID NO: 5158359 - DNA, 20 bp, Homo sapiens
actgaacatttgctttgttt

SEQ ID NO: 5158360 - DNA, 13 bp, Homo sapiens
actgaaccaaatt

SEQ ID NO: 5158361 - DNA, 19 bp, Homo sapiens
actgaaccaaattgcactg

SEQ ID NO: 5158362 - DNA, 20 bp, Homo sapiens
actgaaccaaattgcactga

SEQ ID NO: 5158363 - DNA, 15 bp, Homo sapiens
actgaaccacattca

SEQ ID NO: 5158364 - DNA, 19 bp, Homo sapiens
actgaaccactgcttctct

SEQ ID NO: 5158365 - DNA, 14 bp, Homo sapiens
actgaaccagccac

SEQ ID NO: 5158366 - DNA, 15 bp, Homo sapiens
actgaaccaggccag

SEQ ID NO: 5158367 - DNA, 13 bp, Homo sapiens
actgaacccagag

SEQ ID NO: 5158368 - DNA, 20 bp, Homo sapiens
actgaacgatccttcaaagt

SEQ ID NO: 5158369 - DNA, 14 bp, Homo sapiens
actgaactccatcg

SEQ ID NO: 5158370 - DNA, 22 bp, Homo sapiens
actgaactgtgtgtaattgttc

SEQ ID NO: 5158371 - DNA, 12 bp, Homo sapiens
actgaacttgaa

SEQ ID NO: 5158372 - DNA, 17 bp, Homo sapiens
actgaacttgaagctaa

SEQ ID NO: 5158373 - DNA, 13 bp, Homo sapiens
actgaactttctt

SEQ ID NO: 5158374 - DNA, 15 bp, Homo sapiens
actactgattacttg

SEQ ID NO: 5158375 - DNA, 15 bp, Homo sapiens
actactgcaccattt

SEQ ID NO: 5158376 - DNA, 12 bp, Homo sapiens
actactgcagca

SEQ ID NO: 5158377 - DNA, 13 bp, Homo sapiens
actactgcagcac

SEQ ID NO: 5158378 - DNA, 15 bp, Homo sapiens
actactgcagcacct

SEQ ID NO: 5158379 - DNA, 15 bp, Homo sapiens
actactgcagtcttt

SEQ ID NO: 5158380 - DNA, 19 bp, Homo sapiens
actactgcagtctttattt

SEQ ID NO: 5158381 - DNA, 21 bp, Homo sapiens
actactgcctttagaaaatat

SEQ ID NO: 5158382 - DNA, 22 bp, Homo sapiens
actactgcctttagaaaatata

SEQ ID NO: 5158383 - DNA, 16 bp, Homo sapiens
actactgcctttcaaa

SEQ ID NO: 5158384 - DNA, 14 bp, Homo sapiens
actactgctaatgt

SEQ ID NO: 5158385 - DNA, 14 bp, Homo sapiens
actactgctatttt

SEQ ID NO: 5158386 - DNA, 21 bp, Homo sapiens
actactgctattttttttaaa

SEQ ID NO: 5158387 - DNA, 19 bp, Homo sapiens
actactgctcctgtggcag

SEQ ID NO: 5158388 - DNA, 23 bp, Homo sapiens
actactgctcctgtggcaggagg

SEQ ID NO: 5158389 - DNA, 20 bp, Homo sapiens
actactgctgcaaagtgcaa

SEQ ID NO: 5158390 - DNA, 22 bp, Homo sapiens
actactgctgcaaagtgcaaat

SEQ ID NO: 5158391 - DNA, 13 bp, Homo sapiens
actactgggtgtc

SEQ ID NO: 5158392 - DNA, 21 bp, Homo sapiens
actactgtaattaagtgcaat

SEQ ID NO: 5158393 - DNA, 14 bp, Homo sapiens
actactgtatctga

SEQ ID NO: 5158394 - DNA, 15 bp, Homo sapiens
actactgtatttcat

SEQ ID NO: 5158395 - DNA, 18 bp, Homo sapiens
actactgtggaaaaatat

SEQ ID NO: 5158396 - DNA, 19 bp, Homo sapiens
actactgtggaaaaatatt

SEQ ID NO: 5158397 - DNA, 20 bp, Homo sapiens
actactgtggaaaaatattt

SEQ ID NO: 5158398 - DNA, 21 bp, Homo sapiens
actactgtggaaaaatattta

SEQ ID NO: 5158399 - DNA, 16 bp, Homo sapiens
actactgtgttatgca

SEQ ID NO: 5158400 - DNA, 21 bp, Homo sapiens
actactgtgttcctggcaata

SEQ ID NO: 5158401 - DNA, 22 bp, Homo sapiens
actactgttatcagtaatgcta

SEQ ID NO: 5158402 - DNA, 16 bp, Homo sapiens
actacttacttagaga

SEQ ID NO: 5158403 - DNA, 14 bp, Homo sapiens
actacttagcactt

SEQ ID NO: 5158404 - DNA, 21 bp, Homo sapiens
actacttatctctaaaccatc

SEQ ID NO: 5158405 - DNA, 15 bp, Homo sapiens
actacttcattttct

SEQ ID NO: 5158406 - DNA, 23 bp, Homo sapiens
actacttcttttttcaaaagaaa

SEQ ID NO: 5158407 - DNA, 13 bp, Homo sapiens
actacttgatata

SEQ ID NO: 5158408 - DNA, 19 bp, Homo sapiens
actacttgatataattact

SEQ ID NO: 5158409 - DNA, 17 bp, Homo sapiens
actacttgggagcaccg

SEQ ID NO: 5158410 - DNA, 22 bp, Homo sapiens
actactttcatgaattttttaa

SEQ ID NO: 5158411 - DNA, 11 bp, Homo sapiens
actactttctt

SEQ ID NO: 5158412 - DNA, 23 bp, Homo sapiens
actactttgcctcttcagcagca

SEQ ID NO: 5158413 - DNA, 16 bp, Homo sapiens
actactttgctgctaa

SEQ ID NO: 5158414 - DNA, 17 bp, Homo sapiens
actactttgtgttttca

SEQ ID NO: 5158415 - DNA, 14 bp, Homo sapiens
actacttttctaaa

SEQ ID NO: 5158416 - DNA, 16 bp, Homo sapiens
actacttttctaaaat

SEQ ID NO: 5158417 - DNA, 23 bp, Homo sapiens
actactttttatactccatacat

SEQ ID NO: 5158418 - DNA, 14 bp, Homo sapiens
actagaaatatatt

SEQ ID NO: 5158419 - DNA, 20 bp, Homo sapiens
actagaaatatattcataat

SEQ ID NO: 5158420 - DNA, 15 bp, Homo sapiens
actagaaatctgcca

SEQ ID NO: 5158421 - DNA, 16 bp, Homo sapiens
actagaactctccatc

SEQ ID NO: 5158422 - DNA, 19 bp, Homo sapiens
actagaagaaaagcccatt

SEQ ID NO: 5158423 - DNA, 20 bp, Homo sapiens
actagaagctgatctgattg

SEQ ID NO: 5158424 - DNA, 16 bp, Homo sapiens
actagaatgagaaatc

SEQ ID NO: 5158425 - DNA, 17 bp, Homo sapiens
actagaatgagaaatca

SEQ ID NO: 5158426 - DNA, 20 bp, Homo sapiens
actagaattctagtgctgct

SEQ ID NO: 5158427 - DNA, 13 bp, Homo sapiens
actagaattctgt

SEQ ID NO: 5158428 - DNA, 15 bp, Homo sapiens
actagaattgttgca

SEQ ID NO: 5158429 - DNA, 18 bp, Homo sapiens
actagaatttgtattttg

SEQ ID NO: 5158430 - DNA, 20 bp, Homo sapiens
actagaatttgtattttgct

SEQ ID NO: 5158431 - DNA, 12 bp, Homo sapiens
actagacaagcc

SEQ ID NO: 5158432 - DNA, 15 bp, Homo sapiens
actagacaagccaga

SEQ ID NO: 5158433 - DNA, 17 bp, Homo sapiens
actagacaagccagaac

SEQ ID NO: 5158434 - DNA, 21 bp, Homo sapiens
actagacaagccagaacttga

SEQ ID NO: 5158435 - DNA, 16 bp, Homo sapiens
actagacacagataat

SEQ ID NO: 5158436 - DNA, 18 bp, Homo sapiens
actagacaccaaagttct

SEQ ID NO: 5158437 - DNA, 20 bp, Homo sapiens
actagacaccaaagttctaa

SEQ ID NO: 5158438 - DNA, 15 bp, Homo sapiens
actagacatgtcatg

SEQ ID NO: 5158439 - DNA, 15 bp, Homo sapiens
actagaccaattgtc

SEQ ID NO: 5158440 - DNA, 16 bp, Homo sapiens
actagaccatttttaa

SEQ ID NO: 5158441 - DNA, 16 bp, Homo sapiens
actagacgttcatttg

SEQ ID NO: 5158442 - DNA, 21 bp, Homo sapiens
actagactgaggagccctctc

SEQ ID NO: 5158443 - DNA, 20 bp, Homo sapiens
actagacttgaggaaaccag

SEQ ID NO: 5158444 - DNA, 14 bp, Homo sapiens
actagactttatgt

SEQ ID NO: 5158445 - DNA, 12 bp, Homo sapiens
actagagaaggg

SEQ ID NO: 5158446 - DNA, 12 bp, Homo sapiens
actagagaatgc

SEQ ID NO: 5158447 - DNA, 23 bp, Homo sapiens
actagagaatgcacagatatact

SEQ ID NO: 5158448 - DNA, 16 bp, Homo sapiens
actagagacaaatctt

SEQ ID NO: 5158449 - DNA, 17 bp, Homo sapiens
actagagactctgtgat

SEQ ID NO: 5158450 - DNA, 20 bp, Homo sapiens
actagagactctgtgatcta

SEQ ID NO: 5158451 - DNA, 17 bp, Homo sapiens
actagagatattttgta

SEQ ID NO: 5158452 - DNA, 19 bp, Homo sapiens
actagagatattttgtaaa

SEQ ID NO: 5158453 - DNA, 23 bp, Homo sapiens
actagagatctggttttgctatt

SEQ ID NO: 5158454 - DNA, 19 bp, Homo sapiens
actagagcaaaataatgca

SEQ ID NO: 5158455 - DNA, 16 bp, Homo sapiens
actagagcaagcagga

SEQ ID NO: 5158456 - DNA, 15 bp, Homo sapiens
actagagcacaacat

SEQ ID NO: 5158457 - DNA, 11 bp, Homo sapiens
actagagcacg

SEQ ID NO: 5158458 - DNA, 21 bp, Homo sapiens
actagagcagccctggagtca

SEQ ID NO: 5158459 - DNA, 12 bp, Homo sapiens
actagagctggg

SEQ ID NO: 5158460 - DNA, 21 bp, Homo sapiens
actagaggtgttacagaggac

SEQ ID NO: 5158461 - DNA, 19 bp, Homo sapiens
actagaggttttatgatat

SEQ ID NO: 5158462 - DNA, 16 bp, Homo sapiens
actagagtatgtgtat

SEQ ID NO: 5158463 - DNA, 23 bp, Homo sapiens
actagagtcacccccccaggcct

SEQ ID NO: 5158464 - DNA, 20 bp, Homo sapiens
actagagtctgaacagctgt

SEQ ID NO: 5158465 - DNA, 14 bp, Homo sapiens
actagagtgctctg

SEQ ID NO: 5158466 - DNA, 19 bp, Homo sapiens
actagagttagatatgtgc

SEQ ID NO: 5158467 - DNA, 20 bp, Homo sapiens
actagagtttagctggaaaa

SEQ ID NO: 5158468 - DNA, 19 bp, Homo sapiens
actagataacttaaataat

SEQ ID NO: 5158469 - DNA, 13 bp, Homo sapiens
actagatactact

SEQ ID NO: 5158470 - DNA, 15 bp, Homo sapiens
actagatactacttt

SEQ ID NO: 5158471 - DNA, 23 bp, Homo sapiens
actagatactactttctcttttt

SEQ ID NO: 5158472 - DNA, 20 bp, Homo sapiens
actagatcaaggagcccaga

SEQ ID NO: 5158473 - DNA, 18 bp, Homo sapiens
actagatcttacatctgc

SEQ ID NO: 5158474 - DNA, 15 bp, Homo sapiens
actagatgacctcat

SEQ ID NO: 5158475 - DNA, 14 bp, Homo sapiens
actagatgactgta

SEQ ID NO: 5158476 - DNA, 20 bp, Homo sapiens
actagatggacctgcctgca

SEQ ID NO: 5158477 - DNA, 15 bp, Homo sapiens
actagatggtgctga

SEQ ID NO: 5158478 - DNA, 18 bp, Homo sapiens
actagatggtgctgagaa

SEQ ID NO: 5158479 - DNA, 19 bp, Homo sapiens
actagatgtatgtgaataa

SEQ ID NO: 5158480 - DNA, 20 bp, Homo sapiens
actagattaagatctgtgtt

SEQ ID NO: 5158481 - DNA, 22 bp, Homo sapiens
actagattctcacctgccttca

SEQ ID NO: 5158482 - DNA, 23 bp, Homo sapiens
actagatttcaagctaattttct

SEQ ID NO: 5158483 - DNA, 15 bp, Homo sapiens
actagatttgggaga

SEQ ID NO: 5158484 - DNA, 14 bp, Homo sapiens
actagatttgtcct

SEQ ID NO: 5158485 - DNA, 15 bp, Homo sapiens
actagatttgtcctt

SEQ ID NO: 5158486 - DNA, 13 bp, Homo sapiens
actagcaaaataa

SEQ ID NO: 5158487 - DNA, 15 bp, Homo sapiens
actagcaaaataaaa

SEQ ID NO: 5158488 - DNA, 18 bp, Homo sapiens
actagcaaaataaaacat

SEQ ID NO: 5158489 - DNA, 19 bp, Homo sapiens
actagcacctgccagggag

SEQ ID NO: 5158490 - DNA, 21 bp, Homo sapiens
actagcactttataagccaat

SEQ ID NO: 5158491 - DNA, 14 bp, Homo sapiens
actagcagaaaata

SEQ ID NO: 5158492 - DNA, 21 bp, Homo sapiens
actagcaggctactgggacct

SEQ ID NO: 5158493 - DNA, 13 bp, Homo sapiens
actagcatatctg

SEQ ID NO: 5158494 - DNA, 17 bp, Homo sapiens
actagcatatctgcctt

SEQ ID NO: 5158495 - DNA, 23 bp, Homo sapiens
actagcatttagagcttttcaga

SEQ ID NO: 5158496 - DNA, 14 bp, Homo sapiens
actagcatttttgg

SEQ ID NO: 5158497 - DNA, 14 bp, Homo sapiens
actagccaaaccag

SEQ ID NO: 5158498 - DNA, 17 bp, Homo sapiens
actagccaaacctcacc

SEQ ID NO: 5158499 - DNA, 22 bp, Homo sapiens
actagccaaacctcaccaactc

SEQ ID NO: 5158500 - DNA, 21 bp, Homo sapiens
actagccaacggccccagctt

SEQ ID NO: 5158501 - DNA, 15 bp, Homo sapiens
actagccaccaactc

SEQ ID NO: 5158502 - DNA, 14 bp, Homo sapiens
actagccagacaaa

SEQ ID NO: 5158503 - DNA, 22 bp, Homo sapiens
actagccagacactctgctctg

SEQ ID NO: 5158504 - DNA, 21 bp, Homo sapiens
actagccatgataactgcaat

SEQ ID NO: 5158505 - DNA, 15 bp, Homo sapiens
actagcccaatgaaa

SEQ ID NO: 5158506 - DNA, 13 bp, Homo sapiens
actagcccaggac

SEQ ID NO: 5158507 - DNA, 17 bp, Homo sapiens
actagcccaggacccat

SEQ ID NO: 5158508 - DNA, 18 bp, Homo sapiens
actagccctcctttttcc

SEQ ID NO: 5158509 - DNA, 15 bp, Homo sapiens
actagccctctttct

SEQ ID NO: 5158510 - DNA, 20 bp, Homo sapiens
actagccctctttctctctg

SEQ ID NO: 5158511 - DNA, 21 bp, Homo sapiens
actagcctaggtcataaagag

SEQ ID NO: 5158512 - DNA, 13 bp, Homo sapiens
actagcctccctc

SEQ ID NO: 5158513 - DNA, 15 bp, Homo sapiens
actagcctccctctc

SEQ ID NO: 5158514 - DNA, 23 bp, Homo sapiens
actagcctccctctcctctgtcc

SEQ ID NO: 5158515 - DNA, 16 bp, Homo sapiens
actagcctggccaaca

SEQ ID NO: 5158516 - DNA, 14 bp, Homo sapiens
actagctaattagc

SEQ ID NO: 5158517 - DNA, 19 bp, Homo sapiens
actagctatctaggtggag

SEQ ID NO: 5158518 - DNA, 11 bp, Homo sapiens
actagctcccc

SEQ ID NO: 5158519 - DNA, 13 bp, Homo sapiens
actagctcttgtt

SEQ ID NO: 5158520 - DNA, 12 bp, Homo sapiens
actagctgcctt

SEQ ID NO: 5158521 - DNA, 17 bp, Homo sapiens
actagctgtctcaggag

SEQ ID NO: 5158522 - DNA, 14 bp, Homo sapiens
actagcttacatga

SEQ ID NO: 5158523 - DNA, 19 bp, Homo sapiens
actagcttactgatgatgt

SEQ ID NO: 5158524 - DNA, 22 bp, Homo sapiens
actagcttgaacttagatgtta

SEQ ID NO: 5158525 - DNA, 13 bp, Homo sapiens
actaggaaacgtg

SEQ ID NO: 5158526 - DNA, 22 bp, Homo sapiens
actaggaagtaaagtgaagaat

SEQ ID NO: 5158527 - DNA, 11 bp, Homo sapiens
actaggaattc

SEQ ID NO: 5158528 - DNA, 20 bp, Homo sapiens
actaggaatttttttcagta

SEQ ID NO: 5158529 - DNA, 22 bp, Homo sapiens
actaggaatttttttcagtatt

SEQ ID NO: 5158530 - DNA, 13 bp, Homo sapiens
actaggacctcat

SEQ ID NO: 5158531 - DNA, 19 bp, Homo sapiens
actaggacctcatatcttc

SEQ ID NO: 5158532 - DNA, 18 bp, Homo sapiens
actaggactcagaaacga

SEQ ID NO: 5158533 - DNA, 19 bp, Homo sapiens
actaggagatgaaactggt

SEQ ID NO: 5158534 - DNA, 14 bp, Homo sapiens
actaggaggaaaag

SEQ ID NO: 5158535 - DNA, 18 bp, Homo sapiens
actaggaggaaaagacag

SEQ ID NO: 5158536 - DNA, 21 bp, Homo sapiens
actaggataggaactgggcct

SEQ ID NO: 5158537 - DNA, 19 bp, Homo sapiens
actaggatatgtatatttt

SEQ ID NO: 5158538 - DNA, 17 bp, Homo sapiens
actaggatcccactggc

SEQ ID NO: 5158539 - DNA, 19 bp, Homo sapiens
actaggcattgtgatgttt

SEQ ID NO: 5158540 - DNA, 16 bp, Homo sapiens
actaggcatttgtaaa

SEQ ID NO: 5158541 - DNA, 16 bp, Homo sapiens
actaggccatttgtat

SEQ ID NO: 5158542 - DNA, 18 bp, Homo sapiens
actaggcccccacttgcc

SEQ ID NO: 5158543 - DNA, 21 bp, Homo sapiens
actaggccctacacacagacc

SEQ ID NO: 5158544 - DNA, 16 bp, Homo sapiens
actaggccctggtctg

SEQ ID NO: 5158545 - DNA, 17 bp, Homo sapiens
actaggccctggtctgg

SEQ ID NO: 5158546 - DNA, 23 bp, Homo sapiens
actaggccttgcggctcctcagg

SEQ ID NO: 5158547 - DNA, 16 bp, Homo sapiens
actaggctaaactcaa

SEQ ID NO: 5158548 - DNA, 17 bp, Homo sapiens
actaggctaaactcaag

SEQ ID NO: 5158549 - DNA, 12 bp, Homo sapiens
actaggctgggt

SEQ ID NO: 5158550 - DNA, 13 bp, Homo sapiens
actaggctgggtg

SEQ ID NO: 5158551 - DNA, 22 bp, Homo sapiens
actaggctgggtgcccacagcc

SEQ ID NO: 5158552 - DNA, 16 bp, Homo sapiens
actaggcttctgtaat

SEQ ID NO: 5158553 - DNA, 13 bp, Homo sapiens
actgaactttgaa

SEQ ID NO: 5158554 - DNA, 10 bp, Homo sapiens
actgaagaaa

SEQ ID NO: 5158555 - DNA, 16 bp, Homo sapiens
actgaagaaaatcctt

SEQ ID NO: 5158556 - DNA, 15 bp, Homo sapiens
actgaagaaagagaa

SEQ ID NO: 5158557 - DNA, 18 bp, Homo sapiens
actgaagaagatgagcct

SEQ ID NO: 5158558 - DNA, 12 bp, Homo sapiens
actgaagaagga

SEQ ID NO: 5158559 - DNA, 13 bp, Homo sapiens
actgaagaatttt

SEQ ID NO: 5158560 - DNA, 15 bp, Homo sapiens
actgaagaattttga

SEQ ID NO: 5158561 - DNA, 13 bp, Homo sapiens
actgaagacaggc

SEQ ID NO: 5158562 - DNA, 23 bp, Homo sapiens
actgaagactagccccttttctg

SEQ ID NO: 5158563 - DNA, 18 bp, Homo sapiens
actgaagagaccacagca

SEQ ID NO: 5158564 - DNA, 14 bp, Homo sapiens
actgaagagctctt

SEQ ID NO: 5158565 - DNA, 18 bp, Homo sapiens
actgaagagctcttggcc

SEQ ID NO: 5158566 - DNA, 14 bp, Homo sapiens
actgaagaggagga

SEQ ID NO: 5158567 - DNA, 23 bp, Homo sapiens
actgaagaggaggaggagggtct

SEQ ID NO: 5158568 - DNA, 17 bp, Homo sapiens
actgaagatagaagaaa

SEQ ID NO: 5158569 - DNA, 19 bp, Homo sapiens
actgaagatagaagaaaaa

SEQ ID NO: 5158570 - DNA, 21 bp, Homo sapiens
actgaagatagaagaaaaaag

SEQ ID NO: 5158571 - DNA, 16 bp, Homo sapiens
actgaagatattccaa

SEQ ID NO: 5158572 - DNA, 17 bp, Homo sapiens
actgaagatattccaac

SEQ ID NO: 5158573 - DNA, 16 bp, Homo sapiens
actgaagatgttgaga

SEQ ID NO: 5158574 - DNA, 20 bp, Homo sapiens
actgaagatttatttttaat

SEQ ID NO: 5158575 - DNA, 16 bp, Homo sapiens
actgaagcaaatacca

SEQ ID NO: 5158576 - DNA, 14 bp, Homo sapiens
actgaagcacagca

SEQ ID NO: 5158577 - DNA, 16 bp, Homo sapiens
actgaagcagagtcaa

SEQ ID NO: 5158578 - DNA, 13 bp, Homo sapiens
actgaagcagcct

SEQ ID NO: 5158579 - DNA, 21 bp, Homo sapiens
actgaagcagcctctccccag

SEQ ID NO: 5158580 - DNA, 16 bp, Homo sapiens
actgaagcataaacat

SEQ ID NO: 5158581 - DNA, 18 bp, Homo sapiens
actgaagccagaaataaa

SEQ ID NO: 5158582 - DNA, 23 bp, Homo sapiens
actgaagccggacagctgcccag

SEQ ID NO: 5158583 - DNA, 13 bp, Homo sapiens
actgaagccgtgt

SEQ ID NO: 5158584 - DNA, 15 bp, Homo sapiens
actgaagcctgcagg

SEQ ID NO: 5158585 - DNA, 15 bp, Homo sapiens
actgaagccttcttc

SEQ ID NO: 5158586 - DNA, 15 bp, Homo sapiens
actgaagcgaacatc

SEQ ID NO: 5158587 - DNA, 17 bp, Homo sapiens
actgaagcgaacatctt

SEQ ID NO: 5158588 - DNA, 18 bp, Homo sapiens
actgaagctgctgtaact

SEQ ID NO: 5158589 - DNA, 17 bp, Homo sapiens
actgaagctggggcttg

SEQ ID NO: 5158590 - DNA, 20 bp, Homo sapiens
actgaagctggggcttgggg

SEQ ID NO: 5158591 - DNA, 12 bp, Homo sapiens
actgaagcttaa

SEQ ID NO: 5158592 - DNA, 13 bp, Homo sapiens
actgaagcttttt

SEQ ID NO: 5158593 - DNA, 13 bp, Homo sapiens
actgaaggccact

SEQ ID NO: 5158594 - DNA, 21 bp, Homo sapiens
actgaaggccacttgagttgg

SEQ ID NO: 5158595 - DNA, 19 bp, Homo sapiens
actgaaggctaaaaagcaa

SEQ ID NO: 5158596 - DNA, 20 bp, Homo sapiens
actgaaggctaaaaagcaac

SEQ ID NO: 5158597 - DNA, 14 bp, Homo sapiens
actgaaggctttca

SEQ ID NO: 5158598 - DNA, 20 bp, Homo sapiens
actgaaggctttcagggcct

SEQ ID NO: 5158599 - DNA, 21 bp, Homo sapiens
actgaagggaacagcctgagc

SEQ ID NO: 5158600 - DNA, 23 bp, Homo sapiens
actgaagggaacagcctgagccg

SEQ ID NO: 5158601 - DNA, 16 bp, Homo sapiens
actgaaggggcacacc

SEQ ID NO: 5158602 - DNA, 20 bp, Homo sapiens
actgaaggggcacaccactg

SEQ ID NO: 5158603 - DNA, 23 bp, Homo sapiens
actgaaggggtgcacccacctgt

SEQ ID NO: 5158604 - DNA, 17 bp, Homo sapiens
actgaaggtaaaattga

SEQ ID NO: 5158605 - DNA, 19 bp, Homo sapiens
actgaaggtcaataaatta

SEQ ID NO: 5158606 - DNA, 16 bp, Homo sapiens
actgaaggtgattcac

SEQ ID NO: 5158607 - DNA, 21 bp, Homo sapiens
actgaaggttttttttttaag

SEQ ID NO: 5158608 - DNA, 20 bp, Homo sapiens
actgaagtaaaacaaacaat

SEQ ID NO: 5158609 - DNA, 16 bp, Homo sapiens
actgaagtaaacagct

SEQ ID NO: 5158610 - DNA, 13 bp, Homo sapiens
actgaagtgaata

SEQ ID NO: 5158611 - DNA, 19 bp, Homo sapiens
actgaagtgaatacatggt

SEQ ID NO: 5158612 - DNA, 17 bp, Homo sapiens
actgaagtgcttagtgt

SEQ ID NO: 5158613 - DNA, 20 bp, Homo sapiens
actgaagtgcttgcagatca

SEQ ID NO: 5158614 - DNA, 19 bp, Homo sapiens
actgaagtggccctccctc

SEQ ID NO: 5158615 - DNA, 20 bp, Homo sapiens
actgaagtggccctccctca

SEQ ID NO: 5158616 - DNA, 17 bp, Homo sapiens
actgaagttaacagaga

SEQ ID NO: 5158617 - DNA, 21 bp, Homo sapiens
actgaagttaacagagacaga

SEQ ID NO: 5158618 - DNA, 21 bp, Homo sapiens
actgaagttctgcctctgatg

SEQ ID NO: 5158619 - DNA, 16 bp, Homo sapiens
actgaagtttcacatg

SEQ ID NO: 5158620 - DNA, 15 bp, Homo sapiens
actgaagtttgataa

SEQ ID NO: 5158621 - DNA, 19 bp, Homo sapiens
actgaagtttgataaatag

SEQ ID NO: 5158622 - DNA, 19 bp, Homo sapiens
actgaagtttttgaaatac

SEQ ID NO: 5158623 - DNA, 14 bp, Homo sapiens
actgaataaaaaat

SEQ ID NO: 5158624 - DNA, 22 bp, Homo sapiens
actgaataaaaaataaataaaa

SEQ ID NO: 5158625 - DNA, 21 bp, Homo sapiens
actgaataaactcaaaactct

SEQ ID NO: 5158626 - DNA, 15 bp, Homo sapiens
actgaataaataagt

SEQ ID NO: 5158627 - DNA, 18 bp, Homo sapiens
actgaataaataagtaaa

SEQ ID NO: 5158628 - DNA, 22 bp, Homo sapiens
actgaataatatcaaataaaat

SEQ ID NO: 5158629 - DNA, 16 bp, Homo sapiens
actgaataatgctacc

SEQ ID NO: 5158630 - DNA, 21 bp, Homo sapiens
actgaataatggaattatgta

SEQ ID NO: 5158631 - DNA, 14 bp, Homo sapiens
actgaatacaaata

SEQ ID NO: 5158632 - DNA, 16 bp, Homo sapiens
actgaatacaaataga

SEQ ID NO: 5158633 - DNA, 13 bp, Homo sapiens
actgaataccact

SEQ ID NO: 5158634 - DNA, 17 bp, Homo sapiens
actgaataccactctgt

SEQ ID NO: 5158635 - DNA, 19 bp, Homo sapiens
actgaataccactctgtaa

SEQ ID NO: 5158636 - DNA, 20 bp, Homo sapiens
actgaataccactctgtaat

SEQ ID NO: 5158637 - DNA, 22 bp, Homo sapiens
actgaataccactctgtaattg

SEQ ID NO: 5158638 - DNA, 16 bp, Homo sapiens
actgaatacttgaagt

SEQ ID NO: 5158639 - DNA, 23 bp, Homo sapiens
actgaatagttcaggagacttta

SEQ ID NO: 5158640 - DNA, 17 bp, Homo sapiens
actgaatataaagctta

SEQ ID NO: 5158641 - DNA, 23 bp, Homo sapiens
actgaatatcaactctgaaagag

SEQ ID NO: 5158642 - DNA, 16 bp, Homo sapiens
actgaatatcatatgt

SEQ ID NO: 5158643 - DNA, 18 bp, Homo sapiens
actgaatatttatatttc

SEQ ID NO: 5158644 - DNA, 20 bp, Homo sapiens
actgaatattttggaaactg

SEQ ID NO: 5158645 - DNA, 15 bp, Homo sapiens
actgaatcatgttaa

SEQ ID NO: 5158646 - DNA, 18 bp, Homo sapiens
actgaatctatggcttta

SEQ ID NO: 5158647 - DNA, 21 bp, Homo sapiens
actgaatctcataattggaat

SEQ ID NO: 5158648 - DNA, 21 bp, Homo sapiens
actgaatctcccctcctcaca

SEQ ID NO: 5158649 - DNA, 13 bp, Homo sapiens
actgaatctgtac

SEQ ID NO: 5158650 - DNA, 15 bp, Homo sapiens
actgaatctgtacag

SEQ ID NO: 5158651 - DNA, 16 bp, Homo sapiens
actgaatgaaaccccc

SEQ ID NO: 5158652 - DNA, 19 bp, Homo sapiens
actgaatgaaacccccaca

SEQ ID NO: 5158653 - DNA, 13 bp, Homo sapiens
actgaatgacctc

SEQ ID NO: 5158654 - DNA, 14 bp, Homo sapiens
actgaatgatctat

SEQ ID NO: 5158655 - DNA, 16 bp, Homo sapiens
actgaatgcataaata

SEQ ID NO: 5158656 - DNA, 19 bp, Homo sapiens
actgaatgcataaataaat

SEQ ID NO: 5158657 - DNA, 15 bp, Homo sapiens
actgaatgctgttaa

SEQ ID NO: 5158658 - DNA, 22 bp, Homo sapiens
actgaatgcttctgacttcata

SEQ ID NO: 5158659 - DNA, 22 bp, Homo sapiens
actgaatggactttgcacactt

SEQ ID NO: 5158660 - DNA, 18 bp, Homo sapiens
actgaatggctgacctga

SEQ ID NO: 5158661 - DNA, 20 bp, Homo sapiens
actgaatgggatcatgaaag

SEQ ID NO: 5158662 - DNA, 13 bp, Homo sapiens
actgaatgtgttt

SEQ ID NO: 5158663 - DNA, 18 bp, Homo sapiens
actgaatgtttacatgtc

SEQ ID NO: 5158664 - DNA, 19 bp, Homo sapiens
actgaatgtttattccttg

SEQ ID NO: 5158665 - DNA, 15 bp, Homo sapiens
actgaattaagttat

SEQ ID NO: 5158666 - DNA, 21 bp, Homo sapiens
actgaattaatcatctataaa

SEQ ID NO: 5158667 - DNA, 22 bp, Homo sapiens
actgaattaatgacagagccag

SEQ ID NO: 5158668 - DNA, 23 bp, Homo sapiens
actgaattataagaggctgataa

SEQ ID NO: 5158669 - DNA, 13 bp, Homo sapiens
actgaattcactc

SEQ ID NO: 5158670 - DNA, 18 bp, Homo sapiens
actgaattgctatcattt

SEQ ID NO: 5158671 - DNA, 19 bp, Homo sapiens
actgaattgtatcaatttg

SEQ ID NO: 5158672 - DNA, 17 bp, Homo sapiens
actgaattgtccccagt

SEQ ID NO: 5158673 - DNA, 15 bp, Homo sapiens
actgaatttattgcc

SEQ ID NO: 5158674 - DNA, 12 bp, Homo sapiens
actgaatttcaa

SEQ ID NO: 5158675 - DNA, 12 bp, Homo sapiens
actgaatttcta

SEQ ID NO: 5158676 - DNA, 12 bp, Homo sapiens
actgaatttctt

SEQ ID NO: 5158677 - DNA, 23 bp, Homo sapiens
actgaatttctttgatttaactg

SEQ ID NO: 5158678 - DNA, 13 bp, Homo sapiens
actgaatttggag

SEQ ID NO: 5158679 - DNA, 18 bp, Homo sapiens
actgaatttgttcttaaa

SEQ ID NO: 5158680 - DNA, 21 bp, Homo sapiens
actgaattttaaatgttcaca

SEQ ID NO: 5158681 - DNA, 20 bp, Homo sapiens
actgaatttttaaaatgccg

SEQ ID NO: 5158682 - DNA, 20 bp, Homo sapiens
actgaattttttttaaaaat

SEQ ID NO: 5158683 - DNA, 15 bp, Homo sapiens
actgacaaacgtccc

SEQ ID NO: 5158684 - DNA, 18 bp, Homo sapiens
actgacaaacgtccccag

SEQ ID NO: 5158685 - DNA, 13 bp, Homo sapiens
actgacaaatcaa

SEQ ID NO: 5158686 - DNA, 22 bp, Homo sapiens
actgacaagatggaaaataaat

SEQ ID NO: 5158687 - DNA, 20 bp, Homo sapiens
actgacaagctccatttaaa

SEQ ID NO: 5158688 - DNA, 17 bp, Homo sapiens
actgacacaaaggaagt

SEQ ID NO: 5158689 - DNA, 23 bp, Homo sapiens
actgacacaaaggacaaaaatat

SEQ ID NO: 5158690 - DNA, 14 bp, Homo sapiens
actgacacaggcca

SEQ ID NO: 5158691 - DNA, 15 bp, Homo sapiens
actgacacaggccag

SEQ ID NO: 5158692 - DNA, 23 bp, Homo sapiens
actgacacatcagcatgttttct

SEQ ID NO: 5158693 - DNA, 16 bp, Homo sapiens
actgacacccatgttt

SEQ ID NO: 5158694 - DNA, 23 bp, Homo sapiens
actgacaccctgggatggaacct

SEQ ID NO: 5158695 - DNA, 16 bp, Homo sapiens
actgacacctcactga

SEQ ID NO: 5158696 - DNA, 20 bp, Homo sapiens
actgacacctcactgaggaa

SEQ ID NO: 5158697 - DNA, 12 bp, Homo sapiens
actgacagcatg

SEQ ID NO: 5158698 - DNA, 20 bp, Homo sapiens
actgacagcatgtgccctcc

SEQ ID NO: 5158699 - DNA, 18 bp, Homo sapiens
actgacagcctcccaccc

SEQ ID NO: 5158700 - DNA, 13 bp, Homo sapiens
actgacagcctgg

SEQ ID NO: 5158701 - DNA, 16 bp, Homo sapiens
actgacagcctggggg

SEQ ID NO: 5158702 - DNA, 23 bp, Homo sapiens
actgacagcctgggggggccgct

SEQ ID NO: 5158703 - DNA, 20 bp, Homo sapiens
actgacaggcagcctggaca

SEQ ID NO: 5158704 - DNA, 13 bp, Homo sapiens
actgacagggagc

SEQ ID NO: 5158705 - DNA, 16 bp, Homo sapiens
actgacataggcttca

SEQ ID NO: 5158706 - DNA, 15 bp, Homo sapiens
actgacatcagattt

SEQ ID NO: 5158707 - DNA, 18 bp, Homo sapiens
actgacatcagatttctt

SEQ ID NO: 5158708 - DNA, 23 bp, Homo sapiens
actgacatgattagcagaagaaa

SEQ ID NO: 5158709 - DNA, 18 bp, Homo sapiens
actgacatggtgctgtgt

SEQ ID NO: 5158710 - DNA, 12 bp, Homo sapiens
actgacatgtgg

SEQ ID NO: 5158711 - DNA, 18 bp, Homo sapiens
actgacatgtggggccag

SEQ ID NO: 5158712 - DNA, 21 bp, Homo sapiens
actgacattcctaagagtgga

SEQ ID NO: 5158713 - DNA, 15 bp, Homo sapiens
actgacattgctcca

SEQ ID NO: 5158714 - DNA, 17 bp, Homo sapiens
actgacattgttggcca

SEQ ID NO: 5158715 - DNA, 23 bp, Homo sapiens
actgacattgttggccaaagcca

SEQ ID NO: 5158716 - DNA, 15 bp, Homo sapiens
actgacatttcttct

SEQ ID NO: 5158717 - DNA, 20 bp, Homo sapiens
actgaccaaagactgcagaa

SEQ ID NO: 5158718 - DNA, 20 bp, Homo sapiens
actgaccaaatcacccaatc

SEQ ID NO: 5158719 - DNA, 20 bp, Homo sapiens
actgaccaatattgtacagt

SEQ ID NO: 5158720 - DNA, 22 bp, Homo sapiens
actgaccacaccaaccaggcct

SEQ ID NO: 5158721 - DNA, 12 bp, Homo sapiens
actgaccactgg

SEQ ID NO: 5158722 - DNA, 19 bp, Homo sapiens
actgaccactggcctaccc

SEQ ID NO: 5158723 - DNA, 13 bp, Homo sapiens
actgaccactggg

SEQ ID NO: 5158724 - DNA, 12 bp, Homo sapiens
actgaccagaac

SEQ ID NO: 5158725 - DNA, 15 bp, Homo sapiens
actgaccagcagctt

SEQ ID NO: 5158726 - DNA, 13 bp, Homo sapiens
actgaccagcctc

SEQ ID NO: 5158727 - DNA, 14 bp, Homo sapiens
actgaccagcggct

SEQ ID NO: 5158728 - DNA, 15 bp, Homo sapiens
actgaccagcggctg

SEQ ID NO: 5158729 - DNA, 18 bp, Homo sapiens
actgaccagcggctgctc

SEQ ID NO: 5158730 - DNA, 18 bp, Homo sapiens
actgacccaaaatgtgaa

SEQ ID NO: 5158731 - DNA, 18 bp, Homo sapiens
actgacccaactgggggc

SEQ ID NO: 5158732 - DNA, 17 bp, Homo sapiens
actagggaagataatat

SEQ ID NO: 5158733 - DNA, 22 bp, Homo sapiens
actagggaatcctgcggcagga

SEQ ID NO: 5158734 - DNA, 13 bp, Homo sapiens
actagggacctgg

SEQ ID NO: 5158735 - DNA, 14 bp, Homo sapiens
actagggacctggg

SEQ ID NO: 5158736 - DNA, 22 bp, Homo sapiens
actagggagccatgtttcacaa

SEQ ID NO: 5158737 - DNA, 16 bp, Homo sapiens
actagggattcaggct

SEQ ID NO: 5158738 - DNA, 24 bp, Homo sapiens
actagggcctcggaggctcctccc

SEQ ID NO: 5158739 - DNA, 16 bp, Homo sapiens
actagggtcctcaggc

SEQ ID NO: 5158740 - DNA, 17 bp, Homo sapiens
actagggtcctcaggca

SEQ ID NO: 5158741 - DNA, 16 bp, Homo sapiens
actagggtcctgggga

SEQ ID NO: 5158742 - DNA, 20 bp, Homo sapiens
actagggttttggcctgcct

SEQ ID NO: 5158743 - DNA, 21 bp, Homo sapiens
actaggtaacttattagaaac

SEQ ID NO: 5158744 - DNA, 15 bp, Homo sapiens
actaggtaacttcat

SEQ ID NO: 5158745 - DNA, 15 bp, Homo sapiens
actaggtaataataa

SEQ ID NO: 5158746 - DNA, 18 bp, Homo sapiens
actaggtacataagcttc

SEQ ID NO: 5158747 - DNA, 19 bp, Homo sapiens
actaggtaggcttctacct

SEQ ID NO: 5158748 - DNA, 15 bp, Homo sapiens
actaggtatgaagta

SEQ ID NO: 5158749 - DNA, 18 bp, Homo sapiens
actaggtgaacagcagga

SEQ ID NO: 5158750 - DNA, 19 bp, Homo sapiens
actaggtgcccagtcttga

SEQ ID NO: 5158751 - DNA, 11 bp, Homo sapiens
actaggtgctg

SEQ ID NO: 5158752 - DNA, 14 bp, Homo sapiens
actaggtgctggca

SEQ ID NO: 5158753 - DNA, 22 bp, Homo sapiens
actaggtgctggcatgtctggg

SEQ ID NO: 5158754 - DNA, 16 bp, Homo sapiens
actaggtgtccccaac

SEQ ID NO: 5158755 - DNA, 18 bp, Homo sapiens
actaggttagcatcctgc

SEQ ID NO: 5158756 - DNA, 14 bp, Homo sapiens
actaggttctaggt

SEQ ID NO: 5158757 - DNA, 15 bp, Homo sapiens
actaggttcttttcc

SEQ ID NO: 5158758 - DNA, 15 bp, Homo sapiens
actaggtttttgctt

SEQ ID NO: 5158759 - DNA, 16 bp, Homo sapiens
actagtaaagacatag

SEQ ID NO: 5158760 - DNA, 23 bp, Homo sapiens
actagtaataccaaagactattt

SEQ ID NO: 5158761 - DNA, 16 bp, Homo sapiens
actagtaatactgtct

SEQ ID NO: 5158762 - DNA, 16 bp, Homo sapiens
actagtacaaattata

SEQ ID NO: 5158763 - DNA, 14 bp, Homo sapiens
actagtagatttct

SEQ ID NO: 5158764 - DNA, 17 bp, Homo sapiens
actagtagatttctatg

SEQ ID NO: 5158765 - DNA, 15 bp, Homo sapiens
actagtagctgtttt

SEQ ID NO: 5158766 - DNA, 19 bp, Homo sapiens
actagtagttcctgctaca

SEQ ID NO: 5158767 - DNA, 18 bp, Homo sapiens
actagtatttctatgaaa

SEQ ID NO: 5158768 - DNA, 19 bp, Homo sapiens
actagtatttctatgaaat

SEQ ID NO: 5158769 - DNA, 13 bp, Homo sapiens
actagtcacccca

SEQ ID NO: 5158770 - DNA, 22 bp, Homo sapiens
actagtcaccccaagtagtctg

SEQ ID NO: 5158771 - DNA, 13 bp, Homo sapiens
actagtcacctgg

SEQ ID NO: 5158772 - DNA, 15 bp, Homo sapiens
actagtcacctgggg

SEQ ID NO: 5158773 - DNA, 22 bp, Homo sapiens
actagtcattaacccatctctg

SEQ ID NO: 5158774 - DNA, 22 bp, Homo sapiens
actagtccaatcacccccagga

SEQ ID NO: 5158775 - DNA, 18 bp, Homo sapiens
actagtctacttcttaaa

SEQ ID NO: 5158776 - DNA, 14 bp, Homo sapiens
actagtctgtgtgc

SEQ ID NO: 5158777 - DNA, 13 bp, Homo sapiens
actagtgaaaaat

SEQ ID NO: 5158778 - DNA, 15 bp, Homo sapiens
actagtgaaaaatct

SEQ ID NO: 5158779 - DNA, 16 bp, Homo sapiens
actagtgaggaaagat

SEQ ID NO: 5158780 - DNA, 17 bp, Homo sapiens
actagtgagtcagcacc

SEQ ID NO: 5158781 - DNA, 22 bp, Homo sapiens
actagtgagtcagcaccttggc

SEQ ID NO: 5158782 - DNA, 23 bp, Homo sapiens
actagtgcaattccaagaaaata

SEQ ID NO: 5158783 - DNA, 21 bp, Homo sapiens
actagtgccaatgatgtgacc

SEQ ID NO: 5158784 - DNA, 20 bp, Homo sapiens
actagtgcctagaaagcaat

SEQ ID NO: 5158785 - DNA, 16 bp, Homo sapiens
actagtggaaagtcag

SEQ ID NO: 5158786 - DNA, 18 bp, Homo sapiens
actagtgggatcaacaat

SEQ ID NO: 5158787 - DNA, 23 bp, Homo sapiens
actagtgtacatttctataaata

SEQ ID NO: 5158788 - DNA, 16 bp, Homo sapiens
actagtgtcaggcccc

SEQ ID NO: 5158789 - DNA, 21 bp, Homo sapiens
actagtgtccgcataagaaaa

SEQ ID NO: 5158790 - DNA, 14 bp, Homo sapiens
actagtgtgactcc

SEQ ID NO: 5158791 - DNA, 16 bp, Homo sapiens
actagtgtgactcctt

SEQ ID NO: 5158792 - DNA, 18 bp, Homo sapiens
actagtgtttctgcagag

SEQ ID NO: 5158793 - DNA, 22 bp, Homo sapiens
actagttatatattccttacta

SEQ ID NO: 5158794 - DNA, 18 bp, Homo sapiens
actagttctcttgtcctg

SEQ ID NO: 5158795 - DNA, 19 bp, Homo sapiens
actagttgaacatctcact

SEQ ID NO: 5158796 - DNA, 17 bp, Homo sapiens
actagttgatgaaggag

SEQ ID NO: 5158797 - DNA, 20 bp, Homo sapiens
actagttgtgtctggcagtt

SEQ ID NO: 5158798 - DNA, 18 bp, Homo sapiens
actagtttaattaactat

SEQ ID NO: 5158799 - DNA, 17 bp, Homo sapiens
actagtttccagtggat

SEQ ID NO: 5158800 - DNA, 22 bp, Homo sapiens
actagttttaaaaacctgtgtt

SEQ ID NO: 5158801 - DNA, 17 bp, Homo sapiens
actagttttgtgccagc

SEQ ID NO: 5158802 - DNA, 21 bp, Homo sapiens
actagtttttcctatcatgtt

SEQ ID NO: 5158803 - DNA, 18 bp, Homo sapiens
actagtttttcctgtgca

SEQ ID NO: 5158804 - DNA, 19 bp, Homo sapiens
actataaaaatcatgtgat

SEQ ID NO: 5158805 - DNA, 12 bp, Homo sapiens
actataaaacta

SEQ ID NO: 5158806 - DNA, 13 bp, Homo sapiens
actataaaagctt

SEQ ID NO: 5158807 - DNA, 19 bp, Homo sapiens
actataaaatgtcttcaag

SEQ ID NO: 5158808 - DNA, 20 bp, Homo sapiens
actataaactactgtaatta

SEQ ID NO: 5158809 - DNA, 22 bp, Homo sapiens
actataaactccaggcttgatt

SEQ ID NO: 5158810 - DNA, 20 bp, Homo sapiens
actataaacttaaagctact

SEQ ID NO: 5158811 - DNA, 19 bp, Homo sapiens
actataaacttaagggcaa

SEQ ID NO: 5158812 - DNA, 13 bp, Homo sapiens
actataaagctgt

SEQ ID NO: 5158813 - DNA, 14 bp, Homo sapiens
actataaatacaaa

SEQ ID NO: 5158814 - DNA, 17 bp, Homo sapiens
actataaatacaaatct

SEQ ID NO: 5158815 - DNA, 15 bp, Homo sapiens
actataaatatattg

SEQ ID NO: 5158816 - DNA, 22 bp, Homo sapiens
actataaatgaaattgatttgt

SEQ ID NO: 5158817 - DNA, 23 bp, Homo sapiens
actataacatagaattgcaatct

SEQ ID NO: 5158818 - DNA, 14 bp, Homo sapiens
actataacattata

SEQ ID NO: 5158819 - DNA, 22 bp, Homo sapiens
actataacattatataacaaaa

SEQ ID NO: 5158820 - DNA, 12 bp, Homo sapiens
actataacattc

SEQ ID NO: 5158821 - DNA, 21 bp, Homo sapiens
actataaccagtttagctttt

SEQ ID NO: 5158822 - DNA, 17 bp, Homo sapiens
actataaccatcagtta

SEQ ID NO: 5158823 - DNA, 13 bp, Homo sapiens
actataagaactt

SEQ ID NO: 5158824 - DNA, 22 bp, Homo sapiens
actataagtagttggtttgtat

SEQ ID NO: 5158825 - DNA, 15 bp, Homo sapiens
actataatggttgga

SEQ ID NO: 5158826 - DNA, 23 bp, Homo sapiens
actataatttacctgaagtcttt

SEQ ID NO: 5158827 - DNA, 12 bp, Homo sapiens
actataatttga

SEQ ID NO: 5158828 - DNA, 14 bp, Homo sapiens
actatacaacaatg

SEQ ID NO: 5158829 - DNA, 15 bp, Homo sapiens
actatacatactata

SEQ ID NO: 5158830 - DNA, 16 bp, Homo sapiens
actatacctgcttcag

SEQ ID NO: 5158831 - DNA, 17 bp, Homo sapiens
actatacttgaacaaaa

SEQ ID NO: 5158832 - DNA, 18 bp, Homo sapiens
actatacttgaacaaaag

SEQ ID NO: 5158833 - DNA, 18 bp, Homo sapiens
actatagattctttatta

SEQ ID NO: 5158834 - DNA, 20 bp, Homo sapiens
actatagcaaagtagtactt

SEQ ID NO: 5158835 - DNA, 17 bp, Homo sapiens
actatagccatttgccc

SEQ ID NO: 5158836 - DNA, 22 bp, Homo sapiens
actatagcctaggtgacagagt

SEQ ID NO: 5158837 - DNA, 18 bp, Homo sapiens
actataggcttcttcctt

SEQ ID NO: 5158838 - DNA, 21 bp, Homo sapiens
actatagtccagctttgttct

SEQ ID NO: 5158839 - DNA, 14 bp, Homo sapiens
actatagttatata

SEQ ID NO: 5158840 - DNA, 20 bp, Homo sapiens
actatagtttaaaacacatt

SEQ ID NO: 5158841 - DNA, 22 bp, Homo sapiens
actatagtttaatactcagagg

SEQ ID NO: 5158842 - DNA, 13 bp, Homo sapiens
actatataaataa

SEQ ID NO: 5158843 - DNA, 14 bp, Homo sapiens
actatataaataag

SEQ ID NO: 5158844 - DNA, 13 bp, Homo sapiens
actatataaatga

SEQ ID NO: 5158845 - DNA, 15 bp, Homo sapiens
actatataaatgaca

SEQ ID NO: 5158846 - DNA, 19 bp, Homo sapiens
actatataaatgacattat

SEQ ID NO: 5158847 - DNA, 20 bp, Homo sapiens
actatataatcagattgaca

SEQ ID NO: 5158848 - DNA, 14 bp, Homo sapiens
actatatacatata

SEQ ID NO: 5158849 - DNA, 18 bp, Homo sapiens
actatatacatgtgtgta

SEQ ID NO: 5158850 - DNA, 14 bp, Homo sapiens
actatatagaattt

SEQ ID NO: 5158851 - DNA, 17 bp, Homo sapiens
actatatagaatttcct

SEQ ID NO: 5158852 - DNA, 20 bp, Homo sapiens
actatatagaatttcctgta

SEQ ID NO: 5158853 - DNA, 16 bp, Homo sapiens
actatatatataaatg

SEQ ID NO: 5158854 - DNA, 20 bp, Homo sapiens
actatatatataaatgtata

SEQ ID NO: 5158855 - DNA, 19 bp, Homo sapiens
actatatcagtagtgtaca

SEQ ID NO: 5158856 - DNA, 20 bp, Homo sapiens
actatatcagtagtgtacat

SEQ ID NO: 5158857 - DNA, 14 bp, Homo sapiens
actatatctgtttt

SEQ ID NO: 5158858 - DNA, 16 bp, Homo sapiens
actatatctgttttac

SEQ ID NO: 5158859 - DNA, 19 bp, Homo sapiens
actatatctgttttactgc

SEQ ID NO: 5158860 - DNA, 12 bp, Homo sapiens
actatatgaaaa

SEQ ID NO: 5158861 - DNA, 14 bp, Homo sapiens
actatatgaaaaga

SEQ ID NO: 5158862 - DNA, 20 bp, Homo sapiens
actatatgatcagtgttact

SEQ ID NO: 5158863 - DNA, 18 bp, Homo sapiens
actatatgcaaacagggt

SEQ ID NO: 5158864 - DNA, 16 bp, Homo sapiens
actatatgcataaaca

SEQ ID NO: 5158865 - DNA, 21 bp, Homo sapiens
actatatgcataaacaacagt

SEQ ID NO: 5158866 - DNA, 18 bp, Homo sapiens
actatatgtacagctctc

SEQ ID NO: 5158867 - DNA, 23 bp, Homo sapiens
actatatgtatatctttgcactg

SEQ ID NO: 5158868 - DNA, 12 bp, Homo sapiens
actatatgtgaa

SEQ ID NO: 5158869 - DNA, 13 bp, Homo sapiens
actatatgtgaat

SEQ ID NO: 5158870 - DNA, 14 bp, Homo sapiens
actatatgtttaca

SEQ ID NO: 5158871 - DNA, 18 bp, Homo sapiens
actatatgtttacacaat

SEQ ID NO: 5158872 - DNA, 13 bp, Homo sapiens
actatattaactt

SEQ ID NO: 5158873 - DNA, 17 bp, Homo sapiens
actatattaacttttat

SEQ ID NO: 5158874 - DNA, 18 bp, Homo sapiens
actatattaacttttatt

SEQ ID NO: 5158875 - DNA, 19 bp, Homo sapiens
actatattgattgtccttt

SEQ ID NO: 5158876 - DNA, 15 bp, Homo sapiens
actatattgtacaca

SEQ ID NO: 5158877 - DNA, 21 bp, Homo sapiens
actatatttattgatttcaag

SEQ ID NO: 5158878 - DNA, 21 bp, Homo sapiens
actatatttatttttgggttt

SEQ ID NO: 5158879 - DNA, 22 bp, Homo sapiens
actatatttgggcctgctccag

SEQ ID NO: 5158880 - DNA, 23 bp, Homo sapiens
actatatttgggcctgctccaga

SEQ ID NO: 5158881 - DNA, 21 bp, Homo sapiens
actatattttagatgcaatgt

SEQ ID NO: 5158882 - DNA, 15 bp, Homo sapiens
actatattttgtcat

SEQ ID NO: 5158883 - DNA, 23 bp, Homo sapiens
actatatttttctcaatgtttag

SEQ ID NO: 5158884 - DNA, 22 bp, Homo sapiens
actatatttttgggaggagcca

SEQ ID NO: 5158885 - DNA, 14 bp, Homo sapiens
actatcaacactgc

SEQ ID NO: 5158886 - DNA, 21 bp, Homo sapiens
actatcaactagcagaaaata

SEQ ID NO: 5158887 - DNA, 20 bp, Homo sapiens
actatcaattttaaggaaac

SEQ ID NO: 5158888 - DNA, 22 bp, Homo sapiens
actatcacacactttctcttca

SEQ ID NO: 5158889 - DNA, 14 bp, Homo sapiens
actatcacatacaa

SEQ ID NO: 5158890 - DNA, 18 bp, Homo sapiens
actatcacatacaatttg

SEQ ID NO: 5158891 - DNA, 20 bp, Homo sapiens
actatcacatacaatttgca

SEQ ID NO: 5158892 - DNA, 23 bp, Homo sapiens
actatcacatacaatttgcactg

SEQ ID NO: 5158893 - DNA, 23 bp, Homo sapiens
actatcagcagcggcagcagcag

SEQ ID NO: 5158894 - DNA, 14 bp, Homo sapiens
actatcaggcagaa

SEQ ID NO: 5158895 - DNA, 16 bp, Homo sapiens
actatcaggcagaaga

SEQ ID NO: 5158896 - DNA, 21 bp, Homo sapiens
actatcaggcagaagaatctt

SEQ ID NO: 5158897 - DNA, 18 bp, Homo sapiens
actatcatctcttaaatt

SEQ ID NO: 5158898 - DNA, 13 bp, Homo sapiens
actatcattctca

SEQ ID NO: 5158899 - DNA, 17 bp, Homo sapiens
actatccatgcaccaaa

SEQ ID NO: 5158900 - DNA, 20 bp, Homo sapiens
actatccctgcacataaact

SEQ ID NO: 5158901 - DNA, 22 bp, Homo sapiens
actatcctatgccttcaaatag

SEQ ID NO: 5158902 - DNA, 17 bp, Homo sapiens
actatcctgattccaaa

SEQ ID NO: 5158903 - DNA, 18 bp, Homo sapiens
actatcctgattccaaat

SEQ ID NO: 5158904 - DNA, 19 bp, Homo sapiens
actatcctgtaaatatatc

SEQ ID NO: 5158905 - DNA, 19 bp, Homo sapiens
actatccttctctttcaat

SEQ ID NO: 5158906 - DNA, 19 bp, Homo sapiens
actatcgtcttcctacaca

SEQ ID NO: 5158907 - DNA, 16 bp, Homo sapiens
actatctactctcctc

SEQ ID NO: 5158908 - DNA, 17 bp, Homo sapiens
actatctactctcctca

SEQ ID NO: 5158909 - DNA, 16 bp, Homo sapiens
actgacccagagggga

SEQ ID NO: 5158910 - DNA, 13 bp, Homo sapiens
actgacccaggac

SEQ ID NO: 5158911 - DNA, 16 bp, Homo sapiens
actgaccccctcccct

SEQ ID NO: 5158912 - DNA, 15 bp, Homo sapiens
actgaccctggagcg

SEQ ID NO: 5158913 - DNA, 18 bp, Homo sapiens
actgaccctggagcggct

SEQ ID NO: 5158914 - DNA, 22 bp, Homo sapiens
actgaccctggagcggctctcc

SEQ ID NO: 5158915 - DNA, 17 bp, Homo sapiens
actgaccctggggctgg

SEQ ID NO: 5158916 - DNA, 13 bp, Homo sapiens
actgacccttcca

SEQ ID NO: 5158917 - DNA, 17 bp, Homo sapiens
actgacccttccagaca

SEQ ID NO: 5158918 - DNA, 21 bp, Homo sapiens
actgaccgggatccagttcca

SEQ ID NO: 5158919 - DNA, 14 bp, Homo sapiens
actgacctacctca

SEQ ID NO: 5158920 - DNA, 13 bp, Homo sapiens
actgacctctaca

SEQ ID NO: 5158921 - DNA, 17 bp, Homo sapiens
actgacctgccagccgg

SEQ ID NO: 5158922 - DNA, 12 bp, Homo sapiens
actgacctgccc

SEQ ID NO: 5158923 - DNA, 11 bp, Homo sapiens
actgacctgga

SEQ ID NO: 5158924 - DNA, 13 bp, Homo sapiens
actgacctggaag

SEQ ID NO: 5158925 - DNA, 17 bp, Homo sapiens
actgacctggtccacag

SEQ ID NO: 5158926 - DNA, 17 bp, Homo sapiens
actgacctggttgtcca

SEQ ID NO: 5158927 - DNA, 13 bp, Homo sapiens
actgaccttgatg

SEQ ID NO: 5158928 - DNA, 19 bp, Homo sapiens
actgaccttgatgagctgt

SEQ ID NO: 5158929 - DNA, 20 bp, Homo sapiens
actgaccttgtaaaagacag

SEQ ID NO: 5158930 - DNA, 19 bp, Homo sapiens
actgacgaagaagcaacta

SEQ ID NO: 5158931 - DNA, 16 bp, Homo sapiens
actgacgctggagatg

SEQ ID NO: 5158932 - DNA, 22 bp, Homo sapiens
actgacggctgtgtatttctgt

SEQ ID NO: 5158933 - DNA, 18 bp, Homo sapiens
actgactaaccattgatg

SEQ ID NO: 5158934 - DNA, 14 bp, Homo sapiens
actgactaagaaga

SEQ ID NO: 5158935 - DNA, 21 bp, Homo sapiens
actgactatcataaaatcaaa

SEQ ID NO: 5158936 - DNA, 18 bp, Homo sapiens
actgactattcttgatgt

SEQ ID NO: 5158937 - DNA, 15 bp, Homo sapiens
actgactctgttatt

SEQ ID NO: 5158938 - DNA, 13 bp, Homo sapiens
actgactcttaag

SEQ ID NO: 5158939 - DNA, 16 bp, Homo sapiens
actgactcttaagaag

SEQ ID NO: 5158940 - DNA, 17 bp, Homo sapiens
actgactgaactagagc

SEQ ID NO: 5158941 - DNA, 23 bp, Homo sapiens
actgactgaaggaaaagcaagaa

SEQ ID NO: 5158942 - DNA, 23 bp, Homo sapiens
actgactgagacacgatgccgag

SEQ ID NO: 5158943 - DNA, 13 bp, Homo sapiens
actgactgagata

SEQ ID NO: 5158944 - DNA, 16 bp, Homo sapiens
actgactggaggaggc

SEQ ID NO: 5158945 - DNA, 20 bp, Homo sapiens
actgactggaggaggcctgt

SEQ ID NO: 5158946 - DNA, 21 bp, Homo sapiens
actgactggattcattctcat

SEQ ID NO: 5158947 - DNA, 17 bp, Homo sapiens
actgactggcaccaaca

SEQ ID NO: 5158948 - DNA, 18 bp, Homo sapiens
actgactggcaccaacac

SEQ ID NO: 5158949 - DNA, 21 bp, Homo sapiens
actgactggcaccaacacttt

SEQ ID NO: 5158950 - DNA, 18 bp, Homo sapiens
actgacttcatttgtgcc

SEQ ID NO: 5158951 - DNA, 13 bp, Homo sapiens
actgacttctaag

SEQ ID NO: 5158952 - DNA, 15 bp, Homo sapiens
actgacttctaagta

SEQ ID NO: 5158953 - DNA, 22 bp, Homo sapiens
actgacttggatcccaaagcaa

SEQ ID NO: 5158954 - DNA, 23 bp, Homo sapiens
actgacttggatcccaaagcaag

SEQ ID NO: 5158955 - DNA, 14 bp, Homo sapiens
actgactttatcct

SEQ ID NO: 5158956 - DNA, 15 bp, Homo sapiens
actgactttatcctc

SEQ ID NO: 5158957 - DNA, 17 bp, Homo sapiens
actgactttttcccccc

SEQ ID NO: 5158958 - DNA, 18 bp, Homo sapiens
actgactttttcccccca

SEQ ID NO: 5158959 - DNA, 12 bp, Homo sapiens
actgagaaagag

SEQ ID NO: 5158960 - DNA, 12 bp, Homo sapiens
actgagaaattt

SEQ ID NO: 5158961 - DNA, 21 bp, Homo sapiens
actgagaagatggcactgtcc

SEQ ID NO: 5158962 - DNA, 18 bp, Homo sapiens
actgagaagccaagcctg

SEQ ID NO: 5158963 - DNA, 18 bp, Homo sapiens
actgagaatctaggccac

SEQ ID NO: 5158964 - DNA, 20 bp, Homo sapiens
actgagaatgtaagaactac

SEQ ID NO: 5158965 - DNA, 20 bp, Homo sapiens
actgagacacgatgccgaga

SEQ ID NO: 5158966 - DNA, 23 bp, Homo sapiens
actgagacagcccgggctctgcc

SEQ ID NO: 5158967 - DNA, 16 bp, Homo sapiens
actgagacaggcagtt

SEQ ID NO: 5158968 - DNA, 13 bp, Homo sapiens
actgagacagggt

SEQ ID NO: 5158969 - DNA, 23 bp, Homo sapiens
actgagaccaaggctttctctac

SEQ ID NO: 5158970 - DNA, 14 bp, Homo sapiens
actgagacggcaga

SEQ ID NO: 5158971 - DNA, 17 bp, Homo sapiens
actgagacggcagagac

SEQ ID NO: 5158972 - DNA, 16 bp, Homo sapiens
actgagacttgttctt

SEQ ID NO: 5158973 - DNA, 19 bp, Homo sapiens
actgagacttgttcttggt

SEQ ID NO: 5158974 - DNA, 20 bp, Homo sapiens
actgagacttgttcttggtt

SEQ ID NO: 5158975 - DNA, 12 bp, Homo sapiens
actgagagaagg

SEQ ID NO: 5158976 - DNA, 16 bp, Homo sapiens
actgagagagcgcagc

SEQ ID NO: 5158977 - DNA, 18 bp, Homo sapiens
actgagagctgcctcctg

SEQ ID NO: 5158978 - DNA, 14 bp, Homo sapiens
actgagagctgctc

SEQ ID NO: 5158979 - DNA, 19 bp, Homo sapiens
actgagagctgctcctttg

SEQ ID NO: 5158980 - DNA, 17 bp, Homo sapiens
actgagaggaggggtaa

SEQ ID NO: 5158981 - DNA, 12 bp, Homo sapiens
actgagaggcct

SEQ ID NO: 5158982 - DNA, 23 bp, Homo sapiens
actgagagtaattcatctgtgaa

SEQ ID NO: 5158983 - DNA, 16 bp, Homo sapiens
actgagataagaaaag

SEQ ID NO: 5158984 - DNA, 17 bp, Homo sapiens
actgagataagaaaagc

SEQ ID NO: 5158985 - DNA, 20 bp, Homo sapiens
actgagataagaaaagcctg

SEQ ID NO: 5158986 - DNA, 19 bp, Homo sapiens
actgagatattattttaaa

SEQ ID NO: 5158987 - DNA, 22 bp, Homo sapiens
actgagatattattttaaattt

SEQ ID NO: 5158988 - DNA, 13 bp, Homo sapiens
actgagatccaga

SEQ ID NO: 5158989 - DNA, 20 bp, Homo sapiens
actgagatccagagaggctg

SEQ ID NO: 5158990 - DNA, 17 bp, Homo sapiens
actgagatgcaaatgtc

SEQ ID NO: 5158991 - DNA, 11 bp, Homo sapiens
actgagatgct

SEQ ID NO: 5158992 - DNA, 17 bp, Homo sapiens
actgagatgtgaacaca

SEQ ID NO: 5158993 - DNA, 21 bp, Homo sapiens
actgagatgttaaaatagtca

SEQ ID NO: 5158994 - DNA, 23 bp, Homo sapiens
actgagattgtctgttcagtttc

SEQ ID NO: 5158995 - DNA, 17 bp, Homo sapiens
actgagatttcttaaat

SEQ ID NO: 5158996 - DNA, 19 bp, Homo sapiens
actgagatttcttaaatct

SEQ ID NO: 5158997 - DNA, 19 bp, Homo sapiens
actgagatttgtaaatctt

SEQ ID NO: 5158998 - DNA, 20 bp, Homo sapiens
actgagatttgtaaatcttt

SEQ ID NO: 5158999 - DNA, 23 bp, Homo sapiens
actgagcaatggtaactgcacct

SEQ ID NO: 5159000 - DNA, 15 bp, Homo sapiens
actgagcacagtcag

SEQ ID NO: 5159001 - DNA, 14 bp, Homo sapiens
actgagcaccttac

SEQ ID NO: 5159002 - DNA, 16 bp, Homo sapiens
actgagcactgaacca

SEQ ID NO: 5159003 - DNA, 13 bp, Homo sapiens
actgagcactgtt

SEQ ID NO: 5159004 - DNA, 17 bp, Homo sapiens
actgagcactgttttct

SEQ ID NO: 5159005 - DNA, 23 bp, Homo sapiens
actgagcactgttttctagtgta

SEQ ID NO: 5159006 - DNA, 18 bp, Homo sapiens
actgagcagccgccagct

SEQ ID NO: 5159007 - DNA, 16 bp, Homo sapiens
actgagcagtgatatt

SEQ ID NO: 5159008 - DNA, 12 bp, Homo sapiens
actgagcatcac

SEQ ID NO: 5159009 - DNA, 21 bp, Homo sapiens
actgagcatcactagtgacaa

SEQ ID NO: 5159010 - DNA, 15 bp, Homo sapiens
actgagcatttgcac

SEQ ID NO: 5159011 - DNA, 20 bp, Homo sapiens
actgagccaaacacactgta

SEQ ID NO: 5159012 - DNA, 24 bp, Homo sapiens
actgagccaaacacactgtaaata

SEQ ID NO: 5159013 - DNA, 16 bp, Homo sapiens
actgagccaaggaggc

SEQ ID NO: 5159014 - DNA, 19 bp, Homo sapiens
actgagccaaggaggcctg

SEQ ID NO: 5159015 - DNA, 22 bp, Homo sapiens
actgagccagattggccaatta

SEQ ID NO: 5159016 - DNA, 21 bp, Homo sapiens
actgagccagcttagcaactg

SEQ ID NO: 5159017 - DNA, 15 bp, Homo sapiens
actgagccagtcttt

SEQ ID NO: 5159018 - DNA, 14 bp, Homo sapiens
actgagccatcatt

SEQ ID NO: 5159019 - DNA, 13 bp, Homo sapiens
actgagccccacc

SEQ ID NO: 5159020 - DNA, 12 bp, Homo sapiens
actgagccctct

SEQ ID NO: 5159021 - DNA, 16 bp, Homo sapiens
actgagccctctcact

SEQ ID NO: 5159022 - DNA, 20 bp, Homo sapiens
actgagccctctcactccag

SEQ ID NO: 5159023 - DNA, 21 bp, Homo sapiens
actgagccctctcactccagc

SEQ ID NO: 5159024 - DNA, 22 bp, Homo sapiens
actgagccctctcactccagcc

SEQ ID NO: 5159025 - DNA, 12 bp, Homo sapiens
actgagcccttg

SEQ ID NO: 5159026 - DNA, 14 bp, Homo sapiens
actgagcccttgca

SEQ ID NO: 5159027 - DNA, 21 bp, Homo sapiens
actgagcccttgcacaggcca

SEQ ID NO: 5159028 - DNA, 22 bp, Homo sapiens
actgagcccttgcacaggccac

SEQ ID NO: 5159029 - DNA, 17 bp, Homo sapiens
actgagcctagctacct

SEQ ID NO: 5159030 - DNA, 13 bp, Homo sapiens
actgagcctgttc

SEQ ID NO: 5159031 - DNA, 14 bp, Homo sapiens
actgagcctgttca

SEQ ID NO: 5159032 - DNA, 14 bp, Homo sapiens
actgagccttgtaa

SEQ ID NO: 5159033 - DNA, 14 bp, Homo sapiens
actgagcgaggaaa

SEQ ID NO: 5159034 - DNA, 21 bp, Homo sapiens
actgagcgaggaaaaacaaca

SEQ ID NO: 5159035 - DNA, 15 bp, Homo sapiens
actgagcgcaagcca

SEQ ID NO: 5159036 - DNA, 19 bp, Homo sapiens
actgagcgcaagccacagc

SEQ ID NO: 5159037 - DNA, 21 bp, Homo sapiens
actgagcgcaagccacagcct

SEQ ID NO: 5159038 - DNA, 19 bp, Homo sapiens
actgagcggccgcagagac

SEQ ID NO: 5159039 - DNA, 16 bp, Homo sapiens
actgagctccatgtgc

SEQ ID NO: 5159040 - DNA, 23 bp, Homo sapiens
actgagctccatgtgccccctct

SEQ ID NO: 5159041 - DNA, 13 bp, Homo sapiens
actgagctcccca

SEQ ID NO: 5159042 - DNA, 18 bp, Homo sapiens
actgagctccccagatct

SEQ ID NO: 5159043 - DNA, 20 bp, Homo sapiens
actgagctccccagatctcc

SEQ ID NO: 5159044 - DNA, 21 bp, Homo sapiens
actgagctcctctgggcagga

SEQ ID NO: 5159045 - DNA, 18 bp, Homo sapiens
actgagctcgcagccccc

SEQ ID NO: 5159046 - DNA, 14 bp, Homo sapiens
actgagctctccag

SEQ ID NO: 5159047 - DNA, 15 bp, Homo sapiens
actgagctctgcctc

SEQ ID NO: 5159048 - DNA, 16 bp, Homo sapiens
actgagctctgcctca

SEQ ID NO: 5159049 - DNA, 12 bp, Homo sapiens
actgagctggct

SEQ ID NO: 5159050 - DNA, 15 bp, Homo sapiens
actgagcttctgaga

SEQ ID NO: 5159051 - DNA, 13 bp, Homo sapiens
actgagcttggaa

SEQ ID NO: 5159052 - DNA, 17 bp, Homo sapiens
actgaggaagggagaca

SEQ ID NO: 5159053 - DNA, 15 bp, Homo sapiens
actgaggagacagaa

SEQ ID NO: 5159054 - DNA, 20 bp, Homo sapiens
actgaggaggaggctgcaca

SEQ ID NO: 5159055 - DNA, 21 bp, Homo sapiens
actgaggagtagctgagagga

SEQ ID NO: 5159056 - DNA, 15 bp, Homo sapiens
actgaggatattcag

SEQ ID NO: 5159057 - DNA, 23 bp, Homo sapiens
actgaggatgacccggggcagct

SEQ ID NO: 5159058 - DNA, 15 bp, Homo sapiens
actgaggcagacagc

SEQ ID NO: 5159059 - DNA, 19 bp, Homo sapiens
actgaggcagacagcagct

SEQ ID NO: 5159060 - DNA, 23 bp, Homo sapiens
actgaggcagacagcagctcagg

SEQ ID NO: 5159061 - DNA, 14 bp, Homo sapiens
actgaggcagggaa

SEQ ID NO: 5159062 - DNA, 14 bp, Homo sapiens
actgaggcagggga

SEQ ID NO: 5159063 - DNA, 18 bp, Homo sapiens
actgaggcagtttgagga

SEQ ID NO: 5159064 - DNA, 21 bp, Homo sapiens
actgaggcatccgtgaggcag

SEQ ID NO: 5159065 - DNA, 10 bp, Homo sapiens
actgaggcca

SEQ ID NO: 5159066 - DNA, 23 bp, Homo sapiens
actgaggcccaaagcacttgctt

SEQ ID NO: 5159067 - DNA, 23 bp, Homo sapiens
actgaggcccacggtttcagcta

SEQ ID NO: 5159068 - DNA, 11 bp, Homo sapiens
actgaggccct

SEQ ID NO: 5159069 - DNA, 13 bp, Homo sapiens
actgaggcctgag

SEQ ID NO: 5159070 - DNA, 19 bp, Homo sapiens
actgaggcctgagacccag

SEQ ID NO: 5159071 - DNA, 21 bp, Homo sapiens
actgaggcctgagacccagga

SEQ ID NO: 5159072 - DNA, 13 bp, Homo sapiens
actgaggcttaga

SEQ ID NO: 5159073 - DNA, 20 bp, Homo sapiens
actgagggaccaactgggcc

SEQ ID NO: 5159074 - DNA, 22 bp, Homo sapiens
actgagggactctgaagcctct

SEQ ID NO: 5159075 - DNA, 13 bp, Homo sapiens
actgagggagaga

SEQ ID NO: 5159076 - DNA, 16 bp, Homo sapiens
actgagggcagtgccc

SEQ ID NO: 5159077 - DNA, 12 bp, Homo sapiens
actgagggccac

SEQ ID NO: 5159078 - DNA, 19 bp, Homo sapiens
actgagggccagggaccca

SEQ ID NO: 5159079 - DNA, 17 bp, Homo sapiens
actgagggctctgtttg

SEQ ID NO: 5159080 - DNA, 19 bp, Homo sapiens
actgagggctctgtttgtg

SEQ ID NO: 5159081 - DNA, 18 bp, Homo sapiens
actgaggggattctctac

SEQ ID NO: 5159082 - DNA, 21 bp, Homo sapiens
actgagggggagctgtcttgt

SEQ ID NO: 5159083 - DNA, 20 bp, Homo sapiens
actgaggggggatccagttt

SEQ ID NO: 5159084 - DNA, 19 bp, Homo sapiens
actgaggtatggccatgcc

SEQ ID NO: 5159085 - DNA, 14 bp, Homo sapiens
actgaggtgcctgc

SEQ ID NO: 5159086 - DNA, 18 bp, Homo sapiens
actgaggtttacatacgt

SEQ ID NO: 5159087 - DNA, 15 bp, Homo sapiens
actgagtaaagtgtt

SEQ ID NO: 5159088 - DNA, 17 bp, Homo sapiens
actatctcacttccaga

SEQ ID NO: 5159089 - DNA, 23 bp, Homo sapiens
actatctcatgccagtgccttat

SEQ ID NO: 5159090 - DNA, 23 bp, Homo sapiens
actatctctagagtgagaatctg

SEQ ID NO: 5159091 - DNA, 23 bp, Homo sapiens
actatctcttgtcatataaacct

SEQ ID NO: 5159092 - DNA, 19 bp, Homo sapiens
actatctgaaaatacattt

SEQ ID NO: 5159093 - DNA, 19 bp, Homo sapiens
actatctgaagatttccat

SEQ ID NO: 5159094 - DNA, 20 bp, Homo sapiens
actatctgaagatttccatt

SEQ ID NO: 5159095 - DNA, 21 bp, Homo sapiens
actatctgttcccctgtcctg

SEQ ID NO: 5159096 - DNA, 22 bp, Homo sapiens
actatcttatctcagatatttg

SEQ ID NO: 5159097 - DNA, 14 bp, Homo sapiens
actatcttcacaag

SEQ ID NO: 5159098 - DNA, 20 bp, Homo sapiens
actatcttcacaagtgtgta

SEQ ID NO: 5159099 - DNA, 18 bp, Homo sapiens
actatcttctctatattt

SEQ ID NO: 5159100 - DNA, 16 bp, Homo sapiens
actatcttcttcaaat

SEQ ID NO: 5159101 - DNA, 17 bp, Homo sapiens
actatcttcttcaaata

SEQ ID NO: 5159102 - DNA, 20 bp, Homo sapiens
actatcttcttcaaatacaa

SEQ ID NO: 5159103 - DNA, 22 bp, Homo sapiens
actatcttctttggacttctga

SEQ ID NO: 5159104 - DNA, 11 bp, Homo sapiens
actatcttgtg

SEQ ID NO: 5159105 - DNA, 13 bp, Homo sapiens
actatctttctga

SEQ ID NO: 5159106 - DNA, 15 bp, Homo sapiens
actatctttctgata

SEQ ID NO: 5159107 - DNA, 14 bp, Homo sapiens
actatcttttcatt

SEQ ID NO: 5159108 - DNA, 16 bp, Homo sapiens
actatgaaaagctaga

SEQ ID NO: 5159109 - DNA, 21 bp, Homo sapiens
actatgaaaagctagaattga

SEQ ID NO: 5159110 - DNA, 16 bp, Homo sapiens
actatgaaacgaatat

SEQ ID NO: 5159111 - DNA, 17 bp, Homo sapiens
actatgacaatttttgc

SEQ ID NO: 5159112 - DNA, 12 bp, Homo sapiens
actatgacactg

SEQ ID NO: 5159113 - DNA, 15 bp, Homo sapiens
actatgacccattta

SEQ ID NO: 5159114 - DNA, 21 bp, Homo sapiens
actatgaccttccaagtttga

SEQ ID NO: 5159115 - DNA, 15 bp, Homo sapiens
actatgactgctccc

SEQ ID NO: 5159116 - DNA, 15 bp, Homo sapiens
actatgataaagttg

SEQ ID NO: 5159117 - DNA, 14 bp, Homo sapiens
actatgatcacagt

SEQ ID NO: 5159118 - DNA, 17 bp, Homo sapiens
actatgatcacagtgac

SEQ ID NO: 5159119 - DNA, 16 bp, Homo sapiens
actatgatctcaggag

SEQ ID NO: 5159120 - DNA, 19 bp, Homo sapiens
actatgatgagaggccagc

SEQ ID NO: 5159121 - DNA, 15 bp, Homo sapiens
actatgatgggcttc

SEQ ID NO: 5159122 - DNA, 19 bp, Homo sapiens
actatgatgggcttctgtt

SEQ ID NO: 5159123 - DNA, 19 bp, Homo sapiens
actatgatttaatttgaaa

SEQ ID NO: 5159124 - DNA, 16 bp, Homo sapiens
actatgatttggaaaa

SEQ ID NO: 5159125 - DNA, 14 bp, Homo sapiens
actatgcaaagaac

SEQ ID NO: 5159126 - DNA, 17 bp, Homo sapiens
actatgcacaacagagt

SEQ ID NO: 5159127 - DNA, 14 bp, Homo sapiens
actatgcacagagc

SEQ ID NO: 5159128 - DNA, 20 bp, Homo sapiens
actatgcatggtgccccagg

SEQ ID NO: 5159129 - DNA, 14 bp, Homo sapiens
actatgccacagat

SEQ ID NO: 5159130 - DNA, 23 bp, Homo sapiens
actatgcccctagtaactgctgt

SEQ ID NO: 5159131 - DNA, 23 bp, Homo sapiens
actatgccgtgtagtttctggta

SEQ ID NO: 5159132 - DNA, 12 bp, Homo sapiens
actatgcctgtg

SEQ ID NO: 5159133 - DNA, 18 bp, Homo sapiens
actatgcctgtgtcttct

SEQ ID NO: 5159134 - DNA, 15 bp, Homo sapiens
actatgcctgttgat

SEQ ID NO: 5159135 - DNA, 15 bp, Homo sapiens
actatgctatttctg

SEQ ID NO: 5159136 - DNA, 22 bp, Homo sapiens
actatgctatttctggcctcag

SEQ ID NO: 5159137 - DNA, 23 bp, Homo sapiens
actatgctatttctggcctcagc

SEQ ID NO: 5159138 - DNA, 14 bp, Homo sapiens
actatgctgaagag

SEQ ID NO: 5159139 - DNA, 15 bp, Homo sapiens
actatgctttccttc

SEQ ID NO: 5159140 - DNA, 19 bp, Homo sapiens
actatggaagccacatcac

SEQ ID NO: 5159141 - DNA, 20 bp, Homo sapiens
actatggagtgcaccaaaga

SEQ ID NO: 5159142 - DNA, 23 bp, Homo sapiens
actatggagtgcaccaaagagaa

SEQ ID NO: 5159143 - DNA, 21 bp, Homo sapiens
actatggataaactaaacacg

SEQ ID NO: 5159144 - DNA, 15 bp, Homo sapiens
actatggctccaaca

SEQ ID NO: 5159145 - DNA, 15 bp, Homo sapiens
actatggctgttgag

SEQ ID NO: 5159146 - DNA, 18 bp, Homo sapiens
actatgggaagctctgtg

SEQ ID NO: 5159147 - DNA, 19 bp, Homo sapiens
actatgggaagctctgtgt

SEQ ID NO: 5159148 - DNA, 16 bp, Homo sapiens
actatgggatgagaaa

SEQ ID NO: 5159149 - DNA, 14 bp, Homo sapiens
actatgggtgagca

SEQ ID NO: 5159150 - DNA, 20 bp, Homo sapiens
actatggtaaataactgtga

SEQ ID NO: 5159151 - DNA, 16 bp, Homo sapiens
actatggtaacacttt

SEQ ID NO: 5159152 - DNA, 18 bp, Homo sapiens
actatggtatatattttg

SEQ ID NO: 5159153 - DNA, 18 bp, Homo sapiens
actatggtcctgcagaaa

SEQ ID NO: 5159154 - DNA, 10 bp, Homo sapiens
actatggtgt

SEQ ID NO: 5159155 - DNA, 19 bp, Homo sapiens
actatggtgtgttgtatct

SEQ ID NO: 5159156 - DNA, 21 bp, Homo sapiens
actatggttcccaataaaagt

SEQ ID NO: 5159157 - DNA, 18 bp, Homo sapiens
actatgtaaaaataacct

SEQ ID NO: 5159158 - DNA, 13 bp, Homo sapiens
actatgtaaacaa

SEQ ID NO: 5159159 - DNA, 17 bp, Homo sapiens
actatgtaatgcttatg

SEQ ID NO: 5159160 - DNA, 14 bp, Homo sapiens
actatgtaatttat

SEQ ID NO: 5159161 - DNA, 16 bp, Homo sapiens
actatgtacaatattt

SEQ ID NO: 5159162 - DNA, 22 bp, Homo sapiens
actatgtacaatattttaagca

SEQ ID NO: 5159163 - DNA, 13 bp, Homo sapiens
actatgtattttt

SEQ ID NO: 5159164 - DNA, 19 bp, Homo sapiens
actatgtccatgaaaaaca

SEQ ID NO: 5159165 - DNA, 19 bp, Homo sapiens
actatgtctagagcctctt

SEQ ID NO: 5159166 - DNA, 16 bp, Homo sapiens
actatgtctgaacata

SEQ ID NO: 5159167 - DNA, 23 bp, Homo sapiens
actatgtctgaacatagaaactc

SEQ ID NO: 5159168 - DNA, 16 bp, Homo sapiens
actatgtgatgttaac

SEQ ID NO: 5159169 - DNA, 18 bp, Homo sapiens
actatgtgccagttcctg

SEQ ID NO: 5159170 - DNA, 20 bp, Homo sapiens
actatgtgctatcacatgtg

SEQ ID NO: 5159171 - DNA, 11 bp, Homo sapiens
actatgtgctg

SEQ ID NO: 5159172 - DNA, 22 bp, Homo sapiens
actatgtggctgaaaatgcaaa

SEQ ID NO: 5159173 - DNA, 15 bp, Homo sapiens
actatgtgtcatgat

SEQ ID NO: 5159174 - DNA, 16 bp, Homo sapiens
actatgtgtcatgatt

SEQ ID NO: 5159175 - DNA, 12 bp, Homo sapiens
actatgtgtgtt

SEQ ID NO: 5159176 - DNA, 22 bp, Homo sapiens
actatgttcatgatagtgtgat

SEQ ID NO: 5159177 - DNA, 23 bp, Homo sapiens
actatgttcatgatagtgtgatt

SEQ ID NO: 5159178 - DNA, 21 bp, Homo sapiens
actatgttcctaacaaaatga

SEQ ID NO: 5159179 - DNA, 17 bp, Homo sapiens
actatgttgcccaggca

SEQ ID NO: 5159180 - DNA, 18 bp, Homo sapiens
actatgttgcccaggcag

SEQ ID NO: 5159181 - DNA, 18 bp, Homo sapiens
actatgttgcccaggctg

SEQ ID NO: 5159182 - DNA, 13 bp, Homo sapiens
actatgtttctca

SEQ ID NO: 5159183 - DNA, 22 bp, Homo sapiens
actattaaaaaggtttacagaa

SEQ ID NO: 5159184 - DNA, 15 bp, Homo sapiens
actattaaaatattt

SEQ ID NO: 5159185 - DNA, 18 bp, Homo sapiens
actattaaaatattttgg

SEQ ID NO: 5159186 - DNA, 15 bp, Homo sapiens
actattaaagtgcca

SEQ ID NO: 5159187 - DNA, 12 bp, Homo sapiens
actattaacatg

SEQ ID NO: 5159188 - DNA, 17 bp, Homo sapiens
actattaacatgatgta

SEQ ID NO: 5159189 - DNA, 19 bp, Homo sapiens
actattaacatgatgtact

SEQ ID NO: 5159190 - DNA, 19 bp, Homo sapiens
actattaaggatgtagctt

SEQ ID NO: 5159191 - DNA, 14 bp, Homo sapiens
actattacactgcc

SEQ ID NO: 5159192 - DNA, 14 bp, Homo sapiens
actattacagtgtt

SEQ ID NO: 5159193 - DNA, 15 bp, Homo sapiens
actattacagtgttg

SEQ ID NO: 5159194 - DNA, 19 bp, Homo sapiens
actattactattactattt

SEQ ID NO: 5159195 - DNA, 21 bp, Homo sapiens
actattagagtatttcccttc

SEQ ID NO: 5159196 - DNA, 22 bp, Homo sapiens
actattagagtatttcccttcc

SEQ ID NO: 5159197 - DNA, 22 bp, Homo sapiens
actattaggtgcaatttcaagg

SEQ ID NO: 5159198 - DNA, 19 bp, Homo sapiens
actattagtattattaaca

SEQ ID NO: 5159199 - DNA, 17 bp, Homo sapiens
actattataatttaatg

SEQ ID NO: 5159200 - DNA, 18 bp, Homo sapiens
actattatagaaattctg

SEQ ID NO: 5159201 - DNA, 17 bp, Homo sapiens
actattatctaaaagaa

SEQ ID NO: 5159202 - DNA, 19 bp, Homo sapiens
actattatgtggaataata

SEQ ID NO: 5159203 - DNA, 11 bp, Homo sapiens
actattattat

SEQ ID NO: 5159204 - DNA, 20 bp, Homo sapiens
actattattataggtaatca

SEQ ID NO: 5159205 - DNA, 12 bp, Homo sapiens
actattattgtt

SEQ ID NO: 5159206 - DNA, 15 bp, Homo sapiens
actattatttcctat

SEQ ID NO: 5159207 - DNA, 20 bp, Homo sapiens
actattcagaagacacagag

SEQ ID NO: 5159208 - DNA, 12 bp, Homo sapiens
actattcatcaa

SEQ ID NO: 5159209 - DNA, 14 bp, Homo sapiens
actattcatggcta

SEQ ID NO: 5159210 - DNA, 22 bp, Homo sapiens
actattccattgaccttaattt

SEQ ID NO: 5159211 - DNA, 14 bp, Homo sapiens
actattccctttga

SEQ ID NO: 5159212 - DNA, 16 bp, Homo sapiens
actattccctttgact

SEQ ID NO: 5159213 - DNA, 20 bp, Homo sapiens
actattccctttgacttcag

SEQ ID NO: 5159214 - DNA, 14 bp, Homo sapiens
actattcctaggag

SEQ ID NO: 5159215 - DNA, 19 bp, Homo sapiens
actattctgagatgactat

SEQ ID NO: 5159216 - DNA, 22 bp, Homo sapiens
actattctgattacacaaaaca

SEQ ID NO: 5159217 - DNA, 23 bp, Homo sapiens
actattctgggggcccgacaggt

SEQ ID NO: 5159218 - DNA, 17 bp, Homo sapiens
actattctgttaaaatc

SEQ ID NO: 5159219 - DNA, 19 bp, Homo sapiens
actattcttaagcactttg

SEQ ID NO: 5159220 - DNA, 15 bp, Homo sapiens
actattcttaatagg

SEQ ID NO: 5159221 - DNA, 13 bp, Homo sapiens
actattcttcatt

SEQ ID NO: 5159222 - DNA, 20 bp, Homo sapiens
actattcttgatgtaaaatc

SEQ ID NO: 5159223 - DNA, 22 bp, Homo sapiens
actattcttgatgtaaaatctt

SEQ ID NO: 5159224 - DNA, 23 bp, Homo sapiens
actattcttgatgtaaaatcttg

SEQ ID NO: 5159225 - DNA, 18 bp, Homo sapiens
actattgaagttgcagat

SEQ ID NO: 5159226 - DNA, 17 bp, Homo sapiens
actattgacatcagcat

SEQ ID NO: 5159227 - DNA, 13 bp, Homo sapiens
actattgagaaga

SEQ ID NO: 5159228 - DNA, 14 bp, Homo sapiens
actattgagaagat

SEQ ID NO: 5159229 - DNA, 19 bp, Homo sapiens
actattgcaagtcatactt

SEQ ID NO: 5159230 - DNA, 20 bp, Homo sapiens
actattgcagacctgtcacc

SEQ ID NO: 5159231 - DNA, 22 bp, Homo sapiens
actattgcagacctgtcaccct

SEQ ID NO: 5159232 - DNA, 14 bp, Homo sapiens
actattgcattgtt

SEQ ID NO: 5159233 - DNA, 15 bp, Homo sapiens
actattgcatttata

SEQ ID NO: 5159234 - DNA, 15 bp, Homo sapiens
actattgcattttac

SEQ ID NO: 5159235 - DNA, 13 bp, Homo sapiens
actattgcccagg

SEQ ID NO: 5159236 - DNA, 15 bp, Homo sapiens
actattgctcataat

SEQ ID NO: 5159237 - DNA, 14 bp, Homo sapiens
actattggaaagta

SEQ ID NO: 5159238 - DNA, 13 bp, Homo sapiens
actattggagggt

SEQ ID NO: 5159239 - DNA, 15 bp, Homo sapiens
actattgggtgaata

SEQ ID NO: 5159240 - DNA, 13 bp, Homo sapiens
actattgtaatgc

SEQ ID NO: 5159241 - DNA, 15 bp, Homo sapiens
actattgtaatgcca

SEQ ID NO: 5159242 - DNA, 23 bp, Homo sapiens
actattgtgctcagagacactgt

SEQ ID NO: 5159243 - DNA, 13 bp, Homo sapiens
actattgtttaaa

SEQ ID NO: 5159244 - DNA, 16 bp, Homo sapiens
actattgtttaaaaac

SEQ ID NO: 5159245 - DNA, 19 bp, Homo sapiens
actattgtttatttttaat

SEQ ID NO: 5159246 - DNA, 11 bp, Homo sapiens
actatttaaaa

SEQ ID NO: 5159247 - DNA, 13 bp, Homo sapiens
actatttaaaata

SEQ ID NO: 5159248 - DNA, 15 bp, Homo sapiens
actatttaaaattgg

SEQ ID NO: 5159249 - DNA, 16 bp, Homo sapiens
actatttaaaattggc

SEQ ID NO: 5159250 - DNA, 13 bp, Homo sapiens
actatttaaactt

SEQ ID NO: 5159251 - DNA, 16 bp, Homo sapiens
actatttaaacttata

SEQ ID NO: 5159252 - DNA, 19 bp, Homo sapiens
actatttaaatccttggct

SEQ ID NO: 5159253 - DNA, 13 bp, Homo sapiens
actatttaactga

SEQ ID NO: 5159254 - DNA, 17 bp, Homo sapiens
actatttaactgactat

SEQ ID NO: 5159255 - DNA, 14 bp, Homo sapiens
actatttaagatgt

SEQ ID NO: 5159256 - DNA, 22 bp, Homo sapiens
actatttaagtaaatacagtag

SEQ ID NO: 5159257 - DNA, 20 bp, Homo sapiens
actatttaagtactatcttt

SEQ ID NO: 5159258 - DNA, 17 bp, Homo sapiens
actatttactttattaa

SEQ ID NO: 5159259 - DNA, 19 bp, Homo sapiens
actatttagataacaagaa

SEQ ID NO: 5159260 - DNA, 16 bp, Homo sapiens
actatttatttacaaa

SEQ ID NO: 5159261 - DNA, 13 bp, Homo sapiens
actatttcaaaat

SEQ ID NO: 5159262 - DNA, 17 bp, Homo sapiens
actatttcaataagtgt

SEQ ID NO: 5159263 - DNA, 16 bp, Homo sapiens
actatttcagaatatt

SEQ ID NO: 5159264 - DNA, 13 bp, Homo sapiens
actatttcagtga

SEQ ID NO: 5159265 - DNA, 13 bp, Homo sapiens
actatttccttta

SEQ ID NO: 5159266 - DNA, 14 bp, Homo sapiens
actatttcggcctt

SEQ ID NO: 5159267 - DNA, 16 bp, Homo sapiens
actatttctgttccag

SEQ ID NO: 5159268 - DNA, 18 bp, Homo sapiens
actgagtaaattggaaac

SEQ ID NO: 5159269 - DNA, 14 bp, Homo sapiens
actgagtacaaatg

SEQ ID NO: 5159270 - DNA, 16 bp, Homo sapiens
actgagtacaaatgtg

SEQ ID NO: 5159271 - DNA, 18 bp, Homo sapiens
actgagtacgttgtgcat

SEQ ID NO: 5159272 - DNA, 17 bp, Homo sapiens
actgagtagcagaaaac

SEQ ID NO: 5159273 - DNA, 14 bp, Homo sapiens
actgagtataatca

SEQ ID NO: 5159274 - DNA, 20 bp, Homo sapiens
actgagtccatgaaaatacc

SEQ ID NO: 5159275 - DNA, 20 bp, Homo sapiens
actgagtccctggcaagact

SEQ ID NO: 5159276 - DNA, 20 bp, Homo sapiens
actgagtctgtggacactgt

SEQ ID NO: 5159277 - DNA, 19 bp, Homo sapiens
actgagtcttaacttttca

SEQ ID NO: 5159278 - DNA, 13 bp, Homo sapiens
actgagtgaaata

SEQ ID NO: 5159279 - DNA, 14 bp, Homo sapiens
actgagtgaaatat

SEQ ID NO: 5159280 - DNA, 17 bp, Homo sapiens
actgagtgaaatattac

SEQ ID NO: 5159281 - DNA, 14 bp, Homo sapiens
actgagtgaaggaa

SEQ ID NO: 5159282 - DNA, 12 bp, Homo sapiens
actgagtgactc

SEQ ID NO: 5159283 - DNA, 19 bp, Homo sapiens
actgagtgatactttaagt

SEQ ID NO: 5159284 - DNA, 18 bp, Homo sapiens
actgagtgcctactcttt

SEQ ID NO: 5159285 - DNA, 23 bp, Homo sapiens
actgagtgctgaggttgggaagg

SEQ ID NO: 5159286 - DNA, 22 bp, Homo sapiens
actgagtggcttgtgattctgg

SEQ ID NO: 5159287 - DNA, 21 bp, Homo sapiens
actgagtgttcaaactactgt

SEQ ID NO: 5159288 - DNA, 18 bp, Homo sapiens
actgagttatcaggtgca

SEQ ID NO: 5159289 - DNA, 23 bp, Homo sapiens
actgagttgggcaaaacccagga

SEQ ID NO: 5159290 - DNA, 18 bp, Homo sapiens
actgagttttccatggca

SEQ ID NO: 5159291 - DNA, 15 bp, Homo sapiens
actgataaaaatgat

SEQ ID NO: 5159292 - DNA, 18 bp, Homo sapiens
actgataaaaatgatatt

SEQ ID NO: 5159293 - DNA, 21 bp, Homo sapiens
actgataaacctaatattcaa

SEQ ID NO: 5159294 - DNA, 22 bp, Homo sapiens
actgataaacctaatattcaat

SEQ ID NO: 5159295 - DNA, 13 bp, Homo sapiens
actgataaagatg

SEQ ID NO: 5159296 - DNA, 19 bp, Homo sapiens
actgataattttaaaatgt

SEQ ID NO: 5159297 - DNA, 21 bp, Homo sapiens
actgatactacaacttttgtt

SEQ ID NO: 5159298 - DNA, 18 bp, Homo sapiens
actgatactattcaatgc

SEQ ID NO: 5159299 - DNA, 12 bp, Homo sapiens
actgatagacac

SEQ ID NO: 5159300 - DNA, 22 bp, Homo sapiens
actgatatatcatgagtgaata

SEQ ID NO: 5159301 - DNA, 13 bp, Homo sapiens
actgatattcaga

SEQ ID NO: 5159302 - DNA, 16 bp, Homo sapiens
actgatatttatagaa

SEQ ID NO: 5159303 - DNA, 13 bp, Homo sapiens
actgatcaaaaat

SEQ ID NO: 5159304 - DNA, 15 bp, Homo sapiens
actgatcaaaaataa

SEQ ID NO: 5159305 - DNA, 15 bp, Homo sapiens
actgatcacccaatg

SEQ ID NO: 5159306 - DNA, 21 bp, Homo sapiens
actgatcagtgtaaaaaggaa

SEQ ID NO: 5159307 - DNA, 16 bp, Homo sapiens
actgatcatccaggcc

SEQ ID NO: 5159308 - DNA, 15 bp, Homo sapiens
actgatcatgcattg

SEQ ID NO: 5159309 - DNA, 23 bp, Homo sapiens
actgatcatgtttatgagaaact

SEQ ID NO: 5159310 - DNA, 18 bp, Homo sapiens
actgatcattagagaaat

SEQ ID NO: 5159311 - DNA, 13 bp, Homo sapiens
actgatccctggc

SEQ ID NO: 5159312 - DNA, 13 bp, Homo sapiens
actgatcttactc

SEQ ID NO: 5159313 - DNA, 16 bp, Homo sapiens
actgatgaactagtga

SEQ ID NO: 5159314 - DNA, 15 bp, Homo sapiens
actgatgaatgacaa

SEQ ID NO: 5159315 - DNA, 14 bp, Homo sapiens
actgatgagacaac

SEQ ID NO: 5159316 - DNA, 19 bp, Homo sapiens
actgatgagacaacacaca

SEQ ID NO: 5159317 - DNA, 14 bp, Homo sapiens
actgatgagagaat

SEQ ID NO: 5159318 - DNA, 19 bp, Homo sapiens
actgatgagtttcactgta

SEQ ID NO: 5159319 - DNA, 21 bp, Homo sapiens
actgatgagtttcactgtact

SEQ ID NO: 5159320 - DNA, 19 bp, Homo sapiens
actgatgatagacttcgaa

SEQ ID NO: 5159321 - DNA, 15 bp, Homo sapiens
actgatgattttcct

SEQ ID NO: 5159322 - DNA, 16 bp, Homo sapiens
actgatgcaaggatta

SEQ ID NO: 5159323 - DNA, 22 bp, Homo sapiens
actgatgcaaggattacagaaa

SEQ ID NO: 5159324 - DNA, 19 bp, Homo sapiens
actgatgcgaaaacttgaa

SEQ ID NO: 5159325 - DNA, 22 bp, Homo sapiens
actgatgcgaaaacttgaatct

SEQ ID NO: 5159326 - DNA, 22 bp, Homo sapiens
actgatgcgacttgttttgctg

SEQ ID NO: 5159327 - DNA, 11 bp, Homo sapiens
actgatgctgc

SEQ ID NO: 5159328 - DNA, 20 bp, Homo sapiens
actgatgctgcccctcatct

SEQ ID NO: 5159329 - DNA, 20 bp, Homo sapiens
actgatgctgttctcttctt

SEQ ID NO: 5159330 - DNA, 14 bp, Homo sapiens
actgatggaaacaa

SEQ ID NO: 5159331 - DNA, 14 bp, Homo sapiens
actgatggaacaga

SEQ ID NO: 5159332 - DNA, 22 bp, Homo sapiens
actgatggaatttttttgtacg

SEQ ID NO: 5159333 - DNA, 23 bp, Homo sapiens
actgatggaatttttttgtacga

SEQ ID NO: 5159334 - DNA, 22 bp, Homo sapiens
actgatggaccgggtgggcctg

SEQ ID NO: 5159335 - DNA, 22 bp, Homo sapiens
actgatggctcaagacaaggct

SEQ ID NO: 5159336 - DNA, 23 bp, Homo sapiens
actgatgggcaacccccagcctg

SEQ ID NO: 5159337 - DNA, 24 bp, Homo sapiens
actgatgggctggggcaggggcct

SEQ ID NO: 5159338 - DNA, 19 bp, Homo sapiens
actgatggttgctttgagc

SEQ ID NO: 5159339 - DNA, 22 bp, Homo sapiens
actgatggttgctttgagccca

SEQ ID NO: 5159340 - DNA, 23 bp, Homo sapiens
actgatgtatagctttaacattt

SEQ ID NO: 5159341 - DNA, 12 bp, Homo sapiens
actgatgtcatc

SEQ ID NO: 5159342 - DNA, 13 bp, Homo sapiens
actgatgtcatct

SEQ ID NO: 5159343 - DNA, 15 bp, Homo sapiens
actgatgtccctcct

SEQ ID NO: 5159344 - DNA, 13 bp, Homo sapiens
actgatgtgaaac

SEQ ID NO: 5159345 - DNA, 16 bp, Homo sapiens
actgatgttaggctgg

SEQ ID NO: 5159346 - DNA, 18 bp, Homo sapiens
actgatgttaggctgggc

SEQ ID NO: 5159347 - DNA, 18 bp, Homo sapiens
actgatgttgtgttttta

SEQ ID NO: 5159348 - DNA, 17 bp, Homo sapiens
actgatgttttagcatt

SEQ ID NO: 5159349 - DNA, 19 bp, Homo sapiens
actgattaaatatttgaag

SEQ ID NO: 5159350 - DNA, 20 bp, Homo sapiens
actgattaaatatttgaaga

SEQ ID NO: 5159351 - DNA, 14 bp, Homo sapiens
actgattaacaaat

SEQ ID NO: 5159352 - DNA, 15 bp, Homo sapiens
actgattacctgcca

SEQ ID NO: 5159353 - DNA, 17 bp, Homo sapiens
actgattacctgccaat

SEQ ID NO: 5159354 - DNA, 23 bp, Homo sapiens
actgattacttgtaattatgaaa

SEQ ID NO: 5159355 - DNA, 22 bp, Homo sapiens
actgattagtaagtcttgccta

SEQ ID NO: 5159356 - DNA, 18 bp, Homo sapiens
actgattatgtcttttat

SEQ ID NO: 5159357 - DNA, 23 bp, Homo sapiens
actgattattcttcttacattat

SEQ ID NO: 5159358 - DNA, 14 bp, Homo sapiens
actgattcaagaac

SEQ ID NO: 5159359 - DNA, 17 bp, Homo sapiens
actgattcaattataat

SEQ ID NO: 5159360 - DNA, 20 bp, Homo sapiens
actgattcataataaatatc

SEQ ID NO: 5159361 - DNA, 14 bp, Homo sapiens
actgattccagcaa

SEQ ID NO: 5159362 - DNA, 14 bp, Homo sapiens
actgattcctggag

SEQ ID NO: 5159363 - DNA, 18 bp, Homo sapiens
actgattctcctgtcaga

SEQ ID NO: 5159364 - DNA, 12 bp, Homo sapiens
actgattcttca

SEQ ID NO: 5159365 - DNA, 16 bp, Homo sapiens
actgattgctcccagg

SEQ ID NO: 5159366 - DNA, 17 bp, Homo sapiens
actgattgctcccagga

SEQ ID NO: 5159367 - DNA, 18 bp, Homo sapiens
actgattgctcccaggat

SEQ ID NO: 5159368 - DNA, 20 bp, Homo sapiens
actgattgctcccaggatct

SEQ ID NO: 5159369 - DNA, 13 bp, Homo sapiens
actgattgtttca

SEQ ID NO: 5159370 - DNA, 16 bp, Homo sapiens
actgatttaacacttt

SEQ ID NO: 5159371 - DNA, 22 bp, Homo sapiens
actgatttacaagactaacctt

SEQ ID NO: 5159372 - DNA, 13 bp, Homo sapiens
actgatttcacaa

SEQ ID NO: 5159373 - DNA, 17 bp, Homo sapiens
actgatttcacaacaga

SEQ ID NO: 5159374 - DNA, 20 bp, Homo sapiens
actgatttcacaacagatca

SEQ ID NO: 5159375 - DNA, 19 bp, Homo sapiens
actgatttccatccaaacc

SEQ ID NO: 5159376 - DNA, 20 bp, Homo sapiens
actgatttcccattttaaag

SEQ ID NO: 5159377 - DNA, 21 bp, Homo sapiens
actgatttccccttttgcatt

SEQ ID NO: 5159378 - DNA, 14 bp, Homo sapiens
actgatttcctttg

SEQ ID NO: 5159379 - DNA, 17 bp, Homo sapiens
actgatttctatggctt

SEQ ID NO: 5159380 - DNA, 21 bp, Homo sapiens
actgatttctatggctttcaa

SEQ ID NO: 5159381 - DNA, 22 bp, Homo sapiens
actgatttctatggctttcaaa

SEQ ID NO: 5159382 - DNA, 12 bp, Homo sapiens
actgatttcttc

SEQ ID NO: 5159383 - DNA, 14 bp, Homo sapiens
actgatttcttgcg

SEQ ID NO: 5159384 - DNA, 22 bp, Homo sapiens
actgatttgacatagtctggct

SEQ ID NO: 5159385 - DNA, 20 bp, Homo sapiens
actgattttaaaatgaataa

SEQ ID NO: 5159386 - DNA, 13 bp, Homo sapiens
actgattttacaa

SEQ ID NO: 5159387 - DNA, 21 bp, Homo sapiens
actgattttacaaattaatat

SEQ ID NO: 5159388 - DNA, 13 bp, Homo sapiens
actgattttcaaa

SEQ ID NO: 5159389 - DNA, 16 bp, Homo sapiens
actgattttgtatgta

SEQ ID NO: 5159390 - DNA, 23 bp, Homo sapiens
actgattttttagttaaattgat

SEQ ID NO: 5159391 - DNA, 19 bp, Homo sapiens
actgcaaaaaaagcctcca

SEQ ID NO: 5159392 - DNA, 14 bp, Homo sapiens
actgcaaaatgtct

SEQ ID NO: 5159393 - DNA, 14 bp, Homo sapiens
actgcaaacaataa

SEQ ID NO: 5159394 - DNA, 17 bp, Homo sapiens
actgcaaacacaccttg

SEQ ID NO: 5159395 - DNA, 14 bp, Homo sapiens
actgcaaacagaaa

SEQ ID NO: 5159396 - DNA, 23 bp, Homo sapiens
actgcaaacttttttatatcttt

SEQ ID NO: 5159397 - DNA, 17 bp, Homo sapiens
actgcaaagctttggct

SEQ ID NO: 5159398 - DNA, 23 bp, Homo sapiens
actgcaaagctttggctgagacc

SEQ ID NO: 5159399 - DNA, 15 bp, Homo sapiens
actgcaaataaagcc

SEQ ID NO: 5159400 - DNA, 13 bp, Homo sapiens
actgcaaatactt

SEQ ID NO: 5159401 - DNA, 18 bp, Homo sapiens
actgcaaatcaggctttt

SEQ ID NO: 5159402 - DNA, 20 bp, Homo sapiens
actgcaaatcaggcttttgt

SEQ ID NO: 5159403 - DNA, 22 bp, Homo sapiens
actgcaaatcaggcttttgttt

SEQ ID NO: 5159404 - DNA, 21 bp, Homo sapiens
actgcaaatgtcatcagaact

SEQ ID NO: 5159405 - DNA, 22 bp, Homo sapiens
actgcaaatgtcatcagaactt

SEQ ID NO: 5159406 - DNA, 16 bp, Homo sapiens
actgcaaattttaact

SEQ ID NO: 5159407 - DNA, 18 bp, Homo sapiens
actgcaacaacgcctggt

SEQ ID NO: 5159408 - DNA, 12 bp, Homo sapiens
actgcaacactg

SEQ ID NO: 5159409 - DNA, 15 bp, Homo sapiens
actgcaacaggaact

SEQ ID NO: 5159410 - DNA, 16 bp, Homo sapiens
actgcaacccatgagc

SEQ ID NO: 5159411 - DNA, 23 bp, Homo sapiens
actgcaacccatgagcgtccagg

SEQ ID NO: 5159412 - DNA, 18 bp, Homo sapiens
actgcaacctccacctcc

SEQ ID NO: 5159413 - DNA, 19 bp, Homo sapiens
actgcaacctccacctccg

SEQ ID NO: 5159414 - DNA, 22 bp, Homo sapiens
actgcaacctccacctcctgag

SEQ ID NO: 5159415 - DNA, 13 bp, Homo sapiens
actgcaacctccg

SEQ ID NO: 5159416 - DNA, 14 bp, Homo sapiens
actgcaacctccgc

SEQ ID NO: 5159417 - DNA, 15 bp, Homo sapiens
actgcaacctctgcc

SEQ ID NO: 5159418 - DNA, 17 bp, Homo sapiens
actgcaacctctgcctc

SEQ ID NO: 5159419 - DNA, 19 bp, Homo sapiens
actgcaacctctgcctcct

SEQ ID NO: 5159420 - DNA, 15 bp, Homo sapiens
actgcaactccagcg

SEQ ID NO: 5159421 - DNA, 16 bp, Homo sapiens
actgcaactccagcgt

SEQ ID NO: 5159422 - DNA, 20 bp, Homo sapiens
actgcaacttaacttaaaat

SEQ ID NO: 5159423 - DNA, 19 bp, Homo sapiens
actgcaacttctacctccg

SEQ ID NO: 5159424 - DNA, 14 bp, Homo sapiens
actgcaacttgtga

SEQ ID NO: 5159425 - DNA, 17 bp, Homo sapiens
actgcaagacttaaata

SEQ ID NO: 5159426 - DNA, 21 bp, Homo sapiens
actgcaagagatggaaaaaaa

SEQ ID NO: 5159427 - DNA, 15 bp, Homo sapiens
actgcaagagccttg

SEQ ID NO: 5159428 - DNA, 16 bp, Homo sapiens
actgcaagagccttgg

SEQ ID NO: 5159429 - DNA, 18 bp, Homo sapiens
actgcaagagccttggtg

SEQ ID NO: 5159430 - DNA, 17 bp, Homo sapiens
actgcaagaggctcctg

SEQ ID NO: 5159431 - DNA, 15 bp, Homo sapiens
actgcaagctctgcc

SEQ ID NO: 5159432 - DNA, 16 bp, Homo sapiens
actgcaagctctgcct

SEQ ID NO: 5159433 - DNA, 13 bp, Homo sapiens
actgcaagctgct

SEQ ID NO: 5159434 - DNA, 14 bp, Homo sapiens
actgcaagctgctt

SEQ ID NO: 5159435 - DNA, 15 bp, Homo sapiens
actgcaagtcacaaa

SEQ ID NO: 5159436 - DNA, 18 bp, Homo sapiens
actgcaataacttctgac

SEQ ID NO: 5159437 - DNA, 15 bp, Homo sapiens
actgcaatcatatgt

SEQ ID NO: 5159438 - DNA, 15 bp, Homo sapiens
actgcaatttccatt

SEQ ID NO: 5159439 - DNA, 21 bp, Homo sapiens
actgcacaataaaaccaagcc

SEQ ID NO: 5159440 - DNA, 22 bp, Homo sapiens
actgcacaataaaaccaagcct

SEQ ID NO: 5159441 - DNA, 20 bp, Homo sapiens
actgcacaataactcctccc

SEQ ID NO: 5159442 - DNA, 18 bp, Homo sapiens
actgcacacacagctcct

SEQ ID NO: 5159443 - DNA, 19 bp, Homo sapiens
actgcacacacagctcctc

SEQ ID NO: 5159444 - DNA, 18 bp, Homo sapiens
actgcacactcagttctg

SEQ ID NO: 5159445 - DNA, 15 bp, Homo sapiens
actgcacagagctct

SEQ ID NO: 5159446 - DNA, 16 bp, Homo sapiens
actatttcttcagagt

SEQ ID NO: 5159447 - DNA, 14 bp, Homo sapiens
actatttctttcat

SEQ ID NO: 5159448 - DNA, 15 bp, Homo sapiens
actatttctttttat

SEQ ID NO: 5159449 - DNA, 19 bp, Homo sapiens
actatttgaaaaaagaaga

SEQ ID NO: 5159450 - DNA, 20 bp, Homo sapiens
actatttgaaaaaagaagag

SEQ ID NO: 5159451 - DNA, 18 bp, Homo sapiens
actatttgatgagtctta

SEQ ID NO: 5159452 - DNA, 14 bp, Homo sapiens
actatttgtgactt

SEQ ID NO: 5159453 - DNA, 15 bp, Homo sapiens
actattttaaataaa

SEQ ID NO: 5159454 - DNA, 16 bp, Homo sapiens
actattttaaataaaa

SEQ ID NO: 5159455 - DNA, 13 bp, Homo sapiens
actattttacttc

SEQ ID NO: 5159456 - DNA, 11 bp, Homo sapiens
actattttatt

SEQ ID NO: 5159457 - DNA, 15 bp, Homo sapiens
actattttattctaa

SEQ ID NO: 5159458 - DNA, 17 bp, Homo sapiens
actattttattttctaa

SEQ ID NO: 5159459 - DNA, 14 bp, Homo sapiens
actattttcaaaga

SEQ ID NO: 5159460 - DNA, 16 bp, Homo sapiens
actattttcaaagaaa

SEQ ID NO: 5159461 - DNA, 13 bp, Homo sapiens
actattttcagaa

SEQ ID NO: 5159462 - DNA, 14 bp, Homo sapiens
actattttcagaat

SEQ ID NO: 5159463 - DNA, 17 bp, Homo sapiens
actattttcagaatctg

SEQ ID NO: 5159464 - DNA, 16 bp, Homo sapiens
actattttgaagaaaa

SEQ ID NO: 5159465 - DNA, 21 bp, Homo sapiens
actattttgaagaaaacacaa

SEQ ID NO: 5159466 - DNA, 18 bp, Homo sapiens
actatttttatattctat

SEQ ID NO: 5159467 - DNA, 15 bp, Homo sapiens
actatttttctatga

SEQ ID NO: 5159468 - DNA, 17 bp, Homo sapiens
actatttttctttccaa

SEQ ID NO: 5159469 - DNA, 12 bp, Homo sapiens
actatttttgta

SEQ ID NO: 5159470 - DNA, 13 bp, Homo sapiens
actatttttgtaa

SEQ ID NO: 5159471 - DNA, 21 bp, Homo sapiens
actatttttgtttttattaaa

SEQ ID NO: 5159472 - DNA, 17 bp, Homo sapiens
actattttttaataaaa

SEQ ID NO: 5159473 - DNA, 16 bp, Homo sapiens
actatttttttcaaag

SEQ ID NO: 5159474 - DNA, 20 bp, Homo sapiens
actcaaaaaaacaaaaaaga

SEQ ID NO: 5159475 - DNA, 13 bp, Homo sapiens
actcaaaaagctg

SEQ ID NO: 5159476 - DNA, 12 bp, Homo sapiens
actcaaaaataa

SEQ ID NO: 5159477 - DNA, 15 bp, Homo sapiens
actcaaaacttaaca

SEQ ID NO: 5159478 - DNA, 13 bp, Homo sapiens
actcaaaagacaa

SEQ ID NO: 5159479 - DNA, 18 bp, Homo sapiens
actcaaaagctgggcagg

SEQ ID NO: 5159480 - DNA, 22 bp, Homo sapiens
actcaaaaggagaactgtgctc

SEQ ID NO: 5159481 - DNA, 20 bp, Homo sapiens
actcaaaatatttgtacata

SEQ ID NO: 5159482 - DNA, 17 bp, Homo sapiens
actcaaaatctgtcata

SEQ ID NO: 5159483 - DNA, 13 bp, Homo sapiens
actcaaaatgaca

SEQ ID NO: 5159484 - DNA, 16 bp, Homo sapiens
actcaaaatgacagtt

SEQ ID NO: 5159485 - DNA, 22 bp, Homo sapiens
actcaaaatgatgcaaccaaaa

SEQ ID NO: 5159486 - DNA, 15 bp, Homo sapiens
actcaaaatgcagga

SEQ ID NO: 5159487 - DNA, 15 bp, Homo sapiens
actcaaacacagaga

SEQ ID NO: 5159488 - DNA, 19 bp, Homo sapiens
actcaaaccaaatcactga

SEQ ID NO: 5159489 - DNA, 20 bp, Homo sapiens
actcaaaccaaatcactgaa

SEQ ID NO: 5159490 - DNA, 17 bp, Homo sapiens
actcaaacggaggaagc

SEQ ID NO: 5159491 - DNA, 20 bp, Homo sapiens
actcaaacggaggaagccca

SEQ ID NO: 5159492 - DNA, 22 bp, Homo sapiens
actcaaacggaggaagcccaca

SEQ ID NO: 5159493 - DNA, 23 bp, Homo sapiens
actcaaactgaggaatttcacct

SEQ ID NO: 5159494 - DNA, 17 bp, Homo sapiens
actcaaacttctggctc

SEQ ID NO: 5159495 - DNA, 14 bp, Homo sapiens
actcaaagacttcc

SEQ ID NO: 5159496 - DNA, 17 bp, Homo sapiens
actcaaagtatcctccc

SEQ ID NO: 5159497 - DNA, 19 bp, Homo sapiens
actcaaagtttcagagacc

SEQ ID NO: 5159498 - DNA, 22 bp, Homo sapiens
actcaaagtttcagagaccatt

SEQ ID NO: 5159499 - DNA, 21 bp, Homo sapiens
actcaaatatgagtacaaatg

SEQ ID NO: 5159500 - DNA, 14 bp, Homo sapiens
actcaaatcaagaa

SEQ ID NO: 5159501 - DNA, 19 bp, Homo sapiens
actcaaatgaatttgctaa

SEQ ID NO: 5159502 - DNA, 18 bp, Homo sapiens
actcaaatgctcagacca

SEQ ID NO: 5159503 - DNA, 20 bp, Homo sapiens
actcaaatggggccagatcc

SEQ ID NO: 5159504 - DNA, 21 bp, Homo sapiens
actcaaatggggccagatcca

SEQ ID NO: 5159505 - DNA, 21 bp, Homo sapiens
actcaaatggtgtcatggctg

SEQ ID NO: 5159506 - DNA, 23 bp, Homo sapiens
actcaaatggtgtcatggctgaa

SEQ ID NO: 5159507 - DNA, 19 bp, Homo sapiens
actcaaattaatctttctt

SEQ ID NO: 5159508 - DNA, 14 bp, Homo sapiens
actcaaattttgta

SEQ ID NO: 5159509 - DNA, 22 bp, Homo sapiens
actcaaattttgtaccaagtaa

SEQ ID NO: 5159510 - DNA, 17 bp, Homo sapiens
actcaacatgttactga

SEQ ID NO: 5159511 - DNA, 20 bp, Homo sapiens
actcaacatgttactgacca

SEQ ID NO: 5159512 - DNA, 16 bp, Homo sapiens
actcaaccaaatggta

SEQ ID NO: 5159513 - DNA, 18 bp, Homo sapiens
actcaaccaacctccccg

SEQ ID NO: 5159514 - DNA, 15 bp, Homo sapiens
actcaaccctctcag

SEQ ID NO: 5159515 - DNA, 14 bp, Homo sapiens
actcaactaatttt

SEQ ID NO: 5159516 - DNA, 20 bp, Homo sapiens
actcaactgggctctgtccc

SEQ ID NO: 5159517 - DNA, 14 bp, Homo sapiens
actcaagaagcagg

SEQ ID NO: 5159518 - DNA, 19 bp, Homo sapiens
actcaagactatgttctcc

SEQ ID NO: 5159519 - DNA, 21 bp, Homo sapiens
actcaagagaatttatgtgaa

SEQ ID NO: 5159520 - DNA, 15 bp, Homo sapiens
actcaagaggaatct

SEQ ID NO: 5159521 - DNA, 19 bp, Homo sapiens
actcaagaggaatctgttt

SEQ ID NO: 5159522 - DNA, 21 bp, Homo sapiens
actcaagaggaatctgtttct

SEQ ID NO: 5159523 - DNA, 17 bp, Homo sapiens
actcaagaggctgaggc

SEQ ID NO: 5159524 - DNA, 16 bp, Homo sapiens
actcaagagttcagtg

SEQ ID NO: 5159525 - DNA, 15 bp, Homo sapiens
actcaagattcccag

SEQ ID NO: 5159526 - DNA, 17 bp, Homo sapiens
actcaagattcccagga

SEQ ID NO: 5159527 - DNA, 23 bp, Homo sapiens
actcaagattcccaggagttctg

SEQ ID NO: 5159528 - DNA, 22 bp, Homo sapiens
actcaagcagtgtgctggacct

SEQ ID NO: 5159529 - DNA, 11 bp, Homo sapiens
actcaagccaa

SEQ ID NO: 5159530 - DNA, 16 bp, Homo sapiens
actcaagccaagcagc

SEQ ID NO: 5159531 - DNA, 17 bp, Homo sapiens
actcaagcctgagagaa

SEQ ID NO: 5159532 - DNA, 17 bp, Homo sapiens
actcaagcgggtggctc

SEQ ID NO: 5159533 - DNA, 12 bp, Homo sapiens
actcaaggaaaa

SEQ ID NO: 5159534 - DNA, 22 bp, Homo sapiens
actcaaggaagaataattttaa

SEQ ID NO: 5159535 - DNA, 20 bp, Homo sapiens
actcaaggacaggagcctgg

SEQ ID NO: 5159536 - DNA, 21 bp, Homo sapiens
actcaaggataccttcttatt

SEQ ID NO: 5159537 - DNA, 13 bp, Homo sapiens
actcaaggcctcc

SEQ ID NO: 5159538 - DNA, 15 bp, Homo sapiens
actcaaggggctgga

SEQ ID NO: 5159539 - DNA, 15 bp, Homo sapiens
actcaagggttttcc

SEQ ID NO: 5159540 - DNA, 17 bp, Homo sapiens
actcaagggttttccag

SEQ ID NO: 5159541 - DNA, 18 bp, Homo sapiens
actcaagggttttccagg

SEQ ID NO: 5159542 - DNA, 18 bp, Homo sapiens
actcaaggtttaacctta

SEQ ID NO: 5159543 - DNA, 23 bp, Homo sapiens
actcaagtaccaccaagggatct

SEQ ID NO: 5159544 - DNA, 17 bp, Homo sapiens
actcaagtacccattct

SEQ ID NO: 5159545 - DNA, 20 bp, Homo sapiens
actcaagtctattgaataat

SEQ ID NO: 5159546 - DNA, 22 bp, Homo sapiens
actcaagtctattgaataatgt

SEQ ID NO: 5159547 - DNA, 15 bp, Homo sapiens
actcaagtgtagaag

SEQ ID NO: 5159548 - DNA, 14 bp, Homo sapiens
actcaagtgttaaa

SEQ ID NO: 5159549 - DNA, 18 bp, Homo sapiens
actcaagtgttaaattat

SEQ ID NO: 5159550 - DNA, 19 bp, Homo sapiens
actcaagtgttaaattatt

SEQ ID NO: 5159551 - DNA, 15 bp, Homo sapiens
actcaagttcaagga

SEQ ID NO: 5159552 - DNA, 18 bp, Homo sapiens
actcaagttgtctcttta

SEQ ID NO: 5159553 - DNA, 14 bp, Homo sapiens
actcaagttgttta

SEQ ID NO: 5159554 - DNA, 17 bp, Homo sapiens
actcaagtttttacaaa

SEQ ID NO: 5159555 - DNA, 19 bp, Homo sapiens
actcaagtttttacaaaat

SEQ ID NO: 5159556 - DNA, 19 bp, Homo sapiens
actcaataaacagtcactg

SEQ ID NO: 5159557 - DNA, 19 bp, Homo sapiens
actcaataaagtgggcttt

SEQ ID NO: 5159558 - DNA, 15 bp, Homo sapiens
actcaatactacctc

SEQ ID NO: 5159559 - DNA, 17 bp, Homo sapiens
actcaatactacctctg

SEQ ID NO: 5159560 - DNA, 18 bp, Homo sapiens
actcaatactacctctga

SEQ ID NO: 5159561 - DNA, 15 bp, Homo sapiens
actcaatatatagtt

SEQ ID NO: 5159562 - DNA, 16 bp, Homo sapiens
actcaatatatagtta

SEQ ID NO: 5159563 - DNA, 20 bp, Homo sapiens
actcaatatgtgatttttgt

SEQ ID NO: 5159564 - DNA, 13 bp, Homo sapiens
actcaatattaaa

SEQ ID NO: 5159565 - DNA, 22 bp, Homo sapiens
actcaatattttccatgaaaat

SEQ ID NO: 5159566 - DNA, 18 bp, Homo sapiens
actcaatccatccatgta

SEQ ID NO: 5159567 - DNA, 17 bp, Homo sapiens
actcaatctaaattaaa

SEQ ID NO: 5159568 - DNA, 18 bp, Homo sapiens
actcaatctaaattaaaa

SEQ ID NO: 5159569 - DNA, 17 bp, Homo sapiens
actcaatgaaatatgtg

SEQ ID NO: 5159570 - DNA, 14 bp, Homo sapiens
actcaatgcatgat

SEQ ID NO: 5159571 - DNA, 17 bp, Homo sapiens
actcaatgcctggagac

SEQ ID NO: 5159572 - DNA, 12 bp, Homo sapiens
actcaatgcttt

SEQ ID NO: 5159573 - DNA, 15 bp, Homo sapiens
actcaatgctttatt

SEQ ID NO: 5159574 - DNA, 17 bp, Homo sapiens
actcaatgctttatttg

SEQ ID NO: 5159575 - DNA, 23 bp, Homo sapiens
actcaatgctttatttgtaaatt

SEQ ID NO: 5159576 - DNA, 19 bp, Homo sapiens
actcaatggagtatgtctg

SEQ ID NO: 5159577 - DNA, 23 bp, Homo sapiens
actcaatggagtatgtctgatgg

SEQ ID NO: 5159578 - DNA, 22 bp, Homo sapiens
actcaatgggagaatcagcaga

SEQ ID NO: 5159579 - DNA, 14 bp, Homo sapiens
actcaatgtgctct

SEQ ID NO: 5159580 - DNA, 18 bp, Homo sapiens
actcaattcaacaatgtg

SEQ ID NO: 5159581 - DNA, 14 bp, Homo sapiens
actcaattgatcct

SEQ ID NO: 5159582 - DNA, 15 bp, Homo sapiens
actcaattttaacaa

SEQ ID NO: 5159583 - DNA, 15 bp, Homo sapiens
actcacaaaaggctg

SEQ ID NO: 5159584 - DNA, 16 bp, Homo sapiens
actcacaagaagacca

SEQ ID NO: 5159585 - DNA, 22 bp, Homo sapiens
actcacacagccaggtgccttg

SEQ ID NO: 5159586 - DNA, 22 bp, Homo sapiens
actcacactctctgcagcccag

SEQ ID NO: 5159587 - DNA, 19 bp, Homo sapiens
actcacagacctggagccc

SEQ ID NO: 5159588 - DNA, 22 bp, Homo sapiens
actcacagacctggagcccctg

SEQ ID NO: 5159589 - DNA, 23 bp, Homo sapiens
actcacagacctggagcccctgg

SEQ ID NO: 5159590 - DNA, 15 bp, Homo sapiens
actcacagactgctg

SEQ ID NO: 5159591 - DNA, 16 bp, Homo sapiens
actcacagagacacag

SEQ ID NO: 5159592 - DNA, 21 bp, Homo sapiens
actcacagagtcaaggcctgc

SEQ ID NO: 5159593 - DNA, 17 bp, Homo sapiens
actcacagcttctccaa

SEQ ID NO: 5159594 - DNA, 21 bp, Homo sapiens
actcacatagccaactctccc

SEQ ID NO: 5159595 - DNA, 14 bp, Homo sapiens
actcacatataaca

SEQ ID NO: 5159596 - DNA, 16 bp, Homo sapiens
actcacatataacatg

SEQ ID NO: 5159597 - DNA, 19 bp, Homo sapiens
actcacatgccgcccccag

SEQ ID NO: 5159598 - DNA, 16 bp, Homo sapiens
actcacatgctggaca

SEQ ID NO: 5159599 - DNA, 16 bp, Homo sapiens
actcacattctgttgt

SEQ ID NO: 5159600 - DNA, 21 bp, Homo sapiens
actcacattgttcaactccct

SEQ ID NO: 5159601 - DNA, 12 bp, Homo sapiens
actcacattttg

SEQ ID NO: 5159602 - DNA, 19 bp, Homo sapiens
actcaccacaagctgagca

SEQ ID NO: 5159603 - DNA, 23 bp, Homo sapiens
actcaccacgatgacgcctctgg

SEQ ID NO: 5159604 - DNA, 19 bp, Homo sapiens
actcaccactaccagccag

SEQ ID NO: 5159605 - DNA, 13 bp, Homo sapiens
actcaccactgcc

SEQ ID NO: 5159606 - DNA, 22 bp, Homo sapiens
actcaccagccccactgccagc

SEQ ID NO: 5159607 - DNA, 18 bp, Homo sapiens
actcaccatatttgaatt

SEQ ID NO: 5159608 - DNA, 17 bp, Homo sapiens
actcaccatttaatcat

SEQ ID NO: 5159609 - DNA, 13 bp, Homo sapiens
actcaccccagcc

SEQ ID NO: 5159610 - DNA, 15 bp, Homo sapiens
actcaccccagcctc

SEQ ID NO: 5159611 - DNA, 18 bp, Homo sapiens
actcaccccagcctcatt

SEQ ID NO: 5159612 - DNA, 14 bp, Homo sapiens
actcacccctcagc

SEQ ID NO: 5159613 - DNA, 15 bp, Homo sapiens
actcacccctcagca

SEQ ID NO: 5159614 - DNA, 17 bp, Homo sapiens
actcacccttcctggcc

SEQ ID NO: 5159615 - DNA, 18 bp, Homo sapiens
actcacccttcctggccc

SEQ ID NO: 5159616 - DNA, 19 bp, Homo sapiens
actcaccgtgctgtcttct

SEQ ID NO: 5159617 - DNA, 22 bp, Homo sapiens
actcaccgtgctgtcttctggt

SEQ ID NO: 5159618 - DNA, 20 bp, Homo sapiens
actcacctcccccatctctt

SEQ ID NO: 5159619 - DNA, 13 bp, Homo sapiens
actcacctcctcc

SEQ ID NO: 5159620 - DNA, 15 bp, Homo sapiens
actcacctcctccca

SEQ ID NO: 5159621 - DNA, 16 bp, Homo sapiens
actcacctctaaaaca

SEQ ID NO: 5159622 - DNA, 12 bp, Homo sapiens
actcacctctct

SEQ ID NO: 5159623 - DNA, 15 bp, Homo sapiens
actcacctctgcctc

SEQ ID NO: 5159624 - DNA, 17 bp, Homo sapiens
actcacctctgcctcaa

SEQ ID NO: 5159625 - DNA, 19 bp, Homo sapiens
actgcacagagctctccag

SEQ ID NO: 5159626 - DNA, 16 bp, Homo sapiens
actgcacagcgtcctg

SEQ ID NO: 5159627 - DNA, 16 bp, Homo sapiens
actgcacaggaggagg

SEQ ID NO: 5159628 - DNA, 18 bp, Homo sapiens
actgcacagtgcatctca

SEQ ID NO: 5159629 - DNA, 13 bp, Homo sapiens
actgcacagtgct

SEQ ID NO: 5159630 - DNA, 15 bp, Homo sapiens
actgcacagtgctgt

SEQ ID NO: 5159631 - DNA, 20 bp, Homo sapiens
actgcacagtgctgttggtg

SEQ ID NO: 5159632 - DNA, 16 bp, Homo sapiens
actgcacagtggcaca

SEQ ID NO: 5159633 - DNA, 18 bp, Homo sapiens
actgcacataatttgcat

SEQ ID NO: 5159634 - DNA, 12 bp, Homo sapiens
actgcacatcta

SEQ ID NO: 5159635 - DNA, 18 bp, Homo sapiens
actgcacatgaagaaata

SEQ ID NO: 5159636 - DNA, 18 bp, Homo sapiens
actgcacatgatttcaca

SEQ ID NO: 5159637 - DNA, 19 bp, Homo sapiens
actgcacatgatttcacaa

SEQ ID NO: 5159638 - DNA, 23 bp, Homo sapiens
actgcacatgatttcacaaatat

SEQ ID NO: 5159639 - DNA, 15 bp, Homo sapiens
actgcaccaccgacc

SEQ ID NO: 5159640 - DNA, 22 bp, Homo sapiens
actgcaccaccgaccaactcca

SEQ ID NO: 5159641 - DNA, 14 bp, Homo sapiens
actgcacccagctc

SEQ ID NO: 5159642 - DNA, 16 bp, Homo sapiens
actgcacccagctcca

SEQ ID NO: 5159643 - DNA, 22 bp, Homo sapiens
actgcacccagctccaggggcc

SEQ ID NO: 5159644 - DNA, 13 bp, Homo sapiens
actgcacccagga

SEQ ID NO: 5159645 - DNA, 17 bp, Homo sapiens
actgcacccccctgtgc

SEQ ID NO: 5159646 - DNA, 19 bp, Homo sapiens
actgcacccccctgtgcct

SEQ ID NO: 5159647 - DNA, 20 bp, Homo sapiens
actgcacccccctgtgcctg

SEQ ID NO: 5159648 - DNA, 21 bp, Homo sapiens
actgcacccccctgtgcctgc

SEQ ID NO: 5159649 - DNA, 23 bp, Homo sapiens
actgcacccccctgtgcctgctg

SEQ ID NO: 5159650 - DNA, 16 bp, Homo sapiens
actgcaccccctcctg

SEQ ID NO: 5159651 - DNA, 18 bp, Homo sapiens
actgcaccccctcctgct

SEQ ID NO: 5159652 - DNA, 14 bp, Homo sapiens
actgcaccctccac

SEQ ID NO: 5159653 - DNA, 20 bp, Homo sapiens
actgcaccctccacaggagc

SEQ ID NO: 5159654 - DNA, 14 bp, Homo sapiens
actgcacctgccca

SEQ ID NO: 5159655 - DNA, 19 bp, Homo sapiens
actgcacctgcctccagcc

SEQ ID NO: 5159656 - DNA, 14 bp, Homo sapiens
actgcaccttgtga

SEQ ID NO: 5159657 - DNA, 19 bp, Homo sapiens
actgcacgtggcttctgat

SEQ ID NO: 5159658 - DNA, 20 bp, Homo sapiens
actgcacgtggcttctgatg

SEQ ID NO: 5159659 - DNA, 9 bp, Homo sapiens
actgcactc

SEQ ID NO: 5159660 - DNA, 15 bp, Homo sapiens
actgcactccagcct

SEQ ID NO: 5159661 - DNA, 18 bp, Homo sapiens
actgcactccagcctgag

SEQ ID NO: 5159662 - DNA, 20 bp, Homo sapiens
actgcactccagcctgagtg

SEQ ID NO: 5159663 - DNA, 21 bp, Homo sapiens
actgcactccagcctgggcga

SEQ ID NO: 5159664 - DNA, 20 bp, Homo sapiens
actgcactccagcctggggg

SEQ ID NO: 5159665 - DNA, 22 bp, Homo sapiens
actgcactccggcctgggcgac

SEQ ID NO: 5159666 - DNA, 18 bp, Homo sapiens
actgcactcttaaacagc

SEQ ID NO: 5159667 - DNA, 19 bp, Homo sapiens
actgcactttccaatgcca

SEQ ID NO: 5159668 - DNA, 21 bp, Homo sapiens
actgcactttccaatgccaca

SEQ ID NO: 5159669 - DNA, 17 bp, Homo sapiens
actgcactttccccctt

SEQ ID NO: 5159670 - DNA, 18 bp, Homo sapiens
actgcactttcccccttc

SEQ ID NO: 5159671 - DNA, 12 bp, Homo sapiens
actgcactttgt

SEQ ID NO: 5159672 - DNA, 14 bp, Homo sapiens
actgcactttgttt

SEQ ID NO: 5159673 - DNA, 23 bp, Homo sapiens
actgcactttttttacttcgtct

SEQ ID NO: 5159674 - DNA, 16 bp, Homo sapiens
actgcagaaaaaatat

SEQ ID NO: 5159675 - DNA, 20 bp, Homo sapiens
actgcagaacccccaggtgg

SEQ ID NO: 5159676 - DNA, 21 bp, Homo sapiens
actgcagaacccccaggtggc

SEQ ID NO: 5159677 - DNA, 22 bp, Homo sapiens
actgcagacattctcaaagcct

SEQ ID NO: 5159678 - DNA, 21 bp, Homo sapiens
actgcagaccatgaagtaaat

SEQ ID NO: 5159679 - DNA, 20 bp, Homo sapiens
actgcagacctcactgtcag

SEQ ID NO: 5159680 - DNA, 20 bp, Homo sapiens
actgcagacctgtcctcctg

SEQ ID NO: 5159681 - DNA, 16 bp, Homo sapiens
actgcagagcagatgg

SEQ ID NO: 5159682 - DNA, 21 bp, Homo sapiens
actgcagaggagccacctggg

SEQ ID NO: 5159683 - DNA, 22 bp, Homo sapiens
actgcagaggagccacctgggc

SEQ ID NO: 5159684 - DNA, 13 bp, Homo sapiens
actgcagagggct

SEQ ID NO: 5159685 - DNA, 17 bp, Homo sapiens
actgcagagtaaattgc

SEQ ID NO: 5159686 - DNA, 18 bp, Homo sapiens
actgcagatagccagaca

SEQ ID NO: 5159687 - DNA, 16 bp, Homo sapiens
actgcagatagcccag

SEQ ID NO: 5159688 - DNA, 17 bp, Homo sapiens
actgcagatagcccagg

SEQ ID NO: 5159689 - DNA, 14 bp, Homo sapiens
actgcagattgaga

SEQ ID NO: 5159690 - DNA, 19 bp, Homo sapiens
actgcagatttctcacctg

SEQ ID NO: 5159691 - DNA, 21 bp, Homo sapiens
actgcagcaatcacaaaggct

SEQ ID NO: 5159692 - DNA, 21 bp, Homo sapiens
actgcagcaatctttgaaaga

SEQ ID NO: 5159693 - DNA, 14 bp, Homo sapiens
actgcagcacctcc

SEQ ID NO: 5159694 - DNA, 18 bp, Homo sapiens
actgcagcacctccaggc

SEQ ID NO: 5159695 - DNA, 18 bp, Homo sapiens
actgcagcattttgctgc

SEQ ID NO: 5159696 - DNA, 21 bp, Homo sapiens
actgcagcattttgctgcttt

SEQ ID NO: 5159697 - DNA, 19 bp, Homo sapiens
actgcagcctcaacctcct

SEQ ID NO: 5159698 - DNA, 21 bp, Homo sapiens
actgcagcctcaacctcctgg

SEQ ID NO: 5159699 - DNA, 22 bp, Homo sapiens
actgcagcctcaacctcctggg

SEQ ID NO: 5159700 - DNA, 23 bp, Homo sapiens
actgcagcctcatactcctgggc

SEQ ID NO: 5159701 - DNA, 20 bp, Homo sapiens
actgcagcctgggctccctc

SEQ ID NO: 5159702 - DNA, 13 bp, Homo sapiens
actgcagctgtga

SEQ ID NO: 5159703 - DNA, 14 bp, Homo sapiens
actgcagctgtgag

SEQ ID NO: 5159704 - DNA, 15 bp, Homo sapiens
actgcagctttacat

SEQ ID NO: 5159705 - DNA, 13 bp, Homo sapiens
actgcaggaagag

SEQ ID NO: 5159706 - DNA, 14 bp, Homo sapiens
actgcaggaagaga

SEQ ID NO: 5159707 - DNA, 13 bp, Homo sapiens
actgcaggaatgc

SEQ ID NO: 5159708 - DNA, 15 bp, Homo sapiens
actgcaggccccgct

SEQ ID NO: 5159709 - DNA, 21 bp, Homo sapiens
actgcaggccccgcttgtcca

SEQ ID NO: 5159710 - DNA, 23 bp, Homo sapiens
actgcaggccccgcttgtccagc

SEQ ID NO: 5159711 - DNA, 12 bp, Homo sapiens
actgcaggccct

SEQ ID NO: 5159712 - DNA, 18 bp, Homo sapiens
actgcaggccctggcctc

SEQ ID NO: 5159713 - DNA, 12 bp, Homo sapiens
actgcagggaca

SEQ ID NO: 5159714 - DNA, 14 bp, Homo sapiens
actgcagggaggag

SEQ ID NO: 5159715 - DNA, 15 bp, Homo sapiens
actgcagggccagga

SEQ ID NO: 5159716 - DNA, 16 bp, Homo sapiens
actgcagggccaggac

SEQ ID NO: 5159717 - DNA, 15 bp, Homo sapiens
actgcagggctgctg

SEQ ID NO: 5159718 - DNA, 16 bp, Homo sapiens
actgcagggctgctgt

SEQ ID NO: 5159719 - DNA, 22 bp, Homo sapiens
actgcagggctgctgtggccca

SEQ ID NO: 5159720 - DNA, 21 bp, Homo sapiens
actgcaggggttatgtggaag

SEQ ID NO: 5159721 - DNA, 23 bp, Homo sapiens
actgcaggtgggctgggcccacc

SEQ ID NO: 5159722 - DNA, 21 bp, Homo sapiens
actgcaggttggaccccagag

SEQ ID NO: 5159723 - DNA, 12 bp, Homo sapiens
actgcagtcacc

SEQ ID NO: 5159724 - DNA, 18 bp, Homo sapiens
actgcagtcacccctgtc

SEQ ID NO: 5159725 - DNA, 15 bp, Homo sapiens
actgcagtcacctct

SEQ ID NO: 5159726 - DNA, 16 bp, Homo sapiens
actgcagtcacctctt

SEQ ID NO: 5159727 - DNA, 17 bp, Homo sapiens
actgcagtcctggagca

SEQ ID NO: 5159728 - DNA, 19 bp, Homo sapiens
actgcagtcggcatgccag

SEQ ID NO: 5159729 - DNA, 16 bp, Homo sapiens
actgcagtcttatttc

SEQ ID NO: 5159730 - DNA, 15 bp, Homo sapiens
actgcagtctttatt

SEQ ID NO: 5159731 - DNA, 10 bp, Homo sapiens
actgcagtga

SEQ ID NO: 5159732 - DNA, 20 bp, Homo sapiens
actgcagtgatgtatacatc

SEQ ID NO: 5159733 - DNA, 14 bp, Homo sapiens
actgcagtgtggag

SEQ ID NO: 5159734 - DNA, 16 bp, Homo sapiens
actgcagttgactttc

SEQ ID NO: 5159735 - DNA, 13 bp, Homo sapiens
actgcagtttcct

SEQ ID NO: 5159736 - DNA, 22 bp, Homo sapiens
actgcataccaacctgggcaat

SEQ ID NO: 5159737 - DNA, 23 bp, Homo sapiens
actgcatactttttaaatgtaaa

SEQ ID NO: 5159738 - DNA, 20 bp, Homo sapiens
actgcataggaatttagaac

SEQ ID NO: 5159739 - DNA, 16 bp, Homo sapiens
actgcatatgaaagga

SEQ ID NO: 5159740 - DNA, 17 bp, Homo sapiens
actgcatcaagacttca

SEQ ID NO: 5159741 - DNA, 20 bp, Homo sapiens
actgcatcaagatgtgacat

SEQ ID NO: 5159742 - DNA, 19 bp, Homo sapiens
actgcatcatctgtttgta

SEQ ID NO: 5159743 - DNA, 14 bp, Homo sapiens
actgcatccagcct

SEQ ID NO: 5159744 - DNA, 16 bp, Homo sapiens
actgcatcctactcct

SEQ ID NO: 5159745 - DNA, 21 bp, Homo sapiens
actgcatcctactcctacctg

SEQ ID NO: 5159746 - DNA, 17 bp, Homo sapiens
actgcatcctccgcctc

SEQ ID NO: 5159747 - DNA, 20 bp, Homo sapiens
actgcatcctccgcctcccg

SEQ ID NO: 5159748 - DNA, 21 bp, Homo sapiens
actgcatcttggttatttctg

SEQ ID NO: 5159749 - DNA, 16 bp, Homo sapiens
actgcatgctgctgga

SEQ ID NO: 5159750 - DNA, 17 bp, Homo sapiens
actgcatggacctaaca

SEQ ID NO: 5159751 - DNA, 12 bp, Homo sapiens
actgcatggctt

SEQ ID NO: 5159752 - DNA, 22 bp, Homo sapiens
actgcatggcttctgaaagcag

SEQ ID NO: 5159753 - DNA, 19 bp, Homo sapiens
actgcatggggaggcagca

SEQ ID NO: 5159754 - DNA, 17 bp, Homo sapiens
actgcatggtaatttat

SEQ ID NO: 5159755 - DNA, 14 bp, Homo sapiens
actgcatgtataaa

SEQ ID NO: 5159756 - DNA, 17 bp, Homo sapiens
actgcatgtcagagcac

SEQ ID NO: 5159757 - DNA, 20 bp, Homo sapiens
actgcattaccgcgttgtaa

SEQ ID NO: 5159758 - DNA, 22 bp, Homo sapiens
actgcattaccgcgttgtaaaa

SEQ ID NO: 5159759 - DNA, 23 bp, Homo sapiens
actgcattaccgcgttgtaaaat

SEQ ID NO: 5159760 - DNA, 16 bp, Homo sapiens
actgcattagaaatta

SEQ ID NO: 5159761 - DNA, 14 bp, Homo sapiens
actgcattatttga

SEQ ID NO: 5159762 - DNA, 16 bp, Homo sapiens
actgcattcctgtgcc

SEQ ID NO: 5159763 - DNA, 16 bp, Homo sapiens
actgcattctctccca

SEQ ID NO: 5159764 - DNA, 17 bp, Homo sapiens
actgcattcttctgatc

SEQ ID NO: 5159765 - DNA, 20 bp, Homo sapiens
actgcattggttttccatga

SEQ ID NO: 5159766 - DNA, 23 bp, Homo sapiens
actgcatttaaatttgatttcca

SEQ ID NO: 5159767 - DNA, 16 bp, Homo sapiens
actgcattttacacat

SEQ ID NO: 5159768 - DNA, 16 bp, Homo sapiens
actgcattttaccaga

SEQ ID NO: 5159769 - DNA, 18 bp, Homo sapiens
actgccaaaaccaaattg

SEQ ID NO: 5159770 - DNA, 18 bp, Homo sapiens
actgccaaaatgctctag

SEQ ID NO: 5159771 - DNA, 20 bp, Homo sapiens
actgccaaacctcctgtcag

SEQ ID NO: 5159772 - DNA, 18 bp, Homo sapiens
actgccaaataaacagct

SEQ ID NO: 5159773 - DNA, 19 bp, Homo sapiens
actgccaaataaacagcta

SEQ ID NO: 5159774 - DNA, 22 bp, Homo sapiens
actgccaaataaacagctattt

SEQ ID NO: 5159775 - DNA, 18 bp, Homo sapiens
actgccaacctcgctcca

SEQ ID NO: 5159776 - DNA, 12 bp, Homo sapiens
actgccaagaaa

SEQ ID NO: 5159777 - DNA, 19 bp, Homo sapiens
actgccaagactgctgtgg

SEQ ID NO: 5159778 - DNA, 17 bp, Homo sapiens
actgccaagccaaccct

SEQ ID NO: 5159779 - DNA, 14 bp, Homo sapiens
actgccaagccaga

SEQ ID NO: 5159780 - DNA, 15 bp, Homo sapiens
actgccaagccagat

SEQ ID NO: 5159781 - DNA, 17 bp, Homo sapiens
actgccaagccagattc

SEQ ID NO: 5159782 - DNA, 18 bp, Homo sapiens
actgccaagccatgggta

SEQ ID NO: 5159783 - DNA, 15 bp, Homo sapiens
actgccacaagcaca

SEQ ID NO: 5159784 - DNA, 17 bp, Homo sapiens
actgccacaagcacaat

SEQ ID NO: 5159785 - DNA, 20 bp, Homo sapiens
actgccacaaggaagaaatt

SEQ ID NO: 5159786 - DNA, 15 bp, Homo sapiens
actgccaccagcaat

SEQ ID NO: 5159787 - DNA, 22 bp, Homo sapiens
actgccaccagcaatgccctgc

SEQ ID NO: 5159788 - DNA, 16 bp, Homo sapiens
actgccacgtgcctta

SEQ ID NO: 5159789 - DNA, 21 bp, Homo sapiens
actgccactccagtcctgcca

SEQ ID NO: 5159790 - DNA, 13 bp, Homo sapiens
actgccactgtgt

SEQ ID NO: 5159791 - DNA, 22 bp, Homo sapiens
actgccactttgcacattttga

SEQ ID NO: 5159792 - DNA, 21 bp, Homo sapiens
actgccagaagagaattcagt

SEQ ID NO: 5159793 - DNA, 18 bp, Homo sapiens
actgccagaagtgtgttt

SEQ ID NO: 5159794 - DNA, 13 bp, Homo sapiens
actgccagagcta

SEQ ID NO: 5159795 - DNA, 15 bp, Homo sapiens
actgccagatgctga

SEQ ID NO: 5159796 - DNA, 17 bp, Homo sapiens
actgccagatgctgatg

SEQ ID NO: 5159797 - DNA, 16 bp, Homo sapiens
actgccagatgctgca

SEQ ID NO: 5159798 - DNA, 20 bp, Homo sapiens
actgccaggacccaccactg

SEQ ID NO: 5159799 - DNA, 23 bp, Homo sapiens
actgccaggaccccaggtcaggg

SEQ ID NO: 5159800 - DNA, 14 bp, Homo sapiens
actgccaggaggga

SEQ ID NO: 5159801 - DNA, 23 bp, Homo sapiens
actgccaggattttgtattgcca

SEQ ID NO: 5159802 - DNA, 15 bp, Homo sapiens
actgccaggcacctg

SEQ ID NO: 5159803 - DNA, 22 bp, Homo sapiens
actcacctgcactaacagagtg

SEQ ID NO: 5159804 - DNA, 14 bp, Homo sapiens
actcacctgcccct

SEQ ID NO: 5159805 - DNA, 19 bp, Homo sapiens
actcacctgcccctcaact

SEQ ID NO: 5159806 - DNA, 13 bp, Homo sapiens
actcacctgctgg

SEQ ID NO: 5159807 - DNA, 19 bp, Homo sapiens
actcacctggggctgctgg

SEQ ID NO: 5159808 - DNA, 20 bp, Homo sapiens
actcacctggggctgctggc

SEQ ID NO: 5159809 - DNA, 23 bp, Homo sapiens
actcacggctgcacctgcaggga

SEQ ID NO: 5159810 - DNA, 19 bp, Homo sapiens
actcacgtgggtcctgagg

SEQ ID NO: 5159811 - DNA, 20 bp, Homo sapiens
actcactaaaagttctcaaa

SEQ ID NO: 5159812 - DNA, 20 bp, Homo sapiens
actcactaattcattaatct

SEQ ID NO: 5159813 - DNA, 15 bp, Homo sapiens
actcactcaagttca

SEQ ID NO: 5159814 - DNA, 13 bp, Homo sapiens
actcactcattcc

SEQ ID NO: 5159815 - DNA, 15 bp, Homo sapiens
actcactccagccca

SEQ ID NO: 5159816 - DNA, 20 bp, Homo sapiens
actcactcctgagacccctg

SEQ ID NO: 5159817 - DNA, 18 bp, Homo sapiens
actcactccttttaaaga

SEQ ID NO: 5159818 - DNA, 13 bp, Homo sapiens
actcactctgggc

SEQ ID NO: 5159819 - DNA, 14 bp, Homo sapiens
actcactctgggct

SEQ ID NO: 5159820 - DNA, 20 bp, Homo sapiens
actcactctttagatattta

SEQ ID NO: 5159821 - DNA, 17 bp, Homo sapiens
actcactgaagcccaga

SEQ ID NO: 5159822 - DNA, 19 bp, Homo sapiens
actcactgaagcccagacc

SEQ ID NO: 5159823 - DNA, 19 bp, Homo sapiens
actcactgaagcctgcgtt

SEQ ID NO: 5159824 - DNA, 12 bp, Homo sapiens
actcactgaggc

SEQ ID NO: 5159825 - DNA, 23 bp, Homo sapiens
actcactgaggccatcagggccc

SEQ ID NO: 5159826 - DNA, 18 bp, Homo sapiens
actcactgcctgcagctg

SEQ ID NO: 5159827 - DNA, 19 bp, Homo sapiens
actcactgcctgcagctga

SEQ ID NO: 5159828 - DNA, 21 bp, Homo sapiens
actcactggcagccccagcac

SEQ ID NO: 5159829 - DNA, 20 bp, Homo sapiens
actcactgggaagctcccac

SEQ ID NO: 5159830 - DNA, 22 bp, Homo sapiens
actcactggggcctacagcttt

SEQ ID NO: 5159831 - DNA, 14 bp, Homo sapiens
actcactgtttata

SEQ ID NO: 5159832 - DNA, 22 bp, Homo sapiens
actcacttaattctcattatga

SEQ ID NO: 5159833 - DNA, 14 bp, Homo sapiens
actcacttccagtg

SEQ ID NO: 5159834 - DNA, 17 bp, Homo sapiens
actcacttgatgtttcc

SEQ ID NO: 5159835 - DNA, 19 bp, Homo sapiens
actcacttgatgtttcctg

SEQ ID NO: 5159836 - DNA, 21 bp, Homo sapiens
actcactttcccttgtgtcaa

SEQ ID NO: 5159837 - DNA, 22 bp, Homo sapiens
actcacttttctttattgctgt

SEQ ID NO: 5159838 - DNA, 15 bp, Homo sapiens
actcactttttccaa

SEQ ID NO: 5159839 - DNA, 22 bp, Homo sapiens
actcagaaaattccctggggtc

SEQ ID NO: 5159840 - DNA, 22 bp, Homo sapiens
actcagaaagaggtctccccat

SEQ ID NO: 5159841 - DNA, 13 bp, Homo sapiens
actcagaaagcca

SEQ ID NO: 5159842 - DNA, 14 bp, Homo sapiens
actcagaaagccaa

SEQ ID NO: 5159843 - DNA, 15 bp, Homo sapiens
actcagaaagccaac

SEQ ID NO: 5159844 - DNA, 23 bp, Homo sapiens
actcagaactgtcccatccccag

SEQ ID NO: 5159845 - DNA, 21 bp, Homo sapiens
actcagaactgtcggaggaaa

SEQ ID NO: 5159846 - DNA, 14 bp, Homo sapiens
actcagaagacact

SEQ ID NO: 5159847 - DNA, 23 bp, Homo sapiens
actcagaagagaaatacagctgg

SEQ ID NO: 5159848 - DNA, 16 bp, Homo sapiens
actcagaagcctgagg

SEQ ID NO: 5159849 - DNA, 21 bp, Homo sapiens
actcagaagcctgggggcctg

SEQ ID NO: 5159850 - DNA, 17 bp, Homo sapiens
actcagaatagctgttt

SEQ ID NO: 5159851 - DNA, 20 bp, Homo sapiens
actcagaatagctgttttgt

SEQ ID NO: 5159852 - DNA, 17 bp, Homo sapiens
actcagaatataacatg

SEQ ID NO: 5159853 - DNA, 20 bp, Homo sapiens
actcagaatataacatgtaa

SEQ ID NO: 5159854 - DNA, 22 bp, Homo sapiens
actcagaatataacatgtaaaa

SEQ ID NO: 5159855 - DNA, 15 bp, Homo sapiens
actcagaatgaaaat

SEQ ID NO: 5159856 - DNA, 18 bp, Homo sapiens
actcagaattatttttaa

SEQ ID NO: 5159857 - DNA, 21 bp, Homo sapiens
actcagaattctctagtttga

SEQ ID NO: 5159858 - DNA, 18 bp, Homo sapiens
actcagacattggcacct

SEQ ID NO: 5159859 - DNA, 14 bp, Homo sapiens
actcagaccacttg

SEQ ID NO: 5159860 - DNA, 21 bp, Homo sapiens
actcagacgtgtgacctccat

SEQ ID NO: 5159861 - DNA, 15 bp, Homo sapiens
actcagactcctggc

SEQ ID NO: 5159862 - DNA, 16 bp, Homo sapiens
actcagactcctggct

SEQ ID NO: 5159863 - DNA, 14 bp, Homo sapiens
actcagagacatgc

SEQ ID NO: 5159864 - DNA, 17 bp, Homo sapiens
actcagagacatgcaga

SEQ ID NO: 5159865 - DNA, 12 bp, Homo sapiens
actcagagcagt

SEQ ID NO: 5159866 - DNA, 19 bp, Homo sapiens
actcagagcagtctgtgac

SEQ ID NO: 5159867 - DNA, 17 bp, Homo sapiens
actcagagcccctccct

SEQ ID NO: 5159868 - DNA, 21 bp, Homo sapiens
actcagagctctctctacaga

SEQ ID NO: 5159869 - DNA, 18 bp, Homo sapiens
actcagagctgcgggctg

SEQ ID NO: 5159870 - DNA, 18 bp, Homo sapiens
actcagagctgctgagga

SEQ ID NO: 5159871 - DNA, 11 bp, Homo sapiens
actcagagctt

SEQ ID NO: 5159872 - DNA, 19 bp, Homo sapiens
actcagaggacccacctgg

SEQ ID NO: 5159873 - DNA, 16 bp, Homo sapiens
actcagaggcccccag

SEQ ID NO: 5159874 - DNA, 19 bp, Homo sapiens
actcagaggcccccagtgg

SEQ ID NO: 5159875 - DNA, 18 bp, Homo sapiens
actcagaggtccaggccc

SEQ ID NO: 5159876 - DNA, 22 bp, Homo sapiens
actcagataaggtaaaatgcca

SEQ ID NO: 5159877 - DNA, 17 bp, Homo sapiens
actcagatcactactgc

SEQ ID NO: 5159878 - DNA, 20 bp, Homo sapiens
actcagatcactactgcagt

SEQ ID NO: 5159879 - DNA, 14 bp, Homo sapiens
actcagatccaggg

SEQ ID NO: 5159880 - DNA, 14 bp, Homo sapiens
actcagatctgcac

SEQ ID NO: 5159881 - DNA, 16 bp, Homo sapiens
actcagatgaccccag

SEQ ID NO: 5159882 - DNA, 22 bp, Homo sapiens
actcagatgtctctggcgtgtg

SEQ ID NO: 5159883 - DNA, 19 bp, Homo sapiens
actcagatttaagccttac

SEQ ID NO: 5159884 - DNA, 15 bp, Homo sapiens
actcagcacaaggcc

SEQ ID NO: 5159885 - DNA, 13 bp, Homo sapiens
actcagcaccaca

SEQ ID NO: 5159886 - DNA, 22 bp, Homo sapiens
actcagcaccacattgcctcat

SEQ ID NO: 5159887 - DNA, 14 bp, Homo sapiens
actcagcactctgg

SEQ ID NO: 5159888 - DNA, 18 bp, Homo sapiens
actcagcagacatttatc

SEQ ID NO: 5159889 - DNA, 21 bp, Homo sapiens
actcagcagccctcctcaccc

SEQ ID NO: 5159890 - DNA, 14 bp, Homo sapiens
actcagcagcctgc

SEQ ID NO: 5159891 - DNA, 12 bp, Homo sapiens
actcagcagtga

SEQ ID NO: 5159892 - DNA, 13 bp, Homo sapiens
actcagcagttga

SEQ ID NO: 5159893 - DNA, 16 bp, Homo sapiens
actcagcagttgacat

SEQ ID NO: 5159894 - DNA, 15 bp, Homo sapiens
actcagcatcaccca

SEQ ID NO: 5159895 - DNA, 14 bp, Homo sapiens
actcagccaagaca

SEQ ID NO: 5159896 - DNA, 15 bp, Homo sapiens
actcagccacacccc

SEQ ID NO: 5159897 - DNA, 15 bp, Homo sapiens
actcagccacgacca

SEQ ID NO: 5159898 - DNA, 18 bp, Homo sapiens
actcagccacgaccagcc

SEQ ID NO: 5159899 - DNA, 20 bp, Homo sapiens
actcagccacgaccagcccc

SEQ ID NO: 5159900 - DNA, 22 bp, Homo sapiens
actcagccacgaccagcccctt

SEQ ID NO: 5159901 - DNA, 19 bp, Homo sapiens
actcagccactgtcacagg

SEQ ID NO: 5159902 - DNA, 22 bp, Homo sapiens
actcagccactgtcacaggcat

SEQ ID NO: 5159903 - DNA, 14 bp, Homo sapiens
actcagccattctc

SEQ ID NO: 5159904 - DNA, 16 bp, Homo sapiens
actcagcccacctgca

SEQ ID NO: 5159905 - DNA, 11 bp, Homo sapiens
actcagcccag

SEQ ID NO: 5159906 - DNA, 12 bp, Homo sapiens
actcagcccagc

SEQ ID NO: 5159907 - DNA, 13 bp, Homo sapiens
actcagcccagct

SEQ ID NO: 5159908 - DNA, 20 bp, Homo sapiens
actcagcccctacccctgcc

SEQ ID NO: 5159909 - DNA, 22 bp, Homo sapiens
actcagcccctacccctgccct

SEQ ID NO: 5159910 - DNA, 16 bp, Homo sapiens
actcagcccctaggag

SEQ ID NO: 5159911 - DNA, 14 bp, Homo sapiens
actcagccccttcc

SEQ ID NO: 5159912 - DNA, 17 bp, Homo sapiens
actcagccctcattggc

SEQ ID NO: 5159913 - DNA, 13 bp, Homo sapiens
actcagccctggg

SEQ ID NO: 5159914 - DNA, 15 bp, Homo sapiens
actcagccctgggcc

SEQ ID NO: 5159915 - DNA, 16 bp, Homo sapiens
actcagccctgggccc

SEQ ID NO: 5159916 - DNA, 22 bp, Homo sapiens
actcagccctgggccccaccac

SEQ ID NO: 5159917 - DNA, 23 bp, Homo sapiens
actcagccggcgtggcaaatata

SEQ ID NO: 5159918 - DNA, 22 bp, Homo sapiens
actcagcctcaataagccttgt

SEQ ID NO: 5159919 - DNA, 20 bp, Homo sapiens
actcagcctcattcagcatg

SEQ ID NO: 5159920 - DNA, 16 bp, Homo sapiens
actcagcctctgctgg

SEQ ID NO: 5159921 - DNA, 21 bp, Homo sapiens
actcagcctgcagttaattag

SEQ ID NO: 5159922 - DNA, 13 bp, Homo sapiens
actcagcctgttc

SEQ ID NO: 5159923 - DNA, 21 bp, Homo sapiens
actcagcctgttccttcctgc

SEQ ID NO: 5159924 - DNA, 16 bp, Homo sapiens
actcagccttaagaaa

SEQ ID NO: 5159925 - DNA, 19 bp, Homo sapiens
actcagccttgcaaatagc

SEQ ID NO: 5159926 - DNA, 22 bp, Homo sapiens
actcagccttttgggaataata

SEQ ID NO: 5159927 - DNA, 19 bp, Homo sapiens
actcagcgctcctcctgtg

SEQ ID NO: 5159928 - DNA, 21 bp, Homo sapiens
actcagcgctcctcctgtgtg

SEQ ID NO: 5159929 - DNA, 14 bp, Homo sapiens
actcagctaatgtc

SEQ ID NO: 5159930 - DNA, 14 bp, Homo sapiens
actcagctccccag

SEQ ID NO: 5159931 - DNA, 19 bp, Homo sapiens
actcagctccccagagtcc

SEQ ID NO: 5159932 - DNA, 11 bp, Homo sapiens
actcagctctg

SEQ ID NO: 5159933 - DNA, 12 bp, Homo sapiens
actcagctctgt

SEQ ID NO: 5159934 - DNA, 13 bp, Homo sapiens
actcagctctgtc

SEQ ID NO: 5159935 - DNA, 18 bp, Homo sapiens
actcagctgtcctgcagc

SEQ ID NO: 5159936 - DNA, 19 bp, Homo sapiens
actcagcttggttcctgcc

SEQ ID NO: 5159937 - DNA, 21 bp, Homo sapiens
actcagcttggttcctgcccc

SEQ ID NO: 5159938 - DNA, 20 bp, Homo sapiens
actcagctttctttaaagtt

SEQ ID NO: 5159939 - DNA, 23 bp, Homo sapiens
actcaggaactatggcaaggaac

SEQ ID NO: 5159940 - DNA, 12 bp, Homo sapiens
actcaggaactt

SEQ ID NO: 5159941 - DNA, 16 bp, Homo sapiens
actcaggactccagcc

SEQ ID NO: 5159942 - DNA, 11 bp, Homo sapiens
actcaggagcc

SEQ ID NO: 5159943 - DNA, 21 bp, Homo sapiens
actcaggaggctgaggcagga

SEQ ID NO: 5159944 - DNA, 17 bp, Homo sapiens
actcaggagtctgccac

SEQ ID NO: 5159945 - DNA, 14 bp, Homo sapiens
actcaggatgccca

SEQ ID NO: 5159946 - DNA, 18 bp, Homo sapiens
actcaggatgcccagggc

SEQ ID NO: 5159947 - DNA, 17 bp, Homo sapiens
actcaggatttaaaaac

SEQ ID NO: 5159948 - DNA, 15 bp, Homo sapiens
actcaggcagcctgt

SEQ ID NO: 5159949 - DNA, 14 bp, Homo sapiens
actcaggccacagt

SEQ ID NO: 5159950 - DNA, 22 bp, Homo sapiens
actcaggcccccacctggctca

SEQ ID NO: 5159951 - DNA, 23 bp, Homo sapiens
actcaggcccccacctggctcac

SEQ ID NO: 5159952 - DNA, 14 bp, Homo sapiens
actcaggcctctgc

SEQ ID NO: 5159953 - DNA, 15 bp, Homo sapiens
actcaggcctctgca

SEQ ID NO: 5159954 - DNA, 19 bp, Homo sapiens
actcaggcctgccaatgcc

SEQ ID NO: 5159955 - DNA, 16 bp, Homo sapiens
actcaggcctgtgccc

SEQ ID NO: 5159956 - DNA, 21 bp, Homo sapiens
actcaggcctgtgcccactcc

SEQ ID NO: 5159957 - DNA, 22 bp, Homo sapiens
actcaggcgcctggcacatttc

SEQ ID NO: 5159958 - DNA, 14 bp, Homo sapiens
actcaggctctcca

SEQ ID NO: 5159959 - DNA, 12 bp, Homo sapiens
actcaggctgga

SEQ ID NO: 5159960 - DNA, 15 bp, Homo sapiens
actcaggctttcact

SEQ ID NO: 5159961 - DNA, 20 bp, Homo sapiens
actcagggacagagccatgc

SEQ ID NO: 5159962 - DNA, 17 bp, Homo sapiens
actcagggaccggtgct

SEQ ID NO: 5159963 - DNA, 23 bp, Homo sapiens
actcagggaccggtgctgcagga

SEQ ID NO: 5159964 - DNA, 20 bp, Homo sapiens
actcagggaggctaaatcag

SEQ ID NO: 5159965 - DNA, 21 bp, Homo sapiens
actcagggcagcgccaggctg

SEQ ID NO: 5159966 - DNA, 14 bp, Homo sapiens
actcagggcagctg

SEQ ID NO: 5159967 - DNA, 15 bp, Homo sapiens
actcagggcagctgc

SEQ ID NO: 5159968 - DNA, 16 bp, Homo sapiens
actcagggcagctgcc

SEQ ID NO: 5159969 - DNA, 15 bp, Homo sapiens
actcagggccccagc

SEQ ID NO: 5159970 - DNA, 18 bp, Homo sapiens
actcagggccccagcact

SEQ ID NO: 5159971 - DNA, 19 bp, Homo sapiens
actcagggctcctcccagc

SEQ ID NO: 5159972 - DNA, 22 bp, Homo sapiens
actcagggctcctcccagcttg

SEQ ID NO: 5159973 - DNA, 13 bp, Homo sapiens
actcagggctggc

SEQ ID NO: 5159974 - DNA, 16 bp, Homo sapiens
actcagggctggcccg

SEQ ID NO: 5159975 - DNA, 18 bp, Homo sapiens
actcagggcttctagttt

SEQ ID NO: 5159976 - DNA, 16 bp, Homo sapiens
actcagggcttctcct

SEQ ID NO: 5159977 - DNA, 21 bp, Homo sapiens
actcaggggatgtttacctgg

SEQ ID NO: 5159978 - DNA, 19 bp, Homo sapiens
actcaggggtcactgaggc

SEQ ID NO: 5159979 - DNA, 21 bp, Homo sapiens
actcagggttaggaatcctag

SEQ ID NO: 5159980 - DNA, 14 bp, Homo sapiens
actcaggtctgtaa

SEQ ID NO: 5159981 - DNA, 19 bp, Homo sapiens
actgccaggcacctggcct

SEQ ID NO: 5159982 - DNA, 16 bp, Homo sapiens
actgccaggccagcct

SEQ ID NO: 5159983 - DNA, 19 bp, Homo sapiens
actgccaggccagcctccg

SEQ ID NO: 5159984 - DNA, 13 bp, Homo sapiens
actgccaggctct

SEQ ID NO: 5159985 - DNA, 14 bp, Homo sapiens
actgccaggctctc

SEQ ID NO: 5159986 - DNA, 13 bp, Homo sapiens
actgccaggctgc

SEQ ID NO: 5159987 - DNA, 18 bp, Homo sapiens
actgccagggccgcggcc

SEQ ID NO: 5159988 - DNA, 24 bp, Homo sapiens
actgccagggccgcggccgcccgc

SEQ ID NO: 5159989 - DNA, 19 bp, Homo sapiens
actgccagtccccctgccc

SEQ ID NO: 5159990 - DNA, 16 bp, Homo sapiens
actgccagtctcactg

SEQ ID NO: 5159991 - DNA, 13 bp, Homo sapiens
actgccataaaac

SEQ ID NO: 5159992 - DNA, 23 bp, Homo sapiens
actgccataaaacattaagaaaa

SEQ ID NO: 5159993 - DNA, 17 bp, Homo sapiens
actgccataacttgttt

SEQ ID NO: 5159994 - DNA, 17 bp, Homo sapiens
actgccatattgtgtaa

SEQ ID NO: 5159995 - DNA, 21 bp, Homo sapiens
actgccatgatagctggggct

SEQ ID NO: 5159996 - DNA, 16 bp, Homo sapiens
actgccatgcagggcc

SEQ ID NO: 5159997 - DNA, 20 bp, Homo sapiens
actgccatgcctcaagaaca

SEQ ID NO: 5159998 - DNA, 20 bp, Homo sapiens
actgccatggaattccctcc

SEQ ID NO: 5159999 - DNA, 18 bp, Homo sapiens
actgccatggaggcacac

SEQ ID NO: 5160000 - DNA, 21 bp, Homo sapiens
actgccatgtactagttttag

SEQ ID NO: 5160001 - DNA, 23 bp, Homo sapiens
actgccatgtcaggggtttgctt

SEQ ID NO: 5160002 - DNA, 19 bp, Homo sapiens
actgccattagactgaatt

SEQ ID NO: 5160003 - DNA, 21 bp, Homo sapiens
actgccattattttctgtcag

SEQ ID NO: 5160004 - DNA, 12 bp, Homo sapiens
actgccattttt

SEQ ID NO: 5160005 - DNA, 14 bp, Homo sapiens
actgccattttttg

SEQ ID NO: 5160006 - DNA, 19 bp, Homo sapiens
actgcccaaagtgcttcca

SEQ ID NO: 5160007 - DNA, 15 bp, Homo sapiens
actgcccaaatagga

SEQ ID NO: 5160008 - DNA, 18 bp, Homo sapiens
actgcccacatttgggct

SEQ ID NO: 5160009 - DNA, 14 bp, Homo sapiens
actgcccaccaaag

SEQ ID NO: 5160010 - DNA, 16 bp, Homo sapiens
actgcccaccaaaggt

SEQ ID NO: 5160011 - DNA, 17 bp, Homo sapiens
actgcccaccccctcaa

SEQ ID NO: 5160012 - DNA, 13 bp, Homo sapiens
actgcccaccctg

SEQ ID NO: 5160013 - DNA, 16 bp, Homo sapiens
actgcccaccctgggc

SEQ ID NO: 5160014 - DNA, 18 bp, Homo sapiens
actgcccacctgccaggc

SEQ ID NO: 5160015 - DNA, 19 bp, Homo sapiens
actgcccacctgccaggct

SEQ ID NO: 5160016 - DNA, 15 bp, Homo sapiens
actgcccagatgttt

SEQ ID NO: 5160017 - DNA, 11 bp, Homo sapiens
actgcccagca

SEQ ID NO: 5160018 - DNA, 13 bp, Homo sapiens
actgcccagcccc

SEQ ID NO: 5160019 - DNA, 14 bp, Homo sapiens
actgcccagcccct

SEQ ID NO: 5160020 - DNA, 16 bp, Homo sapiens
actgcccagcggacag

SEQ ID NO: 5160021 - DNA, 15 bp, Homo sapiens
actgcccagggaagc

SEQ ID NO: 5160022 - DNA, 23 bp, Homo sapiens
actgcccatcagtgacagactgg

SEQ ID NO: 5160023 - DNA, 19 bp, Homo sapiens
actgcccatggacaggctg

SEQ ID NO: 5160024 - DNA, 21 bp, Homo sapiens
actgcccatggacaggctggc

SEQ ID NO: 5160025 - DNA, 19 bp, Homo sapiens
actgccccaccagccacct

SEQ ID NO: 5160026 - DNA, 19 bp, Homo sapiens
actgccccacttctggcat

SEQ ID NO: 5160027 - DNA, 16 bp, Homo sapiens
actgccccagccaacg

SEQ ID NO: 5160028 - DNA, 12 bp, Homo sapiens
actgccccaggg

SEQ ID NO: 5160029 - DNA, 14 bp, Homo sapiens
actgccccatctcc

SEQ ID NO: 5160030 - DNA, 23 bp, Homo sapiens
actgcccccagaaagcctcctgc

SEQ ID NO: 5160031 - DNA, 19 bp, Homo sapiens
actgccccccgaggctgct

SEQ ID NO: 5160032 - DNA, 20 bp, Homo sapiens
actgccccccgaggctgcta

SEQ ID NO: 5160033 - DNA, 20 bp, Homo sapiens
actgcccccctcctttccaa

SEQ ID NO: 5160034 - DNA, 18 bp, Homo sapiens
actgccccctcctgtgta

SEQ ID NO: 5160035 - DNA, 16 bp, Homo sapiens
actgccccctctgccc

SEQ ID NO: 5160036 - DNA, 19 bp, Homo sapiens
actgccccctctgccctgc

SEQ ID NO: 5160037 - DNA, 17 bp, Homo sapiens
actgccccctgctgcca

SEQ ID NO: 5160038 - DNA, 19 bp, Homo sapiens
actgccccctgctgccatg

SEQ ID NO: 5160039 - DNA, 17 bp, Homo sapiens
actgccccgtgcagact

SEQ ID NO: 5160040 - DNA, 23 bp, Homo sapiens
actgccccgtgcagactggaggg

SEQ ID NO: 5160041 - DNA, 15 bp, Homo sapiens
actgcccctgccctg

SEQ ID NO: 5160042 - DNA, 17 bp, Homo sapiens
actgcccctgccctgag

SEQ ID NO: 5160043 - DNA, 19 bp, Homo sapiens
actgcccctgccctgagga

SEQ ID NO: 5160044 - DNA, 22 bp, Homo sapiens
actgcccctgctgtgctgctca

SEQ ID NO: 5160045 - DNA, 18 bp, Homo sapiens
actgcccgagctggtgca

SEQ ID NO: 5160046 - DNA, 22 bp, Homo sapiens
actgcccgagctggtgcattac

SEQ ID NO: 5160047 - DNA, 14 bp, Homo sapiens
actgcccgcacacc

SEQ ID NO: 5160048 - DNA, 19 bp, Homo sapiens
actgcccgcacaccctcac

SEQ ID NO: 5160049 - DNA, 22 bp, Homo sapiens
actgcccggcagggtcctagaa

SEQ ID NO: 5160050 - DNA, 20 bp, Homo sapiens
actgccctaagcccccaggg

SEQ ID NO: 5160051 - DNA, 22 bp, Homo sapiens
actgccctaagcccccagggcc

SEQ ID NO: 5160052 - DNA, 15 bp, Homo sapiens
actgccctactggga

SEQ ID NO: 5160053 - DNA, 20 bp, Homo sapiens
actgccctactgggagactg

SEQ ID NO: 5160054 - DNA, 23 bp, Homo sapiens
actgccctccagctctttcctcc

SEQ ID NO: 5160055 - DNA, 14 bp, Homo sapiens
actgccctccaggg

SEQ ID NO: 5160056 - DNA, 20 bp, Homo sapiens
actgccctccagggccagga

SEQ ID NO: 5160057 - DNA, 18 bp, Homo sapiens
actgccctccccttcccc

SEQ ID NO: 5160058 - DNA, 24 bp, Homo sapiens
actgccctctccacacccatgact

SEQ ID NO: 5160059 - DNA, 13 bp, Homo sapiens
actgccctctgaa

SEQ ID NO: 5160060 - DNA, 14 bp, Homo sapiens
actgccctctgttc

SEQ ID NO: 5160061 - DNA, 14 bp, Homo sapiens
actgccctgcctgc

SEQ ID NO: 5160062 - DNA, 17 bp, Homo sapiens
actgccctgcctgccca

SEQ ID NO: 5160063 - DNA, 23 bp, Homo sapiens
actgccctgcctgcccacttagc

SEQ ID NO: 5160064 - DNA, 12 bp, Homo sapiens
actgccctggca

SEQ ID NO: 5160065 - DNA, 14 bp, Homo sapiens
actgccctggcagc

SEQ ID NO: 5160066 - DNA, 18 bp, Homo sapiens
actgccctggcagcagca

SEQ ID NO: 5160067 - DNA, 12 bp, Homo sapiens
actgccctggct

SEQ ID NO: 5160068 - DNA, 11 bp, Homo sapiens
actgccctggt

SEQ ID NO: 5160069 - DNA, 13 bp, Homo sapiens
actgccctgtcta

SEQ ID NO: 5160070 - DNA, 20 bp, Homo sapiens
actgccctgttcatgtgcct

SEQ ID NO: 5160071 - DNA, 12 bp, Homo sapiens
actgcccttctc

SEQ ID NO: 5160072 - DNA, 13 bp, Homo sapiens
actgcccttctca

SEQ ID NO: 5160073 - DNA, 16 bp, Homo sapiens
actgcccttgctgccc

SEQ ID NO: 5160074 - DNA, 17 bp, Homo sapiens
actgcccttgctgcccg

SEQ ID NO: 5160075 - DNA, 17 bp, Homo sapiens
actgcccttttaaatgg

SEQ ID NO: 5160076 - DNA, 17 bp, Homo sapiens
actgcccttttcaggaa

SEQ ID NO: 5160077 - DNA, 21 bp, Homo sapiens
actgccgaagaattgtcttgc

SEQ ID NO: 5160078 - DNA, 17 bp, Homo sapiens
actgccgacatcagcat

SEQ ID NO: 5160079 - DNA, 14 bp, Homo sapiens
actgccgcctcctt

SEQ ID NO: 5160080 - DNA, 14 bp, Homo sapiens
actgccgctgcccc

SEQ ID NO: 5160081 - DNA, 15 bp, Homo sapiens
actgccgctgccccc

SEQ ID NO: 5160082 - DNA, 16 bp, Homo sapiens
actgccgctgccccca

SEQ ID NO: 5160083 - DNA, 17 bp, Homo sapiens
actgccgctgcccccac

SEQ ID NO: 5160084 - DNA, 15 bp, Homo sapiens
actgccgtaatttaa

SEQ ID NO: 5160085 - DNA, 13 bp, Homo sapiens
actgcctaaaatt

SEQ ID NO: 5160086 - DNA, 12 bp, Homo sapiens
actgcctaccca

SEQ ID NO: 5160087 - DNA, 23 bp, Homo sapiens
actgcctacccaccccttcccgc

SEQ ID NO: 5160088 - DNA, 13 bp, Homo sapiens
actgcctactgtt

SEQ ID NO: 5160089 - DNA, 13 bp, Homo sapiens
actgcctagaaac

SEQ ID NO: 5160090 - DNA, 21 bp, Homo sapiens
actgcctaggaggctggccaa

SEQ ID NO: 5160091 - DNA, 13 bp, Homo sapiens
actgcctagtgta

SEQ ID NO: 5160092 - DNA, 16 bp, Homo sapiens
actgcctataatctta

SEQ ID NO: 5160093 - DNA, 21 bp, Homo sapiens
actgcctataatcttatacaa

SEQ ID NO: 5160094 - DNA, 12 bp, Homo sapiens
actgcctcaggt

SEQ ID NO: 5160095 - DNA, 13 bp, Homo sapiens
actgcctcaggtt

SEQ ID NO: 5160096 - DNA, 13 bp, Homo sapiens
actgcctccccca

SEQ ID NO: 5160097 - DNA, 18 bp, Homo sapiens
actgcctccctctcttcc

SEQ ID NO: 5160098 - DNA, 10 bp, Homo sapiens
actgcctcct

SEQ ID NO: 5160099 - DNA, 11 bp, Homo sapiens
actgcctcctc

SEQ ID NO: 5160100 - DNA, 23 bp, Homo sapiens
actgcctcctccctggctgcagc

SEQ ID NO: 5160101 - DNA, 17 bp, Homo sapiens
actgcctcctgcctggg

SEQ ID NO: 5160102 - DNA, 16 bp, Homo sapiens
actgcctcctgttttc

SEQ ID NO: 5160103 - DNA, 21 bp, Homo sapiens
actgcctcctgttttctccct

SEQ ID NO: 5160104 - DNA, 19 bp, Homo sapiens
actgcctccttgccagccc

SEQ ID NO: 5160105 - DNA, 17 bp, Homo sapiens
actgcctctatgccctg

SEQ ID NO: 5160106 - DNA, 18 bp, Homo sapiens
actgcctctatgccctgc

SEQ ID NO: 5160107 - DNA, 20 bp, Homo sapiens
actgcctctatgccctgcag

SEQ ID NO: 5160108 - DNA, 23 bp, Homo sapiens
actgcctctatgccctgcagagc

SEQ ID NO: 5160109 - DNA, 15 bp, Homo sapiens
actgcctctcacagc

SEQ ID NO: 5160110 - DNA, 13 bp, Homo sapiens
actgcctctccct

SEQ ID NO: 5160111 - DNA, 14 bp, Homo sapiens
actgcctctccctc

SEQ ID NO: 5160112 - DNA, 16 bp, Homo sapiens
actgcctctccctctg

SEQ ID NO: 5160113 - DNA, 17 bp, Homo sapiens
actgcctctccctggcc

SEQ ID NO: 5160114 - DNA, 18 bp, Homo sapiens
actgcctctccctggccc

SEQ ID NO: 5160115 - DNA, 13 bp, Homo sapiens
actgcctctgcca

SEQ ID NO: 5160116 - DNA, 15 bp, Homo sapiens
actgcctcttcctcc

SEQ ID NO: 5160117 - DNA, 19 bp, Homo sapiens
actgcctgaataaagagcc

SEQ ID NO: 5160118 - DNA, 16 bp, Homo sapiens
actgcctgaccttgga

SEQ ID NO: 5160119 - DNA, 20 bp, Homo sapiens
actgcctgatggacctgtca

SEQ ID NO: 5160120 - DNA, 22 bp, Homo sapiens
actgcctgcagaggtctgtgct

SEQ ID NO: 5160121 - DNA, 16 bp, Homo sapiens
actgcctgcagctgag

SEQ ID NO: 5160122 - DNA, 15 bp, Homo sapiens
actgcctgcatgagc

SEQ ID NO: 5160123 - DNA, 12 bp, Homo sapiens
actgcctgccaa

SEQ ID NO: 5160124 - DNA, 16 bp, Homo sapiens
actgcctgccaccgcg

SEQ ID NO: 5160125 - DNA, 12 bp, Homo sapiens
actgcctgccca

SEQ ID NO: 5160126 - DNA, 13 bp, Homo sapiens
actgcctgcctta

SEQ ID NO: 5160127 - DNA, 14 bp, Homo sapiens
actgcctgccttaa

SEQ ID NO: 5160128 - DNA, 18 bp, Homo sapiens
actgcctgccttaagtga

SEQ ID NO: 5160129 - DNA, 19 bp, Homo sapiens
actgcctgctcccatcctg

SEQ ID NO: 5160130 - DNA, 22 bp, Homo sapiens
actgcctggatgtgtttgattt

SEQ ID NO: 5160131 - DNA, 18 bp, Homo sapiens
actgcctgtagagacaat

SEQ ID NO: 5160132 - DNA, 23 bp, Homo sapiens
actgcctgtagcaatggccagag

SEQ ID NO: 5160133 - DNA, 15 bp, Homo sapiens
actgcctgtatactt

SEQ ID NO: 5160134 - DNA, 16 bp, Homo sapiens
actgcctgtctccatg

SEQ ID NO: 5160135 - DNA, 14 bp, Homo sapiens
actgccttaaaact

SEQ ID NO: 5160136 - DNA, 23 bp, Homo sapiens
actgccttaataaaaaatgaaaa

SEQ ID NO: 5160137 - DNA, 16 bp, Homo sapiens
actgccttagcctctt

SEQ ID NO: 5160138 - DNA, 22 bp, Homo sapiens
actgccttatattattttctgt

SEQ ID NO: 5160139 - DNA, 21 bp, Homo sapiens
actgccttcagtatcaaggct

SEQ ID NO: 5160140 - DNA, 12 bp, Homo sapiens
actgccttcctc

SEQ ID NO: 5160141 - DNA, 15 bp, Homo sapiens
actgccttcctcctt

SEQ ID NO: 5160142 - DNA, 21 bp, Homo sapiens
actgccttcgcttcttgcctc

SEQ ID NO: 5160143 - DNA, 19 bp, Homo sapiens
actgccttctcaactccaa

SEQ ID NO: 5160144 - DNA, 22 bp, Homo sapiens
actgccttctcaactccaaact

SEQ ID NO: 5160145 - DNA, 15 bp, Homo sapiens
actgccttgaaaaat

SEQ ID NO: 5160146 - DNA, 19 bp, Homo sapiens
actgccttgaaaaatgaca

SEQ ID NO: 5160147 - DNA, 23 bp, Homo sapiens
actgccttgaaaaatgacaattg

SEQ ID NO: 5160148 - DNA, 23 bp, Homo sapiens
actgccttgaacctgtgagtaaa

SEQ ID NO: 5160149 - DNA, 18 bp, Homo sapiens
actgccttgaatatcccc

SEQ ID NO: 5160150 - DNA, 15 bp, Homo sapiens
actgccttgcctcct

SEQ ID NO: 5160151 - DNA, 19 bp, Homo sapiens
actgccttgcctcctcagt

SEQ ID NO: 5160152 - DNA, 20 bp, Homo sapiens
actgccttggcccctccctc

SEQ ID NO: 5160153 - DNA, 20 bp, Homo sapiens
actgccttgtttaatgttaa

SEQ ID NO: 5160154 - DNA, 19 bp, Homo sapiens
actgcctttagaaaatata

SEQ ID NO: 5160155 - DNA, 22 bp, Homo sapiens
actgcctttcaaagtgcacaca

SEQ ID NO: 5160156 - DNA, 20 bp, Homo sapiens
actgcctttgctgccttctg

SEQ ID NO: 5160157 - DNA, 21 bp, Homo sapiens
actgcctttgctgccttctgt

SEQ ID NO: 5160158 - DNA, 16 bp, Homo sapiens
actgcctttggcagag

SEQ ID NO: 5160159 - DNA, 19 bp, Homo sapiens
actgcctttggcagagttc

SEQ ID NO: 5160160 - DNA, 13 bp, Homo sapiens
actcaggtgcaca

SEQ ID NO: 5160161 - DNA, 13 bp, Homo sapiens
actcaggtgggcc

SEQ ID NO: 5160162 - DNA, 19 bp, Homo sapiens
actcaggtgggccctctga

SEQ ID NO: 5160163 - DNA, 14 bp, Homo sapiens
actcaggttccaga

SEQ ID NO: 5160164 - DNA, 23 bp, Homo sapiens
actcaggttccagaacagccctc

SEQ ID NO: 5160165 - DNA, 14 bp, Homo sapiens
actcagtaatttgt

SEQ ID NO: 5160166 - DNA, 20 bp, Homo sapiens
actcagtagctgaacctgtc

SEQ ID NO: 5160167 - DNA, 21 bp, Homo sapiens
actcagtagctgaacctgtct

SEQ ID NO: 5160168 - DNA, 14 bp, Homo sapiens
actcagtcagccca

SEQ ID NO: 5160169 - DNA, 16 bp, Homo sapiens
actcagtccactgttg

SEQ ID NO: 5160170 - DNA, 14 bp, Homo sapiens
actcagtcccccac

SEQ ID NO: 5160171 - DNA, 18 bp, Homo sapiens
actcagtcccccaccaca

SEQ ID NO: 5160172 - DNA, 20 bp, Homo sapiens
actcagtctagtgaagatgt

SEQ ID NO: 5160173 - DNA, 19 bp, Homo sapiens
actcagtctctcttctctc

SEQ ID NO: 5160174 - DNA, 15 bp, Homo sapiens
actcagtctcttcca

SEQ ID NO: 5160175 - DNA, 16 bp, Homo sapiens
actcagtctcttccac

SEQ ID NO: 5160176 - DNA, 18 bp, Homo sapiens
actcagtctgtgggagct

SEQ ID NO: 5160177 - DNA, 22 bp, Homo sapiens
actcagtctgtgggagctcagc

SEQ ID NO: 5160178 - DNA, 13 bp, Homo sapiens
actcagtctttaa

SEQ ID NO: 5160179 - DNA, 20 bp, Homo sapiens
actcagtgaaatcatattaa

SEQ ID NO: 5160180 - DNA, 21 bp, Homo sapiens
actcagtgagcctcctgtgcc

SEQ ID NO: 5160181 - DNA, 23 bp, Homo sapiens
actcagtgagcctcctgtgcctg

SEQ ID NO: 5160182 - DNA, 23 bp, Homo sapiens
actcagtgagctggggccgtctg

SEQ ID NO: 5160183 - DNA, 11 bp, Homo sapiens
actcagtgcag

SEQ ID NO: 5160184 - DNA, 14 bp, Homo sapiens
actcagtgccacac

SEQ ID NO: 5160185 - DNA, 16 bp, Homo sapiens
actcagtgggctgttt

SEQ ID NO: 5160186 - DNA, 16 bp, Homo sapiens
actcagtggggctggc

SEQ ID NO: 5160187 - DNA, 20 bp, Homo sapiens
actcagtgggttaacatcag

SEQ ID NO: 5160188 - DNA, 18 bp, Homo sapiens
actcagtgttagagaaat

SEQ ID NO: 5160189 - DNA, 20 bp, Homo sapiens
actcagtgttagagaaatcc

SEQ ID NO: 5160190 - DNA, 13 bp, Homo sapiens
actcagttattac

SEQ ID NO: 5160191 - DNA, 17 bp, Homo sapiens
actcagttcaaaccatt

SEQ ID NO: 5160192 - DNA, 21 bp, Homo sapiens
actcagttcaaaccatttcag

SEQ ID NO: 5160193 - DNA, 22 bp, Homo sapiens
actcagttccaaagtcacagga

SEQ ID NO: 5160194 - DNA, 17 bp, Homo sapiens
actcagttccaggcctg

SEQ ID NO: 5160195 - DNA, 20 bp, Homo sapiens
actcagtttatgttgtacaa

SEQ ID NO: 5160196 - DNA, 22 bp, Homo sapiens
actcagtttcacaagtgagccc

SEQ ID NO: 5160197 - DNA, 14 bp, Homo sapiens
actcagtttgtcag

SEQ ID NO: 5160198 - DNA, 21 bp, Homo sapiens
actcataaaaagcctgcaatt

SEQ ID NO: 5160199 - DNA, 19 bp, Homo sapiens
actcataaaggacactgga

SEQ ID NO: 5160200 - DNA, 15 bp, Homo sapiens
actcataagagttta

SEQ ID NO: 5160201 - DNA, 23 bp, Homo sapiens
actcataatctataaacaatgaa

SEQ ID NO: 5160202 - DNA, 19 bp, Homo sapiens
actcataatgtgaagtgtt

SEQ ID NO: 5160203 - DNA, 21 bp, Homo sapiens
actcatacagtctctatttga

SEQ ID NO: 5160204 - DNA, 17 bp, Homo sapiens
actcatacctttaaagg

SEQ ID NO: 5160205 - DNA, 21 bp, Homo sapiens
actcatactgtgctggagcca

SEQ ID NO: 5160206 - DNA, 18 bp, Homo sapiens
actcatagatgttatgca

SEQ ID NO: 5160207 - DNA, 17 bp, Homo sapiens
actcatagattgcaaat

SEQ ID NO: 5160208 - DNA, 21 bp, Homo sapiens
actcatagattgcaaatattg

SEQ ID NO: 5160209 - DNA, 13 bp, Homo sapiens
actcatagttttt

SEQ ID NO: 5160210 - DNA, 22 bp, Homo sapiens
actcatataaaaggtgagctca

SEQ ID NO: 5160211 - DNA, 18 bp, Homo sapiens
actcatataattatatgt

SEQ ID NO: 5160212 - DNA, 22 bp, Homo sapiens
actcatatcccctatttaacag

SEQ ID NO: 5160213 - DNA, 13 bp, Homo sapiens
actcatattactg

SEQ ID NO: 5160214 - DNA, 14 bp, Homo sapiens
actcatattttgaa

SEQ ID NO: 5160215 - DNA, 15 bp, Homo sapiens
actcatcacataaag

SEQ ID NO: 5160216 - DNA, 18 bp, Homo sapiens
actcatcacataaagaaa

SEQ ID NO: 5160217 - DNA, 16 bp, Homo sapiens
actcatcactgtggct

SEQ ID NO: 5160218 - DNA, 12 bp, Homo sapiens
actcatcagagc

SEQ ID NO: 5160219 - DNA, 14 bp, Homo sapiens
actcatcataaaat

SEQ ID NO: 5160220 - DNA, 16 bp, Homo sapiens
actcatcataaaataa

SEQ ID NO: 5160221 - DNA, 17 bp, Homo sapiens
actcatcataaaataaa

SEQ ID NO: 5160222 - DNA, 16 bp, Homo sapiens
actcatcattttctac

SEQ ID NO: 5160223 - DNA, 18 bp, Homo sapiens
actcatccagaactgtct

SEQ ID NO: 5160224 - DNA, 12 bp, Homo sapiens
actcatccatta

SEQ ID NO: 5160225 - DNA, 23 bp, Homo sapiens
actcatcctcttttaatggcatt

SEQ ID NO: 5160226 - DNA, 17 bp, Homo sapiens
actcatcctgaacagca

SEQ ID NO: 5160227 - DNA, 19 bp, Homo sapiens
actcatcctgtgtggggag

SEQ ID NO: 5160228 - DNA, 18 bp, Homo sapiens
actcatcgggcccaggga

SEQ ID NO: 5160229 - DNA, 17 bp, Homo sapiens
actcatcgttctaaaat

SEQ ID NO: 5160230 - DNA, 21 bp, Homo sapiens
actcatctaggtaaattacag

SEQ ID NO: 5160231 - DNA, 13 bp, Homo sapiens
actcatctgaaat

SEQ ID NO: 5160232 - DNA, 16 bp, Homo sapiens
actcatctgaaatgtt

SEQ ID NO: 5160233 - DNA, 17 bp, Homo sapiens
actcatctgaaatgtta

SEQ ID NO: 5160234 - DNA, 19 bp, Homo sapiens
actcatctgaaatgttaca

SEQ ID NO: 5160235 - DNA, 21 bp, Homo sapiens
actcatctgtaaacttttata

SEQ ID NO: 5160236 - DNA, 19 bp, Homo sapiens
actcatcttatatgggaaa

SEQ ID NO: 5160237 - DNA, 23 bp, Homo sapiens
actcatcttggccctcctcagct

SEQ ID NO: 5160238 - DNA, 16 bp, Homo sapiens
actcatctttccctcc

SEQ ID NO: 5160239 - DNA, 17 bp, Homo sapiens
actcatctttccctcct

SEQ ID NO: 5160240 - DNA, 21 bp, Homo sapiens
actcatctttccctccttggt

SEQ ID NO: 5160241 - DNA, 15 bp, Homo sapiens
actcatgaacaaaat

SEQ ID NO: 5160242 - DNA, 22 bp, Homo sapiens
actcatgaacaaaatgaagtta

SEQ ID NO: 5160243 - DNA, 12 bp, Homo sapiens
actcatgaatga

SEQ ID NO: 5160244 - DNA, 23 bp, Homo sapiens
actcatgactgagtctggcaaac

SEQ ID NO: 5160245 - DNA, 18 bp, Homo sapiens
actcatgatcaagatata

SEQ ID NO: 5160246 - DNA, 15 bp, Homo sapiens
actcatgatcttgtg

SEQ ID NO: 5160247 - DNA, 22 bp, Homo sapiens
actcatgcaaactgctttattt

SEQ ID NO: 5160248 - DNA, 16 bp, Homo sapiens
actcatgcacacagat

SEQ ID NO: 5160249 - DNA, 16 bp, Homo sapiens
actcatgcctctgagc

SEQ ID NO: 5160250 - DNA, 18 bp, Homo sapiens
actcatgcctctgagctt

SEQ ID NO: 5160251 - DNA, 15 bp, Homo sapiens
actcatgcggcccag

SEQ ID NO: 5160252 - DNA, 19 bp, Homo sapiens
actcatgcggcccagccat

SEQ ID NO: 5160253 - DNA, 16 bp, Homo sapiens
actcatgctgaaagcc

SEQ ID NO: 5160254 - DNA, 22 bp, Homo sapiens
actcatgctggatgaccccatg

SEQ ID NO: 5160255 - DNA, 16 bp, Homo sapiens
actcatggggaagctt

SEQ ID NO: 5160256 - DNA, 13 bp, Homo sapiens
actcatgtacatt

SEQ ID NO: 5160257 - DNA, 23 bp, Homo sapiens
actcatgtctggagtcccctcct

SEQ ID NO: 5160258 - DNA, 16 bp, Homo sapiens
actcatgtgactcttt

SEQ ID NO: 5160259 - DNA, 21 bp, Homo sapiens
actcatgtgcaataggtgaga

SEQ ID NO: 5160260 - DNA, 20 bp, Homo sapiens
actcatgtgcagtcagcttt

SEQ ID NO: 5160261 - DNA, 10 bp, Homo sapiens
actcatgtgt

SEQ ID NO: 5160262 - DNA, 14 bp, Homo sapiens
actcatgttaattg

SEQ ID NO: 5160263 - DNA, 19 bp, Homo sapiens
actcatgttgttcccacac

SEQ ID NO: 5160264 - DNA, 20 bp, Homo sapiens
actcatgttgttcccacaca

SEQ ID NO: 5160265 - DNA, 22 bp, Homo sapiens
actcatgttgttcccacacaca

SEQ ID NO: 5160266 - DNA, 17 bp, Homo sapiens
actcattaattcaatga

SEQ ID NO: 5160267 - DNA, 13 bp, Homo sapiens
actcattaatttc

SEQ ID NO: 5160268 - DNA, 13 bp, Homo sapiens
actcattactgca

SEQ ID NO: 5160269 - DNA, 20 bp, Homo sapiens
actcattactgcaaattgat

SEQ ID NO: 5160270 - DNA, 21 bp, Homo sapiens
actcattactgcaaattgatt

SEQ ID NO: 5160271 - DNA, 14 bp, Homo sapiens
actcattagactgg

SEQ ID NO: 5160272 - DNA, 15 bp, Homo sapiens
actcattagactgga

SEQ ID NO: 5160273 - DNA, 21 bp, Homo sapiens
actcattcaaaagttgaaatt

SEQ ID NO: 5160274 - DNA, 23 bp, Homo sapiens
actcattcagggatagcactgag

SEQ ID NO: 5160275 - DNA, 15 bp, Homo sapiens
actcattccagatcc

SEQ ID NO: 5160276 - DNA, 13 bp, Homo sapiens
actcattcctgta

SEQ ID NO: 5160277 - DNA, 13 bp, Homo sapiens
actcattccttca

SEQ ID NO: 5160278 - DNA, 19 bp, Homo sapiens
actcattctgaaggagccc

SEQ ID NO: 5160279 - DNA, 19 bp, Homo sapiens
actcattctgaattaatta

SEQ ID NO: 5160280 - DNA, 23 bp, Homo sapiens
actcattcttcggtctgaatttt

SEQ ID NO: 5160281 - DNA, 13 bp, Homo sapiens
actcattgaaatg

SEQ ID NO: 5160282 - DNA, 19 bp, Homo sapiens
actcattgaaatgtcacgt

SEQ ID NO: 5160283 - DNA, 14 bp, Homo sapiens
actcattgacctga

SEQ ID NO: 5160284 - DNA, 13 bp, Homo sapiens
actcattgcagca

SEQ ID NO: 5160285 - DNA, 16 bp, Homo sapiens
actcattgcagcagat

SEQ ID NO: 5160286 - DNA, 17 bp, Homo sapiens
actcattgcagcagata

SEQ ID NO: 5160287 - DNA, 21 bp, Homo sapiens
actcattgcccccacctctgg

SEQ ID NO: 5160288 - DNA, 22 bp, Homo sapiens
actcattgcccccacctctggt

SEQ ID NO: 5160289 - DNA, 18 bp, Homo sapiens
actcattgctgagcctct

SEQ ID NO: 5160290 - DNA, 22 bp, Homo sapiens
actcattgctgagcctctgctc

SEQ ID NO: 5160291 - DNA, 23 bp, Homo sapiens
actcattgctgagcctctgctcc

SEQ ID NO: 5160292 - DNA, 15 bp, Homo sapiens
actcattgctggagg

SEQ ID NO: 5160293 - DNA, 19 bp, Homo sapiens
actcattgcttcacaaccc

SEQ ID NO: 5160294 - DNA, 22 bp, Homo sapiens
actcatttaaagctaaattttg

SEQ ID NO: 5160295 - DNA, 21 bp, Homo sapiens
actcatttataaagctaaaat

SEQ ID NO: 5160296 - DNA, 15 bp, Homo sapiens
actcatttctaaaag

SEQ ID NO: 5160297 - DNA, 21 bp, Homo sapiens
actcatttctaaaagaatatt

SEQ ID NO: 5160298 - DNA, 22 bp, Homo sapiens
actcatttgttaaaattatcaa

SEQ ID NO: 5160299 - DNA, 20 bp, Homo sapiens
actcattttaaaaaatggaa

SEQ ID NO: 5160300 - DNA, 19 bp, Homo sapiens
actcattttaatgattgtt

SEQ ID NO: 5160301 - DNA, 21 bp, Homo sapiens
actcattttattcactaagct

SEQ ID NO: 5160302 - DNA, 19 bp, Homo sapiens
actcattttcatattgtaa

SEQ ID NO: 5160303 - DNA, 22 bp, Homo sapiens
actcattttcatattgtaatct

SEQ ID NO: 5160304 - DNA, 19 bp, Homo sapiens
actcatttttcatgataat

SEQ ID NO: 5160305 - DNA, 23 bp, Homo sapiens
actcatttttcatgataatgaac

SEQ ID NO: 5160306 - DNA, 19 bp, Homo sapiens
actcatttttgccatacat

SEQ ID NO: 5160307 - DNA, 19 bp, Homo sapiens
actccaaacaattctgatg

SEQ ID NO: 5160308 - DNA, 14 bp, Homo sapiens
actccaaacctgtc

SEQ ID NO: 5160309 - DNA, 16 bp, Homo sapiens
actccaaacctgtctt

SEQ ID NO: 5160310 - DNA, 21 bp, Homo sapiens
actccaaactgactcttaaga

SEQ ID NO: 5160311 - DNA, 14 bp, Homo sapiens
actccaaagaaatg

SEQ ID NO: 5160312 - DNA, 14 bp, Homo sapiens
actccaaagagaaa

SEQ ID NO: 5160313 - DNA, 23 bp, Homo sapiens
actccaaagatgacttcccctgc

SEQ ID NO: 5160314 - DNA, 18 bp, Homo sapiens
actccaacagaagaactg

SEQ ID NO: 5160315 - DNA, 16 bp, Homo sapiens
actccaacatccactc

SEQ ID NO: 5160316 - DNA, 18 bp, Homo sapiens
actccaacatccactctc

SEQ ID NO: 5160317 - DNA, 19 bp, Homo sapiens
actccaacatccactctct

SEQ ID NO: 5160318 - DNA, 15 bp, Homo sapiens
actccaacctaacct

SEQ ID NO: 5160319 - DNA, 21 bp, Homo sapiens
actccaacctaacctgtgtct

SEQ ID NO: 5160320 - DNA, 22 bp, Homo sapiens
actccaagaaacgtggatctcc

SEQ ID NO: 5160321 - DNA, 17 bp, Homo sapiens
actccaagaccaccagg

SEQ ID NO: 5160322 - DNA, 22 bp, Homo sapiens
actccaagcagactccagcccc

SEQ ID NO: 5160323 - DNA, 15 bp, Homo sapiens
actccaagccctggg

SEQ ID NO: 5160324 - DNA, 18 bp, Homo sapiens
actccaagccctggggca

SEQ ID NO: 5160325 - DNA, 21 bp, Homo sapiens
actccaagccctggggcaggg

SEQ ID NO: 5160326 - DNA, 13 bp, Homo sapiens
actccaagcttca

SEQ ID NO: 5160327 - DNA, 19 bp, Homo sapiens
actccaagcttcaagtgat

SEQ ID NO: 5160328 - DNA, 23 bp, Homo sapiens
actccaagcttcaagtgatatat

SEQ ID NO: 5160329 - DNA, 13 bp, Homo sapiens
actccaaggcaaa

SEQ ID NO: 5160330 - DNA, 23 bp, Homo sapiens
actccaaggcaaatgtccaagca

SEQ ID NO: 5160331 - DNA, 15 bp, Homo sapiens
actccaaggttccct

SEQ ID NO: 5160332 - DNA, 21 bp, Homo sapiens
actccaaggtttataaagcag

SEQ ID NO: 5160333 - DNA, 21 bp, Homo sapiens
actccaatgtctgctgaggag

SEQ ID NO: 5160334 - DNA, 23 bp, Homo sapiens
actccacaccttttatgaatcaa

SEQ ID NO: 5160335 - DNA, 17 bp, Homo sapiens
actccacactgcacaat

SEQ ID NO: 5160336 - DNA, 20 bp, Homo sapiens
actgcctttgtttagaagag

SEQ ID NO: 5160337 - DNA, 21 bp, Homo sapiens
actgcgaagaccctcttgccc

SEQ ID NO: 5160338 - DNA, 22 bp, Homo sapiens
actgcgaagaccctcttgccca

SEQ ID NO: 5160339 - DNA, 15 bp, Homo sapiens
actgcgactttctgc

SEQ ID NO: 5160340 - DNA, 18 bp, Homo sapiens
actgcgactttctgcctg

SEQ ID NO: 5160341 - DNA, 19 bp, Homo sapiens
actgcgactttctgcctgg

SEQ ID NO: 5160342 - DNA, 22 bp, Homo sapiens
actgcgactttctgcctggagt

SEQ ID NO: 5160343 - DNA, 17 bp, Homo sapiens
actgcgataactgagaa

SEQ ID NO: 5160344 - DNA, 18 bp, Homo sapiens
actgcgatcttcagagca

SEQ ID NO: 5160345 - DNA, 19 bp, Homo sapiens
actgcgatcttcagagcag

SEQ ID NO: 5160346 - DNA, 15 bp, Homo sapiens
actgcgcaggtctct

SEQ ID NO: 5160347 - DNA, 21 bp, Homo sapiens
actgcgcaggtctcttctggg

SEQ ID NO: 5160348 - DNA, 14 bp, Homo sapiens
actgcgccacctgc

SEQ ID NO: 5160349 - DNA, 15 bp, Homo sapiens
actgcgccacctgct

SEQ ID NO: 5160350 - DNA, 21 bp, Homo sapiens
actgcgccacggcactccagc

SEQ ID NO: 5160351 - DNA, 23 bp, Homo sapiens
actgcgcccttaactgcatccag

SEQ ID NO: 5160352 - DNA, 14 bp, Homo sapiens
actgcggaagccaa

SEQ ID NO: 5160353 - DNA, 16 bp, Homo sapiens
actgcggaagccaaag

SEQ ID NO: 5160354 - DNA, 15 bp, Homo sapiens
actgcgggagccaga

SEQ ID NO: 5160355 - DNA, 20 bp, Homo sapiens
actgcgggatggtcctgggg

SEQ ID NO: 5160356 - DNA, 21 bp, Homo sapiens
actgcgggatggtcctggggc

SEQ ID NO: 5160357 - DNA, 15 bp, Homo sapiens
actgcggtgtctgca

SEQ ID NO: 5160358 - DNA, 18 bp, Homo sapiens
actgcggtgtctgcagct

SEQ ID NO: 5160359 - DNA, 22 bp, Homo sapiens
actgcggtgtctgcagctcctg

SEQ ID NO: 5160360 - DNA, 20 bp, Homo sapiens
actgcgttctgcaagcatca

SEQ ID NO: 5160361 - DNA, 21 bp, Homo sapiens
actgctaaaatagaatatagc

SEQ ID NO: 5160362 - DNA, 15 bp, Homo sapiens
actgctaaattctat

SEQ ID NO: 5160363 - DNA, 21 bp, Homo sapiens
actgctaaggattagtccctg

SEQ ID NO: 5160364 - DNA, 15 bp, Homo sapiens
actgctaaggctgct

SEQ ID NO: 5160365 - DNA, 17 bp, Homo sapiens
actgctaaggctgctgg

SEQ ID NO: 5160366 - DNA, 19 bp, Homo sapiens
actgctaagtatttcccag

SEQ ID NO: 5160367 - DNA, 20 bp, Homo sapiens
actgctaagtatttcccagc

SEQ ID NO: 5160368 - DNA, 12 bp, Homo sapiens
actgctaataaa

SEQ ID NO: 5160369 - DNA, 17 bp, Homo sapiens
actgctaataaatgacc

SEQ ID NO: 5160370 - DNA, 15 bp, Homo sapiens
actgctaatgcaaat

SEQ ID NO: 5160371 - DNA, 18 bp, Homo sapiens
actgctacaccttagcag

SEQ ID NO: 5160372 - DNA, 16 bp, Homo sapiens
actgctacacttctga

SEQ ID NO: 5160373 - DNA, 16 bp, Homo sapiens
actgctacagcaattt

SEQ ID NO: 5160374 - DNA, 15 bp, Homo sapiens
actgctacctctgag

SEQ ID NO: 5160375 - DNA, 15 bp, Homo sapiens
actgctactgaccca

SEQ ID NO: 5160376 - DNA, 17 bp, Homo sapiens
actgctactgacccaga

SEQ ID NO: 5160377 - DNA, 18 bp, Homo sapiens
actgctactgacccagag

SEQ ID NO: 5160378 - DNA, 18 bp, Homo sapiens
actgctactgtaatttta

SEQ ID NO: 5160379 - DNA, 19 bp, Homo sapiens
actgctagaaccaagcact

SEQ ID NO: 5160380 - DNA, 18 bp, Homo sapiens
actgctaggcgagtgcca

SEQ ID NO: 5160381 - DNA, 15 bp, Homo sapiens
actgctagtgttctg

SEQ ID NO: 5160382 - DNA, 19 bp, Homo sapiens
actgctagtgttctgtcta

SEQ ID NO: 5160383 - DNA, 18 bp, Homo sapiens
actgctatcagtctcttg

SEQ ID NO: 5160384 - DNA, 14 bp, Homo sapiens
actgctatgccatt

SEQ ID NO: 5160385 - DNA, 15 bp, Homo sapiens
actgctatgccattt

SEQ ID NO: 5160386 - DNA, 19 bp, Homo sapiens
actgctatgccatttcttc

SEQ ID NO: 5160387 - DNA, 18 bp, Homo sapiens
actgctattctagagctt

SEQ ID NO: 5160388 - DNA, 21 bp, Homo sapiens
actgctattctagagctttta

SEQ ID NO: 5160389 - DNA, 19 bp, Homo sapiens
actgctattttcctgttct

SEQ ID NO: 5160390 - DNA, 22 bp, Homo sapiens
actgctattttttttaaatcaa

SEQ ID NO: 5160391 - DNA, 16 bp, Homo sapiens
actgctcacgtctctg

SEQ ID NO: 5160392 - DNA, 17 bp, Homo sapiens
actgctcagagctttaa

SEQ ID NO: 5160393 - DNA, 21 bp, Homo sapiens
actgctcagattctaagttgt

SEQ ID NO: 5160394 - DNA, 14 bp, Homo sapiens
actgctcagctctg

SEQ ID NO: 5160395 - DNA, 16 bp, Homo sapiens
actgctcagctctggt

SEQ ID NO: 5160396 - DNA, 14 bp, Homo sapiens
actgctcagcttct

SEQ ID NO: 5160397 - DNA, 19 bp, Homo sapiens
actgctcaggctccccaag

SEQ ID NO: 5160398 - DNA, 12 bp, Homo sapiens
actgctccagcc

SEQ ID NO: 5160399 - DNA, 15 bp, Homo sapiens
actgctccagcctct

SEQ ID NO: 5160400 - DNA, 19 bp, Homo sapiens
actgctccagcctctgccg

SEQ ID NO: 5160401 - DNA, 16 bp, Homo sapiens
actgctcccacctcct

SEQ ID NO: 5160402 - DNA, 18 bp, Homo sapiens
actgctcccacctcctga

SEQ ID NO: 5160403 - DNA, 18 bp, Homo sapiens
actgctccccagccctgg

SEQ ID NO: 5160404 - DNA, 16 bp, Homo sapiens
actgctccctgaagcc

SEQ ID NO: 5160405 - DNA, 17 bp, Homo sapiens
actgctccctgaagcca

SEQ ID NO: 5160406 - DNA, 18 bp, Homo sapiens
actgctccctgaagccag

SEQ ID NO: 5160407 - DNA, 21 bp, Homo sapiens
actgctccctgaagccagcct

SEQ ID NO: 5160408 - DNA, 23 bp, Homo sapiens
actgctccgtggaggaggttggg

SEQ ID NO: 5160409 - DNA, 13 bp, Homo sapiens
actgctcctgagc

SEQ ID NO: 5160410 - DNA, 16 bp, Homo sapiens
actgctcgccttattc

SEQ ID NO: 5160411 - DNA, 20 bp, Homo sapiens
actgctcgtggactgtgctg

SEQ ID NO: 5160412 - DNA, 18 bp, Homo sapiens
actgctctaacagccctc

SEQ ID NO: 5160413 - DNA, 17 bp, Homo sapiens
actgctctaagcacacg

SEQ ID NO: 5160414 - DNA, 15 bp, Homo sapiens
actgctctactttga

SEQ ID NO: 5160415 - DNA, 15 bp, Homo sapiens
actgctctagaaagt

SEQ ID NO: 5160416 - DNA, 11 bp, Homo sapiens
actgctctcac

SEQ ID NO: 5160417 - DNA, 21 bp, Homo sapiens
actgctctcaccttggttcct

SEQ ID NO: 5160418 - DNA, 15 bp, Homo sapiens
actgctctcagcctc

SEQ ID NO: 5160419 - DNA, 20 bp, Homo sapiens
actgctctcagcctcccaac

SEQ ID NO: 5160420 - DNA, 15 bp, Homo sapiens
actgctctcctccac

SEQ ID NO: 5160421 - DNA, 21 bp, Homo sapiens
actgctctcctccacctcaac

SEQ ID NO: 5160422 - DNA, 21 bp, Homo sapiens
actgctctgaatattttgtaa

SEQ ID NO: 5160423 - DNA, 12 bp, Homo sapiens
actgctctgatg

SEQ ID NO: 5160424 - DNA, 17 bp, Homo sapiens
actgctcttaagaaact

SEQ ID NO: 5160425 - DNA, 19 bp, Homo sapiens
actgctcttgggcaatatt

SEQ ID NO: 5160426 - DNA, 22 bp, Homo sapiens
actgctcttgggcaatattctc

SEQ ID NO: 5160427 - DNA, 20 bp, Homo sapiens
actgctctttcatagtataa

SEQ ID NO: 5160428 - DNA, 19 bp, Homo sapiens
actgctgaaaaagaaaaaa

SEQ ID NO: 5160429 - DNA, 22 bp, Homo sapiens
actgctgagatacatacagaat

SEQ ID NO: 5160430 - DNA, 22 bp, Homo sapiens
actgctgaggagtctgaggact

SEQ ID NO: 5160431 - DNA, 20 bp, Homo sapiens
actgctgatcaatgaaatgc

SEQ ID NO: 5160432 - DNA, 20 bp, Homo sapiens
actgctgatcgtagaaaatt

SEQ ID NO: 5160433 - DNA, 13 bp, Homo sapiens
actgctgattctt

SEQ ID NO: 5160434 - DNA, 13 bp, Homo sapiens
actgctgattttt

SEQ ID NO: 5160435 - DNA, 13 bp, Homo sapiens
actgctgcaaagc

SEQ ID NO: 5160436 - DNA, 16 bp, Homo sapiens
actgctgcaaagtgca

SEQ ID NO: 5160437 - DNA, 18 bp, Homo sapiens
actgctgcaaggcctttc

SEQ ID NO: 5160438 - DNA, 22 bp, Homo sapiens
actgctgcaaggtggcctctgc

SEQ ID NO: 5160439 - DNA, 19 bp, Homo sapiens
actgctgcagattagttct

SEQ ID NO: 5160440 - DNA, 16 bp, Homo sapiens
actgctgcccagcctc

SEQ ID NO: 5160441 - DNA, 11 bp, Homo sapiens
actgctgcctc

SEQ ID NO: 5160442 - DNA, 14 bp, Homo sapiens
actgctgctcctct

SEQ ID NO: 5160443 - DNA, 19 bp, Homo sapiens
actgctgctcctctttccc

SEQ ID NO: 5160444 - DNA, 15 bp, Homo sapiens
actgctgctctccca

SEQ ID NO: 5160445 - DNA, 19 bp, Homo sapiens
actgctgctctcccaaggg

SEQ ID NO: 5160446 - DNA, 13 bp, Homo sapiens
actgctgctgacc

SEQ ID NO: 5160447 - DNA, 13 bp, Homo sapiens
actgctgctgcct

SEQ ID NO: 5160448 - DNA, 23 bp, Homo sapiens
actgctgctgctgctgccgccgc

SEQ ID NO: 5160449 - DNA, 14 bp, Homo sapiens
actgctggacatga

SEQ ID NO: 5160450 - DNA, 16 bp, Homo sapiens
actgctggacatgaga

SEQ ID NO: 5160451 - DNA, 22 bp, Homo sapiens
actgctggacgtctttcttttt

SEQ ID NO: 5160452 - DNA, 20 bp, Homo sapiens
actgctggactgtggagggt

SEQ ID NO: 5160453 - DNA, 21 bp, Homo sapiens
actgctggagaggccccagcc

SEQ ID NO: 5160454 - DNA, 19 bp, Homo sapiens
actgctggagtccagtgct

SEQ ID NO: 5160455 - DNA, 20 bp, Homo sapiens
actgctggagtccagtgctt

SEQ ID NO: 5160456 - DNA, 10 bp, Homo sapiens
actgctggct

SEQ ID NO: 5160457 - DNA, 13 bp, Homo sapiens
actgctggctgcc

SEQ ID NO: 5160458 - DNA, 14 bp, Homo sapiens
actgctggctgcct

SEQ ID NO: 5160459 - DNA, 15 bp, Homo sapiens
actgctggctgcctt

SEQ ID NO: 5160460 - DNA, 16 bp, Homo sapiens
actgctgggaagtggc

SEQ ID NO: 5160461 - DNA, 18 bp, Homo sapiens
actgctgggaagtggctt

SEQ ID NO: 5160462 - DNA, 18 bp, Homo sapiens
actgctgggactggccag

SEQ ID NO: 5160463 - DNA, 23 bp, Homo sapiens
actgctggggaggagaggactgg

SEQ ID NO: 5160464 - DNA, 16 bp, Homo sapiens
actgctggggagtccc

SEQ ID NO: 5160465 - DNA, 14 bp, Homo sapiens
actgctggggctgg

SEQ ID NO: 5160466 - DNA, 16 bp, Homo sapiens
actgctggggctggtg

SEQ ID NO: 5160467 - DNA, 22 bp, Homo sapiens
actgctggggctggtgaggccg

SEQ ID NO: 5160468 - DNA, 16 bp, Homo sapiens
actgctgggtggccca

SEQ ID NO: 5160469 - DNA, 18 bp, Homo sapiens
actgctggtgccagggtg

SEQ ID NO: 5160470 - DNA, 17 bp, Homo sapiens
actgctggtgtttatgt

SEQ ID NO: 5160471 - DNA, 24 bp, Homo sapiens
actgctggtgtttatgtgaacatt

SEQ ID NO: 5160472 - DNA, 21 bp, Homo sapiens
actgctgtaaaattataaact

SEQ ID NO: 5160473 - DNA, 19 bp, Homo sapiens
actgctgtaaagcaaaata

SEQ ID NO: 5160474 - DNA, 15 bp, Homo sapiens
actgctgtacccaga

SEQ ID NO: 5160475 - DNA, 13 bp, Homo sapiens
actgctgtcattg

SEQ ID NO: 5160476 - DNA, 15 bp, Homo sapiens
actgctgtcattgtc

SEQ ID NO: 5160477 - DNA, 21 bp, Homo sapiens
actgctgtcattgtccatgcc

SEQ ID NO: 5160478 - DNA, 15 bp, Homo sapiens
actgctgtccctcct

SEQ ID NO: 5160479 - DNA, 16 bp, Homo sapiens
actgctgtccctcctg

SEQ ID NO: 5160480 - DNA, 18 bp, Homo sapiens
actgctgtccctcctgag

SEQ ID NO: 5160481 - DNA, 19 bp, Homo sapiens
actgctgtccctcctgagg

SEQ ID NO: 5160482 - DNA, 15 bp, Homo sapiens
actgctgtcctctcc

SEQ ID NO: 5160483 - DNA, 16 bp, Homo sapiens
actgctgtcctctccc

SEQ ID NO: 5160484 - DNA, 19 bp, Homo sapiens
actgctgtcctctccccct

SEQ ID NO: 5160485 - DNA, 14 bp, Homo sapiens
actgctgtctctta

SEQ ID NO: 5160486 - DNA, 15 bp, Homo sapiens
actgctgtcttacta

SEQ ID NO: 5160487 - DNA, 23 bp, Homo sapiens
actgctgtgaacaagtgaacaca

SEQ ID NO: 5160488 - DNA, 21 bp, Homo sapiens
actgctgtgagtgcgcctcac

SEQ ID NO: 5160489 - DNA, 23 bp, Homo sapiens
actgctgtgagtgcgcctcacca

SEQ ID NO: 5160490 - DNA, 21 bp, Homo sapiens
actgctgtgctgtgcccaagt

SEQ ID NO: 5160491 - DNA, 14 bp, Homo sapiens
actgctgtggccag

SEQ ID NO: 5160492 - DNA, 17 bp, Homo sapiens
actgctgtggccaggag

SEQ ID NO: 5160493 - DNA, 20 bp, Homo sapiens
actgctgttatatttcatca

SEQ ID NO: 5160494 - DNA, 19 bp, Homo sapiens
actgctgttcctgctccat

SEQ ID NO: 5160495 - DNA, 15 bp, Homo sapiens
actgctgttttatgt

SEQ ID NO: 5160496 - DNA, 20 bp, Homo sapiens
actgcttaacttcacatatt

SEQ ID NO: 5160497 - DNA, 14 bp, Homo sapiens
actgcttaaggaaa

SEQ ID NO: 5160498 - DNA, 20 bp, Homo sapiens
actgcttacctactttcttc

SEQ ID NO: 5160499 - DNA, 17 bp, Homo sapiens
actgcttacttatgcca

SEQ ID NO: 5160500 - DNA, 15 bp, Homo sapiens
actgcttataaacat

SEQ ID NO: 5160501 - DNA, 15 bp, Homo sapiens
actgcttcaagtgtt

SEQ ID NO: 5160502 - DNA, 22 bp, Homo sapiens
actgcttcaatctcaattgctt

SEQ ID NO: 5160503 - DNA, 19 bp, Homo sapiens
actgcttcacggactcttt

SEQ ID NO: 5160504 - DNA, 19 bp, Homo sapiens
actgcttcatgacattcct

SEQ ID NO: 5160505 - DNA, 18 bp, Homo sapiens
actgcttcatttttgtaa

SEQ ID NO: 5160506 - DNA, 23 bp, Homo sapiens
actgcttcatttttgtaataaca

SEQ ID NO: 5160507 - DNA, 17 bp, Homo sapiens
actgcttcccactgggg

SEQ ID NO: 5160508 - DNA, 17 bp, Homo sapiens
actgcttcccatcctac

SEQ ID NO: 5160509 - DNA, 20 bp, Homo sapiens
actgcttcccatcctaccct

SEQ ID NO: 5160510 - DNA, 19 bp, Homo sapiens
actgcttcctctgaatatt

SEQ ID NO: 5160511 - DNA, 19 bp, Homo sapiens
actgcttctcggaggccag

SEQ ID NO: 5160512 - DNA, 21 bp, Homo sapiens
actgcttctcggaggccaggc

SEQ ID NO: 5160513 - DNA, 18 bp, Homo sapiens
actgcttctcggccagcc

SEQ ID NO: 5160514 - DNA, 13 bp, Homo sapiens
actccacagcgga

SEQ ID NO: 5160515 - DNA, 23 bp, Homo sapiens
actccacagcggaggagaccagc

SEQ ID NO: 5160516 - DNA, 19 bp, Homo sapiens
actccacagggactgttct

SEQ ID NO: 5160517 - DNA, 14 bp, Homo sapiens
actccacatcctgt

SEQ ID NO: 5160518 - DNA, 13 bp, Homo sapiens
actccacatctgc

SEQ ID NO: 5160519 - DNA, 14 bp, Homo sapiens
actccacatctgcc

SEQ ID NO: 5160520 - DNA, 17 bp, Homo sapiens
actccacatctgcctta

SEQ ID NO: 5160521 - DNA, 15 bp, Homo sapiens
actccaccaacccat

SEQ ID NO: 5160522 - DNA, 21 bp, Homo sapiens
actccaccatccccaccccac

SEQ ID NO: 5160523 - DNA, 22 bp, Homo sapiens
actccacccagagtagagccag

SEQ ID NO: 5160524 - DNA, 15 bp, Homo sapiens
actccacccatccta

SEQ ID NO: 5160525 - DNA, 18 bp, Homo sapiens
actccaccccctccagct

SEQ ID NO: 5160526 - DNA, 22 bp, Homo sapiens
actccaccccctccagctccag

SEQ ID NO: 5160527 - DNA, 14 bp, Homo sapiens
actccaccctgtta

SEQ ID NO: 5160528 - DNA, 18 bp, Homo sapiens
actccaccgaccaactgc

SEQ ID NO: 5160529 - DNA, 21 bp, Homo sapiens
actccaccgaccaactgccct

SEQ ID NO: 5160530 - DNA, 21 bp, Homo sapiens
actccaccgcctatcccaaac

SEQ ID NO: 5160531 - DNA, 15 bp, Homo sapiens
actccacctccaccc

SEQ ID NO: 5160532 - DNA, 16 bp, Homo sapiens
actccacgatgccttt

SEQ ID NO: 5160533 - DNA, 20 bp, Homo sapiens
actccacgcagctggcagag

SEQ ID NO: 5160534 - DNA, 21 bp, Homo sapiens
actccacggatgcgtgggcag

SEQ ID NO: 5160535 - DNA, 23 bp, Homo sapiens
actccacggatgcgtgggcagag

SEQ ID NO: 5160536 - DNA, 19 bp, Homo sapiens
actccactactttactgtt

SEQ ID NO: 5160537 - DNA, 12 bp, Homo sapiens
actccactcagg

SEQ ID NO: 5160538 - DNA, 14 bp, Homo sapiens
actccactcccagc

SEQ ID NO: 5160539 - DNA, 18 bp, Homo sapiens
actccactcccagcagct

SEQ ID NO: 5160540 - DNA, 13 bp, Homo sapiens
actccactcccct

SEQ ID NO: 5160541 - DNA, 15 bp, Homo sapiens
actccactcccctca

SEQ ID NO: 5160542 - DNA, 14 bp, Homo sapiens
actccactctcctt

SEQ ID NO: 5160543 - DNA, 22 bp, Homo sapiens
actccactctccttcgtgtctc

SEQ ID NO: 5160544 - DNA, 13 bp, Homo sapiens
actccactctgat

SEQ ID NO: 5160545 - DNA, 15 bp, Homo sapiens
actccactctgattc

SEQ ID NO: 5160546 - DNA, 14 bp, Homo sapiens
actccactgccctg

SEQ ID NO: 5160547 - DNA, 14 bp, Homo sapiens
actccactggacag

SEQ ID NO: 5160548 - DNA, 18 bp, Homo sapiens
actccactggacagaccc

SEQ ID NO: 5160549 - DNA, 14 bp, Homo sapiens
actccactggctcc

SEQ ID NO: 5160550 - DNA, 15 bp, Homo sapiens
actccactggctcca

SEQ ID NO: 5160551 - DNA, 17 bp, Homo sapiens
actccactgtctttaaa

SEQ ID NO: 5160552 - DNA, 18 bp, Homo sapiens
actccagaaagtgacaag

SEQ ID NO: 5160553 - DNA, 20 bp, Homo sapiens
actccagaaatgtccctttc

SEQ ID NO: 5160554 - DNA, 13 bp, Homo sapiens
actccagaagcag

SEQ ID NO: 5160555 - DNA, 16 bp, Homo sapiens
actccagaagcagcag

SEQ ID NO: 5160556 - DNA, 17 bp, Homo sapiens
actccagaatctgctgt

SEQ ID NO: 5160557 - DNA, 21 bp, Homo sapiens
actccagaattacccttcctc

SEQ ID NO: 5160558 - DNA, 15 bp, Homo sapiens
actccagaatttccc

SEQ ID NO: 5160559 - DNA, 19 bp, Homo sapiens
actccagacccctggcttt

SEQ ID NO: 5160560 - DNA, 16 bp, Homo sapiens
actccagactctgggg

SEQ ID NO: 5160561 - DNA, 11 bp, Homo sapiens
actccagagaa

SEQ ID NO: 5160562 - DNA, 12 bp, Homo sapiens
actccagagaag

SEQ ID NO: 5160563 - DNA, 14 bp, Homo sapiens
actccagagtctga

SEQ ID NO: 5160564 - DNA, 17 bp, Homo sapiens
actccagatagagaaat

SEQ ID NO: 5160565 - DNA, 13 bp, Homo sapiens
actccagatctgc

SEQ ID NO: 5160566 - DNA, 17 bp, Homo sapiens
actccagcacgttttct

SEQ ID NO: 5160567 - DNA, 21 bp, Homo sapiens
actccagcagataaggccgag

SEQ ID NO: 5160568 - DNA, 9 bp, Homo sapiens
actccagcc

SEQ ID NO: 5160569 - DNA, 21 bp, Homo sapiens
actccagccacccagccagga

SEQ ID NO: 5160570 - DNA, 13 bp, Homo sapiens
actccagccagcg

SEQ ID NO: 5160571 - DNA, 15 bp, Homo sapiens
actccagccagcgcc

SEQ ID NO: 5160572 - DNA, 20 bp, Homo sapiens
actccagccagcgcctccct

SEQ ID NO: 5160573 - DNA, 21 bp, Homo sapiens
actccagccagcgcctccctc

SEQ ID NO: 5160574 - DNA, 22 bp, Homo sapiens
actccagccagcgcctccctcc

SEQ ID NO: 5160575 - DNA, 21 bp, Homo sapiens
actccagccagggcaagagag

SEQ ID NO: 5160576 - DNA, 15 bp, Homo sapiens
actccagcctgagca

SEQ ID NO: 5160577 - DNA, 19 bp, Homo sapiens
actccagcctgagcaacag

SEQ ID NO: 5160578 - DNA, 19 bp, Homo sapiens
actccagcctggcgacaga

SEQ ID NO: 5160579 - DNA, 13 bp, Homo sapiens
actccagcctggg

SEQ ID NO: 5160580 - DNA, 16 bp, Homo sapiens
actccagcctgggcaa

SEQ ID NO: 5160581 - DNA, 17 bp, Homo sapiens
actccagcctgggcaac

SEQ ID NO: 5160582 - DNA, 15 bp, Homo sapiens
actccagcctgggcg

SEQ ID NO: 5160583 - DNA, 18 bp, Homo sapiens
actccagcctgggcgaca

SEQ ID NO: 5160584 - DNA, 23 bp, Homo sapiens
actccagcctgggcgacaaaaac

SEQ ID NO: 5160585 - DNA, 20 bp, Homo sapiens
actccagcctgggcgacaga

SEQ ID NO: 5160586 - DNA, 19 bp, Homo sapiens
actccagcctggggacccc

SEQ ID NO: 5160587 - DNA, 21 bp, Homo sapiens
actccagcctggggtgataga

SEQ ID NO: 5160588 - DNA, 20 bp, Homo sapiens
actccagcctgggtgacaga

SEQ ID NO: 5160589 - DNA, 20 bp, Homo sapiens
actccagcgcctgccctccc

SEQ ID NO: 5160590 - DNA, 15 bp, Homo sapiens
actccagcgtcctca

SEQ ID NO: 5160591 - DNA, 17 bp, Homo sapiens
actccagcgtcctcagc

SEQ ID NO: 5160592 - DNA, 18 bp, Homo sapiens
actccagcgtcctcagca

SEQ ID NO: 5160593 - DNA, 11 bp, Homo sapiens
actccagctcc

SEQ ID NO: 5160594 - DNA, 12 bp, Homo sapiens
actccagctccc

SEQ ID NO: 5160595 - DNA, 17 bp, Homo sapiens
actccagctgagtcctg

SEQ ID NO: 5160596 - DNA, 19 bp, Homo sapiens
actccagctgagtcctggg

SEQ ID NO: 5160597 - DNA, 20 bp, Homo sapiens
actccagctgagtcctgggg

SEQ ID NO: 5160598 - DNA, 20 bp, Homo sapiens
actccagctgggttggaaaa

SEQ ID NO: 5160599 - DNA, 21 bp, Homo sapiens
actccagctggtgcccccaga

SEQ ID NO: 5160600 - DNA, 18 bp, Homo sapiens
actccaggaaaactgttt

SEQ ID NO: 5160601 - DNA, 21 bp, Homo sapiens
actccaggaaaactgtttttc

SEQ ID NO: 5160602 - DNA, 18 bp, Homo sapiens
actccaggaaagagcagt

SEQ ID NO: 5160603 - DNA, 22 bp, Homo sapiens
actccaggaaagagcagtcaga

SEQ ID NO: 5160604 - DNA, 13 bp, Homo sapiens
actccaggagagg

SEQ ID NO: 5160605 - DNA, 14 bp, Homo sapiens
actccaggagagga

SEQ ID NO: 5160606 - DNA, 21 bp, Homo sapiens
actccaggatcctcctggagc

SEQ ID NO: 5160607 - DNA, 19 bp, Homo sapiens
actccaggatttataaagc

SEQ ID NO: 5160608 - DNA, 20 bp, Homo sapiens
actccaggcagcagacacat

SEQ ID NO: 5160609 - DNA, 13 bp, Homo sapiens
actccaggcagga

SEQ ID NO: 5160610 - DNA, 11 bp, Homo sapiens
actccaggccc

SEQ ID NO: 5160611 - DNA, 12 bp, Homo sapiens
actccaggcccc

SEQ ID NO: 5160612 - DNA, 23 bp, Homo sapiens
actccaggcccccgttgaagccg

SEQ ID NO: 5160613 - DNA, 12 bp, Homo sapiens
actccaggccct

SEQ ID NO: 5160614 - DNA, 15 bp, Homo sapiens
actccaggccctcct

SEQ ID NO: 5160615 - DNA, 11 bp, Homo sapiens
actccaggcct

SEQ ID NO: 5160616 - DNA, 17 bp, Homo sapiens
actccaggcctgaccag

SEQ ID NO: 5160617 - DNA, 16 bp, Homo sapiens
actccaggctggaagt

SEQ ID NO: 5160618 - DNA, 18 bp, Homo sapiens
actccaggcttccacact

SEQ ID NO: 5160619 - DNA, 18 bp, Homo sapiens
actccaggcttgattcca

SEQ ID NO: 5160620 - DNA, 19 bp, Homo sapiens
actccaggctttctggagt

SEQ ID NO: 5160621 - DNA, 19 bp, Homo sapiens
actccagggacacacagcc

SEQ ID NO: 5160622 - DNA, 14 bp, Homo sapiens
actccaggggcacc

SEQ ID NO: 5160623 - DNA, 17 bp, Homo sapiens
actccaggggctgggga

SEQ ID NO: 5160624 - DNA, 16 bp, Homo sapiens
actccagggtcccctg

SEQ ID NO: 5160625 - DNA, 12 bp, Homo sapiens
actccagggtga

SEQ ID NO: 5160626 - DNA, 19 bp, Homo sapiens
actccagggtgacaaggcc

SEQ ID NO: 5160627 - DNA, 20 bp, Homo sapiens
actccagggtgacaaggcct

SEQ ID NO: 5160628 - DNA, 21 bp, Homo sapiens
actccagggtgacaaggcctg

SEQ ID NO: 5160629 - DNA, 22 bp, Homo sapiens
actccagggtgacaaggcctgc

SEQ ID NO: 5160630 - DNA, 20 bp, Homo sapiens
actccagggttaaagaaagg

SEQ ID NO: 5160631 - DNA, 14 bp, Homo sapiens
actccaggttcctg

SEQ ID NO: 5160632 - DNA, 16 bp, Homo sapiens
actccaggttcctgaa

SEQ ID NO: 5160633 - DNA, 16 bp, Homo sapiens
actccagtactatttt

SEQ ID NO: 5160634 - DNA, 16 bp, Homo sapiens
actccagtatgacaga

SEQ ID NO: 5160635 - DNA, 19 bp, Homo sapiens
actccagtcaacagattca

SEQ ID NO: 5160636 - DNA, 20 bp, Homo sapiens
actccagtgactgctgcctc

SEQ ID NO: 5160637 - DNA, 18 bp, Homo sapiens
actccagtgagctggaat

SEQ ID NO: 5160638 - DNA, 18 bp, Homo sapiens
actccagttttctcctct

SEQ ID NO: 5160639 - DNA, 21 bp, Homo sapiens
actccataaaaagaaagctaa

SEQ ID NO: 5160640 - DNA, 15 bp, Homo sapiens
actccatacagcctc

SEQ ID NO: 5160641 - DNA, 22 bp, Homo sapiens
actccatacagcctctacagcc

SEQ ID NO: 5160642 - DNA, 23 bp, Homo sapiens
actccatatcccgggagcagttg

SEQ ID NO: 5160643 - DNA, 17 bp, Homo sapiens
actccatcatggctgct

SEQ ID NO: 5160644 - DNA, 22 bp, Homo sapiens
actccatcctcctgtgtcactg

SEQ ID NO: 5160645 - DNA, 13 bp, Homo sapiens
actccatctcaaa

SEQ ID NO: 5160646 - DNA, 14 bp, Homo sapiens
actccatctcctgc

SEQ ID NO: 5160647 - DNA, 15 bp, Homo sapiens
actccatctcctgct

SEQ ID NO: 5160648 - DNA, 17 bp, Homo sapiens
actccatctcctgctca

SEQ ID NO: 5160649 - DNA, 23 bp, Homo sapiens
actccatctcctgctcaccacct

SEQ ID NO: 5160650 - DNA, 14 bp, Homo sapiens
actccatctcttct

SEQ ID NO: 5160651 - DNA, 16 bp, Homo sapiens
actccatctctttaaa

SEQ ID NO: 5160652 - DNA, 16 bp, Homo sapiens
actccatctgacaaat

SEQ ID NO: 5160653 - DNA, 19 bp, Homo sapiens
actccatctggtagaaggg

SEQ ID NO: 5160654 - DNA, 11 bp, Homo sapiens
actccatcttg

SEQ ID NO: 5160655 - DNA, 16 bp, Homo sapiens
actccatgaccaggcc

SEQ ID NO: 5160656 - DNA, 17 bp, Homo sapiens
actccatgagaagccgt

SEQ ID NO: 5160657 - DNA, 13 bp, Homo sapiens
actccatgcctat

SEQ ID NO: 5160658 - DNA, 16 bp, Homo sapiens
actccatgcctattta

SEQ ID NO: 5160659 - DNA, 21 bp, Homo sapiens
actccatgctccttgagagga

SEQ ID NO: 5160660 - DNA, 15 bp, Homo sapiens
actccatggccaccc

SEQ ID NO: 5160661 - DNA, 12 bp, Homo sapiens
actccatggccc

SEQ ID NO: 5160662 - DNA, 15 bp, Homo sapiens
actccatggcccttc

SEQ ID NO: 5160663 - DNA, 17 bp, Homo sapiens
actccatggtgaactga

SEQ ID NO: 5160664 - DNA, 19 bp, Homo sapiens
actccatggtgaactgaag

SEQ ID NO: 5160665 - DNA, 15 bp, Homo sapiens
actccatggttctca

SEQ ID NO: 5160666 - DNA, 21 bp, Homo sapiens
actccattactaaagacagaa

SEQ ID NO: 5160667 - DNA, 20 bp, Homo sapiens
actccattactgtgatttct

SEQ ID NO: 5160668 - DNA, 21 bp, Homo sapiens
actccattattttattttata

SEQ ID NO: 5160669 - DNA, 14 bp, Homo sapiens
actccatttctttc

SEQ ID NO: 5160670 - DNA, 19 bp, Homo sapiens
actccatttctttcttcca

SEQ ID NO: 5160671 - DNA, 13 bp, Homo sapiens
actcccaaagagc

SEQ ID NO: 5160672 - DNA, 18 bp, Homo sapiens
actcccaaagagctgcct

SEQ ID NO: 5160673 - DNA, 16 bp, Homo sapiens
actcccaaccctggct

SEQ ID NO: 5160674 - DNA, 20 bp, Homo sapiens
actcccaacttcttcctgtg

SEQ ID NO: 5160675 - DNA, 22 bp, Homo sapiens
actcccaagggacagcaagtga

SEQ ID NO: 5160676 - DNA, 23 bp, Homo sapiens
actcccaagtatggggttcaaga

SEQ ID NO: 5160677 - DNA, 19 bp, Homo sapiens
actcccaagtctacagagt

SEQ ID NO: 5160678 - DNA, 18 bp, Homo sapiens
actcccacaaccacatgt

SEQ ID NO: 5160679 - DNA, 16 bp, Homo sapiens
actcccacacccaaga

SEQ ID NO: 5160680 - DNA, 22 bp, Homo sapiens
actcccacccagtctctgctcc

SEQ ID NO: 5160681 - DNA, 15 bp, Homo sapiens
actcccaccctaccc

SEQ ID NO: 5160682 - DNA, 12 bp, Homo sapiens
actcccactcct

SEQ ID NO: 5160683 - DNA, 13 bp, Homo sapiens
actcccactccta

SEQ ID NO: 5160684 - DNA, 17 bp, Homo sapiens
actcccactctttgaat

SEQ ID NO: 5160685 - DNA, 16 bp, Homo sapiens
actcccacttccctga

SEQ ID NO: 5160686 - DNA, 12 bp, Homo sapiens
actcccagaacc

SEQ ID NO: 5160687 - DNA, 17 bp, Homo sapiens
actcccagaccacctcc

SEQ ID NO: 5160688 - DNA, 17 bp, Homo sapiens
actcccagcactcccct

SEQ ID NO: 5160689 - DNA, 18 bp, Homo sapiens
actcccagcactcccctt

SEQ ID NO: 5160690 - DNA, 23 bp, Homo sapiens
actcccagcactccccttgcctt

SEQ ID NO: 5160691 - DNA, 21 bp, Homo sapiens
actcccagccaccaccactgt

SEQ ID NO: 5160692 - DNA, 21 bp, Homo sapiens
actcccagcgctggctccagg

SEQ ID NO: 5160693 - DNA, 22 bp, Homo sapiens
actcccaggacctggagacagg

SEQ ID NO: 5160694 - DNA, 13 bp, Homo sapiens
actgcttctcttt

SEQ ID NO: 5160695 - DNA, 15 bp, Homo sapiens
actgcttctctttgt

SEQ ID NO: 5160696 - DNA, 17 bp, Homo sapiens
actgcttctcttttgaa

SEQ ID NO: 5160697 - DNA, 21 bp, Homo sapiens
actgcttctcttttgaaagta

SEQ ID NO: 5160698 - DNA, 21 bp, Homo sapiens
actgcttgaccgtactctcac

SEQ ID NO: 5160699 - DNA, 13 bp, Homo sapiens
actgcttgagcat

SEQ ID NO: 5160700 - DNA, 16 bp, Homo sapiens
actgcttgagcatcag

SEQ ID NO: 5160701 - DNA, 18 bp, Homo sapiens
actgcttgaggaaaacaa

SEQ ID NO: 5160702 - DNA, 21 bp, Homo sapiens
actgcttgaggaggggcacct

SEQ ID NO: 5160703 - DNA, 23 bp, Homo sapiens
actgcttgattttaatacattga

SEQ ID NO: 5160704 - DNA, 21 bp, Homo sapiens
actgcttgcttacaatcttta

SEQ ID NO: 5160705 - DNA, 20 bp, Homo sapiens
actgcttggatccatacaaa

SEQ ID NO: 5160706 - DNA, 14 bp, Homo sapiens
actgcttggccaga

SEQ ID NO: 5160707 - DNA, 13 bp, Homo sapiens
actgcttgtttcc

SEQ ID NO: 5160708 - DNA, 13 bp, Homo sapiens
actgctttactgt

SEQ ID NO: 5160709 - DNA, 21 bp, Homo sapiens
actgctttactgtgtatctca

SEQ ID NO: 5160710 - DNA, 16 bp, Homo sapiens
actgctttattttagg

SEQ ID NO: 5160711 - DNA, 15 bp, Homo sapiens
actgctttattttcc

SEQ ID NO: 5160712 - DNA, 20 bp, Homo sapiens
actgctttattttccctact

SEQ ID NO: 5160713 - DNA, 12 bp, Homo sapiens
actgctttctga

SEQ ID NO: 5160714 - DNA, 14 bp, Homo sapiens
actgctttctgaat

SEQ ID NO: 5160715 - DNA, 12 bp, Homo sapiens
actgctttctgt

SEQ ID NO: 5160716 - DNA, 18 bp, Homo sapiens
actgctttctgttccaaa

SEQ ID NO: 5160717 - DNA, 17 bp, Homo sapiens
actgctttctttcgttt

SEQ ID NO: 5160718 - DNA, 23 bp, Homo sapiens
actgctttgattggttgtgcctt

SEQ ID NO: 5160719 - DNA, 15 bp, Homo sapiens
actgctttgcaaaga

SEQ ID NO: 5160720 - DNA, 21 bp, Homo sapiens
actgctttgcaccgtggtcag

SEQ ID NO: 5160721 - DNA, 16 bp, Homo sapiens
actgctttgtgcatat

SEQ ID NO: 5160722 - DNA, 17 bp, Homo sapiens
actgctttgtgcatatg

SEQ ID NO: 5160723 - DNA, 23 bp, Homo sapiens
actgctttgtttggatgcctcag

SEQ ID NO: 5160724 - DNA, 19 bp, Homo sapiens
actgcttttaaaagtgcac

SEQ ID NO: 5160725 - DNA, 20 bp, Homo sapiens
actgcttttaaaagtgcaca

SEQ ID NO: 5160726 - DNA, 21 bp, Homo sapiens
actgcttttaaaagtgcacat

SEQ ID NO: 5160727 - DNA, 14 bp, Homo sapiens
actgcttttcatta

SEQ ID NO: 5160728 - DNA, 19 bp, Homo sapiens
actgcttttcctcaagcaa

SEQ ID NO: 5160729 - DNA, 21 bp, Homo sapiens
actgcttttcctcaagcaata

SEQ ID NO: 5160730 - DNA, 18 bp, Homo sapiens
actgcttttgcaaacaga

SEQ ID NO: 5160731 - DNA, 20 bp, Homo sapiens
actgcttttgcccatataaa

SEQ ID NO: 5160732 - DNA, 14 bp, Homo sapiens
actgcttttggtct

SEQ ID NO: 5160733 - DNA, 14 bp, Homo sapiens
actgctttttcctt

SEQ ID NO: 5160734 - DNA, 16 bp, Homo sapiens
actgctttttccttag

SEQ ID NO: 5160735 - DNA, 21 bp, Homo sapiens
actgctttttccttagcttaa

SEQ ID NO: 5160736 - DNA, 19 bp, Homo sapiens
actgcttttttttttccag

SEQ ID NO: 5160737 - DNA, 17 bp, Homo sapiens
actggaaaacagaacac

SEQ ID NO: 5160738 - DNA, 18 bp, Homo sapiens
actggaaaaggtgaaaat

SEQ ID NO: 5160739 - DNA, 20 bp, Homo sapiens
actggaaaataaattttgaa

SEQ ID NO: 5160740 - DNA, 14 bp, Homo sapiens
actggaaaatagtc

SEQ ID NO: 5160741 - DNA, 18 bp, Homo sapiens
actggaaacaaaacagaa

SEQ ID NO: 5160742 - DNA, 12 bp, Homo sapiens
actggaaacatc

SEQ ID NO: 5160743 - DNA, 16 bp, Homo sapiens
actggaaacatctgat

SEQ ID NO: 5160744 - DNA, 18 bp, Homo sapiens
actggaaacatctgattt

SEQ ID NO: 5160745 - DNA, 12 bp, Homo sapiens
actggaaagaag

SEQ ID NO: 5160746 - DNA, 13 bp, Homo sapiens
actggaaaggaaa

SEQ ID NO: 5160747 - DNA, 17 bp, Homo sapiens
actggaaaggggagagc

SEQ ID NO: 5160748 - DNA, 15 bp, Homo sapiens
actggaaataaagta

SEQ ID NO: 5160749 - DNA, 17 bp, Homo sapiens
actggaaatgcatgact

SEQ ID NO: 5160750 - DNA, 14 bp, Homo sapiens
actggaaattccag

SEQ ID NO: 5160751 - DNA, 19 bp, Homo sapiens
actggaaattgaggtccat

SEQ ID NO: 5160752 - DNA, 19 bp, Homo sapiens
actggaacatgcttttact

SEQ ID NO: 5160753 - DNA, 14 bp, Homo sapiens
actggaagaaagca

SEQ ID NO: 5160754 - DNA, 19 bp, Homo sapiens
actggaagacacttcagat

SEQ ID NO: 5160755 - DNA, 21 bp, Homo sapiens
actggaagacacttcagatct

SEQ ID NO: 5160756 - DNA, 10 bp, Homo sapiens
actggaagat

SEQ ID NO: 5160757 - DNA, 23 bp, Homo sapiens
actggaagatcccctctcctgcc

SEQ ID NO: 5160758 - DNA, 19 bp, Homo sapiens
actggaagcacagcttcat

SEQ ID NO: 5160759 - DNA, 21 bp, Homo sapiens
actggaagcatgtaggagaat

SEQ ID NO: 5160760 - DNA, 22 bp, Homo sapiens
actggaagctttgtagaaatta

SEQ ID NO: 5160761 - DNA, 19 bp, Homo sapiens
actggaaggagcacatact

SEQ ID NO: 5160762 - DNA, 12 bp, Homo sapiens
actggaagttca

SEQ ID NO: 5160763 - DNA, 21 bp, Homo sapiens
actggaagttcatacctaagt

SEQ ID NO: 5160764 - DNA, 21 bp, Homo sapiens
actggaagttgtggatatcag

SEQ ID NO: 5160765 - DNA, 10 bp, Homo sapiens
actggaataa

SEQ ID NO: 5160766 - DNA, 17 bp, Homo sapiens
actggaataagccttcg

SEQ ID NO: 5160767 - DNA, 21 bp, Homo sapiens
actggaatcagctcaggactg

SEQ ID NO: 5160768 - DNA, 18 bp, Homo sapiens
actggaatcgatctgtac

SEQ ID NO: 5160769 - DNA, 19 bp, Homo sapiens
actggaatcgatctgtact

SEQ ID NO: 5160770 - DNA, 22 bp, Homo sapiens
actggaattttatttctctcag

SEQ ID NO: 5160771 - DNA, 13 bp, Homo sapiens
actggaattttta

SEQ ID NO: 5160772 - DNA, 16 bp, Homo sapiens
actggacaacactgat

SEQ ID NO: 5160773 - DNA, 19 bp, Homo sapiens
actggacagacccaggtct

SEQ ID NO: 5160774 - DNA, 16 bp, Homo sapiens
actggacagccagggc

SEQ ID NO: 5160775 - DNA, 24 bp, Homo sapiens
actggacagcctcttctgtcccaa

SEQ ID NO: 5160776 - DNA, 12 bp, Homo sapiens
actggacagctt

SEQ ID NO: 5160777 - DNA, 13 bp, Homo sapiens
actggacagcttg

SEQ ID NO: 5160778 - DNA, 15 bp, Homo sapiens
actggacagcttgtg

SEQ ID NO: 5160779 - DNA, 21 bp, Homo sapiens
actggacagctttgctccgct

SEQ ID NO: 5160780 - DNA, 18 bp, Homo sapiens
actggacataacattttc

SEQ ID NO: 5160781 - DNA, 14 bp, Homo sapiens
actggacatggccc

SEQ ID NO: 5160782 - DNA, 16 bp, Homo sapiens
actggaccactgggca

SEQ ID NO: 5160783 - DNA, 21 bp, Homo sapiens
actggaccactgggcaatgat

SEQ ID NO: 5160784 - DNA, 22 bp, Homo sapiens
actggaccccactggctgagaa

SEQ ID NO: 5160785 - DNA, 23 bp, Homo sapiens
actggacccccagcccccagggc

SEQ ID NO: 5160786 - DNA, 16 bp, Homo sapiens
actggaccccgcctcc

SEQ ID NO: 5160787 - DNA, 19 bp, Homo sapiens
actggaccccgcctcccag

SEQ ID NO: 5160788 - DNA, 20 bp, Homo sapiens
actggaccccgcctcccagc

SEQ ID NO: 5160789 - DNA, 21 bp, Homo sapiens
actggaccccgcctcccagcc

SEQ ID NO: 5160790 - DNA, 18 bp, Homo sapiens
actggaccctgttgctaa

SEQ ID NO: 5160791 - DNA, 20 bp, Homo sapiens
actggaccctgttgctaagc

SEQ ID NO: 5160792 - DNA, 16 bp, Homo sapiens
actggaccgctgactg

SEQ ID NO: 5160793 - DNA, 16 bp, Homo sapiens
actggacctgaaattt

SEQ ID NO: 5160794 - DNA, 12 bp, Homo sapiens
actggactaagt

SEQ ID NO: 5160795 - DNA, 22 bp, Homo sapiens
actggactatagcagggctggg

SEQ ID NO: 5160796 - DNA, 14 bp, Homo sapiens
actggactcacatt

SEQ ID NO: 5160797 - DNA, 17 bp, Homo sapiens
actggactcaggaactt

SEQ ID NO: 5160798 - DNA, 20 bp, Homo sapiens
actggactcaggatgcccag

SEQ ID NO: 5160799 - DNA, 16 bp, Homo sapiens
actggactccggccct

SEQ ID NO: 5160800 - DNA, 18 bp, Homo sapiens
actggactccggccctcc

SEQ ID NO: 5160801 - DNA, 22 bp, Homo sapiens
actggactcttcaaaaactgtt

SEQ ID NO: 5160802 - DNA, 15 bp, Homo sapiens
actggactgcatggg

SEQ ID NO: 5160803 - DNA, 22 bp, Homo sapiens
actggacttgagcttggcagct

SEQ ID NO: 5160804 - DNA, 18 bp, Homo sapiens
actggagaaaacccctcc

SEQ ID NO: 5160805 - DNA, 19 bp, Homo sapiens
actggagaaaacccctccc

SEQ ID NO: 5160806 - DNA, 15 bp, Homo sapiens
actggagaaaatgga

SEQ ID NO: 5160807 - DNA, 15 bp, Homo sapiens
actggagaaatgctt

SEQ ID NO: 5160808 - DNA, 21 bp, Homo sapiens
actggagaagaatatcaaata

SEQ ID NO: 5160809 - DNA, 18 bp, Homo sapiens
actggagaattgaaaagg

SEQ ID NO: 5160810 - DNA, 21 bp, Homo sapiens
actggagaccggaattgagag

SEQ ID NO: 5160811 - DNA, 21 bp, Homo sapiens
actggagacttggaagagttg

SEQ ID NO: 5160812 - DNA, 18 bp, Homo sapiens
actggagaggctaacctc

SEQ ID NO: 5160813 - DNA, 15 bp, Homo sapiens
actggagagtggcaa

SEQ ID NO: 5160814 - DNA, 12 bp, Homo sapiens
actggagcacaa

SEQ ID NO: 5160815 - DNA, 15 bp, Homo sapiens
actggagcagaaggg

SEQ ID NO: 5160816 - DNA, 12 bp, Homo sapiens
actggagcccag

SEQ ID NO: 5160817 - DNA, 21 bp, Homo sapiens
actggagcttttaaaaatgtt

SEQ ID NO: 5160818 - DNA, 18 bp, Homo sapiens
actggaggagagaagaat

SEQ ID NO: 5160819 - DNA, 23 bp, Homo sapiens
actggaggagcacacatccaaga

SEQ ID NO: 5160820 - DNA, 18 bp, Homo sapiens
actggaggagcagcttcc

SEQ ID NO: 5160821 - DNA, 14 bp, Homo sapiens
actggaggcaggac

SEQ ID NO: 5160822 - DNA, 14 bp, Homo sapiens
actggaggctgggt

SEQ ID NO: 5160823 - DNA, 15 bp, Homo sapiens
actggaggctgggtg

SEQ ID NO: 5160824 - DNA, 16 bp, Homo sapiens
actggaggctgggtgg

SEQ ID NO: 5160825 - DNA, 17 bp, Homo sapiens
actggaggctgggtggc

SEQ ID NO: 5160826 - DNA, 19 bp, Homo sapiens
actggaggggcccacccac

SEQ ID NO: 5160827 - DNA, 23 bp, Homo sapiens
actggaggtcacattcaggaaga

SEQ ID NO: 5160828 - DNA, 16 bp, Homo sapiens
actggaggtcgaagca

SEQ ID NO: 5160829 - DNA, 15 bp, Homo sapiens
actggaggtgggcat

SEQ ID NO: 5160830 - DNA, 19 bp, Homo sapiens
actggaggttgaagccaag

SEQ ID NO: 5160831 - DNA, 17 bp, Homo sapiens
actggagtcagatgagc

SEQ ID NO: 5160832 - DNA, 17 bp, Homo sapiens
actggagtccagtctct

SEQ ID NO: 5160833 - DNA, 17 bp, Homo sapiens
actggagtctatgctta

SEQ ID NO: 5160834 - DNA, 20 bp, Homo sapiens
actggagtctatgcttaaaa

SEQ ID NO: 5160835 - DNA, 12 bp, Homo sapiens
actggagtctct

SEQ ID NO: 5160836 - DNA, 13 bp, Homo sapiens
actggagtgaatg

SEQ ID NO: 5160837 - DNA, 20 bp, Homo sapiens
actggagtgaggcttccagg

SEQ ID NO: 5160838 - DNA, 21 bp, Homo sapiens
actggagtgaggcttccaggc

SEQ ID NO: 5160839 - DNA, 21 bp, Homo sapiens
actggagtgatgttagcagac

SEQ ID NO: 5160840 - DNA, 13 bp, Homo sapiens
actggagtgcagg

SEQ ID NO: 5160841 - DNA, 14 bp, Homo sapiens
actggagtgcagtg

SEQ ID NO: 5160842 - DNA, 14 bp, Homo sapiens
actggagtggagca

SEQ ID NO: 5160843 - DNA, 17 bp, Homo sapiens
actggagtggagcattg

SEQ ID NO: 5160844 - DNA, 21 bp, Homo sapiens
actggagtggctcgccaggcc

SEQ ID NO: 5160845 - DNA, 21 bp, Homo sapiens
actggagtggtaacaagagga

SEQ ID NO: 5160846 - DNA, 16 bp, Homo sapiens
actggagtgtgcgtgg

SEQ ID NO: 5160847 - DNA, 22 bp, Homo sapiens
actggagtgtgcgtggtggtcc

SEQ ID NO: 5160848 - DNA, 17 bp, Homo sapiens
actggagttacattaat

SEQ ID NO: 5160849 - DNA, 13 bp, Homo sapiens
actggagttctat

SEQ ID NO: 5160850 - DNA, 19 bp, Homo sapiens
actggagttctatgctctc

SEQ ID NO: 5160851 - DNA, 15 bp, Homo sapiens
actggataaattgta

SEQ ID NO: 5160852 - DNA, 19 bp, Homo sapiens
actggataaattgtttagt

SEQ ID NO: 5160853 - DNA, 18 bp, Homo sapiens
actggatactgcccgggg

SEQ ID NO: 5160854 - DNA, 13 bp, Homo sapiens
actggatactgta

SEQ ID NO: 5160855 - DNA, 14 bp, Homo sapiens
actggatagcatga

SEQ ID NO: 5160856 - DNA, 14 bp, Homo sapiens
actggatatgttgt

SEQ ID NO: 5160857 - DNA, 20 bp, Homo sapiens
actggatccatccgtccagc

SEQ ID NO: 5160858 - DNA, 19 bp, Homo sapiens
actggatcccaacaccaaa

SEQ ID NO: 5160859 - DNA, 18 bp, Homo sapiens
actggatcccatcaaaga

SEQ ID NO: 5160860 - DNA, 16 bp, Homo sapiens
actggatcttctatca

SEQ ID NO: 5160861 - DNA, 11 bp, Homo sapiens
actggatgaaa

SEQ ID NO: 5160862 - DNA, 14 bp, Homo sapiens
actggatgaaaatg

SEQ ID NO: 5160863 - DNA, 22 bp, Homo sapiens
actggatgaaataactccttct

SEQ ID NO: 5160864 - DNA, 19 bp, Homo sapiens
actggatgcatcaagaact

SEQ ID NO: 5160865 - DNA, 15 bp, Homo sapiens
actggatgcttacag

SEQ ID NO: 5160866 - DNA, 17 bp, Homo sapiens
actggattaaaacaatt

SEQ ID NO: 5160867 - DNA, 13 bp, Homo sapiens
actggattggcca

SEQ ID NO: 5160868 - DNA, 18 bp, Homo sapiens
actggatttgcagaagtt

SEQ ID NO: 5160869 - DNA, 13 bp, Homo sapiens
actggatttgttg

SEQ ID NO: 5160870 - DNA, 22 bp, Homo sapiens
actggattttgaacgcttaagt

SEQ ID NO: 5160871 - DNA, 12 bp, Homo sapiens
actggcaaaagg

SEQ ID NO: 5160872 - DNA, 23 bp, Homo sapiens
actggcaaaatagttctgcaggt

SEQ ID NO: 5160873 - DNA, 13 bp, Homo sapiens
actggcaaacttc

SEQ ID NO: 5160874 - DNA, 16 bp, Homo sapiens
actggcaaacttcaga

SEQ ID NO: 5160875 - DNA, 15 bp, Homo sapiens
actggcaaagcagaa

SEQ ID NO: 5160876 - DNA, 15 bp, Homo sapiens
actggcaagaggcct

SEQ ID NO: 5160877 - DNA, 16 bp, Homo sapiens
actggcaagaggcctc

SEQ ID NO: 5160878 - DNA, 14 bp, Homo sapiens
actggcaataaact

SEQ ID NO: 5160879 - DNA, 17 bp, Homo sapiens
actggcacacacccctc

SEQ ID NO: 5160880 - DNA, 21 bp, Homo sapiens
actggcacactgctcttaaga

SEQ ID NO: 5160881 - DNA, 12 bp, Homo sapiens
actggcacagag

SEQ ID NO: 5160882 - DNA, 14 bp, Homo sapiens
actggcacagaggt

SEQ ID NO: 5160883 - DNA, 13 bp, Homo sapiens
actggcacagttt

SEQ ID NO: 5160884 - DNA, 21 bp, Homo sapiens
actggcacagttttctgagaa

SEQ ID NO: 5160885 - DNA, 17 bp, Homo sapiens
actggcacgtttgtgag

SEQ ID NO: 5160886 - DNA, 18 bp, Homo sapiens
actggcactgtggcactg

SEQ ID NO: 5160887 - DNA, 20 bp, Homo sapiens
actggcactgtggcactgcc

SEQ ID NO: 5160888 - DNA, 14 bp, Homo sapiens
actggcacttgcct

SEQ ID NO: 5160889 - DNA, 19 bp, Homo sapiens
actggcacttgcctgctgc

SEQ ID NO: 5160890 - DNA, 22 bp, Homo sapiens
actggcagaagcattgcctgga

SEQ ID NO: 5160891 - DNA, 20 bp, Homo sapiens
actggcagactcaaggggct

SEQ ID NO: 5160892 - DNA, 14 bp, Homo sapiens
actggcagactgtg

SEQ ID NO: 5160893 - DNA, 12 bp, Homo sapiens
actggcagagca

SEQ ID NO: 5160894 - DNA, 18 bp, Homo sapiens
actggcagagcacagccc

SEQ ID NO: 5160895 - DNA, 14 bp, Homo sapiens
actggcagccccag

SEQ ID NO: 5160896 - DNA, 16 bp, Homo sapiens
actggcagccccagca

SEQ ID NO: 5160897 - DNA, 14 bp, Homo sapiens
actggcagcctgca

SEQ ID NO: 5160898 - DNA, 11 bp, Homo sapiens
actggcagctc

SEQ ID NO: 5160899 - DNA, 13 bp, Homo sapiens
actggcagctcct

SEQ ID NO: 5160900 - DNA, 13 bp, Homo sapiens
actggcaggagcc

SEQ ID NO: 5160901 - DNA, 14 bp, Homo sapiens
actggcaggagcct

SEQ ID NO: 5160902 - DNA, 21 bp, Homo sapiens
actggcaggatcacagctcac

SEQ ID NO: 5160903 - DNA, 21 bp, Homo sapiens
actggcaggcaggctcccagg

SEQ ID NO: 5160904 - DNA, 12 bp, Homo sapiens
actggcaggtgc

SEQ ID NO: 5160905 - DNA, 18 bp, Homo sapiens
actggcataaatctgaag

SEQ ID NO: 5160906 - DNA, 15 bp, Homo sapiens
actggcatctccctg

SEQ ID NO: 5160907 - DNA, 23 bp, Homo sapiens
actggcatctccctgaccttctc

SEQ ID NO: 5160908 - DNA, 15 bp, Homo sapiens
actggcatctgctct

SEQ ID NO: 5160909 - DNA, 23 bp, Homo sapiens
actggcatggatatagttttact

SEQ ID NO: 5160910 - DNA, 13 bp, Homo sapiens
actggcatggatt

SEQ ID NO: 5160911 - DNA, 19 bp, Homo sapiens
actggcatgtcatttgcac

SEQ ID NO: 5160912 - DNA, 18 bp, Homo sapiens
actggcattttatagaca

SEQ ID NO: 5160913 - DNA, 23 bp, Homo sapiens
actggcattttatagacaccctg

SEQ ID NO: 5160914 - DNA, 16 bp, Homo sapiens
actggccaagctgagg

SEQ ID NO: 5160915 - DNA, 21 bp, Homo sapiens
actggccaagctgaggtgccc

SEQ ID NO: 5160916 - DNA, 13 bp, Homo sapiens
actggccaaggct

SEQ ID NO: 5160917 - DNA, 15 bp, Homo sapiens
actggccaccaggct

SEQ ID NO: 5160918 - DNA, 16 bp, Homo sapiens
actggccaccaggctg

SEQ ID NO: 5160919 - DNA, 19 bp, Homo sapiens
actggccaccaggctggcg

SEQ ID NO: 5160920 - DNA, 23 bp, Homo sapiens
actggccaccaggctggcgcagc

SEQ ID NO: 5160921 - DNA, 15 bp, Homo sapiens
actggccacccaaca

SEQ ID NO: 5160922 - DNA, 14 bp, Homo sapiens
actggccacccctc

SEQ ID NO: 5160923 - DNA, 19 bp, Homo sapiens
actggccagagagggccca

SEQ ID NO: 5160924 - DNA, 23 bp, Homo sapiens
actggccagagagggcccagctg

SEQ ID NO: 5160925 - DNA, 14 bp, Homo sapiens
actggccagccata

SEQ ID NO: 5160926 - DNA, 13 bp, Homo sapiens
actggccagtcct

SEQ ID NO: 5160927 - DNA, 21 bp, Homo sapiens
actggccagtcctagagctcc

SEQ ID NO: 5160928 - DNA, 23 bp, Homo sapiens
actggccagtggctggatctgtg

SEQ ID NO: 5160929 - DNA, 20 bp, Homo sapiens
actggccagttgcccagagc

SEQ ID NO: 5160930 - DNA, 13 bp, Homo sapiens
actggccatctcc

SEQ ID NO: 5160931 - DNA, 14 bp, Homo sapiens
actggccatctcca

SEQ ID NO: 5160932 - DNA, 15 bp, Homo sapiens
actggccatggcctg

SEQ ID NO: 5160933 - DNA, 17 bp, Homo sapiens
actggccatttttctgg

SEQ ID NO: 5160934 - DNA, 18 bp, Homo sapiens
actggccatttttctggg

SEQ ID NO: 5160935 - DNA, 19 bp, Homo sapiens
actggcccacccctcttcc

SEQ ID NO: 5160936 - DNA, 14 bp, Homo sapiens
actggccccacagg

SEQ ID NO: 5160937 - DNA, 11 bp, Homo sapiens
actggccccag

SEQ ID NO: 5160938 - DNA, 14 bp, Homo sapiens
actggccccaggcg

SEQ ID NO: 5160939 - DNA, 22 bp, Homo sapiens
actggccccaggcggaggggct

SEQ ID NO: 5160940 - DNA, 21 bp, Homo sapiens
actggcccctagaatcagcct

SEQ ID NO: 5160941 - DNA, 18 bp, Homo sapiens
actggcccctgacccagg

SEQ ID NO: 5160942 - DNA, 22 bp, Homo sapiens
actggcccctgacccagggact

SEQ ID NO: 5160943 - DNA, 14 bp, Homo sapiens
actggccctctagc

SEQ ID NO: 5160944 - DNA, 14 bp, Homo sapiens
actggccctggggc

SEQ ID NO: 5160945 - DNA, 16 bp, Homo sapiens
actggccgctgggaga

SEQ ID NO: 5160946 - DNA, 17 bp, Homo sapiens
actggccgggcaggcgt

SEQ ID NO: 5160947 - DNA, 13 bp, Homo sapiens
actggccgtggct

SEQ ID NO: 5160948 - DNA, 18 bp, Homo sapiens
actggccgtggctccaga

SEQ ID NO: 5160949 - DNA, 14 bp, Homo sapiens
actggcctaaattt

SEQ ID NO: 5160950 - DNA, 23 bp, Homo sapiens
actggcctctgctgatcctccca

SEQ ID NO: 5160951 - DNA, 17 bp, Homo sapiens
actggcctctgtgatta

SEQ ID NO: 5160952 - DNA, 18 bp, Homo sapiens
actggcctgacttggggg

SEQ ID NO: 5160953 - DNA, 14 bp, Homo sapiens
actggcctgaggag

SEQ ID NO: 5160954 - DNA, 22 bp, Homo sapiens
actggcctgcacggtgggcctt

SEQ ID NO: 5160955 - DNA, 17 bp, Homo sapiens
actggcctgccttcagc

SEQ ID NO: 5160956 - DNA, 18 bp, Homo sapiens
actggcctgctgcgcccc

SEQ ID NO: 5160957 - DNA, 22 bp, Homo sapiens
actggcctgctgcgccccaggc

SEQ ID NO: 5160958 - DNA, 21 bp, Homo sapiens
actggcctgttctgtaggaga

SEQ ID NO: 5160959 - DNA, 21 bp, Homo sapiens
actggccttgcctccaggacc

SEQ ID NO: 5160960 - DNA, 14 bp, Homo sapiens
actggccttttcac

SEQ ID NO: 5160961 - DNA, 16 bp, Homo sapiens
actggcgaagcctgag

SEQ ID NO: 5160962 - DNA, 18 bp, Homo sapiens
actggcgaagcctgagca

SEQ ID NO: 5160963 - DNA, 20 bp, Homo sapiens
actggcgaagcctgagcagg

SEQ ID NO: 5160964 - DNA, 16 bp, Homo sapiens
actggcgatctcccag

SEQ ID NO: 5160965 - DNA, 20 bp, Homo sapiens
actggcgatctcccagggct

SEQ ID NO: 5160966 - DNA, 15 bp, Homo sapiens
actggcgccttctcg

SEQ ID NO: 5160967 - DNA, 22 bp, Homo sapiens
actggcggtcaagtgtggagga

SEQ ID NO: 5160968 - DNA, 13 bp, Homo sapiens
actggctacagta

SEQ ID NO: 5160969 - DNA, 12 bp, Homo sapiens
actggctcaaga

SEQ ID NO: 5160970 - DNA, 16 bp, Homo sapiens
actggctcatgcccct

SEQ ID NO: 5160971 - DNA, 23 bp, Homo sapiens
actggctccatgattctctgagt

SEQ ID NO: 5160972 - DNA, 15 bp, Homo sapiens
actggctcctccagc

SEQ ID NO: 5160973 - DNA, 23 bp, Homo sapiens
actggctcctcccagcacaggca

SEQ ID NO: 5160974 - DNA, 19 bp, Homo sapiens
actggctcctctgtggtgt

SEQ ID NO: 5160975 - DNA, 21 bp, Homo sapiens
actggctcctttgcctctgct

SEQ ID NO: 5160976 - DNA, 23 bp, Homo sapiens
actggctcctttgcctctgctac

SEQ ID NO: 5160977 - DNA, 12 bp, Homo sapiens
actggctctcca

SEQ ID NO: 5160978 - DNA, 14 bp, Homo sapiens
actggctctccaag

SEQ ID NO: 5160979 - DNA, 20 bp, Homo sapiens
actggctctccaagtgccag

SEQ ID NO: 5160980 - DNA, 15 bp, Homo sapiens
actggctctctccag

SEQ ID NO: 5160981 - DNA, 16 bp, Homo sapiens
actggctctctccagg

SEQ ID NO: 5160982 - DNA, 17 bp, Homo sapiens
actggctctctccagga

SEQ ID NO: 5160983 - DNA, 11 bp, Homo sapiens
actggctctgg

SEQ ID NO: 5160984 - DNA, 13 bp, Homo sapiens
actggctctggga

SEQ ID NO: 5160985 - DNA, 18 bp, Homo sapiens
actggctgaacttggaga

SEQ ID NO: 5160986 - DNA, 12 bp, Homo sapiens
actggctgaccc

SEQ ID NO: 5160987 - DNA, 21 bp, Homo sapiens
actggctgagaatctgggggt

SEQ ID NO: 5160988 - DNA, 14 bp, Homo sapiens
actggctgcctcca

SEQ ID NO: 5160989 - DNA, 21 bp, Homo sapiens
actggctgctccctgctccca

SEQ ID NO: 5160990 - DNA, 23 bp, Homo sapiens
actggctgctccctgctcccagg

SEQ ID NO: 5160991 - DNA, 18 bp, Homo sapiens
actggctgctctgtcttg

SEQ ID NO: 5160992 - DNA, 23 bp, Homo sapiens
actggctgctctgtcttggtcct

SEQ ID NO: 5160993 - DNA, 21 bp, Homo sapiens
actggctggccagtctgggtc

SEQ ID NO: 5160994 - DNA, 15 bp, Homo sapiens
actggctggcctgag

SEQ ID NO: 5160995 - DNA, 13 bp, Homo sapiens
actggctggctcc

SEQ ID NO: 5160996 - DNA, 17 bp, Homo sapiens
actggctggctgcagtg

SEQ ID NO: 5160997 - DNA, 21 bp, Homo sapiens
actggctgggagtccttacct

SEQ ID NO: 5160998 - DNA, 15 bp, Homo sapiens
actggctgggcccct

SEQ ID NO: 5160999 - DNA, 20 bp, Homo sapiens
actggctgggcccctgggga

SEQ ID NO: 5161000 - DNA, 10 bp, Homo sapiens
actggctgta

SEQ ID NO: 5161001 - DNA, 17 bp, Homo sapiens
actggctgtctgcctgt

SEQ ID NO: 5161002 - DNA, 22 bp, Homo sapiens
actggctgtctgcctgtatttt

SEQ ID NO: 5161003 - DNA, 24 bp, Homo sapiens
actggctgtgcccctgatgcagcc

SEQ ID NO: 5161004 - DNA, 17 bp, Homo sapiens
actggctgtgcctcccc

SEQ ID NO: 5161005 - DNA, 23 bp, Homo sapiens
actggctgtgcctcccccgccac

SEQ ID NO: 5161006 - DNA, 17 bp, Homo sapiens
actggctgtgggctccc

SEQ ID NO: 5161007 - DNA, 16 bp, Homo sapiens
actggctgtgtgacct

SEQ ID NO: 5161008 - DNA, 13 bp, Homo sapiens
actggcttcagca

SEQ ID NO: 5161009 - DNA, 15 bp, Homo sapiens
actggcttcagcaag

SEQ ID NO: 5161010 - DNA, 22 bp, Homo sapiens
actggcttctgtgcactagcct

SEQ ID NO: 5161011 - DNA, 23 bp, Homo sapiens
actggcttgctcccgccccaggg

SEQ ID NO: 5161012 - DNA, 13 bp, Homo sapiens
actggcttgtaca

SEQ ID NO: 5161013 - DNA, 17 bp, Homo sapiens
actggctttcctgctgg

SEQ ID NO: 5161014 - DNA, 13 bp, Homo sapiens
actggctttggct

SEQ ID NO: 5161015 - DNA, 21 bp, Homo sapiens
actggctttgggtagtgccat

SEQ ID NO: 5161016 - DNA, 24 bp, Homo sapiens
actggctttgggtagtgccatggc

SEQ ID NO: 5161017 - DNA, 23 bp, Homo sapiens
actggcttttattaatgcacttt

SEQ ID NO: 5161018 - DNA, 17 bp, Homo sapiens
actggctttttcccagc

SEQ ID NO: 5161019 - DNA, 22 bp, Homo sapiens
actgggaaagttaggattcaga

SEQ ID NO: 5161020 - DNA, 16 bp, Homo sapiens
actgggaacagaactc

SEQ ID NO: 5161021 - DNA, 18 bp, Homo sapiens
actgggaacttaggggac

SEQ ID NO: 5161022 - DNA, 13 bp, Homo sapiens
actgggaagaaca

SEQ ID NO: 5161023 - DNA, 16 bp, Homo sapiens
actgggaagaagcaag

SEQ ID NO: 5161024 - DNA, 19 bp, Homo sapiens
actgggaagataggctctg

SEQ ID NO: 5161025 - DNA, 22 bp, Homo sapiens
actgggaagataggctctgcac

SEQ ID NO: 5161026 - DNA, 20 bp, Homo sapiens
actgggaagatgctggcccc

SEQ ID NO: 5161027 - DNA, 16 bp, Homo sapiens
actgggaagctggagt

SEQ ID NO: 5161028 - DNA, 14 bp, Homo sapiens
actgggaaggaaac

SEQ ID NO: 5161029 - DNA, 22 bp, Homo sapiens
actgggaagggggcaggcccct

SEQ ID NO: 5161030 - DNA, 19 bp, Homo sapiens
actgggaatttatttatgt

SEQ ID NO: 5161031 - DNA, 17 bp, Homo sapiens
actgggacagctggctg

SEQ ID NO: 5161032 - DNA, 15 bp, Homo sapiens
actgggaccaggcac

SEQ ID NO: 5161033 - DNA, 17 bp, Homo sapiens
actgggaccgtgcgagc

SEQ ID NO: 5161034 - DNA, 18 bp, Homo sapiens
actgggaccgtgcgagct

SEQ ID NO: 5161035 - DNA, 19 bp, Homo sapiens
actgggaccgtgcgagctg

SEQ ID NO: 5161036 - DNA, 21 bp, Homo sapiens
actgggacctgaatgacctgc

SEQ ID NO: 5161037 - DNA, 17 bp, Homo sapiens
actgggactcccagcag

SEQ ID NO: 5161038 - DNA, 18 bp, Homo sapiens
actgggactcccagcaga

SEQ ID NO: 5161039 - DNA, 20 bp, Homo sapiens
actgggactcccagcagagc

SEQ ID NO: 5161040 - DNA, 21 bp, Homo sapiens
actgggagaagagaacctcaa

SEQ ID NO: 5161041 - DNA, 15 bp, Homo sapiens
actgggagcccccag

SEQ ID NO: 5161042 - DNA, 21 bp, Homo sapiens
actgggagcccccagcctgtc

SEQ ID NO: 5161043 - DNA, 23 bp, Homo sapiens
actgggagcctacccacccccag

SEQ ID NO: 5161044 - DNA, 19 bp, Homo sapiens
actgggaggagggggaggg

SEQ ID NO: 5161045 - DNA, 14 bp, Homo sapiens
actgggaggcaggg

SEQ ID NO: 5161046 - DNA, 22 bp, Homo sapiens
actgggaggccgggcatggtgg

SEQ ID NO: 5161047 - DNA, 12 bp, Homo sapiens
actgggaggctc

SEQ ID NO: 5161048 - DNA, 17 bp, Homo sapiens
actgggaggctcccctt

SEQ ID NO: 5161049 - DNA, 16 bp, Homo sapiens
actgggagtcagagcc

SEQ ID NO: 5161050 - DNA, 18 bp, Homo sapiens
actgggagtgtgggctgc

SEQ ID NO: 5161051 - DNA, 17 bp, Homo sapiens
actgggatcacaggtgt

SEQ ID NO: 5161052 - DNA, 23 bp, Homo sapiens
actcccaggatgacgtgctccgt

SEQ ID NO: 5161053 - DNA, 19 bp, Homo sapiens
actcccagggcccgagcgc

SEQ ID NO: 5161054 - DNA, 22 bp, Homo sapiens
actcccagtccaaatgtcctcc

SEQ ID NO: 5161055 - DNA, 15 bp, Homo sapiens
actcccagtccccag

SEQ ID NO: 5161056 - DNA, 21 bp, Homo sapiens
actcccatatcatataaaatt

SEQ ID NO: 5161057 - DNA, 15 bp, Homo sapiens
actcccatcagccca

SEQ ID NO: 5161058 - DNA, 22 bp, Homo sapiens
actcccatctgtgaaaggaaag

SEQ ID NO: 5161059 - DNA, 13 bp, Homo sapiens
actcccatgaagc

SEQ ID NO: 5161060 - DNA, 16 bp, Homo sapiens
actcccatggctctgg

SEQ ID NO: 5161061 - DNA, 22 bp, Homo sapiens
actcccatgttgggtttgagac

SEQ ID NO: 5161062 - DNA, 21 bp, Homo sapiens
actcccattttggtgtgcatc

SEQ ID NO: 5161063 - DNA, 16 bp, Homo sapiens
actccccaacccccaa

SEQ ID NO: 5161064 - DNA, 20 bp, Homo sapiens
actccccacatcccatcgtc

SEQ ID NO: 5161065 - DNA, 24 bp, Homo sapiens
actccccacttcactttcttcaaa

SEQ ID NO: 5161066 - DNA, 17 bp, Homo sapiens
actccccagagctgtgc

SEQ ID NO: 5161067 - DNA, 19 bp, Homo sapiens
actccccagagctgtgcca

SEQ ID NO: 5161068 - DNA, 20 bp, Homo sapiens
actccccagagctgtgccag

SEQ ID NO: 5161069 - DNA, 16 bp, Homo sapiens
actccccagcccagca

SEQ ID NO: 5161070 - DNA, 19 bp, Homo sapiens
actccccagcccagcaccc

SEQ ID NO: 5161071 - DNA, 14 bp, Homo sapiens
actccccagcccca

SEQ ID NO: 5161072 - DNA, 15 bp, Homo sapiens
actccccagccccac

SEQ ID NO: 5161073 - DNA, 17 bp, Homo sapiens
actccccagccccaccc

SEQ ID NO: 5161074 - DNA, 17 bp, Homo sapiens
actccccagcctgggcc

SEQ ID NO: 5161075 - DNA, 13 bp, Homo sapiens
actccccaggcca

SEQ ID NO: 5161076 - DNA, 14 bp, Homo sapiens
actccccagggcct

SEQ ID NO: 5161077 - DNA, 19 bp, Homo sapiens
actccccagggcctccagg

SEQ ID NO: 5161078 - DNA, 19 bp, Homo sapiens
actccccagtgctcctgtg

SEQ ID NO: 5161079 - DNA, 19 bp, Homo sapiens
actcccccaaccaaggaag

SEQ ID NO: 5161080 - DNA, 20 bp, Homo sapiens
actcccccaaccaaggaagg

SEQ ID NO: 5161081 - DNA, 19 bp, Homo sapiens
actcccccacccatgggga

SEQ ID NO: 5161082 - DNA, 22 bp, Homo sapiens
actcccccacccatggggagga

SEQ ID NO: 5161083 - DNA, 19 bp, Homo sapiens
actcccccaccgcccactc

SEQ ID NO: 5161084 - DNA, 15 bp, Homo sapiens
actcccccagaggtg

SEQ ID NO: 5161085 - DNA, 15 bp, Homo sapiens
actcccccagcccca

SEQ ID NO: 5161086 - DNA, 13 bp, Homo sapiens
actcccccaggag

SEQ ID NO: 5161087 - DNA, 19 bp, Homo sapiens
actcccccagttcccgggc

SEQ ID NO: 5161088 - DNA, 23 bp, Homo sapiens
actcccccctccattcccacccc

SEQ ID NO: 5161089 - DNA, 16 bp, Homo sapiens
actccccccttccaaa

SEQ ID NO: 5161090 - DNA, 14 bp, Homo sapiens
actccccctccccg

SEQ ID NO: 5161091 - DNA, 17 bp, Homo sapiens
actccccctccccggca

SEQ ID NO: 5161092 - DNA, 22 bp, Homo sapiens
actccccgcccgccctcctctg

SEQ ID NO: 5161093 - DNA, 16 bp, Homo sapiens
actccccgcctcccca

SEQ ID NO: 5161094 - DNA, 12 bp, Homo sapiens
actcccctcctt

SEQ ID NO: 5161095 - DNA, 16 bp, Homo sapiens
actcccctgcactgga

SEQ ID NO: 5161096 - DNA, 14 bp, Homo sapiens
actcccctgggggt

SEQ ID NO: 5161097 - DNA, 21 bp, Homo sapiens
actcccctgtttcaatcactg

SEQ ID NO: 5161098 - DNA, 14 bp, Homo sapiens
actccccttccctg

SEQ ID NO: 5161099 - DNA, 15 bp, Homo sapiens
actccccttccctgg

SEQ ID NO: 5161100 - DNA, 22 bp, Homo sapiens
actccccttgccttcccctgtc

SEQ ID NO: 5161101 - DNA, 19 bp, Homo sapiens
actcccgaaagcctttcct

SEQ ID NO: 5161102 - DNA, 18 bp, Homo sapiens
actcccgccccgggctgg

SEQ ID NO: 5161103 - DNA, 19 bp, Homo sapiens
actcccgccccgggctggc

SEQ ID NO: 5161104 - DNA, 17 bp, Homo sapiens
actcccgcctcagggcc

SEQ ID NO: 5161105 - DNA, 22 bp, Homo sapiens
actcccgcctcagggccaggcc

SEQ ID NO: 5161106 - DNA, 13 bp, Homo sapiens
actcccgctgagc

SEQ ID NO: 5161107 - DNA, 15 bp, Homo sapiens
actcccgctgagccc

SEQ ID NO: 5161108 - DNA, 22 bp, Homo sapiens
actcccggagcctgtgcagcct

SEQ ID NO: 5161109 - DNA, 23 bp, Homo sapiens
actcccggaggtgtcaccttcct

SEQ ID NO: 5161110 - DNA, 18 bp, Homo sapiens
actcccggcactccatgc

SEQ ID NO: 5161111 - DNA, 19 bp, Homo sapiens
actcccggcctaggcacct

SEQ ID NO: 5161112 - DNA, 22 bp, Homo sapiens
actcccgggccaagacagatgg

SEQ ID NO: 5161113 - DNA, 18 bp, Homo sapiens
actcccgggccacgcccc

SEQ ID NO: 5161114 - DNA, 22 bp, Homo sapiens
actcccgggccacgccccagcc

SEQ ID NO: 5161115 - DNA, 19 bp, Homo sapiens
actccctaaagccctcttc

SEQ ID NO: 5161116 - DNA, 19 bp, Homo sapiens
actccctagtctccacctg

SEQ ID NO: 5161117 - DNA, 16 bp, Homo sapiens
actccctagttaccca

SEQ ID NO: 5161118 - DNA, 18 bp, Homo sapiens
actccctagttacccacc

SEQ ID NO: 5161119 - DNA, 16 bp, Homo sapiens
actccctccaccagcc

SEQ ID NO: 5161120 - DNA, 20 bp, Homo sapiens
actccctccaccagcctgct

SEQ ID NO: 5161121 - DNA, 21 bp, Homo sapiens
actccctccaccagcctgctg

SEQ ID NO: 5161122 - DNA, 15 bp, Homo sapiens
actccctccagcaca

SEQ ID NO: 5161123 - DNA, 13 bp, Homo sapiens
actccctccatag

SEQ ID NO: 5161124 - DNA, 16 bp, Homo sapiens
actccctccatgtggc

SEQ ID NO: 5161125 - DNA, 23 bp, Homo sapiens
actccctccatgtggccccaggt

SEQ ID NO: 5161126 - DNA, 14 bp, Homo sapiens
actccctcccagaa

SEQ ID NO: 5161127 - DNA, 14 bp, Homo sapiens
actccctccccacc

SEQ ID NO: 5161128 - DNA, 15 bp, Homo sapiens
actccctccccaccc

SEQ ID NO: 5161129 - DNA, 23 bp, Homo sapiens
actccctccccagatctgtcctg

SEQ ID NO: 5161130 - DNA, 14 bp, Homo sapiens
actccctcccctgc

SEQ ID NO: 5161131 - DNA, 15 bp, Homo sapiens
actccctcccctgcc

SEQ ID NO: 5161132 - DNA, 12 bp, Homo sapiens
actccctcctca

SEQ ID NO: 5161133 - DNA, 20 bp, Homo sapiens
actccctcctcacctctgga

SEQ ID NO: 5161134 - DNA, 16 bp, Homo sapiens
actccctcctggagct

SEQ ID NO: 5161135 - DNA, 21 bp, Homo sapiens
actccctcgtcgagctggatg

SEQ ID NO: 5161136 - DNA, 13 bp, Homo sapiens
actccctctcagg

SEQ ID NO: 5161137 - DNA, 15 bp, Homo sapiens
actccctctgccttc

SEQ ID NO: 5161138 - DNA, 16 bp, Homo sapiens
actccctctgccttca

SEQ ID NO: 5161139 - DNA, 23 bp, Homo sapiens
actccctctgccttcaggcttct

SEQ ID NO: 5161140 - DNA, 23 bp, Homo sapiens
actccctcttgtcagtgtagaca

SEQ ID NO: 5161141 - DNA, 20 bp, Homo sapiens
actccctgaacctcagtttc

SEQ ID NO: 5161142 - DNA, 17 bp, Homo sapiens
actccctgagtctggac

SEQ ID NO: 5161143 - DNA, 19 bp, Homo sapiens
actccctgagtctggacct

SEQ ID NO: 5161144 - DNA, 22 bp, Homo sapiens
actccctgagtctggacctcca

SEQ ID NO: 5161145 - DNA, 12 bp, Homo sapiens
actccctgccaa

SEQ ID NO: 5161146 - DNA, 17 bp, Homo sapiens
actccctgccaactcca

SEQ ID NO: 5161147 - DNA, 23 bp, Homo sapiens
actccctgccaactccatgacca

SEQ ID NO: 5161148 - DNA, 22 bp, Homo sapiens
actccctgccaccgtcacacag

SEQ ID NO: 5161149 - DNA, 19 bp, Homo sapiens
actccctgccattttttaa

SEQ ID NO: 5161150 - DNA, 19 bp, Homo sapiens
actccctgcccttccccct

SEQ ID NO: 5161151 - DNA, 12 bp, Homo sapiens
actccctgccta

SEQ ID NO: 5161152 - DNA, 13 bp, Homo sapiens
actccctgctcca

SEQ ID NO: 5161153 - DNA, 15 bp, Homo sapiens
actccctgcttgcag

SEQ ID NO: 5161154 - DNA, 15 bp, Homo sapiens
actccctggccttgc

SEQ ID NO: 5161155 - DNA, 23 bp, Homo sapiens
actccctgggaaaggggttgtca

SEQ ID NO: 5161156 - DNA, 18 bp, Homo sapiens
actccctgggacacagac

SEQ ID NO: 5161157 - DNA, 18 bp, Homo sapiens
actccctgtctgaaacca

SEQ ID NO: 5161158 - DNA, 22 bp, Homo sapiens
actccctgtgggggtggccatc

SEQ ID NO: 5161159 - DNA, 13 bp, Homo sapiens
actcccttcccat

SEQ ID NO: 5161160 - DNA, 21 bp, Homo sapiens
actcccttcccatgacccagg

SEQ ID NO: 5161161 - DNA, 20 bp, Homo sapiens
actcccttcctggcctcact

SEQ ID NO: 5161162 - DNA, 15 bp, Homo sapiens
actcccttctacctg

SEQ ID NO: 5161163 - DNA, 20 bp, Homo sapiens
actcccttctacctgccact

SEQ ID NO: 5161164 - DNA, 22 bp, Homo sapiens
actcccttctacctgccactca

SEQ ID NO: 5161165 - DNA, 15 bp, Homo sapiens
actcccttctgcttg

SEQ ID NO: 5161166 - DNA, 19 bp, Homo sapiens
actcccttgctggccccag

SEQ ID NO: 5161167 - DNA, 23 bp, Homo sapiens
actcccttgctggccccagccct

SEQ ID NO: 5161168 - DNA, 14 bp, Homo sapiens
actcccttgggctc

SEQ ID NO: 5161169 - DNA, 21 bp, Homo sapiens
actcccttggtggcaagagcc

SEQ ID NO: 5161170 - DNA, 14 bp, Homo sapiens
actccctttaaaga

SEQ ID NO: 5161171 - DNA, 14 bp, Homo sapiens
actccctttcagtg

SEQ ID NO: 5161172 - DNA, 17 bp, Homo sapiens
actccctttccaacctc

SEQ ID NO: 5161173 - DNA, 16 bp, Homo sapiens
actccctttcccctct

SEQ ID NO: 5161174 - DNA, 21 bp, Homo sapiens
actccgaaagtctgaatctcc

SEQ ID NO: 5161175 - DNA, 18 bp, Homo sapiens
actccgactccccctccc

SEQ ID NO: 5161176 - DNA, 20 bp, Homo sapiens
actccgactccccctccccg

SEQ ID NO: 5161177 - DNA, 14 bp, Homo sapiens
actccgagaacaac

SEQ ID NO: 5161178 - DNA, 16 bp, Homo sapiens
actccgagaacaacag

SEQ ID NO: 5161179 - DNA, 22 bp, Homo sapiens
actccgagaggtgggccagtct

SEQ ID NO: 5161180 - DNA, 18 bp, Homo sapiens
actccgagtgaactggtc

SEQ ID NO: 5161181 - DNA, 17 bp, Homo sapiens
actccgccagccacagg

SEQ ID NO: 5161182 - DNA, 21 bp, Homo sapiens
actccgccagccacaggacca

SEQ ID NO: 5161183 - DNA, 23 bp, Homo sapiens
actccgccagccacaggaccacc

SEQ ID NO: 5161184 - DNA, 17 bp, Homo sapiens
actccgcccagcctctc

SEQ ID NO: 5161185 - DNA, 18 bp, Homo sapiens
actccgcccagcctctcc

SEQ ID NO: 5161186 - DNA, 16 bp, Homo sapiens
actccgcccccagcct

SEQ ID NO: 5161187 - DNA, 17 bp, Homo sapiens
actccgcccccagccta

SEQ ID NO: 5161188 - DNA, 18 bp, Homo sapiens
actccgcccccagcctat

SEQ ID NO: 5161189 - DNA, 21 bp, Homo sapiens
actccgccctcctcgggccga

SEQ ID NO: 5161190 - DNA, 23 bp, Homo sapiens
actccgcgccgatgccaccggcc

SEQ ID NO: 5161191 - DNA, 18 bp, Homo sapiens
actccggagtgagaagct

SEQ ID NO: 5161192 - DNA, 21 bp, Homo sapiens
actccggattccggccctggc

SEQ ID NO: 5161193 - DNA, 22 bp, Homo sapiens
actccggattccggccctggct

SEQ ID NO: 5161194 - DNA, 15 bp, Homo sapiens
actccggccctccta

SEQ ID NO: 5161195 - DNA, 15 bp, Homo sapiens
actccggcctgggtg

SEQ ID NO: 5161196 - DNA, 16 bp, Homo sapiens
actccggctgtgctgg

SEQ ID NO: 5161197 - DNA, 18 bp, Homo sapiens
actccggctgtgctggga

SEQ ID NO: 5161198 - DNA, 18 bp, Homo sapiens
actccgggaccattgacc

SEQ ID NO: 5161199 - DNA, 22 bp, Homo sapiens
actccgggtttgagatggacac

SEQ ID NO: 5161200 - DNA, 20 bp, Homo sapiens
actccggtgtgcctgcagcc

SEQ ID NO: 5161201 - DNA, 23 bp, Homo sapiens
actccgtccatccgactgcccct

SEQ ID NO: 5161202 - DNA, 19 bp, Homo sapiens
actccgtgaggctgctgcc

SEQ ID NO: 5161203 - DNA, 20 bp, Homo sapiens
actccgtgcttaaccaaaga

SEQ ID NO: 5161204 - DNA, 15 bp, Homo sapiens
actccgttcctggca

SEQ ID NO: 5161205 - DNA, 17 bp, Homo sapiens
actccgttggccactcc

SEQ ID NO: 5161206 - DNA, 18 bp, Homo sapiens
actccgttggccactccg

SEQ ID NO: 5161207 - DNA, 21 bp, Homo sapiens
actccgttggccactccgaga

SEQ ID NO: 5161208 - DNA, 15 bp, Homo sapiens
actcctaaaactttt

SEQ ID NO: 5161209 - DNA, 17 bp, Homo sapiens
actcctaaataaactag

SEQ ID NO: 5161210 - DNA, 14 bp, Homo sapiens
actcctaacctcgg

SEQ ID NO: 5161211 - DNA, 18 bp, Homo sapiens
actcctaattaagggaca

SEQ ID NO: 5161212 - DNA, 20 bp, Homo sapiens
actcctacaagatttagaaa

SEQ ID NO: 5161213 - DNA, 18 bp, Homo sapiens
actcctacacctaactca

SEQ ID NO: 5161214 - DNA, 15 bp, Homo sapiens
actcctacctcagcc

SEQ ID NO: 5161215 - DNA, 15 bp, Homo sapiens
actcctacctgaagg

SEQ ID NO: 5161216 - DNA, 18 bp, Homo sapiens
actcctagttctagaaaa

SEQ ID NO: 5161217 - DNA, 20 bp, Homo sapiens
actcctagttctagaaaaac

SEQ ID NO: 5161218 - DNA, 17 bp, Homo sapiens
actcctataaagtgcct

SEQ ID NO: 5161219 - DNA, 16 bp, Homo sapiens
actcctatgatctgag

SEQ ID NO: 5161220 - DNA, 14 bp, Homo sapiens
actcctatgcttta

SEQ ID NO: 5161221 - DNA, 17 bp, Homo sapiens
actcctatttttgtaaa

SEQ ID NO: 5161222 - DNA, 17 bp, Homo sapiens
actcctcaaaccacttg

SEQ ID NO: 5161223 - DNA, 21 bp, Homo sapiens
actcctcaaaccacttgcctg

SEQ ID NO: 5161224 - DNA, 15 bp, Homo sapiens
actcctcaagacttt

SEQ ID NO: 5161225 - DNA, 19 bp, Homo sapiens
actcctcaagactttgatc

SEQ ID NO: 5161226 - DNA, 21 bp, Homo sapiens
actcctcaagactttgatcct

SEQ ID NO: 5161227 - DNA, 20 bp, Homo sapiens
actcctcacacttactgtaa

SEQ ID NO: 5161228 - DNA, 21 bp, Homo sapiens
actgggatggaatggcagcat

SEQ ID NO: 5161229 - DNA, 22 bp, Homo sapiens
actgggatgggaacactggtgg

SEQ ID NO: 5161230 - DNA, 22 bp, Homo sapiens
actgggatgggaggagaggaca

SEQ ID NO: 5161231 - DNA, 22 bp, Homo sapiens
actgggattaagaaaccttgct

SEQ ID NO: 5161232 - DNA, 16 bp, Homo sapiens
actgggattcatggct

SEQ ID NO: 5161233 - DNA, 16 bp, Homo sapiens
actgggcacacgcaca

SEQ ID NO: 5161234 - DNA, 19 bp, Homo sapiens
actgggcacagattgaaga

SEQ ID NO: 5161235 - DNA, 20 bp, Homo sapiens
actgggcacagattgaagaa

SEQ ID NO: 5161236 - DNA, 17 bp, Homo sapiens
actgggcacccctgcct

SEQ ID NO: 5161237 - DNA, 16 bp, Homo sapiens
actgggcactggggcc

SEQ ID NO: 5161238 - DNA, 16 bp, Homo sapiens
actgggcagcaaggct

SEQ ID NO: 5161239 - DNA, 22 bp, Homo sapiens
actgggcagcaaggctgctgcc

SEQ ID NO: 5161240 - DNA, 19 bp, Homo sapiens
actgggcaggttcctgggg

SEQ ID NO: 5161241 - DNA, 22 bp, Homo sapiens
actgggcaggttcctggggccg

SEQ ID NO: 5161242 - DNA, 18 bp, Homo sapiens
actgggcatttcacgaac

SEQ ID NO: 5161243 - DNA, 15 bp, Homo sapiens
actgggccagcagag

SEQ ID NO: 5161244 - DNA, 16 bp, Homo sapiens
actgggccagcagagc

SEQ ID NO: 5161245 - DNA, 18 bp, Homo sapiens
actgggccagcagagcat

SEQ ID NO: 5161246 - DNA, 15 bp, Homo sapiens
actgggccagccctg

SEQ ID NO: 5161247 - DNA, 15 bp, Homo sapiens
actgggccaggggag

SEQ ID NO: 5161248 - DNA, 22 bp, Homo sapiens
actgggccatgggtcctcggcc

SEQ ID NO: 5161249 - DNA, 20 bp, Homo sapiens
actgggccatgttgtgcctc

SEQ ID NO: 5161250 - DNA, 14 bp, Homo sapiens
actgggcccagagg

SEQ ID NO: 5161251 - DNA, 21 bp, Homo sapiens
actgggcccagaggagaggag

SEQ ID NO: 5161252 - DNA, 17 bp, Homo sapiens
actgggcccaggcaggt

SEQ ID NO: 5161253 - DNA, 15 bp, Homo sapiens
actgggccccattct

SEQ ID NO: 5161254 - DNA, 13 bp, Homo sapiens
actgggcccctca

SEQ ID NO: 5161255 - DNA, 22 bp, Homo sapiens
actgggcccctcaggggaagct

SEQ ID NO: 5161256 - DNA, 19 bp, Homo sapiens
actgggcccctgtccccag

SEQ ID NO: 5161257 - DNA, 12 bp, Homo sapiens
actgggccctga

SEQ ID NO: 5161258 - DNA, 16 bp, Homo sapiens
actgggccctgagcca

SEQ ID NO: 5161259 - DNA, 14 bp, Homo sapiens
actgggccctgagt

SEQ ID NO: 5161260 - DNA, 13 bp, Homo sapiens
actgggccctgcc

SEQ ID NO: 5161261 - DNA, 18 bp, Homo sapiens
actgggccctggggctgc

SEQ ID NO: 5161262 - DNA, 21 bp, Homo sapiens
actgggccctggggctgccct

SEQ ID NO: 5161263 - DNA, 22 bp, Homo sapiens
actgggccctggggctgccctc

SEQ ID NO: 5161264 - DNA, 17 bp, Homo sapiens
actgggccctgtccagg

SEQ ID NO: 5161265 - DNA, 18 bp, Homo sapiens
actgggccggcagcctgg

SEQ ID NO: 5161266 - DNA, 12 bp, Homo sapiens
actgggccgggc

SEQ ID NO: 5161267 - DNA, 19 bp, Homo sapiens
actgggccgggcccagggc

SEQ ID NO: 5161268 - DNA, 21 bp, Homo sapiens
actgggccttgtgtgctggct

SEQ ID NO: 5161269 - DNA, 13 bp, Homo sapiens
actgggcctttcc

SEQ ID NO: 5161270 - DNA, 15 bp, Homo sapiens
actgggcctttccag

SEQ ID NO: 5161271 - DNA, 20 bp, Homo sapiens
actgggctcaagtgatcctc

SEQ ID NO: 5161272 - DNA, 16 bp, Homo sapiens
actgggctcccgggcc

SEQ ID NO: 5161273 - DNA, 14 bp, Homo sapiens
actgggctctgagg

SEQ ID NO: 5161274 - DNA, 14 bp, Homo sapiens
actgggctctggac

SEQ ID NO: 5161275 - DNA, 17 bp, Homo sapiens
actgggctgagggagcc

SEQ ID NO: 5161276 - DNA, 21 bp, Homo sapiens
actgggctgcccacctggctg

SEQ ID NO: 5161277 - DNA, 13 bp, Homo sapiens
actgggctgctgg

SEQ ID NO: 5161278 - DNA, 17 bp, Homo sapiens
actgggctgctggggca

SEQ ID NO: 5161279 - DNA, 14 bp, Homo sapiens
actgggctggctgc

SEQ ID NO: 5161280 - DNA, 23 bp, Homo sapiens
actgggctgggcctcgtgcgccc

SEQ ID NO: 5161281 - DNA, 13 bp, Homo sapiens
actgggctgggtt

SEQ ID NO: 5161282 - DNA, 16 bp, Homo sapiens
actgggctgggtttgc

SEQ ID NO: 5161283 - DNA, 21 bp, Homo sapiens
actgggcttggggaccagagc

SEQ ID NO: 5161284 - DNA, 22 bp, Homo sapiens
actgggcttggggaccagagct

SEQ ID NO: 5161285 - DNA, 19 bp, Homo sapiens
actggggaaaactccacct

SEQ ID NO: 5161286 - DNA, 13 bp, Homo sapiens
actggggaaaagg

SEQ ID NO: 5161287 - DNA, 15 bp, Homo sapiens
actggggaaacataa

SEQ ID NO: 5161288 - DNA, 15 bp, Homo sapiens
actggggaaactggc

SEQ ID NO: 5161289 - DNA, 16 bp, Homo sapiens
actggggaaacttcct

SEQ ID NO: 5161290 - DNA, 17 bp, Homo sapiens
actggggacttggcctc

SEQ ID NO: 5161291 - DNA, 17 bp, Homo sapiens
actggggagcccgtctc

SEQ ID NO: 5161292 - DNA, 21 bp, Homo sapiens
actggggagcccgtctcagtg

SEQ ID NO: 5161293 - DNA, 21 bp, Homo sapiens
actggggaggctgaggcagga

SEQ ID NO: 5161294 - DNA, 19 bp, Homo sapiens
actggggagttataaaaat

SEQ ID NO: 5161295 - DNA, 23 bp, Homo sapiens
actggggagttataaaaatacaa

SEQ ID NO: 5161296 - DNA, 19 bp, Homo sapiens
actggggatcccgtgctgg

SEQ ID NO: 5161297 - DNA, 22 bp, Homo sapiens
actggggatcccgtgctggaag

SEQ ID NO: 5161298 - DNA, 16 bp, Homo sapiens
actggggcaggggccg

SEQ ID NO: 5161299 - DNA, 16 bp, Homo sapiens
actggggcctccagaa

SEQ ID NO: 5161300 - DNA, 17 bp, Homo sapiens
actggggcctccagaac

SEQ ID NO: 5161301 - DNA, 23 bp, Homo sapiens
actggggcctggggctctagccc

SEQ ID NO: 5161302 - DNA, 15 bp, Homo sapiens
actggggctggcaca

SEQ ID NO: 5161303 - DNA, 19 bp, Homo sapiens
actggggctggggaaggaa

SEQ ID NO: 5161304 - DNA, 19 bp, Homo sapiens
actggggctttgccttgca

SEQ ID NO: 5161305 - DNA, 15 bp, Homo sapiens
actgggggaaaagat

SEQ ID NO: 5161306 - DNA, 13 bp, Homo sapiens
actgggggagggg

SEQ ID NO: 5161307 - DNA, 18 bp, Homo sapiens
actggggggaccaaatag

SEQ ID NO: 5161308 - DNA, 23 bp, Homo sapiens
actggggggaccaaatagccacc

SEQ ID NO: 5161309 - DNA, 15 bp, Homo sapiens
actggggggcaggcc

SEQ ID NO: 5161310 - DNA, 18 bp, Homo sapiens
actggggggcaggcctcc

SEQ ID NO: 5161311 - DNA, 21 bp, Homo sapiens
actggggggcaggcctcccaa

SEQ ID NO: 5161312 - DNA, 15 bp, Homo sapiens
actggggggccacca

SEQ ID NO: 5161313 - DNA, 19 bp, Homo sapiens
actgggggttgcgggggga

SEQ ID NO: 5161314 - DNA, 17 bp, Homo sapiens
actggggtaccacatgg

SEQ ID NO: 5161315 - DNA, 19 bp, Homo sapiens
actggggtaccacatggtc

SEQ ID NO: 5161316 - DNA, 22 bp, Homo sapiens
actggggtcattttgactggct

SEQ ID NO: 5161317 - DNA, 23 bp, Homo sapiens
actggggtcattttgactggctt

SEQ ID NO: 5161318 - DNA, 13 bp, Homo sapiens
actggggtctgtt

SEQ ID NO: 5161319 - DNA, 15 bp, Homo sapiens
actggggtgccgcct

SEQ ID NO: 5161320 - DNA, 18 bp, Homo sapiens
actggggtgggagggggc

SEQ ID NO: 5161321 - DNA, 22 bp, Homo sapiens
actggggtgggagggggcaggg

SEQ ID NO: 5161322 - DNA, 17 bp, Homo sapiens
actggggtgggaggtct

SEQ ID NO: 5161323 - DNA, 20 bp, Homo sapiens
actgggtaatgaaacaaaga

SEQ ID NO: 5161324 - DNA, 17 bp, Homo sapiens
actgggtaatttataaa

SEQ ID NO: 5161325 - DNA, 12 bp, Homo sapiens
actgggtacaag

SEQ ID NO: 5161326 - DNA, 18 bp, Homo sapiens
actgggtacaagagatgg

SEQ ID NO: 5161327 - DNA, 17 bp, Homo sapiens
actgggtacccaaaaca

SEQ ID NO: 5161328 - DNA, 15 bp, Homo sapiens
actgggtaggaaaga

SEQ ID NO: 5161329 - DNA, 14 bp, Homo sapiens
actgggtctgacct

SEQ ID NO: 5161330 - DNA, 16 bp, Homo sapiens
actgggtctgacctgg

SEQ ID NO: 5161331 - DNA, 19 bp, Homo sapiens
actgggtctgacctggtgg

SEQ ID NO: 5161332 - DNA, 13 bp, Homo sapiens
actgggtctgcga

SEQ ID NO: 5161333 - DNA, 15 bp, Homo sapiens
actgggtcttcagct

SEQ ID NO: 5161334 - DNA, 17 bp, Homo sapiens
actgggtcttcagcttt

SEQ ID NO: 5161335 - DNA, 18 bp, Homo sapiens
actgggtcttcagcttta

SEQ ID NO: 5161336 - DNA, 13 bp, Homo sapiens
actgggtgagaga

SEQ ID NO: 5161337 - DNA, 21 bp, Homo sapiens
actgggtgcccaagctcagaa

SEQ ID NO: 5161338 - DNA, 18 bp, Homo sapiens
actgggtggtggcctggt

SEQ ID NO: 5161339 - DNA, 17 bp, Homo sapiens
actgggtgtaaacacat

SEQ ID NO: 5161340 - DNA, 14 bp, Homo sapiens
actgggtgtcattt

SEQ ID NO: 5161341 - DNA, 20 bp, Homo sapiens
actgggtgtcatttcattcc

SEQ ID NO: 5161342 - DNA, 22 bp, Homo sapiens
actgggtgttgatcttacaaga

SEQ ID NO: 5161343 - DNA, 14 bp, Homo sapiens
actgggttaaatat

SEQ ID NO: 5161344 - DNA, 15 bp, Homo sapiens
actgggttaaatatt

SEQ ID NO: 5161345 - DNA, 16 bp, Homo sapiens
actgggttaaatattt

SEQ ID NO: 5161346 - DNA, 17 bp, Homo sapiens
actgggttaaatatttt

SEQ ID NO: 5161347 - DNA, 20 bp, Homo sapiens
actgggttaaatattttgct

SEQ ID NO: 5161348 - DNA, 23 bp, Homo sapiens
actgggttatttttgtccctgct

SEQ ID NO: 5161349 - DNA, 15 bp, Homo sapiens
actgggttcaaaaag

SEQ ID NO: 5161350 - DNA, 14 bp, Homo sapiens
actgggttcttgtt

SEQ ID NO: 5161351 - DNA, 20 bp, Homo sapiens
actgggttgactttcaggta

SEQ ID NO: 5161352 - DNA, 18 bp, Homo sapiens
actgggttggaagaaata

SEQ ID NO: 5161353 - DNA, 20 bp, Homo sapiens
actgggtttcaagaaaatct

SEQ ID NO: 5161354 - DNA, 19 bp, Homo sapiens
actgggtttggaccccagc

SEQ ID NO: 5161355 - DNA, 20 bp, Homo sapiens
actgggtttggaccccagct

SEQ ID NO: 5161356 - DNA, 21 bp, Homo sapiens
actgggtttggaccccagctg

SEQ ID NO: 5161357 - DNA, 22 bp, Homo sapiens
actgggtttggaccccagctgg

SEQ ID NO: 5161358 - DNA, 22 bp, Homo sapiens
actggtacccgcccttccgagc

SEQ ID NO: 5161359 - DNA, 16 bp, Homo sapiens
actggtacttagagtt

SEQ ID NO: 5161360 - DNA, 20 bp, Homo sapiens
actggtacttagagtttctg

SEQ ID NO: 5161361 - DNA, 23 bp, Homo sapiens
actggtacttagagtttctgttt

SEQ ID NO: 5161362 - DNA, 14 bp, Homo sapiens
actggtacttcctt

SEQ ID NO: 5161363 - DNA, 16 bp, Homo sapiens
actggtaggaggaggc

SEQ ID NO: 5161364 - DNA, 17 bp, Homo sapiens
actggtaggaggaggca

SEQ ID NO: 5161365 - DNA, 18 bp, Homo sapiens
actggtaggaggaggcat

SEQ ID NO: 5161366 - DNA, 20 bp, Homo sapiens
actggtaggaggaggcatgg

SEQ ID NO: 5161367 - DNA, 21 bp, Homo sapiens
actggtaggaggaggcatgga

SEQ ID NO: 5161368 - DNA, 18 bp, Homo sapiens
actggtatgaataattgc

SEQ ID NO: 5161369 - DNA, 13 bp, Homo sapiens
actggtatgatgt

SEQ ID NO: 5161370 - DNA, 18 bp, Homo sapiens
actggtatgtaaaagaaa

SEQ ID NO: 5161371 - DNA, 19 bp, Homo sapiens
actggtcagggcagtggcc

SEQ ID NO: 5161372 - DNA, 17 bp, Homo sapiens
actggtcatcagtattg

SEQ ID NO: 5161373 - DNA, 19 bp, Homo sapiens
actggtccactcagggctg

SEQ ID NO: 5161374 - DNA, 23 bp, Homo sapiens
actggtccactcagggctgccac

SEQ ID NO: 5161375 - DNA, 18 bp, Homo sapiens
actggtccagctctgaca

SEQ ID NO: 5161376 - DNA, 23 bp, Homo sapiens
actggtccagctctgacatccct

SEQ ID NO: 5161377 - DNA, 20 bp, Homo sapiens
actggtcctgtgtgcagtga

SEQ ID NO: 5161378 - DNA, 16 bp, Homo sapiens
actggtctaatgtttg

SEQ ID NO: 5161379 - DNA, 14 bp, Homo sapiens
actggtctacactg

SEQ ID NO: 5161380 - DNA, 14 bp, Homo sapiens
actggtctcagagg

SEQ ID NO: 5161381 - DNA, 17 bp, Homo sapiens
actggtctcaggccaag

SEQ ID NO: 5161382 - DNA, 18 bp, Homo sapiens
actggtctcgaactcctg

SEQ ID NO: 5161383 - DNA, 23 bp, Homo sapiens
actggtctgcttaaagcttccct

SEQ ID NO: 5161384 - DNA, 12 bp, Homo sapiens
actggtctgtct

SEQ ID NO: 5161385 - DNA, 16 bp, Homo sapiens
actggtgactgattct

SEQ ID NO: 5161386 - DNA, 19 bp, Homo sapiens
actggtgactgattcttca

SEQ ID NO: 5161387 - DNA, 20 bp, Homo sapiens
actggtgactgattcttcag

SEQ ID NO: 5161388 - DNA, 21 bp, Homo sapiens
actggtgactgcgatcttcag

SEQ ID NO: 5161389 - DNA, 15 bp, Homo sapiens
actggtgatatatct

SEQ ID NO: 5161390 - DNA, 23 bp, Homo sapiens
actggtgatgcctaattatgaat

SEQ ID NO: 5161391 - DNA, 20 bp, Homo sapiens
actggtgatgggacaattct

SEQ ID NO: 5161392 - DNA, 23 bp, Homo sapiens
actggtgatgttgaaatatgcat

SEQ ID NO: 5161393 - DNA, 18 bp, Homo sapiens
actggtgcactttgtaaa

SEQ ID NO: 5161394 - DNA, 22 bp, Homo sapiens
actggtgcactttgtaaattcc

SEQ ID NO: 5161395 - DNA, 14 bp, Homo sapiens
actggtgcatgaca

SEQ ID NO: 5161396 - DNA, 15 bp, Homo sapiens
actggtgcatttaaa

SEQ ID NO: 5161397 - DNA, 13 bp, Homo sapiens
actggtgccaaaa

SEQ ID NO: 5161398 - DNA, 18 bp, Homo sapiens
actggtgcctggcacagc

SEQ ID NO: 5161399 - DNA, 20 bp, Homo sapiens
actggtgcgaccccccaccc

SEQ ID NO: 5161400 - DNA, 23 bp, Homo sapiens
actggtgctataggctggagaag

SEQ ID NO: 5161401 - DNA, 14 bp, Homo sapiens
actggtgctgagtg

SEQ ID NO: 5161402 - DNA, 21 bp, Homo sapiens
actggtggcccgacagcctgg

SEQ ID NO: 5161403 - DNA, 22 bp, Homo sapiens
actggtggggataggccagccg

SEQ ID NO: 5161404 - DNA, 21 bp, Homo sapiens
actggtgggggttctggcagg

SEQ ID NO: 5161405 - DNA, 22 bp, Homo sapiens
actggtgggggttctggcagga

SEQ ID NO: 5161406 - DNA, 16 bp, Homo sapiens
actggtgtaaaaaaca

SEQ ID NO: 5161407 - DNA, 15 bp, Homo sapiens
actggtgtatctcag

SEQ ID NO: 5161408 - DNA, 17 bp, Homo sapiens
actggtgtatgaaatga

SEQ ID NO: 5161409 - DNA, 14 bp, Homo sapiens
actggtgtccagct

SEQ ID NO: 5161410 - DNA, 17 bp, Homo sapiens
actggtgtgacctgagg

SEQ ID NO: 5161411 - DNA, 21 bp, Homo sapiens
actggtgtgacctgagggcag

SEQ ID NO: 5161412 - DNA, 18 bp, Homo sapiens
actggtgttaatgagtat

SEQ ID NO: 5161413 - DNA, 21 bp, Homo sapiens
actggtgttatcaccgtgggc

SEQ ID NO: 5161414 - DNA, 22 bp, Homo sapiens
actggtgttatcaccgtgggct

SEQ ID NO: 5161415 - DNA, 19 bp, Homo sapiens
actggtgtttgaaagtagg

SEQ ID NO: 5161416 - DNA, 22 bp, Homo sapiens
actggttaaaaaacaaatgttc

SEQ ID NO: 5161417 - DNA, 11 bp, Homo sapiens
actggttaaac

SEQ ID NO: 5161418 - DNA, 21 bp, Homo sapiens
actggttaaacattaatattt

SEQ ID NO: 5161419 - DNA, 17 bp, Homo sapiens
actggttacctggagaa

SEQ ID NO: 5161420 - DNA, 17 bp, Homo sapiens
actggttagtgatgcag

SEQ ID NO: 5161421 - DNA, 18 bp, Homo sapiens
actggttagtgatgcagt

SEQ ID NO: 5161422 - DNA, 19 bp, Homo sapiens
actggttatagttgatatg

SEQ ID NO: 5161423 - DNA, 20 bp, Homo sapiens
actggttatcttgttattat

SEQ ID NO: 5161424 - DNA, 14 bp, Homo sapiens
actggttcacctga

SEQ ID NO: 5161425 - DNA, 16 bp, Homo sapiens
actggttcaggctcaa

SEQ ID NO: 5161426 - DNA, 13 bp, Homo sapiens
actggttcctaca

SEQ ID NO: 5161427 - DNA, 13 bp, Homo sapiens
actggttccttcc

SEQ ID NO: 5161428 - DNA, 17 bp, Homo sapiens
actggttccttccttag

SEQ ID NO: 5161429 - DNA, 14 bp, Homo sapiens
actggttctcaatg

SEQ ID NO: 5161430 - DNA, 18 bp, Homo sapiens
actggttctcaatgaaaa

SEQ ID NO: 5161431 - DNA, 15 bp, Homo sapiens
actggttctgaggcc

SEQ ID NO: 5161432 - DNA, 15 bp, Homo sapiens
actggttcttgcctt

SEQ ID NO: 5161433 - DNA, 14 bp, Homo sapiens
actggttgcatgga

SEQ ID NO: 5161434 - DNA, 14 bp, Homo sapiens
actggttgctgtgt

SEQ ID NO: 5161435 - DNA, 22 bp, Homo sapiens
actggttggctcccgcggtgcc

SEQ ID NO: 5161436 - DNA, 19 bp, Homo sapiens
actggttgtaaaagagaaa

SEQ ID NO: 5161437 - DNA, 14 bp, Homo sapiens
actggttgtcagaa

SEQ ID NO: 5161438 - DNA, 17 bp, Homo sapiens
actggtttacaggccct

SEQ ID NO: 5161439 - DNA, 13 bp, Homo sapiens
actggtttataat

SEQ ID NO: 5161440 - DNA, 18 bp, Homo sapiens
actggtttcagttgacaa

SEQ ID NO: 5161441 - DNA, 21 bp, Homo sapiens
actggtttccccagggaagga

SEQ ID NO: 5161442 - DNA, 23 bp, Homo sapiens
actggtttccccagggaaggaaa

SEQ ID NO: 5161443 - DNA, 13 bp, Homo sapiens
actggtttgcagt

SEQ ID NO: 5161444 - DNA, 18 bp, Homo sapiens
actggtttgtatgatgta

SEQ ID NO: 5161445 - DNA, 17 bp, Homo sapiens
actggtttgtttgctta

SEQ ID NO: 5161446 - DNA, 15 bp, Homo sapiens
actggttttacacag

SEQ ID NO: 5161447 - DNA, 16 bp, Homo sapiens
actggttttacttaca

SEQ ID NO: 5161448 - DNA, 13 bp, Homo sapiens
actggttttctgc

SEQ ID NO: 5161449 - DNA, 16 bp, Homo sapiens
actgtaaaaataacat

SEQ ID NO: 5161450 - DNA, 16 bp, Homo sapiens
actgtaaaagttataa

SEQ ID NO: 5161451 - DNA, 17 bp, Homo sapiens
actgtaaaatacttctt

SEQ ID NO: 5161452 - DNA, 13 bp, Homo sapiens
actgtaaaatgat

SEQ ID NO: 5161453 - DNA, 13 bp, Homo sapiens
actgtaaaatgca

SEQ ID NO: 5161454 - DNA, 15 bp, Homo sapiens
actgtaaaatgcaaa

SEQ ID NO: 5161455 - DNA, 21 bp, Homo sapiens
actgtaaaatgcaaaaaatct

SEQ ID NO: 5161456 - DNA, 16 bp, Homo sapiens
actgtaaacacagaca

SEQ ID NO: 5161457 - DNA, 12 bp, Homo sapiens
actgtaaacagt

SEQ ID NO: 5161458 - DNA, 23 bp, Homo sapiens
actgtaaactctatcagcattgt

SEQ ID NO: 5161459 - DNA, 18 bp, Homo sapiens
actgtaaagaaagagaga

SEQ ID NO: 5161460 - DNA, 19 bp, Homo sapiens
actgtaaagaaagagagaa

SEQ ID NO: 5161461 - DNA, 20 bp, Homo sapiens
actgtaaagaaagagagaaa

SEQ ID NO: 5161462 - DNA, 21 bp, Homo sapiens
actgtaaagacaaataaatga

SEQ ID NO: 5161463 - DNA, 22 bp, Homo sapiens
actgtaaagacaaataaatgat

SEQ ID NO: 5161464 - DNA, 23 bp, Homo sapiens
actgtaaagagacctacctcagg

SEQ ID NO: 5161465 - DNA, 16 bp, Homo sapiens
actgtaaagatttgtt

SEQ ID NO: 5161466 - DNA, 18 bp, Homo sapiens
actgtaaagatttgttga

SEQ ID NO: 5161467 - DNA, 15 bp, Homo sapiens
actgtaaataaaatg

SEQ ID NO: 5161468 - DNA, 17 bp, Homo sapiens
actgtaaataaaatgtg

SEQ ID NO: 5161469 - DNA, 18 bp, Homo sapiens
actgtaaataaaatgtgt

SEQ ID NO: 5161470 - DNA, 17 bp, Homo sapiens
actgtaaatacgaaccc

SEQ ID NO: 5161471 - DNA, 16 bp, Homo sapiens
actgtaaatatgaatc

SEQ ID NO: 5161472 - DNA, 11 bp, Homo sapiens
actgtaaatca

SEQ ID NO: 5161473 - DNA, 20 bp, Homo sapiens
actgtaaatcacttgtaaat

SEQ ID NO: 5161474 - DNA, 15 bp, Homo sapiens
actgtaaatcataat

SEQ ID NO: 5161475 - DNA, 10 bp, Homo sapiens
actgtaaatt

SEQ ID NO: 5161476 - DNA, 18 bp, Homo sapiens
actgtaaattccaaagat

SEQ ID NO: 5161477 - DNA, 13 bp, Homo sapiens
actgtaaattttt

SEQ ID NO: 5161478 - DNA, 13 bp, Homo sapiens
actgtaacacttt

SEQ ID NO: 5161479 - DNA, 15 bp, Homo sapiens
actgtaacattcagg

SEQ ID NO: 5161480 - DNA, 16 bp, Homo sapiens
actgtaacatttacga

SEQ ID NO: 5161481 - DNA, 16 bp, Homo sapiens
actgtaacgattgaca

SEQ ID NO: 5161482 - DNA, 23 bp, Homo sapiens
actgtaactgcattagaaaccat

SEQ ID NO: 5161483 - DNA, 21 bp, Homo sapiens
actgtaactgctcagagcttt

SEQ ID NO: 5161484 - DNA, 13 bp, Homo sapiens
actgtaacttttt

SEQ ID NO: 5161485 - DNA, 19 bp, Homo sapiens
actgtaactttttttcagt

SEQ ID NO: 5161486 - DNA, 20 bp, Homo sapiens
actgtaactttttttcagtt

SEQ ID NO: 5161487 - DNA, 19 bp, Homo sapiens
actgtaagaaaatatcact

SEQ ID NO: 5161488 - DNA, 20 bp, Homo sapiens
actgtaagaataatttatag

SEQ ID NO: 5161489 - DNA, 20 bp, Homo sapiens
actgtaagacgtatgtaaca

SEQ ID NO: 5161490 - DNA, 14 bp, Homo sapiens
actgtaagatgttg

SEQ ID NO: 5161491 - DNA, 19 bp, Homo sapiens
actgtaagcagattacaat

SEQ ID NO: 5161492 - DNA, 17 bp, Homo sapiens
actgtaagctttgttct

SEQ ID NO: 5161493 - DNA, 21 bp, Homo sapiens
actgtaagctttgttctggga

SEQ ID NO: 5161494 - DNA, 16 bp, Homo sapiens
actgtaaggcaatcat

SEQ ID NO: 5161495 - DNA, 13 bp, Homo sapiens
actgtaagggatt

SEQ ID NO: 5161496 - DNA, 21 bp, Homo sapiens
actgtaaggtgcttgctcccc

SEQ ID NO: 5161497 - DNA, 19 bp, Homo sapiens
actgtaataatacctcaat

SEQ ID NO: 5161498 - DNA, 23 bp, Homo sapiens
actgtaataatacctcaatgttt

SEQ ID NO: 5161499 - DNA, 18 bp, Homo sapiens
actgtaatataaagtatt

SEQ ID NO: 5161500 - DNA, 16 bp, Homo sapiens
actgtaatatttaaat

SEQ ID NO: 5161501 - DNA, 16 bp, Homo sapiens
actgtaatcgtgctat

SEQ ID NO: 5161502 - DNA, 17 bp, Homo sapiens
actgtaatcttaaaagt

SEQ ID NO: 5161503 - DNA, 22 bp, Homo sapiens
actgtaatgaaccgctgaatat

SEQ ID NO: 5161504 - DNA, 23 bp, Homo sapiens
actgtaatgaaccgctgaatatg

SEQ ID NO: 5161505 - DNA, 17 bp, Homo sapiens
actgtaatgctgcctca

SEQ ID NO: 5161506 - DNA, 19 bp, Homo sapiens
actgtaatgctgcctcagg

SEQ ID NO: 5161507 - DNA, 21 bp, Homo sapiens
actgtaatgggtaattctgac

SEQ ID NO: 5161508 - DNA, 21 bp, Homo sapiens
actgtaattaaaactatttag

SEQ ID NO: 5161509 - DNA, 16 bp, Homo sapiens
actgtaattatttgaa

SEQ ID NO: 5161510 - DNA, 20 bp, Homo sapiens
actgtaattgacagagtaaa

SEQ ID NO: 5161511 - DNA, 20 bp, Homo sapiens
actgtaattggtgacaatgt

SEQ ID NO: 5161512 - DNA, 17 bp, Homo sapiens
actgtaattttatatga

SEQ ID NO: 5161513 - DNA, 14 bp, Homo sapiens
actgtaattttgtt

SEQ ID NO: 5161514 - DNA, 13 bp, Homo sapiens
actgtacaaagta

SEQ ID NO: 5161515 - DNA, 18 bp, Homo sapiens
actgtacaataaaaacat

SEQ ID NO: 5161516 - DNA, 17 bp, Homo sapiens
actgtacaataagttac

SEQ ID NO: 5161517 - DNA, 22 bp, Homo sapiens
actgtacaataagttacttgaa

SEQ ID NO: 5161518 - DNA, 14 bp, Homo sapiens
actgtacacacttt

SEQ ID NO: 5161519 - DNA, 17 bp, Homo sapiens
actgtacacactttatt

SEQ ID NO: 5161520 - DNA, 22 bp, Homo sapiens
actgtacacactttatttactt

SEQ ID NO: 5161521 - DNA, 15 bp, Homo sapiens
actgtacacataagc

SEQ ID NO: 5161522 - DNA, 12 bp, Homo sapiens
actgtacacatt

SEQ ID NO: 5161523 - DNA, 14 bp, Homo sapiens
actgtacacatttc

SEQ ID NO: 5161524 - DNA, 20 bp, Homo sapiens
actgtacagacagaaaaaac

SEQ ID NO: 5161525 - DNA, 21 bp, Homo sapiens
actgtacagattgctgcttct

SEQ ID NO: 5161526 - DNA, 13 bp, Homo sapiens
actgtacagctgg

SEQ ID NO: 5161527 - DNA, 14 bp, Homo sapiens
actgtacagctggc

SEQ ID NO: 5161528 - DNA, 15 bp, Homo sapiens
actgtacagtgtctt

SEQ ID NO: 5161529 - DNA, 21 bp, Homo sapiens
actgtacagtgtctttttttg

SEQ ID NO: 5161530 - DNA, 14 bp, Homo sapiens
actgtacagttttg

SEQ ID NO: 5161531 - DNA, 15 bp, Homo sapiens
actgtacataaattc

SEQ ID NO: 5161532 - DNA, 20 bp, Homo sapiens
actgtacataaattccagag

SEQ ID NO: 5161533 - DNA, 21 bp, Homo sapiens
actgtacataaattccagagg

SEQ ID NO: 5161534 - DNA, 24 bp, Homo sapiens
actgtacataaattccagaggact

SEQ ID NO: 5161535 - DNA, 17 bp, Homo sapiens
actgtacataattgcat

SEQ ID NO: 5161536 - DNA, 20 bp, Homo sapiens
actgtacataattgcatgaa

SEQ ID NO: 5161537 - DNA, 22 bp, Homo sapiens
actgtacataattgcatgaaaa

SEQ ID NO: 5161538 - DNA, 12 bp, Homo sapiens
actgtacataga

SEQ ID NO: 5161539 - DNA, 13 bp, Homo sapiens
actgtacatgaaa

SEQ ID NO: 5161540 - DNA, 20 bp, Homo sapiens
actgtacatgaaaacacatt

SEQ ID NO: 5161541 - DNA, 14 bp, Homo sapiens
actgtacatgctat

SEQ ID NO: 5161542 - DNA, 18 bp, Homo sapiens
actgtacatgctatgctg

SEQ ID NO: 5161543 - DNA, 21 bp, Homo sapiens
actgtacatgggactatgctt

SEQ ID NO: 5161544 - DNA, 12 bp, Homo sapiens
actgtacatgtg

SEQ ID NO: 5161545 - DNA, 16 bp, Homo sapiens
actgtacattatgaag

SEQ ID NO: 5161546 - DNA, 14 bp, Homo sapiens
actgtacatttaaa

SEQ ID NO: 5161547 - DNA, 14 bp, Homo sapiens
actgtacatttttt

SEQ ID NO: 5161548 - DNA, 21 bp, Homo sapiens
actgtaccacagacacaatat

SEQ ID NO: 5161549 - DNA, 21 bp, Homo sapiens
actgtaccatgtgctacaggg

SEQ ID NO: 5161550 - DNA, 16 bp, Homo sapiens
actgtaccctatgttc

SEQ ID NO: 5161551 - DNA, 17 bp, Homo sapiens
actgtaccctatgttca

SEQ ID NO: 5161552 - DNA, 21 bp, Homo sapiens
actgtacctgtaggaaacaga

SEQ ID NO: 5161553 - DNA, 14 bp, Homo sapiens
actgtactaattct

SEQ ID NO: 5161554 - DNA, 18 bp, Homo sapiens
actgtactaattcttaca

SEQ ID NO: 5161555 - DNA, 20 bp, Homo sapiens
actgtactactcctaattat

SEQ ID NO: 5161556 - DNA, 20 bp, Homo sapiens
actgtactatcctgtaaata

SEQ ID NO: 5161557 - DNA, 20 bp, Homo sapiens
actgtactccagcctgaaga

SEQ ID NO: 5161558 - DNA, 14 bp, Homo sapiens
actgtactcctccc

SEQ ID NO: 5161559 - DNA, 14 bp, Homo sapiens
actgtactgaggaa

SEQ ID NO: 5161560 - DNA, 16 bp, Homo sapiens
actgtactgatactat

SEQ ID NO: 5161561 - DNA, 12 bp, Homo sapiens
actgtactgcat

SEQ ID NO: 5161562 - DNA, 14 bp, Homo sapiens
actgtactgcatgt

SEQ ID NO: 5161563 - DNA, 14 bp, Homo sapiens
actgtactggccag

SEQ ID NO: 5161564 - DNA, 23 bp, Homo sapiens
actgtactggccagtgtcatttt

SEQ ID NO: 5161565 - DNA, 11 bp, Homo sapiens
actgtactgtg

SEQ ID NO: 5161566 - DNA, 13 bp, Homo sapiens
actgtacttcact

SEQ ID NO: 5161567 - DNA, 22 bp, Homo sapiens
actgtacttgatttttcaaaga

SEQ ID NO: 5161568 - DNA, 18 bp, Homo sapiens
actgtactttcccaggtt

SEQ ID NO: 5161569 - DNA, 13 bp, Homo sapiens
actgtactttgat

SEQ ID NO: 5161570 - DNA, 14 bp, Homo sapiens
actgtactttgcca

SEQ ID NO: 5161571 - DNA, 14 bp, Homo sapiens
actgtagaacctgt

SEQ ID NO: 5161572 - DNA, 15 bp, Homo sapiens
actgtagaactgatt

SEQ ID NO: 5161573 - DNA, 19 bp, Homo sapiens
actgtagaatgatttcatg

SEQ ID NO: 5161574 - DNA, 20 bp, Homo sapiens
actgtagaatgatttcatgc

SEQ ID NO: 5161575 - DNA, 16 bp, Homo sapiens
actgtagacactctga

SEQ ID NO: 5161576 - DNA, 19 bp, Homo sapiens
actgtagacactctgacaa

SEQ ID NO: 5161577 - DNA, 15 bp, Homo sapiens
actgtagagattttt

SEQ ID NO: 5161578 - DNA, 23 bp, Homo sapiens
actgtagataattaaccaaggta

SEQ ID NO: 5161579 - DNA, 13 bp, Homo sapiens
actgtagatgatg

SEQ ID NO: 5161580 - DNA, 20 bp, Homo sapiens
actgtagattgcttctgtag

SEQ ID NO: 5161581 - DNA, 16 bp, Homo sapiens
actgtagatttcagta

SEQ ID NO: 5161582 - DNA, 22 bp, Homo sapiens
actgtagatttcagtagtttct

SEQ ID NO: 5161583 - DNA, 14 bp, Homo sapiens
actgtagcaatata

SEQ ID NO: 5161584 - DNA, 15 bp, Homo sapiens
actgtagcaatatat

SEQ ID NO: 5161585 - DNA, 22 bp, Homo sapiens
actcctcactgccccaccagcc

SEQ ID NO: 5161586 - DNA, 19 bp, Homo sapiens
actcctcaggaacagaaca

SEQ ID NO: 5161587 - DNA, 20 bp, Homo sapiens
actcctcagttcctcaccat

SEQ ID NO: 5161588 - DNA, 20 bp, Homo sapiens
actcctcatccccacaatct

SEQ ID NO: 5161589 - DNA, 20 bp, Homo sapiens
actcctccatccatgtgttc

SEQ ID NO: 5161590 - DNA, 18 bp, Homo sapiens
actcctccattactctat

SEQ ID NO: 5161591 - DNA, 12 bp, Homo sapiens
actcctcccaca

SEQ ID NO: 5161592 - DNA, 23 bp, Homo sapiens
actcctcccacccaacttcccct

SEQ ID NO: 5161593 - DNA, 22 bp, Homo sapiens
actcctcccagggttttaactt

SEQ ID NO: 5161594 - DNA, 18 bp, Homo sapiens
actcctccccaccctcct

SEQ ID NO: 5161595 - DNA, 19 bp, Homo sapiens
actcctccccaccctcctg

SEQ ID NO: 5161596 - DNA, 20 bp, Homo sapiens
actcctccccaccctcctgg

SEQ ID NO: 5161597 - DNA, 19 bp, Homo sapiens
actcctccccctcctccat

SEQ ID NO: 5161598 - DNA, 23 bp, Homo sapiens
actcctccccctcctccatgctg

SEQ ID NO: 5161599 - DNA, 21 bp, Homo sapiens
actcctcccctcttctctttt

SEQ ID NO: 5161600 - DNA, 13 bp, Homo sapiens
actcctcccttcc

SEQ ID NO: 5161601 - DNA, 22 bp, Homo sapiens
actcctcccttccccactctgc

SEQ ID NO: 5161602 - DNA, 18 bp, Homo sapiens
actcctccgtgagcacca

SEQ ID NO: 5161603 - DNA, 23 bp, Homo sapiens
actcctccgtgagcaccaccagg

SEQ ID NO: 5161604 - DNA, 16 bp, Homo sapiens
actcctcctagccacc

SEQ ID NO: 5161605 - DNA, 21 bp, Homo sapiens
actcctcctccaaaggccccc

SEQ ID NO: 5161606 - DNA, 23 bp, Homo sapiens
actcctcctccagcccacccaac

SEQ ID NO: 5161607 - DNA, 23 bp, Homo sapiens
actcctcctcctttctttgctgt

SEQ ID NO: 5161608 - DNA, 16 bp, Homo sapiens
actcctcctcggaaga

SEQ ID NO: 5161609 - DNA, 13 bp, Homo sapiens
actcctcctgggg

SEQ ID NO: 5161610 - DNA, 17 bp, Homo sapiens
actcctcctgggggctg

SEQ ID NO: 5161611 - DNA, 16 bp, Homo sapiens
actcctcggcctggct

SEQ ID NO: 5161612 - DNA, 15 bp, Homo sapiens
actcctcgggcaagg

SEQ ID NO: 5161613 - DNA, 21 bp, Homo sapiens
actcctctaagccactcttcc

SEQ ID NO: 5161614 - DNA, 17 bp, Homo sapiens
actcctctatcatgcaa

SEQ ID NO: 5161615 - DNA, 19 bp, Homo sapiens
actcctctcccttgaggga

SEQ ID NO: 5161616 - DNA, 17 bp, Homo sapiens
actcctctgaccctcct

SEQ ID NO: 5161617 - DNA, 18 bp, Homo sapiens
actcctctgaccctcctt

SEQ ID NO: 5161618 - DNA, 19 bp, Homo sapiens
actcctctgaccctccttc

SEQ ID NO: 5161619 - DNA, 21 bp, Homo sapiens
actcctctgctgacctgctga

SEQ ID NO: 5161620 - DNA, 18 bp, Homo sapiens
actcctctggctttccca

SEQ ID NO: 5161621 - DNA, 19 bp, Homo sapiens
actcctctggctttcccag

SEQ ID NO: 5161622 - DNA, 11 bp, Homo sapiens
actcctctggg

SEQ ID NO: 5161623 - DNA, 15 bp, Homo sapiens
actcctctgggcctg

SEQ ID NO: 5161624 - DNA, 19 bp, Homo sapiens
actcctctgggcctggggt

SEQ ID NO: 5161625 - DNA, 23 bp, Homo sapiens
actcctctgtctctgctcttgcc

SEQ ID NO: 5161626 - DNA, 14 bp, Homo sapiens
actcctcttatttg

SEQ ID NO: 5161627 - DNA, 23 bp, Homo sapiens
actcctcttggtgggtgtggcca

SEQ ID NO: 5161628 - DNA, 20 bp, Homo sapiens
actcctgaaacctcttccta

SEQ ID NO: 5161629 - DNA, 16 bp, Homo sapiens
actcctgaaattcaga

SEQ ID NO: 5161630 - DNA, 20 bp, Homo sapiens
actcctgaagttgtacttgt

SEQ ID NO: 5161631 - DNA, 19 bp, Homo sapiens
actcctgaattcagttgct

SEQ ID NO: 5161632 - DNA, 21 bp, Homo sapiens
actcctgacagtcttgtgctt

SEQ ID NO: 5161633 - DNA, 21 bp, Homo sapiens
actcctgaccataatcctagc

SEQ ID NO: 5161634 - DNA, 18 bp, Homo sapiens
actcctgacccctctcct

SEQ ID NO: 5161635 - DNA, 15 bp, Homo sapiens
actcctgacctcaag

SEQ ID NO: 5161636 - DNA, 18 bp, Homo sapiens
actcctgacctcaagtga

SEQ ID NO: 5161637 - DNA, 15 bp, Homo sapiens
actcctgacctcgtg

SEQ ID NO: 5161638 - DNA, 11 bp, Homo sapiens
actcctgactc

SEQ ID NO: 5161639 - DNA, 19 bp, Homo sapiens
actcctgaggacagctgtc

SEQ ID NO: 5161640 - DNA, 23 bp, Homo sapiens
actcctgatgccctcttctcctt

SEQ ID NO: 5161641 - DNA, 23 bp, Homo sapiens
actcctgattgctctggaagcct

SEQ ID NO: 5161642 - DNA, 15 bp, Homo sapiens
actcctgattttgta

SEQ ID NO: 5161643 - DNA, 18 bp, Homo sapiens
actcctgatttttatcta

SEQ ID NO: 5161644 - DNA, 23 bp, Homo sapiens
actcctgcacacgctccttcctc

SEQ ID NO: 5161645 - DNA, 12 bp, Homo sapiens
actcctgcaggc

SEQ ID NO: 5161646 - DNA, 14 bp, Homo sapiens
actcctgcaggcag

SEQ ID NO: 5161647 - DNA, 18 bp, Homo sapiens
actcctgcaggcagccag

SEQ ID NO: 5161648 - DNA, 21 bp, Homo sapiens
actcctgcaggcagccaggcc

SEQ ID NO: 5161649 - DNA, 20 bp, Homo sapiens
actcctgccaccagcatcca

SEQ ID NO: 5161650 - DNA, 15 bp, Homo sapiens
actcctgccaggccg

SEQ ID NO: 5161651 - DNA, 20 bp, Homo sapiens
actcctgccccggcccaacc

SEQ ID NO: 5161652 - DNA, 21 bp, Homo sapiens
actcctgcctgagtttccagc

SEQ ID NO: 5161653 - DNA, 22 bp, Homo sapiens
actcctgcctgcccccacaccc

SEQ ID NO: 5161654 - DNA, 17 bp, Homo sapiens
actcctgcggctgcctg

SEQ ID NO: 5161655 - DNA, 21 bp, Homo sapiens
actcctgctgcacaggccctg

SEQ ID NO: 5161656 - DNA, 13 bp, Homo sapiens
actcctgcttaat

SEQ ID NO: 5161657 - DNA, 15 bp, Homo sapiens
actcctggagcactg

SEQ ID NO: 5161658 - DNA, 12 bp, Homo sapiens
actcctggcctc

SEQ ID NO: 5161659 - DNA, 15 bp, Homo sapiens
actcctggcctcaag

SEQ ID NO: 5161660 - DNA, 13 bp, Homo sapiens
actcctggccttt

SEQ ID NO: 5161661 - DNA, 15 bp, Homo sapiens
actcctgggctcaag

SEQ ID NO: 5161662 - DNA, 22 bp, Homo sapiens
actcctgggctcaagcagtcct

SEQ ID NO: 5161663 - DNA, 21 bp, Homo sapiens
actcctgggctcaagcagtct

SEQ ID NO: 5161664 - DNA, 18 bp, Homo sapiens
actcctgggctcaagtga

SEQ ID NO: 5161665 - DNA, 16 bp, Homo sapiens
actcctgggctctgaa

SEQ ID NO: 5161666 - DNA, 14 bp, Homo sapiens
actcctgggtgggt

SEQ ID NO: 5161667 - DNA, 23 bp, Homo sapiens
actcctgggtgggtggggtacag

SEQ ID NO: 5161668 - DNA, 11 bp, Homo sapiens
actcctggtgc

SEQ ID NO: 5161669 - DNA, 17 bp, Homo sapiens
actcctggtgcccctcg

SEQ ID NO: 5161670 - DNA, 23 bp, Homo sapiens
actcctggtgcccctcgccagct

SEQ ID NO: 5161671 - DNA, 16 bp, Homo sapiens
actcctgtacactgaa

SEQ ID NO: 5161672 - DNA, 17 bp, Homo sapiens
actcctgtcagcccctc

SEQ ID NO: 5161673 - DNA, 22 bp, Homo sapiens
actcctgtcagcccctcatcag

SEQ ID NO: 5161674 - DNA, 19 bp, Homo sapiens
actcctgtcccgccttcct

SEQ ID NO: 5161675 - DNA, 21 bp, Homo sapiens
actcctgtccctgtagctcag

SEQ ID NO: 5161676 - DNA, 23 bp, Homo sapiens
actcctgtccctgtagctcagtc

SEQ ID NO: 5161677 - DNA, 18 bp, Homo sapiens
actcctgtcccttttccc

SEQ ID NO: 5161678 - DNA, 17 bp, Homo sapiens
actcctgtcttctgctt

SEQ ID NO: 5161679 - DNA, 19 bp, Homo sapiens
actcctgtcttctgctttg

SEQ ID NO: 5161680 - DNA, 20 bp, Homo sapiens
actcctgtcttctgctttgt

SEQ ID NO: 5161681 - DNA, 14 bp, Homo sapiens
actcctgtcttctt

SEQ ID NO: 5161682 - DNA, 20 bp, Homo sapiens
actcctgtcttctttctcca

SEQ ID NO: 5161683 - DNA, 15 bp, Homo sapiens
actcctgtgggagcc

SEQ ID NO: 5161684 - DNA, 16 bp, Homo sapiens
actcctgtgggagcct

SEQ ID NO: 5161685 - DNA, 20 bp, Homo sapiens
actcctgttacttacctaaa

SEQ ID NO: 5161686 - DNA, 23 bp, Homo sapiens
actcctgttttcacaccttacaa

SEQ ID NO: 5161687 - DNA, 20 bp, Homo sapiens
actccttaaaaatgtatgtt

SEQ ID NO: 5161688 - DNA, 19 bp, Homo sapiens
actccttaaccacctagtc

SEQ ID NO: 5161689 - DNA, 22 bp, Homo sapiens
actccttatttggcgtgacccg

SEQ ID NO: 5161690 - DNA, 20 bp, Homo sapiens
actccttcaacaattctaaa

SEQ ID NO: 5161691 - DNA, 14 bp, Homo sapiens
actccttccatcct

SEQ ID NO: 5161692 - DNA, 19 bp, Homo sapiens
actccttccatctcttcct

SEQ ID NO: 5161693 - DNA, 17 bp, Homo sapiens
actccttccccttgtcc

SEQ ID NO: 5161694 - DNA, 22 bp, Homo sapiens
actccttccccttgtccctggg

SEQ ID NO: 5161695 - DNA, 12 bp, Homo sapiens
actccttcctgc

SEQ ID NO: 5161696 - DNA, 20 bp, Homo sapiens
actccttcctggcctgagag

SEQ ID NO: 5161697 - DNA, 23 bp, Homo sapiens
actccttcctggcctgagagtca

SEQ ID NO: 5161698 - DNA, 16 bp, Homo sapiens
actccttctccccaat

SEQ ID NO: 5161699 - DNA, 21 bp, Homo sapiens
actccttctctcactgtgtta

SEQ ID NO: 5161700 - DNA, 19 bp, Homo sapiens
actccttctgccagttccc

SEQ ID NO: 5161701 - DNA, 16 bp, Homo sapiens
actccttctgttttga

SEQ ID NO: 5161702 - DNA, 23 bp, Homo sapiens
actccttctgttttgagttttgt

SEQ ID NO: 5161703 - DNA, 23 bp, Homo sapiens
actccttgaaaacactgttctct

SEQ ID NO: 5161704 - DNA, 23 bp, Homo sapiens
actccttgattttagccttctct

SEQ ID NO: 5161705 - DNA, 11 bp, Homo sapiens
actccttgcat

SEQ ID NO: 5161706 - DNA, 17 bp, Homo sapiens
actccttgcatcaaggg

SEQ ID NO: 5161707 - DNA, 20 bp, Homo sapiens
actccttgcatcaaggggtc

SEQ ID NO: 5161708 - DNA, 16 bp, Homo sapiens
actccttggatttgca

SEQ ID NO: 5161709 - DNA, 11 bp, Homo sapiens
actccttggcc

SEQ ID NO: 5161710 - DNA, 14 bp, Homo sapiens
actccttggcctag

SEQ ID NO: 5161711 - DNA, 21 bp, Homo sapiens
actccttgtggactggctgtg

SEQ ID NO: 5161712 - DNA, 23 bp, Homo sapiens
actccttgtggactggctgtgcc

SEQ ID NO: 5161713 - DNA, 13 bp, Homo sapiens
actcctttacaac

SEQ ID NO: 5161714 - DNA, 21 bp, Homo sapiens
actcctttacaaccatacttt

SEQ ID NO: 5161715 - DNA, 22 bp, Homo sapiens
actcctttacaaccatacttta

SEQ ID NO: 5161716 - DNA, 22 bp, Homo sapiens
actcctttactgcagcctgggc

SEQ ID NO: 5161717 - DNA, 16 bp, Homo sapiens
actcctttatctgtaa

SEQ ID NO: 5161718 - DNA, 17 bp, Homo sapiens
actcctttccaatagaa

SEQ ID NO: 5161719 - DNA, 22 bp, Homo sapiens
actcctttctctatcccaagcc

SEQ ID NO: 5161720 - DNA, 12 bp, Homo sapiens
actcctttctgc

SEQ ID NO: 5161721 - DNA, 14 bp, Homo sapiens
actcctttcttatc

SEQ ID NO: 5161722 - DNA, 18 bp, Homo sapiens
actcctttcttatcttga

SEQ ID NO: 5161723 - DNA, 14 bp, Homo sapiens
actccttttaaaga

SEQ ID NO: 5161724 - DNA, 21 bp, Homo sapiens
actccttttggtgtgttggac

SEQ ID NO: 5161725 - DNA, 19 bp, Homo sapiens
actcgaaactgacagtatt

SEQ ID NO: 5161726 - DNA, 20 bp, Homo sapiens
actcgaagcccttccagtgg

SEQ ID NO: 5161727 - DNA, 15 bp, Homo sapiens
actcgactctgtgcc

SEQ ID NO: 5161728 - DNA, 13 bp, Homo sapiens
actcgagaacttt

SEQ ID NO: 5161729 - DNA, 16 bp, Homo sapiens
actcgagaccatcctg

SEQ ID NO: 5161730 - DNA, 20 bp, Homo sapiens
actcgagaccatcctggccc

SEQ ID NO: 5161731 - DNA, 20 bp, Homo sapiens
actcgagaggccaaagaagg

SEQ ID NO: 5161732 - DNA, 16 bp, Homo sapiens
actcgagagggctgag

SEQ ID NO: 5161733 - DNA, 17 bp, Homo sapiens
actcgagcccacccagc

SEQ ID NO: 5161734 - DNA, 15 bp, Homo sapiens
actcgaggcctgcaa

SEQ ID NO: 5161735 - DNA, 16 bp, Homo sapiens
actcgagttacagaca

SEQ ID NO: 5161736 - DNA, 20 bp, Homo sapiens
actcgatcaaaaccttcctt

SEQ ID NO: 5161737 - DNA, 23 bp, Homo sapiens
actcgatcaaaaccttccttccc

SEQ ID NO: 5161738 - DNA, 20 bp, Homo sapiens
actcgatgagataatatgag

SEQ ID NO: 5161739 - DNA, 14 bp, Homo sapiens
actcgcacctcttg

SEQ ID NO: 5161740 - DNA, 14 bp, Homo sapiens
actcgcacctgtgc

SEQ ID NO: 5161741 - DNA, 13 bp, Homo sapiens
actcgcaggacca

SEQ ID NO: 5161742 - DNA, 20 bp, Homo sapiens
actcgcaggaccaagggggc

SEQ ID NO: 5161743 - DNA, 15 bp, Homo sapiens
actcgccatctcctg

SEQ ID NO: 5161744 - DNA, 16 bp, Homo sapiens
actcgccatttcctca

SEQ ID NO: 5161745 - DNA, 21 bp, Homo sapiens
actcgcctgtggacggggagg

SEQ ID NO: 5161746 - DNA, 15 bp, Homo sapiens
actcgcgacaatgca

SEQ ID NO: 5161747 - DNA, 16 bp, Homo sapiens
actcgcgctcagtaaa

SEQ ID NO: 5161748 - DNA, 16 bp, Homo sapiens
actcgctagcagtggc

SEQ ID NO: 5161749 - DNA, 18 bp, Homo sapiens
actcgctagcagtggcag

SEQ ID NO: 5161750 - DNA, 15 bp, Homo sapiens
actcgctgtatgaaa

SEQ ID NO: 5161751 - DNA, 19 bp, Homo sapiens
actcgcttagctgaaacct

SEQ ID NO: 5161752 - DNA, 21 bp, Homo sapiens
actcgcttaggtagaaactat

SEQ ID NO: 5161753 - DNA, 13 bp, Homo sapiens
actcgcttgtaaa

SEQ ID NO: 5161754 - DNA, 15 bp, Homo sapiens
actcgcttgtaaata

SEQ ID NO: 5161755 - DNA, 17 bp, Homo sapiens
actcgcttgtgcagaaa

SEQ ID NO: 5161756 - DNA, 17 bp, Homo sapiens
actcggaatctattttc

SEQ ID NO: 5161757 - DNA, 14 bp, Homo sapiens
actcggatggggca

SEQ ID NO: 5161758 - DNA, 16 bp, Homo sapiens
actcggatggggcacg

SEQ ID NO: 5161759 - DNA, 19 bp, Homo sapiens
actcggatttgagtgatca

SEQ ID NO: 5161760 - DNA, 16 bp, Homo sapiens
actcggcaccctgcaa

SEQ ID NO: 5161761 - DNA, 16 bp, Homo sapiens
actgtagcaatatatt

SEQ ID NO: 5161762 - DNA, 15 bp, Homo sapiens
actgtagcaggttct

SEQ ID NO: 5161763 - DNA, 18 bp, Homo sapiens
actgtagccacagctgct

SEQ ID NO: 5161764 - DNA, 22 bp, Homo sapiens
actgtagcctcgccgtctgtga

SEQ ID NO: 5161765 - DNA, 19 bp, Homo sapiens
actgtagcgaccccagact

SEQ ID NO: 5161766 - DNA, 14 bp, Homo sapiens
actgtagctctaaa

SEQ ID NO: 5161767 - DNA, 18 bp, Homo sapiens
actgtagcttctcttgct

SEQ ID NO: 5161768 - DNA, 18 bp, Homo sapiens
actgtagctttgtgaaat

SEQ ID NO: 5161769 - DNA, 19 bp, Homo sapiens
actgtaggaagagtagcat

SEQ ID NO: 5161770 - DNA, 20 bp, Homo sapiens
actgtaggaagagtagcatt

SEQ ID NO: 5161771 - DNA, 15 bp, Homo sapiens
actgtaggactatat

SEQ ID NO: 5161772 - DNA, 15 bp, Homo sapiens
actgtagggccaggg

SEQ ID NO: 5161773 - DNA, 19 bp, Homo sapiens
actgtaggtgttatgtatt

SEQ ID NO: 5161774 - DNA, 20 bp, Homo sapiens
actgtaggtgttatgtattc

SEQ ID NO: 5161775 - DNA, 18 bp, Homo sapiens
actgtagtaaataatgct

SEQ ID NO: 5161776 - DNA, 22 bp, Homo sapiens
actgtagtaaataatgctttga

SEQ ID NO: 5161777 - DNA, 14 bp, Homo sapiens
actgtagtaattgt

SEQ ID NO: 5161778 - DNA, 23 bp, Homo sapiens
actgtagtgtagtcaggtgctca

SEQ ID NO: 5161779 - DNA, 16 bp, Homo sapiens
actgtagttctaagac

SEQ ID NO: 5161780 - DNA, 17 bp, Homo sapiens
actgtagttctaagact

SEQ ID NO: 5161781 - DNA, 17 bp, Homo sapiens
actgtagtttagttctg

SEQ ID NO: 5161782 - DNA, 18 bp, Homo sapiens
actgtagtttttcttcaa

SEQ ID NO: 5161783 - DNA, 18 bp, Homo sapiens
actgtagtttttgaaaat

SEQ ID NO: 5161784 - DNA, 19 bp, Homo sapiens
actgtagtttttgaaaatt

SEQ ID NO: 5161785 - DNA, 23 bp, Homo sapiens
actgtagtttttgttcaccttct

SEQ ID NO: 5161786 - DNA, 14 bp, Homo sapiens
actgtataaacaaa

SEQ ID NO: 5161787 - DNA, 17 bp, Homo sapiens
actgtataaactttttt

SEQ ID NO: 5161788 - DNA, 20 bp, Homo sapiens
actgtataaataggagagga

SEQ ID NO: 5161789 - DNA, 22 bp, Homo sapiens
actgtataaataggagaggatg

SEQ ID NO: 5161790 - DNA, 17 bp, Homo sapiens
actgtataactgttctt

SEQ ID NO: 5161791 - DNA, 15 bp, Homo sapiens
actgtataagtacta

SEQ ID NO: 5161792 - DNA, 21 bp, Homo sapiens
actgtataccccgtgaagcat

SEQ ID NO: 5161793 - DNA, 16 bp, Homo sapiens
actgtatagacagttt

SEQ ID NO: 5161794 - DNA, 21 bp, Homo sapiens
actgtatagacagtttgtaaa

SEQ ID NO: 5161795 - DNA, 21 bp, Homo sapiens
actgtataggtagatccagat

SEQ ID NO: 5161796 - DNA, 23 bp, Homo sapiens
actgtataggtagatccagatcc

SEQ ID NO: 5161797 - DNA, 18 bp, Homo sapiens
actgtatagtaatcattg

SEQ ID NO: 5161798 - DNA, 19 bp, Homo sapiens
actgtatagtaatcattga

SEQ ID NO: 5161799 - DNA, 14 bp, Homo sapiens
actgtatataaaca

SEQ ID NO: 5161800 - DNA, 14 bp, Homo sapiens
actgtatataaact

SEQ ID NO: 5161801 - DNA, 13 bp, Homo sapiens
actgtatatgtat

SEQ ID NO: 5161802 - DNA, 14 bp, Homo sapiens
actgtatattattg

SEQ ID NO: 5161803 - DNA, 16 bp, Homo sapiens
actgtatattattgct

SEQ ID NO: 5161804 - DNA, 22 bp, Homo sapiens
actgtatattattgctatattt

SEQ ID NO: 5161805 - DNA, 17 bp, Homo sapiens
actgtatatttgtatga

SEQ ID NO: 5161806 - DNA, 17 bp, Homo sapiens
actgtatattttttaat

SEQ ID NO: 5161807 - DNA, 17 bp, Homo sapiens
actgtatcaaatctgta

SEQ ID NO: 5161808 - DNA, 16 bp, Homo sapiens
actgtatcaataaaat

SEQ ID NO: 5161809 - DNA, 18 bp, Homo sapiens
actgtatcaataaaattc

SEQ ID NO: 5161810 - DNA, 21 bp, Homo sapiens
actgtatcaataaaattctgt

SEQ ID NO: 5161811 - DNA, 17 bp, Homo sapiens
actgtatcatttcatgc

SEQ ID NO: 5161812 - DNA, 14 bp, Homo sapiens
actgtatcattttc

SEQ ID NO: 5161813 - DNA, 16 bp, Homo sapiens
actgtatcattttctt

SEQ ID NO: 5161814 - DNA, 17 bp, Homo sapiens
actgtatctaaaaaata

SEQ ID NO: 5161815 - DNA, 21 bp, Homo sapiens
actgtatctaaaaaataactg

SEQ ID NO: 5161816 - DNA, 22 bp, Homo sapiens
actgtatctaaaaaataactgt

SEQ ID NO: 5161817 - DNA, 13 bp, Homo sapiens
actgtatgatcaa

SEQ ID NO: 5161818 - DNA, 17 bp, Homo sapiens
actgtatgatcaaatgt

SEQ ID NO: 5161819 - DNA, 18 bp, Homo sapiens
actgtatgatcaaatgtt

SEQ ID NO: 5161820 - DNA, 21 bp, Homo sapiens
actgtatgatcaaatgtttaa

SEQ ID NO: 5161821 - DNA, 24 bp, Homo sapiens
actgtatgatcaaatgtttaatca

SEQ ID NO: 5161822 - DNA, 12 bp, Homo sapiens
actgtatgctca

SEQ ID NO: 5161823 - DNA, 16 bp, Homo sapiens
actgtatggaaacact

SEQ ID NO: 5161824 - DNA, 19 bp, Homo sapiens
actgtatggaaacactgat

SEQ ID NO: 5161825 - DNA, 13 bp, Homo sapiens
actgtatgtgtgt

SEQ ID NO: 5161826 - DNA, 15 bp, Homo sapiens
actgtattaaagaaa

SEQ ID NO: 5161827 - DNA, 16 bp, Homo sapiens
actgtattaaagaaaa

SEQ ID NO: 5161828 - DNA, 22 bp, Homo sapiens
actgtattagagcgccagctcc

SEQ ID NO: 5161829 - DNA, 15 bp, Homo sapiens
actgtattattgcaa

SEQ ID NO: 5161830 - DNA, 16 bp, Homo sapiens
actgtattctagtggc

SEQ ID NO: 5161831 - DNA, 17 bp, Homo sapiens
actgtattctagtggct

SEQ ID NO: 5161832 - DNA, 20 bp, Homo sapiens
actgtattctagtggctgtt

SEQ ID NO: 5161833 - DNA, 14 bp, Homo sapiens
actgtattgctcct

SEQ ID NO: 5161834 - DNA, 23 bp, Homo sapiens
actgtattgggacgctggtaact

SEQ ID NO: 5161835 - DNA, 17 bp, Homo sapiens
actgtatttaagaaaac

SEQ ID NO: 5161836 - DNA, 15 bp, Homo sapiens
actgtatttacttgt

SEQ ID NO: 5161837 - DNA, 21 bp, Homo sapiens
actgtatttctaagaagttgt

SEQ ID NO: 5161838 - DNA, 12 bp, Homo sapiens
actgtatttctg

SEQ ID NO: 5161839 - DNA, 15 bp, Homo sapiens
actgtatttctgtgg

SEQ ID NO: 5161840 - DNA, 18 bp, Homo sapiens
actgtatttctgtggaaa

SEQ ID NO: 5161841 - DNA, 23 bp, Homo sapiens
actgtatttgaaataagaattca

SEQ ID NO: 5161842 - DNA, 15 bp, Homo sapiens
actgtatttgtgact

SEQ ID NO: 5161843 - DNA, 17 bp, Homo sapiens
actgtatttgtgactaa

SEQ ID NO: 5161844 - DNA, 23 bp, Homo sapiens
actgtatttgtgactaattgtat

SEQ ID NO: 5161845 - DNA, 16 bp, Homo sapiens
actgtatttttttaac

SEQ ID NO: 5161846 - DNA, 15 bp, Homo sapiens
actgtcaaaataatt

SEQ ID NO: 5161847 - DNA, 22 bp, Homo sapiens
actgtcaaatgatgtgcaaaac

SEQ ID NO: 5161848 - DNA, 12 bp, Homo sapiens
actgtcaagccc

SEQ ID NO: 5161849 - DNA, 15 bp, Homo sapiens
actgtcaagtcatga

SEQ ID NO: 5161850 - DNA, 15 bp, Homo sapiens
actgtcaataaacag

SEQ ID NO: 5161851 - DNA, 13 bp, Homo sapiens
actgtcacactgg

SEQ ID NO: 5161852 - DNA, 17 bp, Homo sapiens
actgtcacactggtgct

SEQ ID NO: 5161853 - DNA, 23 bp, Homo sapiens
actgtcacactggtgctgagtga

SEQ ID NO: 5161854 - DNA, 14 bp, Homo sapiens
actgtcacaggcat

SEQ ID NO: 5161855 - DNA, 22 bp, Homo sapiens
actgtcaccctgaggtaacagg

SEQ ID NO: 5161856 - DNA, 21 bp, Homo sapiens
actgtcacgcggcagcttcag

SEQ ID NO: 5161857 - DNA, 21 bp, Homo sapiens
actgtcacggggttccctcct

SEQ ID NO: 5161858 - DNA, 15 bp, Homo sapiens
actgtcactcattgc

SEQ ID NO: 5161859 - DNA, 20 bp, Homo sapiens
actgtcactgtttctctgct

SEQ ID NO: 5161860 - DNA, 15 bp, Homo sapiens
actgtcactttgctc

SEQ ID NO: 5161861 - DNA, 18 bp, Homo sapiens
actgtcactttgctctgg

SEQ ID NO: 5161862 - DNA, 18 bp, Homo sapiens
actgtcagaataaagaac

SEQ ID NO: 5161863 - DNA, 19 bp, Homo sapiens
actgtcagaataaagaaca

SEQ ID NO: 5161864 - DNA, 21 bp, Homo sapiens
actgtcagaataaagaacatt

SEQ ID NO: 5161865 - DNA, 17 bp, Homo sapiens
actgtcagagaatatga

SEQ ID NO: 5161866 - DNA, 16 bp, Homo sapiens
actgtcagattaaatt

SEQ ID NO: 5161867 - DNA, 19 bp, Homo sapiens
actgtcagcagggactgta

SEQ ID NO: 5161868 - DNA, 22 bp, Homo sapiens
actgtcagcagggactgtaaac

SEQ ID NO: 5161869 - DNA, 16 bp, Homo sapiens
actgtcagccctcact

SEQ ID NO: 5161870 - DNA, 23 bp, Homo sapiens
actgtcagctcccctcggagaag

SEQ ID NO: 5161871 - DNA, 14 bp, Homo sapiens
actgtcagctgagc

SEQ ID NO: 5161872 - DNA, 16 bp, Homo sapiens
actgtcaggaagaaat

SEQ ID NO: 5161873 - DNA, 22 bp, Homo sapiens
actgtcaggaagaaatcacaga

SEQ ID NO: 5161874 - DNA, 13 bp, Homo sapiens
actgtcaggcctc

SEQ ID NO: 5161875 - DNA, 15 bp, Homo sapiens
actgtcagggagggc

SEQ ID NO: 5161876 - DNA, 21 bp, Homo sapiens
actgtcagtcccactgcaccc

SEQ ID NO: 5161877 - DNA, 22 bp, Homo sapiens
actgtcagtcccactgcacccc

SEQ ID NO: 5161878 - DNA, 23 bp, Homo sapiens
actgtcagtgctagatttagcac

SEQ ID NO: 5161879 - DNA, 17 bp, Homo sapiens
actgtcatctagcccct

SEQ ID NO: 5161880 - DNA, 15 bp, Homo sapiens
actgtcatctgccag

SEQ ID NO: 5161881 - DNA, 15 bp, Homo sapiens
actgtcatgcccagc

SEQ ID NO: 5161882 - DNA, 16 bp, Homo sapiens
actgtcatgcccagct

SEQ ID NO: 5161883 - DNA, 18 bp, Homo sapiens
actgtcatgcccagcttg

SEQ ID NO: 5161884 - DNA, 19 bp, Homo sapiens
actgtcatgcccagcttgg

SEQ ID NO: 5161885 - DNA, 17 bp, Homo sapiens
actgtcatgtggcttgg

SEQ ID NO: 5161886 - DNA, 17 bp, Homo sapiens
actgtcattgcccctcc

SEQ ID NO: 5161887 - DNA, 20 bp, Homo sapiens
actgtcattgtgtgtggaat

SEQ ID NO: 5161888 - DNA, 17 bp, Homo sapiens
actgtccaatatgaaaa

SEQ ID NO: 5161889 - DNA, 17 bp, Homo sapiens
actgtccacatctgcct

SEQ ID NO: 5161890 - DNA, 21 bp, Homo sapiens
actgtccacatctgcctcctc

SEQ ID NO: 5161891 - DNA, 22 bp, Homo sapiens
actgtccacatctgcctcctct

SEQ ID NO: 5161892 - DNA, 16 bp, Homo sapiens
actgtccagagtctct

SEQ ID NO: 5161893 - DNA, 13 bp, Homo sapiens
actgtccagctgg

SEQ ID NO: 5161894 - DNA, 23 bp, Homo sapiens
actgtccaggagctaatctgacc

SEQ ID NO: 5161895 - DNA, 22 bp, Homo sapiens
actgtccagggaaacagcctct

SEQ ID NO: 5161896 - DNA, 15 bp, Homo sapiens
actgtccagggccca

SEQ ID NO: 5161897 - DNA, 16 bp, Homo sapiens
actgtccagggcccat

SEQ ID NO: 5161898 - DNA, 23 bp, Homo sapiens
actgtccagggcccatgtagctg

SEQ ID NO: 5161899 - DNA, 19 bp, Homo sapiens
actgtccagttttcttgct

SEQ ID NO: 5161900 - DNA, 15 bp, Homo sapiens
actgtcccagcgaca

SEQ ID NO: 5161901 - DNA, 16 bp, Homo sapiens
actgtcccagtagcca

SEQ ID NO: 5161902 - DNA, 16 bp, Homo sapiens
actgtcccattctcca

SEQ ID NO: 5161903 - DNA, 16 bp, Homo sapiens
actgtccccctaccca

SEQ ID NO: 5161904 - DNA, 19 bp, Homo sapiens
actgtccccctacccaccg

SEQ ID NO: 5161905 - DNA, 15 bp, Homo sapiens
actgtccccttgaag

SEQ ID NO: 5161906 - DNA, 17 bp, Homo sapiens
actgtcccgacacagcg

SEQ ID NO: 5161907 - DNA, 19 bp, Homo sapiens
actgtcccggagctcaggc

SEQ ID NO: 5161908 - DNA, 22 bp, Homo sapiens
actgtcccggagctcaggccct

SEQ ID NO: 5161909 - DNA, 14 bp, Homo sapiens
actgtccctcctgg

SEQ ID NO: 5161910 - DNA, 17 bp, Homo sapiens
actgtccctcctggtgt

SEQ ID NO: 5161911 - DNA, 14 bp, Homo sapiens
actgtccctccttg

SEQ ID NO: 5161912 - DNA, 23 bp, Homo sapiens
actgtccctctcagtgccttctc

SEQ ID NO: 5161913 - DNA, 15 bp, Homo sapiens
actgtccctgctttc

SEQ ID NO: 5161914 - DNA, 20 bp, Homo sapiens
actgtccgctgtctccctcc

SEQ ID NO: 5161915 - DNA, 21 bp, Homo sapiens
actgtccgctgtctccctcct

SEQ ID NO: 5161916 - DNA, 15 bp, Homo sapiens
actgtcctattatat

SEQ ID NO: 5161917 - DNA, 18 bp, Homo sapiens
actgtcctcaaataagtc

SEQ ID NO: 5161918 - DNA, 20 bp, Homo sapiens
actgtcctcccacagacctg

SEQ ID NO: 5161919 - DNA, 16 bp, Homo sapiens
actgtcctcgcagaga

SEQ ID NO: 5161920 - DNA, 17 bp, Homo sapiens
actgtcctctcccctcc

SEQ ID NO: 5161921 - DNA, 19 bp, Homo sapiens
actgtcctctcccctccag

SEQ ID NO: 5161922 - DNA, 19 bp, Homo sapiens
actgtcctctttcagaaaa

SEQ ID NO: 5161923 - DNA, 21 bp, Homo sapiens
actgtcctctttcagaaaaca

SEQ ID NO: 5161924 - DNA, 18 bp, Homo sapiens
actgtcctgaggagccct

SEQ ID NO: 5161925 - DNA, 10 bp, Homo sapiens
actgtcctgc

SEQ ID NO: 5161926 - DNA, 12 bp, Homo sapiens
actgtcctgctc

SEQ ID NO: 5161927 - DNA, 13 bp, Homo sapiens
actgtcctgctcc

SEQ ID NO: 5161928 - DNA, 19 bp, Homo sapiens
actgtcctgctccacagtg

SEQ ID NO: 5161929 - DNA, 13 bp, Homo sapiens
actgtcctggaac

SEQ ID NO: 5161930 - DNA, 14 bp, Homo sapiens
actgtcctggcttt

SEQ ID NO: 5161931 - DNA, 15 bp, Homo sapiens
actgtcctggctttt

SEQ ID NO: 5161932 - DNA, 12 bp, Homo sapiens
actgtcctgggc

SEQ ID NO: 5161933 - DNA, 14 bp, Homo sapiens
actgtcctgggcct

SEQ ID NO: 5161934 - DNA, 17 bp, Homo sapiens
actgtcctgggcctgca

SEQ ID NO: 5161935 - DNA, 15 bp, Homo sapiens
actgtcctgtcctgc

SEQ ID NO: 5161936 - DNA, 19 bp, Homo sapiens
actgtccttccctgccact

SEQ ID NO: 5161937 - DNA, 22 bp, Homo sapiens
actgtccttgaacccaacagtc

SEQ ID NO: 5161938 - DNA, 14 bp, Homo sapiens
actgtcctttcctt

SEQ ID NO: 5161939 - DNA, 15 bp, Homo sapiens
actcggcccagggcc

SEQ ID NO: 5161940 - DNA, 15 bp, Homo sapiens
actcggctctgcagt

SEQ ID NO: 5161941 - DNA, 16 bp, Homo sapiens
actcggctctgcagtc

SEQ ID NO: 5161942 - DNA, 13 bp, Homo sapiens
actcggcttcctg

SEQ ID NO: 5161943 - DNA, 21 bp, Homo sapiens
actcgggagcattctgcctgc

SEQ ID NO: 5161944 - DNA, 17 bp, Homo sapiens
actcgggagctgcacac

SEQ ID NO: 5161945 - DNA, 20 bp, Homo sapiens
actcgggagggaacatcctg

SEQ ID NO: 5161946 - DNA, 17 bp, Homo sapiens
actcgggattacagaaa

SEQ ID NO: 5161947 - DNA, 21 bp, Homo sapiens
actcgggctaagtccagctct

SEQ ID NO: 5161948 - DNA, 15 bp, Homo sapiens
actcgggggcgcctg

SEQ ID NO: 5161949 - DNA, 17 bp, Homo sapiens
actcgggggcgcctgga

SEQ ID NO: 5161950 - DNA, 20 bp, Homo sapiens
actcgggggctgtctcagac

SEQ ID NO: 5161951 - DNA, 14 bp, Homo sapiens
actcggggtccctg

SEQ ID NO: 5161952 - DNA, 16 bp, Homo sapiens
actcggggtgcttcct

SEQ ID NO: 5161953 - DNA, 20 bp, Homo sapiens
actcggggtgcttccttgta

SEQ ID NO: 5161954 - DNA, 20 bp, Homo sapiens
actcgggtttctctgtggct

SEQ ID NO: 5161955 - DNA, 18 bp, Homo sapiens
actcggtctgagaagatt

SEQ ID NO: 5161956 - DNA, 13 bp, Homo sapiens
actcggtgtaaaa

SEQ ID NO: 5161957 - DNA, 20 bp, Homo sapiens
actcgtaggggatgtggagt

SEQ ID NO: 5161958 - DNA, 19 bp, Homo sapiens
actcgtatagcatgcatct

SEQ ID NO: 5161959 - DNA, 14 bp, Homo sapiens
actcgtatatgtct

SEQ ID NO: 5161960 - DNA, 20 bp, Homo sapiens
actcgtccaagggacagccc

SEQ ID NO: 5161961 - DNA, 21 bp, Homo sapiens
actcgtctgatgttttgatgc

SEQ ID NO: 5161962 - DNA, 19 bp, Homo sapiens
actcgtgacagcctctgac

SEQ ID NO: 5161963 - DNA, 19 bp, Homo sapiens
actcgtgacttgtcccctc

SEQ ID NO: 5161964 - DNA, 16 bp, Homo sapiens
actcgtgtgcaacaga

SEQ ID NO: 5161965 - DNA, 13 bp, Homo sapiens
actcgtgtgcatg

SEQ ID NO: 5161966 - DNA, 22 bp, Homo sapiens
actcgtgtgcatgagaatgtca

SEQ ID NO: 5161967 - DNA, 23 bp, Homo sapiens
actcgtgtgcatgagaatgtcat

SEQ ID NO: 5161968 - DNA, 16 bp, Homo sapiens
actctaaaaaacattt

SEQ ID NO: 5161969 - DNA, 19 bp, Homo sapiens
actctaaaaaacattttta

SEQ ID NO: 5161970 - DNA, 20 bp, Homo sapiens
actctaaaaaacatttttaa

SEQ ID NO: 5161971 - DNA, 14 bp, Homo sapiens
actctaaaaataga

SEQ ID NO: 5161972 - DNA, 21 bp, Homo sapiens
actctaaaagatcctttttaa

SEQ ID NO: 5161973 - DNA, 15 bp, Homo sapiens
actctaaaaggttca

SEQ ID NO: 5161974 - DNA, 19 bp, Homo sapiens
actctaaaaggttcaggga

SEQ ID NO: 5161975 - DNA, 20 bp, Homo sapiens
actctaaaatggacattttc

SEQ ID NO: 5161976 - DNA, 13 bp, Homo sapiens
actctaaactgca

SEQ ID NO: 5161977 - DNA, 14 bp, Homo sapiens
actctaaactgcaa

SEQ ID NO: 5161978 - DNA, 22 bp, Homo sapiens
actctaaactgcaaacagaaat

SEQ ID NO: 5161979 - DNA, 15 bp, Homo sapiens
actctaaagaccaaa

SEQ ID NO: 5161980 - DNA, 18 bp, Homo sapiens
actctaaagaccaaactt

SEQ ID NO: 5161981 - DNA, 20 bp, Homo sapiens
actctaaagcttctataaaa

SEQ ID NO: 5161982 - DNA, 18 bp, Homo sapiens
actctaaataaatttgct

SEQ ID NO: 5161983 - DNA, 12 bp, Homo sapiens
actctaaataga

SEQ ID NO: 5161984 - DNA, 16 bp, Homo sapiens
actctaaatagcccag

SEQ ID NO: 5161985 - DNA, 17 bp, Homo sapiens
actctaaatatttcatg

SEQ ID NO: 5161986 - DNA, 13 bp, Homo sapiens
actctaaatgcag

SEQ ID NO: 5161987 - DNA, 22 bp, Homo sapiens
actctaaatgcagttttaagaa

SEQ ID NO: 5161988 - DNA, 21 bp, Homo sapiens
actctaacaggcactttgaga

SEQ ID NO: 5161989 - DNA, 15 bp, Homo sapiens
actctaaccagtgta

SEQ ID NO: 5161990 - DNA, 14 bp, Homo sapiens
actctaactctgag

SEQ ID NO: 5161991 - DNA, 14 bp, Homo sapiens
actctaactgtata

SEQ ID NO: 5161992 - DNA, 16 bp, Homo sapiens
actctaactgtgacaa

SEQ ID NO: 5161993 - DNA, 13 bp, Homo sapiens
actctaagaaaga

SEQ ID NO: 5161994 - DNA, 22 bp, Homo sapiens
actctaagaaatggctttccac

SEQ ID NO: 5161995 - DNA, 12 bp, Homo sapiens
actctaagatct

SEQ ID NO: 5161996 - DNA, 13 bp, Homo sapiens
actctaagatctt

SEQ ID NO: 5161997 - DNA, 19 bp, Homo sapiens
actctaagctggagctctt

SEQ ID NO: 5161998 - DNA, 14 bp, Homo sapiens
actctaagctgtgt

SEQ ID NO: 5161999 - DNA, 18 bp, Homo sapiens
actctaagtcatgtatgt

SEQ ID NO: 5162000 - DNA, 19 bp, Homo sapiens
actctaagtcatgtatgtt

SEQ ID NO: 5162001 - DNA, 23 bp, Homo sapiens
actctaagttttagggtacatgt

SEQ ID NO: 5162002 - DNA, 13 bp, Homo sapiens
actctaatataat

SEQ ID NO: 5162003 - DNA, 14 bp, Homo sapiens
actctaatattgct

SEQ ID NO: 5162004 - DNA, 20 bp, Homo sapiens
actctaattcccattttgca

SEQ ID NO: 5162005 - DNA, 21 bp, Homo sapiens
actctaattcccattttgcaa

SEQ ID NO: 5162006 - DNA, 14 bp, Homo sapiens
actctaattctaac

SEQ ID NO: 5162007 - DNA, 16 bp, Homo sapiens
actctaattctaacca

SEQ ID NO: 5162008 - DNA, 16 bp, Homo sapiens
actctaattggtcatt

SEQ ID NO: 5162009 - DNA, 13 bp, Homo sapiens
actctacaaagag

SEQ ID NO: 5162010 - DNA, 22 bp, Homo sapiens
actctacaagaaagctgtggct

SEQ ID NO: 5162011 - DNA, 14 bp, Homo sapiens
actctacacagctc

SEQ ID NO: 5162012 - DNA, 16 bp, Homo sapiens
actctacaccctctgc

SEQ ID NO: 5162013 - DNA, 15 bp, Homo sapiens
actctacactgaaac

SEQ ID NO: 5162014 - DNA, 14 bp, Homo sapiens
actctacatttaaa

SEQ ID NO: 5162015 - DNA, 18 bp, Homo sapiens
actctaccaaataatttc

SEQ ID NO: 5162016 - DNA, 14 bp, Homo sapiens
actctaccagactg

SEQ ID NO: 5162017 - DNA, 19 bp, Homo sapiens
actctaccagactgtgtat

SEQ ID NO: 5162018 - DNA, 14 bp, Homo sapiens
actctacccctgct

SEQ ID NO: 5162019 - DNA, 16 bp, Homo sapiens
actctacccctgctcc

SEQ ID NO: 5162020 - DNA, 18 bp, Homo sapiens
actctaccctcttagaaa

SEQ ID NO: 5162021 - DNA, 22 bp, Homo sapiens
actctacctcatatcagtttgc

SEQ ID NO: 5162022 - DNA, 18 bp, Homo sapiens
actctactattaagtttg

SEQ ID NO: 5162023 - DNA, 14 bp, Homo sapiens
actctactgctgct

SEQ ID NO: 5162024 - DNA, 18 bp, Homo sapiens
actctactgctgctgaca

SEQ ID NO: 5162025 - DNA, 15 bp, Homo sapiens
actctactgtgtaat

SEQ ID NO: 5162026 - DNA, 15 bp, Homo sapiens
actctactgttgcaa

SEQ ID NO: 5162027 - DNA, 21 bp, Homo sapiens
actctacttaatccaatgggt

SEQ ID NO: 5162028 - DNA, 18 bp, Homo sapiens
actctagaaaaaagggct

SEQ ID NO: 5162029 - DNA, 16 bp, Homo sapiens
actctagaagctcagg

SEQ ID NO: 5162030 - DNA, 17 bp, Homo sapiens
actctagagagccttaa

SEQ ID NO: 5162031 - DNA, 20 bp, Homo sapiens
actctagagagccttaactt

SEQ ID NO: 5162032 - DNA, 23 bp, Homo sapiens
actctagagagccttaacttctt

SEQ ID NO: 5162033 - DNA, 16 bp, Homo sapiens
actctagagggcgagg

SEQ ID NO: 5162034 - DNA, 19 bp, Homo sapiens
actctagagtccaaggttt

SEQ ID NO: 5162035 - DNA, 20 bp, Homo sapiens
actctagagtccaaggttta

SEQ ID NO: 5162036 - DNA, 20 bp, Homo sapiens
actctagatacctaaaacat

SEQ ID NO: 5162037 - DNA, 21 bp, Homo sapiens
actctagatgaagttttacat

SEQ ID NO: 5162038 - DNA, 18 bp, Homo sapiens
actctagatggcaacatt

SEQ ID NO: 5162039 - DNA, 14 bp, Homo sapiens
actctagatgttta

SEQ ID NO: 5162040 - DNA, 20 bp, Homo sapiens
actctagattttgttttgct

SEQ ID NO: 5162041 - DNA, 13 bp, Homo sapiens
actctagcctggg

SEQ ID NO: 5162042 - DNA, 14 bp, Homo sapiens
actctaggacttca

SEQ ID NO: 5162043 - DNA, 15 bp, Homo sapiens
actctaggacttcaa

SEQ ID NO: 5162044 - DNA, 18 bp, Homo sapiens
actctaggacttcaaagt

SEQ ID NO: 5162045 - DNA, 15 bp, Homo sapiens
actctagggaaaaac

SEQ ID NO: 5162046 - DNA, 16 bp, Homo sapiens
actctagggatataaa

SEQ ID NO: 5162047 - DNA, 17 bp, Homo sapiens
actctagtcaatgacat

SEQ ID NO: 5162048 - DNA, 16 bp, Homo sapiens
actctagtgacttcct

SEQ ID NO: 5162049 - DNA, 20 bp, Homo sapiens
actctagtgacttcctggtg

SEQ ID NO: 5162050 - DNA, 22 bp, Homo sapiens
actctagtgacttcctggtgag

SEQ ID NO: 5162051 - DNA, 13 bp, Homo sapiens
actctagtgccat

SEQ ID NO: 5162052 - DNA, 14 bp, Homo sapiens
actctagttctaga

SEQ ID NO: 5162053 - DNA, 15 bp, Homo sapiens
actctagttctagat

SEQ ID NO: 5162054 - DNA, 15 bp, Homo sapiens
actctagttctgttg

SEQ ID NO: 5162055 - DNA, 21 bp, Homo sapiens
actctagttctgttgttttgt

SEQ ID NO: 5162056 - DNA, 17 bp, Homo sapiens
actctagtttattctaa

SEQ ID NO: 5162057 - DNA, 16 bp, Homo sapiens
actctataaagaaact

SEQ ID NO: 5162058 - DNA, 23 bp, Homo sapiens
actctataaagaaacttttgaaa

SEQ ID NO: 5162059 - DNA, 22 bp, Homo sapiens
actctataacaaaggatactta

SEQ ID NO: 5162060 - DNA, 18 bp, Homo sapiens
actctataagattccaaa

SEQ ID NO: 5162061 - DNA, 20 bp, Homo sapiens
actctatactcaatcaagca

SEQ ID NO: 5162062 - DNA, 15 bp, Homo sapiens
actctatagactcta

SEQ ID NO: 5162063 - DNA, 14 bp, Homo sapiens
actctatagacttt

SEQ ID NO: 5162064 - DNA, 20 bp, Homo sapiens
actctatagtaggcatgtta

SEQ ID NO: 5162065 - DNA, 22 bp, Homo sapiens
actctatatagctgatcagttt

SEQ ID NO: 5162066 - DNA, 14 bp, Homo sapiens
actctatcaaatgt

SEQ ID NO: 5162067 - DNA, 21 bp, Homo sapiens
actctatcaagtattatacct

SEQ ID NO: 5162068 - DNA, 15 bp, Homo sapiens
actctatccctggct

SEQ ID NO: 5162069 - DNA, 15 bp, Homo sapiens
actctatgatgattg

SEQ ID NO: 5162070 - DNA, 21 bp, Homo sapiens
actctatgccccaaatatagc

SEQ ID NO: 5162071 - DNA, 12 bp, Homo sapiens
actctatgctct

SEQ ID NO: 5162072 - DNA, 13 bp, Homo sapiens
actctatgctctg

SEQ ID NO: 5162073 - DNA, 12 bp, Homo sapiens
actctattcttt

SEQ ID NO: 5162074 - DNA, 13 bp, Homo sapiens
actctattcttta

SEQ ID NO: 5162075 - DNA, 15 bp, Homo sapiens
actctattctttaac

SEQ ID NO: 5162076 - DNA, 15 bp, Homo sapiens
actctatttacagtc

SEQ ID NO: 5162077 - DNA, 13 bp, Homo sapiens
actctatttttgt

SEQ ID NO: 5162078 - DNA, 19 bp, Homo sapiens
actctcaaaagtctatttt

SEQ ID NO: 5162079 - DNA, 19 bp, Homo sapiens
actctcacactgaatcagc

SEQ ID NO: 5162080 - DNA, 16 bp, Homo sapiens
actctcacatgtggca

SEQ ID NO: 5162081 - DNA, 21 bp, Homo sapiens
actctcaccatgatgtgaaga

SEQ ID NO: 5162082 - DNA, 22 bp, Homo sapiens
actctcaccatgatgtgaagag

SEQ ID NO: 5162083 - DNA, 20 bp, Homo sapiens
actctcaccccaagcggcct

SEQ ID NO: 5162084 - DNA, 12 bp, Homo sapiens
actctcaccccc

SEQ ID NO: 5162085 - DNA, 22 bp, Homo sapiens
actctcacctgtactattgcag

SEQ ID NO: 5162086 - DNA, 19 bp, Homo sapiens
actctcagagactcccagg

SEQ ID NO: 5162087 - DNA, 15 bp, Homo sapiens
actctcagcccagaa

SEQ ID NO: 5162088 - DNA, 16 bp, Homo sapiens
actctcagcccagaag

SEQ ID NO: 5162089 - DNA, 21 bp, Homo sapiens
actctcagcccagaagaaaat

SEQ ID NO: 5162090 - DNA, 19 bp, Homo sapiens
actctcaggaccaccctgc

SEQ ID NO: 5162091 - DNA, 11 bp, Homo sapiens
actctcaggga

SEQ ID NO: 5162092 - DNA, 20 bp, Homo sapiens
actctcaggtttttgaggaa

SEQ ID NO: 5162093 - DNA, 17 bp, Homo sapiens
actctcagtctctgagc

SEQ ID NO: 5162094 - DNA, 22 bp, Homo sapiens
actctcatcaccccagaggcct

SEQ ID NO: 5162095 - DNA, 14 bp, Homo sapiens
actctcattcccca

SEQ ID NO: 5162096 - DNA, 16 bp, Homo sapiens
actctcattccccagg

SEQ ID NO: 5162097 - DNA, 21 bp, Homo sapiens
actctcattccccaggtggct

SEQ ID NO: 5162098 - DNA, 17 bp, Homo sapiens
actctccaacctggaca

SEQ ID NO: 5162099 - DNA, 19 bp, Homo sapiens
actctccaacctggacaac

SEQ ID NO: 5162100 - DNA, 12 bp, Homo sapiens
actctccacctc

SEQ ID NO: 5162101 - DNA, 17 bp, Homo sapiens
actctccactgacctgg

SEQ ID NO: 5162102 - DNA, 23 bp, Homo sapiens
actctccagagaacctttagaat

SEQ ID NO: 5162103 - DNA, 21 bp, Homo sapiens
actctccagccgaagctgcag

SEQ ID NO: 5162104 - DNA, 18 bp, Homo sapiens
actctccaggattgtcca

SEQ ID NO: 5162105 - DNA, 17 bp, Homo sapiens
actctccaggcaccgcc

SEQ ID NO: 5162106 - DNA, 20 bp, Homo sapiens
actctccaggcaccgcctgc

SEQ ID NO: 5162107 - DNA, 14 bp, Homo sapiens
actctccattagaa

SEQ ID NO: 5162108 - DNA, 19 bp, Homo sapiens
actctcccaaagggcacac

SEQ ID NO: 5162109 - DNA, 19 bp, Homo sapiens
actctcccagaggctcctg

SEQ ID NO: 5162110 - DNA, 20 bp, Homo sapiens
actctcccagaggctcctgg

SEQ ID NO: 5162111 - DNA, 21 bp, Homo sapiens
actctcccagaggctcctgga

SEQ ID NO: 5162112 - DNA, 23 bp, Homo sapiens
actctcccatggcttaatgcttc

SEQ ID NO: 5162113 - DNA, 21 bp, Homo sapiens
actctccccaaaatattatat

SEQ ID NO: 5162114 - DNA, 11 bp, Homo sapiens
actctccccac

SEQ ID NO: 5162115 - DNA, 20 bp, Homo sapiens
actctccccacgagggctgg

SEQ ID NO: 5162116 - DNA, 15 bp, Homo sapiens
actctccccagtgcc

SEQ ID NO: 5162117 - DNA, 16 bp, Homo sapiens
actctccccagtgcct

SEQ ID NO: 5162118 - DNA, 13 bp, Homo sapiens
actgtcctttctc

SEQ ID NO: 5162119 - DNA, 15 bp, Homo sapiens
actgtcctttctcca

SEQ ID NO: 5162120 - DNA, 21 bp, Homo sapiens
actgtcctttctccaggccct

SEQ ID NO: 5162121 - DNA, 16 bp, Homo sapiens
actgtcgccacacgcc

SEQ ID NO: 5162122 - DNA, 17 bp, Homo sapiens
actgtcgccacacgcct

SEQ ID NO: 5162123 - DNA, 13 bp, Homo sapiens
actgtcgctgctt

SEQ ID NO: 5162124 - DNA, 20 bp, Homo sapiens
actgtcggaggaaagacaac

SEQ ID NO: 5162125 - DNA, 19 bp, Homo sapiens
actgtcgtgtttacaaaag

SEQ ID NO: 5162126 - DNA, 17 bp, Homo sapiens
actgtctaagcagtttt

SEQ ID NO: 5162127 - DNA, 18 bp, Homo sapiens
actgtctaagcagttttg

SEQ ID NO: 5162128 - DNA, 18 bp, Homo sapiens
actgtctagagcaacttt

SEQ ID NO: 5162129 - DNA, 23 bp, Homo sapiens
actgtctagccactccctcccag

SEQ ID NO: 5162130 - DNA, 15 bp, Homo sapiens
actgtctatatatat

SEQ ID NO: 5162131 - DNA, 20 bp, Homo sapiens
actgtctatatcataactat

SEQ ID NO: 5162132 - DNA, 22 bp, Homo sapiens
actgtctatctctaataaaaac

SEQ ID NO: 5162133 - DNA, 21 bp, Homo sapiens
actgtctattaaaattctgat

SEQ ID NO: 5162134 - DNA, 22 bp, Homo sapiens
actgtctatttaagtgcaatta

SEQ ID NO: 5162135 - DNA, 17 bp, Homo sapiens
actgtctatttctgctg

SEQ ID NO: 5162136 - DNA, 19 bp, Homo sapiens
actgtctatttctgctgaa

SEQ ID NO: 5162137 - DNA, 23 bp, Homo sapiens
actgtctatttctgctgaatttt

SEQ ID NO: 5162138 - DNA, 12 bp, Homo sapiens
actgtctcactg

SEQ ID NO: 5162139 - DNA, 19 bp, Homo sapiens
actgtctcctccctgggct

SEQ ID NO: 5162140 - DNA, 12 bp, Homo sapiens
actgtctccttc

SEQ ID NO: 5162141 - DNA, 15 bp, Homo sapiens
actgtctccttccca

SEQ ID NO: 5162142 - DNA, 15 bp, Homo sapiens
actgtctcggcagag

SEQ ID NO: 5162143 - DNA, 18 bp, Homo sapiens
actgtctcggcagaggtg

SEQ ID NO: 5162144 - DNA, 16 bp, Homo sapiens
actgtctctccagtga

SEQ ID NO: 5162145 - DNA, 21 bp, Homo sapiens
actgtctctccagtgaaatga

SEQ ID NO: 5162146 - DNA, 18 bp, Homo sapiens
actgtctgattggcttgt

SEQ ID NO: 5162147 - DNA, 16 bp, Homo sapiens
actgtctgctgatata

SEQ ID NO: 5162148 - DNA, 14 bp, Homo sapiens
actgtctgctggca

SEQ ID NO: 5162149 - DNA, 22 bp, Homo sapiens
actgtctggcccccctggtccc

SEQ ID NO: 5162150 - DNA, 13 bp, Homo sapiens
actgtctgggatt

SEQ ID NO: 5162151 - DNA, 17 bp, Homo sapiens
actgtctgtagtgtttt

SEQ ID NO: 5162152 - DNA, 11 bp, Homo sapiens
actgtctgtgt

SEQ ID NO: 5162153 - DNA, 14 bp, Homo sapiens
actgtctgtgtcct

SEQ ID NO: 5162154 - DNA, 15 bp, Homo sapiens
actgtctgtgtcctt

SEQ ID NO: 5162155 - DNA, 23 bp, Homo sapiens
actgtctgtgtttttttggcagt

SEQ ID NO: 5162156 - DNA, 10 bp, Homo sapiens
actgtcttaa

SEQ ID NO: 5162157 - DNA, 12 bp, Homo sapiens
actgtcttaaat

SEQ ID NO: 5162158 - DNA, 14 bp, Homo sapiens
actgtcttaaatca

SEQ ID NO: 5162159 - DNA, 11 bp, Homo sapiens
actgtcttaat

SEQ ID NO: 5162160 - DNA, 17 bp, Homo sapiens
actgtcttaattaagta

SEQ ID NO: 5162161 - DNA, 21 bp, Homo sapiens
actgtcttacgtttttctggt

SEQ ID NO: 5162162 - DNA, 19 bp, Homo sapiens
actgtcttagtcataccat

SEQ ID NO: 5162163 - DNA, 17 bp, Homo sapiens
actgtcttcaaccctgc

SEQ ID NO: 5162164 - DNA, 18 bp, Homo sapiens
actgtcttcaaccctgcc

SEQ ID NO: 5162165 - DNA, 19 bp, Homo sapiens
actgtcttcaaccctgccc

SEQ ID NO: 5162166 - DNA, 11 bp, Homo sapiens
actgtcttccc

SEQ ID NO: 5162167 - DNA, 17 bp, Homo sapiens
actgtcttctccctgca

SEQ ID NO: 5162168 - DNA, 18 bp, Homo sapiens
actgtcttgaattagtat

SEQ ID NO: 5162169 - DNA, 22 bp, Homo sapiens
actgtcttgagagaaaagaaaa

SEQ ID NO: 5162170 - DNA, 21 bp, Homo sapiens
actgtcttgcctgccagggcc

SEQ ID NO: 5162171 - DNA, 22 bp, Homo sapiens
actgtcttgcctgccagggccc

SEQ ID NO: 5162172 - DNA, 21 bp, Homo sapiens
actgtcttggctgtggggcta

SEQ ID NO: 5162173 - DNA, 16 bp, Homo sapiens
actgtcttgtgttttc

SEQ ID NO: 5162174 - DNA, 14 bp, Homo sapiens
actgtctttcctat

SEQ ID NO: 5162175 - DNA, 16 bp, Homo sapiens
actgtctttgtgctga

SEQ ID NO: 5162176 - DNA, 13 bp, Homo sapiens
actgtcttttaaa

SEQ ID NO: 5162177 - DNA, 22 bp, Homo sapiens
actgtcttttttctaaagtaaa

SEQ ID NO: 5162178 - DNA, 23 bp, Homo sapiens
actgtcttttttctaaagtaaaa

SEQ ID NO: 5162179 - DNA, 21 bp, Homo sapiens
actgtctttttttccctacca

SEQ ID NO: 5162180 - DNA, 16 bp, Homo sapiens
actgtgaaaaaaaatt

SEQ ID NO: 5162181 - DNA, 17 bp, Homo sapiens
actgtgaaaatagtgta

SEQ ID NO: 5162182 - DNA, 21 bp, Homo sapiens
actgtgaaaatagtgtaagaa

SEQ ID NO: 5162183 - DNA, 23 bp, Homo sapiens
actgtgaaaatagtgtaagaact

SEQ ID NO: 5162184 - DNA, 10 bp, Homo sapiens
actgtgaaag

SEQ ID NO: 5162185 - DNA, 14 bp, Homo sapiens
actgtgaaatacca

SEQ ID NO: 5162186 - DNA, 21 bp, Homo sapiens
actgtgaacagcttgctgtca

SEQ ID NO: 5162187 - DNA, 16 bp, Homo sapiens
actgtgaaccggctcc

SEQ ID NO: 5162188 - DNA, 18 bp, Homo sapiens
actgtgaacctggagggc

SEQ ID NO: 5162189 - DNA, 15 bp, Homo sapiens
actgtgaactgggca

SEQ ID NO: 5162190 - DNA, 18 bp, Homo sapiens
actgtgaactgggcattt

SEQ ID NO: 5162191 - DNA, 21 bp, Homo sapiens
actgtgaacttgactgggtga

SEQ ID NO: 5162192 - DNA, 20 bp, Homo sapiens
actgtgaagacccagcagga

SEQ ID NO: 5162193 - DNA, 22 bp, Homo sapiens
actgtgaagacccagcaggaag

SEQ ID NO: 5162194 - DNA, 13 bp, Homo sapiens
actgtgaagagaa

SEQ ID NO: 5162195 - DNA, 16 bp, Homo sapiens
actgtgaagagaacca

SEQ ID NO: 5162196 - DNA, 15 bp, Homo sapiens
actgtgaaggaccct

SEQ ID NO: 5162197 - DNA, 19 bp, Homo sapiens
actgtgaagggtacagatt

SEQ ID NO: 5162198 - DNA, 22 bp, Homo sapiens
actgtgaagtttacattgtaaa

SEQ ID NO: 5162199 - DNA, 15 bp, Homo sapiens
actgtgaatatgaga

SEQ ID NO: 5162200 - DNA, 14 bp, Homo sapiens
actgtgaatatgtg

SEQ ID NO: 5162201 - DNA, 19 bp, Homo sapiens
actgtgaatatgtgtaact

SEQ ID NO: 5162202 - DNA, 16 bp, Homo sapiens
actgtgaatgcttctg

SEQ ID NO: 5162203 - DNA, 23 bp, Homo sapiens
actgtgaatgtaaaacagagcca

SEQ ID NO: 5162204 - DNA, 23 bp, Homo sapiens
actgtgacaactgtctaacttta

SEQ ID NO: 5162205 - DNA, 22 bp, Homo sapiens
actgtgacaatgactaagccaa

SEQ ID NO: 5162206 - DNA, 23 bp, Homo sapiens
actgtgacacactacaccacaca

SEQ ID NO: 5162207 - DNA, 17 bp, Homo sapiens
actgtgacacagctgag

SEQ ID NO: 5162208 - DNA, 15 bp, Homo sapiens
actgtgacaggcagc

SEQ ID NO: 5162209 - DNA, 19 bp, Homo sapiens
actgtgacaggcagcagag

SEQ ID NO: 5162210 - DNA, 14 bp, Homo sapiens
actgtgacatctct

SEQ ID NO: 5162211 - DNA, 17 bp, Homo sapiens
actgtgacattccacag

SEQ ID NO: 5162212 - DNA, 21 bp, Homo sapiens
actgtgacattccacagagtt

SEQ ID NO: 5162213 - DNA, 14 bp, Homo sapiens
actgtgaccaaagc

SEQ ID NO: 5162214 - DNA, 16 bp, Homo sapiens
actgtgaccaagtata

SEQ ID NO: 5162215 - DNA, 14 bp, Homo sapiens
actgtgaccctggg

SEQ ID NO: 5162216 - DNA, 15 bp, Homo sapiens
actgtgaccctgggt

SEQ ID NO: 5162217 - DNA, 16 bp, Homo sapiens
actgtgacctgctcct

SEQ ID NO: 5162218 - DNA, 20 bp, Homo sapiens
actgtgacctgctcctgccc

SEQ ID NO: 5162219 - DNA, 23 bp, Homo sapiens
actgtgacctttgtctagagttg

SEQ ID NO: 5162220 - DNA, 11 bp, Homo sapiens
actgtgactga

SEQ ID NO: 5162221 - DNA, 15 bp, Homo sapiens
actgtgagaactgtg

SEQ ID NO: 5162222 - DNA, 16 bp, Homo sapiens
actgtgagaactgtga

SEQ ID NO: 5162223 - DNA, 12 bp, Homo sapiens
actgtgagactg

SEQ ID NO: 5162224 - DNA, 15 bp, Homo sapiens
actgtgagataaata

SEQ ID NO: 5162225 - DNA, 15 bp, Homo sapiens
actgtgagcttacat

SEQ ID NO: 5162226 - DNA, 18 bp, Homo sapiens
actgtgaggaagagcagg

SEQ ID NO: 5162227 - DNA, 18 bp, Homo sapiens
actgtgagtcctgatcct

SEQ ID NO: 5162228 - DNA, 15 bp, Homo sapiens
actgtgagttctgat

SEQ ID NO: 5162229 - DNA, 13 bp, Homo sapiens
actgtgatgaagc

SEQ ID NO: 5162230 - DNA, 18 bp, Homo sapiens
actgtgatggggtgggca

SEQ ID NO: 5162231 - DNA, 20 bp, Homo sapiens
actgtgatgtatattgtgtt

SEQ ID NO: 5162232 - DNA, 23 bp, Homo sapiens
actgtgatgttgggaagctattt

SEQ ID NO: 5162233 - DNA, 20 bp, Homo sapiens
actgtgattactctttgctt

SEQ ID NO: 5162234 - DNA, 18 bp, Homo sapiens
actgtgattcttagcaaa

SEQ ID NO: 5162235 - DNA, 13 bp, Homo sapiens
actgtgatttctg

SEQ ID NO: 5162236 - DNA, 18 bp, Homo sapiens
actgtgattttgccctcc

SEQ ID NO: 5162237 - DNA, 20 bp, Homo sapiens
actgtgattttgccctcctg

SEQ ID NO: 5162238 - DNA, 21 bp, Homo sapiens
actgtgattttgccctcctgc

SEQ ID NO: 5162239 - DNA, 17 bp, Homo sapiens
actgtgcaaagggctgc

SEQ ID NO: 5162240 - DNA, 18 bp, Homo sapiens
actgtgcaaagggctgcc

SEQ ID NO: 5162241 - DNA, 17 bp, Homo sapiens
actgtgcaactttttaa

SEQ ID NO: 5162242 - DNA, 18 bp, Homo sapiens
actgtgcaccaagcagga

SEQ ID NO: 5162243 - DNA, 13 bp, Homo sapiens
actgtgcactata

SEQ ID NO: 5162244 - DNA, 18 bp, Homo sapiens
actgtgcactgacatgtt

SEQ ID NO: 5162245 - DNA, 16 bp, Homo sapiens
actgtgcagaataatg

SEQ ID NO: 5162246 - DNA, 21 bp, Homo sapiens
actgtgcagaataatggaaac

SEQ ID NO: 5162247 - DNA, 13 bp, Homo sapiens
actgtgcaggagt

SEQ ID NO: 5162248 - DNA, 15 bp, Homo sapiens
actgtgcaggcccag

SEQ ID NO: 5162249 - DNA, 20 bp, Homo sapiens
actgtgcaggcctgtccctg

SEQ ID NO: 5162250 - DNA, 21 bp, Homo sapiens
actgtgcaggcctgtccctgg

SEQ ID NO: 5162251 - DNA, 22 bp, Homo sapiens
actgtgcaggcctgtccctggg

SEQ ID NO: 5162252 - DNA, 23 bp, Homo sapiens
actgtgcaggcctgtccctggga

SEQ ID NO: 5162253 - DNA, 20 bp, Homo sapiens
actgtgcaggtgctattgtt

SEQ ID NO: 5162254 - DNA, 22 bp, Homo sapiens
actgtgcaggtgctattgttac

SEQ ID NO: 5162255 - DNA, 12 bp, Homo sapiens
actgtgcagtta

SEQ ID NO: 5162256 - DNA, 17 bp, Homo sapiens
actgtgcatagtgctgg

SEQ ID NO: 5162257 - DNA, 21 bp, Homo sapiens
actgtgcatcaaccaggaaga

SEQ ID NO: 5162258 - DNA, 15 bp, Homo sapiens
actgtgcatgtgcgt

SEQ ID NO: 5162259 - DNA, 18 bp, Homo sapiens
actgtgccaactactact

SEQ ID NO: 5162260 - DNA, 18 bp, Homo sapiens
actgtgccaagatttaaa

SEQ ID NO: 5162261 - DNA, 12 bp, Homo sapiens
actgtgccactg

SEQ ID NO: 5162262 - DNA, 17 bp, Homo sapiens
actgtgccagaggccag

SEQ ID NO: 5162263 - DNA, 16 bp, Homo sapiens
actgtgccatgtgttt

SEQ ID NO: 5162264 - DNA, 12 bp, Homo sapiens
actgtgcccagc

SEQ ID NO: 5162265 - DNA, 21 bp, Homo sapiens
actgtgcccagcagtttccca

SEQ ID NO: 5162266 - DNA, 22 bp, Homo sapiens
actgtgcccagcagtttcccag

SEQ ID NO: 5162267 - DNA, 23 bp, Homo sapiens
actgtgcccagcagtttcccaga

SEQ ID NO: 5162268 - DNA, 12 bp, Homo sapiens
actgtgccctgg

SEQ ID NO: 5162269 - DNA, 15 bp, Homo sapiens
actgtgccctggtgg

SEQ ID NO: 5162270 - DNA, 18 bp, Homo sapiens
actgtgcctcagagacca

SEQ ID NO: 5162271 - DNA, 23 bp, Homo sapiens
actgtgcctcagagaccagggct

SEQ ID NO: 5162272 - DNA, 16 bp, Homo sapiens
actgtgcctcaggcca

SEQ ID NO: 5162273 - DNA, 13 bp, Homo sapiens
actgtgcctggct

SEQ ID NO: 5162274 - DNA, 15 bp, Homo sapiens
actgtgcctggctcc

SEQ ID NO: 5162275 - DNA, 20 bp, Homo sapiens
actgtgcctggctccctgat

SEQ ID NO: 5162276 - DNA, 21 bp, Homo sapiens
actgtgcctggctccctgatg

SEQ ID NO: 5162277 - DNA, 18 bp, Homo sapiens
actgtgcctggtttgatt

SEQ ID NO: 5162278 - DNA, 13 bp, Homo sapiens
actgtgccttttc

SEQ ID NO: 5162279 - DNA, 22 bp, Homo sapiens
actgtgcgcataggcctgcttt

SEQ ID NO: 5162280 - DNA, 17 bp, Homo sapiens
actgtgcgtggggctcc

SEQ ID NO: 5162281 - DNA, 18 bp, Homo sapiens
actgtgctccagcctggg

SEQ ID NO: 5162282 - DNA, 20 bp, Homo sapiens
actgtgctccagcctgggca

SEQ ID NO: 5162283 - DNA, 13 bp, Homo sapiens
actgtgctcccac

SEQ ID NO: 5162284 - DNA, 20 bp, Homo sapiens
actgtgctgagtctgaaggc

SEQ ID NO: 5162285 - DNA, 22 bp, Homo sapiens
actgtgctgagtctgaaggctg

SEQ ID NO: 5162286 - DNA, 21 bp, Homo sapiens
actgtgctgattcaataaaat

SEQ ID NO: 5162287 - DNA, 15 bp, Homo sapiens
actgtgctggagcca

SEQ ID NO: 5162288 - DNA, 22 bp, Homo sapiens
actgtgctggagccactaacta

SEQ ID NO: 5162289 - DNA, 14 bp, Homo sapiens
actgtgctgtactg

SEQ ID NO: 5162290 - DNA, 18 bp, Homo sapiens
actgtgctgtactgagca

SEQ ID NO: 5162291 - DNA, 13 bp, Homo sapiens
actgtgctgtcct

SEQ ID NO: 5162292 - DNA, 14 bp, Homo sapiens
actgtgctgttgtt

SEQ ID NO: 5162293 - DNA, 17 bp, Homo sapiens
actgtgctgttgttctc

SEQ ID NO: 5162294 - DNA, 14 bp, Homo sapiens
actgtgcttacagt

SEQ ID NO: 5162295 - DNA, 14 bp, Homo sapiens
actgtgcttgctcc

SEQ ID NO: 5162296 - DNA, 14 bp, Homo sapiens
actgtgcttggcca

SEQ ID NO: 5162297 - DNA, 18 bp, Homo sapiens
actctccccagtgcctgc

SEQ ID NO: 5162298 - DNA, 19 bp, Homo sapiens
actctccccagtgcctgcc

SEQ ID NO: 5162299 - DNA, 21 bp, Homo sapiens
actctccccagtgcctgccac

SEQ ID NO: 5162300 - DNA, 14 bp, Homo sapiens
actctcccccaccc

SEQ ID NO: 5162301 - DNA, 20 bp, Homo sapiens
actctcccccaccccctccc

SEQ ID NO: 5162302 - DNA, 19 bp, Homo sapiens
actctccccgctcaggggc

SEQ ID NO: 5162303 - DNA, 22 bp, Homo sapiens
actctccccgctcaggggcctg

SEQ ID NO: 5162304 - DNA, 13 bp, Homo sapiens
actctcccctccc

SEQ ID NO: 5162305 - DNA, 14 bp, Homo sapiens
actctcccctctta

SEQ ID NO: 5162306 - DNA, 22 bp, Homo sapiens
actctccgcggtggttgttggg

SEQ ID NO: 5162307 - DNA, 23 bp, Homo sapiens
actctcctagagacagaagcagg

SEQ ID NO: 5162308 - DNA, 20 bp, Homo sapiens
actctcctaggcattctgga

SEQ ID NO: 5162309 - DNA, 23 bp, Homo sapiens
actctcctaggcattctggacct

SEQ ID NO: 5162310 - DNA, 14 bp, Homo sapiens
actctcctctgctg

SEQ ID NO: 5162311 - DNA, 19 bp, Homo sapiens
actctcctctgctgctggc

SEQ ID NO: 5162312 - DNA, 13 bp, Homo sapiens
actctcctgcccc

SEQ ID NO: 5162313 - DNA, 12 bp, Homo sapiens
actctcctgcct

SEQ ID NO: 5162314 - DNA, 14 bp, Homo sapiens
actctcctgcctca

SEQ ID NO: 5162315 - DNA, 17 bp, Homo sapiens
actctcctgcctcagcc

SEQ ID NO: 5162316 - DNA, 14 bp, Homo sapiens
actctcctgccttg

SEQ ID NO: 5162317 - DNA, 23 bp, Homo sapiens
actctcctgccttgaaaaagaca

SEQ ID NO: 5162318 - DNA, 18 bp, Homo sapiens
actctcctgctcctcagg

SEQ ID NO: 5162319 - DNA, 20 bp, Homo sapiens
actctcctgctcctcaggaa

SEQ ID NO: 5162320 - DNA, 12 bp, Homo sapiens
actctcctgggc

SEQ ID NO: 5162321 - DNA, 14 bp, Homo sapiens
actctcctgggccc

SEQ ID NO: 5162322 - DNA, 18 bp, Homo sapiens
actctcctgggcccctcc

SEQ ID NO: 5162323 - DNA, 23 bp, Homo sapiens
actctccttcgtgtctctcccac

SEQ ID NO: 5162324 - DNA, 17 bp, Homo sapiens
actctccttgctaccca

SEQ ID NO: 5162325 - DNA, 15 bp, Homo sapiens
actctccttggtgtc

SEQ ID NO: 5162326 - DNA, 16 bp, Homo sapiens
actctccttggtgtcg

SEQ ID NO: 5162327 - DNA, 23 bp, Homo sapiens
actctccttggtgtcgggcatga

SEQ ID NO: 5162328 - DNA, 13 bp, Homo sapiens
actctcggggccc

SEQ ID NO: 5162329 - DNA, 19 bp, Homo sapiens
actctcggggcccttgggg

SEQ ID NO: 5162330 - DNA, 17 bp, Homo sapiens
actctcgtggtatgtat

SEQ ID NO: 5162331 - DNA, 18 bp, Homo sapiens
actctctaaatcttcctt

SEQ ID NO: 5162332 - DNA, 23 bp, Homo sapiens
actctctaaatcttccttgtgag

SEQ ID NO: 5162333 - DNA, 14 bp, Homo sapiens
actctctaccagat

SEQ ID NO: 5162334 - DNA, 18 bp, Homo sapiens
actctctagtgcaggaaa

SEQ ID NO: 5162335 - DNA, 21 bp, Homo sapiens
actctctagttttatcttaaa

SEQ ID NO: 5162336 - DNA, 23 bp, Homo sapiens
actctctataagtgttcagtgtt

SEQ ID NO: 5162337 - DNA, 16 bp, Homo sapiens
actctctcacccacca

SEQ ID NO: 5162338 - DNA, 19 bp, Homo sapiens
actctctcacccaccagct

SEQ ID NO: 5162339 - DNA, 21 bp, Homo sapiens
actctctccaccctatatgta

SEQ ID NO: 5162340 - DNA, 12 bp, Homo sapiens
actctctccagg

SEQ ID NO: 5162341 - DNA, 12 bp, Homo sapiens
actctctcccag

SEQ ID NO: 5162342 - DNA, 15 bp, Homo sapiens
actctctcccaggac

SEQ ID NO: 5162343 - DNA, 16 bp, Homo sapiens
actctctccctggtct

SEQ ID NO: 5162344 - DNA, 17 bp, Homo sapiens
actctctccgatttgct

SEQ ID NO: 5162345 - DNA, 15 bp, Homo sapiens
actctctcctctctc

SEQ ID NO: 5162346 - DNA, 19 bp, Homo sapiens
actctctcctctctctccc

SEQ ID NO: 5162347 - DNA, 16 bp, Homo sapiens
actctctctctgttaa

SEQ ID NO: 5162348 - DNA, 21 bp, Homo sapiens
actctctctcttttccctcct

SEQ ID NO: 5162349 - DNA, 17 bp, Homo sapiens
actctctctgcccccaa

SEQ ID NO: 5162350 - DNA, 16 bp, Homo sapiens
actctctgacaaagtg

SEQ ID NO: 5162351 - DNA, 18 bp, Homo sapiens
actctctgaccctctgga

SEQ ID NO: 5162352 - DNA, 12 bp, Homo sapiens
actctctgagct

SEQ ID NO: 5162353 - DNA, 13 bp, Homo sapiens
actctctgagctg

SEQ ID NO: 5162354 - DNA, 19 bp, Homo sapiens
actctctgagtacattgtg

SEQ ID NO: 5162355 - DNA, 13 bp, Homo sapiens
actctctgcagcc

SEQ ID NO: 5162356 - DNA, 14 bp, Homo sapiens
actctctgcagccc

SEQ ID NO: 5162357 - DNA, 16 bp, Homo sapiens
actctctgcagcccag

SEQ ID NO: 5162358 - DNA, 16 bp, Homo sapiens
actctctgcagtcctc

SEQ ID NO: 5162359 - DNA, 14 bp, Homo sapiens
actctctgccagct

SEQ ID NO: 5162360 - DNA, 15 bp, Homo sapiens
actctctgccagctc

SEQ ID NO: 5162361 - DNA, 17 bp, Homo sapiens
actctctgccagctcca

SEQ ID NO: 5162362 - DNA, 12 bp, Homo sapiens
actctctgccca

SEQ ID NO: 5162363 - DNA, 15 bp, Homo sapiens
actctctgcctgctt

SEQ ID NO: 5162364 - DNA, 13 bp, Homo sapiens
actctctgcctgg

SEQ ID NO: 5162365 - DNA, 16 bp, Homo sapiens
actctctgcctggtgg

SEQ ID NO: 5162366 - DNA, 12 bp, Homo sapiens
actctctgctct

SEQ ID NO: 5162367 - DNA, 14 bp, Homo sapiens
actctctgctctag

SEQ ID NO: 5162368 - DNA, 17 bp, Homo sapiens
actctctgctctagcca

SEQ ID NO: 5162369 - DNA, 23 bp, Homo sapiens
actctctgctctagccaggagtc

SEQ ID NO: 5162370 - DNA, 13 bp, Homo sapiens
actctctgggact

SEQ ID NO: 5162371 - DNA, 14 bp, Homo sapiens
actctctgtcttct

SEQ ID NO: 5162372 - DNA, 19 bp, Homo sapiens
actctctgtcttctctcca

SEQ ID NO: 5162373 - DNA, 20 bp, Homo sapiens
actctctgtcttctctccac

SEQ ID NO: 5162374 - DNA, 15 bp, Homo sapiens
actctctgttcagaa

SEQ ID NO: 5162375 - DNA, 11 bp, Homo sapiens
actctcttccc

SEQ ID NO: 5162376 - DNA, 14 bp, Homo sapiens
actctcttcccttt

SEQ ID NO: 5162377 - DNA, 20 bp, Homo sapiens
actctcttccctttccccag

SEQ ID NO: 5162378 - DNA, 13 bp, Homo sapiens
actctcttcctcc

SEQ ID NO: 5162379 - DNA, 19 bp, Homo sapiens
actctcttcctccacttca

SEQ ID NO: 5162380 - DNA, 14 bp, Homo sapiens
actctcttcctttc

SEQ ID NO: 5162381 - DNA, 19 bp, Homo sapiens
actctcttctctttctctc

SEQ ID NO: 5162382 - DNA, 14 bp, Homo sapiens
actctcttcttact

SEQ ID NO: 5162383 - DNA, 13 bp, Homo sapiens
actctcttcttct

SEQ ID NO: 5162384 - DNA, 12 bp, Homo sapiens
actctctttcct

SEQ ID NO: 5162385 - DNA, 17 bp, Homo sapiens
actctctttccttgagc

SEQ ID NO: 5162386 - DNA, 19 bp, Homo sapiens
actctcttttgaggtccct

SEQ ID NO: 5162387 - DNA, 13 bp, Homo sapiens
actctgaaaaaca

SEQ ID NO: 5162388 - DNA, 13 bp, Homo sapiens
actctgaaagagc

SEQ ID NO: 5162389 - DNA, 16 bp, Homo sapiens
actctgaaagagcaaa

SEQ ID NO: 5162390 - DNA, 14 bp, Homo sapiens
actctgaaatcagc

SEQ ID NO: 5162391 - DNA, 14 bp, Homo sapiens
actctgaaatctga

SEQ ID NO: 5162392 - DNA, 17 bp, Homo sapiens
actctgaaatctgaaga

SEQ ID NO: 5162393 - DNA, 16 bp, Homo sapiens
actctgaactttggag

SEQ ID NO: 5162394 - DNA, 15 bp, Homo sapiens
actctgaagcctctg

SEQ ID NO: 5162395 - DNA, 18 bp, Homo sapiens
actctgaagtcccttcct

SEQ ID NO: 5162396 - DNA, 22 bp, Homo sapiens
actctgaagtcccttcctgtcc

SEQ ID NO: 5162397 - DNA, 22 bp, Homo sapiens
actctgaataagcactttttaa

SEQ ID NO: 5162398 - DNA, 22 bp, Homo sapiens
actctgaatcaaaagctgaaat

SEQ ID NO: 5162399 - DNA, 18 bp, Homo sapiens
actctgaatttatctttg

SEQ ID NO: 5162400 - DNA, 20 bp, Homo sapiens
actctgacaacagacttctg

SEQ ID NO: 5162401 - DNA, 22 bp, Homo sapiens
actctgacaacagacttctgaa

SEQ ID NO: 5162402 - DNA, 23 bp, Homo sapiens
actctgacaacagacttctgaaa

SEQ ID NO: 5162403 - DNA, 19 bp, Homo sapiens
actctgacaagctggccaa

SEQ ID NO: 5162404 - DNA, 14 bp, Homo sapiens
actctgacaagggc

SEQ ID NO: 5162405 - DNA, 19 bp, Homo sapiens
actctgacaagggctgacc

SEQ ID NO: 5162406 - DNA, 21 bp, Homo sapiens
actctgacaagggctgacctg

SEQ ID NO: 5162407 - DNA, 18 bp, Homo sapiens
actctgaccacttaaaaa

SEQ ID NO: 5162408 - DNA, 14 bp, Homo sapiens
actctgaccgggct

SEQ ID NO: 5162409 - DNA, 22 bp, Homo sapiens
actctgagactcgcgacaatgc

SEQ ID NO: 5162410 - DNA, 14 bp, Homo sapiens
actctgagagctgt

SEQ ID NO: 5162411 - DNA, 11 bp, Homo sapiens
actctgagcca

SEQ ID NO: 5162412 - DNA, 17 bp, Homo sapiens
actctgagcccaggccg

SEQ ID NO: 5162413 - DNA, 13 bp, Homo sapiens
actctgagcccat

SEQ ID NO: 5162414 - DNA, 22 bp, Homo sapiens
actctgagcgggaggcagagtt

SEQ ID NO: 5162415 - DNA, 12 bp, Homo sapiens
actctgagctca

SEQ ID NO: 5162416 - DNA, 13 bp, Homo sapiens
actctgaggaagt

SEQ ID NO: 5162417 - DNA, 21 bp, Homo sapiens
actctgaggctctttctgggc

SEQ ID NO: 5162418 - DNA, 17 bp, Homo sapiens
actctgagtcctcattg

SEQ ID NO: 5162419 - DNA, 21 bp, Homo sapiens
actctgagtttaccatttgta

SEQ ID NO: 5162420 - DNA, 21 bp, Homo sapiens
actctgatggaatgtgccacc

SEQ ID NO: 5162421 - DNA, 12 bp, Homo sapiens
actctgatgtaa

SEQ ID NO: 5162422 - DNA, 14 bp, Homo sapiens
actctgatgtaaat

SEQ ID NO: 5162423 - DNA, 17 bp, Homo sapiens
actctgatgtaaatgaa

SEQ ID NO: 5162424 - DNA, 20 bp, Homo sapiens
actctgattcacctcttcct

SEQ ID NO: 5162425 - DNA, 15 bp, Homo sapiens
actctgattttgata

SEQ ID NO: 5162426 - DNA, 19 bp, Homo sapiens
actctgcacatgtcttgta

SEQ ID NO: 5162427 - DNA, 22 bp, Homo sapiens
actctgcacatgtcttgtacat

SEQ ID NO: 5162428 - DNA, 14 bp, Homo sapiens
actctgcactactc

SEQ ID NO: 5162429 - DNA, 21 bp, Homo sapiens
actctgcactatagccatttg

SEQ ID NO: 5162430 - DNA, 20 bp, Homo sapiens
actctgcactccatggccac

SEQ ID NO: 5162431 - DNA, 23 bp, Homo sapiens
actctgcactccatggccacccc

SEQ ID NO: 5162432 - DNA, 13 bp, Homo sapiens
actctgcagccct

SEQ ID NO: 5162433 - DNA, 16 bp, Homo sapiens
actctgcagcctcaga

SEQ ID NO: 5162434 - DNA, 17 bp, Homo sapiens
actctgcagcctcagag

SEQ ID NO: 5162435 - DNA, 14 bp, Homo sapiens
actctgcaggaaat

SEQ ID NO: 5162436 - DNA, 17 bp, Homo sapiens
actctgcatagacaaag

SEQ ID NO: 5162437 - DNA, 18 bp, Homo sapiens
actctgcatcccagcacc

SEQ ID NO: 5162438 - DNA, 21 bp, Homo sapiens
actctgcatcccagcacctgc

SEQ ID NO: 5162439 - DNA, 14 bp, Homo sapiens
actctgcatgtaga

SEQ ID NO: 5162440 - DNA, 16 bp, Homo sapiens
actctgcattctagta

SEQ ID NO: 5162441 - DNA, 11 bp, Homo sapiens
actctgccaat

SEQ ID NO: 5162442 - DNA, 16 bp, Homo sapiens
actctgccagccctgc

SEQ ID NO: 5162443 - DNA, 18 bp, Homo sapiens
actctgccagggcagtgc

SEQ ID NO: 5162444 - DNA, 15 bp, Homo sapiens
actctgcccaccctc

SEQ ID NO: 5162445 - DNA, 16 bp, Homo sapiens
actctgcccaccctcc

SEQ ID NO: 5162446 - DNA, 19 bp, Homo sapiens
actctgcccagccggaggg

SEQ ID NO: 5162447 - DNA, 21 bp, Homo sapiens
actctgcccagccggagggac

SEQ ID NO: 5162448 - DNA, 24 bp, Homo sapiens
actctgccccacgctgtggccctg

SEQ ID NO: 5162449 - DNA, 19 bp, Homo sapiens
actctgcccctggacctgg

SEQ ID NO: 5162450 - DNA, 22 bp, Homo sapiens
actctgcccctggacctgggaa

SEQ ID NO: 5162451 - DNA, 16 bp, Homo sapiens
actctgccctctgctg

SEQ ID NO: 5162452 - DNA, 22 bp, Homo sapiens
actctgccctctgctgctgccc

SEQ ID NO: 5162453 - DNA, 14 bp, Homo sapiens
actctgcctaacca

SEQ ID NO: 5162454 - DNA, 21 bp, Homo sapiens
actctgcctaaccatgggctc

SEQ ID NO: 5162455 - DNA, 14 bp, Homo sapiens
actctgcctctgcc

SEQ ID NO: 5162456 - DNA, 17 bp, Homo sapiens
actctgcctgaacactg

SEQ ID NO: 5162457 - DNA, 14 bp, Homo sapiens
actctgccttccag

SEQ ID NO: 5162458 - DNA, 22 bp, Homo sapiens
actctgcgacgatccccatgga

SEQ ID NO: 5162459 - DNA, 19 bp, Homo sapiens
actctgcggatagcatttg

SEQ ID NO: 5162460 - DNA, 18 bp, Homo sapiens
actctgcggcccgggccg

SEQ ID NO: 5162461 - DNA, 18 bp, Homo sapiens
actctgcgggaggctggg

SEQ ID NO: 5162462 - DNA, 22 bp, Homo sapiens
actctgcgggaggctggggccc

SEQ ID NO: 5162463 - DNA, 21 bp, Homo sapiens
actctgcggtggtgccagagg

SEQ ID NO: 5162464 - DNA, 22 bp, Homo sapiens
actctgcggtggtgccagaggt

SEQ ID NO: 5162465 - DNA, 19 bp, Homo sapiens
actctgctaccttgcccca

SEQ ID NO: 5162466 - DNA, 15 bp, Homo sapiens
actctgctagactcc

SEQ ID NO: 5162467 - DNA, 22 bp, Homo sapiens
actctgctagactcctcaggag

SEQ ID NO: 5162468 - DNA, 19 bp, Homo sapiens
actctgctatttctcttgc

SEQ ID NO: 5162469 - DNA, 15 bp, Homo sapiens
actctgctcagggcc

SEQ ID NO: 5162470 - DNA, 17 bp, Homo sapiens
actctgctccaaagtag

SEQ ID NO: 5162471 - DNA, 15 bp, Homo sapiens
actctgctcccagcc

SEQ ID NO: 5162472 - DNA, 19 bp, Homo sapiens
actctgctctcctcgggcc

SEQ ID NO: 5162473 - DNA, 11 bp, Homo sapiens
actctgctctg

SEQ ID NO: 5162474 - DNA, 14 bp, Homo sapiens
actctgctctgatg

SEQ ID NO: 5162475 - DNA, 20 bp, Homo sapiens
actctgctctgcccttgttc

SEQ ID NO: 5162476 - DNA, 17 bp, Homo sapiens
actctgctgaatgtaaa

SEQ ID NO: 5162477 - DNA, 21 bp, Homo sapiens
actgtggaacactaaagagct

SEQ ID NO: 5162478 - DNA, 16 bp, Homo sapiens
actgtggaactgccac

SEQ ID NO: 5162479 - DNA, 17 bp, Homo sapiens
actgtggaagtccctca

SEQ ID NO: 5162480 - DNA, 16 bp, Homo sapiens
actgtggaatttattg

SEQ ID NO: 5162481 - DNA, 24 bp, Homo sapiens
actgtggacaaaagtttatctttg

SEQ ID NO: 5162482 - DNA, 22 bp, Homo sapiens
actgtggagactgctcctgagc

SEQ ID NO: 5162483 - DNA, 12 bp, Homo sapiens
actgtggagggg

SEQ ID NO: 5162484 - DNA, 18 bp, Homo sapiens
actgtggaggggagctgc

SEQ ID NO: 5162485 - DNA, 14 bp, Homo sapiens
actgtggaggtggc

SEQ ID NO: 5162486 - DNA, 23 bp, Homo sapiens
actgtggatacgggggttccctt

SEQ ID NO: 5162487 - DNA, 17 bp, Homo sapiens
actgtggcaaacaaaac

SEQ ID NO: 5162488 - DNA, 15 bp, Homo sapiens
actgtggcactgcca

SEQ ID NO: 5162489 - DNA, 17 bp, Homo sapiens
actgtggcactgccacc

SEQ ID NO: 5162490 - DNA, 20 bp, Homo sapiens
actgtggcactgccaccagc

SEQ ID NO: 5162491 - DNA, 13 bp, Homo sapiens
actgtggcagcag

SEQ ID NO: 5162492 - DNA, 15 bp, Homo sapiens
actgtggcagcagga

SEQ ID NO: 5162493 - DNA, 16 bp, Homo sapiens
actgtggcagcaggag

SEQ ID NO: 5162494 - DNA, 17 bp, Homo sapiens
actgtggccacagcccc

SEQ ID NO: 5162495 - DNA, 14 bp, Homo sapiens
actgtggccagagc

SEQ ID NO: 5162496 - DNA, 16 bp, Homo sapiens
actgtggccagagctg

SEQ ID NO: 5162497 - DNA, 21 bp, Homo sapiens
actgtggccagagctggaagg

SEQ ID NO: 5162498 - DNA, 13 bp, Homo sapiens
actgtggccaggc

SEQ ID NO: 5162499 - DNA, 15 bp, Homo sapiens
actgtggccaggcct

SEQ ID NO: 5162500 - DNA, 22 bp, Homo sapiens
actgtggccatatatgctgtat

SEQ ID NO: 5162501 - DNA, 21 bp, Homo sapiens
actgtggccatggtccccaag

SEQ ID NO: 5162502 - DNA, 20 bp, Homo sapiens
actgtggccgttatctggaa

SEQ ID NO: 5162503 - DNA, 14 bp, Homo sapiens
actgtggcctgcag

SEQ ID NO: 5162504 - DNA, 15 bp, Homo sapiens
actgtggcctgcagg

SEQ ID NO: 5162505 - DNA, 15 bp, Homo sapiens
actgtggccttggtc

SEQ ID NO: 5162506 - DNA, 18 bp, Homo sapiens
actgtggcgttctgctgc

SEQ ID NO: 5162507 - DNA, 14 bp, Homo sapiens
actgtggctgcaga

SEQ ID NO: 5162508 - DNA, 19 bp, Homo sapiens
actgtggctgctagcactt

SEQ ID NO: 5162509 - DNA, 20 bp, Homo sapiens
actgtgggaaggccagctgc

SEQ ID NO: 5162510 - DNA, 14 bp, Homo sapiens
actgtgggcaaagt

SEQ ID NO: 5162511 - DNA, 20 bp, Homo sapiens
actgtgggcaatttagaaaa

SEQ ID NO: 5162512 - DNA, 16 bp, Homo sapiens
actgtggggaaacaat

SEQ ID NO: 5162513 - DNA, 14 bp, Homo sapiens
actgtggggagaga

SEQ ID NO: 5162514 - DNA, 15 bp, Homo sapiens
actgtggggagagat

SEQ ID NO: 5162515 - DNA, 16 bp, Homo sapiens
actgtggggagagatg

SEQ ID NO: 5162516 - DNA, 17 bp, Homo sapiens
actgtggggagggtcat

SEQ ID NO: 5162517 - DNA, 22 bp, Homo sapiens
actgtggggcttacagaaatga

SEQ ID NO: 5162518 - DNA, 23 bp, Homo sapiens
actgtgggggcccctcaggtcag

SEQ ID NO: 5162519 - DNA, 17 bp, Homo sapiens
actgtggtagctccagc

SEQ ID NO: 5162520 - DNA, 18 bp, Homo sapiens
actgtggtaggggcaggg

SEQ ID NO: 5162521 - DNA, 12 bp, Homo sapiens
actgtggtcagg

SEQ ID NO: 5162522 - DNA, 18 bp, Homo sapiens
actgtggtcgtcaacttt

SEQ ID NO: 5162523 - DNA, 18 bp, Homo sapiens
actgtggtctggtgttcc

SEQ ID NO: 5162524 - DNA, 18 bp, Homo sapiens
actgtggtgacttctgct

SEQ ID NO: 5162525 - DNA, 14 bp, Homo sapiens
actgtggtgacttt

SEQ ID NO: 5162526 - DNA, 21 bp, Homo sapiens
actgtggtgactttggataat

SEQ ID NO: 5162527 - DNA, 22 bp, Homo sapiens
actgtggttaatccaatcaatt

SEQ ID NO: 5162528 - DNA, 16 bp, Homo sapiens
actgtgtaaaccacat

SEQ ID NO: 5162529 - DNA, 17 bp, Homo sapiens
actgtgtaaccagcagt

SEQ ID NO: 5162530 - DNA, 13 bp, Homo sapiens
actgtgtaactgc

SEQ ID NO: 5162531 - DNA, 14 bp, Homo sapiens
actgtgtaactgcc

SEQ ID NO: 5162532 - DNA, 17 bp, Homo sapiens
actgtgtaactgcccaa

SEQ ID NO: 5162533 - DNA, 19 bp, Homo sapiens
actgtgtaagggccagaaa

SEQ ID NO: 5162534 - DNA, 13 bp, Homo sapiens
actgtgtacacct

SEQ ID NO: 5162535 - DNA, 16 bp, Homo sapiens
actgtgtacataactg

SEQ ID NO: 5162536 - DNA, 16 bp, Homo sapiens
actgtgtactggagcc

SEQ ID NO: 5162537 - DNA, 20 bp, Homo sapiens
actgtgtactggagcctgca

SEQ ID NO: 5162538 - DNA, 14 bp, Homo sapiens
actgtgtataggaa

SEQ ID NO: 5162539 - DNA, 15 bp, Homo sapiens
actgtgtataggaat

SEQ ID NO: 5162540 - DNA, 16 bp, Homo sapiens
actgtgtataggaatt

SEQ ID NO: 5162541 - DNA, 17 bp, Homo sapiens
actgtgtataggaattt

SEQ ID NO: 5162542 - DNA, 15 bp, Homo sapiens
actgtgtatatttga

SEQ ID NO: 5162543 - DNA, 16 bp, Homo sapiens
actgtgtatatttgat

SEQ ID NO: 5162544 - DNA, 17 bp, Homo sapiens
actgtgtatatttgatt

SEQ ID NO: 5162545 - DNA, 18 bp, Homo sapiens
actgtgtatatttgattt

SEQ ID NO: 5162546 - DNA, 19 bp, Homo sapiens
actgtgtatcattaaaata

SEQ ID NO: 5162547 - DNA, 21 bp, Homo sapiens
actgtgtatctcaataaagca

SEQ ID NO: 5162548 - DNA, 16 bp, Homo sapiens
actgtgtatgtacata

SEQ ID NO: 5162549 - DNA, 18 bp, Homo sapiens
actgtgtatgtacatata

SEQ ID NO: 5162550 - DNA, 20 bp, Homo sapiens
actgtgtatgtacatatata

SEQ ID NO: 5162551 - DNA, 21 bp, Homo sapiens
actgtgtattccaagacatgt

SEQ ID NO: 5162552 - DNA, 18 bp, Homo sapiens
actgtgtcacatcacgaa

SEQ ID NO: 5162553 - DNA, 15 bp, Homo sapiens
actgtgtcccagtgt

SEQ ID NO: 5162554 - DNA, 18 bp, Homo sapiens
actgtgtccctctctctg

SEQ ID NO: 5162555 - DNA, 22 bp, Homo sapiens
actgtgtccctctctctggaaa

SEQ ID NO: 5162556 - DNA, 13 bp, Homo sapiens
actgtgtctcatg

SEQ ID NO: 5162557 - DNA, 20 bp, Homo sapiens
actgtgtctctgaattcctg

SEQ ID NO: 5162558 - DNA, 19 bp, Homo sapiens
actgtgtctctgtttcctg

SEQ ID NO: 5162559 - DNA, 22 bp, Homo sapiens
actgtgtctggcgttctcaaga

SEQ ID NO: 5162560 - DNA, 14 bp, Homo sapiens
actgtgtgaagaaa

SEQ ID NO: 5162561 - DNA, 14 bp, Homo sapiens
actgtgtgatcagg

SEQ ID NO: 5162562 - DNA, 19 bp, Homo sapiens
actgtgtgctcaggagccc

SEQ ID NO: 5162563 - DNA, 16 bp, Homo sapiens
actgtgtgctgactga

SEQ ID NO: 5162564 - DNA, 13 bp, Homo sapiens
actgtgtggaact

SEQ ID NO: 5162565 - DNA, 18 bp, Homo sapiens
actgtgtggactgtgatg

SEQ ID NO: 5162566 - DNA, 19 bp, Homo sapiens
actgtgtggactgtgatgc

SEQ ID NO: 5162567 - DNA, 20 bp, Homo sapiens
actgtgtgggggacggcttc

SEQ ID NO: 5162568 - DNA, 16 bp, Homo sapiens
actgtgtgtaattgtt

SEQ ID NO: 5162569 - DNA, 17 bp, Homo sapiens
actgtgtgtaattgttc

SEQ ID NO: 5162570 - DNA, 19 bp, Homo sapiens
actgtgtgtgccctctggg

SEQ ID NO: 5162571 - DNA, 22 bp, Homo sapiens
actgtgtgtgccctctgggctc

SEQ ID NO: 5162572 - DNA, 15 bp, Homo sapiens
actgtgtgtgtgaat

SEQ ID NO: 5162573 - DNA, 11 bp, Homo sapiens
actgtgttaaa

SEQ ID NO: 5162574 - DNA, 16 bp, Homo sapiens
actgtgttaaaatttt

SEQ ID NO: 5162575 - DNA, 12 bp, Homo sapiens
actgtgttactg

SEQ ID NO: 5162576 - DNA, 19 bp, Homo sapiens
actgtgttactgctttgca

SEQ ID NO: 5162577 - DNA, 16 bp, Homo sapiens
actgtgttcagtgcct

SEQ ID NO: 5162578 - DNA, 20 bp, Homo sapiens
actgtgttcagtgccttgga

SEQ ID NO: 5162579 - DNA, 15 bp, Homo sapiens
actgtgttcatgtgt

SEQ ID NO: 5162580 - DNA, 14 bp, Homo sapiens
actgtgttgccaca

SEQ ID NO: 5162581 - DNA, 17 bp, Homo sapiens
actgtgttgcccaggct

SEQ ID NO: 5162582 - DNA, 22 bp, Homo sapiens
actgtgttgcccaggctggtct

SEQ ID NO: 5162583 - DNA, 20 bp, Homo sapiens
actgtgttggccaggctggt

SEQ ID NO: 5162584 - DNA, 21 bp, Homo sapiens
actgtgttgtaccaaaattca

SEQ ID NO: 5162585 - DNA, 17 bp, Homo sapiens
actgtgttgtattaaca

SEQ ID NO: 5162586 - DNA, 21 bp, Homo sapiens
actgtgttgtattaacaaaag

SEQ ID NO: 5162587 - DNA, 19 bp, Homo sapiens
actgtgtttatatgtcttg

SEQ ID NO: 5162588 - DNA, 19 bp, Homo sapiens
actgtgtttcgcattaagc

SEQ ID NO: 5162589 - DNA, 22 bp, Homo sapiens
actgtgtttcgcattaagcaca

SEQ ID NO: 5162590 - DNA, 19 bp, Homo sapiens
actgtgtttctgtgctcca

SEQ ID NO: 5162591 - DNA, 20 bp, Homo sapiens
actgtgtttgatttgtctca

SEQ ID NO: 5162592 - DNA, 17 bp, Homo sapiens
actgtgttttataaaat

SEQ ID NO: 5162593 - DNA, 18 bp, Homo sapiens
actgtgttttataaaata

SEQ ID NO: 5162594 - DNA, 12 bp, Homo sapiens
actgttaaaact

SEQ ID NO: 5162595 - DNA, 19 bp, Homo sapiens
actgttaaaactgtacctt

SEQ ID NO: 5162596 - DNA, 20 bp, Homo sapiens
actgttaaaactgtaccttt

SEQ ID NO: 5162597 - DNA, 16 bp, Homo sapiens
actgttaaaataaagc

SEQ ID NO: 5162598 - DNA, 20 bp, Homo sapiens
actgttaaattgctgtgtat

SEQ ID NO: 5162599 - DNA, 23 bp, Homo sapiens
actgttaactatgacagatatat

SEQ ID NO: 5162600 - DNA, 23 bp, Homo sapiens
actgttaaggacccttttaagca

SEQ ID NO: 5162601 - DNA, 16 bp, Homo sapiens
actgttaatacacagt

SEQ ID NO: 5162602 - DNA, 22 bp, Homo sapiens
actgttaatacacagtacttta

SEQ ID NO: 5162603 - DNA, 16 bp, Homo sapiens
actgttaatagtacta

SEQ ID NO: 5162604 - DNA, 21 bp, Homo sapiens
actgttaatagttcaggtaac

SEQ ID NO: 5162605 - DNA, 21 bp, Homo sapiens
actgttacaacttgtatttcc

SEQ ID NO: 5162606 - DNA, 17 bp, Homo sapiens
actgttacaagaggcca

SEQ ID NO: 5162607 - DNA, 15 bp, Homo sapiens
actgttacagtaatg

SEQ ID NO: 5162608 - DNA, 16 bp, Homo sapiens
actgttacagtaatgt

SEQ ID NO: 5162609 - DNA, 17 bp, Homo sapiens
actgttaccattggaaa

SEQ ID NO: 5162610 - DNA, 18 bp, Homo sapiens
actgttaccattggaaat

SEQ ID NO: 5162611 - DNA, 22 bp, Homo sapiens
actgttaccattggaaatttca

SEQ ID NO: 5162612 - DNA, 21 bp, Homo sapiens
actgttacctgatcaatgaca

SEQ ID NO: 5162613 - DNA, 14 bp, Homo sapiens
actgttactccaca

SEQ ID NO: 5162614 - DNA, 13 bp, Homo sapiens
actgttactctaa

SEQ ID NO: 5162615 - DNA, 16 bp, Homo sapiens
actgttactgggccct

SEQ ID NO: 5162616 - DNA, 14 bp, Homo sapiens
actgttacttgata

SEQ ID NO: 5162617 - DNA, 21 bp, Homo sapiens
actgttactttttagtctttt

SEQ ID NO: 5162618 - DNA, 14 bp, Homo sapiens
actgttagaacact

SEQ ID NO: 5162619 - DNA, 18 bp, Homo sapiens
actgttagaacactattt

SEQ ID NO: 5162620 - DNA, 13 bp, Homo sapiens
actgttagaatgt

SEQ ID NO: 5162621 - DNA, 14 bp, Homo sapiens
actgttagaatgta

SEQ ID NO: 5162622 - DNA, 23 bp, Homo sapiens
actgttagatgctgaatatctgt

SEQ ID NO: 5162623 - DNA, 18 bp, Homo sapiens
actgttaggaacagcagt

SEQ ID NO: 5162624 - DNA, 13 bp, Homo sapiens
actgttataaatt

SEQ ID NO: 5162625 - DNA, 17 bp, Homo sapiens
actgttataaattttgt

SEQ ID NO: 5162626 - DNA, 14 bp, Homo sapiens
actgttatcatttt

SEQ ID NO: 5162627 - DNA, 15 bp, Homo sapiens
actgttatccatatt

SEQ ID NO: 5162628 - DNA, 18 bp, Homo sapiens
actgttatctcggacttt

SEQ ID NO: 5162629 - DNA, 15 bp, Homo sapiens
actgttatttataat

SEQ ID NO: 5162630 - DNA, 20 bp, Homo sapiens
actgttatttataatcactt

SEQ ID NO: 5162631 - DNA, 13 bp, Homo sapiens
actgttcaagagc

SEQ ID NO: 5162632 - DNA, 16 bp, Homo sapiens
actgttcaagagcaca

SEQ ID NO: 5162633 - DNA, 14 bp, Homo sapiens
actgttcacggcag

SEQ ID NO: 5162634 - DNA, 18 bp, Homo sapiens
actgttcacggcagacca

SEQ ID NO: 5162635 - DNA, 17 bp, Homo sapiens
actgttcagctgtcctc

SEQ ID NO: 5162636 - DNA, 22 bp, Homo sapiens
actgttcagctgtcctccctcc

SEQ ID NO: 5162637 - DNA, 22 bp, Homo sapiens
actgttcaggagtccaaacctt

SEQ ID NO: 5162638 - DNA, 16 bp, Homo sapiens
actgttcatacagttt

SEQ ID NO: 5162639 - DNA, 20 bp, Homo sapiens
actgttcccataacccctag

SEQ ID NO: 5162640 - DNA, 16 bp, Homo sapiens
actgttccctctgctc

SEQ ID NO: 5162641 - DNA, 18 bp, Homo sapiens
actgttccctctgctcct

SEQ ID NO: 5162642 - DNA, 15 bp, Homo sapiens
actgttccctctggc

SEQ ID NO: 5162643 - DNA, 16 bp, Homo sapiens
actgttccctgaggtg

SEQ ID NO: 5162644 - DNA, 23 bp, Homo sapiens
actgttcggaaggggttcctcaa

SEQ ID NO: 5162645 - DNA, 21 bp, Homo sapiens
actgttctaaagctctgacat

SEQ ID NO: 5162646 - DNA, 22 bp, Homo sapiens
actgttctcaccttaactcagc

SEQ ID NO: 5162647 - DNA, 21 bp, Homo sapiens
actgttctcatggagaagact

SEQ ID NO: 5162648 - DNA, 16 bp, Homo sapiens
actgttctctgccctc

SEQ ID NO: 5162649 - DNA, 20 bp, Homo sapiens
actgttctctgccctccaag

SEQ ID NO: 5162650 - DNA, 22 bp, Homo sapiens
actgttctctttaaaatatttg

SEQ ID NO: 5162651 - DNA, 23 bp, Homo sapiens
actgttctctttaaaatatttgt

SEQ ID NO: 5162652 - DNA, 15 bp, Homo sapiens
actgttctgaaagga

SEQ ID NO: 5162653 - DNA, 19 bp, Homo sapiens
actgttctgagccaaattc

SEQ ID NO: 5162654 - DNA, 14 bp, Homo sapiens
actgttctgcaaag

SEQ ID NO: 5162655 - DNA, 20 bp, Homo sapiens
actgttctgcaaaggtggca

SEQ ID NO: 5162656 - DNA, 16 bp, Homo sapiens
actgttctgtagattc

SEQ ID NO: 5162657 - DNA, 15 bp, Homo sapiens
actgttctgtgtctt

SEQ ID NO: 5162658 - DNA, 13 bp, Homo sapiens
actgttctgtgtg

SEQ ID NO: 5162659 - DNA, 20 bp, Homo sapiens
actgttctgtgtgggtctgg

SEQ ID NO: 5162660 - DNA, 18 bp, Homo sapiens
actgttcttcattttatt

SEQ ID NO: 5162661 - DNA, 19 bp, Homo sapiens
actgttcttcgcagctcat

SEQ ID NO: 5162662 - DNA, 10 bp, Homo sapiens
actgttcttg

SEQ ID NO: 5162663 - DNA, 14 bp, Homo sapiens
actgttcttgctgc

SEQ ID NO: 5162664 - DNA, 15 bp, Homo sapiens
actgttcttgctgct

SEQ ID NO: 5162665 - DNA, 20 bp, Homo sapiens
actgttcttgctgctagaac

SEQ ID NO: 5162666 - DNA, 23 bp, Homo sapiens
actgttcttgctgctagaacttt

SEQ ID NO: 5162667 - DNA, 12 bp, Homo sapiens
actgttctttgc

SEQ ID NO: 5162668 - DNA, 17 bp, Homo sapiens
actgttctttgcagtga

SEQ ID NO: 5162669 - DNA, 16 bp, Homo sapiens
actgttcttttgcatt

SEQ ID NO: 5162670 - DNA, 16 bp, Homo sapiens
actgttgaaaaagata

SEQ ID NO: 5162671 - DNA, 17 bp, Homo sapiens
actgttgataattctta

SEQ ID NO: 5162672 - DNA, 22 bp, Homo sapiens
actgttgataattcttattttg

SEQ ID NO: 5162673 - DNA, 23 bp, Homo sapiens
actgttgataattcttattttgt

SEQ ID NO: 5162674 - DNA, 17 bp, Homo sapiens
actgttgatacaaacca

SEQ ID NO: 5162675 - DNA, 21 bp, Homo sapiens
actgttgatacaaaccactgt

SEQ ID NO: 5162676 - DNA, 20 bp, Homo sapiens
actgttgatgaagtatactt

SEQ ID NO: 5162677 - DNA, 22 bp, Homo sapiens
actgttgatgaagtatactttt

SEQ ID NO: 5162678 - DNA, 15 bp, Homo sapiens
actgttgatgtatct

SEQ ID NO: 5162679 - DNA, 17 bp, Homo sapiens
actgttgatgtatctga

SEQ ID NO: 5162680 - DNA, 20 bp, Homo sapiens
actgttgatgtatctgagtt

SEQ ID NO: 5162681 - DNA, 11 bp, Homo sapiens
actgttgcacg

SEQ ID NO: 5162682 - DNA, 12 bp, Homo sapiens
actgttgcacgt

SEQ ID NO: 5162683 - DNA, 16 bp, Homo sapiens
actgttgcacttttga

SEQ ID NO: 5162684 - DNA, 20 bp, Homo sapiens
actgttgcacttttgaatgt

SEQ ID NO: 5162685 - DNA, 15 bp, Homo sapiens
actgttgcatttact

SEQ ID NO: 5162686 - DNA, 17 bp, Homo sapiens
actgttgcatttacttt

SEQ ID NO: 5162687 - DNA, 13 bp, Homo sapiens
actgttgccacca

SEQ ID NO: 5162688 - DNA, 14 bp, Homo sapiens
actgttgccagaga

SEQ ID NO: 5162689 - DNA, 12 bp, Homo sapiens
actgttgcccag

SEQ ID NO: 5162690 - DNA, 13 bp, Homo sapiens
actgttgcccagg

SEQ ID NO: 5162691 - DNA, 13 bp, Homo sapiens
actgttgcccccc

SEQ ID NO: 5162692 - DNA, 18 bp, Homo sapiens
actgttgcccttctgtcc

SEQ ID NO: 5162693 - DNA, 19 bp, Homo sapiens
actgttgcccttctgtcca

SEQ ID NO: 5162694 - DNA, 20 bp, Homo sapiens
actgttgcccttctgtccaa

SEQ ID NO: 5162695 - DNA, 18 bp, Homo sapiens
actgttgcccttttcctt

SEQ ID NO: 5162696 - DNA, 17 bp, Homo sapiens
actgttgcctaattgga

SEQ ID NO: 5162697 - DNA, 18 bp, Homo sapiens
actgttgcctaattggaa

SEQ ID NO: 5162698 - DNA, 14 bp, Homo sapiens
actgttgcctttta

SEQ ID NO: 5162699 - DNA, 12 bp, Homo sapiens
actgttgctcaa

SEQ ID NO: 5162700 - DNA, 21 bp, Homo sapiens
actgttgctcaaatctattca

SEQ ID NO: 5162701 - DNA, 20 bp, Homo sapiens
actgttgcttaattgtgaac

SEQ ID NO: 5162702 - DNA, 17 bp, Homo sapiens
actgttgctttaatatg

SEQ ID NO: 5162703 - DNA, 21 bp, Homo sapiens
actgttgctttaatatgagct

SEQ ID NO: 5162704 - DNA, 19 bp, Homo sapiens
actgttgctttgaaaaatc

SEQ ID NO: 5162705 - DNA, 15 bp, Homo sapiens
actgttggattcaga

SEQ ID NO: 5162706 - DNA, 14 bp, Homo sapiens
actgttggcactta

SEQ ID NO: 5162707 - DNA, 18 bp, Homo sapiens
actgttggggtgggtata

SEQ ID NO: 5162708 - DNA, 15 bp, Homo sapiens
actgttgtaagaatt

SEQ ID NO: 5162709 - DNA, 21 bp, Homo sapiens
actgttgtaagaattctgatt

SEQ ID NO: 5162710 - DNA, 21 bp, Homo sapiens
actgttgtagaaattcttaat

SEQ ID NO: 5162711 - DNA, 23 bp, Homo sapiens
actgttgtagaaattcttaattt

SEQ ID NO: 5162712 - DNA, 19 bp, Homo sapiens
actgttgtagaagacaaaa

SEQ ID NO: 5162713 - DNA, 12 bp, Homo sapiens
actgttgtataa

SEQ ID NO: 5162714 - DNA, 13 bp, Homo sapiens
actgttgtataaa

SEQ ID NO: 5162715 - DNA, 15 bp, Homo sapiens
actgttgtataaatt

SEQ ID NO: 5162716 - DNA, 19 bp, Homo sapiens
actgttgtataaatttatt

SEQ ID NO: 5162717 - DNA, 19 bp, Homo sapiens
actgttgtgatcttgcatt

SEQ ID NO: 5162718 - DNA, 21 bp, Homo sapiens
actgttgtgatcttgcattca

SEQ ID NO: 5162719 - DNA, 16 bp, Homo sapiens
actgttgttaagcaac

SEQ ID NO: 5162720 - DNA, 17 bp, Homo sapiens
actgttgttatctgttt

SEQ ID NO: 5162721 - DNA, 18 bp, Homo sapiens
actgttgtttgatgtgta

SEQ ID NO: 5162722 - DNA, 19 bp, Homo sapiens
actgtttaacaacatggct

SEQ ID NO: 5162723 - DNA, 18 bp, Homo sapiens
actgtttaatgttctgtg

SEQ ID NO: 5162724 - DNA, 14 bp, Homo sapiens
actgtttaattgaa

SEQ ID NO: 5162725 - DNA, 23 bp, Homo sapiens
actgtttaccaaggaaagaacaa

SEQ ID NO: 5162726 - DNA, 16 bp, Homo sapiens
actgtttactcacatt

SEQ ID NO: 5162727 - DNA, 19 bp, Homo sapiens
actgtttagatttgccata

SEQ ID NO: 5162728 - DNA, 13 bp, Homo sapiens
actgtttataaat

SEQ ID NO: 5162729 - DNA, 14 bp, Homo sapiens
actgtttatacact

SEQ ID NO: 5162730 - DNA, 19 bp, Homo sapiens
actgtttatggaaatacca

SEQ ID NO: 5162731 - DNA, 18 bp, Homo sapiens
actgtttatggtattttc

SEQ ID NO: 5162732 - DNA, 19 bp, Homo sapiens
actgtttatggtattttcg

SEQ ID NO: 5162733 - DNA, 20 bp, Homo sapiens
actgtttattacttccatga

SEQ ID NO: 5162734 - DNA, 24 bp, Homo sapiens
actgtttattacttccatgaattt

SEQ ID NO: 5162735 - DNA, 15 bp, Homo sapiens
actgtttatttaagg

SEQ ID NO: 5162736 - DNA, 19 bp, Homo sapiens
actgtttatttaaggatgg

SEQ ID NO: 5162737 - DNA, 20 bp, Homo sapiens
actgtttatttaaggatgga

SEQ ID NO: 5162738 - DNA, 15 bp, Homo sapiens
actgtttcaaacttt

SEQ ID NO: 5162739 - DNA, 19 bp, Homo sapiens
actgtttcaaactttacta

SEQ ID NO: 5162740 - DNA, 21 bp, Homo sapiens
actgtttcactaatacttact

SEQ ID NO: 5162741 - DNA, 15 bp, Homo sapiens
actgtttcactgaaa

SEQ ID NO: 5162742 - DNA, 13 bp, Homo sapiens
actgtttcagtgt

SEQ ID NO: 5162743 - DNA, 22 bp, Homo sapiens
actgtttcagtgtgagtcagaa

SEQ ID NO: 5162744 - DNA, 16 bp, Homo sapiens
actgtttcatctaagt

SEQ ID NO: 5162745 - DNA, 13 bp, Homo sapiens
actgtttcatctc

SEQ ID NO: 5162746 - DNA, 19 bp, Homo sapiens
actgtttcatctcagcttt

SEQ ID NO: 5162747 - DNA, 20 bp, Homo sapiens
actgtttcattcactgtgca

SEQ ID NO: 5162748 - DNA, 14 bp, Homo sapiens
actgtttccctgct

SEQ ID NO: 5162749 - DNA, 15 bp, Homo sapiens
actgtttccctgctg

SEQ ID NO: 5162750 - DNA, 17 bp, Homo sapiens
actgtttccctgctgaa

SEQ ID NO: 5162751 - DNA, 21 bp, Homo sapiens
actgtttcctattaatcttca

SEQ ID NO: 5162752 - DNA, 22 bp, Homo sapiens
actgtttctcaagtgttttgga

SEQ ID NO: 5162753 - DNA, 13 bp, Homo sapiens
actgtttctctgc

SEQ ID NO: 5162754 - DNA, 16 bp, Homo sapiens
actgtttctcttgagc

SEQ ID NO: 5162755 - DNA, 22 bp, Homo sapiens
actgtttctcttgagctggcct

SEQ ID NO: 5162756 - DNA, 14 bp, Homo sapiens
actgtttcttctca

SEQ ID NO: 5162757 - DNA, 17 bp, Homo sapiens
actgtttcttgcactga

SEQ ID NO: 5162758 - DNA, 13 bp, Homo sapiens
actgtttcttgct

SEQ ID NO: 5162759 - DNA, 21 bp, Homo sapiens
actgtttcttgcttgtacctc

SEQ ID NO: 5162760 - DNA, 17 bp, Homo sapiens
actgtttcttttgtaaa

SEQ ID NO: 5162761 - DNA, 23 bp, Homo sapiens
actgtttgaggtttttaagcctt

SEQ ID NO: 5162762 - DNA, 15 bp, Homo sapiens
actgtttgcacttac

SEQ ID NO: 5162763 - DNA, 23 bp, Homo sapiens
actgtttggaaattgattttgaa

SEQ ID NO: 5162764 - DNA, 20 bp, Homo sapiens
actgtttggctgacatgact

SEQ ID NO: 5162765 - DNA, 19 bp, Homo sapiens
actgtttggcttataaaca

SEQ ID NO: 5162766 - DNA, 21 bp, Homo sapiens
actgtttggcttataaacaca

SEQ ID NO: 5162767 - DNA, 22 bp, Homo sapiens
actgtttggtcgagtctttgtg

SEQ ID NO: 5162768 - DNA, 22 bp, Homo sapiens
actgtttgtaatatacagtttt

SEQ ID NO: 5162769 - DNA, 18 bp, Homo sapiens
actgtttgtcttctcccc

SEQ ID NO: 5162770 - DNA, 19 bp, Homo sapiens
actgtttgtcttctcccca

SEQ ID NO: 5162771 - DNA, 19 bp, Homo sapiens
actgtttgtttacaaaatc

SEQ ID NO: 5162772 - DNA, 23 bp, Homo sapiens
actgtttgtttttaaaaagcaaa

SEQ ID NO: 5162773 - DNA, 15 bp, Homo sapiens
actgttttaaagggt

SEQ ID NO: 5162774 - DNA, 15 bp, Homo sapiens
actgttttaattgta

SEQ ID NO: 5162775 - DNA, 16 bp, Homo sapiens
actgttttaattgtag

SEQ ID NO: 5162776 - DNA, 17 bp, Homo sapiens
actgttttaattgtagt

SEQ ID NO: 5162777 - DNA, 14 bp, Homo sapiens
actgttttagaaat

SEQ ID NO: 5162778 - DNA, 15 bp, Homo sapiens
actgttttagaaatt

SEQ ID NO: 5162779 - DNA, 18 bp, Homo sapiens
actgttttagaaattggt

SEQ ID NO: 5162780 - DNA, 13 bp, Homo sapiens
actgttttatctc

SEQ ID NO: 5162781 - DNA, 23 bp, Homo sapiens
actgttttatctccatactttgg

SEQ ID NO: 5162782 - DNA, 15 bp, Homo sapiens
actgttttatgttga

SEQ ID NO: 5162783 - DNA, 13 bp, Homo sapiens
actgttttcaata

SEQ ID NO: 5162784 - DNA, 18 bp, Homo sapiens
actgttttctagtgtatc

SEQ ID NO: 5162785 - DNA, 20 bp, Homo sapiens
actgttttctagtgtatcaa

SEQ ID NO: 5162786 - DNA, 24 bp, Homo sapiens
actgttttctagtgtatcaaaatg

SEQ ID NO: 5162787 - DNA, 14 bp, Homo sapiens
actgttttgggcct

SEQ ID NO: 5162788 - DNA, 22 bp, Homo sapiens
actgttttgggcctccatgccc

SEQ ID NO: 5162789 - DNA, 18 bp, Homo sapiens
actgttttgggtagctgc

SEQ ID NO: 5162790 - DNA, 19 bp, Homo sapiens
actgttttgggtagctgcc

SEQ ID NO: 5162791 - DNA, 21 bp, Homo sapiens
actgttttgtatatgctgcat

SEQ ID NO: 5162792 - DNA, 21 bp, Homo sapiens
actgttttgtgcttctcctaa

SEQ ID NO: 5162793 - DNA, 18 bp, Homo sapiens
actgtttttaagtaactt

SEQ ID NO: 5162794 - DNA, 13 bp, Homo sapiens
actgtttttaccc

SEQ ID NO: 5162795 - DNA, 16 bp, Homo sapiens
actgtttttacccata

SEQ ID NO: 5162796 - DNA, 12 bp, Homo sapiens
actgtttttcca

SEQ ID NO: 5162797 - DNA, 19 bp, Homo sapiens
actgtttttctctaatgct

SEQ ID NO: 5162798 - DNA, 19 bp, Homo sapiens
actgtttttgataaagtaa

SEQ ID NO: 5162799 - DNA, 18 bp, Homo sapiens
actgtttttgctattaca

SEQ ID NO: 5162800 - DNA, 15 bp, Homo sapiens
actgttttttaagtc

SEQ ID NO: 5162801 - DNA, 17 bp, Homo sapiens
actgttttttcctgagc

SEQ ID NO: 5162802 - DNA, 18 bp, Homo sapiens
actgttttttcctgagct

SEQ ID NO: 5162803 - DNA, 18 bp, Homo sapiens
actgttttttggcttgct

SEQ ID NO: 5162804 - DNA, 23 bp, Homo sapiens
actgttttttttttttttaattt

SEQ ID NO: 5162805 - DNA, 21 bp, Homo sapiens
acttaaaaaaaaaaaaaagct

SEQ ID NO: 5162806 - DNA, 22 bp, Homo sapiens
acttaaaaaaatgacagatgtt

SEQ ID NO: 5162807 - DNA, 15 bp, Homo sapiens
acttaaaaaactgca

SEQ ID NO: 5162808 - DNA, 16 bp, Homo sapiens
acttaaaaaatcagaa

SEQ ID NO: 5162809 - DNA, 21 bp, Homo sapiens
acttaaaaaatcagaacaaaa

SEQ ID NO: 5162810 - DNA, 17 bp, Homo sapiens
acttaaaaacaagagaa

SEQ ID NO: 5162811 - DNA, 14 bp, Homo sapiens
acttaaaaatgtaa

SEQ ID NO: 5162812 - DNA, 16 bp, Homo sapiens
acttaaaaatgtaaat

SEQ ID NO: 5162813 - DNA, 23 bp, Homo sapiens
acttaaaaatgtaaatattctat

SEQ ID NO: 5162814 - DNA, 17 bp, Homo sapiens
acttaaaaattaatagt

SEQ ID NO: 5162815 - DNA, 14 bp, Homo sapiens
acttaaaacacgtt

SEQ ID NO: 5162816 - DNA, 11 bp, Homo sapiens
acttaaaacat

SEQ ID NO: 5162817 - DNA, 15 bp, Homo sapiens
acttaaaacatggtg

SEQ ID NO: 5162818 - DNA, 23 bp, Homo sapiens
acttaaaagaaaacaaagcccca

SEQ ID NO: 5162819 - DNA, 13 bp, Homo sapiens
acttaaaagaaca

SEQ ID NO: 5162820 - DNA, 14 bp, Homo sapiens
acttaaaagagctc

SEQ ID NO: 5162821 - DNA, 17 bp, Homo sapiens
acttaaaagattcacta

SEQ ID NO: 5162822 - DNA, 17 bp, Homo sapiens
acttaaaagtattcata

SEQ ID NO: 5162823 - DNA, 18 bp, Homo sapiens
acttaaaagtattcatac

SEQ ID NO: 5162824 - DNA, 17 bp, Homo sapiens
acttaaaataattaaat

SEQ ID NO: 5162825 - DNA, 20 bp, Homo sapiens
acttaaaatattcctgcatt

SEQ ID NO: 5162826 - DNA, 13 bp, Homo sapiens
acttaaaatcaaa

SEQ ID NO: 5162827 - DNA, 20 bp, Homo sapiens
acttaaaatgacaaagccat

SEQ ID NO: 5162828 - DNA, 20 bp, Homo sapiens
acttaaacaaaaactttcca

SEQ ID NO: 5162829 - DNA, 23 bp, Homo sapiens
acttaaacaaaaactttccatga

SEQ ID NO: 5162830 - DNA, 15 bp, Homo sapiens
acttaaacagaagca

SEQ ID NO: 5162831 - DNA, 16 bp, Homo sapiens
acttaaacatttttgt

SEQ ID NO: 5162832 - DNA, 23 bp, Homo sapiens
acttaaaccacacacacaaggtg

SEQ ID NO: 5162833 - DNA, 21 bp, Homo sapiens
actctgctgaatgtaaaagaa

SEQ ID NO: 5162834 - DNA, 14 bp, Homo sapiens
actctgctgaggcc

SEQ ID NO: 5162835 - DNA, 20 bp, Homo sapiens
actctgctgaggccagagga

SEQ ID NO: 5162836 - DNA, 21 bp, Homo sapiens
actctgctgaggccagaggaa

SEQ ID NO: 5162837 - DNA, 15 bp, Homo sapiens
actctgctgagggtc

SEQ ID NO: 5162838 - DNA, 22 bp, Homo sapiens
actctgctgtctaacctgtgac

SEQ ID NO: 5162839 - DNA, 17 bp, Homo sapiens
actctgcttaaacaaag

SEQ ID NO: 5162840 - DNA, 12 bp, Homo sapiens
actctgcttctc

SEQ ID NO: 5162841 - DNA, 16 bp, Homo sapiens
actctgcttctctgac

SEQ ID NO: 5162842 - DNA, 15 bp, Homo sapiens
actctgcttgatttt

SEQ ID NO: 5162843 - DNA, 16 bp, Homo sapiens
actctgcttggctgtc

SEQ ID NO: 5162844 - DNA, 21 bp, Homo sapiens
actctggaagattttcattga

SEQ ID NO: 5162845 - DNA, 18 bp, Homo sapiens
actctggaagccccccac

SEQ ID NO: 5162846 - DNA, 22 bp, Homo sapiens
actctggaatgtttttccctcc

SEQ ID NO: 5162847 - DNA, 17 bp, Homo sapiens
actctggacccctgggc

SEQ ID NO: 5162848 - DNA, 13 bp, Homo sapiens
actctggactcca

SEQ ID NO: 5162849 - DNA, 18 bp, Homo sapiens
actctggactgggaaggg

SEQ ID NO: 5162850 - DNA, 14 bp, Homo sapiens
actctggactttct

SEQ ID NO: 5162851 - DNA, 23 bp, Homo sapiens
actctggactttctctaataata

SEQ ID NO: 5162852 - DNA, 11 bp, Homo sapiens
actctggagag

SEQ ID NO: 5162853 - DNA, 17 bp, Homo sapiens
actctggagagcctgca

SEQ ID NO: 5162854 - DNA, 23 bp, Homo sapiens
actctggagcaacctactgtcta

SEQ ID NO: 5162855 - DNA, 14 bp, Homo sapiens
actctggaggtcat

SEQ ID NO: 5162856 - DNA, 21 bp, Homo sapiens
actctggaggtttgtttagaa

SEQ ID NO: 5162857 - DNA, 17 bp, Homo sapiens
actctggatatttgcac

SEQ ID NO: 5162858 - DNA, 20 bp, Homo sapiens
actctggattcagccttctt

SEQ ID NO: 5162859 - DNA, 17 bp, Homo sapiens
actctggcaaagctttt

SEQ ID NO: 5162860 - DNA, 12 bp, Homo sapiens
actctggcacag

SEQ ID NO: 5162861 - DNA, 15 bp, Homo sapiens
actctggcagcaccg

SEQ ID NO: 5162862 - DNA, 14 bp, Homo sapiens
actctggcagccac

SEQ ID NO: 5162863 - DNA, 14 bp, Homo sapiens
actctggcagcctc

SEQ ID NO: 5162864 - DNA, 17 bp, Homo sapiens
actctggcagcctcaga

SEQ ID NO: 5162865 - DNA, 20 bp, Homo sapiens
actctggcagcctcagaggc

SEQ ID NO: 5162866 - DNA, 13 bp, Homo sapiens
actctggcagctc

SEQ ID NO: 5162867 - DNA, 15 bp, Homo sapiens
actctggccctggcc

SEQ ID NO: 5162868 - DNA, 17 bp, Homo sapiens
actctggccctggccct

SEQ ID NO: 5162869 - DNA, 11 bp, Homo sapiens
actctggcctc

SEQ ID NO: 5162870 - DNA, 12 bp, Homo sapiens
actctggcctct

SEQ ID NO: 5162871 - DNA, 20 bp, Homo sapiens
actctggcctctcgagttct

SEQ ID NO: 5162872 - DNA, 13 bp, Homo sapiens
actctggcctctg

SEQ ID NO: 5162873 - DNA, 16 bp, Homo sapiens
actctggcctctgtca

SEQ ID NO: 5162874 - DNA, 11 bp, Homo sapiens
actctggcctt

SEQ ID NO: 5162875 - DNA, 19 bp, Homo sapiens
actctggcggtggccacag

SEQ ID NO: 5162876 - DNA, 12 bp, Homo sapiens
actctggctggt

SEQ ID NO: 5162877 - DNA, 19 bp, Homo sapiens
actctggcttcaaaaagcc

SEQ ID NO: 5162878 - DNA, 17 bp, Homo sapiens
actctggcttttggaag

SEQ ID NO: 5162879 - DNA, 19 bp, Homo sapiens
actctgggaaataagagag

SEQ ID NO: 5162880 - DNA, 11 bp, Homo sapiens
actctgggaac

SEQ ID NO: 5162881 - DNA, 12 bp, Homo sapiens
actctgggaaga

SEQ ID NO: 5162882 - DNA, 22 bp, Homo sapiens
actctgggagtaatacttttta

SEQ ID NO: 5162883 - DNA, 23 bp, Homo sapiens
actctgggagtaatactttttaa

SEQ ID NO: 5162884 - DNA, 15 bp, Homo sapiens
actctgggcaaagcc

SEQ ID NO: 5162885 - DNA, 22 bp, Homo sapiens
actctgggcaaagcccctcaca

SEQ ID NO: 5162886 - DNA, 15 bp, Homo sapiens
actctgggcacaagc

SEQ ID NO: 5162887 - DNA, 20 bp, Homo sapiens
actctgggcacaagcagggc

SEQ ID NO: 5162888 - DNA, 22 bp, Homo sapiens
actctgggcacaagcagggcac

SEQ ID NO: 5162889 - DNA, 20 bp, Homo sapiens
actctgggcacttttgaact

SEQ ID NO: 5162890 - DNA, 23 bp, Homo sapiens
actctgggcagaagtgagccccc

SEQ ID NO: 5162891 - DNA, 20 bp, Homo sapiens
actctgggctatggacacag

SEQ ID NO: 5162892 - DNA, 17 bp, Homo sapiens
actctgggctgctaccc

SEQ ID NO: 5162893 - DNA, 23 bp, Homo sapiens
actctgggctgtaacgtggcact

SEQ ID NO: 5162894 - DNA, 21 bp, Homo sapiens
actctggggacccgctggggg

SEQ ID NO: 5162895 - DNA, 22 bp, Homo sapiens
actctggggctcaagcagttct

SEQ ID NO: 5162896 - DNA, 20 bp, Homo sapiens
actctggggctggcaccagc

SEQ ID NO: 5162897 - DNA, 22 bp, Homo sapiens
actctggggcttgtcctgtgct

SEQ ID NO: 5162898 - DNA, 18 bp, Homo sapiens
actctggggtgcagcttc

SEQ ID NO: 5162899 - DNA, 18 bp, Homo sapiens
actctggggtgggagggt

SEQ ID NO: 5162900 - DNA, 16 bp, Homo sapiens
actctgggtccttcct

SEQ ID NO: 5162901 - DNA, 21 bp, Homo sapiens
actctgggtggaagtgcccag

SEQ ID NO: 5162902 - DNA, 23 bp, Homo sapiens
actctggtacgaatctcatccct

SEQ ID NO: 5162903 - DNA, 20 bp, Homo sapiens
actctggtgagtcaccactt

SEQ ID NO: 5162904 - DNA, 11 bp, Homo sapiens
actctggtggc

SEQ ID NO: 5162905 - DNA, 19 bp, Homo sapiens
actctggtggcacaggagt

SEQ ID NO: 5162906 - DNA, 20 bp, Homo sapiens
actctggtggtgcttttgta

SEQ ID NO: 5162907 - DNA, 17 bp, Homo sapiens
actctggtgttctattg

SEQ ID NO: 5162908 - DNA, 15 bp, Homo sapiens
actctggttctttgt

SEQ ID NO: 5162909 - DNA, 15 bp, Homo sapiens
actctgtaaaaacac

SEQ ID NO: 5162910 - DNA, 15 bp, Homo sapiens
actctgtaaaagtgt

SEQ ID NO: 5162911 - DNA, 16 bp, Homo sapiens
actctgtaaaagtgtc

SEQ ID NO: 5162912 - DNA, 17 bp, Homo sapiens
actctgtaaaagtgtct

SEQ ID NO: 5162913 - DNA, 15 bp, Homo sapiens
actctgtaattgcaa

SEQ ID NO: 5162914 - DNA, 23 bp, Homo sapiens
actctgtaattgcactttttaag

SEQ ID NO: 5162915 - DNA, 20 bp, Homo sapiens
actctgtaatttgcttgttt

SEQ ID NO: 5162916 - DNA, 21 bp, Homo sapiens
actctgtataagttgaaggaa

SEQ ID NO: 5162917 - DNA, 18 bp, Homo sapiens
actctgtataatagagat

SEQ ID NO: 5162918 - DNA, 19 bp, Homo sapiens
actctgtatttaggccatt

SEQ ID NO: 5162919 - DNA, 13 bp, Homo sapiens
actctgtccaact

SEQ ID NO: 5162920 - DNA, 17 bp, Homo sapiens
actctgtccaggccact

SEQ ID NO: 5162921 - DNA, 19 bp, Homo sapiens
actctgtccaggccactgt

SEQ ID NO: 5162922 - DNA, 21 bp, Homo sapiens
actctgtccaggccactgtgg

SEQ ID NO: 5162923 - DNA, 22 bp, Homo sapiens
actctgtccctgtccttccctg

SEQ ID NO: 5162924 - DNA, 12 bp, Homo sapiens
actctgtcctga

SEQ ID NO: 5162925 - DNA, 13 bp, Homo sapiens
actctgtcctgaa

SEQ ID NO: 5162926 - DNA, 19 bp, Homo sapiens
actctgtcctgaaggcctg

SEQ ID NO: 5162927 - DNA, 22 bp, Homo sapiens
actctgtcctgaaggcctgagg

SEQ ID NO: 5162928 - DNA, 18 bp, Homo sapiens
actctgtcgctcaggctg

SEQ ID NO: 5162929 - DNA, 18 bp, Homo sapiens
actctgtctcaataatat

SEQ ID NO: 5162930 - DNA, 17 bp, Homo sapiens
actctgtctcagtccat

SEQ ID NO: 5162931 - DNA, 18 bp, Homo sapiens
actctgtctcagtccatg

SEQ ID NO: 5162932 - DNA, 18 bp, Homo sapiens
actctgtctcccaggctg

SEQ ID NO: 5162933 - DNA, 19 bp, Homo sapiens
actctgtctcccaggctgc

SEQ ID NO: 5162934 - DNA, 16 bp, Homo sapiens
actctgtctggccagg

SEQ ID NO: 5162935 - DNA, 17 bp, Homo sapiens
actctgtctggccaggg

SEQ ID NO: 5162936 - DNA, 16 bp, Homo sapiens
actctgtcttcacctg

SEQ ID NO: 5162937 - DNA, 18 bp, Homo sapiens
actctgtcttcacctgat

SEQ ID NO: 5162938 - DNA, 11 bp, Homo sapiens
actctgtgaaa

SEQ ID NO: 5162939 - DNA, 14 bp, Homo sapiens
actctgtgaaagaa

SEQ ID NO: 5162940 - DNA, 15 bp, Homo sapiens
actctgtgcaggtgc

SEQ ID NO: 5162941 - DNA, 14 bp, Homo sapiens
actctgtgccagag

SEQ ID NO: 5162942 - DNA, 15 bp, Homo sapiens
actctgtgccagagc

SEQ ID NO: 5162943 - DNA, 23 bp, Homo sapiens
actctgtgccagagcctggggct

SEQ ID NO: 5162944 - DNA, 13 bp, Homo sapiens
actctgtgcccat

SEQ ID NO: 5162945 - DNA, 18 bp, Homo sapiens
actctgtgcccatgggca

SEQ ID NO: 5162946 - DNA, 21 bp, Homo sapiens
actctgtgcccatgggcactg

SEQ ID NO: 5162947 - DNA, 24 bp, Homo sapiens
actctgtgcccatgggcactgctg

SEQ ID NO: 5162948 - DNA, 20 bp, Homo sapiens
actctgtgcctgaccttgag

SEQ ID NO: 5162949 - DNA, 13 bp, Homo sapiens
actctgtgctgag

SEQ ID NO: 5162950 - DNA, 16 bp, Homo sapiens
actctgtgctggccag

SEQ ID NO: 5162951 - DNA, 17 bp, Homo sapiens
actctgtggggccacac

SEQ ID NO: 5162952 - DNA, 16 bp, Homo sapiens
actctgtggggccttg

SEQ ID NO: 5162953 - DNA, 17 bp, Homo sapiens
actctgtggtccagagt

SEQ ID NO: 5162954 - DNA, 11 bp, Homo sapiens
actctgtgtga

SEQ ID NO: 5162955 - DNA, 14 bp, Homo sapiens
actctgtgtgagag

SEQ ID NO: 5162956 - DNA, 19 bp, Homo sapiens
actctgtgtgagagagagg

SEQ ID NO: 5162957 - DNA, 24 bp, Homo sapiens
actctgtgtgagcgtgtccacaga

SEQ ID NO: 5162958 - DNA, 22 bp, Homo sapiens
actctgtgtggctgtgcaattt

SEQ ID NO: 5162959 - DNA, 23 bp, Homo sapiens
actctgttattcttcaaacacaa

SEQ ID NO: 5162960 - DNA, 16 bp, Homo sapiens
actctgttatttagac

SEQ ID NO: 5162961 - DNA, 21 bp, Homo sapiens
actctgttcattcctccaggt

SEQ ID NO: 5162962 - DNA, 15 bp, Homo sapiens
actctgttcctggct

SEQ ID NO: 5162963 - DNA, 20 bp, Homo sapiens
actctgttccttcacatcct

SEQ ID NO: 5162964 - DNA, 16 bp, Homo sapiens
actctgttgaatattt

SEQ ID NO: 5162965 - DNA, 19 bp, Homo sapiens
actctgttgaatatttagc

SEQ ID NO: 5162966 - DNA, 22 bp, Homo sapiens
actctgttgaatatttagcata

SEQ ID NO: 5162967 - DNA, 18 bp, Homo sapiens
actctgttgaccaggctg

SEQ ID NO: 5162968 - DNA, 20 bp, Homo sapiens
actctgttgaccaggctgga

SEQ ID NO: 5162969 - DNA, 14 bp, Homo sapiens
actctgttgcctcc

SEQ ID NO: 5162970 - DNA, 19 bp, Homo sapiens
actctgttgcctcctctct

SEQ ID NO: 5162971 - DNA, 20 bp, Homo sapiens
actctgttgcctcctctctc

SEQ ID NO: 5162972 - DNA, 21 bp, Homo sapiens
actctgttgcctcctctctcc

SEQ ID NO: 5162973 - DNA, 22 bp, Homo sapiens
actctgttgctggtcttctcag

SEQ ID NO: 5162974 - DNA, 17 bp, Homo sapiens
actctgttgtaagtaat

SEQ ID NO: 5162975 - DNA, 21 bp, Homo sapiens
actctgtttgctcacccagga

SEQ ID NO: 5162976 - DNA, 13 bp, Homo sapiens
actctgtttttca

SEQ ID NO: 5162977 - DNA, 15 bp, Homo sapiens
actcttaaatcattt

SEQ ID NO: 5162978 - DNA, 19 bp, Homo sapiens
actcttaactgaagaaaga

SEQ ID NO: 5162979 - DNA, 23 bp, Homo sapiens
actcttaaggcattgagggctct

SEQ ID NO: 5162980 - DNA, 13 bp, Homo sapiens
actcttaatctgt

SEQ ID NO: 5162981 - DNA, 22 bp, Homo sapiens
actcttaatctgtgtgtatatt

SEQ ID NO: 5162982 - DNA, 16 bp, Homo sapiens
actcttaatgatgtta

SEQ ID NO: 5162983 - DNA, 19 bp, Homo sapiens
actcttagatggattctcc

SEQ ID NO: 5162984 - DNA, 21 bp, Homo sapiens
actcttagccctcaccacagc

SEQ ID NO: 5162985 - DNA, 19 bp, Homo sapiens
actcttaggatatttgagt

SEQ ID NO: 5162986 - DNA, 10 bp, Homo sapiens
actcttaggc

SEQ ID NO: 5162987 - DNA, 18 bp, Homo sapiens
actcttaggcacatcaat

SEQ ID NO: 5162988 - DNA, 19 bp, Homo sapiens
actcttaggcactttgggg

SEQ ID NO: 5162989 - DNA, 13 bp, Homo sapiens
actcttaggctaa

SEQ ID NO: 5162990 - DNA, 18 bp, Homo sapiens
actcttaggtatgtatga

SEQ ID NO: 5162991 - DNA, 18 bp, Homo sapiens
actcttatatttttctgg

SEQ ID NO: 5162992 - DNA, 15 bp, Homo sapiens
actcttatcattttt

SEQ ID NO: 5162993 - DNA, 16 bp, Homo sapiens
actcttattgcccacg

SEQ ID NO: 5162994 - DNA, 19 bp, Homo sapiens
actcttattgcccacgctg

SEQ ID NO: 5162995 - DNA, 20 bp, Homo sapiens
actcttatttatagaattta

SEQ ID NO: 5162996 - DNA, 17 bp, Homo sapiens
actcttatttctttcct

SEQ ID NO: 5162997 - DNA, 21 bp, Homo sapiens
actcttatttggtataaaggg

SEQ ID NO: 5162998 - DNA, 14 bp, Homo sapiens
actcttcaaggcca

SEQ ID NO: 5162999 - DNA, 21 bp, Homo sapiens
actcttcacttgagttggctg

SEQ ID NO: 5163000 - DNA, 23 bp, Homo sapiens
actcttcacttgagttggctgtg

SEQ ID NO: 5163001 - DNA, 15 bp, Homo sapiens
actcttcagagaaat

SEQ ID NO: 5163002 - DNA, 10 bp, Homo sapiens
actcttcagt

SEQ ID NO: 5163003 - DNA, 20 bp, Homo sapiens
actcttcagtgactcctgct

SEQ ID NO: 5163004 - DNA, 12 bp, Homo sapiens
actcttcagtgc

SEQ ID NO: 5163005 - DNA, 15 bp, Homo sapiens
actcttcagtgcaaa

SEQ ID NO: 5163006 - DNA, 20 bp, Homo sapiens
actcttcagtgcaaattgta

SEQ ID NO: 5163007 - DNA, 21 bp, Homo sapiens
actcttcagttaagcctttgg

SEQ ID NO: 5163008 - DNA, 13 bp, Homo sapiens
actcttcattttg

SEQ ID NO: 5163009 - DNA, 15 bp, Homo sapiens
actcttccaccagag

SEQ ID NO: 5163010 - DNA, 20 bp, Homo sapiens
actcttccaccagagcaggg

SEQ ID NO: 5163011 - DNA, 15 bp, Homo sapiens
acttaaacttcctta

SEQ ID NO: 5163012 - DNA, 23 bp, Homo sapiens
acttaaacttccttaaaaagtgg

SEQ ID NO: 5163013 - DNA, 18 bp, Homo sapiens
acttaaacttgcacattt

SEQ ID NO: 5163014 - DNA, 21 bp, Homo sapiens
acttaaacttgcacatttgaa

SEQ ID NO: 5163015 - DNA, 19 bp, Homo sapiens
acttaaacttgcatcactt

SEQ ID NO: 5163016 - DNA, 18 bp, Homo sapiens
acttaaactttgtcactt

SEQ ID NO: 5163017 - DNA, 22 bp, Homo sapiens
acttaaactttgtcacttctgc

SEQ ID NO: 5163018 - DNA, 23 bp, Homo sapiens
acttaaagaacagctaacaataa

SEQ ID NO: 5163019 - DNA, 13 bp, Homo sapiens
acttaaagactgt

SEQ ID NO: 5163020 - DNA, 13 bp, Homo sapiens
acttaaagattta

SEQ ID NO: 5163021 - DNA, 15 bp, Homo sapiens
acttaaagatttatc

SEQ ID NO: 5163022 - DNA, 17 bp, Homo sapiens
acttaaagcaaaatagt

SEQ ID NO: 5163023 - DNA, 22 bp, Homo sapiens
acttaaagctttcagaatatgt

SEQ ID NO: 5163024 - DNA, 19 bp, Homo sapiens
acttaaagggcccaatgaa

SEQ ID NO: 5163025 - DNA, 19 bp, Homo sapiens
acttaaagttttttatata

SEQ ID NO: 5163026 - DNA, 22 bp, Homo sapiens
acttaaagttttttatatatga

SEQ ID NO: 5163027 - DNA, 23 bp, Homo sapiens
acttaaagttttttatatatgaa

SEQ ID NO: 5163028 - DNA, 11 bp, Homo sapiens
acttaaataaa

SEQ ID NO: 5163029 - DNA, 14 bp, Homo sapiens
acttaaataatgtg

SEQ ID NO: 5163030 - DNA, 17 bp, Homo sapiens
acttaaataatgtgaaa

SEQ ID NO: 5163031 - DNA, 20 bp, Homo sapiens
acttaaataatgtgaaactg

SEQ ID NO: 5163032 - DNA, 20 bp, Homo sapiens
acttaaatagcatctgctct

SEQ ID NO: 5163033 - DNA, 16 bp, Homo sapiens
acttaaatattgtaat

SEQ ID NO: 5163034 - DNA, 14 bp, Homo sapiens
acttaaatatttgt

SEQ ID NO: 5163035 - DNA, 12 bp, Homo sapiens
acttaaatcact

SEQ ID NO: 5163036 - DNA, 14 bp, Homo sapiens
acttaaatgttacc

SEQ ID NO: 5163037 - DNA, 16 bp, Homo sapiens
acttaaattcttttga

SEQ ID NO: 5163038 - DNA, 20 bp, Homo sapiens
acttaaatttgaatctgagt

SEQ ID NO: 5163039 - DNA, 20 bp, Homo sapiens
acttaaatttggtttgttaa

SEQ ID NO: 5163040 - DNA, 15 bp, Homo sapiens
acttaaatttgttct

SEQ ID NO: 5163041 - DNA, 16 bp, Homo sapiens
acttaaatttgttctt

SEQ ID NO: 5163042 - DNA, 20 bp, Homo sapiens
acttaaatttgttctttgtt

SEQ ID NO: 5163043 - DNA, 18 bp, Homo sapiens
acttaaattttaaagcct

SEQ ID NO: 5163044 - DNA, 14 bp, Homo sapiens
acttaaattttaag

SEQ ID NO: 5163045 - DNA, 20 bp, Homo sapiens
acttaaattttaagcttgaa

SEQ ID NO: 5163046 - DNA, 11 bp, Homo sapiens
acttaacaaac

SEQ ID NO: 5163047 - DNA, 16 bp, Homo sapiens
acttaacaaatacatt

SEQ ID NO: 5163048 - DNA, 20 bp, Homo sapiens
acttaacaagctcccaggcc

SEQ ID NO: 5163049 - DNA, 21 bp, Homo sapiens
acttaacagatgcaatgtgct

SEQ ID NO: 5163050 - DNA, 15 bp, Homo sapiens
acttaacatgctgtg

SEQ ID NO: 5163051 - DNA, 16 bp, Homo sapiens
acttaacattgattta

SEQ ID NO: 5163052 - DNA, 20 bp, Homo sapiens
acttaacatttcattgtaca

SEQ ID NO: 5163053 - DNA, 19 bp, Homo sapiens
acttaacccagattttatt

SEQ ID NO: 5163054 - DNA, 17 bp, Homo sapiens
acttaaccgcatcagaa

SEQ ID NO: 5163055 - DNA, 13 bp, Homo sapiens
acttaacctgctt

SEQ ID NO: 5163056 - DNA, 23 bp, Homo sapiens
acttaacggacttacaaccttgt

SEQ ID NO: 5163057 - DNA, 20 bp, Homo sapiens
acttaacgttctataaatga

SEQ ID NO: 5163058 - DNA, 21 bp, Homo sapiens
acttaacgttctataaatgaa

SEQ ID NO: 5163059 - DNA, 22 bp, Homo sapiens
acttaacgttctataaatgaat

SEQ ID NO: 5163060 - DNA, 23 bp, Homo sapiens
acttaacgttctataaatgaatg

SEQ ID NO: 5163061 - DNA, 21 bp, Homo sapiens
acttaactctcaagctaagta

SEQ ID NO: 5163062 - DNA, 16 bp, Homo sapiens
acttaactggcccaga

SEQ ID NO: 5163063 - DNA, 18 bp, Homo sapiens
acttaactggcccagaag

SEQ ID NO: 5163064 - DNA, 21 bp, Homo sapiens
acttaactgtccgtaagcagt

SEQ ID NO: 5163065 - DNA, 22 bp, Homo sapiens
acttaactgtgtgaagaaatgg

SEQ ID NO: 5163066 - DNA, 16 bp, Homo sapiens
acttaacttaaaattg

SEQ ID NO: 5163067 - DNA, 15 bp, Homo sapiens
acttaactttaactt

SEQ ID NO: 5163068 - DNA, 17 bp, Homo sapiens
acttaactttactaagt

SEQ ID NO: 5163069 - DNA, 17 bp, Homo sapiens
acttaagaatacacagg

SEQ ID NO: 5163070 - DNA, 14 bp, Homo sapiens
acttaagacaaatg

SEQ ID NO: 5163071 - DNA, 13 bp, Homo sapiens
acttaagagaaat

SEQ ID NO: 5163072 - DNA, 15 bp, Homo sapiens
acttaagagaatatt

SEQ ID NO: 5163073 - DNA, 19 bp, Homo sapiens
acttaagagaatattttaa

SEQ ID NO: 5163074 - DNA, 15 bp, Homo sapiens
acttaagagtggcat

SEQ ID NO: 5163075 - DNA, 15 bp, Homo sapiens
acttaagattcagtt

SEQ ID NO: 5163076 - DNA, 15 bp, Homo sapiens
acttaagcaaaagaa

SEQ ID NO: 5163077 - DNA, 16 bp, Homo sapiens
acttaagcaaaagaaa

SEQ ID NO: 5163078 - DNA, 20 bp, Homo sapiens
acttaagcaaaagaaaaaga

SEQ ID NO: 5163079 - DNA, 15 bp, Homo sapiens
acttaagcacaagca

SEQ ID NO: 5163080 - DNA, 19 bp, Homo sapiens
acttaagcataaaaattga

SEQ ID NO: 5163081 - DNA, 20 bp, Homo sapiens
acttaagcatctggctctaa

SEQ ID NO: 5163082 - DNA, 21 bp, Homo sapiens
acttaagcatctggctctaat

SEQ ID NO: 5163083 - DNA, 14 bp, Homo sapiens
acttaaggaccttt

SEQ ID NO: 5163084 - DNA, 15 bp, Homo sapiens
acttaaggagaaata

SEQ ID NO: 5163085 - DNA, 17 bp, Homo sapiens
acttaagggttgcttgc

SEQ ID NO: 5163086 - DNA, 18 bp, Homo sapiens
acttaagggttttttaga

SEQ ID NO: 5163087 - DNA, 16 bp, Homo sapiens
acttaagtagaagtaa

SEQ ID NO: 5163088 - DNA, 17 bp, Homo sapiens
acttaagtctcgaatgt

SEQ ID NO: 5163089 - DNA, 15 bp, Homo sapiens
acttaagtgcacttt

SEQ ID NO: 5163090 - DNA, 17 bp, Homo sapiens
acttaagtgttcatttt

SEQ ID NO: 5163091 - DNA, 15 bp, Homo sapiens
acttaagttaaacat

SEQ ID NO: 5163092 - DNA, 21 bp, Homo sapiens
acttaagttctttgatttgta

SEQ ID NO: 5163093 - DNA, 13 bp, Homo sapiens
acttaagtttaga

SEQ ID NO: 5163094 - DNA, 17 bp, Homo sapiens
acttaataaattcagat

SEQ ID NO: 5163095 - DNA, 13 bp, Homo sapiens
acttaataatcaa

SEQ ID NO: 5163096 - DNA, 22 bp, Homo sapiens
acttaataatcaagagccttaa

SEQ ID NO: 5163097 - DNA, 21 bp, Homo sapiens
acttaataatttttacctaat

SEQ ID NO: 5163098 - DNA, 14 bp, Homo sapiens
acttaatactcatg

SEQ ID NO: 5163099 - DNA, 15 bp, Homo sapiens
acttaatagaaacat

SEQ ID NO: 5163100 - DNA, 15 bp, Homo sapiens
acttaatagcaacag

SEQ ID NO: 5163101 - DNA, 14 bp, Homo sapiens
acttaatatactca

SEQ ID NO: 5163102 - DNA, 23 bp, Homo sapiens
acttaatatcttcatttctaaat

SEQ ID NO: 5163103 - DNA, 20 bp, Homo sapiens
acttaatattagcttgctta

SEQ ID NO: 5163104 - DNA, 21 bp, Homo sapiens
acttaatattagcttgcttaa

SEQ ID NO: 5163105 - DNA, 15 bp, Homo sapiens
acttaatcattttat

SEQ ID NO: 5163106 - DNA, 22 bp, Homo sapiens
acttaatcggttgaccctactg

SEQ ID NO: 5163107 - DNA, 16 bp, Homo sapiens
acttaatctaaatgga

SEQ ID NO: 5163108 - DNA, 13 bp, Homo sapiens
acttaatctcaca

SEQ ID NO: 5163109 - DNA, 14 bp, Homo sapiens
acttaatcttctct

SEQ ID NO: 5163110 - DNA, 16 bp, Homo sapiens
acttaatcttctctct

SEQ ID NO: 5163111 - DNA, 23 bp, Homo sapiens
acttaatcttctctcttgattga

SEQ ID NO: 5163112 - DNA, 15 bp, Homo sapiens
acttaatgaaaacaa

SEQ ID NO: 5163113 - DNA, 16 bp, Homo sapiens
acttaatgagacttta

SEQ ID NO: 5163114 - DNA, 19 bp, Homo sapiens
acttaatgagactttaaaa

SEQ ID NO: 5163115 - DNA, 19 bp, Homo sapiens
acttaatgcagtgggcagt

SEQ ID NO: 5163116 - DNA, 12 bp, Homo sapiens
acttaatggaaa

SEQ ID NO: 5163117 - DNA, 12 bp, Homo sapiens
acttaatggcac

SEQ ID NO: 5163118 - DNA, 18 bp, Homo sapiens
acttaatgtaattcagga

SEQ ID NO: 5163119 - DNA, 19 bp, Homo sapiens
acttaattacatccagaaa

SEQ ID NO: 5163120 - DNA, 14 bp, Homo sapiens
acttaattctcatt

SEQ ID NO: 5163121 - DNA, 19 bp, Homo sapiens
acttaattctcattatgaa

SEQ ID NO: 5163122 - DNA, 22 bp, Homo sapiens
acttaattctcattatgaagat

SEQ ID NO: 5163123 - DNA, 13 bp, Homo sapiens
acttaattctgtt

SEQ ID NO: 5163124 - DNA, 14 bp, Homo sapiens
acttaattctgttc

SEQ ID NO: 5163125 - DNA, 20 bp, Homo sapiens
acttaattgaagctttttaa

SEQ ID NO: 5163126 - DNA, 12 bp, Homo sapiens
acttaatttcaa

SEQ ID NO: 5163127 - DNA, 13 bp, Homo sapiens
acttaatttgaaa

SEQ ID NO: 5163128 - DNA, 17 bp, Homo sapiens
acttaatttgaaatcta

SEQ ID NO: 5163129 - DNA, 16 bp, Homo sapiens
acttaatttgtaaact

SEQ ID NO: 5163130 - DNA, 17 bp, Homo sapiens
acttaatttgtaaactt

SEQ ID NO: 5163131 - DNA, 15 bp, Homo sapiens
acttaattttagaaa

SEQ ID NO: 5163132 - DNA, 17 bp, Homo sapiens
acttaattttagaaaga

SEQ ID NO: 5163133 - DNA, 16 bp, Homo sapiens
acttacaaaatgccaa

SEQ ID NO: 5163134 - DNA, 16 bp, Homo sapiens
acttacaagtaatgaa

SEQ ID NO: 5163135 - DNA, 18 bp, Homo sapiens
acttacacacctgagaat

SEQ ID NO: 5163136 - DNA, 17 bp, Homo sapiens
acttacactgtttcatc

SEQ ID NO: 5163137 - DNA, 23 bp, Homo sapiens
acttacactgtttcatctcagct

SEQ ID NO: 5163138 - DNA, 15 bp, Homo sapiens
acttacacttataaa

SEQ ID NO: 5163139 - DNA, 19 bp, Homo sapiens
acttacacttataaaataa

SEQ ID NO: 5163140 - DNA, 16 bp, Homo sapiens
acttacacttggagcc

SEQ ID NO: 5163141 - DNA, 16 bp, Homo sapiens
acttacactttatgca

SEQ ID NO: 5163142 - DNA, 22 bp, Homo sapiens
acttacagaaccaattcacttt

SEQ ID NO: 5163143 - DNA, 23 bp, Homo sapiens
acttacagataggccttcttgtg

SEQ ID NO: 5163144 - DNA, 13 bp, Homo sapiens
acttacaggctaa

SEQ ID NO: 5163145 - DNA, 15 bp, Homo sapiens
acttacataaagctc

SEQ ID NO: 5163146 - DNA, 18 bp, Homo sapiens
acttacatactaggtgcc

SEQ ID NO: 5163147 - DNA, 19 bp, Homo sapiens
acttacatatatttttaaa

SEQ ID NO: 5163148 - DNA, 20 bp, Homo sapiens
acttacatctttgtttacca

SEQ ID NO: 5163149 - DNA, 14 bp, Homo sapiens
acttacatgacttt

SEQ ID NO: 5163150 - DNA, 14 bp, Homo sapiens
acttacatgattca

SEQ ID NO: 5163151 - DNA, 23 bp, Homo sapiens
acttacatgttcccaaaacaatg

SEQ ID NO: 5163152 - DNA, 21 bp, Homo sapiens
acttacattctctaataagaa

SEQ ID NO: 5163153 - DNA, 19 bp, Homo sapiens
acttaccaattgatgtttt

SEQ ID NO: 5163154 - DNA, 16 bp, Homo sapiens
acttaccatatgtgct

SEQ ID NO: 5163155 - DNA, 14 bp, Homo sapiens
acttacccagatgt

SEQ ID NO: 5163156 - DNA, 19 bp, Homo sapiens
acttacctaaacagatata

SEQ ID NO: 5163157 - DNA, 12 bp, Homo sapiens
acttacctcaaa

SEQ ID NO: 5163158 - DNA, 14 bp, Homo sapiens
acttacctgcttga

SEQ ID NO: 5163159 - DNA, 16 bp, Homo sapiens
acttaccttcaataaa

SEQ ID NO: 5163160 - DNA, 19 bp, Homo sapiens
acttaccttcaataaagta

SEQ ID NO: 5163161 - DNA, 23 bp, Homo sapiens
acttacgccctgttcccttcctg

SEQ ID NO: 5163162 - DNA, 19 bp, Homo sapiens
acttacggatttattatat

SEQ ID NO: 5163163 - DNA, 23 bp, Homo sapiens
acttacggttttaaatgtgttgc

SEQ ID NO: 5163164 - DNA, 15 bp, Homo sapiens
acttacgtcactact

SEQ ID NO: 5163165 - DNA, 16 bp, Homo sapiens
acttactaataaaatg

SEQ ID NO: 5163166 - DNA, 19 bp, Homo sapiens
acttactaataaaatgtga

SEQ ID NO: 5163167 - DNA, 18 bp, Homo sapiens
acttactataatggttgg

SEQ ID NO: 5163168 - DNA, 14 bp, Homo sapiens
acttactatccatt

SEQ ID NO: 5163169 - DNA, 15 bp, Homo sapiens
acttactatccattt

SEQ ID NO: 5163170 - DNA, 14 bp, Homo sapiens
acttactatggtat

SEQ ID NO: 5163171 - DNA, 13 bp, Homo sapiens
acttactgcctga

SEQ ID NO: 5163172 - DNA, 15 bp, Homo sapiens
acttactgcctgacc

SEQ ID NO: 5163173 - DNA, 22 bp, Homo sapiens
acttactgggtaggtgattcta

SEQ ID NO: 5163174 - DNA, 20 bp, Homo sapiens
acttactgggtgaggaaatc

SEQ ID NO: 5163175 - DNA, 14 bp, Homo sapiens
acttactgtatatg

SEQ ID NO: 5163176 - DNA, 22 bp, Homo sapiens
acttactgtcagagaatatgac

SEQ ID NO: 5163177 - DNA, 14 bp, Homo sapiens
acttactgttaaaa

SEQ ID NO: 5163178 - DNA, 16 bp, Homo sapiens
acttactgttaactgt

SEQ ID NO: 5163179 - DNA, 18 bp, Homo sapiens
acttactgttaactgtct

SEQ ID NO: 5163180 - DNA, 13 bp, Homo sapiens
acttactgtttct

SEQ ID NO: 5163181 - DNA, 21 bp, Homo sapiens
acttactgtttctgtcaggag

SEQ ID NO: 5163182 - DNA, 14 bp, Homo sapiens
acttacttagagat

SEQ ID NO: 5163183 - DNA, 17 bp, Homo sapiens
acttacttgatgatttt

SEQ ID NO: 5163184 - DNA, 13 bp, Homo sapiens
acttacttgctta

SEQ ID NO: 5163185 - DNA, 14 bp, Homo sapiens
acttacttgcttat

SEQ ID NO: 5163186 - DNA, 16 bp, Homo sapiens
acttacttgcttattt

SEQ ID NO: 5163187 - DNA, 12 bp, Homo sapiens
acttactttaat

SEQ ID NO: 5163188 - DNA, 16 bp, Homo sapiens
acttactttaatgcga

SEQ ID NO: 5163189 - DNA, 20 bp, Homo sapiens
acttagaaaaccagctcagc

SEQ ID NO: 5163190 - DNA, 16 bp, Homo sapiens
acttagaaacaatgtt

SEQ ID NO: 5163191 - DNA, 23 bp, Homo sapiens
actcttccctgaacttcctgctt

SEQ ID NO: 5163192 - DNA, 14 bp, Homo sapiens
actcttccctggga

SEQ ID NO: 5163193 - DNA, 16 bp, Homo sapiens
actcttccctgggaac

SEQ ID NO: 5163194 - DNA, 22 bp, Homo sapiens
actcttccgaaaaatcctcttc

SEQ ID NO: 5163195 - DNA, 11 bp, Homo sapiens
actcttcctgc

SEQ ID NO: 5163196 - DNA, 16 bp, Homo sapiens
actcttcctgcaagga

SEQ ID NO: 5163197 - DNA, 13 bp, Homo sapiens
actcttcctgtcc

SEQ ID NO: 5163198 - DNA, 14 bp, Homo sapiens
actcttcctgtcct

SEQ ID NO: 5163199 - DNA, 20 bp, Homo sapiens
actcttcctttatcccctcc

SEQ ID NO: 5163200 - DNA, 16 bp, Homo sapiens
actcttctatgaccca

SEQ ID NO: 5163201 - DNA, 12 bp, Homo sapiens
actcttctcatt

SEQ ID NO: 5163202 - DNA, 17 bp, Homo sapiens
actcttctcattacttg

SEQ ID NO: 5163203 - DNA, 18 bp, Homo sapiens
actcttctccattccctc

SEQ ID NO: 5163204 - DNA, 16 bp, Homo sapiens
actcttctcggctcag

SEQ ID NO: 5163205 - DNA, 18 bp, Homo sapiens
actcttctcggctcaggc

SEQ ID NO: 5163206 - DNA, 13 bp, Homo sapiens
actcttctctctg

SEQ ID NO: 5163207 - DNA, 17 bp, Homo sapiens
actcttctctctgctct

SEQ ID NO: 5163208 - DNA, 17 bp, Homo sapiens
actcttctgactgcccc

SEQ ID NO: 5163209 - DNA, 22 bp, Homo sapiens
actcttctgactgccccctcct

SEQ ID NO: 5163210 - DNA, 20 bp, Homo sapiens
actcttctgtcttgtcccca

SEQ ID NO: 5163211 - DNA, 19 bp, Homo sapiens
actcttcttaacttaaatt

SEQ ID NO: 5163212 - DNA, 20 bp, Homo sapiens
actcttcttaacttaaattt

SEQ ID NO: 5163213 - DNA, 15 bp, Homo sapiens
actcttcttatcaca

SEQ ID NO: 5163214 - DNA, 13 bp, Homo sapiens
actcttgaaaaat

SEQ ID NO: 5163215 - DNA, 14 bp, Homo sapiens
actcttgaaaaatg

SEQ ID NO: 5163216 - DNA, 19 bp, Homo sapiens
actcttgaaaaatgcatgt

SEQ ID NO: 5163217 - DNA, 14 bp, Homo sapiens
actcttgaaatgta

SEQ ID NO: 5163218 - DNA, 13 bp, Homo sapiens
actcttgaagagg

SEQ ID NO: 5163219 - DNA, 21 bp, Homo sapiens
actcttgaagaggaggccgcc

SEQ ID NO: 5163220 - DNA, 23 bp, Homo sapiens
actcttgaaggccacatgtgaaa

SEQ ID NO: 5163221 - DNA, 15 bp, Homo sapiens
actcttgaagtccag

SEQ ID NO: 5163222 - DNA, 18 bp, Homo sapiens
actcttgaagtccaggac

SEQ ID NO: 5163223 - DNA, 21 bp, Homo sapiens
actcttgaagtccaggactgg

SEQ ID NO: 5163224 - DNA, 14 bp, Homo sapiens
actcttgacctcag

SEQ ID NO: 5163225 - DNA, 21 bp, Homo sapiens
actcttgagccctcctggaat

SEQ ID NO: 5163226 - DNA, 15 bp, Homo sapiens
actcttgagttgttt

SEQ ID NO: 5163227 - DNA, 22 bp, Homo sapiens
actcttgagttgtttttgtata

SEQ ID NO: 5163228 - DNA, 21 bp, Homo sapiens
actcttgatctctcttgtcct

SEQ ID NO: 5163229 - DNA, 13 bp, Homo sapiens
actcttgatgtga

SEQ ID NO: 5163230 - DNA, 22 bp, Homo sapiens
actcttgcacagtcactgctct

SEQ ID NO: 5163231 - DNA, 19 bp, Homo sapiens
actcttgcctttccacctg

SEQ ID NO: 5163232 - DNA, 13 bp, Homo sapiens
actcttgctcact

SEQ ID NO: 5163233 - DNA, 15 bp, Homo sapiens
actcttgctcactcc

SEQ ID NO: 5163234 - DNA, 16 bp, Homo sapiens
actcttgctcctgctt

SEQ ID NO: 5163235 - DNA, 13 bp, Homo sapiens
actcttgctcttt

SEQ ID NO: 5163236 - DNA, 10 bp, Homo sapiens
actcttgctg

SEQ ID NO: 5163237 - DNA, 22 bp, Homo sapiens
actcttggagcctctttttcct

SEQ ID NO: 5163238 - DNA, 14 bp, Homo sapiens
actcttggagcctg

SEQ ID NO: 5163239 - DNA, 23 bp, Homo sapiens
actcttggagcctgcagagctgc

SEQ ID NO: 5163240 - DNA, 13 bp, Homo sapiens
actcttggcctct

SEQ ID NO: 5163241 - DNA, 16 bp, Homo sapiens
actcttggcctctgct

SEQ ID NO: 5163242 - DNA, 12 bp, Homo sapiens
actcttgtaaga

SEQ ID NO: 5163243 - DNA, 14 bp, Homo sapiens
actcttgtaagatt

SEQ ID NO: 5163244 - DNA, 16 bp, Homo sapiens
actcttgtacaaaaga

SEQ ID NO: 5163245 - DNA, 17 bp, Homo sapiens
actcttgtacaaaagaa

SEQ ID NO: 5163246 - DNA, 20 bp, Homo sapiens
actcttgtattgctccattt

SEQ ID NO: 5163247 - DNA, 18 bp, Homo sapiens
actcttgtcacccaggct

SEQ ID NO: 5163248 - DNA, 14 bp, Homo sapiens
actcttgtcatttt

SEQ ID NO: 5163249 - DNA, 18 bp, Homo sapiens
actcttgtcatttttaat

SEQ ID NO: 5163250 - DNA, 17 bp, Homo sapiens
actcttgtctcctcctc

SEQ ID NO: 5163251 - DNA, 20 bp, Homo sapiens
actcttgtctcctcctccag

SEQ ID NO: 5163252 - DNA, 21 bp, Homo sapiens
actcttgtgaattattctgat

SEQ ID NO: 5163253 - DNA, 18 bp, Homo sapiens
actctttaacacattctt

SEQ ID NO: 5163254 - DNA, 19 bp, Homo sapiens
actctttaacacattcttt

SEQ ID NO: 5163255 - DNA, 20 bp, Homo sapiens
actctttaagttgaaaagta

SEQ ID NO: 5163256 - DNA, 21 bp, Homo sapiens
actctttagacacacaaaaca

SEQ ID NO: 5163257 - DNA, 13 bp, Homo sapiens
actctttagagca

SEQ ID NO: 5163258 - DNA, 14 bp, Homo sapiens
actctttatgcttg

SEQ ID NO: 5163259 - DNA, 17 bp, Homo sapiens
actctttatgcttgcaa

SEQ ID NO: 5163260 - DNA, 15 bp, Homo sapiens
actctttattgtctg

SEQ ID NO: 5163261 - DNA, 19 bp, Homo sapiens
actctttattgtctgtaaa

SEQ ID NO: 5163262 - DNA, 20 bp, Homo sapiens
actctttattgtctgtaaat

SEQ ID NO: 5163263 - DNA, 17 bp, Homo sapiens
actctttatttttctct

SEQ ID NO: 5163264 - DNA, 13 bp, Homo sapiens
actctttcaaaaa

SEQ ID NO: 5163265 - DNA, 21 bp, Homo sapiens
actctttcaataaatgtatca

SEQ ID NO: 5163266 - DNA, 15 bp, Homo sapiens
actctttccgactgc

SEQ ID NO: 5163267 - DNA, 17 bp, Homo sapiens
actctttccgactgccc

SEQ ID NO: 5163268 - DNA, 20 bp, Homo sapiens
actctttccgactgcccaga

SEQ ID NO: 5163269 - DNA, 16 bp, Homo sapiens
actctttcctaaagcc

SEQ ID NO: 5163270 - DNA, 19 bp, Homo sapiens
actctttctaactttcttt

SEQ ID NO: 5163271 - DNA, 12 bp, Homo sapiens
actctttctctc

SEQ ID NO: 5163272 - DNA, 18 bp, Homo sapiens
actctttctgaaggaaga

SEQ ID NO: 5163273 - DNA, 18 bp, Homo sapiens
actctttctgagtgcctt

SEQ ID NO: 5163274 - DNA, 14 bp, Homo sapiens
actctttcttctct

SEQ ID NO: 5163275 - DNA, 12 bp, Homo sapiens
actctttgaaat

SEQ ID NO: 5163276 - DNA, 18 bp, Homo sapiens
actctttgaatgacaaag

SEQ ID NO: 5163277 - DNA, 22 bp, Homo sapiens
actctttgacgggaggcctcag

SEQ ID NO: 5163278 - DNA, 18 bp, Homo sapiens
actctttgagaaacaaca

SEQ ID NO: 5163279 - DNA, 12 bp, Homo sapiens
actctttgagag

SEQ ID NO: 5163280 - DNA, 16 bp, Homo sapiens
actctttgagatagaa

SEQ ID NO: 5163281 - DNA, 14 bp, Homo sapiens
actctttgagcctt

SEQ ID NO: 5163282 - DNA, 16 bp, Homo sapiens
actctttgcctaacta

SEQ ID NO: 5163283 - DNA, 21 bp, Homo sapiens
actctttgctacaataaatgc

SEQ ID NO: 5163284 - DNA, 21 bp, Homo sapiens
actctttgctttgtagtttgc

SEQ ID NO: 5163285 - DNA, 11 bp, Homo sapiens
actctttggat

SEQ ID NO: 5163286 - DNA, 22 bp, Homo sapiens
actctttggatagcatgtcttt

SEQ ID NO: 5163287 - DNA, 24 bp, Homo sapiens
actctttgggtccattcagatgaa

SEQ ID NO: 5163288 - DNA, 14 bp, Homo sapiens
actctttggtcgtt

SEQ ID NO: 5163289 - DNA, 19 bp, Homo sapiens
actctttggtcgttttttt

SEQ ID NO: 5163290 - DNA, 23 bp, Homo sapiens
actctttgttttctttcctcccc

SEQ ID NO: 5163291 - DNA, 20 bp, Homo sapiens
actcttttaagatcttgtta

SEQ ID NO: 5163292 - DNA, 14 bp, Homo sapiens
actcttttaagtgc

SEQ ID NO: 5163293 - DNA, 15 bp, Homo sapiens
actcttttaagtgcc

SEQ ID NO: 5163294 - DNA, 20 bp, Homo sapiens
actcttttaattgaaattaa

SEQ ID NO: 5163295 - DNA, 23 bp, Homo sapiens
actcttttaattgaaattaactt

SEQ ID NO: 5163296 - DNA, 21 bp, Homo sapiens
actcttttccaaacacaggca

SEQ ID NO: 5163297 - DNA, 18 bp, Homo sapiens
actcttttgagcagtaaa

SEQ ID NO: 5163298 - DNA, 17 bp, Homo sapiens
actcttttgagtggtaa

SEQ ID NO: 5163299 - DNA, 14 bp, Homo sapiens
actcttttgcttta

SEQ ID NO: 5163300 - DNA, 21 bp, Homo sapiens
actcttttggacaaaggaatc

SEQ ID NO: 5163301 - DNA, 13 bp, Homo sapiens
actcttttgggat

SEQ ID NO: 5163302 - DNA, 23 bp, Homo sapiens
actctttttcccaactttggaaa

SEQ ID NO: 5163303 - DNA, 18 bp, Homo sapiens
actctttttctaaagtgt

SEQ ID NO: 5163304 - DNA, 19 bp, Homo sapiens
actctttttctaaagtgtt

SEQ ID NO: 5163305 - DNA, 22 bp, Homo sapiens
actctttttggactcagcccac

SEQ ID NO: 5163306 - DNA, 23 bp, Homo sapiens
actctttttggactcagcccacc

SEQ ID NO: 5163307 - DNA, 17 bp, Homo sapiens
actctttttgggctcct

SEQ ID NO: 5163308 - DNA, 16 bp, Homo sapiens
actctttttgggtcca

SEQ ID NO: 5163309 - DNA, 21 bp, Homo sapiens
actcttttttaaaaattactt

SEQ ID NO: 5163310 - DNA, 15 bp, Homo sapiens
actctttttttgagt

SEQ ID NO: 5163311 - DNA, 11 bp, Homo sapiens
actgaaaaaaa

SEQ ID NO: 5163312 - DNA, 21 bp, Homo sapiens
actgaaaaaaaattcctttca

SEQ ID NO: 5163313 - DNA, 14 bp, Homo sapiens
actgaaaaaatact

SEQ ID NO: 5163314 - DNA, 14 bp, Homo sapiens
actgaaaaaatata

SEQ ID NO: 5163315 - DNA, 15 bp, Homo sapiens
actgaaaaaatgctg

SEQ ID NO: 5163316 - DNA, 14 bp, Homo sapiens
actgaaaaaatgta

SEQ ID NO: 5163317 - DNA, 17 bp, Homo sapiens
actgaaaaagaatgaaa

SEQ ID NO: 5163318 - DNA, 22 bp, Homo sapiens
actgaaaaagaatgaaaacaat

SEQ ID NO: 5163319 - DNA, 14 bp, Homo sapiens
actgaaaaatatct

SEQ ID NO: 5163320 - DNA, 15 bp, Homo sapiens
actgaaaaatatctg

SEQ ID NO: 5163321 - DNA, 14 bp, Homo sapiens
actgaaaaatgtca

SEQ ID NO: 5163322 - DNA, 17 bp, Homo sapiens
actgaaaaatgtcagtc

SEQ ID NO: 5163323 - DNA, 18 bp, Homo sapiens
actgaaaaatgtcagtct

SEQ ID NO: 5163324 - DNA, 16 bp, Homo sapiens
actgaaaaattatact

SEQ ID NO: 5163325 - DNA, 19 bp, Homo sapiens
actgaaaacataaaaagtt

SEQ ID NO: 5163326 - DNA, 16 bp, Homo sapiens
actgaaaacatctgga

SEQ ID NO: 5163327 - DNA, 15 bp, Homo sapiens
actgaaaacctctcc

SEQ ID NO: 5163328 - DNA, 16 bp, Homo sapiens
actgaaaacctctcct

SEQ ID NO: 5163329 - DNA, 17 bp, Homo sapiens
actgaaaacctctcctc

SEQ ID NO: 5163330 - DNA, 17 bp, Homo sapiens
actgaaaacttagccag

SEQ ID NO: 5163331 - DNA, 16 bp, Homo sapiens
actgaaaagaaggaaa

SEQ ID NO: 5163332 - DNA, 15 bp, Homo sapiens
actgaaaagagagca

SEQ ID NO: 5163333 - DNA, 20 bp, Homo sapiens
actgaaaagagagcagagaa

SEQ ID NO: 5163334 - DNA, 14 bp, Homo sapiens
actgaaaagcagcc

SEQ ID NO: 5163335 - DNA, 20 bp, Homo sapiens
actgaaaaggttcttcatcc

SEQ ID NO: 5163336 - DNA, 18 bp, Homo sapiens
actgaaaatattgtttta

SEQ ID NO: 5163337 - DNA, 15 bp, Homo sapiens
actgaaaatctaata

SEQ ID NO: 5163338 - DNA, 23 bp, Homo sapiens
actgaaaatctaatattaaaaat

SEQ ID NO: 5163339 - DNA, 13 bp, Homo sapiens
actgaaaatgtaa

SEQ ID NO: 5163340 - DNA, 14 bp, Homo sapiens
actgaaaatgtaaa

SEQ ID NO: 5163341 - DNA, 16 bp, Homo sapiens
actgaaaatgtaaatt

SEQ ID NO: 5163342 - DNA, 19 bp, Homo sapiens
actgaaaatgtaaatttat

SEQ ID NO: 5163343 - DNA, 19 bp, Homo sapiens
actgaaaatgtgctatact

SEQ ID NO: 5163344 - DNA, 23 bp, Homo sapiens
actgaaaatgtgctctacatctc

SEQ ID NO: 5163345 - DNA, 17 bp, Homo sapiens
actgaaaattatttaaa

SEQ ID NO: 5163346 - DNA, 15 bp, Homo sapiens
actgaaaatttaaca

SEQ ID NO: 5163347 - DNA, 17 bp, Homo sapiens
actgaaacatggctgtg

SEQ ID NO: 5163348 - DNA, 13 bp, Homo sapiens
actgaaacctctg

SEQ ID NO: 5163349 - DNA, 14 bp, Homo sapiens
actgaaacctctgc

SEQ ID NO: 5163350 - DNA, 15 bp, Homo sapiens
actgaaacctgagat

SEQ ID NO: 5163351 - DNA, 19 bp, Homo sapiens
actgaaacctttaagaaaa

SEQ ID NO: 5163352 - DNA, 12 bp, Homo sapiens
actgaaactaca

SEQ ID NO: 5163353 - DNA, 14 bp, Homo sapiens
actgaaagaaaaag

SEQ ID NO: 5163354 - DNA, 16 bp, Homo sapiens
actgaaagaaaaagta

SEQ ID NO: 5163355 - DNA, 20 bp, Homo sapiens
actgaaagaagaaaacagta

SEQ ID NO: 5163356 - DNA, 21 bp, Homo sapiens
actgaaagaagaaaacagtac

SEQ ID NO: 5163357 - DNA, 21 bp, Homo sapiens
actgaaagacaccatttatct

SEQ ID NO: 5163358 - DNA, 17 bp, Homo sapiens
actgaaagcacatgaat

SEQ ID NO: 5163359 - DNA, 15 bp, Homo sapiens
actgaaagcagcagc

SEQ ID NO: 5163360 - DNA, 13 bp, Homo sapiens
actgaaagcttta

SEQ ID NO: 5163361 - DNA, 18 bp, Homo sapiens
actgaaaggaaaaatgta

SEQ ID NO: 5163362 - DNA, 17 bp, Homo sapiens
actgaaaggcttttcaa

SEQ ID NO: 5163363 - DNA, 14 bp, Homo sapiens
actgaaagtggttt

SEQ ID NO: 5163364 - DNA, 23 bp, Homo sapiens
actgaaagttttgtaaaagaaat

SEQ ID NO: 5163365 - DNA, 14 bp, Homo sapiens
actgaaatccttga

SEQ ID NO: 5163366 - DNA, 15 bp, Homo sapiens
actgaaatccttgag

SEQ ID NO: 5163367 - DNA, 16 bp, Homo sapiens
actgaaatccttgaga

SEQ ID NO: 5163368 - DNA, 17 bp, Homo sapiens
actgaaatctgtcaaga

SEQ ID NO: 5163369 - DNA, 17 bp, Homo sapiens
actgaaatcttgtaagt

SEQ ID NO: 5163370 - DNA, 23 bp, Homo sapiens
actgaaatgagcatgcattttct

SEQ ID NO: 5163371 - DNA, 16 bp, Homo sapiens
acttagaaagcagggg

SEQ ID NO: 5163372 - DNA, 17 bp, Homo sapiens
acttagaataaaattgt

SEQ ID NO: 5163373 - DNA, 16 bp, Homo sapiens
acttagaatagaaact

SEQ ID NO: 5163374 - DNA, 18 bp, Homo sapiens
acttagaatagtttgaaa

SEQ ID NO: 5163375 - DNA, 18 bp, Homo sapiens
acttagaatccctgtgtt

SEQ ID NO: 5163376 - DNA, 13 bp, Homo sapiens
acttagaatgcca

SEQ ID NO: 5163377 - DNA, 15 bp, Homo sapiens
acttagaatgccata

SEQ ID NO: 5163378 - DNA, 17 bp, Homo sapiens
acttagaatgccataaa

SEQ ID NO: 5163379 - DNA, 15 bp, Homo sapiens
acttagacccagtca

SEQ ID NO: 5163380 - DNA, 17 bp, Homo sapiens
acttagacctgccagcc

SEQ ID NO: 5163381 - DNA, 18 bp, Homo sapiens
acttagacctgccagcca

SEQ ID NO: 5163382 - DNA, 19 bp, Homo sapiens
acttagactctagtattta

SEQ ID NO: 5163383 - DNA, 14 bp, Homo sapiens
acttagagaacaaa

SEQ ID NO: 5163384 - DNA, 16 bp, Homo sapiens
acttagagaacaaagg

SEQ ID NO: 5163385 - DNA, 12 bp, Homo sapiens
acttagaggaaa

SEQ ID NO: 5163386 - DNA, 16 bp, Homo sapiens
acttagaggaaaatga

SEQ ID NO: 5163387 - DNA, 21 bp, Homo sapiens
acttagaggaaataagaaaaa

SEQ ID NO: 5163388 - DNA, 18 bp, Homo sapiens
acttagagtttctgtttg

SEQ ID NO: 5163389 - DNA, 16 bp, Homo sapiens
acttagatattaaaat

SEQ ID NO: 5163390 - DNA, 15 bp, Homo sapiens
acttagatatttcat

SEQ ID NO: 5163391 - DNA, 16 bp, Homo sapiens
acttagatatttcatg

SEQ ID NO: 5163392 - DNA, 18 bp, Homo sapiens
acttagatctctcctgca

SEQ ID NO: 5163393 - DNA, 16 bp, Homo sapiens
acttagatctgagccc

SEQ ID NO: 5163394 - DNA, 19 bp, Homo sapiens
acttagatgttaaatgtta

SEQ ID NO: 5163395 - DNA, 17 bp, Homo sapiens
acttagattttacatga

SEQ ID NO: 5163396 - DNA, 16 bp, Homo sapiens
acttagcaagacctga

SEQ ID NO: 5163397 - DNA, 21 bp, Homo sapiens
acttagcagtgagtattggaa

SEQ ID NO: 5163398 - DNA, 14 bp, Homo sapiens
acttagcatcctaa

SEQ ID NO: 5163399 - DNA, 18 bp, Homo sapiens
acttagcatcctaagaaa

SEQ ID NO: 5163400 - DNA, 21 bp, Homo sapiens
acttagcatcctaagaaatat

SEQ ID NO: 5163401 - DNA, 15 bp, Homo sapiens
acttagcatgcacaa

SEQ ID NO: 5163402 - DNA, 16 bp, Homo sapiens
acttagcatgcacaaa

SEQ ID NO: 5163403 - DNA, 20 bp, Homo sapiens
acttagcattttctgcatct

SEQ ID NO: 5163404 - DNA, 22 bp, Homo sapiens
acttagcattttctgcatctcc

SEQ ID NO: 5163405 - DNA, 16 bp, Homo sapiens
acttagccatgatggc

SEQ ID NO: 5163406 - DNA, 23 bp, Homo sapiens
acttagccatttttcaaagcaat

SEQ ID NO: 5163407 - DNA, 23 bp, Homo sapiens
acttagcccaagaggtctgagcc

SEQ ID NO: 5163408 - DNA, 21 bp, Homo sapiens
acttagccgtccatggcacca

SEQ ID NO: 5163409 - DNA, 18 bp, Homo sapiens
acttagcgtcaagacatt

SEQ ID NO: 5163410 - DNA, 19 bp, Homo sapiens
acttagcgtcaagacattt

SEQ ID NO: 5163411 - DNA, 16 bp, Homo sapiens
acttagctctgaggag

SEQ ID NO: 5163412 - DNA, 17 bp, Homo sapiens
acttagctggagaacta

SEQ ID NO: 5163413 - DNA, 21 bp, Homo sapiens
acttagctggagatgtctcta

SEQ ID NO: 5163414 - DNA, 15 bp, Homo sapiens
acttagctgtactat

SEQ ID NO: 5163415 - DNA, 16 bp, Homo sapiens
acttagcttatcaatt

SEQ ID NO: 5163416 - DNA, 22 bp, Homo sapiens
acttagcttatcaatttgtcat

SEQ ID NO: 5163417 - DNA, 23 bp, Homo sapiens
acttaggaaggtggccttcctgc

SEQ ID NO: 5163418 - DNA, 20 bp, Homo sapiens
acttaggaggcttacttctt

SEQ ID NO: 5163419 - DNA, 21 bp, Homo sapiens
acttaggcatgcacagctgta

SEQ ID NO: 5163420 - DNA, 18 bp, Homo sapiens
acttaggccctagcggca

SEQ ID NO: 5163421 - DNA, 16 bp, Homo sapiens
acttagggaagaaaaa

SEQ ID NO: 5163422 - DNA, 18 bp, Homo sapiens
acttagggaagaaaaagc

SEQ ID NO: 5163423 - DNA, 16 bp, Homo sapiens
acttagggcaccaggg

SEQ ID NO: 5163424 - DNA, 23 bp, Homo sapiens
acttagggccaagtcttgggtct

SEQ ID NO: 5163425 - DNA, 21 bp, Homo sapiens
acttaggggagttcagtattt

SEQ ID NO: 5163426 - DNA, 17 bp, Homo sapiens
acttagggtttggagct

SEQ ID NO: 5163427 - DNA, 19 bp, Homo sapiens
acttaggtttcaggaagtt

SEQ ID NO: 5163428 - DNA, 15 bp, Homo sapiens
acttagtagattaaa

SEQ ID NO: 5163429 - DNA, 20 bp, Homo sapiens
acttagtagattaaaaatta

SEQ ID NO: 5163430 - DNA, 18 bp, Homo sapiens
acttagtatattattatt

SEQ ID NO: 5163431 - DNA, 19 bp, Homo sapiens
acttagtatgcagttgata

SEQ ID NO: 5163432 - DNA, 19 bp, Homo sapiens
acttagtattgcaaagtca

SEQ ID NO: 5163433 - DNA, 15 bp, Homo sapiens
acttagtattttacc

SEQ ID NO: 5163434 - DNA, 12 bp, Homo sapiens
acttagtccact

SEQ ID NO: 5163435 - DNA, 18 bp, Homo sapiens
acttagtccactctgagt

SEQ ID NO: 5163436 - DNA, 18 bp, Homo sapiens
acttagtgacaaaataga

SEQ ID NO: 5163437 - DNA, 18 bp, Homo sapiens
acttagtgatcatttaaa

SEQ ID NO: 5163438 - DNA, 20 bp, Homo sapiens
acttagtgatcatttaaaaa

SEQ ID NO: 5163439 - DNA, 18 bp, Homo sapiens
acttagtggtatgtctct

SEQ ID NO: 5163440 - DNA, 18 bp, Homo sapiens
acttagtgtctctattta

SEQ ID NO: 5163441 - DNA, 21 bp, Homo sapiens
acttagtgtctctatttatga

SEQ ID NO: 5163442 - DNA, 15 bp, Homo sapiens
acttagttatttctg

SEQ ID NO: 5163443 - DNA, 21 bp, Homo sapiens
acttagtttttaaaatttatt

SEQ ID NO: 5163444 - DNA, 15 bp, Homo sapiens
acttagtttttatct

SEQ ID NO: 5163445 - DNA, 13 bp, Homo sapiens
acttataaaataa

SEQ ID NO: 5163446 - DNA, 18 bp, Homo sapiens
acttataaagaaggttgg

SEQ ID NO: 5163447 - DNA, 20 bp, Homo sapiens
acttataaatcatattgatg

SEQ ID NO: 5163448 - DNA, 23 bp, Homo sapiens
acttataaggtgttttctgtgta

SEQ ID NO: 5163449 - DNA, 14 bp, Homo sapiens
acttataatttcca

SEQ ID NO: 5163450 - DNA, 15 bp, Homo sapiens
acttataatttccaa

SEQ ID NO: 5163451 - DNA, 16 bp, Homo sapiens
acttataatttccaaa

SEQ ID NO: 5163452 - DNA, 14 bp, Homo sapiens
acttataccaaagg

SEQ ID NO: 5163453 - DNA, 14 bp, Homo sapiens
acttatagcctctg

SEQ ID NO: 5163454 - DNA, 17 bp, Homo sapiens
acttatatcatcagcat

SEQ ID NO: 5163455 - DNA, 16 bp, Homo sapiens
acttatattaatagta

SEQ ID NO: 5163456 - DNA, 19 bp, Homo sapiens
acttatattagagtcagag

SEQ ID NO: 5163457 - DNA, 12 bp, Homo sapiens
acttatattgaa

SEQ ID NO: 5163458 - DNA, 18 bp, Homo sapiens
acttatattgaagacaat

SEQ ID NO: 5163459 - DNA, 21 bp, Homo sapiens
acttatattgtaagaaatact

SEQ ID NO: 5163460 - DNA, 15 bp, Homo sapiens
acttatatttcccta

SEQ ID NO: 5163461 - DNA, 23 bp, Homo sapiens
acttatatttctgctttcaaagt

SEQ ID NO: 5163462 - DNA, 15 bp, Homo sapiens
acttatattttcgta

SEQ ID NO: 5163463 - DNA, 20 bp, Homo sapiens
acttatcaacactataattg

SEQ ID NO: 5163464 - DNA, 19 bp, Homo sapiens
acttatcatccacattgtt

SEQ ID NO: 5163465 - DNA, 15 bp, Homo sapiens
acttatcatttttgt

SEQ ID NO: 5163466 - DNA, 13 bp, Homo sapiens
acttatcctgaca

SEQ ID NO: 5163467 - DNA, 20 bp, Homo sapiens
acttatctctaaaccatcta

SEQ ID NO: 5163468 - DNA, 17 bp, Homo sapiens
acttatctctcaaaaca

SEQ ID NO: 5163469 - DNA, 22 bp, Homo sapiens
acttatctctcaaaacaatatt

SEQ ID NO: 5163470 - DNA, 16 bp, Homo sapiens
acttatctctctgtgc

SEQ ID NO: 5163471 - DNA, 22 bp, Homo sapiens
acttatctctctgtgctgtgga

SEQ ID NO: 5163472 - DNA, 14 bp, Homo sapiens
acttatctgagtca

SEQ ID NO: 5163473 - DNA, 17 bp, Homo sapiens
acttatcttctggatta

SEQ ID NO: 5163474 - DNA, 21 bp, Homo sapiens
acttatgaagtaaagtttctg

SEQ ID NO: 5163475 - DNA, 22 bp, Homo sapiens
acttatgaagtaaagtttctga

SEQ ID NO: 5163476 - DNA, 21 bp, Homo sapiens
acttatgactaaaaatatcac

SEQ ID NO: 5163477 - DNA, 22 bp, Homo sapiens
acttatgcaaaaccttgtgaac

SEQ ID NO: 5163478 - DNA, 12 bp, Homo sapiens
acttatgctgct

SEQ ID NO: 5163479 - DNA, 13 bp, Homo sapiens
acttatgctgctg

SEQ ID NO: 5163480 - DNA, 16 bp, Homo sapiens
acttatgctgctgtga

SEQ ID NO: 5163481 - DNA, 21 bp, Homo sapiens
acttatggactgttttgatag

SEQ ID NO: 5163482 - DNA, 15 bp, Homo sapiens
acttatgtacagaaa

SEQ ID NO: 5163483 - DNA, 15 bp, Homo sapiens
acttatgtagaaact

SEQ ID NO: 5163484 - DNA, 19 bp, Homo sapiens
acttatgtagatatttggc

SEQ ID NO: 5163485 - DNA, 20 bp, Homo sapiens
acttatgtagatatttggct

SEQ ID NO: 5163486 - DNA, 12 bp, Homo sapiens
acttatgtatgt

SEQ ID NO: 5163487 - DNA, 12 bp, Homo sapiens
acttatgtcttg

SEQ ID NO: 5163488 - DNA, 15 bp, Homo sapiens
acttatgtttttaaa

SEQ ID NO: 5163489 - DNA, 16 bp, Homo sapiens
acttatgtttttaaat

SEQ ID NO: 5163490 - DNA, 12 bp, Homo sapiens
acttattaacaa

SEQ ID NO: 5163491 - DNA, 23 bp, Homo sapiens
acttattaagagcaaactttagt

SEQ ID NO: 5163492 - DNA, 21 bp, Homo sapiens
acttattaagttcgaacatgt

SEQ ID NO: 5163493 - DNA, 14 bp, Homo sapiens
acttattactgcta

SEQ ID NO: 5163494 - DNA, 14 bp, Homo sapiens
acttattagaaacc

SEQ ID NO: 5163495 - DNA, 16 bp, Homo sapiens
acttattatgcataaa

SEQ ID NO: 5163496 - DNA, 15 bp, Homo sapiens
acttattcaaagaga

SEQ ID NO: 5163497 - DNA, 17 bp, Homo sapiens
acttattcaaagagaaa

SEQ ID NO: 5163498 - DNA, 15 bp, Homo sapiens
acttattcattgtgg

SEQ ID NO: 5163499 - DNA, 21 bp, Homo sapiens
acttattccctcatcctttca

SEQ ID NO: 5163500 - DNA, 13 bp, Homo sapiens
acttattgaatat

SEQ ID NO: 5163501 - DNA, 16 bp, Homo sapiens
acttattgattaagta

SEQ ID NO: 5163502 - DNA, 20 bp, Homo sapiens
acttattgtagcatcctgga

SEQ ID NO: 5163503 - DNA, 23 bp, Homo sapiens
acttattgtagcatcctggaata

SEQ ID NO: 5163504 - DNA, 21 bp, Homo sapiens
acttattgtggataacaaaga

SEQ ID NO: 5163505 - DNA, 21 bp, Homo sapiens
acttattgttgctgaaaactc

SEQ ID NO: 5163506 - DNA, 20 bp, Homo sapiens
acttatttaaaaatatttca

SEQ ID NO: 5163507 - DNA, 21 bp, Homo sapiens
acttatttaaaaatatttcag

SEQ ID NO: 5163508 - DNA, 22 bp, Homo sapiens
acttatttaaaaatatttcaga

SEQ ID NO: 5163509 - DNA, 22 bp, Homo sapiens
acttatttaaaaatgcatgata

SEQ ID NO: 5163510 - DNA, 15 bp, Homo sapiens
acttatttaaactct

SEQ ID NO: 5163511 - DNA, 17 bp, Homo sapiens
acttatttatgaacctg

SEQ ID NO: 5163512 - DNA, 14 bp, Homo sapiens
acttatttatgaat

SEQ ID NO: 5163513 - DNA, 22 bp, Homo sapiens
acttatttattgttgccttttc

SEQ ID NO: 5163514 - DNA, 20 bp, Homo sapiens
acttatttcactatcttctt

SEQ ID NO: 5163515 - DNA, 23 bp, Homo sapiens
acttatttcactatcttcttcaa

SEQ ID NO: 5163516 - DNA, 15 bp, Homo sapiens
acttatttcttcaaa

SEQ ID NO: 5163517 - DNA, 19 bp, Homo sapiens
acttattttacacagcaat

SEQ ID NO: 5163518 - DNA, 17 bp, Homo sapiens
acttattttccaataaa

SEQ ID NO: 5163519 - DNA, 21 bp, Homo sapiens
acttattttccaataaaattt

SEQ ID NO: 5163520 - DNA, 15 bp, Homo sapiens
acttattttctgaat

SEQ ID NO: 5163521 - DNA, 22 bp, Homo sapiens
acttattttctgaattcataaa

SEQ ID NO: 5163522 - DNA, 17 bp, Homo sapiens
acttattttgattgttt

SEQ ID NO: 5163523 - DNA, 23 bp, Homo sapiens
acttattttgtcttattcttaag

SEQ ID NO: 5163524 - DNA, 18 bp, Homo sapiens
acttatttttttcccaag

SEQ ID NO: 5163525 - DNA, 21 bp, Homo sapiens
acttatttttttctgattgta

SEQ ID NO: 5163526 - DNA, 20 bp, Homo sapiens
acttcaaaaactaaaatcat

SEQ ID NO: 5163527 - DNA, 16 bp, Homo sapiens
acttcaaaaactgtca

SEQ ID NO: 5163528 - DNA, 16 bp, Homo sapiens
acttcaaaaataatgt

SEQ ID NO: 5163529 - DNA, 23 bp, Homo sapiens
acttcaaaaatgttaaaccctta

SEQ ID NO: 5163530 - DNA, 19 bp, Homo sapiens
acttcaaaacaaacagatg

SEQ ID NO: 5163531 - DNA, 15 bp, Homo sapiens
acttcaaaagctttt

SEQ ID NO: 5163532 - DNA, 14 bp, Homo sapiens
acttcaaaaggaat

SEQ ID NO: 5163533 - DNA, 15 bp, Homo sapiens
acttcaaaatcagtg

SEQ ID NO: 5163534 - DNA, 19 bp, Homo sapiens
acttcaaaatcagtgatgg

SEQ ID NO: 5163535 - DNA, 20 bp, Homo sapiens
acttcaaacatgccctcagg

SEQ ID NO: 5163536 - DNA, 22 bp, Homo sapiens
acttcaaacatgccctcaggct

SEQ ID NO: 5163537 - DNA, 16 bp, Homo sapiens
acttcaaagcaagctg

SEQ ID NO: 5163538 - DNA, 14 bp, Homo sapiens
acttcaaagtgcct

SEQ ID NO: 5163539 - DNA, 17 bp, Homo sapiens
acttcaaagtgcctggg

SEQ ID NO: 5163540 - DNA, 15 bp, Homo sapiens
acttcaaatatagag

SEQ ID NO: 5163541 - DNA, 18 bp, Homo sapiens
acttcaaatccttgaaga

SEQ ID NO: 5163542 - DNA, 11 bp, Homo sapiens
acttcaaatgt

SEQ ID NO: 5163543 - DNA, 19 bp, Homo sapiens
acttcaaatgtcatttcat

SEQ ID NO: 5163544 - DNA, 13 bp, Homo sapiens
acttcaaatgtgt

SEQ ID NO: 5163545 - DNA, 15 bp, Homo sapiens
acttcaaatgtgtaa

SEQ ID NO: 5163546 - DNA, 16 bp, Homo sapiens
acttcaacatgcatat

SEQ ID NO: 5163547 - DNA, 23 bp, Homo sapiens
acttcaagacatcaccatcagca

SEQ ID NO: 5163548 - DNA, 16 bp, Homo sapiens
acttcaagatgagcct

SEQ ID NO: 5163549 - DNA, 17 bp, Homo sapiens
actgaaatgcctgcttt

SEQ ID NO: 5163550 - DNA, 17 bp, Homo sapiens
actgaaatgcctggaag

SEQ ID NO: 5163551 - DNA, 22 bp, Homo sapiens
actgaaatgccttactttgtat

SEQ ID NO: 5163552 - DNA, 15 bp, Homo sapiens
actgaaattacttta

SEQ ID NO: 5163553 - DNA, 20 bp, Homo sapiens
actgaaattagtgttttcat

SEQ ID NO: 5163554 - DNA, 22 bp, Homo sapiens
actgaaattagtgttttcattc

SEQ ID NO: 5163555 - DNA, 14 bp, Homo sapiens
actgaaattctaaa

SEQ ID NO: 5163556 - DNA, 14 bp, Homo sapiens
actgaaatttgcta

SEQ ID NO: 5163557 - DNA, 23 bp, Homo sapiens
actgaaatttgttatacttcaaa

SEQ ID NO: 5163558 - DNA, 12 bp, Homo sapiens
actgaacaaaaa

SEQ ID NO: 5163559 - DNA, 13 bp, Homo sapiens
actgaacaaaaaa

SEQ ID NO: 5163560 - DNA, 15 bp, Homo sapiens
actgaacaaaaccta

SEQ ID NO: 5163561 - DNA, 21 bp, Homo sapiens
actgaacaccattgaaggctt

SEQ ID NO: 5163562 - DNA, 13 bp, Homo sapiens
actgaacagaaat

SEQ ID NO: 5163563 - DNA, 15 bp, Homo sapiens
actgaacaggctggg

SEQ ID NO: 5163564 - DNA, 24 bp, Homo sapiens
actgaacatctgagtcctggatga

SEQ ID NO: 5163565 - DNA, 12 bp, Homo sapiens
actgaacatgtt

SEQ ID NO: 5163566 - DNA, 13 bp, Homo sapiens
actgaacatgttt

SEQ ID NO: 5163567 - DNA, 19 bp, Homo sapiens
actgaacattagttgcact

SEQ ID NO: 5163568 - DNA, 14 bp, Homo sapiens
actgaaccaaattg

SEQ ID NO: 5163569 - DNA, 16 bp, Homo sapiens
actgaaccaaattgca

SEQ ID NO: 5163570 - DNA, 22 bp, Homo sapiens
actgaaccaaattgcactgaag

SEQ ID NO: 5163571 - DNA, 15 bp, Homo sapiens
actgaaccactgctt

SEQ ID NO: 5163572 - DNA, 16 bp, Homo sapiens
actgaaccacttgtag

SEQ ID NO: 5163573 - DNA, 19 bp, Homo sapiens
actgaaccacttgtagatt

SEQ ID NO: 5163574 - DNA, 20 bp, Homo sapiens
actgaaccacttgtagattt

SEQ ID NO: 5163575 - DNA, 17 bp, Homo sapiens
actgaaccactttgata

SEQ ID NO: 5163576 - DNA, 14 bp, Homo sapiens
actgaaccaggcca

SEQ ID NO: 5163577 - DNA, 12 bp, Homo sapiens
actgaacccaga

SEQ ID NO: 5163578 - DNA, 18 bp, Homo sapiens
actgaacccagagtcagg

SEQ ID NO: 5163579 - DNA, 21 bp, Homo sapiens
actgaaccccctcaaaagcca

SEQ ID NO: 5163580 - DNA, 23 bp, Homo sapiens
actgaaccccctcaaaagccaaa

SEQ ID NO: 5163581 - DNA, 21 bp, Homo sapiens
actgaaccgacttttctaaag

SEQ ID NO: 5163582 - DNA, 19 bp, Homo sapiens
actgaaccggctttaccaa

SEQ ID NO: 5163583 - DNA, 17 bp, Homo sapiens
actgaacctctggctag

SEQ ID NO: 5163584 - DNA, 22 bp, Homo sapiens
actgaacctgggaaagagattt

SEQ ID NO: 5163585 - DNA, 17 bp, Homo sapiens
actgaacgtcctgcagc

SEQ ID NO: 5163586 - DNA, 16 bp, Homo sapiens
actgaactacatgcat

SEQ ID NO: 5163587 - DNA, 20 bp, Homo sapiens
actgaactacatgcataaac

SEQ ID NO: 5163588 - DNA, 14 bp, Homo sapiens
actgaactcaggat

SEQ ID NO: 5163589 - DNA, 17 bp, Homo sapiens
actgaactgcacgttct

SEQ ID NO: 5163590 - DNA, 17 bp, Homo sapiens
actgaactgcttttaaa

SEQ ID NO: 5163591 - DNA, 14 bp, Homo sapiens
actgaactgtttgg

SEQ ID NO: 5163592 - DNA, 23 bp, Homo sapiens
actgaactgtttggtcgagtctt

SEQ ID NO: 5163593 - DNA, 13 bp, Homo sapiens
actgaacttcagg

SEQ ID NO: 5163594 - DNA, 21 bp, Homo sapiens
actgaacttcaggataataaa

SEQ ID NO: 5163595 - DNA, 14 bp, Homo sapiens
actgaacttgaagc

SEQ ID NO: 5163596 - DNA, 18 bp, Homo sapiens
actgaacttgaagctaac

SEQ ID NO: 5163597 - DNA, 15 bp, Homo sapiens
actgaactttgaaga

SEQ ID NO: 5163598 - DNA, 16 bp, Homo sapiens
actgaactttgaagac

SEQ ID NO: 5163599 - DNA, 19 bp, Homo sapiens
actgaactttgaagacccg

SEQ ID NO: 5163600 - DNA, 16 bp, Homo sapiens
actgaactttgctgag

SEQ ID NO: 5163601 - DNA, 21 bp, Homo sapiens
actgaactttgctgagcctgt

SEQ ID NO: 5163602 - DNA, 17 bp, Homo sapiens
actgaacttttcaaaat

SEQ ID NO: 5163603 - DNA, 15 bp, Homo sapiens
actgaagaaggatat

SEQ ID NO: 5163604 - DNA, 21 bp, Homo sapiens
actgaagaattttgagtgaat

SEQ ID NO: 5163605 - DNA, 13 bp, Homo sapiens
actgaagaccagc

SEQ ID NO: 5163606 - DNA, 14 bp, Homo sapiens
actgaagactgcac

SEQ ID NO: 5163607 - DNA, 12 bp, Homo sapiens
actgaagagctc

SEQ ID NO: 5163608 - DNA, 16 bp, Homo sapiens
actgaagagctcttgg

SEQ ID NO: 5163609 - DNA, 17 bp, Homo sapiens
actgaagagctcttggc

SEQ ID NO: 5163610 - DNA, 19 bp, Homo sapiens
actgaagagctcttggccc

SEQ ID NO: 5163611 - DNA, 14 bp, Homo sapiens
actgaagatagaag

SEQ ID NO: 5163612 - DNA, 19 bp, Homo sapiens
actgaagatgaaatatata

SEQ ID NO: 5163613 - DNA, 15 bp, Homo sapiens
actgaagatggcttt

SEQ ID NO: 5163614 - DNA, 13 bp, Homo sapiens
actgaagatttat

SEQ ID NO: 5163615 - DNA, 17 bp, Homo sapiens
actgaagatttattttt

SEQ ID NO: 5163616 - DNA, 21 bp, Homo sapiens
actgaagatttatttttaata

SEQ ID NO: 5163617 - DNA, 19 bp, Homo sapiens
actgaagcaaataccaaag

SEQ ID NO: 5163618 - DNA, 21 bp, Homo sapiens
actgaagcaaataccaaagca

SEQ ID NO: 5163619 - DNA, 18 bp, Homo sapiens
actgaagcacgtgagaga

SEQ ID NO: 5163620 - DNA, 15 bp, Homo sapiens
actgaagcagagtca

SEQ ID NO: 5163621 - DNA, 14 bp, Homo sapiens
actgaagcagcctc

SEQ ID NO: 5163622 - DNA, 16 bp, Homo sapiens
actgaagcatgtgaaa

SEQ ID NO: 5163623 - DNA, 16 bp, Homo sapiens
actgaagccaaatgaa

SEQ ID NO: 5163624 - DNA, 21 bp, Homo sapiens
actgaagccacttggcccaga

SEQ ID NO: 5163625 - DNA, 24 bp, Homo sapiens
actgaagccggacagctgcccaga

SEQ ID NO: 5163626 - DNA, 22 bp, Homo sapiens
actgaagccgtgcctgtagcct

SEQ ID NO: 5163627 - DNA, 18 bp, Homo sapiens
actgaagccttcttctgc

SEQ ID NO: 5163628 - DNA, 23 bp, Homo sapiens
actgaagcgaacatcttcatata

SEQ ID NO: 5163629 - DNA, 13 bp, Homo sapiens
actgaagctgggg

SEQ ID NO: 5163630 - DNA, 23 bp, Homo sapiens
actgaagcttaaccgaagaacta

SEQ ID NO: 5163631 - DNA, 18 bp, Homo sapiens
actgaagctttttattta

SEQ ID NO: 5163632 - DNA, 20 bp, Homo sapiens
actgaaggaaaaacacaagc

SEQ ID NO: 5163633 - DNA, 11 bp, Homo sapiens
actgaaggaga

SEQ ID NO: 5163634 - DNA, 22 bp, Homo sapiens
actgaaggatattttcaacaat

SEQ ID NO: 5163635 - DNA, 20 bp, Homo sapiens
actgaaggcctggcccacag

SEQ ID NO: 5163636 - DNA, 15 bp, Homo sapiens
actgaaggggtgcac

SEQ ID NO: 5163637 - DNA, 15 bp, Homo sapiens
actgaaggtgcagtt

SEQ ID NO: 5163638 - DNA, 13 bp, Homo sapiens
actgaaggtgtgt

SEQ ID NO: 5163639 - DNA, 19 bp, Homo sapiens
actgaagtagtgtgcagtt

SEQ ID NO: 5163640 - DNA, 14 bp, Homo sapiens
actgaagtctgaaa

SEQ ID NO: 5163641 - DNA, 21 bp, Homo sapiens
actgaagtcttactacagaaa

SEQ ID NO: 5163642 - DNA, 13 bp, Homo sapiens
actgaagtgcagc

SEQ ID NO: 5163643 - DNA, 13 bp, Homo sapiens
actgaagtgctta

SEQ ID NO: 5163644 - DNA, 13 bp, Homo sapiens
actgaagtggctg

SEQ ID NO: 5163645 - DNA, 22 bp, Homo sapiens
actgaagtggctggtagaaaaa

SEQ ID NO: 5163646 - DNA, 16 bp, Homo sapiens
actgaagttatctgtg

SEQ ID NO: 5163647 - DNA, 22 bp, Homo sapiens
actgaagttatctgtgttattt

SEQ ID NO: 5163648 - DNA, 19 bp, Homo sapiens
actgaagtttcacatgagc

SEQ ID NO: 5163649 - DNA, 22 bp, Homo sapiens
actgaagtttgataaatagtgt

SEQ ID NO: 5163650 - DNA, 14 bp, Homo sapiens
actgaagtttttga

SEQ ID NO: 5163651 - DNA, 15 bp, Homo sapiens
actgaagtttttgaa

SEQ ID NO: 5163652 - DNA, 21 bp, Homo sapiens
actgaagtttttgaaatacct

SEQ ID NO: 5163653 - DNA, 22 bp, Homo sapiens
actgaagtttttgaaatacctt

SEQ ID NO: 5163654 - DNA, 13 bp, Homo sapiens
actgaataaaaaa

SEQ ID NO: 5163655 - DNA, 19 bp, Homo sapiens
actgaataaactcaaaact

SEQ ID NO: 5163656 - DNA, 12 bp, Homo sapiens
actgaataaatc

SEQ ID NO: 5163657 - DNA, 13 bp, Homo sapiens
actgaataaatca

SEQ ID NO: 5163658 - DNA, 17 bp, Homo sapiens
actgaataaatcatgtg

SEQ ID NO: 5163659 - DNA, 19 bp, Homo sapiens
actgaataatgctaccagg

SEQ ID NO: 5163660 - DNA, 18 bp, Homo sapiens
actgaataccactctgta

SEQ ID NO: 5163661 - DNA, 18 bp, Homo sapiens
actgaataggaaaatgta

SEQ ID NO: 5163662 - DNA, 18 bp, Homo sapiens
actgaatataaagcttaa

SEQ ID NO: 5163663 - DNA, 17 bp, Homo sapiens
actgaatatcatatgta

SEQ ID NO: 5163664 - DNA, 18 bp, Homo sapiens
actgaatatcatatgtat

SEQ ID NO: 5163665 - DNA, 14 bp, Homo sapiens
actgaatattttgg

SEQ ID NO: 5163666 - DNA, 23 bp, Homo sapiens
actgaatcatgttaatagacagt

SEQ ID NO: 5163667 - DNA, 18 bp, Homo sapiens
actgaatccatctttgta

SEQ ID NO: 5163668 - DNA, 15 bp, Homo sapiens
actgaatctgagaaa

SEQ ID NO: 5163669 - DNA, 21 bp, Homo sapiens
actgaatgaagcagtattttg

SEQ ID NO: 5163670 - DNA, 19 bp, Homo sapiens
actgaatgaatccattgga

SEQ ID NO: 5163671 - DNA, 21 bp, Homo sapiens
actgaatgcataatgtttaaa

SEQ ID NO: 5163672 - DNA, 17 bp, Homo sapiens
actgaatgctgttaata

SEQ ID NO: 5163673 - DNA, 20 bp, Homo sapiens
actgaatggaaataaataga

SEQ ID NO: 5163674 - DNA, 21 bp, Homo sapiens
actgaatgggatcatgaaagt

SEQ ID NO: 5163675 - DNA, 17 bp, Homo sapiens
actgaatgtcaagaaaa

SEQ ID NO: 5163676 - DNA, 18 bp, Homo sapiens
actgaatgtcaagaaaag

SEQ ID NO: 5163677 - DNA, 17 bp, Homo sapiens
actgaatgtcagggctg

SEQ ID NO: 5163678 - DNA, 14 bp, Homo sapiens
actgaatgtcattg

SEQ ID NO: 5163679 - DNA, 17 bp, Homo sapiens
actgaatgttttattta

SEQ ID NO: 5163680 - DNA, 15 bp, Homo sapiens
actgaattaaacatg

SEQ ID NO: 5163681 - DNA, 17 bp, Homo sapiens
actgaattaagttattg

SEQ ID NO: 5163682 - DNA, 16 bp, Homo sapiens
actgaattagccaaaa

SEQ ID NO: 5163683 - DNA, 15 bp, Homo sapiens
actgaattatgaaac

SEQ ID NO: 5163684 - DNA, 20 bp, Homo sapiens
actgaattatgaaacttttg

SEQ ID NO: 5163685 - DNA, 13 bp, Homo sapiens
actgaattcaaat

SEQ ID NO: 5163686 - DNA, 14 bp, Homo sapiens
actgaattcactcc

SEQ ID NO: 5163687 - DNA, 12 bp, Homo sapiens
actgaattccaa

SEQ ID NO: 5163688 - DNA, 21 bp, Homo sapiens
actgaattccaaacatggttt

SEQ ID NO: 5163689 - DNA, 19 bp, Homo sapiens
actgaattctgccttggtt

SEQ ID NO: 5163690 - DNA, 20 bp, Homo sapiens
actgaattgctatcatttgg

SEQ ID NO: 5163691 - DNA, 21 bp, Homo sapiens
actgaattgttatgtaaacat

SEQ ID NO: 5163692 - DNA, 17 bp, Homo sapiens
actgaatttattgccgc

SEQ ID NO: 5163693 - DNA, 13 bp, Homo sapiens
actgaatttcttt

SEQ ID NO: 5163694 - DNA, 14 bp, Homo sapiens
actgaatttgctaa

SEQ ID NO: 5163695 - DNA, 16 bp, Homo sapiens
actgaatttgggcctc

SEQ ID NO: 5163696 - DNA, 15 bp, Homo sapiens
actgaattttgggac

SEQ ID NO: 5163697 - DNA, 15 bp, Homo sapiens
actgaatttttatgt

SEQ ID NO: 5163698 - DNA, 16 bp, Homo sapiens
actgaatttttatgtg

SEQ ID NO: 5163699 - DNA, 19 bp, Homo sapiens
actgaatttttatgtgtga

SEQ ID NO: 5163700 - DNA, 18 bp, Homo sapiens
actgaatttttttgtaat

SEQ ID NO: 5163701 - DNA, 20 bp, Homo sapiens
actgaatttttttgtaataa

SEQ ID NO: 5163702 - DNA, 19 bp, Homo sapiens
actgacaaacgtccccagc

SEQ ID NO: 5163703 - DNA, 18 bp, Homo sapiens
actgacaacgaaagtaaa

SEQ ID NO: 5163704 - DNA, 16 bp, Homo sapiens
actgacaagatggaaa

SEQ ID NO: 5163705 - DNA, 20 bp, Homo sapiens
actgacaagttacccctgaa

SEQ ID NO: 5163706 - DNA, 19 bp, Homo sapiens
actgacaatgaagggaaat

SEQ ID NO: 5163707 - DNA, 13 bp, Homo sapiens
actgacacaaagg

SEQ ID NO: 5163708 - DNA, 14 bp, Homo sapiens
actgacacaaagga

SEQ ID NO: 5163709 - DNA, 21 bp, Homo sapiens
actgacacaggaaaccaacac

SEQ ID NO: 5163710 - DNA, 19 bp, Homo sapiens
actgacacaggccagcccc

SEQ ID NO: 5163711 - DNA, 21 bp, Homo sapiens
actgacacaggccagccccat

SEQ ID NO: 5163712 - DNA, 15 bp, Homo sapiens
actgacacatcagca

SEQ ID NO: 5163713 - DNA, 21 bp, Homo sapiens
actgacacatcagcatgtttt

SEQ ID NO: 5163714 - DNA, 21 bp, Homo sapiens
actgacacccatgtttctctg

SEQ ID NO: 5163715 - DNA, 17 bp, Homo sapiens
actgacacctcactgag

SEQ ID NO: 5163716 - DNA, 20 bp, Homo sapiens
actgacactcccacccagtc

SEQ ID NO: 5163717 - DNA, 18 bp, Homo sapiens
actgacacttcctgtcct

SEQ ID NO: 5163718 - DNA, 14 bp, Homo sapiens
actgacagaaagca

SEQ ID NO: 5163719 - DNA, 22 bp, Homo sapiens
actgacagcctccaccttgagc

SEQ ID NO: 5163720 - DNA, 16 bp, Homo sapiens
actgacagcctttgat

SEQ ID NO: 5163721 - DNA, 21 bp, Homo sapiens
actgacaggcagcctggacat

SEQ ID NO: 5163722 - DNA, 22 bp, Homo sapiens
actgacagggcccagttaaata

SEQ ID NO: 5163723 - DNA, 23 bp, Homo sapiens
actgacagggcccagttaaatat

SEQ ID NO: 5163724 - DNA, 12 bp, Homo sapiens
actgacatcaga

SEQ ID NO: 5163725 - DNA, 20 bp, Homo sapiens
actgacatcagatttcttaa

SEQ ID NO: 5163726 - DNA, 17 bp, Homo sapiens
actgacatgccctccct

SEQ ID NO: 5163727 - DNA, 15 bp, Homo sapiens
actgacatggtgctg

SEQ ID NO: 5163728 - DNA, 19 bp, Homo sapiens
acttcaagatgagcctggg

SEQ ID NO: 5163729 - DNA, 17 bp, Homo sapiens
acttcaagatgcctctt

SEQ ID NO: 5163730 - DNA, 18 bp, Homo sapiens
acttcaagctcaccctgc

SEQ ID NO: 5163731 - DNA, 14 bp, Homo sapiens
acttcaaggaaaat

SEQ ID NO: 5163732 - DNA, 24 bp, Homo sapiens
acttcaagtaatacgttttgacat

SEQ ID NO: 5163733 - DNA, 16 bp, Homo sapiens
acttcaagttaaagtg

SEQ ID NO: 5163734 - DNA, 19 bp, Homo sapiens
acttcaataattgtccatg

SEQ ID NO: 5163735 - DNA, 15 bp, Homo sapiens
acttcaatgatagta

SEQ ID NO: 5163736 - DNA, 20 bp, Homo sapiens
acttcaatgggagtgaacat

SEQ ID NO: 5163737 - DNA, 14 bp, Homo sapiens
acttcaattaatgc

SEQ ID NO: 5163738 - DNA, 16 bp, Homo sapiens
acttcacacacaggca

SEQ ID NO: 5163739 - DNA, 19 bp, Homo sapiens
acttcacacacaggcaact

SEQ ID NO: 5163740 - DNA, 12 bp, Homo sapiens
acttcacactga

SEQ ID NO: 5163741 - DNA, 15 bp, Homo sapiens
acttcacagcgtctg

SEQ ID NO: 5163742 - DNA, 18 bp, Homo sapiens
acttcacagctggaccct

SEQ ID NO: 5163743 - DNA, 16 bp, Homo sapiens
acttcacagctggaga

SEQ ID NO: 5163744 - DNA, 22 bp, Homo sapiens
acttcacagtgacactggacca

SEQ ID NO: 5163745 - DNA, 21 bp, Homo sapiens
acttcaccaccccctgtccca

SEQ ID NO: 5163746 - DNA, 17 bp, Homo sapiens
acttcacccggctgggc

SEQ ID NO: 5163747 - DNA, 16 bp, Homo sapiens
acttcacctttcctct

SEQ ID NO: 5163748 - DNA, 16 bp, Homo sapiens
acttcacgcccttggc

SEQ ID NO: 5163749 - DNA, 13 bp, Homo sapiens
acttcactccaaa

SEQ ID NO: 5163750 - DNA, 20 bp, Homo sapiens
acttcactccaaagagaaac

SEQ ID NO: 5163751 - DNA, 15 bp, Homo sapiens
acttcactgaaagac

SEQ ID NO: 5163752 - DNA, 15 bp, Homo sapiens
acttcactggtgtac

SEQ ID NO: 5163753 - DNA, 11 bp, Homo sapiens
acttcactgta

SEQ ID NO: 5163754 - DNA, 12 bp, Homo sapiens
acttcactgtat

SEQ ID NO: 5163755 - DNA, 21 bp, Homo sapiens
acttcactgtatataaacata

SEQ ID NO: 5163756 - DNA, 13 bp, Homo sapiens
acttcactgtgct

SEQ ID NO: 5163757 - DNA, 21 bp, Homo sapiens
acttcactgtgctgttgttat

SEQ ID NO: 5163758 - DNA, 15 bp, Homo sapiens
acttcactttcatct

SEQ ID NO: 5163759 - DNA, 16 bp, Homo sapiens
acttcactttcatctg

SEQ ID NO: 5163760 - DNA, 20 bp, Homo sapiens
acttcagaacatgctggata

SEQ ID NO: 5163761 - DNA, 16 bp, Homo sapiens
acttcagaaggcctca

SEQ ID NO: 5163762 - DNA, 19 bp, Homo sapiens
acttcagactgaacatgta

SEQ ID NO: 5163763 - DNA, 13 bp, Homo sapiens
acttcagagaagt

SEQ ID NO: 5163764 - DNA, 14 bp, Homo sapiens
acttcagagaagtc

SEQ ID NO: 5163765 - DNA, 16 bp, Homo sapiens
acttcagagagctggt

SEQ ID NO: 5163766 - DNA, 22 bp, Homo sapiens
acttcagatacttgtgaacatg

SEQ ID NO: 5163767 - DNA, 15 bp, Homo sapiens
acttcagatgtttcc

SEQ ID NO: 5163768 - DNA, 17 bp, Homo sapiens
acttcagatgtttccaa

SEQ ID NO: 5163769 - DNA, 22 bp, Homo sapiens
acttcagatgtttccaagatgt

SEQ ID NO: 5163770 - DNA, 16 bp, Homo sapiens
acttcagcaagctaga

SEQ ID NO: 5163771 - DNA, 16 bp, Homo sapiens
acttcagcattgtaat

SEQ ID NO: 5163772 - DNA, 11 bp, Homo sapiens
acttcagccac

SEQ ID NO: 5163773 - DNA, 13 bp, Homo sapiens
acttcagcccagc

SEQ ID NO: 5163774 - DNA, 15 bp, Homo sapiens
acttcagctgcctga

SEQ ID NO: 5163775 - DNA, 20 bp, Homo sapiens
acttcagctgcctgaaacag

SEQ ID NO: 5163776 - DNA, 16 bp, Homo sapiens
acttcaggaacaagta

SEQ ID NO: 5163777 - DNA, 17 bp, Homo sapiens
acttcaggccaacaagg

SEQ ID NO: 5163778 - DNA, 18 bp, Homo sapiens
acttcaggcttgataata

SEQ ID NO: 5163779 - DNA, 20 bp, Homo sapiens
acttcagggaaggtgaaaca

SEQ ID NO: 5163780 - DNA, 19 bp, Homo sapiens
acttcagggcagattttag

SEQ ID NO: 5163781 - DNA, 21 bp, Homo sapiens
acttcagggcagattttagtt

SEQ ID NO: 5163782 - DNA, 19 bp, Homo sapiens
acttcaggggatgggtgtg

SEQ ID NO: 5163783 - DNA, 22 bp, Homo sapiens
acttcagggttctcctctcccc

SEQ ID NO: 5163784 - DNA, 23 bp, Homo sapiens
acttcaggtaaaaacttcattag

SEQ ID NO: 5163785 - DNA, 18 bp, Homo sapiens
acttcaggtccgtgggcc

SEQ ID NO: 5163786 - DNA, 12 bp, Homo sapiens
acttcaggtgct

SEQ ID NO: 5163787 - DNA, 17 bp, Homo sapiens
acttcaggtgcttttga

SEQ ID NO: 5163788 - DNA, 17 bp, Homo sapiens
acttcaggttgttctgt

SEQ ID NO: 5163789 - DNA, 16 bp, Homo sapiens
acttcagtatgtgtca

SEQ ID NO: 5163790 - DNA, 17 bp, Homo sapiens
acttcagtatgttgtca

SEQ ID NO: 5163791 - DNA, 16 bp, Homo sapiens
acttcagtcctggtct

SEQ ID NO: 5163792 - DNA, 12 bp, Homo sapiens
acttcagtctgt

SEQ ID NO: 5163793 - DNA, 14 bp, Homo sapiens
acttcagtcttgga

SEQ ID NO: 5163794 - DNA, 22 bp, Homo sapiens
acttcagtgcaagagactttgt

SEQ ID NO: 5163795 - DNA, 23 bp, Homo sapiens
acttcagtgcacctgtggcctct

SEQ ID NO: 5163796 - DNA, 22 bp, Homo sapiens
acttcagtgtggtacaaggtgg

SEQ ID NO: 5163797 - DNA, 15 bp, Homo sapiens
acttcagttctcatc

SEQ ID NO: 5163798 - DNA, 20 bp, Homo sapiens
acttcagttctcatcttgta

SEQ ID NO: 5163799 - DNA, 18 bp, Homo sapiens
acttcagttgtggcctca

SEQ ID NO: 5163800 - DNA, 22 bp, Homo sapiens
acttcagtttcacagaaaataa

SEQ ID NO: 5163801 - DNA, 17 bp, Homo sapiens
acttcagttttactgca

SEQ ID NO: 5163802 - DNA, 20 bp, Homo sapiens
acttcagttttactgcattt

SEQ ID NO: 5163803 - DNA, 13 bp, Homo sapiens
acttcagttttat

SEQ ID NO: 5163804 - DNA, 13 bp, Homo sapiens
acttcataaaact

SEQ ID NO: 5163805 - DNA, 19 bp, Homo sapiens
acttcataagatattcttt

SEQ ID NO: 5163806 - DNA, 17 bp, Homo sapiens
acttcatactggcagga

SEQ ID NO: 5163807 - DNA, 15 bp, Homo sapiens
acttcatagatgaga

SEQ ID NO: 5163808 - DNA, 17 bp, Homo sapiens
acttcatagatttcctt

SEQ ID NO: 5163809 - DNA, 12 bp, Homo sapiens
acttcatatcta

SEQ ID NO: 5163810 - DNA, 19 bp, Homo sapiens
acttcatatctagatttct

SEQ ID NO: 5163811 - DNA, 17 bp, Homo sapiens
acttcatattaatataa

SEQ ID NO: 5163812 - DNA, 19 bp, Homo sapiens
acttcatcaaaatcatgga

SEQ ID NO: 5163813 - DNA, 14 bp, Homo sapiens
acttcatcaatcaa

SEQ ID NO: 5163814 - DNA, 20 bp, Homo sapiens
acttcatcaatcaaatattt

SEQ ID NO: 5163815 - DNA, 17 bp, Homo sapiens
acttcatcccagctgct

SEQ ID NO: 5163816 - DNA, 13 bp, Homo sapiens
acttcatctgcca

SEQ ID NO: 5163817 - DNA, 21 bp, Homo sapiens
acttcatctggctgcctttgc

SEQ ID NO: 5163818 - DNA, 16 bp, Homo sapiens
acttcatcttctcagc

SEQ ID NO: 5163819 - DNA, 16 bp, Homo sapiens
acttcatgcaggtgaa

SEQ ID NO: 5163820 - DNA, 17 bp, Homo sapiens
acttcatgcccactgcc

SEQ ID NO: 5163821 - DNA, 18 bp, Homo sapiens
acttcatgctgtctgtgt

SEQ ID NO: 5163822 - DNA, 18 bp, Homo sapiens
acttcatggaccaagaat

SEQ ID NO: 5163823 - DNA, 13 bp, Homo sapiens
acttcatgtaaag

SEQ ID NO: 5163824 - DNA, 23 bp, Homo sapiens
acttcatgtaattttattttaaa

SEQ ID NO: 5163825 - DNA, 20 bp, Homo sapiens
acttcattaatttcaatcaa

SEQ ID NO: 5163826 - DNA, 16 bp, Homo sapiens
acttcattagcaagtg

SEQ ID NO: 5163827 - DNA, 16 bp, Homo sapiens
acttcattccagcagc

SEQ ID NO: 5163828 - DNA, 17 bp, Homo sapiens
acttcattccagcagct

SEQ ID NO: 5163829 - DNA, 18 bp, Homo sapiens
acttcattccagcagctg

SEQ ID NO: 5163830 - DNA, 19 bp, Homo sapiens
acttcattctaaaccaaaa

SEQ ID NO: 5163831 - DNA, 22 bp, Homo sapiens
acttcattctaaaccaaaacag

SEQ ID NO: 5163832 - DNA, 19 bp, Homo sapiens
acttcattcttgaaagctg

SEQ ID NO: 5163833 - DNA, 15 bp, Homo sapiens
acttcattctttata

SEQ ID NO: 5163834 - DNA, 15 bp, Homo sapiens
acttcattgtccctc

SEQ ID NO: 5163835 - DNA, 21 bp, Homo sapiens
acttcattgtttggacctgca

SEQ ID NO: 5163836 - DNA, 15 bp, Homo sapiens
acttcatttctgatg

SEQ ID NO: 5163837 - DNA, 18 bp, Homo sapiens
acttcatttgtgccacac

SEQ ID NO: 5163838 - DNA, 15 bp, Homo sapiens
acttcattttatatt

SEQ ID NO: 5163839 - DNA, 17 bp, Homo sapiens
acttcattttcagagtg

SEQ ID NO: 5163840 - DNA, 14 bp, Homo sapiens
acttcattttgtat

SEQ ID NO: 5163841 - DNA, 16 bp, Homo sapiens
acttcatttttaagaa

SEQ ID NO: 5163842 - DNA, 15 bp, Homo sapiens
acttccaaaattctt

SEQ ID NO: 5163843 - DNA, 21 bp, Homo sapiens
acttccaaacagtgtgttggt

SEQ ID NO: 5163844 - DNA, 20 bp, Homo sapiens
acttccaaacctgacagatg

SEQ ID NO: 5163845 - DNA, 14 bp, Homo sapiens
acttccaaactaat

SEQ ID NO: 5163846 - DNA, 16 bp, Homo sapiens
acttccaaagaaagtt

SEQ ID NO: 5163847 - DNA, 15 bp, Homo sapiens
acttccaaagaatgt

SEQ ID NO: 5163848 - DNA, 23 bp, Homo sapiens
acttccaaagaatgttagagcac

SEQ ID NO: 5163849 - DNA, 19 bp, Homo sapiens
acttccaaagagtcatcat

SEQ ID NO: 5163850 - DNA, 12 bp, Homo sapiens
acttccaaagct

SEQ ID NO: 5163851 - DNA, 21 bp, Homo sapiens
acttccaaatcccctaagcag

SEQ ID NO: 5163852 - DNA, 22 bp, Homo sapiens
acttccaaggccctgctttttt

SEQ ID NO: 5163853 - DNA, 22 bp, Homo sapiens
acttccacaagagtgaatttga

SEQ ID NO: 5163854 - DNA, 18 bp, Homo sapiens
acttccacagcagcagaa

SEQ ID NO: 5163855 - DNA, 16 bp, Homo sapiens
acttccacagggtccc

SEQ ID NO: 5163856 - DNA, 13 bp, Homo sapiens
acttccacatttt

SEQ ID NO: 5163857 - DNA, 15 bp, Homo sapiens
acttccaccagcctg

SEQ ID NO: 5163858 - DNA, 18 bp, Homo sapiens
acttccaccagcctgcac

SEQ ID NO: 5163859 - DNA, 19 bp, Homo sapiens
acttccacccccagctcct

SEQ ID NO: 5163860 - DNA, 16 bp, Homo sapiens
acttccacctccagcc

SEQ ID NO: 5163861 - DNA, 18 bp, Homo sapiens
acttccacctccagcctc

SEQ ID NO: 5163862 - DNA, 19 bp, Homo sapiens
acttccacctccagcctct

SEQ ID NO: 5163863 - DNA, 17 bp, Homo sapiens
acttccactgccatcct

SEQ ID NO: 5163864 - DNA, 23 bp, Homo sapiens
acttccactgttaaaataaagct

SEQ ID NO: 5163865 - DNA, 20 bp, Homo sapiens
acttccacttgtgtatattt

SEQ ID NO: 5163866 - DNA, 21 bp, Homo sapiens
acttccagcaaaatccaaact

SEQ ID NO: 5163867 - DNA, 18 bp, Homo sapiens
acttccagcttgcctgtt

SEQ ID NO: 5163868 - DNA, 14 bp, Homo sapiens
acttccagctttct

SEQ ID NO: 5163869 - DNA, 19 bp, Homo sapiens
acttccaggaaagtgtgaa

SEQ ID NO: 5163870 - DNA, 21 bp, Homo sapiens
acttccaggaaagtgtgaaga

SEQ ID NO: 5163871 - DNA, 18 bp, Homo sapiens
acttccaggggaacctgc

SEQ ID NO: 5163872 - DNA, 21 bp, Homo sapiens
acttccaggggaacctgccat

SEQ ID NO: 5163873 - DNA, 13 bp, Homo sapiens
acttccagtctgg

SEQ ID NO: 5163874 - DNA, 13 bp, Homo sapiens
acttccagtggct

SEQ ID NO: 5163875 - DNA, 17 bp, Homo sapiens
acttccataatctggac

SEQ ID NO: 5163876 - DNA, 17 bp, Homo sapiens
acttccatacagctcta

SEQ ID NO: 5163877 - DNA, 16 bp, Homo sapiens
acttccatccctgctt

SEQ ID NO: 5163878 - DNA, 17 bp, Homo sapiens
acttccatgaggccaaa

SEQ ID NO: 5163879 - DNA, 16 bp, Homo sapiens
acttccatgatacttt

SEQ ID NO: 5163880 - DNA, 19 bp, Homo sapiens
acttccatgatactttaat

SEQ ID NO: 5163881 - DNA, 14 bp, Homo sapiens
acttccatgcctta

SEQ ID NO: 5163882 - DNA, 20 bp, Homo sapiens
acttccatgccttaaaccta

SEQ ID NO: 5163883 - DNA, 15 bp, Homo sapiens
acttccattctttct

SEQ ID NO: 5163884 - DNA, 22 bp, Homo sapiens
acttccattctttcttcctcca

SEQ ID NO: 5163885 - DNA, 21 bp, Homo sapiens
acttccattggttcttccttt

SEQ ID NO: 5163886 - DNA, 11 bp, Homo sapiens
acttccatttg

SEQ ID NO: 5163887 - DNA, 14 bp, Homo sapiens
acttcccaacagcc

SEQ ID NO: 5163888 - DNA, 18 bp, Homo sapiens
acttcccaattgccacat

SEQ ID NO: 5163889 - DNA, 17 bp, Homo sapiens
acttcccacccccaggc

SEQ ID NO: 5163890 - DNA, 17 bp, Homo sapiens
acttcccaccctgcccc

SEQ ID NO: 5163891 - DNA, 20 bp, Homo sapiens
acttcccactctagggcagt

SEQ ID NO: 5163892 - DNA, 12 bp, Homo sapiens
acttcccagctg

SEQ ID NO: 5163893 - DNA, 14 bp, Homo sapiens
acttcccagctggc

SEQ ID NO: 5163894 - DNA, 15 bp, Homo sapiens
acttcccagctggca

SEQ ID NO: 5163895 - DNA, 20 bp, Homo sapiens
acttcccagctggcagcgcc

SEQ ID NO: 5163896 - DNA, 24 bp, Homo sapiens
acttcccaggatctgctccaacag

SEQ ID NO: 5163897 - DNA, 14 bp, Homo sapiens
acttcccaggccga

SEQ ID NO: 5163898 - DNA, 17 bp, Homo sapiens
acttcccagtgaattct

SEQ ID NO: 5163899 - DNA, 22 bp, Homo sapiens
acttcccagttcaggagtccca

SEQ ID NO: 5163900 - DNA, 13 bp, Homo sapiens
acttcccatctcc

SEQ ID NO: 5163901 - DNA, 19 bp, Homo sapiens
acttcccatctccagggaa

SEQ ID NO: 5163902 - DNA, 22 bp, Homo sapiens
acttcccattaaaaatgagatt

SEQ ID NO: 5163903 - DNA, 19 bp, Homo sapiens
acttcccattttggaagtt

SEQ ID NO: 5163904 - DNA, 19 bp, Homo sapiens
acttccccaagatctgcca

SEQ ID NO: 5163905 - DNA, 19 bp, Homo sapiens
acttccccaagcctggcag

SEQ ID NO: 5163906 - DNA, 21 bp, Homo sapiens
acttccccaagcctggcaggg

SEQ ID NO: 5163907 - DNA, 17 bp, Homo sapiens
actgacatggtgctgtg

SEQ ID NO: 5163908 - DNA, 22 bp, Homo sapiens
actgacatgtggggccaggtca

SEQ ID NO: 5163909 - DNA, 18 bp, Homo sapiens
actgacatgtttcacaac

SEQ ID NO: 5163910 - DNA, 18 bp, Homo sapiens
actgacattgttggccaa

SEQ ID NO: 5163911 - DNA, 22 bp, Homo sapiens
actgacatttcacttcctcgct

SEQ ID NO: 5163912 - DNA, 22 bp, Homo sapiens
actgaccaaagactgcagaacc

SEQ ID NO: 5163913 - DNA, 23 bp, Homo sapiens
actgaccaaagactgcagaaccc

SEQ ID NO: 5163914 - DNA, 22 bp, Homo sapiens
actgaccaatattgtacagttt

SEQ ID NO: 5163915 - DNA, 20 bp, Homo sapiens
actgaccagcctccatgctg

SEQ ID NO: 5163916 - DNA, 15 bp, Homo sapiens
actgacccacagcct

SEQ ID NO: 5163917 - DNA, 14 bp, Homo sapiens
actgacccacctgc

SEQ ID NO: 5163918 - DNA, 19 bp, Homo sapiens
actgacccactcggatgga

SEQ ID NO: 5163919 - DNA, 18 bp, Homo sapiens
actgacccattcacattt

SEQ ID NO: 5163920 - DNA, 21 bp, Homo sapiens
actgaccccccccattagaat

SEQ ID NO: 5163921 - DNA, 15 bp, Homo sapiens
actgaccctcaggca

SEQ ID NO: 5163922 - DNA, 23 bp, Homo sapiens
actgaccctcggcctctactttg

SEQ ID NO: 5163923 - DNA, 19 bp, Homo sapiens
actgaccctgaggaggccg

SEQ ID NO: 5163924 - DNA, 22 bp, Homo sapiens
actgaccctgcaggttgttcat

SEQ ID NO: 5163925 - DNA, 23 bp, Homo sapiens
actgaccgccgcttccagcttcc

SEQ ID NO: 5163926 - DNA, 17 bp, Homo sapiens
actgaccggaggcaaaa

SEQ ID NO: 5163927 - DNA, 21 bp, Homo sapiens
actgacctgagcggcaccctg

SEQ ID NO: 5163928 - DNA, 13 bp, Homo sapiens
actgacctgccca

SEQ ID NO: 5163929 - DNA, 13 bp, Homo sapiens
actgacctgcccc

SEQ ID NO: 5163930 - DNA, 21 bp, Homo sapiens
actgacctggtccacagggca

SEQ ID NO: 5163931 - DNA, 22 bp, Homo sapiens
actgacctggtccacagggcac

SEQ ID NO: 5163932 - DNA, 21 bp, Homo sapiens
actgacctggttgtccaggtc

SEQ ID NO: 5163933 - DNA, 21 bp, Homo sapiens
actgacctgtcatgcccccct

SEQ ID NO: 5163934 - DNA, 20 bp, Homo sapiens
actgaccttcggcagtggct

SEQ ID NO: 5163935 - DNA, 21 bp, Homo sapiens
actgaccttcggcagtggctg

SEQ ID NO: 5163936 - DNA, 22 bp, Homo sapiens
actgaccttcggcagtggctgg

SEQ ID NO: 5163937 - DNA, 19 bp, Homo sapiens
actgaccttgactactcag

SEQ ID NO: 5163938 - DNA, 20 bp, Homo sapiens
actgaccttggagagacaca

SEQ ID NO: 5163939 - DNA, 14 bp, Homo sapiens
actgacgaaagagt

SEQ ID NO: 5163940 - DNA, 19 bp, Homo sapiens
actgacgctggagatgcaa

SEQ ID NO: 5163941 - DNA, 16 bp, Homo sapiens
actgacggctgtgtat

SEQ ID NO: 5163942 - DNA, 21 bp, Homo sapiens
actgacggctgtgtatttctg

SEQ ID NO: 5163943 - DNA, 15 bp, Homo sapiens
actgacgtcctccct

SEQ ID NO: 5163944 - DNA, 15 bp, Homo sapiens
actgacgtttctggg

SEQ ID NO: 5163945 - DNA, 18 bp, Homo sapiens
actgactaggattctgca

SEQ ID NO: 5163946 - DNA, 12 bp, Homo sapiens
actgactatatt

SEQ ID NO: 5163947 - DNA, 22 bp, Homo sapiens
actgactattcttgatgtaaaa

SEQ ID NO: 5163948 - DNA, 23 bp, Homo sapiens
actgactcacattgccttgagct

SEQ ID NO: 5163949 - DNA, 23 bp, Homo sapiens
actgactcccattttggtgtgca

SEQ ID NO: 5163950 - DNA, 12 bp, Homo sapiens
actgactctgga

SEQ ID NO: 5163951 - DNA, 19 bp, Homo sapiens
actgactgagataagaaaa

SEQ ID NO: 5163952 - DNA, 12 bp, Homo sapiens
actgactgaggc

SEQ ID NO: 5163953 - DNA, 15 bp, Homo sapiens
actgactgaggcagt

SEQ ID NO: 5163954 - DNA, 21 bp, Homo sapiens
actgactgaggcagtttgagg

SEQ ID NO: 5163955 - DNA, 22 bp, Homo sapiens
actgactgatagcttacactga

SEQ ID NO: 5163956 - DNA, 13 bp, Homo sapiens
actgactgcagcc

SEQ ID NO: 5163957 - DNA, 16 bp, Homo sapiens
actgactgcagccccc

SEQ ID NO: 5163958 - DNA, 15 bp, Homo sapiens
actgactgcagggac

SEQ ID NO: 5163959 - DNA, 17 bp, Homo sapiens
actgactgcttataaac

SEQ ID NO: 5163960 - DNA, 22 bp, Homo sapiens
actgactgtcgggctttaaaaa

SEQ ID NO: 5163961 - DNA, 20 bp, Homo sapiens
actgactgtgttgggcaaga

SEQ ID NO: 5163962 - DNA, 13 bp, Homo sapiens
actgacttaggtt

SEQ ID NO: 5163963 - DNA, 15 bp, Homo sapiens
actgacttcagtggg

SEQ ID NO: 5163964 - DNA, 16 bp, Homo sapiens
actgacttcagtggga

SEQ ID NO: 5163965 - DNA, 16 bp, Homo sapiens
actgacttcatttgtg

SEQ ID NO: 5163966 - DNA, 18 bp, Homo sapiens
actgacttctcccgggtc

SEQ ID NO: 5163967 - DNA, 13 bp, Homo sapiens
actgacttgagac

SEQ ID NO: 5163968 - DNA, 15 bp, Homo sapiens
actgacttgctcacc

SEQ ID NO: 5163969 - DNA, 20 bp, Homo sapiens
actgacttgtttgtcttcca

SEQ ID NO: 5163970 - DNA, 14 bp, Homo sapiens
actgactttaagta

SEQ ID NO: 5163971 - DNA, 17 bp, Homo sapiens
actgactttaagtaatc

SEQ ID NO: 5163972 - DNA, 13 bp, Homo sapiens
actgactttgctt

SEQ ID NO: 5163973 - DNA, 13 bp, Homo sapiens
actgactttttaa

SEQ ID NO: 5163974 - DNA, 19 bp, Homo sapiens
actgagaaagaggcaggga

SEQ ID NO: 5163975 - DNA, 23 bp, Homo sapiens
actgagaaatagtgcactccaag

SEQ ID NO: 5163976 - DNA, 14 bp, Homo sapiens
actgagaacctgat

SEQ ID NO: 5163977 - DNA, 12 bp, Homo sapiens
actgagaacttt

SEQ ID NO: 5163978 - DNA, 15 bp, Homo sapiens
actgagaagatggca

SEQ ID NO: 5163979 - DNA, 15 bp, Homo sapiens
actgagaatatacaa

SEQ ID NO: 5163980 - DNA, 19 bp, Homo sapiens
actgagaatgtaagaacta

SEQ ID NO: 5163981 - DNA, 21 bp, Homo sapiens
actgagaatttgtgtggatat

SEQ ID NO: 5163982 - DNA, 13 bp, Homo sapiens
actgagaattttc

SEQ ID NO: 5163983 - DNA, 20 bp, Homo sapiens
actgagacagatgggactta

SEQ ID NO: 5163984 - DNA, 22 bp, Homo sapiens
actgagacagccacttggtttt

SEQ ID NO: 5163985 - DNA, 20 bp, Homo sapiens
actgagacaggcagtttcag

SEQ ID NO: 5163986 - DNA, 15 bp, Homo sapiens
actgagaccaaagaa

SEQ ID NO: 5163987 - DNA, 17 bp, Homo sapiens
actgagaccaagtctct

SEQ ID NO: 5163988 - DNA, 14 bp, Homo sapiens
actgagagaaggtg

SEQ ID NO: 5163989 - DNA, 16 bp, Homo sapiens
actgagagatctgctg

SEQ ID NO: 5163990 - DNA, 16 bp, Homo sapiens
actgagagcagatggt

SEQ ID NO: 5163991 - DNA, 15 bp, Homo sapiens
actgagagccttttt

SEQ ID NO: 5163992 - DNA, 14 bp, Homo sapiens
actgagagctgcct

SEQ ID NO: 5163993 - DNA, 21 bp, Homo sapiens
actgagaggacagagagaaat

SEQ ID NO: 5163994 - DNA, 21 bp, Homo sapiens
actgagagggcaaggaagtgg

SEQ ID NO: 5163995 - DNA, 23 bp, Homo sapiens
actgagagggcaatctttgcctt

SEQ ID NO: 5163996 - DNA, 24 bp, Homo sapiens
actgagagtaattcatctgtgaat

SEQ ID NO: 5163997 - DNA, 19 bp, Homo sapiens
actgagagtgcaaattgta

SEQ ID NO: 5163998 - DNA, 13 bp, Homo sapiens
actgagataagaa

SEQ ID NO: 5163999 - DNA, 15 bp, Homo sapiens
actgagataagaaaa

SEQ ID NO: 5164000 - DNA, 19 bp, Homo sapiens
actgagatcactgactctg

SEQ ID NO: 5164001 - DNA, 16 bp, Homo sapiens
actgagatgctgggct

SEQ ID NO: 5164002 - DNA, 18 bp, Homo sapiens
actgagatgctgggctgt

SEQ ID NO: 5164003 - DNA, 18 bp, Homo sapiens
actgagatgttttaccat

SEQ ID NO: 5164004 - DNA, 23 bp, Homo sapiens
actgagatttgtaaatctttgtg

SEQ ID NO: 5164005 - DNA, 20 bp, Homo sapiens
actgagcaacgctattccag

SEQ ID NO: 5164006 - DNA, 13 bp, Homo sapiens
actgagcagactg

SEQ ID NO: 5164007 - DNA, 23 bp, Homo sapiens
actgagcagactggtgagcagac

SEQ ID NO: 5164008 - DNA, 18 bp, Homo sapiens
actgagcaggctgtgggg

SEQ ID NO: 5164009 - DNA, 15 bp, Homo sapiens
actgagcatcacaat

SEQ ID NO: 5164010 - DNA, 21 bp, Homo sapiens
actgagcatcacaataaagag

SEQ ID NO: 5164011 - DNA, 19 bp, Homo sapiens
actgagccaaacacactgt

SEQ ID NO: 5164012 - DNA, 21 bp, Homo sapiens
actgagccaaacacactgtaa

SEQ ID NO: 5164013 - DNA, 22 bp, Homo sapiens
actgagccaaacacactgtaaa

SEQ ID NO: 5164014 - DNA, 15 bp, Homo sapiens
actgagccatcattt

SEQ ID NO: 5164015 - DNA, 16 bp, Homo sapiens
actgagccatcatttc

SEQ ID NO: 5164016 - DNA, 12 bp, Homo sapiens
actgagccccag

SEQ ID NO: 5164017 - DNA, 13 bp, Homo sapiens
actgagccccagc

SEQ ID NO: 5164018 - DNA, 14 bp, Homo sapiens
actgagccccagcg

SEQ ID NO: 5164019 - DNA, 11 bp, Homo sapiens
actgagccccc

SEQ ID NO: 5164020 - DNA, 13 bp, Homo sapiens
actgagcccccac

SEQ ID NO: 5164021 - DNA, 15 bp, Homo sapiens
actgagcccccccaa

SEQ ID NO: 5164022 - DNA, 14 bp, Homo sapiens
actgagccccgcag

SEQ ID NO: 5164023 - DNA, 20 bp, Homo sapiens
actgagccccgcagacctcc

SEQ ID NO: 5164024 - DNA, 21 bp, Homo sapiens
actgagccccgcagacctccc

SEQ ID NO: 5164025 - DNA, 19 bp, Homo sapiens
actgagccgtgcagctggg

SEQ ID NO: 5164026 - DNA, 23 bp, Homo sapiens
actgagcctcttttcaattattt

SEQ ID NO: 5164027 - DNA, 15 bp, Homo sapiens
actgagcgaggaaaa

SEQ ID NO: 5164028 - DNA, 19 bp, Homo sapiens
actgagcgaggaaaaacaa

SEQ ID NO: 5164029 - DNA, 20 bp, Homo sapiens
actgagcgaggaaaaacaac

SEQ ID NO: 5164030 - DNA, 23 bp, Homo sapiens
actgagcgaggaaaaacaacaaa

SEQ ID NO: 5164031 - DNA, 20 bp, Homo sapiens
actgagcggccgcagagact

SEQ ID NO: 5164032 - DNA, 22 bp, Homo sapiens
actgagcgtgttttataaaaaa

SEQ ID NO: 5164033 - DNA, 13 bp, Homo sapiens
actgagctcctct

SEQ ID NO: 5164034 - DNA, 14 bp, Homo sapiens
actgagctcctctg

SEQ ID NO: 5164035 - DNA, 19 bp, Homo sapiens
actgagctcctctgggcag

SEQ ID NO: 5164036 - DNA, 15 bp, Homo sapiens
actgagctctccagg

SEQ ID NO: 5164037 - DNA, 18 bp, Homo sapiens
actgagctctccaggcca

SEQ ID NO: 5164038 - DNA, 20 bp, Homo sapiens
actgagctctccaggccagg

SEQ ID NO: 5164039 - DNA, 14 bp, Homo sapiens
actgagctctgcct

SEQ ID NO: 5164040 - DNA, 17 bp, Homo sapiens
actgagctctgcctcaa

SEQ ID NO: 5164041 - DNA, 12 bp, Homo sapiens
actgagctgaga

SEQ ID NO: 5164042 - DNA, 13 bp, Homo sapiens
actgagctgggga

SEQ ID NO: 5164043 - DNA, 15 bp, Homo sapiens
actgagctggggagg

SEQ ID NO: 5164044 - DNA, 23 bp, Homo sapiens
actgagctgtccagtggagggct

SEQ ID NO: 5164045 - DNA, 18 bp, Homo sapiens
actgagctgtgacccaga

SEQ ID NO: 5164046 - DNA, 17 bp, Homo sapiens
actgagcttctctgtga

SEQ ID NO: 5164047 - DNA, 16 bp, Homo sapiens
actgagcttctgagac

SEQ ID NO: 5164048 - DNA, 18 bp, Homo sapiens
actgaggaacctgagact

SEQ ID NO: 5164049 - DNA, 13 bp, Homo sapiens
actgaggaagaac

SEQ ID NO: 5164050 - DNA, 22 bp, Homo sapiens
actgaggaagaacggggctctt

SEQ ID NO: 5164051 - DNA, 16 bp, Homo sapiens
actgaggaattttctt

SEQ ID NO: 5164052 - DNA, 19 bp, Homo sapiens
actgaggacaaagtggagg

SEQ ID NO: 5164053 - DNA, 13 bp, Homo sapiens
actgaggacaggc

SEQ ID NO: 5164054 - DNA, 14 bp, Homo sapiens
actgaggagacaga

SEQ ID NO: 5164055 - DNA, 19 bp, Homo sapiens
actgaggagacagaaagcc

SEQ ID NO: 5164056 - DNA, 18 bp, Homo sapiens
actgaggagatgaccagg

SEQ ID NO: 5164057 - DNA, 23 bp, Homo sapiens
actgaggagatgaccagggatgc

SEQ ID NO: 5164058 - DNA, 17 bp, Homo sapiens
actgaggagcaaagcag

SEQ ID NO: 5164059 - DNA, 14 bp, Homo sapiens
actgaggatcagag

SEQ ID NO: 5164060 - DNA, 12 bp, Homo sapiens
actgaggatttc

SEQ ID NO: 5164061 - DNA, 13 bp, Homo sapiens
actgaggcagaca

SEQ ID NO: 5164062 - DNA, 22 bp, Homo sapiens
actgaggcagacagcagctcag

SEQ ID NO: 5164063 - DNA, 12 bp, Homo sapiens
actgaggcaggg

SEQ ID NO: 5164064 - DNA, 20 bp, Homo sapiens
actgaggcatttttactact

SEQ ID NO: 5164065 - DNA, 22 bp, Homo sapiens
actgaggcatttttactactat

SEQ ID NO: 5164066 - DNA, 19 bp, Homo sapiens
actgaggccatcagggccc

SEQ ID NO: 5164067 - DNA, 23 bp, Homo sapiens
actgaggccatcagggccctgcc

SEQ ID NO: 5164068 - DNA, 20 bp, Homo sapiens
actgaggcctgagacccagg

SEQ ID NO: 5164069 - DNA, 12 bp, Homo sapiens
actgaggcctgc

SEQ ID NO: 5164070 - DNA, 14 bp, Homo sapiens
actgaggcctgctt

SEQ ID NO: 5164071 - DNA, 15 bp, Homo sapiens
actgaggcctgcttc

SEQ ID NO: 5164072 - DNA, 21 bp, Homo sapiens
actgaggccttgtgtgtcagg

SEQ ID NO: 5164073 - DNA, 19 bp, Homo sapiens
actgaggcttagagagagg

SEQ ID NO: 5164074 - DNA, 22 bp, Homo sapiens
actgagggaccaactgggccca

SEQ ID NO: 5164075 - DNA, 20 bp, Homo sapiens
actgagggattttagcctct

SEQ ID NO: 5164076 - DNA, 13 bp, Homo sapiens
actgagggcagga

SEQ ID NO: 5164077 - DNA, 23 bp, Homo sapiens
actgagggcagtcgatagagctg

SEQ ID NO: 5164078 - DNA, 15 bp, Homo sapiens
actgagggcagtgcc

SEQ ID NO: 5164079 - DNA, 12 bp, Homo sapiens
actgagggccag

SEQ ID NO: 5164080 - DNA, 17 bp, Homo sapiens
actgaggggccagggag

SEQ ID NO: 5164081 - DNA, 21 bp, Homo sapiens
actgaggggtctccaggagga

SEQ ID NO: 5164082 - DNA, 14 bp, Homo sapiens
actgaggtataaag

SEQ ID NO: 5164083 - DNA, 20 bp, Homo sapiens
actgaggtatggccatgccc

SEQ ID NO: 5164084 - DNA, 22 bp, Homo sapiens
actgaggtatggccatgcccta

SEQ ID NO: 5164085 - DNA, 22 bp, Homo sapiens
acttccccaatatcttgcttga

SEQ ID NO: 5164086 - DNA, 20 bp, Homo sapiens
acttccccacaggtgaaagt

SEQ ID NO: 5164087 - DNA, 15 bp, Homo sapiens
acttccccaccccta

SEQ ID NO: 5164088 - DNA, 15 bp, Homo sapiens
acttccccatctgtg

SEQ ID NO: 5164089 - DNA, 16 bp, Homo sapiens
acttcccccaaattta

SEQ ID NO: 5164090 - DNA, 15 bp, Homo sapiens
acttcccccaccctg

SEQ ID NO: 5164091 - DNA, 21 bp, Homo sapiens
acttccccctcttcttctgaa

SEQ ID NO: 5164092 - DNA, 12 bp, Homo sapiens
acttcccctcct

SEQ ID NO: 5164093 - DNA, 17 bp, Homo sapiens
acttcccctcctacccc

SEQ ID NO: 5164094 - DNA, 20 bp, Homo sapiens
acttcccctctaactggaca

SEQ ID NO: 5164095 - DNA, 13 bp, Homo sapiens
acttcccctggga

SEQ ID NO: 5164096 - DNA, 15 bp, Homo sapiens
acttcccctgggatg

SEQ ID NO: 5164097 - DNA, 23 bp, Homo sapiens
acttcccctgggatgctgaccca

SEQ ID NO: 5164098 - DNA, 14 bp, Homo sapiens
acttccccttgcac

SEQ ID NO: 5164099 - DNA, 14 bp, Homo sapiens
acttccccttggga

SEQ ID NO: 5164100 - DNA, 19 bp, Homo sapiens
acttccccttgtctccctg

SEQ ID NO: 5164101 - DNA, 20 bp, Homo sapiens
acttcccgggaacgcttgct

SEQ ID NO: 5164102 - DNA, 20 bp, Homo sapiens
acttcccgggccagggctgc

SEQ ID NO: 5164103 - DNA, 18 bp, Homo sapiens
acttcccgtagctgccag

SEQ ID NO: 5164104 - DNA, 16 bp, Homo sapiens
acttcccgtctcagaa

SEQ ID NO: 5164105 - DNA, 17 bp, Homo sapiens
acttcccgtctcagaat

SEQ ID NO: 5164106 - DNA, 15 bp, Homo sapiens
acttccctagtcccc

SEQ ID NO: 5164107 - DNA, 12 bp, Homo sapiens
acttccctcagg

SEQ ID NO: 5164108 - DNA, 14 bp, Homo sapiens
acttccctgcaagg

SEQ ID NO: 5164109 - DNA, 22 bp, Homo sapiens
acttccctgctccaacccccgc

SEQ ID NO: 5164110 - DNA, 22 bp, Homo sapiens
acttccctgcttttctcccaga

SEQ ID NO: 5164111 - DNA, 10 bp, Homo sapiens
acttccctgg

SEQ ID NO: 5164112 - DNA, 18 bp, Homo sapiens
acttccctggaggagaag

SEQ ID NO: 5164113 - DNA, 11 bp, Homo sapiens
acttccctggc

SEQ ID NO: 5164114 - DNA, 13 bp, Homo sapiens
acttccctgggaa

SEQ ID NO: 5164115 - DNA, 22 bp, Homo sapiens
acttccctgggttagactgcca

SEQ ID NO: 5164116 - DNA, 13 bp, Homo sapiens
acttccctgttct

SEQ ID NO: 5164117 - DNA, 14 bp, Homo sapiens
acttccgctgaggg

SEQ ID NO: 5164118 - DNA, 14 bp, Homo sapiens
acttccgtcaccct

SEQ ID NO: 5164119 - DNA, 16 bp, Homo sapiens
acttccgttcattgct

SEQ ID NO: 5164120 - DNA, 20 bp, Homo sapiens
acttcctaaatattatgaga

SEQ ID NO: 5164121 - DNA, 22 bp, Homo sapiens
acttcctattaatttattaaat

SEQ ID NO: 5164122 - DNA, 14 bp, Homo sapiens
acttcctcaataaa

SEQ ID NO: 5164123 - DNA, 23 bp, Homo sapiens
acttcctccaatccccactcctc

SEQ ID NO: 5164124 - DNA, 15 bp, Homo sapiens
acttcctccacagtc

SEQ ID NO: 5164125 - DNA, 16 bp, Homo sapiens
acttcctccagaagcc

SEQ ID NO: 5164126 - DNA, 17 bp, Homo sapiens
acttcctccagaagcct

SEQ ID NO: 5164127 - DNA, 18 bp, Homo sapiens
acttcctccagaagcctc

SEQ ID NO: 5164128 - DNA, 17 bp, Homo sapiens
acttcctcccctcgccc

SEQ ID NO: 5164129 - DNA, 23 bp, Homo sapiens
acttcctcccctcgcccatcagt

SEQ ID NO: 5164130 - DNA, 14 bp, Homo sapiens
acttcctcctacct

SEQ ID NO: 5164131 - DNA, 15 bp, Homo sapiens
acttcctcctcccca

SEQ ID NO: 5164132 - DNA, 24 bp, Homo sapiens
acttcctctaggaaatgtacgata

SEQ ID NO: 5164133 - DNA, 13 bp, Homo sapiens
acttcctctccac

SEQ ID NO: 5164134 - DNA, 22 bp, Homo sapiens
acttcctctcgcggccctcagt

SEQ ID NO: 5164135 - DNA, 16 bp, Homo sapiens
acttcctctctacccc

SEQ ID NO: 5164136 - DNA, 19 bp, Homo sapiens
acttcctctctacccccca

SEQ ID NO: 5164137 - DNA, 23 bp, Homo sapiens
acttcctctctcggagccctcag

SEQ ID NO: 5164138 - DNA, 16 bp, Homo sapiens
acttcctctgtgaact

SEQ ID NO: 5164139 - DNA, 11 bp, Homo sapiens
acttcctgagg

SEQ ID NO: 5164140 - DNA, 20 bp, Homo sapiens
acttcctgagggatctatac

SEQ ID NO: 5164141 - DNA, 20 bp, Homo sapiens
acttcctgcagtgaatttga

SEQ ID NO: 5164142 - DNA, 21 bp, Homo sapiens
acttcctgccccaactgcagg

SEQ ID NO: 5164143 - DNA, 19 bp, Homo sapiens
acttcctgcctggtctcct

SEQ ID NO: 5164144 - DNA, 14 bp, Homo sapiens
acttcctgctacag

SEQ ID NO: 5164145 - DNA, 17 bp, Homo sapiens
acttcctgctacaggag

SEQ ID NO: 5164146 - DNA, 18 bp, Homo sapiens
acttcctgctacaggagg

SEQ ID NO: 5164147 - DNA, 20 bp, Homo sapiens
acttcctgctacagtagctg

SEQ ID NO: 5164148 - DNA, 12 bp, Homo sapiens
acttcctgctgc

SEQ ID NO: 5164149 - DNA, 13 bp, Homo sapiens
acttcctgctgca

SEQ ID NO: 5164150 - DNA, 17 bp, Homo sapiens
acttcctggattttctt

SEQ ID NO: 5164151 - DNA, 18 bp, Homo sapiens
acttcctggggccccgct

SEQ ID NO: 5164152 - DNA, 16 bp, Homo sapiens
acttcctgtaatgtac

SEQ ID NO: 5164153 - DNA, 12 bp, Homo sapiens
acttcctgtcca

SEQ ID NO: 5164154 - DNA, 18 bp, Homo sapiens
acttcctgtccagctcca

SEQ ID NO: 5164155 - DNA, 23 bp, Homo sapiens
acttcctgtccagctccaacctg

SEQ ID NO: 5164156 - DNA, 20 bp, Homo sapiens
acttcctgtggatgcaaata

SEQ ID NO: 5164157 - DNA, 16 bp, Homo sapiens
acttccttataaaaat

SEQ ID NO: 5164158 - DNA, 18 bp, Homo sapiens
acttccttataaaaattc

SEQ ID NO: 5164159 - DNA, 18 bp, Homo sapiens
acttccttatgcttcttt

SEQ ID NO: 5164160 - DNA, 15 bp, Homo sapiens
acttccttatttctg

SEQ ID NO: 5164161 - DNA, 14 bp, Homo sapiens
acttccttcctgcc

SEQ ID NO: 5164162 - DNA, 22 bp, Homo sapiens
acttccttgagacacggagccc

SEQ ID NO: 5164163 - DNA, 14 bp, Homo sapiens
acttccttgccagt

SEQ ID NO: 5164164 - DNA, 16 bp, Homo sapiens
acttccttgcccctgc

SEQ ID NO: 5164165 - DNA, 17 bp, Homo sapiens
acttccttgcccctgct

SEQ ID NO: 5164166 - DNA, 19 bp, Homo sapiens
acttccttgcccctgctct

SEQ ID NO: 5164167 - DNA, 16 bp, Homo sapiens
acttccttgctctccc

SEQ ID NO: 5164168 - DNA, 20 bp, Homo sapiens
acttcctttaaagatgaact

SEQ ID NO: 5164169 - DNA, 22 bp, Homo sapiens
acttcctttcctactgtcctgg

SEQ ID NO: 5164170 - DNA, 12 bp, Homo sapiens
acttcctttgtg

SEQ ID NO: 5164171 - DNA, 21 bp, Homo sapiens
acttcctttgtgtttatatgg

SEQ ID NO: 5164172 - DNA, 14 bp, Homo sapiens
acttcgaaaacaga

SEQ ID NO: 5164173 - DNA, 21 bp, Homo sapiens
acttcgaagacccagcagatg

SEQ ID NO: 5164174 - DNA, 16 bp, Homo sapiens
acttcgaatatatctg

SEQ ID NO: 5164175 - DNA, 21 bp, Homo sapiens
acttcgaatatatctgtaaag

SEQ ID NO: 5164176 - DNA, 16 bp, Homo sapiens
acttcgacactgttct

SEQ ID NO: 5164177 - DNA, 23 bp, Homo sapiens
acttcgacactgttcttagctca

SEQ ID NO: 5164178 - DNA, 15 bp, Homo sapiens
acttcgactcaggat

SEQ ID NO: 5164179 - DNA, 13 bp, Homo sapiens
acttcgcacacac

SEQ ID NO: 5164180 - DNA, 15 bp, Homo sapiens
acttcgcacacaccc

SEQ ID NO: 5164181 - DNA, 14 bp, Homo sapiens
acttcgcagaggca

SEQ ID NO: 5164182 - DNA, 16 bp, Homo sapiens
acttcgcatcaaaaga

SEQ ID NO: 5164183 - DNA, 23 bp, Homo sapiens
acttcgccaaggttgtagcatgg

SEQ ID NO: 5164184 - DNA, 13 bp, Homo sapiens
acttcgctcttga

SEQ ID NO: 5164185 - DNA, 22 bp, Homo sapiens
acttcggcagatactgtctctt

SEQ ID NO: 5164186 - DNA, 17 bp, Homo sapiens
acttcgggaggtcgagg

SEQ ID NO: 5164187 - DNA, 20 bp, Homo sapiens
acttcgggaggtcgaggcag

SEQ ID NO: 5164188 - DNA, 16 bp, Homo sapiens
acttcgggctgtgtaa

SEQ ID NO: 5164189 - DNA, 17 bp, Homo sapiens
acttcgggctgtgtaaa

SEQ ID NO: 5164190 - DNA, 18 bp, Homo sapiens
acttcgtcttctaatttc

SEQ ID NO: 5164191 - DNA, 18 bp, Homo sapiens
acttcgtttaatgaatgc

SEQ ID NO: 5164192 - DNA, 20 bp, Homo sapiens
acttcgtttctggggcaact

SEQ ID NO: 5164193 - DNA, 21 bp, Homo sapiens
acttctaaaactgtactttga

SEQ ID NO: 5164194 - DNA, 23 bp, Homo sapiens
acttctaaaactgtactttgatt

SEQ ID NO: 5164195 - DNA, 22 bp, Homo sapiens
acttctaaaataaatgttttgg

SEQ ID NO: 5164196 - DNA, 17 bp, Homo sapiens
acttctaagactttact

SEQ ID NO: 5164197 - DNA, 22 bp, Homo sapiens
acttctaatatatttttatatt

SEQ ID NO: 5164198 - DNA, 15 bp, Homo sapiens
acttctaatatcatt

SEQ ID NO: 5164199 - DNA, 17 bp, Homo sapiens
acttctaattgccatgt

SEQ ID NO: 5164200 - DNA, 13 bp, Homo sapiens
acttctaatttgt

SEQ ID NO: 5164201 - DNA, 19 bp, Homo sapiens
acttctacctacatatttg

SEQ ID NO: 5164202 - DNA, 17 bp, Homo sapiens
acttctacctgccctca

SEQ ID NO: 5164203 - DNA, 14 bp, Homo sapiens
acttctactgagca

SEQ ID NO: 5164204 - DNA, 15 bp, Homo sapiens
acttctactgagcaa

SEQ ID NO: 5164205 - DNA, 17 bp, Homo sapiens
acttctagatctcagcc

SEQ ID NO: 5164206 - DNA, 21 bp, Homo sapiens
acttctaggactgggggtctt

SEQ ID NO: 5164207 - DNA, 15 bp, Homo sapiens
acttctagttgctct

SEQ ID NO: 5164208 - DNA, 13 bp, Homo sapiens
acttctagtttca

SEQ ID NO: 5164209 - DNA, 17 bp, Homo sapiens
acttctagtttcacgta

SEQ ID NO: 5164210 - DNA, 23 bp, Homo sapiens
acttctataaagtgaacagattt

SEQ ID NO: 5164211 - DNA, 14 bp, Homo sapiens
acttctatatcatt

SEQ ID NO: 5164212 - DNA, 12 bp, Homo sapiens
acttctatattt

SEQ ID NO: 5164213 - DNA, 14 bp, Homo sapiens
acttctatcctttc

SEQ ID NO: 5164214 - DNA, 14 bp, Homo sapiens
acttctatgttggt

SEQ ID NO: 5164215 - DNA, 22 bp, Homo sapiens
acttctattttcaagtggaaac

SEQ ID NO: 5164216 - DNA, 22 bp, Homo sapiens
acttctattttccttaatcaaa

SEQ ID NO: 5164217 - DNA, 21 bp, Homo sapiens
acttctcaaatgctactcagt

SEQ ID NO: 5164218 - DNA, 23 bp, Homo sapiens
acttctcaactccagagcccctt

SEQ ID NO: 5164219 - DNA, 15 bp, Homo sapiens
acttctcaagtaaca

SEQ ID NO: 5164220 - DNA, 23 bp, Homo sapiens
acttctcaagtcccttgttttgt

SEQ ID NO: 5164221 - DNA, 16 bp, Homo sapiens
acttctcactcaccac

SEQ ID NO: 5164222 - DNA, 12 bp, Homo sapiens
acttctcaggac

SEQ ID NO: 5164223 - DNA, 18 bp, Homo sapiens
acttctcatcacacacat

SEQ ID NO: 5164224 - DNA, 22 bp, Homo sapiens
acttctcatcatattgtatgta

SEQ ID NO: 5164225 - DNA, 23 bp, Homo sapiens
acttctcatcatattgtatgtaa

SEQ ID NO: 5164226 - DNA, 20 bp, Homo sapiens
acttctcattttttaaaaaa

SEQ ID NO: 5164227 - DNA, 16 bp, Homo sapiens
acttctccaccctgct

SEQ ID NO: 5164228 - DNA, 22 bp, Homo sapiens
acttctccagacccaccacacc

SEQ ID NO: 5164229 - DNA, 14 bp, Homo sapiens
acttctccatgctg

SEQ ID NO: 5164230 - DNA, 16 bp, Homo sapiens
acttctccatgctgca

SEQ ID NO: 5164231 - DNA, 12 bp, Homo sapiens
acttctccccag

SEQ ID NO: 5164232 - DNA, 17 bp, Homo sapiens
acttctcccccgccctg

SEQ ID NO: 5164233 - DNA, 16 bp, Homo sapiens
acttctccccgcagcc

SEQ ID NO: 5164234 - DNA, 15 bp, Homo sapiens
acttctcccctgggt

SEQ ID NO: 5164235 - DNA, 14 bp, Homo sapiens
acttctcccttctc

SEQ ID NO: 5164236 - DNA, 20 bp, Homo sapiens
acttctcgcaactgaaggaa

SEQ ID NO: 5164237 - DNA, 21 bp, Homo sapiens
acttctcgcaactgaaggaag

SEQ ID NO: 5164238 - DNA, 20 bp, Homo sapiens
acttctcgtagatgctgcct

SEQ ID NO: 5164239 - DNA, 21 bp, Homo sapiens
acttctcgtagatgctgccta

SEQ ID NO: 5164240 - DNA, 22 bp, Homo sapiens
acttctctctaaggagaatggc

SEQ ID NO: 5164241 - DNA, 13 bp, Homo sapiens
acttctctgaagg

SEQ ID NO: 5164242 - DNA, 14 bp, Homo sapiens
acttctctgaaggg

SEQ ID NO: 5164243 - DNA, 23 bp, Homo sapiens
acttctctgaatcagaaaagcta

SEQ ID NO: 5164244 - DNA, 17 bp, Homo sapiens
acttctctgatcaaaat

SEQ ID NO: 5164245 - DNA, 21 bp, Homo sapiens
acttctctgcctttgacattt

SEQ ID NO: 5164246 - DNA, 16 bp, Homo sapiens
acttctctgctgcctc

SEQ ID NO: 5164247 - DNA, 22 bp, Homo sapiens
acttctctgtgtgcacacccat

SEQ ID NO: 5164248 - DNA, 16 bp, Homo sapiens
acttctcttacatttt

SEQ ID NO: 5164249 - DNA, 16 bp, Homo sapiens
acttctcttctgagcc

SEQ ID NO: 5164250 - DNA, 14 bp, Homo sapiens
acttctctttgcct

SEQ ID NO: 5164251 - DNA, 17 bp, Homo sapiens
acttctctttgcctcaa

SEQ ID NO: 5164252 - DNA, 14 bp, Homo sapiens
acttctgaaactta

SEQ ID NO: 5164253 - DNA, 19 bp, Homo sapiens
acttctgaaataaatgttc

SEQ ID NO: 5164254 - DNA, 14 bp, Homo sapiens
acttctgaatattg

SEQ ID NO: 5164255 - DNA, 17 bp, Homo sapiens
acttctgacaaaggtgg

SEQ ID NO: 5164256 - DNA, 14 bp, Homo sapiens
acttctgacagcct

SEQ ID NO: 5164257 - DNA, 18 bp, Homo sapiens
acttctgactcttcccca

SEQ ID NO: 5164258 - DNA, 20 bp, Homo sapiens
acttctgagatctgttgatt

SEQ ID NO: 5164259 - DNA, 19 bp, Homo sapiens
acttctgagccccagcccc

SEQ ID NO: 5164260 - DNA, 16 bp, Homo sapiens
acttctgagtaattaa

SEQ ID NO: 5164261 - DNA, 18 bp, Homo sapiens
acttctgatactttagta

SEQ ID NO: 5164262 - DNA, 24 bp, Homo sapiens
acttctgcaacaagcatgcagctt

SEQ ID NO: 5164263 - DNA, 22 bp, Homo sapiens
acttctgcattcctgtaacttt

SEQ ID NO: 5164264 - DNA, 24 bp, Homo sapiens
actgaggtatggccatgccctaga

SEQ ID NO: 5164265 - DNA, 12 bp, Homo sapiens
actgaggtgcct

SEQ ID NO: 5164266 - DNA, 18 bp, Homo sapiens
actgaggtgcctgctcag

SEQ ID NO: 5164267 - DNA, 21 bp, Homo sapiens
actgaggtgcctgctcaggtg

SEQ ID NO: 5164268 - DNA, 17 bp, Homo sapiens
actgaggtggtggacat

SEQ ID NO: 5164269 - DNA, 14 bp, Homo sapiens
actgaggttttttt

SEQ ID NO: 5164270 - DNA, 14 bp, Homo sapiens
actgagtaaagtgt

SEQ ID NO: 5164271 - DNA, 20 bp, Homo sapiens
actgagtaagaaatgctgcc

SEQ ID NO: 5164272 - DNA, 17 bp, Homo sapiens
actgagtacaaatgtgt

SEQ ID NO: 5164273 - DNA, 21 bp, Homo sapiens
actgagtacgttgtgcatttg

SEQ ID NO: 5164274 - DNA, 22 bp, Homo sapiens
actgagtacgttgtgcatttgg

SEQ ID NO: 5164275 - DNA, 20 bp, Homo sapiens
actgagtagctctcctgact

SEQ ID NO: 5164276 - DNA, 21 bp, Homo sapiens
actgagtagctttcatttact

SEQ ID NO: 5164277 - DNA, 22 bp, Homo sapiens
actgagtatgtgtaacaggata

SEQ ID NO: 5164278 - DNA, 16 bp, Homo sapiens
actgagtcactcacat

SEQ ID NO: 5164279 - DNA, 18 bp, Homo sapiens
actgagtcactcacattg

SEQ ID NO: 5164280 - DNA, 18 bp, Homo sapiens
actgagtccatgaaaata

SEQ ID NO: 5164281 - DNA, 19 bp, Homo sapiens
actgagtccatgaaaatac

SEQ ID NO: 5164282 - DNA, 21 bp, Homo sapiens
actgagtccatgaaaatacca

SEQ ID NO: 5164283 - DNA, 18 bp, Homo sapiens
actgagtcccctccagga

SEQ ID NO: 5164284 - DNA, 18 bp, Homo sapiens
actgagtccctggcaaga

SEQ ID NO: 5164285 - DNA, 21 bp, Homo sapiens
actgagtccctggcaagactg

SEQ ID NO: 5164286 - DNA, 15 bp, Homo sapiens
actgagtctcgaggg

SEQ ID NO: 5164287 - DNA, 23 bp, Homo sapiens
actgagtctgtggacactgtgga

SEQ ID NO: 5164288 - DNA, 18 bp, Homo sapiens
actgagtgaaatattact

SEQ ID NO: 5164289 - DNA, 22 bp, Homo sapiens
actgagtgaaggaagagagaca

SEQ ID NO: 5164290 - DNA, 16 bp, Homo sapiens
actgagtgcctgcagc

SEQ ID NO: 5164291 - DNA, 13 bp, Homo sapiens
actgagtgggaag

SEQ ID NO: 5164292 - DNA, 22 bp, Homo sapiens
actgagtgttcaaactactgta

SEQ ID NO: 5164293 - DNA, 21 bp, Homo sapiens
actgagttaaattatactgga

SEQ ID NO: 5164294 - DNA, 18 bp, Homo sapiens
actgagttacattgtcat

SEQ ID NO: 5164295 - DNA, 13 bp, Homo sapiens
actgagtttctat

SEQ ID NO: 5164296 - DNA, 14 bp, Homo sapiens
actgagtttctatt

SEQ ID NO: 5164297 - DNA, 22 bp, Homo sapiens
actgagtttgggttctctgctg

SEQ ID NO: 5164298 - DNA, 16 bp, Homo sapiens
actgataaaaatgata

SEQ ID NO: 5164299 - DNA, 19 bp, Homo sapiens
actgataaaagttttgata

SEQ ID NO: 5164300 - DNA, 16 bp, Homo sapiens
actgataaacctaata

SEQ ID NO: 5164301 - DNA, 16 bp, Homo sapiens
actgataacaaccttt

SEQ ID NO: 5164302 - DNA, 13 bp, Homo sapiens
actgataagactg

SEQ ID NO: 5164303 - DNA, 17 bp, Homo sapiens
actgataattttaaaat

SEQ ID NO: 5164304 - DNA, 18 bp, Homo sapiens
actgataattttacaatt

SEQ ID NO: 5164305 - DNA, 19 bp, Homo sapiens
actgatacataaaaattaa

SEQ ID NO: 5164306 - DNA, 20 bp, Homo sapiens
actgatacatctgatgcatg

SEQ ID NO: 5164307 - DNA, 19 bp, Homo sapiens
actgatagcttacactgag

SEQ ID NO: 5164308 - DNA, 14 bp, Homo sapiens
actgatagtccttt

SEQ ID NO: 5164309 - DNA, 17 bp, Homo sapiens
actgatagtgtccaaat

SEQ ID NO: 5164310 - DNA, 15 bp, Homo sapiens
actgatagttactgt

SEQ ID NO: 5164311 - DNA, 20 bp, Homo sapiens
actgatagttactgttgtga

SEQ ID NO: 5164312 - DNA, 21 bp, Homo sapiens
actgatatacttgagtgtgca

SEQ ID NO: 5164313 - DNA, 23 bp, Homo sapiens
actgatatacttgagtgtgcaag

SEQ ID NO: 5164314 - DNA, 19 bp, Homo sapiens
actgatatatttaaaaaca

SEQ ID NO: 5164315 - DNA, 16 bp, Homo sapiens
actgatatattttaca

SEQ ID NO: 5164316 - DNA, 14 bp, Homo sapiens
actgatatattttc

SEQ ID NO: 5164317 - DNA, 16 bp, Homo sapiens
actgatatcacgggcc

SEQ ID NO: 5164318 - DNA, 19 bp, Homo sapiens
actgatatcacgggcccgc

SEQ ID NO: 5164319 - DNA, 20 bp, Homo sapiens
actgatcaaaaataaactag

SEQ ID NO: 5164320 - DNA, 15 bp, Homo sapiens
actgatcacaaaaac

SEQ ID NO: 5164321 - DNA, 16 bp, Homo sapiens
actgatcatatttgtg

SEQ ID NO: 5164322 - DNA, 17 bp, Homo sapiens
actgatcatccaggcct

SEQ ID NO: 5164323 - DNA, 17 bp, Homo sapiens
actgatcatctgctgtg

SEQ ID NO: 5164324 - DNA, 16 bp, Homo sapiens
actgatcatgcattgt

SEQ ID NO: 5164325 - DNA, 17 bp, Homo sapiens
actgatcatgcattgtt

SEQ ID NO: 5164326 - DNA, 20 bp, Homo sapiens
actgatcatttgcagctgct

SEQ ID NO: 5164327 - DNA, 16 bp, Homo sapiens
actgatccagccctga

SEQ ID NO: 5164328 - DNA, 17 bp, Homo sapiens
actgatccctggccact

SEQ ID NO: 5164329 - DNA, 22 bp, Homo sapiens
actgatcctgaacaagaaagag

SEQ ID NO: 5164330 - DNA, 18 bp, Homo sapiens
actgatcctgctccagca

SEQ ID NO: 5164331 - DNA, 21 bp, Homo sapiens
actgatctcaagtatatgtca

SEQ ID NO: 5164332 - DNA, 19 bp, Homo sapiens
actgatctcgatgcaggtg

SEQ ID NO: 5164333 - DNA, 14 bp, Homo sapiens
actgatctcgtttt

SEQ ID NO: 5164334 - DNA, 17 bp, Homo sapiens
actgatctctactacca

SEQ ID NO: 5164335 - DNA, 18 bp, Homo sapiens
actgatgacaaacccagg

SEQ ID NO: 5164336 - DNA, 15 bp, Homo sapiens
actgatgacttacta

SEQ ID NO: 5164337 - DNA, 16 bp, Homo sapiens
actgatgagagaatgt

SEQ ID NO: 5164338 - DNA, 20 bp, Homo sapiens
actgatgagagaatgtggaa

SEQ ID NO: 5164339 - DNA, 21 bp, Homo sapiens
actgatgagagaatgtggaaa

SEQ ID NO: 5164340 - DNA, 20 bp, Homo sapiens
actgatgagatacatttgat

SEQ ID NO: 5164341 - DNA, 20 bp, Homo sapiens
actgatgagcacatctctct

SEQ ID NO: 5164342 - DNA, 17 bp, Homo sapiens
actgatgagtaaactga

SEQ ID NO: 5164343 - DNA, 12 bp, Homo sapiens
actgatgcaagg

SEQ ID NO: 5164344 - DNA, 13 bp, Homo sapiens
actgatgcaagga

SEQ ID NO: 5164345 - DNA, 19 bp, Homo sapiens
actgatgcaatgtatggct

SEQ ID NO: 5164346 - DNA, 12 bp, Homo sapiens
actgatgccaag

SEQ ID NO: 5164347 - DNA, 22 bp, Homo sapiens
actgatgccaaggggctgagtg

SEQ ID NO: 5164348 - DNA, 15 bp, Homo sapiens
actgatgctcctgaa

SEQ ID NO: 5164349 - DNA, 16 bp, Homo sapiens
actgatgctgagattc

SEQ ID NO: 5164350 - DNA, 19 bp, Homo sapiens
actgatgctgcccctcatc

SEQ ID NO: 5164351 - DNA, 15 bp, Homo sapiens
actgatgcttagatg

SEQ ID NO: 5164352 - DNA, 18 bp, Homo sapiens
actgatgcttttagctca

SEQ ID NO: 5164353 - DNA, 17 bp, Homo sapiens
actgatggaaaatacca

SEQ ID NO: 5164354 - DNA, 18 bp, Homo sapiens
actgatggaaacaaagtg

SEQ ID NO: 5164355 - DNA, 19 bp, Homo sapiens
actgatggaaacaaagtgg

SEQ ID NO: 5164356 - DNA, 15 bp, Homo sapiens
actgatggaagcaca

SEQ ID NO: 5164357 - DNA, 21 bp, Homo sapiens
actgatggaatttttttgtac

SEQ ID NO: 5164358 - DNA, 19 bp, Homo sapiens
actgatggaggctgcagcg

SEQ ID NO: 5164359 - DNA, 19 bp, Homo sapiens
actgatggctcaagacaag

SEQ ID NO: 5164360 - DNA, 20 bp, Homo sapiens
actgatggctcaagacaagg

SEQ ID NO: 5164361 - DNA, 14 bp, Homo sapiens
actgatgggaataa

SEQ ID NO: 5164362 - DNA, 18 bp, Homo sapiens
actgatgggaataaaagt

SEQ ID NO: 5164363 - DNA, 16 bp, Homo sapiens
actgatgggacatcaa

SEQ ID NO: 5164364 - DNA, 17 bp, Homo sapiens
actgatgggacatcaaa

SEQ ID NO: 5164365 - DNA, 18 bp, Homo sapiens
actgatgggtcctgctgc

SEQ ID NO: 5164366 - DNA, 21 bp, Homo sapiens
actgatgggtcctgctgctcg

SEQ ID NO: 5164367 - DNA, 18 bp, Homo sapiens
actgatggtgcattttat

SEQ ID NO: 5164368 - DNA, 16 bp, Homo sapiens
actgatgtatagcttt

SEQ ID NO: 5164369 - DNA, 12 bp, Homo sapiens
actgatgtgaaa

SEQ ID NO: 5164370 - DNA, 14 bp, Homo sapiens
actgatgtgaaact

SEQ ID NO: 5164371 - DNA, 20 bp, Homo sapiens
actgatgttactagcctctc

SEQ ID NO: 5164372 - DNA, 21 bp, Homo sapiens
actgatgttaggctgggccca

SEQ ID NO: 5164373 - DNA, 23 bp, Homo sapiens
actgatgttcacctttatatatg

SEQ ID NO: 5164374 - DNA, 17 bp, Homo sapiens
actgattaaaaatacct

SEQ ID NO: 5164375 - DNA, 18 bp, Homo sapiens
actgattaacaaataaat

SEQ ID NO: 5164376 - DNA, 23 bp, Homo sapiens
actgattacgtttacattcttct

SEQ ID NO: 5164377 - DNA, 15 bp, Homo sapiens
actgattatgaaatg

SEQ ID NO: 5164378 - DNA, 14 bp, Homo sapiens
actgattattcttc

SEQ ID NO: 5164379 - DNA, 14 bp, Homo sapiens
actgattcaatttg

SEQ ID NO: 5164380 - DNA, 13 bp, Homo sapiens
actgattctcctg

SEQ ID NO: 5164381 - DNA, 21 bp, Homo sapiens
actgattctgtgtatcttttt

SEQ ID NO: 5164382 - DNA, 13 bp, Homo sapiens
actgattcttcag

SEQ ID NO: 5164383 - DNA, 22 bp, Homo sapiens
actgattcttcagcaaaaatat

SEQ ID NO: 5164384 - DNA, 13 bp, Homo sapiens
actgattgggagg

SEQ ID NO: 5164385 - DNA, 20 bp, Homo sapiens
actgattgggtgccatgtgg

SEQ ID NO: 5164386 - DNA, 22 bp, Homo sapiens
actgattgggtgccatgtggag

SEQ ID NO: 5164387 - DNA, 21 bp, Homo sapiens
actgattgttttagagactat

SEQ ID NO: 5164388 - DNA, 13 bp, Homo sapiens
actgatttaattt

SEQ ID NO: 5164389 - DNA, 15 bp, Homo sapiens
actgatttcagagtg

SEQ ID NO: 5164390 - DNA, 12 bp, Homo sapiens
actgatttcccc

SEQ ID NO: 5164391 - DNA, 20 bp, Homo sapiens
actgatttccccttttgcat

SEQ ID NO: 5164392 - DNA, 23 bp, Homo sapiens
actgatttccccttttgcattct

SEQ ID NO: 5164393 - DNA, 13 bp, Homo sapiens
actgatttctatg

SEQ ID NO: 5164394 - DNA, 18 bp, Homo sapiens
actgatttctatggcttt

SEQ ID NO: 5164395 - DNA, 23 bp, Homo sapiens
actgatttctatggctttcaaag

SEQ ID NO: 5164396 - DNA, 13 bp, Homo sapiens
actgatttctcac

SEQ ID NO: 5164397 - DNA, 19 bp, Homo sapiens
actgatttcttcagaatta

SEQ ID NO: 5164398 - DNA, 18 bp, Homo sapiens
actgatttgctggagttc

SEQ ID NO: 5164399 - DNA, 19 bp, Homo sapiens
actgatttgctggagttca

SEQ ID NO: 5164400 - DNA, 16 bp, Homo sapiens
actgatttggagatat

SEQ ID NO: 5164401 - DNA, 16 bp, Homo sapiens
actgattttacaaatt

SEQ ID NO: 5164402 - DNA, 15 bp, Homo sapiens
actgattttcaaaaa

SEQ ID NO: 5164403 - DNA, 14 bp, Homo sapiens
actgattttgtaaa

SEQ ID NO: 5164404 - DNA, 20 bp, Homo sapiens
actgattttgtacataaaca

SEQ ID NO: 5164405 - DNA, 19 bp, Homo sapiens
actgatttttgtaagacaa

SEQ ID NO: 5164406 - DNA, 14 bp, Homo sapiens
actgatttttgtga

SEQ ID NO: 5164407 - DNA, 17 bp, Homo sapiens
actgatttttttttcct

SEQ ID NO: 5164408 - DNA, 21 bp, Homo sapiens
actgatttttttttccttcag

SEQ ID NO: 5164409 - DNA, 22 bp, Homo sapiens
actgatttttttttccttcagt

SEQ ID NO: 5164410 - DNA, 23 bp, Homo sapiens
actgatttttttttccttcagtg

SEQ ID NO: 5164411 - DNA, 16 bp, Homo sapiens
actgcaaaaaaagcct

SEQ ID NO: 5164412 - DNA, 18 bp, Homo sapiens
actgcaaaaaaagcctcc

SEQ ID NO: 5164413 - DNA, 22 bp, Homo sapiens
actgcaaaaagaaaatctttat

SEQ ID NO: 5164414 - DNA, 17 bp, Homo sapiens
actgcaaaaagtacata

SEQ ID NO: 5164415 - DNA, 16 bp, Homo sapiens
actgcaaacaataaac

SEQ ID NO: 5164416 - DNA, 16 bp, Homo sapiens
actgcaaacacacctt

SEQ ID NO: 5164417 - DNA, 20 bp, Homo sapiens
actgcaaacacaccttggag

SEQ ID NO: 5164418 - DNA, 24 bp, Homo sapiens
actgcaaacttttttatatctttt

SEQ ID NO: 5164419 - DNA, 18 bp, Homo sapiens
actgcaaagtcgccagtc

SEQ ID NO: 5164420 - DNA, 22 bp, Homo sapiens
actgcaaagtcgccagtcactg

SEQ ID NO: 5164421 - DNA, 17 bp, Homo sapiens
actgcaaataaagcctt

SEQ ID NO: 5164422 - DNA, 21 bp, Homo sapiens
actgcaaatcaggcttttgtt

SEQ ID NO: 5164423 - DNA, 13 bp, Homo sapiens
actgcaaatgtgc

SEQ ID NO: 5164424 - DNA, 14 bp, Homo sapiens
actgcaaattttaa

SEQ ID NO: 5164425 - DNA, 14 bp, Homo sapiens
actgcaacactgga

SEQ ID NO: 5164426 - DNA, 17 bp, Homo sapiens
actgcaacccatgagcg

SEQ ID NO: 5164427 - DNA, 22 bp, Homo sapiens
actgcaacccatgagcgtccag

SEQ ID NO: 5164428 - DNA, 14 bp, Homo sapiens
actgcaacctccac

SEQ ID NO: 5164429 - DNA, 22 bp, Homo sapiens
actgcaacctccacctcccagg

SEQ ID NO: 5164430 - DNA, 19 bp, Homo sapiens
actgcaacctccgccttcc

SEQ ID NO: 5164431 - DNA, 12 bp, Homo sapiens
actgcaacctct

SEQ ID NO: 5164432 - DNA, 16 bp, Homo sapiens
actgcaacctctgcct

SEQ ID NO: 5164433 - DNA, 17 bp, Homo sapiens
actgcaacctcttcctc

SEQ ID NO: 5164434 - DNA, 15 bp, Homo sapiens
actgcaaccttcacc

SEQ ID NO: 5164435 - DNA, 23 bp, Homo sapiens
actgcaaccttcgccacctgggt

SEQ ID NO: 5164436 - DNA, 20 bp, Homo sapiens
actgcaaccttgtttattaa

SEQ ID NO: 5164437 - DNA, 14 bp, Homo sapiens
actgcaactccagc

SEQ ID NO: 5164438 - DNA, 20 bp, Homo sapiens
actgcaacttccgcctcctg

SEQ ID NO: 5164439 - DNA, 14 bp, Homo sapiens
actgcaactttaaa

SEQ ID NO: 5164440 - DNA, 14 bp, Homo sapiens
actgcaagaactgt

SEQ ID NO: 5164441 - DNA, 12 bp, Homo sapiens
acttctgccaga

SEQ ID NO: 5164442 - DNA, 19 bp, Homo sapiens
acttctgccagatgtccta

SEQ ID NO: 5164443 - DNA, 22 bp, Homo sapiens
acttctgccagcataatacttg

SEQ ID NO: 5164444 - DNA, 18 bp, Homo sapiens
acttctgccatattctgt

SEQ ID NO: 5164445 - DNA, 19 bp, Homo sapiens
acttctgccatattctgtt

SEQ ID NO: 5164446 - DNA, 17 bp, Homo sapiens
acttctgccccagcttt

SEQ ID NO: 5164447 - DNA, 12 bp, Homo sapiens
acttctgcctgt

SEQ ID NO: 5164448 - DNA, 19 bp, Homo sapiens
acttctgcgggctccctcc

SEQ ID NO: 5164449 - DNA, 21 bp, Homo sapiens
acttctgcgggctccctcctc

SEQ ID NO: 5164450 - DNA, 22 bp, Homo sapiens
acttctgcgggctccctcctct

SEQ ID NO: 5164451 - DNA, 23 bp, Homo sapiens
acttctgcgggctccctcctctg

SEQ ID NO: 5164452 - DNA, 11 bp, Homo sapiens
acttctgcttt

SEQ ID NO: 5164453 - DNA, 18 bp, Homo sapiens
acttctgctttcacttaa

SEQ ID NO: 5164454 - DNA, 16 bp, Homo sapiens
acttctgctttccaca

SEQ ID NO: 5164455 - DNA, 19 bp, Homo sapiens
acttctgctttccacacct

SEQ ID NO: 5164456 - DNA, 17 bp, Homo sapiens
acttctggaaggctggc

SEQ ID NO: 5164457 - DNA, 19 bp, Homo sapiens
acttctggaaggctggctg

SEQ ID NO: 5164458 - DNA, 23 bp, Homo sapiens
acttctggagatggatccttcca

SEQ ID NO: 5164459 - DNA, 20 bp, Homo sapiens
acttctggcataactaaaat

SEQ ID NO: 5164460 - DNA, 14 bp, Homo sapiens
acttctggccacat

SEQ ID NO: 5164461 - DNA, 20 bp, Homo sapiens
acttctggccacatcagccc

SEQ ID NO: 5164462 - DNA, 18 bp, Homo sapiens
acttctggcctaggaccc

SEQ ID NO: 5164463 - DNA, 17 bp, Homo sapiens
acttctggctcacagga

SEQ ID NO: 5164464 - DNA, 22 bp, Homo sapiens
acttctggctccctcttctttc

SEQ ID NO: 5164465 - DNA, 23 bp, Homo sapiens
acttctggcttcagcccccacca

SEQ ID NO: 5164466 - DNA, 20 bp, Homo sapiens
acttctggggccagcccctc

SEQ ID NO: 5164467 - DNA, 23 bp, Homo sapiens
acttctgggtcatgcactgaggt

SEQ ID NO: 5164468 - DNA, 17 bp, Homo sapiens
acttctgggtggggcag

SEQ ID NO: 5164469 - DNA, 16 bp, Homo sapiens
acttctggtataattg

SEQ ID NO: 5164470 - DNA, 17 bp, Homo sapiens
acttctggtataattgt

SEQ ID NO: 5164471 - DNA, 18 bp, Homo sapiens
acttctggtgctgctggg

SEQ ID NO: 5164472 - DNA, 16 bp, Homo sapiens
acttctgtatgcatca

SEQ ID NO: 5164473 - DNA, 21 bp, Homo sapiens
acttctgtcttcacaacagat

SEQ ID NO: 5164474 - DNA, 23 bp, Homo sapiens
acttctgtgagacccccacacct

SEQ ID NO: 5164475 - DNA, 11 bp, Homo sapiens
acttctgtggg

SEQ ID NO: 5164476 - DNA, 13 bp, Homo sapiens
acttctgtgggca

SEQ ID NO: 5164477 - DNA, 15 bp, Homo sapiens
acttctgtgggcccc

SEQ ID NO: 5164478 - DNA, 21 bp, Homo sapiens
acttctgtgggcccctcaaca

SEQ ID NO: 5164479 - DNA, 15 bp, Homo sapiens
acttctgtgtagaca

SEQ ID NO: 5164480 - DNA, 14 bp, Homo sapiens
acttctgtgtctgt

SEQ ID NO: 5164481 - DNA, 18 bp, Homo sapiens
acttctgtgtctgtcacc

SEQ ID NO: 5164482 - DNA, 12 bp, Homo sapiens
acttctgtttct

SEQ ID NO: 5164483 - DNA, 21 bp, Homo sapiens
acttctgtttgatcactgtga

SEQ ID NO: 5164484 - DNA, 15 bp, Homo sapiens
acttctgttttacca

SEQ ID NO: 5164485 - DNA, 17 bp, Homo sapiens
acttctgttttcaatct

SEQ ID NO: 5164486 - DNA, 22 bp, Homo sapiens
acttctgttttcaatctcgtat

SEQ ID NO: 5164487 - DNA, 23 bp, Homo sapiens
acttctgttttcaatctcgtata

SEQ ID NO: 5164488 - DNA, 15 bp, Homo sapiens
acttcttaaaccatt

SEQ ID NO: 5164489 - DNA, 17 bp, Homo sapiens
acttcttaaaggcctgg

SEQ ID NO: 5164490 - DNA, 19 bp, Homo sapiens
acttcttaaatatctttta

SEQ ID NO: 5164491 - DNA, 20 bp, Homo sapiens
acttcttaaatatcttttat

SEQ ID NO: 5164492 - DNA, 16 bp, Homo sapiens
acttcttacacataaa

SEQ ID NO: 5164493 - DNA, 23 bp, Homo sapiens
acttcttagaaaattaaaatagg

SEQ ID NO: 5164494 - DNA, 18 bp, Homo sapiens
acttcttagggattaaat

SEQ ID NO: 5164495 - DNA, 16 bp, Homo sapiens
acttcttatggaattg

SEQ ID NO: 5164496 - DNA, 23 bp, Homo sapiens
acttcttatggaattgatttgca

SEQ ID NO: 5164497 - DNA, 23 bp, Homo sapiens
acttcttatttttcttaccaatt

SEQ ID NO: 5164498 - DNA, 16 bp, Homo sapiens
acttcttcagagctga

SEQ ID NO: 5164499 - DNA, 20 bp, Homo sapiens
acttcttcagagctgacaca

SEQ ID NO: 5164500 - DNA, 21 bp, Homo sapiens
acttcttcagagctgacacag

SEQ ID NO: 5164501 - DNA, 19 bp, Homo sapiens
acttcttcataattttagt

SEQ ID NO: 5164502 - DNA, 23 bp, Homo sapiens
acttcttctatatccaaaattca

SEQ ID NO: 5164503 - DNA, 11 bp, Homo sapiens
acttcttcttc

SEQ ID NO: 5164504 - DNA, 15 bp, Homo sapiens
acttcttcttctttg

SEQ ID NO: 5164505 - DNA, 24 bp, Homo sapiens
acttcttgaaacagcctgggtgac

SEQ ID NO: 5164506 - DNA, 13 bp, Homo sapiens
acttcttgaaggt

SEQ ID NO: 5164507 - DNA, 20 bp, Homo sapiens
acttcttgaaggtgctgacg

SEQ ID NO: 5164508 - DNA, 23 bp, Homo sapiens
acttcttgaatataaaaaatcat

SEQ ID NO: 5164509 - DNA, 16 bp, Homo sapiens
acttcttgccctgggg

SEQ ID NO: 5164510 - DNA, 18 bp, Homo sapiens
acttcttgccctggggat

SEQ ID NO: 5164511 - DNA, 11 bp, Homo sapiens
acttcttgctt

SEQ ID NO: 5164512 - DNA, 18 bp, Homo sapiens
acttcttgcttctttcta

SEQ ID NO: 5164513 - DNA, 19 bp, Homo sapiens
acttcttgcttctttctag

SEQ ID NO: 5164514 - DNA, 21 bp, Homo sapiens
acttcttggaaaaaaattaca

SEQ ID NO: 5164515 - DNA, 18 bp, Homo sapiens
acttcttggttcctggga

SEQ ID NO: 5164516 - DNA, 20 bp, Homo sapiens
acttcttggttcctgggatg

SEQ ID NO: 5164517 - DNA, 19 bp, Homo sapiens
acttcttgtcagacataaa

SEQ ID NO: 5164518 - DNA, 22 bp, Homo sapiens
acttcttgtcagacataaagcc

SEQ ID NO: 5164519 - DNA, 23 bp, Homo sapiens
acttcttgtcagacataaagcca

SEQ ID NO: 5164520 - DNA, 14 bp, Homo sapiens
acttcttgttcatg

SEQ ID NO: 5164521 - DNA, 20 bp, Homo sapiens
acttctttactaacactggc

SEQ ID NO: 5164522 - DNA, 21 bp, Homo sapiens
acttctttagcatttttatgc

SEQ ID NO: 5164523 - DNA, 22 bp, Homo sapiens
acttctttagcatttttatgca

SEQ ID NO: 5164524 - DNA, 23 bp, Homo sapiens
acttctttagcatttttatgcag

SEQ ID NO: 5164525 - DNA, 16 bp, Homo sapiens
acttctttagtattat

SEQ ID NO: 5164526 - DNA, 19 bp, Homo sapiens
acttctttatactctcttc

SEQ ID NO: 5164527 - DNA, 12 bp, Homo sapiens
acttctttccct

SEQ ID NO: 5164528 - DNA, 23 bp, Homo sapiens
acttctttcctctccaattgtaa

SEQ ID NO: 5164529 - DNA, 13 bp, Homo sapiens
acttctttctatt

SEQ ID NO: 5164530 - DNA, 15 bp, Homo sapiens
acttctttgaagtta

SEQ ID NO: 5164531 - DNA, 16 bp, Homo sapiens
acttctttgaagttat

SEQ ID NO: 5164532 - DNA, 17 bp, Homo sapiens
acttctttgcaacaata

SEQ ID NO: 5164533 - DNA, 16 bp, Homo sapiens
acttctttgctttgcc

SEQ ID NO: 5164534 - DNA, 23 bp, Homo sapiens
acttctttggtgttctggcctct

SEQ ID NO: 5164535 - DNA, 22 bp, Homo sapiens
acttcttttataactagtcctt

SEQ ID NO: 5164536 - DNA, 18 bp, Homo sapiens
acttcttttcacattctt

SEQ ID NO: 5164537 - DNA, 19 bp, Homo sapiens
acttcttttcacattctta

SEQ ID NO: 5164538 - DNA, 19 bp, Homo sapiens
acttcttttgctcttagct

SEQ ID NO: 5164539 - DNA, 19 bp, Homo sapiens
acttctttttggcattatc

SEQ ID NO: 5164540 - DNA, 21 bp, Homo sapiens
acttcttttttcaaaagaaag

SEQ ID NO: 5164541 - DNA, 19 bp, Homo sapiens
acttgaaaaaatgttctat

SEQ ID NO: 5164542 - DNA, 14 bp, Homo sapiens
acttgaaaacagaa

SEQ ID NO: 5164543 - DNA, 17 bp, Homo sapiens
acttgaaaacttctcat

SEQ ID NO: 5164544 - DNA, 16 bp, Homo sapiens
acttgaaaagaaagaa

SEQ ID NO: 5164545 - DNA, 15 bp, Homo sapiens
acttgaaaagattgc

SEQ ID NO: 5164546 - DNA, 17 bp, Homo sapiens
acttgaaaagattgcaa

SEQ ID NO: 5164547 - DNA, 20 bp, Homo sapiens
acttgaaaagattgcaaagg

SEQ ID NO: 5164548 - DNA, 23 bp, Homo sapiens
acttgaaaagattgcaaagggac

SEQ ID NO: 5164549 - DNA, 16 bp, Homo sapiens
acttgaaaattaacat

SEQ ID NO: 5164550 - DNA, 17 bp, Homo sapiens
acttgaaaattaacatg

SEQ ID NO: 5164551 - DNA, 12 bp, Homo sapiens
acttgaaaattt

SEQ ID NO: 5164552 - DNA, 18 bp, Homo sapiens
acttgaaaattttttaac

SEQ ID NO: 5164553 - DNA, 16 bp, Homo sapiens
acttgaaaccagtatt

SEQ ID NO: 5164554 - DNA, 13 bp, Homo sapiens
acttgaaagcatc

SEQ ID NO: 5164555 - DNA, 20 bp, Homo sapiens
acttgaaagcatccatgtgt

SEQ ID NO: 5164556 - DNA, 12 bp, Homo sapiens
acttgaaataag

SEQ ID NO: 5164557 - DNA, 19 bp, Homo sapiens
acttgaaataccagtgaac

SEQ ID NO: 5164558 - DNA, 14 bp, Homo sapiens
acttgaaatatata

SEQ ID NO: 5164559 - DNA, 18 bp, Homo sapiens
acttgaaatctaggatta

SEQ ID NO: 5164560 - DNA, 14 bp, Homo sapiens
acttgaaatgttag

SEQ ID NO: 5164561 - DNA, 16 bp, Homo sapiens
acttgaaatttgaatt

SEQ ID NO: 5164562 - DNA, 11 bp, Homo sapiens
acttgaacaaa

SEQ ID NO: 5164563 - DNA, 17 bp, Homo sapiens
acttgaacaaaagggtc

SEQ ID NO: 5164564 - DNA, 13 bp, Homo sapiens
acttgaacaagaa

SEQ ID NO: 5164565 - DNA, 14 bp, Homo sapiens
acttgaaccataaa

SEQ ID NO: 5164566 - DNA, 20 bp, Homo sapiens
acttgaaccataaaatgtcc

SEQ ID NO: 5164567 - DNA, 22 bp, Homo sapiens
acttgaaccataaaatgtccag

SEQ ID NO: 5164568 - DNA, 19 bp, Homo sapiens
acttgaaccatagttactg

SEQ ID NO: 5164569 - DNA, 14 bp, Homo sapiens
acttgaacttgcct

SEQ ID NO: 5164570 - DNA, 15 bp, Homo sapiens
acttgaacttgcctc

SEQ ID NO: 5164571 - DNA, 23 bp, Homo sapiens
acttgaagaaacagagtggcctc

SEQ ID NO: 5164572 - DNA, 21 bp, Homo sapiens
acttgaagaatattcccaata

SEQ ID NO: 5164573 - DNA, 15 bp, Homo sapiens
acttgaagcacaagt

SEQ ID NO: 5164574 - DNA, 18 bp, Homo sapiens
acttgaagccaaactgtt

SEQ ID NO: 5164575 - DNA, 20 bp, Homo sapiens
acttgaagcctgctccttcc

SEQ ID NO: 5164576 - DNA, 13 bp, Homo sapiens
acttgaagctaac

SEQ ID NO: 5164577 - DNA, 15 bp, Homo sapiens
acttgaagctttgta

SEQ ID NO: 5164578 - DNA, 16 bp, Homo sapiens
acttgaagctttgtag

SEQ ID NO: 5164579 - DNA, 16 bp, Homo sapiens
acttgaaggagtttaa

SEQ ID NO: 5164580 - DNA, 17 bp, Homo sapiens
acttgaaggatggatga

SEQ ID NO: 5164581 - DNA, 15 bp, Homo sapiens
acttgaaggattgca

SEQ ID NO: 5164582 - DNA, 14 bp, Homo sapiens
acttgaagggccag

SEQ ID NO: 5164583 - DNA, 21 bp, Homo sapiens
acttgaagggccagagccagg

SEQ ID NO: 5164584 - DNA, 19 bp, Homo sapiens
acttgaaggtttgatgcca

SEQ ID NO: 5164585 - DNA, 13 bp, Homo sapiens
acttgaagtaact

SEQ ID NO: 5164586 - DNA, 22 bp, Homo sapiens
acttgaagtctaaaagcagaaa

SEQ ID NO: 5164587 - DNA, 11 bp, Homo sapiens
acttgaagttg

SEQ ID NO: 5164588 - DNA, 12 bp, Homo sapiens
acttgaagttgt

SEQ ID NO: 5164589 - DNA, 19 bp, Homo sapiens
acttgaatatggaacatat

SEQ ID NO: 5164590 - DNA, 23 bp, Homo sapiens
acttgaatatggaacatatgcac

SEQ ID NO: 5164591 - DNA, 13 bp, Homo sapiens
acttgaatatgta

SEQ ID NO: 5164592 - DNA, 22 bp, Homo sapiens
acttgaatcagatggtgtcatt

SEQ ID NO: 5164593 - DNA, 24 bp, Homo sapiens
acttgaatcagatggtgtcattta

SEQ ID NO: 5164594 - DNA, 15 bp, Homo sapiens
acttgaatcagtttt

SEQ ID NO: 5164595 - DNA, 14 bp, Homo sapiens
acttgaatccattg

SEQ ID NO: 5164596 - DNA, 19 bp, Homo sapiens
acttgaatggttaataaaa

SEQ ID NO: 5164597 - DNA, 17 bp, Homo sapiens
acttgaatgtacaaaga

SEQ ID NO: 5164598 - DNA, 19 bp, Homo sapiens
acttgaatgtacaaagata

SEQ ID NO: 5164599 - DNA, 16 bp, Homo sapiens
acttgaatgtgtcact

SEQ ID NO: 5164600 - DNA, 15 bp, Homo sapiens
acttgaatgtgtcag

SEQ ID NO: 5164601 - DNA, 15 bp, Homo sapiens
acttgaatttctgga

SEQ ID NO: 5164602 - DNA, 11 bp, Homo sapiens
acttgaatttt

SEQ ID NO: 5164603 - DNA, 20 bp, Homo sapiens
acttgaattttcccactgca

SEQ ID NO: 5164604 - DNA, 17 bp, Homo sapiens
acttgaattttttgaaa

SEQ ID NO: 5164605 - DNA, 21 bp, Homo sapiens
acttgacaccaaccagacagc

SEQ ID NO: 5164606 - DNA, 17 bp, Homo sapiens
acttgacagaacactgt

SEQ ID NO: 5164607 - DNA, 18 bp, Homo sapiens
acttgacagaacactgtc

SEQ ID NO: 5164608 - DNA, 19 bp, Homo sapiens
acttgacatgtagcttctt

SEQ ID NO: 5164609 - DNA, 15 bp, Homo sapiens
acttgaccctgagct

SEQ ID NO: 5164610 - DNA, 18 bp, Homo sapiens
acttgaccctgagctgac

SEQ ID NO: 5164611 - DNA, 22 bp, Homo sapiens
acttgaccctttcctcccccag

SEQ ID NO: 5164612 - DNA, 12 bp, Homo sapiens
acttgacctcat

SEQ ID NO: 5164613 - DNA, 22 bp, Homo sapiens
acttgactcatttaaagctaaa

SEQ ID NO: 5164614 - DNA, 20 bp, Homo sapiens
acttgactctaatatgatta

SEQ ID NO: 5164615 - DNA, 23 bp, Homo sapiens
acttgagaacttgacaagttgcg

SEQ ID NO: 5164616 - DNA, 19 bp, Homo sapiens
acttgagaggatgaatgta

SEQ ID NO: 5164617 - DNA, 19 bp, Homo sapiens
acttgagataatctaaata

SEQ ID NO: 5164618 - DNA, 22 bp, Homo sapiens
actgcaagacttaaatagttca

SEQ ID NO: 5164619 - DNA, 13 bp, Homo sapiens
actgcaagctctg

SEQ ID NO: 5164620 - DNA, 18 bp, Homo sapiens
actgcaagctctgcctcc

SEQ ID NO: 5164621 - DNA, 20 bp, Homo sapiens
actgcaagctctgcctcccg

SEQ ID NO: 5164622 - DNA, 14 bp, Homo sapiens
actgcaagggattg

SEQ ID NO: 5164623 - DNA, 19 bp, Homo sapiens
actgcaagtcacaaaggaa

SEQ ID NO: 5164624 - DNA, 20 bp, Homo sapiens
actgcaagtccttttgtaaa

SEQ ID NO: 5164625 - DNA, 22 bp, Homo sapiens
actgcaagtccttttgtaaagt

SEQ ID NO: 5164626 - DNA, 20 bp, Homo sapiens
actgcaagtgagcaaacctg

SEQ ID NO: 5164627 - DNA, 21 bp, Homo sapiens
actgcaagttcaagactgaaa

SEQ ID NO: 5164628 - DNA, 21 bp, Homo sapiens
actgcaagttcattttaaatg

SEQ ID NO: 5164629 - DNA, 16 bp, Homo sapiens
actgcaataacttctg

SEQ ID NO: 5164630 - DNA, 18 bp, Homo sapiens
actgcaatagagactgta

SEQ ID NO: 5164631 - DNA, 17 bp, Homo sapiens
actgcaatcatatgtga

SEQ ID NO: 5164632 - DNA, 20 bp, Homo sapiens
actgcaatcctgtctttctg

SEQ ID NO: 5164633 - DNA, 14 bp, Homo sapiens
actgcaatgaaagt

SEQ ID NO: 5164634 - DNA, 15 bp, Homo sapiens
actgcaatgaaagtc

SEQ ID NO: 5164635 - DNA, 17 bp, Homo sapiens
actgcaattaaagtgat

SEQ ID NO: 5164636 - DNA, 21 bp, Homo sapiens
actgcaatttctccaaagctt

SEQ ID NO: 5164637 - DNA, 19 bp, Homo sapiens
actgcacaataaaaccaag

SEQ ID NO: 5164638 - DNA, 14 bp, Homo sapiens
actgcacaataact

SEQ ID NO: 5164639 - DNA, 21 bp, Homo sapiens
actgcacaataactcctccca

SEQ ID NO: 5164640 - DNA, 17 bp, Homo sapiens
actgcacaatcagttta

SEQ ID NO: 5164641 - DNA, 15 bp, Homo sapiens
actgcacacacagct

SEQ ID NO: 5164642 - DNA, 13 bp, Homo sapiens
actgcacaccagc

SEQ ID NO: 5164643 - DNA, 15 bp, Homo sapiens
actgcacactcagtg

SEQ ID NO: 5164644 - DNA, 20 bp, Homo sapiens
actgcacagcggcccctgca

SEQ ID NO: 5164645 - DNA, 22 bp, Homo sapiens
actgcacagcggcccctgcatc

SEQ ID NO: 5164646 - DNA, 18 bp, Homo sapiens
actgcacagcgtcctgtc

SEQ ID NO: 5164647 - DNA, 16 bp, Homo sapiens
actgcacagtgcatct

SEQ ID NO: 5164648 - DNA, 22 bp, Homo sapiens
actgcacagtgcatctcagccc

SEQ ID NO: 5164649 - DNA, 14 bp, Homo sapiens
actgcacagtgctg

SEQ ID NO: 5164650 - DNA, 14 bp, Homo sapiens
actgcacataattt

SEQ ID NO: 5164651 - DNA, 16 bp, Homo sapiens
actgcacatgaagaaa

SEQ ID NO: 5164652 - DNA, 17 bp, Homo sapiens
actgcacatgaagaaat

SEQ ID NO: 5164653 - DNA, 15 bp, Homo sapiens
actgcacatgatttc

SEQ ID NO: 5164654 - DNA, 16 bp, Homo sapiens
actgcacatgatttca

SEQ ID NO: 5164655 - DNA, 20 bp, Homo sapiens
actgcacatgatttcacaaa

SEQ ID NO: 5164656 - DNA, 20 bp, Homo sapiens
actgcacccacccaagacaa

SEQ ID NO: 5164657 - DNA, 17 bp, Homo sapiens
actgcacccagctccag

SEQ ID NO: 5164658 - DNA, 18 bp, Homo sapiens
actgcacccagctccagg

SEQ ID NO: 5164659 - DNA, 12 bp, Homo sapiens
actgcacccagg

SEQ ID NO: 5164660 - DNA, 14 bp, Homo sapiens
actgcacccaggag

SEQ ID NO: 5164661 - DNA, 22 bp, Homo sapiens
actgcacccccctgtgcctgct

SEQ ID NO: 5164662 - DNA, 15 bp, Homo sapiens
actgcaccccctcct

SEQ ID NO: 5164663 - DNA, 17 bp, Homo sapiens
actgcaccccctcctgc

SEQ ID NO: 5164664 - DNA, 20 bp, Homo sapiens
actgcaccccctcctgctgc

SEQ ID NO: 5164665 - DNA, 21 bp, Homo sapiens
actgcaccccctcctgctgca

SEQ ID NO: 5164666 - DNA, 22 bp, Homo sapiens
actgcaccccctcctgctgcag

SEQ ID NO: 5164667 - DNA, 12 bp, Homo sapiens
actgcacccctg

SEQ ID NO: 5164668 - DNA, 16 bp, Homo sapiens
actgcacccctgcccc

SEQ ID NO: 5164669 - DNA, 18 bp, Homo sapiens
actgcaccctccacagga

SEQ ID NO: 5164670 - DNA, 21 bp, Homo sapiens
actgcaccctccacaggagcc

SEQ ID NO: 5164671 - DNA, 14 bp, Homo sapiens
actgcaccgggcca

SEQ ID NO: 5164672 - DNA, 13 bp, Homo sapiens
actgcacctgggc

SEQ ID NO: 5164673 - DNA, 17 bp, Homo sapiens
actgcacctgggcagct

SEQ ID NO: 5164674 - DNA, 18 bp, Homo sapiens
actgcacctgggcagctc

SEQ ID NO: 5164675 - DNA, 16 bp, Homo sapiens
actgcacgtggcttct

SEQ ID NO: 5164676 - DNA, 13 bp, Homo sapiens
actgcactcagat

SEQ ID NO: 5164677 - DNA, 20 bp, Homo sapiens
actgcactccagcctgggcg

SEQ ID NO: 5164678 - DNA, 20 bp, Homo sapiens
actgcactccagcctgggtg

SEQ ID NO: 5164679 - DNA, 18 bp, Homo sapiens
actgcactctagccggag

SEQ ID NO: 5164680 - DNA, 16 bp, Homo sapiens
actgcactcttaaaca

SEQ ID NO: 5164681 - DNA, 17 bp, Homo sapiens
actgcactgcatgcaaa

SEQ ID NO: 5164682 - DNA, 17 bp, Homo sapiens
actgcacttagtagcta

SEQ ID NO: 5164683 - DNA, 18 bp, Homo sapiens
actgcacttatttgtcaa

SEQ ID NO: 5164684 - DNA, 19 bp, Homo sapiens
actgcacttggtgctgctt

SEQ ID NO: 5164685 - DNA, 20 bp, Homo sapiens
actgcactttcccccttccc

SEQ ID NO: 5164686 - DNA, 13 bp, Homo sapiens
actgcactttgtt

SEQ ID NO: 5164687 - DNA, 16 bp, Homo sapiens
actgcactttgtttag

SEQ ID NO: 5164688 - DNA, 20 bp, Homo sapiens
actgcactttgtttagaaaa

SEQ ID NO: 5164689 - DNA, 17 bp, Homo sapiens
actgcagaaagcccttc

SEQ ID NO: 5164690 - DNA, 15 bp, Homo sapiens
actgcagacattctc

SEQ ID NO: 5164691 - DNA, 17 bp, Homo sapiens
actgcagacattctcaa

SEQ ID NO: 5164692 - DNA, 18 bp, Homo sapiens
actgcagacattctcaaa

SEQ ID NO: 5164693 - DNA, 19 bp, Homo sapiens
actgcagacattctcaaag

SEQ ID NO: 5164694 - DNA, 20 bp, Homo sapiens
actgcagagactaatgttgg

SEQ ID NO: 5164695 - DNA, 17 bp, Homo sapiens
actgcagagcagatggc

SEQ ID NO: 5164696 - DNA, 13 bp, Homo sapiens
actgcagaggagc

SEQ ID NO: 5164697 - DNA, 20 bp, Homo sapiens
actgcagaggagccacctgg

SEQ ID NO: 5164698 - DNA, 23 bp, Homo sapiens
actgcagaggagccacctgggct

SEQ ID NO: 5164699 - DNA, 21 bp, Homo sapiens
actgcagatagccagacacat

SEQ ID NO: 5164700 - DNA, 21 bp, Homo sapiens
actgcagatagcccaggagca

SEQ ID NO: 5164701 - DNA, 17 bp, Homo sapiens
actgcagattgagacct

SEQ ID NO: 5164702 - DNA, 20 bp, Homo sapiens
actgcagattgagacctaca

SEQ ID NO: 5164703 - DNA, 19 bp, Homo sapiens
actgcagcaatctttgaaa

SEQ ID NO: 5164704 - DNA, 12 bp, Homo sapiens
actgcagcacct

SEQ ID NO: 5164705 - DNA, 16 bp, Homo sapiens
actgcagcacctccag

SEQ ID NO: 5164706 - DNA, 21 bp, Homo sapiens
actgcagcacctccaggcctg

SEQ ID NO: 5164707 - DNA, 16 bp, Homo sapiens
actgcagcagaaaaca

SEQ ID NO: 5164708 - DNA, 14 bp, Homo sapiens
actgcagcagaaag

SEQ ID NO: 5164709 - DNA, 14 bp, Homo sapiens
actgcagccacagg

SEQ ID NO: 5164710 - DNA, 17 bp, Homo sapiens
actgcagccactgattc

SEQ ID NO: 5164711 - DNA, 16 bp, Homo sapiens
actgcagccctctcca

SEQ ID NO: 5164712 - DNA, 23 bp, Homo sapiens
actgcagccctctccaccctccg

SEQ ID NO: 5164713 - DNA, 17 bp, Homo sapiens
actgcagcctcaacctc

SEQ ID NO: 5164714 - DNA, 13 bp, Homo sapiens
actgcagcctcat

SEQ ID NO: 5164715 - DNA, 22 bp, Homo sapiens
actgcagcctccgcctcccggg

SEQ ID NO: 5164716 - DNA, 12 bp, Homo sapiens
actgcagcctcg

SEQ ID NO: 5164717 - DNA, 23 bp, Homo sapiens
actgcagcctcgacctccctggc

SEQ ID NO: 5164718 - DNA, 18 bp, Homo sapiens
actgcagcctctctggct

SEQ ID NO: 5164719 - DNA, 19 bp, Homo sapiens
actgcagcctctctggctg

SEQ ID NO: 5164720 - DNA, 20 bp, Homo sapiens
actgcagcctctctggctgg

SEQ ID NO: 5164721 - DNA, 22 bp, Homo sapiens
actgcagcctctgcctcccagg

SEQ ID NO: 5164722 - DNA, 23 bp, Homo sapiens
actgcagcctctgcctcccaggc

SEQ ID NO: 5164723 - DNA, 19 bp, Homo sapiens
actgcagccttgtcctccc

SEQ ID NO: 5164724 - DNA, 12 bp, Homo sapiens
actgcagctgca

SEQ ID NO: 5164725 - DNA, 14 bp, Homo sapiens
actgcagctgctga

SEQ ID NO: 5164726 - DNA, 15 bp, Homo sapiens
actgcagctgtgagt

SEQ ID NO: 5164727 - DNA, 16 bp, Homo sapiens
actgcagctgtgagtg

SEQ ID NO: 5164728 - DNA, 16 bp, Homo sapiens
actgcaggaaaaccct

SEQ ID NO: 5164729 - DNA, 18 bp, Homo sapiens
actgcaggaaaaccctta

SEQ ID NO: 5164730 - DNA, 13 bp, Homo sapiens
actgcaggccctg

SEQ ID NO: 5164731 - DNA, 14 bp, Homo sapiens
actgcaggccctgg

SEQ ID NO: 5164732 - DNA, 15 bp, Homo sapiens
actgcaggccctggc

SEQ ID NO: 5164733 - DNA, 23 bp, Homo sapiens
actgcagggaaaattatttgcat

SEQ ID NO: 5164734 - DNA, 22 bp, Homo sapiens
actgcagggacacgggcagcct

SEQ ID NO: 5164735 - DNA, 18 bp, Homo sapiens
actgcagggactgccagt

SEQ ID NO: 5164736 - DNA, 17 bp, Homo sapiens
actgcagggccaggact

SEQ ID NO: 5164737 - DNA, 20 bp, Homo sapiens
actgcagggccaggactgag

SEQ ID NO: 5164738 - DNA, 23 bp, Homo sapiens
actgcagggctgctgtggcccag

SEQ ID NO: 5164739 - DNA, 19 bp, Homo sapiens
actgcaggggccactccaa

SEQ ID NO: 5164740 - DNA, 22 bp, Homo sapiens
actgcaggggccactccaaact

SEQ ID NO: 5164741 - DNA, 23 bp, Homo sapiens
actgcaggggccactccaaactc

SEQ ID NO: 5164742 - DNA, 13 bp, Homo sapiens
actgcagggttca

SEQ ID NO: 5164743 - DNA, 18 bp, Homo sapiens
actgcaggtgggctgggc

SEQ ID NO: 5164744 - DNA, 20 bp, Homo sapiens
actgcaggttggaccccaga

SEQ ID NO: 5164745 - DNA, 20 bp, Homo sapiens
actgcagtacatacgtctgc

SEQ ID NO: 5164746 - DNA, 17 bp, Homo sapiens
actgcagtcacccctgt

SEQ ID NO: 5164747 - DNA, 19 bp, Homo sapiens
actgcagtcacccctgtct

SEQ ID NO: 5164748 - DNA, 13 bp, Homo sapiens
actgcagtcactg

SEQ ID NO: 5164749 - DNA, 16 bp, Homo sapiens
actgcagtcatcaaca

SEQ ID NO: 5164750 - DNA, 22 bp, Homo sapiens
actgcagtccgcagtctggcct

SEQ ID NO: 5164751 - DNA, 14 bp, Homo sapiens
actgcagtctttat

SEQ ID NO: 5164752 - DNA, 23 bp, Homo sapiens
actgcagtctttatttttttccc

SEQ ID NO: 5164753 - DNA, 17 bp, Homo sapiens
actgcagtgaccactta

SEQ ID NO: 5164754 - DNA, 22 bp, Homo sapiens
actgcagtggcctgatctctgc

SEQ ID NO: 5164755 - DNA, 19 bp, Homo sapiens
actgcagttgactttctcc

SEQ ID NO: 5164756 - DNA, 20 bp, Homo sapiens
actgcagtttactattgcta

SEQ ID NO: 5164757 - DNA, 16 bp, Homo sapiens
actgcagtttcctgga

SEQ ID NO: 5164758 - DNA, 16 bp, Homo sapiens
actgcataccaacctg

SEQ ID NO: 5164759 - DNA, 20 bp, Homo sapiens
actgcataccaacctgggca

SEQ ID NO: 5164760 - DNA, 23 bp, Homo sapiens
actgcatatcctggtgtctagtt

SEQ ID NO: 5164761 - DNA, 19 bp, Homo sapiens
actgcatatcggaggtggt

SEQ ID NO: 5164762 - DNA, 22 bp, Homo sapiens
actgcatcaagatgtgacatgt

SEQ ID NO: 5164763 - DNA, 15 bp, Homo sapiens
actgcatcatatatt

SEQ ID NO: 5164764 - DNA, 20 bp, Homo sapiens
actgcatcatctgtttgtaa

SEQ ID NO: 5164765 - DNA, 20 bp, Homo sapiens
actgcatcccacgttctgtt

SEQ ID NO: 5164766 - DNA, 15 bp, Homo sapiens
actgcatctttctct

SEQ ID NO: 5164767 - DNA, 20 bp, Homo sapiens
actgcatgacggagccgagc

SEQ ID NO: 5164768 - DNA, 23 bp, Homo sapiens
actgcatgatcttacacgaagaa

SEQ ID NO: 5164769 - DNA, 18 bp, Homo sapiens
actgcatgcaagctcagg

SEQ ID NO: 5164770 - DNA, 17 bp, Homo sapiens
actgcatgctgctggac

SEQ ID NO: 5164771 - DNA, 20 bp, Homo sapiens
actgcatggacctaacattc

SEQ ID NO: 5164772 - DNA, 21 bp, Homo sapiens
actgcatggacctaacattcg

SEQ ID NO: 5164773 - DNA, 21 bp, Homo sapiens
actgcatggagacgcatttcg

SEQ ID NO: 5164774 - DNA, 16 bp, Homo sapiens
actgcatggcttctga

SEQ ID NO: 5164775 - DNA, 20 bp, Homo sapiens
actgcatggcttctgaaagc

SEQ ID NO: 5164776 - DNA, 15 bp, Homo sapiens
actgcatgggaaata

SEQ ID NO: 5164777 - DNA, 21 bp, Homo sapiens
actgcatgtaccatttgcatg

SEQ ID NO: 5164778 - DNA, 15 bp, Homo sapiens
actgcatgtttgtga

SEQ ID NO: 5164779 - DNA, 14 bp, Homo sapiens
actgcattatattt

SEQ ID NO: 5164780 - DNA, 15 bp, Homo sapiens
actgcattatattta

SEQ ID NO: 5164781 - DNA, 17 bp, Homo sapiens
actgcattatttgagaa

SEQ ID NO: 5164782 - DNA, 20 bp, Homo sapiens
actgcattcgtatctgagca

SEQ ID NO: 5164783 - DNA, 15 bp, Homo sapiens
actgcattcgttgct

SEQ ID NO: 5164784 - DNA, 22 bp, Homo sapiens
actgcattcgttgctccagtat

SEQ ID NO: 5164785 - DNA, 22 bp, Homo sapiens
actgcattctataataaatggg

SEQ ID NO: 5164786 - DNA, 17 bp, Homo sapiens
actgcattctctcccat

SEQ ID NO: 5164787 - DNA, 21 bp, Homo sapiens
actgcattctctcccatcctg

SEQ ID NO: 5164788 - DNA, 23 bp, Homo sapiens
actgcattcttctgagcactgtt

SEQ ID NO: 5164789 - DNA, 13 bp, Homo sapiens
actgcattctttt

SEQ ID NO: 5164790 - DNA, 21 bp, Homo sapiens
actgcattgactttcagtaaa

SEQ ID NO: 5164791 - DNA, 16 bp, Homo sapiens
actgcattggttttcc

SEQ ID NO: 5164792 - DNA, 16 bp, Homo sapiens
actgcatttagggagt

SEQ ID NO: 5164793 - DNA, 16 bp, Homo sapiens
actgcatttgcctgct

SEQ ID NO: 5164794 - DNA, 18 bp, Homo sapiens
acttgagatctgtataaa

SEQ ID NO: 5164795 - DNA, 19 bp, Homo sapiens
acttgagcaagatgatgta

SEQ ID NO: 5164796 - DNA, 20 bp, Homo sapiens
acttgagcaccgtcatggct

SEQ ID NO: 5164797 - DNA, 11 bp, Homo sapiens
acttgagccca

SEQ ID NO: 5164798 - DNA, 13 bp, Homo sapiens
acttgagcccact

SEQ ID NO: 5164799 - DNA, 15 bp, Homo sapiens
acttgagcccactcc

SEQ ID NO: 5164800 - DNA, 21 bp, Homo sapiens
acttgagcgtgaatctgtatc

SEQ ID NO: 5164801 - DNA, 19 bp, Homo sapiens
acttgagctctgtaactta

SEQ ID NO: 5164802 - DNA, 19 bp, Homo sapiens
acttgagctgtatatatat

SEQ ID NO: 5164803 - DNA, 14 bp, Homo sapiens
acttgagctgtctg

SEQ ID NO: 5164804 - DNA, 23 bp, Homo sapiens
acttgagctgtctgaagcccaaa

SEQ ID NO: 5164805 - DNA, 15 bp, Homo sapiens
acttgagctttaaaa

SEQ ID NO: 5164806 - DNA, 15 bp, Homo sapiens
acttgaggaaaccag

SEQ ID NO: 5164807 - DNA, 11 bp, Homo sapiens
acttgaggaca

SEQ ID NO: 5164808 - DNA, 13 bp, Homo sapiens
acttgaggacaca

SEQ ID NO: 5164809 - DNA, 15 bp, Homo sapiens
acttgaggacacatg

SEQ ID NO: 5164810 - DNA, 17 bp, Homo sapiens
acttgaggacacatgtc

SEQ ID NO: 5164811 - DNA, 22 bp, Homo sapiens
acttgaggaggagctggcctgc

SEQ ID NO: 5164812 - DNA, 16 bp, Homo sapiens
acttgaggcacaaatc

SEQ ID NO: 5164813 - DNA, 18 bp, Homo sapiens
acttgaggcagagtcttc

SEQ ID NO: 5164814 - DNA, 20 bp, Homo sapiens
acttgaggccaggactttga

SEQ ID NO: 5164815 - DNA, 21 bp, Homo sapiens
acttgaggccaggactttgag

SEQ ID NO: 5164816 - DNA, 19 bp, Homo sapiens
acttgaggctggcactccc

SEQ ID NO: 5164817 - DNA, 19 bp, Homo sapiens
acttgagggcccagagcag

SEQ ID NO: 5164818 - DNA, 21 bp, Homo sapiens
acttgagggcccagagcagga

SEQ ID NO: 5164819 - DNA, 15 bp, Homo sapiens
acttgaggtggcctc

SEQ ID NO: 5164820 - DNA, 15 bp, Homo sapiens
acttgaggttctctt

SEQ ID NO: 5164821 - DNA, 21 bp, Homo sapiens
acttgagtaaaatactctttt

SEQ ID NO: 5164822 - DNA, 20 bp, Homo sapiens
acttgagtataagataaaat

SEQ ID NO: 5164823 - DNA, 16 bp, Homo sapiens
acttgagtgtaatgtt

SEQ ID NO: 5164824 - DNA, 20 bp, Homo sapiens
acttgagtgttcctttttaa

SEQ ID NO: 5164825 - DNA, 22 bp, Homo sapiens
acttgagttaactttttgtagg

SEQ ID NO: 5164826 - DNA, 24 bp, Homo sapiens
acttgagttggagtactatattta

SEQ ID NO: 5164827 - DNA, 15 bp, Homo sapiens
acttgagttttattt

SEQ ID NO: 5164828 - DNA, 15 bp, Homo sapiens
acttgataatattag

SEQ ID NO: 5164829 - DNA, 13 bp, Homo sapiens
acttgataatgat

SEQ ID NO: 5164830 - DNA, 16 bp, Homo sapiens
acttgatactgaatgc

SEQ ID NO: 5164831 - DNA, 17 bp, Homo sapiens
acttgatacttgttttc

SEQ ID NO: 5164832 - DNA, 19 bp, Homo sapiens
acttgatagcaaacactgg

SEQ ID NO: 5164833 - DNA, 18 bp, Homo sapiens
acttgatataattactta

SEQ ID NO: 5164834 - DNA, 18 bp, Homo sapiens
acttgatatatttcattc

SEQ ID NO: 5164835 - DNA, 18 bp, Homo sapiens
acttgatccatttctaat

SEQ ID NO: 5164836 - DNA, 15 bp, Homo sapiens
acttgatgaataaac

SEQ ID NO: 5164837 - DNA, 16 bp, Homo sapiens
acttgatgaataaaca

SEQ ID NO: 5164838 - DNA, 14 bp, Homo sapiens
acttgatgatgtgg

SEQ ID NO: 5164839 - DNA, 17 bp, Homo sapiens
acttgatgatttttaac

SEQ ID NO: 5164840 - DNA, 23 bp, Homo sapiens
acttgatgatttttaacttttta

SEQ ID NO: 5164841 - DNA, 22 bp, Homo sapiens
acttgatgcacttattttttaa

SEQ ID NO: 5164842 - DNA, 20 bp, Homo sapiens
acttgatgcagttttaatac

SEQ ID NO: 5164843 - DNA, 19 bp, Homo sapiens
acttgatggctaacttaca

SEQ ID NO: 5164844 - DNA, 16 bp, Homo sapiens
acttgatggtcagaca

SEQ ID NO: 5164845 - DNA, 22 bp, Homo sapiens
acttgatggtcagacacaaaca

SEQ ID NO: 5164846 - DNA, 23 bp, Homo sapiens
acttgatggtcagacacaaacaa

SEQ ID NO: 5164847 - DNA, 17 bp, Homo sapiens
acttgatgtaactgaga

SEQ ID NO: 5164848 - DNA, 20 bp, Homo sapiens
acttgatgtaactgagaatt

SEQ ID NO: 5164849 - DNA, 22 bp, Homo sapiens
acttgatgtacataactcctgt

SEQ ID NO: 5164850 - DNA, 23 bp, Homo sapiens
acttgatgtacataactcctgtc

SEQ ID NO: 5164851 - DNA, 15 bp, Homo sapiens
acttgatgtcaagca

SEQ ID NO: 5164852 - DNA, 13 bp, Homo sapiens
acttgatgtctga

SEQ ID NO: 5164853 - DNA, 18 bp, Homo sapiens
acttgatgtctgaggata

SEQ ID NO: 5164854 - DNA, 17 bp, Homo sapiens
acttgatgttcctggga

SEQ ID NO: 5164855 - DNA, 15 bp, Homo sapiens
acttgatgtttgtta

SEQ ID NO: 5164856 - DNA, 14 bp, Homo sapiens
acttgattaagatt

SEQ ID NO: 5164857 - DNA, 17 bp, Homo sapiens
acttgattaagatttta

SEQ ID NO: 5164858 - DNA, 19 bp, Homo sapiens
acttgattaagattttaca

SEQ ID NO: 5164859 - DNA, 13 bp, Homo sapiens
acttgattgtact

SEQ ID NO: 5164860 - DNA, 21 bp, Homo sapiens
acttgattgtacttggagtaa

SEQ ID NO: 5164861 - DNA, 17 bp, Homo sapiens
acttgatttcttctaga

SEQ ID NO: 5164862 - DNA, 12 bp, Homo sapiens
acttgatttgat

SEQ ID NO: 5164863 - DNA, 15 bp, Homo sapiens
acttgatttgatgtg

SEQ ID NO: 5164864 - DNA, 13 bp, Homo sapiens
acttgatttgcat

SEQ ID NO: 5164865 - DNA, 18 bp, Homo sapiens
acttgatttgcatggatt

SEQ ID NO: 5164866 - DNA, 14 bp, Homo sapiens
acttgatttttcaa

SEQ ID NO: 5164867 - DNA, 17 bp, Homo sapiens
acttgatttttcaaaga

SEQ ID NO: 5164868 - DNA, 14 bp, Homo sapiens
acttgattttttca

SEQ ID NO: 5164869 - DNA, 15 bp, Homo sapiens
acttgattttttcaa

SEQ ID NO: 5164870 - DNA, 16 bp, Homo sapiens
acttgcaaaatcagtt

SEQ ID NO: 5164871 - DNA, 23 bp, Homo sapiens
acttgcaaagacctacctccaga

SEQ ID NO: 5164872 - DNA, 15 bp, Homo sapiens
acttgcaaatgaatg

SEQ ID NO: 5164873 - DNA, 17 bp, Homo sapiens
acttgcaagataatttt

SEQ ID NO: 5164874 - DNA, 21 bp, Homo sapiens
acttgcaatccaggctgttct

SEQ ID NO: 5164875 - DNA, 18 bp, Homo sapiens
acttgcaatgaaaagaaa

SEQ ID NO: 5164876 - DNA, 22 bp, Homo sapiens
acttgcaattgttaatcaaaga

SEQ ID NO: 5164877 - DNA, 16 bp, Homo sapiens
acttgcacaagcttgt

SEQ ID NO: 5164878 - DNA, 12 bp, Homo sapiens
acttgcacactc

SEQ ID NO: 5164879 - DNA, 13 bp, Homo sapiens
acttgcacctctg

SEQ ID NO: 5164880 - DNA, 19 bp, Homo sapiens
acttgcacgcccatgtgtg

SEQ ID NO: 5164881 - DNA, 15 bp, Homo sapiens
acttgcactctttaa

SEQ ID NO: 5164882 - DNA, 14 bp, Homo sapiens
acttgcactgttac

SEQ ID NO: 5164883 - DNA, 22 bp, Homo sapiens
acttgcagactctacagaggcc

SEQ ID NO: 5164884 - DNA, 23 bp, Homo sapiens
acttgcagactctacagaggcca

SEQ ID NO: 5164885 - DNA, 21 bp, Homo sapiens
acttgcagaggagcccagtgg

SEQ ID NO: 5164886 - DNA, 15 bp, Homo sapiens
acttgcagatgaaaa

SEQ ID NO: 5164887 - DNA, 20 bp, Homo sapiens
acttgcagctgatgttggaa

SEQ ID NO: 5164888 - DNA, 23 bp, Homo sapiens
acttgcagctgatgttggaagag

SEQ ID NO: 5164889 - DNA, 21 bp, Homo sapiens
acttgcagtcttgtagctaga

SEQ ID NO: 5164890 - DNA, 22 bp, Homo sapiens
acttgcagtcttgtagctagaa

SEQ ID NO: 5164891 - DNA, 17 bp, Homo sapiens
acttgcagttgtgatat

SEQ ID NO: 5164892 - DNA, 18 bp, Homo sapiens
acttgcagttgtgatata

SEQ ID NO: 5164893 - DNA, 20 bp, Homo sapiens
acttgcatctaaccaaaaag

SEQ ID NO: 5164894 - DNA, 22 bp, Homo sapiens
acttgcatgaattactgtatat

SEQ ID NO: 5164895 - DNA, 12 bp, Homo sapiens
acttgcatgtcc

SEQ ID NO: 5164896 - DNA, 16 bp, Homo sapiens
acttgcattgctggac

SEQ ID NO: 5164897 - DNA, 11 bp, Homo sapiens
acttgcatttc

SEQ ID NO: 5164898 - DNA, 18 bp, Homo sapiens
acttgcatttttgcagga

SEQ ID NO: 5164899 - DNA, 16 bp, Homo sapiens
acttgccaaaatgttg

SEQ ID NO: 5164900 - DNA, 17 bp, Homo sapiens
acttgccaaaatgttgg

SEQ ID NO: 5164901 - DNA, 22 bp, Homo sapiens
acttgccaagcagtgcacattt

SEQ ID NO: 5164902 - DNA, 13 bp, Homo sapiens
acttgccactgcc

SEQ ID NO: 5164903 - DNA, 17 bp, Homo sapiens
acttgccactgccataa

SEQ ID NO: 5164904 - DNA, 14 bp, Homo sapiens
acttgccagaagtt

SEQ ID NO: 5164905 - DNA, 16 bp, Homo sapiens
acttgccagggctctg

SEQ ID NO: 5164906 - DNA, 14 bp, Homo sapiens
acttgccatgcagg

SEQ ID NO: 5164907 - DNA, 22 bp, Homo sapiens
acttgccatgcaggaagaggcc

SEQ ID NO: 5164908 - DNA, 21 bp, Homo sapiens
acttgccattccaaaatatta

SEQ ID NO: 5164909 - DNA, 11 bp, Homo sapiens
acttgccattt

SEQ ID NO: 5164910 - DNA, 15 bp, Homo sapiens
acttgccctgagcac

SEQ ID NO: 5164911 - DNA, 13 bp, Homo sapiens
acttgccctgctc

SEQ ID NO: 5164912 - DNA, 16 bp, Homo sapiens
acttgccctgctccct

SEQ ID NO: 5164913 - DNA, 23 bp, Homo sapiens
acttgcccttctatactttctca

SEQ ID NO: 5164914 - DNA, 22 bp, Homo sapiens
acttgccgcgtcgccctcccag

SEQ ID NO: 5164915 - DNA, 23 bp, Homo sapiens
acttgccgcgtcgccctcccagg

SEQ ID NO: 5164916 - DNA, 21 bp, Homo sapiens
acttgcctcttttacctgctg

SEQ ID NO: 5164917 - DNA, 13 bp, Homo sapiens
acttgcctgcctt

SEQ ID NO: 5164918 - DNA, 13 bp, Homo sapiens
acttgcctgctgc

SEQ ID NO: 5164919 - DNA, 11 bp, Homo sapiens
acttgcctgga

SEQ ID NO: 5164920 - DNA, 12 bp, Homo sapiens
acttgcctggaa

SEQ ID NO: 5164921 - DNA, 14 bp, Homo sapiens
acttgcctggggcc

SEQ ID NO: 5164922 - DNA, 21 bp, Homo sapiens
acttgcctggggtctgagcat

SEQ ID NO: 5164923 - DNA, 14 bp, Homo sapiens
acttgcctgggtca

SEQ ID NO: 5164924 - DNA, 21 bp, Homo sapiens
acttgcctgtagtctcagcta

SEQ ID NO: 5164925 - DNA, 18 bp, Homo sapiens
acttgcctgtcaccccag

SEQ ID NO: 5164926 - DNA, 18 bp, Homo sapiens
acttgcctgttggctgct

SEQ ID NO: 5164927 - DNA, 21 bp, Homo sapiens
acttgcgagtccaaggccagt

SEQ ID NO: 5164928 - DNA, 18 bp, Homo sapiens
acttgcggccacagcact

SEQ ID NO: 5164929 - DNA, 16 bp, Homo sapiens
acttgcgtcctgcaga

SEQ ID NO: 5164930 - DNA, 14 bp, Homo sapiens
acttgctaaagcac

SEQ ID NO: 5164931 - DNA, 14 bp, Homo sapiens
acttgctaccctga

SEQ ID NO: 5164932 - DNA, 18 bp, Homo sapiens
acttgctactcatggcaa

SEQ ID NO: 5164933 - DNA, 12 bp, Homo sapiens
acttgctactta

SEQ ID NO: 5164934 - DNA, 17 bp, Homo sapiens
acttgctcaataaaggt

SEQ ID NO: 5164935 - DNA, 17 bp, Homo sapiens
acttgctcagacgagac

SEQ ID NO: 5164936 - DNA, 22 bp, Homo sapiens
acttgctcagacgagacaccct

SEQ ID NO: 5164937 - DNA, 21 bp, Homo sapiens
acttgctccattcatacacaa

SEQ ID NO: 5164938 - DNA, 16 bp, Homo sapiens
acttgctcccaggagg

SEQ ID NO: 5164939 - DNA, 16 bp, Homo sapiens
acttgctccctctcca

SEQ ID NO: 5164940 - DNA, 20 bp, Homo sapiens
acttgctccctctccaagac

SEQ ID NO: 5164941 - DNA, 23 bp, Homo sapiens
acttgctcctttccatcagcttt

SEQ ID NO: 5164942 - DNA, 17 bp, Homo sapiens
acttgctctggacctgc

SEQ ID NO: 5164943 - DNA, 18 bp, Homo sapiens
acttgctctggacctgcc

SEQ ID NO: 5164944 - DNA, 17 bp, Homo sapiens
acttgctcttgatgcct

SEQ ID NO: 5164945 - DNA, 15 bp, Homo sapiens
acttgctctttgact

SEQ ID NO: 5164946 - DNA, 14 bp, Homo sapiens
acttgctgctattt

SEQ ID NO: 5164947 - DNA, 15 bp, Homo sapiens
acttgctgctatttt

SEQ ID NO: 5164948 - DNA, 17 bp, Homo sapiens
acttgctgctattttac

SEQ ID NO: 5164949 - DNA, 14 bp, Homo sapiens
acttgctgctgcct

SEQ ID NO: 5164950 - DNA, 12 bp, Homo sapiens
acttgctgctgt

SEQ ID NO: 5164951 - DNA, 13 bp, Homo sapiens
acttgctgctgtc

SEQ ID NO: 5164952 - DNA, 23 bp, Homo sapiens
acttgctgctgtgcctgcgtcgc

SEQ ID NO: 5164953 - DNA, 17 bp, Homo sapiens
acttgctgtccaggcag

SEQ ID NO: 5164954 - DNA, 14 bp, Homo sapiens
acttgctgtgactt

SEQ ID NO: 5164955 - DNA, 22 bp, Homo sapiens
acttgctgtgtgaccctgggca

SEQ ID NO: 5164956 - DNA, 14 bp, Homo sapiens
acttgcttaaatgt

SEQ ID NO: 5164957 - DNA, 18 bp, Homo sapiens
acttgcttaaatgtgaat

SEQ ID NO: 5164958 - DNA, 16 bp, Homo sapiens
acttgcttatttgaca

SEQ ID NO: 5164959 - DNA, 14 bp, Homo sapiens
acttgcttcagtgg

SEQ ID NO: 5164960 - DNA, 16 bp, Homo sapiens
acttgcttctctagct

SEQ ID NO: 5164961 - DNA, 17 bp, Homo sapiens
acttgcttcttgtgttt

SEQ ID NO: 5164962 - DNA, 20 bp, Homo sapiens
acttgcttcttgtgtttgaa

SEQ ID NO: 5164963 - DNA, 21 bp, Homo sapiens
acttgcttgctgacttagcct

SEQ ID NO: 5164964 - DNA, 23 bp, Homo sapiens
acttgcttgtattgtaaatgtgg

SEQ ID NO: 5164965 - DNA, 22 bp, Homo sapiens
acttgctttaccttttcagggc

SEQ ID NO: 5164966 - DNA, 15 bp, Homo sapiens
acttgctttgagttg

SEQ ID NO: 5164967 - DNA, 23 bp, Homo sapiens
acttggaaaaagaaagaaacact

SEQ ID NO: 5164968 - DNA, 22 bp, Homo sapiens
acttggaaaattctcttaatca

SEQ ID NO: 5164969 - DNA, 11 bp, Homo sapiens
acttggaaata

SEQ ID NO: 5164970 - DNA, 18 bp, Homo sapiens
acttggaaataaaccatt

SEQ ID NO: 5164971 - DNA, 24 bp, Homo sapiens
acttggaaataaaccattggacag

SEQ ID NO: 5164972 - DNA, 16 bp, Homo sapiens
acttggaaatattaaa

SEQ ID NO: 5164973 - DNA, 23 bp, Homo sapiens
acttggaaatcagtagaaagcta

SEQ ID NO: 5164974 - DNA, 18 bp, Homo sapiens
acttggaaatgacacaga

SEQ ID NO: 5164975 - DNA, 13 bp, Homo sapiens
acttggaaattgt

SEQ ID NO: 5164976 - DNA, 17 bp, Homo sapiens
acttggaacagtgttta

SEQ ID NO: 5164977 - DNA, 16 bp, Homo sapiens
acttggaagaaaaaga

SEQ ID NO: 5164978 - DNA, 21 bp, Homo sapiens
acttggaagggggagacagga

SEQ ID NO: 5164979 - DNA, 22 bp, Homo sapiens
acttggaatcaaggtaagctca

SEQ ID NO: 5164980 - DNA, 18 bp, Homo sapiens
acttggaatttgtaacct

SEQ ID NO: 5164981 - DNA, 22 bp, Homo sapiens
acttggaatttgtaacctcagc

SEQ ID NO: 5164982 - DNA, 23 bp, Homo sapiens
acttggaatttgtaacctcagct

SEQ ID NO: 5164983 - DNA, 22 bp, Homo sapiens
acttggacaggagtcagtgtct

SEQ ID NO: 5164984 - DNA, 16 bp, Homo sapiens
acttggacatctctct

SEQ ID NO: 5164985 - DNA, 21 bp, Homo sapiens
acttggacatttatgtacaaa

SEQ ID NO: 5164986 - DNA, 11 bp, Homo sapiens
acttggactct

SEQ ID NO: 5164987 - DNA, 15 bp, Homo sapiens
acttggactcttgct

SEQ ID NO: 5164988 - DNA, 21 bp, Homo sapiens
acttggacttgtcctcagcag

SEQ ID NO: 5164989 - DNA, 22 bp, Homo sapiens
acttggagactcctggtctgtg

SEQ ID NO: 5164990 - DNA, 22 bp, Homo sapiens
acttggagagggacgaagaaag

SEQ ID NO: 5164991 - DNA, 14 bp, Homo sapiens
acttggagaggggg

SEQ ID NO: 5164992 - DNA, 22 bp, Homo sapiens
acttggagagggggccggaccc

SEQ ID NO: 5164993 - DNA, 14 bp, Homo sapiens
acttggagccaagg

SEQ ID NO: 5164994 - DNA, 19 bp, Homo sapiens
acttggagccccagtgcca

SEQ ID NO: 5164995 - DNA, 20 bp, Homo sapiens
acttggagctgtcctccaga

SEQ ID NO: 5164996 - DNA, 17 bp, Homo sapiens
acttggagtaattgcac

SEQ ID NO: 5164997 - DNA, 21 bp, Homo sapiens
acttggataggagcttccaga

SEQ ID NO: 5164998 - DNA, 23 bp, Homo sapiens
acttggataggagcttccagatg

SEQ ID NO: 5164999 - DNA, 14 bp, Homo sapiens
acttggatattcaa

SEQ ID NO: 5165000 - DNA, 14 bp, Homo sapiens
acttggatgagttt

SEQ ID NO: 5165001 - DNA, 23 bp, Homo sapiens
acttggatggacttgtatagtga

SEQ ID NO: 5165002 - DNA, 17 bp, Homo sapiens
acttggattctttccat

SEQ ID NO: 5165003 - DNA, 18 bp, Homo sapiens
acttggattctttccatt

SEQ ID NO: 5165004 - DNA, 22 bp, Homo sapiens
acttggattctttccatttgca

SEQ ID NO: 5165005 - DNA, 20 bp, Homo sapiens
acttggatttagtttcagta

SEQ ID NO: 5165006 - DNA, 15 bp, Homo sapiens
acttggcaaattctg

SEQ ID NO: 5165007 - DNA, 16 bp, Homo sapiens
acttggcaaattctga

SEQ ID NO: 5165008 - DNA, 15 bp, Homo sapiens
acttggcaacagaag

SEQ ID NO: 5165009 - DNA, 14 bp, Homo sapiens
acttggcaccaata

SEQ ID NO: 5165010 - DNA, 16 bp, Homo sapiens
acttggcaccaataaa

SEQ ID NO: 5165011 - DNA, 22 bp, Homo sapiens
acttggcaccaataaaggagga

SEQ ID NO: 5165012 - DNA, 23 bp, Homo sapiens
acttggcaccaataaaggaggaa

SEQ ID NO: 5165013 - DNA, 11 bp, Homo sapiens
acttggcactt

SEQ ID NO: 5165014 - DNA, 17 bp, Homo sapiens
acttggcagctttttct

SEQ ID NO: 5165015 - DNA, 16 bp, Homo sapiens
acttggcaggtgcctg

SEQ ID NO: 5165016 - DNA, 17 bp, Homo sapiens
acttggcatacaaaata

SEQ ID NO: 5165017 - DNA, 19 bp, Homo sapiens
acttggcatacaaaatatt

SEQ ID NO: 5165018 - DNA, 20 bp, Homo sapiens
acttggccagttttctgttc

SEQ ID NO: 5165019 - DNA, 18 bp, Homo sapiens
acttggcccaggaaaaac

SEQ ID NO: 5165020 - DNA, 17 bp, Homo sapiens
acttggcccccttcagg

SEQ ID NO: 5165021 - DNA, 21 bp, Homo sapiens
acttggcccccttcaggagcc

SEQ ID NO: 5165022 - DNA, 23 bp, Homo sapiens
acttggcccccttcaggagcctg

SEQ ID NO: 5165023 - DNA, 15 bp, Homo sapiens
acttggcctctctct

SEQ ID NO: 5165024 - DNA, 14 bp, Homo sapiens
acttggctctgagg

SEQ ID NO: 5165025 - DNA, 14 bp, Homo sapiens
acttggctggaatt

SEQ ID NO: 5165026 - DNA, 22 bp, Homo sapiens
acttggctggtgtggtacagag

SEQ ID NO: 5165027 - DNA, 11 bp, Homo sapiens
acttggctttc

SEQ ID NO: 5165028 - DNA, 19 bp, Homo sapiens
acttggctttcctgtttct

SEQ ID NO: 5165029 - DNA, 17 bp, Homo sapiens
acttgggaaatttttaa

SEQ ID NO: 5165030 - DNA, 18 bp, Homo sapiens
acttgggaaatttttaat

SEQ ID NO: 5165031 - DNA, 13 bp, Homo sapiens
acttgggacattg

SEQ ID NO: 5165032 - DNA, 20 bp, Homo sapiens
acttgggagacctgtaatca

SEQ ID NO: 5165033 - DNA, 22 bp, Homo sapiens
acttgggagagggagcaagcct

SEQ ID NO: 5165034 - DNA, 15 bp, Homo sapiens
acttgggagcctgag

SEQ ID NO: 5165035 - DNA, 15 bp, Homo sapiens
acttgggagctgctg

SEQ ID NO: 5165036 - DNA, 21 bp, Homo sapiens
acttgggaggctgaggcagga

SEQ ID NO: 5165037 - DNA, 22 bp, Homo sapiens
acttgggaggctgaggcaggag

SEQ ID NO: 5165038 - DNA, 20 bp, Homo sapiens
acttgggcacccccagcctg

SEQ ID NO: 5165039 - DNA, 17 bp, Homo sapiens
acttgggccatagctcc

SEQ ID NO: 5165040 - DNA, 16 bp, Homo sapiens
acttgggctgtaaagc

SEQ ID NO: 5165041 - DNA, 18 bp, Homo sapiens
acttggggcacagggaga

SEQ ID NO: 5165042 - DNA, 23 bp, Homo sapiens
acttggggccttcccccttgtgg

SEQ ID NO: 5165043 - DNA, 22 bp, Homo sapiens
acttgggggaacgatgtgtctg

SEQ ID NO: 5165044 - DNA, 19 bp, Homo sapiens
acttgggggactgggcgca

SEQ ID NO: 5165045 - DNA, 16 bp, Homo sapiens
acttgggggctcagca

SEQ ID NO: 5165046 - DNA, 16 bp, Homo sapiens
acttggtaagagggag

SEQ ID NO: 5165047 - DNA, 16 bp, Homo sapiens
acttggtcagagccac

SEQ ID NO: 5165048 - DNA, 20 bp, Homo sapiens
acttggtccaactgcaactc

SEQ ID NO: 5165049 - DNA, 21 bp, Homo sapiens
acttggtccagattgaaaagt

SEQ ID NO: 5165050 - DNA, 20 bp, Homo sapiens
acttggtgattacctgaaag

SEQ ID NO: 5165051 - DNA, 13 bp, Homo sapiens
acttggtgctggg

SEQ ID NO: 5165052 - DNA, 17 bp, Homo sapiens
acttggtggcttttcct

SEQ ID NO: 5165053 - DNA, 18 bp, Homo sapiens
acttggtgtaattaataa

SEQ ID NO: 5165054 - DNA, 16 bp, Homo sapiens
acttggtgtgaagact

SEQ ID NO: 5165055 - DNA, 14 bp, Homo sapiens
acttggttccattg

SEQ ID NO: 5165056 - DNA, 16 bp, Homo sapiens
acttggttctgaagcc

SEQ ID NO: 5165057 - DNA, 20 bp, Homo sapiens
acttggttggtagggtggga

SEQ ID NO: 5165058 - DNA, 14 bp, Homo sapiens
acttggtttagggt

SEQ ID NO: 5165059 - DNA, 22 bp, Homo sapiens
acttggtttgttatatcaggga

SEQ ID NO: 5165060 - DNA, 14 bp, Homo sapiens
acttggttttgcta

SEQ ID NO: 5165061 - DNA, 20 bp, Homo sapiens
acttggtttttggctctttc

SEQ ID NO: 5165062 - DNA, 21 bp, Homo sapiens
acttggtttttttttttctta

SEQ ID NO: 5165063 - DNA, 12 bp, Homo sapiens
acttgtaaaatg

SEQ ID NO: 5165064 - DNA, 13 bp, Homo sapiens
acttgtaaaatgc

SEQ ID NO: 5165065 - DNA, 15 bp, Homo sapiens
acttgtaaaatgctt

SEQ ID NO: 5165066 - DNA, 16 bp, Homo sapiens
acttgtaaaatgcttt

SEQ ID NO: 5165067 - DNA, 18 bp, Homo sapiens
acttgtaaaggaatttaa

SEQ ID NO: 5165068 - DNA, 14 bp, Homo sapiens
acttgtaaataaat

SEQ ID NO: 5165069 - DNA, 20 bp, Homo sapiens
acttgtaaataaatagattt

SEQ ID NO: 5165070 - DNA, 13 bp, Homo sapiens
acttgtaaataca

SEQ ID NO: 5165071 - DNA, 16 bp, Homo sapiens
acttgtaaatacacca

SEQ ID NO: 5165072 - DNA, 13 bp, Homo sapiens
acttgtaaatata

SEQ ID NO: 5165073 - DNA, 20 bp, Homo sapiens
acttgtaaatgtggtaaaga

SEQ ID NO: 5165074 - DNA, 11 bp, Homo sapiens
acttgtaactt

SEQ ID NO: 5165075 - DNA, 14 bp, Homo sapiens
acttgtaagttgct

SEQ ID NO: 5165076 - DNA, 12 bp, Homo sapiens
acttgtacagtt

SEQ ID NO: 5165077 - DNA, 19 bp, Homo sapiens
acttgtacttacactgaaa

SEQ ID NO: 5165078 - DNA, 13 bp, Homo sapiens
acttgtacttgtt

SEQ ID NO: 5165079 - DNA, 23 bp, Homo sapiens
acttgtacttgtttcatctggtt

SEQ ID NO: 5165080 - DNA, 14 bp, Homo sapiens
acttgtagaaatct

SEQ ID NO: 5165081 - DNA, 12 bp, Homo sapiens
acttgtagattt

SEQ ID NO: 5165082 - DNA, 14 bp, Homo sapiens
acttgtagcagcta

SEQ ID NO: 5165083 - DNA, 14 bp, Homo sapiens
acttgtagctgtaa

SEQ ID NO: 5165084 - DNA, 17 bp, Homo sapiens
acttgtagctgtaaaac

SEQ ID NO: 5165085 - DNA, 19 bp, Homo sapiens
acttgtaggaatctgcctt

SEQ ID NO: 5165086 - DNA, 17 bp, Homo sapiens
acttgtagggatgcctt

SEQ ID NO: 5165087 - DNA, 14 bp, Homo sapiens
acttgtataaatgt

SEQ ID NO: 5165088 - DNA, 15 bp, Homo sapiens
acttgtataaatgta

SEQ ID NO: 5165089 - DNA, 21 bp, Homo sapiens
acttgtatagtgagagaggag

SEQ ID NO: 5165090 - DNA, 20 bp, Homo sapiens
acttgtatattccaccattc

SEQ ID NO: 5165091 - DNA, 18 bp, Homo sapiens
acttgtatattctatttt

SEQ ID NO: 5165092 - DNA, 16 bp, Homo sapiens
acttgtatatttgtac

SEQ ID NO: 5165093 - DNA, 19 bp, Homo sapiens
acttgtatatttgtacaaa

SEQ ID NO: 5165094 - DNA, 20 bp, Homo sapiens
acttgtatattttaagaaat

SEQ ID NO: 5165095 - DNA, 14 bp, Homo sapiens
acttgtatgaaaga

SEQ ID NO: 5165096 - DNA, 15 bp, Homo sapiens
acttgtatgctgccc

SEQ ID NO: 5165097 - DNA, 18 bp, Homo sapiens
acttgtattatgtgtgtt

SEQ ID NO: 5165098 - DNA, 13 bp, Homo sapiens
acttgtattgact

SEQ ID NO: 5165099 - DNA, 16 bp, Homo sapiens
acttgtattgacttta

SEQ ID NO: 5165100 - DNA, 14 bp, Homo sapiens
acttgtcaaagaag

SEQ ID NO: 5165101 - DNA, 18 bp, Homo sapiens
acttgtcaagcctgtgca

SEQ ID NO: 5165102 - DNA, 13 bp, Homo sapiens
acttgtcaatatt

SEQ ID NO: 5165103 - DNA, 14 bp, Homo sapiens
acttgtcaatattt

SEQ ID NO: 5165104 - DNA, 20 bp, Homo sapiens
acttgtcacagatgcagatt

SEQ ID NO: 5165105 - DNA, 20 bp, Homo sapiens
acttgtcactgacacaaagg

SEQ ID NO: 5165106 - DNA, 14 bp, Homo sapiens
acttgtcacttgca

SEQ ID NO: 5165107 - DNA, 15 bp, Homo sapiens
acttgtcacttgcat

SEQ ID NO: 5165108 - DNA, 18 bp, Homo sapiens
acttgtcacttgcatgtc

SEQ ID NO: 5165109 - DNA, 19 bp, Homo sapiens
acttgtcaggagtgtgtgt

SEQ ID NO: 5165110 - DNA, 23 bp, Homo sapiens
acttgtcattgttatataatcat

SEQ ID NO: 5165111 - DNA, 24 bp, Homo sapiens
acttgtcattgttatataatcatt

SEQ ID NO: 5165112 - DNA, 15 bp, Homo sapiens
acttgtccattgcgt

SEQ ID NO: 5165113 - DNA, 17 bp, Homo sapiens
acttgtccattgcgtta

SEQ ID NO: 5165114 - DNA, 18 bp, Homo sapiens
acttgtcctagcacagat

SEQ ID NO: 5165115 - DNA, 14 bp, Homo sapiens
acttgtcctcagct

SEQ ID NO: 5165116 - DNA, 19 bp, Homo sapiens
acttgtcctcagcttgggc

SEQ ID NO: 5165117 - DNA, 19 bp, Homo sapiens
acttgtcctttgaggcccc

SEQ ID NO: 5165118 - DNA, 22 bp, Homo sapiens
acttgtctaaataagtttgcaa

SEQ ID NO: 5165119 - DNA, 17 bp, Homo sapiens
acttgtctcattttaat

SEQ ID NO: 5165120 - DNA, 20 bp, Homo sapiens
acttgtctcattttaatgta

SEQ ID NO: 5165121 - DNA, 14 bp, Homo sapiens
acttgtctcccagt

SEQ ID NO: 5165122 - DNA, 17 bp, Homo sapiens
acttgtctcctttctga

SEQ ID NO: 5165123 - DNA, 15 bp, Homo sapiens
acttgtctgaggcct

SEQ ID NO: 5165124 - DNA, 15 bp, Homo sapiens
acttgtctgcctcct

SEQ ID NO: 5165125 - DNA, 17 bp, Homo sapiens
acttgtctgcctcctgc

SEQ ID NO: 5165126 - DNA, 20 bp, Homo sapiens
acttgtctgcctcctgcttt

SEQ ID NO: 5165127 - DNA, 12 bp, Homo sapiens
acttgtctggct

SEQ ID NO: 5165128 - DNA, 19 bp, Homo sapiens
acttgtctgggaattgtgt

SEQ ID NO: 5165129 - DNA, 20 bp, Homo sapiens
acttgtctgtcaaatgtttc

SEQ ID NO: 5165130 - DNA, 12 bp, Homo sapiens
acttgtctgttt

SEQ ID NO: 5165131 - DNA, 13 bp, Homo sapiens
acttgtctgtttt

SEQ ID NO: 5165132 - DNA, 14 bp, Homo sapiens
acttgtctttctgg

SEQ ID NO: 5165133 - DNA, 14 bp, Homo sapiens
acttgtctttggac

SEQ ID NO: 5165134 - DNA, 20 bp, Homo sapiens
acttgtctttggaccctgag

SEQ ID NO: 5165135 - DNA, 15 bp, Homo sapiens
acttgtctttttctg

SEQ ID NO: 5165136 - DNA, 17 bp, Homo sapiens
acttgtctttttctgga

SEQ ID NO: 5165137 - DNA, 14 bp, Homo sapiens
acttgtctttttgt

SEQ ID NO: 5165138 - DNA, 17 bp, Homo sapiens
acttgtgaaacacagct

SEQ ID NO: 5165139 - DNA, 20 bp, Homo sapiens
acttgtgaaacacagctgtt

SEQ ID NO: 5165140 - DNA, 21 bp, Homo sapiens
acttgtgaaacgtctggactg

SEQ ID NO: 5165141 - DNA, 13 bp, Homo sapiens
acttgtgattggc

SEQ ID NO: 5165142 - DNA, 18 bp, Homo sapiens
acttgtgattggctgcag

SEQ ID NO: 5165143 - DNA, 13 bp, Homo sapiens
acttgtgcactta

SEQ ID NO: 5165144 - DNA, 13 bp, Homo sapiens
acttgtgccaaca

SEQ ID NO: 5165145 - DNA, 13 bp, Homo sapiens
acttgtgccagcc

SEQ ID NO: 5165146 - DNA, 21 bp, Homo sapiens
acttgtgccctccctgtcctt

SEQ ID NO: 5165147 - DNA, 11 bp, Homo sapiens
acttgtgcctc

SEQ ID NO: 5165148 - DNA, 20 bp, Homo sapiens
acttgtgcctcttgggagac

SEQ ID NO: 5165149 - DNA, 15 bp, Homo sapiens
acttgtggacacagc

SEQ ID NO: 5165150 - DNA, 16 bp, Homo sapiens
acttgtggacacagct

SEQ ID NO: 5165151 - DNA, 19 bp, Homo sapiens
acttgtggacacagctctt

SEQ ID NO: 5165152 - DNA, 20 bp, Homo sapiens
actgcattttacacattgac

SEQ ID NO: 5165153 - DNA, 19 bp, Homo sapiens
actgcattttgtagcctct

SEQ ID NO: 5165154 - DNA, 21 bp, Homo sapiens
actgcattttgtagcctctct

SEQ ID NO: 5165155 - DNA, 22 bp, Homo sapiens
actgcattttgtagcctctctt

SEQ ID NO: 5165156 - DNA, 15 bp, Homo sapiens
actgccaaaaccaaa

SEQ ID NO: 5165157 - DNA, 21 bp, Homo sapiens
actgccaaagaagccttgcca

SEQ ID NO: 5165158 - DNA, 20 bp, Homo sapiens
actgccaaataaaatgttta

SEQ ID NO: 5165159 - DNA, 17 bp, Homo sapiens
actgccaaataaacagc

SEQ ID NO: 5165160 - DNA, 20 bp, Homo sapiens
actgccaaataaatcatcct

SEQ ID NO: 5165161 - DNA, 14 bp, Homo sapiens
actgccaacctcgc

SEQ ID NO: 5165162 - DNA, 14 bp, Homo sapiens
actgccaacctggg

SEQ ID NO: 5165163 - DNA, 17 bp, Homo sapiens
actgccaactgatctgt

SEQ ID NO: 5165164 - DNA, 16 bp, Homo sapiens
actgccaagactgctg

SEQ ID NO: 5165165 - DNA, 22 bp, Homo sapiens
actgccaagccaaccctggaaa

SEQ ID NO: 5165166 - DNA, 13 bp, Homo sapiens
actgccaagccag

SEQ ID NO: 5165167 - DNA, 18 bp, Homo sapiens
actgccaagccagattct

SEQ ID NO: 5165168 - DNA, 21 bp, Homo sapiens
actgccaagccagattctctt

SEQ ID NO: 5165169 - DNA, 22 bp, Homo sapiens
actgccaagccagattctcttg

SEQ ID NO: 5165170 - DNA, 17 bp, Homo sapiens
actgccaagcttcctgt

SEQ ID NO: 5165171 - DNA, 19 bp, Homo sapiens
actgccaagcttcctgtgc

SEQ ID NO: 5165172 - DNA, 13 bp, Homo sapiens
actgccaaggtac

SEQ ID NO: 5165173 - DNA, 15 bp, Homo sapiens
actgccaatgctgta

SEQ ID NO: 5165174 - DNA, 16 bp, Homo sapiens
actgccaatgctgtac

SEQ ID NO: 5165175 - DNA, 18 bp, Homo sapiens
actgccacaaggaagaaa

SEQ ID NO: 5165176 - DNA, 22 bp, Homo sapiens
actgccacacgtctgaccctct

SEQ ID NO: 5165177 - DNA, 18 bp, Homo sapiens
actgccacactctccatc

SEQ ID NO: 5165178 - DNA, 20 bp, Homo sapiens
actgccacgtgccttaggaa

SEQ ID NO: 5165179 - DNA, 23 bp, Homo sapiens
actgccacgtgccttaggaatac

SEQ ID NO: 5165180 - DNA, 23 bp, Homo sapiens
actgccactaaaatccacccagc

SEQ ID NO: 5165181 - DNA, 16 bp, Homo sapiens
actgccactccagtcc

SEQ ID NO: 5165182 - DNA, 18 bp, Homo sapiens
actgccactccagtcctg

SEQ ID NO: 5165183 - DNA, 19 bp, Homo sapiens
actgccactccagtcctgc

SEQ ID NO: 5165184 - DNA, 18 bp, Homo sapiens
actgccactgtgtgcctt

SEQ ID NO: 5165185 - DNA, 16 bp, Homo sapiens
actgccactttgcaca

SEQ ID NO: 5165186 - DNA, 17 bp, Homo sapiens
actgccactttgcacat

SEQ ID NO: 5165187 - DNA, 18 bp, Homo sapiens
actgccactttgcacatt

SEQ ID NO: 5165188 - DNA, 12 bp, Homo sapiens
actgccagagct

SEQ ID NO: 5165189 - DNA, 22 bp, Homo sapiens
actgccagatgctgatgttcag

SEQ ID NO: 5165190 - DNA, 13 bp, Homo sapiens
actgccagcagca

SEQ ID NO: 5165191 - DNA, 18 bp, Homo sapiens
actgccagcagcagcagg

SEQ ID NO: 5165192 - DNA, 12 bp, Homo sapiens
actgccagcatt

SEQ ID NO: 5165193 - DNA, 14 bp, Homo sapiens
actgccagcccacc

SEQ ID NO: 5165194 - DNA, 15 bp, Homo sapiens
actgccagccgccac

SEQ ID NO: 5165195 - DNA, 12 bp, Homo sapiens
actgccagctct

SEQ ID NO: 5165196 - DNA, 17 bp, Homo sapiens
actgccaggaccccagg

SEQ ID NO: 5165197 - DNA, 12 bp, Homo sapiens
actgccaggagg

SEQ ID NO: 5165198 - DNA, 13 bp, Homo sapiens
actgccaggaggg

SEQ ID NO: 5165199 - DNA, 21 bp, Homo sapiens
actgccaggattttgtattgc

SEQ ID NO: 5165200 - DNA, 18 bp, Homo sapiens
actgccaggcacctggcc

SEQ ID NO: 5165201 - DNA, 15 bp, Homo sapiens
actgccaggccagcc

SEQ ID NO: 5165202 - DNA, 18 bp, Homo sapiens
actgccaggctgcctcct

SEQ ID NO: 5165203 - DNA, 17 bp, Homo sapiens
actgccaggctgtttca

SEQ ID NO: 5165204 - DNA, 13 bp, Homo sapiens
actgccaggtggt

SEQ ID NO: 5165205 - DNA, 14 bp, Homo sapiens
actgccagtggaga

SEQ ID NO: 5165206 - DNA, 14 bp, Homo sapiens
actgccataaaaca

SEQ ID NO: 5165207 - DNA, 21 bp, Homo sapiens
actgccataaaacattaagaa

SEQ ID NO: 5165208 - DNA, 21 bp, Homo sapiens
actgccataacttgtttgtaa

SEQ ID NO: 5165209 - DNA, 14 bp, Homo sapiens
actgccatattgtg

SEQ ID NO: 5165210 - DNA, 22 bp, Homo sapiens
actgccatggaattccctcctg

SEQ ID NO: 5165211 - DNA, 18 bp, Homo sapiens
actgccattacccagtgc

SEQ ID NO: 5165212 - DNA, 22 bp, Homo sapiens
actgccattttttgtctgtgat

SEQ ID NO: 5165213 - DNA, 19 bp, Homo sapiens
actgcccacatgggacctg

SEQ ID NO: 5165214 - DNA, 22 bp, Homo sapiens
actgcccacatgggacctggcc

SEQ ID NO: 5165215 - DNA, 23 bp, Homo sapiens
actgcccacatttgggctcaggg

SEQ ID NO: 5165216 - DNA, 15 bp, Homo sapiens
actgcccaccaaagg

SEQ ID NO: 5165217 - DNA, 17 bp, Homo sapiens
actgcccaccctgggcc

SEQ ID NO: 5165218 - DNA, 19 bp, Homo sapiens
actgcccagaaagtggggg

SEQ ID NO: 5165219 - DNA, 12 bp, Homo sapiens
actgcccagcca

SEQ ID NO: 5165220 - DNA, 14 bp, Homo sapiens
actgcccagccact

SEQ ID NO: 5165221 - DNA, 22 bp, Homo sapiens
actgcccagccactccaagccc

SEQ ID NO: 5165222 - DNA, 18 bp, Homo sapiens
actgcccagccccttttc

SEQ ID NO: 5165223 - DNA, 17 bp, Homo sapiens
actgcccaggcactgca

SEQ ID NO: 5165224 - DNA, 12 bp, Homo sapiens
actgcccaggga

SEQ ID NO: 5165225 - DNA, 23 bp, Homo sapiens
actgcccagggaagccctcggcc

SEQ ID NO: 5165226 - DNA, 17 bp, Homo sapiens
actgcccatcccacccc

SEQ ID NO: 5165227 - DNA, 21 bp, Homo sapiens
actgccccaactcctggaagc

SEQ ID NO: 5165228 - DNA, 14 bp, Homo sapiens
actgccccacatgc

SEQ ID NO: 5165229 - DNA, 19 bp, Homo sapiens
actgccccacatgcatgtc

SEQ ID NO: 5165230 - DNA, 20 bp, Homo sapiens
actgccccacatgcatgtct

SEQ ID NO: 5165231 - DNA, 22 bp, Homo sapiens
actgccccacatgcatgtctgc

SEQ ID NO: 5165232 - DNA, 14 bp, Homo sapiens
actgccccaccagc

SEQ ID NO: 5165233 - DNA, 20 bp, Homo sapiens
actgccccaccagccacctc

SEQ ID NO: 5165234 - DNA, 22 bp, Homo sapiens
actgccccaccagccacctctt

SEQ ID NO: 5165235 - DNA, 20 bp, Homo sapiens
actgccccacttctggcatg

SEQ ID NO: 5165236 - DNA, 13 bp, Homo sapiens
actgccccagcca

SEQ ID NO: 5165237 - DNA, 15 bp, Homo sapiens
actgccccagctccg

SEQ ID NO: 5165238 - DNA, 12 bp, Homo sapiens
actgcccccaga

SEQ ID NO: 5165239 - DNA, 20 bp, Homo sapiens
actgcccccagaaagcctcc

SEQ ID NO: 5165240 - DNA, 21 bp, Homo sapiens
actgcccccagaaagcctcct

SEQ ID NO: 5165241 - DNA, 22 bp, Homo sapiens
actgcccccagaaagcctcctg

SEQ ID NO: 5165242 - DNA, 19 bp, Homo sapiens
actgccccccatgaggaag

SEQ ID NO: 5165243 - DNA, 22 bp, Homo sapiens
actgccccccatgaggaaggaa

SEQ ID NO: 5165244 - DNA, 21 bp, Homo sapiens
actgccccccgaggctgctag

SEQ ID NO: 5165245 - DNA, 15 bp, Homo sapiens
actgccccctctgcc

SEQ ID NO: 5165246 - DNA, 16 bp, Homo sapiens
actgccccctgctgcc

SEQ ID NO: 5165247 - DNA, 19 bp, Homo sapiens
actgccccgtgcagactgg

SEQ ID NO: 5165248 - DNA, 20 bp, Homo sapiens
actgccccgtgtgaatgtag

SEQ ID NO: 5165249 - DNA, 16 bp, Homo sapiens
actgcccctgccctga

SEQ ID NO: 5165250 - DNA, 18 bp, Homo sapiens
actgcccctgccctgagg

SEQ ID NO: 5165251 - DNA, 15 bp, Homo sapiens
actgcccgagctggt

SEQ ID NO: 5165252 - DNA, 16 bp, Homo sapiens
actgcccgagctggtg

SEQ ID NO: 5165253 - DNA, 19 bp, Homo sapiens
actgcccgagctggtgcat

SEQ ID NO: 5165254 - DNA, 16 bp, Homo sapiens
actgcccgcacaccct

SEQ ID NO: 5165255 - DNA, 16 bp, Homo sapiens
actgcccgctcctcgg

SEQ ID NO: 5165256 - DNA, 17 bp, Homo sapiens
actgcccggggcagctg

SEQ ID NO: 5165257 - DNA, 20 bp, Homo sapiens
actgcccggggcagctgcca

SEQ ID NO: 5165258 - DNA, 22 bp, Homo sapiens
actgcccggggcagctgccaga

SEQ ID NO: 5165259 - DNA, 13 bp, Homo sapiens
actgccctaagcc

SEQ ID NO: 5165260 - DNA, 17 bp, Homo sapiens
actgccctaagccccca

SEQ ID NO: 5165261 - DNA, 15 bp, Homo sapiens
actgccctccagggc

SEQ ID NO: 5165262 - DNA, 18 bp, Homo sapiens
actgccctccagggccag

SEQ ID NO: 5165263 - DNA, 14 bp, Homo sapiens
actgccctcccctt

SEQ ID NO: 5165264 - DNA, 18 bp, Homo sapiens
actgccctccgcccttcc

SEQ ID NO: 5165265 - DNA, 11 bp, Homo sapiens
actgccctctg

SEQ ID NO: 5165266 - DNA, 15 bp, Homo sapiens
actgccctctgccac

SEQ ID NO: 5165267 - DNA, 12 bp, Homo sapiens
actgccctgccc

SEQ ID NO: 5165268 - DNA, 12 bp, Homo sapiens
actgccctgcct

SEQ ID NO: 5165269 - DNA, 13 bp, Homo sapiens
actgccctggcag

SEQ ID NO: 5165270 - DNA, 17 bp, Homo sapiens
actgccctggcagcagc

SEQ ID NO: 5165271 - DNA, 13 bp, Homo sapiens
actgccctgttca

SEQ ID NO: 5165272 - DNA, 22 bp, Homo sapiens
actgccctgttcatgtgcctct

SEQ ID NO: 5165273 - DNA, 17 bp, Homo sapiens
actgccctgtttctgtt

SEQ ID NO: 5165274 - DNA, 12 bp, Homo sapiens
actgcccttcca

SEQ ID NO: 5165275 - DNA, 13 bp, Homo sapiens
actgcccttccag

SEQ ID NO: 5165276 - DNA, 14 bp, Homo sapiens
actgcccttgctgc

SEQ ID NO: 5165277 - DNA, 15 bp, Homo sapiens
actgcccttgctgcc

SEQ ID NO: 5165278 - DNA, 18 bp, Homo sapiens
actgcccttttaaatggc

SEQ ID NO: 5165279 - DNA, 19 bp, Homo sapiens
actgcccttttaaatggca

SEQ ID NO: 5165280 - DNA, 20 bp, Homo sapiens
actgcccttttaaatggcat

SEQ ID NO: 5165281 - DNA, 22 bp, Homo sapiens
actgcccttttaaatggcatga

SEQ ID NO: 5165282 - DNA, 17 bp, Homo sapiens
actgccgacatccctcc

SEQ ID NO: 5165283 - DNA, 23 bp, Homo sapiens
actgccgccgccgtggtgacccc

SEQ ID NO: 5165284 - DNA, 19 bp, Homo sapiens
actgccgcctactggacgc

SEQ ID NO: 5165285 - DNA, 13 bp, Homo sapiens
actgccgcctcct

SEQ ID NO: 5165286 - DNA, 21 bp, Homo sapiens
actgccgctgcccccaccctg

SEQ ID NO: 5165287 - DNA, 22 bp, Homo sapiens
actgccgctgcccccaccctgc

SEQ ID NO: 5165288 - DNA, 16 bp, Homo sapiens
actgcctaaaatgttc

SEQ ID NO: 5165289 - DNA, 14 bp, Homo sapiens
actgcctaagccct

SEQ ID NO: 5165290 - DNA, 18 bp, Homo sapiens
actgcctaaggccctttg

SEQ ID NO: 5165291 - DNA, 19 bp, Homo sapiens
actgcctaccagtcgccct

SEQ ID NO: 5165292 - DNA, 17 bp, Homo sapiens
actgcctacccacccct

SEQ ID NO: 5165293 - DNA, 14 bp, Homo sapiens
actgcctactgtta

SEQ ID NO: 5165294 - DNA, 18 bp, Homo sapiens
actgcctactgttactct

SEQ ID NO: 5165295 - DNA, 19 bp, Homo sapiens
actgcctagaaaatgcaaa

SEQ ID NO: 5165296 - DNA, 22 bp, Homo sapiens
actgcctagaaacaacactgta

SEQ ID NO: 5165297 - DNA, 22 bp, Homo sapiens
actgcctaggaggctggccaag

SEQ ID NO: 5165298 - DNA, 22 bp, Homo sapiens
actgcctataatcttatacaac

SEQ ID NO: 5165299 - DNA, 12 bp, Homo sapiens
actgcctcccat

SEQ ID NO: 5165300 - DNA, 23 bp, Homo sapiens
actgcctcccatccttccctcat

SEQ ID NO: 5165301 - DNA, 17 bp, Homo sapiens
actgcctccctctcttc

SEQ ID NO: 5165302 - DNA, 20 bp, Homo sapiens
actgcctcctccctggctgc

SEQ ID NO: 5165303 - DNA, 15 bp, Homo sapiens
actgcctcctgcctg

SEQ ID NO: 5165304 - DNA, 12 bp, Homo sapiens
actgcctcctgt

SEQ ID NO: 5165305 - DNA, 22 bp, Homo sapiens
actgcctcctgttttctccctc

SEQ ID NO: 5165306 - DNA, 18 bp, Homo sapiens
actgcctccttgccagcc

SEQ ID NO: 5165307 - DNA, 22 bp, Homo sapiens
actgcctctatgccctgcagag

SEQ ID NO: 5165308 - DNA, 16 bp, Homo sapiens
actgcctctccctggc

SEQ ID NO: 5165309 - DNA, 10 bp, Homo sapiens
actgcctctg

SEQ ID NO: 5165310 - DNA, 15 bp, Homo sapiens
actgcctctgcctta

SEQ ID NO: 5165311 - DNA, 18 bp, Homo sapiens
actgcctctgccttagag

SEQ ID NO: 5165312 - DNA, 22 bp, Homo sapiens
actgcctctgccttagaggagc

SEQ ID NO: 5165313 - DNA, 14 bp, Homo sapiens
actgcctgaaagca

SEQ ID NO: 5165314 - DNA, 15 bp, Homo sapiens
actgcctgaataaag

SEQ ID NO: 5165315 - DNA, 23 bp, Homo sapiens
actgcctgcagaggtctgtgctg

SEQ ID NO: 5165316 - DNA, 18 bp, Homo sapiens
actgcctgcagctgagat

SEQ ID NO: 5165317 - DNA, 19 bp, Homo sapiens
actgcctgcagctgagatt

SEQ ID NO: 5165318 - DNA, 13 bp, Homo sapiens
actgcctgcccac

SEQ ID NO: 5165319 - DNA, 14 bp, Homo sapiens
actgcctgcccacc

SEQ ID NO: 5165320 - DNA, 16 bp, Homo sapiens
actgcctgcccacccg

SEQ ID NO: 5165321 - DNA, 22 bp, Homo sapiens
actgcctgcccacccgtggaga

SEQ ID NO: 5165322 - DNA, 23 bp, Homo sapiens
actgcctgcccacccgtggagat

SEQ ID NO: 5165323 - DNA, 21 bp, Homo sapiens
actgcctgcctcccctccgca

SEQ ID NO: 5165324 - DNA, 13 bp, Homo sapiens
actgcctgctccc

SEQ ID NO: 5165325 - DNA, 14 bp, Homo sapiens
actgcctgcttggg

SEQ ID NO: 5165326 - DNA, 14 bp, Homo sapiens
actgcctggaaagc

SEQ ID NO: 5165327 - DNA, 20 bp, Homo sapiens
actgcctggattccatttat

SEQ ID NO: 5165328 - DNA, 12 bp, Homo sapiens
actgcctgggct

SEQ ID NO: 5165329 - DNA, 21 bp, Homo sapiens
actgcctgtagcaatggccag

SEQ ID NO: 5165330 - DNA, 18 bp, Homo sapiens
acttgtggactaaaagat

SEQ ID NO: 5165331 - DNA, 17 bp, Homo sapiens
acttgtgggtcctgggg

SEQ ID NO: 5165332 - DNA, 18 bp, Homo sapiens
acttgtggtgtgaccatg

SEQ ID NO: 5165333 - DNA, 17 bp, Homo sapiens
acttgtggttttcaaat

SEQ ID NO: 5165334 - DNA, 23 bp, Homo sapiens
acttgtgtaaatacaattttgtt

SEQ ID NO: 5165335 - DNA, 20 bp, Homo sapiens
acttgtgtactgataaaata

SEQ ID NO: 5165336 - DNA, 13 bp, Homo sapiens
acttgtgtatatt

SEQ ID NO: 5165337 - DNA, 23 bp, Homo sapiens
acttgtgtatgatccaagtattt

SEQ ID NO: 5165338 - DNA, 17 bp, Homo sapiens
acttgtgtcattgatgt

SEQ ID NO: 5165339 - DNA, 21 bp, Homo sapiens
acttgtgtctctgtgctttta

SEQ ID NO: 5165340 - DNA, 22 bp, Homo sapiens
acttgtgtctctgtgcttttaa

SEQ ID NO: 5165341 - DNA, 13 bp, Homo sapiens
acttgtgttactt

SEQ ID NO: 5165342 - DNA, 15 bp, Homo sapiens
acttgtgttctatta

SEQ ID NO: 5165343 - DNA, 17 bp, Homo sapiens
acttgtgttgctttctg

SEQ ID NO: 5165344 - DNA, 10 bp, Homo sapiens
acttgtgttt

SEQ ID NO: 5165345 - DNA, 13 bp, Homo sapiens
acttgtgtttgct

SEQ ID NO: 5165346 - DNA, 17 bp, Homo sapiens
acttgtgtttgtatata

SEQ ID NO: 5165347 - DNA, 13 bp, Homo sapiens
acttgttaaatgt

SEQ ID NO: 5165348 - DNA, 15 bp, Homo sapiens
acttgttaaatgtat

SEQ ID NO: 5165349 - DNA, 18 bp, Homo sapiens
acttgttaacctttctaa

SEQ ID NO: 5165350 - DNA, 20 bp, Homo sapiens
acttgttaacctttctaacc

SEQ ID NO: 5165351 - DNA, 14 bp, Homo sapiens
acttgttagatcta

SEQ ID NO: 5165352 - DNA, 23 bp, Homo sapiens
acttgttagatctagttcactct

SEQ ID NO: 5165353 - DNA, 19 bp, Homo sapiens
acttgttatgttgtaatat

SEQ ID NO: 5165354 - DNA, 13 bp, Homo sapiens
acttgttattgtg

SEQ ID NO: 5165355 - DNA, 23 bp, Homo sapiens
acttgttcaacagtttctcaagt

SEQ ID NO: 5165356 - DNA, 12 bp, Homo sapiens
acttgttcattt

SEQ ID NO: 5165357 - DNA, 19 bp, Homo sapiens
acttgttcatttctgtctc

SEQ ID NO: 5165358 - DNA, 18 bp, Homo sapiens
acttgttcatttttctct

SEQ ID NO: 5165359 - DNA, 16 bp, Homo sapiens
acttgttccagctctt

SEQ ID NO: 5165360 - DNA, 17 bp, Homo sapiens
acttgttccagctcttt

SEQ ID NO: 5165361 - DNA, 13 bp, Homo sapiens
acttgttctagag

SEQ ID NO: 5165362 - DNA, 14 bp, Homo sapiens
acttgttctagaga

SEQ ID NO: 5165363 - DNA, 16 bp, Homo sapiens
acttgttctgagtaag

SEQ ID NO: 5165364 - DNA, 23 bp, Homo sapiens
acttgttctgagtaagtgtgttc

SEQ ID NO: 5165365 - DNA, 13 bp, Homo sapiens
acttgttctgtat

SEQ ID NO: 5165366 - DNA, 14 bp, Homo sapiens
acttgttctgtatt

SEQ ID NO: 5165367 - DNA, 18 bp, Homo sapiens
acttgttcttttctggta

SEQ ID NO: 5165368 - DNA, 20 bp, Homo sapiens
acttgttgagggtatgtttt

SEQ ID NO: 5165369 - DNA, 19 bp, Homo sapiens
acttgttgattaatggaaa

SEQ ID NO: 5165370 - DNA, 21 bp, Homo sapiens
acttgttgattaatggaaatg

SEQ ID NO: 5165371 - DNA, 15 bp, Homo sapiens
acttgttgcctataa

SEQ ID NO: 5165372 - DNA, 16 bp, Homo sapiens
acttgttgctgatttt

SEQ ID NO: 5165373 - DNA, 20 bp, Homo sapiens
acttgttgctgattttgacc

SEQ ID NO: 5165374 - DNA, 21 bp, Homo sapiens
acttgttgctgattttgacct

SEQ ID NO: 5165375 - DNA, 23 bp, Homo sapiens
acttgttggcgtaggctacagag

SEQ ID NO: 5165376 - DNA, 16 bp, Homo sapiens
acttgttgtttaatgt

SEQ ID NO: 5165377 - DNA, 23 bp, Homo sapiens
acttgtttaattctaaaagagaa

SEQ ID NO: 5165378 - DNA, 16 bp, Homo sapiens
acttgtttacatagca

SEQ ID NO: 5165379 - DNA, 17 bp, Homo sapiens
acttgtttcatctggtt

SEQ ID NO: 5165380 - DNA, 23 bp, Homo sapiens
acttgtttcctgtgcccatcatc

SEQ ID NO: 5165381 - DNA, 16 bp, Homo sapiens
acttgtttctgatcta

SEQ ID NO: 5165382 - DNA, 17 bp, Homo sapiens
acttgtttctttctgtc

SEQ ID NO: 5165383 - DNA, 12 bp, Homo sapiens
acttgtttgaat

SEQ ID NO: 5165384 - DNA, 22 bp, Homo sapiens
acttgtttgaatatttgtttta

SEQ ID NO: 5165385 - DNA, 20 bp, Homo sapiens
acttgtttgaggcaaatcta

SEQ ID NO: 5165386 - DNA, 13 bp, Homo sapiens
acttgtttgcact

SEQ ID NO: 5165387 - DNA, 16 bp, Homo sapiens
acttgtttgtaagatt

SEQ ID NO: 5165388 - DNA, 17 bp, Homo sapiens
acttgtttgtcttccat

SEQ ID NO: 5165389 - DNA, 21 bp, Homo sapiens
acttgtttgtgcatcctgtga

SEQ ID NO: 5165390 - DNA, 12 bp, Homo sapiens
acttgttttaac

SEQ ID NO: 5165391 - DNA, 22 bp, Homo sapiens
acttgttttatttaacctctaa

SEQ ID NO: 5165392 - DNA, 24 bp, Homo sapiens
acttgttttgacttgaataaagta

SEQ ID NO: 5165393 - DNA, 15 bp, Homo sapiens
acttgtttttgtaaa

SEQ ID NO: 5165394 - DNA, 20 bp, Homo sapiens
acttgtttttgtaaagaaaa

SEQ ID NO: 5165395 - DNA, 15 bp, Homo sapiens
actttaaaaaaacaa

SEQ ID NO: 5165396 - DNA, 14 bp, Homo sapiens
actttaaaaaatat

SEQ ID NO: 5165397 - DNA, 21 bp, Homo sapiens
actttaaaaaatatttattaa

SEQ ID NO: 5165398 - DNA, 18 bp, Homo sapiens
actttaaaaaggaaattt

SEQ ID NO: 5165399 - DNA, 13 bp, Homo sapiens
actttaaaaatta

SEQ ID NO: 5165400 - DNA, 16 bp, Homo sapiens
actttaaaaatttact

SEQ ID NO: 5165401 - DNA, 16 bp, Homo sapiens
actttaaaaccagtta

SEQ ID NO: 5165402 - DNA, 17 bp, Homo sapiens
actttaaaagaaaatag

SEQ ID NO: 5165403 - DNA, 15 bp, Homo sapiens
actttaaaagatgaa

SEQ ID NO: 5165404 - DNA, 12 bp, Homo sapiens
actttaaaagca

SEQ ID NO: 5165405 - DNA, 16 bp, Homo sapiens
actttaaaaggagcca

SEQ ID NO: 5165406 - DNA, 15 bp, Homo sapiens
actttaaaataaaat

SEQ ID NO: 5165407 - DNA, 12 bp, Homo sapiens
actttaaaatgc

SEQ ID NO: 5165408 - DNA, 13 bp, Homo sapiens
actttaaaatgcg

SEQ ID NO: 5165409 - DNA, 17 bp, Homo sapiens
actttaaacatctagca

SEQ ID NO: 5165410 - DNA, 20 bp, Homo sapiens
actttaaacatctagcagta

SEQ ID NO: 5165411 - DNA, 16 bp, Homo sapiens
actttaaagaggctgt

SEQ ID NO: 5165412 - DNA, 20 bp, Homo sapiens
actttaaagaggctgtgtgg

SEQ ID NO: 5165413 - DNA, 22 bp, Homo sapiens
actttaaagcaattgcataata

SEQ ID NO: 5165414 - DNA, 15 bp, Homo sapiens
actttaaattatatg

SEQ ID NO: 5165415 - DNA, 16 bp, Homo sapiens
actttaacataagcta

SEQ ID NO: 5165416 - DNA, 19 bp, Homo sapiens
actttaacataagctattt

SEQ ID NO: 5165417 - DNA, 20 bp, Homo sapiens
actttaacattttggaaatt

SEQ ID NO: 5165418 - DNA, 21 bp, Homo sapiens
actttaacattttggaaattg

SEQ ID NO: 5165419 - DNA, 18 bp, Homo sapiens
actttaaccctctcttcc

SEQ ID NO: 5165420 - DNA, 15 bp, Homo sapiens
actttaaccctttct

SEQ ID NO: 5165421 - DNA, 14 bp, Homo sapiens
actttaacctccct

SEQ ID NO: 5165422 - DNA, 11 bp, Homo sapiens
actttaacttc

SEQ ID NO: 5165423 - DNA, 19 bp, Homo sapiens
actttaacttccactttgt

SEQ ID NO: 5165424 - DNA, 20 bp, Homo sapiens
actttaacttctgttttacc

SEQ ID NO: 5165425 - DNA, 14 bp, Homo sapiens
actttaagagagaa

SEQ ID NO: 5165426 - DNA, 15 bp, Homo sapiens
actttaagagagaaa

SEQ ID NO: 5165427 - DNA, 16 bp, Homo sapiens
actttaagagagaaat

SEQ ID NO: 5165428 - DNA, 14 bp, Homo sapiens
actttaagctcctt

SEQ ID NO: 5165429 - DNA, 16 bp, Homo sapiens
actttaaggtgaatga

SEQ ID NO: 5165430 - DNA, 12 bp, Homo sapiens
actttaagtttt

SEQ ID NO: 5165431 - DNA, 12 bp, Homo sapiens
actttaataata

SEQ ID NO: 5165432 - DNA, 16 bp, Homo sapiens
actttaatatgtattt

SEQ ID NO: 5165433 - DNA, 22 bp, Homo sapiens
actttaatatgtattttatgta

SEQ ID NO: 5165434 - DNA, 21 bp, Homo sapiens
actttaatcccggtttcagaa

SEQ ID NO: 5165435 - DNA, 13 bp, Homo sapiens
actttaatgtttt

SEQ ID NO: 5165436 - DNA, 22 bp, Homo sapiens
actttaattaccaacctgttac

SEQ ID NO: 5165437 - DNA, 12 bp, Homo sapiens
actttaattgaa

SEQ ID NO: 5165438 - DNA, 19 bp, Homo sapiens
actttaattgaagaactgc

SEQ ID NO: 5165439 - DNA, 22 bp, Homo sapiens
actttaattgaagaactgcact

SEQ ID NO: 5165440 - DNA, 20 bp, Homo sapiens
actttaattgcttaaaagac

SEQ ID NO: 5165441 - DNA, 15 bp, Homo sapiens
actttacaaaccatt

SEQ ID NO: 5165442 - DNA, 21 bp, Homo sapiens
actttacaaaccattacctgt

SEQ ID NO: 5165443 - DNA, 13 bp, Homo sapiens
actttacaatcat

SEQ ID NO: 5165444 - DNA, 19 bp, Homo sapiens
actttacaatgttcatccc

SEQ ID NO: 5165445 - DNA, 15 bp, Homo sapiens
actttacactcggct

SEQ ID NO: 5165446 - DNA, 20 bp, Homo sapiens
actttacactcggctttgga

SEQ ID NO: 5165447 - DNA, 19 bp, Homo sapiens
actttacagaaatggactg

SEQ ID NO: 5165448 - DNA, 17 bp, Homo sapiens
actttaccaaatgaaat

SEQ ID NO: 5165449 - DNA, 21 bp, Homo sapiens
actttaccaaatgaaatgcca

SEQ ID NO: 5165450 - DNA, 16 bp, Homo sapiens
actttaccacccccac

SEQ ID NO: 5165451 - DNA, 18 bp, Homo sapiens
actttaccataaagcctt

SEQ ID NO: 5165452 - DNA, 12 bp, Homo sapiens
actttacctctt

SEQ ID NO: 5165453 - DNA, 15 bp, Homo sapiens
actttactaagatga

SEQ ID NO: 5165454 - DNA, 16 bp, Homo sapiens
actttactaagatgac

SEQ ID NO: 5165455 - DNA, 22 bp, Homo sapiens
actttactaagatgacattgct

SEQ ID NO: 5165456 - DNA, 20 bp, Homo sapiens
actttactaggtacataagc

SEQ ID NO: 5165457 - DNA, 15 bp, Homo sapiens
actttactctgtgtt

SEQ ID NO: 5165458 - DNA, 19 bp, Homo sapiens
actttactgcctgaataaa

SEQ ID NO: 5165459 - DNA, 19 bp, Homo sapiens
actttacttgtggtgtgac

SEQ ID NO: 5165460 - DNA, 22 bp, Homo sapiens
actttacttgtggtgtgaccat

SEQ ID NO: 5165461 - DNA, 13 bp, Homo sapiens
actttactttcaa

SEQ ID NO: 5165462 - DNA, 17 bp, Homo sapiens
actttacttttgctgtt

SEQ ID NO: 5165463 - DNA, 15 bp, Homo sapiens
actttagaaagaaat

SEQ ID NO: 5165464 - DNA, 16 bp, Homo sapiens
actttagaaagaaatt

SEQ ID NO: 5165465 - DNA, 16 bp, Homo sapiens
actttagaaagccagc

SEQ ID NO: 5165466 - DNA, 15 bp, Homo sapiens
actttagaatgagag

SEQ ID NO: 5165467 - DNA, 16 bp, Homo sapiens
actttagacatttttg

SEQ ID NO: 5165468 - DNA, 19 bp, Homo sapiens
actttagagtagcatgaga

SEQ ID NO: 5165469 - DNA, 21 bp, Homo sapiens
actttagagtagcatgagaga

SEQ ID NO: 5165470 - DNA, 15 bp, Homo sapiens
actttagagtgacta

SEQ ID NO: 5165471 - DNA, 20 bp, Homo sapiens
actttagctagtatcttcaa

SEQ ID NO: 5165472 - DNA, 15 bp, Homo sapiens
actttaggaaatacg

SEQ ID NO: 5165473 - DNA, 22 bp, Homo sapiens
actttaggatgagcaaaacatt

SEQ ID NO: 5165474 - DNA, 14 bp, Homo sapiens
actttaggctttca

SEQ ID NO: 5165475 - DNA, 23 bp, Homo sapiens
actttagggaagtacttttggca

SEQ ID NO: 5165476 - DNA, 22 bp, Homo sapiens
actttagggctaaccagttctc

SEQ ID NO: 5165477 - DNA, 15 bp, Homo sapiens
actttagggctgtaa

SEQ ID NO: 5165478 - DNA, 17 bp, Homo sapiens
actttagtattaaatca

SEQ ID NO: 5165479 - DNA, 16 bp, Homo sapiens
actttagtctgcaaaa

SEQ ID NO: 5165480 - DNA, 15 bp, Homo sapiens
actttagtgccctgc

SEQ ID NO: 5165481 - DNA, 19 bp, Homo sapiens
actttagtgtattttctgt

SEQ ID NO: 5165482 - DNA, 22 bp, Homo sapiens
actttagttaccgagacatgaa

SEQ ID NO: 5165483 - DNA, 12 bp, Homo sapiens
actttataaatt

SEQ ID NO: 5165484 - DNA, 14 bp, Homo sapiens
actttataaatttc

SEQ ID NO: 5165485 - DNA, 19 bp, Homo sapiens
actttataaccaaagcaat

SEQ ID NO: 5165486 - DNA, 16 bp, Homo sapiens
actttataactaacat

SEQ ID NO: 5165487 - DNA, 18 bp, Homo sapiens
actttataactaacatgt

SEQ ID NO: 5165488 - DNA, 22 bp, Homo sapiens
actttataacttaaatattgct

SEQ ID NO: 5165489 - DNA, 19 bp, Homo sapiens
actttatacattagtaaat

SEQ ID NO: 5165490 - DNA, 20 bp, Homo sapiens
actttatacccagaaagtta

SEQ ID NO: 5165491 - DNA, 19 bp, Homo sapiens
actttatagttgttttata

SEQ ID NO: 5165492 - DNA, 18 bp, Homo sapiens
actttatatcttgtttac

SEQ ID NO: 5165493 - DNA, 23 bp, Homo sapiens
actttatatcttgtttacaataa

SEQ ID NO: 5165494 - DNA, 22 bp, Homo sapiens
actttatatgaagtattaaaat

SEQ ID NO: 5165495 - DNA, 16 bp, Homo sapiens
actttatattttctat

SEQ ID NO: 5165496 - DNA, 13 bp, Homo sapiens
actttatcacatt

SEQ ID NO: 5165497 - DNA, 14 bp, Homo sapiens
actttatcacatta

SEQ ID NO: 5165498 - DNA, 15 bp, Homo sapiens
actttatcacttaaa

SEQ ID NO: 5165499 - DNA, 13 bp, Homo sapiens
actttatcacttt

SEQ ID NO: 5165500 - DNA, 13 bp, Homo sapiens
actttatctaaag

SEQ ID NO: 5165501 - DNA, 23 bp, Homo sapiens
actttatctaatacctctgtgtg

SEQ ID NO: 5165502 - DNA, 22 bp, Homo sapiens
actttatctgtgaccacacgct

SEQ ID NO: 5165503 - DNA, 13 bp, Homo sapiens
actttatgaaaaa

SEQ ID NO: 5165504 - DNA, 15 bp, Homo sapiens
actttatgcaataaa

SEQ ID NO: 5165505 - DNA, 13 bp, Homo sapiens
actttatgtagtt

SEQ ID NO: 5165506 - DNA, 16 bp, Homo sapiens
actttatgtgtaaata

SEQ ID NO: 5165507 - DNA, 14 bp, Homo sapiens
actttattaaaaga

SEQ ID NO: 5165508 - DNA, 15 bp, Homo sapiens
actttattaaaagaa

SEQ ID NO: 5165509 - DNA, 12 bp, Homo sapiens
actttattaaat

SEQ ID NO: 5165510 - DNA, 18 bp, Homo sapiens
actgcctgtatactttag

SEQ ID NO: 5165511 - DNA, 17 bp, Homo sapiens
actgcctgtctccatga

SEQ ID NO: 5165512 - DNA, 19 bp, Homo sapiens
actgcctgttaagtctgag

SEQ ID NO: 5165513 - DNA, 16 bp, Homo sapiens
actgccttaaaacttt

SEQ ID NO: 5165514 - DNA, 23 bp, Homo sapiens
actgccttaatgagaacatttac

SEQ ID NO: 5165515 - DNA, 17 bp, Homo sapiens
actgccttaccttcact

SEQ ID NO: 5165516 - DNA, 20 bp, Homo sapiens
actgccttaccttcacttaa

SEQ ID NO: 5165517 - DNA, 17 bp, Homo sapiens
actgccttatattattt

SEQ ID NO: 5165518 - DNA, 22 bp, Homo sapiens
actgccttcagtatcaaggctg

SEQ ID NO: 5165519 - DNA, 13 bp, Homo sapiens
actgccttcctct

SEQ ID NO: 5165520 - DNA, 16 bp, Homo sapiens
actgccttcgcttctt

SEQ ID NO: 5165521 - DNA, 22 bp, Homo sapiens
actgccttcgcttcttgcctct

SEQ ID NO: 5165522 - DNA, 23 bp, Homo sapiens
actgccttcgcttcttgcctctg

SEQ ID NO: 5165523 - DNA, 19 bp, Homo sapiens
actgccttcgtttatattt

SEQ ID NO: 5165524 - DNA, 20 bp, Homo sapiens
actgccttctcaactccaaa

SEQ ID NO: 5165525 - DNA, 20 bp, Homo sapiens
actgccttctcctctctggg

SEQ ID NO: 5165526 - DNA, 13 bp, Homo sapiens
actgccttgaaaa

SEQ ID NO: 5165527 - DNA, 17 bp, Homo sapiens
actgccttgaatatccc

SEQ ID NO: 5165528 - DNA, 18 bp, Homo sapiens
actgccttgattagtgta

SEQ ID NO: 5165529 - DNA, 18 bp, Homo sapiens
actgccttgcctcctcag

SEQ ID NO: 5165530 - DNA, 20 bp, Homo sapiens
actgccttgcctcctcagta

SEQ ID NO: 5165531 - DNA, 14 bp, Homo sapiens
actgccttggcccc

SEQ ID NO: 5165532 - DNA, 11 bp, Homo sapiens
actgcctttga

SEQ ID NO: 5165533 - DNA, 15 bp, Homo sapiens
actgcctttgctgcc

SEQ ID NO: 5165534 - DNA, 14 bp, Homo sapiens
actgcgaactctca

SEQ ID NO: 5165535 - DNA, 21 bp, Homo sapiens
actgcgactttctgcctggag

SEQ ID NO: 5165536 - DNA, 23 bp, Homo sapiens
actgcgactttctgcctggagtg

SEQ ID NO: 5165537 - DNA, 17 bp, Homo sapiens
actgcgaggacatcaaa

SEQ ID NO: 5165538 - DNA, 16 bp, Homo sapiens
actgcgcaggtctctt

SEQ ID NO: 5165539 - DNA, 14 bp, Homo sapiens
actgcgcccagcct

SEQ ID NO: 5165540 - DNA, 15 bp, Homo sapiens
actgcgcccagcctg

SEQ ID NO: 5165541 - DNA, 12 bp, Homo sapiens
actgcgcctcgt

SEQ ID NO: 5165542 - DNA, 18 bp, Homo sapiens
actgcgctttattttctt

SEQ ID NO: 5165543 - DNA, 20 bp, Homo sapiens
actgcggaaaaggaaggaaa

SEQ ID NO: 5165544 - DNA, 17 bp, Homo sapiens
actgcggaagccaaagg

SEQ ID NO: 5165545 - DNA, 12 bp, Homo sapiens
actgcggagcag

SEQ ID NO: 5165546 - DNA, 14 bp, Homo sapiens
actgcgggagccag

SEQ ID NO: 5165547 - DNA, 19 bp, Homo sapiens
actgcgggatggtcctggg

SEQ ID NO: 5165548 - DNA, 22 bp, Homo sapiens
actgcgggatggtcctggggct

SEQ ID NO: 5165549 - DNA, 19 bp, Homo sapiens
actgcgggcaccagaatgc

SEQ ID NO: 5165550 - DNA, 18 bp, Homo sapiens
actgcggggcttggctga

SEQ ID NO: 5165551 - DNA, 15 bp, Homo sapiens
actgcgtagagcctg

SEQ ID NO: 5165552 - DNA, 16 bp, Homo sapiens
actgcgtcaagcaatc

SEQ ID NO: 5165553 - DNA, 14 bp, Homo sapiens
actgcgtccaccct

SEQ ID NO: 5165554 - DNA, 14 bp, Homo sapiens
actgcgttctgcaa

SEQ ID NO: 5165555 - DNA, 17 bp, Homo sapiens
actgctaaataaaattt

SEQ ID NO: 5165556 - DNA, 17 bp, Homo sapiens
actgctaaatactgtac

SEQ ID NO: 5165557 - DNA, 19 bp, Homo sapiens
actgctaaatactgtacat

SEQ ID NO: 5165558 - DNA, 20 bp, Homo sapiens
actgctaaatactgtacata

SEQ ID NO: 5165559 - DNA, 16 bp, Homo sapiens
actgctaaattctatg

SEQ ID NO: 5165560 - DNA, 21 bp, Homo sapiens
actgctaaattctatgttaaa

SEQ ID NO: 5165561 - DNA, 15 bp, Homo sapiens
actgctaaatttacg

SEQ ID NO: 5165562 - DNA, 16 bp, Homo sapiens
actgctaagaatattt

SEQ ID NO: 5165563 - DNA, 16 bp, Homo sapiens
actgctaaggctgctg

SEQ ID NO: 5165564 - DNA, 20 bp, Homo sapiens
actgctaaggctgctggctt

SEQ ID NO: 5165565 - DNA, 22 bp, Homo sapiens
actgctaaggctgctggcttca

SEQ ID NO: 5165566 - DNA, 18 bp, Homo sapiens
actgctaagtatttccca

SEQ ID NO: 5165567 - DNA, 13 bp, Homo sapiens
actgctaataaat

SEQ ID NO: 5165568 - DNA, 14 bp, Homo sapiens
actgctaataaatg

SEQ ID NO: 5165569 - DNA, 22 bp, Homo sapiens
actgctaataaatgaccagttt

SEQ ID NO: 5165570 - DNA, 23 bp, Homo sapiens
actgctaataaatgaccagttta

SEQ ID NO: 5165571 - DNA, 15 bp, Homo sapiens
actgctaatgttgat

SEQ ID NO: 5165572 - DNA, 21 bp, Homo sapiens
actgctaattacacacgtgtg

SEQ ID NO: 5165573 - DNA, 23 bp, Homo sapiens
actgctacaaatactcttaggaa

SEQ ID NO: 5165574 - DNA, 14 bp, Homo sapiens
actgctacacttct

SEQ ID NO: 5165575 - DNA, 17 bp, Homo sapiens
actgctacctctgagaa

SEQ ID NO: 5165576 - DNA, 20 bp, Homo sapiens
actgctacctttcaaagctt

SEQ ID NO: 5165577 - DNA, 17 bp, Homo sapiens
actgctactatctgttt

SEQ ID NO: 5165578 - DNA, 13 bp, Homo sapiens
actgctactgtaa

SEQ ID NO: 5165579 - DNA, 20 bp, Homo sapiens
actgctacttgctctgctct

SEQ ID NO: 5165580 - DNA, 20 bp, Homo sapiens
actgctagaaccaagcacta

SEQ ID NO: 5165581 - DNA, 21 bp, Homo sapiens
actgctaggcgagtgccagga

SEQ ID NO: 5165582 - DNA, 23 bp, Homo sapiens
actgctaggcgagtgccaggact

SEQ ID NO: 5165583 - DNA, 20 bp, Homo sapiens
actgctaggtgggccagccc

SEQ ID NO: 5165584 - DNA, 22 bp, Homo sapiens
actgctaggtgggccagcccct

SEQ ID NO: 5165585 - DNA, 16 bp, Homo sapiens
actgctagtgttctgt

SEQ ID NO: 5165586 - DNA, 13 bp, Homo sapiens
actgctataaata

SEQ ID NO: 5165587 - DNA, 17 bp, Homo sapiens
actgctataaataggtt

SEQ ID NO: 5165588 - DNA, 17 bp, Homo sapiens
actgctatcagtctctt

SEQ ID NO: 5165589 - DNA, 20 bp, Homo sapiens
actgctatctactaagtttc

SEQ ID NO: 5165590 - DNA, 23 bp, Homo sapiens
actgctatctactaagtttcctt

SEQ ID NO: 5165591 - DNA, 19 bp, Homo sapiens
actgctattctagagcttt

SEQ ID NO: 5165592 - DNA, 20 bp, Homo sapiens
actgctattctagagctttt

SEQ ID NO: 5165593 - DNA, 23 bp, Homo sapiens
actgctattctagagcttttatt

SEQ ID NO: 5165594 - DNA, 19 bp, Homo sapiens
actgctattttttttaaat

SEQ ID NO: 5165595 - DNA, 16 bp, Homo sapiens
actgctcaagaagaca

SEQ ID NO: 5165596 - DNA, 17 bp, Homo sapiens
actgctcaattctgttt

SEQ ID NO: 5165597 - DNA, 17 bp, Homo sapiens
actgctcacgtctctgc

SEQ ID NO: 5165598 - DNA, 22 bp, Homo sapiens
actgctcagaacttgctgctgt

SEQ ID NO: 5165599 - DNA, 18 bp, Homo sapiens
actgctcagagctttaaa

SEQ ID NO: 5165600 - DNA, 15 bp, Homo sapiens
actgctcaggcctca

SEQ ID NO: 5165601 - DNA, 12 bp, Homo sapiens
actgctccaaat

SEQ ID NO: 5165602 - DNA, 17 bp, Homo sapiens
actgctccaagggacag

SEQ ID NO: 5165603 - DNA, 21 bp, Homo sapiens
actgctccaagggacaggtgg

SEQ ID NO: 5165604 - DNA, 16 bp, Homo sapiens
actgctccagcctctg

SEQ ID NO: 5165605 - DNA, 21 bp, Homo sapiens
actgctccagcctctgccgct

SEQ ID NO: 5165606 - DNA, 23 bp, Homo sapiens
actgctccatttataaccccagc

SEQ ID NO: 5165607 - DNA, 19 bp, Homo sapiens
actgctcccacctcctgac

SEQ ID NO: 5165608 - DNA, 18 bp, Homo sapiens
actgctcccatcattcct

SEQ ID NO: 5165609 - DNA, 21 bp, Homo sapiens
actgctccccagccctggctc

SEQ ID NO: 5165610 - DNA, 20 bp, Homo sapiens
actgctccctaagccagcct

SEQ ID NO: 5165611 - DNA, 15 bp, Homo sapiens
actgctccctgaagc

SEQ ID NO: 5165612 - DNA, 19 bp, Homo sapiens
actgctccctgaagccagc

SEQ ID NO: 5165613 - DNA, 23 bp, Homo sapiens
actgctccctgaagccagccttc

SEQ ID NO: 5165614 - DNA, 17 bp, Homo sapiens
actgctccgtggaggag

SEQ ID NO: 5165615 - DNA, 17 bp, Homo sapiens
actgctcctgagccccc

SEQ ID NO: 5165616 - DNA, 19 bp, Homo sapiens
actgctcctgagcccccag

SEQ ID NO: 5165617 - DNA, 20 bp, Homo sapiens
actgctcctgagcccccagc

SEQ ID NO: 5165618 - DNA, 13 bp, Homo sapiens
actgctcctgggc

SEQ ID NO: 5165619 - DNA, 19 bp, Homo sapiens
actgctcctgtggcaggag

SEQ ID NO: 5165620 - DNA, 17 bp, Homo sapiens
actgctcctgtgtcggg

SEQ ID NO: 5165621 - DNA, 12 bp, Homo sapiens
actgctccttcc

SEQ ID NO: 5165622 - DNA, 16 bp, Homo sapiens
actgctcggtcaggag

SEQ ID NO: 5165623 - DNA, 22 bp, Homo sapiens
actgctcgtggactgtgctggt

SEQ ID NO: 5165624 - DNA, 19 bp, Homo sapiens
actgctctaagcacacgga

SEQ ID NO: 5165625 - DNA, 13 bp, Homo sapiens
actgctctcacct

SEQ ID NO: 5165626 - DNA, 22 bp, Homo sapiens
actgctctcaccttggttcctg

SEQ ID NO: 5165627 - DNA, 12 bp, Homo sapiens
actgctctcagc

SEQ ID NO: 5165628 - DNA, 16 bp, Homo sapiens
actgctctcagcctcc

SEQ ID NO: 5165629 - DNA, 17 bp, Homo sapiens
actgctctcagcctccc

SEQ ID NO: 5165630 - DNA, 12 bp, Homo sapiens
actgctctgaat

SEQ ID NO: 5165631 - DNA, 19 bp, Homo sapiens
actgctctgaatattttgt

SEQ ID NO: 5165632 - DNA, 12 bp, Homo sapiens
actgctctgaga

SEQ ID NO: 5165633 - DNA, 13 bp, Homo sapiens
actgctctgagaa

SEQ ID NO: 5165634 - DNA, 11 bp, Homo sapiens
actgctctgcc

SEQ ID NO: 5165635 - DNA, 15 bp, Homo sapiens
actgctcttgaacat

SEQ ID NO: 5165636 - DNA, 19 bp, Homo sapiens
actgctcttttactaagac

SEQ ID NO: 5165637 - DNA, 16 bp, Homo sapiens
actgctgaaaaagaaa

SEQ ID NO: 5165638 - DNA, 23 bp, Homo sapiens
actgctgaaaaagaaaaaaatga

SEQ ID NO: 5165639 - DNA, 19 bp, Homo sapiens
actgctgagatacatacag

SEQ ID NO: 5165640 - DNA, 20 bp, Homo sapiens
actgctgagatacatacaga

SEQ ID NO: 5165641 - DNA, 12 bp, Homo sapiens
actgctgagcca

SEQ ID NO: 5165642 - DNA, 15 bp, Homo sapiens
actgctgagccactc

SEQ ID NO: 5165643 - DNA, 17 bp, Homo sapiens
actgctgagctggccct

SEQ ID NO: 5165644 - DNA, 18 bp, Homo sapiens
actgctgaggagtctgag

SEQ ID NO: 5165645 - DNA, 18 bp, Homo sapiens
actgctgataaaatatga

SEQ ID NO: 5165646 - DNA, 17 bp, Homo sapiens
actgctgatcgtagaaa

SEQ ID NO: 5165647 - DNA, 18 bp, Homo sapiens
actgctgatcgtagaaaa

SEQ ID NO: 5165648 - DNA, 21 bp, Homo sapiens
actgctgatcgtagaaaattt

SEQ ID NO: 5165649 - DNA, 23 bp, Homo sapiens
actgctgatcgtagaaaatttgc

SEQ ID NO: 5165650 - DNA, 19 bp, Homo sapiens
actgctgatgctgaaataa

SEQ ID NO: 5165651 - DNA, 22 bp, Homo sapiens
actgctgatgctgaaataaact

SEQ ID NO: 5165652 - DNA, 23 bp, Homo sapiens
actgctgatgctgaaataaacta

SEQ ID NO: 5165653 - DNA, 15 bp, Homo sapiens
actgctgattcttgt

SEQ ID NO: 5165654 - DNA, 13 bp, Homo sapiens
actgctgcaaagt

SEQ ID NO: 5165655 - DNA, 17 bp, Homo sapiens
actgctgcaaagtgcaa

SEQ ID NO: 5165656 - DNA, 19 bp, Homo sapiens
actgctgcaaagtgcaaat

SEQ ID NO: 5165657 - DNA, 20 bp, Homo sapiens
actgctgcaaagtgcaaata

SEQ ID NO: 5165658 - DNA, 11 bp, Homo sapiens
actgctgcaag

SEQ ID NO: 5165659 - DNA, 15 bp, Homo sapiens
actgctgcagattag

SEQ ID NO: 5165660 - DNA, 12 bp, Homo sapiens
actgctgcaggg

SEQ ID NO: 5165661 - DNA, 13 bp, Homo sapiens
actgctgcagggt

SEQ ID NO: 5165662 - DNA, 13 bp, Homo sapiens
actgctgcatact

SEQ ID NO: 5165663 - DNA, 12 bp, Homo sapiens
actgctgcccca

SEQ ID NO: 5165664 - DNA, 16 bp, Homo sapiens
actgctgcctcagctc

SEQ ID NO: 5165665 - DNA, 15 bp, Homo sapiens
actgctgccttaccc

SEQ ID NO: 5165666 - DNA, 19 bp, Homo sapiens
actgctgcgctgtgctggt

SEQ ID NO: 5165667 - DNA, 19 bp, Homo sapiens
actgctgctactgcccctc

SEQ ID NO: 5165668 - DNA, 12 bp, Homo sapiens
actgctgctccc

SEQ ID NO: 5165669 - DNA, 12 bp, Homo sapiens
actgctgctcct

SEQ ID NO: 5165670 - DNA, 16 bp, Homo sapiens
actgctgctcctcttt

SEQ ID NO: 5165671 - DNA, 18 bp, Homo sapiens
actgctgctcctctttcc

SEQ ID NO: 5165672 - DNA, 16 bp, Homo sapiens
actgctgctctcccaa

SEQ ID NO: 5165673 - DNA, 16 bp, Homo sapiens
actgctgctgacccct

SEQ ID NO: 5165674 - DNA, 18 bp, Homo sapiens
actgctgctgcctggcca

SEQ ID NO: 5165675 - DNA, 11 bp, Homo sapiens
actgctgctgt

SEQ ID NO: 5165676 - DNA, 20 bp, Homo sapiens
actgctgcttcatgtttgcc

SEQ ID NO: 5165677 - DNA, 16 bp, Homo sapiens
actgctgcttgtcaaa

SEQ ID NO: 5165678 - DNA, 12 bp, Homo sapiens
actgctgctttt

SEQ ID NO: 5165679 - DNA, 21 bp, Homo sapiens
actgctgctttttgaggtggc

SEQ ID NO: 5165680 - DNA, 17 bp, Homo sapiens
actgctggacatgagat

SEQ ID NO: 5165681 - DNA, 16 bp, Homo sapiens
actgctggagaggccc

SEQ ID NO: 5165682 - DNA, 12 bp, Homo sapiens
actgctggggag

SEQ ID NO: 5165683 - DNA, 17 bp, Homo sapiens
actgctggggagtccct

SEQ ID NO: 5165684 - DNA, 12 bp, Homo sapiens
actgctggggct

SEQ ID NO: 5165685 - DNA, 15 bp, Homo sapiens
actgctggggctggt

SEQ ID NO: 5165686 - DNA, 12 bp, Homo sapiens
actgctgggtgg

SEQ ID NO: 5165687 - DNA, 13 bp, Homo sapiens
actgctgggtggc

SEQ ID NO: 5165688 - DNA, 20 bp, Homo sapiens
actgctgggtggcccatccc

SEQ ID NO: 5165689 - DNA, 18 bp, Homo sapiens
actttattaagtaaaatc

SEQ ID NO: 5165690 - DNA, 21 bp, Homo sapiens
actttattaccttctttctaa

SEQ ID NO: 5165691 - DNA, 16 bp, Homo sapiens
actttattataaaatg

SEQ ID NO: 5165692 - DNA, 18 bp, Homo sapiens
actttattataaaatgct

SEQ ID NO: 5165693 - DNA, 19 bp, Homo sapiens
actttattcttgaaagaag

SEQ ID NO: 5165694 - DNA, 13 bp, Homo sapiens
actttattgcata

SEQ ID NO: 5165695 - DNA, 14 bp, Homo sapiens
actttattgcatat

SEQ ID NO: 5165696 - DNA, 17 bp, Homo sapiens
actttattgcatataga

SEQ ID NO: 5165697 - DNA, 13 bp, Homo sapiens
actttattgcatc

SEQ ID NO: 5165698 - DNA, 17 bp, Homo sapiens
actttattgccaaaacc

SEQ ID NO: 5165699 - DNA, 13 bp, Homo sapiens
actttattggtct

SEQ ID NO: 5165700 - DNA, 14 bp, Homo sapiens
actttattggtctt

SEQ ID NO: 5165701 - DNA, 17 bp, Homo sapiens
actttattggtcttgcc

SEQ ID NO: 5165702 - DNA, 20 bp, Homo sapiens
actttattggtcttgcccta

SEQ ID NO: 5165703 - DNA, 16 bp, Homo sapiens
actttattgtacagac

SEQ ID NO: 5165704 - DNA, 20 bp, Homo sapiens
actttattgtacagactgtt

SEQ ID NO: 5165705 - DNA, 21 bp, Homo sapiens
actttattgtacagactgttt

SEQ ID NO: 5165706 - DNA, 14 bp, Homo sapiens
actttatttaaatg

SEQ ID NO: 5165707 - DNA, 18 bp, Homo sapiens
actttatttaaatgcatg

SEQ ID NO: 5165708 - DNA, 22 bp, Homo sapiens
actttatttaaatgcatgtctt

SEQ ID NO: 5165709 - DNA, 16 bp, Homo sapiens
actttatttaatttca

SEQ ID NO: 5165710 - DNA, 18 bp, Homo sapiens
actttatttaatttcata

SEQ ID NO: 5165711 - DNA, 12 bp, Homo sapiens
actttatttact

SEQ ID NO: 5165712 - DNA, 13 bp, Homo sapiens
actttatttactt

SEQ ID NO: 5165713 - DNA, 16 bp, Homo sapiens
actttatttatttcta

SEQ ID NO: 5165714 - DNA, 12 bp, Homo sapiens
actttatttcca

SEQ ID NO: 5165715 - DNA, 16 bp, Homo sapiens
actttatttctctcat

SEQ ID NO: 5165716 - DNA, 23 bp, Homo sapiens
actttatttctgagcaaagcatc

SEQ ID NO: 5165717 - DNA, 20 bp, Homo sapiens
actttattttatataataaa

SEQ ID NO: 5165718 - DNA, 23 bp, Homo sapiens
actttattttatataataaagta

SEQ ID NO: 5165719 - DNA, 22 bp, Homo sapiens
actttattttctataatttaaa

SEQ ID NO: 5165720 - DNA, 13 bp, Homo sapiens
actttattttctg

SEQ ID NO: 5165721 - DNA, 14 bp, Homo sapiens
actttattttgaat

SEQ ID NO: 5165722 - DNA, 15 bp, Homo sapiens
actttattttgaatg

SEQ ID NO: 5165723 - DNA, 20 bp, Homo sapiens
actttattttgaatgtacct

SEQ ID NO: 5165724 - DNA, 24 bp, Homo sapiens
actttattttgaatgtacctctat

SEQ ID NO: 5165725 - DNA, 13 bp, Homo sapiens
actttatttttct

SEQ ID NO: 5165726 - DNA, 15 bp, Homo sapiens
actttatttttctaa

SEQ ID NO: 5165727 - DNA, 20 bp, Homo sapiens
actttatttttctatgtgtt

SEQ ID NO: 5165728 - DNA, 15 bp, Homo sapiens
actttatttttctga

SEQ ID NO: 5165729 - DNA, 19 bp, Homo sapiens
actttatttttctgataga

SEQ ID NO: 5165730 - DNA, 14 bp, Homo sapiens
actttatttttgta

SEQ ID NO: 5165731 - DNA, 20 bp, Homo sapiens
actttatttttgtataaaat

SEQ ID NO: 5165732 - DNA, 20 bp, Homo sapiens
actttattttttaaaaatga

SEQ ID NO: 5165733 - DNA, 17 bp, Homo sapiens
actttcaaaagagtaga

SEQ ID NO: 5165734 - DNA, 16 bp, Homo sapiens
actttcaaaagcaaac

SEQ ID NO: 5165735 - DNA, 11 bp, Homo sapiens
actttcaaaat

SEQ ID NO: 5165736 - DNA, 13 bp, Homo sapiens
actttcaaaatta

SEQ ID NO: 5165737 - DNA, 14 bp, Homo sapiens
actttcaaatccac

SEQ ID NO: 5165738 - DNA, 16 bp, Homo sapiens
actttcaagaacttgt

SEQ ID NO: 5165739 - DNA, 19 bp, Homo sapiens
actttcaagaacttgttta

SEQ ID NO: 5165740 - DNA, 17 bp, Homo sapiens
actttcaagtattatat

SEQ ID NO: 5165741 - DNA, 15 bp, Homo sapiens
actttcaatatttta

SEQ ID NO: 5165742 - DNA, 16 bp, Homo sapiens
actttcaatattttaa

SEQ ID NO: 5165743 - DNA, 11 bp, Homo sapiens
actttcaatct

SEQ ID NO: 5165744 - DNA, 15 bp, Homo sapiens
actttcacatagatg

SEQ ID NO: 5165745 - DNA, 20 bp, Homo sapiens
actttcacatagatgtccct

SEQ ID NO: 5165746 - DNA, 21 bp, Homo sapiens
actttcacatagatgtccctt

SEQ ID NO: 5165747 - DNA, 23 bp, Homo sapiens
actttcactataatgtgaaatgt

SEQ ID NO: 5165748 - DNA, 11 bp, Homo sapiens
actttcacttc

SEQ ID NO: 5165749 - DNA, 18 bp, Homo sapiens
actttcacttcttcctat

SEQ ID NO: 5165750 - DNA, 19 bp, Homo sapiens
actttcacttcttcctatt

SEQ ID NO: 5165751 - DNA, 14 bp, Homo sapiens
actttcagaactgc

SEQ ID NO: 5165752 - DNA, 17 bp, Homo sapiens
actttcagaatgttgtg

SEQ ID NO: 5165753 - DNA, 21 bp, Homo sapiens
actttcagagcccccagccct

SEQ ID NO: 5165754 - DNA, 22 bp, Homo sapiens
actttcagagcccccagccctg

SEQ ID NO: 5165755 - DNA, 13 bp, Homo sapiens
actttcagattgt

SEQ ID NO: 5165756 - DNA, 17 bp, Homo sapiens
actttcagattgtatct

SEQ ID NO: 5165757 - DNA, 15 bp, Homo sapiens
actttcagctgtctt

SEQ ID NO: 5165758 - DNA, 18 bp, Homo sapiens
actttcaggtactaaata

SEQ ID NO: 5165759 - DNA, 21 bp, Homo sapiens
actttcaggtactaaatacct

SEQ ID NO: 5165760 - DNA, 12 bp, Homo sapiens
actttcagtttt

SEQ ID NO: 5165761 - DNA, 19 bp, Homo sapiens
actttcataccacttgaat

SEQ ID NO: 5165762 - DNA, 21 bp, Homo sapiens
actttcatcctgactctgccc

SEQ ID NO: 5165763 - DNA, 15 bp, Homo sapiens
actttcatctgagct

SEQ ID NO: 5165764 - DNA, 18 bp, Homo sapiens
actttcatctggggtggg

SEQ ID NO: 5165765 - DNA, 13 bp, Homo sapiens
actttcatcttaa

SEQ ID NO: 5165766 - DNA, 17 bp, Homo sapiens
actttcatgctacagaa

SEQ ID NO: 5165767 - DNA, 13 bp, Homo sapiens
actttcattgcca

SEQ ID NO: 5165768 - DNA, 16 bp, Homo sapiens
actttcattgccagtg

SEQ ID NO: 5165769 - DNA, 11 bp, Homo sapiens
actttccaaat

SEQ ID NO: 5165770 - DNA, 12 bp, Homo sapiens
actttccaacat

SEQ ID NO: 5165771 - DNA, 16 bp, Homo sapiens
actttccaatgccaca

SEQ ID NO: 5165772 - DNA, 18 bp, Homo sapiens
actttccaattctccttt

SEQ ID NO: 5165773 - DNA, 19 bp, Homo sapiens
actttccactgacaacgaa

SEQ ID NO: 5165774 - DNA, 13 bp, Homo sapiens
actttccagcagg

SEQ ID NO: 5165775 - DNA, 18 bp, Homo sapiens
actttccagcagtcagtc

SEQ ID NO: 5165776 - DNA, 13 bp, Homo sapiens
actttccatctct

SEQ ID NO: 5165777 - DNA, 18 bp, Homo sapiens
actttccatctctgcctg

SEQ ID NO: 5165778 - DNA, 21 bp, Homo sapiens
actttccatctctgcctgtca

SEQ ID NO: 5165779 - DNA, 14 bp, Homo sapiens
actttccatgacag

SEQ ID NO: 5165780 - DNA, 17 bp, Homo sapiens
actttccatgacagtag

SEQ ID NO: 5165781 - DNA, 21 bp, Homo sapiens
actttccatgacagtagcata

SEQ ID NO: 5165782 - DNA, 22 bp, Homo sapiens
actttccatgacagtagcatac

SEQ ID NO: 5165783 - DNA, 14 bp, Homo sapiens
actttccattaaat

SEQ ID NO: 5165784 - DNA, 13 bp, Homo sapiens
actttccattaca

SEQ ID NO: 5165785 - DNA, 14 bp, Homo sapiens
actttccattacaa

SEQ ID NO: 5165786 - DNA, 15 bp, Homo sapiens
actttccattacaag

SEQ ID NO: 5165787 - DNA, 15 bp, Homo sapiens
actttccatttggta

SEQ ID NO: 5165788 - DNA, 16 bp, Homo sapiens
actttcccaaatgtat

SEQ ID NO: 5165789 - DNA, 15 bp, Homo sapiens
actttcccacactgt

SEQ ID NO: 5165790 - DNA, 16 bp, Homo sapiens
actttcccacactgtg

SEQ ID NO: 5165791 - DNA, 14 bp, Homo sapiens
actttcccacccag

SEQ ID NO: 5165792 - DNA, 21 bp, Homo sapiens
actttcccaggttctgtttat

SEQ ID NO: 5165793 - DNA, 17 bp, Homo sapiens
actttccccccaacccg

SEQ ID NO: 5165794 - DNA, 16 bp, Homo sapiens
actttcccccttcccg

SEQ ID NO: 5165795 - DNA, 14 bp, Homo sapiens
actttccctctggg

SEQ ID NO: 5165796 - DNA, 15 bp, Homo sapiens
actttccctctggga

SEQ ID NO: 5165797 - DNA, 14 bp, Homo sapiens
actttcccttcccc

SEQ ID NO: 5165798 - DNA, 15 bp, Homo sapiens
actttcccttcccct

SEQ ID NO: 5165799 - DNA, 11 bp, Homo sapiens
actttcccttg

SEQ ID NO: 5165800 - DNA, 19 bp, Homo sapiens
actttcccttgccctgggc

SEQ ID NO: 5165801 - DNA, 15 bp, Homo sapiens
actttcccttggctg

SEQ ID NO: 5165802 - DNA, 16 bp, Homo sapiens
actttcccttggctgt

SEQ ID NO: 5165803 - DNA, 17 bp, Homo sapiens
actttcccttggctgtt

SEQ ID NO: 5165804 - DNA, 21 bp, Homo sapiens
actttcccttttgtaagttga

SEQ ID NO: 5165805 - DNA, 21 bp, Homo sapiens
actttccgaaaaataaagaca

SEQ ID NO: 5165806 - DNA, 17 bp, Homo sapiens
actttcctacaaaatgg

SEQ ID NO: 5165807 - DNA, 14 bp, Homo sapiens
actttcctctctct

SEQ ID NO: 5165808 - DNA, 15 bp, Homo sapiens
actttcctctctctc

SEQ ID NO: 5165809 - DNA, 21 bp, Homo sapiens
actttcctcttagtcgagcca

SEQ ID NO: 5165810 - DNA, 16 bp, Homo sapiens
actttcctgagctgtc

SEQ ID NO: 5165811 - DNA, 14 bp, Homo sapiens
actttcctgatgtt

SEQ ID NO: 5165812 - DNA, 22 bp, Homo sapiens
actttcctggataaaaaagaaa

SEQ ID NO: 5165813 - DNA, 23 bp, Homo sapiens
actttccttagacccgccaggtc

SEQ ID NO: 5165814 - DNA, 17 bp, Homo sapiens
actttccttccctctcc

SEQ ID NO: 5165815 - DNA, 10 bp, Homo sapiens
actttccttt

SEQ ID NO: 5165816 - DNA, 14 bp, Homo sapiens
actttcctttaact

SEQ ID NO: 5165817 - DNA, 13 bp, Homo sapiens
actttcctttcaa

SEQ ID NO: 5165818 - DNA, 19 bp, Homo sapiens
actttcctttcaataaagt

SEQ ID NO: 5165819 - DNA, 22 bp, Homo sapiens
actttcctttcaataaagttgt

SEQ ID NO: 5165820 - DNA, 17 bp, Homo sapiens
actttcctttccccagc

SEQ ID NO: 5165821 - DNA, 18 bp, Homo sapiens
actttcctttccccagcc

SEQ ID NO: 5165822 - DNA, 22 bp, Homo sapiens
actttcctttccccagcccagg

SEQ ID NO: 5165823 - DNA, 14 bp, Homo sapiens
actttcctttgcac

SEQ ID NO: 5165824 - DNA, 21 bp, Homo sapiens
actttccttttcttgtctctg

SEQ ID NO: 5165825 - DNA, 22 bp, Homo sapiens
actttccttttcttgtctctga

SEQ ID NO: 5165826 - DNA, 21 bp, Homo sapiens
actttcgaccgactttcccca

SEQ ID NO: 5165827 - DNA, 13 bp, Homo sapiens
actttcgcctcct

SEQ ID NO: 5165828 - DNA, 15 bp, Homo sapiens
actttcgcctcctcc

SEQ ID NO: 5165829 - DNA, 14 bp, Homo sapiens
actttcggagaaat

SEQ ID NO: 5165830 - DNA, 20 bp, Homo sapiens
actttcggagaaattctctt

SEQ ID NO: 5165831 - DNA, 21 bp, Homo sapiens
actttcggagaaattctcttt

SEQ ID NO: 5165832 - DNA, 14 bp, Homo sapiens
actttcgggagggt

SEQ ID NO: 5165833 - DNA, 19 bp, Homo sapiens
actttcgtaatagctcaga

SEQ ID NO: 5165834 - DNA, 15 bp, Homo sapiens
actttctaatgtttc

SEQ ID NO: 5165835 - DNA, 17 bp, Homo sapiens
actttctaatgtttctg

SEQ ID NO: 5165836 - DNA, 17 bp, Homo sapiens
actttctagccagagga

SEQ ID NO: 5165837 - DNA, 22 bp, Homo sapiens
actttctatagcagattgtgta

SEQ ID NO: 5165838 - DNA, 17 bp, Homo sapiens
actttctatctcatctg

SEQ ID NO: 5165839 - DNA, 22 bp, Homo sapiens
actttctatctcatctgtctcg

SEQ ID NO: 5165840 - DNA, 12 bp, Homo sapiens
actttctatttt

SEQ ID NO: 5165841 - DNA, 20 bp, Homo sapiens
actttctatttttatgatga

SEQ ID NO: 5165842 - DNA, 14 bp, Homo sapiens
actttctcaatgct

SEQ ID NO: 5165843 - DNA, 15 bp, Homo sapiens
actttctcacttaca

SEQ ID NO: 5165844 - DNA, 17 bp, Homo sapiens
actttctcaggcttctc

SEQ ID NO: 5165845 - DNA, 19 bp, Homo sapiens
actttctcataagcaccta

SEQ ID NO: 5165846 - DNA, 16 bp, Homo sapiens
actttctccatttaag

SEQ ID NO: 5165847 - DNA, 21 bp, Homo sapiens
actttctcccagtatgtttta

SEQ ID NO: 5165848 - DNA, 22 bp, Homo sapiens
actttctcctggcccctgcctg

SEQ ID NO: 5165849 - DNA, 20 bp, Homo sapiens
actttctcctggtgtttttc

SEQ ID NO: 5165850 - DNA, 21 bp, Homo sapiens
actttctcggtccactcttgt

SEQ ID NO: 5165851 - DNA, 22 bp, Homo sapiens
actttctcggtccactcttgtt

SEQ ID NO: 5165852 - DNA, 14 bp, Homo sapiens
actttctctaataa

SEQ ID NO: 5165853 - DNA, 17 bp, Homo sapiens
actttctctaataataa

SEQ ID NO: 5165854 - DNA, 18 bp, Homo sapiens
actttctctaataataaa

SEQ ID NO: 5165855 - DNA, 21 bp, Homo sapiens
actttctctaataataaatag

SEQ ID NO: 5165856 - DNA, 14 bp, Homo sapiens
actttctctctcct

SEQ ID NO: 5165857 - DNA, 12 bp, Homo sapiens
actttctctctt

SEQ ID NO: 5165858 - DNA, 16 bp, Homo sapiens
actttctctgtagttc

SEQ ID NO: 5165859 - DNA, 16 bp, Homo sapiens
actttctctgtgaaag

SEQ ID NO: 5165860 - DNA, 17 bp, Homo sapiens
actttctctgtgaaagc

SEQ ID NO: 5165861 - DNA, 17 bp, Homo sapiens
actttctcttggacatt

SEQ ID NO: 5165862 - DNA, 13 bp, Homo sapiens
actttctcttgtt

SEQ ID NO: 5165863 - DNA, 16 bp, Homo sapiens
actttctcttgtttaa

SEQ ID NO: 5165864 - DNA, 11 bp, Homo sapiens
actttctcttt

SEQ ID NO: 5165865 - DNA, 12 bp, Homo sapiens
actttctgaaaa

SEQ ID NO: 5165866 - DNA, 21 bp, Homo sapiens
actttctgaaaatttatataa

SEQ ID NO: 5165867 - DNA, 20 bp, Homo sapiens
actttctgaaataacatggc

SEQ ID NO: 5165868 - DNA, 14 bp, Homo sapiens
actttctgcctgga

SEQ ID NO: 5165869 - DNA, 12 bp, Homo sapiens
actttctgcttg

SEQ ID NO: 5165870 - DNA, 14 bp, Homo sapiens
actgctggtgccag

SEQ ID NO: 5165871 - DNA, 16 bp, Homo sapiens
actgctggtgccaggg

SEQ ID NO: 5165872 - DNA, 16 bp, Homo sapiens
actgctggtgtttatg

SEQ ID NO: 5165873 - DNA, 18 bp, Homo sapiens
actgctggtgtttatgtg

SEQ ID NO: 5165874 - DNA, 22 bp, Homo sapiens
actgctggtgtttatgtgaaca

SEQ ID NO: 5165875 - DNA, 19 bp, Homo sapiens
actgctggttgacatcaga

SEQ ID NO: 5165876 - DNA, 22 bp, Homo sapiens
actgctgtaaataaatgcttta

SEQ ID NO: 5165877 - DNA, 16 bp, Homo sapiens
actgctgtacccagat

SEQ ID NO: 5165878 - DNA, 19 bp, Homo sapiens
actgctgtacccagatgcc

SEQ ID NO: 5165879 - DNA, 23 bp, Homo sapiens
actgctgtatttttatttttgca

SEQ ID NO: 5165880 - DNA, 22 bp, Homo sapiens
actgctgtccacatgacctcca

SEQ ID NO: 5165881 - DNA, 14 bp, Homo sapiens
actgctgtcctctc

SEQ ID NO: 5165882 - DNA, 23 bp, Homo sapiens
actgctgtcgttgttgtggaagc

SEQ ID NO: 5165883 - DNA, 12 bp, Homo sapiens
actgctgtctct

SEQ ID NO: 5165884 - DNA, 14 bp, Homo sapiens
actgctgtcttcca

SEQ ID NO: 5165885 - DNA, 22 bp, Homo sapiens
actgctgtgaacatgcctcctc

SEQ ID NO: 5165886 - DNA, 19 bp, Homo sapiens
actgctgtggccaggaggt

SEQ ID NO: 5165887 - DNA, 20 bp, Homo sapiens
actgctgtggccaggaggtg

SEQ ID NO: 5165888 - DNA, 14 bp, Homo sapiens
actgctgtggcccc

SEQ ID NO: 5165889 - DNA, 17 bp, Homo sapiens
actgctgtgtccgcttt

SEQ ID NO: 5165890 - DNA, 22 bp, Homo sapiens
actgctgtgtccgctttcatga

SEQ ID NO: 5165891 - DNA, 15 bp, Homo sapiens
actgctgttatattt

SEQ ID NO: 5165892 - DNA, 21 bp, Homo sapiens
actgctgttcccctcttccct

SEQ ID NO: 5165893 - DNA, 19 bp, Homo sapiens
actgctgttttatgtcata

SEQ ID NO: 5165894 - DNA, 17 bp, Homo sapiens
actgcttaaattccaag

SEQ ID NO: 5165895 - DNA, 13 bp, Homo sapiens
actgcttacagtt

SEQ ID NO: 5165896 - DNA, 19 bp, Homo sapiens
actgcttagcattttgcat

SEQ ID NO: 5165897 - DNA, 22 bp, Homo sapiens
actgcttataaacatttaaaga

SEQ ID NO: 5165898 - DNA, 16 bp, Homo sapiens
actgcttattttatga

SEQ ID NO: 5165899 - DNA, 17 bp, Homo sapiens
actgcttattttatgat

SEQ ID NO: 5165900 - DNA, 14 bp, Homo sapiens
actgcttcattttt

SEQ ID NO: 5165901 - DNA, 21 bp, Homo sapiens
actgcttcatttttgtaataa

SEQ ID NO: 5165902 - DNA, 16 bp, Homo sapiens
actgcttcccactggg

SEQ ID NO: 5165903 - DNA, 15 bp, Homo sapiens
actgcttcccatcct

SEQ ID NO: 5165904 - DNA, 16 bp, Homo sapiens
actgcttcccatccta

SEQ ID NO: 5165905 - DNA, 20 bp, Homo sapiens
actgcttctcggaggccagg

SEQ ID NO: 5165906 - DNA, 16 bp, Homo sapiens
actgcttctctttgtg

SEQ ID NO: 5165907 - DNA, 18 bp, Homo sapiens
actgcttcttatggtggt

SEQ ID NO: 5165908 - DNA, 23 bp, Homo sapiens
actgcttgaactaggctgagcaa

SEQ ID NO: 5165909 - DNA, 14 bp, Homo sapiens
actgcttgaggaaa

SEQ ID NO: 5165910 - DNA, 20 bp, Homo sapiens
actgcttgatgaagcaagga

SEQ ID NO: 5165911 - DNA, 13 bp, Homo sapiens
actgcttgcccag

SEQ ID NO: 5165912 - DNA, 14 bp, Homo sapiens
actgcttgcccagg

SEQ ID NO: 5165913 - DNA, 17 bp, Homo sapiens
actgcttgcccagggtg

SEQ ID NO: 5165914 - DNA, 16 bp, Homo sapiens
actgcttgccctaagc

SEQ ID NO: 5165915 - DNA, 20 bp, Homo sapiens
actgcttgccctaagcagaa

SEQ ID NO: 5165916 - DNA, 22 bp, Homo sapiens
actgcttgccctaagcagaaag

SEQ ID NO: 5165917 - DNA, 12 bp, Homo sapiens
actgcttgctta

SEQ ID NO: 5165918 - DNA, 15 bp, Homo sapiens
actgcttggaagaag

SEQ ID NO: 5165919 - DNA, 16 bp, Homo sapiens
actgcttggagctgag

SEQ ID NO: 5165920 - DNA, 18 bp, Homo sapiens
actgcttggagctgagca

SEQ ID NO: 5165921 - DNA, 11 bp, Homo sapiens
actgctttact

SEQ ID NO: 5165922 - DNA, 14 bp, Homo sapiens
actgctttactgtg

SEQ ID NO: 5165923 - DNA, 15 bp, Homo sapiens
actgctttattttag

SEQ ID NO: 5165924 - DNA, 19 bp, Homo sapiens
actgctttatttttataaa

SEQ ID NO: 5165925 - DNA, 23 bp, Homo sapiens
actgctttcaacttaaatcactg

SEQ ID NO: 5165926 - DNA, 12 bp, Homo sapiens
actgctttcaag

SEQ ID NO: 5165927 - DNA, 16 bp, Homo sapiens
actgctttcagtgcct

SEQ ID NO: 5165928 - DNA, 21 bp, Homo sapiens
actgctttcagtgcctgctgt

SEQ ID NO: 5165929 - DNA, 15 bp, Homo sapiens
actgctttccagcct

SEQ ID NO: 5165930 - DNA, 19 bp, Homo sapiens
actgctttctgttccaaat

SEQ ID NO: 5165931 - DNA, 23 bp, Homo sapiens
actgctttctttcgtttgtttgt

SEQ ID NO: 5165932 - DNA, 14 bp, Homo sapiens
actgctttgagaaa

SEQ ID NO: 5165933 - DNA, 21 bp, Homo sapiens
actgctttgttttggctgctc

SEQ ID NO: 5165934 - DNA, 23 bp, Homo sapiens
actgctttgttttggctgctctc

SEQ ID NO: 5165935 - DNA, 22 bp, Homo sapiens
actgcttttaaaagtgcacatt

SEQ ID NO: 5165936 - DNA, 18 bp, Homo sapiens
actgcttttaacttctga

SEQ ID NO: 5165937 - DNA, 21 bp, Homo sapiens
actgcttttccacaaggaatc

SEQ ID NO: 5165938 - DNA, 20 bp, Homo sapiens
actgcttttcctcaagcaat

SEQ ID NO: 5165939 - DNA, 14 bp, Homo sapiens
actgcttttggcct

SEQ ID NO: 5165940 - DNA, 15 bp, Homo sapiens
actgcttttggcctg

SEQ ID NO: 5165941 - DNA, 20 bp, Homo sapiens
actgcttttggtctgtgtga

SEQ ID NO: 5165942 - DNA, 18 bp, Homo sapiens
actggaaaacagaacact

SEQ ID NO: 5165943 - DNA, 20 bp, Homo sapiens
actggaaaacatagagtaga

SEQ ID NO: 5165944 - DNA, 23 bp, Homo sapiens
actggaaaactgctactatctgt

SEQ ID NO: 5165945 - DNA, 21 bp, Homo sapiens
actggaaaaggtgaaaatgtt

SEQ ID NO: 5165946 - DNA, 22 bp, Homo sapiens
actggaaaatcttctagcatgt

SEQ ID NO: 5165947 - DNA, 21 bp, Homo sapiens
actggaaacaaaacagaaggg

SEQ ID NO: 5165948 - DNA, 21 bp, Homo sapiens
actggaaacaaggaaggacat

SEQ ID NO: 5165949 - DNA, 17 bp, Homo sapiens
actggaaacatctgatt

SEQ ID NO: 5165950 - DNA, 22 bp, Homo sapiens
actggaaacctgttatgccaaa

SEQ ID NO: 5165951 - DNA, 23 bp, Homo sapiens
actggaaagcttttctattttaa

SEQ ID NO: 5165952 - DNA, 20 bp, Homo sapiens
actggaaaggggagagcctg

SEQ ID NO: 5165953 - DNA, 23 bp, Homo sapiens
actggaaaggggagagcctgctg

SEQ ID NO: 5165954 - DNA, 23 bp, Homo sapiens
actggaaataaagtaggaaagaa

SEQ ID NO: 5165955 - DNA, 19 bp, Homo sapiens
actggaaatgtagcactta

SEQ ID NO: 5165956 - DNA, 21 bp, Homo sapiens
actggaaatgtttgtccttgc

SEQ ID NO: 5165957 - DNA, 19 bp, Homo sapiens
actggaacactctataaca

SEQ ID NO: 5165958 - DNA, 15 bp, Homo sapiens
actggaacatggcta

SEQ ID NO: 5165959 - DNA, 21 bp, Homo sapiens
actggaacatggctagccttt

SEQ ID NO: 5165960 - DNA, 13 bp, Homo sapiens
actggaacccttt

SEQ ID NO: 5165961 - DNA, 21 bp, Homo sapiens
actggaacctccctgggcctg

SEQ ID NO: 5165962 - DNA, 17 bp, Homo sapiens
actggaacttgaactga

SEQ ID NO: 5165963 - DNA, 15 bp, Homo sapiens
actggaagaaagcaa

SEQ ID NO: 5165964 - DNA, 18 bp, Homo sapiens
actggaagacacttcaga

SEQ ID NO: 5165965 - DNA, 12 bp, Homo sapiens
actggaagcaca

SEQ ID NO: 5165966 - DNA, 14 bp, Homo sapiens
actggaagcacaga

SEQ ID NO: 5165967 - DNA, 20 bp, Homo sapiens
actggaagcacagcctcggg

SEQ ID NO: 5165968 - DNA, 22 bp, Homo sapiens
actggaagcacagcctcgggga

SEQ ID NO: 5165969 - DNA, 19 bp, Homo sapiens
actggaagcatgtaggaga

SEQ ID NO: 5165970 - DNA, 16 bp, Homo sapiens
actggaagctaatttg

SEQ ID NO: 5165971 - DNA, 19 bp, Homo sapiens
actggaagctaatttgcat

SEQ ID NO: 5165972 - DNA, 21 bp, Homo sapiens
actggaaggaacatggagctg

SEQ ID NO: 5165973 - DNA, 12 bp, Homo sapiens
actggaaggagc

SEQ ID NO: 5165974 - DNA, 15 bp, Homo sapiens
actggaaggagcaca

SEQ ID NO: 5165975 - DNA, 16 bp, Homo sapiens
actggaaggagcacat

SEQ ID NO: 5165976 - DNA, 18 bp, Homo sapiens
actggaaggggaagggac

SEQ ID NO: 5165977 - DNA, 17 bp, Homo sapiens
actggaagggtccggct

SEQ ID NO: 5165978 - DNA, 18 bp, Homo sapiens
actggaaggtggggacag

SEQ ID NO: 5165979 - DNA, 16 bp, Homo sapiens
actggaataatttgta

SEQ ID NO: 5165980 - DNA, 18 bp, Homo sapiens
actggaataatttgtaaa

SEQ ID NO: 5165981 - DNA, 22 bp, Homo sapiens
actggaataatttgtaaatgat

SEQ ID NO: 5165982 - DNA, 14 bp, Homo sapiens
actggaatatctga

SEQ ID NO: 5165983 - DNA, 16 bp, Homo sapiens
actggaatcctttcag

SEQ ID NO: 5165984 - DNA, 13 bp, Homo sapiens
actggaattaaaa

SEQ ID NO: 5165985 - DNA, 18 bp, Homo sapiens
actggaattcttctgcaa

SEQ ID NO: 5165986 - DNA, 14 bp, Homo sapiens
actggaatttttat

SEQ ID NO: 5165987 - DNA, 19 bp, Homo sapiens
actggaatttttattatgc

SEQ ID NO: 5165988 - DNA, 21 bp, Homo sapiens
actggaatttttattatgcat

SEQ ID NO: 5165989 - DNA, 23 bp, Homo sapiens
actggaatttttattatgcataa

SEQ ID NO: 5165990 - DNA, 24 bp, Homo sapiens
actggaatttttattatgcataac

SEQ ID NO: 5165991 - DNA, 15 bp, Homo sapiens
actggacaacactga

SEQ ID NO: 5165992 - DNA, 19 bp, Homo sapiens
actggacacaaacaggaat

SEQ ID NO: 5165993 - DNA, 20 bp, Homo sapiens
actggacacaataggtcttt

SEQ ID NO: 5165994 - DNA, 21 bp, Homo sapiens
actggacacactaaactctgg

SEQ ID NO: 5165995 - DNA, 22 bp, Homo sapiens
actggacacactaaactctggg

SEQ ID NO: 5165996 - DNA, 11 bp, Homo sapiens
actggacagac

SEQ ID NO: 5165997 - DNA, 15 bp, Homo sapiens
actggacagacccag

SEQ ID NO: 5165998 - DNA, 17 bp, Homo sapiens
actggacagacccaggt

SEQ ID NO: 5165999 - DNA, 15 bp, Homo sapiens
actggacagccaggg

SEQ ID NO: 5166000 - DNA, 22 bp, Homo sapiens
actggacagccagggcagggct

SEQ ID NO: 5166001 - DNA, 20 bp, Homo sapiens
actggacagcggttgtaaat

SEQ ID NO: 5166002 - DNA, 21 bp, Homo sapiens
actggacatcacagcagaatg

SEQ ID NO: 5166003 - DNA, 14 bp, Homo sapiens
actggacatgaagg

SEQ ID NO: 5166004 - DNA, 16 bp, Homo sapiens
actggacatggcccat

SEQ ID NO: 5166005 - DNA, 18 bp, Homo sapiens
actggacatggcccattg

SEQ ID NO: 5166006 - DNA, 14 bp, Homo sapiens
actggaccccactg

SEQ ID NO: 5166007 - DNA, 21 bp, Homo sapiens
actggaccccactggctgaga

SEQ ID NO: 5166008 - DNA, 17 bp, Homo sapiens
actggaccgctgactgc

SEQ ID NO: 5166009 - DNA, 14 bp, Homo sapiens
actggacctgaaat

SEQ ID NO: 5166010 - DNA, 15 bp, Homo sapiens
actggacctgaaatt

SEQ ID NO: 5166011 - DNA, 17 bp, Homo sapiens
actggacctgaaattta

SEQ ID NO: 5166012 - DNA, 13 bp, Homo sapiens
actggacctgggg

SEQ ID NO: 5166013 - DNA, 22 bp, Homo sapiens
actggacctttgggttctttct

SEQ ID NO: 5166014 - DNA, 16 bp, Homo sapiens
actggacgctgccctg

SEQ ID NO: 5166015 - DNA, 20 bp, Homo sapiens
actggacgctgtcctgagat

SEQ ID NO: 5166016 - DNA, 19 bp, Homo sapiens
actggactatagcagggct

SEQ ID NO: 5166017 - DNA, 20 bp, Homo sapiens
actggactatagcagggctg

SEQ ID NO: 5166018 - DNA, 12 bp, Homo sapiens
actggactcagg

SEQ ID NO: 5166019 - DNA, 16 bp, Homo sapiens
actggactcaggaact

SEQ ID NO: 5166020 - DNA, 18 bp, Homo sapiens
actggactcaggaacttt

SEQ ID NO: 5166021 - DNA, 14 bp, Homo sapiens
actggactcaggat

SEQ ID NO: 5166022 - DNA, 21 bp, Homo sapiens
actggactcaggatgcccagg

SEQ ID NO: 5166023 - DNA, 21 bp, Homo sapiens
actggactccgaggtggttca

SEQ ID NO: 5166024 - DNA, 14 bp, Homo sapiens
actggactccggcc

SEQ ID NO: 5166025 - DNA, 16 bp, Homo sapiens
actggactccggggcc

SEQ ID NO: 5166026 - DNA, 14 bp, Homo sapiens
actggactcttcaa

SEQ ID NO: 5166027 - DNA, 12 bp, Homo sapiens
actggactgcat

SEQ ID NO: 5166028 - DNA, 14 bp, Homo sapiens
actggactgcatgg

SEQ ID NO: 5166029 - DNA, 21 bp, Homo sapiens
actggagaccagaaaccttcc

SEQ ID NO: 5166030 - DNA, 21 bp, Homo sapiens
actggagactgtgtgtgccct

SEQ ID NO: 5166031 - DNA, 12 bp, Homo sapiens
actggagaggct

SEQ ID NO: 5166032 - DNA, 13 bp, Homo sapiens
actggagcaccag

SEQ ID NO: 5166033 - DNA, 15 bp, Homo sapiens
actggagcaccaggc

SEQ ID NO: 5166034 - DNA, 14 bp, Homo sapiens
actggagcatctga

SEQ ID NO: 5166035 - DNA, 16 bp, Homo sapiens
actggagcatctgact

SEQ ID NO: 5166036 - DNA, 17 bp, Homo sapiens
actggagcatctgactc

SEQ ID NO: 5166037 - DNA, 15 bp, Homo sapiens
actggagccatgggc

SEQ ID NO: 5166038 - DNA, 16 bp, Homo sapiens
actggagcccaggagt

SEQ ID NO: 5166039 - DNA, 11 bp, Homo sapiens
actggagcccc

SEQ ID NO: 5166040 - DNA, 22 bp, Homo sapiens
actggagcccgagggcctgaca

SEQ ID NO: 5166041 - DNA, 15 bp, Homo sapiens
actggagctgctaag

SEQ ID NO: 5166042 - DNA, 16 bp, Homo sapiens
actggagctgctaagc

SEQ ID NO: 5166043 - DNA, 22 bp, Homo sapiens
actggagcttgaaatagtgtct

SEQ ID NO: 5166044 - DNA, 16 bp, Homo sapiens
actggaggagagaaga

SEQ ID NO: 5166045 - DNA, 14 bp, Homo sapiens
actggaggagcaca

SEQ ID NO: 5166046 - DNA, 14 bp, Homo sapiens
actggaggagcagc

SEQ ID NO: 5166047 - DNA, 19 bp, Homo sapiens
actggaggagcagcttcct

SEQ ID NO: 5166048 - DNA, 13 bp, Homo sapiens
actttctggcaaa

SEQ ID NO: 5166049 - DNA, 22 bp, Homo sapiens
actttctggcaaacgtttctca

SEQ ID NO: 5166050 - DNA, 19 bp, Homo sapiens
actttctggtcccttcagt

SEQ ID NO: 5166051 - DNA, 19 bp, Homo sapiens
actttctgtaaactcaaaa

SEQ ID NO: 5166052 - DNA, 21 bp, Homo sapiens
actttctgtactaaacatttc

SEQ ID NO: 5166053 - DNA, 23 bp, Homo sapiens
actttctgtctaggttaaagcta

SEQ ID NO: 5166054 - DNA, 23 bp, Homo sapiens
actttctgtctcaaaccctggct

SEQ ID NO: 5166055 - DNA, 12 bp, Homo sapiens
actttctgttaa

SEQ ID NO: 5166056 - DNA, 13 bp, Homo sapiens
actttctgttaaa

SEQ ID NO: 5166057 - DNA, 16 bp, Homo sapiens
actttctgttaaaatg

SEQ ID NO: 5166058 - DNA, 19 bp, Homo sapiens
actttctgttaaaatgcat

SEQ ID NO: 5166059 - DNA, 16 bp, Homo sapiens
actttctgttccttcc

SEQ ID NO: 5166060 - DNA, 15 bp, Homo sapiens
actttctgttttctg

SEQ ID NO: 5166061 - DNA, 23 bp, Homo sapiens
actttcttaatatcactttggtc

SEQ ID NO: 5166062 - DNA, 16 bp, Homo sapiens
actttcttattctgta

SEQ ID NO: 5166063 - DNA, 13 bp, Homo sapiens
actttcttcaaaa

SEQ ID NO: 5166064 - DNA, 17 bp, Homo sapiens
actttcttcaaaatata

SEQ ID NO: 5166065 - DNA, 14 bp, Homo sapiens
actttcttcaggta

SEQ ID NO: 5166066 - DNA, 23 bp, Homo sapiens
actttctttaaattatgttttta

SEQ ID NO: 5166067 - DNA, 17 bp, Homo sapiens
actttctttcagatgtt

SEQ ID NO: 5166068 - DNA, 15 bp, Homo sapiens
actttctttctaaag

SEQ ID NO: 5166069 - DNA, 16 bp, Homo sapiens
actttctttctcacta

SEQ ID NO: 5166070 - DNA, 22 bp, Homo sapiens
actttctttctcactaaatctt

SEQ ID NO: 5166071 - DNA, 14 bp, Homo sapiens
actttcttttatta

SEQ ID NO: 5166072 - DNA, 20 bp, Homo sapiens
actttcttttcgccgtggct

SEQ ID NO: 5166073 - DNA, 15 bp, Homo sapiens
actttcttttctgga

SEQ ID NO: 5166074 - DNA, 19 bp, Homo sapiens
actttcttttctggaatgt

SEQ ID NO: 5166075 - DNA, 16 bp, Homo sapiens
actttctttttctaca

SEQ ID NO: 5166076 - DNA, 18 bp, Homo sapiens
actttctttttgtagctg

SEQ ID NO: 5166077 - DNA, 21 bp, Homo sapiens
actttgaaaacaattcagtgg

SEQ ID NO: 5166078 - DNA, 14 bp, Homo sapiens
actttgaaaactga

SEQ ID NO: 5166079 - DNA, 19 bp, Homo sapiens
actttgaaaagttggaagg

SEQ ID NO: 5166080 - DNA, 15 bp, Homo sapiens
actttgaaaatattt

SEQ ID NO: 5166081 - DNA, 20 bp, Homo sapiens
actttgaaaggagatgtctt

SEQ ID NO: 5166082 - DNA, 15 bp, Homo sapiens
actttgaaatacctc

SEQ ID NO: 5166083 - DNA, 20 bp, Homo sapiens
actttgaaatacctcatgtt

SEQ ID NO: 5166084 - DNA, 14 bp, Homo sapiens
actttgaaatattt

SEQ ID NO: 5166085 - DNA, 13 bp, Homo sapiens
actttgaacctca

SEQ ID NO: 5166086 - DNA, 15 bp, Homo sapiens
actttgaagatgtca

SEQ ID NO: 5166087 - DNA, 12 bp, Homo sapiens
actttgaaggac

SEQ ID NO: 5166088 - DNA, 19 bp, Homo sapiens
actttgaaggtaataaata

SEQ ID NO: 5166089 - DNA, 17 bp, Homo sapiens
actttgaagttagcttt

SEQ ID NO: 5166090 - DNA, 14 bp, Homo sapiens
actttgaataaaag

SEQ ID NO: 5166091 - DNA, 16 bp, Homo sapiens
actttgaataaaagaa

SEQ ID NO: 5166092 - DNA, 17 bp, Homo sapiens
actttgaataaaagaat

SEQ ID NO: 5166093 - DNA, 14 bp, Homo sapiens
actttgaataaaat

SEQ ID NO: 5166094 - DNA, 20 bp, Homo sapiens
actttgaataaagaatactt

SEQ ID NO: 5166095 - DNA, 18 bp, Homo sapiens
actttgaatagtcctaaa

SEQ ID NO: 5166096 - DNA, 14 bp, Homo sapiens
actttgaatgtgtt

SEQ ID NO: 5166097 - DNA, 16 bp, Homo sapiens
actttgaatttatata

SEQ ID NO: 5166098 - DNA, 23 bp, Homo sapiens
actttgaattttagcacattgca

SEQ ID NO: 5166099 - DNA, 23 bp, Homo sapiens
actttgacaaaaatggttttgaa

SEQ ID NO: 5166100 - DNA, 21 bp, Homo sapiens
actttgacagcgcacagctgc

SEQ ID NO: 5166101 - DNA, 21 bp, Homo sapiens
actttgacaggttccttttaa

SEQ ID NO: 5166102 - DNA, 14 bp, Homo sapiens
actttgacagtgtt

SEQ ID NO: 5166103 - DNA, 20 bp, Homo sapiens
actttgacctaaattattta

SEQ ID NO: 5166104 - DNA, 22 bp, Homo sapiens
actttgacctaaattatttact

SEQ ID NO: 5166105 - DNA, 14 bp, Homo sapiens
actttgacctctgc

SEQ ID NO: 5166106 - DNA, 15 bp, Homo sapiens
actttgacctctgca

SEQ ID NO: 5166107 - DNA, 23 bp, Homo sapiens
actttgacctctgcagcaataaa

SEQ ID NO: 5166108 - DNA, 22 bp, Homo sapiens
actttgacgagtcaccttccag

SEQ ID NO: 5166109 - DNA, 15 bp, Homo sapiens
actttgactttttgc

SEQ ID NO: 5166110 - DNA, 21 bp, Homo sapiens
actttgactttttgcatttaa

SEQ ID NO: 5166111 - DNA, 21 bp, Homo sapiens
actttgagatctaaaaataac

SEQ ID NO: 5166112 - DNA, 16 bp, Homo sapiens
actttgagatgtgttc

SEQ ID NO: 5166113 - DNA, 24 bp, Homo sapiens
actttgagatgtgttcctcctgct

SEQ ID NO: 5166114 - DNA, 18 bp, Homo sapiens
actttgagcctgggaaat

SEQ ID NO: 5166115 - DNA, 17 bp, Homo sapiens
actttgaggacatttat

SEQ ID NO: 5166116 - DNA, 16 bp, Homo sapiens
actttgaggataactt

SEQ ID NO: 5166117 - DNA, 22 bp, Homo sapiens
actttgaggataactttttaaa

SEQ ID NO: 5166118 - DNA, 22 bp, Homo sapiens
actttgaggcagcgcattgttt

SEQ ID NO: 5166119 - DNA, 16 bp, Homo sapiens
actttgatgctccctt

SEQ ID NO: 5166120 - DNA, 15 bp, Homo sapiens
actttgatgtcatgt

SEQ ID NO: 5166121 - DNA, 13 bp, Homo sapiens
actttgattcaca

SEQ ID NO: 5166122 - DNA, 22 bp, Homo sapiens
actttgcaaattatttattact

SEQ ID NO: 5166123 - DNA, 23 bp, Homo sapiens
actttgcaaattatttattactt

SEQ ID NO: 5166124 - DNA, 19 bp, Homo sapiens
actttgcacgacgccctct

SEQ ID NO: 5166125 - DNA, 18 bp, Homo sapiens
actttgcactgatatatc

SEQ ID NO: 5166126 - DNA, 19 bp, Homo sapiens
actttgcactgatatatca

SEQ ID NO: 5166127 - DNA, 18 bp, Homo sapiens
actttgcagacctgggac

SEQ ID NO: 5166128 - DNA, 20 bp, Homo sapiens
actttgcaggcggccctcag

SEQ ID NO: 5166129 - DNA, 12 bp, Homo sapiens
actttgcatgtt

SEQ ID NO: 5166130 - DNA, 13 bp, Homo sapiens
actttgcattgtc

SEQ ID NO: 5166131 - DNA, 19 bp, Homo sapiens
actttgccagcttttcctc

SEQ ID NO: 5166132 - DNA, 15 bp, Homo sapiens
actttgcctcctgtg

SEQ ID NO: 5166133 - DNA, 19 bp, Homo sapiens
actttgcctcttcagcagc

SEQ ID NO: 5166134 - DNA, 20 bp, Homo sapiens
actttgcctcttcagcagca

SEQ ID NO: 5166135 - DNA, 20 bp, Homo sapiens
actttgcctttccataatca

SEQ ID NO: 5166136 - DNA, 17 bp, Homo sapiens
actttgcgggatattta

SEQ ID NO: 5166137 - DNA, 18 bp, Homo sapiens
actttgcgggatatttag

SEQ ID NO: 5166138 - DNA, 19 bp, Homo sapiens
actttgcgtgtgtcataaa

SEQ ID NO: 5166139 - DNA, 17 bp, Homo sapiens
actttgctaaagacatg

SEQ ID NO: 5166140 - DNA, 13 bp, Homo sapiens
actttgctccagg

SEQ ID NO: 5166141 - DNA, 20 bp, Homo sapiens
actttgctgatttcccctct

SEQ ID NO: 5166142 - DNA, 14 bp, Homo sapiens
actttgctgcattt

SEQ ID NO: 5166143 - DNA, 20 bp, Homo sapiens
actttgctggtgtagtcttt

SEQ ID NO: 5166144 - DNA, 22 bp, Homo sapiens
actttgctgttactgcttctct

SEQ ID NO: 5166145 - DNA, 16 bp, Homo sapiens
actttgcttcccctcc

SEQ ID NO: 5166146 - DNA, 20 bp, Homo sapiens
actttgcttcccctccagga

SEQ ID NO: 5166147 - DNA, 12 bp, Homo sapiens
actttgcttctc

SEQ ID NO: 5166148 - DNA, 17 bp, Homo sapiens
actttgcttgagaatcc

SEQ ID NO: 5166149 - DNA, 18 bp, Homo sapiens
actttgcttgagaatcct

SEQ ID NO: 5166150 - DNA, 20 bp, Homo sapiens
actttgcttgattaaacagc

SEQ ID NO: 5166151 - DNA, 16 bp, Homo sapiens
actttgctttaatata

SEQ ID NO: 5166152 - DNA, 18 bp, Homo sapiens
actttgctttaatataaa

SEQ ID NO: 5166153 - DNA, 19 bp, Homo sapiens
actttggaaaacataaaaa

SEQ ID NO: 5166154 - DNA, 12 bp, Homo sapiens
actttggaaaga

SEQ ID NO: 5166155 - DNA, 23 bp, Homo sapiens
actttggaaagagtaggaagact

SEQ ID NO: 5166156 - DNA, 19 bp, Homo sapiens
actttggaaagtagaaaag

SEQ ID NO: 5166157 - DNA, 17 bp, Homo sapiens
actttggaaccagactc

SEQ ID NO: 5166158 - DNA, 14 bp, Homo sapiens
actttggaagcact

SEQ ID NO: 5166159 - DNA, 15 bp, Homo sapiens
actttggaatacatt

SEQ ID NO: 5166160 - DNA, 17 bp, Homo sapiens
actttggaatgactata

SEQ ID NO: 5166161 - DNA, 18 bp, Homo sapiens
actttggagaactcattt

SEQ ID NO: 5166162 - DNA, 21 bp, Homo sapiens
actttggagaactcatttcaa

SEQ ID NO: 5166163 - DNA, 19 bp, Homo sapiens
actttggagactggggtgg

SEQ ID NO: 5166164 - DNA, 23 bp, Homo sapiens
actttggagagtgagctacagag

SEQ ID NO: 5166165 - DNA, 18 bp, Homo sapiens
actttggagtcccctcac

SEQ ID NO: 5166166 - DNA, 23 bp, Homo sapiens
actttggagtcccctcacctcct

SEQ ID NO: 5166167 - DNA, 16 bp, Homo sapiens
actttggatcaggaaa

SEQ ID NO: 5166168 - DNA, 16 bp, Homo sapiens
actttggctacaaata

SEQ ID NO: 5166169 - DNA, 21 bp, Homo sapiens
actttggcttataattctttc

SEQ ID NO: 5166170 - DNA, 23 bp, Homo sapiens
actttggcttataattctttcaa

SEQ ID NO: 5166171 - DNA, 15 bp, Homo sapiens
actttggcttatgaa

SEQ ID NO: 5166172 - DNA, 21 bp, Homo sapiens
actttgggacttgggagctgg

SEQ ID NO: 5166173 - DNA, 14 bp, Homo sapiens
actttgggaggcca

SEQ ID NO: 5166174 - DNA, 20 bp, Homo sapiens
actttgggaggccaaggtgg

SEQ ID NO: 5166175 - DNA, 20 bp, Homo sapiens
actttgggaggccgaggcag

SEQ ID NO: 5166176 - DNA, 14 bp, Homo sapiens
actttgggaggctg

SEQ ID NO: 5166177 - DNA, 19 bp, Homo sapiens
actttgggaggctgaggcg

SEQ ID NO: 5166178 - DNA, 22 bp, Homo sapiens
actttgggagtttttgtttgtt

SEQ ID NO: 5166179 - DNA, 19 bp, Homo sapiens
actttgggattctttccat

SEQ ID NO: 5166180 - DNA, 16 bp, Homo sapiens
actttgggcttagtat

SEQ ID NO: 5166181 - DNA, 22 bp, Homo sapiens
actttggggacagggggtggga

SEQ ID NO: 5166182 - DNA, 22 bp, Homo sapiens
actttggggccaattacttgaa

SEQ ID NO: 5166183 - DNA, 17 bp, Homo sapiens
actttggggctaattta

SEQ ID NO: 5166184 - DNA, 14 bp, Homo sapiens
actttgggggagga

SEQ ID NO: 5166185 - DNA, 17 bp, Homo sapiens
actttgggtttttaact

SEQ ID NO: 5166186 - DNA, 13 bp, Homo sapiens
actttggtaatgt

SEQ ID NO: 5166187 - DNA, 16 bp, Homo sapiens
actttggtaccagata

SEQ ID NO: 5166188 - DNA, 17 bp, Homo sapiens
actttggtaccagataa

SEQ ID NO: 5166189 - DNA, 21 bp, Homo sapiens
actttggtactgctgtcttcc

SEQ ID NO: 5166190 - DNA, 23 bp, Homo sapiens
actttggtactgctgtcttccaa

SEQ ID NO: 5166191 - DNA, 23 bp, Homo sapiens
actttggtagtggaatagtgaat

SEQ ID NO: 5166192 - DNA, 23 bp, Homo sapiens
actttggtcacaagtaggagaca

SEQ ID NO: 5166193 - DNA, 23 bp, Homo sapiens
actttggtgcgggcacaataaat

SEQ ID NO: 5166194 - DNA, 10 bp, Homo sapiens
actttggtta

SEQ ID NO: 5166195 - DNA, 14 bp, Homo sapiens
actttggtttctga

SEQ ID NO: 5166196 - DNA, 11 bp, Homo sapiens
actttggtttt

SEQ ID NO: 5166197 - DNA, 12 bp, Homo sapiens
actttggttttg

SEQ ID NO: 5166198 - DNA, 18 bp, Homo sapiens
actttggttttgctgaga

SEQ ID NO: 5166199 - DNA, 23 bp, Homo sapiens
actttgtaaaatatcgtgtgtgt

SEQ ID NO: 5166200 - DNA, 14 bp, Homo sapiens
actttgtaaattct

SEQ ID NO: 5166201 - DNA, 16 bp, Homo sapiens
actttgtaaattctga

SEQ ID NO: 5166202 - DNA, 17 bp, Homo sapiens
actttgtaaattctgat

SEQ ID NO: 5166203 - DNA, 18 bp, Homo sapiens
actttgtaaattctgatt

SEQ ID NO: 5166204 - DNA, 19 bp, Homo sapiens
actttgtaaattctgattt

SEQ ID NO: 5166205 - DNA, 23 bp, Homo sapiens
actttgtaaattctgatttcttt

SEQ ID NO: 5166206 - DNA, 22 bp, Homo sapiens
actttgtaaccagaattataca

SEQ ID NO: 5166207 - DNA, 15 bp, Homo sapiens
actttgtaatttttg

SEQ ID NO: 5166208 - DNA, 20 bp, Homo sapiens
actttgtacagtggagaaat

SEQ ID NO: 5166209 - DNA, 17 bp, Homo sapiens
actttgtacatttggga

SEQ ID NO: 5166210 - DNA, 18 bp, Homo sapiens
actttgtagacattttga

SEQ ID NO: 5166211 - DNA, 19 bp, Homo sapiens
actttgtataaaagggact

SEQ ID NO: 5166212 - DNA, 14 bp, Homo sapiens
actttgtatacaag

SEQ ID NO: 5166213 - DNA, 14 bp, Homo sapiens
actttgtatacttt

SEQ ID NO: 5166214 - DNA, 16 bp, Homo sapiens
actttgtatactttaa

SEQ ID NO: 5166215 - DNA, 12 bp, Homo sapiens
actttgtatagt

SEQ ID NO: 5166216 - DNA, 14 bp, Homo sapiens
actttgtatagtta

SEQ ID NO: 5166217 - DNA, 18 bp, Homo sapiens
actttgtatagttatgta

SEQ ID NO: 5166218 - DNA, 23 bp, Homo sapiens
actttgtatagttatgtaaataa

SEQ ID NO: 5166219 - DNA, 14 bp, Homo sapiens
actttgtatgatat

SEQ ID NO: 5166220 - DNA, 22 bp, Homo sapiens
actttgtatgtcatttccttca

SEQ ID NO: 5166221 - DNA, 18 bp, Homo sapiens
actttgtattctctgtcc

SEQ ID NO: 5166222 - DNA, 20 bp, Homo sapiens
actttgtattctctgtccag

SEQ ID NO: 5166223 - DNA, 14 bp, Homo sapiens
actttgtcagtgtt

SEQ ID NO: 5166224 - DNA, 17 bp, Homo sapiens
actttgtcccctcacct

SEQ ID NO: 5166225 - DNA, 13 bp, Homo sapiens
actttgtcccgct

SEQ ID NO: 5166226 - DNA, 20 bp, Homo sapiens
actttgtcgcccaggctgga

SEQ ID NO: 5166227 - DNA, 21 bp, Homo sapiens
actttgtcgtggttcttaaat

SEQ ID NO: 5166228 - DNA, 22 bp, Homo sapiens
actttgtcgtggttcttaaatg

SEQ ID NO: 5166229 - DNA, 20 bp, Homo sapiens
actttgtctaagaaacattg

SEQ ID NO: 5166230 - DNA, 14 bp, Homo sapiens
actttgtctgaaaa

SEQ ID NO: 5166231 - DNA, 15 bp, Homo sapiens
actttgtctgtacat

SEQ ID NO: 5166232 - DNA, 20 bp, Homo sapiens
actttgtctttctgcagaaa

SEQ ID NO: 5166233 - DNA, 14 bp, Homo sapiens
actttgtcttttca

SEQ ID NO: 5166234 - DNA, 22 bp, Homo sapiens
actttgtgctggggttatctga

SEQ ID NO: 5166235 - DNA, 23 bp, Homo sapiens
actttgtggagagaatgtgtgtg

SEQ ID NO: 5166236 - DNA, 17 bp, Homo sapiens
actttgtggatatattt

SEQ ID NO: 5166237 - DNA, 17 bp, Homo sapiens
actttgtggtaacttct

SEQ ID NO: 5166238 - DNA, 19 bp, Homo sapiens
actttgtggtaacttcttt

SEQ ID NO: 5166239 - DNA, 20 bp, Homo sapiens
actttgtggtctaaagtgtt

SEQ ID NO: 5166240 - DNA, 20 bp, Homo sapiens
actttgtgtattaaatggtt

SEQ ID NO: 5166241 - DNA, 21 bp, Homo sapiens
actttgtgtcttttgttctct

SEQ ID NO: 5166242 - DNA, 18 bp, Homo sapiens
actttgtgttcatttcat

SEQ ID NO: 5166243 - DNA, 19 bp, Homo sapiens
actttgtgttcatttcatt

SEQ ID NO: 5166244 - DNA, 11 bp, Homo sapiens
actttgtgttt

SEQ ID NO: 5166245 - DNA, 13 bp, Homo sapiens
actttgttaattt

SEQ ID NO: 5166246 - DNA, 18 bp, Homo sapiens
actttgttaggccaaaga

SEQ ID NO: 5166247 - DNA, 21 bp, Homo sapiens
actttgttagtttctccaagc

SEQ ID NO: 5166248 - DNA, 23 bp, Homo sapiens
actttgttattgcaaattgagga

SEQ ID NO: 5166249 - DNA, 14 bp, Homo sapiens
actttgttctggct

SEQ ID NO: 5166250 - DNA, 17 bp, Homo sapiens
actttgttctggctctt

SEQ ID NO: 5166251 - DNA, 19 bp, Homo sapiens
actttgttctggctcttcc

SEQ ID NO: 5166252 - DNA, 23 bp, Homo sapiens
actttgttctggctcttccaggc

SEQ ID NO: 5166253 - DNA, 13 bp, Homo sapiens
actttgttctgtt

SEQ ID NO: 5166254 - DNA, 20 bp, Homo sapiens
actttgttctgttgtctgcg

SEQ ID NO: 5166255 - DNA, 17 bp, Homo sapiens
actttgttgcaagatgt

SEQ ID NO: 5166256 - DNA, 16 bp, Homo sapiens
actttgttgtttttaa

SEQ ID NO: 5166257 - DNA, 15 bp, Homo sapiens
actttgtttagaaaa

SEQ ID NO: 5166258 - DNA, 14 bp, Homo sapiens
actttgttttattt

SEQ ID NO: 5166259 - DNA, 17 bp, Homo sapiens
actttgttttattttca

SEQ ID NO: 5166260 - DNA, 17 bp, Homo sapiens
acttttaaaaaaatttt

SEQ ID NO: 5166261 - DNA, 16 bp, Homo sapiens
acttttaaaactatat

SEQ ID NO: 5166262 - DNA, 23 bp, Homo sapiens
acttttaaaataaattctctcct

SEQ ID NO: 5166263 - DNA, 15 bp, Homo sapiens
acttttaaaatttgt

SEQ ID NO: 5166264 - DNA, 15 bp, Homo sapiens
acttttaaacaaaag

SEQ ID NO: 5166265 - DNA, 12 bp, Homo sapiens
acttttaaacag

SEQ ID NO: 5166266 - DNA, 15 bp, Homo sapiens
acttttaaagaaaaa

SEQ ID NO: 5166267 - DNA, 18 bp, Homo sapiens
acttttaaagaaaaatat

SEQ ID NO: 5166268 - DNA, 21 bp, Homo sapiens
acttttaaagaatttctttat

SEQ ID NO: 5166269 - DNA, 23 bp, Homo sapiens
acttttaaagctcatgcatttca

SEQ ID NO: 5166270 - DNA, 22 bp, Homo sapiens
acttttaaaggaatgtgaaatt

SEQ ID NO: 5166271 - DNA, 19 bp, Homo sapiens
acttttaaatggcagtatt

SEQ ID NO: 5166272 - DNA, 22 bp, Homo sapiens
acttttaaatggcagtatttca

SEQ ID NO: 5166273 - DNA, 20 bp, Homo sapiens
acttttaacgtatgtatttc

SEQ ID NO: 5166274 - DNA, 21 bp, Homo sapiens
acttttaacgtatgtatttca

SEQ ID NO: 5166275 - DNA, 18 bp, Homo sapiens
acttttaactatgtaata

SEQ ID NO: 5166276 - DNA, 14 bp, Homo sapiens
acttttaactattt

SEQ ID NO: 5166277 - DNA, 17 bp, Homo sapiens
acttttaacttcacctt

SEQ ID NO: 5166278 - DNA, 15 bp, Homo sapiens
acttttaagatttct

SEQ ID NO: 5166279 - DNA, 22 bp, Homo sapiens
acttttaagatttctctaatat

SEQ ID NO: 5166280 - DNA, 20 bp, Homo sapiens
acttttaaggataaatcata

SEQ ID NO: 5166281 - DNA, 13 bp, Homo sapiens
acttttaataaag

SEQ ID NO: 5166282 - DNA, 18 bp, Homo sapiens
acttttaataaagtatga

SEQ ID NO: 5166283 - DNA, 20 bp, Homo sapiens
acttttaataaagtatgaat

SEQ ID NO: 5166284 - DNA, 20 bp, Homo sapiens
acttttaatgccttccacat

SEQ ID NO: 5166285 - DNA, 17 bp, Homo sapiens
acttttaattactgttt

SEQ ID NO: 5166286 - DNA, 18 bp, Homo sapiens
acttttaattactgtttt

SEQ ID NO: 5166287 - DNA, 12 bp, Homo sapiens
acttttaattta

SEQ ID NO: 5166288 - DNA, 13 bp, Homo sapiens
acttttacaagta

SEQ ID NO: 5166289 - DNA, 14 bp, Homo sapiens
acttttacaagtaa

SEQ ID NO: 5166290 - DNA, 16 bp, Homo sapiens
acttttacagaatgca

SEQ ID NO: 5166291 - DNA, 19 bp, Homo sapiens
acttttacagaatgcatta

SEQ ID NO: 5166292 - DNA, 20 bp, Homo sapiens
acttttacagaatgcattaa

SEQ ID NO: 5166293 - DNA, 21 bp, Homo sapiens
acttttacagaatgcattaaa

SEQ ID NO: 5166294 - DNA, 14 bp, Homo sapiens
acttttacagatta

SEQ ID NO: 5166295 - DNA, 20 bp, Homo sapiens
acttttacatttttctgatg

SEQ ID NO: 5166296 - DNA, 16 bp, Homo sapiens
acttttaccactattt

SEQ ID NO: 5166297 - DNA, 21 bp, Homo sapiens
acttttactctgcctacagaa

SEQ ID NO: 5166298 - DNA, 22 bp, Homo sapiens
acttttagatgtggttaatttt

SEQ ID NO: 5166299 - DNA, 18 bp, Homo sapiens
acttttaggttgttacca

SEQ ID NO: 5166300 - DNA, 21 bp, Homo sapiens
acttttagtagagacagtgtt

SEQ ID NO: 5166301 - DNA, 22 bp, Homo sapiens
acttttagtagagacagtgttt

SEQ ID NO: 5166302 - DNA, 15 bp, Homo sapiens
acttttataaacttt

SEQ ID NO: 5166303 - DNA, 19 bp, Homo sapiens
acttttataaactttacct

SEQ ID NO: 5166304 - DNA, 16 bp, Homo sapiens
acttttataaagcatg

SEQ ID NO: 5166305 - DNA, 15 bp, Homo sapiens
acttttataaatgtt

SEQ ID NO: 5166306 - DNA, 16 bp, Homo sapiens
acttttataaatgttt

SEQ ID NO: 5166307 - DNA, 15 bp, Homo sapiens
acttttataaattaa

SEQ ID NO: 5166308 - DNA, 19 bp, Homo sapiens
acttttataataaaaggaa

SEQ ID NO: 5166309 - DNA, 20 bp, Homo sapiens
acttttatacctatctgagt

SEQ ID NO: 5166310 - DNA, 18 bp, Homo sapiens
acttttatatttgaaaaa

SEQ ID NO: 5166311 - DNA, 12 bp, Homo sapiens
acttttatgata

SEQ ID NO: 5166312 - DNA, 20 bp, Homo sapiens
acttttatgatgtatattta

SEQ ID NO: 5166313 - DNA, 20 bp, Homo sapiens
acttttatgcagcaaatata

SEQ ID NO: 5166314 - DNA, 17 bp, Homo sapiens
acttttatgcaggcaga

SEQ ID NO: 5166315 - DNA, 22 bp, Homo sapiens
acttttatggctctatcttttc

SEQ ID NO: 5166316 - DNA, 15 bp, Homo sapiens
acttttatgtgagat

SEQ ID NO: 5166317 - DNA, 16 bp, Homo sapiens
acttttatgtgagatt

SEQ ID NO: 5166318 - DNA, 17 bp, Homo sapiens
acttttatgtgagattt

SEQ ID NO: 5166319 - DNA, 18 bp, Homo sapiens
acttttatgtgagatttc

SEQ ID NO: 5166320 - DNA, 22 bp, Homo sapiens
acttttatgtgagatttcctta

SEQ ID NO: 5166321 - DNA, 23 bp, Homo sapiens
acttttattagccagtgaaacac

SEQ ID NO: 5166322 - DNA, 15 bp, Homo sapiens
acttttattgtataa

SEQ ID NO: 5166323 - DNA, 15 bp, Homo sapiens
acttttattgttata

SEQ ID NO: 5166324 - DNA, 14 bp, Homo sapiens
acttttatttcctg

SEQ ID NO: 5166325 - DNA, 22 bp, Homo sapiens
acttttatttcctgtatgttgt

SEQ ID NO: 5166326 - DNA, 20 bp, Homo sapiens
acttttattttacacagaaa

SEQ ID NO: 5166327 - DNA, 15 bp, Homo sapiens
acttttattttcttt

SEQ ID NO: 5166328 - DNA, 15 bp, Homo sapiens
acttttcaaaataaa

SEQ ID NO: 5166329 - DNA, 22 bp, Homo sapiens
acttttcaaggcttatattcaa

SEQ ID NO: 5166330 - DNA, 23 bp, Homo sapiens
acttttcaaggcttatattcaac

SEQ ID NO: 5166331 - DNA, 16 bp, Homo sapiens
acttttcaagtattta

SEQ ID NO: 5166332 - DNA, 21 bp, Homo sapiens
acttttcaatcccaattctgt

SEQ ID NO: 5166333 - DNA, 15 bp, Homo sapiens
acttttcacactgtc

SEQ ID NO: 5166334 - DNA, 20 bp, Homo sapiens
acttttcacactgtcttccc

SEQ ID NO: 5166335 - DNA, 23 bp, Homo sapiens
acttttcacactgtcttcccgat

SEQ ID NO: 5166336 - DNA, 21 bp, Homo sapiens
acttttcagaattgaaggaga

SEQ ID NO: 5166337 - DNA, 17 bp, Homo sapiens
acttttcatatcatttc

SEQ ID NO: 5166338 - DNA, 14 bp, Homo sapiens
acttttcattactt

SEQ ID NO: 5166339 - DNA, 23 bp, Homo sapiens
acttttccaacatacaatttact

SEQ ID NO: 5166340 - DNA, 11 bp, Homo sapiens
acttttccagt

SEQ ID NO: 5166341 - DNA, 14 bp, Homo sapiens
acttttcccactcc

SEQ ID NO: 5166342 - DNA, 17 bp, Homo sapiens
acttttccccaattcat

SEQ ID NO: 5166343 - DNA, 17 bp, Homo sapiens
acttttcccctgtcctg

SEQ ID NO: 5166344 - DNA, 17 bp, Homo sapiens
acttttcccctgttaaa

SEQ ID NO: 5166345 - DNA, 14 bp, Homo sapiens
acttttccctcact

SEQ ID NO: 5166346 - DNA, 20 bp, Homo sapiens
acttttccgtttcagcggaa

SEQ ID NO: 5166347 - DNA, 17 bp, Homo sapiens
acttttcctccctcagt

SEQ ID NO: 5166348 - DNA, 23 bp, Homo sapiens
acttttcctgggtttcctgcagg

SEQ ID NO: 5166349 - DNA, 14 bp, Homo sapiens
acttttccttgcat

SEQ ID NO: 5166350 - DNA, 21 bp, Homo sapiens
acttttccttgcatacaaaca

SEQ ID NO: 5166351 - DNA, 11 bp, Homo sapiens
acttttccttt

SEQ ID NO: 5166352 - DNA, 13 bp, Homo sapiens
acttttccttttc

SEQ ID NO: 5166353 - DNA, 12 bp, Homo sapiens
acttttctaaaa

SEQ ID NO: 5166354 - DNA, 15 bp, Homo sapiens
acttttctaaagtgc

SEQ ID NO: 5166355 - DNA, 19 bp, Homo sapiens
acttttctaagaaaagcat

SEQ ID NO: 5166356 - DNA, 18 bp, Homo sapiens
acttttctagaattattt

SEQ ID NO: 5166357 - DNA, 23 bp, Homo sapiens
acttttctagaattatttttcac

SEQ ID NO: 5166358 - DNA, 17 bp, Homo sapiens
acttttctattaaaagt

SEQ ID NO: 5166359 - DNA, 18 bp, Homo sapiens
acttttctcaatattaag

SEQ ID NO: 5166360 - DNA, 14 bp, Homo sapiens
acttttctccaggg

SEQ ID NO: 5166361 - DNA, 23 bp, Homo sapiens
acttttctcccctctctttctaa

SEQ ID NO: 5166362 - DNA, 22 bp, Homo sapiens
acttttctcctgcatgtgtata

SEQ ID NO: 5166363 - DNA, 16 bp, Homo sapiens
acttttctctacttta

SEQ ID NO: 5166364 - DNA, 17 bp, Homo sapiens
acttttctggttccaaa

SEQ ID NO: 5166365 - DNA, 17 bp, Homo sapiens
acttttctgtaattcag

SEQ ID NO: 5166366 - DNA, 20 bp, Homo sapiens
acttttctgtaattcaggtt

SEQ ID NO: 5166367 - DNA, 16 bp, Homo sapiens
acttttcttaaacctt

SEQ ID NO: 5166368 - DNA, 24 bp, Homo sapiens
acttttcttaaaccttcagttatg

SEQ ID NO: 5166369 - DNA, 12 bp, Homo sapiens
acttttcttccc

SEQ ID NO: 5166370 - DNA, 18 bp, Homo sapiens
acttttcttctattgcct

SEQ ID NO: 5166371 - DNA, 18 bp, Homo sapiens
acttttcttcttcctggt

SEQ ID NO: 5166372 - DNA, 16 bp, Homo sapiens
acttttcttgatatct

SEQ ID NO: 5166373 - DNA, 16 bp, Homo sapiens
acttttctttcagcca

SEQ ID NO: 5166374 - DNA, 14 bp, Homo sapiens
acttttctttgtgg

SEQ ID NO: 5166375 - DNA, 15 bp, Homo sapiens
acttttctttttaaa

SEQ ID NO: 5166376 - DNA, 15 bp, Homo sapiens
acttttgaaaaagga

SEQ ID NO: 5166377 - DNA, 23 bp, Homo sapiens
acttttgaaaaagtgtacatgaa

SEQ ID NO: 5166378 - DNA, 22 bp, Homo sapiens
acttttgaaaagaccaagactt

SEQ ID NO: 5166379 - DNA, 19 bp, Homo sapiens
acttttgaaagatgtatgg

SEQ ID NO: 5166380 - DNA, 16 bp, Homo sapiens
acttttgaaatttaaa

SEQ ID NO: 5166381 - DNA, 23 bp, Homo sapiens
acttttgaagaacaaaaggcttt

SEQ ID NO: 5166382 - DNA, 18 bp, Homo sapiens
acttttgaattacagaga

SEQ ID NO: 5166383 - DNA, 12 bp, Homo sapiens
acttttgacaaa

SEQ ID NO: 5166384 - DNA, 21 bp, Homo sapiens
acttttgagtatggctatcta

SEQ ID NO: 5166385 - DNA, 20 bp, Homo sapiens
acttttgagtgtgtgtgtgc

SEQ ID NO: 5166386 - DNA, 19 bp, Homo sapiens
acttttgatgaaataaaat

SEQ ID NO: 5166387 - DNA, 15 bp, Homo sapiens
acttttgcaatctta

SEQ ID NO: 5166388 - DNA, 23 bp, Homo sapiens
acttttgcaatcttaagcagaga

SEQ ID NO: 5166389 - DNA, 17 bp, Homo sapiens
acttttgcacatatatt

SEQ ID NO: 5166390 - DNA, 16 bp, Homo sapiens
acttttgcagcttcct

SEQ ID NO: 5166391 - DNA, 19 bp, Homo sapiens
acttttgcagcttccttcc

SEQ ID NO: 5166392 - DNA, 18 bp, Homo sapiens
acttttgcatttttcctt

SEQ ID NO: 5166393 - DNA, 13 bp, Homo sapiens
acttttgctttaa

SEQ ID NO: 5166394 - DNA, 18 bp, Homo sapiens
acttttggaaccatgcct

SEQ ID NO: 5166395 - DNA, 14 bp, Homo sapiens
acttttggaaggta

SEQ ID NO: 5166396 - DNA, 13 bp, Homo sapiens
acttttggaatca

SEQ ID NO: 5166397 - DNA, 21 bp, Homo sapiens
acttttggaatctagaagaaa

SEQ ID NO: 5166398 - DNA, 19 bp, Homo sapiens
acttttggcatgaaagtgc

SEQ ID NO: 5166399 - DNA, 16 bp, Homo sapiens
acttttgggatttgtt

SEQ ID NO: 5166400 - DNA, 13 bp, Homo sapiens
acttttgggcctt

SEQ ID NO: 5166401 - DNA, 20 bp, Homo sapiens
acttttggttaagtctgttt

SEQ ID NO: 5166402 - DNA, 15 bp, Homo sapiens
actggaggagctggg

SEQ ID NO: 5166403 - DNA, 12 bp, Homo sapiens
actggaggaggc

SEQ ID NO: 5166404 - DNA, 16 bp, Homo sapiens
actggaggaggcctgt

SEQ ID NO: 5166405 - DNA, 21 bp, Homo sapiens
actggaggaggcctgtcccaa

SEQ ID NO: 5166406 - DNA, 13 bp, Homo sapiens
actggaggccagg

SEQ ID NO: 5166407 - DNA, 15 bp, Homo sapiens
actggaggcccctgg

SEQ ID NO: 5166408 - DNA, 16 bp, Homo sapiens
actggaggcctctgca

SEQ ID NO: 5166409 - DNA, 18 bp, Homo sapiens
actggaggcctctgcaag

SEQ ID NO: 5166410 - DNA, 21 bp, Homo sapiens
actggaggggacgctggtaga

SEQ ID NO: 5166411 - DNA, 15 bp, Homo sapiens
actggaggggcccac

SEQ ID NO: 5166412 - DNA, 14 bp, Homo sapiens
actggaggtcacat

SEQ ID NO: 5166413 - DNA, 19 bp, Homo sapiens
actggaggtcacattcagg

SEQ ID NO: 5166414 - DNA, 17 bp, Homo sapiens
actggaggtcgaagcaa

SEQ ID NO: 5166415 - DNA, 18 bp, Homo sapiens
actggaggtcgaagcaat

SEQ ID NO: 5166416 - DNA, 22 bp, Homo sapiens
actggaggtcgaagcaatcagc

SEQ ID NO: 5166417 - DNA, 14 bp, Homo sapiens
actggaggtgggca

SEQ ID NO: 5166418 - DNA, 18 bp, Homo sapiens
actggaggttgaagccaa

SEQ ID NO: 5166419 - DNA, 22 bp, Homo sapiens
actggagtgaggcttccaggct

SEQ ID NO: 5166420 - DNA, 14 bp, Homo sapiens
actggagttacatt

SEQ ID NO: 5166421 - DNA, 15 bp, Homo sapiens
actggagttacatta

SEQ ID NO: 5166422 - DNA, 15 bp, Homo sapiens
actggagttccttat

SEQ ID NO: 5166423 - DNA, 14 bp, Homo sapiens
actggataaattgt

SEQ ID NO: 5166424 - DNA, 22 bp, Homo sapiens
actggataaattgtatgaagat

SEQ ID NO: 5166425 - DNA, 14 bp, Homo sapiens
actggatactgtac

SEQ ID NO: 5166426 - DNA, 12 bp, Homo sapiens
actggatatgtt

SEQ ID NO: 5166427 - DNA, 21 bp, Homo sapiens
actggatatttcaatctttta

SEQ ID NO: 5166428 - DNA, 22 bp, Homo sapiens
actggatccatccgtccagcca

SEQ ID NO: 5166429 - DNA, 19 bp, Homo sapiens
actggatcccatcaaagaa

SEQ ID NO: 5166430 - DNA, 14 bp, Homo sapiens
actggatcctgctg

SEQ ID NO: 5166431 - DNA, 15 bp, Homo sapiens
actggatcctgctgc

SEQ ID NO: 5166432 - DNA, 14 bp, Homo sapiens
actggatcttctat

SEQ ID NO: 5166433 - DNA, 14 bp, Homo sapiens
actggatgaagatt

SEQ ID NO: 5166434 - DNA, 17 bp, Homo sapiens
actggatgcagaaacag

SEQ ID NO: 5166435 - DNA, 10 bp, Homo sapiens
actggatgct

SEQ ID NO: 5166436 - DNA, 15 bp, Homo sapiens
actggatgctcgcca

SEQ ID NO: 5166437 - DNA, 14 bp, Homo sapiens
actggatgcttaca

SEQ ID NO: 5166438 - DNA, 21 bp, Homo sapiens
actggattaaaaaaatgtggt

SEQ ID NO: 5166439 - DNA, 14 bp, Homo sapiens
actggattcttatt

SEQ ID NO: 5166440 - DNA, 23 bp, Homo sapiens
actggattggccaaacatcagac

SEQ ID NO: 5166441 - DNA, 19 bp, Homo sapiens
actggcaaacagggcctct

SEQ ID NO: 5166442 - DNA, 20 bp, Homo sapiens
actggcaaacttcagactga

SEQ ID NO: 5166443 - DNA, 13 bp, Homo sapiens
actggcaaagcag

SEQ ID NO: 5166444 - DNA, 18 bp, Homo sapiens
actggcaacattccaaga

SEQ ID NO: 5166445 - DNA, 18 bp, Homo sapiens
actggcaagaggcctcat

SEQ ID NO: 5166446 - DNA, 12 bp, Homo sapiens
actggcaataaa

SEQ ID NO: 5166447 - DNA, 13 bp, Homo sapiens
actggcaatattt

SEQ ID NO: 5166448 - DNA, 19 bp, Homo sapiens
actggcaattgtctattta

SEQ ID NO: 5166449 - DNA, 22 bp, Homo sapiens
actggcacagttttctgagaaa

SEQ ID NO: 5166450 - DNA, 20 bp, Homo sapiens
actggcacgtttgtgagaag

SEQ ID NO: 5166451 - DNA, 21 bp, Homo sapiens
actggcactgtggcactgcca

SEQ ID NO: 5166452 - DNA, 23 bp, Homo sapiens
actggcactgtggcactgccacc

SEQ ID NO: 5166453 - DNA, 17 bp, Homo sapiens
actggcacttgcctgct

SEQ ID NO: 5166454 - DNA, 18 bp, Homo sapiens
actggcacttgcctgctg

SEQ ID NO: 5166455 - DNA, 20 bp, Homo sapiens
actggcacttgcctgctgct

SEQ ID NO: 5166456 - DNA, 23 bp, Homo sapiens
actggcagactcaaggggctgga

SEQ ID NO: 5166457 - DNA, 16 bp, Homo sapiens
actggcagagcacagc

SEQ ID NO: 5166458 - DNA, 17 bp, Homo sapiens
actggcagagcacagcc

SEQ ID NO: 5166459 - DNA, 20 bp, Homo sapiens
actggcagagcacagcccac

SEQ ID NO: 5166460 - DNA, 19 bp, Homo sapiens
actggcagatcgctcactg

SEQ ID NO: 5166461 - DNA, 14 bp, Homo sapiens
actggcagccaggg

SEQ ID NO: 5166462 - DNA, 17 bp, Homo sapiens
actggcagcctgcacct

SEQ ID NO: 5166463 - DNA, 22 bp, Homo sapiens
actggcaggagcctcgtgtcct

SEQ ID NO: 5166464 - DNA, 22 bp, Homo sapiens
actggcaggggagacaggagcc

SEQ ID NO: 5166465 - DNA, 22 bp, Homo sapiens
actggcaggtgcagatgggctg

SEQ ID NO: 5166466 - DNA, 12 bp, Homo sapiens
actggcagtgca

SEQ ID NO: 5166467 - DNA, 23 bp, Homo sapiens
actggcagtgcacctctcatcag

SEQ ID NO: 5166468 - DNA, 16 bp, Homo sapiens
actggcagttttccat

SEQ ID NO: 5166469 - DNA, 20 bp, Homo sapiens
actggcatctgacacaaaaa

SEQ ID NO: 5166470 - DNA, 21 bp, Homo sapiens
actggcatctgacacaaaaaa

SEQ ID NO: 5166471 - DNA, 20 bp, Homo sapiens
actggcatggattaatagag

SEQ ID NO: 5166472 - DNA, 22 bp, Homo sapiens
actggcatgtcatttgcacaca

SEQ ID NO: 5166473 - DNA, 17 bp, Homo sapiens
actggcattaattatta

SEQ ID NO: 5166474 - DNA, 18 bp, Homo sapiens
actggcattaattattaa

SEQ ID NO: 5166475 - DNA, 19 bp, Homo sapiens
actggccaagaaaattgcc

SEQ ID NO: 5166476 - DNA, 18 bp, Homo sapiens
actggccaagctgaggtg

SEQ ID NO: 5166477 - DNA, 17 bp, Homo sapiens
actggccaccaggctgg

SEQ ID NO: 5166478 - DNA, 21 bp, Homo sapiens
actggccaccaggctggcgca

SEQ ID NO: 5166479 - DNA, 16 bp, Homo sapiens
actggccagaggcagc

SEQ ID NO: 5166480 - DNA, 17 bp, Homo sapiens
actggccagaggcagct

SEQ ID NO: 5166481 - DNA, 19 bp, Homo sapiens
actggccagtcctagagct

SEQ ID NO: 5166482 - DNA, 20 bp, Homo sapiens
actggccagtcctagagctc

SEQ ID NO: 5166483 - DNA, 22 bp, Homo sapiens
actggccagtcctagagctcct

SEQ ID NO: 5166484 - DNA, 18 bp, Homo sapiens
actggccagttgcccaga

SEQ ID NO: 5166485 - DNA, 21 bp, Homo sapiens
actggccagttgcccagagca

SEQ ID NO: 5166486 - DNA, 21 bp, Homo sapiens
actggccatggcctgcaaact

SEQ ID NO: 5166487 - DNA, 14 bp, Homo sapiens
actggcccacccct

SEQ ID NO: 5166488 - DNA, 15 bp, Homo sapiens
actggcccacccctc

SEQ ID NO: 5166489 - DNA, 23 bp, Homo sapiens
actggcccacccctcttccccct

SEQ ID NO: 5166490 - DNA, 12 bp, Homo sapiens
actggcccagaa

SEQ ID NO: 5166491 - DNA, 16 bp, Homo sapiens
actggccccacaggag

SEQ ID NO: 5166492 - DNA, 17 bp, Homo sapiens
actggccccacaggagt

SEQ ID NO: 5166493 - DNA, 12 bp, Homo sapiens
actggccccacc

SEQ ID NO: 5166494 - DNA, 13 bp, Homo sapiens
actggccccaccc

SEQ ID NO: 5166495 - DNA, 15 bp, Homo sapiens
actggccccagctcc

SEQ ID NO: 5166496 - DNA, 16 bp, Homo sapiens
actggccccaggcgga

SEQ ID NO: 5166497 - DNA, 19 bp, Homo sapiens
actggccccggatcagagc

SEQ ID NO: 5166498 - DNA, 12 bp, Homo sapiens
actggcccctgg

SEQ ID NO: 5166499 - DNA, 14 bp, Homo sapiens
actggcccctgggt

SEQ ID NO: 5166500 - DNA, 17 bp, Homo sapiens
actggcccctgggtcag

SEQ ID NO: 5166501 - DNA, 15 bp, Homo sapiens
actggccctcgggcc

SEQ ID NO: 5166502 - DNA, 19 bp, Homo sapiens
actggccctcgggccctct

SEQ ID NO: 5166503 - DNA, 20 bp, Homo sapiens
actggccctcgggccctctc

SEQ ID NO: 5166504 - DNA, 14 bp, Homo sapiens
actggccctcttct

SEQ ID NO: 5166505 - DNA, 15 bp, Homo sapiens
actggccgtggctcc

SEQ ID NO: 5166506 - DNA, 17 bp, Homo sapiens
actggccgtggctccag

SEQ ID NO: 5166507 - DNA, 17 bp, Homo sapiens
actggcctaaatttctt

SEQ ID NO: 5166508 - DNA, 17 bp, Homo sapiens
actggcctcgcctggcc

SEQ ID NO: 5166509 - DNA, 18 bp, Homo sapiens
actggcctcgcctggcct

SEQ ID NO: 5166510 - DNA, 23 bp, Homo sapiens
actggcctcgcctggcctgaggt

SEQ ID NO: 5166511 - DNA, 18 bp, Homo sapiens
actggcctctccccagga

SEQ ID NO: 5166512 - DNA, 14 bp, Homo sapiens
actggcctctgctg

SEQ ID NO: 5166513 - DNA, 16 bp, Homo sapiens
actggcctctgctgat

SEQ ID NO: 5166514 - DNA, 16 bp, Homo sapiens
actggcctctgtgatt

SEQ ID NO: 5166515 - DNA, 17 bp, Homo sapiens
actggcctgccatgcca

SEQ ID NO: 5166516 - DNA, 13 bp, Homo sapiens
actggcctgcccg

SEQ ID NO: 5166517 - DNA, 19 bp, Homo sapiens
actggccttacgatggcaa

SEQ ID NO: 5166518 - DNA, 17 bp, Homo sapiens
actggccttgcctccag

SEQ ID NO: 5166519 - DNA, 18 bp, Homo sapiens
actggcctttttcattta

SEQ ID NO: 5166520 - DNA, 19 bp, Homo sapiens
actggcgaaccatctcaat

SEQ ID NO: 5166521 - DNA, 19 bp, Homo sapiens
actggcgatctcccagggc

SEQ ID NO: 5166522 - DNA, 15 bp, Homo sapiens
actggcgcagacttc

SEQ ID NO: 5166523 - DNA, 15 bp, Homo sapiens
actggcgcctccgag

SEQ ID NO: 5166524 - DNA, 15 bp, Homo sapiens
actggcggggggccc

SEQ ID NO: 5166525 - DNA, 20 bp, Homo sapiens
actggcgtggattaaactta

SEQ ID NO: 5166526 - DNA, 19 bp, Homo sapiens
actggcgttcacctccctg

SEQ ID NO: 5166527 - DNA, 14 bp, Homo sapiens
actggctacagtac

SEQ ID NO: 5166528 - DNA, 17 bp, Homo sapiens
actggctagctatatta

SEQ ID NO: 5166529 - DNA, 15 bp, Homo sapiens
actggctcacccagt

SEQ ID NO: 5166530 - DNA, 18 bp, Homo sapiens
actggctcacccagtcct

SEQ ID NO: 5166531 - DNA, 12 bp, Homo sapiens
actggctcatgc

SEQ ID NO: 5166532 - DNA, 13 bp, Homo sapiens
actggctcatgcc

SEQ ID NO: 5166533 - DNA, 21 bp, Homo sapiens
actggctccatgattctctga

SEQ ID NO: 5166534 - DNA, 17 bp, Homo sapiens
actggctcctcccagca

SEQ ID NO: 5166535 - DNA, 19 bp, Homo sapiens
actggctcctcccagcaca

SEQ ID NO: 5166536 - DNA, 18 bp, Homo sapiens
actggctcctttgcctct

SEQ ID NO: 5166537 - DNA, 20 bp, Homo sapiens
actggctcctttgcctctgc

SEQ ID NO: 5166538 - DNA, 21 bp, Homo sapiens
actggctctccaagtgccaga

SEQ ID NO: 5166539 - DNA, 22 bp, Homo sapiens
actggctctccaagtgccagag

SEQ ID NO: 5166540 - DNA, 15 bp, Homo sapiens
actggctctcctggc

SEQ ID NO: 5166541 - DNA, 15 bp, Homo sapiens
actggctctgggact

SEQ ID NO: 5166542 - DNA, 22 bp, Homo sapiens
actggctgcaaagggtatcagg

SEQ ID NO: 5166543 - DNA, 16 bp, Homo sapiens
actggctgcacagccc

SEQ ID NO: 5166544 - DNA, 17 bp, Homo sapiens
actggctgcacagccca

SEQ ID NO: 5166545 - DNA, 20 bp, Homo sapiens
actggctgccagctattttt

SEQ ID NO: 5166546 - DNA, 15 bp, Homo sapiens
actggctgctccctg

SEQ ID NO: 5166547 - DNA, 17 bp, Homo sapiens
actggctgctccctgct

SEQ ID NO: 5166548 - DNA, 18 bp, Homo sapiens
actggctgctccctgctc

SEQ ID NO: 5166549 - DNA, 19 bp, Homo sapiens
actggctgctccctgctcc

SEQ ID NO: 5166550 - DNA, 18 bp, Homo sapiens
actggctggactggaggc

SEQ ID NO: 5166551 - DNA, 14 bp, Homo sapiens
actggctggctcct

SEQ ID NO: 5166552 - DNA, 15 bp, Homo sapiens
actggctggctccta

SEQ ID NO: 5166553 - DNA, 17 bp, Homo sapiens
actggctggctcctagg

SEQ ID NO: 5166554 - DNA, 13 bp, Homo sapiens
actggctgggagt

SEQ ID NO: 5166555 - DNA, 21 bp, Homo sapiens
actggctgggcccctggggac

SEQ ID NO: 5166556 - DNA, 23 bp, Homo sapiens
actggctgggcccctggggacag

SEQ ID NO: 5166557 - DNA, 11 bp, Homo sapiens
actggctgggg

SEQ ID NO: 5166558 - DNA, 16 bp, Homo sapiens
actggctggggcagag

SEQ ID NO: 5166559 - DNA, 12 bp, Homo sapiens
actggctggtga

SEQ ID NO: 5166560 - DNA, 17 bp, Homo sapiens
actggctgtcagtatga

SEQ ID NO: 5166561 - DNA, 21 bp, Homo sapiens
actggctgtcagtatgacatt

SEQ ID NO: 5166562 - DNA, 16 bp, Homo sapiens
actggctgtcctttcc

SEQ ID NO: 5166563 - DNA, 14 bp, Homo sapiens
actggctgtctgcc

SEQ ID NO: 5166564 - DNA, 21 bp, Homo sapiens
actggctgtgcccctgatgca

SEQ ID NO: 5166565 - DNA, 19 bp, Homo sapiens
actggctgtgcctcccccg

SEQ ID NO: 5166566 - DNA, 13 bp, Homo sapiens
actggctgtgggc

SEQ ID NO: 5166567 - DNA, 20 bp, Homo sapiens
actggctgtgggctcccttc

SEQ ID NO: 5166568 - DNA, 14 bp, Homo sapiens
actggcttcatttt

SEQ ID NO: 5166569 - DNA, 12 bp, Homo sapiens
actggcttccat

SEQ ID NO: 5166570 - DNA, 16 bp, Homo sapiens
actggcttccccactc

SEQ ID NO: 5166571 - DNA, 19 bp, Homo sapiens
actggcttctgcttgtcat

SEQ ID NO: 5166572 - DNA, 23 bp, Homo sapiens
actggcttgaattggtgacattt

SEQ ID NO: 5166573 - DNA, 15 bp, Homo sapiens
actggctttggcttc

SEQ ID NO: 5166574 - DNA, 22 bp, Homo sapiens
actggctttgtcccacagcttg

SEQ ID NO: 5166575 - DNA, 17 bp, Homo sapiens
actggcttttgcctgta

SEQ ID NO: 5166576 - DNA, 18 bp, Homo sapiens
actggcttttgcctgtaa

SEQ ID NO: 5166577 - DNA, 15 bp, Homo sapiens
actggctttttccca

SEQ ID NO: 5166578 - DNA, 18 bp, Homo sapiens
actggctttttcccagcc

SEQ ID NO: 5166579 - DNA, 23 bp, Homo sapiens
actgggaaagttaggattcagat

SEQ ID NO: 5166580 - DNA, 14 bp, Homo sapiens
actgggaaatgaga

SEQ ID NO: 5166581 - DNA, 22 bp, Homo sapiens
acttttggttaagtctgtttta

SEQ ID NO: 5166582 - DNA, 19 bp, Homo sapiens
acttttgtaaaatcaaatc

SEQ ID NO: 5166583 - DNA, 17 bp, Homo sapiens
acttttgtaaagaaatt

SEQ ID NO: 5166584 - DNA, 18 bp, Homo sapiens
acttttgtaatttgaatt

SEQ ID NO: 5166585 - DNA, 19 bp, Homo sapiens
acttttgtaatttgaattg

SEQ ID NO: 5166586 - DNA, 20 bp, Homo sapiens
acttttgtaatttgaattgg

SEQ ID NO: 5166587 - DNA, 12 bp, Homo sapiens
acttttgtgaaa

SEQ ID NO: 5166588 - DNA, 21 bp, Homo sapiens
acttttgtgaaagctgctctg

SEQ ID NO: 5166589 - DNA, 20 bp, Homo sapiens
acttttgtgacccactaatt

SEQ ID NO: 5166590 - DNA, 18 bp, Homo sapiens
acttttgtgtaatgaaaa

SEQ ID NO: 5166591 - DNA, 19 bp, Homo sapiens
acttttgtgtaatgaaaat

SEQ ID NO: 5166592 - DNA, 16 bp, Homo sapiens
acttttgtgtattctg

SEQ ID NO: 5166593 - DNA, 17 bp, Homo sapiens
acttttgtgtattctgt

SEQ ID NO: 5166594 - DNA, 15 bp, Homo sapiens
acttttgttaacagt

SEQ ID NO: 5166595 - DNA, 20 bp, Homo sapiens
acttttgttagggctgcttt

SEQ ID NO: 5166596 - DNA, 19 bp, Homo sapiens
acttttgttattccatcaa

SEQ ID NO: 5166597 - DNA, 14 bp, Homo sapiens
acttttgttctact

SEQ ID NO: 5166598 - DNA, 18 bp, Homo sapiens
acttttgttctgtatttt

SEQ ID NO: 5166599 - DNA, 12 bp, Homo sapiens
acttttgttctt

SEQ ID NO: 5166600 - DNA, 13 bp, Homo sapiens
acttttgttcttg

SEQ ID NO: 5166601 - DNA, 15 bp, Homo sapiens
acttttgttcttggt

SEQ ID NO: 5166602 - DNA, 13 bp, Homo sapiens
acttttgtttaaa

SEQ ID NO: 5166603 - DNA, 14 bp, Homo sapiens
actttttaaaaaac

SEQ ID NO: 5166604 - DNA, 14 bp, Homo sapiens
actttttaaaatat

SEQ ID NO: 5166605 - DNA, 18 bp, Homo sapiens
actttttaaaatgttggt

SEQ ID NO: 5166606 - DNA, 16 bp, Homo sapiens
actttttaaacagtgt

SEQ ID NO: 5166607 - DNA, 17 bp, Homo sapiens
actttttaaacagtgtt

SEQ ID NO: 5166608 - DNA, 14 bp, Homo sapiens
actttttaaactca

SEQ ID NO: 5166609 - DNA, 14 bp, Homo sapiens
actttttaaattac

SEQ ID NO: 5166610 - DNA, 17 bp, Homo sapiens
actttttaacattctca

SEQ ID NO: 5166611 - DNA, 18 bp, Homo sapiens
actttttaactggcttca

SEQ ID NO: 5166612 - DNA, 16 bp, Homo sapiens
actttttaagtttgaa

SEQ ID NO: 5166613 - DNA, 21 bp, Homo sapiens
actttttaatgttatttggaa

SEQ ID NO: 5166614 - DNA, 14 bp, Homo sapiens
actttttacagcag

SEQ ID NO: 5166615 - DNA, 20 bp, Homo sapiens
actttttacagcagcaatat

SEQ ID NO: 5166616 - DNA, 11 bp, Homo sapiens
actttttacat

SEQ ID NO: 5166617 - DNA, 18 bp, Homo sapiens
actttttacccaaatatg

SEQ ID NO: 5166618 - DNA, 17 bp, Homo sapiens
actttttagtaatttct

SEQ ID NO: 5166619 - DNA, 12 bp, Homo sapiens
actttttataaa

SEQ ID NO: 5166620 - DNA, 14 bp, Homo sapiens
actttttataatgt

SEQ ID NO: 5166621 - DNA, 12 bp, Homo sapiens
actttttatatt

SEQ ID NO: 5166622 - DNA, 17 bp, Homo sapiens
actttttatattttata

SEQ ID NO: 5166623 - DNA, 22 bp, Homo sapiens
actttttatggcactagtattt

SEQ ID NO: 5166624 - DNA, 22 bp, Homo sapiens
actttttatgggtgaaaataag

SEQ ID NO: 5166625 - DNA, 23 bp, Homo sapiens
actttttatgggttttgcttaaa

SEQ ID NO: 5166626 - DNA, 13 bp, Homo sapiens
actttttattcaa

SEQ ID NO: 5166627 - DNA, 22 bp, Homo sapiens
actttttattcaattctgtata

SEQ ID NO: 5166628 - DNA, 14 bp, Homo sapiens
actttttatttaat

SEQ ID NO: 5166629 - DNA, 21 bp, Homo sapiens
actttttatttctaaatgaga

SEQ ID NO: 5166630 - DNA, 14 bp, Homo sapiens
actttttatttgag

SEQ ID NO: 5166631 - DNA, 22 bp, Homo sapiens
actttttattttattttattaa

SEQ ID NO: 5166632 - DNA, 16 bp, Homo sapiens
actttttcaagattga

SEQ ID NO: 5166633 - DNA, 12 bp, Homo sapiens
actttttcaatg

SEQ ID NO: 5166634 - DNA, 21 bp, Homo sapiens
actttttcatagtaagtgcga

SEQ ID NO: 5166635 - DNA, 16 bp, Homo sapiens
actttttccagaattt

SEQ ID NO: 5166636 - DNA, 22 bp, Homo sapiens
actttttccatttcttcagagg

SEQ ID NO: 5166637 - DNA, 19 bp, Homo sapiens
actttttccattttttaaa

SEQ ID NO: 5166638 - DNA, 15 bp, Homo sapiens
actttttcccctgca

SEQ ID NO: 5166639 - DNA, 20 bp, Homo sapiens
actttttcccctgcaatgcg

SEQ ID NO: 5166640 - DNA, 12 bp, Homo sapiens
actttttccttc

SEQ ID NO: 5166641 - DNA, 20 bp, Homo sapiens
actttttccttcctgccctg

SEQ ID NO: 5166642 - DNA, 18 bp, Homo sapiens
actttttctaagctgttt

SEQ ID NO: 5166643 - DNA, 11 bp, Homo sapiens
actttttctga

SEQ ID NO: 5166644 - DNA, 17 bp, Homo sapiens
actttttctgagctttt

SEQ ID NO: 5166645 - DNA, 12 bp, Homo sapiens
actttttctgat

SEQ ID NO: 5166646 - DNA, 15 bp, Homo sapiens
actttttctttatgt

SEQ ID NO: 5166647 - DNA, 18 bp, Homo sapiens
actttttctttgattttc

SEQ ID NO: 5166648 - DNA, 17 bp, Homo sapiens
actttttcttttgtaag

SEQ ID NO: 5166649 - DNA, 18 bp, Homo sapiens
actttttcttttgtaagt

SEQ ID NO: 5166650 - DNA, 19 bp, Homo sapiens
actttttgaggcaaaagaa

SEQ ID NO: 5166651 - DNA, 22 bp, Homo sapiens
actttttgatggaattaaatgt

SEQ ID NO: 5166652 - DNA, 23 bp, Homo sapiens
actttttgatggaattaaatgtg

SEQ ID NO: 5166653 - DNA, 13 bp, Homo sapiens
actttttgcagct

SEQ ID NO: 5166654 - DNA, 17 bp, Homo sapiens
actttttggaattcagc

SEQ ID NO: 5166655 - DNA, 21 bp, Homo sapiens
actttttggaattcagcagtt

SEQ ID NO: 5166656 - DNA, 13 bp, Homo sapiens
actttttggctga

SEQ ID NO: 5166657 - DNA, 15 bp, Homo sapiens
actttttggctggag

SEQ ID NO: 5166658 - DNA, 14 bp, Homo sapiens
actttttggtttga

SEQ ID NO: 5166659 - DNA, 16 bp, Homo sapiens
actttttgtatttagt

SEQ ID NO: 5166660 - DNA, 17 bp, Homo sapiens
actttttgtatttagta

SEQ ID NO: 5166661 - DNA, 18 bp, Homo sapiens
actttttgttccagagct

SEQ ID NO: 5166662 - DNA, 13 bp, Homo sapiens
actttttgtttct

SEQ ID NO: 5166663 - DNA, 21 bp, Homo sapiens
actttttgttttgttcttggt

SEQ ID NO: 5166664 - DNA, 23 bp, Homo sapiens
actttttgtttttatttctttta

SEQ ID NO: 5166665 - DNA, 13 bp, Homo sapiens
acttttttaaata

SEQ ID NO: 5166666 - DNA, 15 bp, Homo sapiens
acttttttaaataaa

SEQ ID NO: 5166667 - DNA, 15 bp, Homo sapiens
acttttttaaatata

SEQ ID NO: 5166668 - DNA, 16 bp, Homo sapiens
acttttttaaatataa

SEQ ID NO: 5166669 - DNA, 18 bp, Homo sapiens
acttttttaaatattttc

SEQ ID NO: 5166670 - DNA, 13 bp, Homo sapiens
acttttttacaac

SEQ ID NO: 5166671 - DNA, 15 bp, Homo sapiens
acttttttacactga

SEQ ID NO: 5166672 - DNA, 21 bp, Homo sapiens
acttttttatccacctcccta

SEQ ID NO: 5166673 - DNA, 13 bp, Homo sapiens
acttttttatgaa

SEQ ID NO: 5166674 - DNA, 16 bp, Homo sapiens
acttttttatgaagaa

SEQ ID NO: 5166675 - DNA, 14 bp, Homo sapiens
acttttttatgtct

SEQ ID NO: 5166676 - DNA, 13 bp, Homo sapiens
acttttttcaaaa

SEQ ID NO: 5166677 - DNA, 14 bp, Homo sapiens
acttttttcaaata

SEQ ID NO: 5166678 - DNA, 15 bp, Homo sapiens
acttttttcaaatat

SEQ ID NO: 5166679 - DNA, 20 bp, Homo sapiens
acttttttcaaatattgaat

SEQ ID NO: 5166680 - DNA, 18 bp, Homo sapiens
acttttttccaaagtgta

SEQ ID NO: 5166681 - DNA, 13 bp, Homo sapiens
acttttttccaca

SEQ ID NO: 5166682 - DNA, 21 bp, Homo sapiens
acttttttcctgtcaatatat

SEQ ID NO: 5166683 - DNA, 21 bp, Homo sapiens
acttttttctagtacactttt

SEQ ID NO: 5166684 - DNA, 14 bp, Homo sapiens
acttttttctgcct

SEQ ID NO: 5166685 - DNA, 14 bp, Homo sapiens
acttttttcttaag

SEQ ID NO: 5166686 - DNA, 18 bp, Homo sapiens
acttttttcttaaggcat

SEQ ID NO: 5166687 - DNA, 20 bp, Homo sapiens
acttttttgagtcattgact

SEQ ID NO: 5166688 - DNA, 21 bp, Homo sapiens
acttttttggggatatgctta

SEQ ID NO: 5166689 - DNA, 15 bp, Homo sapiens
acttttttgtgtatg

SEQ ID NO: 5166690 - DNA, 19 bp, Homo sapiens
acttttttgtttgaatgtt

SEQ ID NO: 5166691 - DNA, 15 bp, Homo sapiens
actttttttaaccat

SEQ ID NO: 5166692 - DNA, 15 bp, Homo sapiens
actttttttcagttc

SEQ ID NO: 5166693 - DNA, 22 bp, Homo sapiens
actttttttctgtgacatttat

SEQ ID NO: 5166694 - DNA, 18 bp, Homo sapiens
actttttttcttctactt

SEQ ID NO: 5166695 - DNA, 19 bp, Homo sapiens
actttttttggtataatgt

SEQ ID NO: 5166696 - DNA, 18 bp, Homo sapiens
actttttttgtagatgaa

SEQ ID NO: 5166697 - DNA, 19 bp, Homo sapiens
actttttttgtagatgaac

SEQ ID NO: 5166698 - DNA, 13 bp, Homo sapiens
actttttttgtat

SEQ ID NO: 5166699 - DNA, 15 bp, Homo sapiens
actttttttgttata

SEQ ID NO: 5166700 - DNA, 17 bp, Homo sapiens
acttttttttctctctt

SEQ ID NO: 5166701 - DNA, 18 bp, Homo sapiens
acttttttttctctcttt

SEQ ID NO: 5166702 - DNA, 19 bp, Homo sapiens
acttttttttctctctttt

SEQ ID NO: 5166703 - DNA, 19 bp, Homo sapiens
acttttttttttttaacat

SEQ ID NO: 5166704 - DNA, 22 bp, Homo sapiens
acttttttttttttaacatctt

SEQ ID NO: 5166705 - DNA, 17 bp, Homo sapiens
actttttttttttttcc

SEQ ID NO: 5166706 - DNA, 21 bp, Homo sapiens
acttttttttttttttttaaa

SEQ ID NO: 5166707 - DNA, 16 bp, Homo sapiens
agaaaaaaaaaaagaa

SEQ ID NO: 5166708 - DNA, 16 bp, Homo sapiens
agaaaaaaaaaagaaa

SEQ ID NO: 5166709 - DNA, 22 bp, Homo sapiens
agaaaaaaaaaagaaatgcaaa

SEQ ID NO: 5166710 - DNA, 13 bp, Homo sapiens
agaaaaaaaaaca

SEQ ID NO: 5166711 - DNA, 13 bp, Homo sapiens
agaaaaaaaaaga

SEQ ID NO: 5166712 - DNA, 19 bp, Homo sapiens
agaaaaaaaaagaaaaaag

SEQ ID NO: 5166713 - DNA, 15 bp, Homo sapiens
agaaaaaaaaagcaa

SEQ ID NO: 5166714 - DNA, 13 bp, Homo sapiens
agaaaaaaaaatg

SEQ ID NO: 5166715 - DNA, 15 bp, Homo sapiens
agaaaaaaaaatgcc

SEQ ID NO: 5166716 - DNA, 21 bp, Homo sapiens
agaaaaaaaaatgccataata

SEQ ID NO: 5166717 - DNA, 12 bp, Homo sapiens
agaaaaaaaacc

SEQ ID NO: 5166718 - DNA, 23 bp, Homo sapiens
agaaaaaaaagtgtctcaaagga

SEQ ID NO: 5166719 - DNA, 20 bp, Homo sapiens
agaaaaaaaataacacagag

SEQ ID NO: 5166720 - DNA, 12 bp, Homo sapiens
agaaaaaaacag

SEQ ID NO: 5166721 - DNA, 13 bp, Homo sapiens
agaaaaaaacagc

SEQ ID NO: 5166722 - DNA, 22 bp, Homo sapiens
agaaaaaaacatgaatttagaa

SEQ ID NO: 5166723 - DNA, 18 bp, Homo sapiens
agaaaaaaacgaaaacag

SEQ ID NO: 5166724 - DNA, 13 bp, Homo sapiens
agaaaaaaagaaa

SEQ ID NO: 5166725 - DNA, 19 bp, Homo sapiens
agaaaaaaagaggtttaag

SEQ ID NO: 5166726 - DNA, 14 bp, Homo sapiens
agaaaaaaagcaaa

SEQ ID NO: 5166727 - DNA, 15 bp, Homo sapiens
agaaaaaaagcaaaa

SEQ ID NO: 5166728 - DNA, 14 bp, Homo sapiens
agaaaaaaataact

SEQ ID NO: 5166729 - DNA, 18 bp, Homo sapiens
agaaaaaaatagttttac

SEQ ID NO: 5166730 - DNA, 20 bp, Homo sapiens
agaaaaaaatagttttacat

SEQ ID NO: 5166731 - DNA, 21 bp, Homo sapiens
agaaaaaaatagttttacatt

SEQ ID NO: 5166732 - DNA, 14 bp, Homo sapiens
agaaaaaaatatat

SEQ ID NO: 5166733 - DNA, 20 bp, Homo sapiens
agaaaaaaatatattttatg

SEQ ID NO: 5166734 - DNA, 12 bp, Homo sapiens
agaaaaaaatcc

SEQ ID NO: 5166735 - DNA, 14 bp, Homo sapiens
agaaaaaaatgtat

SEQ ID NO: 5166736 - DNA, 18 bp, Homo sapiens
agaaaaaaatgtatttta

SEQ ID NO: 5166737 - DNA, 18 bp, Homo sapiens
agaaaaaaattgaaatgt

SEQ ID NO: 5166738 - DNA, 16 bp, Homo sapiens
agaaaaaaattgctct

SEQ ID NO: 5166739 - DNA, 14 bp, Homo sapiens
agaaaaaacaacta

SEQ ID NO: 5166740 - DNA, 20 bp, Homo sapiens
agaaaaaacttgctggtcct

SEQ ID NO: 5166741 - DNA, 16 bp, Homo sapiens
agaaaaaagtacagaa

SEQ ID NO: 5166742 - DNA, 20 bp, Homo sapiens
agaaaaaagtagcaaatgtt

SEQ ID NO: 5166743 - DNA, 18 bp, Homo sapiens
agaaaaaagtccttcagt

SEQ ID NO: 5166744 - DNA, 13 bp, Homo sapiens
agaaaaaataata

SEQ ID NO: 5166745 - DNA, 11 bp, Homo sapiens
agaaaaaatac

SEQ ID NO: 5166746 - DNA, 16 bp, Homo sapiens
agaaaaaatacatttt

SEQ ID NO: 5166747 - DNA, 16 bp, Homo sapiens
agaaaaaatggcaaga

SEQ ID NO: 5166748 - DNA, 12 bp, Homo sapiens
agaaaaaattaa

SEQ ID NO: 5166749 - DNA, 13 bp, Homo sapiens
agaaaaacaaagt

SEQ ID NO: 5166750 - DNA, 19 bp, Homo sapiens
agaaaaacaagttttagaa

SEQ ID NO: 5166751 - DNA, 13 bp, Homo sapiens
agaaaaacaataa

SEQ ID NO: 5166752 - DNA, 16 bp, Homo sapiens
agaaaaacaatcttat

SEQ ID NO: 5166753 - DNA, 19 bp, Homo sapiens
agaaaaacaatggtaacat

SEQ ID NO: 5166754 - DNA, 13 bp, Homo sapiens
agaaaaacagaca

SEQ ID NO: 5166755 - DNA, 11 bp, Homo sapiens
agaaaaacatg

SEQ ID NO: 5166756 - DNA, 16 bp, Homo sapiens
agaaaaacatttcctc

SEQ ID NO: 5166757 - DNA, 23 bp, Homo sapiens
agaaaaaccaaaatactccaaag

SEQ ID NO: 5166758 - DNA, 19 bp, Homo sapiens
agaaaaaccaatgattcat

SEQ ID NO: 5166759 - DNA, 23 bp, Homo sapiens
agaaaaaccaatgattcataaca

SEQ ID NO: 5166760 - DNA, 19 bp, Homo sapiens
agaaaaaccccgtttccct

SEQ ID NO: 5166761 - DNA, 13 bp, Homo sapiens
agaaaaactaact

SEQ ID NO: 5166762 - DNA, 16 bp, Homo sapiens
agaaaaactggctctg

SEQ ID NO: 5166763 - DNA, 13 bp, Homo sapiens
agaaaaagaaaaa

SEQ ID NO: 5166764 - DNA, 18 bp, Homo sapiens
agaaaaagaacatgcagt

SEQ ID NO: 5166765 - DNA, 16 bp, Homo sapiens
agaaaaagaagaagga

SEQ ID NO: 5166766 - DNA, 14 bp, Homo sapiens
agaaaaagaagcaa

SEQ ID NO: 5166767 - DNA, 12 bp, Homo sapiens
agaaaaagagag

SEQ ID NO: 5166768 - DNA, 14 bp, Homo sapiens
agaaaaagagagag

SEQ ID NO: 5166769 - DNA, 15 bp, Homo sapiens
agaaaaagagagagc

SEQ ID NO: 5166770 - DNA, 13 bp, Homo sapiens
agaaaaagcatta

SEQ ID NO: 5166771 - DNA, 17 bp, Homo sapiens
agaaaaagcattaaaaa

SEQ ID NO: 5166772 - DNA, 20 bp, Homo sapiens
agaaaaagctcctgtcctcc

SEQ ID NO: 5166773 - DNA, 11 bp, Homo sapiens
agaaaaaggaa

SEQ ID NO: 5166774 - DNA, 12 bp, Homo sapiens
agaaaaaggaaa

SEQ ID NO: 5166775 - DNA, 13 bp, Homo sapiens
agaaaaaggaaaa

SEQ ID NO: 5166776 - DNA, 15 bp, Homo sapiens
agaaaaaggaaattg

SEQ ID NO: 5166777 - DNA, 14 bp, Homo sapiens
agaaaaaggagctt

SEQ ID NO: 5166778 - DNA, 16 bp, Homo sapiens
agaaaaaggatgtttt

SEQ ID NO: 5166779 - DNA, 14 bp, Homo sapiens
agaaaaaggcagtg

SEQ ID NO: 5166780 - DNA, 16 bp, Homo sapiens
agaaaaagggctgccg

SEQ ID NO: 5166781 - DNA, 14 bp, Homo sapiens
agaaaaaggggcct

SEQ ID NO: 5166782 - DNA, 18 bp, Homo sapiens
agaaaaaggtccatgctt

SEQ ID NO: 5166783 - DNA, 16 bp, Homo sapiens
agaaaaagtacaatga

SEQ ID NO: 5166784 - DNA, 18 bp, Homo sapiens
agaaaaagtcctgtcagt

SEQ ID NO: 5166785 - DNA, 13 bp, Homo sapiens
agaaaaataaaat

SEQ ID NO: 5166786 - DNA, 14 bp, Homo sapiens
agaaaaataaagaa

SEQ ID NO: 5166787 - DNA, 22 bp, Homo sapiens
agaaaaataaatgtcactgcca

SEQ ID NO: 5166788 - DNA, 21 bp, Homo sapiens
agaaaaatagagcaaaatcaa

SEQ ID NO: 5166789 - DNA, 11 bp, Homo sapiens
agaaaaatagg

SEQ ID NO: 5166790 - DNA, 20 bp, Homo sapiens
agaaaaataggtgcaataat

SEQ ID NO: 5166791 - DNA, 12 bp, Homo sapiens
agaaaaatatga

SEQ ID NO: 5166792 - DNA, 19 bp, Homo sapiens
agaaaaatatgaccacact

SEQ ID NO: 5166793 - DNA, 18 bp, Homo sapiens
agaaaaatatgagagaac

SEQ ID NO: 5166794 - DNA, 16 bp, Homo sapiens
agaaaaatatgtacca

SEQ ID NO: 5166795 - DNA, 22 bp, Homo sapiens
agaaaaatcagtttttgttctt

SEQ ID NO: 5166796 - DNA, 12 bp, Homo sapiens
agaaaaatcttg

SEQ ID NO: 5166797 - DNA, 16 bp, Homo sapiens
agaaaaatggcctgca

SEQ ID NO: 5166798 - DNA, 16 bp, Homo sapiens
agaaaaatgtgaattt

SEQ ID NO: 5166799 - DNA, 19 bp, Homo sapiens
agaaaaattagatgactga

SEQ ID NO: 5166800 - DNA, 14 bp, Homo sapiens
agaaaaattgtttc

SEQ ID NO: 5166801 - DNA, 16 bp, Homo sapiens
agaaaaattgtttcca

SEQ ID NO: 5166802 - DNA, 17 bp, Homo sapiens
agaaaaattgtttccaa

SEQ ID NO: 5166803 - DNA, 12 bp, Homo sapiens
agaaaacaaaaa

SEQ ID NO: 5166804 - DNA, 21 bp, Homo sapiens
agaaaacaaaactgcatttca

SEQ ID NO: 5166805 - DNA, 13 bp, Homo sapiens
agaaaacaaaatt

SEQ ID NO: 5166806 - DNA, 22 bp, Homo sapiens
agaaaacaaactaaatgtagtt

SEQ ID NO: 5166807 - DNA, 23 bp, Homo sapiens
agaaaacaaaggagcattaagcc

SEQ ID NO: 5166808 - DNA, 15 bp, Homo sapiens
agaaaacaaagttct

SEQ ID NO: 5166809 - DNA, 22 bp, Homo sapiens
agaaaacaaagttctattttat

SEQ ID NO: 5166810 - DNA, 19 bp, Homo sapiens
agaaaacaaggatgaatta

SEQ ID NO: 5166811 - DNA, 15 bp, Homo sapiens
agaaaacaagtatat

SEQ ID NO: 5166812 - DNA, 17 bp, Homo sapiens
agaaaacaagtatataa

SEQ ID NO: 5166813 - DNA, 17 bp, Homo sapiens
agaaaacacacaaaaga

SEQ ID NO: 5166814 - DNA, 18 bp, Homo sapiens
agaaaacacccaatacct

SEQ ID NO: 5166815 - DNA, 13 bp, Homo sapiens
agaaaacaccctt

SEQ ID NO: 5166816 - DNA, 18 bp, Homo sapiens
agaaaacactgttatcat

SEQ ID NO: 5166817 - DNA, 17 bp, Homo sapiens
agaaaacacttgtaagt

SEQ ID NO: 5166818 - DNA, 15 bp, Homo sapiens
agaaaacagaaaaaa

SEQ ID NO: 5166819 - DNA, 19 bp, Homo sapiens
agaaaacagaccagcatag

SEQ ID NO: 5166820 - DNA, 14 bp, Homo sapiens
agaaaacagagcct

SEQ ID NO: 5166821 - DNA, 15 bp, Homo sapiens
agaaaacagccactg

SEQ ID NO: 5166822 - DNA, 20 bp, Homo sapiens
agaaaacaggaaaaaaactt

SEQ ID NO: 5166823 - DNA, 23 bp, Homo sapiens
agaaaacataatcttctgccttc

SEQ ID NO: 5166824 - DNA, 20 bp, Homo sapiens
agaaaacatgtataaatata

SEQ ID NO: 5166825 - DNA, 17 bp, Homo sapiens
agaaaacatgtctgtga

SEQ ID NO: 5166826 - DNA, 13 bp, Homo sapiens
agaaaacatgttt

SEQ ID NO: 5166827 - DNA, 13 bp, Homo sapiens
agaaaacatttaa

SEQ ID NO: 5166828 - DNA, 23 bp, Homo sapiens
agaaaacattttttttttaaatc

SEQ ID NO: 5166829 - DNA, 22 bp, Homo sapiens
agaaaaccaaacaaaaatgtta

SEQ ID NO: 5166830 - DNA, 15 bp, Homo sapiens
agaaaaccacagtta

SEQ ID NO: 5166831 - DNA, 13 bp, Homo sapiens
agaaaaccacccc

SEQ ID NO: 5166832 - DNA, 23 bp, Homo sapiens
agaaaaccactttattgcaatgc

SEQ ID NO: 5166833 - DNA, 17 bp, Homo sapiens
agaaaacccaaagctct

SEQ ID NO: 5166834 - DNA, 14 bp, Homo sapiens
agaaaacccacccc

SEQ ID NO: 5166835 - DNA, 21 bp, Homo sapiens
agaaaacccacggtttttctt

SEQ ID NO: 5166836 - DNA, 20 bp, Homo sapiens
agaaaaccctaagtgtggat

SEQ ID NO: 5166837 - DNA, 20 bp, Homo sapiens
agaaaacccttgggccagaa

SEQ ID NO: 5166838 - DNA, 16 bp, Homo sapiens
agaaaacccttttcta

SEQ ID NO: 5166839 - DNA, 17 bp, Homo sapiens
agaaaaccgagaatatt

SEQ ID NO: 5166840 - DNA, 15 bp, Homo sapiens
agaaaacctcaaggg

SEQ ID NO: 5166841 - DNA, 19 bp, Homo sapiens
agaaaacctgtttttaaca

SEQ ID NO: 5166842 - DNA, 23 bp, Homo sapiens
agaaaaccttaaaagtaataaag

SEQ ID NO: 5166843 - DNA, 20 bp, Homo sapiens
agaaaacgaagtctttttca

SEQ ID NO: 5166844 - DNA, 17 bp, Homo sapiens
agaaaacgccagtgtgt

SEQ ID NO: 5166845 - DNA, 21 bp, Homo sapiens
agaaaactacatgtaaaatct

SEQ ID NO: 5166846 - DNA, 19 bp, Homo sapiens
agaaaactagaatttcatt

SEQ ID NO: 5166847 - DNA, 21 bp, Homo sapiens
agaaaactcaaagaatgtgta

SEQ ID NO: 5166848 - DNA, 11 bp, Homo sapiens
agaaaactctt

SEQ ID NO: 5166849 - DNA, 14 bp, Homo sapiens
agaaaactgtgatt

SEQ ID NO: 5166850 - DNA, 19 bp, Homo sapiens
agaaaacttcaaggaaaat

SEQ ID NO: 5166851 - DNA, 13 bp, Homo sapiens
agaaaacttccaa

SEQ ID NO: 5166852 - DNA, 20 bp, Homo sapiens
agaaaacttctcttctgagc

SEQ ID NO: 5166853 - DNA, 18 bp, Homo sapiens
agaaaacttgcctttcag

SEQ ID NO: 5166854 - DNA, 21 bp, Homo sapiens
agaaaacttgtattatgtgtg

SEQ ID NO: 5166855 - DNA, 22 bp, Homo sapiens
agaaaactttaaaaaatattta

SEQ ID NO: 5166856 - DNA, 17 bp, Homo sapiens
agaaaacttttatgcaa

SEQ ID NO: 5166857 - DNA, 17 bp, Homo sapiens
agaaaagaaaatatagt

SEQ ID NO: 5166858 - DNA, 21 bp, Homo sapiens
agaaaagaaatggtatgtaga

SEQ ID NO: 5166859 - DNA, 21 bp, Homo sapiens
agaaaagaatccctgttcatt

SEQ ID NO: 5166860 - DNA, 16 bp, Homo sapiens
agaaaagacacttcaa

SEQ ID NO: 5166861 - DNA, 17 bp, Homo sapiens
agaaaagacatgaatat

SEQ ID NO: 5166862 - DNA, 14 bp, Homo sapiens
agaaaagaccctga

SEQ ID NO: 5166863 - DNA, 16 bp, Homo sapiens
agaaaagaccctgaga

SEQ ID NO: 5166864 - DNA, 19 bp, Homo sapiens
agaaaagacttacctgaat

SEQ ID NO: 5166865 - DNA, 19 bp, Homo sapiens
agaaaagacttttgttgaa

SEQ ID NO: 5166866 - DNA, 11 bp, Homo sapiens
agaaaagagaa

SEQ ID NO: 5166867 - DNA, 15 bp, Homo sapiens
agaaaagagaagaaa

SEQ ID NO: 5166868 - DNA, 17 bp, Homo sapiens
agaaaagagaagaagaa

SEQ ID NO: 5166869 - DNA, 23 bp, Homo sapiens
agaaaagagacttctctgtaagt

SEQ ID NO: 5166870 - DNA, 13 bp, Homo sapiens
agaaaagagagaa

SEQ ID NO: 5166871 - DNA, 22 bp, Homo sapiens
agaaaagaggagaggaaaacta

SEQ ID NO: 5166872 - DNA, 18 bp, Homo sapiens
agaaaagagtgagaacta

SEQ ID NO: 5166873 - DNA, 13 bp, Homo sapiens
agaaaagatgaaa

SEQ ID NO: 5166874 - DNA, 15 bp, Homo sapiens
agaaaagatgaattt

SEQ ID NO: 5166875 - DNA, 22 bp, Homo sapiens
agaaaagatgaatttgtccaat

SEQ ID NO: 5166876 - DNA, 15 bp, Homo sapiens
agaaaagatgcactt

SEQ ID NO: 5166877 - DNA, 19 bp, Homo sapiens
agaaaagatgtagatttat

SEQ ID NO: 5166878 - DNA, 15 bp, Homo sapiens
agaaaagatttaagt

SEQ ID NO: 5166879 - DNA, 18 bp, Homo sapiens
agaaaagatttaagtaat

SEQ ID NO: 5166880 - DNA, 18 bp, Homo sapiens
agaaaagattttaatcaa

SEQ ID NO: 5166881 - DNA, 18 bp, Homo sapiens
agaaaagcaatactgttt

SEQ ID NO: 5166882 - DNA, 16 bp, Homo sapiens
agaaaagcacctgccg

SEQ ID NO: 5166883 - DNA, 11 bp, Homo sapiens
agaaaagcact

SEQ ID NO: 5166884 - DNA, 12 bp, Homo sapiens
agaaaagcactt

SEQ ID NO: 5166885 - DNA, 17 bp, Homo sapiens
agaaaagcacttaaagt

SEQ ID NO: 5166886 - DNA, 18 bp, Homo sapiens
agaaaagcacttaaagtt

SEQ ID NO: 5166887 - DNA, 19 bp, Homo sapiens
agaaaagcacttttgttat

SEQ ID NO: 5166888 - DNA, 21 bp, Homo sapiens
agaaaagcacttttgttattc

SEQ ID NO: 5166889 - DNA, 21 bp, Homo sapiens
agaaaagcaggcctttgcaga

SEQ ID NO: 5166890 - DNA, 23 bp, Homo sapiens
agaaaagcattttcagtcttgta

SEQ ID NO: 5166891 - DNA, 11 bp, Homo sapiens
agaaaagccag

SEQ ID NO: 5166892 - DNA, 22 bp, Homo sapiens
agaaaagccagatgacagggag

SEQ ID NO: 5166893 - DNA, 16 bp, Homo sapiens
agaaaagccgaaaggg

SEQ ID NO: 5166894 - DNA, 19 bp, Homo sapiens
agaaaagccgaaagggtta

SEQ ID NO: 5166895 - DNA, 14 bp, Homo sapiens
agaaaagcctcagc

SEQ ID NO: 5166896 - DNA, 19 bp, Homo sapiens
agaaaagcgcgttgtgtat

SEQ ID NO: 5166897 - DNA, 13 bp, Homo sapiens
agaaaagctataa

SEQ ID NO: 5166898 - DNA, 21 bp, Homo sapiens
agaaaagctcagagtaggtgg

SEQ ID NO: 5166899 - DNA, 12 bp, Homo sapiens
agaaaaggaaaa

SEQ ID NO: 5166900 - DNA, 15 bp, Homo sapiens
agaaaaggaatgcaa

SEQ ID NO: 5166901 - DNA, 17 bp, Homo sapiens
agaaaaggattttggaa

SEQ ID NO: 5166902 - DNA, 20 bp, Homo sapiens
agaaaaggcaaaagactggt

SEQ ID NO: 5166903 - DNA, 13 bp, Homo sapiens
agaaaaggcagcc

SEQ ID NO: 5166904 - DNA, 15 bp, Homo sapiens
agaaaaggcagccag

SEQ ID NO: 5166905 - DNA, 16 bp, Homo sapiens
agaaaagggaaaaaag

SEQ ID NO: 5166906 - DNA, 19 bp, Homo sapiens
agaaaagggaaaaaagaaa

SEQ ID NO: 5166907 - DNA, 21 bp, Homo sapiens
agaaaaggttatgttcatttt

SEQ ID NO: 5166908 - DNA, 22 bp, Homo sapiens
agaaaaggttatgttcattttt

SEQ ID NO: 5166909 - DNA, 15 bp, Homo sapiens
agaaaagtaatgaag

SEQ ID NO: 5166910 - DNA, 17 bp, Homo sapiens
agaaaagtagaattata

SEQ ID NO: 5166911 - DNA, 14 bp, Homo sapiens
agaaaagtagacaa

SEQ ID NO: 5166912 - DNA, 17 bp, Homo sapiens
agaaaagtatgttctaa

SEQ ID NO: 5166913 - DNA, 12 bp, Homo sapiens
agaaaagtattt

SEQ ID NO: 5166914 - DNA, 18 bp, Homo sapiens
agaaaagtatttccaact

SEQ ID NO: 5166915 - DNA, 13 bp, Homo sapiens
agaaaagtatttt

SEQ ID NO: 5166916 - DNA, 16 bp, Homo sapiens
agaaaagtattttgaa

SEQ ID NO: 5166917 - DNA, 19 bp, Homo sapiens
agaaaagtattttgaagtt

SEQ ID NO: 5166918 - DNA, 23 bp, Homo sapiens
agaaaagtattttgaagtttaca

SEQ ID NO: 5166919 - DNA, 21 bp, Homo sapiens
agaaaagtgaaagtaactgtt

SEQ ID NO: 5166920 - DNA, 19 bp, Homo sapiens
agaaaagtgaattgaagtt

SEQ ID NO: 5166921 - DNA, 18 bp, Homo sapiens
agaaaagtgcaaagttat

SEQ ID NO: 5166922 - DNA, 11 bp, Homo sapiens
agaaaagttat

SEQ ID NO: 5166923 - DNA, 12 bp, Homo sapiens
agaaaagttatt

SEQ ID NO: 5166924 - DNA, 13 bp, Homo sapiens
agaaaagttatta

SEQ ID NO: 5166925 - DNA, 18 bp, Homo sapiens
agaaaagttcaatactct

SEQ ID NO: 5166926 - DNA, 21 bp, Homo sapiens
agaaaagttgaattttacatg

SEQ ID NO: 5166927 - DNA, 16 bp, Homo sapiens
agaaaagttgcagatg

SEQ ID NO: 5166928 - DNA, 13 bp, Homo sapiens
agaaaataaaaag

SEQ ID NO: 5166929 - DNA, 14 bp, Homo sapiens
agaaaataaaaagt

SEQ ID NO: 5166930 - DNA, 14 bp, Homo sapiens
agaaaataaaacta

SEQ ID NO: 5166931 - DNA, 14 bp, Homo sapiens
agaaaataaaatat

SEQ ID NO: 5166932 - DNA, 19 bp, Homo sapiens
agaaaataaaatattcact

SEQ ID NO: 5166933 - DNA, 24 bp, Homo sapiens
agaaaataaaatattcactctcca

SEQ ID NO: 5166934 - DNA, 13 bp, Homo sapiens
agaaaataaaatt

SEQ ID NO: 5166935 - DNA, 18 bp, Homo sapiens
agaaaataaaattaagaa

SEQ ID NO: 5166936 - DNA, 19 bp, Homo sapiens
agaaaataaaattaagaat

SEQ ID NO: 5166937 - DNA, 16 bp, Homo sapiens
agaaaataaagacaac

SEQ ID NO: 5166938 - DNA, 17 bp, Homo sapiens
agaaaataaatacaagt

SEQ ID NO: 5166939 - DNA, 20 bp, Homo sapiens
agaaaataaatacaagtttg

SEQ ID NO: 5166940 - DNA, 16 bp, Homo sapiens
agaaaataatgcaaat

SEQ ID NO: 5166941 - DNA, 20 bp, Homo sapiens
agaaaataatttatatgcat

SEQ ID NO: 5166942 - DNA, 17 bp, Homo sapiens
agaaaatactatttcaa

SEQ ID NO: 5166943 - DNA, 21 bp, Homo sapiens
actgggaaccaagggccctca

SEQ ID NO: 5166944 - DNA, 16 bp, Homo sapiens
actgggaacccctttc

SEQ ID NO: 5166945 - DNA, 19 bp, Homo sapiens
actgggaacccctttccca

SEQ ID NO: 5166946 - DNA, 21 bp, Homo sapiens
actgggaacttaggggactga

SEQ ID NO: 5166947 - DNA, 18 bp, Homo sapiens
actgggaagatgctggcc

SEQ ID NO: 5166948 - DNA, 17 bp, Homo sapiens
actgggaagcattactt

SEQ ID NO: 5166949 - DNA, 19 bp, Homo sapiens
actgggaagcattactttg

SEQ ID NO: 5166950 - DNA, 13 bp, Homo sapiens
actgggaagctgg

SEQ ID NO: 5166951 - DNA, 15 bp, Homo sapiens
actgggaagctggag

SEQ ID NO: 5166952 - DNA, 12 bp, Homo sapiens
actgggaaggaa

SEQ ID NO: 5166953 - DNA, 11 bp, Homo sapiens
actgggaaggc

SEQ ID NO: 5166954 - DNA, 19 bp, Homo sapiens
actgggacagctggctggg

SEQ ID NO: 5166955 - DNA, 23 bp, Homo sapiens
actgggaccaaccctggggaagg

SEQ ID NO: 5166956 - DNA, 15 bp, Homo sapiens
actgggactttgtaa

SEQ ID NO: 5166957 - DNA, 16 bp, Homo sapiens
actgggagaaatgaaa

SEQ ID NO: 5166958 - DNA, 17 bp, Homo sapiens
actgggagaagagaacc

SEQ ID NO: 5166959 - DNA, 22 bp, Homo sapiens
actgggagaggtgccagcaact

SEQ ID NO: 5166960 - DNA, 23 bp, Homo sapiens
actgggagaggtgccagcaactg

SEQ ID NO: 5166961 - DNA, 20 bp, Homo sapiens
actgggagcccccagcctgt

SEQ ID NO: 5166962 - DNA, 13 bp, Homo sapiens
actgggaggaggg

SEQ ID NO: 5166963 - DNA, 20 bp, Homo sapiens
actgggaggagggggagggt

SEQ ID NO: 5166964 - DNA, 14 bp, Homo sapiens
actgggaggggaga

SEQ ID NO: 5166965 - DNA, 14 bp, Homo sapiens
actgggagtcagag

SEQ ID NO: 5166966 - DNA, 15 bp, Homo sapiens
actgggagtcagagc

SEQ ID NO: 5166967 - DNA, 17 bp, Homo sapiens
actgggagtcagagccc

SEQ ID NO: 5166968 - DNA, 20 bp, Homo sapiens
actgggagtcagagccctgg

SEQ ID NO: 5166969 - DNA, 22 bp, Homo sapiens
actgggagtgtccttagtgtat

SEQ ID NO: 5166970 - DNA, 16 bp, Homo sapiens
actgggataactgatt

SEQ ID NO: 5166971 - DNA, 19 bp, Homo sapiens
actgggataactgatttct

SEQ ID NO: 5166972 - DNA, 21 bp, Homo sapiens
actgggataactgatttctat

SEQ ID NO: 5166973 - DNA, 16 bp, Homo sapiens
actgggcaacactgca

SEQ ID NO: 5166974 - DNA, 17 bp, Homo sapiens
actgggcaacactgcag

SEQ ID NO: 5166975 - DNA, 13 bp, Homo sapiens
actgggcacacgc

SEQ ID NO: 5166976 - DNA, 16 bp, Homo sapiens
actgggcacagattga

SEQ ID NO: 5166977 - DNA, 21 bp, Homo sapiens
actgggcacctgcgcacaggt

SEQ ID NO: 5166978 - DNA, 17 bp, Homo sapiens
actgggcactggggcct

SEQ ID NO: 5166979 - DNA, 11 bp, Homo sapiens
actgggcagca

SEQ ID NO: 5166980 - DNA, 15 bp, Homo sapiens
actgggcagcaaggc

SEQ ID NO: 5166981 - DNA, 15 bp, Homo sapiens
actgggcccagagga

SEQ ID NO: 5166982 - DNA, 19 bp, Homo sapiens
actgggcccaggcaggtct

SEQ ID NO: 5166983 - DNA, 20 bp, Homo sapiens
actgggcccaggcaggtctg

SEQ ID NO: 5166984 - DNA, 15 bp, Homo sapiens
actgggccccacatg

SEQ ID NO: 5166985 - DNA, 12 bp, Homo sapiens
actgggcccctc

SEQ ID NO: 5166986 - DNA, 17 bp, Homo sapiens
actgggccctgagtctg

SEQ ID NO: 5166987 - DNA, 20 bp, Homo sapiens
actgggccctggggctgccc

SEQ ID NO: 5166988 - DNA, 23 bp, Homo sapiens
actgggccctggggctgccctcg

SEQ ID NO: 5166989 - DNA, 13 bp, Homo sapiens
actgggccctgtc

SEQ ID NO: 5166990 - DNA, 14 bp, Homo sapiens
actgggccctgtcc

SEQ ID NO: 5166991 - DNA, 17 bp, Homo sapiens
actgggccggcagcctg

SEQ ID NO: 5166992 - DNA, 16 bp, Homo sapiens
actgggccgggcccag

SEQ ID NO: 5166993 - DNA, 20 bp, Homo sapiens
actgggccgggcccagggcc

SEQ ID NO: 5166994 - DNA, 23 bp, Homo sapiens
actgggccgggcccagggcctct

SEQ ID NO: 5166995 - DNA, 19 bp, Homo sapiens
actgggcctaggccaggag

SEQ ID NO: 5166996 - DNA, 11 bp, Homo sapiens
actgggcctgg

SEQ ID NO: 5166997 - DNA, 12 bp, Homo sapiens
actgggcctgga

SEQ ID NO: 5166998 - DNA, 15 bp, Homo sapiens
actgggctctgagga

SEQ ID NO: 5166999 - DNA, 16 bp, Homo sapiens
actgggctctggctct

SEQ ID NO: 5167000 - DNA, 13 bp, Homo sapiens
actgggctgaggg

SEQ ID NO: 5167001 - DNA, 22 bp, Homo sapiens
actgggctgcccacctggctgc

SEQ ID NO: 5167002 - DNA, 14 bp, Homo sapiens
actgggctgctggg

SEQ ID NO: 5167003 - DNA, 15 bp, Homo sapiens
actgggctgctgggg

SEQ ID NO: 5167004 - DNA, 18 bp, Homo sapiens
actgggctgctggggcag

SEQ ID NO: 5167005 - DNA, 22 bp, Homo sapiens
actgggctggcgcttggatctg

SEQ ID NO: 5167006 - DNA, 13 bp, Homo sapiens
actgggctggctg

SEQ ID NO: 5167007 - DNA, 13 bp, Homo sapiens
actgggctgggcc

SEQ ID NO: 5167008 - DNA, 18 bp, Homo sapiens
actggggaaactggccat

SEQ ID NO: 5167009 - DNA, 18 bp, Homo sapiens
actggggacttggcctct

SEQ ID NO: 5167010 - DNA, 16 bp, Homo sapiens
actggggactttattt

SEQ ID NO: 5167011 - DNA, 23 bp, Homo sapiens
actggggactttatttatttcta

SEQ ID NO: 5167012 - DNA, 18 bp, Homo sapiens
actggggagaaataattg

SEQ ID NO: 5167013 - DNA, 13 bp, Homo sapiens
actggggagcccg

SEQ ID NO: 5167014 - DNA, 19 bp, Homo sapiens
actggggaggaatcctgga

SEQ ID NO: 5167015 - DNA, 16 bp, Homo sapiens
actggggagggctgca

SEQ ID NO: 5167016 - DNA, 23 bp, Homo sapiens
actggggatcccgtgctggaaga

SEQ ID NO: 5167017 - DNA, 19 bp, Homo sapiens
actggggatggtggcacag

SEQ ID NO: 5167018 - DNA, 16 bp, Homo sapiens
actggggcctcagcct

SEQ ID NO: 5167019 - DNA, 13 bp, Homo sapiens
actggggcctcca

SEQ ID NO: 5167020 - DNA, 16 bp, Homo sapiens
actggggctcagagcc

SEQ ID NO: 5167021 - DNA, 18 bp, Homo sapiens
actggggctcagagccgg

SEQ ID NO: 5167022 - DNA, 22 bp, Homo sapiens
actggggctggggaaggaagcc

SEQ ID NO: 5167023 - DNA, 21 bp, Homo sapiens
actggggcttgcaagaggagg

SEQ ID NO: 5167024 - DNA, 22 bp, Homo sapiens
actggggcttgcaagaggaggt

SEQ ID NO: 5167025 - DNA, 20 bp, Homo sapiens
actggggctttgccttgcag

SEQ ID NO: 5167026 - DNA, 19 bp, Homo sapiens
actgggggactgggagtca

SEQ ID NO: 5167027 - DNA, 13 bp, Homo sapiens
actgggggcctct

SEQ ID NO: 5167028 - DNA, 19 bp, Homo sapiens
actgggggcggggcctggg

SEQ ID NO: 5167029 - DNA, 16 bp, Homo sapiens
actggggggcaggcct

SEQ ID NO: 5167030 - DNA, 17 bp, Homo sapiens
actggggggctttggcc

SEQ ID NO: 5167031 - DNA, 21 bp, Homo sapiens
actggggtaagcggaataaac

SEQ ID NO: 5167032 - DNA, 13 bp, Homo sapiens
actggggtgcctt

SEQ ID NO: 5167033 - DNA, 22 bp, Homo sapiens
actggggtgggaggtcttgcta

SEQ ID NO: 5167034 - DNA, 18 bp, Homo sapiens
actggggttcaagcccag

SEQ ID NO: 5167035 - DNA, 14 bp, Homo sapiens
actgggtaatgaaa

SEQ ID NO: 5167036 - DNA, 22 bp, Homo sapiens
actgggtaatttataaagaaaa

SEQ ID NO: 5167037 - DNA, 21 bp, Homo sapiens
actgggtacaagagatgggat

SEQ ID NO: 5167038 - DNA, 21 bp, Homo sapiens
actgggtacccaaaacacatt

SEQ ID NO: 5167039 - DNA, 15 bp, Homo sapiens
actgggtaggttctg

SEQ ID NO: 5167040 - DNA, 16 bp, Homo sapiens
actgggtaggttctga

SEQ ID NO: 5167041 - DNA, 21 bp, Homo sapiens
actgggtaggttctgaacagc

SEQ ID NO: 5167042 - DNA, 16 bp, Homo sapiens
actgggtcatcatttg

SEQ ID NO: 5167043 - DNA, 15 bp, Homo sapiens
actgggtctgcgatg

SEQ ID NO: 5167044 - DNA, 18 bp, Homo sapiens
actgggtgggccccacag

SEQ ID NO: 5167045 - DNA, 19 bp, Homo sapiens
actgggtgggccccacagt

SEQ ID NO: 5167046 - DNA, 22 bp, Homo sapiens
actgggtggggtgaggaccact

SEQ ID NO: 5167047 - DNA, 22 bp, Homo sapiens
actgggtggtggcctggtccct

SEQ ID NO: 5167048 - DNA, 21 bp, Homo sapiens
actgggtgtcatttcattcca

SEQ ID NO: 5167049 - DNA, 13 bp, Homo sapiens
actgggtgtggcc

SEQ ID NO: 5167050 - DNA, 17 bp, Homo sapiens
actgggtgttcaaggcc

SEQ ID NO: 5167051 - DNA, 13 bp, Homo sapiens
actgggttaaata

SEQ ID NO: 5167052 - DNA, 14 bp, Homo sapiens
actgggttcaaaaa

SEQ ID NO: 5167053 - DNA, 19 bp, Homo sapiens
actgggttcaaaaagaaaa

SEQ ID NO: 5167054 - DNA, 16 bp, Homo sapiens
actgggttcccatgct

SEQ ID NO: 5167055 - DNA, 22 bp, Homo sapiens
actgggttcttgttttatatac

SEQ ID NO: 5167056 - DNA, 16 bp, Homo sapiens
actgggttctttggaa

SEQ ID NO: 5167057 - DNA, 20 bp, Homo sapiens
actgggttctttggaagcag

SEQ ID NO: 5167058 - DNA, 13 bp, Homo sapiens
actgggttgactt

SEQ ID NO: 5167059 - DNA, 15 bp, Homo sapiens
actgggttgcgggac

SEQ ID NO: 5167060 - DNA, 15 bp, Homo sapiens
actgggttgtccagg

SEQ ID NO: 5167061 - DNA, 18 bp, Homo sapiens
actgggtttcaagaaaat

SEQ ID NO: 5167062 - DNA, 14 bp, Homo sapiens
actgggtttctagc

SEQ ID NO: 5167063 - DNA, 14 bp, Homo sapiens
actgggtttgctcc

SEQ ID NO: 5167064 - DNA, 16 bp, Homo sapiens
actgggtttgctccct

SEQ ID NO: 5167065 - DNA, 23 bp, Homo sapiens
actgggtttggaccccagctggg

SEQ ID NO: 5167066 - DNA, 18 bp, Homo sapiens
actgggtttgtttttcaa

SEQ ID NO: 5167067 - DNA, 20 bp, Homo sapiens
actggtaaagcctcatttga

SEQ ID NO: 5167068 - DNA, 13 bp, Homo sapiens
actggtaaatgtt

SEQ ID NO: 5167069 - DNA, 13 bp, Homo sapiens
actggtaacatgt

SEQ ID NO: 5167070 - DNA, 17 bp, Homo sapiens
actggtaagattgttat

SEQ ID NO: 5167071 - DNA, 19 bp, Homo sapiens
actggtaagcgatttgaaa

SEQ ID NO: 5167072 - DNA, 20 bp, Homo sapiens
actggtaagcgatttgaaac

SEQ ID NO: 5167073 - DNA, 16 bp, Homo sapiens
actggtaattgtacaa

SEQ ID NO: 5167074 - DNA, 17 bp, Homo sapiens
actggtaattgtacaat

SEQ ID NO: 5167075 - DNA, 19 bp, Homo sapiens
actggtaggaaaaagcttt

SEQ ID NO: 5167076 - DNA, 18 bp, Homo sapiens
actggtaggaaactaggt

SEQ ID NO: 5167077 - DNA, 18 bp, Homo sapiens
actggtaggttgggacac

SEQ ID NO: 5167078 - DNA, 20 bp, Homo sapiens
actggtagttcattgtaaat

SEQ ID NO: 5167079 - DNA, 16 bp, Homo sapiens
actggtatatatttag

SEQ ID NO: 5167080 - DNA, 15 bp, Homo sapiens
actggtatttatatt

SEQ ID NO: 5167081 - DNA, 13 bp, Homo sapiens
actggtcagggca

SEQ ID NO: 5167082 - DNA, 18 bp, Homo sapiens
actggtcagggcagtggc

SEQ ID NO: 5167083 - DNA, 20 bp, Homo sapiens
actggtcagggcagtggcca

SEQ ID NO: 5167084 - DNA, 16 bp, Homo sapiens
actggtcattaatgtg

SEQ ID NO: 5167085 - DNA, 21 bp, Homo sapiens
actggtccaaaagattgctga

SEQ ID NO: 5167086 - DNA, 18 bp, Homo sapiens
actggtccactcagggct

SEQ ID NO: 5167087 - DNA, 10 bp, Homo sapiens
actggtccag

SEQ ID NO: 5167088 - DNA, 14 bp, Homo sapiens
actggtccagctct

SEQ ID NO: 5167089 - DNA, 22 bp, Homo sapiens
actggtccaggcatgggtccct

SEQ ID NO: 5167090 - DNA, 17 bp, Homo sapiens
actggtccaggccaggc

SEQ ID NO: 5167091 - DNA, 22 bp, Homo sapiens
actggtccaggtcttcagtttc

SEQ ID NO: 5167092 - DNA, 23 bp, Homo sapiens
actggtcccacttcacagctgga

SEQ ID NO: 5167093 - DNA, 13 bp, Homo sapiens
actggtcccttcc

SEQ ID NO: 5167094 - DNA, 14 bp, Homo sapiens
actggtcctgtgtg

SEQ ID NO: 5167095 - DNA, 15 bp, Homo sapiens
actggtccttaccag

SEQ ID NO: 5167096 - DNA, 20 bp, Homo sapiens
actggtccttaccagagacg

SEQ ID NO: 5167097 - DNA, 15 bp, Homo sapiens
actggtctacactgg

SEQ ID NO: 5167098 - DNA, 14 bp, Homo sapiens
actggtctcacagt

SEQ ID NO: 5167099 - DNA, 21 bp, Homo sapiens
actggtctcacagtctaagta

SEQ ID NO: 5167100 - DNA, 15 bp, Homo sapiens
actggtctcagagga

SEQ ID NO: 5167101 - DNA, 20 bp, Homo sapiens
actggtctcgaactcctggc

SEQ ID NO: 5167102 - DNA, 13 bp, Homo sapiens
actggtctgctgt

SEQ ID NO: 5167103 - DNA, 15 bp, Homo sapiens
actggtctgtaggga

SEQ ID NO: 5167104 - DNA, 18 bp, Homo sapiens
actggtctgttaatcttt

SEQ ID NO: 5167105 - DNA, 22 bp, Homo sapiens
actggtgaactgagctgggcag

SEQ ID NO: 5167106 - DNA, 14 bp, Homo sapiens
actggtgagcagac

SEQ ID NO: 5167107 - DNA, 20 bp, Homo sapiens
actggtgagggcaagaggtg

SEQ ID NO: 5167108 - DNA, 21 bp, Homo sapiens
actggtgagggcaagaggtgc

SEQ ID NO: 5167109 - DNA, 17 bp, Homo sapiens
actggtgatataaagaa

SEQ ID NO: 5167110 - DNA, 13 bp, Homo sapiens
actggtgatttct

SEQ ID NO: 5167111 - DNA, 15 bp, Homo sapiens
actggtgatttctga

SEQ ID NO: 5167112 - DNA, 23 bp, Homo sapiens
actggtgcaagttgaggacttct

SEQ ID NO: 5167113 - DNA, 13 bp, Homo sapiens
actggtgcacttt

SEQ ID NO: 5167114 - DNA, 16 bp, Homo sapiens
actggtgcactttgta

SEQ ID NO: 5167115 - DNA, 21 bp, Homo sapiens
actggtgcactttgtaaattc

SEQ ID NO: 5167116 - DNA, 18 bp, Homo sapiens
actggtgcgaccccccac

SEQ ID NO: 5167117 - DNA, 13 bp, Homo sapiens
actggtggaagga

SEQ ID NO: 5167118 - DNA, 16 bp, Homo sapiens
actggtggcagtggag

SEQ ID NO: 5167119 - DNA, 20 bp, Homo sapiens
actggtgggatctgtgccca

SEQ ID NO: 5167120 - DNA, 13 bp, Homo sapiens
actggtgtaatct

SEQ ID NO: 5167121 - DNA, 17 bp, Homo sapiens
actggtgtaatctcaat

SEQ ID NO: 5167122 - DNA, 17 bp, Homo sapiens
agaaaatacttaaatgt

SEQ ID NO: 5167123 - DNA, 23 bp, Homo sapiens
agaaaatagaatgtggccactta

SEQ ID NO: 5167124 - DNA, 16 bp, Homo sapiens
agaaaatagataattt

SEQ ID NO: 5167125 - DNA, 22 bp, Homo sapiens
agaaaatagcttttattgagta

SEQ ID NO: 5167126 - DNA, 10 bp, Homo sapiens
agaaaatata

SEQ ID NO: 5167127 - DNA, 11 bp, Homo sapiens
agaaaatataa

SEQ ID NO: 5167128 - DNA, 16 bp, Homo sapiens
agaaaatataaatgca

SEQ ID NO: 5167129 - DNA, 15 bp, Homo sapiens
agaaaatatactgta

SEQ ID NO: 5167130 - DNA, 15 bp, Homo sapiens
agaaaatatatgtat

SEQ ID NO: 5167131 - DNA, 17 bp, Homo sapiens
agaaaatatatgtattt

SEQ ID NO: 5167132 - DNA, 19 bp, Homo sapiens
agaaaatatattctttcaa

SEQ ID NO: 5167133 - DNA, 22 bp, Homo sapiens
agaaaatatctgaaatgtgata

SEQ ID NO: 5167134 - DNA, 16 bp, Homo sapiens
agaaaatatgatatat

SEQ ID NO: 5167135 - DNA, 13 bp, Homo sapiens
agaaaatattcta

SEQ ID NO: 5167136 - DNA, 15 bp, Homo sapiens
agaaaatatttaact

SEQ ID NO: 5167137 - DNA, 20 bp, Homo sapiens
agaaaatatttaatatcaaa

SEQ ID NO: 5167138 - DNA, 20 bp, Homo sapiens
agaaaatattttgtctaaaa

SEQ ID NO: 5167139 - DNA, 21 bp, Homo sapiens
agaaaatattttgtctaaaat

SEQ ID NO: 5167140 - DNA, 13 bp, Homo sapiens
agaaaatcactta

SEQ ID NO: 5167141 - DNA, 19 bp, Homo sapiens
agaaaatcatattgcttct

SEQ ID NO: 5167142 - DNA, 13 bp, Homo sapiens
agaaaatcatcaa

SEQ ID NO: 5167143 - DNA, 19 bp, Homo sapiens
agaaaatcatcaagaaggg

SEQ ID NO: 5167144 - DNA, 23 bp, Homo sapiens
agaaaatcccggtgcttgcagta

SEQ ID NO: 5167145 - DNA, 18 bp, Homo sapiens
agaaaatccttcagcaat

SEQ ID NO: 5167146 - DNA, 15 bp, Homo sapiens
agaaaatctttataa

SEQ ID NO: 5167147 - DNA, 17 bp, Homo sapiens
agaaaatctttgttgaa

SEQ ID NO: 5167148 - DNA, 15 bp, Homo sapiens
agaaaatgaaaagat

SEQ ID NO: 5167149 - DNA, 21 bp, Homo sapiens
agaaaatgaaatgcatatttg

SEQ ID NO: 5167150 - DNA, 17 bp, Homo sapiens
agaaaatgaactgtata

SEQ ID NO: 5167151 - DNA, 20 bp, Homo sapiens
agaaaatgaactgtatatta

SEQ ID NO: 5167152 - DNA, 23 bp, Homo sapiens
agaaaatgaatggacaaagctca

SEQ ID NO: 5167153 - DNA, 15 bp, Homo sapiens
agaaaatgaatttga

SEQ ID NO: 5167154 - DNA, 23 bp, Homo sapiens
agaaaatgacttatttctgctct

SEQ ID NO: 5167155 - DNA, 18 bp, Homo sapiens
agaaaatgagatgggttg

SEQ ID NO: 5167156 - DNA, 18 bp, Homo sapiens
agaaaatgcaaaatgaaa

SEQ ID NO: 5167157 - DNA, 13 bp, Homo sapiens
agaaaatgcaatg

SEQ ID NO: 5167158 - DNA, 16 bp, Homo sapiens
agaaaatgcaccaaat

SEQ ID NO: 5167159 - DNA, 22 bp, Homo sapiens
agaaaatgcagccttaaacagt

SEQ ID NO: 5167160 - DNA, 19 bp, Homo sapiens
agaaaatgcaggagagctt

SEQ ID NO: 5167161 - DNA, 21 bp, Homo sapiens
agaaaatgcctcaattcacat

SEQ ID NO: 5167162 - DNA, 15 bp, Homo sapiens
agaaaatgcgagact

SEQ ID NO: 5167163 - DNA, 13 bp, Homo sapiens
agaaaatgctggc

SEQ ID NO: 5167164 - DNA, 19 bp, Homo sapiens
agaaaatgctttctcatgc

SEQ ID NO: 5167165 - DNA, 20 bp, Homo sapiens
agaaaatggaaaatatacaa

SEQ ID NO: 5167166 - DNA, 23 bp, Homo sapiens
agaaaatggaaaatatacaagta

SEQ ID NO: 5167167 - DNA, 19 bp, Homo sapiens
agaaaatggaaagaaggaa

SEQ ID NO: 5167168 - DNA, 20 bp, Homo sapiens
agaaaatggaaccaggcttg

SEQ ID NO: 5167169 - DNA, 21 bp, Homo sapiens
agaaaatggaattactccaaa

SEQ ID NO: 5167170 - DNA, 19 bp, Homo sapiens
agaaaatggctttaatcaa

SEQ ID NO: 5167171 - DNA, 19 bp, Homo sapiens
agaaaatggggcttgccct

SEQ ID NO: 5167172 - DNA, 20 bp, Homo sapiens
agaaaatggtttattttgta

SEQ ID NO: 5167173 - DNA, 20 bp, Homo sapiens
agaaaatgtaaaggagggag

SEQ ID NO: 5167174 - DNA, 16 bp, Homo sapiens
agaaaatgtaaggcaa

SEQ ID NO: 5167175 - DNA, 20 bp, Homo sapiens
agaaaatgtaaggcaatgct

SEQ ID NO: 5167176 - DNA, 12 bp, Homo sapiens
agaaaatgtctt

SEQ ID NO: 5167177 - DNA, 19 bp, Homo sapiens
agaaaatgtgaccctccaa

SEQ ID NO: 5167178 - DNA, 17 bp, Homo sapiens
agaaaatgtgtaattca

SEQ ID NO: 5167179 - DNA, 13 bp, Homo sapiens
agaaaatgtgtct

SEQ ID NO: 5167180 - DNA, 19 bp, Homo sapiens
agaaaatgttatttaacag

SEQ ID NO: 5167181 - DNA, 23 bp, Homo sapiens
agaaaatgttggggtaaaagtgt

SEQ ID NO: 5167182 - DNA, 15 bp, Homo sapiens
agaaaattaaaataa

SEQ ID NO: 5167183 - DNA, 18 bp, Homo sapiens
agaaaattaaaataggca

SEQ ID NO: 5167184 - DNA, 23 bp, Homo sapiens
agaaaattaaactacagaatatt

SEQ ID NO: 5167185 - DNA, 13 bp, Homo sapiens
agaaaattatatt

SEQ ID NO: 5167186 - DNA, 20 bp, Homo sapiens
agaaaattatgtaaagttta

SEQ ID NO: 5167187 - DNA, 13 bp, Homo sapiens
agaaaattcaatt

SEQ ID NO: 5167188 - DNA, 15 bp, Homo sapiens
agaaaattccctggg

SEQ ID NO: 5167189 - DNA, 22 bp, Homo sapiens
agaaaattcctataaggaagat

SEQ ID NO: 5167190 - DNA, 18 bp, Homo sapiens
agaaaattctctcaagac

SEQ ID NO: 5167191 - DNA, 23 bp, Homo sapiens
agaaaattctgtgccttgttttt

SEQ ID NO: 5167192 - DNA, 23 bp, Homo sapiens
agaaaattcttgagaagtaactg

SEQ ID NO: 5167193 - DNA, 16 bp, Homo sapiens
agaaaattgcactaaa

SEQ ID NO: 5167194 - DNA, 17 bp, Homo sapiens
agaaaattgcatgaaac

SEQ ID NO: 5167195 - DNA, 18 bp, Homo sapiens
agaaaattgcatgaaact

SEQ ID NO: 5167196 - DNA, 21 bp, Homo sapiens
agaaaattgccaaaatatatt

SEQ ID NO: 5167197 - DNA, 20 bp, Homo sapiens
agaaaattgttgcaaactat

SEQ ID NO: 5167198 - DNA, 14 bp, Homo sapiens
agaaaatttaaaaa

SEQ ID NO: 5167199 - DNA, 13 bp, Homo sapiens
agaaaatttaatt

SEQ ID NO: 5167200 - DNA, 21 bp, Homo sapiens
agaaaatttgcaacatataaa

SEQ ID NO: 5167201 - DNA, 15 bp, Homo sapiens
agaaaatttgcttta

SEQ ID NO: 5167202 - DNA, 13 bp, Homo sapiens
agaaaattttgca

SEQ ID NO: 5167203 - DNA, 16 bp, Homo sapiens
agaaaattttgtaaaa

SEQ ID NO: 5167204 - DNA, 14 bp, Homo sapiens
agaaaattttgtat

SEQ ID NO: 5167205 - DNA, 20 bp, Homo sapiens
agaaaatttttgtctttcat

SEQ ID NO: 5167206 - DNA, 17 bp, Homo sapiens
agaaaattttttttcaa

SEQ ID NO: 5167207 - DNA, 17 bp, Homo sapiens
agaaacaaagatgttat

SEQ ID NO: 5167208 - DNA, 21 bp, Homo sapiens
agaaacaaaggggatgcccag

SEQ ID NO: 5167209 - DNA, 21 bp, Homo sapiens
agaaacaaagggttttctttt

SEQ ID NO: 5167210 - DNA, 15 bp, Homo sapiens
agaaacaacactgta

SEQ ID NO: 5167211 - DNA, 17 bp, Homo sapiens
agaaacaactctttgag

SEQ ID NO: 5167212 - DNA, 20 bp, Homo sapiens
agaaacaactctttgagaaa

SEQ ID NO: 5167213 - DNA, 14 bp, Homo sapiens
agaaacaactgcca

SEQ ID NO: 5167214 - DNA, 16 bp, Homo sapiens
agaaacaactgccaaa

SEQ ID NO: 5167215 - DNA, 14 bp, Homo sapiens
agaaacaagagacc

SEQ ID NO: 5167216 - DNA, 13 bp, Homo sapiens
agaaacaagctgt

SEQ ID NO: 5167217 - DNA, 18 bp, Homo sapiens
agaaacaaggttttcagt

SEQ ID NO: 5167218 - DNA, 14 bp, Homo sapiens
agaaacaatgaatg

SEQ ID NO: 5167219 - DNA, 20 bp, Homo sapiens
agaaacaatgtctggggaca

SEQ ID NO: 5167220 - DNA, 23 bp, Homo sapiens
agaaacaatgtctggggacaggc

SEQ ID NO: 5167221 - DNA, 15 bp, Homo sapiens
agaaacaatttctgt

SEQ ID NO: 5167222 - DNA, 15 bp, Homo sapiens
agaaacaatttgact

SEQ ID NO: 5167223 - DNA, 19 bp, Homo sapiens
agaaacacaaatgtaaaat

SEQ ID NO: 5167224 - DNA, 16 bp, Homo sapiens
agaaacacagcatgca

SEQ ID NO: 5167225 - DNA, 18 bp, Homo sapiens
agaaacacataaattatg

SEQ ID NO: 5167226 - DNA, 21 bp, Homo sapiens
agaaacacataaattatgaga

SEQ ID NO: 5167227 - DNA, 14 bp, Homo sapiens
agaaacaccactta

SEQ ID NO: 5167228 - DNA, 18 bp, Homo sapiens
agaaacacccacaggcat

SEQ ID NO: 5167229 - DNA, 19 bp, Homo sapiens
agaaacacccctctgtcta

SEQ ID NO: 5167230 - DNA, 20 bp, Homo sapiens
agaaacacctagatcagaac

SEQ ID NO: 5167231 - DNA, 16 bp, Homo sapiens
agaaacacggagtttc

SEQ ID NO: 5167232 - DNA, 14 bp, Homo sapiens
agaaacactaaatt

SEQ ID NO: 5167233 - DNA, 19 bp, Homo sapiens
agaaacactatttgtgact

SEQ ID NO: 5167234 - DNA, 20 bp, Homo sapiens
agaaacactatttgtgactt

SEQ ID NO: 5167235 - DNA, 11 bp, Homo sapiens
agaaacactga

SEQ ID NO: 5167236 - DNA, 16 bp, Homo sapiens
agaaacactgaaaaga

SEQ ID NO: 5167237 - DNA, 12 bp, Homo sapiens
agaaacactgcc

SEQ ID NO: 5167238 - DNA, 13 bp, Homo sapiens
agaaacactgcct

SEQ ID NO: 5167239 - DNA, 15 bp, Homo sapiens
agaaacactgccttt

SEQ ID NO: 5167240 - DNA, 12 bp, Homo sapiens
agaaacagaaga

SEQ ID NO: 5167241 - DNA, 14 bp, Homo sapiens
agaaacagagacag

SEQ ID NO: 5167242 - DNA, 15 bp, Homo sapiens
agaaacagagacagg

SEQ ID NO: 5167243 - DNA, 22 bp, Homo sapiens
agaaacagagtggcctccctgc

SEQ ID NO: 5167244 - DNA, 23 bp, Homo sapiens
agaaacagagtggcctccctgct

SEQ ID NO: 5167245 - DNA, 15 bp, Homo sapiens
agaaacagataccat

SEQ ID NO: 5167246 - DNA, 21 bp, Homo sapiens
agaaacagataccatactcat

SEQ ID NO: 5167247 - DNA, 14 bp, Homo sapiens
agaaacagccattg

SEQ ID NO: 5167248 - DNA, 14 bp, Homo sapiens
agaaacagctcagc

SEQ ID NO: 5167249 - DNA, 17 bp, Homo sapiens
agaaacagctcagccag

SEQ ID NO: 5167250 - DNA, 12 bp, Homo sapiens
agaaacagctgc

SEQ ID NO: 5167251 - DNA, 19 bp, Homo sapiens
agaaacagctgcttctccc

SEQ ID NO: 5167252 - DNA, 16 bp, Homo sapiens
agaaacagctttcaag

SEQ ID NO: 5167253 - DNA, 19 bp, Homo sapiens
agaaacagctttcaagtgc

SEQ ID NO: 5167254 - DNA, 13 bp, Homo sapiens
agaaacaggaccg

SEQ ID NO: 5167255 - DNA, 19 bp, Homo sapiens
agaaacagggacaaagaaa

SEQ ID NO: 5167256 - DNA, 13 bp, Homo sapiens
agaaacagggcag

SEQ ID NO: 5167257 - DNA, 18 bp, Homo sapiens
agaaacaggggatcaaag

SEQ ID NO: 5167258 - DNA, 20 bp, Homo sapiens
agaaacagttaactttcaga

SEQ ID NO: 5167259 - DNA, 15 bp, Homo sapiens
agaaacagttccatt

SEQ ID NO: 5167260 - DNA, 15 bp, Homo sapiens
agaaacagtttaaca

SEQ ID NO: 5167261 - DNA, 19 bp, Homo sapiens
agaaacagtttcttgcttg

SEQ ID NO: 5167262 - DNA, 14 bp, Homo sapiens
agaaacatcagtta

SEQ ID NO: 5167263 - DNA, 23 bp, Homo sapiens
agaaacatcagttactctgaagg

SEQ ID NO: 5167264 - DNA, 20 bp, Homo sapiens
agaaacatctctggcccaga

SEQ ID NO: 5167265 - DNA, 22 bp, Homo sapiens
agaaacatctctggcccagaaa

SEQ ID NO: 5167266 - DNA, 11 bp, Homo sapiens
agaaacatgaa

SEQ ID NO: 5167267 - DNA, 13 bp, Homo sapiens
agaaacatgacac

SEQ ID NO: 5167268 - DNA, 14 bp, Homo sapiens
agaaacatgacact

SEQ ID NO: 5167269 - DNA, 14 bp, Homo sapiens
agaaacatggtttt

SEQ ID NO: 5167270 - DNA, 20 bp, Homo sapiens
agaaacatgttcctgttcct

SEQ ID NO: 5167271 - DNA, 13 bp, Homo sapiens
agaaacattggaa

SEQ ID NO: 5167272 - DNA, 14 bp, Homo sapiens
agaaacattggaag

SEQ ID NO: 5167273 - DNA, 16 bp, Homo sapiens
agaaacattggaagca

SEQ ID NO: 5167274 - DNA, 14 bp, Homo sapiens
agaaacattgttaa

SEQ ID NO: 5167275 - DNA, 12 bp, Homo sapiens
agaaacatttat

SEQ ID NO: 5167276 - DNA, 22 bp, Homo sapiens
agaaaccaaagctttatttcaa

SEQ ID NO: 5167277 - DNA, 15 bp, Homo sapiens
agaaaccaacaagaa

SEQ ID NO: 5167278 - DNA, 14 bp, Homo sapiens
agaaaccaagccat

SEQ ID NO: 5167279 - DNA, 17 bp, Homo sapiens
agaaaccaagtgggctg

SEQ ID NO: 5167280 - DNA, 18 bp, Homo sapiens
agaaaccacttctggtca

SEQ ID NO: 5167281 - DNA, 19 bp, Homo sapiens
agaaaccagcttccttcag

SEQ ID NO: 5167282 - DNA, 19 bp, Homo sapiens
agaaaccagtatggaaggg

SEQ ID NO: 5167283 - DNA, 21 bp, Homo sapiens
agaaaccagttatgtgaatga

SEQ ID NO: 5167284 - DNA, 19 bp, Homo sapiens
agaaaccatgcaaagcaac

SEQ ID NO: 5167285 - DNA, 16 bp, Homo sapiens
agaaacccaagctcct

SEQ ID NO: 5167286 - DNA, 18 bp, Homo sapiens
agaaacccaagctcctcc

SEQ ID NO: 5167287 - DNA, 19 bp, Homo sapiens
agaaacccaagctcctcct

SEQ ID NO: 5167288 - DNA, 20 bp, Homo sapiens
agaaacccaagctcctcctc

SEQ ID NO: 5167289 - DNA, 19 bp, Homo sapiens
agaaacccacagaagggga

SEQ ID NO: 5167290 - DNA, 16 bp, Homo sapiens
agaaacccaccagcct

SEQ ID NO: 5167291 - DNA, 21 bp, Homo sapiens
agaaacccacgacctgtcctg

SEQ ID NO: 5167292 - DNA, 15 bp, Homo sapiens
agaaacccccaggag

SEQ ID NO: 5167293 - DNA, 17 bp, Homo sapiens
agaaacccccaggagga

SEQ ID NO: 5167294 - DNA, 22 bp, Homo sapiens
agaaaccccgggccatcccact

SEQ ID NO: 5167295 - DNA, 18 bp, Homo sapiens
agaaacccgacagaggga

SEQ ID NO: 5167296 - DNA, 21 bp, Homo sapiens
agaaaccctcattgtgtttct

SEQ ID NO: 5167297 - DNA, 14 bp, Homo sapiens
agaaaccctgtctc

SEQ ID NO: 5167298 - DNA, 16 bp, Homo sapiens
agaaaccctgtctcta

SEQ ID NO: 5167299 - DNA, 16 bp, Homo sapiens
agaaaccgtcctcttt

SEQ ID NO: 5167300 - DNA, 20 bp, Homo sapiens
agaaacctacagaatactag

SEQ ID NO: 5167301 - DNA, 20 bp, Homo sapiens
actggtgtaatctcaatgca

SEQ ID NO: 5167302 - DNA, 21 bp, Homo sapiens
actggtgtaatctcaatgcaa

SEQ ID NO: 5167303 - DNA, 23 bp, Homo sapiens
actggtgtcataaactttctcca

SEQ ID NO: 5167304 - DNA, 15 bp, Homo sapiens
actggtgttaatgag

SEQ ID NO: 5167305 - DNA, 18 bp, Homo sapiens
actggttaaatcaattct

SEQ ID NO: 5167306 - DNA, 16 bp, Homo sapiens
actggttacctggaga

SEQ ID NO: 5167307 - DNA, 19 bp, Homo sapiens
actggttactcagctccct

SEQ ID NO: 5167308 - DNA, 17 bp, Homo sapiens
actggttagtgtgaaat

SEQ ID NO: 5167309 - DNA, 23 bp, Homo sapiens
actggttatagttgatatgtaac

SEQ ID NO: 5167310 - DNA, 18 bp, Homo sapiens
actggttatcacaccatc

SEQ ID NO: 5167311 - DNA, 20 bp, Homo sapiens
actggttatcctgtgctaca

SEQ ID NO: 5167312 - DNA, 21 bp, Homo sapiens
actggttcagaaatagctcct

SEQ ID NO: 5167313 - DNA, 13 bp, Homo sapiens
actggttcaggct

SEQ ID NO: 5167314 - DNA, 18 bp, Homo sapiens
actggttccatggcctct

SEQ ID NO: 5167315 - DNA, 23 bp, Homo sapiens
actggttccttaagtggctgtga

SEQ ID NO: 5167316 - DNA, 20 bp, Homo sapiens
actggttccttccttagttt

SEQ ID NO: 5167317 - DNA, 16 bp, Homo sapiens
actggttccttcttcc

SEQ ID NO: 5167318 - DNA, 16 bp, Homo sapiens
actggttctacaaatt

SEQ ID NO: 5167319 - DNA, 17 bp, Homo sapiens
actggttctacaaattt

SEQ ID NO: 5167320 - DNA, 12 bp, Homo sapiens
actggttctcaa

SEQ ID NO: 5167321 - DNA, 21 bp, Homo sapiens
actggttcttgccttcccctt

SEQ ID NO: 5167322 - DNA, 20 bp, Homo sapiens
actggttgagggagtgggga

SEQ ID NO: 5167323 - DNA, 15 bp, Homo sapiens
actggttgcatggaa

SEQ ID NO: 5167324 - DNA, 16 bp, Homo sapiens
actggttggtgttctt

SEQ ID NO: 5167325 - DNA, 19 bp, Homo sapiens
actggttggttttgccatt

SEQ ID NO: 5167326 - DNA, 14 bp, Homo sapiens
actggttgtatatt

SEQ ID NO: 5167327 - DNA, 15 bp, Homo sapiens
actggttgtcagaat

SEQ ID NO: 5167328 - DNA, 16 bp, Homo sapiens
actggttgtgaataat

SEQ ID NO: 5167329 - DNA, 20 bp, Homo sapiens
actggttgttgccaaacagc

SEQ ID NO: 5167330 - DNA, 15 bp, Homo sapiens
actggtttacaaata

SEQ ID NO: 5167331 - DNA, 18 bp, Homo sapiens
actggtttacaggccctg

SEQ ID NO: 5167332 - DNA, 17 bp, Homo sapiens
actggtttataataaac

SEQ ID NO: 5167333 - DNA, 19 bp, Homo sapiens
actggtttataataaactc

SEQ ID NO: 5167334 - DNA, 18 bp, Homo sapiens
actggtttcaagaatatg

SEQ ID NO: 5167335 - DNA, 22 bp, Homo sapiens
actggtttccccagggaaggaa

SEQ ID NO: 5167336 - DNA, 14 bp, Homo sapiens
actggtttctcaga

SEQ ID NO: 5167337 - DNA, 23 bp, Homo sapiens
actggtttctcagaatccaaaga

SEQ ID NO: 5167338 - DNA, 20 bp, Homo sapiens
actggtttgaagaatgttaa

SEQ ID NO: 5167339 - DNA, 14 bp, Homo sapiens
actggtttgagatt

SEQ ID NO: 5167340 - DNA, 16 bp, Homo sapiens
actggtttgccaggcc

SEQ ID NO: 5167341 - DNA, 21 bp, Homo sapiens
actggtttgtatgatgtatta

SEQ ID NO: 5167342 - DNA, 17 bp, Homo sapiens
actggtttgttccctgt

SEQ ID NO: 5167343 - DNA, 18 bp, Homo sapiens
actggtttgtttgcttaa

SEQ ID NO: 5167344 - DNA, 19 bp, Homo sapiens
actggttttggccacccct

SEQ ID NO: 5167345 - DNA, 15 bp, Homo sapiens
actgtaaaaataaca

SEQ ID NO: 5167346 - DNA, 22 bp, Homo sapiens
actgtaaaagttataataactg

SEQ ID NO: 5167347 - DNA, 16 bp, Homo sapiens
actgtaaaatgaaatt

SEQ ID NO: 5167348 - DNA, 13 bp, Homo sapiens
actgtaaacagtt

SEQ ID NO: 5167349 - DNA, 17 bp, Homo sapiens
actgtaaaccaattttt

SEQ ID NO: 5167350 - DNA, 14 bp, Homo sapiens
actgtaaacccctg

SEQ ID NO: 5167351 - DNA, 17 bp, Homo sapiens
actgtaaacttctgcaa

SEQ ID NO: 5167352 - DNA, 21 bp, Homo sapiens
actgtaaacttggaatcaagg

SEQ ID NO: 5167353 - DNA, 13 bp, Homo sapiens
actgtaaagaaag

SEQ ID NO: 5167354 - DNA, 14 bp, Homo sapiens
actgtaaagaaaga

SEQ ID NO: 5167355 - DNA, 15 bp, Homo sapiens
actgtaaagaaagag

SEQ ID NO: 5167356 - DNA, 17 bp, Homo sapiens
actgtaaagagacctac

SEQ ID NO: 5167357 - DNA, 18 bp, Homo sapiens
actgtaaagatgaatgtc

SEQ ID NO: 5167358 - DNA, 18 bp, Homo sapiens
actgtaaataaaaagaaa

SEQ ID NO: 5167359 - DNA, 12 bp, Homo sapiens
actgtaaataca

SEQ ID NO: 5167360 - DNA, 16 bp, Homo sapiens
actgtaaatatccaca

SEQ ID NO: 5167361 - DNA, 19 bp, Homo sapiens
actgtaaatatgtttgtgc

SEQ ID NO: 5167362 - DNA, 23 bp, Homo sapiens
actgtaaatatgtttgtgcctta

SEQ ID NO: 5167363 - DNA, 22 bp, Homo sapiens
actgtaaatatttatttatgtg

SEQ ID NO: 5167364 - DNA, 23 bp, Homo sapiens
actgtaaatcacttgtaaataaa

SEQ ID NO: 5167365 - DNA, 12 bp, Homo sapiens
actgtaaatcat

SEQ ID NO: 5167366 - DNA, 16 bp, Homo sapiens
actgtaaatcataatg

SEQ ID NO: 5167367 - DNA, 13 bp, Homo sapiens
actgtaaatgtat

SEQ ID NO: 5167368 - DNA, 17 bp, Homo sapiens
actgtaaattccaaaga

SEQ ID NO: 5167369 - DNA, 20 bp, Homo sapiens
actgtaaattccaaagatct

SEQ ID NO: 5167370 - DNA, 17 bp, Homo sapiens
actgtaaatttaataga

SEQ ID NO: 5167371 - DNA, 18 bp, Homo sapiens
actgtaacctcaaactct

SEQ ID NO: 5167372 - DNA, 12 bp, Homo sapiens
actgtaacctga

SEQ ID NO: 5167373 - DNA, 16 bp, Homo sapiens
actgtaactgattaca

SEQ ID NO: 5167374 - DNA, 15 bp, Homo sapiens
actgtaactgctcag

SEQ ID NO: 5167375 - DNA, 20 bp, Homo sapiens
actgtaactgctcagagctt

SEQ ID NO: 5167376 - DNA, 22 bp, Homo sapiens
actgtaactgtgtcatgattca

SEQ ID NO: 5167377 - DNA, 20 bp, Homo sapiens
actgtaacttccaaataaat

SEQ ID NO: 5167378 - DNA, 12 bp, Homo sapiens
actgtaactttt

SEQ ID NO: 5167379 - DNA, 21 bp, Homo sapiens
actgtaactttttttcagttc

SEQ ID NO: 5167380 - DNA, 14 bp, Homo sapiens
actgtaagaataat

SEQ ID NO: 5167381 - DNA, 18 bp, Homo sapiens
actgtaagagacatgaat

SEQ ID NO: 5167382 - DNA, 13 bp, Homo sapiens
actgtaagatgtt

SEQ ID NO: 5167383 - DNA, 17 bp, Homo sapiens
actgtaaggaaatgtta

SEQ ID NO: 5167384 - DNA, 16 bp, Homo sapiens
actgtaataatacctc

SEQ ID NO: 5167385 - DNA, 14 bp, Homo sapiens
actgtaatatcttt

SEQ ID NO: 5167386 - DNA, 16 bp, Homo sapiens
actgtaatatctttaa

SEQ ID NO: 5167387 - DNA, 14 bp, Homo sapiens
actgtaatcttaaa

SEQ ID NO: 5167388 - DNA, 20 bp, Homo sapiens
actgtaatgctgcctcagga

SEQ ID NO: 5167389 - DNA, 15 bp, Homo sapiens
actgtaatgggtaat

SEQ ID NO: 5167390 - DNA, 13 bp, Homo sapiens
actgtaatgtgaa

SEQ ID NO: 5167391 - DNA, 15 bp, Homo sapiens
actgtaatgtgaatc

SEQ ID NO: 5167392 - DNA, 17 bp, Homo sapiens
actgtaattaagtgcaa

SEQ ID NO: 5167393 - DNA, 22 bp, Homo sapiens
actgtaattggtgacaatgtca

SEQ ID NO: 5167394 - DNA, 20 bp, Homo sapiens
actgtaattttgtttgtaat

SEQ ID NO: 5167395 - DNA, 17 bp, Homo sapiens
actgtacaaaaaaatct

SEQ ID NO: 5167396 - DNA, 22 bp, Homo sapiens
actgtacaaagtagaagtctta

SEQ ID NO: 5167397 - DNA, 13 bp, Homo sapiens
actgtacaaatga

SEQ ID NO: 5167398 - DNA, 17 bp, Homo sapiens
actgtacaataaaaaca

SEQ ID NO: 5167399 - DNA, 15 bp, Homo sapiens
actgtacaataagtt

SEQ ID NO: 5167400 - DNA, 22 bp, Homo sapiens
actgtacaatgactttattgca

SEQ ID NO: 5167401 - DNA, 13 bp, Homo sapiens
actgtacacactt

SEQ ID NO: 5167402 - DNA, 15 bp, Homo sapiens
actgtacacacttta

SEQ ID NO: 5167403 - DNA, 21 bp, Homo sapiens
actgtacaccatagtttacaa

SEQ ID NO: 5167404 - DNA, 14 bp, Homo sapiens
actgtacagaattt

SEQ ID NO: 5167405 - DNA, 14 bp, Homo sapiens
actgtacagagact

SEQ ID NO: 5167406 - DNA, 18 bp, Homo sapiens
actgtacagctggctcta

SEQ ID NO: 5167407 - DNA, 13 bp, Homo sapiens
actgtacagtttt

SEQ ID NO: 5167408 - DNA, 18 bp, Homo sapiens
actgtacataattgcatg

SEQ ID NO: 5167409 - DNA, 19 bp, Homo sapiens
actgtacatgaaaacacat

SEQ ID NO: 5167410 - DNA, 13 bp, Homo sapiens
actgtacattgtg

SEQ ID NO: 5167411 - DNA, 16 bp, Homo sapiens
actgtacatttaaaat

SEQ ID NO: 5167412 - DNA, 17 bp, Homo sapiens
actgtacccaaatggaa

SEQ ID NO: 5167413 - DNA, 12 bp, Homo sapiens
actgtacctgta

SEQ ID NO: 5167414 - DNA, 18 bp, Homo sapiens
actgtacctgtaggaaac

SEQ ID NO: 5167415 - DNA, 19 bp, Homo sapiens
actgtacctgtaggaaaca

SEQ ID NO: 5167416 - DNA, 17 bp, Homo sapiens
actgtactagtctgtgt

SEQ ID NO: 5167417 - DNA, 13 bp, Homo sapiens
actgtactgaaga

SEQ ID NO: 5167418 - DNA, 12 bp, Homo sapiens
actgtactgaat

SEQ ID NO: 5167419 - DNA, 13 bp, Homo sapiens
actgtactgcatg

SEQ ID NO: 5167420 - DNA, 15 bp, Homo sapiens
actgtactgcatgtg

SEQ ID NO: 5167421 - DNA, 12 bp, Homo sapiens
actgtactgtgt

SEQ ID NO: 5167422 - DNA, 15 bp, Homo sapiens
actgtacttcactgt

SEQ ID NO: 5167423 - DNA, 19 bp, Homo sapiens
actgtacttgatttttcaa

SEQ ID NO: 5167424 - DNA, 23 bp, Homo sapiens
actgtacttgatttttcaaagac

SEQ ID NO: 5167425 - DNA, 12 bp, Homo sapiens
actgtacttttt

SEQ ID NO: 5167426 - DNA, 14 bp, Homo sapiens
actgtagaaaggaa

SEQ ID NO: 5167427 - DNA, 20 bp, Homo sapiens
actgtagaaaggaaatagac

SEQ ID NO: 5167428 - DNA, 21 bp, Homo sapiens
actgtagaactgattttacaa

SEQ ID NO: 5167429 - DNA, 22 bp, Homo sapiens
actgtagaagaagcccatatca

SEQ ID NO: 5167430 - DNA, 22 bp, Homo sapiens
actgtagaagaagtgaacactt

SEQ ID NO: 5167431 - DNA, 20 bp, Homo sapiens
actgtagatatgtattcttt

SEQ ID NO: 5167432 - DNA, 15 bp, Homo sapiens
actgtagatgatgta

SEQ ID NO: 5167433 - DNA, 16 bp, Homo sapiens
actgtagattgcttct

SEQ ID NO: 5167434 - DNA, 17 bp, Homo sapiens
actgtagattgcttctg

SEQ ID NO: 5167435 - DNA, 13 bp, Homo sapiens
actgtagatttca

SEQ ID NO: 5167436 - DNA, 15 bp, Homo sapiens
actgtagcaggggaa

SEQ ID NO: 5167437 - DNA, 14 bp, Homo sapiens
actgtagccacagc

SEQ ID NO: 5167438 - DNA, 17 bp, Homo sapiens
actgtagcgaccccaga

SEQ ID NO: 5167439 - DNA, 18 bp, Homo sapiens
actgtagcgaccccagac

SEQ ID NO: 5167440 - DNA, 20 bp, Homo sapiens
actgtagcgaccccagactg

SEQ ID NO: 5167441 - DNA, 17 bp, Homo sapiens
actgtagctacattttc

SEQ ID NO: 5167442 - DNA, 21 bp, Homo sapiens
actgtagctacattttcagaa

SEQ ID NO: 5167443 - DNA, 18 bp, Homo sapiens
actgtagctcaagtttaa

SEQ ID NO: 5167444 - DNA, 19 bp, Homo sapiens
actgtagctcaagtttaaa

SEQ ID NO: 5167445 - DNA, 19 bp, Homo sapiens
actgtagctctaaaatctg

SEQ ID NO: 5167446 - DNA, 15 bp, Homo sapiens
actgtagcttctctt

SEQ ID NO: 5167447 - DNA, 19 bp, Homo sapiens
actgtagcttttaggaata

SEQ ID NO: 5167448 - DNA, 18 bp, Homo sapiens
actgtaggcgcccctggg

SEQ ID NO: 5167449 - DNA, 19 bp, Homo sapiens
actgtaggcgcccctgggg

SEQ ID NO: 5167450 - DNA, 20 bp, Homo sapiens
actgtaggcgcccctggggt

SEQ ID NO: 5167451 - DNA, 13 bp, Homo sapiens
actgtagggaggg

SEQ ID NO: 5167452 - DNA, 12 bp, Homo sapiens
actgtagggcca

SEQ ID NO: 5167453 - DNA, 21 bp, Homo sapiens
actgtaggtatgatctcttct

SEQ ID NO: 5167454 - DNA, 12 bp, Homo sapiens
actgtaggtgtt

SEQ ID NO: 5167455 - DNA, 18 bp, Homo sapiens
actgtaggtgttatgtat

SEQ ID NO: 5167456 - DNA, 19 bp, Homo sapiens
actgtagtaaataatgctt

SEQ ID NO: 5167457 - DNA, 21 bp, Homo sapiens
actgtagtaaataatgctttg

SEQ ID NO: 5167458 - DNA, 15 bp, Homo sapiens
actgtagtctcagga

SEQ ID NO: 5167459 - DNA, 16 bp, Homo sapiens
actgtagtctcaggac

SEQ ID NO: 5167460 - DNA, 15 bp, Homo sapiens
actgtagttctaaga

SEQ ID NO: 5167461 - DNA, 19 bp, Homo sapiens
actgtagtttaatactttt

SEQ ID NO: 5167462 - DNA, 18 bp, Homo sapiens
actgtagtttagttctgt

SEQ ID NO: 5167463 - DNA, 23 bp, Homo sapiens
actgtagtttagttctgttgacc

SEQ ID NO: 5167464 - DNA, 20 bp, Homo sapiens
actgtagtttttcttcaaca

SEQ ID NO: 5167465 - DNA, 21 bp, Homo sapiens
actgtagtttttcttcaacat

SEQ ID NO: 5167466 - DNA, 16 bp, Homo sapiens
actgtagtttttgaaa

SEQ ID NO: 5167467 - DNA, 15 bp, Homo sapiens
actgtataaatagga

SEQ ID NO: 5167468 - DNA, 11 bp, Homo sapiens
actgtatactg

SEQ ID NO: 5167469 - DNA, 15 bp, Homo sapiens
actgtatagacagtt

SEQ ID NO: 5167470 - DNA, 17 bp, Homo sapiens
actgtatagacagtttg

SEQ ID NO: 5167471 - DNA, 22 bp, Homo sapiens
actgtatagacagtttgtaaat

SEQ ID NO: 5167472 - DNA, 17 bp, Homo sapiens
actgtatagtaatcatt

SEQ ID NO: 5167473 - DNA, 17 bp, Homo sapiens
actgtatataaacatat

SEQ ID NO: 5167474 - DNA, 20 bp, Homo sapiens
actgtatataaacatatttt

SEQ ID NO: 5167475 - DNA, 13 bp, Homo sapiens
actgtatataaag

SEQ ID NO: 5167476 - DNA, 18 bp, Homo sapiens
actgtatataaaggaaaa

SEQ ID NO: 5167477 - DNA, 14 bp, Homo sapiens
actgtatatgtatt

SEQ ID NO: 5167478 - DNA, 19 bp, Homo sapiens
actgtatatgtcaaaaata

SEQ ID NO: 5167479 - DNA, 20 bp, Homo sapiens
actgtatatgtcaaaaatat

SEQ ID NO: 5167480 - DNA, 16 bp, Homo sapiens
actgtatattacagat

SEQ ID NO: 5167481 - DNA, 15 bp, Homo sapiens
agaaacctactgccc

SEQ ID NO: 5167482 - DNA, 19 bp, Homo sapiens
agaaacctagggttttcta

SEQ ID NO: 5167483 - DNA, 21 bp, Homo sapiens
agaaacctattaagtcatcat

SEQ ID NO: 5167484 - DNA, 18 bp, Homo sapiens
agaaacctccatcctgcc

SEQ ID NO: 5167485 - DNA, 23 bp, Homo sapiens
agaaacctccatcctgccaggag

SEQ ID NO: 5167486 - DNA, 12 bp, Homo sapiens
agaaacctgcca

SEQ ID NO: 5167487 - DNA, 19 bp, Homo sapiens
agaaacctgccaaggagca

SEQ ID NO: 5167488 - DNA, 16 bp, Homo sapiens
agaaacctgggagaga

SEQ ID NO: 5167489 - DNA, 13 bp, Homo sapiens
agaaacctgtatc

SEQ ID NO: 5167490 - DNA, 18 bp, Homo sapiens
agaaaccttattgtacct

SEQ ID NO: 5167491 - DNA, 19 bp, Homo sapiens
agaaaccttgctctcctca

SEQ ID NO: 5167492 - DNA, 14 bp, Homo sapiens
agaaaccttttatt

SEQ ID NO: 5167493 - DNA, 21 bp, Homo sapiens
agaaacgagttggtgtctttc

SEQ ID NO: 5167494 - DNA, 22 bp, Homo sapiens
agaaacggtctttatgaattat

SEQ ID NO: 5167495 - DNA, 17 bp, Homo sapiens
agaaacgtaaactatga

SEQ ID NO: 5167496 - DNA, 15 bp, Homo sapiens
agaaacgtcttctaa

SEQ ID NO: 5167497 - DNA, 18 bp, Homo sapiens
agaaacgtgataaatata

SEQ ID NO: 5167498 - DNA, 19 bp, Homo sapiens
agaaacgtgataaatatat

SEQ ID NO: 5167499 - DNA, 19 bp, Homo sapiens
agaaacgtttggaacaatc

SEQ ID NO: 5167500 - DNA, 17 bp, Homo sapiens
agaaactaaacagaaaa

SEQ ID NO: 5167501 - DNA, 21 bp, Homo sapiens
agaaactaaactaaaatagtt

SEQ ID NO: 5167502 - DNA, 17 bp, Homo sapiens
agaaactactaattttt

SEQ ID NO: 5167503 - DNA, 18 bp, Homo sapiens
agaaactactaatttttt

SEQ ID NO: 5167504 - DNA, 20 bp, Homo sapiens
agaaactcacgatgaaattg

SEQ ID NO: 5167505 - DNA, 17 bp, Homo sapiens
agaaactccaaagtcca

SEQ ID NO: 5167506 - DNA, 21 bp, Homo sapiens
agaaactccaaagtccacaca

SEQ ID NO: 5167507 - DNA, 13 bp, Homo sapiens
agaaactcccctg

SEQ ID NO: 5167508 - DNA, 13 bp, Homo sapiens
agaaactcctgtt

SEQ ID NO: 5167509 - DNA, 20 bp, Homo sapiens
agaaactccttttgctgtct

SEQ ID NO: 5167510 - DNA, 22 bp, Homo sapiens
agaaactccttttgctgtcttt

SEQ ID NO: 5167511 - DNA, 18 bp, Homo sapiens
agaaactgaaaaatatct

SEQ ID NO: 5167512 - DNA, 16 bp, Homo sapiens
agaaactgagaccaaa

SEQ ID NO: 5167513 - DNA, 13 bp, Homo sapiens
agaaactgaggaa

SEQ ID NO: 5167514 - DNA, 18 bp, Homo sapiens
agaaactgaggaattttc

SEQ ID NO: 5167515 - DNA, 16 bp, Homo sapiens
agaaactgaggagtag

SEQ ID NO: 5167516 - DNA, 22 bp, Homo sapiens
agaaactgaggagtagctgaga

SEQ ID NO: 5167517 - DNA, 17 bp, Homo sapiens
agaaactgaggcccaga

SEQ ID NO: 5167518 - DNA, 13 bp, Homo sapiens
agaaactgatgcc

SEQ ID NO: 5167519 - DNA, 21 bp, Homo sapiens
agaaactggattaaaacaatt

SEQ ID NO: 5167520 - DNA, 14 bp, Homo sapiens
agaaactgtagtct

SEQ ID NO: 5167521 - DNA, 20 bp, Homo sapiens
agaaactgtagtctcaggac

SEQ ID NO: 5167522 - DNA, 18 bp, Homo sapiens
agaaactgtccaaatgct

SEQ ID NO: 5167523 - DNA, 22 bp, Homo sapiens
agaaactgtctagcacttcctt

SEQ ID NO: 5167524 - DNA, 23 bp, Homo sapiens
agaaactgtctagcacttccttg

SEQ ID NO: 5167525 - DNA, 21 bp, Homo sapiens
agaaactgttcccacctgctg

SEQ ID NO: 5167526 - DNA, 22 bp, Homo sapiens
agaaactgttcccacctgctgg

SEQ ID NO: 5167527 - DNA, 23 bp, Homo sapiens
agaaacttaaatgttattatctg

SEQ ID NO: 5167528 - DNA, 16 bp, Homo sapiens
agaaacttaagcaaag

SEQ ID NO: 5167529 - DNA, 23 bp, Homo sapiens
agaaacttaaggttacctttgtt

SEQ ID NO: 5167530 - DNA, 20 bp, Homo sapiens
agaaacttaccaattgatgt

SEQ ID NO: 5167531 - DNA, 22 bp, Homo sapiens
agaaacttatttctcatatcaa

SEQ ID NO: 5167532 - DNA, 22 bp, Homo sapiens
agaaacttcctttgagaattgt

SEQ ID NO: 5167533 - DNA, 22 bp, Homo sapiens
agaaacttggctggaatttctg

SEQ ID NO: 5167534 - DNA, 13 bp, Homo sapiens
agaaacttgtaaa

SEQ ID NO: 5167535 - DNA, 14 bp, Homo sapiens
agaaacttgtaaat

SEQ ID NO: 5167536 - DNA, 22 bp, Homo sapiens
agaaactttattcaagtaaaaa

SEQ ID NO: 5167537 - DNA, 15 bp, Homo sapiens
agaaactttctttct

SEQ ID NO: 5167538 - DNA, 21 bp, Homo sapiens
agaaactttgagtacagatac

SEQ ID NO: 5167539 - DNA, 13 bp, Homo sapiens
agaaactttgcct

SEQ ID NO: 5167540 - DNA, 16 bp, Homo sapiens
agaaactttggaagca

SEQ ID NO: 5167541 - DNA, 12 bp, Homo sapiens
agaaacttttct

SEQ ID NO: 5167542 - DNA, 17 bp, Homo sapiens
agaaacttttgaaaaag

SEQ ID NO: 5167543 - DNA, 12 bp, Homo sapiens
agaaacttttgt

SEQ ID NO: 5167544 - DNA, 10 bp, Homo sapiens
agaaagaaaa

SEQ ID NO: 5167545 - DNA, 12 bp, Homo sapiens
agaaagaaaaaa

SEQ ID NO: 5167546 - DNA, 17 bp, Homo sapiens
agaaagaaaagaccctg

SEQ ID NO: 5167547 - DNA, 15 bp, Homo sapiens
agaaagaaaaggcaa

SEQ ID NO: 5167548 - DNA, 23 bp, Homo sapiens
agaaagaaaaggcaaaagactgg

SEQ ID NO: 5167549 - DNA, 16 bp, Homo sapiens
agaaagaaaatgaaga

SEQ ID NO: 5167550 - DNA, 14 bp, Homo sapiens
agaaagaaaattat

SEQ ID NO: 5167551 - DNA, 15 bp, Homo sapiens
agaaagaaaattata

SEQ ID NO: 5167552 - DNA, 23 bp, Homo sapiens
agaaagaaactaaacagaaaact

SEQ ID NO: 5167553 - DNA, 15 bp, Homo sapiens
agaaagaaaggaaag

SEQ ID NO: 5167554 - DNA, 21 bp, Homo sapiens
agaaagaaaggaaagaaggag

SEQ ID NO: 5167555 - DNA, 22 bp, Homo sapiens
agaaagaagacaaactttgcat

SEQ ID NO: 5167556 - DNA, 23 bp, Homo sapiens
agaaagaagaccctttgttgaaa

SEQ ID NO: 5167557 - DNA, 13 bp, Homo sapiens
agaaagaagcatt

SEQ ID NO: 5167558 - DNA, 12 bp, Homo sapiens
agaaagaagcca

SEQ ID NO: 5167559 - DNA, 14 bp, Homo sapiens
agaaagaagccata

SEQ ID NO: 5167560 - DNA, 12 bp, Homo sapiens
agaaagaaggaa

SEQ ID NO: 5167561 - DNA, 15 bp, Homo sapiens
agaaagaataaaatg

SEQ ID NO: 5167562 - DNA, 17 bp, Homo sapiens
agaaagaataaaatgtt

SEQ ID NO: 5167563 - DNA, 11 bp, Homo sapiens
agaaagaatga

SEQ ID NO: 5167564 - DNA, 12 bp, Homo sapiens
agaaagaatgag

SEQ ID NO: 5167565 - DNA, 11 bp, Homo sapiens
agaaagaatgc

SEQ ID NO: 5167566 - DNA, 22 bp, Homo sapiens
agaaagaatgttactgccttaa

SEQ ID NO: 5167567 - DNA, 20 bp, Homo sapiens
agaaagactatctaaatgtt

SEQ ID NO: 5167568 - DNA, 19 bp, Homo sapiens
agaaagactattcaaacag

SEQ ID NO: 5167569 - DNA, 24 bp, Homo sapiens
agaaagagaatgaactgtggaatt

SEQ ID NO: 5167570 - DNA, 16 bp, Homo sapiens
agaaagagactgtggg

SEQ ID NO: 5167571 - DNA, 11 bp, Homo sapiens
agaaagagaga

SEQ ID NO: 5167572 - DNA, 12 bp, Homo sapiens
agaaagagagaa

SEQ ID NO: 5167573 - DNA, 22 bp, Homo sapiens
agaaagagagaaaataaaaagt

SEQ ID NO: 5167574 - DNA, 13 bp, Homo sapiens
agaaagagagaga

SEQ ID NO: 5167575 - DNA, 15 bp, Homo sapiens
agaaagagagagata

SEQ ID NO: 5167576 - DNA, 19 bp, Homo sapiens
agaaagagcacttaagaga

SEQ ID NO: 5167577 - DNA, 22 bp, Homo sapiens
agaaagagcacttaagagaata

SEQ ID NO: 5167578 - DNA, 12 bp, Homo sapiens
agaaagagctac

SEQ ID NO: 5167579 - DNA, 16 bp, Homo sapiens
agaaagaggagtgctt

SEQ ID NO: 5167580 - DNA, 19 bp, Homo sapiens
agaaagagggaaaaagagc

SEQ ID NO: 5167581 - DNA, 14 bp, Homo sapiens
agaaagagggacaa

SEQ ID NO: 5167582 - DNA, 15 bp, Homo sapiens
agaaagaggtctccc

SEQ ID NO: 5167583 - DNA, 23 bp, Homo sapiens
agaaagaggtctccccatcccca

SEQ ID NO: 5167584 - DNA, 19 bp, Homo sapiens
agaaagaggtgaccccagg

SEQ ID NO: 5167585 - DNA, 20 bp, Homo sapiens
agaaagaggtgaccccaggg

SEQ ID NO: 5167586 - DNA, 23 bp, Homo sapiens
agaaagaggtgaccccagggcac

SEQ ID NO: 5167587 - DNA, 18 bp, Homo sapiens
agaaagatatctatgact

SEQ ID NO: 5167588 - DNA, 13 bp, Homo sapiens
agaaagatccacc

SEQ ID NO: 5167589 - DNA, 16 bp, Homo sapiens
agaaagatgaaactga

SEQ ID NO: 5167590 - DNA, 17 bp, Homo sapiens
agaaagatgaagaagaa

SEQ ID NO: 5167591 - DNA, 15 bp, Homo sapiens
agaaagatggagagg

SEQ ID NO: 5167592 - DNA, 21 bp, Homo sapiens
agaaagatgttccagtgagga

SEQ ID NO: 5167593 - DNA, 14 bp, Homo sapiens
agaaagattaaata

SEQ ID NO: 5167594 - DNA, 17 bp, Homo sapiens
agaaagattgtaaacta

SEQ ID NO: 5167595 - DNA, 18 bp, Homo sapiens
agaaagattgtaaactaa

SEQ ID NO: 5167596 - DNA, 22 bp, Homo sapiens
agaaagattgtaaactaaagtg

SEQ ID NO: 5167597 - DNA, 16 bp, Homo sapiens
agaaagatttgatggg

SEQ ID NO: 5167598 - DNA, 19 bp, Homo sapiens
agaaagatttgatgggcca

SEQ ID NO: 5167599 - DNA, 15 bp, Homo sapiens
agaaagatttggaaa

SEQ ID NO: 5167600 - DNA, 20 bp, Homo sapiens
agaaagatttgttactgtat

SEQ ID NO: 5167601 - DNA, 18 bp, Homo sapiens
agaaagattttatgtgct

SEQ ID NO: 5167602 - DNA, 13 bp, Homo sapiens
agaaagcaaaaaa

SEQ ID NO: 5167603 - DNA, 14 bp, Homo sapiens
agaaagcaaaaaat

SEQ ID NO: 5167604 - DNA, 13 bp, Homo sapiens
agaaagcaaaata

SEQ ID NO: 5167605 - DNA, 15 bp, Homo sapiens
agaaagcaaaataca

SEQ ID NO: 5167606 - DNA, 21 bp, Homo sapiens
agaaagcaaaattatgtttgc

SEQ ID NO: 5167607 - DNA, 15 bp, Homo sapiens
agaaagcaaaggtgc

SEQ ID NO: 5167608 - DNA, 18 bp, Homo sapiens
agaaagcaaatcagacac

SEQ ID NO: 5167609 - DNA, 15 bp, Homo sapiens
agaaagcaagatgta

SEQ ID NO: 5167610 - DNA, 21 bp, Homo sapiens
agaaagcaatacgtttgtgca

SEQ ID NO: 5167611 - DNA, 16 bp, Homo sapiens
agaaagcacaaagaat

SEQ ID NO: 5167612 - DNA, 21 bp, Homo sapiens
agaaagcacaatttaaaacaa

SEQ ID NO: 5167613 - DNA, 20 bp, Homo sapiens
agaaagcactacaatcatgg

SEQ ID NO: 5167614 - DNA, 17 bp, Homo sapiens
agaaagcagaacagtga

SEQ ID NO: 5167615 - DNA, 21 bp, Homo sapiens
agaaagcagatacctcaccct

SEQ ID NO: 5167616 - DNA, 19 bp, Homo sapiens
agaaagcaggagcagctgt

SEQ ID NO: 5167617 - DNA, 12 bp, Homo sapiens
agaaagcagggg

SEQ ID NO: 5167618 - DNA, 16 bp, Homo sapiens
agaaagcatattgact

SEQ ID NO: 5167619 - DNA, 17 bp, Homo sapiens
agaaagcatattgactt

SEQ ID NO: 5167620 - DNA, 22 bp, Homo sapiens
agaaagcatccctcacccatcc

SEQ ID NO: 5167621 - DNA, 17 bp, Homo sapiens
agaaagcatctattccc

SEQ ID NO: 5167622 - DNA, 23 bp, Homo sapiens
agaaagcatttcttttctcttta

SEQ ID NO: 5167623 - DNA, 17 bp, Homo sapiens
agaaagcatttgaatgc

SEQ ID NO: 5167624 - DNA, 20 bp, Homo sapiens
agaaagcatttgaatgcatt

SEQ ID NO: 5167625 - DNA, 21 bp, Homo sapiens
agaaagccaaatcaaaatatg

SEQ ID NO: 5167626 - DNA, 12 bp, Homo sapiens
agaaagccacgc

SEQ ID NO: 5167627 - DNA, 19 bp, Homo sapiens
agaaagccacgccctccct

SEQ ID NO: 5167628 - DNA, 16 bp, Homo sapiens
agaaagccagacaact

SEQ ID NO: 5167629 - DNA, 19 bp, Homo sapiens
agaaagccatattccagca

SEQ ID NO: 5167630 - DNA, 14 bp, Homo sapiens
agaaagccatattt

SEQ ID NO: 5167631 - DNA, 19 bp, Homo sapiens
agaaagcccctcacctcag

SEQ ID NO: 5167632 - DNA, 22 bp, Homo sapiens
agaaagcccctcacctcaggac

SEQ ID NO: 5167633 - DNA, 16 bp, Homo sapiens
agaaagccctgtgctt

SEQ ID NO: 5167634 - DNA, 18 bp, Homo sapiens
agaaagccgggggagggg

SEQ ID NO: 5167635 - DNA, 21 bp, Homo sapiens
agaaagcctcagagaattgct

SEQ ID NO: 5167636 - DNA, 19 bp, Homo sapiens
agaaagcctccgctgggct

SEQ ID NO: 5167637 - DNA, 21 bp, Homo sapiens
agaaagcctcctgccccctgc

SEQ ID NO: 5167638 - DNA, 19 bp, Homo sapiens
agaaagcctctctctccct

SEQ ID NO: 5167639 - DNA, 19 bp, Homo sapiens
agaaagcctgttcccctca

SEQ ID NO: 5167640 - DNA, 22 bp, Homo sapiens
agaaagcctgttcccctcactg

SEQ ID NO: 5167641 - DNA, 18 bp, Homo sapiens
agaaagcctgttgtttaa

SEQ ID NO: 5167642 - DNA, 22 bp, Homo sapiens
agaaagcctttcattttgcttt

SEQ ID NO: 5167643 - DNA, 14 bp, Homo sapiens
agaaagctaaatga

SEQ ID NO: 5167644 - DNA, 14 bp, Homo sapiens
agaaagctaataca

SEQ ID NO: 5167645 - DNA, 18 bp, Homo sapiens
agaaagctatatatgaat

SEQ ID NO: 5167646 - DNA, 17 bp, Homo sapiens
agaaagctccttccaga

SEQ ID NO: 5167647 - DNA, 18 bp, Homo sapiens
agaaagctctacatttgc

SEQ ID NO: 5167648 - DNA, 21 bp, Homo sapiens
agaaagctctgcatgtgtgtt

SEQ ID NO: 5167649 - DNA, 13 bp, Homo sapiens
agaaagctgactt

SEQ ID NO: 5167650 - DNA, 15 bp, Homo sapiens
agaaagctgacttgg

SEQ ID NO: 5167651 - DNA, 20 bp, Homo sapiens
agaaagctgaggaacaggtt

SEQ ID NO: 5167652 - DNA, 14 bp, Homo sapiens
agaaagctgccaga

SEQ ID NO: 5167653 - DNA, 21 bp, Homo sapiens
agaaagctggactgaccaaag

SEQ ID NO: 5167654 - DNA, 15 bp, Homo sapiens
agaaagctgtgaaat

SEQ ID NO: 5167655 - DNA, 16 bp, Homo sapiens
agaaagctgtgaacag

SEQ ID NO: 5167656 - DNA, 21 bp, Homo sapiens
agaaagcttcatccacagcct

SEQ ID NO: 5167657 - DNA, 19 bp, Homo sapiens
agaaagcttccttcaacct

SEQ ID NO: 5167658 - DNA, 18 bp, Homo sapiens
agaaaggaaaaacaaact

SEQ ID NO: 5167659 - DNA, 14 bp, Homo sapiens
actgtatattcagg

SEQ ID NO: 5167660 - DNA, 13 bp, Homo sapiens
actgtatatttgt

SEQ ID NO: 5167661 - DNA, 15 bp, Homo sapiens
actgtatatttgtat

SEQ ID NO: 5167662 - DNA, 13 bp, Homo sapiens
actgtatattttg

SEQ ID NO: 5167663 - DNA, 23 bp, Homo sapiens
actgtatattttgtagttaatat

SEQ ID NO: 5167664 - DNA, 17 bp, Homo sapiens
actgtatcaataaaatt

SEQ ID NO: 5167665 - DNA, 23 bp, Homo sapiens
actgtatcaataaaattctgtaa

SEQ ID NO: 5167666 - DNA, 16 bp, Homo sapiens
actgtatcagatgtga

SEQ ID NO: 5167667 - DNA, 17 bp, Homo sapiens
actgtatcagatgtgaa

SEQ ID NO: 5167668 - DNA, 16 bp, Homo sapiens
actgtatcatgacaaa

SEQ ID NO: 5167669 - DNA, 20 bp, Homo sapiens
actgtatcatgacaaagact

SEQ ID NO: 5167670 - DNA, 16 bp, Homo sapiens
actgtatcatttcatg

SEQ ID NO: 5167671 - DNA, 19 bp, Homo sapiens
actgtatcatttcatgctt

SEQ ID NO: 5167672 - DNA, 15 bp, Homo sapiens
actgtatcattttct

SEQ ID NO: 5167673 - DNA, 13 bp, Homo sapiens
actgtatccattc

SEQ ID NO: 5167674 - DNA, 18 bp, Homo sapiens
actgtatctaaaaaataa

SEQ ID NO: 5167675 - DNA, 20 bp, Homo sapiens
actgtatctaggcatttcat

SEQ ID NO: 5167676 - DNA, 23 bp, Homo sapiens
actgtatctgatgtttgttttcg

SEQ ID NO: 5167677 - DNA, 19 bp, Homo sapiens
actgtatgatcaaatgttt

SEQ ID NO: 5167678 - DNA, 15 bp, Homo sapiens
actgtatgatttata

SEQ ID NO: 5167679 - DNA, 16 bp, Homo sapiens
actgtatgccttctgt

SEQ ID NO: 5167680 - DNA, 23 bp, Homo sapiens
actgtatggaaacactgattttg

SEQ ID NO: 5167681 - DNA, 23 bp, Homo sapiens
actgtatgggggagattgaactt

SEQ ID NO: 5167682 - DNA, 14 bp, Homo sapiens
actgtatgtacata

SEQ ID NO: 5167683 - DNA, 15 bp, Homo sapiens
actgtatgtcttata

SEQ ID NO: 5167684 - DNA, 14 bp, Homo sapiens
actgtatgtgatga

SEQ ID NO: 5167685 - DNA, 16 bp, Homo sapiens
actgtatgtgatgaat

SEQ ID NO: 5167686 - DNA, 19 bp, Homo sapiens
actgtatgtttttactgaa

SEQ ID NO: 5167687 - DNA, 17 bp, Homo sapiens
actgtattaaagatgca

SEQ ID NO: 5167688 - DNA, 14 bp, Homo sapiens
actgtattaaatct

SEQ ID NO: 5167689 - DNA, 15 bp, Homo sapiens
actgtattaaatctt

SEQ ID NO: 5167690 - DNA, 18 bp, Homo sapiens
actgtattaaatcttaaa

SEQ ID NO: 5167691 - DNA, 22 bp, Homo sapiens
actgtattaaatcttaaacaat

SEQ ID NO: 5167692 - DNA, 13 bp, Homo sapiens
actgtattaagag

SEQ ID NO: 5167693 - DNA, 12 bp, Homo sapiens
actgtattgatg

SEQ ID NO: 5167694 - DNA, 19 bp, Homo sapiens
actgtattgggccttttgg

SEQ ID NO: 5167695 - DNA, 17 bp, Homo sapiens
actgtattgggcttctt

SEQ ID NO: 5167696 - DNA, 20 bp, Homo sapiens
actgtatttacttgttatgt

SEQ ID NO: 5167697 - DNA, 21 bp, Homo sapiens
actgtatttcagtattttcca

SEQ ID NO: 5167698 - DNA, 22 bp, Homo sapiens
actgtatttcagtattttccag

SEQ ID NO: 5167699 - DNA, 14 bp, Homo sapiens
actgtatttcatta

SEQ ID NO: 5167700 - DNA, 15 bp, Homo sapiens
actgtatttcattat

SEQ ID NO: 5167701 - DNA, 14 bp, Homo sapiens
actgtatttctgtg

SEQ ID NO: 5167702 - DNA, 14 bp, Homo sapiens
actgtatttgtatc

SEQ ID NO: 5167703 - DNA, 14 bp, Homo sapiens
actgtatttgttaa

SEQ ID NO: 5167704 - DNA, 15 bp, Homo sapiens
actgtatttttacta

SEQ ID NO: 5167705 - DNA, 19 bp, Homo sapiens
actgtatttttgaagacta

SEQ ID NO: 5167706 - DNA, 17 bp, Homo sapiens
actgtatttttttaact

SEQ ID NO: 5167707 - DNA, 19 bp, Homo sapiens
actgtcaaaataattttat

SEQ ID NO: 5167708 - DNA, 21 bp, Homo sapiens
actgtcaaaatatttctcatc

SEQ ID NO: 5167709 - DNA, 16 bp, Homo sapiens
actgtcaaatgaactt

SEQ ID NO: 5167710 - DNA, 17 bp, Homo sapiens
actgtcaaatgaacttt

SEQ ID NO: 5167711 - DNA, 15 bp, Homo sapiens
actgtcaaatgatgt

SEQ ID NO: 5167712 - DNA, 22 bp, Homo sapiens
actgtcaaggctgcttagaatc

SEQ ID NO: 5167713 - DNA, 23 bp, Homo sapiens
actgtcaagtcatgatggagact

SEQ ID NO: 5167714 - DNA, 13 bp, Homo sapiens
actgtcaataaac

SEQ ID NO: 5167715 - DNA, 21 bp, Homo sapiens
actgtcaataaacagcttcat

SEQ ID NO: 5167716 - DNA, 13 bp, Homo sapiens
actgtcacaggca

SEQ ID NO: 5167717 - DNA, 15 bp, Homo sapiens
actgtcacaggcata

SEQ ID NO: 5167718 - DNA, 15 bp, Homo sapiens
actgtcaccctgagg

SEQ ID NO: 5167719 - DNA, 20 bp, Homo sapiens
actgtcacgcggcagcttca

SEQ ID NO: 5167720 - DNA, 22 bp, Homo sapiens
actgtcacggggttccctccta

SEQ ID NO: 5167721 - DNA, 24 bp, Homo sapiens
actgtcactcattgctgagcctct

SEQ ID NO: 5167722 - DNA, 13 bp, Homo sapiens
actgtcactgccg

SEQ ID NO: 5167723 - DNA, 15 bp, Homo sapiens
actgtcactgttcct

SEQ ID NO: 5167724 - DNA, 18 bp, Homo sapiens
actgtcacttgctgcttt

SEQ ID NO: 5167725 - DNA, 20 bp, Homo sapiens
actgtcacttgctgcttttt

SEQ ID NO: 5167726 - DNA, 19 bp, Homo sapiens
actgtcactttgctctggg

SEQ ID NO: 5167727 - DNA, 20 bp, Homo sapiens
actgtcagaataaagaacat

SEQ ID NO: 5167728 - DNA, 18 bp, Homo sapiens
actgtcagagaatatgac

SEQ ID NO: 5167729 - DNA, 13 bp, Homo sapiens
actgtcagagctg

SEQ ID NO: 5167730 - DNA, 14 bp, Homo sapiens
actgtcagagctgt

SEQ ID NO: 5167731 - DNA, 22 bp, Homo sapiens
actgtcagagctgttggcctcg

SEQ ID NO: 5167732 - DNA, 19 bp, Homo sapiens
actgtcagattaaattaca

SEQ ID NO: 5167733 - DNA, 21 bp, Homo sapiens
actgtcagattaaattacagc

SEQ ID NO: 5167734 - DNA, 13 bp, Homo sapiens
actgtcagctgag

SEQ ID NO: 5167735 - DNA, 21 bp, Homo sapiens
actgtcagctgagcttgagct

SEQ ID NO: 5167736 - DNA, 22 bp, Homo sapiens
actgtcagctgagcttgagctc

SEQ ID NO: 5167737 - DNA, 13 bp, Homo sapiens
actgtcaggaagt

SEQ ID NO: 5167738 - DNA, 16 bp, Homo sapiens
actgtcagggagggcc

SEQ ID NO: 5167739 - DNA, 23 bp, Homo sapiens
actgtcagggagggccagggagg

SEQ ID NO: 5167740 - DNA, 14 bp, Homo sapiens
actgtcagtggggc

SEQ ID NO: 5167741 - DNA, 23 bp, Homo sapiens
actgtcagtggggcagcctctcc

SEQ ID NO: 5167742 - DNA, 18 bp, Homo sapiens
actgtcagtgtcctcagg

SEQ ID NO: 5167743 - DNA, 18 bp, Homo sapiens
actgtcagttctctggga

SEQ ID NO: 5167744 - DNA, 21 bp, Homo sapiens
actgtcatataatgcaacagg

SEQ ID NO: 5167745 - DNA, 22 bp, Homo sapiens
actgtcatcctcaaagaaagtg

SEQ ID NO: 5167746 - DNA, 14 bp, Homo sapiens
actgtcatctgcca

SEQ ID NO: 5167747 - DNA, 16 bp, Homo sapiens
actgtcatctgccagg

SEQ ID NO: 5167748 - DNA, 14 bp, Homo sapiens
actgtcatgatacg

SEQ ID NO: 5167749 - DNA, 24 bp, Homo sapiens
actgtcatgcttcatcattccctc

SEQ ID NO: 5167750 - DNA, 21 bp, Homo sapiens
actgtcatgtgcgaacacagt

SEQ ID NO: 5167751 - DNA, 17 bp, Homo sapiens
actgtcattagaattga

SEQ ID NO: 5167752 - DNA, 20 bp, Homo sapiens
actgtcattcccattccttt

SEQ ID NO: 5167753 - DNA, 13 bp, Homo sapiens
actgtcattgccc

SEQ ID NO: 5167754 - DNA, 16 bp, Homo sapiens
actgtccacatctgcc

SEQ ID NO: 5167755 - DNA, 18 bp, Homo sapiens
actgtccacatctgcctc

SEQ ID NO: 5167756 - DNA, 22 bp, Homo sapiens
actgtccaccagtttatacaga

SEQ ID NO: 5167757 - DNA, 14 bp, Homo sapiens
actgtccagagagc

SEQ ID NO: 5167758 - DNA, 17 bp, Homo sapiens
actgtccagagtctctt

SEQ ID NO: 5167759 - DNA, 12 bp, Homo sapiens
actgtccaggga

SEQ ID NO: 5167760 - DNA, 23 bp, Homo sapiens
actgtccagggaaacagcctctc

SEQ ID NO: 5167761 - DNA, 13 bp, Homo sapiens
actgtccagggcc

SEQ ID NO: 5167762 - DNA, 18 bp, Homo sapiens
actgtcccaaggaggggg

SEQ ID NO: 5167763 - DNA, 16 bp, Homo sapiens
actgtcccacaaaata

SEQ ID NO: 5167764 - DNA, 19 bp, Homo sapiens
actgtcccacaaaatattt

SEQ ID NO: 5167765 - DNA, 23 bp, Homo sapiens
actgtcccacaaaatatttctaa

SEQ ID NO: 5167766 - DNA, 17 bp, Homo sapiens
actgtcccacttctcat

SEQ ID NO: 5167767 - DNA, 21 bp, Homo sapiens
actgtcccaggagcaaatgct

SEQ ID NO: 5167768 - DNA, 21 bp, Homo sapiens
actgtccctaccactgagccc

SEQ ID NO: 5167769 - DNA, 23 bp, Homo sapiens
actgtccctcaaatgacccaaag

SEQ ID NO: 5167770 - DNA, 13 bp, Homo sapiens
actgtccctccct

SEQ ID NO: 5167771 - DNA, 19 bp, Homo sapiens
actgtccctcccttgctga

SEQ ID NO: 5167772 - DNA, 21 bp, Homo sapiens
actgtccctgccaatgctcca

SEQ ID NO: 5167773 - DNA, 22 bp, Homo sapiens
actgtccctgctttctggtata

SEQ ID NO: 5167774 - DNA, 15 bp, Homo sapiens
actgtccgcctctgc

SEQ ID NO: 5167775 - DNA, 20 bp, Homo sapiens
actgtccgcctctgcccgca

SEQ ID NO: 5167776 - DNA, 16 bp, Homo sapiens
actgtccgctgtctcc

SEQ ID NO: 5167777 - DNA, 18 bp, Homo sapiens
actgtccgctgtctccct

SEQ ID NO: 5167778 - DNA, 17 bp, Homo sapiens
actgtcctacccaccct

SEQ ID NO: 5167779 - DNA, 16 bp, Homo sapiens
actgtcctattatatt

SEQ ID NO: 5167780 - DNA, 18 bp, Homo sapiens
actgtcctccaagccagc

SEQ ID NO: 5167781 - DNA, 13 bp, Homo sapiens
actgtcctcccac

SEQ ID NO: 5167782 - DNA, 19 bp, Homo sapiens
actgtcctcccacagacct

SEQ ID NO: 5167783 - DNA, 21 bp, Homo sapiens
actgtcctcccacagacctgc

SEQ ID NO: 5167784 - DNA, 22 bp, Homo sapiens
actgtcctcccacagacctgca

SEQ ID NO: 5167785 - DNA, 14 bp, Homo sapiens
actgtcctctttca

SEQ ID NO: 5167786 - DNA, 22 bp, Homo sapiens
actgtcctctttcagaaaacag

SEQ ID NO: 5167787 - DNA, 12 bp, Homo sapiens
actgtcctgagg

SEQ ID NO: 5167788 - DNA, 19 bp, Homo sapiens
actgtcctgaggagccctg

SEQ ID NO: 5167789 - DNA, 16 bp, Homo sapiens
actgtcctgctccaca

SEQ ID NO: 5167790 - DNA, 18 bp, Homo sapiens
actgtcctgctccacagt

SEQ ID NO: 5167791 - DNA, 20 bp, Homo sapiens
actgtcctgctccacagtgt

SEQ ID NO: 5167792 - DNA, 11 bp, Homo sapiens
actgtcctgga

SEQ ID NO: 5167793 - DNA, 22 bp, Homo sapiens
actgtcctggcttttatttaaa

SEQ ID NO: 5167794 - DNA, 20 bp, Homo sapiens
actgtcctgggcgccctgga

SEQ ID NO: 5167795 - DNA, 22 bp, Homo sapiens
actgtcctgggcgccctggaag

SEQ ID NO: 5167796 - DNA, 23 bp, Homo sapiens
actgtcctgggcgccctggaagc

SEQ ID NO: 5167797 - DNA, 17 bp, Homo sapiens
actgtcctgttgattaa

SEQ ID NO: 5167798 - DNA, 22 bp, Homo sapiens
actgtcctgttgattaatttct

SEQ ID NO: 5167799 - DNA, 15 bp, Homo sapiens
actgtccttgaaccc

SEQ ID NO: 5167800 - DNA, 14 bp, Homo sapiens
actgtcctttctcc

SEQ ID NO: 5167801 - DNA, 20 bp, Homo sapiens
actgtcctttctccaggccc

SEQ ID NO: 5167802 - DNA, 14 bp, Homo sapiens
actgtcggaggaaa

SEQ ID NO: 5167803 - DNA, 16 bp, Homo sapiens
actgtcggaggaaaga

SEQ ID NO: 5167804 - DNA, 21 bp, Homo sapiens
actgtcggaggaaagacaaca

SEQ ID NO: 5167805 - DNA, 18 bp, Homo sapiens
actgtcgtgtttacaaaa

SEQ ID NO: 5167806 - DNA, 22 bp, Homo sapiens
actgtctaagaataatgacgta

SEQ ID NO: 5167807 - DNA, 21 bp, Homo sapiens
actgtctagcacttccttgcc

SEQ ID NO: 5167808 - DNA, 17 bp, Homo sapiens
actgtctagccactccc

SEQ ID NO: 5167809 - DNA, 18 bp, Homo sapiens
actgtctagccactccct

SEQ ID NO: 5167810 - DNA, 17 bp, Homo sapiens
actgtctattaatattc

SEQ ID NO: 5167811 - DNA, 19 bp, Homo sapiens
actgtctatttaagtgcaa

SEQ ID NO: 5167812 - DNA, 16 bp, Homo sapiens
actgtctcaaaaggat

SEQ ID NO: 5167813 - DNA, 19 bp, Homo sapiens
actgtctcaactactcagc

SEQ ID NO: 5167814 - DNA, 20 bp, Homo sapiens
actgtctcaagagggcactg

SEQ ID NO: 5167815 - DNA, 21 bp, Homo sapiens
actgtctcaagagggcactgg

SEQ ID NO: 5167816 - DNA, 21 bp, Homo sapiens
actgtctcactcgttctgtta

SEQ ID NO: 5167817 - DNA, 18 bp, Homo sapiens
actgtctcagtttcactt

SEQ ID NO: 5167818 - DNA, 13 bp, Homo sapiens
actgtctccttcc

SEQ ID NO: 5167819 - DNA, 18 bp, Homo sapiens
actgtctccttcccactg

SEQ ID NO: 5167820 - DNA, 19 bp, Homo sapiens
actgtctccttcccactgt

SEQ ID NO: 5167821 - DNA, 21 bp, Homo sapiens
actgtctccttcccactgtcc

SEQ ID NO: 5167822 - DNA, 12 bp, Homo sapiens
actgtctcggca

SEQ ID NO: 5167823 - DNA, 10 bp, Homo sapiens
actgtctctc

SEQ ID NO: 5167824 - DNA, 17 bp, Homo sapiens
actgtctctcatgaacc

SEQ ID NO: 5167825 - DNA, 20 bp, Homo sapiens
actgtctctccagtgaaatg

SEQ ID NO: 5167826 - DNA, 18 bp, Homo sapiens
actgtctctcttgtcaca

SEQ ID NO: 5167827 - DNA, 20 bp, Homo sapiens
actgtctctcttgtcacatg

SEQ ID NO: 5167828 - DNA, 22 bp, Homo sapiens
actgtctctcttgtcacatgga

SEQ ID NO: 5167829 - DNA, 14 bp, Homo sapiens
actgtctctgcctc

SEQ ID NO: 5167830 - DNA, 16 bp, Homo sapiens
actgtctctgcctctt

SEQ ID NO: 5167831 - DNA, 15 bp, Homo sapiens
actgtctctggagtg

SEQ ID NO: 5167832 - DNA, 16 bp, Homo sapiens
actgtctctggagtga

SEQ ID NO: 5167833 - DNA, 19 bp, Homo sapiens
actgtctgaatattctaga

SEQ ID NO: 5167834 - DNA, 19 bp, Homo sapiens
actgtctggcccccctggt

SEQ ID NO: 5167835 - DNA, 21 bp, Homo sapiens
actgtctgggattaagggcaa

SEQ ID NO: 5167836 - DNA, 14 bp, Homo sapiens
agaaaggaaagaag

SEQ ID NO: 5167837 - DNA, 17 bp, Homo sapiens
agaaaggaaagaaggag

SEQ ID NO: 5167838 - DNA, 18 bp, Homo sapiens
agaaaggaaagaaggaga

SEQ ID NO: 5167839 - DNA, 15 bp, Homo sapiens
agaaaggaaatagac

SEQ ID NO: 5167840 - DNA, 21 bp, Homo sapiens
agaaaggaagcattgtaaaat

SEQ ID NO: 5167841 - DNA, 20 bp, Homo sapiens
agaaaggaagccttgctcat

SEQ ID NO: 5167842 - DNA, 18 bp, Homo sapiens
agaaaggacagagccagc

SEQ ID NO: 5167843 - DNA, 16 bp, Homo sapiens
agaaaggacctgcaaa

SEQ ID NO: 5167844 - DNA, 11 bp, Homo sapiens
agaaaggagac

SEQ ID NO: 5167845 - DNA, 23 bp, Homo sapiens
agaaaggagagaacgggcgtcag

SEQ ID NO: 5167846 - DNA, 15 bp, Homo sapiens
agaaaggagggcaac

SEQ ID NO: 5167847 - DNA, 14 bp, Homo sapiens
agaaaggaggggag

SEQ ID NO: 5167848 - DNA, 17 bp, Homo sapiens
agaaaggaggggagaac

SEQ ID NO: 5167849 - DNA, 23 bp, Homo sapiens
agaaaggaggggatagagagaga

SEQ ID NO: 5167850 - DNA, 17 bp, Homo sapiens
agaaaggagtctgcaca

SEQ ID NO: 5167851 - DNA, 14 bp, Homo sapiens
agaaaggatataaa

SEQ ID NO: 5167852 - DNA, 16 bp, Homo sapiens
agaaaggatatttaag

SEQ ID NO: 5167853 - DNA, 16 bp, Homo sapiens
agaaaggattaagata

SEQ ID NO: 5167854 - DNA, 19 bp, Homo sapiens
agaaaggcaaccaataaaa

SEQ ID NO: 5167855 - DNA, 13 bp, Homo sapiens
agaaaggcagaga

SEQ ID NO: 5167856 - DNA, 22 bp, Homo sapiens
agaaaggcagccctcacctctg

SEQ ID NO: 5167857 - DNA, 12 bp, Homo sapiens
agaaaggcaggt

SEQ ID NO: 5167858 - DNA, 17 bp, Homo sapiens
agaaaggcaggtttcat

SEQ ID NO: 5167859 - DNA, 15 bp, Homo sapiens
agaaaggccactcag

SEQ ID NO: 5167860 - DNA, 15 bp, Homo sapiens
agaaaggcctgcaca

SEQ ID NO: 5167861 - DNA, 16 bp, Homo sapiens
agaaaggcctgcacac

SEQ ID NO: 5167862 - DNA, 17 bp, Homo sapiens
agaaaggctctattcca

SEQ ID NO: 5167863 - DNA, 18 bp, Homo sapiens
agaaaggctctgaaggtc

SEQ ID NO: 5167864 - DNA, 15 bp, Homo sapiens
agaaaggctgttaaa

SEQ ID NO: 5167865 - DNA, 16 bp, Homo sapiens
agaaaggctgttaaat

SEQ ID NO: 5167866 - DNA, 22 bp, Homo sapiens
agaaaggctgttaaatacagga

SEQ ID NO: 5167867 - DNA, 16 bp, Homo sapiens
agaaagggaaactggc

SEQ ID NO: 5167868 - DNA, 12 bp, Homo sapiens
agaaagggaccc

SEQ ID NO: 5167869 - DNA, 18 bp, Homo sapiens
agaaagggagagaaaact

SEQ ID NO: 5167870 - DNA, 18 bp, Homo sapiens
agaaagggagcagagaag

SEQ ID NO: 5167871 - DNA, 16 bp, Homo sapiens
agaaagggaggcccag

SEQ ID NO: 5167872 - DNA, 17 bp, Homo sapiens
agaaagggagggctctg

SEQ ID NO: 5167873 - DNA, 18 bp, Homo sapiens
agaaagggagggctctga

SEQ ID NO: 5167874 - DNA, 19 bp, Homo sapiens
agaaagggagggctctgag

SEQ ID NO: 5167875 - DNA, 20 bp, Homo sapiens
agaaagggattgctgaggca

SEQ ID NO: 5167876 - DNA, 15 bp, Homo sapiens
agaaagggattgctt

SEQ ID NO: 5167877 - DNA, 13 bp, Homo sapiens
agaaagggcaagg

SEQ ID NO: 5167878 - DNA, 14 bp, Homo sapiens
agaaagggcaaggg

SEQ ID NO: 5167879 - DNA, 12 bp, Homo sapiens
agaaagggcaga

SEQ ID NO: 5167880 - DNA, 22 bp, Homo sapiens
agaaagggcagaggaagagaca

SEQ ID NO: 5167881 - DNA, 17 bp, Homo sapiens
agaaagggcagcccctc

SEQ ID NO: 5167882 - DNA, 13 bp, Homo sapiens
agaaagggcagct

SEQ ID NO: 5167883 - DNA, 14 bp, Homo sapiens
agaaagggcagctt

SEQ ID NO: 5167884 - DNA, 22 bp, Homo sapiens
agaaagggccctgggcctgcct

SEQ ID NO: 5167885 - DNA, 14 bp, Homo sapiens
agaaaggggagccc

SEQ ID NO: 5167886 - DNA, 17 bp, Homo sapiens
agaaaggggagcccact

SEQ ID NO: 5167887 - DNA, 17 bp, Homo sapiens
agaaaggggcaagaaat

SEQ ID NO: 5167888 - DNA, 23 bp, Homo sapiens
agaaaggggcaggagctcagatg

SEQ ID NO: 5167889 - DNA, 20 bp, Homo sapiens
agaaaggggcagtttaaagc

SEQ ID NO: 5167890 - DNA, 17 bp, Homo sapiens
agaaaggggcattttgt

SEQ ID NO: 5167891 - DNA, 19 bp, Homo sapiens
agaaaggggtgattgaaag

SEQ ID NO: 5167892 - DNA, 20 bp, Homo sapiens
agaaaggggtgattgaaaga

SEQ ID NO: 5167893 - DNA, 21 bp, Homo sapiens
agaaagggtgccagttgggct

SEQ ID NO: 5167894 - DNA, 19 bp, Homo sapiens
agaaagggttctgtaaaat

SEQ ID NO: 5167895 - DNA, 18 bp, Homo sapiens
agaaaggtgaaacacaca

SEQ ID NO: 5167896 - DNA, 19 bp, Homo sapiens
agaaaggtgaaacacacac

SEQ ID NO: 5167897 - DNA, 23 bp, Homo sapiens
agaaaggtgagtttgagctgcct

SEQ ID NO: 5167898 - DNA, 16 bp, Homo sapiens
agaaaggtgtgaggag

SEQ ID NO: 5167899 - DNA, 16 bp, Homo sapiens
agaaaggttagtatca

SEQ ID NO: 5167900 - DNA, 16 bp, Homo sapiens
agaaaggttctgcccg

SEQ ID NO: 5167901 - DNA, 15 bp, Homo sapiens
agaaagtaaaaaagg

SEQ ID NO: 5167902 - DNA, 14 bp, Homo sapiens
agaaagtaaaaaga

SEQ ID NO: 5167903 - DNA, 15 bp, Homo sapiens
agaaagtaaaaagaa

SEQ ID NO: 5167904 - DNA, 17 bp, Homo sapiens
agaaagtaaataaaagg

SEQ ID NO: 5167905 - DNA, 22 bp, Homo sapiens
agaaagtaagcatttccagcct

SEQ ID NO: 5167906 - DNA, 16 bp, Homo sapiens
agaaagtaagtctttt

SEQ ID NO: 5167907 - DNA, 13 bp, Homo sapiens
agaaagtaattta

SEQ ID NO: 5167908 - DNA, 14 bp, Homo sapiens
agaaagtacagcag

SEQ ID NO: 5167909 - DNA, 21 bp, Homo sapiens
agaaagtagaggcatgatgat

SEQ ID NO: 5167910 - DNA, 18 bp, Homo sapiens
agaaagtcaaaaaattat

SEQ ID NO: 5167911 - DNA, 17 bp, Homo sapiens
agaaagtcaccaggact

SEQ ID NO: 5167912 - DNA, 14 bp, Homo sapiens
agaaagtcagacct

SEQ ID NO: 5167913 - DNA, 17 bp, Homo sapiens
agaaagtcattccttct

SEQ ID NO: 5167914 - DNA, 21 bp, Homo sapiens
agaaagtcgaattaatagctt

SEQ ID NO: 5167915 - DNA, 22 bp, Homo sapiens
agaaagtctatctaatgacatg

SEQ ID NO: 5167916 - DNA, 15 bp, Homo sapiens
agaaagtctatgctt

SEQ ID NO: 5167917 - DNA, 19 bp, Homo sapiens
agaaagtgacctatttttt

SEQ ID NO: 5167918 - DNA, 13 bp, Homo sapiens
agaaagtgcagaa

SEQ ID NO: 5167919 - DNA, 16 bp, Homo sapiens
agaaagtgcagaatca

SEQ ID NO: 5167920 - DNA, 22 bp, Homo sapiens
agaaagtgcctgacacactaac

SEQ ID NO: 5167921 - DNA, 18 bp, Homo sapiens
agaaagtggaaaatgacc

SEQ ID NO: 5167922 - DNA, 16 bp, Homo sapiens
agaaagtgggaggtca

SEQ ID NO: 5167923 - DNA, 22 bp, Homo sapiens
agaaagtgggcttaatggagtt

SEQ ID NO: 5167924 - DNA, 16 bp, Homo sapiens
agaaagtgggggtgga

SEQ ID NO: 5167925 - DNA, 20 bp, Homo sapiens
agaaagtgggtgagatgctg

SEQ ID NO: 5167926 - DNA, 14 bp, Homo sapiens
agaaagtgggttca

SEQ ID NO: 5167927 - DNA, 19 bp, Homo sapiens
agaaagtggtcttaagaaa

SEQ ID NO: 5167928 - DNA, 21 bp, Homo sapiens
agaaagtggtcttaagaaatg

SEQ ID NO: 5167929 - DNA, 16 bp, Homo sapiens
agaaagtgtgagcaaa

SEQ ID NO: 5167930 - DNA, 17 bp, Homo sapiens
agaaagtgtgagcaaac

SEQ ID NO: 5167931 - DNA, 23 bp, Homo sapiens
agaaagtgtgagcaaactaactt

SEQ ID NO: 5167932 - DNA, 15 bp, Homo sapiens
agaaagtgtgcttta

SEQ ID NO: 5167933 - DNA, 23 bp, Homo sapiens
agaaagtgtgctttatgctgaaa

SEQ ID NO: 5167934 - DNA, 23 bp, Homo sapiens
agaaagtgttctgttacaaaatg

SEQ ID NO: 5167935 - DNA, 17 bp, Homo sapiens
agaaagttattcttggt

SEQ ID NO: 5167936 - DNA, 23 bp, Homo sapiens
agaaagttattgataagttcata

SEQ ID NO: 5167937 - DNA, 20 bp, Homo sapiens
agaaagttccaaatgtttat

SEQ ID NO: 5167938 - DNA, 21 bp, Homo sapiens
agaaagttccaaatgtttata

SEQ ID NO: 5167939 - DNA, 23 bp, Homo sapiens
agaaagttctgtgtaaacagaag

SEQ ID NO: 5167940 - DNA, 12 bp, Homo sapiens
agaaagttgatt

SEQ ID NO: 5167941 - DNA, 19 bp, Homo sapiens
agaaagttgcacggctgct

SEQ ID NO: 5167942 - DNA, 22 bp, Homo sapiens
agaaagttgtgtaggcaccacc

SEQ ID NO: 5167943 - DNA, 12 bp, Homo sapiens
agaaagtttccc

SEQ ID NO: 5167944 - DNA, 20 bp, Homo sapiens
agaaagtttccccaccagtg

SEQ ID NO: 5167945 - DNA, 12 bp, Homo sapiens
agaaataaaaat

SEQ ID NO: 5167946 - DNA, 17 bp, Homo sapiens
agaaataaaaggaagcc

SEQ ID NO: 5167947 - DNA, 18 bp, Homo sapiens
agaaataaaaggaagcca

SEQ ID NO: 5167948 - DNA, 23 bp, Homo sapiens
agaaataaaagtgaatgaaagat

SEQ ID NO: 5167949 - DNA, 23 bp, Homo sapiens
agaaataaaccaaaggaaaatgt

SEQ ID NO: 5167950 - DNA, 15 bp, Homo sapiens
agaaataaagtttct

SEQ ID NO: 5167951 - DNA, 15 bp, Homo sapiens
agaaataaatagcta

SEQ ID NO: 5167952 - DNA, 14 bp, Homo sapiens
agaaataaatatac

SEQ ID NO: 5167953 - DNA, 16 bp, Homo sapiens
agaaataaatcacaga

SEQ ID NO: 5167954 - DNA, 14 bp, Homo sapiens
agaaataaatcaga

SEQ ID NO: 5167955 - DNA, 12 bp, Homo sapiens
agaaataaatct

SEQ ID NO: 5167956 - DNA, 14 bp, Homo sapiens
agaaataaatctat

SEQ ID NO: 5167957 - DNA, 17 bp, Homo sapiens
agaaataaattcctaaa

SEQ ID NO: 5167958 - DNA, 14 bp, Homo sapiens
agaaataaattttg

SEQ ID NO: 5167959 - DNA, 13 bp, Homo sapiens
agaaataagaatt

SEQ ID NO: 5167960 - DNA, 19 bp, Homo sapiens
agaaataagtgccctctcc

SEQ ID NO: 5167961 - DNA, 16 bp, Homo sapiens
agaaataagtttttgt

SEQ ID NO: 5167962 - DNA, 14 bp, Homo sapiens
agaaataataaaaa

SEQ ID NO: 5167963 - DNA, 21 bp, Homo sapiens
agaaataataaaaagaaagat

SEQ ID NO: 5167964 - DNA, 16 bp, Homo sapiens
agaaataatagaaatg

SEQ ID NO: 5167965 - DNA, 23 bp, Homo sapiens
agaaataatccctgtaatattta

SEQ ID NO: 5167966 - DNA, 18 bp, Homo sapiens
agaaataatgcctccaat

SEQ ID NO: 5167967 - DNA, 14 bp, Homo sapiens
agaaatacaaaaat

SEQ ID NO: 5167968 - DNA, 19 bp, Homo sapiens
agaaatacaattctacatt

SEQ ID NO: 5167969 - DNA, 15 bp, Homo sapiens
agaaatacagaagaa

SEQ ID NO: 5167970 - DNA, 21 bp, Homo sapiens
agaaatacagattttgatagc

SEQ ID NO: 5167971 - DNA, 20 bp, Homo sapiens
agaaatacagctggctatct

SEQ ID NO: 5167972 - DNA, 14 bp, Homo sapiens
agaaatacagtctt

SEQ ID NO: 5167973 - DNA, 19 bp, Homo sapiens
agaaatacagtcttccaca

SEQ ID NO: 5167974 - DNA, 18 bp, Homo sapiens
agaaatacataaaaaagt

SEQ ID NO: 5167975 - DNA, 21 bp, Homo sapiens
agaaatacataaaaaagtgtt

SEQ ID NO: 5167976 - DNA, 17 bp, Homo sapiens
agaaatacatcatatgt

SEQ ID NO: 5167977 - DNA, 21 bp, Homo sapiens
agaaatacatcatatgttaga

SEQ ID NO: 5167978 - DNA, 15 bp, Homo sapiens
agaaatacctgtcta

SEQ ID NO: 5167979 - DNA, 14 bp, Homo sapiens
agaaatactgctct

SEQ ID NO: 5167980 - DNA, 15 bp, Homo sapiens
agaaatactgctctg

SEQ ID NO: 5167981 - DNA, 14 bp, Homo sapiens
agaaatactgtaca

SEQ ID NO: 5167982 - DNA, 23 bp, Homo sapiens
agaaatactttcgaaatttcatt

SEQ ID NO: 5167983 - DNA, 13 bp, Homo sapiens
agaaatagaaaag

SEQ ID NO: 5167984 - DNA, 16 bp, Homo sapiens
agaaatagaaaaggaa

SEQ ID NO: 5167985 - DNA, 13 bp, Homo sapiens
agaaatagaacaa

SEQ ID NO: 5167986 - DNA, 14 bp, Homo sapiens
agaaatagacaaaa

SEQ ID NO: 5167987 - DNA, 21 bp, Homo sapiens
agaaatagacaaaaagtatat

SEQ ID NO: 5167988 - DNA, 17 bp, Homo sapiens
agaaatagctgtataga

SEQ ID NO: 5167989 - DNA, 19 bp, Homo sapiens
agaaatagcttatgaaaag

SEQ ID NO: 5167990 - DNA, 14 bp, Homo sapiens
agaaataggaagat

SEQ ID NO: 5167991 - DNA, 17 bp, Homo sapiens
agaaataggacaattca

SEQ ID NO: 5167992 - DNA, 22 bp, Homo sapiens
agaaataggtatcaaaatagtt

SEQ ID NO: 5167993 - DNA, 14 bp, Homo sapiens
agaaataggttaaa

SEQ ID NO: 5167994 - DNA, 16 bp, Homo sapiens
agaaatagttctgtga

SEQ ID NO: 5167995 - DNA, 16 bp, Homo sapiens
agaaatataaaaataa

SEQ ID NO: 5167996 - DNA, 13 bp, Homo sapiens
agaaatataaaca

SEQ ID NO: 5167997 - DNA, 16 bp, Homo sapiens
agaaatataacacatt

SEQ ID NO: 5167998 - DNA, 17 bp, Homo sapiens
agaaatataacacattt

SEQ ID NO: 5167999 - DNA, 23 bp, Homo sapiens
agaaatataggatagacactgga

SEQ ID NO: 5168000 - DNA, 15 bp, Homo sapiens
agaaatatagtgcaa

SEQ ID NO: 5168001 - DNA, 17 bp, Homo sapiens
agaaatatattatgaaa

SEQ ID NO: 5168002 - DNA, 21 bp, Homo sapiens
agaaatatccttttagaagca

SEQ ID NO: 5168003 - DNA, 19 bp, Homo sapiens
agaaatatctgaaaatgta

SEQ ID NO: 5168004 - DNA, 17 bp, Homo sapiens
agaaatatctgtgaaat

SEQ ID NO: 5168005 - DNA, 19 bp, Homo sapiens
agaaatatctgtgaaatat

SEQ ID NO: 5168006 - DNA, 14 bp, Homo sapiens
agaaatatctttct

SEQ ID NO: 5168007 - DNA, 18 bp, Homo sapiens
agaaatatgatcagagct

SEQ ID NO: 5168008 - DNA, 18 bp, Homo sapiens
agaaatatgattgatttg

SEQ ID NO: 5168009 - DNA, 22 bp, Homo sapiens
agaaatatgattttatttgaca

SEQ ID NO: 5168010 - DNA, 17 bp, Homo sapiens
agaaatatggaacttac

SEQ ID NO: 5168011 - DNA, 14 bp, Homo sapiens
agaaatatggacac

SEQ ID NO: 5168012 - DNA, 17 bp, Homo sapiens
agaaatattaagcatgt

SEQ ID NO: 5168013 - DNA, 18 bp, Homo sapiens
agaaatattccaaatgtc

SEQ ID NO: 5168014 - DNA, 13 bp, Homo sapiens
agaaatattgact

SEQ ID NO: 5168015 - DNA, 13 bp, Homo sapiens
actgtctggtttt

SEQ ID NO: 5168016 - DNA, 17 bp, Homo sapiens
actgtctgtaagagaat

SEQ ID NO: 5168017 - DNA, 20 bp, Homo sapiens
actgtctgtacctaaagcaa

SEQ ID NO: 5168018 - DNA, 19 bp, Homo sapiens
actgtcttaattaagtaaa

SEQ ID NO: 5168019 - DNA, 22 bp, Homo sapiens
actgtcttcaaccctgccctgc

SEQ ID NO: 5168020 - DNA, 14 bp, Homo sapiens
actgtcttcccgat

SEQ ID NO: 5168021 - DNA, 23 bp, Homo sapiens
actgtcttcccgatgagggaagg

SEQ ID NO: 5168022 - DNA, 20 bp, Homo sapiens
actgtcttcctcaaaataaa

SEQ ID NO: 5168023 - DNA, 23 bp, Homo sapiens
actgtcttctggacttggtcttg

SEQ ID NO: 5168024 - DNA, 14 bp, Homo sapiens
actgtcttgagaaa

SEQ ID NO: 5168025 - DNA, 18 bp, Homo sapiens
actgtctttaaaagagag

SEQ ID NO: 5168026 - DNA, 18 bp, Homo sapiens
actgtctttattcttatt

SEQ ID NO: 5168027 - DNA, 19 bp, Homo sapiens
actgtctttattcttatta

SEQ ID NO: 5168028 - DNA, 12 bp, Homo sapiens
actgtctttcag

SEQ ID NO: 5168029 - DNA, 19 bp, Homo sapiens
actgtctttgactgtgatt

SEQ ID NO: 5168030 - DNA, 14 bp, Homo sapiens
actgtctttgtgct

SEQ ID NO: 5168031 - DNA, 17 bp, Homo sapiens
actgtctttttcttacc

SEQ ID NO: 5168032 - DNA, 16 bp, Homo sapiens
actgtcttttttctaa

SEQ ID NO: 5168033 - DNA, 21 bp, Homo sapiens
actgtgaaaaaaaatttgttt

SEQ ID NO: 5168034 - DNA, 23 bp, Homo sapiens
actgtgaaaaatcagatgaattg

SEQ ID NO: 5168035 - DNA, 16 bp, Homo sapiens
actgtgaaaatagtgt

SEQ ID NO: 5168036 - DNA, 18 bp, Homo sapiens
actgtgaaatttcatgat

SEQ ID NO: 5168037 - DNA, 22 bp, Homo sapiens
actgtgaaatttcatgattggc

SEQ ID NO: 5168038 - DNA, 18 bp, Homo sapiens
actgtgaacagcttgctg

SEQ ID NO: 5168039 - DNA, 22 bp, Homo sapiens
actgtgaacctgggcactccgc

SEQ ID NO: 5168040 - DNA, 20 bp, Homo sapiens
actgtgaactgggcatttca

SEQ ID NO: 5168041 - DNA, 21 bp, Homo sapiens
actgtgaactgggcatttcac

SEQ ID NO: 5168042 - DNA, 13 bp, Homo sapiens
actgtgaacttga

SEQ ID NO: 5168043 - DNA, 16 bp, Homo sapiens
actgtgaaggaccctt

SEQ ID NO: 5168044 - DNA, 20 bp, Homo sapiens
actgtgaagttacatgcata

SEQ ID NO: 5168045 - DNA, 17 bp, Homo sapiens
actgtgaatcctggcaa

SEQ ID NO: 5168046 - DNA, 18 bp, Homo sapiens
actgtgaatcctggcaag

SEQ ID NO: 5168047 - DNA, 14 bp, Homo sapiens
actgtgaatttcaa

SEQ ID NO: 5168048 - DNA, 14 bp, Homo sapiens
actgtgacaatgac

SEQ ID NO: 5168049 - DNA, 17 bp, Homo sapiens
actgtgacaatgactaa

SEQ ID NO: 5168050 - DNA, 21 bp, Homo sapiens
actgtgacaatgactaagcca

SEQ ID NO: 5168051 - DNA, 13 bp, Homo sapiens
actgtgacacact

SEQ ID NO: 5168052 - DNA, 20 bp, Homo sapiens
actgtgacacagctgagctg

SEQ ID NO: 5168053 - DNA, 13 bp, Homo sapiens
actgtgacaggca

SEQ ID NO: 5168054 - DNA, 16 bp, Homo sapiens
actgtgacaggcagca

SEQ ID NO: 5168055 - DNA, 18 bp, Homo sapiens
actgtgacaggcagcaga

SEQ ID NO: 5168056 - DNA, 17 bp, Homo sapiens
actgtgacatcagaagt

SEQ ID NO: 5168057 - DNA, 12 bp, Homo sapiens
actgtgaccaaa

SEQ ID NO: 5168058 - DNA, 22 bp, Homo sapiens
actgtgaccaagtataaacttt

SEQ ID NO: 5168059 - DNA, 23 bp, Homo sapiens
actgtgacccaaagaagtttaag

SEQ ID NO: 5168060 - DNA, 21 bp, Homo sapiens
actgtgacccccagctccggc

SEQ ID NO: 5168061 - DNA, 13 bp, Homo sapiens
actgtgaccctgg

SEQ ID NO: 5168062 - DNA, 19 bp, Homo sapiens
actgtgacctaagaacaaa

SEQ ID NO: 5168063 - DNA, 13 bp, Homo sapiens
actgtgacctgct

SEQ ID NO: 5168064 - DNA, 12 bp, Homo sapiens
actgtgacctgt

SEQ ID NO: 5168065 - DNA, 14 bp, Homo sapiens
actgtgacctttgt

SEQ ID NO: 5168066 - DNA, 23 bp, Homo sapiens
actgtgactctttttagggccag

SEQ ID NO: 5168067 - DNA, 17 bp, Homo sapiens
actgtgagaacccagtt

SEQ ID NO: 5168068 - DNA, 17 bp, Homo sapiens
actgtgagaactgtgaa

SEQ ID NO: 5168069 - DNA, 18 bp, Homo sapiens
actgtgagaactgtgaat

SEQ ID NO: 5168070 - DNA, 16 bp, Homo sapiens
actgtgagactgtatg

SEQ ID NO: 5168071 - DNA, 13 bp, Homo sapiens
actgtgagagttg

SEQ ID NO: 5168072 - DNA, 19 bp, Homo sapiens
actgtgagataaatatcat

SEQ ID NO: 5168073 - DNA, 22 bp, Homo sapiens
actgtgagcttacattgaaaac

SEQ ID NO: 5168074 - DNA, 20 bp, Homo sapiens
actgtgataaaaagaggagc

SEQ ID NO: 5168075 - DNA, 15 bp, Homo sapiens
actgtgatacagttt

SEQ ID NO: 5168076 - DNA, 23 bp, Homo sapiens
actgtgatcaggctatgtatgga

SEQ ID NO: 5168077 - DNA, 14 bp, Homo sapiens
actgtgatgaaata

SEQ ID NO: 5168078 - DNA, 17 bp, Homo sapiens
actgtgatgaaatatga

SEQ ID NO: 5168079 - DNA, 19 bp, Homo sapiens
actgtgatgaaatatgaaa

SEQ ID NO: 5168080 - DNA, 13 bp, Homo sapiens
actgtgatgccac

SEQ ID NO: 5168081 - DNA, 22 bp, Homo sapiens
actgtgatgccacacagagtgg

SEQ ID NO: 5168082 - DNA, 19 bp, Homo sapiens
actgtgattactctttgct

SEQ ID NO: 5168083 - DNA, 12 bp, Homo sapiens
actgtgattaga

SEQ ID NO: 5168084 - DNA, 16 bp, Homo sapiens
actgtgattagatcac

SEQ ID NO: 5168085 - DNA, 17 bp, Homo sapiens
actgtgattagatcaca

SEQ ID NO: 5168086 - DNA, 19 bp, Homo sapiens
actgtgattagatcacatc

SEQ ID NO: 5168087 - DNA, 23 bp, Homo sapiens
actgtgatttatttggagtggag

SEQ ID NO: 5168088 - DNA, 14 bp, Homo sapiens
actgtgatttctgg

SEQ ID NO: 5168089 - DNA, 14 bp, Homo sapiens
actgtgattttgcc

SEQ ID NO: 5168090 - DNA, 19 bp, Homo sapiens
actgtgattttgccctcct

SEQ ID NO: 5168091 - DNA, 18 bp, Homo sapiens
actgtgatttttatcaca

SEQ ID NO: 5168092 - DNA, 13 bp, Homo sapiens
actgtgcaaagca

SEQ ID NO: 5168093 - DNA, 18 bp, Homo sapiens
actgtgcaactttttaaa

SEQ ID NO: 5168094 - DNA, 20 bp, Homo sapiens
actgtgcaactttttaaagt

SEQ ID NO: 5168095 - DNA, 19 bp, Homo sapiens
actgtgcacatctgtgtct

SEQ ID NO: 5168096 - DNA, 20 bp, Homo sapiens
actgtgcacatctgtgtctt

SEQ ID NO: 5168097 - DNA, 21 bp, Homo sapiens
actgtgcacatctgtgtcttg

SEQ ID NO: 5168098 - DNA, 14 bp, Homo sapiens
actgtgcactgccc

SEQ ID NO: 5168099 - DNA, 17 bp, Homo sapiens
actgtgcactgccctgt

SEQ ID NO: 5168100 - DNA, 12 bp, Homo sapiens
actgtgcagaag

SEQ ID NO: 5168101 - DNA, 14 bp, Homo sapiens
actgtgcagaataa

SEQ ID NO: 5168102 - DNA, 15 bp, Homo sapiens
actgtgcagaataat

SEQ ID NO: 5168103 - DNA, 17 bp, Homo sapiens
actgtgcagacccagtc

SEQ ID NO: 5168104 - DNA, 24 bp, Homo sapiens
actgtgcagacccagtcccacact

SEQ ID NO: 5168105 - DNA, 12 bp, Homo sapiens
actgtgcagagt

SEQ ID NO: 5168106 - DNA, 17 bp, Homo sapiens
actgtgcaggcccaggc

SEQ ID NO: 5168107 - DNA, 21 bp, Homo sapiens
actgtgcaggcccaggcaggc

SEQ ID NO: 5168108 - DNA, 14 bp, Homo sapiens
actgtgcaggcctg

SEQ ID NO: 5168109 - DNA, 21 bp, Homo sapiens
actgtgcaggtgctattgtta

SEQ ID NO: 5168110 - DNA, 13 bp, Homo sapiens
actgtgcagtgac

SEQ ID NO: 5168111 - DNA, 14 bp, Homo sapiens
actgtgcagtggag

SEQ ID NO: 5168112 - DNA, 19 bp, Homo sapiens
actgtgcagtggagcagaa

SEQ ID NO: 5168113 - DNA, 16 bp, Homo sapiens
actgtgcagttgctgt

SEQ ID NO: 5168114 - DNA, 19 bp, Homo sapiens
actgtgcatagtgctggga

SEQ ID NO: 5168115 - DNA, 21 bp, Homo sapiens
actgtgcattacaaagttaat

SEQ ID NO: 5168116 - DNA, 20 bp, Homo sapiens
actgtgccaactactactgg

SEQ ID NO: 5168117 - DNA, 14 bp, Homo sapiens
actgtgccatctgt

SEQ ID NO: 5168118 - DNA, 17 bp, Homo sapiens
actgtgccatctgtggg

SEQ ID NO: 5168119 - DNA, 12 bp, Homo sapiens
actgtgccatgg

SEQ ID NO: 5168120 - DNA, 17 bp, Homo sapiens
actgtgccatgtgccag

SEQ ID NO: 5168121 - DNA, 18 bp, Homo sapiens
actgtgccatgtgccagg

SEQ ID NO: 5168122 - DNA, 17 bp, Homo sapiens
actgtgccctggtggag

SEQ ID NO: 5168123 - DNA, 18 bp, Homo sapiens
actgtgccctggtggaga

SEQ ID NO: 5168124 - DNA, 20 bp, Homo sapiens
actgtgcctcagagaccagg

SEQ ID NO: 5168125 - DNA, 21 bp, Homo sapiens
actgtgcctcaggccagggct

SEQ ID NO: 5168126 - DNA, 19 bp, Homo sapiens
actgtgcctggctccctga

SEQ ID NO: 5168127 - DNA, 19 bp, Homo sapiens
actgtgcctttgcaaatca

SEQ ID NO: 5168128 - DNA, 21 bp, Homo sapiens
actgtgcggcacaggaaacag

SEQ ID NO: 5168129 - DNA, 23 bp, Homo sapiens
actgtgcgtggggctcccgcctc

SEQ ID NO: 5168130 - DNA, 21 bp, Homo sapiens
actgtgctaataacagtgcat

SEQ ID NO: 5168131 - DNA, 20 bp, Homo sapiens
actgtgctaatgggctgctg

SEQ ID NO: 5168132 - DNA, 14 bp, Homo sapiens
actgtgctcagcca

SEQ ID NO: 5168133 - DNA, 12 bp, Homo sapiens
actgtgctccca

SEQ ID NO: 5168134 - DNA, 9 bp, Homo sapiens
actgtgctg

SEQ ID NO: 5168135 - DNA, 13 bp, Homo sapiens
actgtgctgaatg

SEQ ID NO: 5168136 - DNA, 13 bp, Homo sapiens
actgtgctgagaa

SEQ ID NO: 5168137 - DNA, 12 bp, Homo sapiens
actgtgctgatt

SEQ ID NO: 5168138 - DNA, 13 bp, Homo sapiens
actgtgctggaga

SEQ ID NO: 5168139 - DNA, 11 bp, Homo sapiens
actgtgctggg

SEQ ID NO: 5168140 - DNA, 22 bp, Homo sapiens
actgtgctgttgttatgatgtg

SEQ ID NO: 5168141 - DNA, 23 bp, Homo sapiens
actgtgctgttgttatgatgtgc

SEQ ID NO: 5168142 - DNA, 17 bp, Homo sapiens
actgtgcttaatttaaa

SEQ ID NO: 5168143 - DNA, 23 bp, Homo sapiens
actgtgcttaatttaaatagcat

SEQ ID NO: 5168144 - DNA, 17 bp, Homo sapiens
actgtgcttacagtgac

SEQ ID NO: 5168145 - DNA, 18 bp, Homo sapiens
actgtgcttacagtgact

SEQ ID NO: 5168146 - DNA, 14 bp, Homo sapiens
actgtgcttcgagc

SEQ ID NO: 5168147 - DNA, 21 bp, Homo sapiens
actgtgcttctctatgataat

SEQ ID NO: 5168148 - DNA, 15 bp, Homo sapiens
actgtgcttgctcct

SEQ ID NO: 5168149 - DNA, 14 bp, Homo sapiens
actgtgctttctat

SEQ ID NO: 5168150 - DNA, 20 bp, Homo sapiens
actgtgctttctattgtaca

SEQ ID NO: 5168151 - DNA, 19 bp, Homo sapiens
actgtggaaaaatatttaa

SEQ ID NO: 5168152 - DNA, 13 bp, Homo sapiens
actgtggaaagac

SEQ ID NO: 5168153 - DNA, 24 bp, Homo sapiens
actgtggaaccaaagctggcccag

SEQ ID NO: 5168154 - DNA, 18 bp, Homo sapiens
actgtggaactgccacct

SEQ ID NO: 5168155 - DNA, 18 bp, Homo sapiens
actgtggaaggcctccct

SEQ ID NO: 5168156 - DNA, 20 bp, Homo sapiens
actgtggaaggcctccctct

SEQ ID NO: 5168157 - DNA, 20 bp, Homo sapiens
actgtggaagtccctcagag

SEQ ID NO: 5168158 - DNA, 12 bp, Homo sapiens
actgtggaatat

SEQ ID NO: 5168159 - DNA, 15 bp, Homo sapiens
actgtggaatataaa

SEQ ID NO: 5168160 - DNA, 16 bp, Homo sapiens
actgtggaatataaat

SEQ ID NO: 5168161 - DNA, 21 bp, Homo sapiens
actgtggaatataaatagctg

SEQ ID NO: 5168162 - DNA, 11 bp, Homo sapiens
actgtggagac

SEQ ID NO: 5168163 - DNA, 18 bp, Homo sapiens
actgtggagatgctgtgg

SEQ ID NO: 5168164 - DNA, 12 bp, Homo sapiens
actgtggaggaa

SEQ ID NO: 5168165 - DNA, 18 bp, Homo sapiens
actgtggaggaaggattg

SEQ ID NO: 5168166 - DNA, 23 bp, Homo sapiens
actgtggaggaaggattgtaaaa

SEQ ID NO: 5168167 - DNA, 21 bp, Homo sapiens
actgtggaggggagctgctgg

SEQ ID NO: 5168168 - DNA, 15 bp, Homo sapiens
actgtggaggtggct

SEQ ID NO: 5168169 - DNA, 15 bp, Homo sapiens
actgtggatattgtt

SEQ ID NO: 5168170 - DNA, 15 bp, Homo sapiens
actgtggcacacgcc

SEQ ID NO: 5168171 - DNA, 13 bp, Homo sapiens
actgtggccacct

SEQ ID NO: 5168172 - DNA, 22 bp, Homo sapiens
actgtggccagagctggaaggc

SEQ ID NO: 5168173 - DNA, 14 bp, Homo sapiens
actgtggccaggcc

SEQ ID NO: 5168174 - DNA, 19 bp, Homo sapiens
actgtggccccctccgtga

SEQ ID NO: 5168175 - DNA, 23 bp, Homo sapiens
actgtggcccttctgtccaccag

SEQ ID NO: 5168176 - DNA, 23 bp, Homo sapiens
actgtggccgttatctggaagta

SEQ ID NO: 5168177 - DNA, 13 bp, Homo sapiens
actgtggcctcag

SEQ ID NO: 5168178 - DNA, 22 bp, Homo sapiens
actgtggccttggtctaacttt

SEQ ID NO: 5168179 - DNA, 17 bp, Homo sapiens
actgtggcgttctgctg

SEQ ID NO: 5168180 - DNA, 22 bp, Homo sapiens
actgtggctcttgccttatctg

SEQ ID NO: 5168181 - DNA, 14 bp, Homo sapiens
actgtgggcaattt

SEQ ID NO: 5168182 - DNA, 15 bp, Homo sapiens
actgtggggaaacaa

SEQ ID NO: 5168183 - DNA, 12 bp, Homo sapiens
actgtggggaga

SEQ ID NO: 5168184 - DNA, 18 bp, Homo sapiens
actgtggggagggtcatg

SEQ ID NO: 5168185 - DNA, 17 bp, Homo sapiens
actgtggggcaagcctg

SEQ ID NO: 5168186 - DNA, 22 bp, Homo sapiens
actgtgggggcccctcaggtca

SEQ ID NO: 5168187 - DNA, 16 bp, Homo sapiens
actgtggggtggacct

SEQ ID NO: 5168188 - DNA, 17 bp, Homo sapiens
actgtggggtttttaat

SEQ ID NO: 5168189 - DNA, 13 bp, Homo sapiens
actgtgggtagac

SEQ ID NO: 5168190 - DNA, 18 bp, Homo sapiens
actgtgggtccctgcgtc

SEQ ID NO: 5168191 - DNA, 15 bp, Homo sapiens
actgtgggtggggag

SEQ ID NO: 5168192 - DNA, 20 bp, Homo sapiens
actgtgggtggggaggccct

SEQ ID NO: 5168193 - DNA, 15 bp, Homo sapiens
actgtgggtgtgtga

SEQ ID NO: 5168194 - DNA, 17 bp, Homo sapiens
agaaatattggttgaaa

SEQ ID NO: 5168195 - DNA, 20 bp, Homo sapiens
agaaatatttgtgacaaaaa

SEQ ID NO: 5168196 - DNA, 19 bp, Homo sapiens
agaaatattttaaaatcag

SEQ ID NO: 5168197 - DNA, 23 bp, Homo sapiens
agaaatatttttaaagccacaat

SEQ ID NO: 5168198 - DNA, 14 bp, Homo sapiens
agaaatcaaaagaa

SEQ ID NO: 5168199 - DNA, 15 bp, Homo sapiens
agaaatcaacttgtg

SEQ ID NO: 5168200 - DNA, 17 bp, Homo sapiens
agaaatcaagcataaat

SEQ ID NO: 5168201 - DNA, 17 bp, Homo sapiens
agaaatcacagaatcat

SEQ ID NO: 5168202 - DNA, 13 bp, Homo sapiens
agaaatcactgtg

SEQ ID NO: 5168203 - DNA, 15 bp, Homo sapiens
agaaatcactgtgaa

SEQ ID NO: 5168204 - DNA, 16 bp, Homo sapiens
agaaatcactgtgaaa

SEQ ID NO: 5168205 - DNA, 14 bp, Homo sapiens
agaaatcaggcctg

SEQ ID NO: 5168206 - DNA, 18 bp, Homo sapiens
agaaatcaggtgttttaa

SEQ ID NO: 5168207 - DNA, 23 bp, Homo sapiens
agaaatcaggtgttttaagactg

SEQ ID NO: 5168208 - DNA, 14 bp, Homo sapiens
agaaatcatagctg

SEQ ID NO: 5168209 - DNA, 18 bp, Homo sapiens
agaaatcatgcctagtta

SEQ ID NO: 5168210 - DNA, 18 bp, Homo sapiens
agaaatcatgttatgata

SEQ ID NO: 5168211 - DNA, 19 bp, Homo sapiens
agaaatccccccttcagaa

SEQ ID NO: 5168212 - DNA, 19 bp, Homo sapiens
agaaatcccctaactgatt

SEQ ID NO: 5168213 - DNA, 21 bp, Homo sapiens
agaaatcctaacattatattc

SEQ ID NO: 5168214 - DNA, 19 bp, Homo sapiens
agaaatcctggtttgtaat

SEQ ID NO: 5168215 - DNA, 12 bp, Homo sapiens
agaaatctaaaa

SEQ ID NO: 5168216 - DNA, 15 bp, Homo sapiens
agaaatctaaaaaac

SEQ ID NO: 5168217 - DNA, 22 bp, Homo sapiens
agaaatctatagaactgaatga

SEQ ID NO: 5168218 - DNA, 13 bp, Homo sapiens
agaaatctatctt

SEQ ID NO: 5168219 - DNA, 13 bp, Homo sapiens
agaaatctatttc

SEQ ID NO: 5168220 - DNA, 20 bp, Homo sapiens
agaaatctcctaacaaaaga

SEQ ID NO: 5168221 - DNA, 13 bp, Homo sapiens
agaaatctgaaaa

SEQ ID NO: 5168222 - DNA, 23 bp, Homo sapiens
agaaatctggctgtccttccatt

SEQ ID NO: 5168223 - DNA, 13 bp, Homo sapiens
agaaatctgtcct

SEQ ID NO: 5168224 - DNA, 16 bp, Homo sapiens
agaaatctgtcctgtg

SEQ ID NO: 5168225 - DNA, 17 bp, Homo sapiens
agaaatctgtttcaaca

SEQ ID NO: 5168226 - DNA, 17 bp, Homo sapiens
agaaatcttaagtcata

SEQ ID NO: 5168227 - DNA, 18 bp, Homo sapiens
agaaatcttaagtcataa

SEQ ID NO: 5168228 - DNA, 22 bp, Homo sapiens
agaaatcttaagtcataatgaa

SEQ ID NO: 5168229 - DNA, 22 bp, Homo sapiens
agaaatcttgcttcagaccatc

SEQ ID NO: 5168230 - DNA, 21 bp, Homo sapiens
agaaatgaaaaaaaaaaacaa

SEQ ID NO: 5168231 - DNA, 16 bp, Homo sapiens
agaaatgaaaaaatat

SEQ ID NO: 5168232 - DNA, 18 bp, Homo sapiens
agaaatgaaaaaatatat

SEQ ID NO: 5168233 - DNA, 12 bp, Homo sapiens
agaaatgaaaag

SEQ ID NO: 5168234 - DNA, 14 bp, Homo sapiens
agaaatgaaagcag

SEQ ID NO: 5168235 - DNA, 23 bp, Homo sapiens
agaaatgaaattttaccaagtta

SEQ ID NO: 5168236 - DNA, 13 bp, Homo sapiens
agaaatgaacatt

SEQ ID NO: 5168237 - DNA, 15 bp, Homo sapiens
agaaatgaacattcc

SEQ ID NO: 5168238 - DNA, 18 bp, Homo sapiens
agaaatgaactttcagca

SEQ ID NO: 5168239 - DNA, 15 bp, Homo sapiens
agaaatgaagcagag

SEQ ID NO: 5168240 - DNA, 19 bp, Homo sapiens
agaaatgaagcagaggaag

SEQ ID NO: 5168241 - DNA, 21 bp, Homo sapiens
agaaatgaagcagaggaagga

SEQ ID NO: 5168242 - DNA, 12 bp, Homo sapiens
agaaatgaataa

SEQ ID NO: 5168243 - DNA, 19 bp, Homo sapiens
agaaatgaataatttccca

SEQ ID NO: 5168244 - DNA, 20 bp, Homo sapiens
agaaatgagatcaggctctg

SEQ ID NO: 5168245 - DNA, 23 bp, Homo sapiens
agaaatgaggtagctgacacaga

SEQ ID NO: 5168246 - DNA, 15 bp, Homo sapiens
agaaatgatggaagt

SEQ ID NO: 5168247 - DNA, 16 bp, Homo sapiens
agaaatgatgtgaaag

SEQ ID NO: 5168248 - DNA, 19 bp, Homo sapiens
agaaatgatttcaaaatga

SEQ ID NO: 5168249 - DNA, 16 bp, Homo sapiens
agaaatgcaaaaatct

SEQ ID NO: 5168250 - DNA, 16 bp, Homo sapiens
agaaatgcaataactc

SEQ ID NO: 5168251 - DNA, 19 bp, Homo sapiens
agaaatgcacaatgtcttg

SEQ ID NO: 5168252 - DNA, 18 bp, Homo sapiens
agaaatgcatattgtatt

SEQ ID NO: 5168253 - DNA, 18 bp, Homo sapiens
agaaatgcatccattcct

SEQ ID NO: 5168254 - DNA, 11 bp, Homo sapiens
agaaatgccaa

SEQ ID NO: 5168255 - DNA, 14 bp, Homo sapiens
agaaatgccaagca

SEQ ID NO: 5168256 - DNA, 18 bp, Homo sapiens
agaaatgccagtggtgga

SEQ ID NO: 5168257 - DNA, 17 bp, Homo sapiens
agaaatgccccagtgtt

SEQ ID NO: 5168258 - DNA, 14 bp, Homo sapiens
agaaatgccgctgt

SEQ ID NO: 5168259 - DNA, 18 bp, Homo sapiens
agaaatgcggtctggtct

SEQ ID NO: 5168260 - DNA, 12 bp, Homo sapiens
agaaatgctttg

SEQ ID NO: 5168261 - DNA, 16 bp, Homo sapiens
agaaatggaaattttg

SEQ ID NO: 5168262 - DNA, 15 bp, Homo sapiens
agaaatggacaaaga

SEQ ID NO: 5168263 - DNA, 22 bp, Homo sapiens
agaaatggcgtctgctctggtg

SEQ ID NO: 5168264 - DNA, 22 bp, Homo sapiens
agaaatggctaataaactttgt

SEQ ID NO: 5168265 - DNA, 17 bp, Homo sapiens
agaaatggctatgaaca

SEQ ID NO: 5168266 - DNA, 19 bp, Homo sapiens
agaaatggctatgaacaga

SEQ ID NO: 5168267 - DNA, 16 bp, Homo sapiens
agaaatggctttccac

SEQ ID NO: 5168268 - DNA, 17 bp, Homo sapiens
agaaatggcttttctta

SEQ ID NO: 5168269 - DNA, 22 bp, Homo sapiens
agaaatgggaatcatggcctct

SEQ ID NO: 5168270 - DNA, 15 bp, Homo sapiens
agaaatgggactctg

SEQ ID NO: 5168271 - DNA, 20 bp, Homo sapiens
agaaatgggacttaactcct

SEQ ID NO: 5168272 - DNA, 19 bp, Homo sapiens
agaaatgggcctcagcccc

SEQ ID NO: 5168273 - DNA, 19 bp, Homo sapiens
agaaatgggcctgcctgcc

SEQ ID NO: 5168274 - DNA, 21 bp, Homo sapiens
agaaatgggcctgcctgcctc

SEQ ID NO: 5168275 - DNA, 22 bp, Homo sapiens
agaaatgggcctgcctgcctcc

SEQ ID NO: 5168276 - DNA, 21 bp, Homo sapiens
agaaatggggaattctctaat

SEQ ID NO: 5168277 - DNA, 20 bp, Homo sapiens
agaaatgggggtggcaagtg

SEQ ID NO: 5168278 - DNA, 19 bp, Homo sapiens
agaaatggttgtattagat

SEQ ID NO: 5168279 - DNA, 20 bp, Homo sapiens
agaaatggttgtattagatg

SEQ ID NO: 5168280 - DNA, 23 bp, Homo sapiens
agaaatggttgtattagatgttc

SEQ ID NO: 5168281 - DNA, 13 bp, Homo sapiens
agaaatgtaaatg

SEQ ID NO: 5168282 - DNA, 12 bp, Homo sapiens
agaaatgtaatg

SEQ ID NO: 5168283 - DNA, 13 bp, Homo sapiens
agaaatgtaatgc

SEQ ID NO: 5168284 - DNA, 21 bp, Homo sapiens
agaaatgtaatgcgattttat

SEQ ID NO: 5168285 - DNA, 10 bp, Homo sapiens
agaaatgtag

SEQ ID NO: 5168286 - DNA, 12 bp, Homo sapiens
agaaatgtattc

SEQ ID NO: 5168287 - DNA, 19 bp, Homo sapiens
agaaatgtattcctgaaaa

SEQ ID NO: 5168288 - DNA, 21 bp, Homo sapiens
agaaatgtattcctgaaaagc

SEQ ID NO: 5168289 - DNA, 14 bp, Homo sapiens
agaaatgtattttg

SEQ ID NO: 5168290 - DNA, 23 bp, Homo sapiens
agaaatgtattttgaaaacactt

SEQ ID NO: 5168291 - DNA, 18 bp, Homo sapiens
agaaatgtcatgattgcc

SEQ ID NO: 5168292 - DNA, 20 bp, Homo sapiens
agaaatgtctaaatgctgaa

SEQ ID NO: 5168293 - DNA, 20 bp, Homo sapiens
agaaatgtgtcaatgtaaag

SEQ ID NO: 5168294 - DNA, 18 bp, Homo sapiens
agaaatgttggcatttag

SEQ ID NO: 5168295 - DNA, 15 bp, Homo sapiens
agaaatgtttttaac

SEQ ID NO: 5168296 - DNA, 17 bp, Homo sapiens
agaaatgtttttggcaa

SEQ ID NO: 5168297 - DNA, 22 bp, Homo sapiens
agaaattaaaatattatttgat

SEQ ID NO: 5168298 - DNA, 15 bp, Homo sapiens
agaaattaaatctgt

SEQ ID NO: 5168299 - DNA, 13 bp, Homo sapiens
agaaattaactta

SEQ ID NO: 5168300 - DNA, 13 bp, Homo sapiens
agaaattaagtat

SEQ ID NO: 5168301 - DNA, 17 bp, Homo sapiens
agaaattaagtatctga

SEQ ID NO: 5168302 - DNA, 12 bp, Homo sapiens
agaaattacaag

SEQ ID NO: 5168303 - DNA, 15 bp, Homo sapiens
agaaattacaagttt

SEQ ID NO: 5168304 - DNA, 19 bp, Homo sapiens
agaaattacaagtttcagt

SEQ ID NO: 5168305 - DNA, 21 bp, Homo sapiens
agaaattacaagtttcagtaa

SEQ ID NO: 5168306 - DNA, 19 bp, Homo sapiens
agaaattacctgtggatat

SEQ ID NO: 5168307 - DNA, 15 bp, Homo sapiens
agaaattacttctag

SEQ ID NO: 5168308 - DNA, 12 bp, Homo sapiens
agaaattagaaa

SEQ ID NO: 5168309 - DNA, 21 bp, Homo sapiens
agaaattagaaaaaaattact

SEQ ID NO: 5168310 - DNA, 15 bp, Homo sapiens
agaaattagccgggc

SEQ ID NO: 5168311 - DNA, 22 bp, Homo sapiens
agaaattagggctctaatttcc

SEQ ID NO: 5168312 - DNA, 13 bp, Homo sapiens
agaaattattggt

SEQ ID NO: 5168313 - DNA, 14 bp, Homo sapiens
agaaattatttaat

SEQ ID NO: 5168314 - DNA, 16 bp, Homo sapiens
agaaattatttaatat

SEQ ID NO: 5168315 - DNA, 22 bp, Homo sapiens
agaaattatttaatatgcatct

SEQ ID NO: 5168316 - DNA, 14 bp, Homo sapiens
agaaattcaggtac

SEQ ID NO: 5168317 - DNA, 14 bp, Homo sapiens
agaaattccctgga

SEQ ID NO: 5168318 - DNA, 13 bp, Homo sapiens
agaaattcctgta

SEQ ID NO: 5168319 - DNA, 16 bp, Homo sapiens
agaaattcctgtagca

SEQ ID NO: 5168320 - DNA, 19 bp, Homo sapiens
agaaattcctgtagcatct

SEQ ID NO: 5168321 - DNA, 16 bp, Homo sapiens
agaaattccttcccac

SEQ ID NO: 5168322 - DNA, 17 bp, Homo sapiens
agaaattccttcccact

SEQ ID NO: 5168323 - DNA, 19 bp, Homo sapiens
agaaattcgaaaacataaa

SEQ ID NO: 5168324 - DNA, 18 bp, Homo sapiens
agaaattcgtgtgttttt

SEQ ID NO: 5168325 - DNA, 13 bp, Homo sapiens
agaaattctcttt

SEQ ID NO: 5168326 - DNA, 15 bp, Homo sapiens
agaaattctgaattt

SEQ ID NO: 5168327 - DNA, 21 bp, Homo sapiens
agaaattctgcaagtttctgt

SEQ ID NO: 5168328 - DNA, 22 bp, Homo sapiens
agaaattctgcaagtttctgtt

SEQ ID NO: 5168329 - DNA, 17 bp, Homo sapiens
agaaattctggcccagc

SEQ ID NO: 5168330 - DNA, 23 bp, Homo sapiens
agaaattctgtcatagaaagtgc

SEQ ID NO: 5168331 - DNA, 15 bp, Homo sapiens
agaaattctgttaaa

SEQ ID NO: 5168332 - DNA, 18 bp, Homo sapiens
agaaattctgttaaaatc

SEQ ID NO: 5168333 - DNA, 22 bp, Homo sapiens
agaaattctgttaaaatctatt

SEQ ID NO: 5168334 - DNA, 18 bp, Homo sapiens
agaaattctgttaatgtt

SEQ ID NO: 5168335 - DNA, 15 bp, Homo sapiens
agaaattcttcaatt

SEQ ID NO: 5168336 - DNA, 15 bp, Homo sapiens
agaaattcttttcaa

SEQ ID NO: 5168337 - DNA, 13 bp, Homo sapiens
agaaattgaaagc

SEQ ID NO: 5168338 - DNA, 18 bp, Homo sapiens
agaaattgaatactttga

SEQ ID NO: 5168339 - DNA, 18 bp, Homo sapiens
agaaattgaatgtacctt

SEQ ID NO: 5168340 - DNA, 17 bp, Homo sapiens
agaaattgcatttcctg

SEQ ID NO: 5168341 - DNA, 14 bp, Homo sapiens
agaaattgcctcct

SEQ ID NO: 5168342 - DNA, 15 bp, Homo sapiens
agaaattgcctcctt

SEQ ID NO: 5168343 - DNA, 16 bp, Homo sapiens
agaaattgcctcctta

SEQ ID NO: 5168344 - DNA, 15 bp, Homo sapiens
agaaattggctggat

SEQ ID NO: 5168345 - DNA, 20 bp, Homo sapiens
agaaattggtaccttgcaca

SEQ ID NO: 5168346 - DNA, 21 bp, Homo sapiens
agaaattggtaccttgcacac

SEQ ID NO: 5168347 - DNA, 22 bp, Homo sapiens
agaaattggtaccttgcacaca

SEQ ID NO: 5168348 - DNA, 14 bp, Homo sapiens
agaaattgtatatt

SEQ ID NO: 5168349 - DNA, 21 bp, Homo sapiens
agaaattgtatattgtaattt

SEQ ID NO: 5168350 - DNA, 18 bp, Homo sapiens
agaaattgtccttgaagc

SEQ ID NO: 5168351 - DNA, 14 bp, Homo sapiens
agaaattgtgccaa

SEQ ID NO: 5168352 - DNA, 17 bp, Homo sapiens
agaaattgtgccaaaga

SEQ ID NO: 5168353 - DNA, 20 bp, Homo sapiens
agaaattgtgccaaagatag

SEQ ID NO: 5168354 - DNA, 16 bp, Homo sapiens
agaaattgtgtgtgca

SEQ ID NO: 5168355 - DNA, 16 bp, Homo sapiens
agaaattgttcctgat

SEQ ID NO: 5168356 - DNA, 18 bp, Homo sapiens
agaaattgttcctgatgt

SEQ ID NO: 5168357 - DNA, 13 bp, Homo sapiens
agaaatttaaact

SEQ ID NO: 5168358 - DNA, 11 bp, Homo sapiens
agaaatttaac

SEQ ID NO: 5168359 - DNA, 12 bp, Homo sapiens
agaaatttacaa

SEQ ID NO: 5168360 - DNA, 13 bp, Homo sapiens
agaaatttactat

SEQ ID NO: 5168361 - DNA, 16 bp, Homo sapiens
agaaatttagagctaa

SEQ ID NO: 5168362 - DNA, 18 bp, Homo sapiens
agaaatttatatgtcaga

SEQ ID NO: 5168363 - DNA, 19 bp, Homo sapiens
agaaatttcaacagttatt

SEQ ID NO: 5168364 - DNA, 14 bp, Homo sapiens
agaaatttcacata

SEQ ID NO: 5168365 - DNA, 16 bp, Homo sapiens
agaaatttccagagaa
